(12) United States Patent
Sette et al.

(10) Patent No.: US 7,026,443 B1
(45) Date of Patent: Apr. 11, 2006

(54) INDUCING CELLULAR IMMUNE RESPONSES TO HUMAN PAPILLOMAVIRUS USING PEPTIDE AND NUCLEIC ACID COMPOSITIONS

(75) Inventors: Alessandro Sette, La Jolla, CA (US); John Sidney, San Diego, CA (US); Scott Southwood, Santee, CA (US); Robert Chesnut, Cardiff-by-the-Sea, CA (US); Esteban Celis, Rochester, MN (US); Howard M. Grey, La Jolla, CA (US)

(73) Assignee: Epimmune Inc., San Diego, CA (US)

( * ) Notice: Subject to any disclaimer, the term of this patent is extended or adjusted under 35 U.S.C. 154(b) by 588 days.

(21) Appl. No.: 09/641,528

(22) Filed: Aug. 15, 2000

Related U.S. Application Data

(60) Provisional application No. 60/172,705, filed on Dec. 10, 1999.

(51) Int. Cl.
*C07K 7/00* (2006.01)

(52) U.S. Cl. .................. 530/300; 424/184.1; 424/192.1; 424/193.1; 424/194.1; 424/204.1

(58) Field of Classification Search .............. 424/184.1, 424/192.1, 193.1, 194.1, 204.1; 530/300
See application file for complete search history.

(56) References Cited

U.S. PATENT DOCUMENTS

| | | | |
|---|---|---|---|
| 5,180,806 A | 1/1993 | Dillner et al. | |
| 5,200,320 A | 4/1993 | Sette et al. | |
| 5,503,829 A | 4/1996 | Ladant et al. | |
| 5,618,536 A | 4/1997 | Lowy et al. | |
| 5,662,907 A | 9/1997 | Kubo et al. | |
| 5,716,620 A | 2/1998 | Lowy et al. | |
| 5,753,233 A | 5/1998 | Bleul et al. | |
| 5,853,755 A | 12/1998 | Foldvari et al. | |
| 5,855,891 A | 1/1999 | Lowy et al. | |
| 5,871,998 A | 2/1999 | Lowy et al. | |
| 5,985,610 A | 11/1999 | Lowy et al. | |
| 6,034,214 A | 3/2000 | Boon et al. | |
| 6,037,135 A * | 3/2000 | Kubo et al. ................. | 435/7.24 |
| 2002/0098197 A1 | 7/2002 | Sette et al. | |
| 2002/0168374 A1 | 11/2002 | Kubo et al. | |
| 2002/0177694 A1 | 11/2002 | Sette et al. | |

FOREIGN PATENT DOCUMENTS

| | | |
|---|---|---|
| EP | 0 044 710 A1 | 1/1982 |
| EP | 0 226 513 A1 | 6/1987 |
| WO | WO 91/18294 | 11/1991 |
| WO | WO 92/02543 A1 | 2/1992 |
| WO | WO 92/12996 A2 | 8/1992 |
| WO | WO 92/21033 A1 | 11/1992 |
| WO | WO 93/03764 A1 | 3/1993 |
| WO | WO 93/22338 A1 | 11/1993 |
| WO | WO 94/03205 A1 | 2/1994 |
| WO | WO 94/11738 A1 | 5/1994 |
| WO | WO 94/20127 A1 | 9/1994 |
| WO | WO 95/31476 A1 | 11/1995 |
| WO | WO 96/03140 A1 | 2/1996 |
| WO | WO 96/19496 A1 | 6/1996 |
| WO | WO 99/45954 | 9/1999 |

OTHER PUBLICATIONS

NCBI Accession No.–X74479.*
Azoury–Ziadeh et al., Viral Immunology 1999 vol. 12 pp. 297–312.*
Murakami et al., Cancer Research , Mar. 15, 1999 pp. 1184–1187.*
Castellanos, M.R., et al., "Synthetic Peptides Induce a Cytotoxic Response against Human Paillomavirus Type–18," *Gynecol. Oncol.* 82:77–83, Academic Press (Jul. 2001).
Castellanos, M.R., et al., A rapid method to identify cytotoxic T–lymphocyte peptide epitopes from HLA–A2 (+) donors, *Crit. Rev. Oncol. Hematol.* 39:133–138, Elsevier Science Ireland, Ltd. (Jul./Aug. 2001).
"HPV and Animal PV Nucleic Acid Sequences," *Human Papillomaviruses 1997 Compendium, Part I. HPV and Animal PV Nucleotide Sequences in GenBank style*, pp. I–1–I17, The Human Papillomavirus Database (Sep. 1997).
Kast, W.M., et al., "Role of HLA–A Motifs in Identification of Potential CTL Epitopes in Human Papillomavirus Type 16 E6 and E7 Proteins," *J. Immunol.* 152:3904–3912, The American Association of Immunologists (Apr. 1994).
Ressing, M.E., et al., "Human CTL Epitopes Encoded by Human Papillomavirus Type 15 E6 and E7 Identified Through In Vivo and In Vitro Immunogenecity Studies of HLA–A*0201–Binding Peptides," *J. Immunol.* 154:5934–5942, The American Association of Immunologists (Jun. 1995).
Rowen, D., and Lacey, C., "Toward a human papillomavirus vaccine," *Dermatologic Clinics 16*:835–838, W.B. Saunders (Oct. 1998).
Yoon, H., et al., "Synthetic peptides of human papillomavirus type 185 E6 harboring HLA–A2.1 motif can induce peptide–specific cytotoxic T–cells from peripheral blood mononuclear cells of healthy donors," *Virus Res.* 54:23–29, Elsevier Science B.V. (Mar. 1998).
Copy of co–pending U.S. Appl. No. 08/205,713, filed Mar. 4, 1974, inventor Gray (Not Published).
Copy of co–pending U.S. Appl. No. 08/344,824, filed Nov. 23, 1994, inventors Sette et al., (Not Published).

(Continued)

*Primary Examiner*—James Housel
*Assistant Examiner*—Myron G. Hill
(74) *Attorney, Agent, or Firm*—Sterne, Kessler, Goldstein & Fox P.L.L.C.

(57) ABSTRACT

This invention uses our knowledge of the mechanisms by which antigen is recognized by T cells to identify and prepare human papillomavirus (HPV) epitopes, and to develop epitope-based vaccines directed towards HPV. More specifically, this application communicates our discovery of pharmaceutical compositions and methods of use in the prevention and treatment of HPV infection.

10 Claims, No Drawings

OTHER PUBLICATIONS

Copy of co–pending U.S. Appl. No. 08/347,610, filed Dec. 1, 1994, inventors Kubo et al., (Not Published).

Copy of co–pending U.S. Appl. No. 09/017,524, filed Feb. 3, 1998, inventors Kubo et al., (Not Published).

Copy of co–pending U.S. Appl. No. 10/149,136, filed Jun. 10, 2002, inventors Sette et al., (Published).

Aichele, P., et al., "Antiviral cytotoxic T cell response induced by in vivo priming with a free synthetic peptide," *J. Exp. Med.* 171:1815–1820, Rockefeller University Press (1990).

Alexander, J., et al., "Derivation of HLA–A11/$K^b$ Transgenic Mice. Functional CTL Repertoire and Recognition of Human A11–Restricted CTL Epitopes," *J. Immunol.* 159:4753–4761, The American Association of Immunologists (Nov. 1997).

Bergmann, C.C., et al., "Differential Effects of Flanking Residues on Presentation of Epitopes from Chimeric Peptides," *J. Virol.* 68:5306–5310, American Society for Microbiology (Aug. 1994).

Bertoni, R., et al., "Human Histocompatibility Leukocyte Antigen–binding Supermotifs Predict Broadly Cross–reactive Cytotoxic T Lymphocyte Responses in Patients with Acute Hepatitis," *J. Clin. Invest.* 100:503–513, The American Society for Clinical Investigation, Inc. (Aug. 1997).

Bertoni, R., et al., "Human Class I Supertypes and CTL Repertoires Extend to Chimpanzees," *J. Immunol.* 161:4447–4455, American Association of Immunologists (Oct. 1998).

Bjorkman, P.J., et al., "Structure of the human class I histocompatibility antigen, HLA–A2," *Nature* 329:506–512, Macmillan Publishers, Ltd. (1987).

Bjorkman, P.J., et al., "The foreign antigen binding site and T cell recognition regions of class I histocompatibility antigens," *Nature* 329:512–518, Macmillan Publishers, Ltd. (1987).

Buus, S., et al., "Autologous Peptides Constitutively Occupy the Antigen Binding Site on Ia," *Science* 242:1045–1047, American Association for the Advancement of Science (1988).

Carreno, B.M., et al., "HLA–B37 and HLA–A2.1 molecules bind largely nonoverlapping sets of peptides," *Proc. Natl. Acad. Sci. USA* 87:3420–3424, National Academy Press (1990).

Corr, M., et al., "Endogenous Peptides of a Soluble Major Histocompatibility Complex Class I Molecule, H–2$L^{ds}$: Sequence Motif, Quantitative Binding, and Molecular Modeling of the Complex," *J. Exp. Med.* 176:1681–1692, Rockefeller University Press (Dec. 1992).

De Bruijn, M.L.H., et al., "Peptide loading of empty major histocompatibility complex molecules on RMA–S cells allows the induction of primary cytotoxic T lymphocyte responses," *Eur. J. Immunol.* 21:2963–2970, VCH Verlagsgesellschaft mbH (1991).

Del Val, M., et al., "Efficient Processing of an Antigenic Sequence for Presentation by MHC Class I Molecules Depends on Its Neighboring Residues in the Protein," *Cell* 66:1145–1153, Cell Press (1991).

Deres, K., et al., "In vivo priming of virus–specific cytotoxic T lymphocytes with synthetic lipopetide vaccine," *Nature* 342:561–564, Macmillan Publishers, Ltd. (1989).

Dibrino, M., et al., "HLA–A1 and HLA–A3 T Cell Epitopes Derived from Influenza Virus Proteins Predicted from Peptide Binding Motifs," *J. Immunol.* 151:5930–5935, The Association of Immunologists (Dec. 1993).

DiBrino, M., et al., "Endogenous peptides bound to HLA–A3 possess a specific combination of anchor residues that permit identification of potential antigenic peptides," *Proc. Natl. Acad. Sci. USA* 90:1508–1512, National Academy Press (Feb. 1993).

Ding, Y.–H., et al., "Two Human T Cell Receptors Bind in a Similar Diagonal Mode to the HLA–A2/Tax Peptide Complex Using Different TCR Amino Acids," *Immunity* 8:403–11, Cell Press (Apr. 1998).

Eisenlohr, L.C., et al., "Flanking Sequences Influence the Presentation of an Endogenously Synthesized Peptide to Cytotoxic T Lymphocytes," *J. Exp. Med.* 175:481–487, The Rockefeller University Press (Feb. 1992).

Engelhard, V.H., "Structure of peptides associated with MHC Class I molecules," *Curr. Opin. Immunol.* 6:13–23, Current Biology, Ltd. (Feb. 1994).

Falk, K., et al., "Allele–specific motifs revealed by sequencing of self–peptides eluted from MHC molecules," *Nature* 351:290–296, Macmillan Publishers, Ltd. (1991).

Falk, K., et al., "MHC peptide motif register. Peptide motifs of HLA–B35 and –B37 molecules," *Immunogenetics* 38:161–162, Springer–Verlag (Apr. 1993).

Falk, K., et al., "Allele–specific peptide ligand motifs of HLA–C molecules," *Proc. Natl. Acad. Sci. USA* 90:12005–12009, National Academy Press (Dec. 1993).

Falk, K., et al., "Pool sequencing of natural HLA–DR, DQ, and DP ligands reveals detailed peptide motifs, constraints of processing, and general rules," *Immunogenetics* 39:230–242, Springer–Verlag (Feb. 1994).

Falk, K., et al., "Peptide motifs of HLA–A1, –A11, –A31, and –A33 molecules," *Immunogenetics* 40:238–241, Springer–Verlag (Jul. 1994).

Foon, K.A., "Biological Response Modifiers: The New Immunotherapy," *Cancer Res.* 49:1621–1639, American Association for Cancer Research (1989).

Geysen, H.M., et al., "Cognitive Features of Continuous Antigenic Determinants," *J. Mol. Recognit.* 1:32–41, Heyden & sons, Ltd. (1988).

Guo, H.–C., et al., "Different length peptides bind to HLA–Aw68 similarly at their ends but bulge out in the middle," *Nature* 360:364–366, Macmillan Publishers, Ltd. (Nov. 1992).

Henderson, R.A., et al., "HLA–A2.1–Associated Peptides from a Mutant Cell Line: A Second Pathway of Antigen Presentation," *Science* 255:1264–1266, American Association for the Advancement of Science (Mar. 1992).

Hill, A., et al., "Characterization of two Epstein–Barr virus epitopes restricted by HLA–B7," *Eur. J. Immunol.* 25:18–24, VCH Verlagsgesellschaft mbH (Jan. 1995).

Hunt, D.F., et al., "Characterization of Peptides Bound to the Class I MHC Molecule HLA–A2.1 by Mass Spectrometry," *Science* 255:1261–1263, American Association for the Advancement of Science (Mar. 1992).

Ishioka, G.Y., et al., "Utilization of MHC Class I Transgenic Mice for Development of Minigene DNA Vaccines Encoding Multiple HLA–Restricted CTL Epitopes," *J. Immunol.* 162:3915–3925, The American Association of Immunologists (Apr. 1999).

Jameson, S.C., and Bevan, M.J., "Dissection of major histocompatibility complex (MHC) and T cell receptor contact residues in a $K^b$–restricted ovalbumin peptide and an assessment of the predictive power of MHC–binding motifs," *Eur. J. Immunol.* 22:2663–2667, VCH Verlagsgesellschaft mbH (Oct. 1992).

Jardetzky, T.S., et al., "Identification of self peptides bound to purified HLA–B27," *Nature* 353:326–329, Macmillan Publishers, Ltd. (1991).

Kannagi, M., et al., "Target Epitope in the Tax Protein of Human T–Cell Leukemia Virus Type I Recognized by Class I Major Histocompatibility Complex–Restricted Cells," *J. Virol.* 66:2928–2933, American Society for Microbiology (May 1992).

Kast, W.M., et al., "Protection against lethal Sendai virus infection by in vivo priming of virus–specific cytotoxic T lymphocytes with a free synthetic peptide," *Proc. Natl. Acad. Sci. USA* 88:2283–2287, National Academy Press (1991).

Kast, W.M., et al., "Strict peptide length is not required for the induction of cytotoxic T lymphocyte–mediated antiviral protection by peptide vaccination," *Eur. J. Immunol.* 23:1189–1192, VCH Verlagsgesellschaft mbH (May 1993).

Krieger, J.I., et al., "Single amino acid changes in DR and antigen define residues critical for peptide–MHC binding and T cell recognition," *J. Immunol.* 146:2331–2340, American Association of Immunologists (1991).

Lipford, G.B., et al., "Primary in Vivo Responses to Ovalbumin. Probind the Predictive Value of the $K^b$ Binding Motif," *J. Immunol.* 150:1212–1222, The American Association of Immunologists (Feb. 1993).

Maryanski, J.L., et al., "Synthetic peptides as antigens and competitors in recognition by H–2–restricted cytolytic T cells specific for HLA," *J. Exp. Med.* 167:1391–1405, Rockefeller University Press (1988).

Maryanski, J.L., et al., "Competitor Analogs for Defined T Cell Antigens: Peptides Incorporating a Putative Binding Motif and Polyproline or Polyglycine Spacers," *Cell* 60:63–72, Cell Press (1990).

Morrison, J., et al., "Identification of the nonamer peptide from influenza A matrix protein and the role of pockets of HLA–A2 in its recognition by cytotoxic T lymphocytes," *Eur. J. Immunol.* 22:903–907, VCH Verlagsgesellschaft mbH (Apr. 1992).

Niedermann, G., et al., "The proteolytic fragments generated by vertebrate proteosomes: Structural relationships to major histocompatibility complex class I binding peptides," *Proc. Natl. Acad. Sci. USA* 93:8572–8577, National Academy Press (Aug. 1996).

Ochoa–Garay, J., et al., "The ability of peptides to induce cytotoxic T cells in vitro does not strongly correlate with their affinity for the $H–2L^d$ molecule: implications for vaccine design and immunotherapy," *Mol. Immunol.* 34:273–281, Elsevier Science, Ltd. (Feb. 1997).

Pamer, E.G., et al., "Precise prediction of a dominant class I MHC–restricted epitome of Listeria monocytogenes," *Nature* 353:852–855, Macmillan Publishers, Ltd. (1991).

Parham, P., et al., "The Origins of HLA–A, B, C Polymorphism," *Immunol. Rev.* 143:141–180, Munksgaard (Feb. 1995).

Parker, K.C., et al., "Peptide Binding to HLA–A2 and HLA–B27 Isolated from *Escherichia coli*," *J. Biol. Chem.* 267:5451–5459, American Society for Biochemistry and Molecular Biology, Inc. (Mar. 1992).

Parker, K.C., et al., "Sequence motifs important for peptide binding to the human MHC class I molecule, HLA–A2," *J. Immunol.* 149:3580–3587, American Association of Immunologists (Dec. 1992).

Rammensee, H.–G., et al., "Peptides Naturally Presented by MHC Class I Molecules," *Annu. Rev. Immunol.* 11:213–244, Annual Reviews, Inc. (Jan. 1993).

Rammensee, H.–G., et al., "MHC ligands and peptide motifs: first listing," *Immunogenetics* 41:178–228, Springer–Verlag (Feb. 1995).

Reddehase, M.J., et al., "A pentapeptide as minimal antigenic determinant for MHC class I–restricted T lymphocytes," *Nature* 337:651–653, Macmillan Publishers, Ltd. (1989).

Romero, P., et al., "$H–2k^d$–restricted Antigenic Peptides Share a Simple Binding Motif," *J. Exp. Med.* 174:603–612, Rockefeller University Press (1991).

Rothbard, J.B., "Major histocompatibility complex–peptide interactions," *Curr. Opin. Immunol.* 2:99–105, Current Biology, Ltd. (1989).

Rötzschke, O., et al., "Isolation and analysis of naturally processed viral peptides as recognized by cytotoxic T cells," *Nature* 348:252–254, Macmillan Publishers, Ltd. (1990).

Rötzschke, O., et al., "Characterization of Naturally Occurring Minor Histocompatibility Peptides Including H–4 and H–Y," *Science* 249:283–287, American Association for the Advancement of Science (1990).

Rötzschke, O., and Falk, K., "Naturally–occurring peptide antigens derived from the MHC class–I–restricted processing pathway," *Immunol. Today* 12:447–455, Elsevier Science Publishers, Ltd. (1991).

Rotzschke, O., et al., "Peptide motifs of closely related HLA class I molecules encompass substantial differences," *Eur. J. Immunol.* 22:2453–2456, VCH Verlagsgesellschaft mbH (Sep. 1992).

Rötzschke, O., and Falk, K., "Origin, structure and motifs of naturally processed MHC class II ligands," *Curr. Opin. Immunol.* 6:45–51, Current Biology, Ltd. (Feb. 1994).

Rudinger, J., "Characteristics of the amino acids as components of a peptide hormone sequence," in *Peptide Hormones*, Parsons, J.A., ed., University Park Press, Baltimore, MD, pp. 1–7 (1976).

Ruppert, J., et al., "Prominent Role of Secondary Anchor Residues in Peptide Binding to HLA–A2.1 Molecules," *Cell* 74:929–937, Cell Press (Sep. 1993).

Schulz, M., et al., "Major histocompatibility complex binding and T cell recognition of a viral nonapeptide containing a minimal tetrapeptide," *Eur. J. Immunol.* 21:1181–1185, VCH Verlagsgesellschaft mbH (1991).

Sette, A., et al., "Prediction of major histocompatibility complex binding regions of protein antigens by sequence pattern analysis," *Proc. Natl. Acad. Sci. USA* 86:3296–3300, National Academy Press (1989).

Sette, A., et al., "Random association between the peptide repertoire of A2.1 class I and several different DR class II molecules," *J. Immunol.* 147:3893–3900, The American Association of Immunologists (1991).

Sette, A., et al., "The Relationship Between Class I Binding Affinity and Immunogenicity of Potential Cytotoxic T Cell Epitopes," *J. Immunol.* 153:5586–5592, The American Association of Immunologists (Dec. 1994).

Shastri, N., et al., "Presentation of Endogenous Peptide/MHC Class I Complexes Is Profoundly Influenced by Specific C–Terminal Flanking Residues," *J. Immunol.* 155:4339–4346, The American Association of Immunologists (Nov. 1995).

Sherman, L.A., et al., "Extracellular Processing of Peptide Antigens That Bind Class I Major Histocompatibility Molecules," *J. Exp. Med.* 175:1221–1226, The Rockefeller University Press (May 1992).

Shimojo, N., et al., "Specificity of peptide binding by the HLA–A2.1 molecule," *J. Immunol.* 143:2939–2947, The American Association of Immunologists (1989).

Sidney, J., et al., "Several HLA Alleles Share Overlapping Peptide Specificities," *J. Immunol.* 154:247–259, The American Association of Immunologists (Jan. 1995).

Threlkeld, S.C., et al., "Degenerate and Promiscuous Recognition by CTL of Peptides Presented by the MHC Class I A3–like Superfamily. Implications for Vaccine Development," *J. Immunol.* 159:1648–1657, The American Association of Immunologists (Aug. 1997).

Wentworth, P.A., et al., "Differences and similarities in the A2.1–restricted cytotoxic T cell repertoire in humans and human leukocyte antigen–transgenic mice," *Eur. J. Immunol.* 26:97–101, VCH Verlagsgesellschaft mbH (Jan. 1996).

Whitton, J.L., et al., "Molecular Analyses of a Five–Amino–Acid Cytotoxic T–Lymphocyte (CTL) Epitope: an Immunodominant Region Which Induces Nonreciprocal CTL Cross–Reactivity," *J. Virol.* 63:4303–4310, American Society for Microbiology (1989).

Yewdell, J.W., and Bennink, J.R., "Cell Biology of Antigen Processing and Presentation to Major Histocompatibility Complex Class I Molecule–Restricted T Lymphocytes," *Adv. Immunol.* 52:1–123, Academic Press (Jul. 1992).

York, I.A., and Rock, K.L., "Antigen processing and presentation by the class I major histocompatibility complex," *Annu. Rev. Immunol.* 14:369–396, Annual Reviews, Inc. (Apr. 1996).

Zhang, Q–J., et al., "An HLA–All–specific motifs in nonamer peptides derived from viral and cellular proteins," *Proc. Natl. Acad. Sci. USA* 90:2217–2221, National Academy Press (Mar. 1993).

Parker, K.C., et al., "Scheme for Ranking Potential HLA–A2 Binding Peptides Based on Independent Binding of Individual Peptide Side–Chains," *J. Immunol.* 152:163–175, The American Association of Immunologists (Jan. 1994).

Dialog File 351, Accession No. 7180926, Derwent WPI English language abstract for EP 0 226 513.

Dialog File 351, Accession No. 9263567, Derwent WPI English language abstract for WO 92/21033.

Dialog File 351, Accession No. 9888606, Derwent WPI English language abstract for WO 94/11738.

Altuvia, Y. et al., "A Structure–Based Algorithm to Predict Potential Binding Peptides to MHC Molecules with Hydrophobic Binding Pockets," *Human Immunol.* 58:1–11, Elsevier Science Inc. (1997).

* cited by examiner

INDUCING CELLULAR IMMUNE RESPONSES TO HUMAN PAPILLOMAVIRUS USING PEPTIDE AND NUCLEIC ACID COMPOSITIONS

CROSS-REFERENCES TO RELATED APPLICATIONS

The present application claims priority to U.S. Ser. No. 60/172,705 filed Dec. 10, 1999. The application is also related to U.S. Ser. No. 09/189,702, filed Nov. 10, 1998, which is a CIP of U.S. Ser. No. 08/205,713 filed Mar. 4, 1994, which is a CIP of abandoned U.S. Ser. No. 08/159,184 filed Nov. 29, 1993, which is a CIP of abandoned U.S. Ser. No. 08/073,205 filed Jun. 4, 1993 which is a CIP of abandoned U.S. Ser. No. 08/027,146 filed Mar. 5, 1993. Additionally, the present application is related to U.S. Ser. No. 09/226,775, which is a CIP of abandoned U.S. Ser. No. 08/815,396, which claims benefit of abandoned U.S. Ser. No. 60/013,113. Furthermore, the present application is related to U.S. Ser. No. 09/017,735, which is a CIP of abandoned U.S. Ser. No. 08/589,108; U.S. Ser. No. 08/454,033; and U.S. Ser. No. 08/349,177. The present application is also related to U.S. Ser. No. 09/017,524, U.S. Ser. No. 08/821,739, which claims benefit of abandoned U.S. Ser. No. 60/013,833; and U.S. Ser. No. 08/347,610, which is a CIP of U.S. Ser. No. 08/159,339, which is a CIP of abandoned U.S. Ser. No. 08/103,396, which is a CIP of abandoned U.S. Ser. No. 08/027,746, which is a CIP of abandoned U.S. Ser. No. 07/926,666. The present application is also related to U.S. Ser. No. 09/017,743, which is a CIP of abandoned U.S. Ser. No. 08/590,298; and U.S. Ser. No. 08/452,843, which is a CIP of U.S. Ser. No. 08/344,824, which is a CIP of abandoned U.S. Ser. No. 08/278,634. The present application is also related to PCT application 99/12066 filed May 28, 1999 which claims benefit of provisional U.S. Ser. No. 60/087,192; U.S. Ser. No. 09/009,953, which is a CIP of abandoned U.S. Ser. No. 60/036,713; and abandoned U.S. Ser. No. 60/037,432. In addition, the present application is related to U.S. Ser. No. 09/098,584; U.S. Ser. No. 09/239,043; U.S. Ser. No. 60/117,486; U.S. Ser. No. 09/350,401; U.S. Ser. No. 09/357,737; and U.S. Ser. No. 09/390,061. All of the above applications are incorporated herein by reference.

FEDERALLY SPONSORED RESEARCH AND DEVELOPMENT

This invention was funded, in part, by the United States government under grants with the National Institutes of Health. The U.S. government has certain rights in this invention.

REFERENCE TO MICROFICHE APPENDIX/ SEQUENCE LISTING/TABLE/COMPUTER PROGRAM LISTING APPENDIX

(SUBMITTED ON A COMPACT DISC AND AN INCORPORATION-BY-REFERENCE OF THE MATERIAL ON THE COMPACT DISC)

The Substitute Sequence Listing written in file Sequence Listing 2060_0100001, created on Oct. 17, 2003 on compact disc for application Ser. No. 09/641,528, Sette et al., Inducing Cellular Immune Responses to Human Papillomavirus Using Peptide and Nucleic Acid Compositions, is herein incorporated-by-reference.

I. Background of the Invention
II. Summary of the Invention
III. Detailed Description of the Invention
   A. Definitions
   B. Stimulation of CTL and HTL responses
   C. Binding Affinity of Peptide Epitopes for HLA Molecules
   D. Peptide Epitope Binding Motifs and Supermotifs
      1. HLA-A1 supermotif
      2. HLA-A2 supermotif
      3. HLA-A3 supermotif
      4. HLA-A24 supermotif
      5. HLA-B7 supermotif
      6. HLA-B27 supermotif
      7. HLA-B44 supermotif
      8. HLA-B58 supermotif
      9. HLA-B62 supermotif
      10. HLA-A1 motif
      11. HLA-A2.1 motif
      12. HLA-A3 motif
      13. HLA-A11 motif
      14. HLA-A24 motif
      15. HLA-DR-1-4-7 supermotif
      16. HLA-DR3 motifs
   E. Enhancing Population Coverage of the Vaccine
   F. Immune Response-Stimulating Peptide Epitope Analogs
   G. Computer Screening of Protein Sequences from Disease-Related Antigens for Supermotif- or Motif-Containing Epitopes
   H. Preparation of Peptide Epitopes
   I. Assays to Detect T-Cell Responses
   J. Use of Peptide Epitopes for Evaluating Immune Responses
   K. Vaccine Compositions
      1. Minigene Vaccines
      2. Combinations of CTL Peptides with Helper Peptides
      3. Combinations of CTL Peptides with T Cell Priming Agents
      4. Vaccine Compositions Comprising Dendritic Cells Pulsed with CTL and/or HTL Peptides
   L. Administration of Vaccines for Therapeutic or Prophylactic Purposes
   M. Kits
V. Examples
VI. Claims
VII. Abstract

I. BACKGROUND OF THE INVENTION

Human papillomavirus (HPV) is a member of the papillomaviridae, a group of small DNA viruses that infect a variety of higher vertebrates. More than 80 types of HPVs have been identified. Of these, more than 30 can infect the genital tract. Some types, generally types 6 and 11, may cause genital warts, which are typically benign and rarely develop into cancer. Other strains of HPV, "cancer-associated", or "high-risk" types, can lead to the development of cancer.

Cancer-associated HPVs have been linked with cancer in both men and women; they include, but are not limited to, HPV-16, HPV-18, HPV-31, HPV-45, HPV-33 and HPV-56. Other HPV strains, including types 6 and 11 as well as others, e.g., HPV-5 and HPV-8, are less frequently associated with cancer. The high risk types are typically associated with the development of cervical carcinoma and premalignant lesions of the cervix in women, but are also associated with similar malignant and premalignant lesions at other anatomic sites within the lower genital or anogenital tract. These lesions include neoplasia of the vagina, vulva, perineum, the penis, and the anus. HPV infection has also been associated with respiratory tract papillomas, and rarely, cancer, as well as abnormal growth or neoplasia in other epithelial tissues. See, e.g. VIROLOGY, $2^{ND}$ ED, Fields et at., Eds. Raven Press, New York, 1990, Chapters 58 and 59, for a review of HPV association with cancer.

The HPV genome consists of three functional regions, the early region, the late region, and the "long control region". The early region gene products control viral replication, transcription and cellular transformation They include the HPV E1 and E2 proteins, which play a role in HPV DNA replication, and the E6 and E7 oncoproteins, which are involved in the control of cellular proliferation. The late region include the genes that encode the structural proteins L1 and L2, which are the major and minor capsid proteins, respectively. The "long control region" contains such sequences as enhancer and promoter regulatory regions.

HPV expresses different proteins at different stages of the infection, for example early, as well as late, proteins. Even in latent infections, however, early proteins are often expressed and are therefore useful targets for vaccine-based therapies. For example, high-grade dysplasia and cervical squamous cell carcinoma continue to express E6 and E7, which therefore can be targeted to treat disease at both early and late stages of infection.

Treatment for HPV infection is often unsatisfactory because of persistence of virus after treatment and recurrence of clinically apparent disease is common. Thus, a need exists for an efficacious vaccine to both prevent and treat HPV infection and to treat cancer that is associated with HPV infection. Effective HPV vaccines would be a significant advance in the control of sexually transmissable infections and could also protect against clinical disease, particularly cancers such as cervical cancer. (see, e.g., Rowen, P. & Lacey, C., *Dermatologic Clinics* 16(4):835–838, 1998).

Virus-specific, human leukocyte antigen (HLA) class I-restricted cytotoxic T lymphocytes (CTL) are known to play a major role in the prevention and clearance of virus infections in vivo (Oldstone et al., *Nature* 321:239, 1989; Jamieson et al., *J. Virol.* 61:3930, 1987; Yap et al, *Nature* 273:238, 1978; Lukacher et al., *J. Exp. Med.* 160:814, 1994; McMichael et al., *N. Engl. J. Med.* 309:13, 1983; Sethi et al., *J. Gen. Virol.* 64:443, 1983; Watari et al. *J. Exp. Med.* 65:459, 1987; Yasukawa et al., *J. Immunol.* 143:2051, 1989; Tigges et al., *J. Virol.* 66:1622, 1993; Reddenhase et al., *J. Virol.* 55:263, 1985; Quinnan et al., *N. Engl. J. Med.* 307:6, 1982). HLA class I molecules are expressed on the surface of almost all nucleated cells. Following intracellular processing of antigens, epitopes from the antigens are presented as a complex with the HLA class I molecules on the surface of such cells. CTL recognize the peptide-HLA class I complex, which then results in the destruction of the cell bearing the HLA-peptide complex directly by the CTL and/or via the activation of non-destructive mechanisms e.g., the production of interferon, that inhibit viral replication.

Virus-specific T helper lymphocytes are also known to be critical for maintaining effective immunity in chronic viral infections. Historically, HTL responses were viewed as primarily supporting the expansion of specific CTL and B cell populations; however, more recent data indicate that HTL may directly contribute to the control of virus replication. For example, a decline in $CD4^+$T cells and a corresponding loss in HTL function characterize infection with HIV (Lane et al., *New Engl. J. Med.* 313:79, 1985). Furthermore, studies in HIV infected patients have also shown that there is an inverse relationship between virus-specific HTL responses and viral load, suggesting that HTL plays a role in viremia (see, e.g., Rosenberg et al., *Science* 278:1447, 1997).

The development of vaccines with prophylactic and therapeutic efficacy against HPV is ongoing. Early vaccine development was hampered by the inability to culture HPV. With the introduction of cloning techniques and protein expression, however, some attempts have been made to stimulate humoral and CTL response to HPV (See, e.g., Rowen, P. & Lacey, C., *Dermatologic Clinics* 16(4):835–838 (1998)). Studies to date, however, have been inconclusive.

Activation of T helper cells and cytotoxic lymphocytes (CTLs) in the development of vaccines has also been analyzed. Lehtinen, M., et al. for instance, has shown that some peptides from the E2 protein of HPV type 16 activate T helper cells and CTLs (*Biochem. Biophys. Res. Commun.* 209(2):541–6 (1995). Similarly, Tarpey et al, has shown that some peptides from HPV type 11 E7 protein can stimulate human HPV-specific CTLs in vitro (*Immunology* 81:222–227 (1994)) and Borysiewicz et al. have reported a recombinant vaccinia virus expressing HPV 16 and HPV 17 E6 and E7 that stimulated CTL responses in at least one patient (*Lancet* 347:1347–1357, 1996).

The epitope approach, as we have described, allows the incorporation of various antibody, CTL and HTL epitopes, from various proteins, in a single vaccine composition. Such a composition may simultaneously target multiple dominant and subdominant epitopes and thereby be used to achieve effective immunization in a diverse population.

The information provided in this section is intended to disclose the presently understood state of the art as of the filing date of the present application. Information is included in this section which was generated subsequent to the priority date of this application. Accordingly, information in this section is not intended, in any way, to delineate the priority date for the invention.

II. SUMMARY OF THE INVENTION

This invention applies our knowledge of the mechanisms by which antigen is recognized by T cells, for example, to develop epitope-based vaccines directed towards HPV. More specifically, this application communicates our discovery of specific epitope pharmaceutical compositions and methods of use in the prevention and treatment of HPV infection.

Upon development of appropriate technology, the use of epitope-based vaccines has several advantages over current vaccines, particularly when compared to the use of whole antigens in vaccine compositions. There is evidence that the immune response to whole antigens is directed largely toward variable regions of the antigen, allowing for immune escape due to mutations. The epitopes for inclusion in an epitope-based vaccine may be selected from conserved regions of viral or tumor-associated antigens, which thereby reduces the likelihood of escape mutants. Furthermore, immunosuppressive epitopes that may be present in whole antigens can be avoided with the use of epitope-based vaccines.

An additional advantage of an epitope-based vaccine approach is the ability to combine selected epitopes (CTL and HTL), and further, to modify the composition of the epitopes, achieving, for example, enhanced immunogenicity. Accordingly, the immune response can be modulated, as appropriate, for the target disease. Similar engineering of the response is not possible with traditional approaches.

Another major benefit of epitope-based immune-stimulating vaccines is their safety. The possible pathological side effects caused by infectious agents or whole protein antigens, which might have their own intrinsic biological activity, is eliminated.

An epitope-based vaccine also provides the ability to direct and focus an immune response to multiple selected antigens from the sane pathogen. Thus, patient-by-patient variability in the immune response to a particular pathogen may be alleviated by inclusion of epitopes from multiple antigens from the pathogen in a vaccine composition. In the case of HPV, epitopes derived from multiple strains may also be included. A "pathogen" may be an infectious agent or a tumor associated molecule.

One of the most formidable obstacles to the development of broadly efficacious epitope-based immunotherapeutics, however, has been the extreme polymorphism of HLA molecules. To date, effective non-genetically biased coverage of a population has been a task of considerable complexity; such coverage has required that epitopes be used that are specific for HLA molecules corresponding to each individual HLA allele. Impractically large numbers of epitopes would therefore have to be used in order to cover ethnically diverse populations. Thus, there has existed a need for peptide epitopes that are bound by multiple HLA antigen molecules for use in epitope-based vaccines. The greater the number of HLA antigen molecules bound, the greater the breadth of population coverage by the vaccine.

Furthermore, as described herein in greater detail, a need has existed to modulate peptide binding properties, e.g., so that peptides that are able to bind to multiple HLA antigens do so with an affinity that will stimulate an immune response. Identification of epitopes restricted by more than one HLA allele at an affinity that correlates with immunogenicity is important to provide thorough population coverage, and to allow the elicitation of responses of sufficient vigor to prevent or clear an infection in a diverse segment of the population. Such a response can also target a broad array of epitopes. The technology disclosed herein provides for such favored immune responses.

In a preferred embodiment, epitopes for inclusion in vaccine compositions of the invention are selected by a process whereby protein sequences of known antigens are evaluated for the presence of motif or supermotif-bearing epitopes. Peptides corresponding to a motif- or supermotif-bearing epitope are then synthesized and tested for the ability to bind to the HLA molecule that recognizes the selected motif. Those peptides that bind at an intermediate or high affinity i.e., an $IC_{50}$ (or a $K_D$ value) of 500 nM or less for HLA class I molecules or an $IC_{50}$ of 1000 nM or less for HLA class II molecules, are further evaluated for their ability to induce a CTL or HTL response. Immunogenic peptide epitopes are selected for inclusion in vaccine compositions.

Supermotif-bearing peptides may additionally be tested for the ability to bind to multiple alleles within the HLA supertype family. Moreover, peptide epitopes may be analogued to modify binding affinity and/or the ability to bind to multiple alleles within an HLA supertype.

The invention also includes embodiments comprising methods for monitoring or evaluating an immune response to HPV in a patient having a known HLA-type. Such methods comprise incubating a T lymphocyte sample from the patient with a peptide composition comprising an HPV epitope that has an amino acid sequence described in Tables VII to Table XX which binds the product of at least one HLA allele present in the patient, and detecting for the presence of a T lymphocyte that binds to the peptide. A CTL peptide epitope may, for example, be used as a component of a tetrameric complex for this type of analysis.

An alternative modality for defining the peptide epitopes in accordance with the invention is to recite the physical properties, such as length; primary structure; or charge, which are correlated with binding to a particular allele-specific HLA molecule or group of allele-specific HLA molecules. A further modality for defining peptide epitopes is to recite the physical properties of an HLA binding pocket, or properties shared by several allele-specific HLA binding pockets (e.g. pocket configuration and charge distribution) and reciting that the peptide epitope fits and binds to the pocket or pockets.

As will be apparent from the discussion below, other methods and embodiments are also contemplated. Further, novel synthetic peptides produced by any of the methods described herein are also part of the invention.

III. DETAILED DESCRIPTION OF THE INVENTION

The peptides and corresponding nucleic acid compositions of the present invention are useful for stimulating an immune response to HPV by stimulating the production of CTL or HTL responses. The peptide epitopes, which are derived directly or indirectly from native HPV protein amino acid sequences, are able to bind to HLA molecules and stimulate an immune response to HPV. The complete sequence of the HPV proteins to be analyzed can be obtained from Genbank. Epitopes and analogs thereof can also be readily determined from sequence information that may subsequently be discovered for heretofore unknown variants of HPV, as will be clear from the disclosure provided below.

The epitopes of the invention have been identified in a number of ways, as will be discussed below. Also discussed in greater detail is that analog peptides have been derived and the binding activity for HLA molecules modulated by modifying specific amino acid residues to create peptide analogs exhibiting altered imunogenicity. Further, the present invention provides compositions and combinations of compositions that enable epitope-based vaccines that are capable of interacting with HLA molecules encoded by various genetic alleles to provide broader population coverage than prior vaccines.

III.A. Definitions

The invention can be better understood with reference to the following definitions, which are listed alphabetically:

A "computer" or "computer system" generally includes: a processor; at least one information storage/retrieval apparatus such as, for example, a hard drive, a disk drive or a tape drive; at least one input apparatus such as, for example, a keyboard, a mouse, a touch screen, or a microphone; and display structure. Additionally, the computer may include a communication channel in communication with a network. Such a computer may include more or less than what is listed above.

A "construct" as used herein generally denotes a composition that does not occur in nature. A construct can be produced by synthetic technologies, e.g., recombinant DNA preparation and expression or chemical synthetic techniques for nucleic or amino acids. A construct can also be produced by the addition or affiliation of one material with another such that the result is not found in nature in that form.

"Cross-reactive binding" indicates that a peptide is bound by more than one HLA molecule; a synonym is degenerate binding.

A "cryptic epitope" elicits a response by immunization with an isolated peptide, but the response is not cross-reactive in vitro when intact whole protein which comprises the epitope is used as an antigen.

A "dominant epitope" is an epitope that induces an immune response upon immunization with a whole native antigen (see, e.g., Sercarz, et al., *Annu. Rev. Immunol.* 11:729–766, 1993). Such a response is cross-reactive in vitro with an isolated peptide epitope.

With regard to a particular amino acid sequence, an "epitope" is a set of amino acid residues which is involved in recognition by a particular immunoglobulin, or in the context of T cells, those residues necessary for recognition by T cell receptor proteins and/or Major Histocompatibility Complex (MHC) receptors. In an immune system setting, in vivo or in vitro, an epitope is the collective features of a molecule, such as primary, secondary and tertiary peptide structure, and charge, that together form a site recognized by an immunoglobulin, T cell receptor or HLA molecule. Throughout this disclosure epitope and peptide are often used interchangeably. It is to be appreciated, however, that isolated or purified protein or peptide molecules larger than and comprising an epitope of the invention are still within the bounds of the invention.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

An "HLA supertype or family", as used herein, describes sets of HLA molecules grouped on the basis of shared peptide-binding specificities. HLA class I molecules that share somewhat similar binding affinity for peptides bearing certain amino acid motifs are grouped into HLA supertypes. The terms HLA superfamily, HLA supertype family, HLA family, and HLA xx-like molecules (where xx denotes a particular HLA type), are synonyms.

Throughout this disclosure, results are expressed in terms of "$IC_{50}$'s." $IC_{50}$ is the concentration of peptide in a binding assay at which 50% inhibition of binding of a reference peptide is observed. Given the conditions in which the assays are run (i.e., limiting HLA proteins and labeled peptide concentrations), these values approximate $K_D$ values. Assays for determining binding are described in detail, e.g., in PCT publications WO 94/20127 and WO 94/03205. It should be noted that $IC_{50}$ values can change, often dramatically, if the assay conditions are varied, and depending on the particular reagents used (e.g., HLA preparation, etc.). For example, excessive concentrations of HLA molecules will increase the apparent measured $IC_{50}$ of a given ligand.

Alternatively, binding is expressed relative to a reference peptide. Although as a particular assay becomes more, or less, sensitive, the $IC_{50}$'s of the peptides tested may change somewhat, the binding relative to the reference peptide will not significantly change. For example, in an assay run under conditions such that the $IC_{50}$ of the reference peptide increases 10-fold, the $IC_{50}$ values of the test peptides will also shift approximately 10-fold. Therefore, to avoid ambiguities, the assessment of whether a peptide is a good, intermediate, weak, or negative binder is generally based on its $IC_{50}$, relative to the $IC_{50}$ of a standard peptide.

Binding may also be determined using other assay systems including those using: live cells (e.g., Ceppellini et al., *Nature* 339:392, 1989; Christnick et al., *Nature* 352:67, 1991; Busch et al., *Int. Immunol.* 2:443, 19990; Hill et al., *J. Immunol.* 147:189, 1991; del Guercio et al., *J. Immunol.* 154:685, 1995), cell free systems using detergent lysates (e.g., Cerundolo et a., *J. Immunol.* 21:2069, 1991), immobilized purified MHC (e.g., Hill et al., *J. Immunol.* 152, 2890, 1994; Marshall et al., *J. Immunol.* 152:4946, 1994), ELISA systems (e.g., Reay et al., *EMBO J.* 11:2829, 1992), surface plasmon resonance (e.g., Khilko et al., *J. Biol. Chem.* 268:15425, 1993); high flux soluble phase assays (Hammer et al., *J. Exp. Med.* 180:2353, 1994), and measurement of class I MHC stabilization or assembly (e.g., Ljunggren et al., *Nature* 346:476, 1990; Schumacher et al., *Cell* 62:563, 1990; Townsend et al., *Cell* 62:285, 1990; Parker et al., *J. Immunol.* 149:1896, 1992).

As used herein, "high affinity" with respect to HLA class I molecules is defined as binding with an $IC_{50}$, or $K_D$ value, of 50 nM or less; "intermediate affinity" is binding with an $IC_{50}$ or $K_D$ value of between about 50 and about 500 nM. "High affinity" with respect to binding to HLA class II molecules is defined as binding with an $IC_{50}$ or $K_D$ value of 100 nM or less; "intermediate affinity" is binding with an $IC_{50}$ or $K_D$ value of between about 100 and about 1000 nM.

The terms "identical" or percent "identity," in the context of two or more peptide sequences, refer to two or more sequences or subsequences that are the same or have a specified percentage of amino acid residues that are the same, when compared and aligned for maximum correspondence over a comparison window, as measured using a sequence comparison algorithm or by manual alignment and visual inspection.

An "immunogenic peptide" or "peptide epitope" is a peptide that comprises an allele-specific motif or supermotif such that the peptide will bind an HLA molecule and induce a CTL and/or HTL response. Thus, immunogenic peptides of the invention are capable of binding to an appropriate HLA molecule and thereafter inducing a cytotoxic T cell response, or a helper T cell response, to the antigen from which the immunogenic peptide is derived.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment.

"Link" or "join" refers to any method known in the art for functionally connecting peptides, including, without limitation, recombinant fusion, covalent bonding, disulfide bonding, ionic bonding, hydrogen bonding, and electrostatic bonding.

"Major Histocompatibility Complex" or "MHC" is a cluster of genes that plays a role in control of the cellular interactions responsible for physiologic immune responses. In humans, the MHC complex is also known as the HLA complex. For a detailed description of the MHC and HLA complexes, see, Paul, FUNDAMENTAL IMMUNOLOGY, $3^{RD}$ ED., Raven Press, New York, 1993.

The term "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs are typically different for each protein encoded by each human HLA allele and differ in the pattern of the primary and secondary anchor residues.

A "negative binding residue" or "deleterious residue" is an amino acid which, if present at certain positions (typically not primary anchor positions) in a peptide epitope, results in decreased binding affinity of the peptide for the peptide's corresponding HLA molecule.

A "non-native" sequence or "construct" refers to a sequence that is not found in nature, i.e., is "non-naturally occurring". Such sequences include, e.g., peptides that are lipidated or otherwise modified, and polyepitopic compositions that contain epitopes that are not contiguous in a native protein sequence.

The term "peptide" is used interchangeably with "oligopeptide" in the present specification to designate a series of residues, typically L-amino acids, connected one to the other, typically by peptide bonds between the α-amino and carboxyl groups of adjacent amino acids. The preferred CTL-inducing peptides of the invention are 13 residues or less in length and usually consist of between about 8 and about 11 residues, preferably 9 or 10 residues. The preferred HTL-inducing oligopeptides are less than about 50 residues in length and usually consist of between about 6 and about 30 residues, more usually between about 12 and 25, and often between about 15 and 20 residues.

It is to be appreciated that protein or peptide molecules that comprise an epitope of the invention as well as additional amino acid(s) are within the bounds of the invention. In certain embodiments, there is a limitation on the length of a peptide of the invention which is not otherwise a construct as defined herein. An embodiment that is length-limited occurs when the protein/peptide comprising an epitope of the invention comprises a region (i.e., a contiguous series of amino acids) having 100% identity with a native sequence. In order to avoid a recited definition of epitope from reading, e.g., on whole natural molecules, the length of any region that has 100% identity with a native peptide sequence is limited. Thus, for a peptide comprising an epitope of the invention and a region with 100% identity with a native peptide sequence (and which is not otherwise a construct), the region with 100% identity to a native sequence generally has a length of: less than or equal to 600 amino acids, often less than or equal to 500 amino acids, often less than or equal to 400 amino acids, often less than or equal to 250 amino acids, often less than or equal to 100 amino acids, often less than or equal to 85 amino acids, often less than or equal to 75 amino acids, often less than or equal to 65 amino acids, and often less than or equal to 50 amino acids. In certain embodiments, an "epitope" of the invention which is not a construct is comprised by a peptide having a region with less than 51 amino acids that has 100% identity to a native peptide sequence, in any increment of (50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5) down to 5 amino acids.

Certain peptide or protein sequences longer than 600 amino acids are within the scope of the invention. Such longer sequences are within the scope of the invention so long as they do not comprise any contiguous sequence of more than 600 amino acids that have 100% identity with a native peptide sequence, or if longer than 600 amino acids, they are a construct. For any peptide that has five contiguous residues or less that correspond to a native sequence, there is no limitation on the maximal length of that peptide in order to fall within the scope of the invention. It is presently preferred that a CTL epitope of the invention be less than 600 residues long in any increment down to eight amino acid residues.

"Pharmaceutically acceptable" refers to a non-toxic, inert, and/or physiologically compatible composition.

A "pharmaceutical excipient" comprises a material such as an adjuvant, a carrier, pH-adjusting and buffering agents, tonicity adjusting agents, wetting agents, preservative, and the like.

A "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding grooves of an HLA molecule, with their side chains buried in specific pockets of the binding grooves themselves. In one embodiment, for example, the primary anchor residues are located at position 2 (from the amino terminal position) and at the carboxyl terminal position of a 9-residue peptide epitope in accordance with the invention. The primary anchor positions for each motif and supermotif are set forth in Table 1. For example, analog peptides can be created by altering the presence or absence of particular residues in these primary anchor positions. Such analogs are used to modulate the binding affinity of a peptide comprising a particular motif or supermotif.

"Promiscuous recognition" is where a distinct peptide is recognized by the same T cell clone in the context of various HLA molecules. Promiscuous recognition or binding is synonymous with cross-reactive binding.

A "protective immune response" or "therapeutic immune response" refers to a CTL and/or an HTL response to an antigen derived from an infectious agent or a tumor antigen, which prevents or at least partially arrests disease symptoms or progression. The immune response may also include an antibody response which has been facilitated by the stimulation of helper T cells.

The term "residue" refers to an amino acid or amino acid mimetic incorporated into an oligopeptide by an amide bond or amide bond mimetic.

A "secondary anchor residue" is an amino acid at a position other than a primary anchor position in a peptide which may influence peptide binding. A secondary anchor residue occurs at a significantly higher frequency amongst bound peptides than would be expected by random distribution of amino acids at one position. The secondary anchor residues are said to occur at "secondary anchor positions." A secondary anchor residue can be identified as a residue which is present at a higher frequency among high or intermediate affinity binding peptides, or a residue otherwise associated with high or intermediate affinity binding. For example, analog peptides can be created by altering the presence or absence of particular residues in these secondary anchor positions. Such analogs are used to finely modulate the binding affinity of a peptide comprising a particular motif or supermotif.

A "subdominant epitope" is an epitope which evokes little or no response upon immunization with whole antigens which comprise the epitope, but for which a response can be obtained by immunization with an isolated peptide, and this response (unlike the case of cryptic epitopes) is detected when whole protein is used to recall the response in vitro or in vivo.

A "supermotif" is a peptide binding specificity shared by HLA molecules encoded by two or more HLA alleles. Preferably, a supermotif-bearing peptide is recognized with high or intermediate affinity (as defined herein) by two or more HLA antigens.

"Synthetic peptide" refers to a peptide that is man-made using such methods as chemical synthesis or recombinant DNA technology.

As used herein, a "vaccine" is a composition that contains one or more peptides of the invention. There are numerous embodiments of vaccines in accordance with the invention, such as by a cocktail of one or more peptides; one or more epitopes of the invention comprised by a polyepitopic peptide; or nucleic acids that encode such peptides or polypeptides, e.g., a minigene that encodes a polyepitopic peptide. The "one or more peptides" can include any whole unit integer from 1–150, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I-binding peptides of the invention can be admixed with, or linked to, HLA class II-binding peptides, to facilitate activation of both cytotoxic T lymphocytes and helper T lymphocytes. Vaccines can also comprise peptide-pulsed antigen presenting cells, e.g., dendritic cells.

The nomenclature used to describe peptide compounds follows the conventional practice wherein the amino group is presented to the left (the N-terminus) and the carboxyl group to the right (the C-terminus) of each amino acid residue. When amino acid residue positions are referred to in a peptide epitope they are numbered in an amino to carboxyl direction with position one being the position closest to the amino terminal end of the epitope, or the peptide or protein of which it may be a part. In the formulae representing selected specific embodiments of the present invention, the amino- and carboxyl-terminal groups, although not specifically shown, are in the form they would assume at physiologic pH values, unless otherwise specified. In the amino acid structure formulae, each residue is generally represented by standard three letter or single letter designations. The L-form of an amino acid residue is represented by a capital single letter or a capital first letter of a three-letter symbol, and the D-form for those amino acids having D-forms is represented by a lower case single letter or a lower case three letter symbol. Glycine has no asymmetric carbon atom and is simply referred to as "Gly" or G. Symbols for the amino acids are shown below.

| Single Letter Symbol | Three Letter Symbol | Amino Acids |
|---|---|---|
| A | Ala | Alanine |
| C | Cys | Cysteine |
| D | Asp | Aspartic Acid |
| E | Glu | Glutamic Acid |
| F | Phe | Phenylalanine |
| G | Gly | Glycine |
| H | His | Histidine |
| I | Ile | Isoleucine |
| K | Lys | Lysine |
| L | Leu | Leucine |
| M | Met | Methionine |
| N | Asn | Asparagine |

-continued

| Single Letter Symbol | Three Letter Symbol | Amino Acids |
|---|---|---|
| P | Pro | Proline |
| Q | Gln | Glutamine |
| R | Arg | Arginine |
| S | Ser | Serine |
| T | Thr | Threonine |
| V | Val | Valine |
| W | Trp | Tryptophan |
| Y | Tyr | Tyrosine |

III.B. Stimulation of CTL and HTL Responses

The mechanism by which T cells recognize antigens has been delineated during the past ten years. Based on our understanding of the immune system we have developed efficacious peptide epitope vaccine compositions that can induce a therapeutic or prophylactic immune response to HPV in a broad population. For an understanding of the value and efficacy of the claimed compositions, a brief review of immunology-related technology is provided.

A complex of an HLA molecule and a peptidic antigen acts as the ligand recognized by HLA-restricted T cells (Buus, S. et al., *Cell* 47:1071, 1986; Babbitt, B. P. et al., *Nature* 317:359, 1985; Townsend, A. and Bodmer, H., *Annu. Rev. Immunol.* 7:601, 1989; Germain, R. N., *Annu. Rev. Immunol.* 11:403, 1993). Through the study of single amino acid substituted antigen analogs and the sequencing of endogenously bound, naturally processed peptides, critical residues that correspond to motifs required for specific binding to HLA antigen molecules have been identified and are described herein and are set forth in Tables I, II, and III (see also, e.g., Southwood, et al, *J. Immunol.* 160:3363, 1998; Rammensee, et al., *Immunogenetics* 41:178, 1995; Rammensee et al., SYFPEITHI, access via web at: http://134.2.96.221/scripts.hlaserver.dll/home.htm; Sette, A. and Sidney, *J. Curr. Opin. Immunol.* 10:478, 1998; Engelhard, V. H., *Curr. Opin. Immunol.* 6:13, 1994; Sette, A. and Grey, H. M., *Curr. Opin. Immunol.* 4:79, 1992; Sinigaglia, F. and Hammer, *J. Curr. Biol.* 6:52, 1994; Ruppert et al, *Cell* 74:929–937, 1993; Kondo et al., *J. Immunol.* 155:4307–4312, 1995; Sidney et al, *J. Immunol.* 157:3480–3490, 1996; Sidney et a., *Human Immunol.* 45:79–93, 1996; Sette, A. and Sidney, *J. Immunogenetics*, in press, 1999).

Furthermore, x-ray crystallographic analysis of HLA-peptide complexes has revealed pockets within the peptide binding cleft of HLA molecules which accommodate, in an allele-specific mode, residues borne by peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stem et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.)

Accordingly, the definition of class I and class II allele-specific HLA binding motifs, or class I or class II supermotifs allows identification of regions within a protein that have the potential of binding particular HLA antigen(s).

The present inventors have found that the correlation of binding affinity with immunogenicity, which is disclosed herein, is an important factor to be considered when evaluating candidate peptides. Thus, by a combination of motif searches and HLA-peptide binding assays, candidates for epitope-based vaccines have been identified. After determining their binding affinity, additional confirmatory work can be performed to select, amongst these vaccine candidates, epitopes with preferred characteristics in terms of population coverage, antigenicity, and immunogenicity.

Various strategies can be utilized to evaluate immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al., *Human Immunol.* 59:1, 1998); This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997); In this method, peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have effectively been vaccinated, recovered from infection, and/or from chronically infected patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997); In applying this strategy, recall responses are detected by culturing PBL from subjects that have been naturally exposed to the antigen, for instance through infection, and thus have generated an immune response "naturally", or from patients who were vaccinated against the infection. PBL from subjects are cultured in vitro for 1–2 weeks in the presence of test peptide plus antigen presenting cells (APC) to allow activation of "memory" T cells, as compared to "naive" T cells. At the end of the culture period, T cell activity is detected using assays for T cell activity including $^{51}$Cr release involving peptide-sensitized targets, T cell proliferation, or lymphokine release.

The following describes the peptide epitopes and corresponding nucleic acids of the invention.

III.C. Binding Affinity of Peptide Epitopes for HLA Molecules

As indicated herein, the large degree of HLA polymorphism is an important factor to be taken into account with the epitope-based approach to vaccine development. To address this factor, epitope selection encompassing identification of peptides capable of binding at high or intermediate affinity to multiple HLA molecules is preferably utilized, most preferably these epitopes bind at high or intermediate affinity to two or more allele-specific HLA molecules.

CTL-inducing peptides of interest for vaccine compositions preferably include those that have an $IC_{50}$ or binding affinity value for class I HLA molecules of 500 nM or better (i.e., the value is $\leq 500$ nM). HTL-inducing peptides preferably include those that have an $IC_{50}$ or binding affinity value for class II HLA molecules of 1000 nM or better, (i.e., the value is $\leq 1,000$ nM). For example, peptide binding is assessed by testing the capacity of a candidate peptide to bind to a purified HLA molecule in vitro. Peptides exhibiting high or intermediate affinity are then considered for further analysis. Selected peptides are tested on other members of the supertype family. In preferred embodiments, peptides that exhibit cross-reactive binding are then used in cellular screening analyses or vaccines.

As disclosed herein, higher HLA binding affinity is correlated with greater immunogenicity. Greater immunogenicity can be manifested in several different ways. Immunogenicity corresponds to whether an immune response is elicited at all, and to the vigor of any particular response, as well as to the extent of a population in which a response is elicited. For example, a peptide might elicit an immune response in a diverse array of the population, yet in no instance produce a vigorous response. In accordance with these principles, close to 90% of high binding peptides have been found to be immunogenic, as contrasted with about 50% of the peptides which bind with intermediate affinity. Moreover, higher binding affinity peptides lead to more vigorous immunogenic responses. As a result, less peptide is required to elicit a similar biological effect if a high affinity binding peptide is used. Thus, in preferred embodiments of the invention, high affinity binding epitopes are particularly useful.

The relationship between binding affinity for HLA class I molecules and immunogenicity of discrete peptide epitopes on bound antigens has been determined for the first time in the art by the present inventors. The correlation between binding affinity and immunogenicity was analyzed in two different experimental approaches (see, e.g., Sette, et al., *J. Immunol.* 153:5586–5592, 1994). In the first approach, the immunogenicity of potential epitopes ranging in HLA binding affinity over a 10,000-fold range was analyzed in HLA-A*0201 transgenic mice. In the second approach, the antigenicity of approximately 100 different hepatitis B virus (HBV)-derived potential epitopes, all carrying A*0201 binding motifs, was assessed by using PBL from acute hepatitis patients. Pursuant to these approaches, it was determined that an affinity threshold value of approximately 500 nM (preferably 50 nM or less) determines the capacity of a peptide epitope to elicit a CTL response. These data are true for class I binding affinity measurements for naturally processed peptides and for synthesized T cell epitopes. These data also indicate the important role of determinant selection in the shaping of T cell responses (see, e.g., Schaeffer et al. *Proc. Natl. Acad. Sci. USA* 86:4649–4653, 1989).

An affinity threshold associated with immunogenicity in the context of HLA class II DR molecules has also been delineated (see, e.g., Southwood et al. *J. Immunology* 160:3363–3373,1998, and co-pending U.S. Ser. No. 09/009, 953 filed Jan. 21, 1998). In order to define a biologically significant threshold of DR binding affinity, a database of the binding affinities of 32 DR-restricted epitopes for their restricting element (i.e., the HLA molecule that binds the motif) was compiled. In approximately half of the cases (15 of 32 epitopes), DR restriction was associated with high binding affinities, i.e. binding affinity values of 100 nM or less. In the other half of the cases (16 of 32), DR restriction was associated with intermediate affinity (binding affinity values in the 100–1000 nM range). In only one of 32 cases was DR restriction associated with an $IC_{50}$ of 1000 nM or greater. Thus, 1000 nM can be defined as an affinity threshold associated with immunogenicity in the context of DR molecules.

In the case of tumor-associated antigens, many CTL peptide epitopes that have been shown to induce CTL that lyse peptide-pulsed target cells and tumor cell targets endogenously expressing the epitope exhibit binding affinity or $IC_{50}$ values of 200 nM or less. In a study that evaluated the association of binding affinity and immunogenicity of a small set of such TAA epitopes, 100% (10/10) of the high binders, i.e., peptide epitopes binding at an affinity of 50 nM or less, were immunogenic and 80% (8/10) of them elicited CTLs that specifically recognized tumor cells. In the 51 to 200 nM range, very similar figures were obtained. With respect to analog peptides, CTL inductions positive for wildtype peptide and tumor cells were noted for 86% (6/7) and 71% (5/7) of the peptides, respectively. In the 201–500 nM range, most peptides (4/5 wildtype) were positive for induction of CTL recognizing wildtype peptide, but tumor recognition was not detected.

The binding affinity of peptides for HLA molecules can be determined as described in Example 1, below.

III.D. Peptide Epitope Binding Motifs and Supermotifs

Through the study of single amino acid substituted antigen analogs and the sequencing of endogenously bound, naturally processed peptides, critical residues required for allele-specific binding to HLA molecules have been identified. The presence of these residues correlates with binding affinity for HLA molecules. The identification of motifs and/or supermotifs that correlate with high and intermediate affinity binding is an important issue with respect to the identification of immunogenic peptide epitopes for the inclusion in a vaccine. Kast et al. (*J. Immunol.* 152:3904–3912, 1994) have shown that motif-bearing peptides account for 90% of the epitopes that bind to allele-specific HLA class I molecules. In this study all possible peptides of 9 amino acids in length and overlapping by eight amino acids (240 peptides), which cover the entire sequence of the E6 and E7 proteins of human papillomavirus type 16, were evaluated for binding to five allele-specific HLA molecules that are expressed at high frequency among different ethnic groups. This unbiased set of peptides allowed an evaluation of the predictive value of HLA class I motifs. From the set of 240 peptides, 22 peptides were identified that bound to an allele-specific HLA molecule with high or intermediate affinity. Of these 22 peptides, 20 (i.e. 91%) were motif-bearing. Thus, this study demonstrates the value of motifs for the identification of peptide epitopes for inclusion in a vaccine: application of motif-based identification techniques will identify about 90% of the potential epitopes in a target antigen protein sequence.

Such peptide epitopes are identified in the Tables described below.

Peptides of the present invention may also comprise epitopes that bind to MHC class II DR molecules. A greater degree of heterogeneity in both size and binding frame position of the motif, relative to the N and C termini of the peptide, exists for class II peptide ligands. This increased heterogeneity of HLA class II peptide ligands is due to the structure of the binding groove of the HLA class II molecule which, unlike its class I counterpart, is open at both ends. Crystallographic analysis of HLA class II DRB*0101-peptide complexes showed that the major energy of binding is contributed by peptide residues complexed with complementary pockets on the DRB*0101 molecules. An important anchor residue engages the deepest hydrophobic pocket (see, e.g., Madden, D. R. *Ann. Rev. Immunol.* 13:587, 1995) and is referred to as position 1 (P1). P1 may represent the N-terminal residue of a class II binding peptide epitope, but more typically is flanked towards the N-terminus by one or more residues. Other studies have also pointed to an important role for the peptide residue in the $6^{th}$ position towards the C-terminus, relative to P1, for binding to various DR molecules.

In the past few years evidence has accumulated to demonstrate that a large fraction of HLA class I and class II molecules can be classified into a relatively few supertypes, each characterized by largely overlapping peptide binding repertoires, and consensus structures of the main peptide binding pockets. Thus, peptides of the present invention are identified by any one of several HLA-specific amino acid motifs (see, e.g., Tables I–III), or if the presence of the motif corresponds to the ability to bind several allele-specific HLA antigens, a supermotif. The HLA molecules that bind to peptides that possess a particular amino acid supermotif are collectively referred to as an HLA "supertype."

The peptide motifs and supermotifs described below, and summarized in Tables I–III, provide guidance for the identification and use of peptide epitopes in accordance with the invention.

Examples of peptide epitopes bearing a respective supermotif or motif are included in Tables as designated in the description of each motif or supermotif below. The Tables include a binding affinity ratio listing for some of the peptide epitopes. The ratio may be converted to $IC_{50}$ by using the following formula: $IC_{50}$ of the standard peptide/ratio = $IC_{50}$ of the test peptide (i.e., the peptide epitope). The $IC_{50}$ values of standard peptides used to determine binding affinities for Class I peptides are shown in Table IV. The $IC_{50}$ values of standard peptides used to determine binding affinities for Class II peptides are shown in Table V. For example, where an HLA-A2.1 motif-bearing peptide shows a relative binding ratio of 0.01 for HLA-A*0201, the $IC_{50}$ value is 500 nM, and where an HLA-A2.1 motif-bearing peptide shows a relative binding ratio of 0.1 for HLA-A 0201, the $IC_{50}$ value is 50 nM.

The peptides used as standards for the binding assays described herein are examples of standards; alternative standard peptides can also be used when performing binding studies.

To obtain the peptide epitope sequences listed in each Table, protein sequence data for HPV types 16, 18, 31, 33, 45, and 56 were evaluated for the presence of the designated supermotif or motif. Seven HPV structural and regulatory proteins, E1, E2, E5, E6, E7, L1 and L2 were included in the analysis. Peptide epitopes can additionally be evaluated on the basis of their conservancy (i.e., the amount of variance) among the available protein sequences for each HPV antigen. The "number of amino acids" in the Tables indicates the number of residues in the epitope sequence.

HLA Class I Motifs Indicative of CTL Inducing Peptide Epitopes:

The primary anchor residues of the HLA class I peptide epitope supermotifs and motifs delineated below are summarized in Table I. The HLA class I motifs set out in Table I(a) are those most particularly relevant to the invention claimed here. Primary and secondary anchor positions are summarized in Table II. Allele-specific HLA molecules that comprise HLA class I supertype families are listed in Table VI. In some cases, peptide epitopes may be listed in both a motif and a supermotif Table. The relationship of a particular motif and respective supermotif is indicated in the description of the individual motifs.

III.D.1. HLA-A1 Supermotif

The HLA-A1 supermotif is characterized by the presence in peptide ligands of a small (T or S) or hydrophobic (L, I, V, or M) primary anchor residue in position 2, and an aromatic (Y, F, or W) primary anchor residue at the C-terminal position of the epitope. The corresponding family of HLA molecules that bind to the A1 supermotif (i.e., the HLA-A1 supertype) is comprised of at least A*0101, A*2601, A*2602, A*2501, and A*3201 (see, e.g., DiBrino, M. et al., *J. Immunol.* 151:5930, 1993; DiBrino, M. et al., *J. Immunol.* 152:620, 1994; Kondo, A. et al., *Immunogenetics* 45:249, 1997). Other allele-specific HLA molecules predicted to be members of the A1 superfamily are shown in Table VI. Peptides binding to each of the individual HLA proteins can be modulated by substitutions at primary and/or secondary anchor positions, preferably choosing respective residues specified for the supermotif.

Representative peptide epitopes that comprise the A1 supermotif are set forth in Table VII.

III.D.2. HLA-A2 Supermotif

Primary anchor specificities for allele-specific HLA-A2.1 molecules (see, e.g., Falk et al., *Nature* 351:290–296, 1991; Hunt et al., *Science* 255:1261–1263, 1992; Parker et al., *J. Immunol.* 149:3580–3587, 1992; Ruppert et al., *Cell* 74:929–937, 1993) and cross-reactive binding among HLA-A2 and -A28 molecules have been described. (See, e.g., Fruci et al., *Human Immunol.* 38:187–192, 1993; Tanigaki et al., *Human Immunol.* 39:155–162, 1994; Del Guercio et al., *J. Immunol.* 154:685–693, 1995; Kast et al., *J. Immunol.* 152:3904–3912, 1994 for reviews of relevant data.) These primary anchor residues define the HLA-A2 supermotif; which presence in peptide ligands corresponds to the ability to bind several different HLA-A2 and -A28 molecules. The HLA-A2 supermotif comprises peptide ligands with L, I, V, M, A, T, or Q as a primary anchor residue at position 2 and L, I, V, M, A, or T as a primary anchor residue at the C-terminal position of the epitope.

The corresponding family of HLA molecules (i.e., the HLA-A2 supertype that binds these peptides) is comprised of at least: A*0201, A*0202, A*0203, A*0204, A*0205, A*0206, A*0207, A*0209, A*0214, A*6802, and A*6901. Other allele-specific HLA molecules predicted to be members of the A2 superfamily are shown in Table VI. As explained in detail below, binding to each of the individual allele-specific HLA molecules can be modulated by substitutions at the primary anchor and/or secondary anchor positions, preferably choosing respective residues specified for the supermotif.

Representative peptide epitopes that comprise an A2 supermotif are set forth in Table VIII. The motifs comprising the primary anchor residues V, A, T, or Q at position 2 and L, I, V, A, or T at the C-terminal position are those most particularly relevant to the invention claimed herein.

III.D.3. HLA-A3 Supermotif

The HLA-A3 supermotif is characterized by the presence in peptide ligands of A, L, I, V, M, S, or, T as a primary anchor at position 2, and a positively charged residue, R or K, at the C-terminal position of the epitope, e.g., in position 9 of 9-mers (see, e.g., Sidney et al, *Hum. Immunol.* 45:79, 1996). Exemplary members of the corresponding family of HLA molecules (the HLA-A3 supertype) that bind the A3 supermotif include at least A*0301, A*1101, A 3101, A*3301, and A*6801. Other allele-specific HLA molecules predicted to be members of the A3 supertype are shown in Table VI. As explained in detail below, peptide binding to each of the individual allele-specific HLA proteins can be modulated by substitutions of amino acids at the primary and/or secondary anchor positions of the peptide, preferably choosing respective residues specified for the supermotif.

Representative peptide epitopes that comprise the A3 supermotif are set forth in Table IX.

III.D.4. HLA-A24 Supermotif

The HLA-A24 supermotif is characterized by the presence in peptide ligands of an aromatic (F, W, or Y) or hydrophobic aliphatic (L, I, V, M, or T) residue as a primary anchor in position 2, and Y, F, W, L, I, or M as primary anchor at the C-terminal position of the epitope (see, e.g., Sette and Sidney, *Immunogenetics*, in press, 1999). The corresponding family of HLA molecules that bind to the A24 supermotif (i.e., the A24 supertype) includes at least A*2402, A*3001, and A*2301. Other allele-specific HLA molecules predicted to be members of the A24 supertype are shown in Table VI. Peptide binding to each of the allele-specific HLA molecules can be modulated by substitutions at primary and/or secondary anchor positions, preferably choosing respective residues specified for the supermotif.

Representative peptide epitopes that comprise the A24 supermotif are set forth in Table X.

III.D.5. HLA-B7 Supermotif

The HLA-B7 supermotif is characterized by peptides bearing proline in position 2 as a primary anchor, and a hydrophobic or aliphatic amino acid (L, I, V, M, A, F, W, or Y) as the primary anchor at the C-terminal position of the epitope. The corresponding family of HLA molecules that bind the B7 supermotif (i.e., the HLA-B7 supertype) is comprised of at least twenty six HLA-B proteins including: B*0702, B*0703, B*0704, B*0705, B*1508, B*3501, B*3502, B*3503, B*3504, B*3505, B 3506,B*3507, B*3508, B*5101, B*5102, B*5103, B*5104, B*5105, B*5301, B*5401, B*5501, B*5502, B*5601, B*5602, B*6701, and B*7801 (see, e.g., Sidney, et al., *J. Immunol.* 154:247, 1995; Barber, et al., *Curr. Biol.* 5:179, 1995; Hill, et al., *Nature* 360:434, 1992; Rammensee, et al., *Immunogenetics* 41:178, 1995 for reviews of relevant data). Other allele-specific HLA molecules predicted to be members of the B7 supertype are shown in Table VI. As explained in detail below, peptide binding to each of the individual allele-specific HLA proteins can be modulated by substitutions at the primary and/or secondary anchor positions of the peptide, preferably choosing respective residues specified for the supermotif.

Representative peptide epitopes that comprise the 137 supermotif are set forth in Table XI.

III.D.6. HLA-B27 Supermotif

The HLA-B27 supermotif is characterized by the presence in peptide ligands of a positively charged (R, H, or K) residue as a primary anchor at position 2, and a hydrophobic (F, Y, L, W, M, I, A, or V) residue as a primary anchor at the C-terminal position of the epitope (see, e.g., Sidney and Sette, *Immunogenetics*, in press, 1999). Exemplary members of the corresponding family of HLA molecules that bind to the B27 supermotif (i.e., the B27 supertype) include at least B*1401, B*1402, B*1509, B*2702, B*2703, B*2704, B*2705, B*2706, B*3801, B*3901, B*3902, and B*7301. Other allele-specific HLA molecules predicted to be members of the B27 supertype are shown in Table VI. Peptide binding to each of the allele-specific HLA molecules can be modulated by substitutions at primary and/or secondary anchor positions, preferably choosing respective residues specified for the supermotif.

Representative peptide epitopes that comprise the B27 supermotif are set forth in Table XII.

III.D.7. HLA-B44 Supermotif

The HLA-B44 supermotif is characterized by the presence in peptide ligands of negatively charged (D or E) residues as a primary anchor in position 2, and hydrophobic residues (F, W, Y, L, I, M, V, or A) as a primary anchor at the C-terminal position of the epitope (see, e.g., Sidney et al., *Immunol. Today* 17:261, 1996). Exemplary members of the corresponding family of HLA molecules that bind to the B44 supermotif(i.e., the B44 supertype) include at least: B*1801, B*1802, B*3701, B*4001, B*4002, B*4006, B 4402, B*4403, and B*4006. Peptide binding to each of the allele-specific HLA molecules can be modulated by substitutions at primary and/or secondary anchor positions; preferably choosing respective residues specified for the supermotif.

III.D.8. HLA-B58 Supermotif

The HLA-B58 supermotif is characterized by the presence in peptide ligands of a small aliphatic residue (A, S, or T) as a primary anchor residue at position 2, and an aromatic or hydrophobic residue (F, W, Y, L, I, V, M, or A) as a primary anchor residue at the C-terminal position of the epitope (see, e.g., Sidney and Sette, *Immunogenetics*, in press, 1999 for reviews of relevant data). Exemplary members of the corresponding family of HLA molecules that bind to the B58 supermotif (i.e., the B58 supertype) include at least: B*1516, B*1517, B*5701, B*5702, and B*5801. Other allele-specific HLA molecules predicted to be members of the B58 supertype are shown in Table VI. Peptide binding to each of the allele-specific HLA molecules can be modulated by substitutions at primary and/or secondary anchor positions, preferably choosing respective residues specified for the supermotif.

Representative peptide epitopes that comprise the B58 supermotif are set forth in Table XIII.

III.D.9. HLA-B62 Supermotif

The HLA-B62 supermotif is characterized by the presence in peptide ligands of the polar aliphatic residue Q or a hydrophobic aliphatic residue (L, V, M, I, or P) as a primary anchor in position 2, and a hydrophobic residue (F, W, Y, M, I, V, L, or A) as a primary anchor at the C-terminal position of the epitope (see, e.g., Sidney and Sette, *Immunogenetics*, in press, 1999). Exemplary members of the corresponding family of HLA molecules that bind to the B62 supermotif (i.e., the B62 supertype) include at least: B*1501, B*1502, B*1513, and B5201. Other allele-specific HLA molecules predicted to be members of the B62 supertype are shown in Table VI. Peptide binding to each of the allele-specific HLA molecules can be modulated by substitutions at primary and/or secondary anchor positions, preferably choosing respective residues specified for the supermotif.

Representative peptide epitopes that comprise the B62 supermotif are set forth in Table XIV.

III.D.10. HLA-A1 Motif

The HLA-A1 motif is characterized by the presence in peptide ligands of T, S, or M as a primary anchor residue at position 2 and the presence of Y as a primary anchor residue at the C-terminal position of the epitope. An alternative allele-specific A1 motif is characterized by a primary anchor residue at position 3 rather than position 2. This motif is characterized by the presence of D, E, A, or S as a primary anchor residue in position 3, and a Y as a primary anchor residue at the C-terminal position of the epitope (see, e.g., DiBrino et al., *J. Immunol.*, 152:620, 1994; Kondo et al., *Immunogenetics* 45:249, 1997; and Kubo et al., *J. Immunol.* 152:3913, 1994 for reviews of relevant data). Peptide binding to HLA A1 can be modulated by substitutions at primary and/or secondary anchor positions, preferably choosing respective residues specified for the motif.

Representative peptide epitopes that comprise either A1 motif are set forth in Table XV. Those epitopes comprising T, S, or M at position 2 and Y at the C-terminal position are also included in the listing of HLA-A1 supermotif-bearing peptides listed in Table VII, as these residues are a subset of the A1 supermotif primary anchors.

III.D.11. HLA-A*0201 Motif

An HLA-A2*0201 motif was determined to be characterized by the presence in peptide ligands of L or M as a primary anchor residue in position 2, and L or V as a primary anchor residue at the C-terminal position of a 9-residue peptide (see, e.g., Falk et al., *Nature* 351:290–296,1991) and was further found to comprise an I at position 2 and I or A at the C-terminal position of a nine amino acid peptide (see, e.g., Hunt et al., *Science* 255:1261–1263, Mar. 6, 1992; Parker et al., *J. Immunol.* 149:3580–3587, 1992). The A*0201 allele-specific motif has also been defined by the present inventors to additionally comprise V, A, T, or Q as a primary anchor residue at position 2, and M or T as a primary anchor residue at the C-terminal position of the epitope (see, e.g., Kast et al., *J. Immunol.* 152:3904–3912, 1994). Thus, the HLA-A*0201 motif comprises peptide ligands with L, I, V, M, A, T, or Q as primary anchor residues at position 2 and L, I, V, M, A, or T as a primary anchor residue at the C-terminal position of the epitope. The preferred and tolerated residues that characterize the primary anchor positions of the HLA-A*0201 motif are identical to the residues describing the A2 supermotif. (For reviews of relevant data, see, e.g., Del Guercio et al., *J. Immunol.* 154:685–693, 1995; Ruppert et al., *Cell* 74:929–937, 1993; Sidney et al., *Immunol. Today* 17:261–266, 1996; Sette and Sidney, *Curr. Opin. in Immunol.* 10:478–482, 1998). Secondary anchor residues that characterize the A 0201 motif have additionally been defined (see, e.g., Ruppert et al., *Cell* 74:929–937, 1993). These are shown in Table II. Peptide binding to HLA-A 0201 molecules can be modulated by substitutions at primary and/or secondary anchor positions, preferably choosing respective residues specified for the motif.

Representative peptide epitopes that comprise an A*0201 motif are set forth in Table VIII. The A*0201 motifs comprising the primary anchor residues V, A, T, or Q at position 2 and L, I, V, A, or T at the C-terminal position are those most particularly relevant to the invention claimed herein.

III.D.12. HLA-A3 Motif

The HLA-A3 motif is characterized by the presence in peptide ligands of L, M, V, I, S, A, T, F, C, G, or D as a primary anchor residue at position 2, and the presence of K, Y, R, H, F, or A as a primary anchor residue at the C-terminal position of the epitope (see, e.g., DiBrino et al., *Proc. Natl. Acad. Sci USA* 90:1508,1993; and Kubo et al., *J. Immunol.* 152:3913–3924, 1994). Peptide binding to HLA-A3 can be modulated by substitutions at primary and/or secondary anchor positions, preferably choosing respective residues specified for the motif.

Representative peptide epitopes that comprise the A3 motif are set forth in Table XVI. Those epitopes that also comprise the A3 supermotif are also listed in Table IX. The A3 supermotif primary anchor residues comprise a subset of the A3- and A11-allele specific motif primary anchor residues.

III.D.13. HLA-A11 Motif

The HLA-A11 motif is characterized by the presence in peptide ligands of V, T, M, L, I, S, A, G, N, C, D, or F as a primary anchor residue in-position 2, and K, R, Y, or H as a primary anchor residue at the C-terminal position of the epitope (see, e.g., Zhang et al., *Proc. Natl. Acad. Sci USA* 90:2217–2221, 1993; and Kubo et al., *J. Immunol.* 152:3913–3924, 1994). Peptide binding to HLA-A11 can be modulated by substitutions at primary and/or secondary anchor positions, preferably choosing respective residues specified for the motif.

Representative peptide epitopes that comprise the A11 motif are set forth in Table XVII; peptide epitopes comprising the A3 allele-specific motif are also present in this Table because of the extensive overlap between the A3 and A11 motif primary anchor specificities. Further, those peptide epitopes that comprise the A3 supermotif are also listed in Table IX.

III.D.14. HLA-A24 Motif

The HLA-A24 motif is characterized by the presence in peptide ligands of Y, F, W, or M as a primary anchor residue in position 2, and F, L, I, or W as a primary anchor residue at the C-terminal position of the epitope (see, e.g., Kondo et al., *J. Immunol.* 155:4307–4312, 1995; and Kubo et al., *J. Immunol.* 152:3913–3924, 1994). Peptide binding to HLA-A24 molecules can be modulated by substitutions at primary and/or secondary anchor positions; preferably choosing respective residues specified for the motif.

Representative peptide epitopes that comprise the A24 motif are set forth in Table XVIII. These epitopes are also listed in Table X, which sets forth HLA-A24-supermotif-bearing peptides, as the primary anchor residues characterizing the A24 allele-specific motif comprise a subset of the A24 supermotif primary anchor residues.

Motifs Indicative of Class II HTL Inducing Peptide Epitopes

The primary and secondary anchor residues of the HLA class II peptide epitope supermotifs and motifs delineated below are summarized in Table III.

III.D.15. HLA DR-1-4-7 Supermotif

Motifs have also been identified for peptides that bind to three common HLA class II allele-specific HLA molecules: HLA DRB1*0401, DRB1*0101, and DRB1*0701 (see, e.g., the review by Southwood et al. *J. Immunology* 160:3363–3373,1998). Collectively, the common residues from these motifs delineate the HLA DR-1-4-7 supermotif. Peptides that bind to these DR molecules carry a supermotif characterized by a large aromatic or hydrophobic residue (Y, F, W, L, I, V, or M) as a primary anchor residue in position 1, and a small, non-charged residue (S, T, C, A, P, V, I, L, or M) as a primary anchor residue in position 6 of a 9-mer core region. Allele-specific secondary effects and secondary anchors for each of these HLA types have also been identified (Southwood et al., supra). These are set forth in Table III. Peptide binding to HLA- DRB1*0401, DRB1*0101, and/or DRB1*0701 can be modulated by substitutions at primary and/or secondary anchor positions, preferably choosing respective residues specified for the supermotif.

Representative 9-mer epitopes comprising the DR-1-4-7 supermotif, wherein position 1 of the supermotif is at position 1 of the nine-residue core, are set forth in Table XIX. Respective exemplary peptide epitopes of 15 amino acid residues in length, each of which comprise a conserved nine residue core, are also shown in the Table.

III.D.16. HLA DR3 Motifs

Two alternative motifs (i.e., submotifs) characterize peptide epitopes that bind to HLA-DR3 molecules (see, e.g., Geluk et al., *J. Immunol.* 152:5742, 1994). In the first motif (submotif DR3A) a large, hydrophobic residue (L, I, V, M, F, or Y) is present in anchor position 1 of a 9-mer core, and D is present as an anchor at position 4, towards the carboxyl terminus of the epitope. As in other class II motifs, core position 1 may or may not occupy the peptide N-terminal position.

The alternative DR3 submotif provides for lack of the large, hydrophobic residue at anchor position 1, and/or lack of the negatively charged or amide-like anchor residue at position 4, by the presence of a positive charge at position 6 towards the carboxyl terminus of the epitope. Thus, for the alternative allele-specific DR3 motif (submotif DR3B): L, I, V, M, F, Y, A, or Y is present at anchor position 1; D, N, Q, E, S, or T is present at anchor position 4; and K, R, or H is present at anchor position 6. Peptide binding to HLA-DR3 can be modulated by substitutions at primary and/or secondary anchor positions, preferably choosing respective residues specified for the motif.

Representative 9-mer epitopes corresponding to a nine residue sequence comprising the DR3a and DR3b submotifs (wherein position 1 of the motif is at position 1 of the nine residue core) are set forth in Table XXa and b. Respective exemplary peptide epitopes of 15 amino acid residues in length, each of which comprise a conserved nine residue core, are also shown in Table XX.

Each of the HLA class I or class II epitopes set out in the Tables herein are deemed singly to be an inventive aspect of this application. Further, it is also an inventive aspect of this application that each epitope may be used in combination with any other epitope.

III.E. Enhancing Population Coverage of the Vaccine

Vaccines that have broad population coverage are preferred because they are more commercially viable and generally applicable to the most people. Broad population coverage can be obtained using the peptides of the invention (and nucleic acid compositions that encode such peptides) through selecting peptide epitopes that bind to HLA alleles which, when considered in total, are present in most of the population. Table XXI lists the overall frequencies of the HLA class I supertypes in various ethnicities (Table XXIa) and the combined population coverage achieved by the A2-, A3-, and B7-supertypes (Table XXIb). The A2-, A3-, and B7 supertypes are each present on the average of over 40% in each of these five major ethnic groups. Coverage in excess of 80% is achieved with a combination of these supermotifs. These results suggest that effective and non-ethnically biased population coverage is achieved upon use of a limited number of cross-reactive peptides. Although the population coverage reached with these three main peptide specificities is high, coverage can be expanded to reach 95% population coverage and above, and more easily achieve truly multi specific responses upon use of additional supermotif or allele-specific motif bearing peptides.

The B44-, A1-, and A24-supertypes are each present, on average, in a range from 25% to 40% in these major ethnic populations (Table XXIa). While less prevalent overall, the B27-, B58-, and B62 supertypes are each present with a frequency >25% in at least one major ethnic group (Table XXIa). Table XXIb summarizes the estimated prevalence of combinations of HLA supertypes that have been identified in five major ethnic groups. The incremental coverage obtained by the inclusion of A1,- A24-, and B44-supertypes to the A2, A3, and B7 coverage and coverage obtained with all of the supertypes described herein, is shown.

The data presented herein, together with the previous definition of the A2-, A3-, and B7-supertypes, indicates that all antigens, with the possible exception of A29, B8, and B46, can be classified into a total of nine HLA supertypes. By including epitopes from the six most frequent supertypes, an average population coverage of 99% is obtained for five major ethnic groups.

III.F. Immune Response-Stimulating Peptide Analogs

In general, CTL and HTL responses to whole antigens are not directed against all possible epitopes. Rather, they are restricted to a few "immunodominant" determinants (Zinkemagel, et al., *Adv. Immunol.* 27:5159, 1979; Bennink, et al., *J. Exp. Med.* 168:19351939, 1988; Rawle, et al., *J. Immunol.* 146:3977–3984,1991). It has been recognized that immunodominance (Benacerraf, et al., *Science* 175:273–279, 1972) could be explained by either the ability of a given epitope to selectively bind a particular HLA protein (determinant selection theory) (Vitiello, et al, *J. Immunol.* 131:1635, 1983); Rosenthal, et al., *Nature* 267:156–158, 1977), or to be selectively recognized by the existing TCR (T cell receptor) specificities (repertoire theory) (Klein, J. , IMMUNOLOGY, THE SCIENCE OF SELFNON-SELF DISCRIMINATION, John Wiley & Sons, New York, pp. 270–310, 1982). It has been demonstrated that additional factors, mostly linked to processing events, can also play a key role in dictating, beyond strict immunogenicity, which of the many potential determinants will be presented as immunodominant (Sercarz, et al., *Annu. Rev. Immunol.* 11:729–766, 1993).

The concept of dominance and subdominance is relevant to immunotherapy of both infectious diseases and cancer. For example, in the course of chronic viral disease, recruitment of subdominant epitopes can be important for successful clearance of the infection, especially if dominant CTL or HTL specificities have been inactivated by functional tolerance, suppression, mutation of viruses and other mechanisms (Franco, et al., *Curr. Opin. Immunol.* 7:524–531, 1995). In the case of cancer and tumor antigens, CTLs recognizing at least some of the highest binding affinity peptides might be functionally inactivated. Lower binding affinity peptides are preferentially recognized at these times, and may therefore be preferred in therapeutic or prophylactic anti-cancer vaccines.

In particular, it has been noted that a significant number of epitopes derived from known non-viral tumor associated antigens (TAA) bind HLA class I with intermediate affinity ($IC_{50}$ in the 50–500 nM range). For example, it has been found that 8 of 15 known TAA peptides recognized by tumor infiltrating lymphocytes (TIL) or CTL bound in the 50–500 nM range. (These data are in contrast with estimates that 90% of known viral antigens were bound by HLA class I molecules with $IC_{50}$ of 50 nM or less, while only approximately 10% bound in the 50–500 nM range (Sette, et al., *J. Immunol.*, 153:558–5592, 1994). In the cancer setting this phenomenon is probably due to elimination or functional inhibition of the CTL recognizing several of the highest binding peptides, presumably because of T cell tolerization events.

Without intending to be bound by theory, it is believed that because T cells to dominant epitopes may have been clonally deleted, selecting subdominant epitopes may allow existing T cells to be recruited, which will then lead to a therapeutic or prophylactic response. However, the binding of HLA molecules to subdominant epitopes is often less vigorous than to dominant ones. Accordingly, there is a need to be able to modulate the binding affinity of particular immunogenic epitopes for one or more HLA molecules, and thereby to modulate the immune response elicited by the peptide, for example to prepare analog peptides which elicit a more vigorous response. This ability would greatly enhance the usefulness of peptide epitope-based vaccines and therapeutic agents.

Although peptides with suitable cross-reactivity among all alleles of a superfamily are identified by the screening procedures described above, cross-reactivity is not always as complete as possible, and in certain cases procedures to increase cross-reactivity of peptides can be useful; moreover, such procedures can also be used to modify other properties of the peptides such as binding affinity or peptide stability. Having established the general rules that govern cross-reactivity of peptides for HLA alleles within a given motif or supermotif, modification (i.e., analoging) of the structure of peptides of particular interest in order to achieve broader (or otherwise modified) HLA binding capacity can be performed. More specifically, peptides which exhibit the broadest cross-reactivity patterns, can be produced in accordance with the teachings herein. The present concepts related to analog generation are set forth in greater detail in co-pending U.S. Ser. No. 09/226,775 filed Jan. 6, 1999.

In brief, the strategy employed utilizes the motifs or supermotifs which correlate with binding to certain HLA molecules. The motifs or supermotifs are defined by having primary anchors, and in many cases secondary anchors. Analog peptides can be created by substituting amino acid residues at primary anchor, secondary anchor, or at primary and secondary anchor positions. Generally, analogs are made for peptides that already bear a motif or supermotif. Preferred secondary anchor residues of supermotifs and motifs that have been defined for HLA class I and class II binding peptides are shown in Tables II and III, respectively.

For a number of the motifs or supermotifs in accordance with the invention, residues are defined which are deleterious to binding to allele-specific HLA molecules or members of HLA supertypes that bind the respective motif or supermotif (Tables II and III). Accordingly, removal of such residues that are detrimental to binding can be performed in accordance with the present invention. For example, in the case of the A3 supertype, when all peptides that have such deleterious residues are removed from the population of peptides used in the analysis, the incidence of cross-reactivity increased from 22% to 37% (see, e.g., Sidney, J. et al., *Hu. Immunol.* 45:79, 1996). Thus, one strategy to improve the cross-reactivity of peptides within a given supermotif is simply to delete one or more of the deleterious residues present within a peptide and substitute a small "neutral" residue such as Ala (that may not influence T cell recognition of the peptide). An enhanced likelihood of cross-reactivity is expected if, together with elimination of detrimental residues within a peptide, "preferred" residues associated with high affinity binding to an allele-specific HLA molecule or to multiple HLA molecules within a superfamily are inserted.

To ensure that an analog peptide, when used as a vaccine, actually elicits a CTL response to the native epitope in vivo (or, in the case of class II epitopes, elicits helper T cells that cross-react with the wild type peptides), the analog peptide may be used to immunize T cells in vitro from individuals of the appropriate HLA allele. Thereafter, the immunized cells' capacity to induce lysis of wild type peptide sensitized target cells is evaluated. It will be desirable to use as antigen presenting cells, cells that have been either infected, or transfected with the appropriate genes, or, in the case of class II epitopes only, cells that have been pulsed with whole protein antigens, to establish whether endogenously produced antigen is also recognized by the relevant T cells.

Another embodiment of the invention is to create analogs of weak binding peptides, to thereby ensure adequate numbers of cross-reactive cellular binders. Class I binding peptides exhibiting binding affinities of 500–5000 nM, and carrying an acceptable but suboptimal primary anchor residue at one or both positions can be "fixed" by substituting preferred anchor residues in accordance with the respective supertype. The analog peptides can then be tested for crossbinding activity.

Another embodiment for generating effective peptide analogs involves the substitution of residues that have an adverse impact on peptide stability or solubility in, e.g., a liquid environment. This substitution may occur at any position of the peptide epitope. For example, a cysteine (C) can be substituted out in favor of α-amino butyric acid. Due to its chemical nature, cysteine has the propensity to form disulfide bridges and sufficiently alter the peptide structurally so as to reduce binding capacity. Substituting α-amino butyric acid for C not only alleviates this problem, but actually improves binding and crossbinding capability in certain instances (see, e.g., the review by Sette et al., In: *Persistent Viral Infections*, Eds. R. Ahmed and I. Chen, John Wiley & Sons, England, 1999). Substitution of cysteine with a-amino butyric acid may occur at any residue of a peptide epitope, i.e. at either anchor or non-anchor positions.

III.G. Computer Screening of Protein Sequences from Disease-Related Antigens for Supermotif- or Motif-Bearing Peptides In order to identify supermotif- or motif-bearing epitopes in a target antigen, a native protein sequence, e.g., a tumor-associated antigen, or sequences from an infectious organism, or a donor tissue for transplantation, is screened using a means for computing, such as an intellectual calculation or a computer, to determine the presence of a supermotif or motif within the sequence. The information obtained from the analysis of native peptide can be used directly to evaluate the status of the native peptide or may be utilized subsequently to generate the peptide epitope.

Computer programs that allow the rapid screening of protein sequences for the occurrence of the subject supermotifs or motifs are encompassed by the present invention; as are programs that permit the generation of analog peptides. These programs are implemented to analyze any identified amino acid sequence or operate on an unknown sequence and simultaneously determine the sequence and identify motif-bearing epitopes thereof; analogs can be simultaneously determined as well. Generally, the identified sequences will be from a pathogenic organism or a tumor-associated peptide. For example, the target molecules considered herein include, without limitation, the E1, E2, E4, E5a, E5b, E6, E7, L1 and L2 proteins of HPV.

In cases where the sequences of multiple variants of the same target protein are available, potential peptide epitopes can also be selected on the basis of their conservancy. For example, a criterion for conservancy may define that the entire sequence of an HLA class I binding peptide or the entire 9-mer core of a class II binding peptide, be conserved in a designated percentage, of the sequences evaluated for a specific protein antigen.

To target a broad population that may be infected with a number of different strains, it is preferable to include in vaccine compositions epitopes that are representative of HPV antigen sequences from different HPV strains. As appreciated by those in the art, regions with greater or lessor degrees of conservancy among HPV 6a, HPV 6b and/or HPV 11 can be employed as appropriate for a given antigenic target.

It is important that the selection criteria utilized for prediction of peptide binding are as accurate as possible, to correlate most efficiently with actual binding. Prediction of peptides that bind, for example, to HLA-A*0201, on the basis of the presence of the appropriate primary anchors, is positive at about a 30% rate (see, e.g., Ruppert, J. et al. *Cell* 74:929, 1993). However, by extensively analyzing peptide-HLA binding data disclosed herein, data in related patent applications, and data in the art, the present inventors have developed a number of allele-specific polynomial algorithms that dramatically increase the predictive value over identification on the basis of the presence of primary anchor residues alone. These algorithms take into account not only the presence or absence of primary anchors, but also consider the positive or deleterious presence of secondary anchor residues (to account for the impact of different amino acids at different positions). The algorithms are essentially based on the premise that the overall affinity (or ΔG) of peptide-HLA interactions can be approximated as a linear polynomial function of the type:

$$\Delta G = a_{1i} \times a_{2i} \times a_{3i} \ldots \times a_{ni}$$

where $a_{ji}$ is a coefficient that represents the effect of the presence of a given amino acid (j) at a given position (i) along the sequence of a peptide of n amino acids. An important assumption of this method is that the effects at each position are essentially independent of each other. This assumption is justified by studies that demonstrated that peptides are bound to HLA molecules and recognized by T cells in essentially an extended conformation. Derivation of specific algorithm coefficients has been described, for example, in Gulukota, K. et al., *J. Mol. Biol.* 267:1258, 1997.

Additional methods to identify preferred peptide sequences, which also make use of specific motifs, include the use of neural networks and molecular modeling programs (see, e.g., Milik et al., *Nature Biotechnology* 16:753, 1998; Altuvia et al., *Hum. Immunol.* 58:1, 1997; Altuvia et al, *J. Mol. Biol.* 249:244, 1995; Buus, S. *Curr. Opin. Immunol.* 11:209–213, 1999; Brusic, V. et al., *Bioinformatics* 14:121–130, 1998; Parker et al., *J. Immunol.* 152:163, 1993; Meister et al., *Vaccine* 13:581, 1995; Hammer et al., *J. Exp. Med.* 180:2353, 1994; Sturniolo et al., *Nature Biotechnol.* 17:555 1999).

For example, it has been shown that in sets of A*0201 motif-bearing peptides containing at least one preferred secondary anchor residue while avoiding the presence of any deleterious secondary anchor residues, 69% of the peptides will bind A*0201 with an $IC_{50}$ less than 500 nM (Ruppert, J. et al. *Cell* 74:929, 1993). These algorithms are also flexible in that cut-off scores may be adjusted to select sets of peptides with greater or lower predicted binding properties, as desired.

In utilizing computer screening to identify peptide epitopes, a protein sequence or translated sequence may be analyzed using software developed to search for motifs, for example the "FINDPATTERNS" program (Devereux, et al. *Nucl. Acids Res.* 12:387–395, 1984) or MotifSearch 1.4 software program (D. Brown, San Diego, Calif.) to identify potential peptide sequences containing appropriate HLA binding motifs. The identified peptides can be scored using customized polynomial algorithms to predict their capacity to bind specific HLA class I or class II alleles. As appreciated by one of ordinary skill in the art, a large array of computer programming software and hardware options are available in the relevant art which can be employed to implement the motifs of the invention in order to evaluate (e.g., without limitation, to identify epitopes, identify epitope concentration per peptide length, or to generate analogs) known or unknown peptide sequences.

In accordance with the procedures described above, HPV peptide epitopes and analogs thereof that are able to bind HLA supertype groups or allele-specific HLA molecules have been identified (Tables VII–XX).

III.H. Preparation of Peptide Epitopes

Peptides in accordance with the invention can be prepared synthetically, by recombinant DNA technology or chemical synthesis, or from natural sources such as native tumors or pathogenic organisms. Peptide epitopes may be synthesized individually or as polyepitopic peptides. Although the peptide will preferably be substantially free of other naturally occurring host cell proteins and fragments thereof, in some embodiments the peptides may be synthetically conjugated to native fragments or particles.

The peptides in accordance with the invention can be a variety of lengths, and either in their neutral (uncharged) forms or in forms which are salts. The peptides in accordance with the invention are either free of modifications such as glycosylation, side chain oxidation, or phosphorylation; or they contain these modifications, subject to the condition that modifications do not destroy the biological activity of the peptides as described herein.

When possible, it may be desirable to optimize HLA class I binding epitopes of the invention, such as can be used in a polyepitopic construct, to a length of about 8 to about 13 amino acid residues, often 8 to 11, preferably 9 to 10. HLA class II binding peptide epitopes of the invention may be optimized to a length of about 6 to about 30 amino acids in length, preferably to between about 13 and about 20 residues. Preferably, the peptide epitopes are commensurate in size with endogenously processed pathogen-derived peptides or tumor cell peptides that are bound to the relevant HLA molecules, however, the identification and preparation of peptides that comprise epitopes of the invention can also be carried out using the techniques described herein.

In alternative embodiments, epitopes of the invention can be linked as a polyepitopic peptide, or as a minigene that encodes a polyepitopic peptide.

In another embodiment, it is preferred to identify native peptide regions that contain a high concentration of class I and/or class II epitopes. Such a sequence is generally selected on the basis that it contains the greatest number of epitopes per amino acid length. It is to be appreciated that epitopes can be present in a nested or overlapping manner, e.g. a 10 amino acid long peptide could contain two 9 amino acid long epitopes and one 10 amino acid long epitope; upon intracellular processing, each epitope can be exposed and bound by an HLA molecule upon administration of such a peptide. This larger, preferably multi-epitopic, peptide can be generated synthetically, recombinantly, or via cleavage from the native source.

The peptides of the invention can be prepared in a wide variety of ways. For the preferred relatively short size, the peptides can be synthesized in solution or on a solid support in accordance with conventional techniques. Various automatic synthesizers are commercially available and can be used in accordance with known protocols. (See, for example, Stewart & Young, SOLID PHASE PEPTIDE SYNTHESIS, 2D. ED., Pierce Chemical Co., 1984). Further, individual peptide epitopes can be joined using chemical ligation to produce larger peptides that are still within the bounds of the invention.

Alternatively, recombinant DNA technology can be employed wherein a nucleotide sequence which encodes an immunogenic peptide of interest is inserted into an expression vector, transformed or transfected into an appropriate host cell and cultivated under conditions suitable for expression. These procedures are generally known in the art, as described generally in Sambrook et al., MOLECULAR CLONING, A LABORATORY MANUAL, Cold Spring Harbor Press, Cold Spring Harbor, N.Y. (1989). Thus, recombinant polypeptides which comprise one or more peptide sequences of the invention can be used to present the appropriate T cell epitope.

The nucleotide coding sequence for peptide epitopes of the preferred lengths contemplated herein can be synthesized by chemical techniques, for example, the phosphotriester method of Matteucci, et al., *J. Am. Chem. Soc.* 103:3185 (1981). Peptide analogs can be made simply by substituting the appropriate and desired nucleic acid base(s) for those that encode the native peptide sequence; exemplary nucleic acid substitutions are those that encode an amino acid defined by the motifs/supermotifs herein. The coding sequence can then be provided with appropriate linkers and ligated into expression vectors commonly available in the art, and the vectors used to transform suitable hosts to produce the desired fusion protein. A number of such vectors and suitable host systems are now available. For expression of the fusion proteins, the coding sequence will be provided with operably linked start and stop codons, promoter and terminator regions and usually a replication system to provide an expression vector for expression in the desired cellular host. For example, promoter sequences compatible with bacterial hosts are provided in plasmids containing convenient restriction sites for insertion of the desired coding sequence. The resulting expression vectors are transformed into suitable bacterial hosts. Of course, yeast, insect or mammalian cell hosts may also be used, employing suitable vectors and control sequences.

III.I. Assays to Detect T-Cell Responses

Once HLA binding peptides are identified, they can be tested for the ability to elicit a T-cell response. The preparation and evaluation of motif-bearing peptides are described in PCT publications WO 94/20127 and WO 94/03205. Briefly, peptides comprising epitopes from a particular antigen are synthesized and tested for their ability to bind to the appropriate HLA proteins. These assays may involve evaluating the binding of a peptide of the invention to purified HLA class I molecules in relation to the binding of a radioiodinated reference peptide. Alternatively, cells expressing empty class I molecules (i.e. lacking peptide therein) may be evaluated for peptide binding by immunofluorescent staining and flow microfluorimetry. Other assays that may be used to evaluate peptide binding include peptide-dependent class I assembly assays and/or the inhibition of CTL recognition by peptide competition. Those peptides that bind to the class I molecule, typically with an affinity of 500 nM or less, are further evaluated for their ability to serve as targets for CTLs derived from infected or immunized individuals, as well as for their capacity to induce primary in vitro or in vivo CTL responses that can give rise to CTL populations capable of reacting with selected target cells associated with a disease.

Analogous assays are used for evaluation of HLA class II binding peptides. HLA class II motif-bearing peptides that are shown to bind, typically at an affinity of 1000 nM or less, are further evaluated for the ability to stimulate HTL responses.

Conventional assays utilized to detect T cell responses include proliferation assays, lymphokine secretion assays, direct cytotoxicity assays, and limiting dilution assays. For example, antigen-presenting cells that have been incubated with a peptide can be assayed for the ability to induce CTL responses in responder cell populations. Antigen-presenting cells can be normal cells such as peripheral blood mononuclear cells or dendritic cells. Alternatively, mutant non-human mammalian cell lines that are deficient in their ability to load class I molecules with internally processed peptides and that have been transfected with the appropriate human class I gene, may be used to test for the capacity of the peptide to induce in vitro primary CTL responses.

Peripheral blood mononuclear cells (PBMCs) may be used as the responder cell source of CTL precursors. The appropriate antigen-presenting cells are incubated with peptide, after which the peptide-loaded antigen-presenting cells are then incubated with the responder cell population under optimized culture conditions. Positive CTL activation can be determined by assaying the culture for the presence of CTLs that kill radio-labeled target cells, both specific peptide-pulsed targets as well as target cells expressing endogenously processed forms of the antigen from which the peptide sequence was derived.

Additionally, a method has been devised which allows direct quantification of antigen-specific T cells by staining with Fluorescein-labelled HLA tetrameric complexes (Altman, J. D. et al., *Proc. Natl. Acad. Sci. USA* 90:10330, 1993; Altman, J. D. et al., *Science* 274:94, 1996). Other relatively recent technical developments include staining for intracellular lymphokines, and interferon release assays or ELISPOT assays. Tetramer staining, intracellular lymphokine staining and ELISPOT assays all appear to be at least 10-fold more sensitive than more conventional assays (Lalvani, A. et al., *J. Exp. Med.* 186:859, 1997; Dunbar, P. R. et al., *Curr. Biol.* 8:413, 1998; Murali-Krishna, K. et al., *Immunity* 8:177, 1998).

HTL activation may also be assessed using such techniques known to those in the art such as T cell proliferation and secretion of lymphokines, e.g. IL-2 (see, e.g. Alexander et al., *Immunity* 1:751–761, 1994).

Alternatively, immunization of HLA transgenic mice can be used to determine immunogenicity of peptide epitopes. Several transgenic mouse models including mice with human A2.1, A11 (which can additionally be used to analyze HLA-A3 epitopes), and B7 alleles have been characterized and others (e.g., transgenic mice for HLA-A1 and A24) are being developed. HLA-DR1 and HLA-DR3 mouse models have also been developed. Additional transgenic mouse models with other HLA alleles may be generated as necessary. Mice may be immunized with peptides emulsified in Incomplete Freund's Adjuvant and the resulting T cells tested for their capacity to recognize peptide-pulsed target cells and target cells transfected with appropriate genes. CTL responses may be analyzed using cytotoxicity assays described above. Similarly, HTL responses may be analyzed using such assays as T cell proliferation or secretion of lymphokines.

III.J. Use of Peptide Epitopes as Diagnostic Agents and for Evaluating Immune Responses In one aspect of the invention, HLA class I and class II binding peptides as described herein can be used as reagents to evaluate an immune response. The immune response to be evaluated is induced by using as an immunogen any agent that may result in the production of antigen-specific CTLs or HTLs that recognize and bind to the peptide epitope(s) to be employed as the reagent. The peptide reagent need not be used as the immunogen. Assay systems that are used for such an analysis include relatively recent technical developments such as tetramers, staining for intracellular lymphokines and interferon release assays, or ELISPOT assays.

For example, a peptide of the invention is used in a tetramer staining assay to assess peripheral blood mononuclear cells for the presence of antigen-specific CTLs following exposure to a pathogen or immunogen. The HLA-tetrameric complex is used to directly visualize antigen-specific CTLs (see, e.g., Ogg et al., *Science* 279:2103–2106, 1998; and Altman et al., *Science* 174:94–96, 1996) and determine the frequency of the antigen-specific CTL population in a sample of peripheral blood mononuclear cells.

A tetramer reagent using a peptide of the invention is generated as follows: A peptide that binds to an HLA molecule is refolded in the presence of the corresponding HLA heavy chain and $\beta_2$-microglobulin to generate a tri-molecular complex. The complex is biotinylated at the carboxyl terminal end of the heavy chain at a site that was previously engineered into the protein. Tetramer formation is then induced by the addition of streptavidin. By means of fluorescently labeled streptavidin, the tetramer can be used to stain antigen-specific cells. The cells can then be readily identified, for example, by flow cytometry. Such procedures are used for diagnostic or prognostic purposes. Cells identified by the procedure can also be used for therapeutic purposes.

Peptides of the invention are also used as reagents to evaluate immune recall responses. (see, e.g., Bertoni et al., *J. Clin. Invest.* 100:503–513, 1997 and Penna et al., *J. Exp. Med.* 174:1565–1570, 1991.) For example, patient PBMC samples from individuals infected with HPV are analyzed for the presence of antigen-specific CTLs or HTLs using specific peptides. A blood sample containing mononuclear cells may be evaluated by cultivating the PBMCs and stimulating the cells with a peptide of the invention. After an appropriate cultivation period, the expanded cell population may be analyzed, for example, for CTL or for HTL activity.

The peptides are also used as reagents to evaluate the efficacy of a vaccine. PBMCs obtained from a patient vaccinated with an immunogen are analyzed using, for example, either of the methods described above. The patient is HLA typed, and peptide epitope reagents that recognize the allele-specific molecules present in that patient are selected for the analysis. The immunogenicity of the vaccine is indicated by the presence of HPV epitope-specific CTLs and/or HTLs in the PBMC sample.

The peptides of the invention are also be used to make antibodies, using techniques well known in the art (see, e.g. CURRENT PROTOCOLS IN IMMUNOLOGY, Wiley/Greene, NY; and *Antibodies A Laboratory Manual Harlow*, Harlow and Lane, Cold Spring Harbor Laboratory Press, 1989), which may be useful as reagents to diagnose HPV infection. Such antibodies include those that recognize a peptide in the context of an HLA molecule, i.e., antibodies that bind to a peptide-MHC complex.

III.K. Vaccine Compositions

Vaccines and methods of preparing vaccines that contain an immunogenically effective amount of one or more peptides as described herein are further embodiments of the invention. Once appropriately immunogenic epitopes have been defined, they can be sorted and delivered by various means, herein referred to as "vaccine" compositions. Such vaccine compositions can include, for example, lipopeptides (e.g., Vitiello, A. et al., *J. Clin. Invest*. 95:341, 1995), peptide compositions encapsulated in poly(DL-lactide-co-glycolide) ("PLG") microspheres (see, e.g., Eldridge, et al.,*Molec. Immunol*. 28:287–294, 1991: Alonso et al., *Vaccine* 12:299–306, 1994; Jones et al., *Vaccine* 13:675–681, 1995), peptide compositions contained in immune stimulating complexes (ISCOMS) (see, e.g., Takahashi et al., *Nature* 344:873–875, 1990; Hu et al.,*Clin Exp Immunol*. 113:235–243, 1998), multiple antigen peptide systems (MAPs) (see e.g., Tam, J. P., *Proc. Natl. Acad. Sci. U.S.A.* 85:5409–5413, 1988; Tam, J. P., *J. Immunol. Methods* 196:17–32, 1996), peptides formulated as multivalent peptides; peptides for use in ballistic delivery systems, typically crystallized peptides, viral delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis*. 124:148, 1971; Chanda, P. K. et al., *Virology* 175:535, 1990), particles of viral or synthetic origin (e.g., Kofler, N. et al., *J. Immunol. Methods*. 192:25, 1996; Eldridge, J. H. et al., *Sem. Hematol*. 30:16, 1993; Falo, L. D., Jr. et al., *Nature Med*. 7:649, 1995), adjuvants (Warren, H. S., Vogel, F. R., and Chedid, L. A. *Annu. Rev. Immunol*. 4:369,1986; Gupta, R. K. et al., *Vaccine* 11:293, 1993), liposomes (Reddy, R. et al, *J. Immunol*. 148:1585, 1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A., *Annu. Rev. Immunol*. 12:923, 1994 and Eldridge, J. H. et al., *Sem. Hematol*. 30:16, 1993). Toxin-targeted delivery technologies, also known as receptor mediated targeting, such as those of Avant Immunotherapeutics, Inc. (Needham, Mass.) may also be used.

Vaccine compositions of the invention include nucleic acid-mediated modalities. DNA or RNA encoding one or more of the peptides of the invention can also be administered to a patient. This approach is described, for instance, in Wolff et. al., *Science* 247:1465 (1990) as well as U.S. Pat. Nos. 5,580,859; 5,589,466; 5,804,566; 5,739,118; 5,736,524; 5,679,647; WO 98/04720; and in more detail below. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Patent No. 5,922,687).

For therapeutic or prophylactic immunization purposes, the peptides of the invention can be expressed by viral or bacterial vectors. Examples of expression vectors include attenuated viral hosts, such as vaccinia or fowlpox. This approach involves the use of vaccinia virus, for example, as a vector to express nucleotide sequences that encode the peptides of the invention. Upon introduction into an acutely or chronically infected host or into a non-infected host, the recombinant vaccinia virus expresses the immunogenic peptide, and thereby elicits a host CTL and/or HTL response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456–460 (1991). A wide variety of other vectors useful for therapeutic administration or immunization of the peptides of the invention, e.g. adeno and adeno-associated virus vectors, retroviral vectors, *Salmonella typhi* vectors, detoxified anthrax toxin vectors, and the like, will be apparent to those skilled in the art from the description herein.

Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$).

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later infection, or at least partially resistant to developing an ongoing chronic infection, or derives at least some therapeutic benefit when the antigen was tumor-associated.

In some embodiments, it may be desirable to combine the class I peptide components with components that induce or facilitate neutralizing antibody and or helper T cell responses to the target antigen of interest. A preferred embodiment of such a composition comprises class I and class II epitopes in accordance with the invention. An alternative embodiment of such a composition comprises a class I and/or class II epitope in accordance with the invention, along with a PADRE™ (Epimmune, San Diego, Calif.) molecule (described, for example, in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo.

Vaccine compositions, either DNA- or peptide-based, can also be administered in vivo in combination with dendritic cell mobilization whereby loading of dendritic cells occurs in vivo.

Antigenic peptides are used to elicit a CTL and/or HTL response ex vivo, as well. The resulting CTL or HTL cells, can be used to treat chronic infections, or tumors in patients that do not respond to other conventional forms of therapy, or will not respond to a therapeutic vaccine peptide or nucleic acid in accordance with the invention. Ex vivo CTL or HTL responses to a particular antigen (infectious or tumor-associated antigen) are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7–28 days), in which the precursor cells are activated and expanded into effector cells, the cells are infused back into the patient, where they will destroy (CTL) or facilitate destruction (HTL) of their specific target cell (an infected cell or a tumor cell). Transfected dendritic cells may also be used as antigen presenting cells.

The vaccine compositions of the invention can also be used in combination with other treatments used for cancer, including use in combination with immune adjuvants such as IL-2, IL-12, GM-CSF, and the like.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles are balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with clearance of HPV infection or tumor clearance. For HLA Class I this includes 3–4 epitopes that come from at least one TAA. For HLA Class II a similar rationale is employed; again 3–4 epitopes are selected from at least one TAA (see, e.g., Rosenberg et al., *Science* 278:1447–1450). Epitopes from one TAA may be used in combination with epitopes from one or more additional TAAs to produce a vaccine that targets tumors with varying expression patterns of frequently-expressed TAAs as described, e.g., in Example 15.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope. When selecting epitopes for infectious disease-related antigens it is preferable to select either native or analoged epitopes.

5.) Of particular relevance are epitopes referred to as "nested epitopes." Nested epitopes occur where at least two epitopes overlap in a given peptide sequence. A nested peptide sequence can comprise both HLA class I and HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) In cases where the sequences of multiple variants of the same target protein are available, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

8.) When selecting an array of epitopes of an infectious agent, it is preferred that at least some of the epitopes are derived from early and late proteins. The early proteins of HPV are expressed when the virus is replicating, either following acute or dormant infection. Therefore, it is particularly preferred to use epitopes from early stage proteins to alleviate disease manifestations at the earliest stage possible.

III.K.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, e.g., co-pending application U.S. Ser. No. 09/311,784; Ishioka et al., *J. Immunol.* 162:3915–3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived from multiple regions of one or more HPV antigens, the PADRE™ universal helper T cell epitope (or multiple HTL epitopes from HPV antigens), and an endoplasmic reticulum-translocating signal sequence can be engineered. A vaccine may also comprise epitopes that are derived from other TAAs.

The immunogenicity of a multi-epitopic minigene can be tested in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created; To optimize expression and/or immunogenicity, additional elements can be incorporated into the minigene design. Examples of amino acid sequences that can be reverse translated and included in the minigene sequence include: HLA class I epitopes, HLA class II epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30–100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β, may be beneficial in certain diseases.

Therapeutic quantities of plasmid DNA can be produced for example, by fermentation in *E. coli*, followed by purification. Aliquots from the working cell bank are used to inoculate growth medium, and grown to saturation in shaker flasks or a bioreactor according to well known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, BioTechniques 6(7): 682 (1988); U.S. Pat. No. 5,279,833; WO 91/06309; and Felgner, et al., Proc. Nat'l Acad. Sci. USA 84:7413 (1987). In addition, peptides and compounds referred to collectively as protective, interactive, noncondensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is evaluated in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

III.K2. Combinations of CTL Peptides with Helper Peptides

Vaccine compositions comprising CTL peptides of the invention can be modified to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. The use of T helper epitopes in conjunction with CTL epitopes to enhance immunogenicity is illustrated, for example, in the co-pending applications U.S. Ser. No. 08/820,360, U.S. Ser. No. 08/197,484, and U.S. Ser. No. 08/464,234.

Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in the majority of the population. This can be accomplished by selecting peptides that bind to many, most, or all of the HLA class II molecules. These are known as "loosely HLA-restricted" or "promiscuous" T helper sequences. Examples of amino acid sequences that are promiscuous include sequences from antigens such as tetanus toxoid at positions 830–843 (QYIKANSKFIGITE; SEQ ID NO: 51484), Plasmodium falciparum circumsporozoite (CS) protein at positions 378–398 (DIEKKIAKMEKASSVFNVVNS; SEQ ID NO: 51485), and Streptococcus 18 kD protein at positions 116 (GAVDSILGGVATYGAA; SEQ ID NO: 51486). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE®, Epimmune, Inc., San Diego, Calif.) are designed to most preferably bind most HLA-DR (human HLA class II) molecules. For instance, a pan-DR-binding epitope peptide having the formula: aKXVAAWTLKAAa (SEQ ID NO: 51505), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

III.K3. Combinations of CTL Peptides with T Cell Priming Agents

In some embodiments it may be desirable to include in the pharmaceutical compositions of the invention at least one component which primes cytotoxic T lymphocytes. Lipids have been identified as agents capable of priming CTL in vivo against viral antigens. For example, palmitic acid residues can be attached to the ε- and α-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to ε- and α- amino groups of Lys, which is attached via linkage, e.g., Ser-Ser, to the amino terminus of the immunogenic peptide.

As another example of lipid priming of CTL responses, *E. coli* lipoproteins, such as tripalmitoyl-S-glycerylcysteinlyseryl-serine ($P_3CSS$) can be used to prime virus specific CTL when covalently attached to an appropriate peptide (see, e.g., Deres, et al., *Nature* 342:561, 1989). Peptides of the invention can be coupled to $P_3CSS$, for example, and the lipopeptide administered to an individual to specifically prime a CTL response to the target antigen. Moreover, because the induction of neutralizing antibodies can also be primed with $P_3CSS$-conjugated epitopes, two such compositions can be combined to more effectively elicit both humoral and cell-mediated responses.

CTL and/or HTL peptides can also be modified by the addition of amino acids to the termini of a peptide to provide for ease of linking peptides one to another, for coupling to a carrier support or larger peptide, for modifying the physical or chemical properties of the peptide or oligopeptide, or the like. Amino acids such as tyrosine, cysteine, lysine, glutamic or aspartic acid, or the like, can be introduced at the C- or N-terminus of the peptide or oligopeptide; particularly class I peptides. However, it is to be noted that modification at the carboxyl terminus of a CTL epitope may, in some cases, alter binding characteristics of the peptide. In addition, the peptide or oligopeptide sequences can differ from the natural sequence by being modified by terminal-$NH_2$ acylation, e.g., by alkanoyl (C1–C20) or thioglycolyl acetylation, terminal-carboxyl amidation, e.g., ammonia, methylamine, etc. In some instances these modifications may provide sites for linking to a support or other molecule.

IV.J.4. Vaccine Compositions Comprising DC Pulsed with CTL and/or HTL Peptides An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to one or more HPV antigens of interest. Optionally, a helper T cell (HTL) peptide such as a PADRE family molecule, can be included to facilitate the CTL response. Thus, a vaccine in accordance with the invention, preferably comprising epitopes from multiple HPV antigens, is used to treat HPV infection or cancer resulting from HPV infection.

III.L. Administration of Vaccines for Therapeutic or Prophylactic Purposes

The peptides of the present invention and pharmaceutical and vaccine compositions of the invention are typically used to treat and/or prevent cancer associated with HPV infection. Vaccine compositions containing the peptides of the invention are administered to a patient infected with HPV or to an individual susceptible to, or otherwise at risk for, HPV infection to elicit an immune response against HPV antigens and thus enhance the patient's own immune response capabilities.

As noted above, peptides comprising CTL and/or HTL epitopes of the invention induce immune responses when presented by HLA molecules and contacted with a CTL or HTL specific for an epitope comprised by the peptide. The peptides (or DNA encoding them) can be administered individually or as fusions of one or more peptide sequences. The manner in which the peptide is contacted with the CTL or HTL is not critical to the invention. For instance, the peptide can be contacted with the CTL or HTL either in vivo or in vitro. If the contacting occurs in vivo, the peptide itself can be administered to the patient, or other vehicles, e.g., DNA vectors encoding one or more peptides, viral vectors encoding the peptide(s), liposomes and the like, can be used, as described herein.

When the peptide is contacted in vitro, the vaccinating agent can comprise a population of cells, e.g., peptide-pulsed dendritic cells, or HPV-specific CTLs, which have been induced by pulsing antigen-presenting cells in vitro with the peptide or by transfecting antigen-presenting cells with a minigene of the invention. Such a cell population is subsequently administered to a patient in a therapeutically effective dose.

In therapeutic applications, peptide and/or nucleic acid compositions are administered to a patient in an amount sufficient to elicit an effective CTL and/or HTL response to the virus antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already infected with HPV. The peptides or DNA encoding them can be administered individually or as fusions of one or more peptide sequences. HPV-infected patients, with or without neoplasia, can be treated with the immunogenic peptides separately or in conjunction with other treatments, such as surgery, as appropriate.

For therapeutic use, administration should generally begin at the first diagnosis of HPV infection or HPV-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses HPV antigens, a vaccine comprising HPV-specific CTL may be more efficacious in killing tumor cells in patient with advanced disease than alternative embodiments.

Where susceptible individuals are identified prior to or during infection, the composition can be targeted to them, thus minimizing the need for administration to a larger population. Susceptible populations include those individuals who are sexually active.

The peptide or other compositions used for the treatment or prophylaxis of HPV infection can be used, e.g., in persons who have not manifested symptoms, e.g., neoplasia. In this context, it is generally important to provide an amount of the peptide epitope delivered by a mode of administration sufficient to effectively stimulate a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 μg and the higher value is about 10,000; 20,000; 30,000; or 50,000 μg. Dosage values for a human typically range from about 500 μg to about 50,000 μg per 70 kilogram patient. Boosting dosages of between about 1.0 μg to about 50,000 μg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the viral infection, or neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 μg and the higher value is about 10,000; 20,000; 30,000; or 50,000 μg. Dosage values for a human typically range from about 500 μg to about 50,000 μg per 70 kilogram patient. This is followed by boosting dosages of between about 1.0 μg to about 50,000 μg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier. A variety of aqueous carriers may be used, e.g., water, buffered water, 0.8% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of the peptide composition is typically included in a pharmaceutical composition that comprises a human unit dose of an acceptable carrier, preferably an aqueous carrier, and is administered in a volume of fluid that is known by those of skill in the art to be used for administration of such compositions to humans (see, e.g., *Remington's Pharmaceutical Sciences*, $17^{th}$ Edition, A. Gennaro, Editor, Mack Publishing Co., Easton, Pa., 1985).

The peptides of the invention, and/or nucleic acids encoding the peptides, can also be administered via liposomes, which may also serve to target the peptides to a particular tissue, such as lymphoid tissue, or to target selectively to infected cells, as well as to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10–95% of active ingredient, that is, one or more peptides of the invention, and more preferably at a concentration of 25%–75%.

For aerosol administration, the immunogenic peptides are preferably supplied in finely divided form along with a surfactant and propellant. Typical percentages of peptides are 0.01%–20% by weight, preferably 11%–10%. The surfactant must, of course, be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%–20% by weight of the composition, preferably 0.25–5%. The balance of the composition is ordinarily propellant. A carrier can also be included, as desired, as with, e.g., lecithin for intranasal delivery.

III.M. Kits

The peptide and nucleic acid compositions of this invention can be provided in kit form together with instructions for vaccine administration. Typically the kit would include desired peptide compositions in a container, preferably in unit dosage form and instructions for administration. An alternative kit would include a minigene construct with desired nucleic acids of the invention in a container, preferably in unit dosage form together with instructions for administration. Lymphokines such as IL-2 or IL-12 may also be included in the kit. Other kit components that may also be desirable include, for example, a sterile syringe, booster dosages, and other desired excipients.

Epitopes in accordance with the present invention were successfully used to induce an immune response. Immune responses with these epitopes have been induced by administering the epitopes in various forms. The epitopes have been administered as peptides, as nucleic acids, and as viral vectors comprising nucleic acids that encode the epitope(s) of the invention. Upon administration of peptide-based epitope forms, immune responses have been induced by direct loading of an epitope onto an empty HLA molecule that is expressed on a cell, and via internalization of the epitope and processing via the HLA class I pathway; in either event, the HLA molecule expressing the epitope was then able to interact with and induce a CTL response. Peptides can be delivered directly or using such agents as liposomes. They can additionally be delivered using ballistic delivery, in which the peptides are typically in a crystalline form. When DNA is used to induce an immune response, it is administered either as naked DNA, generally in a dose range of approximately 1–5mg, or via the ballistic "gene gun" delivery, typically in a dose range of approximately 10–100 µg. The DNA can be delivered in a variety of conformations, e.g., linear, circular etc. Various viral vectors have also successfully been used that comprise nucleic acids which encode epitopes in accordance with the invention.

Accordingly compositions in accordance with the invention exist in several forms. Embodiments of each of these composition forms in accordance with the invention have been successfully used to induce an immune response.

One composition in accordance with the invention comprises a plurality of peptides. This plurality or cocktail of peptides is generally admixed with one or more pharmaceutically acceptable excipients. The peptide cocktail can comprise multiple copies of the same peptide or can comprise a mixture of peptides. The peptides can be analogs of naturally occurring epitopes. The peptides can comprise artificial amino acids and/or chemical modifications such as addition of a surface active molecule, e.g., lipidation; acetylation, glycosylation, biotinylation, phosphorylation etc. The peptides can be CTL or HTL epitopes. In a preferred embodiment the peptide cocktail comprises a plurality of different CTL epitopes and at least one HTL epitope. The HTL epitope can be naturally or non-naturally (e.g., PADRE®, Epimmune Inc., San Diego, Calif.). The number of distinct epitopes in an embodiment of the invention is generally a whole unit integer from one through one hundred fifty (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, or 150).

An additional embodiment of a composition in accordance with the invention comprises a polypeptide multi-epitope construct, i.e., a polyepitopic peptide. Polyepitopic peptides in accordance with the invention are prepared by use of. technologies well-known in the art. By use of these known technologies, epitopes in accordance with the invention are connected one to another. The polyepitopic peptides can be linear or non-linear, e.g., multivalent. These polyepitopic constructs can comprise artificial amino acids, spacing or spacer amino acids, flanking amino acids, or chemical modifications between adjacent epitope units. The polyepitopic construct can be a heteropolymer or a homopolymer. The polyepitopic constructs generally comprise epitopes in a quantity of any whole unit integer between 2–150 (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, or 150). The polyepitopic construct can comprise CTL and/or HTL epitopes. One or more of the epitopes in the construct can be modified, e.g., by addition of a surface active material, e.g. a lipid, or chemically modified, e.g., acetylation, etc. Moreover, bonds in the multiepitopic construct can be other than peptide bonds, e.g., covalent bonds, ester or ether bonds, disulfide bonds, hydrogen bonds, ionic bonds etc.

Alternatively, a composition in accordance with the invention comprises construct which comprises a series, sequence, stretch, etc., of amino acids that have homology to (i.e., corresponds to or is contiguous with) to a native sequence. This stretch of amino acids comprises at least one subsequence of amino acids that, if cleaved or isolated from the longer series of amino acids, functions as an HLA class I or HLA class II epitope in accordance with the invention. In this embodiment, the peptide sequence is modified, so as to become a construct as defined herein, by use of any number of techniques known or to be provided in the art. The polyepitopic constructs can contain homology to a native sequence in any whole unit integer increment from 70–100%, e.g., 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or, 100 percent.

A further embodiment of a composition in accordance with the invention is an antigen presenting cell that comprises one or more epitopes in accordance with the invention. The antigen presenting cell can be a "professional" antigen presenting cell, such as a dendritic cell. The antigen presenting cell can comprise the epitope of the invention by any means known or to be determined in the art. Such means include pulsing of dendritic cells with one or more individual epitopes or with one or more peptides that comprise multiple epitopes, by nucleic acid administration such as ballistic nucleic acid delivery or by other techniques in the art for administration of nucleic acids, including vector-based, e.g. viral vector, delivery of nucleic acids.

Further embodiments of compositions in accordance with the invention comprise nucleic acids that encode one or more peptides of the invention, or nucleic acids which encode a polyepitopic peptide in accordance with the invention. As appreciated by one of ordinary skill in the art, various nucleic acids compositions will encode the same peptide due to the redundancy of the genetic code. Each of these nucleic acid compositions falls within the scope of the present invention. This embodiment of the invention comprises DNA or RNA, and in certain embodiments a combination of DNA and RNA. It is to be appreciated that any composition comprising nucleic acids that will encode a peptide in accordance with the invention or any other peptide based composition in accordance with the invention, falls within the scope of this invention.

It is to be appreciated that peptide-based forms of the invention (as well as the nucleic acids that encode them) can comprise analogs of epitopes of the invention generated using priniciples already known, or to be known, in the art. Principles related to analoging are now known in the art, and are disclosed herein; moreover, analoging principles (heteroclitic analoging) are disclosed in co-pending application serial number U.S. Ser. No. 09/226,775 filed 6 Jan. 1999. Generally the compositions of the invention are isolated or purified.

The invention will be described in greater detail by way of specific examples. The following examples are offered for illustrative purposes, and are not intended to limit the invention in any manner. Those of skill in the art will readily recognize a variety of non-critical parameters that can be changed or modified to yield alternative embodiments in accordance with the invention.

IV. EXAMPLES

The following example of peptide binding to HLA molecules demonstrates quantification of binding affinities of HLA class I and class II peptides. Binding assays can be performed with peptides that are either motif-bearing or not motif-bearing.

Example 1. HLA Class I and Class II Binding Assays

Cell lysates were prepared and HLA molecules purified in accordance with disclosed protocols (Sidney et al., *Current Protocols in Immunology* 18.3.1 (1998); Sidney, et al., *J. Immunol.* 154:247 (1995); Sette, et al., *Mol. Immunol.* 31:813 (1994)). The cell lines used as sources of HLA molecules and the antibodies used for the extraction of the HLA molecules from the cell lysates are also described in these publications.

Epstein-Barr virus (EBV)-transformed homozygous cell lines, fibroblasts, CIR, or 721.221-transfectants were used as sources of HLA class I molecules. These cells were maintained in vitro by culture in RPMI 1640 medium supplemented with 2 mM L-glutamine (GIBCO, Grand Island, N.Y.), 50 µM 2-ME, 100 µg/ml of streptomycin, 100 U/ml of penicillin (Irvine Scientific) and 10% heat-inactivated FCS (Irvine Scientific, Santa Ana, Calif.). Cells were grown in 225-cm$^2$ tissue culture flasks or, for large-scale cultures, in roller bottle apparatuses.

Cell lysates were prepared and HLA molecules purified in accordance with disclosed protocols (Sidney et al., *Current Protocols in Immunology* 18.3.1 (1998); Sidney, et al, *J. Immunol.* 154:247 (1995); Sette, et al., *Mol. Immunol.* 31:813 (1994)). Briefly, cells were lysed at a concentration of 10$^8$ cells/ml in 50 mM Tris-HCl, pH 8.5, containing 1% Nonidet P-40 (Fluka Biochemika, Buchs, Switzerland), 150 mM NaCl, 5 mM EDTA, and 2 mM PMSF. Lysates were cleared of debris and nuclei by centrifugation at 15,000×g for 30 min.

HLA molecules were purified from lysates by affinity chromatography. Lysates prepared as above were passed twice through two pre-columns of inactivated Sepharose CL4-B and protein A-Sepharose. Next, the lysate was passed over a column of Sepharose CL-4B beads coupled to an appropriate antibody. The anti-HLA column was then washed with 10-column volumes of 10 mM Tris-HCL, pH 8.0, in 1% NP-40, PBS, 2-column volumes of PBS, and 2-column volumes of PBS containing 0.4% n-octylglucoside. Finally, MHC molecules were eluted with 50 mM diethylamine in 0.15 mM NaCl containing 0.4% n-octylglucoside, pH 11.5. A 1/25 volume of 2.0M Tris, pH 6.8, was added to the eluate to reduce the pH to ~8.0. Eluates were then concentrated by centrifugation in Centriprep 30 concentrators at 2000 rpm (Amicon, Beverly, Mass.). Protein content was evaluated by a BCA protein assay (Pierce Chemical Co., Rockford, Ill.) and confirmed by SDS-PAGE.

A detailed description of the protocol utilized to measure the binding of peptides to Class I and Class II MHC has been published (Sette et al., *Mol. Immunol.* 31:813, 1994; Sidney et al., in *Current Protocols in Immunology*, Margulies, Ed., John Wiley & Sons, New York, Section 18.3, 1998). Briefly, purified MHC molecules (5 to 500 nM) were incubated with various unlabeled peptide inhibitors and 1–10 nM $^{125}$I-radiolabeled probe peptides for 48 h in PBS containing 0.05% Nonidet P-40 (NP40) (or 20% w/v digitonin for H-2 IA assays) in the presence of a protease inhibitor cocktail. The final concentrations of protease inhibitors (each from CalBioChem, La Jolla, Calif.) were 1 mM PMSF, 1.3 nM 1.10 phenanthroline, 73 µM pepstatin A, 8 mM EDTA, 6 mM N-ethylmaleimide (for Class II assays), and 200 µM N alpha-p-tosyl-L-lysine chloromethyl ketone (TLCK). All assays were performed at pH 7.0 with the exception of DRB1*0301, which was performed at pH 4.5, and DRB1 1601 (DR2w21β$_1$) and DRB4*0101 (DRw53), which were performed at pH 5.0. pH was adjusted as described elsewhere (see Sidney et al., in *Current Protocols in Immunology*, Margulies, Ed., John Wiley & Sons, New York, Section 18.3, 1998).

Following incubation, MHC-peptide complexes were separated from free peptide by gel filtration on 7.8 mm×15 cm TSK200 columns (TosoHaas 16215, Montgomeryville, Pa.), eluted at 1.2 mls/min with PBS pH 6.5 containing 0.5% NP40 and 0.1% NaN$_3$. Because the large size of the radiolabeled peptide used for the DRB1*1501 (DR2w2β$_1$) assay makes separation of bound from unbound peaks more difficult under these conditions, all DRB1*1501 (DR2w2β$_1$) assays were performed using a 7.8 mm×30 cm TSK2000 column eluted at 0.6 mls/min. The eluate from the TSK columns was passed through a Beckman 170 radioisotope detector, and radioactivity was plotted and integrated using a Hewlett-Packard 3396A integrator, and the fraction of peptide bound was determined.

Radiolabeled peptides were iodinated using the chloramine-T method. Representative radiolabeled probe peptides utilized in each assay, and its assay specific $IC_{50}$ nM, are summarized in Tables IV and V. Typically, in preliminary experiments, each MHC preparation was titered in the presence of fixed amounts of radiolabeled peptides to determine the concentration of HLA molecules necessary to bind 10–20% of the total radioactivity. All subsequent inhibition and direct binding assays were performed using these HLA concentrations.

Since under these conditions [label]<[HLA] and $IC_{50} \geq$ [HLA], the measured $IC_{50}$ values are reasonable approximations of the true $K_D$ values. Peptide inhibitors are typically tested at concentrations ranging from 120 µg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation has proven to be the most accurate and consistent for comparing peptides that have been tested on different days, or with different lots of purified MHC.

Because the antibody used for HLA-DR purification (LB3.1) is α-chain specific, $β_1$ molecules are not separated from $β_3$ (and/or $β_4$ and $β_5$) molecules. The $β_1$ specificity of the binding assay is obvious in the cases of DRB1*0101 (DR1), DRB1*0802 (DR8w2), and DRB1*0803 (DR8w3), where no $β_3$ is expressed. It has also been demonstrated for DRB1*0301 (DR3) and DRB3*0101 (DR52a), DRB1*0401 (DR4w4), DRB1*0404 (DR4w14), DRB1*0405 (DR4w15), DRB1*1101 (DR5), DRB1*1201 (DR5w12), DRB1*1302 (DR6w19) and DRB1*0701 (DR7). The problem of β chain specificity for DRB1*1501 (DR2w2$β_1$), DRB5*0101 (DR2w2$β_2$), DRB1*1601 (DR2w21$β_1$), DRB5*0201 (DR51Dw21), and DRB4*0101 (DRw53) assays is circumvented by the use of fibroblasts. Development and validation of assays with regard to DRβ molecule specificity have been described previously (see, e.g., Southwood et al.; *J. Immunol.* 160:3363–3373, 1998).

Binding assays as outlined above may be used to analyze supermotif and/or motif-bearing epitopes as, for example, described in Example 2.

Example 2

Identification of HLA Supermotif- and Motif-bearing CTL Candidate Epitopes

Vaccine compositions of the invention can include multiple epitopes that comprise multiple HLA supermotifs or motifs to achieve broad population coverage. This example illustrates the identification of supermotif- and motif-bearing epitopes for the inclusion in such a vaccine composition. Calculation of population coverage was performed using the strategy described below.

Computer Searches and Algorthims for Identification of Supermotif and/or Motif-bearing Epitopes The searches performed to identify the motif-bearing peptide sequences in Examples 2 and 5 employed the protein sequence data from seven proteins (E1, E2, E5, E6, E7, L1 and L2) from HPV types 16, 18, 31, 33, 45, and 56. (See, Table XXII for Accession numbers.)

Computer searches for epitopes bearing HLA Class I or Class II supermotifs or motifs were performed as follows.

All translated HPV protein sequences were analyzed using a text string search software program, e.g., MotifSearch 1.4 (D. Brown, San Diego) to identify potential peptide sequences containing appropriate HLA binding motifs; alternative programs are readily produced in accordance with information in the art in view of the motif/supermotif disclosure herein. Furthermore, such calculations can be made mentally.

Identified A2-, A3-, and DR-supermotif sequences were scored using polynomial algorithms to predict their capacity to bind to specific HLA-Class I or Class II molecules. These polynomial algorithms take into account both extended and refined motifs (that is, to account for the impact of different amino acids at different positions), and are essentially based on the premise that the overall affinity (or $\Delta G$) of peptide-HLA molecule interactions can be approximated as a linear polynomial function of the type:

$$\text{``}\Delta G\text{''} = a_{1i} \times a_{2i} \times a_{3i} \ldots \times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide. This assumption is justified by studies from our laboratories that demonstrated that peptides are bound to MHC and recognized by T cells in essentially an extended conformation (data omitted herein).

The method of derivation of specific algorithm coefficients has been described in Gulukota et al., *J. Mol. Biol.* 267:1258–126, 1997; (see also Sidney et al., *Human Immunol.* 45:79–93, 1996; and Southwood et al., *J. Immunol.* 160:3363–3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-reactive Peptides

Complete protein sequences from the seven HPV structural and regulatory proteins of the HPV strains listed above were aligned, then scanned, utilizing motif identification software, to identify 9- and 10-mer sequences containing the HLA-A2-supermotif main anchor specificity.

HLA-A2 supermotif-bearing sequences are shown in Table VIII. Typically, these sequences are then scored using the A2 algorithm and the peptides corresponding to the positive-scoring sequences are synthesized and tested for their capacity to bind purified HLA-A*0201 molecules in vitro (HLA-A*0201 is considered a prototype A2 supertype molecule).

Examples of peptides that bind to HLA-A*0201 with $IC_{50}$ values $\leq$500 nM are shown in Table VII. These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-bearing Epitopes

The HPV protein sequences scanned above were also examined for the presence of peptides with the HLA-A3-supermotif primary anchors (Table IX).

Peptides corresponding to the supermotif-bearing sequences are then synthesized and tested for binding to HLA-A*0301 and HLA-A*1101 molecules, the two most prevalent A3-supertype alleles. The peptides that are found to bind one of the two alleles with binding affinities of $\leq 500$ nM, often $\leq 200$ nM, are then tested for binding cross-reactivity to the other common A3-supertype alleles (A*310, A*3301, and A*6801) to identify those that can bind at least three of the five HLA-A3-supertype molecules tested.

Selection of HLA-B7 Supermotif Bearing Epitopes

The same HPV target antigen protein sequences were also analyzed for the presence of 9- or 10-mer peptides with the HLA-B7-supermotif (Table XI).

Corresponding peptides are synthesized and tested for binding to HLA-B*0702, the most common B7-supertype allele (i.e., the prototype B7 supertype allele). Peptides binding B 0702 with $IC_{50}$ of $\leq 500$ nM are identified using standard methods. These peptides are then tested for binding to other common B7-supertype molecules (B*3501, B*5101, B*5301, and B*5401). Peptides capable of binding to three or more of the five B7-supertype alleles tested are thereby identified.

Selection of A1 and A24 Motif-bearing Epitopes

To further increase population coverage, HLA-A1 and -A24 epitopes can, for example, also be incorporated into potential vaccine constructs. An analysis of the protein sequence data from the HPV target antigens utilized above can also be performed to identify HLA-A1- and A24-motif-containing sequences.

High affinity and/or cross-reactive binding epitopes that bear other motif and/or supermotifs can be identified using analogous methodology.

Example 3

Confirmation of Immunogenicity

Cross-reactive candidate CTL A2-supermotif-bearing peptides that are identified as described in Example 2 were selected for in vitro immunogenicity testing. Testing was performed using the following methodology:

Target Cell Lines for Cellular Screening:

The .221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to test the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/strpetomycin). The monocytes are purified by plating 10×10⁶ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dyna1 immunomagnetic beads (Dynabeads® M-450) and the detacha-bead® reagent. Typically about 200–250×10⁶ PBMC are processed to obtain 24×10⁶ CD8+ T-cells (enough for a 48-well plate culture). Briefly, the PBMCs are thawed in RPMI with 30 μg/ml DNAse, washed once with PBS containing 1% human AB serum and resuspended in PBS/1% AB serum at a concentration of 20×10⁶ cells/ml. The magnetic beads are washed 3 times with PBS/AB serum, added to the cells (140 μl beads/20×10⁶ cells) and incubated for 1 hour at 4° C. with continuous mixing. The beads and cells are washed 4× with PBS/AB serum to remove the nonadherent cells and resuspended at 100×10⁶ cells/ml (based on the original cell number) in PBS/AB serum containing 100 μl/ml detacha-bead® reagent and 30 μg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5–7 minutes, washed once with PBS with 1% BSA, counted and pulsed with 40 μg/ml of peptide at a cell concentration of 1–2×10⁶/ml in the presence of 3 μg/ml $β_2$-microglobulin for 4 hours at 20° C. The DC are then irradiated (4,200 rads), washed 1 time with medium and counted again.

Setting up induction cultures: 0.25 ml cytokine-generated DC (@1×10⁵ cells/ml) are co-cultured with 0.25 ml of CD8+ T-cells (@2×10⁶ cell/ml) in each well of a 48-well plate in the presence of 10 ng/ml of IL-7. Recombinant human IL10 is added the next day at a final concentration of 10 ng/ml and rhuman IL2 is added 48 hours later at 10 IU/ml.

Restimulation of the induction cultures with peptide-pulsed adherent cells: Seven and fourteen days after the primary induction the cells are restimulated with peptide-pulsed adherent cells. The PBMCS are thawed and washed twice with RPMI and DNAse. The cells are resuspended at 5×10⁶ cells/ml and irradiated at ~4200 rads. The PBMCs are plated at 2×10⁶ in 0.5 ml complete medium per well and incubated for 2 hours at 37° C. The plates are washed twice with RPMI by tapping the plate gently to remove the nonadherent cells and the adherent cells pulsed with 10 μg/ml of peptide in the presence of 3 μg/ml $β_2$ microglobulin in 0.25 ml RPMI/5% AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later rhuman IL10 is added at a final concentration of 10 ng/ml and rhuman IL2 is added the next day and again 2–3 days later at 50 IU/ml (Tsai et al., *Critical Reviews in Immunology* 18(1–2):65–75, 1998). Seven days later the cultures are assayed for CTL activity in a $^{51}$Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side by side comparison.

Measurement of CTL Lytic Activity by $^{51}$Cr Release.

Seven days after the second restimulation, cytotoxicity is determined in a standard (5 hr) $^{51}$Cr release assay by assaying individual wells at a single E:T. Peptide-pulsed targets are prepared by incubating the cells with 10 µg/ml peptide overnight at 37° C.

Adherent target cells are removed from culture flasks with trypsin-EDTA. Target cells are labelled with 200 µCi of $^{51}$Cr sodium chromate (Dupont, Wilmington, Del.) for 1 hour at 37° C. Labelled target cells are resuspended at $10^6$ per ml and diluted 1:10 with K562 cells at a concentration of $3.3 \times 10^6$/ml (an NK-sensitive erythroblastoma cell line used to reduce non-specific lysis). Target cells (100 µl) and 100 µl of effectors are plated in 96 well round-bottom plates and incubated for 5 hours at 37° C. At that time, 100 µl of supernatant are collected from each well and percent lysis is determined according to the formula: [(cpm of the test sample-cpm of the spontaneous $^{51}$Cr release sample)/(cpm of the maximal $^{51}$Cr release sample-cpm of the spontaneous $^{51}$Cr release sample)]×100. Maximum and spontaneous release are determined by incubating the labelled targets with 1% Triton X-100 and media alone, respectively. A positive culture is defined as one in which the specific lysis (sample-background) is 10% or higher in the case of individual wells and is 15% or more at the 2 highest E:T ratios when expanded cultures are assayed.

In situ Measurement of Human γIFN Production as an Indicator of Peptide-specific and Endogenous Recognition Immulon 2 plates are coated with mouse anti-human IFNγ monoclonal antibody (4 µg/ml 0.1M NaHCO$_3$, pH8.2) overnight at 4° C. The plates are washed with Ca$^{2+}$, Mg$^{2+}$-free PBS/0.05% Tween 20 and blocked with PBS/10% FCS for 2 hours, after which the CTLs (100 µ/well) and targets (100 µl/well) are added to each well, leaving empty wells for the standards and blanks (which received media only). The target cells, either peptide-pulsed or endogenous targets, are used at a concentration of $1 \times 10^6$ cells/ml. The plates are incubated for 48 hours at 37° C. with 5% CO$_2$.

Recombinant human IFNγ is added to the standard wells starting at 400 pg or 1200 pg/100 µl/well and the plate incubated for 2 hours at 37° C. The plates are washed and 100 µl of biotinylated mouse anti-human IFNγ monoclonal antibody (2 µg/ml in PBS/3% FCS/0.05% Tween 20) are added and incubated for 2 hours at room temperature. After washing again, 100 µl HRP-streptavidin (1:4000) are added and the plates incubated for 1 hour at room temperature. The plates are then washed 6× with wash buffer, 100 µl/well developing solution (TMB 1:1) are added, and the plates allowed to develop for 5–15 minutes. The reaction is stopped with 50 µl/well 1M H$_3$PO$_4$ and read at OD450. A culture is considered positive if it measured at least 50 pg of IFNγ/well above background and is twice the background level of expression.

CTL Expansion. Those cultures that demonstrate specific lytic activity against peptide-pulsed targets and/or tumor targets are expanded over a two week period with anti-CD3. Briefly, $5 \times 10^4$ CD8+ cells are added to a T25 flask containing the following: $1 \times 10^6$ irradiated (4,200 rad) PBMC (autologous or allogeneic) per ml, $2 \times 10^5$ irradiated (8,000 rad) EBV-transformed cells per ml, and OKT3 (anti-CD3) at 30 ng per ml in RPMI-1640 containing 10% (v/v) human AB serum, non-essential amino acids, sodium pyruvate, 25 µM 2-mercaptoethanol, L-glutamnine and penicillin/streptomycin. Rhuman IL2 is added 24 hours later at a final concentration of 200 IU/ml and every 3 days thereafter with fresh media at 50 IU/ml. The cells are split if the cell concentration exceeded $1 \times 10^6$/ml and the cultures are assayed between days 13 and 15 at E:T ratios of 30 30, 10, 3 and 1:1 in the $^{51}$Cr release assay or at $1 \times 10^6$/ml in the in situ IFNγ assay using the same targets as before the expansion.

Cultures are expanded in the absence of anti-CD3+ as follows. Those cultures that demonstrate specific lytic activity against peptide and endogenous targets are selected and $5 \times 10^4$ CD8+ cells are added to a T25 flask containing the following: $1 \times 10^6$ autologous PBMC per ml which have been peptide-pulsed with 10 µg/ml peptide for 2 hours at 37° C. and irradiated (4,200 rad); $2 \times 10^5$ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least 2 donors (unless otherwise noted) and preferably, also recognizes the endogenously expressed peptide.

Immunogenicity is additionally confirmed using PBMCs isolated from HPV-infected patients. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity

Immunogenicity screening of the B7-supertype cross-reactive binding peptides identified in Example 2 are evaluated in a manner analogous to the evaluation of A2- and A3-supermotif-bearing peptides.

Peptides bearing other supermotifs/motifs, e.g., HLA-A1, HLA-A24 etc. are also evaluated using similar methodology Example 4

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged, or "fixed" to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, on the basis of the data disclosed, e.g., in related and co-pending U.S. Ser. No. 09/226,775, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is tested for binding to one or all supertype members and then analogued to modulate binding affinity to any one (or more) of the supertype members to add population coverage.

The selection of analogs for immunogenicity in a cellular screening analysis is typically further restricted by the capacity of the parent peptide to bind at least weakly, i.e., bind at an $IC_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166, 1995).

In the cellular screening of these peptide analogs, it is important to demonstrate that analog-specific CTLs are also able to recognize the wild-type peptide and, when possible, target cells that endogenously express the epitope.

Analoging of HLA-A3 and B7-supermotif-bearing Peptides

Analogs of HLA-A3 supermotif-bearing epitopes are generated using strategies similar to those employed in analoging HLA-A2 supermotif-bearing peptides. For example, peptides binding to 3/5 of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then tested for A3-supertype cross-reactivity.

Similarly to the A2- and A3-motif bearing peptides, peptides binding 3 or more B7-supertype alleles can be improved, where possible, to achieve increased cross-reactive binding. B7 supermotif-bearing peptides are, for example, engineered to possess a preferred residue V, I, L, or F) at the C-terminal primary anchor position, as demonstrated by Sidney et al. (*J. Immunol.* 157:3480–3490, 1996).

Analoguing at primary anchor residues of other motif and/or supermotif-bearing epitopes is performed in a like manner.

The analog peptides are then be tested for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at postion 1 is analyzed. The peptide is then analoged to, for example, substitute L for F at position 1. The analoged peptide is evaluated for increased binding affinity/and or increased cross-reactivity: Such a procedure identifies analoged peptides with modulated binding affinity.

Engineered analogs with sufficiently improved binding capacity or cross-reactivity can also be tested for immunogenicity in HLA-B7-transgenic mice, following for example, IFA immunization or lipopeptide immunization. Analogued peptides are additionally tested for the ability to stimulate a recall response using PBMC from HPV-infected patients.

Other Analoguing Strategies

Another form of peptide analoguing, unrelated to the anchor positions, involves the substitution of a cysteine with α-amino butyric acid. Due to its chemical nature, cysteine has the propensity to form disulfide bridges and sufficiently alter the peptide structurally so as to reduce binding capacity. Subtitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of even single amino acid substitutions, the binding affinity and/or cross-reactivity of peptide ligands for HLA supertype molecules can be modulated.

Example 5

Identification of HPV-derived Sequences with HLA-DR Binding Motifs

Peptide epitopes bearing an HLA class II supermotif or motif are identified as outlined below using methodology similar to that described in Examples 1–3.

Selection of HLA-DR-supermotif-bearing Epitopes.

To identify HPV-derived, HLA class II HTL epitopes, the protein sequences from the same HPV antigens used for the identification of HLA Class I supermotif/motif sequences were analyzed for the presence of sequences bearing an HLA-DR-motif or supermotif. Specifically, 15-mer sequences were selected comprising a DR-supermotif, further comprising a 9-mer core, and three-residue N- and C-terminal flanking regions (15 amino acids total).

Protocols for predicting peptide binding to DR molecules have been developed (Southwood et al., *J. Immunol.* 160:3363–3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The HPV-derived peptides identified above are tested for their binding capacity for various common HLA-DR molecules. All peptides are initially tested for binding to the DR molecules in the primary panel: DR1, DR4w4, and DR7. Peptides binding at least 2 of these 3 DR molecules are then tested for binding to DR2w2 β1, DR2w2 β2, DR6w19, and DR9 molecules in secondary assays. Finally, peptides binding at least 2 of the 4 secondary panel DR molecules, and thus cumulatively at least 4 of 7 different DR molecules, are screened for binding to DR4w15, DR5w11, and DR8w2 molecules in tertiary assays. Peptides binding at least 7 of the 10 DR molecules comprising the primary, secondary, and tertiary screening assays are considered cross-reactive DR binders. HPV-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is an important criterion in the selection of HTL epitopes. However, data generated previously indicated that DR3 only rarely cross-reacts with other DR alleles (Sidney et al., *J. Immunol.* 149:2634–2640, 1992; Geluk et al., *J. Immunol.* 152:5742–5748, 1994; Southwood et al., *J. Immu-* nol. 160:3363–3373, 1998). This is not entirely surprising in that the DR3 peptide-binding motif appears to be distinct from the specificity of most other DR alleles. For maximum efficiency in developing vaccine candidates it would be desirable for DR3 motifs to be clustered in proximity with DR supermotif regions. Thus, peptides shown to be candidates may also be assayed for their DR3 binding capacity. However, in view of the distinct binding specificity of the DR3 motif, peptides binding only to DR3 can also be considered as candidates for inclusion in a vaccine formulation.

To efficiently identify peptides that bind DR3, target HPV antigens are analyzed for sequences carrying one of the two DR3 specific binding motifs reported by Geluk et al. (*J. Immunol.* 152:5742–5748, 1994). The corresponding peptides are then synthesized and tested for the ability to bind DR3 with an affinity of 1 µM or better, i.e., less than 1 µM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 6

Immunogenicity of HPV-derived HTL Epitopes

This example determines immunogenic DR supermotif- and DR3 motif-bearing epitopes among those identified using the methodology in Example 5.

Immunogenicity of HTL epitopes are evaluated in a manner analogous to the determination of immunogenicity of CTL epitopes by assessing the ability to stimulate HTL responses and/or by using appropriate transgenic mouse models. Immunogenicity is determined by screening for: 1.) in vitro primary induction using normal PBMC or 2.) recall responses from cancer patient PBMCs.

Example 7

Calculation of Phenotypic Frequencies of HLA-supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles were determined. Gene frequencies for each HLA allele were calculated from antigen or allele frequencies utilizing the binomial distribution formulae gf=1−(SQRT(1−af)) (see, e.g., Sidney et al., *Human Immunol.* 45:79–93, 1996). To obtain overall phenotypic frequencies, cumulative gene frequencies were calculated, and the cumulative antigen frequencies derived by the use of the inverse formula [af=1−(1−Cgf)²].

Where frequency data was not available at the level of DNA typing, correspondence to the serologically defined antigen frequencies was assumed. To obtain total potential supertype population coverage no linkage disequilibrium was assumed, and only alleles confirmed to belong to each of the supertypes were included (minimal estimates). Estimates of total potential coverage achieved by inter-loci combinations were made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501–03, B51, B*5301, B*5401, B*5501–2, B*5601, B*6701, and B*7801 (potentially also B*1401, B*3504–06, B*4201, and B*5602).

Population coverage achieved by combining the A2-, A3- and B7-supertypes is approximately 86% in five major ethnic groups (see Table XXI). Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%. An analagous approach can be used to estimate population coverage achieved with combinations of class II motif-bearing epitopes.

Immunogenicity studies in humans (e.g., Bertoni et al., *J. Clin. Invest.* 100:503, 1997; Doolan et al., *Immunity* 7:97, 1997; and Threlkeld et al., *J. Immunol.* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 8

CTL Recognition of Endogenous Processed Antigens After Priming

This example determines that CTL induced by native or analogued peptide epitopes identified and selected as described in Examples 1–6 recognize endogenously synthesized, i.e., native antigens.

Effector cells isolated from transgenic mice that are immunized with peptide epitopes as in Example 3, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with HPV expression vectors.

The result will demonstrate that CTL lines obtained from animals primed with peptide epitope recognize endogenously synthesized HPV antigen. The choice of transgenic mouse model to be used for such an analysis depends upon the epitope(s) that is being evaluated. In addition to HLA-A*0201/K$^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 9

Activity of CTL-HTL Conjugated Epitopes in Transgenic Mice

This example illustrates the induction of CTLs and HTLs in transgenic mice by use of a tumor associated antigen CTL/HTL peptide conjugate whereby the vaccine composition comprises peptides to be administered to an HPV-infected patient. The peptide composition can comprise multiple CTL and/or HTL epitopes and further, can comprise epitopes selected from multiple HPV target antigens. The epitopes are identified using methodology as described in Examples 1–6 This analysis demonstrates the enhanced immunogenicity that can be achieved by inclusion of one or more HTL epitopes in a vaccine composition. Such a peptide composition can comprise an HTL epitope conjugated to a preferred CTL epitope containing, for example, at least one CTL epitope that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753–4761, 1997). For example, A2/K$^b$ mice, which are transgenic for the human HLA A2.1 allele and are useful for the assessment of the immunogenicity of HLA-A*0201 motif- or HLA-A2 supermotif-bearing epitopes, are primed subcutaneously (base of the tail) with a 0.1 ml of peptide in Incomplete Freund's Adjuvant, or if the peptide composition is a lipidated CT/HTL conjugate, in DMSO/saline or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/K$^b$ chimeric gene (e.g., Vitiello et al., *J. Exp. Med.* 173:1007, 1991)

In vitro CTL activation: One week after priming, spleen cells (30×10$^6$ cells/flask) are co-cultured at 37° C. with syngeneic, irradiated (3000 rads), peptide coated lymphoblasts (10×10$^6$ cells/flask) in 10 ml of culture medium/T25 flask. After six days, effector cells are harvested and assayed for cytotoxic activity.

Assay for cytotoxic activity: Target cells (1.0 to 1.5×10$^6$) are incubated at 37° C. in the presence of 200 μl of $^{51}$Cr. After 60 minutes, cells are washed three times and resuspended in R10 medium. Peptide is added where required at a concentration of 1 μg/ml. For the assay, 10$^4$ $^{51}$Cr-labeled target cells are added to different concentrations of effector cells (final volume of 200 μl) in U-bottom 96-well plates. After a 6 hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/10$^6$ cells. One lytic unit is arbitrarily defined as the number of effector cells required to achieve 30% lysis of 10,000 target cells in a 6 hour $^{51}$Cr release assay. To obtain specific lytic units/10$^6$, the lytic units/10$^6$ obtained in the absence of peptide is subtracted from the lytic units/10$^6$ obtained in the presence of peptide. For example, if 30% $^{51}$Cr release is obtained at the effector (E): target (T) ratio of 50:1 (i.e., 5×10$^5$ effector cells for 10,000 targets) in the absence of peptide and 5:1 (i.e., 5×10$^4$ effector cells for 10,000 targets) in the presence of peptide, the specific lytic units would be: [(1/50,000)−(1/500,000)]×10$^6$=18 LU.

The results are analyzed to assess the magnitude of the CTL responses of animals injected with the immunogenic CTL/HTL conjugate vaccine preparation and are compared to the magnitude of the CTL response achieved using the CTL epitope as outlined in Example 3. Analyses similar to this may be performed to evaluate the immunogenicity of peptide conjugates containing multiple CTL epitopes and/or multiple HTL epitopes. In accordance with these procedures it is found that a CTL response is induced, and concomitantly that an HTL response is induced upon administration of such compositions.

Example 10

Selection of CTL and HTL Epitopes for Inclusion in an HPV-specific Vaccine

This example illustrates the procedure for the selection of peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting an array of epitopes for inclusion in a vaccine composition. Each of the following principles is balanced in order to make the selection.

Epitopes are selected which, upon administration, mimic immune responses that have been observed to be correlated with HPV clearance. The number of epitopes used depends on observations of patients who spontaneously clear HPV. For example, if it has been observed that patients who spontaneously clear HPV generate an immune response to at least 3 epitopes on at least one HPV antigen, then 3–4 epitopes should be included for HLA class I. A similar rationale is used to determine HLA class II epitopes.

When selecting an array of HPV epitopes, it is preferred that at least some of the epitopes are derived from early and late proteins. The early proteins of HPV are expressed when the virus is replicating, either following acute or dormant infection. Therefore, it is particularly preferred to use epitopes from early stage proteins to alleviate disease manifestations at the earliest stage possible.

Epitopes are often selected that have a binding affinity of an IC$_{50}$ of 500 nM or less for an HLA class I molecule, or for class II, an IC$_{50}$ of 1000 nM or less.

Sufficient supermotif bearing peptides, or a sufficient array of allele-specific motif bearing peptides, are selected to give broad population coverage. For example, epitopes are selected to provide at least 80% population coverage. A Monte Carlo analysis, a statistical evaluation known in the art, can be employed to assess breadth, or redundancy, of population coverage.

When creating a polyepitopic compositions, e.g. a minigene, it is typically desirable to generate the smallest peptide possible that encompasses the epitopes of interest. The principles employed are similar, if not the same, as those employed when selecting a peptide comprising nested epitopes.

In cases where the sequences of multiple variants of the same target protein are available, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

A vaccine composition comprised of selected peptides, when administered, is safe, efficacious, and elicits an immune response similar in magnitude to an immune response that controls or clears an acute HPV infection.

Example 11

Construction of Minigene Multi-epitope DNA Plasmids

This example provides general guidance for the construction of a minigene expression plasmid. Minigene plasmids may, of course, contain various configurations of CTL and/or HTL epitopes or epitope analogs as described herein. Examples of the construction and evaluation of expression plasmids are described, for example, in co-pending U.S. Ser. No. 09/311,784 filed May 13, 1999.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived from multiple HPV antigens, preferably including both early and late phase antigens, are selected such that multiple supermotifs/motifs are represented to ensure broad population coverage. Similarly, HLA class II epitopes are selected from multiple HPV antigens to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in co-pending application U.S. Ser. No. 09/311,784 filed May 13, 1999, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene can be prepared as follows. For a first PCR reaction, 5 µg of each of two oligonucleotides are annealed and extended: In an example using eight oligonucleotides, i.e., four pairs of primers, oligonucleotides 1+2, 3+4, 5+6, and 7+8 are combined in 100 µl reactions containing Pfu polymerase buffer (1×=10 mM KCL, 10 mM $(NH4)_2SO_4$, 20 mM Tris-chloride, pH 8.75, 2 mM $MgSO_4$, 0.1% Triton X-100, 100 µg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 12

The Plasmid Construct and the Degree to which it Induces Immunogenicity

The degree to which a plasmid construct, for example a plasmid constructed in accordance with Example 11, is able to induce immunogenicity can be evaluated in vitro by testing for epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683–692, 1996; Demotz et al., *Nature* 342:682–684, 1989); or the number of peptide-HLA class I complexes can be estimated by measuring the amount of lysis or lymphokine release induced by infected or transfected target cells, and then determining the concentration of peptide necessary to obtained equivalent levels of lysis or lymphokine release (see, e.g., Kageyama et al., *J. Immunol.* 154:567–576, 1995).

Alternatively, immunogenicity can be evaluated through in vivo injections into mice and subsequent in vitro assessment of CTL and HTL activity, which are analysed using cytotoxicity and proliferation assays, respectively, as detailed e.g., in copending U.S. Ser. No. 09/311,784 filed May 13, 1999 and Alexander et al., *Immunity* 1:751–761, 1994.

For example, to assess the capacity of a DNA minigene construct (e.g., a pMin minigene construct generated as described in U.S. Ser. No. 09/311,784) containing at least one HLA-A2 supermotif peptide to induce CTLs in vivo, HLA-A2.1/K$^b$ transgenic mice, for example, are immunized intramuscularly with 100 μg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}$Cr release assay. The results indicate the magnitude of the CTL response directed against the A2-restricted epitope, thus indicating the in vivo immunogenicity of the minigene vaccine and polyepitopic vaccine. It is, therefore, found that the minigene elicits immune responses directed toward the HLA-A2 supermotif peptide epitopes as does the poly-epitopic peptide vaccine. A similar analysis is also performed using other HLA-A3 and HLA-B7 transgenic mouse models to assess CTL induction by HLA-A3 and HLA-B7 motif or supermotif epitopes.

To assess the capacity of a class II epitope encoding minigene to induce HTLs in vivo, DR transgenic mice, or for those epitope that cross react with the appropriate mouse MHC molecule, I-A$^b$-restricted mice, for example, are immunized intramuscularly with 100 μg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. Immunity 1:751–761, 1994). The results indicate the magnitude of the HTL response, thus demonstrating the in vivo immunogenicity of the minigene.

DNA minigenes, constructed as described in Example 11, may also be evaluated as a vaccine in combination with a boosting agent using a prime boost protocol. The boosting agent can consist of recombinant protein (e.g., Barnett et al., *Aids Res. and Human Retroviruses* 14, Supplement 3:S299–S309, 1998) or recombinant vaccinia, for example, expressing a minigene or DNA encoding the complete protein of interest (see, e.g., Hanke et al., *Vaccine* 16:439–445, 1998; Sedegah et al., *Proc. Natl. Acad. Sci USA* 95:7648–53, 1998; Hanke and McMichael, *Immunol. Letters* 66:177–181, 1999; and Robinson et al., *Nature Med.* 5:526–34, 1999).

For example, the efficacy of the DNA minigene used in a prime boost protocol is initially evaluated in transgenic mice. In this example, A2.1/K$^b$ transgenic mice are immunized IM with 100 μg of a DNA minigene encoding the immunogenic peptides including at least one HLA-A2 supermotif-bearing peptide. After an incubation period (ranging from 3–9 weeks), the mice are boosted IP with 10$^7$ pfu/mouse of a recombinant vaccinia virus expressing the same sequence encoded by the DNA minigene. Control mice are immunized with 100 μg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an IFN-γ ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes.

The use of prime boost protocols in humans is described in Example 20.

Example 13

Peptide Composition for Prophylactic Uses

Vaccine compositions of the present invention can be used to prevent HPV infection in persons who are at risk for such infection. For example, a polyepitopic peptide epitope composition (or a nucleic acid comprising the same) containing multiple CTL and HTL epitopes such as those selected in Examples 9 and/or 10, which are also selected to target greater than 80% of the population, is administered to individuals at risk for HPV infection.

For example, a peptide-based composition can be provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 μg, generally 100–5,000 μg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against HPV infection.

Alternatively, a composition typically comprising transfecting agents can be used for the administration of a nucleic acid-based vaccine in accordance with methodologies known in the art and disclosed herein.

Example 14

Polyepitopic Vaccine Compositions Derived from Native HPV Sequences

A native HPV polyprotein sequence is screened, preferably using computer algorithms defined for each class I and/or class II supermotif or motif, to identify "relatively short" regions of the polyprotein that comprise multiple epitopes and is preferably less in length than an entire native antigen. This relatively short sequence that contains multiple distinct,-even overlapping, epitopes is selected and used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with f overlapping epitopes, two 9-mer epitopes and one 10-mer epitope can be present in a 10 amino acid peptide. Such a vaccine composition is administered for therapeutic or prophylactic purposes.

The vaccine composition will include, for example, three CTL epitopes from at least one HPV target antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent analogs) directs the immune response to multiple peptide sequences that are actually present in native HPV antigens thus avoiding the need to evaluate any junctional epitopes. Lastly, the embodiment provides an economy of scale when producing nucleic acid vaccine compositions.

Related to this embodiment, computer programs can be derived in accordance with principles in the art, which identify in a target sequence, the greatest number of epitopes per sequence length.

Example 15

Polyepitopic Vaccine Compositions from Multiple Antigens

The HPV peptide epitopes of the present invention are used in conjunction with peptide epitopes from other target tumor-associated antigens to create a vaccine composition that is useful for the prevention or treatment of cancer resulting from HPV infection in multiple patients.

For example, a vaccine composition can be provided as a single polypeptide that incorporates multiple epitopes from HPV antigens as well as other TAAs that are often expressed with a target cancer, e.g., cervical cancer, associated with HPV infection, or can be administered as a composition comprising one or more discrete epitopes. Alternatively, the vaccine can be administered as a minigene construct or as dendritic cells which have been loaded with the peptide epitopes in vitro.

Example 16

Use of Peptides to Evaluate an Immune Response

Peptides of the invention may be used to analyze an immune response for the presence of specific CTL or HTL populations directed to HPV. Such an analysis may be performed in a manner as that described by Ogg et al., Science 279:2103–2106, 1998. In the following example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, HPV HLA-A*0201-specific CTL frequencies from HLA A*0201-positive individuals at different stages of infection or following immunization using an HPV peptide containing an A*0201 motif. Tetrameric complexes are synthesized as described (Musey et al., N. Engl. J. Med. 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5'triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 µl of cold phosphate-buffered saline. Tri-color analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive uninfected donors. The percentage of cells stained with the tetramer is then determined by flow cytometry. The results indicate the number of cells in the PBMC sample that contain epitope-restricted CTLs, thereby readily indicating the extent of immune response to the HPV epitope, and thus the stage of infection with HPV, the status of exposure to HPV, or exposure to a vaccine that elicits a protective or therapeutic response.

Example 17

Use of Peptide Epitopes to Evaluate Recall Responses

The peptide epitopes of the invention are used as reagents to evaluate T cell responses, such as acute or recall responses, in patients. Such an analysis may be performed on patients who have recovered from infection, who are chronically infected with HPV, or who have been vaccinated with an HPV vaccine.

For example, the class I restricted CTL response of persons who have been vaccinated may be analyzed. The vaccine may be any HPV vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 µg/ml), and Hepes (10 mM) containing 10% heat-inactivated human AB serum (complete RPMI) and plated using microculture formats. A synthetic peptide comprising an epitope of the invention is added at 10 µg/ml to each well and HBV core 128–140 epitope is added at 1 µg/ml to each well as a source of T cell help during the first week of stimulation.

In the microculture format, $4 \times 10^5$ PBMC are stimulated with peptide in 8 replicate cultures in 96-well round bottom plate in 100 µl/well of complete RPMI. On days 3 and 10, 100 ml of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}$Cr release, based on comparison with uninfected control subjects as previously described (Rehermann, et al., Nature Med. 2:1104,1108, 1996; Rehermann et al., J. Clin. Invest. 97:1655–1665, 1996; and Rehermann et al. J. Clin. Invest. 98:1432–1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. J. Virol. 66:2670–2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 µM, and labeled with 100 µCi of $^{51}$Cr (Amershamn Corp., Arlington Heights, Ill.) for 1 hour after which they are washed four times with HBSS.

Cytolytic activity is determined in a standard 4-h, split well $^{51}$Cr release assay using U-bottomed 96 well plates containing 3,000 targets/well. Stimulated PBMC are tested at effector/target (E/T) ratios of 20–50:1 on day 14. Percent cytotoxicity is determined from the formula: 100× [(experimental release-spontaneous release)/maximum release-spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to HPV or an HPV vaccine.

The class II restricted HTL responses may also be analyzed. Purified PBMC are cultured in a 96-well flat bottom plate at a density of $1.5\times10^5$ cells/well and are stimulated with 10 µg/ml synthetic peptide, whole antigen, or PHA. Cells are routinely plated in replicates of 4–6 wells for each condition. After seven days of culture, the medium is removed and replaced with fresh medium containing 10 U/ml IL-2. Two days later, 1 µCi $^3$H-thymidine is added to each well and incubation is continued for an additional 18 hours. Cellular DNA is then harvested on glass fiber mats and analyzed for $^3$H-thymidine incorporation. Antigen-specific T cell proliferation is calculated as the ratio of $^3$H-thymidine incorporation in the presence of antigen divided by the $^3$H-thymidine incorporation in the absence of antigen.

Example 18

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 µg of peptide composition;

Group II: 3 subjects are injected with placebo and 6 subjects are injected with 50 µg peptide composition;

Group III: 3 subjects are injected with placebo and 6 subjects are injected with 500 µg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 19

Phase II Trials in Patients Infected with HPV

Phase II trials are performed to study the effect of administering the CTL-HTL peptide compositions to patients having cancer associated with HPV infection. The main objectives of the trials are to determine an effective dose and regimen for inducing CTLs in HPV-infected patients with cancer, to establish the safety of inducing a CTL and HTL response in these patients, and to see to what extent activation of CTLs improves the clinical picture of chronically infected HPV patients, as manifested by a reduction in viral load, e.g., the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21–65 and represent diverse ethnic backgrounds. All of them are infected with HPV and are HIV, HCV, HBV and delta hepatitis virus (HDV) negative, but are positive for HPV DNA as monitered by PCR.

Clinical manifestations or antigen-specific T-cell responses are monitored to assess the effects of administering the peptide compositions. The vaccine composition is found to be both safe and efficacious in the treatment of HPV infection.

Example 20

Induction of CTL Responses Using a Prime Boost Protocol

A prime boost protocol similar in its underlying principle to that used to valuate the efficacy of a DNA vaccine in transgenic mice, such as described in Example 12, can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in Example 11, in the form of naked nucleic acid administered IM (or SC or ID) in the amounts of 0.5–5 mg at multiple sites. The nucleic acid (0.1 to 1000 μg) can also be administered using a gene gun. Following an incubation period of 3–4 weeks, a booster dose is then administered. The booster can be recombinant fowlpox virus administered at a dose of $5$–$10^7$ to $5 \times 10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples will be obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve protective immunity against HPV is generated.

Example 21

Administration of Vaccine Compositions Using Dendritic Cells (DC)

Vaccines comprising peptide epitopes of the invention can be administered using APCs, or "professional" APCs such as DC. In this example, the peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction of the specific target cells that bear the proteins from which the epitopes in the vaccine are derived.

For example, a cocktail of epitope-bearing peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL-4. After pulsing the DC with peptides and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although $2$–$50 \times 10^6$ DC per patient are typically administered, larger number of DC, such as $10^7$ or $10^8$ can also be provided. Such cell populations typically contain between 50–90% DC.

In some embodiments, peptide-loaded PBMC are injected into patients without purification of the DC. For example, PBMC containing DC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive $5 \times 10^6$ DC, then the patient will be injected with a total of $2.5 \times 10^8$ peptide-loaded PBMC. The percent DC mobilized by an agent such as Progenipoietimm is typically estimated to be between 2–10%, but can vary as appreciated by one of skill in the art.

Ex vivo Activation of CTL/HTL Responses

Alternatively, ex vivo CTL or HTL responses to HPV antigens can be induced by incubating in tissue culture the patient's, or genetically compatible, CTL or HTL precursor cells together with a source of APC, such as DC, and the appropriate immunogenic peptides. After an appropriate incubation time (typically about 7–28 days), in which the precursor cells are activated and expanded into effector cells, the cells are infused back into the patient, where they will destroy (CTL) or facilitate destruction (HTL) of their specific target cells, i.e., tumor cells.

Example 22

Alternative Method of Identifying Motif-bearing Peptides

Another method of identifying motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be infected with a pathogenic organism or transfected with nucleic acids that express the antigen of interest, e.g. HPV regulatory or structural proteins. Peptides produced by endogenous antigen processing of peptides produced consequent to infection (or as a result of transfection) will then bind to HLA molecules within the cell and be transported and displayed on the cell surface. Peptides are then eluted from the HLA molecules by exposure to mild acid conditions and their amino acid sequence determined, e.g., by mass spectral analysis (e.g., Kubo et at., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can be infected with a pathogen or transfected with nucleic acid encoding an antigen of interest to isolate peptides corresponding to the pathogen or antigen of interest that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than infection or transfection, such as loading with a protein antigen, can be used to provide a source of antigen to the cell.

The above examples are provided to illustrate the invention but not to limit its scope. For example, the human terminology for the Major Histocompatibility Complex, namely HLA, is used throughout this document. It is to be appreciated that these principles can be extended to other species as well. Thus, other variants of the invention will be readily apparent to one of ordinary skill in the art and are encompassed by the appended claims. All publications, patents, and patent application cited herein are hereby incorporated by reference for all purposes.

TABLE I

|  | POSITION 2 (Primary Anchor) | POSITION 3 (Primary Anchor) | POSITION C Terminus (Primary Anchor) |
|---|---|---|---|
| SUPERMOTIFS |  |  |  |
| A1 | T, I, L, V, M, S |  | F, W, Y |
| A2 | L, I, V, M, A, T, Q |  | I, V, M, A, T, L |
| A3 | V, S, M, A, T, L, I |  | R, K |
| A24 | Y, F, W, I, V, L, M, T |  | F, I, Y, W, L, M |
| B7 | P |  | V, I, L, F, M, W, Y, A |
| B27 | R, H, K |  | F, Y, L, W, M, I, V, A |
| B44 | E, D |  | F, W, L, I, M, V, A |
| B58 | A, T, S |  | F, W, Y, L, I, V, M, A |
| B62 | Q, L, I, V, M, P |  | F, W, Y, M, I, V, L, A |
| MOTIFS |  |  |  |
| A1 | T, S, M |  | Y |
| A1 |  | D, E, A, S | Y |
| A2.1 | L, M, V, Q, I, A, T |  | V, L, I, M, A, T |
| A3 | L, M, V, I, S, A, T, F, C, G, D |  | K, Y, R, H, F, A |
| A11 | V, T, M, L, I, S, A, G, N, C, D, F |  | K, R, Y, H |
| A24 | Y, F, W, M |  | F, L, I, W |
| A*3101 | M, V, T, A, L, I, S |  | R, K |
| A*3301 | M, V, A, L, F, I, S, T |  | R, K |
| A*6801 | A, V, T, M, S, L, I |  | R, K |
| B*0702 | P |  | L, M, F, W, Y, A, I, V |
| B*3501 | P |  | L, M, F, W, Y, I, V, A |
| B51 | P |  | L, I, V, F, W, Y, A, M |
| B*5301 | P |  | I, M, F, W, Y, A, L, V |
| B*5401 | P |  | A, T, I, V, L, M, F, W, Y |

Bolded residues are preferred, italicized residues are less preferred: A peptide is considered motif-bearing if it has primary anchors at each primary anchor position for a motif or supermotif as specified in the above table.

TABLE Ia

|  | POSITION 2 (Primary Anchor) | POSITION 3 (Primary Anchor) | POSITION C Terminus (Primary Anchor) |
|---|---|---|---|
| SUPERMOTIFS |  |  |  |
| A1 | T, I, L, V, M, S |  | F, W, Y |
| A2 | V, Q, A, T |  | I, V, L, M, A, T |
| A3 | V, S, M, A, T, L, I |  | R, K |
| A24 | Y, F, W, I, V, L, M, T |  | F, I, Y, W, L, M |
| B7 | P |  | V, I, L, F, M, W, Y, A |
| B27 | R, H, K |  | F, Y, L, W, M, I, V, A |
| B58 | A, T, S |  | F, W, Y, L, I, V, M, A |
| B62 | Q, L, I, V, M, P |  | F, W, Y, M, I, V, L, A |
| MOTIFS |  |  |  |
| A1 | T, S, M |  | Y |
| A1 |  | D, E, A, S | Y |
| A2.1 | V, Q, A, T* |  | V, L, I, M, A, T |
| A3.2 | L, M, V, I, S, A, T, F, C, G, D |  | K, Y, R, H, F, A |
| A11 | V, T, M, L, I, S, A, G, N, C, D, F |  | K, R, H, Y |
| A24 | Y, F, W |  | F, L, I, W |

*If 2 is V, or Q, the C-term is not L
Bolded residues are preferred, italicized residues are less preferred: A peptide is considered motif-bearing if it has primary anchors at each primary anchor position for a motif or supermotif as specified in the above table.

TABLE II

| | | 1 | 2 | 3 | 4 | 5 | 6 | 7 | 8 | C-terminus |
|---|---|---|---|---|---|---|---|---|---|---|
| SUPERMOTIFS | | | | | | | | | | |
| A1 | | | 1°Anchor T, I, L, *V, M, S* | | | | | | | 1°Anchor F, W, Y |
| A2 | | | 1°Anchor L, I, V, M, *A, T, Q* | | | | | | | 1°Anchor L, I, V, M, A, T |
| A3 | preferred | | 1°Anchor V, S, M, A, *T, L, I* | Y, F, W, (4/5) | | | Y, F, W, (3/5) | Y, F, W, (4/5) | P, (4/5) | 1°Anchor R, K |
| | deleterious | D, E (3/5); P, (5/5) | | D, E, (4/5) | | | | | | |
| A24 | preferred | | 1°Anchor Y, F, *W, I, V, L, M, T* | | | | | | | 1°Anchor F, I, *Y, W, L, M* |
| B7 | preferred | F, W, Y (5/5) L, I, V, M, (3/5) | 1°Anchor P | F, W, Y, (4/5) | | | | | F, W, Y, (3/5) | 1°Anchor V, I, L, F, *M, W, Y, A* |
| | deleterious | D, E (3/5); P(5/5); G(4/5); A(3/5); Q, N, (3/5) | | | | D, E, (3/5) | G, (4/5) | Q, N, (4/5) | D, E (4/5) | |
| B27 | | | 1°Anchor R, H, K | | | | | | | 1°Anchor F, Y, L, *W, M, V, A* |
| B44 | | | 1°Anchor E, *D* | | | | | | | 1°Anchor F, W, Y, L, I, M, V, A |
| B58 | | | 1°Anchor A, T, S | | | | | | | 1°Anchor F, W, Y, L, I, V, M, A |
| B62 | | | 1°Anchor Q, L, I, V, M, P | | | | | | | 1°Anchor F, W, Y, M, I, V, L, A |
| MOTIFS | | | | | | | | | | |
| A1 9-mer | preferred | G, F, Y, W, | 1°Anchor S, T, M, | D, E, A, | Y, F, W, | | P, | D, E, Q, N, | Y, F, W, | 1°Anchor Y |
| | deleterious | D, E, | | R, H, K, L, I, V M, P, | A, | G, | A, | | | |
| A1 9-mer | preferred | G, R, H, K | A, S, T, C, L, I V, M, | 1°Anchor D, E, *A, S* | G, S, T, C, | | A, S, T, C, | L, I, V, M, | D, E, | 1°Anchor Y |
| | deleterious | A | R, H, K, D, E, P, Y, F, W, | | D, E, | P, Q, N, | R, H, K, | P, G, | G, P, | |

TABLE II-continued

| | | 1 | 2 | 3 | 4 | 5 | 6 | 7 | 8 | 9 or C-terminus | C-terminus |
|---|---|---|---|---|---|---|---|---|---|---|---|
| A1 10-mer | preferred | Y, F, W, | 1°Anchor S, T, M | D, E, A, Q, N, | A, | Y, F, W, Q, N, | | P, A, S, T, C, | G, D, E, | P, | 1°Anchor Y |
| | deleterious | G, P, | | R, H, K, G, L, I | D, E | R, H, K, | Q, N, A | R, H, K, Y, F, W, | R, H, K, | A | |
| A1 10-mer | preferred | Y, F, W, | S, T, C, L, I, V, M, | 1°Anchor D, E, A, S | A, | Y, F, W, | | P, G, | G, | Y, F, W, | 1°Anchor Y |
| | deleterious | R, H, K, | R, H, K, D, E, P, Y, F, W, | | S, T, C, | P, | G, | | P, R, H, K, | Q, N, | |
| A2.1 9-mer | preferred | Y, F, W, | 1°Anchor L, M, I, V, Q, A, T | Y, F, W, | S, T, C, | Y, F, W, | | A, | P, | 1°Anchor V, L, I, M, A, T | |
| A2.1 10-mer | deleterious | D, E, R, K, H | | | | | | | | | |
| | preferred | A, Y, F, W, | 1°Anchor L, M, I, V, Q, A, T | D, E, R, K, H L, V, I, M, | G, | | R, K, H G, | D, E, R, K, H | F, Y, W, L, V, I, M, | | 1°Anchor V, L, I, M, A, T |
| | deleterious | D, E, P, | | D, E, | R, K, H, A, | P, | | R, K, H, | D, E, R, K, H | | |
| A3 | preferred | R, H, K, | 1°Anchor L, M, V, I, S, A, T, F, C, G, D | Y, F, W, | P, R, H, K, Y, F, W, | A, | Y, F, W, | | P, | 1°Anchor K, Y, R, H, F, A | |
| A11 | deleterious | D, E, P, | | D, E Y, F, W, | | | | | | | |
| | preferred | A, | 1°Anchor V, T, L, M, I, S, A, G, N, C, D, F | | Y, FW, | A, | Y, F, W, | Y, FW, | P, | 1°Anchor K,, RY, H | |
| A24 9-mer | deleterious | D, E, P, | | | | | | A Y, F, W, | G, Y, F, W, | 1°Anchor F, L, I, W | |
| | preferred | Y, F, W, R, H, K, | 1°Anchor Y, F, W, M | | S, T, C | Q, N, P, Y, F, W, P, | D, E, R, H, K, | G, P, | A, Q, N, | | |
| A24 10-mer | deleterious | D, E, G, | 1°Anchor Y, F, W, M | D, E, | G, P, | | | | | | 1°Anchor F, L, I, W |
| | preferred | R, H, K, | 1°Anchor M, V, T, A, L, I, S | G, D, E Y, F, W, | Q, N P, | R, H, K | D, E Y, F, W, | A Y, F, W, | Q, N, A, P, | D, E, A, 1°Anchor R, K | |
| A3101 | deleterious | D, E, P, | | D, E, | | A, D, E, | D, E, | D, E, | D, E, | | |

TABLE II-continued

| | | | | | | | | | |
|---|---|---|---|---|---|---|---|---|---|
| A3301 | preferred | 1°Anchor M, V, A, L, F, I, S, T | Y, F, W | | | | | | A, Y, F, W | 1°Anchor R, K |
| | deleterious | G, P | | | | | | | | |
| A6801 | preferred | Y, F, W, S, T, C | 1°Anchor A, V, T, M, S, L, I | D, E | | Y, F, W, L, I, V, M | R, H, K | | Y, F, W, | 1°Anchor R, K |
| | deleterious | G, P | | | | R, H, K | | | P, | |
| B0702 | preferred | R, H, K, F, W, Y | 1°Anchor P | D, E, G, R, H, K | | R, H, K | R, H, K | | R, H, K | 1°Anchor L, M, F, W, Y, A, I, V |
| | deleterious | | | | | | | | A, P, A, | |
| B3501 | preferred | D, E, Q, N, P, F, W, Y, L, I, V, M | 1°Anchor P | D, E, P, F, W, Y | D, E | D, E | G, D, E | | Q, N, F, W, Y | 1°Anchor L, M, F, W, Y, I, V, A |
| | deleterious | | | | | | | | D, E | |
| B51 | preferred | A, G, P, L, I, V, M, F, W, Y | 1°Anchor P | F, W, Y | S, T, C | G, F, W, Y | G, | | G, | 1°Anchor L, I, V, F, W, Y, A, M |
| | deleterious | A, G, P, D, E, R, H, K, S, T, C | | | | | | | F, W, Y, | |
| B5301 | preferred | L, I, V, M, F, W, Y | 1°Anchor P | F, W, Y | S, T, C | F, W, Y | G, | | D, E, Q, N, | 1°Anchor I, M, F, W, Y, A, L, V |
| | deleterious | | | | | | | | G, D, E, | |
| B5401 | preferred | A, G, P, Q, N, F, W, Y | 1°Anchor P | F, W, Y, L, I, V, M | | L, I, V, M | G, | | L, I, V, M, F, W, Y, | 1°Anchor A, T, I, V, L, M, F, W, Y |
| | deleterious | | | | | | | | R, H, K, Q, N, D, E, F, W, Y, A, P, | |
| | deleterious | G, P, Q, N, D, E | | G, D, E, S, T, C | | R, H, K, D, E | D, E | | Q, N, D, G, E, | D, E |

Italicized residues indicate less preferred or "tolerated" residues.
The information in Table II is specific for 9-mers unless otherwise specified.
Secondary anchor specificities are designated for each position independently.

TABLE III

| SEQ ID NO: | MOTIFS | | 1° anchor 1 | 2 | 3 | 4 | 5 | 1° anchor 6 | 7 | 8 | 9 |
|---|---|---|---|---|---|---|---|---|---|---|---|
| | DR4 | preferred | F, M, Y, *L, I, V, W,* | M, T, | | | I, | V, S, T, *C, P, A, L, I, M,* | M, H, | | M, H |
| | | deleterious | | | | W, | | | R, | | W, D, E |
| | DR1 | preferred | M, F, *L, I, V, W, Y,* | | | P, A, M, Q, | | V, M, A, T, *S, P, L, I, C,* | M, | | A, V, M |
| | | deleterious | | C | C, H | F, D | C, W, D | | G, D, E, | D | |
| 51503 | DR7 | preferred | M, F, *L, I, V, W, Y,* | M, W, | | A, | | I, V, M, S, A, *C, T, P, L,* | M, | | I,V |
| 51504 | | deleterious | | C, | | G, | | | G, R, D, | N | G |
| | DR | Supermotif | M, F, *L, I, V, W, Y,* | | | | | V, M, S, T, A, *C, P, L, I,* | | | |

| | | 1° anchor 1 | 2 | 3 | 1° anchor 4 | 5 | 1° anchor 6 |
|---|---|---|---|---|---|---|---|
| DR3 MOTIFS | | | | | | | |
| motif a | preferred | L, I, V, M, F, Y, | | | D | | |
| motif b | preferred | L, I, V, M, F, A, Y, | | | D, N, Q, E, S, T | | K, R, H |

Italicized reidues indicate less preferred or "tolerated" residues. Secondary anchor specificities are designated for each position independently.

TABLE IV

HLA Class I Standard Peptide Binding Affinity.

| ALLELE | STANDARD PEPTIDE | SEQUENCE | SEQ ID NO: | STANDARD BINDING AFFINITY (nM) |
|---|---|---|---|---|
| A*0101 | 944.02 | YLEPAIAKY | 51487 | 25 |
| A*0201 | 941.01 | FLPSDYFPSV | 51488 | 5.0 |
| A*0202 | 941.01 | FLPSDYFPSV | 51488 | 4.3 |
| A*0203 | 941.01 | FLPSDYFPSV | 51488 | 10 |
| A*0205 | 941.01 | FLPSDYFPSV | 51488 | 4.3 |
| A*0206 | 941.01 | FLPSDYFPSV | 51488 | 3.7 |
| A*0207 | 941.01 | FLPSDYFPSV | 51488 | 23 |
| A*6802 | 1072.34 | YVIKVSARV | 51489 | 8.0 |
| A*0301 | 941.12 | KVFPYALINK | 51490 | 11 |
| A*1101 | 940.06 | AVDLYHFLK | 51491 | 6.0 |
| A*3101 | 941.12 | KVFPYALINK | 51490 | 18 |
| A*3301 | 1083.02 | STLPETYVVRR | 51492 | 29 |
| A*6801 | 941.12 | KVFPYALINK | 51490 | 8.0 |
| A*2402 | 979.02 | AYIDNYNKF | 51493 | 12 |
| B*0702 | 1075.23 | APRTLVYLL | 51494 | 5.5 |
| B*3501 | 1021.05 | FPFKYAAAF | 51495 | 7.2 |
| B51 | 1021.05 | FPFKYAAAF | 51495 | 5.5 |
| B*5301 | 1021.05 | FPFKYAAAF | 51495 | 9.3 |
| B*5401 | 1021.05 | FPFKYAAAF | 51495 | 10 |

TABLE V

HLA Class II Standard Peptide Binding Affinity.

| Allele | Nomenclature | Standard Peptide | Sequence | SEQ ID NO: | Binding Affinity (nM) |
|---|---|---|---|---|---|
| DRB1*0101 | DR1 | 515.01 | PKYVKQNTLKLAT | 51496 | 5.0 |
| DRB1*0301 | DR3 | 829.02 | YKTIAFDEEARR | 51497 | 300 |
| DRB1*0401 | DR4w4 | 515.01 | PKYVKQNTLKLAT | 51496 | 45 |
| DRB1*0404 | DR4w14 | 717.01 | YARFQSQTTLKQKT | 51498 | 50 |
| DRB1*0405 | DR4w15 | 717.01 | YARFQSQTTLKQKT | 51498 | 38 |
| DRB1*0701 | DR7 | 553.01 | QYIKANSKFIGITE | 51499 | 25 |
| DRB1*0802 | DR8w2 | 553.01 | QYIKANSKFIGITE | 51499 | 49 |
| DRB1*0803 | DR8w3 | 553.01 | QYIKANSKFIGITE | 51499 | 1600 |
| DRB1*0901 | DR9 | 553.01 | QYIKANSKFIGITE | 51499 | 75 |
| DRB1*1101 | DR5w11 | 553.01 | QYIKANSKFIGITE | 51499 | 20 |
| DRB1*1201 | DR5w12 | 1200.05 | EALIHQLKINPYVLS | 51500 | 298 |
| DRB1*1302 | DR6w19 | 650.22 | QYIKANAKFIGITE | 51499 | 3.5 |
| DRB1*1501 | DR2w2β1 | 507.02 | GRTQDENPVVHFFKNIVTPRTPPP | 51501 | 9.1 |

TABLE V-continued

HLA Class II Standard Peptide Binding Affinity.

| Allele | Nomenclature | Standard Peptide | Sequence | SEQ ID NO: | Binding Affinity (nM) |
|---|---|---|---|---|---|
| DRB3*0101 | DR52a | 511 | NGQIGNDPNRDIL | 51502 | 470 |
| DRB4*0101 | DRw53 | 717.01 | YARFQSQTTLKQKT | 51498 | 58 |
| DRB5*0101 | DR2w2β2 | 553.01 | QYIKANSKFIGITE | 51499 | 20 |

TABLE VI

Allele-specific HLA-supertype members

| HLA-supertype | Verified[a] | Predicted[b] |
|---|---|---|
| A1 | A*0101, A*2501, A*2601, A*2602, A*3201 | A*0102, A*2604, A*3601, A*4301, A*8001 |
| A2 | A*0201, A*0202, A*0203, A*0204, A*0205, A*0206, A*0207, A*209, A*0214, A*6802, A*6901 | A*0208, A*0210, A*0211, A*0212, A*0213 |
| A3 | A*0301, A*1101, A*3101, A*3301, A*6801 | A*0302, A*1102, A*2603, A*3302, A*3303, A*3401, A*3402, A*6601, A*6602, A*7401 |
| A24 | A*2301, A*2402, A*3001 | A*2403, A*2404, A*3002, A*3003 |
| B7 | B*0702, B*0703, B*0704, B*0705, B*1508, B*3501, B*3502, B*3503, B*3503, B*3504, B*3505, B*3506, B*3507, B*3508, B*5101, B*5102 B*5103, B*5104, B*5105, B*5301, B*5401, B*5501, B*5502, B*5601, B*5602, B*6701, B*7801 | |
| B27 | B*1401, B*1402, B*1509, B*2702, B*2703, B*2704, B*2705, B*2706, B*3801, B*3901, B*3902, B*7301 | B*2701, B*2707, B*2708, B*3802, B*3903, B*3904, B*3905, B*4801, B*4802, B*1510, B*1518, B*1503 |
| B44 | B*1801, B*1802, B*3701, B*4402, B*4403, B*4404, B*4001, B*4002, B*4006 | B*4101, B*4501, B*4701, B*4901, B*5001 |
| B58 | B*5701, B*5702, B*5801, B*5802, B*1516, B*1517 | |
| B62 | B*1501, B*1502, B*1513, B*5201 | B*1301, B*1302, B*1504, B*1505, B*1506, B*1507, B*1515, B*1520, B*1521, B*1512, B*1514, B*1510 |

[a] Verified alleles include alleles whose specificity has been determined by pool sequencing analysis, peptide binding assays, or by analysis of the sequences of CTL epitopes.
[b] Predicted alleles are alleles whose specificity is predicted on the basis of B and F pocket structure to overlap with the supertype specificity.

TABLE VII

A01 Supermotif Peptides

| Type | Protein | Position | No. of Amino Acids | Sequence | A*0101 | Seq. Id. No. |
|---|---|---|---|---|---|---|
| HPV16 | E1 | 206 | 10 | AMLAKFKELY | | 1 |
| HPV16 | E1 | 524 | 8 | ATVPCWNY | | 2 |
| HPV16 | E1 | 82 | 9 | AVQVLKRKY | | 3 |
| HPV16 | E1 | 353 | 11 | CTFELSQMVQW | | 4 |
| HPV16 | E1 | 368 | 10 | DIVDDSEIAY | | 5 |
| HPV16 | E1 | 41 | 11 | DSDTGEDLVDF | | 6 |
| HPV16 | E1 | 372 | 8 | DSEIAYKY | | 7 |
| HPV16 | E1 | 249 | 10 | DSIKTLLQQY | | 8 |
| HPV16 | E1 | 43 | 9 | DTGEDLVDF | | 9 |
| HPV16 | E1 | 384 | 9 | DTNSNASAF | | 10 |
| HPV16 | E1 | 603 | 10 | ELNDKNWKSF | | 11- |
| HPV16 | E1 | 603 | 11 | ELNDKNWKSFF | | 12 |
| HPV16 | E1 | 356 | 8 | ELSQMVQW | | 13 |
| HPV16 | E1 | 356 | 10 | ELSQMVQWAY | | 14 |
| HPV16 | E1 | 63 | 9 | ETETAHALF | | 15 |
| HPV16 | E1 | 152 | 9 | ETETPCSQY | | 16 |
| HPV16 | E1 | 331 | 9 | EVYGDTPEW | | 17 |
| HPV16 | E1 | 51 | 8 | FIVNDNDY | | 18 |
| HPV16 | E1 | 493 | 9 | FLQGSVICF | | 19 |
| HPV16 | E1 | 445 | 9 | FLRYQGVEF | | 20 |
| HPV16 | E1 | 456 | 8 | FLTALKRF | | 21 |
| HPV16 | E1 | 453 | 11 | FMSFLTALKRF | | 22 |
| HPV16 | E1 | 219 | 8 | FSELVRPF | | 23 |
| HPV16 | E1 | 586 | 9 | FTFPNEFPF | | 24 |
| HPV16 | E1 | 501 | 8 | FVNSKSHF | | 25 |
| HPV16 | E1 | 501 | 9 | FVNSKSHFW | | 26 |
| HPV16 | E1 | 466 | 11 | GIPKKNCILLY | | 27 |
| HPV16 | E1 | 325 | 9 | GISNISEVY | | 28 |
| HPV16 | E1 | 519 | 11 | GMLDDATVPCW | | 29 |

TABLE VII-continued

A01 Supermotif Peptides

| Type | Protein | Position | No. of Amino Acids | Sequence | A*0101 | Seq. Id. No. |
|---|---|---|---|---|---|---|
| HPV16 | E1 | 272 | 10 | GMVVLLLVRY | | 30 |
| HPV16 | E1 | 163 | 9 | GSGGGCSQY | | 31 |
| HPV16 | E1 | 571 | 8 | GTDSRWPY | | 32 |
| HPV16 | E1 | 12 | 8 | GTGCNGWF | | 33 |
| HPV16 | E1 | 12 | 9 | GTGCNGWFY | 3.9000 | 34 |
| HPV16 | E1 | 216 | 11 | GVSFSELVRPF | | 35 |
| HPV16 | E1 | 263 | 9 | HIQSLACSW | | 36 |
| HPV16 | E1 | 348 | 8 | HSFNDCTF | | 37 |
| HPV16 | E1 | 329 | 11 | ISEVYGDTPEW | | 38 |
| HPV16 | E1 | 326 | 8 | ISNISEVY | | 39 |
| HPV16 | E1 | 369 | 9 | IVDDSEIAY | | 40 |
| HPV16 | E1 | 369 | 11 | IVDDSEIAYKY | | 41 |
| HPV16 | E1 | 311 | 10 | KLRSTAAALY | | 42 |
| HPV16 | E1 | 311 | 11 | KLRSTAAALYW | | 43 |
| HPV16 | E1 | 610 | 8 | KSFFSRTW | | 44 |
| HPV16 | E1 | 483 | 11 | KSLFGMSLMKF | | 45 |
| HPV16 | E1 | 227 | 10 | KSNKSTCCDW | | 46 |
| HPV16 | E1 | 323 | 11 | KTGISNISEVY | | 47 |
| HPV16 | E1 | 252 | 10 | KTLLQQYCLY | | 48 |
| HPV16 | E1 | 254 | 8 | LLQQYCLY | | 49 |
| HPV16 | E1 | 357 | 9 | LSQMVQWAY | | 50 |
| HPV16 | E1 | 48 | 11 | LVDFIVNDNDY | | 51 |
| HPV16 | E1 | 583 | 10 | LVVFTFPNEF | | 52 |
| HPV16 | E1 | 207 | 9 | MLAKFKELY | | 53 |
| HPV16 | E1 | 520 | 10 | MLDDATVPCW | | 54 |
| HPV16 | E1 | 454 | 10 | MSFLTALKRF | | 55 |
| HPV16 | E1 | 420 | 9 | MSMSQWIKY | | 56 |
| HPV16 | E1 | 273 | 9 | MVVLLLVRY | | 57 |
| HPV16 | E1 | 567 | 10 | NINAGTDSRW | | 58 |
| HPV16 | E1 | 600 | 10 | PVYELNDKNW | | 59 |
| HPV16 | E1 | 441 | 8 | QIVMFLRY | | 60 |
| HPV16 | E1 | 419 | 10 | QMSMSQWIKY | | 61 |
| HPV16 | E1 | 118 | 10 | QSRAAKRRLF | | 62 |
| HPV16 | E1 | 343 | 8 | QTVLQHSF | | 63 |
| HPV16 | E1 | 125 | 10 | RLFESEDSGY | | 64 |
| HPV16 | E1 | 582 | 11 | RLVVFTFPNEF | | 65 |
| HPV16 | E1 | 313 | 8 | RSTAAALY | | 66 |
| HPV16 | E1 | 313 | 9 | RSTAAALYW | | 67 |
| HPV16 | E1 | 313 | 10 | RSTAAALYWY | | 68 |
| HPV16 | E1 | 432 | 8 | RVDDGGDW | | 69 |
| HPV16 | E1 | 250 | 9 | SIKTLLQQY | | 70 |
| HPV16 | E1 | 484 | 10 | SLFGMSLMKF | | 71 |
| HPV16 | E1 | 421 | 8 | SMSQWIKY | | 72 |
| HPV16 | E1 | 314 | 8 | STAAALYW | | 73 |
| HPV16 | E1 | 314 | 9 | STAAALYWY | | 74 |
| HPV16 | E1 | 231 | 11 | STCCDWCIAAF | | 75 |
| HPV16 | E1 | 253 | 9 | TLLQQYCLY | | 76 |
| HPV16 | E1 | 498 | 11 | VICFVNSKSHF | | 77 |
| HPV16 | E1 | 345 | 11 | VLQHSFNDCTF | | 78 |
| HPV16 | E1 | 443 | 11 | VMFLRYQGVEF | | 79 |
| HPV16 | E1 | 217 | 10 | VSFSELVRPF | | 80 |
| HPV16 | E1 | 584 | 9 | VVFTFPNEF | | 81 |
| HPV16 | E1 | 584 | 11 | VVFTFPNEFPF | | 82 |
| HPV16 | E1 | 274 | 8 | VVLLLVRY | | 83 |
| HPV16 | E1 | 261 | 11 | YLHIQSLACSW | | 84 |
| HPV16 | E1 | 578 | 9 | YLHNRLVVF | | 85 |
| HPV16 | E1 | 578 | 11 | YLHNRLVVFTF | | 86 |
| HPV16 | E2 | 331 | 11 | AIVTLTYDSEW | | 87 |
| HPV16 | E2 | 41 | 11 | AIYYKAREMGF | | 88 |
| HPV16 | E2 | 314 | 8 | AVSSTWHW | | 89 |
| HPV16 | E2 | 309 | 11 | CTLYTAVSSTW | | 90 |
| HPV16 | E2 | 124 | 8 | DICNTMHY | | 91 |
| HPV16 | E2 | 124 | 11 | DICNTMHYTNW | | 92 |
| HPV16 | E2 | 25 | 8 | DLRDHIDY | | 93 |
| HPV16 | E2 | 25 | 9 | DLRDHIDYW | | 94 |
| HPV16 | E2 | 263 | 9 | DSAPILTAF | | 95 |
| HPV16 | E2 | 338 | 9 | DSEWQRDQF | | 96 |
| HPV16 | E2 | 22 | 11 | DSTDLRDHIDY | | 97 |
| HPV16 | E2 | 74 | 10 | ELQLTLETIY | | 98 |
| HPV16 | E2 | 80 | 8 | ETIYNSQY | | 99 |
| HPV16 | E2 | 168 | 11 | FVQFKDDAEKY | | 100 |
| HPV16 | E2 | 163 | 9 | GIRTYFVQF | | 101 |
| HPV16 | E2 | 35 | 9 | HMRLECAIY | | 102 |
| HPV16 | E2 | 35 | 10 | HMRLECAIYY | | 103 |

TABLE VII-continued

A01 Supermotif Peptides

| Type | Protein | Position | No. of Amino Acids | Sequence | A*0101 | Seq. Id. No. |
|---|---|---|---|---|---|---|
| HPV16 | E2 | 193 | 8 | ILCPTSVF | | 104 |
| HPV16 | E2 | 332 | 10 | IVTLTYDSEW | | 105 |
| HPV16 | E2 | 329 | 9 | KSAIVTLTY | | 106 |
| HPV16 | E2 | 354 | 9 | KTITVSTGF | | 107 |
| HPV16 | E2 | 77 | 11 | LTLETIYNSQY | | 108 |
| HPV16 | E2 | 84 | 9 | NSQYSNEKW | | 109 |
| HPV16 | E2 | 296 | 8 | NTLKCLRY | | 110 |
| HPV16 | E2 | 296 | 10 | NTLKCLRYRF | | 111 |
| HPV16 | E2 | 127 | 8 | NTMHYTNW | | 112 |
| HPV16 | E2 | 9 | 11 | NVCQDKILTHY | | 113 |
| HPV16 | E2 | 106 | 10 | PTGCIKKHGY | | 114 |
| HPV16 | E2 | 76 | 8 | QLTLETIY | | 115 |
| HPV16 | E2 | 151 | 8 | QVDYYGLY | | 116 |
| HPV16 | E2 | 151 | 9 | QVDYYGLYY | | 117 |
| HPV16 | E2 | 191 | 10 | QVILCPTSVF | | 118 |
| HPV16 | E2 | 37 | 8 | RLECAIYY | | 119 |
| HPV16 | E2 | 23 | 10 | STDLRDHIDY | | 120 |
| HPV16 | E2 | 23 | 11 | STDLRDHIDYW | | 121 |
| HPV16 | E2 | 261 | 11 | SVDSAPILTAF | | 122 |
| HPV16 | E2 | 144 | 11 | SVTTVEGQVDY | | 123 |
| HPV16 | E2 | 355 | 8 | TITVSTGF | | 124 |
| HPV16 | E2 | 78 | 10 | TLETIYNSQY | | 125 |
| HPV16 | E2 | 297 | 9 | TLKCLRYRF | | 126 |
| HPV16 | E2 | 93 | 10 | TLQDVSLEVY | | 127 |
| HPV16 | E2 | 334 | 8 | TLTYDSEW | | 128 |
| HPV16 | E2 | 310 | 10 | TLYTAVSSTW | | 129 |
| HPV16 | E2 | 128 | 11 | TMHYTNWTHIY | | 130 |
| HPV16 | E2 | 146 | 9 | TVVEGQVDY | | 131 |
| HPV16 | E2 | 146 | 10 | TVVEGQVDYY | | 132 |
| HPV16 | E2 | 192 | 9 | VILCPTSVF | | 133 |
| HPV16 | E2 | 333 | 9 | VTLTYDSEW | | 134 |
| HPV16 | E2 | 145 | 10 | VTVVEGQVDY | | 135 |
| HPV16 | E2 | 145 | 11 | VTVVEGQVDYY | | 136 |
| HPV16 | E2 | 147 | 8 | VVEGQVDY | | 137 |
| HPV16 | E2 | 147 | 9 | VVEGQVDYY | | 138 |
| HPV16 | E2 | 92 | 11 | WTLQDVSLEVY | | 139 |
| HPV16 | E2 | 312 | 8 | YTAVSSTW | | 140 |
| HPV16 | E2 | 312 | 10 | YTAVSSTWHW | | 141 |
| HPV16 | E2 | 131 | 8 | YTNWTHIY | | 142 |
| HPV16 | E2 | 159 | 9 | YVHEGIRTY | | 143 |
| HPV16 | E2 | 159 | 10 | YVHEGIRTYF | | 144 |
| HPV16 | E5 | 54 | 10 | ASAFRCFIVY | | 145 |
| HPV16 | E5 | 7 | 9 | ASTTLLACF | | 146 |
| HPV16 | E5 | 5 | 11 | DTASTTLLACF | | 147 |
| HPV16 | E5 | 60 | 9 | FIVYIIFVY | | 148 |
| HPV16 | E5 | 72 | 9 | FLIHTHARF | | 149 |
| HPV16 | E5 | 64 | 9 | IIFVYIPLF | | 150 |
| HPV16 | E5 | 43 | 8 | IILVLLLW | | 151 |
| HPV16 | E5 | 51 | 10 | ITAASAFRCF | | 152 |
| HPV16 | E5 | 61 | 8 | IVYIIFVY | | 153 |
| HPV16 | E5 | 73 | 8 | LIHTHARF | | 154 |
| HPV16 | E5 | 42 | 9 | LIILVLLLW | | 155 |
| HPV16 | E5 | 11 | 9 | LLACFLLCF | | 156 |
| HPV16 | E5 | 32 | 8 | LLLSVSTY | | 157 |
| HPV16 | E5 | 47 | 11 | LLLWITAASAF | | 158 |
| HPV16 | E5 | 48 | 10 | LLWITAASAF | | 159 |
| HPV16 | E5 | 70 | 11 | PLFLIHTHARF | | 160 |
| HPV16 | E5 | 31 | 9 | PLLLSVSTY | | 161 |
| HPV16 | E5 | 41 | 10 | SLIILVLLLW | | 162 |
| HPV16 | E5 | 8 | 8 | STTLLACF | | 163 |
| HPV16 | E5 | 10 | 10 | TLLACFLLCF | | 164 |
| HPV16 | E5 | 40 | 11 | TSLIILVLLLW | | 165 |
| HPV16 | E5 | 9 | 11 | TTLLACFLLCF | | 166 |
| HPV16 | E5 | 50 | 8 | WITAASAF | | 167 |
| HPV16 | E5 | 50 | 11 | WITAASAFRCF | | 168 |
| HPV16 | E5 | 63 | 10 | YIIFVYIPLF | | 169 |
| HPV16 | E6 | 68 | 9 | AVCDKCLKF | | 170 |
| HPV16 | E6 | 68 | 10 | AVCDKCLKFY | 0.0095 | 171 |
| HPV16 | E6 | 58 | 10 | CIVYRDGNPY | 0.0015 | 172 |
| HPV16 | E6 | 73 | 11 | CLKFYSKISEY | | 173 |
| HPV16 | E6 | 32 | 8 | DIILECVY | | 174-- |
| HPV16 | E6 | 92 | 8 | GTTLEQQY | 0.0006 | 175 |
| HPV16 | E6 | 125 | 8 | HLDKKQRF | | 176 |
| HPV16 | E6 | 80 | 9 | ISEYRHYCY | 0.3100 | 177 |

TABLE VII-continued

A01 Supermotif Peptides

| Type | Protein | Position | No. of Amino Acids | Sequence | A*0101 | Seq. Id. No. |
|---|---|---|---|---|---|---|
| HPV16 | E6 | 59 | 9 | IVYRDGNPY | 0.0018 | 178 |
| HPV16 | E6 | 79 | 8 | KISEYRHY | | 179 |
| HPV16 | E6 | 79 | 10 | KISEYRHYCY | 0.0090 | 180 |
| HPV16 | E6 | 44 | 9 | LLRREVYDF | | 181 |
| HPV16 | E6 | 44 | 11 | LLRREVYDFAF | | 182 |
| HPV16 | E6 | 43 | 8 | QLLRREVY | | 183 |
| HPV16 | E6 | 43 | 10 | QLLRREVYDF | | 184 |
| HPV16 | E6 | 89 | 11 | SLYGTTLEQQY | | 185 |
| HPV16 | E6 | 29 | 11 | TIHDIILECVY | | 186 |
| HPV16 | E6 | 77 | 10 | YSKISEYRHY | 0.0150 | 187 |
| HPV16 | E7 | 14 | 10 | DLQPETTDLY | 0.0020 | 188 |
| HPV16 | E7 | 4 | 8 | DTPTLHEY | 0.0002 | 189 |
| HPV16 | E7 | 18 | 8 | ETTDLYCY | 0.0780 | 190 |
| HPV16 | L1 | 373 | 9 | AISTSETYY | | 191 |
| HPV16 | L1 | 292 | 11 | AVGENVPDDLY | | 192 |
| HPV16 | L1 | 251 | 10 | CTSICKYPDY | | 193 |
| HPV16 | L1 | 249 | 9 | DICTSICKY | | 194 |
| HPV16 | L1 | 484 | 11 | DLDQFPLGRKF | | 195 |
| HPV16 | L1 | 154 | 8 | DTENASAY | | 196 |
| HPV16 | L1 | 228 | 9 | DTGFGAMDF | | 197 |
| HPV16 | L1 | 17 | 8 | DVNVYHIF | | 198 |
| HPV16 | L1 | 17 | 9 | DVNVYHIFF | | 199 |
| HPV16 | L1 | 378 | 9 | ETTYKNTNF | | 200 |
| HPV16 | L1 | 474 | 8 | EVNLKEKF | | 201 |
| HPV16 | L1 | 5 | 10 | FIYILVITCY | | 202 |
| HPV16 | L1 | 481 | 8 | FSADLDQF | | 203 |
| HPV16 | L1 | 348 | 9 | GICWGNQLF | | 204 |
| HPV16 | L1 | 499 | 8 | GLKAKPKF | | 205 |
| HPV16 | L1 | 323 | 11 | GSMVTSDAQIF | | 206 |
| HPV16 | L1 | 307 | 11 | GSTANLASSNY | | 207 |
| HPV16 | L1 | 438 | 9 | GTLEDTYRF | | 208 |
| HPV16 | L1 | 22 | 9 | HIFFQMSLW | | 209 |
| HPV16 | L1 | 102 | 8 | HLPDPNKF | | 210 |
| HPV16 | L1 | 102 | 10 | HLPDPNKFGF | | 211 |
| HPV16 | L1 | 418 | 11 | HSMNSTILEDW | | 212 |
| HPV16 | L1 | 86 | 11 | ILVPKVSGLQY | | 213 |
| HPV16 | L1 | 374 | 8 | ISTSETTY | | 214 |
| HPV16 | L1 | 11 | 11 | ITCYENDVNVY | | 215 |
| HPV16 | L1 | 407 | 10 | ITLTADVMTY | | 216 |
| HPV16 | L1 | 406 | 11 | KITLTADVMTY | | 217 |
| HPV16 | L1 | 151 | 11 | KLDDTENASAY | | 218 |
| HPV16 | L1 | 90 | 10 | KVSGLQYRVF | | 219 |
| HPV16 | L1 | 46 | 8 | KVVSTDEY | | 220 |
| HPV16 | L1 | 68 | 8 | LLAVGHPY | | 221 |
| HPV16 | L1 | 68 | 9 | LLAVGHPYF | | 222 |
| HPV16 | L1 | 409 | 8 | LTADVMTY | | 223 |
| HPV16 | L1 | 87 | 10 | LVPKVSGLQY | | 224 |
| HPV16 | L1 | 226 | 11 | MVDTGFGAMDF | | 225 |
| HPV16 | L1 | 263 | 11 | MVSEPYGDSLF | | 226 |
| HPV16 | L1 | 325 | 9 | MVTSDAQIF | | 227 |
| HPV16 | L1 | 311 | 8 | NLASSNYF | | 228 |
| HPV16 | L1 | 421 | 8 | NSTILEDW | | 229 |
| HPV16 | L1 | 421 | 10 | NSTILEDWNF | | 230 |
| HPV16 | L1 | 247 | 11 | PLDICTSICKY | | 231 |
| HPV16 | L1 | 466 | 8 | PLKKYTFW | | 232 |
| HPV16 | L1 | 43 | 11 | PVSKVVSTDEY | | 233 |
| HPV16 | L1 | 331 | 8 | QIFNKPYW | | 234 |
| HPV16 | L1 | 280 | 8 | QMFVRHLF | | 235 |
| HPV16 | L1 | 100 | 10 | RIHLPDPNKF | | 236 |
| HPV16 | L1 | 67 | 9 | RLLAVGHPY | | 237 |
| HPV16 | L1 | 67 | 10 | RLLAVGHPYF | | 238 |
| HPV16 | L1 | 253 | 8 | SICKYPDY | | 239 |
| HPV16 | L1 | 28 | 11 | SLWLPSEATVY | | 240 |
| HPV16 | L1 | 419 | 10 | SMNSTILEDW | | 241 |
| HPV16 | L1 | 324 | 10 | SMVTSDAQIF | | 242 |
| HPV16 | L1 | 308 | 10 | STANLASSNY | | 243 |
| HPV16 | L1 | 308 | 11 | STANLASSNYF | | 244 |
| HPV16 | L1 | 422 | 9 | STILEDWNF | | 245 |
| HPV16 | L1 | 423 | 8 | TILEDWNF | | 246 |
| HPV16 | L1 | 439 | 8 | TLEDTYRF | | 247 |
| HPV16 | L1 | 408 | 9 | TLTADVMTY | | 248 |
| HPV16 | L1 | 327 | 11 | TSDAQIFNKPY | | 249 |
| HPV16 | L1 | 376 | 11 | TSETTYKNTNF | | 250 |
| HPV16 | L1 | 252 | 9 | TSICKYPDY | | 251 |

TABLE VII-continued

A01 Supermotif Peptides

| Type | Protein | Position | No. of Amino Acids | Sequence | A*0101 | Seq. Id. No. |
|---|---|---|---|---|---|---|
| HPV16 | L1 | 65 | 11 | TSRLLAVGHPY | | 252 |
| HPV16 | L1 | 379 | 8 | TTYKNTNF | | 253 |
| HPV16 | L1 | 379 | 11 | TTYKNTNFKEY | | 254 |
| HPV16 | L1 | 264 | 10 | VSEPYGDSLF | | 255 |
| HPV16 | L1 | 264 | 11 | VSEPYGDSLFF | | 256 |
| HPV16 | L1 | 91 | 9 | VSGLQYRVF | | 257 |
| HPV16 | L1 | 44 | 10 | VSKVVSTDEY | | 258 |
| HPV16 | L1 | 326 | 8 | VTSDAQIF | | 259 |
| HPV16 | L1 | 30 | 9 | WLPSEATVY | | 260 |
| HPV16 | L1 | 260 | 9 | YIKMVSEPY | | 261 |
| HPV16 | L1 | 7 | 8 | YILVITCY | | 262 |
| HPV16 | L1 | 389 | 8 | YLRHGEEY | | 263 |
| HPV16 | L1 | 275 | 8 | YLRREQMF | | 264 |
| HPV16 | L1 | 53 | 8 | YVARTNIY | | 265 |
| HPV16 | L1 | 53 | 9 | YVARTNIYY | | 266 |
| HPV16 | L2 | 356 | 11 | ALPTSINNGLY | | 267 |
| HPV16 | L2 | 293 | 11 | ALTSRRTGIRY | | 268 |
| HPV16 | L2 | 261 | 8 | DVDNTLYF | | 269 |
| HPV16 | L2 | 340 | 10 | ELQTITPSTY | | 270 |
| HPV16 | L2 | 242 | 11 | FITTPTKLITY | | 271 |
| RPV16 | L2 | 259 | 9 | GIDVDNTLY | | 272 |
| HPV16 | L2 | 259 | 10 | GIDVDNTLYF | | 273 |
| HPV16 | L2 | 364 | 10 | GLYDIYADDF | | 274 |
| HPV16 | L2 | 63 | 10 | GSGTGGRTGY | | 275 |
| HPV16 | L2 | 218 | 11 | GSRPVARLGLY | | 276 |
| HPV16 | L2 | 65 | 8 | GTGGRTGY | | 277 |
| HPV16 | L2 | 439 | 8 | IIADAGDF | | 278 |
| HPV16 | L2 | 439 | 9 | IIADAGDFY | | 279 |
| HPV16 | L2 | 45 | 10 | ILQYGSMGVF | | 280 |
| HPV16 | L2 | 45 | 11 | ILQYGSMGVFF | | 281- |
| HPV16 | L2 | 243 | 10 | ITTPTKLITY | | 282 |
| HPV16 | L2 | 250 | 8 | ITYDNPAY | | 283 |
| HPV16 | L2 | 430 | 8 | IVPGSPQY | | 284 |
| HPV16 | L2 | 105 | 10 | IVSLVEFTSF | | 285 |
| HPV16 | L2 | 248 | 10 | KLITYDNPAY | | 286 |
| HPV16 | L2 | 318 | 9 | KSIGAKVHY | | 287 |
| HPV16 | L2 | 318 | 10 | KSIGAKVHYY | | 288 |
| HPV16 | L2 | 318 | 11 | KSIGAKVHYYY | | 289 |
| HPV16 | L2 | 39 | 10 | KTIADQILQY | | 290 |
| HPV16 | L2 | 323 | 8 | KVHYYYDF | | 291 |
| HPV16 | L2 | 427 | 11 | LIPIVPGSPQY | | 292 |
| HPV16 | L2 | 249 | 9 | LITYDNPAY | | 293 |
| HPV16 | L2 | 183 | 11 | LSSSTISTHNY | | 294 |
| HPV16 | L2 | 294 | 10 | LTSRRTGIRY | | 295 |
| HPV16 | L2 | 454 | 11 | MLRKRRKRLPY | | 296 |
| HPV16 | L2 | 276 | 8 | NIAPDPDF | | 297 |
| HPV16 | L2 | 273 | 11 | NSINIAPDPDF | | 298 |
| HPV16 | L2 | 397 | 10 | NTTIPFGGAY | | 299 |
| HPV16 | L2 | 429 | 9 | PIVPGSPQY | | 300 |
| HPV16 | L2 | 124 | 10 | PSIPPDVSGF | | 301 |
| HPV16 | L2 | 386 | 8 | PSTSLSGY | | 302 |
| HPV16 | L2 | 383 | 11 | PSVPSTSLSGY | | 303 |
| HPV16 | L2 | 172 | 10 | PTPAETGGHF | | 304 |
| HPV16 | L2 | 358 | 9 | PTSINNGLY | | 305 |
| HPV16 | L2 | 221 | 8 | PVARLGLY | | 306 |
| HPV16 | L2 | 44 | 11 | QILQYGSMGVF | | 307 |
| HPV16 | L2 | 342 | 8 | QTITPSTY | | 308 |
| HPV16 | L2 | 234 | 9 | QVKVVDPAF | | 309 |
| HPV16 | L2 | 9 | 11 | RTKRASATQLY | | 310 |
| HPV16 | L2 | 319 | 8 | SIGAKVHY | | 311 |
| HPV16 | L2 | 319 | 9 | SIGAKVHYY | | 312 |
| HPV16 | L2 | 319 | 10 | SIGAKVHYYY | | 313 |
| HPV16 | L2 | 274 | 10 | SINIAPDPDF | | 314 |
| HPV16 | L2 | 360 | 10 | SINNGLYDIY | | 315 |
| HPV16 | L2 | 125 | 9 | SIPPDVSGF | | 316 |
| HPV16 | L2 | 104 | 11 | SIVSLVEETSF | | 317 |
| HPV16 | L2 | 107 | 8 | SLVEETSF | | 318 |
| HPV16 | L2 | 184 | 10 | SSSTISTHNY | | 319 |
| HPV16 | L2 | 185 | 9 | SSTISTHNY | | 320 |
| HPV16 | L2 | 186 | 8 | STISTHNY | | 321 |
| HPV16 | L2 | 384 | 10 | SVPSTSLSGY | | 322 |
| HPV16 | L2 | 40 | 9 | TIADQILQY | | 323 |
| HPV16 | L2 | 438 | 9 | TIIADAGDF | | 324 |
| HPV16 | L2 | 438 | 10 | TIIADAGDFY | | 325 |

TABLE VII-continued

A01 Supermotif Peptides

| Type | Protein | Position | No. of Amino Acids | Sequence | A*0101 | Seq. Id. No. |
|---|---|---|---|---|---|---|
| MPV16 | L2 | 399 | 8 | TIPFGGAY | | 326 |
| HPV16 | L2 | 359 | 8 | TSINNGLY | | 327 |
| HPV16 | L2 | 359 | 11 | TSINNGLYDIY | | 328 |
| HPV16 | L2 | 295 | 9 | TSRRTGIRY | | 329 |
| HPV16 | L2 | 156 | 8 | TTHNNPTF | | 330 |
| HPV16 | L2 | 398 | 9 | TTIPFGGAY | | 331 |
| HPV16 | L2 | 244 | 9 | TTPTKLITY | | 332 |
| HPV16 | L2 | 153 | 11 | TTVTTHNNPTF | | 333 |
| HPV16 | L2 | 154 | 10 | TVTTHNNPTF | | 334 |
| HPV16 | L2 | 106 | 9 | VSLVEETSF | | 335- |
| HPV16 | L2 | 155 | 9 | VTTHNNPTF | | 336 |
| HPV16 | L2 | 393 | 10 | YIPANTTIPF | | 337 |
| HPV16 | L2 | 437 | 10 | YTIIADAGDF | | 338 |
| HPV16 | L2 | 437 | 11 | YTIIADAGDFY | | 339 |
| HPV18 | E1 | 213 | 10 | AMLAVFKDTY | | 340 |
| HPV18 | E1 | 526 | 11 | AMLDDATTTCW | | 341 |
| HPV18 | E1 | 40 | 11 | ATDTGSDMVDF | | 342 |
| HPV18 | E1 | 531 | 8 | ATTTCWTY | | 343 |
| HPV18 | E1 | 531 | 9 | ATTTCWTYF | | 344 |
| HPV18 | E1 | 216 | 11 | AVFKDTYGLSF | | 345 |
| HPV18 | E1 | 437 | 10 | CSKIDEGGDW | | 346 |
| HPV18 | E1 | 240 | 9 | CTDWVTAIF | | 347 |
| HPV18 | E1 | 363 | 8 | DLSEMVQW | | 348 |
| HPV18 | E1 | 363 | 10 | DLSEMVQWAF | | 349 |
| HPV18 | E1 | 391 | 9 | DSNSNAAAF | | 350 |
| HPV18 | E1 | 637 | 10 | DTEGNPFGTF | | 351 |
| HPV18 | E1 | 42 | 9 | DTGSDMVDF | | 352 |
| HPV18 | E1 | 610 | 10 | EINDKNWKCF | | 353 |
| HPV18 | E1 | 610 | 11 | EINDKNWKCFF | | 354 |
| HPV18 | E1 | 62 | 9 | ELETAQALF | | 355 |
| HPV18 | E1 | 375 | 10 | ELTDESDMAF | | 356 |
| HPV18 | E1 | 379 | 8 | ESDMAFEY | | 357 |
| HPV18 | E1 | 587 | 9 | ESRITVFEF | | 358 |
| HPV18 | E1 | 338 | 9 | EVMGDTPEW | | 359 |
| HPV18 | E1 | 50 | 8 | FIDTQGTF | | 360 |
| HPV18 | E1 | 500 | 9 | FIQGAVISF | | 361 |
| HPV18 | E1 | 460 | 11 | FITFLGALKSF | | 362 |
| HPV18 | E1 | 463 | 8 | FLGALKSF | | 363 |
| HPV18 | E1 | 399 | 10 | FLKSNCQAKY | | 364 |
| HPV18 | E1 | 452 | 9 | FLRYQQIEF | | 365 |
| HPV18 | E1 | 226 | 8 | FTDLVRNF | | 366 |
| HPV18 | E1 | 130 | 8 | FTISDSGY | | 367 |
| HPV18 | E1 | 508 | 8 | FVNSTSHF | | 368 |
| HPV18 | E1 | 508 | 9 | FVNSTSHFW | | 369 |
| HPV18 | E1 | 223 | 11 | GLSFTDLVRNF | | 370 |
| HPV18 | E1 | 11 | 8 | GTGCNGWF | | 371 |
| HPV18 | E1 | 11 | 9 | GTGCNGWFY | 3.9000 | 372 |
| HPV18 | E1 | 473 | 10 | GTPKKNCLVF | | 373 |
| HPV18 | E1 | 279 | 10 | GVLILALLRY | | 374 |
| HPV18 | E1 | 249 | 10 | GVNPTIAEGF | | 375 |
| HPV18 | E1 | 270 | 9 | HIQCLDCKW | | 376 |
| HPV18 | E1 | 352 | 11 | IIQHGIDDSNF | | 377 |
| HPV18 | E1 | 336 | 11 | ISEVMGDTPEW | | 378 |
| HPV18 | E1 | 506 | 10 | ISFVNSTSHF | | 379 |
| HPV18 | E1 | 506 | 11 | ISFVNSTSHFW | | 380 |
| HPV18 | E1 | 461 | 10 | ITFLGALKSF | | 381 |
| HPV18 | E1 | 590 | 10 | ITVFEFPNAF | | 382 |
| HPV18 | E1 | 439 | 8 | KIDEGGDW | | 383 |
| HPV18 | E1 | 318 | 10 | KLRSSVAALY | | 384 |
| HPV18 | E1 | 318 | 11 | KLRSSVAALYW | | 385 |
| HPV18 | E1 | 234 | 10 | KSDKTTCTDW | | 386 |
| HPV18 | E1 | 401 | 8 | KSNCQAKY | | 387 |
| HPV18 | E1 | 490 | 8 | KSYFGMSF | | 388 |
| HPV18 | E1 | 490 | 11 | KSYFGMSFIHF | | 389 |
| HPV18 | E1 | 259 | 10 | KTLIQPFILY | | 390 |
| HPV18 | E1 | 281 | 8 | LILALLRY | | 391 |
| HPV18 | E1 | 261 | 8 | LIQPFILY | | 392 |
| HPV18 | E1 | 364 | 9 | LSEMVQWAF | | 393 |
| HPV18 | E1 | 224 | 10 | LSFTDLVRNF | | 394 |
| HPV18 | E1 | 376 | 9 | LTDESDMAF | | 395 |
| HPV18 | E1 | 376 | 11 | LTDESDMAFEY | | 396 |
| HPV18 | E1 | 214 | 9 | MLAVFKDTY | | 397 |
| HPV18 | E1 | 527 | 10 | MLDDATTTCW | | 398 |
| HPV18 | E1 | 47 | 11 | MVDFIDTQGTF | | 399 |

TABLE VII-continued

A01 Supermotif Peptides

| Type | Protein | Position | No. of Amino Acids | Sequence | A*0101 | Seq. Id. No. |
|---|---|---|---|---|---|---|
| HPV18 | E1 | 574 | 10 | NIHPAKDNRW | | 400 |
| HPV18 | E1 | 428 | 8 | NMSQWIRF | | 401 |
| HPV18 | E1 | 487 | 11 | NTGKSYFGMSF | | 402 |
| HPV18 | E1 | 448 | 8 | PIVQFLRY | | 403 |
| HPV18 | E1 | 607 | 10 | PVYEINDKNW | | 404 |
| HPV18 | E1 | 426 | 10 | QMNMSQWIRF | | 405 |
| HPV18 | E1 | 80 | 10 | QVLHVLKRKF | | 406 |
| HPV18 | E1 | 589 | 11 | RITVFEFPNAF | | 407 |
| HPV18 | E1 | 128 | 10 | RLFTISDSGY | | 408 |
| HPV18 | E1 | 320 | 8 | RSSVAALY | | 409 |
| HPV18 | E1 | 320 | 9 | RSSVAALYW | | 410 |
| HPV18 | E1 | 320 | 10 | RSSVAALYWY | | 411 |
| HPV18 | E1 | 321 | 8 | SSVAALYW | | 412 |
| HPV18 | E1 | 321 | 9 | SSVAALYWY | | 413 |
| HPV18 | E1 | 322 | 8 | SVAALYWY | | 414 |
| HPV18 | E1 | 260 | 9 | TLIQPFILY | | 415 |
| HPV18 | E1 | 238 | 11 | TTCTDWVTAIF | | 416 |
| HPV18 | E1 | 533 | 10 | TTCWTYFDTY | | 417 |
| HPV18 | E1 | 532 | 8 | TTTCWTYF | | 418 |
| HPV18 | E1 | 532 | 11 | TTTCWTYFDTY | | 419 |
| HPV18 | E1 | 591 | 9 | TVFEFPNAF | | 420 |
| HPV18 | E1 | 591 | 11 | TVFEFPNAFPF | | 421 |
| HPV18 | E1 | 505 | 11 | VISFVNSTSHF | | 422 |
| HPV18 | E1 | 81 | 9 | VLHVLKRKF | | 423 |
| HPV18 | E1 | 280 | 9 | VLILALLRY | | 424 |
| HPV18 | E1 | 339 | 8 | VMGDTPEW | | 425 |
| HPV18 | E1 | 585 | 9 | YLESRITVF | | 426 |
| HPV18 | E1 | 585 | 11 | YLESRITVFEF | | 427 |
| HPV18 | E2 | 82 | 10 | ALQGLAQSRY | | 428 |
| HPV18 | E2 | 154 | 10 | ATCVSHRGLY | | 429 |
| HPV18 | E2 | 154 | 11 | ATCVSHRGLYY | | 430 |
| HPV18 | E2 | 132 | 11 | CMTYVAWDSVY | | 431 |
| HPV18 | E2 | 14 | 10 | CVQDKIIDHY | | 432 |
| HPV18 | E2 | 156 | 8 | CVSHRGLY | | 433 |
| HPV18 | E2 | 156 | 9 | CVSHRGLYY | | 434 |
| HPV18 | E2 | 29 | 8 | DIDSQIQY | | 435 |
| HPV18 | E2 | 29 | 9 | DIDSQIQYW | | 436 |
| HPV18 | E2 | 315 | 8 | DISSTWHW | | 437 |
| HPV18 | E2 | 26 | 11 | DSKDIDSQIQY | | 438 |
| HPV18 | E2 | 354 | 9 | DSVQILVGY | | 439 |
| HPV18 | E2 | 104 | 11 | ELWNTEPTHCF | | 440 |
| HPV18 | E2 | 161 | 9 | GLYYVKEGY | | 441 |
| HPV18 | E2 | 338 | 9 | HSETQRTKF | | 442 |
| HPV18 | E2 | 329 | 9 | KTGILTVTY | | 443 |
| HPV18 | E2 | 39 | 9 | LIRWENAIF | | 444 |
| HPV18 | E2 | 39 | 10 | LIRWENAIFF | | 445 |
| HPV18 | E2 | 133 | 10 | MTYVAWDSVY | | 446 |
| HPV18 | E2 | 133 | 11 | MTYVAWDSVYY | | 447 |
| HPV18 | E2 | 297 | 8 | NSLKCLRY | | 448 |
| HPV18 | E2 | 107 | 8 | NTEPTHCF | | 449 |
| HPV18 | E2 | 185 | 9 | NTGTWEVHF | | 450 |
| HPV18 | E2 | 33 | 10 | QIQYWQLIRW | | 451 |
| HPV18 | E2 | 38 | 10 | QLIRWENAIF | | 452 |
| HPV18 | E2 | 38 | 11 | QLIRWENAIFF | | 453 |
| HPV18 | E2 | 220 | 9 | QLQHTPSPY | | 454 |
| HPV18 | E2 | 88 | 9 | QSRYKTEDW | | 455 |
| HPV18 | E2 | 56 | 11 | QTLNHQVVPAY | | 456 |
| HPV18 | E2 | 305 | 9 | RLRKHSDHY | | 457 |
| HPV18 | E2 | 230 | 11 | STVSVGTAKTY | | 458 |
| HPV18 | E2 | 233 | 8 | SVGTAKTY | | 459 |
| HPV18 | E2 | 355 | 8 | SVQILVGY | | 460 |
| HPV18 | E2 | 140 | 11 | SVYYMTDAGTW | | 461 |
| HPV18 | E2 | 57 | 10 | TLNHQVVPAY | | 462 |
| HPV18 | E2 | 97 | 10 | TLQDTCEELW | | 463 |
| HPV18 | E2 | 231 | 10 | TVSVGTAKTY | | 464 |
| HPV18 | E2 | 157 | 8 | VSHRGLYY | | 465 |
| HPV18 | E2 | 232 | 9 | VSVGTAKTY | | 466 |
| HPV18 | E2 | 96 | 11 | WTLQDTCEELW | | 467 |
| HPV18 | E2 | 173 | 11 | YIEFKSECEKY | | 468 |
| HPV18 | E2 | 143 | 8 | YMTDAGTW | | 469 |
| HPV18 | E2 | 135 | 8 | YVAWDSVY | | 470 |
| HPV18 | E2 | 135 | 9 | YVAWDSVYY | | 471 |
| HPV18 | E2 | 164 | 9 | YVKEGYNTF | | 472 |
| HPV18 | E2 | 164 | 10 | YVKEGYNTFY | | 473 |

TABLE VII-continued

A01 Supermotif Peptides

| Type | Protein | Position | No. of Amino Acids | Sequence | A*0101 | Seq. Id. No. |
|---|---|---|---|---|---|---|
| HPV18 | E5 | 47 | 9 | ATAFTVYVF | | 474 |
| HPV18 | E5 | 47 | 11 | ATAFTVYVFCF | | 475 |
| HPV18 | E5 | 27 | 11 | CMCAYAWVLVF | | 476 |
| HPV18 | E5 | 6 | 10 | FLFCFCVCMY | | 477 |
| HPV18 | E5 | 50 | 8 | FTVYVFCF | | 478 |
| HPV18 | E5 | 43 | 8 | ITSPATAF | | 479 |
| HPV18 | E5 | 43 | 11 | ITSPATAFTVY | | 480 |
| HPV18 | E5 | 40 | 11 | IVVITSPATAF | | 481 |
| HPV18 | E5 | 22 | 10 | LLPSVCMCAY | | 482 |
| HPV18 | E5 | 2 | 9 | LSLIFLFCF | | 483 |
| HPV18 | E5 | 1 | 8 | MLSLIFLF | | 484 |
| HPV18 | E5 | 1 | 10 | MLSLIFLFCF | | 485 |
| HPV18 | E5 | 21 | 11 | PLLPSVCMCAY | | 486 |
| HPV18 | E5 | 24 | 8 | PSVCMCAY | | 487 |
| HPV18 | E5 | 24 | 10 | PSVCMCAYAW | | 488 |
| HPV18 | E5 | 3 | 8 | SLIFLFCF | | 489 |
| HPV18 | E5 | 25 | 9 | SVCMCAYAW | | 490 |
| HPV18 | E5 | 44 | 10 | TSPATAFTVY | | 491 |
| HPV18 | E5 | 42 | 9 | VITSPATAF | | 492 |
| HPV18 | E5 | 41 | 10 | VVITSPATAF | | 493 |
| HPV18 | E6 | 27 | 8 | DIEITCVY | 0.0025 | 494 |
| HPV18 | E6 | 77 | 10 | ELRHYSDSVY | 0.0037 | 495 |
| HPV18 | E6 | 40 | 8 | ELTEVFEF | | 496 |
| HPV18 | E6 | 40 | 10 | ELTEVFEFAF | | 497 |
| HPV18 | E6 | 43 | 11 | EVFEFAFKDLF | | 498 |
| HPV18 | E6 | 120 | 8 | HLNEKRRF | | 499 |
| HPV18 | E6 | 117 | 11 | KLRHLNEKRRF | | 500 |
| HPV18 | E6 | 92 | 8 | KLTNTGLY | | 501 |
| HPV18 | E6 | 36 | 10 | KTVLELTEVF | | 502 |
| HPV18 | E6 | 41 | 9 | LTEVFEFAF | | 503 |
| HPV18 | E6 | 74 | 8 | RIRELRHY | | 504 |
| HPV18 | E6 | 24 | 11 | SLQDIEITCVY | | 505 |
| HPV18 | E6 | 89 | 11 | TLEKLTNTGLY | 5.9000 | 506 |
| HPV18 | E6 | 37 | 9 | TVLELTEVF | | 507 |
| HPV18 | E6 | 37 | 11 | TVLELTEVFEF | | 508 |
| HPV18 | E6 | 38 | 8 | VLELTEVF | | 509 |
| HPV18 | E6 | 38 | 10 | VLELTEVFEF | | 510 |
| HPV18 | E6 | 72 | 10 | YSRIRELRHY | 0.0008 | 511 |
| HPV18 | E7 | 82 | 9 | DLRAFQQLF | | 512 |
| HPV18 | E7 | 77 | 10 | ESSADDLRAF | | 513 |
| HPV18 | E7 | 90 | 11 | FLNTLSFVCPW | | 514 |
| HPV18 | E7 | 92 | 9 | NTLSFVCPW | | 515 |
| HPV18 | E7 | 88 | 9 | QLFLNTLSF | | 516 |
| HPV18 | E7 | 78 | 9 | SSADDLRAF | | 517 |
| HPV18 | E7 | 93 | 8 | TLSFVCPW | | 518 |
| HPV18 | L1 | 63 | 11 | ALWRPSDNTVY | | 519 |
| HPV18 | L1 | 345 | 8 | ASPGSCVY | | 520 |
| HPV18 | L1 | 407 | 11 | ASTQSPVPGQY | | 521 |
| HPV18 | L1 | 310 | 8 | CLRREQLF | | 522 |
| HPV18 | L1 | 2 | 11 | CLYTRVLILHY | | 523 |
| HPV18 | L1 | 284 | 9 | DICQSICKY | | 524 |
| HPV18 | L1 | 122 | 8 | DIPKVSAY | | 525 |
| HPV18 | L1 | 122 | 10 | DIPKVSAYQY | | 526 |
| HPV18 | L1 | 520 | 11 | DLDQYPLGRKF | | 527 |
| HPV18 | L1 | 364 | 9 | DSQLFNKPY | | 528 |
| HPV18 | L1 | 364 | 10 | DSQLFNKPYW | | 529 |
| HPV18 | L1 | 263 | 9 | DTGYGAMDF | | 530 |
| HPV18 | L1 | 330 | 9 | DTVPQSLY | | 531 |
| HPV18 | L1 | 203 | 10 | DVRDNVSVDY | | 532 |
| HPV18 | L1 | 49 | 8 | FLRNVNVF | | 533 |
| HPV18 | L1 | 49 | 11 | FLRNVNVFPIF | | 534 |
| HPV18 | L1 | 517 | 8 | FSLDLDQY | | 535 |
| HPV18 | L1 | 145 | 8 | GLPDTSIY | | 536 |
| HPV18 | L1 | 177 | 8 | GLSGHPFY | | 537 |
| HPV18 | L1 | 342 | 11 | GMPASPGSCVY | | 538 |
| HPV18 | L1 | 358 | 11 | GSIVTSDSQLF | | 539 |
| HPV18 | L1 | 383 | 9 | GVCWHNQLF | | 540 |
| HPV18 | L1 | 175 | 9 | GVGLSGHPF | | 541 |
| HPV18 | L1 | 175 | 10 | GVGLSGHPFY | | 542 |
| HPV18 | L1 | 38 | 8 | HIIICGHY | | 543 |
| HPV18 | L1 | 13 | 10 | HLLPLYGPLY | | 544 |
| HPV18 | L1 | 454 | 11 | HSMNSSILEDW | | 545 |
| HPV18 | L1 | 428 | 9 | HVEEYDLQF | | 546 |
| HPV18 | L1 | 428 | 11 | HVEEYDLQFIF | | 547 |

TABLE VII-continued

A01 Supermotif Peptides

| Type | Protein | Position | No. of Amino Acids | Sequence | A*0101 | Seq. Id. No. |
|---|---|---|---|---|---|---|
| HPV18 | L1 | 40 | 10 | IICGHYIILF | | 548 |
| HPV18 | L1 | 39 | 11 | IIICGHYIILF | | 549 |
| HPV18 | L1 | 46 | 11 | IILFLRNVNVF | | 550 |
| HPV18 | L1 | 47 | 10 | ILFLRNVNVF | | 551 |
| HPV18 | L1 | 9 | 10 | ILHYHLLPLY | | 552 |
| HPV18 | L1 | 443 | 10 | ITLTADVMSY | | 553 |
| HPV18 | L1 | 360 | 9 | IVTSDSQLF | | 554 |
| HPV18 | L1 | 125 | 10 | KVSAYQYRVF | | 555 |
| HPV18 | L1 | 8 | 11 | LILHYHLLPLY | | 556 |
| HPV18 | L1 | 14 | 9 | LLPLYGPLY | | 557 |
| HPV18 | L1 | 103 | 8 | LLTVGNPY | | 558 |
| HPV18 | L1 | 103 | 9 | LLTVGNPYF | | 559 |
| HPV18 | L1 | 445 | 8 | LTADVMSY | | 560 |
| HPV18 | L1 | 104 | 8 | LTVGNPYF | | 561 |
| HPV18 | L1 | 298 | 11 | MSADPYGDSMF | | 562 |
| HPV18 | L1 | 261 | 11 | MVDTGYGAMDF | | 563 |
| HPV18 | L1 | 36 | 10 | MVHIIICGHY | | 564 |
| HPV18 | L1 | 457 | 8 | NSSILEDW | | 565 |
| HPV18 | L1 | 457 | 10 | NSSILEDWNF | | 566 |
| HPV18 | L1 | 510 | 8 | NVDLKEKF | | 567 |
| HPV18 | L1 | 52 | 8 | NVNVFPIF | | 568 |
| HPV18 | L1 | 57 | 9 | PIFLQMALW | | 569 |
| HPV18 | L1 | 282 | 11 | PLDICQSICKY | | 570 |
| HPV18 | L1 | 173 | 11 | PLGVGLSGHPF | | 571 |
| HPV18 | L1 | 28 | 8 | PLHSILVY | | 572 |
| HPV18 | L1 | 26 | 10 | PLPLHSILVY | | 573 |
| HPV18 | L1 | 472 | 9 | PTTSLVDTY | | 574 |
| HPV18 | L1 | 472 | 11 | PTTSLVDTYRF | | 575 |
| HPV18 | L1 | 412 | 11 | PVPGQYDATKF | | 576 |
| HPV18 | L1 | 315 | 8 | QLFARHFW | | 577 |
| HPV18 | L1 | 366 | 8 | QLFNKPYW | | 578 |
| HPV18 | L1 | 137 | 8 | QLPDPNKF | | 579 |
| HPV18 | L1 | 287 | 9 | QSICKYPDY | | 580 |
| HPV18 | L1 | 410 | 8 | QSPVPGQY | | 581 |
| HPV18 | L1 | 102 | 9 | RLLTVGNPY | | 582 |
| HPV18 | L1 | 102 | 10 | RLLTVGNPYF | | 583 |
| HPV18 | L1 | 135 | 10 | RVQLPDPNKF | | 584 |
| HPV18 | L1 | 81 | 8 | RVVNTDDY | | 585 |
| HPV18 | L1 | 288 | 8 | SICKYPDY | | 586 |
| HPV18 | L1 | 459 | 8 | SILEDWNF | | 587 |
| HPV18 | L1 | 359 | 10 | SIVTSDSQLF | | 588 |
| HPV18 | L1 | 475 | 8 | SLVDTYRF | | 589 |
| HPV18 | L1 | 455 | 10 | SMNSSILEDW | | 590 |
| HPV18 | L1 | 458 | 9 | SSILEDWNF | | 591 |
| HPV18 | L1 | 100 | 11 | SSRLLTVGNPY | | 592 |
| HPV18 | L1 | 408 | 10 | STQSPVPGQY | | 593 |
| HPV18 | L1 | 78 | 11 | SVARVVNTDDY | | 594 |
| HPV18 | L1 | 442 | 11 | TITLTADVMSY | | 595 |
| HPV18 | L1 | 444 | 9 | TLTADVMSY | | 596 |
| HPV18 | L1 | 327 | 11 | TMGDTVPQSLY | | 597 |
| HPV18 | L1 | 362 | 11 | TSDSQLFNKPY | | 598 |
| HPV18 | L1 | 474 | 9 | TSLVDTYRF | | 599 |
| HPV18 | L1 | 473 | 8 | TTSLVDTY | | 600 |
| HPV18 | L1 | 473 | 10 | TTSLVDTYRF | | 601 |
| HPV18 | L1 | 126 | 9 | VSAYQYRVF | | 602 |
| HPV18 | L1 | 89 | 8 | VTPTSIFY | | 603 |
| HPV18 | L1 | 361 | 8 | VTSDSQLF | | 604 |
| HPV18 | L1 | 295 | 9 | YLQMSADPY | | 605 |
| HPV18 | L1 | 35 | 11 | YMVHIIICGHY | | 606 |
| HPV18 | L1 | 425 | 8 | YSRHVEEY | | 607 |
| HPV18 | L1 | 4 | 9 | YTRVLILHY | | 608 |
| HPV18 | L1 | 88 | 8 | YVTPTSIF | | 609 |
| HPV18 | L1 | 88 | 9 | YVTPTSIFY | | 610 |
| HPV18 | L2 | 286 | 11 | ALTSRRGTVRF | | 611 |
| HPV18 | L2 | 341 | 8 | ATEDNDLF | | 612 |
| HPV18 | L2 | 341 | 11 | ATEDNDLFDIY | | 613 |
| HPV18 | L2 | 322 | 11 | DISPIAPSPEY | | 614 |
| HPV18 | L2 | 404 | 11 | DITLPSTTSVW | | 615 |
| HPV18 | L2 | 443 | 11 | FIPKKRKRVPY | | 616 |
| HPV18 | L2 | 241 | 11 | FLTRPSSLITY | | 617 |
| HPV18 | L2 | 296 | 11 | FSRLGQRATMF | | 618 |
| HPV18 | L2 | 429 | 8 | GIHGTHYY | | 619 |
| HPV18 | L2 | 429 | 10 | GIHGTHYYLW | | 620 |
| HPV18 | L2 | 62 | 10 | GSGTGGRTGY | | 621 |

TABLE VII-continued

A01 Supermotif Peptides

| Type | Protein | Position | No. of Amino Acids | Sequence | A*0101 | Seq. Id. No. |
|---|---|---|---|---|---|---|
| HPV18 | L2 | 64 | 8 | GTGGRTGY | | 622 |
| HPV18 | L2 | 432 | 10 | GTHYYLWPLY | | 623 |
| HPV18 | L2 | 432 | 11 | GTHYYLWPLYY | | 624 |
| HPV18 | L2 | 183 | 10 | GTPTSGTHGY | | 625 |
| HPV18 | L2 | 310 | 10 | GTQIGARVHF | | 626 |
| HPV18 | L2 | 310 | 11 | GTQIGARVHFY | | 627 |
| HPV18 | L2 | 37 | 11 | GTTLADKILQW | | 628 |
| HPV18 | L2 | 44 | 10 | ILQWSSLGIF | | 629 |
| HPV18 | L2 | 323 | 10 | ISPIAPSPEY | | 630 |
| HPV18 | L2 | 152 | 11 | ISTTNFTNPAF | | 631 |
| HPV18 | L2 | 405 | 10 | ITLPSTTSVW | | 632 |
| HPV18 | L2 | 249 | 8 | ITYDNPAF | | 633 |
| HPV18 | L2 | 43 | 11 | KILQWSSLGIF | | 634 |
| HPV18 | L2 | 248 | 9 | LITYDNPAF | | 635 |
| HPV18 | L2 | 242 | 10 | LTRPSSLITY | | 636 |
| HPV18 | L2 | 287 | 10 | LTSRRGTVRF | | 637 |
| HPV18 | L2 | 391 | 10 | LTSSWDVPVY | | 638 |
| HPV18 | L2 | 338 | 11 | LVSATEDNDLF | | 639 |
| HPV18 | L2 | 386 | 10 | NVTVPLTSSW | | 640 |
| HPV18 | L2 | 325 | 8 | PIAPSPEY | | 641 |
| HPV18 | L2 | 390 | 11 | PLTSSWDVPVY | | 642 |
| HPV18 | L2 | 362 | 8 | PSRSTTSF | | 643 |
| HPV18 | L2 | 362 | 10 | PSRSTTSFAF | | 644 |
| HPV18 | L2 | 362 | 11 | PSRSTTSFAFF | | 645 |
| HPV18 | L2 | 419 | 9 | PTAPASTQY | | 646 |
| HPV18 | L2 | 120 | 9 | PTFTGTSGF | | 647 |
| HPV18 | L2 | 376 | 9 | PTISSASSY | | 648 |
| HPV18 | L2 | 185 | 8 | PTSGTHGY | | 649 |
| HPV18 | L2 | 258 | 8 | PVDTTLTF | | 650 |
| HPV18 | L2 | 360 | 10 | PVPSRSTTSF | | 651 |
| HPV18 | L2 | 312 | 8 | QIGARVHF | | 652 |
| HPV18 | L2 | 312 | 9 | QIGARVHFY | | 653 |
| HPV18 | L2 | 172 | 10 | QTGEVAGNVF | | 654 |
| HPV18 | L2 | 233 | 9 | QVSVANPEF | | 655 |
| HPV18 | L2 | 298 | 9 | RLGQRATMF | | 656 |
| HPV18 | L2 | 268 | 9 | RSDVPDSDF | | 657 |
| HPV18 | L2 | 364 | 8 | RSTTSFAF | | 658 |
| HPV18 | L2 | 364 | 9 | RSTTSFAFF | | 659 |
| HPV18 | L2 | 364 | 11 | RSTTSFAFFKY | | 660 |
| HPV18 | L2 | 220 | 8 | RVAGPRLY | | 661 |
| HPV18 | L2 | 450 | 10 | RVPYFFADGF | | 662 |
| HPV18 | L2 | 247 | 10 | SLITYDNPAF | | 663 |
| HPV18 | L2 | 246 | 11 | SSLITYDNPAF | | 664 |
| HPV18 | L2 | 393 | 8 | SSWDVPVY | | 665 |
| HPV18 | L2 | 147 | 11 | STSVSISTTNF | | 666 |
| HPV18 | L2 | 153 | 10 | STTNFTNPAF | | 667 |
| HPV18 | L2 | 365 | 8 | STTSFAFF | | 668 |
| HPV18 | L2 | 365 | 10 | STTSFAFFKY | | 669 |
| HPV18 | L2 | 149 | 9 | SVSISTTNF | | 670 |
| HPV18 | L2 | 377 | 8 | TISSASSY | | 671 |
| HPV18 | L2 | 39 | 9 | TLADKILQW | | 672 |
| HPV18 | L2 | 406 | 9 | TLPSTTSVW | | 673 |
| HPV18 | L2 | 367 | 8 | TSFAFFKY | | 674 |
| HPV18 | L2 | 114 | 9 | TSGAPRPTF | | 675 |
| HPV18 | L2 | 288 | 9 | TSRRGTVRF | | 676 |
| HPV18 | L2 | 392 | 9 | TSSWDVPVY | | 677 |
| HPV18 | L2 | 148 | 10 | TSVSISTTNF | | 678 |
| HPV18 | L2 | 38 | 10 | TTLADKILQW | | 679 |
| HPV18 | L2 | 154 | 9 | TTNFTNPAF | | 680 |
| HPV18 | L2 | 366 | 9 | TTSFAFFKY | | 681 |
| HPV18 | L2 | 388 | 8 | TVPLTSSW | | 682 |
| HPV18 | L2 | 217 | 11 | TVRRVAGPRLY | | 683 |
| HPV18 | L2 | 339 | 10 | VSATEDNDLF | | 684 |
| HPV18 | L2 | 150 | 8 | VSISTTNF | | 685 |
| HPV18 | L2 | 417 | 11 | VSPTAPASTQY | | 686 |
| HPV18 | L2 | 234 | 8 | VSVANPEF | | 687 |
| HPV18 | L2 | 113 | 10 | VTSGAPRPTF | | 688 |
| HPV18 | L2 | 387 | 9 | VTVPLTSSW | | 689 |
| HPV18 | L2 | 112 | 11 | VVTSGAPRPTF | | 690 |
| HPV18 | L2 | 427 | 9 | TIGIHGTHY | | 691 |
| HPV18 | L2 | 427 | 10 | YIGIHGTHYY | | 692 |
| HPV18 | L2 | 436 | 8 | YLWPLYYF | | 693 |
| HPV18 | L2 | 374 | 11 | YSPTISSASSY | | 694 |
| HPV31 | E1 | 186 | 10 | AMLGKFKELY | | 695 |

TABLE VII-continued

A01 Supermotif Peptides

| Type | Protein | Position | No. of Amino Acids | Sequence | A*0101 | Seq. Id. No. |
|---|---|---|---|---|---|---|
| HPV31 | E1 | 504 | 8 | ATTPCWHY | | 696 |
| HPV31 | E1 | 81 | 9 | AVQVLKRKY | | 697 |
| HPV31 | E1 | 213 | 9 | CTDWCVAAF | | 698 |
| HPV31 | E1 | 96 | 8 | DISSCVDY | | 699 |
| HPV31 | E1 | 421 | 8 | DIVKFLRY | | 700 |
| HPV31 | E1 | 336 | 8 | DLSQMVQW | | 701 |
| HPV31 | E1 | 336 | 10 | DLSQMVQWAY | | 702 |
| HPV31 | E1 | 364 | 9 | DSDSNACAF | | 703 |
| HPV31 | E1 | 352 | 8 | DSELAYKY | | 704 |
| HPV31 | E1 | 42 | 9 | DTGEDMVDF | | 705 |
| HPV31 | E1 | 348 | 10 | DVMDDSELAY | | 706 |
| HPV31 | E1 | 311 | 9 | DVYGETPEW | | 707 |
| HPV31 | E1 | 583 | 10 | ELSDKNWKSF | | 708 |
| HPV31 | E1 | 583 | 11 | ELSDKNWKSFF | | 709 |
| HPV31 | E1 | 50 | 8 | FIDNCNVY | | 710 |
| HPV31 | E1 | 473 | 9 | FLQGCIISY | | 711 |
| HPV31 | E1 | 425 | 9 | FLRYQQIEF | | 712 |
| HPV31 | E1 | 436 | 8 | FLSALKLF | | 713 |
| HPV31 | E1 | 199 | 8 | FMELIRPF | | 714 |
| HPV31 | E1 | 566 | 9 | FTFPNPFPF | | 715 |
| HPV31 | E1 | 433 | 11 | FVSFLSALKFL | | 716 |
| HPV31 | E1 | 499 | 11 | GMLDDATTPCW | | 717 |
| HPV31 | E1 | 305 | 9 | GMSNISDVY | | 718 |
| HPV31 | E1 | 252 | 10 | GMVMLMLVRF | | 719 |
| HPV31 | E1 | 11 | 8 | GTGCNGWF | | 720 |
| HPV31 | E1 | 11 | 9 | GTGCNGWFY | 3.9000 | 721 |
| HPV31 | E1 | 196 | 11 | GVSFMELIRPF | | 722 |
| HPV31 | E1 | 222 | 10 | GVTGTVAEGF | | 723 |
| HPV31 | E1 | 243 | 9 | HLQSLACSW | | 724 |
| HPV31 | E1 | 328 | 8 | HSFNDTTF | | 725 |
| HPV31 | E1 | 560 | 9 | HSRLVVFTF | | 726 |
| HPV31 | E1 | 478 | 11 | IISYANSKSHF | | 727 |
| HPV31 | E1 | 309 | 11 | ISDVYGETPEW | | 728 |
| HPV31 | E1 | 471 | 11 | ISFLQGCIISY | | 729 |
| HPV31 | E1 | 479 | 10 | ISYANSKSHF | | 730 |
| HPV31 | E1 | 479 | 11 | ISYANSKSHFW | | 731 |
| HPV31 | E1 | 291 | 10 | KLRSTAAALY | | 732 |
| HPV31 | E1 | 291 | 11 | KLRSTAAALYW | | 733 |
| HPV31 | E1 | 590 | 8 | KSFFSRTW | | 734 |
| HPV31 | E1 | 463 | 11 | KSYFGMSLISF | | 735 |
| HPV31 | E1 | 119 | 8 | KTAKRRLF | | 736 |
| HPV31 | E1 | 232 | 10 | KTLLQPYCLY | | 737 |
| HPV31 | E1 | 412 | 8 | KVSDEGDW | | 738 |
| HPV31 | E1 | 234 | 8 | LLQPYCLY | | 739 |
| HPV31 | E1 | 94 | 10 | LSDISSCVDY | | 740 |
| HPV31 | E1 | 584 | 9 | LSDKNWKSF | | 741 |
| HPV31 | E1 | 584 | 10 | LSDKNWKSFF | | 742 |
| HPV31 | E1 | 337 | 9 | LSQMVQWAY | | 743 |
| HPV31 | E1 | 563 | 10 | LVVFTFPNPF | | 744 |
| HPV31 | E1 | 500 | 10 | MLDDATTPCW | | 745 |
| HPV31 | E1 | 187 | 9 | MLGKFKELY | | 746 |
| HPV31 | E1 | 306 | 8 | MSNISDVY | | 747 |
| HPV31 | E1 | 47 | 11 | MVDFIDNCNVY | | 748 |
| HPV31 | E1 | 253 | 9 | MVMLMLVRF | | 749 |
| HPV31 | E1 | 547 | 10 | NINAGKDDRW | | 750 |
| HPV31 | E1 | 117 | 10 | NSKTAKRRLF | | 751 |
| HPV31 | E1 | 93 | 11 | PLSDISSCVDY | | 752 |
| HPV31 | E1 | 580 | 10 | PVYELSDKNW | | 753 |
| HPV31 | E1 | 207 | 10 | QSKNSTCTDW | | 754 |
| HPV31 | E1 | 323 | 8 | QTVLQHSF | | 755 |
| HPV31 | E1 | 124 | 10 | RLFELPDSGY | | 756 |
| HPV31 | E1 | 562 | 11 | RLVVFTFPNPF | | 757 |
| HPV31 | E1 | 293 | 8 | RSTAAALY | | 758 |
| HPV31 | E1 | 293 | 9 | RSTAAALYW | | 759 |
| HPV31 | E1 | 293 | 10 | RSTAAALYWY | | 760 |
| HPV31 | E1 | 303 | 11 | RTGMSNISDVY | | 761 |
| HPV31 | E1 | 40 | 11 | SSDTGEDMVDF | | 762 |
| HPV31 | E1 | 294 | 8 | STAAALYW | | 763 |
| HPV31 | E1 | 294 | 9 | STAAALYWY | | 764 |
| HPV31 | E1 | 211 | 11 | STCTDWCVAAF | | 765 |
| HPV31 | E1 | 233 | 9 | TLLQPYCLY | | 766 |
| HPV31 | E1 | 333 | 11 | TTFDLSQMVQW | | 767 |
| HPV31 | E1 | 505 | 11 | TTPCWHYIDNY | | 768 |
| HPV31 | E1 | 325 | 11 | VLQHSFNDTTF | | 769 |

TABLE VII-continued

A01 Supermotif Peptides

| Type | Protein | Position | No. of Amino Acids | Sequence | A*0101 | Seq. Id. No. |
|---|---|---|---|---|---|---|
| HPV31 | E1 | 349 | 9 | VMDDSEIAY | | 770 |
| HPV31 | E1 | 349 | 11 | VMDDSEIAYKY | | 771 |
| HPV31 | E1 | 254 | 8 | VMLMLVRF | | 772 |
| HPV31 | E1 | 434 | 10 | VSFLSALKLF | | 773 |
| HPV31 | E1 | 197 | 10 | VSFMELIRPF | | 774 |
| HPV31 | E1 | 223 | 9 | VTGTVAEGF | | 775 |
| HPV31 | E1 | 564 | 9 | VVFTFPNPF | | 776 |
| HPV31 | E1 | 564 | 11 | VVFTFPNPFPF | | 777 |
| HPV31 | E1 | 558 | 9 | YLHSRLVVF | | 778 |
| HPV31 | E1 | 558 | 11 | YLHSRLVVFTF | | 779 |
| HPV31 | E2 | 307 | 9 | CLRYRLSKY | | 780 |
| HPV31 | E2 | 22 | 11 | DSKRLCDHIDY | | 781 |
| HPV31 | E2 | 124 | 8 | DVHNTMHY | | 782 |
| HPV31 | E2 | 124 | 11 | DVHNTMHYTNW | | 783 |
| HPV31 | E2 | 197 | 11 | ESVFSSDEISF | | 784 |
| HPV31 | E2 | 80 | 8 | ETLNNTEY | | 785 |
| HPV31 | E2 | 185 | 11 | EVHAGGQVIVF | | 786 |
| HPV31 | E2 | 200 | 8 | FSSDEISF | | 787 |
| HPV31 | E2 | 171 | 8 | FTEEAKKY | | 788 |
| HPV31 | E2 | 168 | 11 | FVNFTEEAKKY | | 789 |
| HPV31 | E2 | 35 | 10 | HIRLECVLMY | | 790 |
| HPV31 | E2 | 164 | 8 | HITYFVNF | | 791 |
| HPV31 | E2 | 345 | 9 | ISTSQRDDF | | 792 |
| HPV31 | E2 | 193 | 8 | IVFPESVF | | 793 |
| HPV31 | E2 | 312 | 8 | LSKYKQLY | | 794 |
| HPV31 | E2 | 78 | 10 | MLETLNNTEY | | 795 |
| HPV31 | E2 | 77 | 11 | MMLETLNNTEY | | 796 |
| HPV31 | E2 | 303 | 8 | NILKCLRY | | 797 |
| HPV31 | E2 | 84 | 9 | NTEYKNEDW | | 798 |
| HPV31 | E2 | 127 | 8 | NTMHYTNW | | 799 |
| HPV31 | E2 | 127 | 10 | NTMHYTNWKF | | 800 |
| HPV31 | E2 | 361 | 9 | NTVSVSTGY | | 801 |
| HPV31 | E2 | 9 | 11 | NVCQDKILEHY | | 802 |
| HPV31 | E2 | 106 | 10 | PTGCLKKHGY | | 803 |
| HPV31 | E2 | 317 | 10 | QLYEQVSSTW | | 804 |
| HPV31 | E2 | 191 | 10 | QVIVFPESVF | | 805 |
| HPV31 | E2 | 151 | 8 | QVNCKGIY | | 806 |
| HPV31 | E2 | 151 | 9 | QVNCKGIYY | | 807 |
| HPV31 | E2 | 321 | 8 | QVSSTWHW | | 808 |
| HPV31 | E2 | 25 | 8 | RLCDHIDY | | 809 |
| HPV31 | E2 | 25 | 9 | RLCDHIDYW | | 810 |
| HPV31 | E2 | 37 | 8 | RLECVLMY | | 811 |
| HPV31 | E2 | 311 | 9 | RLSKYKQLY | | 812 |
| HPV31 | E2 | 346 | 8 | STSQRDDF | | 813 |
| HPV31 | E2 | 198 | 10 | SVFSSDEISF | | 814 |
| HPV31 | E2 | 128 | 9 | TMHYTNWKF | | 815 |
| HPV31 | E2 | 128 | 11 | TMHYTNWKFIY | | 816 |
| HPV31 | E2 | 93 | 10 | TMQQTSLELY | | 817 |
| HPV31 | E2 | 362 | 8 | TVSVSTGY | | 818 |
| HPV31 | E2 | 192 | 9 | VIVFPESVF | | 819 |
| HPV31 | E2 | 92 | 11 | WTMQQTSLELY | | 820 |
| HPV31 | E2 | 344 | 10 | YISTSQRDDF | | 821 |
| HPV31 | E2 | 131 | 8 | YTNWKFIY | | 822 |
| HPV31 | E2 | 159 | 9 | YVHEGHITY | | 823 |
| HPV31 | E2 | 159 | 10 | YVHEGHITYF | | 824 |
| HPV31 | E5 | 40 | 11 | ATLLLLIVILW | | 825 |
| HPV31 | E5 | 53 | 8 | ATSPLRCF | | 826 |
| HPV31 | E5 | 53 | 11 | ATSPLRCFCIY | | 827 |
| HPV31 | E5 | 61 | 8 | CIYVVFIY | | 828 |
| HPV31 | E5 | 15 | 10 | FLLCFCVLLF | | 829 |
| HPV31 | E5 | 72 | 9 | FVIHTHASF | | 830 |
| HPV31 | E5 | 6 | 10 | ISTVSIVLCF | | 831 |
| HPV31 | E5 | 11 | 9 | IVLCFLLCF | | 832 |
| HPV31 | E5 | 16 | 9 | LLCFCVLLF | | 833 |
| HPV31 | E5 | 43 | 8 | LLLIVILW | | 834 |
| HPV31 | E5 | 42 | 9 | LLLLIVILW | | 835 |
| HPV31 | E5 | 32 | 8 | LVLSVSVY | | 836 |
| HPV31 | E5 | 5 | 11 | NISTVSIVLCF | | 837 |
| HPV31 | E5 | 70 | 11 | PLFVIHTHASF | | 838 |
| HPV31 | E5 | 56 | 8 | PLRCFCIY | | 839 |
| HPV31 | E5 | 56 | 11 | PLRCFCIYVVF | | 840 |
| HPV31 | E5 | 31 | 9 | PLVLSVSVY | | 841 |
| HPV31 | E5 | 10 | 10 | SIVLCFLLCF | | 842 |
| HPV31 | E5 | 7 | 9 | STVSIVLCF | | 843 |

TABLE VII-continued

A01 Supermotif Peptides

| Type | Protein | Position | No. of Amino Acids | Sequence | A*0101 | Seq. Id. No. |
|---|---|---|---|---|---|---|
| HPV31 | E5 | 41 | 10 | TLLLLIVILW | | 844 |
| HPV31 | E5 | 54 | 10 | TSPLRCFCIY | | 845 |
| HPV31 | E5 | 8 | 8 | TVSIVLCF | | 846 |
| HPV31 | E5 | 51 | 10 | VIATSPLRCF | | 847 |
| HPV31 | E5 | 73 | 8 | VIHTHASF | | 848 |
| HPV31 | E5 | 12 | 8 | VLCFLLCF | | 849 |
| HPV31 | E5 | 9 | 11 | VSIVLCFLLCF | | 850 |
| HPV31 | E5 | 64 | 9 | VVFIYIPLF | | 851 |
| HPV31 | E5 | 50 | 11 | WVIATSPLRCF | | 852 |
| HPV31 | E5 | 63 | 10 | YVVFIYIPLF | | 853 |
| HPV31 | E6 | 66 | 11 | CLRFYSKVSEF | | 854 |
| HPV31 | E6 | 63 | 8 | CTKCLRFY | | 855 |
| HPV31 | E6 | 25 | 8 | ELRLNCVY | | 856 |
| HPV31 | E6 | 14 | 10 | ELSSALEIPY | | 857 |
| HPV31 | E6 | 39 | 9 | ETEVLDFAF | | 858 |
| HPV31 | E6 | 47 | 8 | FTDLTIVY | | 859 |
| HPV31 | E6 | 61 | 9 | GVCTKCLRF | | 860 |
| HPV31 | E6 | 61 | 10 | GVCTKCLRFY | | 861 |
| HPV31 | E6 | 118 | 8 | HLDKKKRF | | 862 |
| HPV31 | E6 | 72 | 8 | KVSEFRWY | | 863 |
| HPV31 | E6 | 72 | 10 | KVSEFRWYRY | | 864 |
| HPV31 | E6 | 15 | 9 | LSSALEIPY | | 865 |
| HPV31 | E6 | 37 | 9 | LTETEVLDF | | 866 |
| HPV31 | E6 | 37 | 11 | LTETEVLDFAF | | 867 |
| HPV31 | E6 | 36 | 10 | QLTETEVLDF | | 868 |
| HPV31 | E6 | 16 | 8 | SSALEIPY | | 869 |
| HPV31 | E6 | 73 | 9 | VSEFRWYRY | | 870 |
| HPV31 | E6 | 132 | 9 | WTGRCIACW | | 871 |
| HPV31 | E6 | 70 | 9 | YSKVSEFRW | | 872 |
| HPV31 | E6 | 70 | 10 | YSKVSEFRWY | | 873 |
| HPV31 | E7 | 48 | 10 | DTSNYNIVTF | | 874 |
| HPV31 | E7 | 4 | 8 | ETPTLQDY | | 875 |
| HPV31 | E7 | 78 | 10 | ILQELLMGSF | | 876 |
| HPV31 | E7 | 77 | 11 | RILQELLMGSF | | 877 |
| HPV31 | E7 | 49 | 9 | TSNYNIVTF | | 878 |
| HPV31 | L1 | 348 | 9 | AIANSDTTF | | 879 |
| HPV31 | L1 | 398 | 8 | AILEDWNF | | 880 |
| HPV31 | L1 | 285 | 8 | ATLANSTY | | 881 |
| HPV31 | L1 | 285 | 9 | ATLANSTYF | | 882 |
| HPV31 | L1 | 224 | 9 | DICNSICKY | | 883 |
| HPV31 | L1 | 459 | 11 | DLDQFPLGRKF | | 884 |
| HPV31 | L1 | 129 | 8 | DTENSNRY | | 885 |
| HPV31 | L1 | 203 | 9 | DTGFGAMDF | | 886 |
| HPV31 | L1 | 353 | 9 | DTTFKSSNF | | 887 |
| HPV31 | L1 | 270 | 8 | ESVPTDLY | | 888 |
| HPV31 | L1 | 449 | 8 | EVNLKEKF | | 889 |
| HPV31 | L1 | 456 | 8 | FSADLDQF | | 890 |
| HPV31 | L1 | 323 | 9 | GICWGNQLF | | 891 |
| HPV31 | L1 | 117 | 11 | GISGHPLLNKF | | 892 |
| HPV31 | L1 | 413 | 9 | GSLEDTYRF | | 893 |
| HPV31 | L1 | 298 | 11 | GSMVTSDAQIF | | 894 |
| HPV31 | L1 | 282 | 11 | GSTATLANSTY | | 895 |
| HPV31 | L1 | 393 | 11 | HSMNPAILEDW | | 896 |
| HPV31 | L1 | 118 | 10 | ISGHPLLNKF | | 897 |
| HPV31 | L1 | 382 | 10 | ITLSADIMTY | | 898 |
| HPV31 | L1 | 61 | 11 | IVVPKVSGLQY | | 899 |
| HPV31 | L1 | 381 | 11 | KITLSADIMTY | | 900 |
| HPV31 | L1 | 357 | 8 | KSSNFKEY | | 901 |
| HPV31 | L1 | 65 | 10 | KVSGLQYRVF | | 902 |
| HPV31 | L1 | 20 | 8 | KVVSTDEY | | 903 |
| HPV31 | L1 | 42 | 8 | LLTVGHPY | | 904 |
| HPV31 | L1 | 42 | 9 | LLTVGHPYY | | 905 |
| HPV31 | L1 | 384 | 8 | LSADIMTY | | 906 |
| HPV31 | L1 | 43 | 8 | LTVGHPYY | | 907 |
| HPV31 | L1 | 238 | 11 | MVAEPYGDTLF | | 908 |
| HPV31 | L1 | 201 | 11 | MVDTGFGAMDF | | 909 |
| HPV31 | L1 | 300 | 9 | MVTSDAQIF | | 910E |
| HPV31 | L1 | 351 | 11 | NSDTTFKSSNF | | 911 |
| HPV31 | L1 | 227 | 9 | NSICKYPDY | | 912 |
| HPV31 | L1 | 222 | 11 | PLDICNSICKY | | 913 |
| HPV31 | L1 | 411 | 9 | PSGSLEDTY | | 914 |
| HPV31 | L1 | 411 | 11 | PSGSLEDTYRF | | 915 |
| HPV31 | L1 | 17 | 11 | PVSKVVSTDEY | | 916 |
| HPV31 | L1 | 306 | 8 | QIFNKPYW | | 917 |

TABLE VII-continued

A01 Supermotif Peptides

| Type | Protein | Position | No. of Amino Acids | Sequence | A*0101 | Seq. Id. No. |
|---|---|---|---|---|---|---|
| HPV31 | L1 | 255 | 8 | QMFVRHFF | | 918 |
| HPV31 | L1 | 41 | 9 | RLLTVGHPY | | 919 |
| HPV31 | L1 | 41 | 10 | RLLTVGHPYY | | 920 |
| HPV31 | L1 | 77 | 8 | RLPDNKF | | 921 |
| HPV31 | L1 | 77 | 10 | RLPDNKFGF | | 922 |
| HPV31 | L1 | 75 | 10 | RVRLPDNKF | | 923 |
| HPV31 | L1 | 228 | 8 | SICKYPDY | | 924 |
| HPV31 | L1 | 414 | 8 | SLEDTYRF | | 925 |
| HPV31 | L1 | 2 | 11 | SLWRPSEATVY | | 926 |
| HPV31 | L1 | 394 | 10 | SMNPAILEDW | | 927 |
| HPV31 | L1 | 299 | 10 | SMVTSDAQIF | | 928 |
| HPV31 | L1 | 283 | 10 | STATLANSTY | | 929 |
| HPV31 | L1 | 283 | 11 | STATLANSTYF | | 930 |
| HPV31 | L1 | 286 | 8 | TLANSTYF | | 931 |
| HPV31 | L1 | 383 | 9 | TLSADIMTY | | 932 |
| HPV31 | L1 | 302 | 11 | TSDAQIFNKPY | | 933 |
| HPV31 | L1 | 354 | 8 | TTFKSSNF | | 934 |
| HPV31 | L1 | 354 | 11 | TTFKSSNFKEY | | 935 |
| HPV31 | L1 | 267 | 11 | TVGESVPTDLY | | 936 |
| HPV31 | L1 | 66 | 9 | VSGLQYRVF | | 937 |
| HPV31 | L1 | 18 | 10 | VSKVVSTDEY | | 938 |
| HPV31 | L1 | 28 | 8 | VTRTNIYY | | 939 |
| HPV31 | L1 | 301 | 8 | VTSDAQIF | | 940 |
| HPV31 | L1 | 62 | 10 | VVPKVSGLQY | | 941 |
| HPV31 | L1 | 235 | 9 | YLKMVAEPY | | 942 |
| HPV31 | L1 | 364 | 8 | YLRHGEEF | | 943 |
| HPV31 | L1 | 250 | 8 | YLRREQMF | | 944 |
| HPV31 | L1 | 27 | 8 | YVTRTNIY | | 945 |
| HPV31 | L1 | 27 | 9 | YVTRTNIYY | | 946 |
| HPV31 | L2 | 286 | 11 | ALTSRRNTVRY | | 947 |
| HPV31 | L2 | 311 | 9 | ATIGARVHY | | 948 |
| HPV31 | L2 | 311 | 10 | ATIGARVHYY | | 949 |
| HPV31 | L2 | 311 | 11 | ATIGARVHYYY | | 950 |
| HPV31 | L2 | 376 | 11 | AVQSTSAVSAY | | 951 |
| HPV31 | L2 | 354 | 8 | DIYADTDF | | 952 |
| HPV31 | L2 | 253 | 10 | ETVNAEESLY | | 953 |
| HPV31 | L2 | 253 | 11 | ETVNAEESLYF | | 954 |
| HPV31 | L2 | 237 | 11 | FLSAPKQLITY | | 955 |
| HPV31 | L2 | 433 | 8 | FVDGGDFY | | 956 |
| HPV31 | L2 | 351 | 11 | GLYDIYADTDF | | 957 |
| HPV31 | L2 | 63 | 10 | GSGTGGRTGY | | 958 |
| HPV31 | L2 | 65 | 8 | GTGGRTGY | | 959 |
| HPV31 | L2 | 213 | 11 | GVRRPARLGLY | | 960 |
| HPV31 | L2 | 38 | 11 | HTTIADQILRY | | 961 |
| HPV31 | L2 | 45 | 10 | ILRYGSMGVF | | 962 |
| HPV31 | L2 | 45 | 11 | ILRYGSMGVFF | | 963 |
| HPV31 | L2 | 245 | 8 | ITYENPAY | | 964 |
| HPV31 | L2 | 244 | 9 | LITYENPAY | | 965 |
| HPV31 | L2 | 238 | 10 | LSAPKQLITY | | 966 |
| HPV31 | L2 | 178 | 11 | LSSSSISTHNY | | 967 |
| HPV31 | L2 | 395 | 10 | LSTGFDIPIF | | 968 |
| HPV31 | L2 | 287 | 10 | LTSRRNTVRY | | 969 |
| HPV31 | L2 | 447 | 11 | MLKRRRKRVSY | | 970 |
| HPV31 | L2 | 269 | 8 | NIAPDPDF | | 971 |
| HPV31 | L2 | 390 | 10 | NTTVPLSTGF | | 972 |
| HPV31 | L2 | 410 | 10 | PIEHAPTQVF | | 973 |
| HPV31 | L2 | 122 | 11 | PIPHPPTTSGF | | 974 |
| HPV31 | L2 | 394 | 11 | PLSTGFDIPIF | | 975 |
| HPV31 | L2 | 425 | 9 | PTTPQVSIF | | 976 |
| HPV31 | L2 | 44 | 11 | QILRYGSMGVF | | 977 |
| HPV31 | L2 | 243 | 10 | QLITYENPAY | | 978 |
| HPV31 | L2 | 378 | 9 | QSTSAVSAY | | 979 |
| HPV31 | L2 | 229 | 9 | QVKVIDPTF | | 980 |
| HPV31 | L2 | 429 | 11 | QVSIFVDGGDF | | 981 |
| HPV31 | L2 | 9 | 11 | RTKRASATQLY | | 982 |
| HPV31 | L2 | 431 | 9 | SIFVDGGDF | | 983 |
| HPV31 | L2 | 431 | 10 | SIFVDGGDFY | | 984 |
| HPV31 | L2 | 181 | 8 | SSISTHNY | | 985- |
| HPV31 | L2 | 180 | 9 | SSSISTHNY | | 986 |
| HPV31 | L2 | 179 | 10 | SSSSISTHNY | | 987 |
| HPV31 | L2 | 396 | 9 | STGFDIPIF | | 988 |
| HPV31 | L2 | 151 | 8 | STHENPTF | | 989 |
| HPV31 | L2 | 346 | 8 | STLNDGLY | | 990 |
| HPV31 | L2 | 346 | 11 | STLNDGLYDIY | | 991 |

TABLE VII-continued

A01 Supermotif Peptides

| Type | Protein | Position | No. of Amino Acids | Sequence | A*0101 | Seq. Id. No. |
|---|---|---|---|---|---|---|
| HPV31 | L2 | 379 | 8 | STSAVSAY | | 992 |
| HPV31 | L2 | 149 | 10 | SVSTHENPTF | | 993 |
| HPV31 | L2 | 40 | 9 | TIADQILRY | | 994 |
| HPV31 | L2 | 312 | 8 | TIGARVHY | | 995 |
| HPV31 | L2 | 312 | 9 | TIGARVHYY | | 996 |
| HPV31 | L2 | 312 | 10 | TIGARVHYYY | | 997 |
| HPV31 | L2 | 347 | 10 | TLNDGLYDIY | | 998 |
| HPV31 | L2 | 266 | 11 | TSHNIAPDPDF | | 999 |
| HPV31 | L2 | 288 | 9 | TSRRNTVRY | | 1000 |
| HPV31 | L2 | 345 | 9 | TSTLNDGLY | | 1001 |
| HPV31 | L2 | 148 | 11 | TSVSTHENPTF | | 1002 |
| HPV31 | L2 | 39 | 10 | TTIADQILRY | | 1003 |
| HPV31 | L2 | 426 | 8 | TTPQVSIF | | 1004 |
| HPV31 | L2 | 344 | 10 | TTSTLNDGLY | | 1005 |
| HPV31 | L2 | 343 | 11 | TTTSTLNDGLY | | 1006 |
| HPV31 | L2 | 391 | 9 | TTVPLSTGF | | 1007 |
| HPV31 | L2 | 254 | 9 | TVNAEESLY | | 1008 |
| HPV31 | L2 | 254 | 10 | TVNAEESLYF | | 1009 |
| HPV31 | L2 | 392 | 8 | TVPLSTGF | | 1010 |
| HPV31 | L2 | 430 | 10 | VSIFVDGGDF | | 1011 |
| HPV31 | L2 | 430 | 11 | VSIFVDGGDFY | | 1012 |
| HPV31 | L2 | 150 | 9 | VSTHENPTF | | 1013 |
| HPV33 | E1 | 596 | 10 | AINDENWKSF | | 1014 |
| HPV33 | E1 | 596 | 11 | AINDENWKSFF | | 1015 |
| HPV33 | E1 | 81 | 9 | AVCALKRKF | | 1016 |
| HPV33 | E1 | 226 | 9 | CTDWCITGY | | 1017 |
| HPV33 | E1 | 494 | 8 | CVNSKSHF | | 1018 |
| HPV33 | E1 | 494 | 9 | CVNSKSHFW | | 1019 |
| HPV33 | E1 | 349 | 8 | DLSEMVQW | | 1020 |
| HPV33 | E1 | 349 | 10 | DLSEMVQWAY | | 1021 |
| HPV33 | E1 | 365 | 8 | DSDIAYYY | | 1022 |
| HPV33 | E1 | 42 | 9 | DSGTDLLEF | | 1023 |
| HPV33 | E1 | 377 | 9 | DSNSNAAAF | | 1024 |
| HPV33 | E1 | 62 | 9 | DTEAARALF | | 1025 |
| HPV33 | E1 | 324 | 9 | DVQGTTPEW | | 1026 |
| HPV33 | E1 | 516 | 9 | DVTPISWTY | | 1027 |
| HPV33 | E1 | 361 | 10 | ELTDDSDIAY | | 1028 |
| HPV33 | E1 | 361 | 11 | ELTDDSDIAYY | | 1029 |
| HPV33 | E1 | 449 | 8 | FLGAFKKF | | 1030 |
| HPV33 | E1 | 212 | 8 | FMELVRPF | | 1031 |
| HPV33 | E1 | 446 | 8 | FTAFLGAF | | 1032 |
| HPV33 | E1 | 446 | 11 | FTAFLGAFKKF | | 1033 |
| HPV33 | E1 | 265 | 10 | GIIILLLIRF | | 1034 |
| HPV33 | E1 | 209 | 11 | GISFMELVRPF | | 1035 |
| HPV33 | E1 | 11 | 8 | GMGCTGWF | | 1036 |
| HPV33 | E1 | 512 | 11 | GMIDDVTPISW | | 1037 |
| HPV33 | E1 | 564 | 8 | GTDSRWPY | | 1038 |
| HPV33 | E1 | 341 | 8 | HSFNDNIF | | 1039 |
| HPV33 | E1 | 573 | 9 | HSRLTVFEF | | 1040 |
| HPV33 | E1 | 192 | 11 | HSSNTKANILY | | 1041 |
| HPV33 | E1 | 266 | 9 | IIILLLIRF | | 1042 |
| HPV33 | E1 | 267 | 8 | IILLLIRF | | 1043 |
| HPV33 | E1 | 200 | 9 | ILYKFKEAY | | 1044 |
| HPV33 | E1 | 492 | 10 | ISCVNSKSHF | | 1045 |
| HPV33 | E1 | 492 | 11 | ISCVNSKSHFW | | 1046 |
| HPV33 | E1 | 322 | 11 | ISDVQGTTPEW | | 1047 |
| HPV33 | E1 | 210 | 10 | ISFMELVRPF | | 1048 |
| HPV33 | E1 | 520 | 9 | ISWTYIDDY | | 1049 |
| HPV33 | E1 | 124 | 10 | KIDELEDSGY | | 1050 |
| HPV33 | E1 | 304 | 10 | KLRSQTCALY | | 1051 |
| HPV33 | E1 | 304 | 11 | KLRSQTCALYW | | 1052 |
| HPV33 | E1 | 220 | 10 | KSDKTSCTDW | | 1053 |
| HPV33 | E1 | 603 | 8 | KSFFSRTW | | 1054 |
| HPV33 | E1 | 476 | 11 | KSYFGMSLIQF | | 1055 |
| HPV33 | E1 | 425 | 8 | KTNDGGNW | | 1056 |
| HPV33 | E1 | 245 | 10 | KVLIKQHSLY | | 1057 |
| HPV33 | E1 | 247 | 8 | LIKQHSLY | | 1058 |
| HPV33 | E1 | 438 | 9 | LLRYQNIEF | | 1059 |
| HPV33 | E1 | 350 | 9 | LSEMVQWAY | | 1060 |
| HPV33 | E1 | 362 | 9 | LTDDSDIAY | | 1061 |
| HPV33 | E1 | 362 | 10 | LTDDSDIAYY | | 1062 |
| HPV33 | E1 | 362 | 11 | LTDDSDIAYYY | | 1063 |
| HPV33 | E1 | 576 | 10 | LTVFEFKNPF | | 1064 |
| HPV33 | E1 | 336 | 8 | LTVLQHSF | | 1065 |

TABLE VII-continued

A01 Supermotif Peptides

| Type | Protein | Position | No. of Amino Acids | Sequence | A*0101 | Seq. Id. No. |
|---|---|---|---|---|---|---|
| HPV33 | E1 | 513 | 10 | MIDDVTPISW | | 1066 |
| HPV33 | E1 | 443 | 11 | NIEFTAFLGAF | | 1067 |
| HPV33 | E1 | 346 | 11 | NIFDLSEMVQW | | 1068 |
| HPV33 | E1 | 199 | 10 | NILYKFKEAY | | 1069 |
| HPV33 | E1 | 195 | 8 | NTKANILY | | 1070 |
| HPV33 | E1 | 195 | 10 | NTKANILYKF | | 1071 |
| HPV33 | E1 | 560 | 10 | NTNAGTDSRW | | 1072 |
| HPV33 | E1 | 519 | 10 | PISWTYIDDY | | 1073 |
| HPV33 | E1 | 434 | 8 | PIVQLLRY | | 1074 |
| HPV33 | E1 | 593 | 10 | PVYAINDENW | | 1075 |
| HPV33 | E1 | 437 | 10 | QLLRYQNIEF | | 1076 |
| HPV33 | E1 | 308 | 8 | QTCALYWF | | 1077 |
| HPV33 | E1 | 575 | 11 | RLTVFEFKNPF | | 1078 |
| HPV33 | E1 | 335 | 9 | RLTVLQHSF | | 1079 |
| HPV33 | E1 | 306 | 8 | RSQTCALY | | 1080 |
| HPV33 | E1 | 306 | 9 | RSQTCALYW | | 1081 |
| HPV33 | E1 | 306 | 10 | RSQTCALYWF | | 1082 |
| HPV33 | E1 | 111 | 10 | SINKNKECTY | | 1083 |
| HPV33 | E1 | 193 | 10 | SSNTKANILY | | 1084 |
| HPV33 | E1 | 224 | 11 | TSCTDWCITGY | | 1085 |
| HPV33 | E1 | 110 | 11 | TSINKNKECTY | | 1086 |
| HPV33 | E1 | 577 | 9 | TVFEFKNPF | | 1087 |
| HPV33 | E1 | 577 | 11 | TVFEFKNPFPF | | 1088 |
| HPV33 | E1 | 491 | 11 | VISCVNSKSHF | | 1089 |
| HPV33 | E1 | 246 | 9 | VLIKQHSLY | | 1090 |
| HPV33 | E1 | 338 | 11 | VLQHSFNDNIF | | 1091 |
| HPV33 | E1 | 517 | 8 | VTPISWTY | | 1092 |
| HPV33 | E1 | 571 | 9 | YLHSRLTVF | | 1093 |
| HPV33 | E1 | 571 | 11 | YLHSRLTVFEF | | 1094 |
| HPV33 | E2 | 78 | 10 | ALETLSKSQY | | 1095 |
| HPV33 | E2 | 41 | 11 | ALLYTAKQMGF | | 1096 |
| HPV33 | E2 | 10 | 10 | AVQEKILDLY | | 1097 |
| HPV33 | E2 | 288 | 9 | CLRYRLKPY | | 1098 |
| HPV33 | E2 | 145 | 10 | CTMVTGKVDY | | 1099 |
| HPV33 | E2 | 25 | 9 | DLPSQIEHW | | 1100 |
| HPV33 | E2 | 235 | 10 | DTAQPLTKLF | | 1101 |
| HPV33 | E2 | 298 | 10 | ELYSSMSSTW | | 1102 |
| HPV33 | E2 | 282 | 10 | ESNSLKCLRY | | 1103 |
| HPV33 | E2 | 80 | 8 | ETLSKSQY | | 1104 |
| HPV33 | E2 | 100 | 11 | EVWLCEPPKCF | | 1105 |
| HPV33 | E2 | 325 | 10 | FVTEQQQQMF | | 1106 |
| HPV33 | E2 | 34 | 11 | KLIRMECALLY | | 1107 |
| HPV33 | E2 | 84 | 9 | KSQYSTSQW | | 1108 |
| HPV33 | E2 | 23 | 11 | KTDLPSQIEHW | | 1109 |
| HPV33 | E2 | 151 | 8 | KVDYIGMY | | 1110 |
| HPV33 | E2 | 151 | 9 | KVDYIGMYY | | 1111 |
| HPV33 | E2 | 35 | 10 | LIRMECALLY | | 1112 |
| HPV33 | E2 | 62 | 9 | LLASKTKAF | | 1113 |
| HPV33 | E2 | 42 | 10 | LLYTAKQMGF | | 1114 |
| HPV33 | E2 | 82 | 11 | LSKSQYSTSQW | | 1115 |
| HPV33 | E2 | 147 | 8 | MVTGKVDY | | 1116 |
| HPV33 | E2 | 315 | 11 | NSKNGIVTVTF | | 1117 |
| HPV33 | E2 | 284 | 8 | NSLKCLRY | | 1118 |
| HPV33 | E2 | 127 | 8 | NTMDYTNW | | 1119 |
| HPV33 | E2 | 60 | 11 | PSLLASKTKAF | | 1120 |
| HPV33 | E2 | 342 | 9 | PTVQISTGF | | 1121 |
| HPV33 | E2 | 292 | 9 | RLKPYKELY | | 1122 |
| HPV33 | E2 | 37 | 8 | RMECALLY | | 1123 |
| HPV33 | E2 | 61 | 10 | SLLASKTKAF | | 1124 |
| HPV33 | F2 | 302 | 8 | SMSSTWHW | | 1125 |
| HPV33 | E2 | 301 | 9 | SSMSSTWHW | | 1126 |
| HPV33 | E2 | 93 | 10 | TLQQTSLEVW | | 1127 |
| HPV33 | E2 | 128 | 11 | TMDYTNWGEIY | | 1128 |
| HPV33 | E2 | 146 | 9 | TMVTGKVDY | | 1129 |
| HPV33 | E2 | 343 | 8 | TVQISTGF | | 1130 |
| HPV33 | E2 | 326 | 9 | VTEQQQQMF | | 1131 |
| HPV33 | E2 | 148 | 11 | VTGKVDYIGMY | | 1132 |
| HPV33 | E2 | 102 | 9 | WLCEPPKCF | | 1133 |
| HPV33 | E2 | 92 | 11 | WTLQQTSLEVW | | 1134 |
| HPV33 | E2 | 159 | 9 | YIHNCEKVY | | 1135 |
| HPV33 | E2 | 159 | 10 | YIHNCEKVYF | | 1136 |
| HPV33 | E2 | 300 | 8 | YSSMSSTW | | 1137 |
| HPV33 | E2 | 300 | 10 | YSSMSSTWHW | | 1138 |
| HPV33 | E2 | 44 | 8 | YTAKQMGF | | 1139 |

TABLE VII-continued

A01 Supermotif Peptides

| Type | Protein | Position | No. of Amino Acids | Sequence | A*0101 Seq. Id. No. |
|---|---|---|---|---|---|
| HPV33 | E2 | 131 | 8 | YTNWGEIY | 1140 |
| HPV33 | E5 | 56 | 11 | FLYLPMMCINF | 1141 |
| HPV33 | E5 | 3 | 10 | FVFVLCFILF | 1142 |
| HPV33 | E5 | 42 | 9 | FVGSPLKIF | 1143 |
| HPV33 | E5 | 42 | 10 | FVGSPLKIFF | 1144 |
| HPV33 | E5 | 5 | 8 | FVLCFILF | 1145 |
| HPV33 | E5 | 44 | 8 | GSPLKIFF | 1146 |
| HPV33 | E5 | 44 | 10 | GSPLKIFFCY | 1147 |
| HPV33 | E5 | 23 | 9 | ILSISTYAW | 1148 |
| HPV33 | E5 | 48 | 9 | KIFFCYLLF | 1149 |
| HPV33 | E5 | 48 | 11 | KIFFCYLLFLY | 1150 |
| HPV33 | E5 | 22 | 8 | LILSISTY | 1151 |
| HPV33 | E5 | 22 | 10 | LILSISTYAW | 1152 |
| HPV33 | E5 | 32 | 9 | LLVLVLLLW | 1153 |
| HPV33 | E5 | 32 | 11 | LLVLVLLLWVF | 1154 |
| HPV33 | E5 | 24 | 8 | LSISTYAW | 1155 |
| HPV33 | E5 | 35 | 8 | LVLLLWVF | 1156 |
| HPV33 | E5 | 33 | 8 | LVLVLLLW | 1157 |
| HPV33 | E5 | 33 | 10 | LVLVLLLWVF | 1158 |
| HPV33 | E5 | 1 | 9 | MIFVFVLCF | 1159 |
| HPV33 | E5 | 21 | 9 | PLILSISTY | 1160 |
| HPV33 | E5 | 21 | 11 | PLILSISTYAW | 1161 |
| HPV33 | E5 | 46 | 8 | PLKIFFCY | 1162 |
| HPV33 | E5 | 46 | 11 | PLKIFFCYLLF | 1163 |
| HPV33 | E5 | 34 | 9 | VLVLLLWVF | 1164 |
| HPV33 | E5 | 31 | 10 | WLLVLVLLLW | 1165 |
| HPV33 | E5 | 40 | 11 | WVFVGSPLKIF | 1166 |
| HPV33 | E5 | 58 | 9 | YLPMMCINF | 1167 |
| HPV33 | E6 | 66 | 11 | CLRFLSKISEY | 1168 |
| HPV33 | E6 | 69 | 8 | FLSKISEY | 1169 |
| HPV33 | E6 | 69 | 11 | FLSKISEYRHY | 1170 |
| HPV33 | E6 | 61 | 9 | GICKLCLRF | 1171 |
| HPV33 | E6 | 118 | 8 | HVDLNKRF | 1172 |
| HPV33 | E6 | 73 | 9 | ISEYRHYNY | 1173 |
| HPV33 | E6 | 72 | 8 | KISEYRHY | 1174 |
| HPV33 | E6 | 72 | 10 | KISEYRHYNY | 1175 |
| HPV33 | E6 | 70 | 10 | LSKISEYRHY | 1176 |
| HPV33 | E6 | 50 | 11 | LTVVYREGNPF | 1177 |
| HPV33 | E6 | 36 | 8 | PLQRSEVY | 1178 |
| HPV33 | E6 | 36 | 10 | PLQRSEVYDF | 1179 |
| HPV33 | E6 | 39 | 9 | RSEVYDFAF | 1180 |
| HPV33 | E6 | 51 | 10 | TVVYREGNPF | 1181 |
| HPV33 | E6 | 52 | 9 | VVYREGNPF | 1182 |
| HPV33 | E7 | 14 | 10 | DLYPEPTDLY | 1183 |
| HPV33 | E7 | 6 | 11 | PTLKEYVLDLY | 1184 |
| HPV33 | E7 | 7 | 10 | TLKEYVLDLY | 1185 |
| HPV33 | L1 | 392 | 10 | AMNPDILEDW | 1186 |
| HPV33 | L1 | 284 | 8 | ASIQSSAF | 1187 |
| HPV33 | L1 | 284 | 9 | ASIQSSAFF | 1188 |
| HPV33 | L1 | 411 | 9 | ASLQDTYRF | 1189 |
| HPV33 | L1 | 345 | 10 | CTQVTSDSTY | 1190 |
| HPV33 | L1 | 223 | 9 | DICGSTCKY | 1191 |
| HPV33 | L1 | 396 | 8 | DILEDWQF | 1192 |
| HPV33 | L1 | 457 | 11 | DLDQFPLGRKF | 1193 |
| HPV33 | L1 | 351 | 9 | DSTYKNENF | 1194 |
| HPV33 | L1 | 129 | 8 | DTETGNKY | 1195 |
| HPV33 | L1 | 202 | 9 | DTGFGCMDF | 1196 |
| HPV33 | L1 | 303 | 9 | ESQLFNKPY | 1197 |
| HPV33 | L1 | 303 | 10 | ESQLFNKPYW | 1198 |
| HPV33 | L1 | 447 | 8 | EVDLKEKF | 1199 |
| HPV33 | L1 | 249 | 8 | FLRREQMF | 1200 |
| HPV33 | L1 | 454 | 8 | FSADLDQF | 1201 |
| HPV33 | L1 | 322 | 9 | GICWGNQVF | 1202 |
| HPV33 | L1 | 117 | 11 | GISGHPLLNKF | 1203 |
| HPV33 | L1 | 297 | 11 | GSMVTSESQLF | 1204 |
| HPV33 | L1 | 226 | 9 | GSTCKYPDY | 1205 |
| HPV33 | L1 | 281 | 11 | GTTASIQSSAF | 1206 |
| HPV33 | L1 | 365 | 9 | HVEEYDLQF | 1207 |
| HPV33 | L1 | 365 | 11 | HVEEYDLQFVF | 1208 |
| HPV33 | L1 | 118 | 10 | ISGHPLLNKF | 1209 |
| HPV33 | L1 | 65 | 10 | KVSGLQYRVF | 1210 |
| HPV33 | L1 | 379 | 11 | KVTLTAEVMTY | 1211 |
| HPV33 | L1 | 20 | 8 | KVVSTDEY | 1212 |
| HPV33 | L1 | 42 | 8 | LLAVGHPY | 1213 |

TABLE VII-continued

A01 Supermotif Peptides

| Type | Protein | Position | No. of Amino Acids | Sequence | A*0101 | Seq. Id. No. |
|---|---|---|---|---|---|---|
| HPV33 | L1 | 42 | 9 | LLAVGHPYF | | 1214 |
| HPV33 | L1 | 61 | 11 | LLVPKVSGLQY | | 1215 |
| HPV33 | L1 | 382 | 8 | LTAEVMTY | | 1216 |
| HPV33 | L1 | 62 | 10 | LVPKVSGLQY | | 1217 |
| HPV33 | L1 | 237 | 11 | MTSEPYGDSLF | | 1218 |
| HPV33 | L1 | 200 | 11 | MVDTGFGCMDF | | 1219 |
| HPV33 | L1 | 299 | 9 | MVTSESQLF | | 1220 |
| HPV33 | L1 | 221 | 11 | PIDICGSTCKY | | 1221 |
| HPV33 | L1 | 439 | 8 | PLGKYTFW | | 1222 |
| HPV33 | L1 | 409 | 9 | PSASLQDTY | | 1223 |
| HPV33 | L1 | 409 | 11 | PSASLQDTYRF | | 1224 |
| HPV33 | L1 | 17 | 11 | PVSKVVSTDEY | | 1225 |
| HPV33 | L1 | 305 | 8 | QLFNKPYW | | 1226 |
| HPV33 | L1 | 254 | 8 | QMFVRHFF | | 1227 |
| HPV33 | L1 | 347 | 8 | QVTSDSTY | | 1228 |
| HPV33 | L1 | 41 | 9 | RLLAVGHPY | | 1229 |
| HPV33 | L1 | 41 | 10 | RLLAVGHPYF | | 1230 |
| HPV33 | L1 | 77 | 8 | RLPDPNKF | | 1231 |
| HPV33 | L1 | 77 | 10 | RLPDPNKFGF | | 1232 |
| HPV33 | L1 | 75 | 10 | RVRLPDPNKF | | 1233 |
| HPV33 | L1 | 285 | 8 | SIQSSAFF | | 1234 |
| HPV33 | L1 | 412 | 8 | SLQDTYRF | | 1235 |
| HPV33 | L1 | 298 | 10 | SMVTSESQLF | | 1236 |
| HPV33 | L1 | 39 | 11 | SSRLLAVGHPY | | 1237 |
| HPV33 | L1 | 227 | 8 | STCKYPDY | | 1238 |
| HPV33 | L1 | 352 | 8 | STYKNENF | | 1239 |
| HPV33 | L1 | 352 | 11 | STYKNENFKEY | | 1240 |
| HPV33 | L1 | 2 | 11 | SVWRPSEATVY | | 1241 |
| HPV33 | L1 | 266 | 11 | TLGEAVPDDLY | | 1242 |
| HPV33 | L1 | 381 | 9 | TLTAEVMTY | | 1243 |
| HPV33 | L1 | 349 | 11 | TSDSTYKNENF | | 1244 |
| HPV33 | L1 | 238 | 10 | TSEPYGDSLF | | 1245 |
| HPV33 | L1 | 238 | 11 | TSEPYGDSLFF | | 1246 |
| HPV33 | L1 | 301 | 11 | TSESQLFNKPY | | 1247 |
| HPV33 | L1 | 282 | 10 | TTASIQSSAF | | 1248 |
| HPV33 | L1 | 282 | 11 | TTASIQSSAFF | | 1249 |
| HPV33 | L1 | 66 | 9 | VSGLQYRVF | | 1250 |
| HPV33 | L1 | 18 | 10 | VSKVVSTDEY | | 1251 |
| HPV33 | L1 | 28 | 8 | VSRTSIYY | | 1252 |
| HPV33 | L1 | 28 | 9 | VSRTSIYYY | | 1253 |
| HPV33 | L1 | 380 | 10 | VTLTAEVMTY | | 1254 |
| HPV33 | L1 | 300 | 8 | VTSESQLF | | 1255 |
| HPV33 | L1 | 362 | 8 | YIRHVEEY | | 1256 |
| HPV33 | L1 | 234 | 9 | YLKMTSEPY | | 1257 |
| HPV33 | L1 | 27 | 8 | YVSRTSIY | | 1258 |
| HPV33 | L1 | 27 | 9 | YVSRTSIYY | | 1259 |
| HPV33 | L1 | 27 | 10 | YVSRTSIYYY | | 1260 |
| HPV33 | L2 | 291 | 11 | AITSRRHTVRF | | 1261 |
| HPV33 | L2 | 272 | 10 | DISPAPDPDF | | 1262 |
| HPV33 | L2 | 431 | 10 | DTIVVDGADF | | 1263 |
| HPV33 | L2 | 258 | 11 | ESFDPEDTLQF | | 1264 |
| HPV33 | L2 | 447 | 10 | FILRRRRKRF | | 1265 |
| HPV33 | L2 | 242 | 11 | FLTSPHKLITY | | 1266 |
| HPV33 | L2 | 183 | 11 | FSSPTVSTQSY | | 1267 |
| HPV33 | L2 | 440 | 8 | FVLHPSYF | | 1268 |
| HPV33 | L2 | 421 | 8 | FVPISPFF | | 1269 |
| HPV33 | L2 | 421 | 10 | FVPISPFFPF | | 1270 |
| HPV33 | L2 | 64 | 8 | GSGGRTGY | | 1271 |
| HPV33 | L2 | 62 | 10 | GSGSGGRTGY | | 1272 |
| HPV33 | L2 | 218 | 11 | GSRPVARLGLY | | 1273 |
| HPV33 | L2 | 37 | 11 | GSTIADQILKY | | 1274 |
| HPV33 | L2 | 374 | 8 | HTPMQHSY | | 1275 |
| HPV33 | L2 | 374 | 11 | HTPMQHSYSTF | | 1276 |
| HPV33 | L2 | 336 | 8 | HTVPNEQY | | 1277 |
| HPV33 | L2 | 44 | 10 | ILKYGSLGVF | | 1278 |
| HPV33 | L2 | 44 | 11 | ILKYGSLGVFF | | 1279 |
| HPV33 | L2 | 448 | 9 | ILRRRRKRF | | 1280 |
| HPV33 | L2 | 448 | 11 | ILRRRRKRFPY | | 1281 |
| HPV33 | L2 | 273 | 9 | ISPAPDPDF | | 1282 |
| HPV33 | L2 | 155 | 9 | ISTHLNPTF | | 1283 |
| HPV33 | L2 | 292 | 10 | ITSRRHTVRF | | 1284 |
| HPV33 | L2 | 250 | 8 | ITYDNPAF | | 1285 |
| HPV33 | L2 | 250 | 11 | ITYDNPAFESF | | 1286 |
| HPV33 | L2 | 104 | 10 | IVSLIEETSF | | 1287 |

TABLE VII-continued

A01 Supermotif Peptides

| Type | Protein | Position | No. of Amino Acids | Sequence | A*0101 | Seq. Id. No. |
|---|---|---|---|---|---|---|
| HPV33 | L2 | 433 | 8 | IVVDGADF | | 1288 |
| HPV33 | L2 | 248 | 10 | KLITYDNPAF | | 1289 |
| HPV33 | L2 | 249 | 9 | LITYDNPAF | | 1290 |
| HPV33 | L2 | 243 | 10 | LTSPHKLITY | | 1291 |
| HPV33 | L2 | 405 | 11 | MSGPDIPSPLF | | 1292 |
| HPV33 | L2 | 372 | 10 | NVHTPMQHSY | | 1293 |
| HPV33 | L2 | 391 | 10 | NVSIPLNTGF | | 1294 |
| HPV33 | L2 | 423 | 8 | PISPFFPF | | 1295 |
| HPV33 | L2 | 333 | 11 | PLDHTVPNEQY | | 1296 |

TABLE VIII

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E1 | AAALYWYKT | 316 | 9 | | | | | 1856 |
| HPV16 | E1 | AAALYWYKTGI | 316 | 11 | | | | | 1857 |
| HPV16 | E1 | AAFGLTPSI | 239 | 9 | 0.0012 | | | | 1858 |
| HPV16 | E1 | AAFGLTPSIA | 239 | 10 | | | | | 1859 |
| HPV16 | E1 | AALYWYKT | 317 | 8 | | | | | 1860 |
| HPV16 | E1 | AALYWYKTGI | 317 | 10 | | | | | 1861 |
| HPV16 | E1 | AAMLAKFKEL | 205 | 10 | | | | | 1862 |
| HPV16 | E1 | AANTGKSL | 478 | 8 | | | | | 1863 |
| HPV16 | E1 | AANTGKSLFGM | 478 | 11 | | | | | 1864 |
| HPV16 | E1 | AICIEKQSRA | 112 | 10 | | | | | 1865 |
| HPV16 | E1 | AICIEKQSRAA | 112 | 11 | | | | | 1866 |
| HPV16 | E1 | ALDGNLVSM | 539 | 9 | 0.027 | | | | 1867 |
| HPV16 | E1 | ALDGNLVSMDV | 539 | 11 | | | | | 1868 |
| HPV16 | E1 | ALFTAQEA | 69 | 8 | | | | | 1869 |
| HPV16 | E1 | ALKRFLQGI | 459 | 9 | 0.0062 | | | | 1870 |
| HPV16 | E1 | ALYWYKTGI | 318 | 9 | 0.0019 | | | | 1871 |
| HPV16 | E1 | AMLAKFKEL | 206 | 9 | 0.015 | | | | 1872 |
| HPV16 | E1 | AQEAKQHRDA | 73 | 10 | | | | | 1873 |
| HPV16 | E1 | AQEAKQHRDAV | 73 | 11 | | | | | 1874 |
| HPV16 | E1 | AQLADTNSNA | 380 | 10 | | | | | 1875 |
| HPV16 | E1 | ATMCRHYKRA | 406 | 10 | | | | | 1876 |
| HPV16 | E1 | ATVPCWNYI | 524 | 9 | | | | | 1877 |
| HPV16 | E1 | AVQVLKRKYL | 82 | 10 | | | | | 1878 |
| HPV16 | E1 | AVQVLKRKYLV | 82 | 11 | | | | | 1879 |
| HPV16 | E1 | AVVEKKTGDA | 23 | 10 | | | | | 1880 |
| HPV16 | E1 | AVVEKKTGDAI | 23 | 11 | | | | | 1881 |
| HPV16 | E1 | CATMCRHYKRA | 405 | 11 | | | | | 1882 |
| HPV16 | E1 | CIAAFGLT | 237 | 8 | | | | | 1883 |
| HPV16 | E1 | CIAAFGLTPSI | 237 | 11 | | | | | 1884 |
| HPV16 | E1 | CIEKQSRA | 114 | 8 | | | | | 1885 |
| HPV16 | E1 | CIEKQSRAA | 114 | 9 | | | | | 1886 |
| HPV16 | E1 | CILLYGAA | 472 | 8 | | | | | 1887 |
| HPV16 | E1 | CILLYGAANT | 472 | 10 | | | | | 1888 |
| HPV16 | E1 | CLYLHIQSL | 259 | 9 | 0.076 | | | | 1889 |
| HPV16 | E1 | CLYLHIQSLA | 259 | 10 | 0.0032 | | | | 1890 |
| HPV16 | E1 | CMMIEPPKL | 304 | 9 | | | | | 1891 |
| HPV16 | E1 | CQTPLTNI | 187 | 8 | | | | | 1892 |
| HPV16 | E1 | CQTPLTNIL | 187 | 9 | | | | | 1893 |
| HPV16 | E1 | CQTPLTNILNV | 187 | 11 | | | | | 1894 |
| HPV16 | E1 | CTFELSQM | 353 | 8 | | | | | 1895 |
| HPV16 | E1 | CTFELSQMV | 353 | 9 | 0.0029 | | | | 1896 |
| HPV16 | E1 | CVDNNISPRL | 101 | 10 | | | | | 1897 |
| HPV16 | E1 | CVSGQNTNT | 640 | 9 | | | | | 1898 |
| HPV16 | E1 | CVSGQNTNTL | 640 | 10 | | | | | 1899 |
| HPV16 | E1 | CVSPMCMM | 299 | 8 | | | | | 1900 |
| HPV16 | E1 | CVSPMCMMI | 299 | 9 | | | | | 1901 |
| HPV16 | E1 | DAKIGMLDDA | 515 | 10 | | | | | 1902 |
| HPV16 | E1 | DAKIGMLDDAT | 515 | 11 | | | | | 1903 |
| HPV16 | E1 | DATVPCWNYI | 523 | 10 | | | | | 1904 |
| HPV16 | E1 | DAVQVLKRKYL | 81 | 11 | | | | | 1905 |
| HPV16 | E1 | DISGCVDNNI | 97 | 10 | | | | | 1906 |
| HPV16 | E1 | DIVDDSEI | 368 | 8 | | | | | 1907 |
| HPV16 | E1 | DIVDDSEIA | 368 | 9 | | | | | 1908 |
| HPV16 | E1 | DTGEDLVDFI | 43 | 10 | | | | | 1909 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E1 | DTGEDLVDFIV | 43 | 11 | | | | | 1910 |
| HPV16 | E1 | DTNSNASA | 384 | 8 | | | | | 1911 |
| HPV16 | E1 | DTNSNASAFL | 384 | 10 | | | | | 1912 |
| HPV16 | E1 | DTPEWIQRQT | 335 | 10 | | | | | 1913 |
| HPV16 | E1 | DTPEWIQRQTV | 335 | 11 | | | | | 1914 |
| HPV16 | E1 | DVKHRPLV | 548 | 8 | | | | | 1915 |
| HPV16 | E1 | DVKHRPLVQL | 548 | 10 | | | | | 1916 |
| HPV16 | E1 | EAKQHRDA | 75 | 8 | | | | | 1917 |
| HPV16 | E1 | EAKQHRDAV | 75 | 9 | | | | | 1918 |
| HPV16 | E1 | EAKQHRDAVQV | 75 | 11 | | | | | 1919 |
| HPV16 | E1 | EAVVEKKT | 22 | 8 | | | | | 1920 |
| HPV16 | E1 | EAVVEKKTGDA | 22 | 11 | | | | | 1921 |
| HPV16 | E1 | EIAYKYAQL | 374 | 9 | | | | | 1922 |
| HPV16 | E1 | EIAYKYAQLA | 374 | 10 | | | | | 1923 |
| HPV16 | E1 | ELSQMVQWA | 356 | 9 | 0.0003 | | | | 1924 |
| HPV16 | E1 | ELYGVSFSEL | 213 | 10 | | | | | 1925 |
| HPV16 | E1 | ELYGVSFSELV | 213 | 11 | | | | | 1926 |
| HPV16 | E1 | ETAHALFT | 65 | 8 | | | | | 1927 |
| HPV16 | E1 | ETAHALFTA | 65 | 9 | | | | | 1928 |
| HPV16 | E1 | ETETAHAL | 63 | 8 | | | | | 1929 |
| HPV16 | E1 | ETETAHALFT | 63 | 10 | | | | | 1930 |
| HPV16 | E1 | ETETAHALFTA | 63 | 11 | | | | | 1931 |
| HPV16 | E1 | ETIEKLLSKL | 288 | 10 | | | | | 1932 |
| HPV16 | E1 | ETIEKLLSKLL | 288 | 11 | | | | | 1933 |
| HPV16 | E1 | ETQQMLQV | 140 | 8 | | | | | 1934 |
| HPV16 | E1 | EVETQQML | 138 | 8 | | | | | 1935 |
| HPV16 | E1 | EVETQQMLQV | 138 | 10 | | | | | 1936 |
| HPV16 | E1 | EVYGDTPEWI | 331 | 10 | | | | | 1937 |
| HPV16 | E1 | FIVNDNDYL | 51 | 9 | | | | | 1938 |
| HPV16 | E1 | FIVNDNDYLT | 51 | 10 | | | | | 1939 |
| HPV16 | E1 | FLKSNSQA | 392 | 8 | | | | | 1940 |
| HPV16 | E1 | FLKSNSQAKI | 392 | 10 | 0.0011 | | | | 1941 |
| HPV16 | E1 | FLKSNSQAKIV | 392 | 11 | | | | | 1942 |
| HPV16 | E1 | FLQGIPKKNCI | 463 | 11 | | | | | 1943 |
| HPV16 | E1 | FLQGSVICFV | 493 | 10 | 0.23 | | | | 1944 |
| HPV16 | E1 | FLRYQGVEFM | 445 | 10 | | | | | 1945 |
| HPV16 | E1 | FLTALKRFL | 456 | 9 | | | | | 1946 |
| HPV16 | E1 | FMSFLTAL | 453 | 8 | | | | | 1947 |
| HPV16 | E1 | FVNSKSHFWL | 501 | 10 | 0.0015 | | | | 1948 |
| HPV16 | E1 | GAANTGKSL | 477 | 9 | 0.0003 | | | | 1949 |
| HPV16 | E1 | GIPKKNCI | 466 | 8 | | | | | 1950 |
| HPV16 | E1 | GIPKKNCIL | 466 | 9 | | | | | 1951 |
| HPV16 | E1 | GJPKKNCILL | 466 | 10 | | | | | 1952 |
| HPV16 | E1 | GISNISEV | 325 | 8 | | | | | 1953 |
| HPV16 | E1 | GLTPSIADSI | 242 | 10 | 0.0002 | | | | 1954 |
| HPV16 | E1 | GMLDDATV | 519 | 8 | | | | | 1955 |
| HPV16 | E1 | GMSLMKFL | 487 | 8 | | | | | 1956 |
| HPV16 | E1 | GMVVLLLV | 272 | 8 | | | | | 1957 |
| HPV16 | E1 | GTDSRWPYL | 571 | 9 | | | | | 1958 |
| HPV16 | E1 | GTGCNGWFYV | 12 | 10 | 0.0006 | | | | 1959 |
| HPV16 | E1 | GTNGEEGT | 6 | 8 | | | | | 1960 |
| HPV16 | E1 | GVEFMSFL | 450 | 8 | | | | | 1961 |
| HPV16 | E1 | GVEFMSFLT | 450 | 9 | | | | | 1962 |
| HPV16 | E1 | GVEFMSFLTA | 450 | 10 | | | | | 1963 |
| HPV16 | E1 | GVEFMSFLTAL | 450 | 11 | | | | | 1964 |
| HPV16 | E1 | GVSERHTI | 179 | 8 | | | | | 1965 |
| HPV16 | E1 | GVSERHTICQT | 179 | 11 | | | | | 1966 |
| HPV16 | E1 | GVSFSELV | 216 | 8 | | | | | 1967 |
| HPV16 | E1 | HALFTAQEA | 68 | 9 | | | | | 1968 |
| HPV16 | E1 | HIQSLACSWGM | 263 | 11 | | | | | 1969 |
| HPV16 | E1 | HTICQTPL | 184 | 8 | | | | | 1970 |
| HPV16 | E1 | HTICQTPLT | 184 | 9 | | | | | 1971 |
| HPV16 | E1 | HTICQTPLTNI | 184 | 11 | | | | | 1972 |
| HPV16 | E1 | IAAFGLTPSI | 238 | 10 | 0.0002 | | | | 1973 |
| HPV16 | E1 | IAAFGLTPSIA | 238 | 11 | | | | | 1974 |
| HPV16 | E1 | IADSIKTL | 247 | 8 | | | | | 1975 |
| HPV16 | E1 | IADSIKTLL | 247 | 9 | | | | | 1976 |
| HPV16 | E1 | IAYKYAQL | 375 | 8 | | | | | 1977 |
| HPV16 | E1 | IAYKYAQLA | 375 | 9 | | | | | 1978 |
| HPV16 | E1 | IAYKYAQLADT | 375 | 11 | | | | | 1979 |
| HPV16 | E1 | ILLYGAANT | 473 | 9 | | | | | 1980 |
| HPV16 | E1 | ILNVLKTSNA | 194 | 10 | | | | | 1981 |
| HPV16 | E1 | IQSLACSWGM | 264 | 10 | | | | | 1982 |
| HPV16 | E1 | IQSLACSWGMV | 264 | 11 | | | | | 1983 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E1 | ITSNINAGT | 564 | 9 | | | | | 1984 |
| HPV16 | E1 | IVDDSEIA | 369 | 8 | | | | | 1985 |
| HPV16 | E1 | IVKDCATM | 401 | 8 | | | | | 1986 |
| HPV16 | E1 | IVMFLRYQGV | 442 | 10 | 0.0024 | | | | 1987 |
| HPV16 | E1 | IVNDNDYL | 52 | 8 | | | | | 1988 |
| HPV16 | E1 | IVNDNDYLT | 52 | 9 | | | | | 1989 |
| HPV16 | E1 | IVNDNDYLTQA | 52 | 11 | | | | | 1990 |
| HPV16 | E1 | KAAMLAKFKEL | 204 | 11 | | | | | 1991 |
| HPV16 | E1 | KAICIEKQSRA | 111 | 11 | | | | | 1992 |
| HPV16 | E1 | KIGMLDDA | 517 | 8 | | | | | 1993 |
| HPV16 | E1 | KIGMLDDAT | 517 | 9 | | | | | 1994 |
| HPV16 | E1 | KIGMLDDATV | 517 | 10 | | | | | 1995 |
| HPV16 | E1 | KIVKDCAT | 400 | 8 | | | | | 1996 |
| HPV16 | E1 | KIVKDCATM | 400 | 9 | | | | | 1997 |
| HPV16 | E1 | KLLCVSPM | 296 | 8 | | | | | 1998 |
| HPV16 | E1 | KLLCVSPMCM | 296 | 10 | 0.013 | | | | 1999 |
| HPV16 | E1 | KLLCVSPMCMM | 296 | 11 | | | | | 2000 |
| HPV16 | E1 | KLLSKLLCV | 292 | 9 | 0.051 | | | | 2001 |
| HPV16 | E1 | KLRSTAAA | 311 | 8 | | | | | 2002 |
| HPV16 | E1 | KLRSTAAAL | 311 | 9 | 0.0003 | | | | 2003 |
| HPV16 | E1 | KQHRDAVQV | 77 | 9 | | | | | 2004 |
| HPV16 | E1 | KQHRDAVQVL | 77 | 10 | | | | | 2005 |
| HPV16 | E1 | KQMSMSQWI | 418 | 9 | | | | | 2006 |
| HPV16 | E1 | KQSRAAKRRL | 117 | 10 | | | | | 2007 |
| HPV16 | E1 | KTGISNISEV | 323 | 10 | | | | | 2008 |
| HPV16 | E1 | KTLLQQYCL | 252 | 9 | | | | | 2009 |
| HPV16 | E1 | KTLLQQYCLYL | 252 | 11 | | | | | 2010 |
| HPV16 | E1 | KTSNAKAA | 199 | 8 | | | | | 2011 |
| HPV16 | E1 | KTSNAKAAM | 199 | 9 | | | | | 2012 |
| HPV16 | E1 | KTSNAKAAML | 199 | 10 | | | | | 2013 |
| HPV16 | E1 | KTSNAKAAMLA | 199 | 11 | | | | | 2014 |
| HPV16 | E1 | LACSWGMV | 267 | 8 | | | | | 2015 |
| HPV16 | E1 | LACSWGMVV | 267 | 9 | 0.0006 | | | | 2016 |
| HPV16 | E1 | LACSWGMVVL | 267 | 10 | | | | | 2017 |
| HPV16 | E1 | LACSWGMVVLL | 267 | 11 | | | | | 2018 |
| HPV16 | E1 | LADAKIGM | 513 | 8 | | | | | 2019 |
| HPV16 | E1 | LADAKIGML | 513 | 9 | | | | | 2020 |
| HPV16 | E1 | LADTNSNA | 382 | 8 | | | | | 2021 |
| HPV16 | E1 | LADTNSNASA | 382 | 10 | | | | | 2022 |
| HPV16 | E1 | LAKFKELYGV | 208 | 10 | | | | | 2023 |
| HPV16 | E1 | LITSNINA | 563 | 8 | | | | | 2024 |
| HPV16 | E1 | LITSNINAGT | 563 | 10 | | | | | 2025 |
| HPV16 | E1 | LLCVSPMCM | 297 | 9 | 0.0008 | | | | 2026 |
| HPV16 | E1 | LLCVSPMCMM | 297 | 10 | | | | | 2027 |
| HPV16 | E1 | LLCVSPMCMMI | 297 | 11 | | | | | 2028 |
| HPV16 | E1 | LLITSNINA | 562 | 9 | 0.0022 | | | | 2029 |
| HPV16 | E1 | LLITSNINAGT | 562 | 11 | | | | | 2030 |
| HPV16 | E1 | LLQQYCLYL | 254 | 9 | 0.1 | | | | 2031 |
| HPV16 | E1 | LLQQYCLYLHI | 254 | 11 | | | | | 2032 |
| HPV16 | E1 | LLSKLLCV | 293 | 8 | | | | | 2033 |
| HPV16 | E1 | LLSKLLCVSPM | 293 | 11 | | | | | 2034 |
| HPV16 | E1 | LLYGAANT | 474 | 8 | | | | | 2035 |
| HPV16 | E1 | LMKFLQGSV | 490 | 9 | 0.0007 | | | | 2036 |
| HPV16 | E1 | LMKFLQGSVI | 490 | 10 | 0.0003 | | | | 2037 |
| HPV16 | E1 | LQGIPKKNCI | 464 | 10 | | | | | 2038 |
| HPV16 | E1 | LQGIPKKNCIL | 464 | 11 | | | | | 2039 |
| HPV16 | E1 | LQGSVICFV | 494 | 9 | | | | | 2040 |
| HPV16 | E1 | LQHSFNDCT | 346 | 9 | | | | | 2041 |
| HPV16 | E1 | LQPLADAKI | 510 | 9 | | | | | 2042 |
| HPV16 | E1 | LQPLADAKIGM | 510 | 11 | | | | | 2043 |
| HPV16 | E1 | LQQYCLYL | 255 | 8 | | | | | 2044 |
| HPV16 | E1 | LQQYCLYLHI | 255 | 10 | | | | | 2045 |
| HPV16 | E1 | LQVEGRHET | 145 | 9 | | | | | 2046 |
| HPV16 | E1 | LQVEGRHETET | 145 | 11 | | | | | 2047 |
| HPV16 | E1 | LTALKRFL | 457 | 8 | | | | | 2048 |
| HPV16 | E1 | LTALKRFLQGI | 457 | 11 | | | | | 2049 |
| HPV16 | E1 | LTNILNVL | 191 | 8 | | | | | 2050 |
| HPV16 | E1 | LTNILNVLKT | 191 | 10 | | | | | 2051 |
| HPV16 | E1 | LTPSIADSI | 243 | 9 | | | | | 2052 |
| HPV16 | E1 | LTPSIADSIKT | 243 | 11 | | | | | 2053 |
| HPV16 | E1 | LTQAETET | 59 | 8 | | | | | 2054 |
| HPV16 | E1 | LTQAETETA | 59 | 9 | | | | | 2055 |
| HPV16 | E1 | LTQAETETAHA | 59 | 11 | | | | | 2056 |
| HPV16 | E1 | LVQLKCPPL | 554 | 9 | 0.0003 | | | | 2057 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E1 | LVQLKCPPLL | 554 | 10 | | | | | 2058 |
| HPV16 | E1 | LVQLKCPPLLI | 554 | 11 | | | | | 2059 |
| HPV16 | E1 | LVRPFKSNKST | 222 | 11 | | | | | 2060 |
| HPV16 | E1 | LVSMDVKHRPL | 544 | 11 | | | | | 2061 |
| HPV16 | E1 | LVSPLSDI | 91 | 8 | | | | | 2062 |
| HPV16 | E1 | MIEPPKLRST | 306 | 10 | | | | | 2063 |
| HPV16 | E1 | MIEPPKLRSTA | 306 | 11 | | | | | 2064 |
| HPV16 | E1 | MLAKFKEL | 207 | 8 | | | | | 2065 |
| HPV16 | E1 | MLAKFKELYGV | 207 | 11 | | | | | 2066 |
| HPV16 | E1 | MLQVEGRHET | 144 | 10 | | | | | 2067 |
| HPV16 | E1 | MMIEPPKL | 305 | 8 | | | | | 2068 |
| HPV16 | E1 | MMIEPPKLRST | 305 | 11 | | | | | 2069 |
| HPV16 | E1 | MVQWAYDNDI | 360 | 10 | 0.0001 | | | | 2070 |
| HPV16 | E1 | MVQWAYDNDIV | 360 | 11 | | | | | 2071 |
| HPV16 | E1 | NAGTDSRWPYL | 569 | 11 | | | | | 2072 |
| HPV16 | E1 | NAKAAMLA | 202 | 8 | | | | | 2073 |
| HPV16 | E1 | NALDGNLV | 538 | 8 | | | | | 2074 |
| HPV16 | E1 | NALDGNLVSM | 538 | 10 | | | | | 2075 |
| HPV16 | E1 | NILNVLKT | 193 | 8 | | | | | 2076 |
| HPV16 | E1 | NILNVLKTSNA | 193 | 11 | | | | | 2077 |
| HPV16 | E1 | NISEVYGDT | 328 | 9 | | | | | 2078 |
| HPV16 | E1 | NISPRLKA | 105 | 8 | | | | | 2079 |
| HPV16 | E1 | NISPRLKAI | 105 | 9 | | | | | 2080 |
| HPV16 | E1 | NISPRLKAICI | 105 | 11 | | | | | 2081 |
| HPV16 | E1 | NLRNALDGNL | 535 | 10 | | | | | 2082 |
| HPV16 | E1 | NLRNALDGNLV | 535 | 11 | | | | | 2083 |
| HPV16 | E1 | NTEVETQQM | 136 | 9 | | | | | 2084 |
| HPV16 | E1 | NTEVETQQML | 136 | 10 | | | | | 2085 |
| HPV16 | E1 | NTGKSLFGM | 480 | 9 | | | | | 2086 |
| HPV16 | E1 | NTGKSLFGMSL | 480 | 11 | | | | | 2087 |
| HPV16 | E1 | NVLKTSNA | 196 | 8 | | | | | 2088 |
| HPV16 | E1 | NVLKTSNAKA | 196 | 10 | | | | | 2089 |
| HPV16 | E1 | NVLKTSNAKAA | 196 | 11 | | | | | 2090 |
| HPV16 | E1 | PAGTNGEEGT | 4 | 10 | | | | | 2091 |
| HPV16 | E1 | PLADAKIGM | 512 | 9 | | | | | 2092 |
| HPV16 | E1 | PLADAKIGML | 512 | 10 | | | | | 2093 |
| HPV16 | E1 | PLLITSNI | 561 | 8 | | | | | 2094 |
| HPV16 | E1 | PLLITSNINA | 561 | 10 | | | | | 2095 |
| HPV16 | E1 | PLSDISGCV | 94 | 9 | | | | | 2096 |
| HPV16 | E1 | PLTNILNV | 190 | 8 | | | | | 2097 |
| HPV16 | E1 | PLTNILNVL | 190 | 9 | | | | | 2098 |
| HPV16 | E1 | PLTNILNVLKT | 190 | 11 | | | | | 2099 |
| HPV16 | E1 | PLVQLKCPPL | 553 | 10 | | | | | 2100 |
| HPV16 | E1 | PLVQLKCPPLL | 553 | 11 | | | | | 2101 |
| HPV16 | E1 | PMCMMIEPPKL | 302 | 11 | | | | | 2102 |
| HPV16 | E1 | PTFKCVSGQNT | 636 | 11 | | | | | 2103 |
| HPV16 | E1 | QAETETAHA | 61 | 9 | | | | | 2104 |
| HPV16 | E1 | QAETETAHAL | 61 | 10 | | | | | 2105 |
| HPV16 | E1 | QAKIVKDCA | 398 | 9 | | | | | 2106 |
| HPV16 | E1 | QAKIVKDCAT | 398 | 10 | | | | | 2107 |
| HPV16 | E1 | QAKIVKDCATM | 398 | 11 | | | | | 2108 |
| HPV16 | E1 | QIVMFLRYQGV | 441 | 11 | | | | | 2109 |
| HPV16 | E1 | QLADTNSNA | 381 | 9 | 0.0003 | | | | 2110 |
| HPV16 | E1 | QLADTNSNASA | 381 | 11 | | | | | 2111 |
| HPV16 | E1 | QLKCPPLL | 556 | 8 | | | | | 2112 |
| HPV16 | E1 | QLKCPPLLI | 556 | 9 | 0.0049 | | | | 2113 |
| HPV16 | E1 | QLKCPPLLIT | 556 | 10 | | | | | 2114 |
| HPV16 | E1 | QMLQVEGRHET | 143 | 11 | | | | | 2115 |
| HPV16 | E1 | QMSMSQWI | 419 | 8 | | | | | 2116 |
| HPV16 | E1 | QMVQWAYDNDI | 359 | 11 | | | | | 2117 |
| HPV16 | E1 | QQYCLYLHI | 256 | 9 | | | | | 2118 |
| HPV16 | E1 | QTPLTNIL | 188 | 8 | | | | | 2119 |
| HPV16 | E1 | QTPLTNILNV | 188 | 10 | 0.0002 | | | | 2120 |
| HPV16 | E1 | QTPLTNILNVL | 188 | 11 | | | | | 2121 |
| HPV16 | E1 | QVEGRHET | 146 | 8 | | | | | 2122 |
| HPV16 | E1 | QVEGRHETET | 146 | 10 | | | | | 2123 |
| HPV16 | E1 | QVLKRKYL | 84 | 8 | | | | | 2124 |
| HPV16 | E1 | QVLKRKYLV | 84 | 9 | 0.0003 | | | | 2125 |
| HPV16 | E1 | RAEKKQMSM | 414 | 9 | | | | | 2126 |
| HPV16 | E1 | RTWSRLSL | 615 | 8 | | | | | 2127 |
| HPV16 | E1 | RVDDGGDWKQI | 432 | 11 | | | | | 2128 |
| HPV16 | E1 | SAFLKSNSQA | 390 | 10 | | | | | 2129 |
| HPV16 | E1 | SIADSIKT | 246 | 8 | | | | | 2130 |
| HPV16 | E1 | SIADSIKTL | 246 | 9 | | | | | 2131 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E1 | SIADSIKTLL | 246 | 10 | | | | | 2132 |
| HPV16 | E1 | SIKTLLQQYCL | 250 | 11 | | | | | 2133 |
| HPV16 | E1 | SLACSWGM | 266 | 8 | | | | | 2134 |
| HPV16 | E1 | SLACSWGMV | 266 | 9 | 0.082 | | | | 2135 |
| HPV16 | E1 | SLACSWGMVV | 266 | 10 | 0.13 | | | | 2136 |
| HPV16 | E1 | SLACSWGMVVL | 266 | 11 | | | | | 2137 |
| HPVI6 | E1 | SLFGMSLM | 484 | 8 | | | | | 2138 |
| HPV16 | E1 | SLFGMSLMKFL | 484 | 11 | | | | | 2139 |
| HPV16 | E1 | SLMKFLQGSV | 489 | 10 | 0.025 | | | | 2140 |
| HPV16 | E1 | SLMKFLQGSVI | 489 | 11 | | | | | 2141 |
| HPV16 | E1 | SLPTFKCV | 634 | 8 | | | | | 2142 |
| HPV16 | E1 | SMDVKHRPL | 546 | 9 | | | | | 2143 |
| HPV16 | E1 | SMDVKHRPLV | 546 | 10 | | | | | 2144 |
| HPV16 | E1 | SQAKIVKDCA | 397 | 10 | | | | | 2145 |
| HPV16 | E1 | SQAKIVKDCAT | 397 | 11 | | | | | 2146 |
| HPV16 | E1 | SQWIKYRCDRV | 423 | 11 | | | | | 2147 |
| HPV16 | E1 | STAAALYWYKT | 314 | 11 | | | | | 2148 |
| HPV16 | E1 | STCCDWCI | 231 | 8 | | | | | 2149 |
| HPV16 | E1 | STCCDWCIA | 231 | 9 | | | | | 2150 |
| HPV16 | E1 | STCCDWCIAA | 231 | 10 | | | | | 2151 |
| HPV16 | E1 | TAAALYWYKT | 315 | 10 | | | | | 2152 |
| HPV16 | E1 | TAHALFTA | 66 | 8 | | | | | 2153 |
| HPV16 | E1 | TAHALFTAQEA | 66 | 11 | | | | | 2154 |
| HPV16 | E1 | TALKRFLQGI | 458 | 10 | | | | | 2155 |
| HPV16 | E1 | TAQEAKQHRDA | 72 | 11 | | | | | 2156 |
| HPV16 | E1 | TICQTPLT | 185 | 8 | | | | | 2157 |
| HPV16 | E1 | TICQTPLTNI | 185 | 10 | | | | | 2158 |
| HPV16 | E1 | TICQTPLTNIL | 185 | 11 | | | | | 2159 |
| HPV16 | E1 | TIEKLLSKL | 289 | 9 | | | | | 2160 |
| HPV16 | E1 | TIEKLLSKLL | 289 | 10 | | | | | 2161 |
| HPV16 | E1 | TLLQQYCL | 253 | 8 | | | | | 2162 |
| HPV16 | E1 | TLLQQYCLYL | 253 | 10 | 0.65 | | | | 2163 |
| HPV16 | E1 | TMCRHYKRA | 407 | 9 | 0.0003 | | | | 2164 |
| HPV16 | E1 | TQAETETA | 60 | 8 | | | | | 2165 |
| HPV16 | E1 | TQAETETAHA | 60 | 10 | | | | | 2166 |
| HPV16 | E1 | TQAETETAHAL | 60 | 11 | | | | | 2167 |
| HPV16 | E1 | TVLQHSFNDCT | 344 | 11 | | | | | 2168 |
| HPV16 | E1 | TVPCWNYI | 525 | 8 | | | | | 2169 |
| HPV16 | E1 | VLKRKYLV | 85 | 8 | | | | | 2170 |
| HPV16 | E1 | VLKRKYLVSPL | 85 | 11 | | | | | 2171 |
| HPV16 | E1 | VLKTSNAKA | 197 | 9 | | | | | 2172 |
| HPV16 | E1 | VLKTSNAKAA | 197 | 10 | | | | | 2173 |
| HPV16 | E1 | VLKTSNAKAAM | 197 | 11 | | | | | 2174 |
| HPV16 | E1 | VLQHSFNDCT | 345 | 10 | | | | | 2175 |
| HPV16 | E1 | VMFLRYQGV | 443 | 9 | 0.014 | | | | 2176 |
| HPV16 | E1 | VQLKCPPL | 555 | 8 | | | | | 2177 |
| HPV16 | E1 | VQLKCPPLL | 555 | 9 | | | | | 2178 |
| HPV16 | E1 | VQLKCPPLLI | 555 | 10 | | | | | 2179 |
| HPV16 | E1 | VQLKCPPLLIT | 555 | 11 | | | | | 2180 |
| HPV16 | E1 | VQVLKRKYL | 83 | 9 | | | | | 2181 |
| HPV16 | E1 | VQVLKRKYLV | 83 | 10 | | | | | 2182 |
| HPV16 | E1 | VQWAYDNDI | 361 | 9 | | | | | 2183 |
| HPV16 | E1 | VQWAYDNDIV | 361 | 10 | | | | | 2184 |
| HPV16 | E1 | VVEKKTGDA | 24 | 9 | | | | | 2185 |
| HPV16 | E1 | VVEKKTGDAI | 24 | 10 | | | | | 2186 |
| HPV16 | E1 | WAYDNDIV | 363 | 8 | | | | | 2187 |
| HPV16 | E1 | WIKYRCDRV | 425 | 9 | 0.0003 | | | | 2188 |
| HPV16 | E1 | WIQRQTVL | 339 | 8 | | | | | 2189 |
| HPV16 | E1 | WLQPLADA | 509 | 8 | | | | | 2190 |
| HPV16 | E1 | WLQPLADAKI | 509 | 10 | | | | | 2191 |
| HPV16 | E1 | YAQLADTNSNA | 379 | 11 | | | | | 2192 |
| HPV16 | E1 | YIDDNLRNA | 531 | 9 | | | | | 2193 |
| HPV16 | E1 | YIDDNLRNAL | 531 | 10 | | | | | 2194 |
| HPV16 | E1 | YLHIQSLA | 261 | 8 | | | | | 2195 |
| HPV16 | E1 | YLHNRLVV | 578 | 8 | | | | | 2196 |
| HPV16 | E1 | YLHNRLVVFT | 578 | 10 | | | | | 2197 |
| HPV16 | E1 | YLTQAETET | 58 | 9 | | | | | 2198 |
| HPV16 | E1 | YLTQAETETA | 58 | 10 | | | | | 2199 |
| HPV16 | E1 | YLVSPLSDI | 90 | 9 | 0.02 | | | | 2200 |
| HPV16 | E1 | YQGVEFMSFL | 448 | 10 | | | | | 2201 |
| HPV16 | E1 | YQGVEFMSFLT | 448 | 11 | | | | | 2202 |
| HPV16 | E1 | YVEAVVEKKT | 20 | 10 | | | | | 2203 |
| HPV16 | E2 | AATHTKAV | 220 | 8 | | | | | 2204 |
| HPV16 | E2 | AATHTKAVA | 220 | 9 | | | | | 2205 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E2 | AATHTKAVAL | 220 | 10 | | | | | 2206 |
| HPV16 | E2 | AIELQLTL | 72 | 8 | | | | | 2207 |
| HPV16 | E2 | AIELQLTLET | 72 | 10 | | | | | 2208 |
| HPV16 | E2 | AIELQLTLETI | 72 | 11 | | | | | 2209 |
| HPV16 | E2 | AIYYKAREM | 41 | 9 | | | | | 2210 |
| HPV16 | E2 | ALGTEETQT | 228 | 9 | | | | | 2211 |
| HPV16 | E2 | ALGTEETQTT | 228 | 10 | | | | | 2212 |
| HPV16 | E2 | ALGTEETQTTI | 228 | 11 | | | | | 2213 |
| HPV16 | E2 | ALQAIELQL | 69 | 9 | | | | | 2214 |
| HPV16 | E2 | ALQAIELQLT | 69 | 10 | | | | | 2215 |
| HPV16 | E2 | ALQAIELQLTL | 69 | 11 | | | | | 2216 |
| HPV16 | E2 | ATHTKAVA | 221 | 8 | | | | | 2217 |
| HPV16 | E2 | ATHTKAVAL | 221 | 9 | | | | | 2218 |
| HPV16 | E2 | ATHTKAVALGT | 221 | 11 | | | | | 2219 |
| HPV16 | E2 | AVALGTEET | 226 | 9 | | | | | 2220 |
| HPV16 | E2 | AVALGTEETQT | 226 | 11 | | | | | 2221 |
| HPV16 | E2 | AVSKNKAL | 63 | 8 | | | | | 2222 |
| HPV16 | E2 | AVSKNKALQA | 63 | 10 | | | | | 2223 |
| HPV16 | E2 | AVSKNKALQAI | 63 | 11 | | | | | 2224 |
| HPV16 | E2 | AVSSTWHWT | 314 | 9 | | | | | 2225 |
| HPV16 | E2 | CAIYYKAREM | 40 | 10 | | | | | 2226 |
| HPV16 | E2 | CIKKHGYT | 109 | 8 | | | | | 2227 |
| HPV16 | E2 | CIKKHGYTV | 109 | 9 | | | | | 2228 |
| HPV16 | E2 | CIKKHGYTVEV | 109 | 11 | | | | | 2229 |
| HPV16 | E2 | CLRYRFKKHCT | 300 | 11 | | | | | 2230 |
| HPV16 | E2 | CQRLNVCQDKI | 5 | 11 | | | | | 2231 |
| HPV16 | E2 | CTLYTAVSST | 309 | 10 | | | | | 2232 |
| HPV16 | E2 | DAEKYSKNKV | 174 | 10 | | | | | 2233 |
| HPV16 | E2 | DANTLKCL | 294 | 8 | | | | | 2234 |
| HPV16 | E2 | DICNTMHYT | 124 | 9 | | | | | 2235 |
| HPV16 | E2 | DQFLSQVKI | 344 | 9 | | | | | 2236 |
| HPV16 | E2 | DTGNPCHT | 246 | 8 | | | | | 2237 |
| HPV16 | E2 | DTGNPCHTT | 246 | 9 | | | | | 2238 |
| HPV16 | E2 | DTGNPCHTTKL | 246 | 11 | | | | | 2239 |
| HPV16 | E2 | DVSLEVYL | 96 | 8 | | | | | 2240 |
| HPV16 | E2 | DVSLEVYLT | 96 | 9 | | | | | 2241 |
| HPV16 | E2 | DVSLEVYLTA | 96 | 10 | | | | | 2242 |
| HPV16 | E2 | EASVTVVEGQV | 142 | 11 | | | | | 2243 |
| HPV16 | E2 | EIIRQHLA | 209 | 8 | | | | | 2244 |
| HPV16 | E2 | ELQLTLET | 74 | 8 | | | | | 2245 |
| HPV16 | E2 | ELQLTLETI | 74 | 9 | | | | | 2246 |
| HPV16 | E2 | EMGFKHINHQV | 48 | 11 | | | | | 2247 |
| HPV16 | E2 | ETLCQRLNV | 2 | 9 | | | | | 2248 |
| HPV16 | E2 | EVHAGGQV | 185 | 8 | | | | | 2249 |
| HPV16 | E2 | EVHAGGQVI | 185 | 9 | | | | | 2250 |
| HPV16 | E2 | EVHAGGQVIL | 185 | 10 | | | | | 2251 |
| HPV16 | E2 | EVQFDGDI | 118 | 8 | | | | | 2252 |
| HPV16 | E2 | EVQFDGDICNT | 118 | 11 | | | | | 2253 |
| HPV16 | E2 | EVSSPEII | 204 | 8 | | | | | 2254 |
| HPV16 | E2 | EVYLTAPT | 100 | 8 | | | | | 2255 |
| HPV16 | E2 | EVYLTAPTGCI | 100 | 11 | | | | | 2256 |
| HPV16 | E2 | FLSQVKIPKT | 346 | 10 | | | | | 2257 |
| HPV16 | E2 | FLSQVKIPKTI | 346 | 11 | | | | | 2258 |
| HPV16 | E2 | FVQFKDDA | 168 | 8 | | | | | 2259 |
| HPV16 | E2 | GLYYVHEGI | 156 | 9 | | | | | 2260 |
| HPV16 | E2 | GLYYVHEGIRT | 156 | 11 | | | | | 2261 |
| HPV16 | E2 | GQVDYYGL | 150 | 8 | | | | | 2262 |
| HPV16 | E2 | GQVDYYGLYYV | 150 | 11 | | | | | 2263 |
| HPV16 | E2 | GQVILCPT | 190 | 8 | | | | | 2264 |
| HPV16 | E2 | GQVILCPTSV | 190 | 10 | | | | | 2265 |
| HPV16 | E2 | GTEETQTT | 230 | 8 | | | | | 2266 |
| HPV16 | E2 | GTEETQTTI | 230 | 9 | | | | | 2267 |
| HPV16 | E2 | HAGGQVIL | 187 | 8 | | | | | 2268 |
| HPV16 | E2 | HAGGQVILCPT | 187 | 11 | | | | | 2269 |
| HPV16 | E2 | HIDYWKHM | 29 | 8 | | | | | 2270 |
| HPV16 | E2 | HIDYWKFIMRL | 29 | 10 | | | | | 2271 |
| HPV16 | E2 | HINHQVVPT | 53 | 9 | | | | | 2272 |
| HPV16 | E2 | HINHQVVPTL | 53 | 10 | | | | | 2273 |
| HPV16 | E2 | HINHQVVPTLA | 53 | 11 | | | | | 2274 |
| HPV16 | E2 | HIYICEEA | 136 | 8 | | | | | 2275 |
| HPV16 | E2 | HIYICEEASV | 136 | 10 | | | | | 2276 |
| HPV16 | E2 | HIYICEEASVT | 136 | 11 | | | | | 2277 |
| HPV16 | E2 | HLANHPAA | 214 | 8 | | | | | 2278 |
| HPV16 | E2 | HLANHPAAT | 214 | 9 | | | | | 2279 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E2 | HLANHPAATHT | 214 | 11 | | | | | 2280 |
| HPV16 | E2 | HLKGDANT | 290 | 8 | | | | | 2281 |
| HPV16 | E2 | HLKGDANTL | 290 | 9 | | | | | 2282 |
| HPV16 | E2 | HMRLECAI | 35 | 8 | | | | | 2283 |
| HPV16 | E2 | HQVVPTLA | 56 | 8 | | | | | 2284 |
| HPV16 | E2 | HQVVPTLAV | 56 | 9 | | | | | 2285 |
| HPV16 | E2 | HTKAVALGT | 223 | 9 | | | | | 2286 |
| HPV16 | E2 | HTTKLLHRDSV | 252 | 11 | | | | | 2287 |
| HPV16 | E2 | IIRQHLANHPA | 210 | 11 | | | | | 2288 |
| HPV16 | E2 | ILTHYENDST | 15 | 10 | | | | | 2289 |
| HPV16 | E2 | IQRPRSEPDT | 238 | 10 | | | | | 2290 |
| HPV16 | E2 | ITVSTGFM | 356 | 8 | | | | | 2291 |
| HPV16 | E2 | ITVSTGFMSI | 356 | 10 | | | | | 2292 |
| HPV16 | E2 | IVHLKGDA | 288 | 8 | | | | | 2293 |
| HPV16 | E2 | IVHLKGDANT | 288 | 10 | | | | | 2294 |
| HPV16 | E2 | IVHLKGDANTL | 288 | 11 | | | | | 2295 |
| HPV16 | E2 | KALQAIEL | 68 | 8 | | | | | 2296 |
| HPV16 | E2 | KALQAIELQL | 68 | 10 | | | | | 2297 |
| HPV16 | E2 | KALQAIELQLT | 68 | 11 | | | | | 2298 |
| HPV16 | E2 | KAREMGFKHI | 45 | 10 | | | | | 2299 |
| HPV16 | E2 | KAVALGTEET | 225 | 10 | | | | | 2300 |
| HPV16 | E2 | KILTHYENDST | 14 | 11 | | | | | 2301 |
| HPV16 | E2 | KIPKTITV | 351 | 8 | | | | | 2302 |
| HPV16 | E2 | KIPKTITVST | 351 | 10 | | | | | 2303 |
| HPV16 | E2 | KLLHRDSV | 255 | 8 | | | | | 2304 |
| HPV16 | E2 | KLLHRDSVDSA | 255 | 11 | | | | | 2305 |
| HPV16 | E2 | KTITVSTGFM | 354 | 10 | | | | | 2306 |
| HPV16 | E2 | KVWEVHAGGQV | 182 | 11 | | | | | 2307 |
| HPV16 | E2 | LANHPAAT | 215 | 8 | | | | | 2308 |
| HPV16 | E2 | LANHPAATHT | 215 | 10 | | | | | 2309 |
| HPV16 | E2 | LAVSKNKA | 62 | 8 | | | | | 2310 |
| HPV16 | E2 | LAVSKNKAL | 62 | 9 | | | | | 2311 |
| HPV16 | E2 | LAVSKNKALQA | 62 | 11 | | | | | 2312 |
| HPV16 | E2 | LLHRDSVDSA | 256 | 10 | | | | | 2313 |
| HPV16 | E2 | LQAIELQL | 70 | 8 | | | | | 2314 |
| HPV16 | E2 | LQAIELQLT | 70 | 9 | | | | | 2315 |
| HPV16 | E2 | LQAIELQLTL | 70 | 10 | | | | | 2316 |
| HPV16 | E2 | LQDVSLEV | 94 | 8 | | | | | 2317 |
| HPV16 | E2 | LQDVSLEVYL | 94 | 10 | | | | | 2318 |
| HPV16 | E2 | LQDVSLEVYLT | 94 | 11 | | | | | 2319 |
| HPY16 | E2 | LQLTLETI | 75 | 8 | | | | | 2320 |
| HPV16 | E2 | LTAPTGCI | 103 | 8 | | | | | 2321 |
| HPV16 | E2 | LTHYENDST | 16 | 9 | | | | | 2322 |
| HPV16 | E2 | LTHYENDSTDL | 16 | 11 | | | | | 2323 |
| HPV16 | E2 | NTMHYTNWT | 127 | 9 | | | | | 2324 |
| HPV16 | E2 | NTMHYTNWTHI | 127 | 11 | | | | | 2325 |
| HPV16 | E2 | NTTPIVHL | 284 | 8 | | | | | 2326 |
| HPV16 | E2 | NVCQDKIL | 9 | 8 | | | | | 2327 |
| HPV16 | E2 | NVCQDKILT | 9 | 9 | | | | | 2328 |
| HPV16 | E2 | NVKHKSAI | 325 | 8 | | | | | 2329 |
| HPV16 | E2 | NVKHKSAIV | 325 | 9 | | | | | 2330 |
| HPV16 | E2 | NVKHKSAIVT | 325 | 10 | | | | | 2331 |
| HPV16 | E2 | NVKHKSAIVTL | 325 | 11 | | | | | 2332 |
| HPV16 | E2 | PAATHTKA | 219 | 8 | | | | | 2333 |
| HPV16 | E2 | PAATHTKAV | 219 | 9 | | | | | 2334 |
| HPV16 | E2 | PAATHTKAVA | 219 | 10 | | | | | 2335 |
| HPV16 | E2 | PAATHTKAVAL | 219 | 11 | | | | | 2336 |
| HPV16 | E2 | PIVHLKGDA | 287 | 9 | | | | | 2337 |
| HPV16 | E2 | PIVHLKGDANT | 287 | 11 | | | | | 2338 |
| HPV16 | E2 | PTGCIKKHGYT | 106 | 11 | | | | | 2339 |
| HPV16 | E2 | PTLAVSKNKA | 60 | 10 | | | | | 2340 |
| HPV16 | E2 | PTLAVSKNKAL | 60 | 11 | | | | | 2341 |
| HPV16 | E2 | PTSVFSSNEV | 196 | 10 | | | | | 2342 |
| HPV16 | E2 | QAIELQLT | 71 | 8 | | | | | 2343 |
| HPV16 | E2 | QAIELQLTL | 71 | 9 | | | | | 2344 |
| HPV16 | E2 | QAIELQLTLET | 71 | 11 | | | | | 2345 |
| HPV16 | E2 | QVDYYGLYYV | 151 | 10 | | | | | 2346 |
| HPV16 | E2 | QVILCPTSV | 191 | 9 | | | | | 2347 |
| HPV16 | E2 | QVKIPKTI | 349 | 8 | | | | | 2348 |
| HPV16 | E2 | QVKIPKTIT | 349 | 9 | | | | | 2349 |
| HPV16 | E2 | QVKIPKTITV | 349 | 10 | | | | | 2350 |
| HPV16 | E2 | QVVPTLAV | 57 | 8 | | | | | 2351 |
| HPV16 | E2 | RINCNSNT | 278 | 8 | | | | | 2352 |
| HPV16 | E2 | RINCNSNTT | 278 | 9 | | | | | 2353 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E2 | RINCNSNTTPI | 278 | 11 | | | | | 2354 |
| HPV16 | E2 | RLECAIYYKA | 37 | 10 | | | | | 2355 |
| HPV16 | E2 | RLNVCQDKI | 7 | 9 | | | | | 2356 |
| HPV16 | E2 | RLNVCQDKIL | 7 | 10 | | | | | 2357 |
| HPV16 | E2 | RLNVCQDKILT | 7 | 11 | | | | | 2358 |
| HPV16 | E2 | RQHLANHPA | 212 | 9 | | | | | 2359 |
| HPV16 | E2 | RQHLANHPAA | 212 | 10 | | | | | 2360 |
| HPV16 | E2 | RQHLANHPAAT | 212 | 11 | | | | | 2361 |
| HPV16 | E2 | RTYFVQFKDDA | 165 | 11 | | | | | 2362 |
| HPV16 | E2 | SLEVYLTA | 98 | 8 | | | | | 2363 |
| HPV16 | E2 | SLEVYLTAPT | 98 | 10 | | | | | 2364 |
| HPV16 | E2 | SQVKIPKT | 348 | 8 | | | | | 2365 |
| HPV16 | E2 | SQVKIPKTI | 348 | 9 | | | | | 2366 |
| HPV16 | E2 | SQVKIPKTIT | 348 | 10 | | | | | 2367 |
| HPV16 | E2 | SQVKIPKTITV | 348 | 11 | | | | | 2368 |
| HPV16 | E2 | SQYSNEKWT | 85 | 9 | | | | | 2369 |
| HPV16 | E2 | SQYSNEKWTL | 85 | 10 | | | | | 2370 |
| HPV16 | E2 | STDLRDHI | 23 | 8 | | | | | 2371 |
| HPV16 | E2 | STWHWTGHNV | 317 | 10 | | | | | 2372 |
| HPV16 | E2 | SVDSAPIL | 261 | 8 | | | | | 2373 |
| HPV16 | E2 | SVDSAPILT | 261 | 9 | | | | | 2374 |
| HPV16 | E2 | SVDSAPILTA | 261 | 10 | | | | | 2375 |
| HPV16 | E2 | SVFSSNEV | 198 | 8 | | | | | 2376 |
| HPV16 | E2 | SVTVVEGQV | 144 | 9 | | | | | 2377 |
| HPV16 | E2 | TAFNSSHKGRI | 269 | 11 | | | | | 2378 |
| HPV16 | E2 | TAVSSTWHWT | 313 | 10 | | | | | 2379 |
| HPV16 | E2 | TIQRPRSEPDT | 237 | 11 | | | | | 2380 |
| HPV16 | E2 | TITVSTGFM | 355 | 9 | | | | | 2381 |
| HPV16 | E2 | TITVSTGFMSI | 355 | 11 | | | | | 2382 |
| HPV16 | E2 | TLAVSKNKA | 61 | 9 | | | | | 2383 |
| HPV16 | E2 | TLAVSKNKAL | 61 | 10 | | | | | 2384 |
| HPV16 | E2 | TLCQRLNV | 3 | 8 | | | | | 2385 |
| HPV16 | E2 | TLQDVSLEV | 93 | 9 | | | | | 2386 |
| HPV16 | E2 | TLQDVSLEVYL | 93 | 11 | | | | | 2387 |
| HPV16 | E2 | TLYTAVSST | 310 | 9 | | | | | 2388 |
| HPV16 | E2 | TMHYTNWT | 128 | 8 | | | | | 2389 |
| HPV16 | E2 | TMHYTNWTHI | 128 | 10 | | | | | 2390 |
| HPV16 | E2 | TTKLLHRDSV | 253 | 10 | | | | | 2391 |
| HPV16 | E2 | TTPIVHLKGDA | 285 | 11 | | | | | 2392 |
| HPV16 | E2 | TVEVQFDGDI | 116 | 10 | | | | | 2393 |
| HPV16 | E2 | TVSTGFMSI | 357 | 9 | | | | | 2394 |
| HPV16 | E2 | VALGTEET | 227 | 8 | | | | | 2395 |
| HPV16 | E2 | VALGTEETQT | 227 | 10 | | | | | 2396 |
| HPV16 | E2 | VALGTEETQTT | 227 | 11 | | | | | 2397 |
| HPV16 | E2 | VILCPTSV | 192 | 8 | | | | | 2398 |
| HPV16 | E2 | VQFDGDICNT | 119 | 10 | | | | | 2399 |
| HPV16 | E2 | VQFDGDICNTM | 119 | 11 | | | | | 2400 |
| HPV16 | E2 | VTVVEGQV | 145 | 8 | | | | | 2401 |
| HPV16 | E2 | VVEGQVDYYGL | 147 | 11 | | | | | 2402 |
| HPV16 | E2 | WQRDQFLSQV | 341 | 10 | | | | | 2403 |
| HPV16 | E2 | WTGHNVKHKSA | 321 | 11 | | | | | 2404 |
| HPV16 | E2 | WTHIYICEEA | 134 | 10 | | | | | 2405 |
| HPV16 | E2 | WTLQDVSL | 92 | 8 | | | | | 2406 |
| HPV16 | E2 | WTLQDVSLEV | 92 | 10 | | | | | 2407 |
| HPV16 | E2 | YICEEASV | 138 | 8 | | | | | 2408 |
| HPV16 | E2 | YICEEASVT | 138 | 9 | | | | | 2409 |
| HPV16 | E2 | YICEEASVTV | 138 | 10 | | | | | 2410 |
| HPV16 | E2 | YICEEASVTVV | 138 | 11 | | | | | 2411 |
| HPV16 | E2 | YLTAPTGCI | 102 | 9 | | | | | 2412 |
| HPV16 | E2 | YTAVSSTWHWT | 312 | 11 | | | | | 2413 |
| HPV16 | E2 | YTNWTHIYI | 131 | 9 | | | | | 2414 |
| HPV16 | E2 | YTVEVQFDGDI | 115 | 11 | | | | | 2415 |
| HPV16 | E2 | YVHEGIRT | 159 | 8 | | | | | 2416 |
| HPV16 | E2 | YVHEGIRTYFV | 159 | 11 | | | | | 2417 |
| HPV16 | E5 | AASAFRCFI | 53 | 9 | | | | | 2418 |
| HPV16 | E5 | AASAFRCFIV | 53 | 10 | | | | | 2419 |
| HPV16 | E5 | CLLIRPLL | 26 | 8 | | | | | 2420 |
| HPV16 | E5 | CLLIRPLLL | 26 | 9 | | | | | 2421 |
| HPV16 | E5 | CLLIRPLLLSV | 26 | 11 | | | | | 2422 |
| HPV16 | E5 | CVCLLIRPL | 24 | 9 | | | | | 2423 |
| HPV16 | E5 | CVCLLIRPLL | 24 | 10 | | | | | 2424 |
| HPV16 | E5 | CVCLLIRPLLL | 24 | 11 | | | | | 2425 |
| HPV16 | E5 | CVLLCVCL | 20 | 8 | | | | | 2426 |
| HPV16 | E5 | CVLLCVCLL | 20 | 9 | | | | | 2427 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E5 | CVLLCVCLLI | 20 | 10 | | | | | 2428 |
| HPV16 | E5 | DTASTTLL | 5 | 8 | | | | | 2429 |
| HPV16 | E5 | DTASTTLLA | 5 | 9 | | | | | 2430 |
| HPV16 | E5 | FIVYIIFV | 60 | 8 | | | | | 2431 |
| HPV16 | E5 | FIVYIIFVYI | 60 | 10 | | | | | 2432 |
| HPV16 | E5 | FLIHTHARFL | 72 | 10 | | | | | 2433 |
| HPV16 | E5 | FLIHTHARFLI | 72 | 11 | | | | | 2434 |
| HPV16 | E5 | FLLCFCVL | 15 | 8 | | | | | 2435 |
| HPV16 | E5 | FLLCFCVLL | 15 | 9 | | | | | 2436 |
| HPV16 | E5 | FLLCFCVLLCV | 15 | 11 | | | | | 2437 |
| HPV16 | E5 | FVYIPLFL | 66 | 8 | | | | | 2438 |
| HPV16 | E5 | FVYIPLFLI | 66 | 9 | | | | | 2439 |
| HPV16 | E5 | FVYIPLFLIHT | 66 | 11 | | | | | 2440 |
| HPV16 | E5 | HTHARFLI | 75 | 8 | | | | | 2441 |
| HPV16 | E5 | HTHARFLIT | 75 | 9 | | | | | 2442 |
| HPV16 | E5 | IIFVYIPL | 64 | 8 | | | | | 2443 |
| HPV16 | E5 | IIFVYIPLFL | 64 | 10 | | | | | 2444 |
| HPV16 | E5 | IIFVYIPLFLI | 64 | 11 | | | | | 2445 |
| HPV16 | E5 | IILVLLLWI | 43 | 9 | | | | | 2446 |
| HPV16 | E5 | IILVLLLWIT | 43 | 10 | | | | | 2447 |
| HPV16 | E5 | IILVLLLWITA | 43 | 11 | | | | | 2448 |
| HPV16 | E5 | ILVLLLWI | 44 | 8 | | | | | 2449 |
| HPV16 | E5 | ILVLLLWIT | 44 | 9 | | | | | 2450 |
| HPV16 | E5 | ILVLLLWITA | 44 | 10 | | | | | 2451 |
| HPV16 | E5 | ILVLLLWITAA | 44 | 11 | | | | | 2452 |
| HPV16 | E5 | ITAASAFRCFI | 51 | 11 | | | | | 2453 |
| HPV16 | E5 | IVYIIFVYI | 61 | 9 | | | | | 2454 |
| HPV16 | E5 | IVYIIFVYIPL | 61 | 11 | | | | | 2455 |
| HPV16 | E5 | LACFLLCFCV | 12 | 10 | | | | | 2456 |
| HPV16 | E5 | LACFLLCFCVL | 12 | 11 | | | | | 2457 |
| HPV16 | E5 | LIHTHARFL | 73 | 9 | | | | | 2458 |
| HPV16 | E5 | LIHTHARFLI | 73 | 10 | | | | | 2459 |
| HPV16 | E5 | LIHTHARFLIT | 73 | 11 | | | | | 2460 |
| HPV16 | E5 | LIILVLLL | 42 | 8 | | | | | 2461 |
| HPV16 | E5 | LIILVLLLWI | 42 | 10 | | | | | 2462 |
| HPV16 | E5 | LIILVLLLWIT | 42 | 11 | | | | | 2463 |
| HPV16 | E5 | LIRPLLLSV | 28 | 9 | | | | | 2464 |
| HPV16 | E5 | LIRPLLLSVST | 28 | 11 | | | | | 2465 |
| HPV16 | E5 | LLACFLLCFCV | 11 | 11 | | | | | 2466 |
| HPV16 | E5 | LLCFCVLL | 16 | 8 | | | | | 2467 |
| HPV16 | E5 | LLCFCVLLCV | 16 | 10 | | | | | 2468 |
| HPV16 | E5 | LLCVCLLI | 22 | 8 | | | | | 2469 |
| HPV16 | E5 | LLCVCLLIRPL | 22 | 11 | | | | | 2470 |
| HPV16 | E5 | LLIRPLLL | 27 | 8 | | | | | 2471 |
| HPV16 | E5 | LLIRPLLLSV | 27 | 10 | | | | | 2472 |
| HPV16 | E5 | LLLSVSTYT | 32 | 9 | | | | | 2473 |
| HPV16 | E5 | LLLSVSTYTSL | 32 | 11 | | | | | 2474 |
| HPV16 | E5 | LLLWITAA | 47 | 8 | | | | | 2475 |
| HPV16 | E5 | LLLWITAASA | 47 | 10 | | | | | 2476 |
| HPV16 | E5 | LLSVSTYT | 33 | 8 | | | | | 2477 |
| HPV16 | E5 | LLSVSTYTSL | 33 | 10 | | | | | 2478 |
| HPV16 | E5 | LLSVSTYTSLI | 33 | 11 | | | | | 2479 |
| HPV16 | E5 | LLWITAASA | 48 | 9 | | | | | 2480 |
| HPV16 | E5 | LVLLLWIT | 45 | 8 | | | | | 2481 |
| HPV16 | E5 | LVLLLWITA | 45 | 9 | | | | | 2482 |
| HPV16 | E5 | LVLLLWITAA | 45 | 10 | | | | | 2483 |
| HPV16 | E5 | MTNLDTAST | 1 | 9 | | | | | 2484 |
| HPV16 | E5 | MTNLDTASTT | 1 | 10 | | | | | 2485 |
| HPV16 | E5 | MTNLDTASTTL | 1 | 11 | | | | | 2486 |
| HPV16 | E5 | NLDTASTT | 3 | 8 | | | | | 2487 |
| HPV16 | E5 | NLDTASTTL | 3 | 9 | | | | | 2488 |
| HPV16 | E5 | NLDTASTTLL | 3 | 10 | | | | | 2489 |
| HPV16 | E5 | NLDTASTTLLA | 3 | 11 | | | | | 2490 |
| HPV16 | E5 | PLFLIHTHA | 70 | 9 | | | | | 2491 |
| HPV16 | E5 | PLLLSVST | 31 | 8 | | | | | 2492 |
| HPV16 | E5 | PLLLSVSTYT | 31 | 10 | | | | | 2493 |
| HPV16 | E5 | SAFRCFIV | 55 | 8 | | | | | 2494 |
| HPV16 | E5 | SAFRCFIVYI | 55 | 10 | | | | | 2495 |
| HPV16 | E5 | SAFRCFIVYII | 55 | 11 | | | | | 2496 |
| HPV16 | E5 | SLIILVLL | 41 | 8 | | | | | 2497 |
| HPV16 | E5 | SLIILVLLL | 41 | 9 | | | | | 2498 |
| HPV16 | E5 | SLIILVLLLWI | 41 | 11 | | | | | 2499 |
| HPV16 | E5 | STTLLACFL | 8 | 9 | | | | | 2500 |
| HPV16 | E5 | STTLLACFLL | 8 | 10 | | | | | 2501 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E5 | STYTSLII | 37 | 8 | | | | | 2502 |
| HPV16 | E5 | STYTSLIIL | 37 | 9 | | | | | 2503 |
| HPV16 | E5 | STYTSLIILV | 37 | 10 | | | | | 2504 |
| HPV16 | E5 | STYTSLIILVL | 37 | 11 | | | | | 2505 |
| HPV16 | E5 | SVSTYTSL | 35 | 8 | | | | | 2506 |
| HPV16 | E5 | SVSTYTSLI | 35 | 9 | | | | | 2507 |
| HPV16 | E5 | SVSTYTSLII | 35 | 10 | | | | | 2508 |
| HPV16 | E5 | SVSTYTSLIIL | 35 | 11 | | | | | 2509 |
| HPV16 | E5 | TAASAFRCFI | 52 | 10 | | | | | 2510 |
| HPV16 | E5 | TAASAFRCFIV | 52 | 11 | | | | | 2511 |
| HPV16 | E5 | TASTTLLA | 6 | 8 | | | | | 2512 |
| HPV16 | E5 | TASTTLLACFL | 6 | 11 | | | | | 2513 |
| HPV16 | E5 | TLLACFLL | 10 | 8 | | | | | 2514 |
| HPV16 | E5 | TTLLACFL | 9 | 8 | | | | | 2515 |
| HPV16 | E5 | TTLLACFLL | 9 | 9 | | | | | 2516 |
| HPV16 | E5 | VLLCVCLL | 21 | 8 | | | | | 2517 |
| HPV16 | E5 | VLLCVCLLI | 21 | 9 | | | | | 2518 |
| HPV16 | E5 | VLLLWITA | 46 | 8 | | | | | 2519 |
| HPV16 | E5 | VLLLWITAA | 46 | 9 | | | | | 2520 |
| HPV16 | E5 | VLLLWITAASA | 46 | 11 | | | | | 2521 |
| HPV16 | E5 | YIIFVYIPL | 63 | 9 | | | | | 2522 |
| HPV16 | E5 | YIIFVYIPLFL | 63 | 11 | | | | | 2523 |
| HPV16 | E5 | YIPLFLIHT | 68 | 9 | | | | | 2524 |
| HPV16 | E5 | YIPLFLIHTHA | 68 | 11 | | | | | 2525 |
| HPV16 | E5 | YTSLIILV | 39 | 8 | | | | | 2526 |
| HPV16 | E5 | YTSLIILVL | 39 | 9 | | | | | 2527 |
| HPV16 | E5 | YTSLIILVLL | 39 | 10 | | | | | 2528 |
| HPV16 | E5 | YTSLIILVLLL | 39 | 11 | | | | | 2529 |
| HPV16 | E6 | CINCQKPL | 110 | 8 | 0.0001 | | | | 2530 |
| HPV16 | E6 | CIVYRDGNPYA | 58 | 11 | | | | | 2531 |
| HPV16 | E6 | CLKFYSKI | 73 | 8 | 0.0001 | | | | 2532 |
| HPV16 | E6 | CMSCCRSSRT | 143 | 10 | 0.0001 | | | | 2533 |
| HPV16 | E6 | CTELQTTI | 23 | 8 | | | | | 2534 |
| HPV16 | E6 | CTELQTTIHDI | 23 | 11 | | | | | 2535 |
| HPV16 | E6 | CVYCKQQL | 37 | 8 | 0.0001 | | | | 2536 |
| HPV16 | E6 | CVYCKQQLL | 37 | 9 | 0.0001 | | | | 2537 |
| HPV16 | E6 | ELQTTIHDI | 25 | 9 | 0.0001 | | | | 2538 |
| HPV16 | E6 | ELQTTIHDII | 25 | 10 | 0.0002 | | | | 2539 |
| HPV16 | E6 | ELQTTIHDIIL | 25 | 11 | 0.0001 | | | | 2540 |
| HPV16 | E6 | EQQYNKPL | 96 | 8 | | | | | 2541 |
| HPV16 | E6 | EQQYNKPLCDL | 96 | 11 | | | | | 2542 |
| HPV16 | E6 | EVYDFAFRDL | 48 | 10 | 0.0001 | | | | 2543 |
| HPV16 | E6 | FAFRDLCI | 52 | 8 | | | | | 2544 |
| HPV16 | E6 | FAFRDLCIV | 52 | 9 | 0.051 | | | | 2545 |
| HPV16 | E6 | FQDPQERPRKL | 9 | 11 | | | | | 2546 |
| HPV16 | E6 | HLDKKQRFHNI | 125 | 11 | | | | | 2547 |
| HPV16 | E6 | ILECVYCKQQL | 34 | 11 | 0.0004 | | | | 2548 |
| HPV16 | E6 | IVYRDGNPYA | 59 | 10 | 0.0002 | | | | 2549 |
| HPV16 | E6 | IVYRDGNPYAV | 59 | 11 | | | | | 2550 |
| HPV16 | E6 | KLPQLCTEL | 18 | 9 | 0.0009 | | | | 2551 |
| HPV16 | E6 | KLPQLCTELQT | 18 | 11 | | | | | 2552 |
| HPV16 | E6 | KQQLLRREV | 41 | 9 | | | | | 2553 |
| HPV16 | E6 | LIRCINCQKPL | 107 | 11 | | | | | 2554 |
| HPV16 | E6 | LLRREVYDFA | 44 | 10 | 0.0003 | | | | 2555 |
| HPV16 | E6 | LQTTIHDI | 26 | 8 | | | | | 2556 |
| HPV16 | E6 | LQTTIHDII | 26 | 9 | 0.0002 | | | | 2557 |
| HPV16 | E6 | LQTTIHDIIL | 26 | 10 | | | | | 2558 |
| HPV16 | E6 | NIRGRWTGRCM | 134 | 11 | | | | | 2559 |
| HPV16 | E6 | PLCDLLIRCI | 102 | 10 | 0.0001 | | | | 2560 |
| HPV16 | E6 | PLCPEEKQRHL | 116 | 11 | 0.0001 | | | | 2561 |
| HPV16 | E6 | PQERPRKL | 12 | 8 | | | | | 2562 |
| HPV16 | E6 | PQERPRKLPQL | 12 | 11 | | | | | 2563 |
| HPV16 | E6 | PQLCTELQT | 20 | 9 | | | | | 2564 |
| HPV16 | E6 | PQLCTELQTT | 20 | 10 | | | | | 2565 |
| HPV16 | E6 | PQLCTELQTTI | 20 | 11 | | | | | 2566 |
| HPV16 | E6 | QLCTELQT | 21 | 8 | | | | | 2567 |
| HPV16 | E6 | QLCTELQTT | 21 | 9 | 0.0001 | | | | 2568 |
| HPV16 | E6 | QLCTELQTTI | 21 | 10 | 0.0012 | | | | 2569 |
| HPV16 | E6 | QLLRREVYDFA | 43 | 11 | | | | | 2570 |
| HPV16 | E6 | QQLLRREV | 42 | 8 | | | | | 2571 |
| HPV16 | E6 | QQYNKPLCDL | 97 | 10 | | | | | 2572 |
| HPV16 | E6 | QQYNKPLCDLL | 97 | 11 | | | | | 2573 |
| HPV16 | E6 | QTTIHDII | 27 | 8 | | | | | 2574 |
| HPV16 | E6 | QTTIHDIIL | 27 | 9 | | | | | 2575 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | E6 | RTRRETQL | 151 | 8 | | | | | 2576 |
| HPV16 | E6 | TIHDIILECV | 29 | 10 | 0.021 | | | | 2577 |
| HPV16 | E6 | TLEQQYNKPL | 94 | 10 | 0.0001 | | | | 2578 |
| HPV16 | E6 | TTIHDIIL | 28 | 8 | | | | | 2579 |
| HPV16 | E6 | TTIHDIILECV | 28 | 11 | | | | | 2580 |
| HPV16 | E6 | TTLEQQYNKPL | 93 | 11 | | | | | 2581 |
| HPV16 | E6 | YAVCDKCL | 67 | 8 | | | | | 2582 |
| HPV16 | E7 | CVQSTHVDI | 68 | 9 | 0.0004 | | | | 2583 |
| HPV16 | E7 | CVQSTHVDIRT | 68 | 11 | | | | | 2584 |
| HPV16 | E7 | DIRTLEDL | 75 | 8 | 0.0001 | | | | 2585 |
| HPV16 | E7 | DIRTLEDLL | 75 | 9 | 0.0003 | | | | 2586 |
| HPV16 | E7 | DIRTLEDLLM | 75 | 10 | | | | | 2587 |
| HPV16 | E7 | DLLMGTLGI | 81 | 9 | 0.0002 | | | | 2588 |
| HPV16 | E7 | DLLMGTLGIV | 81 | 10 | 0.0005 | | | | 2589 |
| HPV16 | E7 | DLQPETTDL | 14 | 9 | 0.0003 | | | | 2590 |
| HPV16 | E7 | DLYCYEQL | 21 | 8 | 0.0001 | | | | 2591 |
| HPV16 | E7 | DTPTLHEYM | 4 | 9 | | | | | 2592 |
| HPV16 | E7 | DTPTLHEYML | 4 | 10 | | | | | 2593 |
| HPV16 | E7 | EIDGPAGQA | 37 | 9 | | | | | 2594 |
| HPV16 | E7 | ETTDLYCYEQL | 18 | 11 | | | | | 2595 |
| HPV16 | E7 | GQAEPDRA | 43 | 8 | | | | | 2596 |
| HPV16 | E7 | GTLGIVCPI | 85 | 9 | 0.021 | | | | 2597 |
| HPV16 | E7 | HVDIRTLEDL | 73 | 10 | 0.0001 | | | | 2598 |
| HPV16 | E7 | HVDIRTLEDLL | 73 | 11 | | | | | 2599 |
| HPV16 | E7 | IVTFCCKCDST | 54 | 11 | | | | | 2600 |
| HPV16 | E7 | LLMGTLGI | 82 | 8 | 0.0008 | | | | 2601 |
| HPV16 | E7 | LLMGTLGIV | 82 | 9 | 0.072 | 0.015 | 5.9 | 0.011 | 2602 |
| HPV16 | E7 | LMGTLGIV | 83 | 8 | 0.0001 | | | | 2603 |
| HPV16 | E7 | LMGTLGIVCPI | 83 | 11 | | | | | 2604 |
| HPV16 | E7 | LQPETTDL | 15 | 8 | | | | | 2605 |
| HPV16 | E7 | MLDLQPET | 12 | 8 | 0.0001 | | | | 2606 |
| HPV16 | E7 | MLDLQPETT | 12 | 9 | 0.0028 | | | | 2607 |
| HPV16 | E7 | MLDLQPETTDL | 12 | 11 | 0.0005 | | | | 2608 |
| HPV16 | E7 | PAGQAEPDRA | 41 | 10 | | | | | 2609 |
| HPV16 | E7 | PTLHEYML | 6 | 8 | | | | | 2610 |
| HPV16 | E7 | PTLHEYMLDL | 6 | 10 | | | | | 2611 |
| HPV16 | E7 | QAEPDRAHYNI | 44 | 11 | | | | | 2612 |
| HPV16 | E7 | RAHYNIVT | 49 | 8 | | | | | 2613 |
| HPV16 | E7 | RLCVQSTHV | 66 | 9 | 0.0003 | | | | 2614 |
| HPV16 | E7 | RLCVQSTHVDI | 66 | 11 | | | | | 2615 |
| HPV16 | E7 | RTLEDLLM | 77 | 8 | | | | | 2616 |
| HPV16 | E7 | RTLEDLLMGT | 77 | 10 | 0.0006 | | | | 2617 |
| HPV16 | E7 | RTLEDLLMGTL | 77 | 11 | | | | | 2618 |
| HPV16 | E7 | STHVDIRT | 71 | 8 | | | | | 2619 |
| HPV16 | E7 | STHVDIRTL | 71 | 9 | | | | | 2620 |
| HPV16 | E7 | STLRLCVQST | 63 | 10 | 0.0012 | | | | 2621 |
| HPV16 | E7 | TLEDLLMGT | 78 | 9 | 0.0002 | | | | 2622 |
| HPV16 | E7 | TLEDLLMGTL | 78 | 10 | 0.0002 | | | | 2623 |
| HPV16 | E7 | TLGIVCPI | 86 | 8 | 0.15 | 0.0005 | 0.54 | 0.0047 | 2624 |
| HPV16 | E7 | TLHEYMLDL | 7 | 9 | 0.007 | | | | 2625 |
| HPV16 | E7 | TLRLCVQST | 64 | 9 | 0.0061 | | | | 2626 |
| HPV16 | E7 | TLRLCVQSTHV | 64 | 11 | 0.0006 | | | | 2627 |
| HPV16 | E7 | TTDLYCYEQL | 19 | 10 | | | | | 2628 |
| HPV16 | E7 | VQSTHVDI | 69 | 8 | | | | | 2629 |
| HPV16 | E7 | VQSTHVDIRT | 69 | 10 | | | | | 2630 |
| HPV16 | E7 | VQSTHVDIRTL | 69 | 11 | | | | | 2631 |
| HPV16 | E7 | VTFCCKCDST | 55 | 10 | 0.0001 | | | | 2632 |
| HPV16 | E7 | VTFCCKCDSTL | 55 | 11 | | | | | 2633 |
| HPV16 | E7 | YMLDLQPET | 11 | 9 | 0.14 | | | | 2634 |
| HPV16 | E7 | YMLDLQPETT | 11 | 10 | 0.15 | 0.0001 | 1.7 | 0.0022 | 2635 |
| HPV16 | L1 | AAISTSET | 372 | 8 | | | | | 2636 |
| HPV16 | L1 | AAISTSETT | 372 | 9 | | | | | 2637 |
| HPV16 | L1 | AIACQKHT | 451 | 8 | | | | | 2638 |
| HPV16 | L1 | AIACQKHTPPA | 451 | 11 | | | | | 2639 |
| HPV16 | L1 | AISTSETT | 373 | 8 | | | | | 2640 |
| HPV16 | L1 | AMDFTTLQA | 233 | 9 | | | | | 2641 |
| HPV16 | L1 | AQGHNNGI | 342 | 8 | | | | | 2642 |
| HPV16 | L1 | AQIFNKPYWL | 330 | 10 | | | | | 2643 |
| HPV16 | L1 | ATPTTSST | 513 | 8 | | | | | 2644 |
| HPV16 | L1 | ATPTTSSTST | 513 | 10 | | | | | 2645 |
| HPV16 | L1 | ATPTTSSTSTT | 513 | 11 | | | | | 2646 |
| HPV16 | L1 | ATVYLPPV | 35 | 8 | | | | | 2647 |
| HPV16 | L1 | ATVYLPPVPV | 35 | 10 | | | | | 2648 |
| HPV16 | L1 | AVGENVPDDL | 292 | 10 | | | | | 2649 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L1 | AVGHPYFPI | 70 | 9 | | | | | 2650 |
| HPV16 | L1 | AVNPGDCPPL | 205 | 10 | | | | | 2651 |
| HPV16 | L1 | CAAISTSET | 371 | 9 | | | | | 2652 |
| HPV16 | L1 | CAAISTSETT | 371 | 10 | | | | | 2653 |
| HPV16 | L1 | CISMDYKQT | 172 | 9 | | | | | 2654 |
| HPV16 | L1 | CISMDYKQTQL | 172 | 11 | | | | | 2655 |
| HPV16 | L1 | CLIGCKPPI | 183 | 9 | | | | | 2656 |
| HPV16 | L1 | CQKHTPPA | 454 | 8 | | | | | 2657 |
| HPV16 | L1 | CTSICKYPDYI | 251 | 11 | | | | | 2658 |
| HPV16 | L1 | DAQIFNKPYWL | 329 | 11 | | | | | 2659 |
| HPV16 | L1 | DLQFIFQL | 397 | 8 | | | | | 2660 |
| HPV16 | L1 | DLQFIFQLCKI | 397 | 11 | | | | | 2661 |
| HPV16 | L1 | DLYIKGSGST | 300 | 10 | | | | | 2662 |
| HPV16 | L1 | DLYIKGSGSTA | 300 | 11 | | | | | 2663 |
| HPV16 | L1 | DMVDTGFGA | 225 | 9 | | | | | 2664 |
| HPV16 | L1 | DMVDTGFGAM | 225 | 10 | | | | | 2665 |
| HPV16 | L1 | DQFPLGRKFL | 486 | 10 | | | | | 2666 |
| HPV16 | L1 | DQFPLGRKFLL | 486 | 11 | | | | | 2667 |
| HPV16 | L1 | DTENASAYA | 154 | 9 | | | | | 2668 |
| HPV16 | L1 | DTENASAYAA | 154 | 10 | | | | | 2669 |
| HPV16 | L1 | DTGFGAMDFT | 228 | 10 | | | | | 2670 |
| HPV16 | L1 | DTGFGAMDFTT | 228 | 11 | | | | | 2671 |
| HPV16 | L1 | DTQRLVWA | 120 | 8 | | | | | 2672 |
| HPV16 | L1 | DTQRLVWACV | 120 | 10 | | | | | 2673 |
| HPV16 | L1 | DTSFYNPDT | 113 | 9 | | | | | 2674 |
| HPV16 | L1 | DTTRSTNM | 361 | 8 | | | | | 2675 |
| HPV16 | L1 | DTTRSTNMSL | 361 | 10 | | | | | 2676 |
| HPV16 | L1 | DTYRFVTSQA | 442 | 10 | | | | | 2677 |
| HPV16 | L1 | DTYRFVTSQAI | 442 | 11 | | | | | 2678 |
| HPV16 | L1 | DVMTYIHSM | 412 | 9 | | | | | 2679 |
| HPV16 | L1 | DVNVYHIFFQM | 17 | 11 | | | | | 2680 |
| HPV16 | L1 | EATVYLPPV | 34 | 9 | | | | | 2681 |
| HPV16 | L1 | EATVYLPPVPV | 34 | 11 | | | | | 2682 |
| HPV16 | L1 | EQMFVRHL | 279 | 8 | | | | | 2683 |
| HPV16 | L1 | EVGRGQPL | 132 | 8 | | | | | 2684 |
| HPV16 | L1 | EVGRGQPLGV | 132 | 10 | | | | | 2685 |
| HPV16 | L1 | EVNLKEKFSA | 474 | 10 | | | | | 2686 |
| HPV16 | L1 | EVPLDICT | 245 | 8 | | | | | 2687 |
| HPV16 | L1 | EVPLDICTSI | 245 | 10 | | | | | 2688 |
| HPV16 | L1 | FIFQLCKI | 400 | 8 | | | | | 2689 |
| HPV16 | L1 | FIFQLCKIT | 400 | 9 | | | | | 2690 |
| HPV16 | L1 | FIFQLCKITL | 400 | 10 | | | | | 2691 |
| HPV16 | L1 | FIFQLCKITLT | 400 | 11 | | | | | 2692 |
| HPV16 | L1 | FIYILVIT | 5 | 8 | | | | | 2693 |
| HPV16 | L1 | FLLQAGLKA | 494 | 9 | | | | | 2694 |
| HPV16 | L1 | FQLCKITL | 402 | 8 | | | | | 2695 |
| HPV16 | L1 | FQLCKITLT | 402 | 9 | | | | | 2696 |
| HPV16 | L1 | FQLCKITLTA | 402 | 10 | | | | | 2697 |
| HPV16 | L1 | FQMSLWLPSEA | 25 | 11 | | | | | 2698 |
| HPV16 | L1 | FTLGKRKA | 506 | 8 | | | | | 2699 |
| HPV16 | L1 | FTLGKRKAT | 506 | 9 | | | | | 2700 |
| HPV16 | L1 | FTLGKRKATPT | 506 | 11 | | | | | 2701 |
| HPV16 | L1 | FTTLQANKSEV | 236 | 11 | | | | | 2702 |
| HPV16 | L1 | FVRHLFNRA | 282 | 9 | | | | | 2703 |
| HPV16 | L1 | FVRHLFNRAGA | 282 | 11 | | | | | 2704 |
| HPV16 | L1 | FVTSQAIA | 446 | 8 | | | | | 2705 |
| HPV16 | L1 | FVTVVDTT | 356 | 8 | | | | | 2706 |
| HPV16 | L1 | FVTVVDTTRST | 356 | 11 | | | | | 2707 |
| HPV16 | L1 | GAMDFTTL | 232 | 8 | | | | | 2708 |
| HPV16 | L1 | GAMDFTTLQA | 232 | 10 | | | | | 2709 |
| HPV16 | L1 | GAVGENVPDDL | 291 | 11 | | | | | 2710 |
| HPV16 | L1 | GICWGNQL | 348 | 8 | | | | | 2711 |
| HPV16 | L1 | GICWGNQLFV | 348 | 10 | | | | | 2712 |
| HPV16 | L1 | GICWGNQLFVT | 348 | 11 | | | | | 2713 |
| HPV16 | L1 | GISGHPLL | 142 | 8 | | | | | 2714 |
| HPV16 | L1 | GISGHPLLNKL | 142 | 11 | | | | | 2715 |
| HPV16 | L1 | GLKAKPKFT | 499 | 9 | | | | | 2716 |
| HPV16 | L1 | GLKAKPKFTL | 499 | 10 | | | | | 2717 |
| HPV16 | L1 | GLQPPPGGT | 431 | 9 | | | | | 2718 |
| HPV16 | L1 | GLQPPPGGTL | 431 | 10 | | | | | 2719 |
| HPV16 | L1 | GLQYRVFRI | 93 | 9 | | | | | 2720 |
| HPV16 | L1 | GLQYRVFRIHL | 93 | 11 | | | | | 2721 |
| HPV16 | L1 | GQPLGVGI | 136 | 8 | | | | | 2722 |
| HPV16 | L1 | GTLEDTYRFV | 438 | 10 | | | | | 2723 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L1 | GTLEDTYRFVT | 438 | 11 | | | | | 2724 |
| HPV16 | L1 | GTSRLLAV | 64 | 8 | | | | | 2725 |
| HPV16 | L1 | GVDNRECI | 166 | 8 | | | | | 2726 |
| HPV16 | L1 | GVDNRECISM | 166 | 10 | | | | | 2727 |
| HPV16 | L1 | GVEVGRGQPL | 130 | 10 | | | | | 2728 |
| HPV16 | L1 | GVGISGHPL | 140 | 9 | | | | | 2729 |
| HPV16 | L1 | GVGISGHPLL | 140 | 10 | | | | | 2730 |
| HPV16 | L1 | HAGTSRLL | 62 | 8 | | | | | 2731 |
| HPV16 | L1 | HAGTSRLLA | 62 | 9 | | | | | 2732 |
| HPV16 | L1 | HAGTSRLLAV | 62 | 10 | | | | | 2733 |
| HPV16 | L1 | HIFFQMSL | 22 | 8 | | | | | 2734 |
| HPV16 | L1 | HIFFQMSLWL | 22 | 10 | | | | | 2735 |
| HPV16 | L1 | HLFNRAGA | 285 | 8 | | | | | 2736 |
| HPV16 | L1 | HLFNRAGAV | 285 | 9 | | | | | 2737 |
| HPV16 | L1 | HTPPAPKEDPL | 457 | 11 | | | | | 2738 |
| HPV16 | L1 | IACQKHTPPA | 452 | 10 | | | | | 2739 |
| HPV16 | L1 | ILEDWNFGL | 424 | 9 | | | | | 2740 |
| HPV16 | L1 | ILVITCYENDV | 8 | 11 | | | | | 2741 |
| HPV16 | L1 | ILVPKVSGL | 86 | 9 | | | | | 2742 |
| HPV16 | L1 | IQDGDMVDT | 221 | 9 | | | | | 2743 |
| HPV16 | L1 | ITCYENDV | 11 | 8 | | | | | 2744 |
| HPV16 | L1 | ITCYENDVNV | 11 | 10 | | | | | 2745 |
| HPV16 | L1 | ITLTADVM | 407 | 8 | | | | | 2746 |
| HPV16 | L1 | ITLTADVMT | 407 | 9 | | | | | 2747 |
| HPV16 | L1 | ITLTADVMTYI | 407 | 11 | | | | | 2748 |
| HPV16 | L1 | KAKPKFTL | 501 | 8 | | | | | 2749 |
| HPV16 | L1 | KATPTTSST | 512 | 9 | | | | | 2750 |
| HPV16 | L1 | KATPTTSSTST | 512 | 11 | | | | | 2751 |
| HPV16 | L1 | KILVPKVSGL | 85 | 10 | | | | | 2752 |
| HPV16 | L1 | KITLTADV | 406 | 8 | | | | | 2753 |
| HPV16 | L1 | KITLTADVM | 406 | 9 | | | | | 2754 |
| HPV16 | L1 | KITLTADVMT | 406 | 10 | | | | | 2755 |
| HPV16 | L1 | KLDDTENA | 151 | 8 | | | | | 2756 |
| HPV16 | L1 | KLDDTENASA | 151 | 10 | | | | | 2757 |
| HPV16 | L1 | KMVSEPYGDSL | 262 | 11 | | | | | 2758 |
| HPV16 | L1 | KQTQLCLI | 178 | 8 | | | | | 2759 |
| HPV16 | L1 | KVSGLQYRV | 90 | 9 | | | | | 2760 |
| HPV16 | L1 | KVVSTDEYV | 46 | 9 | | | | | 2761 |
| HPV16 | L1 | KVVSTDEYVA | 46 | 10 | | | | | 2762 |
| HPV16 | L1 | LASSNYFPT | 312 | 9 | | | | | 2763 |
| HPV16 | L1 | LAVGHPYFPI | 69 | 10 | | | | | 2764 |
| HPV16 | L1 | LIGCKPPI | 184 | 8 | | | | | 2765 |
| HPV16 | L1 | LINTVIQDGDM | 216 | 11 | | | | | 2766 |
| HPV16 | L1 | LLAVGHPYFPI | 68 | 11 | | | | | 2767 |
| HPV16 | L1 | LLNKLDDT | 148 | 8 | | | | | 2768 |
| HPV16 | L1 | LLNKLDDTENA | 148 | 11 | | | | | 2769 |
| HPV16 | L1 | LLQAGLKA | 495 | 8 | | | | | 2770 |
| HPV16 | L1 | LQANKSEV | 239 | 8 | | | | | 2771 |
| HPV16 | L1 | LQANKSEVPL | 239 | 10 | | | | | 2772 |
| HPV16 | L1 | LQFIFQLCKI | 398 | 10 | | | | | 2773 |
| HPV16 | L1 | LQFIFQLCKIT | 398 | 11 | | | | | 2774 |
| HPV16 | L1 | LQPPPGGT | 432 | 8 | | | | | 2775 |
| HPV16 | L1 | LQPPPGGTL | 432 | 9 | | | | | 2776 |
| HPV16 | L1 | LQRAQGHNNGI | 339 | 11 | | | | | 2777 |
| HPV16 | L1 | LQYRVFRI | 94 | 8 | | | | | 2778 |
| HPV16 | L1 | LQYRVFRIHL | 94 | 10 | | | | | 2779 |
| HPV16 | L1 | LTADVMTYI | 409 | 9 | | | | | 2780 |
| HPV16 | L1 | LVITCYENDV | 9 | 10 | | | | | 2781 |
| HPV16 | L1 | LVPKVSGL | 87 | 8 | | | | | 2782 |
| HPV16 | L1 | LVWACVGV | 124 | 8 | | | | | 2783 |
| HPV16 | L1 | LVWACVGVEV | 124 | 10 | | | | | 2784 |
| HPV16 | L1 | MQVTFIYI | 1 | 8 | | | | | 2785 |
| HPV16 | L1 | MQVTFIYIL | 1 | 9 | | | | | 2786 |
| HPV16 | L1 | MQVTFIYILV | 1 | 10 | | | | | 2787 |
| HPV16 | L1 | MQVTFIYILVI | 1 | 11 | | | | | 2788 |
| HPV16 | L1 | MTYIHSMNST | 414 | 10 | | | | | 2789 |
| HPV16 | L1 | MTYIHSMNSTI | 414 | 11 | | | | | 2790 |
| HPV16 | L1 | MVDTGFGA | 226 | 8 | | | | | 2791 |
| HPV16 | L1 | MVDTGFGAM | 226 | 9 | | | | | 2792 |
| HPV16 | L1 | MVSEPYGDSL | 263 | 10 | | | | | 2793 |
| HPV16 | L1 | MVTSDAQI | 325 | 8 | | | | | 2794 |
| HPV16 | L1 | NAGVDNRECI | 164 | 10 | | | | | 2795 |
| HPV16 | L1 | NASAYAANA | 157 | 9 | | | | | 2796 |
| HPV16 | L1 | NASAYAANAGV | 157 | 11 | | | | | 2797 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L1 | NIYYHAGT | 58 | 8 | | | | | 2798 |
| HPV16 | L1 | NIYYHAGTSRL | 58 | 11 | | | | | 2799 |
| HPV16 | L1 | NLASSNYFPT | 311 | 10 | | | | | 2800 |
| HPV16 | L1 | NLKEKFSA | 476 | 8 | | | | | 2801 |
| HPV16 | L1 | NLKEKFSADL | 476 | 10 | | | | | 2802 |
| HPV16 | L1 | NMSLCAAI | 367 | 8 | | | | | 2803 |
| HPV16 | L1 | NMSLCAAIST | 367 | 10 | | | | | 2804 |
| HPV16 | L1 | NQLFVTVV | 353 | 8 | | | | | 2805 |
| HPV16 | L1 | NQLFVTVVDT | 353 | 10 | | | | | 2806 |
| HPV16 | L1 | NQLFVTVVDTT | 353 | 11 | | | | | 2807 |
| HPV16 | L1 | NTNFKEYL | 383 | 8 | | | | | 2808 |
| HPV16 | L1 | NTVIQDGDM | 218 | 9 | | | | | 2809 |
| HPV16 | L1 | NTVIQDGDMV | 218 | 10 | | | | | 2810 |
| HPV16 | L1 | NVPDDLYI | 296 | 8 | | | | | 2811 |
| HPV16 | L1 | NVYHIFFQM | 19 | 9 | | | | | 2812 |
| HPV16 | L1 | NVYHIFFQMSL | 19 | 11 | | | | | 2813 |
| HPV16 | L1 | PAPKEDPL | 460 | 8 | | | | | 2814 |
| HPV16 | L1 | PIKKPNNNKI | 77 | 10 | | | | | 2815 |
| HPV16 | L1 | PIKKPNNNKIL | 77 | 11 | | | | | 2816 |
| HPV16 | L1 | PLDICTSI | 247 | 8 | | | | | 2817 |
| HPV16 | L1 | PLELINTV | 213 | 8 | | | | | 2818 |
| HPV16 | L1 | PLELINTVI | 213 | 9 | | | | | 2819 |
| HPV16 | L1 | PLGRKFLL | 489 | 8 | | | | | 2820 |
| HPV16 | L1 | PLGRKFLLQA | 489 | 10 | | | | | 2821 |
| HPV16 | L1 | PLGVGISGHPL | 138 | 11 | | | | | 2822 |
| HPV16 | L1 | PLKKYTFWEV | 466 | 10 | | | | | 2823 |
| HPV16 | L1 | PLLNKLDDT | 147 | 9 | | | | | 2824 |
| HPV16 | L1 | PTPSGSMV | 319 | 8 | | | | | 2825 |
| HPV16 | L1 | PTPSGSMVT | 319 | 9 | | | | | 2826 |
| HPV16 | L1 | PTTSSTST | 515 | 8 | | | | | 2827 |
| HPV16 | L1 | PTTSSTSTT | 515 | 9 | | | | | 2828 |
| HPV16 | L1 | PTTSSTSTTA | 515 | 10 | | | | | 2829 |
| HPV16 | L1 | PVPVSKVV | 41 | 8 | | | | | 2830 |
| HPV16 | L1 | PVPVSKVVST | 41 | 10 | | | | | 2831 |
| HPV16 | L1 | PVSKVVST | 43 | 8 | | | | | 2832 |
| HPV16 | L1 | QAGLKAKPKFT | 497 | 11 | | | | | 2833 |
| HPV16 | L1 | QAIACQKHT | 450 | 9 | | | | | 2834 |
| HPV16 | L1 | QANKSEVPL | 240 | 9 | | | | | 2835 |
| HPV16 | L1 | QANKSEVPLDI | 240 | 11 | | | | | 2836 |
| HPV16 | L1 | QIFNKPYWL | 331 | 9 | | | | | 2837 |
| HPV16 | L1 | QLCKITLT | 403 | 8 | | | | | 2838 |
| HPV16 | L1 | QLCKITLTA | 403 | 9 | | | | | 2839 |
| HPV16 | L1 | QLCKITLTADV | 403 | 11 | | | | | 2840 |
| HPV16 | L1 | QLCLIGCKPPI | 181 | 11 | | | | | 2841 |
| HPV16 | L1 | QLFVTVVDT | 354 | 9 | | | | | 2842 |
| HPV16 | L1 | QLFVTVVDTT | 354 | 10 | | | | | 2843 |
| HPV16 | L1 | QMFVRHLFNRA | 280 | 11 | | | | | 2844 |
| HPV16 | L1 | QMSLWLPSEA | 26 | 10 | | | | | 2845 |
| HPV16 | L1 | QMSLWLPSEAT | 26 | 11 | | | | | 2846 |
| HPV16 | L1 | QVTFIYIL | 2 | 8 | | | | | 2847 |
| HPV16 | L1 | QVTFIYILV | 2 | 9 | | | | | 2848 |
| HPV16 | L1 | QVTFIYILVI | 2 | 10 | | | | | 2849 |
| HPV16 | L1 | QVTFIYILVIT | 2 | 11 | | | | | 2850 |
| HPV16 | L1 | RAGAVGENV | 289 | 9 | | | | | 2851 |
| HPV16 | L1 | RAQGHNNGI | 341 | 9 | | | | | 2852 |
| HPV16 | L1 | RLVWACVGV | 123 | 9 | | | | | 2853 |
| HPV16 | L1 | RLVWACVGVEV | 123 | 11 | | | | | 2854 |
| HPV16 | L1 | RTNIYYHA | 56 | 8 | | | | | 2855 |
| HPV16 | L1 | RTNIYYHAGT | 56 | 10 | | | | | 2856 |
| HPV16 | L1 | SADLDQFPL | 482 | 9 | | | | | 2857 |
| HPV16 | L1 | SAYAANAGV | 159 | 9 | | | | | 2858 |
| HPV16 | L1 | SICKYPDYI | 253 | 9 | | | | | 2859 |
| HPV16 | L1 | SICKYPDYIKM | 253 | 11 | | | | | 2860 |
| HPV16 | L1 | SLCAAIST | 369 | 8 | | | | | 2861 |
| HPV16 | L1 | SLCAAISTSET | 369 | 11 | | | | | 2862 |
| HPV16 | L1 | SLFFYLRREQM | 271 | 11 | | | | | 2863 |
| HPV16 | L1 | SLWLPSEA | 28 | 8 | | | | | 2864 |
| HPV16 | L1 | SLWLPSEAT | 28 | 9 | | | | | 2865 |
| HPV16 | L1 | SLWLPSEATV | 28 | 10 | | | | | 2866 |
| HPV16 | L1 | SMDYKQTQL | 174 | 9 | | | | | 2867 |
| HPV16 | L1 | SMDYKQTQLCL | 174 | 11 | | | | | 2868 |
| HPV16 | L1 | SMVTSDAQI | 324 | 9 | | | | | 2869 |
| HPV16 | L1 | SQAIACQKHT | 449 | 10 | | | | | 2870 |
| HPV16 | L1 | STDEYVART | 49 | 9 | | | | | 2871 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L1 | STDEYVARTNI | 49 | 11 | | | | | 2872 |
| HPV16 | L1 | STILEDWNFGL | 422 | 11 | | | | | 2873 |
| HPV16 | L1 | STNMSLCA | 365 | 8 | | | | | 2874 |
| HPV16 | L1 | STNMSLCAA | 365 | 9 | | | | | 2875 |
| HPV16 | L1 | STNMSLCAAI | 365 | 10 | | | | | 2876 |
| HPV16 | L1 | STSETTYKNT | 375 | 10 | | | | | 2877 |
| HPV16 | L1 | STTAKRKKRKL | 521 | 11 | | | | | 2878 |
| HPV16 | L1 | TADVMTYI | 410 | 8 | | | | | 2879 |
| HPV16 | L1 | TADVMTYIHSM | 410 | 11 | | | | | 2880 |
| HPV16 | L1 | TAKRKKRKL | 523 | 9 | | | | | 2881 |
| HPV16 | L1 | TILEDWNFGL | 423 | 10 | | | | | 2882 |
| HPV16 | L1 | TLEDTYRFV | 439 | 9 | | | | | 2883 |
| HPV16 | L1 | TLEDTYRFVT | 439 | 10 | | | | | 2884 |
| HPV16 | L1 | TLGKRKAT | 507 | 8 | | | | | 2885 |
| HPV16 | L1 | TLGKRKATPT | 507 | 10 | | | | | 2886 |
| HPV16 | L1 | TLGKRKATPTT | 507 | 11 | | | | | 2887 |
| HPV16 | L1 | TLQANKSEV | 238 | 9 | | | | | 2888 |
| HPV16 | L1 | TLQANKSEVPL | 238 | 11 | | | | | 2889 |
| HPV16 | L1 | TLTADVMT | 408 | 8 | | | | | 2890 |
| HPV16 | L1 | TLTADVMTYI | 408 | 10 | | | | | 2891 |
| HPV16 | L1 | TQRLVWACV | 121 | 9 | | | | | 2892 |
| HPV16 | L1 | TQRLVWACVGV | 121 | 11 | | | | | 2893 |
| HPV16 | L1 | TTAKRKKRKL | 522 | 10 | | | | | 2894 |
| HPV16 | L1 | TTLQANKSEV | 237 | 10 | | | | | 2895 |
| HPV16 | L1 | TTRSTNMSL | 362 | 9 | | | | | 2896 |
| HPV16 | L1 | TTRSTNMSLCA | 362 | 11 | | | | | 2897 |
| HPV16 | L1 | TTSSTSTT | 516 | 8 | | | | | 2898 |
| HPV16 | L1 | TTSSTSTTA | 516 | 9 | | | | | 2899 |
| HPV16 | L1 | TVIQDGDM | 219 | 8 | | | | | 2900 |
| HPV16 | L1 | TVIQDGDMV | 219 | 9 | | | | | 2901 |
| HPV16 | L1 | TVIQDGDMVDT | 219 | 11 | | | | | 2902 |
| HPV16 | L1 | TVVDTTRST | 358 | 9 | | | | | 2903 |
| HPV16 | L1 | TVVDTTRSTNM | 358 | 11 | | | | | 2904 |
| HPV16 | L1 | TVYLPPVPV | 36 | 9 | | | | | 2905 |
| HPV16 | L1 | VARTNIYYHA | 54 | 10 | | | | | 2906 |
| HPV16 | L1 | VAVNPGDCPPL | 204 | 11 | | | | | 2907 |
| HPV16 | L1 | VIQDGDMV | 220 | 8 | | | | | 2908 |
| HPV16 | L1 | VIQDGDMVDT | 220 | 10 | | | | | 2909 |
| HPV16 | L1 | VITCYENDV | 10 | 9 | | | | | 2910 |
| HPV16 | L1 | VITCYENDVNV | 10 | 11 | | | | | 2911 |
| HPV16 | L1 | VMTYIHSM | 413 | 8 | | | | | 2912 |
| HPV16 | L1 | VMTYIHSMNST | 413 | 11 | | | | | 2913 |
| HPV16 | L1 | VTFIYILV | 3 | 8 | | | | | 2914 |
| HPV16 | L1 | VTFIYILVI | 3 | 9 | | | | | 2915 |
| HPV16 | L1 | VTFIYILVIT | 3 | 10 | | | | | 2916 |
| HPV16 | L1 | VTVVDTTRST | 357 | 10 | | | | | 2917 |
| HPV16 | L1 | VVDTTRST | 359 | 8 | | | | | 2918 |
| HPV16 | L1 | VVDTTRSTNM | 359 | 10 | | | | | 2919 |
| HPV16 | L1 | VVSTDEYV | 47 | 8 | | | | | 2920 |
| HPV16 | L1 | VVSTDEYVA | 47 | 9 | | | | | 2921 |
| HPV16 | L1 | VVSTDEYVART | 47 | 11 | | | | | 2922 |
| HPV16 | L1 | WACVGVEV | 126 | 8 | | | | | 2923 |
| HPV16 | L1 | WLPSEATV | 30 | 8 | | | | | 2924 |
| HPV16 | L1 | WLPSEATVYL | 30 | 10 | | | | | 2925 |
| HPV16 | L1 | YIHSMNST | 416 | 8 | | | | | 2926 |
| HPV16 | L1 | YIHSMNSTI | 416 | 9 | | | | | 2927 |
| HPV16 | L1 | YIHSMNSTIL | 416 | 10 | | | | | 2928 |
| HPV16 | L1 | YIKGSGST | 302 | 8 | | | | | 2929 |
| HPV16 | L1 | YIKGSGSTA | 302 | 9 | | | | | 2930 |
| HPV16 | L1 | YIKGSGSTANL | 302 | 11 | | | | | 2931 |
| HPV16 | L1 | YLPPVPVSKV | 38 | 10 | | | | | 2932 |
| HPV16 | L1 | YLPPVPVSKVV | 38 | 11 | | | | | 2933 |
| HPV16 | L1 | YLRHGEEYDL | 389 | 10 | | | | | 2934 |
| HPV16 | L1 | YLRREQMFV | 275 | 9 | | | | | 2935 |
| HPV16 | L1 | YTFWEVNL | 470 | 8 | | | | | 2936 |
| HPV16 | L1 | YVARTNIYYHA | 53 | 11 | | | | | 2937 |
| HPV16 | L2 | AALPTSINNGL | 355 | 11 | | | | | 2938 |
| HPV16 | L2 | AILDINNT | 144 | 8 | | | | | 2939 |
| HPV16 | L2 | AILDINNTV | 144 | 9 | | | | | 2940 |
| HPV16 | L2 | AILDINNTVT | 144 | 10 | | | | | 2941 |
| HPV16 | L2 | AILDINNTVTT | 144 | 11 | | | | | 2942 |
| HPV16 | L2 | ALHRPALT | 288 | 8 | | | | | 2943 |
| HPV16 | L2 | ALPTSINNGL | 356 | 10 | | | | | 2944 |
| HPV16 | L2 | ALTSRRTGI | 293 | 9 | | | | | 2945 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L2 | ATDTLAPV | 82 | 8 | | | | | 2946 |
| HPV16 | L2 | ATQLYKTCKQA | 15 | 11 | | | | | 2947 |
| HPV16 | L2 | DAGAPTSV | 116 | 8 | | | | | 2948 |
| HPV16 | L2 | DAGAPTSVPSI | 116 | 11 | | | | | 2949 |
| HPV16 | L2 | DIIPKVEGKT | 31 | 10 | | | | | 2950 |
| HPV16 | L2 | DIIPKVEGKTI | 31 | 11 | | | | | 2951 |
| HPV16 | L2 | DINNTVTT | 147 | 8 | | | | | 2952 |
| HPV16 | L2 | DINNTVTTV | 147 | 9 | | | | | 2953 |
| HPV16 | L2 | DINNTVTTVT | 147 | 10 | | | | | 2954 |
| HPV16 | L2 | DINNTVTTVTT | 147 | 11 | | | | | 2955 |
| HPV16 | L2 | DIPINITDQA | 415 | 10 | | | | | 2956 |
| HPV16 | L2 | DIVALHRPA | 285 | 9 | | | | | 2957 |
| HPV16 | L2 | DIVALHRPAL | 285 | 10 | | | | | 2958 |
| HPV16 | L2 | DIVALHRPALT | 285 | 11 | | | | | 2959 |
| HPV16 | L2 | DIYADDFI | 367 | 8 | | | | | 2960 |
| HPV16 | L2 | DIYADDFIT | 367 | 9 | | | | | 2961 |
| HPV16 | L2 | DIYADDFITDT | 367 | 11 | | | | | 2962 |
| HPV16 | L2 | DQAPSLIPI | 422 | 9 | | | | | 2963 |
| HPV16 | L2 | DQAPSLIPIV | 422 | 10 | | | | | 2964 |
| HPV16 | L2 | DQILQYGSM | 43 | 9 | | | | | 2965 |
| HPV16 | L2 | DQILQYGSMGV | 43 | 11 | | | | | 2966 |
| HPV16 | L2 | DTFIVSTNPNT | 199 | 11 | | | | | 2967 |
| HPV16 | L2 | DTLAPVRPPL | 84 | 10 | | | | | 2968 |
| HPV16 | L2 | DTLAPVRPPLT | 84 | 11 | | | | | 2969 |
| HPV16 | L2 | DTSTTPVPSV | 376 | 10 | | | | | 2970 |
| HPV16 | L2 | DTTPAILDI | 140 | 9 | | | | | 2971 |
| HPV16 | L2 | DVSGFSIT | 129 | 8 | | | | | 2972 |
| HPV16 | L2 | DVSGFSITT | 129 | 9 | | | | | 2973 |
| HPV16 | L2 | DVSGFSITTST | 129 | 11 | | | | | 2974 |
| HPV16 | L2 | EIELQTIT | 338 | 8 | | | | | 2975 |
| HPV16 | L2 | EIELQTITPST | 338 | 11 | | | | | 2976 |
| HPV16 | L2 | EIPMDTFI | 195 | 8 | | | | | 2977 |
| HPV16 | L2 | EIPMDTFIV | 195 | 9 | | | | | 2978 |
| HPV16 | L2 | EIPMDTFIVST | 195 | 11 | | | | | 2979 |
| HPV16 | L2 | ELQTITPST | 340 | 9 | | | | | 2980 |
| HPV16 | L2 | ELQTITPSTYT | 340 | 11 | | | | | 2981 |
| HPV16 | L2 | ETGGHFTL | 176 | 8 | | | | | 2982 |
| HPV16 | L2 | ETSFIDAGA | 111 | 9 | | | | | 2983 |
| HPV16 | L2 | ETSFIDAGAPT | 111 | 11 | | | | | 2984 |
| HPV16 | L2 | FIDAGAPT | 114 | 8 | | | | | 2985 |
| HPV16 | L2 | FIDAGAPTSV | 114 | 10 | | | | | 2986 |
| HPV16 | L2 | FITDTSTT | 373 | 8 | | | | | 2987 |
| HPV16 | L2 | FITDTSTTPV | 373 | 10 | | | | | 2988 |
| HPV16 | L2 | FITTPTKL | 242 | 8 | | | | | 2989 |
| HPV16 | L2 | FITTPTKLI | 242 | 9 | | | | | 2990 |
| HPV16 | L2 | FITTPTKLIT | 242 | 10 | | | | | 2991 |
| HPV16 | L2 | FIVSTNPNT | 201 | 9 | | | | | 2992 |
| HPV16 | L2 | FIVSTNPNTV | 201 | 10 | | | | | 2993 |
| HPV16 | L2 | FIVSTNPNTVT | 201 | 11 | | | | | 2994 |
| HPV16 | L2 | FLDIVALHRPA | 283 | 11 | | | | | 2995 |
| HPV16 | L2 | FTDPSVLQPPT | 163 | 11 | | | | | 2996 |
| HPV16 | L2 | FTLSSSTI | 181 | 8 | | | | | 2997 |
| HPV16 | L2 | FTLSSSTIST | 181 | 10 | | | | | 2998 |
| HPV16 | L2 | GAPTSVPSI | 118 | 9 | | | | | 2999 |
| HPV16 | L2 | GAYNIPLV | 404 | 8 | | | | | 3000 |
| HPV16 | L2 | GIDVDNTL | 259 | 8 | | | | | 3001 |
| HPV16 | L2 | GIGTGSGT | 59 | 8 | | | | | 3002 |
| HPV16 | L2 | GLGIGTGSGT | 57 | 10 | | | | | 3003 |
| HPV16 | L2 | GLYDIYADDFI | 364 | 11 | | | | | 3004 |
| HPV16 | L2 | GLYSRTTQQV | 226 | 10 | | | | | 3005 |
| HPV16 | L2 | GTCPPDII | 26 | 8 | | | | | 3006 |
| HPV16 | L2 | GTCPPDIIPKV | 26 | 11 | | | | | 3007 |
| HPV16 | L2 | GTGGRTGYI | 65 | 9 | | | | | 3008 |
| HPV16 | L2 | GTGGRTGYIPL | 65 | 11 | | | | | 3009 |
| HPV16 | L2 | GTGSGTGGRT | 61 | 10 | | | | | 3010 |
| HPV16 | L2 | GTRPPTAT | 76 | 8 | | | | | 3011 |
| HPV16 | L2 | GTRPPTATDT | 76 | 10 | | | | | 3012 |
| HPV16 | L2 | GTRPPTATDTL | 76 | 11 | | | | | 3013 |
| HPV16 | L2 | GVFFGGLGI | 52 | 9 | | | | | 3014 |
| HPV16 | L2 | GVFFGGLGIGT | 52 | 11 | | | | | 3015 |
| HPV16 | L2 | HAALPTSI | 354 | 8 | | | | | 3016 |
| HPV16 | L2 | IADAGDFYL | 440 | 9 | | | | | 3017 |
| HPV16 | L2 | IADQILQYGSM | 41 | 11 | | | | | 3018 |
| HPV16 | L2 | IAPDPDFL | 277 | 8 | | | | | 3019 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L2 | IAPDPDFLDI | 277 | 10 | | | | | 3020 |
| HPV16 | L2 | IAPDPDFLDIV | 277 | 11 | | | | | 3021 |
| HPV16 | L2 | IIADAGDFYL | 439 | 10 | | | | | 3022 |
| HPV16 | L2 | IIPKVEGKT | 32 | 9 | | | | | 3023 |
| HPV16 | L2 | IIPKVEGKTI | 32 | 10 | | | | | 3024 |
| HPV16 | L2 | IIPKVEGKTIA | 32 | 11 | | | | | 3025 |
| HPV16 | L2 | ILDINNTV | 145 | 8 | | | | | 3026 |
| HPV16 | L2 | ILDINNTVT | 145 | 9 | | | | | 3027 |
| HPV16 | L2 | ILDINNTVTT | 145 | 10 | | | | | 3028 |
| HPV16 | L2 | ILDINNTVTTV | 145 | 11 | | | | | 3029 |
| HPV16 | L2 | ILQYGSMGV | 45 | 9 | | | | | 3030 |
| HPV16 | L2 | ITDQAPSL | 420 | 8 | | | | | 3031 |
| HPV16 | L2 | ITDQAPSLI | 420 | 9 | | | | | 3032 |
| HPV16 | L2 | ITDQAPSLIPI | 420 | 11 | | | | | 3033 |
| HPV16 | L2 | ITDTSTTPV | 374 | 9 | | | | | 3034 |
| HPV16 | L2 | ITPSTYTT | 344 | 8 | | | | | 3035 |
| HPV16 | L2 | ITPSTYTTT | 344 | 9 | | | | | 3036 |
| HPV16 | L2 | ITTPTKLI | 243 | 8 | | | | | 3037 |
| HPV16 | L2 | ITTPTKLIT | 243 | 9 | | | | | 3038 |
| HPV16 | L2 | ITTSTDTT | 135 | 8 | | | | | 3039 |
| HPV16 | L2 | ITTSTDTTPA | 135 | 10 | | | | | 3040 |
| HPV16 | L2 | ITTSTDTTPAI | 135 | 11 | | | | | 3041 |
| HPV16 | L2 | ITYDNPAYEGI | 250 | 11 | | | | | 3042 |
| HPV16 | L2 | IVALHRPA | 286 | 8 | | | | | 3043 |
| HPV16 | L2 | IVALHRPAL | 286 | 9 | | | | | 3044 |
| HPV16 | L2 | IVALHRPALT | 286 | 10 | | | | | 3045 |
| HPV16 | L2 | IVPGSPQYT | 430 | 9 | | | | | 3046 |
| HPV16 | L2 | IVPGSPQYTI | 430 | 10 | | | | | 3047 |
| HPV16 | L2 | IVPGSPQYTII | 430 | 11 | | | | | 3048 |
| HPV16 | L2 | IVSLVEET | 105 | 8 | | | | | 3049 |
| HPV16 | L2 | IVSLVEETSFI | 105 | 11 | | | | | 3050 |
| HPV16 | L2 | IVSTNPNT | 202 | 8 | | | | | 3051 |
| HPV16 | L2 | IVSTNPNTV | 202 | 9 | | | | | 3052 |
| HPV16 | L2 | IVSTNPNTVT | 202 | 10 | | | | | 3053 |
| HPV16 | L2 | KLITYDNPA | 248 | 9 | | | | | 3054 |
| HPV16 | L2 | KQAGTCPPDI | 23 | 10 | | | | | 3055 |
| HPV16 | L2 | KQAGTCPPDII | 23 | 11 | | | | | 3056 |
| HPV16 | L2 | KTCKQAGT | 20 | 8 | | | | | 3057 |
| HPV16 | L2 | KTIADQIL | 39 | 8 | | | | | 3058 |
| HPV16 | L2 | KVEGKTIA | 35 | 8 | | | | | 3059 |
| HPV16 | L2 | KVEGKTIADQI | 35 | 11 | | | | | 3060 |
| HPV16 | L2 | KVHYYYDFST | 323 | 10 | | | | | 3061 |
| HPV16 | L2 | KVHYYYDFSTI | 323 | 11 | | | | | 3062 |
| HPV16 | L2 | KVVDPAFI | 236 | 8 | | | | | 3063 |
| HPV16 | L2 | KVVDPAFIT | 236 | 9 | | | | | 3064 |
| HPV16 | L2 | KVVDPAFITT | 236 | 10 | | | | | 3065 |
| HPV16 | L2 | LAPVRPPL | 86 | 8 | | | | | 3066 |
| HPV16 | L2 | LAPVRPPLT | 86 | 9 | | | | | 3067 |
| HPV16 | L2 | LAPVRPPLTV | 86 | 10 | | | | | 3068 |
| HPV16 | L2 | LITYDNPA | 249 | 8 | | | | | 3069 |
| HPV16 | L2 | LQPPTPAET | 169 | 9 | | | | | 3070 |
| HPV16 | L2 | LQTITPST | 341 | 8 | | | | | 3071 |
| HPV16 | L2 | LQTITPSTYT | 341 | 10 | | | | | 3072 |
| HPV16 | L2 | LQTITPSTYTT | 341 | 11 | | | | | 3073 |
| HPV16 | L2 | LQYGSMGV | 46 | 8 | | | | | 3074 |
| HPV16 | L2 | LTSRRTGI | 294 | 8 | | | | | 3075 |
| HPV16 | L2 | LVEETSFI | 108 | 8 | | | | | 3076 |
| HPV16 | L2 | LVEETSFIDA | 108 | 10 | | | | | 3077 |
| HPV16 | L2 | LVSGPDIPI | 410 | 9 | | | | | 3078 |
| HPV16 | L2 | LVSGPDIPINI | 410 | 11 | | | | | 3079 |
| HPV16 | L2 | MLRKRRKRL | 454 | 9 | | | | | 3080 |
| HPV16 | L2 | NIAPDPDFL | 276 | 9 | | | | | 3081 |
| HPV16 | L2 | NIAPDPDFLDI | 276 | 11 | | | | | 3082 |
| HPV16 | L2 | NIPLVSGPDI | 407 | 10 | | | | | 3083 |
| HPV16 | L2 | NITDQAPSL | 419 | 9 | | | | | 3084 |
| HPV16 | L2 | NITDQAPSLI | 419 | 10 | | | | | 3085 |
| HPV16 | L2 | NTTIPFGGA | 397 | 9 | | | | | 3086 |
| HPV16 | L2 | NTVTSSTPI | 208 | 9 | | | | | 3087 |
| HPV16 | L2 | NTVTTVTT | 150 | 8 | | | | | 3088 |
| HPV16 | L2 | PAETGGHFT | 174 | 9 | | | | | 3089 |
| HPV16 | L2 | PAETGGHFTL | 174 | 10 | | | | | 3090 |
| HPV16 | L2 | PAFITTPT | 240 | 8 | | | | | 3091 |
| HPV16 | L2 | PAFITTPTKL | 240 | 10 | | | | | 3092 |
| HPV16 | L2 | PAFITTPTKLI | 240 | 11 | | | | | 3093 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L2 | PAILDINNT | 143 | 9 | | | | | 3094 |
| HPV16 | L2 | PAILDINNTV | 143 | 10 | | | | | 3095 |
| HPV16 | L2 | PAILDINNTVT | 143 | 11 | | | | | 3096 |
| HPV16 | L2 | PALTSRRT | 292 | 8 | | | | | 3097 |
| HPV16 | L2 | PALTSRRTGI | 292 | 10 | | | | | 3098 |
| HPV16 | L2 | PANTTIPFGGA | 395 | 11 | | | | | 3099 |
| HPV16 | L2 | PAYEGIDV | 255 | 8 | | | | | 3100 |
| HPV16 | L2 | PAYEGIDVDNT | 255 | 11 | | | | | 3101 |
| HPV16 | L2 | PINITDQA | 417 | 8 | | | | | 3102 |
| HPV16 | L2 | PINITDQAPSL | 417 | 11 | | | | | 3103 |
| HPV16 | L2 | PIPGSRPV | 215 | 8 | | | | | 3104 |
| HPV16 | L2 | PIPGSRPVA | 215 | 9 | | | | | 3105 |
| HPV16 | L2 | PIPGSRPVARL | 215 | 11 | | | | | 3106 |
| HPV16 | L2 | PIVPGSPQYT | 429 | 10 | | | | | 3107 |
| HPV16 | L2 | PIVPGSPQYTI | 429 | 11 | | | | | 3108 |
| HPV16 | L2 | PLGTRPPT | 74 | 8 | | | | | 3109 |
| HPV16 | L2 | PLGTRPPTA | 74 | 9 | | | | | 3110 |
| HPV16 | L2 | PLGTRPPTAT | 74 | 10 | | | | | 3111 |
| HPV16 | L2 | PLVSGPDI | 409 | 8 | | | | | 3112 |
| HPV16 | L2 | PLVSGPDIPI | 409 | 10 | | | | | 3113 |
| HPV16 | L2 | PMDTFIVST | 197 | 9 | | | | | 3114 |
| HPV16 | L2 | PQYTIIADA | 435 | 9 | | | | | 3115 |
| HPV16 | L2 | PTATDTLA | 80 | 8 | | | | | 3116 |
| HPV16 | L2 | PTATDTLAPV | 80 | 10 | | | | | 3117 |
| HPV16 | L2 | PTFTDPSV | 161 | 8 | | | | | 3118 |
| HPV16 | L2 | PTFTDPSVL | 161 | 9 | | | | | 3119 |
| HPV16 | L2 | PTKLITYDNPA | 246 | 11 | | | | | 3120 |
| HPV16 | L2 | PTPAETGGHFT | 172 | 11 | | | | | 3121 |
| HPV16 | L2 | PTSINNGL | 358 | 8 | | | | | 3122 |
| HPV16 | L2 | PTSINNGLYDI | 358 | 11 | | | | | 3123 |
| HPV16 | L2 | PTSVPSIPPDV | 120 | 11 | | | | | 3124 |
| HPV16 | L2 | PVARLGLYSRT | 221 | 11 | | | | | 3125 |
| HPV16 | L2 | PVGPSDPSI | 97 | 9 | | | | | 3126 |
| HPV16 | L2 | PVGPSDPSIV | 97 | 10 | | | | | 3127 |
| HPV16 | L2 | PVPSVPST | 381 | 8 | | | | | 3128 |
| HPV16 | L2 | PVPSVPSTSL | 381 | 10 | | | | | 3129 |
| HPV16 | L2 | PVRPPLTV | 88 | 8 | | | | | 3130 |
| HPV16 | L2 | PVRPPLTVDPV | 88 | 11 | | | | | 3131 |
| HPV16 | L2 | QAGTCPPDI | 24 | 9 | | | | | 3132 |
| HPV16 | L2 | QAGTCPPDII | 24 | 10 | | | | | 3133 |
| HPV16 | L2 | QAPSLIPI | 423 | 8 | | | | | 3134 |
| HPV16 | L2 | QAPSLIPIV | 423 | 9 | | | | | 3135 |
| HPV16 | L2 | QILQYGSM | 44 | 8 | | | | | 3136 |
| HPV16 | L2 | QILQYGSMGV | 44 | 10 | | | | | 3137 |
| HPV16 | L2 | QLYKTCKQA | 17 | 9 | | | | | 3138 |
| HPV16 | L2 | QLYKTCKQAGT | 17 | 11 | | | | | 3139 |
| HPV16 | L2 | QQVKVVDPA | 233 | 9 | | | | | 3140 |
| HPV16 | L2 | QQVKVVDPAFI | 233 | 11 | | | | | 3141 |
| HPV16 | L2 | QTITPSTYT | 342 | 9 | | | | | 3142 |
| HPV16 | L2 | QTITPSTYTT | 342 | 10 | | | | | 3143 |
| HPV16 | L2 | QTITPSTYTTT | 342 | 11 | | | | | 3144 |
| HPV16 | L2 | QTLRTRSGKSI | 310 | 11 | | | | | 3145 |
| HPV16 | L2 | QVKVVDPA | 234 | 8 | | | | | 3146 |
| HPV16 | L2 | QVKVVDPAFI | 234 | 10 | | | | | 3147 |
| HPV16 | L2 | QVKVVDPAFIT | 234 | 11 | | | | | 3148 |
| HPV16 | L2 | RASATQLYKT | 12 | 10 | | | | | 3149 |
| HPV16 | L2 | RIGNKQTL | 305 | 8 | | | | | 3150 |
| HPV16 | L2 | RIGNKQTLRT | 305 | 10 | | | | | 3151 |
| HPV16 | L2 | RLGLYSRT | 224 | 8 | | | | | 3152 |
| HPV16 | L2 | RLGLYSRTT | 224 | 9 | | | | | 3153 |
| HPV16 | L2 | RLPYFFSDV | 461 | 9 | | | | | 3154 |
| HPV16 | L2 | RLPYFFSDVSL | 461 | 11 | | | | | 3155 |
| HPV16 | L2 | RTGIRYSRI | 298 | 9 | | | | | 3156 |
| HPV16 | L2 | RTGYIPLGT | 69 | 9 | | | | | 3157 |
| HPV16 | L2 | RTKRASAT | 9 | 8 | | | | | 3158 |
| HPV16 | L2 | RTKRASATQL | 9 | 10 | | | | | 3159 |
| HPV16 | L2 | RTRSGKSI | 313 | 8 | | | | | 3160 |
| HPV16 | L2 | RTRSGKSIGA | 313 | 10 | | | | | 3161 |
| HPV16 | L2 | RTTQQVKV | 230 | 8 | | | | | 3162 |
| HPV16 | L2 | RTTQQVKVV | 230 | 9 | | | | | 3163 |
| HPV16 | L2 | SAEEIELQT | 335 | 9 | | | | | 3164 |
| HPV16 | L2 | SAEEIELQTI | 335 | 10 | | | | | 3165 |
| HPV16 | L2 | SAEEIELQTIT | 335 | 11 | | | | | 3166 |
| HPV16 | L2 | SAKRTKRA | 6 | 8 | | | | | 3167 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L2 | SAKRTKRASA | 6 | 10 | | | | | 3168 |
| HPV16 | L2 | SAKRTKRASAT | 6 | 11 | | | | | 3169 |
| HPV16 | L2 | SATQLYKT | 14 | 8 | | | | | 3170 |
| HPV16 | L2 | SINIAPDPDFL | 274 | 11 | | | | | 3171 |
| HPV16 | L2 | SINNGLYDI | 360 | 9 | | | | | 3172 |
| HPV16 | L2 | SINNGLYDIYA | 360 | 11 | | | | | 3173 |
| HPV16 | L2 | SIPPDVSGFSI | 125 | 11 | | | | | 3174 |
| HPV16 | L2 | SITTSTDT | 134 | 8 | | | | | 3175 |
| HPV16 | L2 | SITTSTDTT | 134 | 9 | | | | | 3176 |
| HPV16 | L2 | SITTSTDTTPA | 134 | 11 | | | | | 3177 |
| HPV16 | L2 | SIVSLVEET | 104 | 9 | | | | | 3178 |
| HPV16 | L2 | SLSGYIPA | 389 | 8 | | | | | 3179 |
| HPV16 | L2 | SLSGYIPANT | 389 | 10 | | | | | 3180 |
| HPV16 | L2 | SLSGYIPANTT | 389 | 11 | | | | | 3181 |
| HPV16 | L2 | SLVEETSFI | 107 | 9 | | | | | 3182 |
| HPV16 | L2 | SLVEETSFIDA | 107 | 11 | | | | | 3183 |
| HPV16 | L2 | SMGVFFGGL | 50 | 9 | | | | | 3184 |
| HPV16 | L2 | SMGVFFGGLGI | 50 | 11 | | | | | 3185 |
| HPV16 | L2 | STDTTPAI | 138 | 8 | | | | | 3186 |
| HPV16 | L2 | STDTTPAIL | 138 | 9 | | | | | 3187 |
| HPV16 | L2 | STDTTPAILDI | 138 | 11 | | | | | 3188 |
| HPV16 | L2 | STHNYEEI | 189 | 8 | | | | | 3189 |
| HPV16 | L2 | STHNYEEIPM | 189 | 10 | | | | | 3190 |
| HPV16 | L2 | STIDSAEEI | 331 | 9 | | | | | 3191 |
| HPV16 | L2 | STIDSAEEIEL | 331 | 11 | | | | | 3192 |
| HPV16 | L2 | STISTHNYEEI | 186 | 11 | | | | | 3193 |
| HPV16 | L2 | STNPNTVT | 204 | 8 | | | | | 3194 |
| HPV16 | L2 | STNPNTVTSST | 204 | 11 | | | | | 3195 |
| HPV16 | L2 | STPIPGSRPV | 213 | 10 | | | | | 3196 |
| HPV16 | L2 | STPIPGSRPVA | 213 | 11 | | | | | 3197 |
| HPV16 | L2 | STSLSGYI | 387 | 8 | | | | | 3198 |
| HPV16 | L2 | STSLSGYIPA | 387 | 10 | | | | | 3199 |
| HPV16 | L2 | STTPVPSV | 378 | 8 | | | | | 3200 |
| HPV16 | L2 | STTPVPSVPST | 378 | 11 | | | | | 3201 |
| HPV16 | L2 | STYTTTSHA | 347 | 9 | | | | | 3202 |
| HPV16 | L2 | STYTTTSHAA | 347 | 10 | | | | | 3203 |
| HPV16 | L2 | STYTTTSHAAL | 347 | 11 | | | | | 3204 |
| HPV16 | L2 | SVLQPPTPA | 167 | 9 | | | | | 3205 |
| HPV16 | L2 | SVLQPPTPAET | 167 | 11 | | | | | 3206 |
| HPV16 | L2 | SVPSIPPDV | 122 | 9 | | | | | 3207 |
| HPV16 | L2 | SVPSTSLSGYI | 384 | 11 | | | | | 3208 |
| HPV16 | L2 | TATDTLAPV | 81 | 9 | | | | | 3209 |
| HPV16 | L2 | TIDSAEEI | 332 | 8 | | | | | 3210 |
| HPV16 | L2 | TIDSAEEIEL | 332 | 10 | | | | | 3211 |
| HPV16 | L2 | TIIADAGDFYL | 438 | 11 | | | | | 3212 |
| HPV16 | L2 | TIPFGGAYNI | 399 | 10 | | | | | 3213 |
| HPV16 | L2 | TISTHNYEEI | 187 | 10 | | | | | 3214 |
| HPV16 | L2 | TITPSTYT | 343 | 8 | | | | | 3215 |
| HPV16 | L2 | TITPSTYTT | 343 | 9 | | | | | 3216 |
| HPV16 | L2 | TITPSTYTTT | 343 | 10 | | | | | 3217 |
| HPV16 | L2 | TLAPVRPPL | 85 | 9 | | | | | 3218 |
| HPV16 | L2 | TLAPVRPPLT | 85 | 10 | | | | | 3219 |
| HPV16 | L2 | TLAPVRPPLTV | 85 | 11 | | | | | 3220 |
| HPV16 | L2 | TLRTRSGKSI | 311 | 10 | | | | | 3221 |
| HPV16 | L2 | TLSSSTIST | 182 | 9 | | | | | 3222 |
| HPV16 | L2 | TLYFSSNDNSI | 265 | 11 | | | | | 3223 |
| HPV16 | L2 | TQLYKTCKQA | 16 | 10 | | | | | 3224 |
| HPV16 | L2 | TQQVKVVDPA | 232 | 10 | | | | | 3225 |
| HPV16 | L2 | TTHNNPTFT | 156 | 9 | | | | | 3226 |
| HPV16 | L2 | TTIPFGGA | 398 | 8 | | | | | 3227 |
| HPV16 | L2 | TTIPFGGAYNI | 398 | 11 | | | | | 3228 |
| HPV16 | L2 | TTPAILDI | 141 | 8 | | | | | 3229 |
| HPV16 | L2 | TTPAILDINNT | 141 | 11 | | | | | 3230 |
| HPV16 | L2 | TTPTKLIT | 244 | 8 | | | | | 3231 |
| HPV16 | L2 | TTPVPSVPST | 379 | 10 | | | | | 3232 |
| HPV16 | L2 | TTQQVKVV | 231 | 8 | | | | | 3233 |
| HPV16 | L2 | TTQQVKVVDPA | 231 | 11 | | | | | 3234 |
| HPV16 | L2 | TTSHAALPT | 351 | 9 | | | | | 3235 |
| HPV16 | L2 | TTSHAALPTSI | 351 | 11 | | | | | 3236 |
| HPV16 | L2 | TTSTDTTPA | 136 | 9 | | | | | 3237 |
| HPV16 | L2 | TTSTDTTPAI | 136 | 10 | | | | | 3238 |
| HPV16 | L2 | TTSTDTTPAIL | 136 | 11 | | | | | 3239 |
| HPV16 | L2 | TTTSHAAL | 350 | 8 | | | | | 3240 |
| HPV16 | L2 | TTTSHAALPT | 350 | 10 | | | | | 3241 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV16 | L2 | TTVTTHNNPT | 153 | 10 | | | | | 3242 |
| HPV16 | L2 | TVTSSTPI | 209 | 8 | | | | | 3243 |
| HPV16 | L2 | TVTTHNNPT | 154 | 9 | | | | | 3244 |
| HPV16 | L2 | TVTTHNNPTFT | 154 | 11 | | | | | 3245 |
| HPV16 | L2 | VALHRPAL | 287 | 8 | | | | | 3246 |
| HPV16 | L2 | VALHRPALT | 287 | 9 | | | | | 3247 |
| HPV16 | L2 | VARLGLYSRT | 222 | 10 | | | | | 3248 |
| HPV16 | L2 | VARLGLYSRTT | 222 | 11 | | | | | 3249 |
| HPV16 | L2 | VLQPPTPA | 168 | 8 | | | | | 3250 |
| HPV16 | L2 | VLQPPTPAET | 168 | 10 | | | | | 3251 |
| HPV16 | L2 | VTTHNNPT | 155 | 8 | | | | | 3252 |
| HPV16 | L2 | VTTHNNPTFT | 155 | 10 | | | | | 3253 |
| HPV16 | L2 | VTTVTTHNNPT | 152 | 11 | | | | | 3254 |
| HPV16 | L2 | VVDPAFIT | 237 | 8 | | | | | 3255 |
| HPV16 | L2 | VVDPAFITT | 237 | 9 | | | | | 3256 |
| HPV16 | L2 | VVDPAFITTPT | 237 | 11 | | | | | 3257 |
| HPV16 | L2 | YADDFITDT | 369 | 9 | | | | | 3258 |
| HPV16 | L2 | YADDFITDTST | 369 | 11 | | | | | 3259 |
| HPV16 | L2 | YIPANTTI | 393 | 8 | | | | | 3260 |
| HPV16 | L2 | YIPLGTRPPT | 72 | 10 | | | | | 3261 |
| HPV16 | L2 | YIPLGTRPPTA | 72 | 11 | | | | | 3262 |
| HPV16 | L2 | YLHPSYYM | 447 | 8 | | | | | 3263 |
| HPV16 | L2 | YLHPSYYML | 447 | 9 | | | | | 3264 |
| HPV16 | L2 | YMLRKRRKRL | 453 | 10 | | | | | 3265 |
| HPV16 | L2 | YTTTSHAA | 349 | 8 | | | | | 3266 |
| HPV16 | L2 | YTTTSHAAL | 349 | 9 | | | | | 3267 |
| HPV16 | L2 | YTTTSHAALPT | 349 | 11 | | | | | 3268 |
| HPV18 | E1 | AAAFLKSNCQA | 396 | 11 | | | | | 3269 |
| HPV18 | E1 | AAFLKSNCQA | 397 | 10 | | | | | 3270 |
| HPV18 | E1 | AALYWYRT | 324 | 8 | | | | | 3271 |
| HPV18 | E1 | AALYWYRTGI | 324 | 10 | | | | | 3272 |
| HPV18 | E1 | AIFGVNPT | 246 | 8 | | | | | 3273 |
| HPV18 | E1 | AIFGVNPTI | 246 | 9 | 0.0021 | | | | 3274 |
| HPV18 | E1 | AIFGVNPTIA | 246 | 10 | | | | | 3275 |
| HPV18 | E1 | AIVDKKTGDV | 22 | 10 | | | | | 3276 |
| HPV18 | E1 | AIVDKKTGDVI | 22 | 11 | | | | | 3277 |
| HPV18 | E1 | ALDGNPISI | 546 | 9 | 0.021 | | | | 3278 |
| HPV18 | E1 | ALFHAQEV | 68 | 8 | | | | | 3279 |
| HPV18 | E1 | ALKSFLKGT | 466 | 9 | | | | | 3280 |
| HPV18 | E1 | ALLADSNSNA | 387 | 10 | 0.0004 | | | | 3281 |
| HPV18 | E1 | ALLADSNSNAA | 387 | 11 | | | | | 3282 |
| HPV18 | E1 | ALYWYRTGI | 325 | 9 | 0.0032 | | | | 3283 |
| HPV18 | E1 | AMLAVFKDT | 213 | 9 | | | | | 3284 |
| HPV18 | E1 | AMLDDATT | 526 | 8 | | | | | 3285 |
| HPV18 | E1 | AMLDDATTT | 526 | 9 | | | | | 3286 |
| HPV18 | E1 | AQALFHAQEV | 66 | 10 | | | | | 3287 |
| HPV18 | E1 | AQEVHNDA | 72 | 8 | | | | | 3288 |
| HPV18 | E1 | AQEVHNDAQV | 72 | 10 | | | | | 3289 |
| HPV18 | E1 | AQEVHNDAQVL | 72 | 11 | | | | | 3290 |
| HPV18 | E1 | AQKRQMNM | 422 | 8 | | | | | 3291 |
| HPV18 | E1 | AQLKDLLKV | 199 | 9 | | | | | 3292 |
| HPV18 | E1 | ATDTGSDM | 40 | 8 | | | | | 3293 |
| HPV18 | E1 | ATDTGSDMV | 40 | 9 | | | | | 3294 |
| HPV18 | E1 | ATMCKHYRRA | 413 | 10 | | | | | 3295 |
| HPV18 | E1 | ATQIQVTT | 144 | 8 | | | | | 3296 |
| HPV18 | E1 | ATTTCWTYFDT | 531 | 11 | | | | | 3297 |
| HPV18 | E1 | AVFKDTYGL | 216 | 9 | 0.014 | | | | 3298 |
| HPV18 | E1 | AVISFVNST | 504 | 9 | | | | | 3299 |
| HPV18 | E1 | CATMCKHYRRA | 412 | 11 | | | | | 3300 |
| HPV18 | E1 | CLDCKWGV | 273 | 8 | | | | | 3301 |
| HPV18 | E1 | CLDCKWGVL | 273 | 9 | | | | | 3302 |
| HPV18 | E1 | CLDCKWGVLI | 273 | 10 | 0.0002 | | | | 3303 |
| HPV18 | E1 | CLDCKWGVLIL | 273 | 11 | | | | | 3304 |
| HPV18 | E1 | CLVFCGPA | 479 | 8 | | | | | 3305 |
| HPV18 | E1 | CLVFCGPANT | 479 | 10 | | | | | 3306 |
| HPV18 | E1 | CMLIQPPKL | 311 | 9 | | | | | 3307 |
| HPV18 | E1 | CQAKYLKDCA | 404 | 10 | | | | | 3308 |
| HPV18 | E1 | CQAKYLKDCAT | 404 | 11 | | | | | 3309 |
| HPV18 | E1 | CTDWVTAI | 240 | 8 | | | | | 3310 |
| HPV18 | E1 | CTDWVTAIFGV | 240 | 11 | | | | | 3311 |
| HPV18 | E1 | CTIAQLKDL | 196 | 9 | | | | | 3312 |
| HPV18 | E1 | CTIAQLKDLL | 196 | 10 | | | | | 3313 |
| HPV18 | E1 | DADTEGNPFGT | 635 | 11 | | | | | 3314 |
| HPV18 | E1 | DAQVLHVL | 78 | 8 | | | | | 3315 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E1 | DATTTCWT | 530 | 8 | | | | | 3316 |
| HPV18 | E1 | DLHEEEEDA | 628 | 9 | | | | | 3317 |
| HPV18 | E1 | DLHEEEEDADT | 628 | 11 | | | | | 3318 |
| HPV18 | E1 | DLLKVNNKQGA | 203 | 11 | | | | | 3319 |
| HPV18 | E1 | DLSEMVQWA | 363 | 9 | 0.0003 | | | | 3320 |
| HPV18 | E1 | DLVRNFKSDKT | 228 | 11 | | | | | 3321 |
| HPV18 | E1 | DMAFEYAL | 381 | 8 | | | | | 3322 |
| HPV18 | E1 | DMAFEYALL | 381 | 9 | | | | | 3323 |
| HPV18 | E1 | DMAFEYALLA | 381 | 10 | | | | | 3324 |
| HPV18 | E1 | DMVDFIDT | 46 | 8 | | | | | 3325 |
| HPV18 | E1 | DMVDFIDTQGT | 46 | 11 | | | | | 3326 |
| HPV18 | E1 | DTEGNPFGT | 637 | 9 | | | | | 3327 |
| HPV18 | E1 | DTELSPRL | 106 | 8 | | | | | 3328 |
| HPV18 | E1 | DTELSPRLQEI | 106 | 11 | | | | | 3329 |
| HPV18 | E1 | DTGSDMVDFI | 42 | 10 | | | | | 3330 |
| HPV18 | E1 | DTKVAMLDDA | 522 | 10 | | | | | 3331 |
| HPV18 | E1 | DTKVAMLDDAT | 522 | 11 | | | | | 3332 |
| HPV18 | E1 | DTPEWIQRL | 342 | 9 | | | | | 3333 |
| HPV18 | E1 | DTPEWIQRLT | 342 | 10 | | | | | 3334 |
| HPV18 | E1 | DTPEWIQRLTI | 342 | 11 | | | | | 3335 |
| HPV18 | E1 | DTQGTFCEQA | 52 | 10 | | | | | 3336 |
| HPV18 | E1 | DTYGLSFT | 220 | 8 | | | | | 3337 |
| HPV18 | E1 | DTYGLSFTDL | 220 | 10 | | | | | 3338 |
| HPV18 | E1 | DTYGLSFTDLV | 220 | 11 | | | | | 3339 |
| HPV18 | E1 | DTYMRNAL | 540 | 8 | | | | | 3340 |
| HPV18 | E1 | DVISDDEDENA | 30 | 11 | | | | | 3341 |
| HPV18 | E1 | EAIDNGGT | 166 | 8 | | | | | 3342 |
| HPV18 | E1 | EATQIQVT | 143 | 8 | | | | | 3343 |
| HPV18 | E1 | EATQIQVTT | 143 | 9 | | | | | 3344 |
| HPV18 | E1 | EISLNSGQKKA | 115 | 11 | | | | | 3345 |
| HPV18 | E1 | ELETAQAL | 62 | 8 | | | | | 3346 |
| HPV18 | E1 | ELETAQALFHA | 62 | 11 | | | | | 3347 |
| HPV18 | E1 | ELSPRLQEI | 108 | 9 | 0.0004 | | | | 3348 |
| HPV18 | E1 | ELSPRLQEISL | 108 | 11 | | | | | 3349 |
| HPV18 | E1 | ELTDESDM | 375 | 8 | | | | | 3350 |
| HPV18 | E1 | ELTDESDMA | 375 | 9 | | | | | 3351 |
| HPV18 | E1 | EMVQWAFDNEL | 366 | 11 | | | | | 3352 |
| HPV18 | E1 | EQAELETA | 59 | 8 | | | | | 3353 |
| HPV18 | E1 | EQAELETAQA | 59 | 10 | | | | | 3354 |
| HPV18 | E1 | EQAELETAQAL | 59 | 11 | | | | | 3355 |
| HPV18 | E1 | ETAQALFHA | 64 | 9 | | | | | 3356 |
| HPV18 | E1 | ETCMLIQPPKL | 309 | 11 | | | | | 3357 |
| HPV18 | E1 | EVDTELSPRL | 104 | 10 | | | | | 3358 |
| HPV18 | E1 | EVEATQIQV | 141 | 9 | | | | | 3359 |
| HPV18 | E1 | EVEATQIQVT | 141 | 10 | | | | | 3360 |
| HPV18 | E1 | EVEATQIQVTT | 141 | 11 | | | | | 3361 |
| HPV18 | E1 | EVHNDAQV | 74 | 8 | | | | | 3362 |
| HPV18 | E1 | EVHNDAQVL | 74 | 9 | | | | | 3363 |
| HPV18 | E1 | EVHNDAQVLHV | 74 | 11 | | | | | 3364 |
| HPV18 | E1 | EVMGDTPEWI | 338 | 10 | | | | | 3365 |
| HPV18 | E1 | FAGGSTENSPL | 89 | 11 | | | | | 3366 |
| HPV18 | E1 | FIHFIQGA | 497 | 8 | | | | | 3367 |
| HPV18 | E1 | FIHFIQGAV | 497 | 9 | 0.013 | | | | 3368 |
| HPV18 | E1 | FIHFIQGAVI | 497 | 10 | 0.0057 | | | | 3369 |
| HPV18 | E1 | FILYAHIQCL | 265 | 10 | 0.032 | | | | 3370 |
| HPV18 | E1 | FIQGAVISFV | 500 | 10 | 0.046 | | | | 3371 |
| HPV18 | E1 | FITFLGAL | 460 | 8 | | | | | 3372 |
| HPV18 | E1 | FLGALKSFL | 463 | 9 | 0.045 | | | | 3373 |
| HPV18 | E1 | FLKGTPKKNCL | 470 | 11 | | | | | 3374 |
| HPV18 | E1 | FLKSNCQA | 399 | 8 | | | | | 3375 |
| HPV18 | E1 | FLKSNCQAKYL | 399 | 11 | | | | | 3376 |
| HPV18 | E1 | FLRYQQIEFI | 452 | 10 | 0.0025 | | | | 3377 |
| HPV18 | E1 | FLRYQQIEFIT | 452 | 11 | | | | | 3378 |
| HPV18 | E1 | FVNSTSHFWL | 508 | 10 | 0.062 | | | | 3379 |
| HPV18 | E1 | GALKSFLKGT | 465 | 10 | | | | | 3380 |
| HPV18 | E1 | GAMLAVFKDT | 212 | 10 | | | | | 3381 |
| HPV18 | E1 | GAVISFVNST | 503 | 10 | | | | | 3382 |
| HPV18 | E1 | GIDDSNFDL | 356 | 9 | | | | | 3383 |
| HPV18 | E1 | GISNISEV | 332 | 8 | | | | | 3384 |
| HPV18 | E1 | GISNISEVM | 332 | 9 | | | | | 3385 |
| HPV18 | E1 | GLSFTDLV | 223 | 8 | | | | | 3386 |
| HPV18 | E1 | GLSTLLHV | 300 | 8 | | | | | 3387 |
| HPV18 | E1 | GLSTLLHVPET | 300 | 11 | | | | | 3388 |
| HPV18 | E1 | GMSFIHFI | 494 | 8 | | | | | 3389 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E1 | GMSFIHFIQGA | 494 | 11 | | | | | 3390 |
| HPV18 | E1 | GQKKAKRRL | 121 | 9 | | | | | 3391 |
| HPV18 | E1 | GQKKAKRRLFT | 121 | 11 | | | | | 3392 |
| HPV18 | E1 | GTEGNNSSV | 172 | 9 | | | | | 3393 |
| HPV18 | E1 | GTFCEQAEL | 55 | 9 | | | | | 3394 |
| HPV18 | E1 | GTFCEQAELET | 55 | 11 | | | | | 3395 |
| HPV18 | E1 | GTGCNGWFYV | 11 | 10 | 0.0006 | | | | 3396 |
| HPV18 | E1 | GTPKKNCL | 473 | 8 | | | | | 3397 |
| HPV18 | E1 | GTPKKNCLV | 473 | 9 | | | | | 3398 |
| HPV18 | E1 | GTSDNSNI | 182 | 8 | | | | | 3399 |
| HPV18 | E1 | GTSDNSNIENV | 182 | 11 | | | | | 3400 |
| HPV18 | E1 | GVLILALL | 279 | 8 | | | | | 3401 |
| HPV18 | E1 | HAQEVHNDA | 71 | 9 | | | | | 3402 |
| HPV18 | E1 | HAQEVHNDAQV | 71 | 11 | | | | | 3403 |
| HPV18 | E1 | HIQCLDCKWGV | 270 | 11 | | | | | 3404 |
| HPV18 | E1 | HVLKRKFA | 83 | 8 | | | | | 3405 |
| HPV18 | E1 | HVPETCML | 306 | 8 | | | | | 3406 |
| HPV18 | E1 | HVPETCMLI | 306 | 9 | | | | | 3407 |
| HPV18 | E1 | IAEGFKTL | 254 | 8 | | | | | 3408 |
| HPV18 | E1 | IAEGFKTLI | 254 | 9 | 0.0003 | | | | 3409 |
| HPV18 | E1 | IAQLKDLL | 198 | 8 | | | | | 3410 |
| HPV18 | E1 | IAQLKDLLKV | 198 | 10 | | | | | 3411 |
| HPV18 | E1 | ILLTTNIHPA | 569 | 10 | 0.08 | | | | 3412 |
| HPV18 | E1 | ILYAHIQCL | 266 | 9 | 0.081 | | | | 3413 |
| HPV18 | E1 | IQCLDCKWGV | 271 | 10 | | | | | 3414 |
| HPV18 | E1 | IQCLDCKWGVL | 271 | 11 | | | | | 3415 |
| HPV18 | E1 | IQGAVISFV | 501 | 9 | | | | | 3416 |
| HPV18 | E1 | IQLKCPPI | 562 | 8 | | | | | 3417 |
| HPV18 | E1 | IQLKCPPIL | 562 | 9 | | | | | 3418 |
| HPV18 | E1 | IQLKCPPILL | 562 | 10 | | | | | 3419 |
| HPV18 | E1 | IQLKCPPILLT | 562 | 11 | | | | | 3420 |
| HPV18 | E1 | IQPFILYA | 262 | 8 | | | | | 3421 |
| HPV18 | E1 | IQPFILYAHI | 262 | 10 | | | | | 3422 |
| HPV18 | E1 | IQPPKLRSSV | 314 | 10 | | | | | 3423 |
| HPV18 | E1 | IQPPKLRSSVA | 314 | 11 | | | | | 3424 |
| HPV18 | E1 | IQRLTIIQHGI | 347 | 11 | | | | | 3425 |
| HPV18 | E1 | ITFLGALKSFL | 461 | 11 | | | | | 3426 |
| HPV18 | E1 | ITVFEFPNA | 590 | 9 | | | | | 3427 |
| HPV18 | E1 | IVDKKTGDV | 23 | 9 | | | | | 3428 |
| HPV18 | E1 | IVDKKTGDVI | 23 | 10 | | | | | 3429 |
| HPV18 | E1 | IVQFLRYQQI | 449 | 10 | | | | | 3430 |
| HPV18 | E1 | KAKRRLFT | 124 | 8 | | | | | 3431 |
| HPV18 | E1 | KAKRRLFTI | 124 | 9 | | | | | 3432 |
| HPV18 | E1 | KIDEGGDWRPI | 439 | 11 | | | | | 3433 |
| HPV18 | E1 | KLRAGQNHRPL | 647 | 11 | | | | | 3434 |
| HPV18 | E1 | KLRSSVAA | 318 | 8 | | | | | 3435 |
| HPV18 | E1 | KLRSSVAAL | 318 | 9 | 0.0003 | | | | 3436 |
| HPV18 | E1 | KQGAMLAV | 210 | 8 | | | | | 3437 |
| HPV18 | E1 | KTLIQPFI | 259 | 8 | | | | | 3438 |
| HPV18 | E1 | KTLIQPFIL | 259 | 9 | | | | | 3439 |
| HPV18 | E1 | KTLIQPFILYA | 259 | 11 | | | | | 3440 |
| HPV18 | E1 | KTTCTDWV | 237 | 8 | | | | | 3441 |
| HPV18 | E1 | KTTCTDWVT | 237 | 9 | | | | | 3442 |
| HPV18 | E1 | KTTCTDWVTA | 237 | 10 | | | | | 3443 |
| HPV18 | E1 | KTTCTDWVTAI | 237 | 11 | | | | | 3444 |
| HPV18 | E1 | KVAMLDDA | 524 | 8 | | | | | 3445 |
| HPV18 | E1 | KVAMLDDAT | 524 | 9 | | | | | 3446 |
| HPV18 | E1 | KVAMLDDATT | 524 | 10 | | | | | 3447 |
| HPV18 | E1 | KVAMLDDATTT | 524 | 11 | | | | | 3448 |
| HPV18 | E1 | KVNNKQGA | 206 | 8 | | | | | 3449 |
| HPV18 | E1 | KVNNKQGAM | 206 | 9 | | | | | 3450 |
| HPV18 | E1 | KVNNKQGAML | 206 | 10 | | | | | 3451 |
| HPV18 | E1 | KVNNKQGAMLA | 206 | 11 | | | | | 3452 |
| HPV18 | E1 | LADSNSNA | 389 | 8 | | | | | 3453 |
| HPV18 | E1 | LADSNSNAA | 389 | 9 | | | | | 3454 |
| HPV18 | E1 | LADSNSNAAA | 389 | 10 | | | | | 3455 |
| HPV18 | E1 | LAVFKDTYGL | 215 | 10 | | | | | 3456 |
| HPV18 | E1 | LIQLKCPPI | 561 | 9 | 0.0004 | | | | 3457 |
| HPV18 | E1 | LIQLKCPPIL | 561 | 10 | | | | | 3458 |
| HPV18 | E1 | LIQLKCPPILL | 561 | 11 | | | | | 3459 |
| HPV18 | E1 | LIQPFILYA | 261 | 9 | | | | | 3460 |
| HPV18 | E1 | LIQPFILYAHI | 261 | 11 | | | | | 3461 |
| HPV18 | E1 | LIQPPKLRSSV | 313 | 11 | | | | | 3462 |
| HPV18 | E1 | LLADSNSNA | 388 | 9 | | | | | 3463 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E1 | LLADSNSNAA | 388 | 10 | | | | | 3464 |
| HPV18 | E1 | LLADSNSNAAA | 388 | 11 | | | | | 3465 |
| HPV18 | E1 | LLHVPETCM | 304 | 9 | | | | | 3466 |
| HPV18 | E1 | LLHVPETCML | 304 | 10 | | | | | 3467 |
| HPV18 | E1 | LLHVPETCMLI | 304 | 11 | | | | | 3468 |
| HPV18 | E1 | LLKVNNKQGA | 204 | 10 | | | | | 3469 |
| HPV18 | E1 | LLKVNNKQGAM | 204 | 11 | | | | | 3470 |
| HPV18 | E1 | LLRYKCGKSRL | 285 | 11 | | | | | 3471 |
| HPV18 | E1 | LLTTNIHPA | 570 | 9 | 0.18 | | | | 3472 |
| HPV18 | E1 | LTDESDMA | 376 | 8 | | | | | 3473 |
| HPV18 | E1 | LTDTKVAM | 520 | 8 | | | | | 3474 |
| HPV18 | E1 | LTDTKVAML | 520 | 9 | | | | | 3475 |
| HPV18 | E1 | LTIIQHGI | 350 | 8 | | | | | 3476 |
| HPV18 | E1 | LTTNIHPA | 571 | 8 | | | | | 3477 |
| HPV18 | E1 | LTVAKGLST | 295 | 9 | | | | | 3478 |
| HPV18 | E1 | LTVAKGLSTL | 295 | 10 | | | | | 3479 |
| HPV18 | E1 | LTVAKGLSTLL | 295 | 11 | | | | | 3480 |
| HPV18 | E1 | LVFCGPANT | 480 | 9 | | | | | 3481 |
| HPV18 | E1 | LVRNFKSDKT | 229 | 10 | | | | | 3482 |
| HPV18 | E1 | LVRNFKSDKTT | 229 | 11 | | | | | 3483 |
| HPV18 | E1 | MAFEYALL | 382 | 8 | | | | | 3484 |
| HPV18 | E1 | MAFEYALLA | 382 | 9 | | | | | 3485 |
| HPV18 | E1 | MLAVFKDT | 214 | 8 | | | | | 3486 |
| HPV18 | E1 | MLAVFKDTYGL | 214 | 11 | | | | | 3487 |
| HPV18 | E1 | MLDDATTT | 527 | 8 | | | | | 3488 |
| HPV18 | E1 | MLDDATTTCWT | 527 | 11 | | | | | 3489 |
| HPV18 | E1 | MLIQPPKL | 312 | 8 | | | | | 3490 |
| HPV18 | E1 | MVDFIDTQGT | 47 | 10 | | | | | 3491 |
| HPV18 | E1 | MVQWAFDNEL | 367 | 10 | | | | | 3492 |
| HPV18 | E1 | MVQWAFDNELT | 367 | 11 | | | | | 3493 |
| HPV18 | E1 | NALDGNPI | 545 | 8 | | | | | 3494 |
| HPV18 | E1 | NALDGNPISI | 545 | 10 | | | | | 3495 |
| HPV18 | E1 | NATDTGSDM | 39 | 9 | | | | | 3496 |
| HPV18 | E1 | NATDTGSDMV | 39 | 10 | | | | | 3497 |
| HPV18 | E1 | NIENVNPQCT | 188 | 10 | | | | | 3498 |
| HPV18 | E1 | NIENVNPQCTI | 188 | 11 | | | | | 3499 |
| HPV18 | E1 | NISEVMGDT | 335 | 9 | | | | | 3500 |
| HPV18 | E1 | NTGKSYFGM | 487 | 9 | | | | | 3501 |
| HPV18 | E1 | NVCSGGST | 158 | 8 | | | | | 3502 |
| HPV18 | E1 | NVCSGGSTEA | 158 | 10 | | | | | 3503 |
| HPV18 | E1 | NVCSGGSTEAI | 158 | 11 | | | | | 3504 |
| HPV18 | E1 | NVNPQCTI | 191 | 8 | | | | | 3505 |
| HPV18 | E1 | NVNPQCTIA | 191 | 9 | | | | | 3506 |
| HPV18 | E1 | NVNPQCTIAQL | 191 | 11 | | | | | 3507 |
| HPV18 | E1 | PAKDNRWPYL | 577 | 10 | | | | | 3508 |
| HPV18 | E1 | PANTGKSYFGM | 485 | 11 | | | | | 3509 |
| HPV18 | E1 | PILLTTNI | 568 | 8 | | | | | 3510 |
| HPV18 | E1 | PILLTTNIHPA | 568 | 11 | | | | | 3511 |
| HPV18 | E1 | PISIDRKHKPL | 551 | 11 | | | | | 3512 |
| HPV18 | E1 | PIVQFLRYQQI | 448 | 11 | | | | | 3513 |
| HPV18 | E1 | PLGERLEV | 98 | 8 | | | | | 3514 |
| HPV18 | E1 | PLGERLEVDT | 98 | 10 | | | | | 3515 |
| HPV18 | E1 | PLIQLKCPPI | 560 | 10 | | | | | 3516 |
| HPV18 | E1 | PLIQLKCPPIL | 560 | 11 | | | | | 3517 |
| HPV18 | E1 | PLTDTKVA | 519 | 8 | | | | | 3518 |
| HPV18 | E1 | PLTDTKVAM | 519 | 9 | | | | | 3519 |
| HPV18 | E1 | PLTDTKVAML | 519 | 10 | | | | | 3520 |
| HPV18 | E1 | PQCTIAQL | 194 | 8 | | | | | 3521 |
| HPV18 | E1 | PQCTIAQLKDL | 194 | 11 | | | | | 3522 |
| HPV18 | E1 | PTIAEGFKT | 252 | 9 | | | | | 3523 |
| HPV18 | E1 | PTIAEGFKTL | 252 | 10 | | | | | 3524 |
| HPV18 | E1 | PTIAEGFKTLI | 252 | 11 | | | | | 3525 |
| HPV18 | E1 | QAELETAQA | 60 | 9 | | | | | 3526 |
| HPV18 | E1 | QAELETAQAL | 60 | 10 | | | | | 3527 |
| HPV18 | E1 | QAIVDKKT | 21 | 8 | | | | | 3528 |
| HPV18 | E1 | QAIVDKKTGDV | 21 | 11 | | | | | 3529 |
| HPV18 | E1 | QAKYLKDCA | 405 | 9 | | | | | 3530 |
| HPV18 | E1 | QAKYLKDCAT | 405 | 10 | | | | | 3531 |
| HPV18 | E1 | QAKYLKDCATM | 405 | 11 | | | | | 3532 |
| HPV18 | E1 | QALFHAQEV | 67 | 9 | 0.0002 | | | | 3533 |
| HPV18 | E1 | QIEFITFL | 457 | 8 | | | | | 3534 |
| HPV18 | E1 | QIEFITFLGA | 457 | 10 | | | | | 3535 |
| HPV18 | E1 | QIEFITFLGAL | 457 | 11 | | | | | 3536 |
| HPV18 | E1 | QLKCPPIL | 563 | 8 | | | | | 3537 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E1 | QLKCPPILL | 563 | 9 | 0.0003 | | | | 3538 |
| HPV18 | E1 | QLKCPPILLT | 563 | 10 | | | | | 3539 |
| HPV18 | E1 | QLKCPPILLTT | 563 | 11 | | | | | 3540 |
| HPV18 | E1 | QLKDLLKV | 200 | 8 | | | | | 3541 |
| HPV18 | E1 | QMNMSQWI | 426 | 8 | | | | | 3542 |
| HPV18 | E1 | QQIEFITFL | 456 | 9 | | | | | 3543 |
| HPV18 | E1 | QQIEFITFLGA | 456 | 11 | | | | | 3544 |
| HPV18 | E1 | QVLHVLKRKFA | 80 | 11 | | | | | 3545 |
| HPV18 | E1 | RAGQNHRPL | 649 | 9 | | | | | 3546 |
| HPV18 | E1 | RAQKRQMNM | 421 | 9 | | | | | 3547 |
| HPV18 | E1 | RITVFEFPNA | 589 | 10 | | | | | 3548 |
| HPV18 | E1 | RLDLHEEEEDA | 626 | 11 | | | | | 3549 |
| HPV18 | E1 | RLEVDTEL | 102 | 8 | | | | | 3550 |
| HPV18 | E1 | RLTIIQHGI | 349 | 9 | | | | | 3551 |
| HPV18 | E1 | RLTVAKGL | 294 | 8 | | | | | 3552 |
| HPV18 | E1 | RLTVAKGLST | 294 | 10 | | | | | 3553 |
| HPV18 | E1 | RLTVAKGLSTL | 294 | 11 | | | | | 3554 |
| HPV18 | E1 | RQMNMSQWI | 425 | 9 | | | | | 3555 |
| HPV18 | E1 | RTGISNISEV | 330 | 10 | | | | | 3556 |
| HPV18 | E1 | RTGISNISEVM | 330 | 11 | | | | | 3557 |
| HPV18 | E1 | RTWSRLDL | 622 | 8 | | | | | 3558 |
| HPV18 | E1 | SIDRKHKPL | 553 | 9 | | | | | 3559 |
| HPV18 | E1 | SIDRKHKPLI | 553 | 10 | | | | | 3560 |
| HPV18 | E1 | SLNSGQKKA | 117 | 9 | | | | | 3561 |
| HPV18 | E1 | SQWIRFRCSKI | 430 | 11 | | | | | 3562 |
| HPV18 | E1 | STEAIDNGGT | 164 | 10 | | | | | 3563 |
| HPV18 | E1 | STENSPLGERL | 93 | 11 | | | | | 3564 |
| HPV18 | E1 | STLLHVPET | 302 | 9 | | | | | 3565 |
| HPV18 | E1 | STLLHVPETCM | 302 | 11 | | | | | 3566 |
| HPV18 | E1 | STSHFWLEPL | 511 | 10 | | | | | 3567 |
| HPV18 | E1 | STSHFWLEPLT | 511 | 11 | | | | | 3568 |
| HPV18 | E1 | SVAALYWYRT | 322 | 10 | | | | | 3569 |
| HPV18 | E1 | SVDGTSDNSNI | 179 | 11 | | | | | 3570 |
| HPV18 | E1 | TAIFGVNPT | 245 | 9 | | | | | 3571 |
| HPV18 | E1 | TAIFGVNPTI | 245 | 10 | | | | | 3572 |
| HPV18 | E1 | TAIFGVNPTIA | 245 | 11 | | | | | 3573 |
| HPV18 | E1 | TAQALFHA | 65 | 8 | | | | | 3574 |
| HPV18 | E1 | TAQALFHAQEV | 65 | 11 | | | | | 3575 |
| HPV18 | E1 | TIAEGFKT | 253 | 8 | | | | | 3576 |
| HPV18 | E1 | TIAEGFKTL | 253 | 9 | | | | | 3577 |
| HPV18 | E1 | TIAEGFKTLI | 253 | 10 | | | | | 3578 |
| HPV18 | E1 | TIAQLKDL | 197 | 8 | | | | | 3579 |
| HPV18 | E1 | TIAQLKDLL | 197 | 9 | | | | | 3580 |
| HPV18 | E1 | TIAQLKDLLKV | 197 | 11 | | | | | 3581 |
| HPV18 | E1 | TLIQPFIL | 260 | 8 | | | | | 3582 |
| HPV18 | E1 | TLIQPFILYA | 260 | 10 | | | | | 3583 |
| HPV18 | E1 | TLLHVPET | 303 | 8 | | | | | 3584 |
| HPV18 | E1 | TLLHVPETCM | 303 | 10 | | | | | 3585 |
| HPV18 | E1 | TLLHVPETCML | 303 | 11 | | | | | 3586 |
| HPV18 | E1 | TMCKHYRRA | 414 | 9 | | | | | 3587 |
| HPV18 | E1 | TQGTFCEQA | 53 | 9 | | | | | 3588 |
| HPV18 | E1 | TQGTFCEQAEL | 53 | 11 | | | | | 3589 |
| HPV18 | E1 | TTCTDWVT | 238 | 8 | | | | | 3590 |
| HPV18 | E1 | TTCTDWVTA | 238 | 9 | | | | | 3591 |
| HPV18 | E1 | TTCTDWVTAI | 238 | 10 | | | | | 3592 |
| HPV18 | E1 | TTCWTYFDT | 533 | 9 | | | | | 3593 |
| HPV18 | E1 | TTCWTYFDTYM | 533 | 11 | | | | | 3594 |
| HPV18 | E1 | TTNGEHGGNV | 150 | 10 | | | | | 3595 |
| HPV18 | E1 | TTTCWTYFDT | 532 | 10 | | | | | 3596 |
| HPV18 | E1 | TVAKGLST | 296 | 8 | | | | | 3597 |
| HPV18 | E1 | TVAKGLSTL | 296 | 9 | | | | | 3598 |
| HPV18 | E1 | TVAKGLSTLL | 296 | 10 | | | | | 3599 |
| HPV18 | E1 | TVFEFPNA | 591 | 8 | | | | | 3600 |
| HPV18 | E1 | VAALYWYRT | 323 | 9 | | | | | 3601 |
| HPV18 | E1 | VAALYWYRTGI | 323 | 11 | | | | | 3602 |
| HPV18 | E1 | VAKGLSTL | 297 | 8 | | | | | 3603 |
| HPV18 | E1 | VAKGLSTLL | 297 | 9 | | | | | 3604 |
| HPV18 | E1 | VAKGLSTLLHV | 297 | 11 | | | | | 3605 |
| HPV18 | E1 | VAMLDDAT | 525 | 8 | | | | | 3606 |
| HPV18 | E1 | VAMLDDATT | 525 | 9 | | | | | 3607 |
| HPV18 | E1 | VAMLDDATTT | 525 | 10 | | | | | 3608 |
| HPV18 | E1 | VISDDEDENA | 31 | 10 | | | | | 3609 |
| HPV18 | E1 | VISDDEDENAT | 31 | 11 | | | | | 3610 |
| HPV18 | E1 | VISFVNST | 505 | 8 | | | | | 3611 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E1 | VLHVLKRKFA | 81 | 10 | | | | | 3612 |
| HPV18 | E1 | VLKRKFAGGST | 84 | 11 | | | | | 3613 |
| HPV18 | E1 | VMGDTPEWI | 339 | 9 | 0.007 | | | | 3614 |
| HPV18 | E1 | VQAIVDKKT | 20 | 9 | | | | | 3615 |
| HPV18 | E1 | VQFLRYQQI | 450 | 9 | | | | | 3616 |
| HPV18 | E1 | VQWAFDNEL | 368 | 9 | | | | | 3617 |
| HPV18 | E1 | VQWAFDNELT | 368 | 10 | | | | | 3618 |
| HPV18 | E1 | VTAIFGVNPT | 244 | 10 | | | | | 3619 |
| HPV18 | E1 | VTAIFGVNPTI | 244 | 11 | | | | | 3620 |
| HPV18 | E1 | VTTNGEHGGNV | 149 | 11 | | | | | 3621 |
| HPV18 | E1 | WAFDNELT | 370 | 8 | | | | | 3622 |
| HPV18 | E1 | WIQRLTII | 346 | 8 | | | | | 3623 |
| HPV18 | E1 | WIRFRCSKI | 432 | 9 | | | | | 3624 |
| HPV18 | E1 | WLEPLTDT | 516 | 8 | | | | | 3625 |
| HPV18 | E1 | WLEPLTDTKV | 516 | 10 | | | | | 3626 |
| HPV18 | E1 | WLEPLTDTKVA | 516 | 11 | | | | | 3627 |
| HPV18 | E1 | WTYFDTYM | 536 | 8 | | | | | 3628 |
| HPV18 | E1 | WTYFDTYMRNA | 536 | 11 | | | | | 3629 |
| HPV18 | E1 | WVTAIFGV | 243 | 8 | | | | | 3630 |
| HPV18 | E1 | WVTAIFGVNPT | 243 | 11 | | | | | 3631 |
| HPV18 | E1 | YALLADSNSNA | 386 | 11 | | | | | 3632 |
| HPV18 | E1 | YLESRITV | 585 | 8 | | | | | 3633 |
| HPV18 | E1 | YLKDCATM | 408 | 8 | | | | | 3634 |
| HPV18 | E1 | YMRNALDGNPI | 542 | 11 | | | | | 3635 |
| HPV18 | E1 | YQQIEFIT | 455 | 8 | | | | | 3636 |
| HPV18 | E1 | YQQIEFITFL | 455 | 10 | | | | | 3637 |
| HPV18 | E1 | YVQAIVDKKT | 19 | 10 | | | | | 3638 |
| HPV18 | E2 | AAREHGIQT | 49 | 9 | | | | | 3639 |
| HPV18 | E2 | AAREHGIQTL | 49 | 10 | | | | | 3640 |
| HPV18 | E2 | AATRPGHCGL | 245 | 10 | | | | | 3641 |
| HPV18 | E2 | AATRPGHCGLA | 245 | 11 | | | | | 3642 |
| HPV18 | E2 | AIELQMAL | 76 | 8 | | | | | 3643 |
| HPV18 | E2 | AIELQMALQGL | 76 | 11 | | | | | 3644 |
| HPV18 | E2 | AIFFAAREHGI | 45 | 11 | | | | | 3645 |
| HPV18 | E2 | AIPDSVQI | 351 | 8 | | | | | 3646 |
| HPV18 | E2 | AIPDSVQIL | 351 | 9 | | | | | 3647 |
| HPV18 | E2 | AIPDSVQILV | 351 | 10 | | | | | 3648 |
| HPV18 | E2 | AQSRYKTEDWT | 87 | 11 | | | | | 3649 |
| HPV18 | E2 | ATCVSHRGL | 154 | 9 | | | | | 3650 |
| HPV18 | E2 | ATQLVKQL | 214 | 8 | | | | | 3651 |
| HPV18 | E2 | ATQLVKQLQHT | 214 | 11 | | | | | 3652 |
| HPV18 | E2 | ATRPGHCGL | 246 | 9 | | | | | 3653 |
| HPV18 | E2 | ATRPGHCGLA | 246 | 10 | | | | | 3654 |
| HPV18 | E2 | CMTYVAWDSV | 132 | 10 | | | | | 3655 |
| HPV18 | E2 | CVSHRGLYYV | 156 | 10 | | | | | 3656 |
| HPV18 | E2 | DAGTWDKT | 146 | 8 | | | | | 3657 |
| HPV18 | E2 | DAGTWDKTA | 146 | 9 | | | | | 3658 |
| HPV18 | E2 | DAGTWDKTAT | 146 | 10 | | | | | 3659 |
| HPV18 | E2 | DIDSQIQYWQL | 29 | 11 | | | | | 3660 |
| HPV18 | E2 | DISSTWHWT | 315 | 9 | | | | | 3661 |
| HPV18 | E2 | DISSTWHWTGA | 315 | 11 | | | | | 3662 |
| HPV18 | E2 | DTCEELWNT | 100 | 9 | | | | | 3663 |
| HPV18 | E2 | DTVSATQL | 210 | 8 | | | | | 3664 |
| HPV18 | E2 | DTVSATQLV | 210 | 9 | | | | | 3665 |
| HPV18 | E2 | ELQMALQGL | 78 | 9 | | | | | 3666 |
| HPV18 | E2 | ELQMALQGLA | 78 | 10 | | | | | 3667 |
| HPV18 | E2 | ELWNTEPT | 104 | 8 | | | | | 3668 |
| HPV18 | E2 | ETLSERLSCV | 6 | 10 | | | | | 3669 |
| HPV18 | E2 | ETQRTKFL | 340 | 8 | | | | | 3670 |
| HPV18 | E2 | ETQRTKFLNT | 340 | 10 | | | | | 3671 |
| HPV18 | E2 | ETQRTKFLNTV | 340 | 11 | | | | | 3672 |
| HPV18 | E2 | EVHFGNNV | 190 | 8 | | | | | 3673 |
| HPV18 | E2 | EVHFGNNVI | 190 | 9 | | | | | 3674 |
| HPV18 | E2 | FAAREHGI | 48 | 8 | | | | | 3675 |
| HPV18 | E2 | FAAREHGIQT | 48 | 10 | | | | | 3676 |
| HPV18 | E2 | FAAREHGIQTL | 48 | 11 | | | | | 3677 |
| HPV18 | E2 | FLNTVAIPDSV | 346 | 11 | | | | | 3678 |
| HPV18 | E2 | GAGNEKTGI | 324 | 9 | | | | | 3679 |
| HPV18 | E2 | GAGNEKTGIL | 324 | 10 | | | | | 3680 |
| HPV18 | E2 | GAGNEKTGILT | 324 | 11 | | | | | 3681 |
| HPV18 | E2 | GILTVTYHSET | 331 | 11 | | | | | 3682 |
| HPV33 | E2 | GIQTLNHQV | 54 | 9 | | | | | 3683 |
| HPV18 | E2 | GIQTLNHQVV | 54 | 10 | | | | | 3684 |
| HPV18 | E2 | GLAEKQHCGPV | 253 | 11 | | | | | 3685 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E2 | GLAQSRYKT | 85 | 9 | | | | | 3686 |
| HPV18 | E2 | GLYYVKEGYNT | 161 | 11 | | | | | 3687 |
| HPV18 | E2 | GTAKTYGQT | 235 | 9 | | | | | 3688 |
| HPV18 | E2 | GTAKTYGQTSA | 235 | 11 | | | | | 3689 |
| HPV18 | E2 | GTWDKTAT | 148 | 8 | | | | | 3690 |
| HPV18 | E2 | GTWDKTATCV | 148 | 10 | | | | | 3691 |
| HPV18 | E2 | GTWEVHFGNNV | 187 | 11 | | | | | 3692 |
| HPV18 | E2 | HLKGDRNSL | 291 | 9 | | | | | 3693 |
| HPV18 | E2 | HQVVPAYNI | 60 | 9 | | | | | 3694 |
| HPV18 | E2 | HTPSPYSST | 223 | 9 | | | | | 3695 |
| HPV18 | E2 | HTPSPYSSTV | 223 | 10 | | | | | 3696 |
| HPV18 | E2 | IIHLKGDRNSL | 289 | 11 | | | | | 3697 |
| HPV18 | E2 | ILTVTYHSET | 332 | 10 | | | | | 3698 |
| HPV18 | E2 | ILVGYMTM | 358 | 8 | | | | | 3699 |
| HPV18 | E2 | IQTLNHQV | 55 | 8 | | | | | 3700 |
| HPV18 | E2 | IQTLNHQVV | 55 | 9 | | | | | 3701 |
| HPV18 | E2 | IQTLNHQVVPA | 55 | 11 | | | | | 3702 |
| HPV18 | E2 | KAHKAIEL | 72 | 8 | | | | | 3703 |
| HFV33 | E2 | KAHKAIELQM | 72 | 10 | | | | | 3704 |
| HPV18 | E2 | KAHKAIELQMA | 72 | 11 | | | | | 3705 |
| HPV18 | E2 | KAIELQMA | 75 | 8 | | | | | 3706 |
| HPV18 | E2 | KAIELQMAL | 75 | 9 | | | | | 3707 |
| HPV18 | E2 | KLCSGNTT | 280 | 8 | | | | | 3708 |
| HPV18 | E2 | KLCSGNTTPI | 280 | 10 | | | | | 3709 |
| HPV18 | E2 | KLCSGNTTPII | 280 | 11 | | | | | 3710 |
| HPV18 | E2 | KQHCGPVNPL | 257 | 10 | | | | | 3711 |
| HPV18 | E2 | KQHCGPVNPLL | 257 | 11 | | | | | 3712 |
| HPV18 | E2 | KTATCVSHRGL | 152 | 11 | | | | | 3713 |
| HPV18 | E2 | KTEDWTLQDT | 92 | 10 | | | | | 3714 |
| HPV33 | E2 | KTGILTVT | 329 | 8 | | | | | 3715 |
| HPV18 | E2 | KTYGQTSA | 238 | 8 | | | | | 3716 |
| HPV18 | E2 | KTYGQTSAA | 238 | 9 | | | | | 3717 |
| HPV18 | E2 | KTYGQTSAAT | 238 | 10 | | | | | 3718 |
| HPV18 | E2 | LAEKQHCGPV | 254 | 10 | | | | | 3719 |
| HPV18 | E2 | LAQSRYKT | 86 | 8 | | | | | 3720 |
| HPV18 | E2 | LIRWENAI | 39 | 8 | | | | | 3721 |
| HPV18 | E2 | LIRWENAIFFA | 39 | 11 | | | | | 3722 |
| HPV18 | E2 | LLGAATPT | 266 | 8 | | | | | 3723 |
| HPV18 | E2 | LQDTCEEL | 98 | 8 | | | | | 3724 |
| HPV18 | E2 | LQDTCEELWNT | 98 | 11 | | | | | 3725 |
| HPV18 | E2 | LQGLAQSRYKT | 83 | 11 | | | | | 3726 |
| HPV18 | E2 | LQHTPSPYSST | 221 | 11 | | | | | 3727 |
| HPV18 | E2 | LQMALQGL | 79 | 8 | | | | | 3728 |
| HPV18 | E2 | LQMALQGLA | 79 | 9 | | | | | 3729 |
| HFV33 | E2 | LTVTYHSET | 333 | 9 | | | | | 3730 |
| HPV18 | E2 | LVKQLQHT | 217 | 8 | | | | | 3731 |
| HPV18 | E2 | MQTPKETL | 1 | 8 | | | | | 3732 |
| HPV18 | E2 | MTDAGTWDKT | 144 | 10 | | | | | 3733 |
| HPV18 | E2 | MTDAGTWDKTA | 144 | 11 | | | | | 3734 |
| HPV18 | E2 | MTYVAWDSV | 133 | 9 | | | | | 3735 |
| HPV18 | E2 | NISKSKAHKA | 67 | 10 | | | | | 3736 |
| HPV18 | E2 | NISKSKAHKAI | 67 | 11 | | | | | 3737 |
| HPV18 | E2 | NTTPIIHL | 285 | 8 | | | | | 3738 |
| HPV18 | E2 | NTVAIPDSV | 348 | 9 | | | | | 3739 |
| HPV18 | E2 | NTVAIPDSVQI | 348 | 11 | | | | | 3740 |
| HPV18 | E2 | NVIDCNDSM | 196 | 9 | | | | | 3741 |
| HPV18 | E2 | PAYNISKSKA | 64 | 10 | | | | | 3742 |
| HPV18 | E2 | PLLGAATPT | 265 | 9 | | | | | 3743 |
| HPV18 | E2 | PTGNNKRRKL | 272 | 10 | | | | | 3744 |
| HPV18 | E2 | PTHCFKKGGQT | 110 | 11 | | | | | 3745 |
| HPV18 | E2 | PVNPLLGA | 262 | 8 | | | | | 3746 |
| HPV18 | E2 | PVNPLLGAA | 262 | 9 | | | | | 3747 |
| HPV18 | E2 | PVNPLLGAAT | 262 | 10 | | | | | 3748 |
| HPV18 | E2 | QILVGYMT | 357 | 8 | | | | | 3749 |
| HPV18 | E2 | QILVGYMTM | 357 | 9 | | | | | 3750 |
| HPV18 | E2 | QIQYWQLI | 33 | 8 | | | | | 3751 |
| HPV18 | E2 | QLIRWENA | 38 | 8 | | | | | 3752 |
| HPV18 | E2 | QLIRWENAI | 38 | 9 | | | | | 3753 |
| HPV18 | E2 | QLVKQLQHT | 216 | 9 | | | | | 3754 |
| HPV18 | E2 | QMALQGLA | 80 | 8 | | | | | 3755 |
| HPV18 | E2 | QTLNHQVV | 56 | 8 | | | | | 3756 |
| HPV18 | E2 | QTLNHQVVPA | 56 | 10 | | | | | 3757 |
| HPV18 | E2 | QTPKETLSERL | 2 | 11 | | | | | 3758 |
| HPV18 | E2 | QVVPAYNI | 61 | 8 | | | | | 3759 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E2 | RLSCVQDKI | 11 | 9 | | | | | 3760 |
| HPV18 | E2 | RLSCVQDKII | 11 | 10 | | | | | 3761 |
| HPV18 | E2 | RTKFLNTV | 343 | 8 | | | | | 3762 |
| HPV18 | E2 | RTKFLNTVA | 343 | 9 | | | | | 3763 |
| HPV18 | E2 | RTKFLNTVAI | 343 | 10 | | | | | 3764 |
| HPV18 | E2 | SAATRPGHCGL | 244 | 11 | | | | | 3765 |
| HPV18 | E2 | SATQLVKQL | 213 | 9 | | | | | 3766 |
| HPV18 | E2 | SLKCLRYRL | 298 | 9 | | | | | 3767 |
| HPV18 | E2 | SMCSTSDDT | 203 | 9 | | | | | 3768 |
| HPV18 | E2 | SMCSTSDDTV | 203 | 10 | | | | | 3769 |
| HPV18 | E2 | SQIQYWQL | 32 | 8 | | | | | 3770 |
| HPV18 | E2 | SQIQYWQLI | 32 | 9 | | | | | 3771 |
| HPV18 | E2 | STSDDTVSA | 206 | 9 | | | | | 3772 |
| HPV18 | E2 | STSDDTVSAT | 206 | 10 | | | | | 3773 |
| HPV18 | E2 | STVSVGTA | 230 | 8 | | | | | 3774 |
| HPV18 | E2 | STVSVGTAKT | 230 | 10 | | | | | 3775 |
| HPV18 | E2 | STWHWTGA | 318 | 8 | | | | | 3776 |
| HPV18 | E2 | SVGTAKTYGQT | 233 | 11 | | | | | 3777 |
| HPV18 | E2 | SVQILVGYM | 355 | 9 | | | | | 3778 |
| HPV18 | E2 | SVQILVGYMT | 355 | 10 | | | | | 3779 |
| HPV18 | E2 | SVQILVGYMTM | 355 | 11 | | | | | 3780 |
| HPV18 | E2 | SVYYMTDA | 140 | 8 | | | | | 3781 |
| HPV18 | E2 | SVYYMTDAGT | 140 | 10 | | | | | 3782 |
| HPV18 | E2 | TAKTYGQT | 236 | 8 | | | | | 3783 |
| HPV18 | E2 | TAKTYGQTSA | 236 | 10 | | | | | 3784 |
| HPV18 | E2 | TAKTYGQTSAA | 236 | 11 | | | | | 3785 |
| HPV18 | E2 | TATCVSHRGL | 153 | 10 | | | | | 3786 |
| HPV18 | E2 | TLNHQVVPA | 57 | 9 | | | | | 3787 |
| HPV18 | E2 | TLQDTCEEL | 97 | 9 | | | | | 3788 |
| HPV18 | E2 | TLSERLSCV | 7 | 9 | | | | | 3789 |
| HPV18 | E2 | TQLVKQLQHT | 215 | 10 | | | | | 3790 |
| HPV18 | E2 | TQRTKFLNT | 341 | 9 | | | | | 3791 |
| HPV18 | E2 | TQRTKFLNTV | 341 | 10 | | | | | 3792 |
| HPV18 | E2 | TQRTKFLNTVA | 341 | 11 | | | | | 3793 |
| HPV18 | E2 | TVAIPDSV | 349 | 8 | | | | | 3794 |
| HPV18 | E2 | TVAIPDSVQI | 349 | 10 | | | | | 3795 |
| HPV18 | E2 | TVAIPDSVQIL | 349 | 11 | | | | | 3796 |
| HPV18 | E2 | TVSATQLV | 211 | 8 | | | | | 3797 |
| HPV18 | E2 | TVSATQLVKQL | 211 | 11 | | | | | 3798 |
| HPV18 | E2 | TVSVGTAKT | 231 | 9 | | | | | 3799 |
| HPV18 | E2 | TVTYHSET | 334 | 8 | | | | | 3800 |
| HPV18 | E2 | TVTYHSETQRT | 334 | 11 | | | | | 3801 |
| HPV18 | E2 | VAIPDSVQI | 350 | 9 | | | | | 3802 |
| HPV18 | E2 | VAIPDSVQIL | 350 | 10 | | | | | 3803 |
| HPV18 | E2 | VAIPDSVQILV | 350 | 11 | | | | | 3804 |
| HPV18 | E2 | VAWDSVYYM | 136 | 9 | | | | | 3805 |
| HPV18 | E2 | VAWDSVYYMT | 136 | 10 | | | | | 3806 |
| HPV18 | E2 | VIDCNDSM | 197 | 8 | | | | | 3807 |
| HPV18 | E2 | VIDCNDSMCST | 197 | 11 | | | | | 3808 |
| HPV18 | E2 | VQILVGYM | 356 | 8 | | | | | 3809 |
| HPV18 | E2 | VQILVGYMT | 356 | 9 | | | | | 3810 |
| HPV18 | E2 | VQILVGYMTM | 356 | 10 | | | | | 3811 |
| HPV18 | E2 | VTYHSETQRT | 335 | 10 | | | | | 3812 |
| HPV18 | E2 | WQLIRWENA | 37 | 9 | | | | | 3813 |
| HPV18 | E2 | WQLIRWENAI | 37 | 10 | | | | | 3814 |
| HPV18 | E2 | WTGAGNEKT | 322 | 9 | | | | | 3815 |
| HPV18 | E2 | WTGAGNEKTGI | 322 | 11 | | | | | 3816 |
| HPV18 | E2 | WTLQDTCEEL | 96 | 10 | | | | | 3817 |
| HPV18 | E2 | YMTDAGTWDKT | 143 | 11 | | | | | 3818 |
| HPV18 | E2 | YVAWDSVYYM | 135 | 10 | | | | | 3819 |
| HPV18 | E2 | YVAWDSVYYMT | 135 | 11 | | | | | 3820 |
| HPV18 | E2 | YVKEGYNT | 164 | 8 | | | | | 3821 |
| HPV18 | E2 | YVKEGYNTFYI | 164 | 11 | | | | | 3822 |
| HPV18 | E5 | ATAFTVYV | 47 | 8 | | | | | 3823 |
| HPV18 | E5 | CAYAWVLV | 29 | 8 | | | | | 3824 |
| HPV18 | E5 | CAYAWVLVFV | 29 | 10 | | | | | 3825 |
| HPV18 | E5 | CMCAYAWV | 27 | 8 | | | | | 3826 |
| HPV18 | E5 | CMCAYAWVL | 27 | 9 | | | | | 3827 |
| HPV18 | E5 | CMCAYAWVLV | 27 | 10 | | | | | 3828 |
| HPV18 | E5 | CMYVCCHV | 13 | 8 | | | | | 3829 |
| HPV18 | E5 | CMYVCCHVPL | 13 | 10 | | | | | 3830 |
| HPV18 | E5 | CMYVCCHVPLL | 13 | 11 | | | | | 3831 |
| HPV18 | E5 | CVCMYVCCHV | 11 | 10 | | | | | 3832 |
| HPV18 | E5 | FLFCFCVCM | 6 | 9 | | | | | 3833 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E5 | FLFCFCVCMYV | 6 | 11 | | | | | 3834 |
| HPV18 | E5 | FLLPMLLL | 57 | 8 | | | | | 3835 |
| HPV18 | E5 | FLLPMLLLHI | 57 | 10 | | | | | 3836 |
| HPV18 | E5 | FTVYVFCFL | 50 | 9 | | | | | 3837 |
| HPV18 | E5 | FTVYVFCFLL | 50 | 10 | | | | | 3838 |
| HPV18 | E5 | FVYIVVIT | 37 | 8 | | | | | 3839 |
| HPV18 | E5 | FVYIVVITSPA | 37 | 11 | | | | | 3840 |
| HPV18 | E5 | HIHAILSL | 65 | 8 | | | | | 3841 |
| HPV18 | E5 | HVPLLPSV | 19 | 8 | | | | | 3842 |
| HPV18 | E5 | HVPLLPSVCM | 19 | 10 | | | | | 3843 |
| HPV18 | E5 | ITSPATAFT | 43 | 9 | | | | | 3844 |
| HPV18 | E5 | ITSPATAFTV | 43 | 10 | | | | | 3845 |
| HPV18 | E5 | IVVITSPA | 40 | 8 | | | | | 3846 |
| HPV18 | E5 | IVVITSPAT | 40 | 9 | | | | | 3847 |
| HPV18 | E5 | IVVITSPATA | 40 | 10 | | | | | 3848 |
| HPV18 | E5 | LIFLFCFCV | 4 | 9 | | | | | 3849 |
| HPV18 | E5 | LIFLFCFCVCM | 4 | 11 | | | | | 3850 |
| HPV18 | E5 | LLHIHAIL | 63 | 8 | | | | | 3851 |
| HPV18 | E5 | LLHIHAILSL | 63 | 10 | | | | | 3852 |
| HPV18 | E5 | LLLHIHAI | 62 | 8 | | | | | 3853 |
| HPV18 | E5 | LLLHIHAIL | 62 | 9 | | | | | 3854 |
| HPV18 | E5 | LLLHIHAILSL | 62 | 11 | | | | | 3855 |
| HPV18 | E5 | LLPMLLLHI | 58 | 9 | | | | | 3856 |
| HPV18 | E5 | LLPMLLLHIHA | 58 | 11 | | | | | 3857 |
| HPV18 | E5 | LLPSVCMCA | 22 | 9 | | | | | 3858 |
| HPV18 | E5 | LLPSVCMCAYA | 22 | 11 | | | | | 3859 |
| HPV18 | E5 | LVFVYIVV | 35 | 8 | | | | | 3860 |
| HPV18 | E5 | LVFVYIVVI | 35 | 9 | | | | | 3861 |
| HPV18 | E5 | LVFVYIVVIT | 35 | 10 | | | | | 3862 |
| HPV18 | E5 | MLLLHIHA | 61 | 8 | | | | | 3863 |
| HPV18 | E5 | MLLLHIHAI | 61 | 9 | | | | | 3864 |
| HPV18 | E5 | MLLLHIHAIL | 61 | 10 | | | | | 3865 |
| HPV18 | E5 | PATAFTVYV | 46 | 9 | | | | | 3866 |
| HPV18 | E5 | PLLPSVCM | 21 | 8 | | | | | 3867 |
| HPV18 | E5 | PLLPSVCMCA | 21 | 10 | | | | | 3868 |
| HPV18 | E5 | PMLLLHIHA | 60 | 9 | | | | | 3869 |
| HPV18 | E5 | PMLLLHIHAI | 60 | 10 | | | | | 3870 |
| HPV18 | E5 | PMLLLHIHAIL | 60 | 11 | | | | | 3871 |
| HPV18 | E5 | SLIFLFCFCV | 3 | 10 | | | | | 3872 |
| HPV18 | E5 | SVCMCAYA | 25 | 8 | | | | | 3873 |
| HPV18 | E5 | SVCMCAYAWV | 25 | 10 | | | | | 3874 |
| HPV18 | E5 | SVCMCAYAWVL | 25 | 11 | | | | | 3875 |
| HPV18 | E5 | TAFTVYVFCFL | 48 | 11 | | | | | 3876 |
| HPV18 | E5 | TVYVFCFL | 51 | 8 | | | | | 3877 |
| HPV18 | E5 | TVYVFCFLL | 51 | 9 | | | | | 3878 |
| HPV18 | E5 | TVYVFCFLLPM | 51 | 11 | | | | | 3879 |
| HPV18 | E5 | VITSPATA | 42 | 8 | | | | | 3880 |
| HPV18 | E5 | VITSPATAFT | 42 | 10 | | | | | 3881 |
| HPV18 | E5 | VITSPATAFTV | 42 | 11 | | | | | 3882 |
| HPV18 | E5 | VLVFVYIV | 34 | 8 | | | | | 3883 |
| HPV18 | E5 | VLVFVYIVV | 34 | 9 | | | | | 3884 |
| HPV18 | E5 | VLVFVYIVVI | 34 | 10 | | | | | 3885 |
| HPV18 | E5 | VLVFVYIVVIT | 34 | 11 | | | | | 3886 |
| HPV18 | E5 | VVITSPAT | 41 | 8 | | | | | 3887 |
| HPV18 | E5 | VVITSPATA | 41 | 9 | | | | | 3888 |
| HPV18 | E5 | VVITSPATAFT | 41 | 11 | | | | | 3889 |
| HPV18 | E5 | WVLVFVYI | 33 | 8 | | | | | 3890 |
| HPV18 | E5 | WVLVFVYIV | 33 | 9 | | | | | 3891 |
| HPV18 | E5 | WVLVFVYIVV | 33 | 10 | | | | | 3892 |
| HPV18 | E5 | WVLVFVYIVVI | 33 | 11 | | | | | 3893 |
| HPV18 | E5 | YAWVLVFV | 31 | 8 | | | | | 3894 |
| HPV18 | E5 | YAWVLVFVYI | 31 | 10 | | | | | 3895 |
| HPV18 | E5 | YAWVLVFVYIV | 31 | 11 | | | | | 3896 |
| HPV18 | E5 | YIVVITSPA | 39 | 9 | | | | | 3897 |
| HPV18 | E5 | YIVVITSPAT | 39 | 10 | | | | | 3898 |
| HPV18 | E5 | YIVVITSPATA | 39 | 11 | | | | | 3899 |
| HPV18 | E5 | YVCCHVPL | 15 | 8 | | | | | 3900 |
| HPV18 | E5 | YVCCHVPLL | 15 | 9 | | | | | 3901 |
| HPV18 | E5 | YVFCFLLPM | 53 | 9 | | | | | 3902 |
| HPV18 | E5 | YVFCFLLPML | 53 | 10 | | | | | 3903 |
| HPV18 | E5 | YVFCFLLPMLL | 53 | 11 | | | | | 3904 |
| HPV18 | E6 | CIDFYSRI | 68 | 8 | 0.0001 | | | | 3905 |
| HPV18 | E6 | CIDFYSRIREL | 68 | 11 | | | | | 3906 |
| HPV18 | E6 | CLRCQKPL | 105 | 8 | 0.0001 | | | | 3907 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E6 | CLRCQKPLNPA | 105 | 11 | | | | | 3908 |
| HPV18 | E6 | CQKPLNPA | 108 | 8 | | | | | 3909 |
| HPV18 | E6 | CQKPLNPAEKL | 108 | 11 | | | | | 3910 |
| HPV18 | E6 | CTELNTSL | 18 | 8 | | | | | 3911 |
| HPV18 | E6 | CTELNTSLQDI | 18 | 11 | | | | | 3912 |
| HPV18 | E6 | CVYCKTVL | 32 | 8 | 0.0002 | | | | 3913 |
| HPV18 | E6 | CVYCKTVLEL | 32 | 10 | 0.0001 | | | | 3914 |
| HPV18 | E6 | CVYCKTVLELT | 32 | 11 | | | | | 3915 |
| HPV18 | E6 | DIEITCVYCKT | 27 | 11 | | | | | 3916 |
| HPV18 | E6 | DLCTELNT | 16 | 8 | | | | | 3917 |
| HPV18 | E6 | DLCTELNTSL | 16 | 10 | 0.0001 | | | | 3918 |
| HPV18 | E6 | DLFVVYRDSI | 51 | 10 | 0.0001 | | | | 3919 |
| HPV18 | E6 | DTLEKLTNT | 88 | 9 | 0.0001 | | | | 3920 |
| HPV18 | E6 | DTLEKLTNTGL | 88 | 11 | | | | | 3921 |
| HPV18 | E6 | EITCVYCKT | 29 | 9 | 0.0001 | | | | 3922 |
| HPV18 | E6 | EITCVYCKTV | 29 | 10 | 0.0002 | | | | 3923 |
| HPV18 | E6 | EITCVYCKTVL | 29 | 11 | | | | | 3924 |
| HPV18 | E6 | ELNTSLQDI | 20 | 9 | 0.0001 | | | | 3925 |
| HPV18 | E6 | ELNTSLQDIEI | 20 | 11 | | | | | 3926 |
| HPV18 | E6 | ELRHYSDSV | 77 | 9 | 0.0003 | | | | 3927 |
| HPV18 | E6 | ELTEVFEFA | 40 | 9 | 0.0012 | | | | 3928 |
| HPV18 | E6 | EVFEFAFKDL | 43 | 10 | 0.0009 | | | | 3929 |
| HPV18 | E6 | FAFKDLFV | 47 | 8 | | | | | 3930 |
| HPV18 | E6 | FAFKDLFVV | 47 | 9 | 0.085 | | | | 3931 |
| HPV18 | E6 | FVVYRDSI | 53 | 8 | | | | | 3932 |
| HPV18 | E6 | FVVYRDSIPHA | 53 | 11 | | | | | 3933 |
| HPV18 | E6 | GLYNLLIRCL | 97 | 10 | 0.0036 | | | | 3934 |
| HPV18 | E6 | GQCHSCCNRA | 136 | 10 | | | | | 3935 |
| HPV18 | E6 | HAACHKCI | 62 | 8 | | | | | 3936 |
| HPV18 | E6 | HLNEKRRFHNI | 120 | 11 | | | | | 3937 |
| HPV18 | E6 | ITCVYCKT | 30 | 8 | | | | | 3938 |
| HPV18 | E6 | ITCVYCKTV | 30 | 9 | | | | | 3939 |
| HPV18 | E6 | ITCVYCKTVL | 30 | 10 | | | | | 3940 |
| HPV18 | E6 | KLPDLCTEL | 13 | 9 | 0.0035 | | | | 3941 |
| HPV18 | E6 | KLPDLCTELNT | 13 | 11 | | | | | 3942 |
| HPV18 | E6 | KLTNTGLYNL | 92 | 10 | 0.0048 | | | | 3943 |
| HPV18 | E6 | KLTNTGLYNLL | 92 | 11 | 0.0043 | | | | 3944 |
| HPV18 | E6 | KTVLELTEV | 36 | 9 | | | | | 3945 |
| HPV18 | E6 | LIRCLRCQKPL | 102 | 11 | | | | | 3946 |
| HPV18 | E6 | LQDIEITCV | 25 | 9 | | | | | 3947 |
| HPV18 | E6 | LQRRRETQV | 150 | 9 | | | | | 3948 |
| HPV18 | E6 | LTEVFEFA | 41 | 8 | | | | | 3949 |
| HPV18 | E6 | LTNTGLYNL | 93 | 9 | | | | | 3950 |
| HPV18 | E6 | LTNTGLYNLL | 93 | 10 | | | | | 3951 |
| HPV18 | E6 | LTNTGLYNLLI | 93 | 11 | | | | | 3952 |
| HPV18 | E6 | MARFEDPT | 1 | 8 | | | | | 3953 |
| HPV18 | E6 | NTGLYNLL | 95 | 8 | | | | | 3954 |
| HPV18 | E6 | NTGLYNLLI | 95 | 9 | | | | | 3955 |
| HPV18 | E6 | NTSLQDIEI | 22 | 9 | | | | | 3956 |
| HPV18 | E6 | NTSLQDIEIT | 22 | 10 | 0.0001 | | | | 3957 |
| HPV18 | E6 | PAEKLRHL | 114 | 8 | | | | | 3958 |
| HPV18 | E6 | PLNPAEKL | 111 | 8 | 0.0001 | | | | 3959 |
| HPV18 | E6 | PLNPAEKLRHL | 111 | 11 | 0.0001 | | | | 3960 |
| HPV18 | E6 | PTRRPYKL | 7 | 8 | | | | | 3961 |
| HPV18 | E6 | PTRRPYKLPDL | 7 | 11 | | | | | 3962 |
| HPV18 | E6 | RLQRRRET | 149 | 8 | | | | | 3963 |
| HPV18 | E6 | RLQRRRETQV | 149 | 10 | 0.0001 | | | | 3964 |
| HPV18 | E6 | RQERLQRRRET | 146 | 11 | | | | | 3965 |
| HPV18 | E6 | SIPHAACHKCI | 59 | 11 | | | | | 3966 |
| HPV18 | E6 | SLQDIEIT | 24 | 8 | | | | | 3967 |
| HPV18 | E6 | SLQDIEITCV | 24 | 10 | 0.025 | | | | 3968 |
| HPV18 | E6 | SVYGDTLEKL | 84 | 10 | 0.0028 | | | | 3969 |
| HPV18 | E6 | SVYGDTLEKLT | 84 | 11 | | | | | 3970 |
| HPV18 | E6 | TLEKLTNT | 89 | 8 | | | | | 3971 |
| HPV18 | E6 | TLEKLTNTGL | 89 | 10 | 0.0004 | | | | 3972 |
| HPV18 | E6 | TVLELTEV | 37 | 8 | 0.001 | | | | 3973 |
| HPV18 | E6 | VLELTEVFEFA | 38 | 11 | | | | | 3974 |
| HPV18 | E6 | VVYRDSIPHA | 54 | 10 | 0.0003 | | | | 3975 |
| HPV18 | E6 | VVYRDSIPHAA | 54 | 11 | | | | | 3976 |
| HPV18 | E7 | ATLQDIVL | 6 | 8 | | | | | 3977 |
| HPV18 | E7 | ATLQDIVLHL | 6 | 10 | | | | | 3978 |
| HPV18 | E7 | CMCCKCEA | 63 | 8 | 0.0005 | | | | 3979 |
| HPV18 | E7 | CMCCKCEARI | 63 | 10 | 0.002 | | | | 3980 |
| HPV18 | E7 | DLLCHEQL | 24 | 8 | 0.0001 | | | | 3981 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | E7 | DLRAFQQL | 82 | 8 | 0.0001 | | | | 3982 |
| HPV18 | E7 | DLRAFQQLFL | 82 | 10 | 0.001 | | | | 3983 |
| HPV18 | E7 | EARIKLVV | 69 | 8 | | | | | 3984 |
| HPV18 | E7 | EIDGVNHQHL | 40 | 10 | 0.0001 | | | | 3985 |
| HPV18 | E7 | FLNTLSFV | 90 | 8 | 0.0079 | | | | 3986 |
| HPV18 | E7 | FQQLFLNT | 86 | 8 | | | | | 3987 |
| HPV18 | E7 | FQQLFLNTL | 86 | 9 | | | | | 3988 |
| HPV18 | E7 | GVNHQHLPA | 43 | 9 | 0.0001 | | | | 3989 |
| HPV18 | E7 | HLEPQNEI | 14 | 8 | 0.0001 | | | | 3990 |
| HPV18 | E7 | HLEPQNEIPV | 14 | 10 | 0.0001 | | | | 3991 |
| HPV18 | E7 | HQHLPARRA | 46 | 9 | | | | | 3992 |
| HPV18 | E7 | IVLHLEPONEI | 11 | 11 | | | | | 3993 |
| HPV18 | E7 | KATLQDIV | 5 | 8 | | | | | 3994 |
| HPV18 | E7 | KATLQDIVL | 5 | 9 | | | | | 3995 |
| HPV18 | E7 | KATLQDIVLHL | 5 | 11 | | | | | 3996 |
| HPV18 | E7 | KLVVESSA | 73 | 8 | 0.0001 | | | | 3997 |
| HPV18 | E7 | KLVVESSADDL | 73 | 11 | 0.0001 | | | | 3998 |
| HPV18 | E7 | LQDIVLHL | 8 | 8 | | | | | 3999 |
| HPV18 | E7 | LVVESSADDL | 74 | 10 | 0.0001 | | | | 4000 |
| HPV18 | E7 | MLCMCCKCEA | 61 | 10 | 0.0016 | | | | 4001 |
| HPV18 | E7 | NTLSFVCPWCA | 92 | 11 | | | | | 4002 |
| HPV18 | E7 | PARRAEPQRHT | 50 | 11 | | | | | 4003 |
| HPV18 | E7 | PQNEIPVDL | 17 | 9 | | | | | 4004 |
| HPV18 | E7 | PQNEIPVDLL | 17 | 10 | | | | | 4005 |
| HPV18 | E7 | PQRHTMLCM | 56 | 9 | | | | | 4006 |
| HPV18 | E7 | PVDLLCHEQL | 22 | 10 | 0.0001 | | | | 4007 |
| HPV18 | E7 | QLFNTLSFV | 88 | 10 | 0.11 | | | | 4008 |
| HPV18 | E7 | QQLFLNTL | 87 | 8 | | | | | 4009 |
| HPV18 | E7 | QQLFLNTLSFV | 87 | 11 | | | | | 4010 |
| HPV18 | E7 | RAEPQRHT | 53 | 8 | | | | | 4011 |
| HPV18 | E7 | RAEPQRHTM | 53 | 9 | | | | | 4012 |
| HPV18 | E7 | RAEPQRHTML | 53 | 10 | | | | | 4013 |
| HPV18 | E7 | RAFQQLFL | 84 | 8 | | | | | 4014 |
| HPV18 | E7 | RAFQQLFLNT | 84 | 10 | 0.0003 | | | | 4015 |
| HPV18 | E7 | RAFQQLFLNTL | 84 | 11 | | | | | 4016 |
| HPV18 | E7 | RIKLVVESSA | 71 | 10 | | | | | 4017 |
| HPV18 | E7 | SADDLRAFQQL | 79 | 11 | | | | | 4018 |
| HPV18 | E7 | TLQDIVLHL | 7 | 9 | 3 | | | | 4019 |
| HPV18 | E7 | TLSFVCPWCA | 93 | 10 | 0.0027 | | | | 4020 |
| HPV18 | E7 | TMLCMCCKCEA | 60 | 11 | | | | | 4021 |
| HPV18 | E7 | VLHLEPQNEI | 12 | 10 | 0.0001 | | | | 4022 |
| HPV18 | E7 | VVESSADDL | 75 | 9 | 0.0003 | | | | 4023 |
| HPV18 | E7 | VVESSADDLRA | 75 | 11 | | | | | 4024 |
| HPV18 | L1 | AATSNVSEDV | 195 | 10 | | | | | 4025 |
| HPV18 | L1 | AIGEHWAKGT | 225 | 10 | | | | | 4026 |
| HPV18 | L1 | AIGEHWAKGTA | 225 | 11 | | | | | 4027 |
| HPV18 | L1 | AITCQKDA | 487 | 8 | | | | | 4028 |
| HPV18 | L1 | AITCQKDAA | 487 | 9 | | | | | 4029 |
| HPV18 | L1 | AITCQKDAAPA | 487 | 11 | | | | | 4030 |
| HPV18 | L1 | ALWRPSDNT | 63 | 9 | | | | | 4031 |
| HPV18 | L1 | ALWRPSDNTV | 63 | 10 | | | | | 4032 |
| HPV18 | L1 | AMDFSTLQDT | 268 | 10 | | | | | 4033 |
| HPV18 | L1 | AQGHNNGV | 377 | 8 | | | | | 4034 |
| HPV18 | L1 | ATKFKQYSRHV | 419 | 11 | | | | | 4035 |
| HPV18 | L1 | ATSNVSEDV | 196 | 9 | | | | | 4036 |
| HPV18 | L1 | ATTSSKPA | 552 | 8 | | | | | 4037 |
| HPV18 | L1 | ATTSSKPAKRV | 552 | 11 | | | | | 4038 |
| HPV18 | L1 | CAPAIGEHWA | 222 | 10 | | | | | 4039 |
| HPV18 | L1 | CASTQSPV | 406 | 8 | | | | | 4040 |
| HPV18 | L1 | CILGCAPA | 218 | 8 | | | | | 4041 |
| HPV18 | L1 | CILGCAPAI | 218 | 9 | | | | | 4042 |
| HPV18 | L1 | CLRREQLFA | 310 | 9 | | | | | 4043 |
| HPV18 | L1 | CLYTRVLI | 2 | 8 | | | | | 4044 |
| HPV18 | L1 | CLYTRVLIL | 2 | 9 | | | | | 4045 |
| HPV18 | L1 | CQKDAAPA | 490 | 8 | | | | | 4046 |
| HPV18 | L1 | CQSICKYPDYL | 286 | 11 | | | | | 4047 |
| HPV18 | L1 | CTITLTADV | 441 | 9 | | | | | 4048 |
| HPV18 | L1 | CTITLTADVM | 441 | 10 | | | | | 4049 |
| HPV18 | L1 | CVYSPSPSGSI | 350 | 11 | | | | | 4050 |
| HPV18 | L1 | DLKEKFSL | 512 | 8 | | | | | 4051 |
| HPV18 | L1 | DLKEKFSLDL | 512 | 10 | | | | | 4052 |
| HPV18 | L1 | DLQFIFQL | 433 | 8 | | | | | 4053 |
| HPV18 | L1 | DLQFIFQLCT | 433 | 10 | | | | | 4054 |
| HPV18 | L1 | DLQFIFQLCTI | 433 | 11 | | | | | 4055 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | L1 | DMVDTGYGA | 260 | 9 | | | | | 4056 |
| HPV18 | L1 | DMVDTGYGAM | 260 | 10 | | | | | 4057 |
| HPV18 | L1 | DQYPLGRKFL | 522 | 10 | | | | | 4058 |
| HPV18 | L1 | DQYPLGRKFLV | 522 | 11 | | | | | 4059 |
| HPV18 | L1 | DTESSHAA | 189 | 8 | | | | | 4060 |
| HPV18 | L1 | DTESSHAAT | 189 | 9 | | | | | 4061 |
| HPV18 | L1 | DTGYGAMDFST | 263 | 11 | | | | | 4062 |
| HPV18 | L1 | DTKCEVPL | 276 | 8 | | | | | 4063 |
| HPV18 | L1 | DTKCEVPLDI | 276 | 10 | | | | | 4064 |
| HPV18 | L1 | DTSIYNPET | 148 | 9 | | | | | 4065 |
| HPV18 | L1 | DTTPSTNL | 396 | 8 | | | | | 4066 |
| HPV18 | L1 | DTTPSTNLT | 396 | 9 | | | | | 4067 |
| HPV18 | L1 | DTTPSTNLTI | 396 | 10 | | | | | 4068 |
| HPV18 | L1 | DTVPQSLYI | 330 | 9 | | | | | 4069 |
| HPV18 | L1 | DTYRFVQSV | 478 | 9 | | | | | 4070 |
| HPV18 | L1 | DTYRFVQSVA | 478 | 10 | | | | | 4071 |
| HPV18 | L1 | DTYRFVQSVAI | 478 | 11 | | | | | 4072 |
| HPV18 | L1 | DVMSYIHSM | 448 | 9 | | | | | 4073 |
| HPV18 | L1 | DVRDNVSV | 203 | 8 | | | | | 4074 |
| HPV18 | L1 | EIGRGQPL | 167 | 8 | | | | | 4075 |
| HPV18 | L1 | EIGRGQPLGV | 167 | 10 | | | | | 4076 |
| HPV18 | L1 | ETQRLVWA | 155 | 8 | | | | | 4077 |
| HPV18 | L1 | ETQRLVWACA | 155 | 10 | | | | | 4078 |
| HPV18 | L1 | EVPLDICQSI | 280 | 10 | | | | | 4079 |
| HPV18 | L1 | FARHFWNRA | 317 | 9 | | | | | 4080 |
| HPV18 | L1 | FARHFWNRAGT | 317 | 11 | | | | | 4081 |
| HPV18 | L1 | FIFQLCTI | 436 | 8 | | | | | 4082 |
| HPV18 | L1 | FIFQLCTIT | 436 | 9 | | | | | 4083 |
| HPV18 | L1 | FIFQLCTITL | 436 | 10 | | | | | 4084 |
| HPV18 | L1 | FIFQLCTITLT | 436 | 11 | | | | | 4085 |
| HPV18 | L1 | FLRNVNVFPI | 49 | 10 | | | | | 4086 |
| HPV18 | L1 | FQLCTITL | 438 | 8 | | | | | 4087 |
| HPV18 | L1 | FQLCTITLT | 438 | 9 | | | | | 4088 |
| HPV18 | L1 | FQLCTITLTA | 438 | 10 | | | | | 4089 |
| HPV18 | L1 | FVQSVAIT | 482 | 8 | | | | | 4090 |
| HPV18 | L1 | FVTVVDTT | 391 | 8 | | | | | 4091 |
| HPV18 | L1 | FVTVVDTTPST | 391 | 11 | | | | | 4092 |
| HPV18 | L1 | GAMDFSTL | 267 | 8 | | | | | 4093 |
| HPV18 | L1 | GAMDFSTLQDT | 267 | 11 | | | | | 4094 |
| HPV18 | L1 | GLRRKPTI | 535 | 8 | | | | | 4095 |
| HPV18 | L1 | GLSGHPFYNKL | 177 | 11 | | | | | 4096 |
| HPV18 | L1 | GMPASPGSCV | 342 | 10 | | | | | 4097 |
| HPV18 | L1 | GQPLGVGL | 171 | 8 | | | | | 4098 |
| HPV18 | L1 | GTACKSRPL | 233 | 9 | | | | | 4099 |
| HPV18 | L1 | GTMGDTVPQSL | 326 | 11 | | | | | 4100 |
| HPV18 | L1 | GVCWHNQL | 383 | 8 | | | | | 4101 |
| HPV18 | L1 | GVCWHNQLFV | 383 | 10 | | | | | 4102 |
| HPV18 | L1 | GVCWHNQLFVT | 383 | 11 | | | | | 4103 |
| HPV18 | L1 | GVEIGRGQPL | 165 | 10 | | | | | 4104 |
| HPV18 | L1 | GVPPPPTT | 467 | 8 | | | | | 4105 |
| HPV18 | L1 | GVPPPPTTSL | 467 | 10 | | | | | 4106 |
| HPV18 | L1 | GVPPPPTTSLV | 467 | 11 | | | | | 4107 |
| HPV18 | L1 | HAATSNVSEDV | 194 | 11 | | | | | 4108 |
| HPV18 | L1 | HAGSSRLL | 97 | 8 | | | | | 4109 |
| HPV18 | L1 | HAGSSRLLT | 97 | 9 | | | | | 4110 |
| HPV18 | L1 | HAGSSRLLTV | 97 | 10 | | | | | 4111 |
| HPV18 | L1 | HIIICGHYI | 38 | 9 | | | | | 4112 |
| HPV18 | L1 | HIIICGHYII | 38 | 10 | | | | | 4113 |
| HPV18 | L1 | HIIICGHYIIL | 38 | 11 | | | | | 4114 |
| HPV18 | L1 | HLLPLYGPL | 13 | 9 | | | | | 4115 |
| HPV18 | L1 | HVEEYDLQFI | 428 | 10 | | | | | 4116 |
| HPV18 | L1 | IICGHYII | 40 | 8 | | | | | 4117 |
| HPV18 | L1 | IICGHYIIL | 40 | 9 | | | | | 4118 |
| HPV18 | L1 | IICGHYIILFL | 40 | 11 | | | | | 4119 |
| HPV18 | L1 | IIICGHYI | 39 | 8 | | | | | 4120 |
| HPV18 | L1 | IIICGHYII | 39 | 9 | | | | | 4121 |
| HPV18 | L1 | IIICGHYIIL | 39 | 10 | | | | | 4122 |
| HPV18 | L1 | IILFLRNV | 46 | 8 | | | | | 4123 |
| HPV18 | L1 | IILFLRNVNV | 46 | 10 | | | | | 4124 |
| HPV18 | L1 | ILEDWNFGV | 460 | 9 | | | | | 4125 |
| HPV18 | L1 | ILFLRNVNV | 47 | 9 | | | | | 4126 |
| HPV18 | L1 | ILGCAPAI | 219 | 8 | | | | | 4127 |
| HPV18 | L1 | ILHYHLLPL | 9 | 9 | | | | | 4128 |
| HPV18 | L1 | ILVYMVHI | 32 | 8 | | | | | 4129 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | L1 | ILVYMVHII | 32 | 9 | | | | | 4130 |
| HPV18 | L1 | ILVYMVHIII | 32 | 10 | | | | | 4131 |
| HPV18 | L1 | ITCQKDAA | 488 | 8 | | | | | 4132 |
| HPV18 | L1 | ITCQKDAAPA | 488 | 10 | | | | | 4133 |
| HPV18 | L1 | ITLTADVM | 443 | 8 | | | | | 4134 |
| HPV18 | L1 | ITLTADVMSYI | 443 | 11 | | | | | 4135 |
| HPV18 | L1 | IVTSDSQL | 360 | 8 | | | | | 4136 |
| HPV18 | L1 | KAQGHNNGV | 376 | 9 | | | | | 4137 |
| HPV18 | L1 | KLDDTESSHA | 186 | 10 | | | | | 4138 |
| HPV18 | L1 | KLDDTESSHAA | 186 | 11 | | | | | 4139 |
| HPV18 | L1 | KLKFWNVDL | 505 | 9 | | | | | 4140 |
| HPV18 | L1 | KQDIPKVSA | 120 | 9 | | | | | 4141 |
| HPV18 | L1 | KQTQLCIL | 213 | 8 | | | | | 4142 |
| HPV18 | L1 | KQTQLCILGCA | 213 | 11 | | | | | 4143 |
| HPV18 | L1 | KVSAYQYRV | 125 | 9 | | | | | 4144 |
| HPV18 | L1 | LILHYHLL | 8 | 8 | | | | | 4145 |
| HPV18 | L1 | LILHYHLLPL | 8 | 10 | | | | | 4146 |
| HPV18 | L1 | LLPLYGPL | 14 | 8 | | | | | 4147 |
| HPV18 | L1 | LLTVGNPYFRV | 103 | 11 | | | | | 4148 |
| HPV18 | L1 | LQDTKCEV | 274 | 8 | | | | | 4149 |
| HPV18 | L1 | LQDTKCEVPL | 274 | 10 | | | | | 4150 |
| HPV18 | L1 | LQFIFQLCT | 434 | 9 | | | | | 4151 |
| HPV18 | L1 | LQFIFQLCTI | 434 | 10 | | | | | 4152 |
| HPV18 | L1 | LQFIFQLCTIT | 434 | 11 | | | | | 4153 |
| HPV18 | L1 | LTADVMSYI | 445 | 9 | | | | | 4154 |
| HPV18 | L1 | LTICASTQSPV | 403 | 11 | | | | | 4155 |
| HPV18 | L1 | LTVGNPYFRV | 104 | 10 | | | | | 4156 |
| HPV18 | L1 | LVDTYRFV | 476 | 8 | | | | | 4157 |
| HPV18 | L1 | LVDTYRFVQSV | 476 | 11 | | | | | 4158 |
| HPV18 | L1 | LVQAGLRRKPT | 531 | 11 | | | | | 4159 |
| HPV18 | L1 | LVWACAGV | 159 | 8 | | | | | 4160 |
| HPV18 | L1 | LVWACAGVEI | 159 | 10 | | | | | 4161 |
| HPV18 | L1 | LVYMVHII | 33 | 8 | | | | | 4162 |
| HPV18 | L1 | LVYMVHIII | 33 | 9 | | | | | 4163 |
| HPV18 | L1 | MALWRPSDNT | 62 | 10 | | | | | 4164 |
| HPV18 | L1 | MALWRPSDNTV | 62 | 11 | | | | | 4165 |
| HPV18 | L1 | MVDTGYGA | 261 | 8 | | | | | 4166 |
| HPV18 | L1 | MVDTGYGAM | 261 | 9 | | | | | 4167 |
| HPV18 | L1 | MVHIIICGHYI | 36 | 11 | | | | | 4168 |
| HPV18 | L1 | NLTICAST | 402 | 8 | | | | | 4169 |
| HPV18 | L1 | NQLFVTVV | 388 | 8 | | | | | 4170 |
| HPV18 | L1 | NQLFVTVVDT | 388 | 10 | | | | | 4171 |
| HPV18 | L1 | NQLFVTVVDTT | 388 | 11 | | | | | 4172 |
| HPV18 | L1 | NTDDYVTPT | 84 | 9 | | | | | 4173 |
| HPV18 | L1 | NTDDYVTPTSI | 84 | 11 | | | | | 4174 |
| HPV18 | L1 | NTVLEDGDM | 253 | 9 | | | | | 4175 |
| HPV18 | L1 | NTVLEDGDMV | 253 | 10 | | | | | 4176 |
| HPV18 | L1 | NTVYLPPPSV | 70 | 10 | | | | | 4177 |
| HPV18 | L1 | NTVYLPPPSVA | 70 | 11 | | | | | 4178 |
| HPV18 | L1 | NVDLKEKFSL | 510 | 10 | | | | | 4179 |
| HPV18 | L1 | NVFPIFLQM | 54 | 9 | | | | | 4180 |
| HPV18 | L1 | NVFPIFLQMA | 54 | 10 | | | | | 4181 |
| HPV18 | L1 | NVFPIFLQMAL | 54 | 11 | | | | | 4182 |
| HPV18 | L1 | NVNVFPIFL | 52 | 9 | | | | | 4183 |
| HPV18 | L1 | NVNVFPIFLQM | 52 | 11 | | | | | 4184 |
| HPV18 | L1 | NVSEDVRDNV | 199 | 10 | | | | | 4185 |
| HPV18 | L1 | NVSVDYKQT | 207 | 9 | | | | | 4186 |
| HPV18 | L1 | NVSVDYKQTQL | 207 | 11 | | | | | 4187 |
| HPV18 | L1 | PAENKDPYDKL | 496 | 11 | | | | | 4188 |
| HPV18 | L1 | PAGGGNKQDI | 114 | 10 | | | | | 4189 |
| HPV18 | L1 | PAIGEHWA | 224 | 8 | | | | | 4190 |
| HPV18 | L1 | PAIGEHWAKGT | 224 | 11 | | | | | 4191 |
| HPV18 | L1 | PAKRVRVRA | 558 | 9 | | | | | 4192 |
| HPV18 | L1 | PASPGSCV | 344 | 8 | | | | | 4193 |
| HPV18 | L1 | PIFLQMAL | 57 | 8 | | | | | 4194 |
| HPV18 | L1 | PLDICQSI | 282 | 8 | | | | | 4195 |
| HPV18 | L1 | PLELKNTV | 248 | 8 | | | | | 4196 |
| HPV18 | L1 | PLELKNTVL | 248 | 9 | | | | | 4197 |
| HPV18 | L1 | PLGRKFLV | 525 | 8 | | | | | 4198 |
| HPV18 | L1 | PLGRKFLVQA | 525 | 10 | | | | | 4199 |
| HPV18 | L1 | PLHSILVYM | 28 | 9 | | | | | 4200 |
| HPV18 | L1 | PLHSILVYMV | 28 | 10 | | | | | 4201 |
| HPV18 | L1 | PLPLHSIL | 26 | 8 | | | | | 4202 |
| HPV18 | L1 | PLPLHSILV | 26 | 9 | | | | | 4203 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | L1 | PLPLHSILVYM | 26 | 11 | | | | | 4204 |
| HPV18 | L1 | PLSQGDCPPL | 240 | 10 | | | | | 4205 |
| HPV18 | L1 | PLYHPRPL | 20 | 8 | | | | | 4206 |
| HPV18 | L1 | PLYHPRPLPL | 20 | 10 | | | | | 4207 |
| HPV18 | L1 | PQSLYIKGT | 333 | 9 | | | | | 4208 |
| HPV18 | L1 | PQSLYIKGTGM | 333 | 11 | | | | | 4209 |
| HPV18 | L1 | PTIGPRKRSA | 540 | 10 | | | | | 4210 |
| HPV18 | L1 | PTSIFYHA | 91 | 8 | | | | | 4211 |
| HPV18 | L1 | PTTSLVDT | 472 | 8 | | | | | 4212 |
| HPV18 | L1 | PVPGQYDA | 412 | 8 | | | | | 4213 |
| HPV18 | L1 | PVPGQYDAT | 412 | 9 | | | | | 4214 |
| HPV18 | L1 | QAGLRRKPT | 533 | 9 | | | | | 4215 |
| HPV18 | L1 | QAGLRRKPTI | 533 | 10 | | | | | 4216 |
| HPV18 | L1 | QLCILGCA | 216 | 8 | | | | | 4217 |
| HPV18 | L1 | QLCILGCAPA | 216 | 10 | | | | | 4218 |
| HPV18 | L1 | QLCILGCAPAI | 216 | 11 | | | | | 4219 |
| HPV18 | L1 | QLCTITLT | 439 | 8 | | | | | 4220 |
| HPV18 | L1 | QLCTITLTA | 439 | 9 | | | | | 4221 |
| HPV18 | L1 | QLCTITLTADV | 439 | 11 | | | | | 4222 |
| HPV18 | L1 | QLFARHFWNRA | 315 | 11 | | | | | 4223 |
| HPV18 | L1 | QLFNKPYWL | 366 | 9 | | | | | 4224 |
| HPV18 | L1 | QLFVTVVDT | 389 | 9 | | | | | 4225 |
| HPV18 | L1 | QLFVTVVDTT | 389 | 10 | | | | | 4226 |
| HPV18 | L1 | QLPDPNKFGL | 137 | 10 | | | | | 4227 |
| HPV18 | L1 | QMALWRPSDNT | 61 | 11 | | | | | 4228 |
| HPV18 | L1 | QMSADPYGDSM | 297 | 11 | | | | | 4229 |
| HPV18 | L1 | QTQLCILGCA | 214 | 10 | | | | | 4230 |
| HPV18 | L1 | RAGTMGDT | 324 | 8 | | | | | 4231 |
| HPV18 | L1 | RAGTMGDTV | 324 | 9 | | | | | 4232 |
| HPV18 | L1 | RLVWACAGV | 158 | 9 | | | | | 4233 |
| HPV18 | L1 | RLVWACAGVEI | 158 | 11 | | | | | 4234 |
| HPV18 | L1 | RVLILHYHL | 6 | 9 | | | | | 4235 |
| HPV18 | L1 | RVLILHYHLL | 6 | 10 | | | | | 4236 |
| HPV18 | L1 | RVVNTDDYV | 81 | 9 | | | | | 4237 |
| HPV18 | L1 | RVVNTDDYVT | 81 | 10 | | | | | 4238 |
| HPV18 | L1 | SADPYGDSM | 299 | 9 | | | | | 4239 |
| HPV18 | L1 | SATTSSKPA | 551 | 9 | | | | | 4240 |
| HPV18 | L1 | SAYQYRVFRV | 127 | 10 | | | | | 4241 |
| HPV18 | L1 | SICKYPDYL | 288 | 9 | | | | | 4242 |
| HPV18 | L1 | SICKYPPYLQM | 288 | 11 | | | | | 4243 |
| HPV18 | L1 | SIFYHAGSSRL | 93 | 11 | | | | | 4244 |
| HPV18 | L1 | SILEDWNFGV | 459 | 10 | | | | | 4245 |
| HPV18 | L1 | SILVYMVHI | 31 | 9 | | | | | 4246 |
| HPV18 | L1 | SILVYMVHII | 31 | 10 | | | | | 4247 |
| HPV18 | L1 | SILVYMVHIII | 31 | 11 | | | | | 4248 |
| HPV18 | L1 | SIVTSDSQL | 359 | 9 | | | | | 4249 |
| HPV18 | L1 | SIYNPETQRL | 150 | 10 | | | | | 4250 |
| HPV18 | L1 | SIYNPETQRLV | 150 | 11 | | | | | 4251 |
| HPV18 | L1 | SLDLDQYPL | 518 | 9 | | | | | 4252 |
| HPV18 | L1 | SLVDTYRFV | 475 | 9 | | | | | 4253 |
| HPV18 | L1 | SLYIKGTGM | 335 | 9 | | | | | 4254 |
| HPV18 | L1 | SLYIKGTGMPA | 335 | 11 | | | | | 4255 |
| HPV18 | L1 | SMFFCLRREQL | 306 | 11 | | | | | 4256 |
| HPV18 | L1 | SQGDCPPL | 242 | 8 | | | | | 4257 |
| HPV18 | L1 | SQGDCPPLEL | 242 | 10 | | | | | 4258 |
| HPV18 | L1 | SQLFNKPYWL | 365 | 10 | | | | | 4259 |
| HPV18 | L1 | STLQDTKCEV | 272 | 10 | | | | | 4260 |
| HPV18 | L1 | STNLTICA | 400 | 8 | | | | | 4261 |
| HPV18 | L1 | STNLTICAST | 400 | 10 | | | | | 4262 |
| HPV18 | L1 | SVAITCQKDA | 485 | 10 | | | | | 4263 |
| HPV18 | L1 | SVAITCQKDAA | 485 | 11 | | | | | 4264 |
| HPV18 | L1 | SVARVVNT | 78 | 8 | | | | | 4265 |
| HPV18 | L1 | SVDYKQTQL | 209 | 9 | | | | | 4266 |
| HPV18 | L1 | SVDYKQTQLCI | 209 | 11 | | | | | 4267 |
| HPV18 | L1 | TACKSRPL | 234 | 8 | | | | | 4268 |
| HPV18 | L1 | TADVMSYI | 446 | 8 | | | | | 4269 |
| HPV18 | L1 | TADVMSYIHSM | 446 | 11 | | | | | 4270 |
| HPV18 | L1 | TICASTQSPV | 404 | 10 | | | | | 4271 |
| HPV18 | L1 | TIGPRKRSA | 541 | 9 | | | | | 4272 |
| HPV18 | L1 | TITLTADV | 442 | 8 | | | | | 4273 |
| HPV18 | L1 | TITLTADVM | 442 | 9 | | | | | 4274 |
| HPV18 | L1 | TLQDTKCEV | 273 | 9 | | | | | 4275 |
| HPV18 | L1 | TLQDTKCEVPL | 273 | 11 | | | | | 4276 |
| HPV18 | L1 | TLTADVMSYI | 444 | 10 | | | | | 4277 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | L1 | TMGDTVPQSL | 327 | 10 | | | | | 4278 |
| HPV18 | L1 | TQLCILGCA | 215 | 9 | | | | | 4279 |
| HPV18 | L1 | TQLCILGCAPA | 215 | 11 | | | | | 4280 |
| HPV18 | L1 | TQRLVWACA | 156 | 9 | | | | | 4281 |
| HPV18 | L1 | TQRLVWACAGV | 156 | 11 | | | | | 4282 |
| HPV18 | L1 | TQSPVPGQYDA | 409 | 11 | | | | | 4283 |
| HPV18 | L1 | TTPSTNLT | 397 | 8 | | | | | 4284 |
| HPV18 | L1 | TTPSTNLTI | 397 | 9 | | | | | 4285 |
| HPV18 | L1 | TTPSTNLTICA | 397 | 11 | | | | | 4286 |
| HPV18 | L1 | TTSLVDTYRFV | 473 | 11 | | | | | 4287 |
| HPV18 | L1 | TTSSKPAKRV | 553 | 10 | | | | | 4288 |
| HPV18 | L1 | TVGNPYFRV | 105 | 9 | | | | | 4289 |
| HPV18 | L1 | TVGNPYFRVPA | 105 | 11 | | | | | 4290 |
| HPV18 | L1 | TVLEDGDM | 254 | 8 | | | | | 4291 |
| HPV18 | L1 | TVLEDGDMV | 254 | 9 | | | | | 4292 |
| HPV18 | L1 | TVLEDGDMVDT | 254 | 11 | | | | | 4293 |
| HPV18 | L1 | TVPQSLYI | 331 | 8 | | | | | 4294 |
| HPV18 | L1 | TVPQSLYIKGT | 331 | 11 | | | | | 4295 |
| HPV18 | L1 | TVVDTTPST | 393 | 9 | | | | | 4296 |
| HPV18 | L1 | TVVDTTPSTNL | 393 | 11 | | | | | 4297 |
| HPV18 | L1 | TVYLPPPSV | 71 | 9 | | | | | 4298 |
| HPV18 | L1 | TVYLPPPSVA | 71 | 10 | | | | | 4299 |
| HPV18 | L1 | VAITCQKDA | 486 | 9 | | | | | 4300 |
| HPV18 | L1 | VAITCQKDAA | 486 | 10 | | | | | 4301 |
| HPV18 | L1 | VARVVNTDDYV | 79 | 11 | | | | | 4302 |
| HPV18 | L1 | VLEDGDMV | 255 | 8 | | | | | 4303 |
| HPV18 | L1 | VLEDGDMVDT | 255 | 10 | | | | | 4304 |
| HPV18 | L1 | VLILHYHL | 7 | 8 | | | | | 4305 |
| HPV18 | L1 | VLILHYHLL | 7 | 9 | | | | | 4306 |
| HPV18 | L1 | VLILHYHLLPL | 7 | 11 | | | | | 4307 |
| HPV18 | L1 | VMSYIHSM | 449 | 8 | | | | | 4308 |
| HPV18 | L1 | VQAGLRRKPT | 532 | 10 | | | | | 4309 |
| HPV18 | L1 | VQAGLRRKPTI | 532 | 11 | | | | | 4310 |
| HPV18 | L1 | VQLPDNKFGL | 136 | 11 | | | | | 4311 |
| HPV18 | L1 | VTPTSIFYHA | 89 | 10 | | | | | 4312 |
| HPV18 | L1 | VTVVDTTPST | 392 | 10 | | | | | 4313 |
| HPV18 | L1 | VVDTTPST | 394 | 8 | | | | | 4314 |
| HPV18 | L1 | VVDTTPSTNL | 394 | 10 | | | | | 4315 |
| HPV18 | L1 | VVDTTPSTNLT | 394 | 11 | | | | | 4316 |
| HPV18 | L1 | VVNTDDYV | 82 | 8 | | | | | 4317 |
| HPV18 | L1 | VVNTDDYVT | 82 | 9 | | | | | 4318 |
| HPV18 | L1 | VVNTDDYVTPT | 82 | 11 | | | | | 4319 |
| HPV18 | L1 | WACAGVEI | 161 | 8 | | | | | 4320 |
| HPV18 | L1 | YIHSMNSSI | 452 | 9 | | | | | 4321 |
| HPV18 | L1 | YIHSMNSSIL | 452 | 10 | | | | | 4322 |
| HPV18 | L1 | YIILFLRNV | 45 | 9 | | | | | 4323 |
| HPV18 | L1 | YIILFLRNVNV | 45 | 11 | | | | | 4324 |
| HPV18 | L1 | YIKGTGMPA | 337 | 9 | | | | | 4325 |
| HPV18 | L1 | YLPPPSVA | 73 | 8 | | | | | 4326 |
| HPV18 | L1 | YLPPPSVARV | 73 | 10 | | | | | 4327 |
| HPV18 | L1 | YLPPPSVARVV | 73 | 11 | | | | | 4328 |
| HPV18 | L1 | YQYRVFRV | 129 | 8 | | | | | 4329 |
| HPV18 | L1 | YQYRVFRVQL | 129 | 10 | | | | | 4330 |
| HPV18 | L1 | YTRVLILHYL | 4 | 11 | | | | | 4331 |
| HPV18 | L1 | YVTPTSIFYHA | 88 | 11 | | | | | 4332 |
| HPV18 | L2 | AARRKRASV | 6 | 9 | | | | | 4333 |
| HPV18 | L2 | AARRKRASVT | 6 | 10 | | | | | 4334 |
| HPV18 | L2 | ALTSRRGT | 286 | 8 | | | | | 4335 |
| HPV18 | L2 | ALTSRRGTV | 286 | 9 | | | | | 4336 |
| HPV18 | L2 | ATEDNDLFDI | 341 | 10 | | | | | 4337 |
| HPV18 | L2 | ATMFTRSGT | 303 | 9 | | | | | 4338 |
| HPV18 | L2 | ATMFTRSGTQI | 303 | 11 | | | | | 4339 |
| HPV18 | L2 | AVLDITPSST | 139 | 10 | | | | | 4340 |
| HPV18 | L2 | AVPVPSRST | 358 | 9 | | | | | 4341 |
| HPV18 | L2 | AVPVPSRSTT | 358 | 10 | | | | | 4342 |
| HPV18 | L2 | DIIRLHRPA | 278 | 9 | | | | | 4343 |
| HPV18 | L2 | DIIRLHRPAL | 278 | 10 | | | | | 4344 |
| HPV18 | L2 | DIIRLHRPALT | 278 | 11 | | | | | 4345 |
| HPV18 | L2 | DITLPSTT | 404 | 8 | | | | | 4346 |
| HPV18 | L2 | DITLPSTTSV | 404 | 10 | | | | | 4347 |
| HPV18 | L2 | DITPSSTSV | 142 | 9 | | | | | 4348 |
| HPV18 | L2 | DITPSSTSVSI | 142 | 11 | | | | | 4349 |
| HPV18 | L2 | DITSAGTT | 129 | 8 | | | | | 4350 |
| HPV18 | L2 | DITSAGTTT | 129 | 9 | | | | | 4351 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | L2 | DITSAGTTTPA | 129 | 11 | | | | | 4352 |
| HPV18 | L2 | DIYADDMDPA | 349 | 10 | | | | | 4353 |
| HPV18 | L2 | DIYADDMDPAV | 349 | 11 | | | | | 4354 |
| HPV18 | L2 | DLFDIYADDM | 346 | 10 | | | | | 4355 |
| HPV18 | L2 | DLYKTCKQSGT | 16 | 11 | | | | | 4356 |
| HPV18 | L2 | DMDPAVPV | 354 | 8 | | | | | 4357 |
| HPV18 | L2 | DVGTRPPV | 83 | 9 | | | | | 4358 |
| HPV18 | L2 | DVGPTRPPVV | 83 | 10 | | | | | 4359 |
| HPV18 | L2 | DVGPTRPPVVI | 83 | 11 | | | | | 4360 |
| HPV18 | L2 | DVPDSDFM | 270 | 8 | | | | | 4361 |
| HPV18 | L2 | DVPDSDFMDI | 270 | 10 | | | | | 4362 |
| HPV18 | L2 | DVPDSDFMDII | 270 | 11 | | | | | 4363 |
| HPV18 | L2 | DVPVYTGPDI | 396 | 10 | | | | | 4364 |
| HPV18 | L2 | DVPVYTGPDIT | 396 | 11 | | | | | 4365 |
| HPV18 | L2 | DVVPKVEGT | 30 | 9 | | | | | 4366 |
| HPV18 | L2 | DVVPKVEGTT | 30 | 10 | | | | | 4367 |
| HPV18 | L2 | DVVPKVEGTTL | 30 | 11 | | | | | 4368 |
| HPV18 | L2 | EIPLQTFA | 194 | 8 | | | | | 4369 |
| HPV18 | L2 | ELQPLVSA | 334 | 8 | | | | | 4370 |
| HPV18 | L2 | ELQPLVSAT | 334 | 9 | | | | | 4371 |
| HPV18 | L2 | EVAGNVFV | 175 | 8 | | | | | 4372 |
| HPV18 | L2 | EVAGNVFVGT | 175 | 10 | | | | | 4373 |
| HPV18 | L2 | EVPQTGEV | 169 | 8 | | | | | 4374 |
| HPV18 | L2 | EVPQTGEVA | 169 | 9 | | | | | 4375 |
| HPV18 | L2 | FADGFVAA | 455 | 8 | | | | | 4376 |
| HPV18 | L2 | FAFFKYSPT | 369 | 9 | | | | | 4377 |
| HPV18 | L2 | FAFFKYSPTI | 369 | 10 | | | | | 4378 |
| HPV18 | L2 | FASSGTGEEPI | 200 | 11 | | | | | 4379 |
| HPV18 | L2 | FIPKKRKRV | 443 | 9 | | | | | 4380 |
| HPV18 | L2 | FLGGLGIGT | 53 | 9 | | | | | 4381 |
| HPV18 | L2 | FLTRPSSL | 241 | 8 | | | | | 4382 |
| HPV18 | L2 | FLTRPSSLI | 241 | 9 | | | | | 4383 |
| HPV18 | L2 | FLTRPSSLIT | 241 | 10 | | | | | 4384 |
| HPV18 | L2 | FMDIIRLHRPA | 276 | 11 | | | | | 4385 |
| HPV18 | L2 | FTGTSGFDI | 122 | 9 | | | | | 4386 |
| HPV18 | L2 | FTGTSGFDIT | 122 | 10 | | | | | 4387 |
| HPV18 | L2 | FTNPAFSDPSI | 157 | 11 | | | | | 4388 |
| HPV18 | L2 | FTRSGTQI | 306 | 8 | | | | | 4389 |
| HPV18 | L2 | FTRSGTQIGA | 306 | 10 | | | | | 4390 |
| HPV18 | L2 | FVGTPTSGT | 181 | 9 | | | | | 4391 |
| HPV18 | L2 | GAPRPTFT | 116 | 8 | | | | | 4392 |
| HPV18 | L2 | GAPRPTFTGT | 116 | 10 | | | | | 4393 |
| HPV18 | L2 | GARVHFYHDI | 314 | 10 | | | | | 4394 |
| HPV18 | L2 | GIFLGGLGI | 51 | 9 | | | | | 4395 |
| HPV18 | L2 | GIFLGGLGIGT | 51 | 11 | | | | | 4396 |
| HPV18 | L2 | GIGTGSGT | 58 | 8 | | | | | 4397 |
| HPV18 | L2 | GIHGTHYYL | 429 | 9 | | | | | 4398 |
| HPV18 | L2 | GLGIGTGSGT | 56 | 10 | | | | | 4399 |
| HPV18 | L2 | GQRATMFT | 30 | 8 | | | | | 4400 |
| HPV18 | L2 | GTCPPDVV | 25 | 8 | | | | | 4401 |
| HPV18 | L2 | GTCPPDVVPKV | 25 | 11 | | | | | 4402 |
| HPV18 | L2 | GTGEEPISST | 204 | 10 | | | | | 4403 |
| HPV18 | L2 | GTGGRTGYI | 64 | 9 | | | | | 4404 |
| HPV18 | L2 | GTGGRTGYIPL | 64 | 11 | | | | | 4405 |
| HPV18 | L2 | GTGSGTGGRT | 60 | 10 | | | | | 4406 |
| HPV18 | L2 | GTHGYEEI | 188 | 8 | | | | | 4407 |
| HPV18 | L2 | GTHGYEEIPL | 188 | 10 | | | | | 4408 |
| HPV18 | L2 | GTHYYLWPL | 432 | 9 | | | | | 4409 |
| HPV18 | L2 | GTQIGARV | 310 | 8 | | | | | 4410 |
| HPV18 | L2 | GTSGFDIT | 124 | 8 | | | | | 4411 |
| HPV18 | L2 | GTSGFDITSA | 124 | 10 | | | | | 4412 |
| HPV18 | L2 | GTTLADKI | 37 | 8 | | | | | 4413 |
| HPV18 | L2 | GTTLADKIL | 37 | 9 | | | | | 4414 |
| HPV18 | L2 | GTTTPAVL | 134 | 8 | | | | | 4415 |
| HPV18 | L2 | GTTTPAVLDI | 134 | 10 | | | | | 4416 |
| HPV18 | L2 | GTTTPAVLDIT | 134 | 11 | | | | | 4417 |
| HPV18 | L2 | GTVRFSRL | 292 | 8 | | | | | 4418 |
| HPV18 | L2 | IAPSPEYI | 326 | 8 | | | | | 4419 |
| HPV18 | L2 | IAPSPEYIEL | 326 | 10 | | | | | 4420 |
| HPV18 | L2 | IIEVPQTGEV | 167 | 10 | | | | | 4421 |
| HPV18 | L2 | IIEVPQTGEVA | 167 | 11 | | | | | 4422 |
| HPV18 | L2 | IIRLHRPA | 279 | 8 | | | | | 4423 |
| HPV18 | L2 | IIRLHRPAL | 279 | 9 | | | | | 4424 |
| HPV18 | L2 | IIRLHRPALT | 279 | 10 | | | | | 4425 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | L2 | ILQWSSLGI | 44 | 9 | | | | | 4426 |
| HPV18 | L2 | ILQWSSLGIFL | 44 | 11 | | | | | 4427 |
| HPV18 | L2 | ITLPSTTSV | 405 | 9 | | | | | 4428 |
| HPV18 | L2 | ITPSSTSV | 143 | 8 | | | | | 4429 |
| HPV18 | L2 | ITPSSTSVSI | 143 | 10 | | | | | 4430 |
| HPV18 | L2 | ITSAGTTT | 130 | 8 | | | | | 4431 |
| HPV18 | L2 | ITSAGTTTPA | 130 | 10 | | | | | 4432 |
| HPV18 | L2 | ITSAGTTTPAV | 130 | 11 | | | | | 4433 |
| HPV18 | L2 | ITYDNPAFEPV | 249 | 11 | | | | | 4434 |
| HPV18 | L2 | IVSPTAPA | 416 | 8 | | | | | 4435 |
| HPV18 | L2 | IVSPTAPAST | 416 | 10 | | | | | 4436 |
| HPV18 | L2 | IVTLIEDSSV | 103 | 10 | | | | | 4437 |
| HPV18 | L2 | IVTLIEDSSVV | 103 | 11 | | | | | 4438 |
| HPV18 | L2 | KILQWSSL | 43 | 8 | | | | | 4439 |
| HPV18 | L2 | KILQWSSLGI | 43 | 10 | | | | | 4440 |
| HPV18 | L2 | KQSGTCPPDV | 22 | 10 | | | | | 4441 |
| HPV18 | L2 | KQSGTCPPDVV | 22 | 11 | | | | | 4442 |
| HPV18 | L2 | KTCKQSGT | 19 | 8 | | | | | 4443 |
| HPV18 | L2 | KVEGTTLA | 34 | 8 | | | | | 4444 |
| HPV18 | L2 | KVEGTTLADKI | 34 | 11 | | | | | 4445 |
| HPV18 | L2 | LADKILQWSSL | 40 | 11 | | | | | 4446 |
| HPV18 | L2 | LIEDSSVV | 106 | 8 | | | | | 4447 |
| HPV18 | L2 | LIEDSSVVT | 106 | 9 | | | | | 4448 |
| HPV18 | L2 | LITYDNPA | 248 | 8 | | | | | 4449 |
| HPV18 | L2 | LQPLVSAT | 335 | 8 | | | | | 4450 |
| HPV18 | L2 | LQTFASSGT | 197 | 9 | | | | | 4451 |
| HPV18 | L2 | LQWSSLGI | 45 | 8 | | | | | 4452 |
| HPV18 | L2 | LQWSSLGIFL | 45 | 10 | | | | | 4453 |
| HPV18 | L2 | LTFDPRSDV | 263 | 9 | | | | | 4454 |
| HPV18 | L2 | LTRPSSLI | 242 | 8 | | | | | 4455 |
| HPV18 | L2 | LTRPSSLIT | 242 | 9 | | | | | 4456 |
| HPV18 | L2 | LTSRRGTV | 287 | 8 | | | | | 4457 |
| HPV18 | L2 | LTSSWDVPV | 391 | 9 | | | | | 4458 |
| HPV18 | L2 | LTSSWDVPVYT | 391 | 11 | | | | | 4459 |
| HPV18 | L2 | LVSATEDNDL | 338 | 10 | | | | | 4460 |
| HPV18 | L2 | NTVVDVGPT | 79 | 9 | | | | | 4461 |
| HPV18 | L2 | NVFVGTPT | 179 | 8 | | | | | 4462 |
| HPV18 | L2 | NVFVGTPTSGT | 179 | 11 | | | | | 4463 |
| HPV18 | L2 | PAFEPVDT | 254 | 8 | | | | | 4464 |
| HPV18 | L2 | PAFEPVDTT | 254 | 9 | | | | | 4465 |
| HPV18 | L2 | PAFEPVDTTL | 254 | 10 | | | | | 4466 |
| HPV18 | L2 | PAFEPVDTTLT | 254 | 11 | | | | | 4467 |
| HPV18 | L2 | PAFSDPSI | 160 | 8 | | | | | 4468 |
| HPV18 | L2 | PAFSDPSII | 160 | 9 | | | | | 4469 |
| HPV18 | L2 | PAFSDPSIIEV | 160 | 11 | | | | | 4470 |
| HPV18 | L2 | PALTSRRGT | 285 | 9 | | | | | 4471 |
| HPV18 | L2 | PALTSRRGTV | 285 | 10 | | | | | 4472 |
| HPV18 | L2 | PASTQYIGI | 422 | 9 | | | | | 4473 |
| HPV18 | L2 | PAVLDITPSST | 138 | 11 | | | | | 4474 |
| HPV18 | L2 | PAVPVPSRST | 357 | 10 | | | | | 4475 |
| HPV18 | L2 | PAVPVPSRSTT | 357 | 11 | | | | | 4476 |
| HPV18 | L2 | PIAPSPEYI | 325 | 9 | | | | | 4477 |
| HPV18 | L2 | PIAPSPEYIEL | 325 | 11 | | | | | 4478 |
| HPV18 | L2 | PISSTPLPT | 209 | 9 | | | | | 4479 |
| HPV18 | L2 | PISSTPLPTV | 209 | 10 | | | | | 4480 |
| HPV18 | L2 | PIVSPTAPA | 415 | 9 | | | | | 4481 |
| HPV18 | L2 | PIVSPTAPAST | 415 | 11 | | | | | 4482 |
| HPV18 | L2 | PLGGRSNT | 73 | 8 | | | | | 4483 |
| HPV18 | L2 | PLGGRSNTV | 73 | 9 | | | | | 4484 |
| HPV18 | L2 | PLGGRSNTVV | 73 | 10 | | | | | 4485 |
| HPV18 | L2 | PLPTVRRV | 214 | 8 | | | | | 4486 |
| HPV18 | L2 | PLPTVRRVA | 214 | 9 | | | | | 4487 |
| HPV18 | L2 | PLQTFASSGT | 196 | 10 | | | | | 4488 |
| HPV18 | L2 | PLTSSWDV | 390 | 8 | | | | | 4489 |
| HPV18 | L2 | PLTSSWDVPV | 390 | 10 | | | | | 4490 |
| HPV18 | L2 | PLVSATEDNDL | 337 | 11 | | | | | 4491 |
| HPV18 | L2 | PQTGEVAGNV | 171 | 10 | | | | | 4492 |
| HPV18 | L2 | PTAPASTQYI | 419 | 10 | | | | | 4493 |
| HPV18 | L2 | PTDPSIVT | 98 | 8 | | | | | 4494 |
| HPV18 | L2 | PTDPSIVTL | 98 | 9 | | | | | 4495 |
| HPV18 | L2 | PTDPSIVTLI | 98 | 10 | | | | | 4496 |
| HPV18 | L2 | PTFTGTSGFDI | 120 | 11 | | | | | 4497 |
| HPV18 | L2 | PTRPPVVI | 86 | 8 | | | | | 4498 |
| HPV18 | L2 | PTRPPVVIEPV | 86 | 11 | | | | | 4499 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | L2 | PTSGTHGYEEI | 185 | 11 | | | | | 4500 |
| HPV18 | L2 | PTVRRVAGPRL | 216 | 11 | | | | | 4501 |
| HPV18 | L2 | PVGPTDPSI | 95 | 9 | | | | | 4502 |
| HPV18 | L2 | PVGPTDPSIV | 95 | 10 | | | | | 4503 |
| HPV18 | L2 | PVGPTDPSIVT | 95 | 11 | | | | | 4504 |
| HPV18 | L2 | PVPSRSTT | 360 | 8 | | | | | 4505 |
| HPV18 | L2 | PVPSRSTTSFA | 360 | 11 | | | | | 4506 |
| HPV18 | L2 | PVVIEPVGPT | 90 | 10 | | | | | 4507 |
| HPV18 | L2 | PVYTGPDI | 398 | 8 | | | | | 4508 |
| HPV18 | L2 | PVYTGPDIT | 398 | 9 | | | | | 4509 |
| HPV18 | L2 | PVYTGPDITL | 398 | 10 | | | | | 4510 |
| HPV18 | L2 | QQVSVANPEFL | 232 | 11 | | | | | 4511 |
| HPV18 | L2 | QTFASSGT | 198 | 8 | | | | | 4512 |
| HPV18 | L2 | QTGEVAGNV | 172 | 9 | | | | | 4513 |
| HPV18 | L2 | QTGEVAGNVFV | 172 | 11 | | | | | 4514 |
| HPV18 | L2 | QVSVANPEFL | 233 | 10 | | | | | 4515 |
| HPV18 | L2 | QVSVANPEFLT | 233 | 11 | | | | | 4516 |
| HPV18 | L2 | RAARRKRA | 5 | 8 | | | | | 4517 |
| HPV18 | L2 | RAARRKRASV | 5 | 10 | | | | | 4518 |
| HPV18 | L2 | RAARRKRASVT | 5 | 11 | | | | | 4519 |
| HPV18 | L2 | RASVTDLYKT | 11 | 10 | | | | | 4520 |
| HPV18 | L2 | RATMFTRSGT | 302 | 10 | | | | | 4521 |
| HPV18 | L2 | RAYQQVSV | 229 | 8 | | | | | 4522 |
| HPV18 | L2 | RAYQQVSVA | 229 | 9 | | | | | 4523 |
| HPV18 | L2 | RLGQRATM | 298 | 8 | | | | | 4524 |
| HPV18 | L2 | RLGQRATMFT | 298 | 10 | | | | | 4525 |
| HPV18 | L2 | RLHRPALT | 281 | 8 | | | | | 4526 |
| HPV18 | L2 | RLYSRAYQQV | 225 | 10 | | | | | 4527 |
| HPV18 | L2 | RVAGPRLYSRA | 220 | 11 | | | | | 4528 |
| HPV18 | L2 | RVHFYHDI | 316 | 8 | | | | | 4529 |
| HPV18 | L2 | RVHFYHDISPI | 316 | 11 | | | | | 4530 |
| HPV18 | L2 | RVPYFFADGFV | 450 | 11 | | | | | 4531 |
| HPV18 | L2 | SAGTTTPA | 132 | 8 | | | | | 4532 |
| HPV18 | L2 | SAGTTTPAV | 132 | 9 | | | | | 4533 |
| HPV18 | L2 | SAGTTTPAVL | 132 | 10 | | | | | 4534 |
| HPV18 | L2 | SASSYSNV | 380 | 8 | | | | | 4535 |
| HPV18 | L2 | SASSYSNVT | 380 | 9 | | | | | 4536 |
| HPV18 | L2 | SASSYSNVTV | 380 | 10 | | | | | 4537 |
| HPV18 | L2 | SATEDNDL | 340 | 8 | | | | | 4538 |
| HPV18 | L2 | SATEDNDLFDI | 340 | 11 | | | | | 4539 |
| HPV18 | L2 | SIIEVPQT | 166 | 8 | | | | | 4540 |
| HPV18 | L2 | SIIEVPQTGEV | 166 | 11 | | | | | 4541 |
| HPV18 | L2 | SISTTNFT | 151 | 8 | | | | | 4542 |
| HPV18 | L2 | SISTTNFTNPA | 151 | 11 | | | | | 4543 |
| HPV18 | L2 | SIVTLIEDSSV | 102 | 11 | | | | | 4544 |
| HPV18 | L2 | SLGIFLGGL | 49 | 9 | | | | | 4545 |
| HPV18 | L2 | SLGIFLGGLGI | 49 | 11 | | | | | 4546 |
| HPV18 | L2 | SLITYDNPA | 247 | 9 | | | | | 4547 |
| HPV18 | L2 | STPLPTVRRV | 212 | 10 | | | | | 4548 |
| HPV18 | L2 | STPLPTVRRVA | 212 | 11 | | | | | 4549 |
| HPV18 | L2 | STQYIGIHGT | 424 | 10 | | | | | 4550 |
| HPV18 | L2 | STSVSIST | 147 | 8 | | | | | 4551 |
| HPV18 | L2 | STSVSISTT | 147 | 9 | | | | | 4552 |
| HPV18 | L2 | STTNFTNPA | 153 | 9 | | | | | 4553 |
| HPV18 | L2 | STTSVWPI | 409 | 8 | | | | | 4554 |
| HPV18 | L2 | STTSVWPIV | 409 | 9 | | | | | 4555 |
| HPV18 | L2 | SVANPEFL | 235 | 8 | | | | | 4556 |
| HPV18 | L2 | SVANPEFLT | 235 | 9 | | | | | 4557 |
| HPV18 | L2 | SVSISTTNFT | 149 | 10 | | | | | 4558 |
| HPV18 | L2 | SVTDLYKT | 13 | 8 | | | | | 4559 |
| HPV18 | L2 | SVVTSGAPRPT | 111 | 11 | | | | | 4560 |
| HPV18 | L2 | SVWPIVSPT | 412 | 9 | | | | | 4561 |
| HPV18 | L2 | SVWPIVSPTA | 412 | 10 | | | | | 4562 |
| HPV18 | L2 | TAPASTQYI | 420 | 9 | | | | | 4563 |
| HPV18 | L2 | TAPASTQYIGI | 420 | 11 | | | | | 4564 |
| HPV18 | L2 | TISSASSYSNV | 377 | 11 | | | | | 4565 |
| HPV18 | L2 | TLIEDSSV | 105 | 8 | | | | | 4566 |
| HPV18 | L2 | TLIEDSSVV | 105 | 9 | | | | | 4567 |
| HPV18 | L2 | TLIEDSSVVT | 105 | 10 | | | | | 4568 |
| HPV18 | L2 | TLPSTTSV | 406 | 8 | | | | | 4569 |
| HPV18 | L2 | TLPSTTSVWPI | 406 | 11 | | | | | 4570 |
| HPV18 | L2 | TLTFDPRSDV | 262 | 10 | | | | | 4571 |
| HPV18 | L2 | TMFTRSGT | 304 | 8 | | | | | 4572 |
| HPV18 | L2 | TMFTRSGTQI | 304 | 10 | | | | | 4573 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV18 | L2 | TQYIGIHGT | 425 | 9 | | | | | 4574 |
| HPV18 | L2 | TTLADKIL | 38 | 8 | | | | | 4575 |
| HPV18 | L2 | TTLTFDPRSDV | 261 | 11 | | | | | 4576 |
| HPV18 | L2 | TTNFTNPA | 154 | 8 | | | | | 4577 |
| HPV18 | L2 | TTPAVLDI | 136 | 8 | | | | | 4578 |
| HPV18 | L2 | TTPAVLDIT | 136 | 9 | | | | | 4579 |
| HPV18 | L2 | TTSVWPIV | 410 | 8 | | | | | 4580 |
| HPV18 | L2 | TTSVWPIVSPT | 410 | 11 | | | | | 4581 |
| HPV18 | L2 | TTTPAVLDI | 135 | 9 | | | | | 4582 |
| HPV18 | L2 | TTTPAVLDIT | 135 | 10 | | | | | 4583 |
| HPV18 | L2 | TVPLTSSWDV | 388 | 10 | | | | | 4584 |
| HPV18 | L2 | TVRFSRLGQRA | 293 | 11 | | | | | 4585 |
| HPV18 | L2 | TVRRVAGPRL | 217 | 10 | | | | | 4586 |
| HPV18 | L2 | TVVDVGPT | 80 | 8 | | | | | 4587 |
| HPV18 | L2 | VAGNVFVGT | 176 | 9 | | | | | 4588 |
| HPV18 | L2 | VAGNVFVGTPT | 176 | 11 | | | | | 4589 |
| HPV18 | L2 | VAGPRLYSRA | 221 | 10 | | | | | 4590 |
| HPV18 | L2 | VANPEFLT | 236 | 8 | | | | | 4591 |
| HPV18 | L2 | VIEPVGPT | 92 | 8 | | | | | 4592 |
| HPV18 | L2 | VLDITPSST | 140 | 9 | | | | | 4593 |
| HPV18 | L2 | VLDITPSSTSV | 140 | 11 | | | | | 4594 |
| HPV18 | L2 | VTLIEDSSV | 104 | 9 | | | | | 4595 |
| HPV18 | L2 | VTLIEDSSVV | 104 | 10 | | | | | 4596 |
| HPV18 | L2 | VTLIEDSSVVT | 104 | 11 | | | | | 4597 |
| HPV18 | L2 | VTSGAPRPT | 113 | 9 | | | | | 4598 |
| HPV18 | L2 | VTSGAPRPTFT | 113 | 11 | | | | | 4599 |
| HPV18 | L2 | VTVPLTSSWDV | 387 | 11 | | | | | 4600 |
| HPV18 | L2 | VVDVGPTRPPV | 81 | 11 | | | | | 4601 |
| HPV18 | L2 | VVIEPVGPT | 91 | 9 | | | | | 4602 |
| HPV18 | L2 | VVPKVEGT | 31 | 8 | | | | | 4603 |
| HPV18 | L2 | VVPKVEGTT | 31 | 9 | | | | | 4604 |
| HPV18 | L2 | VVPKVEGTTL | 31 | 10 | | | | | 4605 |
| HPV18 | L2 | VVPKVEGTTLA | 31 | 11 | | | | | 4606 |
| HPV18 | L2 | VVTSGAPRPT | 112 | 10 | | | | | 4607 |
| HPV18 | L2 | YADDMDPA | 351 | 8 | | | | | 4608 |
| HPV18 | L2 | YADDMDPAV | 351 | 9 | | | | | 4609 |
| HPV18 | L2 | YADDMDPAVPV | 351 | 11 | | | | | 4610 |
| HPV18 | L2 | YIELQPLV | 332 | 8 | | | | | 4611 |
| HPV18 | L2 | YIELQPLVSA | 332 | 10 | | | | | 4612 |
| HPV18 | L2 | YIELQPLVSAT | 332 | 11 | | | | | 4613 |
| HPV18 | L2 | YIGIHGTHYYL | 427 | 11 | | | | | 4614 |
| HPV18 | L2 | YIPLGGRSNT | 71 | 10 | | | | | 4615 |
| HPV18 | L2 | YIPLGGRSNTV | 71 | 11 | | | | | 4616 |
| HPV18 | L2 | YLWPLYYFI | 436 | 9 | | | | | 4617 |
| HPV18 | L2 | YTGPDITL | 400 | 8 | | | | | 4618 |
| HPV18 | L2 | YTGPDITLPST | 400 | 11 | | | | | 4619 |
| HPV31 | E1 | AAALYWYRT | 296 | 9 | | | | | 4620 |
| HPV31 | E1 | AAALYWYRTGM | 296 | 11 | | | | | 4621 |
| HPV31 | E1 | AAFGVTGT | 219 | 8 | | | | | 4622 |
| HPV31 | E1 | AAFGVTGTV | 219 | 9 | | | | | 4623 |
| HPV31 | E1 | AAFGVTGTVA | 219 | 10 | | | | | 4624 |
| HPV31 | E1 | AALYWYRT | 297 | 8 | | | | | 4625 |
| HPV31 | E1 | AALYWYRTGM | 297 | 10 | | | | | 4626 |
| HPV31 | E1 | AAMLGKFKEL | 185 | 10 | | | | | 4627 |
| HPV31 | E1 | AICIENNSKT | 111 | 10 | | | | | 4628 |
| HPV31 | E1 | AICIENNSKTA | 111 | 11 | | | | | 4629 |
| HPV31 | E1 | ALDGNPVSI | 519 | 9 | | | | | 4630 |
| HPV31 | E1 | ALDGNPVSIDV | 519 | 11 | | | | | 4631 |
| HPV31 | E1 | ALFHAQEA | 68 | 8 | | | | | 4632 |
| HPV31 | E1 | ALKLFLKGV | 439 | 9 | | | | | 4633 |
| HPV31 | E1 | ALMQLKCPPL | 533 | 10 | | | | | 4634 |
| HPV31 | E1 | ALMQLKCPPLL | 533 | 11 | | | | | 4635 |
| HPV31 | E1 | ALYWYRTGM | 298 | 9 | | | | | 4636 |
| HPV31 | E1 | AMLGKFKEL | 186 | 9 | | | | | 4637 |
| HPV31 | E1 | AQALFHAQEA | 66 | 10 | | | | | 4638 |
| HPV31 | E1 | AQEAEEHA | 72 | 8 | | | | | 4639 |
| HPV31 | E1 | AQEAEEHAEA | 72 | 10 | | | | | 4640 |
| HPV31 | E1 | AQEAEEHAEAV | 72 | 11 | | | | | 4641 |
| HPV31 | E1 | AQLADSDSNA | 360 | 10 | | | | | 4642 |
| HPV31 | E1 | ATTPCWHYI | 504 | 9 | | | | | 4643 |
| HPV31 | E1 | AVIDRQTGDNI | 22 | 11 | | | | | 4644 |
| HPV31 | E1 | AVQVLKRKYV | 81 | 10 | | | | | 4645 |
| HPV31 | E1 | CAFLKSNSQA | 370 | 10 | | | | | 4646 |
| HPV31 | E1 | CAKNRITI | 263 | 8 | | | | | 4647 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E1 | CAKNRITIEKL | 263 | 11 | | | | | 4648 |
| HPV31 | E1 | CIENNSKT | 113 | 8 | | | | | 4649 |
| HPV31 | E1 | CIENNSKTA | 113 | 9 | | | | | 4650 |
| HPV31 | E1 | CILIHGAPNT | 452 | 10 | | | | | 4651 |
| HPV31 | E1 | CISTNCML | 279 | 8 | | | | | 4652 |
| HPV31 | E1 | CISTNCMLI | 279 | 9 | | | | | 4653 |
| HPV31 | E1 | CLYCHLQSL | 239 | 9 | | | | | 4654 |
| HPV31 | E1 | CLYCHLQSLA | 239 | 10 | | | | | 4655 |
| HPV31 | E1 | CMLIQPPKL | 284 | 9 | | | | | 4656 |
| HPV31 | E1 | CTDWCVAA | 213 | 8 | | | | | 4657 |
| HPV31 | E1 | CTDWCVAAFGV | 213 | 11 | | | | | 4658 |
| HPV31 | E1 | CVAAFGVT | 217 | 8 | | | | | 4659 |
| HPV31 | E1 | CVAAFGVTGT | 217 | 10 | | | | | 4660 |
| HPV31 | E1 | CVAAFGVTGTV | 217 | 11 | | | | | 4661 |
| HPV31 | E1 | CVDYNISPRL | 100 | 10 | | | | | 4662 |
| HPV31 | E1 | CVSGQNIRT | 620 | 9 | | | | | 4663 |
| HPV31 | E1 | CVSGQNIRTL | 620 | 10 | | | | | 4664 |
| HPV31 | E1 | DAKIGMLDDA | 495 | 10 | | | | | 4665 |
| HPV31 | E1 | DAKIGMLDDAT | 495 | 11 | | | | | 4666 |
| HPV31 | E1 | DATTPCWHYI | 503 | 10 | | | | | 4667 |
| HPV31 | E1 | DISSCVDYNI | 96 | 10 | | | | | 4668 |
| HPV31 | E1 | DIVKFLRYQQI | 421 | 11 | | | | | 4669 |
| HPV31 | E1 | DLSQMVQWA | 336 | 9 | | | | | 4670 |
| HPV31 | E1 | DMVDFIDNCNV | 46 | 11 | | | | | 4671 |
| HPV31 | E1 | DTGEDMVDFI | 42 | 10 | | | | | 4672 |
| HPV31 | E1 | DTTFDLSQM | 332 | 9 | | | | | 4673 |
| HPV31 | E1 | DTTFDLSQMV | 332 | 10 | | | | | 4674 |
| HPV31 | E1 | DVKHKALM | 528 | 8 | | | | | 4675 |
| HPV31 | E1 | DVKHKALMQL | 528 | 10 | | | | | 4676 |
| HPV31 | E1 | DVMDDSEI | 348 | 8 | | | | | 4677 |
| HPV31 | E1 | DVMDDSEIA | 348 | 9 | | | | | 4678 |
| HPV31 | E1 | DVYGETPEWI | 311 | 10 | | | | | 4679 |
| HPV31 | E1 | EAEEHAEA | 74 | 8 | | | | | 4680 |
| HPV31 | E1 | EAEEHAEAV | 74 | 9 | | | | | 4681 |
| HPV31 | E1 | EAEEHAEAVQV | 74 | 11 | | | | | 4682 |
| HPV31 | E1 | EAETAQAL | 62 | 8 | | | | | 4683 |
| HPV31 | E1 | EAETAQALFHA | 62 | 11 | | | | | 4684 |
| HPV31 | E1 | EAVIDRQT | 21 | 8 | | | | | 4685 |
| HPV31 | E1 | EAVQVLKRKYV | 80 | 11 | | | | | 4686 |
| HPV31 | E1 | EIAYKYAQL | 354 | 9 | | | | | 4687 |
| HPV31 | E1 | EIAYKYAQLA | 354 | 10 | | | | | 4688 |
| HPV31 | E1 | ELPDSGYGNT | 127 | 10 | | | | | 4689 |
| HPV31 | E1 | ELYGVSFM | 193 | 8 | | | | | 4690 |
| HPV31 | E1 | ELYGVSFMEL | 193 | 10 | | | | | 4691 |
| HPV31 | E1 | ELYGVSFMELI | 193 | 11 | | | | | 4692 |
| HPV31 | E1 | ETAQALFHA | 64 | 9 | | | | | 4693 |
| HPV31 | E1 | ETPEWIERQT | 315 | 10 | | | | | 4694 |
| HPV31 | E1 | ETPEWIERQTV | 315 | 11 | | | | | 4695 |
| HPV31 | E1 | ETPTRNIL | 168 | 8 | | | | | 4696 |
| HPV31 | E1 | ETPTRNILQV | 168 | 10 | | | | | 4697 |
| HPV31 | E1 | ETPTRNILQVL | 168 | 11 | | | | | 4698 |
| HPV31 | E1 | ETQQMVQV | 139 | 8 | | | | | 4699 |
| HPV31 | E1 | EVETQQMV | 137 | 8 | | | | | 4700 |
| HPV31 | E1 | EVETQQMVQV | 137 | 10 | | | | | 4701 |
| HPV31 | E1 | FLKGVPKKNCI | 443 | 11 | | | | | 4702 |
| HPV31 | E1 | FLKSNSQA | 372 | 8 | | | | | 4703 |
| HPV31 | E1 | FLKSNSQAKI | 372 | 10 | 0.0011 | | | | 4704 |
| HPV31 | E1 | FLKSNSQAKIV | 372 | 11 | | | | | 4705 |
| HPV31 | E1 | FLQGCIISYA | 473 | 10 | | | | | 4706 |
| HPV31 | E1 | FLRYQQIEFV | 425 | 10 | | | | | 4707 |
| HPV31 | E1 | FLSALKLFL | 436 | 9 | | | | | 4708 |
| HPV31 | E1 | FQSNKSTCT | 206 | 9 | | | | | 4709 |
| HPV31 | E1 | FVSFLSAL | 433 | 8 | | | | | 4710 |
| HPV31 | E1 | FVSFLSALKL | 433 | 10 | | | | | 4711 |
| HPV31 | E1 | GMLDDATT | 499 | 8 | | | | | 4712 |
| HPV31 | E1 | GMSLISFL | 467 | 8 | | | | | 4713 |
| HPV31 | E1 | GMSNISDV | 305 | 8 | | | | | 4714 |
| HPV31 | E1 | GMVMLMLV | 252 | 8 | | | | | 4715 |
| HPV31 | E1 | GQWIKSRCDKV | 403 | 11 | | | | | 4716 |
| HPV31 | E1 | GTGCNGWFYV | 11 | 10 | 0.0006 | | | | 4717 |
| HPV31 | E1 | GTHSERENET | 160 | 10 | | | | | 4718 |
| HPV31 | E1 | GTMCRHYKRA | 386 | 10 | | | | | 4719 |
| HPV31 | E1 | GTVAEGFKT | 225 | 9 | | | | | 4720 |
| HPV31 | E1 | GTVAEGFKTL | 225 | 10 | | | | | 4721 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E1 | GTVAEGFKTLL | 225 | 11 | | | | | 4722 |
| HPV31 | E1 | GVPKKNCI | 446 | 8 | | | | | 4723 |
| HPV31 | E1 | GVPKKNCIL | 446 | 9 | | | | | 4724 |
| HPV31 | E1 | GVPKKNCILI | 446 | 10 | | | | | 4725 |
| HPV31 | E1 | GVSFMELI | 196 | 8 | | | | | 4726 |
| HPV31 | E1 | HAEAVQVL | 78 | 8 | | | | | 4727 |
| HPV31 | E1 | HAQEAEEHA | 71 | 9 | | | | | 4728 |
| HPV31 | E1 | HAQEAEEHAEA | 71 | 11 | | | | | 4729 |
| HPV31 | E1 | HLQSLACSWGM | 243 | 11 | | | | | 4730 |
| HPV31 | E1 | IAYKYAQL | 355 | 8 | | | | | 4731 |
| HPV31 | E1 | IAYKYAQLA | 355 | 9 | | | | | 4732 |
| HPV31 | E1 | ILIHGAPNT | 453 | 9 | | | | | 4733 |
| HPV31 | E1 | IQPPKLRST | 287 | 9 | | | | | 4734 |
| HPV31 | E1 | IQPPKLRSTA | 287 | 10 | | | | | 4735 |
| HPV31 | E1 | IQPPKLRSTAA | 287 | 11 | | | | | 4736 |
| HPV31 | E1 | ITIEKLLEKL | 268 | 10 | | | | | 4737 |
| HPV31 | E1 | ITIEKLLEKLL | 268 | 11 | | | | | 4738 |
| HPV31 | E1 | IVKDCGTM | 381 | 8 | | | | | 4739 |
| HPV31 | E1 | IVKFLRYQQI | 422 | 10 | | | | | 4740 |
| HPV31 | E1 | KAAMLGKFKEL | 184 | 11 | | | | | 4741 |
| HPV31 | E1 | KAICIENNSKT | 110 | 11 | | | | | 4742 |
| HPV31 | E1 | KALMQLKCPPL | 532 | 11 | | | | | 4743 |
| HPV31 | E1 | KIGMLDDA | 497 | 8 | | | | | 4744 |
| HPV31 | E1 | KIGMLDDAT | 497 | 9 | | | | | 4745 |
| HPV31 | E1 | KIGMLDDATT | 497 | 10 | | | | | 4746 |
| HPV31 | E1 | KIVKDCGT | 380 | 8 | | | | | 4747 |
| HPV31 | E1 | KIVKDCGTM | 380 | 9 | | | | | 4748 |
| HPV31 | E1 | KLLCISTNCM | 276 | 10 | | | | | 4749 |
| HPV31 | E1 | KLLCISTNCML | 276 | 11 | | | | | 4750 |
| HPV31 | E1 | KLLEKLLCI | 272 | 9 | | | | | 4751 |
| HPV31 | E1 | KLLEKLLCIST | 272 | 11 | | | | | 4752 |
| HPV31 | E1 | KLRSTAAA | 291 | 8 | | | | | 4753 |
| HPV31 | E1 | KLRSTAAAL | 291 | 9 | 0.0003 | | | | 4754 |
| HPV31 | E1 | KTAKRRLFEL | 119 | 10 | | | | | 4755 |
| HPV31 | E1 | KTLLQPYCL | 232 | 9 | | | | | 4756 |
| HPV31 | E1 | KTSNGKAA | 179 | 8 | | | | | 4757 |
| HPV31 | E1 | KTSNGKAAM | 179 | 9 | | | | | 4768 |
| HPV31 | E1 | KTSNGKAAML | 179 | 10 | | | | | 4759 |
| HPV31 | E1 | KVSDEGDWRDI | 412 | 11 | | | | | 4760 |
| HPV31 | E1 | LACSWGMV | 247 | 8 | | | | | 4761 |
| HPV31 | E1 | LACSWGMVM | 247 | 9 | | | | | 4762 |
| HPV31 | E1 | LACSWGMVML | 247 | 10 | | | | | 4763 |
| HPV31 | E1 | LACSWGMVMLM | 247 | 11 | | | | | 4764 |
| HPV31 | E1 | LADAKIGM | 493 | 8 | | | | | 4765 |
| HPV31 | E1 | LADAKIGML | 493 | 9 | | | | | 4766 |
| HPV31 | E1 | LADSDSNA | 362 | 8 | | | | | 4767 |
| HPV31 | E1 | LADSDSNACA | 362 | 10 | | | | | 4768 |
| HPV31 | E1 | LIHGAPNT | 454 | 8 | | | | | 4769 |
| HPV31 | E1 | LIQPPKLRST | 286 | 10 | | | | | 4770 |
| HPV31 | E1 | LIQPPKLRSTA | 286 | 11 | | | | | 4771 |
| HPV31 | E1 | LIRPFQSNKST | 202 | 11 | | | | | 4772 |
| HPV31 | E1 | LISFLQGCI | 470 | 9 | | | | | 4773 |
| HPV31 | E1 | LISFLQGCII | 470 | 10 | | | | | 4774 |
| HPV31 | E1 | LITSNINA | 543 | 8 | | | | | 4775 |
| HPV31 | E1 | LLCISTNCM | 277 | 9 | | | | | 4776 |
| HPV31 | E1 | LLCISTNCML | 277 | 10 | | | | | 4777 |
| HPV31 | E1 | LLCISTNCMLI | 277 | 11 | | | | | 4778 |
| HPV31 | E1 | LLEKLLCI | 273 | 8 | | | | | 4779 |
| HPV31 | E1 | LLEKLLCIST | 273 | 10 | | | | | 4780 |
| HPV31 | E1 | LLITSNINA | 542 | 9 | 0.0022 | | | | 4781 |
| HPV31 | E1 | LLQPYCLYCHL | 234 | 11 | | | | | 4782 |
| HPV31 | E1 | LMLVRFKCA | 256 | 9 | | | | | 4783 |
| HPV31 | E1 | LMQLKCPPL | 534 | 9 | | | | | 4784 |
| HPV31 | E1 | LMQLKCPPLL | 534 | 10 | | | | | 4785 |
| HPV31 | E1 | LMQLKCPPLLI | 534 | 11 | | | | | 4786 |
| HPV31 | E1 | LQGCIISYA | 474 | 9 | | | | | 4787 |
| HPV31 | E1 | LQHSFNDT | 326 | 8 | | | | | 4788 |
| HPV31 | E1 | LQHSFNDTT | 326 | 9 | | | | | 4789 |
| HPV31 | E1 | LQPLADAKI | 490 | 9 | | | | | 4790 |
| HPV31 | E1 | LQPLADAKIGM | 490 | 11 | | | | | 4791 |
| HPV31 | E1 | LQPYCLYCHL | 235 | 10 | | | | | 4792 |
| HPV31 | E1 | LQSLACSWGM | 244 | 10 | | | | | 4793 |
| HPV31 | E1 | LQSLACSWGMV | 244 | 11 | | | | | 4794 |
| HPV31 | E1 | LQVLKTSNGKA | 175 | 11 | | | | | 4795 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E1 | LVRFKCAKNRI | 258 | 11 | | | | | 4796 |
| HPV31 | E1 | MLGKFKEL | 187 | 8 | | | | | 4797 |
| HPV31 | E1 | MLGKFKELYGV | 187 | 11 | | | | | 4798 |
| HPV31 | E1 | MLIQPPKL | 285 | 8 | | | | | 4799 |
| HPV31 | E1 | MLIQPPKLRST | 285 | 11 | | | | | 4800 |
| HPV31 | E1 | MLMLVRFKCA | 255 | 10 | | | | | 4801 |
| HPV31 | E1 | MLVRFKCA | 257 | 8 | | | | | 4802 |
| HPV31 | E1 | MQLKCPPL | 535 | 8 | | | | | 4803 |
| HPV31 | E1 | MQLKCPPLL | 535 | 9 | | | | | 4804 |
| HPV31 | E1 | MQLKCPPLLI | 535 | 10 | | | | | 4805 |
| HPV31 | E1 | MQLKCPPLLIT | 535 | 11 | | | | | 4806 |
| HPV31 | E1 | MVDFIDNCNV | 47 | 10 | | | | | 4807 |
| HPV31 | E1 | MVQVEEQQT | 143 | 9 | | | | | 4808 |
| HPV31 | E1 | MVQVEEQQTT | 143 | 10 | | | | | 4809 |
| HPV31 | E1 | MVQVEEQQTTL | 143 | 11 | | | | | 4810 |
| HPV31 | E1 | MVQWAYDNDV | 340 | 10 | | | | | 4811 |
| HPV31 | E1 | MVQWAYDNDVM | 340 | 11 | | | | | 4812 |
| HPV31 | E1 | NAGKDDRWPYL | 549 | 11 | | | | | 4813 |
| HPV31 | E1 | NALDGNPV | 518 | 8 | | | | | 4814 |
| HPV31 | E1 | NALDGNPVSI | 518 | 10 | | | | | 4815 |
| HPV31 | E1 | NILQVLKT | 173 | 8 | | | | | 4816 |
| HPV31 | E1 | NISDVYGET | 308 | 9 | | | | | 4817 |
| HPV31 | E1 | NISPRLKA | 104 | 8 | | | | | 4818 |
| HPV31 | E1 | NISPRLKAI | 104 | 9 | | | | | 4819 |
| HPV31 | E1 | NISPRLKAICI | 104 | 11 | | | | | 4820 |
| HPV31 | E1 | NQAEAETA | 59 | 8 | | | | | 4821 |
| HPV31 | E1 | NQAEAETAQA | 59 | 10 | | | | | 4822 |
| HPV31 | E1 | NQAEAETAQAL | 59 | 11 | | | | | 4823 |
| HPV31 | E1 | NTEVETQQM | 135 | 9 | | | | | 4824 |
| HPV31 | E1 | NTEVETQQMV | 135 | 10 | | | | | 4825 |
| HPV31 | E1 | NTGKSYFGM | 460 | 9 | | | | | 4826 |
| HPV31 | E1 | NTGKSYFGMSL | 460 | 11 | | | | | 4827 |
| HPV31 | E1 | NVYNNQAEA | 55 | 9 | | | | | 4828 |
| HPV31 | E1 | NVYNNQAEAET | 55 | 11 | | | | | 4829 |
| HPV31 | E1 | PAGTDGEGT | 4 | 9 | | | | | 4830 |
| HPV31 | E1 | PLADAKIGM | 492 | 9 | | | | | 4831 |
| HPV31 | E1 | PLADAKIGML | 492 | 10 | | | | | 4832 |
| HPV31 | E1 | PLLITSNI | 541 | 8 | | | | | 4833 |
| HPV31 | E1 | PLLITSNINA | 541 | 10 | | | | | 4834 |
| HPV31 | E1 | PLSDISSCV | 93 | 9 | | | | | 4835 |
| HPV31 | E1 | PTRNILQV | 170 | 8 | | | | | 4836 |
| HPV31 | E1 | PTRNILQVL | 170 | 9 | | | | | 4837 |
| HPV31 | E1 | PTRNILQVLKT | 170 | 11 | | | | | 4838 |
| HPV31 | E1 | PVSIDVKHKA | 524 | 10 | | | | | 4839 |
| HPV31 | E1 | PVSIDVKHKAL | 524 | 11 | | | | | 4840 |
| HPV31 | E1 | QAEAETAQA | 60 | 9 | | | | | 4841 |
| HPV31 | E1 | QAEAETAQAL | 60 | 10 | | | | | 4842 |
| HPV31 | E1 | QAKIVKDCGT | 378 | 10 | | | | | 4843 |
| HPV31 | E1 | QAKIVKDCGTM | 378 | 11 | | | | | 4844 |
| HPV31 | E1 | QALFHAQEA | 67 | 9 | | | | | 4845 |
| HPV31 | E1 | QIEFVSFL | 430 | 8 | | | | | 4846 |
| HPV31 | E1 | QIEFVSFLSA | 430 | 10 | | | | | 4847 |
| HPV31 | E1 | QIEFVSFLSAL | 430 | 11 | | | | | 4848 |
| HPV31 | E1 | QLADSDSNA | 361 | 9 | | | | | 4849 |
| HPV31 | E1 | QLADSDSNACA | 361 | 11 | | | | | 4850 |
| HPV31 | E1 | QLKCPPLL | 536 | 8 | | | | | 4851 |
| HPV31 | E1 | QLKCPPLLI | 536 | 9 | 0.0049 | | | | 4852 |
| HPV31 | E1 | QLKCPPLLIT | 536 | 10 | | | | | 4853 |
| HPV31 | E1 | QMSMGQWI | 399 | 8 | | | | | 4854 |
| HPV31 | E1 | QMVQVEEQQT | 142 | 10 | | | | | 4855 |
| HPV31 | E1 | QMVQVEEQQTT | 142 | 11 | | | | | 4856 |
| HPV31 | E1 | QMVQWAYDNDV | 339 | 11 | | | | | 4857 |
| HPV31 | E1 | QQIEFVSFL | 429 | 9 | | | | | 4858 |
| HPV31 | E1 | QQIEFVSFLSA | 429 | 11 | | | | | 4859 |
| HPV31 | E1 | QQMVQVEEQQT | 141 | 11 | | | | | 4860 |
| HPV31 | E1 | QTVLQHSFNDT | 323 | 11 | | | | | 4861 |
| HPV31 | E1 | QVEEQQTT | 145 | 8 | | | | | 4862 |
| HPV31 | E1 | QVEEQQTTL | 145 | 9 | | | | | 4863 |
| HPV31 | E1 | QVLKRKYV | 83 | 8 | | | | | 4864 |
| HPV31 | E1 | QVLKTSNGKA | 176 | 10 | | | | | 4865 |
| HPV31 | E1 | QVLKTSNGKAA | 176 | 11 | | | | | 4866 |
| HPV31 | E1 | RAEKRQMSM | 394 | 9 | | | | | 4867 |
| HPV31 | E1 | RITIEKLL | 267 | 8 | | | | | 4868 |
| HPV31 | E1 | RITIEKLLEKL | 267 | 11 | | | | | 4869 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E1 | RQMSMGQWI | 398 | 9 | | | | | 4870 |
| HPV31 | E1 | RTGMSNISDV | 303 | 10 | | | | | 4871 |
| HPV31 | E1 | RTWCRLNL | 595 | 8 | | | | | 4872 |
| HPV31 | E1 | SALKLFLKGV | 438 | 10 | | | | | 4873 |
| HPV31 | E1 | SIDVKHKA | 526 | 8 | | | | | 4874 |
| HPV31 | E1 | SIDVKHKAL | 526 | 9 | | | | | 4875 |
| HPV31 | E1 | SIDVKHKALM | 526 | 10 | | | | | 4876 |
| HPV31 | E1 | SLACSWGM | 246 | 8 | | | | | 4877 |
| HPV31 | E1 | SLACSWGMV | 246 | 9 | 0.082 | | | | 4878 |
| HPV31 | E1 | SLACSWGMVM | 246 | 10 | | | | | 4879 |
| HPV31 | E1 | SLACSWGMVML | 246 | 11 | | | | | 4880 |
| HPV31 | E1 | SLISFLQGCI | 469 | 10 | | | | | 4881 |
| HPV31 | E1 | SLISFLQGCII | 469 | 11 | | | | | 4882 |
| HPV31 | E1 | SQAKIVKDCGT | 377 | 11 | | | | | 4883 |
| HPV31 | E1 | STAAALYWYRT | 294 | 11 | | | | | 4884 |
| HPV31 | E1 | STCTDWCV | 211 | 8 | | | | | 4885 |
| HPV31 | E1 | STCTDWCVA | 211 | 9 | | | | | 4886 |
| HPV31 | E1 | STCTDWCVAA | 211 | 10 | | | | | 4887 |
| HPV31 | E1 | STFKCVSGQNI | 616 | 11 | | | | | 4888 |
| HPV31 | E1 | TAAALYWYRT | 295 | 10 | | | | | 4889 |
| HPV31 | E1 | TAKRRLFEL | 120 | 9 | | | | | 4890 |
| HPV31 | E1 | TAQALFHA | 65 | 8 | | | | | 4891 |
| HPV31 | E1 | TAQALFHAQEA | 65 | 11 | | | | | 4892 |
| HPV31 | E1 | TIEKLLEKL | 269 | 9 | | | | | 4893 |
| HPV31 | E1 | TIEKLLEKLL | 269 | 10 | | | | | 4894 |
| HPV31 | E1 | TLLQPYCL | 233 | 8 | | | | | 4895 |
| HPV31 | E1 | TLSCNGSDGT | 152 | 10 | | | | | 4896 |
| HPV31 | E1 | TMCRHYKRA | 387 | 9 | 0.0003 | | | | 4897 |
| HPV31 | E1 | TTFDLSQM | 333 | 8 | | | | | 4898 |
| HPV31 | E1 | TTFDLSQMV | 333 | 9 | | | | | 4899 |
| HPV31 | E1 | TTLSCNGSDGT | 151 | 11 | | | | | 4900 |
| HPV31 | E1 | TTPCWHYI | 505 | 8 | | | | | 4901 |
| HPV31 | E1 | TVAEGFKT | 226 | 8 | | | | | 4902 |
| HPV31 | E1 | TVAEGFKTL | 226 | 9 | | | | | 4903 |
| HPV31 | E1 | TVAEGFKTLL | 226 | 10 | | | | | 4904 |
| HPV31 | E1 | TVLQHSFNDT | 324 | 10 | | | | | 4905 |
| HPV31 | E1 | TVLQHSFNDTT | 324 | 11 | | | | | 4906 |
| HPV31 | E1 | VAAFGVTGT | 218 | 9 | | | | | 4907 |
| HPV31 | E1 | VAAFGVTGTV | 218 | 10 | | | | | 4908 |
| HPV31 | E1 | VAAFGVTGTVA | 218 | 11 | | | | | 4909 |
| HPV31 | E1 | VAEGFKTL | 227 | 8 | | | | | 4910 |
| HPV31 | E1 | VAEGFKTLL | 227 | 9 | | | | | 4911 |
| HPV31 | E1 | VIDRQTGDNI | 23 | 10 | | | | | 4912 |
| HPV31 | E1 | VLKRKYVGSPL | 84 | 11 | | | | | 4913 |
| HPV31 | E1 | VLKTSNGKA | 177 | 9 | | | | | 4914 |
| HPV31 | E1 | VLKTSNGKAA | 177 | 10 | | | | | 4915 |
| HPV31 | E1 | VLKTSNGKAAM | 177 | 11 | | | | | 4916 |
| HPV31 | E1 | VLQHSFNDT | 325 | 9 | | | | | 4917 |
| HPV31 | E1 | VLQHSFNDTT | 325 | 10 | | | | | 4918 |
| HPV31 | E1 | VMDDSEIA | 349 | 8 | | | | | 4919 |
| HPV31 | E1 | VMLMLVRFKCA | 254 | 11 | | | | | 4920 |
| HPV31 | E1 | VQVEEQQT | 144 | 8 | | | | | 4921 |
| HPV31 | E1 | VQVEEQQTT | 144 | 9 | | | | | 4922 |
| HPV31 | E1 | VQVEEQQTTL | 144 | 10 | | | | | 4923 |
| HPV31 | E1 | VQVLKRKYV | 82 | 9 | | | | | 4924 |
| HPV31 | E1 | VQWAYDNDV | 341 | 9 | | | | | 4925 |
| HPV31 | E1 | VQWAYDNDVM | 341 | 10 | | | | | 4926 |
| HPV31 | E1 | VTGTVAEGFKT | 223 | 11 | | | | | 4927 |
| HPV31 | E1 | WAYDNDVM | 343 | 8 | | | | | 4928 |
| HPV31 | E1 | WIERQTVL | 319 | 8 | | | | | 4929 |
| HPV31 | E1 | WIKSRCDKV | 405 | 9 | | | | | 4930 |
| HPV31 | E1 | WLQPLADA | 489 | 8 | | | | | 4931 |
| HPV31 | E1 | WLQPLADAKI | 489 | 10 | | | | | 4932 |
| HPV31 | E1 | YANSKSHFWL | 481 | 10 | | | | | 4933 |
| HPV31 | E1 | YAQLADSDSNA | 359 | 11 | | | | | 4934 |
| HPV31 | E1 | YIDNYLRNA | 511 | 9 | | | | | 4935 |
| HPV31 | E1 | YIDNYLRNAL | 511 | 10 | | | | | 4936 |
| HPV31 | E1 | YLHSRLVV | 558 | 8 | | | | | 4937 |
| HPV31 | E1 | YLHSRLVVFT | 558 | 10 | | | | | 4938 |
| HPV31 | E1 | YLRNALDGNPV | 515 | 11 | | | | | 4939 |
| HPV31 | E1 | YQQIEFVSFL | 428 | 10 | | | | | 4940 |
| HPV31 | E1 | YVEAVIDRQT | 19 | 10 | | | | | 4941 |
| HPV31 | E1 | YVGSPLSDI | 89 | 9 | | | | | 4942 |
| HPV31 | E2 | AAACTNQT | 277 | 8 | | | | | 4943 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E2 | AAACTNQTRA | 277 | 10 | | | | | 4944 |
| HPV31 | E2 | AAACTNQTRAV | 277 | 11 | | | | | 4945 |
| HPV31 | E2 | AACTNQTRA | 278 | 9 | | | | | 4946 |
| HPV31 | E2 | AACTNQTRAV | 278 | 10 | | | | | 4947 |
| HPV31 | E2 | AIELQMML | 72 | 8 | | | | | 4948 |
| HPV31 | E2 | AIELQMMLET | 72 | 10 | | | | | 4949 |
| HPV31 | E2 | AIELQMMLETL | 72 | 11 | | | | | 4950 |
| HPV31 | E2 | AIVTLTYI | 338 | 8 | | | | | 4951 |
| HPV31 | E2 | AIVTLTYIST | 338 | 10 | | | | | 4952 |
| HPV31 | E2 | ALGTSEGV | 229 | 8 | | | | | 4953 |
| HPV31 | E2 | ALGTSEGVRRA | 229 | 11 | | | | | 4954 |
| HPV31 | E2 | ALQAIELQM | 69 | 9 | | | | | 4955 |
| HPV31 | E2 | ALQAIELQMM | 69 | 10 | | | | | 4956 |
| HPV31 | E2 | ALQAIELQMML | 69 | 11 | | | | | 4957 |
| HPV31 | E2 | ALSVSKAKA | 61 | 9 | | | | | 4958 |
| HPV31 | E2 | ALSVSKAKAL | 61 | 10 | | | | | 4959 |
| HPV31 | E2 | ATTPIIHL | 291 | 8 | | | | | 4960 |
| HPV31 | E2 | ATTSTKRPRT | 239 | 10 | | | | | 4961 |
| HPV31 | E2 | AVSCPATT | 286 | 8 | | | | | 4962 |
| HPV31 | E2 | AVSCPATTPI | 286 | 10 | | | | | 4963 |
| HPV31 | E2 | AVSCPATTPII | 286 | 11 | | | | | 4964 |
| HPV31 | E2 | CALGTSEGV | 228 | 9 | | | | | 4965 |
| HPV31 | E2 | CIDGQCTV | 140 | 8 | | | | | 4966 |
| HPV31 | E2 | CIDGQCTVV | 140 | 9 | | | | | 4967 |
| HPV31 | E2 | CLKKHGYT | 109 | 8 | | | | | 4968 |
| HPV31 | E2 | CLKKHGYTV | 109 | 9 | | | | | 4969 |
| HPV31 | E2 | CLKKHGYTVEV | 109 | 11 | | | | | 4970 |
| HPV31 | E2 | CTDGKHKNA | 330 | 9 | | | | | 4971 |
| HPV31 | E2 | CTDGKHKNAI | 330 | 10 | | | | | 4972 |
| HPV31 | E2 | CTDGKHKNAIV | 330 | 11 | | | | | 4973 |
| HPV31 | E2 | CTNQTRAV | 280 | 8 | | | | | 4974 |
| HPV31 | E2 | CTVVEGQV | 145 | 8 | | | | | 4975 |
| HPV31 | E2 | CVLMYKAREM | 40 | 10 | | | | | 4976 |
| HPV31 | E2 | DANILKCL | 301 | 8 | | | | | 4977 |
| HPV31 | E2 | DVHNTMHYT | 124 | 9 | | | | | 4978 |
| HPV31 | E2 | EISFAGIV | 204 | 8 | | | | | 4979 |
| HPV31 | E2 | EISFAGIVT | 204 | 9 | | | | | 4980 |
| HPV31 | E2 | EISFAGIVTKL | 204 | 11 | | | | | 4981 |
| HPV31 | E2 | ELQMMLET | 74 | 8 | | | | | 4982 |
| HPV31 | E2 | ELQMMLETL | 74 | 9 | | | | | 4983 |
| HPV31 | E2 | ELYLTAPT | 100 | 8 | | | | | 4984 |
| HPV31 | E2 | ELYLTAPTGCL | 100 | 11 | | | | | 4985 |
| HPV31 | E2 | EMGIHSINHQV | 48 | 11 | | | | | 4986 |
| HPV31 | E2 | EQVSSTWHWT | 320 | 10 | | | | | 4987 |
| HPV31 | E2 | ETLSQRLNV | 2 | 9 | | | | | 4988 |
| HPV31 | E2 | EVHAGGQV | 185 | 8 | | | | | 4989 |
| HPV31 | E2 | EVHAGGQVI | 185 | 9 | | | | | 4990 |
| HPV31 | E2 | EVHAGGQVIV | 185 | 10 | | | | | 4991 |
| HPV31 | E2 | EVQFDGDV | 118 | 8 | | | | | 4992 |
| HPV31 | E2 | EVQFDGDVHNT | 118 | 11 | | | | | 4993 |
| HPV31 | E2 | FAGIVTKL | 207 | 8 | | | | | 4994 |
| HPV31 | E2 | FAGIVTKLPT | 207 | 10 | | | | | 4995 |
| HPV31 | E2 | FAGIVTKLPTA | 207 | 11 | | | | | 4996 |
| HPV31 | E2 | FIYLCIDGQCT | 136 | 11 | | | | | 4997 |
| HPV31 | E2 | FLNTVKIPNT | 353 | 10 | | | | | 4998 |
| HPV31 | E2 | FLNTVKIPNTV | 353 | 11 | | | | | 4999 |
| HPV31 | E2 | FTEEAKKYGT | 171 | 10 | | | | | 5000 |
| HPV31 | E2 | FVNFTEEA | 168 | 8 | | | | | 5001 |
| HPV31 | E2 | GIHSINHQV | 50 | 9 | | | | | 5002 |
| HPV31 | E2 | GIHSINHQVV | 50 | 10 | | | | | 5003 |
| HPV31 | E2 | GIVTKLPT | 209 | 8 | | | | | 5004 |
| HPV31 | E2 | GIVTKLPTA | 209 | 9 | | | | | 5005 |
| HPV31 | E2 | GIYYVHEGHI | 156 | 10 | | | | | 5006 |
| HPV31 | E2 | GIYYVHEGHIT | 156 | 11 | | | | | 5007 |
| HPV31 | E2 | GQCTVVEGQV | 143 | 10 | | | | | 5008 |
| HPV31 | E2 | GQVIVFPESV | 190 | 10 | | | | | 5009 |
| HPV31 | E2 | GQVNCKGI | 150 | 8 | | | | | 5010 |
| HPV31 | E2 | GQVNCKGIYYV | 150 | 11 | | | | | 5011 |
| HPV31 | E2 | GTGKKWEV | 179 | 8 | | | | | 5012 |
| HPV31 | E2 | GTGKKWEVHA | 179 | 10 | | | | | 5013 |
| HPV31 | E2 | GTSEGVRRA | 231 | 9 | | | | | 5014 |
| HPV31 | E2 | GTSEGVRRAT | 231 | 10 | | | | | 5015 |
| HPV31 | E2 | GTSEGVRRATT | 231 | 11 | | | | | 5016 |
| HPV31 | E2 | GVISAAACT | 273 | 9 | | | | | 5017 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E2 | GVRRATTST | 235 | 9 | | | | | 5018 |
| HPV31 | E2 | HAGGQVIV | 187 | 8 | | | | | 5019 |
| HPV31 | E2 | HIDYWKHI | 29 | 8 | | | | | 5020 |
| HPV31 | E2 | HIDYWKHIRL | 29 | 10 | | | | | 5021 |
| HPV31 | E2 | HIRLECVL | 35 | 8 | | | | | 5022 |
| HPV31 | E2 | HIRLECVLM | 35 | 9 | | | | | 5023 |
| HPV31 | E2 | HITYFVNFT | 164 | 9 | | | | | 5024 |
| HPV31 | E2 | HLKGDANI | 297 | 8 | | | | | 5025 |
| HPV31 | E2 | HLKGDANIL | 297 | 9 | | | | | 5026 |
| HPV31 | E2 | HQVVPALSV | 56 | 9 | | | | | 5027 |
| HPV31 | E2 | IIHLKGDA | 295 | 8 | | | | | 5028 |
| HPV31 | E2 | IIHLKGDANI | 295 | 10 | | | | | 5029 |
| HPV31 | E2 | IIHLKGDANIL | 295 | 11 | | | | | 5030 |
| HPV31 | E2 | ILKCLRYRL | 304 | 9 | | | | | 5031 |
| HPV31 | E2 | ITYFVNFT | 165 | 8 | | | | | 5032 |
| HPV31 | E2 | ITYFVNFTEEA | 165 | 11 | | | | | 5033 |
| HPV31 | E2 | IVTKLPTA | 210 | 8 | | | | | 5034 |
| HPV31 | E2 | IVTKLPTANNT | 210 | 11 | | | | | 5035 |
| HPV31 | E2 | IVTLTYIST | 339 | 9 | | | | | 5036 |
| HPV31 | E2 | KAKALQAI | 66 | 8 | | | | | 5037 |
| HPV31 | E2 | KAKALQAIEL | 66 | 10 | | | | | 5038 |
| HPV31 | E2 | KALQAIEL | 68 | 8 | | | | | 5039 |
| HPV31 | E2 | KALQAIELQM | 68 | 10 | | | | | 5040 |
| HPV31 | E2 | KALQAIELQMM | 68 | 11 | | | | | 5041 |
| HPV31 | E2 | KAREMGIHSI | 45 | 10 | | | | | 5042 |
| HPV31 | E2 | KIPNTVSV | 358 | 8 | | | | | 5043 |
| HPV31 | E2 | KIPNTVSVST | 358 | 10 | | | | | 5044 |
| HPV31 | E2 | KLLRGDSV | 260 | 8 | | | | | 5045 |
| HPV31 | E2 | KLLRGDSVDSV | 260 | 11 | | | | | 5046 |
| HPV31 | E2 | KLPTANNT | 213 | 8 | | | | | 5047 |
| HPV31 | E2 | KLPTANNTT | 213 | 9 | | | | | 5048 |
| HPV31 | E2 | KLPTANNTTT | 213 | 10 | | | | | 5049 |
| HPV31 | E2 | KQLYEQVSST | 316 | 10 | | | | | 5050 |
| HPV31 | E2 | KTCALGTSEGV | 226 | 11 | | | | | 5051 |
| HPV31 | E2 | LLRGDSVDSV | 261 | 10 | | | | | 5052 |
| HPV31 | E2 | LMYKAREM | 42 | 8 | | | | | 5053 |
| HPV31 | E2 | LMYKAREMGI | 42 | 10 | | | | | 5054 |
| HPV31 | E2 | LQAIELQM | 70 | 8 | | | | | 5055 |
| HPV31 | E2 | LQAIELQMM | 70 | 9 | | | | | 5056 |
| HPV31 | E2 | LQAIELQMML | 70 | 10 | | | | | 5057 |
| HPV31 | E2 | LQMMLETL | 75 | 8 | | | | | 5058 |
| HPV31 | E2 | LQMMLETLNNT | 75 | 11 | | | | | 5059 |
| HPV31 | E2 | LTAPTGCL | 103 | 8 | | | | | 5060 |
| HPV31 | E2 | MLETLNNT | 78 | 8 | | | | | 5061 |
| HPV31 | E2 | MMLETLNNT | 77 | 9 | | | | | 5062 |
| HPV31 | E2 | MQQTSLEL | 94 | 8 | | | | | 5063 |
| HPV31 | E2 | MQQTSLELYL | 94 | 10 | | | | | 5064 |
| HPV31 | E2 | MQQTSLELYLT | 94 | 11 | | | | | 5065 |
| HPV31 | E2 | NAIVTLTYI | 337 | 9 | | | | | 5066 |
| HPV31 | E2 | NAIVTLTYIST | 337 | 11 | | | | | 5067 |
| HPV31 | E2 | NILKCLRYRL | 303 | 10 | | | | | 5068 |
| HPV31 | E2 | NQTRAVSCPA | 282 | 10 | | | | | 5069 |
| HPV31 | E2 | NQTRAVSCPAT | 282 | 11 | | | | | 5070 |
| HPV31 | E2 | NTEYKNEDWT | 84 | 10 | | | | | 5071 |
| HPV31 | E2 | NTEYKNEDWTM | 84 | 11 | | | | | 5072 |
| HPV31 | E2 | NTHHPNKL | 254 | 8 | | | | | 5073 |
| HPV31 | E2 | NTHHPNKLL | 254 | 9 | | | | | 5074 |
| HPV31 | E2 | NTMHYTNWKFI | 127 | 11 | | | | | 5075 |
| HPV31 | E2 | NTTTSNSKT | 219 | 9 | | | | | 5076 |
| HPV31 | E2 | NTTTSNSKTCA | 219 | 11 | | | | | 5077 |
| HPV31 | E2 | NTVKIPNT | 355 | 8 | | | | | 5078 |
| HPV31 | E2 | NTVKIPNTV | 355 | 9 | | | | | 5079 |
| HPV31 | E2 | NTVKIPNTVSV | 355 | 11 | | | | | 5080 |
| HPV31 | E2 | NTVSVSTGYM | 361 | 10 | | | | | 5081 |
| HPV31 | E2 | NTVSVSTGYMT | 361 | 11 | | | | | 5082 |
| HPV31 | E2 | NVCQDKIL | 9 | 8 | | | | | 5083 |
| HPV31 | E2 | PALSVSKA | 60 | 8 | | | | | 5084 |
| HPV31 | E2 | PALSVSKAKA | 60 | 10 | | | | | 5085 |
| HPV31 | E2 | PALSVSKAKAL | 60 | 11 | | | | | 5086 |
| HPV31 | E2 | PATTPIIHL | 290 | 9 | | | | | 5087 |
| HPV31 | E2 | PIIHLKGDA | 294 | 9 | | | | | 5088 |
| HPV31 | E2 | PIIHLKGDANI | 294 | 11 | | | | | 5089 |
| HPV31 | E2 | PTANNTTT | 215 | 8 | | | | | 5090 |
| HPV31 | E2 | PTGCLKKHGYT | 106 | 11 | | | | | 5091 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E2 | QAIELQMM | 71 | 8 | | | | | 5092 |
| HPV31 | E2 | QAIELQMML | 71 | 9 | | | | | 5093 |
| HPV31 | E2 | QAIELQMMLET | 71 | 11 | | | | | 5094 |
| HPV31 | E2 | QLYEQVSST | 317 | 9 | | | | | 5095 |
| HPV31 | E2 | QMMLETLNNT | 76 | 10 | | | | | 5096 |
| HPV31 | E2 | QQTSLELYL | 95 | 9 | | | | | 5097 |
| HPV31 | E2 | QQTSLELYLT | 95 | 10 | | | | | 5098 |
| HPV31 | E2 | QQTSLELYLTA | 95 | 11 | | | | | 5099 |
| HPV31 | E2 | QTRAVSCPA | 283 | 9 | | | | | 5100 |
| HPV31 | E2 | QTRAVSCPAT | 283 | 10 | | | | | 5101 |
| HPV31 | E2 | QTRAVSCPATT | 283 | 11 | | | | | 5102 |
| HPV31 | E2 | QTSLELYL | 96 | 8 | | | | | 5103 |
| HPV31 | E2 | QTSLELYLT | 96 | 9 | | | | | 5104 |
| HPV31 | E2 | QTSLELYLTA | 96 | 10 | | | | | 5105 |
| HPV31 | E2 | QVIVFPESV | 191 | 9 | | | | | 5106 |
| HPV31 | E2 | QVNCKGIYYV | 151 | 10 | | | | | 5107 |
| HPV31 | E2 | QVSSTWHWT | 321 | 9 | | | | | 5108 |
| HPV31 | E2 | QVSSTWHWTCT | 321 | 11 | | | | | 5109 |
| HPV31 | E2 | QVVPALSV | 57 | 8 | | | | | 5110 |
| HPV31 | E2 | QVVPALSVSKA | 57 | 11 | | | | | 5111 |
| HPV31 | E2 | RATTSTKRPRT | 238 | 11 | | | | | 5112 |
| HPV31 | E2 | RAVSCPAT | 285 | 8 | | | | | 5113 |
| HPV31 | E2 | RAVSCPATT | 285 | 9 | | | | | 5114 |
| HPV31 | E2 | RAVSCPATTPI | 285 | 11 | | | | | 5115 |
| HPV31 | E2 | RLECVLMYKA | 37 | 10 | | | | | 5116 |
| HPV31 | E2 | RLNVCQDKI | 7 | 9 | | | | | 5117 |
| HPV31 | E2 | RLNVCQDKIL | 7 | 10 | | | | | 5118 |
| HPV31 | E2 | RLSKYKQL | 311 | 8 | | | | | 5119 |
| HPV31 | E2 | RTEPEHRNT | 247 | 9 | | | | | 5120 |
| HPV31 | E2 | SAAACTNQT | 276 | 9 | | | | | 5121 |
| HPV31 | E2 | SAAACTNQTRA | 276 | 11 | | | | | 5122 |
| HPV31 | E2 | SINHQVVPA | 53 | 9 | | | | | 5123 |
| HPV31 | E2 | SINHQVVPAL | 53 | 10 | | | | | 5124 |
| HPV31 | E2 | SLELYLTA | 98 | 8 | | | | | 5125 |
| HPV31 | E2 | SLELYLTAPT | 98 | 10 | | | | | 5126 |
| HPV31 | E2 | SQRDDFLNT | 348 | 9 | | | | | 5127 |
| HPV31 | E2 | SQRDDFLNTV | 348 | 10 | | | | | 5128 |
| HPV31 | E2 | SQRLNVCQDKI | 5 | 11 | | | | | 5129 |
| HPV31 | E2 | STSQRDDFL | 346 | 9 | | | | | 5130 |
| HPV31 | E2 | STSQRDDFLNT | 346 | 11 | | | | | 5131 |
| HPV31 | E2 | STWHWTCT | 324 | 8 | | | | | 5132 |
| HPV31 | E2 | SVDSVNCGV | 266 | 9 | | | | | 5133 |
| HPV31 | E2 | SVDSVNCGVI | 266 | 10 | | | | | 5134 |
| HPV31 | E2 | SVFSSDEI | 198 | 8 | | | | | 5135 |
| HPV31 | E2 | SVFSSDEISFA | 198 | 11 | | | | | 5136 |
| HPV31 | E2 | SVNCGVISA | 269 | 9 | | | | | 5137 |
| HPV31 | E2 | SVNCGVISAA | 269 | 10 | | | | | 5138 |
| HPV31 | E2 | SVNCGVISAAA | 269 | 11 | | | | | 5139 |
| HPV31 | E2 | SVSKAKAL | 63 | 8 | | | | | 5140 |
| HPV31 | E2 | SVSKAKALQA | 63 | 10 | | | | | 5141 |
| HPV31 | E2 | SVSKAKALQAI | 63 | 11 | | | | | 5142 |
| HPV31 | E2 | SVSTGYMT | 364 | 8 | | | | | 5143 |
| HPV31 | E2 | SVSTGYMTI | 364 | 9 | | | | | 5144 |
| HPV31 | E2 | TLSQRLNV | 3 | 8 | | | | | 5145 |
| HPV31 | E2 | TMHYTNWKFI | 128 | 10 | | | | | 5146 |
| HPV31 | E2 | TMQQTSLEL | 93 | 9 | | | | | 5147 |
| HPV31 | E2 | TMQQTSLELYL | 93 | 11 | | | | | 5148 |
| HPV31 | E2 | TTPIIHLKGDA | 292 | 11 | | | | | 5149 |
| HPV31 | E2 | TTSNSKTCA | 221 | 9 | | | | | 5150 |
| HPV31 | E2 | TTSNSKTCAL | 221 | 10 | | | | | 5151 |
| HPV31 | E2 | TTSTKRPRT | 240 | 9 | | | | | 5152 |
| HPV31 | E2 | TTTSNSKT | 220 | 8 | | | | | 5153 |
| HPV31 | E2 | TTTSNSKTCA | 220 | 10 | | | | | 5154 |
| HPV31 | E2 | TTTSNSKTCAL | 220 | 11 | | | | | 5155 |
| HPV31 | E2 | TVEVQFDGDV | 116 | 10 | | | | | 5156 |
| HPV31 | E2 | TVKIPNTV | 356 | 8 | | | | | 5157 |
| HPV31 | E2 | TVKIPNTVSV | 356 | 10 | | | | | 5158 |
| HPV31 | E2 | TVSVSTGYM | 362 | 9 | | | | | 5159 |
| HPV31 | E2 | TVSVSTGYMT | 362 | 10 | | | | | 5160 |
| HPV31 | E2 | TVSVSTGYMTI | 362 | 11 | | | | | 5161 |
| HPV31 | E2 | VISAAACT | 274 | 8 | | | | | 5162 |
| HPV31 | E2 | VISAAACTNQT | 274 | 11 | | | | | 5163 |
| HPV31 | E2 | VIVFPESV | 192 | 8 | | | | | 5164 |
| HPV31 | E2 | VLMYKAREM | 41 | 9 | | | | | 5165 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E2 | VLMYKAREMGI | 41 | 11 | | | | | 5166 |
| HPV31 | E2 | VQFDGDVHNT | 119 | 10 | | | | | 5167 |
| HPV31 | E2 | VQFDGDVHNTM | 119 | 11 | | | | | 5168 |
| HPV31 | E2 | VTKLPTANNT | 211 | 10 | | | | | 5169 |
| HPV31 | E2 | VTKLPTANNTT | 211 | 11 | | | | | 5170 |
| HPV31 | E2 | VTLTYIST | 340 | 8 | | | | | 5171 |
| HPV31 | E2 | VVEGQVNCKGI | 147 | 11 | | | | | 5172 |
| HPV31 | E2 | VVPALSVSKA | 58 | 10 | | | | | 5173 |
| HPV31 | E2 | WTCTDGKHKNA | 328 | 11 | | | | | 5174 |
| HPV31 | E2 | WTMQQTSL | 92 | 8 | | | | | 5175 |
| HPV31 | E2 | WTMQQTSLEL | 92 | 10 | | | | | 5176 |
| HPV31 | E2 | YISTSQRDDFL | 344 | 11 | | | | | 5177 |
| HPV31 | E2 | YLCIDGQCT | 138 | 9 | | | | | 5178 |
| HPV31 | E2 | YLCIDGQCTV | 138 | 10 | | | | | 5179 |
| HPV31 | E2 | YLCIDGQCTVV | 138 | 11 | | | | | 5180 |
| HPV31 | E2 | YLTAPTGCL | 102 | 9 | | | | | 5181 |
| HPV31 | E2 | YTNWKFIYL | 131 | 9 | | | | | 5182 |
| HPV31 | E2 | YTNWKFIYLCI | 131 | 11 | | | | | 5183 |
| HPV31 | E2 | YTVEVQFDGDV | 115 | 11 | | | | | 5184 |
| HPV31 | E2 | YVHEGHIT | 159 | 8 | | | | | 5185 |
| HPV31 | E2 | YVHEGHITYFV | 159 | 11 | | | | | 5186 |
| HPV31 | E5 | ATLLLLIV | 40 | 8 | | | | | 5187 |
| HPV31 | E5 | ATLLLLIVI | 40 | 9 | | | | | 5188 |
| HPV31 | E5 | ATLLLLIVIL | 40 | 10 | | | | | 5189 |
| HPV31 | E5 | ATSPLRCFCI | 53 | 10 | | | | | 5190 |
| HPV31 | E5 | CIYVVFIYI | 61 | 9 | | | | | 5191 |
| HPV31 | E5 | CIYVVFIYIPL | 61 | 11 | | | | | 5192 |
| HPV31 | E5 | CLVIRPLV | 26 | 8 | | | | | 5193 |
| HPV31 | E5 | CLVIRPLVL | 26 | 9 | | | | | 5194 |
| HPV31 | E5 | CLVIRPLVLSV | 26 | 11 | | | | | 5195 |
| HPV31 | E5 | CVLLFVCL | 20 | 8 | | | | | 5196 |
| HPV31 | E5 | CVLLFVCLV | 20 | 9 | | | | | 5197 |
| HPV31 | E5 | CVLLFVCLVI | 20 | 10 | | | | | 5198 |
| HPV31 | E5 | ELNISTVSI | 3 | 9 | | | | | 5199 |
| HPV31 | E5 | ELNISTVSIV | 3 | 10 | | | | | 5200 |
| HPV31 | E5 | ELNISTVSIVL | 3 | 11 | | | | | 5201 |
| HPV31 | E5 | FIYIPLFV | 66 | 8 | | | | | 5202 |
| HPV31 | E5 | FIYIPLFVI | 66 | 9 | | | | | 5203 |
| HPV31 | E5 | FIYIPLFVIHT | 66 | 11 | | | | | 5204 |
| HPV31 | E5 | FLLCFCVL | 15 | 8 | | | | | 5205 |
| HPV31 | E5 | FLLCFCVLL | 15 | 9 | | | | | 5206 |
| HPV31 | E5 | FLLCFCVLLFV | 15 | 11 | | | | | 5207 |
| HPV31 | E5 | FVCLVIRPL | 24 | 9 | | | | | 5208 |
| HPV31 | E5 | FVCLVIRPLV | 24 | 10 | | | | | 5209 |
| HPV31 | E5 | FVCLVIRPLVL | 24 | 11 | | | | | 5210 |
| HPV31 | E5 | FVIHTHASFL | 72 | 10 | | | | | 5211 |
| HPV31 | E5 | IATSPLRCFCI | 52 | 11 | | | | | 5212 |
| HPV31 | E5 | ILWVIATSPL | 48 | 10 | | | | | 5213 |
| HPV31 | E5 | IVILWVIA | 46 | 8 | | | | | 5214 |
| HPV31 | E5 | IVILWVIAT | 46 | 9 | | | | | 5215 |
| HPV31 | E5 | IVLCFLLCFCV | 11 | 11 | | | | | 5216 |
| HPV31 | E5 | LIVILWVI | 45 | 8 | | | | | 5217 |
| HPV31 | E5 | LIVILWVIA | 45 | 9 | | | | | 5218 |
| HPV31 | E5 | LIVILWVIAT | 45 | 10 | | | | | 5219 |
| HPV31 | E5 | LLCFCVLL | 16 | 8 | | | | | 5220 |
| HPV31 | E5 | LLCFCVLLFV | 16 | 10 | | | | | 5221 |
| HPV31 | E5 | LLFVCLVI | 22 | 8 | | | | | 5222 |
| HPV31 | E5 | LLFVCLVIRPL | 22 | 11 | | | | | 5223 |
| HPV31 | E5 | LLIVILWV | 44 | 8 | | | | | 5224 |
| HPV31 | E5 | LLIVILWVI | 44 | 9 | | | | | 5225 |
| HPV31 | E5 | LLIVILWVIA | 44 | 10 | | | | | 5226 |
| HPV31 | E5 | LLIVILWVIAT | 44 | 11 | | | | | 5227 |
| HPV31 | E5 | LLLIVILWV | 43 | 9 | | | | | 5228 |
| HPV31 | E5 | LLLIVILWVI | 43 | 10 | | | | | 5229 |
| HPV31 | E5 | LLLIVILWVIA | 43 | 11 | | | | | 5230 |
| HPV31 | E5 | LLLLIVIL | 42 | 8 | | | | | 5231 |
| HPV31 | E5 | LLLLIVILWV | 42 | 10 | | | | | 5232 |
| HPV31 | E5 | LLLLIVILWVI | 42 | 11 | | | | | 5233 |
| HPV31 | E5 | LVIRPLVL | 27 | 8 | | | | | 5234 |
| HPV31 | E5 | LVIRPLVLSV | 27 | 10 | | | | | 5235 |
| HPV31 | E5 | LVLSVSVYA | 32 | 9 | | | | | 5236 |
| HPV31 | E5 | LVLSVSVYAT | 32 | 10 | | | | | 5237 |
| HPV31 | E5 | LVLSVSVYATL | 32 | 11 | | | | | 5238 |
| HPV31 | E5 | MIELNIST | 1 | 8 | | | | | 5239 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E5 | MIELNISTV | 1 | 9 | | | | | 5240 |
| HPV31 | E5 | MIELNISTVSI | 1 | 11 | | | | | 5241 |
| HPV31 | E5 | NISTVSIV | 5 | 8 | | | | | 5242 |
| HPV31 | E5 | NISTVSIVL | 5 | 9 | | | | | 5243 |
| HPV31 | E5 | PLFVIHTHA | 70 | 9 | | | | | 5244 |
| HPV31 | E5 | PLRCFCIYV | 56 | 9 | | | | | 5245 |
| HPV31 | E5 | PLRCFCIYVV | 56 | 10 | | | | | 5246 |
| HPV31 | E5 | PLVLSVSV | 31 | 8 | | | | | 5247 |
| HPV31 | E5 | PLVLSVSVYA | 31 | 10 | | | | | 5248 |
| HPV31 | E5 | PLVLSVSVYAT | 31 | 11 | | | | | 5249 |
| HPV31 | E5 | SIVLCFLL | 10 | 8 | | | | | 5250 |
| HPV31 | E5 | STVSIVLCFL | 7 | 10 | | | | | 5251 |
| HPV31 | E5 | STVSIVLCFLL | 7 | 11 | | | | | 5252 |
| HPV31 | E5 | SVSVYATL | 35 | 8 | | | | | 5253 |
| HPV31 | E5 | SVSVYATLL | 35 | 9 | | | | | 5254 |
| HPV31 | E5 | SVSVYATLLL | 35 | 10 | | | | | 5255 |
| HPV31 | E5 | SVSVYATLLLL | 35 | 11 | | | | | 5256 |
| HPV31 | E5 | SVYATLLL | 37 | 8 | | | | | 5257 |
| HPV31 | E5 | SVYATLLLL | 37 | 9 | | | | | 5258 |
| HPV31 | E5 | SVYATLLLLI | 37 | 10 | | | | | 5259 |
| HPV31 | E5 | SVYATLLLLIV | 37 | 11 | | | | | 5260 |
| HPV31 | E5 | TLLLLIVI | 41 | 8 | | | | | 5261 |
| HPV31 | E5 | TLLLLIVIL | 41 | 9 | | | | | 5262 |
| HPV31 | E5 | TLLLLIVILWV | 41 | 11 | | | | | 5263 |
| HPV31 | E5 | TVSIVLCFL | 8 | 9 | | | | | 5264 |
| HPV31 | E5 | TVSIVLCFLL | 8 | 10 | | | | | 5265 |
| HPV31 | E5 | VIHTHASFL | 73 | 9 | | | | | 5266 |
| HPV31 | E5 | VILWVIAT | 47 | 8 | | | | | 5267 |
| HPV31 | E5 | VILWVIATSPL | 47 | 11 | | | | | 5268 |
| HPV31 | E5 | VIRPLVLSV | 28 | 9 | | | | | 5269 |
| HPV31 | E5 | VIRPLVLSVSV | 28 | 11 | | | | | 5270 |
| HPV31 | E5 | VLCFLLCFCV | 12 | 10 | | | | | 5271 |
| HPV31 | E5 | VLCFLLCFCVL | 12 | 11 | | | | | 5272 |
| HPV31 | E5 | VLLFVCLV | 21 | 8 | | | | | 5273 |
| HPV31 | E5 | VLLFVCLVI | 21 | 9 | | | | | 5274 |
| HPV31 | E5 | VLSVSVYA | 33 | 8 | | | | | 5275 |
| HPV31 | E5 | VLSVSVYAT | 33 | 9 | | | | | 5276 |
| HPV31 | E5 | VLSVSVYATL | 33 | 10 | | | | | 5277 |
| HPV31 | E5 | VLSVSVYATLL | 33 | 11 | | | | | 5278 |
| HPV31 | E5 | VVFIYIPL | 64 | 8 | | | | | 5279 |
| HPV31 | E5 | VVFIYIPLFV | 64 | 10 | | | | | 5280 |
| HPV31 | E5 | VVFIYIPLFVI | 64 | 11 | | | | | 5281 |
| HPV31 | E5 | WVIATSPL | 50 | 8 | | | | | 5282 |
| HPV31 | E5 | YATLLLLI | 39 | 8 | | | | | 5283 |
| HPV31 | E5 | YATLLLLIV | 39 | 9 | | | | | 5284 |
| HPV31 | E5 | YATLLLLIVI | 39 | 10 | | | | | 5285 |
| HPV31 | E5 | YATLLLLIVIL | 39 | 11 | | | | | 5286 |
| HPV31 | E5 | YIPLFVIHT | 68 | 9 | | | | | 5287 |
| HPV31 | E5 | YIPLFVIHTHA | 68 | 11 | | | | | 5288 |
| HPV31 | E5 | YVVFIYIPL | 63 | 9 | | | | | 5289 |
| HPV31 | E5 | YVVFIYIPLFV | 63 | 11 | | | | | 5290 |
| HPV31 | E6 | ALEIPYDEL | 18 | 9 | | | | | 5291 |
| HPV31 | E6 | ALEIPYDELRL | 18 | 11 | | | | | 5292 |
| HPV31 | E6 | CIACWRRPRT | 136 | 10 | | | | | 5293 |
| HPV31 | E6 | CITCQRPL | 103 | 8 | | | | | 5294 |
| HPV31 | E6 | CLRFYSKV | 66 | 8 | | | | | 5295 |
| HPV31 | E6 | CTKCLRFYSKV | 63 | 11 | | | | | 5296 |
| HPV31 | E6 | CVYCKGQL | 30 | 8 | | | | | 5297 |
| HPV31 | E6 | CVYCKGQLT | 30 | 9 | | | | | 5298 |
| HPV31 | E6 | CVYCKGQLTET | 30 | 11 | | | | | 5299 |
| HPV31 | E6 | DLLIRCIT | 98 | 8 | | | | | 5300 |
| HPV31 | E6 | DLTIVYRDDT | 49 | 10 | | | | | 5301 |
| HPV31 | E6 | DTPHGVCT | 57 | 8 | | | | | 5302 |
| HPV31 | E6 | DTPHGVCTKCL | 57 | 11 | | | | | 5303 |
| HPV31 | E6 | EIPYDELRL | 20 | 9 | | | | | 5304 |
| HPV31 | E6 | ELSSALEI | 14 | 8 | | | | | 5305 |
| HPV31 | E6 | ETEVLDFA | 39 | 8 | | | | | 5306 |
| HPV31 | E6 | ETEVLDFAFT | 39 | 10 | | | | | 5307 |
| HPV31 | E6 | EVLDFAFT | 41 | 8 | | | | | 5308 |
| HPV31 | E6 | EVLDFAFTDL | 41 | 10 | | | | | 5309 |
| HPV31 | E6 | EVLDFAFTDLT | 41 | 11 | | | | | 5310 |
| HPV31 | E6 | FAFTDLTI | 45 | 8 | | | | | 5311 |
| HPV31 | E6 | FAFTDLTIV | 45 | 9 | | | | | 5312 |
| HPV31 | E6 | GICDLLIRCI | 95 | 10 | | | | | 5313 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E6 | GICDLLIRCIT | 95 | 11 | | | | | 5314 |
| HPV31 | E6 | GQLTETEV | 35 | 8 | | | | | 5315 |
| HPV31 | E6 | GQLTETEVL | 35 | 9 | | | | | 5316 |
| HPV31 | E6 | GTTLEKLT | 85 | 8 | | | | | 5317 |
| HPV31 | E6 | HLDKKKRFHNI | 118 | 11 | | | | | 5318 |
| HPV31 | E6 | IACWRRPRT | 137 | 9 | | | | | 5319 |
| HPV31 | E6 | IACWRRPRTET | 137 | 11 | | | | | 5320 |
| HPV31 | E6 | IVYRDDTPHGV | 52 | 11 | | | | | 5321 |
| HPV31 | E6 | KLHELSSA | 11 | 8 | | | | | 5322 |
| HPV31 | E6 | KLHELSSAL | 11 | 9 | | | | | 5323 |
| HPV31 | E6 | KLHELSSALEI | 11 | 11 | | | | | 5324 |
| HPV31 | E6 | KLTNKGICDL | 90 | 10 | | | | | 5325 |
| HPV31 | E6 | KLTNKGICDLL | 90 | 11 | | | | | 5326 |
| HPV31 | E6 | LIRCITCQRPL | 100 | 11 | | | | | 5327 |
| HPV31 | E6 | LTETEVLDFA | 37 | 10 | | | | | 5328 |
| HPV31 | E6 | LTIVYRDDT | 50 | 9 | | | | | 5329 |
| HPV31 | E6 | LTNKGICDL | 91 | 9 | | | | | 5330 |
| HPV31 | E6 | LTNKGICDLL | 91 | 10 | | | | | 5331 |
| HPV31 | E6 | LTNKGICDLLI | 91 | 11 | | | | | 5332 |
| HPV31 | E6 | NIGGRWTGRCI | 127 | 11 | | | | | 5333 |
| HPV31 | E6 | PAERPRKL | 5 | 8 | | | | | 5334 |
| HPV31 | E6 | PAERPRKLHEL | 5 | 11 | | | | | 5335 |
| HPV31 | E6 | PLCPEEKQRHL | 109 | 11 | 0.0001 | | | | 5336 |
| HPV31 | E6 | QLTETEVL | 36 | 8 | | | | | 5337 |
| HPV31 | E6 | QLTETEVLDFA | 36 | 11 | | | | | 5338 |
| HPV31 | E6 | RLNCVYCKGQL | 27 | 11 | | | | | 5339 |
| HPV31 | E6 | SALEIPYDEL | 17 | 10 | | | | | 5340 |
| HPV31 | E6 | SVYGTTLEKL | 82 | 10 | | | | | 5341 |
| HPV31 | E6 | SVYGTTLEKLT | 82 | 11 | | | | | 5342 |
| HPV31 | E6 | TIVYRDDT | 51 | 8 | | | | | 5343 |
| HPV31 | E6 | TLEKLTNKGI | 87 | 10 | | | | | 5344 |
| HPV31 | E6 | TTLEKLTNKGI | 86 | 11 | | | | | 5345 |
| HPV31 | E6 | VLDFAFTDL | 42 | 9 | | | | | 5346 |
| HPV31 | E6 | VLDFAFTDLT | 42 | 10 | | | | | 5347 |
| HPV31 | E6 | VLDFAFTDLTI | 42 | 11 | | | | | 5348 |
| HPV31 | E7 | ATDLHCYEQL | 19 | 10 | | | | | 5349 |
| HPV31 | E7 | CQCKSTLRL | 59 | 9 | | | | | 5350 |
| HPV31 | E7 | CQCKSTLRLCV | 59 | 11 | | | | | 5351 |
| HPV31 | E7 | CVQSTQVDI | 68 | 9 | | | | | 5352 |
| HPV31 | E7 | CVQSTQVDIRI | 68 | 11 | | | | | 5353 |
| HPV31 | E7 | DIRILQEL | 75 | 8 | | | | | 5354 |
| HPV31 | E7 | DIRILQELL | 75 | 9 | | | | | 5355 |
| HPV31 | E7 | DIRILQELLM | 75 | 10 | | | | | 5356 |
| HPV31 | E7 | DLHCYEQL | 21 | 8 | | | | | 5357 |
| HPV31 | E7 | DLQPEATDL | 14 | 9 | | | | | 5358 |
| HPV31 | E7 | DTSNYNIV | 48 | 8 | | | | | 5359 |
| HPV31 | E7 | DTSNYNIVT | 48 | 9 | | | | | 5360 |
| HPV31 | E7 | DVIDSPAGQA | 36 | 10 | | | | | 5361 |
| HPV31 | E7 | EATDLHCYEQL | 18 | 11 | | | | | 5362 |
| HPV31 | E7 | ELLMGSFGI | 81 | 9 | | | | | 5363 |
| HPV31 | E7 | ELLMGSFGIV | 81 | 10 | | | | | 5364 |
| HPV31 | E7 | ETPTLQDYV | 4 | 9 | | | | | 5365 |
| HPV31 | E7 | ETPTLQDYVL | 4 | 10 | | | | | 5366 |
| HPV31 | E7 | GIVCPNCST | 88 | 9 | | | | | 5367 |
| HPV31 | E7 | GIVCPNCSTRL | 88 | 11 | | | | | 5368 |
| HPV31 | E7 | IVCPNCST | 89 | 8 | | | | | 5369 |
| HPV31 | E7 | IVCPNCSTRL | 89 | 10 | | | | | 5370 |
| HPV31 | E7 | IVTFCCQCKST | 54 | 11 | | | | | 5371 |
| HPV31 | E7 | LLMGSFGI | 82 | 8 | | | | | 5372 |
| HPV31 | E7 | LLMGSFGIV | 82 | 9 | | | | | 5373 |
| HPV31 | E7 | LMGSFGIV | 83 | 8 | | | | | 5374 |
| HPV31 | E7 | LQDYVLDL | 8 | 8 | | | | | 5375 |
| HPV31 | E7 | LQELLMGSFGI | 79 | 11 | | | | | 5376 |
| HPV31 | E7 | LQPEATDL | 15 | 8 | | | | | 5377 |
| HPV31 | E7 | PAGQAEPDT | 41 | 9 | | | | | 5378 |
| HPV31 | E7 | PTLQDYVL | 6 | 8 | | | | | 5379 |
| HPV31 | E7 | PTLQDYVLDL | 6 | 10 | | | | | 5380 |
| HPV31 | E7 | QAEPDTSNYNI | 44 | 11 | | | | | 5381 |
| HPV31 | E7 | QLPDSSEEDV | 27 | 11 | | | | | 5382 |
| HPV31 | E7 | QVDIRILQEL | 73 | 10 | | | | | 5383 |
| HPV31 | E7 | QVDIRILQELL | 73 | 11 | | | | | 5384 |
| HPV31 | E7 | RILQELLM | 77 | 8 | | | | | 5385 |
| HPV31 | E7 | RLCVQSTQV | 66 | 9 | | | | | 5386 |
| HPV31 | E7 | RLCVQSTQVDI | 66 | 11 | | | | | 5387 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | E7 | STLRLCVQST | 63 | 10 | 0.0012 | | | | 5388 |
| HPV31 | E7 | STQVDIRI | 71 | 8 | | | | | 5389 |
| HPV31 | E7 | STQVDIRIL | 71 | 9 | | | | | 5390 |
| HPV31 | E7 | TLQDYVLDL | 7 | 9 | | | | | 5391 |
| HPV31 | E7 | TLRLCVQST | 64 | 9 | 0.0061 | | | | 5392 |
| HPV31 | E7 | TLRLCVQSTQV | 64 | 11 | | | | | 5393 |
| HPV31 | E7 | TQVDIRIL | 72 | 8 | | | | | 5394 |
| HPV31 | E7 | TQVDIRILQEL | 72 | 11 | | | | | 5395 |
| HPV31 | E7 | VIDSPAGQA | 37 | 9 | | | | | 5396 |
| HPV31 | E7 | VLDLQPEA | 12 | 8 | | | | | 5397 |
| HPV31 | E7 | VLDLQPEAT | 12 | 9 | | | | | 5398 |
| HPV31 | E7 | VLDLQPEATDL | 12 | 11 | | | | | 5399 |
| HPV31 | E7 | VQSTQVDI | 69 | 8 | | | | | 5400 |
| HPV31 | E7 | VQSTQVDIRI | 69 | 10 | | | | | 5401 |
| HPV31 | E7 | VQSTQVDIRIL | 69 | 11 | | | | | 5402 |
| HPV31 | E7 | VTFCCQCKST | 55 | 10 | | | | | 5403 |
| HPV31 | E7 | VTFCCQCKSTL | 55 | 11 | | | | | 5404 |
| HPV31 | E7 | YVLDLQPEA | 11 | 9 | | | | | 5405 |
| HPV31 | E7 | YVLDLQPEAT | 11 | 10 | | | | | 5406 |
| HPV31 | L1 | AAIANSDT | 347 | 8 | | | | | 5407 |
| HPV31 | L1 | AAIANSDTT | 347 | 9 | | | | | 5408 |
| HPV31 | L1 | AIANSDTT | 348 | 8 | | | | | 5409 |
| HPV31 | L1 | AILEDWNFGL | 398 | 10 | | | | | 5410 |
| HPV31 | L1 | AILEDWNFGLT | 398 | 11 | | | | | 5411 |
| HPV31 | L1 | AITCQKTA | 426 | 8 | | | | | 5412 |
| HPV31 | L1 | AITPGDCPPL | 180 | 10 | | | | | 5413 |
| HPV31 | L1 | ALQDTKSNV | 213 | 9 | | | | | 5414 |
| HPV31 | L1 | ALQDTKSNVPL | 213 | 11 | | | | | 5415 |
| HPV31 | L1 | AMDFTALQDT | 208 | 10 | | | | | 5416 |
| HPV31 | L1 | AQGHNNGI | 317 | 8 | | | | | 5417 |
| HPV31 | L1 | AQIFNKPYWM | 305 | 10 | | | | | 5418 |
| HPV31 | L1 | ATLANSTYFPT | 285 | 11 | | | | | 5419 |
| HPV31 | L1 | ATVYLPPV | 9 | 8 | | | | | 5420 |
| HPV31 | L1 | ATVYLPPVPV | 9 | 10 | | | | | 5421 |
| HPV31 | L1 | CAAIANSDT | 346 | 9 | | | | | 5422 |
| HPV31 | L1 | CAAIANSDTT | 346 | 10 | | | | | 5423 |
| HPV31 | L1 | CISMDYKQT | 147 | 9 | | | | | 5424 |
| HPV31 | L1 | CISMDYKQTQL | 147 | 11 | | | | | 5425 |
| HPV31 | L1 | CLLGCKPPI | 158 | 9 | | | | | 5426 |
| HPV31 | L1 | DAQIFNKPYWM | 304 | 11 | | | | | 5427 |
| HPV31 | L1 | DIMTYIHSM | 387 | 9 | | | | | 5428 |
| HPV31 | L1 | DLQFIFQL | 372 | 8 | | | | | 5429 |
| HPV31 | L1 | DLQFIFQLCKI | 372 | 11 | | | | | 5430 |
| HPV31 | L1 | DLYIKGSGST | 275 | 10 | | | | | 5431 |
| HPV31 | L1 | DLYIKGSGSTA | 275 | 11 | | | | | 5432 |
| HPV31 | L1 | DMVDTGFGA | 200 | 9 | | | | | 5433 |
| HPV31 | L1 | DMVDTGFGAM | 200 | 10 | | | | | 5434 |
| HPV31 | L1 | DQFPLGRKFL | 461 | 10 | | | | | 5435 |
| HPV31 | L1 | DQFPLGRKFLL | 461 | 11 | | | | | 5436 |
| HPV31 | L1 | DTENSNRYA | 129 | 9 | | | | | 5437 |
| HPV31 | L1 | DTGFGAMDFT | 203 | 10 | | | | | 5438 |
| HPV31 | L1 | DTGFGAMDFTA | 203 | 11 | | | | | 5439 |
| HPV31 | L1 | DTKSNVPL | 216 | 8 | | | | | 5440 |
| HPV31 | L1 | DTKSNVPLDI | 216 | 10 | | | | | 5441 |
| HPV31 | L1 | DTSFYNPET | 88 | 9 | | | | | 5442 |
| HPV31 | L1 | DTTRSTNM | 336 | 8 | | | | | 5443 |
| HPV31 | L1 | DTTRSTNMSV | 336 | 10 | | | | | 5444 |
| HPV31 | L1 | DTYRFVTSQA | 417 | 10 | | | | | 5445 |
| HPV31 | L1 | DTYRFVTSQAI | 417 | 11 | | | | | 5446 |
| HPV31 | L1 | EATVYLPPV | 8 | 9 | | | | | 5447 |
| HPV31 | L1 | EATVYLPPVPV | 8 | 11 | | | | | 5448 |
| HPV31 | L1 | ETQRLVWA | 95 | 8 | | | | | 5449 |
| HPV31 | L1 | ETQRLVWACV | 95 | 10 | | | | | 5450 |
| HPV31 | L1 | EVGRGQPL | 107 | 8 | | | | | 5451 |
| HPV31 | L1 | EVGRGQPLGV | 107 | 10 | | | | | 5452 |
| HPV31 | L1 | EVNLKEKFSA | 449 | 10 | | | | | 5453 |
| HPV31 | L1 | FIFQLCKI | 375 | 8 | | | | | 5454 |
| HPV31 | L1 | FIFQLCKIT | 375 | 9 | | | | | 5455 |
| HPV31 | L1 | FIFQLCKITL | 375 | 10 | | | | | 5456 |
| HPV31 | L1 | FLLQAGYRA | 469 | 9 | | | | | 5457 |
| HPV31 | L1 | FQLCKITL | 377 | 8 | | | | | 5458 |
| HPV31 | L1 | FQLCKITLSA | 377 | 10 | | | | | 5459 |
| HPV31 | L1 | FTALQDTKSNV | 211 | 11 | | | | | 5460 |
| HPV31 | L1 | FVRHFFNRSGT | 257 | 11 | | | | | 5461 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | L1 | FVTSQAIT | 421 | 8 | | | | | 5462 |
| HPV31 | L1 | FVTVVDTT | 331 | 8 | | | | | 5463 |
| HPV31 | L1 | FVTVVDTTRST | 331 | 11 | | | | | 5464 |
| HPV31 | L1 | GAMDFTAL | 207 | 8 | | | | | 5465 |
| HPV31 | L1 | GAMDFTALQDT | 207 | 11 | | | | | 5466 |
| HPV31 | L1 | GICWGNQL | 323 | 8 | | | | | 5467 |
| HPV31 | L1 | GICWGNQLFV | 323 | 10 | | | | | 5468 |
| HPV31 | L1 | GICWGNQLFVT | 323 | 11 | | | | | 5469 |
| HPV31 | L1 | GISGHPLL | 117 | 8 | | | | | 5470 |
| HPV31 | L1 | GLEVGRGQPL | 105 | 10 | | | | | 5471 |
| HPV31 | L1 | GLQYRVFRV | 68 | 9 | | | | | 5472 |
| HPV31 | L1 | GLQYRVFRVRL | 68 | 11 | | | | | 5473 |
| HPV31 | L1 | GLTTPPSGSL | 406 | 10 | | | | | 5474 |
| HPV31 | L1 | GQPLGVGI | 111 | 8 | | | | | 5475 |
| HPV31 | L1 | GTDNRECI | 141 | 8 | | | | | 5476 |
| HPV31 | L1 | GTDNRECISM | 141 | 10 | | | | | 5477 |
| HPV31 | L1 | GTVGESVPT | 266 | 9 | | | | | 5478 |
| HPV31 | L1 | GTVGESVPTDL | 266 | 11 | | | | | 5479 |
| HPV31 | L1 | GVGISGHPL | 115 | 9 | | | | | 5480 |
| HPV31 | L1 | GVGISGHPLL | 115 | 10 | | | | | 5481 |
| HPV31 | L1 | HAGSARLL | 36 | 8 | | | | | 5482 |
| HPV31 | L1 | HAGSARLLT | 36 | 9 | | | | | 5483 |
| HPV31 | L1 | HAGSARLLTV | 36 | 10 | | | | | 5484 |
| HPV31 | L1 | ILEDWNFGL | 399 | 9 | | | | | 5485 |
| HPV31 | L1 | ILEDWNFGLT | 399 | 10 | | | | | 5486 |
| HPV31 | L1 | ILEDWNFGLTT | 399 | 11 | | | | | 5487 |
| HPV31 | L1 | IMTYIHSM | 388 | 8 | | | | | 5488 |
| HPV31 | L1 | IMTYIHSMNPA | 388 | 11 | | | | | 5489 |
| HPV31 | L1 | IQDGDMVDT | 196 | 9 | | | | | 5490 |
| HPV31 | L1 | ITLSADIM | 382 | 8 | | | | | 5491 |
| HPV31 | L1 | ITLSADIMT | 382 | 9 | | | | | 5492 |
| HPV31 | L1 | ITLSADIMTYI | 382 | 11 | | | | | 5493 |
| HPV31 | L1 | ITPGDCPPL | 181 | 9 | | | | | 5494 |
| HPV31 | L1 | ITPGDCPPLEL | 181 | 11 | | | | | 5495 |
| HPV31 | L1 | IVVPKVSGL | 61 | 9 | | | | | 5496 |
| HPV31 | L1 | KAGKRSAPSA | 482 | 10 | | | | | 5497 |
| HPV31 | L1 | KITLSADI | 381 | 8 | | | | | 5498 |
| HPV31 | L1 | KITLSADIM | 381 | 9 | | | | | 5499 |
| HPV31 | L1 | KITLSADIMT | 381 | 10 | | | | | 5500 |
| HPV31 | L1 | KIVVPKVSGL | 60 | 10 | | | | | 5501 |
| HPV31 | L1 | KMVAEPYGDT | 237 | 10 | | | | | 5502 |
| HPV31 | L1 | KMVAEPYGDTL | 237 | 11 | | | | | 5503 |
| HPV31 | L1 | KQTQLCLL | 153 | 8 | | | | | 5504 |
| HPV31 | L1 | KVSGLQYRV | 65 | 9 | | | | | 5505 |
| HPV31 | L1 | KVVSTDEYV | 20 | 9 | | | | | 5506 |
| HPV31 | L1 | KVVSTDEYVT | 20 | 10 | | | | | 5507 |
| HPV31 | L1 | LANSTYFPT | 287 | 9 | | | | | 5508 |
| HPV31 | L1 | LLGCKPPI | 159 | 8 | | | | | 5509 |
| HPV31 | L1 | LLNKFDDT | 123 | 8 | | | | | 5510 |
| HPV31 | L1 | LLQAGYRA | 470 | 8 | | | | | 5511 |
| HPV31 | L1 | LLTVGHPYYSI | 42 | 11 | | | | | 5512 |
| HPV31 | L1 | LQDTKSNV | 214 | 8 | | | | | 5513 |
| HPV31 | L1 | LQDTKSNVPL | 214 | 10 | | | | | 5514 |
| HPV31 | L1 | LQFIFQLCKI | 373 | 10 | | | | | 5515 |
| HPV31 | L1 | LQFIFQLCKIT | 373 | 11 | | | | | 5516 |
| HPV31 | L1 | LQYRVFRV | 69 | 8 | | | | | 5517 |
| HPV31 | L1 | LQYRVFRVRL | 69 | 10 | | | | | 5518 |
| HPV31 | L1 | LTTPPSGSL | 407 | 9 | | | | | 5519 |
| HPV31 | L1 | LTVGHPYYSI | 43 | 10 | | | | | 5520 |
| HPV31 | L1 | LVWACVGL | 99 | 8 | | | | | 5521 |
| HPV31 | L1 | LVWACVGLEV | 99 | 10 | | | | | 5522 |
| HPV31 | L1 | MQRAQGHNNGI | 314 | 11 | | | | | 5523 |
| HPV31 | L1 | MTYIHSMNPA | 389 | 10 | | | | | 5524 |
| HPV31 | L1 | MTYIHSMNPAI | 389 | 11 | | | | | 5525 |
| HPV31 | L1 | MVAEPYGDT | 238 | 9 | | | | | 5526 |
| HPV31 | L1 | MVAEPYGDTL | 238 | 10 | | | | | 5527 |
| HPV31 | L1 | MVDTGFGA | 201 | 8 | | | | | 5528 |
| HPV31 | L1 | MVDTGFGAM | 201 | 9 | | | | | 5529 |
| HPV31 | L1 | MVTSDAQI | 300 | 8 | | | | | 5530 |
| HPV31 | L1 | NAITPGDCPPL | 179 | 11 | | | | | 5531 |
| HPV31 | L1 | NIYYHAGSA | 32 | 9 | | | | | 5532 |
| HPV31 | L1 | NIYYHAGSARL | 32 | 11 | | | | | 5533 |
| HPV31 | L1 | NLKEKFSA | 451 | 8 | | | | | 5534 |
| HPV31 | L1 | NLKEKFSADL | 451 | 10 | | | | | 5535 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | L1 | NMSVCAAI | 342 | 8 | | | | | 5536 |
| HPV31 | L1 | NMSVCAAIA | 342 | 9 | | | | | 5537 |
| HPV31 | L1 | NQLFVTVV | 328 | 8 | | | | | 5538 |
| HPV31 | L1 | NQLFVTVVDT | 328 | 10 | | | | | 5539 |
| HPV31 | L1 | NQLFVTVVDTT | 328 | 11 | | | | | 5540 |
| HPV31 | L1 | NVPLDICNSI | 220 | 10 | | | | | 5541 |
| HPV31 | L1 | PAILEDWNFGL | 397 | 11 | | | | | 5542 |
| HPV31 | L1 | PLDICNSI | 222 | 8 | | | | | 5543 |
| HPV31 | L1 | PLELKNSV | 188 | 8 | | | | | 5544 |
| HPV31 | L1 | PLELKNSVI | 188 | 9 | | | | | 5545 |
| HPV31 | L1 | PLGRKFLL | 464 | 8 | | | | | 5546 |
| HPV31 | L1 | PLGRKFLLQA | 464 | 10 | | | | | 5547 |
| HPV31 | L1 | PLGVGISGHPL | 113 | 11 | | | | | 5548 |
| HPV31 | L1 | PLLNKFDDT | 122 | 9 | | | | | 5549 |
| HPV31 | L1 | PTPSGSMV | 294 | 8 | | | | | 5550 |
| HPV31 | L1 | PTPSGSMVT | 294 | 9 | | | | | 5551 |
| HPV31 | L1 | PVPVSKVV | 15 | 8 | | | | | 5552 |
| HPV31 | L1 | PVPVSKVVST | 15 | 10 | | | | | 5553 |
| HPV31 | L1 | PVSKVVST | 17 | 8 | | | | | 5554 |
| HPV31 | L1 | QAITCQKT | 425 | 8 | | | | | 5555 |
| HPV31 | L1 | QAITCQKTA | 425 | 9 | | | | | 5556 |
| HPV31 | L1 | QIFNKPYWM | 306 | 9 | | | | | 5557 |
| HPV31 | L1 | QLCKITLSA | 378 | 9 | | | | | 5558 |
| HPV31 | L1 | QLCKITLSADI | 378 | 11 | | | | | 5559 |
| HPV31 | L1 | QLCLLGCKPPI | 156 | 11 | | | | | 5560 |
| HPV31 | L1 | QLFVTVVDT | 329 | 9 | | | | | 5561 |
| HPV31 | L1 | QLFVTVVDTT | 329 | 10 | | | | | 5562 |
| HPV31 | L1 | RAQGHNNGI | 316 | 9 | | | | | 5563 |
| HPV31 | L1 | RARPKFKA | 476 | 8 | | | | | 5564 |
| HPV31 | L1 | RLVWACVGL | 98 | 9 | | | | | 5565 |
| HPV31 | L1 | RLVWACVGLEV | 98 | 11 | | | | | 5566 |
| HPV31 | L1 | RTNIYYHA | 30 | 8 | | | | | 5567 |
| HPV31 | L1 | RTNIYYHAGSA | 30 | 11 | | | | | 5568 |
| HPV31 | L1 | SADIMTYI | 385 | 8 | | | | | 5569 |
| HPV31 | L1 | SADIMTYIHSM | 385 | 11 | | | | | 5570 |
| HPV31 | L1 | SADLDQFPL | 457 | 9 | | | | | 5571 |
| HPV31 | L1 | SAPSASTT | 487 | 8 | | | | | 5572 |
| HPV31 | L1 | SAPSASTTT | 487 | 9 | | | | | 5573 |
| HPV31 | L1 | SAPSASTTTPA | 487 | 11 | | | | | 5574 |
| HPV31 | L1 | SASTTTPA | 490 | 8 | | | | | 5575 |
| HPV31 | L1 | SICKYPDYL | 228 | 9 | | | | | 5576 |
| HPV31 | L1 | SICKYPDYLKM | 228 | 11 | | | | | 5577 |
| HPV31 | L1 | SICKSDNPKKI | 51 | 11 | | | | | 5578 |
| HPV31 | L1 | SLEDTYRFV | 414 | 9 | | | | | 5579 |
| HPV31 | L1 | SLEDTYRFVT | 414 | 10 | | | | | 5580 |
| HPV31 | L1 | SLWRPSEA | 2 | 8 | | | | | 5581 |
| HPV31 | L1 | SLWRPSEAT | 2 | 9 | | | | | 5582 |
| HPV31 | L1 | SLWRPSEATV | 2 | 10 | | | | | 5583 |
| HPV31 | L1 | SMDYKQTQL | 149 | 9 | | | | | 5584 |
| HPV31 | L1 | SMDYKQTQLCL | 149 | 11 | | | | | 5585 |
| HPV31 | L1 | SMVTSDAQI | 299 | 9 | | | | | 5586 |
| HPV31 | L1 | SQAITCQKT | 424 | 9 | | | | | 5587 |
| HPV31 | L1 | SQAITCQKTA | 424 | 10 | | | | | 5588 |
| HPV31 | L1 | STATLANST | 283 | 9 | | | | | 5589 |
| HPV31 | L1 | STDEYVTRT | 23 | 9 | | | | | 5590 |
| HPV31 | L1 | STDEYVTRTNI | 23 | 11 | | | | | 5591 |
| HPV31 | L1 | STNMSVCA | 340 | 8 | | | | | 5592 |
| HPV31 | L1 | STNMSVCAA | 340 | 9 | | | | | 5593 |
| HPV31 | L1 | STNMSVCAAI | 340 | 10 | | | | | 5594 |
| HPV31 | L1 | STNMSVCAAIA | 340 | 11 | | | | | 5595 |
| HPV31 | L1 | STTTPAKRKKT | 492 | 11 | | | | | 5596 |
| HPV31 | L1 | STYFPTPSGSM | 290 | 11 | | | | | 5597 |
| HPV31 | L1 | SVCAAIANSDT | 344 | 11 | | | | | 5598 |
| HPV31 | L1 | SVIQDGDM | 194 | 8 | | | | | 5599 |
| HPV31 | L1 | SVIQDGDMV | 194 | 9 | | | | | 5600 |
| HPV31 | L1 | SVIQDGDMVDT | 194 | 11 | | | | | 5601 |
| HPV31 | L1 | SVPTDLYI | 271 | 8 | | | | | 5602 |
| HPV31 | L1 | TALQDTKSNV | 212 | 10 | | | | | 5603 |
| HPV31 | L1 | TATLANST | 284 | 8 | | | | | 5604 |
| HPV31 | L1 | TLANSTYFPT | 286 | 10 | | | | | 5605 |
| HPV31 | L1 | TLFFYLRREQM | 246 | 11 | | | | | 5606 |
| HPV31 | L1 | TLSADIMT | 383 | 8 | | | | | 5607 |
| HPV31 | L1 | TLSADIMTYI | 383 | 10 | | | | | 5608 |
| HPV31 | L1 | TQRLVWACV | 96 | 9 | | | | | 5609 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | L1 | TQRLVWACVGL | 96 | 11 | | | | | 5610 |
| HPV31 | L1 | TTPAKRKKT | 494 | 9 | | | | | 5611 |
| HPV31 | L1 | TTPPSGSL | 408 | 8 | | | | | 5612 |
| HPV31 | L1 | TTPPSGSLEDT | 408 | 11 | | | | | 5613 |
| HPV31 | L1 | TTRSTNMSV | 337 | 9 | | | | | 5614 |
| HPV31 | L1 | TTRSTNMSVCA | 337 | 11 | | | | | 5615 |
| HPV31 | L1 | TTTPAKRKKT | 493 | 10 | | | | | 5616 |
| HPV31 | L1 | TVGESVPT | 267 | 8 | | | | | 5617 |
| HPV31 | L1 | TVGESVPTDL | 267 | 10 | | | | | 5618 |
| HPV31 | L1 | TVGHPYYSI | 44 | 9 | | | | | 5619 |
| HPV31 | L1 | TVVDTTRST | 333 | 9 | | | | | 5620 |
| HPV31 | L1 | TVVDTTRSTNM | 333 | 11 | | | | | 5621 |
| HPV31 | L1 | TVYLPPVPV | 10 | 9 | | | | | 5622 |
| HPV31 | L1 | VAEPYGDT | 239 | 8 | | | | | 5623 |
| HPV31 | L1 | VAEPYGDTL | 239 | 9 | | | | | 5624 |
| HPV31 | L1 | VIQDGDMV | 195 | 8 | | | | | 5625 |
| HPV31 | L1 | VIQDGDMVDT | 195 | 10 | | | | | 5626 |
| HPV31 | L1 | VTRTNIYYHA | 28 | 10 | | | | | 5627 |
| HPV31 | L1 | VTSQAITCQKT | 422 | 11 | | | | | 5628 |
| HPV31 | L1 | VTVVDTTRST | 332 | 10 | | | | | 5629 |
| HPV31 | L1 | VVDTTRST | 334 | 8 | | | | | 5630 |
| HPV31 | L1 | VVDTTRSTNM | 334 | 10 | | | | | 5631 |
| HPV31 | L1 | VVPKVSGL | 62 | 8 | | | | | 5632 |
| HPV31 | L1 | VVSTDEYV | 21 | 8 | | | | | 5633 |
| HPV31 | L1 | VVSTDEYVT | 21 | 9 | | | | | 5634 |
| HPV31 | L1 | VVSTDEYVTRT | 21 | 11 | | | | | 5635 |
| HPV31 | L1 | WACVGLEV | 101 | 8 | | | | | 5636 |
| HPV31 | L1 | YIHSMNPA | 391 | 8 | | | | | 5637 |
| HPV31 | L1 | YIHSMNPAI | 391 | 9 | | | | | 5638 |
| HPV31 | L1 | YIHSMNPAIL | 391 | 10 | | | | | 5639 |
| HPV31 | L1 | YIKGSGST | 277 | 8 | | | | | 5640 |
| HPV31 | L1 | YIKGSGSTA | 277 | 9 | | | | | 5641 |
| HPV31 | L1 | YIKGSGSTAT | 277 | 10 | | | | | 5642 |
| HPV31 | L1 | YIKGSGSTATL | 277 | 11 | | | | | 5643 |
| HPV31 | L1 | YLPPVPVSKV | 12 | 10 | | | | | 5644 |
| HPV31 | L1 | YLPPVPVSKVV | 12 | 11 | | | | | 5645 |
| HPV31 | L1 | YLRHGEEFDL | 364 | 10 | | | | | 5646 |
| HPV31 | L1 | YLRREQMFV | 250 | 9 | | | | | 5647 |
| HPV31 | L1 | YVFWEVNL | 445 | 8 | | | | | 5648 |
| HPV31 | L1 | YVTRTNIYYHA | 27 | 11 | | | | | 5649 |
| HPV31 | L2 | AAGTCPSDV | 24 | 9 | | | | | 5650 |
| HPV31 | L2 | AAGTCPSDVI | 24 | 10 | | | | | 5651 |
| HPV31 | L2 | AILDVTSV | 143 | 8 | | | | | 5652 |
| HPV31 | L2 | AILDVTSVST | 143 | 10 | | | | | 5653 |
| HPV31 | L2 | ALHRPALT | 281 | 8 | | | | | 5654 |
| HPV31 | L2 | ALTSRRNT | 286 | 8 | | | | | 5655 |
| HPV31 | L2 | ALTSRRNTV | 286 | 9 | | | | | 5656 |
| HPV31 | L2 | ATHNVSPST | 367 | 9 | | | | | 5657 |
| HPV31 | L2 | ATHNVSPSTA | 367 | 10 | | | | | 5658 |
| HPV31 | L2 | ATHNVSPSTAV | 367 | 11 | | | | | 5659 |
| HPV31 | L2 | ATQLYQTCKA | 15 | 10 | | | | | 5660 |
| HPV31 | L2 | ATQLYQTCKAA | 15 | 11 | | | | | 5661 |
| HPV31 | L2 | ATQQVKVI | 226 | 8 | | | | | 5662 |
| HPV31 | L2 | ATQQVKVIDPT | 226 | 11 | | | | | 5663 |
| HPV31 | L2 | ATTADTTPA | 135 | 9 | | | | | 5664 |
| HPV31 | L2 | ATTADTTPAI | 135 | 10 | | | | | 5665 |
| HPV31 | L2 | ATTADTTPAIL | 135 | 11 | | | | | 5666 |
| HPV31 | L2 | ATTTSTLNDGL | 342 | 11 | | | | | 5667 |
| HPV31 | L2 | AVQSTSAV | 376 | 8 | | | | | 5668 |
| HPV31 | L2 | AVQSTSAVSA | 376 | 10 | | | | | 5669 |
| HPV31 | L2 | AVSAYVPT | 382 | 8 | | | | | 5670 |
| HPV31 | L2 | AVSAYVPTNT | 382 | 10 | | | | | 5671 |
| HPV31 | L2 | AVSAYVPTNTT | 382 | 11 | | | | | 5672 |
| HPV31 | L2 | DIATTADT | 133 | 8 | | | | | 5673 |
| HPV31 | L2 | DIATTADTT | 133 | 9 | | | | | 5674 |
| HPV31 | L2 | DIATTADTTPA | 133 | 11 | | | | | 5675 |
| HPV31 | L2 | DIIALHRPA | 278 | 9 | | | | | 5676 |
| HPV31 | L2 | DIIALHRPAL | 278 | 10 | | | | | 5677 |
| HPV31 | L2 | DIIALHRPALT | 278 | 11 | | | | | 5678 |
| HPV31 | L2 | DIPIFSGPDV | 400 | 10 | | | | | 5679 |
| HPV31 | L2 | DISSINPA | 322 | 8 | | | | | 5680 |
| HPV31 | L2 | DIYADTDFT | 354 | 9 | | | | | 5681 |
| HPV31 | L2 | DIYADTDFTV | 354 | 10 | | | | | 5682 |
| HPV31 | L2 | DQILRYGSM | 43 | 9 | | | | | 5683 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | L2 | DQILRYGSMGV | 43 | 11 | | | | | 5684 |
| HPV31 | L2 | DTDFTVDT | 358 | 8 | | | | | 5685 |
| HPV31 | L2 | DTDFTVDTPA | 358 | 10 | | | | | 5686 |
| HPV31 | L2 | DTDFTVDTPAT | 358 | 11 | | | | | 5687 |
| HPV31 | L2 | DTPATHNV | 364 | 8 | | | | | 5688 |
| HPV31 | L2 | DTTPAILDV | 139 | 9 | | | | | 5689 |
| HPV31 | L2 | DTTPAILDVT | 139 | 10 | | | | | 5690 |
| HPV31 | L2 | DVGAPAPI | 116 | 8 | | | | | 5691 |
| HPV31 | L2 | DVIPKIEHT | 31 | 9 | | | | | 5692 |
| HPV31 | L2 | DVIPKIEHTT | 31 | 10 | | | | | 5693 |
| HPV31 | L2 | DVIPKIEHTTI | 31 | 11 | | | | | 5694 |
| HPV31 | L2 | DVPIEHAPT | 408 | 9 | | | | | 5695 |
| HPV31 | L2 | DVPIEHAPTQV | 408 | 11 | | | | | 5696 |
| HPV31 | L2 | EASIPIRPPV | 84 | 10 | | | | | 5697 |
| HPV31 | L2 | EIPMDTFI | 190 | 8 | | | | | 5698 |
| HPV31 | L2 | EIPMDTFIV | 190 | 9 | | | | | 5699 |
| HPV31 | L2 | EIPMDTFIVST | 190 | 11 | | | | | 5700 |
| HPV31 | L2 | EMQPLGASA | 334 | 9 | | | | | 5701 |
| HPV31 | L2 | EMQPLGASAT | 334 | 10 | | | | | 5702 |
| HPV31 | L2 | EMQPLGASATT | 334 | 11 | | | | | 5703 |
| HPV31 | L2 | ETSGHLLL | 171 | 8 | | | | | 5704 |
| HPV31 | L2 | ETVNAEESL | 253 | 9 | | | | | 5705 |
| HPV31 | L2 | FIVSTNNENI | 196 | 10 | | | | | 5706 |
| HPV31 | L2 | FIVSTNNENIT | 196 | 11 | | | | | 5707 |
| HPV31 | L2 | FLDIIALHRPA | 276 | 11 | | | | | 5708 |
| HPV31 | L2 | FLSAPKQL | 237 | 8 | | | | | 5709 |
| HPV31 | L2 | FLSAPKQLI | 237 | 9 | | | | | 5710 |
| HPV31 | L2 | FLSAPKQLIT | 237 | 10 | | | | | 5711 |
| HPV31 | L2 | FTDPSVLQPPT | 158 | 11 | | | | | 5712 |
| HPV31 | L2 | FTDVSVAA | 459 | 8 | | | | | 5713 |
| HPV31 | L2 | FTVDTPAT | 361 | 8 | | | | | 5714 |
| HPV31 | L2 | FTVDTPATHNV | 361 | 11 | | | | | 5715 |
| HPV31 | L2 | FVDGGDFYL | 433 | 9 | | | | | 5716 |
| HPV31 | L2 | GAPAPIPHPPT | 118 | 11 | | | | | 5717 |
| HPV31 | L2 | GARVHYYYDI | 314 | 10 | | | | | 5718 |
| HPV31 | L2 | GASATTTST | 339 | 9 | | | | | 5719 |
| HPV31 | L2 | GASATTTSTL | 339 | 10 | | | | | 5720 |
| HPV31 | L2 | GATIGARV | 310 | 8 | | | | | 5721 |
| HPV31 | L2 | GIGSGSGT | 59 | 8 | | | | | 5722 |
| HPV31 | L2 | GIVDVGAPA | 113 | 9 | | | | | 5723 |
| HPV31 | L2 | GIVDVGAPAPI | 113 | 11 | | | | | 5724 |
| HPV31 | L2 | GLGIGSGSGT | 57 | 10 | | | | | 5725 |
| HPV31 | L2 | GLYDIYADT | 351 | 9 | | | | | 5726 |
| HPV31 | L2 | GLYSKATQQV | 221 | 10 | | | | | 5727 |
| HPV31 | L2 | GTCPSDVI | 26 | 8 | | | | | 5728 |
| HPV31 | L2 | GTCPSDVIPKI | 26 | 11 | | | | | 5729 |
| HPV31 | L2 | GTGGRTGYV | 65 | 9 | | | | | 5730 |
| HPV31 | L2 | GTGGRTGYVPL | 65 | 11 | | | | | 5731 |
| HPV31 | L2 | GVFFGGLGI | 52 | 9 | | | | | 5732 |
| HPV31 | L2 | GVRRPARL | 213 | 8 | | | | | 5733 |
| HPV31 | L2 | GVRRPARLGL | 213 | 10 | | | | | 5734 |
| HPV31 | L2 | HAPTQVFPFPL | 413 | 11 | | | | | 5735 |
| HPV31 | L2 | HLLLSSSSI | 175 | 9 | | | | | 5736 |
| HPV31 | L2 | HLLLSSSSIST | 175 | 11 | | | | | 5737 |
| HPV31 | L2 | HTTIADQI | 38 | 8 | | | | | 5738 |
| HPV31 | L2 | HTTIADQIL | 38 | 9 | | | | | 5739 |
| HPV31 | L2 | IADQILRYGSM | 41 | 11 | | | | | 5740 |
| HPV31 | L2 | IALHRPAL | 280 | 8 | | | | | 5741 |
| HPV31 | L2 | IALHRPALT | 280 | 9 | | | | | 5742 |
| HPV31 | L2 | IAPDPDFL | 270 | 8 | | | | | 5743 |
| HPV31 | L2 | IAPDPDFLDI | 270 | 10 | | | | | 5744 |
| HPV31 | L2 | IAPDPDFLDII | 270 | 11 | | | | | 5745 |
| HPV31 | L2 | IATTADTT | 134 | 8 | | | | | 5746 |
| HPV31 | L2 | IATTADTTPA | 134 | 10 | | | | | 5747 |
| HPV31 | L2 | IATTADTTPAI | 134 | 11 | | | | | 5748 |
| HPV31 | L2 | IIALHRPA | 279 | 8 | | | | | 5749 |
| HPV31 | L2 | IIALHRPAL | 279 | 9 | | | | | 5750 |
| HPV31 | L2 | IIALHRPALT | 279 | 10 | | | | | 5751 |
| HPV31 | L2 | ILDVTSVST | 144 | 9 | | | | | 5752 |
| HPV31 | L2 | ILRYGSMGV | 45 | 9 | | | | | 5753 |
| HPV31 | L2 | ITSSTPIPGV | 205 | 10 | | | | | 5754 |
| HPV31 | L2 | ITYENPAYET | 245 | 10 | | | | | 5755 |
| HPV31 | L2 | ITYENPAYETV | 245 | 11 | | | | | 5756 |
| HPV31 | L2 | IVDVGAPA | 114 | 8 | | | | | 5757 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | L2 | IVDVGAPAPI | 114 | 10 | | | | | 5758 |
| HPV31 | L2 | IVSLVEESGI | 105 | 10 | | | | | 5759 |
| HPV31 | L2 | IVSLVEESGIV | 105 | 11 | | | | | 5760 |
| HPV31 | L2 | IVSTNNENI | 197 | 9 | | | | | 5761 |
| HPV31 | L2 | IVSTNNENIT | 197 | 10 | | | | | 5762 |
| HPV31 | L2 | KAAGTCPSDV | 23 | 10 | | | | | 5763 |
| HPV31 | L2 | KAAGTCPSDVI | 23 | 11 | | | | | 5764 |
| HPV31 | L2 | KATQQVKV | 225 | 8 | | | | | 5765 |
| HPV31 | L2 | KATQQVKVI | 225 | 9 | | | | | 5766 |
| HPV31 | L2 | KIEHTTIA | 35 | 8 | | | | | 5767 |
| HPV31 | L2 | KIEHTTIADQI | 35 | 11 | | | | | 5768 |
| HPV31 | L2 | KQLITYENPA | 242 | 10 | | | | | 5769 |
| HPV31 | L2 | KQTLRTRSGA | 302 | 10 | | | | | 5770 |
| HPV31 | L2 | KQTLRTRSGAT | 302 | 11 | | | | | 5771 |
| HPV31 | L2 | KVIDPTFL | 231 | 8 | | | | | 5772 |
| HPV31 | L2 | KVIDPTFLSA | 231 | 10 | | | | | 5773 |
| HPV31 | L2 | LAPTTPQV | 423 | 8 | | | | | 5774 |
| HPV31 | L2 | LAPTTPQVSI | 423 | 10 | | | | | 5775 |
| HPV31 | L2 | LITYENPA | 244 | 8 | | | | | 5776 |
| HPV31 | L2 | LITYENPAYET | 244 | 11 | | | | | 5777 |
| HPV31 | L2 | LLLSSSSI | 176 | 8 | | | | | 5778 |
| HPV31 | L2 | LLLSSSSIST | 176 | 10 | | | | | 5779 |
| HPV31 | L2 | LLSSSSIST | 177 | 9 | | | | | 5780 |
| HPV31 | L2 | LQPPTPAET | 164 | 9 | | | | | 5781 |
| HPV31 | L2 | LTSRRNTV | 287 | 8 | | | | | 5782 |
| HPV31 | L2 | LVEESGIV | 108 | 8 | | | | | 5783 |
| HPV31 | L2 | LVEESGIVDV | 108 | 10 | | | | | 5784 |
| HPV31 | L2 | MLKRRRKRV | 447 | 9 | | | | | 5785 |
| HPV31 | L2 | MQPLGASA | 335 | 8 | | | | | 5786 |
| HPV31 | L2 | MQPLGASAT | 335 | 9 | | | | | 5787 |
| HPV31 | L2 | MQPLGASATT | 335 | 10 | | | | | 5788 |
| HPV31 | L2 | MQPLGASATTT | 335 | 11 | | | | | 5789 |
| HPV31 | L2 | NAEESLYFSNT | 256 | 11 | | | | | 5790 |
| HPV31 | L2 | NIAPDPDFL | 269 | 9 | | | | | 5791 |
| HPV31 | L2 | NIAPDPDFLDI | 269 | 11 | | | | | 5792 |
| HPV31 | L2 | NITSSTPI | 204 | 8 | | | | | 5793 |
| HPV31 | L2 | NITSSTPIPGV | 204 | 11 | | | | | 5794 |
| HPV31 | L2 | NTTVPLST | 390 | 8 | | | | | 5795 |
| HPV31 | L2 | NTVRYSRL | 292 | 8 | | | | | 5796 |
| HPV31 | L2 | NVSPSTAV | 370 | 8 | | | | | 5797 |
| HPV31 | L2 | NVSPSTAVQST | 370 | 11 | | | | | 5798 |
| HPV31 | L2 | PAETSGHL | 169 | 8 | | | | | 5799 |
| HPV31 | L2 | PAETSGHLL | 169 | 9 | | | | | 5800 |
| HPV31 | L2 | PAETSGHLLL | 169 | 10 | | | | | 5801 |
| HPV31 | L2 | PAGESIEM | 328 | 8 | | | | | 5802 |
| HPV31 | L2 | PAGESIEMQPL | 328 | 11 | | | | | 5803 |
| HPV31 | L2 | PAILDVTSV | 142 | 9 | | | | | 5804 |
| HPV31 | L2 | PAILDVTSVST | 142 | 11 | | | | | 5805 |
| HPV31 | L2 | PALTSRRNT | 285 | 9 | | | | | 5806 |
| HPV31 | L2 | PALTSRRNTV | 285 | 10 | | | | | 5807 |
| HPV31 | L2 | PAPIPHPPT | 120 | 9 | | | | | 5808 |
| HPV31 | L2 | PAPIPHPPTT | 120 | 10 | | | | | 5809 |
| HPV31 | L2 | PARLGLYSKA | 217 | 10 | | | | | 5810 |
| HPV31 | L2 | PARLGLYSKAT | 217 | 11 | | | | | 5811 |
| HPV31 | L2 | PATHNVSPST | 366 | 10 | | | | | 5812 |
| HPV31 | L2 | PATHNVSPSTA | 366 | 11 | | | | | 5813 |
| HPV31 | L2 | PAYETVNA | 250 | 8 | | | | | 5814 |
| HPV31 | L2 | PIEHAPTQV | 410 | 9 | | | | | 5815 |
| HPV31 | L2 | PIFSGPDV | 402 | 8 | | | | | 5816 |
| HPV31 | L2 | PIFSGPDVPI | 402 | 10 | | | | | 5817 |
| HPV31 | L2 | PIPGVRRPA | 210 | 9 | | | | | 5818 |
| HPV31 | L2 | PIPGVRRPARL | 210 | 11 | | | | | 5819 |
| HPV31 | L2 | PIPHPPTT | 122 | 8 | | | | | 5820 |
| HPV31 | L2 | PIRPPVSI | 88 | 8 | | | | | 5821 |
| HPV31 | L2 | PIRPPVSIDPV | 88 | 11 | | | | | 5822 |
| HPV31 | L2 | PLAPTTPQV | 422 | 9 | | | | | 5823 |
| HPV31 | L2 | PLAPTTPQVSI | 422 | 11 | | | | | 5824 |
| HPV31 | L2 | PLDPSIVSL | 100 | 9 | | | | | 5825 |
| HPV31 | L2 | PLDPSIVSLV | 100 | 10 | | | | | 5826 |
| HPV31 | L2 | PLGASATT | 337 | 8 | | | | | 5827 |
| HPV31 | L2 | PLGASATTT | 337 | 9 | | | | | 5828 |
| HPV31 | L2 | PLGASATTTST | 337 | 11 | | | | | 5829 |
| HPV31 | L2 | PLSTGFDI | 394 | 8 | | | | | 5830 |
| HPV31 | L2 | PLSTGFDIPI | 394 | 10 | | | | | 5831 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | L2 | PLSTRPST | 74 | 8 | | | | | 5832 |
| HPV31 | L2 | PLSTRPSTV | 74 | 9 | | | | | 5833 |
| HPV31 | L2 | PMDTFIVST | 192 | 9 | | | | | 5834 |
| HPV31 | L2 | PTFLSAPKQL | 235 | 10 | | | | | 5835 |
| HPV31 | L2 | PTFLSAPKQLI | 235 | 11 | | | | | 5836 |
| HPV31 | L2 | PTFTDPSV | 156 | 8 | | | | | 5837 |
| HPV31 | L2 | PTFTDPSVL | 156 | 9 | | | | | 5838 |
| HPV31 | L2 | PTNTTVPL | 388 | 8 | | | | | 5839 |
| HPV31 | L2 | PTNTTVPLST | 388 | 10 | | | | | 5840 |
| HPV31 | L2 | PTPAETSGHL | 167 | 10 | | | | | 5841 |
| HPV31 | L2 | PTPAETSGHLL | 167 | 11 | | | | | 5842 |
| HPV31 | L2 | PTQVFPFPL | 415 | 9 | | | | | 5843 |
| HPV31 | L2 | PTQVFPFPLA | 415 | 10 | | | | | 5844 |
| HPV31 | L2 | PTTPQVSI | 425 | 8 | | | | | 5845 |
| HPV31 | L2 | PTTPQVSIFV | 425 | 10 | | | | | 5846 |
| HPV31 | L2 | PTTSGFDI | 127 | 8 | | | | | 5847 |
| HPV31 | L2 | PTTSGFDIA | 127 | 9 | | | | | 5848 |
| HPV31 | L2 | PTTSGFDIAT | 127 | 10 | | | | | 5849 |
| HPV31 | L2 | PTTSGFDIATT | 127 | 11 | | | | | 5850 |
| HPV31 | L2 | PVGPLDPSI | 97 | 9 | | | | | 5851 |
| HPV31 | L2 | PVGPLDPSIV | 97 | 10 | | | | | 5852 |
| HPV31 | L2 | PVSIDPVGPL | 92 | 10 | | | | | 5853 |
| HPV31 | L2 | QILRYGSM | 44 | 8 | | | | | 5854 |
| HPV31 | L2 | QILRYGSMGV | 44 | 10 | | | | | 5855 |
| HPV31 | L2 | QLITYENPA | 243 | 9 | | | | | 5856 |
| HPV31 | L2 | QLYQTCKA | 17 | 8 | | | | | 5857 |
| HPV31 | L2 | QLYQTCKAA | 17 | 9 | | | | | 5858 |
| HPV31 | L2 | QLYQTCKAAGT | 17 | 11 | | | | | 5859 |
| HPV31 | L2 | QQVKVIDPT | 228 | 9 | | | | | 5860 |
| HPV31 | L2 | QQVKVIDPTFL | 228 | 11 | | | | | 5861 |
| HPV31 | L2 | QTCKAAGT | 20 | 8 | | | | | 5862 |
| HPV31 | L2 | QTLRTRSGA | 303 | 9 | | | | | 5863 |
| HPV31 | L2 | QTLRTRSGAT | 303 | 10 | | | | | 5864 |
| HPV31 | L2 | QTLRTRSGATI | 303 | 11 | | | | | 5865 |
| HPV31 | L2 | QVFPFPLA | 417 | 8 | | | | | 5866 |
| HPV31 | L2 | QVFPFPLAPT | 417 | 10 | | | | | 5867 |
| HPV31 | L2 | QVFPFPLAPTT | 417 | 11 | | | | | 5868 |
| HPV31 | L2 | QVKVIDPT | 229 | 8 | | | | | 5869 |
| HPV31 | L2 | QVKVIDPTFL | 229 | 10 | | | | | 5870 |
| HPV31 | L2 | RASATQLYQT | 12 | 10 | | | | | 5871 |
| HPV31 | L2 | RLGLYSKA | 219 | 8 | | | | | 5872 |
| HPV31 | L2 | RLGLYSKAT | 219 | 9 | | | | | 5873 |
| HPV31 | L2 | RLGNKQTL | 298 | 8 | | | | | 5874 |
| HPV31 | L2 | RLGNKQTLRT | 298 | 10 | | | | | 5875 |
| HPV31 | L2 | RTGYVPLST | 69 | 9 | | | | | 5876 |
| HPV31 | L2 | RTKRASAT | 9 | 8 | | | | | 5877 |
| HPV31 | L2 | RTKRASATQL | 9 | 10 | | | | | 5878 |
| HPV31 | L2 | RTRSGATI | 306 | 8 | | | | | 5879 |
| HPV31 | L2 | RTRSGATIGA | 306 | 10 | | | | | 5880 |
| HPV31 | L2 | RVHYYYDI | 316 | 8 | | | | | 5881 |
| HPV31 | L2 | RVHYYYDISSI | 316 | 11 | | | | | 5882 |
| HPV31 | L2 | RVSYFFTDV | 454 | 9 | | | | | 5883 |
| HPV31 | L2 | RVSYFFTDVSV | 454 | 11 | | | | | 5884 |
| HPV31 | L2 | SAPKQLIT | 239 | 8 | | | | | 5885 |
| HPV31 | L2 | SATQLYQT | 14 | 8 | | | | | 5886 |
| HPV31 | L2 | SATQLYQTCKA | 14 | 11 | | | | | 5887 |
| HPV31 | L2 | SATTTSTL | 341 | 8 | | | | | 5888 |
| HPV31 | L2 | SAVSAYVPT | 381 | 9 | | | | | 5889 |
| HPV31 | L2 | SAVSAYVPTNT | 381 | 11 | | | | | 5890 |
| HPV31 | L2 | SAYVPTNT | 384 | 8 | | | | | 5891 |
| HPV31 | L2 | SAYVPTNTT | 384 | 9 | | | | | 5892 |
| HPV31 | L2 | SAYVPTNTTV | 384 | 10 | | | | | 5893 |
| HPV31 | L2 | SIDPVGPL | 94 | 8 | | | | | 5894 |
| HPV31 | L2 | SIEMQPLGA | 332 | 9 | | | | | 5895 |
| HPV31 | L2 | SIEMQPLGASA | 332 | 11 | | | | | 5896 |
| HPV31 | L2 | SIFVDGGDFYL | 431 | 11 | | | | | 5897 |
| HPV31 | L2 | SINPAGESI | 325 | 9 | | | | | 5898 |
| HPV31 | L2 | SINPAGESIEM | 325 | 11 | | | | | 5899 |
| HPV31 | L2 | SIPIRPPV | 86 | 8 | | | | | 5900 |
| HPV31 | L2 | SIPIRPPVSI | 86 | 10 | | | | | 5901 |
| HPV31 | L2 | SISTHNYEEI | 182 | 10 | | | | | 5902 |
| HPV31 | L2 | SIVSLVEESGI | 104 | 11 | | | | | 5903 |
| HPV31 | L2 | SLVEESGI | 107 | 8 | | | | | 5904 |
| HPV31 | L2 | SLVEESGIV | 107 | 9 | | | | | 5905 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | L2 | SLVEESGIVDV | 107 | 11 | | | | | 5906 |
| HPV31 | L2 | SLYFSNTSHNI | 260 | 11 | | | | | 5907 |
| HPV31 | L2 | SMGVFFGGL | 50 | 9 | | | | | 5908 |
| HPV31 | L2 | SMGVFFGGLGI | 50 | 11 | | | | | 5909 |
| HPV31 | L2 | STAVQSTSA | 374 | 9 | | | | | 5910 |
| HPV31 | L2 | STAVQSTSAV | 374 | 10 | | | | | 5911 |
| HPV31 | L2 | STGFDIPI | 396 | 8 | | | | | 5912 |
| HPV31 | L2 | STHENPTFT | 151 | 9 | | | | | 5913 |
| HPV31 | L2 | STHNYEEI | 184 | 8 | | | | | 5914 |
| HPV31 | L2 | STHNYEEIPM | 184 | 10 | | | | | 5915 |
| HPV31 | L2 | STKRTKRA | 6 | 8 | | | | | 5916 |
| HPV31 | L2 | STKRTKRASA | 6 | 10 | | | | | 5917 |
| HPV31 | L2 | STKRTKRASAT | 6 | 11 | | | | | 5918 |
| HPV31 | L2 | STLNDGLYDI | 346 | 10 | | | | | 5919 |
| HPV31 | L2 | STNNENIT | 199 | 8 | | | | | 5920 |
| HPV31 | L2 | STNNENITSST | 199 | 11 | | | | | 5921 |
| HPV31 | L2 | STPIPGVRRPA | 208 | 11 | | | | | 5922 |
| HPV31 | L2 | STRPSTVSEA | 76 | 10 | | | | | 5923 |
| HPV31 | L2 | STSAVSAYV | 379 | 9 | | | | | 5924 |
| HPV31 | L2 | STSAVSAYVPT | 379 | 11 | | | | | 5925 |
| HPV31 | L2 | STVSEASI | 80 | 8 | | | | | 5926 |
| HPV31 | L2 | STVSEASIPI | 80 | 10 | | | | | 5927 |
| HPV31 | L2 | SVLQPPTPA | 162 | 9 | | | | | 5928 |
| HPV31 | L2 | SVLQPPTPAET | 162 | 11 | | | | | 5929 |
| HPV31 | L2 | SVSTHENPT | 149 | 9 | | | | | 5930 |
| HPV31 | L2 | SVSTHENPTFT | 149 | 11 | | | | | 5931 |
| HPV31 | L2 | TADTTPAI | 137 | 8 | | | | | 5932 |
| HPV31 | L2 | TADTTPAIL | 137 | 9 | | | | | 5933 |
| HPV31 | L2 | TADTTPAILDV | 137 | 11 | | | | | 5934 |
| HPV31 | L2 | TAVQSTSA | 375 | 8 | | | | | 5935 |
| HPV31 | L2 | TAVQSTSAV | 375 | 9 | | | | | 5936 |
| HPV31 | L2 | TAVQSTSAVSA | 375 | 11 | | | | | 5937 |
| HPV31 | L2 | TLNDGLYDI | 347 | 9 | | | | | 5938 |
| HPV31 | L2 | TLNDGLYDIYA | 347 | 11 | | | | | 5939 |
| HPV31 | L2 | TLRTRSGA | 304 | 8 | | | | | 5940 |
| HPV31 | L2 | TLRTRSGAT | 304 | 9 | | | | | 5941 |
| HPV31 | L2 | TLRTRSGATI | 304 | 10 | | | | | 5942 |
| HPV31 | L2 | TQLYQTCKA | 16 | 9 | | | | | 5943 |
| HPV31 | L2 | TQLYQTCKAA | 16 | 10 | | | | | 5944 |
| HPV31 | L2 | TQQVKVIDPT | 227 | 10 | | | | | 5945 |
| HPV31 | L2 | TQVFPFPL | 416 | 8 | | | | | 5946 |
| HPV31 | L2 | TQVFPFPLA | 416 | 9 | | | | | 5947 |
| HPV31 | L2 | TQVFPFPLAPT | 416 | 11 | | | | | 5948 |
| HPV31 | L2 | TTADTTPA | 136 | 8 | | | | | 5949 |
| HPV31 | L2 | TTADTTPAI | 136 | 9 | | | | | 5950 |
| HPV31 | L2 | TTADTTPAIL | 136 | 10 | | | | | 5951 |
| HPV31 | L2 | TTIADQIL | 39 | 8 | | | | | 5952 |
| HPV31 | L2 | TTPAILDV | 140 | 8 | | | | | 5953 |
| HPV31 | L2 | TTPAILDVT | 140 | 9 | | | | | 5954 |
| HPV31 | L2 | TTPAILDVTSV | 140 | 11 | | | | | 5955 |
| HPV31 | L2 | TTPQVSIFV | 426 | 9 | | | | | 5956 |
| HPV31 | L2 | TTSGFDIA | 128 | 8 | | | | | 5957 |
| HPV31 | L2 | TTSGFDIAT | 128 | 9 | | | | | 5958 |
| HPV31 | L2 | TTSGFDIATT | 128 | 10 | | | | | 5959 |
| HPV31 | L2 | TTSGFDIATTA | 128 | 11 | | | | | 5960 |
| HPV31 | L2 | TTSTLNDGL | 344 | 9 | | | | | 5961 |
| HPV31 | L2 | TTTSTLNDGL | 343 | 10 | | | | | 5962 |
| HPV31 | L2 | TTVPLSTGFDI | 391 | 11 | | | | | 5963 |
| HPV31 | L2 | TVDTPATHNV | 362 | 10 | | | | | 5964 |
| HPV31 | L2 | TVNAEESL | 254 | 8 | | | | | 5965 |
| HPV31 | L2 | TVPLSTGFDI | 392 | 10 | | | | | 5966 |
| HPV31 | L2 | TVSEASIPI | 81 | 9 | | | | | 5967 |
| HPV31 | L2 | VIDPTFLSA | 232 | 9 | | | | | 5968 |
| HPV31 | L2 | VIPKIEHT | 32 | 8 | | | | | 5969 |
| HPV31 | L2 | VIPKIEHTT | 32 | 9 | | | | | 5970 |
| HPV31 | L2 | VIPKIEHTTI | 32 | 10 | | | | | 5971 |
| HPV31 | L2 | VIPKIEHTTIA | 32 | 11 | | | | | 5972 |
| HPV31 | L2 | VLQPPTPA | 163 | 8 | | | | | 5973 |
| HPV31 | L2 | VLQPPTPAET | 163 | 10 | | | | | 5974 |
| HPV31 | L2 | VQSTSAVSA | 377 | 9 | | | | | 5975 |
| HPV31 | L2 | VQSTSAVSAYV | 377 | 11 | | | | | 5976 |
| HPV31 | L2 | VTSVSTHENPT | 147 | 11 | | | | | 5977 |
| HPV31 | L2 | YADTDFTV | 356 | 8 | | | | | 5978 |
| HPV31 | L2 | YADTDFTVDT | 356 | 10 | | | | | 5979 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV31 | L2 | YLHPSYYM | 440 | 8 | | | | | 5980 |
| HPV31 | L2 | YLHPSYYML | 440 | 9 | | | | | 5981 |
| HPV31 | L2 | YMLKRRRKRV | 446 | 10 | | | | | 5982 |
| HPV31 | L2 | YQTCKAAGT | 19 | 9 | | | | | 5983 |
| HPV31 | L2 | YVPLSTRPST | 72 | 10 | | | | | 5984 |
| HPV31 | L2 | YVPLSTRPSTV | 72 | 11 | | | | | 5985 |
| HPV31 | L2 | YVPTNTTV | 386 | 8 | | | | | 5986 |
| HPV31 | L2 | YVPTNTTVPL | 386 | 10 | | | | | 5987 |
| HPV33 | E1 | AAAFLKSNSQA | 382 | 11 | | | | | 5988 |
| HPV33 | E1 | AACSQSAA | 90 | 8 | | | | | 5989 |
| HPV33 | E1 | AACSQSAAEDV | 90 | 11 | | | | | 5990 |
| HPV33 | E1 | AAEDVVDRA | 96 | 9 | | | | | 5991 |
| HPV33 | E1 | AAEDVVDRAA | 96 | 10 | | | | | 5992 |
| HPV33 | E1 | AAFLKSNSQA | 383 | 10 | | | | | 5993 |
| HPV33 | E1 | AANPCRTSI | 104 | 9 | | | | | 5994 |
| HPV33 | E1 | AARALFNI | 65 | 8 | | | | | 5995 |
| HPV33 | E1 | ALDGNEISI | 532 | 9 | | | | | 5996 |
| HPV33 | E1 | ALDGNEISIDV | 532 | 11 | | | | | 5997 |
| HPV33 | E1 | ALKRKFAA | 84 | 8 | | | | | 5998 |
| HPV33 | E1 | ALVQLKCPPL | 546 | 10 | | | | | 5999 |
| HPV33 | E1 | ALVQLKCPPLL | 546 | 11 | | | | | 6000 |
| HPV33 | E1 | ALYWFRTA | 311 | 8 | | | | | 6001 |
| HPV33 | E1 | ALYWFRTAM | 311 | 9 | | | | | 6002 |
| HPV33 | E1 | AMSNISDV | 318 | 8 | | | | | 6003 |
| HPV33 | E1 | AMSNISDVQGT | 318 | 11 | | | | | 6004 |
| HPV33 | E1 | AQLADSNSNA | 373 | 10 | | | | | 6005 |
| HPV33 | E1 | AQLADSNSNAA | 373 | 11 | | | | | 6006 |
| HPV33 | E1 | AVCALKRKFA | 81 | 10 | | | | | 6007 |
| HPV33 | E1 | AVCALKRKFAA | 81 | 11 | | | | | 6008 |
| HPV33 | E1 | AVIERRTGDNI | 22 | 11 | | | | | 6009 |
| HPV33 | E1 | CALKRKFA | 83 | 8 | | | | | 6010 |
| HPV33 | E1 | CALKRKFAA | 83 | 9 | | | | | 6011 |
| HPV33 | E1 | CALYWFRT | 310 | 8 | | | | | 6012 |
| HPV33 | E1 | CALYWFRTA | 310 | 9 | | | | | 6013 |
| HPV33 | E1 | CALYWFRTAM | 310 | 10 | | | | | 6014 |
| HPV33 | E1 | CITGYGISPSV | 230 | 11 | | | | | 6015 |
| HPV33 | E1 | CLTCDRGI | 259 | 8 | | | | | 6016 |
| HPV33 | E1 | CLTCDRGII | 259 | 9 | | | | | 6017 |
| HPV33 | E1 | CLTCDRGIII | 259 | 10 | | | | | 6018 |
| HPV33 | E1 | CLTCDRGIIIL | 259 | 11 | | | | | 6019 |
| HPV33 | E1 | CMLICGPA | 465 | 8 | | | | | 6020 |
| HPV33 | E1 | CMLICGPANT | 465 | 10 | | | | | 6021 |
| HPV33 | E1 | CMVIEPPKL | 297 | 9 | | | | | 6022 |
| HPV33 | E1 | CTDWCITGYGI | 226 | 11 | | | | | 6023 |
| HPV33 | E1 | CTGWFEVEA | 14 | 9 | | | | | 6024 |
| HPV33 | E1 | CTGWFEVEAV | 14 | 10 | | | | | 6025 |
| HPV33 | E1 | CTGWFEVEAVI | 14 | 11 | | | | | 6026 |
| HPV33 | E1 | CTYRKRKI | 118 | 8 | | | | | 6027 |
| HPV33 | E1 | CTYRKRKIDEL | 118 | 11 | | | | | 6028 |
| HPV33 | E1 | CVNSKSHFWL | 494 | 10 | | | | | 6029 |
| HPV33 | E1 | DAKIGMIDDV | 508 | 10 | | | | | 6030 |
| HPV33 | E1 | DAKIGMIDDVT | 508 | 11 | | | | | 6031 |
| HPV33 | E1 | DIAYYYAQL | 367 | 9 | | | | | 6032 |
| HPV33 | E1 | DIAYYYAQLA | 367 | 10 | | | | | 6033 |
| HPV33 | E1 | DLLEFIDDSM | 46 | 10 | | | | | 6034 |
| HPV33 | E1 | DLNAVCAL | 78 | 8 | | | | | 6035 |
| HPV33 | E1 | DLSEMVQWA | 349 | 9 | 0.0003 | | | | 6036 |
| HPV33 | E1 | DTEAARAL | 62 | 8 | | | | | 6037 |
| HPV33 | E1 | DTEAARALFNI | 62 | 11 | | | | | 6038 |
| HPV33 | E1 | DVKHRALV | 541 | 8 | | | | | 6039 |
| HPV33 | E1 | DVKHRALVQL | 541 | 10 | | | | | 6040 |
| HPV33 | E1 | DVQGTTPEWI | 324 | 10 | | | | | 6041 |
| HPV33 | E1 | DVTPISWT | 516 | 8 | | | | | 6042 |
| HPV33 | E1 | DVTPISWTYI | 516 | 10 | | | | | 6043 |
| HPV33 | E1 | EAARALFNI | 64 | 9 | | | | | 6044 |
| HPV33 | E1 | EAVIERRT | 21 | 8 | | | | | 6045 |
| HPV33 | E1 | EAYGISFM | 206 | 8 | | | | | 6046 |
| HPV33 | E1 | EAYGISFMEL | 206 | 10 | | | | | 6047 |
| HPV33 | E1 | EAYGISFMELV | 206 | 11 | | | | | 6048 |
| HPV33 | E1 | EISIDVKHRA | 537 | 10 | | | | | 6049 |
| HPV33 | E1 | EISIDVKHRAL | 537 | 11 | | | | | 6050 |
| HPV33 | E1 | EISNVLHSSNT | 186 | 11 | | | | | 6051 |
| HPV33 | E1 | ELEDSGYGNT | 127 | 10 | | | | | 6052 |
| HPV33 | E1 | ELTDDSDI | 361 | 8 | | | | | 6053 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E1 | ELTDDSDIA | 361 | 9 | | | | | 6054 |
| HPV33 | E1 | ELVRPFKSDKT | 214 | 11 | | | | | 6055 |
| HPV33 | E1 | EMVQWAYDNEL | 352 | 11 | | | | | 6056 |
| HPV33 | E1 | ETADDSGT | 38 | 8 | | | | | 6057 |
| HPV33 | E1 | ETADDSGTDL | 38 | 10 | | | | | 6058 |
| HPV33 | E1 | ETADDSGTDLL | 38 | 11 | | | | | 6059 |
| HPV33 | E1 | ETCMVIEPPKL | 295 | 11 | | | | | 6060 |
| HPV33 | E1 | ETNVDSCENV | 173 | 10 | | | | | 6061 |
| HPV33 | E1 | ETNVDSCENVT | 173 | 11 | | | | | 6062 |
| HPV33 | E1 | ETQQMVQQV | 139 | 9 | | | | | 6063 |
| HPV33 | E1 | EVEAVIERRT | 19 | 10 | | | | | 6064 |
| HPV33 | E1 | EVETQQMV | 137 | 8 | | | | | 6065 |
| HPV33 | E1 | EVETQQMVQQV | 137 | 11 | | | | | 6066 |
| HPV33 | E1 | EVSCETNV | 169 | 8 | | | | | 6067 |
| HPV33 | E1 | FAACSQSA | 89 | 8 | | | | | 6068 |
| HPV33 | E1 | FAACSQSAA | 89 | 9 | | | | | 6069 |
| HPV33 | E1 | FIDDSMENSI | 50 | 10 | | | | | 6070 |
| HPV33 | E1 | FLGAFKKFL | 449 | 9 | | | | | 6071 |
| HPV33 | E1 | FLKGCVISCV | 486 | 10 | | | | | 6072 |
| HPV33 | E1 | FLKGIPKKSCM | 456 | 11 | | | | | 6073 |
| HPV33 | E1 | FLKSNSQA | 385 | 8 | | | | | 6074 |
| HPV33 | E1 | FLKSNSQAKI | 385 | 10 | 0.0011 | | | | 6075 |
| HPV33 | E1 | FLKSNSQAKIV | 385 | 11 | | | | | 6076 |
| HPV33 | E1 | GAFKKFLKGI | 451 | 10 | | | | | 6077 |
| HPV33 | E1 | GIIILLLI | 265 | 8 | | | | | 6078 |
| HPV33 | E1 | GIMCRHYKKA | 399 | 10 | | | | | 6079 |
| HPV33 | E1 | GIPKKSCM | 459 | 8 | | | | | 6080 |
| HPV33 | E1 | GIPKKSCML | 459 | 9 | | | | | 6081 |
| HPV33 | E1 | GIPKKSCMLI | 459 | 10 | | | | | 6082 |
| HPV33 | E1 | GISFMELV | 209 | 8 | | | | | 6083 |
| HPV33 | E1 | GISPSVAESL | 235 | 10 | | | | | 6084 |
| HPV33 | E1 | GMGCTGWFEV | 11 | 10 | | | | | 6085 |
| HPV33 | E1 | GMIDDVTPI | 512 | 9 | | | | | 6086 |
| HPV33 | E1 | GMSLIQFL | 480 | 8 | | | | | 6087 |
| HPV33 | E1 | GQWIQSRCEKT | 416 | 11 | | | | | 6088 |
| HPV33 | E1 | GTDLLEFI | 44 | 8 | | | | | 6089 |
| HPV33 | E1 | GTDSRWPYL | 564 | 9 | | | | | 6090 |
| HPV33 | E1 | GTNGAGMGCT | 6 | 10 | | | | | 6091 |
| HPV33 | E1 | GTTPEWIDRL | 327 | 10 | | | | | 6092 |
| HPV33 | E1 | GTTPEWIDRLT | 327 | 11 | | | | | 6093 |
| HPV33 | E1 | GVGDDSEV | 163 | 8 | | | | | 6094 |
| HPV33 | E1 | HLQCLTCDRGI | 256 | 11 | | | | | 6095 |
| HPV33 | E1 | IAYYYAQL | 368 | 8 | | | | | 6096 |
| HPV33 | E1 | IAYYYAQLA | 368 | 9 | | | | | 6097 |
| HPV33 | E1 | ILYKFKEA | 200 | 8 | | | | | 6098 |
| HPV33 | E1 | ILYKFKEAYGI | 200 | 11 | | | | | 6099 |
| HPV33 | E1 | IMCRHYKKA | 400 | 9 | | | | | 6100 |
| HPV33 | E1 | IQADTEAA | 59 | 8 | | | | | 6101 |
| HPV33 | E1 | IQADTEAARA | 59 | 10 | | | | | 6102 |
| HPV33 | E1 | IQADTEAARAL | 59 | 11 | | | | | 6103 |
| HPV33 | E1 | IQEGEDDL | 72 | 8 | | | | | 6104 |
| HPV33 | E1 | IQEGEDDLNA | 72 | 10 | | | | | 6105 |
| HPV33 | E1 | IQEGEDDLNAV | 72 | 11 | | | | | 6106 |
| HPV33 | E1 | IQFLKGCV | 484 | 8 | | | | | 6107 |
| HPV33 | E1 | IQFLKGCVI | 484 | 9 | | | | | 6108 |
| HPV33 | E1 | IQSRCEKT | 419 | 8 | | | | | 6109 |
| HPV33 | E1 | ITGYGISPSV | 231 | 10 | | | | | 6110 |
| HPV33 | E1 | ITGYGISPSVA | 231 | 11 | | | | | 6111 |
| HPV33 | E1 | IVKDCGIM | 394 | 8 | | | | | 6112 |
| HPV33 | E1 | IVQLLRYQNI | 435 | 10 | | | | | 6113 |
| HPV33 | E1 | KAEKRKMSI | 407 | 9 | | | | | 6114 |
| HPV33 | E1 | KANILYKFKEA | 197 | 11 | | | | | 6115 |
| HPV33 | E1 | KIGMIDDV | 510 | 8 | | | | | 6116 |
| HPV33 | E1 | KIGMIDDVT | 510 | 9 | | | | | 6117 |
| HPV33 | E1 | KIGMIDDVTPI | 510 | 11 | | | | | 6118 |
| HPV33 | E1 | KIVKDCGI | 393 | 8 | | | | | 6119 |
| HPV33 | E1 | KIVKDCGIM | 393 | 9 | | | | | 6120 |
| HPV33 | E1 | KLMSNLLSI | 285 | 9 | | | | | 6121 |
| HPV33 | E1 | KLRSQTCA | 304 | 8 | | | | | 6122 |
| HPV33 | E1 | KLRSQTCAL | 304 | 9 | | | | | 6123 |
| HPV33 | E1 | KMSIGQWI | 412 | 8 | | | | | 6124 |
| HPV33 | E1 | KQHSLYTHL | 249 | 9 | | | | | 6125 |
| HPV33 | E1 | KTNDGGNWRPI | 425 | 11 | | | | | 6126 |
| HPV33 | E1 | KTSCTDWCI | 223 | 9 | | | | | 6127 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E1 | KTSCTDWCIT | 223 | 10 | | | | | 6128 |
| HPV33 | E1 | KVLIKQHSL | 245 | 9 | | | | | 6129 |
| HPV33 | E1 | KVLIKQHSLYT | 245 | 11 | | | | | 6130 |
| HPV33 | E1 | LADSNSNA | 375 | 8 | | | | | 6131 |
| HPV33 | E1 | LADSNSNAA | 375 | 9 | | | | | 6132 |
| HPV33 | E1 | LADSNSNAAA | 375 | 10 | | | | | 6133 |
| HPV33 | E1 | LICGPANT | 467 | 8 | | | | | 6134 |
| HPV33 | E1 | LIKQHSLYT | 247 | 9 | | | | | 6135 |
| HPV33 | E1 | LIKQHSLYTHL | 247 | 11 | | | | | 6136 |
| HPV33 | E1 | LIQFLKGCV | 483 | 9 | | | | | 6137 |
| HPV33 | E1 | LIQFLKGCVI | 483 | 10 | | | | | 6138 |
| HPV33 | E1 | LIRFRCSKNRL | 271 | 11 | | | | | 6139 |
| HPV33 | E1 | LLEFIDDSM | 47 | 9 | | | | | 6140 |
| HPV33 | E1 | LLLTSNTNA | 555 | 9 | | | | | 6141 |
| HPV33 | E1 | LLLTSNTNAGT | 555 | 11 | | | | | 6142 |
| HPV33 | E1 | LLRYQNIEFT | 438 | 10 | | | | | 6143 |
| HPV33 | E1 | LLRYQNIEFTA | 438 | 11 | | | | | 6144 |
| HPV33 | E1 | LLSIPETCM | 290 | 9 | | | | | 6145 |
| HPV33 | E1 | LLSIPETCMV | 290 | 10 | | | | | 6146 |
| HPV33 | E1 | LLSIPETCMVI | 290 | 11 | | | | | 6147 |
| HPV33 | E1 | LLTSNTNA | 556 | 8 | | | | | 6148 |
| HPV33 | E1 | LLTSNTNAGT | 556 | 10 | | | | | 6149 |
| HPV33 | E1 | LMSNLLSI | 286 | 8 | | | | | 6150 |
| HPV33 | E1 | LMSNLLSIPET | 286 | 11 | | | | | 6151 |
| HPV33 | E1 | LQCLTCDRGI | 257 | 10 | | | | | 6152 |
| HPV33 | E1 | LQCLTCDRGII | 257 | 11 | | | | | 6153 |
| HPV33 | E1 | LQEISNVL | 184 | 8 | | | | | 6154 |
| HPV33 | E1 | LQHSFNDNI | 339 | 9 | | | | | 6155 |
| HPV33 | E1 | LQPLSDAKI | 503 | 9 | | | | | 6156 |
| HPV33 | E1 | LQPLSDAKIGM | 503 | 11 | | | | | 6157 |
| HPV33 | E1 | LTCDRGII | 260 | 8 | | | | | 6158 |
| HPV33 | E1 | LTCDRGIII | 260 | 9 | | | | | 6159 |
| HPV33 | E1 | LTCDRGIIIL | 260 | 10 | | | | | 6160 |
| HPV33 | E1 | LTCDRGIIILL | 260 | 11 | | | | | 6161 |
| HPV33 | E1 | LTDDSDIA | 362 | 8 | | | | | 6162 |
| HPV33 | E1 | LTSNTNAGT | 557 | 9 | | | | | 6163 |
| HPV33 | E1 | LTVAKLMSNL | 281 | 10 | | | | | 6164 |
| HPV33 | E1 | LTVAKLMSNLL | 281 | 11 | | | | | 6165 |
| HPV33 | E1 | LVQLKCPPL | 547 | 9 | 0.0003 | | | | 6166 |
| HPV33 | E1 | LVQLKCPPLL | 547 | 10 | | | | | 6167 |
| HPV33 | E1 | LVQLKCPPLLL | 547 | 11 | | | | | 6168 |
| HPV33 | E1 | LVRPFKSDKT | 215 | 10 | | | | | 6169 |
| HPV33 | E1 | MADPEGTNGA | 1 | 10 | | | | | 6170 |
| HPV33 | E1 | MIDDVTPI | 513 | 8 | | | | | 6171 |
| HPV33 | E1 | MIDDVTPISWT | 513 | 11 | | | | | 6172 |
| HPV33 | E1 | MLICGPANT | 466 | 9 | | | | | 6173 |
| HPV33 | E1 | MVIEPPKL | 298 | 8 | | | | | 6174 |
| HPV33 | E1 | MVQWAYDNEL | 353 | 10 | | | | | 6175 |
| HPV33 | E1 | MVQWAYDNELT | 353 | 11 | | | | | 6176 |
| HPV33 | E1 | NAGTDSRWPYL | 562 | 11 | | | | | 6177 |
| HPV33 | E1 | NALDGNEI | 531 | 8 | | | | | 6178 |
| HPV33 | E1 | NALDGNEISI | 531 | 10 | | | | | 6179 |
| HPV33 | E1 | NAVCALKRKFA | 80 | 11 | | | | | 6180 |
| HPV33 | E1 | NIEFTAFL | 443 | 8 | | | | | 6181 |
| HPV33 | E1 | NIEFTAFLGA | 443 | 10 | | | | | 6182 |
| HPV33 | E1 | NIFDLSEM | 346 | 8 | | | | | 6183 |
| HPV33 | E1 | NIFDLSEMV | 346 | 9 | | | | | 6184 |
| HPV33 | E1 | NILYKFKEA | 199 | 9 | | | | | 6185 |
| HPV33 | E1 | NIQEGEDDL | 71 | 9 | | | | | 6186 |
| HPV33 | E1 | NIQEGEDDLNA | 71 | 11 | | | | | 6187 |
| HPV33 | E1 | NISDVQGT | 321 | 8 | | | | | 6188 |
| HPV33 | E1 | NISDVQGTT | 321 | 9 | | | | | 6189 |
| HPV33 | E1 | NISEDEDET | 31 | 9 | | | | | 6190 |
| HPV33 | E1 | NISEDEDETA | 31 | 10 | | | | | 6191 |
| HPV33 | E1 | NISTFKCSA | 627 | 9 | | | | | 6192 |
| HPV33 | E1 | NLLSIPET | 289 | 8 | | | | | 6193 |
| HPV33 | E1 | NLLSIPETCM | 289 | 10 | | | | | 6194 |
| HPV33 | E1 | NLLSIPETCMV | 289 | 11 | | | | | 6195 |
| HPV33 | E1 | NLNDLESSGV | 155 | 10 | | | | | 6196 |
| HPV33 | E1 | NTEVETQQM | 135 | 9 | | | | | 6197 |
| HPV33 | E1 | NTEVETQQMV | 135 | 10 | | | | | 6198 |
| HPV33 | E1 | NTGKSYFGM | 473 | 9 | | | | | 6199 |
| HPV33 | E1 | NTGKSYFGMSL | 473 | 11 | | | | | 6200 |
| HPV33 | E1 | NVDSCENV | 175 | 8 | | | | | 6201 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E1 | NVDSCENVT | 175 | 9 | | | | | 6202 |
| HPV33 | E1 | NVDSCENVTL | 175 | 10 | | | | | 6203 |
| HPV33 | E1 | NVLHSSNT | 189 | 8 | | | | | 6204 |
| HPV33 | E1 | NVLHSSNTKA | 189 | 10 | | | | | 6205 |
| HPV33 | E1 | NVTLQEISNV | 181 | 10 | | | | | 6206 |
| HPV33 | E1 | NVTLQEISNVL | 181 | 11 | | | | | 6207 |
| HPV33 | E1 | PANTGKSYFGM | 471 | 11 | | | | | 6208 |
| HPV33 | E1 | PISWTYIDDYM | 519 | 11 | | | | | 6209 |
| HPV33 | E1 | PIVQLLRYQNI | 434 | 11 | | | | | 6210 |
| HPV33 | E1 | PLLLTSNT | 554 | 8 | | | | | 6211 |
| HPV33 | E1 | PLLLTSNTNA | 554 | 10 | | | | | 6212 |
| HPV33 | E1 | PLSDAKIGM | 505 | 9 | | | | | 6213 |
| HPV33 | E1 | PLSDAKIGMI | 505 | 10 | | | | | 6214 |
| HPV33 | E1 | QADTEAARA | 60 | 9 | | | | | 6215 |
| HPV33 | E1 | QADTEAARAL | 60 | 10 | | | | | 6216 |
| HPV33 | E1 | QAKIVKDCGI | 391 | 10 | | | | | 6217 |
| HPV33 | E1 | QAKIVKDCGIM | 391 | 11 | | | | | 6218 |
| HPV33 | E1 | QLADSNSNA | 374 | 9 | | | | | 6219 |
| HPV33 | E1 | QLADSNSNAA | 374 | 10 | | | | | 6220 |
| HPV33 | E1 | QLADSNSNAAA | 374 | 11 | | | | | 6221 |
| HPV33 | E1 | QLKCPPLL | 549 | 8 | | | | | 6222 |
| HPV33 | E1 | QLKCPPLLL | 549 | 9 | | | | | 6223 |
| HPV33 | E1 | QLKCPPLLLT | 549 | 10 | | | | | 6224 |
| HPV33 | E1 | QLLRYQNI | 437 | 8 | | | | | 6225 |
| HPV33 | E1 | QLLRYQNIEFT | 437 | 11 | | | | | 6226 |
| HPV33 | E1 | QQVESQNGDT | 145 | 10 | | | | | 6227 |
| HPV33 | E1 | QTCALYWFRT | 308 | 10 | | | | | 6228 |
| HPV33 | E1 | QTCALYWFRTA | 308 | 11 | | | | | 6229 |
| HPV33 | E1 | QVESQNGDT | 146 | 9 | | | | | 6230 |
| HPV33 | E1 | QVESQNGDTNL | 146 | 11 | | | | | 6231 |
| HPV33 | E1 | RAANPCRT | 103 | 8 | | | | | 6232 |
| HPV33 | E1 | RAANPCRTSI | 103 | 10 | | | | | 6233 |
| HPV33 | E1 | RALVQLKCPPL | 545 | 11 | | | | | 6234 |
| HPV33 | E1 | RLTVAKLM | 280 | 8 | | | | | 6235 |
| HPV33 | E1 | RLTVAKLMSNL | 280 | 11 | | | | | 6236 |
| HPV33 | E1 | RTAMSNISDV | 316 | 10 | | | | | 6237 |
| HPV33 | E1 | RTSINKNKECT | 109 | 11 | | | | | 6238 |
| HPV33 | E1 | RTWCKLDL | 608 | 8 | | | | | 6239 |
| HPV33 | E1 | RTWCKLDLI | 608 | 9 | | | | | 6240 |
| HPV33 | E1 | SAAEDVVDRA | 95 | 10 | | | | | 6241 |
| HPV33 | E1 | SAAEDVVDRAA | 95 | 11 | | | | | 6242 |
| HPV33 | E1 | SAGENTRSL | 634 | 9 | | | | | 6243 |
| HPV33 | E1 | SIDVKHRA | 539 | 8 | | | | | 6244 |
| HPV33 | E1 | SIDVKHRAL | 539 | 9 | | | | | 6245 |
| HPV33 | E1 | SIDVKHRALV | 539 | 10 | | | | | 6246 |
| HPV33 | E1 | SINKNKECT | 111 | 9 | | | | | 6247 |
| HPV33 | E1 | SIPETCMV | 292 | 8 | | | | | 6248 |
| HPV33 | E1 | SIPETCMVI | 292 | 9 | | | | | 6249 |
| HPV33 | E1 | SIQADTEA | 58 | 8 | | | | | 6250 |
| HPV33 | E1 | SIQADTEAA | 58 | 9 | | | | | 6251 |
| HPV33 | E1 | SIQADTEAARA | 58 | 11 | | | | | 6252 |
| HPV33 | E1 | SLIQFLKGCV | 482 | 10 | | | | | 6253 |
| HPV33 | E1 | SLIQFLKGCVI | 482 | 11 | | | | | 6254 |
| HPV33 | E1 | SLKVLIKQHSL | 243 | 11 | | | | | 6255 |
| HPV33 | E1 | SLYTHLQCL | 252 | 9 | | | | | 6256 |
| HPV33 | E1 | SLYTHLQCLT | 252 | 10 | | | | | 6257 |
| HPV33 | E1 | SMENSIQA | 54 | 8 | | | | | 6258 |
| HPV33 | E1 | SMENSIQADT | 54 | 10 | | | | | 6259 |
| HPV33 | E1 | SQAKIVKDCGI | 390 | 11 | | | | | 6260 |
| HPV33 | E1 | SQNGDTNL | 149 | 8 | | | | | 6261 |
| HPV33 | E1 | SQNGDTNLNDL | 149 | 11 | | | | | 6262 |
| HPV33 | E1 | SQSAAEDV | 93 | 8 | | | | | 6263 |
| HPV33 | E1 | SQSAAEDVV | 93 | 9 | | | | | 6264 |
| HPV33 | E1 | SQTCALYWFRT | 307 | 11 | | | | | 6265 |
| HPV33 | E1 | STFKCSAGENT | 629 | 11 | | | | | 6266 |
| HPV33 | E1 | SVAESLKV | 239 | 8 | | | | | 6267 |
| HPV33 | E1 | SVAESLKVL | 239 | 9 | | | | | 6268 |
| HPV33 | E1 | SVAESLKVLI | 239 | 10 | | | | | 6269 |
| HPV33 | E1 | TADDSGTDL | 39 | 9 | | | | | 6270 |
| HPV33 | E1 | TADDSGTDLL | 39 | 10 | | | | | 6271 |
| HPV33 | E1 | TAFLGAFKKFL | 447 | 11 | | | | | 6272 |
| HPV33 | E1 | TAMSNISDV | 317 | 9 | | | | | 6273 |
| HPV33 | E1 | TLQEISNV | 183 | 8 | | | | | 6274 |
| HPV33 | E1 | TLQEISNVL | 183 | 9 | | | | | 6275 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E1 | TQQMVQQV | 140 | 8 | | | | | 6276 |
| HPV33 | E1 | TTPEWIDRL | 328 | 9 | | | | | 6277 |
| HPV33 | E1 | TTPEWIDRLT | 328 | 10 | | | | | 6278 |
| HPV33 | E1 | TTPEWIDRLTV | 328 | 11 | | | | | 6279 |
| HPV33 | E1 | TVAKLMSNL | 282 | 9 | | | | | 6280 |
| HPV33 | E1 | TVAKLMSNLL | 282 | 10 | | | | | 6281 |
| HPV33 | E1 | TVLQHSFNDNI | 337 | 11 | | | | | 6282 |
| HPV33 | E1 | VAESLKVL | 240 | 8 | | | | | 6283 |
| HPV33 | E1 | VAESLKVLI | 240 | 9 | | | | | 6284 |
| HPV33 | E1 | VAKLMSNL | 283 | 8 | | | | | 6285 |
| HPV33 | E1 | VAKLMSNLL | 283 | 9 | | | | | 6286 |
| HPV33 | E1 | VAKLMSNLLSI | 283 | 11 | | | | | 6287 |
| HPV33 | E1 | VIEPPKLRSQT | 299 | 11 | | | | | 6288 |
| HPV33 | E1 | VIERRTGDNI | 23 | 10 | | | | | 6289 |
| HPV33 | E1 | VLHSSNTKA | 190 | 9 | | | | | 6290 |
| HPV33 | E1 | VLHSSNTKANI | 190 | 11 | | | | | 6291 |
| HPV33 | E1 | VLIKQHSL | 246 | 8 | | | | | 6292 |
| HPV33 | E1 | VLIKQHSLYT | 246 | 10 | | | | | 6293 |
| HPV33 | E1 | VLQHSFNDNI | 338 | 10 | | | | | 6294 |
| HPV33 | E1 | VQGTTPEWI | 325 | 9 | | | | | 6295 |
| HPV33 | E1 | VQLKCPPL | 548 | 8 | | | | | 6296 |
| HPV33 | E1 | VQLKCPPLL | 548 | 9 | | | | | 6297 |
| HPV33 | E1 | VQLKCPPLLL | 548 | 10 | | | | | 6298 |
| HPV33 | E1 | VQLKCPPLLLT | 548 | 11 | | | | | 6299 |
| HPV33 | E1 | VQLLRYQNI | 436 | 9 | | | | | 6300 |
| HPV33 | E1 | VQQVESQNGDT | 144 | 11 | | | | | 6301 |
| HPV33 | E1 | VQWAYDNEL | 354 | 9 | | | | | 6302 |
| HPV33 | E1 | VQWAYDNELT | 354 | 10 | | | | | 6303 |
| HPV33 | E1 | VTLQEISNV | 182 | 9 | | | | | 6304 |
| HPV33 | E1 | VTLQEISNVL | 182 | 10 | | | | | 6305 |
| HPV33 | E1 | VTPISWTYI | 517 | 9 | | | | | 6306 |
| HPV33 | E1 | VVDRAANPCRT | 100 | 11 | | | | | 6307 |
| HPV33 | E1 | WAYDNELT | 356 | 8 | | | | | 6308 |
| HPV33 | E1 | WIDRLTVL | 332 | 8 | | | | | 6309 |
| HPV33 | E1 | WIQSRCEKT | 418 | 9 | | | | | 6310 |
| HPV33 | E1 | WLQPLSDA | 502 | 8 | | | | | 6311 |
| HPV33 | E1 | WLQPLSDAKI | 502 | 10 | | | | | 6312 |
| HPV33 | E1 | WTYIDDYM | 522 | 8 | | | | | 6313 |
| HPV33 | E1 | WTYIDDYMRNA | 522 | 11 | | | | | 6314 |
| HPV33 | E1 | YAQLADSNSNA | 372 | 11 | | | | | 6315 |
| HPV33 | E1 | YIDDYMRNA | 524 | 9 | | | | | 6316 |
| HPV33 | E1 | YIDDYMRNAL | 524 | 10 | | | | | 6317 |
| HPV33 | E1 | YLHSRLTV | 571 | 8 | | | | | 6318 |
| HPV33 | E1 | YMRNALDGNEI | 528 | 11 | | | | | 6319 |
| HPV33 | E1 | YQNIEFTA | 441 | 8 | | | | | 6320 |
| HPV33 | E1 | YQNIEFTAFL | 441 | 10 | | | | | 6321 |
| HPV33 | E1 | YTHLQCLT | 254 | 8 | | | | | 6322 |
| HPV33 | E2 | AAAKRRRPA | 223 | 9 | | | | | 6323 |
| HPV33 | E2 | AAAKRRRPADT | 223 | 11 | | | | | 6324 |
| HPV33 | E2 | AAKRRRPA | 224 | 8 | | | | | 6325 |
| HPV33 | E2 | AAKRRRPADT | 224 | 10 | | | | | 6326 |
| HPV33 | E2 | AAKRRRPADTT | 224 | 11 | | | | | 6327 |
| HPV33 | E2 | AAKYSKTQM | 175 | 9 | | | | | 6328 |
| HPV33 | E2 | ALDNRTART | 249 | 9 | | | | | 6329 |
| HPV33 | E2 | ALDNRTARTA | 249 | 10 | | | | | 6330 |
| HPV33 | E2 | ALDNRTARTAT | 249 | 11 | | | | | 6331 |
| HPV33 | E2 | ALLYTAKQM | 41 | 9 | | | | | 6332 |
| HPV33 | E2 | AQPLTKLFCA | 237 | 10 | | | | | 6333 |
| HPV33 | E2 | ATNCTNKQRT | 258 | 10 | | | | | 6334 |
| HPV33 | E2 | ATNCTNKQRTV | 258 | 11 | | | | | 6335 |
| HPV33 | E2 | AVQEKILDL | 10 | 9 | | | | | 6336 |
| HPV33 | E2 | CADPALDNRT | 245 | 10 | | | | | 6337 |
| HPV33 | E2 | CADPALDNRTA | 245 | 11 | | | | | 6338 |
| HPV33 | E2 | CALLYTAKQM | 40 | 10 | | | | | 6339 |
| HPV33 | E2 | CTMVTGKV | 145 | 8 | | | | | 6340 |
| HPV33 | E2 | CTMVTGKVDYI | 145 | 11 | | | | | 6341 |
| HPV33 | E2 | CTNKQRTV | 261 | 8 | | | | | 6342 |
| HPV33 | E2 | DAAKYSKT | 174 | 8 | | | | | 6343 |
| HPV33 | E2 | DAAKYSKTQM | 174 | 10 | | | | | 6344 |
| HPV33 | E2 | DLPSQIEHWKL | 25 | 11 | | | | | 6345 |
| HPV33 | E2 | DLYEADKT | 17 | 8 | | | | | 6346 |
| HPV33 | E2 | DLYEADKTDL | 17 | 10 | | | | | 6347 |
| HPV33 | E2 | DTAQPLTKL | 235 | 9 | | | | | 6348 |
| HPV33 | E2 | DTCTMVTGKV | 143 | 10 | | | | | 6349 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E2 | DTTDTAQPL | 232 | 9 | | | | | 6350 |
| HPV33 | E2 | DTTDTAQPLT | 232 | 10 | | | | | 6351 |
| HPV33 | E2 | EADKTDLPSQI | 20 | 11 | | | | | 6352 |
| HPV33 | E2 | EISARLNA | 3 | 8 | | | | | 6353 |
| HPV33 | E2 | EISARLNAV | 3 | 9 | | | | | 6354 |
| HFV33 | E2 | EIYIIEEDT | 136 | 9 | | | | | 6355 |
| HPV33 | E2 | EIYIIEEDTCT | 136 | 11 | | | | | 6356 |
| HPV33 | E2 | ELQMALET | 74 | 8 | | | | | 6357 |
| HPV33 | E2 | ELQMALETL | 74 | 9 | | | | | 6358 |
| HPV33 | E2 | ELYSSMSST | 298 | 9 | | | | | 6359 |
| HPV33 | E2 | EQQQQMFL | 328 | 8 | | | | | 6360 |
| HPV33 | E2 | EQQQQMFLGT | 328 | 10 | | | | | 6361 |
| HPV33 | E2 | EQQQQMFLGTV | 328 | 11 | | | | | 6362 |
| HPV33 | E2 | ETLSKSQYST | 80 | 10 | | | | | 6363 |
| HPV33 | E2 | EVHVGGQV | 185 | 8 | | | | | 6364 |
| HPV33 | E2 | EVHVGGQVI | 185 | 9 | | | | | 6365 |
| HPV33 | E2 | EVHVGGQVIV | 185 | 10 | | | | | 6366 |
| HPV33 | E2 | FLGTVKIPPT | 334 | 10 | | | | | 6367 |
| HPV33 | E2 | FLGTVKIPPTV | 334 | 11 | | | | | 6368 |
| HPV33 | E2 | FQVIELQM | 70 | 8 | | | | | 6369 |
| HPV33 | E2 | FQVIELQMA | 70 | 9 | | | | | 6370 |
| HPV33 | E2 | FQVIELQMAL | 70 | 10 | | | | | 6371 |
| HPV33 | E2 | FVTEQQQQM | 325 | 9 | | | | | 6372 |
| HPV33 | E2 | FVTEQQQQMFL | 325 | 11 | | | | | 6373 |
| HPV33 | E2 | GIVTVTFV | 319 | 8 | | | | | 6374 |
| HPV33 | E2 | GIVTVTFVT | 319 | 9 | | | | | 6375 |
| HPV33 | E2 | GMYYIHNCEKV | 156 | 11 | | | | | 6376 |
| HPV33 | E2 | GQVIVCPT | 190 | 8 | | | | | 6377 |
| HPV33 | E2 | GQVIVCPTSI | 190 | 10 | | | | | 6378 |
| HPV33 | E2 | GTVKIPPT | 336 | 8 | | | | | 6379 |
| HPV33 | E2 | GTVKIPPTV | 336 | 9 | | | | | 6380 |
| HPV33 | E2 | GTVKIPPTVQI | 336 | 11 | | | | | 6381 |
| HPV33 | E2 | HLCHQVVPSL | 53 | 10 | | | | | 6382 |
| HPV33 | E2 | HLCHQVVPSLL | 53 | 11 | | | | | 6383 |
| HPV33 | E2 | HLKGESNSL | 278 | 9 | | | | | 6384 |
| HPV33 | E2 | HQVVPSLL | 56 | 8 | | | | | 6385 |
| HPV33 | E2 | HQVVPSLLA | 56 | 9 | | | | | 6386 |
| HPV33 | E2 | HVGGQVIV | 187 | 8 | | | | | 6387 |
| HPV33 | E2 | HVGGQVIVCPT | 187 | 11 | | | | | 6388 |
| HPV33 | E2 | IIEEDTCT | 139 | 8 | | | | | 6389 |
| HPV33 | E2 | IIEEDTCTM | 139 | 9 | | | | | 6390 |
| HPV33 | E2 | IIEEDTCTMV | 139 | 10 | | | | | 6391 |
| HPV33 | E2 | IIEEDTCTMVT | 139 | 11 | | | | | 6392 |
| HPV33 | E2 | ILDLYEADKT | 15 | 10 | | | | | 6393 |
| HPV33 | E2 | IVHLKGESNSL | 276 | 11 | | | | | 6394 |
| HPV33 | E2 | IVTVTFVT | 320 | 8 | | | | | 6395 |
| HPV33 | E2 | KAFQVIEL | 68 | 8 | | | | | 6396 |
| HPV33 | E2 | KAFQVIELQM | 68 | 10 | | | | | 6397 |
| HPV33 | E2 | KAFQVIELQMA | 68 | 11 | | | | | 6398 |
| HPV33 | E2 | KILDLYEA | 14 | 8 | | | | | 6399 |
| HPV33 | E2 | KILDLYEADKT | 14 | 11 | | | | | 6400 |
| HPV33 | E2 | KIPPTVQI | 339 | 8 | | | | | 6401 |
| HPV33 | E2 | KIPPTVQIST | 339 | 10 | | | | | 6402 |
| HPV33 | E2 | KLFCADPA | 242 | 8 | | | | | 6403 |
| HPV33 | E2 | KLFCADPAL | 242 | 9 | | | | | 6404 |
| HPV33 | E2 | KLIRMECA | 34 | 8 | | | | | 6405 |
| HPV33 | E2 | KLIRMECAL | 34 | 9 | | | | | 6406 |
| HPV33 | E2 | KLIRMECALL | 34 | 10 | | | | | 6407 |
| HPV33 | E2 | KQGETVTV | 112 | 8 | | | | | 6408 |
| HPV33 | E2 | KQMGFSHL | 47 | 8 | | | | | 6409 |
| HPV33 | E2 | KQRTVCSSNV | 264 | 10 | | | | | 6410 |
| HPV33 | E2 | KQRTVCSSNVA | 264 | 11 | | | | | 6411 |
| HPV33 | E2 | KTDLPSQI | 23 | 8 | | | | | 6412 |
| HPV33 | E2 | KTKAFQVI | 66 | 8 | | | | | 6413 |
| HPV33 | E2 | KTKAFQVIEL | 66 | 10 | | | | | 6414 |
| HPV33 | E2 | KTQMWEVHV | 180 | 9 | | | | | 6415 |
| HPV33 | E2 | KVDYIGMYYI | 151 | 10 | | | | | 6416 |
| HPV33 | E2 | KVYFKYFKEDA | 165 | 11 | | | | | 6417 |
| HPV33 | E2 | LASKTKAFQV | 63 | 10 | | | | | 6418 |
| HPV33 | E2 | LASKTKAFQVI | 63 | 11 | | | | | 6419 |
| HPV33 | E2 | LIRMECAL | 35 | 8 | | | | | 6420 |
| HPV33 | E2 | LIRMECALL | 35 | 9 | | | | | 6421 |
| HPV33 | E2 | LIRMECALLYT | 35 | 11 | | | | | 6422 |
| HPV33 | E2 | LLASKTKA | 62 | 8 | | | | | 6423 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E2 | LLASKTKAFQV | 62 | 11 | | | | | 6424 |
| HPV33 | E2 | LLYTAKQM | 42 | 8 | | | | | 6425 |
| HPV33 | E2 | LQMALETL | 75 | 8 | | | | | 6426 |
| HPV33 | E2 | LQQTSLEV | 94 | 8 | | | | | 6427 |
| HPV33 | E2 | LQQTSLEVWL | 94 | 10 | | | | | 6428 |
| HPV33 | E2 | LTKLFCADPA | 240 | 10 | | | | | 6429 |
| HPV33 | E2 | LTKLFCADPAL | 240 | 11 | | | | | 6430 |
| HPV33 | E2 | MVTGKVDYI | 147 | 9 | | | | | 6431 |
| HPV33 | E2 | MVTGKVDYIGM | 147 | 11 | | | | | 6432 |
| HPV33 | E2 | NAVQEKIL | 9 | 8 | | | | | 6433 |
| HPV33 | E2 | NAVQEKILDL | 9 | 10 | | | | | 6434 |
| HPV33 | E2 | NQISTTET | 202 | 8 | | | | | 6435 |
| HPV33 | E2 | NQISTTETA | 202 | 9 | | | | | 6436 |
| HPV33 | E2 | NQISTTETADI | 202 | 11 | | | | | 6437 |
| HPV33 | E2 | NTMDYTNWGEI | 127 | 11 | | | | | 6438 |
| HPV33 | E2 | NVAPIVHL | 272 | 8 | | | | | 6439 |
| HPV33 | E2 | PADTTDTA | 230 | 8 | | | | | 6440 |
| HPV33 | E2 | PADTTDTAQPL | 230 | 11 | | | | | 6441 |
| HPV33 | E2 | PALDNRTA | 248 | 8 | | | | | 6442 |
| HPV33 | E2 | PALDNRTART | 248 | 10 | | | | | 6443 |
| HPV33 | E2 | PALDNRTARTA | 248 | 11 | | | | | 6444 |
| HPV33 | E2 | PLTKLFCA | 239 | 8 | | | | | 6445 |
| HPV33 | E2 | PLTKLFCADPA | 239 | 11 | | | | | 6446 |
| HPV33 | E2 | PQAAAKRRRPA | 221 | 11 | | | | | 6447 |
| HPV33 | E2 | PTSISSNQI | 196 | 9 | | | | | 6448 |
| HPV33 | E2 | PTSISSNQIST | 196 | 11 | | | | | 6449 |
| HPV33 | E2 | PTVQISTGFM | 342 | 10 | | | | | 6450 |
| HPV33 | E2 | PTVQISTGFMT | 342 | 11 | | | | | 6451 |
| HPV33 | E2 | QAAAKRRRPA | 222 | 10 | | | | | 6452 |
| HPV33 | E2 | QIEHWKLI | 29 | 8 | | | | | 6453 |
| HPV33 | E2 | QIEHWKLIRM | 29 | 10 | | | | | 6454 |
| HPV33 | E2 | QISTGFMT | 345 | 8 | | | | | 6455 |
| HPV33 | E2 | QISTGFMTL | 345 | 9 | | | | | 6456 |
| HPV33 | E2 | QISTTETA | 203 | 8 | | | | | 6457 |
| HPV33 | E2 | QISTTETADI | 203 | 10 | | | | | 6458 |
| HPV33 | E2 | QMFLGTVKI | 332 | 9 | | | | | 6459 |
| HPV33 | E2 | QMGFSHLCHQV | 48 | 11 | | | | | 6460 |
| HPV33 | E2 | QMWEVHVGGQV | 182 | 11 | | | | | 6461 |
| HPV33 | E2 | QQMFLGTV | 331 | 8 | | | | | 6462 |
| HPV33 | E2 | QQMFLGTVKI | 331 | 10 | | | | | 6463 |
| HPV33 | E2 | QQQMFLGT | 330 | 8 | | | | | 6464 |
| HPV33 | E2 | QQQMFLGTV | 330 | 9 | | | | | 6465 |
| HPV33 | E2 | QQQMFLGTVKI | 330 | 11 | | | | | 6466 |
| HPV33 | E2 | QQQQMFLGT | 329 | 9 | | | | | 6467 |
| HPV33 | E2 | QQQQMFLGTV | 329 | 10 | | | | | 6468 |
| HPV33 | E2 | QQTSLEVWL | 95 | 9 | | | | | 6469 |
| HPV33 | E2 | QTDNDNRPPQA | 213 | 11 | | | | | 6470 |
| HPV33 | E2 | QTSLEVWL | 96 | 8 | | | | | 6471 |
| HPV33 | E2 | QVIELQMA | 71 | 8 | | | | | 6472 |
| HPV33 | E2 | QVIELQMAL | 71 | 9 | | | | | 6473 |
| HPV33 | E2 | QVIELQMALET | 71 | 11 | | | | | 6474 |
| HPV33 | E2 | QVIVCPTSI | 191 | 9 | | | | | 6475 |
| HPV33 | E2 | QVVPSLLA | 57 | 8 | | | | | 6476 |
| HPV33 | E2 | QVVPSLLASKT | 57 | 11 | | | | | 6477 |
| HPV33 | E2 | RLKPYKEL | 292 | 8 | | | | | 6478 |
| HPV33 | E2 | RLNAVQEKI | 7 | 9 | | | | | 6479 |
| HPV33 | E2 | RLNAVQEKIL | 7 | 10 | | | | | 6480 |
| HPV33 | E2 | RMECALLYT | 37 | 9 | | | | | 6481 |
| HPV33 | E2 | RMECALLYTA | 37 | 10 | | | | | 6482 |
| HPV33 | E2 | RTARTATNCT | 253 | 10 | | | | | 6483 |
| HPV33 | E2 | RTVCSSNV | 266 | 8 | | | | | 6484 |
| HPV33 | E2 | RTVCSSNVA | 266 | 9 | | | | | 6485 |
| HPV33 | E2 | RTVCSSNVAPI | 266 | 11 | | | | | 6486 |
| HPV33 | E2 | SARLNAVQEKI | 5 | 11 | | | | | 6487 |
| HPV33 | E2 | SISSNQIST | 198 | 9 | | | | | 6488 |
| HPV33 | E2 | SISSNQISTT | 198 | 10 | | | | | 6489 |
| HPV33 | E2 | SLKCLRYRL | 285 | 9 | | | | | 6490 |
| HPV33 | E2 | SLLASKTKA | 61 | 9 | | | | | 6491 |
| HPV33 | E2 | SMSSTWHWT | 302 | 9 | | | | | 6492 |
| HPV33 | E2 | SQIEHWKL | 28 | 8 | | | | | 6493 |
| HPV33 | E2 | SQIEHWKLI | 28 | 9 | | | | | 6494 |
| HPV33 | E2 | SQIEHWKLIRM | 28 | 11 | | | | | 6495 |
| HPV33 | E2 | SQWTLQQT | 90 | 8 | | | | | 6496 |
| HPV33 | E2 | SQWTLQQTSL | 90 | 10 | | | | | 6497 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E2 | SQYSTSQWT | 85 | 9 | | | | | 6498 |
| HPV33 | E2 | SQYSTSQWTL | 85 | 10 | | | | | 6499 |
| HPV33 | E2 | STSQWTLQQT | 88 | 10 | | | | | 6500 |
| HPV33 | E2 | STTETADI | 205 | 8 | | | | | 6501 |
| HPV33 | E2 | STTETADIQT | 205 | 10 | | | | | 6502 |
| HPV33 | E2 | TAKQMGFSHL | 45 | 10 | | | | | 6503 |
| HPV33 | E2 | TAQPLTKL | 236 | 8 | | | | | 6504 |
| HPV33 | E2 | TAQPLTKLFCA | 236 | 11 | | | | | 6505 |
| HPV33 | E2 | TARTATNCT | 254 | 9 | | | | | 6506 |
| HPV33 | E2 | TATNCTNKQRT | 257 | 11 | | | | | 6507 |
| HPV33 | E2 | TLQQTSLEV | 93 | 9 | | | | | 6508 |
| HPV33 | E2 | TLQQTSLEVWL | 93 | 11 | | | | | 6509 |
| HPV33 | E2 | TLSKSQYST | 81 | 9 | | | | | 6510 |
| HPV33 | E2 | TMDYTNWGEI | 128 | 10 | | | | | 6511 |
| HPV33 | E2 | TMVTGKVDYI | 146 | 10 | | | | | 6512 |
| HPV33 | E2 | TQMWEVHV | 181 | 8 | | | | | 6513 |
| HPV33 | E2 | TTDTAQPL | 233 | 8 | | | | | 6514 |
| HPV33 | E2 | TTDTAQPLT | 233 | 9 | | | | | 6515 |
| HPV33 | E2 | TTDTAQPLTKL | 233 | 11 | | | | | 6516 |
| HPV33 | E2 | TTETADIQT | 206 | 9 | | | | | 6517 |
| HPV33 | E2 | TVCSSNVA | 267 | 8 | | | | | 6518 |
| HPV33 | E2 | TVCSSNVAPI | 267 | 10 | | | | | 6519 |
| HPV33 | E2 | TVCSSNVAPIV | 267 | 11 | | | | | 6520 |
| HPV33 | E2 | TVKIPPTV | 337 | 8 | | | | | 6521 |
| HPV33 | E2 | TVKIPPTVQI | 337 | 10 | | | | | 6522 |
| HPV33 | E2 | TVQISTGFM | 343 | 9 | | | | | 6523 |
| HPV33 | E2 | TVQISTGFMT | 343 | 10 | | | | | 6524 |
| HPV33 | E2 | TVQISTGFMTL | 343 | 11 | | | | | 6525 |
| HPV33 | E2 | TVQYDNDKKNT | 118 | 11 | | | | | 6526 |
| HPV33 | E2 | VIELQMAL | 72 | 8 | | | | | 6527 |
| HPV33 | E2 | VIELQMALET | 72 | 10 | | | | | 6528 |
| HPV33 | E2 | VIELQMALETL | 72 | 11 | | | | | 6529 |
| HPV33 | E2 | VIVCPTSI | 192 | 8 | | | | | 6530 |
| HPV33 | E2 | VQEKILDL | 11 | 8 | | | | | 6531 |
| HPV33 | E2 | VQEKILDLYEA | 11 | 11 | | | | | 6532 |
| HPV33 | E2 | VQISTGFM | 344 | 8 | | | | | 6533 |
| HPV33 | E2 | VQISTGFMT | 344 | 9 | | | | | 6534 |
| HPV33 | E2 | VQISTGFMTL | 344 | 10 | | | | | 6535 |
| HPV33 | E2 | VQYDNDKKNT | 119 | 10 | | | | | 6536 |
| HPV33 | E2 | VQYDNDKKNTM | 119 | 11 | | | | | 6537 |
| HPV33 | E2 | VTEQQQQM | 326 | 8 | | | | | 6538 |
| HPV33 | E2 | VTEQQQQMFL | 326 | 10 | | | | | 6539 |
| HPV33 | E2 | VTFVTEQQQQM | 323 | 11 | | | | | 6540 |
| HPV33 | E2 | VTGKVDYI | 148 | 8 | | | | | 6541 |
| HPV33 | E2 | VTGKVDYIGM | 148 | 10 | | | | | 6542 |
| HPV33 | E2 | VVPSLLASKT | 58 | 10 | | | | | 6543 |
| HPV33 | E2 | WTLQQTSL | 92 | 8 | | | | | 6544 |
| HPV33 | E2 | WTLQQTSLEV | 92 | 10 | | | | | 6545 |
| HPV33 | E2 | YIHNCEKV | 159 | 8 | | | | | 6546 |
| HPV33 | E2 | YIIEEDTCT | 138 | 9 | | | | | 6547 |
| HPV33 | E2 | YIIEEDTCTM | 138 | 10 | | | | | 6548 |
| HPV33 | E2 | YIIEEDTCTMV | 138 | 11 | | | | | 6549 |
| HPV33 | E2 | YTAKQMGFSHL | 44 | 11 | | | | | 6550 |
| HPV33 | E2 | YTNWGEIYI | 131 | 9 | | | | | 6551 |
| HPV33 | E2 | YTNWGEIYII | 131 | 10 | | | | | 6552 |
| HPV33 | E5 | CINFHAQHM | 63 | 9 | | | | | 6553 |
| HPV33 | E5 | CTNFHAQHMT | 63 | 10 | | | | | 6554 |
| HPV33 | E5 | CLSLLLRPL | 14 | 9 | | | | | 6555 |
| HPV33 | E5 | CLSLLLRPLI | 14 | 10 | | | | | 6556 |
| HPV33 | E5 | CLSLLLRPLIL | 14 | 11 | | | | | 6557 |
| HPV33 | E5 | FILFLCLSL | 9 | 9 | | | | | 6558 |
| HPV33 | E5 | FILFLCLSLL | 9 | 10 | | | | | 6559 |
| HPV33 | E5 | FILFLCLSLLL | 9 | 11 | | | | | 6560 |
| HPV33 | E5 | FLCLSLLL | 12 | 8 | | | | | 6561 |
| HPV33 | E5 | FLCLSLLLRPL | 12 | 11 | | | | | 6562 |
| HPV33 | E5 | FLYLPMMCI | 56 | 9 | | | | | 6563 |
| HPV33 | E5 | FVFVLCFI | 3 | 8 | | | | | 6564 |
| HPV33 | E5 | FVFVLCFIL | 3 | 9 | | | | | 6565 |
| HPV33 | E5 | FVFVLCFILFL | 3 | 11 | | | | | 6566 |
| HPV33 | E5 | FVGSPLKI | 42 | 8 | | | | | 6567 |
| HPV33 | E5 | FVLCFILFL | 5 | 9 | | | | | 6568 |
| HPV33 | E5 | FVLCFILFLCL | 5 | 11 | | | | | 6569 |
| HPV33 | E5 | ILFLCLSL | 10 | 8 | | | | | 6570 |
| HPV33 | E5 | ILFLCLSLL | 10 | 9 | | | | | 6571 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E5 | ILFLCLSLLL | 10 | 10 | | | | | 6572 |
| HPV33 | E5 | ILSISTYA | 23 | 8 | | | | | 6573 |
| HPV33 | E5 | ILSISTYAWL | 23 | 10 | | | | | 6574 |
| HPV33 | E5 | ILSISTYAWLL | 23 | 11 | | | | | 6575 |
| HPV33 | E5 | KIFFCYLL | 48 | 8 | | | | | 6576 |
| HPV33 | E5 | KIFFCYLLFL | 48 | 10 | | | | | 6577 |
| HPV33 | E5 | LILSISTYA | 22 | 9 | | | | | 6578 |
| HPV33 | E5 | LILSISTYAWL | 22 | 11 | | | | | 6579 |
| HPV33 | E5 | LLFLYLPM | 54 | 8 | | | | | 6580 |
| HPV33 | E5 | LLFLYLPMM | 54 | 9 | | | | | 6581 |
| HPV33 | E5 | LLFLYLPMMCI | 54 | 11 | | | | | 6582 |
| HPV33 | E5 | LLLRPLIL | 17 | 8 | | | | | 6583 |
| HPV33 | E5 | LLLRPLILSI | 17 | 10 | | | | | 6584 |
| HPV33 | E5 | LLLWVFVGSPL | 37 | 11 | | | | | 6585 |
| HPV33 | E5 | LLRPLILSI | 18 | 9 | | | | | 6586 |
| HPV33 | E5 | LLRPLILSIST | 18 | 11 | | | | | 6587 |
| HPV33 | E5 | LLVLVLLL | 32 | 8 | | | | | 6588 |
| HPV33 | E5 | LLVLVLLLWV | 32 | 10 | | | | | 6589 |
| HPV33 | E5 | LLWVFVGSPL | 38 | 10 | | | | | 6590 |
| HPV33 | E5 | LVLLLWVFV | 35 | 9 | | | | | 6591 |
| HPV33 | E5 | LVLVLLLWV | 33 | 9 | | | | | 6592 |
| HPV33 | E5 | LVLVLLLWVFV | 33 | 11 | | | | | 6593 |
| HPV33 | E5 | MIFVFVLCFI | 1 | 10 | | | | | 6594 |
| HPV33 | E5 | MIFVFVLCFIL | 1 | 11 | | | | | 6595 |
| HPV33 | E5 | MMCINFHA | 61 | 8 | | | | | 6596 |
| HPV33 | E5 | MMCINFHAQHM | 61 | 11 | | | | | 6597 |
| HPV33 | E5 | PLILSIST | 21 | 8 | | | | | 6598 |
| HPV33 | E5 | PLILSISTYA | 21 | 10 | | | | | 6599 |
| HPV33 | E5 | PLKIFFCYL | 46 | 9 | | | | | 6600 |
| HPV33 | E5 | PLKIFFCYLL | 46 | 10 | | | | | 6601 |
| HPV33 | E5 | PMMCINFHA | 60 | 9 | | | | | 6602 |
| HPV33 | E5 | SISTYAWL | 25 | 8 | | | | | 6603 |
| HPV33 | E5 | SISTYAWLL | 25 | 9 | | | | | 6604 |
| HPV33 | E5 | SISTYAWLLV | 25 | 10 | | | | | 6605 |
| HPV33 | E5 | SISTYAWLLVL | 25 | 11 | | | | | 6606 |
| HPV33 | E5 | SLLLRPLI | 16 | 8 | | | | | 6607 |
| HPV33 | E5 | SLLLRPLIL | 16 | 9 | | | | | 6608 |
| HPV33 | E5 | SLLLRPLILSI | 16 | 11 | | | | | 6609 |
| HPV33 | E5 | STYAWLLV | 27 | 8 | | | | | 6610 |
| HPV33 | E5 | STYAWLLVL | 27 | 9 | | | | | 6611 |
| HPV33 | E5 | STYAWLLVLV | 27 | 10 | | | | | 6612 |
| HPV33 | E5 | STYAWLLVLVL | 27 | 11 | | | | | 6613 |
| HPV33 | E5 | VLCFILFL | 6 | 8 | | | | | 6614 |
| HPV33 | E5 | VLCFILFLCL | 6 | 10 | | | | | 6615 |
| HPV33 | E5 | VLLLWVFV | 36 | 8 | | | | | 6616 |
| HPV33 | E5 | VLVLLLWV | 34 | 8 | | | | | 6617 |
| HPV33 | E5 | VLVLLLWVFV | 34 | 10 | | | | | 6618 |
| HPV33 | E5 | WLLVLVLL | 31 | 8 | | | | | 6619 |
| HPV33 | E5 | WLLVLVLLL | 31 | 9 | | | | | 6620 |
| HPV33 | E5 | WLLVLVLLLWV | 31 | 11 | | | | | 6621 |
| HPV33 | E5 | WVFVGSPL | 40 | 8 | | | | | 6622 |
| HPV33 | E5 | WVFVGSPLKI | 40 | 10 | | | | | 6623 |
| HPV33 | E5 | YAWLLVLV | 29 | 8 | | | | | 6624 |
| HPV33 | E5 | YAWLLVLVL | 29 | 9 | | | | | 6625 |
| HPV33 | E5 | YAWLLVLVLL | 29 | 10 | | | | | 6626 |
| HPV33 | E5 | YAWLLVLVLLL | 29 | 11 | | | | | 6627 |
| HPV33 | E5 | YLLFLYLPM | 53 | 9 | | | | | 6628 |
| HPV33 | E5 | YLLFLYLPMM | 53 | 10 | | | | | 6629 |
| HPV33 | E5 | YLPMMCINFHA | 58 | 11 | | | | | 6630 |
| HPV33 | E6 | AACWRSRRRET | 137 | 11 | | | | | 6631 |
| HPV33 | E6 | ALETTIHNI | 18 | 9 | | | | | 6632 |
| HPV33 | E6 | ALETTIHNIEL | 18 | 11 | | | | | 6633 |
| HPV33 | E6 | CIICQRPL | 103 | 8 | | | | | 6634 |
| HPV33 | E6 | CLRFLSKI | 66 | 8 | | | | | 6635 |
| HPV33 | E6 | CQALETTI | 16 | 8 | | | | | 6636 |
| HPV33 | E6 | CQALETTIHNI | 16 | 11 | | | | | 6637 |
| HPV33 | E6 | CVECKKPL | 30 | 8 | | | | | 6638 |
| HPV33 | E6 | DLCQALET | 14 | 8 | | | | | 6639 |
| HPV33 | E6 | DLCQALETT | 14 | 9 | | | | | 6640 |
| HPV33 | E6 | DLCQALETTI | 14 | 10 | | | | | 6641 |
| HPV33 | E6 | DLNKRFHNI | 120 | 9 | | | | | 6642 |
| HPV33 | E6 | DTEEKPRT | 4 | 8 | | | | | 6643 |
| HPV33 | E6 | DTEEKPRTL | 4 | 9 | | | | | 6644 |
| HPV33 | E6 | EILIRCII | 98 | 8 | | | | | 6645 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E6 | ELQCVECKKPL | 27 | 11 | | | | | 6646 |
| HPV33 | E6 | EQTVKKPL | 89 | 8 | | | | | 6647 |
| HPV33 | E6 | EQTVKKPLNEI | 89 | 11 | | | | | 6648 |
| HPV33 | E6 | ETTIHNIEL | 20 | 9 | | | | | 6649 |
| HPV33 | E6 | EVYDFAFA | 41 | 8 | | | | | 6650 |
| HPV33 | E6 | EVYDFAFADL | 41 | 10 | | | | | 6651 |
| HPV33 | E6 | EVYDFAFADLT | 41 | 11 | | | | | 6652 |
| HPV33 | E6 | FAFADLTV | 45 | 8 | | | | | 6653 |
| HPV33 | E6 | FAFADLTVV | 45 | 9 | | | | | 6654 |
| HPV33 | E6 | FQDTEEKPRT | 2 | 10 | | | | | 6655 |
| HPV33 | E6 | FQDTEEKPRTL | 2 | 11 | | | | | 6656 |
| HPV33 | E6 | GICKLCLRFL | 61 | 10 | | | | | 6657 |
| HPV33 | E6 | HVDLNKRFHNI | 118 | 11 | | | | | 6658 |
| HPV33 | E6 | KLCLRFLSKI | 64 | 10 | | | | | 6659 |
| HPV33 | E6 | LIRCIICQRPL | 100 | 11 | | | | | 6660 |
| HPV33 | E6 | LQCVECKKPL | 28 | 10 | | | | | 6661 |
| HPV33 | E6 | LQRSEVYDFA | 37 | 10 | | | | | 6662 |
| HPV33 | E6 | NISGRWAGRCA | 127 | 11 | | | | | 6663 |
| HPV33 | E6 | NTLEQTVKKPL | 86 | 11 | | | | | 6664 |
| HPV33 | E6 | PLCPQEKKRHV | 109 | 11 | | | | | 6665 |
| HPV33 | E6 | PLNEILIRCI | 95 | 10 | | | | | 6666 |
| HPV33 | E6 | PLNEILIRCII | 95 | 11 | | | | | 6667 |
| HPV33 | E6 | PLQRSEVYDFA | 36 | 11 | | | | | 6668 |
| HPV33 | E6 | PQEKKRHV | 112 | 8 | | | | | 6669 |
| HPV33 | E6 | PQEKKRHVDL | 112 | 10 | | | | | 6670 |
| HPV33 | E6 | QALETTIHNI | 17 | 10 | | | | | 6671 |
| HPV33 | E6 | QTVKKPLNEI | 90 | 10 | | | | | 6672 |
| HPV33 | E6 | QTVKKPLNEIL | 90 | 11 | | | | | 6673 |
| HPV33 | E6 | RTLHDLCQA | 10 | 9 | | | | | 6674 |
| HPV33 | E6 | RTLHDLCQAL | 10 | 10 | | | | | 6675 |
| HPV33 | E6 | SVYGNTLEQT | 82 | 10 | | | | | 6676 |
| HPV33 | E6 | SVYGNTLEQTV | 82 | 11 | | | | | 6677 |
| HPV33 | E6 | TIHNIELQCV | 22 | 10 | | | | | 6678 |
| HPV33 | E6 | TLEQTVKKPL | 87 | 10 | | | | | 6679 |
| HPV33 | E6 | TLHDLCQA | 11 | 8 | | | | | 6680 |
| HPV33 | E6 | TLHDLCQAL | 11 | 9 | | | | | 6681 |
| HPV33 | E6 | TLHDLCQALET | 11 | 11 | | | | | 6682 |
| HPV33 | E6 | TTIHNIEL | 21 | 8 | | | | | 6683 |
| HPV33 | E6 | TTIHNIELQCV | 21 | 11 | | | | | 6684 |
| HPV33 | E6 | TVKKPLNEI | 91 | 9 | | | | | 6685 |
| HPV33 | E6 | TVKKPLNEIL | 91 | 10 | | | | | 6686 |
| HPV33 | E6 | TVKKPLNEILI | 91 | 11 | | | | | 6687 |
| HPV33 | E6 | VVYREGNPFGI | 52 | 11 | | | | | 6688 |
| HPV33 | E7 | AQPATADYYI | 45 | 10 | | | | | 6689 |
| HPV33 | E7 | AQPATADYYIV | 45 | 11 | | | | | 6690 |
| HPV33 | E7 | ATADYYIV | 48 | 8 | | | | | 6691 |
| HPV33 | E7 | ATADYYIVT | 48 | 9 | | | | | 6692 |
| HPV33 | E7 | CVNSTASDL | 68 | 9 | | | | | 6693 |
| HPV33 | E7 | CVNSTASDLRT | 68 | 11 | | | | | 6694 |
| HPV33 | E7 | DLRTIQQL | 75 | 8 | | | | | 6695 |
| HPV33 | E7 | DLRTIQQLL | 75 | 9 | | | | | 6696 |
| HPV33 | E7 | DLRTIQQLLM | 75 | 10 | | | | | 6697 |
| HPV33 | E7 | DLYCYEQL | 21 | 8 | 0.0001 | | | | 6698 |
| HPV33 | E7 | DLYPEPTDL | 14 | 9 | | | | | 6699 |
| HPV33 | E7 | GLDRPDGQA | 37 | 9 | | | | | 6700 |
| HPV33 | E7 | GQAQPATA | 43 | 8 | | | | | 6701 |
| HPV33 | E7 | GTVNIVCPT | 85 | 9 | | | | | 6702 |
| HPV33 | E7 | GTVNIVCPTCA | 85 | 11 | | | | | 6703 |
| HPV33 | E7 | HTCNTTVRL | 59 | 9 | | | | | 6704 |
| HPV33 | E7 | HTCNTTVRLCV | 59 | 11 | | | | | 6705 |
| HPV33 | E7 | IQQLLMGT | 79 | 8 | | | | | 6706 |
| HPV33 | E7 | IQQLLMGTV | 79 | 9 | | | | | 6707 |
| HPV33 | E7 | IQQLLMGTVNI | 79 | 11 | | | | | 6708 |
| HPV33 | E7 | IVTCCHTCNT | 54 | 10 | | | | | 6709 |
| HPV33 | E7 | IVTCCHTCNTT | 54 | 11 | | | | | 6710 |
| HPV33 | E7 | LLMGTVNI | 82 | 8 | | | | | 6711 |
| HPV33 | E7 | LLMGTVNIV | 82 | 9 | | | | | 6712 |
| HPV33 | E7 | LMGTVNIV | 83 | 8 | | | | | 6713 |
| HPV33 | E7 | LMGTVNIVCPT | 83 | 11 | | | | | 6714 |
| HPV33 | E7 | NIVCPTCA | 88 | 8 | | | | | 6715 |
| HPV33 | E7 | NTTVRLCV | 62 | 8 | | | | | 6716 |
| HPV33 | E7 | NTTVRLCVNST | 62 | 11 | | | | | 6717 |
| HPV33 | E7 | PATADYYI | 47 | 8 | | | | | 6718 |
| HPV33 | E7 | PATADYYIV | 47 | 9 | | | | | 6719 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | E7 | PATADYYIVT | 47 | 10 | | | | | 6720 |
| HPV33 | E7 | PTDLYCYEQL | 19 | 10 | | | | | 6721 |
| HPV33 | E7 | PTLKEYVL | 6 | 8 | | | | | 6722 |
| HPV33 | E7 | PTLKEYVLDL | 6 | 10 | | | | | 6723 |
| HPV33 | E7 | QAQPATADYYI | 44 | 11 | | | | | 6724 |
| HPV33 | E7 | QLLMGTVNI | 81 | 9 | | | | | 6725 |
| HPV33 | E7 | QLLMGTVNIV | 81 | 10 | | | | | 6726 |
| HPV33 | E7 | QQLLMGTV | 80 | 8 | | | | | 6727 |
| HPV33 | E7 | QQLLMGTVNI | 80 | 10 | | | | | 6728 |
| HPV33 | E7 | QQLLMGTVNIV | 80 | 11 | | | | | 6729 |
| HPV33 | E7 | RLCVNSTA | 66 | 8 | | | | | 6730 |
| HPV33 | E7 | RLCVNSTASDL | 66 | 11 | | | | | 6731 |
| HPV33 | E7 | RTIQQLLM | 77 | 8 | | | | | 6732 |
| HPV33 | E7 | RTIQQLLMGT | 77 | 10 | | | | | 6733 |
| HPV33 | E7 | RTIQQLLMGTV | 77 | 11 | | | | | 6734 |
| HPV33 | E7 | STASDLRT | 71 | 8 | | | | | 6735 |
| HPV33 | E7 | STASDLRTI | 71 | 9 | | | | | 6736 |
| HPV33 | E7 | TADYYIVT | 49 | 8 | | | | | 6737 |
| HPV33 | E7 | TASDLRTI | 72 | 8 | | | | | 6738 |
| HPV33 | E7 | TASDLRTIQQL | 72 | 11 | | | | | 6739 |
| HPV33 | E7 | TIQQLLMGT | 78 | 9 | | | | | 6740 |
| HPV33 | E7 | TIQQLLMGTV | 78 | 10 | | | | | 6741 |
| HPV33 | E7 | TLKEYVLDL | 7 | 9 | | | | | 6742 |
| HPV33 | E7 | TTVRLCVNST | 63 | 10 | | | | | 6743 |
| HPV33 | E7 | TTVRLCVNSTA | 63 | 11 | | | | | 6744 |
| HPV33 | E7 | TVNIVCPT | 86 | 8 | | | | | 6745 |
| HPV33 | E7 | TVNIVCPTCA | 86 | 10 | | | | | 6746 |
| HPV33 | E7 | TVRLCVNST | 64 | 9 | | | | | 6747 |
| HPV33 | E7 | TVRLCVNSTA | 64 | 10 | | | | | 6748 |
| HPV33 | E7 | VLDLYPEPT | 12 | 9 | | | | | 6749 |
| HPV33 | E7 | VLDLYPEPTDL | 12 | 11 | | | | | 6750 |
| HPV33 | E7 | VTCCHTCNT | 55 | 9 | | | | | 6751 |
| HPV33 | E7 | VTCCHTCNTT | 55 | 10 | | | | | 6752 |
| HPV33 | E7 | VTCCHTCNTTV | 55 | 11 | | | | | 6753 |
| HPV33 | E7 | YIVTCCHT | 53 | 8 | | | | | 6754 |
| HPV33 | E7 | YIVTCCHTCNT | 53 | 11 | | | | | 6755 |
| HPV33 | E7 | YVLDLYPEPT | 11 | 10 | | | | | 6756 |
| HPV33 | L1 | AAPANDCPPL | 179 | 10 | | | | | 6757 |
| HPV33 | L1 | AAPTSTRT | 482 | 8 | | | | | 6758 |
| HPV33 | L1 | AAPTSTRTSSA | 482 | 11 | | | | | 6759 |
| HPV33 | L1 | AITCQKTV | 424 | 8 | | | | | 6760 |
| HPV33 | L1 | AQGHNNGI | 316 | 8 | | | | | 6761 |
| HPV33 | L1 | ATVYLPPV | 9 | 8 | | | | | 6762 |
| HPV33 | L1 | ATVYLPPVPV | 9 | 10 | | | | | 6763 |
| HPV33 | L1 | AVGHPYFSI | 44 | 9 | | | | | 6764 |
| HPV33 | L1 | AVPDDLYI | 270 | 8 | | | | | 6765 |
| HPV33 | L1 | CLLGCKPPT | 158 | 9 | | | | | 6766 |
| HPV33 | L1 | CLSMDYKQT | 147 | 9 | | | | | 6767 |
| HPV33 | L1 | CLSMDYKQTQL | 147 | 11 | | | | | 6768 |
| HPV33 | L1 | CMDFKTLQA | 207 | 9 | | | | | 6769 |
| HPV33 | L1 | CTQVTSDST | 345 | 9 | | | | | 6770 |
| HPV33 | L1 | DILEDWQFGL | 396 | 10 | | | | | 6771 |
| HPV33 | L1 | DILEDWQFGLT | 396 | 11 | | | | | 6772 |
| HPV33 | L1 | DLKEKFSA | 449 | 8 | | | | | 6773 |
| HPV33 | L1 | DLKEKFSADL | 449 | 10 | | | | | 6774 |
| HPV33 | L1 | DLQFVFQL | 370 | 8 | | | | | 6775 |
| HPV33 | L1 | DLQFVFQLCKV | 370 | 11 | | | | | 6776 |
| HPV33 | L1 | DLYIKGSGT | 274 | 9 | | | | | 6777 |
| HPV33 | L1 | DLYIKGSGTT | 274 | 10 | | | | | 6778 |
| HPV33 | L1 | DLYIKGSGTTA | 274 | 11 | | | | | 6779 |
| HPV33 | L1 | DMVDTGFGCM | 199 | 10 | | | | | 6780 |
| HPV33 | L1 | DQFPLGRKFL | 459 | 10 | | | | | 6781 |
| HPV33 | L1 | DQFPLGRKFLL | 459 | 11 | | | | | 6782 |
| HPV33 | L1 | DTGFGCMDFKT | 202 | 11 | | | | | 6783 |
| HPV33 | L1 | DTQRLVWA | 95 | 8 | | | | | 6784 |
| HPV33 | L1 | DTQRLVWACV | 95 | 10 | | | | | 6785 |
| HPV33 | L1 | DTSFYNPDT | 88 | 9 | | | | | 6786 |
| HPV33 | L1 | DTTRSTNM | 335 | 8 | | | | | 6787 |
| HPV33 | L1 | DTTRSTNMT | 335 | 9 | | | | | 6788 |
| HPV33 | L1 | DTTRSTNMTL | 335 | 10 | | | | | 6789 |
| HPV33 | L1 | DTYRFVTSQA | 415 | 10 | | | | | 6790 |
| HPV33 | L1 | DTYRFVTSQAI | 415 | 11 | | | | | 6791 |
| HPV33 | L1 | DVPIDICGST | 219 | 10 | | | | | 6792 |
| HPV33 | L1 | EATVYLPPV | 8 | 9 | | | | | 6793 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | L1 | EATVYLPPVPV | 8 | 11 | | | | | 6794 |
| HPV33 | L1 | EAVPDDLYI | 269 | 9 | | | | | 6795 |
| HPV33 | L1 | EIGRGQPL | 107 | 8 | | | | | 6796 |
| HPV33 | L1 | EIGRGQPLGV | 107 | 10 | | | | | 6797 |
| HPV33 | L1 | EVDLKEKFSA | 447 | 10 | | | | | 6798 |
| HPV33 | L1 | EVMTYIHA | 385 | 8 | | | | | 6799 |
| HPV33 | L1 | EVMTYIHAM | 385 | 9 | | | | | 6800 |
| HPV33 | L1 | FLLQAGLKA | 467 | 9 | | | | | 6801 |
| HPV33 | L1 | FLRREQMFV | 249 | 9 | | | | | 6802 |
| HPV33 | L1 | FQLCKVTL | 375 | 8 | | | | | 6803 |
| HPV33 | L1 | FQLCKVTLT | 375 | 9 | | | | | 6804 |
| HPV33 | L1 | FQLCKVTLTA | 375 | 10 | | | | | 6805 |
| HPV33 | L1 | FVFQLCKV | 373 | 8 | | | | | 6806 |
| HPV33 | L1 | FVFQLCKVT | 373 | 9 | | | | | 6807 |
| HPV33 | L1 | FVFQLCKVTL | 373 | 10 | | | | | 6808 |
| HPV33 | L1 | FVFQLCKVTLT | 373 | 11 | | | | | 6809 |
| HPV33 | L1 | FVRHFFNRA | 256 | 9 | | | | | 6810 |
| HPV33 | L1 | FVRHFFNRAGT | 256 | 11 | | | | | 6811 |
| HPV33 | L1 | FVTSQAIT | 419 | 8 | | | | | 6812 |
| HPV33 | L1 | FVTVVDTT | 330 | 8 | | | | | 6813 |
| HPV33 | L1 | FVTVVDTTRST | 330 | 11 | | | | | 6814 |
| HPV33 | L1 | GADNRECL | 141 | 8 | | | | | 6815 |
| HPV33 | L1 | GADNRECLSM | 141 | 10 | | | | | 6816 |
| HPV33 | L1 | GICWGNQV | 322 | 8 | | | | | 6817 |
| HPV33 | L1 | GICWGNQVFV | 322 | 10 | | | | | 6818 |
| HPV33 | L1 | GICWGNQVFVT | 322 | 11 | | | | | 6819 |
| HPV33 | L1 | GISGHPLL | 117 | 8 | | | | | 6820 |
| HPV33 | L1 | GLEIGRGQPL | 105 | 10 | | | | | 6821 |
| HPV33 | L1 | GLKAKPKL | 472 | 8 | | | | | 6822 |
| HPV33 | L1 | GLKAKPKLKRA | 472 | 11 | | | | | 6823 |
| HPV33 | L1 | GLQYRVFRV | 68 | 9 | | | | | 6824 |
| HPV33 | L1 | GLQYRVFRVRL | 68 | 11 | | | | | 6825 |
| HPV33 | L1 | GLTPPPSA | 404 | 8 | | | | | 6826 |
| HPV33 | L1 | GLTPPPSASL | 404 | 10 | | | | | 6827 |
| HPV33 | L1 | GQPGADNRECL | 138 | 11 | | | | | 6828 |
| HPV33 | L1 | GQPLGVGI | 111 | 8 | | | | | 6829 |
| HPV33 | L1 | GTLGEAVPDDL | 265 | 11 | | | | | 6830 |
| HPV33 | L1 | GTTASIQSSA | 281 | 10 | | | | | 6831 |
| HPV33 | L1 | GVACTNAA | 173 | 8 | | | | | 6832 |
| HPV33 | L1 | GVACTNAAPA | 173 | 10 | | | | | 6833 |
| HPV33 | L1 | GVGISGHPL | 115 | 9 | | | | | 6834 |
| HPV33 | L1 | GVGISGHPLL | 115 | 10 | | | | | 6835 |
| HPV33 | L1 | HAMNPDIL | 391 | 8 | | | | | 6836 |
| HPV33 | L1 | HVEEYDLQFV | 365 | 10 | | | | | 6837 |
| HPV33 | L1 | IEDGDMV | 194 | 8 | | | | | 6838 |
| HPV33 | L1 | IIEDGDMVDT | 194 | 10 | | | | | 6839 |
| HPV33 | L1 | ILEDWQFGL | 397 | 9 | | | | | 6840 |
| HPV33 | L1 | ILEDWQFGLT | 397 | 10 | | | | | 6841 |
| HPV33 | L1 | IQSSAFFPT | 286 | 9 | | | | | 6842 |
| HPV33 | L1 | KAKPKLKRA | 474 | 9 | | | | | 6843 |
| HPV33 | L1 | KAKPKLKRAA | 474 | 10 | | | | | 6844 |
| HPV33 | L1 | KLKRAAPT | 478 | 8 | | | | | 6845 |
| HPV33 | L1 | KLKRAAPTST | 478 | 10 | | | | | 6846 |
| HPV33 | L1 | KLLVPKVSGL | 60 | 10 | | | | | 6847 |
| HPV33 | L1 | KMTSEPYGDSL | 236 | 11 | | | | | 6848 |
| HPV33 | L1 | KQTQLCLL | 153 | 8 | | | | | 6849 |
| HPV33 | L1 | KTLQANKSDV | 211 | 10 | | | | | 6850 |
| HPV33 | L1 | KVSGLQYRV | 65 | 9 | | | | | 6851 |
| HPV33 | L1 | KVTLTAEV | 379 | 8 | | | | | 6852 |
| HPV33 | L1 | KVTLTAEVM | 379 | 9 | | | | | 6853 |
| HPV33 | L1 | KVTLTAEVMT | 379 | 10 | | | | | 6854 |
| HPV33 | L1 | KVVSTDEYV | 20 | 9 | | | | | 6855 |
| HPV33 | L1 | LAVGHPYFSI | 43 | 10 | | | | | 6856 |
| HPV33 | L1 | LINTIIEDGDM | 190 | 11 | | | | | 6857 |
| HPV33 | L1 | LLAVGHPYFSI | 42 | 11 | | | | | 6858 |
| HPV33 | L1 | LLGCKPPT | 159 | 8 | | | | | 6859 |
| HPV33 | L1 | LLNKFDDT | 123 | 8 | | | | | 6860 |
| HPV33 | L1 | LLNKFDDTET | 123 | 10 | | | | | 6861 |
| HPV33 | L1 | LLQAGLKA | 468 | 8 | | | | | 6862 |
| HPV33 | L1 | LLVPKVSGL | 61 | 9 | | | | | 6863 |
| HPV33 | L1 | LQAGLKAKPKL | 469 | 11 | | | | | 6864 |
| HPV33 | L1 | LQANKSDV | 213 | 8 | | | | | 6865 |
| HPV33 | L1 | LQANKSDVPI | 213 | 10 | | | | | 6866 |
| HPV33 | L1 | LQDTYRFV | 413 | 8 | | | | | 6867 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | L1 | LQDTYRFVT | 413 | 9 | | | | | 6868 |
| HPV33 | L1 | LQFVFQLCKV | 371 | 10 | | | | | 6869 |
| HPV33 | L1 | LQFVFQLCKVT | 371 | 11 | | | | | 6870 |
| HPV33 | L1 | LQRAQGHNNGI | 313 | 11 | | | | | 6871 |
| HPV33 | L1 | LQYRVFRV | 69 | 8 | | | | | 6872 |
| HPV33 | L1 | LQYRVFRVRL | 69 | 10 | | | | | 6873 |
| HPV33 | L1 | LTAEVMTYI | 382 | 9 | | | | | 6874 |
| HPV33 | L1 | LTAEVMTYIHA | 382 | 11 | | | | | 6875 |
| HPV33 | L1 | LTPPPSASL | 405 | 9 | | | | | 6876 |
| HPV33 | L1 | LVPKVSGL | 62 | 8 | | | | | 6877 |
| HPV33 | L1 | LVWACVGL | 99 | 8 | | | | | 6878 |
| HPV33 | L1 | LVWACVGLEI | 99 | 10 | | | | | 6879 |
| HPV33 | L1 | MTLCTQVT | 342 | 8 | | | | | 6880 |
| HPV33 | L1 | MTSEPYGDSL | 237 | 10 | | | | | 6881 |
| HPV33 | L1 | MTYIHAMNPDI | 387 | 11 | | | | | 6882 |
| HPV33 | L1 | MVDTGFGCM | 200 | 9 | | | | | 6883 |
| HPV33 | L1 | MVTSESQL | 299 | 8 | | | | | 6884 |
| HPV33 | L1 | NAAPANDCPPL | 178 | 11 | | | | | 6885 |
| HPV33 | L1 | NAKKLLVPKV | 57 | 10 | | | | | 6886 |
| HPV33 | L1 | NMTLCTQV | 341 | 8 | | | | | 6887 |
| HPV33 | L1 | NMTLCTQVT | 341 | 9 | | | | | 6888 |
| HPV33 | L1 | NQVFVTVV | 327 | 8 | | | | | 6889 |
| HPV33 | L1 | NQVFVTVVDT | 327 | 10 | | | | | 6890 |
| HPV33 | L1 | NQVFVTVVDTT | 327 | 11 | | | | | 6891 |
| HPV33 | L1 | NTIIEDGDM | 192 | 9 | | | | | 6892 |
| HPV33 | L1 | NTIIEDGDMV | 192 | 10 | | | | | 6893 |
| HPV33 | L1 | PANDCPPL | 181 | 8 | | | | | 6894 |
| HPV33 | L1 | PANDCPPLEL | 181 | 10 | | | | | 6895 |
| HPV33 | L1 | PANDCPPLELI | 181 | 11 | | | | | 6896 |
| HPV33 | L1 | PIDICGST | 221 | 8 | | | | | 6897 |
| HPV33 | L1 | PLELINTI | 187 | 8 | | | | | 6898 |
| HPV33 | L1 | PLELINTII | 187 | 9 | | | | | 6899 |
| HPV33 | L1 | PLGKYTFWEV | 439 | 10 | | | | | 6900 |
| HPV33 | L1 | PLGRKFLL | 462 | 8 | | | | | 6901 |
| HPV33 | L1 | PLGRKFLLQA | 462 | 10 | | | | | 6902 |
| HPV33 | L1 | PLGVGISGHPL | 113 | 11 | | | | | 6903 |
| HPV33 | L1 | PLLNKFDDT | 122 | 9 | | | | | 6904 |
| HPV33 | L1 | PLLNKFDDTET | 122 | 11 | | | | | 6905 |
| HPV33 | L1 | PTGEHWGKGV | 165 | 10 | | | | | 6906 |
| HPV33 | L1 | PTGEHWGKGVA | 165 | 11 | | | | | 6907 |
| HPV33 | L1 | PTNAKKLL | 55 | 8 | | | | | 6908 |
| HPV33 | L1 | PTNAKKLLV | 55 | 9 | | | | | 6909 |
| HPV33 | L1 | PTPSGSMV | 293 | 8 | | | | | 6910 |
| HPV33 | L1 | PTPSGSMVT | 293 | 9 | | | | | 6911 |
| HPV33 | L1 | PTSTRTSSA | 484 | 9 | | | | | 6912 |
| HPV33 | L1 | PVPVSKVV | 15 | 8 | | | | | 6913 |
| HPV33 | L1 | PVPVSKVVST | 15 | 10 | | | | | 6914 |
| HPV33 | L1 | PVSKVVST | 17 | 8 | | | | | 6915 |
| HPV33 | L1 | QAGLKAKPKL | 470 | 10 | | | | | 6916 |
| HPV33 | L1 | QAITCQKT | 423 | 8 | | | | | 6917 |
| HPV33 | L1 | QAITCQKTV | 423 | 9 | | | | | 6918 |
| HPV33 | L1 | QANKSDVPI | 214 | 9 | | | | | 6919 |
| HPV33 | L1 | QANKSDVPIDI | 214 | 11 | | | | | 6920 |
| HPV33 | L1 | QLCKVTLT | 376 | 8 | | | | | 6921 |
| HPV33 | L1 | QLCKVTLTA | 376 | 9 | | | | | 6922 |
| HPV33 | L1 | QLCKVTLTAEV | 376 | 11 | | | | | 6923 |
| HPV33 | L1 | QLCLLGCKPPT | 156 | 11 | | | | | 6924 |
| HPV33 | L1 | QLFNKPYWL | 305 | 9 | | | | | 6925 |
| HPV33 | L1 | QMFVRHFFNRA | 254 | 11 | | | | | 6926 |
| HPV33 | L1 | QVFVTVVDT | 328 | 9 | | | | | 6927 |
| HPV33 | L1 | QVFVTVVDTT | 328 | 10 | | | | | 6928 |
| HPV33 | L1 | RAAPTSTRT | 481 | 9 | | | | | 6929 |
| HPV33 | L1 | RAGTLGEA | 263 | 8 | | | | | 6930 |
| HPV33 | L1 | RAGTLGEAV | 263 | 9 | | | | | 6931 |
| HPV33 | L1 | RAQGHNNGI | 315 | 9 | | | | | 6932 |
| HPV33 | L1 | RLVWACVGL | 98 | 9 | | | | | 6933 |
| HPV33 | L1 | RLVWACVGLEI | 98 | 11 | | | | | 6934 |
| HPV33 | L1 | RTSIYYA | 30 | 8 | | | | | 6935 |
| HPV33 | L1 | RTSSAKRKKV | 488 | 10 | | | | | 6936 |
| HPV33 | L1 | SADLDQFPL | 455 | 9 | | | | | 6937 |
| HPV33 | L1 | SAFFPTPSGSM | 289 | 11 | | | | | 6938 |
| HPV33 | L1 | SASLQDTYRFV | 410 | 11 | | | | | 6939 |
| HPV33 | L1 | SIKNPTNA | 51 | 8 | | | | | 6940 |
| HPV33 | L1 | SIKNPTNAKKL | 51 | 11 | | | | | 6941 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | L1 | SIQSSAFFPT | 285 | 10 | | | | | 6942 |
| HPV33 | L1 | SIYYYAGSSRL | 32 | 11 | | | | | 6943 |
| HPV33 | L1 | SLFFFLRREQM | 245 | 11 | | | | | 6944 |
| HPV33 | L1 | SLQDTYRFV | 412 | 9 | | | | | 6945 |
| HPV33 | L1 | SLQDTYRFVT | 412 | 10 | | | | | 6946 |
| HPV33 | L1 | SMDYKQTQL | 149 | 9 | | | | | 6947 |
| HPV33 | L1 | SMDYKQTQLCL | 149 | 11 | | | | | 6948 |
| HPV33 | L1 | SMVTSESQL | 298 | 9 | | | | | 6949 |
| HPV33 | L1 | SQAITCQKT | 422 | 9 | | | | | 6950 |
| HPV33 | L1 | SQITCQKTV | 422 | 10 | | | | | 6951 |
| HPV33 | L1 | SQLFNKPYWL | 304 | 10 | | | | | 6952 |
| HPV33 | L1 | STCKYPDYL | 227 | 9 | | | | | 6953 |
| HPV33 | L1 | STCKYPDYLKM | 227 | 11 | | | | | 6954 |
| HPV33 | L1 | STDEYVSRT | 23 | 9 | | | | | 6955 |
| HPV33 | L1 | STDEYVSRTSI | 23 | 11 | | | | | 6956 |
| HPV33 | L1 | STNMTLCT | 339 | 8 | | | | | 6957 |
| HPV33 | L1 | STNMTLCTQV | 339 | 10 | | | | | 6958 |
| HPV33 | L1 | STNMTLCTQVT | 339 | 11 | | | | | 6959 |
| HPV33 | L1 | SVWRPSEA | 2 | 8 | | | | | 6960 |
| HPV33 | L1 | SVWRPSEAT | 2 | 9 | | | | | 6961 |
| HPV33 | L1 | SVWRPSEATV | 2 | 10 | | | | | 6962 |
| HPV33 | L1 | TAEVMTYI | 383 | 8 | | | | | 6963 |
| HPV33 | L1 | TAEVMTYIHA | 383 | 10 | | | | | 6964 |
| HPV33 | L1 | TAEVMTYIHAM | 383 | 11 | | | | | 6965 |
| HPV33 | L1 | TASIQSSA | 283 | 8 | | | | | 6966 |
| HPV33 | L1 | TIIEDGDM | 193 | 8 | | | | | 6967 |
| HPV33 | L1 | TIIEDGDMV | 193 | 9 | | | | | 6968 |
| HPV33 | L1 | TIIEDGDMVDT | 193 | 11 | | | | | 6969 |
| HPV33 | L1 | TLCTQVTSDST | 343 | 11 | | | | | 6970 |
| HPV33 | L1 | TLGEAVPDDL | 266 | 10 | | | | | 6971 |
| HPV33 | L1 | TLQANKSDV | 212 | 9 | | | | | 6972 |
| HPV33 | L1 | TLQANKSDVPI | 212 | 11 | | | | | 6973 |
| HPV33 | L1 | TLTAEVMT | 381 | 8 | | | | | 6974 |
| HPV33 | L1 | TLTAEVMTYI | 381 | 10 | | | | | 6975 |
| HPV33 | L1 | TQRLVWACV | 96 | 9 | | | | | 6976 |
| HPV33 | L1 | TQRLVWACVGL | 96 | 11 | | | | | 6977 |
| HPV33 | L1 | TQVTSDST | 346 | 8 | | | | | 6978 |
| HPV33 | L1 | TTASIQSSA | 282 | 9 | | | | | 6979 |
| HPV33 | L1 | TTRSTNMT | 336 | 8 | | | | | 6980 |
| HPV33 | L1 | TTRSTNMTL | 336 | 9 | | | | | 6981 |
| HPV33 | L1 | TTRSTNMTLCT | 336 | 11 | | | | | 6982 |
| HPV33 | L1 | TVPPKEKEDPL | 430 | 11 | | | | | 6983 |
| HPV33 | L1 | TVVDTTRST | 332 | 9 | | | | | 6984 |
| HPV33 | L1 | TVVDTTRSTNM | 332 | 11 | | | | | 6985 |
| HPV33 | L1 | TVYLPPVPV | 10 | 9 | | | | | 6986 |
| HPV33 | L1 | VACTNAAPA | 174 | 9 | | | | | 6987 |
| HPV33 | L1 | VMTYIHAM | 386 | 8 | | | | | 6988 |
| HPV33 | L1 | VTLTAEVM | 380 | 8 | | | | | 6989 |
| HPV33 | L1 | VTLAEVMT | 380 | 9 | | | | | 6990 |
| HPV33 | L1 | VTLTAEVMTYI | 380 | 11 | | | | | 6991 |
| HPV33 | L1 | VTSQAITCQKT | 420 | 11 | | | | | 6992 |
| HPV33 | L1 | VTVVDTTRST | 331 | 10 | | | | | 6993 |
| HPV33 | L1 | VVDTTRST | 333 | 8 | | | | | 6994 |
| HPV33 | L1 | VVDTTRSTNM | 333 | 10 | | | | | 6995 |
| HPV33 | L1 | VVDTTRSTNMT | 333 | 11 | | | | | 6996 |
| HPV33 | L1 | VVSTDEYV | 21 | 8 | | | | | 6997 |
| HPV33 | L1 | VVSTDEYVSRT | 21 | 11 | | | | | 6998 |
| HPV33 | L1 | WACVGLEI | 101 | 8 | | | | | 6999 |
| HPV33 | L1 | WQFGLTPPPSA | 401 | 11 | | | | | 7000 |
| HPV33 | L1 | YAGSSRLL | 36 | 8 | | | | | 7001 |
| HPV33 | L1 | YAGSSRLLA | 36 | 9 | | | | | 7002 |
| HPV33 | L1 | YAGSSRLLAV | 36 | 10 | | | | | 7003 |
| HPV33 | L1 | YIHAMNPDI | 389 | 9 | | | | | 7004 |
| HPV33 | L1 | YIHAMNPDIL | 389 | 10 | | | | | 7005 |
| HPV33 | L1 | YIKGSGTT | 276 | 8 | | | | | 7006 |
| HPV33 | L1 | YIKGSGTTA | 276 | 9 | | | | | 7007 |
| HPV33 | L1 | YIKGSGTTASI | 276 | 11 | | | | | 7008 |
| HPV33 | L1 | YIRHVEEYDL | 362 | 10 | | | | | 7009 |
| HPV33 | L1 | YLPPVPVSKV | 12 | 10 | | | | | 7010 |
| HPV33 | L1 | YLPPVPVSKVV | 12 | 11 | | | | | 7011 |
| HPV33 | L1 | YTFWEVDL | 443 | 8 | | | | | 7012 |
| HPV33 | L1 | YVSRTSIYYA | 27 | 11 | | | | | 7013 |
| HPV33 | L2 | AAIPLQPI | 81 | 8 | | | | | 7014 |
| HPV33 | L2 | AIINVSSV | 140 | 8 | | | | | 7015 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | L2 | AIPLQPIRPPV | 82 | 11 | | | | | 7016 |
| HPV33 | L2 | AITSRRHT | 291 | 8 | | | | | 7017 |
| HPV33 | L2 | AITSRRHTV | 291 | 9 | | | | | 7018 |
| HPV33 | L2 | ALHRPAIT | 286 | 8 | | | | | 7019 |
| HPV33 | L2 | ATGTCPPDV | 23 | 9 | | | | | 7020 |
| HPV33 | L2 | ATGTCPPDVI | 23 | 10 | | | | | 7021 |
| HPV33 | L2 | ATLKTRSGKQI | 308 | 11 | | | | | 7022 |
| HPV33 | L2 | ATQLYQTCKA | 14 | 10 | | | | | 7023 |
| HPV33 | L2 | ATQLYQYCKAT | 14 | 11 | | | | | 7024 |
| HPV33 | L2 | ATTRTSNV | 385 | 8 | | | | | 7025 |
| HPV33 | L2 | ATTRTSNVSI | 385 | 10 | | | | | 7026 |
| HPV33 | L2 | DIIALHRPA | 283 | 9 | | | | | 7027 |
| HPV33 | L2 | DIIALHRPAI | 283 | 10 | | | | | 7028 |
| HPV33 | L2 | DIIALHRPAIT | 283 | 11 | | | | | 7029 |
| HPV33 | L2 | DIPSPLFPT | 409 | 9 | | | | | 7030 |
| HPV33 | L2 | DISPAPDPDFL | 272 | 11 | | | | | 7031 |
| HPV33 | L2 | DLSPIVPL | 327 | 8 | | | | | 7032 |
| HPV33 | L2 | DLSPIVPLDHT | 327 | 11 | | | | | 7033 |
| HPV33 | L2 | DQILKYGSL | 42 | 9 | | | | | 7034 |
| HPV33 | L2 | DQILKYGSLGV | 42 | 11 | | | | | 7035 |
| HPV33 | L2 | DTIVVDGA | 431 | 8 | | | | | 7036 |
| HPV33 | L2 | DTIVVDGAGFV | 431 | 11 | | | | | 7037 |
| HPV33 | L2 | DTLQFQHSDI | 264 | 10 | | | | | 7038 |
| HPV33 | L2 | DTPVMSGPDI | 401 | 10 | | | | | 7039 |
| HPV33 | L2 | DTSTSSYSI | 350 | 9 | | | | | 7040 |
| HPV33 | L2 | DTTPAIINV | 136 | 9 | | | | | 7041 |
| HPV33 | L2 | DTVGPLDSSI | 95 | 10 | | | | | 7042 |
| HPV33 | L2 | DTVGPLDSSIV | 95 | 11 | | | | | 7043 |
| HPV33 | L2 | DVDNVHTPM | 369 | 9 | | | | | 7044 |
| HPV33 | L2 | DVIPKVEGST | 30 | 10 | | | | | 7045 |
| HPV33 | L2 | DVIPKVEGSTI | 30 | 11 | | | | | 7046 |
| HPV33 | L2 | DVTTSADT | 130 | 8 | | | | | 7047 |
| HPV33 | L2 | DVTTSADTT | 130 | 9 | | | | | 7048 |
| HPV33 | L2 | DVTTSADTTPA | 130 | 11 | | | | | 7049 |
| HPV33 | L2 | DVYADDVDNV | 364 | 10 | | | | | 7050 |
| HPV33 | L2 | EAGAPAPSI | 115 | 9 | | | | | 7051 |
| HPV33 | L2 | EAGAPAPSIPT | 115 | 11 | | | | | 7052 |
| HPV33 | L2 | ELQPLHDT | 344 | 8 | | | | | 7053 |
| HPV33 | L2 | ELQPLHDTST | 344 | 10 | | | | | 7054 |
| HPV33 | L2 | EQYELQPL | 341 | 8 | | | | | 7055 |
| HPV33 | L2 | EQYELQPLHDT | 341 | 11 | | | | | 7056 |
| HPV33 | L2 | ETSFIEAGA | 110 | 9 | | | | | 7057 |
| HPV33 | L2 | ETSFIEAGAPA | 110 | 11 | | | | | 7058 |
| HPV33 | L2 | FATTRTSNV | 384 | 9 | | | | | 7059 |
| HPV33 | L2 | FATTRTSNVSI | 384 | 11 | | | | | 7060 |
| HPV33 | L2 | FIEAGAPA | 113 | 8 | | | | | 7061 |
| HPV33 | L2 | FIEAGPAPSI | 113 | 11 | | | | | 7062 |
| HPV33 | L2 | FIFSSPTV | 181 | 8 | | | | | 7063 |
| HPV33 | L2 | FIFSSPTVST | 181 | 10 | | | | | 7064 |
| HPV33 | L2 | FLDIIALHRPA | 281 | 11 | | | | | 7065 |
| HPV33 | L2 | FLTSPHKL | 242 | 8 | | | | | 7066 |
| HPV33 | L2 | FLTSPHKLI | 242 | 9 | | | | | 7067 |
| HPV33 | L2 | FLTSPHKLIT | 242 | 10 | | | | | 7068 |
| HPV33 | L2 | FQHSDISPA | 268 | 9 | | | | | 7069 |
| HPV33 | L2 | FTDVRVAA | 460 | 8 | | | | | 7070 |
| HPV33 | L2 | FTEPSVLHPPA | 163 | 11 | | | | | 7071 |
| HPV33 | L2 | FVLHPSYFI | 440 | 9 | | | | | 7072 |
| HPV33 | L2 | FVLHPSYFIL | 440 | 10 | | | | | 7073 |
| HPV33 | L2 | FVVSTDSSNV | 201 | 10 | | | | | 7074 |
| HPV33 | L2 | FVVSTDSSNVT | 201 | 11 | | | | | 7075 |
| HPV33 | L2 | GAPAPSIPT | 117 | 9 | | | | | 7076 |
| HPV33 | L2 | GARIHYYQDL | 319 | 10 | | | | | 7077 |
| HPV33 | L2 | GLYDVYADDV | 361 | 10 | | | | | 7078 |
| HPV33 | L2 | GLYSRNTQQV | 226 | 10 | | | | | 7079 |
| HPV33 | L2 | GQKATLKT | 305 | 8 | | | | | 7080 |
| HPV33 | L2 | GTCPPDVI | 25 | 8 | | | | | 7081 |
| HPV33 | L2 | GTCPPDVIPKV | 25 | 11 | | | | | 7082 |
| HPV33 | L2 | GTDPPTAA | 75 | 8 | | | | | 7083 |
| HPV33 | L2 | GTDPPTAAI | 75 | 9 | | | | | 7084 |
| HPV33 | L2 | GTDPPTAAIPL | 75 | 11 | | | | | 7085 |
| HPV33 | L2 | GTGSGSGGRT | 60 | 10 | | | | | 7086 |
| HPV33 | L2 | GVFFGGLGI | 51 | 9 | | | | | 7087 |
| HPV33 | L2 | GVFFGGLGIGT | 51 | 11 | | | | | 7088 |
| HPV33 | L2 | HLNPTFTEPSV | 158 | 11 | | | | | 7089 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | L2 | HTPMQHSYST | 374 | 10 | | | | | 7090 |
| HPV33 | L2 | HTVPNEQYEL | 336 | 10 | | | | | 7091 |
| HPV33 | L2 | HTVRFSRV | 297 | 8 | | | | | 7092 |
| HPV33 | L2 | IADQILKYGSL | 40 | 11 | | | | | 7093 |
| HPV33 | L2 | IALHRPAI | 285 | 8 | | | | | 7094 |
| HPV33 | L2 | IALHRPAIT | 285 | 9 | | | | | 7095 |
| HPV33 | L2 | IIALHRPA | 284 | 8 | | | | | 7096 |
| HPV33 | L2 | IIALHRPAI | 284 | 9 | | | | | 7097 |
| HPV33 | L2 | IIALHRPAIT | 284 | 10 | | | | | 7098 |
| HPV33 | L2 | ILKYGSLSV | 44 | 9 | | | | | 7099 |
| HPV33 | L2 | IQTISTHL | 152 | 8 | | | | | 7100 |
| HPV33 | L2 | IQTISTHLNPT | 152 | 11 | | | | | 7101 |
| HPV33 | L2 | ITSRRHTV | 292 | 8 | | | | | 7102 |
| HPV33 | L2 | IVPLDHTV | 331 | 8 | | | | | 7103 |
| HPV33 | L2 | IVSLIEET | 104 | 8 | | | | | 7104 |
| HPV33 | L2 | IVSLIEETSFI | 104 | 11 | | | | | 7105 |
| HPV33 | L2 | IVVDGADFV | 433 | 9 | | | | | 7106 |
| HPV33 | L2 | IVVDGADFVL | 433 | 10 | | | | | 7107 |
| HPV33 | L2 | KATGTCPPDV | 22 | 10 | | | | | 7108 |
| HPV33 | L2 | KATCTCPPDVI | 22 | 11 | | | | | 7109 |
| HPV33 | L2 | KLITYDNPA | 248 | 9 | | | | | 7110 |
| HPV33 | L2 | KTRSGKQI | 311 | 8 | | | | | 7111 |
| HPV33 | L2 | KTRSGKQIGA | 311 | 10 | | | | | 7112 |
| HPV33 | L2 | KVEGSTIA | 34 | 8 | | | | | 7113 |
| HPV33 | L2 | KVEGSTIADQI | 34 | 11 | | | | | 7114 |
| HPV33 | L2 | KVVDPAFL | 236 | 8 | | | | | 7115 |
| HPV33 | L2 | KVVDPAFLT | 236 | 9 | | | | | 7116 |
| HPV33 | L2 | LIEETSFI | 107 | 8 | | | | | 7117 |
| HPV33 | L2 | LIEETSFIEA | 107 | 10 | | | | | 7118 |
| HPV33 | L2 | LITYDNPA | 249 | 8 | | | | | 7119 |
| HPV33 | L2 | LQFQHSDI | 266 | 8 | | | | | 7120 |
| HPV33 | L2 | LQFQHSDISPA | 266 | 11 | | | | | 7121 |
| HPV33 | L2 | LQPIRPPV | 85 | 8 | | | | | 7122 |
| HPV33 | L2 | LQPIRPPVT | 85 | 9 | | | | | 7123 |
| HPV33 | L2 | LQPIRPPVTV | 85 | 10 | | | | | 7124 |
| HPV33 | L2 | LQPLHDTST | 345 | 9 | | | | | 7125 |
| HPV33 | L2 | LTSPHKLI | 243 | 8 | | | | | 7126 |
| HPV33 | L2 | LTSPHKLIT | 243 | 9 | | | | | 7127 |
| HPV33 | L2 | MQHSYSTFA | 377 | 9 | | | | | 7128 |
| HPV33 | L2 | MQHSYSTFAT | 377 | 10 | | | | | 7129 |
| HPV33 | L2 | MQHSYSTFATT | 377 | 11 | | | | | 7130 |
| HPV33 | L2 | NIPMDTFV | 195 | 8 | | | | | 7131 |
| HPV33 | L2 | NIPMDTFVV | 195 | 9 | | | | | 7132 |
| HPV33 | L2 | NIPMDTFVVST | 195 | 11 | | | | | 7133 |
| HPV33 | L2 | NTGFDTPV | 397 | 8 | | | | | 7134 |
| HPV33 | L2 | NTGFDTPVM | 397 | 9 | | | | | 7135 |
| HPV33 | L2 | NTQQVKVV | 231 | 8 | | | | | 7136 |
| HPV33 | L2 | NTQQVKVVDPA | 231 | 11 | | | | | 7137 |
| HPV33 | L2 | NVSIPLNT | 391 | 8 | | | | | 7138 |
| HPV33 | L2 | NVSSVGESSI | 143 | 10 | | | | | 7139 |
| HPV33 | L2 | NVTSSTPI | 209 | 8 | | | | | 7140 |
| HPV33 | L2 | PAEASGHFI | 174 | 9 | | | | | 7141 |
| HPV33 | L2 | PAFESFDPEDT | 255 | 11 | | | | | 7142 |
| HPV33 | L2 | PAFLTSPHKL | 240 | 10 | | | | | 7143 |
| HPV33 | L2 | PAFLTSPHKLI | 240 | 11 | | | | | 7144 |
| HPV33 | L2 | PAIINVSSV | 139 | 9 | | | | | 7145 |
| HPV33 | L2 | PAITSRRHT | 290 | 9 | | | | | 7146 |
| HPV33 | L2 | PAITSRRHTV | 290 | 10 | | | | | 7147 |
| HPV33 | L2 | PAPAEASGHFI | 172 | 11 | | | | | 7148 |
| HPV33 | L2 | PAPDPDFL | 275 | 8 | | | | | 7149 |
| HPV33 | L2 | PAPDPDFLDI | 275 | 10 | | | | | 7150 |
| HPV33 | L2 | PAPDPDFLDII | 275 | 11 | | | | | 7151 |
| HPV33 | L2 | PIGTDPPT | 73 | 8 | | | | | 7152 |
| HPV33 | L2 | PIGTDPPTA | 73 | 9 | | | | | 7153 |
| HPV33 | L2 | PIGTDPPTAA | 73 | 10 | | | | | 7154 |
| HPV33 | L2 | PIGTDPPTAAI | 73 | 11 | | | | | 7155 |
| HPV33 | L2 | PIPGSRPV | 215 | 8 | | | | | 7156 |
| HPV33 | L2 | PIPGSRPVA | 215 | 9 | | | | | 7157 |
| HPV33 | L2 | PIPGSRPVARL | 215 | 11 | | | | | 7158 |
| HPV33 | L2 | PIRPPVTV | 87 | 8 | | | | | 7159 |
| HPV33 | L2 | PIRPPVTVDT | 87 | 10 | | | | | 7160 |
| HPV33 | L2 | PIRPPVTVDTV | 87 | 11 | | | | | 7161 |
| HPV33 | L2 | PISPFFPFDT | 423 | 10 | | | | | 7162 |
| HPV33 | L2 | PISPFFPFDTI | 423 | 11 | | | | | 7163 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | L2 | PIVPLDHT | 330 | 8 | | | | | 7164 |
| HPV33 | L2 | PIVPLDHTV | 330 | 9 | | | | | 7165 |
| HPV33 | L2 | PLDSSIVSL | 99 | 9 | | | | | 7166 |
| HPV33 | L2 | PLDSSIVSLI | 99 | 10 | | | | | 7167 |
| HPV33 | L2 | PLFPTSSPFV | 413 | 10 | | | | | 7168 |
| HPV33 | L2 | PLNTGFDT | 395 | 8 | | | | | 7169 |
| HPV33 | L2 | PLNTGFDTPV | 395 | 10 | | | | | 7170 |
| HPV33 | L2 | PLNTGFDTPVM | 395 | 11 | | | | | 7171 |
| HPV33 | L2 | PLQPIRPPV | 84 | 9 | | | | | 7172 |
| HPV33 | L2 | PLQPIRPPVT | 84 | 10 | | | | | 7173 |
| HPV33 | L2 | PLQPIRPPVTV | 84 | 11 | | | | | 7174 |
| HPV33 | L2 | PMDTFVVST | 197 | 9 | | | | | 7175 |
| HPV33 | L2 | PMQHSYST | 376 | 8 | | | | | 7176 |
| HPV33 | L2 | PMQHSYSTFA | 376 | 10 | | | | | 7177 |
| HPV33 | L2 | PMQHSYSTFAT | 376 | 11 | | | | | 7178 |
| HPV33 | L2 | PTAAIPLQPI | 79 | 10 | | | | | 7179 |
| HPV33 | L2 | PTFTEPSV | 161 | 8 | | | | | 7180 |
| HPV33 | L2 | PTFTEPSVL | 161 | 9 | | | | | 7181 |
| HPV33 | L2 | PTPSGFDV | 124 | 8 | | | | | 7182 |
| HPV33 | L2 | PTPSGFDVT | 124 | 9 | | | | | 7183 |
| HPV33 | L2 | PTPSGFDVTT | 124 | 10 | | | | | 7184 |
| HPV33 | L2 | PTSSPFVPI | 416 | 9 | | | | | 7185 |
| HPV33 | L2 | PTVSTQSYENI | 186 | 11 | | | | | 7186 |
| HPV33 | L2 | PVMSGPDI | 403 | 8 | | | | | 7187 |
| HPV33 | L2 | PVTVDTVGPL | 91 | 10 | | | | | 7188 |
| HPV33 | L2 | QILKYGSL | 43 | 8 | | | | | 7189 |
| HPV33 | L2 | QILKYGSLGV | 43 | 10 | | | | | 7190 |
| HPV33 | L2 | QLYQTCKA | 16 | 8 | | | | | 7191 |
| HPV33 | L2 | QLYQTCKAT | 16 | 9 | | | | | 7192 |
| HPV33 | L2 | QLYQTCKATGT | 16 | 11 | | | | | 7193 |
| HPV33 | L2 | QQVKVVDPA | 233 | 9 | | | | | 7194 |
| HPV33 | L2 | QQVKVVDPAFL | 233 | 11 | | | | | 7195 |
| HPV33 | L2 | QTCKATGT | 19 | 8 | | | | | 7196 |
| HPV33 | L2 | QTISTHLNPT | 153 | 10 | | | | | 7197 |
| HPV33 | L2 | QVKVVDPA | 234 | 8 | | | | | 7198 |
| HPV33 | L2 | QVKVVDPAFL | 234 | 10 | | | | | 7199 |
| HPV33 | L2 | QVKVVDPAFLT | 234 | 11 | | | | | 7200 |
| HPV33 | L2 | RASATQLYQT | 11 | 10 | | | | | 7201 |
| HPV33 | L2 | RIHYYQDL | 321 | 8 | | | | | 7202 |
| HPV33 | L2 | RIHYYQDLSPI | 321 | 11 | | | | | 7203 |
| HPV33 | L2 | RLGLYSRNT | 224 | 9 | | | | | 7204 |
| HPV33 | L2 | RTGYVPIGT | 68 | 9 | | | | | 7205 |
| HPV33 | L2 | RTSNVSIPL | 388 | 9 | | | | | 7206 |
| HPV33 | L2 | RTSNVSIPLNT | 388 | 11 | | | | | 7207 |
| HPV33 | L2 | RVGQKATL | 303 | 8 | | | | | 7208 |
| HPV33 | L2 | RVGQKATLKT | 303 | 10 | | | | | 7209 |
| HPV33 | L2 | SADTTPAI | 134 | 8 | | | | | 7210 |
| HPV33 | L2 | SADTTPAII | 134 | 9 | | | | | 7211 |
| HPV33 | L2 | SADTTPAIINV | 134 | 11 | | | | | 7212 |
| HPV33 | L2 | SATQLYQT | 13 | 8 | | | | | 7213 |
| HPV33 | L2 | SATQLYATCKA | 13 | 11 | | | | | 7214 |
| HPV33 | L2 | SINDGLYDV | 357 | 9 | | | | | 7215 |
| HPV33 | L2 | SINDGLYDVYA | 357 | 11 | | | | | 7216 |
| HPV33 | L2 | SIPLNTGFDT | 393 | 10 | | | | | 7217 |
| HPV33 | L2 | SIPTPSGFDV | 122 | 10 | | | | | 7218 |
| HPV33 | L2 | SIPTPSGFDVT | 122 | 11 | | | | | 7219 |
| HPV33 | L2 | SIQTISTHL | 151 | 9 | | | | | 7220 |
| HPV33 | L2 | SIVSLIEET | 103 | 9 | | | | | 7221 |
| HPV33 | L2 | SLGVFFGGL | 49 | 9 | | | | | 7222 |
| HPV33 | L2 | SLGVFFGGLGI | 49 | 11 | | | | | 7223 |
| HPV33 | L2 | SLIEETSFI | 106 | 9 | | | | | 7224 |
| HPV33 | L2 | SLIEETSFIEA | 106 | 11 | | | | | 7225 |
| HPV33 | L2 | STDSSNVT | 204 | 8 | | | | | 7226 |
| HPV33 | L2 | STDSSNVTSST | 204 | 11 | | | | | 7227 |
| HPV33 | L2 | STFATTRT | 382 | 8 | | | | | 7228 |
| HPV33 | L2 | STFATTRTSNV | 382 | 11 | | | | | 7229 |
| HPV33 | L2 | STHLNPTFT | 156 | 9 | | | | | 7230 |
| HPV33 | L2 | STIADQIL | 38 | 8 | | | | | 7231 |
| HPV33 | L2 | STPIPGSRPV | 213 | 10 | | | | | 7232 |
| HPV33 | L2 | STPIPGSRPVA | 213 | 11 | | | | | 7233 |
| HPV33 | L2 | STQSYENI | 189 | 8 | | | | | 7234 |
| HPV33 | L2 | STQSYENIPM | 189 | 10 | | | | | 7235 |
| HPV33 | L2 | STRRKRASA | 6 | 9 | | | | | 7236 |
| HPV33 | L2 | STRRKRASAT | 6 | 10 | | | | | 7237 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV33 | L2 | STSSYSINDGL | 352 | 11 | | | | | 7238 |
| HPV33 | L2 | SVGEESSIQT | 146 | 9 | | | | | 7239 |
| HPV33 | L2 | SVGESSIQTI | 146 | 10 | | | | | 7240 |
| HPV33 | L2 | SVLHPPAPA | 167 | 9 | | | | | 7241 |
| HPV33 | L2 | SVLHPPAPAEA | 167 | 11 | | | | | 7242 |
| HPV33 | L2 | TAAIPLQPI | 80 | 9 | | | | | 7243 |
| HPV33 | L2 | TISTHLNPT | 154 | 9 | | | | | 7244 |
| HPV33 | L2 | TISTHLNPTFT | 154 | 11 | | | | | 7245 |
| HPV33 | L2 | TIVVDGADFV | 432 | 10 | | | | | 7246 |
| HPV33 | L2 | TIVVDGADFVL | 432 | 11 | | | | | 7247 |
| HPV33 | L2 | TLKTRSGKQI | 309 | 10 | | | | | 7248 |
| HPV33 | L2 | TLQFQHSDI | 265 | 9 | | | | | 7249 |
| HPV33 | L2 | TQLYQTCKA | 15 | 9 | | | | | 7250 |
| HPV33 | L2 | TQLYQTCKAT | 15 | 10 | | | | | 7251 |
| HPV33 | L2 | TQQVKVVDPA | 232 | 10 | | | | | 7252 |
| HPV33 | L2 | TQSYENIPM | 190 | 9 | | | | | 7253 |
| HPV33 | L2 | TQSYENIPMDT | 190 | 11 | | | | | 7254 |
| HPV33 | L2 | TTPAIINV | 137 | 8 | | | | | 7255 |
| HPV33 | L2 | TTPAIINVSSV | 137 | 11 | | | | | 7256 |
| HPV33 | L2 | TTRTSNVSI | 386 | 9 | | | | | 7257 |
| HPV33 | L2 | TTRTSNVSIPL | 386 | 11 | | | | | 7258 |
| HPV33 | L2 | TTSADTTPA | 132 | 9 | | | | | 7259 |
| HPV33 | L2 | TTSADTTPAI | 132 | 10 | | | | | 7260 |
| HPV33 | L2 | TTSADTTPAII | 132 | 11 | | | | | 7261 |
| HPV33 | L2 | TVDTVGPL | 93 | 8 | | | | | 7262 |
| HPV33 | L2 | TVGPLDSSI | 96 | 9 | | | | | 7263 |
| HPV33 | L2 | TVGPLDSSIV | 96 | 10 | | | | | 7264 |
| HPV33 | L2 | TVPNEQYEL | 337 | 9 | | | | | 7265 |
| HPV33 | L2 | TVRFSRVGQKA | 298 | 11 | | | | | 7266 |
| HPV33 | L2 | TVSTQSYENI | 187 | 10 | | | | | 7267 |
| HPV33 | L2 | VARLGLYSRNT | 222 | 11 | | | | | 7268 |
| HPV33 | L2 | VIPKVEGST | 31 | 9 | | | | | 7269 |
| HPV33 | L2 | VIPKVEGSTI | 31 | 10 | | | | | 7270 |
| HPV33 | L2 | VIPKVEGSTIA | 31 | 11 | | | | | 7271 |
| HPV33 | L2 | VLHPPAPA | 168 | 8 | | | | | 7272 |
| HPV33 | L2 | VLHPPAPAEA | 168 | 10 | | | | | 7273 |
| HPV33 | L2 | VLHPSYFI | 441 | 8 | | | | | 7274 |
| HPV33 | L2 | VLHPSYFIL | 441 | 9 | | | | | 7275 |
| HPV33 | L2 | VMSGPDIPSPL | 404 | 11 | | | | | 7276 |
| HPV33 | L2 | VTTSADTT | 131 | 8 | | | | | 7277 |
| HPV33 | L2 | VTTSADTTPA | 131 | 10 | | | | | 7278 |
| HPV33 | L2 | VTTSADTTPAI | 131 | 11 | | | | | 7279 |
| HPV33 | L2 | VTVDTVGPL | 92 | 9 | | | | | 7280 |
| HPV33 | L2 | VVDGADFV | 434 | 8 | | | | | 7281 |
| HPV33 | L2 | VVDGADFVL | 434 | 9 | | | | | 7282 |
| HPV33 | L2 | VVDPAFLT | 237 | 8 | | | | | 7283 |
| HPV33 | L2 | VVSTDSSNV | 202 | 9 | | | | | 7284 |
| HPV33 | L2 | VVSTDSSNVT | 202 | 10 | | | | | 7285 |
| HPV33 | L2 | YADDVDNV | 366 | 8 | | | | | 7286 |
| HPV33 | L2 | YADDVDNVHT | 366 | 10 | | | | | 7287 |
| HPV33 | L2 | YQDLSPIV | 325 | 8 | | | | | 7288 |
| HPV33 | L2 | YQDLSPIVPL | 325 | 10 | | | | | 7289 |
| HPV33 | L2 | YQTCKATGT | 18 | 9 | | | | | 7290 |
| HPV33 | L2 | YVPIGTDPPT | 71 | 10 | | | | | 7291 |
| HPV33 | L2 | YVPIGTDPPTA | 71 | 11 | | | | | 7292 |
| HPV45 | E1 | AAAFLKSNCQA | 382 | 11 | | | | | 7293 |
| HPV45 | E1 | AAETQVTV | 144 | 8 | | | | | 7294 |
| HPV45 | E1 | AAETQVTVNT | 144 | 10 | | | | | 7295 |
| HPV45 | E1 | AAFLKSNCQA | 383 | 10 | | | | | 7296 |
| HPV45 | E1 | AALYWYRT | 310 | 8 | | | | | 7297 |
| HPV45 | E1 | AALYWYRTGI | 310 | 10 | | | | | 7298 |
| HPV45 | E1 | AAMLAVFKDI | 198 | 10 | | | | | 7299 |
| HPV45 | E1 | AIFGVNPT | 232 | 8 | | | | | 7300 |
| HPV45 | E1 | AIFGVNPTV | 232 | 9 | | | | | 7301 |
| HPV45 | E1 | AIFGVNPTVA | 232 | 10 | | | | | 7302 |
| HPV45 | E1 | ALDGNPISI | 532 | 9 | 0.021 | | | | 7303 |
| HPV45 | E1 | ALFHAQEV | 68 | 8 | | | | | 7304 |
| HPV45 | E1 | ALKEFLKGT | 452 | 9 | | | | | 7305 |
| HPV45 | E1 | ALYWYRTGI | 311 | 9 | 0.0032 | | | | 7306 |
| HPV45 | E1 | AMLAVFKDI | 199 | 9 | | | | | 7307 |
| HPV45 | E1 | AMLDDATHT | 512 | 9 | | | | | 7308 |
| HPV45 | E1 | AQALFHAQEV | 66 | 10 | | | | | 7309 |
| HPV45 | E1 | AQEVQNDA | 72 | 8 | | | | | 7310 |
| HPV45 | E1 | AQEVQNDAQV | 72 | 10 | | | | | 7311 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E1 | AQEVQNDAQVL | 72 | 11 | | | | | 7312 |
| HPV45 | E1 | AQKRQMNM | 408 | 8 | | | | | 7313 |
| HPV45 | E1 | AQLADCNSNA | 373 | 10 | | | | | 7314 |
| HPV45 | E1 | AQLADCNSNAA | 373 | 11 | | | | | 7315 |
| HPV45 | E1 | ATDTGSDM | 40 | 8 | | | | | 7316 |
| HPV45 | E1 | ATDTGSDMV | 40 | 9 | | | | | 7317 |
| HPV45 | E1 | ATLYAHIQCL | 251 | 10 | | | | | 7318 |
| HPV45 | E1 | AVFKDIYGL | 202 | 9 | | | | | 7319 |
| HPV45 | E1 | AVMCRHYKRA | 399 | 10 | | | | | 7320 |
| HPV45 | E1 | CAVMCRHYKRA | 398 | 11 | | | | | 7321 |
| HPV45 | E1 | CILLYGPA | 465 | 8 | | | | | 7322 |
| HPV45 | E1 | CILLYGPANT | 465 | 10 | | | | | 7323 |
| HPV45 | E1 | CLDCKWGV | 259 | 8 | | | | | 7324 |
| HPV45 | E1 | CLDCKWGVL | 259 | 9 | | | | | 7325 |
| HPV45 | E1 | CLDCKWGVLI | 259 | 10 | 0.0002 | | | | 7326 |
| HPV45 | E1 | CLDCKWGVLIL | 259 | 11 | | | | | 7327 |
| HPV45 | E1 | CMLIEPPKL | 297 | 9 | | | | | 7328 |
| HPV45 | E1 | CQAKYLKDCA | 390 | 10 | | | | | 7329 |
| HPV45 | E1 | CQAKYLKDCAV | 390 | 11 | | | | | 7330 |
| HPV45 | E1 | CTDWVMAI | 226 | 8 | | | | | 7331 |
| HPV45 | E1 | CTDWVMAIFGV | 226 | 11 | | | | | 7332 |
| HPV45 | E1 | CVTGQNTRPL | 634 | 10 | | | | | 7333 |
| HPV45 | E1 | DADTEGIPFGT | 621 | 11 | | | | | 7334 |
| HPV45 | E1 | DAQVLHLL | 78 | 8 | | | | | 7335 |
| HPV45 | E1 | DATHTCWT | 516 | 8 | | | | | 7336 |
| HPV45 | E1 | DIYGLSFT | 206 | 8 | | | | | 7337 |
| HPV45 | E1 | DIYGLSFTDL | 206 | 10 | | | | | 7338 |
| HPV45 | E1 | DIYGLSFTDLV | 206 | 11 | | | | | 7339 |
| HPV45 | E1 | DLHEDDEDA | 614 | 9 | | | | | 7340 |
| HPV45 | E1 | DLHEDDEDADT | 614 | 11 | | | | | 7341 |
| HPV45 | E1 | DLSDMVQWA | 349 | 9 | | | | | 7342 |
| HPV45 | E1 | DLSPRLQEI | 108 | 9 | | | | | 7343 |
| HPV45 | E1 | DLSPRLQEISL | 108 | 11 | | | | | 7344 |
| HPV45 | E1 | DLTDESDM | 361 | 8 | | | | | 7345 |
| HPV45 | E1 | DLTDESDMA | 361 | 9 | | | | | 7346 |
| HPV45 | E1 | DLVRNFKSDKT | 214 | 11 | | | | | 7347 |
| HPV45 | E1 | DMAFQYAQL | 367 | 9 | | | | | 7348 |
| HPV45 | E1 | DMAFQYAQLA | 367 | 10 | | | | | 7349 |
| HPV45 | E1 | DMVDFIDT | 46 | 8 | | | | | 7350 |
| HPV45 | E1 | DMVDFIDTQL | 46 | 10 | | | | | 7351 |
| HPV45 | E1 | DMVQWAFDNDL | 352 | 11 | | | | | 7352 |
| HPV45 | E1 | DTDLSPRL | 106 | 8 | | | | | 7353 |
| HPV45 | E1 | DTDLSPRLQEI | 106 | 11 | | | | | 7354 |
| HPV45 | E1 | DTEGIPFGT | 623 | 9 | | | | | 7355 |
| HPV45 | E1 | DTGSDMVDFI | 42 | 10 | | | | | 7356 |
| HPV45 | E1 | DTKVAMLDDA | 508 | 10 | | | | | 7357 |
| HPV45 | E1 | DTKVAMLDDAT | 508 | 11 | | | | | 7358 |
| HPV45 | E1 | DTPEWIQRL | 328 | 9 | | | | | 7359 |
| HPV45 | E1 | DTPEWIQRLT | 328 | 10 | | | | | 7360 |
| HPV45 | E1 | DTPEWIQRLTI | 328 | 11 | | | | | 7361 |
| HPV45 | E1 | DTQLSICEQA | 52 | 10 | | | | | 7362 |
| HPV45 | E1 | DVISDDEDET | 30 | 10 | | | | | 7363 |
| HPV45 | E1 | DVISDDEDETA | 30 | 11 | | | | | 7364 |
| HPV45 | E1 | EAAETQVT | 143 | 8 | | | | | 7365 |
| HPV45 | E1 | EAAETQVTV | 143 | 9 | | | | | 7366 |
| HPV45 | E1 | EAAETQVTVNT | 143 | 11 | | | | | 7367 |
| HPV45 | E1 | EISLNSGHKKA | 115 | 11 | | | | | 7368 |
| HPV45 | E1 | ELKEKKQA | 186 | 8 | | | | | 7369 |
| HPV45 | E1 | ELLQASNKKA | 189 | 10 | | | | | 7370 |
| HPV45 | E1 | ELLQASNKKAA | 189 | 11 | | | | | 7371 |
| HPV45 | E1 | EQAEQETA | 59 | 8 | | | | | 7372 |
| HPV45 | E1 | EQAEQETAQA | 59 | 10 | | | | | 7373 |
| HPV45 | E1 | EQAEQETAQAL | 59 | 11 | | | | | 7374 |
| HPV45 | E1 | EQETAQAL | 62 | 8 | | | | | 7375 |
| HPV45 | E1 | EQETAQALFHA | 62 | 11 | | | | | 7376 |
| HPV45 | E1 | EQLSVDTDL | 101 | 9 | | | | | 7377 |
| HPV45 | E1 | ETAQALFHA | 64 | 9 | | | | | 7378 |
| HPV45 | E1 | ETATDTGSDM | 38 | 10 | | | | | 7379 |
| HPV45 | E1 | ETATDTGSDMV | 38 | 11 | | | | | 7380 |
| HPV45 | E1 | ETCMLIEPPKL | 295 | 11 | | | | | 7381 |
| HPV45 | E1 | ETIVEKKT | 21 | 8 | | | | | 7382 |
| HPV45 | E1 | ETIVEKKTGDV | 21 | 11 | | | | | 7383 |
| HPV45 | E1 | ETQVTVNT | 146 | 8 | | | | | 7384 |
| HPV45 | E1 | ETQVTVNTNA | 146 | 10 | | | | | 7385 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E1 | EVEAAETQV | 141 | 9 | | | | | 7386 |
| HPV45 | E1 | EVEAAETQVT | 141 | 10 | | | | | 7387 |
| HPV45 | E1 | EVEAAETQVTV | 141 | 11 | | | | | 7388 |
| HPV45 | E1 | EVQNDAQV | 74 | 8 | | | | | 7389 |
| HPV45 | E1 | EVQNDAQVL | 74 | 9 | | | | | 7390 |
| HPV45 | E1 | EVQNDAQVLHL | 74 | 11 | | | | | 7391 |
| HPV45 | E1 | EVSGDTPEWI | 324 | 10 | | | | | 7392 |
| HPV45 | E1 | FAGGSKENSPL | 89 | 11 | | | | | 7393 |
| HPV45 | E1 | FIDTQLSI | 50 | 8 | | | | | 7394 |
| HPV45 | E1 | FIHFLQGA | 483 | 8 | | | | | 7395 |
| HPV45 | E1 | FIHFLQGAI | 483 | 9 | | | | | 7396 |
| HPV45 | E1 | FIHFLQGAII | 483 | 10 | | | | | 7397 |
| HPV45 | E1 | FISFLRAL | 446 | 8 | | | | | 7398 |
| HPV45 | E1 | FLKGTPKKNCI | 456 | 11 | | | | | 7399 |
| HPV45 | E1 | FLKSNCQA | 385 | 8 | | | | | 7400 |
| HPV45 | E1 | FLKNCQAKYL | 385 | 11 | | | | | 7401 |
| HPV45 | E1 | FLQGAIISFV | 486 | 10 | | | | | 7402 |
| HPV45 | E1 | FLRALKEFL | 449 | 9 | | | | | 7403 |
| HPV45 | E1 | FLRYQGVEFI | 438 | 10 | | | | | 7404 |
| HPV45 | E1 | FVETIVEKKT | 19 | 10 | | | | | 7405 |
| HPV45 | E1 | FVNSNSHFWL | 494 | 10 | | | | | 7406 |
| HPV45 | E1 | GIDDSNFDL | 342 | 9 | | | | | 7407 |
| HPV45 | E1 | GIPFGTFKCV | 626 | 10 | | | | | 7408 |
| HPV45 | E1 | GIPFGTFKCVT | 626 | 11 | | | | | 7409 |
| HPV45 | E1 | GISNISEV | 318 | 8 | | | | | 7410 |
| HPV45 | E1 | GLSFTDLV | 209 | 8 | | | | | 7411 |
| HPV45 | E1 | GLSTLLHV | 286 | 8 | | | | | 7412 |
| HPV45 | E1 | GLSTLLHVPET | 286 | 11 | | | | | 7413 |
| HPV45 | E1 | GMSFIHFL | 480 | 8 | | | | | 7414 |
| HPV45 | E1 | GMSFIHFLQGA | 480 | 11 | | | | | 7415 |
| HPV45 | E1 | GTFKCVTGQNT | 630 | 11 | | | | | 7416 |
| HPV45 | E1 | GTGCNGWFFV | 11 | 10 | | | | | 7417 |
| HPV45 | E1 | GTPKKNCI | 459 | 8 | | | | | 7418 |
| HPV45 | E1 | GTPKKNCIL | 459 | 9 | | | | | 7419 |
| HPV45 | E1 | GTPKKNCILL | 459 | 10 | | | | | 7420 |
| HPV45 | E1 | GVEFISFL | 443 | 8 | | | | | 7421 |
| HPV45 | E1 | GVEFISFLRA | 443 | 10 | | | | | 7422 |
| HPV45 | E1 | GVEFISFLRAL | 443 | 11 | | | | | 7423 |
| HPV45 | E1 | GVLILALL | 265 | 8 | | | | | 7424 |
| HPV45 | E1 | HAQEVQNDA | 71 | 9 | | | | | 7425 |
| HPV45 | E1 | HAQEVQNDAQV | 71 | 11 | | | | | 7426 |
| HPV45 | E1 | HIQCLDCKWGV | 256 | 11 | | | | | 7427 |
| HPV45 | E1 | HLLKRKFA | 83 | 8 | | | | | 7428 |
| HPV45 | E1 | HTCWTYFDNYM | 519 | 11 | | | | | 7429 |
| HPV45 | E1 | HVPETCML | 292 | 8 | | | | | 7430 |
| HPV45 | E1 | HVPETCMLI | 292 | 9 | | | | | 7431 |
| HPV45 | E1 | ILLTSNIDPA | 555 | 10 | | | | | 7432 |
| HPV45 | E1 | ILLYGPANT | 466 | 9 | | | | | 7433 |
| HPV45 | E1 | IQCLDCKWGV | 257 | 10 | | | | | 7434 |
| HPV45 | E1 | IQCLDCKWGVL | 257 | 11 | | | | | 7435 |
| HPV45 | E1 | IQRLTIIQHGI | 333 | 11 | | | | | 7436 |
| HPV45 | E1 | ITELKELL | 184 | 8 | | | | | 7437 |
| HPV45 | E1 | IRELKELLQA | 184 | 10 | | | | | 7438 |
| HPV45 | E1 | IVEKKTGDV | 23 | 9 | | | | | 7439 |
| HPV45 | E1 | IVEKKTGDVI | 23 | 10 | | | | | 7440 |
| HPV45 | E1 | IVQFLRYQGV | 435 | 10 | | | | | 7441 |
| HPV45 | E1 | KAAMLAVFKDI | 197 | 11 | | | | | 7442 |
| HPV45 | E1 | KAKRRLFT | 124 | 8 | | | | | 7443 |
| HPV45 | E1 | KAKRRLFTI | 124 | 9 | | | | | 7444 |
| HPV45 | E1 | KIDEGGDWRPI | 425 | 11 | | | | | 7445 |
| HPV45 | E1 | KLRSSVAA | 304 | 8 | | | | | 7446 |
| HPV45 | E1 | KLRSSVAAL | 304 | 9 | 0.0003 | | | | 7447 |
| HPV45 | E1 | KTLIKPAT | 245 | 8 | | | | | 7448 |
| HPV45 | E1 | KTLIKPATL | 245 | 9 | | | | | 7449 |
| HPV45 | E1 | KTLIKPATLYA | 245 | 11 | | | | | 7450 |
| HPV45 | E1 | KTTCTDWV | 223 | 8 | | | | | 7451 |
| HPV45 | E1 | KTTCTDWVM | 223 | 9 | | | | | 7452 |
| HPV45 | E1 | KTTCTDWVMA | 223 | 10 | | | | | 7453 |
| HPV45 | E1 | KTTCTDWVMAI | 223 | 11 | | | | | 7454 |
| HPV45 | E1 | KVAMLDDA | 510 | 8 | | | | | 7455 |
| HPV45 | E1 | KVAMLDDAT | 510 | 9 | | | | | 7456 |
| HPV45 | E1 | KVAMLDDATHT | 510 | 11 | | | | | 7457 |
| HPV45 | E1 | LADCNSNA | 375 | 8 | | | | | 7458 |
| HPV45 | E1 | LADCNSNAA | 375 | 9 | | | | | 7459 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E1 | LADCNCNAAA | 375 | 10 | | | | | 7460 |
| HPV45 | E1 | LADTKVAM | 506 | 8 | | | | | 7461 |
| HPV45 | E1 | LADTKVAML | 506 | 9 | | | | | 7462 |
| HPV45 | E1 | LAVFKDIYGL | 201 | 10 | | | | | 7463 |
| HPV45 | E1 | LIEPPKLRSSV | 299 | 11 | | | | | 7464 |
| HPV45 | E1 | LIKPATLYA | 247 | 9 | | | | | 7465 |
| HPV45 | E1 | LIKPATLYAHI | 247 | 11 | | | | | 7466 |
| HPV45 | E1 | LLHVPETCM | 290 | 9 | | | | | 7467 |
| HPV45 | E1 | LLHVPETCML | 290 | 10 | | | | | 7468 |
| HPV45 | E1 | LLHVPETCMLI | 290 | 11 | | | | | 7469 |
| HPV45 | E1 | LLQASNKKA | 190 | 9 | | | | | 7470 |
| HPV45 | E1 | LLQASNKKAA | 190 | 10 | | | | | 7471 |
| HPV45 | E1 | LLQASNKKAAM | 190 | 11 | | | | | 7472 |
| HPV45 | E1 | LLQLKCPPI | 547 | 9 | | | | | 7473 |
| HPV45 | E1 | LLQLKCPPIL | 547 | 10 | | | | | 7474 |
| HPV45 | E1 | LLQLKCPPILL | 547 | 11 | | | | | 7475 |
| HPV45 | E1 | LLRYKCGKNRL | 271 | 11 | | | | | 7476 |
| HPV45 | E1 | LLTSNIDPA | 556 | 9 | | | | | 7477 |
| HPV45 | E1 | LLYGPANT | 467 | 8 | | | | | 7478 |
| HPV45 | E1 | LQASNKKA | 191 | 8 | | | | | 7479 |
| HPV45 | E1 | LQASNKKAA | 191 | 9 | | | | | 7480 |
| HPV45 | E1 | LQASNKKAAM | 191 | 10 | | | | | 7481 |
| HPV45 | E1 | LQASNKKAAML | 191 | 11 | | | | | 7482 |
| HPV45 | E1 | LQGAIISFV | 487 | 9 | | | | | 7483 |
| HPV45 | E1 | LQLKCPPI | 548 | 8 | | | | | 7484 |
| HPV45 | E1 | LQLKCPPIL | 548 | 9 | | | | | 7485 |
| HPV45 | E1 | LQLKCPPILL | 548 | 10 | | | | | 7486 |
| HPV45 | E1 | LQLKCPPILLT | 548 | 11 | | | | | 7487 |
| HPV45 | E1 | LTDESDMA | 362 | 8 | | | | | 7488 |
| HPV45 | E1 | LTIIQHGI | 336 | 8 | | | | | 7489 |
| HPV45 | E1 | LTSNIDPA | 557 | 8 | | | | | 7490 |
| HPV45 | E1 | LTVAKGLST | 281 | 9 | | | | | 7491 |
| HPV45 | E1 | LTVAKGLSTL | 281 | 10 | | | | | 7492 |
| HPV45 | E1 | LTVAKGLSTLL | 281 | 11 | | | | | 7493 |
| HPV45 | E1 | LVRNFKSDKT | 215 | 10 | | | | | 7494 |
| HPV45 | E1 | LVRNFKSDKTT | 215 | 11 | | | | | 7495 |
| HPV45 | E1 | MAFQYAQL | 368 | 8 | | | | | 7496 |
| HPV45 | E1 | MAFQYAQLA | 368 | 9 | | | | | 7497 |
| HPV45 | E1 | MAIFGVNPT | 231 | 9 | | | | | 7498 |
| HPV45 | E1 | MAIFGVNPTV | 231 | 10 | | | | | 7499 |
| HPV45 | E1 | MAIFGVNPTVA | 231 | 11 | | | | | 7500 |
| HPV45 | E1 | MLAVFKDI | 200 | 8 | | | | | 7501 |
| HPV45 | E1 | MLAVFKDIYGL | 200 | 11 | | | | | 7502 |
| HPV45 | E1 | MLDDATHT | 513 | 8 | | | | | 7503 |
| HPV45 | E1 | MLDDATHCWT | 513 | 11 | | | | | 7504 |
| HPV45 | E1 | MLIEPPKL | 298 | 8 | | | | | 7505 |
| HPV45 | E1 | MVDFIDTQL | 47 | 9 | | | | | 7506 |
| HPV45 | E1 | MVDFIDTQLSI | 47 | 11 | | | | | 7507 |
| HPV45 | E1 | MVQWAFDNDL | 353 | 10 | | | | | 7508 |
| HPV45 | E1 | MVQWAFDNDLT | 353 | 11 | | | | | 7509 |
| HPV45 | E1 | NAENGGSV | 154 | 8 | | | | | 7510 |
| HPV45 | E1 | NAENGGSVHST | 154 | 11 | | | | | 7511 |
| HPV45 | E1 | NAENVDPHCSI | 174 | 11 | | | | | 7512 |
| HPV45 | E1 | NALDGNPI | 531 | 8 | | | | | 7513 |
| HPV45 | E1 | NALDGNPISI | 531 | 10 | | | | | 7514 |
| HPV45 | E1 | NISEVSGDT | 321 | 9 | | | | | 7515 |
| HPV45 | E1 | NTGKSYFGM | 473 | 9 | | | | | 7516 |
| HPV45 | E1 | NTNAENGGSV | 152 | 10 | | | | | 7517 |
| HPV45 | E1 | NVDPHCSI | 177 | 8 | | | | | 7518 |
| HPV45 | E1 | NVDPHCSIT | 177 | 9 | | | | | 7519 |
| HPV45 | E1 | NVDPHCSITEL | 177 | 11 | | | | | 7520 |
| HPV45 | E1 | PAKDNKWPYL | 563 | 10 | | | | | 7521 |
| HPV45 | E1 | PANTGKSYFGM | 471 | 11 | | | | | 7522 |
| HPV45 | E1 | PATLYAHI | 250 | 8 | | | | | 7523 |
| HPV45 | E1 | PATLYAHIQCL | 250 | 11 | | | | | 7524 |
| HPV45 | E1 | PILLTSNI | 554 | 8 | | | | | 7525 |
| HPV45 | E1 | PILLTSNIDPA | 554 | 11 | | | | | 7526 |
| HPV45 | E1 | PISIDRKHKPL | 537 | 11 | | | | | 7527 |
| HPV45 | E1 | PIVQFLRYQGV | 434 | 11 | | | | | 7528 |
| HPV45 | E1 | PLADTKVA | 505 | 8 | | | | | 7529 |
| HPV45 | E1 | PLADTKVAM | 505 | 9 | | | | | 7530 |
| HPV45 | E1 | PLADTKVAML | 505 | 10 | | | | | 7531 |
| HPV45 | E1 | PLGEQLSV | 98 | 8 | | | | | 7532 |
| HPV45 | E1 | PLGEQLSVDT | 98 | 10 | | | | | 7533 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E1 | PLLQLKCPPI | 546 | 10 | | | | | 7534 |
| HPV45 | E1 | PLLQLKCPPIL | 546 | 11 | | | | | 7535 |
| HPV45 | E1 | PTVAEGFKT | 238 | 9 | | | | | 7536 |
| HPV45 | E1 | PTVAEGFKTL | 238 | 10 | | | | | 7537 |
| HPV45 | E1 | PTVAEGFKTLI | 238 | 11 | | | | | 7538 |
| HPV45 | E1 | QAEQETAQA | 60 | 9 | | | | | 7539 |
| HPV45 | E1 | QAEQETAQAL | 60 | 10 | | | | | 7540 |
| HPV45 | E1 | QAKYLKDCA | 391 | 9 | | | | | 7541 |
| HPV45 | E1 | QAKYLKDCAV | 391 | 10 | | | | | 7542 |
| HPV45 | E1 | QAKYLKDCAVM | 391 | 11 | | | | | 7543 |
| HPV45 | E1 | QALFHAQEV | 67 | 9 | 0.0002 | | | | 7544 |
| HPV45 | E1 | QASNKKAA | 192 | 8 | | | | | 7545 |
| HPV45 | E1 | QASNKKAAM | 192 | 9 | | | | | 7546 |
| HPV45 | E1 | QASNKKAAML | 192 | 10 | | | | | 7547 |
| HPV45 | E1 | QASNKKAAMLA | 192 | 11 | | | | | 7548 |
| HPV45 | E1 | QLADCNSNA | 374 | 9 | | | | | 7549 |
| HPV45 | E1 | QLADCNCNAA | 374 | 10 | | | | | 7550 |
| HPV45 | E1 | QLADCNSNAAA | 374 | 11 | | | | | 7551 |
| HPV45 | E1 | QLKCPPIL | 549 | 8 | | | | | 7552 |
| HPV45 | E1 | QLKCPPILL | 549 | 9 | 0.0003 | | | | 7553 |
| HPV45 | E1 | QLKCPPILLT | 549 | 10 | | | | | 7554 |
| HPV45 | E1 | QLSICEQA | 54 | 8 | | | | | 7555 |
| HPV45 | E1 | QLSVDTDL | 102 | 8 | | | | | 7556 |
| HPV45 | E1 | QMNMSQWI | 412 | 8 | | | | | 7557 |
| HPV45 | E1 | QVLHLLRKFA | 80 | 11 | | | | | 7558 |
| HPV45 | E1 | QVTVNTNA | 148 | 8 | | | | | 7559 |
| HPV45 | E1 | RALKEFLKGT | 451 | 10 | | | | | 7560 |
| HPV45 | E1 | RAQKRQMNM | 407 | 9 | | | | | 7561 |
| HPV45 | E1 | RLDLHEDDEDA | 612 | 11 | | | | | 7562 |
| HPV45 | E1 | RLTIIQHGI | 335 | 9 | | | | | 7563 |
| HPV45 | E1 | RLTVAKGL | 280 | 8 | | | | | 7564 |
| HPV45 | E1 | RLTVAKGLST | 280 | 10 | | | | | 7565 |
| HPV45 | E1 | RLTVAKGLSTL | 280 | 11 | | | | | 7566 |
| HPV45 | E1 | RQMNMSQWI | 411 | 9 | | | | | 7567 |
| HPV45 | E1 | RTGISNISEV | 316 | 10 | | | | | 7568 |
| HPV45 | E1 | RTWSRLDL | 608 | 8 | | | | | 7569 |
| HPV45 | E1 | RVTVFTFPHA | 575 | 10 | | | | | 7570 |
| HPV45 | E1 | SICEQAEQET | 56 | 10 | | | | | 7571 |
| HPV45 | E1 | SICEQAEQETA | 56 | 11 | | | | | 7572 |
| HPV45 | E1 | SIDRKHKPL | 539 | 9 | | | | | 7573 |
| HPV45 | E1 | SIDRKHKPLL | 539 | 10 | | | | | 7574 |
| HPV45 | E1 | SITELKEL | 183 | 8 | | | | | 7575 |
| HPV45 | E1 | SITELKELL | 183 | 9 | | | | | 7576 |
| HPV45 | E1 | SITELKELLQA | 183 | 11 | | | | | 7577 |
| HPV45 | E1 | SLNSGHKKA | 117 | 9 | | | | | 7578 |
| HPV45 | E1 | SQWIKYRCSKI | 416 | 11 | | | | | 7579 |
| HPV45 | E1 | STLLHVPET | 288 | 9 | | | | | 7580 |
| HPV45 | E1 | STLLHVPETCM | 288 | 11 | | | | | 7581 |
| HPV45 | E1 | SVAALYWYRT | 308 | 10 | | | | | 7582 |
| HPV45 | E1 | SVDTDLSPRL | 104 | 10 | | | | | 7583 |
| HPV45 | E1 | TAQALFHA | 65 | 8 | | | | | 7584 |
| HPV45 | E1 | TAQALFHAQEV | 65 | 11 | | | | | 7585 |
| HPV45 | E1 | TATDTGSDM | 39 | 9 | | | | | 7586 |
| HPV45 | E1 | TATDTGSDMV | 39 | 10 | | | | | 7587 |
| HPV45 | E1 | TIVEKKTGDV | 22 | 10 | | | | | 7588 |
| HPV45 | E1 | TIVEKKTGDVI | 22 | 11 | | | | | 7589 |
| HPV45 | E1 | TLIKPATL | 246 | 8 | | | | | 7590 |
| HPV45 | E1 | TLIKPATLYA | 246 | 10 | | | | | 7591 |
| HPV45 | E1 | TLLHVPET | 289 | 8 | | | | | 7592 |
| HPV45 | E1 | TLLHVPETCM | 289 | 10 | | | | | 7593 |
| HPV45 | E1 | TLLHVPETCML | 289 | 11 | | | | | 7594 |
| HPV45 | E1 | TLYAHIQCL | 252 | 9 | | | | | 7595 |
| HPV45 | E1 | TQLSICEQA | 53 | 9 | | | | | 7596 |
| HPV45 | E1 | TQVTVNTNA | 147 | 9 | | | | | 7597 |
| HPV45 | E1 | TTCTDWVW | 224 | 8 | | | | | 7598 |
| HPV45 | E1 | TTCTDWVMA | 224 | 9 | | | | | 7599 |
| HPV45 | E1 | TTCTDWVMAI | 224 | 10 | | | | | 7600 |
| HPV45 | E1 | TVAEGFKT | 239 | 8 | | | | | 7601 |
| HPV45 | E1 | TVAEGFKTL | 239 | 9 | | | | | 7602 |
| HPV45 | E1 | TVAEGFKTLI | 239 | 10 | | | | | 7603 |
| HPV45 | E1 | TVAKGLST | 282 | 8 | | | | | 7604 |
| HPV45 | E1 | TVAKGLSTL | 282 | 9 | | | | | 7605 |
| HPV45 | E1 | TVAKGLSTLL | 282 | 10 | | | | | 7606 |
| HPV45 | E1 | TVFTFPHA | 577 | 8 | | | | | 7607 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E1 | VAALYWYRT | 309 | 9 | | | | | 7608 |
| HPV45 | E1 | VAALYWYRTGI | 309 | 11 | | | | | 7609 |
| HPV45 | E1 | VAEGFKTL | 240 | 8 | | | | | 7610 |
| HPV45 | E1 | VAEGFKTLI | 240 | 9 | | | | | 7611 |
| HPV45 | E1 | VAKGLSTL | 283 | 8 | | | | | 7612 |
| HPV45 | E1 | VAKGLSTLL | 283 | 9 | | | | | 7613 |
| HPV45 | E1 | VAKGLSTLLHV | 283 | 11 | | | | | 7614 |
| HPV45 | E1 | VAMLDDAT | 511 | 8 | | | | | 7615 |
| HPV45 | E1 | VAMLDDATHT | 511 | 10 | | | | | 7616 |
| HPV45 | E1 | VISDDEDET | 31 | 9 | | | | | 7617 |
| HPV45 | E1 | VISDDEDETA | 31 | 10 | | | | | 7618 |
| HPV45 | E1 | VISDDEDETAT | 31 | 11 | | | | | 7619 |
| HPV45 | E1 | VLHLLKRKFA | 81 | 10 | | | | | 7620 |
| HPV45 | E1 | VMAIFGVNPT | 230 | 10 | | | | | 7621 |
| HPV45 | E1 | VMAIFGVNPTV | 230 | 11 | | | | | 7622 |
| HPV45 | E1 | VMCRHYKRA | 400 | 9 | | | | | 7623 |
| HPV45 | E1 | VQFLRYQGV | 436 | 9 | | | | | 7624 |
| HPV45 | E1 | VQNDAQVL | 75 | 8 | | | | | 7625 |
| HPV45 | E1 | VQNDAQVLHL | 75 | 10 | | | | | 7626 |
| HPV45 | E1 | VQNDAQVLHLL | 75 | 11 | | | | | 7627 |
| HPV45 | E1 | VQWAFDNDL | 354 | 9 | | | | | 7628 |
| HPV45 | E1 | VQWAFDNDLT | 354 | 10 | | | | | 7629 |
| HPV45 | E1 | VTGQNTRPL | 635 | 9 | | | | | 7630 |
| HPV45 | E1 | VTVFTFPHA | 576 | 9 | | | | | 7631 |
| HPV45 | E1 | WAFDNDLT | 356 | 8 | | | | | 7632 |
| HPV45 | E1 | WIKYRCSKI | 418 | 9 | | | | | 7633 |
| HPV45 | E1 | WIQRLTII | 332 | 8 | | | | | 7634 |
| HPV45 | E1 | WLEPLADT | 502 | 8 | | | | | 7635 |
| HPV45 | E1 | WLEPLADTKV | 502 | 10 | | | | | 7636 |
| HPV45 | E1 | WLEPLADTKVA | 502 | 11 | | | | | 7637 |
| HPV45 | E1 | WTYFDNYM | 522 | 8 | | | | | 7638 |
| HPV45 | E1 | WTYFDNYMRNA | 522 | 11 | | | | | 7639 |
| HPV45 | E1 | WVMAIFGV | 229 | 8 | | | | | 7640 |
| HPV45 | E1 | WVMAIFGVNPT | 229 | 11 | | | | | 7641 |
| HPV45 | E1 | YAQLADCNSNA | 372 | 11 | | | | | 7642 |
| HPV45 | E1 | YLESRVTV | 571 | 8 | | | | | 7643 |
| HPV45 | E1 | YLESRVTVFT | 571 | 10 | | | | | 7644 |
| HPV45 | E1 | YLKDCAVM | 394 | 8 | | | | | 7645 |
| HPV45 | E1 | YMRNALDGNPI | 528 | 11 | | | | | 7646 |
| HPV45 | E1 | YQGVEFISFL | 441 | 10 | | | | | 7647 |
| HPV45 | E2 | AACVSYWGV | 156 | 9 | | | | | 7648 |
| HPV45 | E2 | AIELQMAL | 78 | 8 | | | | | 7649 |
| HPV45 | E2 | AIELQMALKGL | 78 | 11 | | | | | 7650 |
| HPV45 | E2 | AILFTAREHGI | 47 | 11 | | | | | 7651 |
| HPV45 | E2 | AQSKYNNEEWT | 89 | 11 | | | | | 7652 |
| HPV45 | E2 | ATKRPRQCGL | 247 | 10 | | | | | 7653 |
| HPV45 | E2 | ATKRPRQCGLT | 247 | 11 | | | | | 7654 |
| HPV45 | E2 | ATQIVRQL | 216 | 8 | | | | | 7655 |
| HPV45 | E2 | ATQIVRQLQHA | 216 | 11 | | | | | 7656 |
| HPV45 | E2 | CLRYRLRKYA | 305 | 10 | | | | | 7657 |
| HPV45 | E2 | CMNYVVWDSI | 134 | 10 | | | | | 7658 |
| HPV45 | E2 | CVSYWGVYYI | 158 | 10 | | | | | 7659 |
| HPV45 | E2 | DINSQISYWQL | 31 | 11 | | | | | 7660 |
| HPV45 | E2 | DTCEELWNT | 102 | 9 | | | | | 7661 |
| HPV45 | E2 | DTVSATQI | 212 | 8 | | | | | 7662 |
| HPV45 | E2 | DTVSATQIV | 212 | 9 | | | | | 7663 |
| HPV45 | E2 | DVVTIPNSV | 351 | 9 | | | | | 7664 |
| HPV45 | E2 | DVVTIPNSVQI | 351 | 11 | | | | | 7665 |
| HPV45 | E2 | EISSTWHWT | 319 | 9 | | | | | 7666 |
| HPV45 | E2 | ELQMALKGL | 80 | 9 | | | | | 7667 |
| HPV45 | E2 | ELQMALKGLA | 80 | 10 | | | | | 7668 |
| HPV45 | E2 | EQHHGRVNT | 258 | 9 | | | | | 7669 |
| HPV45 | E2 | EQHHGRVNTHV | 258 | 11 | | | | | 7670 |
| HPV45 | E2 | ETGIWDKT | 148 | 8 | | | | | 7671 |
| HPV45 | E2 | ETGIWDKTA | 148 | 9 | | | | | 7672 |
| HPV45 | E2 | ETGIWDKTAA | 148 | 10 | | | | | 7673 |
| HPV45 | E2 | EVQRNTFL | 343 | 8 | | | | | 7674 |
| HPV45 | E2 | EVQRNTFLDV | 343 | 10 | | | | | 7675 |
| HPV45 | E2 | EVQRNTFLDVV | 343 | 11 | | | | | 7676 |
| HPV45 | E2 | EVQYGGNV | 192 | 8 | | | | | 7677 |
| HPV45 | E2 | EVQYGGNVI | 192 | 9 | | | | | 7678 |
| HPV45 | E2 | FLDVVTIPNSV | 349 | 11 | | | | | 7679 |
| HPV45 | E2 | FTAREHGI | 50 | 8 | | | | | 7680 |
| HPV45 | E2 | FTAREHGIT | 50 | 9 | | | | | 7681 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E2 | FTAREHGITKL | 50 | 11 | | | | | 7682 |
| HPV45 | E2 | GILTVTYNSEV | 334 | 11 | | | | | 7683 |
| HPV45 | E2 | GITKLNHQV | 56 | 9 | | | | | 7684 |
| HPV45 | E2 | GITKLNHQVV | 56 | 10 | | | | | 7685 |
| HPV45 | E2 | GIWDKTAA | 150 | 8 | | | | | 7686 |
| HPV45 | E2 | GIWDKTAACV | 150 | 10 | | | | | 7687 |
| HPV45 | E2 | GLTEQHHGRV | 255 | 10 | | | | | 7688 |
| HPV45 | E2 | GTPKPHIQT | 237 | 9 | | | | | 7689 |
| HPV45 | E2 | GTPKPHIQTPA | 237 | 11 | | | | | 7690 |
| HPV45 | E2 | GVYYIKDGDT | 163 | 10 | | | | | 7691 |
| HPV45 | E2 | GVYYIKDGDTT | 163 | 11 | | | | | 7692 |
| HPV45 | E2 | HASTSTPKT | 225 | 9 | | | | | 7693 |
| HPV45 | E2 | HASTSTPKTA | 225 | 10 | | | | | 7694 |
| HPV45 | E2 | HLKGDKNSL | 295 | 9 | | | | | 7695 |
| HPV45 | E2 | HQVVPPINI | 62 | 9 | | | | | 7696 |
| HPV45 | E2 | HVHNPLLCSST | 267 | 11 | | | | | 7697 |
| HPV45 | E2 | IIHLKGDKNSL | 293 | 11 | | | | | 7698 |
| HPV45 | E2 | ILFTAREHGI | 48 | 10 | | | | | 7699 |
| HPV45 | E2 | ILFTAREHGIT | 48 | 11 | | | | | 7700 |
| HPV45 | E2 | ILTVTYNSEV | 335 | 10 | | | | | 7701 |
| HPV45 | E2 | ITETGIWDKT | 146 | 10 | | | | | 7702 |
| HPV45 | E2 | ITETGIWDKTA | 146 | 11 | | | | | 7703 |
| HPV45 | E2 | ITKLNHQV | 57 | 8 | | | | | 7704 |
| HPV45 | E2 | ITKLNHQVV | 57 | 9 | | | | | 7705 |
| HPV45 | E2 | IVRQLQHA | 219 | 8 | | | | | 7706 |
| HPV45 | E2 | IVRQLQHAST | 219 | 10 | | | | | 7707 |
| HPV45 | E2 | KAHKAIEL | 74 | 8 | | | | | 7708 |
| HPV45 | E2 | KAHKAIELQM | 74 | 10 | | | | | 7709 |
| HPV45 | E2 | KAHKAIELQMA | 74 | 11 | | | | | 7710 |
| HPV45 | E2 | KAIELQMA | 77 | 8 | | | | | 7711 |
| HPV45 | E2 | KAIELQMAL | 77 | 9 | | | | | 7712 |
| HPV45 | E2 | KLNHQVVPPI | 59 | 10 | | | | | 7713 |
| HPV45 | E2 | KMQTPKESL | 2 | 9 | | | | | 7714 |
| HPV45 | E2 | KTAACVSYWGV | 154 | 11 | | | | | 7715 |
| HPV45 | E2 | KVCSGNTT | 284 | 8 | | | | | 7716 |
| HPV45 | E2 | KVCSGNTTPI | 284 | 10 | | | | | 7717 |
| HPV45 | E2 | KVCSGNTTPII | 284 | 11 | | | | | 7718 |
| HPV45 | E2 | LIRLENAI | 41 | 8 | | | | | 7719 |
| HPV45 | E2 | LIRLENAIL | 41 | 9 | | | | | 7720 |
| HPV45 | E2 | LIRLENAILFT | 41 | 11 | | | | | 7721 |
| HPV45 | E2 | LQDTCEEL | 100 | 8 | | | | | 7722 |
| HPV45 | E2 | LQDTCEELWNT | 100 | 11 | | | | | 7723 |
| HPV45 | E2 | LQHASTST | 223 | 8 | | | | | 7724 |
| HPV45 | E2 | LQHASTSTPKT | 223 | 11 | | | | | 7725 |
| HPV45 | E2 | LQMALKGL | 81 | 8 | | | | | 7726 |
| HPV45 | E2 | LQMALKGLA | 81 | 9 | | | | | 7727 |
| HPV45 | E2 | LTEQHHGRV | 256 | 9 | | | | | 7728 |
| HPV45 | E2 | LTEQHHGRVNT | 256 | 11 | | | | | 7729 |
| HPV45 | E2 | LTVTYNSEV | 336 | 9 | | | | | 7730 |
| HPV45 | E2 | MQTPKESL | 3 | 8 | | | | | 7731 |
| HPV45 | E2 | NISKSKAHKA | 69 | 10 | | | | | 7732 |
| HPV45 | E2 | NISKSKAHKAI | 69 | 11 | | | | | 7733 |
| HPV45 | E2 | NTFLDVVT | 347 | 8 | | | | | 7734 |
| HPV45 | E2 | NTFLDVVTI | 347 | 9 | | | | | 7735 |
| HPV45 | E2 | NTGILTVT | 332 | 8 | | | | | 7736 |
| HPV45 | E2 | NTHVHNPL | 265 | 8 | | | | | 7737 |
| HPV45 | E2 | NTHVHNPLL | 265 | 9 | | | | | 7738 |
| HPV45 | E2 | NTTPIIHL | 289 | 8 | | | | | 7739 |
| HPV45 | E2 | NTWEVQYGGNV | 189 | 11 | | | | | 7740 |
| HPV45 | E2 | NVIDCNDSM | 198 | 9 | | | | | 7741 |
| HPV45 | E2 | PATKRPRQCGL | 246 | 11 | | | | | 7742 |
| HPV45 | E2 | PINISKSKA | 67 | 9 | | | | | 7743 |
| HPV45 | E2 | QISVGYMT | 360 | 8 | | | | | 7744 |
| HPV45 | E2 | QISVGYMTI | 360 | 9 | | | | | 7745 |
| HPV45 | E2 | QISYWQLI | 35 | 8 | | | | | 7746 |
| HPV45 | E2 | QISYWQLIRL | 35 | 10 | | | | | 7747 |
| HPV45 | E2 | QIVRQLQHA | 218 | 9 | | | | | 7748 |
| HPV45 | E2 | QIVRQLQHAST | 218 | 11 | | | | | 7749 |
| HPV45 | E2 | QLIRLENA | 40 | 8 | | | | | 7750 |
| HPV45 | E2 | QLIRLENAI | 40 | 9 | | | | | 7751 |
| HPV45 | E2 | QLIRLENAIL | 40 | 10 | | | | | 7752 |
| HPV45 | E2 | QLQHASTST | 222 | 9 | | | | | 7753 |
| HPV45 | E2 | QMALKGLA | 82 | 8 | | | | | 7754 |
| HPV45 | E2 | QTPKESLSERL | 4 | 11 | | | | | 7755 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E2 | QVVPPINI | 63 | 8 | | | | | 7756 |
| HPV45 | E2 | RLENAILFT | 43 | 9 | | | | | 7757 |
| HPV45 | E2 | RLENAILFTA | 43 | 10 | | | | | 7758 |
| HPV45 | E2 | RLSALQDKI | 13 | 9 | | | | | 7759 |
| HPV45 | E2 | RLSALQDKIL | 13 | 10 | | | | | 7760 |
| HPV45 | E2 | RQLQHAST | 221 | 8 | | | | | 7761 |
| HPV45 | E2 | RQLQHASTST | 221 | 10 | | | | | 7762 |
| HPV45 | E2 | RVNTHVHNPL | 263 | 10 | | | | | 7763 |
| HPV45 | E2 | RVNTHVHNPLL | 263 | 11 | | | | | 7764 |
| HPV45 | E2 | SALQDKIL | 15 | 8 | | | | | 7765 |
| HPV45 | E2 | SATQIVRQL | 215 | 9 | | | | | 7766 |
| HPV45 | E2 | SIYYITET | 142 | 8 | | | | | 7767 |
| HPV45 | E2 | SIYYITETGI | 142 | 10 | | | | | 7768 |
| HPV45 | E2 | SLKCLRYRL | 302 | 9 | | | | | 7769 |
| HPV45 | E2 | SLSERLSA | 9 | 8 | | | | | 7770 |
| HPV45 | E2 | SLSERLSAL | 9 | 9 | | | | | 7771 |
| HPV45 | E2 | SMCSTSDDT | 205 | 9 | | | | | 7772 |
| HPV45 | E2 | SMCSTSDDTV | 205 | 10 | | | | | 7773 |
| HPV45 | E2 | SQCFKKGGKT | 113 | 10 | | | | | 7774 |
| HPV45 | E2 | SQCFKKGGKTV | 113 | 11 | | | | | 7775 |
| HPV45 | E2 | SQISYWQL | 34 | 8 | | | | | 7776 |
| HPV45 | E2 | SQISYWQLI | 34 | 9 | | | | | 7777 |
| HPV45 | E2 | SQISYWQLIRL | 34 | 11 | | | | | 7778 |
| HPV45 | E2 | STPKTASV | 229 | 8 | | | | | 7779 |
| HPV45 | E2 | STPKTASVGT | 229 | 10 | | | | | 7780 |
| HPV45 | E2 | STSDDTVSA | 208 | 9 | | | | | 7781 |
| HPV45 | E2 | STSDDTVSAT | 208 | 10 | | | | | 7782 |
| HPV45 | E2 | STSNNKRRKV | 276 | 10 | | | | | 7783 |
| HPV45 | E2 | STSTPKTA | 227 | 8 | | | | | 7784 |
| HPV45 | E2 | STSTPKTASV | 227 | 10 | | | | | 7785 |
| HPV45 | E2 | SVGTPKPHI | 235 | 9 | | | | | 7786 |
| HPV45 | E2 | SVGTPKPHIQT | 235 | 11 | | | | | 7787 |
| HPV45 | E2 | SVQISVGYM | 358 | 9 | | | | | 7788 |
| HPV45 | E2 | SVQISVGYMT | 358 | 10 | | | | | 7789 |
| HPV45 | E2 | SVQISVGYMTI | 358 | 11 | | | | | 7790 |
| HPV45 | E2 | TAACVSYWGV | 155 | 10 | | | | | 7791 |
| HPV45 | E2 | TAREHGIT | 51 | 8 | | | | | 7792 |
| HPV45 | E2 | TAREHGITKL | 51 | 10 | | | | | 7793 |
| HPV45 | E2 | TASVGTPKPHI | 233 | 11 | | | | | 7794 |
| HPV45 | E2 | TIPNSVQI | 354 | 8 | | | | | 7795 |
| HPV45 | E2 | TIPNSVQISV | 354 | 10 | | | | | 7796 |
| HPV45 | E2 | TLQDTCEEL | 99 | 9 | | | | | 7797 |
| HPV45 | E2 | TQIVRQLQHA | 217 | 10 | | | | | 7798 |
| HPV45 | E2 | TVSATQIV | 213 | 8 | | | | | 7799 |
| HPV45 | E2 | TVSATQIVRQL | 213 | 11 | | | | | 7800 |
| HPV45 | E2 | TVTYNSEV | 337 | 8 | | | | | 7801 |
| HPV45 | E2 | VIDCNDSM | 199 | 8 | | | | | 7802 |
| HPV45 | E2 | VIDCNDSMCST | 199 | 11 | | | | | 7803 |
| HPV45 | E2 | VQISVGYM | 359 | 8 | | | | | 7804 |
| HPV45 | E2 | VQISVGYMT | 359 | 9 | | | | | 7805 |
| HPV45 | E2 | VQISVGYMTI | 359 | 10 | | | | | 7806 |
| HPV45 | E2 | VQRNTFLDV | 344 | 9 | | | | | 7807 |
| HPV45 | E2 | VQRNTFLDVV | 344 | 10 | | | | | 7808 |
| HPV45 | E2 | VQRNTFLDVVT | 344 | 11 | | | | | 7809 |
| HPV45 | E2 | VQYGGNVI | 193 | 8 | | | | | 7810 |
| HPV45 | E2 | VTIPNSVQI | 353 | 9 | | | | | 7811 |
| HPV45 | E2 | VTIPNSVQISV | 353 | 11 | | | | | 7812 |
| HPV45 | E2 | VTYNSEVQRNT | 338 | 11 | | | | | 7813 |
| HPV45 | E2 | VVTIPNSV | 352 | 8 | | | | | 7814 |
| HPV45 | E2 | VVTIPNSVQI | 352 | 10 | | | | | 7815 |
| HPV45 | E2 | VVWDSIYYI | 138 | 9 | | | | | 7816 |
| HPV45 | E2 | VVWDSIYYIT | 138 | 10 | | | | | 7817 |
| HPV45 | E2 | WQLIRLENA | 39 | 9 | | | | | 7818 |
| HPV45 | E2 | WQLIRLENAI | 39 | 10 | | | | | 7819 |
| HPV45 | E2 | WQLIRLENAIL | 39 | 11 | | | | | 7820 |
| HPV45 | E2 | WTGCNKNT | 326 | 8 | | | | | 7821 |
| HPV45 | E2 | WTGCNKNTGI | 326 | 10 | | | | | 7822 |
| HPV45 | E2 | WTGCNKNTGIL | 326 | 11 | | | | | 7823 |
| HPV45 | E2 | WTLQDTCEEL | 98 | 10 | | | | | 7824 |
| HPV45 | E2 | YADHYSEI | 313 | 8 | | | | | 7825 |
| HPV45 | E2 | YADHYSEISST | 313 | 11 | | | | | 7826 |
| HPV45 | E2 | YIKDGDTT | 166 | 8 | | | | | 7827 |
| HPV45 | E2 | YIKDGDTTYYV | 166 | 11 | | | | | 7828 |
| HPV45 | E2 | YITETGIWDKT | 145 | 11 | | | | | 7829 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E2 | YVVWDSIYYI | 137 | 10 | | | | | 7830 |
| HPV45 | E2 | YVVWDSIYYIT | 137 | 11 | | | | | 7831 |
| HPV45 | E6 | ATLERTEV | 37 | 8 | | | | | 7832 |
| HPV45 | E6 | CIAYAACHKCI | 59 | 11 | | | | | 7833 |
| HPV45 | E6 | CIDFYSRI | 68 | 8 | 0.0001 | | | | 7834 |
| HPV45 | E6 | CIDFYSRIREL | 68 | 11 | | | | | 7835 |
| HPV45 | E6 | CLRCQKPL | 105 | 8 | 0.0001 | | | | 7836 |
| HPV45 | E6 | CLRCQKPLNPA | 105 | 11 | | | | | 7837 |
| HPV45 | E6 | CQKPLNPA | 108 | 8 | | | | | 7838 |
| HPV45 | E6 | CTELNTSL | 18 | 8 | | | | | 7839 |
| HPV45 | E6 | CTELNTSLQDV | 18 | 11 | | | | | 7840 |
| HPV45 | E6 | CVYCKATL | 32 | 8 | | | | | 7841 |
| HPV45 | E6 | CVYCKATLERT | 32 | 11 | | | | | 7842 |
| HPV45 | E6 | DLCTELNT | 16 | 8 | | | | | 7843 |
| HPV45 | E6 | DLCTELNTSL | 16 | 10 | 0.0001 | | | | 7844 |
| HPV45 | E6 | DLFIVYRDCI | 51 | 10 | | | | | 7845 |
| HPV45 | E6 | DLFIVYRDCIA | 51 | 11 | | | | | 7846 |
| HPV45 | E6 | DQARQERL | 143 | 8 | | | | | 7847 |
| HPV45 | E6 | DVSIACVYCKA | 27 | 11 | | | | | 7848 |
| HPV45 | E6 | ELNTSLQDV | 20 | 9 | | | | | 7849 |
| HPV45 | E6 | ELNTSLQDVSI | 20 | 11 | | | | | 7850 |
| HPV45 | E6 | ELRYYSNSV | 77 | 9 | | | | | 7851 |
| HPV45 | E6 | ELYNLLIRCL | 97 | 10 | | | | | 7852 |
| HPV45 | E6 | ETLEKITNT | 88 | 9 | | | | | 7853 |
| HPV45 | E6 | ETLEKITNTEL | 88 | 11 | | | | | 7854 |
| HPV45 | E6 | EVYQFAFKDL | 43 | 10 | | | | | 7855 |
| HPV45 | E6 | FAFKDLFI | 47 | 8 | | | | | 7856 |
| HPV45 | E6 | FAFKDLFIV | 47 | 9 | | | | | 7857 |
| HPV45 | E6 | FIVYRDCI | 53 | 8 | | | | | 7858 |
| HPV45 | E6 | FIVYRDCIA | 53 | 9 | | | | | 7859 |
| HPV45 | E6 | FIVYRDCIAYA | 53 | 11 | | | | | 7860 |
| HPV45 | E6 | GQCNTCCDQA | 136 | 10 | | | | | 7861 |
| HPV45 | E6 | GQYRGQCNT | 132 | 9 | | | | | 7862 |
| HPV45 | E6 | HLKDKRRFHSI | 120 | 11 | | | | | 7863 |
| HPV45 | E6 | IACVYCKA | 30 | 8 | | | | | 7864 |
| HPV45 | E6 | IACVYCKAT | 30 | 9 | | | | | 7865 |
| HPV45 | E6 | IACVYCKATL | 30 | 10 | | | | | 7866 |
| HPV45 | E6 | IAGQYRGQCNT | 130 | 11 | | | | | 7867 |
| HPV45 | E6 | IAYAACHKCI | 60 | 10 | | | | | 7868 |
| HPV45 | E6 | ITNTELYNL | 93 | 9 | | | | | 7869 |
| HPV45 | E6 | ITNTELYNLL | 93 | 10 | | | | | 7870 |
| HPV45 | E6 | ITNTELYNLLI | 93 | 11 | | | | | 7871 |
| HPV45 | E6 | IVYRDCIA | 54 | 8 | | | | | 7872 |
| HPV45 | E6 | IVYRDCIAYA | 54 | 10 | | | | | 7873 |
| HPV45 | E6 | IVYRDCIAYAA | 54 | 11 | | | | | 7874 |
| HPV45 | E6 | KATLERTEV | 36 | 9 | | | | | 7875 |
| HPV45 | E6 | KITNTELYNL | 92 | 10 | | | | | 7876 |
| HPV45 | E6 | KITNTELYNLL | 92 | 11 | | | | | 7877 |
| HPV45 | E6 | KLPDLCTEL | 13 | 9 | 0.0035 | | | | 7878 |
| HPV45 | E6 | KLPDLCTELNT | 13 | 11 | | | | | 7879 |
| HPV45 | E6 | LIRCLRCQKPL | 102 | 11 | | | | | 7880 |
| HPV45 | E6 | LQDVSIACV | 25 | 9 | | | | | 7881 |
| HPV45 | E6 | MARFDDPT | 1 | 8 | | | | | 7882 |
| HPV45 | E6 | NTELYNLL | 95 | 8 | | | | | 7883 |
| HPV45 | E6 | NTELYNLLI | 95 | 9 | | | | | 7884 |
| HPV45 | E6 | NTSLQDVSI | 22 | 9 | | | | | 7885 |
| HPV45 | E6 | NTSLQDVSIA | 22 | 10 | | | | | 7886 |
| HPV45 | E6 | PAEKRRHL | 114 | 8 | | | | | 7887 |
| HPV45 | E6 | PLNPAEKRRHL | 111 | 11 | | | | | 7888 |
| HPV45 | E6 | PTQRPYKL | 7 | 8 | | | | | 7889 |
| HPV45 | E6 | PTQRPYKLPDL | 7 | 11 | | | | | 7890 |
| HPV45 | E6 | RLRRRRET | 149 | 8 | | | | | 7891 |
| HPV45 | E6 | RLRRRRETQV | 149 | 10 | | | | | 7892 |
| HPV45 | E6 | RQERLRRRRET | 146 | 11 | | | | | 7893 |
| HPV45 | E6 | RTEVYQFA | 41 | 8 | | | | | 7894 |
| HPV45 | E6 | SIACVYCKA | 29 | 9 | | | | | 7895 |
| HPV45 | E6 | SIACVYCKAT | 29 | 10 | | | | | 7896 |
| HPV45 | E6 | SIACVYCKATL | 29 | 11 | | | | | 7897 |
| HPV45 | E6 | SLQDVSIA | 24 | 8 | | | | | 7898 |
| HPV45 | E6 | SLQDVSIACV | 24 | 10 | | | | | 7899 |
| HPV45 | E6 | SVYGETLEKI | 84 | 10 | | | | | 7900 |
| HPV45 | E6 | SVYGETLEKIT | 84 | 11 | | | | | 7901 |
| HPV45 | E6 | TLEKITNT | 89 | 8 | | | | | 7902 |
| HPV45 | E6 | TLEKITNTEL | 89 | 10 | | | | | 7903 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | E6 | TLERTEVYQFA | 38 | 11 | | | | | 7904 |
| HPV45 | E6 | TQRPYKLPDL | 8 | 10 | | | | | 7905 |
| HPV45 | E6 | YAACHKCI | 62 | 8 | | | | | 7906 |
| HPV45 | E6 | YQFAFKDL | 45 | 8 | | | | | 7907 |
| HPV45 | E6 | YQFAFKDLFI | 45 | 10 | | | | | 7908 |
| HPV45 | E6 | YQFAFKDLFIV | 45 | 11 | | | | | 7909 |
| HPV45 | E7 | AQLPARRA | 48 | 8 | | | | | 7910 |
| HPV45 | E7 | ATLQEIVL | 6 | 8 | | | | | 7911 |
| HPV45 | E7 | ATLQEIVLHL | 6 | 10 | | | | | 7912 |
| HPV45 | E7 | CVCCKCDGRI | 64 | 10 | | | | | 7913 |
| HPV45 | E7 | DLLCYEQL | 25 | 8 | | | | | 7914 |
| HPV45 | E7 | DLRTLQQL | 83 | 8 | | | | | 7915 |
| HPV45 | E7 | DLRTLQQLFL | 83 | 10 | | | | | 7916 |
| HPV45 | E7 | EADGVSHA | 41 | 8 | | | | | 7917 |
| HPV45 | E7 | EADGVSHAQL | 41 | 10 | | | | | 7918 |
| HPV45 | E7 | ELDPVDLL | 20 | 8 | | | | | 7919 |
| HPV45 | E7 | ELTVESSA | 74 | 8 | | | | | 7920 |
| HPV45 | E7 | ELTVESSADDL | 74 | 11 | | | | | 7921 |
| HPV45 | E7 | FLSTLSFV | 91 | 8 | | | | | 7922 |
| HPV45 | E7 | FVCPWCAT | 97 | 8 | | | | | 7923 |
| HPV45 | E7 | GVSHAQLPA | 44 | 9 | | | | | 7924 |
| HPV45 | E7 | HAQLPARRA | 47 | 9 | | | | | 7925 |
| HPV45 | E7 | HLEPQNEL | 14 | 8 | | | | | 7926 |
| HPV45 | E7 | HLEPQNELDPV | 14 | 11 | | | | | 7927 |
| HPV45 | E7 | IVLHLEPQNEL | 11 | 11 | | | | | 7928 |
| HPV45 | E7 | LQEIVLHL | 8 | 8 | | | | | 7929 |
| HPV45 | E7 | LQQLFLST | 87 | 8 | | | | | 7930 |
| HPV45 | E7 | LQQLFLSTL | 87 | 9 | | | | | 7931 |
| HPV45 | E7 | LTVESSADDL | 75 | 10 | | | | | 7932 |
| HPV45 | E7 | PQNELDPV | 17 | 8 | | | | | 7933 |
| HPV45 | E7 | PQNELDPVDL | 17 | 10 | | | | | 7934 |
| HPV45 | E7 | PQNELDPVDLL | 17 | 11 | | | | | 7935 |
| HPV45 | E7 | PQRHKILCV | 57 | 9 | | | | | 7936 |
| HPV45 | E7 | PVDLLCYEQL | 23 | 10 | | | | | 7937 |
| HPV45 | E7 | QLFLSTLSFV | 89 | 10 | | | | | 7938 |
| HPV45 | E7 | QQLFLSTL | 88 | 8 | | | | | 7939 |
| HPV45 | E7 | QQLFLSTLSFV | 88 | 11 | | | | | 7940 |
| HPV45 | E7 | RAEPQRHKI | 54 | 9 | | | | | 7941 |
| HPV45 | E7 | RAEPQRHKIL | 54 | 10 | | | | | 7942 |
| HPV45 | E7 | RATLQEIV | 5 | 8 | | | | | 7943 |
| HPV45 | E7 | RATLQEIVL | 5 | 9 | | | | | 7944 |
| HPV45 | E7 | RATLQEIVLHL | 5 | 11 | | | | | 7945 |
| HPV45 | E7 | RIELTVESSA | 72 | 10 | | | | | 7946 |
| HPV45 | E7 | RTLQQLFL | 85 | 8 | | | | | 7947 |
| HPV45 | E7 | RTLQQLFLST | 85 | 10 | | | | | 7948 |
| HPV45 | E7 | RTLQQLFLSTL | 85 | 11 | | | | | 7949 |
| HPV45 | E7 | SADDLRTL | 80 | 8 | | | | | 7950 |
| HPV45 | E7 | SADDLRTLQQL | 80 | 11 | | | | | 7951 |
| HPV45 | E7 | STLSFVCPWCA | 93 | 11 | | | | | 7952 |
| HPV45 | E7 | TLQEIVLHL | 7 | 9 | | | | | 7953 |
| HPV45 | E7 | TLQQLFLST | 86 | 9 | | | | | 7954 |
| HPV45 | E7 | TLQQLFLSTL | 86 | 10 | | | | | 7955 |
| HPV45 | E7 | TLSFVCPWCA | 94 | 10 | 0.0027 | | | | 7956 |
| HPV45 | E7 | TLSFVCPWCAT | 94 | 11 | | | | | 7957 |
| HPV45 | E7 | TVESSADDL | 76 | 9 | | | | | 7958 |
| HPV45 | E7 | TVESSADDLRT | 76 | 11 | | | | | 7959 |
| HPV45 | E7 | VLHLEPQNEL | 12 | 10 | | | | | 7960 |
| HPV45 | L1 | AASTSTASRPA | 517 | 11 | | | | | 7961 |
| HPV45 | L1 | AATAVITQDV | 161 | 10 | | | | | 7962 |
| HPV45 | L1 | AIGEHWAKGT | 191 | 10 | | | | | 7963 |
| HPV45 | L1 | AIGEHWAKGTL | 191 | 11 | | | | | 7964 |
| HPV45 | L1 | ALPDPNKFGL | 103 | 10 | | | | | 7965 |
| HPV45 | L1 | ALWRPSDST | 28 | 9 | | | | | 7966 |
| HPV45 | L1 | ALWRPSDSTV | 28 | 10 | | | | | 7967 |
| HPV45 | L1 | AMDFSTLQDT | 234 | 10 | | | | | 7968 |
| HPV45 | L1 | AQGHNNGI | 345 | 8 | | | | | 7969 |
| HPV45 | L1 | AQLQPGDCPPL | 205 | 11 | | | | | 7970 |
| HPV45 | L1 | ATAVITQDV | 162 | 9 | | | | | 7971 |
| HPV45 | L1 | AVITQDVRDNV | 164 | 11 | | | | | 7972 |
| HPV45 | L1 | AVTCQKDT | 455 | 8 | | | | | 7973 |
| HPV45 | L1 | AVTCQKDTT | 455 | 9 | | | | | 7974 |
| HPV45 | L1 | CASTQNPV | 374 | 8 | | | | | 7975 |
| HPV45 | L1 | CASTQNPVPNT | 374 | 11 | | | | | 7976 |
| HPV45 | L1 | CILGCVPA | 184 | 8 | | | | | 7977 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | L1 | CILGCVPAI | 184 | 9 | | | | | 7978 |
| HPV45 | L1 | CLRREQLFA | 276 | 9 | | | | | 7979 |
| HPV45 | L1 | CQSICKYPDYL | 252 | 11 | | | | | 7980 |
| HPV45 | L1 | CTITLTAEV | 409 | 9 | | | | | 7981 |
| HPV45 | L1 | CTITLTAEVM | 409 | 10 | | | | | 7982 |
| HPV45 | L1 | CVPAIGEHWA | 188 | 10 | | | | | 7983 |
| HPV45 | L1 | CVYSPSPSGSI | 318 | 11 | | | | | 7984 |
| HPV45 | L1 | DLKEKFSSDL | 480 | 10 | | | | | 7985 |
| HPV45 | L1 | DLQFIFQL | 401 | 8 | | | | | 7986 |
| HPV45 | L1 | DLQFIFQLCT | 401 | 10 | | | | | 7987 |
| HPV45 | L1 | DLQFIFQLCTI | 401 | 11 | | | | | 7988 |
| HPV45 | L1 | DLYIKGTSA | 301 | 9 | | | | | 7989 |
| HPV45 | L1 | DLYIKGTSANM | 301 | 11 | | | | | 7990 |
| HPV45 | L1 | DMVDTGYGA | 226 | 9 | | | | | 7991 |
| HPV45 | L1 | DMVDTGYGAM | 226 | 10 | | | | | 7992 |
| HPV45 | L1 | DQYPLGRKFL | 490 | 10 | | | | | 7993 |
| HPV45 | L1 | DQYPLGRKFLV | 490 | 11 | | | | | 7994 |
| HPV45 | L1 | DTESAHAA | 155 | 8 | | | | | 7995 |
| HPV45 | L1 | DTESAHAAT | 155 | 9 | | | | | 7996 |
| HPV45 | L1 | DTESAHAATA | 155 | 10 | | | | | 7997 |
| HPV45 | L1 | DTESAHAATAV | 155 | 11 | | | | | 7998 |
| HPV45 | L1 | DTGYGAMDFST | 229 | 11 | | | | | 7999 |
| HPV45 | L1 | DTKCEVPL | 242 | 8 | | | | | 8000 |
| HPV45 | L1 | DTKCEVPLDI | 242 | 10 | | | | | 8001 |
| HPV45 | L1 | DTTRSTNL | 364 | 8 | | | | | 8002 |
| HPV45 | L1 | DTTRSTNLT | 364 | 9 | | | | | 8003 |
| HPV45 | L1 | DTTRSTNLTL | 364 | 10 | | | | | 8004 |
| HPV45 | L1 | DTVPTDLYI | 296 | 9 | | | | | 8005 |
| HPV45 | L1 | DTYRFVQSV | 446 | 9 | | | | | 8006 |
| HPV45 | L1 | DTYRFVQSVA | 446 | 10 | | | | | 8007 |
| HPV45 | L1 | DTYRFVQSVAV | 446 | 11 | | | | | 8008 |
| HPV45 | L1 | DVRDNVSV | 169 | 8 | | | | | 8009 |
| HPV45 | L1 | EIGRGQPL | 133 | 8 | | | | | 8010 |
| HPV45 | L1 | EIGRGQPLGI | 133 | 10 | | | | | 8011 |
| HPV45 | L1 | ETQRLVWA | 121 | 8 | | | | | 8012 |
| HPV45 | L1 | ETQRLVWACV | 121 | 10 | | | | | 8013 |
| HPV45 | L1 | EVMSYIHSM | 416 | 9 | | | | | 8014 |
| HPV45 | L1 | EVPLDICQSI | 246 | 10 | | | | | 8015 |
| HPV45 | L1 | FARHFWNRA | 283 | 9 | | | | | 8016 |
| HPV45 | L1 | FARHFWNRAGV | 283 | 11 | | | | | 8017 |
| HPV45 | L1 | FIFQLCTI | 404 | 8 | | | | | 8018 |
| HPV45 | L1 | FIFQLCTIT | 404 | 9 | | | | | 8019 |
| HPV45 | L1 | FIFQLCTITL | 404 | 10 | | | | | 8020 |
| HPV45 | L1 | FIFQLCTITLT | 404 | 11 | | | | | 8021 |
| HPV45 | L1 | FLKNVNVFPI | 14 | 10 | | | | | 8022 |
| HPV45 | L1 | FQLCTITL | 406 | 8 | | | | | 8023 |
| HPV45 | L1 | FQLCTITLT | 406 | 9 | | | | | 8024 |
| HPV45 | L1 | FQLCTITLTA | 406 | 10 | | | | | 8025 |
| HPV45 | L1 | FVQSVAVT | 450 | 8 | | | | | 8026 |
| HPV45 | L1 | FVTVVDTT | 359 | 8 | | | | | 8027 |
| HPV45 | L1 | FVTVVDTTRST | 359 | 11 | | | | | 8028 |
| HPV45 | L1 | GAGNKQAV | 82 | 8 | | | | | 8029 |
| HPV45 | L1 | GAGNKQAVPKV | 82 | 11 | | | | | 8030 |
| HPV45 | L1 | GAMDFSTL | 233 | 8 | | | | | 8031 |
| HPV45 | L1 | GAMDFSTLQDT | 233 | 11 | | | | | 8032 |
| HPV45 | L1 | GICWHNQL | 351 | 8 | | | | | 8033 |
| HPV45 | L1 | GICWHNQLFV | 351 | 10 | | | | | 8034 |
| HPV45 | L1 | GICWHNQLFVT | 351 | 11 | | | | | 8035 |
| HPV45 | L1 | GIIIFLKNV | 10 | 9 | | | | | 8036 |
| HPV45 | L1 | GIIIFLKNVNV | 10 | 11 | | | | | 8037 |
| HPV45 | L1 | GLRRRPTI | 503 | 8 | | | | | 8038 |
| HPV45 | L1 | GLSGHPFYNKL | 143 | 11 | | | | | 8039 |
| HPV45 | L1 | GMEIGRGQPL | 131 | 10 | | | | | 8040 |
| HPV45 | L1 | GQPLGIGL | 137 | 8 | | | | | 8041 |
| HPV45 | L1 | GTLCKPAQL | 199 | 9 | | | | | 8042 |
| HPV45 | L1 | GTSANMRET | 306 | 9 | | | | | 8043 |
| HPV45 | L1 | GVMGDTVPT | 292 | 9 | | | | | 8044 |
| HPV45 | L1 | GVMGDTVPTDL | 292 | 11 | | | | | 8045 |
| HPV45 | L1 | GVPPPPTT | 435 | 8 | | | | | 8046 |
| HPV45 | L1 | GVPPPPTTSL | 435 | 10 | | | | | 8047 |
| HPV45 | L1 | GVPPPPTTSLV | 435 | 11 | | | | | 8048 |
| HPV45 | L1 | HAATAVIT | 160 | 8 | | | | | 8049 |
| HPV45 | L1 | HAATAVITQDV | 160 | 11 | | | | | 8050 |
| HPV45 | L1 | HAGSSRLL | 62 | 8 | | | | | 8051 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | L1 | HAGSSRLLT | 62 | 9 | | | | | 8052 |
| HPV45 | L1 | HAGSSRLLTV | 62 | 10 | | | | | 8053 |
| HPV45 | L1 | HVEEYDLQFI | 396 | 10 | | | | | 8054 |
| HPV45 | L1 | IIEDGDMV | 221 | 8 | | | | | 8055 |
| HPV45 | L1 | IIEDGDMVDT | 221 | 10 | | | | | 8056 |
| HPV45 | L1 | IIFLKNVNV | 12 | 9 | | | | | 8057 |
| HPV45 | L1 | IIIFLKNV | 11 | 8 | | | | | 8058 |
| HPV45 | L1 | IIIFLKNVNV | 11 | 10 | | | | | 8059 |
| HPV45 | L1 | IIYGHGII | 5 | 8 | | | | | 8060 |
| HPV45 | L1 | IIYGHGIII | 5 | 9 | | | | | 8061 |
| HPV45 | L1 | IIYGHGIIIFL | 5 | 11 | | | | | 8062 |
| HPV45 | L1 | ILENWNFGV | 428 | 9 | | | | | 8063 |
| HPV45 | L1 | ILGCVPAI | 185 | 8 | | | | | 8064 |
| HPV45 | L1 | ITLTAEVM | 411 | 8 | | | | | 8065 |
| HPV45 | L1 | ITLTAEVMSYI | 411 | 11 | | | | | 8066 |
| HPV45 | L1 | ITQDVRDNV | 166 | 9 | | | | | 8067 |
| HPV45 | L1 | ITQDVRDNVSV | 166 | 11 | | | | | 8068 |
| HPV45 | L1 | ITTSDSQL | 328 | 8 | | | | | 8069 |
| HPV45 | L1 | KAQGHNNGI | 344 | 9 | | | | | 8070 |
| HPV45 | L1 | KLDDTESA | 152 | 8 | | | | | 8071 |
| HPV45 | L1 | KLDDTESAHA | 152 | 10 | | | | | 8072 |
| HPV45 | L1 | KLDDTESAHAA | 152 | 11 | | | | | 8073 |
| HPV45 | L1 | KLKFWTVDL | 473 | 9 | | | | | 8074 |
| HPV45 | L1 | KQAVPKVSA | 86 | 9 | | | | | 8075 |
| HPV45 | L1 | KQDPYDKL | 467 | 8 | | | | | 8076 |
| HPV45 | L1 | KQTQLCIL | 179 | 8 | | | | | 8077 |
| HPV45 | L1 | KQTQLCILGCV | 179 | 11 | | | | | 8078 |
| HPV45 | L1 | KVSAYQYRV | 91 | 9 | | | | | 8079 |
| HPV45 | L1 | LLTVGNPYFRV | 68 | 11 | | | | | 8080 |
| HPV45 | L1 | LQDTKCEV | 240 | 8 | | | | | 8081 |
| HPV45 | L1 | LQDTKCEVPL | 240 | 10 | | | | | 8082 |
| HPV45 | L1 | LQFIFQLCT | 402 | 9 | | | | | 8083 |
| HPV45 | L1 | LQFIFQLCTI | 402 | 10 | | | | | 8084 |
| HPV45 | L1 | LQFIFQLCTIT | 402 | 11 | | | | | 8085 |
| HPV45 | L1 | LQPGDCPPL | 207 | 9 | | | | | 8086 |
| HPV45 | L1 | LQPGDCPPLEL | 207 | 11 | | | | | 8087 |
| HPV45 | L1 | LTAEVMSYI | 413 | 9 | | | | | 8088 |
| HPV45 | L1 | LTLCASTQNPV | 371 | 11 | | | | | 8089 |
| HPV45 | L1 | LTVGNPYFRV | 69 | 10 | | | | | 8090 |
| HPV45 | L1 | LTVGNPYFRVV | 69 | 11 | | | | | 8091 |
| HPV45 | L1 | LVDTYRFV | 444 | 8 | | | | | 8092 |
| HPV45 | L1 | LVDTYRFVQSV | 444 | 11 | | | | | 8093 |
| HPV45 | L1 | LVQAGLRRRPT | 499 | 11 | | | | | 8094 |
| HPV45 | L1 | LVWACVGM | 125 | 8 | | | | | 8095 |
| HPV45 | L1 | LVWACVGMEI | 125 | 10 | | | | | 8096 |
| HPV45 | L1 | MAHNIIYGHGI | 1 | 11 | | | | | 8097 |
| HPV45 | L1 | MALWRPSDST | 27 | 10 | | | | | 8098 |
| HPV45 | L1 | MALWRPSDSTV | 27 | 11 | | | | | 8099 |
| HPV45 | L1 | MVDTGYGA | 227 | 8 | | | | | 8100 |
| HPV45 | L1 | MVDTGYGAM | 227 | 9 | | | | | 8101 |
| HPV45 | L1 | NIIYGHGI | 4 | 8 | | | | | 8102 |
| HPV45 | L1 | NIIYGHGII | 4 | 9 | | | | | 8103 |
| HPV45 | L1 | NIIYGHGIII | 4 | 10 | | | | | 8104 |
| HPV45 | L1 | NLTLCAST | 370 | 8 | | | | | 8105 |
| HPV45 | L1 | NMRETPGSCV | 310 | 10 | | | | | 8106 |
| HPV45 | L1 | NQLFVTVV | 356 | 8 | | | | | 8107 |
| HPV45 | L1 | NQLFVTVVDT | 356 | 10 | | | | | 8108 |
| HPV45 | L1 | NQLFVTVVDTT | 356 | 11 | | | | | 8109 |
| HPV45 | L1 | NTDDYVSRT | 49 | 9 | | | | | 8110 |
| HPV45 | L1 | NTDDYVSRTSI | 49 | 11 | | | | | 8111 |
| HPV45 | L1 | NTIIEDGDM | 219 | 9 | | | | | 8112 |
| HPV45 | L1 | NTIIEDGDMV | 219 | 10 | | | | | 8113 |
| HPV45 | L1 | NVFPIFLQM | 19 | 9 | | | | | 8114 |
| HPV45 | L1 | NVFPIFLQMA | 19 | 10 | | | | | 8115 |
| HPV45 | L1 | NVFPIFLQMAL | 19 | 11 | | | | | 8116 |
| HPV45 | L1 | NVNVFPIFL | 17 | 9 | | | | | 8117 |
| HPV45 | L1 | NVNVFPIFLQM | 17 | 11 | | | | | 8118 |
| HPV45 | L1 | NVSVDYKQT | 173 | 9 | | | | | 8119 |
| HPV45 | L1 | NVSVDYKQTQL | 173 | 11 | | | | | 8120 |
| HPV45 | L1 | PAASTSTA | 516 | 8 | | | | | 8121 |
| HPV45 | L1 | PAIGEHWA | 190 | 8 | | | | | 8122 |
| HPV45 | L1 | PAIGEHWAKGT | 190 | 11 | | | | | 8123 |
| HPV45 | L1 | PIFLQMAL | 22 | 8 | | | | | 8124 |
| HPV45 | L1 | PLDICQSI | 248 | 8 | | | | | 8125 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | L1 | PLELKNTI | 214 | 8 | | | | | 8126 |
| HPV45 | L1 | PLELKNTII | 214 | 9 | | | | | 8127 |
| HPV45 | L1 | PLGRKFLV | 493 | 8 | | | | | 8128 |
| HPV45 | L1 | PLGRKFLVQA | 493 | 10 | | | | | 8129 |
| HPV45 | L1 | PTDLYIKGT | 299 | 9 | | | | | 8130 |
| HPV45 | L1 | PTDLYIKGTSA | 299 | 11 | | | | | 8131 |
| HPV45 | L1 | PTIGPRKRPA | 508 | 10 | | | | | 8132 |
| HPV45 | L1 | PTIGPRKRPAA | 508 | 11 | | | | | 8133 |
| HPV45 | L1 | PTKFKHYSRHV | 387 | 11 | | | | | 8134 |
| HPV45 | L1 | PTTSLVDT | 440 | 8 | | | | | 8135 |
| HPV45 | L1 | PVPNTYDPT | 380 | 9 | | | | | 8136 |
| HPV45 | L1 | QAGLRRRPT | 501 | 9 | | | | | 8137 |
| HPV45 | L1 | QAGLRRRPTI | 501 | 10 | | | | | 8138 |
| HPV45 | L1 | QAVPKVSA | 87 | 8 | | | | | 8139 |
| HPV45 | L1 | QLCILGCV | 182 | 8 | | | | | 8140 |
| HPV45 | L1 | QLCILGCVPA | 182 | 10 | | | | | 8141 |
| HPV45 | L1 | QLCILGCVPAI | 182 | 11 | | | | | 8142 |
| HPV45 | L1 | QLCTITLT | 407 | 8 | | | | | 8143 |
| HPV45 | L1 | QLCTITLTA | 407 | 9 | | | | | 8144 |
| HPV45 | L1 | QLCTITLTAEV | 407 | 11 | | | | | 8145 |
| HPV45 | L1 | QLFARHFWNRA | 281 | 11 | | | | | 8146 |
| HPV45 | L1 | QLFNKPYWL | 334 | 9 | | | | | 8147 |
| HPV45 | L1 | QLFVTVVDT | 357 | 9 | | | | | 8148 |
| HPV45 | L1 | QLFVTVVDTT | 357 | 10 | | | | | 8149 |
| HPV45 | L1 | QLQPGDCPPL | 206 | 10 | | | | | 8150 |
| HPV45 | L1 | QMALWRPSDST | 26 | 11 | | | | | 8151 |
| HPV45 | L1 | QMSADPYGDSM | 263 | 11 | | | | | 8152 |
| HPV45 | L1 | QTQLCILGCV | 180 | 10 | | | | | 8153 |
| HPV45 | L1 | RAGVMGDT | 290 | 8 | | | | | 8154 |
| HPV45 | L1 | RAGVMGDTV | 290 | 9 | | | | | 8155 |
| HPV45 | L1 | RAGVMGDTVPT | 290 | 11 | | | | | 8156 |
| HPV45 | L1 | RLVWACVGM | 124 | 9 | | | | | 8157 |
| HPV45 | L1 | RLVWACVGMEI | 124 | 11 | | | | | 8158 |
| HPV45 | L1 | RTSIFYHA | 56 | 8 | | | | | 8159 |
| HPV45 | L1 | RVVNTDDYV | 46 | 9 | | | | | 8160 |
| HPV45 | L1 | SADPYGDSM | 265 | 9 | | | | | 8161 |
| HPV45 | L1 | SAHAATAV | 158 | 8 | | | | | 8162 |
| HPV45 | L1 | SAHAATAVI | 158 | 9 | | | | | 8163 |
| HPV45 | L1 | SAHAATAVIT | 158 | 10 | | | | | 8164 |
| HPV45 | L1 | SAYQYRVFRV | 93 | 10 | | | | | 8165 |
| HPV45 | L1 | SAYQYRVFRVA | 93 | 11 | | | | | 8166 |
| HPV45 | L1 | SICKYPDYL | 254 | 9 | | | | | 8167 |
| HPV45 | L1 | SICKYPDYLQM | 254 | 11 | | | | | 8168 |
| HPV45 | L1 | SIFYHAGSSRL | 58 | 11 | | | | | 8169 |
| HPV45 | L1 | SILENWNFGV | 427 | 10 | | | | | 8170 |
| HPV45 | L1 | SITTSDSQL | 327 | 9 | | | | | 8171 |
| HPV45 | L1 | SLVDTYRFV | 443 | 9 | | | | | 8172 |
| HPV45 | L1 | SMFFCLRREQL | 272 | 11 | | | | | 8173 |
| HPV45 | L1 | SQLFNKPYWL | 333 | 10 | | | | | 8174 |
| HPV45 | L1 | STASRPAKRV | 521 | 10 | | | | | 8175 |
| HPV45 | L1 | STIYNPET | 115 | 8 | | | | | 8176 |
| HPV45 | L1 | STIYNPETQRL | 115 | 11 | | | | | 8177 |
| HPV45 | L1 | STLQDTKCEV | 238 | 10 | | | | | 8178 |
| HPV45 | L1 | STNLTLCA | 368 | 8 | | | | | 8179 |
| HPV45 | L1 | STNLTLCAST | 368 | 10 | | | | | 8180 |
| HPV45 | L1 | STQNPVPNT | 376 | 9 | | | | | 8181 |
| HPV45 | L1 | STSTASRPA | 519 | 9 | | | | | 8182 |
| HPV45 | L1 | STVYLPPPSV | 35 | 10 | | | | | 8183 |
| HPV45 | L1 | STVYLPPPSVA | 35 | 11 | | | | | 8184 |
| HPV45 | L1 | SVARVVNT | 43 | 8 | | | | | 8185 |
| HPV45 | L1 | SVAVTCQKDT | 453 | 10 | | | | | 8186 |
| HPV45 | L1 | SVAVTCQKDTT | 453 | 11 | | | | | 8187 |
| HPV45 | L1 | SVDYKQTQL | 175 | 9 | | | | | 8188 |
| HPV45 | L1 | SVDYKQTQLCI | 175 | 11 | | | | | 8189 |
| HPV45 | L1 | TAEVMSYI | 414 | 8 | | | | | 8190 |
| HPV45 | L1 | TAEVMSYIHSM | 414 | 11 | | | | | 8191 |
| HPV45 | L1 | TASRPAKRV | 522 | 9 | | | | | 8192 |
| HPV45 | L1 | TASRPAKRVRI | 522 | 11 | | | | | 8193 |
| HPV45 | L1 | TAVITQDV | 163 | 8 | | | | | 8194 |
| HPV45 | L1 | TIGPRKRPA | 509 | 9 | | | | | 8195 |
| HPV45 | L1 | TIGPRKRPAA | 509 | 10 | | | | | 8196 |
| HPV45 | L1 | TIIEDGDM | 220 | 8 | | | | | 8197 |
| HPV45 | L1 | TIIEDGDMV | 220 | 9 | | | | | 8198 |
| HPV45 | L1 | TIIEDGDMVDT | 220 | 11 | | | | | 8199 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | L1 | TITLTAEV | 410 | 8 | | | | | 8200 |
| HPV45 | L1 | TITLTAEVM | 410 | 9 | | | | | 8201 |
| HPV45 | L1 | TIYNPETQRL | 116 | 10 | | | | | 8202 |
| HPV45 | L1 | TIYNPETQRLV | 116 | 11 | | | | | 8203 |
| HPV45 | L1 | TLCASTQNPV | 372 | 10 | | | | | 8204 |
| HPV45 | L1 | TLCKPAQL | 200 | 8 | | | | | 8205 |
| HPV45 | L1 | TLQDTKCEV | 239 | 9 | | | | | 8206 |
| HPV45 | L1 | TLQDTKCEVPL | 239 | 11 | | | | | 8207 |
| HPV45 | L1 | TLTAEVMSYI | 412 | 10 | | | | | 8208 |
| HPV45 | L1 | TQDVRDNV | 167 | 8 | | | | | 8209 |
| HPV45 | L1 | TQDVRDNVSV | 167 | 10 | | | | | 8210 |
| HPV45 | L1 | TQLCILGCV | 181 | 9 | | | | | 8211 |
| HPV45 | L1 | TQLCILGCVPA | 181 | 11 | | | | | 8212 |
| HPV45 | L1 | TQNPVPNT | 377 | 8 | | | | | 8213 |
| HPV45 | L1 | TQRLVWACV | 122 | 9 | | | | | 8214 |
| HPV45 | L1 | TQRLVWACVGM | 122 | 11 | | | | | 8215 |
| HPV45 | L1 | TTRSTNLT | 365 | 8 | | | | | 8216 |
| HPV45 | L1 | TTRSTNLTL | 365 | 9 | | | | | 8217 |
| HPV45 | L1 | TTRSTNLTLCA | 365 | 11 | | | | | 8218 |
| HPV45 | L1 | TTSLVDTYRFV | 441 | 11 | | | | | 8219 |
| HPV45 | L1 | TVGNPYFRV | 70 | 9 | | | | | 8220 |
| HPV45 | L1 | TVGNPYFRVV | 70 | 10 | | | | | 8221 |
| HPV45 | L1 | TVPTDLYI | 297 | 8 | | | | | 8222 |
| HPV45 | L1 | TVPTDLYIKGT | 297 | 11 | | | | | 8223 |
| HPV45 | L1 | TVVDTTRST | 361 | 9 | | | | | 8224 |
| HPV45 | L1 | TVVDTTRSTNL | 361 | 11 | | | | | 8225 |
| HPV45 | L1 | TVYLPPPSV | 36 | 9 | | | | | 8226 |
| HPV45 | L1 | TVYLPPPSVA | 36 | 10 | | | | | 8227 |
| HPV45 | L1 | VALPDPNKFGL | 102 | 11 | | | | | 8228 |
| HPV45 | L1 | VARVVNTDDYV | 44 | 11 | | | | | 8229 |
| HPV45 | L1 | VAVTCQKDT | 454 | 9 | | | | | 8230 |
| HPV45 | L1 | VAVTCQKDTT | 454 | 10 | | | | | 8231 |
| HPV45 | L1 | VITQDVRDNV | 165 | 10 | | | | | 8232 |
| HPV45 | L1 | VMGDTVPT | 293 | 8 | | | | | 8233 |
| HPV45 | L1 | VMGDTVPTDL | 293 | 10 | | | | | 8234 |
| HPV45 | L1 | VMSYIHSM | 417 | 8 | | | | | 8235 |
| HPV45 | L1 | VQAGLRRRPT | 500 | 10 | | | | | 8236 |
| HPV45 | L1 | VQAGLRRRPTI | 500 | 11 | | | | | 8237 |
| HPV45 | L1 | VTCQKDTT | 456 | 8 | | | | | 8238 |
| HPV45 | L1 | VTVVDTTRST | 360 | 10 | | | | | 8239 |
| HPV45 | L1 | VVDTTRST | 362 | 8 | | | | | 8240 |
| HPV45 | L1 | VVDTTRSTNL | 362 | 10 | | | | | 8241 |
| HPV45 | L1 | VVDTTRSTNLT | 362 | 11 | | | | | 8342 |
| HPV45 | L1 | VVNTDDYV | 47 | 8 | | | | | 8243 |
| HPV45 | L1 | VVNTDDYVSRT | 47 | 11 | | | | | 8244 |
| HPV45 | L1 | VVPSGAGNKQA | 78 | 11 | | | | | 8245 |
| HPV45 | L1 | WACVGMEI | 127 | 8 | | | | | 8246 |
| HPV45 | L1 | WAKGTLCKPA | 196 | 10 | | | | | 8247 |
| HPV45 | L1 | YIHSMNSSI | 420 | 9 | | | | | 8248 |
| HPV45 | L1 | YIHSMNSSIL | 420 | 10 | | | | | 8249 |
| HPV45 | L1 | YIKGTSANM | 303 | 9 | | | | | 8250 |
| HPV45 | L1 | YLPPPSVA | 38 | 8 | | | | | 8251 |
| HPV45 | L1 | YLPPPSVARV | 38 | 10 | | | | | 8252 |
| HPV45 | L1 | YLPPPSVARVV | 38 | 11 | | | | | 8253 |
| HPV45 | L1 | YQYRVFRV | 95 | 8 | | | | | 8254 |
| HPV45 | L1 | YQYRVFRVA | 95 | 9 | | | | | 8255 |
| HPV45 | L1 | YQYRVFRVAL | 95 | 10 | | | | | 8256 |
| HPV45 | L1 | YVSRTSIFYHA | 53 | 11 | | | | | 8257 |
| HPV45 | L2 | AARRKRASA | 6 | 9 | | | | | 8258 |
| HPV45 | L2 | AARRKRASAT | 6 | 10 | | | | | 8259 |
| HPV45 | L2 | AASSYSNV | 381 | 8 | | | | | 8260 |
| HPV45 | L2 | AASSYSNVT | 381 | 9 | | | | | 8261 |
| HPV45 | L2 | AASSYSNVTV | 381 | 10 | | | | | 8262 |
| HPV45 | L2 | AATEEIEL | 327 | 8 | | | | | 8263 |
| HPV45 | L2 | AATEEIELQPL | 327 | 11 | | | | | 8264 |
| HPV45 | L2 | ALSSRRGT | 286 | 8 | | | | | 8265 |
| HPV45 | L2 | ALSSRRGTV | 286 | 9 | | | | | 8266 |
| HPV45 | L2 | ATEEIELQPL | 328 | 10 | | | | | 8267 |
| HPV45 | L2 | ATEEIELQPLI | 328 | 11 | | | | | 8268 |
| HPV45 | L2 | ATMFTRSGKQI | 303 | 11 | | | | | 8269 |
| HPV45 | L2 | ATNDSDLFDV | 340 | 10 | | | | | 8270 |
| HPV45 | L2 | AVLDITPT | 139 | 8 | | | | | 8271 |
| HPV45 | L2 | AVLDITPTV | 139 | 9 | | | | | 8272 |
| HPV45 | L2 | DIILPSHT | 405 | 8 | | | | | 8273 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | L2 | DIILPSHTPM | 405 | 10 | | | | | 8274 |
| HPV45 | L2 | DIIRLHRPA | 278 | 9 | | | | | 8275 |
| HPV45 | L2 | DIIRLHRPAL | 278 | 10 | | | | | 8276 |
| HPV45 | L2 | DISPIAAT | 322 | 8 | | | | | 8277 |
| HPV45 | L2 | DISPIAATEEI | 322 | 11 | | | | | 8278 |
| HPV45 | L2 | DITPTVDSV | 142 | 9 | | | | | 8279 |
| HPV45 | L2 | DITPTVDSVSI | 142 | 11 | | | | | 8280 |
| HPV45 | L2 | DLYRTCKQSGT | 16 | 11 | | | | | 8281 |
| HPV45 | L2 | DTTLSFEPT | 260 | 9 | | | | | 8282 |
| HPV45 | L2 | DVGPTRPPV | 83 | 9 | | | | | 8283 |
| HPV45 | L2 | DVGPTRPPVV | 83 | 10 | | | | | 8284 |
| HPV45 | L2 | DVGPTRPPVVI | 83 | 11 | | | | | 8285 |
| HPV45 | L2 | DVINKVEGT | 30 | 9 | | | | | 8286 |
| HPV45 | L2 | DVINKVEGTT | 30 | 10 | | | | | 8287 |
| HPV45 | L2 | DVINKVEGTTL | 30 | 11 | | | | | 8288 |
| HPV45 | L2 | DVPIYTGPDI | 397 | 10 | | | | | 8289 |
| HPV45 | L2 | DVPIYTGPDII | 397 | 11 | | | | | 8390 |
| HPV45 | L2 | DVYADFPPPA | 348 | 10 | | | | | 8291 |
| HPV45 | L2 | EIELQPLI | 331 | 8 | | | | | 8292 |
| HPV45 | L2 | EIELQPLISA | 331 | 10 | | | | | 8293 |
| HPV45 | L2 | EIELQPLISAT | 331 | 11 | | | | | 8294 |
| HPV45 | L2 | EIPLQTFA | 194 | 8 | | | | | 8295 |
| HPV45 | L2 | EITSSGTT | 129 | 8 | | | | | 8296 |
| HPV45 | L2 | EITSSGTTT | 129 | 9 | | | | | 8297 |
| HPV45 | L2 | EITSSGTTTPA | 129 | 11 | | | | | 8298 |
| HPV45 | L2 | ELQPLISA | 333 | 8 | | | | | 8299 |
| HPV45 | L2 | ELQPLISAT | 333 | 9 | | | | | 8300 |
| HPV45 | L2 | EVPQTGEV | 169 | 8 | | | | | 8301 |
| HPV45 | L2 | EVSGNIFV | 175 | 8 | | | | | 8302 |
| HPV45 | L2 | EVSGNIFVGT | 175 | 10 | | | | | 8303 |
| HPV45 | L2 | FADGFVAA | 456 | 8 | | | | | 8304 |
| HPV45 | L2 | FASSGSGT | 200 | 8 | | | | | 8305 |
| HPV45 | L2 | FASSGSGTEPI | 200 | 11 | | | | | 8306 |
| HPV45 | L2 | FLGGLGIGT | 53 | 9 | | | | | 8307 |
| HPV45 | L2 | FLTHPSSL | 241 | 8 | | | | | 8308 |
| HPV45 | L2 | FLTHPSSLV | 241 | 9 | | | | | 8309 |
| HPV45 | L2 | FLTHPSSLVT | 241 | 10 | | | | | 8310 |
| HPV45 | L2 | FMDIIRLHRPA | 276 | 11 | | | | | 8311 |
| HPV45 | L2 | FTGTSGFEI | 122 | 9 | | | | | 8312 |
| HPV45 | L2 | FTGTSGFEIT | 122 | 10 | | | | | 8313 |
| HPV45 | L2 | FTNPAFSDPSI | 157 | 11 | | | | | 8314 |
| HPV45 | L2 | FTRSGKQI | 306 | 8 | | | | | 8315 |
| HPV45 | L2 | FTYPKYSL | 368 | 8 | | | | | 8316 |
| HPV45 | L2 | FTYPKYSLT | 368 | 9 | | | | | 8317 |
| HPV45 | L2 | FTYPKYSLTM | 368 | 10 | | | | | 8318 |
| HPV45 | L2 | GAPVPTFT | 116 | 8 | | | | | 8319 |
| HPV45 | L2 | GAPVPTFTGT | 116 | 10 | | | | | 8320 |
| HPV45 | L2 | GIFLGGLGI | 51 | 9 | | | | | 8321 |
| HPV45 | L2 | GIFLGGLGIGT | 51 | 11 | | | | | 8322 |
| HPV45 | L2 | GIHGTQYYL | 430 | 9 | | | | | 8323 |
| HPV45 | L2 | GQRATMFT | 300 | 8 | | | | | 8324 |
| HPV45 | L2 | GTCPPDVI | 25 | 8 | | | | | 8325 |
| HPV45 | L2 | GTCPPDVINKV | 25 | 11 | | | | | 8326 |
| HPV45 | L2 | GTEPISST | 206 | 8 | | | | | 8327 |
| HPV45 | L2 | GTEPISSTPL | 206 | 10 | | | | | 8328 |
| HPV45 | L2 | GTGSGSGGRT | 60 | 10 | | | | | 8329 |
| HPV45 | L2 | GTSGFEIT | 124 | 8 | | | | | 8330 |
| HPV45 | L2 | GTTLADKI | 37 | 8 | | | | | 8331 |
| HPV45 | L2 | GTTLADKIL | 37 | 9 | | | | | 8332 |
| HPV45 | L2 | GTTTPAVL | 134 | 8 | | | | | 8333 |
| HPV45 | L2 | GTTTPAVLDI | 134 | 10 | | | | | 8334 |
| HPV45 | L2 | GTTTPAVLDIT | 134 | 11 | | | | | 8335 |
| HPV45 | L2 | GTVRFSRL | 292 | 8 | | | | | 8336 |
| HPV45 | L2 | HTPMWPST | 411 | 8 | | | | | 8337 |
| HPV45 | L2 | HTPMWPSTSPT | 411 | 11 | | | | | 8338 |
| HPV45 | L2 | IAATEEIEL | 326 | 9 | | | | | 8339 |
| HPV45 | L2 | IIEVPQTGEV | 167 | 10 | | | | | 8340 |
| HPV45 | L2 | IILPSHTPM | 406 | 9 | | | | | 8341 |
| HPV45 | L2 | IIRLHRPA | 279 | 8 | | | | | 8342 |
| HPV45 | L2 | IIRLHRPAL | 279 | 9 | | | | | 8343 |
| HPV45 | L2 | ILPSHTPM | 407 | 8 | | | | | 8344 |
| HPV45 | L2 | ILQWSSLGI | 44 | 9 | | | | | 8345 |
| HPV45 | L2 | ILQWSSLGIFL | 44 | 11 | | | | | 8346 |
| HPV45 | L2 | ITPTVDSV | 143 | 8 | | | | | 8347 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | L2 | ITPTVDSVSI | 143 | 10 | | | | | 8348 |
| HPV45 | L2 | ITSSGTTT | 130 | 8 | | | | | 8349 |
| HPV45 | L2 | ITSSGTTTPA | 130 | 10 | | | | | 8350 |
| HPV45 | L2 | ITSSGTTTPAV | 130 | 11 | | | | | 8351 |
| HPV45 | L2 | IVTLVEDSSV | 103 | 10 | | | | | 8352 |
| HPV45 | L2 | IVTLVEDSSVV | 103 | 11 | | | | | 8353 |
| HPV45 | L2 | KILQWSSL | 43 | 8 | | | | | 8354 |
| HPV45 | L2 | KILQWSSLGI | 43 | 10 | | | | | 8355 |
| HPV45 | L2 | KQSGTCPPDV | 22 | 10 | | | | | 8356 |
| HPV45 | L2 | KQSGTCPPDVI | 22 | 11 | | | | | 8357 |
| HPV45 | L2 | KVEGTTLA | 34 | 8 | | | | | 8358 |
| HPV45 | L2 | KVEGTTLADKI | 34 | 11 | | | | | 8359 |
| HPV45 | L2 | LADKILQWSSL | 40 | 11 | | | | | 8360 |
| HPV45 | L2 | LISATNDSDL | 337 | 10 | | | | | 8361 |
| HPV45 | L2 | LQPLISAT | 334 | 8 | | | | | 8362 |
| HPV45 | L2 | LQTFASSGSGT | 197 | 11 | | | | | 8363 |
| HPV45 | L2 | LQWSSLGI | 45 | 8 | | | | | 8364 |
| HPV45 | L2 | LQWSSLGIFL | 45 | 10 | | | | | 8365 |
| HPV45 | L2 | LTHPSSLV | 242 | 8 | | | | | 8366 |
| HPV45 | L2 | LTHPSSLVT | 242 | 9 | | | | | 8367 |
| HPV45 | L2 | LTMPSTAA | 375 | 8 | | | | | 8368 |
| HPV45 | L2 | LTSAWDVPI | 392 | 9 | | | | | 8369 |
| HPV45 | L2 | LTSAWDVPIYT | 392 | 11 | | | | | 8370 |
| HPV45 | L2 | LVEDSSVV | 106 | 8 | | | | | 8371 |
| HPV45 | L2 | LVEDSSVVA | 106 | 9 | | | | | 8372 |
| HPV45 | L2 | LVTFDNPA | 248 | 8 | | | | | 8373 |
| HPV45 | L2 | NASTTTYI | 422 | 8 | | | | | 8374 |
| HPV45 | L2 | NASTTTYIGI | 422 | 10 | | | | | 8375 |
| HPV45 | L2 | NIFVGTPT | 179 | 8 | | | | | 8376 |
| HPV45 | L2 | NQQVRVST | 231 | 8 | | | | | 8377 |
| HPV45 | L2 | NTVVDVGPT | 79 | 9 | | | | | 8378 |
| HPV45 | L2 | NVPDSDFM | 270 | 8 | | | | | 8379 |
| HPV45 | L2 | NVPDSDFMDI | 270 | 10 | | | | | 8380 |
| HPV45 | L2 | NVPDSDFMDII | 270 | 11 | | | | | 8381 |
| HPV45 | L2 | NVTVPLTSA | 387 | 9 | | | | | 8382 |
| HPV45 | L2 | PAFSDPSI | 160 | 8 | | | | | 8383 |
| HPV45 | L2 | PAFSDPSII | 160 | 9 | | | | | 8384 |
| HPV45 | L2 | PAFSDPSIIEV | 160 | 11 | | | | | 8385 |
| HPV45 | L2 | PALSSRRGT | 285 | 9 | | | | | 8386 |
| HPV45 | L2 | PALSSRRGTV | 285 | 10 | | | | | 8387 |
| HPV45 | L2 | PASTTPST | 356 | 8 | | | | | 8388 |
| HPV45 | L2 | PASTTPSTI | 356 | 9 | | | | | 8389 |
| HPV45 | L2 | PAVLDITPT | 138 | 9 | | | | | 8390 |
| HPV45 | L2 | PAVLDITPTV | 138 | 10 | | | | | 8391 |
| HPV45 | L2 | PAYEPLDT | 254 | 8 | | | | | 8392 |
| HPV45 | L2 | PAYEPLDTT | 254 | 9 | | | | | 8393 |
| HPV45 | L2 | PAYEPLDTTL | 254 | 10 | | | | | 8394 |
| HPV45 | L2 | PIAATEEI | 325 | 8 | | | | | 8395 |
| HPV45 | L2 | PIAATEEIEL | 325 | 10 | | | | | 8396 |
| HPV45 | L2 | PISSTPLPT | 209 | 9 | | | | | 8397 |
| HPV45 | L2 | PISSTPLPTV | 209 | 10 | | | | | 8398 |
| HPV45 | L2 | PIYTGPDI | 399 | 8 | | | | | 8399 |
| HPV45 | L2 | PIYTGPDII | 399 | 9 | | | | | 8400 |
| HPV45 | L2 | PIYTGPDIIL | 399 | 10 | | | | | 8401 |
| HPV45 | L2 | PLDTTLSFEPT | 258 | 11 | | | | | 8402 |
| HPV45 | L2 | PLGGRSNT | 73 | 8 | | | | | 8403 |
| HPV45 | L2 | PLGGRSNTV | 73 | 9 | | | | | 8404 |
| HPV45 | L2 | PLGGRSNTVV | 73 | 10 | | | | | 8405 |
| HPV45 | L2 | PLISATNDSDL | 336 | 11 | | | | | 8406 |
| HPV45 | L2 | PLPTVRRV | 214 | 8 | | | | | 8407 |
| HPV45 | L2 | PLTSAWDV | 391 | 8 | | | | | 8408 |
| HPV45 | L2 | PLTSAWDVPI | 391 | 10 | | | | | 8409 |
| HPV45 | L2 | PMWPSTSPT | 413 | 9 | | | | | 8410 |
| HPV45 | L2 | PMWPSTSPTNA | 413 | 11 | | | | | 8411 |
| HPV45 | L2 | PQTGEVSGNI | 171 | 10 | | | | | 8412 |
| HPV45 | L2 | PTDPSIVT | 98 | 8 | | | | | 8413 |
| HPV45 | L2 | PTDPSIVTL | 98 | 9 | | | | | 8414 |
| HPV45 | L2 | PTDPSIVTLV | 98 | 10 | | | | | 8415 |
| HPV45 | L2 | PTFTGTSGFEI | 120 | 11 | | | | | 8416 |
| HPV45 | L2 | PTNASTTT | 420 | 8 | | | | | 8417 |
| HPV45 | L2 | PTNASTTTYI | 420 | 10 | | | | | 8418 |
| HPV45 | L2 | PTRPPVVI | 86 | 8 | | | | | 8419 |
| HPV45 | L2 | PTRPPVVIEPV | 86 | 11 | | | | | 8420 |
| HPV45 | L2 | PTSGSHGYEEI | 185 | 11 | | | | | 8421 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | L2 | PTSNVPDSDFM | 267 | 11 | | | | | 8422 |
| HPV45 | L2 | PTVDSVSI | 145 | 8 | | | | | 8423 |
| HPV45 | L2 | PTVDSVSISST | 145 | 11 | | | | | 8424 |
| HPV45 | L2 | PTVRRVRGPRL | 216 | 11 | | | | | 8425 |
| HPV45 | L2 | PVGPTDPSI | 95 | 9 | | | | | 8426 |
| HPV45 | L2 | PVGPTDPSIV | 95 | 10 | | | | | 8427 |
| HPV45 | L2 | PVGPTDPSIVT | 95 | 11 | | | | | 8428 |
| HPV45 | L2 | PVPTFTGT | 118 | 8 | | | | | 8429 |
| HPV45 | L2 | PVVIEPVGPT | 90 | 10 | | | | | 8430 |
| HPV45 | L2 | QQVRVSTSQFL | 232 | 11 | | | | | 8431 |
| HPV45 | L2 | QTFASSGSGT | 198 | 10 | | | | | 8432 |
| HPV45 | L2 | QTGEVSGNI | 172 | 9 | | | | | 8433 |
| HPV45 | L2 | QTGEVSGNIFV | 172 | 11 | | | | | 8434 |
| HPV45 | L2 | QVRVSTSQFL | 233 | 10 | | | | | 8435 |
| HPV45 | L2 | QVRVSTSQFLT | 233 | 11 | | | | | 8436 |
| HPV45 | L2 | RAARRKRA | 5 | 8 | | | | | 8437 |
| HPV45 | L2 | RAARRKRASA | 5 | 10 | | | | | 8438 |
| HPV45 | L2 | RAARRKRASAT | 5 | 11 | | | | | 8439 |
| HPV45 | L2 | RANQQVRV | 229 | 8 | | | | | 8440 |
| HPV45 | L2 | RANQQVRVST | 229 | 10 | | | | | 8441 |
| HPV45 | L2 | RASATDLYRT | 11 | 10 | | | | | 8442 |
| HPV45 | L2 | RIPYFFADGFV | 451 | 11 | | | | | 8443 |
| HPV45 | L2 | RLGQRATM | 298 | 8 | | | | | 8444 |
| HPV45 | L2 | RLGQRATMFT | 298 | 10 | | | | | 8445 |
| HPV45 | L2 | RLYSRANQQV | 225 | 10 | | | | | 8446 |
| HPV45 | L2 | RTCKQSGT | 19 | 8 | | | | | 8447 |
| HPV45 | L2 | RVHFYHDI | 316 | 8 | | | | | 8448 |
| HPV45 | L2 | RVHFYHDISPI | 316 | 11 | | | | | 8449 |
| HPV45 | L2 | RVRGPRLYSRA | 220 | 11 | | | | | 8450 |
| HPV45 | L2 | RVSTSQFL | 235 | 8 | | | | | 8451 |
| HPV45 | L2 | RVSTSQFLT | 235 | 9 | | | | | 8452 |
| HPV45 | L2 | SATDLYRT | 13 | 8 | | | | | 8453 |
| HPV45 | L2 | SATNDSDL | 339 | 8 | | | | | 8454 |
| HPV45 | L2 | SATNDSDLFDV | 339 | 11 | | | | | 8455 |
| HPV45 | L2 | SAWDVPIYT | 394 | 9 | | | | | 8456 |
| HPV45 | L2 | SIIEVPQT | 166 | 8 | | | | | 8457 |
| HPV45 | L2 | SIIEVPQTGEV | 166 | 11 | | | | | 8458 |
| HPV45 | L2 | SISSTSFT | 151 | 8 | | | | | 8459 |
| HPV45 | L2 | SISSTSFTNPA | 151 | 11 | | | | | 8460 |
| HPV45 | L2 | SIVTLVEDSSV | 102 | 11 | | | | | 8461 |
| HPV45 | L2 | SLGIFLGGL | 49 | 9 | | | | | 8462 |
| HPV45 | L2 | SLGIFLGGLGI | 49 | 11 | | | | | 8463 |
| HPV45 | L2 | SLTMPSTA | 374 | 8 | | | | | 8464 |
| HPV45 | L2 | SLTMPSTAA | 374 | 9 | | | | | 8465 |
| HPV45 | L2 | SLVTFDNPA | 247 | 9 | | | | | 8466 |
| HPV45 | L2 | SQFLTHPSSL | 239 | 10 | | | | | 8467 |
| HPV45 | L2 | SQFLTHPSSLV | 239 | 11 | | | | | 8468 |
| HPV45 | L2 | STAASSYSNV | 379 | 10 | | | | | 8469 |
| HPV45 | L2 | STAASSYSNVT | 379 | 11 | | | | | 8470 |
| HPV45 | L2 | STIHKSFT | 362 | 8 | | | | | 8471 |
| HPV45 | L2 | STPLPTVRRV | 212 | 10 | | | | | 8472 |
| HPV45 | L2 | STSFTNPA | 154 | 8 | | | | | 8473 |
| HPV45 | L2 | STSPTNAST | 417 | 9 | | | | | 8474 |
| HPV45 | L2 | STSPTNASTT | 417 | 10 | | | | | 8475 |
| HPV45 | L2 | STSPTNASTTT | 417 | 11 | | | | | 8476 |
| HPV45 | L2 | STTTYIGI | 424 | 8 | | | | | 8477 |
| HPV45 | L2 | STTTYIGIHGT | 424 | 11 | | | | | 8478 |
| HPV45 | L2 | SVSISSTSFT | 149 | 10 | | | | | 8479 |
| HPV45 | L2 | SVVASGAPV | 111 | 9 | | | | | 8480 |
| HPV45 | L2 | SVVASGAPVPT | 111 | 11 | | | | | 8481 |
| HPV45 | L2 | TAASSYSNV | 380 | 9 | | | | | 8482 |
| HPV45 | L2 | TAASSYSNVT | 380 | 10 | | | | | 8483 |
| HPV45 | L2 | TAASSYSNVTV | 380 | 11 | | | | | 8484 |
| HPV45 | L2 | TLSFEPTSNV | 262 | 10 | | | | | 8485 |
| HPV45 | L2 | TLVEDSSV | 105 | 8 | | | | | 8486 |
| HPV45 | L2 | TLVEDSSVV | 105 | 9 | | | | | 8487 |
| HPV45 | L2 | TLVEDSSVVA | 105 | 10 | | | | | 8488 |
| HPV45 | L2 | TMFTRSGKQI | 304 | 10 | | | | | 8489 |
| HPV45 | L2 | TTLADKIL | 38 | 8 | | | | | 8490 |
| HPV45 | L2 | TTLSFEPT | 261 | 8 | | | | | 8491 |
| HPV45 | L2 | TTLSFEPTSNV | 261 | 11 | | | | | 8492 |
| HPV45 | L2 | TTPAVLDI | 136 | 8 | | | | | 8493 |
| HPV45 | L2 | TTPAVLDIT | 136 | 9 | | | | | 8494 |
| HPV45 | L2 | TTPAVLDITPT | 136 | 11 | | | | | 8495 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV45 | L2 | TTPSTIHKSFT | 359 | 11 | | | | | 8496 |
| HPV45 | L2 | TTTPAVLDI | 135 | 9 | | | | | 8497 |
| HPV45 | L2 | TTTPAVLDIT | 135 | 10 | | | | | 8498 |
| HPV45 | L2 | TTTYIGIHGT | 425 | 10 | | | | | 8499 |
| HPV45 | L2 | TTYIGIHGT | 426 | 9 | | | | | 8500 |
| HPV45 | L2 | TVDSVSISST | 146 | 10 | | | | | 8501 |
| HPV45 | L2 | TVPLTSAWDV | 389 | 10 | | | | | 8502 |
| HPV45 | L2 | TVRFSRLGQRA | 293 | 11 | | | | | 8503 |
| HPV45 | L2 | TVRRVRGPRL | 217 | 10 | | | | | 8504 |
| HPV45 | L2 | TVVDVGPT | 80 | 8 | | | | | 8505 |
| HPV45 | L2 | VASGAPVPT | 113 | 9 | | | | | 8506 |
| HPV45 | L2 | VASGAPVPTFT | 113 | 11 | | | | | 8507 |
| HPV45 | L2 | VIEPVGPT | 92 | 8 | | | | | 8508 |
| HPV45 | L2 | VINKVEGT | 31 | 8 | | | | | 8509 |
| HPV45 | L2 | VINKVEGTT | 31 | 9 | | | | | 8510 |
| HPV45 | L2 | VINKVEGTTL | 31 | 10 | | | | | 8511 |
| HPV45 | L2 | VINKVEGTTLA | 31 | 11 | | | | | 8512 |
| HPV45 | L2 | VLDITPTV | 140 | 8 | | | | | 8513 |
| HPV45 | L2 | VLDITPTVDSV | 140 | 11 | | | | | 8514 |
| HPV45 | L2 | VTFDNPAYEPL | 249 | 11 | | | | | 8515 |
| HPV45 | L2 | VTLVEDSSV | 104 | 9 | | | | | 8516 |
| HPV45 | L2 | VTLVEDSSVV | 104 | 10 | | | | | 8517 |
| HPV45 | L2 | VTLVEDSSVVA | 104 | 11 | | | | | 8518 |
| HPV45 | L2 | VTVPLTSA | 388 | 8 | | | | | 8519 |
| HPV45 | L2 | VTVPLTSAWDV | 388 | 11 | | | | | 8520 |
| HPV45 | L2 | VVASGAPV | 112 | 8 | | | | | 8521 |
| HPV45 | L2 | VVASGAPVPT | 112 | 10 | | | | | 8522 |
| HPV45 | L2 | VVDVGPTRPPV | 81 | 11 | | | | | 8523 |
| HPV45 | L2 | VVIEPVGPT | 91 | 9 | | | | | 8524 |
| HPV45 | L2 | YADFPPPA | 350 | 8 | | | | | 8525 |
| HPV45 | L2 | YADFPPPAST | 350 | 10 | | | | | 8526 |
| HPV45 | L2 | YADFPPPASTT | 350 | 11 | | | | | 8527 |
| HPV45 | L2 | YIGIHGTQYYL | 428 | 11 | | | | | 8528 |
| HPV45 | L2 | YTGPDIIL | 401 | 8 | | | | | 8529 |
| HPV45 | L2 | YVPLGGRSNT | 71 | 10 | | | | | 8530 |
| HPV45 | L2 | YVPLGGRSNTV | 71 | 11 | | | | | 8531 |
| HPV56 | E2 | AIEVQIAL | 15 | 8 | | | | | 8532 |
| HPV56 | E2 | AIEVQIALESL | 15 | 11 | | | | | 8533 |
| HPV56 | E2 | ALESLSTT | 21 | 8 | | | | | 8534 |
| HPV56 | E2 | ALESLSTTI | 21 | 9 | | | | | 8535 |
| HPV56 | E2 | CLQVCKAKA | 4 | 9 | | | | | 8536 |
| HPV56 | E2 | CMQYVAWKYI | 71 | 10 | | | | | 8537 |
| HPV56 | E2 | CVTTHTHI | 204 | 8 | | | | | 8538 |
| HPV56 | E2 | CVTTHTHISDT | 204 | 11 | | | | | 8539 |
| HPV56 | E2 | DTCEELWL | 39 | 8 | | | | | 8540 |
| HPV56 | E2 | DTCEELWLT | 39 | 9 | | | | | 8541 |
| HPV56 | E2 | DVTSTYHWT | 263 | 9 | | | | | 8542 |
| HPV56 | E2 | DVTSTYHWTST | 263 | 11 | | | | | 8543 |
| HPV56 | E2 | EAKKFGCKNI | 117 | 10 | | | | | 8544 |
| HPV56 | E2 | ETQRNSFL | 288 | 8 | | | | | 8545 |
| HPV56 | E2 | ETQRNSFLSHV | 288 | 11 | | | | | 8546 |
| HPV56 | E2 | ETVNEYNT | 154 | 8 | | | | | 8547 |
| HPV56 | E2 | ETVNEYNTHKT | 154 | 11 | | | | | 8548 |
| HPV56 | E2 | EVHMENESI | 128 | 9 | | | | | 8549 |
| HPV56 | E2 | EVQIALESL | 17 | 9 | | | | | 8550 |
| HPV56 | E2 | EVQIALESLST | 17 | 11 | | | | | 8551 |
| HPV56 | E2 | FLSHVKIPV | 294 | 9 | | | | | 8552 |
| HPV56 | E2 | FLSHVKIPVV | 294 | 10 | | | | | 8553 |
| HPV56 | E2 | FQKYKTLFV | 254 | 9 | | | | | 8554 |
| HPV56 | E2 | FQKYKTLFVDV | 254 | 11 | | | | | 8555 |
| HPV56 | E2 | FVDVTSTYHWT | 261 | 11 | | | | | 8556 |
| HPV56 | E2 | GIYYVHDGHKT | 99 | 11 | | | | | 8557 |
| HPV56 | E2 | GVDYRGIYYV | 94 | 10 | | | | | 8558 |
| HPV56 | E2 | HAKCVTTHT | 201 | 9 | | | | | 8559 |
| HPV56 | E2 | HAKCVTTHTHI | 201 | 11 | | | | | 8560 |
| HPV56 | E2 | HISDTDNT | 210 | 8 | | | | | 8561 |
| HPV56 | E2 | HLKGEPNRL | 239 | 9 | | | | | 8562 |
| HPV56 | E2 | HTHISDTDNT | 208 | 10 | | | | | 8563 |
| HPV56 | E2 | HVKIPVVYRL | 297 | 10 | | | | | 8564 |
| HPV56 | E2 | HVKIPVVYRLV | 297 | 11 | | | | | 8565 |
| HPV56 | E2 | IALESLST | 20 | 8 | | | | | 8566 |
| HPV56 | E2 | IALESLSTT | 20 | 9 | | | | | 8567 |
| HPV56 | E2 | IALESLSTTI | 20 | 10 | | | | | 8568 |
| HPV56 | E2 | IITIIYKDET | 280 | 10 | | | | | 8569 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | E2 | ITIIYKDET | 281 | 9 | | | | | 8570 |
| HPV56 | E2 | KACSAIEV | 11 | 8 | | | | | 8571 |
| HPV56 | E2 | KACSAIEVQI | 11 | 10 | | | | | 8572 |
| HPV56 | E2 | KACSAIEVQIA | 11 | 11 | | | | | 8573 |
| HPV56 | E2 | KAKACSAI | 9 | 8 | | | | | 8574 |
| HPV56 | E2 | KAKACSAIEV | 9 | 10 | | | | | 8575 |
| HPV56 | E2 | KIPVVYRL | 299 | 8 | | | | | 8576 |
| HPV56 | E2 | KIPVVYRLV | 299 | 9 | | | | | 8577 |
| HPV56 | E2 | KTLFVDVT | 258 | 8 | | | | | 8578 |
| HPV56 | E2 | KTLFVDVTST | 258 | 10 | | | | | 8579 |
| HPV56 | E2 | KTTPVVHL | 233 | 8 | | | | | 8580 |
| HPV56 | E2 | KTTTTTST | 163 | 8 | | | | | 8581 |
| HPV56 | E2 | KTTTTTSTSV | 163 | 10 | | | | | 8582 |
| HPV56 | E2 | KTYYTDFEQEA | 108 | 11 | | | | | 8583 |
| HPV56 | E2 | KVCSGVDYRGI | 90 | 11 | | | | | 8584 |
| HPV56 | E2 | LQVCKAKA | 5 | 8 | | | | | 8585 |
| HPV56 | E2 | LQVCKAKACSA | 5 | 11 | | | | | 8586 |
| HPV56 | E2 | MQYVAWKYI | 72 | 9 | | | | | 8587 |
| HPV56 | E2 | MVPCLQVCKA | 1 | 10 | | | | | 8588 |
| HPV56 | E2 | NTDSRSRSI | 216 | 9 | | | | | 8589 |
| HPV56 | E2 | NTHKTTTT | 160 | 8 | | | | | 8590 |
| HPV56 | E2 | NTHKTTTTT | 160 | 9 | | | | | 8591 |
| HPV56 | E2 | NTHKTTTTTST | 160 | 11 | | | | | 8592 |
| HPV56 | E2 | NVSPVETV | 149 | 8 | | | | | 8593 |
| HPV56 | E2 | PVETVNEYNT | 152 | 10 | | | | | 8594 |
| HPV56 | E2 | QIALESLST | 19 | 9 | | | | | 8595 |
| HPV56 | E2 | QIALESLSTT | 19 | 10 | | | | | 8596 |
| HPV56 | E2 | QIALESLSTTI | 19 | 11 | | | | | 8597 |
| HPV56 | E2 | QVCKAKACSA | 6 | 10 | | | | | 8598 |
| HPV56 | E2 | QVCKAKACSAI | 6 | 11 | | | | | 8599 |
| HPV56 | E2 | SAIEVQIA | 14 | 8 | | | | | 8600 |
| HPV56 | E2 | SAIEVQIAL | 14 | 9 | | | | | 8601 |
| HPV56 | E2 | SIITIIYKDET | 279 | 11 | | | | | 8602 |
| HPV56 | E2 | SIYCPDSV | 135 | 8 | | | | | 8603 |
| HPV56 | E2 | SIYCPDSVSST | 135 | 11 | | | | | 8604 |
| HPV56 | E2 | STCRYNVSPV | 144 | 10 | | | | | 8605 |
| HPV56 | E2 | STDNKNYSI | 272 | 9 | | | | | 8606 |
| HPV56 | E2 | STDNKNYSII | 272 | 10 | | | | | 8607 |
| HPV56 | E2 | STDNKNYSIIT | 272 | 11 | | | | | 8608 |
| HPV56 | E2 | STSVGNQDA | 169 | 9 | | | | | 8609 |
| HPV56 | E2 | STSVGNQDAA | 169 | 10 | | | | | 8610 |
| HPV56 | E2 | STSVGNQDAAV | 169 | 11 | | | | | 8611 |
| HPV56 | E2 | STTIYNNEEWT | 26 | 11 | | | | | 8612 |
| HPV56 | E2 | STYHWTST | 266 | 8 | | | | | 8613 |
| HPV56 | E2 | SVGNQDAA | 171 | 8 | | | | | 8614 |
| HPV56 | E2 | SVGNQDAAV | 171 | 9 | | | | | 8615 |
| HPV56 | E2 | SVSSTCRYNV | 141 | 10 | | | | | 8616 |
| HPV56 | E2 | TIIYKDET | 282 | 8 | | | | | 8617 |
| HPV56 | E2 | TIYNNEEWT | 28 | 9 | | | | | 8618 |
| HPV56 | E2 | TIYNNEEWTL | 28 | 10 | | | | | 8619 |
| HPV56 | E2 | TLFVDVTST | 259 | 9 | | | | | 8620 |
| HPV56 | E2 | TLRDTCEEL | 36 | 9 | | | | | 8621 |
| HPV56 | E2 | TLRDTCEELWL | 36 | 11 | | | | | 8622 |
| HPV56 | E2 | TQRNSFLSHV | 289 | 10 | | | | | 8623 |
| HPV56 | E2 | TTHTHISDT | 206 | 9 | | | | | 8624 |
| HPV56 | E2 | TTIYNNEEWT | 27 | 10 | | | | | 8625 |
| HPV56 | E2 | TTIYNNEEWTL | 27 | 11 | | | | | 8626 |
| HPV56 | E2 | TTSTSVGNQDA | 167 | 11 | | | | | 8627 |
| HPV56 | E2 | TTTTSTSV | 165 | 8 | | | | | 8628 |
| HPV56 | E2 | TTTTTSTSV | 164 | 9 | | | | | 8629 |
| HPV56 | E2 | TVNEYNTHKT | 155 | 10 | | | | | 8630 |
| HPV56 | E2 | TVNEYNTHKTT | 155 | 11 | | | | | 8631 |
| HPV56 | E2 | VQIALESL | 18 | 8 | | | | | 8632 |
| HPV56 | E2 | VQIALESLST | 18 | 10 | | | | | 8633 |
| HPV56 | E2 | VQIALESLSTT | 18 | 11 | | | | | 8634 |
| HPV56 | E2 | VTSTYHWT | 264 | 8 | | | | | 8635 |
| HPV56 | E2 | VTSTYHWTST | 264 | 10 | | | | | 8636 |
| HPV56 | E2 | VTTHTHISDT | 205 | 10 | | | | | 8637 |
| HPV56 | E2 | VVHLKGEPNRL | 237 | 11 | | | | | 8638 |
| HPV56 | E2 | WQKVCSGV | 88 | 8 | | | | | 8639 |
| HPV56 | E2 | WTLRDTCEEL | 35 | 10 | | | | | 8640 |
| HPV56 | E2 | WTSTDNKNYSI | 270 | 11 | | | | | 8641 |
| HPV56 | E2 | YTDFEQEA | 111 | 8 | | | | | 8642 |
| HPV56 | E2 | YVHDGHKT | 102 | 8 | | | | | 8643 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | E2 | YVHDGHKTYYT | 102 | 11 | | | | | 8644 |
| HPV56 | E6 | ATLESITKKQL | 89 | 11 | | | | | 8645 |
| HPV56 | E6 | AVCRVCLL | 64 | 8 | | | | | 8646 |
| HPV56 | E6 | CLGCWRQT | 139 | 8 | | | | | 8547 |
| HPV56 | E6 | CLLFYSKV | 69 | 8 | | | | | 8648 |
| HPV56 | E6 | CVYCKKEL | 33 | 8 | | | | | 8649 |
| HPV56 | E6 | CVYCKKELT | 33 | 9 | | | | | 8650 |
| HPV56 | E6 | CVYCKKELTRA | 33 | 11 | | | | | 8651 |
| HPV56 | E6 | EIPLIDLRL | 23 | 9 | | | | | 8652 |
| HPV56 | E6 | ELTRAEVYNFA | 39 | 11 | | | | | 8653 |
| HPV56 | E6 | EVLEIPLI | 20 | 8 | | | | | 8654 |
| HPV56 | E6 | EVLEIPLIDL | 20 | 10 | | | | | 8655 |
| HPV56 | E6 | EVYNFACT | 44 | 8 | | | | | 8656 |
| HPV56 | E6 | EVYNFACTEL | 44 | 10 | | | | | 8657 |
| HPV56 | E6 | FACTELKL | 48 | 8 | | | | | 8658 |
| HPV56 | E6 | FACTELKLV | 48 | 9 | | | | | 8659 |
| HPV56 | E6 | GATLESIT | 88 | 8 | | | | | 8660 |
| HPV56 | E6 | HLIAHGWT | 129 | 8 | | | | | 8661 |
| HPV56 | E6 | HLSEVLEI | 17 | 8 | | | | | 8662 |
| HPV56 | E6 | HLSEVLEIPL | 17 | 10 | | | | | 8663 |
| HPV56 | E6 | HLSEVLEIPLI | 17 | 11 | | | | | 8664 |
| HPV56 | E6 | IAHGWTGSCL | 131 | 10 | | | | | 8665 |
| HPV56 | E6 | ITKKQLCDL | 94 | 9 | | | | | 8666 |
| HPV56 | E6 | ITKKQLCDLL | 94 | 10 | | | | | 8667 |
| HPV56 | E6 | ITKKQLCDLLI | 94 | 11 | | | | | 8668 |
| HPV56 | E6 | KLVYRDDFPYA | 54 | 11 | | | | | 8669 |
| HPV56 | E6 | KQLCDLLI | 97 | 8 | | | | | 8670 |
| HPV56 | E6 | LIAHGWTGSCL | 130 | 11 | | | | | 8671 |
| HPV56 | E6 | LIDLRLSCV | 26 | 9 | | | | | 8672 |
| HPV56 | E6 | LIRCYRCQSPL | 103 | 11 | | | | | 8673 |
| HPV56 | E6 | LTPEEKQL | 113 | 8 | | | | | 8674 |
| HPV56 | E6 | LTRAEVYNFA | 40 | 10 | | | | | 8675 |
| HPV56 | E6 | LVYRDDFPYA | 55 | 10 | | | | | 8676 |
| HPV56 | E6 | LVYRDDFPYAV | 55 | 11 | | | | | 8677 |
| HPV56 | E6 | PLIDLRLSCV | 25 | 10 | | | | | 8678 |
| HPV56 | E6 | PLTPEEKQL | 112 | 9 | | | | | 8679 |
| HPV56 | E6 | PQERPRSL | 8 | 8 | | | | | 8680 |
| HPV56 | E6 | PQERPRSLHHL | 8 | 11 | | | | | 8681 |
| HPV56 | E6 | QTSREPREST | 145 | 10 | | | | | 8682 |
| HPV56 | E6 | QTSREPRESTV | 145 | 11 | | | | | 8683 |
| HPV56 | E6 | RAEVYNFA | 42 | 8 | | | | | 8684 |
| HPV56 | E6 | RAEVYNFACT | 42 | 10 | | | | | 8685 |
| HPV56 | E6 | RLSCVYCKKEL | 30 | 11 | | | | | 8686 |
| HPV56 | E6 | RQTSREPREST | 144 | 11 | | | | | 8687 |
| HPV56 | E6 | RVCLLFYSKV | 67 | 10 | | | | | 8688 |
| HPV56 | E6 | SITKKQLCDL | 93 | 10 | | | | | 8689 |
| HPV56 | E6 | SITKKQLCDLL | 93 | 11 | | | | | 8690 |
| HPV56 | E6 | SLHHLSEV | 14 | 8 | | | | | 8691 |
| HPV56 | E6 | SLHHLSEVL | 14 | 9 | | | | | 8692 |
| HPV56 | E6 | SLHHLSEVLEI | 14 | 11 | | | | | 8693 |
| HPV56 | E6 | SVYGATLESI | 85 | 10 | | | | | 8694 |
| HPV56 | E6 | SVYGATLESIT | 85 | 11 | | | | | 8695 |
| HPV56 | E6 | TLESITKKQL | 90 | 10 | | | | | 8696 |
| HPV56 | E6 | VLEIPLIDL | 21 | 9 | | | | | 8697 |
| HPV56 | E6 | VLEIPLIDLRL | 21 | 11 | | | | | 8698 |
| HPV56 | E6 | YAVCRVCL | 63 | 8 | | | | | 8699 |
| HPV56 | E6 | YAVCRVCLL | 63 | 9 | | | | | 8700 |
| HPV56 | E7 | ALTVTCPL | 93 | 8 | | | | | 8701 |
| HPV56 | E7 | ALTVTCPLCA | 93 | 10 | | | | | 8702 |
| HPV56 | E7 | DIQSTKEDL | 75 | 9 | | | | | 8703 |
| HPV56 | E7 | DIQSTKEDLRV | 75 | 11 | | | | | 8704 |
| HPV56 | E7 | DLQCNEQL | 22 | 8 | | | | | 8705 |
| HPV56 | E7 | DLRVVQQL | 82 | 8 | | | | | 8706 |
| HPV56 | E7 | DLRVVQQLL | 82 | 9 | | | | | 8707 |
| HPV56 | E7 | DLRVVQQLLM | 82 | 10 | | | | | 8708 |
| HPV56 | E7 | DVVLELTPQT | 10 | 10 | | | | | 8709 |
| HPV56 | E7 | EIDLQCNEQL | 20 | 10 | | | | | 8710 |
| HPV56 | E7 | ELTPQTEI | 14 | 8 | | | | | 8711 |
| HPV56 | E7 | ELTPQTEIDL | 14 | 10 | | | | | 8712 |
| HPV56 | E7 | FVVQLDIQST | 70 | 10 | | | | | 8713 |
| HPV56 | E7 | GALTVTCPL | 92 | 9 | | | | | 8714 |
| HPV56 | E7 | GALTVTCPLCA | 92 | 11 | | | | | 8715 |
| HPV56 | E7 | HLQERPQQA | 42 | 9 | | | | | 8716 |
| HPV56 | E7 | HTCYLIHV | 56 | 8 | | | | | 8717 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | E7 | HVPCCECKFV | 62 | 10 | | | | | 8718 |
| HPV56 | E7 | HVPCCECKFVV | 62 | 11 | | | | | 8719 |
| HPV56 | E7 | IQSTKEDL | 76 | 8 | | | | | 8720 |
| HPV56 | E7 | IQSTKEDLRV | 76 | 10 | | | | | 8721 |
| HPV56 | E7 | IQSTKEDLRVV | 76 | 11 | | | | | 8722 |
| HPV56 | E7 | KQHTCYLI | 54 | 8 | | | | | 8723 |
| HPV56 | E7 | KQHTCYLIHV | 54 | 10 | | | | | 8724 |
| HPV56 | E7 | KVPTLQDV | 4 | 8 | | | | | 8725 |
| HPV56 | E7 | KVPTLQDVV | 4 | 9 | | | | | 8726 |
| HPV56 | E7 | KVPTLQDVVL | 4 | 10 | | | | | 8727 |
| HPV56 | E7 | LLMGALTV | 89 | 8 | | | | | 8728 |
| HPV56 | E7 | LLMGALTVT | 89 | 9 | | | | | 8729 |
| HPV56 | E7 | LMGALTVT | 90 | 8 | | | | | 8730 |
| HPV56 | E7 | LMGALTVTCPL | 90 | 11 | | | | | 8731 |
| HPV56 | E7 | LQDVVLEL | 8 | 8 | | | | | 8732 |
| HPV56 | E7 | LQDVVLELT | 8 | 9 | | | | | 8733 |
| HPV56 | E7 | LQERPQQA | 43 | 8 | | | | | 8734 |
| HPV56 | E7 | LQERPQQARQA | 43 | 11 | | | | | 8735 |
| HPV56 | E7 | LTPQTEIDL | 15 | 9 | | | | | 8736 |
| HPV56 | E7 | LTVTCPLCA | 94 | 9 | | | | | 8737 |
| HPV56 | E7 | PQQARQAKQHT | 47 | 11 | | | | | 8738 |
| HPV56 | E7 | PTLQDVVL | 6 | 8 | | | | | 8739 |
| HPV56 | E7 | PTLQDVVLEL | 6 | 10 | | | | | 8740 |
| HPV56 | E7 | PTLQDVVLELT | 6 | 11 | | | | | 8741 |
| HPV56 | E7 | QAKQHTCYL | 52 | 9 | | | | | 8742 |
| HPV56 | E7 | QAKQHTCYLI | 52 | 10 | | | | | 8743 |
| HPV56 | E7 | QARQAKQHT | 49 | 9 | | | | | 8744 |
| HPV56 | E7 | QLDIQSTKEDL | 73 | 11 | | | | | 8745 |
| HPV56 | E7 | QLLMGALT | 88 | 8 | | | | | 8746 |
| HPV56 | E7 | QLLMGALTV | 88 | 9 | | | | | 8747 |
| HPV56 | E7 | QLLMGALTVT | 88 | 10 | | | | | 8748 |
| HPV56 | E7 | QQARQAKQHT | 48 | 10 | | | | | 8749 |
| HPV56 | E7 | QQLLMGAL | 87 | 8 | | | | | 8750 |
| HPV56 | E7 | QQLLMGALT | 87 | 9 | | | | | 8751 |
| HPV56 | E7 | QQLLMGALTV | 87 | 10 | | | | | 8752 |
| HPV56 | E7 | QQLLMGALTVT | 87 | 11 | | | | | 8753 |
| HPV56 | E7 | RQAKQHTCYL | 51 | 10 | | | | | 8754 |
| HPV56 | E7 | RQAKQHTCYLI | 51 | 11 | | | | | 8755 |
| HPV56 | E7 | RVVQQLLM | 84 | 8 | | | | | 8756 |
| HPV56 | E7 | RVVQQLLMGA | 84 | 10 | | | | | 8757 |
| HPV56 | E7 | RVVQQLLMGAL | 84 | 11 | | | | | 8758 |
| HPV56 | E7 | STKEDLRV | 78 | 8 | | | | | 8759 |
| HPV56 | E7 | STKEDLRVV | 78 | 9 | | | | | 8760 |
| HPV56 | E7 | TLQDVVLEL | 7 | 9 | | | | | 8761 |
| HPV56 | E7 | TLQDVVLELT | 7 | 10 | | | | | 8762 |
| HPV56 | E7 | TVTCPLCA | 95 | 8 | | | | | 8763 |
| HPV56 | E7 | VLELTPQT | 12 | 8 | | | | | 8764 |
| HPV56 | E7 | VLELTPQTEI | 12 | 10 | | | | | 8765 |
| HPV56 | E7 | VQLDIQST | 72 | 8 | | | | | 8766 |
| HPV56 | E7 | VQQLLMGA | 86 | 8 | | | | | 8767 |
| HPV56 | E7 | VQQLLMGAL | 86 | 9 | | | | | 8768 |
| HPV56 | E7 | VQQLLMGALT | 86 | 10 | | | | | 8769 |
| HPV56 | E7 | VQQLLMGALTV | 86 | 11 | | | | | 8770 |
| HPV56 | E7 | VVLELTPQT | 11 | 9 | | | | | 8771 |
| HPV56 | E7 | VVLELTPQTEI | 11 | 11 | | | | | 8772 |
| HPV56 | E7 | VVQLDIQST | 71 | 9 | | | | | 8773 |
| HPV56 | E7 | VVQQLLMGA | 85 | 9 | | | | | 8774 |
| HPV56 | E7 | VVQQLLMGAL | 85 | 10 | | | | | 8775 |
| HPV56 | E7 | VVQQLLMGALT | 85 | 11 | | | | | 8776 |
| HPV56 | L1 | AITCQREQPPT | 458 | 11 | | | | | 8777 |
| HPV56 | L1 | AMGEHWTKGA | 198 | 10 | | | | | 8778 |
| HPV56 | L1 | AMGEHWTKGAV | 198 | 11 | | | | | 8779 |
| HPV56 | L1 | AQGHNNGI | 350 | 8 | | | | | 8780 |
| HPV56 | L1 | AQLFNKPYWL | 338 | 10 | | | | | 8781 |
| HPV56 | L1 | ATDSYVKRT | 58 | 9 | | | | | 8782 |
| HPV56 | L1 | ATDSYVKRTSI | 58 | 11 | | | | | 8783 |
| HPV56 | L1 | ATEQLSKYDA | 381 | 10 | | | | | 8784 |
| HPV56 | L1 | ATPSGSMI | 327 | 8 | | | | | 8785 |
| HPV56 | L1 | ATPSGSMIT | 327 | 9 | | | | | 8786 |
| HPV56 | L1 | ATSKKRSA | 514 | 8 | | | | | 8787 |
| HPV56 | L1 | ATSKKRSAPT | 514 | 10 | | | | | 8788 |
| HPV56 | L1 | ATSLEDKYRYV | 444 | 11 | | | | | 8789 |
| HPV56 | L1 | ATWRPSENKV | 37 | 10 | | | | | 8790 |
| HPV56 | L1 | AVATSKKRSA | 512 | 10 | | | | | 8791 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | L1 | AVCKSTQV | 207 | 8 | | | | | 8792 |
| HPV56 | L1 | AVCKSTQVT | 207 | 9 | | | | | 8793 |
| HPV56 | L1 | AVCKSTQVTT | 207 | 10 | | | | | 8794 |
| HPV56 | L1 | AVGHPYYSV | 79 | 9 | | | | | 8795 |
| HPV56 | L1 | AVGHPYYSVT | 79 | 10 | | | | | 8796 |
| HPV56 | L1 | AVNVFPIFL | 26 | 9 | | | | | 8797 |
| HPV56 | L1 | AVNVFPIFLQM | 26 | 11 | | | | | 8798 |
| HPV56 | L1 | CIFLDVGA | 19 | 8 | | | | | 8799 |
| HPV56 | L1 | CIFLDVGAV | 19 | 9 | | | | | 8800 |
| HPV56 | L1 | CIFLDVGAVNV | 19 | 11 | | | | | 8801 |
| HPV56 | L1 | CIVGCTPA | 191 | 8 | | | | | 8802 |
| HPV56 | L1 | CIVGCTPAM | 191 | 9 | | | | | 8803 |
| HPV56 | L1 | CQREQPPT | 461 | 8 | | | | | 8804 |
| HPV56 | L1 | CTPAMGEHWT | 195 | 10 | | | | | 8805 |
| HPV56 | L1 | DARKINQYL | 389 | 9 | | | | | 8806 |
| HPV56 | L1 | DAYGDSMWFYL | 274 | 11 | | | | | 8807 |
| HPV56 | L1 | DMIDTGFGA | 233 | 9 | | | | | 8808 |
| HPV56 | L1 | DMIDTGFGAM | 233 | 10 | | | | | 8809 |
| HPV56 | L1 | DQERLVWA | 128 | 8 | | | | | 8810 |
| HPV56 | L1 | DQERLVWACV | 128 | 10 | | | | | 8811 |
| HPV56 | L1 | DQFPLGRKFL | 493 | 10 | | | | | 8812 |
| HPV56 | L1 | DQFPLGRKFLM | 493 | 11 | | | | | 8813 |
| HPV56 | L1 | DTESSNLA | 162 | 8 | | | | | 8814 |
| HPV56 | L1 | DTGFGAMDFKV | 236 | 11 | | | | | 8815 |
| HPV56 | L1 | DTTRSTNM | 369 | 8 | | | | | 8816 |
| HPV56 | L1 | DTTRSTNMT | 369 | 9 | | | | | 8817 |
| HPV56 | L1 | DDTRSTNMTI | 369 | 10 | | | | | 8818 |
| HPV56 | L1 | DVGAVNVFPI | 23 | 10 | | | | | 8819 |
| HPV56 | L1 | DVNLQDSFST | 481 | 10 | | | | | 8820 |
| HPV56 | L1 | EAQLFNKPYWL | 337 | 11 | | | | | 8821 |
| HPV56 | L1 | ELQFVFQL | 404 | 8 | | | | | 8822 |
| HPV56 | L1 | ELQFVFQLCKI | 404 | 11 | | | | | 8823 |
| HPV56 | L1 | EQLSKYDA | 383 | 8 | | | | | 8824 |
| HPV56 | L1 | EQLSKYDARKI | 383 | 11 | | | | | 8825 |
| HPV56 | L1 | EQPPTEKQDPL | 464 | 11 | | | | | 8826 |
| HPV56 | L1 | ETIPAELYL | 303 | 9 | | | | | 8827 |
| HPV56 | L1 | EVGRGQPL | 140 | 8 | | | | | 8828 |
| HPV56 | L1 | EVGRGQPLGA | 140 | 10 | | | | | 8829 |
| HPV56 | L1 | EVMAYLHNM | 419 | 9 | | | | | 8830 |
| HPV56 | L1 | EVMAYLHNMNA | 419 | 11 | | | | | 8831 |
| HPV56 | L1 | EVPLDIVQST | 253 | 10 | | | | | 8832 |
| HPV56 | L1 | FARHYFNRA | 290 | 9 | | | | | 8833 |
| HPV56 | L1 | FLDVGAVNV | 21 | 9 | | | | | 8834 |
| HPV56 | L1 | FQLCKITL | 409 | 8 | | | | | 8835 |
| HPV56 | L1 | FQLCKITLSA | 409 | 10 | | | | | 8836 |
| HPV56 | L1 | FVFQLCKI | 407 | 8 | | | | | 8837 |
| HPV56 | L1 | FVFQLCKIT | 407 | 9 | | | | | 8838 |
| HPV56 | L1 | FVFQLCKITL | 407 | 10 | | | | | 8839 |
| HPV56 | L1 | FVTVVDTT | 364 | 8 | | | | | 8840 |
| HPV56 | L1 | FVTVVDTTRST | 364 | 11 | | | | | 8841 |
| HPV56 | L1 | GAGLSGHPL | 148 | 9 | | | | | 8842 |
| HPV56 | L1 | GAMDFKVL | 240 | 8 | | | | | 8843 |
| HPV56 | L1 | GAVCKSTQV | 206 | 9 | | | | | 8844 |
| HPV56 | L1 | GAVCKSTQVT | 206 | 10 | | | | | 8845 |
| HPV56 | L1 | GAVCKSTQVTT | 206 | 11 | | | | | 8846 |
| HPV56 | L1 | GAVNVFPI | 25 | 8 | | | | | 8847 |
| HPV56 | L1 | GAVNVFPIFL | 25 | 10 | | | | | 8848 |
| HPV56 | L1 | GICWGNQL | 356 | 8 | | | | | 8849 |
| HPV56 | L1 | GICWGNQLFV | 356 | 10 | | | | | 8850 |
| HPV56 | L1 | GICWGNQLFVT | 356 | 11 | | | | | 8851 |
| HPV56 | L1 | GLCIFLDV | 17 | 8 | | | | | 8852 |
| HPV56 | L1 | GLCIFLDVGA | 17 | 10 | | | | | 8853 |
| HPV56 | L1 | GLCIFLDVGAV | 17 | 11 | | | | | 8854 |
| HPV56 | L1 | GLEVGRGQPL | 138 | 10 | | | | | 8855 |
| HPV56 | L1 | GLSGHPLFNRL | 150 | 11 | | | | | 8856 |
| HPV56 | L1 | GLSPPVAT | 438 | 8 | | | | | 8857 |
| HPV56 | L1 | GLSPPVATSL | 438 | 10 | | | | | 8858 |
| HPV56 | L1 | GQPLGAGL | 144 | 8 | | | | | 8859 |
| HPV56 | L1 | GTRSKPAV | 506 | 8 | | | | | 8860 |
| HPV56 | L1 | GTRSKPAVA | 506 | 9 | | | | | 8861 |
| HPV56 | L1 | GTRSKPAVAT | 506 | 10 | | | | | 8862 |
| HPV56 | L1 | HAGSSRLL | 71 | 8 | | | | | 8863 |
| HPV56 | L1 | HAGSSRLLA | 71 | 9 | | | | | 8864 |
| HPV56 | L1 | HAGSSRLLAV | 71 | 10 | | | | | 8865 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | L1 | HVEEYELQFV | 399 | 10 | | | | | 8866 |
| HPV56 | L1 | ITCQREQPPT | 459 | 10 | | | | | 8867 |
| HPV56 | L1 | ITLSAEVM | 414 | 8 | | | | | 8868 |
| HPV56 | L1 | ITLSAEVMA | 414 | 9 | | | | | 8869 |
| HPV56 | L1 | ITLSAEVMAYL | 414 | 11 | | | | | 8870 |
| HPV56 | L1 | IVGCTPAM | 192 | 8 | | | | | 8871 |
| HPV56 | L1 | KAEVPLDI | 251 | 8 | | | | | 8872 |
| HPV56 | L1 | KAEVPLDIV | 251 | 9 | | | | | 8873 |
| HPV56 | L1 | KINQYLRHV | 392 | 9 | | | | | 8874 |
| HPV56 | L1 | KITLSAEV | 413 | 8 | | | | | 8875 |
| HPV56 | L1 | KITLSAEVM | 413 | 9 | | | | | 8876 |
| HPV56 | L1 | KITLSAEVMA | 413 | 10 | | | | | 8877 |
| HPV56 | L1 | KMSADAYGDSM | 270 | 11 | | | | | 8878 |
| HPV56 | L1 | KQTQLCIV | 186 | 8 | | | | | 8879 |
| HPV56 | L1 | KQTQLCIVGCT | 186 | 11 | | | | | 8880 |
| HPV56 | L1 | KTNIPKVSA | 93 | 9 | | | | | 8881 |
| HPV56 | L1 | KVGETIPA | 300 | 8 | | | | | 8882 |
| HPV56 | L1 | KVGETIPAEL | 300 | 10 | | | | | 8883 |
| HPV56 | L1 | KVLQESKA | 245 | 8 | | | | | 8884 |
| HPV56 | L1 | KVLQESKAEV | 245 | 10 | | | | | 8885 |
| HPV56 | L1 | KVSAYQYRV | 98 | 9 | | | | | 8886 |
| HPV56 | L1 | KVVATDSYV | 55 | 9 | | | | | 8887 |
| HPV56 | L1 | KVYLPPTPV | 45 | 9 | | | | | 8888 |
| HPV56 | L1 | LAKYKFWDV | 474 | 9 | | | | | 8889 |
| HPV56 | L1 | LAKYKFWDVNL | 474 | 11 | | | | | 8890 |
| HPV56 | L1 | LALINTPI | 222 | 8 | | | | | 8891 |
| HPV56 | L1 | LAVGHPYYSV | 78 | 10 | | | | | 8892 |
| HPV56 | L1 | LAVGHPYYSVT | 78 | 11 | | | | | 8893 |
| HPV56 | L1 | LINTPIEDGDM | 224 | 11 | | | | | 8894 |
| HPV56 | L1 | LLAVGHPYYSV | 77 | 11 | | | | | 8895 |
| HPV56 | L1 | LLEDWNIGL | 431 | 9 | | | | | 8896 |
| HPV56 | L1 | LMQLGTRSKPA | 502 | 11 | | | | | 8897 |
| HPV56 | L1 | LQDSFSTDL | 484 | 9 | | | | | 8898 |
| HPV56 | L1 | LQESKAEV | 247 | 8 | | | | | 8899 |
| HPV56 | L1 | LQESKAEVPL | 247 | 10 | | | | | 8900 |
| HPV56 | L1 | LQFVFQLCKI | 405 | 10 | | | | | 8901 |
| HPV56 | L1 | LQFVFQLCKIT | 405 | 11 | | | | | 8902 |
| HPV56 | L1 | LQRAQGHNNGI | 347 | 11 | | | | | 8903 |
| HPV56 | L1 | LVWACVGL | 132 | 8 | | | | | 8904 |
| HPV56 | L1 | LVWACVGLEV | 132 | 10 | | | | | 8905 |
| HPV56 | L1 | MATWRPSENKV | 36 | 11 | | | | | 8906 |
| HPV56 | L1 | MAYLHNMNA | 421 | 9 | | | | | 8907 |
| HPV56 | L1 | MAYLHNMNANL | 421 | 11 | | | | | 8908 |
| HPV56 | L1 | MIDTGFGA | 234 | 8 | | | | | 8909 |
| HPV56 | L1 | MIDTGFGAM | 234 | 9 | | | | | 8910 |
| HPV56 | L1 | MITSEAQL | 333 | 8 | | | | | 8911 |
| HPV56 | L1 | MMLPMMYI | 1 | 8 | | | | | 8912 |
| HPV56 | L1 | MMYIYRDPPL | 5 | 10 | | | | | 8913 |
| HPV56 | L1 | MQLGTRSKPA | 503 | 10 | | | | | 8914 |
| HPV56 | L1 | MQLGTRSKPAV | 503 | 11 | | | | | 8915 |
| HPV56 | L1 | MTISTATEQL | 376 | 10 | | | | | 8916 |
| HPV56 | L1 | NANLLEDWNI | 428 | 10 | | | | | 8917 |
| HPV56 | L1 | NIGLSPPV | 436 | 8 | | | | | 8918 |
| HPV56 | L1 | NIGLSPPVA | 436 | 9 | | | | | 8919 |
| HPV56 | L1 | NIGLSPPVAT | 436 | 10 | | | | | 8920 |
| HPV56 | L1 | NISVDGKQT | 180 | 9 | | | | | 8921 |
| HPV56 | L1 | NISVDGKQTQL | 180 | 11 | | | | | 8922 |
| HPV56 | L1 | NIYNPDQERL | 123 | 10 | | | | | 8923 |
| HPV56 | L1 | NIYNPDQERLV | 123 | 11 | | | | | 8924 |
| HPV56 | L1 | NLANNNVI | 167 | 8 | | | | | 8925 |
| HPV56 | L1 | NLLEDWNI | 430 | 8 | | | | | 8926 |
| HPV56 | L1 | NLLEDWNIGL | 430 | 10 | | | | | 8927 |
| HPV56 | L1 | NLQDSFST | 483 | 8 | 28 | | | | 8928 |
| HPV56 | L1 | NLQDSFSTDL | 483 | 10 | | | | | 8929 |
| HPV56 | L1 | NMTISTAT | 375 | 8 | | | | | 8930 |
| HPV56 | L1 | NMTISTATEQL | 375 | 11 | | | | | 8931 |
| HPV56 | L1 | NQLFVTVV | 361 | 8 | | | | | 8932 |
| HPV56 | L1 | NQLFVTVVDT | 361 | 10 | | | | | 8933 |
| HPV56 | L1 | NQLFVTVVDTT | 361 | 11 | | | | | 8934 |
| HPV56 | L1 | NTKTNIPKV | 91 | 9 | | | | | 8935 |
| HPV56 | L1 | NTKTNIPKVSA | 91 | 11 | | | | | 8936 |
| HPV56 | L1 | NTPIEDGDM | 226 | 9 | | | | | 8937 |
| HPV56 | L1 | NTPIEDGDMI | 226 | 10 | | | | | 8938 |
| HPV56 | L1 | NVFPIFLQM | 28 | 9 | | | | | 8939 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | L1 | NVFPIFLQMA | 28 | 10 | | | | | 8940 |
| HPV56 | L1 | NVFPIFLQMAT | 28 | 11 | | | | | 8941 |
| HPV56 | L1 | NVIEDSRDNI | 172 | 10 | | | | | 8942 |
| HPV56 | L1 | PAMGEHWT | 197 | 8 | | | | | 8943 |
| HPV56 | L1 | PAMGEHWTKGA | 197 | 11 | | | | | 8944 |
| HPV56 | L1 | PAVATSKKRSA | 511 | 11 | | | | | 8945 |
| HPV56 | L1 | PIEDGDMI | 228 | 8 | | | | | 8946 |
| HPV56 | L1 | PIEDGDMIDT | 228 | 10 | | | | | 8947 |
| HPV56 | L1 | PIFLQMAT | 31 | 8 | | | | | 8948 |
| HPV56 | L1 | PLAKYKFWDV | 473 | 10 | | | | | 8949 |
| HPV56 | L1 | PLALINTPI | 221 | 9 | | | | | 8950 |
| HPV56 | L1 | PLDIVQST | 255 | 8 | | | | | 8951 |
| HPV56 | L1 | PLFNRLDDT | 155 | 9 | | | | | 8952 |
| HPV56 | L1 | PLGAGLSGHPL | 146 | 11 | | | | | 8953 |
| HPV56 | L1 | PLGRKFLM | 496 | 8 | | | | | 8954 |
| HPV56 | L1 | PLGRKFLMQL | 496 | 10 | | | | | 8955 |
| HPV56 | L1 | PLHYGLCI | 13 | 8 | | | | | 8956 |
| HPV56 | L1 | PLHYGLCIFL | 13 | 10 | | | | | 8957 |
| HPV56 | L1 | PMMYIYRDPPL | 4 | 11 | | | | | 8958 |
| HPV56 | L1 | PTEKQDPL | 467 | 8 | | | | | 8959 |
| HPV56 | L1 | PTEKQDPLA | 467 | 9 | | | | | 8960 |
| HPV56 | L1 | PTPVSKVV | 50 | 8 | | | | | 8961 |
| HPV56 | L1 | PTPVSKVVA | 50 | 9 | | | | | 8962 |
| HPV56 | L1 | PTPVSKVVAT | 50 | 10 | | | | | 8963 |
| HPV56 | L1 | PTSTSTPA | 522 | 8 | | | | | 8964 |
| HPV56 | L1 | PVSKVVAT | 52 | 8 | | | | | 8965 |
| HPV56 | L1 | QLCIVGCT | 189 | 8 | | | | | 8966 |
| HPV56 | L1 | QLCIVGCTPA | 189 | 10 | | | | | 8967 |
| HPV56 | L1 | QLCIVGCTPAM | 189 | 11 | | | | | 8968 |
| HPV56 | L1 | QLCKITLSA | 410 | 9 | | | | | 8969 |
| HPV56 | L1 | QLCKITLSAEV | 410 | 11 | | | | | 8970 |
| HPV56 | L1 | QLFARHYFNRA | 288 | 11 | | | | | 8971 |
| HPV56 | L1 | QLFNKPYWL | 339 | 9 | | | | | 8972 |
| HPV56 | L1 | QLFVTVVDT | 362 | 9 | | | | | 8973 |
| HPV56 | L1 | QLFVTVVDTT | 362 | 10 | | | | | 8974 |
| HPV56 | L1 | QLGTRSKPA | 504 | 9 | | | | | 8975 |
| HPV56 | L1 | QLGTRSKPAV | 504 | 10 | | | | | 8976 |
| HPV56 | L1 | QLGTRSKPAVA | 504 | 11 | | | | | 8977 |
| HPV56 | L1 | QLSKYDARKI | 384 | 10 | | | | | 8978 |
| HPV56 | L1 | QTQLCIVGCT | 187 | 10 | | | | | 8979 |
| HPV56 | L1 | QVTTGDCPPL | 213 | 10 | | | | | 8980 |
| HPV56 | L1 | QVTTGDCPPLA | 213 | 11 | | | | | 8981 |
| HPV56 | L1 | RAGKVGET | 297 | 8 | | | | | 8982 |
| HPV56 | L1 | RAGKVGETI | 297 | 9 | | | | | 8983 |
| HPV56 | L1 | RAGKVGETIPA | 297 | 11 | | | | | 8984 |
| HPV56 | L1 | RAQGHNNGI | 349 | 9 | | | | | 8985 |
| HPV56 | L1 | RLDDTESSNL | 159 | 10 | | | | | 8986 |
| HPV56 | L1 | RLDDTESSNLA | 159 | 11 | | | | | 8987 |
| HPV56 | L1 | RLPDPNKFGL | 110 | 10 | | | | | 8988 |
| HPV56 | L1 | RLVWACVGL | 131 | 9 | | | | | 8989 |
| HPV56 | L1 | RLVWACVGLEV | 131 | 11 | | | | | 8990 |
| HPV56 | L1 | RTSIFYHA | 65 | 8 | | | | | 8991 |
| HPV56 | L1 | SADAYGDSM | 272 | 9 | | | | | 8992 |
| HPV56 | L1 | SAEVMAYL | 417 | 8 | | | | | 8993 |
| HPV56 | L1 | SAEVMAYLHNM | 417 | 11 | | | | | 8994 |
| HPV56 | L1 | SAPTSTST | 520 | 8 | | | | | 8995 |
| HPV56 | L1 | SAPTSTSTPA | 520 | 10 | | | | | 8996 |
| HPV56 | L1 | SAYQYRVFRV | 100 | 10 | | | | | 8997 |
| HPV56 | L1 | SIFYHAGSSRL | 67 | 11 | | | | | 8998 |
| HPV56 | L1 | SLEDKYRYV | 446 | 9 | | | | | 8999 |
| HPV56 | L1 | SMITSEAQL | 332 | 9 | | | | | 9000 |
| HPV56 | L1 | SMWFYLRREQL | 279 | 11 | | | | | 9001 |
| HPV56 | L1 | STCKYPDYL | 261 | 9 | | | | | 9002 |
| HPV56 | L1 | STCKYPDYLKM | 261 | 11 | | | | | 9003 |
| HPV56 | L1 | STDLDQFPL | 489 | 9 | | | | | 9004 |
| HPV56 | L1 | STNMTIST | 373 | 8 | | | | | 9005 |
| HPV56 | L1 | STNMTISTA | 373 | 9 | | | | | 9006 |
| HPV56 | L1 | STNMTISTAT | 373 | 10 | | | | | 9007 |
| HPV56 | L1 | SVDGKQTQL | 182 | 9 | | | | | 9008 |
| HPV56 | L1 | SVDGKQTQLCI | 182 | 11 | | | | | 9009 |
| HPV56 | L1 | SVTKDNTKT | 86 | 9 | | | | | 9010 |
| HPV56 | L1 | SVTKDNTKTNI | 86 | 11 | | | | | 9011 |
| HPV56 | L1 | SVYVATPSGSM | 323 | 11 | | | | | 9012 |
| HPV56 | L1 | TATEQLSKYDA | 380 | 11 | | | | | 9013 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | L1 | TIPAELYL | 304 | 8 | | | | | 9014 |
| HPV56 | L1 | TISTATEQL | 377 | 9 | | | | | 9015 |
| HPV56 | L1 | TLSAEVMA | 415 | 8 | | | | | 9016 |
| HPV56 | L1 | TLSAEVMAYL | 415 | 10 | | | | | 9017 |
| HPV56 | L1 | TQLCIVGCT | 188 | 9 | | | | | 9018 |
| HPV56 | L1 | TQLCIVGCTPA | 188 | 11 | | | | | 9019 |
| HPV56 | L1 | TQVTTGDCPPL | 212 | 11 | | | | | 9020 |
| HPV56 | L1 | TTGDCPPL | 215 | 8 | | | | | 9021 |
| HPV56 | L1 | TTGDCPPLA | 215 | 9 | | | | | 9022 |
| HPV56 | L1 | TTGDCPPLAL | 215 | 10 | | | | | 9023 |
| HPV56 | L1 | TTGDCPPLALI | 215 | 11 | | | | | 9024 |
| HPV56 | L1 | TTRSTNMT | 370 | 8 | | | | | 9025 |
| HPV56 | L1 | TTRSTNMTI | 370 | 9 | | | | | 9026 |
| HPV56 | L1 | TTRSTNMTIST | 370 | 11 | | | | | 9027 |
| HPV56 | L1 | TVVDTTRST | 366 | 9 | | | | | 9028 |
| HPV56 | L1 | TVVDTTRSTNM | 366 | 11 | | | | | 9029 |
| HPV56 | L1 | VATDSYVKRT | 57 | 10 | | | | | 9030 |
| HPV56 | L1 | VATPSGSM | 326 | 8 | | | | | 9031 |
| HPV56 | L1 | VATPSGSMI | 326 | 9 | | | | | 9032 |
| HPV56 | L1 | VATPSGSMIT | 326 | 10 | | | | | 9033 |
| HPV56 | L1 | VATSKKRSA | 513 | 9 | | | | | 9034 |
| HPV56 | L1 | VATSKKRSAPT | 513 | 11 | | | | | 9035 |
| HPV56 | L1 | VIEDSRDNI | 173 | 9 | | | | | 9036 |
| HPV56 | L1 | VIEDSRDNISV | 173 | 11 | | | | | 9037 |
| HPV56 | L1 | VLQESKAEV | 246 | 9 | | | | | 9038 |
| HPV56 | L1 | VLQESKAEVPL | 246 | 11 | | | | | 9039 |
| HPV56 | L1 | VMAYLHNM | 420 | 8 | | | | | 9040 |
| HPV56 | L1 | VMAYLHNMNA | 420 | 10 | | | | | 9041 |
| HPV56 | L1 | VQSTCKYPDYL | 259 | 11 | | | | | 9042 |
| HPV56 | L1 | VTKDNTKT | 87 | 8 | | | | | 9043 |
| HPV56 | L1 | VTKDNTKTNI | 87 | 10 | | | | | 9044 |
| HPV56 | L1 | VTTGDCPPL | 214 | 9 | | | | | 9045 |
| HPV56 | L1 | VTTGDCPPLA | 214 | 10 | | | | | 9046 |
| HPV56 | L1 | VTTGDCPPLAL | 214 | 11 | | | | | 9047 |
| HPV56 | L1 | VTVVDTFRST | 365 | 10 | | | | | 9048 |
| HPV56 | L1 | VVATDSYV | 56 | 8 | | | | | 9049 |
| HPV56 | L1 | VVATDSYVKRT | 56 | 11 | | | | | 9050 |
| HPV56 | L1 | VVDTTRST | 367 | 8 | | | | | 9051 |
| HPV56 | L1 | VVDTTRSTNM | 367 | 10 | | | | | 9052 |
| HPV56 | L1 | VVDTTRSTNMT | 367 | 11 | | | | | 9053 |
| HPV56 | L1 | WACVGLEV | 134 | 8 | | | | | 9054 |
| HPV56 | L1 | WTKGAVCKST | 203 | 10 | | | | | 9055 |
| HPV56 | L1 | YIYRDPPL | 7 | 8 | | | | | 9056 |
| HPV56 | L1 | YLHNMNANL | 423 | 9 | | | | | 9057 |
| HPV56 | L1 | YLHNMNANLL | 423 | 10 | | | | | 9058 |
| HPV56 | L1 | YLKMSADA | 268 | 8 | | | | | 9059 |
| HPV56 | L1 | YLPPTPVSKV | 47 | 10 | | | | | 9060 |
| HPV56 | L1 | YLPPTPVSKVV | 47 | 11 | | | | | 9061 |
| HPV56 | L1 | YLRHVEEYEL | 396 | 10 | | | | | 9062 |
| HPV56 | L1 | YLRREQLFA | 283 | 9 | | | | | 9063 |
| HPV56 | L1 | YQYRVFRV | 102 | 8 | | | | | 9064 |
| HPV56 | L1 | YQYRVFRVRL | 102 | 10 | | | | | 9065 |
| HPV56 | L1 | YVATPSGSM | 325 | 9 | | | | | 9066 |
| HPV56 | L1 | YVATPSGSMI | 325 | 10 | | | | | 9067 |
| HPV56 | L1 | YVATPSGSMIT | 325 | 11 | | | | | 9068 |
| HPV56 | L1 | YVKRTSIFYHA | 62 | 11 | | | | | 9069 |
| HPV56 | L1 | YVRSTAIT | 453 | 8 | | | | | 9070 |
| HPV56 | L2 | AAPRLYRKA | 222 | 9 | | | | | 9071 |
| HPV56 | L2 | ALHRPAFT | 281 | 8 | | | | | 9072 |
| HPV56 | L2 | ALHRPAFTT | 281 | 9 | | | | | 9073 |
| HPV56 | L2 | AQAEEIEM | 327 | 8 | | | | | 9074 |
| HPV56 | L2 | AQAEEIEMQPL | 327 | 11 | | | | | 9075 |
| HPV56 | L2 | ATIQTRRGT | 303 | 9 | | | | | 9076 |
| HPV56 | L2 | ATIQTRRGTQI | 303 | 11 | | | | | 9077 |
| HPV56 | L2 | ATLVSADNPL | 246 | 10 | | | | | 9078 |
| HPV56 | L2 | ATPSAHLPI | 367 | 9 | | | | | 9079 |
| HPV56 | L2 | ATQLYKTCKL | 14 | 10 | | | | | 9080 |
| HPV56 | L2 | ATRRKRASA | 6 | 9 | | | | | 9081 |
| HPV56 | L2 | ATRRKRASAT | 6 | 10 | | | | | 9082 |
| HPV56 | L2 | AVHGSGTEPI | 201 | 10 | | | | | 9083 |
| HPV56 | L2 | AVLDITPT | 139 | 8 | | | | | 9084 |
| HPV56 | L2 | AVLDITPTSST | 139 | 11 | | | | | 9085 |
| HPV56 | L2 | DISPIAQA | 322 | 8 | | | | | 9086 |
| HPV56 | L2 | DISPIAQAEEI | 322 | 11 | | | | | 9087 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | L2 | DITPTSST | 142 | 8 | | | | | 9088 |
| HPV56 | L2 | DITPTSSTV | 142 | 9 | | | | | 9089 |
| HPV56 | L2 | DITPTSSTVHV | 142 | 11 | | | | | 9090 |
| HPV56 | L2 | DIVLPTGPST | 406 | 10 | | | | | 9091 |
| HPV56 | L2 | DIYANIDDEA | 349 | 10 | | | | | 9092 |
| HPV56 | L2 | DTSLAFSPSGV | 260 | 11 | | | | | 9093 |
| HPV56 | L2 | DVTHDVYI | 425 | 8 | | | | | 9094 |
| HPV56 | L2 | DVTPARPPI | 83 | 9 | | | | | 9095 |
| HPV56 | L2 | DVTPARPPIV | 83 | 10 | | | | | 9096 |
| HPV56 | L2 | DVTPARPPIVV | 83 | 11 | | | | | 9097 |
| HPV56 | L2 | DVVNKIEQKT | 30 | 10 | | | | | 9098 |
| HPV56 | L2 | DVYIQGSSFA | 429 | 10 | | | | | 9099 |
| HPV56 | L2 | DVYIQGSSFAL | 429 | 11 | | | | | 9100 |
| HPV56 | L2 | EAPGLSSQSV | 357 | 10 | | | | | 9101 |
| HPV56 | L2 | EAPGLSSQSVA | 357 | 11 | | | | | 9102 |
| HPV56 | L2 | EAPQTGEV | 169 | 8 | | | | | 9103 |
| HPV56 | L2 | EIEMQPLL | 331 | 8 | | | | | 9104 |
| HPV56 | L2 | EIEMQPLLSA | 331 | 10 | | | | | 9105 |
| HPV56 | L2 | EIPMQTFA | 194 | 8 | | | | | 9106 |
| HPV56 | L2 | EIPMQTFAV | 194 | 9 | | | | | 9107 |
| HPV56 | L2 | EITSSSTT | 129 | 8 | | | | | 9108 |
| HPV56 | L2 | EITSSSTTT | 129 | 9 | | | | | 9109 |
| HPV56 | L2 | EITSSSTTTPA | 129 | 11 | | | | | 9110 |
| HPV56 | L2 | EMQPLLSA | 333 | 8 | | | | | 9111 |
| HPV56 | L2 | EQKTWADKI | 36 | 9 | | | | | 9112 |
| HPV56 | L2 | EQKTWADKIL | 36 | 10 | | | | | 9113 |
| HPV56 | L2 | ETPFYSGPDI | 398 | 10 | | | | | 9114 |
| HPV56 | L2 | ETPFYSGPDIV | 398 | 11 | | | | | 9115 |
| HPV56 | L2 | EVSGNILI | 175 | 8 | | | | | 9116 |
| HPV56 | L2 | EVSGNILIST | 175 | 10 | | | | | 9117 |
| HPV56 | L2 | FADGDVAA | 457 | 8 | | | | | 9118 |
| HPV56 | L2 | FASNTTNV | 382 | 8 | | | | | 9119 |
| HPV56 | L2 | FASNTTNVT | 382 | 9 | | | | | 9120 |
| HPV56 | L2 | FASNTTNVTA | 382 | 10 | | | | | 9121 |
| HPV56 | L2 | FAVHGSGT | 200 | 8 | | | | | 9122 |
| HPV56 | L2 | FAVHGSGTEPI | 200 | 11 | | | | | 9123 |
| HPV56 | L2 | FIDPPVIEA | 162 | 9 | | | | | 9124 |
| HPV56 | L2 | FLDRPATL | 241 | 8 | | | | | 9125 |
| HPV56 | L2 | FLDRPATLV | 241 | 9 | | | | | 9126 |
| HPV56 | L2 | FLDRPATLVSA | 241 | 11 | | | | | 9127 |
| HPV56 | L2 | FMNIVALHRPA | 276 | 11 | | | | | 9128 |
| HPV56 | L2 | FQQVKVTDPA | 231 | 10 | | | | | 9129 |
| HPV56 | L2 | FTGSGGFEI | 122 | 9 | | | | | 9130 |
| HPV56 | L2 | FTGSGGFEIT | 122 | 10 | | | | | 9131 |
| HPV56 | L2 | FTTRRGGV | 287 | 8 | | | | | 9132 |
| HPV56 | L2 | FTYFGGLGI | 51 | 9 | | | | | 9133 |
| HPV56 | L2 | FTYFGGLGIGT | 51 | 11 | | | | | 9134 |
| HPV56 | L2 | FVPQSPYDV | 418 | 9 | | | | | 9135 |
| HPV56 | L2 | FVPQSPYDVT | 418 | 10 | | | | | 9136 |
| HPV56 | L2 | GAGIPNFT | 116 | 8 | | | | | 9137 |
| HPV56 | L2 | GARVHYYYDI | 314 | 10 | | | | | 9138 |
| HPV56 | L2 | GIHSYEEI | 188 | 8 | | | | | 9139 |
| HPV56 | L2 | GIHSYEEIPM | 188 | 10 | | | | | 9140 |
| HPV56 | L2 | GLGIGTGT | 56 | 8 | | | | | 9141 |
| HPV56 | L2 | GLSSQSVA | 360 | 8 | | | | | 9142 |
| HPV56 | L2 | GLSSQSVAT | 360 | 9 | | | | | 9143 |
| HPV56 | L2 | GLYDIYANI | 346 | 9 | | | | | 9144 |
| HPV56 | L2 | GTCPEDVV | 25 | 8 | | | | | 9145 |
| HPV56 | L2 | GTCPEDVVNKI | 25 | 11 | | | | | 9146 |
| HPV56 | L2 | GTEPISST | 206 | 8 | | | | | 9147 |
| HPV56 | L2 | GTEPISSTPI | 206 | 10 | | | | | 9148 |
| HPV56 | L2 | GTGSGGRA | 62 | 8 | | | | | 9149 |
| HPV56 | L2 | GTGSGGRAGYV | 62 | 11 | | | | | 9150 |
| HPV56 | L2 | GTGTGSGGRA | 60 | 10 | | | | | 9151 |
| HPV56 | L2 | GTQIGARV | 310 | 8 | | | | | 9152 |
| HPV56 | L2 | GVAPDPDFM | 269 | 9 | | | | | 9153 |
| HPV56 | L2 | GVAPDPDFMNI | 269 | 11 | | | | | 9154 |
| HPV56 | L2 | GVRFSRLGRKA | 293 | 11 | | | | | 9155 |
| HPV56 | L2 | HITNPLFI | 156 | 8 | | | | | 9156 |
| HPV56 | L2 | HLPIKPST | 372 | 8 | | | | | 9157 |
| HPV56 | L2 | HLPIKPSTL | 372 | 9 | | | | | 9158 |
| HPV56 | L2 | HVSSTHIT | 151 | 8 | | | | | 9159 |
| HPV56 | L2 | HVSSTHITNPL | 151 | 11 | | | | | 9160 |
| HPV56 | L2 | IAAPRLYRKA | 221 | 10 | | | | | 9161 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | L2 | IAQAEEIEM | 326 | 9 | | | | | 9162 |
| HPV56 | L2 | ILISTPTSGI | 180 | 10 | | | | | 9163 |
| HPV56 | L2 | ILQWGSLFT | 44 | 9 | | | | | 9164 |
| HPV56 | L2 | IQGSSFAL | 432 | 8 | | | | | 9165 |
| HPV56 | L2 | IQGSSFALWPV | 432 | 11 | | | | | 9166 |
| HPV56 | L2 | IQTRRGTQI | 305 | 9 | | | | | 9167 |
| HPV56 | L2 | IQTRRGTQIGA | 305 | 11 | | | | | 9168 |
| HPV56 | L2 | ITNPLFIDPPV | 157 | 11 | | | | | 9169 |
| HPV56 | L2 | ITPTSSTV | 143 | 8 | | | | | 9170 |
| HPV56 | L2 | ITPTSSTVHV | 143 | 10 | | | | | 9171 |
| HPV56 | L2 | ITSSSTTT | 130 | 8 | | | | | 9172 |
| HPV56 | L2 | ITSSSTTTPA | 130 | 10 | | | | | 9173 |
| HPV56 | L2 | ITSSSTTTPAV | 130 | 11 | | | | | 9174 |
| HPV56 | L2 | IVALHRPA | 279 | 8 | | | | | 9175 |
| HPV56 | L2 | IVALHRPAFT | 279 | 10 | | | | | 9176 |
| HPV56 | L2 | IVALHRPAFTT | 279 | 11 | | | | | 9177 |
| HPV56 | L2 | IVDVTPARPPI | 81 | 11 | | | | | 9178 |
| HPV56 | L2 | IVLPTGPST | 407 | 9 | | | | | 9179 |
| HPV56 | L2 | IVTLVEESSV | 103 | 10 | | | | | 9180 |
| HPV56 | L2 | IVTLVEESSVI | 103 | 11 | | | | | 9181 |
| HPV56 | L2 | IVVESVGPT | 91 | 9 | | | | | 9182 |
| HPV56 | L2 | KAFQQVKV | 229 | 8 | | | | | 9183 |
| HPV56 | L2 | KAFQQVKVT | 229 | 9 | | | | | 9184 |
| HPV56 | L2 | KATIQTRRGT | 302 | 10 | | | | | 9185 |
| HPV56 | L2 | KIEQKTWA | 34 | 8 | | | | | 9186 |
| HPV56 | L2 | KIEQKTWADKI | 34 | 11 | | | | | 9187 |
| HPV56 | L2 | KILQWGSL | 43 | 8 | | | | | 9188 |
| HPV56 | L2 | KILQWGSLFT | 43 | 10 | | | | | 9189 |
| HPV56 | L2 | KLSGTCPEDV | 22 | 10 | | | | | 9190 |
| HPV56 | L2 | KLSGTCPEDVV | 22 | 11 | | | | | 9191 |
| HPV56 | L2 | KTCKLSGT | 19 | 8 | | | | | 9192 |
| HPV56 | L2 | KTWADKIL | 38 | 8 | | | | | 9193 |
| HPV56 | L2 | KVTDPAFL | 235 | 8 | | | | | 9194 |
| HPV56 | L2 | LAFSPSGV | 263 | 8 | | | | | 9195 |
| HPV56 | L2 | LAFSPSGVA | 263 | 9 | | | | | 9196 |
| HPV56 | L2 | LISTPTSGI | 181 | 9 | | | | | 9197 |
| HPV56 | L2 | LLSANNSFDGL | 337 | 11 | | | | | 9198 |
| HPV56 | L2 | LQWGSLFT | 45 | 8 | | | | | 9199 |
| HPV56 | L2 | LVEESSVI | 106 | 8 | | | | | 9200 |
| HPV56 | L2 | LVSADNPL | 248 | 8 | | | | | 9201 |
| HPV56 | L2 | MQTFAVHGSGT | 197 | 11 | | | | | 9202 |
| HPV56 | L2 | NIDDEAPGL | 353 | 9 | | | | | 9203 |
| HPV56 | L2 | NILISTPT | 179 | 8 | | | | | 9204 |
| HPV56 | L2 | NILISTPTSGI | 179 | 11 | | | | | 9205 |
| HPV56 | L2 | NIVALHRPA | 278 | 9 | | | | | 9206 |
| HPV56 | L2 | NIVALHRPAFT | 278 | 11 | | | | | 9207 |
| HPV56 | L2 | NTTNVTAPL | 385 | 9 | | | | | 9208 |
| HPV56 | L2 | NVTAPLGNV | 388 | 9 | | | | | 9209 |
| HPV56 | L2 | PAFLDRPA | 239 | 8 | | | | | 9210 |
| HPV56 | L2 | PAFLDRPAT | 239 | 9 | | | | | 9211 |
| HPV56 | L2 | PAFLDRPATL | 239 | 10 | | | | | 9212 |
| HPV56 | L2 | PAFLDRPATLV | 239 | 11 | | | | | 9213 |
| HPV56 | L2 | PAFTTRRGGV | 285 | 10 | | | | | 9214 |
| HPV56 | L2 | PARPPIVV | 86 | 8 | | | | | 9215 |
| HPV56 | L2 | PARPPIVVESV | 86 | 11 | | | | | 9216 |
| HPV56 | L2 | PATLVSADNPL | 245 | 11 | | | | | 9217 |
| HPV56 | L2 | PAVLDITPT | 138 | 9 | | | | | 9218 |
| HPV56 | L2 | PIAQAEEI | 325 | 8 | | | | | 9219 |
| HPV56 | L2 | PIAQAEEIEM | 325 | 10 | | | | | 9220 |
| HPV56 | L2 | PIKPSTLSFA | 374 | 10 | | | | | 9221 |
| HPV56 | L2 | PIPGFRRI | 214 | 8 | | | | | 9222 |
| HPV56 | L2 | PIPGFRRIA | 214 | 9 | | | | | 9223 |
| HPV56 | L2 | PIPGFRRIAA | 214 | 10 | | | | | 9224 |
| HPV56 | L2 | PIVVESVGPT | 90 | 10 | | | | | 9225 |
| HPV56 | L2 | PLFEGTDT | 254 | 8 | | | | | 9226 |
| HPV56 | L2 | PLFEGTDTSL | 254 | 10 | | | | | 9227 |
| HPV56 | L2 | PLFEGTDTSLA | 254 | 11 | | | | | 9228 |
| HPV56 | L2 | PLFIDPPV | 160 | 8 | | | | | 9229 |
| HPV56 | L2 | PLFIDPPVI | 160 | 9 | | | | | 9230 |
| HPV56 | L2 | PLFIDPPVIEA | 160 | 11 | | | | | 9231 |
| HPV56 | L2 | PLGNVWET | 392 | 8 | | | | | 9232 |
| HPV56 | L2 | PLGSRPST | 73 | 8 | | | | | 9233 |
| HPV56 | L2 | PLGSRPSTI | 73 | 9 | | | | | 9234 |
| HPV56 | L2 | PLGSRPSTIV | 73 | 10 | | | | | 9235 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | L2 | PQSPYDVT | 420 | 8 | | | | | 9236 |
| HPV56 | L2 | PQSPYDVTHDV | 420 | 11 | | | | | 9237 |
| HPV56 | L2 | PQTGEVSGNI | 171 | 10 | | | | | 9238 |
| HPV56 | L2 | PQTGEVSGNIL | 171 | 11 | | | | | 9239 |
| HPV56 | L2 | PTDPSIVT | 98 | 8 | | | | | 9240 |
| HPV56 | L2 | PTDPSIVTL | 98 | 9 | | | | | 9241 |
| HPV56 | L2 | PTDPSIVTLV | 98 | 10 | | | | | 9242 |
| HPV56 | L2 | PTGPSTWPFV | 410 | 10 | | | | | 9243 |
| HPV56 | L2 | PTSGIHSYEEI | 185 | 11 | | | | | 9244 |
| HPV56 | L2 | PTSSTVHV | 145 | 8 | | | | | 9245 |
| HPV56 | L2 | PTSSTVHVSST | 145 | 11 | | | | | 9246 |
| HPV56 | L2 | PVIEAPQT | 166 | 8 | | | | | 9247 |
| HPV56 | L2 | PVIEAPQTGEV | 166 | 11 | | | | | 9248 |
| HPV56 | L2 | QAEEIEMQPL | 328 | 10 | | | | | 9249 |
| HPV56 | L2 | QAEEIEMQPLL | 328 | 11 | | | | | 9250 |
| HPV56 | L2 | QLYKTCKL | 16 | 8 | | | | | 9251 |
| HPV56 | L2 | QLYKTCKLSGT | 16 | 11 | | | | | 9252 |
| HPV56 | L2 | QQVKVTDPA | 232 | 9 | | | | | 9253 |
| HPV56 | L2 | QQVKVTDPAFL | 232 | 11 | | | | | 9254 |
| HPV56 | L2 | QTFAVHGSGT | 198 | 10 | | | | | 9255 |
| HPV56 | L2 | QTGEVSGNI | 172 | 9 | | | | | 9256 |
| HPV56 | L2 | QTGEVSGNIL | 172 | 10 | | | | | 9257 |
| HPV56 | L2 | QTGEVSGNILI | 172 | 11 | | | | | 9258 |
| HPV56 | L2 | QTRRGTQI | 306 | 8 | | | | | 9259 |
| HPV56 | L2 | QTRRGTQIGA | 306 | 10 | | | | | 9260 |
| HPV56 | L2 | QVKVTDPA | 233 | 8 | | | | | 9261 |
| HPV56 | L2 | QVKVTDPAFL | 233 | 10 | | | | | 9262 |
| HPV56 | L2 | RASATQLYKT | 11 | 10 | | | | | 9263 |
| HPV56 | L2 | RATRRKRA | 5 | 8 | | | | | 9264 |
| HPV56 | L2 | RATRRKRASA | 5 | 10 | | | | | 9265 |
| HPV56 | L2 | RATRRKRASAT | 5 | 11 | | | | | 9266 |
| HPV56 | L2 | RIAAPRLYRKA | 220 | 11 | | | | | 9267 |
| HPV56 | L2 | RIPYFFADGDV | 452 | 11 | | | | | 9268 |
| HPV56 | L2 | RLGRKATI | 298 | 8 | | | | | 9269 |
| HPV56 | L2 | RLGRKATIQT | 298 | 10 | | | | | 9270 |
| HPV56 | L2 | RLYRKAFQQV | 225 | 10 | | | | | 9271 |
| HPV56 | L2 | RVHYYYDI | 316 | 8 | | | | | 9272 |
| HPV56 | L2 | RVHYYYDISPI | 316 | 11 | | | | | 9273 |
| HPV56 | L2 | SADNPLFEGT | 250 | 10 | | | | | 9274 |
| HPV56 | L2 | SAHLPIKPST | 370 | 10 | | | | | 9275 |
| HPV56 | L2 | SAHLPIKPSTL | 370 | 11 | | | | | 9276 |
| HPV56 | L2 | SANNSFDGL | 339 | 9 | | | | | 9277 |
| HPV56 | L2 | SATQLYKT | 13 | 8 | | | | | 9278 |
| HPV56 | L2 | SATQLYKTCKL | 13 | 11 | | | | | 9279 |
| HPV56 | L2 | SIVTLVEESSV | 102 | 11 | | | | | 9280 |
| HPV56 | L2 | SLAFSPSGV | 262 | 9 | | | | | 9281 |
| HPV56 | L2 | SLAFSPSGVA | 262 | 10 | | | | | 9282 |
| HPV56 | L2 | SLFTYFGGL | 49 | 9 | | | | | 9283 |
| HPV56 | L2 | SLFTYFGGLGI | 49 | 11 | | | | | 9284 |
| HPV56 | L2 | SQSVATPSA | 363 | 9 | | | | | 9285 |
| HPV56 | L2 | SQSVATPSAHL | 363 | 11 | | | | | 9286 |
| HPV56 | L2 | STHITNPL | 154 | 8 | | | | | 9287 |
| HPV56 | L2 | STHITNPLFI | 154 | 10 | | | | | 9288 |
| HPV56 | L2 | STIVDVTPA | 79 | 9 | | | | | 9289 |
| HPV56 | L2 | STLSFASNT | 378 | 9 | | | | | 9290 |
| HFV56 | L2 | STLSFASNTT | 378 | 10 | | | | | 9291 |
| HPV56 | L2 | STPIPGFRRI | 212 | 10 | | | | | 9292 |
| HPV56 | L2 | STPIPGFRRIA | 212 | 11 | | | | | 9293 |
| HPV56 | L2 | STTTPAVL | 134 | 8 | | | | | 9294 |
| HPV56 | L2 | STTTPAVLDI | 134 | 10 | | | | | 9295 |
| HPV56 | L2 | STTTPAVLDIT | 134 | 11 | | | | | 9296 |
| HPV56 | L2 | STVHVSST | 148 | 8 | | | | | 9297 |
| HPV56 | L2 | STVHVSSTHI | 148 | 10 | | | | | 9298 |
| HPV56 | L2 | STVHVSSTHIT | 148 | 11 | | | | | 9299 |
| HPV56 | L2 | SVATPSAHL | 365 | 9 | | | | | 9300 |
| HPV56 | L2 | SVATPSAHLPI | 365 | 11 | | | | | 9301 |
| HPV56 | L2 | SVGPTDPSI | 95 | 9 | | | | | 9302 |
| HPV56 | L2 | SVGPTDPSIV | 95 | 10 | | | | | 9303 |
| HPV56 | L2 | SVGPTDPSIVT | 95 | 11 | | | | | 9304 |
| HPV56 | L2 | SVIESGAGI | 111 | 9 | | | | | 9305 |
| HPV56 | L2 | TAPLGNVWET | 390 | 10 | | | | | 9306 |
| HPV56 | L2 | TIQTRRGT | 304 | 8 | | | | | 9307 |
| HPV56 | L2 | TIQTRRGTQI | 304 | 10 | | | | | 9308 |
| HPV56 | L2 | TIVDVTPA | 80 | 8 | | | | | 9309 |

TABLE VIII-continued

A02 Supermotif Peptides with Binding Information

| Type | Protein | Sequence | Position | No. of Amino Acids | A*0201 | A*0203 | A*0206 | A*6802 | Seq. Id. No. |
|---|---|---|---|---|---|---|---|---|---|
| HPV56 | L2 | TLSFASNT | 379 | 8 | | | | | 9310 |
| HPV56 | L2 | TLSFASNTT | 379 | 9 | | | | | 9311 |
| HPV56 | L2 | TLSFASNTTNV | 379 | 11 | | | | | 9312 |
| HPV56 | L2 | TLVEESSV | 105 | 8 | | | | | 9313 |
| HPV56 | L2 | TLVEESSVI | 105 | 9 | | | | | 9314 |
| HPV56 | L2 | TLVSADNPL | 247 | 9 | | | | | 9315 |
| HPV56 | L2 | TQLYKTCKL | 15 | 9 | | | | | 9316 |
| HPV56 | L2 | TTNVTAPL | 386 | 8 | | | | | 9317 |
| HPV56 | L2 | TTNVTAPLGNV | 386 | 11 | | | | | 9318 |
| HPV56 | L2 | TTPAVLDI | 136 | 8 | | | | | 9319 |
| HPV56 | L2 | TTPAVLDIT | 136 | 9 | | | | | 9320 |
| HPV56 | L2 | TTPAVLDITPT | 136 | 11 | | | | | 9321 |
| HPV56 | L2 | TTTPAVLDI | 135 | 9 | | | | | 9322 |
| HPV56 | L2 | TTTPAVLDIT | 135 | 10 | | | | | 9323 |
| HPV56 | L2 | TVHVSSTHI | 149 | 9 | | | | | 9324 |
| HPV56 | L2 | TVHVSSTHIT | 149 | 10 | | | | | 9325 |
| HPV56 | L2 | VAHRATRRKRA | 2 | 11 | | | | | 9326 |
| HPV56 | L2 | VALHRPAFT | 280 | 9 | | | | | 9327 |
| HPV56 | L2 | VALHRPAFTT | 280 | 10 | | | | | 9328 |
| HPV56 | L2 | VAPDPDFM | 270 | 8 | | | | | 9329 |
| HPV56 | L2 | VAPDPDFMNI | 270 | 10 | | | | | 9330 |
| HPV56 | L2 | VAPDPDFMNIV | 270 | 11 | | | | | 9331 |
| HPV56 | L2 | VATPSAHL | 366 | 8 | | | | | 9332 |
| HPV56 | L2 | VATPSAHLPI | 366 | 10 | | | | | 9333 |
| HPV56 | L2 | VIEAPQTGEV | 167 | 10 | | | | | 9334 |
| HPV56 | L2 | VIESGAGI | 112 | 8 | | | | | 9335 |
| HPV56 | L2 | VLDITPTSST | 140 | 10 | | | | | 9336 |
| HPV56 | L2 | VLDITPTSSTV | 140 | 11 | | | | | 9337 |
| HPV56 | L2 | VLPTGPST | 408 | 8 | | | | | 9338 |
| HPV56 | L2 | VTAPLGNV | 389 | 8 | | | | | 9339 |
| HPV56 | L2 | VTAPLGNVWET | 389 | 11 | | | | | 9340 |
| HPV56 | L2 | VTDPAFLDRPA | 236 | 11 | | | | | 9341 |
| HPV56 | L2 | VTLVEESSV | 104 | 9 | | | | | 9342 |
| HPV56 | L2 | VTLVEESSVI | 104 | 10 | | | | | 9343 |
| HPV56 | L2 | VTPARPPI | 84 | 8 | | | | | 9344 |
| HPV56 | L2 | VTPARPPIV | 84 | 9 | | | | | 9345 |
| HPV56 | L2 | VTPARPPIVV | 84 | 10 | | | | | 9346 |
| HPV56 | L2 | VVESVGPT | 92 | 8 | | | | | 9347 |
| HPV56 | L2 | VVNKIEQKT | 31 | 9 | | | | | 9348 |
| HPV56 | L2 | VVNKIEQKTWA | 31 | 11 | | | | | 9349 |
| HPV56 | L2 | WADKILQWGSL | 40 | 11 | | | | | 9350 |
| HPV56 | L2 | YANIDDEA | 351 | 8 | | | | | 9351 |
| HPV56 | L2 | YANIDDEAPGL | 351 | 11 | | | | | 9352 |
| HPV56 | L2 | YIQGSSFA | 431 | 8 | | | | | 9353 |
| HPV56 | L2 | YIQGSSFAL | 431 | 9 | | | | | 9354 |
| HPV56 | L2 | YVPLGSRPST | 71 | 10 | | | | | 9355 |
| HPV56 | L2 | YVPLGSRPSTI | 71 | 11 | | | | | 9356 |

TABLE IX

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV16 | E1 | AAALYWYK | 316 | 8 | | | | | | 9357 |
| HPV16 | E1 | AAMLAKFK | 205 | 8 | | | | | | 9358 |
| HPV16 | E1 | AICIEKQSR | 112 | 9 | 0.0010 | 0.0057 | | | | 9359 |
| HPV16 | E1 | ALFTAQEAK | 69 | 9 | 0.2400 | 0.4000 | | | | 9360 |
| HPV16 | E1 | ALKRFLQGIPK | 459 | 11 | | | | | | 9361 |
| HPV16 | E1 | ATMCRHYK | 406 | 8 | | | | | | 9362 |
| HPV16 | E1 | ATMCRHYKR | 406 | 9 | 0.0660 | 1.5000 | | | | 9363 |
| HPV16 | E1 | AVQVLKRK | 82 | 8 | | | | | | 9364 |
| HPV16 | E1 | CATMCRHYK | 405 | 9 | 0.0012 | 0.0098 | 0.0077 | 0.0100 | 0.0056 | 9365 |
| HPV16 | E1 | CATMCRHYKR | 405 | 10 | | | | | | 9366 |
| HPV16 | E1 | CIEKQSRAAK | 114 | 10 | | | | | | 9367 |
| HPV16 | E1 | CIEKQSRAAKR | 114 | 11 | | | | | | 9368 |
| HPV16 | E1 | CMMIEPPK | 304 | 8 | | | | | | 9369 |
| HPV16 | E1 | CMMIEPPKLR | 304 | 10 | | | | | | 9370 |
| HPV16 | E1 | CVDNNISPR | 101 | 9 | | | | | | 9371 |
| HPV16 | E1 | CVDNNISPRLK | 101 | 11 | | | | | | 9372 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV16 | E1 | DAVQVLKR | 81 | 8 | | | | | | 9373 |
| HPV16 | E1 | DAVQVLKRK | 81 | 9 | | | | | | 9374 |
| HPV16 | E1 | DIVDDSEIAYK | 368 | 11 | | | | | | 9375 |
| HPV16 | E1 | DSRWPYLHNR | 573 | 10 | | | | | | 9376 |
| HPV16 | E1 | DTNSNASAFLK | 384 | 11 | | | | | | 9377 |
| HPV16 | E1 | DTPEWIQR | 335 | 8 | | | | | | 9378 |
| HPV16 | E1 | DVKHRPLVQLK | 548 | 11 | | | | | | 9379 |
| HPV16 | E1 | ELNDKNWK | 603 | 8 | | | | | | 9380 |
| HPV16 | E1 | ELVRPFKSNK | 221 | 10 | | | | | | 9381 |
| HPV16 | E1 | ETIEKLLSK | 288 | 9 | | | | | | 9382 |
| HPV16 | E1 | ETQQMLQVEGR | 140 | 11 | | | | | | 9383 |
| HPV16 | E1 | FLKSNSQAK | 392 | 9 | 0.0013 | 0.0002 | | | | 9384 |
| HPV16 | E1 | FLQGIPKK | 463 | 8 | | | | | | 9385 |
| HPV16 | E1 | FMSFLTALK | 453 | 9 | 0.1300 | 0.2100 | | | | 9386 |
| HPV16 | E1 | FMSFLTALKR | 453 | 10 | | | | | | 9387 |
| HPV16 | E1 | FSELVRPFK | 219 | 9 | | | | | | 9388 |
| HPV16 | E1 | FTAQEAKQHR | 71 | 10 | | | | | | 9389 |
| HPV16 | E1 | GLTPSIADSIK | 242 | 11 | | | | | | 9390 |
| HPV16 | E1 | GMVVLLLVR | 272 | 9 | 0.0036 | 0.0082 | | | | 9391 |
| HPV16 | E1 | GMVVLLLVRYK | 272 | 11 | | | | | | 9392 |
| HPV16 | E1 | GSGGEGVSER | 174 | 10 | | | | | | 9393 |
| HPV16 | E1 | GSVICFVNSK | 496 | 10 | | | | | | 9394 |
| HPV16 | E1 | GVSFSELVR | 216 | 9 | 0.0011 | 0.0180 | | | | 9395 |
| HPV16 | E1 | HALFTAQEAK | 68 | 10 | | | | | | 9396 |
| HPV16 | E1 | ILLYGAANTGK | 473 | 11 | | | | | | 9397 |
| HPV16 | E1 | ILNVLKTSNAK | 194 | 11 | | | | | | 9398 |
| HPV16 | E1 | IVDDSEIAYK | 369 | 10 | | | | | | 9399 |
| HPV16 | E1 | IVKDCATMCR | 401 | 10 | | | | | | 9400 |
| HPV16 | E1 | KAAMLAKFK | 204 | 9 | 0.1100 | 0.1800 | | | | 9401 |
| HPV16 | E1 | KAICIEKQSR | 111 | 10 | | | | | | 9402 |
| HPV16 | E1 | KIVKDCATMCR | 400 | 11 | | | | | | 9403 |
| HPV16 | E1 | KSFFSRTWSR | 610 | 10 | | | | | | 9404 |
| HPV16 | E1 | KSLFGMSLMK | 483 | 10 | | | | | | 9405 |
| HPV16 | E1 | KSNSQAKIVK | 394 | 10 | | | | | | 9406 |
| HPV16 | E1 | LLLVRYKCGK | 276 | 10 | | | | | | 9407 |
| HPV16 | E1 | LLVRYKCGK | 277 | 9 | 0.0043 | 0.0033 | | | | 9408 |
| HPV16 | E1 | LLVRYKCGKNR | 277 | 11 | | | | | | 9409 |
| HPV16 | E1 | LLYGAANTGK | 474 | 10 | | | | | | 9410 |
| HPV16 | E1 | LSLHEDEDK | 620 | 9 | 0.0005 | 0.0002 | | | | 9411 |
| HPV16 | E1 | LTNILNVLK | 191 | 9 | 0.0086 | 0.4200 | | | | 9412 |
| HPV16 | E1 | LTPSIADSIK | 243 | 10 | | | | | | 9413 |
| HPV16 | E1 | LVRPFKSNK | 222 | 9 | 0.0700 | 1.8000 | | | | 9414 |
| HPV16 | E1 | LVRYKCGK | 278 | 8 | | | | | | 9415 |
| HPV16 | E1 | LVRYKCGKNR | 278 | 10 | | | | | | 9416 |
| HPV16 | E1 | LVSMDVKHR | 544 | 9 | 0.0005 | 0.0089 | | | | 9417 |
| HPV16 | E1 | MIEPPKLR | 306 | 8 | | | | | | 9418 |
| HPV16 | E1 | MMIEPPKLR | 305 | 9 | 0.0010 | 0.0086 | | | | 9419 |
| HPV16 | E1 | MSFLTALK | 454 | 8 | | | | | | 9420 |
| HPV16 | E1 | MSFLTALKR | 454 | 9 | 0.0870 | 0.0980 | | | | 9421 |
| HPV16 | E1 | MSMSQWIK | 420 | 8 | | | | | | 9422 |
| HPV16 | E1 | MSMSQWIKYR | 420 | 10 | | | | | | 9423 |
| HPV16 | E1 | MSQWIKYR | 422 | 8 | | | | | | 9424 |
| HPV16 | E1 | MSQWIKYRCDR | 422 | 11 | | | | | | 9425 |
| HPV16 | E1 | MVVLLLVR | 273 | 8 | | | | | | 9426 |
| HPV16 | E1 | MVVLLLVRYK | 273 | 10 | | | | | | 9427 |
| HPV16 | E1 | NAKAAMLAK | 202 | 9 | 0.0005 | 0.0031 | | | | 9428 |
| HPV16 | E1 | NAKAAMLAKFK | 202 | 11 | | | | | | 9429 |
| HPV16 | E1 | NINAGTDSR | 567 | 9 | 0.0005 | 0.0002 | | | | 9430 |
| HPV16 | E1 | NLVSMDVK | 543 | 8 | | | | | | 9431 |
| HPV16 | E1 | NLVSMDVKHR | 543 | 10 | | | | | | 9432 |
| HPV16 | E1 | NSNASAFLK | 386 | 9 | 0.0005 | 0.0110 | | | | 9433 |
| HPV16 | E1 | NSQAKIVK | 396 | 8 | | | | | | 9434 |
| HPV16 | E1 | NVLKTSNAK | 196 | 9 | 0.0005 | 0.0015 | | | | 9435 |
| HPV16 | E1 | PLTNILNVLK | 190 | 10 | | | | | | 9436 |
| HPV16 | E1 | PMCMMIEPPK | 302 | 10 | | | | | | 9437 |
| HPV16 | E1 | PSIADSIK | 245 | 8 | | | | | | 9438 |
| HPV16 | E1 | PVYELNDK | 600 | 8 | | | | | | 9439 |
| HPV16 | E1 | PVYELNDKNWK | 600 | 11 | | | | | | 9440 |
| HPV16 | E1 | QMLQVEGR | 143 | 8 | | | | | | 9441 |
| HPV16 | E1 | QMSMSQWIK | 419 | 9 | 0.0023 | 0.0260 | | | | 9442 |
| HPV16 | E1 | QMSMSQWIKYR | 419 | 11 | | | | | | 9443 |
| HPV16 | E1 | QSRAAKRR | 118 | 8 | | | | | | 9444 |
| HPV16 | E1 | RLKAICIEK | 109 | 9 | 0.0840 | 0.0510 | | | | 9445 |
| HPV16 | E1 | RLSLHEDEDK | 619 | 10 | | | | | | 9446 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV16 | E1 | RSTAAALYWYK | 313 | 11 | | | | | | 9447 |
| HPV16 | E1 | RVDDGGDWK | 432 | 9 | | | | | | 9448 |
| HPV16 | E1 | SAFLKSNSQAK | 390 | 11 | | | | | | 9449 |
| HPV16 | E1 | SLFGMSLMK | 484 | 9 | 0.7200 | 7.1000 | | | | 9450 |
| HPV16 | E1 | SLHEDEDK | 621 | 8 | | | | | | 9451 |
| HPV16 | E1 | SMSQWIKYR | 421 | 9 | 0.6900 | 0.0280 | | | | 9452 |
| HPV16 | E1 | STAAALYWYK | 314 | 10 | | | | | | 9453 |
| HPV16 | E1 | SVICFVNSK | 497 | 9 | 0.0005 | 0.0002 | | | | 9454 |
| HPV16 | E1 | TAAALYWYK | 315 | 9 | 0.7800 | ##### | | | | 9455 |
| HPV16 | E1 | TAQEAKQHR | 72 | 9 | 0.0005 | 0.0025 | | | | 9456 |
| HPV16 | E1 | TIEKLLSK | 289 | 8 | | | | | | 9457 |
| HPV16 | E1 | TMCRHYKR | 407 | 8 | | | | | | 9458 |
| HPV16 | E1 | TMCRHYKRAEK | 407 | 11 | | | | | | 9459 |
| HPV16 | E1 | TSNAKAAMLAK | 200 | 11 | | | | | | 9460 |
| HPV16 | E1 | TSNINAGTDSR | 565 | 11 | | | | | | 9461 |
| HPV16 | E1 | VICFVNSK | 498 | 8 | | | | | | 9462 |
| HPV16 | E1 | VLKTSNAK | 197 | 8 | | | | | | 9463 |
| HPV16 | E1 | VLLLVRYK | 275 | 8 | | | | | | 9464 |
| HPV16 | E1 | VLLLVRYKCGK | 275 | 11 | | | | | | 9465 |
| HPV16 | E1 | VSFSELVR | 217 | 8 | | | | | | 9466 |
| HPV16 | E1 | VSFSELVRPFK | 217 | 11 | | | | | | 9467 |
| HPV16 | E1 | VSMDVKHR | 545 | 8 | | | | | | 9468 |
| HPV16 | E1 | VVLLLVRYK | 274 | 9 | 1.0000 | 0.3600 | | | | 9469 |
| HPV16 | E1 | WIKYRCDR | 425 | 8 | | | | | | 9470 |
| HPV16 | E1 | WLQPLADAK | 509 | 9 | 0.0005 | 0.0002 | | | | 9471 |
| HPV16 | E1 | YVEAVVEK | 20 | 8 | | | | | | 9472 |
| HPV16 | E1 | YVEAVVEKK | 20 | 9 | | | | | | 9473 |
| HPV16 | E2 | CAIYYKAR | 40 | 8 | | | | | | 9474 |
| HPV16 | E2 | CLRYRFKK | 300 | 8 | | | | | | 9475 |
| HPV16 | E2 | DAEKYSKNK | 174 | 9 | | | | | | 9476 |
| HPV16 | E2 | DANTLKCLR | 294 | 9 | | | | | | 9477 |
| HPV16 | E2 | DANTLKCLRYR | 294 | 11 | | | | | | 9478 |
| HPV16 | E2 | DLRDHIDYWK | 25 | 10 | | | | | | 9479 |
| HPV16 | E2 | DTGNPCHTTK | 246 | 10 | | | | | | 9480 |
| HPV16 | E2 | ETQTTIQR | 233 | 8 | | | | | | 9481 |
| HPV16 | E2 | ETQTTIQRPR | 233 | 10 | | | | | | 9482 |
| HPV16 | E2 | EVSSPEIIR | 204 | 9 | | | | | | 9483 |
| HPV16 | E2 | FLSQVKIPK | 346 | 9 | | | | | | 9484 |
| HPV16 | E2 | FVQFKDDAEK | 168 | 10 | | | | | | 9485 |
| HPV16 | E2 | GIRTYFVQFK | 163 | 10 | | | | | | 9486 |
| HPV16 | E2 | GLYYVHEGIR | 156 | 10 | | | | | | 9487 |
| RPV16 | E2 | GTEETQTTIQR | 230 | 11 | | | | | | 9488 |
| HPV16 | E2 | HIDYWKHMR | 29 | 9 | | | | | | 9489 |
| HPV16 | E2 | HLKGDANTLK | 290 | 10 | | | | | | 9490 |
| HPV16 | E2 | HMRLECAIYYK | 35 | 11 | | | | | | 9491 |
| HPV16 | E2 | HTTKLLHR | 252 | 8 | | | | | | 9492 |
| HPV16 | E2 | ILTAFNSSHK | 267 | 10 | | | | | | 9493 |
| HPV16 | E2 | KAREMGFK | 45 | 8 | | | | | | 9494 |
| HPV16 | E2 | LANHPAATHTK | 215 | 11 | | | | | | 9495 |
| HPV16 | E2 | LSQVKIPK | 347 | 8 | | | | | | 9496 |
| HPV16 | E2 | LTAFNSSHK | 268 | 9 | | | | | | 9497 |
| HPV16 | E2 | LTAFNSSHKGR | 268 | 11 | | | | | | 9498 |
| HPV16 | E2 | LTAPTGCIK | 103 | 9 | | | | | | 9499 |
| HPV16 | E2 | LTAPTGCIKK | 103 | 10 | | | | | | 9500 |
| HPV16 | E2 | LTYDSEWQR | 335 | 9 | | | | | | 9501 |
| HPV16 | E2 | NSNTTPIVHLK | 282 | 11 | | | | | | 9502 |
| HPV16 | E2 | NSQYSNEK | 84 | 8 | | | | | | 9503 |
| HPV16 | E2 | NTLKCLRYR | 296 | 9 | | | | | | 9504 |
| HPV16 | E2 | NTLKCLRYRFK | 296 | 11 | | | | | | 9505 |
| HPV16 | E2 | NTTPIVHLK | 284 | 9 | | | | | | 9506 |
| HPV16 | E2 | PILTAFNSSHK | 266 | 11 | | | | | | 9507 |
| HPV16 | E2 | PTLAVSKNK | 60 | 9 | | | | | | 9508 |
| HPV16 | E2 | QTTIQRPR | 235 | 8 | | | | | | 9509 |
| HPV16 | E2 | QVVPTLAVSK | 57 | 10 | | | | | | 9510 |
| HPV16 | E2 | RLECAIYYK | 37 | 9 | | | | | | 9511 |
| HPV16 | E2 | RLECAIYYKAR | 37 | 11 | | | | | | 9512 |
| HPV16 | E2 | RLNVCQDK | 7 | 8 | | | | | | 9513 |
| HPV16 | E2 | RTYFVQFK | 165 | 8 | | | | | | 9514 |
| HPV16 | E2 | STWHWTGHNVK | 317 | 11 | | | | | | 9515 |
| HPV16 | E2 | TAFNSSHK | 269 | 8 | | | | | | 9516 |
| HPV16 | E2 | TAFNSSHKGR | 269 | 10 | | | | | | 9517 |
| HPV16 | E2 | TAPTGCIK | 104 | 8 | | | | | | 9518 |
| HPV16 | E2 | TAPTGCIKK | 104 | 9 | | | | | | 9519 |
| HPV16 | E2 | TIYNSQYSNEK | 81 | 11 | | | | | | 9520 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV16 | E2 | TLAVSKNK | 61 | 8 | | | | | | 9521 |
| HPV16 | E2 | TLKCLRYR | 297 | 8 | | | | | | 9522 |
| HPV16 | E2 | TLKCLRYRFK | 297 | 10 | | | | | | 9523 |
| HPV16 | E2 | TLKCLRYRFKK | 297 | 11 | | | | | | 9524 |
| HPV16 | E2 | TLTYDSEWQR | 334 | 10 | | | | | | 9525 |
| HPV16 | E2 | TTPIVHLK | 285 | 8 | | | | | | 9526 |
| HPV16 | E2 | VSSPEIIR | 205 | 8 | | | | | | 9527 |
| HPV16 | E2 | VTLTYDSEWQR | 333 | 11 | | | | | | 9528 |
| HPV16 | E2 | VVPTLAVSK | 58 | 9 | | | | | | 9529 |
| HPV16 | E2 | VVPTLAVSKNK | 58 | 11 | | | | | | 9530 |
| HPV16 | E2 | WTGHNVKHK | 321 | 9 | | | | | | 9531 |
| HPV16 | E2 | YLTAPTGCIK | 102 | 10 | | | | | | 9532 |
| HPV16 | E2 | YLTAPTGCIKK | 102 | 11 | | | | | | 9533 |
| HPV16 | E5 | CVLLCVCLLIR | 20 | 11 | | | | | | 9534 |
| HPV16 | E5 | FLIHTHAR | 72 | 8 | | | | | | 9535 |
| HPV16 | E5 | ITAASAFR | 51 | 8 | | | | | | 9536 |
| HPV16 | E5 | LLCVCLLIR | 22 | 9 | | | | | | 9537 |
| HPV16 | E5 | LLWITAASAFR | 48 | 11 | | | | | | 9538 |
| HPV16 | E5 | PLFLIHTHAR | 70 | 10 | | | | | | 9539 |
| HPV16 | E5 | VLLCVCLLIR | 21 | 10 | | | | | | 9540 |
| HPV16 | E5 | WITAASAFR | 50 | 9 | | | | | | 9541 |
| HPV16 | E6 | AMFQDPQER | 7 | 9 | 0.0170 | 0.0320 | | | | 9542 |
| HPV16 | E6 | AMFQDPQERPR | 7 | 11 | | | | | | 9543 |
| HPV16 | E6 | AVCDKCLK | 68 | 8 | 0.0053 | 0.0110 | | | | 9544 |
| HPV16 | E6 | CMSCCRSSR | 143 | 9 | 0.0033 | 0.0001 | 0.0820 | 0.1200 | 0.0011 | 9545 |
| HPV16 | E6 | CMSCCRSSRTR | 143 | 11 | | | | | | 9546 |
| HPV16 | E6 | CVYCKQQLLR | 37 | 10 | 0.0001 | 0.0005 | | | | 9547 |
| HPV16 | E6 | CVYCKQQLLRR | 37 | 11 | | | | | | 9548 |
| HPV16 | E6 | DIILECVYCK | 32 | 10 | 0.0065 | 0.0210 | | | | 9549 |
| HPV16 | E6 | DLLIRCINCQK | 105 | 11 | | | | | | 9550 |
| HPV16 | E6 | EVYDFAFR | 48 | 8 | 0.0004 | 0.0025 | | | | 9551 |
| HPV16 | E6 | FAFRDLCIVYR | 52 | 11 | | | | | | 9552 |
| HPV16 | E6 | GTTLEQQYNK | 92 | 10 | 0.0002 | 0.0700 | | | | 9553 |
| HPV16 | E6 | IILECVYCK | 33 | 9 | 0.0016 | 0.0190 | | | | 9554 |
| HPV16 | E6 | ILECVYCK | 34 | 8 | | | | | | 9555 |
| HPV16 | E6 | LIRCINCQK | 107 | 9 | 0.0025 | 0.0009 | 0.0012 | 0.0041 | 0.0021 | 9556 |
| HPV16 | E6 | LLIRCINCQK | 106 | 10 | 0.0210 | 0.1800 | | | | 9557 |
| HPV16 | E6 | MSCCRSSR | 144 | 8 | | | | | | 9558 |
| HPV16 | E6 | MSCCRSSRTR | 144 | 10 | | | | | | 9559 |
| HPV16 | E6 | MSCCRSSRTRR | 144 | 11 | | | | | | 9560 |
| HPV16 | E6 | NIRGRWTGR | 134 | 9 | 0.0014 | 0.0005 | | | | 9561 |
| HPV16 | E6 | PLCDLLIR | 102 | 8 | | | | | | 9562 |
| HPV16 | E6 | PLCPEEKQR | 116 | 9 | 0.0002 | 0.0005 | | | | 9563 |
| HPV16 | E6 | RTAMFQDPQER | 5 | 11 | | | | | | 9564 |
| HPV16 | E6 | TAMFQDPQER | 6 | 10 | | | | | | 9565 |
| HPV16 | E6 | TLEQQYNK | 94 | 8 | | | | | | 9566 |
| HPV16 | E6 | TTLEQQYNK | 93 | 9 | 0.0100 | 0.2900 | | 0.0660 | 0.3000 | 9567 |
| HPV16 | E6 | WTGRCMSCCR | 139 | 10 | 0.0003 | 0.0008 | | | | 9568 |
| HPV16 | E6 | YAVCDKCLK | 67 | 9 | 0.0003 | 0.0010 | 0.0015 | 0.0024 | 0.0120 | 9569 |
| HPV16 | E6 | YSKJSEYR | 77 | 8 | | | | | | 9570 |
| HPV16 | E7 | CVQSTHVDIR | 68 | 10 | 0.0049 | 0.0001 | | | | 9571 |
| HPV16 | E7 | GIVCPICSQK | 88 | 10 | 0.0003 | 0.0670 | | | | 9572 |
| HPV16 | E7 | IVCPICSQK | 89 | 9 | 0.0077 | 0.0065 | | 0.0016 | 0.0100 | 9573 |
| HPV16 | E7 | NIVTFCCK | 53 | 8 | | | | | | 9574 |
| HPV16 | E7 | PAGQAEPDR | 41 | 9 | | | | | | 9575 |
| HPV16 | E7 | QSTHVDIR | 70 | 8 | | | | | | 9576 |
| HPV16 | L1 | AAISTSETTYK | 372 | 11 | | | | | | 9577 |
| HPV16 | L1 | AANAGVDNR | 162 | 9 | | | | | | 9578 |
| HPV16 | L1 | AISTSETTYK | 373 | 10 | | | | | | 9579 |
| HPV16 | L1 | AMDFTTLQANK | 233 | 11 | | | | | | 9580 |
| HPV16 | L1 | AVGHPYFPIK | 70 | 10 | | | | | | 9581 |
| HPV16 | L1 | AVGHPYFPIKK | 70 | 11 | | | | | | 9582 |
| HPV16 | L1 | CVGVEVGR | 128 | 8 | | | | | | 9583 |
| HPV16 | L1 | DICTSICK | 249 | 8 | | | | | | 9584 |
| HPV16 | L1 | DLDQFPLGR | 484 | 9 | | | | | | 9585 |
| HPV16 | L1 | DLDQFPLGRK | 484 | 10 | | | | | | 9586 |
| HPV16 | L1 | DLQFIFQLCK | 397 | 10 | | | | | | 9587 |
| HPV16 | L1 | DSLFFYLR | 270 | 8 | | | | | | 9588 |
| HPV16 | L1 | DSLFFYLRR | 270 | 9 | | | | | | 9589 |
| HPV16 | L1 | DTSFYNPDTQR | 113 | 11 | | | | | | 9590 |
| HPV16 | L1 | ETTYKNTNFK | 378 | 10 | | | | | | 9591 |
| HPV16 | L1 | FLLQAGLK | 494 | 8 | | | | | | 9592 |
| HPV16 | L1 | FLLQAGLKAK | 494 | 10 | | | | | | 9593 |
| HPV16 | L1 | FTTLQANK | 236 | 8 | | | | | | 9594 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV16 | L1 | FVRHLFNR | 282 | 8 | | | | | | 9595 |
| HPV16 | L1 | FVTSQAIACQK | 446 | 11 | | | | | | 9596 |
| HPV16 | L1 | FVTVVDTTR | 356 | 9 | | | | | | 9597 |
| HPV16 | L1 | GISGHPLLNK | 142 | 10 | | | | | | 9598 |
| HPV16 | L1 | GLQYRVFR | 93 | 8 | | | | | | 9599 |
| HPV16 | L1 | GTLEDTYR | 438 | 8 | | | | | | 9600 |
| HPV16 | L1 | ISGHPLLNK | 143 | 9 | | | | | | 9601 |
| HPV16 | L1 | ISTSETTYK | 374 | 9 | | | | | | 9602 |
| HPV16 | L1 | KAKPKFTLGK | 501 | 10 | | | | | | 9603 |
| HPV16 | L1 | KAKPKFTLGKR | 501 | 11 | | | | | | 9604 |
| HPV16 | L1 | KVSGLQYR | 90 | 8 | | | | | | 9605 |
| HPV16 | L1 | KVSGLQYRVFR | 90 | 11 | | | | | | 9606 |
| HPV16 | L1 | KVVSTDEYVAR | 46 | 11 | | | | | | 9607 |
| HPV16 | L1 | LAVGHPYFPIK | 69 | 11 | | | | | | 9608 |
| HPV16 | L1 | LLQAGLKAK | 495 | 9 | | | | | | 9609 |
| HPV16 | L1 | LLQAGLKAKPK | 495 | 11 | | | | | | 9610 |
| HPV16 | L1 | LVPKVSGLQYR | 87 | 11 | | | | | | 9611 |
| HPV16 | L1 | MVTSDAQIFNK | 325 | 11 | | | | | | 9612 |
| HPV16 | L1 | NIYYHAGTSR | 58 | 10 | | | | | | 9613 |
| HPV16 | L1 | NTNFKEYLR | 383 | 9 | | | | | | 9614 |
| HPV16 | L1 | NVPDDLYIK | 296 | 9 | | | | | | 9615 |
| HPV16 | L1 | PAPKEDPLK | 460 | 9 | | | | | | 9616 |
| HPV16 | L1 | PAPKEDPLKK | 460 | 10 | | | | | | 9617 |
| HPV16 | L1 | PIGEHWGK | 190 | 8 | | | | | | 9618 |
| HPV16 | L1 | PIKKPNNNK | 77 | 9 | | | | | | 9619 |
| HPV16 | L1 | PLDICTSICK | 247 | 10 | | | | | | 9620 |
| HPV16 | L1 | PTTSSTSTTAK | 515 | 11 | | | | | | 9621 |
| HPV16 | L1 | QAGLKAKPK | 497 | 9 | | | | | | 9622 |
| HPV16 | L1 | QIFNKPYWLQR | 331 | 11 | | | | | | 9623 |
| HPV16 | L1 | QLCLIGCK | 181 | 8 | | | | | | 9624 |
| HPV16 | L1 | QLFVTVVDTTR | 354 | 11 | | | | | | 9625 |
| HPV16 | L1 | QMFVRHLFNR | 280 | 10 | | | | | | 9626 |
| HPV16 | L1 | QTQLCLIGCK | 179 | 10 | | | | | | 9627 |
| HPV16 | L1 | RIHLPDPNK | 100 | 9 | | | | | | 9628 |
| HPV16 | L1 | SADLDQFPLGR | 482 | 11 | | | | | | 9629 |
| HPV16 | L1 | SICKYPDYIK | 253 | 10 | | | | | | 9630 |
| HPV16 | L1 | SLFFYLRR | 271 | 8 | | | | | | 9631 |
| HPV16 | L1 | SSTSTTAK | 518 | 8 | | | | | | 9632 |
| HPV16 | L1 | SSTSTTAKR | 518 | 9 | | | | | | 9633 |
| HPV16 | L1 | SSTSTTAKRK | 518 | 10 | | | | | | 9634 |
| HPV16 | L1 | SSTSTTAKRKK | 518 | 11 | | | | | | 9635 |
| HPV16 | L1 | STDEYVAR | 49 | 8 | | | | | | 9636 |
| HPV16 | L1 | STSETTYK | 375 | 8 | | | | | | 9637 |
| HPV16 | L1 | STSTTAKR | 519 | 8 | | | | | | 9638 |
| HPV16 | L1 | STSTTAKRK | 519 | 9 | | | | | | 9639 |
| HPV16 | L1 | STSTTAKRKK | 519 | 10 | | | | | | 9640 |
| HPV16 | L1 | STSTTAKRKKR | 519 | 11 | | | | | | 9641 |
| HPV16 | L1 | STTAKRKK | 521 | 8 | | | | | | 9642 |
| HPV16 | L1 | STTAKRKKR | 521 | 9 | | | | | | 9643 |
| HPV16 | L1 | STTAKRKKRK | 521 | 10 | | | | | | 9644 |
| HPV16 | L1 | TAKRKKRK | 523 | 8 | | | | | | 9645 |
| HPV16 | L1 | TSDAQIFNK | 327 | 9 | | | | | | 9646 |
| HPV16 | L1 | TSFYNPDTQR | 114 | 10 | | | | | | 9647 |
| HPV16 | L1 | TSICKYPDYIK | 252 | 11 | | | | | | 9648 |
| HPV16 | L1 | TSQAIACQK | 448 | 9 | | | | | | 9649 |
| HPV16 | L1 | TSSTSTTAK | 517 | 9 | | | | | | 9650 |
| HPV16 | L1 | TSSTSTTAKR | 517 | 10 | | | | | | 9651 |
| HPV16 | L1 | TSSTSTTAKRK | 517 | 11 | | | | | | 9652 |
| HPV16 | L1 | TSTTAKRK | 520 | 8 | | | | | | 9653 |
| HPV16 | L1 | TSTTAKRKK | 520 | 9 | | | | | | 9654 |
| HPV16 | L1 | TSTTAKRKKR | 520 | 10 | | | | | | 9655 |
| HPV16 | L1 | TSTTAKRKKRK | 520 | 11 | | | | | | 9656 |
| HPV16 | L1 | TTAKRKKR | 522 | 8 | | | | | | 9657 |
| HPV16 | L1 | TTAKRKKRK | 522 | 9 | | | | | | 9658 |
| HPV16 | L1 | TTSSTSTTAK | 516 | 10 | | | | | | 9659 |
| HPV16 | L1 | TTSSTSTTAKR | 516 | 11 | | | | | | 9660 |
| HPV16 | L1 | TTYKNTNFK | 379 | 9 | | | | | | 9661 |
| HPV16 | L1 | TVYLPPVPVSK | 36 | 11 | | | | | | 9662 |
| HPV16 | L1 | VSGLQYRVFR | 91 | 10 | | | | | | 9663 |
| HPV16 | L1 | VSTDEYVAR | 48 | 9 | | | | | | 9664 |
| HPV16 | L1 | VTSDAQIFNK | 326 | 10 | | | | | | 9665 |
| HPV16 | L1 | VTSQAIACQK | 447 | 10 | | | | | | 9666 |
| HPV16 | L1 | VTVVDTTR | 357 | 8 | | | | | | 9667 |
| HPV16 | L1 | VVSTDEYVAR | 47 | 10 | | | | | | 9668 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV16 | L1 | WACVGVEVGR | 126 | 10 | | | | | | 9669 |
| HPV16 | L1 | YAANAGVDNR | 161 | 10 | | | | | | 9670 |
| HPV16 | L1 | YLPPVPVSK | 38 | 9 | | | | | | 9671 |
| HPV16 | L1 | YLRREQMFVR | 275 | 10 | | | | | | 9672 |
| HPV16 | L1 | YTFWEVNLK | 470 | 9 | | | | | | 9673 |
| HPV16 | L1 | YTFWEVNLKEK | 470 | 11 | | | | | | 9674 |
| HPV16 | L2 | ALHRPALTSR | 288 | 10 | | | | | | 9675 |
| HPV16 | L2 | ALHRPALTSRR | 288 | 11 | | | | | | 9676 |
| HPV16 | L2 | ALTSRRTGIR | 293 | 10 | | | | | | 9677 |
| HPV16 | L2 | ASATQLYK | 13 | 8 | | | | | | 9678 |
| HPV16 | L2 | ASATQLYKTCK | 13 | 11 | | | | | | 9679 |
| HPV16 | L2 | ATDTLAPVR | 82 | 9 | | | | | | 9680 |
| HPV16 | L2 | ATQLYKTCK | 15 | 9 | | | | | | 9681 |
| HPV16 | L2 | DIIPKVEGK | 31 | 9 | | | | | | 9682 |
| HPV16 | L2 | FLDIVALHR | 283 | 9 | | | | | | 9683 |
| HPV16 | L2 | GIGTGSGTGGR | 59 | 11 | | | | | | 9684 |
| HPV16 | L2 | GIRYSRIGNK | 300 | 10 | | | | | | 9685 |
| HPV16 | L2 | GLYSRTTQQVK | 226 | 11 | | | | | | 9686 |
| HPV16 | L2 | GTCPPDIIPK | 26 | 10 | | | | | | 9687 |
| HPV16 | L2 | GTGSGTGGR | 61 | 9 | | | | | | 9688 |
| HPV16 | L2 | IIPKVEGK | 32 | 8 | | | | | | 9689 |
| HPV16 | L2 | LTSRRTGIR | 294 | 9 | | | | | | 9690 |
| HPV16 | L2 | MLRKRRKR | 454 | 8 | | | | | | 9691 |
| HPV16 | L2 | PAFITTPTK | 240 | 9 | | | | | | 9692 |
| HPV16 | L2 | PALTSRRTGIR | 292 | 11 | | | | | | 9693 |
| HPV16 | L2 | PIPGSRPVAR | 215 | 10 | | | | | | 9694 |
| HPV16 | L2 | PSYYMLRK | 450 | 8 | | | | | | 9695 |
| HPV16 | L2 | PSYYMLRKR | 450 | 9 | | | | | | 9696 |
| HPV16 | L2 | PSYYMLRKRR | 450 | 10 | | | | | | 9697 |
| HPV16 | L2 | PSYYMLRKRRK | 450 | 11 | | | | | | 9698 |
| HPV16 | L2 | PTATDTLAPVR | 80 | 11 | | | | | | 9699 |
| HPV16 | L2 | PVARLGLYSR | 221 | 10 | | | | | | 9700 |
| HPV16 | L2 | QTLRTRSGK | 310 | 9 | | | | | | 9701 |
| HPV16 | L2 | RASATQLYK | 12 | 9 | | | | | | 9702 |
| HPV16 | L2 | RIGNKQTLR | 305 | 9 | | | | | | 9703 |
| HPV16 | L2 | RIGNKQTLRTR | 305 | 11 | | | | | | 9704 |
| HPV16 | L2 | RSAKRTKR | 5 | 8 | | | | | | 9705 |
| HPV16 | L2 | RSGKSIGAK | 315 | 9 | | | | | | 9706 |
| HPV16 | L2 | RTGIRYSR | 298 | 8 | | | | | | 9707 |
| HPV16 | L2 | RTGYIPLGTR | 69 | 10 | | | | | | 9708 |
| HPV16 | L2 | RTRSGKSIGAK | 313 | 11 | | | | | | 9709 |
| HPV16 | L2 | SATQLYKTCK | 14 | 10 | | | | | | 9710 |
| HPV16 | L2 | SSTPIPGSR | 212 | 9 | | | | | | 9711 |
| HPV16 | L2 | STPIPGSR | 213 | 8 | | | | | | 9712 |
| HPV16 | L2 | TATDTLAPVR | 81 | 10 | | | | | | 9713 |
| HPV16 | L2 | TLRTRSGK | 311 | 8 | | | | | | 9714 |
| HPV16 | L2 | TSRRTGIR | 295 | 8 | | | | | | 9715 |
| HPV16 | L2 | TSRRTGIRYSR | 295 | 11 | | | | | | 9716 |
| HPV16 | L2 | TSSTPIPGSR | 211 | 10 | | | | | | 9717 |
| HPV16 | L2 | VALHRPALTSR | 287 | 11 | | | | | | 9718 |
| HPV16 | L2 | VARLGLYSR | 222 | 9 | | | | | | 9719 |
| HPV16 | L2 | VTSSTPIPGSR | 210 | 11 | | | | | | 9720 |
| HPV16 | L2 | YLHPSYYMLR | 447 | 10 | | | | | | 9721 |
| HPV16 | L2 | YLHPSYYMLRK | 447 | 11 | | | | | | 9722 |
| HPV16 | L2 | YMLRKRRK | 453 | 8 | | | | | | 9723 |
| HPV16 | L2 | YMLRKRRKR | 453 | 9 | | | | | | 9724 |
| HPV16 | L2 | YSRIGNKQTLR | 303 | 11 | | | | | | 9725 |
| HPV16 | L2 | YSRTTQQVK | 228 | 9 | | | | | | 9726 |
| HPV18 | E1 | AAFLKSNCQAK | 397 | 11 | | | | | | 9727 |
| HPV18 | E1 | ALDGNPISIDR | 546 | 11 | | | | | | 9728 |
| HPV18 | E1 | ALKSFLKGTPK | 466 | 11 | | | | | | 9729 |
| HPV18 | E1 | ALLRYKCGK | 284 | 9 | 0.0900 | 0.1400 | | | | 9730 |
| HPV18 | E1 | ALLRYKCGKSR | 284 | 11 | | | | | | 9731 |
| HPV18 | E1 | ATMCKHYR | 413 | 8 | | | | | | 9732 |
| HPV18 | E1 | ATMCKHYRR | 413 | 9 | 0.0300 | 0.2800 | | | | 9733 |
| HPV18 | E1 | CATMCKHYR | 412 | 9 | 0.0012 | 0.0110 | | | | 9734 |
| HPV18 | E1 | CATMCKHYRR | 412 | 10 | | | | | | 9735 |
| HPV18 | E1 | CMLIQPPK | 311 | 8 | | | | | | 9736 |
| HPV18 | E1 | CMLIQPPKLR | 311 | 10 | | | | | | 9737 |
| HPV18 | E1 | CSKIDEGGDWR | 437 | 11 | | | | | | 9738 |
| HPV18 | E1 | CTIAQLKDLLK | 196 | 11 | | | | | | 9739 |
| HPV18 | E1 | DAQVLHVLK | 78 | 9 | | | | | | 9740 |
| HPV18 | E1 | DAQVLHVLKR | 78 | 10 | | | | | | 9741 |
| HPV18 | E1 | DAQVLHVLKRK | 78 | 11 | | | | | | 9742 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV18 | E1 | DLLKVNNK | 203 | 8 | | | | | | 9743 |
| HPV18 | E1 | DLVRNFKSDK | 228 | 10 | | | | | | 9744 |
| HPV18 | E1 | DSNSNAAAFLK | 391 | 11 | | | | | | 9745 |
| HPV18 | E1 | DTEGNPFGTFK | 637 | 11 | | | | | | 9746 |
| HPV18 | E1 | DTPEWIQR | 342 | 8 | | | | | | 9747 |
| HPV18 | E1 | EINDKNWK | 610 | 8 | | | | | | 9748 |
| HPV18 | E1 | EISLNSGQK | 115 | 9 | | | | | | 9749 |
| HPV18 | E1 | EISLNSGQKK | 115 | 10 | | | | | | 9750 |
| HPV18 | E1 | ETCMLIQPPK | 309 | 10 | | | | | | 9751 |
| HPV18 | E1 | EVDTELSPR | 104 | 9 | | | | | | 9752 |
| HPV18 | E1 | FITFLGALK | 460 | 9 | 0.0320 | 0.0370 | | | | 9753 |
| HPV18 | E1 | FLGALKSFLK | 463 | 10 | | | | | | 9754 |
| HPV18 | E1 | FLKGTPKK | 470 | 8 | | | | | | 9755 |
| HPV18 | E1 | FLKSNCQAK | 399 | 9 | 0.0035 | 0.0007 | | | | 9756 |
| HPV18 | E1 | FTDLVRNFK | 226 | 9 | | | | | | 9757 |
| HPV18 | E1 | GALKSFLK | 465 | 8 | | | | | | 9758 |
| HPV18 | E1 | GAMLAVFK | 212 | 8 | | | | | | 9759 |
| HPV18 | E1 | GLSFTDLVR | 223 | 9 | 0.0009 | 0.0025 | | | | 9760 |
| HPV18 | E1 | GSTENSPLGER | 92 | 11 | | | | | | 9761 |
| HPV18 | E1 | GVLILALLR | 279 | 9 | 0.0058 | 0.1400 | | | | 9762 |
| HPV18 | E1 | GVLILALLRYK | 279 | 11 | | | | | | 9763 |
| HPV18 | E1 | GVNPTIAEGFK | 249 | 11 | | | | | | 9764 |
| HPV18 | E1 | HIQCLDCK | 270 | 8 | | | | | | 9765 |
| HPV18 | E1 | IAQLKDLLK | 198 | 9 | 0.0003 | 0.0027 | | | | 9766 |
| HPV18 | E1 | ILALLRYK | 282 | 8 | | | | | | 9767 |
| HPV18 | E1 | ILALLRYKCGK | 282 | 11 | | | | | | 9768 |
| HPV18 | E1 | ILLTTNIHPAK | 569 | 11 | | | | | | 9769 |
| HPV18 | E1 | ISIDRKHK | 552 | 8 | | | | | | 9770 |
| HPV18 | E1 | ISLNSGQK | 116 | 8 | | | | | | 9771 |
| HPV18 | E1 | ISLNSGQKK | 116 | 9 | 0.0003 | 0.0026 | | | | 9772 |
| HPV18 | E1 | ISLNSGQKKAK | 116 | 11 | | | | | | 9773 |
| HPV18 | E1 | ITFLGALK | 461 | 8 | | | | | | 9774 |
| HPV18 | E1 | KIDEGGDWR | 439 | 9 | | | | | | 9775 |
| HPV18 | E1 | KLRAGQNHR | 647 | 9 | 0.3000 | 0.0013 | | | | 9776 |
| HPV18 | E1 | KSFLKGTPK | 468 | 9 | 0.0003 | 0.0015 | | | | 9777 |
| HPV18 | E1 | KSFLKGTPKK | 468 | 10 | | | | | | 9778 |
| HPV18 | E1 | KSNCQAKYLK | 401 | 10 | | | | | | 9779 |
| HPV18 | E1 | KSRLTVAK | 292 | 8 | | | | | | 9780 |
| HPV18 | E1 | LALLRYKCGK | 283 | 10 | | | | | | 9781 |
| HPV18 | E1 | LILALLRYK | 281 | 9 | 0.2700 | 0.1800 | | | | 9782 |
| HPV18 | E1 | LIQPPKLR | 313 | 8 | | | | | | 9783 |
| HPV18 | E1 | LLRYKCGK | 285 | 8 | | | | | | 9784 |
| HPV18 | E1 | LLRYKCGKSR | 285 | 10 | | | | | | 9785 |
| HPV18 | E1 | LLTTNIHPAK | 570 | 10 | | | | | | 9786 |
| HPV18 | E1 | LSFTDLVR | 224 | 8 | | | | | | 9787 |
| HPV18 | E1 | LSFTDLVRNFK | 224 | 11 | | | | | | 9788 |
| HPV18 | E1 | LTTNIHPAK | 571 | 9 | 0.0910 | 0.1200 | | | | 9789 |
| HPV18 | E1 | LVFCGPANTGK | 480 | 11 | | | | | | 9790 |
| HPV18 | E1 | LVRNFKSDK | 229 | 9 | 0.0005 | 0.0002 | | | | 9791 |
| HPV18 | E1 | MLIQPPKLR | 312 | 9 | 0.0005 | 0.0014 | | | | 9792 |
| HPV18 | E1 | MSQWIRFR | 429 | 8 | | | | | | 9793 |
| HPV18 | E1 | MSQWIRFRCSK | 429 | 11 | | | | | | 9794 |
| HPV18 | E1 | NIHPAKDNR | 574 | 9 | 0.0005 | 0.0002 | | | | 9795 |
| HPV18 | E1 | NMSQWIRFR | 428 | 9 | 0.0540 | 0.0012 | | | | 9796 |
| HPV18 | E1 | NSGQKKAK | 119 | 8 | | | | | | 9797 |
| HPV18 | E1 | NSGQKKAKR | 119 | 9 | 0.0005 | 0.0002 | | | | 9798 |
| HPV18 | E1 | NSGQKKAKRR | 119 | 10 | | | | | | 9799 |
| HPV18 | E1 | NSNAAAFLK | 393 | 9 | 0.0057 | 0.3700 | | | | 9800 |
| HPV18 | E1 | PISIDRKHK | 551 | 9 | | | | | | 9801 |
| HPV18 | E1 | PTIAEGFK | 252 | 8 | | | | | | 9802 |
| HPV18 | E1 | PVYEINDK | 607 | 8 | | | | | | 9803 |
| HPV18 | E1 | PVYEINDKNWK | 607 | 11 | | | | | | 9804 |
| HPV18 | E1 | QLKDLLKVNNK | 200 | 11 | | | | | | 9805 |
| HPV18 | E1 | QMNMSQWIR | 426 | 9 | 0.0011 | 0.0023 | | | | 9806 |
| HPV18 | E1 | QMNMSQWIRFR | 426 | 11 | | | | | | 9807 |
| HPV18 | E1 | QVLHVLKR | 80 | 8 | | | | | | 9808 |
| HPV18 | E1 | QVLHVLKRK | 80 | 9 | 0.0028 | 0.0020 | | | | 9809 |
| HPV18 | E1 | RLEVDTELSPR | 102 | 11 | | | | | | 9810 |
| HPV18 | E1 | RSSVAALYWYR | 320 | 11 | | | | | | 9811 |
| HPV18 | E1 | SLNSGQKK | 117 | 8 | | | | | | 9812 |
| HPV18 | E1 | SLNSGQKKAK | 117 | 10 | | | | | | 9813 |
| HPV18 | E1 | SLNSGQKKAKR | 117 | 11 | | | | | | 9814 |
| HPV18 | E1 | SSVAALYWYR | 321 | 10 | | | | | | 9815 |
| HPV18 | E1 | STENSPLGER | 93 | 10 | | | | | | 9816 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV18 | E1 | SVAALYWYR | 322 | 9 | 2.9000 | 8.8000 | | | | 9817 |
| HPV18 | E1 | TIAQLKDLLK | 197 | 10 | | | | | | 9818 |
| HPV18 | E1 | TMCKHYRR | 414 | 8 | | | | | | 9819 |
| HPV18 | E1 | TMCKHYRRAQK | 414 | 11 | | | | | | 9820 |
| HPV18 | E1 | TTNIHPAK | 572 | 8 | | | | | | 9821 |
| HPV18 | E1 | TTNIHPAKDNR | 572 | 11 | | | | | | 9822 |
| HPV18 | E1 | VAALYWYR | 323 | 8 | | | | | | 9823 |
| HPV18 | E1 | VLHVLKRK | 81 | 8 | | | | | | 9824 |
| HPV18 | E1 | VLILALLR | 280 | 8 | | | | | | 9825 |
| HPV18 | E1 | VLILALLRYK | 280 | 10 | | | | | | 9826 |
| HPV18 | E1 | VMGDTPEWIQR | 339 | 11 | | | | | | 9827 |
| HPV18 | E1 | WIRFRCSK | 432 | 8 | | | | | | 9828 |
| HPV18 | E1 | WLEPLTDTK | 516 | 9 | | | | | | 9829 |
| HPV18 | E1 | WTYFDTYMR | 536 | 9 | 0.0005 | 0.0120 | | | | 9830 |
| HPV18 | E1 | YAHIQCLDCK | 268 | 10 | | | | | | 9831 |
| HPV18 | E1 | YLKDCATMCK | 408 | 10 | | | | | | 9832 |
| HPV18 | E1 | YVQAIVDK | 19 | 8 | | | | | | 9833 |
| HPV18 | E1 | YVQAIVDKK | 19 | 9 | 0.0005 | 0.0290 | | | | 9834 |
| HPV18 | E2 | AATPTGNNK | 269 | 9 | | | | | | 9835 |
| HPV18 | E2 | AATPTGNNKR | 269 | 10 | | | | | | 9836 |
| HPV18 | E2 | AATPTGNNKRR | 269 | 11 | | | | | | 9837 |
| HPV18 | E2 | ALQGLAQSR | 82 | 9 | | | | | | 9838 |
| HPV18 | E2 | ALQGLAQSRYK | 82 | 11 | | | | | | 9839 |
| HPV18 | E2 | ATPTGNNK | 270 | 8 | | | | | | 9840 |
| HPV18 | E2 | ATPTGNNKR | 270 | 9 | | | | | | 9841 |
| HPV18 | E2 | ATPTGNNKRR | 270 | 10 | | | | | | 9842 |
| HPV18 | E2 | ATPTGNNKRRK | 270 | 11 | | | | | | 9843 |
| HPV18 | E2 | CLRYRLRK | 301 | 8 | | | | | | 9844 |
| HPV18 | E2 | CVSHRGLYYVK | 156 | 11 | | | | | | 9845 |
| HPV18 | E2 | DSQIQYWQLIR | 31 | 11 | | | | | | 9846 |
| HPV18 | E2 | DTVSATQLVK | 210 | 10 | | | | | | 9847 |
| HPV18 | E2 | GAATPTGNNK | 268 | 10 | | | | | | 9848 |
| HPV18 | E2 | GAATPTGNNKR | 268 | 11 | | | | | | 9849 |
| HPV18 | E2 | GLAQSRYK | 85 | 8 | | | | | | 9850 |
| HPV18 | E2 | HLKGDRNSLK | 291 | 10 | | | | | | 9851 |
| HPV18 | E2 | HSETQRTK | 338 | 8 | | | | | | 9852 |
| HPV18 | E2 | IIDHYENDSK | 19 | 10 | | | | | | 9853 |
| HPV18 | E2 | IIHLKGDR | 289 | 8 | | | | | | 9854 |
| HPV18 | E2 | ISKSKAHK | 68 | 8 | | | | | | 9855 |
| HPV18 | E2 | KIIDHYENDSK | 18 | 11 | | | | | | 9856 |
| HPV18 | E2 | KTATCVSHR | 152 | 9 | | | | | | 9857 |
| HPV18 | E2 | KTYGQTSAATR | 238 | 11 | | | | | | 9858 |
| HPV18 | E2 | LSERLSCVQDK | 8 | 11 | | | | | | 9859 |
| HPV18 | E2 | LTVTYHSETQR | 333 | 11 | | | | | | 9860 |
| HPV18 | E2 | MALQGLAQSR | 81 | 10 | | | | | | 9861 |
| HPV18 | E2 | MTDAGTWDK | 144 | 9 | | | | | | 9862 |
| HPV18 | E2 | NAIFFAAR | 44 | 8 | | | | | | 9863 |
| HPV18 | E2 | NISKSKAHK | 67 | 9 | | | | | | 9864 |
| HPV18 | E2 | NSLKCLRYR | 297 | 9 | | | | | | 9865 |
| HPV18 | E2 | NSLKCLRYRLR | 297 | 11 | | | | | | 9866 |
| HPV18 | E2 | NTEPTHCFK | 107 | 9 | | | | | | 9867 |
| HPV18 | E2 | NTEPTHCFKK | 107 | 10 | | | | | | 9868 |
| HPV18 | E2 | NTFYIEFK | 170 | 8 | | | | | | 9869 |
| HPV18 | E2 | NTTPIIHLK | 285 | 9 | | | | | | 9870 |
| HPV18 | E2 | PAYNISKSK | 64 | 9 | | | | | | 9871 |
| HPV18 | E2 | PIIHLKGDR | 288 | 9 | | | | | | 9872 |
| HPV18 | E2 | PTGNNKRR | 272 | 8 | | | | | | 9873 |
| HPV18 | E2 | PTGNNKRRK | 272 | 9 | | | | | | 9874 |
| HPV18 | E2 | QIQYWQLIR | 33 | 9 | | | | | | 9875 |
| HPV18 | E2 | QMALQGLAQSR | 80 | 11 | | | | | | 9876 |
| HPV18 | E2 | QTPKETLSER | 2 | 10 | | | | | | 9877 |
| HPV18 | E2 | QTVQVYFDGNK | 119 | 11 | | | | | | 9878 |
| HPV18 | E2 | QVVPAYNISK | 61 | 10 | | | | | | 9879 |
| HPV18 | E2 | QVYFDGNK | 122 | 8 | | | | | | 9880 |
| HPV18 | E2 | RLRKHSDHYR | 305 | 10 | | | | | | 9881 |
| HPV18 | E2 | RLSCVQDK | 11 | 8 | | | | | | 9882 |
| HPV18 | E2 | SLKCLRYR | 298 | 8 | | | | | | 9883 |
| HPV18 | E2 | SLKCLRYRLR | 298 | 10 | | | | | | 9884 |
| HPV18 | E2 | SLKCLRYRLRK | 298 | 11 | | | | | | 9885 |
| HPV18 | E2 | SSTVSVGTAK | 229 | 10 | | | | | | 9886 |
| HPV18 | E2 | STVSVGTAK | 230 | 9 | | | | | | 9887 |
| HPV18 | E2 | TATCVSHR | 153 | 8 | | | | | | 9888 |
| HPV18 | E2 | TTPIIHLK | 286 | 8 | | | | | | 9889 |
| HPV18 | E2 | TTPIIHLKGDR | 286 | 11 | | | | | | 9890 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV18 | E2 | TVQVYFDGNK | 120 | 10 | | | | | | 9891 |
| HPV18 | E2 | TVSATQLVK | 211 | 9 | | | | | | 9892 |
| HPV18 | E2 | TVSVGTAK | 231 | 8 | | | | | | 9893 |
| HPV18 | E2 | TVTYHSETQR | 334 | 10 | | | | | | 9894 |
| HPV18 | E2 | VSATQLVK | 212 | 8 | | | | | | 9895 |
| HPV18 | E2 | VSHRGLYYVK | 157 | 10 | | | | | | 9896 |
| HPV18 | E2 | VTYHSETQR | 335 | 9 | | | | | | 9897 |
| HPV18 | E2 | VTYHSETQRTK | 335 | 11 | | | | | | 9898 |
| HPV18 | E2 | VVPAYNISK | 62 | 9 | | | | | | 9899 |
| HPV18 | E2 | VVPAYNISKSK | 62 | 11 | | | | | | 9900 |
| HPV18 | E2 | WTGAGNEK | 322 | 8 | | | | | | 9901 |
| HPV18 | E2 | YIEFKSECEK | 173 | 10 | | | | | | 9902 |
| HPV18 | E2 | YMTDAGTWDK | 143 | 10 | | | | | | 9903 |
| HPV18 | E2 | YSSTVSVGTAK | 228 | 11 | | | | | | 9904 |
| HPV18 | E6 | CIDFYSRIR | 68 | 9 | 0.0001 | 0.0001 | | | | 9905 |
| HPV18 | E6 | DIEIITCVYCK | 27 | 10 | 0.0089 | 0.0021 | | | | 9906 |
| HPV18 | E6 | DSIPHAACHK | 58 | 10 | | | | | | 9907 |
| HPV18 | E6 | SDVYGDTLEK | 83 | 10 | 0.0005 | 0.0051 | | | | 9908 |
| HPV18 | E6 | EITCVYCK | 29 | 8 | | | | | | 9909 |
| HPV18 | E6 | ELTEVFEFAFK | 40 | 11 | | | | | | 9910 |
| HPV18 | E6 | EVFEFAFK | 43 | 8 | 0.0025 | 0.0180 | | | | 9911 |
| HPV18 | E6 | FAFKDLFVVYR | 47 | 11 | | | | | | 9912 |
| HPV18 | E6 | GLYNLLIR | 97 | 8 | | | | | | 9913 |
| HPV18 | E6 | GLYNLLIRCLR | 97 | 11 | | | | | | 9914 |
| HPV18 | E6 | HSCCNRAR | 139 | 8 | | | | | | 9915 |
| HPV18 | E6 | HSCCNRARQER | 139 | 11 | | | | | | 9916 |
| HPV18 | E6 | KLRHLNEK | 117 | 8 | | | | | | 9917 |
| HPV18 | E6 | KLRHLNEKR | 117 | 9 | 0.0250 | 0.0005 | | | | 9918 |
| HPV18 | E6 | KLRHLNEKRR | 117 | 10 | 0.0130 | 0.0001 | | | | 9919 |
| HPV18 | E6 | LIRCLRCQK | 102 | 9 | 0.0190 | 0.0012 | | | | 9920 |
| HPV18 | E6 | LLIRCLRCQK | 101 | 10 | 0.0470 | 0.1200 | | | | 9921 |
| HPV18 | E6 | LTEVFEFAFK | 41 | 10 | 0.0001 | 0.0360 | | | | 9922 |
| HPV18 | E6 | MARFEDPTR | 1 | 9 | | | | | | 9923 |
| HPV18 | E6 | MARFEDPTRR | 1 | 10 | | | | | | 9924 |
| HPV18 | E6 | NLLIRCLR | 100 | 8 | | | | | | 9925 |
| HPV18 | E6 | NLLIRCLRCQK | 100 | 11 | | | | | | 9926 |
| HPV18 | E6 | NTGLYNLLIR | 95 | 10 | 0.0002 | 0.0013 | | | | 9927 |
| HPV18 | E6 | PAEKLRHLNEK | 114 | 11 | | | | | | 9928 |
| HPV18 | E6 | PLNPAEKLR | 111 | 9 | 0.0002 | 0.0005 | | | | 9929 |
| HPV18 | E6 | RARQERLQR | 144 | 9 | 0.0007 | 0.0002 | | | | 9930 |
| HPV18 | E6 | RARQERLQRR | 144 | 10 | | | | | | 9931 |
| HPV18 | E6 | RARQERLQRRR | 144 | 11 | | | | | | 9932 |
| HPV18 | E6 | SIPHAACHK | 59 | 9 | 0.0170 | 0.1200 | | | | 9933 |
| HPV18 | E6 | SVYGDTLEK | 84 | 9 | 0.0800 | 0.2300 | | | | 9934 |
| HPV18 | E6 | YSRIRELR | 72 | 8 | | | | | | 9935 |
| HPV18 | E7 | CMCCKCEAR | 63 | 9 | | | | | | 9936 |
| HPV18 | E7 | CMCCKCEARIK | 63 | 11 | 0.0014 | 0.0002 | | | | 9937 |
| HPV18 | E7 | ESSADDLR | 77 | 8 | | | | | | 9938 |
| HPV18 | E7 | GVNHQHLPAR | 43 | 10 | | | | | | 9939 |
| HPV18 | E7 | GVNHQHLPARR | 43 | 11 | | | | | | 9940 |
| HPV18 | E7 | HLPARRAEPQR | 48 | 11 | | | | | | 9941 |
| HPV18 | E7 | HTMLCMCCK | 59 | 9 | 0.0640 | 0.0940 | | | | 9942 |
| HPV18 | E7 | LVVESSADDLR | 74 | 11 | | | | | | 9943 |
| HPV18 | E7 | MLCMCCKCEAR | 61 | 11 | | | | | | 9944 |
| HPV18 | E7 | PARRAEPQR | 50 | 9 | | | | | | 9945 |
| HPV18 | E7 | TMLCMCCK | 60 | 8 | 0.0240 | 0.0240 | | | | 9946 |
| HPV18 | E7 | VVESSADDLR | 75 | 10 | | | | | | 9947 |
| HPV18 | L1 | AATSNVSEDVR | 195 | 11 | | | | | | 9948 |
| HPV18 | L1 | AIGEHWAK | 225 | 8 | | | | | | 9949 |
| HPV18 | L1 | AMDFSTLQDTK | 268 | 11 | | | | | | 9950 |
| HPV18 | L1 | ATKFKQYSR | 419 | 9 | | | | | | 9951 |
| HPV18 | L1 | ATSNVSEDVR | 196 | 10 | | | | | | 9952 |
| HPV18 | L1 | ATTSSKPAK | 552 | 9 | | | | | | 9953 |
| HPV18 | L1 | ATTSSKPAKR | 552 | 10 | | | | | | 9954 |
| HPV18 | L1 | CAGVEIGR | 163 | 8 | | | | | | 9955 |
| HPV18 | L1 | CAPAIGEHWAK | 222 | 11 | | | | | | 9956 |
| HPV18 | L1 | CLRREQLFAR | 310 | 10 | | | | | | 9957 |
| HPV18 | L1 | DAAPAENK | 493 | 8 | | | | | | 9958 |
| HPV18 | L1 | DATKFKQYSR | 418 | 10 | | | | | | 9959 |
| HPV18 | L1 | DICQSICK | 284 | 8 | | | | | | 9960 |
| HPV18 | L1 | DIPKVSAYQYR | 122 | 11 | | | | | | 9961 |
| HPV18 | L1 | DLDQYPLGR | 520 | 9 | | | | | | 9962 |
| HPV18 | L1 | DLDQYPLGRK | 520 | 10 | | | | | | 9963 |
| HPV18 | L1 | DSMFFCLR | 305 | 8 | | | | | | 9964 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV18 | L1 | DSMFFCLRR | 305 | 9 | | | | | | 9965 |
| HPV18 | L1 | DTSIYNPETQR | 148 | 11 | | | | | | 9966 |
| HPV18 | L1 | DTVPQSLYIK | 330 | 10 | | | | | | 9967 |
| HPV18 | L1 | DVRDNVSVDYK | 203 | 11 | | | | | | 9968 |
| HPV18 | L1 | FARHFWNR | 317 | 8 | | | | | | 9969 |
| HPV18 | L1 | FLQMALWR | 59 | 8 | | | | | | 9970 |
| HPV18 | L1 | FLVQAGLR | 530 | 8 | | | | | | 9971 |
| HPV18 | L1 | FLVQAGLRR | 530 | 9 | | | | | | 9972 |
| HPV18 | L1 | FLVQAGLRRK | 530 | 10 | | | | | | 9973 |
| HPV18 | L1 | FSTLQDTK | 271 | 8 | | | | | | 9974 |
| HPV18 | L1 | FVQSVAITCQK | 482 | 11 | | | | | | 9975 |
| HPV18 | L1 | GLRRKPTIGPR | 535 | 11 | | | | | | 9976 |
| HPV18 | L1 | GLSGHPFYNK | 177 | 10 | | | | | | 9977 |
| HPV18 | L1 | IVTSDSQLFNK | 360 | 11 | | | | | | 9978 |
| HPV18 | L1 | KLKFWNVDLK | 505 | 10 | | | | | | 9979 |
| HPV18 | L1 | KVSAYQYR | 125 | 8 | | | | | | 9980 |
| HPV18 | L1 | KVSAYQYRVFR | 125 | 11 | | | | | | 9981 |
| HPV18 | L1 | LLTVGNPYFR | 103 | 10 | | | | | | 9982 |
| HPV18 | L1 | LSGHPFYNK | 178 | 9 | | | | | | 9983 |
| HPV18 | L1 | LTVGNPYFR | 104 | 9 | | | | | | 9984 |
| HPV18 | L1 | LVQAGLRR | 531 | 8 | | | | | | 9985 |
| HPV18 | L1 | LVQAGLRRK | 531 | 9 | | | | | | 9986 |
| HPV18 | L1 | PAENKDPYDK | 496 | 10 | | | | | | 9987 |
| HPV18 | L1 | PAIGEHWAK | 224 | 9 | | | | | | 9988 |
| HPV18 | L1 | PAKRVRVR | 558 | 8 | | | | | | 9989 |
| HPV18 | L1 | PAKRVRVRAR | 558 | 10 | | | | | | 9990 |
| HPV18 | L1 | PAKRVRVRARK | 558 | 11 | | | | | | 9991 |
| HPV18 | L1 | PIFLQMALWR | 57 | 10 | | | | | | 9992 |
| HPV18 | L1 | PLDICQSICK | 282 | 10 | | | | | | 9993 |
| HPV18 | L1 | PLYGPLYHPR | 16 | 10 | | | | | | 9994 |
| HPV18 | L1 | PSATTSSK | 550 | 8 | | | | | | 9995 |
| HPV18 | L1 | PSATTSSKPAK | 550 | 11 | | | | | | 9996 |
| HPV18 | L1 | PTIGPRKR | 540 | 8 | | | | | | 9997 |
| HPV18 | L1 | PTTSLVDTYR | 472 | 10 | | | | | | 9998 |
| HPV18 | L1 | PVPGQYDATK | 412 | 10 | | | | | | 9999 |
| HPV18 | L1 | QLFARHFWNR | 315 | 10 | | | | | | 10000 |
| HPV18 | L1 | QLFNKPYWLHK | 366 | 11 | | | | | | 10001 |
| HPV18 | L1 | QSVAITCQK | 484 | 9 | | | | | | 10002 |
| HPV18 | L1 | RLLTVGNPYFR | 102 | 11 | | | | | | 10003 |
| HPV18 | L1 | RSAPSATTSSK | 547 | 11 | | | | | | 10004 |
| HPV18 | L1 | RVPAGGGNK | 112 | 9 | | | | | | 10005 |
| HPV18 | L1 | RVQLPDPNK | 135 | 9 | | | | | | 10006 |
| HPV18 | L1 | RVRVRARK | 561 | 8 | | | | | | 10007 |
| HPV18 | L1 | SAPSATTSSK | 548 | 10 | | | | | | 10008 |
| HPV18 | L1 | SATTSSKPAK | 551 | 10 | | | | | | 10009 |
| HPV18 | L1 | SATTSSKPAKR | 551 | 11 | | | | | | 10010 |
| HPV18 | L1 | SAYQYRVFR | 127 | 9 | | | | | | 10011 |
| HPV18 | L1 | SIFYHAGSSR | 93 | 10 | | | | | | 10012 |
| HPV18 | L1 | SIYNPETQR | 150 | 9 | | | | | | 10013 |
| HPV18 | L1 | SLDLDQYPLGR | 518 | 11 | | | | | | 10014 |
| HPV18 | L1 | SMFFCLRR | 306 | 8 | | | | | | 10015 |
| HPV18 | L1 | SSKPAKRVR | 555 | 9 | | | | | | 10016 |
| HPV18 | L1 | SSKPAKRVRVR | 555 | 11 | | | | | | 10017 |
| HPV18 | L1 | SVAITCQK | 485 | 8 | | | | | | 10018 |
| HPV18 | L1 | TSDSQLFNK | 362 | 9 | | | | | | 10019 |
| HPV18 | L1 | TSIFYHAGSSR | 92 | 11 | | | | | | 10020 |
| HPV18 | L1 | TSIYNPETQR | 149 | 10 | | | | | | 10021 |
| HPV18 | L1 | TSLVDTYR | 474 | 8 | | | | | | 10022 |
| HPV18 | L1 | TSNVSEDVR | 197 | 9 | | | | | | 10023 |
| HPV18 | L1 | TSSKPAKR | 554 | 8 | | | | | | 10024 |
| HPV18 | L1 | TSSKPAKRVR | 554 | 10 | | | | | | 10025 |
| HPV18 | L1 | TTSLVDTYR | 473 | 9 | | | | | | 10026 |
| HPV18 | L1 | TTSSKPAK | 553 | 8 | | | | | | 10027 |
| HPV18 | L1 | TTSSKPAKR | 553 | 9 | | | | | | 10028 |
| HPV18 | L1 | TTSSKPAKRVR | 553 | 11 | | | | | | 10029 |
| HPV18 | L1 | TVGNPYFR | 105 | 8 | | | | | | 10030 |
| HPV18 | L1 | TVPQSLYIK | 331 | 9 | | | | | | 10031 |
| HPV18 | L1 | TVYLPPPSVAR | 71 | 11 | | | | | | 10032 |
| HPV18 | L1 | VSAYQYRVFR | 126 | 10 | | | | | | 10033 |
| HPV18 | L1 | VTSDSQLFNK | 361 | 10 | | | | | | 10034 |
| HPV18 | L1 | WACAGVEIGR | 161 | 10 | | | | | | 10035 |
| HPV18 | L1 | WAKGTACK | 230 | 8 | | | | | | 10036 |
| HPV18 | L1 | WAKGTACKSR | 230 | 10 | | | | | | 10037 |
| HPV18 | L1 | YLPPPSVAR | 73 | 9 | | | | | | 10038 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV18 | L2 | ALTSRRGTVR | 286 | 10 | | | | | | 10039 |
| HPV18 | L2 | ASVTDLYK | 12 | 8 | | | | | | 10040 |
| HPV18 | L2 | ASVTDLYKTCK | 12 | 11 | | | | | | 10041 |
| HPV18 | L2 | DMDPAVPVPSR | 354 | 11 | | | | | | 10042 |
| HPV18 | L2 | DSDFMDIIR | 273 | 9 | | | | | | 10043 |
| HPV18 | L2 | DSVVTSGAPR | 109 | 11 | | | | | | 10044 |
| HPV18 | L2 | DTTLTFDPR | 260 | 9 | | | | | | 10045 |
| HPV18 | L2 | FIPKKRKR | 443 | 8 | | | | | | 10046 |
| HPV18 | L2 | FMDIIRLHR | 276 | 9 | | | | | | 10047 |
| HPV18 | L2 | FTRSGTQIGAR | 306 | 11 | | | | | | 10048 |
| HPV18 | L2 | GIGTGSGTGGR | 58 | 11 | | | | | | 10049 |
| HPV18 | L2 | GTCPPDVVPK | 25 | 10 | | | | | | 10050 |
| HPV18 | L2 | GTGSGTGGR | 60 | 9 | | | | | | 10051 |
| HPV18 | L2 | GTVRFSRLGQR | 292 | 11 | | | | | | 10052 |
| HPV18 | L2 | ISSTPLPTVR | 210 | 10 | | | | | | 10053 |
| HPV18 | L2 | ISSTPLPTVRR | 210 | 11 | | | | | | 10054 |
| HPV18 | L2 | KVEGTTLADK | 34 | 10 | | | | | | 10055 |
| HPV18 | L2 | LTSRRGTVR | 287 | 9 | | | | | | 10056 |
| HPV18 | L2 | MVSHRAAR | 1 | 8 | | | | | | 10057 |
| HPV18 | L2 | MVSHRAARR | 1 | 9 | | | | | | 10058 |
| HPV18 | L2 | MVSHRAARRK | 1 | 10 | | | | | | 10059 |
| HPV18 | L2 | MVSHRAARRKR | 1 | 11 | | | | | | 10060 |
| HPV18 | L2 | NTVVDVGPTR | 79 | 10 | | | | | | 10061 |
| HPV18 | L2 | PALTSRRGTVR | 285 | 11 | | | | | | 10062 |
| HPV18 | L2 | PAVPVPSR | 357 | 8 | | | | | | 10063 |
| HPV18 | L2 | PISSTPLPTVR | 209 | 11 | | | | | | 10064 |
| HPV18 | L2 | PLYYFIPK | 439 | 8 | | | | | | 10065 |
| HPV18 | L2 | PLYYFIPKK | 439 | 9 | | | | | | 10066 |
| HPV18 | L2 | PLYYFIPKKR | 439 | 10 | | | | | | 10067 |
| HPV18 | L2 | PLYYFIPKKRK | 439 | 11 | | | | | | 10068 |
| HPV18 | L2 | PTVRRVAGPR | 216 | 10 | | | | | | 10069 |
| HPV18 | L2 | PVDTTLTFDPR | 258 | 11 | | | | | | 10070 |
| HPV18 | L2 | RASVTDLYK | 11 | 9 | | | | | | 10071 |
| HPV18 | L2 | RLGQRATMFTR | 298 | 11 | | | | | | 10072 |
| HPV18 | L2 | RLHRPALTSR | 281 | 10 | | | | | | 10073 |
| HPV18 | L2 | RLHRPALTSRR | 281 | 11 | | | | | | 10074 |
| HPV18 | L2 | RSGTQIGAR | 308 | 9 | | | | | | 10075 |
| HPV18 | L2 | RSTTSFAFFK | 364 | 10 | | | | | | 10076 |
| HPV18 | L2 | RTGYIPLGGR | 68 | 10 | | | | | | 10077 |
| HPV18 | L2 | RVAGPRLYSR | 220 | 10 | | | | | | 10078 |
| HPV18 | L2 | SSTPLPTVR | 211 | 9 | | | | | | 10079 |
| HPV18 | L2 | SSTPLPTVRR | 211 | 10 | | | | | | 10080 |
| HPV18 | L2 | SSVVTSGAPR | 110 | 10 | | | | | | 10081 |
| HPV18 | L2 | STPLPTVR | 212 | 8 | | | | | | 10082 |
| HPV18 | L2 | STPLPTVRR | 212 | 9 | | | | | | 10083 |
| HPV18 | L2 | STTSFAFFK | 365 | 9 | | | | | | 10084 |
| HPV18 | L2 | SVANPEFLTR | 235 | 10 | | | | | | 10085 |
| HPV18 | L2 | SVTDLYKTCK | 13 | 10 | | | | | | 10086 |
| HPV18 | L2 | SVVTSGAPR | 111 | 9 | | | | | | 10087 |
| HPV18 | L2 | TSRRGTVR | 288 | 8 | | | | | | 10088 |
| HPV18 | L2 | TSRRGTVRFSR | 288 | 11 | | | | | | 10089 |
| HPV18 | L2 | TTLTFDPR | 261 | 8 | | | | | | 10090 |
| HPV18 | L2 | TTSFAFFK | 366 | 8 | | | | | | 10091 |
| HPV18 | L2 | TVRFSRLGQR | 293 | 10 | | | | | | 10092 |
| HPV18 | L2 | TVRRVAGPR | 217 | 9 | | | | | | 10093 |
| HPV18 | L2 | TVVDVGPTR | 80 | 9 | | | | | | 10094 |
| HPV18 | L2 | VAGPRLYSR | 221 | 9 | | | | | | 10095 |
| HPV18 | L2 | VANPEFLTR | 236 | 9 | | | | | | 10096 |
| HPV18 | L2 | VSHRAARR | 2 | 8 | | | | | | 10097 |
| HPV18 | L2 | VSHRAARRK | 2 | 9 | | | | | | 10098 |
| HPV18 | L2 | VSHRAARRKR | 2 | 10 | | | | | | 10099 |
| HPV18 | L2 | VSVANPEFLTR | 234 | 11 | | | | | | 10100 |
| HPV18 | L2 | VTDLYKTCK | 14 | 9 | | | | | | 10101 |
| HPV18 | L2 | VVDVGPTR | 81 | 8 | | | | | | 10102 |
| HPV18 | L2 | VVTSGAPR | 112 | 8 | | | | | | 10103 |
| HPV18 | L2 | YLWPLYYFIPK | 436 | 11 | | | | | | 10104 |
| HPV31 | E1 | AAALYWYR | 296 | 8 | | | | | | 10105 |
| HPV31 | E1 | AAMLGKFK | 185 | 8 | | | | | | 10106 |
| HPV31 | E1 | AICIENNSK | 111 | 9 | | | | | | 10107 |
| HPV31 | E1 | ALKLFLKGVPK | 439 | 11 | | | | | | 10108 |
| HPV31 | E1 | AVQVLKRK | 81 | 8 | | | | | | 10109 |
| HPV31 | E1 | CAFLKSNSQAK | 370 | 11 | | | | | | 10110 |
| HPV31 | E1 | CAKNRITIEK | 263 | 10 | | | | | | 10111 |
| HPV31 | E1 | CIENNSKTAK | 113 | 10 | | | | | | 10112 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV31 | E1 | CIENNSKTAKR | 113 | 11 | | | | | | 10113 |
| HPV31 | E1 | CIISYANSK | 477 | 9 | | | | | | 10114 |
| HPV31 | E1 | CMLIQPPK | 284 | 8 | | | | | | 10115 |
| HPV31 | E1 | CMLIQPPKLR | 284 | 10 | | | | | | 10116 |
| HPV31 | E1 | CVDYNISPR | 100 | 9 | | | | | | 10117 |
| HPV31 | E1 | CVDYNISPRLK | 100 | 11 | | | | | | 10118 |
| HPV31 | E1 | CVSGQNIR | 620 | 8 | | | | | | 10119 |
| HPV31 | E1 | DSDSNACAFLK | 364 | 11 | | | | | | 10120 |
| HPV31 | E1 | DSNACAFLK | 366 | 9 | | | | | | 10121 |
| HPV31 | E1 | DVKHKALMQLK | 528 | 11 | | | | | | 10122 |
| HPV31 | E1 | DVMDDSEIAYK | 348 | 11 | | | | | | 10123 |
| HPV31 | E1 | EAVQVLKR | 80 | 8 | | | | | | 10124 |
| HPV31 | E1 | EAVQVLKRK | 80 | 9 | | | | | | 10125 |
| HPV31 | E1 | ELIRPFQSNK | 201 | 10 | | | | | | 10126 |
| HPV31 | E1 | ELSDKNWK | 583 | 8 | | | | | | 10127 |
| HPV31 | E1 | ETPEWIER | 315 | 8 | | | | | | 10128 |
| HPV31 | E1 | FLKGVPKK | 443 | 8 | | | | | | 10129 |
| HPV31 | E1 | FLKSNSQAK | 372 | 9 | 0.0013 | 0.0002 | | | | 10130 |
| HPV31 | E1 | FLSALKLFLK | 436 | 10 | | | | | | 10131 |
| HPV31 | E1 | FTFPNPFPFDK | 566 | 11 | | | | | | 10132 |
| HPV31 | E1 | FVSFLSALK | 433 | 9 | | | | | | 10133 |
| HPV31 | E1 | GMVMLMLVR | 252 | 9 | | | | | | 10134 |
| HPV31 | E1 | GMVMLMLVRFK | 252 | 11 | | | | | | 10135 |
| HPV31 | E1 | GSDGTHSER | 157 | 9 | | | | | | 10136 |
| HPV31 | E1 | GTMCRHYK | 386 | 8 | | | | | | 10137 |
| HPV31 | E1 | GTMCRHYKR | 386 | 9 | | | | | | 10138 |
| HPV31 | E1 | GTVAEGFK | 225 | 8 | | | | | | 10139 |
| HPV31 | E1 | GVSFMELIR | 196 | 9 | | | | | | 10140 |
| HPV31 | E1 | GVTGTVAEGFK | 222 | 11 | | | | | | 10141 |
| HPV31 | E1 | HAEAVQVLK | 78 | 9 | | | | | | 10142 |
| HPV31 | E1 | HAEAVQVLKR | 78 | 10 | | | | | | 10143 |
| HPV31 | E1 | HAEAVQVLKRK | 78 | 11 | | | | | | 10144 |
| HPV31 | E1 | HSERENETPTR | 162 | 11 | | | | | | 10145 |
| HPV31 | E1 | IISYANSK | 478 | 8 | | | | | | 10146 |
| HPV31 | E1 | ILIHGAPNTGK | 453 | 11 | | | | | | 10147 |
| HPV31 | E1 | ILQVLKTSNGK | 174 | 11 | | | | | | 10148 |
| HPV31 | E1 | ITIEKLLEK | 268 | 9 | | | | | | 10149 |
| HPV31 | E1 | ITSNINAGK | 544 | 9 | | | | | | 10150 |
| HPV31 | E1 | IVKDCGTMCR | 381 | 10 | | | | | | 10151 |
| HPV31 | E1 | KAAMLGKFK | 184 | 9 | | | | | | 10152 |
| HPV31 | E1 | KAICIENNSK | 110 | 10 | | | | | | 10153 |
| HPV31 | E1 | KIVKDCGTMCR | 380 | 11 | | | | | | 10154 |
| HPV31 | E1 | KLFLKGVPK | 441 | 9 | | | | | | 10155 |
| HPV31 | E1 | KLFLKGVPKK | 441 | 10 | | | | | | 10156 |
| HPV31 | E1 | KSFFSRTWCR | 590 | 10 | | | | | | 10157 |
| HPV31 | E1 | KSNSQAKIVK | 374 | 10 | | | | | | 10158 |
| HPV31 | E1 | KVSDEGDWR | 412 | 9 | | | | | | 10159 |
| HPV31 | E1 | LIHGAPNTGK | 454 | 10 | | | | | | 10160 |
| HPV31 | E1 | LIQPPKLR | 286 | 8 | | | | | | 10161 |
| HPV31 | E1 | LIRPFQSNK | 202 | 9 | | | | | | 10162 |
| HPV31 | E1 | LITSNINAGK | 543 | 10 | | | | | | 10163 |
| HPV31 | E1 | LLITSNINAGK | 542 | 11 | | | | | | 10164 |
| HPV31 | E1 | LMLVRFKCAK | 256 | 10 | | | | | | 10165 |
| HPV31 | E1 | LSALKLFLK | 437 | 9 | | | | | | 10166 |
| HPV31 | E1 | LVRFKCAK | 258 | 8 | | | | | | 10167 |
| HPV31 | E1 | LVRFKCAKNR | 258 | 10 | | | | | | 10168 |
| HPV31 | E1 | MLIQPPKLR | 285 | 9 | 0.0005 | 0.0014 | | | | 10169 |
| HPV31 | E1 | MLMLVRFK | 255 | 8 | | | | | | 10170 |
| HPV31 | E1 | MLMLVRFKCAK | 255 | 11 | | | | | | 10171 |
| HPV31 | E1 | MLVRFKCAK | 257 | 9 | | | | | | 10172 |
| HPV31 | E1 | MLVRFKCAKNR | 257 | 11 | | | | | | 10173 |
| HPV31 | E1 | MSMGQWIK | 400 | 8 | | | | | | 10174 |
| HPV31 | E1 | MSMGQWIKSR | 400 | 10 | | | | | | 10175 |
| HPV31 | E1 | MVMLMLVR | 253 | 8 | | | | | | 10176 |
| HPV31 | E1 | MVMLMLVRFK | 253 | 10 | | | | | | 10177 |
| HPV31 | E1 | NINAGKDDR | 547 | 9 | | | | | | 10178 |
| HPV31 | E1 | NLHEEEDK | 601 | 8 | | | | | | 10179 |
| HPV31 | E1 | NSKTAKRR | 117 | 8 | | | | | | 10180 |
| HPV31 | E1 | NSQAKIVK | 376 | 8 | | | | | | 10181 |
| HPV31 | E1 | PTRNILQVLK | 170 | 10 | | | | | | 10182 |
| HPV31 | E1 | PVSIDVKHK | 524 | 9 | | | | | | 10183 |
| HPV31 | E1 | PVYELSDK | 580 | 8 | | | | | | 10184 |
| HPV31 | E1 | PVYELSDKNWK | 580 | 11 | | | | | | 10185 |
| HPV31 | E1 | QMSMGQWIK | 399 | 9 | | | | | | 10186 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV31 | E1 | QMSMGQWIKSR | 399 | 11 | | | | | | 10187 |
| HPV31 | E1 | QVLKTSNGK | 176 | 9 | | | | | | 10188 |
| HPV31 | E1 | RITIEKLLEK | 267 | 10 | | | | | | 10189 |
| HPV31 | E1 | RLNLHEEEDK | 599 | 10 | | | | | | 10190 |
| HPV31 | E1 | RSTAAALYWYR | 293 | 11 | | | | | | 10191 |
| HPV31 | E1 | SALKLFLK | 438 | 8 | | | | | | 10192 |
| HPV31 | E1 | SMGQWIKSR | 401 | 9 | | | | | | 10193 |
| HPV31 | E1 | SSCVDYNISPR | 98 | 11 | | | | | | 10194 |
| HPV31 | E1 | STAAALYWYR | 294 | 10 | | | | | | 10195 |
| HPV31 | E1 | STNCMLIQPPK | 281 | 11 | | | | | | 10196 |
| HPV31 | E1 | TAAALYWYR | 295 | 9 | | | | | | 10197 |
| HPV31 | E1 | TIEKLLEK | 269 | 8 | | | | | | 10198 |
| HPV31 | E1 | TMCRHYKR | 387 | 8 | | | | | | 10199 |
| HPV31 | E1 | TMCRHYKRAEK | 387 | 11 | | | | | | 10200 |
| HPV31 | E1 | TSNGKAAMLGK | 180 | 11 | | | | | | 10201 |
| HPV31 | E1 | TSNINAGK | 545 | 8 | | | | | | 10202 |
| HPV31 | E1 | TSNINAGKDDR | 545 | 11 | | | | | | 10203 |
| HPV31 | E1 | VLKTSNGK | 177 | 8 | | | | | | 10204 |
| HPV31 | E1 | VMDDSEIAYK | 349 | 10 | | | | | | 10205 |
| HPV31 | E1 | VMLMLVRFK | 254 | 9 | | | | | | 10206 |
| HPV31 | E1 | VSDEGDWR | 413 | 8 | | | | | | 10207 |
| HPV31 | E1 | VSFLSALK | 434 | 8 | | | | | | 10208 |
| HPV31 | E1 | VSFMELIR | 197 | 8 | | | | | | 10209 |
| HPV31 | E1 | VSIDVKHK | 525 | 8 | | | | | | 10210 |
| HPV31 | E1 | VTGTVAEGFK | 223 | 10 | | | | | | 10211 |
| HPV31 | E1 | WIKSRCDK | 405 | 8 | | | | | | 10212 |
| HPV31 | E1 | WLQPLADAK | 489 | 9 | 0.0005 | 0.0002 | | | | 10213 |
| HPV31 | E1 | YVEAVIDR | 19 | 8 | | | | | | 10214 |
| HPV31 | E2 | AAACTNQTR | 277 | 9 | | | | | | 10215 |
| HPV31 | E2 | AACTNQTR | 278 | 8 | | | | | | 10216 |
| HPV31 | E2 | ALGTSEGVR | 229 | 9 | | | | | | 10217 |
| HPV31 | E2 | ALGTSEGVRR | 229 | 10 | | | | | | 10218 |
| HPV31 | E2 | ALSVSKAK | 61 | 8 | | | | | | 10219 |
| HPV31 | E2 | ATTPIIHLK | 291 | 9 | | | | | | 10220 |
| HPV31 | E2 | ATTSTKRPR | 239 | 9 | | | | | | 10221 |
| HPV31 | E2 | CALGTSEGVR | 228 | 10 | | | | | | 10222 |
| HPV31 | E2 | CALGTSEGVRR | 228 | 11 | | | | | | 10223 |
| HPV31 | E2 | CLRYRLSK | 307 | 8 | | | | | | 10224 |
| HPV31 | E2 | CLRYRLSKYK | 307 | 10 | | | | | | 10225 |
| HPV31 | E2 | CTVVEGQVNCK | 145 | 11 | | | | | | 10226 |
| HPV31 | E2 | CVLMYKAR | 40 | 8 | | | | | | 10227 |
| HPV31 | E2 | DANILKCLR | 301 | 9 | | | | | | 10228 |
| HPV31 | E2 | DANILKCLRYR | 301 | 11 | | | | | | 10229 |
| HPV31 | E2 | EAKKYGTGK | 174 | 9 | | | | | | 10230 |
| HPV31 | E2 | EAKKYGTGKK | 174 | 10 | | | | | | 10231 |
| HPV31 | E2 | EISFAGIVTK | 204 | 10 | | | | | | 10232 |
| HPV31 | E2 | ETLNNTEYK | 80 | 9 | | | | | | 10233 |
| HPV31 | E2 | FVNFTEEAK | 168 | 9 | | | | | | 10234 |
| HPV31 | E2 | FVNFTEEAKK | 168 | 10 | | | | | | 10235 |
| HPV31 | E2 | GTSEGVRR | 231 | 8 | | | | | | 10236 |
| HPV31 | E2 | GVRRATTSTK | 235 | 10 | | | | | | 10237 |
| HPV31 | E2 | GVRRATTSTKR | 235 | 11 | | | | | | 10238 |
| HPV31 | E2 | HIDYWKHIR | 29 | 9 | | | | | | 10239 |
| HPV31 | E2 | HIRLECVLMYK | 35 | 11 | | | | | | 10240 |
| HPV31 | E2 | HLKGDANILK | 297 | 10 | | | | | | 10241 |
| HPV31 | E2 | ILEHYENDSK | 15 | 10 | | | | | | 10242 |
| HPV31 | E2 | ILEHYENDSKR | 15 | 11 | | | | | | 10243 |
| HPV31 | E2 | ILKCLRYR | 304 | 8 | | | | | | 10244 |
| HPV31 | E2 | ILKCLRYRLSK | 304 | 11 | | | | | | 10245 |
| HPV31 | E2 | ISAAACTNQTR | 275 | 11 | | | | | | 10246 |
| HPV31 | E2 | ISFAGIVTK | 205 | 9 | | | | | | 10247 |
| HPV31 | E2 | KILEHYENDSK | 14 | 11 | | | | | | 10248 |
| HPV31 | E2 | LSQRLNVCQDK | 4 | 11 | | | | | | 10249 |
| HPV31 | E2 | LTAPTGCLK | 103 | 9 | | | | | | 10250 |
| HPV31 | E2 | LTAPTGCLKK | 103 | 10 | | | | | | 10251 |
| HPV31 | E2 | LTYISTSQR | 342 | 9 | | | | | | 10252 |
| HPV31 | E2 | MLETLNNTEYK | 78 | 11 | | | | | | 10253 |
| HPV31 | E2 | NILKCLRYR | 303 | 9 | | | | | | 10254 |
| HPV31 | E2 | NTHHPNKLLR | 254 | 10 | | | | | | 10255 |
| HPV31 | E2 | NTMHYTNWK | 127 | 9 | | | | | | 10256 |
| HPV31 | E2 | NTTTSNSK | 219 | 8 | | | | | | 10257 |
| HPV31 | E2 | PALSVSKAK | 60 | 9 | | | | | | 10258 |
| HPV31 | E2 | PATTPIIHLK | 290 | 10 | | | | | | 10259 |
| HPV31 | E2 | QVVPALSVSK | 57 | 10 | | | | | | 10260 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV31 | E2 | RATTSTKR | 238 | 8 | | | | | | 10261 |
| HPV31 | E2 | RATTSTKRPR | 238 | 10 | | | | | | 10262 |
| HPV31 | E2 | RLCDHIDYWK | 25 | 10 | | | | | | 10263 |
| HPV31 | E2 | RLECVLMYK | 37 | 9 | | | | | | 10264 |
| HPV31 | E2 | RLECVLMYKAR | 37 | 11 | | | | | | 10265 |
| HPV31 | E2 | RLNVCQDK | 7 | 8 | | | | | | 10266 |
| HPV31 | E2 | SAAACTNQTR | 276 | 10 | | | | | | 10267 |
| HPV31 | E2 | STWHWTCTDGK | 324 | 11 | | | | | | 10268 |
| HPV31 | E2 | TANNTTTSNSK | 216 | 11 | | | | | | 10269 |
| HPV31 | E2 | TAPTGCLK | 104 | 8 | | | | | | 10270 |
| HPV31 | E2 | TAPTGCLKK | 104 | 9 | | | | | | 10271 |
| HPV31 | E2 | TLNNTEYK | 81 | 8 | | | | | | 10272 |
| HPV31 | E2 | TLTYISTSQR | 341 | 10 | | | | | | 10273 |
| HPV31 | E2 | TMHYTNWK | 128 | 8 | | | | | | 10274 |
| HPV31 | E2 | TTPIIHLK | 292 | 8 | | | | | | 10275 |
| HPV31 | E2 | TTSTKRPR | 240 | 8 | | | | | | 10276 |
| HPV31 | E2 | TVVEGQVNCK | 146 | 10 | | | | | | 10277 |
| HPV31 | E2 | VTLTYISTSQR | 340 | 11 | | | | | | 10278 |
| HPV31 | E2 | VVEGQVNCK | 147 | 9 | | | | | | 10279 |
| HPV31 | E2 | VVPALSVSK | 58 | 9 | | | | | | 10280 |
| HPV31 | E2 | VVPALSVSKAK | 58 | 11 | | | | | | 10281 |
| HPV31 | E2 | WTCTDGKHK | 328 | 9 | | | | | | 10282 |
| HPV31 | E2 | YLTAPTGCLK | 102 | 10 | | | | | | 10283 |
| HPV31 | E2 | YLTAPTGCLKK | 102 | 11 | | | | | | 10284 |
| HPV31 | E5 | CVLLFVCLVIR | 20 | 11 | | | | | | 10285 |
| HPV31 | E5 | ILWVIATSPLR | 48 | 11 | | | | | | 10286 |
| HPV31 | E5 | LLFVCLVIR | 22 | 9 | | | | | | 10287 |
| HPV31 | E5 | VIATSPLR | 51 | 8 | | | | | | 10288 |
| HPV31 | E5 | VLLFVCLVIR | 21 | 10 | | | | | | 10289 |
| HPV31 | E5 | WVIATSPLR | 50 | 9 | | | | | | 10290 |
| HPV31 | E6 | ALEIPYDELR | 18 | 10 | | | | | | 10291 |
| HPV31 | E6 | CIACWRRPR | 136 | 9 | | | | | | 10292 |
| HPV31 | E6 | CTKCLRFYSK | 63 | 10 | | | | | | 10293 |
| HPV31 | E6 | DLLIRCITCQR | 98 | 11 | | | | | | 10294 |
| HPV31 | E6 | DTPHGVCTK | 57 | 9 | | | | | | 10295 |
| HPV31 | E6 | EIPYDELR | 20 | 8 | | | | | | 10296 |
| HPV31 | E6 | ELRLNCVYCK | 25 | 10 | | | | | | 10297 |
| HPV31 | E6 | FAFTDLTIVYR | 45 | 11 | | | | | | 10298 |
| HPV31 | E6 | FTDLTIVYR | 47 | 9 | | | | | | 10299 |
| HPV31 | E6 | GICDLLIR | 95 | 8 | | | | | | 10300 |
| HPV31 | E6 | GTTLEKLTNK | 85 | 10 | | | | | | 10301 |
| HPV31 | E6 | GVCTKCLR | 61 | 8 | | | | | | 10302 |
| HPV31 | E6 | IACWRRPR | 137 | 8 | | | | | | 10303 |
| HPV31 | E6 | KVSEFRWYR | 72 | 9 | | | | | | 10304 |
| HPV31 | E6 | LIRCITCQR | 100 | 9 | | | | | | 10305 |
| HPV31 | E6 | LLIRCITCQR | 99 | 10 | | | | | | 10306 |
| HPV31 | E6 | NIGGRWTGR | 127 | 9 | | | | | | 10307 |
| HPV31 | E6 | PLCPEEKQR | 109 | 9 | 0.0002 | 0.0005 | | | | 10308 |
| HPV31 | E6 | RLNCVYCK | 27 | 8 | | | | | | 10309 |
| HPV31 | E6 | SALEIPYDELR | 17 | 11 | | | | | | 10310 |
| HPV31 | E6 | SVYGTTLEK | 82 | 9 | | | | | | 10311 |
| HPV31 | E6 | TLEKLTNK | 87 | 8 | | | | | | 10312 |
| HPV31 | E6 | TTLEKLTNK | 86 | 9 | | | | | | 10313 |
| HPV31 | E6 | VSEFRWYR | 73 | 8 | | | | | | 10314 |
| HPV31 | E6 | WTGRCIACWR | 132 | 10 | | | | | | 10315 |
| HPV31 | E6 | WTGRCIACWRR | 132 | 11 | | | | | | 10316 |
| HPV31 | E6 | YSKVSEFR | 70 | 8 | | | | | | 10317 |
| HPV31 | E6 | YSKVSEFRWYR | 70 | 11 | | | | | | 10318 |
| HPV31 | E6 | YSVYGTTLEK | 81 | 10 | | | | | | 10319 |
| HPV31 | E7 | CVQSTQVDIR | 68 | 10 | | | | | | 10320 |
| HPV31 | E7 | GIVCPNCSTR | 88 | 10 | | | | | | 10321 |
| HPV31 | E7 | IVCPNCSTR | 89 | 9 | | | | | | 10322 |
| HPV31 | E7 | IVTFCCQCK | 54 | 9 | | | | | | 10323 |
| HPV31 | E7 | NIVTFCCQCK | 53 | 10 | | | | | | 10324 |
| HPV31 | E7 | QSTQVDIR | 70 | 8 | | | | | | 10325 |
| HPV31 | E7 | VTFCCQCK | 55 | 8 | | | | | | 10326 |
| HPV31 | L1 | AAIANSDTTFK | 347 | 11 | | | | | | 10327 |
| HPV31 | L1 | AIANSDTTFK | 348 | 10 | | | | | | 10328 |
| HPV31 | L1 | AITCQKTAPQK | 426 | 11 | | | | | | 10329 |
| HPV31 | L1 | AMDFTALQDTK | 208 | 11 | | | | | | 10330 |
| HPV31 | L1 | ASTTTPAK | 491 | 8 | | | | | | 10331 |
| HPV31 | L1 | ASTTTPAKR | 491 | 9 | | | | | | 10332 |
| HPV31 | L1 | ASTTTPAKRK | 491 | 10 | | | | | | 10333 |
| HPV31 | L1 | ASTTTPAKRKK | 491 | 11 | | | | | | 10334 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV31 | L1 | CVGLEVGR | 103 | 8 | | | | | | 10335 |
| HPV31 | L1 | DICNSICK | 224 | 8 | | | | | | 10336 |
| HPV31 | L1 | DLDQFPLGR | 459 | 9 | | | | | | 10337 |
| HPV31 | L1 | DLDQFPLGRK | 459 | 10 | | | | | | 10338 |
| HPV31 | L1 | DLQFIFQLCK | 372 | 10 | | | | | | 10339 |
| HPV31 | L1 | DTLFFYLR | 245 | 8 | | | | | | 10340 |
| HPV31 | L1 | DTLFFYLRR | 245 | 9 | | | | | | 10341 |
| HPV31 | L1 | DTSFYNPETQR | 88 | 11 | | | | | | 10342 |
| HPV31 | L1 | DTTFKSSNFK | 353 | 10 | | | | | | 10343 |
| HPV31 | L1 | ESVPTDLYIK | 270 | 10 | | | | | | 10344 |
| HPV31 | L1 | FLLQAGYR | 469 | 8 | | | | | | 10345 |
| HPV31 | L1 | FLLQAGYRAR | 469 | 10 | | | | | | 10346 |
| HPV31 | L1 | FTALQDTK | 211 | 8 | | | | | | 10347 |
| HPV31 | L1 | FVRHFFNR | 257 | 8 | | | | | | 10348 |
| HPV31 | L1 | FVTSQAITCQK | 421 | 11 | | | | | | 10349 |
| HPV31 | L1 | FVTVVDTTR | 331 | 9 | | | | | | 10350 |
| HPV31 | L1 | GISGHPLLNK | 117 | 10 | | | | | | 10351 |
| HPV31 | L1 | GLQYRVFR | 68 | 8 | | | | | | 10352 |
| HPV31 | L1 | GLQYRVFRVR | 68 | 10 | | | | | | 10353 |
| HPV31 | L1 | GSLEDTYR | 413 | 8 | | | | | | 10354 |
| HPV31 | L1 | IANSDTTFK | 349 | 9 | | | | | | 10355 |
| HPV31 | L1 | ISGHPLLNK | 118 | 9 | | | | | | 10356 |
| HPV31 | L1 | ITCQKTAPQK | 427 | 10 | | | | | | 10357 |
| HPV31 | L1 | KSSNFKEYLR | 357 | 10 | | | | | | 10358 |
| HPV31 | L1 | KTAPQKPK | 431 | 8 | | | | | | 10359 |
| HPV31 | L1 | KVSGLQYR | 65 | 8 | | | | | | 10360 |
| HPV31 | L1 | KVSGLQYRVFR | 65 | 11 | | | | | | 10361 |
| HPV31 | L1 | KVVSTDEYVTR | 20 | 11 | | | | | | 10362 |
| HPV31 | L1 | LLQAGYRAR | 470 | 9 | | | | | | 10363 |
| HPV31 | L1 | LLQAGYRARPK | 470 | 11 | | | | | | 10364 |
| HPV31 | L1 | MVTSDAQIFNK | 300 | 11 | | | | | | 10365 |
| HPV31 | L1 | NIYYHAGSAR | 32 | 10 | | | | | | 10366 |
| HPV31 | L1 | NSICKYPDYLK | 227 | 11 | | | | | | 10367 |
| HPV31 | L1 | PAKRKKTK | 496 | 8 | | | | | | 10368 |
| HPV31 | L1 | PAKRKKTKK | 496 | 9 | | | | | | 10369 |
| HPV31 | L1 | PIGEHWGK | 165 | 8 | | | | | | 10370 |
| HPV31 | L1 | PLDICNSICK | 222 | 10 | | | | | | 10371 |
| HPV31 | L1 | PSASTTTPAK | 489 | 10 | | | | | | 10372 |
| HPV31 | L1 | PSASTTTPAKR | 489 | 11 | | | | | | 10373 |
| HPV31 | L1 | PSGSLEDTYR | 411 | 10 | | | | | | 10374 |
| HPV31 | L1 | QAGYRARPK | 472 | 9 | | | | | | 10375 |
| HPV31 | L1 | QAGYRARPKFK | 472 | 11 | | | | | | 10376 |
| HPV31 | L1 | QIFNKPYWMQR | 306 | 11 | | | | | | 10377 |
| HPV31 | L1 | QLCLLGCK | 156 | 8 | | | | | | 10378 |
| HPV31 | L1 | QLFVTVVDTTR | 329 | 11 | | | | | | 10379 |
| HPV31 | L1 | QMFVRHFFNR | 255 | 10 | | | | | | 10380 |
| HPV31 | L1 | QTQLCLLGCK | 154 | 10 | | | | | | 10381 |
| HPV31 | L1 | RARPKFKAGK | 476 | 10 | | | | | | 10382 |
| HPV31 | L1 | RARPKFKAGKR | 476 | 11 | | | | | | 10383 |
| HPV31 | L1 | RVRLPDPNK | 75 | 9 | | | | | | 10384 |
| HPV31 | L1 | SADLDQFPLGR | 457 | 11 | | | | | | 10385 |
| HPV31 | L1 | SASTTTPAK | 490 | 9 | | | | | | 10386 |
| HPV31 | L1 | SASTTTPAKR | 490 | 10 | | | | | | 10387 |
| HPV31 | L1 | SASTTTPAKRK | 490 | 11 | | | | | | 10388 |
| HPV31 | L1 | SICKYPDYLK | 228 | 10 | | | | | | 10389 |
| HPV31 | L1 | SIPKSDNPK | 51 | 9 | | | | | | 10390 |
| HPV31 | L1 | SIPKSDNPKK | 51 | 10 | | | | | | 10391 |
| HPV31 | L1 | SSNFKEYLR | 358 | 9 | | | | | | 10392 |
| HPV31 | L1 | STDEYVTR | 23 | 8 | | | | | | 10393 |
| HPV31 | L1 | STTTPAKR | 492 | 8 | | | | | | 10394 |
| HPV31 | L1 | STTTPAKRK | 492 | 9 | | | | | | 10395 |
| HPV31 | L1 | STTTPAKRKK | 492 | 10 | | | | | | 10396 |
| HPV31 | L1 | SVPTDLYIK | 271 | 9 | | | | | | 10397 |
| HPV31 | L1 | TLFFYLRR | 246 | 8 | | | | | | 10398 |
| HPV31 | L1 | TSDAQIFNK | 302 | 9 | | | | | | 10399 |
| HPV31 | L1 | TSFYNPETQR | 89 | 10 | | | | | | 10400 |
| HPV31 | L1 | TSQAITCQK | 423 | 9 | | | | | | 10401 |
| HPV31 | L1 | TTFKSSNFK | 354 | 9 | | | | | | 10402 |
| HPV31 | L1 | TTPAKRKK | 494 | 8 | | | | | | 10403 |
| HPV31 | L1 | TTPAKRKKTK | 494 | 10 | | | | | | 10404 |
| HPV31 | L1 | TTPAKRKKTKK | 494 | 11 | | | | | | 10405 |
| HPV31 | L1 | TTTPAKRK | 493 | 8 | | | | | | 10406 |
| HPV31 | L1 | TTTPAKRKK | 493 | 9 | | | | | | 10407 |
| HPV31 | L1 | TTTPAKRKKTK | 493 | 11 | | | | | | 10408 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV31 | L1 | TVGHPYYSIPK | 44 | 11 | | | | | | 10409 |
| HPV31 | L1 | TVYLPPVPVSK | 10 | 11 | | | | | | 10410 |
| HPV31 | L1 | VSGLQYRVFR | 66 | 10 | | | | | | 10411 |
| HPV31 | L1 | VSTDEYVTR | 22 | 9 | | | | | | 10412 |
| HPV31 | L1 | VTSDAQIFNK | 301 | 10 | | | | | | 10413 |
| HPV31 | L1 | VTSQAITCQK | 422 | 10 | | | | | | 10414 |
| HPV31 | L1 | VTVVDTTR | 332 | 8 | | | | | | 10415 |
| HPV31 | L1 | VVPKVSGLQYR | 62 | 11 | | | | | | 10416 |
| HPV31 | L1 | VVSTDEYVTR | 21 | 10 | | | | | | 10417 |
| HPV31 | L1 | WACVGLEVGR | 101 | 10 | | | | | | 10418 |
| HPV31 | L1 | YAGGPGTDNR | 136 | 10 | | | | | | 10419 |
| HPV31 | L1 | YLPPVPVSK | 12 | 9 | | | | | | 10420 |
| HPV31 | L1 | YLRREQMFVR | 250 | 10 | | | | | | 10421 |
| HPV31 | L1 | YSIPKSDNPK | 50 | 10 | | | | | | 10422 |
| HPV31 | L1 | YSIPKSDNPKK | 50 | 11 | | | | | | 10423 |
| HPV31 | L1 | YVFWEVNLK | 445 | 9 | | | | | | 10424 |
| HPV31 | L1 | YVFWEVNLKEK | 445 | 11 | | | | | | 10425 |
| HPV31 | L2 | ALHRPALTSR | 281 | 10 | | | | | | 10426 |
| HPV31 | L2 | ALHRPALTSRR | 281 | 11 | | | | | | 10427 |
| HPV31 | L2 | ALTSRRNTVR | 286 | 10 | | | | | | 10428 |
| HPV31 | L2 | ASATQLYQTCK | 13 | 11 | | | | | | 10429 |
| HPV31 | L2 | ATQLYQTCK | 15 | 9 | | | | | | 10430 |
| HPV31 | L2 | FLDIIALHR | 276 | 9 | | | | | | 10431 |
| HPV31 | L2 | GIGSGSGTGGR | 59 | 11 | | | | | | 10432 |
| HPV31 | L2 | GLYSKATQQVK | 221 | 11 | | | | | | 10433 |
| HPV31 | L2 | GSGSGTGGR | 61 | 9 | | | | | | 10434 |
| HPV31 | L2 | GTCPSDVIPK | 26 | 10 | | | | | | 10435 |
| HPV31 | L2 | HTTIADQILR | 38 | 10 | | | | | | 10436 |
| HPV31 | L2 | IALHRPALTSR | 280 | 11 | | | | | | 10437 |
| HPV31 | L2 | ITSSTPIPGVR | 205 | 11 | | | | | | 10438 |
| HPV31 | L2 | LTSRRNTVR | 287 | 9 | | | | | | 10439 |
| HPV31 | L2 | MLKRRRKR | 447 | 8 | | | | | | 10440 |
| HPV31 | L2 | NTVRYSRLGNK | 292 | 11 | | | | | | 10441 |
| HPV31 | L2 | PALTSRRNTVR | 285 | 11 | | | | | | 10442 |
| HPV31 | L2 | PARLGLYSK | 217 | 9 | | | | | | 10443 |
| HPV31 | L2 | PIPGVRRPAR | 210 | 10 | | | | | | 10444 |
| HPV31 | L2 | PSYYMLKR | 443 | 8 | | | | | | 10445 |
| HPV31 | L2 | PSYYMLKRR | 443 | 9 | | | | | | 10446 |
| HPV31 | L2 | PSYYMLKRRR | 443 | 10 | | | | | | 10447 |
| HPV31 | L2 | PSYYMLKRRRK | 443 | 11 | | | | | | 10448 |
| HPV31 | L2 | PTFLSAPK | 235 | 8 | | | | | | 10449 |
| HPV31 | L2 | RLGNKQTLR | 298 | 9 | | | | | | 10450 |
| HPV31 | L2 | RLGNKQTLRTR | 298 | 11 | | | | | | 10451 |
| HPV31 | L2 | RSGATIGAR | 308 | 9 | | | | | | 10452 |
| HPV31 | L2 | RSKRSTKR | 2 | 8 | | | | | | 10453 |
| HPV31 | L2 | RSKRSTKRTK | 2 | 10 | | | | | | 10454 |
| HPV31 | L2 | RSKRSTKRTKR | 2 | 11 | | | | | | 10455 |
| HPV31 | L2 | RSTKRTKR | 5 | 8 | | | | | | 10456 |
| HPV31 | L2 | RTGYVPLSTR | 69 | 10 | | | | | | 10457 |
| HPV31 | L2 | RTRSGATIGAR | 306 | 11 | | | | | | 10458 |
| HPV31 | L2 | SATQLYQTCK | 14 | 10 | | | | | | 10459 |
| HPV31 | L2 | SSTPIPGVR | 207 | 9 | | | | | | 10460 |
| HPV31 | L2 | SSTPIPGVRR | 207 | 10 | | | | | | 10461 |
| HPV31 | L2 | STPIPGVR | 208 | 8 | | | | | | 10462 |
| HPV31 | L2 | STPIPGVRR | 208 | 9 | | | | | | 10463 |
| HPV31 | L2 | STVSEASIPIR | 80 | 11 | | | | | | 10464 |
| HPV31 | L2 | TIADQILR | 40 | 8 | | | | | | 10465 |
| HPV31 | L2 | TSRRNTVR | 288 | 8 | | | | | | 10466 |
| HPV31 | L2 | TSRRNTVRYSR | 288 | 11 | | | | | | 10467 |
| HPV31 | L2 | TSSTPIPGVR | 206 | 10 | | | | | | 10468 |
| HPV31 | L2 | TSSTPIPGVRR | 206 | 11 | | | | | | 10469 |
| HPV31 | L2 | TTIADQILR | 39 | 9 | | | | | | 10470 |
| HPV31 | L2 | TVRYSRLGNK | 293 | 10 | | | | | | 10471 |
| HPV31 | L2 | TVSEASIPIR | 81 | 10 | | | | | | 10472 |
| HPV31 | L2 | VIDPTFLSAPK | 232 | 11 | | | | | | 10473 |
| HPV31 | L2 | VSEASIPIR | 82 | 9 | | | | | | 10474 |
| HPV31 | L2 | YLHPSYYMLK | 440 | 10 | | | | | | 10475 |
| HPV31 | L2 | YLHPSYYMLKR | 440 | 11 | | | | | | 10476 |
| HPV31 | L2 | YMLKRRRK | 446 | 8 | | | | | | 10477 |
| HPV31 | L2 | YMLKRRRKR | 446 | 9 | | | | | | 10478 |
| HPV31 | L2 | YSKATQQVK | 223 | 9 | | | | | | 10479 |
| HPV31 | L2 | YSRLGNKQTLR | 296 | 11 | | | | | | 10480 |
| HPV33 | E1 | AAEDVVDR | 96 | 8 | | | | | | 10481 |
| HPV33 | E1 | AAFLKSNSQAK | 383 | 11 | | | | | | 10482 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV33 | E1 | AANPCRTSINK | 104 | 11 | | | | | | 10483 |
| HPV33 | E1 | AINDENWK | 596 | 8 | | | | | | 10484 |
| HPV33 | E1 | AVCALKRK | 81 | 8 | | | | | | 10485 |
| HPV33 | E1 | CMVIEPPK | 297 | 8 | | | | | | 10486 |
| HPV33 | E1 | CMVIEPPKLR | 297 | 10 | | | | | | 10487 |
| HPV33 | E1 | CSAGENTR | 633 | 8 | | | | | | 10488 |
| HPV33 | E1 | CSAGENTRSLR | 633 | 11 | | | | | | 10489 |
| HPV33 | E1 | CSKNRLTVAK | 276 | 10 | | | | | | 10490 |
| HPV33 | E1 | CVISCVNSK | 490 | 9 | | | | | | 10491 |
| HPV33 | E1 | DLIEEEDK | 614 | 8 | | | | | | 10492 |
| HPV33 | E1 | DLNAVCALK | 78 | 9 | | | | | | 10493 |
| HPV33 | E1 | DLNAVCALKR | 78 | 10 | | | | | | 10494 |
| HPV33 | E1 | DLNAVCALKRK | 78 | 11 | | | | | | 10495 |
| HPV33 | E1 | DSNSNAAAFLK | 377 | 11 | | | | | | 10496 |
| HPV33 | E1 | DSRWPYLHSR | 566 | 10 | | | | | | 10497 |
| HPV33 | E1 | DVKHRALVQLK | 541 | 11 | | | | | | 10498 |
| HPV33 | E1 | DVVDRAANPCR | 99 | 11 | | | | | | 10499 |
| HPV33 | E1 | EISIDVKHR | 537 | 9 | | | | | | 10500 |
| HPV33 | E1 | ELVRPFKSDK | 214 | 10 | | | | | | 10501 |
| HPV33 | E1 | ESLKVLIK | 242 | 8 | | | | | | 10502 |
| HPV33 | E1 | ETCMVIEPPK | 295 | 10 | | | | | | 10503 |
| HPV33 | E1 | EVEAVIER | 19 | 8 | | | | | | 10504 |
| HPV33 | E1 | EVEAVIERR | 19 | 9 | | | | | | 10505 |
| HPV33 | E1 | FLGAFKKFLK | 449 | 10 | | | | | | 10506 |
| HPV33 | E1 | FLKGIPKK | 456 | 8 | | | | | | 10507 |
| HPV33 | E1 | FLKSNSQAK | 385 | 9 | 0.0013 | 0.0002 | | | | 10508 |
| HPV33 | E1 | FMELVRPFK | 212 | 9 | | | | | | 10509 |
| HPV33 | E1 | FTAFLGAFK | 446 | 9 | | | | | | 10510 |
| HPV33 | E1 | FTAFLGAFKK | 446 | 10 | | | | | | 10511 |
| HPV33 | E1 | GAFKKFLK | 451 | 8 | | | | | | 10512 |
| HPV33 | E1 | GIIILLIR | 265 | 9 | | | | | | 10513 |
| HPV33 | E1 | GIIILLLIRFR | 265 | 11 | | | | | | 10514 |
| HPV33 | E1 | GIMCRHYK | 399 | 8 | | | | | | 10515 |
| HPV33 | E1 | GIMCRHYKK | 399 | 9 | | | | | | 10516 |
| HPV33 | E1 | GISFMELVR | 209 | 9 | | | | | | 10517 |
| HPV33 | E1 | GISPSVAESLK | 235 | 11 | | | | | | 10518 |
| HPV33 | E1 | GMSLIQFLK | 480 | 9 | | | | | | 10519 |
| HPV33 | E1 | GTTPEWIDR | 327 | 9 | | | | | | 10520 |
| HPV33 | E1 | HLQCLTCDR | 256 | 9 | | | | | | 10521 |
| HPV33 | E1 | HSRLTVFEFK | 573 | 10 | | | | | | 10522 |
| HPV33 | E1 | IIILLIR | 266 | 8 | | | | | | 10523 |
| HPV33 | E1 | IIILLLIRFR | 266 | 10 | | | | | | 10524 |
| HPV33 | E1 | IILLLIRFR | 267 | 9 | | | | | | 10525 |
| HPV33 | E1 | ILLLIRFR | 268 | 8 | | | | | | 10526 |
| HPV33 | E1 | ILLLIRFRCSK | 268 | 11 | | | | | | 10527 |
| HPV33 | E1 | IMCRHYKK | 400 | 8 | | | | | | 10528 |
| HPV33 | E1 | IMCRHYKKAEK | 400 | 11 | | | | | | 10529 |
| HPV33 | E1 | ISFMELVR | 210 | 8 | | | | | | 10530 |
| HPV33 | E1 | ISFMELVRPFK | 210 | 11 | | | | | | 10531 |
| HPV33 | E1 | ISIDVKHR | 538 | 8 | | | | | | 10532 |
| HPV33 | E1 | ISNVLHSSNTK | 187 | 11 | | | | | | 10533 |
| HPV33 | E1 | ISPSVAESLK | 236 | 10 | | | | | | 10534 |
| HPV33 | E1 | ISWTYIDDYMR | 520 | 11 | | | | | | 10535 |
| HPV33 | E1 | IVKDCGIMCR | 394 | 10 | | | | | | 10536 |
| HPV33 | E1 | KANILYKFK | 197 | 9 | | | | | | 10537 |
| HPV33 | E1 | KIVKDCGIMCR | 393 | 11 | | | | | | 10538 |
| HPV33 | E1 | KLDLIEEEDK | 612 | 10 | | | | | | 10539 |
| HPV33 | E1 | KMSIGQWIQSR | 412 | 11 | | | | | | 10540 |
| HPV33 | E1 | KSFFSRTWCK | 603 | 10 | | | | | | 10541 |
| HPV33 | E1 | KSNSQAKIVK | 387 | 10 | | | | | | 10542 |
| HPV33 | E1 | KTNDGGNWR | 425 | 9 | | | | | | 10543 |
| HPV33 | E1 | LICGPANTGK | 467 | 10 | | | | | | 10544 |
| HPV33 | E1 | LIRFRCSK | 271 | 8 | | | | | | 10545 |
| HPV33 | E1 | LIRFRCSKNR | 271 | 10 | | | | | | 10546 |
| HPV33 | E1 | LLIRFRCSK | 270 | 9 | | | | | | 10547 |
| HPV33 | E1 | LLIRFRCSKNR | 270 | 11 | | | | | | 10548 |
| HPV33 | E1 | LLLIRFRCSK | 269 | 10 | | | | | | 10549 |
| HPV33 | E1 | LVRPFKSDK | 215 | 9 | | | | | | 10550 |
| HPV33 | E1 | MLICGPANTGK | 466 | 11 | | | | | | 10551 |
| HPV33 | E1 | MSIGQWIQSR | 413 | 10 | | | | | | 10552 |
| HPV33 | E1 | MSLIQFLK | 481 | 8 | | | | | | 10553 |
| HPV33 | E1 | MVIEPPKLR | 298 | 9 | | | | | | 10554 |
| HPV33 | E1 | NAVCALKR | 80 | 8 | | | | | | 10555 |
| HPV33 | E1 | NAVCALKRK | 80 | 9 | | | | | | 10556 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV33 | E1 | NSIQADTEAAR | 57 | 11 | | | | | | 10557 |
| HPV33 | E1 | NSNAAAFLK | 379 | 9 | 0.0057 | 0.3700 | | | | 10558 |
| HPV33 | E1 | NSQAKIVK | 389 | 8 | | | | | | 10559 |
| HPV33 | E1 | NTKANILYK | 195 | 9 | | | | | | 10560 |
| HPV33 | E1 | NTKANILYKFK | 195 | 11 | | | | | | 10561 |
| HPV33 | E1 | NTNAGTDSR | 560 | 9 | | | | | | 10562 |
| HPV33 | E1 | NVLHSSNTK | 189 | 9 | | | | | | 10563 |
| HPV33 | E1 | PSVAESLK | 238 | 8 | | | | | | 10564 |
| HPV33 | E1 | PVYAINDENWK | 593 | 11 | | | | | | 10565 |
| HPV33 | E1 | QADTEAAR | 60 | 8 | | | | | | 10566 |
| HPV33 | E1 | QSAAEDVVDR | 94 | 10 | | | | | | 10567 |
| HPV33 | E1 | QTCALYWFR | 308 | 9 | | | | | | 10568 |
| HPV33 | E1 | RLTVFEFK | 575 | 8 | | | | | | 10569 |
| HPV33 | E1 | RSQTCALYWFR | 306 | 11 | | | | | | 10570 |
| HPV33 | E1 | RTSINKNK | 109 | 8 | | | | | | 10571 |
| HPV33 | E1 | SAAEDVVDR | 95 | 9 | | | | | | 10572 |
| HPV33 | E1 | SAGENTRSLR | 634 | 10 | | | | | | 10573 |
| HPV33 | E1 | SIGQWIQSR | 414 | 9 | | | | | | 10574 |
| HPV33 | E1 | SINKNKECTYR | 111 | 11 | | | | | | 10575 |
| HPV33 | E1 | SIQADTEAAR | 58 | 10 | | | | | | 10576 |
| HPV33 | E1 | SSNTKANILYK | 193 | 11 | | | | | | 10577 |
| HPV33 | E1 | SVAESLKVLIK | 239 | 11 | | | | | | 10578 |
| HPV33 | E1 | TAFLGAFK | 447 | 8 | | | | | | 10579 |
| HPV33 | E1 | TAFLGAFKK | 447 | 9 | | | | | | 10580 |
| HPV33 | E1 | TSNTNAGTDSR | 558 | 11 | | | | | | 10581 |
| HPV33 | E1 | TTPEWIDR | 328 | 8 | | | | | | 10582 |
| HPV33 | E1 | VAESLKVLIK | 240 | 10 | | | | | | 10583 |
| HPV33 | E1 | VIEPPKLR | 299 | 8 | | | | | | 10584 |
| HPV33 | E1 | VISCVNSK | 491 | 8 | | | | | | 10585 |
| HPV33 | E1 | VLHSSNTK | 190 | 8 | | | | | | 10586 |
| HPV33 | E1 | VVDRAANPCR | 100 | 10 | | | | | | 10587 |
| HPV33 | E1 | WIQSRCEK | 418 | 8 | | | | | | 10588 |
| HPV33 | E1 | WLQPLSDAK | 502 | 9 | | | | | | 10589 |
| HPV33 | E1 | WTYIDDYMR | 522 | 9 | | | | | | 10590 |
| HPV33 | E1 | YAINDENWK | 595 | 9 | | | | | | 10591 |
| HPV33 | E1 | YTHLQCLTCDR | 254 | 11 | | | | | | 10592 |
| HPV33 | E2 | ALDNRTAR | 249 | 8 | | | | | | 10593 |
| HPV33 | E2 | ATNCTNKQR | 258 | 9 | | | | | | 10594 |
| HPV33 | E2 | CADPALDNR | 245 | 9 | | | | | | 10595 |
| HPV33 | E2 | CALLYTAK | 40 | 8 | | | | | | 10596 |
| HPV33 | E2 | CLRYRLKPYK | 288 | 10 | | | | | | 10597 |
| HPV33 | E2 | DIQTDNDNR | 211 | 9 | | | | | | 10598 |
| HPV33 | E2 | DLPSQIEHWK | 25 | 10 | | | | | | 10599 |
| HPV33 | E2 | DTAQPLTK | 235 | 8 | | | | | | 10600 |
| HPV33 | E2 | DTCTMVTGK | 143 | 9 | | | | | | 10601 |
| HPV33 | E2 | DTTDTAQPLTK | 232 | 11 | | | | | | 10602 |
| HPV33 | E2 | ELQMALETLSK | 74 | 11 | | | | | | 10603 |
| HPV33 | E2 | ESNSLKCLRYR | 282 | 9 | | | | | | 10604 |
| HPV33 | E2 | ESNSLKCLRYR | 282 | 11 | | | | | | 10605 |
| HPV33 | E2 | ETVTVQYDNDK | 115 | 11 | | | | | | 10606 |
| HPV33 | E2 | EVWLCEPPK | 100 | 9 | | | | | | 10607 |
| HPV33 | E2 | GMYYIHNCEK | 156 | 10 | | | | | | 10608 |
| HPV33 | E2 | HLKGESNSLK | 278 | 10 | | | | | | 10609 |
| HPV33 | E2 | ILDLYEADK | 15 | 9 | | | | | | 10610 |
| HPV33 | E2 | ISARLNAVQEK | 4 | 11 | | | | | | 10611 |
| HPV33 | E2 | KILDLYEADK | 14 | 10 | | | | | | 10612 |
| HPV33 | E2 | KVYFKYFK | 165 | 8 | | | | | | 10613 |
| HPV33 | E2 | MALETLSK | 77 | 8 | | | | | | 10614 |
| HPV33 | E2 | NSLKCLRYR | 284 | 9 | | | | | | 10615 |
| HPV33 | E2 | NSLKCLRYRLK | 284 | 11 | | | | | | 10616 |
| HPV33 | E2 | NVAPIVHLK | 272 | 9 | | | | | | 10617 |
| HPV33 | E2 | PALDNRTAR | 248 | 9 | | | | | | 10618 |
| HPV33 | E2 | PSLLASKTK | 60 | 9 | | | | | | 10619 |
| HPV33 | E2 | PSQIEHWK | 27 | 8 | | | | | | 10620 |
| HPV33 | E2 | PSQIEHWKLIR | 27 | 11 | | | | | | 10621 |
| HPV33 | E2 | QAAAKRRR | 222 | 8 | | | | | | 10622 |
| HPV33 | E2 | QIEHWKLIR | 29 | 9 | | | | | | 10623 |
| HPV33 | E2 | QMALETLSK | 76 | 9 | | | | | | 10624 |
| HPV33 | E2 | QMFLGTVK | 332 | 8 | | | | | | 10625 |
| HPV33 | E2 | QVVPSLLASK | 57 | 10 | | | | | | 10626 |
| HPV33 | E2 | RLNAVQEK | 7 | 8 | | | | | | 10627 |
| HPV33 | E2 | RMECALLYTAK | 37 | 11 | | | | | | 10628 |
| HPV33 | E2 | RTATNCTNK | 256 | 9 | | | | | | 10629 |
| HPV33 | E2 | RTATNCTNKQR | 256 | 11 | | | | | | 10630 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV33 | E2 | SARLNAVQEK | 5 | 10 | | | | | | 10631 |
| HPV33 | E2 | SLEVWLCEPPK | 98 | 11 | | | | | | 10632 |
| HPV33 | E2 | SLKCLRYR | 285 | 8 | | | | | | 10633 |
| HPV33 | E2 | SLKCLRYRLK | 285 | 10 | | | | | | 10634 |
| HPV33 | E2 | SLLASKTK | 61 | 8 | | | | | | 10635 |
| HPV33 | E2 | SSNVAPIVHLK | 270 | 11 | | | | | | 10636 |
| HPV33 | E2 | SSTWHWTSDNK | 304 | 11 | | | | | | 10637 |
| HPV33 | E2 | STWHWTSDNK | 305 | 10 | | | | | | 10638 |
| HPV33 | E2 | TADIQTDNDNR | 209 | 11 | | | | | | 10639 |
| HPV33 | E2 | TARTATNCTNK | 254 | 11 | | | | | | 10640 |
| HPV33 | E2 | TATNCTNK | 257 | 8 | | | | | | 10641 |
| HPV33 | E2 | TATNCTNKQR | 257 | 10 | | | | | | 10642 |
| HPV33 | E2 | TSDNKNSK | 310 | 8 | | | | | | 10643 |
| HPV33 | E2 | TTDTAQPLTK | 233 | 10 | | | | | | 10644 |
| HPV33 | E2 | TVQYDNDK | 118 | 8 | | | | | | 10645 |
| HPV33 | E2 | TVQYDNDKK | 118 | 9 | | | | | | 10646 |
| HPV33 | E2 | TVTVQYDNDK | 116 | 10 | | | | | | 10647 |
| HPV33 | E2 | TVTVQYDNDKK | 116 | 11 | | | | | | 10648 |
| HPV33 | E2 | VAPIVHLK | 273 | 8 | | | | | | 10649 |
| HPV33 | E2 | VTVQYDNDK | 117 | 9 | | | | | | 10650 |
| HPV33 | E2 | VTVQYDNDKK | 117 | 10 | | | | | | 10651 |
| HPV33 | E2 | VVPSLLASK | 58 | 9 | | | | | | 10652 |
| HPV33 | E2 | VVPSLLASKTK | 58 | 11 | | | | | | 10653 |
| HPV33 | E2 | WLCEPPKCFK | 102 | 10 | | | | | | 10654 |
| HPV33 | E2 | WLCEPPKCFKK | 102 | 11 | | | | | | 10655 |
| HPV33 | E2 | WTSDNKNSK | 309 | 9 | | | | | | 10656 |
| HPV33 | E2 | YIHNCEKVYFK | 159 | 11 | | | | | | 10657 |
| HPV33 | E5 | FLCLSLLLR | 12 | 9 | | | | | | 10658 |
| HPV33 | E5 | ILFLCLSLLLR | 10 | 11 | | | | | | 10659 |
| HPV33 | E5 | LLWVFVGSPLK | 38 | 11 | | | | | | 10660 |
| HPV33 | E5 | WVFVGSPLK | 40 | 9 | | | | | | 10661 |
| HPV33 | E6 | AACWRSRR | 137 | 8 | | | | | | 10662 |
| HPV33 | E6 | AACWRSRRR | 137 | 9 | | | | | | 10663 |
| HPV33 | E6 | CAACWRSR | 136 | 8 | | | | | | 10664 |
| HPV33 | E6 | CAACWRSRR | 136 | 9 | | | | | | 10665 |
| HPV33 | E6 | CAACWRSRRR | 136 | 10 | | | | | | 10666 |
| HPV33 | E6 | CVECKKPLQR | 30 | 10 | | | | | | 10667 |
| HPV33 | E6 | EILIRCIICQR | 98 | 11 | | | | | | 10668 |
| HPV33 | E6 | ELQCVECK | 27 | 8 | | | | | | 10669 |
| HPV33 | E6 | ELQCVECKK | 27 | 9 | | | | | | 10670 |
| HPV33 | E6 | FADLTVVYR | 47 | 9 | | | | | | 10671 |
| HPV33 | E6 | FAFADLTVVYR | 45 | 11 | | | | | | 10672 |
| HPV33 | E6 | FLSKISEYR | 69 | 9 | | | | | | 10673 |
| HPV33 | E6 | GICKLCLR | 61 | 8 | | | | | | 10674 |
| HPV33 | E6 | ILIRCIICQR | 99 | 10 | | | | | | 10675 |
| HPV33 | E6 | ISGRWAGR | 128 | 8 | | | | | | 10676 |
| HPV33 | E6 | KLCLRFLSK | 64 | 9 | | | | | | 10677 |
| HPV33 | E6 | LIRCIICQR | 100 | 9 | | | | | | 10678 |
| HPV33 | E6 | LSKISEYR | 70 | 8 | | | | | | 10679 |
| HPV33 | E6 | NIELQCVECK | 25 | 10 | | | | | | 10680 |
| HPV33 | E6 | NIELQCVECKK | 25 | 11 | | | | | | 10681 |
| HPV33 | E6 | NISGRWAGR | 127 | 9 | | | | | | 10682 |
| HPV33 | E6 | NTLEQTVK | 86 | 8 | | | | | | 10683 |
| HPV33 | E6 | NTLEQTVKK | 86 | 9 | | | | | | 10684 |
| HPV33 | E6 | PLCPQEKK | 109 | 8 | | | | | | 10685 |
| HPV33 | E6 | PLCPQEKKR | 109 | 9 | | | | | | 10686 |
| HPV33 | E6 | PLNEILIR | 95 | 8 | | | | | | 10687 |
| HPV33 | E6 | TLEQTVKK | 87 | 8 | | | | | | 10688 |
| HPV33 | E6 | WAGRCAACWR | 132 | 10 | | | | | | 10689 |
| HPV33 | E7 | CVNSTASDLR | 68 | 10 | | | | | | 10690 |
| HPV33 | E7 | DSSDEDEGLDR | 30 | 11 | | | | | | 10691 |
| HPV33 | E7 | HTCNTTVR | 59 | 8 | | | | | | 10692 |
| HPV33 | E7 | NSTASDLR | 70 | 8 | | | | | | 10693 |
| HPV33 | E7 | SSDEDEGLDR | 31 | 10 | | | | | | 10694 |
| HPV33 | L1 | AITCQKTVPPK | 424 | 11 | | | | | | 10695 |
| HPV33 | L1 | ASLQDTYR | 411 | 8 | | | | | | 10696 |
| HPV33 | L1 | AVGHPYFSIK | 44 | 10 | | | | | | 10697 |
| HPV33 | L1 | AVPDDLYIK | 270 | 9 | | | | | | 10698 |
| HPV33 | L1 | CMDFKTLQANK | 207 | 11 | | | | | | 10699 |
| HPV33 | L1 | CTQVTSDSTYK | 345 | 11 | | | | | | 10700 |
| HPV33 | L1 | CVGLEIGR | 103 | 8 | | | | | | 10701 |
| HPV33 | L1 | DICGSTCK | 223 | 8 | | | | | | 10702 |
| HPV33 | L1 | DLDQFPLGR | 457 | 9 | | | | | | 10703 |
| HPV33 | L1 | DLDQFPLGRK | 457 | 10 | | | | | | 10704 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV33 | L1 | DLQFVFQLCK | 370 | 10 | | | | | | 10705 |
| HPV33 | L1 | DSLFFFLR | 244 | 8 | | | | | | 10706 |
| HPV33 | L1 | DSLFFFLRR | 244 | 9 | | | | | | 10707 |
| HPV33 | L1 | DSTYKNENFK | 351 | 10 | | | | | | 10708 |
| HPV33 | L1 | DTGFGCMDFK | 202 | 10 | | | | | | 10709 |
| HPV33 | L1 | DTSFYNPDTQR | 88 | 11 | | | | | | 10710 |
| HPV33 | L1 | EAVPDDLYIK | 269 | 10 | | | | | | 10711 |
| HPV33 | L1 | FLLQAGLK | 467 | 8 | | | | | | 10712 |
| HPV33 | L1 | FLLQAGLKAK | 467 | 10 | | | | | | 10713 |
| HPV33 | L1 | FLRREQMFVR | 249 | 10 | | | | | | 10714 |
| HPV33 | L1 | FSIKNPTNAK | 50 | 10 | | | | | | 10715 |
| HPV33 | L1 | FSIKNPTNAKK | 50 | 11 | | | | | | 10716 |
| HPV33 | L1 | FVRHFFNR | 256 | 8 | | | | | | 10717 |
| HPV33 | L1 | FVTSQAITCQK | 419 | 11 | | | | | | 10718 |
| HPV33 | L1 | FVTVVDTTR | 330 | 9 | | | | | | 10719 |
| HPV33 | L1 | GISGHPLLNK | 117 | 10 | | | | | | 10720 |
| HPV33 | L1 | GLKAKPKLK | 472 | 9 | | | | | | 10721 |
| HPV33 | L1 | GLKAKPKLKR | 472 | 10 | | | | | | 10722 |
| HPV33 | L1 | GLQYRVFR | 68 | 8 | | | | | | 10723 |
| HPV33 | L1 | GLQYRVFRVR | 68 | 10 | | | | | | 10724 |
| HPV33 | L1 | GSTCKYPDYLK | 226 | 11 | | | | | | 10725 |
| HPV33 | L1 | ISGHPLLNK | 118 | 9 | | | | | | 10726 |
| HPV33 | L1 | ITCQKTVPPK | 425 | 10 | | | | | | 10727 |
| HPV33 | L1 | KAKPKLKR | 474 | 8 | | | | | | 10728 |
| HPV33 | L1 | KLKRAAPTSTR | 478 | 11 | | | | | | 10729 |
| HPV33 | L1 | KTVPPKEK | 429 | 8 | | | | | | 10730 |
| HPV33 | L1 | KVSGLQYR | 65 | 8 | | | | | | 10731 |
| HPV33 | L1 | KVSGLQYRVFR | 65 | 11 | | | | | | 10732 |
| HPV33 | L1 | KVVSTDEYVSR | 20 | 11 | | | | | | 10733 |
| HPV33 | L1 | LAVGHPYFSIK | 43 | 11 | | | | | | 10734 |
| HPV33 | L1 | LLQAGLKAK | 468 | 9 | | | | | | 10735 |
| HPV33 | L1 | LLQAGLKAKPK | 468 | 11 | | | | | | 10736 |
| HPV33 | L1 | LVPKVSGLQYR | 62 | 11 | | | | | | 10737 |
| HPV33 | L1 | MVTSESQLFNK | 299 | 11 | | | | | | 10738 |
| HPV33 | L1 | NAKKLLVPK | 57 | 9 | | | | | | 10739 |
| HPV33 | L1 | PIDICGSTCK | 221 | 10 | | | | | | 10740 |
| HPV33 | L1 | PSASLQDTYR | 409 | 10 | | | | | | 10741 |
| HPV33 | L1 | PTGEHWGK | 165 | 8 | | | | | | 10742 |
| HPV33 | L1 | PTNAKKLLVPK | 55 | 11 | | | | | | 10743 |
| HPV33 | L1 | PTSTRTSSAK | 484 | 10 | | | | | | 10744 |
| HPV33 | L1 | PTSTRTSSAKR | 484 | 11 | | | | | | 10745 |
| HPV33 | L1 | QAGLKAKPK | 470 | 9 | | | | | | 10746 |
| HPV33 | L1 | QAGLKAKPKLK | 470 | 11 | | | | | | 10747 |
| HPV33 | L1 | QLCLLGCK | 156 | 8 | | | | | | 10748 |
| HPV33 | L1 | QLFNKPYWLQR | 305 | 11 | | | | | | 10749 |
| HPV33 | L1 | QMFVRHFFNR | 254 | 10 | | | | | | 10750 |
| HPV33 | L1 | QTQLCLLGCK | 154 | 10 | | | | | | 10751 |
| HPV33 | L1 | QVFVTVVDTTR | 328 | 11 | | | | | | 10752 |
| HPV33 | L1 | QVTSDSTYK | 347 | 9 | | | | | | 10753 |
| HPV33 | L1 | RAAPTSTR | 481 | 8 | | | | | | 10754 |
| HPV33 | L1 | RTSSAKRK | 488 | 8 | | | | | | 10755 |
| HPV33 | L1 | RTSSAKRKK | 488 | 9 | | | | | | 10756 |
| HPV33 | L1 | RTSSAKRKKVK | 488 | 11 | | | | | | 10757 |
| HPV33 | L1 | RVRLPDPNK | 75 | 9 | | | | | | 10758 |
| HPV33 | L1 | SADLDQFPLGR | 455 | 11 | | | | | | 10759 |
| HPV33 | L1 | SAKRKKVK | 491 | 8 | | | | | | 10760 |
| HPV33 | L1 | SAKRKKVKK | 491 | 9 | | | | | | 10761 |
| HPV33 | L1 | SASLQDTYR | 410 | 9 | | | | | | 10762 |
| HPV33 | L1 | SIKNPTNAK | 51 | 9 | | | | | | 10763 |
| HPV33 | L1 | SIKNPTNAKK | 51 | 10 | | | | | | 10764 |
| HPV33 | L1 | SIYYYAGSSR | 32 | 10 | | | | | | 10765 |
| HPV33 | L1 | SLFFFLRR | 245 | 8 | | | | | | 10766 |
| HPV33 | L1 | SSAKRKKVK | 490 | 9 | | | | | | 10767 |
| HPV33 | L1 | SSAKRKKVKK | 490 | 10 | | | | | | 10768 |
| HPV33 | L1 | STCKYPDYLK | 227 | 10 | | | | | | 10769 |
| HPV33 | L1 | STDEYVSR | 23 | 8 | | | | | | 10770 |
| HPV33 | L1 | STRTSSAK | 486 | 8 | | | | | | 10771 |
| HPV33 | L1 | STRTSSAKR | 486 | 9 | | | | | | 10772 |
| HPV33 | L1 | STRTSSAKRK | 486 | 10 | | | | | | 10773 |
| HPV33 | L1 | STRTSSAKRKK | 486 | 11 | | | | | | 10774 |
| HPV33 | L1 | STYKNENFK | 352 | 9 | | | | | | 10775 |
| HPV33 | L1 | TSESQLFNK | 301 | 9 | | | | | | 10776 |
| HPV33 | L1 | TSFYNPDTQR | 89 | 10 | | | | | | 10777 |
| HPV33 | L1 | TSIYYYAGSSR | 31 | 11 | | | | | | 10778 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV33 | L1 | TSQAITCQK | 421 | 9 | | | | | | 10779 |
| HPV33 | L1 | TSSAKRKK | 489 | 8 | | | | | | 10780 |
| HPV33 | L1 | TSSAKRKKVK | 489 | 10 | | | | | | 10781 |
| HPV33 | L1 | TSSAKRKKVKK | 489 | 11 | | | | | | 10782 |
| HPV33 | L1 | TSTRTSSAK | 485 | 9 | | | | | | 10783 |
| HPV33 | L1 | TSTRTSSAKR | 485 | 10 | | | | | | 10784 |
| HPV33 | L1 | TSTRTSSAKRK | 485 | 11 | | | | | | 10785 |
| HPV33 | L1 | TVYLPPVPVSK | 10 | 11 | | | | | | 10786 |
| HPV33 | L1 | VSGLQYRVFR | 66 | 10 | | | | | | 10787 |
| HPV33 | L1 | VSTDEYVSR | 22 | 9 | | | | | | 10788 |
| HPV33 | L1 | VTSDSTYK | 348 | 8 | | | | | | 10789 |
| HPV33 | L1 | VTSESQLFNK | 300 | 10 | | | | | | 10790 |
| HPV33 | L1 | VTSQAITCQK | 420 | 10 | | | | | | 10791 |
| HPV33 | L1 | VTVVDTTR | 331 | 8 | | | | | | 10792 |
| HPV33 | L1 | VVSTDEYVSR | 21 | 10 | | | | | | 10793 |
| HPV33 | L1 | WACVGLEIGR | 101 | 10 | | | | | | 10794 |
| HPV33 | L1 | YLPPVPVSK | 12 | 9 | | | | | | 10795 |
| HPV33 | L1 | YTFWEVDLK | 443 | 9 | | | | | | 10796 |
| HPV33 | L1 | YTFWEVDLKEK | 443 | 11 | | | | | | 10797 |
| HPV33 | L2 | AAIPLQPIR | 81 | 9 | | | | | | 10798 |
| HPV33 | L2 | AIPLQPIR | 82 | 8 | | | | | | 10799 |
| HPV33 | L2 | AITSRRHTVR | 291 | 10 | | | | | | 10800 |
| HPV33 | L2 | ALHRPAITSR | 286 | 10 | | | | | | 10801 |
| HPV33 | L2 | ALHRPAITSRR | 286 | 11 | | | | | | 10802 |
| HPV33 | L2 | ASATQLYQTCK | 12 | 11 | | | | | | 10803 |
| HPV33 | L2 | ATLKTRSGK | 308 | 9 | | | | | | 10804 |
| HPV33 | L2 | ATQLYQTCK | 14 | 9 | | | | | | 10805 |
| HPV33 | L2 | FILRRRRK | 447 | 8 | | | | | | 10806 |
| HPV33 | L2 | FILRRRRKR | 447 | 9 | | | | | | 10807 |
| HPV33 | L2 | FLDIIALHR | 281 | 9 | | | | | | 10808 |
| HPV33 | L2 | FSRVGQKATLK | 301 | 11 | | | | | | 10809 |
| HPV33 | L2 | FVLHPSYFILR | 440 | 11 | | | | | | 10810 |
| HPV33 | L2 | GIGTGSGSGGR | 58 | 11 | | | | | | 10811 |
| HPV33 | L2 | GLYSRNTQQVK | 226 | 11 | | | | | | 10812 |
| HPV33 | L2 | GSTIADQILK | 37 | 10 | | | | | | 10813 |
| HPV33 | L2 | GTCPPDVIPK | 25 | 10 | | | | | | 10814 |
| HPV33 | L2 | GTGSGSGGR | 60 | 9 | | | | | | 10815 |
| HPV33 | L2 | HSYSTFATTR | 379 | 10 | | | | | | 10816 |
| HPV33 | L2 | HTVRFSRVGQK | 297 | 11 | | | | | | 10817 |
| HPV33 | L2 | IALHRPAITSR | 285 | 11 | | | | | | 10818 |
| HPV33 | L2 | ILRRRRKR | 448 | 8 | | | | | | 10819 |
| HPV33 | L2 | ITSRRHTVR | 292 | 9 | | | | | | 10820 |
| HPV33 | L2 | KATLKTRSGK | 307 | 10 | | | | | | 10821 |
| HPV33 | L2 | KTRSGKQIGAR | 311 | 11 | | | | | | 10822 |
| HPV33 | L2 | PAFLTSPHK | 240 | 9 | | | | | | 10823 |
| HPV33 | L2 | PAITSRRHTVR | 290 | 11 | | | | | | 10824 |
| HPV33 | L2 | PIPGSRPVAR | 215 | 10 | | | | | | 10825 |
| HPV33 | L2 | PSYFILRR | 444 | 8 | | | | | | 10826 |
| HPV33 | L2 | PSYFILRRR | 444 | 9 | | | | | | 10827 |
| HPV33 | L2 | PSYFILRRRR | 444 | 10 | | | | | | 10828 |
| HPV33 | L2 | PSYFILRRRRK | 444 | 11 | | | | | | 10829 |
| HPV33 | L2 | PTAAIPLQPIR | 79 | 11 | | | | | | 10830 |
| HPV33 | L2 | PVARLGLYSR | 221 | 10 | | | | | | 10831 |
| HPV33 | L2 | RSGKQIGAR | 313 | 9 | | | | | | 10832 |
| HPV33 | L2 | RVGQKATLK | 303 | 9 | | | | | | 10833 |
| HPV33 | L2 | RVGQKATLKTR | 303 | 11 | | | | | | 10834 |
| HPV33 | L2 | SATQLYQTCK | 13 | 10 | | | | | | 10835 |
| HPV33 | L2 | SSTPIPGSR | 212 | 9 | | | | | | 10836 |
| HPV33 | L2 | STIADQILK | 38 | 9 | | | | | | 10837 |
| HPV33 | L2 | STPIPGSR | 213 | 8 | | | | | | 10838 |
| HPV33 | L2 | TAAIPLQPIR | 80 | 10 | | | | | | 10839 |
| HPV33 | L2 | TIADQILK | 39 | 8 | | | | | | 10840 |
| HPV33 | L2 | TLKTRSGK | 309 | 8 | | | | | | 10841 |
| HPV33 | L2 | TSRRHTVR | 293 | 8 | | | | | | 10842 |
| HPV33 | L2 | TSRRHTVRFSR | 293 | 11 | | | | | | 10843 |
| HPV33 | L2 | TSSTPIPGSR | 211 | 10 | | | | | | 10844 |
| HPV33 | L2 | TVRFSRVGQK | 298 | 10 | | | | | | 10845 |
| HPV33 | L2 | VARLGLYSR | 222 | 9 | | | | | | 10846 |
| HPV33 | L2 | VLHPSYFILR | 441 | 10 | | | | | | 10847 |
| HPV33 | L2 | VLHPSYFILRR | 441 | 11 | | | | | | 10848 |
| HPV33 | L2 | VTSSTPIPGSR | 210 | 11 | | | | | | 10849 |
| HPV33 | L2 | YSRNTQQVK | 228 | 9 | | | | | | 10850 |
| HPV33 | L2 | YSTFATTR | 381 | 8 | | | | | | 10851 |
| HPV45 | E1 | AAFLKSNCQAK | 383 | 11 | | | | | | 10852 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV45 | E1 | AAMLAVFK | 198 | 8 | | | | | | 10853 |
| HPV45 | E1 | ALDGNPISIDR | 532 | 11 | | | | | | 10854 |
| HPV45 | E1 | ALKEFLKGTPK | 452 | 11 | | | | | | 10855 |
| HPV45 | E1 | ALLRYKCGK | 270 | 9 | 0.0900 | 0.1400 | | | | 10856 |
| HPV45 | E1 | ALLRYKCGKNR | 270 | 11 | | | | | | 10857 |
| HPV45 | E1 | AVMCRHYK | 399 | 8 | | | | | | 10858 |
| HPV45 | E1 | AVMCRHYKR | 399 | 9 | | | | | | 10859 |
| HPV45 | E1 | CAVMCRHYK | 398 | 9 | | | | | | 10860 |
| HPV45 | E1 | CAVMCRHYKR | 398 | 10 | | | | | | 10861 |
| HPV45 | E1 | CMLIEPPK | 297 | 8 | | | | | | 10862 |
| HPV45 | E1 | CMLIEPPKLR | 297 | 10 | | | | | | 10863 |
| HPV45 | E1 | CSKIDEGGDWR | 423 | 11 | | | | | | 10864 |
| HPV45 | E1 | CVTGQNTR | 634 | 8 | | | | | | 10865 |
| HPV45 | E1 | DAQVLHLLK | 78 | 9 | | | | | | 10866 |
| HPV45 | E1 | DAQVLHLLKR | 78 | 10 | | | | | | 10867 |
| HPV45 | E1 | DAQVLHLLKRK | 78 | 11 | | | | | | 10868 |
| HPV45 | E1 | DLVRNFKSDK | 214 | 10 | | | | | | 10869 |
| HPV45 | E1 | DTEGIPFGTFK | 623 | 11 | | | | | | 10870 |
| HPV45 | E1 | DTPEWIQR | 328 | 8 | | | | | | 10871 |
| HPV45 | E1 | EINDKNWK | 596 | 8 | | | | | | 10872 |
| HPV45 | E1 | EISLNSGHK | 115 | 9 | | | | | | 10873 |
| HPV45 | E1 | EISLNSGHKK | 115 | 10 | | | | | | 10874 |
| HPV45 | E1 | ELKELLQASNK | 186 | 11 | | | | | | 10875 |
| HPV45 | E1 | ELLQASNK | 189 | 8 | | | | | | 10876 |
| HPV45 | E1 | ELLQASNKK | 189 | 9 | | | | | | 10877 |
| HPV45 | E1 | ETCMLIEPPK | 295 | 10 | | | | | | 10878 |
| HPV45 | E1 | FISFLRALK | 446 | 9 | | | | | | 10879 |
| HPV45 | E1 | FLKGTPKK | 456 | 8 | | | | | | 10880 |
| HPV45 | E1 | FLKSNCQAK | 385 | 9 | 0.0035 | 0.0007 | | | | 10881 |
| HPV45 | E1 | FLRALKEFLK | 449 | 10 | | | | | | 10882 |
| HPV45 | E1 | FTDLVRNFK | 212 | 9 | | | | | | 10883 |
| HPV45 | E1 | FTFPHAFPFDK | 579 | 11 | | | | | | 10884 |
| HPV45 | E1 | FVETIVEK | 19 | 8 | | | | | | 10885 |
| HPV45 | E1 | FVETIVEKK | 19 | 9 | | | | | | 10886 |
| HPV45 | E1 | GIPFGTFK | 626 | 8 | | | | | | 10887 |
| HPV45 | E1 | GLSFTDLVR | 209 | 9 | 0.0009 | 0.0025 | | | | 10888 |
| HPV45 | E1 | GVEFISFLR | 443 | 9 | | | | | | 10889 |
| HPV45 | E1 | GVLILARLLR | 265 | 9 | 0.0058 | 0.1400 | | | | 10890 |
| HPV45 | E1 | GVLILALLRYK | 265 | 11 | | | | | | 10891 |
| HPV45 | E1 | GVNPTVAEGFK | 235 | 11 | | | | | | 10892 |
| HPV45 | E1 | HIQCLDCK | 256 | 8 | | | | | | 10893 |
| HPV45 | E1 | ILALLRYK | 268 | 8 | | | | | | 10894 |
| HPV45 | E1 | ILALLRYKCGK | 268 | 11 | | | | | | 10895 |
| HPV45 | E1 | ILLTSNIDPAK | 555 | 11 | | | | | | 10896 |
| HPV45 | E1 | ILLYGPANTGK | 466 | 11 | | | | | | 10897 |
| HPV45 | E1 | ISFLRALK | 447 | 8 | | | | | | 10898 |
| HPV45 | E1 | ISIDRKHK | 538 | 8 | | | | | | 10899 |
| HPV45 | E1 | ISLNSGHK | 116 | 8 | | | | | | 10900 |
| HPV45 | E1 | ISLNSGHKK | 116 | 9 | | | | | | 10901 |
| HPV45 | E1 | ISLNSGHKKAK | 116 | 11 | | | | | | 10902 |
| HPV45 | E1 | KAAMLAVFK | 197 | 9 | | | | | | 10903 |
| HPV45 | E1 | KIDEGGDWR | 425 | 9 | | | | | | 10904 |
| HPV45 | E1 | KSNCQAKYLK | 387 | 10 | | | | | | 10905 |
| HPV45 | E1 | LALLRYKCGK | 269 | 10 | | | | | | 10906 |
| HPV45 | E1 | LIEPPKLR | 299 | 8 | | | | | | 10907 |
| HPV45 | E1 | LILALLRYK | 267 | 9 | 0.2700 | 0.1800 | | | | 10908 |
| HPV45 | E1 | LLKRKFAGGSK | 84 | 11 | | | | | | 10909 |
| HPV45 | E1 | LLQASNKK | 190 | 8 | | | | | | 10910 |
| HPV45 | E1 | LLRKCGK | 271 | 8 | | | | | | 10911 |
| HPV45 | E1 | LLRYKCGKNR | 271 | 10 | | | | | | 10912 |
| HPV45 | E1 | LLTSNIDPAK | 556 | 10 | | | | | | 10913 |
| HPV45 | E1 | LLYGPANTGK | 467 | 10 | | | | | | 10914 |
| HPV45 | E1 | LSFTDLVR | 210 | 8 | | | | | | 10915 |
| HPV45 | E1 | LSFTDLVRNFK | 210 | 11 | | | | | | 10916 |
| HPV45 | E1 | LSVDTDLSPR | 103 | 10 | | | | | | 10917 |
| HPV45 | E1 | LTSNIDPAK | 557 | 9 | | | | | | 10918 |
| HPV45 | E1 | LVRNFKSDK | 215 | 9 | 0.0005 | 0.0002 | | | | 10919 |
| HPV45 | E1 | MLIEPPKLR | 298 | 9 | | | | | | 10920 |
| HPV45 | E1 | MSQWIKYR | 415 | 8 | | | | | | 10921 |
| HPV45 | E1 | MSQWIKYRCSK | 415 | 11 | | | | | | 10922 |
| HPV45 | E1 | NIDPAKDNK | 560 | 9 | | | | | | 10923 |
| HPV45 | E1 | NMSQWIKYR | 414 | 9 | | | | | | 10924 |
| HPV45 | E1 | NSGHKKAK | 119 | 8 | | | | | | 10925 |
| HPV45 | E1 | NSGHKKAKR | 119 | 9 | | | | | | 10926 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV45 | E1 | NSGHKKAKRR | 119 | 10 | | | | | | 10927 |
| HPV45 | E1 | NSNAAAFLK | 379 | 9 | 0.0057 | 0.3700 | | | | 10928 |
| HPV45 | E1 | PISIDRKHK | 537 | 9 | | | | | | 10929 |
| HPV45 | E1 | PTVAEGFK | 238 | 8 | | | | | | 10930 |
| HPV45 | E1 | PVYEINDK | 593 | 8 | | | | | | 10931 |
| HPV45 | E1 | PVYEINDKNWK | 593 | 11 | | | | | | 10932 |
| HPV45 | E1 | QLSVDTDLSPR | 102 | 11 | | | | | | 10933 |
| HPV45 | E1 | QMNMSQWIK | 412 | 9 | | | | | | 10934 |
| HPV45 | E1 | QMNMSQWIKYR | 412 | 11 | | | | | | 10935 |
| HPV45 | E1 | QVLHLLKR | 80 | 8 | | | | | | 10936 |
| HPV45 | E1 | QVLHLLKRK | 80 | 9 | | | | | | 10937 |
| HPV45 | E1 | RALKEFLK | 451 | 8 | | | | | | 10938 |
| HPV45 | E1 | RSSVAALYWYR | 306 | 11 | | | | | | 10939 |
| HPV45 | E1 | SLNSGHKK | 117 | 8 | | | | | | 10940 |
| HPV45 | E1 | SLNSGHKKAK | 117 | 10 | | | | | | 10941 |
| HPV45 | E1 | SLNSGHKKAKR | 117 | 11 | | | | | | 10942 |
| HPV45 | E1 | SSVAALYWYR | 307 | 10 | | | | | | 10943 |
| HPV45 | E1 | SVAALYWYR | 308 | 9 | 2.9000 | 8.8000 | | | | 10944 |
| HPV45 | E1 | SVDTDLSPR | 104 | 9 | | | | | | 10945 |
| HPV45 | E1 | TSNIDPAK | 558 | 8 | | | | | | 10946 |
| HPV45 | E1 | TSNIDPAKDNK | 558 | 11 | | | | | | 10947 |
| HPV45 | E1 | TVAEGFKTLIK | 239 | 11 | | | | | | 10948 |
| HPV45 | E1 | VAALYWYR | 309 | 8 | | | | | | 10949 |
| HPV45 | E1 | VAEGFKTLIK | 240 | 10 | | | | | | 10950 |
| HPV45 | E1 | VLHLLKRK | 81 | 8 | | | | | | 10951 |
| HPV45 | E1 | VLILALLR | 266 | 8 | | | | | | 10952 |
| HPV45 | E1 | VLILALLRYK | 266 | 10 | | | | | | 10953 |
| HPV45 | E1 | VMCRHYKR | 400 | 8 | | | | | | 10954 |
| HPV45 | E1 | VMCRHYKRAQK | 400 | 11 | | | | | | 10955 |
| HPV45 | E1 | VSGDTPEWIQR | 325 | 11 | | | | | | 10956 |
| HPV45 | E1 | WIKYRCSK | 418 | 8 | | | | | | 10957 |
| HPV45 | E1 | WLEPLADTK | 502 | 9 | | | | | | 10958 |
| HPV45 | E1 | WTYFDNYMR | 522 | 9 | | | | | | 10959 |
| HPV45 | E1 | YAHIQCLDCK | 254 | 10 | | | | | | 10960 |
| HPV45 | E1 | YLKDCAVMCR | 394 | 10 | | | | | | 10961 |
| HPV45 | E2 | AIELQMALK | 78 | 9 | | | | | | 10962 |
| HPV45 | E2 | ALKGLAQSK | 84 | 9 | | | | | | 10963 |
| HPV45 | E2 | CLRYRLRK | 305 | 8 | | | | | | 10964 |
| HPV45 | E2 | CSSTSNNK | 274 | 8 | | | | | | 10965 |
| HPV45 | E2 | CSSTSNNKR | 274 | 9 | | | | | | 10966 |
| HPV45 | E2 | CSSTSNNKRR | 274 | 10 | | | | | | 10967 |
| HPV45 | E2 | CSSTSNNKRRK | 274 | 11 | | | | | | 10968 |
| HPV45 | E2 | CVSYWGVYYIK | 158 | 11 | | | | | | 10969 |
| HPV45 | E2 | DTTYYVQFK | 171 | 9 | | | | | | 10970 |
| HPV45 | E2 | DTVSATQIVR | 212 | 10 | | | | | | 10971 |
| HPV45 | E2 | FTAREHGITK | 50 | 10 | | | | | | 10972 |
| HPV45 | E2 | GLTEQHHGR | 255 | 9 | | | | | | 10973 |
| HPV45 | E2 | HASTSTPK | 225 | 8 | | | | | | 10974 |
| HPV45 | E2 | HIQTPATK | 242 | 8 | | | | | | 10975 |
| HPV45 | E2 | HIQTPATKR | 242 | 9 | | | | | | 10976 |
| HPV45 | E2 | HIQTPATKRPR | 242 | 11 | | | | | | 10977 |
| HPV45 | E2 | HLKGDKNSLK | 295 | 10 | | | | | | 10978 |
| HPV45 | E2 | HVYFDGNK | 124 | 8 | | | | | | 10979 |
| HPV45 | E2 | IIHLKGDK | 293 | 8 | | | | | | 10980 |
| HPV45 | E2 | ILDHYENDSK | 21 | 10 | | | | | | 10981 |
| HPV45 | E2 | ISKSKAHK | 70 | 8 | | | | | | 10982 |
| HPV45 | E2 | ISYWQLIR | 36 | 8 | | | | | | 10983 |
| HPV45 | E2 | ITETGIWDK | 146 | 9 | | | | | | 10984 |
| HPV45 | E2 | KAIELQMALK | 77 | 10 | | | | | | 10985 |
| HPV45 | E2 | KILDHYENDSK | 20 | 11 | | | | | | 10986 |
| HPV45 | E2 | KTASVGTPK | 232 | 9 | | | | | | 10987 |
| HPV45 | E2 | KTVHVYFDGNK | 121 | 11 | | | | | | 10988 |
| HPV45 | E2 | LLCSSTSNNK | 272 | 10 | | | | | | 10989 |
| HPV45 | E2 | LLCSSTSNNKR | 272 | 11 | | | | | | 10990 |
| HPV45 | E2 | LSERLSALQDK | 10 | 11 | | | | | | 10991 |
| HPV45 | E2 | LTEQHHGR | 256 | 8 | | | | | | 10992 |
| HPV45 | E2 | LTVTYNSEVQR | 336 | 11 | | | | | | 10993 |
| HPV45 | E2 | MALKGLAQSK | 83 | 10 | | | | | | 10994 |
| HPV45 | E2 | NAILFTAR | 46 | 8 | | | | | | 10995 |
| HPV45 | E2 | NISKSKAHK | 69 | 9 | | | | | | 10996 |
| HPV45 | E2 | NSLKCLRYR | 301 | 9 | | | | | | 10997 |
| HPV45 | E2 | NSLKCLRYRLR | 301 | 11 | | | | | | 10998 |
| HPV45 | E2 | NSQISYWQLIR | 33 | 11 | | | | | | 10999 |
| HPV45 | E2 | NTEPSQCFK | 109 | 9 | | | | | | 11000 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV45 | E2 | NTEPSQCFKK | 109 | 10 | | | | | | 11001 |
| HPV45 | E2 | NTTPIIHLK | 289 | 9 | | | | | | 11002 |
| HPV45 | E2 | PIIHLKGDK | 292 | 9 | | | | | | 11003 |
| HPV45 | E2 | PINISKSK | 67 | 8 | | | | | | 11004 |
| HPV45 | E2 | PINISKSKAHK | 67 | 11 | | | | | | 11005 |
| HPV45 | E2 | PLLCSSTSNNK | 271 | 11 | | | | | | 11006 |
| HPV45 | E2 | PSQCFKKGGK | 112 | 10 | | | | | | 11007 |
| HPV45 | E2 | QISYWQLIR | 35 | 9 | | | | | | 11008 |
| HPV45 | E2 | QLQHASTSTPK | 222 | 11 | | | | | | 11009 |
| HPV45 | E2 | QMALKGLAQSK | 82 | 11 | | | | | | 11010 |
| HPV45 | E2 | QTPATKRPR | 244 | 9 | | | | | | 11011 |
| HPV45 | E2 | QTPKESLSER | 4 | 10 | | | | | | 11012 |
| HPV45 | E2 | QVVPPINISK | 63 | 10 | | | | | | 11013 |
| HPV45 | E2 | RLENAILFTAR | 43 | 11 | | | | | | 11014 |
| HPV45 | E2 | RLSALQDK | 13 | 8 | | | | | | 11015 |
| HPV45 | E2 | SLKCLRYR | 302 | 8 | | | | | | 11016 |
| HPV45 | E2 | SLKCLRYRLR | 302 | 10 | | | | | | 11017 |
| HPV45 | E2 | SLKCLRYRLRK | 302 | 11 | | | | | | 11018 |
| HPV45 | E2 | SSTSNNKR | 275 | 8 | | | | | | 11019 |
| HPV45 | E2 | SSTSNNKRR | 275 | 9 | | | | | | 11020 |
| HPV45 | E2 | SSTSNNKRRK | 275 | 10 | | | | | | 11021 |
| HPV45 | E2 | SSTWHWTGCNK | 321 | 11 | | | | | | 11022 |
| HPV45 | E2 | STSNNKRR | 276 | 8 | | | | | | 11023 |
| HPV45 | E2 | STSNNKRRK | 276 | 9 | | | | | | 11024 |
| HPV45 | E2 | STWHWTGCNK | 322 | 10 | | | | | | 11025 |
| HPV45 | E2 | TAREHGITK | 51 | 9 | | | | | | 11026 |
| HPV45 | E2 | TASVGTPK | 233 | 8 | | | | | | 11027 |
| HPV45 | E2 | TSNNKRRK | 277 | 8 | | | | | | 11028 |
| HPV45 | E2 | TTPIIHLK | 290 | 8 | | | | | | 11029 |
| HPV45 | E2 | TTPIIHLKGDK | 290 | 11 | | | | | | 11030 |
| HPV45 | E2 | TTYYVQFK | 172 | 8 | | | | | | 11031 |
| HPV45 | E2 | TVHVYFDGNK | 122 | 10 | | | | | | 11032 |
| HPV45 | E2 | TVSATQIVR | 213 | 9 | | | | | | 11033 |
| HPV45 | E2 | TVTYNSEVQR | 337 | 10 | | | | | | 11034 |
| HPV45 | E2 | VSATQIVR | 214 | 8 | | | | | | 11035 |
| HPV45 | E2 | VSYWGVYYIK | 159 | 10 | | | | | | 11036 |
| HPV45 | E2 | VTYNSEVQR | 338 | 9 | | | | | | 11037 |
| HPV45 | E2 | VVPPINISK | 64 | 9 | | | | | | 11038 |
| HPV45 | E2 | VVPPINISKSK | 64 | 11 | | | | | | 11039 |
| HPV45 | E2 | YITETGIWDK | 145 | 10 | | | | | | 11040 |
| HPV45 | E2 | YVQFKSECEK | 175 | 10 | | | | | | 11041 |
| HPV45 | E6 | CIAYAACHK | 59 | 9 | | | | | | 11042 |
| HPV45 | E6 | CIDFYSRIR | 68 | 9 | 0.0001 | 0.0001 | | | | 11043 |
| HPV45 | E6 | CVYCKATLER | 32 | 10 | | | | | | 11044 |
| HPV45 | E6 | DVSIACVYCK | 27 | 10 | | | | | | 11045 |
| HPV45 | E6 | ELYNLLIR | 97 | 8 | | | | | | 11046 |
| HPV45 | E6 | ELYNLLIRCLR | 97 | 11 | | | | | | 11047 |
| HPV45 | E6 | EVYQFAFK | 43 | 8 | | | | | | 11048 |
| HPV45 | E6 | FAFKDLFIVYR | 47 | 11 | | | | | | 11049 |
| HPV45 | E6 | HSIAGQYR | 128 | 8 | | | | | | 11050 |
| HPV45 | E6 | IAYAACHK | 60 | 8 | | | | | | 11051 |
| HPV45 | E6 | LIRCLRCQK | 102 | 9 | 0.0190 | 0.0012 | | | | 11052 |
| HPV45 | E6 | LLIRCLRCQK | 101 | 10 | 0.0470 | 0.1200 | | | | 11053 |
| HPV45 | E6 | MARFDDPTQR | 1 | 10 | | | | | | 11054 |
| HPV45 | E6 | NLLIRCLR | 100 | 8 | | | | | | 11055 |
| HPV45 | E6 | NLLIRCLRCQK | 100 | 11 | | | | | | 11056 |
| HPV45 | E6 | NSVYGETLEK | 83 | 10 | | | | | | 11057 |
| HPV45 | E6 | NTCCDQAR | 139 | 8 | | | | | | 11058 |
| HPV45 | E6 | NTCCDQARQER | 139 | 11 | | | | | | 11059 |
| HPV45 | E6 | NTELYNLLIR | 95 | 10 | | | | | | 11060 |
| HPV45 | E6 | PAEKRRHLK | 114 | 9 | | | | | | 11061 |
| HPV45 | E6 | PAEKRRHLKDK | 114 | 11 | | | | | | 11062 |
| HPV45 | E6 | PLNPAEKR | 111 | 8 | | | | | | 11063 |
| HPV45 | E6 | PLNPAEKRR | 111 | 9 | | | | | | 11064 |
| HPV45 | E6 | QARQERLR | 144 | 8 | | | | | | 11065 |
| HPV45 | E6 | QARQERLRR | 144 | 9 | | | | | | 11066 |
| HPV45 | E6 | QARQERLRRR | 144 | 10 | | | | | | 11067 |
| HPV45 | E6 | QARQERLRRRR | 144 | 11 | | | | | | 11068 |
| HPV45 | E6 | RTEVYQFAFK | 41 | 10 | | | | | | 11069 |
| HPV45 | E6 | SIACVYCK | 29 | 8 | | | | | | 11070 |
| HPV45 | E6 | SVYGETLEK | 84 | 9 | | | | | | 11071 |
| HPV45 | E6 | VSIACVYCK | 28 | 9 | | | | | | 11072 |
| HPV45 | E6 | YSRIRELR | 72 | 8 | | | | | | 11073 |
| HPV45 | E7 | CVCCKCDGR | 64 | 9 | | | | | | 11074 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV45 | E7 | ESSADDLR | 78 | 8 | | | | | | 11075 |
| HPV45 | E7 | GVSHAQLPAR | 44 | 10 | | | | | | 11076 |
| HPV45 | E7 | GVSHAQLPARR | 44 | 11 | | | | | | 11077 |
| HPV45 | E7 | HAQLPARR | 47 | 8 | | | | | | 11078 |
| HPV45 | E7 | ILCVCCKCDGR | 62 | 11 | | | | | | 11079 |
| HPV45 | E7 | KILCVCCK | 61 | 8 | | | | | | 11080 |
| HPV45 | E7 | LTVESSADDLR | 75 | 11 | | | | | | 11081 |
| HPV45 | E7 | PARRAEPQR | 51 | 9 | | | | | | 11082 |
| HPV45 | E7 | PARRAEPQRHK | 51 | 11 | | | | | | 11083 |
| HPV45 | E7 | QLPARRAEPQR | 49 | 11 | | | | | | 11084 |
| HPV45 | E7 | RAEPQRHK | 54 | 8 | | | | | | 11085 |
| HPV45 | E7 | TVESSADDLR | 76 | 10 | | | | | | 11086 |
| HPV45 | E7 | VSHAQLPAR | 45 | 9 | | | | | | 11087 |
| HPV45 | E7 | VSHAQLPARR | 45 | 10 | | | | | | 11088 |
| HPV45 | L1 | AASTSTASR | 517 | 9 | | | | | | 11089 |
| HPV45 | L1 | AATAVITQDVR | 161 | 11 | | | | | | 11090 |
| HPV45 | L1 | AIGEHWAK | 191 | 8 | | | | | | 11091 |
| HPV45 | L1 | AMDFSTLQDTK | 234 | 11 | | | | | | 11092 |
| HPV45 | L1 | ASRPAKRVR | 523 | 9 | | | | | | 11093 |
| HPV45 | L1 | ASRPAKRVRIR | 523 | 11 | | | | | | 11094 |
| HPV45 | L1 | ASTSTASR | 518 | 8 | | | | | | 11095 |
| HPV45 | L1 | ASTSTASRPAK | 518 | 11 | | | | | | 11096 |
| HPV45 | L1 | ATAVITQDVR | 162 | 10 | | | | | | 11097 |
| HPV45 | L1 | AVITQDVR | 164 | 8 | | | | | | 11098 |
| HPV45 | L1 | AVPKVSAYQYR | 88 | 11 | | | | | | 11099 |
| HPV45 | L1 | CLRREQLFAR | 276 | 10 | | | | | | 11100 |
| HPV45 | L1 | CVGMEIGR | 129 | 8 | | | | | | 11101 |
| HPV45 | L1 | CVPAIGEHWAK | 188 | 11 | | | | | | 11102 |
| HPV45 | L1 | DICQSICK | 250 | 8 | | | | | | 11103 |
| HPV45 | L1 | DLDQYPLGR | 488 | 9 | | | | | | 11104 |
| HPV45 | L1 | DLDQYPLGRK | 488 | 10 | | | | | | 11105 |
| HPV45 | L1 | DSMFFCLR | 271 | 8 | | | | | | 11106 |
| HPV45 | L1 | DSMFFCLRR | 271 | 9 | | | | | | 11107 |
| HPV45 | L1 | DSTIYNPETQR | 114 | 11 | | | | | | 11108 |
| HPV45 | L1 | DTVPTDLYIK | 296 | 10 | | | | | | 11109 |
| HPV45 | L1 | DVRDNVSVDYK | 169 | 11 | | | | | | 11110 |
| HPV45 | L1 | FARHFWNR | 283 | 8 | | | | | | 11111 |
| HPV45 | L1 | FLQMALWR | 24 | 8 | | | | | | 11112 |
| HPV45 | L1 | FLVQAGLR | 498 | 8 | | | | | | 11113 |
| HPV45 | L1 | FLVQAGLRR | 498 | 9 | | | | | | 11114 |
| HPV45 | L1 | FLVQAGLRRR | 498 | 10 | | | | | | 11115 |
| HPV45 | L1 | FSTLQDTK | 237 | 8 | | | | | | 11116 |
| HPV45 | L1 | FVQSVAVTCQK | 450 | 11 | | | | | | 11117 |
| HPV45 | L1 | FVTVVDTTR | 359 | 9 | | | | | | 11118 |
| HPV45 | L1 | GAGNKQAVPK | 82 | 10 | | | | | | 11119 |
| HPV45 | L1 | GLRRRPTIGPR | 503 | 11 | | | | | | 11120 |
| HPV45 | L1 | GLSGHPFYNK | 143 | 10 | | | | | | 11121 |
| HPV45 | L1 | ITTSDSQLFNK | 328 | 11 | | | | | | 11122 |
| HPV45 | L1 | KLKFWTVDLK | 473 | 10 | | | | | | 11123 |
| HPV45 | L1 | KVSAYQYR | 91 | 8 | | | | | | 11124 |
| HPV45 | L1 | KVSAYQYRVFR | 91 | 11 | | | | | | 11125 |
| HPV45 | L1 | LLTVGNPYFR | 68 | 10 | | | | | | 11126 |
| HPV45 | L1 | LSGHPFYNK | 144 | 9 | | | | | | 11127 |
| HPV45 | L1 | LTVGNPYFR | 69 | 9 | | | | | | 11128 |
| HPV45 | L1 | LVQAGLRR | 499 | 8 | | | | | | 11129 |
| HPV45 | L1 | LVQAGLRRR | 499 | 9 | | | | | | 11130 |
| HPV45 | L1 | NTDDYVSR | 49 | 8 | | | | | | 11131 |
| HPV45 | L1 | NTYDPTKFK | 383 | 9 | | | | | | 11132 |
| HPV45 | L1 | PAASTSTASR | 516 | 10 | | | | | | 11133 |
| HPV45 | L1 | PAIGEHWAK | 190 | 9 | | | | | | 11134 |
| HPV45 | L1 | PAKRVRIR | 526 | 8 | | | | | | 11135 |
| HPV45 | L1 | PAKRVRIRSK | 526 | 10 | | | | | | 11136 |
| HPV45 | L1 | PAKRVRIRSKK | 526 | 11 | | | | | | 11137 |
| HPV45 | L1 | PIFLQMALWR | 22 | 10 | | | | | | 11138 |
| HPV45 | L1 | PLDICQSICK | 248 | 10 | | | | | | 11139 |
| HPV45 | L1 | PTIGPRKR | 508 | 8 | | | | | | 11140 |
| HPV45 | L1 | PTKFKHYSR | 387 | 9 | | | | | | 11141 |
| HPV45 | L1 | PTTSLVDTYR | 440 | 10 | | | | | | 11142 |
| HPV45 | L1 | PVPNTYDPTK | 380 | 10 | | | | | | 11143 |
| HPV45 | L1 | QLFARHFWNR | 281 | 10 | | | | | | 11144 |
| HPV45 | L1 | QLFNKPYWLHK | 334 | 11 | | | | | | 11145 |
| HPV45 | L1 | QLFVTVVDTTR | 357 | 11 | | | | | | 11146 |
| HPV45 | L1 | QSVAVTCQK | 452 | 9 | | | | | | 11147 |
| HPV45 | L1 | RLLTVGNPYFR | 67 | 11 | | | | | | 11148 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV45 | L1 | RVALPDPNK | 101 | 9 | | | | | | 11149 |
| HPV45 | L1 | RVRIRSKK | 529 | 8 | | | | | | 11150 |
| HPV45 | L1 | RVVNTDDYVSR | 46 | 11 | | | | | | 11151 |
| HPV45 | L1 | RVVPSGAGNK | 77 | 10 | | | | | | 11152 |
| HPV45 | L1 | SAYQYRVFR | 93 | 9 | | | | | | 11153 |
| HPV45 | L1 | SIFYHAGSSR | 58 | 10 | | | | | | 11154 |
| HPV45 | L1 | SMFFCLRR | 272 | 8 | | | | | | 11155 |
| HPV45 | L1 | SSDLDQYPLGR | 486 | 11 | | | | | | 11156 |
| HPV45 | L1 | STASRPAK | 521 | 8 | | | | | | 11157 |
| HPV45 | L1 | STASRPAKR | 521 | 9 | | | | | | 11158 |
| HPV45 | L1 | STASRPAKRVR | 521 | 11 | | | | | | 11159 |
| HPV45 | L1 | STIYNPETQR | 115 | 10 | | | | | | 11160 |
| HPV45 | L1 | STSASRPAK | 519 | 10 | | | | | | 11161 |
| HPV45 | L1 | STSASRPAKR | 519 | 11 | | | | | | 11162 |
| HPV45 | L1 | SVAVTCQK | 453 | 8 | | | | | | 11163 |
| HPV45 | L1 | TASRPAKR | 522 | 8 | | | | | | 11164 |
| HPV45 | L1 | TASRPAKRVR | 522 | 10 | | | | | | 11165 |
| HPV45 | L1 | TAVITQDVR | 163 | 9 | | | | | | 11166 |
| HPV45 | L1 | TIYNPETQR | 116 | 9 | | | | | | 11167 |
| HPV45 | L1 | TSDSQLFNK | 330 | 9 | | | | | | 11168 |
| HPV45 | L1 | TSIFYHAGSSR | 57 | 11 | | | | | | 11169 |
| HPV45 | L1 | TSLVDTYR | 442 | 8 | | | | | | 11170 |
| HPV45 | L1 | TSTASRPAK | 520 | 9 | | | | | | 11171 |
| HPV45 | L1 | TSTASRPAKR | 520 | 10 | | | | | | 11172 |
| HPV45 | L1 | TTSDSQLFNK | 329 | 10 | | | | | | 11173 |
| HPV45 | L1 | TTSLVDTYR | 441 | 9 | | | | | | 11174 |
| HPV45 | L1 | TVGNPYFR | 70 | 8 | | | | | | 11175 |
| HPV45 | L1 | TVPTDLYIK | 297 | 9 | | | | | | 11176 |
| HPV45 | L1 | TVYLPPPSVAR | 36 | 11 | | | | | | 11177 |
| HPV45 | L1 | VALPDPNK | 102 | 8 | | | | | | 11178 |
| HPV45 | L1 | VSAYQYRVFR | 92 | 10 | | | | | | 11179 |
| HPV45 | L1 | VTVVDTTR | 360 | 8 | | | | | | 11180 |
| HPV45 | L1 | VVNTDDYVSR | 47 | 10 | | | | | | 11181 |
| HPV45 | L1 | VVPSGAGNK | 78 | 9 | | | | | | 11182 |
| HPV45 | L1 | WACVGMEIGR | 127 | 10 | | | | | | 11183 |
| HPV45 | L1 | WAKGTLCK | 196 | 8 | | | | | | 11184 |
| HPV45 | L1 | WTVDLKEK | 477 | 8 | | | | | | 11185 |
| HPV45 | L1 | YIKGTSANMR | 303 | 10 | | | | | | 11186 |
| HPV45 | L1 | YLPPPSVAR | 38 | 9 | | | | | | 11187 |
| HPV45 | L2 | ALSSRRGTVR | 286 | 10 | | | | | | 11188 |
| HPV45 | L2 | ASATDLYR | 12 | 8 | | | | | | 11189 |
| HPV45 | L2 | ASATDLYRTCK | 12 | 11 | | | | | | 11190 |
| HPV45 | L2 | ASTTPSTIHK | 357 | 10 | | | | | | 11191 |
| HPV45 | L2 | ATDLYRTCK | 14 | 9 | | | | | | 11192 |
| HPV45 | L2 | ATMFTRSGK | 303 | 9 | | | | | | 11193 |
| HPV45 | L2 | DSDFMDIIR | 273 | 9 | | | | | | 11194 |
| HPV45 | L2 | FMDIIRLHR | 276 | 9 | | | | | | 11195 |
| HPV45 | L2 | FTRSGKQIGGR | 306 | 11 | | | | | | 11196 |
| HPV45 | L2 | GIGTGSGSGGR | 58 | 11 | | | | | | 11197 |
| HPV45 | L2 | GTCPPDVINK | 25 | 10 | | | | | | 11198 |
| HPV45 | L2 | GTGSGSGGR | 60 | 9 | | | | | | 11199 |
| HPV45 | L2 | GTVRFSRLGQR | 292 | 11 | | | | | | 11200 |
| HPV45 | L2 | ISSTPLPTVR | 210 | 10 | | | | | | 11201 |
| HPV45 | L2 | ISSTPLPTVRR | 210 | 11 | | | | | | 11202 |
| HPV45 | L2 | KVEGTTLADK | 34 | 10 | | | | | | 11203 |
| HPV45 | L2 | LSSRRGTVR | 287 | 9 | | | | | | 11204 |
| HPV45 | L2 | MVSHRAAR | 1 | 8 | | | | | | 11205 |
| HPV45 | L2 | MVSHRAARR | 1 | 9 | | | | | | 11206 |
| HPV45 | L2 | MVSHRAARRK | 1 | 10 | | | | | | 11207 |
| HPV45 | L2 | MVSHRAARRKR | 1 | 11 | | | | | | 11208 |
| HPV45 | L2 | NTVVDVGPTR | 79 | 10 | | | | | | 11209 |
| HPV45 | L2 | PALSSRRGTVR | 285 | 11 | | | | | | 11210 |
| HPV45 | L2 | PASTTPSTIHK | 356 | 11 | | | | | | 11211 |
| HPV45 | L2 | PISSTPLPTVR | 209 | 11 | | | | | | 11212 |
| HPV45 | L2 | PLPTVRRVR | 214 | 9 | | | | | | 11213 |
| HPV45 | L2 | PTVRRVRGPR | 216 | 10 | | | | | | 11214 |
| HPV45 | L2 | RASATDLYR | 11 | 9 | | | | | | 11215 |
| HPV45 | L2 | RATMFTRSGK | 302 | 10 | | | | | | 11216 |
| HPV45 | L2 | RLGQRATMFTR | 298 | 11 | | | | | | 11217 |
| HPV45 | L2 | RLHRPALSSR | 281 | 10 | | | | | | 11218 |
| HPV45 | L2 | RLHRPALSSRR | 281 | 11 | | | | | | 11219 |
| HPV45 | L2 | RLYSRANQQVR | 225 | 11 | | | | | | 11220 |
| HPV45 | L2 | RSGKQIGGR | 308 | 9 | | | | | | 11221 |
| HPV45 | L2 | RTGYVPLGGR | 68 | 10 | | | | | | 11222 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV45 | L2 | RVRGPRLYSR | 220 | 10 | | | | | | 11223 |
| HPV45 | L2 | SATDLYRTCK | 13 | 10 | | | | | | 11224 |
| HPV45 | L2 | SSRRGTVR | 288 | 8 | | | | | | 11225 |
| HPV45 | L2 | SSRRGTVRFSR | 288 | 11 | | | | | | 11226 |
| HPV45 | L2 | SSTPLPTVR | 211 | 9 | | | | | | 11227 |
| HPV45 | L2 | SSTPLPTVRR | 211 | 10 | | | | | | 11228 |
| HPV45 | L2 | STIHKSFTYPK | 362 | 11 | | | | | | 11229 |
| HPV45 | L2 | STPLPTVR | 212 | 8 | | | | | | 11230 |
| HPV45 | L2 | STPLPTVRR | 212 | 9 | | | | | | 11231 |
| HPV45 | L2 | STPLPTVRRVR | 212 | 11 | | | | | | 11232 |
| HPV45 | L2 | STTPSTIHK | 358 | 9 | | | | | | 11233 |
| HPV45 | L2 | TIHKSFTYPK | 363 | 10 | | | | | | 11234 |
| HPV45 | L2 | TMFTRSGK | 304 | 8 | | | | | | 11235 |
| HPV45 | L2 | TTPSTIHK | 359 | 8 | | | | | | 11236 |
| HPV45 | L2 | TVRFSRLGQR | 293 | 10 | | | | | | 11237 |
| HPV45 | L2 | TVRRVRGPR | 217 | 9 | | | | | | 11238 |
| HPV45 | L2 | TVVDVGPTR | 80 | 9 | | | | | | 11239 |
| HPV45 | L2 | VSHRAARR | 2 | 8 | | | | | | 11240 |
| HPV45 | L2 | VSHRAARRK | 2 | 9 | | | | | | 11241 |
| HPV45 | L2 | VSHRAARRKR | 2 | 10 | | | | | | 11242 |
| HPV45 | L2 | VVDVGPTR | 81 | 8 | | | | | | 11243 |
| HPV45 | L2 | YLWPWYYYFPK | 437 | 11 | | | | | | 11244 |
| HPV45 | L2 | YSRANQQVR | 227 | 9 | | | | | | 11245 |
| HPV56 | E2 | AAVSHRPGK | 177 | 9 | | | | | | 11246 |
| HPV56 | E2 | AAVSHRPGKR | 177 | 10 | | | | | | 11247 |
| HPV56 | E2 | AVSHRPGK | 178 | 8 | | | | | | 11248 |
| HPV56 | E2 | AVSHRPGKR | 178 | 9 | | | | | | 11249 |
| HPV56 | E2 | AVSHRPGKRPR | 178 | 11 | | | | | | 11250 |
| HPV56 | E2 | CLQVCKAK | 4 | 8 | | | | | | 11251 |
| HPV56 | E2 | CMQYVAWK | 71 | 8 | | | | | | 11252 |
| HPV56 | E2 | DAAVSHRPGK | 176 | 10 | | | | | | 11253 |
| HPV56 | E2 | DAAVSHRPGKR | 176 | 11 | | | | | | 11254 |
| HPV56 | E2 | DSSRESHAK | 195 | 9 | | | | | | 11255 |
| HPV56 | E2 | DSVSSTCR | 140 | 8 | | | | | | 11256 |
| HPV56 | E2 | DTDNTDSR | 213 | 8 | | | | | | 11257 |
| HPV56 | E2 | DTDNTDSRSR | 213 | 10 | | | | | | 11258 |
| HPV56 | E2 | EAKKFGCK | 117 | 8 | | | | | | 11259 |
| HPV56 | E2 | ELWLTEPK | 43 | 8 | | | | | | 11260 |
| HPV56 | E2 | ELWLTEPKK | 43 | 9 | | | | | | 11261 |
| HPV56 | E2 | ESEFDSSR | 191 | 8 | | | | | | 11262 |
| HPV56 | E2 | ETVNEYNTHK | 154 | 10 | | | | | | 11263 |
| HPV56 | E2 | EVWFDGSK | 61 | 8 | | | | | | 11264 |
| HPV56 | E2 | GIYYVHDGHK | 99 | 10 | | | | | | 11265 |
| HPV56 | E2 | HIEVWFDGSK | 59 | 10 | | | | | | 11266 |
| HPV56 | E2 | HISDTDNTDSR | 210 | 11 | | | | | | 11267 |
| HPV56 | E2 | HLKGEPNR | 239 | 8 | | | | | | 11268 |
| HPV56 | E2 | HLKGEPNRLK | 239 | 10 | | | | | | 11269 |
| HPV56 | E2 | HVKIPVVYR | 297 | 9 | | | | | | 11270 |
| HPV56 | E2 | IIYKDETQR | 283 | 9 | | | | | | 11271 |
| HPV56 | E2 | ISDTDNTDSR | 211 | 10 | | | | | | 11272 |
| HPV56 | E2 | ITIIYKDETQR | 281 | 11 | | | | | | 11273 |
| HPV56 | E2 | KTTPVVHLK | 233 | 9 | | | | | | 11274 |
| HPV56 | E2 | KVCSGVDYR | 90 | 9 | | | | | | 11275 |
| HPV56 | E2 | LSHVKIPVVYR | 295 | 11 | | | | | | 11276 |
| HPV56 | E2 | LTEPKKCFK | 46 | 9 | | | | | | 11277 |
| HPV56 | E2 | LTEPKKCFKK | 46 | 10 | | | | | | 11278 |
| HPV56 | E2 | MVPCLQVCK | 1 | 9 | | | | | | 11279 |
| HPV56 | E2 | MVPCLQVCKAK | 1 | 11 | | | | | | 11280 |
| HPV56 | E2 | NSFLSHVK | 292 | 8 | | | | | | 11281 |
| HPV56 | E2 | PVVHLKGEPNR | 236 | 11 | | | | | | 11282 |
| HPV56 | E2 | PVVYRLVWDK | 301 | 10 | | | | | | 11283 |
| HPV56 | E2 | RLKCCRYR | 246 | 8 | | | | | | 11284 |
| HPV56 | E2 | RLKCCRYRFQK | 246 | 11 | | | | | | 11285 |
| HPV56 | E2 | RLRESEFDSSR | 188 | 11 | | | | | | 11286 |
| HPV56 | E2 | SIITIIYK | 279 | 8 | | | | | | 11287 |
| HPV56 | E2 | SINNNNHPGDK | 223 | 11 | | | | | | 11288 |
| HPV56 | E2 | SSRESHAK | 196 | 8 | | | | | | 11289 |
| HPV56 | E2 | STYHWTSTDNK | 266 | 11 | | | | | | 11290 |
| HPV56 | E2 | TIIYKDETQR | 282 | 10 | | | | | | 11291 |
| HPV56 | E2 | TIYNNEEWTLR | 28 | 11 | | | | | | 11292 |
| HPV56 | E2 | TTPVVHLK | 234 | 8 | | | | | | 11293 |
| HPV56 | E2 | TVNEYNTHK | 155 | 9 | | | | | | 11294 |
| HPV56 | E2 | VSHRPGKR | 179 | 8 | | | | | | 11295 |
| HPV56 | E2 | VSHRPGKRPR | 179 | 10 | | | | | | 11296 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV56 | E2 | VVHLKGEPNR | 237 | 10 | | | | | | 11297 |
| HPV56 | E2 | VVYRLVWDK | 302 | 9 | | | | | | 11298 |
| HPV56 | E2 | WLTEPKKCFK | 45 | 10 | | | | | | 11299 |
| HPV56 | E2 | WLTEPKKCFKK | 45 | 11 | | | | | | 11300 |
| HPV56 | E2 | YSIITIIYK | 278 | 9 | | | | | | 11301 |
| HPV56 | E2 | YTDFEQEAK | 111 | 9 | | | | | | 11302 |
| HPV56 | E2 | YTDFEQEAKK | 111 | 10 | | | | | | 11303 |
| HPV56 | E6 | ATLESITK | 89 | 8 | | | | | | 11304 |
| HPV56 | E6 | ATLESITKK | 89 | 9 | | | | | | 11305 |
| HPV56 | E6 | CLGCWRQTSR | 139 | 10 | | | | | | 11306 |
| HPV56 | E6 | CLLFYSKVR | 69 | 9 | | | | | | 11307 |
| HPV56 | E6 | CLLFYSKVRK | 69 | 10 | | | | | | 11308 |
| HPV56 | E6 | CTELKLVYR | 50 | 9 | | | | | | 11309 |
| HPV56 | E6 | CVYCKKELTR | 33 | 10 | | | | | | 11310 |
| HPV56 | E6 | DLLIRCYR | 101 | 8 | | | | | | 11311 |
| HPV56 | E6 | DLRLSCVYCK | 28 | 10 | | | | | | 11312 |
| HPV56 | E6 | DLRLSCVYCKK | 28 | 11 | | | | | | 11313 |
| HPV56 | E6 | EIPLIDLR | 23 | 8 | | | | | | 11314 |
| HPV56 | E6 | EVLEIPLIDLR | 20 | 11 | | | | | | 11315 |
| HPV56 | E6 | EVYNFACTELK | 44 | 11 | | | | | | 11316 |
| HPV56 | E6 | FACTELKLVYR | 48 | 11 | | | | | | 11317 |
| HPV56 | E6 | GATLESITK | 88 | 9 | | | | | | 11318 |
| HPV56 | E6 | GATLESITKK | 88 | 10 | | | | | | 11319 |
| HPV56 | E6 | GSCLGCWR | 137 | 8 | | | | | | 11320 |
| HPV56 | E6 | LLFYSKVR | 70 | 8 | | | | | | 11321 |
| HPV56 | E6 | LLFYSKVRK | 70 | 9 | | | | | | 11322 |
| HPV56 | E6 | LLFYSKVRKYR | 70 | 11 | | | | | | 11323 |
| HPV56 | E6 | LSCVYCKK | 31 | 8 | | | | | | 11324 |
| HPV56 | E6 | QLCDLLIR | 98 | 8 | | | | | | 11325 |
| HPV56 | E6 | QLCDLLIRCYR | 98 | 11 | | | | | | 11326 |
| HPV56 | E6 | QLHCDRKR | 119 | 8 | | | | | | 11327 |
| HPV56 | E6 | QLHCDRKRR | 119 | 9 | | | | | | 11328 |
| HPV56 | E6 | QSPLTPEEK | 110 | 9 | | | | | | 11329 |
| HPV56 | E6 | RLSCVYCK | 30 | 8 | | | | | | 11330 |
| HPV56 | E6 | RLSCVYCKK | 30 | 9 | | | | | | 11331 |
| HPV56 | E6 | RVCLLFYSK | 67 | 9 | | | | | | 11332 |
| HPV56 | E6 | RVCLLFYSKVR | 67 | 11 | | | | | | 11333 |
| HPV56 | E6 | TLESITKK | 90 | 8 | | | | | | 11334 |
| HPV56 | E6 | VLEIPLIDLR | 21 | 10 | | | | | | 11335 |
| HPV56 | E6 | WTGSCLGCWR | 135 | 10 | | | | | | 11336 |
| HPV56 | E6 | YSKVRKYR | 73 | 8 | | | | | | 11337 |
| HPV56 | E7 | DIQSTKEDLR | 75 | 10 | | | | | | 11338 |
| HPV56 | E7 | EVDHLQER | 39 | 8 | | | | | | 11339 |
| HPV56 | E7 | FVVQLDIQSTK | 70 | 11 | | | | | | 11340 |
| HPV56 | E7 | HLQERPQQAR | 42 | 10 | | | | | | 11341 |
| HPV56 | E7 | HVPCCECK | 62 | 8 | | | | | | 11342 |
| HPV56 | E7 | LIHVPCCECK | 60 | 10 | | | | | | 11343 |
| HPV56 | E7 | QLDIQSTK | 73 | 8 | | | | | | 11344 |
| HPV56 | E7 | QSTKEDLR | 77 | 8 | | | | | | 11345 |
| HPV56 | E7 | VVQLDIQSTK | 71 | 10 | | | | | | 11346 |
| HPV56 | E7 | YLIHVPCCECK | 59 | 11 | | | | | | 11347 |
| HPV56 | L1 | AMDFKVLQESK | 241 | 11 | | | | | | 11348 |
| HPV56 | L1 | AMGEHWTK | 198 | 8 | | | | | | 11349 |
| HPV56 | L1 | ATDSYVKR | 58 | 8 | | | | | | 11350 |
| HPV56 | L1 | ATEQLSKYDAR | 381 | 11 | | | | | | 11351 |
| HPV56 | L1 | ATSLEDKYR | 444 | 9 | | | | | | 11352 |
| HPV56 | L1 | ATWRPSENK | 37 | 9 | | | | | | 11353 |
| HPV56 | L1 | AVATSKKR | 512 | 8 | | | | | | 11354 |
| HPV56 | L1 | AVGHPYYSVTK | 79 | 11 | | | | | | 11355 |
| HPV56 | L1 | CTPAMGEHWTK | 195 | 11 | | | | | | 11356 |
| HPV56 | L1 | CVGLEVGR | 136 | 8 | | | | | | 11357 |
| HPV56 | L1 | DARKINQYLR | 389 | 10 | | | | | | 11358 |
| HPV56 | L1 | DIVQSTCK | 257 | 8 | | | | | | 11359 |
| HPV56 | L1 | DLDQFPLGR | 491 | 9 | | | | | | 11360 |
| HPV56 | L1 | DLDQFPLGRK | 491 | 10 | | | | | | 11361 |
| HPV56 | L1 | DSMWFYLR | 278 | 8 | | | | | | 11362 |
| HPV56 | L1 | DSMWFYLRR | 278 | 9 | | | | | | 11363 |
| HPV56 | L1 | DSRDNISVDGK | 176 | 11 | | | | | | 11364 |
| HPV56 | L1 | DTGFGAMDFK | 236 | 10 | | | | | | 11365 |
| HPV56 | L1 | DTNIYNPDQER | 121 | 11 | | | | | | 11366 |
| HPV56 | L1 | ELQFVFQLCK | 404 | 10 | | | | | | 11367 |
| HPV56 | L1 | ELYLKGSNGR | 308 | 10 | | | | | | 11368 |
| HPV56 | L1 | ETIPAELYLK | 303 | 10 | | | | | | 11369 |
| HPV56 | L1 | FARHYFNR | 290 | 8 | | | | | | 11370 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV56 | L1 | FARHYFNRAGK | 290 | 11 | | | | | | 11371 |
| HPV56 | L1 | FLMQLGTR | 501 | 8 | | | | | | 11372 |
| HPV56 | L1 | FLMQLGTRSK | 501 | 10 | | | | | | 11373 |
| HPV56 | L1 | FLQMATWR | 33 | 8 | | | | | | 11374 |
| HPV56 | L1 | FVTVVDTTR | 364 | 9 | | | | | | 11375 |
| HPV56 | L1 | GLSGHPLFNR | 150 | 10 | | | | | | 11376 |
| HPV56 | L1 | ISTATEQLSK | 378 | 10 | | | | | | 11377 |
| HPV56 | L1 | ITSEAQLFNK | 334 | 10 | | | | | | 11378 |
| HPV56 | L1 | KVSAYQYR | 98 | 8 | | | | | | 11379 |
| HPV56 | L1 | KVSAYQYRVFR | 98 | 11 | | | | | | 11380 |
| HPV56 | L1 | KVVATDSYVK | 55 | 10 | | | | | | 11381 |
| HPV56 | L1 | KVVATDSYVKR | 55 | 11 | | | | | | 11382 |
| HPV56 | L1 | KFYLPPTPVSK | 45 | 11 | | | | | | 11383 |
| HPV56 | L1 | LANNNVIEDSR | 168 | 11 | | | | | | 11384 |
| HPV56 | L1 | LMQLGTRSK | 502 | 9 | | | | | | 11385 |
| HPV56 | L1 | LSGHPLFNR | 151 | 9 | | | | | | 11386 |
| HPV56 | L1 | LSKYDARK | 385 | 8 | | | | | | 11387 |
| HPV56 | L1 | MATWRPSENK | 36 | 10 | | | | | | 11388 |
| HPV56 | L1 | MITSEAQLFNK | 333 | 11 | | | | | | 11389 |
| HPV56 | L1 | MLPMMYIYR | 2 | 9 | | | | | | 11390 |
| HPV56 | L1 | MMLPMMYIYR | 1 | 10 | | | | | | 11391 |
| HPV56 | L1 | NIPKVSAYQYR | 95 | 11 | | | | | | 11392 |
| HPV56 | L1 | NIYNPDQER | 123 | 9 | | | | | | 11393 |
| HPV56 | L1 | NTKTNIPK | 91 | 8 | | | | | | 11394 |
| HPV56 | L1 | PAMGEHWTK | 197 | 9 | | | | | | 11395 |
| HPV56 | L1 | PAVATSKK | 511 | 8 | | | | | | 11396 |
| HPV56 | L1 | PAVATSKKR | 511 | 9 | | | | | | 11397 |
| HPV56 | L1 | PIFLQMATWR | 31 | 10 | | | | | | 11398 |
| HPV56 | L1 | PLDIVQSTCK | 255 | 10 | | | | | | 11399 |
| HPV56 | L1 | PTEKQDPLAK | 467 | 10 | | | | | | 11400 |
| HPV56 | L1 | PTSTSTPAK | 522 | 9 | | | | | | 11401 |
| HPV56 | L1 | PTSTSTPAKR | 522 | 10 | | | | | | 11402 |
| HPV56 | L1 | PTSTSTPAKRK | 522 | 11 | | | | | | 11403 |
| HPV56 | L1 | PVATSLEDK | 442 | 9 | | | | | | 11404 |
| HPV56 | L1 | PVATSLEDKYR | 442 | 11 | | | | | | 11405 |
| HPV56 | L1 | QLFARHYFNR | 288 | 10 | | | | | | 11406 |
| HPV56 | L1 | QLFNKPYWLQR | 339 | 11 | | | | | | 11407 |
| HPV56 | L1 | QLFVTVVDTTR | 362 | 11 | | | | | | 11408 |
| HPV56 | L1 | QLSKYDAR | 384 | 8 | | | | | | 11409 |
| HPV56 | L1 | QLSKYDARK | 384 | 9 | | | | | | 11410 |
| HPV56 | L1 | QMATWRPSENK | 35 | 11 | | | | | | 11411 |
| HPV56 | L1 | QSTCKYPDYLK | 260 | 11 | | | | | | 11412 |
| HPV56 | L1 | RSKPAVATSK | 508 | 10 | | | | | | 11413 |
| HPV56 | L1 | RSKPAVATSKK | 508 | 11 | | | | | | 11414 |
| HPV56 | L1 | RSTAITCQR | 455 | 9 | | | | | | 11415 |
| HPV56 | L1 | RVRLPDPNK | 108 | 9 | | | | | | 11416 |
| HPV56 | L1 | SAPTSTSTPAK | 520 | 11 | | | | | | 11417 |
| HPV56 | L1 | SAYQYRVFR | 100 | 9 | | | | | | 11418 |
| HPV56 | L1 | SAYQYRVFRVR | 100 | 11 | | | | | | 11419 |
| HPV56 | L1 | SIFYHAGSSR | 67 | 10 | | | | | | 11420 |
| HPV56 | L1 | SLEDKYRYVR | 446 | 10 | | | | | | 11421 |
| HPV56 | L1 | SMWFYLRR | 279 | 8 | | | | | | 11422 |
| HPV56 | L1 | STAITCQR | 456 | 8 | | | | | | 11423 |
| HPV56 | L1 | STATEQLSK | 379 | 9 | | | | | | 11424 |
| HPV56 | L1 | STCKYPDYLK | 261 | 10 | | | | | | 11425 |
| HPV56 | L1 | STDLDQFPLGR | 489 | 11 | | | | | | 11426 |
| HPV56 | L1 | STPAKRKR | 526 | 8 | | | | | | 11427 |
| HPV56 | L1 | STPAKRKRR | 526 | 9 | | | | | | 11428 |
| HPV56 | L1 | STSTPAKR | 524 | 8 | | | | | | 11429 |
| HPV56 | L1 | STSPAKRK | 524 | 9 | | | | | | 11430 |
| HPV56 | L1 | STSPAKRKR | 524 | 10 | | | | | | 11431 |
| HPV56 | L1 | STSPAKRKRR | 524 | 11 | | | | | | 11432 |
| HPV56 | L1 | SVTKDNTK | 86 | 8 | | | | | | 11433 |
| HPV56 | L1 | TATEQLSK | 380 | 8 | | | | | | 11434 |
| HPV56 | L1 | TIPAELYLK | 304 | 9 | | | | | | 11435 |
| HPV56 | L1 | TISTATEQLSK | 377 | 11 | | | | | | 11436 |
| HPV56 | L1 | TSEAQLFNK | 335 | 9 | | | | | | 11437 |
| HPV56 | L1 | TSIFYHAGSSR | 66 | 11 | | | | | | 11438 |
| HPV56 | L1 | TSLEDKYR | 445 | 8 | | | | | | 11439 |
| HPV56 | L1 | TSLEDKYRYVR | 445 | 11 | | | | | | 11440 |
| HPV56 | L1 | TSTPAKRK | 525 | 8 | | | | | | 11441 |
| HPV56 | L1 | TSTPAKRKR | 525 | 9 | | | | | | 11442 |
| HPV56 | L1 | TSTPAKRKRR | 525 | 10 | | | | | | 11443 |
| HPV56 | L1 | TSTSTPAK | 523 | 8 | | | | | | 11444 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV56 | L1 | TSTSTPAKR | 523 | 9 | | | | | | 11445 |
| HPV56 | L1 | TSTSTPAKRK | 523 | 10 | | | | | | 11446 |
| HPV56 | L1 | TSTSTPAKRKR | 523 | 11 | | | | | | 11447 |
| HPV56 | L1 | VATDSYVK | 57 | 8 | | | | | | 11448 |
| HPV56 | L1 | VATDSYVKR | 57 | 9 | | | | | | 11449 |
| HPV56 | L1 | VATSLEDK | 443 | 8 | | | | | | 11450 |
| HPV56 | L1 | VATSLEDKYR | 443 | 10 | | | | | | 11451 |
| HPV56 | L1 | VSAYQYRVFR | 99 | 10 | | | | | | 11452 |
| HPV56 | L1 | VTVVDTTR | 365 | 8 | | | | | | 11453 |
| HPV56 | L1 | VVATDSYVK | 56 | 9 | | | | | | 11454 |
| HPV56 | L1 | VVATDSYVKR | 56 | 10 | | | | | | 11455 |
| HPV56 | L1 | WACVGLEVGR | 134 | 10 | | | | | | 11456 |
| HPV56 | L1 | WTKGAVCK | 203 | 8 | | | | | | 11457 |
| HPV56 | L1 | YLKGSNGR | 310 | 8 | | | | | | 11458 |
| HPV56 | L1 | YLPPTPVSK | 47 | 9 | | | | | | 11459 |
| HPV56 | L1 | YLRREQLFAR | 283 | 10 | | | | | | 11460 |
| HPV56 | L1 | YSVTKDNTK | 85 | 9 | | | | | | 11461 |
| HPV56 | L1 | YVRSTAITCQR | 453 | 11 | | | | | | 11462 |
| HPV56 | L2 | AAPRLYRK | 222 | 8 | | | | | | 11463 |
| HPV56 | L2 | ALHRPAFTTR | 281 | 10 | | | | | | 11464 |
| HPV56 | L2 | ALHRPAFTTRR | 281 | 11 | | | | | | 11465 |
| HPV56 | L2 | ALWPVYFFR | 438 | 9 | | | | | | 11466 |
| HPV56 | L2 | ALWPVYFFRR | 438 | 10 | | | | | | 11467 |
| HPV56 | L2 | ALWPVYFFRRR | 438 | 11 | | | | | | 11468 |
| HPV56 | L2 | ASATQLYK | 12 | 8 | | | | | | 11469 |
| HPV56 | L2 | ASATQLYKTCK | 12 | 11 | | | | | | 11470 |
| HPV56 | L2 | ATPSAHLPIK | 367 | 10 | | | | | | 11471 |
| HPV56 | L2 | ATQLYKTCK | 14 | 9 | | | | | | 11472 |
| HPV56 | L2 | DVVNKIEQK | 30 | 9 | | | | | | 11473 |
| HPV56 | L2 | FALWPVYFFR | 437 | 10 | | | | | | 11474 |
| HPV56 | L2 | FALWPVYFFRR | 437 | 11 | | | | | | 11475 |
| HPV56 | L2 | FMNIVALHR | 276 | 9 | | | | | | 11476 |
| HPV56 | L2 | FTTRRGGVR | 287 | 9 | | | | | | 11477 |
| HPV56 | L2 | GIGTGTGSGGR | 58 | 11 | | | | | | 11478 |
| HPV56 | L2 | GTCPEDVVNK | 25 | 10 | | | | | | 11479 |
| HPV56 | L2 | GTGTGSGGR | 60 | 9 | | | | | | 11480 |
| HPV56 | L2 | GVRFSRLGR | 293 | 9 | | | | | | 11481 |
| HPV56 | L2 | GVRFSRLGRK | 293 | 10 | | | | | | 11482 |
| HPV56 | L2 | IAAPRLYR | 221 | 8 | | | | | | 11483 |
| HPV56 | L2 | IAAPRLYRK | 221 | 9 | | | | | | 11484 |
| HPV56 | L2 | ISSTPIPGFR | 210 | 10 | | | | | | 11485 |
| HPV56 | L2 | ISSTPIPGFRR | 210 | 11 | | | | | | 11486 |
| HPV56 | L2 | IVDVTPAR | 81 | 8 | | | | | | 11487 |
| HPV56 | L2 | KATIQTRR | 302 | 8 | | | | | | 11488 |
| HPV56 | L2 | KIEQKTWADK | 34 | 10 | | | | | | 11489 |
| HPV56 | L2 | KVTDPAFLDR | 235 | 10 | | | | | | 11490 |
| HPV56 | L2 | MVAHRATR | 1 | 8 | | | | | | 11491 |
| HPV56 | L2 | MVAHRATRR | 1 | 9 | | | | | | 11492 |
| HPV56 | L2 | MVAHRATRRK | 1 | 10 | | | | | | 11493 |
| HPV56 | L2 | MVAHRATRRKR | 1 | 11 | | | | | | 11494 |
| HPV56 | L2 | PAFTTRRGGVR | 285 | 11 | | | | | | 11495 |
| HPV56 | L2 | PISSTPIPGFR | 209 | 11 | | | | | | 11496 |
| HPV56 | L2 | PSAHLPIK | 369 | 8 | | | | | | 11497 |
| HPV56 | L2 | PSTIVDVTPAR | 78 | 11 | | | | | | 11498 |
| HPV56 | L2 | PVYFFRRR | 441 | 8 | | | | | | 11499 |
| HPV56 | L2 | PVYFFRRRR | 441 | 9 | | | | | | 11500 |
| HPV56 | L2 | PVYFFRRRRR | 441 | 10 | | | | | | 11501 |
| HPV56 | L2 | PVYFFRRRRRK | 441 | 11 | | | | | | 11502 |
| HPV56 | L2 | QTRRGTQIGAR | 306 | 11 | | | | | | 11503 |
| HPV56 | L2 | RAGYVPLGSR | 68 | 10 | | | | | | 11504 |
| HPV56 | L2 | RASATQLYK | 11 | 9 | | | | | | 11505 |
| HPV56 | L2 | RIAAPRLYR | 220 | 9 | | | | | | 11506 |
| HPV56 | L2 | RIAAPRLYRK | 220 | 10 | | | | | | 11507 |
| HPV56 | L2 | RLGRKATIQTR | 298 | 11 | | | | | | 11508 |
| HPV56 | L2 | RLYRKAFQQVK | 225 | 11 | | | | | | 11509 |
| HPV56 | L2 | SATQLYKTCK | 13 | 10 | | | | | | 11510 |
| HPV56 | L2 | SSTPIPGFR | 211 | 9 | | | | | | 11511 |
| HPV56 | L2 | SSTPIPGFRR | 211 | 10 | | | | | | 11512 |
| HPV56 | L2 | STIVDVTPAR | 79 | 10 | | | | | | 11513 |
| HPV56 | L2 | STPIPGFR | 212 | 8 | | | | | | 11514 |
| HPV56 | L2 | STPIPGFRR | 212 | 9 | | | | | | 11515 |
| HPV56 | L2 | TIVDVTPAR | 80 | 9 | | | | | | 11516 |
| HPV56 | L2 | TTRRGGVR | 288 | 8 | | | | | | 11517 |
| HPV56 | L2 | TTRRGGVRFSR | 288 | 11 | | | | | | 11518 |

TABLE IX-continued

A03 Supermotif Peptides with Binding Data

| Type | Protein | Sequence | Position | No. of Amino Acids | A*0301 | A*1101 | A*3101 | A*3301 | A*6801 | Seq. Id. No. |
|---|---|---|---|---|---|---|---|---|---|---|
| HPV56 | L2 | VAHRATRR | 2 | 8 | | | | | | 11519 |
| HPV56 | L2 | VAHRATRRK | 2 | 9 | | | | | | 11520 |
| HPV56 | L2 | VAHRATRRKR | 2 | 10 | | | | | | 11521 |
| HPV56 | L2 | VALHRPAFTTR | 280 | 11 | | | | | | 11522 |
| HPV56 | L2 | VATPSAHLPIK | 366 | 11 | | | | | | 11523 |
| HPV56 | L2 | VTDPAFLDR | 236 | 9 | | | | | | 11524 |
| HPV56 | L2 | VVNKIEQK | 31 | 8 | | | | | | 11525 |

TABLE X

A24 Supermotif Peptides

| Type | Protein | Position | No. of Amino Acids | Sequence | A*2402 | Seq. Id. No. |
|---|---|---|---|---|---|---|
| HPV16 | E1 | 240 | 8 | AFGLTPSI | | 11526 |
| HPV16 | E1 | 391 | 11 | AFLKSNSQAKI | | 11527 |
| HPV16 | E1 | 539 | 9 | ALDGNLVSM | | 11528 |
| HPV16 | E1 | 459 | 9 | ALKRFLQGI | | 11529 |
| HPV16 | E1 | 318 | 9 | ALYWYKTGI | | 11530 |
| HPV16 | E1 | 206 | 9 | AMLAKFKEL | | 11531 |
| HPV16 | E1 | 206 | 10 | AMLAKFKELY | | 11532 |
| HPV16 | E1 | 524 | 8 | ATVPCWNY | | 11533 |
| HPV16 | E1 | 524 | 9 | ATVPCWNYI | | 11534 |
| HPV16 | E1 | 82 | 9 | AVQVLKRKY | | 11535 |
| HPV16 | E1 | 82 | 10 | AVQVLKRKYL | | 11536 |
| HPV16 | E1 | 23 | 11 | AVVEKKTGDAI | | 11537 |
| HPV16 | E1 | 500 | 9 | CFVNSKSHF | | 11538 |
| HPV16 | E1 | 500 | 10 | CFVNSKSHFW | | 11539 |
| HPV16 | E1 | 500 | 11 | CFVNSKSHFWL | | 11540 |
| HPV16 | E1 | 237 | 11 | CIAAFGLTPSI | | 11541 |
| HPV16 | E1 | 259 | 9 | CLYLHIQSL | | 11542 |
| HPV16 | E1 | 304 | 9 | CMMIEPPKL | | 11543 |
| HPV16 | E1 | 353 | 8 | CTFELSQM | | 11544 |
| HPV16 | E1 | 353 | 11 | CTFELSQMVQW | | 11545 |
| HPV16 | E1 | 101 | 10 | CVDNNISPRL | | 11546 |
| HPV16 | E1 | 640 | 10 | CVSGQNTNTL | | 11547 |
| HPV16 | E1 | 299 | 8 | CVSPMCMM | | 11548 |
| HPV16 | E1 | 299 | 9 | CVSPMCMMI | | 11549 |
| HPV16 | E1 | 528 | 9 | CWNYIDDNL | | 11550 |
| HPV16 | E1 | 50 | 9 | DFIVNDNDY | | 11551 |
| HPV16 | E1 | 50 | 10 | DFIVNDNDYL | | 11552 |
| HPV16 | E1 | 97 | 10 | DISGCVDNNI | | 11553 |
| HPV16 | E1 | 368 | 8 | DIVDDSEI | | 11554 |
| HPV16 | E1 | 368 | 10 | DIVDDSEIAY | | 11555 |
| HPV16 | E1 | 43 | 9 | DTGEDLVDF | | 11556 |
| HPV16 | E1 | 43 | 10 | DTGEDLVDFI | | 11557 |
| HPV16 | E1 | 384 | 9 | DTNSNASAF | | 11558 |
| HPV16 | E1 | 384 | 10 | DTNSNASAFL | | 11559 |
| HPV16 | E1 | 548 | 10 | DVKHRPLVQL | | 11560 |
| HPV16 | E1 | 235 | 9 | DWCIAAFGL | | 11561 |
| RPV16 | E1 | 438 | 8 | DWKQIVMF | | 11562 |
| HPV16 | E1 | 438 | 9 | DWKQIVMFL | | 11563 |
| HPV16 | E1 | 438 | 11 | DWKQIVMFLRY | | 11564 |
| HPV16 | E1 | 452 | 9 | EFMSFLTAL | | 11565 |
| HPV16 | E1 | 374 | 9 | EIAYKYAQL | | 11566 |
| HPV16 | E1 | 603 | 10 | ELNDKNWKSF | | 11567 |
| HPV16 | E1 | 603 | 11 | ELNDKNWKSFF | | 11568 |
| HPV16 | E1 | 356 | 8 | ELSQMVQW | | 11569 |
| HPV16 | E1 | 356 | 10 | ELSQMVQWAY | | 11570 |
| HPV16 | E1 | 213 | 10 | ELYGVSFSEL | | 11571 |
| HPV16 | E1 | 63 | 8 | ETETAHAL | | 11572 |
| HPV16 | E1 | 63 | 9 | ETETAHALF | | 11573 |
| HPV16 | E1 | 152 | 9 | ETETPCSQY | | 11574 |
| HPV16 | E1 | 288 | 10 | ETIEKLLSKL | | 11575 |
| HPV16 | E1 | 288 | 11 | ETIEKLLSKLL | | 11576 |
| HPV16 | E1 | 138 | 8 | EVETQQML | | 11577 |
| HPV16 | E1 | 331 | 9 | EVYGDTPEW | | 11578 |
| HPV16 | E1 | 331 | 10 | EVYGDTPEWI | | 11579 |
| HPV16 | E1 | 338 | 9 | EWIQRQTVL | | 11580 |
| HPV16 | E1 | 612 | 9 | FFSRTWSRL | | 11581 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | E1 | 612 | 11 | FFSRTWSRLSL | | 11582 |
| HPV16 | E1 | 51 | 8 | FIVNDNDY | | 11583 |
| HPV16 | E1 | 51 | 9 | FIVNDNDYL | | 11584 |
| HPV16 | E1 | 392 | 10 | FLKSNSQAKI | | 11585 |
| HPV16 | E1 | 463 | 11 | FLQGIPKKNCI | | 11586 |
| HPV16 | E1 | 493 | 9 | FLQGSVICF | | 11587 |
| HPV16 | E1 | 445 | 9 | FLRYQGVEF | | 11588 |
| HPV16 | E1 | 445 | 10 | FLRYQGVEFM | | 11589 |
| HPV16 | E1 | 456 | 8 | FLTALKRF | | 11590 |
| HPV16 | E1 | 456 | 9 | FLTALKRFL | | 11591 |
| HPV16 | E1 | 453 | 8 | FMSFLTAL | | 11592 |
| HPV16 | E1 | 453 | 11 | FMSFLTALKRF | | 11593 |
| HPV16 | E1 | 586 | 9 | FTFPNEFPF | | 11594 |
| HPV16 | E1 | 501 | 8 | FVNSKSHF | | 11595 |
| HPV16 | E1 | 501 | 9 | FVNSKSHFW | | 11596 |
| HPV16 | E1 | 501 | 10 | FVNSKSHFWL | | 11597 |
| HPV16 | E1 | 508 | 11 | FWLQPLADAKI | | 11598 |
| HPV16 | E1 | 466 | 8 | GIPKKNCI | | 11599 |
| HPV16 | E1 | 466 | 9 | GIPKKNCIL | | 11600 |
| HPV16 | E1 | 466 | 10 | GIPKKNCILL | | 11601 |
| HPV16 | E1 | 466 | 11 | GIPKKNCILLY | | 11602 |
| HPV16 | E1 | 325 | 9 | GISNISEVY | | 11603 |
| HPV16 | E1 | 242 | 10 | GLTPSIADSI | | 11604 |
| HPV16 | E1 | 519 | 11 | GMLDDATVPCW | | 11605 |
| HPV16 | E1 | 487 | 8 | GMSLMKFL | | 11606 |
| HPV16 | E1 | 272 | 10 | GMVVLLLVRY | | 11607 |
| HPV16 | E1 | 571 | 8 | GTDSRWPY | | 11608 |
| HPV16 | E1 | 571 | 9 | GTDSRWPYL | | 11609 |
| HPV16 | E1 | 12 | 8 | GTGCNGWF | | 11610 |
| HPV16 | E1 | 12 | 9 | GTGCNGWFY | | 11611 |
| HPV16 | E1 | 450 | 8 | GVEFMSFL | | 11612 |
| HPV16 | E1 | 450 | 11 | GVEFMSFLTAL | | 11613 |
| HPV16 | E1 | 179 | 8 | GVSERHTI | | 11614 |
| HPV16 | E1 | 216 | 11 | GVSFSELVRPF | | 11615 |
| HPV16 | E1 | 263 | 9 | HIQSLACSW | | 11616 |
| HPV16 | E1 | 263 | 11 | HIQSLACSWGM | | 11617 |
| HPV16 | E1 | 184 | 8 | HTICQTPL | | 11618 |
| HPV16 | E1 | 184 | 11 | HTICQTPLTNI | | 11619 |
| HPV16 | E1 | 411 | 10 | HYKRAEKKQM | | 11620 |
| HPV16 | E1 | 369 | 9 | IVDDSEIAY | | 11621 |
| HPV16 | E1 | 369 | 11 | IVDDSEIAYKY | | 11622 |
| HPV16 | E1 | 401 | 8 | IVKDCATM | | 11623 |
| HPV16 | E1 | 52 | 8 | IVNDNDYL | | 11624 |
| HPV16 | E1 | 210 | 10 | KFKELYGVSF | | 11625 |
| HPV16 | E1 | 492 | 8 | KFLQGSVI | | 11626 |
| HPV16 | E1 | 492 | 10 | KFLQGSVICF | | 11627 |
| HPV16 | E1 | 400 | 9 | KIVKDCATM | | 11628 |
| HPV16 | E1 | 296 | 8 | KLLCVSPM | | 11629 |
| HPV16 | E1 | 296 | 10 | KLLCVSPMCM | | 11630 |
| HPV16 | E1 | 296 | 11 | KLLCVSPMCMM | | 11631 |
| HPV16 | E1 | 311 | 9 | KLRSTAAAL | | 11632 |
| HPV16 | E1 | 311 | 10 | KLRSTAAALY | | 11633 |
| HPV16 | E1 | 311 | 11 | KLRSTAAALYW | | 11634 |
| HPV16 | E1 | 323 | 11 | KTGISNISEVY | | 11635 |
| HPV16 | E1 | 252 | 9 | KTLLQQYCL | | 11636 |
| HPV16 | E1 | 252 | 10 | KTLLQQYCLY | | 11637 |
| HPV16 | E1 | 252 | 11 | KTLLQQYCLYL | | 11638 |
| HPV16 | E1 | 199 | 9 | KTSNAKAAM | | 11639 |
| HPV16 | E1 | 199 | 10 | KTSNAKAAML | | 11640 |
| HPV16 | E1 | 89 | 10 | KYLVSPLSDI | | 11641 |
| HPV16 | E1 | 126 | 9 | LFESEDSGY | | 11642 |
| HPV16 | E1 | 485 | 9 | LFGMSLMKF | | 11643 |
| HPV16 | E1 | 485 | 10 | LFGMSLMKFL | | 11644 |
| HPV16 | E1 | 297 | 9 | LLCVSPMCM | | 11645 |
| HPV16 | E1 | 297 | 10 | LLCVSPMCMM | | 11646 |
| HPV16 | E1 | 297 | 11 | LLCVSPMCMMI | | 11647 |
| HPV16 | E1 | 254 | 8 | LLQQYCLY | | 11648 |
| HPV16 | E1 | 254 | 9 | LLQQYCLYL | | 11649 |
| HPV16 | E1 | 254 | 11 | LLQQYCLYLHI | | 11650 |
| HPV16 | E1 | 293 | 11 | LLSKLLCVSPM | | 11651 |
| HPV16 | E1 | 490 | 10 | LMKFLQGSVI | | 11652 |
| HPV16 | E1 | 457 | 8 | LTALKRFL | | 11653 |
| HPV16 | E1 | 457 | 11 | LTALKRFLQGI | | 11654 |
| HPV16 | E1 | 191 | 8 | LTNILNVL | | 11655 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | E1 | 243 | 9 | LTPSIADSI | | 11656 |
| HPV16 | E1 | 48 | 11 | LVDFIVNDNDY | | 11657 |
| HPV16 | E1 | 554 | 9 | LVQLKCPPL | | 11658 |
| HPV16 | E1 | 554 | 10 | LVQLKCPPLL | | 11659 |
| HPV16 | E1 | 554 | 11 | LVQLKCPPLLI | | 11660 |
| HPV16 | E1 | 544 | 11 | LVSMDVKHRPL | | 11661 |
| HPV16 | E1 | 91 | 8 | LVSPLSDI | | 11662 |
| HPV16 | E1 | 583 | 10 | LVVFTFPNEF | | 11663 |
| HPV16 | E1 | 475 | 11 | LYGAANTGKSL | | 11664 |
| HPV16 | E1 | 214 | 9 | LYGVSFSEL | | 11665 |
| HPV16 | E1 | 260 | 8 | LYLHIQSL | | 11666 |
| HPV16 | E1 | 319 | 8 | LYWYKTGI | | 11667 |
| HPV16 | E1 | 319 | 11 | LYWYKTGISNI | | 11668 |
| HPV16 | E1 | 444 | 10 | MFLRYQGVEF | | 11669 |
| HPV16 | E1 | 444 | 11 | MFLRYQGVEFM | | 11670 |
| HPV16 | E1 | 207 | 8 | MLAKFKEL | | 11671 |
| HPV16 | E1 | 207 | 9 | MLAKFKELY | | 11672 |
| HPV16 | E1 | 520 | 10 | MLDDATVPCW | | 11673 |
| HPV16 | E1 | 305 | 8 | MMIEPPKL | | 11674 |
| HPV16 | E1 | 360 | 10 | MVQWAYDNDI | | 11675 |
| HPV16 | E1 | 273 | 9 | MVVLLLVRY | | 11676 |
| HPV16 | E1 | 567 | 10 | NINAGTDSRW | | 11677 |
| HPV16 | E1 | 105 | 9 | NISPRLKAI | | 11678 |
| HPV16 | E1 | 105 | 11 | NISPRLKAICI | | 11679 |
| HPV16 | E1 | 535 | 10 | NLRNALDGNL | | 11680 |
| HPV16 | E1 | 136 | 9 | NTEVETQQM | | 11681 |
| HPV16 | E1 | 136 | 10 | NTEVETQQML | | 11682 |
| HPV16 | E1 | 480 | 9 | NTGKSLFGM | | 11683 |
| HPV16 | E1 | 480 | 11 | NTGKSLFGMSL | | 11684 |
| HPV16 | E1 | 608 | 10 | NWKSFFSRTW | | 11685 |
| HPV16 | E1 | 530 | 11 | NYIDDNLRNAL | | 11686 |
| HPV16 | E1 | 593 | 10 | PFDENGNPVY | | 11687 |
| HPV16 | E1 | 512 | 9 | PLADAKIGM | | 11688 |
| HPV16 | E1 | 512 | 10 | PLADAKIGML | | 11689 |
| HPV16 | E1 | 561 | 8 | PLLITSNI | | 11690 |
| HPV16 | E1 | 190 | 9 | PLTNILNVL | | 11691 |
| HPV16 | E1 | 553 | 10 | PLVQLKCPPL | | 11692 |
| HPV16 | E1 | 553 | 11 | PLVQLKCPPLL | | 11693 |
| HPV16 | E1 | 302 | 11 | PMCMMIEPPKL | | 11694 |
| HPV16 | E1 | 600 | 10 | PVYELNDKNW | | 11695 |
| HPV16 | E1 | 577 | 10 | PYLHNRLVVF | | 11696 |
| HPV16 | E1 | 441 | 8 | QIVMFLRY | | 11697 |
| HPV16 | E1 | 556 | 8 | QLKCPPLL | | 11698 |
| HPV16 | E1 | 556 | 9 | QLKCPPLLI | | 11699 |
| HPV16 | E1 | 419 | 8 | QMSMSQWI | | 11700 |
| HPV16 | E1 | 419 | 10 | QMSMSQWIKY | | 11701 |
| HPV16 | E1 | 359 | 11 | QMVQWAYDNDI | | 11702 |
| HPV16 | E1 | 188 | 8 | QTPLTNIL | | 11703 |
| HPV16 | E1 | 188 | 11 | QTPLTNILNVL | | 11704 |
| HPV16 | E1 | 343 | 8 | QTVLQHSF | | 11705 |
| HPV16 | E1 | 84 | 8 | QVLKRKYL | | 11706 |
| HPV16 | E1 | 362 | 8 | QWAYDNDI | | 11707 |
| HPV16 | E1 | 257 | 8 | QYCLYLHI | | 11708 |
| HPV16 | E1 | 257 | 11 | QYCLYLHIQSL | | 11709 |
| HPV16 | E1 | 125 | 10 | RLFESEDSGY | | 11710 |
| HPV16 | E1 | 582 | 11 | RLVVFTFPNEF | | 11711 |
| HPV16 | E1 | 615 | 8 | RTWSRLSL | | 11712 |
| HPV16 | E1 | 432 | 8 | RVDDGGDW | | 11713 |
| HPV16 | E1 | 432 | 11 | RVDDGGDWKQI | | 11714 |
| HPV16 | E1 | 575 | 9 | RWPYLHNRL | | 11715 |
| HPV16 | E1 | 280 | 11 | RYKCGKNRETI | | 11716 |
| HPV16 | E1 | 447 | 8 | RYQGVEFM | | 11717 |
| HPV16 | E1 | 447 | 10 | RYQGVEFMSF | | 11718 |
| HPV16 | E1 | 447 | 11 | RYQGVEFMSFL | | 11719 |
| HPV16 | E1 | 611 | 10 | SFFSRTWSRL | | 11720 |
| HPV16 | E1 | 455 | 9 | SFLTALKRF | | 11721 |
| HPV16 | E1 | 455 | 10 | SFLTALKRFL | | 11722 |
| HPV16 | E1 | 349 | 9 | SFNDCTFEL | | 11723 |
| HPV16 | E1 | 218 | 9 | SFSELVRPF | | 11724 |
| RPV16 | E1 | 246 | 9 | SIADSIKTL | | 11725 |
| HPV16 | E1 | 246 | 10 | SIADSIKTLL | | 11726 |
| HPV16 | E1 | 250 | 9 | SIKTLLQQY | | 11727 |
| HPV16 | E1 | 250 | 11 | SIKTLLQQYCL | | 11728 |
| HPV16 | E1 | 266 | 8 | SLACSWGM | | 11729 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | E1 | 266 | 11 | SLACSWGMVVL | | 11730 |
| HPV16 | E1 | 484 | 8 | SLFGMSLM | | 11731 |
| HPV16 | E1 | 484 | 10 | SLFGMSLMKF | | 11732 |
| HPV16 | E1 | 484 | 11 | SLFGMSLMKFL | | 11733 |
| HPV16 | E1 | 489 | 11 | SLMKFLQGSVI | | 11734 |
| HPV16 | E1 | 546 | 9 | SMDVKHRPL | | 11735 |
| HPV16 | E1 | 421 | 8 | SMSQWIKY | | 11736 |
| HPV16 | E1 | 314 | 8 | STAAALYW | | 11737 |
| HPV16 | E1 | 314 | 9 | STAAALYWY | | 11738 |
| HPV16 | E1 | 231 | 8 | STCCDWCI | | 11739 |
| HPV16 | E1 | 231 | 11 | STCCDWCIAAF | | 11740 |
| HPV16 | E1 | 270 | 8 | SWGMVVLL | | 11741 |
| HPV16 | E1 | 270 | 9 | SWGMVVLLL | | 11742 |
| HPV16 | E1 | 354 | 10 | TFELSQMVQW | | 11743 |
| HPV16 | E1 | 587 | 8 | TFPNEFPF | | 11744 |
| HPV16 | E1 | 185 | 10 | TICQTPLTNI | | 11745 |
| HPV16 | E1 | 185 | 11 | TICQTPLTNIL | | 11746 |
| HPV16 | E1 | 289 | 9 | TIEKLLSKL | | 11747 |
| HPV16 | E1 | 289 | 10 | TIEKLLSKLL | | 11748 |
| HPV16 | E1 | 253 | 8 | TLLQQYCL | | 11749 |
| HPV16 | E1 | 253 | 9 | TLLQQYCLY | | 11750 |
| HPV16 | E1 | 253 | 10 | TLLQQYCLYL | | 11751 |
| HPV16 | E1 | 525 | 8 | TVPCWNYI | | 11752 |
| HPV16 | E1 | 585 | 8 | VFTFPNEF | | 11753 |
| HPV16 | E1 | 585 | 10 | VFTFPNEFPF | | 11754 |
| HPV16 | E1 | 498 | 11 | VICFVNSKSHF | | 11755 |
| HPV16 | E1 | 85 | 11 | VLKRKYLVSPL | | 11756 |
| HPV16 | E1 | 197 | 11 | VLKTSNAKAAM | | 11757 |
| HPV16 | E1 | 345 | 11 | VLQHSFNDCTF | | 11758 |
| HPV16 | E1 | 443 | 11 | VMFLRYQGVEF | | 11759 |
| HPV16 | E1 | 24 | 10 | VVEKKTGDAI | | 11760 |
| HPV16 | E1 | 584 | 9 | VVFTFPNEF | | 11761 |
| HPV16 | E1 | 584 | 11 | VVFTFPNEFPF | | 11762 |
| HPV16 | E1 | 274 | 8 | VVLLLVRY | | 11763 |
| HPV16 | E1 | 601 | 9 | VYELNDKNW | | 11764 |
| HPV16 | E1 | 332 | 8 | VYGDTPEW | | 11765 |
| HPV16 | E1 | 332 | 9 | VYGDTPEWI | | 11766 |
| HPV16 | E1 | 339 | 8 | WIQRQTVL | | 11767 |
| HPV16 | E1 | 509 | 10 | WLQPLADAKI | | 11768 |
| HPV16 | E1 | 321 | 9 | WYKTGISNI | | 11769 |
| HPV16 | E1 | 531 | 10 | YIDDNLRNAL | | 11770 |
| HPV16 | E1 | 261 | 11 | YLHIQSLACSW | | 11771 |
| HPV16 | E1 | 578 | 9 | YLHNRLVVF | | 11772 |
| HPV16 | E1 | 578 | 11 | YLHNRLVVFTF | | 11773 |
| HPV16 | E1 | 90 | 9 | YLVSPLSDI | | 11774 |
| HPV16 | E1 | 320 | 10 | YWYKTGISNI | | 11775 |
| HPV16 | E2 | 270 | 10 | AFNSSHKGRI | | 11776 |
| HPV16 | E2 | 72 | 8 | AIELQLTL | | 11777 |
| HPV16 | E2 | 72 | 11 | AIELQLTLETI | | 11778 |
| HPV16 | E2 | 331 | 11 | AIVTLTYDSEW | | 11779 |
| HPV16 | E2 | 41 | 9 | AIYYKAREM | | 11780 |
| HPV16 | E2 | 41 | 11 | AIYYKAREMGF | | 11781 |
| HPV16 | E2 | 228 | 11 | ALGTEETQTTI | | 11782 |
| HPV16 | E2 | 69 | 9 | ALQAIELQL | | 11783 |
| HPV16 | E2 | 69 | 11 | ALQAIELQLTL | | 11784 |
| HPV16 | E2 | 221 | 9 | ATHTKAVAL | | 11785 |
| HPV16 | E2 | 63 | 8 | AVSKNKAL | | 11786 |
| HPV16 | E2 | 63 | 11 | AVSKNKALQAI | | 11787 |
| HPV16 | E2 | 314 | 8 | AVSSTWHW | | 11788 |
| HPV16 | E2 | 309 | 11 | CTLYTAVSSTW | | 11789 |
| HPV16 | E2 | 124 | 8 | DICNTMHY | | 11790 |
| HPV16 | E2 | 124 | 11 | DICNTMHYTNW | | 11791 |
| HPV16 | E2 | 25 | 8 | DLRDHIDY | | 11792 |
| HPV16 | E2 | 25 | 9 | DLRDHIDYW | | 11793 |
| HPV16 | E2 | 246 | 11 | DTGNPCHTTKL | | 11794 |
| HPV16 | E2 | 96 | 8 | DVSLEVYL | | 11795 |
| HPV16 | E2 | 31 | 8 | DYWKHMRL | | 11796 |
| HPV16 | E2 | 74 | 9 | ELQLTLETI | | 11797 |
| HPV16 | E2 | 74 | 10 | ELQLTLETIY | | 11798 |
| HPV16 | E2 | 80 | 8 | ETIYNSQY | | 11799 |
| HPV16 | E2 | 185 | 9 | EVHAGGQVI | | 11800 |
| HPV16 | E2 | 185 | 10 | EVHAGGQVIL | | 11801 |
| HPV16 | E2 | 118 | 8 | EVQFDGDI | | 11802 |
| HPV16 | E2 | 204 | 8 | EVSSPEII | | 11803 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | E2 | 100 | 11 | EVYLTAPTGCI | | 11804 |
| HPV16 | E2 | 340 | 8 | EWQRDQFL | | 11805 |
| HPV16 | E2 | 346 | 11 | FLSQVKIPKTI | | 11806 |
| HPV16 | E2 | 168 | 11 | FVQFKDDAEKY | | 11807 |
| HPV16 | E2 | 163 | 9 | GIRTYFVQF | | 11808 |
| HPV16 | E2 | 156 | 9 | GLYYVHEGI | | 11809 |
| HPV16 | E2 | 230 | 9 | GTEETQTTI | | 11810 |
| HPV16 | E2 | 114 | 8 | GYTVEVQF | | 11811 |
| HPV16 | E2 | 29 | 8 | HIDYWKHM | | 11812 |
| HPV16 | E2 | 29 | 10 | HIDYWKHMRL | | 11813 |
| HPV16 | E2 | 53 | 10 | HINHQVVPTL | | 11814 |
| HPV16 | E2 | 290 | 9 | HLKGDANTL | | 11815 |
| HPV16 | E2 | 35 | 8 | HMRLECAI | | 11816 |
| HPV16 | E2 | 35 | 9 | HMRLECAIY | | 11817 |
| HPV16 | E2 | 35 | 10 | HMRLECAIYY | | 11818 |
| HPV16 | E2 | 18 | 9 | HYENDSTDL | | 11819 |
| HPV16 | E2 | 130 | 8 | HYTNWTHI | | 11820 |
| HPV16 | E2 | 130 | 9 | HYTNWTHIY | | 11821 |
| HPV16 | E2 | 130 | 10 | HYINWTHIYI | | 11822 |
| HPV16 | E2 | 193 | 8 | ILCPTSVF | | 11823 |
| HPV16 | E2 | 356 | 8 | ITVSTGFM | | 11824 |
| HPV16 | E2 | 356 | 10 | ITVSTGFMSI | | 11825 |
| HPV16 | E2 | 288 | 11 | IVHLKGDANTL | | 11826 |
| HPV16 | E2 | 332 | 10 | IVTLTYDSEW | | 11827 |
| HPV16 | E2 | 82 | 11 | IYNSQYSNEKW | | 11828 |
| HPV16 | E2 | 42 | 8 | IYYKAREM | | 11829 |
| HPV16 | E2 | 42 | 10 | IYYKAREMGF | | 11830 |
| HPV16 | E2 | 354 | 9 | KTITVSTGF | | 11831 |
| HPV16 | E2 | 354 | 10 | KTITVSTGFM | | 11832 |
| HPV16 | E2 | 91 | 9 | KWTLQDVSL | | 11833 |
| HPV16 | E2 | 177 | 8 | KYSKNKVW | | 11834 |
| HPV16 | E2 | 103 | 8 | LTAPTGCI | | 11835 |
| HPV16 | E2 | 16 | 11 | LTHYENDSTDL | | 11836 |
| HPV16 | E2 | 77 | 11 | LTLETIYNSQY | | 11837 |
| HPV16 | E2 | 311 | 9 | LYTAVSSTW | | 11838 |
| HPV16 | E2 | 311 | 11 | LYTAVSSTWHW | | 11839 |
| HPV16 | E2 | 157 | 8 | LYYVHEGI | | 11840 |
| HPV16 | E2 | 157 | 11 | LYYVHEGIRTY | | 11841 |
| HPV16 | E2 | 296 | 8 | NTLKCLRY | | 11842 |
| HPV16 | E2 | 296 | 10 | NTLKCLRYRF | | 11843 |
| HPV16 | E2 | 127 | 8 | NTMHYTNW | | 11844 |
| HPV16 | E2 | 127 | 11 | NTMHYTNWTHI | | 11845 |
| HPV16 | E2 | 284 | 8 | NTTPIVHL | | 11846 |
| HPV16 | E2 | 9 | 8 | NVCQDKIL | | 11847 |
| HPV16 | E2 | 9 | 11 | NVCQDKILTHY | | 11848 |
| HPV16 | E2 | 325 | 8 | NVKHKSAI | | 11849 |
| HPV16 | E2 | 325 | 11 | NVKHKSAIVTL | | 11850 |
| HPV16 | E2 | 106 | 10 | PTGCIKKHGY | | 11851 |
| HPV16 | E2 | 60 | 11 | PTLAVSKNKAL | | 11852 |
| HPV16 | E2 | 120 | 10 | QFDGDICNTM | | 11853 |
| HPV16 | E2 | 170 | 9 | QFKDDAEKY | | 11854 |
| HPV16 | E2 | 345 | 8 | QFLSQVKI | | 11855 |
| HPV16 | E2 | 76 | 8 | QLTLETIY | | 11856 |
| HPV16 | E2 | 151 | 8 | QVDYYGLY | | 11857 |
| HPV16 | E2 | 151 | 9 | QVDYYGLYY | | 11858 |
| HPV16 | E2 | 191 | 10 | QVILCPTSVF | | 11859 |
| HPV16 | E2 | 349 | 8 | QVKIPKTI | | 11860 |
| HPV16 | E2 | 86 | 9 | QYSNEKWTL | | 11861 |
| HPV16 | E2 | 304 | 8 | RFKKHCTL | | 11862 |
| HPV16 | E2 | 304 | 9 | RFKKHCTLY | | 11863 |
| HPV16 | E2 | 278 | 11 | RINCNSNTTPI | | 11864 |
| HPV16 | E2 | 37 | 8 | RLECAIYY | | 11865 |
| HPV16 | E2 | 7 | 9 | RLNVCQDKI | | 11866 |
| HPV16 | E2 | 7 | 10 | RLNVCQDKIL | | 11867 |
| HPV16 | E2 | 302 | 10 | RYRFKKHCTL | | 11868 |
| HPV16 | E2 | 302 | 11 | RYRFKKHCTLY | | 11869 |
| HPV16 | E2 | 23 | 8 | STDLRDHI | | 11870 |
| HPV16 | E2 | 23 | 10 | STDLRDHIDY | | 11871 |
| HPV16 | E2 | 23 | 11 | STDLRDHIDYW | | 11872 |
| HPV16 | E2 | 261 | 8 | SVDSAPIL | | 11873 |
| HPV16 | E2 | 261 | 11 | SVDSAPILTAF | | 11874 |
| HPV16 | E2 | 144 | 11 | SVTVVEGQVDY | | 11875 |
| HPV16 | E2 | 355 | 8 | TITVSTGF | | 11876 |
| HPV16 | E2 | 355 | 9 | TITVSTGFM | | 11877 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | E2 | 355 | 11 | TITVSTGFMSI | | 11878 |
| HPV16 | E2 | 61 | 10 | TLAVSKNKAL | | 11879 |
| HPV16 | E2 | 78 | 10 | TLETIYNSQY | | 11880 |
| HPV16 | E2 | 297 | 9 | TLKCLRYRF | | 11881 |
| HPV16 | E2 | 93 | 10 | TLQDVSLEVY | | 11882 |
| HPV16 | E2 | 93 | 11 | TLQDVSLEVYL | | 11883 |
| HPV16 | E2 | 334 | 8 | TLTYDSEW | | 11884 |
| HPV16 | E2 | 310 | 10 | TLYTAVSSTW | | 11885 |
| HPV16 | E2 | 128 | 10 | TMHYTNWTHI | | 11886 |
| HPV16 | E2 | 128 | 11 | TMHYTNWTHIY | | 11887 |
| HPV16 | E2 | 116 | 10 | TVEVQFDGDI | | 11888 |
| HPV16 | E2 | 357 | 9 | TVSTGFMSI | | 11889 |
| HPV16 | E2 | 146 | 9 | TVVEGQVDY | | 11890 |
| HPV16 | E2 | 146 | 10 | TVVEGQVDYY | | 11891 |
| HPV16 | E2 | 336 | 11 | TYDSEWQRDQF | | 11892 |
| HPV16 | E2 | 192 | 9 | VILCPTSVF | | 11893 |
| HPV16 | E2 | 333 | 9 | VTLTYDSEW | | 11894 |
| HPV16 | E2 | 145 | 10 | VTVVEGQVDY | | 11895 |
| HPV16 | E2 | 145 | 11 | VTVVEGQVDYY | | 11896 |
| HPV16 | E2 | 147 | 8 | VVEGQVDY | | 11897 |
| HPV16 | E2 | 147 | 9 | VVEGQVDYY | | 11898 |
| HPV16 | E2 | 147 | 11 | VVEGQVDYYGL | | 11899 |
| HPV16 | E2 | 183 | 11 | VWEVHAGGQVI | | 11900 |
| HPV16 | E2 | 101 | 10 | VYLTAPTGCI | | 11901 |
| HPV16 | E2 | 92 | 8 | WTLQDVSL | | 11902 |
| HPV16 | E2 | 92 | 11 | WTLQDVSLEVY | | 11903 |
| HPV16 | E2 | 102 | 9 | YLTAPTGCI | | 11904 |
| HPV16 | E2 | 312 | 8 | YTAVSSTW | | 11905 |
| HPV16 | E2 | 312 | 10 | YTAVSSTWHW | | 11906 |
| HPV16 | E2 | 131 | 8 | YTNWTHIY | | 11907 |
| HPV16 | E2 | 131 | 9 | YTNWTHIYI | | 11908 |
| HPV16 | E2 | 115 | 11 | YTVEVQFDGDI | | 11909 |
| HPV16 | E2 | 159 | 9 | YVHEGIRTY | | 11910 |
| HPV16 | E2 | 159 | 10 | YVHEGIRTYF | | 11911 |
| HPV16 | E2 | 32 | 11 | YWKHMRLECAI | | 11912 |
| HPV16 | E2 | 154 | 11 | YYGLYYVHEGI | | 11913 |
| HPV16 | E2 | 43 | 9 | YYKAREMGF | | 11914 |
| HPV16 | E2 | 158 | 10 | YYVHEGIRTY | | 11915 |
| HPV16 | E2 | 158 | 11 | YYVHEGIRTYF | | 11916 |
| HPV16 | E5 | 56 | 8 | AFRCFIVY | | 11917 |
| HPV16 | E5 | 56 | 9 | AFRCFIVYI | | 11918 |
| HPV16 | E5 | 56 | 10 | AFRCFIVYII | | 11919 |
| HPV16 | E5 | 56 | 11 | AFRCFIVYIIF | | 11920 |
| HPV16 | E5 | 18 | 10 | CFCVLLCVCL | | 11921 |
| HPV16 | E5 | 18 | 11 | CFCVLLCVCLL | | 11922 |
| HPV16 | E5 | 59 | 8 | CFIVYIIF | | 11923 |
| HPV16 | E5 | 59 | 10 | CFIVYIIFVY | | 11924 |
| HPV16 | E5 | 59 | 11 | CFIVYIIFVYI | | 11925 |
| HPV16 | E5 | 14 | 9 | CFLLCFCVL | | 11926 |
| HPV16 | E5 | 14 | 10 | CFLLCFCVLL | | 11927 |
| HPV16 | E5 | 26 | 8 | CLLIRPLL | | 11928 |
| HPV16 | E5 | 26 | 9 | CLLIRPLLL | | 11929 |
| HPV16 | E5 | 24 | 9 | CVCLLIRPL | | 11930 |
| HPV16 | E5 | 24 | 10 | CVCLLIRPLL | | 11931 |
| HPV16 | E5 | 24 | 11 | CVCLLIRPLLL | | 11932 |
| HPV16 | E5 | 20 | 8 | CVLLCVCL | | 11933 |
| HPV16 | E5 | 20 | 9 | CVLLCVCLL | | 11934 |
| HPV16 | E5 | 20 | 10 | CVLLCVCLLI | | 11935 |
| HPV16 | E5 | 5 | 8 | DTASTTLL | | 11936 |
| HPV16 | E5 | 5 | 11 | DTASTTLLACF | | 11937 |
| HPV16 | E5 | 60 | 9 | FIVYIIFVY | | 11938 |
| HPV16 | E5 | 60 | 10 | FIVYIIFVYI | | 11939 |
| HPV16 | E5 | 72 | 9 | FLIHTHARF | | 11940 |
| HPV16 | E5 | 72 | 10 | FLIHTHARFL | | 11941 |
| HPV16 | E5 | 72 | 11 | FLIHTHARFLI | | 11942 |
| HPV16 | E5 | 15 | 8 | FLLCFCVL | | 11943 |
| HPV16 | E5 | 15 | 9 | FLLCFCVLL | | 11944 |
| HPV16 | E5 | 66 | 8 | FVYIPLFL | | 11945 |
| HPV16 | E5 | 66 | 9 | FVYIPLFLI | | 11946 |
| HPV16 | E5 | 75 | 8 | HTHARFLI | | 11947 |
| HPV16 | E5 | 65 | 8 | IFVYIPLF | | 11948 |
| HPV16 | E5 | 65 | 9 | IFVYIPLFL | | 11949 |
| HPV16 | E5 | 65 | 10 | IFVYIPLFLI | | 11950 |
| HPV16 | E5 | 64 | 8 | IIFVYIPL | | 11951 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | E5 | 64 | 9 | IIFVYIPLF | | 11952 |
| HPV16 | E5 | 64 | 10 | IIFVYIPLFL | | 11953 |
| HPV16 | E5 | 64 | 11 | IIFVYIPLFLI | | 11954 |
| HPV16 | E5 | 43 | 8 | IILVLLLW | | 11955 |
| HPV16 | E5 | 43 | 9 | IILVLLLWI | | 11956 |
| HPV16 | E5 | 44 | 8 | ILVLLLWI | | 11957 |
| HPV16 | E5 | 51 | 10 | ITAASAFRCF | | 11958 |
| HPV16 | E5 | 51 | 11 | ITAASAFRCFI | | 11959 |
| HPV16 | E5 | 61 | 8 | IVYIIFVY | | 11960 |
| HPV16 | E5 | 61 | 9 | IVYIIFVYI | | 11961 |
| HPV16 | E5 | 61 | 11 | IVYIIFVYIPL | | 11962 |
| HPV16 | E5 | 71 | 10 | LFLIHTHARF | | 11963 |
| HPV16 | E5 | 71 | 11 | LFLIHTHARFL | | 11964 |
| HPV16 | E5 | 73 | 8 | LIHTHARF | | 11965 |
| HPV16 | E5 | 73 | 9 | LIHTHARFL | | 11966 |
| HPV16 | E5 | 73 | 10 | LIHTHARFLI | | 11967 |
| HPV16 | E5 | 42 | 8 | LIILVLLL | | 11968 |
| HPV16 | E5 | 42 | 9 | LIILVLLLW | | 11969 |
| HPV16 | E5 | 42 | 10 | LIILVLLLWI | | 11970 |
| HPV16 | E5 | 11 | 9 | LLACFLLCF | | 11971 |
| HPV16 | E5 | 16 | 8 | LLCFCVLL | | 11972 |
| HPV16 | E5 | 22 | 8 | LLCVCLLI | | 11973 |
| HPV16 | E5 | 22 | 11 | LLCVCLLIRPL | | 11974 |
| HPV16 | E5 | 27 | 8 | LLIRPLLL | | 11975 |
| HPV16 | E5 | 32 | 8 | LLLSVSTY | | 11976 |
| HPV16 | E5 | 32 | 11 | LLLSVSTYTSL | | 11977 |
| HPV16 | E5 | 47 | 11 | LLLWITAASAF | | 11978 |
| HPV16 | E5 | 33 | 10 | LLSVSTYTSL | | 11979 |
| HPV16 | E5 | 33 | 11 | LLSVSTYTSLI | | 11980 |
| HPV16 | E5 | 48 | 10 | LLWITAASAF | | 11981 |
| HPV16 | E5 | 49 | 9 | LWITAASAF | | 11982 |
| HPV16 | E5 | 1 | 11 | MTNLDTASTTL | | 11983 |
| HPV16 | E5 | 3 | 9 | NLDTASTTL | | 11984 |
| HPV16 | E5 | 3 | 10 | NLDTASTTLL | | 11985 |
| HPV16 | E5 | 70 | 11 | PLFLIHTHARF | | 11986 |
| HPV16 | E5 | 31 | 9 | PLLLSVSTY | | 11987 |
| HPV16 | E5 | 41 | 8 | SLIILVLL | | 11988 |
| HPV16 | E5 | 41 | 9 | SLIILVLLL | | 11989 |
| HPV16 | E5 | 41 | 10 | SLIILVLLLW | | 11990 |
| HPV16 | E5 | 41 | 11 | SLIILVLLLWI | | 11991 |
| HPV16 | E5 | 8 | 8 | STTLLACF | | 11992 |
| HPV16 | E5 | 8 | 9 | STTLLACFL | | 11993 |
| HPV16 | E5 | 8 | 10 | STTLLACFLL | | 11994 |
| HPV16 | E5 | 37 | 8 | STYTSLII | | 11995 |
| HPV16 | E5 | 37 | 9 | STYTSLIIL | | 11996 |
| HPV16 | E5 | 37 | 11 | STYTSLIILVL | | 11997 |
| HPV16 | E5 | 35 | 8 | SVSTYTSL | | 11998 |
| HPV16 | E5 | 35 | 9 | SVSTYTSLI | | 11999 |
| HPV16 | E5 | 35 | 10 | SVSTYTSLII | | 12000 |
| HPV16 | E5 | 35 | 11 | SVSTYTSLIIL | | 12001 |
| HPV16 | E5 | 10 | 8 | TLLACFLL | | 12002 |
| HPV16 | E5 | 10 | 10 | TLLACFLLCF | | 12003 |
| HPV16 | E5 | 9 | 8 | TTLLACFL | | 12004 |
| HPV16 | E5 | 9 | 9 | TTLLACFLL | | 12005 |
| HPV16 | E5 | 9 | 11 | TTLLACFLLCF | | 12006 |
| HPV16 | E5 | 38 | 8 | TYTSLIIL | | 12007 |
| HPV16 | E5 | 38 | 10 | TYTSLIILVL | | 12008 |
| HPV16 | E5 | 38 | 11 | TYTSLIILVLL | | 12009 |
| HPV16 | E5 | 21 | 8 | VLLCVCLL | | 12010 |
| HPV16 | E5 | 21 | 9 | VLLCVCLLI | | 12011 |
| HPV16 | E5 | 62 | 8 | VYIIFVYI | | 12012 |
| HPV16 | E5 | 62 | 10 | VYIIFVYIPL | | 12013 |
| HPV16 | E5 | 62 | 11 | VYIIFVYIPLF | | 12014 |
| HPV16 | E5 | 67 | 8 | VYIPLFLI | | 12015 |
| HPV16 | E5 | 50 | 8 | WITAASAF | | 12016 |
| HPV16 | E5 | 50 | 11 | WITAASAFRCF | | 12017 |
| HPV16 | E5 | 63 | 9 | YIIFVYIPL | | 12018 |
| HPV16 | E5 | 63 | 10 | YIIFVYIPLF | | 12019 |
| HPV16 | E5 | 63 | 11 | YIIFVYIPLFL | | 12020 |
| HPV16 | E5 | 39 | 9 | YTSLIILVL | | 12021 |
| HPV16 | E5 | 39 | 10 | YTSLIILVLL | | 12022 |
| HPV16 | E5 | 39 | 11 | YTSLIILVLLL | | 12023 |
| HPV16 | E6 | 53 | 9 | AFRDLCIVY | | 12024 |
| HPV16 | E6 | 68 | 9 | AVCDKCLKF | | 12025 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | E6 | 68 | 10 | AVCDKCLKFY | | 12026 |
| HPV16 | E6 | 110 | 8 | CINCQKPL | | 12027 |
| HPV16 | E6 | 58 | 10 | CIVYRDGNPY | | 12028 |
| HPV16 | E6 | 73 | 8 | CLKFYSKI | | 12029 |
| HPV16 | E6 | 73 | 11 | CLKFYSKISEY | | 12030 |
| HPV16 | E6 | 23 | 8 | CTELQTTI | | 12031 |
| HPV16 | E6 | 23 | 11 | CTELQTTIHDI | | 12032 |
| HPV16 | E6 | 37 | 8 | CVYCKQQL | | 12033 |
| HPV16 | E6 | 37 | 9 | CVYCKQQLL | | 12034 |
| HPV16 | E6 | 87 | 9 | CYSLYGTTL | 0.046 | 12035 |
| HPV16 | E6 | 51 | 9 | DFAFRDLCI | 0.0003 | 12036 |
| HPV16 | E6 | 51 | 11 | DFAFRDLCIVY | | 12037 |
| HPV16 | E6 | 32 | 8 | DIILECVY | | 12038 |
| HPV16 | E6 | 25 | 9 | ELQTTIHDI | | 12039 |
| HPV16 | E6 | 25 | 10 | ELQTTIHDII | | 12040 |
| HPV16 | E6 | 25 | 11 | ELQTTIHDIIL | | 12041 |
| HPV16 | E6 | 48 | 10 | EVYDFAFRDL | | 12042 |
| HPV16 | E6 | 82 | 9 | EYRHYCYSL | 0.0051 | 12043 |
| HPV16 | E6 | 82 | 10 | EYRHYCYSLY | | 12044 |
| HPV16 | E6 | 76 | 8 | FYSKISEY | 0.0007 | 12045 |
| HPV16 | E6 | 76 | 11 | FYSKISEYRHY | 0.0004 | 12046 |
| HPV16 | E6 | 92 | 8 | GTTLEQQY | | 12047 |
| HPV16 | E6 | 125 | 8 | HLDKKQRF | | 12048 |
| HPV16 | E6 | 125 | 11 | HLDKKQRFHNI | | 12049 |
| HPV16 | E6 | 85 | 11 | HYCYSLYGTTL | 0.065 | 12050 |
| HPV16 | E6 | 34 | 11 | ILECVYCKQQL | | 12051 |
| HPV16 | E6 | 59 | 9 | IVYRDGNPY | 0.0001 | 12052 |
| HPV16 | E6 | 75 | 9 | KFYSKISEY | | 12053 |
| HPV16 | E6 | 79 | 8 | KISEYRHY | | 12054 |
| HPV16 | E6 | 79 | 10 | KISEYRHYCY | | 12055 |
| HPV16 | E6 | 18 | 9 | KLPQLCTEL | | 12056 |
| HPV16 | E6 | 107 | 11 | LIRCINCQKPL | | 12057 |
| HPV16 | E6 | 44 | 9 | LLRREVYDF | | 12058 |
| HPV16 | E6 | 44 | 11 | LLRREVYDFAF | | 12059 |
| HPV16 | E6 | 90 | 10 | LYGTTLEQQY | | 12060 |
| HPV16 | E6 | 134 | 11 | NIRGRWTGRCM | | 12061 |
| HPV16 | E6 | 102 | 10 | PLCDLLIRCI | | 12062 |
| HPV16 | E6 | 116 | 11 | PLCPEEKQRHL | | 12063 |
| HPV16 | E6 | 66 | 9 | PYAVCDKCL | 0.0078 | 12064 |
| HPV16 | E6 | 66 | 11 | PYAVCDKCLKF | 0.11 | 12065 |
| HPV16 | E6 | 21 | 10 | QLCTELQTTI | | 12066 |
| HPV16 | E6 | 43 | 8 | QLLRREVY | | 12067 |
| HPV16 | E6 | 43 | 10 | QLLRREVYDF | | 12068 |
| HPV16 | E6 | 27 | 8 | QTTIHDII | | 12069 |
| HPV16 | E6 | 27 | 9 | QTTIHDIIL | | 12070 |
| HPV16 | E6 | 98 | 9 | QYNKPLCDL | 0.0001 | 12071 |
| HPV16 | E6 | 98 | 10 | QYNKPLCDLL | 0.0015 | 12072 |
| HPV16 | E6 | 98 | 1 | QYNKPLCDLLI | | 12073 |
| HPV16 | E6 | 131 | 9 | RFHNIRGRW | 0.022 | 12074 |
| HPV16 | E6 | 151 | 8 | RTRRETQL | | 12075 |
| HPV16 | E6 | 89 | 11 | SLYGTTLEQQY | | 12076 |
| HPV16 | E6 | 29 | 11 | TIHDIILECVY | | 12077 |
| HPV16 | E6 | 94 | 10 | TLEQQYNKPL | | 12078 |
| HPV16 | E6 | 28 | 8 | TTIHDIIL | | 12079 |
| HPV16 | E6 | 93 | 11 | TTLEQQYNKPL | | 12080 |
| HPV16 | E6 | 38 | 8 | VYCKQQLL | 0.0069 | 12081 |
| HPV16 | E6 | 49 | 9 | VYDFAFRDL | 0.015 | 12082 |
| HPV16 | E6 | 49 | 11 | VYDFAFRDLCI | | 12083 |
| HPV16 | E6 | 60 | 8 | VYRDGNPY | 0.0001 | 12084 |
| HPV16 | E7 | 68 | 9 | CVQSTHVDI | | 12085 |
| HPV16 | E7 | 75 | 8 | DIRTLEDL | | 12086 |
| HPV16 | E7 | 75 | 9 | DIRTLEDLL | | 12087 |
| HPV16 | E7 | 75 | 10 | DIRTLEDLLM | | 12088 |
| HPV16 | E7 | 81 | 9 | DLLMGTLGI | | 12089 |
| HPV16 | E7 | 14 | 9 | DLQPETTDL | | 12090 |
| HPV16 | E7 | 14 | 10 | DLQPETTDLY | | 12091 |
| HPV16 | E7 | 21 | 8 | DLYCYEQL | | 12092 |
| HPV16 | E7 | 4 | 8 | DTPTLHEY | | 12093 |
| HPV16 | E7 | 4 | 9 | DTPTLHEYM | | 12094 |
| HPV16 | E7 | 4 | 10 | DTPTLHEYML | | 12095 |
| HPV16 | E7 | 18 | 8 | ETTDLYCY | 0.0001 | 12096 |
| HPV16 | E7 | 18 | 11 | ETTDLYCYEQL | | 12097 |
| HPV16 | E7 | 85 | 9 | GTLGIVCPI | | 12098 |
| HPV16 | E7 | 73 | 10 | HVDIRTLEDL | | 12099 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | E7 | 73 | 11 | HVDIRTLEDLL | | 12100 |
| HPV16 | E7 | 82 | 8 | LLMGTLGI | | 12101 |
| HPV16 | E7 | 83 | 11 | LMGTLGIVCPI | | 12102 |
| HPV16 | E7 | 12 | 11 | MLDLQPETTDL | | 12103 |
| HPV16 | E7 | 6 | 8 | PTLHEYML | | 12104 |
| HPV16 | E7 | 6 | 10 | PTLHEYMLDL | | 12105 |
| HPV16 | E7 | 66 | 11 | RLCVQSTHVDI | | 12106 |
| HPV16 | E7 | 77 | 8 | RTLEDLLM | | 12107 |
| HPV16 | E7 | 77 | 11 | RTLEDLLMGTL | | 12108 |
| HPV16 | E7 | 71 | 9 | STHVDIRTL | | 12109 |
| HPV16 | E7 | 56 | 10 | TFCCKCDSTL | | 12110 |
| HPV16 | E7 | 78 | 10 | TLEDLLMGTL | | 12111 |
| HPV16 | E7 | 86 | 8 | TLGIVCPI | | 12112 |
| HPV16 | E7 | 7 | 9 | TLHEYMLDL | | 12113 |
| HPV16 | E7 | 19 | 10 | TTDLYCYEQL | | 12114 |
| HPV16 | E7 | 55 | 11 | VTFCCKCDSTL | | 12115 |
| HPV16 | L1 | 373 | 9 | AISTSETTY | | 12116 |
| HPV16 | L1 | 292 | 10 | AVGENVPDDL | | 12117 |
| HPV16 | L1 | 292 | 11 | AVGENVPDDLY | | 12118 |
| HPV16 | L1 | 70 | 9 | AVGHPYFPI | | 12119 |
| HPV16 | L1 | 205 | 10 | AVNPGDCPPL | | 12120 |
| HPV16 | L1 | 172 | 11 | CISMDYKQTQL | | 12121 |
| HPV16 | L1 | 183 | 9 | CLIGCKPPI | | 12122 |
| HPV16 | L1 | 251 | 10 | CTSICKYPDY | | 12123 |
| HPV16 | L1 | 251 | 11 | CTSICKYPDYI | | 12124 |
| HPV16 | L1 | 13 | 9 | CYENDVNVY | | 12125 |
| HPV16 | L1 | 13 | 11 | CYENDVNVYHI | | 12126 |
| HPV16 | L1 | 249 | 9 | DICTSICKY | | 12127 |
| HPV16 | L1 | 484 | 11 | DLDQFPLGRKF | | 12128 |
| HPV16 | L1 | 397 | 8 | DLQFIFQL | | 12129 |
| HPV16 | L1 | 397 | 11 | DLQFIFQLCKI | | 12130 |
| HPV16 | L1 | 225 | 10 | DMVDTGFGAM | | 12131 |
| HPV16 | L1 | 154 | 8 | DTENASAY | | 12132 |
| HPV16 | L1 | 228 | 9 | DTGFGAMDF | | 12133 |
| HPV16 | L1 | 361 | 8 | DTTRSTNM | | 12134 |
| HPV16 | L1 | 361 | 10 | DTTRSTNMSL | | 12135 |
| HPV16 | L1 | 442 | 11 | DTYRFVTSQAI | | 12136 |
| HPV16 | L1 | 412 | 9 | DVMTYIHSM | | 12137 |
| HPV16 | L1 | 17 | 8 | DVNVYHIF | | 12138 |
| HPV16 | L1 | 17 | 9 | DVNVYHIFF | | 12139 |
| HPV16 | L1 | 17 | 11 | DVNVYHIFFQM | | 12140 |
| HPV16 | L1 | 259 | 10 | DYIKMVSEPY | | 12141 |
| HPV16 | L1 | 176 | 9 | DYKQTQLCL | | 12142 |
| HPV16 | L1 | 176 | 10 | DYKQTQLCLI | | 12143 |
| HPV16 | L1 | 378 | 9 | ETTYKNTNF | | 12144 |
| HPV16 | L1 | 132 | 8 | EVGRGQPL | | 12145 |
| HPV16 | L1 | 474 | 8 | EVNLKEKF | | 12146 |
| HPV16 | L1 | 245 | 10 | EVPLDICTSI | | 12147 |
| HPV16 | L1 | 395 | 8 | EYDLQFIF | | 12148 |
| HPV16 | L1 | 395 | 10 | EYDLQFIFQL | | 12149 |
| HPV16 | L1 | 388 | 9 | EYLRHGEEY | | 12150 |
| HPV16 | L1 | 388 | 11 | EYLRHGEEYDL | | 12151 |
| HPV16 | L1 | 52 | 8 | EYVATRNI | | 12152 |
| HPV16 | L1 | 52 | 9 | EYVATRNIY | | 12153 |
| HPV16 | L1 | 52 | 10 | EYVATRNIYY | | 12154 |
| HPV16 | L1 | 24 | 8 | FFQMSLWL | | 12155 |
| HPV16 | L1 | 273 | 9 | FFYLRREQM | | 12156 |
| HPV16 | L1 | 273 | 10 | FFYLRREQMF | | 12157 |
| HPV16 | L1 | 400 | 8 | FIFQLCKI | | 12158 |
| HPV16 | L1 | 400 | 10 | FIFQLCKITL | | 12159 |
| HPV16 | L1 | 5 | 10 | FIYILVITCY | | 12160 |
| HPV16 | L1 | 472 | 10 | FWEVNLKEKF | | 12161 |
| HPV16 | L1 | 274 | 8 | FYLRREQM | | 12162 |
| HPV16 | L1 | 274 | 9 | FYLRREQMF | | 12163 |
| HPV16 | L1 | 116 | 9 | FYNPDTQRL | | 12164 |
| HPV16 | L1 | 116 | 11 | FYNPDTQRLVW | | 12165 |
| HPV16 | L1 | 230 | 10 | GFGAMDFTTL | | 12166 |
| HPV16 | L1 | 110 | 8 | FGPDTSFY | | 12167 |
| HPV16 | L1 | 348 | 8 | GICWGNQL | | 12168 |
| HPV16 | L1 | 348 | 9 | GICWGNQLF | | 12169 |
| HPV16 | L1 | 142 | 8 | GISGHPLL | | 12170 |
| HPV16 | L1 | 142 | 11 | GISGHPLLNKL | | 12171 |
| HPV16 | L1 | 499 | 8 | GLKAKPKF | | 12172 |
| HPV16 | L1 | 499 | 10 | GLKAKPKFTL | | 12173 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | L1 | 431 | 10 | GLQPPPGGTL | | 12174 |
| HPV16 | L1 | 93 | 9 | GLQYRVFRI | | 12175 |
| HPV16 | L1 | 93 | 11 | GLQYRVFRIHL | | 12176 |
| HPV16 | L1 | 438 | 9 | GTLEDTYRF | | 12177 |
| HPV16 | L1 | 166 | 8 | GVDNRECI | | 12178 |
| HPV16 | L1 | 166 | 10 | GVDNRECISM | | 12179 |
| HPV16 | L1 | 130 | 10 | GVEVGRGQPL | | 12180 |
| HPV16 | L1 | 140 | 9 | GVGISGHPL | | 12181 |
| HPV16 | L1 | 140 | 10 | GVGISGHPLL | | 12182 |
| HPV16 | L1 | 22 | 8 | HIFFQMSL | | 12183 |
| HPV16 | L1 | 22 | 9 | HIFFQMSLW | | 12184 |
| HPV16 | L1 | 22 | 10 | HIFFQMSLWL | | 12185 |
| HPV16 | L1 | 102 | 8 | HLPDPNKF | | 12186 |
| HPV16 | L1 | 102 | 10 | HLPDPNKFGF | | 12187 |
| HPV16 | L1 | 457 | 11 | HTPPAPKEDPL | | 12188 |
| HPV16 | L1 | 23 | 8 | IFFQMSLW | | 12189 |
| HPV16 | L1 | 23 | 9 | IFFQMSLWL | | 12190 |
| HPV16 | L1 | 332 | 8 | IFNKPYWL | | 12191 |
| HPV16 | L1 | 401 | 9 | IFQLCKITL | | 12192 |
| HPV16 | L1 | 424 | 9 | ILEDWNFGL | | 12193 |
| HPV16 | L1 | 86 | 9 | ILVPKVSGL | | 12194 |
| HPV16 | L1 | 86 | 11 | ILVPKVSGLQY | | 12195 |
| HPV16 | L1 | 11 | 11 | ITCYENDVNVY | | 12196 |
| HPV16 | L1 | 407 | 8 | ITLTADVM | | 12197 |
| HPV16 | L1 | 407 | 10 | ITLTADVMTY | | 12198 |
| HPV16 | L1 | 407 | 11 | ITLTADVMTYI | | 12199 |
| HPV16 | L1 | 6 | 9 | IYILVITCY | | 12200 |
| HPV16 | L1 | 59 | 10 | IYYHAGTSRL | | 12201 |
| HPV16 | L1 | 59 | 11 | IYYHAGTSRLL | | 12202 |
| HPV16 | L1 | 108 | 9 | KFGFPDTSF | | 12203 |
| HPV16 | L1 | 108 | 10 | KFGFPDTSFY | | 12204 |
| HPV16 | L1 | 493 | 8 | KFLLQAGL | | 12205 |
| HPV16 | L1 | 480 | 9 | KFSADLDQF | | 12206 |
| HPV16 | L1 | 480 | 11 | KFSADLDQFPL | | 12207 |
| HPV16 | L1 | 85 | 10 | KILVPKVSGL | | 12208 |
| HPV16 | L1 | 406 | 9 | KITLTADVM | | 12209 |
| HPV16 | L1 | 406 | 11 | KITLTADVMTY | | 12210 |
| HPV16 | L1 | 151 | 11 | KLDDTENASAY | | 12211 |
| HPV16 | L1 | 262 | 11 | KMVSEPYGDSL | | 12212 |
| HPV16 | L1 | 90 | 10 | KVSGLQYRVF | | 12213 |
| HPV16 | L1 | 46 | 8 | KVVSTDEY | | 12214 |
| HPV16 | L1 | 256 | 8 | KYPDYIKM | | 12215 |
| HPV16 | L1 | 469 | 9 | KYTFWEVNL | | 12216 |
| HPV16 | L1 | 272 | 10 | LFFYLRREQM | | 12217 |
| HPV16 | L1 | 272 | 11 | LFFYLRREQMF | | 12218 |
| HPV16 | L1 | 184 | 8 | LIGCKPPI | | 12219 |
| HPV16 | L1 | 216 | 11 | LINTVIQDGDM | | 12220 |
| HPV16 | L1 | 68 | 8 | LLAVGHPY | | 12221 |
| HPV16 | L1 | 68 | 9 | LLAVGHPYF | | 12222 |
| HPV16 | L1 | 68 | 11 | LLAVGHPYFPI | | 12223 |
| HPV16 | L1 | 409 | 8 | LTADVMTY | | 12224 |
| HPV16 | L1 | 409 | 9 | LTADVMTYI | | 12225 |
| HPV16 | L1 | 87 | 8 | LVPKVSGL | | 12226 |
| HPV16 | L1 | 87 | 10 | LVPKVSGLQY | | 12227 |
| HPV16 | L1 | 29 | 10 | LWLPSEATVY | | 12228 |
| HPV16 | L1 | 29 | 11 | LWLPSEATVYL | | 12229 |
| HPV16 | L1 | 414 | 11 | MTYIHSMNSTI | | 12230 |
| HPV16 | L1 | 226 | 9 | MVDTGFGAM | | 12231 |
| HPV16 | L1 | 226 | 11 | MVDTGFGAMDF | | 12232 |
| HPV16 | L1 | 263 | 10 | MVSEPYGDSL | | 12233 |
| HPV16 | L1 | 263 | 11 | MVSEPYGDSLF | | 12234 |
| HPV16 | L1 | 325 | 8 | MVTSDAQI | | 12235 |
| HPV16 | L1 | 325 | 9 | MVTSDAQIF | | 12236 |
| HPV16 | L1 | 58 | 11 | NIYYHAGTSRL | | 12237 |
| HPV16 | L1 | 311 | 8 | NLASSNYF | | 12238 |
| HPV16 | L1 | 476 | 10 | NLKEKFSADL | | 12239 |
| HPV16 | L1 | 367 | 8 | NMSLCAAI | | 12240 |
| HPV16 | L1 | 383 | 8 | NTNFKEYL | | 12241 |
| HPV16 | L1 | 218 | 9 | NTVIQDGDM | | 12242 |
| HPV16 | L1 | 296 | 8 | NVPDDLYI | | 12243 |
| HPV16 | L1 | 19 | 9 | NVYHIFFQM | | 12244 |
| HPV16 | L1 | 19 | 11 | NVYHIFFQMSL | | 12245 |
| HPV16 | L1 | 316 | 10 | NYFPTPSGSM | | 12246 |
| HPV16 | L1 | 77 | 10 | PIKKPNNNKI | | 12247 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | L1 | 77 | 11 | PIKKPNNNKIL | | 12248 |
| HPV16 | L1 | 247 | 8 | PLDICTSI | | 12249 |
| HPV16 | L1 | 247 | 11 | PLDICTSICKY | | 12250 |
| HPV16 | L1 | 213 | 9 | PLELINTVI | | 12251 |
| HPV16 | L1 | 489 | 8 | PLGRKFLL | | 12252 |
| HPV16 | L1 | 138 | 11 | PLGVGISGHPL | | 12253 |
| HPV16 | L1 | 466 | 8 | PLKKYTFW | | 12254 |
| HPV16 | L1 | 43 | 11 | PVSKVVSTDEY | | 12255 |
| HPV16 | L1 | 267 | 8 | PYGDSLFF | | 12256 |
| HPV16 | L1 | 267 | 9 | PYGDSLFFY | | 12257 |
| HPV16 | L1 | 267 | 10 | PYGDSLFFYL | | 12258 |
| HPV16 | L1 | 399 | 9 | QFIFQLCKI | | 12259 |
| HPV16 | L1 | 399 | 11 | QFIFQLCKITL | | 12260 |
| HPV16 | L1 | 487 | 8 | QFPLGRKF | | 12261 |
| HPV16 | L1 | 487 | 9 | QFPLGRKFL | | 12262 |
| HPV16 | L1 | 487 | 10 | QFPLGRKFLL | | 12263 |
| HPV16 | L1 | 331 | 8 | QIFNKPYW | | 12264 |
| HPV16 | L1 | 331 | 9 | QIFNKPYWL | | 12265 |
| HPV16 | L1 | 181 | 11 | QLCLIGCKPPI | | 12266 |
| HPV16 | L1 | 280 | 8 | QMFVRHLF | | 12267 |
| HPV16 | L1 | 2 | 8 | QVTFIYIL | | 12268 |
| HPV16 | L1 | 2 | 10 | QVTFIYILVI | | 12269 |
| HPV16 | L1 | 95 | 9 | QYRVFRIHL | | 12270 |
| HPV16 | L1 | 445 | 8 | RFVTSQAI | | 12271 |
| HPV16 | L1 | 100 | 10 | RIHLPDPNKF | | 12272 |
| HPV16 | L1 | 67 | 9 | RLLAVGHPY | | 12273 |
| HPV16 | L1 | 67 | 10 | RLLAVGHPYF | | 12274 |
| HPV16 | L1 | 115 | 10 | SFYNPDTQRL | | 12275 |
| HPV16 | L1 | 253 | 8 | SICKYPDY | | 12276 |
| HPV16 | L1 | 253 | 9 | SICKYPDYI | | 12277 |
| HPV16 | L1 | 253 | 11 | SICKYPDYIKM | | 12278 |
| HPV16 | L1 | 271 | 11 | SLFFYLRREQM | | 12279 |
| HPV16 | L1 | 28 | 11 | SLWLPSEATVY | | 12280 |
| HPV16 | L1 | 174 | 9 | SMDYKQTQL | | 12281 |
| HPV16 | L1 | 174 | 11 | SMDYKQTQLCL | | 12282 |
| HPV16 | L1 | 419 | 10 | SMNSTILEDW | | 12283 |
| HPV16 | L1 | 324 | 9 | SMVTSDAQI | | 12284 |
| HPV16 | L1 | 324 | 10 | SMVTSDAQIF | | 12285 |
| HPV16 | L1 | 308 | 10 | STANLASSNY | | 12286 |
| HPV16 | L1 | 308 | 11 | STANLASSNYF | | 12287 |
| HPV16 | L1 | 49 | 11 | STDEYVARTNI | | 12288 |
| HPV16 | L1 | 422 | 9 | STILEDWNF | | 12289 |
| HPV16 | L1 | 422 | 11 | STILEDWNFGL | | 12290 |
| HPV16 | L1 | 365 | 10 | STNMSLCAAI | | 12291 |
| HPV16 | L1 | 521 | 11 | STTAKRKKRKL | | 12292 |
| HPV16 | L1 | 4 | 8 | TFIYILVI | | 12293 |
| HPV16 | L1 | 4 | 11 | TFIYILVITCY | | 12294 |
| HPV16 | L1 | 471 | 11 | TFWEVNLKEKF | | 12295 |
| HPV16 | L1 | 423 | 8 | TILEDWNF | | 12296 |
| HPV16 | L1 | 423 | 10 | TILEDWNFGL | | 12297 |
| HPV16 | L1 | 439 | 8 | TLEDTYRF | | 12298 |
| HPV16 | L1 | 238 | 11 | TLQANKSEVPL | | 12299 |
| HPV16 | L1 | 408 | 9 | TLTADVMTY | | 12300 |
| HPV16 | L1 | 408 | 10 | TLTADVMTYI | | 12301 |
| HPV16 | L1 | 522 | 10 | TTAKRKKRKL | | 12302 |
| HPV16 | L1 | 362 | 9 | TTRSTNMSL | | 12303 |
| HPV16 | L1 | 379 | 8 | TTYKNTNF | | 12304 |
| HPV16 | L1 | 379 | 11 | TTYKNTNFKEY | | 12305 |
| HPV16 | L1 | 219 | 8 | TVIQDGDM | | 12306 |
| HPV16 | L1 | 358 | 11 | TVVDTTRSTNM | | 12307 |
| HPV16 | L1 | 415 | 10 | TYIHSMNSTI | | 12308 |
| HPV16 | L1 | 415 | 11 | TYIHSMNSTIL | | 12309 |
| HPV16 | L1 | 380 | 10 | TYKNTNFKEY | | 12310 |
| HPV16 | L1 | 380 | 11 | TYKNTNFKEYL | | 12311 |
| HPV16 | L1 | 443 | 10 | TYRFVTSQAI | | 12312 |
| HPV16 | L1 | 413 | 8 | VMTYIHSM | | 12313 |
| HPV16 | L1 | 3 | 9 | VTFIYILVI | | 12314 |
| HPV16 | L1 | 326 | 8 | VTSDAQIF | | 12315 |
| HPV16 | L1 | 359 | 10 | VVDTTRSTNM | | 12316 |
| HPV16 | L1 | 20 | 8 | VYHIFFQM | | 12317 |
| HPV16 | L1 | 20 | 10 | VYHIFFQMSL | | 12318 |
| HPV16 | L1 | 20 | 11 | VYHIFFQMSLW | | 12319 |
| HPV16 | L1 | 30 | 9 | WLPSEATVY | | 12320 |
| HPV16 | L1 | 30 | 10 | WLPSEATVYL | | 12321 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | L1 | 317 | 9 | YFPTPSGSM | | 12322 |
| HPV16 | L1 | 416 | 9 | YIHSMNSTI | | 12323 |
| HPV16 | L1 | 416 | 10 | YIHSMNSTIL | | 12324 |
| HPV16 | L1 | 302 | 11 | YIKGSGSTANL | | 12325 |
| HPV16 | L1 | 260 | 9 | YIKMVSEPY | | 12326 |
| HPV16 | L1 | 7 | 8 | YILVITCY | | 12327 |
| HPV16 | L1 | 389 | 8 | YLRHGEEY | | 12328 |
| HPV16 | L1 | 389 | 10 | YLRHGEEYDL | | 12329 |
| HPV16 | L1 | 275 | 8 | YLRREQMF | | 12330 |
| HPV16 | L1 | 470 | 8 | YTFWEVNL | | 12331 |
| HPV16 | L1 | 53 | 8 | YVARTNIY | | 12332 |
| HPV16 | L1 | 53 | 9 | YVARTNIYY | | 12333 |
| HPV16 | L1 | 60 | 9 | YYHAGTSRL | | 12334 |
| HPV16 | L1 | 60 | 10 | YYHAGTSRLL | | 12335 |
| HPV16 | L2 | 241 | 9 | AFITTPTKL | | 12336 |
| HPV16 | L2 | 241 | 10 | AFITTPTKLI | | 12337 |
| HPV16 | L2 | 356 | 10 | ALPTSINNGL | | 12338 |
| HPV16 | L2 | 356 | 11 | ALPTSINNGLY | | 12339 |
| HPV16 | L2 | 293 | 9 | ALTSRRTGI | | 12340 |
| HPV16 | L2 | 293 | 11 | ALTSRRTGIRY | | 12341 |
| HPV16 | L2 | 256 | 11 | AYEGIDVDNTL | | 12342 |
| HPV16 | L2 | 282 | 8 | DFLDIVAL | | 12343 |
| HPV16 | L2 | 329 | 11 | DFSTIDSAEEI | | 12344 |
| HPV16 | L2 | 445 | 8 | DFYLHPSY | | 12345 |
| HPV16 | L2 | 445 | 9 | DFYLHPSYY | | 12346 |
| HPV16 | L2 | 445 | 10 | DFYLHPSYYM | | 12347 |
| HPV16 | L2 | 445 | 11 | DFYLHPSYYML | | 12348 |
| HPV16 | L2 | 31 | 11 | DIIPKVEGKTI | | 12349 |
| HPV16 | L2 | 285 | 10 | DIVALHRPAL | | 12350 |
| HPV16 | L2 | 367 | 8 | DIYADDFI | | 12351 |
| HPV16 | L2 | 84 | 10 | DTLAPVRPPL | | 12352 |
| HPV16 | L2 | 140 | 9 | DTTPAILDI | | 12353 |
| HPV16 | L2 | 261 | 8 | DVDNTLYF | | 12354 |
| HPV16 | L2 | 195 | 8 | EIPMDTFI | | 12355 |
| HPV16 | L2 | 340 | 10 | ELQTITPSTY | | 12356 |
| HPV16 | L2 | 176 | 8 | ETGGHFTL | | 12357 |
| HPV16 | L2 | 242 | 8 | FITTPTKL | | 12358 |
| HPV16 | L2 | 242 | 9 | FITTPTKLI | | 12359 |
| HPV16 | L2 | 242 | 11 | FITTPTKLITY | | 12360 |
| HPV16 | L2 | 181 | 8 | FTLSSSTI | | 12361 |
| HPV16 | L2 | 446 | 8 | FYLHPSYY | | 12362 |
| HPV16 | L2 | 446 | 9 | FYLHPSYYM | | 12363 |
| HPV16 | L2 | 446 | 10 | FYLHPSYYML | | 12364 |
| HPV16 | L2 | 259 | 8 | GIDVDNTL | | 12365 |
| HPV16 | L2 | 259 | 9 | GIDVDNTLY | | 12366 |
| HPV16 | L2 | 259 | 10 | GIDVDNTLYF | | 12367 |
| HPV16 | L2 | 364 | 10 | GLYDIYADDF | | 12368 |
| HPV16 | L2 | 364 | 11 | GLYDIYADDFI | | 12369 |
| HPV16 | L2 | 26 | 8 | GTCPPDII | | 12370 |
| HPV16 | L2 | 65 | 8 | GTGGRTGY | | 12371 |
| HPV16 | L2 | 65 | 9 | GTGGRTGYI | | 12372 |
| HPV16 | L2 | 65 | 11 | GTGGRTGYIPL | | 12373 |
| HPV16 | L2 | 76 | 11 | GTRPPTATDTL | | 12374 |
| HPV16 | L2 | 52 | 9 | GVFFGGLGI | | 12375 |
| HPV16 | L2 | 392 | 9 | GYIPANTTI | | 12376 |
| HPV16 | L2 | 392 | 11 | GYIPANTTIPF | | 12377 |
| HPV16 | L2 | 180 | 9 | HFTLSSSTI | | 12378 |
| HPV16 | L2 | 325 | 9 | HYYYDFSTI | | 12379 |
| HPV16 | L2 | 439 | 8 | IIADAGDF | | 12380 |
| HPV16 | L2 | 439 | 9 | IIADAGDFY | | 12381 |
| HPV16 | L2 | 439 | 10 | IIADAGDFYL | | 12382 |
| HPV16 | L2 | 32 | 10 | IIPKVEGKTI | | 12383 |
| HPV16 | L2 | 45 | 10 | ILQYGSMGVF | | 12384 |
| HPV16 | L2 | 45 | 11 | ILQYGSMGVFF | | 12385 |
| HPV16 | L2 | 420 | 8 | ITDQAPSL | | 12386 |
| HPV16 | L2 | 420 | 9 | ITDQAPSLI | | 12387 |
| HPV16 | L2 | 420 | 11 | ITDQAPSLIPI | | 12388 |
| HPV16 | L2 | 243 | 8 | ITTPTKLI | | 12389 |
| HPV16 | L2 | 243 | 10 | ITTPTKLITY | | 12390 |
| HPV16 | L2 | 135 | 11 | ITTSTDTTPAI | | 12391 |
| HPV16 | L2 | 250 | 8 | ITYDNPAY | | 12392 |
| HPV16 | L2 | 250 | 11 | ITYDNPAYEGI | | 12393 |
| HPV16 | L2 | 286 | 9 | IVALHRPAL | | 12394 |
| HPV16 | L2 | 430 | 8 | IVPGSPQY | | 12395 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | L2 | 430 | 10 | IVPGSPQYTI | | 12396 |
| HPV16 | L2 | 430 | 11 | IVPGSPQYTII | | 12397 |
| HPV16 | L2 | 105 | 10 | IVSLVEETSF | | 12398 |
| HPV16 | L2 | 105 | 11 | IVSLVEETSFI | | 12399 |
| HPV16 | L2 | 248 | 10 | KLITYDNPAY | | 12400 |
| HPV16 | L2 | 39 | 8 | KTIADQIL | | 12401 |
| HPV16 | L2 | 39 | 10 | KTIADQILQY | | 12402 |
| HPV16 | L2 | 35 | 11 | KVEGKTIADQI | | 12403 |
| HPV16 | L2 | 323 | 8 | KVHYYYDF | | 12404 |
| HPV16 | L2 | 323 | 11 | KVHYYYDFSTI | | 12405 |
| HPV16 | L2 | 236 | 8 | KVVDPAFI | | 12406 |
| HPV16 | L2 | 427 | 11 | LIPIVPGSPQY | | 12407 |
| HPV16 | L2 | 249 | 9 | LITYDNPAY | | 12408 |
| HPV16 | L2 | 294 | 8 | LTSRRTGI | | 12409 |
| HPV16 | L2 | 294 | 10 | LTSRRTGIRY | | 12410 |
| HPV16 | L2 | 108 | 8 | LVEETSFI | | 12411 |
| HPV16 | L2 | 410 | 9 | LVSGPDIPI | | 12412 |
| HPV16 | L2 | 410 | 11 | LVSGPDIPINI | | 12413 |
| HPV16 | L2 | 365 | 9 | LYDIYADDF | | 12414 |
| HPV16 | L2 | 365 | 10 | LYDIYADDFI | | 12415 |
| HPV16 | L2 | 266 | 10 | LYFSSNDNSI | | 12416 |
| HPV16 | L2 | 454 | 9 | MLRKRRKRL | | 12417 |
| HPV16 | L2 | 454 | 11 | MLRKRRKRLPY | | 12418 |
| HPV16 | L2 | 276 | 8 | NIAPDPDF | | 12419 |
| HPV16 | L2 | 276 | 9 | NIAPDPDFL | | 12420 |
| HPV16 | L2 | 276 | 11 | NIAPDPDFLDI | | 12421 |
| HPV16 | L2 | 407 | 10 | NIPLVSGPDI | | 12422 |
| HPV16 | L2 | 419 | 9 | NITDQAPSL | | 12423 |
| HPV16 | L2 | 419 | 10 | NITDQAPSLI | | 12424 |
| HPV16 | L2 | 397 | 10 | NTTIPFGGAY | | 12425 |
| HPV16 | L2 | 208 | 9 | NTVTSSTPI | | 12426 |
| HPV16 | L2 | 192 | 10 | NYEEIPMDTF | | 12427 |
| HPV16 | L2 | 192 | 11 | NYEEIPMDTFI | | 12428 |
| HPV16 | L2 | 401 | 8 | PFGGAYNI | | 12429 |
| HPV16 | L2 | 401 | 10 | PFGGAYNIPL | | 12430 |
| HPV16 | L2 | 417 | 11 | PINITDQAPSL | | 12431 |
| HPV16 | L2 | 215 | 11 | PIPGSRPVARL | | 12432 |
| HPV16 | L2 | 429 | 9 | PIVPGSPQY | | 12433 |
| HPV16 | L2 | 429 | 11 | PIVPGSPQYTI | | 12434 |
| HPV16 | L2 | 409 | 8 | PLVSGPDI | | 12435 |
| HPV16 | L2 | 409 | 10 | PLVSGPDIPI | | 12436 |
| HPV16 | L2 | 161 | 9 | PTFTDPSVL | | 12437 |
| HPV16 | L2 | 172 | 10 | PTPAETGGHF | | 12438 |
| HPV16 | L2 | 358 | 8 | PTSINNGL | | 12439 |
| HPV16 | L2 | 358 | 9 | PTSINNGLY | | 12440 |
| HPV16 | L2 | 358 | 11 | PTSINNGLYDI | | 12441 |
| HPV16 | L2 | 221 | 8 | PVARLGLY | | 12442 |
| HPV16 | L2 | 97 | 9 | PVGPSDPSI | | 12443 |
| HPV16 | L2 | 381 | 10 | PVPSVPSTSL | | 12444 |
| HPV16 | L2 | 463 | 9 | PYFFSDVSL | | 12445 |
| HPV16 | L2 | 44 | 8 | QILQYGSM | | 12446 |
| HPV16 | L2 | 44 | 11 | QILQYGSMGVF | | 12447 |
| HPV16 | L2 | 342 | 8 | QTITPSTY | | 12448 |
| HPV16 | L2 | 310 | 11 | QTLRTRSGKSI | | 12449 |
| HPV16 | L2 | 234 | 9 | QVKVVDPAF | | 12450 |
| HPV16 | L2 | 234 | 10 | QVKVVDPAFI | | 12451 |
| HPV16 | L2 | 47 | 8 | QYGSMGVF | | 12452 |
| HPV16 | L2 | 47 | 9 | QYGSMGVFF | | 12453 |
| HPV16 | L2 | 436 | 11 | QYTIIADAGDF | | 12454 |
| HPV16 | L2 | 305 | 8 | RIGNKQTL | | 12455 |
| HPV16 | L2 | 461 | 11 | RLPYFFSDVSL | | 12456 |
| HPV16 | L2 | 298 | 9 | RTGIRYSRI | | 12457 |
| HPV16 | L2 | 9 | 10 | RTKRASATQL | | 12458 |
| HPV16 | L2 | 9 | 11 | RTKRASATQLY | | 12459 |
| HPV16 | L2 | 313 | 8 | RTRSGKSI | | 12460 |
| HPV16 | L2 | 302 | 11 | RYSRIGNKQTL | | 12461 |
| HPV16 | L2 | 319 | 8 | SIGAKVHY | | 12462 |
| HPV16 | L2 | 319 | 9 | SIGAKVHYY | | 12463 |
| HPV16 | L2 | 319 | 10 | SIGAKVHYYY | | 12464 |
| HPV16 | L2 | 274 | 10 | SINIAPDPDF | | 12465 |
| HPV16 | L2 | 274 | 11 | SINIAPDPDFL | | 12466 |
| HPV16 | L2 | 360 | 9 | SINNGLYDI | | 12467 |
| HPV16 | L2 | 360 | 10 | SINNGLYDIY | | 12468 |
| HPV16 | L2 | 125 | 9 | SIPPDVSGF | | 12469 |

TABLE X-continued

A24 Supermotif Peptides

| Type | Protein | Position | No. of Amino Acids | Sequence | A*2402 | Seq. Id. No. |
|---|---|---|---|---|---|---|
| HPV16 | L2 | 125 | 11 | SIPPDVSGFSI | | 12470 |
| HPV16 | L2 | 104 | 11 | SIVSLVEETSF | | 12471 |
| HPV16 | L2 | 107 | 8 | SLVEETSF | | 12472 |
| HPV16 | L2 | 107 | 9 | SLVEETSFI | | 12473 |
| HPV16 | L2 | 50 | 9 | SMGVFFGGL | | 12474 |
| HPV16 | L2 | 50 | 11 | SMGVFFGGLGI | | 12475 |
| HPV16 | L2 | 138 | 8 | STDTTPAI | | 12476 |
| HPV16 | L2 | 138 | 9 | STDTTPAIL | | 12477 |
| HPV16 | L2 | 138 | 11 | STDTTPAILDI | | 12478 |
| HPV16 | L2 | 189 | 8 | STHNYEEI | | 12479 |
| HPV16 | L2 | 189 | 10 | STHNYEEIPM | | 12480 |
| HPV16 | L2 | 331 | 9 | STIDSAEEI | | 12481 |
| HPV16 | L2 | 331 | 11 | STIDSAEEIEL | | 12482 |
| HPV16 | L2 | 186 | 8 | STISTHNY | | 12483 |
| HPV16 | L2 | 186 | 11 | STISTHNYEEI | | 12484 |
| HPV16 | L2 | 387 | 8 | STSLSGYI | | 12485 |
| HPV16 | L2 | 347 | 11 | STYTTTSHAAL | | 12486 |
| HPV16 | L2 | 384 | 10 | SVPSTSLSGY | | 12487 |
| HPV16 | L2 | 384 | 11 | SVPSTSLSGYI | | 12488 |
| HPV16 | L2 | 162 | 8 | TFTDPSVL | | 12489 |
| HPV16 | L2 | 40 | 9 | TIADQILQY | | 12490 |
| HPV16 | L2 | 332 | 8 | TIDSAEEI | | 12491 |
| HPV16 | L2 | 332 | 10 | TIDSAEEIEL | | 12492 |
| HPV16 | L2 | 438 | 9 | TIIADAGDF | | 12493 |
| HPV16 | L2 | 438 | 10 | TIIADAGDFY | | 12494 |
| HPV16 | L2 | 438 | 11 | TIIADAGDFYL | | 12495 |
| HPV16 | L2 | 399 | 8 | TIPFGGAY | | 12496 |
| HPV16 | L2 | 399 | 10 | TIPFGGAYNI | | 12497 |
| HPV16 | L2 | 187 | 10 | TISTHNYEEI | | 12498 |
| HPV16 | L2 | 85 | 9 | TLAPVRPPL | | 12499 |
| HPV16 | L2 | 311 | 10 | TLRTRSGKSI | | 12500 |
| HPV16 | L2 | 265 | 11 | TLYFSSNDNSI | | 12501 |
| HPV16 | L2 | 156 | 8 | TTHNNPTF | | 12502 |
| HPV16 | L2 | 398 | 9 | TTIPFGGAY | | 12503 |
| HPV16 | L2 | 398 | 11 | TTIPFGGAYNI | | 12504 |
| HPV16 | L2 | 141 | 8 | TTPAILDI | | 12505 |
| HPV16 | L2 | 244 | 9 | TTPTKLITY | | 12506 |
| HPV16 | L2 | 351 | 11 | TTSHAALPTSI | | 12507 |
| HPV16 | L2 | 136 | 10 | TTSTDTTPAI | | 12508 |
| HPV16 | L2 | 136 | 11 | TTSTDTTPAIL | | 12509 |
| HPV16 | L2 | 350 | 8 | TTTSHAAL | | 12510 |
| HPV16 | L2 | 153 | 11 | TTVTTHNNPTF | | 12511 |
| HPV16 | L2 | 209 | 8 | TVTSSTPI | | 12512 |
| HPV16 | L2 | 154 | 10 | TVTTHNNPTF | | 12513 |
| HPV16 | L2 | 251 | 10 | TYDNPAYEGI | | 12514 |
| HPV16 | L2 | 348 | 10 | TYTTSHAAL | | 12515 |
| HPV16 | L2 | 53 | 8 | VFFGGLGI | | 12516 |
| HPV16 | L2 | 155 | 9 | VTTHNNPTF | | 12517 |
| HPV16 | L2 | 464 | 8 | YFFSDVSL | | 12518 |
| HPV16 | L2 | 267 | 9 | YFSSNDNSI | | 12519 |
| HPV16 | L2 | 267 | 11 | YFSSNDNSINI | | 12520 |
| HPV16 | L2 | 393 | 8 | YIPANTTI | | 12521 |
| HPV16 | L2 | 393 | 10 | YIPANTTIPF | | 12522 |
| HPV16 | L2 | 447 | 8 | YLHPSYYM | | 12523 |
| HPV16 | L2 | 447 | 9 | YLHPSYYML | | 12524 |
| HPV16 | L2 | 453 | 10 | YMLRKRRKRL | | 12525 |
| HPV16 | L2 | 437 | 10 | YTIIADAGDF | | 12526 |
| HPV16 | L2 | 437 | 11 | YTIIADAGDFY | | 12527 |
| HPV16 | L2 | 349 | 9 | YTTTSHAAL | | 12528 |
| HPV16 | L2 | 452 | 11 | YYMLRKRRKRL | | 12529 |
| HPV16 | L2 | 326 | 8 | YYYDFSTI | | 12530 |
| HPV18 | E1 | 398 | 11 | AFLKSNCQAKY | | 12531 |
| HPV18 | E1 | 246 | 9 | AIFGVNPTI | | 12532 |
| HPV18 | E1 | 22 | 11 | AIVDKKTGDVI | | 12533 |
| HPV18 | E1 | 546 | 9 | ALDGNPISI | | 12534 |
| HPV18 | E1 | 325 | 9 | ALYWYRTGI | | 12535 |
| HPV18 | E1 | 213 | 10 | AMLAVFKDTY | | 12536 |
| HPV18 | E1 | 526 | 11 | AMLDDATTTCW | | 12537 |
| HPV18 | E1 | 40 | 8 | ATDTGSDM | | 12538 |
| HPV18 | E1 | 40 | 11 | ATDTGSDMVDF | | 12539 |
| HPV18 | E1 | 531 | 8 | ATTCWTY | | 12540 |
| HPV18 | E1 | 531 | 9 | ATTCWTYF | | 12541 |
| HPV18 | E1 | 216 | 9 | AVFKDTYGL | | 12542 |
| HPV18 | E1 | 216 | 11 | AVFKDTYGLSF | | 12543 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | E1 | 618 | 10 | CFFERTWSRL | | 12544 |
| HPV18 | E1 | 273 | 9 | CLDCKWGVL | | 12545 |
| HPV18 | E1 | 273 | 10 | CLDCKWGVLI | | 12546 |
| HPV18 | E1 | 273 | 11 | CLDCKWGVLIL | | 12547 |
| HPV18 | E1 | 311 | 9 | CMLIQPPKL | | 12548 |
| HPV18 | E1 | 240 | 8 | CTDWVTAI | | 12549 |
| HPV18 | E1 | 240 | 9 | CTDWVTAIF | | 12550 |
| HPV18 | E1 | 196 | 9 | CTIAQLKDL | | 12551 |
| HPV18 | E1 | 196 | 10 | CTIAQLKDLL | | 12552 |
| HPV18 | E1 | 535 | 8 | CWTYFDTY | | 12553 |
| HPV18 | E1 | 535 | 9 | CWTYFDTYM | | 12554 |
| HPV18 | E1 | 49 | 9 | DFIDTQGTF | | 12555 |
| HPV18 | E1 | 363 | 8 | DLSEMVQW | | 12556 |
| HPV18 | E1 | 363 | 10 | DLSEMVQWAF | | 12557 |
| HPV18 | E1 | 381 | 8 | DMAFEYAL | | 12558 |
| HPV18 | E1 | 381 | 9 | DMAFEYALL | | 12559 |
| HPV18 | E1 | 637 | 10 | DTEGNPFGTF | | 12560 |
| HPV18 | E1 | 106 | 8 | DTELSPRL | | 12561 |
| HPV18 | E1 | 106 | 11 | DTELSPRLQEI | | 12562 |
| HPV18 | E1 | 42 | 9 | DTGSDMVDF | | 12563 |
| HPV18 | E1 | 42 | 10 | DTGSDMVDFI | | 12564 |
| HPV18 | E1 | 342 | 9 | DTPEWIQRL | | 12565 |
| HPV18 | E1 | 342 | 11 | DTPEWIQRLTI | | 12566 |
| HPV18 | E1 | 220 | 10 | DTYGLSFTDL | | 12567 |
| HPV18 | E1 | 540 | 8 | DTYMRNAL | | 12568 |
| HPV18 | E1 | 445 | 8 | DWRPIVQF | | 12569 |
| HPV18 | E1 | 445 | 9 | DWRPIVQFL | | 12570 |
| HPV18 | E1 | 445 | 11 | DWRPIVQFLRY | | 12571 |
| HPV18 | E1 | 459 | 9 | EFITFLGAL | | 12572 |
| HPV18 | E1 | 594 | 8 | EFPNAFPF | | 12573 |
| HPV18 | E1 | 610 | 10 | EINDKNWKCF | | 12574 |
| HPV18 | E1 | 610 | 11 | EINDKNWKCFF | | 12575 |
| HPV18 | E1 | 62 | 8 | ELETAQAL | | 12576 |
| HPV18 | E1 | 62 | 9 | ELETAQALF | | 12577 |
| HPV18 | E1 | 108 | 9 | ELSPRLQEI | | 12578 |
| HPV18 | E1 | 108 | 11 | ELSPRLQEISL | | 12579 |
| HPV18 | E1 | 375 | 8 | ELTDESDM | | 12580 |
| HPV18 | E1 | 375 | 10 | ELTDESDMAF | | 12581 |
| HPV18 | E1 | 366 | 11 | EMVQWAFDNEL | | 12582 |
| HPV18 | E1 | 309 | 11 | ETCMLIQPPKL | | 12583 |
| HPV18 | E1 | 104 | 10 | EVDTELSPRL | | 12584 |
| HPV18 | E1 | 74 | 9 | EVHNDAQVL | | 12585 |
| HPV18 | E1 | 338 | 9 | EVMGDTPEW | | 12586 |
| HPV18 | E1 | 338 | 10 | EVMGDTPEWI | | 12587 |
| HPV18 | E1 | 345 | 8 | EWIQRLTI | | 12588 |
| HPV18 | E1 | 345 | 9 | EWIQRLTII | | 12589 |
| HPV18 | E1 | 619 | 9 | FFERTWSRL | | 12590 |
| HPV18 | E1 | 619 | 11 | FFERTWSRLDL | | 12591 |
| HPV18 | E1 | 50 | 8 | FIDTQGTF | | 12592 |
| HPV18 | E1 | 497 | 10 | FIHFIQGAVI | | 12593 |
| HPV18 | E1 | 265 | 10 | FILYAHIQCL | | 12594 |
| HPV18 | E1 | 500 | 9 | FIQGAVISF | | 12595 |
| HPV18 | E1 | 460 | 8 | FITFLGAL | | 12596 |
| HPV18 | E1 | 460 | 11 | FITFLGALKSF | | 12597 |
| HPV18 | E1 | 463 | 8 | FLGALKSF | | 12598 |
| HPV18 | E1 | 463 | 9 | FLGALKSFL | | 12599 |
| HPV18 | E1 | 470 | 11 | FLKGTPKKNCL | | 12600 |
| HPV18 | E1 | 399 | 10 | FLKSNCQAKY | | 12601 |
| HPV18 | E1 | 399 | 11 | FLKSNCQAKYL | | 12602 |
| HPV18 | E1 | 452 | 9 | FLRYQQIEF | | 12603 |
| HPV18 | E1 | 452 | 10 | FLRYQQIEFI | | 12604 |
| HPV18 | E1 | 226 | 8 | FTDLVRNF | | 12605 |
| HPV18 | E1 | 130 | 8 | FTISDSGY | | 12606 |
| HPV18 | E1 | 508 | 8 | FVNSTSHF | | 12607 |
| HPV18 | E1 | 508 | 9 | FVNSTSHFW | | 12608 |
| HPV18 | E1 | 508 | 10 | FVNSTSHFWL | | 12609 |
| HPV18 | E1 | 257 | 9 | GFKTLIQPF | | 12610 |
| HPV18 | E1 | 257 | 10 | GFKTLIQPFI | | 12611 |
| HPV18 | E1 | 257 | 11 | GFKTLIQPFIL | | 12612 |
| HPV18 | E1 | 356 | 9 | GIDDSNFDL | | 12613 |
| HPV18 | E1 | 332 | 9 | GISNISEVM | | 12614 |
| HPV18 | E1 | 223 | 11 | GLSFTDLVRNF | | 12615 |
| HPV18 | E1 | 494 | 8 | GMSFIHFI | | 12616 |
| HPV18 | E1 | 55 | 9 | GTFCEQAEL | | 12617 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | E1 | 11 | 8 | GTGCNGWF | | 12618 |
| HPV18 | E1 | 11 | 9 | GTGCNGWFY | | 12619 |
| HPV18 | E1 | 473 | 8 | GTPKKNCL | | 12620 |
| HPV18 | E1 | 473 | 10 | GTPKKNCLVF | | 12621 |
| HPV18 | E1 | 182 | 8 | GTSDNSNI | | 12622 |
| HPV18 | E1 | 279 | 8 | GVLILALL | | 12623 |
| HPV18 | E1 | 279 | 10 | GVLILALLRY | | 12624 |
| HPV18 | E1 | 249 | 10 | GVNPTIAEGF | | 12625 |
| HPV18 | E1 | 16 | 8 | GWFYVQAI | | 12626 |
| HPV18 | E1 | 499 | 8 | HFIQGAVI | | 12627 |
| HPV18 | E1 | 499 | 10 | HFIQGAVISF | | 12628 |
| HPV18 | E1 | 270 | 9 | HIQCLDCKW | | 12629 |
| HPV18 | E1 | 306 | 8 | HVPETCML | | 12630 |
| HPV18 | E1 | 306 | 9 | HVPETCMLI | | 12631 |
| HPV18 | E1 | 418 | 10 | HYRRAQKRQM | | 12632 |
| HPV18 | E1 | 247 | 8 | IFGVNPTI | | 12633 |
| HPV18 | E1 | 352 | 11 | IIQHGIDDSNF | | 12634 |
| HPV18 | E1 | 266 | 9 | ILYAHIQCL | | 12635 |
| HPV18 | E1 | 461 | 10 | ITFLGALKSF | | 12636 |
| HPV18 | E1 | 461 | 11 | ITFLGALKSFL | | 12637 |
| HPV18 | E1 | 590 | 10 | ITVFEFPNAF | | 12638 |
| HPV18 | E1 | 23 | 10 | IVDKKTGDVI | | 12639 |
| HPV18 | E1 | 449 | 10 | IVQFLRYQQI | | 12640 |
| HPV18 | E1 | 439 | 8 | KIDEGGDW | | 12641 |
| HPV18 | E1 | 439 | 11 | KIDEGGDWRPI | | 12642 |
| HPV18 | E1 | 647 | 11 | KLRAGQNHRPL | | 12643 |
| HPV18 | E1 | 318 | 9 | KLRSSVAAL | | 12644 |
| HPV18 | E1 | 318 | 10 | KLRSSVAALY | | 12645 |
| HPV18 | E1 | 318 | 11 | KLRSSVAALYW | | 12646 |
| HPV18 | E1 | 259 | 8 | KTLIQPFI | | 12647 |
| HPV18 | E1 | 259 | 9 | KTLIQPFIL | | 12648 |
| HPV18 | E1 | 259 | 10 | KTLIQPFILY | | 12649 |
| HPV18 | E1 | 237 | 11 | KTTCTDWVTAI | | 12650 |
| HPV18 | E1 | 206 | 9 | KVNNKQGAM | | 12651 |
| HPV18 | E1 | 206 | 10 | KVNNKQGAML | | 12652 |
| HPV18 | E1 | 277 | 9 | KWGVLILAL | | 12653 |
| HPV18 | E1 | 277 | 10 | KWGVLILALL | | 12654 |
| HPV18 | E1 | 407 | 9 | KYLKDCATM | | 12655 |
| HPV18 | E1 | 129 | 9 | LFTISDSGY | | 12656 |
| HPV18 | E1 | 281 | 8 | LILALLRY | | 12657 |
| HPV18 | E1 | 561 | 9 | LIQLKCPPI | | 12658 |
| HPV18 | E1 | 561 | 10 | LIQLKCPPIL | | 12659 |
| HPV18 | E1 | 561 | 11 | LIQLKCPPILL | | 12660 |
| HPV18 | E1 | 261 | 8 | LIQPFILY | | 12661 |
| HPV18 | E1 | 261 | 11 | LIQPFILYAHI | | 12662 |
| HPV18 | E1 | 304 | 9 | LLHVPETCM | | 12663 |
| HPV18 | E1 | 304 | 10 | LLHVPETCML | | 12664 |
| HPV18 | E1 | 304 | 11 | LLHVPETCMLI | | 12665 |
| HPV18 | E1 | 204 | 11 | LLKVNNKQGAM | | 12666 |
| HPV18 | E1 | 285 | 11 | LLRYKCGKSRL | | 12667 |
| HPV18 | E1 | 376 | 9 | LTDESDMAF | | 12668 |
| HPV18 | E1 | 376 | 11 | LTDESDMAFEY | | 12669 |
| HPV18 | E1 | 520 | 8 | LTDTKVAM | | 12670 |
| HPV18 | E1 | 520 | 9 | LTDTKVAML | | 12671 |
| HPV18 | E1 | 350 | 8 | LTIIQHGI | | 12672 |
| HPV18 | E1 | 295 | 10 | LTVAKGLSTL | | 12673 |
| HPV18 | E1 | 295 | 11 | LTVAKGLSTLL | | 12674 |
| HPV18 | E1 | 267 | 8 | LYAHIQCL | | 12675 |
| HPV18 | E1 | 326 | 8 | LYWYRTGI | | 12676 |
| HPV18 | E1 | 326 | 11 | LYWYRTGISNI | | 12677 |
| HPV18 | E1 | 214 | 9 | MLAVFKDTY | | 12678 |
| HPV18 | E1 | 214 | 11 | MLAVFKDTYGL | | 12679 |
| HPV18 | E1 | 527 | 10 | MLDDATTTCW | | 12680 |
| HPV18 | E1 | 312 | 8 | MLIQPPKL | | 12681 |
| HPV18 | E1 | 47 | 11 | MVDFIDTQGTF | | 12682 |
| HPV18 | E1 | 367 | 10 | MVQWAFDNEL | | 12683 |
| HPV18 | E1 | 361 | 10 | NFDLSEMVQW | | 12684 |
| HPV18 | E1 | 188 | 11 | NIENVNPQCTI | | 12685 |
| HPV18 | E1 | 574 | 10 | NIHPAKDNRW | | 12686 |
| HPV18 | E1 | 428 | 8 | NMSQWIRF | | 12687 |
| HPV18 | E1 | 487 | 9 | NTGKSYFGM | | 12688 |
| HPV18 | E1 | 487 | 11 | NTGKSYFGMSF | | 12689 |
| HPV18 | E1 | 158 | 11 | NVCSGGSTEAI | | 12690 |
| HPV18 | E1 | 191 | 8 | NVNPQCTI | | 12691 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | E1 | 191 | 11 | NVNPQCTIAQL | | 12692 |
| HPV18 | E1 | 615 | 10 | NWKCFFERTW | | 12693 |
| HPV18 | E1 | 600 | 10 | PFDKNGNPVY | | 12694 |
| HPV18 | E1 | 264 | 8 | PFILYAHI | | 12695 |
| HPV18 | E1 | 264 | 11 | PFILYAHIQCL | | 12696 |
| HPV18 | E1 | 568 | 8 | PILLTTNI | | 12697 |
| HPV18 | E1 | 551 | 11 | PISIDRKHKPL | | 12698 |
| HPV18 | E1 | 448 | 8 | PIVQFLRY | | 12699 |
| HPV18 | E1 | 448 | 11 | PIVQFLRYQQI | | 12700 |
| HPV18 | E1 | 560 | 10 | PLIQLKCPPI | | 12701 |
| HPV18 | E1 | 560 | 11 | PLIQLKCPPIL | | 12702 |
| HPV18 | E1 | 519 | 9 | PLTDTKVAM | | 12703 |
| HPV18 | E1 | 519 | 10 | PLTDTKVAML | | 12704 |
| HPV18 | E1 | 252 | 10 | PTIAEGFKTL | | 12705 |
| HPV18 | E1 | 252 | 11 | PTIAEGFKTLI | | 12706 |
| HPV18 | E1 | 607 | 10 | PVYEINDKNW | | 12707 |
| HPV18 | E1 | 584 | 10 | PYLESRITVF | | 12708 |
| HPV18 | E1 | 451 | 8 | QFLRYQQI | | 12709 |
| HPV18 | E1 | 451 | 10 | QFLRYQQIEF | | 12710 |
| HPV18 | E1 | 451 | 11 | QFLRYQQIEFI | | 12711 |
| HPV18 | E1 | 457 | 8 | QIEFITFL | | 12712 |
| HPV18 | E1 | 457 | 11 | QIEFITFLGAL | | 12713 |
| HPV18 | E1 | 563 | 8 | QLKCPPIL | | 12714 |
| HPV18 | E1 | 563 | 9 | QLKCPPILL | | 12715 |
| HPV18 | E1 | 426 | 8 | QMNMSQWI | | 12716 |
| HPV18 | E1 | 426 | 10 | QMNMSQWIRF | | 12717 |
| HPV18 | E1 | 80 | 10 | QVLHVLRKF | | 12718 |
| HPV18 | E1 | 369 | 8 | QWAFDNEL | | 12719 |
| HPV18 | E1 | 431 | 10 | QWIRFRCSKI | | 12720 |
| HPV18 | E1 | 589 | 11 | RITVFEFPNAF | | 12721 |
| HPV18 | E1 | 102 | 8 | RLEVDTEL | | 12722 |
| HPV18 | E1 | 128 | 10 | RLFTISDSGY | | 12723 |
| HPV18 | E1 | 349 | 9 | RLTIIQHGI | | 12724 |
| HPV18 | E1 | 294 | 8 | RLTVAKGL | | 12725 |
| HPV18 | E1 | 294 | 11 | TLTVAKGLSTL | | 12726 |
| HPV18 | E1 | 330 | 11 | RTGISNISEVM | | 12727 |
| HPV18 | E1 | 622 | 8 | RTWSRLDL | | 12728 |
| HPV18 | E1 | 582 | 9 | RWPYLESRI | | 12729 |
| HPV18 | E1 | 287 | 9 | RYKCGKSRL | | 12730 |
| HPV18 | E1 | 454 | 8 | RYQQIEFI | | 12731 |
| HPV18 | E1 | 454 | 10 | RYQQIEFITF | | 12732 |
| HPV18 | E1 | 454 | 11 | RYQQIEFITFL | | 12733 |
| HPV18 | E1 | 496 | 11 | SFIHFIQGAVI | | 12734 |
| HPV18 | E1 | 225 | 9 | SFTDLVRNF | | 12735 |
| HPV18 | E1 | 507 | 9 | SFVNSTSHF | | 12736 |
| HPV18 | E1 | 507 | 10 | SFVNSTSHFW | | 12737 |
| HPV18 | E1 | 507 | 11 | SFVNSTSHFWL | | 12738 |
| HPV18 | E1 | 553 | 9 | SIDRKHKPL | | 12739 |
| HPV18 | E1 | 553 | 10 | SIDRKHKPLI | | 12740 |
| HPV18 | E1 | 93 | 11 | STENSPLGERL | | 12741 |
| HPV18 | E1 | 302 | 11 | STLLHVPETCM | | 12742 |
| HPV18 | E1 | 511 | 10 | STSHFWLEPL | | 12743 |
| HPV18 | E1 | 322 | 8 | SVAALYWY | | 12744 |
| HPV18 | E1 | 179 | 11 | SVDGTSDNSNI | | 12745 |
| HPV18 | E1 | 491 | 8 | SYFGMSFI | | 12746 |
| HPV18 | E1 | 491 | 10 | SYFGMSFIHF | | 12747 |
| HPV18 | E1 | 491 | 11 | SYFGMSFIHFI | | 12748 |
| HPV18 | E1 | 56 | 8 | TFCEQAEL | | 12749 |
| HPV18 | E1 | 462 | 9 | TFLGALKSF | | 12750 |
| HPV18 | E1 | 462 | 10 | TFLGALKSFL | | 12751 |
| HPV18 | E1 | 253 | 9 | TIAEGFKTL | | 12752 |
| HPV18 | E1 | 253 | 10 | TIAEGFKTLI | | 12753 |
| HPV18 | E1 | 197 | 8 | TIAQLKDL | | 12754 |
| HPV18 | E1 | 197 | 9 | TIAQLKDLL | | 12755 |
| HPV18 | E1 | 260 | 8 | TLIQPFIL | | 12756 |
| HPV18 | E1 | 260 | 9 | TLIQPFILY | | 12757 |
| HPV18 | E1 | 303 | 10 | TLLHVPETCM | | 12758 |
| HPV18 | E1 | 303 | 11 | TLLHVPETCML | | 12759 |
| HPV18 | E1 | 238 | 10 | TTCTDWVTAI | | 12760 |
| HPV18 | E1 | 238 | 11 | TTCTDWVTAIF | | 12761 |
| HPV18 | E1 | 533 | 10 | TTCWTYFDTY | | 12762 |
| HPV18 | E1 | 533 | 11 | TTCWTYFDTYM | | 12763 |
| HPV18 | E1 | 532 | 8 | TTCWTYF | | 12764 |
| HPV18 | E1 | 532 | 11 | TTCWTYFDTY | | 12765 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | E1 | 296 | 9 | TVAKGLSTL | | 12766 |
| HPV18 | E1 | 296 | 10 | TVAKGLSTLL | | 12767 |
| HPV18 | E1 | 591 | 9 | TVFEFPNAF | | 12768 |
| HPV18 | E1 | 591 | 11 | TVFEFPNAFPF | | 12769 |
| HPV18 | E1 | 537 | 11 | TYFDTYMRNAL | | 12770 |
| HPV18 | E1 | 221 | 9 | TYGLSFTDL | | 12771 |
| HPV18 | E1 | 592 | 8 | VFEFPNAF | | 12772 |
| HPV18 | E1 | 592 | 10 | VFEFPNAFPF | | 12773 |
| HPV18 | E1 | 217 | 8 | VFKDTYGL | | 12774 |
| HPV18 | E1 | 217 | 10 | VFKDTYGLSF | | 12775 |
| HPV18 | E1 | 505 | 11 | VISFVNSTSHF | | 12776 |
| HPV18 | E1 | 81 | 9 | VLHVLKRKF | | 12777 |
| HPV18 | E1 | 280 | 9 | VLILALLRY | | 12778 |
| HPV18 | E1 | 339 | 8 | VMGDTPEW | | 12779 |
| HPV18 | E1 | 339 | 9 | VMGDTPEWI | | 12780 |
| HPV18 | E1 | 244 | 11 | VTAIFGVNPTI | | 12781 |
| HPV18 | E1 | 608 | 9 | VYEINDKNW | | 12782 |
| HPV18 | E1 | 346 | 8 | WIQRLTII | | 12783 |
| HPV18 | E1 | 432 | 9 | WIRFRCSKI | | 12784 |
| HPV18 | E1 | 536 | 8 | WTYFDTYM | | 12785 |
| HPV18 | E1 | 328 | 9 | WYRTGISNI | | 12786 |
| HPV18 | E1 | 538 | 10 | YFDTYMRNAL | | 12787 |
| HPV18 | E1 | 492 | 9 | YFGMSFIHF | | 12788 |
| HPV18 | E1 | 492 | 10 | YFGMSFIHFI | | 12789 |
| HPV18 | E1 | 585 | 9 | YLESRITVF | | 12790 |
| HPV18 | E1 | 585 | 11 | YLESRITVFEF | | 12791 |
| HPV18 | E1 | 408 | 8 | YLKDCATM | | 12792 |
| HPV18 | E1 | 542 | 11 | YMRNALDGNPI | | 12793 |
| HPV18 | E1 | 327 | 10 | YWYRTGISNI | | 12794 |
| HPV18 | E2 | 76 | 8 | AIELQMAL | | 12795 |
| HPV18 | E2 | 76 | 11 | AIELQMALQGL | | 12796 |
| HPV18 | E2 | 45 | 11 | AIFFAAREHGI | | 12797 |
| HPV18 | E2 | 351 | 8 | AIPDSVQI | | 12798 |
| HPV18 | E2 | 351 | 9 | AIPDSVQIL | | 12799 |
| HPV18 | E2 | 82 | 10 | ALQGLAQSRY | | 12800 |
| HPV18 | E2 | 154 | 9 | ATCVSHRGL | | 12801 |
| HPV18 | E2 | 154 | 10 | ATCVSHRGLY | | 12802 |
| HPV18 | E2 | 154 | 11 | ATCVSHRGLYY | | 12803 |
| HPV18 | E2 | 214 | 8 | ATQLVKQL | | 12804 |
| HPV18 | E2 | 246 | 9 | ATRPGHCGL | | 12805 |
| HPV18 | E2 | 137 | 8 | AWDSVYYM | | 12806 |
| HPV18 | E2 | 132 | 11 | CMTYVAWDSVY | | 12807 |
| HPV18 | E2 | 14 | 10 | CVQDKIIDHY | | 12808 |
| HPV18 | E2 | 156 | 8 | CVSHRGLY | | 12809 |
| HPV18 | E2 | 156 | 9 | CVSHRGLYY | | 12810 |
| HPV18 | E2 | 29 | 8 | DIDSQIQY | | 12811 |
| HPV18 | E2 | 29 | 9 | DIDSQIQYW | | 12812 |
| HPV18 | E2 | 29 | 11 | DIDSQIQYWQL | | 12813 |
| HPV18 | E2 | 315 | 8 | DISSTWHW | | 12814 |
| HPV18 | E2 | 210 | 8 | DTVSATQL | | 12815 |
| HPV18 | E2 | 95 | 11 | DWTLQDTCEEL | | 12816 |
| HPV18 | E2 | 175 | 9 | EFKSECEKY | | 12817 |
| HPV18 | E2 | 78 | 9 | ELQMALQGL | | 12818 |
| HPV18 | E2 | 104 | 11 | ELWNTEPTHCF | | 12819 |
| HPV18 | E2 | 340 | 8 | ETQRTKFL | | 12820 |
| HPV18 | E2 | 190 | 9 | EVHFGNNVI | | 12821 |
| HPV18 | E2 | 47 | 9 | FFAAREHGI | | 12822 |
| HPV18 | E2 | 161 | 9 | GLYYVKEGY | | 12823 |
| HPV18 | E2 | 168 | 9 | GYNTFYIEF | | 12824 |
| HPV18 | E2 | 291 | 9 | HLKGDRNSL | | 12825 |
| HPV18 | E2 | 22 | 9 | HYENDSKDI | | 12826 |
| HPV18 | E2 | 312 | 9 | HYRDISSTW | | 12827 |
| HPV18 | E2 | 312 | 11 | HYRDISSTWHW | | 12828 |
| HPV18 | E2 | 46 | 10 | IFFAAREHGI | | 12829 |
| HPV18 | E2 | 289 | 11 | IIHLKGDRNSL | | 12830 |
| HPV18 | E2 | 358 | 8 | ILVGYMTM | | 12831 |
| HPV18 | E2 | 345 | 8 | KFLNTVAI | | 12832 |
| HPV18 | E2 | 280 | 10 | KLCSGNTTPI | | 12833 |
| HPV18 | E2 | 280 | 11 | KLCSGNTTPII | | 12834 |
| HPV18 | E2 | 152 | 11 | KTATCVSHRGL | | 12835 |
| HPV18 | E2 | 329 | 9 | KTGILTVTY | | 12836 |
| HPV18 | E2 | 182 | 8 | KYGNTGTW | | 12837 |
| HPV18 | E2 | 39 | 8 | LIRWENAI | | 12838 |
| HPV18 | E2 | 39 | 9 | LIRWENAIF | | 12839 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | E2 | 39 | 10 | LIRWENAIFF | | 12840 |
| HPV18 | E2 | 105 | 10 | LWNTEPTHCF | | 12841 |
| HPV18 | E2 | 162 | 8 | LYYVKEGY | | 12842 |
| HPV18 | E2 | 162 | 11 | LYYVKEGYNTF | | 12843 |
| HPV18 | E2 | 133 | 10 | MTYVAWDSVY | | 12844 |
| HPV18 | E2 | 133 | 11 | MTYVAWDSVYY | | 12845 |
| HPV18 | E2 | 67 | 11 | NISKSKAHKAI | | 12846 |
| HPV18 | E2 | 107 | 8 | NTEPTHCF | | 12847 |
| HPV18 | E2 | 185 | 9 | NTGTWEVHF | | 12848 |
| HPV18 | E2 | 285 | 8 | NTTPIIHL | | 12849 |
| HPV18 | E2 | 348 | 11 | NTVAIPDSVQI | | 12850 |
| HPV18 | E2 | 196 | 9 | NVIDCNDSM | | 12851 |
| HPV18 | E2 | 272 | 10 | PTGNNKRRKL | | 12852 |
| HPV18 | E2 | 357 | 9 | QILVGYMTM | | 12853 |
| HPV18 | E2 | 33 | 8 | QIQYWQLI | | 12854 |
| HPV18 | E2 | 33 | 10 | QIQYWQLIRW | | 12855 |
| HPV18 | E2 | 38 | 9 | QLIRWENAI | | 12856 |
| HPV18 | E2 | 38 | 10 | QLIRWENAIF | | 12857 |
| HPV18 | E2 | 38 | 11 | QLIRWENAIFF | | 12858 |
| HPV18 | E2 | 220 | 9 | QLQHTPSPY | | 12859 |
| HPV18 | E2 | 56 | 11 | QTLNHQVVPAY | | 12860 |
| HPV18 | E2 | 2 | 11 | QTPKETLSERL | | 12861 |
| HPV18 | E2 | 61 | 8 | QVVPAYNI | | 12862 |
| HPV18 | E2 | 35 | 8 | QYWQLIRW | | 12863 |
| HPV18 | E2 | 305 | 9 | RLRKHSDHY | | 12864 |
| HPV18 | E2 | 11 | 9 | RLSCVQDKI | | 12865 |
| HPV18 | E2 | 11 | 10 | RLSCVQDKII | | 12866 |
| HPV18 | E2 | 343 | 10 | RTKFLNTVAI | | 12867 |
| HPV18 | E2 | 41 | 8 | RWENAIFF | | 12868 |
| HPV18 | E2 | 90 | 9 | RYKTEDWTL | | 12869 |
| HPV18 | E2 | 303 | 11 | RYRLRKHSDHY | | 12870 |
| HPV18 | E2 | 298 | 9 | SLKCLRYRL | | 12871 |
| HPV18 | E2 | 230 | 11 | STVSVGTAKTY | | 12872 |
| HPV18 | E2 | 233 | 8 | SVGTAKTY | | 12873 |
| HPV18 | E2 | 355 | 8 | SVQILVGY | | 12874 |
| HPV18 | E2 | 355 | 9 | SVQILVGYM | | 12875 |
| HPV18 | E2 | 355 | 11 | SVQILVGYMTM | | 12876 |
| HPV18 | E2 | 140 | 11 | SVYYMTDAGTW | | 12877 |
| HPV18 | E2 | 57 | 10 | TLNHQVVPAY | | 12878 |
| HPV18 | E2 | 97 | 9 | TLQDTCEEL | | 12879 |
| HPV18 | E2 | 97 | 10 | TLQDTCEELW | | 12880 |
| HPV18 | E2 | 349 | 10 | TVAIPDSVQI | | 12881 |
| HPV18 | E2 | 349 | 11 | TVAIPDSVQIL | | 12882 |
| HPV18 | E2 | 211 | 11 | TVSATQLVKQL | | 12883 |
| HPV18 | E2 | 231 | 10 | TVSVGTAKTY | | 12884 |
| HPV18 | E2 | 188 | 11 | TWEVHFGNNVI | | 12885 |
| HPV18 | E2 | 336 | 11 | TYHSETQRTKF | | 12886 |
| HPV18 | E2 | 134 | 9 | TYVAWDSVY | | 12887 |
| HPV18 | E2 | 134 | 10 | TYVAWDSVYY | | 12888 |
| HPV18 | E2 | 134 | 11 | TYVAWDSVYYM | | 12889 |
| HPV18 | E2 | 197 | 8 | VIDCNDSM | | 12890 |
| HPV18 | E2 | 123 | 11 | VYFDGNKDNCM | | 12891 |
| HPV18 | E2 | 141 | 10 | VYYMTDAGTW | | 12892 |
| HPV18 | E2 | 322 | 11 | WTGAGNEKTGI | | 12893 |
| HPV18 | E2 | 96 | 10 | WTLQDTCEEL | | 12894 |
| HPV18 | E2 | 96 | 11 | WTLQDTCEELW | | 12895 |
| HPV18 | E2 | 124 | 10 | YFDGNKDNCM | | 12896 |
| HPV18 | E2 | 173 | 11 | YIEFKSECEKY | | 12897 |
| HPV18 | E2 | 143 | 8 | YMTDAGTW | | 12898 |
| HPV18 | E2 | 135 | 8 | YVAWDSVY | | 12899 |
| HPV18 | E2 | 135 | 9 | YVAWDSVYY | | 12900 |
| HPV18 | E2 | 135 | 10 | YVAWDSVYYM | | 12901 |
| HPV18 | E2 | 164 | 9 | YVKEGYNTF | | 12902 |
| HPV18 | E2 | 164 | 10 | YVKEGYNTFY | | 12903 |
| HPV18 | E2 | 164 | 11 | YVKEGYNTFYI | | 12904 |
| HPV18 | E2 | 36 | 11 | YWQLIRWENAI | | 12905 |
| HPV18 | E2 | 142 | 9 | YYMTDAGTW | | 12906 |
| HPV18 | E2 | 163 | 10 | YYVKEGYNTF | | 12907 |
| HPV18 | E2 | 163 | 11 | YYVKEGYNTFY | | 12908 |
| HPV18 | E5 | 49 | 9 | AFTVYVFCF | | 12909 |
| HPV18 | E5 | 49 | 10 | AFTVYVFCFL | | 12910 |
| HPV18 | E5 | 49 | 11 | AFTVYVFCFLL | | 12911 |
| HPV18 | E5 | 47 | 9 | ATAFTVYVF | | 12912 |
| HPV18 | E5 | 47 | 11 | ATAFTVYVFCF | | 12913 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | E5 | 32 | 8 | AWVLVFVY | | 12914 |
| HPV18 | E5 | 32 | 9 | AWVLVFVYI | | 12915 |
| HPV18 | E5 | 30 | 8 | AYAWVLVF | | 12916 |
| HPV18 | E5 | 30 | 10 | AYAWVLVFVY | | 12917 |
| HPV18 | E5 | 30 | 11 | AYAWVLVFVYI | | 12918 |
| HPV18 | E5 | 56 | 8 | CFLLPMLL | | 12919 |
| HPV18 | E5 | 56 | 9 | CFLLPMLLL | | 12920 |
| HPV18 | E5 | 56 | 11 | CFLLPMLLLHI | | 12921 |
| HPV18 | E5 | 27 | 9 | CMCAYAWVL | | 12922 |
| HPV18 | E5 | 27 | 11 | CMCAYAWVLVF | | 12923 |
| HPV18 | E5 | 13 | 10 | CMYVCCHVPL | | 12924 |
| HPV18 | E5 | 13 | 11 | CMYVCCHVPLL | | 12925 |
| HPV18 | E5 | 6 | 9 | FLFCFCVCM | | 12926 |
| HPV18 | E5 | 6 | 10 | FLFCFCVCMY | | 12927 |
| HPV18 | E5 | 57 | 8 | FLLPMLLL | | 12928 |
| HPV18 | E5 | 57 | 10 | FLLPMLLLHI | | 12929 |
| HPV18 | E5 | 50 | 8 | FTVYVFCF | | 12930 |
| HPV18 | E5 | 50 | 9 | FTVYVFCFL | | 12931 |
| HPV18 | E5 | 50 | 10 | FTVYVFCFLL | | 12932 |
| HPV18 | E5 | 65 | 8 | HIHAILSL | | 12933 |
| HPV18 | E5 | 19 | 10 | HVPLLPSVCM | | 12934 |
| HPV18 | E5 | 5 | 10 | IFLFCFCVCM | | 12935 |
| HPV18 | E5 | 5 | 11 | IFLFCFCVCMY | | 12936 |
| HPV18 | E5 | 43 | 8 | ITSPATAF | | 12937 |
| HPV18 | E5 | 43 | 11 | ITSPATAFTVY | | 12938 |
| HPV18 | E5 | 40 | 11 | IVVITSPATAF | | 12939 |
| HPV18 | E5 | 7 | 8 | LFCFCVCM | | 12940 |
| HPV18 | E5 | 7 | 9 | LFCFCVCMY | | 12941 |
| HPV18 | E5 | 4 | 11 | LIFLFCFCVCM | | 12942 |
| HPV18 | E5 | 63 | 8 | LLHIHAIL | | 12943 |
| HPV18 | E5 | 63 | 10 | LLHIHAILSL | | 12944 |
| HPV18 | E5 | 62 | 8 | LLLHIHAI | | 12945 |
| HPV18 | E5 | 62 | 9 | LLLHIHAIL | | 12946 |
| HPV18 | E5 | 62 | 11 | LLLHIHAILSL | | 12947 |
| HPV18 | E5 | 58 | 9 | LLPMLLLHI | | 12948 |
| HPV18 | E5 | 22 | 10 | LLPSVCMCAY | | 12949 |
| HPV18 | E5 | 35 | 9 | LVFVYIVVI | | 12950 |
| HPV18 | E5 | 61 | 9 | MLLLHIHAI | | 12951 |
| HPV18 | E5 | 61 | 10 | MLLLHIHAIL | | 12952 |
| HPV18 | E5 | 1 | 8 | MLSLIFLF | | 12953 |
| HPV18 | E5 | 1 | 10 | MLSLIFLFCF | | 12954 |
| HPV18 | E5 | 14 | 9 | MYVCCHVPL | | 12955 |
| HPV18 | E5 | 14 | 10 | MYVCCHVPLL | | 12956 |
| HPV18 | E5 | 21 | 8 | PLLPSVCM | | 12957 |
| HPV18 | E5 | 21 | 11 | PLLPSVCMCAY | | 12958 |
| HPV18 | E5 | 60 | 10 | PMLLLHIHAI | | 12959 |
| HPV18 | E5 | 60 | 11 | PMLLLHIHAIL | | 12960 |
| HPV18 | E5 | 3 | 8 | SLIFLFCF | | 12961 |
| HPV18 | E5 | 25 | 9 | SVCMCAYAW | | 12962 |
| HPV18 | E5 | 25 | 11 | SVCMCAYAWVL | | 12963 |
| HPV18 | E5 | 51 | 8 | TVYVFCFL | | 12964 |
| HPV18 | E5 | 51 | 9 | TVYVFCFLL | | 12965 |
| HPV18 | E5 | 51 | 11 | TVYVFCFLLPM | | 12966 |
| HPV18 | E5 | 54 | 8 | VFCFLLPM | | 12967 |
| HPV18 | E5 | 54 | 9 | VFCFLLPML | | 12968 |
| HPV18 | E5 | 54 | 10 | VFCFLLPMLL | | 12969 |
| HPV18 | E5 | 54 | 11 | VFCFLLPMLLL | | 12970 |
| HPV18 | E5 | 36 | 8 | VFVYIVVI | | 12971 |
| HPV18 | E5 | 42 | 9 | VITSPATAF | | 12972 |
| HPV18 | E5 | 34 | 10 | VLVFVYIVVI | | 12973 |
| HPV18 | E5 | 41 | 10 | VVITSPATAF | | 12974 |
| HPV18 | E5 | 52 | 8 | VYVFCFLL | | 12975 |
| HPV18 | E5 | 52 | 10 | VYVFCFLLPM | | 12976 |
| HPV18 | E5 | 52 | 11 | VYVFCFLLPML | | 12977 |
| HPV18 | E5 | 33 | 8 | WVLVFVYI | | 12978 |
| HPV18 | E5 | 33 | 11 | WVLVFVYIVVI | | 12979 |
| HPV18 | E5 | 15 | 8 | YVCCHVPL | | 12980 |
| HPV18 | E5 | 15 | 9 | YVCCHVPLL | | 12981 |
| HPV18 | E5 | 53 | 9 | YVFCFLLPM | | 12982 |
| HPV18 | E5 | 53 | 10 | YVFCFLLPML | | 12983 |
| HPV18 | E5 | 53 | 11 | YVFCFLLPMLL | | 12984 |
| HPV18 | E6 | 48 | 9 | AFKDLFVVY | | 12985 |
| HPV18 | E6 | 68 | 8 | CIDFYSRI | | 12986 |
| HPV18 | E6 | 68 | 11 | CIDFYSRIREL | | 12987 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | E6 | 105 | 8 | CLRCQKPL | | 12988 |
| HPV18 | E6 | 18 | 8 | CTELNTSL | | 12989 |
| HPV18 | E6 | 18 | 11 | CTELNTSLQDI | | 12990 |
| HPV18 | E6 | 32 | 8 | CVYCKTVL | | 12991 |
| HPV18 | E6 | 32 | 10 | CVYCKTVLEL | | 12992 |
| HPV18 | E6 | 70 | 9 | DFYSRIREL | | 12993 |
| HPV18 | E6 | 27 | 8 | DIEITCVY | | 12994 |
| HPV18 | E6 | 16 | 10 | DLCTELNTSL | | 12995 |
| HPV18 | E6 | 51 | 10 | DLFVVYRDSI | | 12996 |
| HPV18 | E6 | 88 | 11 | DTLEKLTNTGL | | 12997 |
| HPV18 | E6 | 46 | 8 | EFAFKDLF | | 12998 |
| HPV18 | E6 | 46 | 11 | EFAFKDLFVVY | | 12999 |
| HPV18 | E6 | 29 | 11 | EITCVYCKTVL | | 13000 |
| HPV18 | E6 | 20 | 9 | ELNTSLQDI | | 13001 |
| HPV18 | E6 | 20 | 11 | ELNTSLQDIEI | | 13002 |
| HPV18 | E6 | 77 | 10 | ELRHYSDSVY | | 13003 |
| HPV18 | E6 | 40 | 8 | ELTEVFEF | | 13004 |
| HPV18 | E6 | 40 | 10 | ELTEVFEFAF | | 13005 |
| HPV18 | E6 | 43 | 10 | EVFEFAFKDL | | 13006 |
| HPV18 | E6 | 43 | 11 | EVFEFAFKDLF | | 13007 |
| HPV18 | E6 | 53 | 8 | FVVYRDSI | | 13008 |
| HPV18 | E6 | 71 | 8 | FYSRIREL | 0.026 | 13009 |
| HPV18 | E6 | 71 | 11 | FYSRIRELRHY | 0.0052 | 13010 |
| HPV18 | E6 | 97 | 10 | GLYNLLIRCL | | 13011 |
| HPV18 | E6 | 120 | 8 | HLNEKRRF | | 13012 |
| HPV18 | E6 | 120 | 11 | HLNEKRRFHNI | | 13013 |
| HPV18 | E6 | 80 | 11 | HYSDSVYGDTL | 0.0069 | 13014 |
| HPV18 | E6 | 30 | 10 | ITCVYCKTVL | | 13015 |
| HPV18 | E6 | 13 | 9 | KLPDLCTEL | 0.0013 | 13016 |
| HPV18 | E6 | 117 | 11 | KLRHLNEKRRF | | 13017 |
| HPV18 | E6 | 92 | 8 | KLTNTGLY | | 13018 |
| HPV18 | E6 | 92 | 10 | KLTNTGLYNL | 0.0001 | 13019 |
| HPV18 | E6 | 92 | 11 | KLTNTGLYNLL | | 13020 |
| HPV18 | E6 | 36 | 10 | KTVLELTEVF | | 13021 |
| HPV18 | E6 | 52 | 9 | LFVVYRDSI | | 13022 |
| HPV18 | E6 | 102 | 11 | LIRCLRCQKPL | | 13023 |
| HPV18 | E6 | 41 | 9 | LTEVFEFAF | | 13024 |
| HPV18 | E6 | 93 | 9 | LTNTGLYNL | | 13025 |
| HPV18 | E6 | 93 | 10 | LTNTGLYNLL | | 13026 |
| HPV18 | E6 | 93 | 11 | LTNTGLYNLLI | | 13027 |
| HPV18 | E6 | 98 | 9 | LYNLLIRCL | 0.0001 | 13028 |
| HPV18 | E6 | 95 | 8 | NTGLYNLL | | 13029 |
| HPV18 | E6 | 95 | 9 | NTGLYNLLI | | 13030 |
| HPV18 | E6 | 22 | 9 | NTSLQDIEI | | 13031 |
| HPV18 | E6 | 111 | 8 | PLNPAEKL | | 13032 |
| HPV18 | E6 | 111 | 11 | PLNPAEKLRHL | | 13033 |
| HPV18 | E6 | 7 | 8 | PTRRPYKL | | 13034 |
| HPV18 | E6 | 7 | 11 | PTRRPYKLPDL | | 13035 |
| HPV18 | E6 | 11 | 11 | PYKLPDLCTEL | 0.0064 | 13036 |
| HPV18 | E6 | 3 | 10 | RFEDPTRRPY | | 13037 |
| HPV18 | E6 | 126 | 9 | RFHNIAGHY | | 13038 |
| HPV18 | E6 | 74 | 8 | RIRELRHY | | 13039 |
| HPV18 | E6 | 59 | 11 | SIPHAACHKCI | | 13040 |
| HPV18 | E6 | 24 | 11 | SLQDIEITCVY | | 13041 |
| HPV18 | E6 | 84 | 10 | SVYGDTLEKL | | 13042 |
| HPV18 | E6 | 89 | 10 | TLEKLTNTGL | | 13043 |
| HPV18 | E6 | 89 | 11 | TLEKLTNTGLY | 0.0001 | 13044 |
| HPV18 | E6 | 37 | 9 | TVLELTEVF | | 13045 |
| HPV18 | E6 | 37 | 11 | TVLELTEVFEF | | 13046 |
| HPV18 | E6 | 44 | 9 | VFEFAFKDL | | 13047 |
| HPV18 | E6 | 44 | 10 | VFEFAFKDLF | 0.036 | 13048 |
| HPV18 | E6 | 38 | 8 | VLELTEVF | | 13049 |
| HPV18 | E6 | 38 | 10 | VLELTEVFEF | | 13050 |
| HPV18 | E6 | 33 | 9 | VYCKTVLEL | 0.022 | 13051 |
| HPV18 | E6 | 85 | 9 | VYGDTLEKL | 0.015 | 13052 |
| HPV18 | E7 | 85 | 10 | AFQQLFLNTL | | 13053 |
| HPV18 | E7 | 6 | 8 | ATLQDIVL | | 13054 |
| HPV18 | E7 | 6 | 10 | ATLQDIVLHL | | 13055 |
| HPV18 | E7 | 63 | 10 | CMCCKCEARI | 0.0001 | 13056 |
| HPV18 | E7 | 24 | 8 | DLLCHEQL | | 13057 |
| HPV18 | E7 | 82 | 8 | DLRAFQQL | | 13058 |
| HPV18 | E7 | 82 | 9 | DLRAFQQLF | | 13059 |
| HPV18 | E7 | 82 | 10 | DLRAFQQLFL | | 13060 |
| HPV18 | E7 | 40 | 10 | EIDGVNHQHL | | 13061 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | E7 | 90 | 11 | FLNTLSFVCPW | | 13062 |
| HPV18 | E7 | 14 | 8 | HLEPQNEI | | 13063 |
| HPV18 | E7 | 11 | 11 | IVLHLEPQNEI | | 13064 |
| HPV18 | E7 | 73 | 11 | KLVVESSADDL | | 13065 |
| HPV18 | E7 | 89 | 8 | LFLNTLSF | | 13066 |
| HPV18 | E7 | 74 | 10 | LVVESSADDL | | 13067 |
| HPV18 | E7 | 92 | 9 | NTLSFVCPW | | 13068 |
| HPV18 | E7 | 22 | 10 | PVDLLCHEQL | | 13069 |
| HPV18 | E7 | 88 | 9 | QLFLNTLSF | | 13070 |
| HPV18 | E7 | 7 | 9 | TLQDIVLHL | | 13071 |
| HPV18 | E7 | 93 | 8 | TLSFVCPW | | 13072 |
| HPV18 | E7 | 12 | 10 | VLHLEPQNEI | | 13073 |
| HPV18 | E7 | 75 | 9 | VVESSADDL | | 13074 |
| HPV18 | L1 | 63 | 11 | ALWRPSDNTVY | | 13075 |
| HPV18 | L1 | 128 | 11 | AYQYRVFRVQL | | 13076 |
| HPV18 | L1 | 218 | 9 | CILGCAPAI | | 13077 |
| HPV18 | L1 | 310 | 8 | CLRREQLF | | 13078 |
| HPV18 | L1 | 2 | 8 | CLYTRVLI | | 13079 |
| HPV18 | L1 | 2 | 9 | CLYTRVLIL | | 13080 |
| HPV18 | L1 | 2 | 11 | CLYTRVLILHY | | 13081 |
| HPV18 | L1 | 441 | 10 | CTITLTADVM | | 13082 |
| HPV18 | L1 | 350 | 11 | CVYSPSPSGSI | | 13083 |
| HPV18 | L1 | 284 | 9 | DICQSICKY | | 13084 |
| HPV18 | L1 | 122 | 8 | DIPKVSAY | | 13085 |
| HPV18 | L1 | 122 | 10 | DIPKVSAYQY | | 13086 |
| HPV18 | L1 | 520 | 11 | DLDQYPLGRKF | | 13087 |
| HPV18 | L1 | 512 | 8 | DLKEKFSL | | 13088 |
| HPV18 | L1 | 512 | 10 | DLKEKFSLDL | | 13089 |
| HPV18 | L1 | 433 | 8 | DLQFIFQL | | 13090 |
| HPV18 | L1 | 433 | 11 | DLQFIFQLCTI | | 13091 |
| HPV18 | L1 | 260 | 10 | DMVDTGYGAM | | 13092 |
| HPV18 | L1 | 263 | 9 | DTGYGAMDF | | 13093 |
| HPV18 | L1 | 276 | 8 | DTKCEVPL | | 13094 |
| HPV18 | L1 | 276 | 10 | DTKCEVPLDI | | 13095 |
| HPV18 | L1 | 396 | 8 | DTTPSTNL | | 13096 |
| HPV18 | L1 | 396 | 10 | DTTPSTNLTI | | 13097 |
| HPV18 | L1 | 330 | 8 | DTVPQSLY | | 13098 |
| HPV18 | L1 | 330 | 9 | DTVPQSLYI | | 13099 |
| HPV18 | L1 | 478 | 11 | DTYRFVQSVAI | | 13100 |
| HPV18 | L1 | 448 | 9 | DVMSYIHSM | | 13101 |
| HPV18 | L1 | 203 | 10 | DVRDNVSVDY | | 13102 |
| HPV18 | L1 | 211 | 9 | DYKQTQLCI | | 13103 |
| HPV18 | L1 | 211 | 10 | DYKQTQLCIL | | 13104 |
| HPV18 | L1 | 294 | 10 | DYLQMSADPY | | 13105 |
| HPV18 | L1 | 87 | 8 | DYVTPTSI | | 13106 |
| HPV18 | L1 | 87 | 9 | DYVTPTSIF | | 13107 |
| HPV18 | L1 | 87 | 10 | DYVTPTSIFY | | 13108 |
| HPV18 | L1 | 167 | 8 | EIGRGQPL | | 13109 |
| HPV18 | L1 | 280 | 10 | EVPLDICQSI | | 13110 |
| HPV18 | L1 | 431 | 8 | EYDLQFIF | | 13111 |
| HPV18 | L1 | 431 | 10 | EYDLQFIFQL | | 13112 |
| HPV18 | L1 | 308 | 9 | FFCLRREQL | | 13113 |
| HPV18 | L1 | 308 | 10 | FFCLRREQLF | | 13114 |
| HPV18 | L1 | 436 | 8 | FIFQLCTI | | 13115 |
| HPV18 | L1 | 436 | 10 | FIFQLCTITL | | 13116 |
| HPV18 | L1 | 49 | 8 | FLRNVNVF | | 13117 |
| HPV18 | L1 | 49 | 10 | FLRNVNVFPI | | 13118 |
| HPV18 | L1 | 49 | 11 | FLRNVNVFPIF | | 13119 |
| HPV18 | L1 | 321 | 8 | FWNRAGTM | | 13120 |
| HPV18 | L1 | 508 | 10 | FWNVDLKEKF | | 13121 |
| HPV18 | L1 | 95 | 9 | FYHAGSSRL | | 13122 |
| HPV18 | L1 | 95 | 10 | FYHAGSSRLL | | 13123 |
| HPV18 | L1 | 145 | 8 | GLPDTSIY | | 13124 |
| HPV18 | L1 | 535 | 8 | GLRRKPTI | | 13125 |
| HPV18 | L1 | 177 | 8 | GLSGHPFY | | 13126 |
| HPV18 | L1 | 177 | 11 | GLSGHPFYNKL | | 13127 |
| HPV18 | L1 | 342 | 11 | GMPASPGSCVY | | 13128 |
| HPV18 | L1 | 233 | 9 | GTACKSRPL | | 13129 |
| HPV18 | L1 | 326 | 11 | GTMGDTVPQSL | | 13130 |
| HPV18 | L1 | 383 | 8 | GVCWHNQL | | 13131 |
| HPV18 | L1 | 383 | 9 | GVCWHNQLF | | 13132 |
| HPV18 | L1 | 165 | 10 | GVEIGRGQPL | | 13133 |
| HPV18 | L1 | 175 | 9 | GVGLSGHPF | | 13134 |
| HPV18 | L1 | 175 | 10 | GVGLSGHPFY | | 13135 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | L1 | 467 | 10 | GVPPPPTTSL | | 13136 |
| HPV18 | L1 | 265 | 10 | GYGAMDFSTL | | 13137 |
| HPV18 | L1 | 320 | 9 | HFWNRAGTM | | 13138 |
| HPV18 | L1 | 38 | 8 | HIIICGHY | | 13139 |
| HPV18 | L1 | 38 | 9 | HIIICGHYI | | 13140 |
| HPV18 | L1 | 38 | 10 | HIIICGHYII | | 13141 |
| HPV18 | L1 | 38 | 11 | HIIICGHYIIL | | 13142 |
| HPV18 | L1 | 13 | 9 | HLLPLYGPL | | 13143 |
| HPV18 | L1 | 13 | 10 | HLLPLYGPLY | | 13144 |
| HPV18 | L1 | 428 | 9 | HVEEYDLQF | | 13145 |
| HPV18 | L1 | 428 | 10 | HVEEYDLQFI | | 13146 |
| HPV18 | L1 | 428 | 11 | HVEEYDLQFIF | | 13147 |
| HPV18 | L1 | 11 | 8 | HYHLLPLY | | 13148 |
| HPV18 | L1 | 11 | 11 | HYHLLPLYGPL | | 13149 |
| HPV18 | L1 | 58 | 8 | IFLQMALW | | 13150 |
| HPV18 | L1 | 437 | 9 | IFQLCTITL | | 13151 |
| HPV18 | L1 | 94 | 10 | IFYHAGSSRL | | 13152 |
| HPV18 | L1 | 94 | 11 | IFYHAGSSRLL | | 13153 |
| HPV18 | L1 | 40 | 8 | IICGHYII | | 13154 |
| HPV18 | L1 | 40 | 9 | IICGHYIIL | | 13155 |
| HPV18 | L1 | 40 | 10 | IICGHYIILF | | 13156 |
| HPV18 | L1 | 40 | 11 | IICGHYIILFL | | 13157 |
| HPV18 | L1 | 39 | 8 | IIICGHYI | | 13158 |
| HPV18 | L1 | 39 | 9 | IIICGHYII | | 13159 |
| HPV18 | L1 | 39 | 10 | IIICGHYIIL | | 13160 |
| HPV18 | L1 | 39 | 11 | IIICGHYIILF | | 13161 |
| HPV18 | L1 | 46 | 11 | IILFLRNVNVF | | 13162 |
| HPV18 | L1 | 47 | 10 | ILFLRNVNVF | | 13163 |
| HPV18 | L1 | 219 | 8 | ILGCAPAI | | 13164 |
| HPV18 | L1 | 9 | 9 | ILHYHLLPL | | 13165 |
| HPV18 | L1 | 9 | 10 | ILHYHLLPLY | | 13166 |
| HPV18 | L1 | 32 | 8 | ILVYMVHI | | 13167 |
| HPV18 | L1 | 32 | 9 | ILVYMVHII | | 13168 |
| HPV18 | L1 | 32 | 10 | ILVYMVHIII | | 13169 |
| HPV18 | L1 | 443 | 8 | ITLTADVM | | 13170 |
| HPV18 | L1 | 443 | 10 | ITLTADVMSY | | 13171 |
| HPV18 | L1 | 443 | 11 | ITLTADVMSYI | | 13172 |
| HPV18 | L1 | 360 | 8 | IVTSDSQL | | 13173 |
| HPV18 | L1 | 360 | 9 | IVTSDSQLF | | 13174 |
| HPV18 | L1 | 151 | 9 | IYNPETQRL | | 13175 |
| HPV18 | L1 | 151 | 11 | IYNPETQRLVW | | 13176 |
| HPV18 | L1 | 143 | 9 | KFGLPDTSI | | 13177 |
| HPV18 | L1 | 143 | 10 | KFGLPDTSIY | | 13178 |
| HPV18 | L1 | 529 | 8 | KFLVQAGL | | 13179 |
| HPV18 | L1 | 516 | 9 | KFSLDLDQY | | 13180 |
| HPV18 | L1 | 516 | 11 | KFSLDLDQYPL | | 13181 |
| HPV18 | L1 | 507 | 11 | KFWNVDLKEKF | | 13182 |
| HPV18 | L1 | 505 | 9 | KLKFWNVDL | | 13183 |
| HPV18 | L1 | 125 | 10 | KVSAYQYRVF | | 13184 |
| HPV18 | L1 | 291 | 8 | KYPDYLQM | | 13185 |
| HPV18 | L1 | 48 | 9 | LFLRNVNVF | | 13186 |
| HPV18 | L1 | 48 | 11 | LFLRNVNVFPI | | 13187 |
| HPV18 | L1 | 367 | 8 | LFNKPYWL | | 13188 |
| HPV18 | L1 | 8 | 8 | LILHYHLL | | 13189 |
| HPV18 | L1 | 8 | 10 | LILHYHLLPL | | 13190 |
| HPV18 | L1 | 8 | 11 | LILHYHLLPLY | | 13191 |
| HPV18 | L1 | 14 | 8 | LLPLYGPL | | 13192 |
| HPV18 | L1 | 14 | 9 | LLPLYGPLY | | 13193 |
| HPV18 | L1 | 103 | 8 | LLTVGNPY | | 13194 |
| HPV18 | L1 | 103 | 9 | LLTVGNPYF | | 13195 |
| HPV18 | L1 | 445 | 8 | LTADVMSY | | 13196 |
| HPV18 | L1 | 445 | 9 | LTADVMSYI | | 13197 |
| HPV18 | L1 | 104 | 8 | LTVGNPYF | | 13198 |
| HPV18 | L1 | 159 | 10 | LVWACAGVEI | | 13199 |
| HPV18 | L1 | 33 | 8 | LVYMVHII | | 13200 |
| HPV18 | L1 | 33 | 9 | LVYMVHIII | | 13201 |
| HPV18 | L1 | 64 | 10 | LWRPSDNTVY | | 13202 |
| HPV18 | L1 | 64 | 11 | LWRPSDNTVYL | | 13203 |
| HPV18 | L1 | 17 | 11 | LYGPLYHPRPL | | 13204 |
| HPV18 | L1 | 21 | 9 | LYHPRPLPL | | 13205 |
| HPV18 | L1 | 336 | 8 | LYIKGTGM | | 13206 |
| HPV18 | L1 | 3 | 8 | LYTRVLIL | | 13207 |
| HPV18 | L1 | 3 | 10 | LYTRVLILHY | | 13208 |
| HPV18 | L1 | 307 | 10 | MFFCLRREQL | | 13209 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | L1 | 307 | 11 | MFFCLRREQLF | | 13210 |
| HPV18 | L1 | 261 | 9 | MVDTGYGAM | | 13211 |
| HPV18 | L1 | 261 | 11 | MVDTGYGAMDF | | 13212 |
| HPV18 | L1 | 36 | 10 | MVHIIICGHY | | 13213 |
| HPV18 | L1 | 36 | 11 | MVHIIICGHYI | | 13214 |
| HPV18 | L1 | 84 | 11 | NTDDYVTPTSI | | 13215 |
| HPV18 | L1 | 253 | 9 | NTVLEDGDM | | 13216 |
| HPV18 | L1 | 510 | 8 | NVDLKEKF | | 13217 |
| HPV18 | L1 | 510 | 10 | NVDLKEKFSL | | 13218 |
| HPV18 | L1 | 54 | 9 | NVFPIFLQM | | 13219 |
| HPV18 | L1 | 54 | 11 | NVFPIFLQMAL | | 13220 |
| HPV18 | L1 | 52 | 8 | NVNVFPIF | | 13221 |
| HPV18 | L1 | 52 | 9 | NVNVFPIFL | | 13222 |
| HPV18 | L1 | 52 | 11 | NVNVFPIFLQM | | 13223 |
| HPV18 | L1 | 207 | 11 | NVSVDYKQTQL | | 13224 |
| HPV18 | L1 | 57 | 8 | PIFLQMAL | | 13225 |
| HPV18 | L1 | 57 | 9 | PIFLQMALW | | 13226 |
| HPV18 | L1 | 282 | 8 | PLDICQSI | | 13227 |
| HPV18 | L1 | 282 | 11 | PLDICQSICKY | | 13228 |
| HPV18 | L1 | 248 | 9 | PLELKNTVL | | 13229 |
| HPV18 | L1 | 173 | 11 | PLGVGLSGHPF | | 13230 |
| HPV18 | L1 | 28 | 8 | PLHSILVY | | 13231 |
| HPV18 | L1 | 28 | 9 | PLHSILVYM | | 13232 |
| HPV18 | L1 | 26 | 8 | PLPLHSIL | | 13233 |
| HPV18 | L1 | 26 | 10 | PLPLHSILVY | | 13234 |
| HPV18 | L1 | 26 | 11 | PLPLHSILVYM | | 13235 |
| HPV18 | L1 | 240 | 10 | PLSQGDCPPL | | 13236 |
| HPV18 | L1 | 20 | 8 | PLYHPRPL | | 13237 |
| HPV18 | L1 | 20 | 10 | PLYHPRPLPL | | 13238 |
| HPV18 | L1 | 472 | 9 | PTTSLVDTY | | 13239 |
| HPV18 | L1 | 472 | 11 | PTTSLVDTYRF | | 13240 |
| HPV18 | L1 | 412 | 11 | PVPGQYDATKF | | 13241 |
| HPV18 | L1 | 502 | 8 | PYDKLKFW | | 13242 |
| HPV18 | L1 | 302 | 8 | PYGDSMFF | | 13243 |
| HPV18 | L1 | 302 | 10 | PYGDSMFFCL | | 13244 |
| HPV18 | L1 | 435 | 9 | QFIFQLCTI | | 13245 |
| HPV18 | L1 | 435 | 11 | QFIFQLCTITL | | 13246 |
| HPV18 | L1 | 216 | 11 | QLCILGCAPAI | | 13247 |
| HPV18 | L1 | 315 | 8 | QLFARHFW | | 13248 |
| HPV18 | L1 | 366 | 8 | QLFNKPYW | | 13249 |
| HPV18 | L1 | 366 | 9 | QLFNKPYWL | | 13250 |
| HPV18 | L1 | 137 | 8 | QLPDPNKF | | 13251 |
| HPV18 | L1 | 137 | 10 | QLPDPNKFGL | | 13252 |
| HPV18 | L1 | 297 | 11 | QMSADPYGDSM | | 13253 |
| HPV18 | L1 | 416 | 10 | QYDATKFKQY | | 13254 |
| HPV18 | L1 | 523 | 8 | QYPLGRKF | | 13255 |
| HPV18 | L1 | 523 | 9 | QYPLGRKFL | | 13256 |
| HPV18 | L1 | 130 | 9 | QYRVFRVQL | | 13257 |
| HPV18 | L1 | 424 | 9 | QYSRHVEEY | | 13258 |
| HPV18 | L1 | 424 | 11 | QYSRHVEEYDL | | 13259 |
| HPV18 | L1 | 481 | 8 | RFVQSVAI | | 13260 |
| HPV18 | L1 | 102 | 9 | RLLTVGNPY | | 13261 |
| HPV18 | L1 | 102 | 10 | RLLTVGNPYF | | 13262 |
| HPV18 | L1 | 158 | 11 | RLVWACAGVEI | | 13263 |
| HPV18 | L1 | 6 | 9 | RVLILHYHL | | 13264 |
| HPV18 | L1 | 6 | 10 | RVLILHYHLL | | 13265 |
| HPV18 | L1 | 135 | 10 | RVQLPDPNKF | | 13266 |
| HPV18 | L1 | 81 | 8 | RVVNTDDY | | 13267 |
| HPV18 | L1 | 288 | 8 | SICKYPDY | | 13268 |
| HPV18 | L1 | 288 | 9 | SICKYPDYL | | 13269 |
| HPV18 | L1 | 288 | 11 | SICKYPDYLQM | | 13270 |
| HPV18 | L1 | 93 | 11 | SIFYHAGSSRL | | 13271 |
| HPV18 | L1 | 459 | 8 | SILEDWNF | | 13272 |
| HPV18 | L1 | 31 | 9 | SILVYMVHI | | 13273 |
| HPV18 | L1 | 31 | 10 | SILVYMVHII | | 13274 |
| HPV18 | L1 | 31 | 11 | SILVYMVHIII | | 13275 |
| HPV18 | L1 | 359 | 9 | SIVTSDSQL | | 13276 |
| HPV18 | L1 | 359 | 10 | SIVTSDSQLF | | 13277 |
| HPV18 | L1 | 150 | 10 | SIYNPETQRL | | 13278 |
| HPV18 | L1 | 518 | 9 | SLDLDQYPL | | 13279 |
| HPV18 | L1 | 475 | 8 | SLVDTYRF | | 13280 |
| HPV18 | L1 | 335 | 9 | SLYIKGTGM | | 13281 |
| HPV18 | L1 | 306 | 11 | SMFFCLRREQL | | 13282 |
| HPV18 | L1 | 455 | 10 | SMNSSILEDW | | 13283 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | L1 | 408 | 10 | STQSPVPGQY | | 13284 |
| HPV18 | L1 | 78 | 11 | SVARVVNTDDY | | 13285 |
| HPV18 | L1 | 209 | 9 | SVDYKQTQL | | 13286 |
| HPV18 | L1 | 209 | 11 | SVDYKQTQLCI | | 13287 |
| HPV18 | L1 | 451 | 10 | SYIHSMNSSI | | 13288 |
| HPV18 | L1 | 451 | 11 | SYIHSMNSSIL | | 13289 |
| HPV18 | L1 | 442 | 9 | TITLTADVM | | 13290 |
| HPV18 | L1 | 442 | 11 | TITLTADVMSY | | 13291 |
| HPV18 | L1 | 273 | 11 | TLQDTKCEVPL | | 13292 |
| HPV18 | L1 | 444 | 9 | TLTADVMSY | | 13293 |
| HPV18 | L1 | 444 | 10 | TLTADVMSYI | | 13294 |
| HPV18 | L1 | 327 | 10 | TMGDTVPQSL | | 13295 |
| HPV18 | L1 | 327 | 11 | TMGDTVPQSLY | | 13296 |
| HPV18 | L1 | 397 | 9 | TTPSTNLTI | | 13297 |
| HPV18 | L1 | 473 | 8 | TTSLVDTY | | 13298 |
| HPV18 | L1 | 473 | 10 | TTSLVDTYRF | | 13299 |
| HPV18 | L1 | 254 | 8 | TVLEDGDM | | 13300 |
| HPV18 | L1 | 331 | 8 | TVPQSLYI | | 13301 |
| HPV18 | L1 | 393 | 11 | TVVDTTPSTNL | | 13302 |
| HPV18 | L1 | 479 | 10 | TYRFVQSVAI | | 13303 |
| HPV18 | L1 | 55 | 8 | VFPIFLQM | | 13304 |
| HPV18 | L1 | 55 | 10 | VFPIFLQMAL | | 13305 |
| HPV18 | L1 | 55 | 11 | VFPIFLQMALW | | 13306 |
| HPV18 | L1 | 7 | 8 | VLILHYHL | | 13307 |
| HPV18 | L1 | 7 | 9 | VLILHYHLL | | 13308 |
| HPV18 | L1 | 7 | 11 | VLILHYHLLPL | | 13309 |
| HPV18 | L1 | 449 | 8 | VMSYIHSM | | 13310 |
| HPV18 | L1 | 89 | 8 | VTPTSIFY | | 13311 |
| HPV18 | L1 | 361 | 8 | VTSDSQLF | | 13312 |
| HPV18 | L1 | 394 | 10 | VVDTTPSTNL | | 13313 |
| HPV18 | L1 | 160 | 9 | VWACAGVEI | | 13314 |
| HPV18 | L1 | 34 | 8 | VYMVHIII | | 13315 |
| HPV18 | L1 | 351 | 10 | VYSPSPSGSI | | 13316 |
| HPV18 | L1 | 452 | 9 | YIHSMNSSI | | 13317 |
| HPV18 | L1 | 452 | 10 | YIHSMNSSIL | | 13318 |
| HPV18 | L1 | 295 | 9 | YLQMSADPY | | 13319 |
| HPV18 | L1 | 35 | 11 | YMVHIICGHY | | 13320 |
| HPV18 | L1 | 4 | 9 | YTRVLILHY | | 13321 |
| HPV18 | L1 | 4 | 11 | YTRVLILHYHL | | 13322 |
| HPV18 | L1 | 88 | 8 | YVTPTSIF | | 13323 |
| HPV18 | L1 | 88 | 9 | YVTPTSIFY | | 13324 |
| HPV18 | L2 | 255 | 9 | AFEPVDTTL | | 13325 |
| HPV18 | L2 | 255 | 11 | AFEPVDTTLTF | | 13326 |
| HPV18 | L2 | 370 | 9 | AFFKYSPTI | | 13327 |
| HPV18 | L2 | 161 | 8 | AFSDPSII | | 13328 |
| HPV18 | L2 | 286 | 11 | ALTSRRGTVRF | | 13329 |
| HPV18 | L2 | 341 | 8 | ATEDNDLF | | 13330 |
| HPV18 | L2 | 341 | 10 | ATEDNDLFDI | | 13331 |
| HPV18 | L2 | 341 | 11 | ATEDNDLFDIY | | 13332 |
| HPV18 | L2 | 303 | 11 | ATMFTRSGTQI | | 13333 |
| HPV18 | L2 | 275 | 8 | DFMDIIRL | | 13334 |
| HPV18 | L2 | 278 | 10 | DIIRLHRPAL | | 13335 |
| HPV18 | L2 | 322 | 11 | DISPIAPSPEY | | 13336 |
| HPV18 | L2 | 404 | 11 | DITLPSTTSVW | | 13337 |
| HPV18 | L2 | 142 | 11 | DITPSSTSVSI | | 13338 |
| HPV18 | L2 | 346 | 10 | DLFDIYADDM | | 13339 |
| HPV18 | L2 | 83 | 11 | DVGPTRPPVVI | | 13340 |
| HPV18 | L2 | 270 | 8 | DVPDSDFM | | 13341 |
| HPV18 | L2 | 270 | 10 | DVPDSDFMDI | | 13342 |
| HPV18 | L2 | 270 | 11 | DVPDSDFMDII | | 13343 |
| HPV18 | L2 | 396 | 10 | DVPVYTGPDI | | 13344 |
| HPV18 | L2 | 30 | 11 | DVVPKVEGTTL | | 13345 |
| HPV18 | L2 | 240 | 9 | EFLTRPSSL | | 13346 |
| HPV18 | L2 | 240 | 10 | EFLTRPSSLI | | 13347 |
| HPV18 | L2 | 331 | 8 | EYIELQPL | | 13348 |
| HPV18 | L2 | 371 | 8 | FFKYSPTI | | 13349 |
| HPV18 | L2 | 443 | 11 | FIPKKRKRVPY | | 13350 |
| HPV18 | L2 | 241 | 8 | FLTRPSSL | | 13351 |
| HPV18 | L2 | 241 | 9 | FLTRPSSLI | | 13352 |
| HPV18 | L2 | 241 | 11 | FLTRPSSLITY | | 13353 |
| HPV18 | L2 | 122 | 9 | FTGTSGFDI | | 13354 |
| HPV18 | L2 | 157 | 11 | FTNPAFSDPSI | | 13355 |
| HPV18 | L2 | 306 | 8 | FTRSGTQI | | 13356 |
| HPV18 | L2 | 319 | 8 | FYHDISPI | | 13357 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | L2 | 51 | 9 | GIFLGGLGI | | 13358 |
| HPV18 | L2 | 429 | 8 | GIHGTHYY | | 13359 |
| HPV18 | L2 | 429 | 9 | GIHGTHYYL | | 13360 |
| HPV18 | L2 | 429 | 10 | GIHGTHYYLW | | 13361 |
| HPV18 | L2 | 64 | 8 | GTGGRTGY | | 13362 |
| HPV18 | L2 | 64 | 9 | GTGGRTGYI | | 13363 |
| HPV18 | L2 | 64 | 11 | GTGGRTGYIPL | | 13364 |
| HPV18 | L2 | 188 | 8 | GTHGYEEI | | 13365 |
| HPV18 | L2 | 188 | 10 | GTHGYEEIPL | | 13366 |
| HPV18 | L2 | 432 | 9 | GTHYYLWPL | | 13367 |
| HPV18 | L2 | 432 | 10 | GTHYYLWPLY | | 13368 |
| HPV18 | L2 | 432 | 11 | GTHYYLWPLYY | | 13369 |
| HPV18 | L2 | 183 | 10 | GTPTSGTHGY | | 13370 |
| HPV18 | L2 | 310 | 10 | GTQIGARVHF | | 13371 |
| HPV18 | L2 | 310 | 11 | GTQIGARVHFY | | 13372 |
| HPV18 | L2 | 37 | 8 | GTTLADKI | | 13373 |
| HPV18 | L2 | 37 | 9 | GTTLADKIL | | 13374 |
| HPV18 | L2 | 37 | 11 | GTTLADKILQW | | 13375 |
| HPV18 | L2 | 134 | 8 | GTTTPAVL | | 13376 |
| HPV18 | L2 | 134 | 10 | GTTTPAVLDI | | 13377 |
| HPV18 | L2 | 292 | 8 | GTVRFSRL | | 13378 |
| HPV18 | L2 | 191 | 10 | GYEEIPLQTF | | 13379 |
| HPV18 | L2 | 318 | 9 | HFYHDISPI | | 13380 |
| HPV18 | L2 | 434 | 8 | HYYLWPLY | | 13381 |
| HPV18 | L2 | 434 | 9 | HYYLWPLYY | | 13382 |
| HPV18 | L2 | 434 | 10 | HYYLWPLYYF | | 13383 |
| HPV18 | L2 | 434 | 11 | HYYLWPLYYFI | | 13384 |
| HPV18 | L2 | 52 | 8 | IFLGGLGI | | 13385 |
| HPV18 | L2 | 279 | 9 | IIRLHRPAL | | 13386 |
| HPV18 | L2 | 44 | 9 | ILQWSSLGI | | 13387 |
| HPV18 | L2 | 44 | 10 | ILQWSSLGIF | | 13388 |
| HPV18 | L2 | 44 | 11 | ILQWSSLGIFL | | 13389 |
| HPV18 | L2 | 405 | 10 | ITLPSTTSVW | | 13390 |
| HPV18 | L2 | 143 | 10 | ITPSSTSVSI | | 13391 |
| HPV18 | L2 | 249 | 8 | ITYDNPAF | | 13392 |
| HPV18 | L2 | 43 | 8 | KILQWSSL | | 13393 |
| HPV18 | L2 | 43 | 10 | KILQWSSLGI | | 13394 |
| HPV18 | L2 | 43 | 11 | KILQWSSLGIF | | 13395 |
| HPV18 | L2 | 34 | 11 | KVEGTTLADKI | | 13396 |
| HPV18 | L2 | 347 | 9 | LFDIYADDM | | 13397 |
| HPV18 | L2 | 248 | 9 | LITYDNPAF | | 13398 |
| HPV18 | L2 | 242 | 8 | LTRPSSLI | | 13399 |
| HPV18 | L2 | 242 | 10 | LTRPSSLITY | | 13400 |
| HPV18 | L2 | 287 | 10 | LTSRRGTVRF | | 13401 |
| HPV18 | L2 | 391 | 10 | LTSSWDVPVY | | 13402 |
| HPV18 | L2 | 338 | 10 | LVSATEDNDL | | 13403 |
| HPV18 | L2 | 338 | 11 | LVSATEDNDLF | | 13404 |
| HPV18 | L2 | 437 | 8 | LWPLYYFI | | 13405 |
| HPV18 | L2 | 305 | 9 | MFTRSGTQI | | 13406 |
| HPV18 | L2 | 386 | 10 | NVTVPLTSSW | | 13407 |
| HPV18 | L2 | 325 | 8 | PIAPSPEY | | 13408 |
| HPV18 | L2 | 325 | 9 | PIAPSPEYI | | 13409 |
| HPV18 | L2 | 325 | 11 | PIAPSPEYIEL | | 13410 |
| HPV18 | L2 | 390 | 11 | PLTSSWDVPVY | | 13411 |
| HPV18 | L2 | 337 | 11 | PLVSATEDNDL | | 13412 |
| HPV18 | L2 | 419 | 9 | PTAPASTQY | | 13413 |
| HPV18 | L2 | 419 | 10 | PTAPASTQYI | | 13414 |
| HPV18 | L2 | 98 | 9 | PTDPSIVTL | | 13415 |
| HPV18 | L2 | 98 | 10 | PTDPSIVTLI | | 13416 |
| HPV18 | L2 | 120 | 9 | PTFTGTSGF | | 13417 |
| HPV18 | L2 | 120 | 11 | PTFTGTSGFDI | | 13418 |
| HPV18 | L2 | 376 | 9 | PTISSASSY | | 13419 |
| HPV18 | L2 | 86 | 8 | PTRPPVVI | | 13420 |
| HPV18 | L2 | 185 | 8 | PTSGTHGY | | 13421 |
| HPV18 | L2 | 185 | 11 | PTSGTHGYEEI | | 13422 |
| HPV18 | L2 | 216 | 11 | PTVRRVAGPRL | | 13423 |
| HPV18 | L2 | 258 | 8 | PVDTTLTF | | 13424 |
| HPV18 | L2 | 95 | 9 | PVGPTDPSI | | 13425 |
| HPV18 | L2 | 360 | 10 | PVPSRSTTSF | | 13426 |
| HPV18 | L2 | 398 | 8 | PVYTGPDI | | 13427 |
| HPV18 | L2 | 398 | 10 | PVYTGPDITL | | 13428 |
| HPV18 | L2 | 452 | 8 | PYFFADGF | | 13429 |
| HPV18 | L2 | 312 | 8 | QIGARVHF | | 13430 |
| HPV18 | L2 | 312 | 9 | QIGARVHFY | | 13431 |

TABLE X-continued

A24 Supermotif Peptides

| Type | Protein | Position | No. of Amino Acids | Sequence | A*2402 | Seq. Id. No. |
|---|---|---|---|---|---|---|
| HPV18 | L2 | 172 | 10 | QTGEVAGNVF | | 13432 |
| HPV18 | L2 | 233 | 9 | QVSVANPEF | | 13433 |
| HPV18 | L2 | 233 | 10 | QVSVANPEFL | | 13434 |
| HPV18 | L2 | 46 | 8 | QWSSLGIF | | 13435 |
| HPV18 | L2 | 46 | 9 | QWSSLGIFL | | 13436 |
| HPV18 | L2 | 426 | 10 | QYIGIHGTHY | | 13437 |
| HPV18 | L2 | 426 | 11 | QYIGIHGTHYY | | 13438 |
| HPV18 | L2 | 295 | 11 | RFSRLGQRATM | | 13439 |
| HPV18 | L2 | 298 | 8 | RLGQRATM | | 13440 |
| HPV18 | L2 | 298 | 9 | RLGQRATMF | | 13441 |
| HPV18 | L2 | 220 | 8 | RVAGPRLY | | 13442 |
| HPV18 | L2 | 316 | 8 | RVHFYHDI | | 13443 |
| HPV18 | L2 | 316 | 11 | RVHFYHDISPI | | 13444 |
| HPV18 | L2 | 450 | 10 | RVPYFFADGF | | 13445 |
| HPV18 | L2 | 368 | 11 | SFAFKYSPTI | | 13446 |
| HPV18 | L2 | 49 | 9 | SLGIFLGGL | | 13447 |
| HPV18 | L2 | 49 | 11 | SLGIFLGGLGI | | 13448 |
| HPV18 | L2 | 247 | 10 | SLITYDNPAF | | 13449 |
| HPV18 | L2 | 147 | 11 | STSVSISTTNF | | 13450 |
| HPV18 | L2 | 153 | 10 | STTNFTNPAF | | 13451 |
| HPV18 | L2 | 365 | 8 | STTSFAFF | | 13452 |
| HPV18 | L2 | 365 | 10 | STTSFAFFKY | | 13453 |
| HPV18 | L2 | 409 | 8 | STTSVWPI | | 13454 |
| HPV18 | L2 | 235 | 8 | SVANPEFL | | 13455 |
| HPV18 | L2 | 149 | 9 | SVSISTTNF | | 13456 |
| HPV18 | L2 | 383 | 9 | SYSNVTVPL | | 13457 |
| HPV18 | L2 | 121 | 8 | TFTGTSGF | | 13458 |
| HPV18 | L2 | 121 | 10 | TFTGTSGFDI | | 13459 |
| HPV18 | L2 | 377 | 8 | TISSASSY | | 13460 |
| HPV18 | L2 | 39 | 9 | TLADKILQW | | 13461 |
| HPV18 | L2 | 406 | 9 | TLPSTTSVW | | 13462 |
| HPV18 | L2 | 406 | 11 | TLPSTTSVWPI | | 13463 |
| HPV18 | L2 | 304 | 10 | TMFTRSGTQI | | 13464 |
| HPV18 | L2 | 38 | 8 | TTLADKIL | | 13465 |
| HPV18 | L2 | 38 | 10 | TTLADKILQW | | 13466 |
| HPV18 | L2 | 154 | 9 | TTNFTNPAF | | 13467 |
| HPV18 | L2 | 136 | 8 | TTPAVLDI | | 13468 |
| HPV18 | L2 | 366 | 9 | TTSFAFFKY | | 13469 |
| HPV18 | L2 | 135 | 9 | TTTPAVLDI | | 13470 |
| HPV18 | L2 | 388 | 8 | TVPLTSSW | | 13471 |
| HPV18 | L2 | 217 | 10 | TVRRVAGPRL | | 13472 |
| HPV18 | L2 | 217 | 11 | TVRRVAGPRLY | | 13473 |
| HPV18 | L2 | 113 | 10 | VTSGAPRPTF | | 13474 |
| HPV18 | L2 | 387 | 9 | VTVPLTSSW | | 13475 |
| HPV18 | L2 | 31 | 10 | VVPKVEGTTL | | 13476 |
| HPV18 | L2 | 112 | 11 | VVTSGAPRPTF | | 13477 |
| HPV18 | L2 | 399 | 9 | VYTGPDITL | | 13478 |
| HPV18 | L2 | 427 | 9 | YIGIHGTHY | | 13479 |
| HPV18 | L2 | 427 | 10 | YIGIHGTHYY | | 13480 |
| HPV18 | L2 | 427 | 11 | YIGIHGTHYYL | | 13481 |
| HPV18 | L2 | 436 | 8 | YLWPLYYF | | 13482 |
| HPV18 | L2 | 436 | 9 | YLWPLYYFI | | 13483 |
| HPV18 | L2 | 400 | 8 | YTGPDITL | | 13484 |
| HPV18 | L2 | 435 | 8 | YYLWPLYY | | 13485 |
| HPV18 | L2 | 435 | 9 | YYLWPLYYF | | 13486 |
| HPV18 | L2 | 435 | 10 | YYLWPLYYFI | | 13487 |
| HPV31 | E1 | 371 | 11 | AFLKSNSQAKI | | 13488 |
| HPV31 | E1 | 519 | 9 | ALDGNPVSI | | 13489 |
| HPV31 | E1 | 533 | 10 | ALMQLKCPPL | | 13490 |
| HPV31 | E1 | 533 | 11 | ALMQLKCPPLL | | 13491 |
| HPV31 | E1 | 298 | 9 | ALYWYRTGM | | 13492 |
| HPV31 | E1 | 186 | 9 | AMLGKFKEL | | 13493 |
| HPV31 | E1 | 186 | 10 | AMLGKFKELY | | 13494 |
| HPV31 | E1 | 504 | 8 | ATTPCWHY | | 13495 |
| HPV31 | E1 | 504 | 9 | ATTPCWHYI | | 13496 |
| HPV31 | E1 | 22 | 11 | AVIDRQTGDNI | | 13497 |
| HPV31 | E1 | 81 | 9 | AVQVLKRKY | | 13498 |
| HPV31 | E1 | 279 | 8 | CISTNCML | | 13499 |
| HPV31 | E1 | 279 | 9 | CISTNCMLI | | 13500 |
| HPV31 | E1 | 239 | 9 | CLYCHLQSL | | 13501 |
| HPV31 | E1 | 284 | 9 | CMLIQPPKL | | 13502 |
| HPV31 | E1 | 213 | 9 | CTDWCVAAF | | 13503 |
| HPV31 | E1 | 100 | 10 | CVDYNISPRL | | 13504 |
| HPV31 | E1 | 620 | 10 | CVSGQNIRTL | | 13505 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | E1 | 508 | 8 | CWHYIDNY | | 13506 |
| HPV31 | E1 | 508 | 9 | CWHYIDNYL | | 13507 |
| HPV31 | E1 | 49 | 9 | DFIDNCNVY | | 13508 |
| HPV31 | E1 | 96 | 8 | DISSCVDY | | 13509 |
| HPV31 | E1 | 96 | 10 | DISSCVDYNI | | 13510 |
| HPV31 | E1 | 421 | 8 | DIVKFLRY | | 13511 |
| HPV31 | E1 | 421 | 11 | DIVKFLRYQQI | | 13512 |
| HPV31 | E1 | 336 | 8 | DLSQMVQW | | 13513 |
| HPV31 | E1 | 336 | 10 | DLSQMVQWAY | | 13514 |
| HPV31 | E1 | 42 | 9 | DTGEDMVDF | | 13515 |
| HPV31 | E1 | 42 | 10 | DTGEDMVDFI | | 13516 |
| HPV31 | E1 | 332 | 9 | DTTFDLSQM | | 13517 |
| HPV31 | E1 | 528 | 8 | DVKHKALM | | 13518 |
| HPV31 | E1 | 528 | 10 | DVKHKALMQL | | 13519 |
| HPV31 | E1 | 348 | 8 | DVMDDSEI | | 13520 |
| HPV31 | E1 | 348 | 10 | DVMDDSEIAY | | 13521 |
| HPV31 | E1 | 311 | 9 | DVYGETPEW | | 13522 |
| HPV31 | E1 | 311 | 10 | DVYGETPEWI | | 13523 |
| HPV31 | E1 | 418 | 8 | DWRDIVKF | | 13524 |
| HPV31 | E1 | 418 | 9 | DWRDIVKFL | | 13525 |
| HPV31 | E1 | 418 | 11 | DWRDIVKFLRY | | 13526 |
| HPV31 | E1 | 102 | 8 | DYNISPRL | | 13527 |
| HPV31 | E1 | 102 | 11 | DYNISPRLKAI | | 13528 |
| HPV31 | E1 | 432 | 9 | EFVSFLSAL | | 13529 |
| HPV31 | E1 | 432 | 11 | EFVSFLSALKL | | 13530 |
| HPV31 | E1 | 354 | 9 | EIAYKYAQL | | 13531 |
| HPV31 | E1 | 583 | 10 | ELSDKNWKSF | | 13532 |
| HPV31 | E1 | 583 | 11 | ELSDKNWKSFF | | 13533 |
| HPV31 | E1 | 193 | 8 | ELYGVSFM | | 13534 |
| HPV31 | E1 | 193 | 10 | ELYGVSFMEL | | 13535 |
| HPV31 | E1 | 193 | 11 | ELYGVSFMELI | | 13536 |
| HPV31 | E1 | 168 | 8 | ETPTRNIL | | 13537 |
| HPV31 | E1 | 168 | 11 | ETPTRNILQVL | | 13538 |
| HPV31 | E1 | 318 | 9 | EWIERQTVL | | 13539 |
| HPV31 | E1 | 592 | 9 | FFSRTWCRL | | 13540 |
| HPV31 | E1 | 592 | 11 | FFSRTWCRLNL | | 13541 |
| HPV31 | E1 | 50 | 8 | FIDNCNVY | | 13542 |
| HPV31 | E1 | 443 | 11 | FLKGVPKKNCI | | 13543 |
| HPV31 | E1 | 372 | 10 | FLKSNSQAKI | | 13544 |
| HPV31 | E1 | 473 | 9 | FLQGCIISY | | 13545 |
| HPV31 | E1 | 425 | 9 | FLRYQQIEF | | 13546 |
| HPV31 | E1 | 436 | 8 | FLSALKLF | | 13547 |
| HPV31 | E1 | 436 | 9 | FLSALKLFL | | 13548 |
| HPV31 | E1 | 199 | 8 | FMELIRPF | | 13549 |
| HPV31 | E1 | 566 | 9 | FTFPNPFPF | | 13550 |
| HPV31 | E1 | 433 | 8 | FVSFLSAL | | 13551 |
| HPV31 | E1 | 433 | 10 | FVSFLSALKL | | 13552 |
| HPV31 | E1 | 433 | 11 | FVSFLSALKLF | | 13553 |
| HPV31 | E1 | 488 | 11 | FWLQPLADAKI | | 13554 |
| HPV31 | E1 | 230 | 9 | GFKTLLQPY | | 13555 |
| HPV31 | E1 | 230 | 11 | GFKTLLQPYCL | | 13556 |
| HPV31 | E1 | 499 | 11 | GMLDDATTPCW | | 13557 |
| HPV31 | E1 | 467 | 8 | GMSLISFL | | 13558 |
| HPV31 | E1 | 305 | 9 | GMSNISDVY | | 13559 |
| HPV31 | E1 | 252 | 10 | GMVMLMLVRF | | 13560 |
| HPV31 | E1 | 11 | 8 | GTGCNGWF | | 13561 |
| HPV31 | E1 | 11 | 9 | GTGCNGWFY | | 13562 |
| HPV31 | E1 | 225 | 10 | GTVAEGFKTL | | 13563 |
| HPV31 | E1 | 225 | 11 | GTVAEGFKTLL | | 13564 |
| HPV31 | E1 | 446 | 8 | GVPKKNCI | | 13565 |
| HPV31 | E1 | 446 | 9 | GVPKKNCIL | | 13566 |
| HPV31 | E1 | 446 | 10 | GVPKKNCILI | | 13567 |
| HPV31 | E1 | 196 | 8 | GVSFMELI | | 13568 |
| HPV31 | E1 | 196 | 11 | GVSFMELIRPF | | 13569 |
| HPV31 | E1 | 222 | 10 | GVTGTVAEGF | | 13570 |
| HPV31 | E1 | 16 | 9 | GWFYVEAVI | | 13571 |
| HPV31 | E1 | 243 | 9 | HLQSLACSW | | 13572 |
| HPV31 | E1 | 243 | 11 | HLQSLACSWGM | | 13573 |
| HPV31 | E1 | 510 | 11 | HYIDNYLRNAL | | 13574 |
| HPV31 | E1 | 391 | 10 | HYKRAEKRQM | | 13575 |
| HPV31 | E1 | 478 | 11 | IISYANSKSHF | | 13576 |
| HPV31 | E1 | 268 | 10 | ITIEKLLEKL | | 13577 |
| HPV31 | E1 | 268 | 11 | ITIEKLLEKLL | | 13578 |
| HPV31 | E1 | 381 | 8 | IVKDCGTM | | 13579 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | E1 | 422 | 10 | IVKFLRYQQI | | 13580 |
| HPV31 | E1 | 190 | 10 | KFKELYGVSF | | 13581 |
| HPV31 | E1 | 190 | 11 | KFKELYGVSFM | | 13582 |
| HPV31 | E1 | 424 | 8 | KFLRYQQI | | 13583 |
| HPV31 | E1 | 424 | 10 | KFLRYQQIEF | | 13584 |
| HPV31 | E1 | 380 | 9 | KIVKDCGTM | | 13585 |
| HPV31 | E1 | 276 | 10 | KLLCISTNCM | | 13586 |
| HPV31 | E1 | 276 | 11 | KLLCISTNCML | | 13587 |
| HPV31 | E1 | 272 | 9 | KLLEKLLCI | | 13588 |
| HPV31 | E1 | 291 | 9 | KLRSTAAAL | | 13589 |
| HPV31 | E1 | 291 | 10 | KLRSTAAALY | | 13590 |
| HPV31 | E1 | 291 | 11 | KLRSTAAALYW | | 13591 |
| HPV31 | E1 | 119 | 8 | KTAKRRLF | | 13592 |
| HPV31 | E1 | 119 | 10 | KTAKRRLFEL | | 13593 |
| HPV31 | E1 | 232 | 9 | KTLLQPYCL | | 13594 |
| HPV31 | E1 | 232 | 10 | KTLLQPYCLY | | 13595 |
| HPV31 | E1 | 179 | 9 | KTSNGKAAM | | 13596 |
| HPV31 | E1 | 179 | 10 | KTSNGKAAML | | 13597 |
| HPV31 | E1 | 412 | 8 | KVSDEGDW | | 13598 |
| HPV31 | E1 | 412 | 11 | KVSDEGDWRDI | | 13599 |
| HPV31 | E1 | 88 | 10 | KYVGSPLSDI | | 13600 |
| HPV31 | E1 | 125 | 9 | LFELPDSGY | | 13601 |
| HPV31 | E1 | 470 | 9 | LISFLQGCI | | 13602 |
| HPV31 | E1 | 470 | 10 | LISFLQGCII | | 13603 |
| HPV31 | E1 | 277 | 9 | LLCISTNCM | | 13604 |
| HPV31 | E1 | 277 | 10 | LLCISTNCML | | 13605 |
| HPV31 | E1 | 277 | 11 | LLCISTNCMLI | | 13606 |
| HPV31 | E1 | 273 | 8 | LLEKLLCI | | 13607 |
| HPV31 | E1 | 234 | 8 | LLQPYCLY | | 13608 |
| HPV31 | E1 | 234 | 11 | LLQPYCLYCHL | | 13609 |
| HPV31 | E1 | 534 | 9 | LMQLKCPPL | | 13610 |
| HPV31 | E1 | 534 | 10 | LMQLKCPPLL | | 13611 |
| HPV31 | E1 | 534 | 11 | LMQLKCPPLLI | | 13612 |
| HPV31 | E1 | 258 | 11 | LVRFKCAKNRI | | 13613 |
| HPV31 | E1 | 563 | 10 | LVVFTFPNPF | | 13614 |
| HPV31 | E1 | 240 | 8 | LYCHLQSL | | 13615 |
| HPV31 | E1 | 194 | 9 | LYGVSFMEL | | 13616 |
| HPV31 | E1 | 194 | 10 | LYGVSFMELI | | 13617 |
| HPV31 | E1 | 299 | 8 | LYWYRTGM | | 13618 |
| HPV31 | E1 | 299 | 11 | LYWYRTGMSNI | | 13619 |
| HPV31 | E1 | 500 | 10 | MLDDATTPCW | | 13620 |
| HPV31 | E1 | 187 | 8 | MLGKFKEL | | 13621 |
| HPV31 | E1 | 187 | 9 | MLGKFKELY | | 13622 |
| HPV31 | E1 | 285 | 8 | MLIQPPKL | | 13623 |
| HPV31 | E1 | 47 | 11 | MVDFIDNCNVY | | 13624 |
| HPV31 | E1 | 253 | 9 | MVMLMLVRF | | 13625 |
| HPV31 | E1 | 143 | 11 | MVQVEEQQTTL | | 13626 |
| HPV31 | E1 | 340 | 11 | MVQWAYDNDVM | | 13627 |
| HPV31 | E1 | 547 | 10 | NINAGKDDRW | | 13628 |
| HPV31 | E1 | 104 | 9 | NISPRLKAI | | 13629 |
| HPV31 | E1 | 104 | 11 | NISPRLKAICI | | 13630 |
| HPV31 | E1 | 135 | 9 | NTEVETQQM | | 13631 |
| HPV31 | E1 | 460 | 9 | NTGKSYFGM | | 13632 |
| HPV31 | E1 | 460 | 11 | NTGKSYFGMSL | | 13633 |
| HPV31 | E1 | 588 | 10 | NWKSFFSRTW | | 13634 |
| HPV31 | E1 | 573 | 10 | PFDKNGNPVY | | 13635 |
| HPV31 | E1 | 492 | 9 | PLADAKIGM | | 13636 |
| HPV31 | E1 | 492 | 10 | PLADAKIGML | | 13637 |
| HPV31 | E1 | 541 | 8 | PLLITSNI | | 13638 |
| HPV31 | E1 | 93 | 11 | PLSDISSCVDY | | 13639 |
| HPV31 | E1 | 170 | 9 | PTRNILQVL | | 13640 |
| HPV31 | E1 | 524 | 11 | PVSIDVKHKAL | | 13641 |
| HPV31 | E1 | 580 | 10 | PVYELSDKNW | | 13642 |
| HPV31 | E1 | 237 | 8 | PYCLYCHL | | 13643 |
| HPV31 | E1 | 237 | 11 | PYCLYCHLQSL | | 13644 |
| HPV31 | E1 | 557 | 10 | PYLHSRLVVF | | 13645 |
| HPV31 | E1 | 430 | 8 | QIEFVSFL | | 13646 |
| HPV31 | E1 | 430 | 11 | QIEFVSFLSAL | | 13647 |
| HPV31 | E1 | 536 | 8 | QLKCPPLL | | 13648 |
| HPV31 | E1 | 536 | 9 | QLKCPPLLI | | 13649 |
| HPV31 | E1 | 399 | 8 | QMSMGQWI | | 13650 |
| HPV31 | E1 | 323 | 8 | QTVLQHSF | | 13651 |
| HPV31 | E1 | 145 | 9 | QVEEQQTTL | | 13652 |
| HPV31 | E1 | 342 | 9 | QWAYDNDVM | | 13653 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | E1 | 260 | 9 | RFKCAKNRI | | 13654 |
| HPV31 | E1 | 260 | 11 | RFKCAKNRITI | | 13655 |
| HPV31 | E1 | 267 | 8 | RITIEKLL | | 13656 |
| HPV31 | E1 | 267 | 11 | RITIEKLLEKL | | 13657 |
| HPV31 | E1 | 124 | 10 | RLFELPDSGY | | 13658 |
| HPV31 | E1 | 562 | 11 | RLVVFTFPNPF | | 13659 |
| HPV31 | E1 | 303 | 11 | RTGMSNISDVY | | 13660 |
| HPV31 | E1 | 595 | 8 | RTWCRLNL | | 13661 |
| HPV31 | E1 | 555 | 9 | RWPYLHSRL | | 13662 |
| HPV31 | E1 | 427 | 10 | RYQQIEFVSF | | 13663 |
| HPV31 | E1 | 427 | 11 | RYQQIEFVSFL | | 13664 |
| HPV31 | E1 | 591 | 10 | SFFSRTWCRL | | 13665 |
| HPV31 | E1 | 472 | 8 | SFLQGCII | | 13666 |
| HPV31 | E1 | 472 | 10 | SFLQGCIISY | | 13667 |
| HPV31 | E1 | 435 | 8 | SFLSALKL | | 13668 |
| HPV31 | E1 | 435 | 9 | SFLSALKLF | | 13669 |
| HPV31 | E1 | 435 | 10 | SFLSALKLFL | | 13670 |
| HPV31 | E1 | 198 | 9 | SFMELIRPF | | 13671 |
| HPV31 | E1 | 329 | 9 | SFNDTTFDL | | 13672 |
| HPV31 | E1 | 526 | 9 | SIDVKHKAL | | 13673 |
| HPV31 | E1 | 526 | 10 | SIDVKHKALM | | 13674 |
| HPV31 | E1 | 246 | 8 | SLACSWGM | | 13675 |
| HPV31 | E1 | 246 | 10 | SLACSWGMVM | | 13676 |
| HPV31 | E1 | 246 | 11 | SLACSWGMVML | | 13677 |
| HPV31 | E1 | 469 | 10 | SLISFLQGCI | | 13678 |
| HPV31 | E1 | 469 | 11 | SLISFLQGCII | | 13679 |
| HPV31 | E1 | 294 | 8 | STAAALYW | | 13680 |
| HPV31 | E1 | 294 | 9 | STAAALYWY | | 13681 |
| HPV31 | E1 | 211 | 11 | STCTDWCVAAF | | 13682 |
| HPV31 | E1 | 616 | 11 | STFKCVSGQNI | | 13683 |
| HPV31 | E1 | 250 | 8 | SWGMVMLM | | 13684 |
| HPV31 | E1 | 250 | 9 | SWGMVMLML | | 13685 |
| HPV31 | E1 | 480 | 9 | SYANSKSHF | | 13686 |
| HPV31 | E1 | 480 | 10 | SYANSKSHFW | | 13687 |
| HPV31 | E1 | 480 | 11 | SYANSKSHFWL | | 13688 |
| HPV31 | E1 | 464 | 8 | SYFGMSLI | | 13689 |
| HPV31 | E1 | 464 | 10 | SYFGMSLISF | | 13690 |
| HPV31 | E1 | 464 | 11 | SYFGMSLISFL | | 13691 |
| HPV31 | E1 | 334 | 10 | TFDLSQMVQW | | 13692 |
| HPV31 | E1 | 617 | 10 | TFKCVSGQNI | | 13693 |
| HPV31 | E1 | 567 | 8 | TFPNPFPF | | 13694 |
| HPV31 | E1 | 269 | 9 | TIEKLLEKL | | 13695 |
| HPV31 | E1 | 269 | 10 | TIEKLLEKLL | | 13696 |
| HPV31 | E1 | 233 | 8 | TLLQPYCL | | 13697 |
| HPV31 | E1 | 233 | 9 | TLLQPYCLY | | 13698 |
| HPV31 | E1 | 333 | 8 | TTFDLSQM | | 13699 |
| HPV31 | E1 | 333 | 11 | TTFDLSQMVQW | | 13700 |
| HPV31 | E1 | 505 | 8 | TTPCWHYI | | 13701 |
| HPV31 | E1 | 505 | 11 | TTPCWHYIDNY | | 13702 |
| HPV31 | E1 | 226 | 9 | TVAEGFKTL | | 13703 |
| HPV31 | E1 | 226 | 10 | TVAEGFKTLL | | 13704 |
| HPV31 | E1 | 565 | 8 | VFTFPNPF | | 13705 |
| HPV31 | E1 | 565 | 10 | VFTFPNPFPF | | 13706 |
| HPV31 | E1 | 23 | 10 | VIDRQTGDNI | | 13707 |
| HPV31 | E1 | 84 | 11 | VLKRKYVGSPL | | 13708 |
| HPV31 | E1 | 177 | 11 | VLKTSNGKAAM | | 13709 |
| HPV31 | E1 | 325 | 11 | VLQHSFNDTTF | | 13710 |
| HPV31 | E1 | 349 | 9 | VMDDSEIAY | | 13711 |
| HPV31 | E1 | 349 | 11 | VMDDSEIAYKY | | 13712 |
| HPV31 | E1 | 254 | 8 | VMLMLVRF | | 13713 |
| HPV31 | E1 | 223 | 9 | VTGTVAEGF | | 13714 |
| HPV31 | E1 | 564 | 9 | VVFTFPNPF | | 13715 |
| HPV31 | E1 | 564 | 11 | VVFTFPNPFPF | | 13716 |
| HPV31 | E1 | 581 | 9 | VYELSDKNW | | 13717 |
| HPV31 | E1 | 312 | 8 | VYGETPEW | | 13718 |
| HPV31 | E1 | 312 | 9 | VYGETPEWI | | 13719 |
| HPV31 | E1 | 17 | 8 | WFYVEAVI | | 13720 |
| HPV31 | E1 | 319 | 8 | WIERQTVL | | 13721 |
| HPV31 | E1 | 489 | 10 | WLQPLADAKI | | 13722 |
| HPV31 | E1 | 301 | 9 | WYRTGMSNI | | 13723 |
| HPV31 | E1 | 465 | 9 | YFGMSLISF | | 13724 |
| HPV31 | E1 | 465 | 10 | YFGMSLISFL | | 13725 |
| HPV31 | E1 | 511 | 10 | YIDNYLRNAL | | 13726 |
| HPV31 | E1 | 558 | 9 | YLHSRLVVF | | 13727 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | E1 | 558 | 11 | YLHSRLVVFTF | | 13728 |
| HPV31 | E1 | 89 | 9 | YVGSPLSDI | | 13729 |
| HPV31 | E1 | 300 | 10 | YWYRTGMSNI | | 13730 |
| HPV31 | E2 | 72 | 8 | AIELQMML | | 13731 |
| HPV31 | E2 | 72 | 11 | AIELQMMLETL | | 13732 |
| HPV31 | E2 | 338 | 8 | AIVTLTYI | | 13733 |
| HPV31 | E2 | 69 | 9 | ALQAIELQM | | 13734 |
| HPV31 | E2 | 69 | 10 | ALQAIELQMM | | 13735 |
| HPV31 | E2 | 69 | 11 | ALQAIELQMML | | 13736 |
| HPV31 | E2 | 61 | 10 | ALSVSKAKAL | | 13737 |
| HPV31 | E2 | 291 | 8 | ATTPIIHL | | 13738 |
| HPV31 | E2 | 286 | 10 | AVSCPATTPI | | 13739 |
| HPV31 | E2 | 286 | 11 | AVSCPATTPII | | 13740 |
| HPV31 | E2 | 307 | 9 | CLRYRLSKY | | 13741 |
| HPV31 | E2 | 330 | 10 | CTDGKHKNAI | | 13742 |
| HPV31 | E2 | 40 | 10 | CVLMYKAREM | | 13743 |
| HPV31 | E2 | 352 | 8 | DFLNTVKI | | 13744 |
| HPV31 | E2 | 124 | 8 | DVHNTMHY | | 13745 |
| HPV31 | E2 | 124 | 11 | DVHNTMHYTNW | | 13746 |
| HPV31 | E2 | 91 | 9 | DWTMQQTSL | | 13747 |
| HPV31 | E2 | 91 | 11 | DWTMQQTSLEL | | 13748 |
| HPV31 | E2 | 31 | 8 | DYWKHIRL | | 13749 |
| HPV31 | E2 | 204 | 11 | EISFAGIVTKL | | 13750 |
| HPV31 | E2 | 74 | 9 | ELQMMLETL | | 13751 |
| HPV31 | E2 | 100 | 11 | ELYLTAPTGCL | | 13752 |
| HPV31 | E2 | 80 | 8 | ETLNNTEY | | 13753 |
| HPV31 | E2 | 185 | 9 | EVHAGGQVI | | 13754 |
| HPV31 | E2 | 185 | 11 | EVHAGGQVIVF | | 13755 |
| HPV31 | E2 | 86 | 9 | EYKNEDWTM | | 13756 |
| HPV31 | E2 | 171 | 8 | FTEEAKKY | | 13757 |
| HPV31 | E2 | 168 | 11 | FVNFTEEAKKY | | 13758 |
| HPV31 | E2 | 156 | 10 | GIYYVHEGHI | | 13759 |
| HPV31 | E2 | 114 | 8 | GYTVEVQF | | 13760 |
| HPV31 | E2 | 29 | 8 | HIDYWKHI | | 13761 |
| HPV31 | E2 | 29 | 10 | HIDYWKHIRL | | 13762 |
| HPV31 | E2 | 35 | 8 | HIRLECVL | | 13763 |
| HPV31 | E2 | 35 | 9 | HIRLECVLM | | 13764 |
| HPV31 | E2 | 35 | 10 | HIRLECVLMY | | 13765 |
| HPV31 | E2 | 164 | 8 | HITYFVNF | | 13766 |
| HPV31 | E2 | 297 | 8 | HLKGDANI | | 13767 |
| HPV31 | E2 | 297 | 9 | HLKGDANIL | | 13768 |
| HPV31 | E2 | 18 | 9 | HYENDSKRL | | 13769 |
| HPV31 | E2 | 130 | 8 | HYTNWKFI | | 13770 |
| HPV31 | E2 | 130 | 9 | HYTNWKFIY | | 13771 |
| HPV31 | E2 | 130 | 10 | HYTNWKFIYL | | 13772 |
| HPV31 | E2 | 295 | 10 | IIHLKGDANI | | 13773 |
| HPV31 | E2 | 295 | 11 | IIHLKGDANIL | | 13774 |
| HPV31 | E2 | 304 | 9 | ILKCLRYRL | | 13775 |
| HPV31 | E2 | 193 | 8 | IVFPESVF | | 13776 |
| HPV31 | E2 | 157 | 9 | IYYVHEGHI | | 13777 |
| HPV31 | E2 | 157 | 11 | IYYVHEGHITY | | 13778 |
| HPV31 | E2 | 183 | 11 | KWEVHAGGQVI | | 13779 |
| HPV31 | E2 | 177 | 8 | KYGTGKKW | | 13780 |
| HPV31 | E2 | 42 | 8 | LMYKAREM | | 13781 |
| HPV31 | E2 | 42 | 10 | LMYKAREMGI | | 13782 |
| HPV31 | E2 | 103 | 8 | LTAPTGCL | | 13783 |
| HPV31 | E2 | 318 | 9 | LYEQVSSTW | | 13784 |
| HPV31 | E2 | 318 | 11 | LYEQVSSTWHW | | 13785 |
| HPV31 | E2 | 101 | 10 | LYLTAPTGCL | | 13786 |
| HPV31 | E2 | 78 | 10 | MLETLNNTEY | | 13787 |
| HPV31 | E2 | 77 | 11 | MMLETLNNTEY | | 13788 |
| HPV31 | E2 | 43 | 9 | MYKAREMGI | | 13789 |
| HPV31 | E2 | 170 | 9 | NFTEEAKKY | | 13790 |
| HPV31 | E2 | 303 | 8 | NILKCLRY | | 13791 |
| HPV31 | E2 | 303 | 10 | NILKCLRYRL | | 13792 |
| HPV31 | E2 | 84 | 9 | NTEYKNEDW | | 13793 |
| HPV31 | E2 | 84 | 11 | NTEYKNEDWTM | | 13794 |
| HPV31 | E2 | 254 | 8 | NTHHPNKL | | 13795 |
| HPV31 | E2 | 254 | 9 | NTHHPNKLL | | 13796 |
| HPV31 | E2 | 127 | 8 | NTMHYTNW | | 13797 |
| HPV31 | E2 | 127 | 10 | NTMHYTNWKF | | 13798 |
| HPV31 | E2 | 127 | 11 | NTMHYTNWKFI | | 13799 |
| HPV31 | E2 | 361 | 9 | NTVSVSTGY | | 13800 |
| HPV31 | E2 | 361 | 10 | NTVSVSTGYM | | 13801 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | E2 | 9 | 8 | NVCQDKIL | | 13802 |
| HPV31 | E2 | 9 | 11 | NVCQDKILEHY | | 13803 |
| HPV31 | E2 | 133 | 9 | NWKFIYLCI | | 13804 |
| HPV31 | E2 | 294 | 11 | PIIHLKGDANI | | 13805 |
| HPV31 | E2 | 106 | 10 | PTGCLKKHGY | | 13806 |
| HPV31 | E2 | 120 | 10 | QFDGDVHNTM | | 13807 |
| HPV31 | E2 | 317 | 10 | QLYEQVSSTW | | 13808 |
| HPV31 | E2 | 96 | 8 | QTSLELYL | | 13809 |
| HPV31 | E2 | 191 | 10 | QVIVFPESVF | | 13810 |
| HPV31 | E2 | 151 | 8 | QVNCKGIY | | 13811 |
| HPV31 | E2 | 151 | 9 | QVNCKGIYY | | 13812 |
| HPV31 | E2 | 321 | 8 | QVSSTWHW | | 13813 |
| HPV31 | E2 | 25 | 8 | RLCDHIDY | | 13814 |
| HPV31 | E2 | 25 | 9 | RLCDHIDYW | | 13815 |
| HPV31 | E2 | 37 | 8 | RLECVLMY | | 13816 |
| HPV31 | E2 | 7 | 9 | RLNVCQDKI | | 13817 |
| HPV31 | E2 | 7 | 10 | RLNVCQDKIL | | 13818 |
| HPV31 | E2 | 311 | 8 | RLSKYKQL | | 13819 |
| HPV31 | E2 | 311 | 9 | RLSKYKQLY | | 13820 |
| HPV31 | E2 | 309 | 10 | RYRLSKYKQL | | 13821 |
| HPV31 | E2 | 309 | 11 | RYRLSKYKQLY | | 13822 |
| HPV31 | E2 | 206 | 9 | SFAGIVTKL | | 13823 |
| HPV31 | E2 | 53 | 10 | SINHQVVPAL | | 13824 |
| HPV31 | E2 | 346 | 8 | STSQRDDF | | 13825 |
| HPV31 | E2 | 346 | 9 | STSQRDDFL | | 13826 |
| HPV31 | E2 | 266 | 10 | SVDSVNCGVI | | 13827 |
| HPV31 | E2 | 198 | 8 | SVFSSDEI | | 13828 |
| HPV31 | E2 | 198 | 10 | SVFSSDEISF | | 13829 |
| HPV31 | E2 | 63 | 8 | SVSKAKAL | | 13830 |
| HPV31 | E2 | 63 | 11 | SVSKAKALQAI | | 13831 |
| HPV31 | E2 | 364 | 9 | SVSTGYMTI | | 13832 |
| HPV31 | E2 | 128 | 9 | TMHYTNWKF | | 13833 |
| HPV31 | E2 | 128 | 10 | TMHYTNWKFI | | 13834 |
| HPV31 | E2 | 128 | 11 | TMHYTNWKFIY | | 13835 |
| HPV31 | E2 | 93 | 9 | TMQQTSLEL | | 13836 |
| HPV31 | E2 | 93 | 10 | TMQQTSLELY | | 13837 |
| HPV31 | E2 | 93 | 11 | TMQQTSLELYL | | 13838 |
| HPV31 | E2 | 221 | 10 | TTSNSKTCAL | | 13839 |
| HPV31 | E2 | 220 | 11 | TTTSNSKTCAL | | 13840 |
| HPV31 | E2 | 362 | 8 | TVSVSTGY | | 13841 |
| HPV31 | E2 | 362 | 9 | TVSVSTGYM | | 13842 |
| HPV31 | E2 | 362 | 11 | TVSVSTGYMTI | | 13843 |
| HPV31 | E2 | 343 | 11 | TYISTSQRDDF | | 13844 |
| HPV31 | E2 | 199 | 9 | VFSSDEISF | | 13845 |
| HPV31 | E2 | 192 | 9 | VIVFPESVF | | 13846 |
| HPV31 | E2 | 41 | 9 | VLMYKAREM | | 13847 |
| HPV31 | E2 | 41 | 11 | VLMYKAREMGI | | 13848 |
| HPV31 | E2 | 147 | 11 | VVEGQVNCKGI | | 13849 |
| HPV31 | E2 | 92 | 8 | WTMQQTSL | | 13850 |
| HPV31 | E2 | 92 | 10 | WTMQQTSLEL | | 13851 |
| HPV31 | E2 | 92 | 11 | WTMQQTSLELY | | 13852 |
| HPV31 | E2 | 344 | 10 | YISTSQRDDF | | 13853 |
| HPV31 | E2 | 344 | 11 | YISTSQRDDFL | | 13854 |
| HPV31 | E2 | 102 | 9 | YLTAPTGCL | | 13855 |
| HPV31 | E2 | 131 | 8 | YTNWKFIY | | 13856 |
| HPV31 | E2 | 131 | 9 | YTNWKFIYL | | 13857 |
| HPV31 | E2 | 131 | 11 | YTNWKFIYLCI | | 13858 |
| HPV31 | E2 | 159 | 9 | YVHEGHITY | | 13859 |
| HPV31 | E2 | 159 | 10 | YVHEGHITYF | | 13860 |
| HPV31 | E2 | 32 | 11 | YWKHIRLECVL | | 13861 |
| HPV31 | E2 | 158 | 8 | YYVHEGHI | | 13862 |
| HPV31 | E2 | 158 | 10 | YYVHEGHITY | | 13863 |
| HPV31 | E2 | 158 | 11 | YYVHEGHITYF | | 13864 |
| HPV31 | E5 | 40 | 9 | ATLLLLIVI | | 13865 |
| HPV31 | E5 | 40 | 10 | ATLLLLIVIL | | 13866 |
| HPV31 | E5 | 40 | 11 | ATLLLLIVILW | | 13867 |
| HPV31 | E5 | 53 | 8 | ATSPLRCF | | 13868 |
| HPV31 | E5 | 53 | 10 | ATSPLRCFCI | | 13869 |
| HPV31 | E5 | 53 | 11 | ATSPLRCFCIY | | 13870 |
| HPV31 | E5 | 59 | 8 | CFCIYVVF | | 13871 |
| HPV31 | E5 | 59 | 9 | CFCIYVVFI | | 13872 |
| HPV31 | E5 | 59 | 10 | CFCIYVVFIY | | 13873 |
| HPV31 | E5 | 59 | 11 | CFCIYVVFIYI | | 13874 |
| HPV31 | E5 | 18 | 10 | CFCVLLFVCL | | 13875 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | E5 | 14 | 9 | CFLLCFCVL | | 13876 |
| HPV31 | E5 | 14 | 10 | CFLLCFCVLL | | 13877 |
| HPV31 | E5 | 14 | 11 | CFLLCFCVLLF | | 13878 |
| HPV31 | E5 | 61 | 8 | CIYVVFIY | | 13879 |
| HPV31 | E5 | 61 | 9 | CIYVVFIYI | | 13880 |
| HPV31 | E5 | 61 | 11 | CIYVVFIYIPL | | 13881 |
| HPV31 | E5 | 26 | 9 | CLVIRPLVL | | 13882 |
| HPV31 | E5 | 20 | 8 | CVLLFVCL | | 13883 |
| HPV31 | E5 | 20 | 10 | CVLLFVCLVI | | 13884 |
| HPV31 | E5 | 3 | 9 | ELNISTVSI | | 13885 |
| HPV31 | E5 | 3 | 11 | ELNISTVSIVL | | 13886 |
| HPV31 | E5 | 66 | 9 | FIYIPLFVI | | 13887 |
| HPV31 | E5 | 15 | 8 | FLLCFCVL | | 13888 |
| HPV31 | E5 | 15 | 9 | FLLCFCVLL | | 13889 |
| HPV31 | E5 | 15 | 10 | FLLCFCVLLF | | 13890 |
| HPV31 | E5 | 24 | 9 | FVCLVIRPL | | 13891 |
| HPV31 | E5 | 24 | 11 | FVCLVIRPLVL | | 13892 |
| HPV31 | E5 | 72 | 9 | FVIHTHASF | | 13893 |
| HPV31 | E5 | 72 | 10 | FVIHTHASFL | | 13894 |
| HPV31 | E5 | 48 | 10 | ILWVIATSPL | | 13895 |
| HPV31 | E5 | 11 | 9 | IVLCFLLCF | | 13896 |
| HPV31 | E5 | 67 | 8 | IYIPLFVI | | 13897 |
| HPV31 | E5 | 62 | 8 | IYVVFIYI | | 13898 |
| HPV31 | E5 | 62 | 10 | IYVVFIYIPL | | 13899 |
| HPV31 | E5 | 62 | 11 | IYVVFIYIPLF | | 13900 |
| HPV31 | E5 | 23 | 10 | LFVCLVIRPL | | 13901 |
| HPV31 | E5 | 71 | 10 | LFVIHTHASF | | 13902 |
| HPV31 | E5 | 71 | 11 | LFVIHTHASFL | | 13903 |
| HPV31 | E5 | 45 | 8 | LIVILWVI | | 13904 |
| HPV31 | E5 | 16 | 8 | LLCFCVLL | | 13905 |
| HPV31 | E5 | 16 | 9 | LLCFCVLLF | | 13906 |
| HPV31 | E5 | 22 | 8 | LLFVCLVI | | 13907 |
| HPV31 | E5 | 22 | 11 | LLFVCLVIRPL | | 13908 |
| HPV31 | E5 | 44 | 9 | LLIVILWVI | | 13909 |
| HPV31 | E5 | 43 | 8 | LLLIVILW | | 13910 |
| HPV31 | E5 | 43 | 10 | LLLIVILWVI | | 13911 |
| HPV31 | E5 | 42 | 8 | LLLLIVIL | | 13912 |
| HPV31 | E5 | 42 | 9 | LLLLIVILW | | 13913 |
| HPV31 | E5 | 42 | 11 | LLLLIVILWVI | | 13914 |
| HPV31 | E5 | 27 | 8 | LVIRPLVL | | 13915 |
| HPV31 | E5 | 32 | 8 | LVLSVSVY | | 13916 |
| HPV31 | E5 | 32 | 11 | LVLSVSVYATL | | 13917 |
| HPV31 | E5 | 49 | 9 | LWVIATSPL | | 13918 |
| HPV31 | E5 | 1 | 11 | MIELNISTVSI | | 13919 |
| HPV31 | E5 | 5 | 9 | NISTVSIVL | | 13920 |
| HPV31 | E5 | 5 | 11 | NISTVSIVLCF | | 13921 |
| HPV31 | E5 | 70 | 11 | PLFVIHTHASF | | 13922 |
| HPV31 | E5 | 56 | 8 | PLRCFCIY | | 13923 |
| HPV31 | E5 | 56 | 11 | PLRCFCIYVVF | | 13924 |
| HPV31 | E5 | 31 | 9 | PLVLSVSVY | | 13925 |
| HPV31 | E5 | 10 | 8 | SIVLCFLL | | 13926 |
| HPV31 | E5 | 10 | 10 | SIVLCFLLCF | | 13927 |
| HPV31 | E5 | 7 | 9 | STVSIVLCF | | 13928 |
| HPV31 | E5 | 7 | 10 | STVSIVLCFL | | 13929 |
| HPV31 | E5 | 7 | 11 | STVSIVLCFLL | | 13930 |
| HPV31 | E5 | 35 | 8 | SVSVYATL | | 13931 |
| HPV31 | E5 | 35 | 9 | SVSVYATLL | | 13932 |
| HPV31 | E5 | 35 | 10 | SVSVYATLLL | | 13933 |
| HPV31 | E5 | 35 | 11 | SVSVYATLLLL | | 13934 |
| HPV31 | E5 | 37 | 8 | SVYATLLL | | 13935 |
| HPV31 | E5 | 37 | 9 | SVYATLLLL | | 13936 |
| HPV31 | E5 | 37 | 10 | SVYATLLLLI | | 13937 |
| HPV31 | E5 | 41 | 8 | TLLLLIVI | | 13938 |
| HPV31 | E5 | 41 | 9 | TLLLLIVIL | | 13939 |
| HPV31 | E5 | 41 | 10 | TLLLLIVILW | | 13940 |
| HPV31 | E5 | 8 | 8 | TVSIVLCF | | 13941 |
| HPV31 | E5 | 8 | 9 | TVSIVLCFL | | 13942 |
| HPV31 | E5 | 8 | 10 | TVSIVLCFLL | | 13943 |
| HPV31 | E5 | 65 | 8 | VFIYIPLF | | 13944 |
| HPV31 | E5 | 65 | 10 | VFIYIPLFVI | | 13945 |
| HPV31 | E5 | 51 | 10 | VIATSPLRCF | | 13946 |
| HPV31 | E5 | 73 | 8 | VIHTHASF | | 13947 |
| HPV31 | E5 | 73 | 9 | VIHTHASFL | | 13948 |
| HPV31 | E5 | 47 | 11 | VILWVIATSPL | | 13949 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | E5 | 12 | 8 | VLCFLLCF | | 13950 |
| HPV31 | E5 | 12 | 11 | VLCFLLCFCVL | | 13951 |
| HPV31 | E5 | 21 | 9 | VLLFVCLVI | | 13952 |
| HPV31 | E5 | 33 | 10 | VLSVSVYATL | | 13953 |
| HPV31 | E5 | 33 | 11 | VLSVSVYATLL | | 13954 |
| HPV31 | E5 | 64 | 8 | VVFIYIPL | | 13955 |
| HPV31 | E5 | 64 | 9 | VVFIYIPLF | | 13956 |
| HPV31 | E5 | 64 | 11 | VVFIYIPLFVI | | 13957 |
| HPV31 | E5 | 38 | 8 | VYATLLLL | | 13958 |
| HPV31 | E5 | 38 | 9 | VYATLLLLI | | 13959 |
| HPV31 | E5 | 38 | 11 | VYATLLLLIVI | | 13960 |
| HPV31 | E5 | 50 | 8 | WVIATSPL | | 13961 |
| HPV31 | E5 | 50 | 11 | WVIATSPLRCF | | 13962 |
| HPV31 | E5 | 63 | 9 | YVVFIYIPL | | 13963 |
| HPV31 | E5 | 63 | 10 | YVVFIYIPLF | | 13964 |
| HPV31 | E6 | 46 | 9 | AFTDLTIVY | | 13965 |
| HPV31 | E6 | 18 | 9 | ALEIPYDEL | | 13966 |
| HPV31 | E6 | 18 | 11 | ALEIPYDELRL | | 13967 |
| HPV31 | E6 | 103 | 8 | CITCQRPL | | 13968 |
| HPV31 | E6 | 66 | 11 | CLRFYSKVSEF | | 13969 |
| HPV31 | E6 | 63 | 8 | CTKCLRFY | | 13970 |
| HPV31 | E6 | 30 | 8 | CVYCKGQL | | 13971 |
| HPV31 | E6 | 44 | 9 | DFAFTDLTI | | 13972 |
| HPV31 | E6 | 44 | 11 | DFAFTDLTIVY | | 13973 |
| HPV31 | E6 | 57 | 11 | DTPHGVCTKCL | | 13974 |
| HPV31 | E6 | 75 | 10 | EFRWYRYSVY | | 13975 |
| HPV31 | E6 | 20 | 9 | EIPYDELRL | | 13976 |
| HPV31 | E6 | 25 | 8 | ELRLNCVY | | 13977 |
| HPV31 | E6 | 14 | 8 | ELSSALEI | | 13978 |
| HPV31 | E6 | 14 | 10 | ELSSALEIPY | | 13979 |
| HPV31 | E6 | 39 | 9 | ETEVLDFAF | | 13980 |
| HPV31 | E6 | 41 | 10 | EVLDFAFTDL | | 13981 |
| HPV31 | E6 | 47 | 8 | FTDLTIVY | | 13982 |
| HPV31 | E6 | 69 | 8 | FYSKVSEF | | 13983 |
| HPV31 | E6 | 69 | 10 | FYSKVSEFRW | | 13984 |
| HPV31 | E6 | 69 | 11 | FYSKVSEFRWY | | 13985 |
| HPV31 | E6 | 95 | 10 | GICDLLIRCI | | 13986 |
| HPV31 | E6 | 61 | 9 | GVCTKCLRF | | 13987 |
| HPV31 | E6 | 61 | 10 | GVCTKCLRFY | | 13988 |
| HPV31 | E6 | 118 | 8 | HLDKKKRF | | 13989 |
| HPV31 | E6 | 118 | 11 | HLDKKKRFHNI | | 13990 |
| HPV31 | E6 | 11 | 9 | KLHELSSAL | | 13991 |
| HPV31 | E6 | 11 | 11 | KLHELSSALEI | | 13992 |
| HPV31 | E6 | 90 | 10 | KLTNKGICDL | | 13993 |
| HPV31 | E6 | 90 | 11 | KLTNKGICDLL | | 13994 |
| HPV31 | E6 | 72 | 8 | KVSEFRWY | | 13995 |
| HPV31 | E6 | 72 | 10 | KVSEFRWYRY | | 13996 |
| HPV31 | E6 | 100 | 11 | LIRCITCQRPL | | 13997 |
| HPV31 | E6 | 37 | 9 | LTETEVLDF | | 13998 |
| HPV31 | E6 | 37 | 11 | LTETEVLDFAF | | 13999 |
| HPV31 | E6 | 91 | 9 | LTNKGICDL | | 14000 |
| HPV31 | E6 | 91 | 10 | LTNKGICDLL | | 14001 |
| HPV31 | E6 | 91 | 11 | LTNKGICDLLI | | 14002 |
| HPV31 | E6 | 127 | 11 | NIGGRWTGRCI | | 14003 |
| HPV31 | E6 | 109 | 11 | PLCPEEKQRHL | | 14004 |
| HPV31 | E6 | 22 | 11 | PYDELRLNCVY | | 14005 |
| HPV31 | E6 | 36 | 8 | QLTETEVL | | 14006 |
| HPV31 | E6 | 36 | 10 | QLTETEVLDF | | 14007 |
| HPV31 | E6 | 124 | 9 | RFHNIGGRW | | 14008 |
| HPV31 | E6 | 68 | 9 | RFYSKVSEF | | 14009 |
| HPV31 | E6 | 68 | 11 | RFYSKVSEFRW | | 14010 |
| HPV31 | E6 | 27 | 11 | RLNCVYCKGQL | | 14011 |
| HPV31 | E6 | 131 | 10 | RWTGRCIACW | | 14012 |
| HPV31 | E6 | 77 | 8 | RWYRYSVY | | 14013 |
| HPV31 | E6 | 80 | 9 | RYSVYGTTL | | 14014 |
| HPV31 | E6 | 82 | 10 | SVYGTTLEKL | | 14015 |
| HPV31 | E6 | 87 | 10 | TLEKLTNKGI | | 14016 |
| HPV31 | E6 | 86 | 11 | TTLEKLTNKGI | | 14017 |
| HPV31 | E6 | 42 | 9 | VLDFAFTDL | | 14018 |
| HPV31 | E6 | 42 | 11 | VLDFAFTDLTI | | 14019 |
| HPV31 | E6 | 83 | 9 | VYGTTLEKL | | 14020 |
| HPV31 | E6 | 132 | 9 | WTGRCIACW | | 14021 |
| HPV31 | E6 | 78 | 11 | WYRYSVYGTTL | | 14022 |
| HPV31 | E7 | 19 | 10 | ATDLHCYEQL | | 14023 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | E7 | 68 | 9 | CVQSTQVDI | | 14024 |
| HPV31 | E7 | 68 | 11 | CVQSTQVDIRI | | 14025 |
| HPV31 | E7 | 75 | 8 | DIRILQEL | | 14026 |
| HPV31 | E7 | 75 | 9 | DIRILQELL | | 14027 |
| HPV31 | E7 | 75 | 10 | DIRILQELLM | | 14028 |
| HPV31 | E7 | 21 | 8 | DLHCYEQL | | 14029 |
| HPV31 | E7 | 14 | 9 | DLQPEATDL | | 14030 |
| HPV31 | E7 | 48 | 10 | DTSNYNIVTF | | 14031 |
| HPV31 | E7 | 81 | 9 | ELLMGSFGI | | 14032 |
| HPV31 | E7 | 4 | 8 | ETPTLQDY | | 14033 |
| HPV31 | E7 | 4 | 10 | ETPTLQDYVL | | 14034 |
| HPV31 | E7 | 88 | 11 | GIVCPNCSTRL | | 14035 |
| HPV31 | E7 | 78 | 10 | ILQELLMGSF | | 14036 |
| HPV31 | E7 | 89 | 10 | IVCPNCSTRL | | 14037 |
| HPV31 | E7 | 82 | 8 | LLMGSFGI | | 14038 |
| HPV31 | E7 | 6 | 8 | PTLQDYVL | | 14039 |
| HPV31 | E7 | 6 | 10 | PTLQDYVLDL | | 14040 |
| HPV31 | E7 | 73 | 10 | QVDIRILQEL | | 14041 |
| HPV31 | E7 | 73 | 11 | QVDIRILQELL | | 14042 |
| HPV31 | E7 | 77 | 8 | RILQELLM | | 14043 |
| HPV31 | E7 | 77 | 11 | RILQELLMGSF | | 14044 |
| HPV31 | E7 | 66 | 11 | RLCVQSTQVDI | | 14045 |
| HPV31 | E7 | 71 | 8 | STQVDIRI | | 14046 |
| HPV31 | E7 | 71 | 9 | STQVDIRIL | | 14047 |
| HPV31 | E7 | 56 | 10 | TFCCQCKSTL | | 14048 |
| HPV31 | E7 | 7 | 9 | TLQDYVLDL | | 14049 |
| HPV31 | E7 | 12 | 11 | VLDLQPEATDL | | 14050 |
| HPV31 | E7 | 55 | 11 | VTFCCQCKSTL | | 14051 |
| HPV31 | L1 | 348 | 9 | AIANSDTTF | | 14052 |
| HPV31 | L1 | 398 | 8 | AILEDWNF | | 14053 |
| HPV31 | L1 | 398 | 10 | AILEDWNFGL | | 14054 |
| HPV31 | L1 | 180 | 10 | AITPGDCPPL | | 14055 |
| HPV31 | L1 | 213 | 11 | ALQDTKSNVPL | | 14056 |
| HPV31 | L1 | 285 | 8 | ATLANSTY | | 14057 |
| HPV31 | L1 | 285 | 9 | ATLANSTYF | | 14058 |
| HPV31 | L1 | 147 | 11 | CISMDYKQTQL | | 14059 |
| HPV31 | L1 | 158 | 9 | CLLGCKPPI | | 14060 |
| HPV31 | L1 | 224 | 9 | DICNSICKY | | 14061 |
| HPV31 | L1 | 387 | 9 | DIMTYIHSM | | 14062 |
| HPV31 | L1 | 459 | 11 | DLDQFPLGRKF | | 14063 |
| HPV31 | L1 | 372 | 8 | DLQFIFQL | | 14064 |
| HPV31 | L1 | 372 | 11 | DLQFIFQLCKI | | 14065 |
| HPV31 | L1 | 200 | 10 | DMVDTGFGAM | | 14066 |
| HPV31 | L1 | 129 | 8 | DTENSNRY | | 14067 |
| HPV31 | L1 | 203 | 9 | DTGFGAMDF | | 14068 |
| HPV31 | L1 | 216 | 8 | DTKSNVPL | | 14069 |
| HPV31 | L1 | 216 | 10 | DTKSNVPLDI | | 14070 |
| HPV31 | L1 | 353 | 9 | DTTFKSSNF | | 14071 |
| HPV31 | L1 | 336 | 8 | DTTRSTNM | | 14072 |
| HPV31 | L1 | 417 | 11 | DTYRFVTSQAI | | 14073 |
| HPV31 | L1 | 151 | 9 | DYKQTQLCL | | 14074 |
| HPV31 | L1 | 151 | 10 | DYKQTQLCLL | | 14075 |
| HPV31 | L1 | 234 | 10 | DYLKMVAEPY | | 14076 |
| HPV31 | L1 | 444 | 9 | DYVFWEVNL | | 14077 |
| HPV31 | L1 | 370 | 8 | EFDLQFIF | | 14078 |
| HPV31 | L1 | 370 | 10 | EFDLQFIFQL | | 14079 |
| HPV31 | L1 | 107 | 8 | EVGRGQPL | | 14080 |
| HPV31 | L1 | 449 | 8 | EVNLKEKF | | 14081 |
| HPV31 | L1 | 363 | 9 | EYLRHGEEF | | 14082 |
| HPV31 | L1 | 363 | 11 | EYLRHGEEFDL | | 14083 |
| HPV31 | L1 | 26 | 8 | EYVTRTNI | | 14084 |
| HPV31 | L1 | 26 | 9 | EYVTRTNIY | | 14085 |
| HPV31 | L1 | 26 | 10 | EYVTRTNIYY | | 14086 |
| HPV31 | L1 | 248 | 9 | FFYLRREQM | | 14087 |
| HPV31 | L1 | 248 | 10 | FFYLRREQMF | | 14088 |
| HPV31 | L1 | 375 | 8 | FIFQLCKI | | 14089 |
| HPV31 | L1 | 375 | 10 | FIFQLCKITL | | 14090 |
| HPV31 | L1 | 447 | 10 | FWEVNLKEKF | | 14091 |
| HPV31 | L1 | 249 | 8 | FYLRREQM | | 14092 |
| HPV31 | L1 | 249 | 9 | FYLRREQMF | | 14093 |
| HPV31 | L1 | 91 | 9 | FYNPETQRL | | 14094 |
| HPV31 | L1 | 91 | 11 | FYNPETQRLVW | | 14095 |
| HPV31 | L1 | 205 | 10 | GFGAMDFTAL | | 14096 |
| HPV31 | L1 | 85 | 8 | GFPDTSFY | | 14097 |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | L1 | 323 | 8 | GICWGNQL | | 14098 |
| HPV31 | L1 | 323 | 9 | GICWGNQLF | | 14099 |
| HPV31 | L1 | 117 | 8 | GISGHPLL | | 14100 |
| HPV31 | L1 | 117 | 11 | GISGHPLLNKF | | 14101 |
| HPV31 | L1 | 105 | 10 | GLEVGRGQPL | | 14102 |
| HPV31 | L1 | 68 | 11 | GLQYRVFRVRL | | 14103 |
| HPV31 | L1 | 406 | 10 | GLTTPPSGSL | | 14104 |
| HPV31 | L1 | 141 | 8 | GTDNRECI | | 14105 |
| HPV31 | L1 | 141 | 10 | GTDNRECISM | | 14106 |
| HPV31 | L1 | 266 | 11 | GTVGESVPTDL | | 14107 |
| HPV31 | L1 | 115 | 9 | GVGISGHPL | | 14108 |
| HPV31 | L1 | 115 | 10 | GVGISGHPLL | | 14109 |
| HPV31 | L1 | 474 | 8 | GYRARPKF | | 14110 |
| HPV31 | L1 | 307 | 8 | IFNKPYWM | | 14111 |
| HPV31 | L1 | 376 | 9 | IFQLCKITL | | 14112 |
| HPV31 | L1 | 399 | 9 | ILEDWNFGL | | 14113 |
| HPV31 | L1 | 388 | 8 | IMTYIHSM | | 14114 |
| HPV31 | L1 | 382 | 8 | ITLSADIM | | 14115 |
| HPV31 | L1 | 382 | 10 | ITLSADIMTY | | 14116 |
| HPV31 | L1 | 382 | 11 | ITLSADIMTYI | | 14117 |
| HPV31 | L1 | 181 | 9 | ITPGDCPPL | | 14118 |
| HPV31 | L1 | 181 | 11 | ITPGDCPPLEL | | 14119 |
| HPV31 | L1 | 61 | 9 | IVVPKVSGL | | 14120 |
| HPV31 | L1 | 61 | 11 | IVVPKVSGLQY | | 14121 |
| HPV31 | L1 | 33 | 10 | IYYHAGSARL | | 14122 |
| HPV31 | L1 | 33 | 11 | IYYHAGSARLL | | 14123 |
| HPV31 | L1 | 126 | 11 | KFDDTENSNRY | | 14124 |
| HPV31 | L1 | 83 | 9 | KFGFPDTSF | | 14125 |
| HPV31 | L1 | 83 | 10 | KFGFPDTSFY | 14126 | |
| HPV31 | L1 | 468 | 8 | KFLLQAGY | 14127 | |
| HPV31 | L1 | 455 | 9 | KFSADLDQF | 14128 | |
| HPV31 | L1 | 455 | 11 | KFSADLDQFPL | 14129 | |
| HPV31 | L1 | 381 | 8 | KITLSADI | 14130 | |
| HPV31 | L1 | 381 | 9 | KITLSADIM | 14131 | |
| HPV31 | L1 | 381 | 11 | KITLSADIMTY | 14132 | |
| HPV31 | L1 | 60 | 10 | KIVVPKVSGL | 14133 | |
| HPV31 | L1 | 237 | 11 | KMVAEPYGDTL | 14134 | |
| HPV31 | L1 | 65 | 10 | KVSGLQYRVF | 14135 | |
| HPV31 | L1 | 20 | 8 | KVVSTDEY | 14136 | |
| HPV31 | L1 | 231 | 8 | KYPDYLKM | 14137 | |
| HPV31 | L1 | 247 | 10 | LFFYLRREQM | 14138 | |
| HPV31 | L1 | 247 | 11 | LFFYLRREQMF | 14139 | |
| HPV31 | L1 | 159 | 8 | LLGCKPPI | 14140 | |
| HPV31 | L1 | 42 | 8 | LLTVGHPY | 14141 | |
| HPV31 | L1 | 42 | 9 | LLTVGHPYY | 14142 | |
| HPV31 | L1 | 42 | 11 | LLTVGHPYYSI | 14143 | |
| HPV31 | L1 | 407 | 9 | LTTPPSGSL | 14144 | |
| HPV31 | L1 | 43 | 8 | LTVGHPYY | 14145 | |
| HPV31 | L1 | 43 | 10 | LTVGHPYYSI | 14146 | |
| HPV31 | L1 | 99 | 8 | LVWACVGL | 14147 | |
| HPV31 | L1 | 3 | 10 | LWRPSEATVY | 14148 | |
| HPV31 | L1 | 3 | 11 | LWRPSEATVYL | 14149 | |
| HPV31 | L1 | 389 | 11 | MTYIHSMNPAI | 14150 | |
| HPV31 | L1 | 238 | 10 | MVAEPYGDTL | 14151 | |
| HPV31 | L1 | 238 | 11 | MVAEPYGDTLF | 14152 | |
| HPV31 | L1 | 201 | 9 | MVDTGFGAM | 14153 | |
| HPV31 | L1 | 201 | 11 | MVDTGFGAMDF | 14154 | |
| HPV31 | L1 | 300 | 8 | MVTSDAQI | 14155 | |
| HPV31 | L1 | 300 | 9 | MVTSDAQIF | 14156 | |
| HPV31 | L1 | 32 | 11 | NIYYHAGSARL | 14157 | |
| HPV31 | L1 | 451 | 10 | NLKEKFSADL | 14158 | |
| HPV31 | L1 | 342 | 8 | NMSVCAAI | 14159 | |
| HPV31 | L1 | 220 | 10 | NVPLDICNSI | 14160 | |
| HPV31 | L1 | 441 | 8 | PFKDYVFW | 14161 | |
| HPV31 | L1 | 222 | 8 | PLDICNSI | 14162 | |
| HPV31 | L1 | 222 | 11 | PLDICNSICKY | 14163 | |
| HPV31 | L1 | 188 | 9 | PLELKNSVI | 14164 | |
| HPV31 | L1 | 464 | 8 | PLGRKFLL | 14165 | |
| HPV31 | L1 | 113 | 11 | PLGVGISGHPL | 14166 | |
| HPV31 | L1 | 17 | 11 | PVSKVVSTDEY | 14167 | |
| HPV31 | L1 | 242 | 8 | PYGDTLFF | 14168 | |
| HPV31 | L1 | 242 | 9 | PYGDTLFFY | 14169 | |
| HPV31 | L1 | 242 | 10 | PYGDTLFFYL | 14170 | |
| HPV31 | L1 | 374 | 9 | QFIFQLCKI | 14171 | |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | L1 | 374 | 11 | QFIFQLCKITL | 14172 | |
| HPV31 | L1 | 462 | 8 | QFPLGRKF | 14173 | |
| HPV31 | L1 | 462 | 9 | QFPLGRKFL | 14174 | |
| HPV31 | L1 | 462 | 10 | QFPLGRKFLL | 14175 | |
| HPV31 | L1 | 306 | 8 | QIFNKPYW | 14176 | |
| HPV31 | L1 | 306 | 9 | QIFNKPYWM | 14177 | |
| HPV31 | L1 | 378 | 11 | QLCKITLSADI | 14178 | |
| HPV31 | L1 | 156 | 11 | QLCLLGCKPPI | 14179 | |
| HPV31 | L1 | 255 | 8 | QMFVRHFF | 14180 | |
| HPV31 | L1 | 70 | 9 | QYRVFRVRL | 14181 | |
| HPV31 | L1 | 420 | 8 | RFVTSQAI | 14182 | |
| HPV31 | L1 | 41 | 9 | RLLTVGHPY | 14183 | |
| HPV31 | L1 | 41 | 10 | RLLTVGHPYY | 14184 | |
| HPV31 | L1 | 77 | 8 | RLPDPNKF | 14185 | |
| HPV31 | L1 | 77 | 10 | RLPDPNKFGF | 14186 | |
| HPV31 | L1 | 98 | 9 | RLVWACVGL | 14187 | |
| HPV31 | L1 | 75 | 10 | RVRLPDPNKF | 14188 | |
| HPV31 | L1 | 90 | 10 | SFYNPETQRL | 14189 | |
| HPV31 | L1 | 228 | 8 | SICKYPDY | 14190 | |
| HPV31 | L1 | 228 | 9 | SICKYPDYL | 14191 | |
| HPV31 | L1 | 228 | 11 | SICKYPDYLKM | 14192 | |
| HPV31 | L1 | 51 | 11 | SIPKSDNPKKI | 14193 | |
| HPV31 | L1 | 414 | 8 | SLEDTYRF | 14194 | |
| HPV31 | L1 | 2 | 11 | SLWRPSEATVY | 14195 | |
| HPV31 | L1 | 149 | 9 | SMDYKQTQL | 14196 | |
| HPV31 | L1 | 149 | 11 | SMDYKQTQLCL | 14197 | |
| HPV31 | L1 | 394 | 10 | SMNPAILEDW | 14198 | |
| HPV31 | L1 | 299 | 9 | SMVTSDAQI | 14199 | |
| HPV31 | L1 | 299 | 10 | SMVTSDAQIF | 14200 | |
| HPV31 | L1 | 283 | 10 | STATLANSTY | 14201 | |
| HPV31 | L1 | 283 | 11 | STATLANSTYF | 14202 | |
| HPV31 | L1 | 23 | 11 | STDEYVTRTNI | 14203 | |
| HPV31 | L1 | 340 | 10 | STNMSVCAAI | 14204 | |
| HPV31 | L1 | 290 | 11 | STYFPTPSGSM | 14205 | |
| HPV31 | L1 | 194 | 8 | SVIQDGDM | 14206 | |
| HPV31 | L1 | 271 | 8 | SVPTDLYI | 14207 | |
| HPV31 | L1 | 355 | 10 | TFKSSNFKEY | 14208 | |
| HPV31 | L1 | 355 | 11 | TFKSSNFKEYL | 14209 | |
| HPV31 | L1 | 286 | 8 | TLANSTYF | 14210 | |
| HPV31 | L1 | 246 | 11 | TLFFYLRREQM | 14211 | |
| HPV31 | L1 | 383 | 9 | TLSADIMTY | 14212 | |
| HPV31 | L1 | 383 | 10 | TLSADIMTYI | 14213 | |
| HPV31 | L1 | 354 | 8 | TTFKSSNF | 14214 | |
| HPV31 | L1 | 354 | 11 | TTFKSSNFKEY | 14215 | |
| HPV31 | L1 | 408 | 8 | TTPPSGSL | 14216 | |
| HPV31 | L1 | 267 | 10 | TVGESVPTDL | 14217 | |
| HPV31 | L1 | 267 | 11 | TVGESVPTDLY | 14218 | |
| HPV31 | L1 | 44 | 9 | TVGHPYYSI | 14219 | |
| HPV31 | L1 | 333 | 11 | TVVDTTRSTNM | 14220 | |
| HPV31 | L1 | 291 | 10 | TYFPTPSGSM | 14221 | |
| HPV31 | L1 | 390 | 10 | TYIHSMNPAI | 14222 | |
| HPV31 | L1 | 390 | 11 | TYIHSMNPAIL | 14223 | |
| HPV31 | L1 | 418 | 10 | TYRFVTSQAI | 14224 | |
| HPV31 | L1 | 446 | 11 | VFWEVNLKEKF | 14225 | |
| HPV31 | L1 | 28 | 8 | VTRTNIYY | 14226 | |
| HPV31 | L1 | 301 | 8 | VTSDAQIF | 14227 | |
| HPV31 | L1 | 334 | 10 | VVDTTRSTNM | 14228 | |
| HPV31 | L1 | 62 | 8 | VVPKVSGL | 14229 | |
| HPV31 | L1 | 62 | 10 | VVPKVSGLQY | 14230 | |
| HPV31 | L1 | 292 | 9 | YFPTPSGSM | 14231 | |
| HPV31 | L1 | 391 | 9 | YIHSMNPAI | 14232 | |
| HPV31 | L1 | 391 | 10 | YIHSMNPAIL | 14233 | |
| HPV31 | L1 | 277 | 11 | YIKGSGSTATL | 14234 | |
| HPV31 | L1 | 235 | 9 | YLKMVAEPY | 14235 | |
| HPV31 | L1 | 364 | 8 | YLRHGEEF | 14236 | |
| HPV31 | L1 | 364 | 10 | YLRHGEEFDL | 14237 | |
| HPV31 | L1 | 250 | 8 | YLRREQMF | 14238 | |
| HPV31 | L1 | 445 | 8 | YVFWEVNL | 14239 | |
| HPV31 | L1 | 27 | 8 | YVTRTNIY | 14240 | |
| HPV31 | L1 | 27 | 9 | YVTRTNIYY | 14241 | |
| HPV31 | L1 | 34 | 9 | YYHAGSARL | 14242 | |
| HPV31 | L1 | 34 | 10 | YYHAGSARLL | 14243 | |
| HPV31 | L2 | 286 | 11 | ALTSRRNTVRY | 14244 | |
| HPV31 | L2 | 311 | 9 | ATIGARVHY | 14245 | |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | L2 | 311 | 10 | ATIGARVHYY | 14246 | |
| HPV31 | L2 | 311 | 11 | ATIGARVHYYY | 14247 | |
| HPV31 | L2 | 226 | 8 | ATQQVKVI | 14248 | |
| HPV31 | L2 | 135 | 10 | ATTADTTPAI | 14249 | |
| HPV31 | L2 | 135 | 11 | ATTADTTPAIL | 14250 | |
| HPV31 | L2 | 342 | 11 | ATTTSTLNDGL | 14251 | |
| HPV31 | L2 | 376 | 11 | AVQSTSAVSAY | 14252 | |
| HPV31 | L2 | 251 | 11 | AYETVNAEESL | 14253 | |
| HPV31 | L2 | 385 | 11 | AYVPTNTTVPL | 14254 | |
| HPV31 | L2 | 275 | 8 | DFLDIIAL | 14255 | |
| HPV31 | L2 | 438 | 8 | DFYLHPSY | 14256 | |
| HPV31 | L2 | 438 | 9 | DFYLHPSYY | 14257 | |
| HPV31 | L2 | 438 | 10 | DFYLHPSYYM | 14258 | |
| HPV31 | L2 | 438 | 11 | DFYLHPSYYML | 14259 | |
| HPV31 | L2 | 278 | 10 | DIIALHRPAL | 14260 | |
| HPV31 | L2 | 354 | 8 | DIYADTDF | 14261 | |
| HPV31 | L2 | 116 | 8 | DVGAPAPI | 14262 | |
| HPV31 | L2 | 31 | 11 | DVIPKIEHTTI | 14263 | |
| HPV31 | L2 | 190 | 8 | EIPMDTFI | 14264 | |
| HPV31 | L2 | 171 | 8 | ETSGHLLL | 14265 | |
| HPV31 | L2 | 253 | 9 | ETVNAEESL | 14266 | |
| HPV31 | L2 | 253 | 10 | ETVNAEESLY | 14267 | |
| HPV31 | L2 | 253 | 11 | ETVNAEESLYF | 14268 | |
| HPV31 | L2 | 196 | 10 | FIVSTNNENI | 14269 | |
| HPV31 | L2 | 237 | 8 | FLSAPKQL | 14270 | |
| HPV31 | L2 | 237 | 9 | FLSAPKQLI | 14271 | |
| HPV31 | L2 | 237 | 11 | FLSAPKQLITY | 14272 | |
| HPV31 | L2 | 433 | 8 | FVDGGDFY | 14273 | |
| HPV31 | L2 | 433 | 9 | FVDGGDFYL | 14274 | |
| HPV31 | L2 | 439 | 8 | FYLHPSYY | 14275 | |
| HPV31 | L2 | 439 | 9 | FYLHPSYYM | 14276 | |
| HPV31 | L2 | 439 | 10 | FYLHPSYYML | 14277 | |
| HPV31 | L2 | 113 | 11 | GIVDVGAPAPI | 14278 | |
| HPV31 | L2 | 351 | 11 | GLYDIYADTDF | 14279 | |
| HPV31 | L2 | 26 | 8 | GTCPSDVI | 14280 | |
| HPV31 | L2 | 26 | 11 | GTCPSDVIPKI | 14281 | |
| HPV31 | L2 | 65 | 8 | GTGGRTGY | 14282 | |
| HPV31 | L2 | 65 | 11 | GTGGRTGYVPL | 14283 | |
| HPV31 | L2 | 52 | 9 | GVFFGGLGI | 14284 | |
| HPV31 | L2 | 213 | 8 | GVRRPARL | 14285 | |
| HPV31 | L2 | 213 | 10 | GVRRPARLGL | 14286 | |
| HPV31 | L2 | 213 | 11 | GVRRPARLGLY | 14287 | |
| HPV31 | L2 | 175 | 9 | HLLLSSSSI | 14288 | |
| HPV31 | L2 | 38 | 8 | HTTIADQI | 14289 | |
| HPV31 | L2 | 38 | 9 | HTTIADQIL | 14290 | |
| HPV31 | L2 | 38 | 11 | HTTIADQILRY | 14291 | |
| HPV31 | L2 | 318 | 9 | HYYYDISSI | 14292 | |
| HPV31 | L2 | 403 | 9 | IFSGPDVPI | 14293 | |
| HPV31 | L2 | 432 | 8 | IFVDGGDF | 14294 | |
| HPV31 | L2 | 432 | 9 | IFVDGGDFY | 14295 | |
| HPV31 | L2 | 432 | 10 | IFVDGGDFYL | 14296 | |
| HPV31 | L2 | 279 | 9 | IIALHRPAL | 14297 | |
| HPV31 | L2 | 45 | 10 | ILRYGSMGVF | 14298 | |
| HPV31 | L2 | 45 | 11 | ILRYGSMGVFF | 14299 | |
| HPV31 | L2 | 245 | 8 | ITYENPAY | 14300 | |
| HPV31 | L2 | 114 | 10 | IVDVGAPAPI | 14301 | |
| HPV31 | L2 | 105 | 10 | IVSLVEESGI | 14302 | |
| HPV31 | L2 | 197 | 9 | IVSTNNENI | 14303 | |
| HPV31 | L2 | 35 | 11 | KIEHTTIADQI | 14304 | |
| HPV31 | L2 | 231 | 8 | KVIDPTFL | 14305 | |
| HPV31 | L2 | 244 | 9 | LITYENPAY | 14306 | |
| HPV31 | L2 | 176 | 8 | LLLSSSSI | 14307 | |
| HPV31 | L2 | 287 | 10 | LTSRRNTVRY | 14308 | |
| HPV31 | L2 | 352 | 10 | LYDIYADTDF | 14309 | |
| HPV31 | L2 | 261 | 10 | LYFSNTSHNI | 14310 | |
| HPV31 | L2 | 447 | 11 | MLKRRRKRVSY | 14311 | |
| HPV31 | L2 | 269 | 8 | NIAPDPDF | 14312 | |
| HPV31 | L2 | 269 | 9 | NIAPDPDFL | 14313 | |
| HPV31 | L2 | 269 | 11 | NIAPDPDFLDI | 14314 | |
| HPV31 | L2 | 204 | 8 | NITSSTPI | 14315 | |
| HPV31 | L2 | 390 | 10 | NTTVPLSTGF | 14316 | |
| HPV31 | L2 | 292 | 8 | NTVRYSRL | 14317 | |
| HPV31 | L2 | 187 | 10 | NYEEIPMDTF | 14318 | |
| HPV31 | L2 | 187 | 11 | NYEEIPMDTFI | 14319 | |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | L2 | 410 | 10 | PIEHAPTQVF | 14320 | |
| HPV31 | L2 | 402 | 10 | PIFSGPDVPI | 14321 | |
| HPV31 | L2 | 210 | 11 | PIPGVRRPARL | 14322 | |
| HPV31 | L2 | 122 | 11 | PIPHPPTTSGF | 14323 | |
| HPV31 | L2 | 88 | 8 | PIRPPVSI | 14324 | |
| HPV31 | L2 | 422 | 11 | PLAPTTPQVSI | 14325 | |
| HPV31 | L2 | 100 | 9 | PLDPSIVSL | 14326 | |
| HPV31 | L2 | 394 | 8 | PLSTGFDI | 14327 | |
| HPV31 | L2 | 394 | 10 | PLSTGFDIPI | 14328 | |
| HPV31 | L2 | 394 | 11 | PLSTGFDIPIF | 14329 | |
| HPV31 | L2 | 235 | 10 | PTFLSAPKQL | 14330 | |
| HPV31 | L2 | 235 | 11 | PTFLSAPKQLI | 14331 | |
| HPV31 | L2 | 156 | 9 | PTFTDPSVL | 14332 | |
| HPV31 | L2 | 388 | 8 | PTNTTVPL | 14333 | |
| HPV31 | L2 | 167 | 10 | PTPAETSGHL | 14334 | |
| HPV31 | L2 | 167 | 11 | PTPAETSGHLL | 14335 | |
| HPV31 | L2 | 415 | 9 | PTQVFPFPL | 14336 | |
| HPV31 | L2 | 425 | 8 | PTTPQVSI | 14337 | |
| HPV31 | L2 | 425 | 9 | PTTPQVSIF | 14338 | |
| HPV31 | L2 | 127 | 8 | PTTSGFDI | 14339 | |
| HPV31 | L2 | 97 | 9 | PVGPLDPSI | 14340 | |
| HPV31 | L2 | 92 | 10 | PVSIDPVGPL | 14341 | |
| HPV31 | L2 | 44 | 8 | QILRYGSM | 14342 | |
| HPV31 | L2 | 44 | 11 | QILRYGSMGVF | 14343 | |
| HPV31 | L2 | 243 | 10 | QLITYENPAY | 14344 | |
| HPV31 | L2 | 303 | 11 | QTLRTRSGATI | 14345 | |
| HPV31 | L2 | 229 | 9 | QVKVIDPTF | 14346 | |
| HPV31 | L2 | 229 | 10 | QVKVIDPTFL | 14347 | |
| HPV31 | L2 | 429 | 11 | QVSIFVDGGDF | 14348 | |
| HPV31 | L2 | 298 | 8 | RLGNKQTL | 14349 | |
| HPV31 | L2 | 9 | 10 | RTKRASATQL | 14350 | |
| HPV31 | L2 | 9 | 11 | RTKRASATQLY | 14351 | |
| HPV31 | L2 | 306 | 8 | RTRSGATI | 14352 | |
| HPV31 | L2 | 316 | 8 | RVHYYYDI | 14353 | |
| HPV31 | L2 | 316 | 11 | RVHYYYDISSI | 14354 | |
| HPV31 | L2 | 47 | 8 | RYGSMGVF | 14355 | |
| HPV31 | L2 | 47 | 9 | RYGSMGVFF | 14356 | |
| HPV31 | L2 | 295 | 11 | RYSRLGNKQTL | 14357 | |
| HPV31 | L2 | 94 | 8 | SIDPVGPL | 14358 | |
| HPV31 | L2 | 431 | 9 | SIFVDGGDF | 14359 | |
| HPV31 | L2 | 431 | 10 | SIFVDGGDFY | 14360 | |
| HPV31 | L2 | 431 | 11 | SIFVDGGDFYL | 14361 | |
| HPV31 | L2 | 325 | 9 | SINPAGESI | 14362 | |
| HPV31 | L2 | 325 | 11 | SINPAGESIEM | 14363 | |
| HPV31 | L2 | 86 | 10 | SIPIRPPVSI | 14364 | |
| HPV31 | L2 | 182 | 10 | SISTHNYEEI | 14365 | |
| HPV31 | L2 | 104 | 11 | SIVSLVEESGI | 14366 | |
| HPV31 | L2 | 107 | 8 | SLVEESGI | 14367 | |
| HPV31 | L2 | 260 | 11 | SLYFSNTSHNI | 14368 | |
| HPV31 | L2 | 50 | 9 | SMGVFFGGL | 14369 | |
| HPV31 | L2 | 50 | 11 | SMGVFFGGLGI | 14370 | |
| HPV31 | L2 | 396 | 8 | STGFDIPI | 14371 | |
| HPV31 | L2 | 396 | 9 | STGFDIPIF | 14372 | |
| HPV31 | L2 | 151 | 8 | STHENPTF | 14373 | |
| HPV31 | L2 | 184 | 8 | STHNYEEI | 14374 | |
| HPV31 | L2 | 184 | 10 | STHNYEEIPM | 14375 | |
| HPV31 | L2 | 346 | 8 | STLNDGLY | 14376 | |
| HPV31 | L2 | 346 | 10 | STLNDGLYDI | 14377 | |
| HPV31 | L2 | 346 | 11 | STLNDGLYDIY | 14378 | |
| HPV31 | L2 | 379 | 8 | STSAVSAY | 14379 | |
| HPV31 | L2 | 80 | 8 | STVSEASI | 14380 | |
| HPV31 | L2 | 80 | 10 | STVSEASIPI | 14381 | |
| HPV31 | L2 | 149 | 10 | SVSTHENPTF | 14382 | |
| HPV31 | L2 | 195 | 11 | TFIVSTNNENI | 14383 | |
| HPV31 | L2 | 236 | 9 | TFLSAPKQL | 14384 | |
| HPV31 | L2 | 236 | 10 | TFLSAPKQLI | 14385 | |
| HPV31 | L2 | 157 | 8 | TFTDPSVL | 14386 | |
| HPV31 | L2 | 40 | 9 | TIADQILRY | 14387 | |
| HPV31 | L2 | 312 | 8 | TIGARVHY | 14388 | |
| HPV31 | L2 | 312 | 9 | TIGARVHYY | 14389 | |
| HPV31 | L2 | 312 | 10 | TIGARVHYYY | 14390 | |
| HPV31 | L2 | 347 | 9 | TLNDGLYDI | 14391 | |
| HPV31 | L2 | 347 | 10 | TLNDGLYDIY | 14392 | |
| HPV31 | L2 | 304 | 10 | TLRTRSGATI | 14393 | |

TABLE X-continued

A24 Supermotif Peptides

| Type | Protein | Position | No. of Amino Acids | Sequence | A*2402 | Seq. Id. No. |
|---|---|---|---|---|---|---|
| HPV31 | L2 | 136 | 9 | TTADTTPAI | 14394 | |
| HPV31 | L2 | 136 | 10 | TTADTTPAIL | 14395 | |
| HPV31 | L2 | 39 | 8 | TTIADQIL | 14396 | |
| HPV31 | L2 | 39 | 10 | TTIADQILRY | 14397 | |
| HPV31 | L2 | 426 | 8 | TTPQVSIF | 14398 | |
| HPV3t | L2 | 344 | 9 | TTSTLNDGL | 14399 | |
| HPV31 | L2 | 344 | 10 | TTSTLNDGLY | 14400 | |
| HPV31 | L2 | 343 | 10 | TTTSTLNDGL | 14401 | |
| HPV31 | L2 | 343 | 11 | TTTSTLNDGLY | 14402 | |
| HPV31 | L2 | 391 | 9 | TTVPLSTGF | 14403 | |
| HPV31 | L2 | 391 | 11 | TTVPLSTGFDI | 14404 | |
| HPV31 | L2 | 254 | 8 | TVNAEESL | 14405 | |
| HPV31 | L2 | 254 | 9 | TVNAEESLY | 14406 | |
| HPV31 | L2 | 254 | 10 | TVNAEESLYF | 14407 | |
| HPV31 | L2 | 392 | 8 | TVPLSTGF | 14408 | |
| HPV31 | L2 | 392 | 10 | TVPLSTGFDI | 14409 | |
| HPV31 | L2 | 81 | 9 | TVSEASIPI | 14410 | |
| HPV31 | L2 | 53 | 8 | VFFGGLGI | 14411 | |
| HPV31 | L2 | 32 | 10 | VIPKIEHTTI | 14412 | |
| HPV31 | L2 | 262 | 9 | YFSNTSHNI | 14413 | |
| HPV31 | L2 | 440 | 8 | YLHPSYYM | 14414 | |
| HPV31 | L2 | 440 | 9 | YLHPSYYML | 14415 | |
| HPV31 | L2 | 386 | 10 | YVPTNTTVPL | 14416 | |
| HPV31 | L2 | 319 | 8 | YYYDISSI | 14417 | |
| HPV33 | E1 | 452 | 9 | AFKKFLKGI | 14418 | |
| HPV33 | E1 | 448 | 9 | AFLGAFKKF | 14419 | |
| HPV33 | E1 | 448 | 10 | AFLGAFKKFL | 14420 | |
| HPV33 | E1 | 384 | 11 | AFLKSNSQAKI | 14421 | |
| HPV33 | E1 | 596 | 10 | AINDENWKSF | 14422 | |
| HPV33 | E1 | 596 | 11 | AINDENWKSFF | 14423 | |
| HPV33 | E1 | 532 | 9 | ALDGNEISI | 14424 | |
| HPV33 | E1 | 546 | 10 | ALVQLKCPPL | 14425 | |
| HPV33 | E1 | 546 | 11 | ALVQLKCPPLL | 14426 | |
| HPV33 | E1 | 311 | 9 | ALYWFRTAM | 14427 | |
| HPV33 | E1 | 81 | 9 | AVCALKRKF | 14428 | |
| HPV33 | E1 | 22 | 11 | AVIERRTGDNI | 14429 | |
| HPV33 | E1 | 207 | 9 | AYGISFMEL | 14430 | |
| HPV33 | E1 | 259 | 8 | CLTCDRGI | 14431 | |
| HPV33 | E1 | 259 | 9 | CLTCDRGII | 14432 | |
| HPV33 | E1 | 259 | 10 | CLTCDRGIII | 14433 | |
| HPV33 | E1 | 259 | 11 | CLTCDRGIIIL | 14434 | |
| HPV33 | E1 | 297 | 9 | CMVIEPPKL | 14435 | |
| HPV33 | E1 | 226 | 9 | CTDWCITGY | 14436 | |
| HPV33 | E1 | 226 | 11 | CTDWCITGYGI | 14437 | |
| HPV33 | E1 | 14 | 11 | CTGWFEVEAVI | 14438 | |
| HPV33 | E1 | 118 | 8 | CTYRKRKI | 14439 | |
| HPV33 | E1 | 118 | 11 | CTYRKRKIDEL | 14440 | |
| HPV33 | E1 | 494 | 8 | CVNSKSHF | 14441 | |
| HPV33 | E1 | 494 | 9 | CVNSKSHFW | 14442 | |
| HPV33 | E1 | 494 | 10 | CVNSKSHFWL | 14443 | |
| HPV33 | E1 | 367 | 9 | DIAYYYAQL | 14444 | |
| HPV33 | E1 | 46 | 10 | DLLEFIDDSM | 14445 | |
| HPV33 | E1 | 78 | 8 | DLNAVCAL | 14446 | |
| HPV33 | E1 | 349 | 8 | DLSEMVQW | 14447 | |
| HPV33 | E1 | 349 | 10 | DLSEMVQWAY | 14448 | |
| HPV33 | E1 | 62 | 8 | DTEAARAL | 14449 | |
| HPV33 | E1 | 62 | 9 | DTEAARALF | 14450 | |
| HPV33 | E1 | 62 | 11 | DTEAARALFNI | 14451 | |
| HPV33 | E1 | 541 | 10 | DVKHRALVQL | 14452 | |
| HPV33 | E1 | 324 | 9 | DVQGTTPEW | 14453 | |
| HPV33 | E1 | 324 | 10 | DVQGTTPEWI | 14454 | |
| HPV33 | E1 | 516 | 9 | DVTPISWTY | 14455 | |
| HPV33 | E1 | 516 | 10 | DVTPISWTYI | 14456 | |
| HPV33 | E1 | 228 | 9 | DWCITGYGI | 14457 | |
| HPV33 | E1 | 49 | 11 | EFIDDSMENSI | 14458 | |
| HPV33 | E1 | 580 | 8 | EFKNPFPF | 14459 | |
| HPV33 | E1 | 445 | 9 | EFTAFLGAF | 14460 | |
| HPV33 | E1 | 537 | 11 | EISIDVKHRAL | 14461 | |
| HPV33 | E1 | 361 | 8 | ELTDDSDI | 14462 | |
| HPV33 | E1 | 361 | 10 | ELTDDSDIAY | 14463 | |
| HPV33 | E1 | 361 | 11 | ELTDDSDIAYY | 14464 | |
| HPV33 | E1 | 352 | 11 | EMVQWAYDNEL | 14465 | |
| HPV33 | E1 | 38 | 10 | ETADDSGTDL | 14466 | |
| HPV33 | E1 | 38 | 11 | ETADDSGTDLL | 14467 | |

TABLE X-continued

A24 Supermotif Peptides

| Type | Protein | Position | No. of Amino Acids | Sequence | A*2402 Seq. Id. No. |
|---|---|---|---|---|---|
| HPV33 | E1 | 295 | 11 | ETCMVIEPPKL | 14468 |
| HPV33 | E1 | 331 | 9 | EWIDRLTVL | 14469 |
| HPV33 | E1 | 605 | 9 | FFSRTWCKL | 14470 |
| HPV33 | E1 | 605 | 11 | FFSRTWCKLDL | 14471 |
| HPV33 | E1 | 50 | 10 | FIDDSMENSI | 14472 |
| HPV33 | E1 | 449 | 8 | FLGAFKKF | 14473 |
| HPV33 | E1 | 449 | 9 | FLGAFKKFL | 14474 |
| HPV33 | E1 | 456 | 11 | FLKGIPKKSCM | 14475 |
| HPV33 | E1 | 385 | 10 | FLKSNSQAKI | 14476 |
| HPV33 | E1 | 212 | 8 | FMELVRPF | 14477 |
| HPV33 | E1 | 446 | 8 | FTAFLGAF | 14478 |
| HPV33 | E1 | 446 | 11 | FTAFLGAFKKF | 14479 |
| HPV33 | E1 | 501 | 11 | FWLQPLSDAKI | 14480 |
| HPV33 | E1 | 265 | 8 | GIIILLLI | 14481 |
| HPV33 | E1 | 265 | 10 | GIIILLLIRF | 14482 |
| HPV33 | E1 | 459 | 8 | GIPKKSCM | 14483 |
| HPV33 | E1 | 459 | 9 | GIPKKSCML | 14484 |
| HPV33 | E1 | 459 | 10 | GIPKKSCMLI | 14485 |
| HPV33 | E1 | 209 | 11 | GISFMELVRPF | 14486 |
| HPV33 | E1 | 235 | 10 | GISPSVAESL | 14487 |
| HPV33 | E1 | 11 | 8 | GMGCTGWF | 14488 |
| HPV33 | E1 | 512 | 9 | GMIDDVTPI | 14489 |
| HPV33 | E1 | 512 | 11 | GMIDDVTPISW | 14490 |
| HPV33 | E1 | 480 | 8 | GMSLIQFL | 14491 |
| HPV33 | E1 | 44 | 8 | GTDLLEFI | 14492 |
| HPV33 | E1 | 564 | 8 | GTDSRWPY | 14493 |
| HPV33 | E1 | 564 | 9 | GTDSRWPYL | 14494 |
| HPV33 | E1 | 327 | 10 | GTTPEWIDRL | 14495 |
| HPV33 | E1 | 16 | 9 | GWFEVEAVI | 14496 |
| HPV33 | E1 | 256 | 11 | HLQCLTCDRGI | 14497 |
| HPV33 | E1 | 404 | 10 | HYKKAEKRKM | 14498 |
| HPV33 | E1 | 347 | 10 | IFDLSEMVQW | 14499 |
| HPV33 | E1 | 266 | 9 | IIILLLIRF | 14500 |
| HPV33 | E1 | 267 | 8 | IILLLIRF | 14501 |
| HPV33 | E1 | 200 | 9 | ILYKFKEAY | 14502 |
| HPV33 | E1 | 200 | 11 | ILYKFKEAYGI | 14503 |
| HPV33 | E1 | 394 | 8 | IVKDCGIM | 14504 |
| HPV33 | E1 | 435 | 10 | IVQLLRYQNI | 14505 |
| HPV33 | E1 | 203 | 8 | KFKEAYGI | 14506 |
| HPV33 | E1 | 203 | 10 | KFKEAYGISF | 14507 |
| HPV33 | E1 | 203 | 11 | KFKEAYGISFM | 14508 |
| HPV33 | E1 | 124 | 10 | KIDELEDSGY | 14509 |
| HPV33 | E1 | 510 | 11 | KIGMIDDVTPI | 14510 |
| HPV33 | E1 | 393 | 8 | KIVKDCGI | 14511 |
| HPV33 | E1 | 393 | 9 | KIVKDCGIM | 14512 |
| HPV33 | E1 | 285 | 9 | KLMSNLLSI | 14513 |
| HPV33 | E1 | 304 | 9 | KLRSQTCAL | 14514 |
| HPV33 | E1 | 304 | 10 | KLRSQTCALY | 14515 |
| HPV33 | E1 | 304 | 11 | KLRSQTCALYW | 14516 |
| HPV33 | E1 | 412 | 8 | KMSIGQWI | 14517 |
| HPV33 | E1 | 425 | 8 | KTNDGGNW | 14518 |
| HPV33 | E1 | 425 | 11 | KTNDGGNWRPI | 14519 |
| HPV33 | E1 | 223 | 9 | KTSCTDWCI | 14520 |
| HPV33 | E1 | 245 | 9 | KVLIKQHSL | 14521 |
| HPV33 | E1 | 245 | 10 | KVLIKQHSLY | 14522 |
| HPV33 | E1 | 69 | 11 | LFNIQEGEDDL | 14523 |
| HPV33 | E1 | 247 | 8 | LIKQHSLY | 14524 |
| HPV33 | E1 | 247 | 11 | LIKQHSLYTHL | 14525 |
| HPV33 | E1 | 483 | 10 | LIQFLKGCVI | 14526 |
| HPV33 | E1 | 271 | 11 | LIRFRCSKNRL | 14527 |
| HPV33 | E1 | 47 | 9 | LLEFIDDSM | 14528 |
| HPV33 | E1 | 438 | 9 | LLRYQNIEF | 14529 |
| HPV33 | E1 | 290 | 9 | LLSIPETCM | 14530 |
| HPV33 | E1 | 290 | 11 | LLSIPETCMVI | 14531 |
| HPV33 | E1 | 286 | 8 | LMSNLLSI | 14532 |
| HPV33 | E1 | 260 | 8 | LTCDRGII | 14533 |
| HPV33 | E1 | 260 | 9 | LTCDRGIII | 14534 |
| HPV33 | E1 | 260 | 10 | LTCDRGIIIL | 14535 |
| HPV33 | E1 | 260 | 11 | LTCDRGIIILL | 14536 |
| HPV33 | E1 | 362 | 9 | LTDDSDIAY | 14537 |
| HPV33 | E1 | 362 | 10 | LTDDSDIAYY | 14538 |
| HPV33 | E1 | 362 | 11 | LTDDSDIAYYY | 14539 |
| HPV33 | E1 | 281 | 10 | LTVAKLMSNL | 14540 |
| HPV33 | E1 | 281 | 11 | LTVAKLMSNLL | 14541 |

TABLE X-continued

A24 Supermotif Peptides

| Type | Protein | Position | No. of Amino Acids | Sequence | A*2402 | Seq. Id. No. |
|---|---|---|---|---|---|---|
| HPV33 | E1 | 576 | 10 | LTVFEFKNPF | 14542 | |
| HPV33 | E1 | 336 | 8 | LTVLQHSF | 14543 | |
| HPV33 | E1 | 547 | 9 | LVQLKCPPL | 14544 | |
| HPV33 | E1 | 547 | 10 | LVQLKCPPLL | 14545 | |
| HPV33 | E1 | 547 | 11 | LVQLKCPPLLL | 14546 | |
| HPV33 | E1 | 201 | 8 | LYKFKEAY | 14547 | |
| HPV33 | E1 | 201 | 10 | LYKFKEAYGI | 14548 | |
| HPV33 | E1 | 253 | 8 | LYTHLQCL | 14549 | |
| HPV33 | E1 | 312 | 8 | LYWFRTAM | 14550 | |
| HPV33 | E1 | 312 | 11 | LYWFRTAMSNI | 14551 | |
| HPV33 | E1 | 513 | 8 | MIDDVTPI | 14552 | |
| HPV33 | E1 | 513 | 10 | MIDDVTPISW | 14553 | |
| HPV33 | E1 | 298 | 8 | MVIEPPKL | 14554 | |
| HPV33 | E1 | 353 | 10 | MVQWAYDNEL | 14555 | |
| HPV33 | E1 | 443 | 8 | NIEFTAFL | 14556 | |
| HPV33 | E1 | 443 | 11 | NIEFTAFLGAF | 14557 | |
| HPV33 | E1 | 346 | 8 | NIFDLSEM | 14558 | |
| HPV33 | E1 | 346 | 11 | NIFDLSEMVQW | 14559 | |
| HPV33 | E1 | 199 | 10 | NILYKFKEAY | 14560 | |
| HPV33 | E1 | 71 | 9 | NIQEGEDDL | 14561 | |
| HPV33 | E1 | 289 | 10 | NLLSIPETCM | 14562 | |
| HPV33 | E1 | 135 | 9 | NTEVETQQM | 14563 | |
| HPV33 | E1 | 473 | 9 | NTGKSYFGM | 14564 | |
| HPV33 | E1 | 473 | 11 | NTGKSYFGMSL | 14565 | |
| HPV33 | E1 | 195 | 8 | NTKANILY | 14566 | |
| HPV33 | E1 | 195 | 10 | NTKANILYKF | 14567 | |
| HPV33 | E1 | 560 | 10 | NTNAGTDSRW | 14568 | |
| HPV33 | E1 | 175 | 10 | NVDSCENVTL | 14569 | |
| HPV33 | E1 | 181 | 11 | NVTLQEISNVL | 14570 | |
| HPV33 | E1 | 601 | 10 | NWKSFFSRTW | 14571 | |
| HPV33 | E1 | 431 | 8 | NWRPIVQL | 14572 | |
| HPV33 | E1 | 431 | 9 | NWRPIVQLL | 14573 | |
| HPV33 | E1 | 431 | 11 | NWRPIVQLLRY | 14574 | |
| HPV33 | E1 | 586 | 10 | PFDENGNPVY | 14575 | |
| HPV33 | E1 | 519 | 10 | PISWTYIDDY | 14576 | |
| HPV33 | E1 | 519 | 11 | PISWTYIDDYM | 14577 | |
| HPV33 | E1 | 434 | 8 | PIVQLLRY | 14578 | |
| HPV33 | E1 | 434 | 11 | PIVQLLRYQNI | 14579 | |
| HPV33 | E1 | 505 | 9 | PLSDAKIGM | 14580 | |
| HPV33 | E1 | 505 | 10 | PLSDAKIGMI | 14581 | |
| HPV33 | E1 | 593 | 10 | PVYAINDENW | 14582 | |
| HPV33 | E1 | 570 | 10 | PYLHSRLTVF | 14583 | |
| HPV33 | E1 | 485 | 8 | QFLKGCVI | 14584 | |
| HPV33 | E1 | 549 | 8 | QLKCPPLL | 14585 | |
| HPV33 | E1 | 549 | 9 | QLKCPPLLL | 14586 | |
| HPV33 | E1 | 437 | 8 | QLLRYQNI | 14587 | |
| HPV33 | E1 | 437 | 10 | QLLRYQNIEF | 14588 | |
| HPV33 | E1 | 308 | 8 | QTCALYWF | 14589 | |
| HPV33 | E1 | 146 | 11 | QVESQNGDTNL | 14590 | |
| HPV33 | E1 | 355 | 8 | QWAYDNEL | 14591 | |
| HPV33 | E1 | 273 | 9 | RFRCSKNRL | 14592 | |
| HPV33 | E1 | 280 | 8 | RLTVAKLM | 14593 | |
| HPV33 | E1 | 280 | 11 | RLTVAKLMSNL | 14594 | |
| HPV33 | E1 | 575 | 11 | RLTVFEFKNPF | 14595 | |
| HPV33 | E1 | 335 | 9 | RLTVLQHSF | 14596 | |
| HPV33 | E1 | 608 | 8 | RTWCKLDL | 14597 | |
| HPV33 | E1 | 608 | 9 | RTWCKLDLI | 14598 | |
| HPV33 | E1 | 568 | 9 | RWPYLHSRL | 14599 | |
| HPV33 | E1 | 440 | 10 | RYQNIEFTAF | 14600 | |
| HPV33 | E1 | 440 | 11 | RYQNIEFTAFL | 14601 | |
| HPV33 | E1 | 604 | 10 | SFFSRTWCKL | 14602 | |
| HPV33 | E1 | 211 | 9 | SFMELVRPF | 14603 | |
| HPV33 | E1 | 342 | 9 | SFNDNIFDL | 14604 | |
| HPV33 | E1 | 539 | 9 | SIDVKHRAL | 14605 | |
| HPV33 | E1 | 111 | 10 | SINKNKECTY | 14606 | |
| HPV33 | E1 | 292 | 9 | SIPETCMVI | 14607 | |
| HPV33 | E1 | 482 | 11 | SLIQFLKGCVI | 14608 | |
| HPV33 | E1 | 243 | 11 | SLKVLIKQHSL | 14609 | |
| HPV33 | E1 | 252 | 9 | SLYTHLQCL | 14610 | |
| HPV33 | E1 | 239 | 9 | SVAESLKVL | 14611 | |
| HPV33 | E1 | 239 | 10 | SVAESLKVLI | 14612 | |
| HPV33 | E1 | 521 | 8 | SWTYIDDY | 14613 | |
| HPV33 | E1 | 521 | 9 | SWTYIDDYM | 14614 | |
| HPV33 | E1 | 477 | 8 | SYFGMSLI | 14615 | |

TABLE X-continued

A24 Supermotif Peptides

| Type | Protein | Position | No. of Amino Acids | Sequence | A*2402 | Seq. Id. No. |
|---|---|---|---|---|---|---|
| HPV33 | E1 | 477 | 10 | SYFGMSLIQF | 14616 | |
| HPV33 | E1 | 477 | 11 | SYFGMSLIQFL | 14617 | |
| HPV33 | E1 | 183 | 9 | TLQEISNVL | 14618 | |
| HPV33 | E1 | 328 | 9 | TTPEWIDRL | 14619 | |
| HPV33 | E1 | 282 | 9 | TVAKLMSNL | 14620 | |
| HPV33 | E1 | 282 | 10 | TVAKLMSNLL | 14621 | |
| HPV33 | E1 | 577 | 9 | TVFEFKNPF | 14622 | |
| HPV33 | E1 | 577 | 11 | TVFEFKNPFPF | 14623 | |
| HPV33 | E1 | 337 | 11 | TVLQHSFNDNI | 14624 | |
| HPV33 | E1 | 609 | 8 | TWCKLDLI | 14625 | |
| HPV33 | E1 | 523 | 11 | TYIDDYMRNAL | 14626 | |
| HPV33 | E1 | 119 | 10 | TYRKRKIDEL | 14627 | |
| HPV33 | E1 | 578 | 8 | VFEFKNPF | 14628 | |
| HPV33 | E1 | 578 | 10 | VFEFKNPFPF | 14629 | |
| HPV33 | E1 | 23 | 10 | VIERRTGDNI | 14630 | |
| HPV33 | E1 | 491 | 11 | VISCVNSKSHF | 14631 | |
| HPV33 | E1 | 190 | 11 | VLHSSNTKANI | 14632 | |
| HPV33 | E1 | 246 | 8 | VLIKQHSL | 14633 | |
| HPV33 | E1 | 246 | 9 | VLIKQHSLY | 14634 | |
| HPV33 | E1 | 338 | 10 | VLQHSFNDNI | 14635 | |
| HPV33 | E1 | 338 | 11 | VLQHSFNDNIF | 14636 | |
| HPV33 | E1 | 182 | 10 | VTLQEISNVL | 14637 | |
| HPV33 | E1 | 517 | 8 | VTPISWTY | 14638 | |
| HPV33 | E1 | 517 | 9 | VTPISWTYI | 14639 | |
| HPV33 | E1 | 594 | 9 | VYAINDENW | 14640 | |
| HPV33 | E1 | 17 | 8 | WFEVEAVI | 14641 | |
| HPV33 | E1 | 314 | 9 | WFRTAMSNI | 14642 | |
| HPV33 | E1 | 332 | 8 | WIDRLTVL | 14643 | |
| HPV33 | E1 | 502 | 10 | WLQPLSDAKI | 14644 | |
| HPV33 | E1 | 522 | 8 | WTYIDDYM | 14645 | |
| HPV33 | E1 | 478 | 9 | YFGMSLIQF | 14646 | |
| HPV33 | E1 | 478 | 10 | YFGMSLIQFL | 14647 | |
| HPV33 | E1 | 524 | 10 | YIDDYMRNAL | 14648 | |
| HPV33 | E1 | 571 | 9 | YLHSRLTVF | 14649 | |
| HPV33 | E1 | 571 | 11 | YLHSRLTVFEF | 14650 | |
| HPV33 | E1 | 528 | 11 | YMRNALDGNEI | 14651 | |
| HPV33 | E1 | 313 | 10 | YWFRTAMSNI | 14652 | |
| HPV33 | E2 | 69 | 9 | AFQVIELQM | 14653 | |
| HPV33 | E2 | 69 | 11 | AFQVIELQMAL | 14654 | |
| HPV33 | E2 | 78 | 10 | ALETLSKSQY | 14655 | |
| HPV33 | E2 | 41 | 9 | ALLYTAKQM | 14656 | |
| HPV33 | E2 | 41 | 11 | ALLYTAKQMGF | 14657 | |
| HPV33 | E2 | 10 | 9 | AVQEKILDL | 14658 | |
| HPV33 | E2 | 10 | 10 | AVQEKILDLY | 14659 | |
| HPV33 | E2 | 288 | 9 | CLRYRLKPY | 14660 | |
| HPV33 | E2 | 145 | 10 | CTMVTGKVDY | 14661 | |
| HPV33 | E2 | 145 | 11 | CTMVTGKVDYI | 14662 | |
| HPV33 | E2 | 25 | 9 | DLPSQIEHW | 14663 | |
| HPV33 | E2 | 25 | 11 | DLPSQIEHWKL | 14664 | |
| HPV33 | E2 | 17 | 10 | DLYEADKTDL | 14665 | |
| HPV33 | E2 | 235 | 9 | DTAQPLTKL | 14666 | |
| HPV33 | E2 | 235 | 10 | DTAQPLTKLF | 14667 | |
| HPV33 | E2 | 232 | 9 | DTTDTAQPL | 14668 | |
| HPV33 | E2 | 153 | 8 | DYIGMYYI | 14669 | |
| HPV33 | E2 | 130 | 8 | DYTNWGEI | 14670 | |
| HPV33 | E2 | 130 | 9 | DYTNWGEIY | 14671 | |
| HPV33 | E2 | 130 | 10 | DYTNWGEIYI | 14672 | |
| HPV33 | E2 | 130 | 11 | DYTNWGEIYII | 14673 | |
| HPV33 | E2 | 74 | 9 | ELQMALETL | 14674 | |
| HPV33 | E2 | 298 | 10 | ELYSSMSSTW | 14675 | |
| HPV33 | E2 | 80 | 8 | ETLSKSQY | 14676 | |
| HPV33 | E2 | 185 | 9 | EVHVGGQVI | 14677 | |
| HPV33 | E2 | 100 | 11 | EVWLCEPPKCF | 14678 | |
| HPV33 | E2 | 325 | 9 | FVTEQQQQM | 14679 | |
| HPV33 | E2 | 325 | 10 | FVTEQQQQMF | 14680 | |
| HPV33 | E2 | 325 | 11 | FVTEQQQQMFL | 14681 | |
| HPV33 | E2 | 336 | 11 | GTVKIPPTVQI | 14682 | |
| HPV33 | E2 | 53 | 10 | HLCHQVVPSL | 14683 | |
| HPV33 | E2 | 53 | 11 | HLCHQVVPSLL | 14684 | |
| HPV33 | E2 | 278 | 9 | HLKGESNSL | 14685 | |
| HPV33 | E2 | 32 | 11 | HWKLIRMECAL | 14686 | |
| HPV33 | E2 | 139 | 9 | IIEEDTCTM | 14687 | |
| HPV33 | E2 | 276 | 11 | IVHLKGESNSL | 14688 | |
| HPV33 | E2 | 137 | 11 | IYIIEEDTCTM | 14689 | |

TABLE X-continued

A24 Supermotif Peptides

| Type | Protein | Position | No. of Amino Acids | Sequence | A*2402 | Seq. Id. No. |
|---|---|---|---|---|---|---|
| HPV33 | E2 | 339 | 8 | KIPPIVQI | 14690 | |
| HPV33 | E2 | 242 | 9 | KLFCADPAL | 14691 | |
| HPV33 | E2 | 34 | 9 | KLIRMECAL | 14692 | |
| HPV33 | E2 | 34 | 10 | KLIRMECALL | 14693 | |
| HPV33 | E2 | 34 | 11 | KLIRMECALLY | 14694 | |
| HPV33 | E2 | 23 | 8 | KTDLPSQI | 14695 | |
| HPV33 | E2 | 23 | 11 | KTDLPSQIEHW | 14696 | |
| HPV33 | E2 | 66 | 8 | KTKAFQVI | 14697 | |
| HPV33 | E2 | 66 | 10 | KTKAFQVIEL | 14698 | |
| HPV33 | E2 | 151 | 8 | KVDYIGMY | 14699 | |
| HPV33 | E2 | 151 | 9 | KVDYIGMYY | 14700 | |
| HPV33 | E2 | 151 | 10 | KVDYIGMYYI | 14701 | |
| HPV33 | E2 | 169 | 10 | KYFKEDAAKY | 14702 | |
| HPV33 | E2 | 177 | 8 | KYSKTQMW | 14703 | |
| HPV33 | E2 | 243 | 8 | LFCADPAL | 14704 | |
| HPV33 | E2 | 35 | 8 | LIRMECAL | 14705 | |
| HPV33 | E2 | 35 | 9 | LIRMECALL | 14706 | |
| HPV33 | E2 | 35 | 10 | LIRMECALLY | 14707 | |
| HPV33 | E2 | 62 | 9 | LLASKTKAF | 14708 | |
| HPV33 | E2 | 42 | 8 | LLYTAKQM | 14709 | |
| HPV33 | E2 | 42 | 10 | LLYTAKQMGF | 14710 | |
| HPV33 | E2 | 240 | 11 | LTKLFCADPAL | 14711 | |
| HPV33 | E2 | 18 | 9 | LYEADKTDL | 14712 | |
| HPV33 | E2 | 299 | 9 | LYSSMSSTW | 14713 | |
| HPV33 | E2 | 299 | 11 | LYSSMSSTWHW | 14714 | |
| HPV33 | E2 | 43 | 9 | LYTAKQMGF | 14715 | |
| HPV33 | E2 | 333 | 8 | MFLGTVKI | 14716 | |
| HPV33 | E2 | 147 | 8 | MVTGKVDY | 14717 | |
| HPV33 | E2 | 147 | 9 | MVTGKVDYI | 14718 | |
| HPV33 | E2 | 147 | 11 | MVTGKVDYIGM | 14179 | |
| HPV33 | E2 | 183 | 11 | MWEVHVGGQVI | 14720 | |
| HPV33 | E2 | 157 | 11 | MYYIHNCEKVY | 14721 | |
| HPV33 | E2 | 127 | 8 | NTMDYTNW | 14722 | |
| HPV33 | E2 | 127 | 11 | NTMDYTNWGEI | 14723 | |
| HPV33 | E2 | 272 | 8 | NVAPIVHL | 14724 | |
| HPV33 | E2 | 133 | 8 | NWGEIYII | 14725 | |
| HPV33 | E2 | 196 | 9 | PTSISSNQI | 14726 | |
| HPV33 | E2 | 342 | 9 | PTVQISTGF | 14727 | |
| HPV33 | E2 | 342 | 10 | PTVQISTGFM | 14728 | |
| HPV33 | E2 | 295 | 9 | PYKELYSSM | 14729 | |
| HPV33 | E2 | 29 | 8 | QIEHWKLI | 14730 | |
| HPV33 | E2 | 29 | 10 | QIEHWKLIRM | 14731 | |
| HPV33 | E2 | 345 | 9 | QISTGFMTL | 14732 | |
| HPV33 | E2 | 203 | 10 | QISTTETADI | 14733 | |
| HPV33 | E2 | 332 | 9 | QMFLGTVKI | 14734 | |
| HPV33 | E2 | 96 | 8 | QTSLEVWL | 14735 | |
| HPV33 | E2 | 71 | 9 | QVIELQMAL | 14736 | |
| HPV33 | E2 | 191 | 9 | QVIVCPTSI | 14737 | |
| HPV33 | E2 | 91 | 9 | QWTLQQTSL | 14738 | |
| HPV33 | E2 | 120 | 10 | QYDNDKKNTM | 14739 | |
| HPV33 | E2 | 86 | 9 | QYSTSQWTL | 14740 | |
| HPV33 | E2 | 292 | 8 | RLKPYKEL | 14741 | |
| HPV33 | E2 | 292 | 9 | RLKPYKELY | 14742 | |
| HPV33 | E2 | 7 | 9 | RLNAVQEKI | 14743 | |
| HPV33 | E2 | 7 | 10 | RLNAVQEKIL | 14744 | |
| HPV33 | E2 | 37 | 8 | RMECALLY | 14745 | |
| HPV33 | E2 | 266 | 11 | RTVCSSNVAPI | 14746 | |
| HPV33 | E2 | 290 | 10 | RYRLKPYKEL | 14747 | |
| HPV33 | E2 | 290 | 11 | RYRLKPYKELY | 14748 | |
| HPV33 | E2 | 285 | 9 | SLKCLRYRL | 14749 | |
| HPV33 | E2 | 61 | 10 | SLLASKTKAF | 14750 | |
| HPV33 | E2 | 302 | 8 | SMSSTWHW | 14751 | |
| HPV33 | E2 | 205 | 8 | STTETADI | 14752 | |
| HPV33 | E2 | 324 | 10 | TFVTEQQQQM | 14753 | |
| HPV33 | E2 | 324 | 11 | TFVTEQQQQMF | 14754 | |
| HPV33 | E2 | 93 | 10 | TLQQTSLEVW | 14755 | |
| HPV33 | E2 | 93 | 11 | TLQQTSLEVWL | 14756 | |
| HPV33 | E2 | 128 | 10 | TMDYTNWGEI | 14757 | |
| HPV33 | E2 | 128 | 11 | TMDYTNWGEIY | 14758 | |
| HPV33 | E2 | 146 | 9 | TMVTGKVDY | 14759 | |
| HPV33 | E2 | 146 | 10 | TMVTGKVDYI | 14760 | |
| HPV33 | E2 | 233 | 8 | TTDTAQPL | 14761 | |
| HPV33 | E2 | 233 | 11 | TTDTAQPLTKL | 14762 | |
| HPV33 | E2 | 267 | 10 | TVCSSNVAPI | 14763 | |

TABLE X-continued

A24 Supermotif Peptides

| Type | Protein | Position | No. of Amino Acids | Sequence | A*2402 | Seq. Id. No. |
|---|---|---|---|---|---|---|
| HPV33 | E2 | 337 | 10 | TVKIPPTVQI | 14764 | |
| HPV33 | E2 | 343 | 8 | TVQISTGF | 14765 | |
| HPV33 | E2 | 343 | 9 | TVQISTGFM | 14766 | |
| HPV33 | E2 | 343 | 11 | TVQISTGFMTL | 14767 | |
| HPV33 | E2 | 72 | 8 | VIELQMAL | 14768 | |
| HPV33 | E2 | 72 | 11 | VIELQMALETL | 14769 | |
| HPV33 | E2 | 192 | 8 | VIVCPTSI | 14770 | |
| HPV33 | E2 | 326 | 8 | VTEQQQQM | 14771 | |
| HPV33 | E2 | 326 | 9 | VTEQQQQMF | 14772 | |
| HPV33 | E2 | 326 | 10 | VTEQQQQMFL | 14773 | |
| HPV33 | E2 | 323 | 11 | VTFVTEQQQQM | 14774 | |
| HPV33 | E2 | 148 | 8 | VTGKVDYI | 14775 | |
| HPV33 | E2 | 148 | 10 | VTGKVDYIGM | 14776 | |
| HPV33 | E2 | 148 | 11 | VTGKVDYIGMY | 14777 | |
| HPV33 | E2 | 101 | 10 | VWLCEPPKCF | 14778 | |
| HPV33 | E2 | 102 | 9 | WLCEPPKCF | 14779 | |
| HPV33 | E2 | 92 | 8 | WTLQQTSL | 14780 | |
| HPV33 | E2 | 92 | 11 | WTLQQTSLEVW | 14781 | |
| HPV33 | E2 | 170 | 9 | YFKEDAAKY | 14782 | |
| HPV33 | E2 | 159 | 9 | YIHNCEKVY | 14783 | |
| HPV33 | E2 | 159 | 10 | YIHNCEKVYF | 14784 | |
| HPV33 | E2 | 138 | 10 | YIIEEDTCTM | 14785 | |
| HPV33 | E2 | 44 | 8 | YTAKQMGF | 14786 | |
| HPV33 | E2 | 44 | 11 | YTAKQMGFSHL | 14787 | |
| HPV33 | E2 | 131 | 8 | YTNWGEIY | 14788 | |
| HPV33 | E2 | 131 | 9 | YTNWGEIYI | 14789 | |
| HPV33 | E2 | 131 | 10 | YTNWGEIYII | 14790 | |
| HPV33 | E2 | 158 | 10 | YYIHNCEKVY | 14791 | |
| HPV33 | E2 | 158 | 11 | YYIHNCEKVYF | 14792 | |
| HPV33 | E5 | 30 | 8 | AWLLVLVL | 14793 | |
| HPV33 | E5 | 30 | 9 | AWLLVLVLL | 14794 | |
| HPV33 | E5 | 30 | 10 | AWLLVLVLLL | 14795 | |
| HPV33 | E5 | 30 | 11 | AWLLVLVLLLW | 14796 | |
| HPV33 | E5 | 8 | 8 | CFILFLCL | 14797 | |
| HPV33 | E5 | 8 | 10 | CFILFLCLSL | 14798 | |
| HPV33 | E5 | 8 | 11 | CFILFLCLSLL | 14799 | |
| HPV33 | E5 | 63 | 9 | CINFHAQHM | 14800 | |
| HPV33 | E5 | 14 | 9 | CLSLLLRPL | 14801 | |
| HPV33 | E5 | 14 | 10 | CLSLLLRPLI | 14802 | |
| HPV33 | E5 | 14 | 11 | CLSLLLRRLIL | 14803 | |
| HPV33 | E5 | 52 | 8 | CYLLFLYL | 14804 | |
| HPV33 | E5 | 52 | 10 | CYLLFLYLPM | 14805 | |
| HPV33 | E5 | 52 | 11 | CYLLFLYLPMM | 14806 | |
| HPV33 | E5 | 50 | 8 | FFCYLLFL | 14807 | |
| HPV33 | E5 | 50 | 9 | FFCYLLFLY | 14808 | |
| HPV33 | E5 | 50 | 10 | FFCYLLFLYL | 14809 | |
| HPV33 | E5 | 9 | 9 | FILFLCLSL | 14810 | |
| HPV33 | E5 | 9 | 10 | FILFLCLSLL | 14811 | |
| HPV33 | E5 | 9 | 11 | FILFLCLSLLL | 14812 | |
| HPV33 | E5 | 12 | 8 | FLCLSLLL | 14813 | |
| HPV33 | E5 | 12 | 11 | FLCLSLLLRPL | 14814 | |
| HPV33 | E5 | 56 | 9 | FLYLPMMCI | 14815 | |
| HPV33 | E5 | 56 | 11 | FLYLPMMCINF | 14816 | |
| HPV33 | E5 | 3 | 8 | FVFVLCFI | 14817 | |
| HPV33 | E5 | 3 | 9 | FVFVLCFIL | 14818 | |
| HPV33 | E5 | 3 | 10 | FVFVLCFILF | 14819 | |
| HPV33 | E5 | 3 | 11 | FVFVLCFILFL | 14820 | |
| HPV33 | E5 | 42 | 8 | FVGSPLKI | 14821 | |
| HPV33 | E5 | 42 | 9 | FVGSPLKIF | 14822 | |
| HPV33 | E5 | 42 | 10 | FVGSPLKIFF | 14823 | |
| HPV33 | E5 | 5 | 8 | FVLCFILF | 14824 | |
| HPV33 | E5 | 5 | 9 | FVLCFILFL | 14825 | |
| HPV33 | E5 | 5 | 11 | FVLCFILFLCL | 14826 | |
| HPV33 | E5 | 49 | 8 | IFFCYLLF | 14827 | |
| HPV33 | E5 | 49 | 9 | IFFCYLLFL | 14828 | |
| HPV33 | E5 | 49 | 10 | IFFCYLLFLY | 14829 | |
| HPV33 | E5 | 49 | 11 | IFFCYLLFLYL | 14830 | |
| HPV33 | E5 | 2 | 8 | IFVFVLCF | 14831 | |
| HPV33 | E5 | 2 | 9 | IFVFVLCFI | 14832 | |
| HPV33 | E5 | 2 | 10 | IFVFVLCFIL | 14833 | |
| HPV33 | E5 | 2 | 11 | IFVFVLCFILF | 14834 | |
| HPV33 | E5 | 10 | 8 | ILFLCLSL | 14835 | |
| HPV33 | E5 | 10 | 9 | ILFLCLSLL | 14836 | |
| HPV33 | E5 | 10 | 10 | ILFLCLSLLL | 14837 | |

TABLE X-continued

A24 Supermotif Peptides

| Type | Protein | Position | No. of Amino Acids | Sequence | A*2402 Seq. Id. No. |
|---|---|---|---|---|---|
| HPV33 | E5 | 23 | 9 | ILSISTYAW | 14838 |
| HPV33 | E5 | 23 | 10 | ILSISTYAWL | 14839 |
| HPV33 | E5 | 23 | 11 | ILSISTYAWLL | 14840 |
| HPV33 | E5 | 48 | 8 | KIFFCYLL | 14841 |
| HPV33 | E5 | 48 | 9 | KIFFCYLLF | 14842 |
| HPV33 | E5 | 48 | 10 | KIFFCYLLFL | 14843 |
| HPV33 | E5 | 48 | 11 | KIFFCYLLFLY | 14844 |
| HPV33 | E5 | 11 | 8 | LFLCLSLL | 14845 |
| HPV33 | E5 | 11 | 9 | LFLCLSLLL | 14846 |
| HPV33 | E5 | 55 | 8 | LFLYLPMM | 14847 |
| HPV33 | E5 | 55 | 10 | LFLYLPMMCI | 14848 |
| HPV33 | E5 | 22 | 8 | LILSISTY | 14849 |
| HPV33 | E5 | 22 | 10 | LILSISTYAW | 14850 |
| HPV33 | E5 | 22 | 11 | LILSISTYAWL | 14851 |
| HPV33 | E5 | 54 | 8 | LLFLYLPM | 14852 |
| HPV33 | E5 | 54 | 9 | LLFLYLPMM | 14853 |
| HPV33 | E5 | 54 | 11 | LLFLYLPMMCI | 14854 |
| HPV33 | E5 | 17 | 8 | LLLRPLIL | 14855 |
| HPV33 | E5 | 17 | 10 | LLLRPLILSI | 14856 |
| HPV33 | E5 | 37 | 11 | LLLWVFVGSPL | 14857 |
| HPV33 | E5 | 18 | 9 | LLRPLILSI | 14858 |
| HPV33 | E5 | 32 | 8 | LLVLVLLL | 14859 |
| HPV33 | E5 | 32 | 9 | LLVLVLLLW | 14860 |
| HPV33 | E5 | 32 | 11 | LLVLVLLLWVF | 14861 |
| HPV33 | E5 | 38 | 10 | LLWVFVGSPL | 14862 |
| HPV33 | E5 | 35 | 8 | LVLLLWVF | 14863 |
| HPV33 | E5 | 33 | 8 | LVLVLLLW | 14864 |
| HPV33 | E5 | 33 | 10 | LVLVLLLWVF | 14865 |
| HPV33 | E5 | 39 | 9 | LWVFVGSPL | 14866 |
| HPV33 | E5 | 39 | 11 | LWVFVGSPLKI | 14867 |
| HPV33 | E5 | 57 | 8 | LYLPMMCI | 14868 |
| HPV33 | E5 | 57 | 10 | LYLPMMCINF | 14869 |
| HPV33 | E5 | 1 | 9 | MIFVFVLCF | 14870 |
| HPV33 | E5 | 1 | 10 | MIFVFVLCFI | 14871 |
| HPV33 | E5 | 1 | 11 | MIFVFVLCFIL | 14872 |
| HPV33 | E5 | 61 | 11 | MMCINFHAQHM | 14873 |
| HPV33 | E5 | 21 | 9 | PLILSISTY | 14874 |
| HPV33 | E5 | 21 | 11 | PLILSISTYAW | 14875 |
| HPV33 | E5 | 46 | 8 | PLKIFFCY | 14876 |
| HPV33 | E5 | 46 | 9 | PLKIFFCYL | 14877 |
| HPV33 | E5 | 46 | 10 | PLKIFFCYLL | 14878 |
| HPV33 | E5 | 46 | 11 | PLKIFFCYLLF | 14879 |
| HPV33 | E5 | 25 | 8 | SISTYAWL | 14880 |
| HPV33 | E5 | 25 | 9 | SISTYAWLL | 14881 |
| HPV33 | E5 | 25 | 11 | SISTYAWLLVL | 14882 |
| HPV33 | E5 | 16 | 8 | SLLLRPLI | 14883 |
| HPV33 | E5 | 16 | 9 | SLLLRPLIL | 14884 |
| HPV33 | E5 | 16 | 11 | SLLLRPLILSI | 14885 |
| HPV33 | E5 | 27 | 9 | STYAWLLVL | 14886 |
| HPV33 | E5 | 27 | 11 | STYAWLLVLVL | 14887 |
| HPV33 | E5 | 28 | 8 | TYAWLLVL | 14888 |
| HPV33 | E5 | 28 | 10 | TYAWLLVLVL | 14889 |
| HPV33 | E5 | 28 | 11 | TYAWLLVLVLL | 14890 |
| HPV33 | E5 | 41 | 9 | VFVGSPLKI | 14891 |
| HPV33 | E5 | 41 | 10 | VFVGSPLKIF | 14892 |
| HPV33 | E5 | 41 | 11 | VFVGSPLKIFF | 14893 |
| HPV33 | E5 | 4 | 8 | VFVLCFIL | 14894 |
| HPV33 | E5 | 4 | 9 | VFVLCFILF | 14895 |
| HPV33 | E5 | 4 | 10 | VFVLCFILFL | 14896 |
| HPV33 | E5 | 6 | 8 | VLCFILFL | 14897 |
| HPV33 | E5 | 6 | 10 | VLCFILFLCL | 14898 |
| HPV33 | E5 | 34 | 9 | VLVLLLWVF | 14899 |
| HPV33 | E5 | 31 | 8 | WLLVLVLL | 14900 |
| HPV33 | E5 | 31 | 9 | WLLVLVLLL | 14901 |
| HPV33 | E5 | 31 | 10 | WLLVLVLLLW | 14902 |
| HPV33 | E5 | 40 | 8 | WVFVGSPL | 14903 |
| HPV33 | E5 | 40 | 10 | WVFVGSPLKI | 14904 |
| HPV33 | E5 | 40 | 11 | WVFVGSPLKIF | 14905 |
| HPV33 | E5 | 53 | 9 | YLLFLYLPM | 14906 |
| HPV33 | E5 | 53 | 10 | YLLFLYLPMM | 14907 |
| HPV33 | E5 | 58 | 9 | YLPMMCINF | 14908 |
| HPV33 | E6 | 46 | 9 | AFADLTVVY | 14909 |
| HPV33 | E6 | 18 | 9 | ALETTIHNI | 14910 |
| HPV33 | E6 | 18 | 11 | ALETTIHNIEL | 14911 |

TABLE X-continued

A24 Supermotif Peptides

| Type | Protein | Position | No. of Amino Acids | Sequence | A*2402 | Seq. Id. No. |
|---|---|---|---|---|---|---|
| HPV33 | E6 | 103 | 8 | CIICQRPL | 14912 | |
| HPV33 | E6 | 66 | 8 | CLRFLSKI | 14913 | |
| HPV33 | E6 | 66 | 11 | CLRFLSKISEY | 14914 | |
| HPV33 | E6 | 30 | 8 | CVECKKPL | 14915 | |
| HPV33 | E6 | 139 | 11 | CWRSRRRETAL | 14916 | |
| HPV33 | E6 | 44 | 11 | DFAFADLTVVY | 14917 | |
| HPV33 | E6 | 14 | 10 | DLCQALETTI | 14918 | |
| HPV33 | E6 | 120 | 9 | DLNKRFHNI | 14919 | |
| HPV33 | E6 | 4 | 9 | DTEEKPRTL | 14920 | |
| HPV33 | E6 | 98 | 8 | EILIRCII | 14921 | |
| HPV33 | E6 | 27 | 11 | ELQCVECKKPL | 14922 | |
| HPV33 | E6 | 20 | 9 | ETTIHNIEL | 14923 | |
| HPV33 | E6 | 41 | 10 | EVYDFAFADL | 14924 | |
| HPV33 | E6 | 75 | 10 | EYRHYNYSVY | 14925 | |
| HPV33 | E6 | 69 | 8 | FLSKISEY | 14926 | |
| HPV33 | E6 | 69 | 11 | FLSKISEYRHY | 14927 | |
| HPV33 | E6 | 61 | 9 | GICKLCLRF | 14928 | |
| HPV33 | E6 | 61 | 10 | GICKLCLRFL | 14929 | |
| HPV33 | E6 | 118 | 8 | HVDLNKRF | 14930 | |
| HPV33 | E6 | 118 | 11 | HVDLNKRFHNI | 14931 | |
| HPV33 | E6 | 78 | 11 | HYNYSVYGNTL | 14932 | |
| HPV33 | E6 | 72 | 8 | KISEYRHY | 14933 | |
| HPV33 | E6 | 72 | 10 | KISEYRHYNY | 14934 | |
| HPV33 | E6 | 64 | 10 | KLCLRFLSKI | 14935 | |
| HPV33 | E6 | 100 | 11 | LIRCIICQRPL | 14936 | |
| HPV33 | E6 | 50 | 11 | LTVVYREGNPF | 14937 | |
| HPV33 | E6 | 86 | 11 | NTLEQTVKKPL | 14938 | |
| HPV33 | E6 | 80 | 9 | NYSVYGNTL | 14939 | |
| HPV33 | E6 | 59 | 9 | PFGICKLCL | 14940 | |
| HPV33 | E6 | 59 | 11 | PFGICKLCLRF | 14941 | |
| HPV33 | E6 | 95 | 10 | PLNEILIRCI | 14942 | |
| HPV33 | E6 | 95 | 11 | PLNEILIRCII | 14943 | |
| HPV33 | E6 | 36 | 8 | PLQRSEVY | 14944 | |
| HPV33 | E6 | 36 | 10 | PLQRSEVYDF | 14945 | |
| HPV33 | E6 | 90 | 10 | QTVKKPLNEI | 14946 | |
| HPV33 | E6 | 90 | 11 | QTVKKPLNEIL | 14947 | |
| HPV33 | E6 | 124 | 9 | RFHNISGRW | 14948 | |
| HPV33 | E6 | 68 | 9 | RFLSKISEY | 14949 | |
| HPV33 | E6 | 10 | 10 | RTLHDLCQAL | 14950 | |
| HPV33 | E6 | 131 | 10 | RWAGRCAACW | 14951 | |
| HPV33 | E6 | 87 | 10 | TLEQTVKKPL | 14952 | |
| HPV33 | E6 | 11 | 9 | TLHDLCQAL | 14953 | |
| HPV33 | E6 | 21 | 8 | TTIHNIEL | 14954 | |
| HPV33 | E6 | 91 | 9 | TVKKPLNEI | 14955 | |
| HPV33 | E6 | 91 | 10 | TVKKPLNEIL | 14956 | |
| HPV33 | E6 | 91 | 11 | TVKKPLNEILI | 14957 | |
| HPV33 | E6 | 51 | 10 | TVVYREGNPF | 14958 | |
| HPV33 | E6 | 52 | 9 | VVYREGNPF | 14959 | |
| HPV33 | E6 | 52 | 11 | VVYREGNPFGI | 14960 | |
| HPV33 | E6 | 42 | 9 | VYDFAFADL | 14961 | |
| HPV33 | E6 | 53 | 8 | VYREGNPF | 14962 | |
| HPV33 | E6 | 53 | 10 | VYREGNPFGI | 14963 | |
| HPV33 | E7 | 68 | 9 | CVNSTASDL | 14964 | |
| HPV33 | E7 | 75 | 8 | DLRTIQQL | 14965 | |
| HPV33 | E7 | 75 | 9 | DLRTIQQLL | 14966 | |
| HPV33 | E7 | 75 | 10 | DLRTIQQLLM | 14967 | |
| HPV33 | E7 | 21 | 8 | DLYCYEQL | 14968 | |
| HPV33 | E7 | 14 | 9 | DLYPEPTDL | 14969 | |
| HPV33 | E7 | 14 | 10 | DLYPEPTDLY | 14970 | |
| HPV33 | E7 | 59 | 9 | HTCNTTVRL | 14971 | |
| HPV33 | E7 | 82 | 8 | LLMGTVNI | 14972 | |
| HPV33 | E7 | 15 | 8 | LYPEPTDL | 14973 | |
| HPV33 | E7 | 15 | 9 | LYPEPTDLY | 14974 | |
| HPV33 | E7 | 15 | 11 | LYPEPTDLYCY | 14975 | |
| HPV33 | E7 | 19 | 10 | PTDLYCYEQL | 14976 | |
| HPV33 | E7 | 6 | 8 | PTLKEYVL | 14977 | |
| HPV33 | E7 | 6 | 10 | PTLKEYVLDL | 14978 | |
| HPV33 | E7 | 6 | 11 | PTLKEYVLDLY | 14979 | |
| HPV33 | E7 | 81 | 9 | QLLMGTVNI | 14980 | |
| HPV33 | E7 | 66 | 11 | RLCVNSTASDL | 14981 | |
| HPV33 | E7 | 77 | 8 | RTIQQLLM | 14982 | |
| HPV33 | E7 | 71 | 9 | STASDLRTI | 14983 | |
| HPV33 | E7 | 7 | 9 | TLKEYVLDL | 14984 | |
| HPV33 | E7 | 7 | 10 | TLKEYVLDLY | 14985 | |

TABLE X-continued

A24 Supermotif Peptides

| Type | Protein | Position | No. of Amino Acids | Sequence | A*2402 | Seq. Id. No. |
|---|---|---|---|---|---|---|
| HPV33 | E7 | 12 | 11 | VLDLYPEPTDL | 14986 | |
| HPV33 | L1 | 290 | 10 | AFFPTPSGSM | 14987 | |
| HPV33 | L1 | 392 | 10 | AMNPDILEDW | 14988 | |
| HPV33 | L1 | 44 | 9 | AVGHPYFSI | 14989 | |
| HPV33 | L1 | 270 | 8 | AVPDDLYI | 14990 | |
| HPV33 | L1 | 147 | 11 | CLSMDYKQTQL | 14991 | |
| HPV33 | L1 | 345 | 10 | CTQVTSDSTY | 14992 | |
| HPV33 | L1 | 223 | 9 | DICGSTCKY | 14993 | |
| HPV33 | L1 | 396 | 8 | DILEDWQF | 14994 | |
| HPV33 | L1 | 396 | 10 | DILEDWQFGL | 14995 | |
| HPV33 | L1 | 457 | 11 | DLDQFPLGRKF | 14996 | |
| HPV33 | L1 | 449 | 10 | DLKEKFSADL | 14997 | |
| HPV33 | L1 | 370 | 8 | DLQFVFQL | 14998 | |
| HPV33 | L1 | 199 | 10 | DMVDTGFGCM | 14999 | |
| HPV33 | L1 | 129 | 8 | DTETGNKY | 15000 | |
| HPV33 | L1 | 202 | 9 | DTGFGCMDF | 15001 | |
| HPV33 | L1 | 335 | 8 | DTTRSTNM | 15002 | |
| HPV33 | L1 | 335 | 10 | DTTRSTNMTL | 15003 | |
| HPV33 | L1 | 415 | 11 | DTYRFVTSQAI | 15004 | |
| HPV33 | L1 | 151 | 9 | DYKQTQLCL | 15005 | |
| HPV33 | L1 | 151 | 10 | DYKQTQLCLL | 15006 | |
| HPV33 | L1 | 233 | 10 | DYLKMTSEPY | 15007 | |
| HPV33 | L1 | 107 | 8 | EIGRGQPL | 15008 | |
| HPV33 | L1 | 447 | 8 | EVDLKEKF | 15009 | |
| HPV33 | L1 | 385 | 9 | EVMTYIHAM | 15010 | |
| HPV33 | L1 | 368 | 8 | EYDLQFVF | 15011 | |
| HPV33 | L1 | 368 | 10 | EYDLQFVFQL | 15012 | |
| HPV33 | L1 | 361 | 9 | EYIRHVEEY | 15013 | |
| HPV33 | L1 | 361 | 11 | EYIRHVEEYDL | 15014 | |
| HPV33 | L1 | 26 | 8 | EYVSTRSI | 15015 | |
| HPV33 | L1 | 26 | 9 | EYVSRTSIY | 15016 | |
| HPV33 | L1 | 26 | 10 | EYVSRTSIYY | 15017 | |
| HPV33 | L1 | 26 | 11 | EYVSRTSIYYY | 15018 | |
| HPV33 | L1 | 247 | 9 | FFFLRREQM | 15019 | |
| HPV33 | L1 | 247 | 10 | FFFLRREQMF | 15020 | |
| HPV33 | L1 | 248 | 8 | FFLRREQM | 15021 | |
| HPV33 | L1 | 248 | 9 | FFLRREQMF | 15022 | |
| HPV33 | L1 | 260 | 8 | FFNRAGTL | 15023 | |
| HPV33 | L1 | 291 | 9 | FFPTPSGSM | 15024 | |
| HPV33 | L1 | 249 | 8 | FLRREQMF | 15025 | |
| HPV33 | L1 | 373 | 10 | FVFQLCKVTL | 15026 | |
| HPV33 | L1 | 445 | 10 | FWEVDLKEKF | 15027 | |
| HPV33 | L1 | 91 | 9 | FYNPDTQRL | 15028 | |
| HPV33 | L1 | 91 | 11 | FYNPDTQRLVW | 15029 | |
| HPV33 | L1 | 204 | 10 | GFGCMDFKTL | 15030 | |
| HPV33 | L1 | 85 | 8 | GFPDTSFY | 15031 | |
| HPV33 | L1 | 322 | 9 | GICWGNQVF | 15032 | |
| HPV33 | L1 | 117 | 8 | GISGHPLL | 15033 | |
| HPV33 | L1 | 117 | 11 | GISGHPLLNKF | 15034 | |
| HPV33 | L1 | 105 | 10 | GLEIGRGQPL | 15035 | |
| HPV33 | L1 | 472 | 8 | GLKAKPKL | 15036 | |
| HPV33 | L1 | 68 | 11 | GLQYRVFRVRL | 15037 | |
| HPV33 | L1 | 404 | 10 | GLTPPPSASL | 15038 | |
| HPV33 | L1 | 265 | 11 | GTLGEAVPDDL | 15039 | |
| HPV33 | L1 | 281 | 11 | GTTASIQSSAF | 15040 | |
| HPV33 | L1 | 115 | 9 | GVGISGHPL | 15041 | |
| HPV33 | L1 | 115 | 10 | GVGISGHPLL | 15042 | |
| HPV33 | L1 | 259 | 9 | HFFNRAGTL | 15043 | |
| HPV33 | L1 | 365 | 9 | HVEEYDLQF | 15044 | |
| HPV33 | L1 | 365 | 11 | HVEEYDLQFVF | 15045 | |
| HPV33 | L1 | 397 | 9 | ILEDWQFGL | 15046 | |
| HPV33 | L1 | 33 | 10 | IYYYAGSSRL | 15047 | |
| HPV33 | L1 | 33 | 11 | IYYYAGSSRLL | 15048 | |
| HPV33 | L1 | 126 | 11 | KFDDTETGNKY | 15049 | |
| HPV33 | L1 | 83 | 9 | KFGFPDTSF | 15050 | |
| HPV33 | L1 | 83 | 10 | KFGFPDTSFY | 15051 | |
| HPV33 | L1 | 466 | 8 | KFLLQAGL | 15052 | |
| HPV33 | L1 | 453 | 9 | KFSADLDQF | 15053 | |
| HPV33 | L1 | 453 | 11 | KFSADLDQFPL | 15054 | |
| HPV33 | L1 | 60 | 10 | KLLVPKVSGL | 15055 | |
| HPV33 | L1 | 236 | 11 | KMTSEPYGDSL | 15056 | |
| HPV33 | L1 | 65 | 10 | KVSGLQYRVF | 15057 | |
| HPV33 | L1 | 379 | 9 | KVTLTAEVM | 15058 | |
| HPV33 | L1 | 379 | 11 | KVTLTAEVMTY | 15059 | |

TABLE X-continued

A24 Supermotif Peptides

| Type | Protein | Position | No. of Amino Acids | Sequence | A*2402 Seq. Id. No. |
|---|---|---|---|---|---|
| HPV33 | L1 | 20 | 8 | KVVSTDEY | 15060 |
| HPV33 | L1 | 230 | 8 | KYPDYLKM | 15061 |
| HPV33 | L1 | 442 | 9 | KYTFWEVDL | 15062 |
| HPV33 | L1 | 246 | 10 | LFFFLRREQM | 15063 |
| HPV33 | L1 | 246 | 11 | LFFFLRREQMF | 15064 |
| HPV33 | L1 | 306 | 8 | LFNKPYWL | 15065 |
| HPV33 | L1 | 190 | 11 | LINTIIEDGDM | 15066 |
| HPV33 | L1 | 42 | 8 | LLAVGHPY | 15067 |
| HPV33 | L1 | 42 | 9 | LLAVGHPYF | 15068 |
| HPV33 | L1 | 42 | 11 | LLAVGHPYFSI | 15069 |
| HPV33 | L1 | 61 | 9 | LLVPKVSGL | 15070 |
| HPV33 | L1 | 61 | 11 | LLVPKVSGLQY | 15071 |
| HPV33 | L1 | 382 | 8 | LTAEVMTY | 15072 |
| HPV33 | L1 | 382 | 9 | LTAEVMTYI | 15073 |
| HPV33 | L1 | 405 | 9 | LTPPPSASL | 15074 |
| HPV33 | L1 | 62 | 8 | LVPKVSGL | 15075 |
| HPV33 | L1 | 62 | 10 | LVPKVSGLQY | 15076 |
| HPV33 | L1 | 99 | 8 | LVWACVGL | 15077 |
| HPV33 | L1 | 99 | 10 | LVWACVGLEI | 15078 |
| HPV33 | L1 | 237 | 10 | MTSEPYGDSL | 15079 |
| HPV33 | L1 | 237 | 11 | MTSEPYGDSLF | 15080 |
| HPV33 | L1 | 387 | 11 | MTYIHAMNPDI | 15081 |
| HPV33 | L1 | 200 | 9 | MVDTGFGCM | 15082 |
| HPV33 | L1 | 200 | 11 | MVDTGFGCMDF | 15083 |
| HPV33 | L1 | 299 | 8 | MVTSESQL | 15084 |
| HPV33 | L1 | 299 | 9 | MVTSESQLF | 15085 |
| HPV33 | L1 | 192 | 9 | NTIIEDGDM | 15086 |
| HPV33 | L1 | 221 | 11 | PIDICGSTCKY | 15087 |
| HPV33 | L1 | 187 | 8 | PLELINTI | 15088 |
| HPV33 | L1 | 187 | 9 | PLELINTII | 15089 |
| HPV33 | L1 | 439 | 8 | PLGKYTFW | 15090 |
| HPV33 | L1 | 462 | 8 | PLGRKFLL | 15091 |
| HPV33 | L1 | 113 | 11 | PLGVGISGHPL | 15092 |
| HPV33 | L1 | 55 | 8 | PTNAKKLL | 15093 |
| HPV33 | L1 | 17 | 11 | PVSKVVSTDEY | 15094 |
| HPV33 | L1 | 241 | 8 | PYGDSLFF | 15095 |
| HPV33 | L1 | 241 | 9 | PYGDSLFFF | 15096 |
| HPV33 | L1 | 241 | 10 | PYGDSLFFFL | 15097 |
| HPV33 | L1 | 460 | 8 | QFPLGRKF | 15098 |
| HPV33 | L1 | 460 | 9 | QFPLGRKFL | 15099 |
| HPV33 | L1 | 460 | 10 | QFPLGRKFLL | 15100 |
| HPV33 | L1 | 372 | 11 | QFVFQLCKVTL | 15101 |
| HPV33 | L1 | 305 | 8 | QLFNKPYW | 15102 |
| HPV33 | L1 | 305 | 9 | QLFNKPYWL | 15103 |
| HPV33 | L1 | 254 | 8 | QMFVRHFF | 15104 |
| HPV33 | L1 | 347 | 8 | QVTSDSTY | 15105 |
| HPV33 | L1 | 70 | 9 | QYRVFRVRL | 15016 |
| HPV33 | L1 | 418 | 8 | RFVTSQAI | 15107 |
| HPV33 | L1 | 41 | 9 | RLLAVGHPY | 15018 |
| HPV33 | L1 | 41 | 10 | RLLAVGHPYF | 15019 |
| HPV33 | L1 | 77 | 8 | RLPDPNKF | 15110 |
| HPV33 | L1 | 77 | 10 | RLPDPNKFGF | 15111 |
| HPV33 | L1 | 98 | 9 | RLVWACVGL | 15112 |
| HPV33 | L1 | 98 | 11 | RLVWACVGLEI | 15113 |
| HPV33 | L1 | 75 | 10 | RVRLPDPNKF | 15114 |
| HPV33 | L1 | 90 | 10 | SKYNPDTQRL | 15115 |
| HPV33 | L1 | 51 | 11 | SIKNPTNAKKL | 15116 |
| HPV33 | L1 | 285 | 8 | SIQSSAFF | 15117 |
| HPV33 | L1 | 32 | 11 | SIYYYAGSSRL | 15118 |
| HPV33 | L1 | 245 | 11 | SLFFFLRREQM | 15119 |
| HPV33 | L1 | 412 | 8 | SLQDTYRF | 15120 |
| HPV33 | L1 | 149 | 9 | SMDYKQTQL | 15121 |
| HPV33 | L1 | 149 | 11 | SMDYKQTQLCL | 15122 |
| HPV33 | L1 | 298 | 9 | SMVTSESQL | 15123 |
| HPV33 | L1 | 298 | 10 | SMVTSESQLF | 15124 |
| HPV33 | L1 | 227 | 8 | STCKYPDY | 15125 |
| HPV33 | L1 | 227 | 9 | STCKYPDYL | 15126 |
| HPV33 | L1 | 227 | 11 | STCKYPDYLKM | 15127 |
| HPV33 | L1 | 23 | 11 | STDEYVSRTSI | 15128 |
| HPV33 | L1 | 352 | 8 | STYKNENF | 15129 |
| HPV33 | L1 | 352 | 11 | STYKNENFKEY | 15130 |
| HPV33 | L1 | 2 | 11 | SVWRPSEATVY | 15131 |
| HPV33 | L1 | 444 | 11 | TFWEVDLKEKF | 15132 |
| HPV33 | L1 | 193 | 8 | TIIEDGDM | 15133 |

TABLE X-continued

A24 Supermotif Peptides

| Type | Protein | Position | No. of Amino Acids | Sequence | A*2402 | Seq. Id. No. |
|---|---|---|---|---|---|---|
| HPV33 | L1 | 266 | 10 | TLGEAVPDDL | 15134 | |
| HPV33 | L1 | 266 | 11 | TLGEAVPDDLY | 15135 | |
| HPV33 | L1 | 212 | 11 | TLQANKSDVPI | 15136 | |
| HPV33 | L1 | 381 | 9 | TLTAEVMTY | 15137 | |
| HPV33 | L1 | 381 | 10 | TLTAEVMTYI | 15138 | |
| HPV33 | L1 | 282 | 10 | TTASIQSSAF | 15139 | |
| HPV33 | L1 | 282 | 11 | TTASIQSSAFF | 15140 | |
| HPV33 | L1 | 336 | 9 | TTRSTNMTL | 15141 | |
| HPV33 | L1 | 430 | 11 | TVPPKEKEDPL | 15142 | |
| HPV33 | L1 | 332 | 11 | TVVDTTRSTNM | 15143 | |
| HPV33 | L1 | 388 | 10 | TYIHAMNPDI | 15144 | |
| HPV33 | L1 | 388 | 11 | TYIHAMNPDIL | 15145 | |
| HPV33 | L1 | 353 | 10 | TYKNENFKEY | 15146 | |
| HPV33 | L1 | 353 | 11 | TYKNENFKEYI | 15147 | |
| HPV33 | L1 | 416 | 10 | TYRFVTSQAI | 15148 | |
| HPV33 | L1 | 374 | 9 | VFQLCKVTL | 15149 | |
| HPV33 | L1 | 386 | 8 | VMTYIHAM | 15150 | |
| HPV33 | L1 | 380 | 8 | VTLTAEVM | 15151 | |
| HPV33 | L1 | 380 | 10 | VTLTAEVMTY | 15152 | |
| HPV33 | L1 | 380 | 11 | VTLTAEVMTYI | 15153 | |
| HPV33 | L1 | 300 | 8 | VTSESQLF | 15154 | |
| HPV33 | L1 | 333 | 10 | VVDTTRSTNM | 15155 | |
| HPV33 | L1 | 100 | 9 | VWACVGLEI | 15156 | |
| HPV33 | L1 | 3 | 10 | VWRPSEATVY | 15157 | |
| HPV33 | L1 | 3 | 11 | VWRPSEATVYL | 15158 | |
| HPV33 | L1 | 389 | 9 | YIHAMNPDI | 15159 | |
| HPV33 | L1 | 389 | 10 | YIHAMNPDIL | 15160 | |
| HPV33 | L1 | 276 | 11 | YIKGSGTTASI | 15161 | |
| HPV33 | L1 | 362 | 8 | YIRHVEEY | 15162 | |
| HPV33 | L1 | 362 | 10 | YIRHVEEYDL | 15163 | |
| HPV33 | L1 | 234 | 9 | YLKMTSEPY | 15164 | |
| HPV33 | L1 | 443 | 8 | YTFWEVDL | 15165 | |
| HPV33 | L1 | 27 | 8 | YVSRTSIY | 15166 | |
| HPV33 | L1 | 27 | 9 | YVSRTSIYY | 15167 | |
| HPV33 | L1 | 27 | 10 | YVSRTSIYYY | 15168 | |
| HPV33 | L1 | 35 | 8 | YYAGSSRL | 15169 | |
| HPV33 | L1 | 35 | 9 | YYAGSSRLL | 15170 | |
| HPV33 | L1 | 34 | 9 | YYYAGSSRL | 15171 | |
| HPV33 | L1 | 34 | 10 | YYYAGSSRLL | 15172 | |
| HPV33 | L2 | 256 | 11 | AFESFDPEDTL | 15173 | |
| HPV33 | L2 | 241 | 9 | AFLTSPHKL | 15174 | |
| HPV33 | L2 | 241 | 10 | AFLTSPHKLI | 15175 | |
| HPV33 | L2 | 291 | 11 | AITSRRHTVRF | 15176 | |
| HPV33 | L2 | 23 | 10 | ATGTCPPDVI | 15177 | |
| HPV33 | L2 | 308 | 11 | ATLKTRSGKQI | 15178 | |
| HPV33 | L2 | 385 | 10 | ATTRTSNVSI | 15179 | |
| HPV33 | L2 | 280 | 8 | DFLDIIAL | 15180 | |
| HPV33 | L2 | 439 | 8 | DFVLHPSY | 15181 | |
| HPV33 | L2 | 439 | 9 | DFVLHPSYF | 15182 | |
| HPV33 | L2 | 439 | 10 | DFVLHPSYFI | 15183 | |
| HPV33 | L2 | 439 | 11 | DFVLHPSYFIL | 15184 | |
| HPV33 | L2 | 283 | 10 | DILALHRPAI | 15185 | |
| HPV33 | L2 | 272 | 10 | DISPAPDPDF | 15186 | |
| HPV33 | L2 | 272 | 11 | DISPAPDPDFL | 15187 | |
| HPV33 | L2 | 327 | 8 | DLSPIVPL | 15188 | |
| HPV33 | L2 | 431 | 10 | DTIVVDGADF | 15189 | |
| HPV33 | L2 | 264 | 10 | DTLQFQHSDI | 15190 | |
| HPV33 | L2 | 401 | 10 | DTPVMSGPDI | 15191 | |
| HPV33 | L2 | 350 | 9 | DTSTSSYSI | 15192 | |
| HPV33 | L2 | 95 | 10 | DTVGPLDSSI | 15193 | |
| HPV33 | L2 | 369 | 9 | DVDNVHTPM | 15194 | |
| HPV33 | L2 | 30 | 11 | DVIPKVEGSTI | 15195 | |
| HPV33 | L2 | 113 | 11 | FIEAGAPAPSI | 15196 | |
| HPV33 | L2 | 447 | 10 | FILRRRRKRF | 15197 | |
| HPV33 | L2 | 242 | 8 | FLTSPHKL | 15198 | |
| HPV33 | L2 | 242 | 9 | FLTSPHKLI | 15199 | |
| HPV33 | L2 | 242 | 11 | FLTSPHKLITY | 15200 | |
| HPV33 | L2 | 440 | 8 | FVLHPSYF | 15201 | |
| HPV33 | L2 | 440 | 9 | FVLHPSYFI | 15202 | |
| HPV33 | L2 | 440 | 10 | FVLHPSYFIL | 15203 | |
| HPV33 | L2 | 421 | 8 | FVPISPFF | 15204 | |
| HPV33 | L2 | 421 | 10 | FVPISPFFPF | 15205 | |
| HPV33 | L2 | 25 | 8 | GTCPPDVI | 15206 | |
| HPV33 | L2 | 75 | 9 | GTDPPTAAI | 15207 | |

TABLE X-continued

A24 Supermotif Peptides

| Type | Protein | Position | No. of Amino Acids | Sequence | A*2402 | Seq. Id. No. |
|---|---|---|---|---|---|---|
| HPV33 | L2 | 75 | 11 | GTDPPTAAIPL | 15208 | |
| HPV33 | L2 | 51 | 9 | GVFFGGLGI | 15209 | |
| HPV33 | L2 | 374 | 8 | HTPMQHSY | 15210 | |
| HPV33 | L2 | 374 | 11 | HTPMQHSYSTF | 15211 | |
| HPV33 | L2 | 336 | 8 | HTVPNEQY | 15212 | |
| HPV33 | L2 | 336 | 10 | HTVPNEQYEL | 15213 | |
| HPV33 | L2 | 323 | 9 | HYYQDLSPI | 15214 | |
| HPV33 | L2 | 284 | 9 | IIALHRPAI | 15215 | |
| HPV33 | L2 | 44 | 10 | ILKYGSLGVF | 15216 | |
| HPV33 | L2 | 44 | 11 | ILKYGSLGVFF | 15217 | |
| HPV33 | L2 | 448 | 9 | ILRRRKRF | 15218 | |
| HPV33 | L2 | 448 | 11 | ILRRRKRFPY | 15219 | |
| HPV33 | L2 | 292 | 10 | ITSRRHTVRF | 15220 | |
| HPV33 | L2 | 250 | 8 | ITYDNPAF | 15221 | |
| HPV33 | L2 | 250 | 11 | ITYDNPAFESF | 15222 | |
| HPV33 | L2 | 104 | 10 | IVSLIEETSF | 15223 | |
| HPV33 | L2 | 104 | 11 | IVSLIEETSFI | 15224 | |
| HPV33 | L2 | 433 | 8 | IVVDGADF | 15225 | |
| HPV33 | L2 | 433 | 10 | IVVDGADFVL | 15226 | |
| HPV33 | L2 | 248 | 10 | KLITYDNPAF | 15227 | |
| HPV33 | L2 | 311 | 8 | KTRSGKQI | 15228 | |
| HPV33 | L2 | 34 | 11 | KVEGSTIADQI | 15229 | |
| HPV33 | L2 | 236 | 8 | KVVDPAFL | 15230 | |
| HPV33 | L2 | 46 | 8 | KYGSLGVF | 15231 | |
| HPV33 | L2 | 46 | 9 | KYGSLGVFF | 15232 | |
| HPV33 | L2 | 414 | 8 | LFPTSSPF | 15233 | |
| HPV33 | L2 | 414 | 11 | LFPTSSPFVPI | 15234 | |
| HPV33 | L2 | 107 | 8 | LIEETSFI | 15235 | |
| HPV33 | L2 | 249 | 9 | LITYDNPAF | 15236 | |
| HPV33 | L2 | 243 | 8 | LTSPHKLI | 15237 | |
| HPV33 | L2 | 243 | 10 | LTSPHKLITY | 15238 | |
| HPV33 | L2 | 397 | 9 | NTGFDTPVM | 15239 | |
| HPV33 | L2 | 372 | 10 | NVHTPMQHSY | 15240 | |
| HPV33 | L2 | 391 | 10 | NVSIPLNTGF | 15241 | |
| HPV33 | L2 | 143 | 10 | NVSSVGESSI | 15242 | |
| HPV33 | L2 | 209 | 8 | NVTSSTPI | 15243 | |
| HPV33 | L2 | 426 | 8 | PFFPFDTI | 15244 | |
| HPV33 | L2 | 420 | 8 | PFVPISPF | 15245 | |
| HPV33 | L2 | 420 | 9 | PFVPISPFF | 15246 | |
| HPV33 | L2 | 420 | 11 | PFVPISPFFPF | 15247 | |
| HPV33 | L2 | 73 | 11 | PIGTDPPTAAI | 15248 | |
| HPV33 | L2 | 215 | 11 | PIPGSRPVARL | 15249 | |
| HPV33 | L2 | 423 | 8 | PISPFFPF | 15250 | |
| HPV33 | L2 | 423 | 11 | PISPFFPFDTI | 15251 | |
| HPV33 | L2 | 333 | 11 | PLDHTVPNEQY | 15252 | |
| HPV33 | L2 | 99 | 9 | PLDSSIVSL | 15253 | |
| HPV33 | L2 | 99 | 10 | PLDSSIVSLI | 15254 | |
| HPV33 | L2 | 413 | 9 | PLFPTSSPF | 15255 | |
| HPV33 | L2 | 347 | 10 | PLHDTSTSSY | 15256 | |
| HPV33 | L2 | 395 | 11 | PLNTGFDTPVM | 15257 | |
| HPV33 | L2 | 376 | 9 | PMQHSYSTF | 15258 | |
| HPV33 | L2 | 79 | 10 | PTAAIPLQPI | 15259 | |
| HPV33 | L2 | 161 | 9 | PTFTEPSVL | 15260 | |
| HPV33 | L2 | 416 | 9 | PTSSPFVPI | 15261 | |
| HPV33 | L2 | 186 | 8 | PTVSTQSY | 15262 | |
| HPV33 | L2 | 186 | 11 | PTVSTQSYENI | 15263 | |
| HPV33 | L2 | 221 | 8 | PVARLGLY | 15264 | |
| HPV33 | L2 | 403 | 8 | PVMSGPDI | 15265 | |
| HPV33 | L2 | 91 | 10 | PVTVDTVGPL | 15266 | |
| HPV33 | L2 | 317 | 8 | QIGARIHY | 15267 | |
| HPV33 | L2 | 317 | 9 | QIGARIHYY | 15268 | |
| HPV33 | L2 | 43 | 8 | QILKYGSL | 15269 | |
| HPV33 | L2 | 43 | 11 | QILKYGSLGVF | 15270 | |
| HPV33 | L2 | 153 | 11 | QTISTHLNPTF | 15271 | |
| HPV33 | L2 | 234 | 9 | QVKVVDPAF | 15272 | |
| HPV33 | L2 | 234 | 10 | QVKVVDPAFL | 15273 | |
| HPV33 | L2 | 300 | 11 | RFSRVGQKATL | 15274 | |
| HPV33 | L2 | 321 | 8 | RIHYYQDL | 15275 | |
| HPV33 | L2 | 321 | 11 | RIHYYQDLSPI | 15276 | |
| HPV33 | L2 | 388 | 9 | RTSNVSIPL | 15277 | |
| HPV33 | L2 | 303 | 8 | RVGQKATL | 15278 | |
| HPV33 | L2 | 259 | 8 | SFDPEDTL | 15279 | |
| HPV33 | L2 | 259 | 10 | SFDPEDTLQF | 15280 | |
| HPV33 | L2 | 357 | 10 | SINDGLYDVY | 15281 | |

TABLE X-continued

A24 Supermotif Peptides

| Type | Protein | Position | No. of Amino Acids | Sequence | A*2402 Seq. Id. No. |
|---|---|---|---|---|---|
| HPV33 | L2 | 393 | 8 | SIPLNTGF | 15282 |
| HPV33 | L2 | 122 | 8 | SIPTPSGF | 15283 |
| HPV33 | L2 | 151 | 9 | SIQTISTHL | 15284 |
| HPV33 | L2 | 103 | 11 | SIVSLIEETSF | 15285 |
| HPV33 | L2 | 49 | 9 | SLGVFFGGL | 15286 |
| HPV33 | L2 | 49 | 11 | SLGVFFGGLGI | 15287 |
| HPV33 | L2 | 106 | 8 | SLIEETSF | 15288 |
| HPV33 | L2 | 106 | 9 | SLIEETSFI | 15289 |
| HPV33 | L2 | 156 | 8 | STHLNPTF | 15290 |
| HPV33 | L2 | 38 | 8 | STIADQIL | 15291 |
| HPV33 | L2 | 38 | 10 | STIADQILKY | 15292 |
| HPV33 | L2 | 189 | 8 | STQSYENI | 15293 |
| HPV33 | L2 | 189 | 10 | STQSYENIPM | 15294 |
| HPV33 | L2 | 352 | 11 | STSSYSINDGL | 15295 |
| HPV33 | L2 | 146 | 10 | SVGESSIQTI | 15296 |
| HPV33 | L2 | 192 | 10 | SYENIPMDTF | 15297 |
| HPV33 | L2 | 355 | 8 | SYSINDGL | 15298 |
| HPV33 | L2 | 355 | 9 | SYSINDGLY | 15299 |
| HPV33 | L2 | 162 | 8 | TFTEPSVL | 15300 |
| HPV33 | L2 | 39 | 9 | TIADQILKY | 15301 |
| HPV33 | L2 | 154 | 10 | TISTHLNPTF | 15302 |
| HPV33 | L2 | 432 | 9 | TIVVDGADF | 15303 |
| HPV33 | L2 | 432 | 11 | TIVVDGADFVL | 15304 |
| HPV33 | L2 | 309 | 10 | TLKTRSGKQI | 15305 |
| HPV33 | L2 | 265 | 9 | TLQFQHSDI | 15306 |
| HPV33 | L2 | 386 | 9 | TTRTSNVSI | 15307 |
| HPV33 | L2 | 386 | 11 | TTRTSNVSIPL | 15308 |
| HPV33 | L2 | 132 | 10 | TTSADTTPAI | 15309 |
| HPV33 | L2 | 132 | 11 | TTSADTTPAII | 15310 |
| HPV33 | L2 | 93 | 8 | TVDTVGPL | 15311 |
| HPV33 | L2 | 96 | 9 | TVGPLDSSI | 15312 |
| HPV33 | L2 | 337 | 9 | TVPENQYEL | 15313 |
| HPV33 | L2 | 187 | 10 | TVSTQSYENI | 15314 |
| HPV33 | L2 | 251 | 10 | TYDNPAFESF | 15315 |
| HPV33 | L2 | 52 | 8 | VFFGGLGI | 15316 |
| HPV33 | L2 | 31 | 10 | VIPKVEGSTI | 15317 |
| HPV33 | L2 | 441 | 8 | VLHPSYFI | 15318 |
| HPV33 | L2 | 441 | 9 | VLHPSYFIL | 15319 |
| HPV33 | L2 | 404 | 11 | VMSGPDIPSPL | 15320 |
| HPV33 | L2 | 131 | 11 | VTTSADTTPAI | 15321 |
| HPV33 | L2 | 92 | 9 | VTVDTVGPL | 15322 |
| HPV33 | L2 | 434 | 9 | VVDGADFVL | 15323 |
| HPV33 | L2 | 446 | 11 | YFILRRRKRF | 15324 |
| HPV33 | L2 | 324 | 8 | YYQDLSPI | 15325 |
| HPV33 | L2 | 324 | 11 | YYQDLSPIVPL | 15326 |
| HPV45 | E1 | 384 | 11 | AFLKSNCQAKY | 15327 |
| HPV45 | E1 | 532 | 9 | ALDGNPISI | 15328 |
| HPV45 | E1 | 311 | 9 | ALYWYRTGI | 15329 |
| HPV45 | E1 | 199 | 9 | AMLAVFKDI | 15330 |
| HPV45 | E1 | 199 | 10 | AMLAVFKDIY | 15331 |
| HPV45 | E1 | 512 | 11 | AMLDDATHTCW | 15332 |
| HPV45 | E1 | 40 | 8 | ATDTGSDM | 15333 |
| HPV45 | E1 | 40 | 11 | ATDTGSDMVDF | 15334 |
| HPV45 | E1 | 517 | 8 | ATHTCWTY | 15335 |
| HPV45 | E1 | 517 | 9 | ATHTCWTYF | 15336 |
| HPV45 | E1 | 251 | 10 | ATLYAHIQCL | 15337 |
| HPV45 | E1 | 202 | 9 | AVFKDIYGL | 15338 |
| HPV45 | E1 | 202 | 11 | AVFKDIYGLSF | 15339 |
| HPV45 | E1 | 604 | 10 | CFFERTWSRL | 15340 |
| HPV45 | E1 | 259 | 9 | CLDCKWGVL | 15341 |
| HPV45 | E1 | 259 | 10 | CLDCKWGVLI | 15342 |
| HPV45 | E1 | 259 | 11 | CLDCKWGVLIL | 15343 |
| HPV45 | E1 | 297 | 9 | CMLIEPPKL | 15344 |
| HPV45 | E1 | 226 | 8 | CTDWVMAI | 15345 |
| HPV45 | E1 | 226 | 9 | CTDWVMAIF | 15346 |
| HPV45 | E1 | 634 | 10 | CVTGQNTRPL | 15347 |
| HPV45 | E1 | 521 | 8 | CWTYFDNY | 15348 |
| HPV45 | E1 | 521 | 9 | CWTYFDNYM | 15349 |
| HPV45 | E1 | 49 | 9 | DFIDTQLSI | 15350 |
| HPV45 | E1 | 206 | 10 | DIYGLSFTDL | 15351 |
| HPV45 | E1 | 349 | 8 | DLSDMVQW | 15352 |
| HPV45 | E1 | 349 | 10 | DLSDMVQWAF | 15353 |
| HPV45 | E1 | 108 | 9 | DLSPRLQEI | 15354 |
| HPV45 | E1 | 108 | 11 | DLSPRLQEISL | 15355 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | E1 | 361 | 8 | DLTDESDM | 15356 | |
| HPV45 | E1 | 361 | 10 | DLTDESDMAF | 15357 | |
| HPV45 | E1 | 367 | 9 | DMAFQYAQL | 15358 | |
| HPV45 | E1 | 46 | 10 | DMVDFIDTQL | 15359 | |
| HPV45 | E1 | 352 | 11 | DMVQWAFDNDL | 15360 | |
| HPV45 | E1 | 106 | 8 | DTDLSPRL | 15361 | |
| HPV45 | E1 | 106 | 11 | DTDLSPRLQEI | 15362 | |
| HPV45 | E1 | 623 | 10 | DTEGIPFGTF | 15363 | |
| HPV45 | E1 | 42 | 9 | DTGSDMVDF | 15364 | |
| HPV45 | E1 | 42 | 10 | DTGSDMVDFI | 15365 | |
| HPV45 | E1 | 328 | 9 | DTPEWIQRL | 15366 | |
| HPV45 | E1 | 328 | 11 | DTPEWIQRLTI | 15367 | |
| HPV45 | E1 | 431 | 8 | DWRPIVQF | 15368 | |
| HPV45 | E1 | 431 | 9 | DWRPIVQFL | 15369 | |
| HPV45 | E1 | 431 | 11 | DWRPIVQFLRY | 15370 | |
| HPV45 | E1 | 445 | 9 | EFISFLRAL | 15371 | |
| HPV45 | E1 | 596 | 10 | EINDKNWKCF | 15372 | |
| HPV45 | E1 | 596 | 11 | EINDKNWKCFF | 15373 | |
| HPV45 | E1 | 38 | 10 | ETATDTGSDM | 15374 | |
| HPV45 | E1 | 295 | 11 | ETCMLIEPPKL | 15375 | |
| HPV45 | E1 | 74 | 9 | EVQNDAQVL | 15376 | |
| HPV45 | E1 | 74 | 11 | EVQNDAQVLHL | 15377 | |
| HPV45 | E1 | 324 | 9 | EVSGDTPEW | 15378 | |
| HPV45 | E1 | 324 | 10 | EVSGDTPEWI | 15379 | |
| HPV45 | E1 | 331 | 8 | EWIQRLTI | 15380 | |
| HPV45 | E1 | 331 | 9 | EWIQRLTII | 15381 | |
| HPV45 | E1 | 605 | 9 | FFERTWSRL | 15382 | |
| HPV45 | E1 | 605 | 11 | FFERTWSRLDL | 15383 | |
| HPV45 | E1 | 50 | 8 | FIDTQLSI | 15384 | |
| HPV45 | E1 | 483 | 9 | FIHFLQGAI | 15385 | |
| HPV45 | E1 | 483 | 10 | FIHFLQGAII | 15386 | |
| HPV45 | E1 | 446 | 8 | FISFLRAL | 15387 | |
| HPV45 | E1 | 446 | 11 | FISFLRALKEF | 15388 | |
| HPV45 | E1 | 456 | 11 | FLKGTPKKNCI | 15389 | |
| HPV45 | E1 | 385 | 10 | FLKSNCQAKY | 15390 | |
| HPV45 | E1 | 385 | 11 | FLKSNCQAKYL | 15391 | |
| HPV45 | E1 | 486 | 9 | FLQGAIISF | 15392 | |
| HPV45 | E1 | 449 | 8 | FLRALKEF | 15393 | |
| HPV45 | E1 | 449 | 9 | FLRALKEFL | 15394 | |
| HPV45 | E1 | 438 | 9 | FLRYQGVEF | 15395 | |
| HPV45 | E1 | 438 | 10 | FLRYQGVEFI | 15396 | |
| HPV45 | E1 | 212 | 8 | FTDLVRNF | 15397 | |
| HPV45 | E1 | 579 | 9 | FTFPHAFPF | 15398 | |
| HPV45 | E1 | 130 | 8 | FTISDSGY | 15399 | |
| HPV45 | E1 | 494 | 8 | FVNSNSHF | 15400 | |
| HPV45 | E1 | 494 | 9 | FVNSNSHFW | 15401 | |
| HPV45 | E1 | 494 | 10 | FVNSNSHFWL | 15402 | |
| HPV45 | E1 | 243 | 11 | GFKTLIKPATL | 15403 | |
| HPV45 | E1 | 342 | 9 | GIDDSNFDL | 15404 | |
| HPV45 | E1 | 209 | 11 | GLSFTDLVRNF | 15405 | |
| HPV45 | E1 | 480 | 8 | GMSFIHFL | 15406 | |
| HPV45 | E1 | 11 | 8 | GTGCNGWF | 15407 | |
| HPV45 | E1 | 11 | 9 | GTGCNGWFF | 15408 | |
| HPV45 | E1 | 459 | 8 | GTPKKNCI | 15409 | |
| HPV45 | E1 | 459 | 9 | GTPKKNCIL | 15410 | |
| HPV45 | E1 | 459 | 10 | GTPKKNCILL | 15411 | |
| HPV45 | E1 | 459 | 11 | GTPKKNCILLY | 15412 | |
| HPV45 | E1 | 443 | 8 | GVEFISFL | 15413 | |
| HPV45 | E1 | 443 | 11 | GVEFISFLRAL | 15414 | |
| HPV45 | E1 | 265 | 8 | GVLILALL | 15415 | |
| HPV45 | E1 | 265 | 10 | GVLILALLRY | 15416 | |
| HPV45 | E1 | 235 | 10 | GVNPTVAEGF | 15417 | |
| HPV45 | E1 | 16 | 8 | GWFFVETI | 15418 | |
| HPV45 | E1 | 485 | 8 | HFLQGAII | 15419 | |
| HPV45 | E1 | 485 | 10 | HFLQGAIISF | 15420 | |
| HPV45 | E1 | 256 | 9 | HIQCLDCKW | 15421 | |
| HPV45 | E1 | 519 | 10 | HTCWTYFDNY | 15422 | |
| HPV45 | E1 | 519 | 11 | HTCWTYFDNYM | 15423 | |
| HPV45 | E1 | 292 | 8 | HVPETCML | 15424 | |
| HPV45 | E1 | 292 | 9 | HVPETCMLI | 15425 | |
| HPV45 | E1 | 404 | 10 | HYKRAQKRQM | | 15426 |
| HPV45 | E1 | 338 | 11 | IIQHGIDDSNF | | 15427 |
| HPV45 | E1 | 491 | 11 | IISFVNSNSHF | | 15428 |
| HPV45 | E1 | 184 | 8 | ITELKELL | | 15429 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | E1 | 23 | 10 | IVEKKTGDVI | | 15430 |
| HPV45 | E1 | 207 | 9 | IYGLSFTDL | | 15431 |
| HPV45 | E1 | 425 | 8 | KIDEGGDW | | 15432 |
| HPV45 | E1 | 425 | 11 | KIDEGGDWRPI | | 15433 |
| HPV45 | E1 | 304 | 9 | KLRSSVAAL | | 15434 |
| HPV45 | E1 | 304 | 10 | KLRSSVAALY | | 15435 |
| HPV45 | E1 | 304 | 11 | KLRSSVAALYW | | 15436 |
| HPV45 | E1 | 245 | 9 | KTLIKPATL | | 15437 |
| HPV45 | E1 | 245 | 10 | KTLIKPATLY | | 15438 |
| HPV45 | E1 | 223 | 9 | KTTCTDWVM | | 15439 |
| HPV45 | E1 | 223 | 11 | KTTCTDWVMAI | | 15440 |
| HPV45 | E1 | 263 | 9 | KWGVLILAL | | 15441 |
| HPV45 | E1 | 263 | 10 | KWGVLILALL | | 15442 |
| HPV45 | E1 | 393 | 9 | KYLKDCAVM | | 15443 |
| HPV45 | E1 | 129 | 9 | LFTISDSGY | | 15444 |
| HPV45 | E1 | 247 | 8 | LIKPATLY | | 15445 |
| HPV45 | E1 | 247 | 11 | LIKPATLYAHI | | 15446 |
| HPV45 | E1 | 267 | 8 | LILALLRY | | 15447 |
| HPV45 | E1 | 290 | 9 | LLHVPETCM | | 15448 |
| HPV45 | E1 | 290 | 10 | LLHVPETCML | | 15449 |
| HPV45 | E1 | 290 | 11 | LLHVPETCMLI | | 15450 |
| HPV45 | E1 | 190 | 11 | LLQASNKKAAM | | 15451 |
| HPV45 | E1 | 547 | 9 | LLQLKCPPI | | 15452 |
| HPV45 | E1 | 547 | 10 | LLQLKCPPIL | | 15453 |
| HPV45 | E1 | 547 | 11 | LLQLKCPPILL | | 15454 |
| HPV45 | E1 | 271 | 11 | LLRYKCGKNRL | | 15455 |
| HPV45 | E1 | 362 | 9 | LTDESDMAF | | 15456 |
| HPV45 | E1 | 362 | 11 | LTDESDMAFQY | | 15457 |
| HPV45 | E1 | 336 | 8 | LTIIQHGI | | 15458 |
| HPV45 | E1 | 281 | 10 | LTVAKGLSTL | | 15459 |
| HPV45 | E1 | 281 | 11 | LTVAKGLSTLL | | 15460 |
| HPV45 | E1 | 253 | 8 | LYAHIQCL | | 15461 |
| HPV45 | E1 | 468 | 11 | LYGPANTGKSY | | 15462 |
| HPV45 | E1 | 312 | 8 | LYWYRTGI | | 15463 |
| HPV45 | E1 | 312 | 11 | LYWYRTGISNI | | 15464 |
| HPV45 | E1 | 200 | 8 | MLAVFKDI | | 15465 |
| HPV45 | E1 | 200 | 9 | MLAVFKDIY | | 15466 |
| HPV45 | E1 | 200 | 11 | MLAVFKDIYGL | | 15467 |
| HPV45 | E1 | 513 | 10 | MLDDATHTCW | | 15468 |
| HPV45 | E1 | 298 | 8 | MLIEPPKL | | 15469 |
| HPV45 | E1 | 47 | 9 | MVDFIDTQL | | 15470 |
| HPV45 | E1 | 47 | 11 | MVDFIDTQLSI | | 15471 |
| HPV45 | E1 | 353 | 10 | MVQWAFDNDL | | 15472 |
| HPV45 | E1 | 347 | 10 | NFDLSDMVQW | | 15473 |
| HPV45 | E1 | 560 | 10 | NIDPAKDNKW | | 15474 |
| HPV45 | E1 | 414 | 8 | NMSQWIKY | | 15475 |
| HPV45 | E1 | 473 | 9 | NTGKSYFGM | | 15476 |
| HPV45 | E1 | 473 | 11 | NTGKSYFGMSF | | 15477 |
| HPV45 | E1 | 177 | 8 | NVDPHCSI | | 15478 |
| HPV45 | E1 | 177 | 11 | NVDPHCSITEL | | 15479 |
| HPV45 | E1 | 601 | 10 | NWKCFFERTW | | 15480 |
| HPV45 | E1 | 586 | 10 | PFDKNGNPVY | | 15481 |
| HPV45 | E1 | 554 | 8 | PILLTSNI | | 15482 |
| HPV45 | E1 | 537 | 11 | PISIDRKHKPL | | 15483 |
| HPV45 | E1 | 434 | 8 | PIVQFLRY | | 15484 |
| HPV45 | E1 | 505 | 9 | PLADTKVAM | | 15485 |
| HPV45 | E1 | 505 | 10 | PLADTKVAML | | 15486 |
| HPV45 | E1 | 546 | 10 | PLLQLKCPPI | | 15487 |
| HPV45 | E1 | 546 | 11 | PLLQLKCPPIL | | 15488 |
| HPV45 | E1 | 238 | 10 | PTVAEGFKTL | | 15489 |
| HPV45 | E1 | 238 | 11 | PTVAEGFKTLI | | 15490 |
| HPV45 | E1 | 593 | 10 | PVYEINDKNW | | 15491 |
| HPV45 | E1 | 570 | 10 | PYLESRVTVF | | 15492 |
| HPV45 | E1 | 437 | 10 | QFLRYQGVEF | | 15493 |
| HPV45 | E1 | 437 | 11 | QFLRYQGVEFI | | 15494 |
| HPV45 | E1 | 549 | 8 | QLKCPPIL | | 15495 |
| HPV45 | E1 | 549 | 9 | QLKCPPILL | | 15496 |
| HPV45 | E1 | 102 | 8 | QLSVDTDL | | 15497 |
| HPV45 | E1 | 412 | 8 | QMNMSQWI | | 15498 |
| HPV45 | E1 | 412 | 10 | QMNMSQWIKY | | 15499 |
| HPV45 | E1 | 80 | 10 | QVLHLLKRKF | | 15500 |
| HPV45 | E1 | 355 | 8 | QWAFDNDL | | 15501 |
| HPV45 | E1 | 417 | 10 | QWIKYRCSKI | | 15502 |
| HPV45 | E1 | 128 | 10 | RLFTISDSGY | | 15503 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | E1 | 335 | 9 | RLTIIQHGI | | 15504 |
| HPV45 | E1 | 280 | 8 | RLTVAKGL | | 15505 |
| HPV45 | E1 | 280 | 11 | RLTVAKGLSTL | | 15506 |
| HPV45 | E1 | 608 | 8 | RTWSRLDL | | 15507 |
| HPV45 | E1 | 575 | 11 | RVTVFTFPHAF | | 15508 |
| HPV45 | E1 | 273 | 9 | RYKCGKNRL | | 15509 |
| HPV45 | E1 | 440 | 8 | RYQGVEFI | | 15510 |
| HPV45 | E1 | 440 | 10 | RYQGVEFISF | | 15511 |
| HPV45 | E1 | 440 | 11 | RYQGVEFISFL | | 15512 |
| HPV45 | E1 | 482 | 10 | SFIHFLQGAI | | 15513 |
| HPV45 | E1 | 482 | 11 | SFIHFLQGAII | | 15514 |
| HPV45 | E1 | 448 | 9 | SFLRALKEF | | 15515 |
| HPV45 | E1 | 448 | 10 | SFLRALKEFL | | 15516 |
| HPV45 | E1 | 211 | 9 | SFTDLVRNF | | 15517 |
| HPV45 | E1 | 493 | 9 | SFVNSNSHF | | 15518 |
| HPV45 | E1 | 493 | 10 | SFVNSNSHFW | | 15519 |
| HPV45 | E1 | 493 | 11 | SFVNSNSHFWL | | 15520 |
| HPV45 | E1 | 539 | 9 | SIDRKHKPL | | 15521 |
| HPV45 | E1 | 539 | 10 | SIDRKHKPLL | | 15522 |
| HPV45 | E1 | 183 | 8 | SITELKEL | | 15523 |
| HPV45 | E1 | 183 | 9 | SITELKELL | | 15524 |
| HPV45 | E1 | 288 | 11 | STLLHVPETCM | | 15525 |
| HPV45 | E1 | 308 | 8 | SVAALYWY | | 15526 |
| HPV45 | E1 | 104 | 10 | SVDTDLSPRL | | 15527 |
| HPV45 | E1 | 477 | 8 | SYFGMSFI | | 15528 |
| HPV45 | E1 | 477 | 10 | SYFGMSFIHF | | 15529 |
| HPV45 | E1 | 477 | 11 | SYFGMSFIHFL | | 15530 |
| HPV45 | E1 | 580 | 8 | TFPHAFPF | | 15531 |
| HPV45 | E1 | 22 | 11 | TIVEKKTGDVI | | 15532 |
| HPV45 | E1 | 246 | 8 | TLIKPATL | | 15533 |
| HPV45 | E1 | 246 | 9 | TLIKPATLY | | 15534 |
| HPV45 | E1 | 289 | 10 | TLLHVPETCM | | 15535 |
| HPV45 | E1 | 289 | 11 | TLLHVPETCML | | 15536 |
| HPV45 | E1 | 252 | 9 | TLYAHIQCL | | 15537 |
| HPV45 | E1 | 224 | 8 | TTCTDWVM | | 15538 |
| HPV45 | E1 | 224 | 10 | TTCTDWVMAI | | 15539 |
| HPV45 | E1 | 224 | 11 | TTCTDWVMAIF | | 15540 |
| HPV45 | E1 | 239 | 9 | TVAEGFKTL | | 15541 |
| HPV45 | E1 | 239 | 10 | TVAEGFKTLI | | 15542 |
| HPV45 | E1 | 282 | 9 | TVAKGLSTL | | 15543 |
| HPV45 | E1 | 282 | 10 | TVAKGLSTLL | | 15544 |
| HPV45 | E1 | 577 | 9 | TVFTFPHAF | | 15545 |
| HPV45 | E1 | 577 | 11 | TVFTFPHAFPF | | 15546 |
| HPV45 | E1 | 523 | 11 | TYFDNYMRNAL | | 15547 |
| HPV45 | E1 | 203 | 8 | VFKDIYGL | | 15548 |
| HPV45 | E1 | 203 | 10 | VFKDIYGLSF | | 15549 |
| HPV45 | E1 | 578 | 8 | VFTFPHAF | | 15550 |
| HPV45 | E1 | 578 | 10 | VFTFPHAFPF | | 15551 |
| HPV45 | E1 | 81 | 9 | VLHLLKRKF | | 15552 |
| HPV45 | E1 | 266 | 9 | VLILALLRY | | 15553 |
| HPV45 | E1 | 635 | 9 | VTGQNTRPL | | 15554 |
| HPV45 | E1 | 576 | 10 | VTVFTFPHAF | | 15555 |
| HPV45 | E1 | 594 | 9 | VYEINDKNW | | 15556 |
| HPV45 | E1 | 418 | 9 | WIKYRCSKI | | 15557 |
| HPV45 | E1 | 332 | 8 | WIQRLTII | | 15558 |
| HPV45 | E1 | 522 | 8 | WTYFDNYM | | 15559 |
| HPV45 | E1 | 314 | 9 | WYRTGISNI | | 15560 |
| HPV45 | E1 | 524 | 10 | YFDNYMRNAL | | 15561 |
| HPV45 | E1 | 478 | 9 | YFGMSFIHF | | 15562 |
| HPV45 | E1 | 478 | 10 | YFGMSFIHFL | | 15563 |
| HPV45 | E1 | 571 | 9 | YLESRVTVF | | 15564 |
| HPV45 | E1 | 571 | 11 | YLESRVTVFTF | | 15565 |
| HPV45 | E1 | 394 | 8 | YLKDCAVM | | 15566 |
| HPV45 | E1 | 528 | 11 | YMRNALDGNPI | | 15567 |
| HPV45 | E1 | 313 | 10 | YWYRTGISNI | | 15568 |
| HPV45 | E2 | 78 | 8 | AIELQMAL | | 15569 |
| HPV45 | E2 | 78 | 11 | AIELQMALKGL | | 15570 |
| HPV45 | E2 | 47 | 11 | AILFTAREHGI | | 15571 |
| HPV45 | E2 | 84 | 10 | ALKGLAQSKY | | 15572 |
| HPV45 | E2 | 16 | 10 | ALQDKILDHY | | 15573 |
| HPV45 | E2 | 247 | 10 | ATKRPRQCGL | | 15574 |
| HPV45 | E2 | 216 | 8 | ATQIVRQL | | 15575 |
| HPV45 | E2 | 305 | 9 | CLRYRLRKY | | 15576 |
| HPV45 | E2 | 134 | 10 | CMNYVVWDSI | | 15577 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | E2 | 134 | 11 | CMNYVVWDSIY | | 15578 |
| HPV45 | E2 | 158 | 8 | CVSYWGVY | | 15579 |
| HPV45 | E2 | 158 | 9 | CVSYWGVYY | | 15580 |
| HPV45 | E2 | 158 | 10 | CVSYWGVYYI | | 15581 |
| HPV45 | E2 | 31 | 8 | DINSQISY | | 15582 |
| HPV45 | E2 | 31 | 9 | DINSQISYW | | 15583 |
| HPV45 | E2 | 31 | 11 | DINSQISYWQL | | 15584 |
| HPV45 | E2 | 171 | 8 | DTTYYVQF | | 15585 |
| HPV45 | E2 | 212 | 8 | DTVSATQI | | 15586 |
| HPV45 | E2 | 351 | 11 | DVVTIPNSVQI | | 15587 |
| HPV45 | E2 | 319 | 8 | EISSTWHW | | 15588 |
| HPV45 | E2 | 80 | 9 | ELQMALKGL | | 15589 |
| HPV45 | E2 | 106 | 11 | ELWNTEPSQCF | | 15590 |
| HPV45 | E2 | 343 | 8 | EVQRNTFL | | 15591 |
| HPV45 | E2 | 192 | 9 | EVQYGGNVI | | 15592 |
| HPV45 | E2 | 97 | 11 | EWTLQDTCEEL | | 15593 |
| HPV45 | E2 | 50 | 8 | FTAREHGI | | 15594 |
| HPV45 | E2 | 50 | 11 | FTAREHGITKL | | 15595 |
| HPV45 | E2 | 295 | 9 | HLKGDKNSL | | 15596 |
| HPV45 | E2 | 325 | 11 | HWTGCNKNTGI | | 15597 |
| HPV45 | E2 | 24 | 9 | HYENDSKDI | | 15598 |
| HPV45 | E2 | 316 | 9 | HYSEISSTW | | 15599 |
| HPV45 | E2 | 316 | 11 | HYSEISSTWHW | | 15600 |
| HPV45 | E2 | 293 | 11 | IIHLKGDKNSL | | 15601 |
| HPV45 | E2 | 48 | 10 | ILFTAREHGI | | 15602 |
| HPV45 | E2 | 151 | 11 | IWDKTAACVSY | | 15603 |
| HPV45 | E2 | 143 | 9 | IYYITETGI | | 15604 |
| HPV45 | E2 | 143 | 10 | IYYITETGIW | | 15605 |
| HPV45 | E2 | 59 | 10 | KLNHQVVPPI | | 15606 |
| HPV45 | E2 | 2 | 9 | KMQTPKESL | | 15607 |
| HPV45 | E2 | 154 | 8 | KTAACVSY | | 15608 |
| HPV45 | E2 | 154 | 9 | KTAACVSYW | | 15609 |
| HPV45 | E2 | 284 | 10 | KVCSGNTTPI | | 15610 |
| HPV45 | E2 | 284 | 11 | KVCSGNTTPII | | 15611 |
| HPV45 | E2 | 312 | 9 | KYADHYSEI | | 15612 |
| HPV45 | E2 | 184 | 8 | KYGNSNTW | | 15613 |
| HPV45 | E2 | 92 | 9 | KYNNEEWTL | | 15614 |
| HPV45 | E2 | 49 | 9 | LFTAREHGI | | 15615 |
| HPV45 | E2 | 41 | 8 | LIRLENAI | | 15616 |
| HPV45 | E2 | 41 | 9 | LIRLENAIL | | 15617 |
| HPV45 | E2 | 41 | 10 | LIRLENAILF | | 15618 |
| HPV45 | E2 | 107 | 10 | LWNTEPSQCF | | 15619 |
| HPV45 | E2 | 69 | 11 | NISKSKAHKAI | | 15620 |
| HPV45 | E2 | 109 | 8 | NTEPSQCF | | 15621 |
| HPV45 | E2 | 347 | 9 | NTFLDVVTI | | 15622 |
| HPV45 | E2 | 332 | 9 | NTGILTVTY | | 15623 |
| HPV45 | E2 | 265 | 8 | NTHVHNPL | | 15624 |
| HPV45 | E2 | 265 | 9 | NTHVHNPLL | | 15625 |
| HPV45 | E2 | 289 | 8 | NTTPIIHL | | 15626 |
| HPV45 | E2 | 198 | 9 | NVIDCNDSM | | 15627 |
| HPV45 | E2 | 136 | 8 | NYVVWDSI | | 15628 |
| HPV45 | E2 | 136 | 9 | NYVVWDSIY | | 15629 |
| HPV45 | E2 | 136 | 10 | NYVVWDSIYY | | 15630 |
| HPV45 | E2 | 136 | 11 | NYVVWDSIYYI | | 15631 |
| HPV45 | E2 | 177 | 9 | QFKSECEKY | | 15632 |
| HPV45 | E2 | 360 | 9 | QISVGYMTI | | 15633 |
| HPV45 | E2 | 35 | 8 | QISYWQLI | | 15634 |
| HPV45 | E2 | 35 | 10 | QISYWQLIRL | | 15635 |
| HPV45 | E2 | 40 | 9 | QLIRLENAI | | 15636 |
| HPV45 | E2 | 40 | 10 | QLIRLENAIL | | 15637 |
| HPV45 | E2 | 40 | 11 | QLIRLENAILF | | 15638 |
| HPV45 | E2 | 4 | 11 | QTPKESLSERL | | 15639 |
| HPV45 | E2 | 63 | 8 | QVVPPINI | | 15640 |
| HPV45 | E2 | 43 | 8 | RLENAILF | | 15641 |
| HPV45 | E2 | 309 | 9 | RLRKYADHY | | 15642 |
| HPV45 | E2 | 13 | 9 | RLSALQDKI | | 15643 |
| HPV45 | E2 | 13 | 10 | RLSALQDKIL | | 15644 |
| HPV45 | E2 | 263 | 10 | RVNTHVHNPL | | 15645 |
| HPV45 | E2 | 263 | 11 | RVNTHVHNPLL | | 15646 |
| HPV45 | E2 | 307 | 11 | RYRLRKYADHY | | 15647 |
| HPV45 | E2 | 142 | 10 | SIYYITETGI | | 15648 |
| HPV45 | E2 | 142 | 11 | SIYYITETGIW | | 15649 |
| HPV45 | E2 | 302 | 9 | SLKCLRYRL | | 15650 |
| HPV45 | E2 | 9 | 9 | SLSERLSAL | | 15651 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | E2 | 235 | 9 | SVGTPKPHI | | 15652 |
| HPV45 | E2 | 358 | 8 | SVQISVGY | | 15653 |
| HPV45 | E2 | 358 | 9 | SVQISVGYM | | 15654 |
| HPV45 | E2 | 358 | 11 | SVQISVGYMTI | | 15655 |
| HPV45 | E2 | 160 | 8 | SYWGVYYI | | 15656 |
| HPV45 | E2 | 37 | 8 | SYWQLIRL | | 15657 |
| HPV45 | E2 | 348 | 8 | TFLDVVTI | | 15658 |
| HPV45 | E2 | 354 | 8 | TIPNSVQI | | 15659 |
| HPV45 | E2 | 99 | 9 | TLQDTCEEL | | 15660 |
| HPV45 | E2 | 99 | 10 | TLQDTCEELW | | 15661 |
| HPV45 | E2 | 213 | 11 | TVSATQIVRQL | | 15662 |
| HPV45 | E2 | 190 | 11 | TWEVQYGGNVI | | 15663 |
| HPV45 | E2 | 339 | 11 | TYNSEVQRNTF | | 15664 |
| HPV45 | E2 | 199 | 8 | VIDCNDSM | | 15665 |
| HPV45 | E2 | 353 | 9 | VTIPNSVQI | | 15666 |
| HPV45 | E2 | 352 | 10 | VVTIPNSVQI | | 15667 |
| HPV45 | E2 | 138 | 8 | VVWDSIYY | | 15668 |
| HPV45 | E2 | 138 | 9 | VVWDSIYYI | | 15669 |
| HPV45 | E2 | 139 | 8 | VWDSIYYI | | 15670 |
| HPV45 | E2 | 125 | 11 | VYFDGNKDNCM | | 15671 |
| HPV45 | E2 | 164 | 11 | VYYIKDGDTTY | | 15672 |
| HPV45 | E2 | 326 | 10 | WTGCNKNTGI | | 15673 |
| HPV45 | E2 | 326 | 11 | WTGCNKNTGIL | | 15674 |
| HPV45 | E2 | 98 | 10 | WTLQDTCEEL | | 15675 |
| HPV45 | E2 | 98 | 11 | WTLQDTCEELW | | 15676 |
| HPV45 | E2 | 126 | 10 | YFDGNKDNCM | | 15677 |
| HPV45 | E2 | 166 | 9 | YIKDGDTTY | | 15678 |
| HPV45 | E2 | 166 | 10 | YIKDGDTTYY | | 15679 |
| HPV45 | E2 | 145 | 8 | YITETGIW | | 15680 |
| HPV45 | E2 | 175 | 11 | YVQFKSECEKY | | 15681 |
| HPV45 | E2 | 137 | 8 | YVVWDSIY | | 15682 |
| HPV45 | E2 | 137 | 9 | YVVWDSIYY | | 15683 |
| HPV45 | E2 | 137 | 10 | YVVWDSIYYI | | 15684 |
| HPV45 | E2 | 38 | 11 | YWQLIRLENAI | | 15685 |
| HPV45 | E2 | 165 | 10 | YYIKDGDTTY | | 15686 |
| HPV45 | E2 | 165 | 11 | YYIKDGDTTYY | | 15687 |
| HPV45 | E2 | 144 | 8 | YYITETGI | | 15688 |
| HPV45 | E2 | 144 | 9 | YYITETGIW | | 15689 |
| HPV45 | E6 | 48 | 9 | AFKDLFIVY | | 15690 |
| HPV45 | E6 | 37 | 9 | ATLERTEVY | | 15691 |
| HPV45 | E6 | 37 | 11 | ATLERTEVYQF | | 15692 |
| HPV45 | E6 | 61 | 9 | AYAACHKCI | | 15693 |
| HPV45 | E6 | 61 | 11 | AYAACHKCIDF | | 15694 |
| HPV45 | E6 | 59 | 11 | CIAYAACHKCI | | 15695 |
| HPV45 | E6 | 68 | 8 | CIDFYSRI | | 15696 |
| HPV45 | E6 | 68 | 11 | CIDFYSRIREL | | 15697 |
| HPV45 | E6 | 105 | 8 | CLRCQKPL | | 15698 |
| HPV45 | E6 | 18 | 8 | CTELNTSL | | 15699 |
| HPV45 | E6 | 32 | 8 | CVYCKATL | | 15700 |
| HPV45 | E6 | 70 | 9 | DFYSRIREL | | 15701 |
| HPV45 | E6 | 70 | 11 | DFYSRIRELRY | | 15702 |
| HPV45 | E6 | 16 | 10 | DLCTELNTSL | | 15703 |
| HPV45 | E6 | 51 | 10 | DLFIVYRDCI | | 15704 |
| HPV45 | E6 | 27 | 8 | DVSIACVY | | 15705 |
| HPV45 | E6 | 20 | 11 | ELNTSLQDVSI | | 15706 |
| HPV45 | E6 | 77 | 10 | ELRYYSNSVY | | 15707 |
| HPV45 | E6 | 97 | 10 | ELYNLLIRCL | | 15708 |
| HPV45 | E6 | 88 | 11 | ETLEKITNTEL | | 15709 |
| HPV45 | E6 | 43 | 10 | EVYQFAFKDL | | 15710 |
| HPV45 | E6 | 43 | 11 | EVYQFAFKDLF | | 15711 |
| HPV45 | E6 | 53 | 8 | FIVYRDCI | | 15712 |
| HPV45 | E6 | 53 | 10 | FIVYRDCIAY | | 15713 |
| HPV45 | E6 | 71 | 8 | FYSRIREL | 0.026 | 15714 |
| HPV45 | E6 | 71 | 10 | FYSRIRELRY | | 15715 |
| HPV45 | E6 | 71 | 11 | FYSRIRELRYY | | 15716 |
| HPV45 | E6 | 120 | 8 | HLKDKRRF | | 15717 |
| HPV45 | E6 | 120 | 11 | HLKDKRRFHSI | | 15718 |
| HPV45 | E6 | 93 | 9 | ITNTELYNL | | 15719 |
| HPV45 | E6 | 93 | 10 | ITNTELYNLL | | 15720 |
| HPV45 | E6 | 93 | 11 | ITNTELYNLLI | | 15721 |
| HPV45 | E6 | 54 | 9 | IVYRDCIAY | | 15722 |
| HPV45 | E6 | 92 | 8 | KITNTELY | | 15723 |
| HPV45 | E6 | 92 | 10 | KITNTELYNL | | 15724 |
| HPV45 | E6 | 92 | 11 | KITNTELYNLL | | 15725 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | E6 | 13 | 9 | KLPDLCTEL | 0.0013 | 15726 |
| HPV45 | E6 | 52 | 9 | LFIVYRDCI | | 15727 |
| HPV45 | E6 | 52 | 11 | LFIVYRDCIAY | | 15728 |
| HPV45 | E6 | 102 | 11 | LIRCLRCQKPL | | 15729 |
| HPV45 | E6 | 98 | 9 | LYNLLIRCL | 0.0001 | 15730 |
| HPV45 | E6 | 95 | 8 | NTELYNLL | | 15731 |
| HPV45 | E6 | 95 | 9 | NTELYNLLI | | 15732 |
| HPV45 | E6 | 22 | 9 | NTSLQDVSI | | 15733 |
| HPV45 | E6 | 111 | 11 | PLNPAEKRRHL | | 15734 |
| HPV45 | E6 | 7 | 8 | PTQRPYKL | | 15735 |
| HPV45 | E6 | 7 | 11 | PTQRPYKLPDL | | 15736 |
| HPV45 | E6 | 11 | 11 | PYKLPDLCTEL | 0.0064 | 15737 |
| HPV45 | E6 | 46 | 8 | QFAFKDLF | | 15738 |
| HPV45 | E6 | 46 | 9 | QFAFKDLFI | | 15739 |
| HPV45 | E6 | 46 | 11 | QFAFKDLFIVY | | 15740 |
| HPV45 | E6 | 3 | 10 | RFDDPTQRPY | | 15741 |
| HPV45 | E6 | 126 | 9 | RFHSIAGQY | | 15742 |
| HPV45 | E6 | 74 | 8 | RIRELRYY | | 15743 |
| HPV45 | E6 | 41 | 9 | RTEVYQFAF | | 15744 |
| HPV45 | E6 | 79 | 8 | RYYSNSVY | | 15745 |
| HPV45 | E6 | 29 | 11 | SIACVYCKATL | | 15746 |
| HPV45 | E6 | 24 | 11 | SLQDVSIACVY | | 15747 |
| HPV45 | E6 | 84 | 10 | SVYGETLEKI | | 15748 |
| HPV45 | E6 | 89 | 10 | TLEKITNTEL | | 15749 |
| HPV45 | E6 | 89 | 11 | TLEKITNTELY | | 15750 |
| HPV45 | E6 | 38 | 8 | TLERTEVY | | 15751 |
| HPV45 | E6 | 38 | 10 | TLERTEVYQF | | 15752 |
| HPV45 | E6 | 85 | 9 | VYGETLEKI | | 15753 |
| HPV45 | E6 | 44 | 9 | VYQFAFKDL | | 15754 |
| HPV45 | E6 | 44 | 10 | VYQFAFKDLF | | 15755 |
| HPV45 | E6 | 44 | 11 | VYQFAFKDLFI | | 15756 |
| HPV45 | E6 | 55 | 8 | VYRDCIAY | | 15757 |
| HPV45 | E6 | 80 | 11 | YYSNSVYGETL | | 15758 |
| HPV45 | E7 | 6 | 8 | ATLQEIVL | | 15759 |
| HPV45 | E7 | 6 | 10 | ATLQEIVLHL | | 15760 |
| HPV45 | E7 | 64 | 10 | CVCCKCDGRI | | 15761 |
| HPV45 | E7 | 25 | 8 | DLLCYEQL | | 15762 |
| HPV45 | E7 | 83 | 8 | DLRTLQQL | | 15763 |
| HPV45 | E7 | 83 | 9 | DLRTLQQLF | | 15764 |
| HPV45 | E7 | 83 | 10 | DLRTLQQLFL | | 15765 |
| HPV45 | E7 | 20 | 8 | ELDPVDLL | | 15766 |
| HPV45 | E7 | 20 | 10 | ELDPVDLLCY | | 15767 |
| HPV45 | E7 | 74 | 11 | ELTVESSADDL | | 15768 |
| HPV45 | E7 | 91 | 11 | FLSTLSFVCPW | | 15769 |
| HPV45 | E7 | 14 | 8 | HLEPQNEL | | 15770 |
| HPV45 | E7 | 11 | 11 | IVLHLEPQNEL | | 15771 |
| HPV45 | E7 | 90 | 8 | LFLSTLSF | | 15772 |
| HPV45 | E7 | 75 | 10 | LTVESSADDL | | 15773 |
| HPV45 | E7 | 23 | 10 | PVDLLCYEQL | | 15774 |
| HPV45 | E7 | 89 | 9 | QLFLSTLSF | | 15775 |
| HPV45 | E7 | 85 | 8 | RTLQQLFL | | 15776 |
| HPV45 | E7 | 85 | 11 | RTLQQLFLSTL | | 15777 |
| HPV45 | E7 | 93 | 9 | STLSFVCPW | | 15778 |
| HPV45 | E7 | 7 | 9 | TLQEIVLHL | | 15779 |
| HPV45 | E7 | 86 | 10 | TLQQLFLSTL | | 15780 |
| HPV45 | E7 | 94 | 8 | TLSFVCPW | | 15781 |
| HPV45 | E7 | 76 | 9 | TVESSADDL | | 15782 |
| HPV45 | E7 | 12 | 10 | VLHLEPQNEL | | 15783 |
| HPV45 | L1 | 191 | 11 | AIGEHWAKGTL | | 15784 |
| HPV45 | L1 | 103 | 8 | ALPDPNKF | | 15785 |
| HPV45 | L1 | 103 | 10 | ALPDPNKFGL | | 15786 |
| HPV45 | L1 | 28 | 11 | ALWRPSDSTVY | | 15787 |
| HPV45 | L1 | 88 | 8 | AVPKVSAY | | 15788 |
| HPV45 | L1 | 88 | 10 | AVPKVSAYQY | | 15789 |
| HPV45 | L1 | 94 | 11 | AYQYRVFRVAL | | 15790 |
| HPV45 | L1 | 184 | 9 | CILGCVPAI | | 15791 |
| HPV45 | L1 | 276 | 8 | CLRREQLF | | 15792 |
| HPV45 | L1 | 409 | 10 | CTITLTAEVM | | 15793 |
| HPV45 | L1 | 188 | 9 | CVPAIGEHW | | 15794 |
| HPV45 | L1 | 318 | 11 | CVYSPSPSGSI | | 15795 |
| HPV45 | L1 | 250 | 9 | DICQSICKY | | 15796 |
| HPV45 | L1 | 488 | 11 | DLDQYPLGRKF | | 15797 |
| HPV45 | L1 | 480 | 10 | DLKEKFSSDL | | 15798 |
| HPV45 | L1 | 401 | 8 | DLQFIFQL | | 15799 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | L1 | 401 | 11 | DLQFIFQLCTI | | 15800 |
| HPV45 | L1 | 301 | 11 | DLYIKGTSANM | | 15801 |
| HPV45 | L1 | 226 | 10 | DMVDTGYGAM | | 15802 |
| HPV45 | L1 | 229 | 9 | DTGYGAMDF | | 15803 |
| HPV45 | L1 | 242 | 8 | DTKCEVPL | | 15804 |
| HPV45 | L1 | 242 | 10 | DTKCEVPLDI | | 15805 |
| HPV45 | L1 | 461 | 11 | DTTPPEKQDPY | | 15806 |
| HPV45 | L1 | 364 | 8 | DTTRSTNL | | 15807 |
| HPV45 | L1 | 364 | 10 | DTTRSTNLTL | | 15808 |
| HPV45 | L1 | 296 | 8 | DTVPTDLY | | 15809 |
| HPV45 | L1 | 296 | 9 | DTVPTDLYI | | 15810 |
| HPV45 | L1 | 169 | 10 | DVRDNVSVDY | | 15811 |
| HPV45 | L1 | 177 | 9 | DYKQTQLCI | | 15812 |
| HPV45 | L1 | 177 | 10 | DYKQTQLCIL | | 15813 |
| HPV45 | L1 | 260 | 10 | DYLQMSADPY | | 15814 |
| HPV45 | L1 | 52 | 8 | DYVSRTSI | | 15815 |
| HPV45 | L1 | 52 | 9 | DYVSRTSIF | | 15816 |
| HPV45 | L1 | 52 | 10 | DYVSRTSIFY | | 15817 |
| HPV45 | L1 | 133 | 8 | EIGRGQPL | | 15818 |
| HPV45 | L1 | 133 | 10 | EIGRGQPLGI | | 15819 |
| HPV45 | L1 | 313 | 8 | ETPGSCVY | | 15820 |
| HPV45 | L1 | 416 | 9 | EVMSYIHSM | | 15821 |
| HPV45 | L1 | 246 | 10 | EVPLDICQSI | | 15822 |
| HPV45 | L1 | 399 | 8 | EYDLQFIF | | 15823 |
| HPV45 | L1 | 399 | 10 | EYDLQFIFQL | | 15824 |
| HPV45 | L1 | 274 | 9 | FFCLRREQL | | 15825 |
| HPV45 | L1 | 274 | 10 | FFCLRREQLF | | 15826 |
| HPV45 | L1 | 404 | 8 | FIFQLCTI | | 15827 |
| HPV45 | L1 | 404 | 10 | FIFQLCTITL | | 15828 |
| HPV45 | L1 | 14 | 8 | FLKNVNVF | | 15829 |
| HPV45 | L1 | 14 | 10 | FLKNVNVFPI | | 15830 |
| HPV45 | L1 | 14 | 11 | FLKNVNVFPIF | | 15831 |
| HPV45 | L1 | 287 | 8 | FWNRAGVM | | 15832 |
| HPV45 | L1 | 476 | 10 | FWTVDLKEKF | | 15833 |
| HPV45 | L1 | 60 | 9 | FYHAGSSRL | | 15834 |
| HPV45 | L1 | 60 | 10 | FYHAGSSRLL | | 15835 |
| HPV45 | L1 | 351 | 8 | GICWHNQL | | 15836 |
| HPV45 | L1 | 351 | 9 | GICWHNQLF | | 15837 |
| HPV45 | L1 | 141 | 9 | GIGLSGHPF | | 15838 |
| HPV45 | L1 | 141 | 10 | GIGLSGHPFY | | 15839 |
| HPV45 | L1 | 111 | 8 | GLPDSTIY | | 15840 |
| HPV45 | L1 | 503 | 8 | GLRRRPTI | | 15841 |
| HPV45 | L1 | 143 | 8 | GLSGHPFY | | 15842 |
| HPV45 | L1 | 143 | 11 | GLSGHPFYNKL | | 15843 |
| HPV45 | L1 | 131 | 10 | GMEIGRGQPL | | 15844 |
| HPV45 | L1 | 199 | 9 | GTLCKPAQL | | 15845 |
| HPV45 | L1 | 292 | 11 | GVMGDTVPTDL | | 15846 |
| HPV45 | L1 | 435 | 10 | GVPPPPTTSL | | 15847 |
| HPV45 | L1 | 231 | 10 | GYGAMDFSTL | | 15848 |
| HPV45 | L1 | 286 | 9 | HFWNRAGVM | | 15849 |
| HPV45 | L1 | 396 | 9 | HVEEYDLQF | | 15850 |
| HPV45 | L1 | 396 | 10 | HVEEYDLQFI | | 15851 |
| HPV45 | L1 | 396 | 11 | HVEEYDLQFIF | | 15852 |
| HPV45 | L1 | 392 | 9 | HYSRHVEEY | | 15853 |
| HPV45 | L1 | 392 | 11 | HYSRHVEEYDL | | 15854 |
| HPV45 | L1 | 13 | 9 | IFLKNVNVF | | 15855 |
| HPV45 | L1 | 13 | 11 | IFLKNVNVFPI | | 15856 |
| HPV45 | L1 | 23 | 8 | IFLQMALW | | 15857 |
| HPV45 | L1 | 405 | 9 | IFQLCTITL | | 15858 |
| HPV45 | L1 | 59 | 10 | IFYHAGSSRL | | 15859 |
| HPV45 | L1 | 59 | 11 | IFYHAGSSRLL | | 15860 |
| HPV45 | L1 | 12 | 10 | IIFLKNVNVF | | 15861 |
| HPV45 | L1 | 11 | 11 | IIIFLKNVNVF | | 15862 |
| HPV45 | L1 | 5 | 8 | IIYGHGII | | 15863 |
| HPV45 | L1 | 5 | 9 | IIYGHGIII | | 15864 |
| HPV45 | L1 | 5 | 10 | IIYGHGIIIF | | 15865 |
| HPV45 | L1 | 5 | 11 | IIYGHGIIIFL | | 15866 |
| HPV45 | L1 | 185 | 8 | ILGCVPAI | | 15867 |
| HPV45 | L1 | 411 | 8 | ITLTAEVM | | 15868 |
| HPV45 | L1 | 411 | 10 | ITLTAEVMSY | | 15869 |
| HPV45 | L1 | 411 | 11 | ITLTAEVMSYI | | 15870 |
| HPV45 | L1 | 328 | 8 | ITTSDSQL | | 15871 |
| HPV45 | L1 | 328 | 9 | ITTSDSQLF | | 15872 |
| HPV45 | L1 | 6 | 8 | IYGHGIII | | 15873 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | L1 | 6 | 9 | IYGHGIIIF | | 15874 |
| HPV45 | L1 | 6 | 10 | IYGHGIIIFL | | 15875 |
| HPV45 | L1 | 117 | 9 | IYNPETQRL | | 15876 |
| HPV45 | L1 | 117 | 11 | IYNPETQRLVW | | 15877 |
| HPV45 | L1 | 109 | 9 | KFGLPDSTI | | 15878 |
| HPV45 | L1 | 109 | 10 | KFGLPDSTIY | | 15879 |
| HPV45 | L1 | 497 | 8 | KFLVQAGL | | 15880 |
| HPV45 | L1 | 484 | 9 | KFSSDLDQY | | 15881 |
| HPV45 | L1 | 484 | 11 | KFSSDLDQYPL | | 15882 |
| HPV45 | L1 | 475 | 11 | KFWTVDLKEKF | | 15883 |
| HPV45 | L1 | 473 | 9 | KLKFWTVDL | | 15884 |
| HPV45 | L1 | 91 | 10 | KVSAYQYRVF | | 15885 |
| HPV45 | L1 | 257 | 8 | KYPDYLQM | | 15886 |
| HPV45 | L1 | 335 | 8 | LFNKPYWL | | 15887 |
| HPV45 | L1 | 68 | 8 | LLTVGNPY | | 15888 |
| HPV45 | L1 | 68 | 9 | LLTVGNPYF | | 15889 |
| HPV45 | L1 | 413 | 8 | LTAEVMSY | | 15890 |
| HPV45 | L1 | 413 | 9 | LTAEVMSYI | | 15891 |
| HPV45 | L1 | 69 | 8 | LTVGNPYF | | 15892 |
| HPV45 | L1 | 125 | 8 | LVWACVGM | | 15893 |
| HPV45 | L1 | 125 | 10 | LVWACVGMEI | | 15894 |
| HPV45 | L1 | 29 | 10 | LWRPSDSTVY | | 15895 |
| HPV45 | L1 | 29 | 11 | LWRPSDSTVYL | | 15896 |
| HPV45 | L1 | 302 | 10 | LYIKGTSANM | | 15897 |
| HPV45 | L1 | 273 | 10 | MFFCLRREQL | | 15898 |
| HPV45 | L1 | 273 | 11 | MFFCLRREQLF | | 15899 |
| HPV45 | L1 | 227 | 9 | MVDTGYGAM | | 15900 |
| HPV45 | L1 | 227 | 11 | MVDTGYGAMDF | | 15901 |
| HPV45 | L1 | 4 | 8 | NIIYGHGI | | 15902 |
| HPV45 | L1 | 4 | 9 | NIIYGHGII | | 15903 |
| HPV45 | L1 | 4 | 10 | NIIYGHGIII | | 15904 |
| HPV45 | L1 | 4 | 11 | NIIYGHGIIIF | | 15905 |
| HPV45 | L1 | 310 | 11 | NMRETPGSCVY | | 15906 |
| HPV45 | L1 | 49 | 11 | NTDDYVSRTSI | | 15907 |
| HPV45 | L1 | 219 | 9 | NTIIEDGDM | | 15908 |
| HPV45 | L1 | 383 | 8 | NTYDPTKF | | 15909 |
| HPV45 | L1 | 383 | 11 | NTYDPTKFKHY | | 15910 |
| HPV45 | L1 | 19 | 9 | NVFPIFLQM | | 15911 |
| HPV45 | L1 | 19 | 11 | NVFPIFLQMAL | | 15912 |
| HPV45 | L1 | 17 | 8 | NVNVFPIF | | 15913 |
| HPV45 | L1 | 17 | 9 | NVNVFPIFL | | 15914 |
| HPV45 | L1 | 17 | 11 | NVNVFPIFLQM | | 15915 |
| HPV45 | L1 | 173 | 11 | NVSVDYKQTQL | | 15916 |
| HPV45 | L1 | 22 | 8 | PIFLQMAL | | 15917 |
| HPV45 | L1 | 22 | 9 | PIFLQMALW | | 15918 |
| HPV45 | L1 | 248 | 8 | PLDICQSI | | 15919 |
| HPV45 | L1 | 248 | 11 | PLDICQSICKY | | 15920 |
| HPV45 | L1 | 214 | 8 | PLELKNTI | | 15921 |
| HPV45 | L1 | 214 | 9 | PLELKNTII | | 15922 |
| HPV45 | L1 | 139 | 11 | PLGIGLSGHPF | | 15923 |
| HPV45 | L1 | 440 | 9 | PTTSLVDTY | | 15924 |
| HPV45 | L1 | 440 | 11 | PTTSLVDTYRF | | 15925 |
| HPV45 | L1 | 380 | 11 | PVPNTYDPTKF | | 15926 |
| HPV45 | L1 | 470 | 8 | PYDKLKFW | | 15927 |
| HPV45 | L1 | 268 | 8 | PYGDSMFF | | 15928 |
| HPV45 | L1 | 268 | 10 | PYGDSMFFCL | | 15929 |
| HPV45 | L1 | 403 | 9 | QFIFQLCTI | | 15930 |
| HPV45 | L1 | 403 | 11 | QFIFQLCTITL | | 15931 |
| HPV45 | L1 | 182 | 11 | QLCILGCVPAI | | 15932 |
| HPV45 | L1 | 281 | 8 | QLFARHFW | | 15933 |
| HPV45 | L1 | 334 | 8 | QLFNKPYW | | 15934 |
| HPV45 | L1 | 334 | 9 | QLFNKPYWL | | 15935 |
| HPV45 | L1 | 206 | 10 | QLQPGDCPPL | | 15936 |
| HPV45 | L1 | 263 | 11 | QMSADPYGDSM | | 15937 |
| HPV45 | L1 | 491 | 8 | QYPLGRKF | | 15938 |
| HPV45 | L1 | 491 | 9 | QYPLGRKFL | | 15939 |
| HPV45 | L1 | 96 | 9 | QYRVFRVAL | | 15940 |
| HPV45 | L1 | 67 | 9 | RLLTVGNPY | | 15941 |
| HPV45 | L1 | 67 | 10 | RLLTVGNPYF | | 15942 |
| HPV45 | L1 | 124 | 9 | RLVWACVGM | | 15943 |
| HPV45 | L1 | 124 | 11 | RLVWACVGMEI | | 15944 |
| HPV45 | L1 | 101 | 10 | RVALPDPNKF | | 15945 |
| HPV45 | L1 | 46 | 8 | RVVNTDDY | | 15946 |
| HPV45 | L1 | 254 | 8 | SICKYPDY | | 15947 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | L1 | 254 | 9 | SICKYPDYL | | 15948 |
| HPV45 | L1 | 254 | 11 | SICKYPDYLQM | | 15949 |
| HPV45 | L1 | 58 | 11 | SIFYHAGSSRL | | 15950 |
| HPV45 | L1 | 427 | 8 | SILENWNF | | 15951 |
| HPV45 | L1 | 327 | 9 | SITTSDSQL | | 15952 |
| HPV45 | L1 | 327 | 10 | SITFSDSQLF | | 15953 |
| HPV45 | L1 | 443 | 8 | SLVDTYRF | | 15954 |
| HPV45 | L1 | 272 | 11 | SMFFCLRREQL | | 15955 |
| HPV45 | L1 | 423 | 10 | SMNSSILENW | | 15956 |
| HPV45 | L1 | 115 | 11 | STIYNPETQRL | | 15957 |
| HPV45 | L1 | 376 | 10 | STQNPVPNTY | | 15958 |
| HPV45 | L1 | 43 | 11 | SVARVVNTDDY | | 15959 |
| HPV45 | L1 | 175 | 9 | SVDYKQTQL | | 15960 |
| HPV45 | L1 | 175 | 11 | SVDYKQTQLCI | | 15961 |
| HPV45 | L1 | 419 | 10 | SYIHSMNSSI | | 15962 |
| HPV45 | L1 | 419 | 11 | SYIHSMNSSIL | | 15963 |
| HPV45 | L1 | 220 | 8 | TIIEDGDM | | 15964 |
| HPV45 | L1 | 410 | 9 | TITLTAEVM | | 15965 |
| HPV45 | L1 | 410 | 11 | TITLTAEVMSY | | 15966 |
| HPV45 | L1 | 116 | 10 | TIYNPETQRL | | 15967 |
| HPV45 | L1 | 200 | 8 | TLCKPAQL | | 15968 |
| HPV45 | L1 | 239 | 11 | TLQDTKCEVPL | | 15969 |
| HPV45 | L1 | 412 | 9 | TLTAEVMSY | | 15970 |
| HPV45 | L1 | 412 | 10 | TLTAEVMSYI | | 15971 |
| HPV45 | L1 | 462 | 10 | TTPPEKQDPY | | 15972 |
| HPV45 | L1 | 365 | 9 | TTRSTNLTL | | 15973 |
| HPV45 | L1 | 329 | 8 | TTSDSQLF | | 15974 |
| HPV45 | L1 | 441 | 8 | TTSLVDTY | | 15975 |
| HPV45 | L1 | 441 | 10 | TTSLVDTYRF | | 15976 |
| HPV45 | L1 | 478 | 8 | TVDLKEKF | | 15977 |
| HPV45 | L1 | 297 | 8 | TVPTDLYI | | 15978 |
| HPV45 | L1 | 361 | 11 | TVVDTTRSTNL | | 15979 |
| HPV45 | L1 | 384 | 10 | TYDPTKFKHY | | 15980 |
| HPV45 | L1 | 20 | 8 | VFPIFLQM | | 15981 |
| HPV45 | L1 | 20 | 10 | VFPIFLQMAL | | 15982 |
| HPV45 | L1 | 20 | 11 | VFPIFLQMALW | | 15983 |
| HPV45 | L1 | 293 | 10 | VMGDTVPTDL | | 15984 |
| HPV45 | L1 | 293 | 11 | VMGDTVPTDLY | | 15985 |
| HPV45 | L1 | 417 | 8 | VMSYIHSM | | 15986 |
| HPV45 | L1 | 362 | 10 | VVDTTRSTNL | | 15987 |
| HPV45 | L1 | 126 | 9 | VWACVGMEI | | 15988 |
| HPV45 | L1 | 319 | 10 | VYSPSPSGSI | | 15989 |
| HPV45 | L1 | 477 | 9 | WTVDLKEKF | | 15990 |
| HPV45 | L1 | 420 | 9 | YIHSMNSSI | | 15991 |
| HPV45 | L1 | 420 | 10 | YIHSMNSSIL | | 15992 |
| HPV45 | L1 | 303 | 9 | YIKGTSANM | | 15993 |
| HPV45 | L1 | 261 | 9 | YLQMSADPY | | 15994 |
| HPV45 | L1 | 53 | 8 | YVSRTSIF | | 15995 |
| HPV45 | L1 | 53 | 9 | YVSRTSIFY | | 15996 |
| HPV45 | L2 | 161 | 8 | AFSDPSII | | 15997 |
| HPV45 | L2 | 286 | 11 | ALSSRRGTVRF | | 15998 |
| HPV45 | L2 | 328 | 10 | ATEEIELQPL | | 15999 |
| HPV45 | L2 | 328 | 11 | ATEEIELQPLI | | 16000 |
| HPV45 | L2 | 303 | 11 | ATMFTRSGKQI | | 16001 |
| HPV45 | L2 | 340 | 8 | ATNDSDLF | | 16002 |
| HPV45 | L2 | 340 | 11 | ATNDSDLFDVY | | 16003 |
| HPV45 | L2 | 255 | 9 | AYEPLDTTL | | 16004 |
| HPV45 | L2 | 255 | 11 | AYEPLDTTLSF | | 16005 |
| HPV45 | L2 | 275 | 8 | DFMDIIRL | | 16006 |
| HPV45 | L2 | 405 | 10 | DIILPSHTPM | | 16007 |
| HPV45 | L2 | 405 | 11 | DIILPSHTPMW | | 16008 |
| HPV45 | L2 | 278 | 10 | DIIRLHRPAL | | 16009 |
| HPV45 | L2 | 322 | 11 | DISPIAATEEI | | 16010 |
| HPV45 | L2 | 142 | 11 | DITPTVDSVSI | | 16011 |
| HPV45 | L2 | 345 | 9 | DLFDVYADF | | 16012 |
| HPV45 | L2 | 83 | 11 | DVGPTRPPVVI | | 16013 |
| HPV45 | L2 | 30 | 11 | DVINKVEGTTL | | 16014 |
| HPV45 | L2 | 397 | 10 | DVPIYTGPDI | | 16015 |
| HPV45 | L2 | 397 | 11 | DVPIYTGPDII | | 16016 |
| HPV45 | L2 | 331 | 8 | EIELQPLI | | 16017 |
| HPV45 | L2 | 241 | 8 | FLTHPSSL | | 16018 |
| HPV45 | L2 | 241 | 11 | FLTHPSSLVTF | | 16019 |
| HPV45 | L2 | 122 | 9 | FTGTSGFEI | | 16020 |
| HPV45 | L2 | 157 | 11 | FTNPAFSDPSI | | 16021 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | L2 | 306 | 8 | FTRSGKQI | | 16022 |
| HPV45 | L2 | 368 | 8 | FTYPKYSL | | 16023 |
| HPV45 | L2 | 368 | 10 | FTYPKYSLTM | | 16024 |
| HPV45 | L2 | 319 | 8 | FYHDISPI | | 16025 |
| HPV45 | L2 | 51 | 9 | GIFLGGLGI | | 16026 |
| HPV45 | L2 | 430 | 8 | GIHGTQYY | | 16027 |
| HPV45 | L2 | 430 | 9 | GIHGTQYYL | | 16028 |
| HPV45 | L2 | 430 | 10 | GIHGTQYYLW | | 16029 |
| HPV45 | L2 | 25 | 8 | GTCPPDVI | | 16030 |
| HPV45 | L2 | 206 | 10 | GTEPISSTPL | | 16031 |
| HPV45 | L2 | 183 | 10 | GTPTSGSHGY | | 16032 |
| HPV45 | L2 | 433 | 9 | GTQYYLWPW | | 16033 |
| HPV45 | L2 | 433 | 10 | GTQYYLWPWY | | 16034 |
| HPV45 | L2 | 433 | 11 | GTQYYLWPWYY | | 16035 |
| HPV45 | L2 | 37 | 8 | GTTLADKI | | 16036 |
| HPV45 | L2 | 37 | 9 | GTTLADKIL | | 16037 |
| HPV45 | L2 | 37 | 11 | GTTLADKILQW | | 16038 |
| HPV45 | L2 | 134 | 8 | GTTTPAVL | | 16039 |
| HPV45 | L2 | 134 | 10 | GTTTPAVLDI | 16040 | |
| HPV45 | L2 | 292 | 8 | GTVRFSRL | | 16041 |
| HPV45 | L2 | 191 | 10 | GYEEIPLQTF | | 16042 |
| HPV45 | L2 | 318 | 9 | HFYHDISPI | | 16043 |
| HPV45 | L2 | 52 | 8 | IFLGGLGI | | 16044 |
| HPV45 | L2 | 406 | 9 | IILPSHTPM | | 16045 |
| HPV45 | L2 | 406 | 10 | IILPSHTPMW | | 16046 |
| HPV45 | L2 | 279 | 9 | IIRLHRPAL | | 16047 |
| HPV45 | L2 | 407 | 8 | ILPSHTPM | | 16048 |
| HPV45 | L2 | 407 | 9 | ILPSHTPMW | | 16049 |
| HPV45 | L2 | 44 | 9 | ILQWSSLGI | | 16050 |
| HPV45 | L2 | 44 | 10 | ILQWSSLGIF | | 16051 |
| HPV45 | L2 | 44 | 11 | ILQWSSLGIFL | | 16052 |
| HPV45 | L2 | 143 | 10 | ITPTVDSVSI | | 16053 |
| HPV45 | L2 | 400 | 8 | IYTGPDII | | 16054 |
| HPV45 | L2 | 400 | 9 | IYTGPDIIL | | 16055 |
| HPV45 | L2 | 43 | 8 | KILQWSSL | | 16056 |
| HPV45 | L2 | 43 | 10 | KILQWSSLGI | | 16057 |
| HPV45 | L2 | 43 | 11 | KILQWSSLGIF | | 16058 |
| HPV45 | L2 | 34 | 11 | KVEGTTLADKI | | 16059 |
| HPV45 | L2 | 346 | 8 | LFDVYADF | | 16060 |
| HPV45 | L2 | 337 | 10 | LISATNDSDL | | 16061 |
| HPV45 | L2 | 337 | 11 | LISATNDSDLF | | 16062 |
| HPV45 | L2 | 242 | 10 | LTHPSSLVTF | | 16063 |
| HPV45 | L2 | 375 | 11 | LTMPSTAASSY | | 16064 |
| HPV45 | L2 | 392 | 9 | LTSAWDVPI | | 16065 |
| HPV45 | L2 | 392 | 10 | LTSAWDVPIY | | 16066 |
| HPV45 | L2 | 248 | 9 | LVTFDNPAY | | 16067 |
| HPV45 | L2 | 438 | 8 | LWPWYYYF | | 16068 |
| HPV45 | L2 | 305 | 9 | MFTRSGKQI | | 16069 |
| HPV45 | L2 | 270 | 8 | NVPDSDFM | | 16070 |
| HPV45 | L2 | 270 | 10 | NVPDSDFMDI | | 16071 |
| HPV45 | L2 | 270 | 11 | NVPDSDFMDII | | 16072 |
| HPV45 | L2 | 387 | 10 | NVTVPLTSAW | | 16073 |
| HPV45 | L2 | 325 | 8 | PIAATEEI | | 16074 |
| HPV45 | L2 | 325 | 10 | PIAATEEIEL | | 16075 |
| HPV45 | L2 | 399 | 8 | PIYTGPDI | | 16076 |
| HPV45 | L2 | 399 | 9 | PIYTGPDII | | 16077 |
| HPV45 | L2 | 399 | 10 | PIYTGPDIIL | | 16078 |
| HPV45 | L2 | 258 | 8 | PLDTTLSF | | 16079 |
| HPV45 | L2 | 336 | 11 | PLISATNDSDL | | 16080 |
| HPV45 | L2 | 391 | 10 | PLTSAWDVPI | | 16081 |
| HPV45 | L2 | 391 | 11 | PLTSAWDVPIY | | 16082 |
| HPV45 | L2 | 98 | 9 | PTDPSIVTL | | 16083 |
| HPV45 | L2 | 120 | 9 | PTFTGTSGF | | 16084 |
| HPV45 | L2 | 120 | 11 | PTFTGTSGFEI | | 16085 |
| HPV45 | L2 | 420 | 9 | PTNASTTTY | | 16086 |
| HPV45 | L2 | 420 | 10 | PTNASTTTYI | | 16087 |
| HPV45 | L2 | 86 | 8 | PTRPPVVI | | 16088 |
| HPV45 | L2 | 185 | 8 | PTSGSHGY | | 16089 |
| HPV45 | L2 | 185 | 11 | PTSGSHGYEEI | | 16090 |
| HPV45 | L2 | 267 | 10 | PTSNVPDSDF | | 16091 |
| HPV45 | L2 | 267 | 11 | PTSNVPDSDFM | | 16092 |
| HPV45 | L2 | 145 | 8 | PTVDSVSI | | 16093 |
| HPV45 | L2 | 216 | 11 | PTVRRVRGPRL | | 16094 |
| HPV45 | L2 | 95 | 9 | PVGPTDPSI | | 16095 |

TABLE X-continued

A24 Supermotif Peptides

| Type | Protein | Position | No. of Amino Acids | Sequence | A*2402 | Seq. Id. No. |
|---|---|---|---|---|---|---|
| HPV45 | L2 | 118 | 11 | PVPTFTGTSGF | | 16096 |
| HPV45 | L2 | 453 | 8 | PYFFADGF | | 16097 |
| HPV45 | L2 | 240 | 9 | QFLTHPSSL | | 16098 |
| HPV45 | L2 | 312 | 8 | QIGGRVHF | | 16099 |
| HPV45 | L2 | 312 | 9 | QIGGRVHFY | | 16100 |
| HPV45 | L2 | 172 | 9 | QTGEVSGNI | | 16101 |
| HPV45 | L2 | 172 | 10 | QTGEVSGNIF | | 16102 |
| HPV45 | L2 | 233 | 9 | QVRVSTSQF | | 16103 |
| HPV45 | L2 | 233 | 10 | QVRVSTSQFL | | 16104 |
| HPV45 | L2 | 46 | 8 | QWSSLGIF | | 16105 |
| HPV45 | L2 | 46 | 9 | QWSSLGIFL | | 16106 |
| HPV45 | L2 | 435 | 8 | QYYLWPWY | | 16107 |
| HPV45 | L2 | 435 | 9 | QYYLWPWYY | | 16108 |
| HPV45 | L2 | 435 | 10 | QYYLWPWYYY | | 16109 |
| HPV45 | L2 | 435 | 11 | QYYLWPWYYYF | | 16110 |
| HPV45 | L2 | 295 | 11 | RFSRLGQRATM | | 16111 |
| HPV45 | L2 | 451 | 10 | RIPYFFADGF | | 16112 |
| HPV45 | L2 | 298 | 8 | RLGQRATM | | 16113 |
| HPV45 | L2 | 298 | 9 | RLGQRATMF | | 16114 |
| HPV45 | L2 | 316 | 8 | RVHFYHDI | | 16115 |
| HPV45 | L2 | 316 | 11 | RVHFYHDISPI | | 16116 |
| HPV45 | L2 | 220 | 8 | RVRGPRLY | | 16117 |
| HPV45 | L2 | 235 | 8 | RVSTSQFL | | 16118 |
| HPV45 | L2 | 367 | 9 | SFTYPKYSL | | 16119 |
| HPV45 | L2 | 367 | 11 | SFTYPKYSLTM | | 16120 |
| HPV45 | L2 | 49 | 9 | SLGIFLGGL | | 16121 |
| HPV45 | L2 | 49 | 11 | SLGIFLGGLGI | | 16122 |
| HPV45 | L2 | 247 | 10 | SLVTFDNPAY | | 16123 |
| HPV45 | L2 | 362 | 9 | STIHKSFTY | | 16124 |
| HPV45 | L2 | 154 | 9 | STSFTNPAF | | 16125 |
| HPV45 | L2 | 358 | 11 | STTPSTIHKSF | | 16126 |
| HPV45 | L2 | 424 | 8 | STTTYIGI | | 16127 |
| HPV45 | L2 | 149 | 9 | SVSISSTSF | | 16128 |
| HPV45 | L2 | 384 | 9 | SYSNVTVPL | | 16129 |
| HPV45 | L2 | 250 | 10 | TFDNPAYEPL | | 16130 |
| HPV45 | L2 | 121 | 8 | TFTGTSGF | | 16131 |
| HPV45 | L2 | 121 | 10 | TFTGTSGFEI | | 16132 |
| HPV45 | L2 | 363 | 8 | TIHKSFTY | | 16133 |
| HPV45 | L2 | 363 | 11 | TIHKSFTYPKY | | 16134 |
| HPV45 | L2 | 39 | 9 | TLADKILQW | | 16135 |
| HPV45 | L2 | 304 | 10 | TMFTRSGKQI | | 16136 |
| HPV45 | L2 | 376 | 10 | TMPSTAASSY | | 16137 |
| HPV45 | L2 | 38 | 8 | TTLADKIL | | 16138 |
| HPV45 | L2 | 38 | 10 | TTLADKILQW | | 16139 |
| HPV45 | L2 | 136 | 8 | TTPAVLDI | | 16140 |
| HPV45 | L2 | 359 | 10 | TTPSTIHKSF | | 16141 |
| HPV45 | L2 | 135 | 9 | TTTPAVLDI | | 16142 |
| HPV45 | L2 | 426 | 11 | TTYIGIHGTQY | | 16143 |
| HPV45 | L2 | 389 | 8 | TVPLTSAW | | 16144 |
| HPV45 | L2 | 217 | 10 | TVRRVRGPRL | | 16145 |
| HPV45 | L2 | 217 | 11 | TVRRVRGPRLY | | 16146 |
| HPV45 | L2 | 427 | 10 | TYIGIHGTQY | | 16147 |
| HPV45 | L2 | 427 | 11 | TYIGIHGTQYY | | 16148 |
| HPV45 | L2 | 369 | 9 | TYPKYSLTM | | 16149 |
| HPV45 | L2 | 31 | 10 | VINKVEGTTL | | 16150 |
| HPV45 | L2 | 249 | 8 | VTFDNPAY | | 16151 |
| HPV45 | L2 | 249 | 11 | VTFDNPAYEPL | | 16152 |
| HPV45 | L2 | 388 | 9 | VTVPLTSAW | | 16153 |
| HPV45 | L2 | 112 | 11 | VVASGAPVPTF | | 16154 |
| HPV45 | L2 | 444 | 9 | YFPKKRKRI | | 16155 |
| HPV45 | L2 | 444 | 11 | YFPKKRKRIPY | | 16156 |
| HPV45 | L2 | 428 | 9 | YIGIHGTQY | | 16157 |
| HPV45 | L2 | 428 | 10 | YIGIHGTQYY | | 16158 |
| HPV45 | L2 | 428 | 11 | YIGIHGTQYYL | | 16159 |
| HPV45 | L2 | 437 | 8 | YLWPWYYY | | 16160 |
| HPV45 | L2 | 437 | 9 | YLWPWYYYF | | 16161 |
| HPV45 | L2 | 401 | 8 | YTGPDIIL | | 16162 |
| HPV45 | L2 | 443 | 10 | YYFPKKRKRI | | 16163 |
| HPV45 | L2 | 436 | 8 | YYLWPWYY | | 16164 |
| HPV45 | L2 | 436 | 9 | YYLWPWYYY | | 16165 |
| HPV45 | L2 | 436 | 10 | YYLWPWYYYF | | 16166 |
| HPV45 | L2 | 442 | 11 | YYYFPKKRKRI | | 16167 |
| HPV56 | E2 | 15 | 8 | AIEVQIAL | | 16168 |
| HPV56 | E2 | 15 | 11 | AIEVQIALESL | | 16169 |

TABLE X-continued

A24 Supermotif Peptides

| Type | Protein | Position | No. of Amino Acids | Sequence | A*2402 | Seq. Id. No. |
|---|---|---|---|---|---|---|
| HPV56 | E2 | 21 | 9 | ALESLSTTI | | 16170 |
| HPV56 | E2 | 21 | 10 | ALESLSTTIY | | 16171 |
| HPV56 | E2 | 52 | 9 | CFKKEGQHI | | 16172 |
| HPV56 | E2 | 71 | 9 | CMQYVAWKY | | 16173 |
| HPV56 | E2 | 71 | 10 | CMQYVAWKYI | | 16174 |
| HPV56 | E2 | 71 | 11 | CMQYVAWKYIY | | 16175 |
| HPV56 | E2 | 204 | 8 | CVTTHTHI | | 16176 |
| HPV56 | E2 | 113 | 9 | DFEQEAKKF | | 16177 |
| HPV56 | E2 | 39 | 8 | DTCEELWL | | 16178 |
| HPV56 | E2 | 263 | 8 | DVTSTYHW | | 16179 |
| HPV56 | E2 | 43 | 11 | ELWLTEPKKCF | | 16180 |
| HPV56 | E2 | 288 | 8 | ETQRNSFL | | 16181 |
| HPV56 | E2 | 128 | 9 | EVHMENESI | | 16182 |
| HPV56 | E2 | 128 | 10 | EVHMENESIY | | 16183 |
| HPV56 | E2 | 17 | 9 | EVQIALESL | | 16184 |
| HPV56 | E2 | 34 | 11 | EWTLRDTCEEL | | 16185 |
| HPV56 | E2 | 294 | 11 | FLSHVKIPVVY | | 16186 |
| HPV56 | E2 | 261 | 8 | FVDVTSTY | | 16187 |
| HPV56 | E2 | 261 | 10 | FVDVTSTYHW | | 16188 |
| HPV56 | E2 | 94 | 8 | GVDYRGIY | | 16189 |
| HPV56 | E2 | 94 | 9 | GVDYRGIYY | | 16190 |
| HPV56 | E2 | 87 | 11 | GWQKVCSGVDY | | 16191 |
| HPV56 | E2 | 239 | 9 | HLKGEPNRL | | 16192 |
| HPV56 | E2 | 130 | 8 | HMENESIY | | 16193 |
| HPV56 | E2 | 297 | 8 | HVKIPVVY | | 16194 |
| HPV56 | E2 | 297 | 10 | HVKIPVVYRL | | 16195 |
| HPV56 | E2 | 269 | 10 | HWTSTDNKNY | | 16196 |
| HPV56 | E2 | 126 | 11 | IWEVHMENESI | | 16197 |
| HPV56 | E2 | 284 | 11 | IYKDETQRNSF | | 16198 |
| HPV56 | E2 | 29 | 9 | IYNNEEWTL | | 16199 |
| HPV56 | E2 | 80 | 9 | IYYNGDCGW | | 16200 |
| HPV56 | E2 | 100 | 11 | IYYVHDGHKTY | | 16201 |
| HPV56 | E2 | 120 | 8 | KFGCKNIW | | 16202 |
| HPV56 | E2 | 299 | 8 | KIPVVYRL | | 16203 |
| HPV56 | E2 | 299 | 10 | KIPVVYRLVW | | 16204 |
| HPV56 | E2 | 258 | 11 | KTLFVDVTSTY | | 16205 |
| HPV56 | E2 | 233 | 8 | KTTPVVHL | | 16206 |
| HPV56 | E2 | 90 | 8 | KVCSGVDY | | 16207 |
| HPV56 | E2 | 90 | 11 | KVCSGVDYRGI | | 16208 |
| HPV56 | E2 | 78 | 11 | KYIYYNGDCGW | | 16209 |
| HPV56 | E2 | 260 | 9 | LFVDVTSTY | | 16210 |
| HPV56 | E2 | 260 | 11 | LFVDVTSTYHW | | 16211 |
| HPV56 | E2 | 46 | 8 | LTEPKKCF | | 16212 |
| HPV56 | E2 | 44 | 10 | LWLTEPKKCF | | 16213 |
| HPV56 | E2 | 216 | 9 | NTDSRSRSI | | 16214 |
| HPV56 | E2 | 149 | 11 | NVSPVETVNEY | | 16215 |
| HPV56 | E2 | 277 | 8 | NYSIITII | | 16216 |
| HPV56 | E2 | 277 | 9 | NYSIITIIY | | 16217 |
| HPV56 | E2 | 152 | 8 | PVETVNEY | | 16218 |
| HPV56 | E2 | 301 | 8 | PVVYRLVW | | 16219 |
| HPV56 | E2 | 19 | 11 | QIALESLSTTI | | 16220 |
| HPV56 | E2 | 6 | 11 | QVCKAKACSAI | | 16221 |
| HPV56 | E2 | 73 | 8 | QYVAWKYI | | 16222 |
| HPV56 | E2 | 73 | 9 | QYVAWKYIY | | 16223 |
| HPV56 | E2 | 73 | 10 | QYVAWKYIYY | | 16224 |
| HPV56 | E2 | 253 | 8 | RFQKYKTL | | 16225 |
| HPV56 | E2 | 253 | 9 | RFQKYKTLF | | 16226 |
| HPV56 | E2 | 246 | 9 | RLKCCRYRF | | 16227 |
| HPV56 | E2 | 251 | 10 | RYRFQKYKTL | | 16228 |
| HPV56 | E2 | 251 | 11 | RYRFQKYKTLF | | 16229 |
| HPV56 | E2 | 293 | 8 | SFLSHVKI | | 16230 |
| HPV56 | E2 | 272 | 9 | STDNKNYSI | | 16231 |
| HPV56 | E2 | 272 | 10 | STDNKNYSII | | 16232 |
| HPV56 | E2 | 26 | 10 | STTIYNNEEW | | 16233 |
| HPV56 | E2 | 141 | 8 | SVSSTCRY | | 16234 |
| HPV56 | E2 | 28 | 8 | TIYNNEEW | | 16235 |
| HPV56 | E2 | 28 | 10 | TIYNNEEWTL | | 16236 |
| HPV56 | E2 | 259 | 10 | TLFVDVTSTY | | 16237 |
| HPV56 | E2 | 36 | 9 | TLRDTCEEL | | 16238 |
| HPV56 | E2 | 36 | 10 | TLRDTCEELW | | 16239 |
| HPV56 | E2 | 36 | 11 | TLRDTCEELWL | | 16240 |
| HPV56 | E2 | 27 | 9 | TTIYNNEEW | | 16241 |
| HPV56 | E2 | 27 | 11 | TTIYNNEEWTL | | 16242 |
| HPV56 | E2 | 237 | 11 | VVHLKGEPNRL | | 16243 |

TABLE X-continued

A24 Supermotif Peptides

| Type | Protein | Position | No. of Amino Acids | Sequence | A*2402 | Seq. Id. No. |
|---|---|---|---|---|---|---|
| HPV56 | E2 | 62 | 11 | VWFDGSKNNCM | | 16244 |
| HPV56 | E2 | 63 | 10 | WFDGSKNNCM | | 16245 |
| HPV56 | E2 | 45 | 9 | WLTEPKKCF | | 16246 |
| HPV56 | E2 | 35 | 10 | WTLRDTCEEL | | 16247 |
| HPV56 | E2 | 35 | 11 | WTLRDTCEELW | | 16248 |
| HPV56 | E2 | 270 | 9 | WTSTDNKNY | | 16249 |
| HPV56 | E2 | 270 | 11 | WTSTDNKNYSI | | 16250 |
| HPV56 | E2 | 79 | 10 | YIYYNGDCGW | | 16251 |
| HPV56 | E2 | 111 | 11 | YTDFEQEAKKF | | 16252 |
| HPV56 | E2 | 74 | 8 | YVAWKYIY | | 16253 |
| HPV56 | E2 | 74 | 9 | YVAWKYIYY | | 16254 |
| HPV56 | E2 | 102 | 9 | YVHDGHKTY | | 16255 |
| HPV56 | E2 | 102 | 10 | YVHDGHKTYY | | 16256 |
| HPV56 | E2 | 81 | 8 | YYNGDCGW | | 16257 |
| HPV56 | E2 | 101 | 10 | YYVHDGHKTY | | 16258 |
| HPV56 | E2 | 101 | 11 | YYVHDGHKTYY | | 16259 |
| HPV56 | E6 | 89 | 11 | ATLESITKKQL | | 16260 |
| HPV56 | E6 | 64 | 8 | AVCRVCLL | | 16261 |
| HPV56 | E6 | 64 | 9 | AVCRVCLLF | | 16262 |
| HPV56 | E6 | 64 | 10 | AVCRVCLLFY | | 16263 |
| HPV56 | E6 | 69 | 11 | CLLFYSKVRKY | | 16264 |
| HPV56 | E6 | 50 | 8 | CTELKLVY | | 16265 |
| HPV56 | E6 | 33 | 8 | CVYCKKEL | | 16266 |
| HPV56 | E6 | 106 | 8 | CYRCQSPL | | 16267 |
| HPV56 | E6 | 60 | 11 | DFPYAVCRVCL | | 16268 |
| HPV56 | E6 | 28 | 8 | DLRLSCVY | | 16269 |
| HPV56 | E6 | 83 | 9 | DYSVYGATL | | 16270 |
| HPV56 | E6 | 23 | 9 | EIPLIDLRL | | 16271 |
| HPV56 | E6 | 52 | 10 | ELKLVYRDDF | | 16272 |
| HPV56 | E6 | 39 | 8 | ELTRAEVY | | 16273 |
| HPV56 | E6 | 39 | 10 | ELTRAEVYNF | | 16274 |
| HPV56 | E6 | 20 | 8 | EVLEIPLI | | 16275 |
| HPV56 | E6 | 20 | 10 | EVLEIPLIDL | | 16276 |
| HPV56 | E6 | 44 | 10 | EVYNFACTEL | | 16277 |
| HPV56 | E6 | 72 | 8 | FYSKVRKY | | 16278 |
| HPV56 | E6 | 72 | 10 | FYSKVRKYRY | | 16279 |
| HPV56 | E6 | 72 | 11 | FYSKVRKYRYY | | 16280 |
| HPV56 | E6 | 134 | 10 | GWTGSCLGCW | | 16281 |
| HPV56 | E6 | 17 | 8 | HLSEVLEI | | 16282 |
| HPV56 | E6 | 17 | 10 | HLSEVLEIPL | | 16283 |
| HPV56 | E6 | 17 | 11 | HLSEVLEIPLI | | 16284 |
| HPV56 | E6 | 94 | 9 | ITKKQLCDL | | 16285 |
| HPV56 | E6 | 94 | 10 | ITKKQLCDLL | | 16286 |
| HPV56 | E6 | 94 | 11 | ITKKQLCDLLI | | 16287 |
| HPV56 | E6 | 54 | 8 | KLVYRDDF | | 16288 |
| HPV56 | E6 | 54 | 10 | KLVYRDDFPY | | 16289 |
| HPV56 | E6 | 75 | 8 | KVRKYRYY | | 16290 |
| HPV56 | E6 | 75 | 10 | KVRKYRYYDY | | 16291 |
| HPV56 | E6 | 78 | 10 | KYRYYDYSVY | | 16292 |
| HPV56 | E6 | 71 | 9 | LFYSKVRKY | | 16293 |
| HPV56 | E6 | 71 | 11 | LFYSKVRKYRY | | 16294 |
| HPV56 | E6 | 130 | 11 | LIAHGWTGSCL | | 16295 |
| HPV56 | E6 | 26 | 10 | LIDLRLSCVY | | 16296 |
| HPV56 | E6 | 103 | 11 | LICYRCQSPL | | 16297 |
| HPV56 | E6 | 70 | 10 | LLFYSKVRKY | | 16298 |
| HPV56 | E6 | 113 | 8 | LTPEEKQL | | 16299 |
| HPV56 | E6 | 40 | 9 | LTRAEVYNF | | 16300 |
| HPV56 | E6 | 55 | 9 | LVYRDDFPY | | 16301 |
| HPV56 | E6 | 47 | 9 | NFACTELKL | | 16302 |
| HPV56 | E6 | 47 | 11 | NFACTELKLVY | | 16303 |
| HPV56 | E6 | 25 | 11 | PLIDLRLSCVY | | 16304 |
| HPV56 | E6 | 112 | 9 | PLTPEEKQL | | 16305 |
| HPV56 | E6 | 62 | 9 | PYAVCRVCL | | 16306 |
| HPV56 | E6 | 62 | 10 | PYAVCRVCLL | | 16307 |
| HPV56 | E6 | 62 | 11 | PYAVCRVCLLF | | 16308 |
| HPV56 | E6 | 98 | 10 | QLCDLLIRCY | | 16309 |
| HPV56 | E6 | 119 | 10 | QLHCDRKRRF | | 16310 |
| HPV56 | E6 | 127 | 9 | RFHLIAHGW | | 16311 |
| HPV56 | E6 | 30 | 11 | RLSCVYCKKEL | | 16312 |
| HPV56 | E6 | 80 | 8 | RYYDYSVY | | 16313 |
| HPV56 | E6 | 93 | 10 | SITKKQLCDL | | 16314 |
| HPV56 | E6 | 93 | 11 | SITKKQLCDLL | | 16315 |
| HPV56 | E6 | 14 | 9 | SLHHLSEVL | | 16316 |
| HPV56 | E6 | 14 | 11 | SLHHLSEVLEI | | 16317 |

TABLE X-continued

A24 Supermotif Peptides

| Type | Protein | Position | No. of Amino Acids | Sequence | A*2402 | Seq. Id. No. |
|---|---|---|---|---|---|---|
| HPV56 | E6 | 85 | 10 | SVYGATLESI | | 16318 |
| HPV56 | E6 | 90 | 10 | TLESITKKQL | | 16319 |
| HPV56 | E6 | 21 | 9 | VLEIPLIDL | | 16320 |
| HPV56 | E6 | 21 | 11 | VLEIPLIDLRL | | 16321 |
| HPV56 | E6 | 86 | 9 | VYGATLESI | | 16322 |
| HPV56 | E6 | 45 | 9 | VYNFACTEL | | 16323 |
| HPV56 | E6 | 45 | 11 | VYNFACTELKL | | 16324 |
| HPV56 | E6 | 56 | 8 | VYRDDFPY | | 16325 |
| HPV56 | E6 | 135 | 9 | WTGSCLGCW | | 16326 |
| HPV56 | E6 | 81 | 11 | YYDYSVYGATL | | 16327 |
| HPV56 | E7 | 93 | 8 | ALTVTCPL | | 16328 |
| HPV56 | E7 | 75 | 9 | DIQSTKEDL | | 16329 |
| HPV56 | E7 | 22 | 8 | DLQCNEQL | | 16330 |
| HPV56 | E7 | 82 | 8 | DLRVVQQL | | 16331 |
| HPV56 | E7 | 82 | 9 | DLRVVQQLL | | 16332 |
| HPV56 | E7 | 82 | 10 | DLRVVQQLLM | | 16333 |
| HPV56 | E7 | 20 | 10 | EIDLQCNEQL | | 16334 |
| HPV56 | E7 | 14 | 8 | ELTPQTEI | | 16335 |
| HPV56 | E7 | 14 | 10 | ELTPQTEIDL | | 16336 |
| HPV56 | E7 | 62 | 9 | HVPCCECKF | | 16337 |
| HPV56 | E7 | 69 | 8 | KFVVQLDI | | 16338 |
| HPV56 | E7 | 4 | 10 | KVPTLQDVVL | | 16339 |
| HPV56 | E7 | 60 | 11 | LIHVPCCECKF | | 16340 |
| HPV56 | E7 | 90 | 11 | LMGALTVTCPL | | 16341 |
| HPV56 | E7 | 15 | 9 | LTPQTEIDL | | 16342 |
| HPV56 | E7 | 6 | 8 | PTLQDVVL | | 16343 |
| HPV56 | E7 | 6 | 10 | PTLQDVVLEL | | 16344 |
| HPV56 | E7 | 73 | 11 | QLDIQSTKEDL | | 16345 |
| HPV56 | E7 | 84 | 8 | RVVQQLLM | | 16346 |
| HPV56 | E7 | 84 | 11 | RVVQQLLMGAL | | 16347 |
| HPV56 | E7 | 7 | 9 | TLQDVVLEL | | 16348 |
| HPV56 | E7 | 12 | 10 | VLELTPQTEI | | 16349 |
| HPV56 | E7 | 11 | 11 | VVLELTPQTEI | | 16350 |
| HPV56 | E7 | 85 | 10 | VVQQLLMGAL | | 16351 |
| HPV56 | L1 | 58 | 11 | ATDSYVKRTSI | | 16352 |
| HPV56 | L1 | 381 | 8 | ATEQLSKY | | 16353 |
| HPV56 | L1 | 327 | 8 | ATPSGSMI | | 16354 |
| HPV56 | L1 | 444 | 8 | ATSLEDKY | | 16355 |
| HPV56 | L1 | 444 | 10 | ATSLEDKYRY | | 16356 |
| HPV56 | L1 | 37 | 11 | ATWRPSENKVY | | 16357 |
| HPV56 | L1 | 26 | 8 | AVNVFPIF | | 16358 |
| HPV56 | L1 | 26 | 9 | AVNVFPIFL | | 16359 |
| HPV56 | L1 | 26 | 11 | AVNVFPIFLQM | | 16360 |
| HPV56 | L1 | 275 | 8 | AYGDSMWF | | 16361 |
| HPV56 | L1 | 275 | 9 | AYGDSMWFY | | 16362 |
| HPV56 | L1 | 275 | 10 | AYGDSMWFYL | | 16363 |
| HPV56 | L1 | 422 | 10 | AYLHNMNANL | | 16364 |
| HPV56 | L1 | 422 | 11 | AYLHNMNANLL | | 16365 |
| HPV56 | L1 | 101 | 11 | AYQYRVFRVRL | | 16366 |
| HPV56 | L1 | 191 | 9 | CIVGCTPAM | | 16367 |
| HPV56 | L1 | 195 | 9 | CTPAMGEHW | | 16368 |
| HPV56 | L1 | 257 | 9 | DIVQSTCKY | | 16369 |
| HPV56 | L1 | 491 | 11 | DLDQFPLGRKF | | 16370 |
| HPV56 | L1 | 233 | 10 | DMIDTGFGAM | | 16371 |
| HPV56 | L1 | 236 | 9 | DTGFGAMDF | | 16372 |
| HPV56 | L1 | 369 | 8 | DTTRSTNM | | 16373 |
| HPV56 | L1 | 369 | 10 | DTTRSTNMTI | | 16374 |
| HPV56 | L1 | 23 | 8 | DVGAVNVF | | 16375 |
| HPV56 | L1 | 23 | 10 | DVGAVNVFPI | | 16376 |
| HPV56 | L1 | 23 | 11 | DVGAVNVFPIF | | 16377 |
| HPV56 | L1 | 481 | 8 | DVNLQDSF | | 16378 |
| HPV56 | L1 | 267 | 10 | DYLKMSADAY | | 16379 |
| HPV56 | L1 | 404 | 8 | ELQFVFQL | | 16380 |
| HPV56 | L1 | 404 | 11 | ELQFVFQLCKI | | 16381 |
| HPV56 | L1 | 303 | 8 | ETIPAELY | | 16382 |
| HPV56 | L1 | 303 | 9 | ETIPAELYL | | 16383 |
| HPV56 | L1 | 140 | 8 | EVGRGQPL | | 16384 |
| HPV56 | L1 | 419 | 9 | EVMAYLHNM | | 16385 |
| HPV56 | L1 | 402 | 8 | EYELQFVF | | 16386 |
| HPV56 | L1 | 402 | 10 | EYELQFVFQL | | 16387 |
| HPV56 | L1 | 21 | 10 | FLDVGAVNVF | | 16388 |
| HPV56 | L1 | 407 | 8 | FVFQLCKI | | 16389 |
| HPV56 | L1 | 407 | 10 | FVFQLCKITL | | 16390 |
| HPV56 | L1 | 479 | 10 | FWDVNLQDSF | | 16391 |

TABLE X-continued

A24 Supermotif Peptides

| Type | Protein | Position | No. of Amino Acids | Sequence | A*2402 | Seq. Id. No. |
|---|---|---|---|---|---|---|
| HPV56 | L1 | 69 | 9 | FYHAGSSRL | | 16392 |
| HPV56 | L1 | 69 | 10 | FYHAGSSRLL | | 16393 |
| HPV56 | L1 | 282 | 8 | FYLRREQL | | 16394 |
| HPV56 | L1 | 282 | 9 | FYLRREQLF | | 16395 |
| HPV56 | L1 | 238 | 10 | GFGAMDFKVL | | 16396 |
| HPV56 | L1 | 356 | 8 | GICWGNQL | | 16397 |
| HPV56 | L1 | 356 | 9 | GICWGNQLF | | 16398 |
| HPV56 | L1 | 138 | 10 | GLEVGRGQPL | | 16399 |
| HPV56 | L1 | 118 | 8 | GLPDTNIY | | 16400 |
| HPV56 | L1 | 150 | 8 | GLSGHPLF | | 16401 |
| HPV56 | L1 | 150 | 11 | GLSGHPLFNRL | | 16402 |
| HPV56 | L1 | 438 | 10 | GLSPPVATSL | | 16403 |
| HPV56 | L1 | 399 | 9 | HVEEYELQF | | 16404 |
| HPV56 | L1 | 399 | 11 | HVEEYELQFVF | | 16405 |
| HPV56 | L1 | 15 | 8 | HYGLCIFL | | 16406 |
| HPV56 | L1 | 20 | 11 | IFLDVGAVNVF | | 16407 |
| HPV56 | L1 | 32 | 8 | IFLQMATW | | 16408 |
| HPV56 | L1 | 68 | 10 | IFYHAGSSRL | | 16409 |
| HPV56 | L1 | 68 | 11 | IFYHAGSSRLL | | 16410 |
| HPV56 | L1 | 414 | 8 | ITLSAEVM | | 16411 |
| HPV56 | L1 | 414 | 10 | ITLSAEVMAY | | 16412 |
| HPV56 | L1 | 414 | 11 | ITLSAEVMAYL | | 16413 |
| HPV56 | L1 | 334 | 8 | ITSEAQLF | | 16414 |
| HPV56 | L1 | 192 | 8 | IVGCTPAM | | 16415 |
| HPV56 | L1 | 258 | 8 | IVQSTCKY | | 16416 |
| HPV56 | L1 | 258 | 11 | IVQSTCKYPDY | | 16417 |
| HPV56 | L1 | 124 | 9 | IYNPDQERL | | 16418 |
| HPV56 | L1 | 124 | 11 | IYNPDQERLVW | | 16419 |
| HPV56 | L1 | 8 | 9 | IYRDPPLHY | | 16420 |
| HPV56 | L1 | 8 | 11 | IYRDPPLHYGL | | 16421 |
| HPV56 | L1 | 116 | 9 | KFGLPDTNI | | 16422 |
| HPV56 | L1 | 116 | 10 | KFGLPDTNIY | | 16423 |
| HPV56 | L1 | 478 | 11 | KFWDVNLQDSF | | 16424 |
| HPV56 | L1 | 413 | 9 | KITLSAEVM | | 16425 |
| HPV56 | L1 | 413 | 11 | KITLSAEVMAY | | 16426 |
| HPV56 | L1 | 270 | 11 | KMSADAYGDSM | | 16427 |
| HPV56 | L1 | 93 | 10 | KTNIPKVSAY | | 16428 |
| HPV56 | L1 | 300 | 10 | KVGETIPAEL | | 16429 |
| HPV56 | L1 | 300 | 11 | KVGETIPAELY | | 16430 |
| HPV56 | L1 | 98 | 10 | KVSAYQYRVF | | 16431 |
| HPV56 | L1 | 55 | 8 | KVVATDSY | | 16432 |
| HPV56 | L1 | 387 | 10 | KYDARKINQY | | 16433 |
| HPV56 | L1 | 387 | 11 | KYDARKINQYL | | 16434 |
| HPV56 | L1 | 476 | 9 | KYKFWDVNL | | 16435 |
| HPV56 | L1 | 264 | 8 | KYPDYLKM | | 16436 |
| HPV56 | L1 | 450 | 10 | KYRYVRSTAI | | 16437 |
| HPV56 | L1 | 340 | 8 | LFNKPYWL | | 16438 |
| HPV56 | L1 | 224 | 11 | LINTPIEDGDM | | 16439 |
| HPV56 | L1 | 77 | 8 | LLAVGHPY | | 16440 |
| HPV56 | L1 | 77 | 9 | LLAVGHPYY | | 16441 |
| HPV56 | L1 | 431 | 9 | LLEDWNIGL | | 16442 |
| HPV56 | L1 | 132 | 8 | LVWACVGL | | 16443 |
| HPV56 | L1 | 234 | 9 | MIDTGFGAM | | 16444 |
| HPV56 | L1 | 234 | 11 | MIDTGFGAMDF | | 16445 |
| HPV56 | L1 | 333 | 8 | MITSEAQL | | 16446 |
| HPV56 | L1 | 333 | 9 | MITSEAQLF | | 16447 |
| HPV56 | L1 | 2 | 8 | MLPMMYIY | | 16448 |
| HPV56 | L1 | 1 | 8 | MMLPMMYI | | 16449 |
| HPV56 | L1 | 1 | 9 | MMLPMMYIY | | 16450 |
| HPV56 | L1 | 5 | 10 | MMYIYRDPPL | | 16451 |
| HPV56 | L1 | 376 | 10 | MTISTATEQL | | 16452 |
| HPV56 | L1 | 280 | 10 | MWFYLRREQL | | 16453 |
| HPV56 | L1 | 280 | 11 | MWFYLRREQLF | | 16454 |
| HPV56 | L1 | 6 | 9 | MYIYRDPPL | | 16455 |
| HPV56 | L1 | 6 | 11 | MYIYRDPPLHY | | 16456 |
| HPV56 | L1 | 95 | 8 | NIPKVSAY | | 16457 |
| HPV56 | L1 | 95 | 10 | NIPKVSAYQY | | 16458 |
| HPV56 | L1 | 180 | 11 | NISVDGKQTQL | | 16459 |
| HPV56 | L1 | 123 | 10 | NIYNPDQERL | | 16460 |
| HPV56 | L1 | 167 | 8 | NLANNNVI | | 16461 |
| HPV56 | L1 | 430 | 8 | NLLEDWNI | | 16462 |
| HPV56 | L1 | 430 | 10 | NLLEDWNIGL | | 16463 |
| HPV56 | L1 | 483 | 10 | NLQDSFSTDL | | 16464 |
| HPV56 | L1 | 426 | 10 | NMNANLLEDW | | 16465 |

TABLE X-continued

A24 Supermotif Peptides

| Type | Protein | Position | No. of Amino Acids | Sequence | A*2402 | Seq. Id. No. |
|---|---|---|---|---|---|---|
| HPV56 | L1 | 375 | 11 | NMTISTATEQL | | 16466 |
| HPV56 | L1 | 226 | 9 | NTPIEDGDM | | 16467 |
| HPV56 | L1 | 226 | 10 | NTPIEDGDMI | | 16468 |
| HPV56 | L1 | 28 | 9 | NVFPIFLQM | | 16469 |
| HPV56 | L1 | 172 | 10 | NVIEDSRDNI | | 16470 |
| HPV56 | L1 | 228 | 8 | PIEDGDMI | | 16471 |
| HPV56 | L1 | 31 | 9 | PIFLQMATW | | 16472 |
| HPV56 | L1 | 473 | 8 | PLAKYKFW | | 16473 |
| HPV56 | L1 | 221 | 9 | PLALINTPI | | 16474 |
| HPV56 | L1 | 255 | 11 | PLDIVQSTCKY | | 16475 |
| HPV56 | L1 | 146 | 11 | PLGAGLSGHPL | | 16476 |
| HPV56 | L1 | 496 | 8 | PLGRKFLM | | 16477 |
| HPV56 | L1 | 496 | 10 | PLGRKFLMQL | | 16478 |
| HPV56 | L1 | 13 | 8 | PLHYGLCI | | 16479 |
| HPV56 | L1 | 13 | 9 | PLHYGLCIF | | 16480 |
| HPV56 | L1 | 13 | 10 | PLHYGLCIFL | | 16481 |
| HPV56 | L1 | 4 | 11 | PMMYIYRDPPL | | 16482 |
| HPV56 | L1 | 467 | 8 | PTEKQDPL | | 16483 |
| HPV56 | L1 | 467 | 11 | PTEKQDPLAKY | | 16484 |
| HPV56 | L1 | 442 | 10 | PVATSLEDKY | | 16485 |
| HPV56 | L1 | 52 | 11 | PVSKVVATDSY | | 16486 |
| HPV56 | L1 | 494 | 8 | QFPLGRKF | | 16487 |
| HPV56 | L1 | 494 | 9 | QFPLGRKFL | | 16488 |
| HPV56 | L1 | 494 | 10 | QFPLGRKFLM | | 16489 |
| HPV56 | L1 | 406 | 9 | QFVFQLCKI | | 16490 |
| HPV56 | L1 | 406 | 11 | QFVFQLCKITL | | 16491 |
| HPV56 | L1 | 189 | 11 | QLCIVGCTPAM | | 16492 |
| HPV56 | L1 | 288 | 8 | QLFARHYF | | 16493 |
| HPV56 | L1 | 339 | 8 | QLFNKPYW | | 16494 |
| HPV56 | L1 | 339 | 9 | QLFNKPYWL | | 16495 |
| HPV56 | L1 | 384 | 10 | QLSKYDARKI | | 16496 |
| HPV56 | L1 | 213 | 10 | QVTTGDCPPL | | 16497 |
| HPV56 | L1 | 395 | 9 | QYLRHVEEY | | 16498 |
| HPV56 | L1 | 395 | 11 | QYLRHVEEYEL | | 16499 |
| HPV56 | L1 | 103 | 9 | QYRVFRVRL | | 16500 |
| HPV56 | L1 | 159 | 10 | RLDDTESSNL | | 16501 |
| HPV56 | L1 | 76 | 9 | RLLAVGHPY | | 16502 |
| HPV56 | L1 | 76 | 10 | RLLAVGHPYY | | 16503 |
| HPV56 | L1 | 110 | 8 | RLPDPNKF | | 16504 |
| HPV56 | L1 | 110 | 10 | RLPDPNKFGL | | 16505 |
| HPV56 | L1 | 131 | 9 | RLVWACVGL | | 16506 |
| HPV56 | L1 | 108 | 10 | RVRLPDPNKF | | 16507 |
| HPV56 | L1 | 452 | 8 | RYVRSTAI | | 16508 |
| HPV56 | L1 | 487 | 9 | SFSTDLDQF | | 16509 |
| HPV56 | L1 | 487 | 11 | SFSTDLDQFPL | | 16510 |
| HPV56 | L1 | 67 | 11 | SIFYHAGSSRL | | 16511 |
| HPV56 | L1 | 446 | 8 | SLEDKYRY | | 16512 |
| HPV56 | L1 | 332 | 9 | SMITSEAQL | | 16513 |
| HPV56 | L1 | 332 | 10 | SMITSEAQLF | | 16514 |
| HPV56 | L1 | 279 | 11 | SMWFYLRREQL | | 16515 |
| HPV56 | L1 | 379 | 10 | STATEQLSKY | | 16516 |
| HPV56 | L1 | 261 | 8 | STCKYPDY | | 16517 |
| HPV56 | L1 | 261 | 9 | STCKYPDYL | | 16518 |
| HPV56 | L1 | 261 | 11 | STCKYPDYLKM | | 16519 |
| HPV56 | L1 | 489 | 9 | STDLDQFPL | | 16520 |
| HPV56 | L1 | 182 | 9 | SVDGKQTQL | | 16521 |
| HPV56 | L1 | 182 | 11 | SVDGKQTQLCI | | 16522 |
| HPV56 | L1 | 86 | 11 | SVTKDNTKTNI | | 16523 |
| HPV56 | L1 | 323 | 11 | SVYVATPSGSM | | 16524 |
| HPV56 | L1 | 61 | 8 | SYVKRTSI | | 16525 |
| HPV56 | L1 | 61 | 9 | SYVKRTSIF | | 16526 |
| HPV56 | L1 | 61 | 10 | SYVKRTSIFY | | 16527 |
| HPV56 | L1 | 304 | 8 | TIPAELYL | | 16528 |
| HPV56 | L1 | 377 | 9 | TISTATEQL | | 16529 |
| HPV56 | L1 | 415 | 9 | TLSAEVMAY | | 16530 |
| HPV56 | L1 | 415 | 10 | TLSAEVMAYL | | 16531 |
| HPV56 | L1 | 215 | 8 | TTGDCPPL | | 16532 |
| HPV56 | L1 | 215 | 10 | TTGDCPPLAL | | 16533 |
| HPV56 | L1 | 215 | 11 | TTGDCPPLALI | | 16534 |
| HPV56 | L1 | 370 | 9 | TTRSTNMTI | | 16535 |
| HPV56 | L1 | 366 | 11 | TVVDTTRSTNM | | 16536 |
| HPV56 | L1 | 38 | 10 | TWRPSENKVY | | 16537 |
| HPV56 | L1 | 38 | 11 | TWRPSENKVYL | | 16538 |
| HPV56 | L1 | 29 | 8 | VFPIFLQM | | 16539 |

TABLE X-continued

A24 Supermotif Peptides

| Type | Protein | Position | No. of Amino Acids | Sequence | A*2402 | Seq. Id. No. |
|---|---|---|---|---|---|---|
| HPV56 | L1 | 29 | 11 | VFPIFLQMATW | | 16540 |
| HPV56 | L1 | 408 | 9 | VFQLCKITL | | 16541 |
| HPV56 | L1 | 173 | 9 | VIEDSRDNI | | 16542 |
| HPV56 | L1 | 246 | 11 | VLQESKAEVPL | | 16543 |
| HPV56 | L1 | 420 | 8 | VMAYLHNM | | 16544 |
| HPV56 | L1 | 87 | 10 | VTKDNTKTNI | | 16545 |
| HPV56 | L1 | 214 | 9 | VTTGDCPPL | | 16546 |
| HPV56 | L1 | 214 | 11 | VTTGDCPPLAL | | 16547 |
| HPV56 | L1 | 367 | 10 | VVDTTRSTNM | | 16548 |
| HPV56 | L1 | 324 | 10 | VYVATPSGSM | | 16549 |
| HPV56 | L1 | 324 | 11 | VYVATPSGSMI | | 16550 |
| HPV56 | L1 | 281 | 9 | WFYLRREQL | | 16551 |
| HPV56 | L1 | 281 | 10 | WFYLRREQLF | | 16552 |
| HPV56 | L1 | 7 | 8 | YIYRDPPL | | 16553 |
| HPV56 | L1 | 7 | 10 | YIYRDPPLHY | | 16554 |
| HPV56 | L1 | 423 | 9 | YLHNMNANL | | 16555 |
| HPV56 | L1 | 423 | 10 | YLHNMNANLL | | 16556 |
| HPV56 | L1 | 268 | 9 | YLKMSADAY | | 16557 |
| HPV56 | L1 | 396 | 8 | YLRHVEEY | | 16558 |
| HPV56 | L1 | 396 | 10 | YLRHVEEYEL | | 16559 |
| HPV56 | L1 | 283 | 8 | YLRREQLF | | 16560 |
| HPV56 | L1 | 325 | 9 | YVATPSGSM | | 16561 |
| HPV56 | L1 | 325 | 10 | YVATPSGSMI | | 16562 |
| HPV56 | L1 | 62 | 8 | YVKRTSIF | | 16563 |
| HPV56 | L1 | 62 | 9 | YVKRTSIFY | | 16564 |
| HPV56 | L2 | 240 | 9 | AFLDRPATL | | 16565 |
| HPV56 | L2 | 286 | 11 | AFTTRRGGVRF | | 16566 |
| HPV56 | L2 | 438 | 8 | ALWPVYFF | | 16567 |
| HPV56 | L2 | 303 | 11 | ATIQTRRGTQI | | 16568 |
| HPV56 | L2 | 246 | 10 | ATLVSADNPL | | 16569 |
| HPV56 | L2 | 246 | 11 | ATLVSADNPLF | | 16570 |
| HPV56 | L2 | 367 | 9 | ATPSAHLPI | | 16571 |
| HPV56 | L2 | 14 | 10 | ATQLYKTCKL | | 16572 |
| HPV56 | L2 | 201 | 10 | AVHGSGTEPI | | 16573 |
| HPV56 | L2 | 275 | 8 | DFMNIVAL | | 16574 |
| HPV56 | L2 | 322 | 11 | DISPIAQAEEI | | 16575 |
| HPV56 | L2 | 406 | 11 | DIVLPTGPSTW | | 16576 |
| HPV56 | L2 | 425 | 8 | DVTHDVYI | | 16577 |
| HPV56 | L2 | 83 | 9 | DVTPARPPI | | 16578 |
| HPV56 | L2 | 30 | 11 | DVVNKIEQKTW | | 16579 |
| HPV56 | L2 | 429 | 9 | DVYIQGSSF | | 16580 |
| HPV56 | L2 | 429 | 11 | DVYIQGSSFAL | | 16581 |
| HPV56 | L2 | 331 | 8 | EIEMQPLL | | 16582 |
| HPV56 | L2 | 398 | 10 | ETPFYSGPDI | | 16583 |
| HPV56 | L2 | 175 | 8 | EVSGNILI | | 16584 |
| HPV56 | L2 | 444 | 10 | FFRRRRRKRI | | 16585 |
| HPV56 | L2 | 241 | 8 | FLDRPATL | | 16586 |
| HPV56 | L2 | 122 | 9 | FTGSGGFEI | | 16587 |
| HPV56 | L2 | 287 | 10 | FTTRRGGVRF | | 16588 |
| HPV56 | L2 | 51 | 9 | FTYFGGLGI | | 16589 |
| HPV56 | L2 | 401 | 9 | FYSGPDIVL | | 16590 |
| HPV56 | L2 | 217 | 10 | GFRRIAAPRL | | 16591 |
| HPV56 | L2 | 217 | 11 | GFRRIAAPRLY | | 16592 |
| HPV56 | L2 | 188 | 8 | GIHSYEEI | | 16593 |
| HPV56 | L2 | 188 | 10 | GIHSYEEIPM | | 16594 |
| HPV56 | L2 | 118 | 11 | GIPNFTGSGGF | | 16595 |
| HPV56 | L2 | 346 | 9 | GLYDIYANI | | 16596 |
| HPV56 | L2 | 25 | 11 | GTCPEDVVNKI | | 16597 |
| HPV56 | L2 | 258 | 8 | GTDTSLAF | | 16598 |
| HPV56 | L2 | 206 | 10 | GTEPISSTPI | | 16599 |
| HPV56 | L2 | 62 | 10 | GTGSGGRAGY | | 16600 |
| HPV56 | L2 | 310 | 10 | GTQIGARVHY | | 16601 |
| HPV56 | L2 | 310 | 11 | GTQIGARVHYY | | 16602 |
| HPV56 | L2 | 269 | 8 | GVAPDPDF | | 16603 |
| HPV56 | L2 | 269 | 9 | GVAPDPDFM | | 16604 |
| HPV56 | L2 | 269 | 11 | GVAPDPDFMNI | | 16605 |
| HPV56 | L2 | 156 | 8 | HITNPLFI | | 16606 |
| HPV56 | L2 | 372 | 9 | HLPIKPSTL | | 16607 |
| HPV56 | L2 | 372 | 11 | HLPIKPSTLSF | | 16608 |
| HPV56 | L2 | 151 | 11 | HVSSTHITNPL | | 16609 |
| HPV56 | L2 | 318 | 9 | HYYYDISPI | | 16610 |
| HPV56 | L2 | 180 | 10 | ILISTPTSGI | | 16611 |
| HPV56 | L2 | 44 | 8 | ILQWGSLF | | 16612 |
| HPV56 | L2 | 44 | 10 | ILQWGSLFTY | | 16613 |

TABLE X-continued

A24 Supermotif Peptides

| Type | Protein | Position | No. of Amino Acids | Sequence | A*2402 | Seq. Id. No. |
|---|---|---|---|---|---|---|
| HPV56 | L2 | 44 | 11 | ILQWGSLFTYF | | 16614 |
| HPV56 | L2 | 279 | 9 | IVALHRPAF | | 16615 |
| HPV56 | L2 | 81 | 11 | IVDVTPARPPI | | 16616 |
| HPV56 | L2 | 407 | 10 | IVLPTGPSTW | | 16617 |
| HPV56 | L2 | 103 | 11 | IVTLVEESSVI | | 16618 |
| HPV56 | L2 | 34 | 11 | KIEQKTWADKI | | 16619 |
| HPV56 | L2 | 43 | 8 | KILQWGSL | | 16620 |
| HPV56 | L2 | 43 | 9 | KILQWGSLF | | 16621 |
| HPV56 | L2 | 43 | 11 | KILQWGSLFTY | | 16622 |
| HPV56 | L2 | 38 | 8 | KTWADKIL | | 16623 |
| HPV56 | L2 | 38 | 10 | KTWADKILQW | | 16624 |
| HPV56 | L2 | 235 | 8 | KVTDPAFL | | 16625 |
| HPV56 | L2 | 255 | 9 | LFEGTDTSL | | 16626 |
| HPV56 | L2 | 255 | 11 | LFEGTDTSLAF | | 16627 |
| HPV56 | L2 | 161 | 8 | LFIDPPVI | | 16628 |
| HPV56 | L2 | 50 | 8 | LFTYFGGL | | 16629 |
| HPV56 | L2 | 50 | 10 | LFTYFGGLGI | | 16630 |
| HPV56 | L2 | 181 | 9 | LISTPTSGI | | 16631 |
| HPV56 | L2 | 337 | 8 | LLSANNSF | | 16632 |
| HPV56 | L2 | 337 | 11 | LLSANNSFDGL | | 16633 |
| HPV56 | L2 | 106 | 8 | LVEESSVI | | 16634 |
| HPV56 | L2 | 248 | 8 | LVSADNPL | | 16635 |
| HPV56 | L2 | 248 | 9 | LVSADNPLF | | 16636 |
| HPV56 | L2 | 347 | 8 | LYDIYANI | | 16637 |
| HPV56 | L2 | 121 | 8 | NFTGSGGF | | 16638 |
| HPV56 | L2 | 121 | 10 | NFTGSGGFEI | | 16639 |
| HPV56 | L2 | 353 | 9 | NIDDEAPGL | | 16640 |
| HPV56 | L2 | 179 | 11 | NILISTPTSGI | | 16641 |
| HPV56 | L2 | 278 | 10 | NIVALHRPAF | | 16642 |
| HPV56 | L2 | 385 | 9 | NTTNVTAPL | | 16643 |
| HPV56 | L2 | 388 | 10 | NVTAPLGNVW | | 16644 |
| HPV56 | L2 | 395 | 8 | NVWETPFY | | 16645 |
| HPV56 | L2 | 417 | 8 | PFVPQSPY | | 16646 |
| HPV56 | L2 | 400 | 8 | PFYSGPDI | | 16647 |
| HPV56 | L2 | 400 | 10 | PFYSGPDIVL | | 16648 |
| HPV56 | L2 | 325 | 8 | PIAQAEEI | | 16649 |
| HPV56 | L2 | 325 | 10 | PIAQAEEIEM | | 16650 |
| HPV56 | L2 | 374 | 9 | PIKPSTLSF | | 16651 |
| HPV56 | L2 | 214 | 8 | PIPGFRRI | | 16652 |
| HPV56 | L2 | 209 | 10 | PISSTPIPGF | | 16653 |
| HPV56 | L2 | 254 | 10 | PLFEGTDTSL | | 16654 |
| HPV56 | L2 | 160 | 9 | PLFIDPPVI | | 16655 |
| HPV56 | L2 | 392 | 10 | PLGNVWETPF | | 16656 |
| HPV56 | L2 | 392 | 11 | PLGNVWETPFY | | 16657 |
| HPV56 | L2 | 73 | 9 | PLGSRPSTI | | 16658 |
| HPV56 | L2 | 336 | 9 | PLLSANNSF | | 16659 |
| HPV56 | L2 | 98 | 9 | PTDPSIVTL | | 16660 |
| HPV56 | L2 | 410 | 9 | PTGPSTWPF | | 16661 |
| HPV56 | L2 | 185 | 8 | PTSGIHSY | | 16662 |
| HPV56 | L2 | 185 | 11 | PTSGIHSYEEI | | 16663 |
| HPV56 | L2 | 423 | 9 | PYDVTHDVY | | 16664 |
| HPV56 | L2 | 423 | 10 | PYDVTHDVYI | | 16665 |
| HPV56 | L2 | 312 | 8 | QIGARVHY | | 16666 |
| HPV56 | L2 | 312 | 9 | QIGARVHYY | | 16667 |
| HPV56 | L2 | 312 | 10 | QIGARVHYYY | | 16668 |
| HPV56 | L2 | 16 | 8 | QLYKTCKL | | 16669 |
| HPV56 | L2 | 172 | 9 | QTGEVSGNI | | 16670 |
| HPV56 | L2 | 172 | 10 | QTGEVSGNIL | | 16671 |
| HPV56 | L2 | 172 | 11 | QTGEVSGNILI | | 16672 |
| HPV56 | L2 | 306 | 8 | QTRRGTQI | | 16673 |
| HPV56 | L2 | 233 | 9 | QVKVTDPAF | | 16674 |
| HPV56 | L2 | 233 | 10 | QVKVTDPAFL | | 16675 |
| HPV56 | L2 | 46 | 8 | QWGSLFTY | | 16676 |
| HPV56 | L2 | 46 | 9 | QWGSLFTYF | | 16677 |
| HPV56 | L2 | 295 | 11 | RFSRLGRKATI | | 16678 |
| HPV56 | L2 | 220 | 8 | RIAAPRLY | | 16679 |
| HPV56 | L2 | 298 | 8 | RLGRKATI | | 16680 |
| HPV56 | L2 | 316 | 8 | RVHYYYDI | | 16681 |
| HPV56 | L2 | 316 | 11 | RVHYYYDISPI | | 16682 |
| HPV56 | L2 | 436 | 8 | SFALWPVY | | 16683 |
| HPV56 | L2 | 436 | 9 | SFALWPVYF | | 16684 |
| HPV56 | L2 | 436 | 10 | SFALWPVYFF | | 16685 |
| HPV56 | L2 | 343 | 8 | SFDGLYDI | | 16686 |
| HPV56 | L2 | 343 | 9 | SFDGLYDIY | | 16687 |

TABLE X-continued

A24 Supermotif Peptides

| Type | Protein | Position | No. of Amino Acids | Sequence | A*2402 | Seq. Id. No. |
|---|---|---|---|---|---|---|
| HPV56 | L2 | 49 | 9 | SLFTYFGGL | | 16688 |
| HPV56 | L2 | 49 | 11 | SLFTYFGGLGI | | 16689 |
| HPV56 | L2 | 154 | 8 | STHITNPL | | 16690 |
| HPV56 | L2 | 154 | 9 | STHITNPLF | | 16691 |
| HPV56 | L2 | 154 | 10 | STHITNPLFI | | 16692 |
| HPV56 | L2 | 212 | 10 | STPIPGFRRI | | 16693 |
| HPV56 | L2 | 183 | 10 | STPTSGIHSY | | 16694 |
| HPV56 | L2 | 134 | 8 | STTTPAVL | | 16695 |
| HPV56 | L2 | 134 | 10 | STTTPAVLDI | | 16696 |
| HPV56 | L2 | 148 | 10 | STVHVSSTHI | | 16697 |
| HPV56 | L2 | 414 | 11 | STWPFVPQSPY | | 16698 |
| HPV56 | L2 | 365 | 9 | SVATPSAHL | | 16699 |
| HPV56 | L2 | 365 | 11 | SVATPSAHLPI | | 16700 |
| HPV56 | L2 | 95 | 9 | SVGPTDPSI | | 16701 |
| HPV56 | L2 | 111 | 9 | SVIESGAGI | | 16702 |
| HPV56 | L2 | 191 | 10 | SYEEIPMQTF | | 16703 |
| HPV56 | L2 | 304 | 10 | TIQTRRGTQI | | 16704 |
| HPV56 | L2 | 105 | 9 | TLVEESSVI | | 16705 |
| HPV56 | L2 | 247 | 9 | TLVSADNPL | | 16706 |
| HPV56 | L2 | 247 | 10 | TLVSADNPLF | | 16707 |
| HPV56 | L2 | 386 | 8 | TTNVTAPL | | 16708 |
| HPV56 | L2 | 136 | 8 | TTPAVLDI | | 16709 |
| HPV56 | L2 | 288 | 9 | TTRRGGVRF | | 16710 |
| HPV56 | L2 | 135 | 9 | TTTPAVLDI | | 16711 |
| HPV56 | L2 | 149 | 9 | TVHVSSTHI | | 16712 |
| HPV56 | L2 | 39 | 9 | TWADKILQW | | 16713 |
| HPV56 | L2 | 415 | 10 | TWPFVPQSPY | | 16714 |
| HPV56 | L2 | 52 | 8 | TYFGGLGI | | 16715 |
| HPV56 | L2 | 112 | 8 | VIESGAGI | | 16716 |
| HPV56 | L2 | 112 | 11 | VIESGAGIPNF | | 16717 |
| HPV56 | L2 | 408 | 9 | VLPTGPSTW | | 16718 |
| HPV56 | L2 | 408 | 11 | VLPTGPSTWPF | | 16719 |
| HPV56 | L2 | 389 | 9 | VTAPLGNVW | | 16720 |
| HPV56 | L2 | 104 | 10 | VTLVEESSVI | | 16721 |
| HPV56 | L2 | 84 | 8 | VTPARPPI | | 16722 |
| HPV56 | L2 | 31 | 10 | VVNKIEQKTW | | 16723 |
| HPV56 | L2 | 430 | 8 | VYIQGSSF | | 16724 |
| HPV56 | L2 | 430 | 10 | VYIQGSSFAL | | 16725 |
| HPV56 | L2 | 430 | 11 | VYIQGSSFALW | | 16726 |
| HPV56 | L2 | 443 | 11 | YFFRRRRRKRI | | 16727 |
| HPV56 | L2 | 431 | 9 | YIQGSSFAL | | 16728 |
| HPV56 | L2 | 431 | 10 | YIQGSSFALW | | 16729 |
| HPV56 | L2 | 71 | 11 | YVPLGSRPSTI | | 16730 |
| HPV56 | L2 | 319 | 8 | YYYDISPI | | 16731 |

TABLE XI

B07 Supermotif Peptides

| Type | Protein | Position | No. of Amino Acids | Sequence | B*0702 | B*3501 | B*5101 | B*5301 | B*5401 | Seq. Id. No. |
|---|---|---|---|---|---|---|---|---|---|---|
| HPV16 | E1 | 559 | 10 | CPPLLITSNI | | | | | | 16732 |
| HPV16 | E1 | 308 | 9 | EPPKLRSTA | | | | | | 16733 |
| HPV16 | E1 | 308 | 10 | EPPKLRSTAA | 0.0002 | 0.0003 | 0.0002 | 0.0002 | 0.0200 | 16734 |
| HPV16 | E1 | 308 | 11 | EPPKLRSTAAA | | | | | | 16735 |
| HPV16 | E1 | 592 | 10 | FPFDENGNPV | | | | | | 16736 |
| HPV16 | E1 | 592 | 11 | FPFDENGNPVY | | | | | | 16737 |
| HPV16 | E1 | 467 | 8 | IPKKNCIL | | | | | | 16738 |
| HPV16 | E1 | 467 | 9 | IPKKNCILL | | | | | | 16739 |
| HPV16 | E1 | 467 | 10 | IPKKNCILLY | | | | | | 16740 |
| HPV16 | E1 | 599 | 11 | NPVYELNDKNW | | | | | | 16741 |
| HPV16 | E1 | 309 | 8 | PPKLRSTA | | | | | | 16742 |
| HPV16 | E1 | 309 | 9 | PPKLRSTAA | 0.0014 | 0.0003 | 0.0002 | 0.0002 | 0.0024 | 16743 |
| HPV16 | E1 | 309 | 10 | PPKLRSTAAA | | | | | | 16744 |
| HPV16 | E1 | 309 | 11 | PPKLRSTAAAL | | | | | | 16745 |
| HPV16 | E1 | 560 | 9 | PPLLITSNI | | | | | | 16746 |
| HPV16 | E1 | 560 | 11 | PPLLITSNINA | | | | | | 16747 |
| HPV16 | E1 | 511 | 8 | QPLADAKI | | | | | | 16748 |
| HPV16 | E1 | 511 | 10 | QPLADAKIGM | | | | | | 16749 |
| HPV16 | E1 | 511 | 11 | QPLADAKIGML | | | | | | 16750 |

TABLE XI-continued

| | | | | | | | | | | | |
|---|---|---|---|---|---|---|---|---|---|---|---|
| HPV16 | E1 | 552 | 11 | RPLVQLKCPPL | | | | | | | 16751 |
| HPV16 | E1 | 93 | 10 | SPLSDISGCV | | | | | | | 16752 |
| HPV16 | EI | 107 | 9 | SPRLKAICI | 0.4700 | 0.0003 | 0.0004 | 0.0002 | 0.0004 | | 16753 |
| HPV16 | E1 | 336 | 10 | TPEWIQRQTV | | | | | | | 16754 |
| HPV16 | E1 | 336 | 11 | TPEWIQRQTVL | | | | | | | 16755 |
| HPV16 | E1 | 189 | 9 | TPLTNILNV | | | | | | | 16756 |
| HPV16 | E1 | 189 | 10 | TPLTNILNVL | | | | | | | 16757 |
| HPV16 | E1 | 244 | 8 | TPSIADSI | | | | | | | 16758 |
| HPV16 | E1 | 244 | 11 | TPSIADSIKTL | | | | | | | 16759 |
| HPV16 | E1 | 526 | 11 | VPCWNYIDDNL | | | | | | | 16760 |
| HPV16 | E1 | 576 | 8 | WPYLHNRL | | | | | | | 16761 |
| HPV16 | E1 | 576 | 9 | WPYLHNRLV | 0.0520 | 0.0003 | 0.1100 | 0.0002 | 0.1800 | | 16762 |
| HPV16 | E1 | 576 | 10 | WPYLHNRLVV | 0.0950 | 0.0012 | 0.0740 | 0.0002 | 0.0760 | | 16763 |
| HPV16 | E1 | 576 | 11 | WPYLHNRLVVF | | | | | | | 16764 |
| HPV16 | E2 | 105 | 11 | APTGCIKKHGY | | | | | | | 16765 |
| HPV16 | E2 | 195 | 11 | CPTSVFSSNEV | | | | | | | 16766 |
| HPV16 | E2 | 218 | 9 | HPAATHTKA | | | | | | | 16767 |
| HPV16 | E2 | 218 | 10 | HPAATHTKAV | | | | | | | 16768 |
| HPV16 | E2 | 218 | 11 | HPAATHTKAVA | | | | | | | 16769 |
| HPV16 | E2 | 352 | 11 | IPKTITVSTGF | | | | | | | 16770 |
| HPV16 | E2 | 249 | 8 | NPCHTTKL | | | | | | | 16771 |
| HPV16 | E2 | 249 | 9 | NPCHTTKLL | | | | | | | 16772 |
| HPV16 | E2 | 207 | 9 | SPEIIRQHL | | | | | | | 16773 |
| HPV16 | E2 | 207 | 10 | SPEIIRQHLA | | | | | | | 16774 |
| HPV16 | E2 | 286 | 10 | TPIVHLKGDA | | | | | | | 16775 |
| HPV16 | E2 | 59 | 11 | VPTLAVSKNKA | | | | | | | 16776 |
| HPV16 | E5 | 69 | 10 | IPLFLIHTHA | | | | | | | 16777 |
| HPV16 | E5 | 30 | 10 | RPLLLSVSTY | | | | | | | 16778 |
| HPV16 | E6 | 118 | 9 | CPEEKQRHL | 0.0003 | 0.0002 | 0.0074 | 0.0006 | 0.0002 | | 16779 |
| HPV16 | E6 | 11 | 9 | DPQERPRKL | 0.0001 | 0.0001 | 0.0001 | 0.0001 | 0.0002 | | 16780 |
| HPV16 | E6 | 101 | 8 | KPLCDLLI | | | | | | | 16781 |
| HPV16 | E6 | 101 | 11 | KPLCDLLIRCI | | | | | | | 16782 |
| HPV16 | E6 | 19 | 8 | LPQLCTEL | 0.0055 | | | | | | 16783 |
| HPV16 | E6 | 65 | 10 | NPYAVCDKCL | 0.0001 | 0.0001 | 0.0001 | 0.0001 | 0.0001 | | 16784 |
| HPV16 | E6 | 15 | 8 | RPRKLPQL | | | | | | | 16785 |
| HPV16 | E7 | 46 | 9 | EPDRAHYNI | 0.0001 | 0.0001 | 0.0031 | 0.0017 | 0.0002 | | 16786 |
| HPV16 | E7 | 46 | 10 | EPDRAHYNIV | 0.0001 | 0.0001 | 0.0001 | 0.0001 | 0.0001 | | 16787 |
| HPV16 | E7 | 40 | 11 | GPAGQAEPDRA | | | | | | | 16788 |
| HPV16 | E7 | 16 | 8 | QPETTDLY | | | | | | | 16789 |
| HPV16 | E7 | 16 | 10 | QPETTDLYCY | | | | | | | 16790 |
| HPV16 | E7 | 5 | 8 | TPTLHEYM | | | | | | | 16791 |
| HPV16 | E7 | 5 | 9 | TPTLHEYML | 0.1100 | 0.0001 | 0.0001 | 0.0001 | 0.0002 | | 16792 |
| HPV16 | E7 | 5 | 11 | TPTLHEYMLDL | | | | | | | 16793 |
| HPV16 | L1 | 461 | 10 | APKEDPLKKY | | | | | | | 16794 |
| HPV16 | L1 | 211 | 10 | CPPLELINTV | | | | | | | 16795 |
| HPV16 | L1 | 211 | 11 | CPPLELINTVI | | | | | | | 16796 |
| HPV16 | L1 | 465 | 8 | DPLKKYTF | | | | | | | 16797 |
| HPV16 | L1 | 465 | 9 | DPLKKYTFW | | | | | | | 16798 |
| HPV16 | L1 | 465 | 11 | DPLKKYTFWEV | | | | | | | 16799 |
| HPV16 | L1 | 266 | 8 | EPYGDSLF | | | | | | | 16800 |
| HPV16 | L1 | 266 | 9 | EPYGDSLFF | | | | | | | 16801 |
| HPV16 | L1 | 266 | 10 | EPYGDSLFFY | | | | | | | 16802 |
| HPV16 | L1 | 266 | 11 | EPYGDSLFFYL | | | | | | | 16803 |
| HPV16 | L1 | 76 | 11 | FPIKKPNNNKI | | | | | | | 16804 |
| HPV16 | L1 | 488 | 8 | FPLGRKFL | | | | | | | 16805 |
| HPV16 | L1 | 488 | 9 | FPLGRKFLL | | | | | | | 16806 |
| HPV16 | L1 | 488 | 11 | FPLGRKFLLQA | | | | | | | 16807 |
| HPV16 | L1 | 318 | 8 | FPTPSGSM | | | | | | | 16808 |
| HPV16 | L1 | 318 | 9 | FPTPSGSMV | | | | | | | 16809 |
| HPV16 | L1 | 503 | 11 | KPKFTLGKRKA | | | | | | | 16810 |
| HPV16 | L1 | 80 | 8 | KPNNNKIL | | | | | | | 16811 |
| HPV16 | L1 | 80 | 9 | KPNNNKILV | | | | | | | 16812 |
| HPV16 | L1 | 188 | 8 | KPPIGEHW | | | | | | | 16813 |
| HPV16 | L1 | 335 | 8 | KPYWLQRA | | | | | | | 16814 |
| HPV16 | L1 | 103 | 9 | LPDPNKFGF | | | | | | | 16815 |
| HPV16 | L1 | 39 | 9 | LPPVPVSKV | | | | | | | 16816 |
| HPV16 | L1 | 39 | 10 | LPPVPVSKVV | | | | | | | 16817 |
| HPV16 | L1 | 31 | 8 | LPSEATVY | | | | | | | 16818 |
| HPV16 | L1 | 31 | 9 | LPSEATVYL | | | | | | | 16819 |
| HPV16 | L1 | 118 | 8 | NPDTQRLV | | | | | | | 16820 |
| HPV16 | L1 | 118 | 9 | NPDTQRLVW | | | | | | | 16821 |
| HPV16 | L1 | 118 | 10 | NPDTQRLVWA | | | | | | | 16822 |
| HPV16 | L1 | 207 | 8 | NPGDCPPL | | | | | | | 16823 |
| HPV16 | L1 | 207 | 10 | NPGDCPPLEL | | | | | | | 16824 |
| HPV16 | L1 | 207 | 11 | NPGDCPPLELI | | | | | | | 16825 |
| HPV16 | L1 | 459 | 9 | PPAPKEDPL | | | | | | | 16826 |
| HPV16 | L1 | 435 | 10 | PPGGTLEDTY | | | | | | | 16827 |
| HPV16 | L1 | 212 | 9 | PPLELINTV | | | | | | | 16828 |
| HPV16 | L1 | 212 | 10 | PPLELINTVI | | | | | | | 16829 |

TABLE XI-continued

| | | | | | | |
|---|---|---|---|---|---|---|
| HPV16 | L1 | 434 | 11 | PPPGGTLEDTY | | 16830 |
| HPV16 | L1 | 40 | 8 | PPVPVSKV | | 16831 |
| HPV16 | L1 | 40 | 9 | PPVPVSKVV | | 16832 |
| HPV16 | L1 | 433 | 8 | QPPPGGTL | | 16833 |
| HPV16 | L1 | 199 | 8 | SPCTNVAV | | 16834 |
| HPV16 | L1 | 458 | 10 | TPPAPKEDPL | | 16835 |
| HPV16 | L1 | 320 | 11 | TPSGSMVTSDA | | 16836 |
| HPV16 | L1 | 514 | 11 | TPTFSSTSTTA | | 16837 |
| HPV16 | L1 | 88 | 9 | VPKVSGLQY | | 16838 |
| HPV16 | L1 | 88 | 11 | VPKVSGLQYRV | | 16839 |
| HPV16 | L1 | 246 | 9 | VPLDICTSI | | 16840 |
| HPV16 | L1 | 257 | 8 | YPDYIKMV | | 16841 |
| HPV16 | L2 | 278 | 9 | APDPDFLDI | | 16842 |
| HPV16 | L2 | 278 | 10 | APDPDFLDIV | | 16843 |
| HPV16 | L2 | 278 | 11 | APDPDFLDIVA | | 16844 |
| HPV16 | L2 | 424 | 8 | APSLIPIV | | 16845 |
| HPV16 | L2 | 119 | 8 | APTSVPSI | | 16846 |
| HPV16 | L2 | 87 | 9 | APVRPPLTV | | 16847 |
| HPV16 | L2 | 28 | 9 | CPPDIIPKV | | 16848 |
| HPV16 | L2 | 239 | 11 | DPAFITTPTKL | | 16849 |
| HPV16 | L2 | 280 | 8 | DPDFLDIV | | 16850 |
| HPV16 | L2 | 280 | 9 | DPDFLDIVA | | 16851 |
| HPV16 | L2 | 280 | 10 | DPDFLDIVAL | | 16852 |
| HPV16 | L2 | 102 | 8 | DPSIVSLV | | 16853 |
| HPV16 | L2 | 165 | 11 | DPSVLQPPTPA | | 16854 |
| HPV16 | L2 | 96 | 10 | DPVGPSDPSI | | 16855 |
| HPV16 | L2 | 96 | 11 | DPVGPSDPSIV | | 16856 |
| HPV16 | L2 | 413 | 8 | GPDIPINI | | 16857 |
| HPV16 | L2 | 99 | 8 | GPSDPSIV | | 16858 |
| HPV16 | L2 | 99 | 10 | GPSDPSIVSL | | 16859 |
| HPV16 | L2 | 99 | 11 | GPSDPSIVSLV | | 16860 |
| HPV16 | L2 | 394 | 9 | IPANTTIPF | | 16861 |
| HPV16 | L2 | 400 | 9 | IPFGGAYNI | | 16862 |
| HPV16 | L2 | 400 | 11 | IPFGGAYNIPL | | 16863 |
| HPV16 | L2 | 216 | 8 | IPGSRPVA | | 16864 |
| HPV16 | L2 | 216 | 10 | IPGSRPVARL | | 16865 |
| HPV16 | L2 | 416 | 9 | IPINITDQA | | 16866 |
| HPV16 | L2 | 428 | 10 | IPIVPGSPQY | | 16867 |
| HPV16 | L2 | 33 | 9 | IPKVEGKTI | | 16868 |
| HPV16 | L2 | 33 | 10 | IPKVEGKTIA | | 16869 |
| HPV16 | L2 | 73 | 10 | IPLGTRPPTA | | 16870 |
| HPV16 | L2 | 408 | 9 | IPLVSGPDI | | 16871 |
| HPV16 | L2 | 408 | 11 | IPLVSGPDIPI | | 16872 |
| HPV16 | L2 | 196 | 8 | IPMDTFIV | | 16873 |
| HPV16 | L2 | 126 | 8 | IPPDVSGF | | 16874 |
| HPV16 | L2 | 126 | 10 | IPPDVSGFSI | | 16875 |
| HPV16 | L2 | 357 | 9 | LPTSINNGL | | 16876 |
| HPV16 | L2 | 357 | 10 | LPTSINNGLY | | 16877 |
| HPV16 | L2 | 462 | 8 | LPYFFSDV | | 16878 |
| HPV16 | L2 | 462 | 10 | LPYFFSDVSL | | 16879 |
| HPV16 | L2 | 462 | 11 | LPYFFSDVSLA | | 16880 |
| HPV16 | L2 | 254 | 9 | NPAYEGIDV | | 16881 |
| HPV16 | L2 | 206 | 11 | NPNTVTSSTPI | | 16882 |
| HPV16 | L2 | 160 | 9 | NPTFTDPSV | | 16883 |
| HPV16 | L2 | 160 | 10 | NPTFTDPSVL | | 16884 |
| HPV16 | L2 | 29 | 8 | PPDIIPKV | | 16885 |
| HPV16 | L2 | 127 | 9 | PPDVSGFSI | | 16886 |
| HPV16 | L2 | 91 | 8 | PPLTVDPV | | 16887 |
| HPV16 | L2 | 79 | 8 | PPTATDTL | | 16888 |
| HPV16 | L2 | 79 | 9 | PPTATDTLA | | 16889 |
| HPV16 | L2 | 79 | 11 | PPTATDTLAPV | | 16890 |
| HPV16 | L2 | 171 | 11 | PPTPAETGGHF | | 16891 |
| HPV16 | L2 | 291 | 11 | RPALTSRRTGI | | 16892 |
| HPV16 | L2 | 90 | 9 | RPPLTVDPV | | 16893 |
| HPV16 | L2 | 78 | 9 | RPPTATDTL | | 16894 |
| HPV16 | L2 | 78 | 10 | RPPTATDTLA | | 16895 |
| HPV16 | L2 | 220 | 8 | RPVARLGL | | 16896 |
| HPV16 | L2 | 220 | 9 | RPVARLGLY | | 16897 |
| HPV16 | L2 | 434 | 8 | SPQYTIIA | | 16898 |
| HPV16 | L2 | 434 | 10 | SPQYTIIADA | | 16899 |
| HPV16 | L2 | 173 | 9 | TPAETGGHF | | 16900 |
| HPV16 | L2 | 173 | 11 | TPAETGGHFTL | | 16901 |
| HPV16 | L2 | 142 | 11 | TPAILDINNTV | | 16902 |
| HPV16 | L2 | 214 | 9 | TPIPGSRPV | | 16903 |
| HPV16 | L2 | 214 | 10 | TPIPGSRPVA | | 16904 |
| HPV16 | L2 | 345 | 11 | TPSTYTTTSHA | | 16905 |
| HPV16 | L2 | 245 | 8 | TPTKLITY | | 16906 |
| HPV16 | L2 | 380 | 11 | TPVPSVPSTSL | | 16907 |
| HPV16 | L2 | 431 | 9 | VPGSPQYTI | | 16908 |

TABLE XI-continued

| | | | | | | | | | | | |
|---|---|---|---|---|---|---|---|---|---|---|---|
| HPV16 | L2 | 431 | 10 | VPGSPQYTII | | | | | | | 16909 |
| HPV16 | L2 | 431 | 11 | VPGSPQYTIIA | | | | | | | 16910 |
| HPV16 | L2 | 123 | 8 | VPSIPPDV | | | | | | | 16911 |
| HPV16 | L2 | 123 | 11 | VPSIPPDVSGF | | | | | | | 16912 |
| HPV16 | L2 | 385 | 9 | VPSTSLSGY | | | | | | | 16913 |
| HPV16 | L2 | 385 | 10 | VPSTSLSGYI | | | | | | | 16914 |
| HPV16 | L2 | 382 | 9 | VPSVPSTSL | | | | | | | 16915 |
| HPV18 | E1 | 566 | 10 | CPPILLTTNI | | | | | | | 16916 |
| HPV18 | E1 | 518 | 8 | EPLTDTKV | | | | | | | 16917 |
| HPV18 | E1 | 518 | 9 | EPLTDTKVA | | | | | | | 16918 |
| HPV18 | E1 | 518 | 10 | EPLTDTKVAM | | | | | | | 16919 |
| HPV18 | E1 | 518 | 11 | EPLTDTKVAML | | | | | | | 16920 |
| HPV18 | E1 | 599 | 10 | FPFDKNGNPV | | | | | | | 16921 |
| HPV18 | E1 | 599 | 11 | FPFDKNGNPVY | | | | | | | 16922 |
| HPV18 | E1 | 484 | 9 | GPANTGKSY | | | | | | | 16923 |
| HPV18 | E1 | 484 | 10 | GPANTGKSYF | | | | | | | 16924 |
| HPV18 | E1 | 576 | 8 | HPAKDNRW | | | | | | | 16925 |
| HPV18 | E1 | 576 | 10 | HPAKDNRWPY | | | | | | | 16926 |
| HPV18 | E1 | 576 | 11 | HPAKDNRWPYL | | | | | | | 16927 |
| HPV18 | E1 | 559 | 11 | KPLIQLKCPPI | | | | | | | 16928 |
| HPV18 | E1 | 641 | 8 | NPFGTFKL | | | | | | | 16929 |
| HPV18 | E1 | 641 | 10 | NPFGTFKLRA | | | | | | | 16930 |
| HPV18 | E1 | 193 | 9 | NPQCTIAQL | | | | | | | 16931 |
| HPV18 | E1 | 251 | 8 | NPTIAEGF | | | | | | | 16932 |
| HPV18 | E1 | 251 | 11 | NPTIAEGFKTL | | | | | | | 16933 |
| HPV18 | E1 | 606 | 11 | NPVYEINDKNW | | | | | | | 16934 |
| HPV18 | E1 | 567 | 9 | PPILLTTNI | | | | | | | 16935 |
| HPV18 | E1 | 316 | 8 | PPKLRSSV | | | | | | | 16936 |
| HPV18 | E1 | 316 | 9 | PPKLRSSVA | | | | | | | 16937 |
| HPV18 | E1 | 316 | 10 | PPKLRSSVAA | | | | | | | 16938 |
| HPV18 | E1 | 316 | 11 | PPKLRSSVAAL | | | | | | | 16939 |
| HPV18 | E1 | 263 | 9 | QPFILYAHI | 0.0002 | 0.0003 | 0.2100 | 0.0017 | 0.0034 | | 16940 |
| HPV18 | E1 | 315 | 9 | QPPKLRSSV | 0.0004 | 0.0003 | 0.0002 | 0.0002 | 0.0004 | | 16941 |
| HPV18 | E1 | 315 | 10 | QPPKLRSSVA | 0.0004 | 0.0003 | 0.0002 | 0.0002 | 0.0390 | | 16942 |
| HPV18 | E1 | 315 | 11 | QPPKLRSSVAA | | | | | | | 16943 |
| HPV18 | E1 | 447 | 9 | RPIVQFLRY | 0.0033 | 0.0400 | 0.0002 | 0.0230 | 0.0004 | | 16944 |
| HPV18 | E1 | 97 | 9 | SPLGERLEV | 0.1300 | 0.0003 | 0.0002 | 0.0002 | 0.0011 | | 16945 |
| HPV18 | E1 | 110 | 9 | SPRLQEISL | 0.6200 | 0.0008 | 0.0005 | 0.0002 | 0.0004 | | 16946 |
| HPV18 | E1 | 343 | 8 | TPEWIQRL | | | | | | | 16947 |
| HPV18 | E1 | 343 | 10 | TPEWIQRLTI | | | | | | | 16948 |
| HPV18 | E1 | 343 | 11 | TPEWIQRLTII | | | | | | | 16949 |
| HPV18 | E1 | 474 | 8 | TPKKNCLV | | | | | | | 16950 |
| HPV18 | E1 | 474 | 9 | TPKKNCLVF | | | | | | | 16951 |
| HPV18 | E1 | 307 | 8 | VPETCMLI | | | | | | | 16952 |
| HPV18 | E1 | 583 | 8 | WPYLESRI | | | | | | | 16953 |
| HPV18 | E1 | 583 | 10 | WPYLESRITV | 0.0067 | 0.0066 | 0.0550 | 0.0140 | 0.0240 | | 16954 |
| HPV18 | E1 | 583 | 11 | WPYLESRITVF | | | | | | | 16955 |
| HPV18 | E2 | 261 | 9 | GPVNPLLGA | | | | | | | 16956 |
| HPV18 | E2 | 261 | 10 | GPVNPLLGAA | | | | | | | 16957 |
| HPV18 | E2 | 352 | 8 | IPDSVQIL | | | | | | | 16958 |
| HPV18 | E2 | 352 | 9 | IPDSVQILV | | | | | | | 16959 |
| HPV18 | E2 | 352 | 11 | IPDSVQILVGY | | | | | | | 16960 |
| HPV18 | E2 | 248 | 8 | RPGHCGLA | | | | | | | 16961 |
| HPV18 | E2 | 226 | 9 | SPYSSTVSV | | | | | | | 16962 |
| HPV18 | E2 | 3 | 10 | TPKETLSERL | | | | | | | 16963 |
| HPV18 | E2 | 224 | 9 | TPSPYSSTV | | | | | | | 16964 |
| HPV18 | E2 | 224 | 11 | TPSPYSSTVSV | | | | | | | 16965 |
| HPV18 | E2 | 271 | 11 | TPTGNNKRRKL | | | | | | | 16966 |
| HPV18 | E2 | 63 | 11 | VPAYNISKSKA | | | | | | | 16967 |
| HPV18 | E5 | 59 | 8 | LPMLLLHI | | | | | | | 16968 |
| HPV18 | E5 | 59 | 10 | LPMLLLHIHA | | | | | | | 16969 |
| HPV18 | E5 | 59 | 11 | LPMLLLHIHAI | | | | | | | 16970 |
| HPV18 | E5 | 23 | 8 | LPSVCMCA | | | | | | | 16971 |
| HPV18 | E5 | 23 | 9 | LPSVCMCAY | | | | | | | 16972 |
| HPV18 | E5 | 23 | 10 | LPSVCMCAYA | | | | | | | 16973 |
| HPV18 | E5 | 23 | 11 | LPSVCMCAYAW | | | | | | | 16974 |
| HPV18 | E5 | 45 | 8 | SPATAFTV | | | | | | | 16975 |
| HPV18 | E5 | 45 | 9 | SPATAFTVY | | | | | | | 16976 |
| HPV18 | E5 | 45 | 10 | SPATAFTVYV | | | | | | | 16977 |
| HPV18 | E5 | 45 | 11 | SPATAFTVYVF | | | | | | | 16978 |
| HPV18 | E5 | 20 | 9 | VPLLPSVCM | | | | | | | 16979 |
| HPV18 | E5 | 20 | 11 | VPLLPSVCMCA | | | | | | | 16980 |
| HPV18 | E6 | 6 | 9 | DPTRRPYKL | 0.0001 | 0.0001 | 0.0001 | 0.0001 | 0.0002 | | 16981 |
| HPV18 | E6 | 60 | 10 | IPHAACHKCI | 0.0065 | 0.0001 | 0.0046 | 0.0001 | 0.0005 | | 16982 |
| HPV18 | E6 | 110 | 9 | KPLNPAEKL | 0.0350 | 0.0001 | 0.0001 | 0.0001 | 0.0002 | | 16983 |
| HPV18 | E6 | 14 | 8 | LPDLCTEL | | | | | | | 16984 |
| HPV18 | E6 | 113 | 9 | NPAEKLRHL | 0.0110 | 0.0001 | 0.0001 | 0.0001 | 0.0002 | | 16985 |
| HPV18 | E6 | 10 | 8 | RPYKLPDL | | | | | | | 16986 |
| HPV18 | E7 | 16 | 8 | EPQNEIPV | | | | | | | 16987 |

TABLE XI-continued

| | | | | | | | | | | | |
|---|---|---|---|---|---|---|---|---|---|---|---|
| HPV18 | E7 | 16 | 10 | EPQNEIPVDL | 0.0001 | 0.0005 | 0.0001 | 0.0001 | 0.0001 | | 16988 |
| HPV18 | E7 | 16 | 11 | EPQNEIPVDLL | | | | | | | 16989 |
| HPV18 | E7 | 55 | 8 | EPQRHTML | | | | | | | 16990 |
| HPV18 | E7 | 55 | 10 | EPQRHTMLCM | 0.0026 | 0.0002 | 0.0003 | 0.0043 | 0.0001 | | 16991 |
| HPV18 | E7 | 3 | 9 | GPKATLQDI | 0.0004 | 0.0001 | 0.0001 | 0.0001 | 0.0002 | | 16992 |
| HPV18 | E7 | 3 | 10 | GPKATLQDIV | 0.0001 | 0.0001 | 0.0001 | 0.0001 | 0.0001 | | 16993 |
| HPV18 | E7 | 3 | 11 | GPKATLQDIVL | | | | | | | 16994 |
| HPV18 | E7 | 21 | 11 | IPVDLLCHEQL | | | | | | | 16995 |
| HPV18 | L1 | 495 | 9 | APAENKDPY | | | | | | | 16996 |
| HPV18 | L1 | 223 | 8 | APAIGEHW | | | | | | | 16997 |
| HPV18 | L1 | 223 | 9 | APAIGEHWA | | | | | | | 16998 |
| HPV18 | L1 | 549 | 11 | APSATTSSKPA | | | | | | | 16999 |
| HPV18 | L1 | 246 | 10 | CPPLELKNTV | | | | | | | 17000 |
| HPV18 | L1 | 246 | 11 | CPPLELKNTVL | | | | | | | 17001 |
| HPV18 | L1 | 501 | 8 | DPYDKLKF | | | | | | | 17002 |
| HPV18 | L1 | 501 | 9 | DPYDKLKFW | | | | | | | 17003 |
| HPV18 | L1 | 501 | 11 | DPYDKLKFWNV | | | | | | | 17004 |
| HPV18 | L1 | 301 | 8 | DPYGDSMF | | | | | | | 17005 |
| HPV18 | L1 | 301 | 9 | DPYGDSMFF | | | | | | | 17006 |
| HPV18 | L1 | 301 | 11 | DPYGDSMFFCL | | | | | | | 17007 |
| HPV18 | L1 | 56 | 8 | FPIFLQMA | | | | | | | 17008 |
| HPV18 | L1 | 56 | 9 | FPIFLQMAL | | | | | | | 17009 |
| HPV18 | L1 | 56 | 10 | FPIFLQMALW | | | | | | | 17010 |
| HPV18 | L1 | 19 | 9 | GPLYHPRPL | | | | | | | 17011 |
| HPV18 | L1 | 19 | 11 | GPLYHPRPLPL | | | | | | | 17012 |
| HPV18 | L1 | 543 | 10 | GPRKRSAPSA | | | | | | | 17013 |
| HPV18 | L1 | 23 | 10 | HPRPLPLHSI | | | | | | | 17014 |
| HPV18 | L1 | 23 | 11 | HPRPLPLHSIL | | | | | | | 17015 |
| HPV18 | L1 | 123 | 9 | IPKVSAYQY | | | | | | | 17016 |
| HPV18 | L1 | 123 | 11 | IPKVSAYQYRV | | | | | | | 17017 |
| HPV18 | L1 | 557 | 8 | KPAKRVRV | | | | | | | 17018 |
| HPV18 | L1 | 557 | 10 | KPAKRVRVRA | | | | | | | 17019 |
| HPV18 | L1 | 539 | 11 | KPTIGPRKRSA | | | | | | | 17020 |
| HPV18 | L1 | 370 | 8 | KPYWLHKA | | | | | | | 17021 |
| HPV18 | L1 | 138 | 9 | LPDPNKFGL | | | | | | | 17022 |
| HPV18 | L1 | 27 | 8 | LPLHSILV | | | | | | | 17023 |
| HPV18 | L1 | 27 | 9 | LPLHSILVY | | | | | | | 17024 |
| HPV18 | L1 | 27 | 10 | LPLHSILVYM | | | | | | | 17025 |
| HPV18 | L1 | 27 | 11 | LPLHSILVYMV | | | | | | | 17026 |
| HPV18 | L1 | 15 | 8 | LPLYGPLY | | | | | | | 17027 |
| HPV18 | L1 | 74 | 9 | LPPPSVARV | | | | | | | 17028 |
| HPV18 | L1 | 74 | 10 | LPPPSVARVV | | | | | | | 17029 |
| HPV18 | L1 | 343 | 9 | MPASPGSCV | | | | | | | 17030 |
| HPV18 | L1 | 343 | 10 | MPASPGSCVY | | | | | | | 17031 |
| HPV18 | L1 | 153 | 8 | NPETQRLV | | | | | | | 17032 |
| HPV18 | L1 | 153 | 9 | NPETQRLVW | | | | | | | 17033 |
| HPV18 | L1 | 153 | 10 | NPETQRLVWA | | | | | | | 17034 |
| HPV18 | L1 | 108 | 8 | NPYFRVPA | | | | | | | 17035 |
| HPV18 | L1 | 247 | 9 | PPLELKNTV | | | | | | | 17036 |
| HPV18 | L1 | 247 | 10 | PPLELKNTVL | | | | | | | 17037 |
| HPV18 | L1 | 469 | 8 | PPPPTTSL | | | | | | | 17038 |
| HPV18 | L1 | 469 | 9 | PPPPTTSLV | | | | | | | 17039 |
| HPV18 | L1 | 75 | 8 | PPPSVARV | | | | | | | 17040 |
| HPV18 | L1 | 75 | 9 | PPPSVARVV | | | | | | | 17041 |
| HPV18 | L1 | 470 | 8 | PPPTTSLV | | | | | | | 17042 |
| HPV18 | L1 | 470 | 11 | PPPTTSLVDTY | | | | | | | 17043 |
| HPV18 | L1 | 76 | 8 | PPSVARVV | | | | | | | 17044 |
| HPV18 | L1 | 471 | 10 | PPTTSLVDTY | | | | | | | 17045 |
| HPV18 | L1 | 25 | 8 | RPLPLHSI | | | | | | | 17046 |
| HPV18 | L1 | 25 | 9 | RPLPLHSIL | | | | | | | 17047 |
| HPV18 | L1 | 25 | 10 | RPLPLHSILV | | | | | | | 17048 |
| HPV18 | L1 | 25 | 11 | RPLPLHSILVY | | | | | | | 17049 |
| HPV18 | L1 | 239 | 11 | RPLSQGDCPPL | | | | | | | 17050 |
| HPV18 | L1 | 66 | 8 | RPSDNTVY | | | | | | | 17051 |
| HPV18 | L1 | 66 | 9 | RPSDNTVYL | | | | | | | 17052 |
| HPV18 | L1 | 353 | 8 | SPSPSGSI | | | | | | | 17053 |
| HPV18 | L1 | 353 | 9 | SPSPSGSIV | | | | | | | 17054 |
| HPV18 | L1 | 411 | 9 | SPVPGQYDA | | | | | | | 17055 |
| HPV18 | L1 | 398 | 8 | TPSTNLTI | | | | | | | 17056 |
| HPV18 | L1 | 398 | 10 | TPSTNLTICA | | | | | | | 17057 |
| HPV18 | L1 | 90 | 9 | TPTSIFYHA | | | | | | | 17058 |
| HPV18 | L1 | 113 | 11 | VPAGGGNKQDI | | | | | | | 17059 |
| HPV18 | L1 | 413 | 10 | VPGQYDATKF | | | | | | | 17060 |
| HPV18 | L1 | 281 | 9 | VPLDICQSI | | | | | | | 17061 |
| HPV18 | L1 | 468 | 9 | VPPPPTTSL | | | | | | | 17062 |
| HPV18 | L1 | 468 | 10 | VPPPPTTSLV | | | | | | | 17063 |
| HPV18 | L1 | 292 | 9 | YPDYLQMSA | | | | | | | 17064 |
| HPV18 | L1 | 524 | 8 | YPLGRKFL | | | | | | | 17065 |
| HPV18 | L1 | 524 | 9 | YPLGRKFLV | | | | | | | 17066 |

TABLE XI-continued

| | | | | | | | | | | | |
|---|---|---|---|---|---|---|---|---|---|---|---|
| HPV18 | L1 | 524 | 11 | YPLGRKFLVQA | | | | | | | 17067 |
| HPV18 | L2 | 421 | 8 | APASTQYI | | | | | | | 17068 |
| HPV18 | L2 | 421 | 10 | APASTQYIGI | | | | | | | 17069 |
| HPV18 | L2 | 327 | 9 | APSPEYIEL | | | | | | | 17070 |
| HPV18 | L2 | 27 | 9 | CPPDVVPKV | | | | | | | 17071 |
| HPV18 | L2 | 266 | 11 | DPRSDVPDSDF | | | | | | | 17072 |
| HPV18 | L2 | 100 | 8 | DPSIVTLI | | | | | | | 17073 |
| HPV18 | L2 | 208 | 8 | EPISSTPL | | | | | | | 17074 |
| HPV18 | L2 | 208 | 11 | EPISSTPLPTV | | | | | | | 17075 |
| HPV18 | L2 | 257 | 9 | EPVDTTLTF | | | | | | | 17076 |
| HPV18 | L2 | 94 | 10 | EPVGPTDPSI | | | | | | | 17077 |
| HPV18 | L2 | 94 | 11 | EPVGPTDPSIV | | | | | | | 17078 |
| HPV18 | L2 | 223 | 8 | GPRLYSRA | | | | | | | 17079 |
| HPV18 | L2 | 223 | 9 | GPRLYSRAY | | | | | | | 17080 |
| HPV18 | L2 | 97 | 8 | GPTDPSIV | | | | | | | 17081 |
| HPV18 | L2 | 97 | 10 | GPTDPSIVTL | | | | | | | 17082 |
| HPV18 | L2 | 97 | 11 | GPTDPSIVTLI | | | | | | | 17083 |
| HPV18 | L2 | 85 | 8 | GPTRPPVV | | | | | | | 17084 |
| HPV18 | L2 | 85 | 9 | GPTRPPVVI | | | | | | | 17085 |
| HPV18 | L2 | 444 | 8 | IPKKRKRV | | | | | | | 17086 |
| HPV18 | L2 | 444 | 10 | IPKKRKRVPY | | | | | | | 17087 |
| HPV18 | L2 | 444 | 11 | IPKKRKRVPYF | | | | | | | 17088 |
| HPV18 | L2 | 72 | 10 | IPLGGRSNTV | | | | | | | 17089 |
| HPV18 | L2 | 72 | 11 | IPLGGRSNTVV | | | | | | | 17090 |
| HPV18 | L2 | 407 | 8 | LPSTTSVW | | | | | | | 17091 |
| HPV18 | L2 | 407 | 10 | LPSTTSVWPI | | | | | | | 17092 |
| HPV18 | L2 | 407 | 11 | LPSTTSVWPIV | | | | | | | 17093 |
| HPV18 | L2 | 215 | 8 | LPTVRRVA | | | | | | | 17094 |
| HPV18 | L2 | 253 | 11 | NPAFEPVDTTL | | | | | | | 17095 |
| HPV18 | L2 | 159 | 9 | NPAFSDPSI | | | | | | | 17096 |
| HPV18 | L2 | 159 | 10 | NPAFSDPSII | | | | | | | 17097 |
| HPV18 | L2 | 238 | 11 | NPEFLTRPSSL | | | | | | | 17098 |
| HPV18 | L2 | 28 | 8 | PPDVVPKV | | | | | | | 17099 |
| HPV18 | L2 | 89 | 8 | PPVVIEPV | | | | | | | 17100 |
| HPV18 | L2 | 284 | 11 | RPALTSRRGTV | | | | | | | 17101 |
| HPV18 | L2 | 88 | 9 | RPPVVIEPV | | | | | | | 17102 |
| HPV18 | L2 | 244 | 8 | RPSSLITY | | | | | | | 17103 |
| HPV18 | L2 | 119 | 10 | RPTFTGTSGF | | | | | | | 17104 |
| HPV18 | L2 | 329 | 10 | SPEYIELQPL | | | | | | | 17105 |
| HPV18 | L2 | 329 | 11 | SPEYIELQPLV | | | | | | | 17106 |
| HPV18 | L2 | 324 | 9 | SPIAPSPEY | | | | | | | 17107 |
| HPV18 | L2 | 324 | 10 | SPIAPSPEYI | | | | | | | 17108 |
| HPV18 | L2 | 418 | 10 | SPTAPASTQY | | | | | | | 17109 |
| HPV18 | L2 | 418 | 11 | SPTAPASTQYI | | | | | | | 17110 |
| HPV18 | L2 | 375 | 10 | SPTISSASSY | | | | | | | 17111 |
| HPV18 | L2 | 213 | 9 | TPLPTVRRV | | | | | | | 17112 |
| HPV18 | L2 | 213 | 10 | TPLPTVRRVA | | | | | | | 17113 |
| HPV18 | L2 | 144 | 9 | TPSSTSVSI | | | | | | | 17114 |
| HPV18 | L2 | 184 | 9 | TPTSGTHGY | | | | | | | 17115 |
| HPV18 | L2 | 271 | 9 | VPDSDFMDI | | | | | | | 17116 |
| HPV18 | L2 | 271 | 10 | VPDSDFMDII | | | | | | | 17117 |
| HPV18 | L2 | 32 | 9 | VPKVEGTTL | | | | | | | 17118 |
| HPV18 | L2 | 32 | 10 | VPKVEGTTLA | | | | | | | 17119 |
| HPV18 | L2 | 389 | 9 | VPLTSSWDV | | | | | | | 17120 |
| HPV18 | L2 | 389 | 11 | VPLTSSWDVPV | | | | | | | 17121 |
| HPV18 | L2 | 170 | 8 | VPQTGEVA | | | | | | | 17122 |
| HPV18 | L2 | 170 | 11 | VPQTGEVAGNV | | | | | | | 17123 |
| HPV18 | L2 | 361 | 9 | VPSRSTTSF | | | | | | | 17124 |
| HPV18 | L2 | 361 | 10 | VPSRSTTSFA | | | | | | | 17125 |
| HPV18 | L2 | 361 | 11 | VPSRSTTSFAF | | | | | | | 17126 |
| HPV18 | L2 | 359 | 11 | VPVPSRSTTSF | | | | | | | 17127 |
| HPV18 | L2 | 397 | 9 | VPVYTGPDI | | | | | | | 17128 |
| HPV18 | L2 | 397 | 11 | VPVYTGPDITL | | | | | | | 17129 |
| HPV18 | L2 | 451 | 9 | VPYFFADGF | | | | | | | 17130 |
| HPV18 | L2 | 451 | 10 | VPYFFADGFV | | | | | | | 17131 |
| HPV18 | L2 | 451 | 11 | VPYFFADGFVA | | | | | | | 17132 |
| HPV18 | L2 | 414 | 8 | WPIVSPTA | | | | | | | 17133 |
| HPV18 | L2 | 414 | 10 | WPIVSPTAPA | | | | | | | 17134 |
| HPV31 | E1 | 458 | 8 | APNTGKSY | | | | | | | 17135 |
| HPV31 | E1 | 458 | 9 | APNTGKSYF | | | | | | | 17136 |
| HPV31 | E1 | 458 | 11 | APNTGKSYFGM | | | | | | | 17137 |
| HPV31 | E1 | 539 | 10 | CPPLLITSNI | | | | | | | 17138 |
| HPV31 | E1 | 572 | 10 | FPFDKNGNPV | | | | | | | 17139 |
| HPV31 | E1 | 572 | 11 | FPFDKNGNPVY | | | | | | | 17140 |
| HPV31 | E1 | 128 | 11 | LPDSGYGNTEV | | | | | | | 17141 |
| HPV31 | E1 | 523 | 11 | NPVSIDVKHKA | | | | | | | 17142 |
| HPV31 | E1 | 579 | 11 | NPVYELSDKNW | | | | | | | 17143 |
| HPV31 | E1 | 289 | 8 | PPKLRSTA | | | | | | | 17144 |
| HPV31 | E1 | 289 | 9 | PPKLRSTAA | 0.0014 | 0.0003 | 0.0002 | 0.0002 | 0.0024 | | 17145 |

TABLE XI-continued

| | | | | | | | | | | | |
|---|---|---|---|---|---|---|---|---|---|---|---|
| HPV31 | E1 | 289 | 10 | PPKLRSTAAA | | | | | | | 17146 |
| HPV31 | E1 | 289 | 11 | PPKLRSTAAAL | | | | | | | 17147 |
| HPV31 | E1 | 540 | 9 | PPLLITSNI | | | | | | | 17148 |
| HPV31 | E1 | 540 | 11 | PPLLITSNINA | | | | | | | 17149 |
| HPV31 | E1 | 491 | 8 | QPLADAKI | | | | | | | 17150 |
| HPV31 | E1 | 491 | 10 | QPLADAKIGM | | | | | | | 17151 |
| HPV31 | E1 | 491 | 11 | QPLADAKIGML | | | | | | | 17152 |
| HPV31 | E1 | 288 | 9 | QPPKLRSTA | | | | | | | 17153 |
| HPV31 | E1 | 288 | 10 | QPPKLRSTAA | | | | | | | 17154 |
| HPV31 | E1 | 288 | 11 | QPPKLRSTAAA | | | | | | | 17155 |
| HPV31 | E1 | 236 | 9 | QPYCLYCHL | | | | | | | 17156 |
| HPV31 | E1 | 92 | 10 | SPLSDISSCV | | | | | | | 17157 |
| HPV31 | E1 | 106 | 9 | SPRLKAICI | 0.4700 | 0.0003 | 0.0004 | 0.0002 | 0.0004 | | 17158 |
| HPV31 | E1 | 506 | 10 | TPCWHYIDNY | | | | | | | 17159 |
| HPV31 | E1 | 506 | 11 | TPCWHYIDNYL | | | | | | | 17160 |
| HPV31 | E1 | 316 | 10 | TPEWIERQTV | | | | | | | 17161 |
| HPV31 | E1 | 316 | 11 | TPEWIERQTVL | | | | | | | 17162 |
| HPV31 | E1 | 169 | 9 | TPTRNILQV | | | | | | | 17163 |
| HPV31 | E1 | 169 | 10 | TPTRNILQVL | | | | | | | 17164 |
| HPV31 | E1 | 447 | 8 | VPKKNCIL | | | | | | | 17165 |
| HPV31 | E1 | 447 | 9 | VPKKNCILI | | | | | | | 17166 |
| HPV31 | E1 | 556 | 8 | WPYLHSRL | | | | | | | 17167 |
| HPV31 | E1 | 556 | 9 | WPYLHSRLV | | | | | | | 17168 |
| HPV31 | E1 | 556 | 10 | WPYLHSPLVV | | | | | | | 17169 |
| HPV31 | E1 | 556 | 11 | WPYLHSRLVVF | | | | | | | 17170 |
| HPV31 | E2 | 105 | 11 | APTGCLKKHGY | | | | | | | 17171 |
| HPV31 | E2 | 289 | 8 | CPATTPII | | | | | | | 17172 |
| HPV31 | E2 | 289 | 10 | CPATTPIIHL | | | | | | | 17173 |
| HPV31 | E2 | 195 | 11 | FPESVFSSDEI | | | | | | | 17174 |
| HPV31 | E2 | 257 | 11 | HPNKLLRGDSV | | | | | | | 17175 |
| HPV31 | E2 | 359 | 11 | IPNTVSVSTGY | | | | | | | 17176 |
| HPV31 | E2 | 293 | 10 | TPIIHLKGDA | | | | | | | 17177 |
| HPV31 | E2 | 59 | 9 | VPALSVSKA | | | | | | | 17178 |
| HPV31 | E2 | 59 | 11 | VPALSVSKAKA | | | | | | | 17179 |
| HPV31 | E5 | 69 | 10 | IPLFVIHTHA | | | | | | | 17180 |
| HPV31 | E5 | 30 | 9 | RPLVLSVSV | | | | | | | 17181 |
| HPV31 | E5 | 30 | 10 | RPLVLSVSVY | | | | | | | 17182 |
| HPV31 | E5 | 30 | 11 | RPLVLSVSVYA | | | | | | | 17183 |
| HPV31 | E5 | 55 | 8 | SPLRCFCI | | | | | | | 17184 |
| HPV31 | E5 | 55 | 9 | SPLRCFCIY | | | | | | | 17185 |
| HPV31 | E5 | 55 | 10 | SPLRCFCIYV | | | | | | | 17186 |
| HPV31 | E5 | 55 | 11 | SPLRCFCIYVV | | | | | | | 17187 |
| HPV31 | E6 | 111 | 9 | CPEEKQRHL | 0.0003 | 0.0002 | 0.0074 | 0.0006 | 0.0002 | | 17188 |
| HPV31 | E6 | 21 | 8 | IPYDELRL | | | | | | | 17189 |
| HPV31 | E6 | 21 | 11 | IPYDELRLNCV | | | | | | | 17190 |
| HPV31 | E6 | 4 | 9 | NPAERPRKL | | | | | | | 17191 |
| HPV31 | E6 | 8 | 8 | RPRKLHEL | | | | | | | 17192 |
| HPV31 | E6 | 8 | 11 | RPRKLHELSSA | | | | | | | 17193 |
| HPV31 | E6 | 142 | 8 | RPRTETQV | | | | | | | 17194 |
| HPV31 | E6 | 58 | 10 | TPHGVCTKCL | | | | | | | 17195 |
| HPV31 | E7 | 91 | 8 | CPNCSTRL | | | | | | | 17196 |
| HPV31 | E7 | 46 | 9 | EPDTSNYNI | | | | | | | 17197 |
| HPV31 | E7 | 46 | 10 | EPDTSNYNIV | | | | | | | 17198 |
| HPV31 | E7 | 28 | 10 | LPDSSDEEDV | | | | | | | 17199 |
| HPV31 | E7 | 28 | 11 | LPDSSDEEDVI | | | | | | | 17200 |
| HPV31 | E7 | 16 | 10 | QPEATDLHCY | | | | | | | 17201 |
| HPV31 | E7 | 5 | 8 | TPTLQDYV | | | | | | | 17202 |
| HPV31 | E7 | 5 | 9 | TPTLQDYVL | | | | | | | 17203 |
| HPV31 | E7 | 5 | 11 | TPTLQDYVLDL | | | | | | | 17204 |
| HPV31 | L1 | 433 | 10 | APQKPKEDPF | | | | | | | 17205 |
| HPV31 | L1 | 488 | 10 | APSASTTTPA | | | | | | | 17206 |
| HPV31 | L1 | 186 | 10 | CPPLELKNSV | | | | | | | 17207 |
| HPV31 | L1 | 186 | 11 | CPPLELKNSVI | | | | | | | 17208 |
| HPV31 | L1 | 440 | 8 | DPFKDYVF | | | | | | | 17209 |
| HPV31 | L1 | 440 | 9 | DPFKDYVFW | | | | | | | 17210 |
| HPV31 | L1 | 440 | 11 | DPFKDYVFWEV | | | | | | | 17211 |
| HPV31 | L1 | 241 | 8 | EPYGDTLF | | | | | | | 17212 |
| HPV31 | L1 | 241 | 9 | EPYGDTLFF | | | | | | | 17213 |
| HPV31 | L1 | 241 | 10 | EPYGDTLFFY | | | | | | | 17214 |
| HPV31 | L1 | 241 | 11 | EPYGDTLFFYL | | | | | | | 17215 |
| HPV31 | L1 | 463 | 8 | FPLGRKFL | | | | | | | 17216 |
| HPV31 | L1 | 463 | 9 | FPLGRKFLL | | | | | | | 17217 |
| HPV31 | L1 | 463 | 11 | FPLGRKFLLQA | | | | | | | 17218 |
| HPV31 | L1 | 293 | 8 | FPTPSGSM | | | | | | | 17219 |
| HPV31 | L1 | 293 | 9 | FPTPSGSMV | | | | | | | 17220 |
| HPV31 | L1 | 139 | 10 | GPGTDNRECI | | | | | | | 17221 |
| HPV31 | L1 | 52 | 10 | IPKSDNPKKI | | | | | | | 17222 |
| HPV31 | L1 | 52 | 11 | IPKSDNPKKIV | | | | | | | 17223 |
| HPV31 | L1 | 436 | 10 | KPKEDPFKDY | | | | | | | 17224 |

TABLE XI-continued

| | | | | | |
|---|---|---|---|---|---|
| HPV31 | L1 | 436 | 11 | KPKEDPFKDYV | 17225 |
| HPV31 | L1 | 163 | 8 | KPPIGEHW | 17226 |
| HPV31 | L1 | 310 | 8 | KPYWMQRA | 17227 |
| HPV31 | L1 | 78 | 9 | LPDPNKFGF | 17228 |
| HPV31 | L1 | 13 | 9 | LPPVPVSKV | 17229 |
| HPV31 | L1 | 13 | 10 | LPPVPVSKVV | 17230 |
| HPV31 | L1 | 396 | 8 | NPAILEDW | 17231 |
| HPV31 | L1 | 396 | 10 | NPAILEDWNF | 17232 |
| HPV31 | L1 | 93 | 8 | NPETQRLV | 17233 |
| HPV31 | L1 | 93 | 9 | NPETQRLVW | 17234 |
| HPV31 | L1 | 93 | 10 | NPETQRLVWA | 17235 |
| HPV31 | L1 | 57 | 10 | NPKKIVVPKV | 17236 |
| HPV31 | L1 | 187 | 9 | PPLELKNSV | 17237 |
| HPV31 | L1 | 187 | 10 | PPLELKNSVI | 17238 |
| HPV31 | L1 | 410 | 10 | PPSGSLEDTY | 17239 |
| HPV31 | L1 | 14 | 8 | PPVPVSKV | 17240 |
| HPV31 | L1 | 14 | 9 | PPVPVSKVV | 17241 |
| HPV31 | L1 | 478 | 11 | RPKFKAGKRSA | 17242 |
| HPV31 | L1 | 5 | 8 | RPSEATVY | 17243 |
| HPV31 | L1 | 5 | 9 | RPSEATVYL | 17244 |
| HPV31 | L1 | 174 | 8 | SPCSNNAI | 17245 |
| HPV31 | L1 | 182 | 8 | TPGDCPPL | 17246 |
| HPV31 | L1 | 182 | 10 | TPGDCPPLEL | 17247 |
| HPV31 | L1 | 409 | 11 | TPPSGSLEDTY | 17248 |
| HPV31 | L1 | 295 | 11 | TPSGSMVTSDA | 17249 |
| HPV31 | L1 | 63 | 9 | VPKVSGLQY | 17250 |
| HPV31 | L1 | 63 | 11 | VPKVSGLQYRV | 17251 |
| HPV31 | L1 | 221 | 9 | VPLDICNSI | 17252 |
| HPV31 | L1 | 232 | 8 | YPDYLKMV | 17253 |
| HPV31 | L1 | 232 | 9 | YPDYLKMVA | 17254 |
| HPV31 | L2 | 271 | 9 | APDPDFLDI | 17255 |
| HPV31 | L2 | 271 | 10 | APDPDFLDII | 17256 |
| HPV31 | L2 | 271 | 11 | APDPDFLDIIA | 17257 |
| HPV31 | L2 | 240 | 8 | APKQLITY | 17258 |
| HPV31 | L2 | 414 | 8 | APTQVFPF | 17259 |
| HPV31 | L2 | 414 | 10 | APTQVFPFPL | 17260 |
| HPV31 | L2 | 414 | 11 | APTQVFPFPLA | 17261 |
| HPV31 | L2 | 424 | 9 | APTTPQVSI | 17262 |
| HPV31 | L2 | 424 | 10 | APTTPQVSIF | 17263 |
| HPV31 | L2 | 424 | 11 | APTTPQVSIFV | 17264 |
| HPV31 | L2 | 28 | 9 | CPSDVIPKI | 17265 |
| HPV31 | L2 | 273 | 8 | DPDFLDII | 17266 |
| HPV31 | L2 | 273 | 9 | DPDFLDIIA | 17267 |
| HPV31 | L2 | 273 | 10 | DPDFLDIIAL | 17268 |
| HPV31 | L2 | 102 | 8 | DPSIVSLV | 17269 |
| HPV31 | L2 | 160 | 11 | DPSVLQPPTPA | 17270 |
| HPV31 | L2 | 234 | 11 | DPTFLSAPKQL | 17271 |
| HPV31 | L2 | 96 | 10 | DPVGPLDPSI | 17272 |
| HPV31 | L2 | 96 | 11 | DPVGPLDPSIV | 17273 |
| HPV31 | L2 | 421 | 10 | FPLAPTTPQV | 17274 |
| HPV31 | L2 | 406 | 9 | GPDVPIEHA | 17275 |
| HPV31 | L2 | 99 | 8 | GPLDPSIV | 17276 |
| HPV31 | L2 | 99 | 10 | GPLDPSIVSL | 17277 |
| HPV31 | L2 | 99 | 11 | GPLDPSIVSLV | 17278 |
| HPV31 | L2 | 125 | 8 | HPPTTSGF | 17279 |
| HPV31 | L2 | 125 | 10 | HPPTTSGFDI | 17280 |
| HPV31 | L2 | 125 | 11 | HPPTTSGFDIA | 17281 |
| HPV31 | L2 | 211 | 8 | IPGVRRPA | 17282 |
| HPV31 | L2 | 211 | 10 | IPGVRRPARL | 17283 |
| HPV31 | L2 | 123 | 10 | IPHPPTTSGF | 17284 |
| HPV31 | L2 | 401 | 9 | IPIFSGPDV | 17285 |
| HPV31 | L2 | 401 | 11 | IPIFSGPDVPI | 17286 |
| HPV31 | L2 | 87 | 9 | IPIRPPVSI | 17287 |
| HPV31 | L2 | 33 | 9 | IPKIEHTTI | 17288 |
| HPV31 | L2 | 33 | 10 | IPKIEHTTIA | 17289 |
| HPV31 | L2 | 191 | 8 | IPMDTFIV | 17290 |
| HPV31 | L2 | 327 | 9 | NPAGESIEM | 17291 |
| HPV31 | L2 | 249 | 9 | NPAYETVNA | 17292 |
| HPV31 | L2 | 155 | 9 | NPTFTDPSV | 17293 |
| HPV31 | L2 | 155 | 10 | NPTFTDPSVL | 17294 |
| HPV31 | L2 | 166 | 11 | PPTPAETSGHL | 17295 |
| HPV31 | L2 | 126 | 9 | PPTTSGFDI | 17296 |
| HPV31 | L2 | 126 | 10 | PPTTSGFDIA | 17297 |
| HPV31 | L2 | 91 | 8 | PPVSIDPV | 17298 |
| HPV31 | L2 | 91 | 11 | PPVSIDPVGPL | 17299 |
| HPV31 | L2 | 284 | 11 | RPALTSRRNTV | 17300 |
| HPV31 | L2 | 216 | 8 | RPARLGLY | 17301 |
| HPV31 | L2 | 216 | 11 | RPARLGLYSKA | 17302 |
| HPV31 | L2 | 90 | 9 | RPPVSIDPV | 17303 |

TABLE XI-continued

| | | | | | |
|---|---|---|---|---|---|
| HPV31 | L2 | 78 | 8 | RPSTVSEA | 17304 |
| HPV31 | L2 | 78 | 10 | RPSTVSEASI | 17305 |
| HPV31 | L2 | 372 | 11 | SPSTAVQSTSA | 17306 |
| HPV31 | L2 | 168 | 9 | TPAETSGHL | 17307 |
| HPV31 | L2 | 168 | 10 | TPAETSGHLL | 17308 |
| HPV31 | L2 | 168 | 11 | TPAETSGHLLL | 17309 |
| HPV31 | L2 | 141 | 10 | TPAILDVTSV | 17310 |
| HPV31 | L2 | 209 | 10 | TPIPGVRRPA | 17311 |
| HPV31 | L2 | 427 | 8 | TPQVSIFV | 17312 |
| HPV31 | L2 | 409 | 10 | VPIEHAPTQV | 17313 |
| HPV31 | L2 | 409 | 11 | VPIEHAPTQVF | 17314 |
| HPV31 | L2 | 393 | 9 | VPLSTGFDI | 17315 |
| HPV31 | L2 | 393 | 11 | VPLSTGFDIPI | 17316 |
| HPV31 | L2 | 73 | 10 | VPLSTRPSTV | 17317 |
| HPV31 | L2 | 387 | 9 | VPTNTTVPL | 17318 |
| HPV33 | E1 | 3 | 8 | DPEGTNGA | 17319 |
| HPV33 | E1 | 3 | 10 | DPEGTNGAGM | 17320 |
| HPV33 | E1 | 301 | 11 | EPPKLRSQTCA | 17321 |
| HPV33 | E1 | 585 | 10 | FPFDENGNPV | 17322 |
| HPV33 | E1 | 585 | 11 | FPFDENGNPVY | 17323 |
| HPV33 | E1 | 470 | 9 | GPANTGKSY | 17324 |
| HPV33 | E1 | 470 | 10 | GPANTGKSYF | 17325 |
| HPV33 | E1 | 293 | 8 | IPETCMVI | 17326 |
| HPV33 | E1 | 460 | 8 | IPKKSCML | 17327 |
| HPV33 | E1 | 460 | 9 | IPKKSCMLI | 17328 |
| HPV33 | E1 | 592 | 11 | NPVYAINDENW | 17329 |
| HPV33 | E1 | 302 | 10 | PPKLRSQTCA | 17330 |
| HPV33 | E1 | 302 | 11 | PPKLRSQTCAL | 17331 |
| HPV33 | E1 | 553 | 11 | PPLLLTSNTNA | 17332 |
| HPV33 | E1 | 504 | 8 | QPLSDAKI | 17333 |
| HPV33 | E1 | 504 | 10 | QPLSDAKIGM | 17334 |
| HPV33 | E1 | 504 | 11 | QPLSDAKIGMI | 17335 |
| HPV33 | E1 | 433 | 9 | RPIVQLLRY | 17336 |
| HPV33 | E1 | 237 | 8 | SPSVAESL | 17337 |
| HPV33 | E1 | 237 | 10 | SPSVAESLKV | 17338 |
| HPV33 | E1 | 237 | 11 | SPSVAESLKVL | 17339 |
| HPV33 | E1 | 329 | 8 | TPEWIDRL | 17340 |
| HPV33 | E1 | 329 | 10 | TPEWIDRLTV | 17341 |
| HPV33 | E1 | 329 | 11 | TPEWIDRLTVL | 17342 |
| HPV33 | E1 | 518 | 8 | TPISWTYI | 17343 |
| HPV33 | E1 | 518 | 11 | TPISWTYIDDY | 17344 |
| HPV33 | E1 | 569 | 8 | WPYLHSRL | 17345 |
| HPV33 | E1 | 569 | 10 | WPYLHSRLTV | 17346 |
| HPV33 | E1 | 569 | 11 | WPYLHSRLTVF | 17347 |
| HPV33 | E2 | 195 | 10 | CPTSISSNQI | 17348 |
| HPV33 | E2 | 247 | 9 | DPALDNRTA | 17349 |
| HPV33 | E2 | 340 | 11 | IPPTVQISTGF | 17350 |
| HPV33 | E2 | 294 | 10 | KPYKELYSSM | 17351 |
| HPV33 | E2 | 26 | 8 | LPSQIEHW | 17352 |
| HPV33 | E2 | 26 | 10 | LPSQIEHWKL | 17353 |
| HPV33 | E2 | 26 | 11 | LPSQIEHWKLI | 17354 |
| HPV33 | E2 | 341 | 10 | PPTVQISTGF | 17355 |
| HPV33 | E2 | 341 | 11 | PPTVQISTGFM | 17356 |
| HPV33 | E2 | 238 | 9 | QPLTKLFCA | 17357 |
| HPV33 | E2 | 229 | 9 | RPADTTDTA | 17358 |
| HPV33 | E2 | 59 | 11 | VPSLLASKTKA | 17359 |
| HPV33 | E5 | 59 | 8 | LPMMCINF | 17360 |
| HPV33 | E5 | 59 | 10 | LPMMCINFHA | 17361 |
| HPV33 | E5 | 20 | 10 | RPLILSISTY | 17362 |
| HPV33 | E5 | 20 | 11 | RPLILSISTYA | 17363 |
| HPV33 | E5 | 45 | 9 | SPLKIFFCY | 17364 |
| HPV33 | E5 | 45 | 10 | SPLKIFFCYL | 17365 |
| HPV33 | E5 | 45 | 11 | SPLKIFFCYLL | 17366 |
| HPV33 | E6 | 111 | 9 | CPQEKKRHV | 17367 |
| HPV33 | E6 | 111 | 11 | CPQEKKRHVDL | 17368 |
| HPV33 | E6 | 94 | 8 | KPLNEILI | 17369 |
| HPV33 | E6 | 94 | 11 | KPLNEILIRCI | 17370 |
| HPV33 | E6 | 35 | 8 | KPLQRSEV | 17371 |
| HPV33 | E6 | 35 | 9 | KPLQRSEVY | 17372 |
| HPV33 | E6 | 35 | 11 | KPLQRSEVYDF | 17373 |
| HPV33 | E6 | 8 | 8 | KPRTLHDL | 17374 |
| HPV33 | E6 | 8 | 11 | KPRTLHDLCQA | 17375 |
| HPV33 | E6 | 58 | 8 | NPFGICKL | 17376 |
| HPV33 | E6 | 58 | 10 | NPFGICKLCL | 17377 |
| HPV33 | E7 | 18 | 8 | EPTDLYCY | 17378 |
| HPV33 | E7 | 18 | 11 | EPTDLYCYEQL | 17379 |
| HPV33 | E7 | 5 | 8 | KPTLKEYV | 17380 |
| HPV33 | E7 | 5 | 9 | KPTLKEYVL | 17381 |
| HPV33 | E7 | 5 | 11 | KPTLKEYVLDL | 17382 |

TABLE XI-continued

| | | | | | |
|---|---|---|---|---|---|
| HPV33 | E7 | 46 | 8 | QPATADYY | 17383 |
| HPV33 | E7 | 46 | 9 | QPATADYYI | 17384 |
| HPV33 | E7 | 46 | 10 | QPATADYYIV | 17385 |
| HPV33 | E7 | 40 | 9 | RPDGQAQPA | 17386 |
| HPV33 | E7 | 40 | 11 | RPDGQAQPATA | 17387 |
| HPV33 | E7 | 16 | 8 | YPEPTDLY | 17388 |
| HPV33 | E7 | 16 | 10 | YPEPTDLYCY | 17389 |
| HPV33 | L1 | 180 | 9 | APANDCPPL | 17390 |
| HPV33 | L1 | 180 | 11 | APANDCPPLEL | 17391 |
| HPV33 | L1 | 483 | 10 | APTSTRTSSA | 17392 |
| HPV33 | L1 | 185 | 10 | CPPLELINTI | 17393 |
| HPV33 | L1 | 185 | 11 | CPPLELINTII | 17394 |
| HPV33 | L1 | 438 | 8 | DPLGKYTF | 17395 |
| HPV33 | L1 | 438 | 9 | DPLGKYTFW | 17396 |
| HPV33 | L1 | 438 | 11 | DPLGKYTFWEV | 17397 |
| HPV33 | L1 | 240 | 8 | EPYGDSLF | 17398 |
| HPV33 | L1 | 240 | 9 | EPYGDSLFF | 17399 |
| HPV33 | L1 | 240 | 10 | EPYGDSLFFF | 17400 |
| HPV33 | L1 | 240 | 11 | EPYGDSLFFFL | 17401 |
| HPV33 | L1 | 461 | 8 | FPLGRKFL | 17402 |
| HPV33 | L1 | 461 | 9 | FPLGRKFLL | 17403 |
| HPV33 | L1 | 461 | 11 | FPLGRKFLLQA | 17404 |
| HPV33 | L1 | 292 | 8 | FPTPSGSM | 17405 |
| HPV33 | L1 | 292 | 9 | FPTPSGSMV | 17406 |
| HPV33 | L1 | 476 | 8 | KPKLKRAA | 17407 |
| HPV33 | L1 | 163 | 8 | KPPTGEHW | 17408 |
| HPV33 | L1 | 309 | 8 | KPYWLQRA | 17409 |
| HPV33 | L1 | 78 | 9 | LPDPNKFGF | 17410 |
| HPV33 | L1 | 13 | 9 | LPPVPVSKV | 17411 |
| HPV33 | L1 | 13 | 10 | LPPVPVSKVV | 17412 |
| HPV33 | L1 | 394 | 8 | NPDILEDW | 17413 |
| HPV33 | L1 | 394 | 10 | NPDILEDWQF | 17414 |
| HPV33 | L1 | 93 | 8 | NPDTQRLV | 17415 |
| HPV33 | L1 | 93 | 9 | NPDTQRLVW | 17416 |
| HPV33 | L1 | 93 | 10 | NPDTQRLVWA | 17417 |
| HPV33 | L1 | 54 | 8 | NPTNAKKL | 17418 |
| HPV33 | L1 | 54 | 9 | NPTNAKKLL | 17419 |
| HPV33 | L1 | 54 | 10 | NPTNAKKLLV | 17420 |
| HPV33 | L1 | 432 | 9 | PPKEKEDPL | 17421 |
| HPV33 | L1 | 186 | 9 | PPLELINTI | 17422 |
| HPV33 | L1 | 186 | 10 | PPLELINTII | 17423 |
| HPV33 | L1 | 407 | 11 | PPPSASLQDTY | 17424 |
| HPV33 | L1 | 408 | 10 | PPSASLQDTY | 17425 |
| HPV33 | L1 | 164 | 11 | PPTGEHWGKGV | 17426 |
| HPV33 | L1 | 14 | 8 | PPVPVSKV | 17427 |
| HPV33 | L1 | 14 | 9 | PPVPVSKVV | 17428 |
| HPV33 | L1 | 139 | 10 | QPGADNRECL | 17429 |
| HPV33 | L1 | 5 | 8 | RPSEATVY | 17430 |
| HPV33 | L1 | 5 | 9 | RPSEATVYL | 17431 |
| HPV33 | L1 | 406 | 8 | TPPPSASL | 17432 |
| HPV33 | L1 | 63 | 9 | VPKVSGLQY | 17433 |
| HPV33 | L1 | 63 | 11 | VPKVSGLQYRV | 17434 |
| HPV33 | L1 | 431 | 10 | VPPKEKEDPL | 17435 |
| HPV33 | L2 | 173 | 9 | APAEASGHF | 17436 |
| HPV33 | L2 | 173 | 10 | APAEASGHFI | 17437 |
| HPV33 | L2 | 173 | 11 | APAEASGHFIF | 17438 |
| HPV33 | L2 | 276 | 9 | APDPDFLDI | 17439 |
| HPV33 | L2 | 276 | 10 | APDPDFLDII | 17440 |
| HPV33 | L2 | 276 | 11 | APDPDFLDIIA | 17441 |
| HPV33 | L2 | 120 | 10 | APSIPTPSGF | 17442 |
| HPV33 | L2 | 27 | 9 | CPPDVIPKV | 17443 |
| HPV33 | L2 | 239 | 11 | DPAFLTSPHKL | 17444 |
| HPV33 | L2 | 278 | 8 | DPDFLDII | 17445 |
| HPV33 | L2 | 278 | 9 | DPDFLDIIA | 17446 |
| HPV33 | L2 | 278 | 10 | DPDFLDIIAL | 17447 |
| HPV33 | L2 | 261 | 8 | DPEDTLQF | 17448 |
| HPV33 | L2 | 77 | 9 | DPPTAAIPL | 17449 |
| HPV33 | L2 | 165 | 9 | EPSVLHPPA | 17450 |
| HPV33 | L2 | 165 | 11 | EPSVLHPPAPA | 17451 |
| HPV33 | L2 | 428 | 8 | FPFDTIVV | 17452 |
| HPV33 | L2 | 428 | 11 | FPFDTIVVDGA | 17453 |
| HPV33 | L2 | 415 | 8 | FPTSSPFV | 17454 |
| HPV33 | L2 | 415 | 10 | FPTSSPFVPI | 17455 |
| HPV33 | L2 | 456 | 8 | FPYFFTDV | 17456 |
| HPV33 | L2 | 456 | 10 | FPYFFTDVRV | 17457 |
| HPV33 | L2 | 456 | 11 | FPYFFTDVRVA | 17458 |
| HPV33 | L2 | 407 | 8 | GPDIPSPL | 17459 |
| HPV33 | L2 | 407 | 9 | GPDIPSPLF | 17460 |
| HPV33 | L2 | 98 | 8 | GPLDSSIV | 17461 |

TABLE XI-continued

| | | | | | | | | | | | |
|---|---|---|---|---|---|---|---|---|---|---|---|
| HPV33 | L2 | 98 | 10 | GPLDSSIVSL | | | | | | | 17462 |
| HPV33 | L2 | 98 | 11 | GPLDSSIVSLI | | | | | | | 17463 |
| HPV33 | L2 | 170 | 8 | HPPAPAEA | | | | | | | 17464 |
| HPV33 | L2 | 216 | 8 | IPGSRPVA | | | | | | | 17465 |
| HPV33 | L2 | 216 | 10 | IPGSRPVARL | | | | | | | 17466 |
| HPV33 | L2 | 32 | 9 | IPKVEGSTI | | | | | | | 17467 |
| HPV33 | L2 | 32 | 10 | IPKVEGSTIA | | | | | | | 17468 |
| HPV33 | L2 | 394 | 11 | IPLNTGFDTPV | | | | | | | 17469 |
| HPV33 | L2 | 83 | 10 | IPLQPIRPPV | | | | | | | 17470 |
| HPV33 | L2 | 196 | 8 | IPMDTFVV | | | | | | | 17471 |
| HPV33 | L2 | 123 | 9 | IPTPSGFDV | | | | | | | 17472 |
| HPV33 | L2 | 160 | 9 | NPTFTEPSV | | | | | | | 17473 |
| HPV33 | L2 | 160 | 10 | NPTFTEPSVL | | | | | | | 17474 |
| HPV33 | L2 | 171 | 11 | PPAPAEASGHF | | | | | | | 17475 |
| HPV33 | L2 | 28 | 8 | PPDVIPKV | | | | | | | 17476 |
| HPV33 | L2 | 78 | 8 | PPTAAIPL | | | | | | | 17477 |
| HPV33 | L2 | 78 | 11 | PPTAAIPLQPI | | | | | | | 17478 |
| HPV33 | L2 | 90 | 8 | PPVTVDTV | | | | | | | 17479 |
| HPV33 | L2 | 90 | 11 | PPVTVDTVGPL | | | | | | | 17480 |
| HPV33 | L2 | 86 | 9 | QPIRPPVTV | | | | | | | 17481 |
| HPV33 | L2 | 346 | 11 | QPLHDTSTSSY | | | | | | | 17482 |
| HPV33 | L2 | 289 | 11 | RPAITSRRHTV | | | | | | | 17483 |
| HPV33 | L2 | 89 | 9 | RPPVTVDTV | | | | | | | 17484 |
| HPV33 | L2 | 220 | 8 | RPVARLGL | | | | | | | 17485 |
| HPV33 | L2 | 220 | 9 | RPVARLGLY | | | | | | | 17486 |
| HPV33 | L2 | 274 | 8 | SPAPDPDF | | | | | | | 17487 |
| HPV33 | L2 | 274 | 9 | SPAPDPDFL | | | | | | | 17488 |
| HPV33 | L2 | 274 | 11 | SPAPDPDFLDI | | | | | | | 17489 |
| HPV33 | L2 | 425 | 9 | SPFFPFDTI | | | | | | | 17490 |
| HPV33 | L2 | 425 | 10 | SPFFPFDTIV | | | | | | | 17491 |
| HPV33 | L2 | 425 | 11 | SPFFPFDTIVV | | | | | | | 17492 |
| HPV33 | L2 | 419 | 9 | SPFVPISPF | | | | | | | 17493 |
| HPV33 | L2 | 419 | 10 | SPFVPISPFF | | | | | | | 17494 |
| HPV33 | L2 | 245 | 8 | SPHKLITY | | | | | | | 17495 |
| HPV33 | L2 | 329 | 10 | SPIVPLDHTV | | | | | | | 17496 |
| HPV33 | L2 | 412 | 10 | SPLFPTSSPF | | | | | | | 17497 |
| HPV33 | L2 | 412 | 11 | SPLFPTSSPFV | | | | | | | 17498 |
| HPV33 | L2 | 185 | 9 | SPTVSTQSY | | | | | | | 17499 |
| HPV33 | L2 | 138 | 10 | TPAIINVSSV | | | | | | | 17500 |
| HPV33 | L2 | 214 | 9 | TPIPGSRPV | | | | | | | 17501 |
| HPV33 | L2 | 214 | 10 | TPIPGSRPVA | | | | | | | 17502 |
| HPV33 | L2 | 375 | 10 | TPMQHSYSTF | | | | | | | 17503 |
| HPV33 | L2 | 375 | 11 | TPMQHSYSTFA | | | | | | | 17504 |
| HPV33 | L2 | 125 | 11 | TPSGFDVTTSA | | | | | | | 17505 |
| HPV33 | L2 | 402 | 9 | TPVMSGPDI | | | | | | | 17506 |
| HPV33 | L2 | 72 | 10 | VPIGTDPPTA | | | | | | | 17507 |
| HPV33 | L2 | 72 | 11 | VPIGTDPPTAA | | | | | | | 17508 |
| HPV33 | L2 | 422 | 9 | VPISPFFPF | | | | | | | 17509 |
| HPV33 | L2 | 338 | 8 | VPNEQYEL | | | | | | | 17510 |
| HPV33 | L2 | 338 | 11 | VPNEQYELQPL | | | | | | | 17511 |
| HPV45 | E1 | 552 | 10 | CPPILLTSNI | | | | | | | 17512 |
| HPV45 | E1 | 562 | 8 | DPAKDNKW | | | | | | | 17513 |
| HPV45 | E1 | 562 | 10 | DPAKDNKWPY | | | | | | | 17514 |
| HPV45 | E1 | 562 | 11 | DPAKDNKWPYL | | | | | | | 17515 |
| HPV45 | E1 | 179 | 9 | DPHCSITEL | | | | | | | 17516 |
| HPV45 | E1 | 504 | 8 | EPLADTKV | | | | | | | 17517 |
| HPV45 | E1 | 504 | 9 | EPLADTKVA | | | | | | | 17518 |
| HPV45 | E1 | 504 | 10 | EPLADTKVAM | | | | | | | 17519 |
| HPV45 | E1 | 504 | 11 | EPLADTKVAML | | | | | | | 17520 |
| HPV45 | E1 | 301 | 9 | EPPKLRSSV | | | | | | | 17521 |
| HPV45 | E1 | 301 | 10 | EPPKLRSSVA | | | | | | | 17522 |
| HPV45 | E1 | 301 | 11 | EPPKLRSSVAA | | | | | | | 17523 |
| HPV45 | E1 | 585 | 10 | FPFDKNGNPV | | | | | | | 17524 |
| HPV45 | E1 | 585 | 11 | FPFDKNGNPVY | | | | | | | 17525 |
| HPV45 | E1 | 470 | 9 | GPANTGKSY | | | | | | | 17526 |
| HPV45 | E1 | 470 | 10 | GPANTGKSYF | | | | | | | 17527 |
| HPV45 | E1 | 627 | 9 | IPFGTFKCV | | | | | | | 17528 |
| HPV45 | E1 | 249 | 9 | KPATLYAHI | | | | | | | 17529 |
| HPV45 | E1 | 545 | 11 | KPLLQLKCPPI | | | | | | | 17530 |
| HPV45 | E1 | 237 | 8 | NPTVAEGF | | | | | | | 17531 |
| HPV45 | E1 | 237 | 11 | NPTVAEGFKTL | | | | | | | 17532 |
| HPV45 | E1 | 592 | 11 | NPVYEINDKNW | | | | | | | 17533 |
| HPV45 | E1 | 553 | 9 | PPILLTSNI | | | | | | | 17534 |
| HPV45 | E1 | 302 | 8 | PPKLRSSV | | | | | | | 17535 |
| HPV45 | E1 | 302 | 9 | PPKLRSSVA | | | | | | | 17536 |
| HPV45 | E1 | 302 | 10 | PPKLRSSVAA | | | | | | | 17537 |
| HPV45 | E1 | 302 | 11 | PPKLRSSVAAL | | | | | | | 17538 |
| HPV45 | E1 | 433 | 9 | RPIVQFLRY | 0.0033 | 0.0400 | 0.0002 | 0.0230 | 0.0004 | | 17539 |
| HPV45 | E1 | 97 | 9 | SPLGEQLSV | | | | | | | 17540 |

TABLE XI-continued

| | | | | | | | | | | | |
|---|---|---|---|---|---|---|---|---|---|---|---|
| HPV45 | E1 | 110 | 9 | SPRLQEISL | 0.6200 | 0.0008 | 0.0005 | 0.0002 | 0.0004 | | 17541 |
| HPV45 | E1 | 329 | 8 | TPEWIQRL | | | | | | | 17542 |
| HPV45 | E1 | 329 | 10 | TPEWIQRLTI | | | | | | | 17543 |
| HPV45 | E1 | 329 | 11 | TPEWIQRLTII | | | | | | | 17544 |
| HPV45 | E1 | 460 | 8 | TPKKNCIL | | | | | | | 17545 |
| HPV45 | E1 | 460 | 9 | TPKKNCILL | | | | | | | 17546 |
| HPV45 | E1 | 460 | 10 | TPKKNCILLY | | | | | | | 17547 |
| HPV45 | E1 | 293 | 8 | VPETCMLI | | | | | | | 17548 |
| HPV45 | E1 | 569 | 8 | WPYLESRV | | | | | | | 17549 |
| HPV45 | E1 | 569 | 10 | WPYLESRVTV | | | | | | | 17550 |
| HPV45 | E1 | 569 | 11 | WPYLESRVTVF | | | | | | | 17551 |
| HPV45 | E2 | 355 | 9 | IPNSVQISV | | | | | | | 17552 |
| HPV45 | E2 | 355 | 11 | IPNSVQISVGY | | | | | | | 17553 |
| HPV45 | E2 | 240 | 8 | KPHIQTPA | | | | | | | 17554 |
| HPV45 | E2 | 66 | 10 | PPINISKSKA | | | | | | | 17555 |
| HPV45 | E2 | 5 | 10 | TPKESLSERL | | | | | | | 17556 |
| HPV45 | E2 | 238 | 10 | TPKPHIQTPA | | | | | | | 17557 |
| HPV45 | E2 | 65 | 11 | VPPINISKSKA | | | | | | | 17558 |
| HPV45 | E6 | 6 | 9 | DPTQRPYKL | | | | | | | 17559 |
| HPV45 | E6 | 14 | 8 | LPDLCTEL | | | | | | | 17560 |
| HPV45 | E6 | 113 | 9 | NPAEKRRHL | | | | | | | 17561 |
| HPV45 | E6 | 10 | 8 | RPYKLPDL | | | | | | | 17562 |
| HPV45 | E7 | 22 | 8 | DPVDLLCY | | | | | | | 17563 |
| HPV45 | E7 | 22 | 11 | DPVDLLCYEQL | | | | | | | 17564 |
| HPV45 | E7 | 16 | 9 | EPQNELDPV | | | | | | | 17565 |
| HPV45 | E7 | 16 | 11 | EPQNELDPVDL | | | | | | | 17566 |
| HPV45 | E7 | 56 | 8 | EPQRHKIL | | | | | | | 17567 |
| HPV45 | E7 | 56 | 10 | EPQRHKILCV | | | | | | | 17568 |
| HPV45 | E7 | 3 | 9 | GPRATLQEI | | | | | | | 17569 |
| HPV45 | E7 | 3 | 10 | GPRATLQEIV | | | | | | | 17570 |
| HPV45 | E7 | 3 | 11 | GPRATLQEIVL | | | | | | | 17571 |
| HPV45 | L1 | 212 | 10 | CPPLELKNTI | | | | | | | 17572 |
| HPV45 | L1 | 212 | 11 | CPPLELKNTII | | | | | | | 17573 |
| HPV45 | L1 | 386 | 8 | DPTKFKHY | | | | | | | 17574 |
| HPV45 | L1 | 469 | 8 | DPYDKLKF | | | | | | | 17575 |
| HPV45 | L1 | 469 | 9 | DPYDKLKFW | | | | | | | 17576 |
| HPV45 | L1 | 469 | 11 | DPYDKLKFWTV | | | | | | | 17577 |
| HPV45 | L1 | 267 | 8 | DPYGDSMF | | | | | | | 17578 |
| HPV45 | L1 | 267 | 9 | DPYGDSMFF | | | | | | | 17579 |
| HPV45 | L1 | 267 | 11 | DPYGDSMFFCL | | | | | | | 17580 |
| HPV45 | L1 | 21 | 8 | FPIFLQMA | | | | | | | 17581 |
| HPV45 | L1 | 21 | 9 | FPIFLQMAL | | | | | | | 17582 |
| HPV45 | L1 | 21 | 10 | FPIFLQMALW | | | | | | | 17583 |
| HPV45 | L1 | 511 | 8 | GPRKRPAA | | | | | | | 17584 |
| HPV45 | L1 | 338 | 8 | KPYWLHKA | | | | | | | 17585 |
| HPV45 | L1 | 104 | 9 | LPDNKFGL | | | | | | | 17586 |
| HPV45 | L1 | 39 | 9 | LPPPSVARV | | | | | | | 17587 |
| HPV45 | L1 | 39 | 10 | LPPPSVARVV | | | | | | | 17588 |
| HPV45 | L1 | 119 | 8 | NPETQRLV | | | | | | | 17589 |
| HPV45 | L1 | 119 | 9 | NPETQRLVW | | | | | | | 17590 |
| HPV45 | L1 | 119 | 10 | NPETQRLVWA | | | | | | | 17591 |
| HPV45 | L1 | 73 | 11 | NPYFRVVPSGA | | | | | | | 17592 |
| HPV45 | L1 | 464 | 8 | PPEKQDPY | | | | | | | 17593 |
| HPV45 | L1 | 464 | 11 | PPEKQDPYDKL | | | | | | | 17594 |
| HPV45 | L1 | 213 | 9 | PPLELKNTI | | | | | | | 17595 |
| HPV45 | L1 | 213 | 10 | PPLELKNTII | | | | | | | 17596 |
| HPV45 | L1 | 437 | 8 | PPPPTTSL | | | | | | | 17597 |
| HPV45 | L1 | 437 | 9 | PPPPTTSLV | | | | | | | 17598 |
| HPV45 | L1 | 40 | 8 | PPPSVARV | | | | | | | 17599 |
| HPV45 | L1 | 40 | 9 | PPPSVARVV | | | | | | | 17600 |
| HPV45 | L1 | 438 | 8 | PPPTTSLV | | | | | | | 17601 |
| HPV45 | L1 | 438 | 11 | PPPTTSLVDTY | | | | | | | 17602 |
| HPV45 | L1 | 41 | 8 | PPSVARVV | | | | | | | 17603 |
| HPV45 | L1 | 439 | 10 | PPTTSLVDTY | | | | | | | 17604 |
| HPV45 | L1 | 208 | 8 | QPGDCPPL | | | | | | | 17605 |
| HPV45 | L1 | 208 | 10 | QPGDCPPLEL | | | | | | | 17606 |
| HPV45 | L1 | 515 | 9 | RPAASTSTA | | | | | | | 17607 |
| HPV45 | L1 | 525 | 8 | RPAKRVRI | | | | | | | 17608 |
| HPV45 | L1 | 31 | 8 | RPSDSTVY | | | | | | | 17609 |
| HPV45 | L1 | 31 | 9 | RPSDSTVYL | | | | | | | 17610 |
| HPV45 | L1 | 507 | 11 | RPTIGPRKRPA | | | | | | | 17611 |
| HPV45 | L1 | 321 | 8 | SPSPSGSI | | | | | | | 17612 |
| HPV45 | L1 | 463 | 9 | TPPEKQDPY | | | | | | | 17613 |
| HPV45 | L1 | 189 | 8 | VPAIGEHW | | | | | | | 17614 |
| HPV45 | L1 | 189 | 9 | VPAIGEHWA | | | | | | | 17615 |
| HPV45 | L1 | 89 | 9 | VPKVSAYQY | | | | | | | 17616 |
| HPV45 | L1 | 89 | 11 | VPKVSAYQYRV | | | | | | | 17617 |
| HPV45 | L1 | 247 | 9 | VPLDICQSI | | | | | | | 17618 |
| HPV45 | L1 | 381 | 10 | VPNTYDPTKF | | | | | | | 17619 |

TABLE XI-continued

| | | | | | |
|---|---|---|---|---|---|
| HPV45 | L1 | 436 | 9 | VPPPPTTSL | 17620 |
| HPV45 | L1 | 436 | 10 | VPPPPTTSLV | 17621 |
| HPV45 | L1 | 79 | 10 | VPSGAGNKQA | 17622 |
| HPV45 | L1 | 79 | 11 | VPSGAGNKQAV | 17623 |
| HPV45 | L1 | 258 | 9 | YPDYLQMSA | 17624 |
| HPV45 | L1 | 492 | 8 | YPLGRKFL | 17625 |
| HPV45 | L1 | 492 | 9 | YPLGRKFLV | 17626 |
| HPV45 | L1 | 492 | 11 | YPLGRKFLVQA | 17627 |
| HPV45 | L2 | 27 | 9 | CPPDVINKV | 17628 |
| HPV45 | L2 | 100 | 8 | DPSIVTLV | 17629 |
| HPV45 | L2 | 208 | 8 | EPISSTPL | 17630 |
| HPV45 | L2 | 208 | 11 | EPISSTPLPTV | 17631 |
| HPV45 | L2 | 257 | 9 | EPLDTTLSF | 17632 |
| HPV45 | L2 | 266 | 11 | EPTSNVPDSDF | 17633 |
| HPV45 | L2 | 94 | 10 | EPVGPTDPSI | 17634 |
| HPV45 | L2 | 94 | 11 | EPVGPTDPSIV | 17635 |
| HPV45 | L2 | 445 | 8 | FPKKRKRI | 17636 |
| HPV45 | L2 | 445 | 10 | FPKKRKRIPY | 17637 |
| HPV45 | L2 | 445 | 11 | FPKKRKRIPYF | 17638 |
| HPV45 | L2 | 223 | 8 | GPRLYSRA | 17639 |
| HPV45 | L2 | 97 | 8 | GPTDPSIV | 17640 |
| HPV45 | L2 | 97 | 10 | GPTDPSIVTL | 17641 |
| HPV45 | L2 | 97 | 11 | GPTDPSIVTLV | 17642 |
| HPV45 | L2 | 85 | 8 | GPTRPPVV | 17643 |
| HPV45 | L2 | 85 | 9 | GPTRPPVVI | 17644 |
| HPV45 | L2 | 244 | 8 | HPSSLVTF | 17645 |
| HPV45 | L2 | 452 | 9 | IPYFFADGF | 17646 |
| HPV45 | L2 | 452 | 10 | IPYFFADGFV | 17647 |
| HPV45 | L2 | 452 | 11 | IPYFFADGFVA | 17648 |
| HPV45 | L2 | 408 | 8 | LPSHTPMW | 17649 |
| HPV45 | L2 | 377 | 9 | MPSTAASSY | 17650 |
| HPV45 | L2 | 159 | 9 | NPAFSDPSI | 17651 |
| HPV45 | L2 | 159 | 10 | NPAFSDPSII | 17652 |
| HPV45 | L2 | 253 | 11 | NPAYEPLDTTL | 17653 |
| HPV45 | L2 | 355 | 10 | PPASTTPSTI | 17654 |
| HPV45 | L2 | 28 | 8 | PPDVINKV | 17655 |
| HPV45 | L2 | 354 | 11 | PPPASTTPSTI | 17656 |
| HPV45 | L2 | 89 | 8 | PPVVIEPV | 17657 |
| HPV45 | L2 | 284 | 11 | RPALSSRRGTV | 17658 |
| HPV45 | L2 | 88 | 9 | RPPVVIEPV | 17659 |
| HPV45 | L2 | 324 | 9 | SPIAATEEI | 17660 |
| HPV45 | L2 | 324 | 11 | SPIAATEEIEL | 17661 |
| HPV45 | L2 | 419 | 10 | SPTNASTTTY | 17662 |
| HPV45 | L2 | 419 | 11 | SPTNASTTTYI | 17663 |
| HPV45 | L2 | 137 | 11 | TPAVLDITPTV | 17664 |
| HPV45 | L2 | 213 | 9 | TPLPTVRRV | 17665 |
| HPV45 | L2 | 360 | 9 | TPSTIHKSF | 17666 |
| HPV45 | L2 | 360 | 11 | TPSTIHKSFTY | 17667 |
| HPV45 | L2 | 184 | 9 | TPTSGSHGY | 17668 |
| HPV45 | L2 | 144 | 9 | TPTVDSVSI | 17669 |
| HPV45 | L2 | 271 | 9 | VPDSDFMDI | 17670 |
| HPV45 | L2 | 271 | 10 | VPDSDFMDII | 17671 |
| HPV45 | L2 | 398 | 9 | VPIYTGPDI | 17672 |
| HPV45 | L2 | 398 | 10 | VPIYTGPDII | 17673 |
| HPV45 | L2 | 398 | 11 | VPIYTGPDIIL | 17674 |
| HPV45 | L2 | 72 | 10 | VPLGGRSNTV | 17675 |
| HPV45 | L2 | 72 | 11 | VPLGGRSNTVV | 17676 |
| HPV45 | L2 | 390 | 9 | VPLTSAWDV | 17677 |
| HPV45 | L2 | 390 | 11 | VPLTSAWDVPI | 17678 |
| HPV45 | L2 | 170 | 11 | VPQTGEVSGNI | 17679 |
| HPV45 | L2 | 119 | 10 | VPTFTGTSGF | 17680 |
| HPV45 | L2 | 415 | 9 | WPSTSPTNA | 17681 |
| HPV45 | L2 | 370 | 8 | YPKYSLTM | 17682 |
| HPV56 | E2 | 138 | 11 | CPDSVSSTCRY | 17683 |
| HPV56 | E2 | 243 | 10 | EPNRLKCCRY | 17684 |
| HPV56 | E2 | 229 | 9 | HPGDKTTPV | 17685 |
| HPV56 | E2 | 229 | 10 | HPGDKTTPVV | 17686 |
| HPV56 | E2 | 300 | 8 | IPVVYRLV | 17687 |
| HPV56 | E2 | 300 | 9 | IPVVYRLVW | 17688 |
| HPV56 | E2 | 182 | 8 | RPGKRPRL | 17689 |
| HPV56 | E2 | 186 | 9 | RPRLRESEF | 17690 |
| HPV56 | E2 | 151 | 9 | SPVETVNEY | 17691 |
| HPV56 | E2 | 2 | 9 | VPCLQVCKA | 17692 |
| HPV56 | E2 | 2 | 11 | VPCLQVCKAKA | 17693 |
| HPV56 | E6 | 61 | 8 | FPYAVCRV | 17694 |
| HPV56 | E6 | 61 | 10 | FPYAVCRVCL | 17695 |
| HPV56 | E6 | 61 | 11 | FPYAVCRVCLL | 17696 |
| HPV56 | E6 | 24 | 8 | IPLIDLRL | 17697 |
| HPV56 | E6 | 24 | 11 | IPLIDLRLSCV | 17698 |

TABLE XI-continued

| | | | | | |
|---|---|---|---|---|---|
| HPV56 | E6 | 7 | 9 | NPQERPRSL | 17699 |
| HPV56 | E6 | 11 | 8 | RPRSLHHL | 17700 |
| HPV56 | E6 | 11 | 11 | RPRSLHHLSEV | 17701 |
| HPV56 | E6 | 111 | 10 | SPLTPEEKQL | 17702 |
| HPV56 | E7 | 46 | 8 | RPQQARQA | 17703 |
| HPV56 | E7 | 16 | 8 | TPQTEIDL | 17704 |
| HPV56 | E7 | 63 | 8 | VPCCECKF | 17705 |
| HPV56 | E7 | 63 | 9 | VPCCECKFV | 17706 |
| HPV56 | E7 | 63 | 10 | VPCCECKFVV | 17707 |
| HPV56 | E7 | 5 | 8 | VPTLQDVV | 17708 |
| HPV56 | E7 | 5 | 9 | VPTLQDVVL | 17709 |
| HPV56 | E7 | 5 | 11 | VPTLQDVVLEL | 17710 |
| HPV56 | L1 | 521 | 9 | APTSTSTPA | 17711 |
| HPV56 | L1 | 219 | 11 | CPPLALINTPI | 17712 |
| HPV56 | L1 | 472 | 8 | DPLAKYKF | 17713 |
| HPV56 | L1 | 472 | 9 | DPLAKYKFW | 17714 |
| HPV56 | L1 | 472 | 11 | DPLAKYKFWDV | 17715 |
| HPV56 | L1 | 11 | 8 | DPPLHYGL | 17716 |
| HPV56 | L1 | 11 | 10 | DPPLHYGLCI | 17717 |
| HPV56 | L1 | 11 | 11 | DPPLHYGLCIF | 17718 |
| HPV56 | L1 | 318 | 8 | EPPPSSVY | 17719 |
| HPV56 | L1 | 318 | 9 | EPPPSSVYV | 17720 |
| HPV56 | L1 | 318 | 10 | EPPPSSVYVA | 17721 |
| HPV56 | L1 | 30 | 8 | FPIFLQMA | 17722 |
| HPV56 | L1 | 30 | 10 | FPIFLQMATW | 17723 |
| HPV56 | L1 | 495 | 8 | FPLGRKFL | 17724 |
| HPV56 | L1 | 495 | 9 | FPLGRKFLM | 17725 |
| HPV56 | L1 | 495 | 11 | FPLGRKFLMQL | 17726 |
| HPV56 | L1 | 96 | 9 | IPKVSAYQY | 17727 |
| HPV56 | L1 | 96 | 11 | IPKVSAYQYRV | 17728 |
| HPV56 | L1 | 343 | 8 | KPYWLQRA | 17729 |
| HPV56 | L1 | 111 | 9 | LPDPNKFGL | 17730 |
| HPV56 | L1 | 48 | 9 | LPPTPVSKV | 17731 |
| HPV56 | L1 | 48 | 10 | LPPTPVSKVV | 17732 |
| HPV56 | L1 | 48 | 11 | LPPTPVSKVVA | 17733 |
| HPV56 | L1 | 126 | 8 | NPDQERLV | 17734 |
| HPV56 | L1 | 126 | 9 | NPDQERLVW | 17735 |
| HPV56 | L1 | 126 | 10 | NPDQERLVWA | 17736 |
| HPV56 | L1 | 220 | 10 | PPLALINTPI | 17737 |
| HPV56 | L1 | 12 | 9 | PPLHYGLCI | 17738 |
| HPV56 | L1 | 12 | 10 | PPLHYGLCIF | 17739 |
| HPV56 | L1 | 12 | 11 | PPLHYGLCIFL | 17740 |
| HPV56 | L1 | 319 | 8 | PPPSSVYV | 17741 |
| HPV56 | L1 | 319 | 9 | PPPSSVYVA | 17742 |
| HPV56 | L1 | 320 | 8 | PPSSVYVA | 17743 |
| HPV56 | L1 | 466 | 9 | PPTEKQDPL | 17744 |
| HPV56 | L1 | 466 | 10 | PPTEKQDPLA | 17745 |
| HPV56 | L1 | 49 | 8 | PPTPVSKV | 17746 |
| HPV56 | L1 | 49 | 9 | PPTPVSKVV | 17747 |
| HPV56 | L1 | 49 | 10 | PPTPVSKVVA | 17748 |
| HPV56 | L1 | 441 | 11 | PPVATSLEDKY | 17749 |
| HPV56 | L1 | 465 | 10 | QPPTEKQDPL | 17750 |
| HPV56 | L1 | 465 | 11 | QPPTEKQDPLA | 17751 |
| HPV56 | L1 | 40 | 8 | RPSENKVY | 17752 |
| HPV56 | L1 | 40 | 9 | RPSENKVYL | 17753 |
| HPV56 | L1 | 440 | 8 | SPPVATSL | 17754 |
| HPV56 | L1 | 196 | 8 | TPAMGEHW | 17755 |
| HPV56 | L1 | 227 | 8 | TPIEDGDM | 17756 |
| HPV56 | L1 | 227 | 9 | TPIEDGDMI | 17757 |
| HPV56 | L1 | 328 | 11 | TPSGSMITSEA | 17758 |
| HPV56 | L1 | 51 | 8 | TPVSKVVA | 17759 |
| HPV56 | L1 | 265 | 9 | YPDYLKMSA | 17760 |
| HPV56 | L1 | 265 | 11 | YPDYLKMSADA | 17761 |
| HPV56 | L2 | 271 | 9 | APDPDFMNI | 17762 |
| HPV56 | L2 | 271 | 10 | APDPDFMNIV | 17763 |
| HPV56 | L2 | 271 | 11 | APDPDFMNIVA | 17764 |
| HPV56 | L2 | 358 | 9 | APGLSSQSV | 17765 |
| HPV56 | L2 | 358 | 10 | APGLSSQSVA | 17766 |
| HPV56 | L2 | 391 | 11 | APLGNVWETPF | 17767 |
| HPV56 | L2 | 170 | 11 | APQTGEVSGNI | 17768 |
| HPV56 | L2 | 223 | 8 | APRLYRKA | 17769 |
| HPV56 | L2 | 223 | 9 | APRLYRKAF | 17770 |
| HPV56 | L2 | 27 | 9 | CPEDVVNKI | 17771 |
| HPV56 | L2 | 238 | 9 | DPAFLDRPA | 17772 |
| HPV56 | L2 | 238 | 11 | DPAFLDRPATL | 17773 |
| HPV56 | L2 | 273 | 8 | DPDFMNIV | 17774 |
| HPV56 | L2 | 273 | 9 | DPDFMNIVA | 17775 |
| HPV56 | L2 | 273 | 10 | DPDFMNIVAL | 17776 |
| HPV56 | L2 | 100 | 8 | DPSIVTLV | 17777 |

TABLE XI-continued

| | | | | | |
|---|---|---|---|---|---|
| HPV56 | L2 | 208 | 8 | EPISSTPI | 17778 |
| HPV56 | L2 | 208 | 11 | EPISSTPIPGF | 17779 |
| HPV56 | L2 | 412 | 8 | GPSTWPFV | 17780 |
| HPV56 | L2 | 97 | 8 | GPTDPSIV | 17781 |
| HPV56 | L2 | 97 | 10 | GPTDPSIVTL | 17782 |
| HPV56 | L2 | 97 | 11 | GPTDPSIVTLV | 17783 |
| HPV56 | L2 | 215 | 8 | IPGFRRIA | 17784 |
| HPV56 | L2 | 215 | 9 | IPGFRRIAA | 17785 |
| HPV56 | L2 | 195 | 8 | IPMQTFAV | 17786 |
| HPV56 | L2 | 119 | 10 | IPNFTGSGGF | 17787 |
| HPV56 | L2 | 453 | 10 | IPYFFADGDV | 17788 |
| HPV56 | L2 | 453 | 11 | IPYFFADGDVA | 17789 |
| HPV56 | L2 | 376 | 8 | KPSTLSFA | 17790 |
| HPV56 | L2 | 373 | 8 | LPIKPSTL | 17791 |
| HPV56 | L2 | 373 | 10 | LPIKPSTLSF | 17792 |
| HPV56 | L2 | 373 | 11 | LPIKPSTLSFA | 17793 |
| HPV56 | L2 | 409 | 8 | LPTGPSTW | 17794 |
| HPV56 | L2 | 409 | 10 | LPTGPSTWPF | 17795 |
| HPV56 | L2 | 409 | 11 | LPTGPSTWPFV | 17796 |
| HPV56 | L2 | 253 | 11 | NPLFEGTDTSL | 17797 |
| HPV56 | L2 | 159 | 9 | NPLFIDPPV | 17798 |
| HPV56 | L2 | 159 | 10 | NPLFIDPPVI | 17799 |
| HPV56 | L2 | 89 | 8 | PPIVVESV | 17800 |
| HPV56 | L2 | 335 | 10 | QPLLSANNSF | 17801 |
| HPV56 | L2 | 284 | 11 | RPAFTTRRGGV | 17802 |
| HPV56 | L2 | 244 | 8 | RPATLVSA | 17803 |
| HPV56 | L2 | 88 | 9 | RPPIVVESV | 17804 |
| HPV56 | L2 | 77 | 8 | RPSTIVDV | 17805 |
| HPV56 | L2 | 77 | 11 | RPSTIVDVTPA | 17806 |
| HPV56 | L2 | 324 | 9 | SPIAQAEEI | 17807 |
| HPV56 | L2 | 324 | 11 | SPIAQAEEIEM | 17808 |
| HPV56 | L2 | 266 | 11 | SPSGVAPDPDF | 17809 |
| HPV56 | L2 | 422 | 9 | SPYDVTHDV | 17810 |
| HPV56 | L2 | 422 | 10 | SPYDVTHDVY | 17811 |
| HPV56 | L2 | 422 | 11 | SPYDVTHDVYI | 17812 |
| HPV56 | L2 | 85 | 8 | TPARPPIV | 17813 |
| HPV56 | L2 | 85 | 9 | TPARPPIVV | 17814 |
| HPV56 | L2 | 399 | 9 | TPFYSGPDI | 17815 |
| HPV56 | L2 | 399 | 10 | TPFYSGPDIV | 17816 |
| HPV56 | L2 | 399 | 11 | TPFYSGPDIVL | 17817 |
| HPV56 | L2 | 213 | 9 | TPIPGFRRI | 17818 |
| HPV56 | L2 | 213 | 10 | TPIPGFRRIA | 17819 |
| HPV56 | L2 | 213 | 11 | TPIPGFRRIAA | 17820 |
| HPV56 | L2 | 368 | 8 | TPSAHLPI | 17821 |
| HPV56 | L2 | 184 | 9 | TPTSGIHSY | 17822 |
| HPV56 | L2 | 144 | 9 | TPTSSTVHV | 17823 |
| HPV56 | L2 | 72 | 10 | VPLGSRPSTI | 17824 |
| HPV56 | L2 | 72 | 11 | VPLGSRPSTIV | 17825 |
| HPV56 | L2 | 419 | 8 | VPQSPYDV | 17826 |
| HPV56 | L2 | 416 | 9 | WPFVPQSPY | 17827 |
| HPV56 | L2 | 416 | 11 | WPFVPQSPYDV | 17828 |

B27 Supermotif Peptides

| Type | Protein | No. of Amino Acids | Position | Sequence | Seq. Id. No. |
|---|---|---|---|---|---|
| HPV16 | E1 | 10 | 67 | AHALFTAQEA | 17829 |
| HPV16 | E1 | 9 | 203 | AKAAMLAKF | 17830 |
| HPV16 | E1 | 9 | 209 | AKFKELYGV | 17831 |
| HPV16 | E1 | 11 | 209 | AKFKELYGVSF | 17832 |
| HPV16 | E1 | 9 | 516 | AKIGMLDDA | 17833 |
| HPV16 | E1 | 11 | 516 | AKIGMLDDATV | 17834 |
| HPV16 | E1 | 8 | 399 | AKIVKDCA | 17835 |
| HPV16 | E1 | 10 | 399 | AKIVKDCATM | 17836 |
| HPV16 | E1 | 8 | 76 | AKQHRDAV | 17837 |
| HPV16 | E1 | 10 | 76 | AKQHRDAVQV | 17838 |
| HPV16 | E1 | 11 | 76 | AKQHRDAVQVL | 17839 |
| HPV16 | E1 | 9 | 627 | DKENDGDSL | 17840 |
| HPV16 | E1 | 8 | 606 | DKNWKSFF | 17841 |
| HPV16 | E1 | 9 | 431 | DRVDDGGDW | 17842 |
| HPV16 | E1 | 10 | 416 | EKKQMSMSQW | 17843 |
| HPV16 | E1 | 11 | 416 | EKKQMSMSQWI | 17844 |
| HPV16 | E1 | 8 | 26 | EKKTGDAI | 17845 |
| HPV16 | E1 | 8 | 291 | EKLLSKLL | 17846 |
| HPV16 | E1 | 10 | 291 | EKLLSKLLCV | 17847 |
| HPV16 | E1 | 11 | 116 | EKQSRAAKRRL | 17848 |
| HPV16 | E1 | 10 | 182 | ERHTICQTPL | 17849 |
| HPV16 | E1 | 9 | 211 | FKELYGVSF | 17850 |

TABLE XI-continued

| | | | | | |
|---|---|---|---|---|---|
| HPV16 | E1 | 11 | 226 | FKSNKSTCCDW | 17851 |
| HPV16 | E1 | 10 | 284 | GKNRETIEKL | 17852 |
| HPV16 | E1 | 11 | 284 | GKNRETIEKLL | 17853 |
| HPV16 | E1 | 9 | 482 | GKSLFGMSL | 17854 |
| HPV16 | E1 | 10 | 482 | GKSLFGMSLM | 17855 |
| HPV16 | E1 | 8 | 79 | HRDAVQVL | 17856 |
| HPV16 | E1 | 8 | 251 | IKTLLQQY | 17857 |
| HPV16 | E1 | 10 | 251 | IKTLLQQYCL | 17858 |
| HPV16 | E1 | 11 | 251 | IKTLLQQYCLY | 17859 |
| HPV16 | E1 | 8 | 426 | IKYRCDRV | 17860 |
| HPV16 | E1 | 8 | 550 | KHRPLVQL | 17861 |
| HPV16 | E1 | 8 | 469 | KKNCILLY | 17862 |
| HPV16 | E1 | 10 | 469 | KKNCILLYGA | 17863 |
| HPV16 | E1 | 11 | 469 | KKNCILLYGAA | 17864 |
| HPV16 | E1 | 9 | 417 | KKQMSMSQW | 17865 |
| HPV16 | E1 | 10 | 417 | KKQMSMSQWI | 17866 |
| HPV16 | E1 | 8 | 413 | KRAEKKQM | 17867 |
| HPV16 | E1 | 10 | 413 | KRAEKKQMSM | 17868 |
| HPV16 | E1 | 9 | 87 | KRKYLVSPL | 17869 |
| HPV16 | E1 | 10 | 262 | LHIQSLACSW | 17870 |
| HPV16 | E1 | 8 | 579 | LHNRLVVF | 17871 |
| HPV16 | E1 | 10 | 579 | LHNRLVVFTF | 17872 |
| HPV16 | E1 | 8 | 557 | LKCPPLLI | 17873 |
| HPV16 | E1 | 8 | 460 | LKRFLQGI | 17874 |
| HPV16 | E1 | 10 | 86 | LKRKYLVSPL | 17875 |
| HPV16 | E1 | 9 | 393 | LKSNSQAKI | 17876 |
| HPV16 | E1 | 10 | 393 | LKSNSQAKIV | 17877 |
| HPV16 | E1 | 8 | 198 | LKTSNAKA | 17878 |
| HPV16 | E1 | 9 | 198 | LKTSNAKAA | 17879 |
| HPV16 | E1 | 10 | 198 | LKTSNAKAAM | 17880 |
| HPV16 | E1 | 11 | 198 | LKTSNAKAAML | 17881 |
| HPV16 | E1 | 9 | 536 | LRNALDGNL | 17882 |
| HPV16 | E1 | 10 | 536 | LRNALDGNLV | 17883 |
| HPV16 | E1 | 8 | 312 | LRSTAAAL | 17884 |
| HPV16 | E1 | 9 | 312 | LRSTAAALY | 17885 |
| HPV16 | E1 | 10 | 312 | LRSTAAALYW | 17886 |
| HPV16 | E1 | 11 | 312 | LRSTAAALYWY | 17887 |
| HPV16 | E1 | 8 | 446 | LRYQGVEF | 17888 |
| HPV16 | E1 | 9 | 446 | LRYQGVEFM | 17889 |
| HPV16 | E1 | 11 | 446 | LRYQGVEFMSF | 17890 |
| HPV16 | E1 | 8 | 491 | MKFLQGSV | 17891 |
| HPV16 | E1 | 9 | 491 | MKFLQGSVI | 17892 |
| HPV16 | E1 | 11 | 491 | MKFLQGSVICF | 17893 |
| HPV16 | E1 | 8 | 229 | NKSTCCDW | 17894 |
| HPV16 | E1 | 10 | 229 | NKSTCCDWCI | 17895 |
| HPV16 | E1 | 11 | 229 | NKSTCCDWCIA | 17896 |
| HPV16 | E1 | 8 | 286 | NRETIEKL | 17897 |
| HPV16 | E1 | 9 | 286 | NRETIEKLL | 17898 |
| HPV16 | E1 | 8 | 581 | NRLVVFTF | 17899 |
| HPV16 | E1 | 8 | 468 | PKKNCILL | 17900 |
| HPV16 | E1 | 9 | 468 | PKKNCILLY | 17901 |
| HPV16 | E1 | 11 | 468 | PKKNCILLYGA | 17902 |
| HPV16 | E1 | 8 | 310 | PKLRSTAA | 17903 |
| HPV16 | E1 | 9 | 310 | PKLRSTAAA | 17904 |
| HPV16 | E1 | 10 | 310 | PKLRSTAAAL | 17905 |
| HPV16 | E1 | 11 | 310 | PKLRSTAAALY | 17906 |
| HPV16 | E1 | 8 | 108 | PRLKAICI | 17907 |
| HPV16 | E1 | 8 | 78 | QHRDAVQV | 17908 |
| HPV16 | E1 | 9 | 78 | QHRDAVQVL | 17909 |
| HPV16 | E1 | 9 | 347 | QHSFNDCTF | 17910 |
| HPV16 | E1 | 11 | 347 | QHSFNDCTFEL | 17911 |
| HPV16 | E1 | 10 | 341 | QRQTVLQHSF | 17912 |
| HPV16 | E1 | 11 | 150 | RHETETPCSQY | 17913 |
| HPV16 | E1 | 9 | 183 | RHTICQTPL | 17914 |
| HPV16 | E1 | 11 | 410 | RHYKRAEKKQM | 17915 |
| HPV16 | E1 | 8 | 88 | RKYLVSPL | 17916 |
| HPV16 | E1 | 11 | 88 | RKYLVSPLSDI | 17917 |
| HPV16 | E1 | 11 | 124 | RRLFESEDSGY | 17918 |
| HPV16 | E1 | 8 | 506 | SHFWLQPL | 17919 |
| HPV16 | E1 | 9 | 506 | SHFWLQPLA | 17920 |
| HPV16 | E1 | 11 | 506 | SHFWLQPLADA | 17921 |
| HPV16 | E1 | 9 | 295 | SKLLCVSPM | 17922 |
| HPV16 | E1 | 11 | 295 | SKLLCVSPMCM | 17923 |
| HPV16 | E1 | 10 | 504 | SKSHFWLQPL | 17924 |
| HPV16 | E1 | 11 | 504 | SKSHFWLQPLA | 17925 |
| HPV16 | E1 | 8 | 119 | SRAAKRRL | 17926 |
| HPV16 | E1 | 9 | 119 | SRAAKRRLF | 17927 |
| HPV16 | E1 | 9 | 614 | SRTWSRLSL | 17928 |
| HPV16 | E1 | 10 | 574 | SRWPYLHNRL | 17929 |

TABLE XI-continued

| | | | | | |
|---|---|---|---|---|---|
| HPV16 | E1 | 11 | 574 | SRWPYLHNRLV | 17930 |
| HPV16 | E1 | 11 | 402 | VKDCATMCRHY | 17931 |
| HPV16 | E1 | 9 | 549 | VKHRPLVQL | 17932 |
| HPV16 | E1 | 8 | 439 | WKQIVMFL | 17933 |
| HPV16 | E1 | 10 | 439 | WKQIVMFLRY | 17934 |
| HPV16 | E1 | 9 | 609 | WKSFFSRTW | 17935 |
| HPV16 | E1 | 10 | 281 | YKCGKNRETI | 17936 |
| HPV16 | E1 | 9 | 412 | YKRAEKKQM | 17937 |
| HPV16 | E1 | 11 | 412 | YKRAEKKQMSM | 17938 |
| HPV16 | E1 | 8 | 322 | YKTGISNI | 17939 |
| HPV16 | E1 | 11 | 322 | YKTGISNISEV | 17940 |
| HPV16 | E2 | 9 | 46 | AREMGFKHI | 17941 |
| HPV16 | E2 | 9 | 28 | DHIDYWKHM | 17942 |
| HPV16 | E2 | 11 | 28 | DHIDYWKHMRL | 17943 |
| HPV16 | E2 | 8 | 90 | EKWTLQDV | 17944 |
| HPV16 | E2 | 10 | 90 | EKWTLQDVSL | 17945 |
| HPV16 | E2 | 8 | 176 | EKYSKNKV | 17946 |
| HPV16 | E2 | 9 | 176 | EKYSKNKVW | 17947 |
| HPV16 | E2 | 11 | 176 | EKYSKNKVWEV | 17948 |
| HPV16 | E2 | 8 | 171 | FKDDAEKY | 17949 |
| HPV16 | E2 | 8 | 51 | FKHINHQV | 17950 |
| HPV16 | E2 | 9 | 51 | FKHINHQVV | 17951 |
| HPV16 | E2 | 8 | 305 | FKKHCTLY | 17952 |
| HPV16 | E2 | 10 | 305 | FKKHCTLYTA | 17953 |
| HPV16 | E2 | 11 | 305 | FKKHCTLYTAV | 17954 |
| HPV16 | E2 | 9 | 323 | GHNVKHKSA | 17955 |
| HPV16 | E2 | 10 | 323 | GHNVKHKSAI | 17956 |
| HPV16 | E2 | 11 | 323 | GHNVKHKSAIV | 17957 |
| HPV16 | E2 | 8 | 328 | HKSAIVTL | 17958 |
| HPV16 | E2 | 10 | 328 | HKSAIVTLTY | 17959 |
| HPV16 | E2 | 8 | 258 | HRDSVDSA | 17960 |
| HPV16 | E2 | 10 | 258 | HRDSVDSAPI | 17961 |
| HPV16 | E2 | 11 | 258 | HRDSVDSAPIL | 17962 |
| HPV16 | E2 | 8 | 110 | IKKHGYTV | 17963 |
| HPV16 | E2 | 10 | 110 | IKKHGYTVEV | 17964 |
| HPV16 | E2 | 10 | 211 | IRQHLANHPA | 17965 |
| HPV16 | E2 | 11 | 211 | IRQHLANHPAA | 17966 |
| HPV16 | E2 | 8 | 164 | IRTYFVQF | 17967 |
| HPV16 | E2 | 8 | 307 | KHCTLYTA | 17968 |
| HPV16 | E2 | 9 | 307 | KHCTLYTAV | 17969 |
| HPV16 | E2 | 8 | 112 | KHGYTVEV | 17970 |
| HPV16 | E2 | 10 | 112 | KHGYTVEVQF | 17971 |
| HPV16 | E2 | 8 | 52 | KHINHQVV | 17972 |
| HPV16 | E2 | 11 | 52 | KHINHQVVPTL | 17973 |
| HPV16 | E2 | 9 | 327 | KHKSAIVTL | 17974 |
| HPV16 | E2 | 11 | 327 | KHKSAIVTLTY | 17975 |
| HPV16 | E2 | 8 | 34 | KHMRLECA | 17976 |
| HPV16 | E2 | 9 | 34 | KHMRLECAI | 17977 |
| HPV16 | E2 | 10 | 34 | KHMRLECAIY | 17978 |
| HPV16 | E2 | 11 | 34 | KHMRLECAIYY | 17979 |
| HPV16 | E2 | 9 | 306 | KKHCTLYTA | 17980 |
| HPV16 | E2 | 10 | 306 | KKHCTLYTAV | 17981 |
| HPV16 | E2 | 9 | 111 | KKHGYTVEV | 17982 |
| HPV16 | E2 | 11 | 111 | KKHGYTVEVQF | 17983 |
| HPV16 | E2 | 9 | 257 | LHRDSVDSA | 17984 |
| HPV16 | E2 | 11 | 257 | LHRDSVDSAPI | 17985 |
| HPV16 | E2 | 8 | 298 | LKCLRYRF | 17986 |
| HPV16 | E2 | 8 | 291 | LKGDANTL | 17987 |
| HPV16 | E2 | 11 | 291 | LKGDANTLKCL | 17988 |
| HPV16 | E2 | 8 | 26 | LRDHIDYW | 17989 |
| HPV16 | E2 | 11 | 26 | LRDHIDYWKHM | 17990 |
| HPV16 | E2 | 11 | 301 | LRYRFKKHCTL | 17991 |
| HPV16 | E2 | 9 | 129 | MHYTNWTHI | 17992 |
| HPV16 | E2 | 10 | 129 | MHYTNWTHIY | 17993 |
| HPV16 | E2 | 11 | 129 | MHYTNWTHIYI | 17994 |
| HPV16 | E2 | 8 | 36 | MRLECAIY | 17995 |
| HPV16 | E2 | 9 | 36 | MRLECAIYY | 17996 |
| HPV16 | E2 | 11 | 36 | MRLECAIYYKA | 17997 |
| HPV16 | E2 | 10 | 217 | NHPAATHTKA | 17998 |
| HPV16 | E2 | 11 | 217 | NHPAATHTKAV | 17999 |
| HPV16 | E2 | 8 | 55 | NHQVVPTL | 18000 |
| HPV16 | E2 | 9 | 55 | NHQVVPTLA | 18001 |
| HPV16 | E2 | 10 | 55 | NHQVVPTLAV | 18002 |
| HPV16 | E2 | 9 | 67 | NKALQAIEL | 18003 |
| HPV16 | E2 | 11 | 67 | NKALQAIELQL | 18004 |
| HPV16 | E2 | 8 | 181 | NKVWEVHA | 18005 |
| HPV16 | E2 | 10 | 353 | PKTITVSTGF | 18006 |
| HPV16 | E2 | 11 | 353 | PKTITVSTGFM | 18007 |
| HPV16 | E2 | 8 | 213 | QHLANHPA | 18008 |

TABLE XI-continued

| | | | | | |
|---|---|---|---|---|---|
| HPV16 | E2 | 9 | 213 | QHLANHPAA | 18009 |
| HPV16 | E2 | 9 | 342 | QRDQFLSQV | 18010 |
| HPV16 | E2 | 11 | 342 | QRDQFLSQVKI | 18011 |
| HPV16 | E2 | 10 | 6 | QRLNVCQDKI | 18012 |
| HPV16 | E2 | 11 | 6 | QRLNVCQDKIL | 18013 |
| HPV16 | E2 | 8 | 65 | SKNKALQA | 18014 |
| HPV16 | E2 | 9 | 65 | SKNKALQAI | 18015 |
| HPV16 | E2 | 11 | 65 | SKNKALQAIEL | 18016 |
| HPV16 | E2 | 8 | 179 | SKNKVWEV | 18017 |
| HPV16 | E2 | 10 | 179 | SKNKVWEVHA | 18018 |
| HPV16 | E2 | 9 | 135 | THIYICEEA | 18019 |
| HPV16 | E2 | 11 | 135 | THIYICEEASV | 18020 |
| HPV16 | E2 | 8 | 222 | THTKAVAL | 18021 |
| HPV16 | E2 | 10 | 17 | THYENDSTDL | 18022 |
| HPV16 | E2 | 9 | 254 | TKLLHRDSV | 18023 |
| HPV16 | E2 | 8 | 186 | VHAGGQVI | 18024 |
| HPV16 | E2 | 9 | 186 | VHAGGQVIL | 18025 |
| HPV16 | E2 | 8 | 160 | VHEGIRTY | 18026 |
| HPV16 | E2 | 9 | 160 | VHEGIRTYF | 18027 |
| HPV16 | E2 | 10 | 160 | VHEGIRTYFV | 18028 |
| HPV16 | E2 | 10 | 289 | VHLKGDANTL | 18029 |
| HPV16 | E2 | 8 | 326 | VKHKSAIV | 18030 |
| HPV16 | E2 | 10 | 326 | VKHKSMVTL | 18031 |
| HPV16 | E2 | 9 | 350 | VKIPKTITV | 18032 |
| HPV16 | E2 | 8 | 319 | WHWTGHNV | 18033 |
| HPV16 | E2 | 9 | 33 | WKHMRLECA | 18034 |
| HPV16 | E2 | 10 | 33 | WKHMRLECAI | 18035 |
| HPV16 | E2 | 11 | 33 | WKHMRLECAIY | 18036 |
| HPV16 | E2 | 8 | 44 | YKAREMGF | 18037 |
| HPV16 | E2 | 11 | 44 | YKAREMGFKHI | 18038 |
| HPV16 | E2 | 9 | 303 | YRFKKHCTL | 18039 |
| HPV16 | E2 | 10 | 303 | YRFKKHCTLY | 18040 |
| HPV16 | E5 | 8 | 57 | FRCFIVYI | 18041 |
| HPV16 | E5 | 9 | 57 | FRCFIVYII | 18042 |
| HPV16 | E5 | 10 | 57 | FRCFIVYIIF | 18043 |
| HPV16 | E5 | 11 | 57 | FRCFIVYIIFV | 18044 |
| HPV16 | E5 | 8 | 74 | IHTHARFL | 18045 |
| HPV16 | E5 | 9 | 74 | IHTHARFLI | 18046 |
| HPV16 | E5 | 8 | 29 | IRPLLLSV | 18047 |
| HPV16 | E5 | 11 | 29 | IRPLLLSVSTY | 18048 |
| HPV16 | E6 | 10 | 40 | CKQQLLRREV | 18049 |
| HPV16 | E6 | 11 | 40 | CKQQLLRREVY | 18050 |
| HPV16 | E6 | 10 | 71 | DKCLKFYSKI | 18051 |
| HPV16 | E6 | 9 | 127 | DKKQRFHNI | 18052 |
| HPV16 | E6 | 9 | 14 | ERPRKLPQL | 18053 |
| HPV16 | E6 | 8 | 132 | FHNIRGRW | 18054 |
| HPV16 | E6 | 8 | 54 | FRDLCIVY | 18055 |
| HPV16 | E6 | 8 | 137 | GRWTGRCM | 18056 |
| HPV16 | E6 | 9 | 30 | IHDIILECV | 18057 |
| HPV16 | E6 | 10 | 30 | IHDIILECVY | 18058 |
| HPV16 | E6 | 10 | 108 | IRCINCQKPL | 18059 |
| HPV16 | E6 | 10 | 135 | IRGRWTGRCM | 18060 |
| HPV16 | E6 | 8 | 128 | KKQRFHNI | 18061 |
| HPV16 | E6 | 10 | 74 | LKFYSKISEY | 18062 |
| HPV16 | E6 | 8 | 45 | LRREVYDF | 18063 |
| HPV16 | E6 | 9 | 45 | LRREVYDFA | 18064 |
| HPV16 | E6 | 10 | 45 | LRREVYDFAF | 18065 |
| HPV16 | E6 | 8 | 1 | MHQKRTAM | 18066 |
| HPV16 | E6 | 9 | 1 | MHQKRTAMF | 18067 |
| HPV16 | E6 | 8 | 100 | NKPLCDLL | 18068 |
| HPV16 | E6 | 9 | 100 | NKPLCDLLI | 18069 |
| HPV16 | E6 | 11 | 16 | PRKLPQLCTEL | 18070 |
| HPV16 | E6 | 10 | 130 | QRFHNIRGRW | 18071 |
| HPV16 | E6 | 10 | 123 | QRHLDKKQRF | 18072 |
| HPV16 | E6 | 9 | 124 | RHLDKKQRF | 18073 |
| HPV16 | E6 | 8 | 84 | RHYCYSLY | 18074 |
| HPV16 | E6 | 10 | 17 | RKLPQLCTEL | 18075 |
| HPV16 | E6 | 8 | 46 | RREVYDFA | 18076 |
| HPV16 | E6 | 9 | 46 | RREVYDFAF | 18077 |
| HPV16 | E6 | 9 | 78 | SKISEYRHY | 18078 |
| HPV16 | E6 | 11 | 78 | SKISEYRHYCY | 18079 |
| HPV16 | E6 | 9 | 150 | SRTRRETQL | 18080 |
| HPV16 | E6 | 8 | 61 | YRDGNPYA | 18081 |
| HPV16 | E6 | 9 | 61 | YRDGNPYAV | 18082 |
| HPV16 | E6 | 8 | 83 | YRHYCYSL | 18083 |
| HPV16 | E6 | 9 | 83 | YRHYCYSLY | 18084 |
| HPV16 | E7 | 8 | 50 | AHYNIVTF | 18085 |
| HPV16 | E7 | 9 | 59 | CKCDSTLRL | 18086 |
| HPV16 | E7 | 11 | 59 | CKCDSTLRLCV | 18087 |

TABLE XI-continued

| | | | | | |
|---|---|---|---|---|---|
| HPV16 | E7 | 8 | 48 | DRAHYNIV | 18088 |
| HPV16 | E7 | 10 | 48 | DRAHYNIVTF | 18089 |
| HPV16 | E7 | 8 | 76 | IRTLEDLL | 18090 |
| HPV16 | E7 | 9 | 76 | IRTLEDLLM | 18091 |
| HPV16 | E7 | 8 | 8 | LHEYMLDL | 18092 |
| HPV16 | E7 | 10 | 65 | LRLCVQSTHV | 18093 |
| HPV16 | E7 | 8 | 1 | MHGDTPTL | 18094 |
| HPV16 | E7 | 11 | 1 | MHGDTPTLHEY | 18095 |
| HPV16 | E7 | 8 | 72 | THVDIRTL | 18096 |
| HPV16 | E7 | 11 | 72 | THVDIRTLEDL | 18097 |
| HPV16 | L1 | 8 | 524 | AKRKKRKL | 18098 |
| HPV16 | L1 | 9 | 55 | ARTNIYYHA | 18099 |
| HPV16 | L1 | 9 | 405 | CKITLTADV | 18100 |
| HPV16 | L1 | 10 | 405 | CKITLTADVM | 18101 |
| HPV16 | L1 | 9 | 187 | CKPPIGEHW | 18102 |
| HPV16 | L1 | 9 | 255 | CKYPDYIKM | 18103 |
| HPV16 | L1 | 10 | 255 | CKYPDYIKMV | 18104 |
| HPV16 | L1 | 10 | 479 | EKFSADLDQF | 18105 |
| HPV16 | L1 | 11 | 386 | FKEYLRHGEEY | 18106 |
| HPV16 | L1 | 11 | 99 | FRIHLPDPNKF | 18107 |
| HPV16 | L1 | 8 | 344 | GHNNGICW | 18108 |
| HPV16 | L1 | 8 | 145 | GHPLLNKL | 18109 |
| HPV16 | L1 | 9 | 196 | GKGSPCTNV | 18110 |
| HPV16 | L1 | 10 | 196 | GKGSPCTNVA | 18111 |
| HPV16 | L1 | 11 | 196 | GKGSPCTNVAV | 18112 |
| HPV16 | L1 | 8 | 134 | GRGQPLGV | 18113 |
| HPV16 | L1 | 10 | 134 | GRGQPLGVGI | 18114 |
| HPV16 | L1 | 8 | 491 | GRKFLLQA | 18115 |
| HPV16 | L1 | 10 | 491 | GRKFLLQAGL | 18116 |
| HPV16 | Li | 9 | 101 | IHLPDPNKF | 18117 |
| HPV16 | L1 | 11 | 101 | IHLPDPNKFGF | 18118 |
| HPV16 | L1 | 8 | 417 | IHSMNSTI | 18119 |
| HPV16 | L1 | 9 | 417 | IHSMNSTIL | 18120 |
| HPV16 | L1 | 8 | 303 | IKGSGSTA | 18121 |
| HPV16 | L1 | 10 | 303 | IKGSGSTANL | 18122 |
| HPV16 | L1 | 11 | 303 | IKGSGSTANLA | 18123 |
| HPV16 | L1 | 9 | 78 | IKKPNNNKI | 18124 |
| HPV16 | L1 | 10 | 78 | IKKPNNNKIL | 18125 |
| HPV16 | L1 | 11 | 78 | IKKPNNNKILV | 18126 |
| HPV16 | L1 | 8 | 261 | IKMVSEPY | 18127 |
| HPV16 | L1 | 8 | 79 | KKPNNNKI | 18128 |
| HPV16 | L1 | 9 | 79 | KKPNNNKIL | 18129 |
| HPV16 | L1 | 10 | 79 | KKPNNNKILV | 18130 |
| HPV16 | L1 | 8 | 468 | KKYTFWEV | 18131 |
| HPV16 | L1 | 10 | 468 | KKYTFWEVNL | 18132 |
| HPV16 | L1 | 9 | 500 | LKAKPKFTL | 18133 |
| HPV16 | L1 | 9 | 477 | LKEKFSADL | 18134 |
| HPV16 | L1 | 9 | 467 | LKKYTFWEV | 18135 |
| HPV16 | L1 | 11 | 467 | LKKYTFWEVNL | 18136 |
| HPV16 | L1 | 9 | 390 | LRHGEEYDL | 18137 |
| HPV16 | L1 | 11 | 390 | LRHGEEYDLQF | 18138 |
| HPV16 | L1 | 8 | 276 | LRREQMFV | 18139 |
| HPV16 | L1 | 11 | 276 | LRREQMFVRHL | 18140 |
| HPV16 | L1 | 10 | 107 | NKFGFPDTSF | 18141 |
| HPV16 | L1 | 11 | 107 | NKFGFPDTSFY | 18142 |
| HPV16 | L1 | 8 | 84 | NKILVPKV | 18143 |
| HPV16 | L1 | 11 | 84 | NKILVPKVSGL | 18144 |
| HPV16 | L1 | 9 | 150 | NKLDDTENA | 18145 |
| HPV16 | L1 | 11 | 150 | NKLDDTENASA | 18146 |
| HPV16 | L1 | 9 | 334 | NKPYWLQRA | 18147 |
| HPV16 | L1 | 9 | 242 | NKSEVPLDI | 18148 |
| HPV16 | L1 | 10 | 288 | NRAGAVGENV | 18149 |
| HPV16 | L1 | 9 | 169 | NRECISMDY | 18150 |
| HPV16 | L1 | 9 | 462 | PKEDPLKKY | 18151 |
| HPV16 | L1 | 11 | 462 | PKEDPLKKYTF | 18152 |
| HPV16 | L1 | 10 | 504 | PKFTLGKRKA | 18153 |
| HPV16 | L1 | 8 | 89 | PKVSGLQY | 18154 |
| HPV16 | L1 | 10 | 89 | PKVSGLQYRV | 18155 |
| HPV16 | L1 | 11 | 89 | PKVSGLQYRVF | 18156 |
| HPV16 | L1 | 10 | 340 | QRAQGHNNGI | 18157 |
| HPV16 | L1 | 8 | 122 | QRLVWACV | 18158 |
| HPV16 | L1 | 10 | 122 | QRLVWACVGV | 18159 |
| HPV16 | L1 | 8 | 391 | RHGEEYDL | 18160 |
| HPV16 | L1 | 10 | 391 | RHGEEYDLQF | 18161 |
| HPV16 | L1 | 11 | 391 | RHGEEYDLQFI | 18162 |
| HPV16 | L1 | 9 | 284 | RHLFNRAGA | 18163 |
| HPV16 | L1 | 10 | 284 | RHLFNRAGAV | 18164 |
| HPV16 | L1 | 9 | 492 | RKFLLQAGL | 18165 |
| HPV16 | L1 | 11 | 492 | RKFLLQAGLKA | 18166 |

TABLE XI-continued

| | | | | | |
|---|---|---|---|---|---|
| HPV16 | L1 | 10 | 277 | RREQMFVRHL | 18167 |
| HPV16 | L1 | 11 | 277 | RREQMFVRHLF | 18168 |
| HPV16 | L1 | 9 | 45 | SKVVSTDEY | 18169 |
| HPV16 | L1 | 10 | 45 | SKVVSTDEYV | 18170 |
| HPV16 | L1 | 11 | 45 | SKVVSTDEYVA | 18171 |
| HPV16 | L1 | 10 | 66 | SRLLAVGHPY | 18172 |
| HPV16 | L1 | 11 | 66 | SRLLAVGHPYF | 18173 |
| HPV16 | L1 | 8 | 363 | TRSTNMSL | 18174 |
| HPV16 | L1 | 10 | 363 | TRSTNMSLCA | 18175 |
| HPV16 | L1 | 11 | 363 | TRSTNMSLCAA | 18176 |
| HPV16 | L1 | 8 | 283 | VRHLFNRA | 18177 |
| HPV16 | L1 | 10 | 283 | VRHLFNRAGA | 18178 |
| HPV16 | L1 | 11 | 283 | VRHLFNRAGAV | 18179 |
| HPV16 | L1 | 8 | 61 | YHAGTSRL | 18180 |
| HPV16 | L1 | 9 | 61 | YHAGTSRLL | 18181 |
| HPV16 | L1 | 10 | 61 | YHAGTSRLLA | 18182 |
| HPV16 | L1 | 11 | 61 | YHAGTSRLLAV | 18183 |
| HPV16 | L1 | 9 | 21 | YHIFFQMSL | 18184 |
| HPV16 | L1 | 10 | 21 | YHIFFQMSLW | 18185 |
| HPV16 | L1 | 11 | 21 | YHIFFQMSLWL | 18186 |
| HPV16 | L1 | 9 | 381 | YKNTNFKEY | 18187 |
| HPV16 | L1 | 10 | 381 | YKNTNFKEYL | 18188 |
| HPV16 | L1 | 8 | 177 | YKQTQLCL | 18189 |
| HPV16 | L1 | 9 | 177 | YKQTQLCLI | 18190 |
| HPV16 | L1 | 8 | 444 | YRFVTSQA | 18191 |
| HPV16 | L1 | 9 | 444 | YRFVTSQAI | 18192 |
| HPV16 | L1 | 10 | 444 | YRFVTSQAIA | 18193 |
| HPV16 | L1 | 8 | 96 | YRVFRIHL | 18194 |
| HPV16 | L2 | 9 | 7 | AKRTKRASA | 18195 |
| HPV16 | L2 | 9 | 322 | AKVHYYYDF | 18196 |
| HPV16 | L2 | 11 | 22 | CKQAGTCPPDI | 18197 |
| HPV16 | L2 | 10 | 179 | GHFTLSSSTI | 18198 |
| HPV16 | L2 | 8 | 317 | GKSIGAKV | 18199 |
| HPV16 | L2 | 10 | 317 | GKSIGAKVHY | 18200 |
| HPV16 | L2 | 11 | 317 | GKSIGAKVHYY | 18201 |
| HPV16 | L2 | 8 | 38 | GKTIADQI | 18202 |
| HPV16 | L2 | 9 | 38 | GKTIADQIL | 18203 |
| HPV16 | L2 | 11 | 38 | GKTIADQILQY | 18204 |
| HPV16 | L2 | 8 | 68 | GRTGYIPL | 18205 |
| HPV16 | L2 | 11 | 3 | HKRSAKRTKRA | 18206 |
| HPV16 | L2 | 8 | 11 | KRASATQL | 18207 |
| HPV16 | L2 | 9 | 11 | KRASATQLY | 18208 |
| HPV16 | L2 | 10 | 460 | KRLPYFFSDV | 18209 |
| HPV16 | L2 | 8 | 457 | KRRKRLPY | 18210 |
| HPV16 | L2 | 9 | 457 | KRRKRLPYF | 18211 |
| HPV16 | L2 | 10 | 457 | KRRKRLPYFF | 18212 |
| HPV16 | L2 | 10 | 4 | KRSAKRTKRA | 18213 |
| HPV16 | L2 | 8 | 8 | KRTKRASA | 18214 |
| HPV16 | L2 | 11 | 8 | KRTKRASATQL | 18215 |
| HPV16 | L2 | 8 | 448 | LHPSYYML | 18216 |
| HPV16 | L2 | 8 | 455 | LRKRRKRL | 18217 |
| HPV16 | L2 | 10 | 455 | LRKRRKRLPY | 18218 |
| HPV16 | L2 | 11 | 455 | LRKRRKRLPYF | 18219 |
| HPV16 | L2 | 9 | 312 | LRTRSGKSI | 18220 |
| HPV16 | L2 | 11 | 312 | LRTRSGKSIGA | 18221 |
| HPV16 | L2 | 8 | 34 | PKVEGKTI | 18222 |
| HPV16 | L2 | 9 | 34 | PKVEGKTIA | 18223 |
| HPV16 | L2 | 8 | 459 | RKRLPYFF | 18224 |
| HPV16 | L2 | 11 | 459 | RKRLPYFFSDV | 18225 |
| HPV16 | L2 | 9 | 456 | RKRRKRLPY | 18226 |
| HPV16 | L2 | 10 | 456 | RKRRKRLPYF | 18227 |
| HPV16 | L2 | 11 | 456 | RKRRKRLPYFF | 18228 |
| HPV16 | L2 | 8 | 458 | RRKRLPYF | 18229 |
| HPV16 | L2 | 9 | 458 | RRKRLPYFF | 18230 |
| HPV16 | L2 | 10 | 297 | RRTGIRYSRI | 18231 |
| HPV16 | L2 | 9 | 353 | SHAALPTSI | 18232 |
| HPV16 | L2 | 9 | 304 | SRIGNKQTL | 18233 |
| HPV16 | L2 | 9 | 219 | SRPVARLGL | 18234 |
| HPV16 | L2 | 10 | 219 | SRPVARLGLY | 18235 |
| HPV16 | L2 | 8 | 296 | SRRTGIRY | 18236 |
| HPV16 | L2 | 11 | 296 | SRRTGIRYSRI | 18237 |
| HPV16 | L2 | 9 | 229 | SRTTQQVKV | 18238 |
| HPV16 | L2 | 10 | 229 | SRTTQQVKVV | 18239 |
| HPV16 | L2 | 9 | 190 | THNYEEIPM | 18240 |
| HPV16 | L2 | 10 | 247 | TKLITYDNPA | 18241 |
| HPV16 | L2 | 11 | 247 | TKLITYDNPAY | 18242 |
| HPV16 | L2 | 9 | 10 | TKRASATQL | 18243 |
| HPV16 | L2 | 10 | 10 | TKRASATQLY | 18244 |
| HPV16 | L2 | 10 | 77 | TRPPTATDTL | 18245 |

TABLE XI-continued

| | | | | | |
|---|---|---|---|---|---|
| HPV16 | L2 | 11 | 77 | TRPPTATDTLA | 18246 |
| HPV16 | L2 | 9 | 314 | TRSGKSIGA | 18247 |
| HPV16 | L2 | 11 | 314 | TRSGKSIGAKV | 18248 |
| HPV16 | L2 | 10 | 324 | VHYYYDFSTI | 18249 |
| HPV16 | L2 | 8 | 235 | VKVVDPAF | 18250 |
| HPV16 | L2 | 9 | 235 | VKVVDPAFI | 18251 |
| HPV16 | L2 | 10 | 89 | VRPPLTVDPV | 18252 |
| HPV18 | E1 | 10 | 269 | AHIQCLDCKW | 18253 |
| HPV18 | E1 | 8 | 578 | AKDNRWPY | 18254 |
| HPV18 | E1 | 9 | 578 | AKDNRWPYL | 18255 |
| HPV18 | E1 | 8 | 298 | AKGLSTLL | 18256 |
| HPV18 | E1 | 10 | 298 | AKGLSTLLHV | 18257 |
| HPV18 | E1 | 8 | 125 | AKRRLFTI | 18258 |
| HPV18 | E1 | 8 | 406 | AKYLKDCA | 18259 |
| HPV18 | E1 | 10 | 406 | AKYLKDCATM | 18260 |
| HPV18 | E1 | 8 | 276 | CKWGVLIL | 18261 |
| HPV18 | E1 | 9 | 276 | CKWGVLILA | 18262 |
| HPV18 | E1 | 10 | 276 | CKWGVLILAL | 18263 |
| HPV18 | E1 | 11 | 276 | CKWGVLILALL | 18264 |
| HPV18 | E1 | 8 | 25 | DKKTGDVI | 18265 |
| HPV18 | E1 | 8 | 602 | DKNGNPVY | 18266 |
| HPV18 | E1 | 10 | 602 | DKNGNPVYEI | 18267 |
| HPV18 | E1 | 8 | 613 | DKNWKCFF | 18268 |
| HPV18 | E1 | 8 | 236 | DKTTCTDW | 18269 |
| HPV18 | E1 | 9 | 236 | DKTTCTDWV | 18270 |
| HPV18 | E1 | 11 | 236 | DKTTCTDWVTA | 18271 |
| HPV18 | E1 | 8 | 555 | DRKHKPLI | 18272 |
| HPV18 | E1 | 10 | 555 | DRKHKPLIQL | 18273 |
| HPV18 | E1 | 9 | 101 | ERLEVDTEL | 18274 |
| HPV18 | E1 | 9 | 621 | ERTWSRLDL | 18275 |
| HPV18 | E1 | 10 | 70 | FHAQEVHNDA | 18276 |
| HPV18 | E1 | 9 | 218 | FKDTYGLSF | 18277 |
| HPV18 | E1 | 11 | 233 | FKSDKTTCTDW | 18278 |
| HPV18 | E1 | 8 | 258 | FKTLIQPF | 18279 |
| HPV18 | E1 | 9 | 258 | FKTLIQPFI | 18280 |
| HPV18 | E1 | 10 | 258 | FKTLIQPFIL | 18281 |
| HPV18 | E1 | 11 | 258 | FKTLIQPFILY | 18282 |
| HPV18 | E1 | 8 | 291 | GKSRLTVA | 18283 |
| HPV18 | E1 | 11 | 291 | GKSRLTVAKGL | 18284 |
| HPV18 | E1 | 9 | 489 | GKSYFGMSF | 18285 |
| HPV18 | E1 | 10 | 489 | GKSYFGMSFI | 18286 |
| HPV18 | E1 | 8 | 498 | IHFIQGAV | 18287 |
| HPV18 | E1 | 9 | 498 | IHFIQGAVI | 18288 |
| HPV18 | E1 | 11 | 498 | IHFIQGAVISF | 18289 |
| HPV18 | E1 | 9 | 575 | IHPAKDNRW | 18290 |
| HPV18 | E1 | 11 | 575 | IHPAKDNRWPY | 18291 |
| HPV18 | E1 | 8 | 433 | IRFRCSKI | 18292 |
| HPV18 | E1 | 8 | 557 | KHKPLIQL | 18293 |
| HPV18 | E1 | 11 | 417 | KHYRRAQKRQM | 18294 |
| HPV18 | E1 | 8 | 123 | KKAKRRLF | 18295 |
| HPV18 | E1 | 10 | 123 | KKAKRRLFTI | 18296 |
| HPV18 | E1 | 11 | 476 | KKNCLVFCGPA | 18297 |
| HPV18 | E1 | 9 | 424 | KRQMNMSQW | 18298 |
| HPV18 | E1 | 10 | 424 | KRQMNMSQWI | 18299 |
| HPV18 | E1 | 8 | 629 | LHEEEEDA | 18300 |
| HPV18 | E1 | 8 | 82 | LHVLKRKF | 18301 |
| HPV18 | E1 | 9 | 82 | LHVLKRKFA | 18302 |
| HPV18 | E1 | 8 | 305 | LHVPETCM | 18303 |
| HPV18 | E1 | 9 | 305 | LHVPETCML | 18304 |
| HPV18 | E1 | 10 | 305 | LHVPETCMLI | 18305 |
| HPV18 | E1 | 8 | 564 | LKCPPILL | 18306 |
| HPV18 | E1 | 11 | 409 | LKDCATMCKHY | 18307 |
| HPV18 | E1 | 10 | 471 | LKGTPKKNCL | 18308 |
| HPV18 | E1 | 11 | 471 | LKGTPKKNCLV | 18309 |
| HPV18 | E1 | 9 | 400 | LKSNCQAKY | 18310 |
| HPV18 | E1 | 10 | 400 | LKSNCQAKYL | 18311 |
| HPV18 | E1 | 9 | 205 | LKVNNKQGA | 18312 |
| HPV18 | E1 | 10 | 205 | LKVNNKQGAM | 18313 |
| HPV18 | E1 | 11 | 205 | LKVNNKQGAML | 18314 |
| HPV18 | E1 | 10 | 648 | LRAGQNHRPL | 18315 |
| HPV18 | E1 | 8 | 319 | LRSSVAAL | 18316 |
| HPV18 | E1 | 9 | 319 | LRSSVAALY | 18317 |
| HPV18 | E1 | 10 | 319 | LRSSVAALYW | 18318 |
| HPV18 | E1 | 11 | 319 | LRSSVAALYWY | 18319 |
| HPV18 | E1 | 10 | 286 | LRYKCGKSRL | 18320 |
| HPV18 | E1 | 8 | 453 | LRYQQIEF | 18321 |
| HPV18 | E1 | 9 | 453 | LRYQQIEFI | 18322 |
| HPV18 | E1 | 11 | 453 | LRYQQIEFITF | 18323 |
| HPV18 | E1 | 10 | 543 | MRNALDGNPI | 18324 |

TABLE XI-continued

| | | | | | |
|---|---|---|---|---|---|
| HPV18 | E1 | 8 | 209 | NKQGAMLA | 18325 |
| HPV18 | E1 | 9 | 209 | NKQGAMLAV | 18326 |
| HPV18 | E1 | 10 | 209 | NKQGAMLAVF | 18327 |
| HPV18 | E1 | 10 | 581 | NRWPYLESRI | 18328 |
| HPV18 | E1 | 8 | 475 | PKKNCLVF | 18329 |
| HPV18 | E1 | 8 | 317 | PKLRSSVA | 18330 |
| HPV18 | E1 | 9 | 317 | PKLRSSVAA | 18331 |
| HPV18 | E1 | 10 | 317 | PKLRSSVAAL | 18332 |
| HPV18 | E1 | 11 | 317 | PKLRSSVAALY | 18333 |
| HPV18 | E1 | 8 | 111 | PRLQEISL | 18334 |
| HPV18 | E1 | 9 | 354 | QHGIDDSNF | 18335 |
| HPV18 | E1 | 11 | 354 | QHGIDDSNFDL | 18336 |
| HPV18 | E1 | 8 | 122 | QKKAKRRL | 18337 |
| HPV18 | E1 | 9 | 122 | QKKAKRRLF | 18338 |
| HPV18 | E1 | 11 | 122 | QKKAKRRLFTI | 18339 |
| HPV18 | E1 | 10 | 423 | QKRQMNMSQW | 18340 |
| HPV18 | E1 | 11 | 423 | QKRQMNMSQWI | 18341 |
| HPV18 | E1 | 10 | 348 | QRLTIIQHGI | 18342 |
| HPV18 | E1 | 9 | 556 | RKHKPLIQL | 18343 |
| HPV18 | E1 | 8 | 420 | RRAQKRQM | 18344 |
| HPV18 | E1 | 10 | 420 | RRAQKRQMNM | 18345 |
| HPV18 | E1 | 11 | 127 | RRLFTISDSGY | 18346 |
| HPV18 | E1 | 8 | 513 | SHFWLEPL | 18347 |
| HPV18 | E1 | 9 | 438 | SKIDEGGDW | 18348 |
| HPV18 | E1 | 8 | 588 | SRITVFEF | 18349 |
| HPV18 | E1 | 11 | 588 | SRITVFEFPNA | 18350 |
| HPV18 | E1 | 9 | 293 | SRLTVAKGL | 18351 |
| HPV18 | E1 | 9 | 523 | TKVAMLDDA | 18352 |
| HPV18 | E1 | 8 | 75 | VHNDAQVL | 18353 |
| HPV18 | E1 | 10 | 75 | VHNDAQVLHV | 18354 |
| HPV18 | E1 | 11 | 75 | VHNDAQVLHVL | 18355 |
| HPV18 | E1 | 9 | 616 | WKCFFERTW | 18356 |
| HPV18 | E1 | 8 | 446 | WRPIVQFL | 18357 |
| HPV18 | E1 | 10 | 446 | WRPIVQFLRY | 18358 |
| HPV18 | E1 | 8 | 288 | YKCGKSRL | 18359 |
| HPV18 | E1 | 10 | 288 | YKCGKSRLTV | 18360 |
| HPV18 | E1 | 11 | 288 | YKCGKSRLTVA | 18361 |
| HPV18 | E1 | 9 | 419 | YRRAQKRQM | 18362 |
| HPV18 | E1 | 11 | 419 | YRRAQKRQMNM | 18363 |
| HPV18 | E1 | 8 | 329 | YRTGISNI | 18364 |
| HPV18 | E1 | 11 | 329 | YRTGISNISEV | 18365 |
| HPV18 | E2 | 9 | 73 | AHKAIELQM | 18366 |
| HPV18 | E2 | 10 | 73 | AHKAIELQMA | 18367 |
| HPV18 | E2 | 11 | 73 | AHKAIELQMAL | 18368 |
| HPV18 | E2 | 9 | 237 | AKTYGQTSA | 18369 |
| HPV18 | E2 | 10 | 237 | AKTYGQTSAA | 18370 |
| HPV18 | E2 | 9 | 50 | AREHGIQTL | 18371 |
| HPV18 | E2 | 10 | 21 | DHYENDSKDI | 18372 |
| HPV18 | E2 | 10 | 311 | DHYRDISSTW | 18373 |
| HPV18 | E2 | 8 | 295 | DRNSLKCL | 18374 |
| HPV18 | E2 | 10 | 295 | DRNSLKCLRY | 18375 |
| HPV18 | E2 | 11 | 52 | EHGIQTLNHQV | 18376 |
| HPV18 | E2 | 8 | 256 | EKQHCGPV | 18377 |
| HPV18 | E2 | 11 | 256 | EKQHCGPVNPL | 18378 |
| HPV18 | E2 | 8 | 328 | EKTGILTV | 18379 |
| HPV18 | E2 | 10 | 328 | EKTGILTVTY | 18380 |
| HPV18 | E2 | 9 | 181 | EKYGNTGTW | 18381 |
| HPV18 | E2 | 11 | 181 | EKYGNTGTWEV | 18382 |
| HPV18 | E2 | 10 | 10 | ERLSCVQDKI | 18383 |
| HPV18 | E2 | 11 | 10 | ERLSCVQDKII | 18384 |
| HPV18 | E2 | 8 | 114 | FKKGGQTV | 18385 |
| HPV18 | E2 | 10 | 114 | FKKGGQTVQV | 18386 |
| HPV18 | E2 | 11 | 114 | FKKGGQTVQVY | 18387 |
| HPV18 | E2 | 8 | 176 | FKSECEKY | 18388 |
| HPV18 | E2 | 8 | 74 | HKAIELQM | 18389 |
| HPV18 | E2 | 9 | 74 | HKAIELQMA | 18390 |
| HPV18 | E2 | 10 | 74 | HKAIELQMAL | 18391 |
| HPV18 | E2 | 11 | 159 | HRGLYYVKEGY | 18392 |
| HPV18 | E2 | 10 | 290 | IHLKGDRNSL | 18393 |
| HPV18 | E2 | 8 | 40 | IRWENAIF | 18394 |
| HPV18 | E2 | 9 | 40 | IRWENAIFF | 18395 |
| HPV18 | E2 | 10 | 40 | IRWENAIFFA | 18396 |
| HPV18 | E2 | 11 | 40 | IRWENAIFFAA | 18397 |
| HPV18 | E2 | 9 | 308 | KHSDHYRDI | 18398 |
| HPV18 | E2 | 9 | 115 | KKGGQTVQV | 18399 |
| HPV18 | E2 | 10 | 115 | KKGGQTVQVY | 18400 |
| HPV18 | E2 | 11 | 115 | KKGGQTVQVYF | 18401 |
| HPV18 | E2 | 8 | 299 | LKCLRYRL | 18402 |
| HPV18 | E2 | 8 | 292 | LKGDRNSL | 18403 |

TABLE XI-continued

| | | | | | |
|---|---|---|---|---|---|
| HPV18 | E2 | 11 | 292 | LKGDRNSLKCL | 18404 |
| HPV18 | E2 | 8 | 306 | LRKHSDHY | 18405 |
| HPV18 | E2 | 11 | 306 | LRKHSDHYRDI | 18406 |
| HPV18 | E2 | 8 | 59 | NHQVVPAY | 18407 |
| HPV18 | E2 | 10 | 59 | NHQVVPAYNI | 18408 |
| HPV18 | E2 | 8 | 128 | NKDNCMTY | 18409 |
| HPV18 | E2 | 9 | 128 | NKDNCMTYV | 18410 |
| HPV18 | E2 | 10 | 128 | NKDNCMTYVA | 18411 |
| HPV18 | E2 | 11 | 128 | NKDNCMTYVAW | 18412 |
| HPV18 | E2 | 9 | 4 | PKETLSERL | 18413 |
| HPV18 | E2 | 9 | 258 | QHCGPVNPL | 18414 |
| HPV18 | E2 | 10 | 258 | QHCGPVNPLL | 18415 |
| HPV18 | E2 | Ii | 222 | QHTPSPYSSTV | 18416 |
| HPV18 | E2 | 9 | 342 | QRTKFLNTV | 18417 |
| HPV18 | E2 | 10 | 342 | QRTKFLNTVA | 18418 |
| HPV18 | E2 | 11 | 342 | QRTKFLNTVAI | 18419 |
| HPV18 | E2 | 10 | 307 | RKHSDHYRDI | 18420 |
| HPV18 | E2 | 11 | 279 | RKLCSGNTTPI | 18421 |
| HPV18 | E2 | 8 | 158 | SHRGLYYV | 18422 |
| HPV18 | E2 | 9 | 71 | SKAHKAIEL | 18423 |
| HPV18 | E2 | 11 | 71 | SKAHKAIELQM | 18424 |
| HPV18 | E2 | 8 | 27 | SKDIDSQI | 18425 |
| HPV18 | E2 | 10 | 27 | SKDIDSQIQY | 18426 |
| HPV18 | E2 | 11 | 27 | SKDIDSQIQYW | 18427 |
| HPV18 | E2 | 8 | 69 | SKSKAHKA | 18428 |
| HPV18 | E2 | 9 | 69 | SKSKAHKAI | 18429 |
| HPV18 | E2 | 11 | 69 | SKSKAHKAIEL | 18430 |
| HPV18 | E2 | 8 | 89 | SRYKTEDW | 18431 |
| HPV18 | E2 | 10 | 89 | SRYKTEDWTL | 18432 |
| HPV18 | E2 | 11 | 111 | THCFKKGGQTV | 18433 |
| HPV18 | E2 | 8 | 344 | TKFLNTVA | 18434 |
| HPV18 | E2 | 9 | 344 | TKFLNTVAI | 18435 |
| HPV18 | E2 | 8 | 247 | TRPGHCGL | 18436 |
| HPV18 | E2 | 9 | 247 | TRPGHCGLA | 18437 |
| HPV18 | E2 | 8 | 191 | VHFGNNVI | 18438 |
| HPV18 | E2 | 8 | 165 | VKEGYNTF | 18439 |
| HPV18 | E2 | 9 | 165 | VKEGYNTFY | 18440 |
| HPV18 | E2 | 10 | 165 | VKEGYNTFYI | 18441 |
| HPV18 | E2 | 11 | 218 | VKQLQHTPSPY | 18442 |
| HPV18 | E2 | 10 | 337 | YHSETQRTKF | 18443 |
| HPV18 | E2 | 11 | 337 | YHSETQRTKFL | 18444 |
| HPV18 | E2 | 8 | 91 | YKTEDWTL | 18445 |
| HPV18 | E2 | 8 | 313 | YRDISSTW | 18446 |
| HPV18 | E2 | 10 | 313 | YRDISSTWHW | 18447 |
| HPV18 | E2 | 10 | 304 | YRLRKHSDHY | 18448 |
| HPV18 | E5 | 9 | 18 | CHVPLLPSV | 18449 |
| HPV18 | E5 | 11 | 18 | CHVPLLPSVCM | 18450 |
| HPV18 | E5 | 9 | 64 | LHIHAILSL | 18451 |
| HPV18 | E6 | 11 | 2 | ARFEDPTRRPY | 18452 |
| HPV18 | E6 | 8 | 65 | CHKCIDFY | 18453 |
| HPV18 | E6 | 11 | 65 | CHKCIDFYSRI | 18454 |
| HPV18 | E6 | 8 | 138 | CHSCCNRA | 18455 |
| HPV18 | E6 | 10 | 35 | CKTVLELTEV | 18456 |
| HPV18 | E6 | 11 | 35 | CKTVLELTEVF | 18457 |
| HPV18 | E6 | 8 | 91 | EKLTNTGL | 18458 |
| HPV18 | E6 | 9 | 91 | EKLTNTGLY | 18459 |
| HPV18 | E6 | 11 | 91 | EKLTNTGLYNL | 18460 |
| HPV18 | E6 | 8 | 123 | EKRRFHNI | 18461 |
| HPV18 | E6 | 9 | 123 | EKRRFHNIA | 18462 |
| HPV18 | E6 | 11 | 148 | ERLQRRRETQV | 18463 |
| HPV18 | E6 | 8 | 127 | FHNIAGHY | 18464 |
| HPV18 | E6 | 8 | 49 | FKDLFVVY | 18465 |
| HPV18 | E6 | 10 | 66 | HKCIDFYSRI | 18466 |
| HPV18 | E6 | 10 | 103 | IRCLRCQKPL | 18467 |
| HPV18 | E6 | 11 | 75 | IRELRHYSDSV | 18468 |
| HPV18 | E6 | 8 | 124 | KRRFHNIA | 18469 |
| HPV18 | E6 | 11 | 124 | KRRFHNIAGHY | 18470 |
| HPV18 | E6 | 10 | 106 | LRCQKPLNPA | 18471 |
| HPV18 | E6 | 10 | 118 | LRHLNEKRRF | 18472 |
| HPV18 | E6 | 8 | 78 | LRHYSDSV | 18473 |
| HPV18 | E6 | 9 | 78 | LRHYSDSVY | 18474 |
| HPV18 | E6 | 8 | 143 | NRARQERL | 18475 |
| HPV18 | E6 | 9 | 61 | PHAACHKCI | 18476 |
| HPV18 | E6 | 11 | 61 | PHAACHKCIDF | 18477 |
| HPV18 | E6 | 10 | 109 | QKPLNPAEKL | 18478 |
| HPV18 | E6 | 8 | 151 | QRRRETQV | 18479 |
| HPV18 | E6 | 9 | 119 | RHLNEKRRF | 18480 |
| HPV18 | E6 | 8 | 79 | RHYSDSVY | 18481 |
| HPV18 | E6 | 10 | 125 | RRFHNIAGHY | 18482 |

TABLE XI-continued

| | | | | | |
|---|---|---|---|---|---|
| HPV18 | E6 | 9 | 9 | RRPYKLPDL | 18483 |
| HPV18 | E6 | 9 | 73 | SRIRELRHY | 18484 |
| HPV18 | E6 | 10 | 8 | TRRPYKLPDL | 18485 |
| HPV18 | E6 | 10 | 12 | YKLPDLCTEL | 18486 |
| HPV18 | E6 | 8 | 56 | YRDSIPHA | 18487 |
| HPV18 | E6 | 9 | 56 | YRDSIPHAA | 18488 |
| HPV18 | E7 | 11 | 70 | ARIKLVVESSA | 18489 |
| HPV18 | E7 | 11 | 51 | ARRAEPQRHTM | 18490 |
| HPV18 | E7 | 9 | 66 | CKCEARIKL | 18491 |
| HPV18 | E7 | 10 | 66 | CKCEARIKLV | 18492 |
| HPV18 | E7 | 11 | 66 | CKCEARIKLVV | 18493 |
| HPV18 | E7 | 9 | 72 | IKLVVESSA | 18494 |
| HPV18 | E7 | 9 | 13 | LHLEPQNEI | 18495 |
| HPV18 | E7 | 11 | 13 | LHLEPQNEIPV | 18496 |
| HPV18 | E7 | 8 | 83 | LRAFQQLF | 18497 |
| HPV18 | E7 | 9 | 83 | LRAFQQLFL | 18498 |
| HPV18 | E7 | 8 | 1 | MHGPKATL | 18499 |
| HPV18 | E7 | 11 | 1 | MHGPKATLQDI | 18500 |
| HPV18 | E7 | 10 | 45 | NHQHLPARRA | 18501 |
| HPV18 | E7 | 8 | 4 | PKATLQDI | 18502 |
| HPV18 | E7 | 9 | 4 | PKATLQDIV | 18503 |
| HPV18 | E7 | 10 | 4 | PKATLQDIVL | 18504 |
| HPV18 | E7 | 8 | 47 | QHLPARRA | 18505 |
| HPV18 | E7 | 8 | 57 | QRHTMLCM | 18506 |
| HPV18 | E7 | 10 | 52 | RRAEPQRHTM | 18507 |
| HPV18 | E7 | 11 | 52 | RRAEPQRHTML | 18508 |
| HPV18 | L1 | 11 | 231 | AKGTACKSRPL | 18509 |
| HPV18 | L1 | 8 | 559 | AKRVRVRA | 18510 |
| HPV18 | L1 | 8 | 318 | ARHFWNRA | 18511 |
| HPV18 | L1 | 11 | 318 | ARHFWNRAGTM | 18512 |
| HPV18 | L1 | 9 | 80 | ARVVNTDDY | 18513 |
| HPV18 | L1 | 10 | 80 | ARVVNTDDYV | 18514 |
| HPV18 | L1 | 9 | 290 | CKYPDYLQM | 18515 |
| HPV18 | L1 | 11 | 290 | CKYPDYLQMSA | 18516 |
| HPV18 | L1 | 8 | 504 | DKLKFWNV | 18517 |
| HPV18 | L1 | 10 | 504 | DKLKFWNVDL | 18518 |
| HPV18 | L1 | 8 | 228 | EHWAKGTA | 18519 |
| HPV18 | L1 | 10 | 515 | EKFSLDLDQY | 18520 |
| HPV18 | L1 | 8 | 422 | FKQYSRHV | 18521 |
| HPV18 | L1 | 11 | 422 | FKQYSRHVEEY | 18522 |
| HPV18 | L1 | 11 | 134 | FRVQLPDPNKF | 18523 |
| HPV18 | L1 | 8 | 379 | GHNNGVCW | 18524 |
| HPV18 | L1 | 8 | 180 | GHPFYKKL | 18525 |
| HPV18 | L1 | 8 | 43 | GHYIILFL | 18526 |
| HPV18 | L1 | 11 | 43 | GHYIILFLRNV | 18527 |
| HPV18 | L1 | 8 | 169 | GRGQPLGV | 18528 |
| HPV18 | L1 | 10 | 169 | GRGQPLGVGL | 18529 |
| HPV18 | L1 | 8 | 527 | GRKFLVQA | 18530 |
| HPV18 | L1 | 10 | 527 | GRKFLVQAGL | 18531 |
| HPV18 | L1 | 10 | 375 | HKAQGHNNGV | 18532 |
| HPV18 | L1 | 8 | 453 | IHSMNSSI | 18533 |
| HPV18 | L1 | 9 | 453 | IHSMNSSIL | 18534 |
| HPV18 | L1 | 8 | 338 | IKGTGMPA | 18535 |
| HPV18 | L1 | 11 | 374 | LHKAQGHNNGV | 18536 |
| HPV18 | L1 | 8 | 29 | LHSILVYM | 18537 |
| HPV18 | L1 | 9 | 29 | LHSILVYMV | 18538 |
| HPV18 | L1 | tI | 29 | LHSILVYMVHI | 18539 |
| HPV18 | L1 | 8 | 10 | LHYHLLPL | 18540 |
| HPV18 | L1 | 9 | 10 | LHYHLLPLY | 18541 |
| HPV18 | L1 | 9 | 513 | LKEKFSLDL | 18542 |
| HPV18 | L1 | 8 | 506 | LKFWNVDL | 18543 |
| HPV18 | L1 | 11 | 251 | LKNTVLEDGDM | 18544 |
| HPV18 | L1 | 9 | 50 | LRNVNVFPI | 18545 |
| HPV18 | L1 | 10 | 50 | LRNVNVFPIF | 18546 |
| HPV18 | L1 | 11 | 50 | LRNVNVFPIFL | 18547 |
| HPV18 | L1 | 8 | 311 | LRREQLFA | 18548 |
| HPV18 | L1 | 11 | 311 | LRREQLFARHF | 18549 |
| HPV18 | L1 | 8 | 499 | NKDPYDKL | 18550 |
| HPV18 | L1 | 10 | 499 | NKDPYDKLKF | 18551 |
| HPV18 | L1 | 11 | 499 | NKDPYDKLKFW | 18552 |
| HPV18 | L1 | 10 | 142 | NKFGLPDTSI | 18553 |
| HPV18 | L1 | 11 | 142 | NKFGLPDTSIY | 18554 |
| HPV18 | L1 | 11 | 185 | NKLDDTESSHA | 18555 |
| HPV18 | L1 | 9 | 369 | NKPYWLHKA | 18556 |
| HPV18 | L1 | 8 | 119 | NKQDIPKV | 18557 |
| HPV18 | L1 | 10 | 119 | NKQDIPKVSA | 18558 |
| HPV18 | L1 | 11 | 119 | NKQDIPKVSAY | 18559 |
| HPV18 | L1 | 10 | 323 | NRAGTMGDTV | 18560 |
| HPV18 | L1 | 8 | 124 | PKVSAYQY | 18561 |

TABLE XI-continued

| | | | | | |
|---|---|---|---|---|---|
| HPV18 | L1 | 10 | 124 | PKVSAYQYRV | 18562 |
| HPV18 | L1 | 11 | 124 | PKVSAYQYRVF | 18563 |
| HPV18 | L1 | 9 | 544 | PRKRSAPSA | 18564 |
| HPV18 | L1 | 9 | 24 | PRPLPLHSI | 18565 |
| HPV18 | L1 | 10 | 24 | PRPLPLHSIL | 18566 |
| HPV18 | L1 | 11 | 24 | PRPLPLHSILV | 18567 |
| HPV18 | L1 | 8 | 157 | QRLVWACA | 18568 |
| HPV18 | L1 | 10 | 157 | QRLVWACAGV | 18569 |
| HPV18 | L1 | 10 | 319 | RHFWNRAGTM | 18570 |
| HPV18 | L1 | 8 | 427 | RHVEEYDL | 18571 |
| HPV18 | L1 | 10 | 427 | RHVEEYDLQF | 18572 |
| HPV18 | L1 | 11 | 427 | RHVEEYDLQFI | 18573 |
| HPV18 | L1 | 9 | 528 | RKFLVQAGL | 18574 |
| HPV18 | L1 | 8 | 545 | RKRSAPSA | 18575 |
| HPV18 | L1 | 10 | 312 | RREQLFARHF | 18576 |
| HPV18 | L1 | 11 | 312 | RREQLFARHFW | 18577 |
| HPV18 | L1 | 8 | 193 | SHAATSNV | 18578 |
| HPV18 | L1 | 9 | 556 | SKPAKRVRV | 18579 |
| HPV18 | L1 | 11 | 556 | SKPAKRVRVRA | 18580 |
| HPV18 | L1 | 9 | 426 | SRHVEEYDL | 18581 |
| HPV18 | L1 | 11 | 426 | SRHVEEYDLQF | 18582 |
| HPV18 | L1 | 10 | 101 | SRLLTVGNPY | 18583 |
| HPV18 | L1 | 11 | 101 | SRLLTVGNPYF | 18584 |
| HPV18 | L1 | 9 | 277 | TKCEVPLDI | 18585 |
| HPV18 | L1 | 10 | 420 | TKFKQYSRHV | 18586 |
| HPV18 | L1 | 8 | 5 | TRVLILHY | 18587 |
| HPV18 | L1 | 10 | 5 | TRVLILHYHL | 18588 |
| HPV18 | L1 | 11 | 5 | TRVLILHYHLL | 18589 |
| HPV18 | L1 | 9 | 37 | VHIIICGHY | 18590 |
| HPV18 | L1 | 10 | 37 | VHIIICGHYI | 18591 |
| HPV18 | L1 | 11 | 37 | VHIIICGHYII | 18592 |
| HPV18 | L1 | 9 | 204 | VRDNVSVDY | 18593 |
| HPV18 | L1 | 9 | 386 | WHNQLFVTV | 18594 |
| HPV18 | L1 | 10 | 386 | WHNQLFVTVV | 18595 |
| HPV18 | L1 | 8 | 65 | WRPSDNTV | 18596 |
| HPV18 | L1 | 9 | 65 | WRPSDNTVY | 18597 |
| HPV18 | L1 | 10 | 65 | WRPSDNTVYL | 18598 |
| HPV18 | L1 | 8 | 96 | YHAGSSRL | 18599 |
| HPV18 | L1 | 9 | 96 | YHAGSSRLL | 18600 |
| HPV18 | L1 | 11 | 96 | YHAGSSRLLTV | 18601 |
| HPV18 | L1 | 10 | 12 | YHLLPLYGPL | 18602 |
| HPV18 | L1 | 11 | 12 | YHLLPLYGPLY | 18603 |
| HPV18 | L1 | 8 | 22 | YHPRPLPL | 18604 |
| HPV18 | L1 | 11 | 22 | YHPRPLPLHSI | 18605 |
| HPV18 | L1 | 8 | 212 | YKQTQLCI | 18606 |
| HPV18 | L1 | 9 | 212 | YKQTQLCIL | 18607 |
| HPV18 | L1 | 8 | 480 | YRFVQSVA | 18608 |
| HPV18 | L1 | 9 | 480 | YRFVQSVAI | 18609 |
| HPV18 | L1 | 8 | 131 | YRVFRVQL | 18610 |
| HPV18 | L2 | 8 | 7 | ARRKRASV | 18611 |
| HPV18 | L2 | 11 | 7 | ARRKRASVTDL | 18612 |
| HPV18 | L2 | 9 | 315 | ARVHFYHDI | 18613 |
| HPV18 | L2 | 11 | 21 | CKQSGTCPPDV | 18614 |
| HPV18 | L2 | 9 | 42 | DKILQWSSL | 18615 |
| HPV18 | L2 | 11 | 42 | DKILQWSSLGI | 18616 |
| HPV18 | L2 | 10 | 372 | FKYSPTISSA | 18617 |
| HPV18 | L2 | 9 | 76 | GRSNTVVDV | 18618 |
| HPV18 | L2 | 8 | 67 | GRTGYIPL | 18619 |
| HPV18 | L2 | 9 | 4 | HRAARRKRA | 18620 |
| HPV18 | L2 | 11 | 4 | HRAARRKRASV | 18621 |
| HPV18 | L2 | 8 | 430 | IHGTHYYL | 18622 |
| HPV18 | L2 | 9 | 430 | IHGTHYYLW | 18623 |
| HPV18 | L2 | 11 | 430 | IHGTHYYLWPL | 18624 |
| HPV18 | L2 | 8 | 280 | IRLHRPAL | 18625 |
| HPV18 | L2 | 8 | 446 | KKRKRVPY | 18626 |
| HPV18 | L2 | 9 | 446 | KKRKRVPYF | 18627 |
| HPV18 | L2 | 10 | 446 | KKRKRVPYFF | 18628 |
| HPV18 | L2 | 11 | 446 | KKRKRVPYFFA | 18629 |
| HPV18 | L2 | 8 | 10 | KRASVTDL | 18630 |
| HPV18 | L2 | 9 | 10 | KRASVTDLY | 18631 |
| HPV18 | L2 | 8 | 447 | KRKRVPYF | 18632 |
| HPV18 | L2 | 9 | 447 | KRKRVPYFF | 18633 |
| HPV18 | L2 | 10 | 447 | KRKRVPYFFA | 18634 |
| HPV18 | L2 | 8 | 449 | KRVPYFFA | 18635 |
| HPV18 | L2 | 11 | 449 | KRVPYFFADGF | 18636 |
| HPV18 | L2 | 9 | 445 | PKKRKRVPY | 18637 |
| HPV18 | L2 | 10 | 445 | PKKRKRVPYF | 18638 |
| HPV18 | L2 | 11 | 445 | PKKRKRVPYFF | 18639 |
| HPV18 | L2 | 8 | 33 | PKVEGTTL | 18640 |

TABLE XI-continued

| | | | | | |
|---|---|---|---|---|---|
| HPV18 | L2 | 9 | 33 | PKVEGTTLA | 18641 |
| HPV18 | L2 | 8 | 224 | PRLYSRAY | 18642 |
| HPV18 | L2 | 11 | 224 | PRLYSRAYQQV | 18643 |
| HPV18 | L2 | 11 | 118 | PRPTFTGTSGF | 18644 |
| HPV18 | L2 | 10 | 267 | PRSDVPDSDF | 18645 |
| HPV18 | L2 | 11 | 267 | PRSDVPDSDFM | 18646 |
| HPV18 | L2 | 9 | 9 | RKRASVTDL | 18647 |
| HPV18 | L2 | 10 | 9 | RKRASVTDLY | 18648 |
| HPV18 | L2 | 8 | 448 | RKRVPYFF | 18649 |
| HPV18 | L2 | 9 | 448 | RKRVPYFFA | 18650 |
| HPV18 | L2 | 10 | 290 | RRGTVRFSRL | 18651 |
| HPV18 | L2 | 10 | 8 | RRKRASVTDL | 18652 |
| HPV18 | L2 | 11 | 8 | RRKRASVTDLY | 18653 |
| HPV18 | L2 | 8 | 219 | RRVAGPRL | 18654 |
| HPV18 | L2 | 9 | 219 | RRVAGPRLY | 18655 |
| HPV18 | L2 | 10 | 3 | SHRAARRKRA | 18656 |
| HPV18 | L2 | 9 | 228 | SRAYQQVSV | 18657 |
| HPV18 | L2 | 10 | 228 | SRAYQQVSVA | 18658 |
| HPV18 | L2 | 9 | 297 | SRLGQRATM | 18659 |
| HPV18 | L2 | 10 | 297 | SRLGQRATMF | 18660 |
| HPV18 | L2 | 8 | 289 | SRRGTVRF | 18661 |
| HPV18 | L2 | 11 | 289 | SRRGTVRFSRL | 18662 |
| HPV18 | L2 | 8 | 363 | SRSTTSFA | 18663 |
| HPV18 | L2 | 9 | 363 | SRSTTSFAF | 18664 |
| HPV18 | L2 | 10 | 363 | SRSTTSFAFF | 18665 |
| HPV18 | L2 | 9 | 189 | THGYEEIPL | 18666 |
| HPV18 | L2 | 8 | 433 | THYYLWPL | 18667 |
| HPV18 | L2 | 9 | 433 | THYYLWPLY | 18668 |
| HPV18 | L2 | 10 | 433 | THYYLWPLYY | 18669 |
| HPV18 | L2 | 11 | 433 | THYYLWPLYYF | 18670 |
| HPV18 | L2 | 10 | 87 | TRPPVVIEPV | 18671 |
| HPV18 | L2 | 9 | 243 | TRPSSLITY | 18672 |
| HPV18 | L2 | 9 | 307 | TRSGTQIGA | 18673 |
| HPV18 | L2 | 11 | 307 | TRSGTQIGARV | 18674 |
| HPV18 | L2 | 10 | 317 | VHFYHDISPI | 18675 |
| HPV18 | L2 | 11 | 317 | VHFYHDISPIA | 18676 |
| HPV18 | L2 | 10 | 294 | VRFSRLGQRA | 18677 |
| HPV18 | L2 | 9 | 218 | VRRVAGPRL | 18678 |
| HPV18 | L2 | 10 | 218 | VRRVAGPRLY | 18679 |
| HPV18 | L2 | 8 | 320 | YHDISPIA | 18680 |
| HPV31 | E1 | 9 | 496 | AKIGMLDDA | 18681 |
| HPV31 | E1 | 10 | 379 | AKIVKDCGTM | 18682 |
| HPV31 | E1 | 10 | 264 | AKNRITIEKL | 18683 |
| HPV31 | E1 | 11 | 264 | AKNRITIEKLL | 18684 |
| HPV31 | E1 | 8 | 121 | AKRRLFEL | 18685 |
| HPV31 | E1 | 10 | 242 | CHLQSLACSW | 18686 |
| HPV31 | E1 | 9 | 607 | DKENDGDSF | 18687 |
| HPV31 | E1 | 8 | 575 | DKNGNPVY | 18688 |
| HPV31 | E1 | 10 | 575 | DKNGNPVYEL | 18689 |
| HPV31 | E1 | 8 | 586 | DKNWKSFF | 18690 |
| HPV31 | E1 | 9 | 411 | DKVSDEGDW | 18691 |
| HPV31 | E1 | 8 | 25 | DRQTGDNI | 18692 |
| HPV31 | E1 | 10 | 554 | DRWFYLHSRL | 18693 |
| HPV31 | E1 | 11 | 554 | DRWPYLHSRLV | 18694 |
| HPV31 | E1 | 8 | 77 | EHAEAVQV | 18695 |
| HPV31 | E1 | 9 | 77 | EHAEAVQVL | 18696 |
| HPV31 | E1 | 11 | 275 | EKLLCISTNCM | 18697 |
| HPV31 | E1 | 8 | 271 | EKLLEKLL | 18698 |
| HPV31 | E1 | 10 | 271 | EKLLEKLLCI | 18699 |
| HPV31 | E1 | 10 | 396 | EKRQMSMGQW | 18700 |
| HPV31 | E1 | 11 | 396 | EKRQMSMGQWI | 18701 |
| HPV31 | E1 | 11 | 164 | ERENETPTRNI | 18702 |
| HPV31 | E1 | 10 | 321 | ERQTVLQHSF | 18703 |
| HPV31 | E1 | 10 | 70 | FHAQEAEEHA | 18704 |
| HPV31 | E1 | 8 | 261 | FKCAKNRI | 18705 |
| HPV31 | E1 | 10 | 261 | FKCAKNRITI | 18706 |
| HPV31 | E1 | 9 | 618 | FKCVSGQNI | 18707 |
| HPV31 | E1 | 9 | 191 | FKELYGVSF | 18708 |
| HPV31 | E1 | 10 | 191 | FKELYGVSFM | 18709 |
| HPV31 | E1 | 8 | 231 | FKTLLQPY | 18710 |
| HPV31 | E1 | 10 | 231 | FKTLLQPYCL | 18711 |
| HPV31 | E1 | 11 | 231 | FKTLLQPYCLY | 18712 |
| HPV31 | E1 | 9 | 183 | GKAAMLGKF | 18713 |
| HPV31 | E1 | 8 | 551 | GKDDRWPY | 18714 |
| HPV31 | E1 | 9 | 551 | GKDDRWPYL | 18715 |
| HPV31 | E1 | 9 | 189 | GKFKELYGV | 18716 |
| HPV31 | E1 | 11 | 189 | GKFKELYGVSF | 18717 |
| HPV31 | E1 | 9 | 462 | GKSYFGMSL | 18718 |
| HPV31 | E1 | 10 | 462 | GKSYFGMSLI | 18719 |

TABLE XI-continued

| | | | | | |
|---|---|---|---|---|---|
| HPV31 | E1 | 11 | 455 | IHGAPNTGKSY | 18720 |
| HPV31 | E1 | 8 | 406 | IKSRCDKV | 18721 |
| HPV31 | E1 | 8 | 530 | KHKALMQL | 18722 |
| HPV31 | E1 | 10 | 449 | KKNCILIHGA | 18723 |
| HPV31 | E1 | 8 | 393 | KRAEKRQM | 18724 |
| HPV31 | E1 | 10 | 393 | KRAEKRQMSM | 18725 |
| HPV31 | E1 | 9 | 86 | KRKYVGSPL | 18726 |
| HPV31 | Ei | 9 | 397 | KRQMSMGQW | 18727 |
| HPV31 | E1 | 10 | 397 | KRQMSMGQWI | 18728 |
| HPV31 | E1 | 8 | 559 | LHSRLVVF | 18729 |
| HPV31 | E1 | 10 | 559 | LHSRLVVFTF | 18730 |
| HPV31 | E1 | 8 | 537 | LKCPPLL1 | 18731 |
| HPV31 | E1 | 10 | 444 | LKGVPKKNCI | 18732 |
| HPV31 | E1 | 11 | 444 | LKGVPKKNCIL | 18733 |
| HPV31 | E1 | 8 | 440 | LKLFLKGV | 18734 |
| HPV31 | E1 | 10 | 85 | LKRKYVGSPL | 18735 |
| HPV31 | E1 | 9 | 373 | LKSNSQAKI | 18736 |
| HPV31 | E1 | 10 | 373 | LKSNSQAKIV | 18737 |
| HPV31 | E1 | 8 | 178 | LKTSNGKA | 18738 |
| HPV31 | E1 | 9 | 178 | LKTSNGKAA | 18739 |
| HPV31 | E1 | 10 | 178 | LKTSNGKAAM | 18740 |
| HPV31 | E1 | 11 | 178 | LKTSNGKAAML | 18741 |
| HPV31 | E1 | 10 | 516 | LRNALDGNPV | 18742 |
| HPV31 | E1 | 8 | 292 | LRSTAAAL | 18743 |
| HPV31 | E1 | 9 | 292 | LRSTAAALY | 18744 |
| HPV31 | E1 | 10 | 292 | LRSTAAALYW | 18745 |
| HPV31 | E1 | 11 | 292 | LRSTAAALYWY | 18746 |
| HPV31 | E1 | 8 | 426 | LRYQQIEF | 18747 |
| HPV31 | E1 | 9 | 426 | LRYQQIEFV | 18748 |
| HPV31 | E1 | 11 | 426 | LRYQQIEFVSF | 18749 |
| HPV31 | E1 | 8 | 209 | NKSTCTDW | 18750 |
| HPV31 | E1 | 10 | 209 | NKSTCTDWCV | 18751 |
| HPV31 | E1 | 11 | 209 | NKSTCTDWCVA | 18752 |
| HPV31 | E1 | 8 | 266 | NRITIEKL | 18753 |
| HPV31 | E1 | 9 | 266 | NRITIEKLL | 18754 |
| HPV31 | E1 | 8 | 448 | PKKNCILI | 18755 |
| HPV31 | E1 | 11 | 448 | PKKNCILIHGA | 18756 |
| HPV31 | E1 | 8 | 290 | PKLRSTAA | 18757 |
| HPV31 | E1 | 9 | 290 | PKLRSTAAA | 18758 |
| HPV31 | E1 | 10 | 290 | PKLRSTAAAL | 18759 |
| HPV31 | E1 | 11 | 290 | PKLRSTAAALY | 18760 |
| HPV31 | E1 | 8 | 107 | PRLKAICI | 18761 |
| HPV31 | E1 | 9 | 327 | QHSFNDTTF | 18762 |
| HPV31 | E1 | 11 | 327 | QHSFNDTTFDL | 18763 |
| HPV31 | E1 | 11 | 390 | RHYKRAEKRQM | 18764 |
| HPV31 | E1 | 8 | 87 | RKYVGSPL | 18765 |
| HPV31 | E1 | 11 | 87 | RKYVGSPLSDI | 18766 |
| HPV31 | E1 | 11 | 123 | RRLFELPDSGY | 18767 |
| HPV31 | E1 | 8 | 486 | SHFWLQPL | 18768 |
| HPV31 | E1 | 9 | 486 | SHFWLQPLA | 18769 |
| HPV31 | E1 | 11 | 486 | SHFWLQPLADA | 18770 |
| HPV31 | E1 | 10 | 484 | SKSHFWLQPL | 18771 |
| HPV31 | E1 | 11 | 484 | SKSHFWLQPLA | 18772 |
| HPV31 | E1 | 8 | 118 | SKTAKRRL | 18773 |
| HPV31 | E1 | 9 | 118 | SKTAKRRLF | 18774 |
| HPV31 | E1 | 11 | 118 | SKTAKRRLFEL | 18775 |
| HPV31 | E1 | 8 | 561 | SRLVVFTF | 18776 |
| HPV31 | E1 | 9 | 594 | SRTWCRLNL | 18777 |
| HPV31 | E1 | 8 | 171 | TRNILQVL | 18778 |
| HPV31 | E1 | 11 | 382 | VKDCGTMCRHY | 18779 |
| HPV31 | E1 | 9 | 423 | VKFLRYQQI | 18780 |
| HPV31 | E1 | 11 | 423 | VKFLRYQQIEF | 18781 |
| HPV31 | E1 | 9 | 529 | VKHALMQL | 18782 |
| HPV31 | E1 | 10 | 259 | VRFKCAKNRI | 18783 |
| HPV31 | E1 | 8 | 509 | WHYIDNYL | 18784 |
| HPV31 | E1 | 11 | 509 | WHYIDNYLRNA | 18785 |
| HPV31 | E1 | 9 | 589 | WKSFFSRTW | 18786 |
| HPV31 | E1 | 8 | 419 | WRDIVKFL | 18787 |
| HPV31 | E1 | 10 | 419 | WRDIVKFLRY | 18788 |
| HPV31 | E1 | 9 | 392 | YKRAEKRQM | 18789 |
| HPV31 | E1 | 11 | 392 | YKRAEKRQMSM | 18790 |
| HPV31 | E1 | 8 | 302 | YRTGMSNI | 18791 |
| HPV31 | E1 | 11 | 302 | YRTGMSNISDV | 18792 |
| HPV31 | E2 | 9 | 67 | AKALQAIEL | 18793 |
| HPV31 | E2 | 11 | 67 | AKALQAIELQM | 18794 |
| HPV31 | E2 | 10 | 175 | AKKYGTGKKW | 18795 |
| HPV31 | E2 | 9 | 46 | AREMGIHSI | 18796 |
| HPV31 | E2 | 9 | 28 | DHIDYWKHI | 18797 |
| HPV31 | E2 | 11 | 28 | DHIDYWKHIRL | 18798 |

TABLE XI-continued

| | | | | | |
|---|---|---|---|---|---|
| HPV31 | E2 | 11 | 251 | EHRNTHHPNKL | 18799 |
| HPV31 | E2 | 10 | 17 | EHYENDSKRL | 18800 |
| HPV31 | E2 | 9 | 163 | GHITYFVNF | 18801 |
| HPV31 | E2 | 8 | 333 | GKHKNAIV | 18802 |
| HPV31 | E2 | 10 | 333 | GKHKNAIVTL | 18803 |
| HPV31 | E2 | 8 | 181 | GKKWEVHA | 18804 |
| HPV31 | E2 | 8 | 335 | HKNAIVTL | 18805 |
| HPV31 | E2 | 10 | 335 | HKNAIVTLTY | 18806 |
| HPV31 | E2 | 11 | 335 | HKNAIVTLTYI | 18807 |
| HPV31 | E2 | 10 | 252 | HRNTHHPNKL | 18808 |
| HPV31 | E2 | 11 | 252 | HRNTHHPNKLL | 18809 |
| HPV31 | E2 | 9 | 296 | IHLKGDANI | 18810 |
| HPV31 | E2 | 10 | 296 | IHLKGDANIL | 18811 |
| HPV31 | E2 | 8 | 51 | IHSINHQV | 18812 |
| HPV31 | E2 | 9 | 51 | IHSINHQVV | 18813 |
| HPV31 | E2 | 11 | 51 | IHSINHQVVPA | 18814 |
| HPV31 | E2 | 8 | 36 | IRLECVLM | 18815 |
| HPV31 | E2 | 9 | 36 | IRLECVLMY | 18816 |
| HPV31 | E2 | 11 | 36 | IRLECVLMYKA | 18817 |
| HPV31 | E2 | 8 | 112 | KHGYTVEV | 18818 |
| HPV31 | E2 | 10 | 112 | KHGYTVEVQF | 18819 |
| HPV31 | E2 | 8 | 34 | KHIRLECV | 18820 |
| HPV31 | E2 | 9 | 34 | KHIRLECVL | 18821 |
| HPV31 | E2 | 10 | 34 | KHIRLECVLM | 18822 |
| HPV31 | E2 | 11 | 34 | KHIRLECVLMY | 18823 |
| HPV31 | E2 | 9 | 334 | KHKNAIVTL | 18824 |
| HPV31 | E2 | 11 | 334 | KHKNAIVTLTY | 18825 |
| HPV31 | E2 | 9 | 111 | KKHGYTVEV | 18826 |
| HPV31 | E2 | 11 | 111 | KKHGYTVEVQF | 18827 |
| HPV31 | E2 | 11 | 182 | KKWEVHAGGQV | 18828 |
| HPV31 | E2 | 9 | 176 | KKYGTGKKW | 18829 |
| HPV31 | E2 | 11 | 176 | KKYGTGKKWEV | 18830 |
| HPV31 | E2 | 9 | 24 | KRLCDHIDY | 18831 |
| HPV31 | E2 | 10 | 24 | KRLCDHIDYW | 18832 |
| HPV31 | E2 | 8 | 305 | LKCLRYRL | 18833 |
| HPV31 | E2 | 11 | 305 | LKCLRYRLSKY | 18834 |
| HPV31 | E2 | 8 | 298 | LKGDANIL | 18835 |
| HPV31 | E2 | 11 | 298 | LKGDANILKCL | 18836 |
| HPV31 | E2 | 8 | 110 | LKKHGYTV | 18837 |
| HPV31 | E2 | 10 | 110 | LKKHGYTVEV | 18838 |
| HPV31 | E2 | 9 | 262 | LRGDSVDSV | 18839 |
| HPV31 | E2 | 8 | 308 | LRVRLSKY | 18840 |
| HPV31 | E2 | 11 | 308 | LRYRLSKYKQL | 18841 |
| HPV31 | E2 | 8 | 129 | MHYTNWKF | 18842 |
| HPV31 | E2 | 9 | 129 | MHYTNWKFI | 18843 |
| HPV31 | E2 | 10 | 129 | MHYTNWKFIY | 18844 |
| HPV31 | E2 | 11 | 129 | MHYTNWKFIYL | 18845 |
| HPV31 | E2 | 8 | 55 | NHQVVPAL | 18846 |
| HPV31 | E2 | 10 | 55 | NHQVVPALSV | 18847 |
| HPV31 | E2 | 9 | 259 | NKLLRGDSV | 18848 |
| HPV31 | E2 | 9 | 349 | QRDDFLNTV | 18849 |
| HPV31 | E2 | 11 | 349 | QRDDFLNTVKI | 18850 |
| HPV31 | E2 | 10 | 6 | QRLNVCQDKI | 18851 |
| HPV31 | E2 | 11 | 6 | QRLNVCQDKIL | 18852 |
| HPV31 | E2 | 8 | 65 | SKAKALQA | 18853 |
| HPV31 | E2 | 9 | 65 | SKAKALQAI | 18854 |
| HPV31 | E2 | 11 | 65 | SKAKALQAIEL | 18855 |
| HPV31 | E2 | 8 | 23 | SKRLCDHI | 18856 |
| HPV31 | E2 | 10 | 23 | SKRLCDHIDY | 18857 |
| HPV31 | E2 | 11 | 23 | SKRLCDHIDYW | 18858 |
| HPV31 | E2 | 10 | 313 | SKYKQLYEQV | 18859 |
| HPV31 | E2 | 8 | 255 | THHPNKLL | 18860 |
| HPV31 | E2 | 8 | 284 | TRAVSCPA | 18861 |
| HPV31 | E2 | 8 | 186 | VHAGGQVI | 18862 |
| HPV31 | E2 | 9 | 186 | VHAGGQVIV | 18863 |
| HPV31 | E2 | 10 | 186 | VHAGGQVIVF | 18864 |
| HPV31 | E2 | 8 | 160 | VHEGHITY | 18865 |
| HPV31 | E2 | 9 | 160 | VHEGHITYF | 18866 |
| HPV31 | E2 | 10 | 160 | VHEGHITYFV | 18867 |
| HPV31 | E2 | 10 | 125 | VHNTMHYTNW | 18868 |
| HPV31 | E2 | 9 | 357 | VKIPNTVSV | 18869 |
| HPV31 | E2 | 8 | 134 | WKFIYLCI | 18870 |
| HPV31 | E2 | 9 | 33 | WKHIRLECV | 18871 |
| HPV31 | E2 | 10 | 33 | WKHIRLECVL | 18872 |
| HPV31 | E2 | 11 | 33 | WKHIRLECVLM | 18873 |
| HPV31 | E2 | 8 | 44 | YKAREMGI | 18874 |
| HPV31 | E2 | 11 | 44 | YKAREMGIHSI | 18875 |
| HPV31 | E2 | 8 | 87 | YKNEDWTM | 18876 |
| HPV31 | E2 | 8 | 315 | YKQLYEQV | 18877 |

TABLE XI-continued

| | | | | | |
|---|---|---|---|---|---|
| HPV31 | E2 | 9 | 310 | YRLSKYKQL | 18878 |
| HPV31 | E2 | 10 | 310 | YRLSKYKQLY | 18879 |
| HPV31 | E5 | 8 | 74 | IHTHASFL | 18880 |
| HPV31 | E5 | 8 | 29 | IRPLVLSV | 18881 |
| HPV31 | E5 | 10 | 29 | IRPLVLSVSV | 18882 |
| HPV31 | E5 | 11 | 29 | IRPLVLSVSVY | 18883 |
| HPV31 | E5 | 8 | 57 | LRCFCIYV | 18884 |
| HPV31 | E5 | 9 | 57 | LRCFCIYVV | 18885 |
| HPV31 | E5 | 10 | 57 | LRCFCIYVVF | 18886 |
| HPV31 | E5 | 11 | 57 | LRCFCIYVVFI | 18887 |
| HPV31 | E6 | 10 | 33 | CKGQLTETEV | 18888 |
| HPV31 | E6 | 11 | 33 | CKGQLTETEVL | 18889 |
| HPV31 | E6 | 9 | 120 | DKKKRFHNI | 18890 |
| HPV31 | E6 | 8 | 89 | EKLTNKGI | 18891 |
| HPV31 | E6 | 11 | 89 | EKLTNKGICDL | 18892 |
| HPV31 | E6 | 9 | 7 | ERPRKLHEL | 18893 |
| HPV31 | E6 | 8 | 125 | FHNIGGRW | 18894 |
| HPV31 | E6 | 11 | 2 | FKNPAERPRKL | 18895 |
| HPV31 | E6 | 8 | 76 | FRWYRYSV | 18896 |
| HPV31 | E6 | 9 | 76 | FRWYRYSVY | 18897 |
| HPV31 | E6 | 8 | 130 | GRWTGRCI | 18898 |
| HPV31 | E6 | 9 | 130 | GRWTGRCIA | 18899 |
| HPV31 | E6 | 11 | 130 | GRWTGRCIACW | 18900 |
| HPV31 | E6 | 10 | 101 | IRCITCQRPL | 18901 |
| HPV31 | E6 | 8 | 121 | KKKRFHNI | 18902 |
| HPV31 | E6 | 11 | 122 | KKRFHNIGGRW | 18903 |
| HPV31 | E6 | 10 | 123 | KRFHNIGGRW | 18904 |
| HPV31 | E6 | 8 | 12 | LHELSSAL | 18905 |
| HPV31 | E6 | 10 | 12 | LHELSSALEI | 18906 |
| HPV31 | E6 | 10 | 67 | LRFYSKVSEF | 18907 |
| HPV31 | E6 | 8 | 93 | NKGICDLL | 18908 |
| HPV31 | E6 | 9 | 93 | NKGICDLLI | 18909 |
| HPV31 | E6 | 9 | 59 | PHGVCTKCL | 18910 |
| HPV31 | E6 | 11 | 59 | PHGVCTKCLRF | 18911 |
| HPV31 | E6 | 10 | 9 | PRKLHELSSA | 18912 |
| HPV31 | E6 | 11 | 9 | PRKLHELSSAL | 18913 |
| HPV31 | E6 | 10 | 116 | QRHLDKKKRF | 18914 |
| HPV31 | E6 | 9 | 117 | RHLDKKKRF | 18915 |
| HPV31 | E6 | 9 | 10 | RKLHELSSA | 18916 |
| HPV31 | E6 | 10 | 10 | RKLHELSSAL | 18917 |
| HPV31 | E6 | 9 | 141 | RRPRTETQV | 18918 |
| HPV31 | E6 | 8 | 71 | SKVSEFRW | 18919 |
| HPV31 | E6 | 9 | 71 | SKVSEFRWY | 18920 |
| HPV31 | E6 | 11 | 71 | SKVSEFRWYRY | 18921 |
| HPV31 | E6 | 10 | 64 | TKCLRFYSKV | 18922 |
| HPV31 | E6 | 10 | 140 | WRRPRTETQV | 18923 |
| HPV31 | E6 | 9 | 54 | YRDDTPHGV | 18924 |
| HPV31 | E6 | 10 | 79 | YRYSVYGTTL | 18925 |
| HPV31 | E7 | 9 | 61 | CKSTLRLCV | 18926 |
| HPV31 | E7 | 8 | 76 | IRILQELL | 18927 |
| HPV31 | E7 | 9 | 76 | IRILQELLM | 18928 |
| HPV31 | E7 | 10 | 65 | LRLCVQSTQV | 18929 |
| HPV31 | E7 | 8 | 1 | MRGETPTL | 18930 |
| HPV31 | E7 | 11 | 1 | MRGETPTLQDY | 18931 |
| HPV31 | L1 | 10 | 40 | ARLLTVGHPY | 18932 |
| HPV31 | L1 | 11 | 40 | ARLLTVGHPYY | 18933 |
| HPV31 | L1 | 9 | 380 | CKITLSADI | 18934 |
| HPV31 | L1 | 10 | 380 | CKITLSADIM | 18935 |
| HPV31 | L1 | 9 | 162 | CKPPIGEHW | 18936 |
| HPV31 | L1 | 9 | 230 | CKYPDYLKM | 18937 |
| HPV31 | L1 | 10 | 230 | CKYPDYLKMV | 18938 |
| HPV31 | L1 | 11 | 230 | CKYPDYLKMVA | 18939 |
| HPV31 | L1 | 10 | 454 | EKFSADLDQF | 18940 |
| HPV31 | L1 | 8 | 481 | FKAGKRSA | 18941 |
| HPV31 | L1 | 11 | 481 | FKAGKRSAPSA | 18942 |
| HPV31 | L1 | 9 | 442 | FKDYVFWEV | 18943 |
| HPV31 | L1 | 11 | 442 | FKDYVFWEVNL | 18944 |
| HPV31 | L1 | 11 | 361 | FKEYLRHGEEF | 18945 |
| HPV31 | L1 | 9 | 356 | FKSSNFKEY | 18946 |
| HPV31 | L1 | 10 | 356 | FKSSNFKEYL | 18947 |
| HPV31 | L1 | 11 | 74 | FRVRLPDPNKF | 18948 |
| HPV31 | L1 | 8 | 319 | GHNNGICW | 18949 |
| HPV31 | L1 | 8 | 120 | GHPLLNKF | 18950 |
| HPV31 | L1 | 10 | 171 | GKGSPCSNNA | 18951 |
| HPV31 | L1 | 11 | 171 | GKGSPCSNNAI | 18952 |
| HPV31 | L1 | 8 | 484 | GKRSAPSA | 18953 |
| HPV31 | L1 | 8 | 109 | GRGQPLGV | 18954 |
| HPV31 | L1 | 10 | 109 | GRGQPLGVGI | 18955 |
| HPV31 | L1 | 8 | 466 | GRKFLLQA | 18956 |

TABLE XI-continued

| | | | | | |
|---|---|---|---|---|---|
| HPV31 | L1 | 10 | 466 | GRKFLLQAGY | 18957 |
| HPV31 | L1 | 8 | 392 | IHSMNPM | 18958 |
| HPV31 | L1 | 9 | 392 | IHSMNPML | 18959 |
| HPV31 | L1 | 8 | 278 | IKGSGSTA | 18960 |
| HPV31 | L1 | 10 | 278 | IKGSGSTATL | 18961 |
| HPV31 | L1 | 11 | 278 | IKGSGSTATLA | 18962 |
| HPV31 | L1 | 8 | 59 | KKIVVPKV | 18963 |
| HPV31 | L1 | 11 | 59 | KKIVVPKVSGL | 18964 |
| HPV31 | L1 | 9 | 452 | LKEKFSADL | 18965 |
| HPV31 | L1 | 8 | 236 | LKMVAEPY | 18966 |
| HPV31 | L1 | 11 | 191 | LKNSVIQDGDM | 18967 |
| HPV31 | L1 | 9 | 365 | LRHGEEFDL | 18968 |
| HPV31 | L1 | 11 | 365 | LRHGEEFDLQF | 18969 |
| HPV31 | L1 | 8 | 251 | LRREQMFV | 18970 |
| HPV31 | L1 | 11 | 251 | LRREQMFVRHF | 18971 |
| HPV31 | L1 | 10 | 82 | NKFGFPDTSF | 18972 |
| HPV31 | L1 | 11 | 82 | NKFGFPDTSFY | 18973 |
| HPV31 | L1 | 9 | 309 | NKPYWMQRA | 18974 |
| HPV31 | L1 | 9 | 144 | NRECISMDY | 18975 |
| HPV31 | L1 | 10 | 263 | NRSGTVGESV | 18976 |
| HPV31 | L1 | 9 | 437 | PKEDPFKDY | 18977 |
| HPV31 | L1 | 10 | 437 | PKEDPFKDYV | 18978 |
| HPV31 | L1 | 11 | 437 | PKEDPFKDYVF | 18979 |
| HPV31 | L1 | 10 | 479 | PKFKAGKRSA | 18980 |
| HPV31 | L1 | 9 | 58 | PKKIVVPKV | 18981 |
| HPV31 | L1 | 9 | 53 | PKSDNPKKI | 18982 |
| HPV31 | L1 | 10 | 53 | PKSDNPKKIV | 18983 |
| HPV31 | L1 | 11 | 53 | PKSDNPKKIVV | 18984 |
| HPV31 | L1 | 8 | 64 | PKVSGLQY | 18985 |
| HPV31 | L1 | 10 | 64 | PKVSGLQYRV | 18986 |
| HPV31 | L1 | 11 | 64 | PKVSGLQYRVF | 18987 |
| HPV31 | L1 | 8 | 435 | QKPKEDPF | 18988 |
| HPV31 | L1 | 11 | 435 | QKPKEDPFKDY | 18989 |
| HPV31 | L1 | 10 | 315 | QRAQGHNNGI | 18990 |
| HPV31 | L1 | 8 | 97 | QRLVWACV | 18991 |
| HPV31 | L1 | 10 | 97 | QRLVWACVGL | 18992 |
| HPV31 | L1 | 10 | 259 | RHFFNRSGTV | 18993 |
| HPV31 | L1 | 8 | 366 | RHGEEFDL | 18994 |
| HPV31 | L1 | 10 | 366 | RHGEEFDLQF | 18995 |
| HPV31 | L1 | 11 | 366 | RHGEEFDLQFI | 18996 |
| HPV31 | L1 | 9 | 467 | RKFLLQAGY | 18997 |
| HPV31 | L1 | 11 | 467 | RKFLLQAGYRA | 18998 |
| HPV31 | L1 | 10 | 252 | RREQMFVRHF | 18999 |
| HPV31 | L1 | 11 | 252 | RREQMFVRHFF | 19000 |
| HPV31 | L1 | 9 | 19 | SKVVSTDEY | 19001 |
| HPV31 | L1 | 10 | 19 | SKVVSTDEYV | 19002 |
| HPV31 | L1 | 9 | 217 | TKSNVPLDI | 19003 |
| HPV31 | L1 | 8 | 338 | TRSTNMSV | 19004 |
| HPV31 | L1 | 10 | 338 | TRSTNMSVCA | 19005 |
| HPV31 | L1 | 11 | 338 | TRSTNMSVCAA | 19006 |
| HPV31 | L1 | 9 | 29 | TRTNIYYHA | 19007 |
| HPV31 | L1 | 11 | 253 | VRHFFNRSGTV | 19008 |
| HPV31 | L1 | 9 | 76 | VRLPDPNKF | 19009 |
| HPV31 | L1 | 11 | 76 | VRLPDPNKFGF | 19010 |
| HPV31 | L1 | 8 | 4 | WRPSEATV | 19011 |
| HPV31 | L1 | 9 | 4 | WRPSEATVY | 19012 |
| HPV31 | L1 | 10 | 4 | WRPSEATVYL | 19013 |
| HPV31 | L1 | 8 | 35 | YHAGSARL | 19014 |
| HPV31 | L1 | 9 | 35 | YHAGSARLL | 19015 |
| HPV31 | L1 | 11 | 35 | YHAGSARLLTV | 19016 |
| HPV31 | L1 | 8 | 152 | YKQTQLCL | 19017 |
| HPV31 | L1 | 9 | 152 | YKQTQLCLL | 19018 |
| HPV31 | L1 | 9 | 475 | YRARPKFKA | 19019 |
| HPV31 | L1 | 8 | 419 | YRFVTSQA | 19020 |
| HPV31 | L1 | 9 | 419 | YRFVTSQAI | 19021 |
| HPV31 | L1 | 8 | 71 | YRVFRVRL | 19022 |
| HPV31 | L2 | 9 | 218 | ARLGLYSKA | 19023 |
| HPV31 | L2 | 9 | 315 | ARVHYYYDI | 19024 |
| HPV31 | L2 | 11 | 22 | CKAAGTCPSDV | 19025 |
| HPV31 | L2 | 8 | 412 | EHAPTQVF | 19026 |
| HPV31 | L2 | 10 | 412 | EHAPTQVFPF | 19027 |
| HPV31 | L2 | 9 | 37 | EHTTIADQI | 19028 |
| HPV31 | L2 | 10 | 37 | EHTTIADQIL | 19029 |
| HPV31 | L2 | 10 | 174 | GHLLLSSSSI | 19030 |
| HPV31 | L2 | 8 | 68 | GRTGYVPL | 19031 |
| HPV31 | L2 | 10 | 89 | IRPPVSIDPV | 19032 |
| HPV31 | L2 | 8 | 11 | KRASATQL | 19033 |
| HPV31 | L2 | 9 | 11 | KRASATQLY | 19034 |
| HPV31 | L2 | 9 | 449 | KRRRKRVSY | 19035 |

TABLE XI-continued

| | | | | | |
|---|---|---|---|---|---|
| HPV31 | L2 | 10 | 449 | KRRRKRVSYF | 19036 |
| HPV31 | L2 | 11 | 449 | KRRRKRVSYFF | 19037 |
| HPV31 | L2 | 10 | 4 | KRSTKRTKRA | 19038 |
| HPV31 | L2 | 8 | 8 | KRTKRASA | 19039 |
| HPV31 | L2 | 11 | 8 | KRTKRASATQL | 19040 |
| HPV31 | L2 | 10 | 453 | KRVSYFFTDV | 19041 |
| HPV31 | L2 | 8 | 441 | LHPSYYML | 19042 |
| HPV31 | L2 | 8 | 448 | LKRRRKRV | 19043 |
| HPV31 | L2 | 10 | 448 | LKRRRKRVSY | 19044 |
| HPV31 | L2 | 11 | 448 | LKRRRKRVSYF | 19045 |
| HPV31 | L2 | 9 | 305 | LRTRSGATI | 19046 |
| HPV31 | L2 | 11 | 305 | LRTRSGATIGA | 19047 |
| HPV31 | L2 | 8 | 46 | LRYGSMGV | 19048 |
| HPV31 | L2 | 9 | 46 | LRYGSMGVF | 19049 |
| HPV31 | L2 | 10 | 46 | LRYGSMGVFF | 19050 |
| HPV31 | L2 | 11 | 301 | NKQTLRTRSGA | 19051 |
| HPV31 | L2 | 9 | 124 | PHPPTTSGF | 19052 |
| HPV31 | L2 | 11 | 124 | PHPPTTSGFDI | 19053 |
| HPV31 | L2 | 8 | 34 | PKIEHTFI | 19054 |
| HPV31 | L2 | 9 | 34 | PKIEHTFIA | 19055 |
| HPV31 | L2 | 11 | 241 | PKQLITYENPA | 19056 |
| HPV31 | L2 | 8 | 452 | RKRVSYFF | 19057 |
| HPV31 | L2 | 11 | 452 | RKRVSYFFTDV | 19058 |
| HPV31 | L2 | 8 | 451 | RRKRVSYF | 19059 |
| HPV31 | L2 | 9 | 451 | RRKRVSYFF | 19060 |
| HPV31 | L2 | 10 | 290 | RRNTVRYSRL | 19061 |
| HPV31 | L2 | 8 | 215 | RRPARLGL | 19062 |
| HPV31 | L2 | 9 | 215 | RRPARLGLY | 19063 |
| HPV31 | L2 | 8 | 450 | RRRKRVSY | 19064 |
| HPV31 | L2 | 9 | 450 | RRRKRVSYF | 19065 |
| HPV31 | L2 | 10 | 450 | RRRKRVSYFF | 19066 |
| HPV31 | L2 | 10 | 267 | SHNIAPDPDF | 19067 |
| HPV31 | L2 | 11 | 267 | SHNIAPDPDFL | 19068 |
| HPV31 | L2 | 9 | 224 | SKATQQVKV | 19069 |
| HPV31 | L2 | 10 | 224 | SKATQQVKVI | 19070 |
| HPV31 | L2 | 11 | 3 | SKRSTKRTKRA | 19071 |
| HPV31 | L2 | 9 | 297 | SRLGNKQTL | 19072 |
| HPV31 | L2 | 8 | 289 | SRRNTVRY | 19073 |
| HPV31 | L2 | 11 | 289 | SRRNTVRYSRL | 19074 |
| HPV31 | L2 | 9 | 368 | THNVSPSTA | 19075 |
| HPV31 | L2 | 10 | 368 | THNVSPSTAV | 19076 |
| HPV31 | L2 | 9 | 185 | THNYEEIPM | 19077 |
| HPV31 | L2 | 9 | 10 | TKRASATQL | 19078 |
| HPV31 | L2 | 10 | 10 | TKRASATQLY | 19079 |
| HPV31 | L2 | 9 | 7 | TKRTKRASA | 19080 |
| HPV31 | L2 | 9 | 77 | TRPSTVSEA | 19081 |
| HPV31 | L2 | 11 | 77 | TRPSTVSEASI | 19082 |
| HPV31 | L2 | 9 | 307 | TRSGATIGA | 19083 |
| HPV31 | L2 | 11 | 307 | TRSGATIGARV | 19084 |
| HPV31 | L2 | 10 | 317 | VHYYYDISSI | 19085 |
| HPV31 | L2 | 8 | 230 | VKVIDPTF | 19086 |
| HPV31 | L2 | 9 | 230 | VKVIDPTFL | 19087 |
| HPV31 | L2 | 11 | 230 | VKVIDPTFLSA | 19088 |
| HPV31 | L2 | 9 | 214 | VRRPARLGL | 19089 |
| HPV31 | L2 | 10 | 214 | VRRPARLGLY | 19090 |
| HPV33 | E1 | 9 | 509 | AKIGMIDDV | 19091 |
| HPV33 | E1 | 9 | 392 | AKIVKDCGI | 19092 |
| HPV33 | E1 | 10 | 392 | AKIVKDCGIM | 19093 |
| HPV33 | E1 | 8 | 284 | AKLMSNLL | 19094 |
| HPV33 | E1 | 10 | 284 | AKLMSNLLSI | 19095 |
| HPV33 | E1 | 9 | 620 | DKENHGGNI | 19096 |
| HPV33 | E1 | 8 | 222 | DKTSCTDW | 19097 |
| HPV33 | E1 | 10 | 222 | DKTSCTDWCI | 19098 |
| HPV33 | E1 | 11 | 102 | DRAANPCRTSI | 19099 |
| HPV33 | E1 | 8 | 263 | DRGIIILL | 19100 |
| HPV33 | E1 | 9 | 263 | DRGIIILLL | 19101 |
| HPV33 | E1 | 10 | 263 | DRGIIILLLI | 19102 |
| HPV33 | E1 | 10 | 334 | DRLTVLQHSF | 19103 |
| HPV33 | E1 | 10 | 409 | EKRKMSIGQW | 19104 |
| HPV33 | E1 | 11 | 409 | EKRKMSIGQWI | 19105 |
| HPV33 | E1 | 9 | 424 | EKTNDGGNW | 19106 |
| HPV33 | E1 | 8 | 25 | ERRTGDNI | 19107 |
| HPV33 | E1 | 9 | 204 | FKEAYGISF | 19108 |
| HPV33 | E1 | 10 | 204 | FKEAYGISFM | 19109 |
| HPV33 | E1 | 8 | 453 | FKKFLKGI | 19110 |
| HPV33 | E1 | 11 | 219 | FKSDKTSCTDW | 19111 |
| HPV33 | E1 | 8 | 274 | FRCSKNRL | 19112 |
| HPV33 | E1 | 10 | 274 | FRCSKNRLTV | 19113 |
| HPV33 | E1 | 11 | 274 | FRCSKNRLTVA | 19114 |

TABLE XI-continued

| | | | | | |
|---|---|---|---|---|---|
| HPV33 | E1 | 8 | 315 | FRTAMSNI | 19115 |
| HPV33 | E1 | 11 | 315 | FRTAMSMSDV | 19116 |
| HPV33 | E1 | 9 | 475 | GKSYFGMSL | 19117 |
| HPV33 | E1 | 10 | 475 | GKSYFGMSLI | 19118 |
| HPV33 | E1 | 10 | 248 | IKQHSLYTHL | 19119 |
| HPV33 | E1 | 10 | 272 | IRFRCSKNRL | 19120 |
| HPV33 | E1 | 8 | 543 | KHRALVQL | 19121 |
| HPV33 | E1 | 8 | 406 | KKAEKRKM | 19122 |
| HPV33 | E1 | 10 | 406 | KKAEKRKMSI | 19123 |
| HPV33 | E1 | 11 | 462 | KKSCMLICGPA | 19124 |
| HPV33 | E1 | 11 | 86 | KKKFAACSQSA | 19125 |
| HPV33 | E1 | 9 | 410 | KKKMSIGQW | 19126 |
| HPV33 | E1 | 10 | 410 | KRKMSIGQWI | 19127 |
| HPV33 | E1 | 8 | 572 | LHSRLTVF | 19128 |
| HPV33 | E1 | 10 | 572 | LHSRLTVFEF | 19129 |
| HPV33 | E1 | 8 | 191 | LHSSNTKA | 19130 |
| HPV33 | E1 | 10 | 191 | LHSSNTKANI | 19131 |
| HPV33 | E1 | 11 | 191 | LHSSNTKANIL | 19132 |
| HPV33 | E1 | 8 | 550 | LKCPPLLL | 19133 |
| HPV33 | E1 | 9 | 487 | LKGCVISCV | 19134 |
| HPV33 | E1 | 10 | 457 | LKGIPKKSCM | 19135 |
| HPV33 | E1 | 11 | 457 | LKGIPKKSCML | 19136 |
| HPV33 | E1 | 9 | 386 | LKSNSQAKI | 19137 |
| HPV33 | E1 | 10 | 386 | LKSNSQAKIV | 19138 |
| HPV33 | E1 | 10 | 244 | LKVLIKQHSL | 19139 |
| HPV33 | E1 | 11 | 244 | LKVLIKQHSLY | 19140 |
| HPV33 | E1 | 8 | 305 | LRSQTCAL | 19141 |
| HPV33 | E1 | 9 | 305 | LRSQTCALY | 19142 |
| HPV33 | E1 | 10 | 305 | LRSQTCALYW | 19143 |
| HPV33 | E1 | 11 | 305 | LRSQTCALYWF | 19144 |
| HPV33 | E1 | 8 | 439 | LRYQNIEF | 19145 |
| HPV33 | E1 | 10 | 439 | LRYQNIEFTA | 19146 |
| HPV33 | E1 | 11 | 439 | LRYQNIEFTAF | 19147 |
| HPV33 | E1 | 10 | 529 | MRNALDGNE1 | 19148 |
| HPV33 | E1 | 9 | 623 | NHGGNISTF | 19149 |
| HPV33 | E1 | 11 | 115 | NKECTYRKRKI | 19150 |
| HPV33 | E1 | 8 | 113 | NKNKECTY | 19151 |
| HPV33 | E1 | 8 | 279 | NRLTVAKL | 19152 |
| HPV33 | E1 | 9 | 279 | NRLTVAKLM | 19153 |
| HPV33 | E1 | 8 | 461 | PKKSCMLI | 19154 |
| HPV33 | E1 | 9 | 303 | PKLRSQTCA | 19155 |
| HPV33 | E1 | 10 | 303 | PKLRSQTCAL | 19156 |
| HPV33 | E1 | 11 | 303 | PKLRSQTCALY | 19157 |
| HPV33 | E1 | 8 | 340 | QHSFNDNI | 19158 |
| HPV33 | E1 | 9 | 340 | QHSFNDNIF | 19159 |
| HPV33 | E1 | 11 | 340 | QHSFNDNIFDL | 19160 |
| HPV33 | E1 | 8 | 250 | QHSLYTHL | 19161 |
| HPV33 | E1 | 11 | 250 | QHSLYTHLQCL | 19162 |
| HPV33 | E1 | 11 | 403 | RHYKKAEKRKM | 19163 |
| HPV33 | E1 | 10 | 87 | RKFAACSQSA | 19164 |
| HPV33 | E1 | 11 | 87 | RKFAACSQSAA | 19165 |
| HPV33 | E1 | 11 | 123 | RKIDELEDSGY | 19166 |
| HPV33 | E1 | 8 | 411 | RKMSIGQW | 19167 |
| HPV33 | E1 | 9 | 411 | RKMSIGQWI | 19168 |
| HPV33 | E1 | 8 | 121 | RKRKIDEL | 19169 |
| HPV33 | E1 | 8 | 499 | SHFWLQPL | 19170 |
| HPV33 | E1 | 11 | 499 | SHFWLQPLSDA | 19171 |
| HPV33 | E1 | 8 | 277 | SKNRLTVA | 19172 |
| HPV33 | E1 | 10 | 277 | SKNRLTVAKL | 19173 |
| HPV33 | E1 | 11 | 277 | SKNRLTVAKLM | 19174 |
| HPV33 | E1 | 10 | 497 | SKSHFWLQPL | 19175 |
| HPV33 | E1 | 8 | 574 | SRLTVFEF | 19176 |
| HPV33 | E1 | 9 | 607 | SRTWCKLDL | 19177 |
| HPV33 | E1 | 10 | 607 | SRTWCKLDLI | 19178 |
| HPV33 | E1 | 10 | 567 | SRWPYLHSRL | 19179 |
| HPV33 | E1 | 9 | 196 | TKANILYKF | 19180 |
| HPV33 | E1 | 11 | 395 | VKDCGIMCRHY | 19181 |
| HPV33 | E1 | 9 | 542 | VKHRALVQL | 19182 |
| HPV33 | E1 | 9 | 602 | WKSFFSRTW | 19183 |
| HPV33 | E1 | 8 | 432 | WRPIVQLL | 19184 |
| HPV33 | E1 | 10 | 432 | WRPIVQLLRY | 19185 |
| HPV33 | E1 | 9 | 202 | YKFKEAYGI | 19186 |
| HPV33 | E1 | 11 | 202 | YKFKEAYGISF | 19187 |
| HPV33 | E1 | 9 | 405 | YKKAEKRKM | 19188 |
| HPV33 | E1 | 11 | 405 | YKKAEKRKMSI | 19189 |
| HPV33 | E1 | 9 | 120 | YRKRKIDEL | 19190 |
| HPV33 | E2 | 9 | 46 | AKQMGFSHL | 19191 |
| HPV33 | E2 | 8 | 176 | AKYSKTQM | 19192 |
| HPV33 | E2 | 9 | 176 | AKYSKTQMW | 19193 |

TABLE XI-continued

| | | | | | |
|---|---|---|---|---|---|
| HPV33 | E2 | 11 | 176 | AKYSKTQMWEV | 19194 |
| HPV33 | E2 | 10 | 6 | ARLNAVQEKI | 19195 |
| HPV33 | E2 | 11 | 6 | ARLNAVQEKIL | 19196 |
| HPV33 | E2 | 8 | 55 | CHQVVPSL | 19197 |
| HPV33 | E2 | 9 | 55 | CHQVVPSLL | 19198 |
| HPV33 | E2 | 10 | 55 | CHQVVPSLLA | 19199 |
| HPV33 | E2 | 8 | 124 | DKKNTMDY | 19200 |
| HPV33 | E2 | 11 | 124 | DKKNTMDYTNW | 19201 |
| HPV33 | E2 | 9 | 22 | DKTDLPSQI | 19202 |
| HPV33 | E2 | 8 | 31 | EHWKLIRM | 19203 |
| HPV33 | E2 | 11 | 31 | EHWKLIRMECA | 19204 |
| HPV33 | E2 | 9 | 13 | EKILDLYEA | 19205 |
| HPV33 | E2 | 8 | 164 | EKVYFKYF | 19206 |
| HPV33 | E2 | 8 | 171 | FKEDAAKY | 19207 |
| HPV33 | E2 | 8 | 110 | FKKQGETV | 19208 |
| HPV33 | E2 | 10 | 110 | FKKQGETVTV | 19209 |
| HPV33 | E2 | 8 | 168 | FKYFKEDA | 19210 |
| HPV33 | E2 | 9 | 168 | FKYFKEDAA | 19211 |
| HPV33 | E2 | 11 | 168 | FKYFKEDAAKY | 19212 |
| HPV33 | E2 | 8 | 150 | GKVDYIGM | 19213 |
| HPV33 | E2 | 9 | 150 | GKVDYIGMY | 19214 |
| HPV33 | E2 | 10 | 150 | GKVDYIGMYY | 19215 |
| HPV33 | E2 | 11 | 150 | GKVDYIGMYYI | 19216 |
| HPV33 | E2 | 8 | 160 | IHNCEKVY | 19217 |
| HPV33 | E2 | 9 | 160 | IHNCEKVYF | 19218 |
| HPV33 | E2 | 11 | 160 | IHNCEKVYFKY | 19219 |
| HPV33 | E2 | 8 | 36 | IRMECALL | 19220 |
| HPV33 | E2 | 9 | 36 | IRMECALLY | 19221 |
| HPV33 | E2 | 11 | 36 | IRMECALLYTA | 19222 |
| HPV33 | E2 | 10 | 125 | KKNTMDYTNW | 19223 |
| HPV33 | E2 | 9 | 111 | KKQGETVTV | 19224 |
| HPV33 | E2 | 11 | 111 | KKQGETVTVQY | 19225 |
| HPV33 | E2 | 8 | 286 | LKCLRYRL | 19226 |
| HPV33 | E2 | 11 | 286 | LKCLRYRLKPY | 19227 |
| HPV33 | E2 | 8 | 279 | LKGESNSL | 19228 |
| HPV33 | E2 | 11 | 279 | LKGESNSLKCL | 19229 |
| HPV33 | E2 | 8 | 293 | LKPYKELY | 19230 |
| HPV33 | E2 | 11 | 293 | LKPYKELYSSM | 19231 |
| HPV33 | E2 | 8 | 289 | LRYRLKPY | 19232 |
| HPV33 | E2 | 11 | 289 | LRYRLKPYKEL | 19233 |
| HPV33 | E2 | 8 | 313 | NKNSKNGI | 19234 |
| HPV33 | E2 | 9 | 313 | NKNSKNGIV | 19235 |
| HPV33 | E2 | 11 | 313 | NKNSKNGIVTV | 19236 |
| HPV33 | E2 | 11 | 263 | NKQRTVCSSNV | 19237 |
| HPV33 | E2 | 8 | 218 | NRPPQAAA | 19238 |
| HPV33 | E2 | 11 | 107 | PKCFKKQGETV | 19239 |
| HPV33 | E2 | 9 | 265 | QRTVCSSNV | 19240 |
| HPV33 | E2 | 10 | 265 | QRTVCSSNVA | 19241 |
| HPV33 | E2 | 10 | 228 | RRPADTTDTA | 19242 |
| HPV33 | E2 | 11 | 227 | RRRPADTTDTA | 19243 |
| HPV33 | E2 | 8 | 52 | SHLCHQVV | 19244 |
| HPV33 | E2 | 11 | 52 | SHLCHQVVPSL | 19245 |
| HPV33 | E2 | 8 | 316 | SKNGIVTV | 19246 |
| HPV33 | E2 | 10 | 316 | SKNGIVTVTF | 19247 |
| HPV33 | E2 | 11 | 316 | SKNGIVTVTFV | 19248 |
| HPV33 | E2 | 10 | 83 | SKSQYSTSQW | 19249 |
| HPV33 | E2 | 8 | 65 | SKTKAFQV | 19250 |
| HPV33 | E2 | 9 | 65 | SKTKAFQVI | 19251 |
| HPV33 | E2 | 11 | 65 | SKTKAFQVIEL | 19252 |
| HPV33 | E2 | 8 | 179 | SKTQMWEV | 19253 |
| HPV33 | E2 | 10 | 179 | SKTQMWEVHV | 19254 |
| HPV33 | E2 | 9 | 67 | TKAFQVIEL | 19255 |
| HPV33 | E2 | 11 | 67 | TKAFQVIELQM | 19256 |
| HPV33 | E2 | 9 | 241 | TKLFCADPA | 19257 |
| HPV33 | E2 | 10 | 241 | TKLFCADPAL | 19258 |
| HPV33 | E2 | 10 | 277 | VHLKGESNSL | 19259 |
| HPV33 | E2 | 8 | 186 | VHVGGQVI | 19260 |
| HPV33 | E2 | 9 | 186 | VHVGGQVIW | 19261 |
| HPV33 | E2 | 9 | 338 | VKIPPTVQI | 19262 |
| HPV33 | E2 | 9 | 33 | WKLIRMECA | 19263 |
| HPV33 | E2 | 10 | 33 | WKLIRMECAL | 19264 |
| HPV33 | E2 | 11 | 33 | WKLIRMECALL | 19265 |
| HPV33 | E2 | 8 | 296 | YKELYSSM | 19266 |
| HPV33 | E2 | 9 | 291 | YRLKPYKEL | 19267 |
| HPV33 | E2 | 10 | 291 | YRLKPYKELY | 19268 |
| HPV33 | E5 | 8 | 47 | LKIFFCYL | 19269 |
| HPV33 | E5 | 9 | 47 | LKIFFCYLL | 19270 |
| HPV33 | E5 | 10 | 47 | LKIFFCYLLF | 19271 |
| HPV33 | E5 | 11 | 47 | LKIFFCYLLFL | 19272 |

TABLE XI-continued

| | | | | | |
|---|---|---|---|---|---|
| HPV33 | E5 | 8 | 19 | LRPLILSI | 19273 |
| HPV33 | E5 | 11 | 19 | LRPLILSISTY | 19274 |
| HPV33 | E6 | 10 | 33 | CKKPLQRSEV | 19275 |
| HPV33 | E6 | 11 | 33 | CKKPLQRSEVY | 19276 |
| HPV33 | E6 | 8 | 63 | CKLCLRFL | 19277 |
| HPV33 | E6 | 11 | 63 | CKLCLRFLSKI | 19278 |
| HPV33 | E6 | 8 | 114 | EKKRHVDL | 19279 |
| HPV33 | E6 | 9 | 7 | EKPRTLHDL | 19280 |
| HPV33 | E6 | 8 | 125 | FHNISGRW | 19281 |
| HPV33 | E6 | 9 | 125 | FHNISGRWA | 19282 |
| HPV33 | E6 | 8 | 130 | GRWAGRCA | 19283 |
| HPV33 | E6 | 9 | 130 | GRWAGRCAA | 19284 |
| HPV33 | E6 | 11 | 130 | GRWAGRCAACW | 19285 |
| HPV33 | E6 | 9 | 23 | IHNIELQCV | 19286 |
| HPV33 | E6 | 10 | 101 | IRCIICQRPL | 19287 |
| HPV33 | E6 | 8 | 93 | KKPLNEIL | 19288 |
| HPV33 | E6 | 9 | 93 | KKPLNEILI | 19289 |
| HPV33 | E6 | 9 | 34 | KKPLQRSEV | 19290 |
| HPV33 | E6 | 10 | 34 | KKPLQRSEVY | 19291 |
| HPV33 | E6 | 11 | 115 | KKRHVDLNKRF | 19292 |
| HPV33 | E6 | 10 | 123 | KRFHNISGRW | 19293 |
| HPV33 | E6 | 11 | 123 | KRFHNISGRWA | 19294 |
| HPV33 | E6 | 10 | 116 | KRHVDLNKRF | 19295 |
| HPV33 | E6 | 8 | 12 | LHDLCQAL | 19296 |
| HPV33 | E6 | 10 | 67 | LRFLSKISEY | 19297 |
| HPV33 | E6 | 11 | 122 | NKRFHMSGRW | 19298 |
| HPV33 | E6 | 10 | 9 | PRTLHDLCQA | 19299 |
| HPV33 | E6 | 11 | 9 | PRTLHDLCQAL | 19300 |
| HPV33 | E6 | 8 | 38 | QRSEVYDF | 19301 |
| HPV33 | E6 | 9 | 38 | QRSEVYDFA | 19302 |
| HPV33 | E6 | 10 | 38 | QRSEVYDFAF | 19303 |
| HPV33 | E6 | 11 | 38 | QRSEVYDFAFA | 19304 |
| HPV33 | E6 | 9 | 117 | RHVDLNKRF | 19305 |
| HPV33 | E6 | 8 | 77 | RHYNYSVY | 19306 |
| HPV33 | E6 | 9 | 71 | SKISEYRHY | 19307 |
| HPV33 | E6 | 11 | 71 | SKISEYRHYNY | 19308 |
| HPV33 | E6 | 8 | 142 | SRRRETAL | 19309 |
| HPV33 | E6 | 8 | 92 | VKKPLNEI | 19310 |
| HPV33 | E6 | 9 | 92 | VKKPLNEIL | 19311 |
| HPV33 | E6 | 10 | 92 | VKKPLNEILI | 19312 |
| HPV33 | E6 | 9 | 140 | WRSRRRETA | 19313 |
| HPV33 | E6 | 10 | 140 | WRSRRRETAL | 19314 |
| HPV33 | E6 | 9 | 54 | YREGNPFGI | 19315 |
| HPV33 | E6 | 8 | 76 | YRHYNYSV | 19316 |
| HPV33 | E6 | 9 | 76 | YRHYNYSVY | 19317 |
| HPV33 | E7 | 8 | 58 | CHTCNTYV | 19318 |
| HPV33 | E7 | 10 | 58 | CHTCNTUVRL | 19319 |
| HPV33 | E7 | 10 | 39 | DRPDGQAQPA | 19320 |
| HPV33 | E7 | 9 | 3 | GHKPTLKEY | 19321 |
| HPV33 | E7 | 10 | 3 | GHKPTLKEYV | 19322 |
| HPV33 | E7 | 11 | 3 | GHKPTLKEYVL | 19323 |
| HPV33 | E7 | 8 | 4 | HKPTLKEY | 19324 |
| HPV33 | E7 | 9 | 4 | HKPTLKEYV | 19325 |
| HPV33 | E7 | 10 | 4 | HKPTLKEYVL | 19326 |
| HPV33 | E7 | 8 | 8 | LKEYVLDL | 19327 |
| HPV33 | E7 | 9 | 8 | LKEYVLDLY | 19328 |
| HPV33 | E7 | 8 | 76 | LRTIQQLL | 19329 |
| HPV33 | E7 | 9 | 76 | LRTIQQLLM | 19330 |
| HPV33 | E7 | 8 | 1 | MRGHKPTL | 19331 |
| HPV33 | E7 | 11 | 1 | MRGHKPTLKEY | 19332 |
| HPV33 | E7 | 9 | 65 | VRLCVNSTA | 19333 |
| HPV33 | L1 | 9 | 58 | AKKLLVPKV | 19334 |
| HPV33 | L1 | 8 | 475 | AKPKLKRA | 19335 |
| HPV33 | L1 | 9 | 475 | AKPKLKRAA | 19336 |
| HPV33 | L1 | 9 | 162 | CKPPTGEHW | 19337 |
| HPV33 | L1 | 9 | 378 | CKVTLTAEV | 19338 |
| HPV33 | L1 | 10 | 378 | CKVTLTAEVM | 19339 |
| HPV33 | L1 | 9 | 229 | CKYPDYLKM | 19340 |
| HPV33 | L1 | 8 | 168 | EHWGKGVA | 19341 |
| HPV33 | L1 | 9 | 435 | EKEDPLGKY | 19342 |
| HPV33 | L1 | 11 | 435 | EKEDPLGKYUF | 19343 |
| HPV33 | L1 | 10 | 452 | EKFSADLDQF | 19344 |
| HPV33 | L1 | 8 | 359 | FKEYIRHV | 19345 |
| HPV33 | L1 | 11 | 359 | FKEYIRHVEEY | 19346 |
| HPV33 | L1 | t1 | 210 | FKTLQANKSDV | 19347 |
| HPV33 | L1 | 11 | 74 | FRVRLPDPNKF | 19348 |
| HPV33 | L1 | 8 | 318 | GHNNGICW | 19349 |
| HPV33 | L1 | 8 | 120 | GHPLLNKF | 19350 |
| HPV33 | L1 | 9 | 171 | GKGVACTNA | 19351 |

TABLE XI-continued

| | | | | | |
|---|---|---|---|---|---|
| HPV33 | L1 | 10 | 171 | GKGVACTNAA | 19352 |
| HPV33 | L1 | 8 | 441 | GKYTFWEV | 19353 |
| HPV33 | L1 | 10 | 441 | GKYTFWEVDL | 19354 |
| HPV33 | L1 | 8 | 109 | GRGQPLGV | 19355 |
| HPV33 | L1 | 10 | 109 | GRGQPLGVGI | 19356 |
| HPV33 | L1 | 8 | 464 | GRKFLLQA | 19357 |
| HPV33 | L1 | 10 | 464 | GRKFLLQAGL | 19358 |
| HPV33 | L1 | 8 | 390 | IHAMNPDI | 19359 |
| HPV33 | L1 | 9 | 390 | IHAMNPDIL | 19360 |
| HPV33 | L1 | 8 | 277 | IKGSGTTA | 19361 |
| HPV33 | L1 | 10 | 277 | IKGSGTTASI | 19362 |
| HPV33 | L1 | 10 | 52 | IKNPTNAKKL | 19363 |
| HPV33 | L1 | 11 | 52 | IKNPTNAKKLL | 19364 |
| HPV33 | L1 | 9 | 363 | IRHVEEYDL | 19365 |
| HPV33 | L1 | 11 | 363 | IRHVEEYDLQF | 19366 |
| HPV33 | L1 | 8 | 59 | KKLLVPKV | 19367 |
| HPV33 | L1 | 11 | 59 | KKLLVPKVSGL | 19368 |
| HPV33 | L1 | 10 | 473 | LKAKPKLKRA | 19369 |
| HPV33 | L1 | 11 | 473 | LKAKPKLKRAA | 19370 |
| HPV33 | L1 | 9 | 450 | LKEKFSADL | 19371 |
| HPV33 | L1 | 8 | 235 | LKMTSEPY | 19372 |
| HPV33 | L1 | 8 | 250 | LRREQMFV | 19373 |
| HPV33 | L1 | 11 | 250 | LRREQMFVRHF | 19374 |
| HPV33 | L1 | 10 | 82 | NKFGFPDTSF | 19375 |
| HPV33 | L1 | 11 | 82 | NKFGFPDTSFY | 19376 |
| HPV33 | L1 | 9 | 308 | NKPYWLQRA | 19377 |
| HPV33 | L1 | 9 | 216 | NKSDVPIDI | 19378 |
| HPV33 | L1 | 9 | 134 | NKYPGQPGA | 19379 |
| HPV33 | L1 | 9 | 262 | NRAGTLGEA | 19380 |
| HPV33 | L1 | 10 | 262 | NRAGTLGEAV | 19381 |
| HPV33 | L1 | 9 | 144 | NRECLSMDY | 19382 |
| HPV33 | L1 | 8 | 433 | PKEKEDPL | 19383 |
| HPV33 | L1 | 11 | 433 | PKEKEDPLGKY | 19384 |
| HPV33 | L1 | 8 | 64 | PKVSGLQY | 19385 |
| HPV33 | L1 | 10 | 64 | PKVSGLQYRV | 19386 |
| HPV33 | L1 | 11 | 64 | PKVSGLQYRVF | 19387 |
| HPV33 | L1 | 10 | 314 | QRAQGHNNGI | 19388 |
| HPV33 | L1 | 8 | 97 | QRLVWACV | 19389 |
| HPV33 | L1 | 10 | 97 | QRLVWACVGL | 19390 |
| HPV33 | L1 | 10 | 258 | RIIFFNRAGTL | 19391 |
| HPV33 | L1 | 8 | 364 | RHVEEYDL | 19392 |
| HPV33 | L1 | 10 | 364 | RHVEEYDLQF | 19393 |
| HPV33 | L1 | 11 | 364 | RHVEEYDLQFV | 19394 |
| HPV33 | L1 | 9 | 465 | RKFLLQAGL | 19395 |
| HPV33 | L1 | 11 | 465 | RKFLLQAGLKA | 19396 |
| HPV33 | L1 | 10 | 251 | RREQMFVRIIF | 19397 |
| HPV33 | L1 | 11 | 251 | RREQMFVRIIFF | 19398 |
| HPV33 | L1 | 9 | 19 | SKVVSTDEY | 19399 |
| HPV33 | L1 | 10 | 19 | SKVVSTDEYV | 19400 |
| HPV33 | L1 | 10 | 40 | SRLLAVGHPY | 19401 |
| HPV33 | L1 | 11 | 40 | SRLLAVGHPYF | 19402 |
| HPV33 | L1 | 8 | 29 | SRTSIYYY | 19403 |
| HPV33 | L1 | 9 | 29 | SRTSIYYYA | 19404 |
| HPV33 | L1 | 8 | 337 | TRSTNMTL | 19405 |
| HPV33 | L1 | 11 | 487 | TRTSSAKRKKV | 19406 |
| HPV33 | L1 | 8 | 257 | VRHFFNRA | 19407 |
| HPV33 | L1 | 11 | 257 | VRHFFNRAGTL | 19408 |
| HPV33 | L1 | 9 | 76 | VRLPDPNKF | 19409 |
| HPV33 | L1 | 11 | 76 | VRLPDPNKFGF | 19410 |
| HPV33 | L1 | 8 | 4 | WRPSEATV | 19411 |
| HPV33 | L1 | 9 | 4 | WRPSEATVY | 19412 |
| HPV33 | L1 | 10 | 4 | WRPSEATVYL | 19413 |
| HPV33 | L1 | 9 | 354 | YKNENFKEY | 19414 |
| HPV33 | L1 | 10 | 354 | YKNENFKEYI | 19415 |
| HPV33 | L1 | 8 | 152 | YKQTQLCL | 19416 |
| HPV33 | L1 | 9 | 152 | YKQTQLCLL | 19417 |
| HPV33 | L1 | 8 | 417 | YRFVTSQA | 19418 |
| HPV33 | L1 | 9 | 417 | YRFVTSQAI | 19419 |
| HPV33 | L1 | 8 | 71 | YRVFRVRL | 19420 |
| HPV33 | L2 | 9 | 320 | ARIHYYQDL | 19421 |
| HPV33 | L2 | 11 | 21 | CKATGTCPPDV | 19422 |
| HPV33 | L2 | 9 | 335 | DHTVPNEQY | 19423 |
| HPV33 | L2 | 11 | 335 | DHTVPNEQYEL | 19424 |
| HPV33 | L2 | 10 | 179 | GHFIFSSPTV | 19425 |
| HPV33 | L2 | 8 | 315 | GKQIGARI | 19426 |
| HPV33 | L2 | 10 | 315 | GKQIGARIHY | 19427 |
| HPV33 | L2 | 11 | 315 | GKQIGARIHYY | 19428 |
| HPV33 | L2 | 8 | 67 | GRTGYVPI | 19429 |
| HPV33 | L2 | 10 | 247 | HKLITYDNPA | 19430 |

TABLE XI-continued

| | | | | | |
|---|---|---|---|---|---|
| HPV33 | L2 | 11 | 247 | HKLITYDNPAF | 19431 |
| HPV33 | L2 | 10 | 3 | HKRSTRRKRA | 19432 |
| HPV33 | L2 | 10 | 322 | IHYYQDLSPI | 19433 |
| HPV33 | L2 | 11 | 322 | IHYYQDLSPIV | 19434 |
| HPV33 | L2 | 10 | 88 | IRPPVTVDTV | 19435 |
| HPV33 | L2 | 8 | 10 | KRASATQL | 19436 |
| HPV33 | L2 | 9 | 10 | KRASATQLY | 19437 |
| HPV33 | L2 | 10 | 454 | KRFPYFFTDV | 19438 |
| HPV33 | L2 | 9 | 4 | KRSTRRRRA | 19439 |
| HPV33 | L2 | 11 | 4 | KRSTRRKRASA | 19440 |
| HPV33 | L2 | 9 | 348 | LHDTSTSSY | 19441 |
| HPV33 | L2 | 11 | 348 | LHDTSTSSYSI | 19442 |
| HPV33 | L2 | 9 | 169 | LHPPAPAEA | 19443 |
| HPV33 | L2 | 8 | 442 | LHPSYFIL | 19444 |
| HPV33 | L2 | 9 | 310 | LKTRSGKQI | 19445 |
| HPV33 | L2 | 11 | 310 | LKTRSGKQIGA | 19446 |
| HPV33 | L2 | 8 | 45 | LKYGSLGV | 19447 |
| HPV33 | L2 | 9 | 45 | LKYGSLGVF | 19448 |
| HPV33 | L2 | 10 | 45 | LKYGSLGVFF | 19449 |
| HPV33 | L2 | 8 | 449 | LRRRRKRF | 19450 |
| HPV33 | L2 | 10 | 449 | LRRRRKRFPY | 19451 |
| HPV33 | L2 | 11 | 449 | LRRRRKRFPYF | 19452 |
| HPV33 | L2 | 11 | 246 | PHKLITYDNPA | 19453 |
| HPV33 | L2 | 8 | 33 | PKVEGSTI | 19454 |
| HPV33 | L2 | 9 | 33 | PKVEGSTIA | 19455 |
| HPV33 | L2 | 8 | 269 | QHSDISPA | 19456 |
| HPV33 | L2 | 8 | 378 | QHSYSTFA | 19457 |
| HPV33 | L2 | 11 | 2 | RHKRSTRRRRA | 19458 |
| HPV33 | L2 | 9 | 296 | RHTVRFSRV | 19459 |
| HPV33 | L2 | 9 | 9 | RKRASATQL | 19460 |
| HPV33 | L2 | 10 | 9 | RKRASATQLY | 19461 |
| HPV33 | L2 | 8 | 453 | RKRFPYFF | 19462 |
| HPV33 | L2 | 11 | 453 | RKRFPYFFTDV | 19463 |
| HPV33 | L2 | 10 | 295 | RRHTVRFSRV | 19464 |
| HPV33 | L2 | 10 | 8 | RRKRASATQL | 19465 |
| HPV33 | L2 | 11 | 8 | RRKRASATQLY | 19466 |
| HPV33 | L2 | 8 | 452 | RRKRFPYF | 19467 |
| HPV33 | L2 | 9 | 452 | RRKRFPYFF | 19468 |
| HPV33 | L2 | 8 | 451 | RRRKRFPY | 19469 |
| HPV33 | L2 | 9 | 451 | RRRKRFPYF | 19470 |
| HPV33 | L2 | 10 | 451 | RRRKRFPYFF | 19471 |
| HPV33 | L2 | 9 | 450 | RRRRKRFPY | 19472 |
| HPV33 | L2 | 10 | 450 | RRRRKRFPYF | 19473 |
| HPV33 | L2 | 11 | 450 | RRRRKRFPYFF | 19474 |
| HPV33 | L2 | 9 | 229 | SRNTQQVKV | 19475 |
| HPV33 | L2 | 10 | 229 | SRNTQQVKVV | 19476 |
| HPV33 | L2 | 9 | 219 | SHPVARLGL | 19477 |
| HPV33 | L2 | 10 | 219 | SHPVARLGLY | 19478 |
| HPV33 | L2 | 8 | 294 | SRRHTVRF | 19479 |
| HPV33 | L2 | 11 | 294 | SRRHTVRFSRV | 19480 |
| HPV33 | L2 | 9 | 302 | SRVGQKATL | 19481 |
| HPV33 | L2 | 8 | 7 | TRRKRASA | 19482 |
| HPV33 | L2 | 11 | 7 | TRRKRASATQL | 19483 |
| HPV33 | L2 | 9 | 312 | TRSGKQIGA | 19484 |
| HPV33 | L2 | 11 | 312 | TRSGKQIGARI | 19485 |
| HPV33 | L2 | 8 | 387 | TRTSNVSI | 19486 |
| HPV33 | L2 | 10 | 387 | TRTSNVSIPL | 19487 |
| HPV33 | L2 | 9 | 373 | VHTPMQHSY | 19488 |
| HPV33 | L2 | 8 | 235 | VKVVDPAF | 19489 |
| HPV33 | L2 | 9 | 235 | VKVVDPAFL | 19490 |
| HPV33 | L2 | 10 | 299 | VRFSRVGQKA | 19491 |
| HPV45 | E1 | 10 | 255 | AHIQCLDCKW | 19492 |
| HPV45 | E1 | 8 | 564 | AKDNKWPY | 19493 |
| HPV45 | E1 | 9 | 564 | AKDNKWPYL | 19494 |
| HPV45 | E1 | 8 | 284 | AKGLSTLL | 19495 |
| HPV45 | E1 | 10 | 284 | AKGLSTLLHV | 19496 |
| HPV45 | E1 | 8 | 125 | AKRRLFTI | 19497 |
| HPV45 | E1 | 8 | 392 | AKYLKDCA | 19498 |
| HPV45 | E1 | 9 | 392 | AKYLKDCAV | 19499 |
| HPV45 | E1 | 10 | 392 | AKYLKDCAVM | 19500 |
| HPV45 | E1 | 8 | 262 | CKWGVLIL | 19501 |
| HPV45 | E1 | 9 | 262 | CKWGVLILA | 19502 |
| HPV45 | E1 | 10 | 262 | CKWGVLILAL | 19503 |
| HPV45 | E1 | 11 | 262 | CKWGVLILALL | 19504 |
| HPV45 | E1 | 8 | 588 | DKNGNPVY | 19505 |
| HPV45 | E1 | 10 | 588 | DKNGNPVYEI | 19506 |
| HPV45 | E1 | 8 | 599 | DKNWKCFF | 19507 |
| HPV45 | E1 | 8 | 222 | DKTTCTDW | 19508 |
| HPV45 | E1 | 9 | 222 | DKTFCTDWV | 19509 |

TABLE XI-continued

| | | | | | |
|---|---|---|---|---|---|
| HPV45 | E1 | 10 | 222 | DKTTCTDWVM | 19510 |
| HPV45 | E1 | 11 | 222 | DKTTCTDWVMA | 19511 |
| HPV45 | E1 | 8 | 541 | DRKHKPLL | 19512 |
| HPV45 | E1 | 10 | 541 | DRKHKPLLQL | 19513 |
| HPV45 | E1 | 8 | 25 | EKKTGDVI | 19514 |
| HPV45 | E1 | 9 | 607 | ERTWSRLDL | 19515 |
| HPV45 | E1 | 10 | 70 | FHAQEVQNDA | 19516 |
| HPV45 | E1 | 9 | 204 | FKDIYGLSF | 19517 |
| HPV45 | E1 | 11 | 219 | FKSDKTTCTDW | 19518 |
| HPV45 | E1 | 8 | 244 | FKTLIKPA | 19519 |
| HPV45 | E1 | 10 | 244 | FKTLIKPATL | 19520 |
| HPV45 | E1 | 11 | 244 | FKTLIKPATLY | 19521 |
| HPV45 | E1 | 9 | 121 | GHKKAKRRL | 19522 |
| HPV45 | E1 | 10 | 121 | GHKKARRRLF | 19523 |
| HPV45 | E1 | 8 | 277 | GKNRLTVA | 19524 |
| HPV45 | E1 | 11 | 277 | GKNRLTVAKGL | 19525 |
| HPV45 | E1 | 9 | 475 | GKSYFGMSF | 19526 |
| HPV45 | E1 | 10 | 475 | GKSYFGMSFI | 19527 |
| HPV45 | E1 | 8 | 122 | HKKAKRRL | 19528 |
| HPV45 | E1 | 9 | 122 | RKKAKRRLF | 19529 |
| HPV45 | E1 | 11 | 122 | HKKAKRRLFFI | 19530 |
| HPV45 | E1 | 8 | 484 | IHFLQGAI | 19531 |
| HPV45 | E1 | 9 | 484 | IHFLQGAII | 19532 |
| HPV45 | E1 | 11 | 484 | IHFLQGMISF | 19533 |
| HPV45 | E1 | 8 | 248 | IKPATLYA | 19534 |
| HPV45 | E1 | 10 | 248 | IKPATLYAHI | 19535 |
| HPV45 | E1 | 8 | 419 | IKYRCSKI | 19536 |
| HPV45 | E1 | 8 | 543 | KIIKPLLQL | 19537 |
| HPV45 | E1 | 8 | 196 | KAAAMLAV | 19538 |
| HPV45 | E1 | 9 | 196 | KKAAMLAVF | 19539 |
| HPV45 | E1 | 8 | 123 | KKAKRRLF | 19540 |
| HPV45 | E1 | 10 | 123 | KAAKRRLFTI | 19541 |
| HPV45 | E1 | 8 | 462 | KKNCILLY | 19542 |
| HPV45 | E1 | 11 | 462 | KKNCWLYGPA | 19543 |
| HPV45 | E1 | 8 | 406 | KRAQKRQM | 19544 |
| HPV45 | E1 | 10 | 406 | KRAQKRQMNM | 19545 |
| HPV45 | E1 | 9 | 410 | KRQMNMSQW | 19546 |
| HPV45 | E1 | 10 | 410 | KRQMNMSQWI | 19547 |
| HPV45 | E1 | 8 | 615 | LHEDDEDA | 19548 |
| HPV45 | E1 | 8 | 82 | LHLLKRKF | 19549 |
| HPV45 | E1 | 9 | 82 | LHLLKRKPA | 19550 |
| HPV45 | E1 | 8 | 291 | LHVPETCM | 19551 |
| HPV45 | E1 | 9 | 291 | LHVPETCML | 19552 |
| HPV45 | E1 | 10 | 291 | LHVPETCMLI | 19553 |
| HPV45 | E1 | 8 | 550 | LKCPPWL | 19554 |
| HPV45 | E1 | 11 | 395 | LKDCAVMCRHY | 19555 |
| HPV45 | E1 | 10 | 457 | LKGTPKKNCI | 19556 |
| HPV45 | E1 | 11 | 457 | LKGTPKKNCIL | 19557 |
| HPV45 | E1 | 9 | 386 | LKSNCQAKY | 19558 |
| HPV45 | E1 | 10 | 386 | LKSNCQAKYL | 19559 |
| HPV45 | E1 | 8 | 450 | LRALKEFL | 19560 |
| HPV45 | E1 | 8 | 305 | LRSSVAAL | 19561 |
| HPV45 | E1 | 9 | 305 | LRSSVAALY | 19562 |
| HPV45 | E1 | 10 | 305 | LRSSVAALYW | 19563 |
| HPV45 | E1 | 11 | 305 | LRSSVAALYWY | 19564 |
| HPV45 | E1 | 10 | 272 | LRYKCGKNRL | 19565 |
| HPV45 | E1 | 8 | 439 | LRYQGVEF | 19566 |
| HPV45 | E1 | 9 | 439 | LRYQGVEFI | 19567 |
| HPV45 | E1 | 11 | 439 | LRYQGVEPISF | 19568 |
| HPV45 | E1 | 10 | 529 | MRNALDGNPI | 19569 |
| HPV45 | E1 | 8 | 195 | NKKAAMLA | 19570 |
| HPV45 | E1 | 9 | 195 | NKKAAMLAV | 19571 |
| HPV45 | E1 | 10 | 195 | NKKAAMLAVF | 19572 |
| HPV45 | E1 | 10 | 567 | NKWPYLESRV | 19573 |
| HPV45 | E1 | 9 | 279 | NRLTVAKGL | 19574 |
| HPV45 | E1 | 8 | 180 | PHCSITEL | 19575 |
| HPV45 | E1 | 11 | 180 | PHCSITELKEL | 19576 |
| HPV45 | E1 | 8 | 461 | PKKNCILL | 19577 |
| HPV45 | E1 | 9 | 461 | PKKNCILLY | 19578 |
| HPV45 | E1 | 8 | 303 | PKLRSSVA | 19579 |
| HPV45 | E1 | 9 | 303 | PKLRSSVAA | 19580 |
| HPV45 | E1 | 10 | 303 | PKLRSSVAAL | 19581 |
| HPV45 | E1 | 11 | 303 | PKLRSSVAALY | 19582 |
| HPV45 | E1 | 8 | 111 | PRLQEISL | 19583 |
| HPV45 | E1 | 9 | 340 | QHGIDDSNF | 19584 |
| HPV45 | E1 | 11 | 340 | QHGIDDSNFDL | 19585 |
| HPV45 | E1 | 10 | 409 | QKRQMNMSQW | 19586 |
| HPV45 | E1 | 11 | 409 | QKRQMNMSQWI | 19587 |
| HPV45 | E1 | 10 | 334 | QRLTIIQHGI | 19588 |

TABLE XI-continued

| | | | | | |
|---|---|---|---|---|---|
| HPV45 | E1 | 11 | 403 | RHYKRAQKRQM | 19589 |
| HPV45 | E1 | 9 | 542 | RKHKPLLQL | 19590 |
| HPV45 | E1 | 11 | 127 | RRLFTISDSGY | 19591 |
| HPV45 | E1 | 8 | 499 | SHFWLEPL | 19592 |
| HPV45 | E1 | 9 | 499 | SHFWLEPLA | 19593 |
| HPV45 | E1 | 11 | 93 | SKENSPLGEQL | 19594 |
| HPV45 | E1 | 9 | 424 | SKIDEGGDW | 19595 |
| HPV45 | E1 | 8 | 574 | SRVTVFTF | 19596 |
| HPV45 | E1 | 11 | 574 | SRVTVFTFPHA | 19597 |
| HPV45 | E1 | 8 | 518 | THTCWTYF | 19598 |
| HPV45 | E1 | 11 | 518 | THTCWTYFDNY | 19599 |
| HPV45 | E1 | 9 | 509 | TKVAMLDDA | 19600 |
| HPV45 | E1 | 9 | 602 | WKCFFERTW | 19601 |
| HPV45 | E1 | 8 | 432 | WRPIVQFL | 19602 |
| HPV45 | E1 | 10 | 432 | WRPIVQFLRY | 19603 |
| HPV45 | E1 | 8 | 274 | YKCGKNRL | 19604 |
| HPV45 | E1 | 10 | 274 | YKCGKNRLTV | 19605 |
| HPV45 | E1 | 11 | 274 | YKCGKNRLTVA | 19606 |
| HPV45 | E1 | 9 | 405 | YKRAQKRQM | 19607 |
| HPV45 | E1 | 11 | 405 | YKRAQKRQMNM | 19608 |
| HPV45 | E1 | 8 | 315 | YRTGISNI | 19609 |
| HPV45 | E1 | 11 | 315 | YRTGISNISEV | 19610 |
| HPV45 | E2 | 9 | 75 | AHKAIELQM | 19611 |
| HPV45 | E2 | 10 | 75 | AHKMELQMA | 19612 |
| HPV45 | E2 | 11 | 75 | AHKMELQMAL | 19613 |
| HPV45 | E2 | 9 | 52 | AREHGITKL | 19614 |
| HPV45 | E2 | 10 | 23 | DHYENDSKDI | 19615 |
| HPV45 | E2 | 10 | 315 | DHYSEISSTW | 19616 |
| HPV45 | E2 | 8 | 299 | DKNSLKCL | 19617 |
| HPV45 | E2 | 10 | 299 | DKNSLKCLRY | 19618 |
| HPV45 | E2 | 9 | 153 | DKTAACVSY | 19619 |
| HPV45 | E2 | 10 | 153 | DKTAACVSYW | 19620 |
| HPV45 | E2 | 11 | 54 | EHGITKLNHQV | 19621 |
| HPV45 | E2 | 9 | 183 | EKYGNSNTW | 19622 |
| HPV45 | E2 | 11 | 183 | EKYGNSNTWEV | 19623 |
| HPV45 | E2 | 10 | 12 | ERLSALQDKI | 19624 |
| HPV45 | E2 | 11 | 12 | ERLSALQDKIL | 19625 |
| HPV45 | E2 | 8 | 116 | FKKGGKTV | 19626 |
| HPV45 | E2 | 10 | 116 | FKKGGKTVHV | 19627 |
| HPV45 | E2 | 11 | 116 | FKKGGKTVHVY | 19628 |
| HPV45 | E2 | 8 | 178 | FKSECEKY | 19629 |
| HPV45 | E2 | 8 | 120 | GKTVHVYF | 19630 |
| HPV45 | E2 | 11 | 262 | GRVNTHVHNPL | 19631 |
| HPV45 | E2 | 9 | 260 | HHGRVNTHV | 19632 |
| HPV45 | E2 | 8 | 76 | HKAIELQM | 19633 |
| HPV45 | E2 | 9 | 76 | HKAIELQMA | 19634 |
| HPV45 | E2 | 10 | 76 | HKAIELQMAL | 19635 |
| HPV45 | E2 | 10 | 294 | IHLKGDKNSL | 19636 |
| HPV45 | E2 | 8 | 167 | IKDGDTTY | 19637 |
| HPV45 | E2 | 9 | 167 | IKDGDTTYY | 19638 |
| HPV45 | E2 | 10 | 167 | IKDGDTTYYV | 19639 |
| HPV45 | E2 | 8 | 42 | IRLENAIL | 19640 |
| HPV45 | E2 | 9 | 42 | IRLENAILF | 19641 |
| HPV45 | E2 | 11 | 42 | IRLENAILFTA | 19642 |
| HPV45 | E2 | 9 | 117 | KKGGKTVHV | 19643 |
| HPV45 | E2 | 10 | 117 | KKGGKTVHVY | 19644 |
| HPV45 | E2 | 11 | 117 | KKGGKTVHVYF | 19645 |
| HPV45 | E2 | 8 | 249 | KRPRQCGL | 19646 |
| HPV45 | E2 | 8 | 303 | LKCLRYRL | 19647 |
| HPV45 | E2 | 11 | 303 | LKCLRYRLRKY | 19648 |
| HPV45 | E2 | 8 | 296 | LKGDKNSL | 19649 |
| HPV45 | E2 | 11 | 296 | LKGDKNSLKCL | 19650 |
| HPV45 | E2 | 9 | 85 | LKGLAQSKY | 19651 |
| HPV45 | E2 | 8 | 310 | LRKYADHY | 19652 |
| HPV45 | E2 | 11 | 310 | LRKYADHYSEI | 19653 |
| HPV45 | E2 | 8 | 306 | LRYRLRKY | 19654 |
| HPV45 | E2 | 9 | 306 | LRYRLRKYA | 19655 |
| HPV45 | E2 | 10 | 1 | MKMQTPKESL | 19656 |
| HPV45 | E2 | 8 | 61 | NHQVVPPI | 19657 |
| HPV45 | E2 | 10 | 61 | NHQVVPPINI | 19658 |
| HPV45 | E2 | 8 | 130 | NKDNCMNY | 19659 |
| HPV45 | E2 | 9 | 130 | NKDNCMNYV | 19660 |
| HPV45 | E2 | 10 | 130 | NKDNCMNYVV | 19661 |
| HPV45 | E2 | 11 | 130 | NKDNCMYYVVW | 19662 |
| HPV45 | E2 | 9 | 330 | NKNTGILTV | 19663 |
| HPV45 | E2 | 11 | 330 | NKNTGILTVTY | 19664 |
| HPV45 | E2 | 9 | 6 | PKESLSERL | 19665 |
| HPV45 | E2 | 11 | 6 | PKESLSERLSA | 19666 |
| HPV45 | E2 | 9 | 239 | PKPHIQTPA | 19667 |

TABLE XI-continued

| | | | | | |
|---|---|---|---|---|---|
| HPV45 | E2 | 11 | 224 | QHASTSTPKTA | 19668 |
| HPV45 | E2 | 10 | 259 | QHHGRVNTHV | 19669 |
| HPV45 | E2 | 8 | 345 | QRNTFLDV | 19670 |
| HPV45 | E2 | 9 | 345 | QRNTFLDVV | 19671 |
| HPV45 | E2 | 11 | 345 | QRNTFLDVVTI | 19672 |
| HPV45 | E2 | 11 | 283 | RKVCSGNTTPI | 19673 |
| HPV45 | E2 | 10 | 311 | RKYADHYSEI | 19674 |
| HPV45 | E2 | 9 | 73 | SKAHKAIEL | 19675 |
| HPV45 | E2 | 11 | 73 | SKAHKAIELQM | 19676 |
| HPV45 | E2 | 8 | 29 | SKDINSQI | 19677 |
| HPV45 | E2 | 10 | 29 | SKDINSQISY | 19678 |
| HPV45 | E2 | 11 | 29 | SKDINSQISYW | 19679 |
| HPV45 | E2 | 8 | 71 | SKSKAHKA | 19680 |
| HPV45 | E2 | 9 | 71 | SKSKAHKAI | 19681 |
| HPV45 | E2 | 11 | 71 | SKSKAHKAIEL | 19682 |
| HPV45 | E2 | 8 | 91 | SKYNNEEW | 19683 |
| HPV45 | E2 | 10 | 91 | SKYNNEEWTL | 19684 |
| HPV45 | E2 | 8 | 266 | THVHNPLL | 19685 |
| HPV45 | E2 | 8 | 58 | TKLNHQVV | 19686 |
| HPV45 | E2 | 11 | 58 | TKLNHQVVPPI | 19687 |
| HPV45 | E2 | 9 | 248 | TKRPRQCGL | 19688 |
| HPV45 | E2 | 10 | 308 | YRLRKYADHY | 19689 |
| HPV45 | E6 | 11 | 2 | ARFDDPTQRPY | 19690 |
| HPV45 | E6 | 8 | 65 | CHKCIDFY | 19691 |
| HPV45 | E6 | 11 | 65 | CHKCIDFYSRI | 19692 |
| HPV45 | E6 | 10 | 35 | CKATLERTEV | 19693 |
| HPV45 | E6 | 11 | 35 | CKATLERTEVY | 19694 |
| HPV45 | E6 | 8 | 123 | DKRRFHSI | 19695 |
| HPV45 | E6 | 9 | 123 | DKRRFHSIA | 19696 |
| HPV45 | E6 | 8 | 91 | EKITNTEL | 19697 |
| HPV45 | E6 | 9 | 91 | EKITNTELY | 19698 |
| HPV45 | E6 | 11 | 91 | EKITNTELYNL | 19699 |
| HPV45 | E6 | 11 | 148 | ERLRRRETQV | 19700 |
| HPV45 | E6 | 8 | 40 | ERTEVYQF | 19701 |
| HPV45 | E6 | 9 | 40 | ERTEVYQFA | 19702 |
| HPV45 | E6 | 10 | 40 | ERTEVYQFAF | 19703 |
| HPV45 | E6 | 8 | 127 | FHSIAGQY | 19704 |
| HPV45 | E6 | 8 | 49 | FKDLFIVY | 19705 |
| HPV45 | E6 | 10 | 66 | HKCIDFYSRI | 19706 |
| HPV45 | E6 | 10 | 103 | IRCLRCQKPL | 19707 |
| HPV45 | E6 | 11 | 75 | IRELRYYSNSV | 19708 |
| HPV45 | E6 | 8 | 124 | KRRFHSIA | 19709 |
| HPV45 | E6 | 11 | 124 | KRRFHSIAGQY | 19710 |
| HPV45 | E6 | 11 | 117 | KRRHLKDKRRF | 19711 |
| HPV45 | E6 | 10 | 121 | LKDKRRFHSI | 19712 |
| HPV45 | E6 | 11 | 121 | LKDKRRFHSIA | 19713 |
| HPV45 | E6 | 10 | 106 | LRCQKPLNPA | 19714 |
| HPV45 | E6 | 9 | 150 | LRRRRETQV | 19715 |
| HPV45 | E6 | 8 | 78 | LRYYSNSV | 19716 |
| HPV45 | E6 | 9 | 78 | LRYYSNSVY | 19717 |
| HPV45 | E6 | 9 | 9 | QRPYKLPDL | 19718 |
| HPV45 | E6 | 9 | 119 | RHLKDKRRF | 19719 |
| HPV45 | E6 | 10 | 125 | RRFHSIAGQY | 19720 |
| HPV45 | E6 | 10 | 118 | RRHLKDKRRF | 19721 |
| HPV45 | E6 | 8 | 151 | RRRRETQV | 19722 |
| HPV45 | E6 | 8 | 73 | SRIRELRY | 19723 |
| HPV45 | E6 | 9 | 73 | SRIRELRYY | 19724 |
| HPV45 | E6 | 10 | 12 | YKLPDLGFLL | 19725 |
| HPV45 | E6 | 8 | 56 | YRDCIAYA | 19726 |
| HPV45 | E6 | 9 | 56 | YRDCIAYAA | 19727 |
| HPV45 | E7 | 11 | 52 | ARRAEPQRRKI | 19728 |
| HPV45 | E7 | 9 | 67 | CKCDGRIEL | 19729 |
| HPV45 | E7 | 11 | 67 | CKCDGRIELTV | 19730 |
| HPV45 | E7 | 11 | 71 | GRIELTVESSA | 19731 |
| HPV45 | E7 | 9 | 13 | LHLEPQNEL | 19732 |
| HPV45 | E7 | 8 | 84 | LRTLQQLF | 19733 |
| HPV45 | E7 | 9 | 84 | LRTLQQLFL | 19734 |
| HPV45 | E7 | 8 | 1 | MHGPRATL | 19735 |
| HPV45 | E7 | 11 | 1 | MHGPRATLQEI | 19736 |
| HPV45 | E7 | 8 | 4 | PRATLQEI | 19737 |
| HPV45 | E7 | 9 | 4 | PRATLQEIV | 19738 |
| HPV45 | E7 | 10 | 4 | PRATLQEIVL | 19739 |
| HPV45 | E7 | 8 | 58 | QRHKILCV | 19740 |
| HPV45 | E7 | 10 | 53 | RRAEPQRHKI | 19741 |
| HPV45 | E7 | 11 | 53 | RRAEPQRHKIL | 19742 |
| HPV45 | E7 | 10 | 46 | SHAQLPARRA | 19743 |
| HPV45 | L1 | 8 | 159 | AHAATAVI | 19744 |
| HPV45 | L1 | 10 | 2 | AHNIIYGHGI | 19745 |
| HPV45 | L1 | 11 | 2 | AHNIIYGRGII | 19746 |

TABLE XI-continued

| | | | | | |
|---|---|---|---|---|---|
| HPV45 | L1 | 9 | 197 | AKGTLCKPA | 19747 |
| HPV45 | L1 | 11 | 197 | AKGTLCKPAQL | 19748 |
| HPV45 | L1 | 8 | 284 | ARHFWNRA | 19749 |
| HPV45 | L1 | 10 | 284 | ARHFWNRAGV | 19750 |
| HPV45 | L1 | 11 | 284 | ARHFWNRAGVM | 19751 |
| HPV45 | L1 | 9 | 45 | ARVVNTDDY | 19752 |
| HPV45 | L1 | 10 | 45 | ARVVNTDDYV | 19753 |
| HPV45 | L1 | 9 | 256 | CKYPDYLQM | 19754 |
| HPV45 | L1 | 11 | 256 | CKYPDYLQMSA | 19755 |
| HPV45 | L1 | 8 | 472 | DKLKFWTV | 19756 |
| HPV45 | L1 | 10 | 472 | DKLKFWTVDL | 19757 |
| HPV45 | L1 | 8 | 194 | EHWAKGTL | 19758 |
| HPV45 | L1 | 10 | 483 | EKFSSDLDQY | 19759 |
| HPV45 | L1 | 9 | 466 | EKQDPYDKL | 19760 |
| HPV45 | L1 | 11 | 466 | EKQDPYDKLKF | 19761 |
| HPV45 | L1 | 8 | 390 | FKHYSRHV | 19762 |
| HPV45 | L1 | 11 | 390 | FKHYSRHVEEY | 19763 |
| HPV45 | L1 | 11 | 100 | FRVALPDPNKF | 19764 |
| HPV45 | L1 | 8 | 76 | FRVVPSGA | 19765 |
| HPV45 | L1 | 8 | 8 | GHGIIIFL | 19766 |
| HPV45 | L1 | 11 | 8 | GHGIIIFLKNV | 19767 |
| HPV45 | L1 | 8 | 347 | GHNNGICW | 19768 |
| HPV45 | L1 | 8 | 146 | GHPFYNKL | 19769 |
| HPV45 | L1 | 8 | 135 | GRGQPLGI | 19770 |
| HPV45 | L1 | 10 | 135 | GRGQPLGIGL | 19771 |
| HPV45 | L1 | 8 | 495 | GRKFLVQA | 19772 |
| HPV45 | L1 | 10 | 495 | GRKFLVQAGL | 19773 |
| HPV45 | L1 | 10 | 343 | HKAQGHNNGI | 19774 |
| HPV45 | L1 | 8 | 421 | IHSMNSSI | 19775 |
| HPV45 | L1 | 9 | 421 | IHSMNSSIL | 19776 |
| HPV45 | L1 | 8 | 304 | IKGTSANM | 19777 |
| HPV45 | L1 | 10 | 391 | KHYSRHVEEY | 19778 |
| HPV45 | L1 | 10 | 514 | KRPAASTSTA | 19779 |
| HPV45 | L1 | 11 | 342 | LHKAQGHNNGI | 19780 |
| HPV45 | L1 | 9 | 481 | LKEKFSSDL | 19781 |
| HPV45 | L1 | 8 | 474 | LKFWTVDL | 19782 |
| HPV45 | L1 | 11 | 217 | LKNTIIEDGDM | 19783 |
| HPV45 | L1 | 9 | 15 | LKNVNVFPI | 19784 |
| HPV45 | L1 | 10 | 15 | LKNVNVFPIF | 19785 |
| HPV45 | L1 | 11 | 15 | LKNVNVFPIFL | 19786 |
| HPV45 | L1 | 8 | 277 | LRREQLFA | 19787 |
| HPV45 | L1 | 11 | 277 | LRREQLFARIIF | 19788 |
| HPV45 | L1 | 9 | 311 | MRETPGSCV | 19789 |
| HPV45 | L1 | 10 | 311 | MRETPGSCVY | 19790 |
| HPV45 | L1 | 10 | 108 | NKFGLPDSTI | 19791 |
| HPV45 | L1 | 11 | 108 | NKFGLPDSTIY | 19792 |
| HPV45 | L1 | 9 | 151 | NKLDDTESA | 19793 |
| HPV45 | L1 | 11 | 151 | NKLDDTESAHA | 19794 |
| HPV45 | L1 | 9 | 337 | NKPYWLHKA | 19795 |
| HPV45 | L1 | 8 | 85 | NKQAVPKV | 19796 |
| HPV45 | L1 | 10 | 85 | NKQAVPKVSA | 19797 |
| HPV45 | L1 | 11 | 85 | NKQAVPKVSAY | 19798 |
| HPV45 | L1 | 10 | 289 | NRAGVMGDTV | 19799 |
| HPV45 | L1 | 8 | 90 | PKVSAYQY | 19800 |
| HPV45 | L1 | 10 | 90 | PKVSAYQYRV | 19801 |
| HPV45 | L1 | 11 | 90 | PKVSAYQYRVF | 19802 |
| HPV45 | L1 | 8 | 123 | QRLVWACV | 19803 |
| HPV45 | L1 | 10 | 123 | QRLVWACVGM | 19804 |
| HPV45 | L1 | 9 | 285 | RHFWNRAGV | 19805 |
| HPV45 | L1 | 10 | 285 | RHFWNRAGVM | 19806 |
| HPV45 | L1 | 8 | 395 | RHVEEYDL | 19807 |
| HPV45 | L1 | 10 | 395 | RHVEEYDLQF | 19808 |
| HPV45 | L1 | 11 | 395 | RHVEEYDLQFI | 19809 |
| HPV45 | L1 | 9 | 496 | RKFLVQAGL | 19810 |
| HPV45 | L1 | 11 | 513 | RKRPAASTSTA | 19811 |
| HPV45 | L1 | 10 | 278 | RREQLFARHF | 19812 |
| HPV45 | L1 | 11 | 278 | RREQLFARHFW | 19813 |
| HPV45 | L1 | 9 | 394 | SRHVEEYDL | 19814 |
| HPV45 | L1 | 11 | 394 | SRHVEEYDLQF | 19815 |
| HPV45 | L1 | 10 | 66 | SRLLTVGNPY | 19816 |
| HPV45 | L1 | 11 | 66 | SRLLTVGNPYF | 19817 |
| HPV45 | L1 | 9 | 524 | SRPAKRVRI | 19818 |
| HPV45 | L1 | 9 | 55 | SRTSIFYHA | 19819 |
| HPV45 | L1 | 9 | 243 | TKCEVPLDI | 19820 |
| HPV45 | L1 | 10 | 388 | TKFKHYSRHV | 19821 |
| HPV45 | L1 | 8 | 366 | TRSTNLTL | 19822 |
| HPV45 | L1 | 10 | 366 | TRSTNLTLCA | 19823 |
| HPV45 | L1 | 9 | 170 | VRDNVSVDY | 19824 |
| HPV45 | L1 | 9 | 354 | WHNQLFVTV | 19825 |

TABLE XI-continued

| | | | | | |
|---|---|---|---|---|---|
| HPV45 | L1 | 10 | 354 | WHNQLFVTVV | 19826 |
| HPV45 | L1 | 8 | 30 | WRPSDSTV | 19827 |
| HPV45 | L1 | 9 | 30 | WRPSDSTVY | 19828 |
| HPV45 | L1 | 10 | 30 | WRPSDSTVYL | 19829 |
| HPV45 | L1 | 8 | 61 | YHAGSSRL | 19830 |
| HPV45 | L1 | 9 | 61 | YHAGSSRLL | 19831 |
| HPV45 | L1 | 11 | 61 | YHAGSSRLLTV | 19832 |
| HPV45 | L1 | 8 | 178 | YKQTQLCI | 19833 |
| HPV45 | L1 | 9 | 178 | YKQTQLCIL | 19834 |
| HPV45 | L1 | 8 | 448 | YRFVQSVA | 19835 |
| HPV45 | L1 | 9 | 448 | YRFVQSVAV | 19836 |
| HPV45 | L1 | 8 | 97 | YRVFRVAL | 19837 |
| HPV45 | L2 | 8 | 7 | ARRKRASA | 19838 |
| HPV45 | L2 | 11 | 7 | ARRKRASATDL | 19839 |
| HPV45 | L2 | 11 | 21 | CKQSGTCPPDV | 19840 |
| HPV45 | L2 | 9 | 42 | DKILQWSSL | 19841 |
| HPV45 | L2 | 11 | 42 | DKILQWSSLGI | 19842 |
| HPV45 | L2 | 8 | 310 | GKQIGGRV | 19843 |
| HPV45 | L2 | 10 | 310 | GKQIGGRVHF | 19844 |
| HPV45 | L2 | 11 | 310 | GKQIGGRVHFY | 19845 |
| HPV45 | L2 | 9 | 76 | GRSNTVVDV | 19846 |
| HPV45 | L2 | 8 | 67 | GRTGYVPL | 19847 |
| HPV45 | L2 | 9 | 315 | GRVIIFYHDI | 19848 |
| HPV45 | L2 | 9 | 365 | HKSFYYPKY | 19849 |
| HPV45 | L2 | 11 | 365 | HKSFYYPKYSL | 19850 |
| HPV45 | L2 | 9 | 4 | HRAARRKRA | 19851 |
| HPV45 | L2 | 11 | 4 | HRAARRKRASA | 19852 |
| HPV45 | L2 | 8 | 431 | IHGTQYYL | 19853 |
| HPV45 | L2 | 9 | 431 | IHGTQYYLW | 19854 |
| HPV45 | L2 | 11 | 431 | IHGTQYYLWPW | 19855 |
| HPV45 | L2 | 10 | 364 | IHKSFTYPKY | 19856 |
| HPV45 | L2 | 8 | 280 | IRLHRPAL | 19857 |
| HPV45 | L2 | 8 | 447 | KKRKRIPY | 19858 |
| HPV45 | L2 | 9 | 447 | KKRKRIPYF | 19859 |
| HPV45 | L2 | 10 | 447 | KKRKRIPYFF | 19860 |
| HPV45 | L2 | 11 | 447 | KKRKRIPYFFA | 19861 |
| HPV45 | L2 | 8 | 10 | KRASATDL | 19862 |
| HPV45 | L2 | 9 | 10 | KRASATDLY | 19863 |
| HPV45 | L2 | 8 | 450 | KRIPYFFA | 19864 |
| HPV45 | L2 | 11 | 450 | KRIPYFFADGF | 19865 |
| HPV45 | L2 | 8 | 448 | KRKRIPYF | 19866 |
| HPV45 | L2 | 9 | 448 | KRKRIPYFF | 19867 |
| HPV45 | L2 | 10 | 448 | KRKRIPYFFA | 19868 |
| HPV45 | L2 | 8 | 33 | NKVEGTTL | 19869 |
| HPV45 | L2 | 9 | 33 | NKVEGTTLA | 19870 |
| HPV45 | L2 | 9 | 446 | PKKRKRIPY | 19871 |
| HPV45 | L2 | 10 | 446 | PKKRKRIPYF | 19872 |
| HPV45 | L2 | 11 | 446 | PKKRKRIPYFF | 19873 |
| HPV45 | L2 | 11 | 371 | PKYSLTMPSTA | 19874 |
| HPV45 | L2 | 11 | 224 | PRLYSRANQQV | 19875 |
| HPV45 | L2 | 9 | 9 | RRRASATDL | 19876 |
| HPV45 | L2 | 10 | 9 | RRRASATDLY | 19877 |
| HPV45 | L2 | 8 | 449 | RKRIPYFF | 19878 |
| HPV45 | L2 | 9 | 449 | RKRIPYFFA | 19879 |
| HPV45 | L2 | 10 | 290 | RRGTVRFSRL | 19880 |
| HPV45 | L2 | 10 | 8 | RRRRASATDL | 19881 |
| HPV45 | L2 | 11 | 8 | RRKRASATDLY | 19882 |
| HPV45 | L2 | 8 | 219 | RRVRGPRL | 19883 |
| HPV45 | L2 | 9 | 219 | RRVRGPRLY | 19884 |
| HPV45 | L2 | 9 | 189 | SHGYEEIPL | 19885 |
| HPV45 | L2 | 10 | 3 | SHRAARRKRA | 19886 |
| HPV45 | L2 | 9 | 228 | SRANQQVRV | 19887 |
| HPV45 | L2 | 9 | 297 | SRLGQRATM | 19888 |
| HPV45 | L2 | 10 | 297 | SRLGQRATMF | 19889 |
| HPV45 | L2 | 8 | 289 | SRRGTVRF | 19890 |
| HPV45 | L2 | 11 | 289 | SRRGTVRFSRL | 19891 |
| HPV45 | L2 | 9 | 243 | THPSSLVTF | 19892 |
| HPV45 | L2 | 10 | 87 | TRPPVVIEPV | 19893 |
| HPV45 | L2 | 11 | 307 | TRSGKQIGGRV | 19894 |
| HPV45 | L2 | 10 | 317 | VHFYHDISPI | 19895 |
| HPV45 | L2 | 11 | 317 | VHFYHDISPIA | 19896 |
| HPV45 | L2 | 10 | 294 | VRFSRLGQRA | 19897 |
| HPV45 | L2 | 10 | 221 | VRGPRLYSRA | 19898 |
| HPV45 | L2 | 9 | 218 | VRRVRGPRL | 19899 |
| HPV45 | L2 | 10 | 218 | VRRVRGPRLY | 19900 |
| HPV45 | L2 | 8 | 234 | VRVSTSQF | 19901 |
| HPV45 | L2 | 9 | 234 | VRVSTSQFL | 19902 |
| HPV45 | L2 | 8 | 320 | YHDISPIA | 19903 |
| HPV45 | L2 | 9 | 320 | YHDISPIAA | 19904 |

TABLE XI-continued

| | | | | | |
|---|---|---|---|---|---|
| HPV56 | E2 | 9 | 10 | AKACSAIEV | 19905 |
| HPV56 | E2 | 11 | 10 | AKACSAIEVQI | 19906 |
| HPV56 | E2 | 10 | 202 | AKCVTFHTHI | 19907 |
| HPV56 | E2 | 9 | 118 | AKKFGCKNI | 19908 |
| HPV56 | E2 | 10 | 118 | AKKFGCKNIW | 19909 |
| HPV56 | E2 | 8 | 8 | CKAKACSA | 19910 |
| HPV56 | E2 | 9 | 8 | CKAKACSAI | 19911 |
| HPV56 | E2 | 11 | 8 | CKAKACSAIEV | 19912 |
| HPV56 | E2 | 9 | 123 | CKNIWEVHM | 19913 |
| HPV56 | E2 | 8 | 146 | CRYNVSPV | 19914 |
| HPV56 | E2 | 11 | 146 | CRYNVSPVETV | 19915 |
| HPV56 | E2 | 8 | 250 | CRYRFQKY | 19916 |
| HPV56 | E2 | 11 | 250 | CRYRFQKYKTL | 19917 |
| HPV56 | E2 | 9 | 232 | DKTTPVVHL | 19918 |
| HPV56 | E2 | 8 | 53 | FKKEGQHI | 19919 |
| HPV56 | E2 | 10 | 53 | FKKEGQHIEV | 19920 |
| HPV56 | E2 | 11 | 53 | FKKEGQHIEVW | 19921 |
| HPV56 | E2 | 9 | 106 | GHKTYYTDF | 19922 |
| HPV56 | E2 | 11 | 184 | GKRPRLRESEF | 19923 |
| HPV56 | E2 | 11 | 162 | HKTTTTTSTSV | 19924 |
| HPV56 | E2 | 8 | 107 | HKTYYTDF | 19925 |
| HPV56 | E2 | 9 | 181 | HRPGKRPRL | 19926 |
| HPV56 | E2 | 11 | 50 | KKCFKKEGQHI | 19927 |
| HPV56 | E2 | 9 | 54 | KKEGQHIEV | 19928 |
| HPV56 | E2 | 10 | 54 | KKEGQHIEVW | 19929 |
| HPV56 | E2 | 11 | 54 | KKEGQHIEVWF | 19930 |
| HPV56 | E2 | 8 | 119 | KKFGCKNI | 19931 |
| HPV56 | E2 | 9 | 119 | KKFGCKNIW | 19932 |
| HPV56 | E2 | 11 | 119 | KKFGCKNIWEV | 19933 |
| HPV56 | E2 | 10 | 185 | KRPRLRESEF | 19934 |
| HPV56 | E2 | 8 | 247 | LKCCRYRF | 19935 |
| HPV56 | E2 | 11 | 247 | LKCCRYRFQKY | 19936 |
| HPV56 | E2 | 8 | 240 | LKGEPNRL | 19937 |
| HPV56 | E2 | 8 | 37 | LRDTCEEL | 19938 |
| HPV56 | E2 | 9 | 37 | LRDTCEELW | 19939 |
| HPV56 | E2 | 10 | 37 | LRDTCEELWL | 19940 |
| HPV56 | E2 | 10 | 228 | NHPGDKTTPV | 19941 |
| HPV56 | E2 | 11 | 228 | NHPGDKTTPVV | 19942 |
| HPV56 | E2 | 9 | 275 | NKNYSHTI | 19943 |
| HPV56 | E2 | 10 | 275 | NKNYSHTII | 19944 |
| HPV56 | E2 | 11 | 275 | NKNYSHTIIY | 19945 |
| HPV56 | E2 | 8 | 245 | NRLKCCRY | 19946 |
| HPV56 | E2 | 10 | 245 | NRLKCCRYRF | 19947 |
| HPV56 | E2 | 8 | 187 | PRLRESEF | 19948 |
| HPV56 | E2 | 9 | 89 | QKVCSGVDY | 19949 |
| HPV56 | E2 | 8 | 255 | QKYKTLFV | 19950 |
| HPV56 | E2 | 10 | 255 | QKYKTLFVDV | 19951 |
| HPV56 | E2 | 9 | 290 | QRNSFLSHV | 19952 |
| HPV56 | E2 | 11 | 290 | QRNSFLSHVKI | 19953 |
| HPV56 | E2 | 10 | 180 | SHRPGKRPRL | 19954 |
| HPV56 | E2 | 8 | 296 | SHVKIPVV | 19955 |
| HPV56 | E2 | 9 | 296 | SHVKIPVVY | 19956 |
| HPV56 | E2 | 11 | 296 | SHVKIPVVYRL | 19957 |
| HPV56 | E2 | 8 | 67 | SKNNCMQY | 19958 |
| HPV56 | E2 | 9 | 67 | SKNNCMQYV | 19959 |
| HPV56 | E2 | 10 | 67 | SKNNCMQYVA | 19960 |
| HPV56 | E2 | 11 | 67 | SKNNCMQYVAW | 19961 |
| HPV56 | E2 | 9 | 197 | SRESHAKCV | 19962 |
| HPV56 | E2 | 8 | 103 | VHDGHKTY | 19963 |
| HPV56 | E2 | 9 | 103 | VHDGHKTYY | 19964 |
| HPV56 | E2 | 10 | 238 | VHLKGEFNRL | 19965 |
| HPV56 | E2 | 8 | 129 | VHMENEST | 19966 |
| HPV56 | E2 | 9 | 129 | VHMENESTY | 19967 |
| HPV56 | E2 | 9 | 298 | VKIPVVYRL | 19968 |
| HPV56 | E2 | 10 | 298 | VKIPVVYRLV | 19969 |
| HPV56 | E2 | 11 | 298 | VKIPVVYRLVW | 19970 |
| HPV56 | E2 | 11 | 268 | YHWTSTDNKNY | 19971 |
| HPV56 | E2 | 10 | 285 | YKDETQRNSF | 19972 |
| HPV56 | E2 | 11 | 285 | YKDETQRNSFL | 19973 |
| HPV56 | E2 | 8 | 257 | YKTLFVDV | 19974 |
| HPV56 | E2 | 9 | 252 | YRFQKYKTL | 19975 |
| HPV56 | E2 | 10 | 252 | YRFQKYKTLF | 19976 |
| HPV56 | E2 | 11 | 252 | YRFQKYKTLFV | 19977 |
| HPV56 | E6 | 9 | 132 | AHGWTGSCL | 19978 |
| HPV56 | E6 | 8 | 36 | CKKELTRA | 19979 |
| HPV56 | E6 | 10 | 36 | CKKELTRAEV | 19980 |
| HPV56 | E6 | 11 | 36 | CKKELTRAEVY | 19981 |
| HPV56 | E6 | 8 | 66 | CRVCLLFY | 19982 |
| HPV56 | E6 | 11 | 66 | CRVCLLFYSKV | 19983 |

TABLE XI-continued

| | | | | | |
|---|---|---|---|---|---|
| HPV56 | E6 | 8 | 123 | DRKRRFHL | 19984 |
| HPV56 | E6 | 9 | 123 | DRKRRFHLI | 19985 |
| HPV56 | E6 | 10 | 123 | DRKRRFHLIA | 19986 |
| HPV56 | E6 | 9 | 10 | ERPRSLHHL | 19987 |
| HPV56 | E6 | 8 | 128 | FHLIAHGW | 19988 |
| HPV56 | E6 | 9 | 16 | HHLSEVLEI | 19989 |
| HPV56 | E6 | 11 | 16 | HHLSEVLEIPL | 19990 |
| HPV56 | E6 | 10 | 104 | IRCYRCQSPL | 19991 |
| HPV56 | E6 | 9 | 37 | KKELTRAEV | 19992 |
| HPV56 | E6 | 10 | 37 | KKELTRAEVY | 19993 |
| HPV56 | E6 | 8 | 96 | KKQLCDLL | 19994 |
| HPV56 | E6 | 9 | 96 | KKQLCDLLI | 19995 |
| HPV56 | E6 | 8 | 125 | KRRFHLIA | 19996 |
| HPV56 | E6 | 11 | 125 | KRRFHLIAHGW | 19997 |
| HPV56 | E6 | 9 | 120 | LHCDRKRRF | 19998 |
| HPV56 | E6 | 11 | 120 | LHCDRKRRFHL | 19999 |
| HPV56 | E6 | 8 | 15 | LHHLSEVL | 20000 |
| HPV56 | E6 | 10 | 15 | LHHLSEVLEI | 20001 |
| HPV56 | E6 | 9 | 53 | LKLVYRDDF | 20002 |
| HPV56 | E6 | 11 | 53 | LKLVRRDDFPY | 20003 |
| HPV56 | E6 | 10 | 12 | PRSLHHLSEV | 20004 |
| HPV56 | E6 | 11 | 12 | PRSLHHLSEVL | 20005 |
| HPV56 | E6 | 8 | 124 | RKRRFHLI | 20006 |
| HPV56 | E6 | 9 | 124 | RKRRFHLIA | 20007 |
| HPV56 | E6 | 8 | 77 | RKYRYYDY | 20008 |
| HPV56 | E6 | 10 | 77 | RKYRYYDYSV | 20009 |
| HPV56 | E6 | 11 | 77 | RKYRYYDYSVY | 20010 |
| HPV56 | E6 | 10 | 126 | RRFHLIAHGW | 20011 |
| HPV56 | E6 | 8 | 74 | SKVRKYRY | 20012 |
| HPV56 | E6 | 9 | 74 | SKVRKYRYY | 20013 |
| HPV56 | E6 | 11 | 74 | SKVRKYRYYDY | 20014 |
| HPV56 | E6 | 9 | 147 | SREPRESTV | 20015 |
| HPV56 | E6 | 8 | 95 | TKKQLCDL | 20016 |
| HPV56 | E6 | 9 | 95 | TKKQLCDLL | 20017 |
| HPV56 | E6 | 10 | 95 | TKKQLCDLLI | 20018 |
| HPV56 | E6 | 8 | 41 | TRAEVYNF | 20019 |
| HPV56 | E6 | 9 | 41 | TRAEVYNFA | 20020 |
| HPV56 | E6 | 9 | 76 | VRKYRYYDY | 20021 |
| HPV56 | E6 | 11 | 76 | VRKYRYYDYSV | 20022 |
| HPV56 | E6 | 8 | 57 | YRDDFPYA | 20023 |
| HPV56 | E6 | 9 | 57 | YRDDFPYAV | 20024 |
| HPV56 | E6 | 8 | 79 | YRYYDYSV | 20025 |
| HPV56 | E6 | 9 | 79 | YRYYDYSVY | 20026 |
| HPV56 | E6 | 11 | 79 | YRYYDYSVYGA | 20027 |
| HPV56 | E7 | 8 | 53 | AKQHTCYL | 20028 |
| HPV56 | E7 | 9 | 53 | AKQHTCYLI | 20029 |
| HPV56 | E7 | 11 | 53 | AKQHTCYLIHV | 20030 |
| HPV56 | E7 | 10 | 50 | ARQAKQHTCY | 20031 |
| HPV56 | E7 | 11 | 50 | ARQAKQHTCYL | 20032 |
| HPV56 | E7 | 9 | 68 | CKFVVQLDI | 20033 |
| HPV56 | E7 | 10 | 41 | DHLQERPQQA | 20034 |
| HPV56 | E7 | 9 | 45 | ERPQQARQA | 20035 |
| HPV56 | E7 | 9 | 3 | GKVPTLQDV | 20036 |
| HPV56 | E7 | 10 | 3 | GKVPTLQDVV | 20037 |
| HPV56 | E7 | 11 | 3 | GKVPTLQDVVL | 20038 |
| HPV56 | E7 | 10 | 61 | IHVPCCECKF | 20039 |
| HPV56 | E7 | 11 | 61 | IHVPCCECKFV | 20040 |
| HPV56 | E7 | 8 | 83 | LRVVQQLL | 20041 |
| HPV56 | E7 | 9 | 83 | LRVVQQLLM | 20042 |
| HPV56 | E7 | 11 | 83 | LRVVQQLLMGA | 20043 |
| HPV56 | E7 | 8 | 1 | MHGKVPTL | 20044 |
| HPV56 | E7 | 11 | 1 | MHGKVPTLQDV | 20045 |
| HPV56 | E7 | 9 | 55 | QHTCYLIHV | 20046 |
| HPV56 | E7 | 8 | 79 | TKEDLRVV | 20047 |
| HPV56 | E7 | 11 | 79 | TKEDLRVVQQL | 20048 |
| HPV56 | L1 | 8 | 475 | AKYKFWDV | 20049 |
| HPV56 | L1 | 10 | 475 | AKYKFWDVNL | 20050 |
| HPV56 | L1 | 8 | 291 | ARHYFNRA | 20051 |
| HPV56 | L1 | 11 | 291 | ARHYFNRAGKV | 20052 |
| HPV56 | L1 | 8 | 390 | ARKINQYL | 20053 |
| HPV56 | L1 | 11 | 390 | ARKINQYLRHV | 20054 |
| HPV56 | L1 | 9 | 412 | CKITLSAEV | 20055 |
| HPV56 | L1 | 10 | 412 | CKITLSAEVM | 20056 |
| HPV56 | L1 | 11 | 412 | CKITLSAEVMA | 20057 |
| HPV56 | L1 | 9 | 263 | CKYPDYLKM | 20058 |
| HPV56 | L1 | 11 | 263 | CKYPDYLKMSA | 20059 |
| HPV56 | L1 | 10 | 449 | DKYRYVRSTA | 20060 |
| HPV56 | L1 | 11 | 449 | DKYRYVRSTAI | 20061 |
| HPV56 | L1 | 8 | 201 | EHWTKGAV | 20062 |

TABLE XI-continued

| | | | | | |
|---|---|---|---|---|---|
| HPV56 | L1 | 9 | 469 | EKQDPLAKY | 20063 |
| HPV56 | L1 | 11 | 469 | EKQDPLAKYKF | 20064 |
| HPV56 | L1 | 8 | 130 | ERLVWACV | 20065 |
| HPV56 | L1 | 10 | 130 | ERLVWACVGL | 20066 |
| HPV56 | L1 | 9 | 244 | FKVLQESKA | 20067 |
| HPV56 | L1 | 11 | 244 | FKVLQESKAEV | 20068 |
| HPV56 | L1 | 11 | 107 | FRVRLPDPNKF | 20069 |
| HPV56 | L1 | 8 | 352 | GHNNGICW | 20070 |
| HPV56 | L1 | 8 | 153 | GHPLFNRL | 20071 |
| HPV56 | L1 | 8 | 185 | GKQTQLCI | 20072 |
| HPV56 | L1 | 9 | 185 | GKQTQLCIV | 20073 |
| HPV56 | L1 | 9 | 299 | GKVGETIPA | 20074 |
| HPV56 | L1 | 11 | 299 | GKVGETIPAEL | 20075 |
| HPV56 | L1 | 9 | 316 | GREPPPSSV | 20076 |
| HPV56 | L1 | 10 | 316 | GREPPPSSVY | 20077 |
| HPV56 | L1 | 11 | 316 | GREPPPSSVYV | 20078 |
| HPV56 | L1 | 8 | 142 | GRGQPLGA | 20079 |
| HPV56 | L1 | 10 | 142 | GRGQPLGAGL | 20080 |
| HPV56 | L1 | 8 | 498 | GRKFLMQL | 20081 |
| HPV56 | L1 | 9 | 64 | KRTSIFYHA | 20082 |
| HPV56 | L1 | 8 | 424 | LHNMNANL | 20083 |
| HPV56 | L1 | 9 | 424 | LHNMNANLL | 20084 |
| HPV56 | L1 | 8 | 14 | LHYGLCIF | 20085 |
| HPV56 | L1 | 9 | 14 | LHYGLCWL | 20086 |
| HPV56 | L1 | 11 | 14 | LHYGLCIFLDV | 20087 |
| HPV56 | L1 | 8 | 269 | LKMSADAY | 20088 |
| HPV56 | L1 | 9 | 397 | LRHVEEYEL | 20089 |
| HPV56 | L1 | 11 | 397 | LRHVEEYELQF | 20090 |
| HPV56 | L1 | 8 | 284 | LRREQLFA | 20091 |
| HPV56 | L1 | 11 | 284 | LRREQLFARHY | 20092 |
| HPV56 | L1 | 10 | 115 | NKFGLPDTNI | 20093 |
| HPV56 | L1 | 11 | 115 | NKFGLPDTNIY | 20094 |
| HPV56 | L1 | 9 | 342 | NKPYWLQRA | 20095 |
| HPV56 | L1 | 10 | 44 | NKVYLPPTPV | 20096 |
| HPV56 | L1 | 10 | 296 | NRAGKVGETI | 20097 |
| HPV56 | L1 | 11 | 158 | NRLDDTESSNL | 20098 |
| HPV56 | L1 | 8 | 97 | PKVSAYQY | 20099 |
| HPV56 | L1 | 10 | 97 | PKVSAYQYRV | 20100 |
| HPV56 | L1 | 11 | 97 | PKVSAYQYRVF | 20101 |
| HPV56 | L1 | 10 | 348 | QRAQGHNNGI | 20102 |
| HPV56 | L1 | 8 | 398 | RHVEEYEL | 20103 |
| HPV56 | L1 | 10 | 398 | RHVEEYELQF | 20104 |
| HPV56 | L1 | 11 | 398 | RHVEEYELQFV | 20105 |
| HPV56 | L1 | 10 | 292 | RHYFNRAGKV | 20106 |
| HPV56 | L1 | 10 | 391 | RKINQYLRHV | 20107 |
| HPV56 | L1 | 10 | 285 | RREQLFARHY | 20108 |
| HPV56 | L1 | 11 | 285 | RREQLFARHYF | 20109 |
| HPV56 | L1 | 9 | 250 | SKAEVPLDI | 20110 |
| HPV56 | L1 | 10 | 250 | SKAEVPLDIV | 20111 |
| HPV56 | L1 | 9 | 54 | SKVVATDSY | 20112 |
| HPV56 | L1 | 10 | 54 | SKVVATDSYV | 20113 |
| HPV56 | L1 | 8 | 386 | SKYDARKI | 20114 |
| HPV56 | L1 | 11 | 386 | SKYDARKINQY | 20115 |
| HPV56 | L1 | 10 | 75 | SRLLAVGHPY | 20116 |
| HPV56 | L1 | 11 | 75 | SRLLAVGHPYY | 20117 |
| HPV56 | L1 | 9 | 88 | TKDNTKTNI | 20118 |
| HPV56 | L1 | 11 | 204 | TKGAVCKSTQV | 20119 |
| HPV56 | L1 | 8 | 92 | TKTNIPKV | 20120 |
| HPV56 | L1 | 10 | 92 | TKTNIPKVSA | 20121 |
| HPV56 | L1 | 11 | 92 | TKTNIPKVSAY | 20122 |
| HPV56 | L1 | 8 | 507 | TRSKPAVA | 20123 |
| HPV56 | L1 | 8 | 371 | TRSTNMTI | 20124 |
| HPV56 | L1 | 11 | 371 | TRSTNMTISTA | 20125 |
| HPV56 | L1 | 8 | 63 | VKRTSWY | 20126 |
| HPV56 | L1 | 10 | 63 | VKRTSWYHA | 20127 |
| HPV56 | L1 | 9 | 109 | VRLPDPNKF | 20128 |
| HPV56 | L1 | 11 | 109 | VRLPDPNKFGL | 20129 |
| HPV56 | L1 | 8 | 39 | WRPSENKV | 20130 |
| HPV56 | L1 | 9 | 39 | WRPSENKVY | 20131 |
| HPV56 | L1 | 10 | 39 | WRPSENKVYL | 20132 |
| HPV56 | L1 | 8 | 70 | YHAGSSRL | 20133 |
| HPV56 | L1 | 9 | 70 | YHAGSSRLL | 20134 |
| HPV56 | L1 | 10 | 70 | YHAGSSRLLA | 20135 |
| HPV56 | L1 | 11 | 70 | YHAGSSRLLAV | 20136 |
| HPV56 | L1 | 8 | 477 | YKFWDVNL | 20137 |
| HPV56 | L1 | 8 | 9 | YRDPPLHY | 20138 |
| HPV56 | L1 | 10 | 9 | YRDPPLHYGL | 20139 |
| HPV56 | L1 | 8 | 104 | YRVFRVRL | 20140 |
| HPV56 | L1 | 8 | 451 | YRYVRSTA | 20141 |

TABLE XI-continued

| | | | | | |
|---|---|---|---|---|---|
| HPV56 | L1 | 9 | 451 | YRYVRSTAI | 20142 |
| HPV56 | L2 | 10 | 371 | AHLPIKPSTL | 20143 |
| HPV56 | L2 | 10 | 3 | AHRATRRKRA | 20144 |
| HPV56 | L2 | 10 | 87 | ARPPIVVESV | 20145 |
| HPV56 | L2 | 9 | 315 | ARVHYYYDI | 20146 |
| HPV56 | L2 | 11 | 21 | CKLSGTCPEDV | 20147 |
| HPV56 | L2 | 9 | 42 | DKILQWGSL | 20148 |
| HPV56 | L2 | 10 | 42 | DKILQWGSLF | 20149 |
| HPV56 | L2 | 9 | 243 | DRPATLVSA | 20150 |
| HPV56 | L2 | 9 | 218 | FRRIAAPRL | 20151 |
| HPV56 | L2 | 10 | 218 | FRRIAAPRLY | 20152 |
| HPV56 | L2 | 9 | 445 | FRRRRRKRI | 20153 |
| HPV56 | L2 | 11 | 445 | FRRRRRKRIPY | 20154 |
| HPV56 | L2 | 8 | 67 | GRAGYVPL | 20155 |
| HPV56 | L2 | 9 | 4 | HRATRRKRA | 20156 |
| HPV56 | L2 | 11 | 4 | HRATRRKRASA | 20157 |
| HPV56 | L2 | 9 | 189 | IHSYEEIPM | 20158 |
| HPV56 | L2 | 8 | 375 | IKPSTLSF | 20159 |
| HPV56 | L2 | 9 | 375 | IKPSTLSFA | 20160 |
| HPV56 | L2 | 8 | 10 | KRASATQL | 20161 |
| HPV56 | L2 | 9 | 10 | KRASATQLY | 20162 |
| HPV56 | L2 | 8 | 451 | KRIPYFFA | 20163 |
| HPV56 | L2 | 8 | 33 | NKIEQKTW | 20164 |
| HPV56 | L2 | 9 | 33 | NKIEQKTWA | 20165 |
| HPV56 | L2 | 8 | 224 | PRLYRKAF | 20166 |
| HPV56 | L2 | 11 | 224 | PRLYRKAFQQV | 20167 |
| HPV56 | L2 | 8 | 37 | QKTWADKI | 20168 |
| HPV56 | L2 | 9 | 37 | QKTWADKIL | 20169 |
| HPV56 | L2 | 11 | 37 | QKTWADKILQW | 20170 |
| HPV56 | L2 | 9 | 228 | RKAPQQVKV | 20171 |
| HPV56 | L2 | 9 | 9 | RKRASATQL | 20172 |
| HPV56 | L2 | 10 | 9 | RKRASATQLY | 20173 |
| HPV56 | L2 | 8 | 450 | RKRIPYFF | 20174 |
| HPV56 | L2 | 9 | 450 | RKRIPYFFA | 20175 |
| HPV56 | L2 | 10 | 290 | RRGGVRFSRL | 20176 |
| HPV56 | L2 | 8 | 308 | RRGTQIGA | 20177 |
| HPV56 | L2 | 10 | 308 | RRGTQIGARV | 20178 |
| HPV56 | L2 | 8 | 219 | RRIAAPRL | 20179 |
| HPV56 | L2 | 9 | 219 | RRIAAPRLY | 20180 |
| HPV56 | L2 | 10 | 8 | RRKRASATQL | 20181 |
| HPV56 | L2 | 11 | 8 | RRKRASATQLY | 20182 |
| HPV56 | L2 | 8 | 449 | RRKRIPYF | 20183 |
| HPV56 | L2 | 9 | 449 | RRKRIPYFF | 20184 |
| HPV56 | L2 | 10 | 449 | RRKRIPYFFA | 20185 |
| HPV56 | L2 | 8 | 448 | RRRKRIPY | 20186 |
| HPV56 | L2 | 9 | 448 | RRRKRIPYF | 20187 |
| HPV56 | L2 | 10 | 448 | RRRKRIPYFF | 20188 |
| HPV56 | L2 | 11 | 448 | RRRKRIPYFFA | 20189 |
| HPV56 | L2 | 9 | 447 | RRRRKRIPY | 20190 |
| HPV56 | L2 | 10 | 447 | RRRRKRIPYF | 20191 |
| HPV56 | L2 | 11 | 447 | RRRRKRIPYFF | 20192 |
| HPV56 | L2 | 8 | 446 | RRRRRKRI | 20193 |
| HPV56 | L2 | 10 | 446 | RRRRRKRIPY | 20194 |
| HPV56 | L2 | 11 | 446 | RRRRRKRIPYF | 20195 |
| HPV56 | L2 | 9 | 297 | SRLGRKATI | 20196 |
| HPV56 | L2 | 9 | 76 | SRPSTIVDV | 20197 |
| HPV56 | L2 | 11 | 427 | THDVYIQGSSF | 20198 |
| HPV56 | L2 | 8 | 155 | THITNPLF | 20199 |
| HPV56 | L2 | 9 | 155 | THITNPLFI | 20200 |
| HPV56 | L2 | 8 | 289 | TRRGGVRF | 20201 |
| HPV56 | L2 | 11 | 289 | TRRGGVRFSRL | 20202 |
| HPV56 | L2 | 9 | 307 | TRRGTQIGA | 20203 |
| HPV56 | L2 | 11 | 307 | TRRGTQIGARV | 20204 |
| HPV56 | L2 | 8 | 7 | TRRKRASA | 20205 |
| HPV56 | L2 | 11 | 7 | TRRKRASATQL | 20206 |
| HPV56 | L2 | 9 | 202 | VHGSGTEPI | 20207 |
| HPV56 | L2 | 8 | 150 | VHVSSTHI | 20208 |
| HPV56 | L2 | 10 | 317 | VHYYYDISPI | 20209 |
| HPV56 | L2 | 11 | 317 | VHYYYDISPIA | 20210 |
| HPV56 | L2 | 8 | 234 | VKVTDPAF | 20211 |
| HPV56 | L2 | 9 | 234 | VKVTDPAFL | 20212 |
| HPV56 | L2 | 10 | 294 | VRFSRLGRKA | 20213 |
| HPV56 | L2 | 8 | 227 | YRKAFQQV | 20214 |
| HPV56 | L2 | 10 | 227 | YRKAFQQVKV | 20215 |

TABLE XIII

B58 Supermotif Peptides

| Type | Protein | No. of Amino Acids | Position | Sequence | Seq. Id. No. |
|---|---|---|---|---|---|
| HPV16 | E1 | 11 | 316 | AAALYWYKTGI | 20216 |
| HPV16 | E1 | 9 | 239 | AAFGLTPSI | 20217 |
| HPV16 | E1 | 10 | 239 | AAFGLTPSIA | 20218 |
| HPV16 | E1 | 10 | 317 | AALYWYKTGI | 20219 |
| HPV16 | E1 | 10 | 205 | AAMLAKFKEL | 20220 |
| HPV16 | E1 | 11 | 205 | AAMLAKFKELY | 20221 |
| HPV16 | E1 | 8 | 478 | AANTGKSL | 20222 |
| HPV16 | E1 | 9 | 478 | AANTGKSLF | 20223 |
| HPV16 | E1 | 11 | 478 | AANTGKSLFGM | 20224 |
| HPV16 | E1 | 11 | 389 | ASAFLKSNSQA | 20225 |
| HPV16 | E1 | 10 | 406 | ATMCRHYKRA | 20226 |
| HPV16 | E1 | 8 | 524 | ATVPCWNY | 20227 |
| HPV16 | E1 | 9 | 524 | ATVPCWNYI | 20228 |
| HPV16 | E1 | 8 | 405 | CATMCRHY | 20229 |
| HPV16 | E1 | 11 | 405 | CATMCRHYKRA | 20230 |
| HPV16 | E1 | 8 | 269 | CSWGMVVL | 20231 |
| HPV16 | E1 | 9 | 269 | CSWGMVVLL | 20232 |
| HPV16 | E1 | 10 | 269 | CSWGMVVLLL | 20233 |
| HPV16 | E1 | 11 | 269 | CSWGMVVLLLV | 20234 |
| HPV16 | E1 | 8 | 353 | CTFELSQM | 20235 |
| HPV16 | E1 | 9 | 353 | CTFELSQMV | 20236 |
| HPV16 | E1 | 11 | 353 | CTFELSQMVQW | 20237 |
| HPV16 | E1 | 10 | 515 | DAKIGMLDDA | 20238 |
| HPV16 | E1 | 9 | 523 | DATVPCWNY | 20239 |
| HPV16 | E1 | 10 | 523 | DATVPCWNYI | 20240 |
| HPV16 | E1 | 10 | 81 | DAVQVLKRKY | 20241 |
| HPV16 | E1 | 11 | 81 | DAVQVLKRKYL | 20242 |
| HPV16 | E1 | 8 | 41 | DSDTGEDL | 20243 |
| HPV16 | E1 | 9 | 41 | DSDTGEDLV | 20244 |
| HPV16 | E1 | 11 | 41 | DSDTGEDLVDF | 20245 |
| HPV16 | E1 | 8 | 372 | DSEIAYKY | 20246 |
| HPV16 | E1 | 9 | 372 | DSEIAYKYA | 20247 |
| HPV16 | E1 | 11 | 372 | DSEIAYKYAQL | 20248 |
| HPV16 | E1 | 9 | 131 | DSGYGNTEV | 20249 |
| HPV16 | E1 | 10 | 249 | DSIKTLLQQY | 20250 |
| HPV16 | E1 | 9 | 633 | DSLPTFKCV | 20251 |
| HPV16 | E1 | 11 | 573 | DSRWPYLHNRL | 20252 |
| HPV16 | E1 | 9 | 43 | DTGEDLVDF | 20253 |
| HPV16 | E1 | 10 | 43 | DTGEDLVDFI | 20254 |
| HPV16 | E1 | 11 | 43 | DTGEDLVDFIV | 20255 |
| HPV16 | E1 | 8 | 384 | DTNSNASA | 20256 |
| HPV16 | E1 | 9 | 384 | DTNSNASAF | 20257 |
| HPV16 | E1 | 10 | 384 | DTNSNASAFL | 20258 |
| HPV16 | E1 | 11 | 335 | DTPEWIQRQTV | 20259 |
| HPV16 | E1 | 8 | 75 | EAKQHRDA | 20260 |
| HPV16 | E1 | 9 | 75 | EAKQHRDAV | 20261 |
| HPV16 | E1 | 11 | 75 | EAKQHRDAVQV | 20262 |
| HPV16 | E1 | 11 | 22 | EAVVEKKTGDA | 20263 |
| HPV16 | E1 | 9 | 65 | ETAHALFTA | 20264 |
| HPV16 | E1 | 8 | 63 | ETETAHAL | 20265 |
| HPV16 | E1 | 9 | 63 | ETETAHALF | 20266 |
| HPV16 | E1 | 11 | 63 | ETETAHALFTA | 20267 |
| HPV16 | E1 | 9 | 152 | ETETPCSQY | 20268 |
| HPV16 | E1 | 10 | 288 | ETIEKLLSKL | 20269 |
| HPV16 | E1 | 11 | 288 | ETIEKLLSKLL | 20270 |
| HPV16 | E1 | 8 | 140 | ETQQMLQV | 20271 |
| HPV16 | E1 | 8 | 219 | FSELVRPF | 20272 |
| HPV16 | E1 | 8 | 613 | FSRTWSRL | 20273 |
| HPV16 | E1 | 10 | 613 | FSRTWSRLSL | 20274 |
| HPV16 | E1 | 9 | 586 | FTFPNEPF | 20275 |
| HPV16 | E1 | 9 | 477 | GAANTGKSL | 20276 |
| HPV16 | E1 | 10 | 477 | GAANTGKSLF | 20277 |
| HPV16 | E1 | 9 | 163 | GSGGGCSQY | 20278 |
| HPV16 | E1 | 8 | 571 | GTDSRWPY | 20279 |
| HPV16 | E1 | 9 | 571 | GTDSRWPYL | 20280 |
| HPV16 | E1 | 8 | 12 | GTGCNGWF | 20281 |
| HPV16 | E1 | 9 | 12 | GTGCNGWFY | 20282 |
| HPV16 | E1 | 10 | 12 | GTGCNGWFYV | 20283 |
| HPV16 | E1 | 9 | 68 | HALFTAQEA | 20284 |
| HPV16 | E1 | 8 | 348 | HSFNDCTF | 20285 |
| HPV16 | E1 | 10 | 348 | HSFNDCTFEL | 20286 |
| HPV16 | E1 | 8 | 184 | HTICQTPL | 20287 |
| HPV16 | E1 | 11 | 184 | HTICQTPLTNI | 20288 |
| HPV16 | E1 | 10 | 238 | IAAFGLTPSI | 20289 |
| HPV16 | E1 | 11 | 238 | IAAFGLTPSIA | 20290 |
| HPV16 | E1 | 8 | 247 | IADSIKTL | 20291 |

TABLE XIII-continued

B58 Supermotif Peptides

| Type | Protein | No. of Amino Acids | Position | Sequence | Seq. Id. No. |
|---|---|---|---|---|---|
| HPV16 | E1 | 9 | 247 | IADSIKTLL | 20292 |
| HPV16 | E1 | 8 | 375 | IAYKYAQL | 20293 |
| HPV16 | E1 | 9 | 375 | IAYKYAQLA | 20294 |
| HPV16 | E1 | 11 | 329 | ISEVYGDTPEW | 20295 |
| HPV16 | E1 | 9 | 98 | ISGCVDNNI | 20296 |
| HPV16 | E1 | 8 | 326 | ISNISEVY | 20297 |
| HPV16 | E1 | 8 | 106 | ISPRLKAI | 20298 |
| HPV16 | E1 | 10 | 106 | ISPRLKAICI | 20299 |
| HPV16 | E1 | 8 | 204 | KAAMLAKF | 20300 |
| HPV16 | E1 | 11 | 204 | KAAMLAKFKEL | 20301 |
| HPV16 | E1 | 11 | 111 | KAICIEKQSRA | 20302 |
| HPV16 | E1 | 8 | 610 | KSFFSRTW | 20303 |
| HPV16 | E1 | 11 | 610 | KSFFSRTWSRL | 20304 |
| HPV16 | E1 | 9 | 505 | KSHFWLQPL | 20305 |
| HPV16 | E1 | 10 | 505 | KSHFWLQPLA | 20306 |
| HPV16 | E1 | 8 | 483 | KSLFGMSL | 20307 |
| HPV16 | E1 | 9 | 483 | KSLFGMSLM | 20308 |
| HPV16 | E1 | 11 | 483 | KSLFGMSLMKF | 20309 |
| HPV16 | E1 | 10 | 227 | KSNKSTCCDW | 20310 |
| HPV16 | E1 | 8 | 394 | KSNSQAKI | 20311 |
| HPV16 | E1 | 9 | 394 | KSNSQAKIV | 20312 |
| HPV16 | E1 | 9 | 230 | KSTCCDWCI | 20313 |
| HPV16 | E1 | 10 | 230 | KSTCCDWCIA | 20314 |
| HPV16 | E1 | 11 | 230 | KSTCCDWCIAA | 20315 |
| HPV16 | E1 | 10 | 323 | KTGISNISEV | 20316 |
| HPV16 | E1 | 11 | 323 | KTGISNISEVY | 20317 |
| HPV16 | E1 | 9 | 252 | KTLLQQYCL | 20318 |
| HPV16 | E1 | 10 | 252 | KTLLQQYCLY | 20319 |
| HPV16 | E1 | 11 | 252 | KTLLQQYCLYL | 20320 |
| HPV16 | E1 | 8 | 199 | KTSNAKAA | 20321 |
| HPV16 | E1 | 9 | 199 | KTSNAKAAM | 20322 |
| HPV16 | E1 | 10 | 199 | KTSNAKAAML | 20323 |
| HPV16 | E1 | 11 | 199 | KTSNAKAAMLA | 20324 |
| HPV16 | E1 | 8 | 267 | LACSWGMV | 20325 |
| HPV16 | E1 | 9 | 267 | LACSWGMVV | 20326 |
| HPV16 | E1 | 10 | 267 | LACSWGMVVL | 20327 |
| HPV16 | E1 | 11 | 267 | LACSWGMVVLL | 20328 |
| HPV16 | E1 | 8 | 513 | LADAKIGM | 20329 |
| HPV16 | E1 | 9 | 513 | LADAKIGML | 20330 |
| HPV16 | E1 | 8 | 382 | LADTNSNA | 20331 |
| HPV16 | E1 | 10 | 382 | LADTNSNASA | 20332 |
| HPV16 | E1 | 11 | 382 | LADTNSNASAF | 20333 |
| HPV16 | E1 | 8 | 208 | LAKFKELY | 20334 |
| HPV16 | E1 | 10 | 208 | LAKFKELYGV | 20335 |
| HPV16 | E1 | 8 | 95 | LSDISGCV | 20336 |
| HPV16 | E1 | 10 | 294 | LSKLLCVSPM | 20337 |
| HPV16 | E1 | 8 | 357 | LSQMVQWA | 20338 |
| HPV16 | E1 | 9 | 357 | LSQMVQWAY | 20339 |
| HPV16 | E1 | 8 | 457 | LTALKRFL | 20340 |
| HPV16 | E1 | 11 | 457 | LTALKRFLQGI | 20341 |
| HPV16 | E1 | 8 | 191 | LTNILNVL | 20342 |
| HPV16 | E1 | 9 | 243 | LTPSIADSI | 20343 |
| HPV16 | E1 | 9 | 59 | LTQAETETA | 20344 |
| HPV16 | E1 | 11 | 59 | LTQAETETAHA | 20345 |
| HPV16 | E1 | 10 | 454 | MSFLTALKRF | 20346 |
| HPV16 | E1 | 11 | 454 | MSFLTALKRFL | 20347 |
| HPV16 | E1 | 11 | 488 | MSLMKFLQGSV | 20348 |
| HPV16 | E1 | 9 | 420 | MSMSQWIKY | 20349 |
| HPV16 | E1 | 8 | 569 | NAGTDSRW | 20350 |
| HPV16 | E1 | 10 | 569 | NAGTDSRWPY | 20351 |
| HPV16 | E1 | 11 | 569 | NAGTDSRWPYL | 20352 |
| HPV16 | E1 | 8 | 202 | NAKAAMLA | 20353 |
| HPV16 | E1 | 10 | 202 | NAKAAMLAKF | 20354 |
| HPV16 | E1 | 8 | 538 | NALDGNLV | 20355 |
| HPV16 | E1 | 10 | 538 | NALDGNLVSM | 20356 |
| HPV16 | E1 | 8 | 503 | NSKSHFWL | 20357 |
| HPV16 | E1 | 11 | 503 | NSKSHFWLQPL | 20358 |
| HPV16 | E1 | 8 | 386 | NSNASAFL | 20359 |
| HPV16 | E1 | 11 | 396 | NSQAKIVKDCA | 20360 |
| HPV16 | E1 | 9 | 136 | NTEVETQQM | 20361 |
| HPV16 | E1 | 10 | 136 | NTEVETQQML | 20362 |
| HPV16 | E1 | 9 | 480 | NTGKSLFGM | 20363 |
| HPV16 | E1 | 11 | 480 | NTGKSLFGMSL | 20364 |
| HPV16 | E1 | 10 | 245 | PSIADSIKTL | 20365 |
| HPV16 | E1 | 11 | 245 | PSIADSIKTLL | 20366 |
| HPV16 | E1 | 9 | 61 | QAETETAHA | 20367 |

TABLE XIII-continued

B58 Supermotif Peptides

| Type | Protein | No. of Amino Acids | Position | Sequence | Seq. Id. No. |
|---|---|---|---|---|---|
| HPV16 | E1 | 10 | 61 | QAETETAHAL | 20368 |
| HPV16 | E1 | 11 | 61 | QAETETAHALF | 20369 |
| HPV16 | E1 | 9 | 398 | QAKIVKDCA | 20370 |
| HPV16 | E1 | 11 | 398 | QAKIVKDCATM | 20371 |
| HPV16 | E1 | 9 | 265 | QSLACSWGM | 20372 |
| HPV16 | E1 | 10 | 265 | QSLACSWGMV | 20373 |
| HPV16 | E1 | 11 | 265 | QSLACSWGMVV | 20374 |
| HPV16 | E1 | 9 | 118 | QSRAAKRRL | 20375 |
| HPV16 | E1 | 10 | 118 | QSRAAKRRLF | 20376 |
| HPV16 | E1 | 8 | 188 | QTPLTNIL | 20377 |
| HPV16 | E1 | 10 | 188 | QTPLTNILNV | 20378 |
| HPV16 | E1 | 11 | 188 | QTPLTNILNVL | 20379 |
| HPV16 | E1 | 8 | 343 | QTVLQHSF | 20380 |
| HPV16 | E1 | 8 | 120 | RAAKRRLF | 20381 |
| HPV16 | E1 | 9 | 414 | RAEKKQMSM | 20382 |
| HPV16 | E1 | 8 | 313 | RSTAAALY | 20383 |
| HPV16 | E1 | 9 | 313 | RSTAAALYW | 20384 |
| HPV16 | E1 | 10 | 313 | RSTAAALYWY | 20385 |
| HPV16 | E1 | 8 | 615 | RTWSRLSL | 20386 |
| HPV16 | E1 | 10 | 390 | SAFLKSNSQA | 20387 |
| HPV16 | E1 | 9 | 172 | SSGSGGEGV | 20388 |
| HPV16 | E1 | 8 | 314 | STAAALYW | 20389 |
| HPV16 | E1 | 9 | 314 | STAAALYWY | 20390 |
| HPV16 | E1 | 8 | 231 | STCCDWCI | 20391 |
| HPV16 | E1 | 9 | 231 | STCCDWCIA | 20392 |
| HPV16 | E1 | 10 | 231 | STCCDWCIAA | 20393 |
| HPV16 | E1 | 11 | 231 | STCCDWCIAAF | 20394 |
| HPV16 | E1 | 8 | 315 | TAAALYWY | 20395 |
| HPV16 | E1 | 8 | 66 | TAHALFTA | 20396 |
| HPV16 | E1 | 11 | 66 | TAHALFTAQEA | 20397 |
| HPV16 | E1 | 10 | 458 | TALKRFLQGI | 20398 |
| HPV16 | E1 | 11 | 72 | TAQEAKQHRDA | 20399 |
| HPV16 | E1 | 8 | 200 | TSNAKAAM | 20400 |
| HPV16 | E1 | 9 | 200 | TSNAKAAML | 20401 |
| HPV16 | E1 | 10 | 200 | TSNAKAAMLA | 20402 |
| HPV16 | E1 | 10 | 217 | VSFSELVRPF | 20403 |
| HPV16 | E1 | 9 | 641 | VSGQNTNTL | 20404 |
| HPV16 | E1 | 10 | 545 | VSMDVKHRPL | 20405 |
| HPV16 | E1 | 11 | 545 | VSMDVKHRPLV | 20406 |
| HPV16 | E1 | 11 | 92 | VSPLSDISGCV | 20407 |
| HPV16 | E1 | 8 | 300 | VSPMCMMI | 20408 |
| HPV16 | E1 | 8 | 363 | WAYDNDIV | 20409 |
| HPV16 | E1 | 11 | 379 | YAQLADTNSNA | 20410 |
| HPV16 | E1 | 10 | 171 | YSSGSGGEGV | 20411 |
| HPV16 | E2 | 8 | 220 | AATHTKAV | 20412 |
| HPV16 | E2 | 9 | 220 | AATHTKAVA | 20413 |
| HPV16 | E2 | 10 | 220 | AATHTKAVAL | 20414 |
| HPV16 | E2 | 10 | 143 | ASVTVVEGQV | 20415 |
| HPV16 | E2 | 8 | 221 | ATHTKAVA | 20416 |
| HPV16 | E2 | 9 | 221 | ATHTKAVAL | 20417 |
| HPV16 | E2 | 10 | 40 | CAIYYKAREM | 20418 |
| HPV16 | E2 | 11 | 309 | CTLYTAVSSTW | 20419 |
| HPV16 | E2 | 10 | 174 | DAEKYSKNKV | 20420 |
| HPV16 | E2 | 11 | 174 | DAEKYSKNKVW | 20421 |
| HPV16 | E2 | 8 | 294 | DANTLKCL | 20422 |
| HPV16 | E2 | 10 | 294 | DANTLKCLRY | 20423 |
| HPV16 | E2 | 8 | 263 | DSAPILTA | 20424 |
| HPV16 | E2 | 9 | 263 | DSAPILTAF | 20425 |
| HPV16 | E2 | 9 | 338 | DSEWQRDQF | 20426 |
| HPV16 | E2 | 10 | 338 | DSEWQRDQFL | 20427 |
| HPV16 | E2 | 9 | 22 | DSTDLRDHI | 20428 |
| HPV16 | E2 | 11 | 22 | DSTDLRDHIDY | 20429 |
| HPV16 | E2 | 8 | 260 | DSVDSAPI | 20430 |
| HPV16 | E2 | 9 | 260 | DSVDSAPIL | 20431 |
| HPV16 | E2 | 11 | 260 | DSVDSAPILTA | 20432 |
| HPV16 | E2 | 11 | 246 | DTGNPCHTTKL | 20433 |
| HPV16 | E2 | 11 | 142 | EASVTVVEGQV | 20434 |
| HPV16 | E2 | 8 | 80 | ETIYNSQY | 20435 |
| HPV16 | E2 | 9 | 2 | ETLCQRLNV | 20436 |
| HPV16 | E2 | 11 | 200 | FSSNEVSSPEI | 20437 |
| HPV16 | E2 | 9 | 230 | GTEETQTTI | 20438 |
| HPV16 | E2 | 8 | 187 | HAGGQVIL | 20439 |
| HPV16 | E2 | 11 | 252 | HTTKLLHRDSV | 20440 |
| HPV16 | E2 | 8 | 356 | ITVSTGFM | 20441 |
| HPV16 | E2 | 10 | 356 | ITVSTGFMSI | 20442 |
| HPV16 | E2 | 8 | 68 | KALQAIEL | 20443 |

TABLE XIII-continued

B58 Supermotif Peptides

| Type | Protein | No. of Amino Acids | Position | Sequence | Seq. Id. No. |
|---|---|---|---|---|---|
| HPV16 | E2 | 10 | 68 | KALQAIELQL | 20444 |
| HPV16 | E2 | 10 | 45 | KAREMGFKHI | 20445 |
| HPV16 | E2 | 9 | 329 | KSAIVTLTY | 20446 |
| HPV16 | E2 | 9 | 354 | KTITVSTGF | 20447 |
| HPV16 | E2 | 10 | 354 | KTITVSTGFM | 20448 |
| HPV16 | E2 | 8 | 62 | LAVSKNKA | 20449 |
| HPV16 | E2 | 9 | 62 | LAVSKNKAL | 20450 |
| HPV16 | E2 | 11 | 62 | LAVSKNKALQA | 20451 |
| HPV16 | E2 | 10 | 347 | LSQVKIPKTI | 20452 |
| HPV16 | E2 | 8 | 103 | LTAPTGCI | 20453 |
| HPV16 | E2 | 11 | 16 | LTHYENDSTDL | 20454 |
| HPV16 | E2 | 11 | 77 | LTLETIYNSQY | 20455 |
| HPV16 | E2 | 8 | 282 | NSNTTPIV | 20456 |
| HPV16 | E2 | 10 | 282 | NSNTTPIVHL | 20457 |
| HPV16 | E2 | 9 | 84 | NSQYSNEKW | 20458 |
| HPV16 | E2 | 11 | 84 | NSQYSNEKWTL | 20459 |
| HPV16 | E2 | 8 | 272 | NSSHKGRI | 20460 |
| HPV16 | E2 | 8 | 296 | NTLKCLRY | 20461 |
| HPV16 | E2 | 10 | 296 | NTLKCLRYRF | 20462 |
| HPV16 | E2 | 8 | 127 | NTMHYTNW | 20463 |
| HPV16 | E2 | 11 | 127 | NTMHYTNWTHI | 20464 |
| HPV16 | E2 | 8 | 284 | NTTPIVHL | 20465 |
| HPV16 | E2 | 8 | 219 | PAATHTKA | 20466 |
| HPV16 | E2 | 9 | 219 | PAATHTKAV | 20467 |
| HPV16 | E2 | 10 | 219 | PAATHTKAVA | 20468 |
| HPV16 | E2 | 11 | 219 | PAATHTKAVAL | 20469 |
| HPV16 | E2 | 10 | 106 | PTGCIKKHGY | 20470 |
| HPV16 | E2 | 10 | 60 | PTLAVSKNKA | 20471 |
| HPV16 | E2 | 11 | 60 | PTLAVSKNKAL | 20472 |
| HPV16 | E2 | 10 | 196 | PTSVFSSNEV | 20473 |
| HPV16 | E2 | 9 | 71 | QAIELQLTL | 20474 |
| HPV16 | E2 | 11 | 165 | RTYFVQFKDDA | 20475 |
| HPV16 | E2 | 8 | 330 | SAIVTLTY | 20476 |
| HPV16 | E2 | 8 | 264 | SAPILTAF | 20477 |
| HPV16 | E2 | 10 | 201 | SSNEVSSPEI | 20478 |
| HPV16 | E2 | 11 | 201 | SSNEVSSPEII | 20479 |
| HPV16 | E2 | 10 | 206 | SSPEIIRQHL | 20480 |
| HPV16 | E2 | 11 | 206 | SSPEIIRQHLA | 20481 |
| HPV16 | E2 | 11 | 316 | SSTWHWTGHNV | 20482 |
| HPV16 | E2 | 8 | 23 | STDLRDHI | 20483 |
| HPV16 | E2 | 10 | 23 | STDLRDHIDY | 20484 |
| HPV16 | E2 | 11 | 23 | STDLRDHIDYW | 20485 |
| HPV16 | E2 | 10 | 317 | STWHWTGHNV | 20486 |
| HPV16 | E2 | 11 | 269 | TAFNSSHKGRI | 20487 |
| HPV16 | E2 | 9 | 313 | TAVSSTWHW | 20488 |
| HPV16 | E2 | 9 | 197 | TSVFSSNEV | 20489 |
| HPV16 | E2 | 10 | 253 | TTKLLHRDSV | 20490 |
| HPV16 | E2 | 11 | 285 | TTPIVHLKGDA | 20491 |
| HPV16 | E2 | 9 | 64 | VSKNKALQA | 20492 |
| HPV16 | E2 | 10 | 64 | VSKNKALQAI | 20493 |
| HPV16 | E2 | 9 | 97 | VSLEVYLTA | 20494 |
| HPV16 | E2 | 11 | 205 | VSSPEIIRQHL | 20495 |
| HPV16 | E2 | 8 | 358 | VSTGFMSI | 20496 |
| HPV16 | E2 | 9 | 333 | VTLTYDSEW | 20497 |
| HPV16 | E2 | 8 | 145 | VTVVEGQV | 20498 |
| HPV16 | E2 | 10 | 145 | VTVVEGQVDY | 20499 |
| HPV16 | E2 | 11 | 145 | VTVVEGQVDYY | 20500 |
| HPV16 | E2 | 11 | 321 | WTGHNVKHKSA | 20501 |
| HPV16 | E2 | 10 | 134 | WTHIYICEEA | 20502 |
| HPV16 | E2 | 8 | 92 | WTLQDVSL | 20503 |
| HPV16 | E2 | 10 | 92 | WTLQDVSLEV | 20504 |
| HPV16 | E2 | 11 | 92 | WTLQDVSLEVY | 20505 |
| HPV16 | E2 | 9 | 178 | YSKNKVWEV | 20506 |
| HPV16 | E2 | 11 | 178 | YSKNKVWEVHA | 20507 |
| HPV16 | E2 | 8 | 87 | YSNEKWTL | 20508 |
| HPV16 | E2 | 11 | 87 | YSNEKWTLQDV | 20509 |
| HPV16 | E2 | 8 | 312 | YTAVSSTW | 20510 |
| HPV16 | E2 | 10 | 312 | YTAVSSTWHW | 20511 |
| HPV16 | E2 | 8 | 131 | YTNWTHIY | 20512 |
| HPV16 | E2 | 9 | 131 | YTNWTHIYI | 20513 |
| HPV16 | E2 | 11 | 115 | YTVEVQFDGDI | 20514 |
| HPV16 | E5 | 8 | 53 | AASAFRCF | 20515 |
| HPV16 | E5 | 9 | 53 | AASAFRCFI | 20516 |
| HPV16 | E5 | 10 | 53 | AASAFRCFIV | 20517 |
| HPV16 | E5 | 11 | 53 | AASAFRCFIVY | 20518 |
| HPV16 | E5 | 8 | 54 | ASAFRCFI | 20519 |

TABLE XIII-continued

B58 Supermotif Peptides

| Type | Protein | No. of Amino Acids | Position | Sequence | Seq. Id. No. |
|---|---|---|---|---|---|
| HPV16 | E5 | 9 | 54 | ASAFRCFIV | 20520 |
| HPV16 | E5 | 10 | 54 | ASAFRCFIVY | 20521 |
| HPV16 | E5 | 11 | 54 | ASAFRCFIVYI | 20522 |
| HPV16 | E5 | 9 | 7 | ASTTLLACF | 20523 |
| HPV16 | E5 | 10 | 7 | ASTTLLACFL | 20524 |
| HPV16 | E5 | 11 | 7 | ASTTLLACFLL | 20525 |
| HPV16 | E5 | 8 | 5 | DTASTTLL | 20526 |
| HPV16 | E5 | 9 | 5 | DTASTTLLA | 20527 |
| HPV16 | E5 | 11 | 5 | DTASTTLLACF | 20528 |
| HPV16 | E5 | 8 | 75 | HTHARFLI | 20529 |
| HPV16 | E5 | 10 | 51 | ITAASAFRCF | 20530 |
| HPV16 | E5 | 11 | 51 | ITAASAFRCFI | 20531 |
| HPV16 | E5 | 8 | 12 | LACFLLCF | 20532 |
| HPV16 | E5 | 10 | 12 | LACFLLCFCV | 20533 |
| HPV16 | E5 | 11 | 12 | LACFLLCFCVL | 20534 |
| HPV16 | E5 | 9 | 34 | LSVSTYTSL | 20535 |
| HPV16 | E5 | 10 | 34 | LSVSTYTSLI | 20536 |
| HPV16 | E5 | 11 | 34 | LSVSTYTSLII | 20537 |
| HPV16 | E5 | 11 | 1 | MTNLDTASTTL | 20538 |
| HPV16 | E5 | 8 | 55 | SAFRCFIV | 20539 |
| HPV16 | E5 | 9 | 55 | SAFRCFIVY | 20540 |
| HPV16 | E5 | 10 | 55 | SAFRCFIVYI | 20541 |
| HPV16 | E5 | 11 | 55 | SAFRCFIVYII | 20542 |
| HPV16 | E5 | 8 | 8 | STTLLACF | 20543 |
| HPV16 | E5 | 9 | 8 | STTLLACFL | 20544 |
| HPV16 | E5 | 10 | 8 | STTLLACFLL | 20545 |
| HPV16 | E5 | 8 | 37 | STYTSLII | 20546 |
| HPV16 | E5 | 9 | 37 | STYTSLIIL | 20547 |
| HPV16 | E5 | 10 | 37 | STYTSLIILV | 20548 |
| HPV16 | E5 | 11 | 37 | STYTSLIILVL | 20549 |
| HPV16 | E5 | 9 | 52 | TAASAFRCF | 20550 |
| HPV16 | E5 | 10 | 52 | TAASAFRCFI | 20551 |
| HPV16 | E5 | 11 | 52 | TAASAFRCFIV | 20552 |
| HPV16 | E5 | 8 | 6 | TASTTLLA | 20553 |
| HPV16 | E5 | 10 | 6 | TASTTLLACF | 20554 |
| HPV16 | E5 | 11 | 6 | TASTTLLACFL | 20555 |
| HPV16 | E5 | 8 | 40 | TSLIILVL | 20556 |
| HPV16 | E5 | 9 | 40 | TSLIILVLL | 20557 |
| HPV16 | E5 | 10 | 40 | TSLIILVLLL | 20558 |
| HPV16 | E5 | 11 | 40 | TSLIILVLLLW | 20559 |
| HPV16 | E5 | 8 | 9 | TTLLACFL | 20560 |
| HPV16 | E5 | 9 | 9 | TTLLACFLL | 20561 |
| HPV16 | E5 | 11 | 9 | TTLLACFLLCF | 20562 |
| HPV16 | E5 | 8 | 36 | VSTYTSLI | 20563 |
| HPV16 | E5 | 9 | 36 | VSTYTSLII | 20564 |
| HPV16 | E5 | 10 | 36 | VSTYTSLIIL | 20565 |
| HPV16 | E5 | 11 | 36 | VSTYTSLIILV | 20566 |
| HPV16 | E5 | 8 | 39 | YTSLIILV | 20567 |
| HPV16 | E5 | 9 | 39 | YTSLIILVL | 20568 |
| HPV16 | E5 | 10 | 39 | YTSLIILVLL | 20569 |
| HPV16 | E5 | 11 | 39 | YTSLIILVLLL | 20570 |
| HPV16 | E6 | 8 | 23 | CTELQTTI | 20571 |
| HPV16 | E6 | 11 | 23 | CTELQTTIHDI | 20572 |
| HPV16 | E6 | 8 | 52 | FAFRDLCI | 20573 |
| HPV16 | E6 | 9 | 52 | FAFRDLCIV | 20574 |
| HPV16 | E6 | 10 | 52 | FAFRDLCIVY | 20575 |
| HPV16 | E6 | 8 | 92 | GTTLEQQY | 20576 |
| HPV16 | E6 | 9 | 80 | ISEYRHYCY | 20577 |
| HPV16 | E6 | 11 | 80 | ISEYRHYCYSL | 20578 |
| HPV16 | E6 | 8 | 27 | QTTIHDII | 20579 |
| HPV16 | E6 | 9 | 27 | QTTIHDIIL | 20580 |
| HPV16 | E6 | 11 | 148 | RSSRTRRETQL | 20581 |
| HPV16 | E6 | 8 | 151 | RTRRETQL | 20582 |
| HPV16 | E6 | 10 | 149 | SSRTRRETQL | 20583 |
| HPV16 | E6 | 8 | 28 | TTIHDIIL | 20584 |
| HPV16 | E6 | 11 | 28 | TTIHDIILECV | 20585 |
| HPV16 | E6 | 11 | 93 | TTLEQQYNKPL | 20586 |
| HPV16 | E6 | 8 | 67 | YAVCDKCL | 20587 |
| HPV16 | E6 | 10 | 67 | YAVCDKCLKF | 20588 |
| HPV16 | E6 | 11 | 67 | YAVCDKCLKFY | 20589 |
| HPV16 | E6 | 10 | 77 | YSKISEYRHY | 20590 |
| HPV16 | E6 | 8 | 88 | YSLYGTTL | 20591 |
| HPV16 | E7 | 9 | 30 | DSSEEEDEI | 20592 |
| HPV16 | E7 | 8 | 62 | DSTLRLCV | 20593 |
| HPV16 | E7 | 8 | 4 | DTPTLHEY | 20594 |
| HPV16 | E7 | 9 | 4 | DTPTLHEYM | 20595 |

TABLE XIII-continued

B58 Supermotif Peptides

| Type | Protein | No. of Amino Acids | Position | Sequence | Seq. Id. No. |
|---|---|---|---|---|---|
| HPV16 | E7 | 10 | 4 | DTPTLHEYML | 20596 |
| HPV16 | E7 | 8 | 18 | ETTDLYCY | 20597 |
| HPV16 | E7 | 11 | 18 | ETTDLYCYEQL | 20598 |
| HPV16 | E7 | 9 | 85 | GTLGIVCPI | 20599 |
| HPV16 | E7 | 10 | 41 | PAGQAEPDRA | 20600 |
| HPV16 | E7 | 8 | 6 | PTLHEYML | 20601 |
| HPV16 | E7 | 10 | 6 | PTLHEYMLDL | 20602 |
| HPV16 | E7 | 9 | 44 | QAEPDRAHY | 20603 |
| HPV16 | E7 | 11 | 44 | QAEPDRAHYNI | 20604 |
| HPV16 | E7 | 10 | 70 | QSTHVDIRTL | 20605 |
| HPV16 | E7 | 9 | 49 | RAHYNIVTF | 20606 |
| HPV16 | E7 | 8 | 77 | RTLEDLLM | 20607 |
| HPV16 | E7 | 11 | 77 | RTLEDLLMGTL | 20608 |
| HPV16 | E7 | 8 | 31 | SSEEEDEI | 20609 |
| HPV16 | E7 | 9 | 71 | STHVDIRTL | 20610 |
| HPV16 | E7 | 10 | 19 | TTDLYCYEQL | 20611 |
| HPV16 | E7 | 11 | 55 | VTFCCKCDSTL | 20612 |
| HPV16 | L1 | 10 | 372 | AAISTSETTY | 20613 |
| HPV16 | L1 | 8 | 158 | ASAYAANA | 20614 |
| HPV16 | L1 | 10 | 158 | ASAYAANAGV | 20615 |
| HPV16 | L1 | 8 | 35 | ATVYLPPV | 20616 |
| HPV16 | L1 | 10 | 35 | ATVYLPPVPV | 20617 |
| HPV16 | L1 | 11 | 371 | CAAISTSETTY | 20618 |
| HPV16 | L1 | 10 | 251 | CTSICKYPDY | 20619 |
| HPV16 | L1 | 11 | 251 | CTSICKYPDYI | 20620 |
| HPV16 | L1 | 9 | 329 | DAQIFNKPY | 20621 |
| HPV16 | L1 | 10 | 329 | DAQIFNKPYW | 20622 |
| HPV16 | L1 | 11 | 329 | DAQIFNKPYWL | 20623 |
| HPV16 | L1 | 8 | 154 | DTENASAY | 20624 |
| HPV16 | L1 | 9 | 154 | DTENASAYA | 20625 |
| HPV16 | L1 | 10 | 154 | DTENASAYAA | 20626 |
| HPV16 | L1 | 9 | 228 | DTGFGAMDF | 20627 |
| HPV16 | L1 | 8 | 120 | DTQRLVWA | 20628 |
| HPV16 | L1 | 10 | 120 | DTQRLVWACV | 20629 |
| HPV16 | L1 | 8 | 361 | DTTRSTNM | 20630 |
| HPV16 | L1 | 10 | 361 | DTTRSTNMSL | 20631 |
| HPV16 | L1 | 10 | 442 | DTYRFVTSQA | 20632 |
| HPV16 | L1 | 11 | 442 | DTYRFVTSQAI | 20633 |
| HPV16 | L1 | 9 | 34 | EATVYLPPV | 20634 |
| HPV16 | L1 | 11 | 34 | EATVYLPPVPV | 20635 |
| HPV16 | L1 | 9 | 378 | ETTYKNTNF | 20636 |
| HPV16 | L1 | 8 | 481 | FSADLDQF | 20637 |
| HPV16 | L1 | 10 | 481 | FSADLDQFPL | 20638 |
| HPV16 | L1 | 8 | 506 | FTLGKRKA | 20639 |
| HPV16 | L1 | 11 | 236 | FTTLQANKSEV | 20640 |
| HPV16 | L1 | 8 | 232 | GAMDFTTL | 20641 |
| HPV16 | L1 | 10 | 232 | GAMDFTTLQA | 20642 |
| HPV16 | L1 | 11 | 291 | GAVGENVPDDL | 20643 |
| HPV16 | L1 | 8 | 305 | GSGSTANL | 20644 |
| HPV16 | L1 | 9 | 305 | GSGSTANLA | 20645 |
| HPV16 | L1 | 8 | 323 | GSMVTSDA | 20646 |
| HPV16 | L1 | 10 | 323 | GSMVTSDAQI | 20647 |
| HPV16 | L1 | 11 | 323 | GSMVTSDAQIF | 20648 |
| HPV16 | L1 | 8 | 198 | GSPCTNVA | 20649 |
| HPV16 | L1 | 9 | 198 | GSPCTNVAV | 20650 |
| HPV16 | L1 | 11 | 307 | GSTANLASSNY | 20651 |
| HPV16 | L1 | 9 | 438 | GTLEDTYRF | 20652 |
| HPV16 | L1 | 10 | 438 | GTLEDTYRFV | 20653 |
| HPV16 | L1 | 8 | 64 | GTSRLLAV | 20654 |
| HPV16 | L1 | 8 | 62 | HAGTSRLL | 20655 |
| HPV16 | L1 | 9 | 62 | HAGTSRLLA | 20656 |
| HPV16 | L1 | 10 | 62 | HAGTSRLLAV | 20657 |
| HPV16 | L1 | 8 | 418 | HSMNSTIL | 20658 |
| HPV16 | L1 | 11 | 418 | HSMNSTILEDW | 20659 |
| HPV16 | L1 | 11 | 457 | HTPPAPKEDPL | 20660 |
| HPV16 | L1 | 10 | 452 | IACQKHTPPA | 20661 |
| HPV16 | L1 | 10 | 143 | ISGHPLLNKL | 20662 |
| HPV16 | L1 | 10 | 173 | ISMDYKQTQL | 20663 |
| HPV16 | L1 | 8 | 374 | ISTSETTY | 20664 |
| HPV16 | L1 | 8 | 11 | ITCYENDV | 20665 |
| HPV16 | L1 | 10 | 11 | ITCYENDVNV | 20666 |
| HPV16 | L1 | 11 | 11 | ITCYENDVNVY | 20667 |
| HPV16 | L1 | 8 | 407 | ITLTADVM | 20668 |
| HPV16 | L1 | 10 | 407 | ITLTADVMTY | 20669 |
| HPV16 | L1 | 11 | 407 | ITLTADVMTYI | 20670 |
| HPV16 | L1 | 8 | 501 | KAKPKFTL | 20671 |

TABLE XIII-continued

B58 Supermotif Peptides

| Type | Protein | No. of Amino Acids | Position | Sequence | Seq. Id. No. |
|---|---|---|---|---|---|
| HPV16 | L1 | 8 | 243 | KSEVPLDI | 20672 |
| HPV16 | L1 | 8 | 69 | LAVGHPYF | 20673 |
| HPV16 | L1 | 10 | 69 | LAVGHPYFPI | 20674 |
| HPV16 | L1 | 8 | 409 | LTADVMTY | 20675 |
| HPV16 | L1 | 9 | 409 | LTADVMTYI | 20676 |
| HPV16 | L1 | 9 | 27 | MSLWLPSEA | 20677 |
| HPV16 | L1 | 11 | 27 | MSLWLPSEATV | 20678 |
| HPV16 | L1 | 11 | 414 | MTYIHSMNSTI | 20679 |
| HPV16 | L1 | 10 | 164 | NAGVDNRECI | 20680 |
| HPV16 | L1 | 9 | 157 | NASAYAANA | 20681 |
| HPV16 | L1 | 11 | 157 | NASAYAANAGV | 20682 |
| HPV16 | L1 | 8 | 421 | NSTILEDW | 20683 |
| HPV16 | L1 | 10 | 421 | NSTILEDWNF | 20684 |
| HPV16 | L1 | 8 | 383 | NTNFKEYL | 20685 |
| HPV16 | L1 | 9 | 218 | NTVIQDGDM | 20686 |
| HPV16 | L1 | 10 | 218 | NTVIQDGDMV | 20687 |
| HPV16 | L1 | 8 | 460 | PAPKEDPL | 20688 |
| HPV16 | L1 | 11 | 460 | PAPKEDPLKKY | 20689 |
| HPV16 | L1 | 8 | 32 | PSEATVYL | 20690 |
| HPV16 | L1 | 11 | 32 | PSEATVYLPPV | 20691 |
| HPV16 | L1 | 10 | 321 | PSGSMVTSDA | 20692 |
| HPV16 | L1 | 8 | 319 | PTPSGSMV | 20693 |
| HPV16 | L1 | 10 | 515 | PTTSSTSTTA | 20694 |
| HPV16 | L1 | 10 | 497 | QAGLKAKPKF | 20695 |
| HPV16 | L1 | 9 | 240 | QANKSEVPL | 20696 |
| HPV16 | L1 | 11 | 240 | QANKSEVPLDI | 20697 |
| HPV16 | L1 | 9 | 289 | RAGAVGENV | 20698 |
| HPV16 | L1 | 9 | 341 | RAQGHNNGI | 20699 |
| HPV16 | L1 | 11 | 341 | RAQGHNNGICW | 20700 |
| HPV16 | L1 | 9 | 364 | RSTNMSLCA | 20701 |
| HPV16 | L1 | 10 | 364 | RSTNMSLCAA | 20702 |
| HPV16 | L1 | 11 | 364 | RSTNMSLCAAI | 20703 |
| HPV16 | L1 | 8 | 56 | RTNIYYHA | 20704 |
| HPV16 | L1 | 9 | 482 | SADLDQFPL | 20705 |
| HPV16 | L1 | 9 | 159 | SAYAANAGV | 20706 |
| HPV16 | L1 | 10 | 308 | STANLASSNY | 20707 |
| HPV16 | L1 | 11 | 308 | STANLASSNYF | 20708 |
| HPV16 | L1 | 11 | 49 | STDEYVARTNI | 20709 |
| HPV16 | L1 | 9 | 422 | STILEDWNF | 20710 |
| HPV16 | L1 | 11 | 422 | STILEDWNFGL | 20711 |
| HPV16 | L1 | 8 | 365 | STNMSLCA | 20712 |
| HPV16 | L1 | 9 | 365 | STNMSLCAA | 20713 |
| HPV16 | L1 | 10 | 365 | STNMSLCAAI | 20714 |
| HPV16 | L1 | 11 | 521 | STTAKRKKRKL | 20715 |
| HPV16 | L1 | 8 | 410 | TADVMTYI | 20716 |
| HPV16 | L1 | 11 | 410 | TADVMTYIHSM | 20717 |
| HPV16 | L1 | 9 | 523 | TAKRKKRKL | 20718 |
| HPV16 | L1 | 9 | 309 | TANLASSNY | 20719 |
| HPV16 | L1 | 10 | 309 | TANLASSNYF | 20720 |
| HPV16 | L1 | 11 | 327 | TSDAQIFNKPY | 20721 |
| HPV16 | L1 | 11 | 376 | TSETTYKNTNF | 20722 |
| HPV16 | L1 | 11 | 114 | TSFYNPDTQRL | 20723 |
| HPV16 | L1 | 9 | 252 | TSICKYPDY | 20724 |
| HPV16 | L1 | 10 | 252 | TSICKYPDYI | 20725 |
| HPV16 | L1 | 11 | 65 | TSRLLAVGHPY | 20726 |
| HPV16 | L1 | 8 | 517 | TSSTSTTA | 20727 |
| HPV16 | L1 | 10 | 522 | TTAKRKKRKL | 20728 |
| HPV16 | L1 | 10 | 237 | TTLQANKSEV | 20729 |
| HPV16 | L1 | 9 | 362 | TTRSTNMSL | 20730 |
| HPV16 | L1 | 11 | 362 | TTRSTNMSLCA | 20731 |
| HPV16 | L1 | 9 | 516 | TTSSTSTTA | 20732 |
| HPV16 | L1 | 8 | 379 | TTYKNTNF | 20733 |
| HPV16 | L1 | 11 | 379 | TTYKNTNFKEY | 20734 |
| HPV16 | L1 | 8 | 54 | VARTNIYY | 20735 |
| HPV16 | L1 | 10 | 54 | VARTNIYYHA | 20736 |
| HPV16 | L1 | 11 | 204 | VAVNPGDCPPL | 20737 |
| HPV16 | L1 | 9 | 264 | VSEPYGDSL | 20738 |
| HPV16 | L1 | 10 | 264 | VSEPYGDSLF | 20739 |
| HPV16 | L1 | 11 | 264 | VSEPYGDSLFF | 20740 |
| HPV16 | L1 | 8 | 91 | VSGLQYRV | 20741 |
| HPV16 | L1 | 9 | 91 | VSGLQYRVF | 20742 |
| HPV16 | L1 | 11 | 91 | VSGLQYRVFRI | 20743 |
| HPV16 | L1 | 10 | 44 | VSKVVSTDEY | 20744 |
| HPV16 | L1 | 11 | 44 | VSKVVSTDEYV | 20745 |
| HPV16 | L1 | 8 | 48 | VSTDEYVA | 20746 |
| HPV16 | L1 | 8 | 3 | VTFIYILV | 20747 |

TABLE XIII-continued

B58 Supermotif Peptides

| Type | Protein | No. of Amino Acids | Position | Sequence | Seq. Id. No. |
|---|---|---|---|---|---|
| HPV16 | L1 | 9 | 3 | VTFIYILVI | 20748 |
| HPV16 | L1 | 8 | 326 | VTSDAQIF | 20749 |
| HPV16 | L1 | 8 | 126 | WACVGVEV | 20750 |
| HPV16 | L1 | 8 | 470 | YTFWEVNL | 20751 |
| HPV16 | L2 | 11 | 355 | AALPTSINNGL | 20752 |
| HPV16 | L2 | 8 | 82 | ATDTLAPV | 20753 |
| HPV16 | L2 | 11 | 15 | ATQLYKTCKQA | 20754 |
| HPV16 | L2 | 8 | 116 | DAGAPTSV | 20755 |
| HPV16 | L2 | 11 | 116 | DAGAPTSVPSI | 20756 |
| HPV16 | L2 | 11 | 442 | DAGDFYLHPSY | 20757 |
| HPV16 | L2 | 8 | 334 | DSAEEIEL | 20758 |
| HPV16 | L2 | 11 | 334 | DSAEEIELQTI | 20759 |
| HPV16 | L2 | 10 | 84 | DTLAPVRPPL | 20760 |
| HPV16 | L2 | 10 | 376 | DTSTTPVPSV | 20761 |
| HPV16 | L2 | 9 | 140 | DTTPAILDI | 20762 |
| HPV16 | L2 | 8 | 176 | ETGGHFTL | 20763 |
| HPV16 | L2 | 9 | 111 | ETSFIDAGA | 20764 |
| HPV16 | L2 | 8 | 466 | FSDVSLAA | 20765 |
| HPV16 | L2 | 8 | 268 | FSSNDNSI | 20766 |
| HPV16 | L2 | 10 | 268 | FSSNDNSINI | 20767 |
| HPV16 | L2 | 11 | 268 | FSSNDNSINIA | 20768 |
| HPV16 | L2 | 10 | 330 | FSTIDSAEEI | 20769 |
| HPV16 | L2 | 8 | 181 | FTLSSSTI | 20770 |
| HPV16 | L2 | 8 | 321 | GAKVHYYY | 20771 |
| HPV16 | L2 | 10 | 321 | GAKVHYYYDF | 20772 |
| HPV16 | L2 | 9 | 118 | GAPTSVPSI | 20773 |
| HPV16 | L2 | 8 | 404 | GAYNIPLV | 20774 |
| HPV16 | L2 | 10 | 63 | GSGTGGRTGY | 20775 |
| HPV16 | L2 | 11 | 63 | GSGTGGRTGYI | 20776 |
| HPV16 | L2 | 10 | 49 | GSMGVFFGGL | 20777 |
| HPV16 | L2 | 8 | 433 | GSPQYTII | 20778 |
| HPV16 | L2 | 9 | 433 | GSPQYTIIA | 20779 |
| HPV16 | L2 | 11 | 433 | GSPQYTIIADA | 20780 |
| HPV16 | L2 | 8 | 218 | GSRPVARL | 20781 |
| HPV16 | L2 | 10 | 218 | GSRPVARLGL | 20782 |
| HPV16 | L2 | 11 | 218 | GSRPVARLGLY | 20783 |
| HPV16 | L2 | 8 | 26 | GTCPPDII | 20784 |
| HPV16 | L2 | 11 | 26 | GTCPPDIIPKV | 20785 |
| HPV16 | L2 | 8 | 65 | GTGGRTGY | 20786 |
| HPV16 | L2 | 9 | 65 | GTGGRTGYI | 20787 |
| HPV16 | L2 | 11 | 65 | GTGGRTGYIPL | 20788 |
| HPV16 | L2 | 11 | 76 | GTRPPTATDTL | 20789 |
| HPV16 | L2 | 8 | 354 | HAALPTSI | 20790 |
| HPV16 | L2 | 8 | 440 | IADAGDFY | 20791 |
| HPV16 | L2 | 9 | 440 | IADAGDFYL | 20792 |
| HPV16 | L2 | 8 | 41 | IADQILQY | 20793 |
| HPV16 | L2 | 11 | 41 | IADQILQYGSM | 20794 |
| HPV16 | L2 | 8 | 277 | IAPDPDFL | 20795 |
| HPV16 | L2 | 10 | 277 | IAPDPDFLDI | 20796 |
| HPV16 | L2 | 11 | 277 | IAPDPDFLDIV | 20797 |
| HPV16 | L2 | 9 | 188 | ISTHNYEEI | 20798 |
| HPV16 | L2 | 11 | 188 | ISTHNYEEIPM | 20799 |
| HPV16 | L2 | 8 | 420 | ITDQAPSL | 20800 |
| HPV16 | L2 | 9 | 420 | ITDQAPSLI | 20801 |
| HPV16 | L2 | 11 | 420 | ITDQAPSLIPI | 20802 |
| HPV16 | L2 | 9 | 374 | ITDTSTTPV | 20803 |
| HPV16 | L2 | 8 | 243 | ITTPTKLI | 20804 |
| HPV16 | L2 | 10 | 243 | ITTPTKLITY | 20805 |
| HPV16 | L2 | 10 | 135 | ITTSTDTTPA | 20806 |
| HPV16 | L2 | 11 | 135 | ITTSTDTTPAI | 20807 |
| HPV16 | L2 | 8 | 250 | ITYDNPAY | 20808 |
| HPV16 | L2 | 11 | 250 | ITYDNPAYEGI | 20809 |
| HPV16 | L2 | 9 | 318 | KSIGAKVHY | 20810 |
| HPV16 | L2 | 10 | 318 | KSIGAKVHYY | 20811 |
| HPV16 | L2 | 11 | 318 | KSIGAKVHYYY | 20812 |
| HPV16 | L2 | 8 | 39 | KTIADQIL | 20813 |
| HPV16 | L2 | 10 | 39 | KTIADQILQY | 20814 |
| HPV16 | L2 | 8 | 86 | LAPVRPPL | 20815 |
| HPV16 | L2 | 10 | 86 | LAPVRPPLTV | 20816 |
| HPV16 | L2 | 11 | 390 | LSGYIPANTTI | 20817 |
| HPV16 | L2 | 11 | 183 | LSSSTISTHNY | 20818 |
| HPV16 | L2 | 8 | 294 | LTSRRTGI | 20819 |
| HPV16 | L2 | 10 | 294 | LTSRRTGIRY | 20820 |
| HPV16 | L2 | 11 | 273 | NSINIAPDPDF | 20821 |
| HPV16 | L2 | 9 | 397 | NTTIPFGGA | 20822 |
| HPV16 | L2 | 10 | 397 | NTTIPFGGAY | 20823 |

TABLE XIII-continued

B58 Supermotif Peptides

| Type | Protein | No. of Amino Acids | Position | Sequence | Seq. Id. No. |
|---|---|---|---|---|---|
| HPV16 | L2 | 9 | 208 | NTVTSSTPI | 20824 |
| HPV16 | L2 | 8 | 174 | PAETGGHF | 20825 |
| HPV16 | L2 | 10 | 174 | PAETGGHFTL | 20826 |
| HPV16 | L2 | 10 | 240 | PAFITTPTKL | 20827 |
| HPV16 | L2 | 11 | 240 | PAFITTPTKLI | 20828 |
| HPV16 | L2 | 10 | 143 | PAILDINNTV | 20829 |
| HPV16 | L2 | 10 | 292 | PALTSRRTGI | 20830 |
| HPV16 | L2 | 8 | 395 | PANTTIPF | 20831 |
| HPV16 | L2 | 11 | 395 | PANTTIPFGGA | 20832 |
| HPV16 | L2 | 8 | 255 | PAYEGIDV | 20833 |
| HPV16 | L2 | 9 | 100 | PSDPSIVSL | 20834 |
| HPV16 | L2 | 10 | 100 | PSDPSIVSLV | 20835 |
| HPV16 | L2 | 10 | 124 | PSIPPDVSGF | 20836 |
| HPV16 | L2 | 8 | 386 | PSTSLSGY | 20837 |
| HPV16 | L2 | 9 | 386 | PSTSLSGYI | 20838 |
| HPV16 | L2 | 11 | 386 | PSTSLSGYIPA | 20839 |
| HPV16 | L2 | 10 | 346 | PSTYTTTSHA | 20840 |
| HPV16 | L2 | 11 | 346 | PSTYTTTSHAA | 20841 |
| HPV16 | L2 | 10 | 166 | PSVLQPPTPA | 20842 |
| HPV16 | L2 | 8 | 383 | PSVPSTSL | 20843 |
| HPV16 | L2 | 11 | 383 | PSVPSTSLSGY | 20844 |
| HPV16 | L2 | 8 | 80 | PTATDTLA | 20845 |
| HPV16 | L2 | 10 | 80 | PTATDTLAPV | 20846 |
| HPV16 | L2 | 8 | 161 | PTFTDPSV | 20847 |
| HPV16 | L2 | 9 | 161 | PTFTDPSVL | 20848 |
| HPV16 | L2 | 11 | 246 | PTKLITYDNPA | 20849 |
| HPV16 | L2 | 10 | 172 | PTPAETGGHF | 20850 |
| HPV16 | L2 | 8 | 358 | PTSINNGL | 20851 |
| HPV16 | L2 | 9 | 358 | PTSINNGLY | 20852 |
| HPV16 | L2 | 11 | 358 | PTSINNGLYDI | 20853 |
| HPV16 | L2 | 11 | 120 | PTSVPSIPPDV | 20854 |
| HPV16 | L2 | 9 | 24 | QAGTCPPDI | 20855 |
| HPV16 | L2 | 10 | 24 | QAGTCPPDII | 20856 |
| HPV16 | L2 | 8 | 423 | QAPSLIPI | 20857 |
| HPV16 | L2 | 9 | 423 | QAPSLIPIV | 20858 |
| HPV16 | L2 | 8 | 342 | QTITPSTY | 20859 |
| HPV16 | L2 | 11 | 310 | QTLRTRSGKSI | 20860 |
| HPV16 | L2 | 8 | 12 | RASATQLY | 20861 |
| HPV16 | L2 | 9 | 5 | RSAKRTKRA | 20862 |
| HPV16 | L2 | 11 | 5 | RSAKRTKRASA | 20863 |
| HPV16 | L2 | 8 | 315 | RSGKSIGA | 20864 |
| HPV16 | L2 | 10 | 315 | RSGKSIGAKV | 20865 |
| HPV16 | L2 | 9 | 298 | RTGIRYSRI | 20866 |
| HPV16 | L2 | 10 | 9 | RTKRASATQL | 20867 |
| HPV16 | L2 | 11 | 9 | RTKRASATQLY | 20868 |
| HPV16 | L2 | 8 | 313 | RTRSGKSI | 20869 |
| HPV16 | L2 | 10 | 313 | RTRSGKSIGA | 20870 |
| HPV16 | L2 | 8 | 230 | RTTQQVKV | 20871 |
| HPV16 | L2 | 9 | 230 | RTTQQVKVV | 20872 |
| HPV16 | L2 | 10 | 335 | SAEEIELQTI | 20873 |
| HPV16 | L2 | 8 | 6 | SAKRTKRA | 20874 |
| HPV16 | L2 | 10 | 6 | SAKRTKRASA | 20875 |
| HPV16 | L2 | 9 | 269 | SSNDNSINI | 20876 |
| HPV16 | L2 | 10 | 269 | SSNDNSINIA | 20877 |
| HPV16 | L2 | 10 | 184 | SSSTISTHNY | 20878 |
| HPV16 | L2 | 9 | 185 | SSTISTHNY | 20879 |
| HPV16 | L2 | 11 | 212 | SSTPIPGSRPV | 20880 |
| HPV16 | L2 | 8 | 138 | STDTTPAI | 20881 |
| HPV16 | L2 | 9 | 138 | STDTTPAIL | 20882 |
| HPV16 | L2 | 11 | 138 | STDTTPAILDI | 20883 |
| HPV16 | L2 | 8 | 189 | STHNYEEI | 20884 |
| HPV16 | L2 | 10 | 189 | STHNYEEIPM | 20885 |
| HPV16 | L2 | 9 | 331 | STIDSAEEI | 20886 |
| HPV16 | L2 | 11 | 331 | STIDSAEEIEL | 20887 |
| HPV16 | L2 | 8 | 186 | STISTHNY | 20888 |
| HPV16 | L2 | 11 | 186 | STISTHNYEEI | 20889 |
| HPV16 | L2 | 10 | 213 | STPIPGSRPV | 20890 |
| HPV16 | L2 | 11 | 213 | STPIPGSRPVA | 20891 |
| HPV16 | L2 | 8 | 387 | STSLSGYI | 20892 |
| HPV16 | L2 | 10 | 387 | STSLSGYIPA | 20893 |
| HPV16 | L2 | 8 | 378 | STTPVPSV | 20894 |
| HPV16 | L2 | 9 | 347 | STYTTTSHA | 20895 |
| HPV16 | L2 | 10 | 347 | STYTTTSHAA | 20896 |
| HPV16 | L2 | 11 | 347 | STYTTTSHAAL | 20897 |
| HPV16 | L2 | 9 | 81 | TATDTLAPV | 20898 |
| HPV16 | L2 | 8 | 112 | TSFIDAGA | 20899 |

TABLE XIII-continued

B58 Supermotif Peptides

| Type | Protein | No. of Amino Acids | Position | Sequence | Seq. Id. No. |
|---|---|---|---|---|---|
| HPV16 | L2 | 10 | 352 | TSHAALPTSI | 20900 |
| HPV16 | L2 | 8 | 359 | TSINNGLY | 20901 |
| HPV16 | L2 | 10 | 359 | TSINNGLYDI | 20902 |
| HPV16 | L2 | 11 | 359 | TSINNGLYDIY | 20903 |
| HPV16 | L2 | 9 | 388 | TSLSGYIPA | 20904 |
| HPV16 | L2 | 9 | 295 | TSRRTGIRY | 20905 |
| HPV16 | L2 | 8 | 137 | TSTDTTPA | 20906 |
| HPV16 | L2 | 9 | 137 | TSTDTTPAI | 20907 |
| HPV16 | L2 | 10 | 137 | TSTDTTPAIL | 20908 |
| HPV16 | L2 | 9 | 377 | TSTTPVPSV | 20909 |
| HPV16 | L2 | 10 | 121 | TSVPSIPPDV | 20910 |
| HPV16 | L2 | 8 | 156 | TTHNNPTF | 20911 |
| HPV16 | L2 | 8 | 398 | TTIPFGGA | 20912 |
| HPV16 | L2 | 9 | 398 | TTIPFGGAY | 20913 |
| HPV16 | L2 | 11 | 398 | TTIPFGGAYNI | 20914 |
| HPV16 | L2 | 8 | 141 | TTPAILDI | 20915 |
| HPV16 | L2 | 9 | 244 | TTPTKLITY | 20916 |
| HPV16 | L2 | 8 | 231 | TTQQVKVV | 20917 |
| HPV16 | L2 | 11 | 231 | TTQQVKVVDPA | 20918 |
| HPV16 | L2 | 11 | 351 | TTSHAALPTSI | 20919 |
| HPV16 | L2 | 9 | 136 | TTSTDTTPA | 20920 |
| HPV16 | L2 | 10 | 136 | TTSTDTTPAI | 20921 |
| HPV16 | L2 | 11 | 136 | TTSTDTTPAIL | 20922 |
| HPV16 | L2 | 8 | 350 | TTTSHAAL | 20923 |
| HPV16 | L2 | 11 | 153 | TTVTTHNNPTF | 20924 |
| HPV16 | L2 | 8 | 287 | VALHRPAL | 20925 |
| HPV16 | L2 | 8 | 411 | VSGPDIPI | 20926 |
| HPV16 | L2 | 10 | 411 | VSGPDIPINI | 20927 |
| HPV16 | L2 | 9 | 106 | VSLVEETSF | 20928 |
| HPV16 | L2 | 10 | 106 | VSLVEETSFI | 20929 |
| HPV16 | L2 | 8 | 203 | VSTNPNTV | 20930 |
| HPV16 | L2 | 9 | 155 | VTTHNNPTF | 20931 |
| HPV16 | L2 | 10 | 303 | YSRIGNKQTL | 20932 |
| HPV16 | L2 | 8 | 228 | YSRTTQQV | 20933 |
| HPV16 | L2 | 10 | 228 | YSRTTQQVKV | 20934 |
| HPV16 | L2 | 11 | 228 | YSRTTQQVKVV | 20935 |
| HPV16 | L2 | 10 | 437 | YTIIADAGDF | 20936 |
| HPV16 | L2 | 11 | 437 | YTIIADAGDFY | 20937 |
| HPV16 | L2 | 8 | 349 | YTTTSHAA | 20938 |
| HPV16 | L2 | 9 | 349 | YTTTSHAAL | 20939 |
| HPV18 | E1 | 11 | 396 | AAAFLKSNCQA | 20940 |
| HPV18 | E1 | 10 | 397 | AAFLKSNCQA | 20941 |
| HPV18 | E1 | 10 | 324 | AALYWYRTGI | 20942 |
| HPV18 | E1 | 8 | 40 | ATDTGSDM | 20943 |
| HPV18 | E1 | 9 | 40 | ATDTGSDMV | 20944 |
| HPV18 | E1 | 11 | 40 | ATDTGSDMVDF | 20945 |
| HPV18 | E1 | 10 | 413 | ATMCKHYRRA | 20946 |
| HPV18 | E1 | 8 | 531 | ATTTCWTY | 20947 |
| HPV18 | E1 | 9 | 531 | ATTTCWTYF | 20948 |
| HPV18 | E1 | 8 | 412 | CATMCKHY | 20949 |
| HPV18 | E1 | 11 | 412 | CATMCKHYRRA | 20950 |
| HPV18 | E1 | 9 | 139 | CSEVEATQI | 20951 |
| HPV18 | E1 | 11 | 139 | CSEVEATQIQV | 20952 |
| HPV18 | E1 | 8 | 160 | CSGGSTEA | 20953 |
| HPV18 | E1 | 9 | 160 | CSGGSTEAI | 20954 |
| HPV18 | E1 | 10 | 437 | CSKIDEGGDW | 20955 |
| HPV18 | E1 | 8 | 240 | CTDWVTAI | 20956 |
| HPV18 | E1 | 9 | 240 | CTDWVTAIF | 20957 |
| HPV18 | E1 | 11 | 240 | CTDWVTAIFGV | 20958 |
| HPV18 | E1 | 9 | 196 | CTIAQLKDL | 20959 |
| HPV18 | E1 | 10 | 196 | CTIAQLKDLL | 20960 |
| HPV18 | E1 | 9 | 635 | DADTEGNPF | 20961 |
| HPV18 | E1 | 8 | 78 | DAQVLHVL | 20962 |
| HPV18 | E1 | 9 | 530 | DATTTCWTY | 20963 |
| HPV18 | E1 | 10 | 530 | DATTTCWTYF | 20964 |
| HPV18 | E1 | 9 | 134 | DSGYGCSEV | 20965 |
| HPV18 | E1 | 11 | 134 | DSGYGCSEVEA | 20966 |
| HPV18 | E1 | 9 | 359 | DSNFDLSEM | 20967 |
| HPV18 | E1 | 10 | 359 | DSNFDLSEMV | 20968 |
| HPV18 | E1 | 8 | 391 | DSNSNAAA | 20969 |
| HPV18 | E1 | 9 | 391 | DSNSNAAAF | 20970 |
| HPV18 | E1 | 10 | 391 | DSNSNAAAFL | 20971 |
| HPV18 | E1 | 10 | 637 | DTEGNPFGTF | 20972 |
| HPV18 | E1 | 8 | 106 | DTELSPRL | 20973 |
| HPV18 | E1 | 11 | 106 | DTELSPRLQEI | 20974 |
| HPV18 | E1 | 9 | 42 | DTGSDMVDF | 20975 |

TABLE XIII-continued

B58 Supermotif Peptides

| Type | Protein | No. of Amino Acids | Position | Sequence | Seq. Id. No. |
|---|---|---|---|---|---|
| HPV18 | E1 | 10 | 42 | DTGSDMVDFI | 20976 |
| HPV18 | E1 | 10 | 522 | DTKVAMLDDA | 20977 |
| HPV18 | E1 | 9 | 342 | DTPEWIQRL | 20978 |
| HPV18 | E1 | 11 | 342 | DTPEWIQRLTI | 20979 |
| HPV18 | E1 | 10 | 52 | DTQGTFCEQA | 20980 |
| HPV18 | E1 | 10 | 220 | DTYGLSFTDL | 20981 |
| HPV18 | E1 | 11 | 220 | DTYGLSFTDLV | 20982 |
| HPV18 | E1 | 8 | 540 | DTYMRNAL | 20983 |
| HPV18 | E1 | 8 | 379 | EDSMAFEY | 20984 |
| HPV18 | E1 | 9 | 379 | EDSMAFEYA | 20985 |
| HPV18 | E1 | 10 | 379 | EDSMAFEYAL | 20986 |
| HPV18 | E1 | 11 | 379 | EDSMAFEYALL | 20987 |
| HPV18 | E1 | 9 | 587 | ESRITVFEF | 20988 |
| HPV18 | E1 | 9 | 64 | ETAQALFHA | 20989 |
| HPV18 | E1 | 11 | 309 | ETCMLIQPPKL | 20990 |
| HPV18 | E1 | 11 | 89 | FAGGSTENSPL | 20991 |
| HPV18 | E1 | 8 | 226 | FTDLVRNF | 20992 |
| HPV18 | E1 | 8 | 130 | FTISDSGY | 20993 |
| HPV18 | E1 | 11 | 212 | GAMLAVFKDTY | 20994 |
| HPV18 | E1 | 8 | 44 | GSDMVDFI | 20995 |
| HPV18 | E1 | 8 | 92 | GSTENSPL | 20996 |
| HPV18 | E1 | 9 | 172 | GTEGNNSSV | 20997 |
| HPV18 | E1 | 9 | 55 | GTFCEQAEL | 20998 |
| HPV18 | E1 | 8 | 11 | GTGCNGWF | 20999 |
| HPV18 | E1 | 9 | 11 | GTGCNGWFY | 21000 |
| HPV18 | E1 | 10 | 11 | GTGCNGWFYV | 21001 |
| HPV18 | E1 | 8 | 473 | GTPKKNCL | 21002 |
| HPV18 | E1 | 9 | 473 | GTPKKNCLV | 21003 |
| HPV18 | E1 | 10 | 473 | GTPKKNCLVF | 21004 |
| HPV18 | E1 | 8 | 182 | GTSDNSNI | 21005 |
| HPV18 | E1 | 11 | 182 | GTSDNSNIENV | 21006 |
| HPV18 | E1 | 9 | 71 | HAQEVHNDA | 21007 |
| HPV18 | E1 | 11 | 71 | HAQEVHNDAQV | 21008 |
| HPV18 | E1 | 8 | 254 | IAEGFKTL | 21009 |
| HPV18 | E1 | 9 | 254 | IAEGFKTLI | 21010 |
| HPV18 | E1 | 8 | 198 | IAQLKDLL | 21011 |
| HPV18 | E1 | 10 | 198 | IAQLKDLLKV | 21012 |
| HPV18 | E1 | 9 | 32 | ISDDEDENA | 21013 |
| HPV18 | E1 | 11 | 132 | ISDSGYGCSEV | 21014 |
| HPV18 | E1 | 11 | 336 | ISEVMGDTPEW | 21015 |
| HPV18 | E1 | 10 | 506 | ISFVNSTSHF | 21016 |
| HPV18 | E1 | 11 | 506 | ISFVNSTSHFW | 21017 |
| HPV18 | E1 | 10 | 552 | ISIDRKHKPL | 21018 |
| HPV18 | E1 | 11 | 552 | ISIDRKHKPLI | 21019 |
| HPV18 | E1 | 10 | 116 | ISLNSGQKKA | 21020 |
| HPV18 | E1 | 8 | 333 | ISNISEVM | 21021 |
| HPV18 | E1 | 10 | 461 | ITFLGALKSF | 21022 |
| HPV18 | E1 | 11 | 461 | ITFLGALKSFL | 21023 |
| HPV18 | E1 | 9 | 590 | ITVFEFPNA | 21024 |
| HPV18 | E1 | 10 | 590 | ITVFEFPNAF | 21025 |
| HPV18 | E1 | 9 | 124 | KAKRRLFTI | 21026 |
| HPV18 | E1 | 10 | 234 | KSDKTTCTDW | 21027 |
| HPV18 | E1 | 11 | 234 | KSDKTTCTDWV | 21028 |
| HPV18 | E1 | 8 | 401 | KSNCQAKY | 21029 |
| HPV18 | E1 | 9 | 401 | KSNCQAKYL | 21030 |
| HPV18 | E1 | 10 | 292 | KSRLTVAKGL | 21031 |
| HPV18 | E1 | 8 | 490 | KSYFGMSF | 21032 |
| HPV18 | E1 | 9 | 490 | KSYFGMSFI | 21033 |
| HPV18 | E1 | 11 | 490 | KSYFGMSFIHF | 21034 |
| HPV18 | E1 | 8 | 259 | KTLIQPFI | 21035 |
| HPV18 | E1 | 9 | 259 | KTLIQPFIL | 21036 |
| HPV18 | E1 | 10 | 259 | KTLIQPFILY | 21037 |
| HPV18 | E1 | 11 | 259 | KTLIQPFILYA | 21038 |
| HPV18 | E1 | 8 | 237 | KTTCTDWV | 21039 |
| HPV18 | E1 | 10 | 237 | KTTCTDWVTA | 21040 |
| HPV18 | E1 | 11 | 237 | KTTCTDWVTAI | 21041 |
| HPV18 | E1 | 8 | 389 | LADSNSNA | 21042 |
| HPV18 | E1 | 9 | 389 | LADSNSNAA | 21043 |
| HPV18 | E1 | 10 | 389 | LADSNSNAAA | 21044 |
| HPV18 | E1 | 11 | 389 | LADSNSNAAAF | 21045 |
| HPV18 | E1 | 8 | 215 | LAVFKDTY | 21046 |
| HPV18 | E1 | 10 | 215 | LAVFKDTYGL | 21047 |
| HPV18 | E1 | 8 | 364 | LSEMVQWA | 21048 |
| HPV18 | E1 | 9 | 364 | LSEMVQWAF | 21049 |
| HPV18 | E1 | 10 | 224 | LSFTDLVRNF | 21050 |
| HPV18 | E1 | 8 | 109 | LSPRLQEI | 21051 |

TABLE XIII-continued

B58 Supermotif Peptides

| Type | Protein | No. of Amino Acids | Position | Sequence | Seq. Id. No. |
|---|---|---|---|---|---|
| HPV18 | E1 | 10 | 109 | LSPRLQEISL | 21052 |
| HPV18 | E1 | 8 | 376 | LTDESDMA | 21053 |
| HPV18 | E1 | 9 | 376 | LTDESDMAF | 21054 |
| HPV18 | E1 | 11 | 376 | LTDESDMAFEY | 21055 |
| HPV18 | E1 | 8 | 520 | LTDTKVAM | 21056 |
| HPV18 | E1 | 9 | 520 | LTDTKVAML | 21057 |
| HPV18 | E1 | 8 | 350 | LTIIQHGI | 21058 |
| HPV18 | E1 | 8 | 571 | LTTNIHPA | 21059 |
| HPV18 | E1 | 10 | 295 | LTVAKGLSTL | 21060 |
| HPV18 | E1 | 11 | 295 | LTVAKGLSTLL | 21061 |
| HPV18 | E1 | 8 | 382 | MAFEYALL | 21062 |
| HPV18 | E1 | 9 | 382 | MAFEYALLA | 21063 |
| HPV18 | E1 | 10 | 495 | MSFIHFIQGA | 21064 |
| HPV18 | E1 | 11 | 495 | MSFIHFIQGAV | 21065 |
| HPV18 | E1 | 8 | 545 | NALDGNPI | 21066 |
| HPV18 | E1 | 10 | 545 | NALDGNPISI | 21067 |
| HPV18 | E1 | 9 | 39 | NATDTGSDM | 21068 |
| HPV18 | E1 | 10 | 39 | NATDTGSDMV | 21069 |
| HPV18 | E1 | 11 | 119 | NSGQKKAKRRL | 21070 |
| HPV18 | E1 | 8 | 393 | NSNAAAFL | 21071 |
| HPV18 | E1 | 8 | 96 | NSPLGERL | 21072 |
| HPV18 | E1 | 10 | 96 | NSPLGERLEV | 21073 |
| HPV18 | E1 | 8 | 510 | NSTSHFWL | 21074 |
| HPV18 | E1 | 11 | 510 | NSTSHFWLEPL | 21075 |
| HPV18 | E1 | 9 | 487 | NTGKSYFGM | 21076 |
| HPV18 | E1 | 11 | 487 | NTGKSYFGMSF | 21077 |
| HPV18 | E1 | 9 | 577 | PAKDNRWPY | 21078 |
| HPV18 | E1 | 10 | 577 | PAKDNRWPYL | 21079 |
| HPV18 | E1 | 8 | 485 | PANTGKSY | 21080 |
| HPV18 | E1 | 9 | 485 | PANTGKSYF | 21081 |
| HPV18 | E1 | 11 | 485 | PANTGKSYFGM | 21082 |
| HPV18 | E1 | 10 | 252 | PTIAEGFKTL | 21083 |
| HPV18 | E1 | 11 | 252 | PTIAEGFKTLI | 21084 |
| HPV18 | E1 | 9 | 60 | QAELETAQA | 21085 |
| HPV18 | E1 | 10 | 60 | QAELETAQAL | 21086 |
| HPV18 | E1 | 11 | 60 | QAELETAQALF | 21087 |
| HPV18 | E1 | 11 | 21 | QAIVDKKTGDV | 21088 |
| HPV18 | E1 | 9 | 405 | QAKYLKDCA | 21089 |
| HPV18 | E1 | 11 | 405 | QAKYLKDCATM | 21090 |
| HPV18 | E1 | 9 | 67 | QALFHAQEV | 21091 |
| HPV18 | E1 | 9 | 649 | RAGQNHRPL | 21092 |
| HPV18 | E1 | 9 | 421 | RAQKRQMNM | 21093 |
| HPV18 | E1 | 8 | 320 | RSSVAALY | 21094 |
| HPV18 | E1 | 9 | 320 | RSSVAALYW | 21095 |
| HPV18 | E1 | 10 | 320 | RSSVAALYWY | 21096 |
| HPV18 | E1 | 10 | 330 | RTGISNISEV | 21097 |
| HPV18 | E1 | 11 | 330 | RTGISNISEVM | 21098 |
| HPV18 | E1 | 8 | 622 | RTWSRLDL | 21099 |
| HPV18 | E1 | 8 | 321 | SSVAALYW | 21100 |
| HPV18 | E1 | 9 | 321 | SSVAALYWY | 21101 |
| HPV18 | E1 | 11 | 93 | STENSPLGERL | 21102 |
| HPV18 | E1 | 11 | 302 | STLLHVPETCM | 21103 |
| HPV18 | E1 | 10 | 511 | STSHFWLEPL | 21104 |
| HPV18 | E1 | 10 | 245 | TAIFGVNPTI | 21105 |
| HPV18 | E1 | 11 | 245 | TAIFGVNPTIA | 21106 |
| HPV18 | E1 | 8 | 65 | TAQALFHA | 21107 |
| HPV18 | E1 | 11 | 65 | TAQALFHAQEV | 21108 |
| HPV18 | E1 | 10 | 183 | TSDNSNIENV | 21109 |
| HPV18 | E1 | 9 | 512 | TSHFWLEPL | 21110 |
| HPV18 | E1 | 9 | 238 | TTCTDWVTA | 21111 |
| HPV18 | E1 | 10 | 238 | TTCTDWVTAI | 21112 |
| HPV18 | E1 | 11 | 238 | TTCTDWVTAIF | 21113 |
| HPV18 | E1 | 10 | 533 | TTCWTYFDTY | 21114 |
| HPV18 | E1 | 11 | 533 | TTCWTYFDTYM | 21115 |
| HPV18 | E1 | 10 | 150 | TTNGEHGGNV | 21116 |
| HPV18 | E1 | 8 | 532 | TTTCWTYF | 21117 |
| HPV18 | E1 | 11 | 532 | TTTCWTYFDTY | 21118 |
| HPV18 | E1 | 11 | 323 | VAALYWYRTGI | 21119 |
| HPV18 | E1 | 8 | 297 | VAKGLSTL | 21120 |
| HPV18 | E1 | 9 | 297 | VAKGLSTLL | 21121 |
| HPV18 | E1 | 11 | 297 | VAKGLSTLLHV | 21122 |
| HPV18 | E1 | 11 | 244 | VTAIFGVNPTI | 21123 |
| HPV18 | E1 | 11 | 149 | VTTNGEHGGNV | 21124 |
| HPV18 | E1 | 8 | 536 | WTYFDTYM | 21125 |
| HPV18 | E1 | 11 | 536 | WTYFDTYMRNA | 21126 |
| HPV18 | E1 | 11 | 268 | YAHIQCLDCKW | 21127 |

TABLE XIII-continued

B58 Supermotif Peptides

| Type | Protein | No. of Amino Acids | Position | Sequence | Seq. Id. No. |
|---|---|---|---|---|---|
| HPV18 | E1 | 11 | 386 | YALLADSNSNA | 21128 |
| HPV18 | E2 | 10 | 49 | AAREHGIQTL | 21129 |
| HPV18 | E2 | 10 | 245 | AATRPGHCGL | 21130 |
| HPV18 | E2 | 11 | 245 | AATRPGHCGLA | 21131 |
| HPV18 | E2 | 9 | 154 | ATCVSHRGL | 21132 |
| HPV18 | E2 | 10 | 154 | ATCVSHRGLY | 21133 |
| HPV18 | E2 | 11 | 154 | ATCVSHRGLYY | 21134 |
| HPV18 | E2 | 8 | 214 | ATQLVKQL | 21135 |
| HPV18 | E2 | 9 | 246 | ATRPGHCGL | 21136 |
| HPV18 | E2 | 10 | 246 | ATRPGHCGLA | 21137 |
| HPV18 | E2 | 8 | 282 | CSGNTTPI | 21138 |
| HPV18 | E2 | 9 | 282 | CSGNTTPII | 21139 |
| HPV18 | E2 | 11 | 282 | CSGNTTPIIHL | 21140 |
| HPV18 | E2 | 8 | 205 | CSTSDDTV | 21141 |
| HPV18 | E2 | 10 | 205 | CSTSDDTVSA | 21142 |
| HPV18 | E2 | 9 | 146 | DAGTWDKTA | 21143 |
| HPV18 | E2 | 9 | 26 | DSKDIDSQI | 21144 |
| HPV18 | E2 | 11 | 26 | DSKDIDSQIQY | 21145 |
| HPV18 | E2 | 11 | 202 | DSMCSTSDDTV | 21146 |
| HPV18 | E2 | 9 | 31 | DSQIQYWQL | 21147 |
| HPV18 | E2 | 10 | 31 | DSQIQYWQLI | 21148 |
| HPV18 | E2 | 9 | 354 | DSVQILVGY | 21149 |
| HPV18 | E2 | 10 | 354 | DSVQILVGYM | 21150 |
| HPV18 | E2 | 9 | 139 | DSVYYMTDA | 21151 |
| HPV18 | E2 | 8 | 210 | DTVSATQL | 21152 |
| HPV18 | E2 | 9 | 210 | DTVSATQLV | 21153 |
| HPV18 | E2 | 10 | 6 | ETLSERLSCV | 21154 |
| HPV18 | E2 | 8 | 340 | ETQRTKFL | 21155 |
| HPV18 | E2 | 11 | 340 | ETQRTKFLNTV | 21156 |
| HPV18 | E2 | 8 | 48 | FAAREHGI | 21157 |
| HPV18 | E2 | 11 | 48 | FAAREHGIQTL | 21158 |
| HPV18 | E2 | 9 | 324 | GAGNEKTGI | 21159 |
| HPV18 | E2 | 10 | 324 | GAGNEKTGIL | 21160 |
| HPV18 | E2 | 11 | 235 | GTAKTYGQTSA | 21161 |
| HPV18 | E2 | 10 | 148 | GTWDKTATCV | 21162 |
| HPV18 | E2 | 11 | 187 | GTWEVHFGNNV | 21163 |
| HPV18 | E2 | 8 | 309 | HSDHYRDI | 21164 |
| HPV18 | E2 | 9 | 338 | HSETQRTKF | 21165 |
| HPV18 | E2 | 10 | 338 | HSETQRTKFL | 21166 |
| HPV18 | E2 | 10 | 223 | HTPSPYSSTV | 21167 |
| HPV18 | E2 | 9 | 68 | ISKSKAHKA | 21168 |
| HPV18 | E2 | 10 | 68 | ISKSKAHKAI | 21169 |
| HPV18 | E2 | 10 | 316 | ISSTWHWTGA | 21170 |
| HPV18 | E2 | 8 | 72 | KAHKAIEL | 21171 |
| HPV18 | E2 | 10 | 72 | KAHKAIELQM | 21172 |
| HPV18 | E2 | 11 | 72 | KAHKAIELQMA | 21173 |
| HPV18 | E2 | 8 | 75 | KAIELQMA | 21174 |
| HPV18 | E2 | 9 | 75 | KAIELQMAL | 21175 |
| HPV18 | E2 | 8 | 70 | KSKAHKAI | 21176 |
| HPV18 | E2 | 10 | 70 | KSKAHKAIEL | 21177 |
| HPV18 | E2 | 11 | 152 | KTATCVSHRGL | 21178 |
| HPV18 | E2 | 9 | 329 | KTGILTVTY | 21179 |
| HPV18 | E2 | 8 | 238 | KTYGQTSA | 21180 |
| HPV18 | E2 | 9 | 238 | KTYGQTSAA | 21181 |
| HPV18 | E2 | 10 | 254 | LAEKQHCGPV | 21182 |
| HPV18 | E2 | 11 | 86 | LAQSRYKTEDW | 21183 |
| HPV18 | E2 | 8 | 12 | LSCVQDKI | 21184 |
| HPV18 | E2 | 9 | 12 | LSCVQDKII | 21185 |
| HPV18 | E2 | 8 | 8 | LSERLSCV | 21186 |
| HPV18 | E2 | 11 | 81 | MALQGLAQSRY | 21187 |
| HPV18 | E2 | 11 | 144 | MTDAGTWDKTA | 21188 |
| HPV18 | E2 | 9 | 133 | MTYVAWDSV | 21189 |
| HPV18 | E2 | 10 | 133 | MTYVAWDSVY | 21190 |
| HPV18 | E2 | 11 | 133 | MTYVAWDSVYY | 21191 |
| HPV18 | E2 | 8 | 297 | NSLKCLRY | 21192 |
| HPV18 | E2 | 10 | 297 | NSLKCLRYRL | 21193 |
| HPV18 | E2 | 8 | 107 | NTEPTHCF | 21194 |
| HPV18 | E2 | 9 | 185 | NTGTWEVHF | 21195 |
| HPV18 | E2 | 8 | 285 | NTTPIIHL | 21196 |
| HPV18 | E2 | 9 | 348 | NTVAIPDSV | 21197 |
| HPV18 | E2 | 11 | 348 | NTVAIPDSVQI | 21198 |
| HPV18 | E2 | 10 | 64 | PAYNISKSKA | 21199 |
| HPV18 | E2 | 8 | 225 | PSPYSSTV | 21200 |
| HPV18 | E2 | 10 | 225 | PSPYSSTVSV | 21201 |
| HPV18 | E2 | 10 | 272 | PTGNNKRRKL | 21202 |
| HPV18 | E2 | 9 | 88 | QSRYKTEDW | 21203 |

TABLE XIII-continued

B58 Supermotif Peptides

| Type | Protein | No. of Amino Acids | Position | Sequence | Seq. Id. No. |
|---|---|---|---|---|---|
| HPV18 | E2 | 11 | 88 | QSRYKTEDWTL | 21204 |
| HPV18 | E2 | 8 | 56 | QTLNHQVV | 21205 |
| HPV18 | E2 | 10 | 56 | QTLNHQVVPA | 21206 |
| HPV18 | E2 | 11 | 56 | QTLNHQVVPAY | 21207 |
| HPV18 | E2 | 11 | 2 | QTPKETLSERL | 21208 |
| HPV18 | E2 | 8 | 343 | RTKFLNTV | 21209 |
| HPV18 | E2 | 9 | 343 | RTKFLNTVA | 21210 |
| HPV18 | E2 | 10 | 343 | RTKFLNTVAI | 21211 |
| HPV18 | E2 | 11 | 244 | SAATRPGHCGL | 21212 |
| HPV18 | E2 | 9 | 213 | SATQLVKQL | 21213 |
| HPV18 | E2 | 9 | 229 | SSTVSVGTA | 21214 |
| HPV18 | E2 | 9 | 317 | SSTWHWTGA | 21215 |
| HPV18 | E2 | 9 | 206 | STSDDTVSA | 21216 |
| HPV18 | E2 | 8 | 230 | STVSVGTA | 21217 |
| HPV18 | E2 | 11 | 230 | STVSVGTAKTY | 21218 |
| HPV18 | E2 | 8 | 318 | STWHWTGA | 21219 |
| HPV18 | E2 | 10 | 236 | TAKTYGQTSA | 21220 |
| HPV18 | E2 | 11 | 236 | TAKTYGQTSAA | 21221 |
| HPV18 | E2 | 10 | 153 | TATCVSHRGL | 21222 |
| HPV18 | E2 | 11 | 153 | TATCVSHRGLY | 21223 |
| HPV18 | E2 | 8 | 207 | TSDDTVSA | 21224 |
| HPV18 | E2 | 11 | 207 | TSDDTVSATQL | 21225 |
| HPV18 | E2 | 9 | 350 | VAIPDSVQI | 21226 |
| HPV18 | E2 | 10 | 350 | VAIPDSVQIL | 21227 |
| HPV18 | E2 | 11 | 350 | VAIPDSVQILV | 21228 |
| HPV18 | E2 | 8 | 136 | VAWDSVYY | 21229 |
| HPV18 | E2 | 9 | 136 | VAWDSVYYM | 21230 |
| HPV18 | E2 | 10 | 212 | VSATQLVKQL | 21231 |
| HPV18 | E2 | 8 | 157 | VSHRGLYY | 21232 |
| HPV18 | E2 | 9 | 157 | VSHRGLYYV | 21233 |
| HPV18 | E2 | 9 | 232 | VSVGTAKTY | 21234 |
| HPV18 | E2 | 11 | 322 | WTGAGNEKTGI | 21235 |
| HPV18 | E2 | 10 | 96 | WTLQDTCEEL | 21236 |
| HPV18 | E2 | 11 | 96 | WTLQDTCEELW | 21237 |
| HPV18 | E2 | 10 | 228 | YSSTVSVGTA | 21238 |
| HPV18 | E5 | 8 | 47 | ATAFTVYV | 21239 |
| HPV18 | E5 | 9 | 47 | ATAFTVYVF | 21240 |
| HPV18 | E5 | 11 | 47 | ATAFTVYVFCF | 21241 |
| HPV18 | E5 | 8 | 29 | CAYAWVLV | 21242 |
| HPV18 | E5 | 9 | 29 | CAYAWVLVF | 21243 |
| HPV18 | E5 | 10 | 29 | CAYAWVLVFV | 21244 |
| HPV18 | E5 | 11 | 29 | CAYAWVLVFVY | 21245 |
| HPV18 | E5 | 8 | 50 | FTVYVFCF | 21246 |
| HPV18 | E5 | 9 | 50 | FTVYVFCFL | 21247 |
| HPV18 | E5 | 10 | 50 | FTVYVFCFLL | 21248 |
| HPV18 | E5 | 8 | 43 | ITSPATAF | 21249 |
| HPV18 | E5 | 10 | 43 | ITSPATAFTV | 21250 |
| HPV18 | E5 | 11 | 43 | ITSPATAFTVY | 21251 |
| HPV18 | E5 | 9 | 2 | LSLIFLFCF | 21252 |
| HPV18 | E5 | 11 | 2 | LSLIFLFCFCV | 21253 |
| HPV18 | E5 | 8 | 46 | PATAFTVY | 21254 |
| HPV18 | E5 | 9 | 46 | PATAFTVYV | 21255 |
| HPV18 | E5 | 10 | 46 | PATAFTVYVF | 21256 |
| HPV18 | E5 | 8 | 24 | PSVCMCAY | 21257 |
| HPV18 | E5 | 9 | 24 | PSVCMCAYA | 21258 |
| HPV18 | E5 | 10 | 24 | PSVCMCAYAW | 21259 |
| HPV18 | E5 | 11 | 24 | PSVCMCAYAWV | 21260 |
| HPV18 | E5 | 8 | 48 | TAFTVYVF | 21261 |
| HPV18 | E5 | 10 | 48 | TAFTVYVFCF | 21262 |
| HPV18 | E5 | 11 | 48 | TAFTVYVFCFL | 21263 |
| HPV18 | E5 | 9 | 44 | TSPATAFTV | 21264 |
| HPV18 | E5 | 10 | 44 | TSPATAFTVY | 21265 |
| HPV18 | E5 | 11 | 44 | TSPATAFTVYV | 21266 |
| HPV18 | E5 | 8 | 31 | YAWVLVFV | 21267 |
| HPV18 | E5 | 9 | 31 | YAWVLVFVY | 21268 |
| HPV18 | E5 | 10 | 31 | YAWVLVFVYI | 21269 |
| HPV18 | E5 | 11 | 31 | YAWVLVFVYIV | 21270 |
| HPV18 | E6 | 9 | 63 | AACHKCIDF | 21271 |
| HPV18 | E6 | 10 | 63 | AACHKCIDFY | 21272 |
| HPV18 | E6 | 8 | 18 | CTELNTSL | 21273 |
| HPV18 | E6 | 11 | 18 | CTELNTSLQDI | 21274 |
| HPV18 | E6 | 8 | 83 | DSVYGDTL | 21275 |
| HPV18 | E6 | 11 | 83 | DSVYGDTLEKL | 21276 |
| HPV18 | E6 | 11 | 88 | DTLEKLTNTGL | 21277 |
| HPV18 | E6 | 8 | 47 | FAFKDLFV | 21278 |
| HPV18 | E6 | 9 | 47 | FAFKDLFVV | 21279 |

TABLE XIII-continued

B58 Supermotif Peptides

| Type | Protein | No. of Amino Acids | Position | Sequence | Seq. Id. No. |
|---|---|---|---|---|---|
| HPV18 | E6 | 10 | 47 | FAFKDLFVVY | 21280 |
| HPV18 | E6 | 8 | 62 | HAACHKCI | 21281 |
| HPV18 | E6 | 10 | 62 | HAACHKCIDF | 21282 |
| HPV18 | E6 | 11 | 62 | HAACHKCIDFY | 21283 |
| HPV18 | E6 | 9 | 30 | ITCVYCKTV | 21284 |
| HPV18 | E6 | 10 | 30 | ITCVYCKTVL | 21285 |
| HPV18 | E6 | 9 | 36 | KTVLELTEV | 21286 |
| HPV18 | E6 | 10 | 36 | KTVLELTEVF | 21287 |
| HPV18 | E6 | 8 | 41 | LTEVFEFA | 21288 |
| HPV18 | E6 | 9 | 41 | LTEVFEFAF | 21289 |
| HPV18 | E6 | 9 | 93 | LTNTGLYNL | 21290 |
| HPV18 | E6 | 10 | 93 | LTNTGLYNLL | 21291 |
| HPV18 | E6 | 11 | 93 | LTNTGLYNLLI | 21292 |
| HPV18 | E6 | 8 | 95 | NTGLYNLL | 21293 |
| HPV18 | E6 | 9 | 95 | NTGLYNLLI | 21294 |
| HPV18 | E6 | 9 | 22 | NTSLQDIEI | 21295 |
| HPV18 | E6 | 8 | 114 | PAEKLRHL | 21296 |
| HPV18 | E6 | 8 | 7 | PTRRPYKL | 21297 |
| HPV18 | E6 | 11 | 7 | PTRRPYKLPDL | 21298 |
| HPV18 | E6 | 8 | 23 | TSLQDIEI | 21299 |
| HPV18 | E6 | 11 | 23 | TSLQDIEITCV | 21300 |
| HPV18 | E6 | 10 | 81 | YSDSVYGDTL | 21301 |
| HPV18 | E6 | 10 | 72 | YSRIRELRHY | 21302 |
| HPV18 | E7 | 8 | 6 | ATLQDIVL | 21303 |
| HPV18 | E7 | 10 | 6 | ATLQDIVLHL | 21304 |
| HPV18 | E7 | 9 | 33 | DSEEENDEI | 21305 |
| HPV18 | E7 | 8 | 69 | EARIKLVV | 21306 |
| HPV18 | E7 | 9 | 77 | ESSADDLRA | 21307 |
| HPV18 | E7 | 10 | 77 | ESSADDLRAF | 21308 |
| HPV18 | E7 | 8 | 5 | KATLQDIV | 21309 |
| HPV18 | E7 | 9 | 5 | KATLQDIVL | 21310 |
| HPV18 | E7 | 11 | 5 | KATLQDIVLHL | 21311 |
| HPV18 | E7 | 11 | 31 | LSDSEEENDEI | 21312 |
| HPV18 | E7 | 9 | 94 | LSFVCPWCA | 21313 |
| HPV18 | E7 | 9 | 92 | NTLSFVCPW | 21314 |
| HPV18 | E7 | 11 | 92 | NTLSFVCPWCA | 21315 |
| HPV18 | E7 | 9 | 53 | RAEPQRHTM | 21316 |
| HPV18 | E7 | 10 | 53 | RAEPQRHTML | 21317 |
| HPV18 | E7 | 8 | 84 | RAFQQLFL | 21318 |
| HPV18 | E7 | 11 | 84 | RAFQQLFLNTL | 21319 |
| HPV18 | E7 | 8 | 79 | SADDLRAF | 21320 |
| HPV18 | E7 | 11 | 79 | SADDLRAFQQL | 21321 |
| HPV18 | E7 | 8 | 78 | SSADDLRA | 21322 |
| HPV18 | E7 | 9 | 78 | SSADDLRAF | 21323 |
| HPV18 | L1 | 10 | 494 | AAPAENKDPY | 21324 |
| HPV18 | L1 | 10 | 195 | AATSNVSEDV | 21325 |
| HPV18 | L1 | 8 | 345 | ASPGSCVY | 21326 |
| HPV18 | L1 | 11 | 407 | ASTQSPVPGQY | 21327 |
| HPV18 | L1 | 11 | 419 | ATKFKQYSRHV | 21328 |
| HPV18 | L1 | 9 | 196 | ATSNVSEDV | 21329 |
| HPV18 | L1 | 8 | 552 | ATTSSKPA | 21330 |
| HPV18 | L1 | 11 | 552 | ATTSSKPAKRV | 21331 |
| HPV18 | L1 | 9 | 222 | CAPAIGEHW | 21332 |
| HPV18 | L1 | 10 | 222 | CAPAIGEHWA | 21333 |
| HPV18 | L1 | 8 | 406 | CASTQSPV | 21334 |
| HPV18 | L1 | 9 | 441 | CTITLTADV | 21335 |
| HPV18 | L1 | 10 | 441 | CTITLTADVM | 21336 |
| HPV18 | L1 | 11 | 493 | DAAPAENKDPY | 21337 |
| HPV18 | L1 | 8 | 418 | DATKFKQY | 21338 |
| HPV18 | L1 | 9 | 364 | DSQLFNKPY | 21339 |
| HPV18 | L1 | 10 | 364 | DSQLFNKPYW | 21340 |
| HPV18 | L1 | 11 | 364 | DSQLFNKPYWL | 21341 |
| HPV18 | L1 | 8 | 189 | DTESSHAA | 21342 |
| HPV18 | L1 | 9 | 263 | DTGYGAMDF | 21343 |
| HPV18 | L1 | 8 | 276 | DTKCEVPL | 21344 |
| HPV18 | L1 | 10 | 276 | DTKCEVPLDI | 21345 |
| HPV18 | L1 | 8 | 396 | DTTPSTNL | 21346 |
| HPV18 | L1 | 10 | 396 | DTTPSTNLTI | 21347 |
| HPV18 | L1 | 8 | 330 | DTVPQSLY | 21348 |
| HPV18 | L1 | 9 | 330 | DTVPQSLYI | 21349 |
| HPV18 | L1 | 9 | 478 | DTYRFVQSV | 21350 |
| HPV18 | L1 | 10 | 478 | DTYRFVQSVA | 21351 |
| HPV18 | L1 | 11 | 478 | DTYRFVQSVAI | 21352 |
| HPV18 | L1 | 10 | 191 | ESSHAATSNV | 21353 |
| HPV18 | L1 | 8 | 155 | ETQRLVWA | 21354 |
| HPV18 | L1 | 10 | 155 | ETQRLVWACA | 21355 |

TABLE XIII-continued

B58 Supermotif Peptides

| Type | Protein | No. of Amino Acids | Position | Sequence | Seq. Id. No. |
|---|---|---|---|---|---|
| HPV18 | L1 | 9 | 317 | FARHFWNRA | 21356 |
| HPV18 | L1 | 8 | 517 | FSLDLDQY | 21357 |
| HPV18 | L1 | 10 | 517 | FSLDLDQYPL | 21358 |
| HPV18 | L1 | 11 | 271 | FSTLQDTKCEV | 21359 |
| HPV18 | L1 | 8 | 267 | GAMDFSTL | 21360 |
| HPV18 | L1 | 10 | 358 | GSIVTSDSQL | 21361 |
| HPV18 | L1 | 11 | 358 | GSIVTSDSQLF | 21362 |
| HPV18 | L1 | 8 | 99 | GSSRLLTV | 21363 |
| HPV18 | L1 | 9 | 233 | GTACKSRPL | 21364 |
| HPV18 | L1 | 11 | 326 | GTMGDTVPQSL | 21365 |
| HPV18 | L1 | 11 | 194 | HAATSNVSEDV | 21366 |
| HPV18 | L1 | 8 | 97 | HAGSSRLL | 21367 |
| HPV18 | L1 | 10 | 97 | HAGSSRLLTV | 21368 |
| HPV18 | L1 | 8 | 30 | HSILVYMV | 21369 |
| HPV18 | L1 | 10 | 30 | HSILVYMVHI | 21370 |
| HPV18 | L1 | 11 | 30 | HSILVYMVHII | 21371 |
| HPV18 | L1 | 8 | 454 | HSMNSSIL | 21372 |
| HPV18 | L1 | 11 | 454 | HSMNSSILEDW | 21373 |
| HPV18 | L1 | 8 | 488 | ITCQKDAA | 21374 |
| HPV18 | L1 | 10 | 488 | ITCQKDAAPA | 21375 |
| HPV18 | L1 | 8 | 443 | ITLTADVM | 21376 |
| HPV18 | L1 | 10 | 443 | ITLTADVMSY | 21377 |
| HPV18 | L1 | 11 | 443 | ITLTADVMSYI | 21378 |
| HPV18 | L1 | 9 | 376 | KAQGHNNGV | 21379 |
| HPV18 | L1 | 11 | 376 | KAQGHNNGVCW | 21380 |
| HPV18 | L1 | 10 | 178 | LSGHPFYNKL | 21381 |
| HPV18 | L1 | 9 | 241 | LSQGDCPPL | 21382 |
| HPV18 | L1 | 11 | 241 | LSQGDCPPLEL | 21383 |
| HPV18 | L1 | 8 | 445 | LTADVMSY | 21384 |
| HPV18 | L1 | 9 | 445 | LTADVMSYI | 21385 |
| HPV18 | L1 | 11 | 403 | LTICASTQSPV | 21386 |
| HPV18 | L1 | 8 | 104 | LTVGNPYF | 21387 |
| HPV18 | L1 | 10 | 104 | LTVGNPYFRV | 21388 |
| HPV18 | L1 | 11 | 62 | MALWRPSDNTV | 21389 |
| HPV18 | L1 | 10 | 298 | MSADPYGDSM | 21390 |
| HPV18 | L1 | 11 | 298 | MSADPYGDSMF | 21391 |
| HPV18 | L1 | 11 | 450 | MSYIHSMNSSI | 21392 |
| HPV18 | L1 | 8 | 457 | NSSILEDW | 21393 |
| HPV18 | L1 | 10 | 457 | NSSILEDWNF | 21394 |
| HPV18 | L1 | 11 | 84 | NTDDYVTPTSI | 21395 |
| HPV18 | L1 | 9 | 253 | NTVLEDGDM | 21396 |
| HPV18 | L1 | 10 | 253 | NTVLEDGDMV | 21397 |
| HPV18 | L1 | 10 | 70 | NTVYLPPPSV | 21398 |
| HPV18 | L1 | 11 | 70 | NTVYLPPPSVA | 21399 |
| HPV18 | L1 | 8 | 496 | PAENKDPY | 21400 |
| HPV18 | L1 | 11 | 496 | PAENKDPYDKL | 21401 |
| HPV18 | L1 | 10 | 114 | PAGGGNKQDI | 21402 |
| HPV18 | L1 | 8 | 224 | PAIGEHWA | 21403 |
| HPV18 | L1 | 9 | 558 | PAKRVRVRA | 21404 |
| HPV18 | L1 | 8 | 344 | PASPGSCV | 21405 |
| HPV18 | L1 | 9 | 344 | PASPGSCVY | 21406 |
| HPV18 | L1 | 10 | 550 | PSATTSSKPA | 21407 |
| HPV18 | L1 | 8 | 67 | PSDNTVYL | 21408 |
| HPV18 | L1 | 8 | 354 | PSPSGSIV | 21409 |
| HPV18 | L1 | 9 | 399 | PSTNLTICA | 21410 |
| HPV18 | L1 | 10 | 540 | PTIGPRKRSA | 21411 |
| HPV18 | L1 | 8 | 91 | PTSIFYHA | 21412 |
| HPV18 | L1 | 9 | 472 | PTTSLVDTY | 21413 |
| HPV18 | L1 | 11 | 472 | PTTSLVDTYRF | 21414 |
| HPV18 | L1 | 10 | 533 | QAGLRRKPTI | 21415 |
| HPV18 | L1 | 9 | 287 | QSICKYPDY | 21416 |
| HPV18 | L1 | 10 | 287 | QSICKYPDYL | 21417 |
| HPV18 | L1 | 10 | 334 | QSLYIKGTGM | 21418 |
| HPV18 | L1 | 8 | 410 | QSPVPGQY | 21419 |
| HPV18 | L1 | 10 | 410 | QSPVPGQYDA | 21420 |
| HPV18 | L1 | 11 | 484 | QSVAITCQKDA | 21421 |
| HPV18 | L1 | 10 | 214 | QTQLCILGCA | 21422 |
| HPV18 | L1 | 9 | 324 | RAGTMGDTV | 21423 |
| HPV18 | L1 | 9 | 299 | SADPYGDSM | 21424 |
| HPV18 | L1 | 10 | 299 | SADPYGDSMF | 21425 |
| HPV18 | L1 | 11 | 299 | SADPYGDSMFF | 21426 |
| HPV18 | L1 | 9 | 551 | SATTSSKPA | 21427 |
| HPV18 | L1 | 8 | 127 | SAYQYRVF | 21428 |
| HPV18 | L1 | 10 | 127 | SAYQYRVFV | 21429 |
| HPV18 | L1 | 9 | 192 | SSHAATSNV | 21430 |
| HPV18 | L1 | 9 | 458 | SSILEDWNF | 21431 |

TABLE XIII-continued

B58 Supermotif Peptides

| Type | Protein | No. of Amino Acids | Position | Sequence | Seq. Id. No. |
|---|---|---|---|---|---|
| HPV18 | L1 | 11 | 458 | SSILEDWNFGV | 21432 |
| HPV18 | L1 | 8 | 555 | SSKPAKRV | 21433 |
| HPV18 | L1 | 10 | 555 | SSKPAKRVRV | 21434 |
| HPV18 | L1 | 11 | 100 | SSRLLTVGNPY | 21435 |
| HPV18 | L1 | 10 | 272 | STLQDTKCEV | 21436 |
| HPV18 | L1 | 8 | 400 | STNLTICA | 21437 |
| HPV18 | L1 | 10 | 408 | STQSPVPGQY | 21438 |
| HPV18 | L1 | 8 | 234 | TACKSRPL | 21439 |
| HPV18 | L1 | 8 | 446 | TADVMSYI | 21440 |
| HPV18 | L1 | 11 | 446 | TADVMSYIHSM | 21441 |
| HPV18 | L1 | 11 | 362 | TSDSQLFNKPY | 21442 |
| HPV18 | L1 | 11 | 149 | TSIYNPETQRL | 21443 |
| HPV18 | L1 | 9 | 474 | TSLVDTYRF | 21444 |
| HPV18 | L1 | 10 | 474 | TSLVDTYRFV | 21445 |
| HPV18 | L1 | 8 | 197 | TSNVSEDV | 21446 |
| HPV18 | L1 | 9 | 554 | TSSKPAKRV | 21447 |
| HPV18 | L1 | 11 | 554 | TSSKPAKRVRV | 21448 |
| HPV18 | L1 | 9 | 397 | TTPSTNLTI | 21449 |
| HPV18 | L1 | 11 | 397 | TTPSTNLTICA | 21450 |
| HPV18 | L1 | 8 | 473 | TTSLVDTY | 21451 |
| HPV18 | L1 | 10 | 473 | TTSLVDTYRF | 21452 |
| HPV18 | L1 | 11 | 473 | TTSLVDTYRFV | 21453 |
| HPV18 | L1 | 10 | 553 | TTSSKPAKRV | 21454 |
| HPV18 | L1 | 9 | 486 | VAITCQKDA | 21455 |
| HPV18 | L1 | 10 | 486 | VAITCQKDAA | 21456 |
| HPV18 | L1 | 10 | 79 | VARVVNTDDY | 21457 |
| HPV18 | L1 | 11 | 79 | VARVVNTDDYV | 21458 |
| HPV18 | L1 | 8 | 126 | VSAYQYRV | 21459 |
| HPV18 | L1 | 9 | 126 | VSAYQYRVF | 21460 |
| HPV18 | L1 | 11 | 126 | VSAYQYRVFRV | 21461 |
| HPV18 | L1 | 9 | 200 | VSEDVRDNV | 21462 |
| HPV18 | L1 | 11 | 200 | VSEDVRDNVSV | 21463 |
| HPV18 | L1 | 10 | 208 | VSVDYKQTQL | 21464 |
| HPV18 | L1 | 8 | 89 | VTPTSIFY | 21465 |
| HPV18 | L1 | 10 | 89 | VTPTSIFYHA | 21466 |
| HPV18 | L1 | 8 | 361 | VTSDSQLF | 21467 |
| HPV18 | L1 | 8 | 161 | WACAGVEI | 21468 |
| HPV18 | L1 | 9 | 352 | YSPSPSGSI | 21469 |
| HPV18 | L1 | 10 | 352 | YSPSPSGSIV | 21470 |
| HPV18 | L1 | 8 | 425 | YSRHVEEY | 21471 |
| HPV18 | L1 | 10 | 425 | YSRHVEEYDL | 21472 |
| HPV18 | L1 | 9 | 4 | YTRVLILHY | 21473 |
| HPV18 | L1 | 11 | 4 | YTRVLILHYHL | 21474 |
| HPV18 | L2 | 9 | 6 | AARRKRASV | 21475 |
| HPV18 | L2 | 10 | 201 | ASSGTGEEPI | 21476 |
| HPV18 | L2 | 9 | 381 | ASSYSNVTV | 21477 |
| HPV18 | L2 | 11 | 381 | ASSYSNVTVPL | 21478 |
| HPV18 | L2 | 8 | 423 | ASTQYIGI | 21479 |
| HPV18 | L2 | 8 | 341 | ATEDNDLF | 21480 |
| HPV18 | L2 | 10 | 341 | ATEDNDLFDI | 21481 |
| HPV18 | L2 | 11 | 341 | ATEDNDLFDIY | 21482 |
| HPV18 | L2 | 11 | 303 | ATMFTRSGTQI | 21483 |
| HPV18 | L2 | 8 | 273 | DSDFMDII | 21484 |
| HPV18 | L2 | 10 | 273 | DSDFMDIIRL | 21485 |
| HPV18 | L2 | 9 | 109 | DSSVVTSGA | 21486 |
| HPV18 | L2 | 8 | 455 | FADGFVAA | 21487 |
| HPV18 | L2 | 10 | 369 | FAFFKYSPTI | 21488 |
| HPV18 | L2 | 11 | 200 | FASSGTGEEPI | 21489 |
| HPV18 | L2 | 9 | 162 | FSDPSIIEV | 21490 |
| HPV18 | L2 | 8 | 296 | FSRLGQRA | 21491 |
| HPV18 | L2 | 10 | 296 | FSRLGQRATM | 21492 |
| HPV18 | L2 | 11 | 296 | FSRLGQRATMF | 21493 |
| HPV18 | L2 | 9 | 122 | FTGTSGFDI | 21494 |
| HPV18 | L2 | 11 | 157 | FTNPAFSDPSI | 21495 |
| HPV18 | L2 | 8 | 306 | FTRSGTQI | 21496 |
| HPV18 | L2 | 10 | 306 | FTRSGTQIGA | 21497 |
| HPV18 | L2 | 10 | 314 | GARVHFYHDI | 21498 |
| HPV18 | L2 | 10 | 62 | GSGTGGRTGY | 21499 |
| HPV18 | L2 | 11 | 62 | GSGTGGRTGYI | 21500 |
| HPV18 | L2 | 8 | 25 | GTCPPDVV | 21501 |
| HPV18 | L2 | 11 | 25 | GTCPPDVVPKV | 21502 |
| HPV18 | L2 | 8 | 64 | GTGGRTGY | 21503 |
| HPV18 | L2 | 9 | 64 | GTGGRTGYI | 21504 |
| HPV18 | L2 | 11 | 64 | GTGGRTGYIPL | 21505 |
| HPV18 | L2 | 8 | 188 | GTHGYEEI | 21506 |
| HPV18 | L2 | 10 | 188 | GTHGYEEIPL | 21507 |

TABLE XIII-continued

B58 Supermotif Peptides

| Type | Protein | No. of Amino Acids | Position | Sequence | Seq. Id. No. |
|---|---|---|---|---|---|
| HPV18 | L2 | 9 | 432 | GTHYYLWPL | 21508 |
| HPV18 | L2 | 10 | 432 | GTHYYLWPLY | 21509 |
| HPV18 | L2 | 11 | 432 | GTHYYLWPLYY | 21510 |
| HPV18 | L2 | 10 | 183 | GTPTSGTHGY | 21511 |
| HPV18 | L2 | 8 | 310 | GTQIGARV | 21512 |
| HPV18 | L2 | 10 | 310 | GTQIGARVHF | 21513 |
| HPV18 | L2 | 11 | 310 | GTQIGARVHFY | 21514 |
| HPV18 | L2 | 10 | 124 | GTSGFDITSA | 21515 |
| HPV18 | L2 | 8 | 37 | GTTLADKI | 21516 |
| HPV18 | L2 | 9 | 37 | GTTLADKIL | 21517 |
| HPV18 | L2 | 11 | 37 | GTTLADKILQW | 21518 |
| HPV18 | L2 | 8 | 134 | GTTTPAVL | 21519 |
| HPV18 | L2 | 10 | 134 | GTTTPAVLDI | 21520 |
| HPV18 | L2 | 8 | 292 | GTVRFSRL | 21521 |
| HPV18 | L2 | 8 | 326 | IAPSPEYI | 21522 |
| HPV18 | L2 | 10 | 326 | IAPSPEYIEL | 21523 |
| HPV18 | L2 | 10 | 323 | ISPIAPSPEY | 21524 |
| HPV18 | L2 | 11 | 323 | ISPIAPSPEYI | 21525 |
| HPV18 | L2 | 10 | 378 | ISSASSYSNV | 21526 |
| HPV18 | L2 | 9 | 210 | ISSTPLPTV | 21527 |
| HPV18 | L2 | 10 | 152 | ISTTNFTNPA | 21528 |
| HPV18 | L2 | 11 | 152 | ISTTNFTNPAF | 21529 |
| HPV18 | L2 | 9 | 405 | ITLPSTTSV | 21530 |
| HPV18 | L2 | 10 | 405 | ITLPSTTSVW | 21531 |
| HPV18 | L2 | 8 | 143 | ITPSSTSV | 21532 |
| HPV18 | L2 | 10 | 143 | ITPSSTSVSI | 21533 |
| HPV18 | L2 | 10 | 130 | ITSAGTTTPA | 21534 |
| HPV18 | L2 | 11 | 130 | ITSAGTTTPAV | 21535 |
| HPV18 | L2 | 8 | 249 | ITYDNPAF | 21536 |
| HPV18 | L2 | 11 | 249 | ITYDNPAFEPV | 21537 |
| HPV18 | L2 | 8 | 40 | LADKILQW | 21538 |
| HPV18 | L2 | 11 | 40 | LADKILQWSSL | 21539 |
| HPV18 | L2 | 9 | 263 | LTFDPRSDV | 21540 |
| HPV18 | L2 | 8 | 242 | LTRPSSLI | 21541 |
| HPV18 | L2 | 10 | 242 | LTRPSSLITY | 21542 |
| HPV18 | L2 | 8 | 287 | LTSRRGTV | 21543 |
| HPV18 | L2 | 10 | 287 | LTSRRGTVRF | 21544 |
| HPV18 | L2 | 9 | 391 | LTSSWDVPV | 21545 |
| HPV18 | L2 | 10 | 391 | LTSSWDVPVY | 21546 |
| HPV18 | L2 | 10 | 254 | PAFEPVDTTL | 21547 |
| HPV18 | L2 | 8 | 160 | PAFSDPSI | 21548 |
| HPV18 | L2 | 9 | 160 | PAFSDPSII | 21549 |
| HPV18 | L2 | 11 | 160 | PAFSDPSIIEV | 21550 |
| HPV18 | L2 | 10 | 285 | PALTSRRGTV | 21551 |
| HPV18 | L2 | 9 | 422 | PASTQYIGI | 21552 |
| HPV18 | L2 | 8 | 328 | PSPEYIEL | 21553 |
| HPV18 | L2 | 11 | 328 | PSPEYIELQPL | 21554 |
| HPV18 | L2 | 8 | 362 | PSRTTSF | 21555 |
| HPV18 | L2 | 9 | 362 | PSRTTSFA | 21556 |
| HPV18 | L2 | 10 | 362 | PSRTTSFAF | 21557 |
| HPV18 | L2 | 11 | 362 | PSRTTSFAFF | 21558 |
| HPV18 | L2 | 11 | 245 | PSSLITYDNPA | 21559 |
| HPV18 | L2 | 8 | 145 | PSSTSVSI | 21560 |
| HPV18 | L2 | 9 | 408 | PSTTSVWPI | 21561 |
| HPV18 | L2 | 10 | 408 | PSTTSVWPIV | 21562 |
| HPV18 | L2 | 9 | 419 | PTAPASTQY | 21563 |
| HPV18 | L2 | 10 | 419 | PTAPASTQYI | 21564 |
| HPV18 | L2 | 9 | 98 | PTDPSIVTL | 21565 |
| HPV18 | L2 | 10 | 98 | PTDPSIVTLI | 21566 |
| HPV18 | L2 | 9 | 120 | PTFTGTSGF | 21567 |
| HPV18 | L2 | 11 | 120 | PTFTGTSGFDI | 21568 |
| HPV18 | L2 | 9 | 376 | PTISSASSY | 21569 |
| HPV18 | L2 | 8 | 86 | PTRPPVVI | 21570 |
| HPV18 | L2 | 11 | 86 | PTRPPVVIEPV | 21571 |
| HPV18 | L2 | 8 | 185 | PTSGTHGY | 21572 |
| HPV18 | L2 | 11 | 185 | PTSGTHGYEEI | 21573 |
| HPV18 | L2 | 11 | 216 | PTVRRVAGPRL | 21574 |
| HPV18 | L2 | 9 | 23 | QSGTCPPDV | 21575 |
| HPV18 | L2 | 10 | 23 | QSGTCPPDVV | 21576 |
| HPV18 | L2 | 9 | 172 | QTGEVAGNV | 21577 |
| HPV18 | L2 | 10 | 172 | QTGEVAGNVF | 21578 |
| HPV18 | L2 | 11 | 172 | QTGEVAGNVFV | 21579 |
| HPV18 | L2 | 8 | 5 | RAARRKRA | 21580 |
| HPV18 | L2 | 10 | 5 | RAARRKRASV | 21581 |
| HPV18 | L2 | 8 | 11 | RASVTDLY | 21582 |
| HPV18 | L2 | 8 | 229 | RAYQQVSV | 21583 |

TABLE XIII-continued

B58 Supermotif Peptides

| Type | Protein | No. of Amino Acids | Position | Sequence | Seq. Id. No. |
|---|---|---|---|---|---|
| HPV18 | L2 | 9 | 229 | RAYQQVSVA | 21584 |
| HPV18 | L2 | 9 | 268 | RSDVPDSDF | 21585 |
| HPV18 | L2 | 10 | 268 | RSDVPDSDFM | 21586 |
| HPV18 | L2 | 8 | 308 | RSGTQIGA | 21587 |
| HPV18 | L2 | 10 | 308 | RSGTQIGARV | 21588 |
| HPV18 | L2 | 8 | 77 | RSNTVVDV | 21589 |
| HPV18 | L2 | 8 | 364 | RSTTSFAF | 21590 |
| HPV18 | L2 | 9 | 364 | RSTTSFAFF | 21591 |
| HPV18 | L2 | 11 | 364 | RSTTSFAFFKY | 21592 |
| HPV18 | L2 | 8 | 132 | SAGTTTPA | 21593 |
| HPV18 | L2 | 9 | 132 | SAGTTTPAV | 21594 |
| HPV18 | L2 | 10 | 132 | SAGTTTPAVL | 21595 |
| HPV18 | L2 | 8 | 380 | SASSYSNV | 21596 |
| HPV18 | L2 | 10 | 380 | SASSYSNVTV | 21597 |
| HPV18 | L2 | 8 | 340 | SATEDNDL | 21598 |
| HPV18 | L2 | 9 | 340 | SATEDNDLF | 21599 |
| HPV18 | L2 | 11 | 340 | SATEDNDLFDI | 21600 |
| HPV18 | L2 | 9 | 379 | SSASSYSNV | 21601 |
| HPV18 | L2 | 11 | 379 | SSASSYSNVTV | 21602 |
| HPV18 | L2 | 9 | 202 | SSGTGEEPI | 21603 |
| HPV18 | L2 | 10 | 48 | SSLGIFLGGL | 21604 |
| HPV18 | L2 | 10 | 246 | SSLITYDNPA | 21605 |
| HPV18 | L2 | 11 | 246 | SSLITYDNPAF | 21606 |
| HPV18 | L2 | 8 | 211 | SSTPLPTV | 21607 |
| HPV18 | L2 | 11 | 211 | SSTPLPTVRRV | 21608 |
| HPV18 | L2 | 8 | 110 | SSVVTSGA | 21609 |
| HPV18 | L2 | 8 | 393 | SSWDVPVY | 21610 |
| HPV18 | L2 | 8 | 382 | SSYSNVTV | 21611 |
| HPV18 | L2 | 10 | 382 | SSYSNVTVPL | 21612 |
| HPV18 | L2 | 10 | 212 | STPLPTVRRV | 21613 |
| HPV18 | L2 | 11 | 212 | STPLPTVRRVA | 21614 |
| HPV18 | L2 | 11 | 147 | STSVSISTTNF | 21615 |
| HPV18 | L2 | 9 | 153 | STTNFTNPA | 21616 |
| HPV18 | L2 | 10 | 153 | STTNFTNPAF | 21617 |
| HPV18 | L2 | 8 | 365 | STTSFAFF | 21618 |
| HPV18 | L2 | 10 | 365 | STTSFAFFKY | 21619 |
| HPV18 | L2 | 8 | 409 | STTSVWPI | 21620 |
| HPV18 | L2 | 9 | 409 | STTSVWPIV | 21621 |
| HPV18 | L2 | 8 | 420 | TAPASTQY | 21622 |
| HPV18 | L2 | 9 | 420 | TAPASTQYI | 21623 |
| HPV18 | L2 | 11 | 420 | TAPASTQYIGI | 21624 |
| HPV18 | L2 | 9 | 131 | TSAGTTTPA | 21625 |
| HPV18 | L2 | 10 | 131 | TSAGTTTPAV | 21626 |
| HPV18 | L2 | 11 | 131 | TSAGTTTPAVL | 21627 |
| HPV18 | L2 | 8 | 367 | TSFAFFKY | 21628 |
| HPV18 | L2 | 9 | 114 | TSGAPRPTF | 21629 |
| HPV18 | L2 | 9 | 125 | TSGFDITSA | 21630 |
| HPV18 | L2 | 10 | 186 | TSGTHGYEEI | 21631 |
| HPV18 | L2 | 9 | 288 | TSRRGTVRF | 21632 |
| HPV18 | L2 | 8 | 392 | TSSWDVPV | 21633 |
| HPV18 | L2 | 9 | 392 | TSSWDVPVY | 21634 |
| HPV18 | L2 | 10 | 148 | TSVSISTTNF | 21635 |
| HPV18 | L2 | 11 | 411 | TSVWPIVSPTA | 21636 |
| HPV18 | L2 | 8 | 38 | TTLADKIL | 21637 |
| HPV18 | L2 | 10 | 38 | TTLADKILQW | 21638 |
| HPV18 | L2 | 11 | 261 | TTLTFDPRSDV | 21639 |
| HPV18 | L2 | 8 | 154 | TTNFTNPA | 21640 |
| HPV18 | L2 | 9 | 154 | TTNFTNPAF | 21641 |
| HPV18 | L2 | 8 | 136 | TPAVLDI | 21642 |
| HPV18 | L2 | 9 | 366 | TTSFAFFKY | 21643 |
| HPV18 | L2 | 8 | 410 | TTSVWPIV | 21644 |
| HPV18 | L2 | 9 | 135 | TTTPAVLDI | 21645 |
| HPV18 | L2 | 10 | 221 | VAGPRLYSRA | 21646 |
| HPV18 | L2 | 11 | 221 | VAGPRLYSRAY | 21647 |
| HPV18 | L2 | 9 | 339 | VSATEDNDL | 21648 |
| HPV18 | L2 | 10 | 339 | VSATEDNDLF | 21649 |
| HPV18 | L2 | 11 | 2 | VSHRAARRKRA | 21650 |
| HPV18 | L2 | 8 | 150 | VSISTTNF | 21651 |
| HPV18 | L2 | 11 | 417 | VSPTAPASTQY | 21652 |
| HPV18 | L2 | 8 | 234 | VSVANPEF | 21653 |
| HPV18 | L2 | 9 | 234 | VSVANPEFL | 21654 |
| HPV18 | L2 | 9 | 104 | VTLIEDSSV | 21655 |
| HPV18 | L2 | 10 | 104 | VTLIEDSSVV | 21656 |
| HPV18 | L2 | 10 | 113 | VTSGAPRPTF | 21657 |
| HPV18 | L2 | 9 | 387 | VTVPLTSSW | 21658 |
| HPV18 | L2 | 11 | 387 | VTVPLTSSWDV | 21659 |

TABLE XIII-continued

B58 Supermotif Peptides

| Type | Protein | No. of Amino Acids | Position | Sequence | Seq. Id. No. |
|---|---|---|---|---|---|
| HPV18 | L2 | 8 | 47 | WSSLGIFL | 21660 |
| HPV18 | L2 | 11 | 47 | WSSLGIFLGGL | 21661 |
| HPV18 | L2 | 8 | 351 | YADDMDPA | 21662 |
| HPV18 | L2 | 9 | 351 | YADDMDPAV | 21663 |
| HPV18 | L2 | 11 | 351 | YADDMDPAVPV | 21664 |
| HPV18 | L2 | 8 | 384 | YSNVTVPL | 21665 |
| HPV18 | L2 | 8 | 374 | YSPTISSA | 21666 |
| HPV18 | L2 | 11 | 374 | YSPTISSASSY | 21667 |
| HPV18 | L2 | 8 | 227 | YSRAYQQV | 21668 |
| HPV18 | L2 | 10 | 227 | YSRAYQQVSV | 21669 |
| HPV18 | L2 | 11 | 227 | YSRAYQQVSVA | 21670 |
| HPV18 | L2 | 8 | 400 | YTGPDITL | 21671 |
| HPV31 | E1 | 11 | 296 | AAALYWYRTGM | 21672 |
| HPV31 | E1 | 9 | 219 | AAFGVTGTV | 21673 |
| HPV31 | E1 | 10 | 219 | AAFGVTGTVA | 21674 |
| HPV31 | E1 | 10 | 297 | AALYWYRTGM | 21675 |
| HPV31 | E1 | 10 | 185 | AAMLGKFKEL | 21676 |
| HPV31 | E1 | 11 | 185 | AAMLGKFKELY | 21677 |
| HPV31 | E1 | 8 | 504 | ATTPCWHY | 21678 |
| HPV31 | E1 | 9 | 504 | ATTPCWHYI | 21679 |
| HPV31 | E1 | 10 | 370 | CAFLKSNSQA | 21680 |
| HPV31 | E1 | 8 | 263 | CAKNRITI | 21681 |
| HPV31 | E1 | 11 | 263 | CAKNRITIEKL | 21682 |
| HPV31 | E1 | 8 | 249 | CSWGMVML | 21683 |
| HPV31 | E1 | 9 | 249 | CSWGMVMLM | 21684 |
| HPV31 | E1 | 10 | 249 | CSWGMVMLML | 21685 |
| HPV31 | E1 | 11 | 249 | CSWGMVMLMLV | 21686 |
| HPV31 | E1 | 8 | 213 | CTDWCVAA | 21687 |
| HPV31 | E1 | 9 | 213 | CTDWCVAAF | 21688 |
| HPV31 | E1 | 11 | 213 | CTDWCVAAFGV | 21689 |
| HPV31 | E1 | 10 | 495 | DAKIGMLDDA | 21690 |
| HPV31 | E1 | 9 | 503 | DATTPCWHY | 21691 |
| HPV31 | E1 | 10 | 503 | DATTPCWHYI | 21692 |
| HPV31 | E1 | 8 | 364 | DSDSNACA | 21693 |
| HPV31 | E1 | 9 | 364 | DSDSNACAF | 21694 |
| HPV31 | E1 | 10 | 364 | DSDSNACAFL | 21695 |
| HPV31 | E1 | 8 | 352 | DSEIAYKY | 21696 |
| HPV31 | E1 | 9 | 352 | DSEIAYKYA | 21697 |
| HPV31 | E1 | 11 | 352 | DSEIAYKYAQL | 21698 |
| HPV31 | E1 | 9 | 613 | DSFSTFKCV | 21699 |
| HPV31 | E1 | 9 | 130 | DSGYGNTEV | 21700 |
| HPV31 | E1 | 8 | 366 | DSNACAFL | 21701 |
| HPV31 | E1 | 9 | 39 | DSSDTGEDM | 21702 |
| HPV31 | E1 | 10 | 39 | DSSDTGEDMV | 21703 |
| HPV31 | E1 | 9 | 42 | DTGEDMVDF | 21704 |
| HPV31 | E1 | 10 | 42 | DTGEDMVDFI | 21705 |
| HPV31 | E1 | 9 | 332 | DTTFDLSQM | 21706 |
| HPV31 | E1 | 10 | 332 | DTTFDLSQMV | 21707 |
| HPV31 | E1 | 8 | 74 | EAEEHAEA | 21708 |
| HPV31 | E1 | 9 | 74 | EAEEHAEAV | 21709 |
| HPV31 | E1 | 11 | 74 | EAEEHAEAVQV | 21710 |
| HPV31 | E1 | 8 | 62 | EAETAQAL | 21711 |
| HPV31 | E1 | 9 | 62 | EAETAQALF | 21712 |
| HPV31 | E1 | 11 | 62 | EAETAQALFHA | 21713 |
| HPV31 | E1 | 10 | 80 | EAVQVLKRKY | 21714 |
| HPV31 | E1 | 11 | 80 | EAVQVLKRKYV | 21715 |
| HPV31 | E1 | 9 | 64 | ETAQALFHA | 21716 |
| HPV31 | E1 | 11 | 315 | ETPEWIERQTV | 21717 |
| HPV31 | E1 | 8 | 168 | ETPTRNIL | 21718 |
| HPV31 | E1 | 10 | 168 | ETPTRNILQV | 21719 |
| HPV31 | E1 | 11 | 168 | ETPTRNILQVL | 21720 |
| HPV31 | E1 | 8 | 139 | ETQQMVQV | 21721 |
| HPV31 | E1 | 8 | 593 | FSRTWCRL | 21722 |
| HPV31 | E1 | 10 | 593 | FSRTWCRLNL | 21723 |
| HPV31 | E1 | 9 | 566 | FTFPNPFPF | 21724 |
| HPV31 | E1 | 9 | 457 | GAPNTGKSY | 21725 |
| HPV31 | E1 | 10 | 457 | GAPNTGKSYF | 21726 |
| HPV31 | E1 | 11 | 91 | GSPLSDISSCV | 21727 |
| HPV31 | E1 | 8 | 11 | GTGCNGWF | 21728 |
| HPV31 | E1 | 9 | 11 | GTGCNGWFY | 21729 |
| HPV31 | E1 | 10 | 11 | GTGCNGWFYV | 21730 |
| HPV31 | E1 | 10 | 386 | GTMCRHYKRA | 21731 |
| HPV31 | E1 | 10 | 225 | GTVAEGFKTL | 21732 |
| HPV31 | E1 | 11 | 225 | GTVAEGFKTLL | 21733 |
| HPV31 | E1 | 8 | 78 | HAEAVQVL | 21734 |
| HPV31 | E1 | 9 | 71 | HAQEAEEHA | 21735 |

TABLE XIII-continued

B58 Supermotif Peptides

| Type | Protein | No. of Amino Acids | Position | Sequence | Seq. Id. No. |
|---|---|---|---|---|---|
| HPV31 | E1 | 11 | 71 | HAQEAEEHAEA | 21736 |
| HPV31 | E1 | 8 | 328 | HSFNDTTF | 21737 |
| HPV31 | E1 | 10 | 328 | HSFNDTTFDL | 21738 |
| HPV31 | E1 | 9 | 560 | HSRLVVFTF | 21739 |
| HPV31 | E1 | 8 | 355 | IAYKYAQL | 21740 |
| HPV31 | E1 | 9 | 355 | IAYKYAQLA | 21741 |
| HPV31 | E1 | 11 | 309 | ISDVYGETPEW | 21742 |
| HPV31 | E1 | 8 | 471 | ISFLQGCI | 21743 |
| HPV31 | E1 | 9 | 471 | ISFLQGCII | 21744 |
| HPV31 | E1 | 11 | 471 | ISFLQGCIISY | 21745 |
| HPV31 | E1 | 8 | 105 | ISPRLKAI | 21746 |
| HPV31 | E1 | 10 | 105 | ISPRLKAICI | 21747 |
| HPV31 | E1 | 9 | 97 | ISSCVDYNI | 21748 |
| HPV31 | E1 | 8 | 280 | ISTNCMLI | 21749 |
| HPV31 | E1 | 10 | 479 | ISYANSKSHF | 21750 |
| HPV31 | E1 | 11 | 479 | ISYANSKSHFW | 21751 |
| HPV31 | E1 | 10 | 268 | ITIEKLLEKL | 21752 |
| HPV31 | E1 | 11 | 268 | ITIEKLLEKLL | 21753 |
| HPV31 | E1 | 8 | 184 | KAAMLGKF | 21754 |
| HPV31 | E1 | 11 | 184 | KAAMLGKFKEL | 21755 |
| HPV31 | E1 | 11 | 532 | KALMQLKCPPL | 21756 |
| HPV31 | E1 | 8 | 590 | KSFFSRTW | 21757 |
| HPV31 | E1 | 11 | 590 | KSFFSRTWCRL | 21758 |
| HPV31 | E1 | 9 | 485 | KSHFWLQPL | 21759 |
| HPV31 | E1 | 10 | 485 | KSHFWLQPLA | 21760 |
| HPV31 | E1 | 8 | 374 | KSNSQAKI | 21761 |
| HPV31 | E1 | 9 | 374 | KSNSQAKIV | 21762 |
| HPV31 | E1 | 9 | 210 | KSTCTDWCV | 21763 |
| HPV31 | E1 | 10 | 210 | KSTCTDWCVA | 21764 |
| HPV31 | E1 | 11 | 210 | KSTCTDWCVAA | 21765 |
| HPV31 | E1 | 8 | 463 | KSYFGMSL | 21766 |
| HPV31 | E1 | 9 | 463 | KSYFGMSLI | 21767 |
| HPV31 | E1 | 11 | 463 | KSYFGMSLISF | 21768 |
| HPV31 | E1 | 8 | 119 | KTAKRRLF | 21769 |
| HPV31 | E1 | 10 | 119 | KTAKRRLFEL | 21770 |
| HPV31 | E1 | 9 | 232 | KTLLQPYCL | 21771 |
| HPV31 | E1 | 10 | 232 | KTLLQPYCLY | 21772 |
| HPV31 | E1 | 8 | 179 | KTSNGKAA | 21773 |
| HPV31 | E1 | 9 | 179 | KTSNGKAAM | 21774 |
| HPV31 | E1 | 10 | 179 | KTSNGKAAML | 21775 |
| HPV31 | E1 | 8 | 247 | LACSWGMV | 21776 |
| HPV31 | E1 | 9 | 247 | LACSWGMVM | 21777 |
| HPV31 | E1 | 10 | 247 | LACSWGMVML | 21778 |
| HPV31 | E1 | 11 | 247 | LACSWGMVMLM | 21779 |
| HPV31 | E1 | 8 | 493 | LADAKIGM | 21780 |
| HPV31 | E1 | 9 | 493 | LADAKIGML | 21781 |
| HPV31 | E1 | 8 | 362 | LADSDSNA | 21782 |
| HPV31 | E1 | 10 | 362 | LADSDSNACA | 21783 |
| HPV31 | E1 | 11 | 362 | LADSDSNACAF | 21784 |
| HPV31 | E1 | 8 | 437 | LSALKLFL | 21785 |
| HPV31 | E1 | 11 | 437 | LSALKLFLKGV | 21786 |
| HPV31 | E1 | 8 | 94 | LSDISSCV | 21787 |
| HPV31 | E1 | 10 | 94 | LSDISSCVDY | 21788 |
| HPV31 | E1 | 9 | 584 | LSDKNWKSF | 21789 |
| HPV31 | E1 | 10 | 584 | LSDKNWKSFF | 21790 |
| HPV31 | E1 | 8 | 337 | LSQMVQWA | 21791 |
| HPV31 | E1 | 9 | 337 | LSQMVQWAY | 21792 |
| HPV31 | E1 | 11 | 468 | MSLISFLQGCI | 21793 |
| HPV31 | E1 | 8 | 306 | MSNISDVY | 21794 |
| HPV31 | E1 | 8 | 549 | NAGKDDRW | 21795 |
| HPV31 | E1 | 10 | 549 | NAGKDDRWPY | 21796 |
| HPV31 | E1 | 11 | 549 | NAGKDDRWPYL | 21797 |
| HPV31 | E1 | 8 | 518 | NALDGNPV | 21798 |
| HPV31 | E1 | 10 | 518 | NALDGNPVSI | 21799 |
| HPV31 | E1 | 8 | 483 | NSKSHFWL | 21800 |
| HPV31 | E1 | 11 | 483 | NSKSHFWLQPL | 21801 |
| HPV31 | E1 | 9 | 117 | NSKTAKRRL | 21802 |
| HPV31 | E1 | 10 | 117 | NSKTAKRRLF | 21803 |
| HPV31 | E1 | 9 | 135 | NTEVETQQM | 21804 |
| HPV31 | E1 | 10 | 135 | NTEVETQQMV | 21805 |
| HPV31 | E1 | 9 | 460 | NTGKSYFGM | 21806 |
| HPV31 | E1 | 11 | 460 | NTGKSYFGMSL | 21807 |
| HPV31 | E1 | 8 | 170 | PTRNILQV | 21808 |
| HPV31 | E1 | 9 | 170 | PTRNILQVL | 21809 |
| HPV31 | E1 | 9 | 60 | QAEAETAQA | 21810 |
| HPV31 | E1 | 10 | 60 | QAEAETAQAL | 21811 |

TABLE XIII-continued

B58 Supermotif Peptides

| Type | Protein | No. of Amino Acids | Position | Sequence | Seq. Id. No. |
|---|---|---|---|---|---|
| HPV31 | E1 | 11 | 60 | QAEAETAQALF | 21812 |
| HPV31 | E1 | 11 | 378 | QAKIVKDCGTM | 21813 |
| HPV31 | E1 | 9 | 67 | QALFHAQEA | 21814 |
| HPV31 | E1 | 9 | 245 | QSLACSWGM | 21815 |
| HPV31 | E1 | 10 | 245 | QSLACSWGMV | 21816 |
| HPV31 | E1 | 11 | 245 | QSLACSWGMVM | 21817 |
| HPV31 | E1 | 10 | 207 | QSNKSTCTDW | 21818 |
| HPV31 | E1 | 8 | 323 | QTVLQHSF | 21819 |
| HPV31 | E1 | 9 | 394 | RAEKRQMSM | 21820 |
| HPV31 | E1 | 8 | 293 | RSTAAALY | 21821 |
| HPV31 | E1 | 9 | 293 | RSTAAALYW | 21822 |
| HPV31 | E1 | 10 | 293 | RSTAAALYWY | 21823 |
| HPV31 | E1 | 10 | 303 | RTGMSNISDV | 21824 |
| HPV31 | E1 | 11 | 303 | RTGMSNISDVY | 21825 |
| HPV31 | E1 | 8 | 595 | RTWCRLNL | 21826 |
| HPV31 | E1 | 10 | 438 | SALKLFLKGV | 21827 |
| HPV31 | E1 | 8 | 98 | SSCVDYNI | 21828 |
| HPV31 | E1 | 8 | 40 | SSDTGEDM | 21829 |
| HPV31 | E1 | 9 | 40 | SSDTGEDMV | 21830 |
| HPV31 | E1 | 11 | 40 | SSDTGEDMVDF | 21831 |
| HPV31 | E1 | 8 | 294 | STAAALYW | 21832 |
| HPV31 | E1 | 9 | 294 | STAAALYWY | 21833 |
| HPV31 | E1 | 8 | 211 | STCTDWCV | 21834 |
| HPV31 | E1 | 9 | 211 | STCTDWCVA | 21835 |
| HPV31 | E1 | 10 | 211 | STCTDWCVAA | 21836 |
| HPV31 | E1 | 11 | 211 | STCTDWCVAAF | 21837 |
| HPV31 | E1 | 11 | 616 | STFKCVSGQNI | 21838 |
| HPV31 | E1 | 8 | 295 | TAAALYWY | 21839 |
| HPV31 | E1 | 9 | 120 | TAKRRLFEL | 21840 |
| HPV31 | E1 | 8 | 65 | TAQALFHA | 21841 |
| HPV31 | E1 | 11 | 65 | TAQALFHAQEA | 21842 |
| HPV31 | E1 | 8 | 180 | TSNGKAAM | 21843 |
| HPV31 | E1 | 9 | 180 | TSNGKAAML | 21844 |
| HPV31 | E1 | 8 | 333 | TTFLDSQM | 21845 |
| HPV31 | E1 | 9 | 333 | TTFLDSQMV | 21846 |
| HPV31 | E1 | 11 | 333 | TTFLDSQMVQW | 21847 |
| HPV31 | E1 | 8 | 505 | TTPCWHYI | 21848 |
| HPV31 | E1 | 11 | 505 | TTPCWHYIDNY | 21849 |
| HPV31 | E1 | 10 | 218 | VAAFGVTGTV | 21850 |
| HPV31 | E1 | 11 | 218 | VAAFGVTGTVA | 21851 |
| HPV31 | E1 | 8 | 227 | VAEGFKTL | 21852 |
| HPV31 | E1 | 9 | 227 | VAEGFKTLL | 21853 |
| HPV31 | E1 | 10 | 413 | VSDEGDWRDI | 21854 |
| HPV31 | E1 | 11 | 413 | VSDEGDWRDIV | 21855 |
| HPV31 | E1 | 9 | 434 | VSFLSALKL | 21856 |
| HPV31 | E1 | 10 | 434 | VSFLSALKLF | 21857 |
| HPV31 | E1 | 11 | 434 | VSFLSALKLFL | 21858 |
| HPV31 | E1 | 10 | 197 | VSFMELIRPF | 21859 |
| HPV31 | E1 | 9 | 621 | VSGQNIRTL | 21860 |
| HPV31 | E1 | 9 | 525 | VSIDVKHKA | 21861 |
| HPV31 | E1 | 10 | 525 | VSIDVKHKAL | 21862 |
| HPV31 | E1 | 11 | 525 | VSIDVKHKALM | 21863 |
| HPV31 | E1 | 9 | 223 | VTGTVAEGF | 21864 |
| HPV31 | E1 | 8 | 343 | WAYDNDVM | 21865 |
| HPV31 | E1 | 8 | 481 | YANSKSHF | 21866 |
| HPV31 | E1 | 9 | 481 | YANSKSHFW | 21867 |
| HPV31 | E1 | 10 | 481 | YANSKSHFWL | 21868 |
| HPV31 | E1 | 11 | 359 | YAQLADSDSNA | 21869 |
| HPV31 | E2 | 10 | 277 | AAACTNQTRA | 21870 |
| HPV31 | E2 | 11 | 277 | AAACTNQTRAV | 21871 |
| HPV31 | E2 | 9 | 278 | AACTNQTRA | 21872 |
| HPV31 | E2 | 10 | 278 | AACTNQTRAV | 21873 |
| HPV31 | E2 | 8 | 291 | ATTPIIHL | 21874 |
| HPV31 | E2 | 9 | 228 | CALGTSEGV | 21875 |
| HPV31 | E2 | 9 | 330 | CTDGKHKNA | 21876 |
| HPV31 | E2 | 10 | 330 | CTDGKHKNAI | 21877 |
| HPV31 | E2 | 11 | 330 | CTDGKHKNAIV | 21878 |
| HPV31 | E2 | 8 | 280 | CTNQTRAV | 21879 |
| HPV31 | E2 | 8 | 145 | CTVVEGQV | 21880 |
| HPV31 | E2 | 8 | 301 | DANILKCL | 21881 |
| HPV31 | E2 | 10 | 301 | DANILKCLRY | 21882 |
| HPV31 | E2 | 9 | 22 | DSKRLCDHI | 21883 |
| HPV31 | E2 | 11 | 22 | DSKRLCDHIDY | 21884 |
| HPV31 | E2 | 10 | 265 | DSVDSVNCGV | 21885 |
| HPV31 | E2 | 11 | 265 | DSVDSVNCGVI | 21886 |
| HPV31 | E2 | 8 | 268 | DSVNCGVI | 21887 |

TABLE XIII-continued

B58 Supermotif Peptides

| Type | Protein | No. of Amino Acids | Position | Sequence | Seq. Id. No. |
|---|---|---|---|---|---|
| HPV31 | E2 | 10 | 268 | DSVNCGVISA | 21888 |
| HPV31 | E2 | 11 | 268 | DSVNCGVISAA | 21889 |
| HPV31 | E2 | 11 | 174 | EAKKYGTGKKW | 21890 |
| HPV31 | E2 | 9 | 197 | ESVFSSDEI | 21891 |
| HPV31 | E2 | 11 | 197 | ESVFSSDEISF | 21892 |
| HPV31 | E2 | 8 | 80 | ETLNNTEY | 21893 |
| HPV31 | E2 | 9 | 2 | ETLSQRLNV | 21894 |
| HPV31 | E2 | 8 | 207 | FAGIVTKL | 21895 |
| HPV31 | E2 | 11 | 207 | FAGIVTKLPTA | 21896 |
| HPV31 | E2 | 8 | 200 | FSSDEISF | 21897 |
| HPV31 | E2 | 9 | 200 | FSSDEISFA | 21898 |
| HPV31 | E2 | 11 | 200 | FSSDEISFAGI | 21899 |
| HPV31 | E2 | 8 | 171 | FTEEAKKY | 21900 |
| HPV31 | E2 | 8 | 179 | GTGKKWEV | 21901 |
| HPV31 | E2 | 10 | 179 | GTGKKWEVHA | 21902 |
| HPV31 | E2 | 9 | 231 | GTSEGVRRA | 21903 |
| HPV31 | E2 | 8 | 187 | HAGGQVIV | 21904 |
| HPV31 | E2 | 9 | 187 | HAGGQVIVF | 21905 |
| HPV31 | E2 | 8 | 52 | HSINHQVV | 21906 |
| HPV31 | E2 | 10 | 52 | HSINHQVVPA | 21907 |
| HPV31 | E2 | 11 | 52 | HSINHQVVPAL | 21908 |
| HPV31 | E2 | 10 | 205 | ISFAGIVTKL | 21909 |
| HPV31 | E2 | 9 | 345 | ISTSQRDDF | 21910 |
| HPV31 | E2 | 10 | 345 | ISTSQRDDFL | 21911 |
| HPV31 | E2 | 11 | 165 | ITYFVNFTEEA | 21912 |
| HPV31 | E2 | 8 | 66 | KAKALQAI | 21913 |
| HPV31 | E2 | 10 | 66 | KAKALQAIEL | 21914 |
| HPV31 | E2 | 8 | 68 | KALQAIEL | 21915 |
| HPV31 | E2 | 10 | 68 | KALQAIELQM | 21916 |
| HPV31 | E2 | 11 | 68 | KALQAIELQMM | 21917 |
| HPV31 | E2 | 10 | 45 | KAREMGIHSI | 21918 |
| HPV31 | E2 | 11 | 226 | KTCALGTSEGV | 21919 |
| HPV31 | E2 | 8 | 312 | LSKYKQLY | 21920 |
| HPV31 | E2 | 11 | 312 | LSKYKQLYEQV | 21921 |
| HPV31 | E2 | 8 | 62 | LSVSKAKA | 21922 |
| HPV31 | E2 | 9 | 62 | LSVSKAKAL | 21923 |
| HPV31 | E2 | 11 | 62 | LSVSKAKALQA | 21924 |
| HPV31 | E2 | 8 | 103 | LTAPTGCL | 21925 |
| HPV31 | E2 | 8 | 337 | NAIVTLTY | 21926 |
| HPV31 | E2 | 9 | 337 | NAIVTLTYI | 21927 |
| HPV31 | E2 | 9 | 84 | NTEYKNEDW | 21928 |
| HPV31 | E2 | 11 | 84 | NTEYKNEDWTM | 21929 |
| HPV31 | E2 | 8 | 254 | NTHHPNKL | 21930 |
| HPV31 | E2 | 9 | 254 | NTHHPNKLL | 21931 |
| HPV31 | E2 | 8 | 127 | NTMHYTNW | 21932 |
| HPV31 | E2 | 10 | 127 | NTMHYTNWKF | 21933 |
| HPV31 | E2 | 11 | 127 | NTMHYTNWKFI | 21934 |
| HPV31 | E2 | 11 | 219 | NTTTSNSKTCA | 21935 |
| HPV31 | E2 | 9 | 355 | NTVKIPNTV | 21936 |
| HPV31 | E2 | 11 | 355 | NTVKIPNTVSV | 21937 |
| HPV31 | E2 | 9 | 361 | NTVSVSTGY | 21938 |
| HPV31 | E2 | 10 | 361 | NTVSVSTGYM | 21939 |
| HPV31 | E2 | 8 | 60 | PALSVSKA | 21940 |
| HPV31 | E2 | 10 | 60 | PALSVSKAKA | 21941 |
| HPV31 | E2 | 11 | 60 | PALSVSKAKAL | 21942 |
| HPV31 | E2 | 9 | 290 | PATTPIIHL | 21943 |
| HPV31 | E2 | 10 | 106 | PTGCLKKHGY | 21944 |
| HPV31 | E2 | 8 | 71 | QAIELQMM | 21945 |
| HPV31 | E2 | 9 | 71 | QAIELQMML | 21946 |
| HPV31 | E2 | 9 | 283 | QTRAVSCPA | 21947 |
| HPV31 | E2 | 8 | 96 | QTSLELYL | 21948 |
| HPV31 | E2 | 10 | 96 | QTSLELYLTA | 21949 |
| HPV31 | E2 | 11 | 285 | RAVSCPATTPI | 21950 |
| HPV31 | E2 | 11 | 276 | SAAACTNQTRA | 21951 |
| HPV31 | E2 | 8 | 201 | SSDEISFA | 21952 |
| HPV31 | E2 | 10 | 201 | SSDEISFAGI | 21953 |
| HPV31 | E2 | 11 | 201 | SSDEISFAGIV | 21954 |
| HPV31 | E2 | 8 | 346 | STSQRDDF | 21955 |
| HPV31 | E2 | 9 | 346 | STSQRDDFL | 21956 |
| HPV31 | E2 | 8 | 232 | TSEGVRRA | 21957 |
| HPV31 | E2 | 9 | 97 | TSLELYLTA | 21958 |
| HPV31 | E2 | 8 | 222 | TSNSKTCA | 21959 |
| HPV31 | E2 | 9 | 222 | TSNSKTCAL | 21960 |
| HPV31 | E2 | 8 | 347 | TSQRDDFL | 21961 |
| HPV31 | E2 | 11 | 347 | TSQRDDFLNTV | 21962 |
| HPV31 | E2 | 11 | 292 | TTPIIHLKGDA | 21963 |

TABLE XIII-continued

B58 Supermotif Peptides

| Type | Protein | No. of Amino Acids | Position | Sequence | Seq. Id. No. |
|---|---|---|---|---|---|
| HPV31 | E2 | 9 | 221 | TTSNSKTCA | 21964 |
| HPV31 | E2 | 10 | 221 | TTSNSKTCAL | 21965 |
| HPV31 | E2 | 10 | 220 | TTTSNSKTCA | 21966 |
| HPV31 | E2 | 11 | 220 | TTTSNSKTCAL | 21967 |
| HPV31 | E2 | 9 | 287 | VSCPATTPI | 21968 |
| HPV31 | E2 | 10 | 287 | VSCPATTPII | 21969 |
| HPV31 | E2 | 9 | 64 | VSKAKALQA | 21970 |
| HPV31 | E2 | 10 | 64 | VSKAKALQAI | 21971 |
| HPV31 | E2 | 8 | 365 | VSTGYMTI | 21972 |
| HPV31 | E2 | 8 | 363 | VSVSTGYM | 21973 |
| HPV31 | E2 | 10 | 363 | VSVSTGYMTI | 21974 |
| HPV31 | E2 | 11 | 328 | WTCTDGKHKNA | 21975 |
| HPV31 | E2 | 8 | 92 | WTMQQTSL | 21976 |
| HPV31 | E2 | 10 | 92 | WTMQQTSLEL | 21977 |
| HPV31 | E2 | 11 | 92 | WTMQQTSLELY | 21978 |
| HPV31 | E2 | 8 | 131 | YTNWKFIY | 21979 |
| HPV31 | E2 | 9 | 131 | YTNWKFIYL | 21980 |
| HPV31 | E2 | 11 | 131 | YTNWKFIYLCI | 21981 |
| HPV31 | E2 | 11 | 115 | YTVEVQFDGDV | 21982 |
| HPV31 | E5 | 8 | 40 | ATLLLLIV | 21983 |
| HPV31 | E5 | 9 | 40 | ATLLLLIVI | 21984 |
| HPV31 | E5 | 10 | 40 | ATLLLLIVIL | 21985 |
| HPV31 | E5 | 11 | 40 | ATLLLLIVILW | 21986 |
| HPV31 | E5 | 8 | 53 | ATSPLRCF | 21987 |
| HPV31 | E5 | 10 | 53 | ATSPLRCFCI | 21988 |
| HPV31 | E5 | 11 | 53 | ATSPLRCFCIY | 21989 |
| HPV31 | E5 | 9 | 52 | IATSPLRCF | 21990 |
| HPV31 | E5 | 11 | 52 | IATSPLRCFCI | 21991 |
| HPV31 | E5 | 8 | 6 | ISTVSIVL | 21992 |
| HPV31 | E5 | 10 | 6 | ISTVSIVLCF | 21993 |
| HPV31 | E5 | 11 | 6 | ISTVSIVLCFL | 21994 |
| HPV31 | E5 | 9 | 34 | LSVSVYATL | 21995 |
| HPV31 | E5 | 10 | 34 | LSVSVYATLL | 21996 |
| HPV31 | E5 | 11 | 34 | LSVSVYATLLL | 21997 |
| HPV31 | E5 | 9 | 7 | STVSIVLCF | 21998 |
| HPV31 | E5 | 10 | 7 | STVSIVLCFL | 21999 |
| HPV31 | E5 | 11 | 7 | STVSIVLCFLL | 22000 |
| HPV31 | E5 | 9 | 54 | TSPLRCFCI | 22001 |
| HPV31 | E5 | 10 | 54 | TSPLRCFCIY | 22002 |
| HPV31 | E5 | 11 | 54 | TSPLRCFCIYV | 22003 |
| HPV31 | E5 | 8 | 9 | VSIVLCFL | 22004 |
| HPV31 | E5 | 9 | 9 | VSIVLCFLL | 22005 |
| HPV31 | E5 | 11 | 9 | VSIVLCFLLCF | 22006 |
| HPV31 | E5 | 8 | 36 | VSVYATLL | 22007 |
| HPV31 | E5 | 9 | 36 | VSVYATLLL | 22008 |
| HPV31 | E5 | 10 | 36 | VSVYATLLLL | 22009 |
| HPV31 | E5 | 11 | 36 | VSVYATLLLLI | 22010 |
| HPV31 | E5 | 8 | 39 | YATLLLLI | 22011 |
| HPV31 | E5 | 9 | 39 | YATLLLLIV | 22012 |
| HPV31 | E5 | 10 | 39 | YATLLLLIVI | 22013 |
| HPV31 | E5 | 11 | 39 | YATLLLLIVIL | 22014 |
| HPV31 | E6 | 8 | 63 | CTKCLRFY | 22015 |
| HPV31 | E6 | 11 | 63 | CTKCLRFYSKV | 22016 |
| HPV31 | E6 | 11 | 57 | DTPHGVCTKCL | 22017 |
| HPV31 | E6 | 8 | 39 | ETEVLDFA | 22018 |
| HPV31 | E6 | 9 | 39 | ETEVLDFAF | 22019 |
| HPV31 | E6 | 8 | 45 | FAFTDLTI | 22020 |
| HPV31 | E6 | 9 | 45 | FAFTDLTIV | 22021 |
| HPV31 | E6 | 10 | 45 | FAFTDLTIVY | 22022 |
| HPV31 | E6 | 8 | 47 | FTDLTIVY | 22023 |
| HPV31 | E6 | 9 | 15 | LSSALEIPY | 22024 |
| HPV31 | E6 | 9 | 37 | LTETEVLDF | 22025 |
| HPV31 | E6 | 10 | 37 | LTETEVLDFA | 22026 |
| HPV31 | E6 | 11 | 37 | LTETEVLDFAF | 22027 |
| HPV31 | E6 | 9 | 91 | LTNKGICDL | 22028 |
| HPV31 | E6 | 10 | 91 | LTNKGICDLL | 22029 |
| HPV31 | E6 | 11 | 91 | LTNKGICDLLI | 22030 |
| HPV31 | E6 | 8 | 5 | PAERPRKL | 22031 |
| HPV31 | E6 | 11 | 5 | PAERPRKLHEL | 22032 |
| HPV31 | E6 | 10 | 17 | SALEIPYDEL | 22033 |
| HPV31 | E6 | 8 | 16 | SSALEIPY | 22034 |
| HPV31 | E6 | 11 | 16 | SSALEIPYDEL | 22035 |
| HPV31 | E6 | 11 | 86 | TTLEKLTNKGI | 22036 |
| HPV31 | E6 | 9 | 73 | VSEFRWYRY | 22037 |
| HPV31 | E6 | 11 | 73 | VSEFRWYRYSV | 22038 |
| HPV31 | E6 | 9 | 132 | WTGRCIACW | 22039 |

TABLE XIII-continued

B58 Supermotif Peptides

| Type | Protein | No. of Amino Acids | Position | Sequence | Seq. Id. No. |
|---|---|---|---|---|---|
| HPV31 | E6 | 9 | 70 | YSKVSEFRW | 22040 |
| HPV31 | E6 | 10 | 70 | YSKVSEFRWY | 22041 |
| HPV31 | E6 | 8 | 81 | YSVYGTTL | 22042 |
| HPV31 | E6 | 11 | 81 | YSVYGTTLEKL | 22043 |
| HPV31 | E7 | 10 | 19 | ATDLHCYEQL | 22044 |
| HPV31 | E7 | 8 | 30 | DSSDEEDV | 22045 |
| HPV31 | E7 | 9 | 30 | DSSDEEDVI | 22046 |
| HPV31 | E7 | 8 | 48 | DTSNYNIV | 22047 |
| HPV31 | E7 | 10 | 48 | DTSNYNIVTF | 22048 |
| HPV31 | E7 | 8 | 18 | EATDLHCY | 22049 |
| HPV31 | E7 | 11 | 18 | EATDLHCYEQL | 22050 |
| HPV31 | E7 | 8 | 4 | ETPTLQDY | 22051 |
| HPV31 | E7 | 9 | 4 | ETPTLQDYV | 22052 |
| HPV31 | E7 | 10 | 4 | ETPTLQDYVL | 22053 |
| HPV31 | E7 | 8 | 62 | KSTLRLCV | 22054 |
| HPV31 | E7 | 8 | 6 | PTLQDYVL | 22055 |
| HPV31 | E7 | 10 | 6 | PTLQDYVLDL | 22056 |
| HPV31 | E7 | 9 | 44 | QAEPDTSNY | 22057 |
| HPV31 | E7 | 11 | 44 | QAEPDTSNYNI | 22058 |
| HPV31 | E7 | 9 | 70 | QSTQVDIRI | 22059 |
| HPV31 | E7 | 10 | 70 | QSTQVDIRIL | 22060 |
| HPV31 | E7 | 8 | 31 | SSDEEDVI | 22061 |
| HPV31 | E7 | 8 | 71 | STQVDIRI | 22062 |
| HPV31 | E7 | 9 | 71 | STQVDIRIL | 22063 |
| HPV31 | E7 | 9 | 49 | TSNYNIVTF | 22064 |
| HPV31 | E7 | 11 | 55 | VTFCCQCKSTL | 22065 |
| HPV31 | L1 | 10 | 347 | AAIANSDTTF | 22066 |
| HPV31 | L1 | 8 | 285 | ATLANSTY | 22067 |
| HPV31 | L1 | 9 | 285 | ATLANSTYF | 22068 |
| HPV31 | L1 | 8 | 9 | ATVYLPPV | 22069 |
| HPV31 | L1 | 10 | 9 | ATVYLPPVPV | 22070 |
| HPV31 | L1 | 11 | 346 | CAAIANSDTTF | 22071 |
| HPV31 | L1 | 9 | 304 | DAQIFNKPY | 22072 |
| HPV31 | L1 | 10 | 304 | DAQIFNKPYW | 22073 |
| HPV31 | L1 | 11 | 304 | DAQIFNKPYWM | 22074 |
| HPV31 | L1 | 8 | 129 | DTENSNRY | 22075 |
| HPV31 | L1 | 9 | 129 | DTENSNRYA | 22076 |
| HPV31 | L1 | 9 | 203 | DTGFGAMDF | 22077 |
| HPV31 | L1 | 11 | 203 | DTGFGAMDFTA | 22078 |
| HPV31 | L1 | 8 | 216 | DTKSNVPL | 22079 |
| HPV31 | L1 | 10 | 216 | DTKSNVPLDI | 22080 |
| HPV31 | L1 | 9 | 353 | DTTFKSSNF | 22081 |
| HPV31 | L1 | 8 | 336 | DTTRSTNM | 22082 |
| HPV31 | L1 | 10 | 336 | DTTRSTNMSV | 22083 |
| HPV31 | L1 | 10 | 417 | DTYRFVTSQA | 22084 |
| HPV31 | L1 | 11 | 417 | DTYRFVTSQAI | 22085 |
| HPV31 | L1 | 9 | 8 | EATVYLPPV | 22086 |
| HPV31 | L1 | 11 | 8 | EATVYLPPVPV | 22087 |
| HPV31 | L1 | 8 | 270 | ESVPTDLY | 22088 |
| HPV31 | L1 | 9 | 270 | ESVPTDLYI | 22089 |
| HPV31 | L1 | 8 | 95 | ETQRLVWA | 22090 |
| HPV31 | L1 | 10 | 95 | ETQRLVWACV | 22091 |
| HPV31 | L1 | 8 | 456 | FSADLDQF | 22092 |
| HPV31 | L1 | 10 | 456 | FSADLDQFPL | 22093 |
| HPV31 | L1 | 11 | 211 | FTALQDTKSNV | 22094 |
| HPV31 | L1 | 8 | 207 | GAMDFTAL | 22095 |
| HPV31 | L1 | 8 | 38 | GSARLLTV | 22096 |
| HPV31 | L1 | 8 | 280 | GSGSTATL | 22097 |
| HPV31 | L1 | 9 | 280 | GSGSTATLA | 22098 |
| HPV31 | L1 | 9 | 413 | GSLEDTYRF | 22099 |
| HPV31 | L1 | 10 | 413 | GSLEDTYRFV | 22100 |
| HPV31 | L1 | 8 | 298 | GSMVTSDA | 22101 |
| HPV31 | L1 | 10 | 298 | GSMVTSDAQI | 22102 |
| HPV31 | L1 | 11 | 298 | GSMVTSDAQIF | 22103 |
| HPV31 | L1 | 8 | 173 | GSPCSNNA | 22104 |
| HPV31 | L1 | 9 | 173 | GSPCSNNAI | 22105 |
| HPV31 | L1 | 11 | 282 | GSTATLANSTY | 22106 |
| HPV31 | L1 | 8 | 141 | GTDNRECI | 22107 |
| HPV31 | L1 | 10 | 141 | GTDNRECISM | 22108 |
| HPV31 | L1 | 11 | 266 | GTVGESVPTDL | 22109 |
| HPV31 | L1 | 8 | 36 | HAGSARLL | 22110 |
| HPV31 | L1 | 10 | 36 | HAGSARLLTV | 22111 |
| HPV31 | L1 | 8 | 393 | HSMNPAIL | 22112 |
| HPV31 | L1 | 11 | 393 | HSMNPAILEDW | 22113 |
| HPV31 | L1 | 8 | 349 | IANSDTTF | 22114 |
| HPV31 | L1 | 10 | 118 | ISGHPLLNKF | 22115 |

TABLE XIII-continued

B58 Supermotif Peptides

| Type | Protein | No. of Amino Acids | Position | Sequence | Seq. Id. No. |
|---|---|---|---|---|---|
| HPV31 | L1 | 10 | 148 | ISMDYKQTQL | 22116 |
| HPV31 | L1 | 8 | 382 | ITLSADIM | 22117 |
| HPV31 | L1 | 10 | 382 | ITLSADIMTY | 22118 |
| HPV31 | L1 | 11 | 382 | ITLSADIMTYI | 22119 |
| HPV31 | L1 | 9 | 181 | ITPGDCPPL | 22120 |
| HPV31 | L1 | 11 | 181 | ITPGDCPPLEL | 22121 |
| HPV31 | L1 | 10 | 482 | KAGKRSAPSA | 22122 |
| HPV31 | L1 | 8 | 54 | KSDNPKKI | 22123 |
| HPV31 | L1 | 9 | 54 | KSDNPKKIV | 22124 |
| HPV31 | L1 | 10 | 54 | KSDNPKKIVV | 22125 |
| HPV31 | L1 | 8 | 218 | KSNVPLDI | 22126 |
| HPV31 | L1 | 8 | 357 | KSSNFKEY | 22127 |
| HPV31 | L1 | 9 | 357 | KSSNFKEYL | 22128 |
| HPV31 | L1 | 8 | 384 | LSADIMTY | 22129 |
| HPV31 | L1 | 9 | 384 | LSADIMTYI | 22130 |
| HPV31 | L1 | 9 | 407 | LTTPPSGSL | 22131 |
| HPV31 | L1 | 8 | 43 | LTVGHPYY | 22132 |
| HPV31 | L1 | 10 | 43 | LTVGHPYYSI | 22133 |
| HPV31 | L1 | 9 | 1 | MSLWRPSEA | 22134 |
| HPV31 | L1 | 11 | 1 | MSLWRPSEATV | 22135 |
| HPV31 | L1 | 8 | 343 | MSVCAAIA | 22136 |
| HPV31 | L1 | 10 | 389 | MTYIHSMNPA | 22137 |
| HPV31 | L1 | 11 | 389 | MTYIHSMNPAI | 22138 |
| HPV31 | L1 | 11 | 179 | NAITPGDCPPL | 22139 |
| HPV31 | L1 | 11 | 351 | NSDTTFKSSNF | 22140 |
| HPV31 | L1 | 9 | 227 | NSICKYPDY | 22141 |
| HPV31 | L1 | 10 | 227 | NSICKYPDYL | 22142 |
| HPV31 | L1 | 9 | 193 | NSVIQDGDM | 22143 |
| HPV31 | L1 | 10 | 193 | NSVIQDGDMV | 22144 |
| HPV31 | L1 | 9 | 397 | PAILEDWNF | 22145 |
| HPV31 | L1 | 11 | 397 | PAILEDWNFGL | 22146 |
| HPV31 | L1 | 9 | 489 | PSASTTTPA | 22147 |
| HPV31 | L1 | 8 | 6 | PSEATVYL | 22148 |
| HPV31 | L1 | 11 | 6 | PSEATVYLPPV | 22149 |
| HPV31 | L1 | 9 | 411 | PSGSLEDTY | 22150 |
| HPV31 | L1 | 11 | 411 | PSGSLEDTYRF | 22151 |
| HPV31 | L1 | 10 | 296 | PSGSMVTSDA | 22152 |
| HPV31 | L1 | 8 | 294 | PTPSGSMV | 22153 |
| HPV31 | L1 | 10 | 472 | QAGYRARPKF | 22154 |
| HPV31 | L1 | 9 | 425 | QAITCQKTA | 22155 |
| HPV31 | L1 | 9 | 316 | RAQGHNNGI | 22156 |
| HPV31 | L1 | 11 | 316 | RAQGHNNGICW | 22157 |
| HPV31 | L1 | 8 | 476 | RARPKFKA | 22158 |
| HPV31 | L1 | 9 | 264 | RSGTVGESV | 22159 |
| HPV31 | L1 | 9 | 339 | RSTNMSVCA | 22160 |
| HPV31 | L1 | 10 | 339 | RSTNMSVCAA | 22161 |
| HPV31 | L1 | 11 | 339 | RSTNMSVCAAI | 22162 |
| HPV31 | L1 | 8 | 30 | RTNIYYHA | 22163 |
| HPV31 | L1 | 11 | 30 | RTNIYYHAGSA | 22164 |
| HPV31 | L1 | 8 | 385 | SADIMTYI | 22165 |
| HPV31 | L1 | 11 | 385 | SADIMTYIHSM | 22166 |
| HPV31 | L1 | 9 | 457 | SADLDQFPL | 22167 |
| HPV31 | L1 | 11 | 487 | SAPSASTTTPA | 22168 |
| HPV31 | L1 | 11 | 39 | SARLLTVGHPY | 22169 |
| HPV31 | L1 | 8 | 490 | SASTTTPA | 22170 |
| HPV31 | L1 | 8 | 358 | SSNFKEYL | 22171 |
| HPV31 | L1 | 10 | 283 | STATLANSTY | 22172 |
| HPV31 | L1 | 11 | 283 | STATLANSTYF | 22173 |
| HPV31 | L1 | 11 | 23 | STDEYVTRTNI | 22174 |
| HPV31 | L1 | 8 | 340 | STNMSVCA | 22175 |
| HPV31 | L1 | 9 | 340 | STNMSVCAA | 22176 |
| HPV31 | L1 | 10 | 340 | STNMSVCAAI | 22177 |
| HPV31 | L1 | 11 | 340 | STNMSVCAAIA | 22178 |
| HPV31 | L1 | 11 | 290 | STYFPTPSGSM | 22179 |
| HPV31 | L1 | 10 | 212 | TALQDTKSNV | 22180 |
| HPV31 | L1 | 11 | 432 | TAPQKPKEDPF | 22181 |
| HPV31 | L1 | 9 | 284 | TATLANSTY | 22182 |
| HPV31 | L1 | 10 | 284 | TATLANSTYF | 22183 |
| HPV31 | L1 | 11 | 302 | TSDAQIFNKPY | 22184 |
| HPV31 | L1 | 11 | 89 | TSFYNPETQRL | 22185 |
| HPV31 | L1 | 11 | 423 | TSQAITCQKTA | 22186 |
| HPV31 | L1 | 8 | 354 | TTFKSSNF | 22187 |
| HPV31 | L1 | 11 | 354 | TTFKSSNFKEY | 22188 |
| HPV31 | L1 | 8 | 408 | TTPPSGSL | 22189 |
| HPV31 | L1 | 9 | 337 | TTRSTNMSV | 22190 |
| HPV31 | L1 | 11 | 337 | TTRSTNMSVCA | 22191 |

TABLE XIII-continued

B58 Supermotif Peptides

| Type | Protein | No. of Amino Acids | Position | Sequence | Seq. Id. No. |
|---|---|---|---|---|---|
| HPV31 | L1 | 9 | 239 | VAEPYGDTL | 22192 |
| HPV31 | L1 | 10 | 239 | VAEPYGDTLF | 22193 |
| HPV31 | L1 | 11 | 239 | VAEPYGDTLFF | 22194 |
| HPV31 | L1 | 8 | 66 | VSGLQYRV | 22195 |
| HPV31 | L1 | 9 | 66 | VSGLQYRVF | 22196 |
| HPV31 | L1 | 11 | 66 | VSGLQYRVFRV | 22197 |
| HPV31 | L1 | 10 | 18 | VSKVVSTDEY | 22198 |
| HPV31 | L1 | 11 | 18 | VSKVVSTDEYV | 22199 |
| HPV31 | L1 | 8 | 28 | VTRTNIYY | 22200 |
| HPV31 | L1 | 10 | 28 | VTRTNIYYHA | 22201 |
| HPV31 | L1 | 8 | 301 | VTSDAQIF | 22202 |
| HPV31 | L1 | 8 | 101 | WACVGLEV | 22203 |
| HPV31 | L2 | 9 | 24 | AAGTCPSDV | 22204 |
| HPV31 | L2 | 10 | 24 | AAGTCPSDVI | 22205 |
| HPV31 | L2 | 9 | 340 | ASATTTSTL | 22206 |
| HPV31 | L2 | 9 | 85 | ASIPIRPPV | 22207 |
| HPV31 | L2 | 11 | 85 | ASIPIRPPVSI | 22208 |
| HPV31 | L2 | 10 | 367 | ATHNVSPSTA | 22209 |
| HPV31 | L2 | 11 | 367 | ATHNVSPSTAV | 22210 |
| HPV31 | L2 | 9 | 311 | ATIGARVHY | 22211 |
| HPV31 | L2 | 10 | 311 | ATIGARVHYY | 22212 |
| HPV31 | L2 | 11 | 311 | ATIGARVHYYY | 22213 |
| HPV31 | L2 | 10 | 15 | ATQLYQTCKA | 22214 |
| HPV31 | L2 | 11 | 15 | ATQLYQTCKAA | 22215 |
| HPV31 | L2 | 8 | 226 | ATQQVKVI | 22216 |
| HPV31 | L2 | 9 | 135 | ATTADTTPA | 22217 |
| HPV31 | L2 | 10 | 135 | ATTADTTPAI | 22218 |
| HPV31 | L2 | 11 | 135 | ATTADTTPAIL | 22219 |
| HPV31 | L2 | 11 | 342 | ATTTSTLNDGL | 22220 |
| HPV31 | L2 | 10 | 358 | DTDFTVDTPA | 22221 |
| HPV31 | L2 | 8 | 364 | DTPATHNV | 22222 |
| HPV31 | L2 | 9 | 139 | DTTPAILDV | 22223 |
| HPV31 | L2 | 10 | 84 | EASIPIRPPV | 22224 |
| HPV31 | L2 | 9 | 111 | ESGIVDVGA | 22225 |
| HPV31 | L2 | 11 | 111 | ESGIVDVGAPA | 22226 |
| HPV31 | L2 | 8 | 331 | ESIEMQPL | 22227 |
| HPV31 | L2 | 10 | 331 | ESIEMQPLGA | 22228 |
| HPV31 | L2 | 8 | 171 | ETSGHLLL | 22229 |
| HPV31 | L2 | 9 | 253 | ETVNAEESL | 22230 |
| HPV31 | L2 | 10 | 253 | ETVNAEESLY | 22231 |
| HPV31 | L2 | 11 | 253 | ETVNAEESLYF | 22232 |
| HPV31 | L2 | 8 | 404 | FSGPDVPI | 22233 |
| HPV31 | L2 | 11 | 404 | FSGPDVPIEHA | 22234 |
| HPV31 | L2 | 8 | 263 | FSNTSHNI | 22235 |
| HPV31 | L2 | 9 | 263 | FSNTSHNIA | 22236 |
| HPV31 | L2 | 8 | 459 | FTDVSVAA | 22237 |
| HPV31 | L2 | 11 | 361 | FTVDTPATHNV | 22238 |
| HPV31 | L2 | 8 | 314 | GARVHYYY | 22239 |
| HPV31 | L2 | 10 | 314 | GARVHYYYDI | 22240 |
| HPV31 | L2 | 10 | 339 | GASATTTSTL | 22241 |
| HPV31 | L2 | 8 | 310 | GATIGARV | 22242 |
| HPV31 | L2 | 10 | 310 | GATIGARVHY | 22243 |
| HPV31 | L2 | 11 | 310 | GATIGARVHYY | 22244 |
| HPV31 | L2 | 10 | 63 | GSGTGGRTGY | 22245 |
| HPV31 | L2 | 11 | 63 | GSGTGGRTGYV | 22246 |
| HPV31 | L2 | 10 | 49 | GSMGVFFGGL | 22247 |
| HPV31 | L2 | 8 | 26 | GTCPSDVI | 22248 |
| HPV31 | L2 | 11 | 26 | GTCPSDVIPKI | 22249 |
| HPV31 | L2 | 8 | 65 | GTGGRTGY | 22250 |
| HPV31 | L2 | 9 | 65 | GTGGRTGYV | 22251 |
| HPV31 | L2 | 11 | 65 | GTGGRTGYVPL | 22252 |
| HPV31 | L2 | 9 | 413 | HAPTQVFPF | 22253 |
| HPV31 | L2 | 11 | 413 | HAPTQVFPFPL | 22254 |
| HPV31 | L2 | 8 | 38 | HTTIADQI | 22255 |
| HPV31 | L2 | 9 | 38 | HTTIADQIL | 22256 |
| HPV31 | L2 | 11 | 38 | HTTIADQILRY | 22257 |
| HPV31 | L2 | 8 | 41 | IADQILRY | 22258 |
| HPV31 | L2 | 11 | 41 | IADQILRYGSM | 22259 |
| HPV31 | L2 | 8 | 280 | IALHRPAL | 22260 |
| HPV31 | L2 | 8 | 270 | IAPDPDFL | 22261 |
| HPV31 | L2 | 10 | 270 | IAPDPDFLDI | 22262 |
| HPV31 | L2 | 11 | 270 | IAPDPDFLDII | 22263 |
| HPV31 | L2 | 10 | 134 | IATTADTTPA | 22264 |
| HPV31 | L2 | 11 | 134 | IATTADTTPAI | 22265 |
| HPV31 | L2 | 11 | 323 | ISSINPAGESI | 22266 |
| HPV31 | L2 | 9 | 183 | ISTHNYEEI | 22267 |

TABLE XIII-continued

B58 Supermotif Peptides

| Type | Protein | No. of Amino Acids | Position | Sequence | Seq. Id. No. |
|---|---|---|---|---|---|
| HPV31 | L2 | 11 | 183 | ISTHNYEEIPM | 22268 |
| HPV31 | L2 | 10 | 205 | ITSSTPIPGV | 22269 |
| HPV31 | L2 | 8 | 245 | ITYENPAY | 22270 |
| HPV31 | L2 | 11 | 245 | ITYENPAYETV | 22271 |
| HPV31 | L2 | 10 | 23 | KAAGTCPSDV | 22272 |
| HPV31 | L2 | 11 | 23 | KAAGTCPSDVI | 22273 |
| HPV31 | L2 | 8 | 225 | KATQQVKV | 22274 |
| HPV31 | L2 | 9 | 225 | KATQQVKVI | 22275 |
| HPV31 | L2 | 8 | 423 | LAPTTPQV | 22276 |
| HPV31 | L2 | 10 | 423 | LAPTTPQVSI | 22277 |
| HPV31 | L2 | 11 | 423 | LAPTTPQVSIF | 22278 |
| HPV31 | L2 | 8 | 238 | LSAPKQLI | 22279 |
| HPV31 | L2 | 10 | 238 | LSAPKQLITY | 22280 |
| HPV31 | L2 | 11 | 178 | LSSSSISTHNY | 22281 |
| HPV31 | L2 | 9 | 395 | LSTGFDIPI | 22282 |
| HPV31 | L2 | 10 | 395 | LSTGFDIPIF | 22283 |
| HPV31 | L2 | 8 | 75 | LSTRPSTV | 22284 |
| HPV31 | L2 | 11 | 75 | LSTRPSTVSEA | 22285 |
| HPV31 | L2 | 8 | 287 | LTSRRNTV | 22286 |
| HPV31 | L2 | 10 | 287 | LTSRRNTVRY | 22287 |
| HPV31 | L2 | 8 | 256 | NAEESLYF | 22288 |
| HPV31 | L2 | 10 | 390 | NTTVPLSTGF | 22289 |
| HPV31 | L2 | 8 | 292 | NTVRYSRL | 22290 |
| HPV31 | L2 | 8 | 169 | PAETSGHL | 22291 |
| HPV31 | L2 | 9 | 169 | PAETSGHLL | 22292 |
| HPV31 | L2 | 10 | 169 | PAETSGHLLL | 22293 |
| HPV31 | L2 | 8 | 328 | PAGESIEM | 22294 |
| HPV31 | L2 | 11 | 328 | PAGESIEMQPL | 22295 |
| HPV31 | L2 | 9 | 142 | PAILDVTSV | 22296 |
| HPV31 | L2 | 10 | 285 | PALTSRRNTV | 22297 |
| HPV31 | L2 | 10 | 217 | PARLGLYSKA | 22298 |
| HPV31 | L2 | 11 | 366 | PATHNVSPSTA | 22299 |
| HPV31 | L2 | 8 | 250 | PAYETVNA | 22300 |
| HPV31 | L2 | 8 | 29 | PSDVIPKI | 22301 |
| HPV31 | L2 | 10 | 373 | PSTAVQSTSA | 22302 |
| HPV31 | L2 | 11 | 373 | PSTAVQSTSAV | 22303 |
| HPV31 | L2 | 9 | 79 | PSTVSEASI | 22304 |
| HPV31 | L2 | 11 | 79 | PSTVSEASIPI | 22305 |
| HPV31 | L2 | 10 | 161 | PSVLQPPTPA | 22306 |
| HPV31 | L2 | 10 | 235 | PTFLSAPKQL | 22307 |
| HPV31 | L2 | 11 | 235 | PTFLSAPKQLI | 22308 |
| HPV31 | L2 | 8 | 156 | PTFTDPSV | 22309 |
| HPV31 | L2 | 9 | 156 | PTFTDPSVL | 22310 |
| HPV31 | L2 | 8 | 388 | PTNTTVPL | 22311 |
| HPV31 | L2 | 10 | 167 | PTPAETSGHL | 22312 |
| HPV31 | L2 | 11 | 167 | PTPAETSGHLL | 22313 |
| HPV31 | L2 | 9 | 415 | PTQVFPFPL | 22314 |
| HPV31 | L2 | 10 | 415 | PTQVFPFPLA | 22315 |
| HPV31 | L2 | 8 | 425 | PTTPQVSI | 22316 |
| HPV31 | L2 | 9 | 425 | PTTPQVSIF | 22317 |
| HPV31 | L2 | 10 | 425 | PTTPQVSIFV | 22318 |
| HPV31 | L2 | 8 | 127 | PTTSGFDI | 22319 |
| HPV31 | L2 | 9 | 127 | PTTSGFDIA | 22320 |
| HPV31 | L2 | 8 | 378 | QSTSAVSA | 22321 |
| HPV31 | L2 | 9 | 378 | QSTSAVSAY | 22322 |
| HPV31 | L2 | 10 | 378 | QSTSAVSAYV | 22323 |
| HPV31 | L2 | 9 | 303 | QTLRTRSGA | 22324 |
| HPV31 | L2 | 11 | 303 | QTLRTRSGATI | 22325 |
| HPV31 | L2 | 8 | 12 | RASATQLY | 22326 |
| HPV31 | L2 | 8 | 308 | RSGATIGA | 22327 |
| HPV31 | L2 | 10 | 308 | RSGATIGARV | 22328 |
| HPV31 | L2 | 9 | 5 | RSTKRTKRA | 22329 |
| HPV31 | L2 | 11 | 5 | RSTKRTKRASA | 22330 |
| HPV31 | L2 | 10 | 9 | RTKRASATQL | 22331 |
| HPV31 | L2 | 11 | 9 | RTKRASATQLY | 22332 |
| HPV31 | L2 | 8 | 306 | RTRSGATI | 22333 |
| HPV31 | L2 | 10 | 306 | RTRSGATIGA | 22334 |
| HPV31 | L2 | 9 | 239 | SAPKQLITY | 22335 |
| HPV31 | L2 | 11 | 14 | SATQLYQTCKA | 22336 |
| HPV31 | L2 | 8 | 341 | SATTTSTL | 22337 |
| HPV31 | L2 | 10 | 384 | SAYVPTNTTV | 22338 |
| HPV31 | L2 | 10 | 324 | SSINPAGESI | 22339 |
| HPV31 | L2 | 8 | 181 | SSISTHNY | 22340 |
| HPV31 | L2 | 11 | 181 | SSISTHNYEEI | 22341 |
| HPV31 | L2 | 9 | 180 | SSSISTHNY | 22342 |
| HPV31 | L2 | 10 | 179 | SSSSISTHNY | 22343 |

TABLE XIII-continued

B58 Supermotif Peptides

| Type | Protein | No. of Amino Acids | Position | Sequence | Seq. Id. No. |
|---|---|---|---|---|---|
| HPV31 | L2 | 8 | 207 | SSTPIPGV | 22344 |
| HPV31 | L2 | 9 | 374 | STAVQSTSA | 22345 |
| HPV31 | L2 | 10 | 374 | STAVQSTSAV | 22346 |
| HPV31 | L2 | 8 | 396 | STGFDIPI | 22347 |
| HPV31 | L2 | 9 | 396 | STGFDIPIF | 22348 |
| HPV31 | L2 | 8 | 151 | STHENPTF | 22349 |
| HPV31 | L2 | 8 | 184 | STHNYEEI | 22350 |
| HPV31 | L2 | 10 | 184 | STHNYEEIPM | 22351 |
| HPV31 | L2 | 8 | 6 | STKRTKRA | 22352 |
| HPV31 | L2 | 10 | 6 | STKRTKRASA | 22353 |
| HPV31 | L2 | 8 | 346 | STLNDGLY | 22354 |
| HPV31 | L2 | 10 | 346 | STLNDGLYDI | 22355 |
| HPV31 | L2 | 11 | 346 | STLNDGLYDIY | 22356 |
| HPV31 | L2 | 11 | 208 | STPIPGVRRPA | 22357 |
| HPV31 | L2 | 10 | 76 | STRPSTVSEA | 22358 |
| HPV31 | L2 | 8 | 379 | STSAVSAY | 22359 |
| HPV31 | L2 | 9 | 379 | STSAVSAYV | 22360 |
| HPV31 | L2 | 8 | 80 | STVSEASI | 22361 |
| HPV31 | L2 | 10 | 80 | STVSEASIPI | 22362 |
| HPV31 | L2 | 8 | 137 | TADTTPAI | 22363 |
| HPV31 | L2 | 9 | 137 | TADTTPAIL | 22364 |
| HPV31 | L2 | 11 | 137 | TADTTPAILDV | 22365 |
| HPV31 | L2 | 8 | 375 | TAVQSTSA | 22366 |
| HPV31 | L2 | 9 | 375 | TAVQSTSAV | 22367 |
| HPV31 | L2 | 11 | 375 | TAVQSTSAVSA | 22368 |
| HPV31 | L2 | 8 | 380 | TSAVSAYV | 22369 |
| HPV31 | L2 | 10 | 129 | TSGFDIATTA | 22370 |
| HPV31 | L2 | 11 | 266 | TSHNIAPDPDF | 22371 |
| HPV31 | L2 | 9 | 288 | TSRRNTVRY | 22372 |
| HPV31 | L2 | 9 | 206 | TSSTPIPGV | 22373 |
| HPV31 | L2 | 8 | 345 | TSTLNDGL | 22374 |
| HPV31 | L2 | 9 | 345 | TSTLNDGLY | 22375 |
| HPV31 | L2 | 11 | 345 | TSTLNDGLYDI | 22376 |
| HPV31 | L2 | 11 | 148 | TSVSTHENPTF | 22377 |
| HPV31 | L2 | 8 | 136 | TTADTTPA | 22378 |
| HPV31 | L2 | 9 | 136 | TTADTTPAI | 22379 |
| HPV31 | L2 | 10 | 136 | TTADTTPAIL | 22380 |
| HPV31 | L2 | 8 | 39 | TTIADQIL | 22381 |
| HPV31 | L2 | 10 | 39 | TTIADQILRY | 22382 |
| HPV31 | L2 | 8 | 140 | TTPAILDV | 22383 |
| HPV31 | L2 | 11 | 140 | TTPAILDVTSV | 22384 |
| HPV31 | L2 | 8 | 426 | TTPQVSIF | 22385 |
| HPV31 | L2 | 9 | 426 | TTPQVSIFV | 22386 |
| HPV31 | L2 | 8 | 128 | TTSGFDIA | 22387 |
| HPV31 | L2 | 11 | 128 | TTSGFDIATTA | 22388 |
| HPV31 | L2 | 9 | 344 | TTSTLNDGL | 22389 |
| HPV31 | L2 | 10 | 344 | TTSTLNDGLY | 22390 |
| HPV31 | L2 | 10 | 343 | TTTSTLNDGL | 22391 |
| HPV31 | L2 | 11 | 343 | TTTSTLNDGLY | 22392 |
| HPV31 | L2 | 9 | 391 | TTVPLSTGF | 22393 |
| HPV31 | L2 | 11 | 391 | TTVPLSTGFDI | 22394 |
| HPV31 | L2 | 11 | 383 | VSAYVPTNTTV | 22395 |
| HPV31 | L2 | 8 | 82 | VSEASIPI | 22396 |
| HPV31 | L2 | 9 | 93 | VSIDPVGPL | 22397 |
| HPV31 | L2 | 10 | 430 | VSIFVDGGDF | 22398 |
| HPV31 | L2 | 11 | 430 | VSIFVDGGDFY | 22399 |
| HPV31 | L2 | 9 | 106 | VSLVEESGI | 22400 |
| HPV31 | L2 | 10 | 106 | VSLVEESGIV | 22401 |
| HPV31 | L2 | 9 | 150 | VSTHENPTF | 22402 |
| HPV31 | L2 | 8 | 198 | VSTNNENI | 22403 |
| HPV31 | L2 | 8 | 455 | VSYFFTDV | 22404 |
| HPV31 | L2 | 10 | 455 | VSYFFTDVSV | 22405 |
| HPV31 | L2 | 11 | 455 | VSYFFTDVSVA | 22406 |
| HPV31 | L2 | 8 | 356 | YADTDFTV | 22407 |
| HPV31 | L2 | 8 | 223 | YSKATQQV | 22408 |
| HPV31 | L2 | 10 | 223 | YSKATQQVKV | 22409 |
| HPV31 | L2 | 11 | 223 | YSKATQQVKVI | 22410 |
| HPV31 | L2 | 10 | 296 | YSRLGNKQTL | 22411 |
| HPV33 | E1 | 11 | 382 | AAAFLKSNSQA | 22412 |
| HPV33 | E1 | 8 | 90 | AACSQSAA | 22413 |
| HPV33 | E1 | 11 | 90 | AACSQSAAEDV | 22414 |
| HPV33 | E1 | 9 | 96 | AAEDVVDRA | 22415 |
| HPV33 | E1 | 10 | 96 | AAEDVVDRAA | 22416 |
| HPV33 | E1 | 10 | 383 | AAFLKSNSQA | 22417 |
| HPV33 | E1 | 9 | 104 | AANPCRTSI | 22418 |
| HPV33 | E1 | 8 | 65 | AARALFNI | 22419 |

TABLE XIII-continued

B58 Supermotif Peptides

| Type | Protein | No. of Amino Acids | Position | Sequence | Seq. Id. No. |
|---|---|---|---|---|---|
| HPV33 | E1 | 8 | 83 | CALKRKFA | 22420 |
| HPV33 | E1 | 9 | 83 | CALKRKFAA | 22421 |
| HPV33 | E1 | 9 | 310 | CALYWFRTA | 22422 |
| HPV33 | E1 | 10 | 310 | CALYWFRTAM | 22423 |
| HPV33 | E1 | 10 | 633 | CSAGENTRSL | 22424 |
| HPV33 | E1 | 8 | 276 | CSKNRLTV | 22425 |
| HPV33 | E1 | 9 | 276 | CSKNRLTVA | 22426 |
| HPV33 | E1 | 11 | 276 | CSKNRLTVAKL | 22427 |
| HPV33 | E1 | 9 | 92 | CSQSAAEDV | 22428 |
| HPV33 | E1 | 10 | 92 | CSQSAAEDVV | 22429 |
| HPV33 | E1 | 9 | 226 | CTDWCITGY | 22430 |
| HPV33 | E1 | 11 | 226 | CTDWCITGYGI | 22431 |
| HPV33 | E1 | 9 | 14 | CTGWFEVEA | 22432 |
| HPV33 | E1 | 10 | 14 | CTGWFEVEAV | 22433 |
| HPV33 | E1 | 11 | 14 | CTGWFEVEAVI | 22434 |
| HPV33 | E1 | 8 | 118 | CTYRKRKI | 22435 |
| HPV33 | E1 | 11 | 118 | CTYRKRKIDEL | 22436 |
| HPV33 | E1 | 10 | 508 | DAKIGMIDDV | 22437 |
| HPV33 | E1 | 8 | 177 | DSCENVTL | 22438 |
| HPV33 | E1 | 11 | 177 | DSCENVTLQEI | 22439 |
| HPV33 | E1 | 8 | 365 | DSDIAYYY | 22440 |
| HPV33 | E1 | 9 | 365 | DSDIAYYYA | 22441 |
| HPV33 | E1 | 11 | 365 | DSDIAYYYAQL | 22442 |
| HPV33 | E1 | 10 | 167 | DSEVSCETNV | 22443 |
| HPV33 | E1 | 9 | 42 | DSGTDLLEF | 22444 |
| HPV33 | E1 | 10 | 42 | DSGTDLLEFI | 22445 |
| HPV33 | E1 | 9 | 130 | DSGYGNTEV | 22446 |
| HPV33 | E1 | 9 | 53 | DSMENSIQA | 22447 |
| HPV33 | E1 | 8 | 377 | DSNSNAAA | 22448 |
| HPV33 | E1 | 9 | 377 | DSNSNAAAF | 22449 |
| HPV33 | E1 | 10 | 377 | DSNSNAAAFL | 22450 |
| HPV33 | E1 | 11 | 566 | DSRWPYLHSRL | 22451 |
| HPV33 | E1 | 8 | 62 | DTEAARAL | 22452 |
| HPV33 | E1 | 9 | 62 | DTEAARALF | 22453 |
| HPV33 | E1 | 11 | 62 | DTEAARALFNI | 22454 |
| HPV33 | E1 | 9 | 64 | EAARALFNI | 22455 |
| HPV33 | E1 | 8 | 206 | EAYGISFM | 22456 |
| HPV33 | E1 | 10 | 206 | EAYGISFMEL | 22457 |
| HPV33 | E1 | 11 | 206 | EAYGISFMELV | 22458 |
| HPV33 | E1 | 9 | 148 | ESQNGDTNL | 22459 |
| HPV33 | E1 | 11 | 160 | ESSGVGDDSEV | 22460 |
| HPV33 | E1 | 10 | 38 | ETADDSGTDL | 22461 |
| HPV33 | E1 | 11 | 38 | ETADDSGTDLL | 22462 |
| HPV33 | E1 | 11 | 295 | ETCMVIEPPKL | 22463 |
| HPV33 | E1 | 10 | 173 | ETNVDSCENV | 22464 |
| HPV33 | E1 | 9 | 139 | ETQQMVQQV | 22465 |
| HPV33 | E1 | 8 | 89 | FAACSQSA | 22466 |
| HPV33 | E1 | 9 | 89 | FAACSQSAA | 22467 |
| HPV33 | E1 | 8 | 606 | FSRTWCKL | 22468 |
| HPV33 | E1 | 10 | 606 | FSRTWCKLDL | 22469 |
| HPV33 | E1 | 11 | 606 | FSRTWCKLDLI | 22470 |
| HPV33 | E1 | 8 | 446 | FTAFLGAF | 22471 |
| HPV33 | E1 | 11 | 446 | FTAFLGAFKKF | 22472 |
| HPV33 | E1 | 10 | 451 | GAFKKFLKGI | 22473 |
| HPV33 | E1 | 9 | 9 | GAGMGCTGW | 22474 |
| HPV33 | E1 | 10 | 9 | GAGMGCTGWF | 22475 |
| HPV33 | E1 | 8 | 44 | GTDLLEFI | 22476 |
| HPV33 | E1 | 8 | 564 | GTDSRWPY | 22477 |
| HPV33 | E1 | 9 | 564 | GTDSRWPYL | 22478 |
| HPV33 | E1 | 10 | 327 | GTTPEWIDRL | 22479 |
| HPV33 | E1 | 8 | 341 | HSFNDNIF | 22480 |
| HPV33 | E1 | 10 | 341 | HSFNDNIFDL | 22481 |
| HPV33 | E1 | 10 | 251 | HSLYTHLQCL | 22482 |
| HPV33 | E1 | 9 | 573 | HSRLTVFEF | 22483 |
| HPV33 | E1 | 9 | 192 | HSSNTKANI | 22484 |
| HPV33 | E1 | 10 | 192 | HSSNTKANIL | 22485 |
| HPV33 | E1 | 11 | 192 | HSSNTKANILY | 22486 |
| HPV33 | E1 | 8 | 368 | IAYYYAQL | 22487 |
| HPV33 | E1 | 9 | 368 | IAYYYAQLA | 22488 |
| HPV33 | E1 | 10 | 492 | ISCVNSKSHF | 22489 |
| HPV33 | E1 | 11 | 492 | ISCVNSKSHFW | 22490 |
| HPV33 | E1 | 11 | 322 | ISDVQGTTPEW | 22491 |
| HPV33 | E1 | 9 | 32 | ISEDEDETA | 22492 |
| HPV33 | E1 | 10 | 210 | ISFMELVRPF | 22493 |
| HPV33 | E1 | 9 | 538 | ISIDVKHRA | 22494 |
| HPV33 | E1 | 10 | 538 | ISIDVKHRAL | 22495 |

TABLE XIII-continued

B58 Supermotif Peptides

| Type | Protein | No. of Amino Acids | Position | Sequence | Seq. Id. No. |
|---|---|---|---|---|---|
| HPV33 | E1 | 11 | 538 | ISIDVKHRALV | 22496 |
| HPV33 | E1 | 9 | 236 | ISPSVAESL | 22497 |
| HPV33 | E1 | 11 | 236 | ISPSVAESLKV | 22498 |
| HPV33 | E1 | 8 | 628 | ISTFKCSA | 22499 |
| HPV33 | E1 | 9 | 520 | ISWTYIDDY | 22500 |
| HPV33 | E1 | 10 | 520 | ISWTYIDDYM | 22501 |
| HPV33 | E1 | 10 | 231 | ITGYGISPSV | 22502 |
| HPV33 | E1 | 11 | 231 | ITGYGISPSVA | 22503 |
| HPV33 | E1 | 9 | 407 | KAEKRKMSI | 22504 |
| HPV33 | E1 | 8 | 197 | KANILYKF | 22505 |
| HPV33 | E1 | 11 | 197 | KANILYKFKEA | 22506 |
| HPV33 | E1 | 10 | 463 | KSCMLICGPA | 22507 |
| HPV33 | E1 | 10 | 220 | KSDKTSCTDW | 22508 |
| HPV33 | E1 | 8 | 603 | KSFFSRTW | 22509 |
| HPV33 | E1 | 11 | 603 | KSFFSRTWCKL | 22510 |
| HPV33 | E1 | 9 | 498 | KSHFWLQPL | 22511 |
| HPV33 | E1 | 8 | 387 | KSNSQAKI | 22512 |
| HPV33 | E1 | 9 | 387 | KSNSQAKIV | 22513 |
| HPV33 | E1 | 8 | 476 | KSYFGMSL | 22514 |
| HPV33 | E1 | 9 | 476 | KSYFGMSLI | 22515 |
| HPV33 | E1 | 11 | 476 | KSYFGMSLIQF | 22516 |
| HPV33 | E1 | 8 | 425 | KTNDGGNW | 22517 |
| HPV33 | E1 | 11 | 425 | KTNDGGNWRPI | 22518 |
| HPV33 | E1 | 9 | 223 | KTSCTDWCI | 22519 |
| HPV33 | E1 | 8 | 375 | LADSNSNA | 22520 |
| HPV33 | E1 | 9 | 375 | LADSNSNAA | 22521 |
| HPV33 | E1 | 10 | 375 | LADSNSNAAA | 22522 |
| HPV33 | E1 | 11 | 375 | LADSNSNAAAF | 22523 |
| HPV33 | E1 | 8 | 506 | LSDAKIGM | 22524 |
| HPV33 | E1 | 9 | 506 | LSDAKIGMI | 22525 |
| HPV33 | E1 | 8 | 350 | LSEMVQWA | 22526 |
| HPV33 | E1 | 9 | 350 | LSEMVQWAY | 22527 |
| HPV33 | E1 | 8 | 291 | LSIPETCM | 22528 |
| HPV33 | E1 | 9 | 291 | LSIPETCMV | 22529 |
| HPV33 | E1 | 10 | 291 | LSIPETCMVI | 22530 |
| HPV33 | E1 | 8 | 260 | LTCDRGII | 22531 |
| HPV33 | E1 | 9 | 260 | LTCDRGIII | 22532 |
| HPV33 | E1 | 10 | 260 | LTCDRGIIIL | 22533 |
| HPV33 | E1 | 11 | 260 | LTCDRGIIILL | 22534 |
| HPV33 | E1 | 8 | 362 | LTDDSDIA | 22535 |
| HPV33 | E1 | 9 | 362 | LTDDSDIAY | 22536 |
| HPV33 | E1 | 10 | 362 | LTDDSDIAYY | 22537 |
| HPV33 | E1 | 11 | 362 | LTDDSDIAYYY | 22538 |
| HPV33 | E1 | 10 | 281 | LTVAKLMSNL | 22539 |
| HPV33 | E1 | 11 | 281 | LTVAKLMSNLL | 22540 |
| HPV33 | E1 | 10 | 576 | LTVFEFKNPF | 22541 |
| HPV33 | E1 | 8 | 336 | LTVLQHSF | 22542 |
| HPV33 | E1 | 10 | 1 | MADPEGTNGA | 22543 |
| HPV33 | E1 | 11 | 481 | MSLIQFLKGCV | 22544 |
| HPV33 | E1 | 8 | 562 | NAGTDSRW | 22545 |
| HPV33 | E1 | 10 | 562 | NAGTDSRWPY | 22546 |
| HPV33 | E1 | 11 | 562 | NAGTDSRWPYL | 22547 |
| HPV33 | E1 | 8 | 531 | NALDGNEI | 22548 |
| HPV33 | E1 | 10 | 531 | NALDGNEISI | 22549 |
| HPV33 | E1 | 10 | 80 | NAVCALKRKF | 22550 |
| HPV33 | E1 | 11 | 80 | NAVCALKRKFA | 22551 |
| HPV33 | E1 | 9 | 57 | NSIQADTEA | 22552 |
| HPV33 | E1 | 10 | 57 | NSIQADTEAA | 22553 |
| HPV33 | E1 | 8 | 496 | NSKSHFWL | 22554 |
| HPV33 | E1 | 11 | 496 | NSKSHFWLQPL | 22555 |
| HPV33 | E1 | 8 | 379 | NSNAAAFL | 22556 |
| HPV33 | E1 | 9 | 135 | NTEVETQQM | 22557 |
| HPV33 | E1 | 10 | 135 | NTEVETQQMV | 22558 |
| HPV33 | E1 | 9 | 473 | NTGKSYFGM | 22559 |
| HPV33 | E1 | 11 | 473 | NTGKSYFGMSL | 22560 |
| HPV33 | E1 | 8 | 195 | NTKANILY | 22561 |
| HPV33 | E1 | 10 | 195 | NTKANILYKF | 22562 |
| HPV33 | E1 | 10 | 560 | NTNAGTDSRW | 22563 |
| HPV33 | E1 | 8 | 471 | PANTGKSY | 22564 |
| HPV33 | E1 | 9 | 471 | PANTGKSYF | 22565 |
| HPV33 | E1 | 11 | 471 | PANTGKSYFGM | 22566 |
| HPV33 | E1 | 9 | 238 | PSVAESLKV | 22567 |
| HPV33 | E1 | 10 | 238 | PSVAESLKVL | 22568 |
| HPV33 | E1 | 11 | 238 | PSVAESLKVLI | 22569 |
| HPV33 | E1 | 9 | 60 | QADTEAARA | 22570 |
| HPV33 | E1 | 10 | 60 | QADTEAARAL | 22571 |

TABLE XIII-continued

B58 Supermotif Peptides

| Type | Protein | No. of Amino Acids | Position | Sequence | Seq. Id. No. |
|---|---|---|---|---|---|
| HPV33 | E1 | 11 | 60 | QADTEAARALF | 22572 |
| HPV33 | E1 | 10 | 391 | QAKIVKDCGI | 22573 |
| HPV33 | E1 | 11 | 391 | QAKIVKDCGIM | 22574 |
| HPV33 | E1 | 8 | 94 | QSAAEDVV | 22575 |
| HPV33 | E1 | 11 | 94 | QSAAEDVVDRA | 22576 |
| HPV33 | E1 | 8 | 308 | QTCALYWF | 22577 |
| HPV33 | E1 | 11 | 308 | QTCALYWFRTA | 22578 |
| HPV33 | E1 | 10 | 103 | RAANPCRTSI | 22579 |
| HPV33 | E1 | 11 | 545 | RALVQLKCPPL | 22580 |
| HPV33 | E1 | 8 | 306 | RSQTCALY | 22581 |
| HPV33 | E1 | 9 | 306 | RSQTCALYW | 22582 |
| HPV33 | E1 | 10 | 306 | RSQTCALYWF | 22583 |
| HPV33 | E1 | 10 | 316 | RTAMSNISDV | 22584 |
| HPV33 | E1 | 8 | 608 | RTWCKLDL | 22585 |
| HPV33 | E1 | 9 | 608 | RTWCKLDLI | 22586 |
| HPV33 | E1 | 10 | 95 | SAAEDVVDRA | 22587 |
| HPV33 | E1 | 11 | 95 | SAAEDVVDRAA | 22588 |
| HPV33 | E1 | 9 | 634 | SAGENTRSL | 22589 |
| HPV33 | E1 | 10 | 161 | SSGVGDDSEV | 22590 |
| HPV33 | E1 | 8 | 193 | SSNTKANI | 22591 |
| HPV33 | E1 | 9 | 193 | SSNTKANIL | 22592 |
| HPV33 | E1 | 10 | 193 | SSNTKANILY | 22593 |
| HPV33 | E1 | 9 | 39 | TADDSGTDL | 22594 |
| HPV33 | E1 | 10 | 39 | TADDSGTDLL | 22595 |
| HPV33 | E1 | 10 | 447 | TAFLGAFKKF | 22596 |
| HPV33 | E1 | 11 | 447 | TAFLGAFKKFL | 22597 |
| HPV33 | E1 | 9 | 317 | TAMSNISDV | 22598 |
| HPV33 | E1 | 8 | 224 | TSCTDWCI | 22599 |
| HPV33 | E1 | 11 | 224 | TSCTDWCITGY | 22600 |
| HPV33 | E1 | 11 | 110 | TSINKNKECTY | 22601 |
| HPV33 | E1 | 9 | 328 | TTPEWIDRL | 22602 |
| HPV33 | E1 | 11 | 328 | TTPEWIDRLTV | 22603 |
| HPV33 | E1 | 8 | 240 | VAESLKVL | 22604 |
| HPV33 | E1 | 9 | 240 | VAESLKVLI | 22605 |
| HPV33 | E1 | 8 | 283 | VAKLMSNL | 22606 |
| HPV33 | E1 | 9 | 283 | VAKLMSNLL | 22607 |
| HPV33 | E1 | 11 | 283 | VAKLMSNLLSI | 22608 |
| HPV33 | E1 | 9 | 182 | VTLQEISNV | 22609 |
| HPV33 | E1 | 10 | 182 | VTLQEISNVL | 22610 |
| HPV33 | E1 | 8 | 517 | VTPISWTY | 22611 |
| HPV33 | E1 | 9 | 517 | VTPISWTYI | 22612 |
| HPV33 | E1 | 8 | 522 | WTYIDDYM | 22613 |
| HPV33 | E1 | 11 | 522 | WTYIDDYMRNA | 22614 |
| HPV33 | E1 | 8 | 595 | YAINDENW | 22615 |
| HPV33 | E1 | 11 | 595 | YAINDENWKSF | 22616 |
| HPV33 | E1 | 11 | 372 | YAQLADSNSNA | 22617 |
| HPV33 | E2 | 9 | 223 | AAAKRRRPA | 22618 |
| HPV33 | E2 | 8 | 224 | AAKRRRPA | 22619 |
| HPV33 | E2 | 9 | 175 | AAKYSKTQM | 22620 |
| HPV33 | E2 | 10 | 175 | AAKYSKTQMW | 22621 |
| HPV33 | E2 | 9 | 64 | ASKTKAFQV | 22622 |
| HPV33 | E2 | 10 | 64 | ASKTKAFQVI | 22623 |
| HPV33 | E2 | 11 | 258 | ATNCTNKQRTV | 22624 |
| HPV33 | E2 | 11 | 245 | CADPALDNRTA | 22625 |
| HPV33 | E2 | 10 | 40 | CALLYTAKQM | 22626 |
| HPV33 | E2 | 8 | 269 | CSSNVAPI | 22627 |
| HPV33 | E2 | 9 | 269 | CSSNVAPIV | 22628 |
| HPV33 | E2 | 11 | 269 | CSSNVAPIVHL | 22629 |
| HPV33 | E2 | 8 | 145 | CTMVTGKV | 22630 |
| HPV33 | E2 | 10 | 145 | CTMVTGKVDY | 22631 |
| HPV33 | E2 | 11 | 145 | CTMVTGKVDYI | 22632 |
| HPV33 | E2 | 8 | 261 | CTNKQRTV | 22633 |
| HPV33 | E2 | 10 | 174 | DAAKYSKTQM | 22634 |
| HPV33 | E2 | 11 | 174 | DAAKYSKTQMW | 22635 |
| HPV33 | E2 | 9 | 235 | DTAQPLTKL | 22636 |
| HPV33 | E2 | 10 | 235 | DTAQPLTKLF | 22637 |
| HPV33 | E2 | 10 | 143 | DTCTMVTGKV | 22638 |
| HPV33 | E2 | 9 | 232 | DTTDTAQPL | 22639 |
| HPV33 | E2 | 11 | 20 | EADKTDLPSQI | 22640 |
| HPV33 | E2 | 8 | 282 | ESNSLKCL | 22641 |
| HPV33 | E2 | 10 | 282 | ESNSLKCLRY | 22642 |
| HPV33 | E2 | 8 | 80 | ETLSKSQY | 22643 |
| HPV33 | E2 | 8 | 51 | FSHLCHQV | 22644 |
| HPV33 | E2 | 9 | 51 | FSHLCHQVV | 22645 |
| HPV33 | E2 | 9 | 336 | GTVKIPPTV | 22646 |
| HPV33 | E2 | 11 | 336 | GTVKIPPTVQI | 22647 |

TABLE XIII-continued

B58 Supermotif Peptides

| Type | Protein | No. of Amino Acids | Position | Sequence | Seq. Id. No. |
|---|---|---|---|---|---|
| HPV33 | E2 | 8 | 4 | ISARLNAV | 22648 |
| HPV33 | E2 | 8 | 346 | ISTGFMTL | 22649 |
| HPV33 | E2 | 9 | 204 | ISTTETADI | 22650 |
| HPV33 | E2 | 8 | 68 | KAFQVIEL | 22651 |
| HPV33 | E2 | 10 | 68 | KAFQVIELQM | 22652 |
| HPV33 | E2 | 11 | 68 | KAFQVIELQMA | 22653 |
| HPV33 | E2 | 9 | 84 | KSQYSTSQW | 22654 |
| HPV33 | E2 | 11 | 84 | KSQYSTSQWTL | 22655 |
| HPV33 | E2 | 8 | 23 | KTDLPSQI | 22656 |
| HPV33 | E2 | 11 | 23 | KTDLPSQIEHW | 22657 |
| HPV33 | E2 | 8 | 66 | KTKAFQVI | 22658 |
| HPV33 | E2 | 10 | 66 | KTKAFQVIEL | 22659 |
| HPV33 | E2 | 9 | 180 | KTQMWEVHV | 22660 |
| HPV33 | E2 | 8 | 63 | LASKTKAF | 22661 |
| HPV33 | E2 | 10 | 63 | LASKTKAFQV | 22662 |
| HPV33 | E2 | 11 | 63 | LASKTKAFQVI | 22663 |
| HPV33 | E2 | 11 | 82 | LSKSQYSTSQW | 22664 |
| HPV33 | E2 | 10 | 240 | LTKLFCADPA | 22665 |
| HPV33 | E2 | 11 | 240 | LTKLFCADPAL | 22666 |
| HPV33 | E2 | 11 | 77 | MALETLSKSQY | 22667 |
| HPV33 | E2 | 8 | 9 | NAVQEKIL | 22668 |
| HPV33 | E2 | 10 | 9 | NAVQEKILDL | 22669 |
| HPV33 | E2 | 11 | 9 | NAVQEKILDLY | 22670 |
| HPV33 | E2 | 9 | 315 | NSKNGIVTV | 22671 |
| HPV33 | E2 | 11 | 315 | NSKNGIVTVTF | 22672 |
| HPV33 | E2 | 8 | 284 | NSLKCLRY | 22673 |
| HPV33 | E2 | 10 | 284 | NSLKCLRYRL | 22674 |
| HPV33 | E2 | 8 | 127 | NTMDYTNW | 22675 |
| HPV33 | E2 | 11 | 127 | NTMDYTNWGEI | 22676 |
| HPV33 | E2 | 8 | 230 | PADTTDTA | 22677 |
| HPV33 | E2 | 11 | 230 | PADTTDTAQPL | 22678 |
| HPV33 | E2 | 8 | 248 | PALDNRTA | 22679 |
| HPV33 | E2 | 11 | 248 | PALDNRTARTA | 22680 |
| HPV33 | E2 | 10 | 60 | PSLLASKTKA | 22681 |
| HPV33 | E2 | 11 | 60 | PSLLASKTKAF | 22682 |
| HPV33 | E2 | 9 | 27 | PSQIEHWKL | 22683 |
| HPV33 | E2 | 10 | 27 | PSQIEHWKLI | 22684 |
| HPV33 | E2 | 9 | 196 | PTSISSNQI | 22685 |
| HPV33 | E2 | 9 | 342 | PTVQISTGF | 22686 |
| HPV33 | E2 | 10 | 342 | PTVQISTGFM | 22687 |
| HPV33 | E2 | 10 | 222 | QAAAKRRRPA | 22688 |
| HPV33 | E2 | 11 | 213 | QTDNDNRPPQA | 22689 |
| HPV33 | E2 | 8 | 96 | QTSLEVWL | 22690 |
| HPV33 | E2 | 8 | 266 | RTVCSSNV | 22691 |
| HPV33 | E2 | 9 | 266 | RTVCSSNVA | 22692 |
| HPV33 | E2 | 11 | 266 | RTVCSSNVAPI | 22693 |
| HPV33 | E2 | 11 | 5 | SARLNAVQEKI | 22694 |
| HPV33 | E2 | 9 | 301 | SSMSSTWHW | 22695 |
| HPV33 | E2 | 11 | 200 | SSNQISTTETA | 22696 |
| HPV33 | E2 | 8 | 270 | SSNVAPIV | 22697 |
| HPV33 | E2 | 10 | 270 | SSNVAPIVHL | 22698 |
| HPV33 | E2 | 8 | 205 | STTETADI | 22699 |
| HPV33 | E2 | 10 | 45 | TAKQMGFSHL | 22700 |
| HPV33 | E2 | 8 | 236 | TAQPLTKL | 22701 |
| HPV33 | E2 | 9 | 236 | TAQPLTKLF | 22702 |
| HPV33 | E2 | 11 | 236 | TAQPLTKLFCA | 22703 |
| HPV33 | E2 | 11 | 310 | TSDNKSKNGI | 22704 |
| HPV33 | E2 | 8 | 197 | TSISSNQI | 22705 |
| HPV33 | E2 | 11 | 89 | TSQWTLQQTSL | 22706 |
| HPV33 | E2 | 8 | 233 | TTDTAQPL | 22707 |
| HPV33 | E2 | 11 | 233 | TTDTAQPLTKL | 22708 |
| HPV33 | E2 | 8 | 326 | VTEQQQQM | 22709 |
| HPV33 | E2 | 9 | 326 | VTEQQQQMF | 22710 |
| HPV33 | E2 | 10 | 326 | VTEQQQQMFL | 22711 |
| HPV33 | E2 | 11 | 323 | VTFVTEQQQQM | 22712 |
| HPV33 | E2 | 8 | 148 | VTGKVDYI | 22713 |
| HPV33 | E2 | 10 | 148 | VTGKVDYIGM | 22714 |
| HPV33 | E2 | 11 | 148 | VTGKVDYIGMY | 22715 |
| HPV33 | E2 | 8 | 92 | WTLQQTSL | 22716 |
| HPV33 | E2 | 10 | 92 | WTLQQTSLEV | 22717 |
| HPV33 | E2 | 11 | 92 | WTLQQTSLEVW | 22718 |
| HPV33 | E2 | 9 | 178 | YSKTQMWEV | 22719 |
| HPV33 | E2 | 11 | 178 | YSKTQMWEVHV | 22720 |
| HPV33 | E2 | 8 | 300 | YSSMSSTW | 22721 |
| HPV33 | E2 | 10 | 300 | YSSMSSTWHW | 22722 |
| HPV33 | E2 | 8 | 87 | YSTSQWTL | 22723 |

TABLE XIII-continued

B58 Supermotif Peptides

| Type | Protein | No. of Amino Acids | Position | Sequence | Seq. Id. No. |
|---|---|---|---|---|---|
| HPV33 | E2 | 8 | 44 | YTAKQMGF | 22724 |
| HPV33 | E2 | 11 | 44 | YTAKQMGFSHL | 22725 |
| HPV33 | E2 | 8 | 131 | YTNWGEIY | 22726 |
| HPV33 | E2 | 9 | 131 | YTNWGEIYI | 22727 |
| HPV33 | E2 | 10 | 131 | YTNWGEIYII | 22728 |
| HPV33 | E5 | 8 | 44 | GSPLKIFF | 22729 |
| HPV33 | E5 | 10 | 44 | GSPLKIFFCY | 22730 |
| HPV33 | E5 | 11 | 44 | GSPLKIFFCYL | 22731 |
| HPV33 | E5 | 8 | 26 | ISTYAWLL | 22732 |
| HPV33 | E5 | 9 | 26 | ISTYAWLLV | 22733 |
| HPV33 | E5 | 10 | 26 | ISTYAWLLVL | 22734 |
| HPV33 | E5 | 11 | 26 | ISTYAWLLVLV | 22735 |
| HPV33 | E5 | 8 | 24 | LSISTYAW | 22736 |
| HPV33 | E5 | 9 | 24 | LSISTYAWL | 22737 |
| HPV33 | E5 | 10 | 24 | LSISTYAWLL | 22738 |
| HPV33 | E5 | 11 | 24 | LSISTYAWLLV | 22739 |
| HPV33 | E5 | 8 | 15 | LSLLLRPL | 22740 |
| HPV33 | E5 | 9 | 15 | LSLLLRPLI | 22741 |
| HPV33 | E5 | 10 | 15 | LSLLLRPLIL | 22742 |
| HPV33 | E5 | 8 | 27 | STYAWLLV | 22743 |
| HPV33 | E5 | 9 | 27 | STYAWLLVL | 22744 |
| HPV33 | E5 | 10 | 27 | STYAWLLVLV | 22745 |
| HPV33 | E5 | 11 | 27 | STYAWLLVLVL | 22746 |
| HPV33 | E5 | 8 | 29 | YAWLLVLV | 22747 |
| HPV33 | E5 | 9 | 29 | YAWLLVLVL | 22748 |
| HPV33 | E5 | 10 | 29 | YAWLLVLVLL | 22749 |
| HPV33 | E5 | 11 | 29 | YAWLLVLVLLL | 22750 |
| HPV33 | E6 | 9 | 4 | DTEEKPRTL | 22751 |
| HPV33 | E6 | 9 | 20 | ETTIHNIEL | 22752 |
| HPV33 | E6 | 8 | 47 | FADLTVVY | 22753 |
| HPV33 | E6 | 8 | 45 | FAFADLTV | 22754 |
| HPV33 | E6 | 9 | 45 | FAFADLTVV | 22755 |
| HPV33 | E6 | 10 | 45 | FAFADLTVVY | 22756 |
| HPV33 | E6 | 9 | 73 | ISEYRHYNY | 22757 |
| HPV33 | E6 | 11 | 73 | ISEYRHYNYSV | 22758 |
| HPV33 | E6 | 10 | 128 | ISGRWAGRCA | 22759 |
| HPV33 | E6 | 11 | 128 | ISGRWAGRCAA | 22760 |
| HPV33 | E6 | 10 | 70 | LSKISEYRHY | 22761 |
| HPV33 | E6 | 11 | 50 | LTVVYREGNPF | 22762 |
| HPV33 | E6 | 11 | 86 | NTLEQTVKKPL | 22763 |
| HPV33 | E6 | 10 | 17 | QALETTIHNI | 22764 |
| HPV33 | E6 | 10 | 90 | QTVKKPLNEI | 22765 |
| HPV33 | E6 | 11 | 90 | QTVKKPLNEIL | 22766 |
| HPV33 | E6 | 8 | 39 | RSEVYDFA | 22767 |
| HPV33 | E6 | 9 | 39 | RSEVYDFAF | 22768 |
| HPV33 | E6 | 10 | 39 | RSEVYDFAFA | 22769 |
| HPV33 | E6 | 8 | 141 | RSRRRETA | 22770 |
| HPV33 | E6 | 9 | 141 | RSRRRETAL | 22771 |
| HPV33 | E6 | 9 | 10 | RTLHDLCQA | 22772 |
| HPV33 | E6 | 10 | 10 | RTLHDLCQAL | 22773 |
| HPV33 | E6 | 8 | 21 | TTIHNIEL | 22774 |
| HPV33 | E6 | 11 | 21 | TTIHNIELQCV | 22775 |
| HPV33 | E6 | 9 | 132 | WAGRCAACW | 22776 |
| HPV33 | E6 | 8 | 81 | YSVYGNTL | 22777 |
| HPV33 | E7 | 10 | 73 | ASDLRTIQQL | 22778 |
| HPV33 | E7 | 11 | 73 | ASDLRTIQQLL | 22779 |
| HPV33 | E7 | 8 | 48 | ATADYYIV | 22780 |
| HPV33 | E7 | 9 | 30 | DSSDEDEGL | 22781 |
| HPV33 | E7 | 11 | 85 | GTVNIVCPTCA | 22782 |
| HPV33 | E7 | 9 | 59 | HTCNTTVRL | 22783 |
| HPV33 | E7 | 11 | 59 | HTCNTTVRLCV | 22784 |
| HPV33 | E7 | 11 | 28 | LSDSSDEDEGL | 22785 |
| HPV33 | E7 | 10 | 70 | NSTASDLRTI | 22786 |
| HPV33 | E7 | 8 | 62 | NTTVRLCV | 22787 |
| HPV33 | E7 | 8 | 47 | PATADYYI | 22788 |
| HPV33 | E7 | 9 | 47 | PATADYYIV | 22789 |
| HPV33 | E7 | 10 | 19 | PTDLYCYEQL | 22790 |
| HPV33 | E7 | 8 | 6 | PTLKEYVL | 22791 |
| HPV33 | E7 | 10 | 6 | PTLKEYVLDL | 22792 |
| HPV33 | E7 | 11 | 6 | PTLKEYVLDLY | 22793 |
| HPV33 | E7 | 9 | 44 | QAQPATADY | 22794 |
| HPV33 | E7 | 10 | 44 | QAQPATADYY | 22795 |
| HPV33 | E7 | 11 | 44 | QAQPATADYYI | 22796 |
| HPV33 | E7 | 8 | 77 | RTIQQLLM | 22797 |
| HPV33 | E7 | 11 | 77 | RTIQQLLMGTV | 22798 |
| HPV33 | E7 | 8 | 31 | SSDEDEGL | 22799 |

TABLE XIII-continued

B58 Supermotif Peptides

| Type | Protein | No. of Amino Acids | Position | Sequence | Seq. Id. No. |
|---|---|---|---|---|---|
| HPV33 | E7 | 9 | 71 | STASDLRTI | 22800 |
| HPV33 | E7 | 8 | 72 | TASDLRTI | 22801 |
| HPV33 | E7 | 11 | 72 | TASDLRTIQQL | 22802 |
| HPV33 | E7 | 11 | 63 | TTVRLCVNSTA | 22803 |
| HPV33 | E7 | 11 | 55 | VTCCHTCNTTV | 22804 |
| HPV33 | L1 | 10 | 179 | AAPANDCPPL | 22805 |
| HPV33 | L1 | 11 | 482 | AAPTSTRTSSA | 22806 |
| HPV33 | L1 | 8 | 284 | ASIQSSAF | 22807 |
| HPV33 | L1 | 9 | 284 | ASIQSSAFF | 22808 |
| HPV33 | L1 | 9 | 411 | ASLQDTYRF | 22809 |
| HPV33 | L1 | 10 | 411 | ASLQDTYRFV | 22810 |
| HPV33 | L1 | 8 | 9 | ATVYLPPV | 22811 |
| HPV33 | L1 | 10 | 9 | ATVYLPPVPV | 22812 |
| HPV33 | L1 | 10 | 345 | CTQVTSDSTY | 22813 |
| HPV33 | L1 | 9 | 351 | DSTYKNENF | 22814 |
| HPV33 | L1 | 8 | 129 | DTETGNKY | 22815 |
| HPV33 | L1 | 9 | 202 | DTGFGCMDF | 22816 |
| HPV33 | L1 | 8 | 95 | DTQRLVWA | 22817 |
| HPV33 | L1 | 10 | 95 | DTQRLVWACV | 22818 |
| HPV33 | L1 | 8 | 335 | DTTRSTNM | 22819 |
| HPV33 | L1 | 10 | 335 | DTTRSTNMTL | 22820 |
| HPV33 | L1 | 10 | 415 | DTYRFVTSQA | 22821 |
| HPV33 | L1 | 11 | 415 | DTYRFVTSQAI | 22822 |
| HPV33 | L1 | 9 | 8 | EATVYLPPV | 22823 |
| HPV33 | L1 | 11 | 8 | EATVYLPPVPV | 22824 |
| HPV33 | L1 | 8 | 269 | EAVPDDLY | 22825 |
| HPV33 | L1 | 9 | 269 | EAVPDDLYI | 22826 |
| HPV33 | L1 | 9 | 303 | ESQLFNKPY | 22827 |
| HPV33 | L1 | 10 | 303 | ESQLFNKPYW | 22828 |
| HPV33 | L1 | 11 | 303 | ESQLFNKPYWL | 22829 |
| HPV33 | L1 | 8 | 454 | FSADLDQF | 22830 |
| HPV33 | L1 | 10 | 454 | FSADLDQFPL | 22831 |
| HPV33 | L1 | 9 | 50 | FSIKNPTNA | 22832 |
| HPV33 | L1 | 8 | 141 | GADNRECL | 22833 |
| HPV33 | L1 | 10 | 141 | GADNRECLSM | 22834 |
| HPV33 | L1 | 8 | 279 | GSGTTASI | 22835 |
| HPV33 | L1 | 10 | 297 | GSMVTSESQL | 22836 |
| HPV33 | L1 | 11 | 297 | GSMVTSESQLF | 22837 |
| HPV33 | L1 | 8 | 38 | GSSRLLAV | 22838 |
| HPV33 | L1 | 9 | 226 | GSTCKYPDY | 22839 |
| HPV33 | L1 | 10 | 226 | GSTCKYPDYL | 22840 |
| HPV33 | L1 | 11 | 265 | GTLGEAVPDDL | 22841 |
| HPV33 | L1 | 10 | 281 | GTTASIQSSA | 22842 |
| HPV33 | L1 | 11 | 281 | GTTASIQSSAF | 22843 |
| HPV33 | L1 | 8 | 391 | HAMNPDIL | 22844 |
| HPV33 | L1 | 11 | 391 | HAMNPDILEDW | 22845 |
| HPV33 | L1 | 10 | 118 | ISGHPLLNKF | 22846 |
| HPV33 | L1 | 9 | 474 | KAKPKLKRA | 22847 |
| HPV33 | L1 | 10 | 474 | KAKPKLKRAA | 22848 |
| HPV33 | L1 | 8 | 217 | KSDVPIDI | 22849 |
| HPV33 | L1 | 10 | 211 | KTLQANKSDV | 22850 |
| HPV33 | L1 | 8 | 43 | LAVGHPYF | 22851 |
| HPV33 | L1 | 10 | 43 | LAVGHPYFSI | 22852 |
| HPV33 | L1 | 10 | 148 | LSMDYKQTQL | 22853 |
| HPV33 | L1 | 8 | 382 | LTAEVMTY | 22854 |
| HPV33 | L1 | 9 | 382 | LTAEVMTYI | 22855 |
| HPV33 | L1 | 11 | 382 | LTAEVMTYIHA | 22856 |
| HPV33 | L1 | 9 | 405 | LTPPPSASL | 22857 |
| HPV33 | L1 | 9 | 1 | MSVWRPSEA | 22858 |
| HPV33 | L1 | 11 | 1 | MSVWRPSEATV | 22859 |
| HPV33 | L1 | 10 | 237 | MTSEPYGDSL | 22860 |
| HPV33 | L1 | 11 | 237 | MTSEPYGDSLF | 22861 |
| HPV33 | L1 | 11 | 387 | MTYIHAMNPDI | 22862 |
| HPV33 | L1 | 11 | 178 | NAAPANDCPPL | 22863 |
| HPV33 | L1 | 10 | 57 | NAKKLLVPKV | 22864 |
| HPV33 | L1 | 9 | 192 | NTIIEDGDM | 22865 |
| HPV33 | L1 | 10 | 192 | NTIIEDGDMV | 22866 |
| HPV33 | L1 | 8 | 181 | PANDCPPL | 22867 |
| HPV33 | L1 | 10 | 181 | PANDCPPLEL | 22868 |
| HPV33 | L1 | 11 | 181 | PANDCPPLELI | 22869 |
| HPV33 | L1 | 9 | 409 | PSASLQDTY | 22870 |
| HPV33 | L1 | 11 | 409 | PSASLQDTYRF | 22871 |
| HPV33 | L1 | 8 | 6 | PSEATVYL | 22872 |
| HPV33 | L1 | 11 | 6 | PSEATVYLPPV | 22873 |
| HPV33 | L1 | 10 | 165 | PTGEHWGKGV | 22874 |
| HPV33 | L1 | 11 | 165 | PTGEHWGKGVA | 22875 |

TABLE XIII-continued

B58 Supermotif Peptides

| Type | Protein | No. of Amino Acids | Position | Sequence | Seq. Id. No. |
|---|---|---|---|---|---|
| HPV33 | L1 | 8 | 55 | PTNAKKLL | 22876 |
| HPV33 | L1 | 9 | 55 | PTNAKKLLV | 22877 |
| HPV33 | L1 | 8 | 293 | PTPSGSMV | 22878 |
| HPV33 | L1 | 9 | 484 | PTSTRTSSA | 22879 |
| HPV33 | L1 | 10 | 470 | QAGLKAKPKL | 22880 |
| HPV33 | L1 | 9 | 423 | QAITCQKTV | 22881 |
| HPV33 | L1 | 9 | 214 | QANKSDVPI | 22882 |
| HPV33 | L1 | 11 | 214 | QANKSDVPIDI | 22883 |
| HPV33 | L1 | 8 | 263 | RAGTLGEA | 22884 |
| HPV33 | L1 | 9 | 263 | RAGTLGEAV | 22885 |
| HPV33 | L1 | 9 | 315 | RAQGHNNGI | 22886 |
| HPV33 | L1 | 11 | 315 | RAQGHNNGICW | 22887 |
| HPV33 | L1 | 11 | 338 | RSTNMTLCTQV | 22888 |
| HPV33 | L1 | 8 | 30 | RTSIYYYA | 22889 |
| HPV33 | L1 | 10 | 488 | RTSSAKRKKV | 22890 |
| HPV33 | L1 | 9 | 455 | SADLDQFPL | 22891 |
| HPV33 | L1 | 11 | 289 | SAFFPTPSGSM | 22892 |
| HPV33 | L1 | 8 | 410 | SASLQDTY | 22893 |
| HPV33 | L1 | 10 | 410 | SASLQDTYRF | 22894 |
| HPV33 | L1 | 11 | 410 | SASLQDTYRFV | 22895 |
| HPV33 | L1 | 8 | 490 | SSAKRKKV | 22896 |
| HPV33 | L1 | 11 | 39 | SSRLLAVGHPY | 22897 |
| HPV33 | L1 | 8 | 227 | STCKYPDY | 22898 |
| HPV33 | L1 | 9 | 227 | STCKYPDYL | 22899 |
| HPV33 | L1 | 11 | 227 | STCKYPDYLKM | 22900 |
| HPV33 | L1 | 11 | 23 | STDEYVSRTSI | 22901 |
| HPV33 | L1 | 10 | 339 | STNMTLCTQV | 22902 |
| HPV33 | L1 | 8 | 352 | STYKNENF | 22903 |
| HPV33 | L1 | 11 | 352 | STYKNENFKEY | 22904 |
| HPV33 | L1 | 8 | 383 | TAEVMTYI | 22905 |
| HPV33 | L1 | 10 | 383 | TAEVMTYIHA | 22906 |
| HPV33 | L1 | 11 | 383 | TAEVMTYIHAM | 22907 |
| HPV33 | L1 | 8 | 283 | TASIQSSA | 22908 |
| HPV33 | L1 | 9 | 283 | TASIQSSAF | 22909 |
| HPV33 | L1 | 10 | 283 | TASIQSSAFF | 22910 |
| HPV33 | L1 | 11 | 349 | TSDSTYKNENF | 22911 |
| HPV33 | L1 | 9 | 238 | TSEPYGDSL | 22912 |
| HPV33 | L1 | 10 | 238 | TSEPYGDSLF | 22913 |
| HPV33 | L1 | 11 | 238 | TSEPYGDSLFF | 22914 |
| HPV33 | L1 | 11 | 301 | TSESQLFNKPY | 22915 |
| HPV33 | L1 | 11 | 89 | TSFYNPDTQRL | 22916 |
| HPV33 | L1 | 11 | 421 | TSQAITCQKTV | 22917 |
| HPV33 | L1 | 9 | 489 | TSSAKRKKV | 22918 |
| HPV33 | L1 | 8 | 485 | TSTRTSSA | 22919 |
| HPV33 | L1 | 9 | 282 | TTASIQSSA | 22920 |
| HPV33 | L1 | 10 | 282 | TTASIQSSAF | 22921 |
| HPV33 | L1 | 11 | 282 | TTASIQSSAFF | 22922 |
| HPV33 | L1 | 9 | 336 | TTRSTNMTL | 22923 |
| HPV33 | L1 | 9 | 174 | VACTNAAPA | 22924 |
| HPV33 | L1 | 8 | 66 | VSGLQYRV | 22925 |
| HPV33 | L1 | 9 | 66 | VSGLQYRVF | 22926 |
| HPV33 | L1 | 11 | 66 | VSGLQYRVFRV | 22927 |
| HPV33 | L1 | 10 | 18 | VSKVVSTDEY | 22928 |
| HPV33 | L1 | 11 | 18 | VSKVVSTDEYV | 22929 |
| HPV33 | L1 | 8 | 28 | VSRTSIYY | 22930 |
| HPV33 | L1 | 9 | 28 | VSRTSIYYY | 22931 |
| HPV33 | L1 | 10 | 28 | VSRTSIYYYA | 22932 |
| HPV33 | L1 | 8 | 380 | VTLTAEVM | 22933 |
| HPV33 | L1 | 10 | 380 | VTLTAEVMTY | 22934 |
| HPV33 | L1 | 11 | 380 | VTLTAEVMTYI | 22935 |
| HPV33 | L1 | 8 | 300 | VTSESQLF | 22936 |
| HPV33 | L1 | 8 | 101 | WACVGLEI | 22937 |
| HPV33 | L1 | 8 | 36 | YAGSSRLL | 22938 |
| HPV33 | L1 | 9 | 36 | YAGSSRLLA | 22939 |
| HPV33 | L1 | 10 | 36 | YAGSSRLLAV | 22940 |
| HPV33 | L1 | 8 | 443 | YTFWEVDL | 22941 |
| HPV33 | L2 | 8 | 81 | AAIPLQPI | 22942 |
| HPV33 | L2 | 9 | 23 | ATGTCPPDV | 22943 |
| HPV33 | L2 | 10 | 23 | ATGTCPPDVI | 22944 |
| HPV33 | L2 | 11 | 308 | ATLKTRSGKQI | 22945 |
| HPV33 | L2 | 10 | 14 | ATQLYQTCKA | 22946 |
| HPV33 | L2 | 8 | 385 | ATTRTSNV | 22947 |
| HPV33 | L2 | 10 | 385 | ATTRTSNVSI | 22948 |
| HPV33 | L2 | 8 | 101 | DSSIVSLI | 22949 |
| HPV33 | L2 | 11 | 206 | DSSNVTSSTPI | 22950 |
| HPV33 | L2 | 8 | 431 | DTIVVDGA | 22951 |

TABLE XIII-continued

B58 Supermotif Peptides

| Type | Protein | No. of Amino Acids | Position | Sequence | Seq. Id. No. |
|---|---|---|---|---|---|
| HPV33 | L2 | 10 | 431 | DTIVVDGADF | 22952 |
| HPV33 | L2 | 11 | 431 | DTIVVDGADFV | 22953 |
| HPV33 | L2 | 10 | 264 | DTLQFQHSDI | 22954 |
| HPV33 | L2 | 10 | 401 | DTPVMSGPDI | 22955 |
| HPV33 | L2 | 9 | 350 | DTSTSSYSI | 22956 |
| HPV33 | L2 | 9 | 136 | DTTPAIINV | 22957 |
| HPV33 | L2 | 10 | 95 | DTVGPLDSSI | 22958 |
| HPV33 | L2 | 11 | 95 | DTVGPLDSSIV | 22959 |
| HPV33 | L2 | 9 | 115 | EAGAPAPSI | 22960 |
| HPV33 | L2 | 8 | 176 | EASGHFIF | 22961 |
| HPV33 | L2 | 9 | 258 | ESFDPEDTL | 22962 |
| HPV33 | L2 | 11 | 258 | ESFDPEDTLQF | 22963 |
| HPV33 | L2 | 11 | 149 | ESSIQTISTHL | 22964 |
| HPV33 | L2 | 9 | 110 | ETSFIEAGA | 22965 |
| HPV33 | L2 | 11 | 110 | ETSFIEAGAPA | 22966 |
| HPV33 | L2 | 9 | 384 | FATTRTSNV | 22967 |
| HPV33 | L2 | 11 | 384 | FATTRTSNVSI | 22968 |
| HPV33 | L2 | 8 | 301 | FSRVGQKA | 22969 |
| HPV33 | L2 | 10 | 301 | FSRVGQKATL | 22970 |
| HPV33 | L2 | 11 | 183 | FSSPTVSTQSY | 22971 |
| HPV33 | L2 | 8 | 460 | FTDVRVAA | 22972 |
| HPV33 | L2 | 11 | 163 | FTEPSVLHPPA | 22973 |
| HPV33 | L2 | 10 | 437 | GADFVLHPSY | 22974 |
| HPV33 | L2 | 11 | 437 | GADFVLHPSYF | 22975 |
| HPV33 | L2 | 10 | 319 | GARIHYYQDL | 22976 |
| HPV33 | L2 | 8 | 64 | GSGGRTGY | 22977 |
| HPV33 | L2 | 9 | 64 | GSGGRTGYV | 22978 |
| HPV33 | L2 | 11 | 64 | GSGGRTGYVPI | 22979 |
| HPV33 | L2 | 10 | 62 | GSGSGGRTGY | 22980 |
| HPV33 | L2 | 11 | 62 | GSGSGGRTGYV | 22981 |
| HPV33 | L2 | 10 | 48 | GSLGVFFGGL | 22982 |
| HPV33 | L2 | 8 | 218 | GSRPVARL | 22983 |
| HPV33 | L2 | 10 | 218 | GSRPVARLGL | 22984 |
| HPV33 | L2 | 11 | 218 | GSRPVARLGLY | 22985 |
| HPV33 | L2 | 8 | 37 | GSTIADQI | 22986 |
| HPV33 | L2 | 9 | 37 | GSTIADQIL | 22987 |
| HPV33 | L2 | 11 | 37 | GSTIADQILKY | 22988 |
| HPV33 | L2 | 8 | 25 | GTCPPDVI | 22989 |
| HPV33 | L2 | 11 | 25 | GTCPPDVIPKV | 22990 |
| HPV33 | L2 | 8 | 75 | GTDPPTAA | 22991 |
| HPV33 | L2 | 9 | 75 | GTDPPTAAI | 22992 |
| HPV33 | L2 | 11 | 75 | GTDPPTAAIPL | 22993 |
| HPV33 | L2 | 8 | 374 | HTPMQHSY | 22994 |
| HPV33 | L2 | 11 | 374 | HTPMQHSYSTF | 22995 |
| HPV33 | L2 | 8 | 336 | HTVPNEQY | 22996 |
| HPV33 | L2 | 10 | 336 | HTVPNEQYEL | 22997 |
| HPV33 | L2 | 8 | 297 | HTVRFSRV | 22998 |
| HPV33 | L2 | 8 | 40 | IADQILKY | 22999 |
| HPV33 | L2 | 11 | 40 | IADQILKYGSL | 23000 |
| HPV33 | L2 | 8 | 285 | IALHRPAI | 23001 |
| HPV33 | L2 | 9 | 273 | ISPAPDPDF | 23002 |
| HPV33 | L2 | 10 | 273 | ISPAPDPDFL | 23003 |
| HPV33 | L2 | 10 | 424 | ISPFFPFDTI | 23004 |
| HPV33 | L2 | 11 | 424 | ISPFFPFDTIV | 23005 |
| HPV33 | L2 | 9 | 155 | ISTHLNPTF | 23006 |
| HPV33 | L2 | 8 | 292 | ITSRRHTV | 23007 |
| HPV33 | L2 | 10 | 292 | ITSRRHTVRF | 23008 |
| HPV33 | L2 | 8 | 250 | ITYDNPAF | 23009 |
| HPV33 | L2 | 11 | 250 | ITYDNPAFESF | 23010 |
| HPV33 | L2 | 10 | 22 | KATGTCPPDV | 23011 |
| HPV33 | L2 | 11 | 22 | KATGTCPPDVI | 23012 |
| HPV33 | L2 | 8 | 311 | KTRSGKQI | 23013 |
| HPV33 | L2 | 10 | 311 | KTRSGKQIGA | 23014 |
| HPV33 | L2 | 11 | 328 | LSPIVPLDHTV | 23015 |
| HPV33 | L2 | 8 | 243 | LTSPHKLI | 23016 |
| HPV33 | L2 | 10 | 243 | LTSPHKLITY | 23017 |
| HPV33 | L2 | 10 | 405 | MSGPDIPSPL | 23018 |
| HPV33 | L2 | 11 | 405 | MSGPDIPSPLF | 23019 |
| HPV33 | L2 | 8 | 397 | NTGFDTPV | 23020 |
| HPV33 | L2 | 9 | 397 | NTGFDTPVM | 23021 |
| HPV33 | L2 | 8 | 231 | NTQQVKVV | 23022 |
| HPV33 | L2 | 11 | 231 | NTQQVKVVDPA | 23023 |
| HPV33 | L2 | 8 | 174 | PAEASGHF | 23024 |
| HPV33 | L2 | 9 | 174 | PAEASGHFI | 23025 |
| HPV33 | L2 | 10 | 174 | PAEASGHFIF | 23026 |
| HPV33 | L2 | 10 | 240 | PAFLTSPHKL | 23027 |

TABLE XIII-continued

B58 Supermotif Peptides

| Type | Protein | No. of Amino Acids | Position | Sequence | Seq. Id. No. |
|---|---|---|---|---|---|
| HPV33 | L2 | 11 | 240 | PAFLTSPHKLI | 23028 |
| HPV33 | L2 | 9 | 139 | PAIINVSSV | 23029 |
| HPV33 | L2 | 10 | 290 | PAITSRRHTV | 23030 |
| HPV33 | L2 | 10 | 172 | PAPAEASGHF | 23031 |
| HPV33 | L2 | 11 | 172 | PAPAEASGHFI | 23032 |
| HPV33 | L2 | 8 | 275 | PAPDPDFL | 23033 |
| HPV33 | L2 | 10 | 275 | PAPDPDFLDI | 23034 |
| HPV33 | L2 | 11 | 275 | PAPDPDFLDII | 23035 |
| HPV33 | L2 | 11 | 119 | PAPSIPTPSGF | 23036 |
| HPV33 | L2 | 10 | 126 | PSGFDVTTSA | 23037 |
| HPV33 | L2 | 9 | 121 | PSIPTPSGF | 23038 |
| HPV33 | L2 | 11 | 121 | PSIPTPSGFDV | 23039 |
| HPV33 | L2 | 11 | 411 | PSPLFPTSSPF | 23040 |
| HPV33 | L2 | 8 | 166 | PSVLHPPA | 23041 |
| HPV33 | L2 | 10 | 166 | PSVLHPPAPA | 23042 |
| HPV33 | L2 | 10 | 79 | PTAAIPLQPI | 23043 |
| HPV33 | L2 | 8 | 161 | PTFTEPSV | 23044 |
| HPV33 | L2 | 9 | 161 | PTFTEPSVL | 23045 |
| HPV33 | L2 | 8 | 124 | PTPSGFDV | 23046 |
| HPV33 | L2 | 9 | 416 | PTSSPFVPI | 23047 |
| HPV33 | L2 | 8 | 186 | PTVSTQSY | 23048 |
| HPV33 | L2 | 11 | 186 | PTVSTQSYENI | 23049 |
| HPV33 | L2 | 8 | 191 | QSYENIPM | 23050 |
| HPV33 | L2 | 11 | 191 | QSYENIPMDTF | 23051 |
| HPV33 | L2 | 11 | 153 | QTISTHLNPTF | 23052 |
| HPV33 | L2 | 8 | 11 | RASATQLY | 23053 |
| HPV33 | L2 | 8 | 313 | RSGKQIGA | 23054 |
| HPV33 | L2 | 10 | 313 | RSGKQIGARI | 23055 |
| HPV33 | L2 | 8 | 5 | RSTRRKRA | 23056 |
| HPV33 | L2 | 10 | 5 | RSTRRKRASA | 23057 |
| HPV33 | L2 | 9 | 388 | RTSNVSIPL | 23058 |
| HPV33 | L2 | 8 | 134 | SADTTPAI | 23059 |
| HPV33 | L2 | 9 | 134 | SADTTPAII | 23060 |
| HPV33 | L2 | 11 | 134 | SADTTPAIINV | 23061 |
| HPV33 | L2 | 11 | 13 | SATQLYQTCKA | 23062 |
| HPV33 | L2 | 10 | 150 | SSIQTISTHL | 23063 |
| HPV33 | L2 | 10 | 207 | SSNVTSSTPI | 23064 |
| HPV33 | L2 | 10 | 418 | SSPFVPISPF | 23065 |
| HPV33 | L2 | 11 | 418 | SSPFVPISPFF | 23066 |
| HPV33 | L2 | 10 | 184 | SSPTVSTQSY | 23067 |
| HPV33 | L2 | 11 | 212 | SSTPIPGSRPV | 23068 |
| HPV33 | L2 | 8 | 145 | SSVGESSI | 23069 |
| HPV33 | L2 | 11 | 145 | SSVGESSIQTI | 23070 |
| HPV33 | L2 | 9 | 354 | SSYSINDGL | 23071 |
| HPV33 | L2 | 10 | 354 | SSYSINDGLY | 23072 |
| HPV33 | L2 | 11 | 382 | STFATTRTSNV | 23073 |
| HPV33 | L2 | 8 | 156 | STHLNPTF | 23074 |
| HPV33 | L2 | 8 | 38 | STIADQIL | 23075 |
| HPV33 | L2 | 10 | 38 | STIADQILKY | 23076 |
| HPV33 | L2 | 10 | 213 | STPIPGSRPV | 23077 |
| HPV33 | L2 | 11 | 213 | STPIPGSRPVA | 23078 |
| HPV33 | L2 | 8 | 189 | STQSYENI | 23079 |
| HPV33 | L2 | 10 | 189 | STQSYENIPM | 23080 |
| HPV33 | L2 | 9 | 6 | STRRKRASA | 23081 |
| HPV33 | L2 | 11 | 352 | STSSYSINDGL | 23082 |
| HPV33 | L2 | 9 | 80 | TAAIPLQPI | 23083 |
| HPV33 | L2 | 8 | 133 | TSADTTPA | 23084 |
| HPV33 | L2 | 9 | 133 | TSADTTPAI | 23085 |
| HPV33 | L2 | 10 | 133 | TSADTTPAII | 23086 |
| HPV33 | L2 | 8 | 111 | TSFIEAGA | 23087 |
| HPV33 | L2 | 10 | 111 | TSFIEAGAPA | 23088 |
| HPV33 | L2 | 8 | 389 | TSNVSIPL | 23089 |
| HPV33 | L2 | 9 | 244 | TSPHKLITY | 23090 |
| HPV33 | L2 | 9 | 293 | TSRRHTVRF | 23091 |
| HPV33 | L2 | 8 | 417 | TSSPFVPI | 23092 |
| HPV33 | L2 | 11 | 417 | TSSPFVPISPF | 23093 |
| HPV33 | L2 | 10 | 353 | TSSYSINDGL | 23094 |
| HPV33 | L2 | 11 | 353 | TSSYSINDGLY | 23095 |
| HPV33 | L2 | 8 | 351 | TSTSSYSI | 23096 |
| HPV33 | L2 | 8 | 137 | TTPAIINV | 23097 |
| HPV33 | L2 | 11 | 137 | TTPAIINVSSV | 23098 |
| HPV33 | L2 | 9 | 386 | TTRTSNVSI | 23099 |
| HPV33 | L2 | 11 | 386 | TTRTSNVSIPL | 23100 |
| HPV33 | L2 | 9 | 132 | TTSADTTPA | 23101 |
| HPV33 | L2 | 10 | 132 | TTSADTTPAI | 23102 |
| HPV33 | L2 | 11 | 132 | TTSADTTPAII | 23103 |

TABLE XIII-continued

B58 Supermotif Peptides

| Type | Protein | No. of Amino Acids | Position | Sequence | Seq. Id. No. |
|---|---|---|---|---|---|
| HPV33 | L2 | 9 | 392 | VSIPLNTGF | 23104 |
| HPV33 | L2 | 9 | 105 | VSLIEETSF | 23105 |
| HPV33 | L2 | 10 | 105 | VSLIEETSFI | 23106 |
| HPV33 | L2 | 9 | 144 | VSSVGESSI | 23107 |
| HPV33 | L2 | 8 | 203 | VSTDSSNV | 23108 |
| HPV33 | L2 | 9 | 188 | VSTQSYENI | 23109 |
| HPV33 | L2 | 11 | 188 | VSTQSYENIPM | 23110 |
| HPV33 | L2 | 10 | 131 | VTTSADTTPA | 23111 |
| HPV33 | L2 | 11 | 131 | VTTSADTTPAI | 23112 |
| HPV33 | L2 | 9 | 92 | VTVDTVGPL | 23113 |
| HPV33 | L2 | 8 | 366 | YADDVDNV | 23114 |
| HPV33 | L2 | 8 | 356 | YSINDGLY | 23115 |
| HPV33 | L2 | 10 | 356 | YSINDGLYDV | 23116 |
| HPV33 | L2 | 11 | 356 | YSINDGLYDVY | 23117 |
| HPV33 | L2 | 8 | 228 | YSRNTQQV | 23118 |
| HPV33 | L2 | 10 | 228 | YSRNTQQVKV | 23119 |
| HPV33 | L2 | 11 | 228 | YSRNTQQVKVV | 23120 |
| HPV45 | E1 | 11 | 382 | AAAFLKSNCQA | 23121 |
| HPV45 | E1 | 8 | 144 | AAETQVTV | 23122 |
| HPV45 | E1 | 10 | 383 | AAFLKSNCQA | 23123 |
| HPV45 | E1 | 10 | 310 | AALYWYRTGI | 23124 |
| HPV45 | E1 | 10 | 198 | AAMLAVFKDI | 23125 |
| HPV45 | E1 | 11 | 198 | AAMLAVFKDIY | 23126 |
| HPV45 | E1 | 8 | 193 | ASNKKAAM | 23127 |
| HPV45 | E1 | 9 | 193 | ASNKKAAML | 23128 |
| HPV45 | E1 | 10 | 193 | ASNKKAAMLA | 23129 |
| HPV45 | E1 | 11 | 193 | ASNKKAAMLAV | 23130 |
| HPV45 | E1 | 8 | 40 | ATDTGSDM | 23131 |
| HPV45 | E1 | 9 | 40 | ATDTGSDMV | 23132 |
| HPV45 | E1 | 11 | 40 | ATDTGSDMVDF | 23133 |
| HPV45 | E1 | 8 | 517 | ATHTCWTY | 23134 |
| HPV45 | E1 | 9 | 517 | ATHTCWTYF | 23135 |
| HPV45 | E1 | 10 | 251 | ATLYAHIQCL | 23136 |
| HPV45 | E1 | 8 | 398 | CAVMCRHY | 23137 |
| HPV45 | E1 | 11 | 398 | CAVMCRHYKRA | 23138 |
| HPV45 | E1 | 11 | 139 | CSEVEAAETQV | 23139 |
| HPV45 | E1 | 9 | 182 | CSITELKEL | 23140 |
| HPV45 | E1 | 10 | 182 | CSITELKELL | 23141 |
| HPV45 | E1 | 10 | 423 | CSKIDEGGDW | 23142 |
| HPV45 | E1 | 8 | 226 | CTDWVMAI | 23143 |
| HPV45 | E1 | 9 | 226 | CTDWVMAIF | 23144 |
| HPV45 | E1 | 11 | 226 | CTDWVMAIFGV | 23145 |
| HPV45 | E1 | 9 | 621 | DADTEGIPF | 23146 |
| HPV45 | E1 | 8 | 78 | DAQVLHLL | 23147 |
| HPV45 | E1 | 9 | 516 | DATHTCWTY | 23148 |
| HPV45 | E1 | 10 | 516 | DATHTCWTYF | 23149 |
| HPV45 | E1 | 9 | 134 | DSGYGCSEV | 23150 |
| HPV45 | E1 | 11 | 134 | DSGYGCSEVEA | 23151 |
| HPV45 | E1 | 9 | 345 | DSNFDLSDM | 23152 |
| HPV45 | E1 | 10 | 345 | DSNFDLSDMV | 23153 |
| HPV45 | E1 | 9 | 170 | DSSDNAENV | 23154 |
| HPV45 | E1 | 8 | 106 | DTDLSPRL | 23155 |
| HPV45 | E1 | 11 | 106 | DTDLSPRLQEI | 23156 |
| HPV45 | E1 | 10 | 623 | DTEGIPFGTF | 23157 |
| HPV45 | E1 | 9 | 42 | DTGSDMVDF | 23158 |
| HPV45 | E1 | 10 | 42 | DTGSDMVDFI | 23159 |
| HPV45 | E1 | 10 | 508 | DTKVAMLDDA | 23160 |
| HPV45 | E1 | 9 | 328 | DTPEWIQRL | 23161 |
| HPV45 | E1 | 11 | 328 | DTPEWIQRLTI | 23162 |
| HPV45 | E1 | 10 | 52 | DTQLSICEQA | 23163 |
| HPV45 | E1 | 9 | 143 | EAAETQVTV | 23164 |
| HPV45 | E1 | 8 | 365 | ESDMAFQY | 23165 |
| HPV45 | E1 | 9 | 365 | ESDMAFQYA | 23166 |
| HPV45 | E1 | 11 | 365 | ESDMAFQYAQL | 23167 |
| HPV45 | E1 | 9 | 573 | ESRVTVFTF | 23168 |
| HPV45 | E1 | 9 | 64 | ETAQALFHA | 23169 |
| HPV45 | E1 | 10 | 38 | ETATDTGSDM | 23170 |
| HPV45 | E1 | 11 | 38 | ETATDTGSDMV | 23171 |
| HPV45 | E1 | 11 | 295 | ETCMLIEPPKL | 23172 |
| HPV45 | E1 | 11 | 21 | ETIVEKKTGDV | 23173 |
| HPV45 | E1 | 10 | 146 | ETQVTVNTNA | 23174 |
| HPV45 | E1 | 11 | 89 | FAGGSKENSPL | 23175 |
| HPV45 | E1 | 8 | 212 | FTDLVRNF | 23176 |
| HPV45 | E1 | 9 | 579 | FTFPHAFPF | 23177 |
| HPV45 | E1 | 8 | 130 | FTISDSGY | 23178 |
| HPV45 | E1 | 8 | 44 | GSDMVDFI | 23179 |

TABLE XIII-continued

B58 Supermotif Peptides

| Type | Protein | No. of Amino Acids | Position | Sequence | Seq. Id. No. |
|---|---|---|---|---|---|
| HPV45 | E1 | 8 | 92 | GSKENSPL | 23180 |
| HPV45 | E1 | 8 | 11 | GTGCNGWF | 23181 |
| HPV45 | E1 | 9 | 11 | GTGCNGWFF | 23182 |
| HPV45 | E1 | 10 | 11 | GTGCNGWFFV | 23183 |
| HPV45 | E1 | 8 | 459 | GTPKKNCI | 23184 |
| HPV45 | E1 | 9 | 459 | GTPKKNCIL | 23185 |
| HPV45 | E1 | 10 | 459 | GTPKKNCILL | 23186 |
| HPV45 | E1 | 11 | 459 | GTPKKNCILLY | 23187 |
| HPV45 | E1 | 9 | 71 | HAQEVQNDA | 23188 |
| HPV45 | E1 | 11 | 71 | HAQEVQNDAQV | 23189 |
| HPV45 | E1 | 10 | 519 | HTCWTYFDNY | 23190 |
| HPV45 | E1 | 11 | 519 | HTCWTYFDNYM | 23191 |
| HPV45 | E1 | 9 | 32 | ISDDEDETA | 23192 |
| HPV45 | E1 | 11 | 132 | ISDSGYGCSEV | 23193 |
| HPV45 | E1 | 11 | 322 | ISEVSGDTPEW | 23194 |
| HPV45 | E1 | 10 | 447 | ISFLRALKEF | 23195 |
| HPV45 | E1 | 11 | 447 | ISFLRALKEFL | 23196 |
| HPV45 | E1 | 10 | 492 | ISFVNSNSHF | 23197 |
| HPV45 | E1 | 11 | 492 | ISFVNSNSHFW | 23198 |
| HPV45 | E1 | 10 | 538 | ISIDRKHKPL | 23199 |
| HPV45 | E1 | 11 | 538 | ISIDRKHKPLL | 23200 |
| HPV45 | E1 | 10 | 116 | ISLNSGHKKA | 23201 |
| HPV45 | E1 | 8 | 184 | ITELKELL | 23202 |
| HPV45 | E1 | 10 | 184 | ITELKELLQA | 23203 |
| HPV45 | E1 | 8 | 197 | KAAMLAVF | 23204 |
| HPV45 | E1 | 11 | 197 | KAAMLAVFKDI | 23205 |
| HPV45 | E1 | 9 | 124 | KAKRRLFTI | 23206 |
| HPV45 | E1 | 10 | 220 | KSDKTTCTDW | 23207 |
| HPV45 | E1 | 11 | 220 | KSDKTTCTDWV | 23208 |
| HPV45 | E1 | 8 | 387 | KSNCQAKY | 23209 |
| HPV45 | E1 | 9 | 387 | KSNCQAKYL | 23210 |
| HPV45 | E1 | 8 | 476 | KSYFGMSF | 23211 |
| HPV45 | E1 | 9 | 476 | KSYFGMSFI | 23212 |
| HPV45 | E1 | 11 | 476 | KSYFGMSFIHF | 23213 |
| HPV45 | E1 | 9 | 245 | KTLIKPATL | 23214 |
| HPV45 | E1 | 10 | 245 | KTLIKPATLY | 23215 |
| HPV45 | E1 | 11 | 245 | KTLIKPATLYA | 23216 |
| HPV45 | E1 | 8 | 223 | KTTCTDWV | 23217 |
| HPV45 | E1 | 9 | 223 | KTTCTDWVM | 23218 |
| HPV45 | E1 | 10 | 223 | KTTCTDWVMA | 23219 |
| HPV45 | E1 | 11 | 223 | KTTCTDWVMAI | 23220 |
| HPV45 | E1 | 8 | 375 | LADCNSNA | 23221 |
| HPV45 | E1 | 9 | 375 | LADCNSNAA | 23222 |
| HPV45 | E1 | 10 | 375 | LADCNSNAAA | 23223 |
| HPV45 | E1 | 11 | 375 | LADCNSNAAAF | 23224 |
| HPV45 | E1 | 8 | 506 | LADTKVAM | 23225 |
| HPV45 | E1 | 9 | 506 | LADTKVAML | 23226 |
| HPV45 | E1 | 8 | 201 | LAVFKDIY | 23227 |
| HPV45 | E1 | 10 | 201 | LAVFKDIYGL | 23228 |
| HPV45 | E1 | 8 | 350 | LSDMVQWA | 23229 |
| HPV45 | E1 | 9 | 350 | LSDMVQWAF | 23230 |
| HPV45 | E1 | 10 | 210 | LSFTDLVRNF | 23231 |
| HPV45 | E1 | 8 | 109 | LSPRLQEI | 23232 |
| HPV45 | E1 | 10 | 109 | LSPRLQEISL | 23233 |
| HPV45 | E1 | 11 | 103 | LSVDTDLSPRL | 23234 |
| HPV45 | E1 | 8 | 362 | LTDESDMA | 23235 |
| HPV45 | E1 | 9 | 362 | LTDESDMAF | 23236 |
| HPV45 | E1 | 11 | 362 | LTDESDMAFQY | 23237 |
| HPV45 | E1 | 8 | 336 | LTIIQHGI | 23238 |
| HPV45 | E1 | 8 | 557 | LTSNIDPA | 23239 |
| HPV45 | E1 | 10 | 281 | LTVAKGLSTL | 23240 |
| HPV45 | E1 | 11 | 281 | LTVAKGLSTLL | 23241 |
| HPV45 | E1 | 8 | 368 | MAFQYAQL | 23242 |
| HPV45 | E1 | 9 | 368 | MAFQYAQLA | 23243 |
| HPV45 | E1 | 10 | 231 | MAIFGVNPTV | 23244 |
| HPV45 | E1 | 11 | 231 | MAIFGVNPTVA | 23245 |
| HPV45 | E1 | 10 | 481 | MSFIHFLQGA | 23246 |
| HPV45 | E1 | 11 | 481 | MSFIHFLQGAI | 23247 |
| HPV45 | E1 | 8 | 154 | NAENGGSV | 23248 |
| HPV45 | E1 | 11 | 174 | NAENVDPHCSI | 23249 |
| HPV45 | E1 | 8 | 531 | NALDGNPI | 23250 |
| HPV45 | E1 | 10 | 531 | NALDGNPISI | 23251 |
| HPV45 | E1 | 11 | 119 | NSGHKKAKRRL | 23252 |
| HPV45 | E1 | 9 | 498 | NSHFWLEPL | 23253 |
| HPV45 | E1 | 10 | 498 | NSHFWLEPLA | 23254 |
| HPV45 | E1 | 8 | 376 | NSNAAAFL | 23255 |

TABLE XIII-continued

B58 Supermotif Peptides

| Type | Protein | No. of Amino Acids | Position | Sequence | Seq. Id. No. |
|---|---|---|---|---|---|
| HPV45 | E1 | 8 | 496 | NSNSHFWL | 23256 |
| HPV45 | E1 | 11 | 496 | NSNSHFWLEPL | 23257 |
| HPV45 | E1 | 8 | 96 | NSPLGEQL | 23258 |
| HPV45 | E1 | 10 | 96 | NSPLGEQLSV | 23259 |
| HPV45 | E1 | 9 | 473 | NTGKSYFGM | 23260 |
| HPV45 | E1 | 11 | 473 | NTGKSYFGMSF | 23261 |
| HPV45 | E1 | 10 | 152 | NTNAENGGSV | 23262 |
| HPV45 | E1 | 9 | 563 | PAKDNKWPY | 23263 |
| HPV45 | E1 | 10 | 563 | PAKDNKWPYL | 23264 |
| HPV45 | E1 | 8 | 471 | PANTGKSY | 23265 |
| HPV45 | E1 | 9 | 471 | PANTGKSYF | 23266 |
| HPV45 | E1 | 11 | 471 | PANTGKSYFGM | 23267 |
| HPV45 | E1 | 8 | 250 | PATLYAHI | 23268 |
| HPV45 | E1 | 11 | 250 | PATLYAHIQCL | 23269 |
| HPV45 | E1 | 10 | 238 | PTVAEGFKTL | 23270 |
| HPV45 | E1 | 11 | 238 | PTVAEGFKTLI | 23271 |
| HPV45 | E1 | 9 | 60 | QAEQETAQA | 23272 |
| HPV45 | E1 | 10 | 60 | QAEQETAQAL | 23273 |
| HPV45 | E1 | 11 | 60 | QAEQETAQALF | 23274 |
| HPV45 | E1 | 9 | 391 | QAKYLKDCA | 23275 |
| HPV45 | E1 | 10 | 391 | QAKYLKDCAV | 23276 |
| HPV45 | E1 | 11 | 391 | QAKYLKDCAVM | 23277 |
| HPV45 | E1 | 9 | 67 | QALFHAQEV | 23278 |
| HPV45 | E1 | 8 | 192 | QASNKKAA | 23279 |
| HPV45 | E1 | 9 | 192 | QASNKKAAM | 23280 |
| HPV45 | E1 | 10 | 192 | QASNKKAAML | 23281 |
| HPV45 | E1 | 11 | 192 | QASNKKAAMLA | 23282 |
| HPV45 | E1 | 11 | 165 | QSSGGDSSDNA | 23283 |
| HPV45 | E1 | 9 | 407 | RAQKRQMNM | 23284 |
| HPV45 | E1 | 8 | 306 | RSSVAALY | 23285 |
| HPV45 | E1 | 9 | 306 | RSSVAALYW | 23286 |
| HPV45 | E1 | 10 | 306 | RSSVAALYWY | 23287 |
| HPV45 | E1 | 10 | 316 | RTGISNISEV | 23288 |
| HPV45 | E1 | 8 | 608 | RTWSRLDL | 23289 |
| HPV45 | E1 | 8 | 171 | SSDNAENV | 23290 |
| HPV45 | E1 | 10 | 166 | SSGGDSSDNA | 23291 |
| HPV45 | E1 | 8 | 307 | SSVAALYW | 23292 |
| HPV45 | E1 | 9 | 307 | SSVAALYWY | 23293 |
| HPV45 | E1 | 11 | 288 | STLLHVPETCM | 23294 |
| HPV45 | E1 | 8 | 65 | TAQALFHA | 23295 |
| HPV45 | E1 | 11 | 65 | TAQALFHAQEV | 23296 |
| HPV45 | E1 | 9 | 39 | TATDTGSDM | 23297 |
| HPV45 | E1 | 10 | 39 | TATDTGSDMV | 23298 |
| HPV45 | E1 | 8 | 224 | TTCTDWVM | 23299 |
| HPV45 | E1 | 9 | 224 | TTCTDWVMA | 23300 |
| HPV45 | E1 | 10 | 224 | TTCTDWVMAI | 23301 |
| HPV45 | E1 | 11 | 224 | TTCTDWVMAIF | 23302 |
| HPV45 | E1 | 11 | 309 | VAALYWYRTGI | 23303 |
| HPV45 | E1 | 8 | 240 | VAEGFKTL | 23304 |
| HPV45 | E1 | 9 | 240 | VAEGFKTLI | 23305 |
| HPV45 | E1 | 8 | 283 | VAKGLSTL | 23306 |
| HPV45 | E1 | 9 | 283 | VAKGLSTLL | 23307 |
| HPV45 | E1 | 11 | 283 | VAKGLSTLLHV | 23308 |
| HPV45 | E1 | 8 | 325 | VSGDTPEW | 23309 |
| HPV45 | E1 | 9 | 325 | VSGDTPEWI | 23310 |
| HPV45 | E1 | 9 | 635 | VTGQNTRPL | 23311 |
| HPV45 | E1 | 9 | 576 | VTVFTFPHA | 23312 |
| HPV45 | E1 | 10 | 576 | VTVFTFPHAF | 23313 |
| HPV45 | E1 | 8 | 522 | WTYFDNYM | 23314 |
| HPV45 | E1 | 11 | 522 | WTYFDNYMRNA | 23315 |
| HPV45 | E1 | 11 | 254 | YAHIQCLDCKW | 23316 |
| HPV45 | E1 | 11 | 372 | YAQLADCNSNA | 23317 |
| HPV45 | E2 | 9 | 156 | AACVSYWGV | 23318 |
| HPV45 | E2 | 10 | 156 | AACVSYWGVY | 23319 |
| HPV45 | E2 | 11 | 156 | AACVSYWGVYY | 23320 |
| HPV45 | E2 | 9 | 226 | ASTSTPKTA | 23321 |
| HPV45 | E2 | 11 | 226 | ASTSTPKTASV | 23322 |
| HPV45 | E2 | 10 | 234 | ASVGTPKPHI | 23323 |
| HPV45 | E2 | 10 | 247 | ATKRPRQCGL | 23324 |
| HPV45 | E2 | 8 | 216 | ATQIVRQL | 23325 |
| HPV45 | E2 | 11 | 216 | ATQIVRQLQHA | 23326 |
| HPV45 | E2 | 8 | 286 | CSGNTTPI | 23327 |
| HPV45 | E2 | 9 | 286 | CSGNTTPII | 23328 |
| HPV45 | E2 | 11 | 286 | CSGNTTPIIHL | 23329 |
| HPV45 | E2 | 8 | 207 | CSTSDDTV | 23330 |
| HPV45 | E2 | 10 | 207 | CSTSDDTVSA | 23331 |

TABLE XIII-continued

B58 Supermotif Peptides

| Type | Protein | No. of Amino Acids | Position | Sequence | Seq. Id. No. |
|---|---|---|---|---|---|
| HPV45 | E2 | 11 | 141 | DSIYYITETGI | 23332 |
| HPV45 | E2 | 9 | 28 | DSKDINSQI | 23333 |
| HPV45 | E2 | 11 | 28 | DSKDINSQISY | 23334 |
| HPV45 | E2 | 11 | 204 | DSMCSTSDDTV | 23335 |
| HPV45 | E2 | 8 | 171 | DTTYYVQF | 23336 |
| HPV45 | E2 | 8 | 212 | DTVSATQI | 23337 |
| HPV45 | E2 | 9 | 212 | DTVSATQIV | 23338 |
| HPV45 | E2 | 9 | 8 | ESLSERLSA | 23339 |
| HPV45 | E2 | 10 | 8 | ESLSERLSAL | 23340 |
| HPV45 | E2 | 9 | 148 | ETGIWDKTA | 23341 |
| HPV45 | E2 | 10 | 148 | ETGIWDKTAA | 23342 |
| HPV45 | E2 | 8 | 50 | FTAREHGI | 23343 |
| HPV45 | E2 | 11 | 50 | FTAREHGITKL | 23344 |
| HPV45 | E2 | 11 | 237 | GTPKPHIQTPA | 23345 |
| HPV45 | E2 | 10 | 225 | HASTSTPKTA | 23346 |
| HPV45 | E2 | 9 | 70 | ISKSKAHKA | 23347 |
| HPV45 | E2 | 10 | 70 | ISKSKAHKAI | 23348 |
| HPV45 | E2 | 8 | 361 | ISVGYMTI | 23349 |
| HPV45 | E2 | 9 | 36 | ISYWQLIRL | 23350 |
| HPV45 | E2 | 11 | 146 | ITETGIWDKTA | 23351 |
| HPV45 | E2 | 8 | 57 | ITKLNHQV | 23352 |
| HPV45 | E2 | 9 | 57 | ITKLNHQVV | 23353 |
| HPV45 | E2 | 8 | 74 | KAHKAIEL | 23354 |
| HPV45 | E2 | 10 | 74 | KAHKAIELQM | 23355 |
| HPV45 | E2 | 11 | 74 | KAHKAIELQMA | 23356 |
| HPV45 | E2 | 8 | 77 | KAIELQMA | 23357 |
| HPV45 | E2 | 9 | 77 | KAIELQMAL | 23358 |
| HPV45 | E2 | 8 | 72 | KSKAHKAI | 23359 |
| HPV45 | E2 | 10 | 72 | KSKAHKAIEL | 23360 |
| HPV45 | E2 | 8 | 154 | KTAACVSY | 23361 |
| HPV45 | E2 | 9 | 154 | KTAACVSYW | 23362 |
| HPV45 | E2 | 11 | 154 | KTAACVSYWGV | 23363 |
| HPV45 | E2 | 11 | 88 | LAQSKYNNEEW | 23364 |
| HPV45 | E2 | 8 | 14 | LSALQDKI | 23365 |
| HPV45 | E2 | 9 | 14 | LSALQDKIL | 23366 |
| HPV45 | E2 | 8 | 10 | LSERLSAL | 23367 |
| HPV45 | E2 | 9 | 256 | LTEQHHGRV | 23368 |
| HPV45 | E2 | 9 | 336 | LTVTYNSEV | 23369 |
| HPV45 | E2 | 11 | 83 | MALKGLAQSKY | 23370 |
| HPV45 | E2 | 9 | 341 | NSEVQRNTF | 23371 |
| HPV45 | E2 | 10 | 341 | NSEVQRNTFL | 23372 |
| HPV45 | E2 | 8 | 301 | NSLKCLRY | 23373 |
| HPV45 | E2 | 10 | 301 | NSLKCLRYRL | 23374 |
| HPV45 | E2 | 9 | 187 | NSNTWEVQY | 23375 |
| HPV45 | E2 | 9 | 33 | NSQISYWQL | 23376 |
| HPV45 | E2 | 10 | 33 | NSQISYWQLI | 23377 |
| HPV45 | E2 | 9 | 357 | NSVQISVGY | 23378 |
| HPV45 | E2 | 10 | 357 | NSVQISVGYM | 23379 |
| HPV45 | E2 | 8 | 109 | NTEPSQCF | 23380 |
| HPV45 | E2 | 9 | 347 | NTFLDVVTI | 23381 |
| HPV45 | E2 | 9 | 332 | NTGILTVTY | 23382 |
| HPV45 | E2 | 8 | 265 | NTHVHNPL | 23383 |
| HPV45 | E2 | 9 | 265 | NTHVHNPLL | 23384 |
| HPV45 | E2 | 8 | 289 | NTTPIIHL | 23385 |
| HPV45 | E2 | 11 | 189 | NTWEVQYGGNV | 23386 |
| HPV45 | E2 | 11 | 246 | PATKRPRQCGL | 23387 |
| HPV45 | E2 | 9 | 90 | QSKYNNEEW | 23388 |
| HPV45 | E2 | 11 | 90 | QSKYNNEEWTL | 23389 |
| HPV45 | E2 | 11 | 4 | QTPKESLSERL | 23390 |
| HPV45 | E2 | 8 | 15 | SALQDKIL | 23391 |
| HPV45 | E2 | 11 | 15 | SALQDKILDHY | 23392 |
| HPV45 | E2 | 9 | 215 | SATQIVRQL | 23393 |
| HPV45 | E2 | 11 | 275 | SSTSNNKRRKV | 23394 |
| HPV45 | E2 | 8 | 229 | STPKTASV | 23395 |
| HPV45 | E2 | 9 | 208 | STSDDTVSA | 23396 |
| HPV45 | E2 | 10 | 276 | STSNNKRRKV | 23397 |
| HPV45 | E2 | 8 | 227 | STSTPKTA | 23398 |
| HPV45 | E2 | 10 | 227 | STSTPKTASV | 23399 |
| HPV45 | E2 | 8 | 155 | TAACVSYW | 23400 |
| HPV45 | E2 | 10 | 155 | TAACVSYWGV | 23401 |
| HPV45 | E2 | 11 | 155 | TAACVSYWGVY | 23402 |
| HPV45 | E2 | 10 | 51 | TAREHGITKL | 23403 |
| HPV45 | E2 | 11 | 233 | TASVGTPKPHI | 23404 |
| HPV45 | E2 | 8 | 209 | TSDDTVSA | 23405 |
| HPV45 | E2 | 11 | 209 | TSDDTVSATQI | 23406 |
| HPV45 | E2 | 9 | 277 | TSNNKRRKV | 23407 |

TABLE XIII-continued

B58 Supermotif Peptides

| Type | Protein | No. of Amino Acids | Position | Sequence | Seq. Id. No. |
|---|---|---|---|---|---|
| HPV45 | E2 | 9 | 228 | TSTPKTASV | 23408 |
| HPV45 | E2 | 10 | 214 | VSATQIVRQL | 23409 |
| HPV45 | E2 | 8 | 159 | VSYWGVYY | 23410 |
| HPV45 | E2 | 9 | 159 | VSYWGVYYI | 23411 |
| HPV45 | E2 | 9 | 353 | VTIPNSVQI | 23412 |
| HPV45 | E2 | 11 | 353 | VTIPNSVQISV | 23413 |
| HPV45 | E2 | 10 | 326 | WTGCNKNTGI | 23414 |
| HPV45 | E2 | 11 | 326 | WTGCNKNTGIL | 23415 |
| HPV45 | E2 | 10 | 98 | WTLQDTCEEL | 23416 |
| HPV45 | E2 | 11 | 98 | WTLQDTCEELW | 23417 |
| HPV45 | E2 | 8 | 313 | YADHYSEI | 23418 |
| HPV45 | E2 | 8 | 317 | YSEISSTW | 23419 |
| HPV45 | E2 | 10 | 317 | YSEISSTWHW | 23420 |
| HPV45 | E6 | 9 | 63 | AACHKCIDF | 23421 |
| HPV45 | E6 | 10 | 63 | AACHKCIDFY | 23422 |
| HPV45 | E6 | 8 | 37 | ATLERTEV | 23423 |
| HPV45 | E6 | 9 | 37 | ATLERTEVY | 23424 |
| HPV45 | E6 | 11 | 37 | ATLERTEVYQF | 23425 |
| HPV45 | E6 | 8 | 18 | CTELNTSL | 23426 |
| HPV45 | E6 | 11 | 18 | CTELNTSLQDV | 23427 |
| HPV45 | E6 | 11 | 88 | ETLEKITNTEL | 23428 |
| HPV45 | E6 | 8 | 47 | FAFKDLFI | 23429 |
| HPV45 | E6 | 9 | 47 | FAFKDLFIV | 23430 |
| HPV45 | E6 | 10 | 47 | FAFKDLFIVY | 23431 |
| HPV45 | E6 | 8 | 30 | IACVYCKA | 23432 |
| HPV45 | E6 | 10 | 30 | IACVYCKATL | 23433 |
| HPV45 | E6 | 10 | 60 | IAYAACHKCI | 23434 |
| HPV45 | E6 | 9 | 93 | ITNTELYNL | 23435 |
| HPV45 | E6 | 10 | 93 | ITNTELYNLL | 23436 |
| HPV45 | E6 | 11 | 93 | ITNTELYNLLI | 23437 |
| HPV45 | E6 | 9 | 36 | KATLERTEV | 23438 |
| HPV45 | E6 | 10 | 36 | KATLERTEVY | 23439 |
| HPV45 | E6 | 8 | 83 | NSVYGETL | 23440 |
| HPV45 | E6 | 11 | 83 | NSVYGETLEKI | 23441 |
| HPV45 | E6 | 8 | 95 | NTELYNLL | 23442 |
| HPV45 | E6 | 9 | 95 | NTELYNLLI | 23443 |
| HPV45 | E6 | 9 | 22 | NTSLQDVSI | 23444 |
| HPV45 | E6 | 10 | 22 | NTSLQDVSIA | 23445 |
| HPV45 | E6 | 8 | 114 | PAEKRRHL | 23446 |
| HPV45 | E6 | 8 | 7 | PTQRPYKL | 23447 |
| HPV45 | E6 | 11 | 7 | PTQRPYKLPDL | 23448 |
| HPV45 | E6 | 8 | 41 | RTEVYQFA | 23449 |
| HPV45 | E6 | 9 | 41 | RTEVYQFAF | 23450 |
| HPV45 | E6 | 8 | 23 | TSLQDVSI | 23451 |
| HPV45 | E6 | 9 | 23 | TSLQDVSIA | 23452 |
| HPV45 | E6 | 11 | 23 | TSLQDVSIACV | 23453 |
| HPV45 | E6 | 10 | 28 | VSIACVYCKA | 23454 |
| HPV45 | E6 | 8 | 62 | YAACHKCI | 23455 |
| HPV45 | E6 | 10 | 62 | YAACHKCIDF | 23456 |
| HPV45 | E6 | 11 | 62 | YAACHKCIDFY | 23457 |
| HPV45 | E6 | 10 | 81 | YSNSVYGETL | 23458 |
| HPV45 | E6 | 9 | 72 | YSRIRELRY | 23459 |
| HPV45 | E6 | 10 | 72 | YSRIRELRYY | 23460 |
| HPV45 | E7 | 8 | 6 | ATLQEIVL | 23461 |
| HPV45 | E7 | 10 | 6 | ATLQEIVLHL | 23462 |
| HPV45 | E7 | 8 | 41 | EADGVSHA | 23463 |
| HPV45 | E7 | 10 | 41 | EADGVSHAQL | 23464 |
| HPV45 | E7 | 9 | 34 | ESEEENDEA | 23465 |
| HPV45 | E7 | 10 | 78 | ESSADDLRTL | 23466 |
| HPV45 | E7 | 9 | 47 | HAQLPARRA | 23467 |
| HPV45 | E7 | 11 | 32 | LSESEEENDEA | 23468 |
| HPV45 | E7 | 9 | 95 | LSFVCPWCA | 23469 |
| HPV45 | E7 | 10 | 92 | LSTLSFVCPW | 23470 |
| HPV45 | E7 | 10 | 75 | LTVESSADDL | 23471 |
| HPV45 | E7 | 9 | 54 | RAEPQRHKI | 23472 |
| HPV45 | E7 | 10 | 54 | RAEPQRHKIL | 23473 |
| HPV45 | E7 | 8 | 5 | RATLQEIV | 23474 |
| HPV45 | E7 | 9 | 5 | RATLQEIVL | 23475 |
| HPV45 | E7 | 11 | 5 | RATLQEIVLHL | 23476 |
| HPV45 | E7 | 8 | 85 | RTLQQLFL | 23477 |
| HPV45 | E7 | 11 | 85 | RTLQQLFLSTL | 23478 |
| HPV45 | E7 | 8 | 80 | SADDLRTL | 23479 |
| HPV45 | E7 | 11 | 80 | SADDLRTLQQL | 23480 |
| HPV45 | E7 | 9 | 79 | SSADDLRTL | 23481 |
| HPV45 | E7 | 9 | 93 | STLSFVCPW | 23482 |
| HPV45 | E7 | 11 | 93 | STLSFVCPWCA | 23483 |

TABLE XIII-continued

B58 Supermotif Peptides

| Type | Protein | No. of Amino Acids | Position | Sequence | Seq. Id. No. |
|---|---|---|---|---|---|
| HPV45 | E7 | 8 | 45 | VSHAQLPA | 23484 |
| HPV45 | E7 | 11 | 45 | VSHAQLPARRA | 23485 |
| HPV45 | L1 | 11 | 517 | AASTSTASRPA | 23486 |
| HPV45 | L1 | 10 | 161 | AATAVITQDV | 23487 |
| HPV45 | L1 | 8 | 523 | ASRPAKRV | 23488 |
| HPV45 | L1 | 10 | 523 | ASRPAKRVRI | 23489 |
| HPV45 | L1 | 11 | 375 | ASTQNPVPNTY | 23490 |
| HPV45 | L1 | 10 | 518 | ASTSTASRPA | 23491 |
| HPV45 | L1 | 9 | 162 | ATAVITQDV | 23492 |
| HPV45 | L1 | 8 | 374 | CASTQNPV | 23493 |
| HPV45 | L1 | 9 | 409 | CTITLTAEV | 23494 |
| HPV45 | L1 | 10 | 409 | CTITLTAEVM | 23495 |
| HPV45 | L1 | 9 | 332 | DSQLFNKPY | 23496 |
| HPV45 | L1 | 10 | 332 | DSQLFNKPYW | 23497 |
| HPV45 | L1 | 11 | 332 | DSQLFNKPYWL | 23498 |
| HPV45 | L1 | 11 | 34 | DSTVYLPPPSV | 23499 |
| HPV45 | L1 | 8 | 155 | DTESAHAA | 23500 |
| HPV45 | L1 | 10 | 155 | DTESAHAATA | 23501 |
| HPV45 | L1 | 11 | 155 | DTESAHAATAV | 23502 |
| HPV45 | L1 | 9 | 229 | DTGYGAMDF | 23503 |
| HPV45 | L1 | 8 | 242 | DTKCEVPL | 23504 |
| HPV45 | L1 | 10 | 242 | DTKCEVPLDI | 23505 |
| HPV45 | L1 | 11 | 461 | DTTPPEKQDPY | 23506 |
| HPV45 | L1 | 8 | 364 | DTTRSTNL | 23507 |
| HPV45 | L1 | 10 | 364 | DTTRSTNLTL | 23508 |
| HPV45 | L1 | 8 | 296 | DTVPTDLY | 23509 |
| HPV45 | L1 | 9 | 296 | DTVPTDLYI | 23510 |
| HPV45 | L1 | 9 | 446 | DTYRFVQSV | 23511 |
| HPV45 | L1 | 10 | 446 | DTYRFVQSVA | 23512 |
| HPV45 | L1 | 11 | 446 | DTYRFVQSVAV | 23513 |
| HPV45 | L1 | 8 | 157 | ESAHAATA | 23514 |
| HPV45 | L1 | 9 | 157 | ESAHAATAV | 23515 |
| HPV45 | L1 | 10 | 157 | ESAHAATAVI | 23516 |
| HPV45 | L1 | 8 | 313 | ETPGSCVY | 23517 |
| HPV45 | L1 | 8 | 121 | ETQRLVWA | 23518 |
| HPV45 | L1 | 10 | 121 | ETQRLVWACV | 23519 |
| HPV45 | L1 | 9 | 283 | FARHFWNRA | 23520 |
| HPV45 | L1 | 11 | 283 | FARHFWNRAGV | 23521 |
| HPV45 | L1 | 8 | 485 | FSSDLDQY | 23522 |
| HPV45 | L1 | 10 | 485 | FSSDLDQYPL | 23523 |
| HPV45 | L1 | 11 | 237 | FSTLQDTKCEV | 23524 |
| HPV45 | L1 | 8 | 82 | GAGNKQAV | 23525 |
| HPV45 | L1 | 11 | 82 | GAGNKQAVPKV | 23526 |
| HPV45 | L1 | 8 | 233 | GAMDFSTL | 23527 |
| HPV45 | L1 | 10 | 326 | GSITTSDSQL | 23528 |
| HPV45 | L1 | 11 | 326 | GSITTSDSQLF | 23529 |
| HPV45 | L1 | 8 | 64 | GSSRLLTV | 23530 |
| HPV45 | L1 | 9 | 199 | GTLCKPAQL | 23531 |
| HPV45 | L1 | 11 | 160 | HAATAVITQDV | 23532 |
| HPV45 | L1 | 8 | 62 | HAGSSRLL | 23533 |
| HPV45 | L1 | 10 | 62 | HAGSSRLLTV | 23534 |
| HPV45 | L1 | 8 | 422 | HSMNSSIL | 23535 |
| HPV45 | L1 | 11 | 422 | HSMNSSILENW | 23536 |
| HPV45 | L1 | 8 | 411 | ITLTAEVM | 23537 |
| HPV45 | L1 | 10 | 411 | ITLTAEVMSY | 23538 |
| HPV45 | L1 | 11 | 411 | ITLTAEVMSYI | 23539 |
| HPV45 | L1 | 9 | 166 | ITQDVRDNV | 23540 |
| HPV45 | L1 | 11 | 166 | ITQDVRDNVSV | 23541 |
| HPV45 | L1 | 8 | 328 | ITTSDSQL | 23542 |
| HPV45 | L1 | 9 | 328 | ITTSDSQLF | 23543 |
| HPV45 | L1 | 9 | 344 | KAQGHNNGI | 23544 |
| HPV45 | L1 | 11 | 344 | KAQGHNNGICW | 23545 |
| HPV45 | L1 | 10 | 144 | LSGHPFYNKL | 23546 |
| HPV45 | L1 | 8 | 413 | LTAEVMSY | 23547 |
| HPV45 | L1 | 9 | 413 | LTAEVMSYI | 23548 |
| HPV45 | L1 | 11 | 371 | LTLCASTQNPV | 23549 |
| HPV45 | L1 | 8 | 69 | LTVGNPYF | 23550 |
| HPV45 | L1 | 10 | 69 | LTVGNPYFRV | 23551 |
| HPV45 | L1 | 11 | 69 | LTVGNPYFRVV | 23552 |
| HPV45 | L1 | 11 | 1 | MAHNIIYGHGI | 23553 |
| HPV45 | L1 | 11 | 27 | MALWRPSDSTV | 23554 |
| HPV45 | L1 | 10 | 264 | MSADPYGDSM | 23555 |
| HPV45 | L1 | 11 | 264 | MSADPYGDSMF | 23556 |
| HPV45 | L1 | 11 | 418 | MSYIHSMNSSI | 23557 |
| HPV45 | L1 | 8 | 425 | NSSILENW | 23558 |
| HPV45 | L1 | 10 | 425 | NSSILENWNF | 23559 |

TABLE XIII-continued

B58 Supermotif Peptides

| Type | Protein | No. of Amino Acids | Position | Sequence | Seq. Id. No. |
|---|---|---|---|---|---|
| HPV45 | L1 | 11 | 49 | NTDDYVSRTSI | 23560 |
| HPV45 | L1 | 9 | 219 | NTIIEDGDM | 23561 |
| HPV45 | L1 | 10 | 219 | NTIIEDGDMV | 23562 |
| HPV45 | L1 | 8 | 383 | NTYDPTKF | 23563 |
| HPV45 | L1 | 11 | 383 | NTYDPTKFHY | 23564 |
| HPV45 | L1 | 8 | 516 | PAASTSTA | 23565 |
| HPV45 | L1 | 8 | 190 | PAIGEHWA | 23566 |
| HPV45 | L1 | 8 | 32 | PSDSTVYL | 23567 |
| HPV45 | L1 | 9 | 80 | PSGAGNKQA | 23568 |
| HPV45 | L1 | 10 | 80 | PSGAGNKQAV | 23569 |
| HPV45 | L1 | 11 | 299 | PTDLYIKGTSA | 23570 |
| HPV45 | L1 | 10 | 508 | PTIGPRKRPA | 23571 |
| HPV45 | L1 | 11 | 508 | PTIGPRKRPAA | 23572 |
| HPV45 | L1 | 11 | 387 | PTKFKHYSRHV | 23573 |
| HPV45 | L1 | 9 | 440 | PTTSLVDTY | 23574 |
| HPV45 | L1 | 11 | 440 | PTTSLVDTYRF | 23575 |
| HPV45 | L1 | 10 | 501 | QAGLRRRPTI | 23576 |
| HPV45 | L1 | 8 | 87 | QAVPKVSA | 23577 |
| HPV45 | L1 | 9 | 87 | QAVPKVSAY | 23578 |
| HPV45 | L1 | 11 | 87 | QAVPKVSAYQY | 23579 |
| HPV45 | L1 | 9 | 253 | QSICKYPDY | 23580 |
| HPV45 | L1 | 10 | 253 | QSICKYPDYL | 23581 |
| HPV45 | L1 | 10 | 180 | QTQLCILGCV | 23582 |
| HPV45 | L1 | 9 | 290 | RAGVMGDTV | 23583 |
| HPV45 | L1 | 9 | 367 | RSTNLTLCA | 23584 |
| HPV45 | L1 | 8 | 56 | RTSIFYHA | 23585 |
| HPV45 | L1 | 9 | 265 | SADPYGDSM | 23586 |
| HPV45 | L1 | 10 | 265 | SADPYGDSMF | 23587 |
| HPV45 | L1 | 11 | 265 | SADPYGDSMFF | 23588 |
| HPV45 | L1 | 8 | 158 | SAHAATAV | 23589 |
| HPV45 | L1 | 9 | 158 | SAHAATAVI | 23590 |
| HPV45 | L1 | 8 | 93 | SAYQYRVF | 23591 |
| HPV45 | L1 | 10 | 93 | SAYQYRVFRV | 23592 |
| HPV45 | L1 | 11 | 93 | SAYQYRVFRVA | 23593 |
| HPV45 | L1 | 9 | 486 | SSDLDQYPL | 23594 |
| HPV45 | L1 | 9 | 426 | SSILENWNF | 23595 |
| HPV45 | L1 | 11 | 426 | SSILENWNFGV | 23596 |
| HPV45 | L1 | 11 | 65 | SSRLLTVGNPY | 23597 |
| HPV45 | L1 | 10 | 521 | STASRPAKRV | 23598 |
| HPV45 | L1 | 11 | 115 | STIYNPETQRL | 23599 |
| HPV45 | L1 | 10 | 238 | STLQDTKCEV | 23600 |
| HPV45 | L1 | 8 | 368 | STNLTLCA | 23601 |
| HPV45 | L1 | 10 | 376 | STQNPVPNTY | 23602 |
| HPV45 | L1 | 9 | 519 | STSTASRPA | 23603 |
| HPV45 | L1 | 10 | 35 | STVYLPPPSV | 23604 |
| HPV45 | L1 | 11 | 35 | STVYLPPPSVA | 23605 |
| HPV45 | L1 | 8 | 414 | TAEVMSYI | 23606 |
| HPV45 | L1 | 11 | 414 | TAEVMSYIHSM | 23607 |
| HPV45 | L1 | 9 | 522 | TASRPAKRV | 23608 |
| HPV45 | L1 | 11 | 522 | TASRPAKRVRI | 23609 |
| HPV45 | L1 | 8 | 163 | TAVITQDV | 23610 |
| HPV45 | L1 | 11 | 330 | ISDSQLFNKPY | 23611 |
| HPV45 | L1 | 9 | 442 | TSLVDTYRF | 23612 |
| HPV45 | L1 | 10 | 442 | TSLVDTYRFV | 23613 |
| HPV45 | L1 | 8 | 520 | TSTASRPA | 23614 |
| HPV45 | L1 | 11 | 520 | TSTASRPAKRV | 23615 |
| HPV45 | L1 | 10 | 462 | TTPPEKQDPY | 23616 |
| HPV45 | L1 | 9 | 365 | TTRSTNLTL | 23617 |
| HPV45 | L1 | 11 | 365 | TTRSTNLTLCA | 23618 |
| HPV45 | L1 | 8 | 329 | TTSDSQLF | 23619 |
| HPV45 | L1 | 8 | 441 | TTSLVDTY | 23620 |
| HPV45 | L1 | 10 | 441 | TTSLVDTYRF | 23621 |
| HPV45 | L1 | 11 | 441 | TTSLVDTYRFV | 23622 |
| HPV45 | L1 | 9 | 102 | VALPDPNKF | 23623 |
| HPV45 | L1 | 11 | 102 | VALPDPNKFGL | 23624 |
| HPV45 | L1 | 10 | 44 | VARVVNTDDY | 23625 |
| HPV45 | L1 | 11 | 44 | VARVVNTDDYV | 23626 |
| HPV45 | L1 | 8 | 92 | VSAYQYRV | 23627 |
| HPV45 | L1 | 9 | 92 | VSAYQYRVF | 23628 |
| HPV45 | L1 | 11 | 92 | VSAYQYRVFRV | 23629 |
| HPV45 | L1 | 8 | 54 | VSRTSIFY | 23630 |
| HPV45 | L1 | 10 | 54 | VSRTSIFYHA | 23631 |
| HPV45 | L1 | 10 | 174 | VSVDYKQTQL | 23632 |
| HPV45 | L1 | 8 | 127 | WACVGMEI | 23633 |
| HPV45 | L1 | 10 | 196 | WAKGTLCKPA | 23634 |
| HPV45 | L1 | 9 | 477 | WTVDLKEKF | 23635 |

TABLE XIII-continued

B58 Supermotif Peptides

| Type | Protein | No. of Amino Acids | Position | Sequence | Seq. Id. No. |
|---|---|---|---|---|---|
| HPV45 | L1 | 9 | 320 | YSPSPSGSI | 23636 |
| HPV45 | L1 | 8 | 393 | YSRHVEEY | 23637 |
| HPV45 | L1 | 10 | 393 | YSRHVEEYDL | 23638 |
| HPV45 | L2 | 9 | 6 | AARRKRASA | 23639 |
| HPV45 | L2 | 8 | 381 | AASSYSNV | 23640 |
| HPV45 | L2 | 10 | 381 | AASSYSNVTV | 23641 |
| HPV45 | L2 | 8 | 327 | AATEEIEL | 23642 |
| HPV45 | L2 | 11 | 327 | AATEEIELQPL | 23643 |
| HPV45 | L2 | 9 | 114 | ASGAPVPTF | 23644 |
| HPV45 | L2 | 10 | 201 | ASSGSGTEPI | 23645 |
| HPV45 | L2 | 9 | 382 | ASSYSNVTV | 23646 |
| HPV45 | L2 | 11 | 382 | ASSYSNVTVPL | 23647 |
| HPV45 | L2 | 8 | 357 | ASTTPSTI | 23648 |
| HPV45 | L2 | 9 | 423 | ASTTTYIGI | 23649 |
| HPV45 | L2 | 10 | 328 | ATEEIELQPL | 23650 |
| HPV45 | L2 | 11 | 328 | ATEEIELQPLI | 23651 |
| HPV45 | L2 | 11 | 303 | ATMFTRSGKQI | 23652 |
| HPV45 | L2 | 8 | 340 | ATNDSDLF | 23653 |
| HPV45 | L2 | 10 | 340 | ATNDSDLFDV | 23654 |
| HPV45 | L2 | 11 | 340 | ATNDSDLFDVY | 23655 |
| HPV45 | L2 | 8 | 273 | DSDFMDII | 23656 |
| HPV45 | L2 | 10 | 273 | DSDFMDIIRL | 23657 |
| HPV45 | L2 | 8 | 343 | DSDLFDVY | 23658 |
| HPV45 | L2 | 9 | 343 | DSDLFDVYA | 23659 |
| HPV45 | L2 | 11 | 343 | DSDLFDVYADF | 23660 |
| HPV45 | L2 | 9 | 109 | DSSVVASGA | 23661 |
| HPV45 | L2 | 11 | 109 | DSSVVASGAPV | 23662 |
| HPV45 | L2 | 10 | 148 | DSVSISSTSF | 23663 |
| HPV45 | L2 | 8 | 456 | FADGFVAA | 23664 |
| HPV45 | L2 | 11 | 200 | FASSGSGTEPI | 23665 |
| HPV45 | L2 | 9 | 162 | FSDPSIIEV | 23666 |
| HPV45 | L2 | 8 | 296 | FSRLGQRA | 23667 |
| HPV45 | L2 | 10 | 296 | FSRLGQRATM | 23668 |
| HPV45 | L2 | 11 | 296 | FSRLGQRATMF | 23669 |
| HPV45 | L2 | 9 | 122 | FTGTSGFEI | 23670 |
| HPV45 | L2 | 11 | 157 | FTNPAFSDPSI | 23671 |
| HPV45 | L2 | 8 | 306 | FTRSGKQI | 23672 |
| HPV45 | L2 | 8 | 368 | FTYPKYSL | 23673 |
| HPV45 | L2 | 10 | 368 | FTYPKYSLTM | 23674 |
| HPV45 | L2 | 8 | 64 | GSGGRTGY | 23675 |
| HPV45 | L2 | 9 | 64 | GSGGRTGYV | 23676 |
| HPV45 | L2 | 11 | 64 | GSGGRTGYVPL | 23677 |
| HPV45 | L2 | 10 | 62 | GSGSGGRTGY | 23678 |
| HPV45 | L2 | 11 | 62 | GSGSGGRTGYV | 23679 |
| HPV45 | L2 | 8 | 188 | GSHGYEEI | 23680 |
| HPV45 | L2 | 10 | 188 | GSHGYEEIPL | 23681 |
| HPV45 | L2 | 8 | 25 | GTCPPDVI | 23682 |
| HPV45 | L2 | 11 | 25 | GTCPPDVINKV | 23683 |
| HPV45 | L2 | 10 | 206 | GTEPISSTPL | 23684 |
| HPV45 | L2 | 10 | 183 | GTPTSGSHGY | 23685 |
| HPV45 | L2 | 9 | 433 | GTQYYLWPW | 23686 |
| HPV45 | L2 | 10 | 433 | GTQYYLWPWY | 23687 |
| HPV45 | L2 | 11 | 433 | GTQYYLWPWYY | 23688 |
| HPV45 | L2 | 8 | 37 | GTTLADKI | 23689 |
| HPV45 | L2 | 9 | 37 | GTTLADKIL | 23690 |
| HPV45 | L2 | 11 | 37 | GTTLADKILQW | 23691 |
| HPV45 | L2 | 8 | 134 | GTTTPAVL | 23692 |
| HPV45 | L2 | 10 | 134 | GTTTPAVLDI | 23693 |
| HPV45 | L2 | 8 | 292 | GTVRFSRL | 23694 |
| HPV45 | L2 | 9 | 326 | IAATEEIEL | 23695 |
| HPV45 | L2 | 9 | 338 | ISATNDSDL | 23696 |
| HPV45 | L2 | 10 | 338 | ISATNDSDLF | 23697 |
| HPV45 | L2 | 10 | 323 | ISPIAATEEI | 23698 |
| HPV45 | L2 | 9 | 210 | ISSTPLPTV | 23699 |
| HPV45 | L2 | 10 | 152 | ISSTSFTNPA | 23700 |
| HPV45 | L2 | 11 | 152 | ISSTSFTNPAF | 23701 |
| HPV45 | L2 | 8 | 143 | ITPTVDSV | 23702 |
| HPV45 | L2 | 10 | 143 | ITPTVDSVSI | 23703 |
| HPV45 | L2 | 10 | 130 | ITSSGTTTPA | 23704 |
| HPV45 | L2 | 11 | 130 | ITSSGTTTPAV | 23705 |
| HPV45 | L2 | 8 | 366 | KSFTYPKY | 23706 |
| HPV45 | L2 | 10 | 366 | KSFTYPKYSL | 23707 |
| HPV45 | L2 | 8 | 40 | LADKILQW | 23708 |
| HPV45 | L2 | 11 | 40 | LADKILQWSSL | 23709 |
| HPV45 | L2 | 9 | 263 | LSFEPTSNV | 23710 |
| HPV45 | L2 | 8 | 287 | LSSRRGTV | 23711 |

TABLE XIII-continued

B58 Supermotif Peptides

| Type | Protein | No. of Amino Acids | Position | Sequence | Seq. Id. No. |
|---|---|---|---|---|---|
| HPV45 | L2 | 10 | 287 | LSSRRGTVRF | 23712 |
| HPV45 | L2 | 8 | 242 | LTHPSSLV | 23713 |
| HPV45 | L2 | 10 | 242 | LTHPSSLVTF | 23714 |
| HPV45 | L2 | 8 | 375 | LTMPSTAA | 23715 |
| HPV45 | L2 | 11 | 375 | LTMPSTAASSY | 23716 |
| HPV45 | L2 | 9 | 392 | LTSAWDVPI | 23717 |
| HPV45 | L2 | 10 | 392 | LTSAWDVPIY | 23718 |
| HPV45 | L2 | 8 | 422 | NASTTTYI | 23719 |
| HPV45 | L2 | 10 | 422 | NASTTTYIGI | 23720 |
| HPV45 | L2 | 8 | 160 | PAFSDPSI | 23721 |
| HPV45 | L2 | 9 | 160 | PAFSDPSII | 23722 |
| HPV45 | L2 | 11 | 160 | PAFSDPSIIEV | 23723 |
| HPV45 | L2 | 10 | 285 | PALSSRRGTV | 23724 |
| HPV45 | L2 | 9 | 356 | PASTTPSTI | 23725 |
| HPV45 | L2 | 10 | 138 | PAVLDITPTV | 23726 |
| HPV45 | L2 | 10 | 254 | PAYEPLDTTL | 23727 |
| HPV45 | L2 | 11 | 245 | PSSLVTFDNPA | 23728 |
| HPV45 | L2 | 8 | 378 | PSTAASSY | 23729 |
| HPV45 | L2 | 11 | 378 | PSTAASSYSNV | 23730 |
| HPV45 | L2 | 8 | 361 | PSTIHKSF | 23731 |
| HPV45 | L2 | 10 | 361 | PSTIHKSFTY | 23732 |
| HPV45 | L2 | 8 | 416 | PSTSPTNA | 23733 |
| HPV45 | L2 | 9 | 98 | PTDPSIVTL | 23734 |
| HPV45 | L2 | 10 | 98 | PTDPSIVTLV | 23735 |
| HPV45 | L2 | 9 | 120 | PTFTGTSGF | 23736 |
| HPV45 | L2 | 11 | 120 | PTFTGTSGFEI | 23737 |
| HPV45 | L2 | 9 | 420 | PTNASTTTY | 23738 |
| HPV45 | L2 | 10 | 420 | PTNASTTTYI | 23739 |
| HPV45 | L2 | 8 | 86 | PTRPPVVI | 23740 |
| HPV45 | L2 | 11 | 86 | PTRPPVVIEPV | 23741 |
| HPV45 | L2 | 8 | 185 | PTSGSHGY | 23742 |
| HPV45 | L2 | 11 | 185 | PTSGSHGYEEI | 23743 |
| HPV45 | L2 | 10 | 267 | PTSNVPDSDF | 23744 |
| HPV45 | L2 | 11 | 267 | PTSNVPDSDFM | 23745 |
| HPV45 | L2 | 8 | 145 | PTVDSVSI | 23746 |
| HPV45 | L2 | 11 | 216 | PTVRRVRGPRL | 23747 |
| HPV45 | L2 | 9 | 23 | QSGTCPPDV | 23748 |
| HPV45 | L2 | 10 | 23 | QSGTCPPDVI | 23749 |
| HPV45 | L2 | 9 | 172 | QTGEVSGNI | 23750 |
| HPV45 | L2 | 10 | 172 | QTGEVSGNIF | 23751 |
| HPV45 | L2 | 11 | 172 | QTGEVSGNIFV | 23752 |
| HPV45 | L2 | 8 | 5 | RAARRKRA | 23753 |
| HPV45 | L2 | 10 | 5 | RAARRKRASA | 23754 |
| HPV45 | L2 | 8 | 229 | RANQQVRV | 23755 |
| HPV45 | L2 | 8 | 11 | RASATDLY | 23756 |
| HPV45 | L2 | 10 | 308 | RSGKQIGGRV | 23757 |
| HPV45 | L2 | 8 | 77 | RSNTVVDV | 23758 |
| HPV45 | L2 | 8 | 339 | SATNDSDL | 23759 |
| HPV45 | L2 | 9 | 339 | SATNDSDLF | 23760 |
| HPV45 | L2 | 11 | 339 | SATNDSDLFDV | 23761 |
| HPV45 | L2 | 8 | 394 | SAWDVPIY | 23762 |
| HPV45 | L2 | 9 | 202 | SSGSGTEPI | 23763 |
| HPV45 | L2 | 8 | 132 | SSGTTTPA | 23764 |
| HPV45 | L2 | 9 | 132 | SSGTTTPAV | 23765 |
| HPV45 | L2 | 10 | 132 | SSGTTTPAVL | 23766 |
| HPV45 | L2 | 10 | 48 | SSLGIFLGGL | 23767 |
| HPV45 | L2 | 10 | 246 | SSLVTFDNPA | 23768 |
| HPV45 | L2 | 11 | 246 | SSLVTFDNPAY | 23769 |
| HPV45 | L2 | 9 | 288 | SSRRGTVRF | 23770 |
| HPV45 | L2 | 8 | 211 | SSTPLPTV | 23771 |
| HPV45 | L2 | 11 | 211 | SSTPLPTVRRV | 23772 |
| HPV45 | L2 | 9 | 153 | SSTSFTNPA | 23773 |
| HPV45 | L2 | 10 | 153 | SSTSFTNPAF | 23774 |
| HPV45 | L2 | 8 | 110 | SSVVASGA | 23775 |
| HPV45 | L2 | 10 | 110 | SSVVASGAPV | 23776 |
| HPV45 | L2 | 8 | 383 | SSYSNVTV | 23777 |
| HPV45 | L2 | 10 | 383 | SSYSNVTVPL | 23778 |
| HPV45 | L2 | 10 | 379 | STAASSYSNV | 23779 |
| HPV45 | L2 | 9 | 362 | STIHKSFTY | 23780 |
| HPV45 | L2 | 10 | 212 | STPLPTVRRV | 23781 |
| HPV45 | L2 | 8 | 154 | STSFTNPA | 23782 |
| HPV45 | L2 | 9 | 154 | STSFTNPAF | 23783 |
| HPV45 | L2 | 11 | 358 | STTPSTIHKSF | 23784 |
| HPV45 | L2 | 8 | 424 | STTTYIGI | 23785 |
| HPV45 | L2 | 9 | 380 | TAASSYSNV | 23786 |
| HPV45 | L2 | 11 | 380 | TAASSYSNVTV | 23787 |

TABLE XIII-continued

B58 Supermotif Peptides

| Type | Protein | No. of Amino Acids | Position | Sequence | Seq. Id. No. |
|---|---|---|---|---|---|
| HPV45 | L2 | 8 | 393 | TSAWDVPI | 23788 |
| HPV45 | L2 | 9 | 393 | TSAWDVPIY | 23789 |
| HPV45 | L2 | 8 | 155 | TSFTNPAF | 23790 |
| HPV45 | L2 | 10 | 186 | TSGSHGYEEI | 23791 |
| HPV45 | L2 | 9 | 268 | TSNVPDSDF | 23792 |
| HPV45 | L2 | 10 | 268 | TSNVPDSDFM | 23793 |
| HPV45 | L2 | 11 | 418 | TSPTNASTTTY | 23794 |
| HPV45 | L2 | 11 | 238 | TSQFLTHPSSL | 23795 |
| HPV45 | L2 | 9 | 131 | TSSGTTTPA | 23796 |
| HPV45 | L2 | 10 | 131 | TSSGTTTPAV | 23797 |
| HPV45 | L2 | 11 | 131 | TSSGTTTPAVL | 23798 |
| HPV45 | L2 | 8 | 38 | TTLADKIL | 23799 |
| HPV45 | L2 | 10 | 38 | TTLADKILQW | 23800 |
| HPV45 | L2 | 11 | 261 | TTLSFEPTSNV | 23801 |
| HPV45 | L2 | 8 | 136 | TTPAVLDI | 23802 |
| HPV45 | L2 | 10 | 359 | TTPSTIHKSF | 23803 |
| HPV45 | L2 | 9 | 135 | TTTPAVLDI | 23804 |
| HPV45 | L2 | 11 | 426 | TTYIGIHGTQY | 23805 |
| HPV45 | L2 | 10 | 113 | VASGAPVPTF | 23806 |
| HPV45 | L2 | 11 | 2 | VSHRAARRKRA | 23807 |
| HPV45 | L2 | 8 | 150 | VSISSTSF | 23808 |
| HPV45 | L2 | 8 | 249 | VTFDNPAY | 23809 |
| HPV45 | L2 | 11 | 249 | VTFDNPAYEPL | 23810 |
| HPV45 | L2 | 9 | 104 | VTLVEDSSV | 23811 |
| HPV45 | L2 | 10 | 104 | VTLVEDSSVV | 23812 |
| HPV45 | L2 | 11 | 104 | VTLVEDSSVVA | 23813 |
| HPV45 | L2 | 8 | 388 | VTVPLTSA | 23814 |
| HPV45 | L2 | 9 | 388 | VTVPLTSAW | 23815 |
| HPV45 | L2 | 11 | 388 | VTVPLTSAWDV | 23816 |
| HPV45 | L2 | 8 | 47 | WSSLGIFL | 23817 |
| HPV45 | L2 | 11 | 47 | WSSLGIFLGGL | 23818 |
| HPV45 | L2 | 8 | 350 | YADFPPPA | 23819 |
| HPV45 | L2 | 9 | 373 | YSLTMPSTA | 23820 |
| HPV45 | L2 | 10 | 373 | YSLTMPSTAA | 23821 |
| HPV45 | L2 | 8 | 385 | YSNVTVPL | 23822 |
| HPV45 | L2 | 11 | 385 | YSNVTVPLTSA | 23823 |
| HPV45 | L2 | 8 | 227 | YSRANQQV | 23824 |
| HPV45 | L2 | 10 | 227 | YSRANQQVRV | 23825 |
| HPV45 | L2 | 8 | 401 | YTGPDIIL | 23826 |
| HPV56 | E2 | 8 | 13 | CSAIEVQI | 23827 |
| HPV56 | E2 | 9 | 13 | CSAIEVQIA | 23828 |
| HPV56 | E2 | 10 | 13 | CSAIEVQIAL | 23829 |
| HPV56 | E2 | 9 | 92 | CSGVDYRGI | 23830 |
| HPV56 | E2 | 10 | 92 | CSGVDYRGIY | 23831 |
| HPV56 | E2 | 11 | 92 | CSGVDYRGIYY | 23832 |
| HPV56 | E2 | 8 | 195 | DSSRESHA | 23833 |
| HPV56 | E2 | 11 | 195 | DSSRESHAKCV | 23834 |
| HPV56 | E2 | 9 | 140 | DSVSSTCRY | 23835 |
| HPV56 | E2 | 11 | 140 | DSVSSTCRYNV | 23836 |
| HPV56 | E2 | 8 | 39 | DTCEELWL | 23837 |
| HPV56 | E2 | 10 | 117 | EAKKFGCKNI | 23838 |
| HPV56 | E2 | 11 | 117 | EAKKFGCKNIW | 23839 |
| HPV56 | E2 | 9 | 134 | ESIYCPDSV | 23840 |
| HPV56 | E2 | 8 | 23 | ESLSTTIY | 23841 |
| HPV56 | E2 | 8 | 288 | ETQRNSFL | 23842 |
| HPV56 | E2 | 11 | 288 | ETQRNSFLSHV | 23843 |
| HPV56 | E2 | 9 | 66 | GSKNNCMQY | 23844 |
| HPV56 | E2 | 10 | 66 | GSKNNCMQYV | 23845 |
| HPV56 | E2 | 11 | 66 | GSKNNCMQYVA | 23846 |
| HPV56 | E2 | 11 | 201 | HAKCVTTHTHI | 23847 |
| HPV56 | E2 | 10 | 20 | IALESLSTTI | 23848 |
| HPV56 | E2 | 11 | 20 | IALESLSTTIY | 23849 |
| HPV56 | E2 | 8 | 11 | KACSAIEV | 23850 |
| HPV56 | E2 | 10 | 11 | KACSAIEVQI | 23851 |
| HPV56 | E2 | 11 | 11 | KACSAIEVQIA | 23852 |
| HPV56 | E2 | 8 | 9 | KAKACSAI | 23853 |
| HPV56 | E2 | 10 | 9 | KAKACSAIEV | 23854 |
| HPV56 | E2 | 11 | 258 | KTLFVDVTSTY | 23855 |
| HPV56 | E2 | 8 | 233 | KTTPVVHL | 23856 |
| HPV56 | E2 | 10 | 163 | KTTTTTSTSV | 23857 |
| HPV56 | E2 | 11 | 108 | KTYYTDFEQEA | 23858 |
| HPV56 | E2 | 8 | 295 | LSHVKIPV | 23859 |
| HPV56 | E2 | 9 | 295 | LSHVKIPVV | 23860 |
| HPV56 | E2 | 10 | 295 | LSHVKIPVVY | 23861 |
| HPV56 | E2 | 11 | 25 | LSTTIYNNEEW | 23862 |
| HPV56 | E2 | 8 | 46 | LTEPKKCF | 23863 |

TABLE XIII-continued

B58 Supermotif Peptides

| Type | Protein | No. of Amino Acids | Position | Sequence | Seq. Id. No. |
|---|---|---|---|---|---|
| HPV56 | E2 | 9 | 292 | NSFLSHVKI | 23864 |
| HPV56 | E2 | 11 | 292 | NSFLSHVKIPV | 23865 |
| HPV56 | E2 | 9 | 216 | NTDSRSRSI | 23866 |
| HPV56 | E2 | 8 | 14 | SAIEVQIA | 23867 |
| HPV56 | E2 | 9 | 14 | SAIEVQIAL | 23868 |
| HPV56 | E2 | 10 | 196 | SSRESHAKCV | 23869 |
| HPV56 | E2 | 8 | 143 | SSTCRYNV | 23870 |
| HPV56 | E2 | 11 | 143 | SSTCRYNVSPV | 23871 |
| HPV56 | E2 | 10 | 144 | STCRYNVSPV | 23872 |
| HPV56 | E2 | 9 | 272 | STDNKNYSI | 23873 |
| HPV56 | E2 | 10 | 272 | STDNKNYSII | 23874 |
| HPV56 | E2 | 9 | 169 | STSVGNQDA | 23875 |
| HPV56 | E2 | 10 | 169 | STSVGNQDAA | 23876 |
| HPV56 | E2 | 11 | 169 | STSVGNQDAAV | 23877 |
| HPV56 | E2 | 10 | 26 | STTIYNNEEW | 23878 |
| HPV56 | E2 | 8 | 271 | TSTDNKNY | 23879 |
| HPV56 | E2 | 10 | 271 | TSTDNKNYSI | 23880 |
| HPV56 | E2 | 11 | 271 | TSTDNKNYSII | 23881 |
| HPV56 | E2 | 10 | 168 | TSTSVGNQDA | 23882 |
| HPV56 | E2 | 11 | 168 | TSTSVGNQDAA | 23883 |
| HPV56 | E2 | 8 | 170 | TSVGNQDA | 23884 |
| HPV56 | E2 | 9 | 170 | TSVGNQDAA | 23885 |
| HPV56 | E2 | 10 | 170 | TSVGNQDAAV | 23886 |
| HPV56 | E2 | 9 | 27 | TTIYNNEEW | 23887 |
| HPV56 | E2 | 11 | 27 | TTIYNNEEWTL | 23888 |
| HPV56 | E2 | 11 | 167 | TTSTSVGNQDA | 23889 |
| HPV56 | E2 | 8 | 165 | TTTTSTSV | 23890 |
| HPV56 | E2 | 9 | 164 | TTTTTSTSV | 23891 |
| HPV56 | E2 | 8 | 75 | VAWKYIYY | 23892 |
| HPV56 | E2 | 11 | 179 | YSHRPGKRPRL | 23893 |
| HPV56 | E2 | 10 | 150 | VSPVETVNEY | 23894 |
| HPV56 | E2 | 9 | 142 | VSSTCRYNV | 23895 |
| HPV56 | E2 | 10 | 35 | WTLRDTCEEL | 23896 |
| HPV56 | E2 | 11 | 35 | WTLRDTCEELW | 23897 |
| HPV56 | E2 | 9 | 270 | WTSTDNKNY | 23898 |
| HPV56 | E2 | 11 | 270 | WTSTDNKNYSI | 23899 |
| HPV56 | E2 | 8 | 278 | YSIITIIY | 23900 |
| HPV56 | E2 | 8 | 111 | YTDFEQEA | 23901 |
| HPV56 | E2 | 11 | 111 | YTDFEQEAKKF | 23902 |
| HPV56 | E6 | 11 | 89 | ATLESITKKQL | 23903 |
| HPV56 | E6 | 8 | 50 | CTELKLVY | 23904 |
| HPV56 | E6 | 8 | 92 | ESITKKQL | 23905 |
| HPV56 | E6 | 11 | 92 | ESITKKQLCDL | 23906 |
| HPV56 | E6 | 8 | 48 | FACTELKL | 23907 |
| HPV56 | E6 | 9 | 48 | FACTELKLV | 23908 |
| HPV56 | E6 | 10 | 48 | FACTELKLVY | 23909 |
| HPV56 | E6 | 10 | 131 | IAHGWTGSCL | 23910 |
| HPV56 | E6 | 9 | 94 | ITKKQLCDL | 23911 |
| HPV56 | E6 | 10 | 94 | ITKKQLCDLL | 23912 |
| HPV56 | E6 | 11 | 94 | ITKKQLCDLLI | 23913 |
| HPV56 | E6 | 10 | 31 | LSCVYCKKEL | 23914 |
| HPV56 | E6 | 9 | 18 | LSEVLEIPL | 23915 |
| HPV56 | E6 | 10 | 18 | LSEVLEIPLI | 23916 |
| HPV56 | E6 | 8 | 113 | LTPEEKQL | 23917 |
| HPV56 | E6 | 9 | 40 | LTRAEVYNF | 23918 |
| HPV56 | E6 | 10 | 40 | LTRAEVYNFA | 23919 |
| HPV56 | E6 | 11 | 110 | QSPLTPEEKQL | 23920 |
| HPV56 | E6 | 11 | 145 | QTSREPRESTV | 23921 |
| HPV56 | E6 | 8 | 42 | RAEVYNFA | 23922 |
| HPV56 | E6 | 9 | 13 | RSLHHLSEV | 23923 |
| HPV56 | E6 | 10 | 13 | RSLHHLSEVL | 23924 |
| HPV56 | E6 | 10 | 146 | TSREPRESTV | 23925 |
| HPV56 | E6 | 9 | 135 | WTGSCLGCW | 23926 |
| HPV56 | E6 | 8 | 63 | YAVCRVCL | 23927 |
| HPV56 | E6 | 9 | 63 | YAVCRVCLL | 23928 |
| HPV56 | E6 | 10 | 63 | YAVCRVCLLF | 23929 |
| HPV56 | E6 | 11 | 63 | YAVCRVCLLFY | 23930 |
| HPV56 | E6 | 9 | 73 | YSKVRKYRY | 23931 |
| HPV56 | E6 | 10 | 73 | YSKVRKYRYY | 23932 |
| HPV56 | E6 | 8 | 84 | YSVYGATL | 23933 |
| HPV56 | E6 | 11 | 84 | YSVYGATLESI | 23934 |
| HPV56 | E7 | 11 | 30 | DSSEDEDEDEV | 23935 |
| HPV56 | E7 | 9 | 92 | GALTVTCPL | 23936 |
| HPV56 | E7 | 11 | 92 | GALTVTCPLCA | 23937 |
| HPV56 | E7 | 8 | 56 | HTCYLIHV | 23938 |
| HPV56 | E7 | 9 | 15 | LTPQTEIDL | 23939 |

TABLE XIII-continued

B58 Supermotif Peptides

| Type | Protein | No. of Amino Acids | Position | Sequence | Seq. Id. No. |
|---|---|---|---|---|---|
| HPV56 | E7 | 9 | 94 | LTVTCPLCA | 23940 |
| HPV56 | E7 | 8 | 6 | PTLQDVVL | 23941 |
| HPV56 | E7 | 10 | 6 | PTLQDVVLEL | 23942 |
| HPV56 | E7 | 8 | 52 | QAKQHTCY | 23943 |
| HPV56 | E7 | 9 | 52 | QAKQHTCYL | 23944 |
| HPV56 | E7 | 10 | 52 | QAKQHTCYLI | 23945 |
| HPV56 | E7 | 11 | 49 | QARQAKQHTCY | 23946 |
| HPV56 | E7 | 9 | 77 | QSTKEDLRV | 23947 |
| HPV56 | E7 | 10 | 77 | QSTKEDLRVV | 23948 |
| HPV56 | E7 | 10 | 31 | SSEDEDEDEV | 23949 |
| HPV56 | E7 | 8 | 78 | STKEDLRV | 23950 |
| HPV56 | E7 | 9 | 78 | STKEDLRVV | 23951 |
| HPV56 | L1 | 11 | 58 | ATDSYVKRTSI | 23952 |
| HPV56 | L1 | 8 | 381 | ATEQLSKY | 23953 |
| HPV56 | L1 | 10 | 381 | ATEQLSKYDA | 23954 |
| HPV56 | L1 | 8 | 327 | ATPSGSMI | 23955 |
| HPV56 | L1 | 8 | 514 | ATSKKRSA | 23956 |
| HPV56 | L1 | 8 | 444 | ATSLEDKY | 23957 |
| HPV56 | L1 | 10 | 444 | ATSLEDKYRY | 23958 |
| HPV56 | L1 | 11 | 444 | ATSLEDKYRYV | 23959 |
| HPV56 | L1 | 10 | 37 | ATWRPSENKV | 23960 |
| HPV56 | L1 | 11 | 37 | ATWRPSENKVY | 23961 |
| HPV56 | L1 | 9 | 195 | CTPAMGEHW | 23962 |
| HPV56 | L1 | 8 | 389 | DARKINQY | 23963 |
| HPV56 | L1 | 9 | 389 | DARKINQYL | 23964 |
| HPV56 | L1 | 8 | 274 | DAYGDSMW | 23965 |
| HPV56 | L1 | 9 | 274 | DAYGDSMWF | 23966 |
| HPV56 | L1 | 10 | 274 | DAYGDSMWFY | 23967 |
| HPV56 | L1 | 11 | 274 | DAYGDSMWFYL | 23968 |
| HPV56 | L1 | 10 | 486 | DSFSTDLDQF | 23969 |
| HPV56 | L1 | 8 | 176 | DSRDNISV | 23970 |
| HPV56 | L1 | 9 | 60 | DSYVKRTSI | 23971 |
| HPV56 | L1 | 10 | 60 | DSYVKRTSIF | 23972 |
| HPV56 | L1 | 11 | 60 | DSYVKRTSIFY | 23973 |
| HPV56 | L1 | 8 | 162 | DTESSNLA | 23974 |
| HPV56 | L1 | 9 | 236 | DTGFGAMDF | 23975 |
| HPV56 | L1 | 11 | 236 | DTGFGAMDFKV | 23976 |
| HPV56 | L1 | 8 | 369 | DTTRSTNM | 23977 |
| HPV56 | L1 | 10 | 369 | DTTRSTNMTI | 23978 |
| HPV56 | L1 | 9 | 337 | EAQLFNKPY | 23979 |
| HPV56 | L1 | 10 | 337 | EAQLFNKPYW | 23980 |
| HPV56 | L1 | 11 | 337 | EAQLFNKPYWL | 23981 |
| HPV56 | L1 | 8 | 249 | ESKAEVPL | 23982 |
| HPV56 | L1 | 10 | 249 | ESKAEVPLDI | 23983 |
| HPV56 | L1 | 11 | 249 | ESKAEVPLDIV | 23984 |
| HPV56 | L1 | 10 | 164 | ESSNLANNNV | 23985 |
| HPV56 | L1 | 11 | 164 | ESSNLANNNVI | 23986 |
| HPV56 | L1 | 8 | 303 | ETIPAELY | 23987 |
| HPV56 | L1 | 9 | 303 | ETIPAELYL | 23988 |
| HPV56 | L1 | 9 | 290 | FARHYFNRA | 23989 |
| HPV56 | L1 | 8 | 488 | FSTDLDQF | 23990 |
| HPV56 | L1 | 10 | 488 | FSTDLDQFPL | 23991 |
| HPV56 | L1 | 9 | 148 | GAGLSGHPL | 23992 |
| HPV56 | L1 | 10 | 148 | GAGLSGHPLF | 23993 |
| HPV56 | L1 | 8 | 240 | GAMDFKVL | 23994 |
| HPV56 | L1 | 9 | 206 | GAVCKSTQV | 23995 |
| HPV56 | L1 | 8 | 25 | GAVNVFPI | 23996 |
| HPV56 | L1 | 9 | 25 | GAVNVFPIF | 23997 |
| HPV56 | L1 | 10 | 25 | GAVNVFPIFL | 23998 |
| HPV56 | L1 | 8 | 331 | GSMITSEA | 23999 |
| HPV56 | L1 | 10 | 331 | GSMITSEAQL | 24000 |
| HPV56 | L1 | 11 | 331 | GSMITSEAQLF | 24001 |
| HPV56 | L1 | 8 | 73 | GSSRLLAV | 24002 |
| HPV56 | L1 | 8 | 506 | GTRSKPAV | 24003 |
| HPV56 | L1 | 9 | 506 | GTRSKPAVA | 24004 |
| HPV56 | L1 | 8 | 71 | HAGSSRLL | 24005 |
| HPV56 | L1 | 9 | 71 | HAGSSRLLA | 24006 |
| HPV56 | L1 | 10 | 71 | HAGSSRLLAV | 24007 |
| HPV56 | L1 | 8 | 378 | ISTATEQL | 24008 |
| HPV56 | L1 | 11 | 378 | ISTATEQLSKY | 24009 |
| HPV56 | L1 | 10 | 181 | ISVDGKQTQL | 24010 |
| HPV56 | L1 | 8 | 414 | ITLSAEVM | 24011 |
| HPV56 | L1 | 9 | 414 | ITLSAEVMA | 24012 |
| HPV56 | L1 | 10 | 414 | ITLSAEVMAY | 24013 |
| HPV56 | L1 | 11 | 414 | ITLSAEVMAYL | 24014 |
| HPV56 | L1 | 8 | 334 | ITSEAQLF | 24015 |

TABLE XIII-continued

B58 Supermotif Peptides

| Type | Protein | No. of Amino Acids | Position | Sequence | Seq. Id. No. |
|---|---|---|---|---|---|
| HPV56 | L1 | 8 | 251 | KAEVPLDI | 24016 |
| HPV56 | L1 | 9 | 251 | KAEVPLDIV | 24017 |
| HPV56 | L1 | 9 | 93 | KTNIPKVSA | 24018 |
| HPV56 | L1 | 10 | 93 | KTNIPKVSAY | 24019 |
| HPV56 | L1 | 9 | 474 | LAKYKFWDV | 24020 |
| HPV56 | L1 | 11 | 474 | LAKYKFWDVNL | 24021 |
| HPV56 | L1 | 8 | 222 | LALINTPI | 24022 |
| HPV56 | L1 | 8 | 78 | LAVGHPYY | 24023 |
| HPV56 | L1 | 10 | 78 | LAVGHPYYSV | 24024 |
| HPV56 | L1 | 8 | 416 | LSAEVMAY | 24025 |
| HPV56 | L1 | 9 | 416 | LSAEVMAYL | 24026 |
| HPV56 | L1 | 10 | 151 | LSGHPLFNRL | 24027 |
| HPV56 | L1 | 9 | 385 | LSKYDARKI | 24028 |
| HPV56 | L1 | 9 | 439 | LSPPVATSL | 24029 |
| HPV56 | L1 | 11 | 36 | MATWRPSENKV | 24030 |
| HPV56 | L1 | 9 | 421 | MAYLHNMNA | 24031 |
| HPV56 | L1 | 11 | 421 | MAYLHNMNANL | 24032 |
| HPV56 | L1 | 10 | 271 | MSADAYGDSM | 24033 |
| HPV56 | L1 | 11 | 271 | MSADAYGDSMW | 24034 |
| HPV56 | L1 | 10 | 376 | MTISTATEQL | 24035 |
| HPV56 | L1 | 8 | 428 | NANLLEDW | 24036 |
| HPV56 | L1 | 10 | 428 | NANLLEDWNI | 24037 |
| HPV56 | L1 | 9 | 91 | NTKTNIPKV | 24038 |
| HPV56 | L1 | 11 | 91 | NTKTNIPKVSA | 24039 |
| HPV56 | L1 | 9 | 226 | NTPIEDGDM | 24040 |
| HPV56 | L1 | 10 | 226 | NTPIEDGDMI | 24041 |
| HPV56 | L1 | 11 | 197 | PAMGEHWTKGA | 24042 |
| HPV56 | L1 | 11 | 511 | PAVATSKKRSA | 24043 |
| HPV56 | L1 | 8 | 41 | PSENKVYL | 24044 |
| HPV56 | L1 | 10 | 329 | PSGSMITSEA | 24045 |
| HPV56 | L1 | 8 | 467 | PTEKQDPL | 24046 |
| HPV56 | L1 | 9 | 467 | PTEKQDPLA | 24047 |
| HPV56 | L1 | 11 | 467 | PTEKQDPLAKY | 24048 |
| HPV56 | L1 | 8 | 50 | PTPVSKVV | 24049 |
| HPV56 | L1 | 9 | 50 | PTPVSKVVA | 24050 |
| HPV56 | L1 | 8 | 522 | PTSTSTPA | 24051 |
| HPV56 | L1 | 9 | 260 | QSTCKYPDY | 24052 |
| HPV56 | L1 | 10 | 260 | QSTCKYPDYL | 24053 |
| HPV56 | L1 | 9 | 297 | RAGKVGETI | 24054 |
| HPV56 | L1 | 11 | 297 | RAGKVGETIPA | 24055 |
| HPV56 | L1 | 9 | 349 | RAQGHNNGI | 24056 |
| HPV56 | L1 | 11 | 349 | RAQGHNNGICW | 24057 |
| HPV56 | L1 | 11 | 519 | RSAPTSTSTPA | 24058 |
| HPV56 | L1 | 10 | 372 | RSTNMTISTA | 24059 |
| HPV56 | L1 | 8 | 65 | RTSIFYHA | 24060 |
| HPV56 | L1 | 9 | 272 | SADAYGDSM | 24061 |
| HPV56 | L1 | 10 | 272 | SADAYGDSMW | 24062 |
| HPV56 | L1 | 11 | 272 | SADAYGDSMWF | 24063 |
| HPV56 | L1 | 8 | 417 | SAEVMAYL | 24064 |
| HPV56 | L1 | 11 | 417 | SAEVMAYLHNM | 24065 |
| HPV56 | L1 | 10 | 520 | SAPTSTSTPA | 24066 |
| HPV56 | L1 | 8 | 100 | SAYQYRVF | 24067 |
| HPV56 | L1 | 10 | 100 | SAYQYRVFRV | 24068 |
| HPV56 | L1 | 9 | 165 | SSNLANNNV | 24069 |
| HPV56 | L1 | 10 | 165 | SSNLANNNVI | 24070 |
| HPV56 | L1 | 11 | 74 | SSRLLAVGHPY | 24071 |
| HPV56 | L1 | 10 | 379 | STATEQLSKY | 24072 |
| HPV56 | L1 | 8 | 261 | STCKYPDY | 24073 |
| HPV56 | L1 | 9 | 261 | STCKYPDYL | 24074 |
| HPV56 | L1 | 11 | 261 | STCKYPDYLKM | 24075 |
| HPV56 | L1 | 9 | 489 | STDLDQFPL | 24076 |
| HPV56 | L1 | 9 | 373 | STNMTISTA | 24077 |
| HPV56 | L1 | 9 | 380 | TATEQLSKY | 24078 |
| HPV56 | L1 | 11 | 380 | TATEQLSKYDA | 24079 |
| HPV56 | L1 | 11 | 335 | TSEAQLFNKPY | 24080 |
| HPV56 | L1 | 9 | 445 | TSLEDKYRY | 24081 |
| HPV56 | L1 | 10 | 445 | TSLEDKYRYV | 24082 |
| HPV56 | L1 | 8 | 215 | TTGDCPPL | 24083 |
| HPV56 | L1 | 9 | 215 | TTGDCPPLA | 24084 |
| HPV56 | L1 | 10 | 215 | TTGDCPPLAL | 24085 |
| HPV56 | L1 | 11 | 215 | TTGDCPPLALI | 24086 |
| HPV56 | L1 | 9 | 370 | TTRSTNMTI | 24087 |
| HPV56 | L1 | 8 | 326 | VATPSGSM | 24088 |
| HPV56 | L1 | 9 | 326 | VATPSGSMI | 24089 |
| HPV56 | L1 | 9 | 513 | VATSKKRSA | 24090 |
| HPV56 | L1 | 9 | 443 | VATSLEDKY | 24091 |

TABLE XIII-continued

B58 Supermotif Peptides

| Type | Protein | No. of Amino Acids | Position | Sequence | Seq. Id. No. |
|---|---|---|---|---|---|
| HPV56 | L1 | 11 | 443 | VATSLEDKYRY | 24092 |
| HPV56 | L1 | 8 | 99 | VSAYQYRV | 24093 |
| HPV56 | L1 | 9 | 99 | VSAYQYRVF | 24094 |
| HPV56 | L1 | 11 | 99 | VSAYQYRVFRV | 24095 |
| HPV56 | L1 | 10 | 53 | VSKVVATDSY | 24096 |
| HPV56 | L1 | 11 | 53 | VSKVVATDSYV | 24097 |
| HPV56 | L1 | 10 | 87 | VTKDNTKTNI | 24098 |
| HPV56 | L1 | 9 | 214 | VTTGDCPPL | 24099 |
| HPV56 | L1 | 10 | 214 | VTTGDCPPLA | 24100 |
| HPV56 | L1 | 11 | 214 | VTTGDCPPLAL | 24101 |
| HPV56 | L1 | 8 | 134 | WACVGLEV | 24102 |
| HPV56 | L2 | 9 | 222 | AAPRLYRKA | 24103 |
| HPV56 | L2 | 10 | 222 | AAPRLYRKAF | 24104 |
| HPV56 | L2 | 9 | 383 | ASNTTNVTA | 24105 |
| HPV56 | L2 | 11 | 383 | ASNTTNVTAPL | 24106 |
| HPV56 | L2 | 11 | 303 | ATIQTRRGTQI | 24107 |
| HPV56 | L2 | 10 | 246 | ATLVSADNPL | 24108 |
| HPV56 | L2 | 11 | 246 | ATLVSADNPLF | 24109 |
| HPV56 | L2 | 9 | 367 | ATPSAHLPI | 24110 |
| HPV56 | L2 | 10 | 14 | ATQLYKTCKL | 24111 |
| HPV56 | L2 | 9 | 6 | ATRRKRASA | 24112 |
| HPV56 | L2 | 11 | 260 | DTSLAFSPSGV | 24113 |
| HPV56 | L2 | 10 | 357 | EAPGLSSQSV | 24114 |
| HPV56 | L2 | 11 | 357 | EAPGLSSQSVA | 24115 |
| HPV56 | L2 | 8 | 169 | EAPQTGEV | 24116 |
| HPV56 | L2 | 9 | 114 | ESGAGIPNF | 24117 |
| HPV56 | L2 | 9 | 109 | ESSVIESGA | 24118 |
| HPV56 | L2 | 11 | 109 | ESSVIESGAGI | 24119 |
| HPV56 | L2 | 10 | 94 | ESVGPTDPSI | 24120 |
| HPV56 | L2 | 11 | 94 | ESVGPTDPSIV | 24121 |
| HPV56 | L2 | 10 | 398 | ETPFYSGPDI | 24122 |
| HPV56 | L2 | 11 | 398 | ETPFYSGPDIV | 24123 |
| HPV56 | L2 | 8 | 457 | FADGDVAA | 24124 |
| HPV56 | L2 | 8 | 437 | FALWPVYF | 24125 |
| HPV56 | L2 | 9 | 437 | FALWPVYFF | 24126 |
| HPV56 | L2 | 8 | 382 | FASNTTNV | 24127 |
| HPV56 | L2 | 10 | 382 | FASNTTNVTA | 24128 |
| HPV56 | L2 | 11 | 200 | FAVHGSGTEPI | 24129 |
| HPV56 | L2 | 8 | 296 | FSRLGRKA | 24130 |
| HPV56 | L2 | 10 | 296 | FSRLGRKATI | 24131 |
| HPV56 | L2 | 9 | 122 | FTGSGGFEI | 24132 |
| HPV56 | L2 | 8 | 287 | FTTRRGGV | 24133 |
| HPV56 | L2 | 10 | 287 | FTTRRGGVRF | 24134 |
| HPV56 | L2 | 9 | 51 | FTYFGGLGI | 24135 |
| HPV56 | L2 | 8 | 314 | GARVHYYY | 24136 |
| HPV56 | L2 | 10 | 314 | GARVHYYYDI | 24137 |
| HPV56 | L2 | 8 | 64 | GSGGRAGY | 24138 |
| HPV56 | L2 | 9 | 64 | GSGGRAGYV | 24139 |
| HPV56 | L2 | 11 | 64 | GSGGRAGYVPL | 24140 |
| HPV56 | L2 | 10 | 48 | GSLFTYFGGL | 24141 |
| HPV56 | L2 | 8 | 75 | GSRPSTIV | 24142 |
| HPV56 | L2 | 10 | 75 | GSRPSTIVDV | 24143 |
| HPV56 | L2 | 9 | 434 | GSSFALWPV | 24144 |
| HPV56 | L2 | 10 | 434 | GSSFALWPVY | 24145 |
| HPV56 | L2 | 11 | 434 | GSSFALWPVYF | 24146 |
| HPV56 | L2 | 8 | 25 | GTCPEDVV | 24147 |
| HPV56 | L2 | 11 | 25 | GTCPEDVVNKI | 24148 |
| HPV56 | L2 | 8 | 258 | GTDTSLAF | 24149 |
| HPV56 | L2 | 10 | 206 | GTEPISSTPI | 24150 |
| HPV56 | L2 | 8 | 62 | GTGSGGRA | 24151 |
| HPV56 | L2 | 10 | 62 | GTGSGGRAGY | 24152 |
| HPV56 | L2 | 11 | 62 | GTGSGGRAGYV | 24153 |
| HPV56 | L2 | 10 | 60 | GTGTGSGGRA | 24154 |
| HPV56 | L2 | 8 | 310 | GTQIGARV | 24155 |
| HPV56 | L2 | 10 | 310 | GTQIGARVHY | 24156 |
| HPV56 | L2 | 11 | 310 | GTQIGARVHYY | 24157 |
| HPV56 | L2 | 8 | 190 | HSYEEIPM | 24158 |
| HPV56 | L2 | 11 | 190 | HSYEEIPMQTF | 24159 |
| HPV56 | L2 | 10 | 221 | IAAPRLYRKA | 24160 |
| HPV56 | L2 | 11 | 221 | IAAPRLYRKAF | 24161 |
| HPV56 | L2 | 9 | 326 | IAQAEEIEM | 24162 |
| HPV56 | L2 | 10 | 323 | ISPIAQAEEI | 24163 |
| HPV56 | L2 | 9 | 210 | ISSTPIPGF | 24164 |
| HPV56 | L2 | 8 | 182 | ISTPTSGI | 24165 |
| HPV56 | L2 | 11 | 182 | ISTPTSGIHSY | 24166 |
| HPV56 | L2 | 11 | 157 | ITNPLFIDPPV | 24167 |

TABLE XIII-continued

B58 Supermotif Peptides

| Type | Protein | No. of Amino Acids | Position | Sequence | Seq. Id. No. |
|---|---|---|---|---|---|
| HPV56 | L2 | 8 | 143 | ITPTSSTV | 24168 |
| HPV56 | L2 | 10 | 143 | ITPTSSTVHV | 24169 |
| HPV56 | L2 | 10 | 130 | ITSSSTTTPA | 24170 |
| HPV56 | L2 | 11 | 130 | ITSSSTTTPAV | 24171 |
| HPV56 | L2 | 8 | 229 | KAFQQVKV | 24172 |
| HPV56 | L2 | 8 | 38 | KTWADKIL | 24173 |
| HPV56 | L2 | 10 | 38 | KTWADKILQW | 24174 |
| HPV56 | L2 | 8 | 263 | LAFSPSGV | 24175 |
| HPV56 | L2 | 9 | 263 | LAFSPSGVA | 24176 |
| HPV56 | L2 | 10 | 338 | LSANNSFDGL | 24177 |
| HPV56 | L2 | 11 | 338 | LSANNSFDGLY | 24178 |
| HPV56 | L2 | 10 | 380 | LSFASNTTNV | 24179 |
| HPV56 | L2 | 9 | 23 | LSGTCPEDV | 24180 |
| HPV56 | L2 | 10 | 23 | LSGTCPEDVV | 24181 |
| HPV56 | L2 | 11 | 361 | LSSQSVATPSA | 24182 |
| HPV56 | L2 | 9 | 342 | NSFDGLYDI | 24183 |
| HPV56 | L2 | 10 | 342 | NSFDGLYDIY | 24184 |
| HPV56 | L2 | 11 | 342 | NSFDGLYDIYA | 24185 |
| HPV56 | L2 | 9 | 385 | NTTNVTAPL | 24186 |
| HPV56 | L2 | 8 | 239 | PAFLDRPA | 24187 |
| HPV56 | L2 | 10 | 239 | PAFLDRPATL | 24188 |
| HPV56 | L2 | 11 | 239 | PAFLDRPATLV | 24189 |
| HPV56 | L2 | 10 | 285 | PAFTTRRGGV | 24190 |
| HPV56 | L2 | 8 | 86 | PARPPIVV | 24191 |
| HPV56 | L2 | 11 | 86 | PARPPIVVESV | 24192 |
| HPV56 | L2 | 11 | 245 | PATLVSADNPL | 24193 |
| HPV56 | L2 | 10 | 267 | PSGVAPDPDF | 24194 |
| HPV56 | L2 | 11 | 267 | PSGVAPDPDFM | 24195 |
| HPV56 | L2 | 10 | 78 | PSTIVDVTPA | 24196 |
| HPV56 | L2 | 9 | 98 | PTDPSIVTL | 24197 |
| HPV56 | L2 | 10 | 98 | PTDPSIVTLV | 24198 |
| HPV56 | L2 | 9 | 410 | PTGPSTWPF | 24199 |
| HPV56 | L2 | 10 | 410 | PTGPSTWPFV | 24200 |
| HPV56 | L2 | 8 | 185 | PTSGIHSY | 24201 |
| HPV56 | L2 | 11 | 185 | PTSGIHSYEEI | 24202 |
| HPV56 | L2 | 8 | 145 | PTSSTVHV | 24203 |
| HPV56 | L2 | 10 | 328 | QAEEIEMQPL | 24204 |
| HPV56 | L2 | 11 | 328 | QAEEIEMQPLL | 24205 |
| HPV56 | L2 | 10 | 421 | QSPYDVTHDV | 24206 |
| HPV56 | L2 | 11 | 421 | QSPYDVTHDVY | 24207 |
| HPV56 | L2 | 8 | 364 | QSVATPSA | 24208 |
| HPV56 | L2 | 10 | 364 | QSVATPSAHL | 24209 |
| HPV56 | L2 | 9 | 172 | QTGEVSGNI | 24210 |
| HPV56 | L2 | 10 | 172 | QTGEVSGNIL | 24211 |
| HPV56 | L2 | 11 | 172 | QTGEVSGNILI | 24212 |
| HPV56 | L2 | 8 | 306 | QTRRGTQI | 24213 |
| HPV56 | L2 | 10 | 306 | QTRRGTQIGA | 24214 |
| HPV56 | L2 | 8 | 11 | RASATQLY | 24215 |
| HPV56 | L2 | 8 | 5 | RATRRKRA | 24216 |
| HPV56 | L2 | 10 | 5 | RATRRKRASA | 24217 |
| HPV56 | L2 | 11 | 370 | SAHLPIKPSTL | 24218 |
| HPV56 | L2 | 9 | 339 | SANNSFDGL | 24219 |
| HPV56 | L2 | 10 | 339 | SANNSFDGLY | 24220 |
| HPV56 | L2 | 11 | 13 | SATQLYKTCKL | 24221 |
| HPV56 | L2 | 8 | 435 | SSFALWPV | 24222 |
| HPV56 | L2 | 9 | 435 | SSFALWPVY | 24223 |
| HPV56 | L2 | 10 | 435 | SSFALWPVYF | 24224 |
| HPV56 | L2 | 11 | 435 | SSFALWPVYFF | 24225 |
| HPV56 | L2 | 10 | 362 | SSQSVATPSA | 24226 |
| HPV56 | L2 | 8 | 132 | SSSTTTPA | 24227 |
| HPV56 | L2 | 9 | 132 | SSSTTTPAV | 24228 |
| HPV56 | L2 | 10 | 132 | SSSTTTPAVL | 24229 |
| HPV56 | L2 | 9 | 153 | SSTHITNPL | 24230 |
| HPV56 | L2 | 10 | 153 | SSTHITNPLF | 24231 |
| HPV56 | L2 | 11 | 153 | SSTHITNPLFI | 24232 |
| HPV56 | L2 | 8 | 211 | SSTPIPGF | 24233 |
| HPV56 | L2 | 11 | 211 | SSTPIPGFRRI | 24234 |
| HPV56 | L2 | 8 | 133 | SSTTPAV | 24235 |
| HPV56 | L2 | 9 | 133 | SSTTTPAVL | 24236 |
| HPV56 | L2 | 11 | 133 | SSTTTPAVLDI | 24237 |
| HPV56 | L2 | 11 | 147 | SSTVHVSSTHI | 24238 |
| HPV56 | L2 | 8 | 110 | SSVIESGA | 24239 |
| HPV56 | L2 | 10 | 110 | SSVIESGAGI | 24240 |
| HPV56 | L2 | 8 | 154 | STHITNPL | 24241 |
| HPV56 | L2 | 9 | 154 | STHITNPLF | 24242 |
| HPV56 | L2 | 10 | 154 | STHITNPLFI | 24243 |

TABLE XIII-continued

B58 Supermotif Peptides

| Type | Protein | No. of Amino Acids | Position | Sequence | Seq. Id. No. |
|---|---|---|---|---|---|
| HPV56 | L2 | 9 | 79 | STIVDVTPA | 24244 |
| HPV56 | L2 | 10 | 212 | STPIPGFRRI | 24245 |
| HPV56 | L2 | 11 | 212 | STPIPGFRRIA | 24246 |
| HPV56 | L2 | 10 | 183 | STPTSGIHSY | 24247 |
| HPV56 | L2 | 8 | 134 | STTTPAVL | 24248 |
| HPV56 | L2 | 10 | 134 | STTTPAVLDI | 24249 |
| HPV56 | L2 | 10 | 148 | STVHVSSTHI | 24250 |
| HPV56 | L2 | 11 | 414 | STWPFVPQSPY | 24251 |
| HPV56 | L2 | 8 | 390 | TAPLGNVW | 24252 |
| HPV56 | L2 | 10 | 186 | TSGIHSYEEI | 24253 |
| HPV56 | L2 | 10 | 261 | TSLAFSPSGV | 24254 |
| HPV56 | L2 | 11 | 261 | TSLAFSPSGVA | 24255 |
| HPV56 | L2 | 9 | 131 | TSSSTTPA | 24256 |
| HPV56 | L2 | 10 | 131 | TSSSTTTPAV | 24257 |
| HPV56 | L2 | 11 | 131 | TSSSTTTPAVL | 24258 |
| HPV56 | L2 | 8 | 386 | TTNVTAPL | 24259 |
| HPV56 | L2 | 11 | 386 | TTNVTAPLGNV | 24260 |
| HPV56 | L2 | 8 | 136 | TTPAVLDI | 24261 |
| HPV56 | L2 | 9 | 288 | TTRRGGVRF | 24262 |
| HPV56 | L2 | 9 | 135 | TTTPAVLDI | 24263 |
| HPV56 | L2 | 11 | 2 | VAHRATRRKRA | 24264 |
| HPV56 | L2 | 8 | 280 | VALHRPAF | 24265 |
| HPV56 | L2 | 8 | 270 | VAPDPDFM | 24266 |
| HPV56 | L2 | 10 | 270 | VAPDPDFMNI | 24267 |
| HPV56 | L2 | 11 | 270 | VAPDPDFMNIV | 24268 |
| HPV56 | L2 | 8 | 366 | VATPSAHL | 24269 |
| HPV56 | L2 | 10 | 366 | VATPSAHLPI | 24270 |
| HPV56 | L2 | 8 | 249 | VSADNPLF | 24271 |
| HPV56 | L2 | 10 | 152 | VSSTHITNPL | 24272 |
| HPV56 | L2 | 11 | 152 | VSSTHITNPLF | 24273 |
| HPV56 | L2 | 8 | 389 | VTAPLGNV | 24274 |
| HPV56 | L2 | 9 | 389 | VTAPLGNVW | 24275 |
| HPV56 | L2 | 11 | 236 | VTDPAFLDRPA | 24276 |
| HPV56 | L2 | 9 | 104 | VTLVEESSV | 24277 |
| HPV56 | L2 | 10 | 104 | VTLVEESSVI | 24278 |
| HPV56 | L2 | 8 | 84 | VTPARPPI | 24279 |
| HPV56 | L2 | 9 | 84 | VTPARPPIV | 24280 |
| HPV56 | L2 | 10 | 84 | VTPARPPIVV | 24281 |
| HPV56 | L2 | 8 | 40 | WADKILQW | 24282 |
| HPV56 | L2 | 11 | 40 | WADKILQWGSL | 24283 |
| HPV56 | L2 | 8 | 351 | YANIDDEA | 24284 |
| HPV56 | L2 | 11 | 351 | YANIDDEAPGL | 24285 |
| HPV56 | L2 | 8 | 402 | YSGPDIVL | 24286 |

TABLE XIV

B62 Supermotif Peptides

| Type | Protein | No. of Amino Acid | Position | Sequence | Seq. Id. No. |
|---|---|---|---|---|---|
| HPV16 | E1 | 10 | 112 | AICIEKQSRA | 24287 |
| HPV16 | E1 | 11 | 112 | AICIEKQSRAA | 24288 |
| HPV16 | E1 | 9 | 539 | ALDGNLVSM | 24289 |
| HPV16 | E1 | 11 | 539 | ALDGNLVSMDV | 24290 |
| HPV16 | E1 | 8 | 69 | ALFTAQEA | 24291 |
| HPV16 | E1 | 9 | 459 | ALKRFLQGI | 24292 |
| HPV16 | E1 | 9 | 318 | ALYWYKTGI | 24293 |
| HPV16 | E1 | 9 | 206 | AMLAKFKEL | 24294 |
| HPV16 | E1 | 10 | 206 | AMLAKFKELY | 24295 |
| HPV16 | E1 | 10 | 73 | AQEAKQHRDA | 24296 |
| HPV16 | E1 | 11 | 73 | AQEAKQHRDAV | 24297 |
| HPV16 | E1 | 10 | 380 | AQLADTNSNA | 24298 |
| HPV16 | E1 | 9 | 82 | AVQVLKRKY | 24299 |
| HPV16 | E1 | 10 | 82 | AVQVLKRKYL | 24300 |
| HPV16 | E1 | 11 | 82 | AVQVLKRKYLV | 24301 |
| HPV16 | E1 | 10 | 23 | AVVEKKTGDA | 24302 |
| HPV16 | E1 | 11 | 23 | AVVEKKTGDAI | 24303 |
| HPV16 | E1 | 11 | 237 | CIAAFGLTPSI | 24304 |
| HPV16 | E1 | 8 | 114 | CIEKQSRA | 24305 |
| HPV16 | E1 | 9 | 114 | CIEKQSRAA | 24306 |
| HPV16 | E1 | 8 | 472 | CILLYGAA | 24307 |
| HPV16 | E1 | 9 | 259 | CLYLHIQSL | 24308 |
| HPV16 | E1 | 10 | 259 | CLYLHIQSLA | 24309 |

TABLE XIV-continued

B62 Supermotif Peptides

| Type | Protein | No. of Amino Acid | Position | Sequence | Seq. Id. No. |
|---|---|---|---|---|---|
| HPV16 | E1 | 9 | 304 | CMMIEPPKL | 24310 |
| HPV16 | E1 | 10 | 559 | CPPLLITSNI | 24311 |
| HPV16 | E1 | 8 | 187 | CQTPLTNI | 24312 |
| HPV16 | E1 | 9 | 187 | CQTPLTNIL | 24313 |
| HPV16 | E1 | 11 | 187 | CQTPLTNILNV | 24314 |
| HPV16 | E1 | 10 | 101 | CVDNNISPRL | 24315 |
| HPV16 | E1 | 10 | 640 | CVSGQNTNTL | 24316 |
| HPV16 | E1 | 8 | 299 | CVSPMCMM | 24317 |
| HPV16 | E1 | 9 | 299 | CVSPMCMMI | 24318 |
| HPV16 | E1 | 10 | 97 | DISGCVDNNI | 24319 |
| HPV16 | E1 | 8 | 368 | DIVDDSEI | 24320 |
| HPV16 | E1 | 9 | 368 | DIVDDSEIA | 24321 |
| HPV16 | E1 | 10 | 368 | DIVDDSEIAY | 24322 |
| HPV16 | E1 | 8 | 548 | DVKHRPLV | 24323 |
| HPV16 | E1 | 10 | 548 | DVKHRPLVQL | 24324 |
| HPV16 | E1 | 9 | 374 | EIAYKYAQL | 24325 |
| HPV16 | E1 | 10 | 374 | EIAYKYAQLA | 24326 |
| HPV16 | E1 | 10 | 603 | ELNDKNWKSF | 24327 |
| HPV16 | E1 | 11 | 603 | ELNDKNWKSFF | 24328 |
| HPV16 | E1 | 8 | 356 | ELSQMVQW | 24329 |
| HPV16 | E1 | 9 | 356 | ELSQMVQWA | 24330 |
| HPV16 | E1 | 10 | 356 | ELSQMVQWAY | 24331 |
| HPV16 | E1 | 10 | 213 | ELYGVSFSEL | 24332 |
| HPV16 | E1 | 11 | 213 | ELYGVSFSELV | 24333 |
| HPV16 | E1 | 9 | 308 | EPPKLRSTA | 24334 |
| HPV16 | E1 | 10 | 308 | EPPKLRSTAA | 24335 |
| HPV16 | E1 | 11 | 308 | EPPKLRSTAAA | 24336 |
| HPV16 | E1 | 8 | 138 | EVETQQML | 24337 |
| HPV16 | E1 | 10 | 138 | EVETQQMLQV | 24338 |
| HPV16 | E1 | 9 | 331 | EVYGDTPEW | 24339 |
| HPV16 | E1 | 10 | 331 | EVYGDTPEWI | 24340 |
| HPV16 | E1 | 8 | 51 | FIVNDNDY | 24341 |
| HPV16 | E1 | 9 | 51 | FIVNDNDYL | 24342 |
| HPV16 | E1 | 8 | 392 | FLKSNSQA | 24343 |
| HPV16 | E1 | 10 | 392 | FLKSNSQAKI | 24344 |
| HPV16 | E1 | 11 | 392 | FLKSNSQAKIV | 24345 |
| HPV16 | E1 | 11 | 463 | FLQGIPKKNCI | 24346 |
| HPV16 | E1 | 9 | 493 | FLQGSVICF | 24347 |
| HPV16 | E1 | 10 | 493 | FLQGSVICFV | 24348 |
| HPV16 | E1 | 9 | 445 | FLRYQGVEF | 24349 |
| HPV16 | E1 | 10 | 445 | FLRYQGVEFM | 24350 |
| HPV16 | E1 | 8 | 456 | FLTALKRF | 24351 |
| HPV16 | E1 | 9 | 456 | FLTALKRFL | 24352 |
| HPV16 | E1 | 8 | 453 | FMSFLTAL | 24353 |
| HPV16 | E1 | 11 | 453 | FMSFLTALKRF | 24354 |
| HPV16 | E1 | 10 | 592 | FPFDENGNPV | 24355 |
| HPV16 | E1 | 11 | 592 | FPFDENGNPVY | 24356 |
| HPV16 | E1 | 8 | 501 | FVNSKSHF | 24357 |
| HPV16 | E1 | 9 | 501 | FVNSKSHFW | 24358 |
| HPV16 | E1 | 10 | 501 | FVNSKSHFWL | 24359 |
| HPV16 | E1 | 8 | 466 | GIPKKNCI | 24360 |
| HPV16 | E1 | 9 | 466 | GIPKKNCIL | 24361 |
| HPV16 | E1 | 10 | 466 | GIPKKNCILL | 24362 |
| HPV16 | E1 | 11 | 466 | GIPKKNCILLY | 24363 |
| HPV16 | E1 | 8 | 325 | GISNISEV | 24364 |
| HPV16 | E1 | 9 | 325 | GISNISEVY | 24365 |
| HPV16 | E1 | 10 | 242 | GLTPSIADSI | 24366 |
| HPV16 | E1 | 8 | 519 | GMLDDATV | 24367 |
| HPV16 | E1 | 11 | 519 | GMLDDATVPCW | 24368 |
| HPV16 | E1 | 8 | 487 | GMSLMKFL | 24369 |
| HPV16 | E1 | 8 | 272 | GMVVLLLV | 24370 |
| HPV16 | E1 | 10 | 272 | GMVVLLLVRY | 24371 |
| HPV16 | E1 | 8 | 450 | GVEFMSFL | 24372 |
| HPV16 | E1 | 10 | 450 | GVEFMSFLTA | 24373 |
| HPV16 | E1 | 11 | 450 | GVEFMSFLTAL | 24374 |
| HPV16 | E1 | 8 | 179 | GVSERHTI | 24375 |
| HPV16 | E1 | 8 | 216 | GVSFSELV | 24376 |
| HPV16 | E1 | 11 | 216 | GVSFSELVRPF | 24377 |
| HPV16 | E1 | 9 | 263 | HIQSLACSW | 24378 |
| HPV16 | E1 | 11 | 263 | HIQSLACSWGM | 24379 |
| HPV16 | E1 | 10 | 194 | ILNVLKTSNA | 24380 |
| HPV16 | E1 | 8 | 467 | IPKKNCIL | 24381 |
| HPV16 | E1 | 9 | 467 | IPKKNCILL | 24382 |
| HPV16 | E1 | 10 | 467 | IPKKNCILLY | 24383 |
| HPV16 | E1 | 11 | 340 | IQRQTVLQHSF | 24384 |

TABLE XIV-continued

B62 Supermotif Peptides

| Type | Protein | No. of Amino Acid | Position | Sequence | Seq. Id. No. |
|---|---|---|---|---|---|
| HPV16 | E1 | 8 | 264 | IQSLACSW | 24385 |
| HPV16 | E1 | 10 | 264 | IQSLACSWGM | 24386 |
| HPV16 | E1 | 11 | 264 | IQSLACSWGMV | 24387 |
| HPV16 | E1 | 8 | 369 | IVDDSEIA | 24388 |
| HPV16 | E1 | 9 | 369 | IVDDSEIAY | 24389 |
| HPV16 | E1 | 11 | 369 | IVDDSEIAYKY | 24390 |
| HPV16 | E1 | 8 | 401 | IVKDCATM | 24391 |
| HPV16 | E1 | 10 | 442 | IVMFLRYQGV | 24392 |
| HPV16 | E1 | 8 | 52 | IVNDNDYL | 24393 |
| HPV16 | E1 | 11 | 52 | IVNDNDYLTQA | 24394 |
| HPV16 | E1 | 8 | 517 | KIGMLDDA | 24395 |
| HPV16 | E1 | 10 | 517 | KIGMLDDATV | 24396 |
| HPV16 | E1 | 9 | 400 | KIVKDCATM | 24397 |
| HPV16 | E1 | 8 | 296 | KLLCVSPM | 24398 |
| HPV16 | E1 | 10 | 296 | KLLCVSPMCM | 24399 |
| HPV16 | E1 | 11 | 296 | KLLCVSPMCMM | 24400 |
| HPV16 | E1 | 9 | 292 | KLLSKLLCV | 24401 |
| HPV16 | E1 | 8 | 311 | KLRSTAAA | 24402 |
| HPV16 | E1 | 9 | 311 | KLRSTAAAL | 24403 |
| HPV16 | E1 | 10 | 311 | KLRSTAAALY | 24404 |
| HPV16 | E1 | 11 | 311 | KLRSTAAALYW | 24405 |
| HPV16 | E1 | 9 | 77 | KQHRDAVQV | 24406 |
| HPV16 | E1 | 10 | 77 | KQHRDAVQVL | 24407 |
| HPV16 | E1 | 9 | 440 | KQIVMFLRY | 24408 |
| HPV16 | E1 | 8 | 418 | KQMSMSQW | 24409 |
| HPV16 | E1 | 9 | 418 | KQMSMSQWI | 24410 |
| HPV16 | E1 | 11 | 418 | KQMSMSQWIKY | 24411 |
| HPV16 | E1 | 10 | 117 | KQSRAAKRRL | 24412 |
| HPV16 | E1 | 11 | 117 | KQSRAAKRRLF | 24413 |
| HPV16 | E1 | 8 | 563 | LITSNINA | 24414 |
| HPV16 | E1 | 9 | 297 | LLCVSPMCM | 24415 |
| HPV16 | E1 | 10 | 297 | LLCVSPMCMM | 24416 |
| HPV16 | E1 | 11 | 297 | LLCVSPMCMMI | 24417 |
| HPV16 | E1 | 9 | 562 | LLITSNINA | 24418 |
| HPV16 | E1 | 8 | 254 | LLQQYCLY | 24419 |
| HPV16 | E1 | 9 | 254 | LLQQYCLYL | 24420 |
| HPV16 | E1 | 11 | 254 | LLQQYCLYLHI | 24421 |
| HPV16 | E1 | 8 | 293 | LLSKLLCV | 24422 |
| HPV16 | E1 | 11 | 293 | LLSKLLCVSPM | 24423 |
| HPV16 | E1 | 9 | 490 | LMKFLQGSV | 24424 |
| HPV16 | E1 | 10 | 490 | LMKFLQGSVI | 24425 |
| HPV16 | E1 | 10 | 464 | LQGIPKKNCI | 24426 |
| HPV16 | E1 | 11 | 464 | LQGIPKKNCIL | 24427 |
| HPV16 | E1 | 8 | 494 | LQGSVICF | 24428 |
| HPV16 | E1 | 9 | 494 | LQGSVICFV | 24429 |
| HPV16 | E1 | 10 | 346 | LQHSFNDCTF | 24430 |
| HPV16 | E1 | 9 | 510 | LQPLADAKI | 24431 |
| HPV16 | E1 | 11 | 510 | LQPLADAKIGM | 24432 |
| HPV16 | E1 | 8 | 255 | LQQYCLYL | 24433 |
| HPV16 | E1 | 10 | 255 | LQQYCLYLHI | 24434 |
| HPV16 | E1 | 11 | 48 | LVDFIVNDNDY | 24435 |
| HPV16 | E1 | 9 | 554 | LVQLKCPPL | 24436 |
| HPV16 | E1 | 10 | 554 | LVQLKCPPLL | 24437 |
| HPV16 | E1 | 11 | 554 | LVQLKCPPLLI | 24438 |
| HPV16 | E1 | 11 | 544 | LVSMDVKHRPL | 24439 |
| HPV16 | E1 | 8 | 91 | LVSPLSDI | 24440 |
| HPV16 | E1 | 10 | 583 | LVVFTFPNEF | 24441 |
| HPV16 | E1 | 11 | 306 | MIEPPKLRSTA | 24442 |
| HPV16 | E1 | 8 | 207 | MLAKFKEL | 24443 |
| HPV16 | E1 | 9 | 207 | MLAKFKELY | 24444 |
| HPV16 | E1 | 11 | 207 | MLAKFKELYGV | 24445 |
| HPV16 | E1 | 10 | 520 | MLDDATVPCW | 24446 |
| HPV16 | E1 | 8 | 305 | MMIEPPKL | 24447 |
| HPV16 | E1 | 10 | 360 | MVQWAYDNDI | 24448 |
| HPV16 | E1 | 11 | 360 | MVQWAYDNDIV | 24449 |
| HPV16 | E1 | 9 | 273 | MVVLLLVRY | 24450 |
| HPV16 | E1 | 11 | 193 | NILNVLKTSNA | 24451 |
| HPV16 | E1 | 10 | 567 | NINAGTDSRW | 24452 |
| HPV16 | E1 | 8 | 105 | NISPRLKA | 24453 |
| HPV16 | E1 | 9 | 105 | NISPRLKAI | 24454 |
| HPV16 | E1 | 11 | 105 | NISPRLKAICI | 24455 |
| HPV16 | E1 | 10 | 535 | NLRNALDGNL | 24456 |
| HPV16 | E1 | 11 | 535 | NLRNALDGNLV | 24457 |
| HPV16 | E1 | 11 | 599 | NPVYELNDKNW | 24458 |
| HPV16 | E1 | 8 | 196 | NVLKTSNA | 24459 |

TABLE XIV-continued

B62 Supermotif Peptides

| Type | Protein | No. of Amino Acid | Position | Sequence | Seq. Id. No. |
|---|---|---|---|---|---|
| HPV16 | E1 | 10 | 196 | NVLKTSNAKA | 24460 |
| HPV16 | E1 | 11 | 196 | NVLKTSNAKAA | 24461 |
| HPV16 | E1 | 9 | 512 | PLADAKIGM | 24462 |
| HPV16 | E1 | 10 | 512 | PLADAKIGML | 24463 |
| HPV16 | E1 | 8 | 561 | PLLITSNI | 24464 |
| HPV16 | E1 | 10 | 561 | PLLITSNINA | 24465 |
| HPV16 | E1 | 9 | 94 | PLSDISGCV | 24466 |
| HPV16 | E1 | 8 | 190 | PLTNILNV | 24467 |
| HPV16 | E1 | 9 | 190 | PLTNILNVL | 24468 |
| HPV16 | E1 | 10 | 553 | PLVQLKCPPL | 24469 |
| HPV16 | E1 | 11 | 553 | PLVQLKCPPLL | 24470 |
| HPV16 | E1 | 11 | 302 | PMCMMIEPPKL | 24471 |
| HPV16 | E1 | 8 | 309 | PPKLRSTA | 24472 |
| HPV16 | E1 | 9 | 309 | PPKLRSTAA | 24473 |
| HPV16 | E1 | 10 | 309 | PPKLRSTAAA | 24474 |
| HPV16 | E1 | 11 | 309 | PPKLRSTAAAL | 24475 |
| HPV16 | E1 | 9 | 560 | PPLLITSNI | 24476 |
| HPV16 | E1 | 11 | 560 | PPLLITSNINA | 24477 |
| HPV16 | E1 | 10 | 600 | PVYELNDKNW | 24478 |
| HPV16 | E1 | 8 | 441 | QIVMFLRY | 24479 |
| HPV16 | E1 | 11 | 441 | QIVMFLRYQGV | 24480 |
| HPV16 | E1 | 9 | 381 | QLADTNSNA | 24481 |
| HPV16 | E1 | 11 | 381 | QLADTNSNASA | 24482 |
| HPV16 | E1 | 8 | 556 | QLKCPPLL | 24483 |
| HPV16 | E1 | 9 | 556 | QLKCPPLLI | 24484 |
| HPV16 | E1 | 8 | 419 | QMSMSQWI | 24485 |
| HPV16 | E1 | 10 | 419 | QMSMSQWIKY | 24486 |
| HPV16 | E1 | 11 | 359 | QMVQWAYDNDI | 24487 |
| HPV16 | E1 | 8 | 511 | QPLADAKI | 24488 |
| HPV16 | E1 | 10 | 511 | QPLADAKIGM | 24489 |
| HPV16 | E1 | 11 | 511 | QPLADAKIGML | 24490 |
| HPV16 | E1 | 9 | 256 | QQYCLYLHI | 24491 |
| HPV16 | E1 | 8 | 84 | QVLKRKYL | 24492 |
| HPV16 | E1 | 9 | 84 | QVLKRKYLV | 24493 |
| HPV16 | E1 | 10 | 125 | RLFESEDSGY | 24494 |
| HPV16 | E1 | 11 | 582 | RLVVFTFPNEF | 24495 |
| HPV16 | E1 | 11 | 552 | RPLVQLKCPPL | 24496 |
| HPV16 | E1 | 9 | 342 | RQTVLQHSF | 24497 |
| HPV16 | E1 | 8 | 432 | RVDDGGDW | 24498 |
| HPV16 | E1 | 11 | 432 | RVDDGGDWKQI | 24499 |
| HPV16 | E1 | 9 | 246 | SIADSIKTL | 24500 |
| HPV16 | E1 | 10 | 246 | SIADSIKTLL | 24501 |
| HPV16 | E1 | 9 | 250 | SIKTLLQQY | 24502 |
| HPV16 | E1 | 11 | 250 | SIKTLLQQYCL | 24503 |
| HPV16 | E1 | 8 | 266 | SLACSWGM | 24504 |
| HPV16 | E1 | 9 | 266 | SLACSWGMV | 24505 |
| HPV16 | E1 | 10 | 266 | SLACSWGMVV | 24506 |
| HPV16 | E1 | 11 | 266 | SLACSWGMVVL | 24507 |
| HPV16 | E1 | 8 | 484 | SLFGMSLM | 24508 |
| HPV16 | E1 | 10 | 484 | SLFGMSLMKF | 24509 |
| HPV16 | E1 | 11 | 484 | SLFGMSLMKFL | 24510 |
| HPV16 | E1 | 10 | 489 | SLMKFLQGSV | 24511 |
| HPV16 | E1 | 11 | 489 | SLMKFLQGSVI | 24512 |
| HPV16 | E1 | 8 | 634 | SLPTFKCV | 24513 |
| HPV16 | E1 | 9 | 546 | SMDVKHRPL | 24514 |
| HPV16 | E1 | 10 | 546 | SMDVKIHRPLV | 24515 |
| HPV16 | E1 | 8 | 421 | SMSQWIKY | 24516 |
| HPV16 | E1 | 10 | 93 | SPLSDISGCV | 24517 |
| HPV16 | E1 | 9 | 107 | SPRLKAICI | 24518 |
| HPV16 | E1 | 10 | 397 | SQAKIVKDCA | 24519 |
| HPV16 | E1 | 8 | 358 | SQMVQWAY | 24520 |
| HPV16 | E1 | 11 | 423 | SQWIKYRCDRV | 24521 |
| HPV16 | E1 | 10 | 185 | TICQTPLTNI | 24522 |
| HPV16 | E1 | 11 | 185 | TICQTPLTNIL | 24523 |
| HPV16 | E1 | 9 | 289 | TIEKLLSKL | 24524 |
| HPV16 | E1 | 10 | 289 | TIEKLLSKLL | 24525 |
| HPV16 | E1 | 8 | 253 | TLLQQYCL | 24526 |
| HPV16 | E1 | 9 | 253 | TLLQQYCLY | 24527 |
| HPV16 | E1 | 10 | 253 | TLLQQYCLYL | 24528 |
| HPV16 | E1 | 9 | 407 | TMCRHYKRA | 24529 |
| HPV16 | E1 | 10 | 336 | TPEWIQRQTV | 24530 |
| HPV16 | E1 | 11 | 336 | TPEWIQRQTVL | 24531 |
| HPV16 | E1 | 9 | 189 | TPLTNILNV | 24532 |
| HPV16 | E1 | 10 | 189 | TPLTNILNVL | 24533 |
| HPV16 | E1 | 8 | 244 | TPSIADSI | 24534 |

TABLE XIV-continued

B62 Supermotif Peptides

| Type | Protein | No. of Amino Acid | Position | Sequence | Seq. Id. No. |
|---|---|---|---|---|---|
| HPV16 | E1 | 11 | 244 | TPSIADSIKTL | 24535 |
| HPV16 | E1 | 8 | 60 | TQAETETA | 24536 |
| HPV16 | E1 | 10 | 60 | TQAETETAHA | 24537 |
| HPV16 | E1 | 11 | 60 | TQAETETAHAL | 24538 |
| HPV16 | E1 | 8 | 525 | TVPCWNYI | 24539 |
| HPV16 | E1 | 11 | 498 | VICFVNSKSHF | 24540 |
| HPV16 | E1 | 8 | 85 | VLKRKYLV | 24541 |
| HPV16 | E1 | 11 | 85 | VLKRKYLVSPL | 24542 |
| HPV16 | E1 | 9 | 197 | VLKTSNAKA | 24543 |
| HPV16 | E1 | 10 | 197 | VLKTSNAKAA | 24544 |
| HPV16 | E1 | 11 | 197 | VLKTSNAKAAM | 24545 |
| HPV16 | E1 | 11 | 345 | VLQHSFNDCTF | 24546 |
| HPV16 | E1 | 9 | 443 | VMFLRYQGV | 24547 |
| HPV16 | E1 | 11 | 443 | VMFLRYQGVEF | 24548 |
| HPV16 | E1 | 11 | 526 | VPCWNYIDDNL | 24549 |
| HPV16 | E1 | 8 | 555 | VQLKCPPL | 24550 |
| HPV16 | E1 | 9 | 555 | VQLKCPPLL | 24551 |
| HPV16 | E1 | 10 | 555 | VQLKCPPLLI | 24552 |
| HPV16 | E1 | 8 | 83 | VQVLKRKY | 24553 |
| HPV16 | E1 | 9 | 83 | VQVLKRKYL | 24554 |
| HPV16 | E1 | 10 | 83 | VQVLKRKYLV | 24555 |
| HPV16 | E1 | 9 | 361 | VQWAYDNDI | 24556 |
| HPV16 | E1 | 10 | 361 | VQWAYDNDIV | 24557 |
| HPV16 | E1 | 9 | 24 | VVEKKTGDA | 24558 |
| HPV16 | E1 | 10 | 24 | VVEKKTGDAI | 24559 |
| HPV16 | E1 | 9 | 584 | VVFTFPNEF | 24560 |
| HPV16 | E1 | 11 | 584 | VVFTFPNEFPF | 24561 |
| HPV16 | E1 | 8 | 274 | VVLLLVRY | 24562 |
| HPV16 | E1 | 9 | 425 | WIKYRCDRV | 24563 |
| HPV16 | E1 | 8 | 339 | WIQRQTVL | 24564 |
| HPV16 | E1 | 8 | 509 | WLQPLADA | 24565 |
| HPV16 | E1 | 10 | 509 | WLQPLADAKI | 24566 |
| HPV16 | E1 | 8 | 576 | WPYLHNRL | 24567 |
| HPV16 | E1 | 9 | 576 | WPYLHNRLV | 24568 |
| HPV16 | E1 | 10 | 576 | WPYLHNRLVV | 24569 |
| HPV16 | E1 | 11 | 576 | WPYLHNRLVVF | 24570 |
| HPV16 | E1 | 9 | 531 | YIDDNLRNA | 24571 |
| HPV16 | E1 | 10 | 531 | YIDDNLRNAL | 24572 |
| HPV16 | E1 | 8 | 261 | YLHIQSLA | 24573 |
| HPV16 | E1 | 11 | 261 | YLHIQSLACSW | 24574 |
| HPV16 | E1 | 8 | 578 | YLHNRLVV | 24575 |
| HPV16 | E1 | 9 | 578 | YLHNRLVVF | 24576 |
| HPV16 | E1 | 11 | 578 | YLHNRLVVFTF | 24577 |
| HPV16 | E1 | 10 | 58 | YLTQAETETA | 24578 |
| HPV16 | E1 | 9 | 90 | YLVSPLSDI | 24579 |
| HPV16 | E1 | 9 | 448 | YQGVEFMSF | 24580 |
| HPV16 | E1 | 10 | 448 | YQGVEFMSFL | 24581 |
| HPV16 | E2 | 8 | 72 | AIELQLTL | 24582 |
| HPV16 | E2 | 11 | 72 | AIELQLTLETI | 24583 |
| HPV16 | E2 | 11 | 331 | AIVTLTYDSEW | 24584 |
| HPV16 | E2 | 9 | 41 | AIYYKAREM | 24585 |
| HPV16 | E2 | 11 | 41 | AIYYKAREMGF | 24586 |
| HPV16 | E2 | 11 | 228 | ALGTEETQTTI | 24587 |
| HPV16 | E2 | 9 | 69 | ALQAIELQL | 24588 |
| HPV16 | E2 | 11 | 69 | ALQAIELQLTL | 24589 |
| HPV16 | E2 | 11 | 105 | APTGCIKKHGY | 24590 |
| HPV16 | E2 | 8 | 63 | AVSKNKAL | 24591 |
| HPV16 | E2 | 10 | 63 | AVSKNKALQA | 24592 |
| HPV16 | E2 | 11 | 63 | AVSKAAALQAI | 24593 |
| HPV16 | E2 | 8 | 314 | AVSSTWHW | 24594 |
| HPV16 | E2 | 9 | 109 | CIKKHGYTV | 24595 |
| HPV16 | E2 | 11 | 109 | CIKKHGYTVEV | 24596 |
| HPV16 | E2 | 11 | 195 | CPTSVFSSNEV | 24597 |
| HPV16 | E2 | 9 | 11 | CQDKILTHY | 24598 |
| HPV16 | E2 | 11 | 5 | CQRLNVCQDKI | 24599 |
| HPV16 | E2 | 8 | 124 | DICNTMHY | 24600 |
| HPV16 | E2 | 11 | 124 | DICNTMHYTNW | 24601 |
| HPV16 | E2 | 8 | 25 | DLRDHIDY | 24602 |
| HPV16 | E2 | 9 | 25 | DLRDHIDYW | 24603 |
| HPV16 | E2 | 9 | 344 | DQFLSQVKI | 24604 |
| HPV16 | E2 | 8 | 96 | DVSLEVYL | 24605 |
| HPV16 | E2 | 10 | 96 | DVSLEVYLTA | 24606 |
| HPV16 | E2 | 8 | 209 | EIIRQHLA | 24607 |
| HPV16 | E2 | 9 | 74 | ELQLTLETI | 24608 |
| HPV16 | E2 | 10 | 74 | ELQLTLETIY | 24609 |

TABLE XIV-continued

B62 Supermotif Peptides

| Type | Protein | No. of Amino Acid | Position | Sequence | Seq. Id. No. |
|---|---|---|---|---|---|
| HPV16 | E2 | 11 | 48 | EMGFKHINHQV | 24610 |
| HPV16 | E2 | 8 | 185 | EVHAGGQV | 24611 |
| HPV16 | E2 | 9 | 185 | EVHAGGQVI | 24612 |
| HPV16 | E2 | 10 | 185 | EVHAGGQVIL | 24613 |
| HPV16 | E2 | 8 | 118 | EVQFDGDI | 24614 |
| HPV16 | E2 | 8 | 204 | EVSSPEII | 24615 |
| HPV16 | E2 | 11 | 100 | EVYLTAPTGCI | 24616 |
| HPV16 | E2 | 11 | 346 | FLSQVKLPKTI | 24617 |
| HPV16 | E2 | 8 | 168 | FVQFKDDA | 24618 |
| HPV16 | E2 | 11 | 168 | FVQFKDDAEKY | 24619 |
| HPV16 | E2 | 9 | 163 | GIRTYFVQF | 24620 |
| HPV16 | E2 | 9 | 156 | GLYYVHEGI | 24621 |
| HPV16 | E2 | 8 | 150 | GQVDYYGL | 24622 |
| HPV16 | E2 | 9 | 150 | GQVDYYGLY | 24623 |
| HPV16 | E2 | 10 | 150 | GQVDYYGLYY | 24624 |
| HPV16 | E2 | 11 | 150 | GQVDYYGLYYV | 24625 |
| HPV16 | E2 | 10 | 190 | GQVILCPTSV | 24626 |
| HPV16 | E2 | 11 | 190 | GQVILCPTSVF | 24627 |
| HPV16 | E2 | 8 | 29 | HIDYWKHM | 24628 |
| HPV16 | E2 | 10 | 29 | HIDYWKHMRL | 24629 |
| HPV16 | E2 | 10 | 53 | HINHQVVPTL | 24630 |
| HPV16 | E2 | 11 | 53 | HINHQVVPTLA | 24631 |
| HPV16 | E2 | 8 | 136 | HIYICEEA | 24632 |
| HPV16 | E2 | 10 | 136 | HIYICEEASV | 24633 |
| HPV16 | E2 | 8 | 214 | HLANHPAA | 24634 |
| HPV16 | E2 | 9 | 290 | HLKGDANTL | 24635 |
| HPV16 | E2 | 8 | 35 | HMRLECAI | 24636 |
| HPV16 | E2 | 9 | 35 | HMRLECAIY | 24637 |
| HPV16 | E2 | 10 | 35 | HMRLECAIYY | 24638 |
| HPV16 | E2 | 9 | 218 | HPAATHTKA | 24639 |
| HPV16 | E2 | 10 | 218 | HPAATHTKAV | 24640 |
| HPV16 | E2 | 11 | 218 | HPAATHTKAVA | 24641 |
| HPV16 | E2 | 8 | 56 | HQVVPTLA | 24642 |
| HPV16 | E2 | 9 | 56 | HQVVPTLAV | 24643 |
| HPV16 | E2 | 11 | 210 | IIRQHLANHPA | 24644 |
| HPV16 | E2 | 8 | 193 | ILCPTSVF | 24645 |
| HPV16 | E2 | 11 | 352 | IPKTITVSTGF | 24646 |
| HPV16 | E2 | 8 | 288 | IVHLKGDA | 24647 |
| HPV16 | E2 | 11 | 288 | IVHLKGDANTL | 24648 |
| HPV16 | E2 | 10 | 332 | IVTLTYDSEW | 24649 |
| HPV16 | E2 | 8 | 351 | KIPKTITV | 24650 |
| HPV16 | E2 | 8 | 255 | KLLHRDSV | 24651 |
| HPV16 | E2 | 11 | 255 | KLLHRDSVDSA | 24652 |
| HPV16 | E2 | 11 | 182 | KVWEVHAGGQV | 24653 |
| HPV16 | E2 | 10 | 256 | LLHRDSVDSA | 24654 |
| HPV16 | E2 | 8 | 70 | LQAIELQL | 24655 |
| HPV16 | E2 | 10 | 70 | LQAIELQLTL | 24656 |
| HPV16 | E2 | 8 | 94 | LQDVSLEV | 24657 |
| HPV16 | E2 | 9 | 94 | LQDVSLEVY | 24658 |
| HPV16 | E2 | 10 | 94 | LQDVSLEVYL | 24659 |
| HPV16 | E2 | 8 | 75 | LQLTLETI | 24660 |
| HPV16 | E2 | 9 | 75 | LQLTLETIY | 24661 |
| HPV16 | E2 | 8 | 249 | NPCHTTKL | 24662 |
| HPV16 | E2 | 9 | 249 | NPCHTTKLL | 24663 |
| HPV16 | E2 | 8 | 9 | NVCQDKIL | 24664 |
| HPV16 | E2 | 11 | 9 | NVCQDKILTHY | 24665 |
| HPV16 | E2 | 8 | 325 | NVKHKSAI | 24666 |
| HPV16 | E2 | 9 | 325 | NVKHKSAIV | 24667 |
| HPV16 | E2 | 11 | 325 | NVKHKSAIVTL | 24668 |
| HPV16 | E2 | 9 | 287 | PIVHLKGDA | 24669 |
| HPV16 | E2 | 8 | 76 | QLTLETIY | 24670 |
| HPV16 | E2 | 8 | 151 | QVDYYGLY | 24671 |
| HPV16 | E2 | 9 | 151 | QVDYYGLYY | 24672 |
| HPV16 | E2 | 10 | 151 | QVDYYGLYYV | 24673 |
| HPV16 | E2 | 9 | 191 | QVILCPTSV | 24674 |
| HPV16 | E2 | 10 | 191 | QVILCPTSVF | 24675 |
| HPV16 | E2 | 8 | 349 | QVKIPKTI | 24676 |
| HPV16 | E2 | 10 | 349 | QVKIPKTITV | 24677 |
| HPV16 | E2 | 8 | 57 | QVVPTLAV | 24678 |
| HPV16 | E2 | 11 | 278 | RINCNSNTTPI | 24679 |
| HPV16 | E2 | 8 | 37 | RLECAIYY | 24680 |
| HPV16 | E2 | 10 | 37 | RLECAIYYKA | 24681 |
| HPV16 | E2 | 9 | 7 | RLNVCQDKI | 24682 |
| HPV16 | E2 | 10 | 7 | RLNVCQDKIL | 24683 |
| HPV16 | E2 | 9 | 212 | RQHLANHPA | 24684 |

TABLE XIV-continued

B62 Supermotif Peptides

| Type | Protein | No. of Amino Acid | Position | Sequence | Seq. Id. No. |
|---|---|---|---|---|---|
| HPV16 | E2 | 10 | 212 | RQHLANHPAA | 24685 |
| HPV16 | E2 | 8 | 98 | SLEVYLTA | 24686 |
| HPV16 | E2 | 9 | 207 | SPEIIRQHL | 24687 |
| HPV16 | E2 | 10 | 207 | SPEIIRQHLA | 24688 |
| HPV16 | E2 | 9 | 348 | SQVKIPKTI | 24689 |
| HPV16 | E2 | 11 | 348 | SQVKIPKTITV | 24690 |
| HPV16 | E2 | 8 | 85 | SQYSNEKW | 24691 |
| HPV16 | E2 | 10 | 85 | SQYSNEKWTL | 24692 |
| HPV16 | E2 | 8 | 261 | SVDSAPIL | 24693 |
| HPV16 | E2 | 10 | 261 | SVDSAPILTA | 24694 |
| HPV16 | E2 | 11 | 261 | SVDSAPILTAF | 24695 |
| HPV16 | E2 | 8 | 198 | SVFSSNEV | 24696 |
| HPV16 | E2 | 9 | 144 | SVTVVEGQV | 24697 |
| HPV16 | E2 | 11 | 144 | SVTVVEGQVDY | 24698 |
| HPV16 | E2 | 8 | 355 | TITVSTGF | 24699 |
| HPV16 | E2 | 9 | 355 | TITVSTGFM | 24700 |
| HPV16 | E2 | 11 | 355 | TITVSTGFMSI | 24701 |
| HPV16 | E2 | 9 | 61 | TLAVSKNKA | 24702 |
| HPV16 | E2 | 10 | 61 | TLAVSKNKAL | 24703 |
| HPV16 | E2 | 8 | 3 | TLCQRLNV | 24704 |
| HPV16 | E2 | 10 | 78 | TLETIYNSQY | 24705 |
| HPV16 | E2 | 9 | 297 | TLKCLRYRF | 24706 |
| HPV16 | E2 | 9 | 93 | TLQDVSLEV | 24707 |
| HPV16 | E2 | 10 | 93 | TLQDVSLEVY | 24708 |
| HPV16 | E2 | 11 | 93 | TLQDVSLEVYL | 24709 |
| HPV16 | E2 | 8 | 334 | TLTYDSEW | 24710 |
| HPV16 | E2 | 10 | 310 | TLYTAVSSTW | 24711 |
| HPV16 | E2 | 10 | 128 | TMHYTNWTHI | 24712 |
| HPV16 | E2 | 11 | 128 | TMHYTNWTHIY | 24713 |
| HPV16 | E2 | 10 | 286 | TPIVHLKGDA | 24714 |
| HPV16 | E2 | 10 | 116 | TVEVQFDGDI | 24715 |
| HPV16 | E2 | 9 | 357 | TVSTGFMSI | 24716 |
| HPV16 | E2 | 9 | 146 | TVVEGQVDY | 24717 |
| HPV16 | E2 | 10 | 146 | TVVEGQVDYY | 24718 |
| HPV16 | E2 | 8 | 192 | VILCPTSV | 24719 |
| HPV16 | E2 | 9 | 192 | VILCPTSVF | 24720 |
| HPV16 | E2 | 11 | 59 | VPTLAVSKNKA | 24721 |
| HPV16 | E2 | 11 | 119 | VQFDGDICNTM | 24722 |
| HPV16 | E2 | 10 | 169 | VQFKDDAEKY | 24723 |
| HPV16 | E2 | 8 | 147 | VVEGQVDY | 24724 |
| HPV16 | E2 | 9 | 147 | VVEGQVDYY | 24725 |
| HPV16 | E2 | 11 | 147 | VVEGQVDYYGL | 24726 |
| HPV16 | E2 | 10 | 341 | WQRDQFLSQV | 24727 |
| HPV16 | E2 | 8 | 138 | YICEEASV | 24728 |
| HPV16 | E2 | 10 | 138 | YICEEASVTV | 24729 |
| HPV16 | E2 | 11 | 138 | YICEEASVTVV | 24730 |
| HPV16 | E2 | 9 | 102 | YLTAPTGCI | 24731 |
| HPV16 | E2 | 9 | 159 | YVHEGIRTY | 24732 |
| HPV16 | E2 | 10 | 159 | YVHEGIRTYF | 24733 |
| HPV16 | E2 | 11 | 159 | YVHEGIRTYFV | 24734 |
| HPV16 | E5 | 8 | 26 | CLLIRPLL | 24735 |
| HPV16 | E5 | 9 | 26 | CLLIRPLLL | 24736 |
| HPV16 | E5 | 11 | 26 | CLLIRPLLLSV | 24737 |
| HPV16 | E5 | 9 | 24 | CVCLLIRPL | 24738 |
| HPV16 | E5 | 10 | 24 | CVCLLIRPLL | 24739 |
| HPV16 | E5 | 11 | 24 | CVCLLIRPLLL | 24740 |
| HPV16 | E5 | 8 | 20 | CVLLCVCL | 24741 |
| HPV16 | E5 | 9 | 20 | CVLLCVCLL | 24742 |
| HPV16 | E5 | 10 | 20 | CVLLCVCLLI | 24743 |
| HPV16 | E5 | 8 | 60 | FIVYIIFV | 24744 |
| HPV16 | E5 | 9 | 60 | FIVYIIFVY | 24745 |
| HPV16 | E5 | 10 | 60 | FIVYIIFVYI | 24746 |
| HPV16 | E5 | 9 | 72 | FLIHTHARF | 24747 |
| HPV16 | E5 | 10 | 72 | FLIHTHARFL | 24748 |
| HPV16 | E5 | 11 | 72 | FLIRTHARFLI | 24749 |
| HPV16 | E5 | 8 | 15 | FLLCFCVL | 24750 |
| HPV16 | E5 | 9 | 15 | FLLCFCVLL | 24751 |
| HPV16 | E5 | 11 | 15 | FLLCFCVLLCV | 24752 |
| HPV16 | E5 | 8 | 66 | FVYIPLFL | 24753 |
| HPV16 | E5 | 9 | 66 | FVYIPLFLI | 24754 |
| HPV16 | E5 | 8 | 64 | IIFVYIPL | 24755 |
| HPV16 | E5 | 9 | 64 | IIFVYIPLF | 24756 |
| HPV16 | E5 | 10 | 64 | IIFVYIPLFL | 24757 |
| HPV16 | E5 | 11 | 64 | IIFVYIPLFLI | 24758 |
| HPV16 | E5 | 8 | 43 | IILVLLLW | 24759 |

TABLE XIV-continued

B62 Supermotif Peptides

| Type | Protein | No. of Amino Acid | Position | Sequence | Seq. Id. No. |
|---|---|---|---|---|---|
| HPV16 | E5 | 9 | 43 | IILVLLLWI | 24760 |
| HPV16 | E5 | 11 | 43 | IILVLLLWITA | 24761 |
| HPV16 | E5 | 8 | 44 | ILVLLLWI | 24762 |
| HPV16 | E5 | 10 | 44 | ILVLLLWITA | 24763 |
| HPV16 | E5 | 11 | 44 | ILVLLLWITAA | 24764 |
| HPV16 | E5 | 10 | 69 | IPLFLIHTHA | 24765 |
| HPV16 | E5 | 8 | 61 | IVYIIFVY | 24766 |
| HPV16 | E5 | 9 | 61 | IVYIIFVYI | 24767 |
| HPV16 | E5 | 11 | 61 | IVYIIFVYIPL | 24768 |
| HPV16 | E5 | 8 | 73 | LIHTHARF | 24769 |
| HPV16 | E5 | 9 | 73 | LIHTHARFL | 24770 |
| HPV16 | E5 | 10 | 73 | LIHTHARFLI | 24771 |
| HPV16 | E5 | 8 | 42 | LIILVLLL | 24772 |
| HPV16 | E5 | 9 | 42 | LIILVLLLW | 24773 |
| HPV16 | E5 | 10 | 42 | LIILVLLLWI | 24774 |
| HPV16 | E5 | 9 | 28 | LIRPLLLSV | 24775 |
| HPV16 | E5 | 9 | 11 | LLACFLLCF | 24776 |
| HPV16 | E5 | 11 | 11 | LLACFLLCFCV | 24777 |
| HPV16 | E5 | 8 | 16 | LLCFCVLL | 24778 |
| HPV16 | E5 | 10 | 16 | LLCFCVLLCV | 24779 |
| HPV16 | E5 | 8 | 22 | LLCVCLLI | 24780 |
| HPV16 | E5 | 11 | 22 | LLCVCLLIRPL | 24781 |
| HPV16 | E5 | 8 | 27 | LLIRPLLL | 24782 |
| HPV16 | E5 | 10 | 27 | LLIRPLLLSV | 24783 |
| HPV16 | E5 | 8 | 32 | LLLSVSTY | 24784 |
| HPV16 | E5 | 11 | 32 | LLLSVSTYTSL | 24785 |
| HPV16 | E5 | 8 | 47 | LLLWITAA | 24786 |
| HPV16 | E5 | 10 | 47 | LLLWITAASA | 24787 |
| HPV16 | E5 | 11 | 47 | LLLWITAASAF | 24788 |
| HPV16 | E5 | 10 | 33 | LLSVSTYTSL | 24789 |
| HPV16 | E5 | 11 | 33 | LLSVSTYTSLI | 24790 |
| HPV16 | E5 | 9 | 48 | LLWITAASA | 24791 |
| HPV16 | E5 | 10 | 48 | LLWITAASAF | 24792 |
| HPV16 | E5 | 9 | 45 | LVLLLWITA | 24793 |
| HPV16 | E5 | 10 | 45 | LVLLLWITAA | 24794 |
| HPV16 | E5 | 9 | 3 | NLDTASTTL | 24795 |
| HPV16 | E5 | 10 | 3 | NLDTASTTLL | 24796 |
| HPV16 | E5 | 11 | 3 | NLDTASTTLLA | 24797 |
| HPV16 | E5 | 9 | 70 | PLFLIHTHA | 24798 |
| HPV16 | E5 | 11 | 70 | PLFLIHTHARF | 24799 |
| HPV16 | E5 | 9 | 31 | PLLLSVSTY | 24800 |
| HPV16 | E5 | 10 | 30 | RPLLLSVSTY | 24801 |
| HPV16 | E5 | 8 | 41 | SLIILVLL | 24802 |
| HPV16 | E5 | 9 | 41 | SLIILVLLL | 24803 |
| HPV16 | E5 | 10 | 41 | SLIILVLLLW | 24804 |
| HPV16 | E5 | 11 | 41 | SLIILVLLLWI | 24805 |
| HPV16 | E5 | 8 | 35 | SVSTYTSL | 24806 |
| HPV16 | E5 | 9 | 35 | SVSTYTSLI | 24807 |
| HPV16 | E5 | 10 | 35 | SVSTYTSLII | 24808 |
| HPV16 | E5 | 11 | 35 | SVSTYTSLIIL | 24809 |
| HPV16 | E5 | 8 | 10 | TLLACFLL | 24810 |
| HPV16 | E5 | 10 | 10 | TLLACFLLCF | 24811 |
| HPV16 | E5 | 8 | 21 | VLLCVCLL | 24812 |
| HPV16 | E5 | 9 | 21 | VLLCVCLLI | 24813 |
| HPV16 | E5 | 8 | 46 | VLLLWITA | 24814 |
| HPV16 | E5 | 9 | 46 | VLLLWITAA | 24815 |
| HPV16 | E5 | 11 | 46 | VLLLWITAASA | 24816 |
| HPV16 | E5 | 8 | 50 | WITAASAF | 24817 |
| HPV16 | E5 | 11 | 50 | WITAASAFRCF | 24818 |
| HPV16 | E5 | 9 | 63 | YIIFVYIPL | 24819 |
| HPV16 | E5 | 10 | 63 | YIIFVYIPLF | 24820 |
| HPV16 | E5 | 11 | 63 | YIIFVYIPLFL | 24821 |
| HPV16 | E5 | 11 | 68 | YIPLFLIHTHA | 24822 |
| HPV16 | E6 | 9 | 68 | AVCDKCLKF | 24823 |
| HPV16 | E6 | 10 | 68 | AVCDKCLKFY | 24824 |
| HPV16 | E6 | 8 | 110 | CINCQKPL | 24825 |
| HPV16 | E6 | 10 | 58 | CIVYRDGNPY | 24826 |
| HPV16 | E6 | 11 | 58 | CIVYRDGNPYA | 24827 |
| HPV16 | E6 | 8 | 73 | CLKFYSKI | 24828 |
| HPV16 | E6 | 11 | 73 | CLKFYSKISEY | 24829 |
| HPV16 | E6 | 9 | 118 | CPEEKQRHL | 24830 |
| HPV16 | E6 | 8 | 37 | CVYCKQQL | 24831 |
| HPV16 | E6 | 9 | 37 | CVYCKQQLL | 24832 |
| HPV16 | E6 | 8 | 32 | DIILECVY | 24833 |
| HPV16 | E6 | 9 | 11 | DPQERPRKL | 24834 |

TABLE XIV-continued

B62 Supermotif Peptides

| Type | Protein | No. of Amino Acid | Position | Sequence | Seq. Id. No. |
|---|---|---|---|---|---|
| HPV16 | E6 | 9 | 25 | ELQTTIHDI | 24835 |
| HPV16 | E6 | 10 | 25 | ELQTTIHDII | 24836 |
| HPV16 | E6 | 11 | 25 | ELQTTIHDIIL | 24837 |
| HPV16 | E6 | 8 | 96 | EQQYNKPL | 24838 |
| HPV16 | E6 | 11 | 96 | EQQYNKPLCDL | 24839 |
| HPV16 | E6 | 10 | 48 | EVYDFAFRDL | 24840 |
| HPV16 | E6 | 11 | 9 | FQDPQERPRKL | 24841 |
| HPV16 | E6 | 8 | 125 | HLDKKQRF | 24842 |
| HPV16 | E6 | 11 | 125 | HLDKKQRFHNI | 24843 |
| HPV16 | E6 | 8 | 2 | HQKRTAMF | 24844 |
| HPV16 | E6 | 11 | 34 | ILECVYCKQQL | 24845 |
| HPV16 | E6 | 9 | 59 | IVYRDGNPY | 24846 |
| HPV16 | E6 | 10 | 59 | IVYRDGNPYA | 24847 |
| HPV16 | E6 | 11 | 59 | IVYRDGNPYAV | 24848 |
| HPV16 | E6 | 8 | 79 | KISEYRHY | 24849 |
| HPV16 | E6 | 10 | 79 | KISEYRHYCY | 24850 |
| HPV16 | E6 | 9 | 18 | KLPQLCTEL | 24851 |
| HPV16 | E6 | 8 | 101 | KPLCDLLI | 24852 |
| HPV16 | E6 | 11 | 101 | KPLCDLLIRCI | 24853 |
| HPV16 | E6 | 9 | 41 | KQQLLRREV | 24854 |
| HPV16 | E6 | 10 | 41 | KQQLLRREVY | 24855 |
| HPV16 | E6 | 11 | 129 | KQRFHNIRGRW | 24856 |
| HPV16 | E6 | 11 | 122 | KQRHLDKKQRF | 24857 |
| HPV16 | E6 | 11 | 107 | LIRCINCQKPL | 24858 |
| HPV16 | E6 | 9 | 44 | LLRREVYDF | 24859 |
| HPV16 | E6 | 10 | 44 | LLRREVYDFA | 24860 |
| HPV16 | E6 | 11 | 44 | LLRREVYDFAF | 24861 |
| HPV16 | E6 | 8 | 19 | LPQLCTEL | 24862 |
| HPV16 | E6 | 8 | 26 | LQTTIHDI | 24863 |
| HPV16 | E6 | 9 | 26 | LQTTIHDII | 24864 |
| HPV16 | E6 | 10 | 26 | LQTTIHDIIL | 24865 |
| HPV16 | E6 | 11 | 134 | NIRGRWTGRCM | 24866 |
| HPV16 | E6 | 10 | 65 | NPYAVCDKCL | 24867 |
| HPV16 | E6 | 10 | 102 | PLCDLLIRCI | 24868 |
| HPV16 | E6 | 11 | 116 | PLCPEEKQRHL | 24869 |
| HPV16 | E6 | 8 | 12 | PQERPRKL | 24870 |
| HPV16 | E6 | 11 | 12 | PQERPRKLPQL | 24871 |
| HPV16 | E6 | 11 | 20 | PQLCTELQTTI | 24872 |
| HPV16 | E6 | 10 | 21 | QLCTELQTTI | 24873 |
| HPV16 | E6 | 8 | 43 | QLLRREVY | 24874 |
| HPV16 | E6 | 10 | 43 | QLLRREVYDF | 24875 |
| HPV16 | E6 | 11 | 43 | QLLRREVYDFA | 24876 |
| HPV16 | E6 | 8 | 42 | QQLLRREV | 24877 |
| HPV16 | E6 | 9 | 42 | QQLLRREVY | 24878 |
| HPV16 | E6 | 11 | 42 | QQLLRREVYDF | 24879 |
| HPV16 | E6 | 10 | 97 | QQYNKPLCDL | 24880 |
| HPV16 | E6 | 11 | 97 | QQYNKPLCDLL | 24881 |
| HPV16 | E6 | 8 | 15 | RPRKLPQL | 24882 |
| HPV16 | E6 | 11 | 89 | SLYGTTLEQQY | 24883 |
| HPV16 | E6 | 10 | 29 | TIHDIILECV | 24884 |
| HPV16 | E6 | 11 | 29 | TIHDIILECVY | 24885 |
| HPV16 | E6 | 10 | 94 | TLEQQYNKPL | 24886 |
| HPV16 | E7 | 9 | 68 | CVQSTHVDI | 24887 |
| HPV16 | E7 | 8 | 75 | DIRTLEDL | 24888 |
| HPV16 | E7 | 9 | 75 | DIRTLEDLL | 24889 |
| HPV16 | E7 | 10 | 75 | DIRTLEDLLM | 24890 |
| HPV16 | E7 | 9 | 81 | DLLMGTLGI | 24891 |
| HPV16 | E7 | 10 | 81 | DLLMGTLGIV | 24892 |
| HPV16 | E7 | 9 | 14 | DLQPETTDL | 24893 |
| HPV16 | E7 | 10 | 14 | DLQPETTDLY | 24894 |
| HPV16 | E7 | 8 | 21 | DLYCYEQL | 24895 |
| HPV16 | E7 | 9 | 37 | EIDGPAGQA | 24896 |
| HPV16 | E7 | 9 | 46 | EPDRAHYNI | 24897 |
| HPV16 | E7 | 10 | 46 | EPDRAHYNIV | 24898 |
| HPV16 | E7 | 11 | 40 | GPAGQAEPDRA | 24899 |
| HPV16 | E7 | 8 | 43 | GQAEPDRA | 24900 |
| HPV16 | E7 | 10 | 43 | GQAEPDRAHY | 24901 |
| HPV16 | E7 | 10 | 73 | HVDIRTLEDL | 24902 |
| HPV16 | E7 | 11 | 73 | HVDIRTLEDLL | 24903 |
| HPV16 | E7 | 8 | 82 | LLMGTLGI | 24904 |
| HPV16 | E7 | 9 | 82 | LLMGTLGIV | 24905 |
| HPV16 | E7 | 8 | 83 | LMGTLGIV | 24906 |
| HPV16 | E7 | 11 | 83 | LMGTLGIVCPI | 24907 |
| HPV16 | E7 | 8 | 15 | LQPETTDL | 24908 |
| HPV16 | E7 | 9 | 15 | LQPETTDLY | 24909 |

TABLE XIV-continued

B62 Supermotif Peptides

| Type | Protein | No. of Amino Acid | Position | Sequence | Seq. Id. No. |
|---|---|---|---|---|---|
| HPV16 | E7 | 11 | 15 | LQPETTDLYCY | 24910 |
| HPV16 | E7 | 11 | 12 | MLDLQPETTDL | 24911 |
| HPV16 | E7 | 8 | 16 | QPETTDLY | 24912 |
| HPV16 | E7 | 10 | 16 | QPETTDLYCY | 24913 |
| HPV16 | E7 | 9 | 66 | RLCVQSTHV | 24914 |
| HPV16 | E7 | 11 | 66 | RLCVQSTHVDI | 24915 |
| HPV16 | E7 | 10 | 78 | TLEDLLMGTL | 24916 |
| HPV16 | E7 | 8 | 86 | TLGIVCPI | 24917 |
| HPV16 | E7 | 9 | 7 | TLHEYMLDL | 24918 |
| HPV16 | E7 | 11 | 64 | TLRLCVQSTHV | 24919 |
| HPV16 | E7 | 8 | 5 | TPTLHEYM | 24920 |
| HPV16 | E7 | 9 | 5 | TPTLHEYML | 24921 |
| HPV16 | E7 | 11 | 5 | TPTLHEYMLDL | 24922 |
| HPV16 | E7 | 8 | 69 | VQSTHVDI | 24923 |
| HPV16 | E7 | 11 | 69 | VQSTHVDIRTL | 24924 |
| HPV16 | L1 | 11 | 451 | AIACQKHTPPA | 24925 |
| HPV16 | L1 | 9 | 373 | AISTSETTY | 24926 |
| HPV16 | L1 | 9 | 233 | AMDFTTLQA | 24927 |
| HPV16 | L1 | 10 | 461 | APKEDPLKKY | 24928 |
| HPV16 | L1 | 8 | 342 | AQGHNNGI | 24929 |
| HPV16 | L1 | 10 | 342 | AQGHNNGICW | 24930 |
| HPV16 | L1 | 8 | 330 | AQIFNKPY | 24931 |
| HPV16 | L1 | 9 | 330 | AQIFNKPYW | 24932 |
| HPV16 | L1 | 10 | 330 | AQIFNKPYWL | 24933 |
| HPV16 | L1 | 10 | 292 | AVGENVPDDL | 24934 |
| HPV16 | L1 | 11 | 292 | AVGENVPDDLY | 24935 |
| HPV16 | L1 | 9 | 70 | AVGHPYFPI | 24936 |
| HPV16 | L1 | 10 | 205 | AVNPGDCPPL | 24937 |
| HPV16 | L1 | 11 | 172 | CISMDYKQTQL | 24938 |
| HPV16 | L1 | 9 | 183 | CLIGCKPPI | 24939 |
| HPV16 | L1 | 10 | 211 | CPPLELINTV | 24940 |
| HPV16 | L1 | 11 | 211 | CPPLELINTVI | 24941 |
| HPV16 | L1 | 8 | 454 | CQKHTPPA | 24942 |
| HPV16 | L1 | 9 | 249 | DICTSICKY | 24943 |
| HPV16 | L1 | 11 | 484 | DLDQFPLGRKF | 24944 |
| HPV16 | L1 | 8 | 397 | DLQFIFQL | 24945 |
| HPV16 | L1 | 11 | 397 | DLQFIFQLCKI | 24946 |
| HPV16 | L1 | 11 | 300 | DLYIKGSGSTA | 24947 |
| HPV16 | L1 | 9 | 225 | DMVDTGFGA | 24948 |
| HPV16 | L1 | 10 | 225 | DMVDTGFGAM | 24949 |
| HPV16 | L1 | 8 | 465 | DPLKKYTF | 24950 |
| HPV16 | L1 | 9 | 465 | KPLKKYTFW | 24951 |
| HPV16 | L1 | 11 | 465 | DPLKKYTFWEV | 24952 |
| HPV16 | L1 | 9 | 486 | DQFPLGRKF | 24953 |
| HPV16 | L1 | 10 | 486 | DQFPLGRKFL | 24954 |
| HPV16 | L1 | 11 | 486 | DQFPLGRKFLL | 24955 |
| HPV16 | L1 | 9 | 412 | DVMTYIHSM | 24956 |
| HPV16 | L1 | 8 | 17 | DVNVYHIF | 24957 |
| HPV16 | L1 | 9 | 17 | DVNVYHIFF | 24958 |
| HPV16 | L1 | 11 | 17 | DVNVYHIFFQM | 24959 |
| HPV16 | L1 | 8 | 266 | EPYGDSLF | 24960 |
| HPV16 | L1 | 9 | 266 | EPYGDSLFF | 24961 |
| HPV16 | L1 | 10 | 266 | EPYGDSLFFY | 24962 |
| HPV16 | L1 | 11 | 266 | EPYGDSLFFYL | 24963 |
| HPV16 | L1 | 8 | 279 | EQMFVRHL | 24964 |
| HPV16 | L1 | 9 | 279 | EQMFVRHLF | 24965 |
| HPV16 | L1 | 8 | 132 | EVGRGQPL | 24966 |
| HPV16 | L1 | 10 | 132 | EVGRGQPLGV | 24967 |
| HPV16 | L1 | 8 | 474 | EVNLKEKF | 24968 |
| HPV16 | L1 | 10 | 474 | EVNLKEKFSA | 24969 |
| HPV16 | L1 | 10 | 245 | EVPLDICTSI | 24970 |
| HPV16 | L1 | 8 | 400 | FIFQLCKI | 24971 |
| HPV16 | L1 | 10 | 400 | FIFQLCKITL | 24972 |
| HPV16 | L1 | 10 | 5 | FIYILVITCY | 24973 |
| HPV16 | L1 | 9 | 494 | FLLQAGLKA | 24974 |
| HPV16 | L1 | 11 | 76 | FPIKKPNNNKI | 24975 |
| HPV16 | L1 | 8 | 488 | FPLGRKFL | 24976 |
| HPV16 | L1 | 9 | 488 | FPLGRKFLL | 24977 |
| HPV16 | L1 | 11 | 488 | FPLGRKFLLQA | 24978 |
| HPV16 | L1 | 8 | 318 | FPTPSGSM | 24979 |
| HPV16 | L1 | 9 | 318 | FPTPSGSMV | 24980 |
| HPV16 | L1 | 8 | 402 | FQLCKITL | 24981 |
| HPV16 | L1 | 10 | 402 | FQLCKITLTA | 24982 |
| HPV16 | L1 | 11 | 25 | FQMSLWLPSEA | 24983 |
| HPV16 | L1 | 9 | 282 | FVRHLFNRA | 24984 |

TABLE XIV-continued

B62 Supermotif Peptides

| Type | Protein | No. of Amino Acid | Position | Sequence | Seq. Id. No. |
|---|---|---|---|---|---|
| HPV16 | L1 | 11 | 282 | FVRHLFNRAGA | 24985 |
| HPV16 | L1 | 8 | 446 | FVTSQAIA | 24986 |
| HPV16 | L1 | 8 | 348 | GICWGNQL | 24987 |
| HPV16 | L1 | 9 | 348 | GICWGNQLF | 24988 |
| HPV16 | L1 | 10 | 348 | GICWGNQLFV | 24989 |
| HPV16 | L1 | 8 | 142 | GISGHPLL | 24990 |
| HPV16 | L1 | 11 | 142 | GISGHPLLNKL | 24991 |
| HPV16 | L1 | 8 | 499 | GLKAKPKF | 24992 |
| HPV16 | L1 | 10 | 499 | GLKAKPKFTL | 24993 |
| HPV16 | L1 | 10 | 431 | GLQPPPGGTL | 24994 |
| HPV16 | L1 | 9 | 93 | GLQYRVFRI | 24995 |
| HPV16 | L1 | 11 | 93 | GLQYRVFRIHL | 24996 |
| HPV16 | L1 | 8 | 136 | GQPLGVGI | 24997 |
| HPV16 | L1 | 8 | 166 | GVDNRECI | 24998 |
| HPV16 | L1 | 10 | 166 | GVDNRECISM | 24999 |
| HPV16 | L1 | 10 | 130 | GVEVGRGQPL | 25000 |
| HPV16 | L1 | 9 | 140 | GVGISGHPL | 25001 |
| HPV16 | L1 | 10 | 140 | GVGISGHPLL | 25002 |
| HPV16 | L1 | 8 | 22 | HIFFQMSL | 25003 |
| HPV16 | L1 | 9 | 22 | HIFFQMSLW | 25004 |
| HPV16 | L1 | 10 | 22 | HIFFQMSLWL | 25005 |
| HPV16 | L1 | 8 | 285 | HLFNRAGA | 25006 |
| HPV16 | L1 | 9 | 285 | HLFNRAGAV | 25007 |
| HPV16 | L1 | 8 | 102 | HLPDPNKF | 25008 |
| HPV16 | L1 | 10 | 102 | HLPDPNKFGF | 25009 |
| HPV16 | L1 | 9 | 424 | ILEDWNFGL | 25010 |
| HPV16 | L1 | 11 | 8 | ILVITCYENDV | 25011 |
| HPV16 | L1 | 9 | 86 | ILVPKVSGL | 25012 |
| HPV16 | L1 | 11 | 86 | ILVPKVSGLQY | 25013 |
| HPV16 | L1 | 11 | 221 | IQDGDMVDTGF | 25014 |
| HPV16 | L1 | 10 | 85 | KILVPKVSGL | 25015 |
| HPV16 | L1 | 8 | 406 | KITLTADV | 25016 |
| HPV16 | L1 | 9 | 406 | KITLTADVM | 25017 |
| HPV16 | L1 | 11 | 406 | KITLTADVMTY | 25018 |
| HPV16 | L1 | 8 | 151 | KLDDTENA | 25019 |
| HPV16 | L1 | 10 | 151 | KLDDTENASA | 25020 |
| HPV16 | L1 | 11 | 151 | KLDDTENASAY | 25021 |
| HPV16 | L1 | 11 | 262 | KMVSEPYGDSL | 25022 |
| HPV16 | L1 | 11 | 503 | KPKFTLGKRKA | 25023 |
| HPV16 | L1 | 8 | 80 | KPNNNKIL | 25024 |
| HPV16 | L1 | 9 | 80 | KPNNNKILV | 25025 |
| HPV16 | L1 | 8 | 188 | KPPIGEHW | 25026 |
| HPV16 | L1 | 8 | 335 | KPYWLQRA | 25027 |
| HPV16 | L1 | 8 | 178 | KQTQLCLI | 25028 |
| HPV16 | L1 | 9 | 90 | KVSGLQYRV | 25029 |
| HPV16 | L1 | 10 | 90 | KVSGLQYRVF | 25030 |
| HPV16 | L1 | 8 | 46 | KVVSTDEY | 25031 |
| HPV16 | L1 | 9 | 46 | KVVSTDEYV | 25032 |
| HPV16 | L1 | 10 | 46 | KVVSTDEYVA | 25033 |
| HPV16 | L1 | 8 | 184 | LIGCKPPI | 25034 |
| HPV16 | L1 | 11 | 216 | LINTVIQDGDM | 25035 |
| HPV16 | L1 | 8 | 68 | LLAVGHPY | 25036 |
| HPV16 | L1 | 9 | 68 | LLAVGHPYF | 25037 |
| HPV16 | L1 | 11 | 68 | LLAVGHPYFPI | 25038 |
| HPV16 | L1 | 11 | 148 | LLNKLDDTENA | 25039 |
| HPV16 | L1 | 8 | 495 | LLQAGLKA | 25040 |
| HPV16 | L1 | 9 | 103 | LPDPNKFGF | 25041 |
| HPV16 | L1 | 9 | 39 | LPPVPVSKV | 25042 |
| HPV16 | L1 | 10 | 39 | LPPVPVSKVV | 25043 |
| HPV16 | L1 | 8 | 31 | LPSEATVY | 25044 |
| HPV16 | L1 | 9 | 31 | LPSEATVYL | 25045 |
| HPV16 | L1 | 11 | 496 | LQAGLKAKPKF | 25046 |
| HPV16 | L1 | 8 | 239 | LQANKSEV | 25047 |
| HPV16 | L1 | 10 | 239 | LQANKSEVPL | 25048 |
| HPV16 | L1 | 10 | 398 | LQFIFQLCKI | 25049 |
| HPV16 | L1 | 9 | 432 | LQPPPGGTL | 25050 |
| HPV16 | L1 | 11 | 339 | LQRAQGHNNGI | 25051 |
| HPV16 | L1 | 8 | 94 | LQYRVFRI | 25052 |
| HPV16 | L1 | 10 | 94 | LQYRVFRIHL | 25053 |
| HPV16 | L1 | 10 | 9 | LVITCYENDV | 25054 |
| HPV16 | L1 | 8 | 87 | LVPKVSGL | 25055 |
| HPV16 | L1 | 10 | 87 | LVPKVSGLQY | 25056 |
| HPV16 | L1 | 8 | 124 | LVWACVGV | 25057 |
| HPV16 | L1 | 10 | 124 | LVWACVGVEV | 25058 |
| HPV16 | L1 | 8 | 1 | MQVTFIYI | 25059 |

TABLE XIV-continued

B62 Supermotif Peptides

| Type | Protein | No. of Amino Acid | Position | Sequence | Seq. Id. No. |
|---|---|---|---|---|---|
| HPV16 | L1 | 9 | 1 | MQVTFIYIL | 25060 |
| HPV16 | L1 | 10 | 1 | MQVTFIYILV | 25061 |
| HPV16 | L1 | 11 | 1 | MQVTFIYILVI | 25062 |
| HPV16 | L1 | 8 | 226 | MVDTGFGA | 25063 |
| HPV16 | L1 | 9 | 226 | MVDTGFGAM | 25064 |
| HPV16 | L1 | 11 | 226 | MVDTGFGAMDF | 25065 |
| HPV16 | L1 | 10 | 263 | MVSEPYGDSL | 25066 |
| HPV16 | L1 | 11 | 263 | MVSEPYGDSLF | 25067 |
| HPV16 | L1 | 8 | 325 | MVTSDAQI | 25068 |
| HPV16 | L1 | 9 | 325 | MVTSDAQIF | 25069 |
| HPV16 | L1 | 11 | 58 | NIYYHAGTSRL | 25070 |
| HPV16 | L1 | 8 | 311 | NLASSNYF | 25071 |
| HPV16 | L1 | 8 | 476 | NLKEKFSA | 25072 |
| HPV16 | L1 | 10 | 476 | NLKEKFSADL | 25073 |
| HPV16 | L1 | 8 | 367 | NMSLCAAI | 25074 |
| HPV16 | L1 | 8 | 118 | NPDTQRLV | 25075 |
| HPV16 | L1 | 9 | 118 | NPDTQRLVW | 25076 |
| HPV16 | L1 | 10 | 118 | NPDTQRLVWA | 25077 |
| HPV16 | L1 | 8 | 207 | NPGDCPPL | 25078 |
| HPV16 | L1 | 10 | 207 | NPGDCPPLEL | 25079 |
| HPV16 | L1 | 11 | 207 | NPGDCPPLELI | 25080 |
| HPV16 | L1 | 8 | 353 | NQLFVTVV | 25081 |
| HPV16 | L1 | 8 | 296 | NVPDDLYI | 25082 |
| HPV16 | L1 | 9 | 19 | NVYHIFFQM | 25083 |
| HPV16 | L1 | 11 | 19 | NVYHIFFQMSL | 25084 |
| HPV16 | L1 | 10 | 77 | PIKKPNNNKI | 25085 |
| HPV16 | L1 | 11 | 77 | PIKKPNNNKIL | 25086 |
| HPV16 | L1 | 8 | 247 | PLDICTSI | 25087 |
| HPV16 | L1 | 11 | 247 | PLDICTSICKY | 25088 |
| HPV16 | L1 | 8 | 213 | PLELINTV | 25089 |
| HPV16 | L1 | 9 | 213 | PLELINTVI | 25090 |
| HPV16 | L1 | 8 | 489 | PLGRKFLL | 25091 |
| HPV16 | L1 | 10 | 489 | PLGRKFLLQA | 25092 |
| HPV16 | L1 | 11 | 138 | PLGVGISGHPL | 25093 |
| HPV16 | L1 | 8 | 466 | PLKKYTFW | 25094 |
| HPV16 | L1 | 10 | 466 | PLKKYTFWEV | 25095 |
| HPV16 | L1 | 9 | 459 | PPAPKEDPL | 25096 |
| HPV16 | L1 | 10 | 435 | PPGGTLEDTY | 25097 |
| HPV16 | L1 | 9 | 212 | PPLELINTV | 25098 |
| HPV16 | L1 | 10 | 212 | PPLELINTVI | 25099 |
| HPV16 | L1 | 11 | 434 | PPPGGTLEDTY | 25100 |
| HPV16 | L1 | 8 | 40 | PPVPVSKV | 25101 |
| HPV16 | L1 | 9 | 40 | PPVPVSKVV | 25102 |
| HPV16 | L1 | 8 | 41 | PVPVSKVV | 25103 |
| HPV16 | L1 | 11 | 43 | PVSKVVSTDEY | 25104 |
| HPV16 | L1 | 8 | 331 | QIFNKPYW | 25105 |
| HPV16 | L1 | 9 | 331 | QIFNKPYWL | 25106 |
| HPV16 | L1 | 9 | 403 | QLCKITLTA | 25107 |
| HPV16 | L1 | 11 | 403 | QLCKITLTADV | 25108 |
| HPV16 | L1 | 11 | 181 | QLCLIGCKPPI | 25109 |
| HPV16 | L1 | 8 | 280 | QMFVRHLF | 25110 |
| HPV16 | L1 | 11 | 280 | QMFVRHLFNRA | 25111 |
| HPV16 | L1 | 10 | 26 | QMSLWLPSEA | 25112 |
| HPV16 | L1 | 8 | 433 | QPPPGGTL | 25113 |
| HPV16 | L1 | 8 | 2 | QVTFIYIL | 25114 |
| HPV16 | L1 | 9 | 2 | QVTFIYILV | 25115 |
| HPV16 | L1 | 10 | 2 | QVTFIYILVI | 25116 |
| HPV16 | L1 | 10 | 100 | RIHLPDPNKF | 25117 |
| HPV16 | L1 | 9 | 67 | RLLAVGHPY | 25118 |
| HPV16 | L1 | 10 | 67 | RLLAVGHPYF | 25119 |
| HPV16 | L1 | 9 | 123 | RLVWACVGV | 25120 |
| HPV16 | L1 | 11 | 123 | RLVWACVGVEV | 25121 |
| HPV16 | L1 | 8 | 253 | SICKYPDY | 25122 |
| HPV16 | L1 | 9 | 253 | SICKYPDYI | 25123 |
| HPV16 | L1 | 11 | 253 | SICKYPDYIKM | 25124 |
| HPV16 | L1 | 11 | 271 | SLFFYLRREQM | 25125 |
| HPV16 | L1 | 8 | 28 | SLWLPSEA | 25126 |
| HPV16 | L1 | 10 | 28 | SLWLPSEATV | 25127 |
| HPV16 | L1 | 11 | 28 | SLWLPSEATVY | 25128 |
| HPV16 | L1 | 9 | 174 | SMDYKQTQL | 25129 |
| HPV16 | L1 | 11 | 174 | SMDYKQTQLCL | 25130 |
| HPV16 | L1 | 10 | 419 | SMNSTILEDW | 25131 |
| HPV16 | L1 | 9 | 324 | SMVTSDAQI | 25132 |
| HPV16 | L1 | 10 | 324 | SMVTSDAQIF | 25133 |
| HPV16 | L1 | 8 | 199 | SPCTNVAV | 25134 |

TABLE XIV-continued

B62 Supermotif Peptides

| Type | Protein | No. of Amino Acid | Position | Sequence | Seq. Id. No. |
|---|---|---|---|---|---|
| HPV16 | L1 | 8 | 423 | TILEDWNF | 25135 |
| HPV16 | L1 | 10 | 423 | TILEDWNFGL | 25136 |
| HPV16 | L1 | 8 | 439 | TLEDTYRF | 25137 |
| HPV16 | L1 | 9 | 439 | TLEDTYRFV | 25138 |
| HPV16 | L1 | 9 | 238 | TLQANKSEV | 25139 |
| HPV16 | L1 | 11 | 238 | TLQANKSEVPL | 25140 |
| HPV16 | L1 | 9 | 408 | TLTADVMTY | 25141 |
| HPV16 | L1 | 10 | 408 | TLTADVMTYI | 25142 |
| HPV16 | L1 | 10 | 458 | TPPAPKEDPL | 25143 |
| HPV16 | L1 | 11 | 320 | TPSGSMVTSDA | 25144 |
| HPV16 | L1 | 11 | 514 | TPTTSSTSTTA | 25145 |
| HPV16 | L1 | 9 | 121 | TQRLVWACV | 25146 |
| HPV16 | L1 | 11 | 121 | TQRLVWACVGV | 25147 |
| HPV16 | L1 | 8 | 219 | TVIQDGDM | 25148 |
| HPV16 | L1 | 9 | 219 | TVIQDGDMV | 25149 |
| HPV16 | L1 | 11 | 358 | TVVDTTRSTNM | 25150 |
| HPV16 | L1 | 9 | 36 | TVYLPPVPV | 25151 |
| HPV16 | L1 | 8 | 220 | VIQDGDMV | 25152 |
| HPV16 | L1 | 9 | 10 | VITCYENDV | 25153 |
| HPV16 | L1 | 11 | 10 | VITCYENDVNV | 25154 |
| HPV16 | L1 | 8 | 413 | VMTYIHSM | 25155 |
| HPV16 | L1 | 9 | 88 | VPKVSGLQY | 25156 |
| HPV16 | L1 | 11 | 88 | VPKVSGLQYRV | 25157 |
| HPV16 | L1 | 9 | 246 | VPLDICTSI | 25158 |
| HPV16 | L1 | 10 | 359 | VVDTTRSTNM | 25159 |
| HPV16 | L1 | 8 | 47 | VVSTDEYV | 25160 |
| HPV16 | L1 | 9 | 47 | VVSTDEYVA | 25161 |
| HPV16 | L1 | 8 | 30 | WLPSEATV | 25162 |
| HPV16 | L1 | 9 | 30 | WLPSEATVY | 25163 |
| HPV16 | L1 | 10 | 30 | WLPSEATVYL | 25164 |
| HPV16 | L1 | 9 | 416 | YIHSMNSTI | 25165 |
| HPV16 | L1 | 10 | 416 | YIHSMNSTIL | 25166 |
| HPV16 | L1 | 9 | 302 | YIKGSGSTA | 25167 |
| HPV16 | L1 | 11 | 302 | YIKGSGSTANL | 25168 |
| HPV16 | L1 | 9 | 260 | YIKMVSEPY | 25169 |
| HPV16 | L1 | 8 | 7 | YILVITCY | 25170 |
| HPV16 | L1 | 10 | 38 | YLPPVPSKV | 25171 |
| HPV16 | L1 | 11 | 38 | YLPPVPSKVV | 25172 |
| HPV16 | L1 | 8 | 389 | YLRHGEEY | 25173 |
| HPV16 | L1 | 10 | 389 | YLRHGEEYDL | 25174 |
| HPV16 | L1 | 8 | 275 | YLRREQMF | 25175 |
| HPV16 | L1 | 9 | 275 | YLRREQMFV | 25176 |
| HPV16 | L1 | 8 | 257 | YPDYIKMV | 25177 |
| HPV16 | L1 | 8 | 53 | YVARTNIY | 25178 |
| HPV16 | L1 | 9 | 53 | YVARTNIYY | 25179 |
| HPV16 | L1 | 11 | 53 | YVARTNIYYHA | 25180 |
| HPV16 | L2 | 9 | 144 | AILDINNTV | 25181 |
| HPV16 | L2 | 10 | 356 | ALPTSINNGL | 25182 |
| HPV16 | L2 | 11 | 356 | ALPTSINNGLY | 25183 |
| HPV16 | L2 | 9 | 293 | ALTSRRTGI | 25184 |
| HPV16 | L2 | 11 | 293 | ALTSRRTGIRY | 25185 |
| HPV16 | L2 | 9 | 278 | APDPDFLDI | 25186 |
| HPV16 | L2 | 10 | 278 | APDPDFLDIV | 25187 |
| HPV16 | L2 | 11 | 278 | APDPDFLDIVA | 25188 |
| HPV16 | L2 | 8 | 424 | APSLIPIV | 25189 |
| HPV16 | L2 | 8 | 119 | APTSVPSI | 25190 |
| HPV16 | L2 | 9 | 87 | APVRPPLTV | 25191 |
| HPV16 | L2 | 9 | 28 | CPPDIIPKV | 25192 |
| HPV16 | L2 | 11 | 31 | DIIPKVEGKTI | 25193 |
| HPV16 | L2 | 9 | 147 | DINNTVTTV | 25194 |
| HPV16 | L2 | 10 | 415 | DIPINITDQA | 25195 |
| HPV16 | L2 | 9 | 285 | DIVALHRPA | 25196 |
| HPV16 | L2 | 10 | 285 | DIVALHRPAL | 25197 |
| HPV16 | L2 | 8 | 367 | DIYADDFI | 25198 |
| HPV16 | L2 | 11 | 239 | DPAFITTPTKL | 25199 |
| HPV16 | L2 | 8 | 280 | DPDFLDIV | 25200 |
| HPV16 | L2 | 9 | 280 | DPDFLDIVA | 25201 |
| HPV16 | L2 | 10 | 280 | DPDFLDIVAL | 25202 |
| HPV16 | L2 | 8 | 102 | DPSIVSLV | 25203 |
| HPV16 | L2 | 11 | 165 | DPSVLQPPTPA | 25204 |
| HPV16 | L2 | 10 | 96 | DPVGPSDPSI | 25205 |
| HPV16 | L2 | 11 | 96 | DPVGPSDPSIV | 25206 |
| HPV16 | L2 | 9 | 422 | DQAPSLIPI | 25207 |
| HPV16 | L2 | 10 | 422 | DQAPSLIPIV | 25208 |
| HPV16 | L2 | 9 | 43 | DQILQYGSM | 25209 |

TABLE XIV-continued

B62 Supermotif Peptides

| Type | Protein | No. of Amino Acid | Position | Sequence | Seq. Id. No. |
|---|---|---|---|---|---|
| HPV16 | L2 | 11 | 43 | DQILQYGSMGV | 25210 |
| HPV16 | L2 | 8 | 261 | DVDNTLYF | 25211 |
| HPV16 | L2 | 8 | 195 | EIPMDTFI | 25212 |
| HPV16 | L2 | 9 | 195 | EIPMDTFIV | 25213 |
| HPV16 | L2 | 10 | 340 | ELQTITPSTY | 25214 |
| HPV16 | L2 | 10 | 114 | FIDAGAPTSV | 25215 |
| HPV16 | L2 | 10 | 373 | FITDTSTTPV | 25216 |
| HPV16 | L2 | 8 | 242 | FITTPTKL | 25217 |
| HPV16 | L2 | 9 | 242 | FITTPTKLI | 25218 |
| HPV16 | L2 | 11 | 242 | FITTPTKLITY | 25219 |
| HPV16 | L2 | 10 | 201 | FIVSTNPNTV | 25220 |
| HPV16 | L2 | 11 | 283 | FLDIVALHRPA | 25221 |
| HPV16 | L2 | 8 | 259 | GIDVDNTL | 25222 |
| HPV16 | L2 | 9 | 259 | GIDVDNTLY | 25223 |
| HPV16 | L2 | 10 | 259 | GIDVDNTLYF | 25224 |
| HPV16 | L2 | 10 | 364 | GLYDIYADDF | 25225 |
| HPV16 | L2 | 11 | 364 | GLYDIYADDFI | 25226 |
| HPV16 | L2 | 10 | 226 | GLYSRTTQQV | 25227 |
| HPV16 | L2 | 8 | 413 | GPDIPINI | 25228 |
| HPV16 | L2 | 8 | 99 | GPSDPSIV | 25229 |
| HPV16 | L2 | 10 | 99 | GPSDPSIVSL | 25230 |
| HPV16 | L2 | 11 | 99 | GPSDPSIVSLV | 25231 |
| HPV16 | L2 | 9 | 52 | GVFFGGLGI | 25232 |
| HPV16 | L2 | 8 | 439 | IIADAGDF | 25233 |
| HPV16 | L2 | 9 | 439 | IIADAGDFY | 25234 |
| HPV16 | L2 | 10 | 439 | IIADAGDFYL | 25235 |
| HPV16 | L2 | 10 | 32 | IIPKVEGKTI | 25236 |
| HPV16 | L2 | 11 | 32 | IIPKVEGKTIA | 25237 |
| HPV16 | L2 | 8 | 145 | ILDINNTV | 25238 |
| HPV16 | L2 | 11 | 145 | ILDINNTVTTV | 25239 |
| HPV16 | L2 | 9 | 45 | ILQYGSMGV | 25240 |
| HPV16 | L2 | 10 | 45 | ILQYGSMGVF | 25241 |
| HPV16 | L2 | 11 | 45 | ILQYGSMGVFF | 25242 |
| HPV16 | L2 | 9 | 394 | IPANTTIPF | 25243 |
| HPV16 | L2 | 9 | 400 | IPFGGAYNI | 25244 |
| HPV16 | L2 | 11 | 400 | IPFGGAYNIPL | 25245 |
| HPV16 | L2 | 8 | 216 | IPGSRPVA | 25246 |
| HPV16 | L2 | 10 | 216 | IPGSRPVARL | 25247 |
| HPV16 | L2 | 9 | 416 | IPINITDQA | 25248 |
| HPV16 | L2 | 10 | 428 | IPIVPGSPQY | 25249 |
| HPV16 | L2 | 9 | 33 | IPKVEGKTI | 25250 |
| HPV16 | L2 | 10 | 33 | IPKVEGKTIA | 25251 |
| HPV16 | L2 | 10 | 73 | IPLGTRPPTA | 25252 |
| HPV16 | L2 | 9 | 408 | IPLVSGPDI | 25253 |
| HPV16 | L2 | 11 | 408 | IPLVSGPDIPI | 25254 |
| HPV16 | L2 | 8 | 196 | IPMDTFIV | 25255 |
| HPV16 | L2 | 8 | 126 | IPPDVSGF | 25256 |
| HPV16 | L2 | 10 | 126 | IPPDVSGFSI | 25257 |
| HPV16 | L2 | 8 | 286 | IVALHRPA | 25258 |
| HPV16 | L2 | 9 | 286 | IVALHRPAL | 25259 |
| HPV16 | L2 | 8 | 430 | IVPGSPQY | 25260 |
| HPV16 | L2 | 10 | 430 | IVPGSPQYTI | 25261 |
| HPV16 | L2 | 11 | 430 | IVPGSPQYTII | 25262 |
| HPV16 | L2 | 10 | 105 | IVSLVEETSF | 25263 |
| HPV16 | L2 | 11 | 105 | IVSLVEETSFI | 25264 |
| HPV16 | L2 | 9 | 202 | IVSTNPNTV | 25265 |
| HPV16 | L2 | 9 | 248 | KLITYDNPA | 25266 |
| HPV16 | L2 | 10 | 248 | KLITYDNPAY | 25267 |
| HPV16 | L2 | 10 | 23 | KQAGTCPPDI | 25268 |
| HPV16 | L2 | 11 | 23 | KQAGTCPPDII | 25269 |
| HPV16 | L2 | 8 | 35 | KVEGKTIA | 25270 |
| HPV16 | L2 | 11 | 35 | KVEGKTIADQI | 25271 |
| HPV16 | L2 | 8 | 323 | KVHYYYDF | 25272 |
| HPV16 | L2 | 11 | 323 | KVHYYYDFSTI | 25273 |
| HPV16 | L2 | 8 | 236 | KVVDPAFI | 25274 |
| HPV16 | L2 | 11 | 427 | LIPIVPGSPQY | 25275 |
| HPV16 | L2 | 8 | 249 | LITYDNPA | 25276 |
| HPV16 | L2 | 9 | 249 | LITYDNPAY | 25277 |
| HPV16 | L2 | 9 | 357 | LPTSINNGL | 25278 |
| HPV16 | L2 | 10 | 357 | LPTSINNGLY | 25279 |
| HPV16 | L2 | 8 | 462 | LPYFFSDV | 25280 |
| HPV16 | L2 | 10 | 462 | LPYFFSDVSL | 25281 |
| HPV16 | L2 | 11 | 462 | LPYFFSDVSLA | 25282 |
| HPV16 | L2 | 9 | 341 | LQTITPSTY | 25283 |
| HPV16 | L2 | 8 | 46 | LQYGSMGV | 25284 |

TABLE XIV-continued

B62 Supermotif Peptides

| Type | Protein | No. of Amino Acid | Position | Sequence | Seq. Id. No. |
|---|---|---|---|---|---|
| HPV16 | L2 | 9 | 46 | LQYGSMGVF | 25285 |
| HPV16 | L2 | 10 | 46 | LQYGSMGVFF | 25286 |
| HPV16 | L2 | 8 | 108 | LVEETSFI | 25287 |
| HPV16 | L2 | 10 | 108 | LVEETSFIDA | 25288 |
| HPV16 | L2 | 9 | 410 | LVSGPDIPI | 25289 |
| HPV16 | L2 | 11 | 410 | LVSGPDIPINI | 25290 |
| HPV16 | L2 | 9 | 454 | MLRKRRKRL | 25291 |
| HPV16 | L2 | 11 | 454 | MLRKRRKRLPY | 25292 |
| HPV16 | L2 | 8 | 276 | NIAPDPDF | 25293 |
| HPV16 | L2 | 9 | 276 | NIAPDPDFL | 25294 |
| HPV16 | L2 | 11 | 276 | NIAPDPDFLDI | 25295 |
| HPV16 | L2 | 10 | 407 | NIPLVSGPDI | 25296 |
| HPV16 | L2 | 9 | 419 | NITDQAPSL | 25297 |
| HPV16 | L2 | 10 | 419 | NITDQAPSLI | 25298 |
| HPV16 | L2 | 9 | 254 | NPAYEGIDV | 25299 |
| HPV16 | L2 | 11 | 206 | NPNTVTSSTPI | 25300 |
| HPV16 | L2 | 9 | 160 | NPTFTDPSV | 25301 |
| HPV16 | L2 | 10 | 160 | NPTFTDPSVL | 25302 |
| HPV16 | L2 | 8 | 417 | PINITDQA | 25303 |
| HPV16 | L2 | 11 | 417 | PINITDQAPSL | 25304 |
| HPV16 | L2 | 8 | 215 | PIPGSRPV | 25305 |
| HPV16 | L2 | 9 | 215 | PIPGSRPVA | 25306 |
| HPV16 | L2 | 11 | 215 | PIPGSRPVARL | 25307 |
| HPV16 | L2 | 9 | 429 | PIVPGSPQY | 25308 |
| HPV16 | L2 | 11 | 429 | PIVPGSPQYTI | 25309 |
| HPV16 | L2 | 9 | 74 | PLGTRPPTA | 25310 |
| HPV16 | L2 | 8 | 409 | PLVSGPDI | 25311 |
| HPV16 | L2 | 10 | 409 | PLVSGPDIPI | 25312 |
| HPV16 | L2 | 8 | 29 | PPDIIPKV | 25313 |
| HPV16 | L2 | 9 | 127 | PPDVSGFSI | 25314 |
| HPV16 | L2 | 8 | 91 | PPLTVDPV | 25315 |
| HPV16 | L2 | 8 | 79 | PPTATDTL | 25316 |
| HPV16 | L2 | 9 | 79 | PPTATDTLA | 25317 |
| HPV16 | L2 | 11 | 79 | PPTATDTLAPV | 25318 |
| HPV16 | L2 | 11 | 171 | PPTPAETGGHF | 25319 |
| HPV16 | L2 | 9 | 435 | PQYTIIADA | 25320 |
| HPV16 | L2 | 8 | 221 | PVARLGLY | 25321 |
| HPV16 | L2 | 9 | 97 | PVGPSDPSI | 25322 |
| HPV16 | L2 | 10 | 97 | PVGPSDPSIV | 25323 |
| HPV16 | L2 | 10 | 381 | PVPSVPSTSL | 25324 |
| HPV16 | L2 | 8 | 88 | PVRPPLTV | 25325 |
| HPV16 | L2 | 11 | 88 | PVRPPLTVDPV | 25326 |
| HPV16 | L2 | 8 | 44 | QILQYGSM | 25327 |
| HPV16 | L2 | 10 | 44 | QILQYGSMGV | 25328 |
| HPV16 | L2 | 11 | 44 | QILQYGSMGVF | 25329 |
| HPV16 | L2 | 9 | 17 | QLYKTCKQA | 25330 |
| HPV16 | L2 | 9 | 233 | QQVKVVDPA | 25331 |
| HPV16 | L2 | 10 | 233 | QQVKVVDPAF | 25332 |
| HPV16 | L2 | 11 | 233 | QQVKVVDPAFI | 25333 |
| HPV16 | L2 | 8 | 234 | QVKVVDPA | 25334 |
| HPV16 | L2 | 9 | 234 | QVKVVDPAF | 25335 |
| HPV16 | L2 | 10 | 234 | QVKVVDPAFI | 25336 |
| HPV16 | L2 | 8 | 305 | RIGNKQTL | 25337 |
| HPV16 | L2 | 9 | 461 | RLPYFFSDV | 25338 |
| HPV16 | L2 | 11 | 461 | RLPYFFSDVSL | 25339 |
| HPV16 | L2 | 11 | 291 | RPALTSRRTGI | 25340 |
| HPV16 | L2 | 9 | 90 | RPPLTVDPV | 25341 |
| HPV16 | L2 | 9 | 78 | RPPTATDTL | 25342 |
| HPV16 | L2 | 10 | 78 | RPPTATDTLA | 25343 |
| HPV16 | L2 | 8 | 220 | RPVARLGL | 25344 |
| HPV16 | L2 | 9 | 220 | RPVARLGLY | 25345 |
| HPV16 | L2 | 8 | 319 | SIGAKVHY | 25346 |
| HPV16 | L2 | 9 | 319 | SIGAKVHYY | 25347 |
| HPV16 | L2 | 10 | 319 | SIGAKVHYYY | 25348 |
| HPV16 | L2 | 10 | 274 | SINIAPDPDF | 25349 |
| HPV16 | L2 | 11 | 274 | SINIAPDPDFL | 25350 |
| HPV16 | L2 | 9 | 360 | SINNGLYDI | 25351 |
| HPV16 | L2 | 10 | 360 | SINNGLYDIY | 25352 |
| HPV16 | L2 | 11 | 360 | SINNGLYDIYA | 25353 |
| HPV16 | L2 | 9 | 125 | SIPPDVSGF | 25354 |
| HPV16 | L2 | 11 | 125 | SIPPDVSGFSI | 25355 |
| HPV16 | L2 | 11 | 134 | SITTSTDTTPA | 25356 |
| HPV16 | L2 | 11 | 104 | SIVSLVEETSF | 25357 |
| HPV16 | L2 | 8 | 389 | SLSGYIPA | 25358 |
| HPV16 | L2 | 8 | 107 | SLVEETSF | 25359 |

TABLE XIV-continued

B62 Supermotif Peptides

| Type | Protein | No. of Amino Acid | Position | Sequence | Seq. Id. No. |
|---|---|---|---|---|---|
| HPV16 | L2 | 9 | 107 | SLVEETSFI | 25360 |
| HPV16 | L2 | 11 | 107 | SLVEETSFIDA | 25361 |
| HPV16 | L2 | 9 | 50 | SMGVFFGGL | 25362 |
| HPV16 | L2 | 11 | 50 | SMGVFFGGLGI | 25363 |
| HPV16 | L2 | 8 | 434 | SPQYTIIA | 25364 |
| HPV16 | L2 | 10 | 434 | SPQYTIIADA | 25365 |
| HPV16 | L2 | 9 | 167 | SVLQPPTPA | 25366 |
| HPV16 | L2 | 9 | 122 | SVPSIPPDV | 25367 |
| HPV16 | L2 | 10 | 384 | SVPSTSLSGY | 25368 |
| HPV16 | L2 | 11 | 384 | SVPSTSLSGYI | 25369 |
| HPV16 | L2 | 9 | 40 | TIADQILQY | 25370 |
| HPV16 | L2 | 8 | 332 | TIDSAEEI | 25371 |
| HPV16 | L2 | 10 | 332 | TIDSAEEIEL | 25372 |
| HPV16 | L2 | 9 | 438 | TIIADAGDF | 25373 |
| HPV16 | L2 | 10 | 438 | TIIADAGDFY | 25374 |
| HPV16 | L2 | 11 | 438 | TIIADAGDFYL | 25375 |
| HPV16 | L2 | 8 | 399 | TIPFGGAY | 25376 |
| HPV16 | L2 | 10 | 399 | TIPFGGAYNI | 25377 |
| HPV16 | L2 | 10 | 187 | TISTHNYEEI | 25378 |
| HPV16 | L2 | 9 | 85 | TLAPVRPPL | 25379 |
| HPV16 | L2 | 11 | 85 | TLAPVRPPLTV | 25380 |
| HPV16 | L2 | 10 | 311 | TLRTRSGKSI | 25381 |
| HPV16 | L2 | 11 | 265 | TLYFSSNDNSI | 25382 |
| HPV16 | L2 | 9 | 173 | TPAETGGHF | 25383 |
| HPV16 | L2 | 11 | 173 | TPAETGGHFTL | 25384 |
| HPV16 | L2 | 11 | 142 | TPAILDINNTV | 25385 |
| HPV16 | L2 | 9 | 214 | TPIPGSRPV | 25386 |
| HPV16 | L2 | 10 | 214 | TPIPGSRPVA | 25387 |
| HPV16 | L2 | 11 | 345 | TPSTYTTTSHA | 25388 |
| HPV16 | L2 | 8 | 245 | TPTKLITY | 25389 |
| HPV16 | L2 | 11 | 380 | TPVPSVPSTSL | 25390 |
| HPV16 | L2 | 10 | 16 | TQLYKTCKQA | 25391 |
| HPV16 | L2 | 10 | 232 | TQQVKVVDPA | 25392 |
| HPV16 | L2 | 11 | 232 | TQQVKVVDPAF | 25393 |
| HPV16 | L2 | 8 | 209 | TVTSSTPI | 25394 |
| HPV16 | L2 | 10 | 154 | TVTTHNNPTF | 25395 |
| HPV16 | L2 | 8 | 168 | VLQPPTPA | 25396 |
| HPV16 | L2 | 9 | 431 | VPGSPQYTI | 25397 |
| HPV16 | L2 | 10 | 431 | VPGSPQYTII | 25398 |
| HPV16 | L2 | 11 | 431 | VPGSPQYTIIA | 25399 |
| HPV16 | L2 | 8 | 123 | VPSIPPDV | 25400 |
| HPV16 | L2 | 11 | 123 | VPSIPPDVSGF | 25401 |
| HPV16 | L2 | 9 | 385 | VPSTSLSGY | 25402 |
| HPV16 | L2 | 10 | 385 | VPSTSLSGYI | 25403 |
| HPV16 | L2 | 9 | 382 | VPSVPSTSL | 25404 |
| HPV16 | L2 | 8 | 393 | YIPANTTI | 25405 |
| HPV16 | L2 | 10 | 393 | YIPANTTIPF | 25406 |
| HPV16 | L2 | 11 | 72 | YIPLGTRPPTA | 25407 |
| HPV16 | L2 | 8 | 447 | YLHPSYYM | 25408 |
| HPV16 | L2 | 9 | 447 | YLHPSYYML | 25409 |
| HPV16 | L2 | 10 | 453 | YMLRKRRKRL | 25410 |
| HPV18 | E1 | 9 | 246 | AIFGVNPTI | 25411 |
| HPV18 | E1 | 10 | 246 | AIFGVNPTIA | 25412 |
| HPV18 | E1 | 10 | 22 | AIVDKKTGDV | 25413 |
| HPV18 | E1 | 11 | 22 | AIVDKKTGDVI | 25414 |
| HPV18 | E1 | 9 | 546 | ALDGNPISI | 25415 |
| HPV18 | E1 | 8 | 68 | ALFHAQEV | 25416 |
| HPV18 | E1 | 10 | 387 | ALLADSNSNA | 25417 |
| HPV18 | E1 | 11 | 387 | ALLADSNSNAA | 25418 |
| HPV18 | E1 | 9 | 325 | ALYWYRTGI | 25419 |
| HPV18 | E1 | 10 | 213 | AMLAVFKDTY | 25420 |
| HPV18 | E1 | 11 | 526 | AMLDDATTTCW | 25421 |
| HPV18 | E1 | 10 | 66 | AQALFHAQEV | 25422 |
| HPV18 | E1 | 8 | 72 | AQEVHNDA | 25423 |
| HPV18 | E1 | 10 | 72 | AQEVHNDAQV | 25424 |
| HPV18 | E1 | 11 | 72 | AQEVHNDAQVL | 25425 |
| HPV18 | E1 | 8 | 422 | AQKRQMNM | 25426 |
| HPV18 | E1 | 11 | 422 | AQKRQMNMSQW | 25427 |
| HPV18 | E1 | 9 | 199 | AQLKDLLKV | 25428 |
| HPV18 | E1 | 11 | 79 | AQVLHVLKRKF | 25429 |
| HPV18 | E1 | 9 | 216 | AVFKDTYGL | 25430 |
| HPV18 | E1 | 11 | 216 | AVFKDTYGLSF | 25431 |
| HPV18 | E1 | 8 | 273 | CLDCKWGV | 25432 |
| HPV18 | E1 | 9 | 273 | CLDCKWGVL | 25433 |
| HPV18 | E1 | 10 | 273 | CLDCKWGVLI | 25434 |

TABLE XIV-continued

B62 Supermotif Peptides

| Type | Protein | No. of Amino Acid | Position | Sequence | Seq. Id. No. |
|---|---|---|---|---|---|
| HPV18 | E1 | 11 | 273 | CLDCKWGVLIL | 25435 |
| HPV18 | E1 | 8 | 479 | CLVFCGPA | 25436 |
| HPV18 | E1 | 9 | 311 | CMLIQPPKL | 25437 |
| HPV18 | E1 | 10 | 566 | CPPILLTTNI | 25438 |
| HPV18 | E1 | 10 | 404 | CQAKYLKDCA | 25439 |
| HPV18 | E1 | 9 | 628 | DLHEEEDA | 25440 |
| HPV18 | E1 | 11 | 203 | DLLKVNNKQGA | 25441 |
| HPV18 | E1 | 8 | 363 | DLSEMVQW | 25442 |
| HPV18 | E1 | 9 | 363 | DLSEMVQWA | 25443 |
| HPV18 | E1 | 10 | 363 | DLSEMVQWAF | 25444 |
| HPV18 | E1 | 8 | 381 | DMAFEYAL | 25445 |
| HPV18 | E1 | 9 | 381 | DMAFEYALL | 25446 |
| HPV18 | E1 | 10 | 381 | DMAFEYALLA | 25447 |
| HPV18 | E1 | 11 | 30 | DVISDDEDENA | 25448 |
| HPV18 | E1 | 10 | 610 | EINDKNWKCF | 25449 |
| HPV18 | E1 | 11 | 610 | EINDKNWKCFF | 25450 |
| HPV18 | E1 | 11 | 115 | EISLNSGQKKA | 25451 |
| HPV18 | E1 | 8 | 62 | ELETAQAL | 25452 |
| HPV18 | E1 | 9 | 62 | ELETAQALF | 25453 |
| HPV18 | E1 | 11 | 62 | ELETAQALFHA | 25454 |
| HPV18 | E1 | 9 | 108 | ELSPRLQEI | 25455 |
| HPV18 | E1 | 11 | 108 | ELSPRLQEISL | 25456 |
| HPV18 | E1 | 8 | 375 | ELTDESDM | 25457 |
| HPV18 | E1 | 9 | 375 | ELTDESDMA | 25458 |
| HPV18 | E1 | 10 | 375 | ELTDESDMAF | 25459 |
| HPV18 | E1 | 11 | 366 | EMVQWAFDNEL | 25460 |
| HPV18 | E1 | 8 | 518 | EPLTDTKV | 25461 |
| HPV18 | E1 | 9 | 518 | EPLTDTKVA | 25462 |
| HPV18 | E1 | 10 | 518 | EPLTDTKVAM | 25463 |
| HPV18 | E1 | 11 | 518 | EPLTDTKVAML | 25464 |
| HPV18 | E1 | 8 | 59 | EQAELETA | 25465 |
| HPV18 | E1 | 10 | 59 | EQAELETAQA | 25466 |
| HPV18 | E1 | 11 | 59 | EQAELETAQAL | 25467 |
| HPV18 | E1 | 10 | 104 | EVDTELSPRL | 25468 |
| HPV18 | E1 | 9 | 141 | EVEATQIQV | 25469 |
| HPV18 | E1 | 8 | 74 | EVHNDAQV | 25470 |
| HPV18 | E1 | 9 | 74 | EVHNDAQVL | 25471 |
| HPV18 | E1 | 11 | 74 | EVHNDAQVLHV | 25472 |
| HPV18 | E1 | 9 | 338 | EVMGDTPEW | 25473 |
| HPV18 | E1 | 10 | 338 | EVMGDTPEWI | 25474 |
| HPV18 | E1 | 8 | 50 | FIDTQGTF | 25475 |
| HPV18 | E1 | 8 | 497 | FIHFIQGA | 25476 |
| HPV18 | E1 | 9 | 497 | FIHFIQGAV | 25477 |
| HPV18 | E1 | 10 | 497 | FIHFIQGAVI | 25478 |
| HPV18 | E1 | 10 | 265 | FILYAHIQCL | 25479 |
| HPV18 | E1 | 9 | 500 | FIQGAVISF | 25480 |
| HPV18 | E1 | 10 | 500 | FIQGAVISFV | 25481 |
| HPV18 | E1 | 8 | 460 | FITFLGAL | 25482 |
| HPV18 | E1 | 11 | 460 | FITFLGALKSF | 25483 |
| HPV18 | E1 | 8 | 463 | FLGALKSF | 25484 |
| HPV18 | E1 | 9 | 463 | FLGALKSFL | 25485 |
| HPV18 | E1 | 11 | 470 | FLKGTPKKNCL | 25486 |
| HPV18 | E1 | 8 | 399 | FLKSNCQA | 25487 |
| HPV18 | E1 | 10 | 399 | FLKSNCQAKY | 25488 |
| HPV18 | E1 | 11 | 399 | FLKSNCQAKYL | 25489 |
| HPV18 | E1 | 9 | 452 | FLRYQQIEF | 25490 |
| HPV18 | E1 | 10 | 452 | FLRYQQIEFI | 25491 |
| HPV18 | E1 | 10 | 599 | FPFDKNGNPV | 25492 |
| HPV18 | E1 | 11 | 599 | FPFDKNGNPVY | 25493 |
| HPV18 | E1 | 8 | 508 | FVNSTSHF | 25494 |
| HPV18 | E1 | 9 | 508 | FVNSTSHFW | 25495 |
| HPV18 | E1 | 10 | 508 | FVNSTSHFWL | 25496 |
| HPV18 | E1 | 9 | 356 | GIDDSNFDL | 25497 |
| HPV18 | E1 | 8 | 332 | GISNISEV | 25498 |
| HPV18 | E1 | 9 | 332 | GISNISEVM | 25499 |
| HPV18 | E1 | 8 | 223 | GLSFTDLV | 25500 |
| HPV18 | E1 | 11 | 223 | GLSFTDLVRNF | 25501 |
| HPV18 | E1 | 8 | 300 | GLSTLLHV | 25502 |
| HPV18 | E1 | 8 | 494 | GMSFIHFI | 25503 |
| HPV18 | E1 | 11 | 494 | GMSFIHFIQGA | 25504 |
| HPV18 | E1 | 9 | 484 | GPANTGKSY | 25505 |
| HPV18 | E1 | 10 | 484 | GPANTGKSYF | 25506 |
| HPV18 | E1 | 9 | 121 | GQKKAKRRL | 25507 |
| HPV18 | E1 | 10 | 121 | GQKKAKRRLF | 25508 |
| HPV18 | E1 | 8 | 279 | GVLILALL | 25509 |

TABLE XIV-continued

B62 Supermotif Peptides

| Type | Protein | No. of Amino Acid | Position | Sequence | Seq. Id. No. |
|---|---|---|---|---|---|
| HPV18 | E1 | 10 | 279 | GVLILALLRY | 25510 |
| HPV18 | E1 | 10 | 249 | GVNPTIAEGF | 25511 |
| HPV18 | E1 | 9 | 270 | HIQCLDCKW | 25512 |
| HPV18 | E1 | 11 | 270 | HIQCLDCKWGV | 25513 |
| HPV18 | E1 | 8 | 576 | HPAKDNRW | 25514 |
| HPV18 | E1 | 10 | 576 | HPAKDNRWPY | 25515 |
| HPV18 | E1 | 11 | 576 | HPAKDNRWPYL | 25516 |
| HPV18 | E1 | 8 | 83 | HVLKRKFA | 25517 |
| HPV18 | E1 | 8 | 306 | HVPETCML | 25518 |
| HPV18 | E1 | 9 | 306 | HVPETCMLI | 25519 |
| HPV18 | E1 | 11 | 352 | IIQHGIDDSNF | 25520 |
| HPV18 | E1 | 10 | 569 | ILLTTNIHPA | 25521 |
| HPV18 | E1 | 9 | 266 | ILYAHIQCL | 25522 |
| HPV18 | E1 | 8 | 271 | IQCLDCKW | 25523 |
| HPV18 | E1 | 10 | 271 | IQCLDCKWGV | 25524 |
| HPV18 | E1 | 11 | 271 | IQCLDCKWGVL | 25525 |
| HPV18 | E1 | 8 | 501 | IQGAVISF | 25526 |
| HPV18 | E1 | 9 | 501 | IQGAVISFV | 25527 |
| HPV18 | E1 | 10 | 353 | IQHGIDDSNF | 25528 |
| HPV18 | E1 | 8 | 562 | IQLKCPPI | 25529 |
| HPV18 | E1 | 9 | 562 | IQLKCPPIL | 25530 |
| HPV18 | E1 | 10 | 562 | IQLKCPPILL | 25531 |
| HPV18 | E1 | 8 | 262 | IQPFILYA | 25532 |
| HPV18 | E1 | 10 | 262 | IQPFILYAHI | 25533 |
| HPV18 | E1 | 10 | 314 | IQPPKLRSSV | 25534 |
| HPV18 | E1 | 11 | 314 | IQPPKLRSSVA | 25535 |
| HPV18 | E1 | 11 | 347 | IQRLTIIQHGI | 25536 |
| HPV18 | E1 | 9 | 23 | IVDKKTGDV | 25537 |
| HPV18 | E1 | 10 | 23 | IVDKKTGDVI | 25538 |
| HPV18 | E1 | 10 | 449 | IVQFLRYQQI | 25539 |
| HPV18 | E1 | 8 | 439 | KIDEGGDW | 25540 |
| HPV18 | E1 | 11 | 439 | KIDEGGDWRPI | 25541 |
| HPV18 | E1 | 11 | 647 | KLRAGQNHRPL | 25542 |
| HPV18 | E1 | 8 | 318 | KLRSSVAA | 25543 |
| HPV18 | E1 | 9 | 318 | KLRSSVAAL | 25544 |
| HPV18 | E1 | 10 | 318 | KLRSSVAALY | 25545 |
| HPV18 | E1 | 11 | 318 | KLRSSVAALYW | 25546 |
| HPV18 | E1 | 11 | 559 | KPLIQLKCPPI | 25547 |
| HPV18 | E1 | 8 | 210 | KQGAMLAV | 25548 |
| HPV18 | E1 | 9 | 210 | KQGAMLAVF | 25549 |
| HPV18 | E1 | 8 | 524 | KVAMLDDA | 25550 |
| HPV18 | E1 | 8 | 206 | KVNNKQGA | 25551 |
| HPV18 | E1 | 9 | 206 | KVNNKQGAM | 25552 |
| HPV18 | E1 | 10 | 206 | KVNNKQGAML | 25553 |
| HPV18 | E1 | 11 | 206 | KVNNKQGAMLA | 25554 |
| HPV18 | E1 | 8 | 281 | LILALLRY | 25555 |
| HPV18 | E1 | 9 | 561 | LIQLKCPPI | 25556 |
| HPV18 | E1 | 10 | 561 | LIQLKCPPIL | 25557 |
| HPV18 | E1 | 11 | 561 | LIQLKCPPILL | 25558 |
| HPV18 | E1 | 8 | 261 | LIQPFILY | 25559 |
| HPV18 | E1 | 9 | 261 | LIQPFILYA | 25560 |
| HPV18 | E1 | 11 | 261 | LIQPFILYAHI | 25561 |
| HPV18 | E1 | 11 | 313 | LIQPPKLRSSV | 25562 |
| HPV18 | E1 | 9 | 388 | LLADSNSNA | 25563 |
| HPV18 | E1 | 10 | 388 | LLADSNSNAA | 25564 |
| HPV18 | E1 | 11 | 388 | LLADSNSNAAA | 25565 |
| HPV18 | E1 | 9 | 304 | LLHVPETCM | 25566 |
| HPV18 | E1 | 10 | 304 | LLHVPETCML | 25567 |
| HPV18 | E1 | 11 | 304 | LLHVPETCMLI | 25568 |
| HPV18 | E1 | 10 | 204 | LLKVNNKQGA | 25569 |
| HPV18 | E1 | 11 | 204 | LLKVNNKQGAM | 25570 |
| HPV18 | E1 | 11 | 285 | LLRYKCGKSRL | 25571 |
| HPV18 | E1 | 9 | 570 | LLTTNIHPA | 25572 |
| HPV18 | E1 | 9 | 214 | MLAVFKDTY | 25573 |
| HPV18 | E1 | 11 | 214 | MLAVFKDTYGL | 25574 |
| HPV18 | E1 | 10 | 527 | MLDDATTTCW | 25575 |
| HPV18 | E1 | 8 | 312 | MLIQPPKL | 25576 |
| HPV18 | E1 | 11 | 47 | MVDFIDTQGTF | 25577 |
| HPV18 | E1 | 10 | 367 | MVQWAFDNEL | 25578 |
| HPV18 | E1 | 11 | 188 | NIENVNPQCTI | 25579 |
| HPV18 | E1 | 10 | 574 | NIHPAKDNRW | 25580 |
| HPV18 | E1 | 8 | 428 | NMSQWIRF | 25581 |
| HPV18 | E1 | 8 | 641 | NPFGTFKL | 25582 |
| HPV18 | E1 | 10 | 641 | NPFGTFKLRA | 25583 |
| HPV18 | E1 | 9 | 193 | NPQCTIAQL | 25584 |

TABLE XIV-continued

B62 Supermotif Peptides

| Type | Protein | No. of Amino Acid | Position | Sequence | Seq. Id. No. |
|---|---|---|---|---|---|
| HPV18 | E1 | 8 | 251 | NPTIAEGF | 25585 |
| HPV18 | E1 | 11 | 251 | NPTIAEGFKTL | 25586 |
| HPV18 | E1 | 11 | 606 | NPVYEINDKNW | 25587 |
| HPV18 | E1 | 10 | 158 | NVCSGGSTEA | 25588 |
| HPV18 | E1 | 11 | 158 | NVCSGGSTEAI | 25589 |
| HPV18 | E1 | 8 | 191 | NVNPQCTI | 25590 |
| HPV18 | E1 | 9 | 191 | NVNPQCTIA | 25591 |
| HPV18 | E1 | 11 | 191 | NVNPQCTIAQL | 25592 |
| HPV18 | E1 | 8 | 568 | PILLTTNI | 25593 |
| HPV18 | E1 | 11 | 568 | PILLTTNIHPA | 25594 |
| HPV18 | E1 | 11 | 551 | PISIDRKHKPL | 25595 |
| HPV18 | E1 | 8 | 448 | PIVQFLRY | 25596 |
| HPV18 | E1 | 11 | 448 | PIVQFLRYQQI | 25597 |
| HPV18 | E1 | 8 | 98 | PLGERLEV | 25598 |
| HPV18 | E1 | 10 | 560 | PLIQLKCPPI | 25599 |
| HPV18 | E1 | 11 | 560 | PLIQLKCPPIL | 25600 |
| HPV18 | E1 | 8 | 519 | PLTDTKVA | 25601 |
| HPV18 | E1 | 9 | 519 | PLTDTKVAM | 25602 |
| HPV18 | E1 | 10 | 519 | PLTDTKVAML | 25603 |
| HPV18 | E1 | 9 | 567 | PPILLTTNI | 25604 |
| HPV18 | E1 | 8 | 316 | PPKLRSSV | 25605 |
| HPV18 | E1 | 9 | 316 | PPKLRSSVA | 25606 |
| HPV18 | E1 | 10 | 316 | PPKLRSSVAA | 25607 |
| HPV18 | E1 | 11 | 316 | PPKLRSSVAAL | 25608 |
| HPV18 | E1 | 8 | 194 | PQCTIAQL | 25609 |
| HPV18 | E1 | 11 | 194 | PQCTIAQLKDL | 25610 |
| HPV18 | E1 | 10 | 607 | PVYEINDKNW | 25611 |
| HPV18 | E1 | 8 | 457 | QIEFITFL | 25612 |
| HPV18 | E1 | 10 | 457 | QIEFITFLGA | 25613 |
| HPV18 | E1 | 11 | 457 | QIEFITFLGAL | 25614 |
| HPV18 | E1 | 8 | 563 | QLKCPPIL | 25615 |
| HPV18 | E1 | 9 | 563 | QLKCPPILL | 25616 |
| HPV18 | E1 | 8 | 200 | QLKDLLKV | 25617 |
| HPV18 | E1 | 8 | 426 | QMNMSQWI | 25618 |
| HPV18 | E1 | 10 | 426 | QMNMSQWIRF | 25619 |
| HPV18 | E1 | 9 | 263 | QPFILYAHI | 25620 |
| HPV18 | E1 | 9 | 315 | QPPKLRSSV | 25621 |
| HPV18 | E1 | 10 | 315 | QPPKLRSSVA | 25622 |
| HPV18 | E1 | 11 | 315 | QPPKLRSSVAA | 25623 |
| HPV18 | E1 | 8 | 456 | QQIEFITF | 25624 |
| HPV18 | E1 | 9 | 456 | QQIEFITFL | 25625 |
| HPV18 | E1 | 11 | 456 | QQIEFITFLGA | 25626 |
| HPV18 | E1 | 10 | 80 | QVLHVLKRKF | 25627 |
| HPV18 | E1 | 11 | 80 | QVLHVLKRKFA | 25628 |
| HPV18 | E1 | 10 | 589 | RITVFEFPNA | 25629 |
| HPV18 | E1 | 11 | 589 | RITVFEFPNAF | 25630 |
| HPV18 | E1 | 11 | 626 | RLDLHEEEEDA | 25631 |
| HPV18 | E1 | 8 | 102 | RLEVDTEL | 25632 |
| HPV18 | E1 | 10 | 128 | RLFTISDSGY | 25633 |
| HPV18 | E1 | 9 | 349 | RLTIIQHGI | 25634 |
| HPV18 | E1 | 8 | 294 | RLTVAKGL | 25635 |
| HPV18 | E1 | 11 | 294 | RLTVAKGLSTL | 25636 |
| HPV18 | E1 | 9 | 447 | RPIVQFLRY | 25637 |
| HPV18 | E1 | 8 | 425 | RQMNMSQW | 25638 |
| HPV18 | E1 | 9 | 425 | RQMNMSQWI | 25639 |
| HPV18 | E1 | 11 | 425 | RQMNMSQWIRF | 25640 |
| HPV18 | E1 | 9 | 553 | SIDRKHKPL | 25641 |
| HPV18 | E1 | 10 | 553 | SIDRKHKPLI | 25642 |
| HPV18 | E1 | 9 | 117 | SLNSGQKKA | 25643 |
| HPV18 | E1 | 9 | 97 | SPLGERLEV | 25644 |
| HPV18 | E1 | 9 | 110 | SPRLQEISL | 25645 |
| HPV18 | E1 | 11 | 430 | SQWIRFRCSKI | 25646 |
| HPV18 | E1 | 8 | 322 | SVAALYWY | 25647 |
| HPV18 | E1 | 11 | 179 | SVDGTSDNSNI | 25648 |
| HPV18 | E1 | 9 | 253 | TIAEGFKTL | 25649 |
| HPV18 | E1 | 10 | 253 | TIAEGFKTLI | 25650 |
| HPV18 | E1 | 8 | 197 | TIAQLKDL | 25651 |
| HPV18 | E1 | 9 | 197 | TIAQLKDLL | 25652 |
| HPV18 | E1 | 11 | 197 | TIAQLKDLLKV | 25653 |
| HPV18 | E1 | 8 | 260 | TLIQPFIL | 25654 |
| HPV18 | E1 | 9 | 260 | TLIQPFILY | 25655 |
| HPV18 | E1 | 10 | 260 | TLIQPFILYA | 25656 |
| HPV18 | E1 | 10 | 303 | TLLHVPETCM | 25657 |
| HPV18 | E1 | 11 | 303 | TLLHVPETCML | 25658 |
| HPV18 | E1 | 9 | 414 | TMCKHYRRA | 25659 |

TABLE XIV-continued

B62 Supermotif Peptides

| Type | Protein | No. of Amino Acid | Position | Sequence | Seq. Id. No. |
|---|---|---|---|---|---|
| HPV18 | E1 | 8 | 343 | TPEWIQRL | 25660 |
| HPV18 | E1 | 10 | 343 | TPEWIQRLTI | 25661 |
| HPV18 | E1 | 11 | 343 | TPEWIQRLTII | 25662 |
| HPV18 | E1 | 8 | 474 | TPKKNCLV | 25663 |
| HPV18 | E1 | 9 | 474 | TPKKNCLVF | 25664 |
| HPV18 | E1 | 9 | 53 | TQGTFCEQA | 25665 |
| HPV18 | E1 | 11 | 53 | TQGTFCEQAEL | 25666 |
| HPV18 | E1 | 9 | 296 | TVAKGLSTL | 25667 |
| HPV18 | E1 | 10 | 296 | TVAKGLSTLL | 25668 |
| HPV18 | E1 | 8 | 591 | TVFEFPNA | 25669 |
| HPV18 | E1 | 9 | 591 | TVFEFPNAF | 25670 |
| HPV18 | E1 | 11 | 591 | TVFEFPNAFPF | 25671 |
| HPV18 | E1 | 10 | 31 | VISDDEDENA | 25672 |
| HPV18 | E1 | 11 | 505 | VISFVNSTSHF | 25673 |
| HPV18 | E1 | 9 | 81 | VLHVLKRKF | 25674 |
| HPV18 | E1 | 10 | 81 | VLHVLKRKFA | 25675 |
| HPV18 | E1 | 9 | 280 | VLILALLRY | 25676 |
| HPV18 | E1 | 8 | 339 | VMGDTPEW | 25677 |
| HPV18 | E1 | 9 | 339 | VMGDTPEWI | 25678 |
| HPV18 | E1 | 8 | 307 | VPETCMLI | 25679 |
| HPV18 | E1 | 9 | 450 | VQFLRYQQI | 25680 |
| HPV18 | E1 | 11 | 450 | VQFLRYQQIEF | 25681 |
| HPV18 | E1 | 9 | 368 | VQWAFDNEL | 25682 |
| HPV18 | E1 | 8 | 346 | WIQRLTII | 25683 |
| HPV18 | E1 | 9 | 432 | WIRFRCSKI | 25684 |
| HPV18 | E1 | 10 | 516 | WLEPLTDTKV | 25685 |
| HPV18 | E1 | 11 | 516 | WLEPLTDTKVA | 25686 |
| HPV18 | E1 | 8 | 583 | WPYLESRI | 25687 |
| HPV18 | E1 | 10 | 583 | WPYLESRITV | 25688 |
| HPV18 | E1 | 11 | 583 | WPYLESRITVF | 25689 |
| HPV18 | E1 | 8 | 243 | WVTAIFGV | 25690 |
| HPV18 | E1 | 8 | 585 | YLESRITV | 25691 |
| HPV18 | E1 | 9 | 585 | YLESRITVF | 25692 |
| HPV18 | E1 | 11 | 585 | YLESRITVFEF | 25693 |
| HPV18 | E1 | 8 | 408 | YLKDCATM | 25694 |
| HPV18 | E1 | 11 | 542 | YMRNALDGNPI | 25695 |
| HPV18 | E1 | 9 | 455 | YQQIEFITF | 25696 |
| HPV18 | E1 | 10 | 455 | YQQIEFITFL | 25697 |
| HPV18 | E2 | 8 | 76 | AIELQMAL | 25698 |
| HPV18 | E2 | 11 | 76 | AIELQMALOGL | 25699 |
| HPV18 | E2 | 11 | 45 | AIFFAAREHGI | 25700 |
| HPV18 | E2 | 8 | 351 | AIPDSVQI | 25701 |
| HPV18 | E2 | 9 | 351 | AIPDSVQIL | 25702 |
| HPV18 | E2 | 10 | 351 | AIPDSVQILV | 25703 |
| HPV18 | E2 | 10 | 82 | ALQGLAQSRY | 25704 |
| HPV18 | E2 | 10 | 87 | AQSRYKTEDW | 25705 |
| HPV18 | E2 | 10 | 132 | CMTYVAWDSV | 25706 |
| HPV18 | E2 | 11 | 132 | CMTYVAWDSVY | 25707 |
| HPV18 | E2 | 10 | 14 | CVQDKIIDHY | 25708 |
| HPV18 | E2 | 8 | 156 | CVSHRGLY | 25709 |
| HPV18 | E2 | 9 | 156 | CVSHRGLYY | 25710 |
| HPV18 | E2 | 10 | 156 | CVSHRGYYV | 25711 |
| HPV18 | E2 | 8 | 29 | DIDSQIQY | 25712 |
| HPV18 | E2 | 9 | 29 | DIDSQIQYW | 25713 |
| HPV18 | E2 | 11 | 29 | DIDSQIQYWQL | 25714 |
| HPV18 | E2 | 8 | 315 | DISSTWHW | 25715 |
| HPV18 | E2 | 11 | 315 | DISSTWHWTGA | 25716 |
| HPV18 | E2 | 9 | 78 | ELQMALQGL | 25717 |
| HPV18 | E2 | 10 | 78 | ELQMALQGLA | 25718 |
| HPV18 | E2 | 11 | 104 | ELWNTEPTHCF | 25719 |
| HPV18 | E2 | 8 | 190 | EVHFGNNV | 25720 |
| HPV18 | E2 | 9 | 190 | EVHFGNNVI | 25721 |
| HPV18 | E2 | 11 | 346 | FLNTVAIPDSV | 25722 |
| HPV18 | E2 | 9 | 54 | GIQTLNHQV | 25723 |
| HPV18 | E2 | 10 | 54 | GIQTLNHQVV | 25724 |
| HPV18 | E2 | 11 | 253 | GLAEKQHCGPV | 25725 |
| HPV18 | E2 | 9 | 161 | GLYYVKEGY | 25726 |
| HPV18 | E2 | 9 | 261 | GPVNPLLGA | 25727 |
| HPV18 | E2 | 10 | 261 | GPVNPLLGAA | 25728 |
| HPV18 | E2 | 8 | 118 | GQTVQVYF | 25729 |
| HPV18 | E2 | 9 | 291 | HLKGDRNSL | 25730 |
| HPV18 | E2 | 9 | 60 | HQVVPAYNI | 25731 |
| HPV18 | E2 | 11 | 289 | IIHLKGDRNSL | 25732 |
| HPV18 | E2 | 8 | 358 | ILVGYMTM | 25733 |
| HPV18 | E2 | 8 | 352 | IPDSVQIL | 25734 |

TABLE XIV-continued

B62 Supermotif Peptides

| Type | Protein | No. of Amino Acid | Position | Sequence | Seq. Id. No. |
|---|---|---|---|---|---|
| HPV18 | E2 | 9 | 352 | IPDSVQILV | 25735 |
| HPV18 | E2 | 11 | 352 | IPDSVQILVGY | 25736 |
| HPV18 | E2 | 8 | 55 | IQTLNHQV | 25737 |
| HPV18 | E2 | 9 | 55 | IQTLNHQVV | 25738 |
| HPV18 | E2 | 11 | 55 | IQTLNHQVVPA | 25739 |
| HPV18 | E2 | 9 | 34 | IQYWQLIRW | 25740 |
| HPV18 | E2 | 10 | 280 | KLCSGNTTPI | 25741 |
| HPV18 | E2 | 11 | 280 | KLCSGNTTPII | 25742 |
| HPV18 | E2 | 10 | 257 | KQHCGPVNPL | 25743 |
| HPV18 | E2 | 11 | 257 | KQHCGPVNPLL | 25744 |
| HPV18 | E2 | 10 | 219 | KQLQHTPSPY | 25745 |
| HPV18 | E2 | 8 | 39 | LIRWENAI | 25746 |
| HPV18 | E2 | 9 | 39 | LIRWENAIF | 25747 |
| HPV18 | E2 | 10 | 39 | LIRWENAIFF | 25748 |
| HPV18 | E2 | 11 | 39 | LIRWENAIFFA | 25749 |
| HPV18 | E2 | 8 | 98 | LQDTCEEL | 25750 |
| HPV18 | E2 | 9 | 98 | LQDTCEELW | 25751 |
| HPV18 | E2 | 9 | 83 | LQGLAQSRY | 25752 |
| HPV18 | E2 | 8 | 221 | LQHTPSPY | 25753 |
| HPV18 | E2 | 8 | 79 | LQMALQGL | 25754 |
| HPV18 | E2 | 9 | 79 | LQMALQGLA | 25755 |
| HPV18 | E2 | 8 | 1 | MQTPKETL | 25756 |
| HPV18 | E2 | 10 | 67 | NISKSKAHKA | 25757 |
| HPV18 | E2 | 11 | 67 | NISKSKAHKAI | 25758 |
| HPV18 | E2 | 9 | 196 | NVIDCNDSM | 25759 |
| HPV18 | E2 | 8 | 262 | PVNPLLGA | 25760 |
| HPV18 | E2 | 9 | 262 | PVNPLLGAA | 25761 |
| HPV18 | E2 | 9 | 357 | QILVGYMTM | 25762 |
| HPV18 | E2 | 8 | 33 | QIQYWQLI | 25763 |
| HPV18 | E2 | 10 | 33 | QIQYWQLIRW | 25764 |
| HPV18 | E2 | 8 | 38 | QLIRWENA | 25765 |
| HPV18 | E2 | 9 | 38 | QLIRWENAI | 25766 |
| HPV18 | E2 | 10 | 38 | QLIRWENAIF | 25767 |
| HPV18 | E2 | 11 | 38 | QLIRWENAIFF | 25768 |
| HPV18 | E2 | 9 | 220 | QLQHTPSPY | 25769 |
| HPV18 | E2 | 8 | 80 | QMALQGLA | 25770 |
| HPV18 | E2 | 8 | 61 | QVVPAYNI | 25771 |
| HPV18 | E2 | 9 | 305 | RLRKHSDHY | 25772 |
| HPV18 | E2 | 9 | 11 | RLSCVQDKI | 25773 |
| HPV18 | E2 | 10 | 11 | RLSCVQDKII | 25774 |
| HPV18 | E2 | 8 | 248 | RPGHCGLA | 25775 |
| HPV18 | E2 | 9 | 298 | SLKCLRYRL | 25776 |
| HPV18 | E2 | 10 | 203 | SMCSTSDDTV | 25777 |
| HPV18 | E2 | 9 | 226 | SPYSSTVSV | 25778 |
| HPV18 | E2 | 8 | 32 | SQIQYWQL | 25779 |
| HPV18 | E2 | 9 | 32 | SQIQYWQLI | 25780 |
| HPV18 | E2 | 11 | 32 | SQIQYWQLIRW | 25781 |
| HPV18 | E2 | 8 | 233 | SVGTAKTY | 25782 |
| HPV18 | E2 | 8 | 355 | SVQILVGY | 25783 |
| HPV18 | E2 | 9 | 355 | SVQILVGYM | 25784 |
| HPV18 | E2 | 11 | 355 | SVQILVGYMTM | 25785 |
| HPV18 | E2 | 8 | 140 | SVYYMTDA | 25786 |
| HPV18 | E2 | 11 | 140 | SVYYMTDAGTW | 25787 |
| HPV18 | E2 | 9 | 57 | TLNHQVVPA | 25788 |
| HPV18 | E2 | 10 | 57 | TLNHQVVPAY | 25789 |
| HPV18 | E2 | 9 | 97 | TLQDTCEEL | 25790 |
| HPV18 | E2 | 10 | 97 | TLQDTCEELW | 25791 |
| HPV18 | E2 | 9 | 7 | TLSERLSCV | 25792 |
| HPV18 | E2 | 10 | 3 | TPKETLSERL | 25793 |
| HPV18 | E2 | 9 | 224 | TPSPYSSTV | 25794 |
| HPV18 | E2 | 11 | 224 | TPSPYSSTVSV | 25795 |
| HPV18 | E2 | 11 | 271 | TPTGNNKRRKL | 25796 |
| HPV18 | E2 | 10 | 341 | TQRTKFLNTV | 25797 |
| HPV18 | E2 | 11 | 341 | TQRTKFLNTVA | 25798 |
| HPV18 | E2 | 8 | 349 | TVAIPDSV | 25799 |
| HPV18 | E2 | 10 | 349 | TVAIPDSVQI | 25800 |
| HPV18 | E2 | 11 | 349 | TVAIPDSVQIL | 25801 |
| HPV18 | E2 | 8 | 211 | TVSATQLV | 25802 |
| HPV18 | E2 | 11 | 211 | TVSATQLVKQL | 25803 |
| HPV18 | E2 | 10 | 231 | TVSVGTAKTY | 25804 |
| HPV18 | E2 | 8 | 197 | VIDCNDSM | 25805 |
| HPV18 | E2 | 11 | 63 | VPAYNISKSKA | 25806 |
| HPV18 | E2 | 9 | 15 | VQDKIIDHY | 25807 |
| HPV18 | E2 | 8 | 356 | VQILVGYM | 25808 |
| HPV18 | E2 | 10 | 356 | VQILVGYMTM | 25809 |

TABLE XIV-continued

B62 Supermotif Peptides

| Type | Protein | No. of Amino Acid | Position | Sequence | Seq. Id. No. |
|---|---|---|---|---|---|
| HPV18 | E2 | 9 | 37 | WQLIRWENA | 25810 |
| HPV18 | E2 | 10 | 37 | WQLIRWENAI | 25811 |
| HPV18 | E2 | 11 | 37 | WQLIRWENAIF | 25812 |
| HPV18 | E2 | 11 | 173 | YIEFKSECEKY | 25813 |
| HPV18 | E2 | 8 | 143 | YMTDAGTW | 25814 |
| HPV18 | E2 | 8 | 135 | YVAWDSVY | 25815 |
| HPV18 | E2 | 9 | 135 | YVAWDSVYY | 25816 |
| HPV18 | E2 | 10 | 135 | YVAWDSVYYM | 25817 |
| HPV18 | E2 | 9 | 164 | YVKEGYNTF | 25818 |
| HPV18 | E2 | 10 | 164 | YVKEGYNTFY | 25819 |
| HPV18 | E2 | 11 | 164 | YVKEGYNTFYI | 25820 |
| HPV18 | E5 | 8 | 27 | CMCAYAWV | 25821 |
| HPV18 | E5 | 9 | 27 | CMCAYAWVL | 25822 |
| HPV18 | E5 | 10 | 27 | CMCAYAWVLV | 25823 |
| HPV18 | E5 | 11 | 27 | CMCAYAWVLVF | 25824 |
| HPV18 | E5 | 8 | 13 | CMYVCCHV | 25825 |
| HPV18 | E5 | 10 | 13 | CMYVCCHVPL | 25826 |
| HPV18 | E5 | 11 | 13 | CMYVCCHVPLL | 25827 |
| HPV18 | E5 | 10 | 11 | CVCMYVCCHV | 25828 |
| HPV18 | E5 | 9 | 6 | FLFCFCVCM | 25829 |
| HPV18 | E5 | 10 | 6 | FLFCFCVCMY | 25830 |
| HPV18 | E5 | 11 | 6 | FLFCFCVCMYV | 25831 |
| HPV18 | E5 | 8 | 57 | FLLPMLLL | 25832 |
| HPV18 | E5 | 10 | 57 | FLLPMLLLHI | 25833 |
| HPV18 | E5 | 11 | 37 | FVYIVVITSPA | 25834 |
| HPV18 | E5 | 8 | 65 | HIHAILSL | 25835 |
| HPV18 | E5 | 8 | 19 | HVPLLPSV | 25836 |
| HPV18 | E5 | 10 | 19 | HVPLLPSVCM | 25837 |
| HPV18 | E5 | 8 | 40 | IVVITSPA | 25838 |
| HPV18 | E5 | 10 | 40 | IVVITSPATA | 25839 |
| HPV18 | E5 | 11 | 40 | IVVITSPATAF | 25840 |
| HPV18 | E5 | 9 | 4 | LIFLFCFCV | 25841 |
| HPV18 | E5 | 11 | 4 | LIFLFCFCVCM | 25842 |
| HPV18 | E5 | 8 | 63 | LLHIHAIL | 25843 |
| HPV18 | E5 | 10 | 63 | LLHIHAILSL | 25844 |
| HPV18 | E5 | 8 | 62 | LLLHIHAI | 25845 |
| HPV18 | E5 | 9 | 62 | LLLHIHAIL | 25846 |
| HPV18 | E5 | 11 | 62 | LLLHIHAILSL | 25847 |
| HPV18 | E5 | 9 | 58 | LLPMLLLHI | 25848 |
| HPV18 | E5 | 11 | 58 | LLPMLLLHIHA | 25849 |
| HPV18 | E5 | 9 | 22 | LLPSVCMCA | 25850 |
| HPV18 | E5 | 10 | 22 | LLPSVCMCAY | 25851 |
| HPV18 | E5 | 11 | 22 | LLPSVCMCAYA | 25852 |
| HPV18 | E5 | 8 | 59 | LPMLLLHI | 25853 |
| HPV18 | E5 | 10 | 59 | LPMLLLHIHA | 25854 |
| HPV18 | E5 | 11 | 59 | LPMLLLHIHAI | 25855 |
| HPV18 | E5 | 8 | 23 | LPSVCMCA | 25856 |
| HPV18 | E5 | 9 | 23 | LPSVCMCAY | 25857 |
| HPV18 | E5 | 10 | 23 | LPSVCMCAYA | 25858 |
| HPV18 | E5 | 11 | 23 | LPSVCMCAYAW | 25859 |
| HPV18 | E5 | 8 | 35 | LVFVYIVV | 25860 |
| HPV18 | E5 | 9 | 35 | LVFVYIVVI | 25861 |
| HPV18 | E5 | 8 | 61 | MLLLHIHA | 25862 |
| HPV18 | E5 | 9 | 61 | MLLLHIHAI | 25863 |
| HPV18 | E5 | 10 | 61 | MLLLHIHAIL | 25864 |
| HPV18 | E5 | 8 | 1 | MLSLIFLF | 25865 |
| HPV18 | E5 | 10 | 1 | MLSLIFLCF | 25866 |
| HPV18 | E5 | 8 | 21 | PLLPSVCM | 25867 |
| HPV18 | E5 | 10 | 21 | PLLPSVCMCA | 25868 |
| HPV18 | E5 | 11 | 21 | PLLPSVCMCAY | 25869 |
| HPV18 | E5 | 9 | 60 | PMLLLHIHA | 25870 |
| HPV18 | E5 | 10 | 60 | PMLLLHIHAI | 25871 |
| HPV18 | E5 | 11 | 60 | PMLLLHIHAIL | 25872 |
| HPV18 | E5 | 8 | 3 | SLIFLFCF | 25873 |
| HPV18 | E5 | 10 | 3 | SLIFLFCFCV | 25874 |
| HPV18 | E5 | 8 | 45 | SPATAFTV | 25875 |
| HPV18 | E5 | 9 | 45 | SPATAFTVY | 25876 |
| HPV18 | E5 | 10 | 45 | SPATAFTVYV | 25877 |
| HPV18 | E5 | 11 | 45 | SPATAFTVYVF | 25878 |
| HPV18 | E5 | 8 | 25 | SVCMCAYA | 25879 |
| HPV18 | E5 | 9 | 25 | SVCMCAYAW | 25880 |
| HPV18 | E5 | 10 | 25 | SVCMCAYAWV | 25881 |
| HPV18 | E5 | 11 | 25 | SVCMCAYAWVL | 25882 |
| HPV18 | E5 | 8 | 51 | TVYVFCFL | 25883 |
| HPV18 | E5 | 9 | 51 | TVYVFCFLL | 25884 |

TABLE XIV-continued

B62 Supermotif Peptides

| Type | Protein | No. of Amino Acid | Position | Sequence | Seq. Id. No. |
|---|---|---|---|---|---|
| HPV18 | E5 | 11 | 51 | TVYVFCFLLPM | 25885 |
| HPV18 | E5 | 8 | 42 | VITSPATA | 25886 |
| HPV18 | E5 | 9 | 42 | VITSPATAF | 25887 |
| HPV18 | E5 | 11 | 42 | VITSPATAFTV | 25888 |
| HPV18 | E5 | 8 | 34 | VLVFVYIV | 25889 |
| HPV18 | E5 | 9 | 34 | VLVFVYIVV | 25890 |
| HPV18 | E5 | 10 | 34 | VLVFVYIVVI | 25891 |
| HPV18 | E5 | 9 | 20 | VPLLPSVCM | 25892 |
| HPV18 | E5 | 11 | 20 | VPLLPSVCMCA | 25893 |
| HPV18 | E5 | 9 | 41 | VVITSPATA | 25894 |
| HPV18 | E5 | 10 | 41 | VVITSPATAF | 25895 |
| HPV18 | E5 | 8 | 33 | WVLVFVYI | 25896 |
| HPV18 | E5 | 9 | 33 | WVLVFVYIV | 25897 |
| HPV18 | E5 | 10 | 33 | WVLVFVYIVV | 25898 |
| HPV18 | E5 | 11 | 33 | WVLVFVYIVVI | 25899 |
| HPV18 | E5 | 9 | 39 | YIVVITSPA | 25900 |
| HPV18 | E5 | 11 | 39 | YIVVITSPATA | 25901 |
| HPV18 | E5 | 8 | 15 | YVCCHVPL | 25902 |
| HPV18 | E5 | 9 | 15 | YVCCHVPLL | 25903 |
| HPV18 | E5 | 9 | 53 | YVFCFLLPM | 25904 |
| HPV18 | E5 | 10 | 53 | YVFCFLLPML | 25905 |
| HPV18 | E5 | 11 | 53 | YVFCFLLPMLL | 25906 |
| HPV18 | E6 | 8 | 68 | CIDFYSRI | 25907 |
| HPV18 | E6 | 11 | 68 | CIDFYSRIREL | 25908 |
| HPV18 | E6 | 8 | 105 | CLRCQKPL | 25909 |
| HPV18 | E6 | 11 | 105 | CLRCQKPLNPA | 25910 |
| HPV18 | E6 | 8 | 108 | CQKPLNPA | 25911 |
| HPV18 | E6 | 11 | 108 | CQKPLNPAEKL | 25912 |
| HPV18 | E6 | 8 | 32 | CVYCKTVL | 25913 |
| HPV18 | E6 | 10 | 32 | CVYCKTVLEL | 25914 |
| HPV18 | E6 | 8 | 27 | DIEITCVY | 25915 |
| HPV18 | E6 | 10 | 16 | DLCTELNTSL | 25916 |
| HPV18 | E6 | 10 | 51 | DLFVVYRDSI | 25917 |
| HPV18 | E6 | 9 | 6 | DPTRRPYKL | 25918 |
| HPV18 | E6 | 10 | 29 | EITCVYCKTV | 25919 |
| HPV18 | E6 | 11 | 29 | EITCVYCKTVL | 25920 |
| HPV18 | E6 | 9 | 20 | ELNTSLQDI | 25921 |
| HPV18 | E6 | 11 | 20 | ELNTSLQDIEI | 25922 |
| HPV18 | E6 | 9 | 77 | ELRHYSDSV | 25923 |
| HPV18 | E6 | 10 | 77 | ELRHYSDSVY | 25924 |
| HPV18 | E6 | 8 | 40 | ELTEVFEF | 25925 |
| HPV18 | E6 | 9 | 40 | ELTEVFEFA | 25926 |
| HPV18 | E6 | 10 | 40 | ELTEVFEFAF | 25927 |
| HPV18 | E6 | 10 | 43 | EVFEFAFKDL | 25928 |
| HPV18 | E6 | 11 | 43 | EVFEFAFKDLF | 25929 |
| HPV18 | E6 | 8 | 53 | FVVYRDSI | 25930 |
| HPV18 | E6 | 11 | 53 | FVVYRDSIPHA | 25931 |
| HPV18 | E6 | 10 | 97 | GLYNLLIRCL | 25932 |
| HPV18 | E6 | 10 | 136 | GQCHSCCNRA | 25933 |
| HPV18 | E6 | 8 | 120 | HLNEKRRF | 25934 |
| HPV18 | E6 | 11 | 120 | HLNEKRRFHNI | 25935 |
| HPV18 | E6 | 10 | 60 | IPHAACHKCI | 25936 |
| HPV18 | E6 | 9 | 13 | KLPDLCTEL | 25937 |
| HPV18 | E6 | 11 | 117 | KLRHLNEKRRF | 25938 |
| HPV18 | E6 | 8 | 92 | KLTNTGLY | 25939 |
| HPV18 | E6 | 10 | 92 | KLTNTGLYNL | 25940 |
| HPV18 | E6 | 11 | 92 | KLTNTGLYNLL | 25941 |
| HPV18 | E6 | 9 | 110 | KPLNPAEKL | 25942 |
| HPV18 | E6 | 11 | 102 | LIRCLRCQKPL | 25943 |
| HPV18 | E6 | 8 | 14 | LPDLCTEL | 25944 |
| HPV18 | E6 | 9 | 25 | LQDIEITCV | 25945 |
| HPV18 | E6 | 10 | 25 | LQDIEITCVY | 25946 |
| HPV18 | E6 | 9 | 150 | LQRRRETQV | 25947 |
| HPV18 | E6 | 9 | 113 | NPAEKLRHL | 25948 |
| HPV18 | E6 | 8 | 111 | PLNPAEKL | 25949 |
| HPV18 | E6 | 11 | 111 | PLNPAEKLRHL | 25950 |
| HPV18 | E6 | 8 | 74 | RIRELRHY | 25951 |
| HPV18 | E6 | 10 | 149 | RLQRRRETQV | 25952 |
| HPV18 | E6 | 8 | 10 | RPYKLPDL | 25953 |
| HPV18 | E6 | 11 | 59 | SIPHAACHKCI | 25954 |
| HPV18 | E6 | 10 | 24 | SLQDIEITCV | 25955 |
| HPV18 | E6 | 11 | 24 | SLQDIEITCVY | 25956 |
| HPV18 | E6 | 10 | 84 | SVYGDTLEKL | 25957 |
| HPV18 | E6 | 10 | 89 | TLEKLTNTGL | 25958 |
| HPV18 | E6 | 11 | 89 | TLEKLTNTGLY | 25959 |

TABLE XIV-continued

B62 Supermotif Peptides

| Type | Protein | No. of Amino Acid | Position | Sequence | Seq. Id. No. |
|---|---|---|---|---|---|
| HPV18 | E6 | 8 | 37 | TVLELTEV | 25960 |
| HPV18 | E6 | 9 | 37 | TVLELTEVF | 25961 |
| HPV18 | E6 | 11 | 37 | TVLELTEVFEF | 25962 |
| HPV18 | E6 | 8 | 38 | VLELTEVF | 25963 |
| HPV18 | E6 | 10 | 38 | VLELTEVFEF | 25964 |
| HPV18 | E6 | 11 | 38 | VLELTEVFEFA | 25965 |
| HPV18 | E6 | 10 | 54 | VVYRDSIPHA | 25966 |
| HPV18 | E6 | 11 | 54 | VVYRDSIPHAA | 25967 |
| HPV18 | E7 | 8 | 63 | CMCCKCEA | 25968 |
| HPV18 | E7 | 10 | 63 | CMCCKCEARI | 25969 |
| HPV18 | E7 | 8 | 24 | DLLCHEQL | 25970 |
| HPV18 | E7 | 8 | 82 | DLRAFQQL | 25971 |
| HPV18 | E7 | 9 | 82 | DLRAFQQLF | 25972 |
| HPV18 | E7 | 10 | 82 | DLRAFQQLFL | 25973 |
| HPV18 | E7 | 10 | 40 | EIDGVNHQHL | 25974 |
| HPV18 | E7 | 8 | 16 | EPQNEIPV | 25975 |
| HPV18 | E7 | 10 | 16 | EPQNEIPVDL | 25976 |
| HPV18 | E7 | 11 | 16 | EPQNEIPVDLL | 25977 |
| HPV18 | E7 | 8 | 55 | EPQRHTML | 25978 |
| HPV18 | E7 | 10 | 55 | EPQRHTMLCM | 25979 |
| HPV18 | E7 | 8 | 90 | FLNTLSFV | 25980 |
| HPV18 | E7 | 11 | 90 | FLNTLSFVCPW | 25981 |
| HPV18 | E7 | 9 | 86 | FQQLFLNTL | 25982 |
| HPV18 | E7 | 11 | 86 | FQQLFLNTLSF | 25983 |
| HPV18 | E7 | 9 | 3 | GPKATLQDI | 25984 |
| HPV18 | E7 | 10 | 3 | GPKATLQDIV | 25985 |
| HPV18 | E7 | 11 | 3 | GPKATLQDIVL | 25986 |
| HPV18 | E7 | 9 | 43 | GVNHQHLPA | 25987 |
| HPV18 | E7 | 8 | 14 | HLEPQNEI | 25988 |
| HPV18 | E7 | 10 | 14 | HLEPQNEIPV | 25989 |
| HPV18 | E7 | 9 | 46 | HQHLPARRA | 25990 |
| HPV18 | E7 | 11 | 21 | IPVDLLCHEQL | 25991 |
| HPV18 | E7 | 11 | 11 | IVLHLEPQNEI | 25992 |
| HPV18 | E7 | 8 | 73 | KLVVESSA | 25993 |
| HPV18 | E7 | 11 | 73 | KLVVESSADDL | 25994 |
| HPV18 | E7 | 8 | 8 | LQDIVLHL | 25995 |
| HPV18 | E7 | 10 | 74 | LVVESSADDL | 25996 |
| HPV18 | E7 | 10 | 61 | MLCMCCKCEA | 25997 |
| HPV18 | E7 | 9 | 17 | PQNEIPVDL | 25998 |
| HPV18 | E7 | 10 | 17 | PQNEIPVDLL | 25999 |
| HPV18 | E7 | 9 | 56 | PQRHTMLCM | 26000 |
| HPV18 | E7 | 10 | 22 | PVDLLCHEQL | 26001 |
| HPV18 | E7 | 9 | 88 | QLFLNTLSF | 26002 |
| HPV18 | E7 | 10 | 88 | QLFLNTLSFV | 26003 |
| HPV18 | E7 | 8 | 87 | QQLFLNTL | 26004 |
| HPV18 | E7 | 10 | 87 | QQLFLNTLSF | 26005 |
| HPV18 | E7 | 11 | 87 | QQLFLNTLSFV | 26006 |
| HPV18 | E7 | 10 | 71 | RIKLVVESSA | 26007 |
| HPV18 | E7 | 9 | 7 | TLQDIVLHL | 26008 |
| HPV18 | E7 | 8 | 93 | TLSFVCPW | 26009 |
| HPV18 | E7 | 10 | 93 | TLSFVCPWCA | 26010 |
| HPV18 | E7 | 11 | 60 | TMLCMCCKCEA | 26011 |
| HPV18 | E7 | 10 | 12 | VLHLEPQNEI | 26012 |
| HPV18 | E7 | 9 | 75 | VVESSADDL | 26013 |
| HPV18 | E7 | 11 | 75 | VVESSADDLRA | 26014 |
| HPV18 | L1 | 11 | 225 | AIGEHWAKGTA | 26015 |
| HPV18 | L1 | 8 | 487 | AITCQKDA | 26016 |
| HPV18 | L1 | 9 | 487 | AITCQKDAA | 26017 |
| HPV18 | L1 | 11 | 487 | AITCQKDAAPA | 26018 |
| HPV18 | L1 | 10 | 63 | ALWRPSDNTV | 26019 |
| HPV18 | L1 | 11 | 63 | ALWRPSDNTVY | 26020 |
| HPV18 | L1 | 9 | 495 | APAENKDPY | 26021 |
| HPV18 | L1 | 8 | 223 | APAIGEHW | 26022 |
| HPV18 | L1 | 9 | 223 | APAIGEHWA | 26023 |
| HPV18 | L1 | 11 | 549 | APSATTSSKPA | 26024 |
| HPV18 | L1 | 8 | 377 | AQGHNNGV | 26025 |
| HPV18 | L1 | 10 | 377 | AQGHNNGVCW | 26026 |
| HPV18 | L1 | 8 | 218 | CILGCAPA | 26027 |
| HPV18 | L1 | 9 | 218 | CILGCAPAI | 26028 |
| HPV18 | L1 | 8 | 310 | CLRREQLF | 26029 |
| HPV18 | L1 | 9 | 310 | CLRREQLFA | 26030 |
| HPV18 | L1 | 8 | 2 | CLYTRVLI | 26031 |
| HPV18 | L1 | 9 | 2 | CLYTRVLIL | 26032 |
| HPV18 | L1 | 11 | 2 | CLYTRVLILHY | 26033 |
| HPV18 | L1 | 10 | 246 | CPPLELKNTV | 26034 |

TABLE XIV-continued

B62 Supermotif Peptides

| Type | Protein | No. of Amino Acid | Position | Sequence | Seq. Id. No. |
|---|---|---|---|---|---|
| HPV18 | L1 | 11 | 246 | CPPLELKNTVL | 26035 |
| HPV18 | L1 | 8 | 490 | CQKDAAPA | 26036 |
| HPV18 | L1 | 10 | 286 | CQSICKYPDY | 26037 |
| HPV18 | L1 | 11 | 286 | CQSICKYPDYL | 26038 |
| HPV18 | L1 | 11 | 350 | CVYSPSPSGSI | 26039 |
| HPV18 | L1 | 9 | 284 | DICQSICKY | 26040 |
| HPV18 | L1 | 8 | 122 | DIPKVSAY | 26041 |
| HPV18 | L1 | 10 | 122 | DIPKVSAYQY | 26042 |
| HPV18 | L1 | 11 | 520 | DLDQYPLGRKF | 26043 |
| HPV18 | L1 | 8 | 512 | DLKEKFSL | 26044 |
| HPV18 | L1 | 10 | 512 | DLKEKFSLDL | 26045 |
| HPV18 | L1 | 8 | 433 | DLQFIFQL | 26046 |
| HPV18 | L1 | 11 | 433 | DLQFIFQLCTI | 26047 |
| HPV18 | L1 | 9 | 260 | DMVDTGYGA | 26048 |
| HPV18 | L1 | 10 | 260 | DMVDTGYGAM | 26049 |
| HPV18 | L1 | 8 | 501 | DPYDKLKF | 26050 |
| HPV18 | L1 | 9 | 501 | DPYDKLKFW | 26051 |
| HPV18 | L1 | 11 | 501 | DPYDKLKFWNV | 26052 |
| HPV18 | L1 | 8 | 301 | DPYGDSMF | 26053 |
| HPV18 | L1 | 9 | 301 | DPYGDSMFF | 26054 |
| HPV18 | L1 | 11 | 301 | DPYGDSMFFCL | 26055 |
| HPV18 | L1 | 9 | 522 | DQYPLGRKF | 26056 |
| HPV18 | L1 | 10 | 522 | DQYPLGRKFL | 26057 |
| HPV18 | L1 | 11 | 522 | DQYPLGRKFLV | 26058 |
| HPV18 | L1 | 9 | 448 | DVMSYIHSM | 26059 |
| HPV18 | L1 | 8 | 203 | DVRDNVSV | 26060 |
| HPV18 | L1 | 10 | 203 | DVRDNVSVDY | 26061 |
| HPV18 | L1 | 8 | 167 | EIGRGQPL | 26062 |
| HPV18 | L1 | 10 | 167 | EIGRGQPLGV | 26063 |
| HPV18 | L1 | 8 | 314 | EQLFARHF | 26064 |
| HPV18 | L1 | 9 | 314 | EQLFARHFW | 26065 |
| HPV18 | L1 | 10 | 280 | EVPLDICQSI | 26066 |
| HPV18 | L1 | 8 | 436 | FIFQLCTI | 26067 |
| HPV18 | L1 | 10 | 436 | FIFQLCTITL | 26068 |
| HPV18 | L1 | 8 | 49 | FLRNVNVF | 26069 |
| HPV18 | L1 | 10 | 49 | FLRNVNVFPI | 26070 |
| HPV18 | L1 | 11 | 49 | FLRNVNVFPIF | 26071 |
| HPV18 | L1 | 8 | 56 | FPIFLQMA | 26072 |
| HPV18 | L1 | 9 | 56 | FPIFLQMAL | 26073 |
| HPV18 | L1 | 10 | 56 | FPIFLQMALW | 26074 |
| HPV18 | L1 | 8 | 438 | FQLCTITL | 26075 |
| HPV18 | L1 | 10 | 438 | FQLCTITLTA | 26076 |
| HPV18 | L1 | 8 | 145 | GLPDTSIY | 26077 |
| HPV18 | L1 | 8 | 535 | GLRRKPTI | 26078 |
| HPV18 | L1 | 8 | 177 | GLSGHPFY | 26079 |
| HPV18 | L1 | 11 | 177 | GLSGHPFYNKL | 26080 |
| HPV18 | L1 | 10 | 342 | GMPASPGSCV | 26081 |
| HPV18 | L1 | 11 | 342 | GMPASPGSCVY | 26082 |
| HPV18 | L1 | 9 | 19 | GPLYHPRPL | 26083 |
| HPV18 | L1 | 11 | 19 | GPLYHPRPLPL | 26084 |
| HPV18 | L1 | 10 | 543 | GPRKRSAPSA | 26085 |
| HPV18 | L1 | 8 | 171 | GQPLGVGL | 26086 |
| HPV18 | L1 | 8 | 415 | GQYDATKF | 26087 |
| HPV18 | L1 | 11 | 415 | GQYDATKFKQY | 26088 |
| HPV18 | L1 | 8 | 383 | GVCWHNQL | 26089 |
| HPV18 | L1 | 9 | 383 | GVCWHNQLF | 26090 |
| HPV18 | L1 | 10 | 383 | GVCWHNQLFV | 26091 |
| HPV18 | L1 | 10 | 165 | GVEIGRGQPL | 26092 |
| HPV18 | L1 | 9 | 175 | GVGLSGHPF | 26093 |
| HPV18 | L1 | 10 | 175 | GVGLSGHPFY | 26094 |
| HPV18 | L1 | 10 | 467 | GVPPPPTTSL | 26095 |
| HPV18 | L1 | 11 | 467 | GVPPPPTTSLV | 26096 |
| HPV18 | L1 | 8 | 38 | HIIICGHY | 26097 |
| HPV18 | L1 | 9 | 38 | HIIICGHYI | 26098 |
| HPV18 | L1 | 10 | 38 | HIIICGHYII | 26099 |
| HPV18 | L1 | 11 | 38 | HIIICGHYIIL | 26100 |
| HPV18 | L1 | 9 | 13 | HLLPLYGPL | 26101 |
| HPV18 | L1 | 10 | 13 | HLLPLYGPLY | 26102 |
| HPV18 | L1 | 10 | 23 | HPRPLPLHSI | 26103 |
| HPV18 | L1 | 11 | 23 | HPRPLPLHSIL | 26104 |
| HPV18 | L1 | 9 | 428 | HVEEYDLQF | 26105 |
| HPV18 | L1 | 10 | 428 | HVEEYDLQFI | 26106 |
| HPV18 | L1 | 11 | 428 | HVEEYDLQFIF | 26107 |
| HPV18 | L1 | 8 | 40 | IICGHYII | 26108 |
| HPV18 | L1 | 9 | 40 | IICGHYIIL | 26109 |

TABLE XIV-continued

B62 Supermotif Peptides

| Type | Protein | No. of Amino Acid | Position | Sequence | Seq. Id. No. |
|---|---|---|---|---|---|
| HPV18 | L1 | 10 | 40 | IICGHYIILP | 26110 |
| HPV18 | L1 | 11 | 40 | IICGHYIILFL | 26111 |
| HPV18 | L1 | 8 | 39 | IIICGHYI | 26112 |
| HPV18 | L1 | 9 | 39 | IIICGHYII | 26113 |
| HPV18 | L1 | 10 | 39 | IIICGHYIIL | 26114 |
| HPV18 | L1 | 11 | 39 | IIICGHYIILF | 26115 |
| HPV18 | L1 | 8 | 46 | IILFLRNV | 26116 |
| HPV18 | L1 | 10 | 46 | IILFLRNVNV | 26117 |
| HPV18 | L1 | 11 | 46 | IILFLRNVNVF | 26118 |
| HPV18 | L1 | 9 | 460 | ILEDWNFGV | 26119 |
| HPV18 | L1 | 9 | 47 | ILFLRNVNV | 26120 |
| HPV18 | L1 | 10 | 47 | ILFLRNVNVF | 26121 |
| HPV18 | L1 | 8 | 219 | ILGCAPAI | 26122 |
| HPV18 | L1 | 9 | 9 | ILHYHLLPL | 26123 |
| HPV18 | L1 | 10 | 9 | ILHYHLLPLY | 26124 |
| HPV18 | L1 | 8 | 32 | ILVYMVHI | 26125 |
| HPV18 | L1 | 9 | 32 | ILVYMVHII | 26126 |
| HPV18 | L1 | 10 | 32 | ILVYMVHIII | 26127 |
| HPV18 | L1 | 9 | 123 | IPKVSAYQY | 26128 |
| HPV18 | L1 | 11 | 123 | IPKVSAYQYRV | 26129 |
| HPV18 | L1 | 8 | 360 | IVTSDSQL | 26130 |
| HPV18 | L1 | 9 | 360 | IVTSDSQLF | 26131 |
| HPV18 | L1 | 10 | 186 | KLDDTESSHA | 26132 |
| HPV18 | L1 | 11 | 186 | KLDDTESSHAA | 26133 |
| HPV18 | L1 | 9 | 505 | KLKFWNVDL | 26134 |
| HPV18 | L1 | 8 | 557 | KPAKRVRV | 26135 |
| HPV18 | L1 | 10 | 557 | KPAKRVRVRA | 26136 |
| HPV18 | L1 | 11 | 539 | KPTIGPRKRSA | 26137 |
| HPV18 | L1 | 8 | 370 | KPYWLHKA | 26138 |
| HPV18 | L1 | 9 | 120 | KQDIPKVSA | 26139 |
| HPV18 | L1 | 10 | 120 | KQDIPKVSAY | 26140 |
| HPV18 | L1 | 8 | 213 | KQTQLCIL | 26141 |
| HPV18 | L1 | 11 | 213 | KQTQLCILGCA | 26142 |
| HPV18 | L1 | 10 | 423 | KQYSRHVEEY | 26143 |
| HPV18 | L1 | 9 | 125 | KVSAYQYRV | 26144 |
| HPV18 | L1 | 10 | 125 | KVSAYQYRVF | 26145 |
| HPV18 | L1 | 8 | 8 | LILHYHLL | 26146 |
| HPV18 | L1 | 10 | 8 | LILHYHLLPL | 26147 |
| HPV18 | L1 | 11 | 8 | LILHYHLLPLY | 26148 |
| HPV18 | L1 | 8 | 14 | LLPLYGPL | 26149 |
| HPV18 | L1 | 9 | 14 | LLPLYGPLY | 26150 |
| HPV18 | L1 | 8 | 103 | LLTVGNPY | 26151 |
| HPV18 | L1 | 9 | 103 | LLTVGNPYF | 26152 |
| HPV18 | L1 | 11 | 103 | LLTVGNPYFRV | 26153 |
| HPV18 | L1 | 9 | 138 | LPDPNKFGL | 26154 |
| HPV18 | L1 | 8 | 27 | LPLHSILV | 26155 |
| HPV18 | L1 | 9 | 27 | LPLHSILVY | 26156 |
| HPV18 | L1 | 10 | 27 | LPLHSILVYM | 26157 |
| HPV18 | L1 | 11 | 27 | LPLHSILVYMV | 26158 |
| HPV18 | L1 | 8 | 15 | LPLYGPLY | 26159 |
| HPV18 | L1 | 9 | 74 | LPPPSVARV | 26160 |
| HPV18 | L1 | 10 | 74 | LPPPSVARVV | 26161 |
| HPV18 | L1 | 8 | 274 | LQDTKCEV | 26162 |
| HPV18 | L1 | 10 | 274 | LQDTKCEVPL | 26163 |
| HPV18 | L1 | 10 | 434 | LQFIFQLCTI | 26164 |
| HPV18 | L1 | 8 | 296 | LQMSADPY | 26165 |
| HPV18 | L1 | 8 | 476 | LVDTYRFV | 26166 |
| HPV18 | L1 | 11 | 476 | LVDTYRFVQSV | 26167 |
| HPV18 | L1 | 8 | 159 | LVWACAGV | 26168 |
| HPV18 | L1 | 10 | 159 | LVWACAGVEI | 26169 |
| HPV18 | L1 | 8 | 33 | LVYMVHII | 26170 |
| HPV18 | L1 | 9 | 33 | LVYMVHIII | 26171 |
| HPV18 | L1 | 9 | 343 | MPASPGSCV | 26172 |
| HPV18 | L1 | 10 | 343 | MPASPGSCVY | 26173 |
| HPV18 | L1 | 8 | 261 | MVDTGYGA | 26174 |
| HPV18 | L1 | 9 | 261 | MVDTGYGAM | 26175 |
| HPV18 | L1 | 11 | 261 | MVDTGYGAMDF | 26176 |
| HPV18 | L1 | 10 | 36 | MVHIIICGHY | 26177 |
| HPV18 | L1 | 11 | 36 | MVHIIICGHYI | 26178 |
| HPV18 | L1 | 8 | 153 | NPETQRLV | 26179 |
| HPV18 | L1 | 9 | 153 | NPETQRLVW | 26180 |
| HPV18 | L1 | 10 | 153 | NPETQRLVWA | 26181 |
| HPV18 | L1 | 8 | 108 | NPYFRVPA | 26182 |
| HPV18 | L1 | 8 | 388 | NQLFVTVV | 26183 |
| HPV18 | L1 | 8 | 510 | NVDLKEKF | 26184 |

TABLE XIV-continued

B62 Supermotif Peptides

| Type | Protein | No. of Amino Acid | Position | Sequence | Seq. Id. No. |
|---|---|---|---|---|---|
| HPV18 | L1 | 10 | 510 | NVDLKEKFSL | 26185 |
| HPV18 | L1 | 9 | 54 | NVFPIFLQM | 26186 |
| HPV18 | L1 | 10 | 54 | NVFPIFLQMA | 26187 |
| HPV18 | L1 | 11 | 54 | NVFPIFLQMAL | 26188 |
| HPV18 | L1 | 8 | 52 | NVNVFPIF | 26189 |
| HPV18 | L1 | 9 | 52 | NVNVFPIFL | 26190 |
| HPV18 | L1 | 11 | 52 | NVNVFPIFLQM | 26191 |
| HPV18 | L1 | 10 | 199 | NVSEDVRDNV | 26192 |
| HPV18 | L1 | 11 | 207 | NVSVDYKQTQL | 26193 |
| HPV18 | L1 | 8 | 57 | PIFLQMAL | 26194 |
| HPV18 | L1 | 9 | 57 | PIFLQMALW | 26195 |
| HPV18 | L1 | 8 | 282 | PLDICQSI | 26196 |
| HPV18 | L1 | 11 | 282 | PLDICQSICKY | 26197 |
| HPV18 | L1 | 8 | 248 | PLELKNTV | 26198 |
| HPV18 | L1 | 9 | 248 | PLELKNTVL | 26199 |
| HPV18 | L1 | 8 | 525 | PLGRKFLV | 26200 |
| HPV18 | L1 | 10 | 525 | PLGRKFLVQA | 26201 |
| HPV18 | L1 | 11 | 173 | PLGVGLSGHPF | 26202 |
| HPV18 | L1 | 8 | 28 | PLHSILVY | 26203 |
| HPV18 | L1 | 9 | 28 | PLHSILVYM | 26204 |
| HPV18 | L1 | 10 | 28 | PLHSILVYMV | 26205 |
| HPV18 | L1 | 8 | 26 | PLPLHSIL | 26206 |
| HPV18 | L1 | 9 | 26 | PLPLHSILV | 26207 |
| HPV18 | L1 | 10 | 26 | PLPLHSILVY | 26208 |
| HPV18 | L1 | 11 | 26 | PLPLHSILVYM | 26209 |
| HPV18 | L1 | 10 | 240 | PLSQGDCPPL | 26210 |
| HPV18 | L1 | 8 | 20 | PLYHPRPL | 26211 |
| HPV18 | L1 | 10 | 20 | PLYHPRPLPL | 26212 |
| HPV18 | L1 | 9 | 247 | PPLELKNTV | 26213 |
| HPV18 | L1 | 10 | 247 | PPLELKNTVL | 26214 |
| HPV18 | L1 | 8 | 469 | PPPPTTSL | 26215 |
| HPV18 | L1 | 9 | 469 | PPPPTTSLV | 26216 |
| HPV18 | L1 | 8 | 75 | PPPSVARV | 26217 |
| HPV18 | L1 | 9 | 75 | PPPSVARVV | 26218 |
| HPV18 | L1 | 8 | 470 | PPPTTSLV | 26219 |
| HPV18 | L1 | 11 | 470 | PPPTTSLVDTY | 26220 |
| HPV18 | L1 | 8 | 76 | PPSVARVV | 26221 |
| HPV18 | L1 | 10 | 471 | PPTTSLVDTY | 26222 |
| HPV18 | L1 | 11 | 333 | PQSLYIKGTGM | 26223 |
| HPV18 | L1 | 8 | 412 | PVPGQYDA | 26224 |
| HPV18 | L1 | 11 | 412 | PVPGQYDATKF | 26225 |
| HPV18 | L1 | 8 | 216 | QLCILGCA | 26226 |
| HPV18 | L1 | 10 | 216 | QLCILGCAPA | 26227 |
| HPV18 | L1 | 11 | 216 | QLCILGCAPAI | 26228 |
| HPV18 | L1 | 9 | 439 | QLCTITLTA | 26229 |
| HPV18 | L1 | 11 | 439 | QLCTITLTADV | 26230 |
| HPV18 | L1 | 8 | 315 | QLFARHFW | 26231 |
| HPV18 | L1 | 11 | 315 | QLFARHFWNRA | 26232 |
| HPV18 | L1 | 8 | 366 | QLFNKPYW | 26233 |
| HPV18 | L1 | 9 | 366 | QLFNKPYWL | 26234 |
| HPV18 | L1 | 8 | 137 | QLPDPNKF | 26235 |
| HPV18 | L1 | 10 | 137 | QLPDPNKFGL | 26236 |
| HPV18 | L1 | 11 | 297 | QMSADPYGDSM | 26237 |
| HPV18 | L1 | 9 | 102 | RLLTVGNPY | 26238 |
| HPV18 | L1 | 10 | 102 | RLLTVGNPYF | 26239 |
| HPV18 | L1 | 9 | 158 | RLVWACAGV | 26240 |
| HPV18 | L1 | 11 | 158 | RLVWACAGVEI | 26241 |
| HPV18 | L1 | 8 | 25 | RPLPLHSI | 26242 |
| HPV18 | L1 | 9 | 25 | RPLPLHSIL | 26243 |
| HPV18 | L1 | 10 | 25 | RPLPLHSILV | 26244 |
| HPV18 | L1 | 11 | 25 | RPLPLHSILVY | 26245 |
| HPV18 | L1 | 11 | 239 | RPLSQGDCPPL | 26246 |
| HPV18 | L1 | 8 | 66 | RPSDNTVY | 26247 |
| HPV18 | L1 | 9 | 66 | RPSDNTVYL | 26248 |
| HPV18 | L1 | 9 | 6 | RVLILHYHL | 26249 |
| HPV18 | L1 | 10 | 6 | RVLILHYHLL | 26250 |
| HPV18 | L1 | 10 | 135 | RVQLPDPNKF | 26251 |
| HPV18 | L1 | 8 | 81 | RVVNTDDY | 26252 |
| HPV18 | L1 | 9 | 81 | RVVNTDDYV | 26253 |
| HPV18 | L1 | 8 | 288 | SICKYPDY | 26254 |
| HPV18 | L1 | 9 | 288 | SICKYPDYL | 26255 |
| HPV18 | L1 | 11 | 288 | SICKYPDYLQM | 26256 |
| HPV18 | L1 | 11 | 93 | SIFYHAGSSRL | 26257 |
| HPV18 | L1 | 8 | 459 | SILEDWNF | 26258 |
| HPV18 | L1 | 10 | 459 | SILEDWNFGV | 26259 |

TABLE XIV-continued

B62 Supermotif Peptides

| Type | Protein | No. of Amino Acid | Position | Sequence | Seq. Id. No. |
|---|---|---|---|---|---|
| HPV18 | L1 | 9 | 31 | SILVYMVHI | 26260 |
| HPV18 | L1 | 10 | 31 | SILVYMVHII | 26261 |
| HPV18 | L1 | 11 | 31 | SILVYMVHIII | 26262 |
| HPV18 | L1 | 9 | 359 | SIVTSDSQL | 26263 |
| HPV18 | L1 | 10 | 359 | SIVTSDSQLF | 26264 |
| HPV18 | L1 | 10 | 150 | SIYNPETQRL | 26265 |
| HPV18 | L1 | 11 | 150 | SIYNPETQRLV | 26266 |
| HPV18 | L1 | 9 | 518 | SLDLDQYPL | 26267 |
| HPV18 | L1 | 8 | 475 | SLVDTYRF | 26268 |
| HPV18 | L1 | 9 | 475 | SLVDTYRFV | 26269 |
| HPV18 | L1 | 9 | 335 | SLYIKGTGM | 26270 |
| HPV18 | L1 | 11 | 335 | SLYIKGTGMPA | 26271 |
| HPV18 | L1 | 11 | 306 | SMFFCLRREQL | 26272 |
| HPV18 | L1 | 10 | 455 | SMNSSILEDW | 26273 |
| HPV18 | L1 | 8 | 353 | SPSPSGSI | 26274 |
| HPV18 | L1 | 9 | 353 | SPSPSGSIV | 26275 |
| HPV18 | L1 | 9 | 411 | SPVPGQYDA | 26276 |
| HPV18 | L1 | 8 | 242 | SQGDCPPL | 26277 |
| HPV18 | L1 | 10 | 242 | SQGDCPPLEL | 26278 |
| HPV18 | L1 | 8 | 365 | SQLFNKPY | 26279 |
| HPV18 | L1 | 9 | 365 | SQLFNKPYW | 26280 |
| HPV18 | L1 | 10 | 365 | SQLFNKPYWL | 26281 |
| HPV18 | L1 | 10 | 485 | SVAITCQKDA | 26282 |
| HPV18 | L1 | 11 | 485 | SVAITCQKDAA | 26283 |
| HPV18 | L1 | 11 | 78 | SVARVVNTDDY | 26284 |
| HPV18 | L1 | 9 | 209 | SVDYKQTQL | 26285 |
| HPV18 | L1 | 11 | 209 | SVDYKQTQLCI | 26286 |
| HPV18 | L1 | 10 | 404 | TICASTQSPV | 26287 |
| HPV18 | L1 | 9 | 541 | TIGPRKRSA | 26288 |
| HPV18 | L1 | 8 | 442 | TITLTADV | 26289 |
| HPV18 | L1 | 9 | 442 | TITLTADVM | 26290 |
| HPV18 | L1 | 11 | 442 | TITLTADVMSY | 26291 |
| HPV18 | L1 | 9 | 273 | TLQDTKCEV | 26292 |
| HPV18 | L1 | 11 | 273 | TLQDTKCEVPL | 26293 |
| HPV18 | L1 | 9 | 444 | TLTADVMSY | 26294 |
| HPV18 | L1 | 10 | 444 | TLTADVMSYI | 26295 |
| HPV18 | L1 | 10 | 327 | TMGDTVPQSL | 26296 |
| HPV18 | L1 | 11 | 327 | TMGDTVPQSLY | 26297 |
| HPV18 | L1 | 8 | 398 | TPSTNLTI | 26298 |
| HPV18 | L1 | 10 | 398 | TPSTNLTICA | 26299 |
| HPV18 | L1 | 9 | 90 | TPTSIFYHA | 26300 |
| HPV18 | L1 | 9 | 215 | TQLCILGCA | 26301 |
| HPV18 | L1 | 11 | 215 | TQLCILGCAPA | 26302 |
| HPV18 | L1 | 9 | 156 | TQRLVWACA | 26303 |
| HPV18 | L1 | 11 | 156 | TQRLVWACAGV | 26304 |
| HPV18 | L1 | 9 | 409 | TQSPVPGQY | 26305 |
| HPV18 | L1 | 11 | 409 | TQSPVPGQYDA | 26306 |
| HPV18 | L1 | 9 | 105 | TVGNPYFRV | 26307 |
| HPV18 | L1 | 11 | 105 | TVGNPYFRVPA | 26308 |
| HPV18 | L1 | 8 | 254 | TVLEDGDM | 26309 |
| HPV18 | L1 | 9 | 254 | TVLEDGDMV | 26310 |
| HPV18 | L1 | 8 | 331 | TVPQSLYI | 26311 |
| HPV18 | L1 | 11 | 393 | TVVDTTPSTNL | 26312 |
| HPV18 | L1 | 9 | 71 | TVYLPPPSV | 26313 |
| HPV18 | L1 | 10 | 71 | TVYLPPPSVA | 26314 |
| HPV18 | L1 | 8 | 255 | VLEDGDMV | 26315 |
| HPV18 | L1 | 8 | 7 | VLILHYHL | 26316 |
| HPV18 | L1 | 9 | 7 | VLILHYHLL | 26317 |
| HPV18 | L1 | 11 | 7 | VLILHYHLLPL | 26318 |
| HPV18 | L1 | 8 | 449 | VMSYIHSM | 26319 |
| HPV18 | L1 | 11 | 113 | VPAGGGNKQDI | 26320 |
| HPV18 | L1 | 10 | 113 | VPGQYDATKF | 26321 |
| HPV18 | L1 | 9 | 281 | VPLDICQSI | 26322 |
| HPV18 | L1 | 9 | 468 | VPPPPTTSL | 26323 |
| HPV18 | L1 | 10 | 468 | VPPPPTTSLV | 26324 |
| HPV18 | L1 | 11 | 532 | VQAGLRRKPTI | 26325 |
| HPV18 | L1 | 9 | 136 | VQLPDPNKF | 26326 |
| HPV18 | L1 | 11 | 136 | VQLPDPNKFGL | 26327 |
| HPV18 | L1 | 10 | 394 | VVDTTPSTNL | 26328 |
| HPV18 | L1 | 8 | 82 | VVNTDDYV | 26329 |
| HPV18 | L1 | 9 | 452 | YIHSMNSSI | 26330 |
| HPV18 | L1 | 10 | 452 | YIHSMNSSIL | 26331 |
| HPV18 | L1 | 9 | 45 | YIILFLRNV | 26332 |
| HPV18 | L1 | 11 | 45 | YIILFLRNVNV | 26333 |
| HPV18 | L1 | 9 | 337 | YIKGTGMPA | 26334 |

TABLE XIV-continued

B62 Supermotif Peptides

| Type | Protein | No. of Amino Acid | Position | Sequence | Seq. Id. No. |
|---|---|---|---|---|---|
| HPV18 | L1 | 8 | 73 | YLPPPSVA | 26335 |
| HPV18 | L1 | 10 | 73 | YLPPPSVARV | 26336 |
| HPV18 | L1 | 11 | 73 | YLPPPSVARVV | 26337 |
| HPV18 | L1 | 9 | 295 | YLQMSADPY | 26338 |
| HPV18 | L1 | 11 | 35 | YMVHIIICGHY | 26339 |
| HPV18 | L1 | 9 | 292 | YPDYLQMSA | 26340 |
| HPV18 | L1 | 8 | 524 | YPLGRKFL | 26341 |
| HPV18 | L1 | 9 | 524 | YPLGRKFLV | 26342 |
| HPV18 | L1 | 11 | 524 | YPLGRKFLVQA | 26343 |
| HPV18 | L1 | 8 | 129 | YQYRVFRV | 26344 |
| HPV18 | L1 | 10 | 129 | YQYRVFRVQL | 26345 |
| HPV18 | L1 | 8 | 88 | YVTPTSIF | 26346 |
| HPV18 | L1 | 9 | 88 | YVTPTSIFY | 26347 |
| HPV18 | L1 | 11 | 88 | YVTPTSIFYHA | 26348 |
| HPV18 | L2 | 9 | 286 | ALTSRRGTV | 26349 |
| HPV18 | L2 | 11 | 286 | ALTSRRGTVRF | 26350 |
| HPV18 | L2 | 8 | 421 | APASTQYI | 26351 |
| HPV18 | L2 | 10 | 421 | APASTQYIGI | 26352 |
| HPV18 | L2 | 9 | 327 | APSPEYIEL | 26353 |
| HPV18 | L2 | 9 | 27 | CPPDVVPKV | 26354 |
| HPV18 | L2 | 9 | 278 | DIIRLHRPA | 26355 |
| HPV18 | L2 | 10 | 278 | DIIRLHRPAL | 26356 |
| HPV18 | L2 | 11 | 322 | DISPIAPSPEY | 26357 |
| HPV18 | L2 | 10 | 404 | DITLPSTTSV | 26358 |
| HPV18 | L2 | 11 | 404 | DITLPSTTSVW | 26359 |
| HPV18 | L2 | 9 | 142 | DITPSSTSV | 26360 |
| HPV18 | L2 | 11 | 142 | DITPSSTSVSI | 26361 |
| HPV18 | L2 | 11 | 129 | DITSAGTTTPA | 26362 |
| HPV18 | L2 | 10 | 349 | DIYADDMDPA | 26363 |
| HPV18 | L2 | 11 | 349 | DIYADDMDPAV | 26364 |
| HPV18 | L2 | 10 | 346 | DLFDIYADDM | 26365 |
| HPV18 | L2 | 8 | 354 | DMDPAVPV | 26366 |
| HPV18 | L2 | 11 | 266 | DPRSDVPDSDF | 26367 |
| HPV18 | L2 | 8 | 100 | DPSIVTLI | 26368 |
| HPV18 | L2 | 9 | 83 | DVGPTRPPV | 26369 |
| HPV18 | L2 | 10 | 83 | DVGPTRPPVV | 26370 |
| HPV18 | L2 | 11 | 83 | DVGPTRPPVVI | 26371 |
| HPV18 | L2 | 8 | 270 | DVPDSDFM | 26372 |
| HPV18 | L2 | 10 | 270 | DVPDSDFMDI | 26373 |
| HPV18 | L2 | 11 | 270 | DVPDSDFMDII | 26374 |
| HPV18 | L2 | 10 | 396 | DVPVYTGPDI | 26375 |
| HPV18 | L2 | 11 | 30 | DVVPKVEGTTL | 26376 |
| HPV18 | L2 | 8 | 194 | EIPLQTFA | 26377 |
| HPV18 | L2 | 8 | 334 | ELQPLVSA | 26378 |
| HPV18 | L2 | 8 | 208 | EPISSTPL | 26379 |
| HPV18 | L2 | 11 | 208 | EPISSTPLPTV | 26380 |
| HPV18 | L2 | 9 | 257 | EPVDTTLTF | 26381 |
| HPV18 | L2 | 10 | 94 | EPVGPTDPSI | 26382 |
| HPV18 | L2 | 11 | 94 | EPVGPTDPSIV | 26383 |
| HPV18 | L2 | 8 | 175 | EVAGNVFV | 26384 |
| HPV18 | L2 | 8 | 169 | EVPQTGEV | 26385 |
| HPV18 | L2 | 9 | 169 | EVPQTGEVA | 26386 |
| HPV18 | L2 | 9 | 443 | FIPKKRKRV | 26387 |
| HPV18 | L2 | 11 | 443 | FIPKKRKRVPY | 26388 |
| HPV18 | L2 | 8 | 241 | FLTRPSSL | 26389 |
| HPV18 | L2 | 9 | 241 | FLTRPSSLI | 26390 |
| HPV18 | L2 | 11 | 241 | FLTRPSSLITY | 26391 |
| HPV18 | L2 | 11 | 276 | FMDIIRLHRPA | 26392 |
| HPV18 | L2 | 9 | 51 | GIFLGGLGI | 26393 |
| HPV18 | L2 | 8 | 429 | GIHGTHYY | 26394 |
| HPV18 | L2 | 9 | 429 | GIHGTHYYL | 26395 |
| HPV18 | L2 | 10 | 429 | GIHGTHYYLW | 26396 |
| HPV18 | L2 | 8 | 223 | GPRLYSRA | 26397 |
| HPV18 | L2 | 9 | 223 | GPRLYSRAY | 26398 |
| HPV18 | L2 | 8 | 97 | GPTDPSIV | 26399 |
| HPV18 | L2 | 10 | 97 | GPTDPSIVTL | 26400 |
| HPV18 | L2 | 11 | 97 | GPTDPSIVTLI | 26401 |
| HPV18 | L2 | 8 | 85 | GPTRPPVV | 26402 |
| HPV18 | L2 | 9 | 85 | GPTRPPVVI | 26403 |
| HPV18 | L2 | 10 | 167 | IIEVPQTGEV | 26404 |
| HPV18 | L2 | 11 | 167 | IIEVPQTGEVA | 26405 |
| HPV18 | L2 | 8 | 279 | IIRLHRPA | 26406 |
| HPV18 | L2 | 9 | 279 | IIRLHRPAL | 26407 |
| HPV18 | L2 | 9 | 44 | ILQWSSLGI | 26408 |
| HPV18 | L2 | 10 | 44 | ILQWSSLGIF | 26409 |

TABLE XIV-continued

B62 Supermotif Peptides

| Type | Protein | No. of Amino Acid | Position | Sequence | Seq. Id. No. |
|---|---|---|---|---|---|
| HPV18 | L2 | 11 | 44 | ILQWSSLGIFL | 26410 |
| HPV18 | L2 | 8 | 444 | IPKKRKRV | 26411 |
| HPV18 | L2 | 10 | 444 | IPKKRKRVPY | 26412 |
| HPV18 | L2 | 11 | 444 | IPKKRKRVPYF | 26413 |
| HPV18 | L2 | 10 | 72 | IPLGGRSNTV | 26414 |
| HPV18 | L2 | 11 | 72 | IPLGGRSNTVV | 26415 |
| HPV18 | L2 | 8 | 416 | IVSPTAPA | 26416 |
| HPV18 | L2 | 10 | 103 | IVTLIEDSSV | 26417 |
| HPV18 | L2 | 11 | 103 | IVTLIEDSSVV | 26418 |
| HPV18 | L2 | 8 | 43 | KILQWSSL | 26419 |
| HPV18 | L2 | 10 | 43 | KILQWSSLGI | 26420 |
| HPV18 | L2 | 11 | 43 | KILQWSSLGIF | 26421 |
| HPV18 | L2 | 10 | 22 | KQSGTCPPDV | 26422 |
| HPV18 | L2 | 11 | 22 | KQSGTCPPDVV | 26423 |
| HPV18 | L2 | 8 | 34 | KVEGTTLA | 26424 |
| HPV18 | L2 | 11 | 34 | KVEGTTLADKI | 26425 |
| HPV18 | L2 | 8 | 106 | LIEDSSVV | 26426 |
| HPV18 | L2 | 8 | 248 | LITYDNPA | 26427 |
| HPV18 | L2 | 9 | 248 | LITYDNPAF | 26428 |
| HPV18 | L2 | 8 | 407 | LPSTTSVW | 26429 |
| HPV18 | L2 | 10 | 407 | LPSTTSVWPI | 26430 |
| HPV18 | L2 | 11 | 407 | LPSTTSVWPIV | 26431 |
| HPV18 | L2 | 8 | 215 | LPTVRRVA | 26432 |
| HPV18 | L2 | 8 | 45 | LQWSSLGI | 26433 |
| HPV18 | L2 | 9 | 45 | LQWSSLGIF | 26434 |
| HPV18 | L2 | 10 | 45 | LQWSSLGIFL | 26435 |
| HPV18 | L2 | 10 | 338 | LVSATEDNDL | 26436 |
| HPV18 | L2 | 11 | 338 | LVSATEDNDLF | 26437 |
| HPV18 | L2 | 11 | 253 | NPAFEPVDTTL | 26438 |
| HPV18 | L2 | 9 | 159 | NPAFSDPSI | 26439 |
| HPV18 | L2 | 10 | 159 | NPAFSDPSII | 26440 |
| HPV18 | L2 | 11 | 238 | NPEFLTRPSSL | 26441 |
| HPV18 | L2 | 10 | 386 | NVTVPLTSSW | 26442 |
| HPV18 | L2 | 8 | 325 | PIAPSPEY | 26443 |
| HPV18 | L2 | 9 | 325 | PIAPSPEYI | 26444 |
| HPV18 | L2 | 11 | 325 | PIAPSPEYIEL | 26445 |
| HPV18 | L2 | 10 | 209 | PISSTPLPTV | 26446 |
| HPV18 | L2 | 9 | 415 | PIVSPTAPA | 26447 |
| HPV18 | L2 | 9 | 73 | PLGGRSNTV | 26448 |
| HPV18 | L2 | 10 | 73 | PLGGRSNTVV | 26449 |
| HPV18 | L2 | 8 | 214 | PLPTVRRV | 26450 |
| HPV18 | L2 | 9 | 214 | PLPTVRRVA | 26451 |
| HPV18 | L2 | 8 | 390 | PLTSSWDV | 26452 |
| HPV18 | L2 | 10 | 390 | PLTSSWDVPV | 26453 |
| HPV18 | L2 | 11 | 390 | PLTSSWDVPVY | 26454 |
| HPV18 | L2 | 11 | 337 | PLVSATEDNDL | 26455 |
| HPV18 | L2 | 8 | 28 | PPDVVPKV | 26456 |
| HPV18 | L2 | 8 | 89 | PPVVIEPV | 26457 |
| HPV18 | L2 | 10 | 171 | PQTGEVAGNV | 26458 |
| HPV18 | L2 | 11 | 171 | PQTGEVAGNVF | 26459 |
| HPV18 | L2 | 8 | 258 | PVDTTLTF | 26460 |
| HPV18 | L2 | 9 | 95 | PVGPTDPSI | 26461 |
| HPV18 | L2 | 10 | 95 | PVGPTDPSIV | 26462 |
| HPV18 | L2 | 10 | 360 | PVPSRSTTSF | 26463 |
| HPV18 | L2 | 11 | 360 | PVPSRSTTSFA | 26464 |
| HPV18 | L2 | 8 | 398 | PVYTGPDI | 26465 |
| HPV18 | L2 | 10 | 398 | PVYTGPDITL | 26466 |
| HPV18 | L2 | 8 | 312 | QIGARVHF | 26467 |
| HPV18 | L2 | 9 | 312 | QIGARVHFY | 26468 |
| HPV18 | L2 | 10 | 232 | QQVSVANPEF | 26469 |
| HPV18 | L2 | 11 | 232 | QQVSVANPEFL | 26470 |
| HPV18 | L2 | 9 | 233 | QVSVANPEF | 26471 |
| HPV18 | L2 | 10 | 233 | QVSVANPEFL | 26472 |
| HPV18 | L2 | 8 | 298 | RLGQRATM | 26473 |
| HPV18 | L2 | 9 | 298 | RLGQRATMF | 26474 |
| HPV18 | L2 | 10 | 225 | RLYSRAYQQV | 26475 |
| HPV18 | L2 | 11 | 284 | RPALTSRRGTV | 26476 |
| HPV18 | L2 | 9 | 88 | RPPVVIEPV | 26477 |
| HPV18 | L2 | 8 | 244 | RPSSLITY | 26478 |
| HPV18 | L2 | 10 | 119 | RPTFTGTSGF | 26479 |
| HPV18 | L2 | 8 | 220 | RVAGPRLY | 26480 |
| HPV18 | L2 | 11 | 220 | RVAGPRLYSRA | 26481 |
| HPV18 | L2 | 8 | 316 | RVHFYHDI | 26482 |
| HPV18 | L2 | 11 | 316 | RVHFYHDISPI | 26483 |
| HPV18 | L2 | 10 | 450 | RVPYFFADGF | 26484 |

TABLE XIV-continued

B62 Supermotif Peptides

| Type | Protein | No. of Amino Acid | Position | Sequence | Seq. Id. No. |
|---|---|---|---|---|---|
| HPV18 | L2 | 11 | 450 | RVPYFFADGFV | 26485 |
| HPV18 | L2 | 11 | 166 | SIIEVPQTGEV | 26486 |
| HPV18 | L2 | 11 | 151 | SISTTNFTNPA | 26487 |
| HPV18 | L2 | 11 | 102 | SIVTLIEDSSV | 26488 |
| HPV18 | L2 | 9 | 49 | SLGIFLGGL | 26489 |
| HPV18 | L2 | 11 | 49 | SLGIFLGGLGI | 26490 |
| HPV18 | L2 | 9 | 247 | SLITYDNPA | 26491 |
| HPV18 | L2 | 10 | 247 | SLITYDNPAF | 26492 |
| HPV18 | L2 | 10 | 329 | SPEYIELQPL | 26493 |
| HPV18 | L2 | 11 | 329 | SPEYIELQPLV | 26494 |
| HPV18 | L2 | 9 | 324 | SPIAPSPEY | 26495 |
| HPV18 | L2 | 10 | 324 | SPIAPSPEYI | 26496 |
| HPV18 | L2 | 10 | 418 | SPTAPASTQY | 26497 |
| HPV18 | L2 | 11 | 418 | SPTAPASTQYI | 26498 |
| HPV18 | L2 | 10 | 375 | SPTISSASSY | 26499 |
| HPV18 | L2 | 8 | 235 | SVANPEFL | 26500 |
| HPV18 | L2 | 9 | 149 | SVSISTTNF | 26501 |
| HPV18 | L2 | 10 | 412 | SVWPIVSPTA | 26502 |
| HPV18 | L2 | 8 | 377 | TISSASSY | 26503 |
| HPV18 | L2 | 11 | 377 | TISSASSYSNV | 26504 |
| HPV18 | L2 | 9 | 39 | TLADKILQW | 26505 |
| HPV18 | L2 | 8 | 105 | TLIEDSSV | 26506 |
| HPV18 | L2 | 9 | 105 | TLIEDSSVV | 26507 |
| HPV18 | L2 | 8 | 406 | TLPSTTSV | 26508 |
| HPV18 | L2 | 9 | 406 | TLPSTTSVW | 26509 |
| HPV18 | L2 | 11 | 406 | TLPSTTSVWPI | 26510 |
| HPV18 | L2 | 10 | 262 | TLTFDPRSDV | 26511 |
| HPV18 | L2 | 10 | 304 | TMFTRSGTQI | 26512 |
| HPV18 | L2 | 9 | 213 | TPLPTVRRV | 26513 |
| HPV18 | L2 | 10 | 213 | TPLPTVRRVA | 26514 |
| HPV18 | L2 | 9 | 144 | TPSSTSVSI | 26515 |
| HPV18 | L2 | 9 | 184 | TPTSGTHGY | 26516 |
| HPV18 | L2 | 9 | 311 | TQIGARVHF | 26517 |
| HPV18 | L2 | 10 | 311 | TQIGARVHFY | 26518 |
| HPV18 | L2 | 11 | 425 | TQYIGIHGTHY | 26519 |
| HPV18 | L2 | 8 | 388 | TVPLTSSW | 26520 |
| HPV18 | L2 | 10 | 388 | TVPLTSSWDV | 26521 |
| HPV18 | L2 | 11 | 293 | TVRFSRLGQRA | 26522 |
| HPV18 | L2 | 10 | 217 | TVRRVAGPRL | 26523 |
| HPV18 | L2 | 11 | 217 | TVRRVAGPRLY | 26524 |
| HPV18 | L2 | 11 | 140 | VLDITPSSTSV | 26525 |
| HPV18 | L2 | 9 | 271 | VPDSDFMDI | 26526 |
| HPV18 | L2 | 10 | 271 | VPDSDFMDII | 26527 |
| HPV18 | L2 | 9 | 32 | VPKVEGTTL | 26528 |
| HPV18 | L2 | 10 | 32 | VPKVEGTTLA | 26529 |
| HPV18 | L2 | 9 | 389 | VPLTSSWDV | 26530 |
| HPV18 | L2 | 11 | 389 | VPLTSSWDVPV | 26531 |
| HPV18 | L2 | 8 | 170 | VPQTGEVA | 26532 |
| HPV18 | L2 | 11 | 170 | VPQTGEVAGNV | 26533 |
| HPV18 | L2 | 9 | 361 | VPSRSTTSF | 26534 |
| HPV18 | L2 | 10 | 361 | VPSRSTTSFA | 26535 |
| HPV18 | L2 | 11 | 361 | VPSRSTTSFAF | 26536 |
| HPV18 | L2 | 11 | 359 | VPVPSRSTTSF | 26537 |
| HPV18 | L2 | 9 | 397 | VPVYTGPDI | 26538 |
| HPV18 | L2 | 11 | 397 | VPVYTGPDITL | 26539 |
| HPV18 | L2 | 9 | 451 | VPYFFADGF | 26540 |
| HPV18 | L2 | 10 | 451 | VPYFFADGFV | 26541 |
| HPV18 | L2 | 11 | 451 | VPYFFADGFVA | 26542 |
| HPV18 | L2 | 11 | 81 | VVDVGPTRPPV | 26543 |
| HPV18 | L2 | 10 | 31 | VVPKVEGTTL | 26544 |
| HPV18 | L2 | 11 | 31 | VVPKVEGTTLA | 26545 |
| HPV18 | L2 | 11 | 112 | VVTSGAPRPTF | 26546 |
| HPV18 | L2 | 8 | 414 | WPIVSPTA | 26547 |
| HPV18 | L2 | 10 | 414 | WPIVSPTAPA | 26548 |
| HPV18 | L2 | 8 | 332 | YIELQPLV | 26549 |
| HPV18 | L2 | 10 | 332 | YIELQPLVSA | 26550 |
| HPV18 | L2 | 9 | 427 | YIGIHGTHY | 26551 |
| HPV18 | L2 | 10 | 427 | YIGIHGTHYY | 26552 |
| HPV18 | L2 | 11 | 427 | YIGIHGTHYYL | 26553 |
| HPV18 | L2 | 11 | 71 | YIPLGGRSNTV | 26554 |
| HPV18 | L2 | 8 | 436 | YLWPLYYF | 26555 |
| HPV18 | L2 | 9 | 436 | YLWPLYYFI | 26556 |
| HPV18 | L2 | 11 | 231 | YQQVSVANPEF | 26557 |
| HPV31 | E1 | 11 | 111 | AICIENNSKTA | 26558 |
| HPV31 | E1 | 9 | 519 | ALDGNPVSI | 26559 |

TABLE XIV-continued

B62 Supermotif Peptides

| Type | Protein | No. of Amino Acid | Position | Sequence | Seq. Id. No. |
|---|---|---|---|---|---|
| HPV31 | E1 | 11 | 519 | ALDGNPVSIDV | 26560 |
| HPV31 | E1 | 8 | 68 | ALFHAQEA | 26561 |
| HPV31 | E1 | 9 | 439 | ALKLFLKGV | 26562 |
| HPV31 | E1 | 10 | 533 | ALMQLKCPPL | 26563 |
| HPV31 | E1 | 11 | 533 | ALMQLKCPPLL | 26564 |
| HPV31 | E1 | 9 | 298 | ALYWYRTGM | 26565 |
| HPV31 | E1 | 9 | 186 | AMLGKFKEL | 26566 |
| HPV31 | E1 | 10 | 186 | AMLGKFKELY | 26567 |
| HPV31 | E1 | 8 | 458 | APNTGKSY | 26568 |
| HPV31 | E1 | 9 | 458 | APNTGKSYF | 26569 |
| HPV31 | E1 | 11 | 458 | APNTGKSYFGM | 26570 |
| HPV31 | E1 | 10 | 66 | AQALFHAQEA | 26571 |
| HPV31 | E1 | 8 | 72 | AQEAEEHA | 26572 |
| HPV31 | E1 | 10 | 72 | AQEAEEHAEA | 26573 |
| HPV31 | E1 | 11 | 72 | AQEAEEHAEAV | 26574 |
| HPV31 | E1 | 10 | 360 | AQLADSDSNA | 26575 |
| HPV31 | E1 | 11 | 22 | AVIDRQTGDNI | 26576 |
| HPV31 | E1 | 9 | 81 | AVQVLKRKY | 26577 |
| HPV31 | E1 | 10 | 81 | AVQVLKRKYV | 26578 |
| HPV31 | E1 | 9 | 113 | CIENNSKTA | 26579 |
| HPV31 | E1 | 8 | 279 | CISTNCML | 26580 |
| HPV31 | E1 | 9 | 279 | CISTNCMLI | 26581 |
| HPV31 | E1 | 9 | 239 | CLYCHLQSL | 26582 |
| HPV31 | E1 | 10 | 239 | CLYCHLQSLA | 26583 |
| HPV31 | E1 | 9 | 284 | CMLIQPPKL | 26584 |
| HPV31 | E1 | 10 | 539 | CPPLLITSNI | 26585 |
| HPV31 | E1 | 11 | 217 | CVAAFGVTGTV | 26586 |
| HPV31 | E1 | 10 | 100 | CVDYNISPRL | 26587 |
| HPV31 | E1 | 10 | 620 | CVSGQNIRTL | 26588 |
| HPV31 | E1 | 8 | 96 | DISSCVDY | 26589 |
| HPV31 | E1 | 10 | 96 | DISSCVDYNI | 26590 |
| HPV31 | E1 | 8 | 421 | DIVKFLRY | 26591 |
| HPV31 | E1 | 11 | 421 | DIVKFLRYQQI | 26592 |
| HPV31 | E1 | 8 | 336 | DLSQMVQW | 26593 |
| HPV31 | E1 | 9 | 336 | DLSQMVQWA | 26594 |
| HPV31 | E1 | 10 | 336 | DLSQMVQWAY | 26595 |
| HPV31 | E1 | 11 | 46 | DMVDFIDNCNV | 26596 |
| HPV31 | E1 | 8 | 528 | DVKHKALM | 26597 |
| HPV31 | E1 | 10 | 528 | DVKHKALMQL | 26598 |
| HPV31 | E1 | 8 | 348 | DVMDDSEI | 26599 |
| HPV31 | E1 | 9 | 348 | DVMDDSEIA | 26600 |
| HPV31 | E1 | 10 | 348 | DVMDDSEIAY | 26601 |
| HPV31 | E1 | 9 | 311 | DVYGETPEW | 26602 |
| HPV31 | E1 | 10 | 311 | DVYGETPEWI | 26603 |
| HPV31 | E1 | 9 | 354 | EIAYKYAQL | 26604 |
| HPV31 | E1 | 10 | 354 | EIAYKYAQLA | 26605 |
| HPV31 | E1 | 10 | 583 | ELSDKNWKSF | 26606 |
| HPV31 | E1 | 11 | 583 | ELSDKNWKSFF | 26607 |
| HPV31 | E1 | 8 | 193 | ELYGVSFM | 26608 |
| HPV31 | E1 | 10 | 193 | ELYGVSFMEL | 26609 |
| HPV31 | E1 | 11 | 193 | ELYGVSFMELI | 26610 |
| HPV31 | E1 | 8 | 137 | EVETQQMV | 26611 |
| HPV31 | E1 | 10 | 137 | EVETQQMVQV | 26612 |
| HPV31 | E1 | 8 | 50 | FIDNCNVY | 26613 |
| HPV31 | E1 | 11 | 443 | FLKGVPKKNCI | 26614 |
| HPV31 | E1 | 8 | 372 | FLKSNSQA | 26615 |
| HPV31 | E1 | 10 | 372 | FLKSNSQAKI | 26616 |
| HPV31 | E1 | 11 | 372 | FLKSNSQAKIV | 26617 |
| HPV31 | E1 | 9 | 473 | FLQGCIISY | 26618 |
| HPV31 | E1 | 10 | 473 | FLQGCIISYA | 26619 |
| HPV31 | E1 | 9 | 425 | FLRYQQIEF | 26620 |
| HPV31 | E1 | 10 | 425 | FLRYQQIEFV | 26621 |
| HPV31 | E1 | 8 | 436 | FLSALKLF | 26622 |
| HPV31 | E1 | 9 | 436 | FLSALKLFL | 26623 |
| HPV31 | E1 | 8 | 199 | FMELIRPF | 26624 |
| HPV31 | E1 | 10 | 572 | FPFDKNGNPV | 26625 |
| HPV31 | E1 | 11 | 572 | FPFDKNGNPVY | 26626 |
| HPV31 | E1 | 11 | 206 | FQSNKSTCTDW | 26627 |
| HPV31 | E1 | 8 | 433 | FVSFLSAL | 26628 |
| HPV31 | E1 | 10 | 433 | FVSFLSALKL | 26629 |
| HPV31 | E1 | 11 | 433 | FVSFLSALKLF | 26630 |
| HPV31 | E1 | 11 | 499 | GMLDDATTPCW | 26631 |
| HPV31 | E1 | 8 | 467 | GMSLISFL | 26632 |
| HPV31 | E1 | 8 | 305 | GMSNISDV | 26633 |
| HPV31 | E1 | 9 | 305 | GMSNISDVY | 26634 |

TABLE XIV-continued

B62 Supermotif Peptides

| Type | Protein | No. of Amino Acid | Position | Sequence | Seq. Id. No. |
|---|---|---|---|---|---|
| HPV31 | E1 | 8 | 252 | GMVMLMLV | 26635 |
| HPV31 | E1 | 10 | 252 | GMVMLMLVRF | 26636 |
| HPV31 | E1 | 11 | 403 | GQWIKSRCDKV | 26637 |
| HPV31 | E1 | 8 | 446 | GVPKKNCI | 26638 |
| HPV31 | E1 | 9 | 446 | GVPKKNCIL | 26639 |
| HPV31 | E1 | 10 | 446 | GVPKKNCILI | 26640 |
| HPV31 | E1 | 8 | 196 | GVSFMELI | 26641 |
| HPV31 | E1 | 11 | 196 | GVSFMELIRPF | 26642 |
| HPV31 | E1 | 10 | 222 | GVTGTVAEGF | 26643 |
| HPV31 | E1 | 9 | 243 | HLQSLACSW | 26644 |
| HPV31 | E1 | 11 | 243 | HLQSLACSWGM | 26645 |
| HPV31 | E1 | 11 | 478 | IISYANSKSHF | 26646 |
| HPV31 | E1 | 10 | 287 | IQPPKLRSTA | 26647 |
| HPV31 | E1 | 11 | 287 | IQPPKLRSTAA | 26648 |
| HPV31 | E1 | 8 | 381 | IVKDCGTM | 26649 |
| HPV31 | E1 | 10 | 422 | IVKFLRYQQI | 26650 |
| HPV31 | E1 | 8 | 497 | KIGMLDDA | 26651 |
| HPV31 | E1 | 9 | 380 | KIVKDCGTM | 26652 |
| HPV31 | E1 | 10 | 276 | KLLCISTNCM | 26653 |
| HPV31 | E1 | 11 | 276 | KLLCISTNCML | 26654 |
| HPV31 | E1 | 9 | 272 | KLLEKLLCI | 26655 |
| HPV31 | E1 | 8 | 291 | KLRSTAAA | 26656 |
| HPV31 | E1 | 9 | 291 | KLRSTAAAL | 26657 |
| HPV31 | E1 | 10 | 291 | KLRSTAAALY | 26658 |
| HPV31 | E1 | 11 | 291 | KLRSTAAALYW | 26659 |
| HPV31 | E1 | 8 | 412 | KVSDEGDW | 26660 |
| HPV31 | E1 | 11 | 412 | KVSDEGDWRDI | 26661 |
| HPV31 | E1 | 11 | 286 | LIQPPKLRSTA | 26662 |
| HPV31 | E1 | 9 | 470 | LISFLQGCI | 26663 |
| HPV31 | E1 | 10 | 470 | LISFLQGCII | 26664 |
| HPV31 | E1 | 8 | 543 | LITSNINA | 26665 |
| HPV31 | E1 | 9 | 277 | LLCISTNCM | 26666 |
| HPV31 | E1 | 10 | 277 | LLCISTNCML | 26667 |
| HPV31 | E1 | 11 | 277 | LLCISTNCMLI | 26668 |
| HPV31 | E1 | 8 | 273 | LLEKLLCI | 26669 |
| HPV31 | E1 | 9 | 542 | LLITSNINA | 26670 |
| HPV31 | E1 | 8 | 234 | LLQPYCLY | 26671 |
| HPV31 | E1 | 11 | 234 | LLQPYCLYCHL | 26672 |
| HPV31 | E1 | 9 | 256 | LMLVRFKCA | 26673 |
| HPV31 | E1 | 9 | 534 | LMQLKCPPL | 26674 |
| HPV31 | E1 | 10 | 534 | LMQLKCPPLL | 26675 |
| HPV31 | E1 | 11 | 534 | LMQLKCPPLLI | 26676 |
| HPV31 | E1 | 11 | 128 | LPDSGYGNTEV | 26677 |
| HPV31 | E1 | 8 | 474 | LQGCIISY | 26678 |
| HPV31 | E1 | 9 | 474 | LQGCIISYA | 26679 |
| HPV31 | E1 | 10 | 326 | LQHSFNDTTF | 26680 |
| HPV31 | E1 | 9 | 490 | LQPLADAKI | 26681 |
| HPV31 | E1 | 11 | 490 | LQPLADAKIGM | 26682 |
| HPV31 | E1 | 10 | 235 | LQPYCLYCHL | 26683 |
| HPV31 | E1 | 8 | 244 | LQSLACSW | 26684 |
| HPV31 | E1 | 10 | 244 | LQSLACSWGM | 26685 |
| HPV31 | E1 | 11 | 244 | LQSLACSWGMV | 26686 |
| HPV31 | E1 | 11 | 175 | LQVLKTSNGKA | 26687 |
| HPV31 | E1 | 11 | 258 | LVRFKCAKNRI | 26688 |
| HPV31 | E1 | 10 | 563 | LVVFTFPNPF | 26689 |
| HPV31 | E1 | 10 | 500 | MLDDATTPCW | 26690 |
| HPV31 | E1 | 8 | 187 | MLGKFKEL | 26691 |
| HPV31 | E1 | 9 | 187 | MLGKFKELY | 26692 |
| HPV31 | E1 | 11 | 187 | MLGKFKELYGV | 26693 |
| HPV31 | E1 | 8 | 285 | MLIQPPKL | 26694 |
| HPV31 | E1 | 10 | 255 | MLMLVRFKCA | 26695 |
| HPV31 | E1 | 8 | 257 | MLVRFKCA | 26696 |
| HPV31 | E1 | 8 | 535 | MQLKCPPL | 26697 |
| HPV31 | E1 | 9 | 535 | MQLKCPPLL | 26698 |
| HPV31 | E1 | 10 | 535 | MQLKCPPLLI | 26699 |
| HPV31 | E1 | 10 | 47 | MVDFIDNCNV | 26700 |
| HPV31 | E1 | 11 | 47 | MVDFIDNCNVY | 26701 |
| HPV31 | E1 | 9 | 253 | MVMLMLVRF | 26702 |
| HPV31 | E1 | 11 | 143 | MVQVEEQQTTL | 26703 |
| HPV31 | E1 | 10 | 340 | MVQWAYDNDV | 26704 |
| HPV31 | E1 | 11 | 340 | MVQWAYDNDVM | 26705 |
| HPV31 | E1 | 10 | 547 | NINAGKDDRW | 26706 |
| HPV31 | E1 | 8 | 104 | NISPRLKA | 26707 |
| HPV31 | E1 | 9 | 104 | NISPRLKAI | 26708 |
| HPV31 | E1 | 11 | 104 | NISPRLKAICI | 26709 |

TABLE XIV-continued

B62 Supermotif Peptides

| Type | Protein | No. of Amino Acid | Position | Sequence | Seq. Id. No. |
|---|---|---|---|---|---|
| HPV31 | E1 | 11 | 523 | NPVSIDVKHKA | 26710 |
| HPV31 | E1 | 11 | 579 | NPVYELSDKNW | 26711 |
| HPV31 | E1 | 8 | 59 | NQAEAETA | 26712 |
| HPV31 | E1 | 10 | 59 | NQAEAETAQA | 26713 |
| HPV31 | E1 | 11 | 59 | NQAEAETAQAL | 26714 |
| HPV31 | E1 | 9 | 55 | NVYNNQAEA | 26715 |
| HPV31 | E1 | 9 | 492 | PLADAKIGM | 26716 |
| HPV31 | E1 | 10 | 492 | PLADAKIGML | 26717 |
| HPV31 | E1 | 8 | 541 | PLLITSNI | 26718 |
| HPV31 | E1 | 10 | 541 | PLLITSNINA | 26719 |
| HPV31 | E1 | 9 | 93 | PLSDISSCV | 26720 |
| HPV31 | E1 | 11 | 93 | PLSDISSCVDY | 26721 |
| HPV31 | E1 | 8 | 289 | PPKLRSTA | 26722 |
| HPV31 | E1 | 9 | 289 | PPKLRSTAA | 26723 |
| HPV31 | E1 | 10 | 289 | PPKLRSTAAA | 26724 |
| HPV31 | E1 | 11 | 289 | PPKLRSTAAAL | 26725 |
| HPV31 | E1 | 9 | 540 | PPLLITSNI | 26726 |
| HPV31 | E1 | 11 | 540 | PPLLITSNINA | 26727 |
| HPV31 | E1 | 10 | 524 | PVSIDVKHKA | 26728 |
| HPV31 | E1 | 11 | 524 | PVSIDVKHKAL | 26729 |
| HPV31 | E1 | 10 | 580 | PVYELSDKNW | 26730 |
| HPV31 | E1 | 8 | 430 | QIEFVSFL | 26731 |
| HPV31 | E1 | 10 | 430 | QIEFVSFLSA | 26732 |
| HPV31 | E1 | 11 | 430 | QIEFVSFLSAL | 26733 |
| HPV31 | E1 | 9 | 361 | QLADSDSNA | 26734 |
| HPV31 | E1 | 11 | 361 | QLADSDSNACA | 26735 |
| HPV31 | E1 | 8 | 536 | QLKCPPLL | 26736 |
| HPV31 | E1 | 9 | 536 | QLKCPPLLI | 26737 |
| HPV31 | E1 | 8 | 399 | QMSMGQWI | 26738 |
| HPV31 | E1 | 11 | 339 | QMVQWAYDNDV | 26739 |
| HPV31 | E1 | 8 | 491 | QPLADAKI | 26740 |
| HPV31 | E1 | 10 | 491 | QPLADAKIGM | 26741 |
| HPV31 | E1 | 11 | 491 | QPLADAKIGML | 26742 |
| HPV31 | E1 | 9 | 288 | QPPKLRSTA | 26743 |
| HPV31 | E1 | 10 | 288 | QPPKLRSTAA | 26744 |
| HPV31 | E1 | 11 | 288 | QPPKLRSTAAA | 26745 |
| HPV31 | E1 | 9 | 236 | QPYCLYCHL | 26746 |
| HPV31 | E1 | 8 | 429 | QQIEFVSF | 26747 |
| HPV31 | E1 | 9 | 429 | QQIEFVSFL | 26748 |
| HPV31 | E1 | 11 | 429 | QQIEFVSFLSA | 26749 |
| HPV31 | E1 | 9 | 145 | QVEEQQTTL | 26750 |
| HPV31 | E1 | 8 | 83 | QVLKRKYV | 26751 |
| HPV31 | E1 | 10 | 176 | QVLKTSNGKA | 26752 |
| HPV31 | E1 | 11 | 176 | QVLKTSNGKAA | 26753 |
| HPV31 | E1 | 8 | 267 | RITIEKLL | 26754 |
| HPV31 | E1 | 11 | 267 | RITIEKLLEKL | 26755 |
| HPV31 | E1 | 10 | 124 | RLFELPDSGY | 26756 |
| HPV31 | E1 | 11 | 562 | RLVVFTFPNPF | 26757 |
| HPV31 | E1 | 8 | 398 | RQMSMGQW | 26758 |
| HPV31 | E1 | 9 | 398 | RQMSMGQWI | 26759 |
| HPV31 | E1 | 9 | 322 | RQTVLQHSF | 26760 |
| HPV31 | E1 | 8 | 526 | SIDVKHKA | 26761 |
| HPV31 | E1 | 9 | 526 | SIDVKHKAL | 26762 |
| HPV31 | E1 | 10 | 526 | SIDVKHKALM | 26763 |
| HPV31 | E1 | 8 | 246 | SLACSWGM | 26764 |
| HPV31 | E1 | 9 | 246 | SLACSWGMV | 26765 |
| HPV31 | E1 | 10 | 246 | SLACSWGMVM | 26766 |
| HPV31 | E1 | 11 | 246 | SLACSWGMVML | 26767 |
| HPV31 | E1 | 10 | 469 | SLISFLQGCI | 26768 |
| HPV31 | E1 | 11 | 469 | SLISFLQGCII | 26769 |
| HPV31 | E1 | 10 | 92 | SPLSDISSCV | 26770 |
| HPV31 | E1 | 9 | 106 | SPRLKAICI | 26771 |
| HPV31 | E1 | 8 | 338 | SQMVQWAY | 26772 |
| HPV31 | E1 | 9 | 269 | TIEKLLEKL | 26773 |
| HPV31 | E1 | 10 | 269 | TIEKLLEKLL | 26774 |
| HPV31 | E1 | 8 | 233 | TLLQPYCL | 26775 |
| HPV31 | E1 | 9 | 233 | TLLQPYCLY | 26776 |
| HPV31 | E1 | 9 | 387 | TMCRHYKRA | 26777 |
| HPV31 | E1 | 10 | 506 | TPCWHYIDNY | 26778 |
| HPV31 | E1 | 11 | 506 | TPCWHYIDNYL | 26779 |
| HPV31 | E1 | 10 | 316 | TPEWIERQTV | 26780 |
| HPV31 | E1 | 11 | 316 | TPEWIERQTVL | 26781 |
| HPV31 | E1 | 9 | 169 | TPTRNILQV | 26782 |
| HPV31 | E1 | 10 | 169 | TPTRNILQVL | 26783 |
| HPV31 | E1 | 9 | 226 | TVAEGFKTL | 26784 |

TABLE XIV-continued

B62 Supermotif Peptides

| Type | Protein | No. of Amino Acid | Position | Sequence | Seq. Id. No. |
|---|---|---|---|---|---|
| HPV31 | E1 | 10 | 226 | TVAEGFKTLL | 26785 |
| HPV31 | E1 | 10 | 23 | VIDRQTGDNI | 26786 |
| HPV31 | E1 | 11 | 84 | VLRKYVGSPL | 26787 |
| HPV31 | E1 | 9 | 177 | VLKTSNGKA | 26788 |
| HPV31 | E1 | 10 | 177 | VLKTSNGKAA | 26789 |
| HPV31 | E1 | 11 | 177 | VLKTSNGKAAM | 26790 |
| HPV31 | E1 | 11 | 325 | VLQHSFNDTTF | 26791 |
| HPV31 | E1 | 8 | 349 | VMDDSEIA | 26792 |
| HPV31 | E1 | 9 | 349 | VMDDSEIAY | 26793 |
| HPV31 | E1 | 11 | 349 | VMDDSEIAYKY | 26794 |
| HPV31 | E1 | 8 | 254 | VMLMLVRF | 26795 |
| HPV31 | E1 | 11 | 254 | VMLMLVRFKCA | 26796 |
| HPV31 | E1 | 8 | 447 | VPKKNCIL | 26797 |
| HPV31 | E1 | 9 | 447 | VPKKNCILI | 26798 |
| HPV31 | E1 | 10 | 144 | VQVEEQQTTL | 26799 |
| HPV31 | E1 | 8 | 82 | VQVLKRKY | 26800 |
| HPV31 | E1 | 9 | 82 | VQVLKRKYV | 26801 |
| HPV31 | E1 | 9 | 341 | VQWAYDNDV | 26802 |
| HPV31 | E1 | 10 | 341 | VQWAYDNDVM | 26803 |
| HPV31 | E1 | 9 | 564 | VVFTFPNPF | 26804 |
| HPV31 | E1 | 11 | 564 | VVFTFPNPFPF | 26805 |
| HPV31 | E1 | 8 | 319 | WIERQTVL | 26806 |
| HPV31 | E1 | 9 | 405 | WIKSRCDKV | 26807 |
| HPV31 | E1 | 8 | 489 | WLQPLADA | 26808 |
| HPV31 | E1 | 10 | 489 | WLQPLADAKI | 26809 |
| HPV31 | E1 | 8 | 556 | WPYLHSRL | 26810 |
| HPV31 | E1 | 9 | 556 | WPYLHSRLV | 26811 |
| HPV31 | E1 | 10 | 556 | WPYLHSRLVV | 26812 |
| HPV31 | E1 | 11 | 556 | WPYLHSRLVVF | 26813 |
| HPV31 | E1 | 9 | 511 | YIDNYLRNA | 26814 |
| HPV31 | E1 | 10 | 511 | YIDNYLRNAL | 26815 |
| HPV31 | E1 | 8 | 558 | YLHSRLVV | 26816 |
| HPV31 | E1 | 9 | 558 | YLHSRLVVF | 26817 |
| HPV31 | E1 | 11 | 558 | YLHSRLVVFTF | 26818 |
| HPV31 | E1 | 11 | 515 | YLRNALDGNPV | 26819 |
| HPV31 | E1 | 9 | 428 | YQQIEFVSF | 26820 |
| HPV31 | E1 | 10 | 428 | YQQIEFVSFL | 26821 |
| HPV31 | E1 | 9 | 89 | YVGSPLSDI | 26822 |
| HPV31 | E2 | 8 | 72 | AIELQMML | 26823 |
| HPV31 | E2 | 11 | 72 | AIELQMMLETL | 26824 |
| HPV31 | E2 | 8 | 338 | AIVTLTYI | 26825 |
| HPV31 | E2 | 8 | 229 | ALGTSEGV | 26826 |
| HPV31 | E2 | 11 | 229 | ALGTSEGVRRA | 26827 |
| HPV31 | E2 | 9 | 69 | ALQAIELQM | 26828 |
| HPV31 | E2 | 10 | 69 | ALQAIELQMM | 26829 |
| HPV31 | E2 | 11 | 69 | ALQAIELQMML | 26830 |
| HPV31 | E2 | 9 | 61 | ALSVSKAKA | 26831 |
| HPV31 | E2 | 10 | 61 | ALSVSKAKAL | 26832 |
| HPV31 | E2 | 11 | 105 | APTGCLKKHGY | 26833 |
| HPV31 | E2 | 10 | 286 | AVSCPATTPI | 26834 |
| HPV31 | E2 | 11 | 286 | AVSCPATTPII | 26835 |
| HPV31 | E2 | 8 | 140 | CIDGQCTV | 26836 |
| HPV31 | E2 | 9 | 140 | CIDGQCTVV | 26837 |
| HPV31 | E2 | 9 | 109 | CLKKHGYTV | 26838 |
| HPV31 | E2 | 11 | 109 | CLKKHGYTVEV | 26839 |
| HPV31 | E2 | 9 | 307 | CLRYRLSKY | 26840 |
| HPV31 | E2 | 8 | 289 | CPATTPII | 26841 |
| HPV31 | E2 | 10 | 289 | CPATTPIIHL | 26842 |
| HPV31 | E2 | 9 | 11 | CQDKILEHY | 26843 |
| HPV31 | E2 | 10 | 40 | CVLMYKAREM | 26844 |
| HPV31 | E2 | 8 | 124 | DVHNTMHY | 26845 |
| HPV31 | E2 | 11 | 124 | DVHNTMHYTNW | 26846 |
| HPV31 | E2 | 8 | 204 | EISFAGIV | 26847 |
| HPV31 | E2 | 11 | 204 | EISFAGIVTKL | 26848 |
| HPV31 | E2 | 9 | 74 | ELQMMLETL | 26849 |
| HPV31 | E2 | 11 | 100 | ELYLTAPTGCL | 26850 |
| HPV31 | E2 | 11 | 48 | EMGIHSINHQV | 26851 |
| HPV31 | E2 | 9 | 320 | EQVSSTWHW | 26852 |
| HPV31 | E2 | 8 | 185 | EVHAGGQV | 26853 |
| HPV31 | E2 | 9 | 185 | EVHAGGQVI | 26854 |
| HPV31 | E2 | 10 | 185 | EVHAGGQVIV | 26855 |
| HPV31 | E2 | 11 | 185 | EVHAGGQVIVF | 26856 |
| HPV31 | E2 | 8 | 118 | EVQFDGDV | 26857 |
| HPV31 | E2 | 11 | 353 | FLNTVKIPNTV | 26858 |
| HPV31 | E2 | 11 | 195 | FPESVFSSDEI | 26859 |

TABLE XIV-continued

B62 Supermotif Peptides

| Type | Protein | No. of Amino Acid | Position | Sequence | Seq. Id. No. |
|---|---|---|---|---|---|
| HPV31 | E2 | 8 | 168 | FVNFTEEA | 26860 |
| HPV31 | E2 | 11 | 168 | FVNFTEEAKKY | 26861 |
| HPV31 | E2 | 9 | 50 | GIHSINHQV | 26862 |
| HPV31 | E2 | 10 | 50 | GIHSINHQVV | 26863 |
| HPV31 | E2 | 9 | 209 | GITVKLPTA | 26864 |
| HPV31 | E2 | 10 | 156 | GIYYVHEGHI | 26865 |
| HPV31 | E2 | 10 | 143 | GQCTVVEGQV | 26866 |
| HPV31 | E2 | 10 | 190 | GQVIVFPESV | 26867 |
| HPV31 | E2 | 11 | 190 | GQVIVFPESVF | 26868 |
| HPV31 | E2 | 8 | 150 | GQVNCKGI | 26869 |
| HPV31 | E2 | 9 | 150 | GQVNCKGIY | 26870 |
| HPV31 | E2 | 10 | 150 | GQVNCKGIYY | 26871 |
| HPV31 | E2 | 11 | 150 | GQVNCKGIYYV | 26872 |
| HPV31 | E2 | 8 | 29 | HIDYWKHI | 26873 |
| HPV31 | E2 | 10 | 29 | HIDYWKHIRL | 26874 |
| HPV31 | E2 | 8 | 35 | HIRLECVL | 26875 |
| HPV31 | E2 | 9 | 35 | HIRLECVLM | 26876 |
| HPV31 | E2 | 10 | 35 | HIRLECVLMY | 26877 |
| HPV31 | E2 | 8 | 164 | HITYFVNF | 26878 |
| HPV31 | E2 | 8 | 297 | HLKGDANI | 26879 |
| HPV31 | E2 | 9 | 297 | HLKGDANIL | 26880 |
| HPV31 | E2 | 11 | 257 | HPNKLLRGDSV | 26881 |
| HPV31 | E2 | 9 | 56 | HQVVPALSV | 26882 |
| HPV31 | E2 | 8 | 295 | IIHLKGDA | 26883 |
| HPV31 | E2 | 10 | 295 | IIHLKGDANI | 26884 |
| HPV31 | E2 | 11 | 295 | IIHLKGDANIL | 26885 |
| HPV31 | E2 | 9 | 304 | ILKCLRYRL | 26886 |
| HPV31 | E2 | 11 | 359 | IPNTVSVSTGY | 26887 |
| HPV31 | E2 | 8 | 193 | IVFPESVF | 26888 |
| HPV31 | E2 | 8 | 210 | IVTKLPTA | 26889 |
| HPV31 | E2 | 8 | 358 | KIPNTVSV | 26890 |
| HPV31 | E2 | 8 | 260 | KLLRGDSV | 26891 |
| HPV31 | E2 | 11 | 260 | KLLRGDSVDSV | 26892 |
| HPV31 | E2 | 11 | 316 | KQLYEQVSSTW | 26893 |
| HPV31 | E2 | 10 | 261 | LLRGDSVDSV | 26894 |
| HPV31 | E2 | 8 | 42 | LMYKAREM | 26895 |
| HPV31 | E2 | 10 | 42 | LMYKAREMGI | 26896 |
| HPV31 | E2 | 8 | 70 | LQAIELQM | 26897 |
| HPV31 | E2 | 9 | 70 | LQAIELQMM | 26898 |
| HPV31 | E2 | 10 | 70 | LQAIELQMML | 26899 |
| HPV31 | E2 | 8 | 75 | LQMMLETL | 26900 |
| HPV31 | E2 | 10 | 78 | MLETLNNTEY | 26901 |
| HPV31 | E2 | 11 | 77 | MMLETLNNTEY | 26902 |
| HPV31 | E2 | 8 | 94 | MQQTSLEL | 26903 |
| HPV31 | E2 | 9 | 94 | MQQTSLELY | 26904 |
| HPV31 | E2 | 10 | 94 | MQQTSLELYL | 26905 |
| HPV31 | E2 | 8 | 303 | NILKCLRY | 26906 |
| HPV31 | E2 | 10 | 303 | NILKCLRYRL | 26907 |
| HPV31 | E2 | 10 | 282 | NQTRAVSCPA | 26908 |
| HPV31 | E2 | 8 | 9 | NVCQDKIL | 26909 |
| HPV31 | E2 | 11 | 9 | NVCQDKILEHY | 26910 |
| HPV31 | E2 | 9 | 294 | PIIHLKGDA | 26911 |
| HPV31 | E2 | 11 | 294 | PIIHLKGDANI | 26912 |
| HPV31 | E2 | 10 | 317 | QLYEQVSSTW | 26913 |
| HPV31 | E2 | 8 | 95 | QQTSLELY | 26914 |
| HPV31 | E2 | 9 | 95 | QQTSLELYL | 26915 |
| HPV31 | E2 | 11 | 95 | QQTSLELYLTA | 26916 |
| HPV31 | E2 | 9 | 191 | QVIVFPESV | 26917 |
| HPV31 | E2 | 10 | 191 | QVIVFPESVF | 26918 |
| HPV31 | E2 | 8 | 151 | QVNCKGIY | 26919 |
| HPV31 | E2 | 9 | 151 | QVNCKGIYY | 26920 |
| HPV31 | E2 | 10 | 151 | QVNCKGIYYV | 26921 |
| HPV31 | E2 | 8 | 321 | QVSSTWHW | 26922 |
| HPV31 | E2 | 8 | 57 | QVVPALSV | 26923 |
| HPV31 | E2 | 11 | 57 | QVVPALSVSKA | 26924 |
| HPV31 | E2 | 8 | 25 | RLCDHIDY | 26925 |
| HPV31 | E2 | 9 | 25 | RLCDHIDYW | 26926 |
| HPV31 | E2 | 8 | 37 | RLECVLMY | 26927 |
| HPV31 | E2 | 10 | 37 | RLECVLMYKA | 26928 |
| HPV31 | E2 | 9 | 7 | RLNVCQDKI | 26929 |
| HPV31 | E2 | 10 | 7 | RLNVCQDKIL | 26930 |
| HPV31 | E2 | 8 | 311 | RLSKYKQL | 26931 |
| HPV31 | E2 | 9 | 311 | RLSKYKQLY | 26932 |
| HPV31 | E2 | 9 | 53 | SINHQVVPA | 26933 |
| HPV31 | E2 | 10 | 53 | SINHQVVPAL | 26934 |

TABLE XIV-continued

B62 Supermotif Peptides

| Type | Protein | No. of Amino Acid | Position | Sequence | Seq. Id. No. |
|---|---|---|---|---|---|
| HPV31 | E2 | 8 | 98 | SLELYLTA | 26935 |
| HPV31 | E2 | 10 | 348 | SQRDDFLNTV | 26936 |
| HPV31 | E2 | 11 | 5 | SQRLNVCQDKI | 26937 |
| HPV31 | E2 | 9 | 266 | SVDSVNCGV | 26938 |
| HPV31 | E2 | 10 | 266 | SVDSVNCGVI | 26939 |
| HPV31 | E2 | 8 | 198 | SVFSSDEI | 26940 |
| HPV31 | E2 | 10 | 198 | SVFSSDEISF | 26941 |
| HPV31 | E2 | 11 | 198 | SVFSSDEISFA | 26942 |
| HPV31 | E2 | 9 | 269 | SVNCGVISA | 26943 |
| HPV31 | E2 | 10 | 269 | SVNCGVISAA | 26944 |
| HPV31 | E2 | 11 | 269 | SVNCGVISAAA | 26945 |
| HPV31 | E2 | 8 | 63 | SVSKAKAL | 26946 |
| HPV31 | E2 | 10 | 63 | SVSKAKALQA | 26947 |
| HPV31 | E2 | 11 | 63 | SVSKAKALQAI | 26948 |
| HPV31 | E2 | 9 | 364 | SVSTGYMTI | 26949 |
| HPV31 | E2 | 8 | 3 | TLSQRLNV | 26950 |
| HPV31 | E2 | 9 | 128 | TMHYTNWKF | 26951 |
| HPV31 | E2 | 10 | 128 | TMHYTNWKFI | 26952 |
| HPV31 | E2 | 11 | 128 | TMHYTNWKFIY | 26953 |
| HPV31 | E2 | 9 | 93 | TMQQTSLEL | 26954 |
| HPV31 | E2 | 10 | 93 | TMQQTSLELY | 26955 |
| HPV31 | E2 | 11 | 93 | TMQQTSLELYL | 26956 |
| HPV31 | E2 | 10 | 293 | TPIIHLKGDA | 26957 |
| HPV31 | E2 | 10 | 116 | TVEVQFDGDV | 26958 |
| HPV31 | E2 | 8 | 356 | TVKIPNTV | 26959 |
| HPV31 | E2 | 10 | 356 | TVKIPNTVSV | 26960 |
| HPV31 | E2 | 8 | 362 | TVSVSTGY | 26961 |
| HPV31 | E2 | 9 | 362 | TVSVSTGYM | 26962 |
| HPV31 | E2 | 11 | 362 | TVSVSTGYMTI | 26963 |
| HPV31 | E2 | 8 | 192 | VIVFPESV | 26964 |
| HPV31 | E2 | 9 | 192 | VIVFPESVF | 26965 |
| HPV31 | E2 | 9 | 41 | VLMYKAREM | 26966 |
| HPV31 | E2 | 11 | 41 | VLMYKAREMGI | 26967 |
| HPV31 | E2 | 9 | 59 | VPALSVSKA | 26968 |
| HPV31 | E2 | 11 | 59 | VPALSVSKAKA | 26969 |
| HPV31 | E2 | 11 | 119 | VQFDGDVHNTM | 26970 |
| HPV31 | E2 | 11 | 147 | VVEGQVNCKGI | 26971 |
| HPV31 | E2 | 10 | 58 | VVPALSVSKA | 26972 |
| HPV31 | E2 | 10 | 344 | YISTSQRDDF | 26973 |
| HPV31 | E2 | 11 | 344 | YISTSQRDDFL | 26974 |
| HPV31 | E2 | 10 | 138 | YLCIDGQCTV | 26975 |
| HPV31 | E2 | 11 | 138 | YLCIDGQCTVV | 26976 |
| HPV31 | E2 | 9 | 102 | YLTAPTGCL | 26977 |
| HPV31 | E2 | 9 | 159 | YVHEGHITY | 26978 |
| HPV31 | E2 | 10 | 159 | YVHEGHITYF | 26979 |
| HPV31 | E2 | 11 | 159 | YVHEGHITYFV | 26980 |
| HPV31 | E5 | 8 | 61 | CIYVVFIY | 26981 |
| HPV31 | E5 | 9 | 61 | CIYVVFIYI | 26982 |
| HPV31 | E5 | 11 | 61 | CIYVVFIYIPL | 26983 |
| HPV31 | E5 | 8 | 26 | CLVIRPLV | 26984 |
| HPV31 | E5 | 9 | 26 | CLVIRPLVL | 26985 |
| HPV31 | E5 | 11 | 26 | CLVIRPLVLSV | 26986 |
| HPV31 | E5 | 8 | 20 | CVLLFVCL | 26987 |
| HPV31 | E5 | 9 | 20 | CVLLFVCLV | 26988 |
| HPV31 | E5 | 10 | 20 | CVLLFVCLVI | 26989 |
| HPV31 | E5 | 9 | 3 | ELNISTVSI | 26990 |
| HPV31 | E5 | 10 | 3 | ELNISTVSIV | 26991 |
| HPV31 | E5 | 11 | 3 | ELNISTVSIVL | 26992 |
| HPV31 | E5 | 8 | 66 | FIYIPLFV | 26993 |
| HPV31 | E5 | 9 | 66 | FIYIPLFVI | 26994 |
| HPV31 | E5 | 8 | 15 | FLLCFCVL | 26995 |
| HPV31 | E5 | 9 | 15 | FLLCFCVLL | 26996 |
| HPV31 | E5 | 10 | 15 | FLLCFCVLLF | 26997 |
| HPV31 | E5 | 11 | 15 | FLLCFCVLLFV | 26998 |
| HPV31 | E5 | 9 | 24 | FVCLVIRPL | 26999 |
| HPV31 | E5 | 10 | 24 | FVCLVIRPLV | 27000 |
| HPV31 | E5 | 11 | 24 | FVCLVIRPLVL | 27001 |
| HPV31 | E5 | 9 | 72 | FVIHTHASF | 27002 |
| HPV31 | E5 | 10 | 72 | FVIHTHASFL | 27003 |
| HPV31 | E5 | 10 | 48 | ILWVIATSPL | 27004 |
| HPV31 | E5 | 10 | 69 | IPLFVIHTHA | 27005 |
| HPV31 | E5 | 8 | 46 | IVILWVIA | 27006 |
| HPV31 | E5 | 9 | 11 | IVLCFLLCF | 27007 |
| HPV31 | E5 | 11 | 11 | IVLCFLLCFCV | 27008 |
| HPV31 | E5 | 8 | 45 | LIVILWVI | 27009 |

TABLE XIV-continued

B62 Supermotif Peptides

| Type | Protein | No. of Amino Acid | Position | Sequence | Seq. Id. No. |
|---|---|---|---|---|---|
| HPV31 | E5 | 9 | 45 | LIVILWVIA | 27010 |
| HPV31 | E5 | 8 | 16 | LLCFCVLL | 27011 |
| HPV31 | E5 | 9 | 16 | LLCFCVLLF | 27012 |
| HPV31 | E5 | 10 | 16 | LLCFCVLLFV | 27013 |
| HPV31 | E5 | 8 | 22 | LLFVCLVI | 27014 |
| HPV31 | E5 | 11 | 22 | LLFVCLVIRPL | 27015 |
| HPV31 | E5 | 8 | 44 | LLIVILWV | 27016 |
| HPV31 | E5 | 9 | 44 | LLIVILWVI | 27017 |
| HPV31 | E5 | 10 | 44 | LLIVILWVIA | 27018 |
| HPV31 | E5 | 8 | 43 | LLLIVILW | 27019 |
| HPV31 | E5 | 9 | 43 | LLLIVILWV | 27020 |
| HPV31 | E5 | 10 | 43 | LLLIVILWVI | 27021 |
| HPV31 | E5 | 11 | 43 | LLLIVILWVIA | 27022 |
| HPV31 | E5 | 8 | 42 | LLLLIVIL | 27023 |
| HPV31 | E5 | 9 | 42 | LLLLIVILW | 27024 |
| HPV31 | E5 | 10 | 42 | LLLLIVILWV | 27025 |
| HPV31 | E5 | 11 | 42 | LLLLIVILWVI | 27026 |
| HPV31 | E5 | 8 | 27 | LVIRPLVL | 27027 |
| HPV31 | E5 | 10 | 27 | LVIRPLVLSV | 27028 |
| HPV31 | E5 | 8 | 32 | LVLSVSVY | 27029 |
| HPV31 | E5 | 9 | 32 | LVLSVSVYA | 27030 |
| HPV31 | E5 | 11 | 32 | LVLSVSVYATL | 27031 |
| HPV31 | E5 | 9 | 1 | MIELNISTV | 27032 |
| HPV31 | E5 | 11 | 1 | MIELNISTVSI | 27033 |
| HPV31 | E5 | 8 | 5 | NISTVSIV | 27034 |
| HPV31 | E5 | 9 | 5 | NISTVSIVL | 27035 |
| HPV31 | E5 | 11 | 5 | NISTVSIVLCF | 27036 |
| HPV31 | E5 | 9 | 70 | PLFVIHTHA | 27037 |
| HPV31 | E5 | 11 | 70 | PLFVIHTHASF | 27038 |
| HPV31 | E5 | 8 | 56 | PLRCFCIY | 27039 |
| HPV31 | E5 | 9 | 56 | PLRCFCIYV | 27040 |
| HPV31 | E5 | 10 | 56 | PLRCFCIYVV | 27041 |
| HPV31 | E5 | 11 | 56 | PLRCFCIYVVF | 27042 |
| HPV31 | E5 | 8 | 31 | PLVLSVSV | 27043 |
| HPV31 | E5 | 9 | 31 | PLVLSVSVY | 27044 |
| HPV31 | E5 | 10 | 31 | PLVLSVSVYA | 27045 |
| HPV31 | E5 | 9 | 30 | RPLVLSVSV | 27046 |
| HPV31 | E5 | 10 | 30 | RPLVLSVSVY | 27047 |
| HPV31 | E5 | 11 | 30 | RPLVLSVSVYA | 27048 |
| HPV31 | E5 | 8 | 10 | SIVLCFLL | 27049 |
| HPV31 | E5 | 10 | 10 | SIVLCFLLCF | 27050 |
| HPV31 | E5 | 8 | 55 | SPLRCFCI | 27051 |
| HPV31 | E5 | 9 | 55 | SPLRCFCIY | 27052 |
| HPV31 | E5 | 10 | 55 | SPLRCFCIYV | 27053 |
| HPV31 | E5 | 11 | 55 | SPLRCFCIYVV | 27054 |
| HPV31 | E5 | 8 | 35 | SVSVYATL | 27055 |
| HPV31 | E5 | 9 | 35 | SVSVYATLL | 27056 |
| HPV31 | E5 | 10 | 35 | SVSVYATLLL | 27057 |
| HPV31 | E5 | 11 | 35 | SVSVYATLLLL | 27058 |
| HPV31 | E5 | 8 | 37 | SVYATLLL | 27059 |
| HPV31 | E5 | 9 | 37 | SVYATLLLL | 27060 |
| HPV31 | E5 | 10 | 37 | SYVATLLLLI | 27061 |
| HPV31 | E5 | 11 | 37 | SVYATLLLLIV | 27062 |
| HPV31 | E5 | 8 | 41 | TLLLLIVI | 27063 |
| HPV31 | E5 | 9 | 41 | TLLLLIVIL | 27064 |
| HPV31 | E5 | 10 | 41 | TLLLLIVILW | 27065 |
| HPV31 | E5 | 11 | 41 | TLLLLIVILWV | 27066 |
| HPV31 | E5 | 8 | 8 | TVSIVLCF | 27067 |
| HPV31 | E5 | 9 | 8 | TVSIVLCFL | 27068 |
| HPV31 | E5 | 10 | 8 | TVSIVLCFLL | 27069 |
| HPV31 | E5 | 10 | 51 | VIATSPLRCF | 27070 |
| HPV31 | E5 | 8 | 73 | VIHTHASF | 27071 |
| HPV31 | E5 | 9 | 73 | VIHTHASFL | 27072 |
| HPV31 | E5 | 11 | 47 | VILWVIATSPL | 27073 |
| HPV31 | E5 | 9 | 28 | VIRPLVLSV | 27074 |
| HPV31 | E5 | 11 | 28 | VIRPLVLSVSV | 27075 |
| HPV31 | E5 | 8 | 12 | VLCFLLCF | 27076 |
| HPV31 | E5 | 10 | 12 | VLCFLLCFCV | 27077 |
| HPV31 | E5 | 11 | 12 | VLCFLLCFCVL | 27078 |
| HPV31 | E5 | 8 | 21 | VLLFVCLV | 27079 |
| HPV31 | E5 | 9 | 21 | VLLFVCLVI | 27080 |
| HPV31 | E5 | 8 | 33 | VLSVSVYA | 27081 |
| HPV31 | E5 | 10 | 33 | VLSVSVYATL | 27082 |
| HPV31 | E5 | 11 | 33 | VLSVSVYATLL | 27083 |
| HPV31 | E5 | 8 | 64 | VVFIYIPL | 27084 |

TABLE XIV-continued

B62 Supermotif Peptides

| Type | Protein | No. of Amino Acid | Position | Sequence | Seq. Id. No. |
|---|---|---|---|---|---|
| HPV31 | E5 | 9 | 64 | VVFIYIPLF | 27085 |
| HPV31 | E5 | 10 | 64 | VVFIYIPLFV | 27086 |
| HPV31 | E5 | 11 | 64 | VVFIYIPLFVI | 27087 |
| HPV31 | E5 | 8 | 50 | WVIATSPL | 27088 |
| HPV31 | E5 | 11 | 50 | WVIATSPLRCF | 27089 |
| HPV31 | E5 | 11 | 68 | YIPLFVIHTHA | 27090 |
| HPV31 | E5 | 9 | 63 | YVVFIYIPL | 27091 |
| HPV31 | E5 | 10 | 63 | YVVFIYIPLF | 27092 |
| HPV31 | E5 | 11 | 63 | YVVFIYIPLFV | 27093 |
| HPV31 | E6 | 9 | 18 | ALEIPYDEL | 27094 |
| HPV31 | E6 | 11 | 18 | ALEIPYDELRL | 27095 |
| HPV31 | E6 | 8 | 103 | CITCQRPL | 27096 |
| HPV31 | E6 | 8 | 66 | CLRFYSKV | 27097 |
| HPV31 | E6 | 11 | 66 | CLRFYSKVSEF | 27098 |
| HPV31 | E6 | 9 | 111 | CPEEKQRHL | 27099 |
| HPV31 | E6 | 8 | 30 | CVYCKGQL | 27100 |
| HPV31 | E6 | 9 | 20 | EIPYDELRL | 27101 |
| HPV31 | E6 | 8 | 25 | ELRLNCVY | 27102 |
| HPV31 | E6 | 8 | 14 | ELSSALEI | 27103 |
| HPV31 | E6 | 10 | 14 | ELSSALEIPY | 27104 |
| HPV31 | E6 | 10 | 41 | EVLDFAFTDL | 27105 |
| HPV31 | E6 | 10 | 95 | GICDLLIRCI | 27106 |
| HPV31 | E6 | 8 | 35 | GQLTETEV | 27107 |
| HPV31 | E6 | 9 | 35 | GQLTETEVL | 27108 |
| HPV31 | E6 | 11 | 35 | GQLTETEVLDF | 27109 |
| HPV31 | E6 | 9 | 61 | GVCTKCLRF | 27110 |
| HPV31 | E6 | 10 | 61 | GVCTKCLRFY | 27111 |
| HPV31 | E6 | 8 | 118 | HLDKKKRF | 27112 |
| HPV31 | E6 | 11 | 118 | HLDKKKRFHNI | 27113 |
| HPV31 | E6 | 8 | 21 | IPYDELRL | 27114 |
| HPV31 | E6 | 11 | 21 | IPYDELRLNCV | 27115 |
| HPV31 | E6 | 11 | 52 | IVYRDDTPHGV | 27116 |
| HPV31 | E6 | 8 | 11 | KLHELSSA | 27117 |
| HPV31 | E6 | 9 | 11 | KLHELSSAL | 27118 |
| HPV31 | E6 | 11 | 11 | KLHELSSALEI | 27119 |
| HPV31 | E6 | 10 | 90 | KLTNKGICDL | 27120 |
| HPV31 | E6 | 11 | 90 | KLTNKGICDLL | 27121 |
| HPV31 | E6 | 11 | 115 | KQRHLDKKKRF | 27122 |
| HPV31 | E6 | 8 | 72 | KVSEFRWY | 27123 |
| HPV31 | E6 | 10 | 72 | KVSEFRWYRY | 27124 |
| HPV31 | E6 | 11 | 100 | LIRCITCQRPL | 27125 |
| HPV31 | E6 | 11 | 127 | NIGGRWTGRCI | 27126 |
| HPV31 | E6 | 9 | 4 | NPAERPRKL | 27127 |
| HPV31 | E6 | 11 | 109 | PLCPEEKQRHL | 27128 |
| HPV31 | E6 | 8 | 36 | QLTETEVL | 27129 |
| HPV31 | E6 | 10 | 36 | QLTETEVLDF | 27130 |
| HPV31 | E6 | 11 | 36 | QLTETEVLDFA | 27131 |
| HPV31 | E6 | 11 | 27 | RLNCVYCKGQL | 27132 |
| HPV31 | E6 | 8 | 8 | RPRKLHEL | 27133 |
| HPV31 | E6 | 11 | 8 | RPRKLHELSSA | 27134 |
| HPV31 | E6 | 8 | 142 | RPRTETQV | 27135 |
| HPV31 | E6 | 10 | 82 | SVYGTTLEKL | 27136 |
| HPV31 | E6 | 10 | 87 | TLEKLTNKGI | 27137 |
| HPV31 | E6 | 10 | 58 | TPHGVCTKCL | 27138 |
| HPV31 | E6 | 9 | 42 | VLDFAFTDL | 27139 |
| HPV31 | E6 | 11 | 42 | VLDFAFTDLTI | 27140 |
| HPV31 | E7 | 8 | 91 | CPNCSTRL | 27141 |
| HPV31 | E7 | 9 | 59 | CQCKSTLRL | 27142 |
| HPV31 | E7 | 11 | 59 | CQCKSTLRLCV | 27143 |
| HPV31 | E7 | 9 | 68 | CVQSTQVDI | 27144 |
| HPV31 | E7 | 11 | 68 | CVQSTQVDIRI | 27145 |
| HPV31 | E7 | 8 | 75 | DIRILQEL | 27146 |
| HPV31 | E7 | 9 | 75 | DIRILQELL | 27147 |
| HPV31 | E7 | 10 | 75 | DIRILQELLM | 27148 |
| HPV31 | E7 | 8 | 21 | DLHCYEQL | 27149 |
| HPV31 | E7 | 9 | 14 | DLQPEATDL | 27150 |
| HPV31 | E7 | 10 | 36 | DVIDSPAGQA | 27151 |
| HPV31 | E7 | 9 | 81 | ELLMGSFGI | 27152 |
| HPV31 | E7 | 10 | 81 | ELLMGSFGIV | 27153 |
| HPV31 | E7 | 9 | 46 | EPDTSNYNI | 27154 |
| HPV31 | E7 | 10 | 46 | EPDTSNYNIV | 27155 |
| HPV31 | E7 | 11 | 88 | GIVCPNCSTRL | 27156 |
| HPV31 | E7 | 10 | 43 | GQAEPDTSNY | 27157 |
| HPV31 | E7 | 10 | 78 | ILQELLMGSF | 27158 |
| HPV31 | E7 | 10 | 89 | IVCPNCSTRL | 27159 |

TABLE XIV-continued

B62 Supermotif Peptides

| Type | Protein | No. of Amino Acid | Position | Sequence | Seq. Id. No. |
|---|---|---|---|---|---|
| HPV31 | E7 | 8 | 82 | LLMGSFGI | 27160 |
| HPV31 | E7 | 9 | 82 | LLMGSFGIV | 27161 |
| HPV31 | E7 | 8 | 83 | LMGSFGIV | 27162 |
| HPV31 | E7 | 10 | 28 | LPDSSDEEDV | 27163 |
| HPV31 | E7 | 11 | 28 | LPDSSDEEDVI | 27164 |
| HPV31 | E7 | 8 | 8 | LQDYVLDL | 27165 |
| HPV31 | E7 | 9 | 79 | LQELLMGSF | 27166 |
| HPV31 | E7 | 11 | 79 | LQELLMGSFGI | 27167 |
| HPV31 | E7 | 8 | 15 | LQPEATDL | 27168 |
| HPV31 | E7 | 11 | 15 | LQPEATDLHCY | 27169 |
| HPV31 | E7 | 11 | 27 | QLPDSSDEEDV | 27170 |
| HPV31 | E7 | 10 | 16 | QPEATDLHCY | 27171 |
| HPV31 | E7 | 10 | 73 | QVDIRILQEL | 27172 |
| HPV31 | E7 | 11 | 73 | QVDIRILQELL | 27173 |
| HPV31 | E7 | 8 | 77 | RILQELLM | 27174 |
| HPV31 | E7 | 11 | 77 | RILQELLMGSF | 27175 |
| HPV31 | E7 | 9 | 66 | RLCVQSTQV | 27176 |
| HPV31 | E7 | 11 | 66 | RLCVQSTQVDI | 27177 |
| HPV31 | E7 | 9 | 7 | TLQDYVLDL | 27178 |
| HPV31 | E7 | 11 | 64 | TLRLCVQSTQV | 27179 |
| HPV31 | E7 | 8 | 5 | TPTLQDYV | 27180 |
| HPV31 | E7 | 9 | 5 | TPTLQDYVL | 27181 |
| HPV31 | E7 | 11 | 5 | TPTLQDYVLDL | 27182 |
| HPV31 | E7 | 8 | 72 | TQVDIRIL | 27183 |
| HPV31 | E7 | 11 | 72 | TQVDIRILQEL | 27184 |
| HPV31 | E7 | 9 | 37 | VIDSPAGQA | 27185 |
| HPV31 | E7 | 8 | 12 | VLDLQPEA | 27186 |
| HPV31 | E7 | 11 | 12 | VLDLQPEATDL | 27187 |
| HPV31 | E7 | 8 | 69 | VQSTQVDI | 27188 |
| HPV31 | E7 | 10 | 69 | VQSTQVDIRI | 27189 |
| HPV31 | E7 | 11 | 69 | VQSTQVDIRIL | 27190 |
| HPV31 | E7 | 9 | 11 | YVLDLQPEA | 27191 |
| HPV31 | L1 | 9 | 348 | AIANSDTTF | 27192 |
| HPV31 | L1 | 8 | 398 | AILEDWNF | 27193 |
| HPV31 | L1 | 10 | 398 | AILEDWNFGL | 27194 |
| HPV31 | L1 | 8 | 426 | AITCQKTA | 27195 |
| HPV31 | L1 | 10 | 180 | AITPGDCPPL | 27196 |
| HPV31 | L1 | 9 | 213 | ALQDTKSNV | 27197 |
| HPV31 | L1 | 11 | 213 | ALQDTKSNVPL | 27198 |
| HPV31 | L1 | 10 | 433 | APQKPKEDPF | 27199 |
| HPV31 | L1 | 10 | 488 | APSASTTTPA | 27200 |
| HPV31 | L1 | 8 | 317 | AQGHNNGI | 27201 |
| HPV31 | L1 | 10 | 317 | AQGHNNGICW | 27202 |
| HPV31 | L1 | 8 | 305 | AQIFNKPY | 27203 |
| HPV31 | L1 | 9 | 305 | AQIFNKPYW | 27204 |
| HPV31 | L1 | 10 | 305 | AQIFNKPYWM | 27205 |
| HPV31 | L1 | 11 | 147 | CISMDYKQTQL | 27206 |
| HPV31 | L1 | 9 | 158 | CLLGCKPPI | 27207 |
| HPV31 | L1 | 10 | 186 | CPPLELKNSV | 27208 |
| HPV31 | L1 | 11 | 186 | CPPLELKNSVI | 27209 |
| HPV31 | L1 | 9 | 224 | DICNSICKY | 27210 |
| HPV31 | L1 | 9 | 387 | DIMTYIHSM | 27211 |
| HPV31 | L1 | 11 | 459 | DLDQFPLGRKF | 27212 |
| HPV31 | L1 | 8 | 372 | DLQFIFQL | 27213 |
| HPV31 | L1 | 11 | 372 | DLQFIFQLCKI | 27214 |
| HPV31 | L1 | 11 | 275 | DLYIKGSGSTA | 27215 |
| HPV31 | L1 | 9 | 200 | DMVDTGFGA | 27216 |
| HPV31 | L1 | 10 | 200 | DMVDTGFGAM | 27217 |
| HPV31 | L1 | 8 | 440 | DPFKDYVF | 27218 |
| HPV31 | L1 | 9 | 440 | DPFKDYVFW | 27219 |
| HPV31 | L1 | 11 | 440 | DPFKDYVFWEV | 27220 |
| HPV31 | L1 | 9 | 461 | DQFPLGRKF | 27221 |
| HPV31 | L1 | 10 | 461 | DQFPLGRKFL | 27222 |
| HPV31 | L1 | 11 | 461 | DQFPLGRKFLL | 27223 |
| HPV31 | L1 | 8 | 241 | EPYGDTLF | 27224 |
| HPV31 | L1 | 9 | 241 | EPYGDTLFF | 27225 |
| HPV31 | L1 | 10 | 241 | EPYGDTLFFY | 27226 |
| HPV31 | L1 | 11 | 241 | EPYGDTLFFYL | 27227 |
| HPV31 | L1 | 8 | 254 | EQMFVRHF | 27228 |
| HPV31 | L1 | 9 | 254 | EQMFVRHFF | 27229 |
| HPV31 | L1 | 8 | 107 | EVGRGQPL | 27230 |
| HPV31 | L1 | 10 | 107 | EVGRGQPLGV | 27231 |
| HPV31 | L1 | 8 | 449 | EVNLKEKF | 27232 |
| HPV31 | L1 | 10 | 449 | EVNLKEKFSA | 27233 |
| HPV31 | L1 | 8 | 375 | FIFQLCKI | 27234 |

TABLE XIV-continued

B62 Supermotif Peptides

| Type | Protein | No. of Amino Acid | Position | Sequence | Seq. Id. No. |
|---|---|---|---|---|---|
| HPV31 | L1 | 10 | 375 | FIFQLCKITL | 27235 |
| HPV31 | L1 | 9 | 469 | FLLQAGYRA | 27236 |
| HPV31 | L1 | 8 | 463 | FPLGRKFL | 27237 |
| HPV31 | L1 | 9 | 463 | FPLGRKFLL | 27238 |
| HPV31 | L1 | 11 | 463 | FPLGRKFLLQA | 27239 |
| HPV31 | L1 | 8 | 293 | FPTPSGSM | 27240 |
| HPV31 | L1 | 9 | 293 | FPTPSGSMV | 27241 |
| HPV31 | L1 | 8 | 377 | FQLCKITL | 27242 |
| HPV31 | L1 | 10 | 377 | FQLCKITLSA | 27243 |
| HPV31 | L1 | 8 | 323 | GICWGNQL | 27244 |
| HPV31 | L1 | 9 | 323 | GICWGNQLF | 27245 |
| HPV31 | L1 | 10 | 323 | GICWGNQLFV | 27246 |
| HPV31 | L1 | 8 | 117 | GISGHPLL | 27247 |
| HPV31 | L1 | 11 | 117 | GISGHPLLNKF | 27248 |
| HPV31 | L1 | 10 | 105 | GLEVGRGQPL | 27249 |
| HPV31 | L1 | 9 | 68 | GLQYRVFRV | 27250 |
| HPV31 | L1 | 11 | 68 | GLQYRVFRVRL | 27251 |
| HPV31 | L1 | 10 | 406 | GLTTPPSGSL | 27252 |
| HPV31 | L1 | 10 | 139 | GPGTDNRECI | 27253 |
| HPV31 | L1 | 8 | 111 | GQPLGVGI | 27254 |
| HPV31 | L1 | 9 | 115 | GVGISGHPL | 27255 |
| HPV31 | L1 | 10 | 115 | GVGISGHPLL | 27256 |
| HPV31 | L1 | 9 | 399 | ILEDWNFGL | 27257 |
| HPV31 | L1 | 8 | 388 | IMTYIHSM | 27258 |
| HPV31 | L1 | 11 | 388 | IMTYIHSMNPA | 27259 |
| HPV31 | L1 | 10 | 52 | IPKSDNPKKI | 27260 |
| HPV31 | L1 | 11 | 52 | IPKSDNPKKIV | 27261 |
| HPV31 | L1 | 11 | 196 | IQDGDMVDTGF | 27262 |
| HPV31 | L1 | 9 | 61 | IVVPKVSGL | 27263 |
| HPV31 | L1 | 11 | 61 | IVVPKVSGLQY | 27264 |
| HPV31 | L1 | 8 | 381 | KITLSADI | 27265 |
| HPV31 | L1 | 9 | 381 | KITLSADIM | 27266 |
| HPV31 | L1 | 11 | 381 | KITLSADIMTY | 27267 |
| HPV31 | L1 | 10 | 60 | KIVVPKVSGL | 27268 |
| HPV31 | L1 | 11 | 237 | KMVAEPYGDTL | 27269 |
| HPV31 | L1 | 10 | 436 | KPKEDPFKDY | 27270 |
| HPV31 | L1 | 11 | 436 | KPKEDPFKDYV | 27271 |
| HPV31 | L1 | 8 | 163 | KPPIGEHW | 27272 |
| HPV31 | L1 | 8 | 310 | KPYWMQRA | 27273 |
| HPV31 | L1 | 8 | 153 | KQTQLCLL | 27274 |
| HPV31 | L1 | 9 | 65 | KVSGLQYRV | 27275 |
| HPV31 | L1 | 10 | 65 | KVSGLQYRVF | 27276 |
| HPV31 | L1 | 8 | 20 | KVVSTDEY | 27277 |
| HPV31 | L1 | 9 | 20 | KVVSTDEYV | 27278 |
| HPV31 | L1 | 8 | 159 | LLGCKPPI | 27279 |
| HPV31 | L1 | 8 | 470 | LLQAGYRA | 27280 |
| HPV31 | L1 | 8 | 42 | LLTVGHPY | 27281 |
| HPV31 | L1 | 9 | 42 | LLTVGHPYY | 27282 |
| HPV31 | L1 | 11 | 42 | LLTVGHPYYSI | 27283 |
| HPV31 | L1 | 9 | 78 | LPDPNKFGF | 27284 |
| HPV31 | L1 | 9 | 13 | LPPVPVSKV | 27285 |
| HPV31 | L1 | 10 | 13 | LPPVPVSKVV | 27286 |
| HPV31 | L1 | 11 | 471 | LQAGYRARPKF | 27287 |
| HPV31 | L1 | 8 | 214 | LQDTKSNV | 27288 |
| HPV31 | L1 | 10 | 214 | LQDTKSNVPL | 27289 |
| HPV31 | L1 | 10 | 373 | LQFIFQLCKI | 27290 |
| HPV31 | L1 | 8 | 69 | LQYRVFRV | 27291 |
| HPV31 | L1 | 10 | 69 | LQYRVFRVRL | 27292 |
| HPV31 | L1 | 8 | 99 | LVWACVGL | 27293 |
| HPV31 | L1 | 10 | 99 | LVWACVGLEV | 27294 |
| HPV31 | L1 | 11 | 314 | MQRAQGHNNGI | 27295 |
| HPV31 | L1 | 10 | 238 | MVAEPYGDTL | 27296 |
| HPV31 | L1 | 11 | 238 | MVAEPYGDTLF | 27297 |
| HPV31 | L1 | 8 | 201 | MVDTGFGA | 27298 |
| HPV31 | L1 | 9 | 201 | MVDTGFGAM | 27299 |
| HPV31 | L1 | 11 | 201 | MVDTGFGAMDF | 27300 |
| HPV31 | L1 | 8 | 300 | MVTSDAQI | 27301 |
| HPV31 | L1 | 9 | 300 | MVTSDAQIF | 27302 |
| HPV31 | L1 | 9 | 32 | NIYYHAGSA | 27303 |
| HPV31 | L1 | 11 | 32 | NIYYHAGSARL | 27304 |
| HPV31 | L1 | 8 | 451 | NLKEKFSA | 27305 |
| HPV31 | L1 | 10 | 451 | NLKEKFSADL | 27306 |
| HPV31 | L1 | 8 | 342 | NMSVCAAI | 27307 |
| HPV31 | L1 | 9 | 342 | NMSVCAAIA | 27308 |
| HPV31 | L1 | 8 | 396 | NPAILEDW | 27309 |

TABLE XIV-continued

B62 Supermotif Peptides

| Type | Protein | No. of Amino Acid | Position | Sequence | Seq. Id. No. |
|---|---|---|---|---|---|
| HPV31 | L1 | 10 | 396 | NPAILEDWNF | 27310 |
| HPV31 | L1 | 8 | 93 | NPETQRLV | 27311 |
| HPV31 | L1 | 9 | 93 | NPETQRLVW | 27312 |
| HPV31 | L1 | 10 | 93 | NPETQRLVWA | 27313 |
| HPV31 | L1 | 10 | 57 | NPKKIVVPKV | 27314 |
| HPV31 | L1 | 8 | 328 | NQLFVTVV | 27315 |
| HPV31 | L1 | 10 | 220 | NVPLDICNSI | 27316 |
| HPV31 | L1 | 8 | 222 | PLDICNSI | 27317 |
| HPV31 | L1 | 11 | 222 | PLDICNSICKY | 27318 |
| HPV31 | L1 | 8 | 188 | PLELKNSV | 27319 |
| HPV31 | L1 | 9 | 188 | PLELKNSVI | 27320 |
| HPV31 | L1 | 8 | 464 | PLGRKFLL | 27321 |
| HPV31 | L1 | 10 | 464 | PLGRKFLLQA | 27322 |
| HPV31 | L1 | 11 | 113 | PLGVGISGHPL | 27323 |
| HPV31 | L1 | 9 | 187 | PPLELKNSV | 27324 |
| HPV31 | L1 | 10 | 187 | PPLELKNSVI | 27325 |
| HPV31 | L1 | 10 | 410 | PPSGSLEDTY | 27326 |
| HPV31 | L1 | 8 | 14 | PPVPVSKV | 27327 |
| HPV31 | L1 | 9 | 14 | PPVPVSKVV | 27328 |
| HPV31 | L1 | 9 | 434 | PQKPKEDPF | 27329 |
| HPV31 | L1 | 8 | 15 | PVPVSKVV | 27330 |
| HPV31 | L1 | 11 | 17 | PVSKVVSTDEY | 27331 |
| HPV31 | L1 | 8 | 306 | QIFNKPYW | 27332 |
| HPV31 | L1 | 9 | 306 | QIFNKPYWM | 27333 |
| HPV31 | L1 | 9 | 378 | QLCKITLSA | 27334 |
| HPV31 | L1 | 11 | 378 | QLCKITLSADI | 27335 |
| HPV31 | L1 | 11 | 156 | QLCLLGCKPPI | 27336 |
| HPV31 | L1 | 8 | 255 | QMFVRHFF | 27337 |
| HPV31 | L1 | 9 | 41 | RLLTVGHPY | 27338 |
| HPV31 | L1 | 10 | 41 | RLLTVGHPYY | 27339 |
| HPV31 | L1 | 8 | 77 | RLPDPNKF | 27340 |
| HPV31 | L1 | 10 | 77 | RLPDPNKFGF | 27341 |
| HPV31 | L1 | 9 | 98 | RLVWACVGL | 27342 |
| HPV31 | L1 | 11 | 98 | RLVWACVGLEV | 27343 |
| HPV31 | L1 | 11 | 478 | RPKFKAGKRSA | 27344 |
| HPV31 | L1 | 8 | 5 | RPSEATVY | 27345 |
| HPV31 | L1 | 9 | 5 | RPSEATVYL | 27346 |
| HPV31 | L1 | 10 | 75 | RVRLPDPNKF | 27347 |
| HPV31 | L1 | 8 | 228 | SICKYPDY | 27348 |
| HPV31 | L1 | 9 | 228 | SICKYPDYL | 27349 |
| HPV31 | L1 | 11 | 228 | SICKYPDYLKM | 27350 |
| HPV31 | L1 | 11 | 51 | SIPKSDNPKKI | 27351 |
| HPV31 | L1 | 8 | 414 | SLEDTYRF | 27352 |
| HPV31 | L1 | 9 | 414 | SLEDTYRFV | 27353 |
| HPV31 | L1 | 8 | 2 | SLWRPSEA | 27354 |
| HPV31 | L1 | 10 | 2 | SLWRPSEATV | 27355 |
| HPV31 | L1 | 11 | 2 | SLWRPSEATVY | 27356 |
| HPV31 | L1 | 9 | 149 | SMDYKQTQL | 27357 |
| HPV31 | L1 | 11 | 149 | SMDYKQTQLCL | 27358 |
| HPV31 | L1 | 10 | 394 | SMNPAILEDW | 27359 |
| HPV31 | L1 | 9 | 299 | SMVTSDAQI | 27360 |
| HPV31 | L1 | 10 | 299 | SMVTSDAQIF | 27361 |
| HPV31 | L1 | 8 | 174 | SPCSNNAI | 27362 |
| HPV31 | L1 | 10 | 424 | SQAITCQKTA | 27363 |
| HPV31 | L1 | 8 | 194 | SVIQDGDM | 27364 |
| HPV31 | L1 | 9 | 194 | SVIQDGDMV | 27365 |
| HPV31 | L1 | 8 | 271 | SVPTDLYI | 27366 |
| HPV31 | L1 | 8 | 286 | TLANSTYF | 27367 |
| HPV31 | L1 | 11 | 246 | TLFFYLRREQM | 27368 |
| HPV31 | L1 | 9 | 383 | TLSADIMTY | 27369 |
| HPV31 | L1 | 10 | 383 | TLSADIMTYI | 27370 |
| HPV31 | L1 | 8 | 182 | TPGDCPPL | 27371 |
| HPV31 | L1 | 10 | 182 | TPGDCPPLEL | 27372 |
| HPV31 | L1 | 11 | 409 | TPPSGSLEDTY | 27373 |
| HPV31 | L1 | 11 | 295 | TPSGSMVTSDA | 27374 |
| HPV31 | L1 | 9 | 96 | TQRLVWACV | 27375 |
| HPV31 | L1 | 11 | 96 | TQRLVWACVGL | 27376 |
| HPV31 | L1 | 10 | 267 | TVGESVPTDL | 27377 |
| HPV31 | L1 | 11 | 267 | TVGESVPTDLY | 27378 |
| HPV31 | L1 | 9 | 44 | TVGHPYYSI | 27379 |
| HPV31 | L1 | 11 | 333 | TVVDTTRSTNM | 27380 |
| HPV31 | L1 | 9 | 10 | TVYLPPVPV | 27381 |
| HPV31 | L1 | 8 | 195 | VIQDGDMV | 27382 |
| HPV31 | L1 | 9 | 63 | VPKVSGLQY | 27383 |
| HPV31 | L1 | 11 | 63 | VPKVSGLQYRV | 27384 |

TABLE XIV-continued

B62 Supermotif Peptides

| Type | Protein | No. of Amino Acid | Position | Sequence | Seq. Id. No. |
|---|---|---|---|---|---|
| HPV31 | L1 | 9 | 221 | VPLDICNSI | 27385 |
| HPV31 | L1 | 10 | 334 | VVDTTRSTNM | 27386 |
| HPV31 | L1 | 8 | 62 | VVPKVSGL | 27387 |
| HPV31 | L1 | 10 | 62 | VVPKVSGLQY | 27388 |
| HPV31 | L1 | 8 | 21 | VVSTDEYV | 27389 |
| HPV31 | L1 | 8 | 391 | YIHSMNPA | 27390 |
| HPV31 | L1 | 9 | 391 | YIHSMNPAI | 27391 |
| HPV31 | L1 | 10 | 391 | YIHSMNPAIL | 27392 |
| HPV31 | L1 | 9 | 277 | YIKGSGSTA | 27393 |
| HPV31 | L1 | 11 | 277 | YIKGSGSTATL | 27394 |
| HPV31 | L1 | 9 | 235 | YLKMVAEPY | 27395 |
| HPV31 | L1 | 10 | 12 | YLPPVPVSKV | 27396 |
| HPV31 | L1 | 11 | 12 | YLPPVPVSKVV | 27397 |
| HPV31 | L1 | 8 | 364 | YLRHGEEF | 27398 |
| HPV31 | L1 | 10 | 364 | YLRHGEEFDL | 27399 |
| HPV31 | L1 | 8 | 250 | YLRREQMF | 27400 |
| HPV31 | L1 | 9 | 250 | YLRREQMFV | 27401 |
| HPV31 | L1 | 8 | 232 | YPDYLKMV | 27402 |
| HPV31 | L1 | 9 | 232 | YPDYLKMVA | 27403 |
| HPV31 | L1 | 8 | 445 | YVFWEVNL | 27404 |
| HPV31 | L1 | 8 | 27 | YVTRTNIY | 27405 |
| HPV31 | L1 | 9 | 27 | YVTRTNIYY | 27406 |
| HPV31 | L1 | 11 | 27 | YVTRTNIYYHA | 27407 |
| HPV31 | L2 | 8 | 143 | AILDVTSV | 27408 |
| HPV31 | L2 | 9 | 286 | ALTSRRNTV | 27409 |
| HPV31 | L2 | 11 | 286 | ALTSRRNTVRY | 27410 |
| HPV31 | L2 | 9 | 271 | APDPDFLDI | 27411 |
| HPV31 | L2 | 10 | 271 | APDPDFLDII | 27412 |
| HPV31 | L2 | 11 | 271 | APDPDFLDIIA | 27413 |
| HPV31 | L2 | 8 | 240 | APKQLITY | 27414 |
| HPV31 | L2 | 8 | 414 | APTQVFPF | 27415 |
| HPV31 | L2 | 10 | 414 | APTQVFPFPL | 27416 |
| HPV31 | L2 | 11 | 414 | APTQVFPFPLA | 27417 |
| HPV31 | L2 | 9 | 424 | APTTPQVSI | 27418 |
| HPV31 | L2 | 10 | 424 | APTTPQVSIF | 27419 |
| HPV31 | L2 | 11 | 424 | APTTPQVSIFV | 27420 |
| HPV31 | L2 | 8 | 376 | AVQSTSAV | 27421 |
| HPV31 | L2 | 10 | 376 | AVQSTSAVSA | 27422 |
| HPV31 | L2 | 11 | 376 | AVQSTSAVSAY | 27423 |
| HPV31 | L2 | 9 | 28 | CPSDVIPKI | 27424 |
| HPV31 | L2 | 11 | 133 | DIATTADTTPA | 27425 |
| HPV31 | L2 | 9 | 278 | DIIALHRPA | 27426 |
| HPV31 | L2 | 10 | 278 | DIIALHRPAL | 27427 |
| HPV31 | L2 | 10 | 400 | DIPIFSGPDV | 27428 |
| HPV31 | L2 | 8 | 322 | DISSINPA | 27429 |
| HPV31 | L2 | 8 | 354 | DIYADTDF | 27430 |
| HPV31 | L2 | 10 | 354 | DIYADTDFTV | 27431 |
| HPV31 | L2 | 8 | 273 | DPDFLDII | 27432 |
| HPV31 | L2 | 9 | 273 | DPDFLDIIA | 27433 |
| HPV31 | L2 | 10 | 273 | DPDFLDIIAL | 27434 |
| HPV31 | L2 | 8 | 102 | DPSIVSLV | 27435 |
| HPV31 | L2 | 11 | 160 | DPSVLQPPTPA | 27436 |
| HPV31 | L2 | 11 | 234 | DPTFLSAPKQL | 27437 |
| HPV31 | L2 | 10 | 96 | DPVGPLDPSI | 27438 |
| HPV31 | L2 | 11 | 96 | DPVGPLDPSIV | 27439 |
| HPV31 | L2 | 9 | 43 | DQILRYGSM | 27440 |
| HPV31 | L2 | 11 | 43 | DQILRYGSMGV | 27441 |
| HPV31 | L2 | 8 | 116 | DVGAPAPI | 27442 |
| HPV31 | L2 | 11 | 31 | DVIPKIEHTTI | 27443 |
| HPV31 | L2 | 11 | 408 | DVPIEHAPTQV | 27444 |
| HPV31 | L2 | 8 | 190 | EIPMDTFI | 27445 |
| HPV31 | L2 | 9 | 190 | EIPMDTFIV | 27446 |
| HPV31 | L2 | 9 | 334 | EMQPLGASA | 27447 |
| HPV31 | L2 | 10 | 196 | FIVSTNNENI | 27448 |
| HPV31 | L2 | 11 | 276 | FLDIIALHRPA | 27449 |
| HPV31 | L2 | 8 | 237 | FLSAPKQL | 27450 |
| HPV31 | L2 | 9 | 237 | FLSAPKQLI | 27451 |
| HPV31 | L2 | 11 | 237 | FLSAPKQLITY | 27452 |
| HPV31 | L2 | 10 | 421 | FPLAPTTPQV | 27453 |
| HPV31 | L2 | 8 | 433 | FVDGGDFY | 27454 |
| HPV31 | L2 | 9 | 433 | FVDGGDFYL | 27455 |
| HPV31 | L2 | 9 | 113 | GIVDVGAPA | 27456 |
| HPV31 | L2 | 11 | 113 | GIVDVGAPAPI | 27457 |
| HPV31 | L2 | 11 | 351 | GLYDIYADTDF | 27458 |
| HPV31 | L2 | 10 | 221 | GLYSKATQQV | 27459 |

TABLE XIV-continued

B62 Supermotif Peptides

| Type | Protein | No. of Amino Acid | Position | Sequence | Seq. Id. No. |
|---|---|---|---|---|---|
| HPV31 | L2 | 9 | 406 | GPDVPIEHA | 27460 |
| HPV31 | L2 | 8 | 99 | GPLDPSIV | 27461 |
| HPV31 | L2 | 10 | 99 | GPLDPSIVSL | 27462 |
| HPV31 | L2 | 11 | 99 | GPLDPSIVSLV | 27463 |
| HPV31 | L2 | 9 | 52 | GVFFGGLGI | 27464 |
| HPV31 | L2 | 8 | 213 | GVRRPARL | 27465 |
| HPV31 | L2 | 10 | 213 | GVRRPARLGL | 27466 |
| HPV31 | L2 | 11 | 213 | GVRRPARLGLY | 27467 |
| HPV31 | L2 | 9 | 175 | HLLLSSSSI | 27468 |
| HPV31 | L2 | 8 | 125 | HPPTTSGF | 27469 |
| HPV31 | L2 | 10 | 125 | HPPTTSGFDI | 27470 |
| HPV31 | L2 | 11 | 125 | HPPTTSGFDIA | 27471 |
| HPV31 | L2 | 8 | 279 | IIALHRPA | 27472 |
| HPV31 | L2 | 9 | 279 | IIALHRPAL | 27473 |
| HPV31 | L2 | 9 | 45 | ILRYGSMGV | 27474 |
| HPV31 | L2 | 10 | 45 | ILRYGSMGVF | 27475 |
| HPV31 | L2 | 11 | 45 | ILRYGSMGVFF | 27476 |
| HPV31 | L2 | 8 | 211 | IPGVRRPA | 27477 |
| HPV31 | L2 | 10 | 211 | IPGVRRPARL | 27478 |
| HPV31 | L2 | 10 | 123 | IPHPPTTSGF | 27479 |
| HPV31 | L2 | 9 | 401 | IPIFSGPDV | 27480 |
| HPV31 | L2 | 11 | 401 | IPIFSGPDVPI | 27481 |
| HPV31 | L2 | 9 | 87 | IPIRPPVSI | 27482 |
| HPV31 | L2 | 9 | 33 | IPKIEHTTI | 27483 |
| HPV31 | L2 | 10 | 33 | IPKIEHTTIA | 27484 |
| HPV31 | L2 | 8 | 191 | IPMDTFIV | 27485 |
| HPV31 | L2 | 8 | 114 | IVDVGAPA | 27486 |
| HPV31 | L2 | 10 | 114 | IVDVGAPAPI | 27487 |
| HPV31 | L2 | 10 | 105 | IVSLVEESGI | 27488 |
| HPV31 | L2 | 11 | 105 | IVSLVEESGIV | 27489 |
| HPV31 | L2 | 9 | 197 | IVSTNNENI | 27490 |
| HPV31 | L2 | 8 | 35 | KIEHTTIA | 27491 |
| HPV31 | L2 | 11 | 35 | KIEHTTIADQI | 27492 |
| HPV31 | L2 | 10 | 242 | KQLITYENPA | 27493 |
| HPV31 | L2 | 11 | 242 | KQLITYENPAY | 27494 |
| HPV31 | L2 | 10 | 302 | KQTLRTRSGA | 27495 |
| HPV31 | L2 | 8 | 231 | KVIDPTFL | 27496 |
| HPV31 | L2 | 10 | 231 | KVIDPTFLSA | 27497 |
| HPV31 | L2 | 8 | 244 | LITYENPA | 27498 |
| HPV31 | L2 | 9 | 244 | LITYENPAY | 27499 |
| HPV31 | L2 | 8 | 176 | LLLSSSSI | 27500 |
| HPV31 | L2 | 8 | 108 | LVEESGIV | 27501 |
| HPV31 | L2 | 10 | 108 | LVEESGIVDV | 27502 |
| HPV31 | L2 | 9 | 447 | MLKRRRKRV | 27503 |
| HPV31 | L2 | 11 | 447 | MLKRRRKRVSY | 27504 |
| HPV31 | L2 | 8 | 335 | MQPLGASA | 27505 |
| HPV31 | L2 | 8 | 269 | NIAPDPDF | 27506 |
| HPV31 | L2 | 9 | 269 | NIAPDPDFL | 27507 |
| HPV31 | L2 | 11 | 269 | NIAPDPDFLDI | 27508 |
| HPV31 | L2 | 8 | 204 | NITSSTPI | 27509 |
| HPV31 | L2 | 11 | 204 | NITSSTPIPGV | 27510 |
| HPV31 | L2 | 9 | 327 | NPAGESIEM | 27511 |
| HPV31 | L2 | 9 | 249 | NPAYETVNA | 27512 |
| HPV31 | L2 | 9 | 155 | NPTFTDPSV | 27513 |
| HPV31 | L2 | 10 | 155 | NPTFTDPSVL | 27514 |
| HPV31 | L2 | 8 | 370 | NVSPSTAV | 27515 |
| HPV31 | L2 | 9 | 410 | PIEHAPTQV | 27516 |
| HPV31 | L2 | 10 | 410 | PIEHAPTQVF | 27517 |
| HPV31 | L2 | 8 | 402 | PIFSGPDV | 27518 |
| HPV31 | L2 | 10 | 402 | PIFSGPDVPI | 27519 |
| HPV31 | L2 | 9 | 210 | PIPGVRRPA | 27520 |
| HPV31 | L2 | 11 | 210 | PIPGVRRPARL | 27521 |
| HPV31 | L2 | 11 | 122 | PIPHPPTTSGF | 27522 |
| HPV31 | L2 | 8 | 88 | PIRPPVSI | 27523 |
| HPV31 | L2 | 11 | 88 | PIRPPVSIDPV | 27524 |
| HPV31 | L2 | 9 | 422 | PLAPTTPQV | 27525 |
| HPV31 | L2 | 11 | 422 | PLAPTTPQVSI | 27526 |
| HPV31 | L2 | 9 | 100 | PLDPSIVSL | 27527 |
| HPV31 | L2 | 10 | 100 | PLDPSIVSLV | 27528 |
| HPV31 | L2 | 8 | 394 | PLSTGFDI | 27529 |
| HPV31 | L2 | 10 | 394 | PLSTGFDIPI | 27530 |
| HPV31 | L2 | 11 | 394 | PLSTGFDIPIF | 27531 |
| HPV31 | L2 | 9 | 74 | PLSTRPSTV | 27532 |
| HPV31 | L2 | 11 | 166 | PPTPAETSGHL | 27533 |
| HPV31 | L2 | 9 | 126 | PPTTSGFDI | 27534 |

TABLE XIV-continued

B62 Supermotif Peptides

| Type | Protein | No. of Amino Acid | Position | Sequence | Seq. Id. No. |
|---|---|---|---|---|---|
| HPV31 | L2 | 10 | 126 | PPTTSGFDIA | 27535 |
| HPV31 | L2 | 8 | 91 | PPVSIDPV | 27536 |
| HPV31 | L2 | 11 | 91 | PPVSIDPVGPL | 27537 |
| HPV31 | L2 | 9 | 97 | PVGPLDPSI | 27538 |
| HPV31 | L2 | 10 | 97 | PVGPLDPSIV | 27539 |
| HPV31 | L2 | 10 | 92 | PVSIDPVGPL | 27540 |
| HPV31 | L2 | 8 | 44 | QILRYGSM | 27541 |
| HPV31 | L2 | 10 | 44 | QILRYGSMGV | 27542 |
| HPV31 | L2 | 11 | 44 | QILRYGSMGVF | 27543 |
| HPV31 | L2 | 9 | 243 | QLITYENPA | 27544 |
| HPV31 | L2 | 10 | 243 | QLITYENPAY | 27545 |
| HPV31 | L2 | 8 | 17 | QLYQTCKA | 27546 |
| HPV31 | L2 | 9 | 17 | QLYQTCKAA | 27547 |
| HPV31 | L2 | 10 | 228 | QQVKVIDPTF | 27548 |
| HPV31 | L2 | 11 | 228 | QQVKVIDPTFL | 27549 |
| HPV31 | L2 | 8 | 417 | QVFPFPLA | 27550 |
| HPV31 | L2 | 9 | 229 | QVKVIDPTF | 27551 |
| HPV31 | L2 | 10 | 229 | QVKVIDPTFL | 27552 |
| HPV31 | L2 | 11 | 429 | QVSIFVDGGDF | 27553 |
| HPV31 | L2 | 8 | 219 | RLGLYSKA | 27554 |
| HPV31 | L2 | 8 | 298 | RLGNKQTL | 27555 |
| HPV31 | L2 | 11 | 284 | RPALTSRRNTV | 27556 |
| HPV31 | L2 | 8 | 216 | RPARLGLY | 27557 |
| HPV31 | L2 | 11 | 216 | RPARLGLYSKA | 27558 |
| HPV31 | L2 | 9 | 90 | RPPVSIDPV | 27559 |
| HPV31 | L2 | 8 | 78 | RPSTVSEA | 27560 |
| HPV31 | L2 | 10 | 78 | RPSTVSEASI | 27561 |
| HPV31 | L2 | 8 | 316 | RVHYYYDI | 27562 |
| HPV31 | L2 | 11 | 316 | RVHYYYDISSI | 27563 |
| HPV31 | L2 | 9 | 454 | RVSYFFTDV | 27564 |
| HPV31 | L2 | 11 | 454 | RVSYFFTDVSV | 27565 |
| HPV31 | L2 | 8 | 94 | SIDPVGPL | 27566 |
| HPV31 | L2 | 9 | 332 | SIEMQPLGA | 27567 |
| HPV31 | L2 | 11 | 332 | SIEMQPLGASA | 27568 |
| HPV31 | L2 | 9 | 431 | SIFVDGGDF | 27569 |
| HPV31 | L2 | 10 | 431 | SIFVDGGDFY | 27570 |
| HPV31 | L2 | 11 | 431 | SIFVDGGDFYL | 27571 |
| HPV31 | L2 | 9 | 325 | SINPAGESI | 27572 |
| HPV31 | L2 | 11 | 325 | SINPAGESIEM | 27573 |
| HPV31 | L2 | 8 | 86 | SIPIRPPV | 27574 |
| HPV31 | L2 | 10 | 86 | SIPIRPPVSI | 27575 |
| HPV31 | L2 | 10 | 182 | SISTHNYEEI | 27576 |
| HPV31 | L2 | 11 | 104 | SIVSLVEESGI | 27577 |
| HPV31 | L2 | 8 | 107 | SLVEESGI | 27578 |
| HPV31 | L2 | 9 | 107 | SLVEESGIV | 27579 |
| HPV31 | L2 | 11 | 107 | SLVEESGIVDV | 27580 |
| HPV31 | L2 | 11 | 260 | SLYFSNTSHNI | 27581 |
| HPV31 | L2 | 9 | 50 | SMGVFFGGL | 27582 |
| HPV31 | L2 | 11 | 50 | SMGVFFGGLGI | 27583 |
| HPV31 | L2 | 11 | 372 | SPSTAVQSTSA | 27584 |
| HPV31 | L2 | 9 | 162 | SVLQPPTPA | 27585 |
| HPV31 | L2 | 10 | 149 | SVSTHENPTF | 27586 |
| HPV31 | L2 | 9 | 40 | TIADQILRY | 27587 |
| HPV31 | L2 | 8 | 312 | TIGARVHY | 27588 |
| HPV31 | L2 | 9 | 312 | TIGARVHYY | 27589 |
| HPV31 | L2 | 10 | 312 | TIGARVHYYY | 27590 |
| HPV31 | L2 | 9 | 347 | TLNDGLYDI | 27591 |
| HPV31 | L2 | 10 | 347 | TLNDGLYDIY | 27592 |
| HPV31 | L2 | 11 | 347 | TLNDGLYDIYA | 27593 |
| HPV31 | L2 | 8 | 304 | TLRTRSGA | 27594 |
| HPV31 | L2 | 10 | 304 | TLRTRSGATI | 27595 |
| HPV31 | L2 | 9 | 168 | TPAETSGHL | 27596 |
| HPV31 | L2 | 10 | 168 | TPAETSGHLL | 27597 |
| HPV31 | L2 | 11 | 168 | TPAETSGHLLL | 27598 |
| HPV31 | L2 | 10 | 141 | TPAILDVTSV | 27599 |
| HPV31 | L2 | 10 | 209 | TPIPGVRRPA | 27600 |
| HPV31 | L2 | 8 | 427 | TPQVSIFV | 27601 |
| HPV31 | L2 | 9 | 16 | TQLYQTCKA | 27602 |
| HPV31 | L2 | 10 | 16 | TQLYQTCKAA | 27603 |
| HPV31 | L2 | 11 | 227 | TQQVKVIDPTF | 27604 |
| HPV31 | L2 | 8 | 416 | TQVFPFPL | 27605 |
| HPV31 | L2 | 9 | 416 | TQVFPFPLA | 27606 |
| HPV31 | L2 | 10 | 362 | TVDTPATHNV | 27607 |
| HPV31 | L2 | 8 | 254 | TVNAEESL | 27608 |
| HPV31 | L2 | 9 | 254 | TVNAEESLY | 27609 |

TABLE XIV-continued

B62 Supermotif Peptides

| Type | Protein | No. of Amino Acid | Position | Sequence | Seq. Id. No. |
|---|---|---|---|---|---|
| HPV31 | L2 | 10 | 254 | TVNAEESLYF | 27610 |
| HPV31 | L2 | 8 | 392 | TVPLSTGF | 27611 |
| HPV31 | L2 | 10 | 392 | TVPLSTGFDI | 27612 |
| HPV31 | L2 | 9 | 81 | TVSEASIPI | 27613 |
| HPV31 | L2 | 9 | 232 | VIDPTFLSA | 27614 |
| HPV31 | L2 | 10 | 32 | VIPKIEHTTI | 27615 |
| HPV31 | L2 | 11 | 32 | VIPKIEHTTIA | 27616 |
| HPV31 | L2 | 8 | 163 | VLQPPTPA | 27617 |
| HPV31 | L2 | 10 | 409 | VPIEHAPTQV | 27618 |
| HPV31 | L2 | 11 | 409 | VPIEHAPTQVF | 27619 |
| HPV31 | L2 | 9 | 393 | VPLSTGFDI | 27620 |
| HPV31 | L2 | 11 | 393 | VPLSTGFDIPI | 27621 |
| HPV31 | L2 | 10 | 73 | VPLSTRPSTV | 27622 |
| HPV31 | L2 | 9 | 387 | VPTNTTVPL | 27623 |
| HPV31 | L2 | 9 | 377 | VQSTSAVSA | 27624 |
| HPV31 | L2 | 10 | 377 | VQSTSAVSAY | 27625 |
| HPV31 | L2 | 11 | 377 | VQSTSAVSAYV | 27626 |
| HPV31 | L2 | 8 | 440 | YLHPSYYM | 27627 |
| HPV31 | L2 | 9 | 440 | YLHPSYYML | 27628 |
| HPV31 | L2 | 10 | 446 | YMLKRRRKRV | 27629 |
| HPV31 | L2 | 11 | 72 | YVPLSTRPSTV | 27630 |
| HPV31 | L2 | 8 | 386 | YVPTNTTV | 27631 |
| HPV31 | L2 | 10 | 386 | YVPTNTTVPL | 27632 |
| HPV33 | E1 | 10 | 596 | AINDENWKSF | 27633 |
| HPV33 | E1 | 11 | 596 | AINDENWKSFF | 27634 |
| HPV33 | E1 | 9 | 532 | ALDGNEISI | 27635 |
| HPV33 | E1 | 11 | 532 | ALDGNEISIDV | 27636 |
| HPV33 | E1 | 8 | 84 | ALKRKFAA | 27637 |
| HPV33 | E1 | 10 | 546 | ALVQLKCPPL | 27638 |
| HPV33 | E1 | 11 | 546 | ALVQLKCPPLL | 27639 |
| HPV33 | E1 | 8 | 311 | ALYWFRTA | 27640 |
| HPV33 | E1 | 9 | 311 | ALYWFRTAM | 27641 |
| HPV33 | E1 | 8 | 318 | AMSNISDV | 27642 |
| HPV33 | E1 | 10 | 373 | AQLADSNSNA | 27643 |
| HPV33 | E1 | 11 | 373 | AQLADSNSNAA | 27644 |
| HPV33 | E1 | 9 | 81 | AVCALKRKF | 27645 |
| HPV33 | E1 | 10 | 81 | AVCALKRKFA | 27646 |
| HPV33 | E1 | 11 | 81 | AVCALKRKFAA | 27647 |
| HPV33 | E1 | 11 | 22 | AVIERRTGDNI | 27648 |
| HPV33 | E1 | 11 | 230 | CITGYGISPSV | 27649 |
| HPV33 | E1 | 8 | 259 | CLTCDRGI | 27650 |
| HPV33 | E1 | 9 | 259 | CLTCDRGII | 27651 |
| HPV33 | E1 | 10 | 259 | CLTCDRGIII | 27652 |
| HPV33 | E1 | 11 | 259 | CLTCDRGIIIL | 27653 |
| HPV33 | E1 | 8 | 465 | CMLICGPA | 27654 |
| HPV33 | E1 | 9 | 297 | CMVIEPPKL | 27655 |
| HPV33 | E1 | 8 | 494 | CVNSKSHF | 27656 |
| HPV33 | E1 | 9 | 494 | CVNSKSHFW | 27657 |
| HPV33 | E1 | 10 | 494 | CVNSKSHFWL | 27658 |
| HPV33 | E1 | 9 | 367 | DIAYYYAQL | 27659 |
| HPV33 | E1 | 10 | 367 | DIAYYYAQLA | 27660 |
| HPV33 | E1 | 10 | 46 | DLLEFIDDSM | 27661 |
| HPV33 | E1 | 8 | 78 | DLNAVCAL | 27662 |
| HPV33 | E1 | 8 | 349 | DLSEMVQW | 27663 |
| HPV33 | E1 | 9 | 349 | DLSEMVQWA | 27664 |
| HPV33 | E1 | 10 | 349 | DLSEMVQWAY | 27665 |
| HPV33 | E1 | 8 | 3 | DPEGTNGA | 27666 |
| HPV33 | E1 | 10 | 3 | DPEGTNGAGM | 27667 |
| HPV33 | E1 | 8 | 541 | DVKHRALV | 27668 |
| HPV33 | E1 | 10 | 541 | DVKHRALVQL | 27669 |
| HPV33 | E1 | 9 | 324 | DVQGTTPEW | 27670 |
| HPV33 | E1 | 10 | 324 | DVQGTTPEWI | 27671 |
| HPV33 | E1 | 9 | 516 | DVTPISWTY | 27672 |
| HPV33 | E1 | 10 | 516 | DVTPISWTYI | 27673 |
| HPV33 | E1 | 10 | 537 | EISIDVKHRA | 27674 |
| HPV33 | E1 | 11 | 537 | EISIDVKHRAL | 27675 |
| HPV33 | E1 | 8 | 361 | ELTDDSDI | 27676 |
| HPV33 | E1 | 9 | 361 | ELTDDSDIA | 27677 |
| HPV33 | E1 | 10 | 361 | ELTDDSDIAY | 27678 |
| HPV33 | E1 | 11 | 361 | ELTDDSDIAYY | 27679 |
| HPV33 | E1 | 11 | 352 | EMVQWAYDNEL | 27680 |
| HPV33 | E1 | 11 | 301 | EPPKLRSQTCA | 27681 |
| HPV33 | E1 | 8 | 137 | EVETQQMV | 27682 |
| HPV33 | E1 | 11 | 137 | EVETQQMVQQV | 27683 |
| HPV33 | E1 | 8 | 169 | EVSCETNV | 27684 |

TABLE XIV-continued

B62 Supermotif Peptides

| Type | Protein | No. of Amino Acid | Position | Sequence | Seq. Id. No. |
|---|---|---|---|---|---|
| HPV33 | E1 | 10 | 50 | FIDDSMENSI | 27685 |
| HPV33 | E1 | 8 | 449 | FLGAFKKF | 27686 |
| HPV33 | E1 | 9 | 449 | FLGAFKKFL | 27687 |
| HPV33 | E1 | 10 | 486 | FLKGCVISCV | 27688 |
| HPV33 | E1 | 11 | 456 | FLKGIPKKSCM | 27689 |
| HPV33 | E1 | 8 | 385 | FLKSNSQA | 27690 |
| HPV33 | E1 | 10 | 385 | FLKSNSQAKI | 27691 |
| HPV33 | E1 | 11 | 385 | FLKSNSQAKIV | 27692 |
| HPV33 | E1 | 8 | 212 | FMELVRPF | 27693 |
| HPV33 | E1 | 10 | 585 | FPFDENGNPV | 27694 |
| HPV33 | E1 | 11 | 585 | FPFDENGNPVY | 27695 |
| HPV33 | E1 | 8 | 265 | GIIILLLI | 27696 |
| HPV33 | E1 | 10 | 265 | GIIILLLIRF | 27697 |
| HPV33 | E1 | 10 | 399 | GIMCRHYKKA | 27698 |
| HPV33 | E1 | 8 | 459 | GIPKKSCM | 27699 |
| HPV33 | E1 | 9 | 459 | GIPKKSCML | 27700 |
| HPV33 | E1 | 10 | 459 | GIPKKSCMLI | 27701 |
| HPV33 | E1 | 8 | 209 | GISFMELV | 27702 |
| HPV33 | E1 | 11 | 209 | GISFMELVRPF | 27703 |
| HPV33 | E1 | 10 | 235 | GISPSVAESL | 27704 |
| HPV33 | E1 | 8 | 11 | GMGCTGWF | 27705 |
| HPV33 | E1 | 10 | 11 | GMGCTGWFEV | 27706 |
| HPV33 | E1 | 9 | 512 | GMIDDVTPI | 27707 |
| HPV33 | E1 | 11 | 512 | GMIDDVTPISW | 27708 |
| HPV33 | E1 | 8 | 480 | GMSLIQFL | 27709 |
| HPV33 | E1 | 9 | 470 | GPANTGKSY | 27710 |
| HPV33 | E1 | 10 | 470 | GPANTGKSYF | 27711 |
| HPV33 | E1 | 8 | 163 | GVGDDSEV | 27712 |
| HPV33 | E1 | 11 | 256 | HLQCLTCDRGI | 27713 |
| HPV33 | E1 | 9 | 266 | IIILLLIRF | 27714 |
| HPV33 | E1 | 8 | 267 | IILLLIRF | 27715 |
| HPV33 | E1 | 8 | 200 | ILYKFKEA | 27716 |
| HPV33 | E1 | 9 | 200 | ILYKFKEAY | 27717 |
| HPV33 | E1 | 11 | 200 | ILYKFKEAYGI | 27718 |
| HPV33 | E1 | 9 | 400 | IMCRHYKKA | 27719 |
| HPV33 | E1 | 8 | 293 | IPETCMVI | 27720 |
| HPV33 | E1 | 8 | 460 | IPKKSCML | 27721 |
| HPV33 | E1 | 9 | 460 | IPKKSCMLI | 27722 |
| HPV33 | E1 | 8 | 59 | IQADTEAA | 27723 |
| HPV33 | E1 | 10 | 59 | IQADTEAARA | 27724 |
| HPV33 | E1 | 11 | 59 | IQADTEAARAL | 27725 |
| HPV33 | E1 | 8 | 72 | IQEDEDDL | 27726 |
| HPV33 | E1 | 10 | 72 | IQEGEDDLNA | 27727 |
| HPV33 | E1 | 11 | 72 | IQEGEDDLNAV | 27728 |
| HPV33 | E1 | 8 | 484 | IQFLKGCV | 27729 |
| HPV33 | E1 | 9 | 484 | IQFLKGCVI | 27730 |
| HPV33 | E1 | 8 | 394 | IVKDCGIM | 27731 |
| HPV33 | E1 | 10 | 435 | IVQLLRYQNI | 27732 |
| HPV33 | E1 | 10 | 124 | KIDELEDSGY | 27733 |
| HPV33 | E1 | 8 | 510 | KIGMIDDV | 27734 |
| HPV33 | E1 | 11 | 510 | KIGMIDDVTPI | 27735 |
| HPV33 | E1 | 8 | 393 | KIVKDCGI | 27736 |
| HPV33 | E1 | 9 | 393 | KIVKDCGIM | 27737 |
| HPV33 | E1 | 9 | 285 | KLMSNLLSI | 27738 |
| HPV33 | E1 | 8 | 304 | KLRSQTCA | 27739 |
| HPV33 | E1 | 9 | 304 | KLRSQTCAL | 27740 |
| HPV33 | E1 | 10 | 304 | KLRSQTCALY | 27741 |
| HPV33 | E1 | 11 | 304 | KLRSQTCALYW | 27742 |
| HPV33 | E1 | 8 | 412 | KMSIGQWI | 27743 |
| HPV33 | E1 | 9 | 249 | KQHSLYTHL | 27744 |
| HPV33 | E1 | 9 | 245 | KVLIKQHSL | 27745 |
| HPV33 | E1 | 10 | 245 | KVLIKQHSLY | 27746 |
| HPV33 | E1 | 8 | 247 | LIKQHSLY | 27747 |
| HPV33 | E1 | 11 | 247 | LIKQHSLYTHL | 27748 |
| HPV33 | E1 | 9 | 483 | LIQFLKGCV | 27749 |
| HPV33 | E1 | 10 | 483 | LIQFLKGCVI | 27750 |
| HPV33 | E1 | 11 | 271 | LIRFRCSKNRL | 27751 |
| HPV33 | E1 | 9 | 47 | LLEFIDDSM | 27752 |
| HPV33 | E1 | 9 | 555 | LLLTSNTNA | 27753 |
| HPV33 | E1 | 9 | 438 | LLRYQNIEF | 27754 |
| HPV33 | E1 | 11 | 438 | LLRYQNIEFTA | 27755 |
| HPV33 | E1 | 9 | 290 | LLSIPETCM | 27756 |
| HPV33 | E1 | 10 | 290 | LLSIPETCMV | 27757 |
| HPV33 | E1 | 11 | 290 | LLSIPETCMVI | 27758 |
| HPV33 | E1 | 8 | 556 | LLTSNTNA | 27759 |

TABLE XIV-continued

B62 Supermotif Peptides

| Type | Protein | No. of Amino Acid | Position | Sequence | Seq. Id. No. |
|---|---|---|---|---|---|
| HPV33 | E1 | 8 | 286 | LMSNLLSI | 27760 |
| HPV33 | E1 | 10 | 257 | LQCLTCDRGI | 27761 |
| HPV33 | E1 | 11 | 257 | LQCLTCDRGII | 27762 |
| HPV33 | E1 | 8 | 184 | LQEISNVL | 27763 |
| HPV33 | E1 | 9 | 339 | LQHSFNDNI | 27764 |
| HPV33 | E1 | 10 | 339 | LQHSFNDNIF | 27765 |
| HPV33 | E1 | 9 | 503 | LQPLSDAKI | 27766 |
| HPV33 | E1 | 11 | 503 | LQPLSDAKIGM | 27767 |
| HPV33 | E1 | 9 | 547 | LVQLKCPPL | 27768 |
| HPV33 | E1 | 10 | 547 | LVQLKCPPLL | 27769 |
| HPV33 | E1 | 11 | 547 | LVQLKCPPLLL | 27770 |
| HPV33 | E1 | 8 | 513 | MIDDVTPI | 27771 |
| HPV33 | E1 | 10 | 513 | MIDDVTPISW | 27772 |
| HPV33 | E1 | 8 | 298 | MVIEPPKL | 27773 |
| HPV33 | E1 | 10 | 353 | MVQWAYDNEL | 27774 |
| HPV33 | E1 | 8 | 443 | NIEFTAFL | 27775 |
| HPV33 | E1 | 10 | 443 | NIEFTAFLGA | 27776 |
| HPV33 | E1 | 11 | 443 | NIEFTAFLGAF | 27777 |
| HPV33 | E1 | 8 | 346 | NIFDLSEM | 27778 |
| HPV33 | E1 | 9 | 346 | NIFDLSEMV | 27779 |
| HPV33 | E1 | 11 | 346 | NIFDLSEMVQW | 27780 |
| HPV33 | E1 | 9 | 199 | NILYKFKEA | 27781 |
| HPV33 | E1 | 10 | 199 | NILYKFKEAY | 27782 |
| HPV33 | E1 | 9 | 71 | NIQEGEDDL | 27783 |
| HPV33 | E1 | 11 | 71 | NIQEGEDDLNA | 27784 |
| HPV33 | E1 | 10 | 31 | NISEDEDETA | 27785 |
| HPV33 | E1 | 9 | 627 | NISTFKCSA | 27786 |
| HPV33 | E1 | 10 | 289 | NLLSIPETCM | 27787 |
| HPV33 | E1 | 11 | 289 | NLLSIPETCMV | 27788 |
| HPV33 | E1 | 10 | 155 | NLNDLESSGV | 27789 |
| HPV33 | E1 | 11 | 592 | NPVYAINDENW | 27790 |
| HPV33 | E1 | 8 | 175 | NVDSCENV | 27791 |
| HPV33 | E1 | 10 | 175 | NVDSCENVTL | 27792 |
| HPV33 | E1 | 10 | 189 | NVLHSSNTKA | 27793 |
| HPV33 | E1 | 10 | 181 | NVTLQEISNV | 27794 |
| HPV33 | E1 | 11 | 181 | NVTLQEISNVL | 27795 |
| HPV33 | E1 | 10 | 519 | PISWTYIDDY | 27796 |
| HPV33 | E1 | 11 | 519 | PISWTYIDDYM | 27797 |
| HPV33 | E1 | 8 | 434 | PIVQLLRY | 27798 |
| HPV33 | E1 | 11 | 434 | PIVQLLRYQNI | 27799 |
| HPV33 | E1 | 10 | 554 | PLLLTSNTNA | 27800 |
| HPV33 | E1 | 9 | 505 | PLSDAKIGM | 27801 |
| HPV33 | E1 | 10 | 505 | PLSDAKIGMI | 27802 |
| HPV33 | E1 | 10 | 302 | PPKLRSQTCA | 27803 |
| HPV33 | E1 | 11 | 302 | PPKLRSQTCAL | 27804 |
| HPV33 | E1 | 11 | 553 | PPLLLTSNTNA | 27805 |
| HPV33 | E1 | 10 | 593 | PVYAINDENW | 27806 |
| HPV33 | E1 | 9 | 374 | QLADSNSNA | 27807 |
| HPV33 | E1 | 10 | 374 | QLADSNSNAA | 27808 |
| HPV33 | E1 | 11 | 374 | QLADSNSNAAA | 27809 |
| HPV33 | E1 | 8 | 549 | QLKCPPLL | 27810 |
| HPV33 | E1 | 9 | 549 | QLKCPPLLL | 27811 |
| HPV33 | E1 | 8 | 437 | QLLRYQNI | 27812 |
| HPV33 | E1 | 10 | 437 | QLLRYQNIEF | 27813 |
| HPV33 | E1 | 8 | 504 | QPLSDAKI | 27814 |
| HPV33 | E1 | 10 | 504 | QPLSDAKIGM | 27815 |
| HPV33 | E1 | 11 | 504 | QPLSDAKIGMI | 27816 |
| HPV33 | E1 | 11 | 146 | QVESQNGDTNL | 27817 |
| HPV33 | E1 | 8 | 280 | RLTVAKLM | 27818 |
| HPV33 | E1 | 11 | 280 | RLTVAKLMSNL | 27819 |
| HPV33 | E1 | 11 | 575 | RLTVFEFKNPF | 27820 |
| HPV33 | E1 | 9 | 335 | RLTVLQHSF | 27821 |
| HPV33 | E1 | 9 | 433 | RPIVQLLRY | 27822 |
| HPV33 | E1 | 8 | 539 | SIDVKHRA | 27823 |
| HPV33 | E1 | 9 | 539 | SIDVKHRAL | 27824 |
| HPV33 | E1 | 10 | 539 | SIDVKHRALV | 27825 |
| HPV33 | E1 | 10 | 111 | SINKNKECTY | 27826 |
| HPV33 | E1 | 8 | 292 | SIPETCMV | 27827 |
| HPV33 | E1 | 9 | 292 | SIPETCMVI | 27828 |
| HPV33 | E1 | 8 | 58 | SIQADTEA | 27829 |
| HPV33 | E1 | 9 | 58 | SIQADTEAA | 27830 |
| HPV33 | E1 | 11 | 58 | SIQADTEAARA | 27831 |
| HPV33 | E1 | 10 | 482 | SLIQFLKGCV | 27832 |
| HPV33 | E1 | 11 | 482 | SLIQFLKGCVI | 27833 |
| HPV33 | E1 | 11 | 243 | SLKVLIKQHSL | 27834 |

TABLE XIV-continued

B62 Supermotif Peptides

| Type | Protein | No. of Amino Acid | Position | Sequence | Seq. Id. No. |
|---|---|---|---|---|---|
| HPV33 | E1 | 9 | 252 | SLYTHLQCL | 27835 |
| HPV33 | E1 | 8 | 54 | SMENSIQA | 27836 |
| HPV33 | E1 | 8 | 237 | SPSVAESL | 27837 |
| HPV33 | E1 | 10 | 237 | SPSVAESLKV | 27838 |
| HPV33 | E1 | 11 | 237 | SPSVAESLKVL | 27839 |
| HPV33 | E1 | 11 | 390 | SQAKIVKDCGI | 27840 |
| HPV33 | E1 | 8 | 149 | SQNGDTNL | 27841 |
| HPV33 | E1 | 11 | 149 | SQNGDTNLNDL | 27842 |
| HPV33 | E1 | 8 | 93 | SQSAAEDV | 27843 |
| HPV33 | E1 | 9 | 93 | SQSAAEDVV | 27844 |
| HPV33 | E1 | 8 | 307 | SQTCALYW | 27845 |
| HPV33 | E1 | 9 | 307 | SQTCALYWF | 27846 |
| HPV33 | E1 | 8 | 239 | SVAESLKV | 27847 |
| HPV33 | E1 | 9 | 239 | SVAESLKVL | 27848 |
| HPV33 | E1 | 10 | 239 | SVAESLKVLI | 27849 |
| HPV33 | E1 | 8 | 183 | TLQEISNV | 27850 |
| HPV33 | E1 | 9 | 183 | TLQEISNVL | 27851 |
| HPV33 | E1 | 8 | 329 | TPEWIDRL | 27852 |
| HPV33 | E1 | 10 | 329 | TPEWIDRLTV | 27853 |
| HPV33 | E1 | 11 | 329 | TPEWIDRLTVL | 27854 |
| HPV33 | E1 | 8 | 518 | TPISWTYI | 27855 |
| HPV33 | E1 | 11 | 518 | TPISWTYIDDY | 27856 |
| HPV33 | E1 | 8 | 140 | TQQMVQQV | 27857 |
| HPV33 | E1 | 9 | 282 | TVAKLMSNL | 27858 |
| HPV33 | E1 | 10 | 282 | TVAKLMSNLL | 27859 |
| HPV33 | E1 | 9 | 577 | TVFEFKNPF | 27860 |
| HPV33 | E1 | 11 | 577 | TVFEFKNPFPF | 27861 |
| HPV33 | E1 | 11 | 337 | TVLQHSFNDNI | 27862 |
| HPV33 | E1 | 10 | 23 | VIERRTGDNI | 27863 |
| HPV33 | E1 | 11 | 491 | VISCVNSKSHF | 27864 |
| HPV33 | E1 | 9 | 190 | VLHSSNTKA | 27865 |
| HPV33 | E1 | 11 | 190 | VLHSSNTKANI | 27866 |
| HPV33 | E1 | 8 | 246 | VLIKQHSL | 27867 |
| HPV33 | E1 | 9 | 246 | VLIKQHSLY | 27868 |
| HPV33 | E1 | 10 | 338 | VLQHSFNDNI | 27869 |
| HPV33 | E1 | 11 | 338 | VLQHSFNDNIF | 27870 |
| HPV33 | E1 | 8 | 325 | VQGTTPEW | 27871 |
| HPV33 | E1 | 9 | 325 | VQGTTPEWI | 27872 |
| HPV33 | E1 | 8 | 548 | VQLKCPPL | 27873 |
| HPV33 | E1 | 9 | 548 | VQLKCPPLL | 27874 |
| HPV33 | E1 | 10 | 548 | VQLKCPPLLL | 27875 |
| HPV33 | E1 | 9 | 436 | VQLLRYQNI | 27876 |
| HPV33 | E1 | 11 | 436 | VQLLRYQNIEF | 27877 |
| HPV33 | E1 | 9 | 354 | VQWAYDNEL | 27878 |
| HPV33 | E1 | 8 | 332 | WIDRLTVL | 27879 |
| HPV33 | E1 | 8 | 502 | WLQPLSDA | 27880 |
| HPV33 | E1 | 10 | 502 | WLQPLSDAKI | 27881 |
| HPV33 | E1 | 8 | 569 | WPYLHSRL | 27882 |
| HPV33 | E1 | 10 | 569 | WPYLHSRLTV | 27883 |
| HPV33 | E1 | 11 | 569 | WPYLHSRLTVF | 27884 |
| HPV33 | E1 | 9 | 524 | YIDDYMRNA | 27885 |
| HPV33 | E1 | 10 | 524 | YIDDYMRNAL | 27886 |
| HPV33 | E1 | 8 | 571 | YLHSRLTV | 27887 |
| HPV33 | E1 | 9 | 571 | YLHSRLTVF | 27888 |
| HPV33 | E1 | 11 | 571 | YLHSRLTVFEF | 27889 |
| HPV33 | E1 | 11 | 528 | YMRNALDGNEI | 27890 |
| HPV33 | E1 | 8 | 441 | YQNIEFTA | 27891 |
| HPV33 | E1 | 9 | 441 | YQNIEFTAF | 27892 |
| HPV33 | E1 | 10 | 441 | YQNIEFTAFL | 27893 |
| HPV33 | E2 | 10 | 249 | ALDNRTARTA | 27894 |
| HPV33 | E2 | 10 | 78 | ALETLSKSQY | 27895 |
| HPV33 | E2 | 9 | 41 | ALLYTAKQM | 27896 |
| HPV33 | E2 | 11 | 41 | ALLYTAKQMGF | 27897 |
| HPV33 | E2 | 8 | 237 | AQPLTKLF | 27898 |
| HPV33 | E2 | 10 | 237 | AQPLTKLFCA | 27899 |
| HPV33 | E2 | 9 | 10 | AVQEKILDL | 27900 |
| HPV33 | E2 | 10 | 10 | AVQEKILDLY | 27901 |
| HPV33 | E2 | 9 | 288 | CLRYRLKPY | 27902 |
| HPV33 | E2 | 10 | 195 | CPTSISSNQI | 27903 |
| HPV33 | E2 | 9 | 25 | DLPSQIEHW | 27904 |
| HPV33 | E2 | 11 | 25 | DLPSQIEHWKL | 27905 |
| HPV33 | E2 | 10 | 17 | DLYEADKTDL | 27906 |
| HPV33 | E2 | 9 | 247 | DPALDNRTA | 27907 |
| HPV33 | E2 | 8 | 3 | EISARLNA | 27908 |
| HPV33 | E2 | 9 | 3 | EISARLNAV | 27909 |

TABLE XIV-continued

B62 Supermotif Peptides

| Type | Protein | No. of Amino Acid | Position | Sequence | Seq. Id. No. |
|---|---|---|---|---|---|
| HPV33 | E2 | 9 | 74 | ELQMALETL | 27910 |
| HPV33 | E2 | 10 | 298 | ELYSSMSSTW | 27911 |
| HPV33 | E2 | 8 | 328 | EQQQQMFL | 27912 |
| HPV33 | E2 | 11 | 328 | EQQQQMFLGTV | 27913 |
| HPV33 | E2 | 8 | 185 | EVHVGGQV | 27914 |
| HPV33 | E2 | 9 | 185 | EVHVGGQVI | 27915 |
| HPV33 | E2 | 10 | 185 | EVHVGGQVIV | 27916 |
| HPV33 | E2 | 11 | 100 | EVWLCEPPKCF | 27917 |
| HPV33 | E2 | 11 | 334 | FLGTVKIPPTV | 27918 |
| HPV33 | E2 | 8 | 70 | FQVIELQM | 27919 |
| HPV33 | E2 | 9 | 70 | FQVIELQMA | 27920 |
| HPV33 | E2 | 10 | 70 | FQVIELQMAL | 27921 |
| HPV33 | E2 | 9 | 325 | FVTEQQQM | 27922 |
| HPV33 | E2 | 10 | 325 | FVTEQQQQMF | 27923 |
| HPV33 | E2 | 11 | 325 | FVTEQQQQMFL | 27924 |
| HPV33 | E2 | 8 | 319 | GIVTVTFV | 27925 |
| HPV33 | E2 | 11 | 156 | GMYYIHNCEKV | 27926 |
| HPV33 | E2 | 10 | 190 | GQVIVCPTSI | 27927 |
| HPV33 | E2 | 10 | 53 | HLCHQVVPSL | 27928 |
| HPV33 | E2 | 11 | 53 | HLCHQVVPSLL | 27929 |
| HPV33 | E2 | 9 | 278 | HLKGESNSL | 27930 |
| HPV33 | E2 | 8 | 56 | HQVVPSLL | 27931 |
| HPV33 | E2 | 9 | 56 | HQVVPSLLA | 27932 |
| HPV33 | E2 | 8 | 187 | HVGGQVIV | 27933 |
| HPV33 | E2 | 9 | 139 | IIEEDTCTM | 27934 |
| HPV33 | E2 | 10 | 139 | IIEEDTCTMV | 27935 |
| HPV33 | E2 | 11 | 340 | IPPTVQISTGF | 27936 |
| HPV33 | E2 | 11 | 276 | IVHLKGESNSL | 27937 |
| HPV33 | E2 | 8 | 14 | KILDLYEA | 27938 |
| HPV33 | E2 | 8 | 339 | KIPPTVQI | 27939 |
| HPV33 | E2 | 8 | 242 | KLFCADPA | 27940 |
| HPV33 | E2 | 9 | 242 | KLFCADPAL | 27941 |
| HPV33 | E2 | 8 | 34 | KLIRMECA | 27942 |
| HPV33 | E2 | 9 | 34 | KLIRMECAL | 27943 |
| HPV33 | E2 | 10 | 34 | KLIRMECALL | 27944 |
| HPV33 | E2 | 11 | 34 | KLIRMECALLY | 27945 |
| HPV33 | E2 | 10 | 294 | KPYKELYSSM | 27946 |
| HPV33 | E2 | 8 | 112 | KQGETVTV | 27947 |
| HPV33 | E2 | 10 | 112 | KQGETVTVQY | 27948 |
| HPV33 | E2 | 8 | 47 | KQMGFSHL | 27949 |
| HPV33 | E2 | 10 | 264 | KQRTVCSSNV | 27950 |
| HPV33 | E2 | 11 | 264 | KQRTVCSSNVA | 27951 |
| HPV33 | E2 | 8 | 151 | KVDYIGMY | 27952 |
| HPV33 | E2 | 9 | 151 | KVDYIGMYY | 27953 |
| HPV33 | E2 | 10 | 151 | KVDYIGMYYI | 27954 |
| HPV33 | E2 | 11 | 165 | KVYFKYFKEDA | 27955 |
| HPV33 | E2 | 8 | 35 | LIRMECAL | 27956 |
| HPV33 | E2 | 9 | 35 | LIRMECALL | 27957 |
| HPV33 | E2 | 10 | 35 | LIRMECALLY | 27958 |
| HPV33 | E2 | 8 | 62 | LLASKTKA | 27959 |
| HPV33 | E2 | 9 | 62 | LLASKTKAF | 27960 |
| HPV33 | E2 | 11 | 62 | LLASKTKAFQV | 27961 |
| HPV33 | E2 | 8 | 42 | LLYTAKQM | 27962 |
| HPV33 | E2 | 10 | 42 | LLYTAKQMGF | 27963 |
| HPV33 | E2 | 8 | 26 | LPSQIEHW | 27964 |
| HPV33 | E2 | 10 | 26 | LPSQIEHWKL | 27965 |
| HPV33 | E2 | 11 | 26 | LPSQIEHWKLI | 27966 |
| HPV33 | E2 | 8 | 75 | LQMALETL | 27967 |
| HPV33 | E2 | 8 | 94 | LQQTSLEV | 27968 |
| HPV33 | E2 | 9 | 94 | LQQTSLEVW | 27969 |
| HPV33 | E2 | 10 | 94 | LQQTSLEVWL | 27970 |
| HPV33 | E2 | 8 | 147 | MVTGKVDY | 27971 |
| HPV33 | E2 | 9 | 147 | MVTGKVDYI | 27972 |
| HPV33 | E2 | 11 | 147 | MVTGKVDYIGM | 27973 |
| HPV33 | E2 | 9 | 202 | NQISTTETA | 27974 |
| HPV33 | E2 | 11 | 202 | NQISTTETADI | 27975 |
| HPV33 | E2 | 8 | 272 | NVAPIVHL | 27976 |
| HPV33 | E2 | 8 | 239 | PLTKLFCA | 27977 |
| HPV33 | E2 | 11 | 239 | PLTKLFCADPA | 27978 |
| HPV33 | E2 | 10 | 341 | PPTVQISTGF | 27979 |
| HPV33 | E2 | 11 | 341 | PPTVQISTGFM | 27980 |
| HPV33 | E2 | 11 | 221 | PQAAAKRRRPA | 27981 |
| HPV33 | E2 | 8 | 29 | QIEHWKLI | 27982 |
| HPV33 | E2 | 10 | 29 | QIEHWKLIRM | 27983 |
| HPV33 | E2 | 9 | 345 | QISTGFMTL | 27984 |

TABLE XIV-continued

B62 Supermotif Peptides

| Type | Protein | No. of Amino Acid | Position | Sequence | Seq. Id. No. |
|---|---|---|---|---|---|
| HPV33 | E2 | 8 | 203 | QISTTETA | 27985 |
| HPV33 | E2 | 10 | 203 | QISTTETADI | 27986 |
| HPV33 | E2 | 9 | 332 | QMFLGTVKI | 27987 |
| HPV33 | E2 | 11 | 48 | QMGFSHLCHQV | 27988 |
| HPV33 | E2 | 11 | 182 | QMWEVHVGGQV | 27989 |
| HPV33 | E2 | 9 | 238 | QPLTKLFCA | 27990 |
| HPV33 | E2 | 8 | 331 | QQMFLGTV | 27991 |
| HPV33 | E2 | 10 | 331 | QQMFLGTVKI | 27992 |
| HPV33 | E2 | 9 | 330 | QQQMFLGTV | 27993 |
| HPV33 | E2 | 11 | 330 | QQQMFLGTVKI | 27994 |
| HPV33 | E2 | 10 | 329 | QQQQMFLGTV | 27995 |
| HPV33 | E2 | 8 | 95 | QQTSLEVW | 27996 |
| HPV33 | E2 | 9 | 95 | QQTSLEVWL | 27997 |
| HPV33 | E2 | 8 | 71 | QVIELQMA | 27998 |
| HPV33 | E2 | 9 | 71 | QVIELQMAL | 27999 |
| HPV33 | E2 | 9 | 191 | QVIVCPTSI | 28000 |
| HPV33 | E2 | 8 | 57 | QVVPSLLA | 28001 |
| HPV33 | E2 | 8 | 292 | RLKPYKEL | 28002 |
| HPV33 | E2 | 9 | 292 | RLKPYKELY | 28003 |
| HPV33 | E2 | 9 | 7 | RLNAVQEKI | 28004 |
| HPV33 | E2 | 10 | 7 | RLNAVQEKIL | 28005 |
| HPV33 | E2 | 8 | 37 | RMECALLY | 28006 |
| HPV33 | E2 | 10 | 37 | RMECALLYTA | 28007 |
| HPV33 | E2 | 9 | 229 | RPADTTDTA | 28008 |
| HPV33 | E2 | 9 | 285 | SLKCLRYRL | 28009 |
| HPV33 | E2 | 9 | 61 | SLLASKTKA | 28010 |
| HPV33 | E2 | 10 | 61 | SLLASKTKAF | 28011 |
| HPV33 | E2 | 8 | 302 | SMSSTWHW | 28012 |
| HPV33 | E2 | 8 | 28 | SQIEHWKL | 28013 |
| HPV33 | E2 | 9 | 28 | SQIEHWKLI | 28014 |
| HPV33 | E2 | 11 | 28 | SQIEHWKLIRM | 28015 |
| HPV33 | E2 | 10 | 90 | SQWTLQQTSL | 28016 |
| HPV33 | E2 | 8 | 85 | SQYSTSQW | 28017 |
| HPV33 | E2 | 10 | 85 | SQYSTSQWTL | 28018 |
| HPV33 | E2 | 9 | 93 | TLQQTSLEV | 28019 |
| HPV33 | E2 | 10 | 93 | TLQQTSLEVW | 28020 |
| HPV33 | E2 | 11 | 93 | TLQQTSLEVWL | 28021 |
| HPV33 | E2 | 10 | 128 | TMDYTNWGEI | 28022 |
| HPV33 | E2 | 11 | 128 | TMDYTNWGEIY | 28023 |
| HPV33 | E2 | 9 | 146 | TMVTGKVDY | 28024 |
| HPV33 | E2 | 10 | 146 | TMVTGKVDYI | 28025 |
| HPV33 | E2 | 8 | 181 | TQMWEVHV | 28026 |
| HPV33 | E2 | 8 | 267 | TVCSSNVA | 28027 |
| HPV33 | E2 | 10 | 267 | TVCSSNVAPI | 28028 |
| HPV33 | E2 | 11 | 267 | TVCSSNVAPIV | 28029 |
| HPV33 | E2 | 8 | 337 | TVKIPPTV | 28030 |
| HPV33 | E2 | 10 | 337 | TVKIPPTVQI | 28031 |
| HPV33 | E2 | 8 | 343 | TVQISTGF | 28032 |
| HPV33 | E2 | 9 | 343 | TVQISTGFM | 28033 |
| HPV33 | E2 | 11 | 343 | TVQISTGFMTL | 28034 |
| HPV33 | E2 | 8 | 72 | VIELQMAL | 28035 |
| HPV33 | E2 | 11 | 72 | VIELQMALETL | 28036 |
| HPV33 | E2 | 8 | 192 | VIVCPTSI | 28037 |
| HPV33 | E2 | 11 | 59 | VPSLLASKTKA | 28038 |
| HPV33 | E2 | 8 | 11 | VQEKILDL | 28039 |
| HPV33 | E2 | 9 | 11 | VQEKILDLY | 28040 |
| HPV33 | E2 | 11 | 11 | VQEKILDLYEA | 28041 |
| HPV33 | E2 | 8 | 344 | VQISTGFM | 28042 |
| HPV33 | E2 | 10 | 344 | VQISTGFMTL | 28043 |
| HPV33 | E2 | 11 | 119 | VQYDNDKKNTM | 28044 |
| HPV33 | E2 | 9 | 102 | WLCEPPKCF | 28045 |
| HPV33 | E2 | 8 | 159 | YIHNCEKV | 28046 |
| HPV33 | E2 | 9 | 159 | YIHNCEKVY | 28047 |
| HPV33 | E2 | 10 | 159 | YIHNCEKVYF | 28048 |
| HPV33 | E2 | 10 | 138 | YIIEEDTCTM | 28049 |
| HPV33 | E2 | 11 | 138 | YIIEEDTCTMV | 28050 |
| HPV33 | E5 | 9 | 63 | CINFHAQHM | 28051 |
| HPV33 | E5 | 9 | 14 | CLSLLLRPL | 28052 |
| HPV33 | E5 | 10 | 14 | CLSLLLRPLI | 28053 |
| HPV33 | E5 | 11 | 14 | CLSLLLRPLIL | 28054 |
| HPV33 | E5 | 9 | 9 | FILFLCLSL | 28055 |
| HPV33 | E5 | 10 | 9 | FILFLCLSLL | 28056 |
| HPV33 | E5 | 11 | 9 | FILFLCLSLLL | 28057 |
| HPV33 | E5 | 8 | 12 | FLCLSLLL | 28058 |
| HPV33 | E5 | 11 | 12 | FLCLSLLLRPL | 28059 |

TABLE XIV-continued

B62 Supermotif Peptides

| Type | Protein | No. of Amino Acid | Position | Sequence | Seq. Id. No. |
|---|---|---|---|---|---|
| HPV33 | E5 | 9 | 56 | FLYLPMMCI | 28060 |
| HPV33 | E5 | 11 | 56 | FLYLPMMCINF | 28061 |
| HPV33 | E5 | 8 | 3 | FVFVLCFI | 28062 |
| HPV33 | E5 | 9 | 3 | FVFVLCFIL | 28063 |
| HPV33 | E5 | 10 | 3 | FVFVLCFILF | 28064 |
| HPV33 | E5 | 11 | 3 | FVFVLCFILFL | 28065 |
| HPV33 | E5 | 8 | 42 | FVGSPLKI | 28066 |
| HPV33 | E5 | 9 | 42 | FVGSPLKIF | 28067 |
| HPV33 | E5 | 10 | 42 | FVGSPLKIFF | 28068 |
| HPV33 | E5 | 8 | 5 | FVLCFILF | 28069 |
| HPV33 | E5 | 9 | 5 | FVLCFILFL | 28070 |
| HPV33 | E5 | 11 | 5 | FVLCFILFLCL | 28071 |
| HPV33 | E5 | 8 | 10 | ILFLCLSL | 28072 |
| HPV33 | E5 | 9 | 10 | ILFLCLSLL | 28073 |
| HPV33 | E5 | 10 | 10 | ILFLCLSLLL | 28074 |
| HPV33 | E5 | 8 | 23 | ILSISTYA | 28075 |
| HPV33 | E5 | 9 | 23 | ILSISTYAW | 28076 |
| HPV33 | E5 | 10 | 23 | ILSISTYAWL | 28077 |
| HPV33 | E5 | 11 | 23 | ILSISTYAWLL | 28078 |
| HPV33 | E5 | 8 | 48 | KIFFCYLL | 28079 |
| HPV33 | E5 | 9 | 48 | KIFFCYLLF | 28080 |
| HPV33 | E5 | 10 | 48 | KIFFCYLLFL | 28081 |
| HPV33 | E5 | 11 | 48 | KIFFCYLLFLY | 28082 |
| HPV33 | E5 | 8 | 22 | LILSISTY | 28083 |
| HPV33 | E5 | 9 | 22 | LILSISTYA | 28084 |
| HPV33 | E5 | 10 | 22 | LILSISTYAW | 28085 |
| HPV33 | E5 | 11 | 22 | LILSISTYAWL | 28086 |
| HPV33 | E5 | 8 | 54 | LLFLYLPM | 28087 |
| HPV33 | E5 | 9 | 54 | LLFLYLPMM | 28088 |
| HPV33 | E5 | 11 | 54 | LLFLYLPMMCI | 28089 |
| HPV33 | E5 | 8 | 17 | LLLRPLIL | 28090 |
| HPV33 | E5 | 10 | 17 | LLLRPLILSI | 28091 |
| HPV33 | E5 | 11 | 37 | LLLWVFVGSPL | 28092 |
| HPV33 | E5 | 9 | 18 | LLRPLILSI | 28093 |
| HPV33 | E5 | 8 | 32 | LLVLVLLL | 28094 |
| HPV33 | E5 | 9 | 32 | LLVLVLLLW | 28095 |
| HPV33 | E5 | 10 | 32 | LLVLVLLLWV | 28096 |
| HPV33 | E5 | 11 | 32 | LLVLVLLLWVF | 28097 |
| HPV33 | E5 | 10 | 38 | LLWVFVGSPL | 28098 |
| HPV33 | E5 | 8 | 59 | LPMMCINF | 28099 |
| HPV33 | E5 | 10 | 59 | LPMMCINFHA | 28100 |
| HPV33 | E5 | 8 | 35 | LVLLLWVF | 28101 |
| HPV33 | E5 | 9 | 35 | LVLLLWVFV | 28102 |
| HPV33 | E5 | 8 | 33 | LVLVLLLW | 28103 |
| HPV33 | E5 | 9 | 33 | LVLVLLLWV | 28104 |
| HPV33 | E5 | 10 | 33 | LVLVLLLWVF | 28105 |
| HPV33 | E5 | 11 | 33 | LVLVLLLWVFV | 28106 |
| HPV33 | E5 | 9 | 1 | MIFVFVLCF | 28107 |
| HPV33 | E5 | 10 | 1 | MIFVFVLCFI | 28108 |
| HPV33 | E5 | 11 | 1 | MIFVFVLCFIL | 28109 |
| HPV33 | E5 | 8 | 61 | MMCINFHA | 28110 |
| HPV33 | E5 | 11 | 61 | MMCINFHAQHM | 28111 |
| HPV33 | E5 | 9 | 21 | PLILSISTY | 28112 |
| HPV33 | E5 | 10 | 21 | PLILSISTYA | 28113 |
| HPV33 | E5 | 11 | 21 | PLILSISTYAW | 28114 |
| HPV33 | E5 | 8 | 46 | PLKIFFCY | 28115 |
| HPV33 | E5 | 9 | 46 | PLKIFFCYL | 28116 |
| HPV33 | E5 | 10 | 46 | PLKIFFCYLL | 28117 |
| HPV33 | E5 | 11 | 46 | PLKIFFCYLLF | 28118 |
| HPV33 | E5 | 9 | 60 | PMMCINFHA | 28119 |
| HPV33 | E5 | 10 | 20 | RPLILSISTY | 28120 |
| HPV33 | E5 | 11 | 20 | RPLILSISTYA | 28121 |
| HPV33 | E5 | 8 | 25 | SISTYAWL | 28122 |
| HPV33 | E5 | 9 | 25 | SISTYAWLL | 28123 |
| HPV33 | E5 | 10 | 25 | SISTYAWLLV | 28124 |
| HPV33 | E5 | 11 | 25 | SISTYAWLLVL | 28125 |
| HPV33 | E5 | 8 | 16 | SLLRPLI | 28126 |
| HPV33 | E5 | 9 | 16 | SLLLRPLIL | 28127 |
| HPV33 | E5 | 11 | 16 | SLLLRPLILSI | 28128 |
| HPV33 | E5 | 9 | 45 | SPLKIFFCY | 28129 |
| HPV33 | E5 | 10 | 45 | SPLKIFFCYL | 28130 |
| HPV33 | E5 | 11 | 45 | SPLKIFFCYLL | 28131 |
| HPV33 | E5 | 8 | 6 | VLCFILFL | 28132 |
| HPV33 | E5 | 10 | 6 | VLCFILFLCL | 28133 |
| HPV33 | E5 | 8 | 36 | VLLLWVFV | 28134 |

TABLE XIV-continued

B62 Supermotif Peptides

| Type | Protein | No. of Amino Acid | Position | Sequence | Seq. Id. No. |
|---|---|---|---|---|---|
| HPV33 | E5 | 8 | 34 | VLVLLLWV | 28135 |
| HPV33 | E5 | 9 | 34 | VLVLLLWVF | 28136 |
| HPV33 | E5 | 10 | 34 | VLVLLLWVFV | 28137 |
| HPV33 | E5 | 8 | 31 | WLLVLVLL | 28138 |
| HPV33 | E5 | 9 | 31 | WLLVLVLLL | 28139 |
| HPV33 | E5 | 10 | 31 | WLLVLVLLLW | 28140 |
| HPV33 | E5 | 11 | 31 | WLLVLVLLLWV | 28141 |
| HPV33 | E5 | 8 | 40 | WVFVGSPL | 28142 |
| HPV33 | E5 | 10 | 40 | WVFVGSPLKI | 28143 |
| HPV33 | E5 | 11 | 40 | WVFVGSPLKIF | 28144 |
| HPV33 | E5 | 9 | 53 | YLLFLYLPM | 28145 |
| HPV33 | E5 | 10 | 53 | YLLFLYLPMM | 28146 |
| HPV33 | E5 | 9 | 58 | YLPMMCINF | 28147 |
| HPV33 | E5 | 11 | 58 | YLPMMCINFHA | 28148 |
| HPV33 | E6 | 9 | 18 | ALETTIHNI | 28149 |
| HPV33 | E6 | 11 | 18 | ALETTIHNIEL | 28150 |
| HPV33 | E6 | 8 | 103 | CIICQRPL | 28151 |
| HPV33 | E6 | 8 | 66 | CLRFLSKI | 28152 |
| HPV33 | E6 | 11 | 66 | CLRFLSKISEY | 28153 |
| HPV33 | E6 | 9 | 111 | CPQEKKRHV | 28154 |
| HPV33 | E6 | 11 | 111 | CPQEKKRHVDL | 28155 |
| HPV33 | E6 | 8 | 16 | CQALETTI | 28156 |
| HPV33 | E6 | 11 | 16 | CQALETTIHNI | 28157 |
| HPV33 | E6 | 8 | 30 | CVECKKPL | 28158 |
| HPV33 | E6 | 10 | 14 | DLCQALETTI | 28159 |
| HPV33 | E6 | 9 | 120 | DLNKRFHNI | 28160 |
| HPV33 | E6 | 8 | 98 | EILIRCII | 28161 |
| HPV33 | E6 | 11 | 27 | ELQCVECKKPL | 28162 |
| HPV33 | E6 | 8 | 89 | EQTVKKPL | 28163 |
| HPV33 | E6 | 11 | 89 | EQTVKKPLNEI | 28164 |
| HPV33 | E6 | 8 | 41 | EVYDFAFA | 28165 |
| HPV33 | E6 | 10 | 41 | EVYDFAFADL | 28166 |
| HPV33 | E6 | 8 | 69 | FLSKISEY | 28167 |
| HPV33 | E6 | 11 | 69 | FLSKISEYRHY | 28168 |
| HPV33 | E6 | 11 | 2 | FQDTEEKPRTL | 28169 |
| HPV33 | E6 | 9 | 61 | GICKLCLRF | 28170 |
| HPV33 | E6 | 10 | 61 | GICKLCLRFL | 28171 |
| HPV33 | E6 | 8 | 118 | HVDLNKRF | 28172 |
| HPV33 | E6 | 11 | 118 | HVDLNKRFHNI | 28173 |
| HPV33 | E6 | 8 | 72 | KISEYRHY | 28174 |
| HPV33 | E6 | 10 | 72 | KISEYRHYNY | 28175 |
| HPV33 | E6 | 10 | 64 | KLCLRFLSKI | 28176 |
| HPV33 | E6 | 8 | 94 | KPLNEILI | 28177 |
| HPV33 | E6 | 11 | 94 | KPLNEILIRCI | 28178 |
| HPV33 | E6 | 8 | 35 | KPLQRSEV | 28179 |
| HPV33 | E6 | 9 | 35 | KPLQRSEVY | 28180 |
| HPV33 | E6 | 11 | 35 | KPLQRSEVYDF | 28181 |
| HPV33 | E6 | 8 | 8 | KPRTLHDL | 28182 |
| HPV33 | E6 | 11 | 8 | KPRTLHDLCQA | 28183 |
| HPV33 | E6 | 11 | 100 | LIRCIICQRPL | 28184 |
| HPV33 | E6 | 10 | 28 | LQCVECKKPL | 28185 |
| HPV33 | E6 | 9 | 37 | LQRSEVYDF | 28186 |
| HPV33 | E6 | 10 | 37 | LQRSEVYDFA | 28187 |
| HPV33 | E6 | 11 | 37 | LQRSEVYDFAF | 28188 |
| HPV33 | E6 | 11 | 127 | NISGRWAGRCA | 28189 |
| HPV33 | E6 | 8 | 58 | NPFGICKL | 28190 |
| HPV33 | E6 | 10 | 58 | NPFGICKLCL | 28191 |
| HPV33 | E6 | 11 | 109 | PLCPQEKKRHV | 28192 |
| HPV33 | E6 | 10 | 95 | PLNEILIRCI | 28193 |
| HPV33 | E6 | 11 | 95 | PLNEILIRCII | 28194 |
| HPV33 | E6 | 8 | 36 | PLQRSEVY | 28195 |
| HPV33 | E6 | 10 | 36 | PLQRSEVYDF | 28196 |
| HPV33 | E6 | 11 | 36 | PLQRSEVYDFA | 28197 |
| HPV33 | E6 | 8 | 112 | PQEKKRHV | 28198 |
| HPV33 | E6 | 10 | 112 | PQEKKRHVDL | 28199 |
| HPV33 | E6 | 11 | 82 | SVYGNTLEQTV | 28200 |
| HPV33 | E6 | 10 | 22 | TIHNIELQCV | 28201 |
| HPV33 | E6 | 10 | 87 | TLEQTVKKPL | 28202 |
| HPV33 | E6 | 8 | 11 | TLHDLCQA | 28203 |
| HPV33 | E6 | 9 | 11 | TLHDLCQAL | 28204 |
| HPV33 | E6 | 9 | 91 | TVKKPLNEI | 28205 |
| HPV33 | E6 | 10 | 91 | TVKKPLNEIL | 28206 |
| HPV33 | E6 | 11 | 91 | TVKKPLNEILI | 28207 |
| HPV33 | E6 | 10 | 51 | TVVYREGNPF | 28208 |
| HPV33 | E6 | 9 | 52 | VVYREGNPF | 28209 |

TABLE XIV-continued

B62 Supermotif Peptides

| Type | Protein | No. of Amino Acid | Position | Sequence | Seq. Id. No. |
|---|---|---|---|---|---|
| HPV33 | E6 | 11 | 52 | VVYREGNPFGI | 28210 |
| HPV33 | E7 | 8 | 45 | AQPATADY | 28211 |
| HPV33 | E7 | 9 | 45 | AQPATADYY | 28212 |
| HPV33 | E7 | 10 | 45 | AQPATADYYI | 28213 |
| HPV33 | E7 | 11 | 45 | AQPATADYYIV | 28214 |
| HPV33 | E7 | 9 | 68 | CVNSTASDL | 28215 |
| HPV33 | E7 | 8 | 75 | DLRTIQQL | 28216 |
| HPV33 | E7 | 9 | 75 | DLRTIQQLL | 28217 |
| HPV33 | E7 | 10 | 75 | DLRTIQQLLM | 28218 |
| HPV33 | E7 | 8 | 21 | DLYCYEQL | 28219 |
| HPV33 | E7 | 9 | 14 | DLYPEPTDL | 28220 |
| HPV33 | E7 | 10 | 14 | DLYPEPTDLY | 28221 |
| HPV33 | E7 | 8 | 18 | EPTDLYCY | 28222 |
| HPV33 | E7 | 11 | 18 | EPTDLYCYEQL | 28223 |
| HPV33 | E7 | 9 | 37 | GLDRPDGQA | 28224 |
| HPV33 | E7 | 8 | 43 | GQAQPATA | 28225 |
| HPV33 | E7 | 10 | 43 | GQAQPATADY | 28226 |
| HPV33 | E7 | 11 | 43 | GQAQPATADYY | 28227 |
| HPV33 | E7 | 9 | 79 | IQQLLMGTV | 28228 |
| HPV33 | E7 | 11 | 79 | IQQLLMGTVNI | 28229 |
| HPV33 | E7 | 8 | 5 | KPTLKEYV | 28230 |
| HPV33 | E7 | 9 | 5 | KPTLKEYVL | 28231 |
| HPV33 | E7 | 11 | 5 | KPTLKEYVLDL | 28232 |
| HPV33 | E7 | 8 | 82 | LLMGTVNI | 28233 |
| HPV33 | E7 | 9 | 82 | LLMGTVNIV | 28234 |
| HPV33 | E7 | 8 | 83 | LMGTVNIV | 28235 |
| HPV33 | E7 | 8 | 88 | NIVCPTCA | 28236 |
| HPV33 | E7 | 9 | 81 | QLLMGTVNI | 28237 |
| HPV33 | E7 | 10 | 81 | QLLMGTVNIV | 28238 |
| HPV33 | E7 | 8 | 46 | QPATADYY | 28239 |
| HPV33 | E7 | 9 | 46 | QPATADYYI | 28240 |
| HPV33 | E7 | 10 | 46 | QPATADYYIV | 28241 |
| HPV33 | E7 | 8 | 80 | QQLLMGTV | 28242 |
| HPV33 | E7 | 10 | 80 | QQLLMGTVNI | 28243 |
| HPV33 | E7 | 11 | 80 | QQLLMGTVNIV | 28244 |
| HPV33 | E7 | 8 | 66 | RLCVNSTA | 28245 |
| HPV33 | E7 | 11 | 66 | RLCVNSTASDL | 28246 |
| HPV33 | E7 | 9 | 40 | RPDGQAQPA | 28247 |
| HPV33 | E7 | 11 | 40 | RPDGQAQPATA | 28248 |
| HPV33 | E7 | 10 | 78 | TIQQLLMGTV | 28249 |
| HPV33 | E7 | 9 | 7 | TLKEYVLDL | 28250 |
| HPV33 | E7 | 10 | 7 | TLKEYVLDLY | 28251 |
| HPV33 | E7 | 10 | 86 | TVNIVCPTCA | 28252 |
| HPV33 | E7 | 10 | 64 | TVRLCVNSTA | 28253 |
| HPV33 | E7 | 11 | 12 | VLDLYPEPTDL | 28254 |
| HPV33 | E7 | 8 | 16 | YPEPTDLY | 28255 |
| HPV33 | E7 | 10 | 16 | YPEPTDLYCY | 28256 |
| HPV33 | L1 | 8 | 424 | AITCQKTV | 28257 |
| HPV33 | L1 | 10 | 392 | AMNPDILEDW | 28258 |
| HPV33 | L1 | 9 | 180 | APANDCPPL | 28259 |
| HPV33 | L1 | 11 | 180 | APANDCPPLEL | 28260 |
| HPV33 | L1 | 10 | 483 | APTSTRTSSA | 28261 |
| HPV33 | L1 | 8 | 316 | AQGHNNGI | 28262 |
| HPV33 | L1 | 10 | 316 | AQGHNNGICW | 28263 |
| HPV33 | L1 | 9 | 44 | AVGHPYFSI | 28264 |
| HPV33 | L1 | 8 | 270 | AVPDDLYI | 28265 |
| HPV33 | L1 | 11 | 147 | CLSMDYKQTQL | 28266 |
| HPV33 | L1 | 9 | 207 | CMDFKTLQA | 28267 |
| HPV33 | L1 | 10 | 185 | CPPLELINTI | 28268 |
| HPV33 | L1 | 11 | 185 | CPPLELINTII | 28269 |
| HPV33 | L1 | 9 | 223 | DICGSTCKY | 28270 |
| HPV33 | L1 | 8 | 396 | DILEDWQF | 28271 |
| HPV33 | L1 | 10 | 396 | DILEDWQFGL | 28272 |
| HPV33 | L1 | 11 | 457 | DLDQFPLGRKF | 28273 |
| HPV33 | L1 | 8 | 449 | DLKEKFSA | 28274 |
| HPV33 | L1 | 10 | 449 | DLKEKFSADL | 28275 |
| HPV33 | L1 | 8 | 370 | DLQFVFQL | 28276 |
| HPV33 | L1 | 11 | 370 | DLQFVFQLCKV | 28277 |
| HPV33 | L1 | 11 | 274 | DLYIKGSGTTA | 28278 |
| HPV33 | L1 | 10 | 199 | DMVDTGFGCM | 28279 |
| HPV33 | L1 | 8 | 438 | DPLGKYTF | 28280 |
| HPV33 | L1 | 9 | 438 | DPLGKYTFW | 28281 |
| HPV33 | L1 | 11 | 438 | DPLGKYTFWEV | 28282 |
| HPV33 | L1 | 9 | 459 | DQFPLGRKF | 28283 |
| HPV33 | L1 | 10 | 459 | DQFPLGRKFL | 28284 |

TABLE XIV-continued

B62 Supermotif Peptides

| Type | Protein | No. of Amino Acid | Position | Sequence | Seq. Id. No. |
|---|---|---|---|---|---|
| HPV33 | L1 | 11 | 459 | DQFPLGRKFLL | 28285 |
| HPV33 | L1 | 8 | 107 | EIGRGQPL | 28286 |
| HPV33 | L1 | 10 | 107 | EIGRGQPLGV | 28287 |
| HPV33 | L1 | 8 | 240 | EPYGDSLF | 28288 |
| HPV33 | L1 | 9 | 240 | EPYGDSLFF | 28289 |
| HPV33 | L1 | 10 | 240 | EPYGDSLFFF | 28290 |
| HPV33 | L1 | 11 | 240 | EPYGDSLFFFL | 28291 |
| HPV33 | L1 | 8 | 253 | EQMFVRHF | 28292 |
| HPV33 | L1 | 9 | 253 | EQMFVRHFF | 28293 |
| HPV33 | L1 | 8 | 447 | EVDLKEKF | 28294 |
| HPV33 | L1 | 10 | 447 | EVDLKEKFSA | 28295 |
| HPV33 | L1 | 8 | 385 | EVMTYIHA | 28296 |
| HPV33 | L1 | 9 | 385 | EVMTYIHAM | 28297 |
| HPV33 | L1 | 9 | 467 | FLLQAGLKA | 28298 |
| HPV33 | L1 | 8 | 249 | FLRREQMF | 28299 |
| HPV33 | L1 | 9 | 249 | FLRREQMFV | 28300 |
| HPV33 | L1 | 8 | 461 | FPLGRKFL | 28301 |
| HPV33 | L1 | 9 | 461 | FPLGRKFLL | 28302 |
| HPV33 | L1 | 11 | 461 | FPLGRKFLLQA | 28303 |
| HPV33 | L1 | 8 | 292 | FPTPSGSM | 28304 |
| HPV33 | L1 | 9 | 292 | FPTPSGSMV | 28305 |
| HPV33 | L1 | 8 | 375 | FQLCKVTL | 28306 |
| HPV33 | L1 | 10 | 375 | FQLCKVTLTA | 28307 |
| HPV33 | L1 | 8 | 373 | FVFQLCKV | 28308 |
| HPV33 | L1 | 10 | 373 | FVFQLCKVTL | 28309 |
| HPV33 | L1 | 9 | 256 | FVRHFFNRA | 28310 |
| HPV33 | L1 | 8 | 322 | GICWGNQV | 28311 |
| HPV33 | L1 | 9 | 322 | GICWGNQVF | 28312 |
| HPV33 | L1 | 10 | 322 | GICWGNQVFV | 28313 |
| HPV33 | L1 | 8 | 117 | GISGHPLL | 28314 |
| HPV33 | L1 | 11 | 117 | GISGHPLLNKF | 28315 |
| HPV33 | L1 | 10 | 105 | GLEIGRGQPL | 28316 |
| HPV33 | L1 | 8 | 472 | GLKAKPKL | 28317 |
| HPV33 | L1 | 11 | 472 | GLKAKPKLKRA | 28318 |
| HPV33 | L1 | 9 | 68 | GLQYRVFRV | 28319 |
| HPV33 | L1 | 11 | 68 | GLQYRVFRVRL | 28320 |
| HPV33 | L1 | 8 | 404 | GLTPPPSA | 28321 |
| HPV33 | L1 | 10 | 404 | GLTPPPSASL | 28322 |
| HPV33 | L1 | 11 | 138 | GQPGADNRECL | 28323 |
| HPV33 | L1 | 8 | 111 | GQPLGVGI | 28324 |
| HPV33 | L1 | 8 | 173 | GVACTNAA | 28325 |
| HPV33 | L1 | 10 | 173 | GVACTNAAPA | 28326 |
| HPV33 | L1 | 9 | 115 | GVGISGHPL | 28327 |
| HPV33 | L1 | 10 | 115 | GVGISGHPLL | 28328 |
| HPV33 | L1 | 9 | 365 | HVEEYDLQF | 28329 |
| HPV33 | L1 | 10 | 365 | HVEEYDLQFV | 28330 |
| HPV33 | L1 | 11 | 365 | HVEEYDLQFVF | 28331 |
| HPV33 | L1 | 8 | 194 | IIEDGDMV | 28332 |
| HPV33 | L1 | 9 | 397 | ILEDWQFGL | 28333 |
| HPV33 | L1 | 10 | 60 | KLLVPKVSGL | 28334 |
| HPV33 | L1 | 11 | 236 | KMTSEPYGDSL | 28335 |
| HPV33 | L1 | 8 | 476 | KPKLKRAA | 28336 |
| HPV33 | L1 | 8 | 163 | KPPTGEHW | 28337 |
| HPV33 | L1 | 8 | 309 | KPYWLQRA | 28338 |
| HPV33 | L1 | 8 | 153 | KQTQLCLL | 28339 |
| HPV33 | L1 | 9 | 65 | KVSGLQYRV | 28340 |
| HPV33 | L1 | 10 | 65 | KVSGLQYRVF | 28341 |
| HPV33 | L1 | 8 | 379 | KVTLTAEV | 28342 |
| HPV33 | L1 | 9 | 379 | KVTLTAEVM | 28343 |
| HPV33 | L1 | 11 | 379 | KVTLTAEVMTY | 28344 |
| HPV33 | L1 | 8 | 20 | KVVSTDEY | 28345 |
| HPV33 | L1 | 9 | 20 | KVVSTDEYV | 28346 |
| HPV33 | L1 | 11 | 190 | LINTIIEDGDM | 28347 |
| HPV33 | L1 | 8 | 42 | LLAVGHPY | 28348 |
| HPV33 | L1 | 9 | 42 | LLAVGHPYF | 28349 |
| HPV33 | L1 | 11 | 42 | LLAVGHPYFSI | 28350 |
| HPV33 | L1 | 8 | 468 | LLQAGLKA | 28351 |
| HPV33 | L1 | 9 | 61 | LLVPKVSGL | 28352 |
| HPV33 | L1 | 11 | 61 | LLVPKVSGLQY | 28353 |
| HPV33 | L1 | 9 | 78 | LPDPNKFGF | 28354 |
| HPV33 | L1 | 9 | 13 | LPPVPVSKV | 28355 |
| HPV33 | L1 | 10 | 13 | LPPVPVSKVV | 28356 |
| HPV33 | L1 | 11 | 469 | LQAGLKAKPKL | 28357 |
| HPV33 | L1 | 8 | 213 | LQANKSDV | 28358 |
| HPV33 | L1 | 10 | 213 | LQANKSDVPI | 28359 |

TABLE XIV-continued

B62 Supermotif Peptides

| Type | Protein | No. of Amino Acid | Position | Sequence | Seq. Id. No. |
|---|---|---|---|---|---|
| HPV33 | L1 | 8 | 413 | LQDTYRFV | 28360 |
| HPV33 | L1 | 10 | 371 | LQFVFQLCKV | 28361 |
| HPV33 | L1 | 11 | 313 | LQRAQGHNNGI | 28362 |
| HPV33 | L1 | 8 | 69 | LQYRVFRV | 28363 |
| HPV33 | L1 | 10 | 69 | LQYRVFRVRL | 28364 |
| HPV33 | L1 | 8 | 62 | LVPKVSGL | 28365 |
| HPV33 | L1 | 10 | 62 | LVPKVSGLQY | 28366 |
| HPV33 | L1 | 8 | 99 | LVWACVGL | 28367 |
| HPV33 | L1 | 10 | 99 | LVWACVGLEI | 28368 |
| HPV33 | L1 | 9 | 200 | MVDTGFGCM | 28369 |
| HPV33 | L1 | 11 | 200 | MVDTGFGCMDF | 28370 |
| HPV33 | L1 | 8 | 299 | MVTSESQL | 28371 |
| HPV33 | L1 | 9 | 299 | MVTSESQLF | 28372 |
| HPV33 | L1 | 8 | 341 | NMTLCTQV | 28373 |
| HPV33 | L1 | 8 | 394 | NPDILEDW | 28374 |
| HPV33 | L1 | 10 | 394 | NPDILEDWQF | 28375 |
| HPV33 | L1 | 8 | 93 | NPDTQRLV | 28376 |
| HPV33 | L1 | 9 | 93 | NPDTQRLVW | 28377 |
| HPV33 | L1 | 10 | 93 | NPDTQRLVWA | 28378 |
| HPV33 | L1 | 8 | 54 | NPTNAKKL | 28379 |
| HPV33 | L1 | 9 | 54 | NPTNAKKLL | 28380 |
| HPV33 | L1 | 10 | 54 | NPTNAKKLLV | 28381 |
| HPV33 | L1 | 8 | 327 | NQVFVTVV | 28382 |
| HPV33 | L1 | 11 | 221 | PIDICGSTCKY | 28383 |
| HPV33 | L1 | 8 | 187 | PLELINTI | 28384 |
| HPV33 | L1 | 9 | 187 | PLELINTII | 28385 |
| HPV33 | L1 | 8 | 439 | PLGKYTFW | 28386 |
| HPV33 | L1 | 10 | 439 | PLGKYTFWEV | 28387 |
| HPV33 | L1 | 8 | 462 | PLGRKFLL | 28388 |
| HPV33 | L1 | 10 | 462 | PLGRKFLLQA | 28389 |
| HPV33 | L1 | 11 | 113 | PLGVGISGHPL | 28390 |
| HPV33 | L1 | 9 | 432 | PPKEKEDPL | 28391 |
| HPV33 | L1 | 9 | 186 | PPLELINTI | 28392 |
| HPV33 | L1 | 10 | 186 | PPLELINTII | 28393 |
| HPV33 | L1 | 11 | 407 | PPPSASLQDTY | 28394 |
| HPV33 | L1 | 10 | 408 | PPSASLQDTY | 28395 |
| HPV33 | L1 | 11 | 164 | PPTGEHWGKGV | 28396 |
| HPV33 | L1 | 8 | 14 | PPVPVSKV | 28397 |
| HPV33 | L1 | 9 | 14 | PPVPVSKVV | 28398 |
| HPV33 | L1 | 8 | 15 | PVPVSKVV | 28399 |
| HPV33 | L1 | 11 | 17 | PVSKVVSTDEY | 28400 |
| HPV33 | L1 | 9 | 376 | QLCKVTLTA | 28401 |
| HPV33 | L1 | 11 | 376 | QLCKVTLTAEV | 28402 |
| HPV33 | L1 | 8 | 305 | QLFNKPYW | 28403 |
| HPV33 | L1 | 9 | 305 | QLFNKPYWL | 28404 |
| HPV33 | L1 | 8 | 254 | QMFVRHFF | 28405 |
| HPV33 | L1 | 11 | 254 | QMFVRHFFNRA | 28406 |
| HPV33 | L1 | 10 | 139 | QPGADNRECL | 28407 |
| HPV33 | L1 | 8 | 347 | QVTSDSTY | 28408 |
| HPV33 | L1 | 9 | 41 | RLLAVGHPY | 28409 |
| HPV33 | L1 | 10 | 41 | RLLAVGHPYF | 28410 |
| HPV33 | L1 | 8 | 77 | RLPDPNKF | 28411 |
| HPV33 | L1 | 10 | 77 | RLPDPNKFGF | 28412 |
| HPV33 | L1 | 9 | 98 | RLVWACVGL | 28413 |
| HPV33 | L1 | 11 | 98 | RLVWACVGLEI | 28414 |
| HPV33 | L1 | 8 | 5 | RPSEATVY | 28415 |
| HPV33 | L1 | 9 | 5 | RPSEATVYL | 28416 |
| HPV33 | L1 | 10 | 75 | RVRLPDPNKF | 28417 |
| HPV33 | L1 | 8 | 51 | SIKNPTNA | 28418 |
| HPV33 | L1 | 11 | 51 | SIKNPTNAKKL | 28419 |
| HPV33 | L1 | 8 | 285 | SIQSSAFF | 28420 |
| HPV33 | L1 | 11 | 32 | SIYYYAGSSRL | 28421 |
| HPV33 | L1 | 11 | 245 | SLFFFLRREQM | 28422 |
| HPV33 | L1 | 8 | 412 | SLQDTYRF | 28423 |
| HPV33 | L1 | 9 | 412 | SLQDTYRFV | 28424 |
| HPV33 | L1 | 9 | 149 | SMDYKQTQL | 28425 |
| HPV33 | L1 | 11 | 149 | SMDYKQTQLCL | 28426 |
| HPV33 | L1 | 9 | 298 | SMVTSESQL | 28427 |
| HPV33 | L1 | 10 | 298 | SMVTSESQLF | 28428 |
| HPV33 | L1 | 10 | 422 | SQAITCQKTV | 28429 |
| HPV33 | L1 | 8 | 304 | SQLFNKPY | 28430 |
| HPV33 | L1 | 9 | 304 | SQLFNKPYW | 28431 |
| HPV33 | L1 | 10 | 304 | SQLFNKPYWL | 28432 |
| HPV33 | L1 | 8 | 2 | SVWRPSEA | 28433 |
| HPV33 | L1 | 10 | 2 | SVWRPSEATV | 28434 |

TABLE XIV-continued

B62 Supermotif Peptides

| Type | Protein | No. of Amino Acid | Position | Sequence | Seq. Id. No. |
|---|---|---|---|---|---|
| HPV33 | L1 | 11 | 2 | SVWRPSEATVY | 28435 |
| HPV33 | L1 | 8 | 193 | TIIEDGDM | 28436 |
| HPV33 | L1 | 9 | 193 | TIIEDGDMV | 28437 |
| HPV33 | L1 | 10 | 266 | TLGEAVPDDL | 28438 |
| HPV33 | L1 | 11 | 266 | TLGEAVPDDLY | 28439 |
| HPV33 | L1 | 9 | 212 | TLQANKSDV | 28440 |
| HPV33 | L1 | 11 | 212 | TLQANKSDVPI | 28441 |
| HPV33 | L1 | 9 | 381 | TLTAEVMTY | 28442 |
| HPV33 | L1 | 10 | 381 | TLTAEVMTYI | 28443 |
| HPV33 | L1 | 8 | 406 | TPPPSASL | 28444 |
| HPV33 | L1 | 9 | 96 | TQRLVWACV | 28445 |
| HPV33 | L1 | 11 | 96 | TQRLVWACVGL | 28446 |
| HPV33 | L1 | 9 | 346 | TQVTSDSTY | 28447 |
| HPV33 | L1 | 11 | 430 | TVPPKEKEDPL | 28448 |
| HPV33 | L1 | 11 | 332 | TVVDTTRSTNM | 28449 |
| HPV33 | L1 | 9 | 10 | TVYLPPVPV | 28450 |
| HPV33 | L1 | 8 | 386 | VMTYIHAM | 28451 |
| HPV33 | L1 | 9 | 63 | VPKVSGLQY | 28452 |
| HPV33 | L1 | 11 | 63 | VPKVSGLQYRV | 28453 |
| HPV33 | L1 | 10 | 431 | VPPKEKEDPL | 28454 |
| HPV33 | L1 | 10 | 333 | VVDTTRSTNM | 28455 |
| HPV33 | L1 | 8 | 21 | VVSTDEYV | 28456 |
| HPV33 | L1 | 11 | 401 | WQFGLTPPPSA | 28457 |
| HPV33 | L1 | 9 | 389 | YIHAMNPDI | 28458 |
| HPV33 | L1 | 10 | 389 | YIHAMNPDIL | 28459 |
| HPV33 | L1 | 9 | 276 | YIKGSGTTA | 28460 |
| HPV33 | L1 | 11 | 276 | YIKGSGTTASI | 28461 |
| HPV33 | L1 | 8 | 362 | YIRHVEEY | 28462 |
| HPV33 | L1 | 10 | 362 | YIRHVEEYDL | 28463 |
| HPV33 | L1 | 9 | 234 | YLKMTSEPY | 28464 |
| HPV33 | L1 | 10 | 12 | YLPPVPVSKV | 28465 |
| HPV33 | L1 | 11 | 12 | YLPPVPVSKVV | 28466 |
| HPV33 | L1 | 8 | 27 | YVSRTSIY | 28467 |
| HPV33 | L1 | 9 | 27 | YVSRTSIYY | 28468 |
| HPV33 | L1 | 10 | 27 | YVSRTSIYYY | 28469 |
| HPV33 | L1 | 11 | 27 | YVSRTSIYYYA | 28470 |
| HPV33 | L2 | 8 | 140 | AIINVSSV | 28471 |
| HPV33 | L2 | 11 | 82 | AIPLQPIRPPV | 28472 |
| HPV33 | L2 | 9 | 291 | AITSRRHTV | 28473 |
| HPV33 | L2 | 11 | 291 | AITSRRHTVRF | 28474 |
| HPV33 | L2 | 9 | 173 | APAEASGHF | 28475 |
| HPV33 | L2 | 10 | 173 | APAEASGHFI | 28476 |
| HPV33 | L2 | 11 | 173 | APAEASGHFIF | 28477 |
| HPV33 | L2 | 9 | 276 | APDPDFLDI | 28478 |
| HPV33 | L2 | 10 | 276 | APDPDFLDII | 28479 |
| HPV33 | L2 | 11 | 276 | APDPDFLDIIA | 28480 |
| HPV33 | L2 | 10 | 120 | APSIPTPSGF | 28481 |
| HPV33 | L2 | 9 | 27 | CPPDVIPKV | 28482 |
| HPV33 | L2 | 9 | 283 | DIIALHRPA | 28483 |
| HPV33 | L2 | 10 | 283 | DIIALHRPAI | 28484 |
| HPV33 | L2 | 10 | 272 | DISPAPDPDF | 28485 |
| HPV33 | L2 | 11 | 272 | DISPAPDPDFL | 28486 |
| HPV33 | L2 | 8 | 327 | DLSPIVPL | 28487 |
| HPV33 | L2 | 11 | 239 | DPAFLTSPHKL | 28488 |
| HPV33 | L2 | 8 | 278 | DPDFLDII | 28489 |
| HPV33 | L2 | 9 | 278 | DPDFLDIIA | 28490 |
| HPV33 | L2 | 10 | 278 | DPDFLDIIAL | 28491 |
| HPV33 | L2 | 8 | 261 | DPEDTLQF | 28492 |
| HPV33 | L2 | 9 | 77 | DPPTAAIPL | 28493 |
| HPV33 | L2 | 9 | 42 | DQILKYGSL | 28494 |
| HPV33 | L2 | 11 | 42 | DQILKYGSLGV | 28495 |
| HPV33 | L2 | 9 | 369 | DVDNVHTPM | 28496 |
| HPV33 | L2 | 11 | 30 | DVIPKVEGSTI | 28497 |
| HPV33 | L2 | 11 | 130 | DVTTSADTTPA | 28498 |
| HPV33 | L2 | 10 | 364 | DVYADDVDNV | 28499 |
| HPV33 | L2 | 9 | 165 | EPSVLHPPA | 28500 |
| HPV33 | L2 | 11 | 165 | EPSVLHPPAPA | 28501 |
| HPV33 | L2 | 8 | 341 | EQYELQPL | 28502 |
| HPV33 | L2 | 8 | 113 | FIEAGAPA | 28503 |
| HPV33 | L2 | 11 | 113 | FIEAGAPAPSI | 28504 |
| HPV33 | L2 | 8 | 181 | FIFSSPTV | 28505 |
| HPV33 | L2 | 10 | 447 | FILRRRKRF | 28506 |
| HPV33 | L2 | 11 | 281 | FLDIIALHRPA | 28507 |
| HPV33 | L2 | 8 | 242 | FLTSPHKL | 28508 |
| HPV33 | L2 | 9 | 242 | FLTSPHKLI | 28509 |

TABLE XIV-continued

B62 Supermotif Peptides

| Type | Protein | No. of Amino Acid | Position | Sequence | Seq. Id. No. |
|---|---|---|---|---|---|
| HPV33 | L2 | 11 | 242 | FLTSPHKLITY | 28510 |
| HPV33 | L2 | 8 | 428 | FPFDTIVV | 28511 |
| HPV33 | L2 | 11 | 428 | FPFDTIVVDGA | 28512 |
| HPV33 | L2 | 8 | 415 | FPTSSPFV | 28513 |
| HPV33 | L2 | 10 | 415 | FPTSSPFVPI | 28514 |
| HPV33 | L2 | 8 | 456 | FPYFFTDV | 28515 |
| HPV33 | L2 | 10 | 456 | FPYFFTDVRV | 28516 |
| HPV33 | L2 | 11 | 456 | FPYFFTDVRVA | 28517 |
| HPV33 | L2 | 9 | 268 | FQHSDISPA | 28518 |
| HPV33 | L2 | 8 | 440 | FVLHPSYF | 28519 |
| HPV33 | L2 | 9 | 440 | FVLHPSYFI | 28520 |
| HPV33 | L2 | 10 | 440 | FVLHPSYFIL | 28521 |
| HPV33 | L2 | 8 | 421 | FVPISPFF | 28522 |
| HPV33 | L2 | 10 | 421 | FVPISPFFPF | 28523 |
| HPV33 | L2 | 10 | 201 | FVVSTDSSNV | 28524 |
| HPV33 | L2 | 10 | 361 | GLYDVYADDV | 28525 |
| HPV33 | L2 | 10 | 226 | GLYSRNTQQV | 28526 |
| HPV33 | L2 | 8 | 407 | GPDIPSPL | 28527 |
| HPV33 | L2 | 9 | 407 | GPDIPSPLF | 28528 |
| HPV33 | L2 | 8 | 98 | GPLDSSIV | 28529 |
| HPV33 | L2 | 10 | 98 | GPLDSSIVSL | 28530 |
| HPV33 | L2 | 11 | 98 | GPLDSSIVSLI | 28531 |
| HPV33 | L2 | 9 | 51 | GVFFGGLGI | 28532 |
| HPV33 | L2 | 11 | 158 | HLNPTFTEPSV | 28533 |
| HPV33 | L2 | 8 | 170 | HPPAPAEA | 28534 |
| HPV33 | L2 | 8 | 284 | IIALHRPA | 28535 |
| HPV33 | L2 | 9 | 284 | IIALHRPAI | 28536 |
| HPV33 | L2 | 9 | 44 | ILKYGSLGV | 28537 |
| HPV33 | L2 | 10 | 44 | ILKYGSLGVF | 28538 |
| HPV33 | L2 | 11 | 44 | ILKYGSLGVFF | 28539 |
| HPV33 | L2 | 9 | 448 | ILRRRKRF | 28540 |
| HPV33 | L2 | 11 | 448 | ILRRRRKRFPY | 28541 |
| HPV33 | L2 | 8 | 216 | IPGSRPVA | 28542 |
| HPV33 | L2 | 10 | 216 | IPGSRPVARL | 28543 |
| HPV33 | L2 | 9 | 32 | IPKVEGSTI | 28544 |
| HPV33 | L2 | 10 | 32 | IPKVEGSTIA | 28545 |
| HPV33 | L2 | 11 | 394 | IPLNTGFDTPV | 28546 |
| HPV33 | L2 | 10 | 83 | IPLQPIRPPV | 28547 |
| HPV33 | L2 | 8 | 196 | IPMDTFVV | 28548 |
| HPV33 | L2 | 9 | 123 | IPTPSGFDV | 28549 |
| HPV33 | L2 | 8 | 152 | IQTISTHL | 28550 |
| HPV33 | L2 | 8 | 331 | IVPLDHTV | 28551 |
| HPV33 | L2 | 10 | 104 | IVSLIEETSF | 28552 |
| HPV33 | L2 | 11 | 104 | IVSLIEETSFI | 28553 |
| HPV33 | L2 | 8 | 433 | IVVDGADF | 28554 |
| HPV33 | L2 | 9 | 433 | IVVDGADFV | 28555 |
| HPV33 | L2 | 10 | 433 | IVVDGADFVL | 28556 |
| HPV33 | L2 | 9 | 248 | KLITYDNPA | 28557 |
| HPV33 | L2 | 10 | 248 | KLITYDNPAF | 28558 |
| HPV33 | L2 | 9 | 316 | KQIGARIHY | 28559 |
| HPV33 | L2 | 10 | 316 | KQIGARIHYY | 28560 |
| HPV33 | L2 | 8 | 34 | KVEGSTIA | 28561 |
| HPV33 | L2 | 11 | 34 | KVEGSTIADQI | 28562 |
| HPV33 | L2 | 8 | 236 | KVVDPAFL | 28563 |
| HPV33 | L2 | 8 | 107 | LIEETSFI | 28564 |
| HPV33 | L2 | 10 | 107 | LIEETSFIEA | 28565 |
| HPV33 | L2 | 8 | 249 | LITYDNPA | 28566 |
| HPV33 | L2 | 9 | 249 | LITYDNPAF | 28567 |
| HPV33 | L2 | 8 | 266 | LQFQHSDI | 28568 |
| HPV33 | L2 | 11 | 266 | LQFQHSDISPA | 28569 |
| HPV33 | L2 | 8 | 85 | LQPIRPPV | 28570 |
| HPV33 | L2 | 10 | 85 | LQPIRPPVTV | 28571 |
| HPV33 | L2 | 8 | 377 | MQHSYSTF | 28572 |
| HPV33 | L2 | 9 | 377 | MQHSYSTFA | 28573 |
| HPV33 | L2 | 8 | 195 | NIPMDTFV | 28574 |
| HPV33 | L2 | 9 | 195 | NIPMDTFVV | 28575 |
| HPV33 | L2 | 9 | 160 | NPTFTEPSV | 28576 |
| HPV33 | L2 | 10 | 160 | NPTFTEPSVL | 28577 |
| HPV33 | L2 | 10 | 372 | NVHTPMQHSY | 28578 |
| HPV33 | L2 | 10 | 391 | NVSIPLNTGF | 28579 |
| HPV33 | L2 | 10 | 143 | NVSSVGESSI | 28580 |
| HPV33 | L2 | 8 | 209 | NVTSSTPI | 28581 |
| HPV33 | L2 | 9 | 73 | PIGTDPPTA | 28582 |
| HPV33 | L2 | 10 | 73 | PIGTDPPTAA | 28583 |
| HPV33 | L2 | 11 | 73 | PIGTDPPTAAI | 28584 |

TABLE XIV-continued

B62 Supermotif Peptides

| Type | Protein | No. of Amino Acid | Position | Sequence | Seq. Id. No. |
|---|---|---|---|---|---|
| HPV33 | L2 | 8 | 215 | PIPGSRPV | 28585 |
| HPV33 | L2 | 9 | 215 | PIPGSRPVA | 28586 |
| HPV33 | L2 | 11 | 215 | PIPGSRPVARL | 28587 |
| HPV33 | L2 | 8 | 87 | PIRPPVTV | 28588 |
| HPV33 | L2 | 11 | 87 | PIRPPVTVDTV | 28589 |
| HPV33 | L2 | 8 | 423 | PISPFFPF | 28590 |
| HPV33 | L2 | 11 | 423 | PISPFFPFDTI | 28591 |
| HPV33 | L2 | 9 | 330 | PIVPLDHTV | 28592 |
| HPV33 | L2 | 11 | 333 | PLDHTVPNEQY | 28593 |
| HPV33 | L2 | 9 | 99 | PLDSSIVSL | 28594 |
| HPV33 | L2 | 10 | 99 | PLDSSIVSLI | 28595 |
| HPV33 | L2 | 9 | 413 | PLFPTSSPF | 28596 |
| HPV33 | L2 | 10 | 413 | PLFPTSSPFV | 28597 |
| HPV33 | L2 | 10 | 347 | PLHDTSTSSY | 28598 |
| HPV33 | L2 | 10 | 395 | PLNTGFDTPV | 28599 |
| HPV33 | L2 | 11 | 395 | PLNTGFDTPVM | 28600 |
| HPV33 | L2 | 9 | 84 | PLQPIRPPV | 28601 |
| HPV33 | L2 | 11 | 84 | PLQPIRPPVTV | 28602 |
| HPV33 | L2 | 9 | 376 | PMQHSYSTF | 28603 |
| HPV33 | L2 | 10 | 376 | PMQHSYSTFA | 28604 |
| HPV33 | L2 | 11 | 171 | PPAPAEASGHF | 28605 |
| HPV33 | L2 | 8 | 28 | PPDVIPKV | 28606 |
| HPV33 | L2 | 8 | 78 | PPTAAIPL | 28607 |
| HPV33 | L2 | 11 | 78 | PPTAAIPLQPI | 28608 |
| HPV33 | L2 | 8 | 90 | PPVTVDTV | 28609 |
| HPV33 | L2 | 11 | 90 | PPVTVDTVGPL | 28610 |
| HPV33 | L2 | 8 | 221 | PVARLGLY | 28611 |
| HPV33 | L2 | 8 | 403 | PVMSGPDI | 28612 |
| HPV33 | L2 | 10 | 91 | PVTVDTVGPL | 28613 |
| HPV33 | L2 | 8 | 317 | QIGARIHY | 28614 |
| HPV33 | L2 | 9 | 317 | QIGARIHYY | 28615 |
| HPV33 | L2 | 8 | 43 | QILKYGSL | 28616 |
| HPV33 | L2 | 10 | 43 | QILKYGSLGV | 28617 |
| HPV33 | L2 | 11 | 43 | QILKYGSLGVF | 28618 |
| HPV33 | L2 | 8 | 16 | QLYQTCKA | 28619 |
| HPV33 | L2 | 9 | 86 | QPIRPPVTV | 28620 |
| HPV33 | L2 | 11 | 346 | QPLHDTSTSSY | 28621 |
| HPV33 | L2 | 9 | 233 | QQVKVVDPA | 28622 |
| HPV33 | L2 | 10 | 233 | QQVKVVDPAF | 28623 |
| HPV33 | L2 | 11 | 233 | QQVKVVDPAFL | 28624 |
| HPV33 | L2 | 8 | 234 | QVKVVDPA | 28625 |
| HPV33 | L2 | 9 | 234 | QVKVVDPAF | 28626 |
| HPV33 | L2 | 10 | 234 | QVKVVDPAFL | 28627 |
| HPV33 | L2 | 8 | 321 | RIHYYQDL | 28628 |
| HPV33 | L2 | 11 | 321 | RIHYYQDLSPI | 28629 |
| HPV33 | L2 | 11 | 289 | RPAITSRRHTV | 28630 |
| HPV33 | L2 | 9 | 89 | RPPVTVDTV | 28631 |
| HPV33 | L2 | 8 | 220 | RPVARLGL | 28632 |
| HPV33 | L2 | 9 | 220 | RPVARLGLY | 28633 |
| HPV33 | L2 | 8 | 303 | RVGQKATL | 28634 |
| HPV33 | L2 | 9 | 357 | SINDGLYDV | 28635 |
| HPV33 | L2 | 10 | 357 | SINDGLYDVY | 28636 |
| HPV33 | L2 | 11 | 357 | SINDGLYDVYA | 28637 |
| HPV33 | L2 | 8 | 393 | SIPLNTGF | 28638 |
| HPV33 | L2 | 8 | 122 | SIPTPSGF | 28639 |
| HPV33 | L2 | 10 | 122 | SIPTPSGFDV | 28640 |
| HPV33 | L2 | 9 | 151 | SIQTISTHL | 28641 |
| HPV33 | L2 | 11 | 103 | SIVSLIEETSF | 28642 |
| HPV33 | L2 | 9 | 49 | SLGVFFGGL | 28643 |
| HPV33 | L2 | 11 | 49 | SLGVFFGGLGI | 28644 |
| HPV33 | L2 | 8 | 106 | SLIEETSF | 28645 |
| HPV33 | L2 | 9 | 106 | SLIEETSFI | 28646 |
| HPV33 | L2 | 11 | 106 | SLIEETSFIEA | 28647 |
| HPV33 | L2 | 8 | 274 | SPAPDPDF | 28648 |
| HPV33 | L2 | 9 | 274 | SPAPDPDFL | 28649 |
| HPV33 | L2 | 11 | 274 | SPAPDPDFLDI | 28650 |
| HPV33 | L2 | 9 | 425 | SPFFPFDTI | 28651 |
| HPV33 | L2 | 10 | 425 | SPFFPFDTIV | 28652 |
| HPV33 | L2 | 11 | 425 | SPFFPFDTIVV | 28653 |
| HPV33 | L2 | 9 | 419 | SPFVPISPF | 28654 |
| HPV33 | L2 | 10 | 419 | SPFVPISPFF | 28655 |
| HPV33 | L2 | 8 | 245 | SPHKLITY | 28656 |
| HPV33 | L2 | 10 | 329 | SPIVPLDHTV | 28657 |
| HPV33 | L2 | 10 | 412 | SPLFPTSSPF | 28658 |
| HPV33 | L2 | 11 | 412 | SPLFPTSSPFV | 28659 |

TABLE XIV-continued

B62 Supermotif Peptides

| Type | Protein | No. of Amino Acid | Position | Sequence | Seq. Id. No. |
|---|---|---|---|---|---|
| HPV33 | L2 | 9 | 185 | SPTVSTQSY | 28660 |
| HPV33 | L2 | 10 | 146 | SVGESSIQTI | 28661 |
| HPV33 | L2 | 9 | 167 | SVLHPPAPA | 28662 |
| HPV33 | L2 | 11 | 167 | SVLHPPAPAEA | 28663 |
| HPV33 | L2 | 9 | 39 | TIADQILKY | 28664 |
| HPV33 | L2 | 10 | 154 | TISTHLNPTF | 28665 |
| HPV33 | L2 | 9 | 432 | TIVVDGADF | 28666 |
| HPV33 | L2 | 10 | 432 | TIVVDGADFV | 28667 |
| HPV33 | L2 | 11 | 432 | TIVVDGADFVL | 28668 |
| HPV33 | L2 | 10 | 309 | TLKTRSGKQI | 28669 |
| HPV33 | L2 | 9 | 265 | TLQFQHSDI | 28670 |
| HPV33 | L2 | 10 | 138 | TPAIINVSSV | 28671 |
| HPV33 | L2 | 9 | 214 | TPIPGSRPV | 28672 |
| HPV33 | L2 | 10 | 214 | TPIPGSRPVA | 28673 |
| HPV33 | L2 | 10 | 375 | TPMQHSYSTF | 28674 |
| HPV33 | L2 | 11 | 375 | TPMQHSYSTFA | 28675 |
| HPV33 | L2 | 11 | 125 | TPSGFDVTTSA | 28676 |
| HPV33 | L2 | 9 | 402 | TPVMSGPDI | 28677 |
| HPV33 | L2 | 9 | 15 | TQLYQTCKA | 28678 |
| HPV33 | L2 | 10 | 232 | TQQVKVVDPA | 28679 |
| HPV33 | L2 | 11 | 232 | TQQVKVVDPAF | 28680 |
| HPV33 | L2 | 9 | 190 | TQSYENIPM | 28681 |
| HPV33 | L2 | 8 | 93 | TVDTVGPL | 28682 |
| HPV33 | L2 | 9 | 96 | TVGPLDSSI | 28683 |
| HPV33 | L2 | 10 | 96 | TVGPLDSSIV | 28684 |
| HPV33 | L2 | 9 | 337 | TVPNEQYEL | 28685 |
| HPV33 | L2 | 11 | 298 | TVRFSRVGQKA | 28686 |
| HPV33 | L2 | 10 | 187 | TVSTQSYENI | 28687 |
| HPV33 | L2 | 10 | 31 | VIPKVEGSTI | 28688 |
| HPV33 | L2 | 11 | 31 | VIPKVEGSTIA | 28689 |
| HPV33 | L2 | 8 | 168 | VLHPPAPA | 28690 |
| HPV33 | L2 | 10 | 168 | VLHPPAPAEA | 28691 |
| HPV33 | L2 | 8 | 441 | VLHPSYFI | 28692 |
| HPV33 | L2 | 9 | 441 | VLHPSYFIL | 28693 |
| HPV33 | L2 | 11 | 404 | VMSGPDIPSPL | 28694 |
| HPV33 | L2 | 10 | 72 | VPIGTDPPTA | 28695 |
| HPV33 | L2 | 11 | 72 | VPIGTDPPTAA | 28696 |
| HPV33 | L2 | 9 | 422 | VPISPFFPF | 28697 |
| HPV33 | L2 | 8 | 338 | VPNEQYEL | 28698 |
| HPV33 | L2 | 11 | 338 | VPNEQYELQPL | 28699 |
| HPV33 | L2 | 8 | 434 | VVDGADFV | 28700 |
| HPV33 | L2 | 9 | 434 | VVDGADFVL | 28701 |
| HPV33 | L2 | 9 | 202 | VVSTDSSNV | 28702 |
| HPV33 | L2 | 8 | 325 | YQDLSPIV | 28703 |
| HPV33 | L2 | 10 | 325 | YQDLSPIVPL | 28704 |
| HPV33 | L2 | 11 | 71 | YVPIGTDPPTA | 28705 |
| HPV45 | E1 | 9 | 232 | AIFGVNPTV | 28706 |
| HPV45 | E1 | 10 | 232 | AIFGVNPTVA | 28707 |
| HPV45 | E1 | 9 | 532 | ALDGNPISI | 28708 |
| HPV45 | E1 | 8 | 68 | ALFHAQEV | 28709 |
| HPV45 | E1 | 9 | 311 | ALYWYRTGI | 28710 |
| HPV45 | E1 | 9 | 199 | AMLAVFKDI | 28711 |
| HPV45 | E1 | 10 | 199 | AMLAVFKDIY | 28712 |
| HPV45 | E1 | 11 | 512 | AMLDDATHTCW | 28713 |
| HPV45 | E1 | 10 | 66 | AQALFHAQEV | 28714 |
| HPV45 | E1 | 8 | 72 | AQEVQNDA | 28715 |
| HPV45 | E1 | 10 | 72 | AQEVQNDAQV | 28716 |
| HPV45 | E1 | 11 | 72 | AQEVQNDAQVL | 28717 |
| HPV45 | E1 | 8 | 408 | AQKRQMNM | 28718 |
| HPV45 | E1 | 11 | 408 | AQKRQMNMSQW | 28719 |
| HPV45 | E1 | 10 | 373 | AQLADCNSNA | 28720 |
| HPV45 | E1 | 11 | 373 | AQLADCNSNAA | 28721 |
| HPV45 | E1 | 11 | 79 | AQVLHLLKRKF | 28722 |
| HPV45 | E1 | 9 | 202 | AVFKDIYGL | 28723 |
| HPV45 | E1 | 11 | 202 | AVFKDIYGLSF | 28724 |
| HPV45 | E1 | 10 | 399 | AVMCRHYKRA | 28725 |
| HPV45 | E1 | 8 | 465 | CILLYGPA | 28726 |
| HPV45 | E1 | 8 | 259 | CLDCKWGV | 28727 |
| HPV45 | E1 | 9 | 259 | CLDCKWGVL | 28728 |
| HPV45 | E1 | 10 | 259 | CLDCKWGVLI | 28729 |
| HPV45 | E1 | 11 | 259 | CLDCKWGVLIL | 28730 |
| HPV45 | E1 | 9 | 297 | CMLIEPPKL | 28731 |
| HPV45 | E1 | 10 | 552 | CPPILLTSNI | 28732 |
| HPV45 | E1 | 10 | 390 | CQAKYLKDCA | 28733 |
| HPV45 | E1 | 11 | 390 | CQAKYLKDCAV | 28734 |

TABLE XIV-continued

B62 Supermotif Peptides

| Type | Protein | No. of Amino Acid | Position | Sequence | Seq. Id. No. |
|---|---|---|---|---|---|
| HPV45 | E1 | 10 | 634 | CVTGQNTRPL | 28735 |
| HPV45 | E1 | 10 | 206 | DIYGLSFTDL | 28736 |
| HPV45 | E1 | 11 | 206 | DIYGLSFTDLV | 28737 |
| HPV45 | E1 | 9 | 614 | DLHEDDEDA | 28738 |
| HPV45 | E1 | 8 | 349 | DLSDMVQW | 28739 |
| HPV45 | E1 | 9 | 349 | DLSDMVQWA | 28740 |
| HPV45 | E1 | 10 | 349 | DLSDMVQWAF | 28741 |
| HPV45 | E1 | 9 | 108 | DLSPRLQEI | 28742 |
| HPV45 | E1 | 11 | 108 | DLSPRLQEISL | 28743 |
| HPV45 | E1 | 8 | 361 | DLTDESDM | 28744 |
| HPV45 | E1 | 9 | 361 | DLTDESDMA | 28745 |
| HPV45 | E1 | 10 | 361 | DLTDESDMAF | 28746 |
| HPV45 | E1 | 9 | 367 | DMAFQYAQL | 28747 |
| HPV45 | E1 | 10 | 367 | DMAFQYAQLA | 28748 |
| HPV45 | E1 | 10 | 46 | DMVDFIDTQL | 28749 |
| HPV45 | E1 | 11 | 352 | DMVQWAFDNDL | 28750 |
| HPV45 | E1 | 8 | 562 | DPAKDNKW | 28751 |
| HPV45 | E1 | 10 | 562 | DPAKDNKWPY | 28752 |
| HPV45 | E1 | 11 | 562 | DPAKDNKWPYL | 28753 |
| HPV45 | E1 | 9 | 179 | DPHCSITEL | 28754 |
| HPV45 | E1 | 11 | 30 | DVISDDEDETA | 28755 |
| HPV45 | E1 | 10 | 596 | EINDKNWKCF | 28756 |
| HPV45 | E1 | 11 | 596 | EINDKNWKCFF | 28757 |
| HPV45 | E1 | 11 | 115 | EISLNSGHKKA | 28758 |
| HPV45 | E1 | 8 | 186 | ELKELLQA | 28759 |
| HPV45 | E1 | 10 | 189 | ELLQASNKKA | 28760 |
| HPV45 | E1 | 11 | 189 | ELLQASNKKAA | 28761 |
| HPV45 | E1 | 8 | 504 | EPLADTKV | 28762 |
| HPV45 | E1 | 9 | 504 | EPLADTKVA | 28763 |
| HPV45 | E1 | 10 | 504 | EPLADTKVAM | 28764 |
| HPV45 | E1 | 11 | 504 | EPLADTKVAML | 28765 |
| HPV45 | E1 | 9 | 301 | EPPKLRSSV | 28766 |
| HPV45 | E1 | 10 | 301 | EPPKLRSSVA | 28767 |
| HPV45 | E1 | 11 | 301 | EPPKLRSSVAA | 28768 |
| HPV45 | E1 | 8 | 59 | EQAEQETA | 28769 |
| HPV45 | E1 | 10 | 59 | EQAEQETAQA | 28770 |
| HPV45 | E1 | 11 | 59 | EQAEQETAQAL | 28771 |
| HPV45 | E1 | 8 | 62 | EQETAQAL | 28772 |
| HPV45 | E1 | 9 | 62 | EQETAQALF | 28773 |
| HPV45 | E1 | 11 | 62 | EQETAQALFHA | 28774 |
| HPV45 | E1 | 9 | 101 | EQLSVDTDL | 28775 |
| HPV45 | E1 | 9 | 141 | EVEAAETQV | 28776 |
| HPV45 | E1 | 11 | 141 | EVEAAETQVTV | 28777 |
| HPV45 | E1 | 8 | 74 | EVQNDAQV | 28778 |
| HPV45 | E1 | 9 | 74 | EVQNDAQVL | 28779 |
| HPV45 | E1 | 11 | 74 | EVQNDAQVLHL | 28780 |
| HPV45 | E1 | 9 | 324 | EVSGDTPEW | 28781 |
| HPV45 | E1 | 10 | 324 | EVSGDTPEWI | 28782 |
| HPV45 | E1 | 8 | 50 | FIDTQLSI | 28783 |
| HPV45 | E1 | 8 | 483 | FIHFLQGA | 28784 |
| HPV45 | E1 | 9 | 483 | FIHFLQGAI | 28785 |
| HPV45 | E1 | 10 | 483 | FIHFLQGAII | 28786 |
| HPV45 | E1 | 8 | 446 | FISFLRAL | 28787 |
| HPV45 | E1 | 11 | 446 | FISFLRALKEF | 28788 |
| HPV45 | E1 | 11 | 456 | FLKGTPKKNCI | 28789 |
| HPV45 | E1 | 8 | 385 | FLKSNCQA | 28790 |
| HPV45 | E1 | 10 | 385 | FLKSNCQAKY | 28791 |
| HPV45 | E1 | 11 | 385 | FLKSNCQAKYL | 28792 |
| HPV45 | E1 | 9 | 486 | FLQGAIISF | 28793 |
| HPV45 | E1 | 10 | 486 | FLQGAIISFV | 28794 |
| HPV45 | E1 | 8 | 449 | FLRALKEF | 28795 |
| HPV45 | E1 | 9 | 449 | FLRALKEFL | 28796 |
| HPV45 | E1 | 9 | 438 | FLRYQGVEF | 28797 |
| HPV45 | E1 | 10 | 438 | FLRYQGVEFI | 28798 |
| HPV45 | E1 | 10 | 585 | FPFDKNGNPV | 28799 |
| HPV45 | E1 | 11 | 585 | FPFDKNGNPVY | 28800 |
| HPV45 | E1 | 8 | 494 | FVNSNSHF | 28801 |
| HPV45 | E1 | 9 | 494 | FVNSNSHFW | 28802 |
| HPV45 | E1 | 10 | 494 | FVNSNSHFWL | 28803 |
| HPV45 | E1 | 9 | 342 | GIDDSNFDL | 28804 |
| HPV45 | E1 | 10 | 626 | GIPFGTFKCV | 28805 |
| HPV45 | E1 | 8 | 318 | GISNISEV | 28806 |
| HPV45 | E1 | 8 | 209 | GLSFTDLV | 28807 |
| HPV45 | E1 | 11 | 209 | GLSFTDLVRNF | 28808 |
| HPV45 | E1 | 8 | 286 | GLSTLLHV | 28809 |

TABLE XIV-continued

B62 Supermotif Peptides

| Type | Protein | No. of Amino Acid | Position | Sequence | Seq. Id. No. |
|---|---|---|---|---|---|
| HPV45 | E1 | 8 | 480 | GMSFIHFL | 28810 |
| HPV45 | E1 | 11 | 480 | GMSFIHFLQGA | 28811 |
| HPV45 | E1 | 9 | 470 | GPANTGKSY | 28812 |
| HPV45 | E1 | 10 | 470 | GPANTGKSYF | 28813 |
| HPV45 | E1 | 8 | 443 | GVEFISFL | 28814 |
| HPV45 | E1 | 10 | 443 | GVEFISFLRA | 28815 |
| HPV45 | E1 | 11 | 443 | GVEFISFLRAL | 28816 |
| HPV45 | E1 | 8 | 265 | GVLILALL | 28817 |
| HPV45 | E1 | 10 | 265 | GVLILALLRY | 28818 |
| HPV45 | E1 | 10 | 235 | GVNPTVAEGF | 28819 |
| HPV45 | E1 | 9 | 256 | HIQCLDCKW | 28820 |
| HPV45 | E1 | 11 | 256 | HIQCLDCKWGV | 28821 |
| HPV45 | E1 | 8 | 83 | HLLKRKFA | 28822 |
| HPV45 | E1 | 8 | 292 | HVPETCML | 28823 |
| HPV45 | E1 | 9 | 292 | HVPETCMLI | 28824 |
| HPV45 | E1 | 11 | 338 | IIQHGIDDSNF | 28825 |
| HPV45 | E1 | 11 | 491 | IISFVNSNSHF | 28826 |
| HPV45 | E1 | 10 | 555 | ILLTSNIDPA | 28827 |
| HPV45 | E1 | 9 | 627 | IPFGTFKCV | 28828 |
| HPV45 | E1 | 8 | 257 | IQCLDCKW | 28829 |
| HPV45 | E1 | 10 | 257 | IQCLDCKWGV | 28830 |
| HPV45 | E1 | 11 | 257 | IQCLDCKWGVL | 28831 |
| HPV45 | E1 | 10 | 339 | IQHGIDDSNF | 28832 |
| HPV45 | E1 | 11 | 333 | IQRLTIIQHGI | 28833 |
| HPV45 | E1 | 9 | 23 | IVEKKTGDV | 28834 |
| HPV45 | E1 | 10 | 23 | IVEKKTGDVI | 28835 |
| HPV45 | E1 | 10 | 435 | IVQFLRYQGV | 28836 |
| HPV45 | E1 | 8 | 425 | KIDEGGDW | 28837 |
| HPV45 | E1 | 11 | 425 | KIDEGGDWRPI | 28838 |
| HPV45 | E1 | 8 | 304 | KLRSSVAA | 28839 |
| HPV45 | E1 | 9 | 304 | KLRSSVAAL | 28840 |
| HPV45 | E1 | 10 | 304 | KLRSSVAALY | 28841 |
| HPV45 | E1 | 11 | 304 | KLRSSVAALYW | 28842 |
| HPV45 | E1 | 9 | 249 | KPATLYAHI | 28843 |
| HPV45 | E1 | 11 | 545 | KPLLQLKCPPI | 28844 |
| HPV45 | E1 | 8 | 510 | KVAMLDDA | 28845 |
| HPV45 | E1 | 11 | 299 | LIEPPKLRSSV | 28846 |
| HPV45 | E1 | 8 | 247 | LIKPATLY | 28847 |
| HPV45 | E1 | 9 | 247 | LIKPATLYA | 28848 |
| HPV45 | E1 | 11 | 247 | LIKPATLYAHI | 28849 |
| HPV45 | E1 | 8 | 267 | LILALLRY | 28850 |
| HPV45 | E1 | 9 | 290 | LLHVPETCM | 28851 |
| HPV45 | E1 | 10 | 290 | LLHVPETCML | 28852 |
| HPV45 | E1 | 11 | 290 | LLHVPETCMLI | 28853 |
| HPV45 | E1 | 9 | 190 | LLQASNKKA | 28854 |
| HPV45 | E1 | 10 | 190 | LLQASNKKAA | 28855 |
| HPV45 | E1 | 11 | 190 | LLQASNKKAAM | 28856 |
| HPV45 | E1 | 9 | 547 | LLQLKCPPI | 28857 |
| HPV45 | E1 | 10 | 547 | LLQLKCPPIL | 28858 |
| HPV45 | E1 | 11 | 547 | LLQLKCPPILL | 28859 |
| HPV45 | E1 | 11 | 271 | LLRYKCGKNRL | 28860 |
| HPV45 | E1 | 9 | 556 | LLTSNIDPA | 28861 |
| HPV45 | E1 | 8 | 191 | LQASNKKA | 28862 |
| HPV45 | E1 | 9 | 191 | LQASNKKAA | 28863 |
| HPV45 | E1 | 10 | 191 | LQASNKKAAM | 28864 |
| HPV45 | E1 | 11 | 191 | LQASNKKAAML | 28865 |
| HPV45 | E1 | 8 | 487 | LQGAIISF | 28866 |
| HPV45 | E1 | 9 | 487 | LQGAIISFV | 28867 |
| HPV45 | E1 | 8 | 548 | LQLKCPPI | 28868 |
| HPV45 | E1 | 9 | 548 | LQLKCPPIL | 28869 |
| HPV45 | E1 | 10 | 548 | LQLKCPPILL | 28870 |
| HPV45 | E1 | 8 | 200 | MLAVFKDI | 28871 |
| HPV45 | E1 | 9 | 200 | MLAVFKDIY | 28872 |
| HPV45 | E1 | 11 | 200 | MLAVFKDIYGL | 28873 |
| HPV45 | E1 | 10 | 513 | MLDDATHTCW | 28874 |
| HPV45 | E1 | 8 | 298 | MLIEPPKL | 28875 |
| HPV45 | E1 | 9 | 47 | MVDFIDTQL | 28876 |
| HPV45 | E1 | 11 | 47 | MVDFIDTQLSI | 28877 |
| HPV45 | E1 | 10 | 353 | MVQWAFDNDL | 28878 |
| HPV45 | E1 | 10 | 560 | NIDPAKDNKW | 28879 |
| HPV45 | E1 | 8 | 414 | NMSQWIKY | 28880 |
| HPV45 | E1 | 8 | 237 | NPTVAEGF | 28881 |
| HPV45 | E1 | 11 | 237 | NPTVAEGFKTL | 28882 |
| HPV45 | E1 | 11 | 592 | NPVYEINDKNW | 28883 |
| HPV45 | E1 | 8 | 177 | NVDPHCSI | 28884 |

TABLE XIV-continued

B62 Supermotif Peptides

| Type | Protein | No. of Amino Acid | Position | Sequence | Seq. Id. No. |
|---|---|---|---|---|---|
| HPV45 | E1 | 11 | 177 | NVDPHCSITEL | 28885 |
| HPV45 | E1 | 8 | 554 | PILLTSNI | 28886 |
| HPV45 | E1 | 11 | 554 | PILLTSNIDPA | 28887 |
| HPV45 | E1 | 11 | 537 | PISIDRKHKPL | 28888 |
| HPV45 | E1 | 8 | 434 | PIVQFLRY | 28889 |
| HPV45 | E1 | 11 | 434 | PIVQFLRYQGV | 28890 |
| HPV45 | E1 | 8 | 505 | PLADTKVA | 28891 |
| HPV45 | E1 | 9 | 505 | PLADTKVAM | 28892 |
| HPV45 | E1 | 10 | 505 | PLADTKVAML | 28893 |
| HPV45 | E1 | 8 | 98 | PLGEQLSV | 28894 |
| HPV45 | E1 | 10 | 546 | PLLQLKCPPI | 28895 |
| HPV45 | E1 | 11 | 546 | PLLQLKCPPIL | 28896 |
| HPV45 | E1 | 9 | 553 | PPILLTSNI | 28897 |
| HPV45 | E1 | 8 | 302 | PPKLRSSV | 28898 |
| HPV45 | E1 | 9 | 302 | PPKLRSSVA | 28899 |
| HPV45 | E1 | 10 | 302 | PPKLRSSVAA | 28900 |
| HPV45 | E1 | 11 | 302 | PPKLRSSVAAL | 28901 |
| HPV45 | E1 | 10 | 593 | PVYEINDKNW | 28902 |
| HPV45 | E1 | 9 | 374 | QLADCNSNA | 28903 |
| HPV45 | E1 | 10 | 374 | QLADCNSNAA | 28904 |
| HPV45 | E1 | 11 | 374 | QLADCNSNAAA | 28905 |
| HPV45 | E1 | 8 | 549 | QLKCPPIL | 28906 |
| HPV45 | E1 | 9 | 549 | QLKCPPILL | 28907 |
| HPV45 | E1 | 8 | 54 | QLSICEQA | 28908 |
| HPV45 | E1 | 8 | 102 | QLSVDTDL | 28909 |
| HPV45 | E1 | 8 | 412 | QMNMSQWI | 28910 |
| HPV45 | E1 | 10 | 412 | QMNMSQWIKY | 28911 |
| HPV45 | E1 | 10 | 80 | QVLHLLRKF | 28912 |
| HPV45 | E1 | 11 | 80 | QVLHLLRKFA | 28913 |
| HPV45 | E1 | 8 | 148 | QVTVNTNA | 28914 |
| HPV45 | E1 | 11 | 612 | RLDLHEDDEDA | 28915 |
| HPV45 | E1 | 10 | 128 | RLFTISDSGY | 28916 |
| HPV45 | E1 | 9 | 335 | RLTIIQHGI | 28917 |
| HPV45 | E1 | 8 | 280 | RLTVAKGL | 28918 |
| HPV45 | E1 | 11 | 280 | RLTVAKGLSTL | 28919 |
| HPV45 | E1 | 9 | 433 | RPIVQFLRY | 28920 |
| HPV45 | E1 | 8 | 411 | RQMNMSQW | 28921 |
| HPV45 | E1 | 9 | 411 | RQMNMSQWI | 28922 |
| HPV45 | E1 | 11 | 411 | RQMNMSQWIKY | 28923 |
| HPV45 | E1 | 10 | 575 | RVTVFTFPHA | 28924 |
| HPV45 | E1 | 11 | 575 | RVTVFTFPHAF | 28925 |
| HPV45 | E1 | 11 | 56 | SICEQAEQETA | 28926 |
| HPV45 | E1 | 9 | 539 | SIDRKHKPL | 28927 |
| HPV45 | E1 | 10 | 539 | SIDRKHKPLL | 28928 |
| HPV45 | E1 | 8 | 183 | SITELKEL | 28929 |
| HPV45 | E1 | 9 | 183 | SITELKELL | 28930 |
| HPV45 | E1 | 11 | 183 | SITELKELLQA | 28931 |
| HPV45 | E1 | 9 | 117 | SLNSGHKKA | 28932 |
| HPV45 | E1 | 9 | 97 | SPLGEQLSV | 28933 |
| HPV45 | E1 | 9 | 110 | SPRLQEISL | 28934 |
| HPV45 | E1 | 11 | 416 | SQWIKYRCSKI | 28935 |
| HPV45 | E1 | 8 | 308 | SVAALYWY | 28936 |
| HPV45 | E1 | 10 | 104 | SVDTDLSPRL | 28937 |
| HPV45 | E1 | 10 | 22 | TIVEKKTGDV | 28938 |
| HPV45 | E1 | 11 | 22 | TIVEKKTGDVI | 28939 |
| HPV45 | E1 | 8 | 246 | TLIKPATL | 28940 |
| HPV45 | E1 | 9 | 246 | TLIKPATLY | 28941 |
| HPV45 | E1 | 10 | 246 | TLIKPATLYA | 28942 |
| HPV45 | E1 | 10 | 289 | TLLHVPETCM | 28943 |
| HPV45 | E1 | 11 | 289 | TLLHVPETCML | 28944 |
| HPV45 | E1 | 9 | 252 | TLYAHIQCL | 28945 |
| HPV45 | E1 | 8 | 329 | TPEWIQRL | 28946 |
| HPV45 | E1 | 10 | 329 | TPEWIQRLTI | 28947 |
| HPV45 | E1 | 11 | 329 | TPEWIQRLTII | 28948 |
| HPV45 | E1 | 8 | 460 | TPKKNCIL | 28949 |
| HPV45 | E1 | 9 | 460 | TPKKNCILL | 28950 |
| HPV45 | E1 | 10 | 460 | TPKKNCILLY | 28951 |
| HPV45 | E1 | 9 | 53 | TQLSICEQA | 28952 |
| HPV45 | E1 | 9 | 147 | TQVTVNTNA | 28953 |
| HPV45 | E1 | 9 | 239 | TVAEGFKTL | 28954 |
| HPV45 | E1 | 10 | 239 | TVAEGFKTLI | 28955 |
| HPV45 | E1 | 9 | 282 | TVAKGLSTL | 28956 |
| HPV45 | E1 | 10 | 282 | TVAKGLSTLL | 28957 |
| HPV45 | E1 | 8 | 577 | TVFTFPHA | 28958 |
| HPV45 | E1 | 9 | 577 | TVFTFPHAF | 28959 |

TABLE XIV-continued

B62 Supermotif Peptides

| Type | Protein | No. of Amino Acid | Position | Sequence | Seq. Id. No. |
|---|---|---|---|---|---|
| HPV45 | E1 | 11 | 577 | TVFTFPHAFPF | 28960 |
| HPV45 | E1 | 10 | 31 | VISDDEDETA | 28961 |
| HPV45 | E1 | 9 | 81 | VLHLLKRKF | 28962 |
| HPV45 | E1 | 10 | 81 | VLHLLKRKFA | 28963 |
| HPV45 | E1 | 9 | 266 | VLILALLRY | 28964 |
| HPV45 | E1 | 11 | 230 | VMAIFGVNPTV | 28965 |
| HPV45 | E1 | 9 | 400 | VMCRHYKRA | 28966 |
| HPV45 | E1 | 8 | 293 | VPETCMLI | 28967 |
| HPV45 | E1 | 9 | 436 | VQFLRYQGV | 28968 |
| HPV45 | E1 | 11 | 436 | VQFLRYQGVEF | 28969 |
| HPV45 | E1 | 8 | 75 | VQNDAQVL | 28970 |
| HPV45 | E1 | 10 | 75 | VQNDAQVLHL | 28971 |
| HPV45 | E1 | 11 | 75 | VQNDAQVLHLL | 28972 |
| HPV45 | E1 | 9 | 354 | VQWAFDNDL | 28973 |
| HPV45 | E1 | 9 | 418 | WIKYRCSKI | 28974 |
| HPV45 | E1 | 8 | 332 | WIQRLTII | 28975 |
| HPV45 | E1 | 10 | 502 | WLEPLADTKV | 28976 |
| HPV45 | E1 | 11 | 502 | WLEPLADTKVA | 28977 |
| HPV45 | E1 | 8 | 569 | WPYLESRV | 28978 |
| HPV45 | E1 | 10 | 569 | WPYLESRVTV | 28979 |
| HPV45 | E1 | 11 | 569 | WPYLESRVTVF | 28980 |
| HPV45 | E1 | 8 | 229 | WVMAIFGV | 28981 |
| HPV45 | E1 | 8 | 571 | YLESRVTV | 28982 |
| HPV45 | E1 | 9 | 571 | YLESRVTVF | 28983 |
| HPV45 | E1 | 11 | 571 | YLESRVTVFTF | 28984 |
| HPV45 | E1 | 8 | 394 | YLKDCAVM | 28985 |
| HPV45 | E1 | 11 | 528 | YMRNALDGNPI | 28986 |
| HPV45 | E1 | 9 | 441 | YQGVEFISF | 28987 |
| HPV45 | E1 | 10 | 441 | YQGVEFISFL | 28988 |
| HPV45 | E2 | 8 | 78 | AIELQMAL | 28989 |
| HPV45 | E2 | 11 | 78 | AIELQMALKGL | 28990 |
| HPV45 | E2 | 11 | 47 | AILFTAREHGI | 28991 |
| HPV45 | E2 | 10 | 84 | ALKGLAQSKY | 28992 |
| HPV45 | E2 | 10 | 16 | ALQDKILDHY | 28993 |
| HPV45 | E2 | 10 | 89 | AQSKYNNEEW | 28994 |
| HPV45 | E2 | 9 | 305 | CLRYRLRKY | 28995 |
| HPV45 | E2 | 10 | 305 | CLRYRLRKYA | 28996 |
| HPV45 | E2 | 10 | 134 | CMNYVVWDSI | 28997 |
| HPV45 | E2 | 11 | 134 | CMNYVVWDSIY | 28998 |
| HPV45 | E2 | 8 | 158 | CVSYWGVY | 28999 |
| HPV45 | E2 | 9 | 158 | CVSYWGVYY | 29000 |
| HPV45 | E2 | 10 | 158 | CVSYWGVYYI | 29001 |
| HPV45 | E2 | 8 | 31 | DINSQISY | 29002 |
| HPV45 | E2 | 9 | 31 | DINSQISYW | 29003 |
| HPV45 | E2 | 11 | 31 | DINSQISYWQL | 29004 |
| HPV45 | E2 | 9 | 351 | DVVTIPNSV | 29005 |
| HPV45 | E2 | 11 | 351 | DVVTIPNSVQI | 29006 |
| HPV45 | E2 | 8 | 319 | EISSTWHW | 29007 |
| HPV45 | E2 | 9 | 80 | ELQMALKGL | 29008 |
| HPV45 | E2 | 10 | 80 | ELQMALKGLA | 29009 |
| HPV45 | E2 | 11 | 106 | ELWNTEPSQCF | 29010 |
| HPV45 | E2 | 11 | 258 | EQHHGRVNTHV | 29011 |
| HPV45 | E2 | 8 | 343 | EVQRNTFL | 29012 |
| HPV45 | E2 | 10 | 343 | EVQRNTFLDV | 29013 |
| HPV45 | E2 | 11 | 343 | EVQRNTFLDVV | 29014 |
| HPV45 | E2 | 8 | 192 | EVQYGGNV | 29015 |
| HPV45 | E2 | 9 | 192 | EVQYGGNVI | 29016 |
| HPV45 | E2 | 11 | 349 | FLDVVTIPNSV | 29017 |
| HPV45 | E2 | 11 | 334 | GILTVTYNSEV | 29018 |
| HPV45 | E2 | 9 | 56 | GITKLNHQV | 29019 |
| HPV45 | E2 | 10 | 56 | GITKLNHQVV | 29020 |
| HPV45 | E2 | 8 | 150 | GIWDKTAA | 29021 |
| HPV45 | E2 | 10 | 150 | GIWDKTAACV | 29022 |
| HPV45 | E2 | 10 | 255 | GLTEQHHGRV | 29023 |
| HPV45 | E2 | 9 | 295 | HLKGDKNSL | 29024 |
| HPV45 | E2 | 9 | 62 | HQVVPPINI | 29025 |
| HPV45 | E2 | 11 | 293 | IIHLKGDKNSL | 29026 |
| HPV45 | E2 | 10 | 48 | ILFTAREHGI | 29027 |
| HPV45 | E2 | 10 | 335 | ILTVTYNSEV | 29028 |
| HPV45 | E2 | 9 | 355 | IPNSVQISV | 29029 |
| HPV45 | E2 | 11 | 355 | IPNSVQISVGY | 29030 |
| HPV45 | E2 | 8 | 219 | IVRQLQHA | 29031 |
| HPV45 | E2 | 10 | 59 | KLNHQVVPPI | 29032 |
| HPV45 | E2 | 9 | 2 | KMQTPKESL | 29033 |
| HPV45 | E2 | 8 | 240 | KPHIQTPA | 29034 |

TABLE XIV-continued

B62 Supermotif Peptides

| Type | Protein | No. of Amino Acid | Position | Sequence | Seq. Id. No. |
|---|---|---|---|---|---|
| HPV45 | E2 | 10 | 284 | KVCSGNTTPI | 29035 |
| HPV45 | E2 | 11 | 284 | KVCSGNTTPII | 29036 |
| HPV45 | E2 | 8 | 41 | LIRLENAI | 29037 |
| HPV45 | E2 | 9 | 41 | LIRLENAIL | 29038 |
| HPV45 | E2 | 10 | 41 | LIRLENAILF | 29039 |
| HPV45 | E2 | 9 | 17 | LQDKILDHY | 29040 |
| HPV45 | E2 | 8 | 100 | LQDTCEEL | 29041 |
| HPV45 | E2 | 9 | 100 | LQDTCEELW | 29042 |
| HPV45 | E2 | 8 | 81 | LQMALKGL | 29043 |
| HPV45 | E2 | 9 | 81 | LQMALKGLA | 29044 |
| HPV45 | E2 | 8 | 3 | MQTPKESL | 29045 |
| HPV45 | E2 | 10 | 69 | NISKSKAHKA | 29046 |
| HPV45 | E2 | 11 | 69 | NISKSKAHKAI | 29047 |
| HPV45 | E2 | 9 | 198 | NVIDCNDSM | 29048 |
| HPV45 | E2 | 9 | 67 | PINISKSKA | 29049 |
| HPV45 | E2 | 10 | 66 | PPINISKSKA | 29050 |
| HPV45 | E2 | 9 | 360 | QISVGYMTI | 29051 |
| HPV45 | E2 | 8 | 35 | QISYWQLI | 29052 |
| HPV45 | E2 | 10 | 35 | QISYWQLIRL | 29053 |
| HPV45 | E2 | 9 | 218 | QIVRQLQHA | 29054 |
| HPV45 | E2 | 8 | 40 | QLIRLENA | 29055 |
| HPV45 | E2 | 9 | 40 | QLIRLENAI | 29056 |
| HPV45 | E2 | 10 | 40 | QLIRLENAIL | 29057 |
| HPV45 | E2 | 11 | 40 | QLIRLENAILF | 29058 |
| HPV45 | E2 | 8 | 82 | QMALKGLA | 29059 |
| HPV45 | E2 | 8 | 63 | QVVPPINI | 29060 |
| HPV45 | E2 | 8 | 43 | RLENAILF | 29061 |
| HPV45 | E2 | 10 | 43 | RLENAILFTA | 29062 |
| HPV45 | E2 | 9 | 309 | RLRKYADHY | 29063 |
| HPV45 | E2 | 9 | 13 | RLSALQDKI | 29064 |
| HPV45 | E2 | 10 | 13 | RLSALQDKIL | 29065 |
| HPV45 | E2 | 10 | 263 | RVNTHVHNPL | 29066 |
| HPV45 | E2 | 11 | 263 | RVNTHVHNPLL | 29067 |
| HPV45 | E2 | 10 | 142 | SIYYITETGI | 29068 |
| HPV45 | E2 | 11 | 142 | SIYYITETGIW | 29069 |
| HPV45 | E2 | 9 | 302 | SLKCLRYRL | 29070 |
| HPV45 | E2 | 8 | 9 | SLSERLSA | 29071 |
| HPV45 | E2 | 9 | 9 | SLSERLSAL | 29072 |
| HPV45 | E2 | 10 | 205 | SMCSTSDDTV | 29073 |
| HPV45 | E2 | 11 | 113 | SQCFKKGGKTV | 29074 |
| HPV45 | E2 | 8 | 34 | SQISYWQL | 29075 |
| HPV45 | E2 | 9 | 34 | SQISYWQLI | 29076 |
| HPV45 | E2 | 11 | 34 | SQISYWQLIRL | 29077 |
| HPV45 | E2 | 9 | 235 | SVGTPKPHI | 29078 |
| HPV45 | E2 | 8 | 358 | SVQISVGY | 29079 |
| HPV45 | E2 | 9 | 358 | SVQISVGYM | 29080 |
| HPV45 | E2 | 11 | 358 | SVQISVGYMTI | 29081 |
| HPV45 | E2 | 8 | 354 | TIPNSVQI | 29082 |
| HPV45 | E2 | 10 | 354 | TIPNSVQISV | 29083 |
| HPV45 | E2 | 9 | 99 | TLQDTCEEL | 29084 |
| HPV45 | E2 | 10 | 99 | TLQDTCEELW | 29085 |
| HPV45 | E2 | 10 | 5 | TPKESLSERL | 29086 |
| HPV45 | E2 | 10 | 238 | TPKPHIQTPA | 29087 |
| HPV45 | E2 | 10 | 217 | TQIVRQLQHA | 29088 |
| HPV45 | E2 | 8 | 213 | TVSATQIV | 29089 |
| HPV45 | E2 | 11 | 213 | TVSATQIVRQL | 29090 |
| HPV45 | E2 | 8 | 337 | TVTYNSEV | 29091 |
| HPV45 | E2 | 8 | 199 | VIDCNDSM | 29092 |
| HPV45 | E2 | 11 | 65 | VPPINISKSKA | 29093 |
| HPV45 | E2 | 10 | 176 | VQFKSECEKY | 29094 |
| HPV45 | E2 | 8 | 359 | VQISVGYM | 29095 |
| HPV45 | E2 | 10 | 359 | VQISVGYMTI | 29096 |
| HPV45 | E2 | 9 | 344 | VQRNTFLDV | 29097 |
| HPV45 | E2 | 10 | 344 | VQRNTFLDVV | 29098 |
| HPV45 | E2 | 8 | 193 | VQYGGNVI | 29099 |
| HPV45 | E2 | 8 | 352 | VVTIPNSV | 29100 |
| HPV45 | E2 | 10 | 352 | VVTIPNSVQI | 29101 |
| HPV45 | E2 | 8 | 138 | VVWDSIYY | 29102 |
| HPV45 | E2 | 9 | 138 | VVWDSIYYI | 29103 |
| HPV45 | E2 | 9 | 39 | WQLIRLENA | 29104 |
| HPV45 | E2 | 10 | 39 | WQLIRLENAI | 29105 |
| HPV45 | E2 | 11 | 39 | WQLIRLENAIL | 29106 |
| HPV45 | E2 | 9 | 166 | YIKDGDTTY | 29107 |
| HPV45 | E2 | 10 | 166 | YIKDGDTTYY | 29108 |
| HPV45 | E2 | 11 | 166 | YIKDGDTTYYV | 29109 |

TABLE XIV-continued

B62 Supermotif Peptides

| Type | Protein | No. of Amino Acid | Position | Sequence | Seq. Id. No. |
|---|---|---|---|---|---|
| HPV45 | E2 | 8 | 145 | YITETGIW | 29110 |
| HPV45 | E2 | 11 | 175 | YVQFKSECEKY | 29111 |
| HPV45 | E2 | 8 | 137 | YVVWDSIY | 29112 |
| HPV45 | E2 | 9 | 137 | YVVWDSIYY | 29113 |
| HPV45 | E2 | 10 | 137 | YVVWDSIYYI | 29114 |
| HPV45 | E6 | 11 | 59 | CIAYAACHKCI | 29115 |
| HPV45 | E6 | 8 | 68 | CIDFYSRI | 29116 |
| HPV45 | E6 | 11 | 68 | CIDFYSRIREL | 29117 |
| HPV45 | E6 | 8 | 105 | CLRCQKPL | 29118 |
| HPV45 | E6 | 11 | 105 | CLRCQKPLNPA | 29119 |
| HPV45 | E6 | 8 | 108 | CQKPLNPA | 29120 |
| HPV45 | E6 | 8 | 32 | CVYCKATL | 29121 |
| HPV45 | E6 | 10 | 16 | DLCTELNTSL | 29122 |
| HPV45 | E6 | 10 | 51 | DLFIVYRDCI | 29123 |
| HPV45 | E6 | 11 | 51 | DLFIVYRDCIA | 29124 |
| HPV45 | E6 | 9 | 6 | DPTQRPYKL | 29125 |
| HPV45 | E6 | 8 | 143 | DQARQERL | 29126 |
| HPV45 | E6 | 8 | 27 | DVSIACVY | 29127 |
| HPV45 | E6 | 11 | 27 | DVSIACVYCKA | 29128 |
| HPV45 | E6 | 9 | 20 | ELNTSLQDV | 29129 |
| HPV45 | E6 | 11 | 20 | ELNTSLQDVSI | 29130 |
| HPV45 | E6 | 9 | 77 | ELRYYSNSV | 29131 |
| HPV45 | E6 | 10 | 77 | ELRYYSNSVY | 29132 |
| HPV45 | E6 | 10 | 97 | ELYNLLIRCL | 29133 |
| HPV45 | E6 | 10 | 43 | EVYQFAFKDL | 29134 |
| HPV45 | E6 | 11 | 43 | EVYQFAFKDLF | 29135 |
| HPV45 | E6 | 8 | 53 | FIVYRDCI | 29136 |
| HPV45 | E6 | 9 | 53 | FIVYRDCIA | 29137 |
| HPV45 | E6 | 10 | 53 | FIVYRDCIAY | 29138 |
| HPV45 | E6 | 11 | 53 | FIVYRDCIAYA | 29139 |
| HPV45 | E6 | 10 | 136 | GQCNTCCDQA | 29140 |
| HPV45 | E6 | 8 | 120 | HLKDKRRF | 29141 |
| HPV45 | E6 | 11 | 120 | HLKDKRRFHSI | 29142 |
| HPV45 | E6 | 8 | 54 | IVYRDCIA | 29143 |
| HPV45 | E6 | 9 | 54 | IVYRDCIAY | 29144 |
| HPV45 | E6 | 10 | 54 | IVYRDCIAYA | 29145 |
| HPV45 | E6 | 11 | 54 | IVYRDCIAYAA | 29146 |
| HPV45 | E6 | 8 | 92 | KITNTELY | 29147 |
| HPV45 | E6 | 10 | 92 | KITNTELYNL | 29148 |
| HPV45 | E6 | 11 | 92 | KITNTELYNLL | 29149 |
| HPV45 | E6 | 9 | 13 | KLPDLCTEL | 29150 |
| HPV45 | E6 | 11 | 102 | LIRCLRCQKPL | 29151 |
| HPV45 | E6 | 8 | 14 | LPDLCTEL | 29152 |
| HPV45 | E6 | 9 | 25 | LQDVSIACV | 29153 |
| HPV45 | E6 | 10 | 25 | LQDVSIACVY | 29154 |
| HPV45 | E6 | 9 | 113 | NPAEKRRHL | 29155 |
| HPV45 | E6 | 11 | 111 | PLNPAEKRRHL | 29156 |
| HPV45 | E6 | 8 | 74 | RIRELRYY | 29157 |
| HPV45 | E6 | 10 | 149 | RLRRRRETQV | 29158 |
| HPV45 | E6 | 8 | 10 | RPYKLPDL | 29159 |
| HPV45 | E6 | 9 | 29 | SIACVYCKA | 29160 |
| HPV45 | E6 | 11 | 29 | SIACVYCKATL | 29161 |
| HPV45 | E6 | 8 | 24 | SLQDVSIA | 29162 |
| HPV45 | E6 | 10 | 24 | SLQDVSIACV | 29163 |
| HPV45 | E6 | 11 | 24 | SLQDVSIACVY | 29164 |
| HPV45 | E6 | 10 | 84 | SVYGETLEKI | 29165 |
| HPV45 | E6 | 10 | 89 | TLEKITNTEL | 29166 |
| HPV45 | E6 | 11 | 89 | TLEKITNTELY | 29167 |
| HPV45 | E6 | 8 | 38 | TLERTEVY | 29168 |
| HPV45 | E6 | 10 | 38 | TLERTEVYQF | 29169 |
| HPV45 | E6 | 11 | 38 | TLERTEVYQFA | 29170 |
| HPV45 | E6 | 10 | 8 | TQRPYKLPDL | 29171 |
| HPV45 | E6 | 8 | 45 | YQFAFKDL | 29172 |
| HPV45 | E6 | 9 | 45 | YQFAFKDLF | 29173 |
| HPV45 | E6 | 10 | 45 | YQFAFKDLFI | 29174 |
| HPV45 | E6 | 11 | 45 | YQFAFKDLFIV | 29175 |
| HPV45 | E7 | 8 | 48 | AQLPARRA | 29176 |
| HPV45 | E7 | 10 | 64 | CVCCKCDGRI | 29177 |
| HPV45 | E7 | 8 | 25 | DLLCYEQL | 29178 |
| HPV45 | E7 | 8 | 83 | DLRTLQQL | 29179 |
| HPV45 | E7 | 9 | 83 | DLRTLQQLF | 29180 |
| HPV45 | E7 | 10 | 83 | DLRTLQQLFL | 29181 |
| HPV45 | E7 | 8 | 22 | DPVDLLCY | 29182 |
| HPV45 | E7 | 11 | 22 | DPVDLLCYEQL | 29183 |
| HPV45 | E7 | 8 | 20 | ELDPVDLL | 29184 |

TABLE XIV-continued

B62 Supermotif Peptides

| Type | Protein | No. of Amino Acid | Position | Sequence | Seq. Id. No. |
|---|---|---|---|---|---|
| HPV45 | E7 | 10 | 20 | ELDPVDLLCY | 29185 |
| HPV45 | E7 | 8 | 74 | ELTVESSA | 29186 |
| HPV45 | E7 | 11 | 74 | ELTVESSADDL | 29187 |
| HPV45 | E7 | 9 | 16 | EPQNELDPV | 29188 |
| HPV45 | E7 | 11 | 16 | EPQNELDPVDL | 29189 |
| HPV45 | E7 | 8 | 56 | EPQRHKIL | 29190 |
| HPV45 | E7 | 10 | 56 | EPQPHKILCV | 29191 |
| HPV45 | E7 | 8 | 91 | FLSTLSFV | 29192 |
| HPV45 | E7 | 11 | 91 | FLSTLSFVCPW | 29193 |
| HPV45 | E7 | 9 | 3 | GPRATLQEI | 29194 |
| HPV45 | E7 | 10 | 3 | GPRATLQEIV | 29195 |
| HPV45 | E7 | 11 | 3 | GPRATLQEIVL | 29196 |
| HPV45 | E7 | 9 | 44 | GVSHAQLPA | 29197 |
| HPV45 | E7 | 8 | 14 | HLEPQNEL | 29198 |
| HPV45 | E7 | 11 | 14 | HLEPQNELDPV | 29199 |
| HPV45 | E7 | 11 | 11 | IVLHLEPQNEL | 29200 |
| HPV45 | E7 | 8 | 8 | LQEIVLHL | 29201 |
| HPV45 | E7 | 9 | 87 | LQQLFLSTL | 29202 |
| HPV45 | E7 | 11 | 87 | LQQLFLSTLSF | 29203 |
| HPV45 | E7 | 8 | 17 | PQNELDPV | 29204 |
| HPV45 | E7 | 10 | 17 | PQNELDPVDL | 29205 |
| HPV45 | E7 | 11 | 17 | PQNELDPVDLL | 29206 |
| HPV45 | E7 | 9 | 57 | PQRHKILCV | 29207 |
| HPV45 | E7 | 10 | 23 | PVDLLCYEQL | 29208 |
| HPV45 | E7 | 9 | 89 | QLFLSTLSF | 29209 |
| HPV45 | E7 | 10 | 89 | QLFLSTLSFV | 29210 |
| HPV45 | E7 | 8 | 88 | QQLFLSTL | 29211 |
| HPV45 | E7 | 10 | 88 | QQLFLSTLSF | 29212 |
| HPV45 | E7 | 11 | 88 | QQLFLSTLSFV | 29213 |
| HPV45 | E7 | 10 | 72 | RIELTVESSA | 29214 |
| HPV45 | E7 | 9 | 7 | TLQEIVLHL | 29215 |
| HPV45 | E7 | 10 | 86 | TLQQLFLSTL | 29216 |
| HPV45 | E7 | 8 | 94 | TLSFVCPW | 29217 |
| HPV45 | E7 | 10 | 94 | TLSFVCPWCA | 29218 |
| HPV45 | E7 | 9 | 76 | TVESSADDL | 29219 |
| HPV45 | E7 | 10 | 12 | VLHLEPQNEL | 29220 |
| HPV45 | L1 | 11 | 191 | AIGEHWAKGTL | 29221 |
| HPV45 | L1 | 8 | 103 | ALPDPNKF | 29222 |
| HPV45 | L1 | 10 | 103 | ALPDPNKFGL | 29223 |
| HPV45 | L1 | 10 | 28 | ALWRPSDSTV | 29224 |
| HPV45 | L1 | 11 | 28 | ALWRPSDSTVY | 29225 |
| HPV45 | L1 | 8 | 345 | AQGHNNGI | 29226 |
| HPV45 | L1 | 10 | 345 | AQGHNNGICW | 29227 |
| HPV45 | L1 | 11 | 205 | AQLQPGDCPPL | 29228 |
| HPV45 | L1 | 11 | 164 | AVITQDVRDNV | 29229 |
| HPV45 | L1 | 8 | 88 | AVPKVSAY | 29230 |
| HPV45 | L1 | 10 | 88 | AVPKVSAYQY | 29231 |
| HPV45 | L1 | 8 | 184 | CILGCVPA | 29232 |
| HPV45 | L1 | 9 | 184 | CILGCVPAI | 29233 |
| HPV45 | L1 | 8 | 276 | CLRREQLF | 29234 |
| HPV45 | L1 | 9 | 276 | CLRREQLFA | 29235 |
| HPV45 | L1 | 10 | 212 | CPPLELKNTI | 29236 |
| HPV45 | L1 | 11 | 212 | CPPLELKNTII | 29237 |
| HPV45 | L1 | 10 | 252 | CQSICKYPDY | 29238 |
| HPV45 | L1 | 11 | 252 | CQSICKYPDYL | 29239 |
| HPV45 | L1 | 9 | 188 | CVPAIGEHW | 29240 |
| HPV45 | L1 | 10 | 188 | CVPAIGEHWA | 29241 |
| HPV45 | L1 | 11 | 318 | CVYSPSPSGSI | 29242 |
| HPV45 | L1 | 9 | 250 | DICQSICKY | 29243 |
| HPV45 | L1 | 11 | 488 | DLDQYPLGRKF | 29244 |
| HPV45 | L1 | 10 | 480 | DLKEKFSSDL | 29245 |
| HPV45 | L1 | 8 | 401 | DLQFIFQL | 29246 |
| HPV45 | L1 | 11 | 401 | DLQFIFQLCTI | 29247 |
| HPV45 | L1 | 9 | 301 | DLYIKGTSA | 29248 |
| HPV45 | L1 | 11 | 301 | DLYIKGTSANM | 29249 |
| HPV45 | L1 | 9 | 226 | DMVDTGYGA | 29250 |
| HPV45 | L1 | 10 | 226 | DMVDTGYGAM | 29251 |
| HPV45 | L1 | 8 | 386 | DPTKFKHY | 29252 |
| HPV45 | L1 | 8 | 469 | DPYDKLKF | 29253 |
| HPV45 | L1 | 9 | 469 | DPYDKLKFW | 29254 |
| HPV45 | L1 | 11 | 469 | DPYDKLKFWTV | 29255 |
| HPV45 | L1 | 8 | 267 | DPYGDSMF | 29256 |
| HPV45 | L1 | 9 | 267 | DPYGDSMFF | 29257 |
| HPV45 | L1 | 11 | 267 | DPYGDSMFFCL | 29258 |
| HPV45 | L1 | 9 | 490 | DQYPLGRKF | 29259 |

TABLE XIV-continued

B62 Supermotif Peptides

| Type | Protein | No. of Amino Acid | Position | Sequence | Seq. Id. No. |
|---|---|---|---|---|---|
| HPV45 | L1 | 10 | 490 | DQYPLGRKFL | 29260 |
| HPV45 | L1 | 11 | 490 | DQYPLGRKFLV | 29261 |
| HPV45 | L1 | 8 | 169 | DVRDNVSV | 29262 |
| HPV45 | L1 | 10 | 169 | DVRDNVSVDY | 29263 |
| HPV45 | L1 | 8 | 133 | EIGRGQPL | 29264 |
| HPV45 | L1 | 10 | 133 | EIGRGQPLGI | 29265 |
| HPV45 | L1 | 8 | 280 | EQLFARHF | 29266 |
| HPV45 | L1 | 9 | 280 | EQLFARHFW | 29267 |
| HPV45 | L1 | 9 | 416 | EVMSYIHSM | 29268 |
| HPV45 | L1 | 10 | 246 | EVPLDICQSI | 29269 |
| HPV45 | L1 | 8 | 404 | FIFQLCTI | 29270 |
| HPV45 | L1 | 10 | 404 | FIFQLCTITL | 29271 |
| HPV45 | L1 | 8 | 14 | FLKNVNVF | 29272 |
| HPV45 | L1 | 10 | 14 | FLKNVNVFPI | 29273 |
| HPV45 | L1 | 11 | 14 | FLKNVNVFPIF | 29274 |
| HPV45 | L1 | 8 | 21 | FPIFLQMA | 29275 |
| HPV45 | L1 | 9 | 21 | FPIFLQMAL | 29276 |
| HPV45 | L1 | 10 | 21 | FPIFLQMALW | 29277 |
| HPV45 | L1 | 8 | 406 | FQLCTITL | 29278 |
| HPV45 | L1 | 10 | 406 | FQLCTITLTA | 29279 |
| HPV45 | L1 | 8 | 351 | GICWHNQL | 29280 |
| HPV45 | L1 | 9 | 351 | GICWHNQLF | 29281 |
| HPV45 | L1 | 10 | 351 | GICWHNQLFV | 29282 |
| HPV45 | L1 | 9 | 141 | GIGLSGHPF | 29283 |
| HPV45 | L1 | 10 | 141 | GIGLSGHPFY | 29284 |
| HPV45 | L1 | 9 | 10 | GIIIFLKNV | 29285 |
| HPV45 | L1 | 11 | 10 | GIIIFLKNVNV | 29286 |
| HPV45 | L1 | 8 | 111 | GLPDSTIY | 29287 |
| HPV45 | L1 | 8 | 503 | GLRRRPTI | 29288 |
| HPV45 | L1 | 8 | 143 | GLSGHPFY | 29289 |
| HPV45 | L1 | 11 | 143 | GLSGHPFYNKL | 29290 |
| HPV45 | L1 | 10 | 131 | GMEIGRGQPL | 29291 |
| HPV45 | L1 | 8 | 511 | GPRKRPAA | 29292 |
| HPV45 | L1 | 8 | 137 | GQPLGIGL | 29293 |
| HPV45 | L1 | 11 | 292 | GVMGDTVPTDL | 29294 |
| HPV45 | L1 | 10 | 435 | GVPPPPTTSL | 29295 |
| HPV45 | L1 | 11 | 435 | GVPPPPTTSLV | 29296 |
| HPV45 | L1 | 9 | 396 | HVEEYDLQF | 29297 |
| HPV45 | L1 | 10 | 396 | HVEEYDLQFI | 29298 |
| HPV45 | L1 | 11 | 396 | HVEEYDLQFIF | 29299 |
| HPV45 | L1 | 8 | 221 | IIEDGDMV | 29300 |
| HPV45 | L1 | 9 | 12 | IIFLKNVNV | 29301 |
| HPV45 | L1 | 10 | 12 | IIFLKNVNVF | 29302 |
| HPV45 | L1 | 8 | 11 | IIIFLKNV | 29303 |
| HPV45 | L1 | 10 | 11 | IIIFLKNVNV | 29304 |
| HPV45 | L1 | 11 | 11 | IIIFLKNVNVF | 29305 |
| HPV45 | L1 | 8 | 5 | IIYGHGII | 29306 |
| HPV45 | L1 | 9 | 5 | IIYGHGIII | 29307 |
| HPV45 | L1 | 10 | 5 | IIYGHGIIIF | 29308 |
| HPV45 | L1 | 11 | 5 | IIYGHGIIIFL | 29309 |
| HPV45 | L1 | 9 | 428 | ILENWNFGV | 29310 |
| HPV45 | L1 | 8 | 185 | ILGCVPAI | 29311 |
| HPV45 | L1 | 8 | 152 | KLDDTESA | 29312 |
| HPV45 | L1 | 10 | 152 | KLDDTESAHA | 29313 |
| HPV45 | L1 | 11 | 152 | KLDDTESAHAA | 29314 |
| HPV45 | L1 | 9 | 473 | KLKFWTVDL | 29315 |
| HPV45 | L1 | 8 | 338 | KPYWLHKA | 29316 |
| HPV45 | L1 | 9 | 86 | KQAVPKVSA | 29317 |
| HPV45 | L1 | 10 | 86 | KQAVPKVSAY | 29318 |
| HPV45 | L1 | 8 | 467 | KQDPYDKL | 29319 |
| HPV45 | L1 | 10 | 467 | KQDPYDKLKF | 29320 |
| HPV45 | L1 | 11 | 467 | KQDPYDKLKFW | 29321 |
| HPV45 | L1 | 8 | 179 | KQTQLCIL | 29322 |
| HPV45 | L1 | 11 | 179 | KQTQLCILGCV | 29323 |
| HPV45 | L1 | 9 | 91 | KVSAYQYRV | 29324 |
| HPV45 | L1 | 10 | 91 | KVSAYQYRVF | 29325 |
| HPV45 | L1 | 8 | 68 | LLTVGNPY | 29326 |
| HPV45 | L1 | 9 | 68 | LLTVGNPYF | 29327 |
| HPV45 | L1 | 11 | 68 | LLTVGNPYFRV | 29328 |
| HPV45 | L1 | 9 | 104 | LPDPNKFGL | 29329 |
| HPV45 | L1 | 9 | 39 | LPPPSVARV | 29330 |
| HPV45 | L1 | 10 | 39 | LPPPSVARVV | 29331 |
| HPV45 | L1 | 8 | 240 | LQDTKCEV | 29332 |
| HPV45 | L1 | 10 | 240 | LQDTKCEVPL | 29333 |
| HPV45 | L1 | 10 | 402 | LQFIFQLCTI | 29334 |

TABLE XIV-continued

B62 Supermotif Peptides

| Type | Protein | No. of Amino Acid | Position | Sequence | Seq. Id. No. |
|---|---|---|---|---|---|
| HPV45 | L1 | 8 | 262 | LQMSADPY | 29335 |
| HPV45 | L1 | 9 | 207 | LQPGDCPPL | 29336 |
| HPV45 | L1 | 11 | 207 | LQPGDCPPLEL | 29337 |
| HPV45 | L1 | 8 | 444 | LVDTYRFV | 29338 |
| HPV45 | L1 | 11 | 444 | LVDTYRFVQSV | 29339 |
| HPV45 | L1 | 8 | 125 | LVWACVGM | 29340 |
| HPV45 | L1 | 10 | 125 | LVWACVGMEI | 29341 |
| HPV45 | L1 | 8 | 227 | MVDTGYGA | 29342 |
| HPV45 | L1 | 9 | 227 | MVDTGYGAM | 29343 |
| HPV45 | L1 | 11 | 227 | MVDTGYGAMDF | 29344 |
| HPV45 | L1 | 8 | 4 | NIIYGHGI | 29345 |
| HPV45 | L1 | 9 | 4 | NIIYGHGII | 29346 |
| HPV45 | L1 | 10 | 4 | NIIYGHGIII | 29347 |
| HPV45 | L1 | 11 | 4 | NIIYGHGIIIF | 29348 |
| HPV45 | L1 | 10 | 310 | NMRETPGSCV | 29349 |
| HPV45 | L1 | 11 | 310 | NMRETPGSCVY | 29350 |
| HPV45 | L1 | 8 | 119 | NPETQRLV | 29351 |
| HPV45 | L1 | 9 | 119 | NPETQRLVW | 29352 |
| HPV45 | L1 | 10 | 119 | NPETQRLVWA | 29353 |
| HPV45 | L1 | 11 | 73 | NPYFRVVPSGA | 29354 |
| HPV45 | L1 | 8 | 356 | NQLFVTVV | 29355 |
| HPV45 | L1 | 9 | 19 | NVFPIFLQM | 29356 |
| HPV45 | L1 | 10 | 19 | NVFPIFLQMA | 29357 |
| HPV45 | L1 | 11 | 19 | NVFPIFLQMAL | 29358 |
| HPV45 | L1 | 8 | 17 | NVNVFPIF | 29359 |
| HPV45 | L1 | 9 | 17 | NVNVFPIFL | 29360 |
| HPV45 | L1 | 11 | 17 | NVNVFPIFLQM | 29361 |
| HPV45 | L1 | 11 | 173 | NVSVDYKQTQL | 29362 |
| HPV45 | L1 | 8 | 22 | PIFLQMAL | 29363 |
| HPV45 | L1 | 9 | 22 | PIFLQMALW | 29364 |
| HPV45 | L1 | 8 | 248 | PLDICQSI | 29365 |
| HPV45 | L1 | 11 | 248 | PLDICQSICKY | 29366 |
| HPV45 | L1 | 8 | 214 | PLELKNTI | 29367 |
| HPV45 | L1 | 9 | 214 | PLELKNTII | 29368 |
| HPV45 | L1 | 11 | 139 | PLGIGLSGHPF | 29369 |
| HPV45 | L1 | 8 | 493 | PLGRKFLV | 29370 |
| HPV45 | L1 | 10 | 493 | PLGRKFLVQA | 29371 |
| HPV45 | L1 | 8 | 464 | PPEKQDPY | 29372 |
| HPV45 | L1 | 11 | 464 | PPEKQDPYDKL | 29373 |
| HPV45 | L1 | 9 | 213 | PPLELKNTI | 29374 |
| HPV45 | L1 | 10 | 213 | PPLELKNTII | 29375 |
| HPV45 | L1 | 8 | 437 | PPPPTTSL | 29376 |
| HPV45 | L1 | 9 | 437 | PPPPTTSLV | 29377 |
| HPV45 | L1 | 8 | 40 | PPPSVARV | 29378 |
| HPV45 | L1 | 9 | 40 | PPPSVARVV | 29379 |
| HPV45 | L1 | 8 | 438 | PPPTTSLV | 29380 |
| HPV45 | L1 | 11 | 438 | PPPTTSLVDTY | 29381 |
| HPV45 | L1 | 8 | 41 | PPSVARVV | 29382 |
| HPV45 | L1 | 10 | 439 | PPTTSLVDTY | 29383 |
| HPV45 | L1 | 11 | 380 | PVPNTYDPTKF | 29384 |
| HPV45 | L1 | 8 | 182 | QLCILGCV | 29385 |
| HPV45 | L1 | 10 | 182 | QLCILGCVPA | 29386 |
| HPV45 | L1 | 11 | 182 | QLCILGCVPAI | 29387 |
| HPV45 | L1 | 9 | 407 | QLCTITLTA | 29388 |
| HPV45 | L1 | 11 | 407 | QLCTITLTAEV | 29389 |
| HPV45 | L1 | 8 | 281 | QLFARHFW | 29390 |
| HPV45 | L1 | 11 | 281 | QLFARHFWNRA | 29391 |
| HPV45 | L1 | 8 | 334 | QLFNKPYW | 29392 |
| HPV45 | L1 | 9 | 334 | QLFNKPYWL | 29393 |
| HPV45 | L1 | 10 | 206 | QLQPGDCPPL | 29394 |
| HPV45 | L1 | 11 | 263 | QMSADPYGDSM | 29395 |
| HPV45 | L1 | 8 | 208 | QPGDCPPL | 29396 |
| HPV45 | L1 | 10 | 208 | QPGDCPPLEL | 29397 |
| HPV45 | L1 | 9 | 67 | RLLTVGNPY | 29398 |
| HPV45 | L1 | 10 | 67 | RLLTVGNPYF | 29399 |
| HPV45 | L1 | 9 | 124 | RLVWACVGM | 29400 |
| HPV45 | L1 | 11 | 124 | RLVWACVGMEI | 29401 |
| HPV45 | L1 | 9 | 515 | RPAASTSTA | 29402 |
| HPV45 | L1 | 8 | 525 | RPAKRVRI | 29403 |
| HPV45 | L1 | 8 | 31 | RPSDSTVY | 29404 |
| HPV45 | L1 | 9 | 31 | RPSDSTVYL | 29405 |
| HPV45 | L1 | 11 | 507 | RPTIGPRKRPA | 29406 |
| HPV45 | L1 | 10 | 101 | RVALPDPNKF | 29407 |
| HPV45 | L1 | 8 | 46 | RVVNTDDY | 29408 |
| HPV45 | L1 | 9 | 46 | RVVNTDDYV | 29409 |

TABLE XIV-continued

B62 Supermotif Peptides

| Type | Protein | No. of Amino Acid | Position | Sequence | Seq. Id. No. |
|---|---|---|---|---|---|
| HPV45 | L1 | 8 | 254 | SICKYPDY | 29410 |
| HPV45 | L1 | 9 | 254 | SICKYPDYL | 29411 |
| HPV45 | L1 | 11 | 254 | SICKYPDYLQM | 29412 |
| HPV45 | L1 | 11 | 58 | SIFYHAGSSRL | 29413 |
| HPV45 | L1 | 8 | 427 | SILENWNF | 29414 |
| HPV45 | L1 | 10 | 427 | SILENWNFGV | 29415 |
| HPV45 | L1 | 9 | 327 | SITTSDSQL | 29416 |
| HPV45 | L1 | 10 | 327 | SITUSDSQLF | 29417 |
| HPV45 | L1 | 8 | 443 | SLVDTYRF | 29418 |
| HPV45 | L1 | 9 | 443 | SLVDTYRFV | 29419 |
| HPV45 | L1 | 11 | 272 | SMFFCLRREQL | 29420 |
| HPV45 | L1 | 10 | 423 | SMNSSILENW | 29421 |
| HPV45 | L1 | 8 | 321 | SPSPSGSI | 29422 |
| HPV45 | L1 | 8 | 333 | SQLFNKPY | 29423 |
| HPV45 | L1 | 9 | 333 | SQLFNKPYW | 29424 |
| HPV45 | L1 | 10 | 333 | SQLFNKPYWL | 29425 |
| HPV45 | L1 | 11 | 43 | SVARVVNTDDY | 29426 |
| HPV45 | L1 | 9 | 175 | SVDYKQTQL | 29427 |
| HPV45 | L1 | 11 | 175 | SVDYKQTQLCI | 29428 |
| HPV45 | L1 | 9 | 509 | TIGPRKRPA | 29429 |
| HPV45 | L1 | 10 | 509 | TIGPRKRPAA | 29430 |
| HPV45 | L1 | 8 | 220 | TIIEDGDM | 29431 |
| HPV45 | L1 | 9 | 220 | TIIEDGDMV | 29432 |
| HPV45 | L1 | 8 | 410 | TITLTAEV | 29433 |
| HPV45 | L1 | 9 | 410 | TITLTAEVM | 29434 |
| HPV45 | L1 | 11 | 410 | TITLTAEVMSY | 29435 |
| HPV45 | L1 | 10 | 116 | TIYNPETQRL | 29436 |
| HPV45 | L1 | 11 | 116 | TIYNPETQRLV | 29437 |
| HPV45 | L1 | 10 | 372 | TLCASTQNPV | 29438 |
| HPV45 | L1 | 8 | 200 | TLCKPAQL | 29439 |
| HPV45 | L1 | 9 | 239 | TLQDTKCEV | 29440 |
| HPV45 | L1 | 11 | 239 | TLQDTKCEVPL | 29441 |
| HPV45 | L1 | 9 | 412 | TLTAEVMSY | 29442 |
| HPV45 | L1 | 10 | 412 | TLTAEVMSYI | 29443 |
| HPV45 | L1 | 9 | 463 | TPPEKQDPY | 29444 |
| HPV45 | L1 | 8 | 167 | TQDVRDNV | 29445 |
| HPV45 | L1 | 10 | 167 | TQDVRDNVSV | 29446 |
| HPV45 | L1 | 9 | 181 | TQLCILGCV | 29447 |
| HPV45 | L1 | 11 | 181 | TQLCILGCVPA | 29448 |
| HPV45 | L1 | 9 | 377 | TQNPVPNTY | 29449 |
| HPV45 | L1 | 9 | 122 | TQRLVWACV | 29450 |
| HPV45 | L1 | 11 | 122 | TQRLVWACVGM | 29451 |
| HPV45 | L1 | 8 | 478 | TVDLKEKF | 29452 |
| HPV45 | L1 | 9 | 70 | TVGNPYFRV | 29453 |
| HPV45 | L1 | 10 | 70 | TVGNPYFRVV | 29454 |
| HPV45 | L1 | 8 | 297 | TVPTDLYI | 29455 |
| HPV45 | L1 | 11 | 361 | TVVDTTRSTNL | 29456 |
| HPV45 | L1 | 9 | 36 | TVYLPPPSV | 29457 |
| HPV45 | L1 | 10 | 36 | TVYLPPPSVA | 29458 |
| HPV45 | L1 | 10 | 165 | VITQDVRDNV | 29459 |
| HPV45 | L1 | 10 | 293 | VMGDTVPTDL | 29460 |
| HPV45 | L1 | 11 | 293 | VMGDTVPTDLY | 29461 |
| HPV45 | L1 | 8 | 417 | VMSYIHSM | 29462 |
| HPV45 | L1 | 8 | 189 | VPAIGEHW | 29463 |
| HPV45 | L1 | 9 | 189 | VPAIGEHWA | 29464 |
| HPV45 | L1 | 9 | 89 | VPKVSAYQY | 29465 |
| HPV45 | L1 | 11 | 89 | VPKVSAYQYRV | 29466 |
| HPV45 | L1 | 9 | 247 | VPLDICQSI | 29467 |
| HPV45 | L1 | 10 | 381 | VPNTYDPTKF | 29468 |
| HPV45 | L1 | 9 | 436 | VPPPPTTSL | 29469 |
| HPV45 | L1 | 10 | 436 | VPPPPTTSLV | 29470 |
| HPV45 | L1 | 10 | 79 | VPSGAGNKQA | 29471 |
| HPV45 | L1 | 11 | 79 | VPSGAGNKQAV | 29472 |
| HPV45 | L1 | 11 | 500 | VQAGLRRRPTI | 29473 |
| HPV45 | L1 | 10 | 362 | VVDTTRSTNL | 29474 |
| HPV45 | L1 | 8 | 47 | VVNTDDYV | 29475 |
| HPV45 | L1 | 11 | 78 | VVPSGAGNKQA | 29476 |
| HPV45 | L1 | 9 | 420 | YIHSMNSSI | 29477 |
| HPV45 | L1 | 10 | 420 | YIHSMNSSIL | 29478 |
| HPV45 | L1 | 9 | 303 | YIKGTSANM | 29479 |
| HPV45 | L1 | 8 | 38 | YLPPPSVA | 29480 |
| HPV45 | L1 | 10 | 38 | YLPPPSVARV | 29481 |
| HPV45 | L1 | 11 | 38 | YLPPPSVARVV | 29482 |
| HPV45 | L1 | 9 | 261 | YLQMSADPY | 29483 |
| HPV45 | L1 | 9 | 258 | YPDYLQMSA | 29484 |

TABLE XIV-continued

B62 Supermotif Peptides

| Type | Protein | No. of Amino Acid | Position | Sequence | Seq. Id. No. |
|---|---|---|---|---|---|
| HPV45 | L1 | 8 | 492 | YPLGRKFL | 29485 |
| HPV45 | L1 | 9 | 492 | YPLGRKFLV | 29486 |
| HPV45 | L1 | 11 | 492 | YPLGRKFLVQA | 29487 |
| HPV45 | L1 | 8 | 95 | YQYRVFRV | 29488 |
| HPV45 | L1 | 9 | 95 | YQYRVFRVA | 29489 |
| HPV45 | L1 | 10 | 95 | YQYRVFRVAL | 29490 |
| HPV45 | L1 | 8 | 53 | YVSRTSIF | 29491 |
| HPV45 | L1 | 9 | 53 | YVSRTSIFY | 29492 |
| HPV45 | L1 | 11 | 53 | YVSRTSIFYHA | 29493 |
| HPV45 | L2 | 9 | 286 | ALSSRRGTV | 29494 |
| HPV45 | L2 | 11 | 286 | ALSSRRGTVRF | 29495 |
| HPV45 | L2 | 9 | 139 | AVLDITPTV | 29496 |
| HPV45 | L2 | 9 | 27 | CPPDVINKV | 29497 |
| HPV45 | L2 | 10 | 405 | DIILPSHTPM | 29498 |
| HPV45 | L2 | 11 | 405 | DIILPSHTPMW | 29499 |
| HPV45 | L2 | 9 | 278 | DIIRLHRPA | 29500 |
| HPV45 | L2 | 10 | 278 | DIIRLHRPAL | 29501 |
| HPV45 | L2 | 11 | 322 | DISPIAATEEI | 29502 |
| HPV45 | L2 | 9 | 142 | DITPTVDSV | 29503 |
| HPV45 | L2 | 11 | 142 | DITPTVDSVSI | 29504 |
| HPV45 | L2 | 9 | 345 | DLFDVYADF | 29505 |
| HPV45 | L2 | 8 | 100 | DPSIVTLV | 29506 |
| HPV45 | L2 | 9 | 83 | DVGPTRPPV | 29507 |
| HPV45 | L2 | 10 | 83 | DVGPTRPPVV | 29508 |
| HPV45 | L2 | 11 | 83 | DVGPTRPPVVI | 29509 |
| HPV45 | L2 | 11 | 30 | DVINKVEGTTL | 29510 |
| HPV45 | L2 | 10 | 397 | DVPIYTGPDI | 29511 |
| HPV45 | L2 | 11 | 397 | DVPIYTGPDII | 29512 |
| HPV45 | L2 | 10 | 348 | DVYADFPPPA | 29513 |
| HPV45 | L2 | 8 | 331 | EIELQPLI | 29514 |
| HPV45 | L2 | 10 | 331 | EIELQPLISA | 29515 |
| HPV45 | L2 | 8 | 194 | EIPLQTFA | 29516 |
| HPV45 | L2 | 11 | 129 | EITSSGTTTPA | 29517 |
| HPV45 | L2 | 8 | 333 | ELQPLISA | 29518 |
| HPV45 | L2 | 8 | 208 | EPISSTPL | 29519 |
| HPV45 | L2 | 11 | 208 | EPISSTPLPTV | 29520 |
| HPV45 | L2 | 9 | 257 | EPLDTTLSF | 29521 |
| HPV45 | L2 | 11 | 266 | EPTSNVPDSDF | 29522 |
| HPV45 | L2 | 10 | 94 | EPVGPTDPSI | 29523 |
| HPV45 | L2 | 11 | 94 | EPVGPTDPSIV | 29524 |
| HPV45 | L2 | 8 | 169 | EVPQTGEV | 29525 |
| HPV45 | L2 | 8 | 175 | EVSGNIFV | 29526 |
| HPV45 | L2 | 8 | 241 | FLTHPSSL | 29527 |
| HPV45 | L2 | 9 | 241 | FLTHPSSLV | 29528 |
| HPV45 | L2 | 11 | 241 | FLTHPSSLVTF | 29529 |
| HPV45 | L2 | 11 | 276 | FMDIIRLHRPA | 29530 |
| HPV45 | L2 | 8 | 445 | FPKKRKRI | 29531 |
| HPV45 | L2 | 10 | 445 | FPKKRKRIPY | 29532 |
| HPV45 | L2 | 11 | 445 | FPKKRKRIPYF | 29533 |
| HPV45 | L2 | 9 | 51 | GIFLGGLGI | 29534 |
| HPV45 | L2 | 8 | 430 | GIHGTQYY | 29535 |
| HPV45 | L2 | 9 | 430 | GIHGTQYYL | 29536 |
| HPV45 | L2 | 10 | 430 | GIHGTQYYLW | 29537 |
| HPV45 | L2 | 8 | 223 | GPRLYSRA | 29538 |
| HPV45 | L2 | 8 | 97 | GPTDPSIV | 29539 |
| HPV45 | L2 | 10 | 97 | GPTDPSIVTL | 29540 |
| HPV45 | L2 | 11 | 97 | GPTDPSIVTLV | 29541 |
| HPV45 | L2 | 8 | 85 | GPTRPPVV | 29542 |
| HPV45 | L2 | 9 | 85 | GPTRPPVVI | 29543 |
| HPV45 | L2 | 8 | 244 | HPSSLVTF | 29544 |
| HPV45 | L2 | 10 | 167 | IIEVPQTGEV | 29545 |
| HPV45 | L2 | 9 | 406 | IILPSHTPM | 29546 |
| HPV45 | L2 | 10 | 406 | IILPSHTPMW | 29547 |
| HPV45 | L2 | 8 | 279 | IIRLHRPA | 29548 |
| HPV45 | L2 | 9 | 279 | IIRLHRPAL | 29549 |
| HPV45 | L2 | 8 | 407 | ILPSHTPM | 29550 |
| HPV45 | L2 | 9 | 407 | ILPSHTPMW | 29551 |
| HPV45 | L2 | 9 | 44 | ILQWSSLGI | 29552 |
| HPV45 | L2 | 10 | 44 | ILQWSSLGIF | 29553 |
| HPV45 | L2 | 11 | 44 | ILQWSSLGIFL | 29554 |
| HPV45 | L2 | 9 | 452 | IPYFFADGF | 29555 |
| HPV45 | L2 | 10 | 452 | IPYFFADGFV | 29556 |
| HPV45 | L2 | 11 | 452 | IPYFFADGFVA | 29557 |
| HPV45 | L2 | 10 | 103 | IVTLVEDSSV | 29558 |
| HPV45 | L2 | 11 | 103 | IVTLVEDSSVV | 29559 |

TABLE XIV-continued

B62 Supermotif Peptides

| Type | Protein | No. of Amino Acid | Position | Sequence | Seq. Id. No. |
|---|---|---|---|---|---|
| HPV45 | L2 | 8 | 43 | KILQWSSL | 29560 |
| HPV45 | L2 | 10 | 43 | KILQWSSLGI | 29561 |
| HPV45 | L2 | 11 | 43 | KILQWSSLGIF | 29562 |
| HPV45 | L2 | 9 | 311 | KQIGGRVHF | 29563 |
| HPV45 | L2 | 10 | 311 | KQIGGRVHFY | 29564 |
| HPV45 | L2 | 10 | 22 | KQSGTCPPDV | 29565 |
| HPV45 | L2 | 11 | 22 | KQSGTCPPDVI | 29566 |
| HPV45 | L2 | 8 | 34 | KVEGTTLA | 29567 |
| HPV45 | L2 | 11 | 34 | KVEGTTLADKI | 29568 |
| HPV45 | L2 | 10 | 337 | LISATNDSDL | 29569 |
| HPV45 | L2 | 11 | 337 | LISATNDSDLF | 29570 |
| HPV45 | L2 | 8 | 408 | LPSHTPMW | 29571 |
| HPV45 | L2 | 8 | 45 | LQWSSLGI | 29572 |
| HPV45 | L2 | 9 | 45 | LQWSSLGIF | 29573 |
| HPV45 | L2 | 10 | 45 | LQWSSLGIFL | 29574 |
| HPV45 | L2 | 8 | 106 | LVEDSSVV | 29575 |
| HPV45 | L2 | 9 | 106 | LVEDSSVVA | 29576 |
| HPV45 | L2 | 8 | 248 | LVTFDNPA | 29577 |
| HPV45 | L2 | 9 | 248 | LVTFDNPAY | 29578 |
| HPV45 | L2 | 9 | 377 | MPSTAASSY | 29579 |
| HPV45 | L2 | 9 | 159 | NPAFSDPSI | 29580 |
| HPV45 | L2 | 10 | 159 | NPAFSDPSII | 29581 |
| HPV45 | L2 | 11 | 253 | NPAYEPLDTTL | 29582 |
| HPV45 | L2 | 11 | 231 | NQQVRVSTSQF | 29583 |
| HPV45 | L2 | 8 | 270 | NVPDSDFM | 29584 |
| HPV45 | L2 | 10 | 270 | NVPDSDFMDI | 29585 |
| HPV45 | L2 | 11 | 270 | NVPDSDFMDII | 29586 |
| HPV45 | L2 | 9 | 387 | NVTVPLTSA | 29587 |
| HPV45 | L2 | 10 | 387 | NVTVPLTSAW | 29588 |
| HPV45 | L2 | 8 | 325 | PIAATEEI | 29589 |
| HPV45 | L2 | 10 | 325 | PIAATEEIEL | 29590 |
| HPV45 | L2 | 10 | 209 | PISSTPLPTV | 29591 |
| HPV45 | L2 | 8 | 399 | PIYTGPDI | 29592 |
| HPV45 | L2 | 9 | 399 | PIYTGPDII | 29593 |
| HPV45 | L2 | 10 | 399 | PIYTGPDIIL | 29594 |
| HPV45 | L2 | 8 | 258 | PLDTTLSF | 29595 |
| HPV45 | L2 | 9 | 73 | PLGGRSNTV | 29596 |
| HPV45 | L2 | 10 | 73 | PLGGRSNTVV | 29597 |
| HPV45 | L2 | 11 | 336 | PLISATNDSDL | 29598 |
| HPV45 | L2 | 8 | 214 | PLPTVRRV | 29599 |
| HPV45 | L2 | 8 | 391 | PLTSAWDV | 29600 |
| HPV45 | L2 | 10 | 391 | PLTSAWDVPI | 29601 |
| HPV45 | L2 | 11 | 391 | PLTSAWDVPIY | 29602 |
| HPV45 | L2 | 11 | 413 | PMWPSTSPTNA | 29603 |
| HPV45 | L2 | 10 | 355 | PPASTTPSTI | 29604 |
| HPV45 | L2 | 8 | 28 | PPDVINKV | 29605 |
| HPV45 | L2 | 11 | 354 | PPPASTTPSTI | 29606 |
| HPV45 | L2 | 8 | 89 | PPVVIEPV | 29607 |
| HPV45 | L2 | 10 | 171 | PQTGEVSGNI | 29608 |
| HPV45 | L2 | 11 | 171 | PQTGEVSGNIF | 29609 |
| HPV45 | L2 | 9 | 95 | PVGPTDPSI | 29610 |
| HPV45 | L2 | 10 | 95 | PVGPTDPSIV | 29611 |
| HPV45 | L2 | 11 | 118 | PVPTFTGTSGF | 29612 |
| HPV45 | L2 | 8 | 312 | QIGGRVHF | 29613 |
| HPV45 | L2 | 9 | 312 | QIGGRVHFY | 29614 |
| HPV45 | L2 | 10 | 232 | QQVRVSTSQF | 29615 |
| HPV45 | L2 | 11 | 232 | QQVRVSTSQFL | 29616 |
| HPV45 | L2 | 9 | 233 | QVRVSTSQF | 29617 |
| HPV45 | L2 | 10 | 233 | QVRVSTSQFL | 29618 |
| HPV45 | L2 | 10 | 451 | RIPYFFADGF | 29619 |
| HPV45 | L2 | 11 | 451 | RIPYFFADGFV | 29620 |
| HPV45 | L2 | 8 | 298 | RLGQRATM | 29621 |
| HPV45 | L2 | 9 | 298 | RLGQRATMF | 29622 |
| HPV45 | L2 | 10 | 225 | RLYSRANQQV | 29623 |
| HPV45 | L2 | 11 | 284 | RPALSSRRGTV | 29624 |
| HPV45 | L2 | 9 | 88 | RPPVVIEPV | 29625 |
| HPV45 | L2 | 8 | 316 | RVHFYHDI | 29626 |
| HPV45 | L2 | 11 | 316 | RVHFYHDISPI | 29627 |
| HPV45 | L2 | 8 | 220 | RVRGPRLY | 29628 |
| HPV45 | L2 | 11 | 220 | RVRGPRLYSRA | 29629 |
| HPV45 | L2 | 8 | 235 | RVSTSQFL | 29630 |
| HPV45 | L2 | 11 | 166 | SIIEVPQTGEV | 29631 |
| HPV45 | L2 | 11 | 151 | SISSTSFTNPA | 29632 |
| HPV45 | L2 | 11 | 102 | SIVTLVEDSSV | 29633 |
| HPV45 | L2 | 9 | 49 | SLGIFLGGL | 29634 |

TABLE XIV-continued

B62 Supermotif Peptides

| Type | Protein | No. of Amino Acid | Position | Sequence | Seq. Id. No. |
|---|---|---|---|---|---|
| HPV45 | L2 | 11 | 49 | SLGIFLGGLGI | 29635 |
| HPV45 | L2 | 8 | 374 | SLTMPSTA | 29636 |
| HPV45 | L2 | 9 | 374 | SLTMPSTAA | 29637 |
| HPV45 | L2 | 9 | 247 | SLVTFDNPA | 29638 |
| HPV45 | L2 | 10 | 247 | SLVTFDNPAY | 29639 |
| HPV45 | L2 | 9 | 324 | SPIAATEEI | 29640 |
| HPV45 | L2 | 11 | 324 | SPIAATEEIEL | 29641 |
| HPV45 | L2 | 10 | 419 | SPTNASTTTY | 29642 |
| HPV45 | L2 | 11 | 419 | SPTNASTTTYI | 29643 |
| HPV45 | L2 | 10 | 239 | SQFLTHPSSL | 29644 |
| HPV45 | L2 | 11 | 239 | SQFLTHPSSLV | 29645 |
| HPV45 | L2 | 9 | 149 | SVSISSTSF | 29646 |
| HPV45 | L2 | 9 | 111 | SVVASGAPV | 29647 |
| HPV45 | L2 | 8 | 363 | TIHKSFTY | 29648 |
| HPV45 | L2 | 11 | 363 | TIHKSFTYPKY | 29649 |
| HPV45 | L2 | 9 | 39 | TLADKILQW | 29650 |
| HPV45 | L2 | 10 | 262 | TLSFEPTSNV | 29651 |
| HPV45 | L2 | 8 | 105 | TLVEDSSV | 29652 |
| HPV45 | L2 | 9 | 105 | TLVEDSSVV | 29653 |
| HPV45 | L2 | 10 | 105 | TLVEDSSVVA | 29654 |
| HPV45 | L2 | 10 | 304 | TMFTRSGKQI | 29655 |
| HPV45 | L2 | 10 | 376 | TMPSTAASSY | 29656 |
| HPV45 | L2 | 11 | 137 | TPAVLDITPTV | 29657 |
| HPV45 | L2 | 9 | 213 | TPLPTVRRV | 29658 |
| HPV45 | L2 | 9 | 360 | TPSTIHKSF | 29659 |
| HPV45 | L2 | 11 | 360 | TPSTIHKSFTY | 29660 |
| HPV45 | L2 | 9 | 184 | TPTSGSHGY | 29661 |
| HPV45 | L2 | 9 | 144 | TPTVDSVSI | 29662 |
| HPV45 | L2 | 8 | 434 | TQYYLWPW | 29663 |
| HPV45 | L2 | 9 | 434 | TQYYLWPWY | 29664 |
| HPV45 | L2 | 10 | 434 | TQYYLWPWYY | 29665 |
| HPV45 | L2 | 11 | 434 | TQYYLWPWYYY | 29666 |
| HPV45 | L2 | 8 | 389 | TVPLTSAW | 29667 |
| HPV45 | L2 | 10 | 389 | TVPLTSAWDV | 29668 |
| HPV45 | L2 | 11 | 293 | TVRFSRLGQRA | 29669 |
| HPV45 | L2 | 10 | 217 | TVRRVRGPRL | 29670 |
| HPV45 | L2 | 11 | 217 | TVRRVRGPRLY | 29671 |
| HPV45 | L2 | 10 | 31 | VINKVEGTTL | 29672 |
| HPV45 | L2 | 11 | 31 | VINKVEGTTLA | 29673 |
| HPV45 | L2 | 8 | 140 | VLDITPTV | 29674 |
| HPV45 | L2 | 11 | 140 | VLDITPTVDSV | 29675 |
| HPV45 | L2 | 9 | 271 | VPDSDFMDI | 29676 |
| HPV45 | L2 | 10 | 271 | VPDSDFMDII | 29677 |
| HPV45 | L2 | 9 | 398 | VPIYTGPDI | 29678 |
| HPV45 | L2 | 10 | 398 | VPIYTGPDII | 29679 |
| HPV45 | L2 | 11 | 398 | VPIYTGPDIIL | 29680 |
| HPV45 | L2 | 10 | 72 | VPLGGRSNTV | 29681 |
| HPV45 | L2 | 11 | 72 | VPLGGRSNTVV | 29682 |
| HPV45 | L2 | 9 | 390 | VPLTSAWDV | 29683 |
| HPV45 | L2 | 11 | 390 | VPLTSAWDVPI | 29684 |
| HPV45 | L2 | 11 | 170 | VPQTGEVSGNI | 29685 |
| HPV45 | L2 | 10 | 119 | VPTFTGTSGF | 29686 |
| HPV45 | L2 | 8 | 112 | VVASGAPV | 29687 |
| HPV45 | L2 | 11 | 112 | VVASGAPVPTF | 29688 |
| HPV45 | L2 | 11 | 81 | VVDVGPTRPPV | 29689 |
| HPV45 | L2 | 9 | 415 | WPSTSPTNA | 29690 |
| HPV45 | L2 | 9 | 428 | YIGIHGTQY | 29691 |
| HPV45 | L2 | 10 | 428 | YIGIHGTQYY | 29692 |
| HPV45 | L2 | 11 | 428 | YIGIHGTQYYL | 29693 |
| HPV45 | L2 | 8 | 437 | YLWPWYYY | 29694 |
| HPV45 | L2 | 9 | 437 | YLWPWYYYF | 29695 |
| HPV45 | L2 | 8 | 370 | YPKYSLTM | 29696 |
| HPV45 | L2 | 11 | 71 | YVPLGGRSNTV | 29697 |
| HPV56 | E2 | 8 | 15 | AIEVQIAL | 29698 |
| HPV56 | E2 | 11 | 15 | AIEVQIALESL | 29699 |
| HPV56 | E2 | 9 | 21 | ALESLSTTI | 29700 |
| HPV56 | E2 | 10 | 21 | ALESLSTTIY | 29701 |
| HPV56 | E2 | 9 | 4 | CLQVCKAKA | 29702 |
| HPV56 | E2 | 9 | 71 | CMQYVAWKY | 29703 |
| HPV56 | E2 | 10 | 71 | CMQYVAWKYI | 29704 |
| HPV56 | E2 | 11 | 71 | CMQYVAWKYIY | 29705 |
| HPV56 | E2 | 11 | 138 | CPDSVSSTCRY | 29706 |
| HPV56 | E2 | 8 | 204 | CVTTHTHI | 29707 |
| HPV56 | E2 | 8 | 263 | DVTSTYHW | 29708 |
| HPV56 | E2 | 11 | 43 | ELWLTEPKKCF | 29709 |

TABLE XIV-continued

B62 Supermotif Peptides

| Type | Protein | No. of Amino Acid | Position | Sequence | Seq. Id. No. |
|---|---|---|---|---|---|
| HPV56 | E2 | 10 | 243 | EPNRLKCCRY | 29710 |
| HPV56 | E2 | 9 | 128 | EVHMENESI | 29711 |
| HPV56 | E2 | 10 | 128 | EVHMENESIY | 29712 |
| HPV56 | E2 | 9 | 17 | EVQIALESL | 29713 |
| HPV56 | E2 | 9 | 294 | FLSHVKIPV | 29714 |
| HPV56 | E2 | 10 | 294 | FLSHVKIPVV | 29715 |
| HPV56 | E2 | 11 | 294 | FLSHVKIPVVY | 29716 |
| HPV56 | E2 | 8 | 254 | FQKYKTLF | 29717 |
| HPV56 | E2 | 9 | 254 | FQKYKTLFV | 29718 |
| HPV56 | E2 | 11 | 254 | FQKYKTLFVDV | 29719 |
| HPV56 | E2 | 8 | 261 | FVDVTSTY | 29720 |
| HPV56 | E2 | 10 | 261 | FVDVTSTYHW | 29721 |
| HPV56 | E2 | 8 | 57 | GQHIEVWF | 29722 |
| HPV56 | E2 | 8 | 94 | GVDYRGIY | 29723 |
| HPV56 | E2 | 9 | 94 | GVDYRGIYY | 29724 |
| HPV56 | E2 | 10 | 94 | GVDYRGIYYV | 29725 |
| HPV56 | E2 | 9 | 239 | HLKGEPNRL | 29726 |
| HPV56 | E2 | 8 | 130 | HMENESIY | 29727 |
| HPV56 | E2 | 9 | 229 | HPGDKTTPV | 29728 |
| HPV56 | E2 | 10 | 229 | HPGDKTTPVV | 29729 |
| HPV56 | E2 | 8 | 297 | HVKIPVVY | 29730 |
| HPV56 | E2 | 10 | 297 | HVKIPVVYRL | 29731 |
| HPV56 | E2 | 11 | 297 | HVKIPVVYRLV | 29732 |
| HPV56 | E2 | 8 | 300 | IPVVYRLV | 29733 |
| HPV56 | E2 | 9 | 300 | IPVVYRLVW | 29734 |
| HPV56 | E2 | 8 | 299 | KIPVVYRL | 29735 |
| HPV56 | E2 | 9 | 299 | KIPVVYRLV | 29736 |
| HPV56 | E2 | 10 | 299 | KIPVVYRLVW | 29737 |
| HPV56 | E2 | 8 | 90 | KVCSGVDY | 29738 |
| HPV56 | E2 | 11 | 90 | KVCSGVDYRGI | 29739 |
| HPV56 | E2 | 8 | 5 | LQVCKAKA | 29740 |
| HPV56 | E2 | 11 | 5 | LQVCKAKACSA | 29741 |
| HPV56 | E2 | 8 | 72 | MQYVAWKY | 29742 |
| HPV56 | E2 | 9 | 72 | MQYVAWKYI | 29743 |
| HPV56 | E2 | 10 | 72 | MQYVAWKYIY | 29744 |
| HPV56 | E2 | 11 | 72 | MQYVAWKYIYY | 29745 |
| HPV56 | E2 | 10 | 1 | MVPCLQVCKA | 29746 |
| HPV56 | E2 | 8 | 149 | NVSPVETV | 29747 |
| HPV56 | E2 | 11 | 149 | NVSPVETVNEY | 29748 |
| HPV56 | E2 | 8 | 152 | PVETVNEY | 29749 |
| HPV56 | E2 | 8 | 301 | PVVYRLVW | 29750 |
| HPV56 | E2 | 11 | 19 | QIALESLSTTI | 29751 |
| HPV56 | E2 | 10 | 6 | QVCKAKACSA | 29752 |
| HPV56 | E2 | 11 | 6 | QVCKAKACSAI | 29753 |
| HPV56 | E2 | 9 | 246 | RLKCCRYRF | 29754 |
| HPV56 | E2 | 8 | 182 | RPGKRPRL | 29755 |
| HPV56 | E2 | 9 | 186 | RPRLRESEF | 29756 |
| HPV56 | E2 | 8 | 135 | SIYCPDSV | 29757 |
| HPV56 | E2 | 9 | 151 | SPVETVNEY | 29758 |
| HPV56 | E2 | 8 | 171 | SVGNQDAA | 29759 |
| HPV56 | E2 | 9 | 171 | SVGNQDAAV | 29760 |
| HPV56 | E2 | 8 | 141 | SVSSTCRY | 29761 |
| HPV56 | E2 | 10 | 141 | SVSSTCRYNV | 29762 |
| HPV56 | E2 | 8 | 28 | TIYNNEEW | 29763 |
| HPV56 | E2 | 10 | 28 | TIYNNEEWTL | 29764 |
| HPV56 | E2 | 10 | 259 | TLFVDVTSTY | 29765 |
| HPV56 | E2 | 9 | 36 | TLRDTCEEL | 29766 |
| HPV56 | E2 | 10 | 36 | TLRDTCEELW | 29767 |
| HPV56 | E2 | 11 | 36 | TLRDTCEELWL | 29768 |
| HPV56 | E2 | 10 | 289 | TQRNSFLSHV | 29769 |
| HPV56 | E2 | 9 | 2 | VPCLQVCKA | 29770 |
| HPV56 | E2 | 11 | 2 | VPCLQVCKAKA | 29771 |
| HPV56 | E2 | 8 | 18 | VQIALESL | 29772 |
| HPV56 | E2 | 11 | 237 | VVHLKGEPNRL | 29773 |
| HPV56 | E2 | 9 | 45 | WLTEPKKCF | 29774 |
| HPV56 | E2 | 8 | 88 | WQKVCSGV | 29775 |
| HPV56 | E2 | 10 | 88 | WQKVCSGVDY | 29776 |
| HPV56 | E2 | 10 | 79 | YIYYNGDCGW | 29777 |
| HPV56 | E2 | 8 | 74 | YVAWKYIY | 29778 |
| HPV56 | E2 | 9 | 74 | YVAWKYIYY | 29779 |
| HPV56 | E2 | 9 | 102 | YVHDGHKTY | 29780 |
| HPV56 | E2 | 10 | 102 | YVHDGHKTYY | 29781 |
| HPV56 | E6 | 8 | 64 | AVCRVCLL | 29782 |
| HPV56 | E6 | 9 | 64 | AVCRVCLLF | 29783 |
| HPV56 | E6 | 10 | 64 | AVCRVCLLFY | 29784 |

TABLE XIV-continued

B62 Supermotif Peptides

| Type | Protein | No. of Amino Acid | Position | Sequence | Seq. Id. No. |
|---|---|---|---|---|---|
| HPV56 | E6 | 8 | 69 | CLLFYSKV | 29785 |
| HPV56 | E6 | 11 | 69 | CLLFYSKVRKY | 29786 |
| HPV56 | E6 | 8 | 33 | CVYCKKEL | 29787 |
| HPV56 | E6 | 11 | 33 | CVYCKKELTRA | 29788 |
| HPV56 | E6 | 8 | 28 | DLRLSCVY | 29789 |
| HPV56 | E6 | 9 | 23 | EIPLIDLRL | 29790 |
| HPV56 | E6 | 10 | 52 | ELKLVYRDDF | 29791 |
| HPV56 | E6 | 8 | 39 | ELTRAEVY | 29792 |
| HPV56 | E6 | 10 | 39 | ELTRAEVYNF | 29793 |
| HPV56 | E6 | 11 | 39 | ELTRAEVYNFA | 29794 |
| HPV56 | E6 | 8 | 20 | EVLEIPLI | 29795 |
| HPV56 | E6 | 10 | 20 | EVLEIPLIDL | 29796 |
| HPV56 | E6 | 10 | 44 | EVYNFACTEL | 29797 |
| HPV56 | E6 | 8 | 61 | FPYAVCRV | 29798 |
| HPV56 | E6 | 10 | 61 | FPYAVCRVCL | 29799 |
| HPV56 | E6 | 11 | 61 | FPYAVCRVCLL | 29800 |
| HPV56 | E6 | 8 | 17 | HLSEVLEI | 29801 |
| HPV56 | E6 | 10 | 17 | HLSEVLEIPL | 29802 |
| HPV56 | E6 | 11 | 17 | HLSEVLEIPLI | 29803 |
| HPV56 | E6 | 8 | 24 | IPLIDLRL | 29804 |
| HPV56 | E6 | 11 | 24 | IPLIDLRLSCV | 29805 |
| HPV56 | E6 | 8 | 54 | KLVYRDDF | 29806 |
| HPV56 | E6 | 10 | 54 | KLVYRDDFPY | 29807 |
| HPV56 | E6 | 11 | 54 | KLVYRDDFPYA | 29808 |
| HPV56 | E6 | 8 | 97 | KQLCDLLI | 29809 |
| HPV56 | E6 | 11 | 97 | KQLCDLLIRCY | 29810 |
| HPV56 | E6 | 11 | 118 | KQLHCDRKRRF | 29811 |
| HPV56 | E6 | 8 | 75 | KVRKYRYY | 29812 |
| HPV56 | E6 | 10 | 75 | KVRKYRYYDY | 29813 |
| HPV56 | E6 | 11 | 130 | LIAHGWTGSCL | 29814 |
| HPV56 | E6 | 9 | 26 | LIDLRLSCV | 29815 |
| HPV56 | E6 | 10 | 26 | LIDLRLSCVY | 29816 |
| HPV56 | E6 | 11 | 103 | LIRCYRCQSPL | 29817 |
| HPV56 | E6 | 10 | 70 | LLFYSKVRKY | 29818 |
| HPV56 | E6 | 9 | 55 | LVYRDDFPY | 29819 |
| HPV56 | E6 | 10 | 55 | LVYRDDFPYA | 29820 |
| HPV56 | E6 | 11 | 55 | LVYRDDFPYAV | 29821 |
| HPV56 | E6 | 9 | 7 | NPQERPRSL | 29822 |
| HPV56 | E6 | 10 | 25 | PLIDLRLSCV | 29823 |
| HPV56 | E6 | 11 | 25 | PLIDLRLSCVY | 29824 |
| HPV56 | E6 | 9 | 112 | PLTPEEKQL | 29825 |
| HPV56 | E6 | 8 | 8 | PQERPRSL | 29826 |
| HPV56 | E6 | 11 | 8 | PQERPRSLHHL | 29827 |
| HPV56 | E6 | 10 | 98 | QLCDLLIRCY | 29828 |
| HPV56 | E6 | 10 | 119 | QLHCDRKRRF | 29829 |
| HPV56 | E6 | 11 | 30 | RLSCVYCKKEL | 29830 |
| HPV56 | E6 | 8 | 11 | RPRSLHHL | 29831 |
| HPV56 | E6 | 11 | 11 | RPRSLHHLSEV | 29832 |
| HPV56 | E6 | 10 | 67 | RVCLLFYSKV | 29833 |
| HPV56 | E6 | 10 | 93 | SITKKQLCDL | 29834 |
| HPV56 | E6 | 11 | 93 | SITKKQLCDLL | 29835 |
| HPV56 | E6 | 8 | 14 | SLHHLSEV | 29836 |
| HPV56 | E6 | 9 | 14 | SLHHLSEVL | 29837 |
| HPV56 | E6 | 11 | 14 | SLHHLSEVLEI | 29838 |
| HPV56 | E6 | 10 | 111 | SPLTPEEKQL | 29839 |
| HPV56 | E6 | 10 | 85 | SVYGATLESI | 29840 |
| HPV56 | E6 | 10 | 90 | TLESITKKQL | 29841 |
| HPV56 | E6 | 9 | 21 | VLEIPLIDL | 29842 |
| HPV56 | E6 | 11 | 21 | VLEIPLIDLRL | 29843 |
| HPV56 | E7 | 8 | 93 | ALTVTCPL | 29844 |
| HPV56 | E7 | 10 | 93 | ALTVTCPLCA | 29845 |
| HPV56 | E7 | 9 | 75 | DIQSTKEDL | 29846 |
| HPV56 | E7 | 11 | 75 | DIQSTKEDLRV | 29847 |
| HPV56 | E7 | 8 | 22 | DLQCNEQL | 29848 |
| HPV56 | E7 | 8 | 82 | DLRVVQQL | 29849 |
| HPV56 | E7 | 9 | 82 | DLRVVQQLL | 29850 |
| HPV56 | E7 | 10 | 82 | DLRVVQQLLM | 29851 |
| HPV56 | E7 | 10 | 20 | EIDLQCNEQL | 29852 |
| HPV56 | E7 | 8 | 14 | ELTPQTEI | 29853 |
| HPV56 | E7 | 10 | 14 | ELTPQTEIDL | 29854 |
| HPV56 | E7 | 9 | 42 | HLQERPQQA | 29855 |
| HPV56 | E7 | 9 | 62 | HVPCCECKF | 29856 |
| HPV56 | E7 | 10 | 62 | HVPCCECKFV | 29857 |
| HPV56 | E7 | 11 | 62 | HVPCCECKFVV | 29858 |
| HPV56 | E7 | 8 | 76 | IQSTKEDL | 29859 |

TABLE XIV-continued

B62 Supermotif Peptides

| Type | Protein | No. of Amino Acid | Position | Sequence | Seq. Id. No. |
|---|---|---|---|---|---|
| HPV56 | E7 | 10 | 76 | IQSTKEDLRV | 29860 |
| HPV56 | E7 | 11 | 76 | IQSTKEDLRVV | 29861 |
| HPV56 | E7 | 8 | 54 | KQHTCYLI | 29862 |
| HPV56 | E7 | 10 | 54 | KQHTCYLIHV | 29863 |
| HPV56 | E7 | 8 | 4 | KVPTLQDV | 29864 |
| HPV56 | E7 | 9 | 4 | KVPTLQDVV | 29865 |
| HPV56 | E7 | 10 | 4 | KVPTLQDVVL | 29866 |
| HPV56 | E7 | 11 | 60 | LIHVPCCECKF | 29867 |
| HPV56 | E7 | 8 | 89 | LLMGALTV | 29868 |
| HPV56 | E7 | 11 | 90 | LMGALTVTCPL | 29869 |
| HPV56 | E7 | 8 | 8 | LQDVVLEL | 29870 |
| HPV56 | E7 | 8 | 43 | LQERPQQA | 29871 |
| HPV56 | E7 | 11 | 43 | LQERPQQARQA | 29872 |
| HPV56 | E7 | 11 | 73 | QLDIQSTKEDL | 29873 |
| HPV56 | E7 | 9 | 88 | QLLMGALTV | 29874 |
| HPV56 | E7 | 8 | 87 | QQLLMGAL | 29875 |
| HPV56 | E7 | 10 | 87 | QQLLMGALTV | 29876 |
| HPV56 | E7 | 8 | 46 | RPQQARQA | 29877 |
| HPV56 | E7 | 9 | 51 | RQAKQHTCY | 29878 |
| HPV56 | E7 | 10 | 51 | RQAKQHTCYL | 29879 |
| HPV56 | E7 | 11 | 51 | RQAKQHTCYLI | 29880 |
| HPV56 | E7 | 8 | 84 | RVVQQLLM | 29881 |
| HPV56 | E7 | 10 | 84 | RVVQQLLMGA | 29882 |
| HPV56 | E7 | 11 | 84 | RVVQQLLMGAL | 29883 |
| HPV56 | E7 | 9 | 7 | TLQDVVLEL | 29884 |
| HPV56 | E7 | 8 | 16 | TPQTEIDL | 29885 |
| HPV56 | E7 | 8 | 95 | TVTCPLCA | 29886 |
| HPV56 | E7 | 10 | 12 | VLELTPQTEI | 29887 |
| HPV56 | E7 | 8 | 63 | VPCCECKF | 29888 |
| HPV56 | E7 | 9 | 63 | VPCCECKFV | 29889 |
| HPV56 | E7 | 10 | 63 | VPCCECKFVV | 29890 |
| HPV56 | E7 | 8 | 5 | VPTLQDVV | 29891 |
| HPV56 | E7 | 9 | 5 | VPTLQDVVL | 29892 |
| HPV56 | E7 | 11 | 5 | VPTLQDVVLEL | 29893 |
| HPV56 | E7 | 8 | 86 | VQQLLMGA | 29894 |
| HPV56 | E7 | 9 | 86 | VQQLLMGAL | 29895 |
| HPV56 | E7 | 11 | 86 | VQQLLMGALTV | 29896 |
| HPV56 | E7 | 11 | 11 | VVLELTPQTEI | 29897 |
| HPV56 | E7 | 9 | 85 | VVQQLLMGA | 29898 |
| HPV56 | E7 | 10 | 85 | VVQQLLMGAL | 29899 |
| HPV56 | L1 | 10 | 198 | AMGEHWTKGA | 29900 |
| HPV56 | L1 | 11 | 198 | AMGEHWTKGAV | 29901 |
| HPV56 | L1 | 9 | 521 | APTSTSTPA | 29902 |
| HPV56 | L1 | 8 | 350 | AQGHNNGI | 29903 |
| HPV56 | L1 | 10 | 350 | AQGHNNGICW | 29904 |
| HPV56 | L1 | 8 | 338 | AQLFNKPY | 29905 |
| HPV56 | L1 | 9 | 338 | AQLFNKPYW | 29906 |
| HPV56 | L1 | 10 | 338 | AQLFNKPYWL | 29907 |
| HPV56 | L1 | 10 | 512 | AVATSKKRSA | 29908 |
| HPV56 | L1 | 8 | 207 | AVCKSTQV | 29909 |
| HPV56 | L1 | 9 | 79 | AVGHPYYSV | 29910 |
| HPV56 | L1 | 8 | 26 | AVNVFPIF | 29911 |
| HPV56 | L1 | 9 | 26 | AVNVFPIFL | 29912 |
| HPV56 | L1 | 11 | 26 | AVNVFPIFLQM | 29913 |
| HPV56 | L1 | 8 | 19 | CIFLDVGA | 29914 |
| HPV56 | L1 | 9 | 19 | CIFLDVGAV | 29915 |
| HPV56 | L1 | 11 | 19 | CIFLDVGAVNV | 29916 |
| HPV56 | L1 | 8 | 191 | CIVGCTPA | 29917 |
| HPV56 | L1 | 9 | 191 | CIVGCTPAM | 29918 |
| HPV56 | L1 | 11 | 219 | CPPLALINTPI | 29919 |
| HPV56 | L1 | 9 | 257 | DIVQSTCKY | 29920 |
| HPV56 | L1 | 11 | 491 | DLDQFPLGRKF | 29921 |
| HPV56 | L1 | 9 | 233 | DMIDTGFGA | 29922 |
| HPV56 | L1 | 10 | 233 | DMIDTGFGAM | 29923 |
| HPV56 | L1 | 8 | 472 | DPLAKYKF | 29924 |
| HPV56 | L1 | 9 | 472 | DPLAKYKFW | 29925 |
| HPV56 | L1 | 11 | 472 | DPLAKYKFWDV | 29926 |
| HPV56 | L1 | 8 | 11 | DPPLHYGL | 29927 |
| HPV56 | L1 | 10 | 11 | DPPLHYGLCI | 29928 |
| HPV56 | L1 | 11 | 11 | DPPLHYGLCIF | 29929 |
| HPV56 | L1 | 8 | 128 | DQERLVWA | 29930 |
| HPV56 | L1 | 10 | 128 | DQERLVWACV | 29931 |
| HPV56 | L1 | 9 | 493 | DQFPLGRKF | 29932 |
| HPV56 | L1 | 10 | 493 | DQFPLGRKFL | 29933 |
| HPV56 | L1 | 11 | 493 | DQFPLGRKFLM | 29934 |

TABLE XIV-continued

B62 Supermotif Peptides

| Type | Protein | No. of Amino Acid | Position | Sequence | Seq. Id. No. |
|---|---|---|---|---|---|
| HPV56 | L1 | 8 | 23 | DVGAVNVF | 29935 |
| HPV56 | L1 | 10 | 23 | DVGAVNVFPI | 29936 |
| HPV56 | L1 | 11 | 23 | DVGAVNVFPIF | 29937 |
| HPV56 | L1 | 8 | 481 | DVNLQDSF | 29938 |
| HPV56 | L1 | 8 | 404 | ELQFVFQL | 29939 |
| HPV56 | L1 | 11 | 404 | ELQFVFQLCKI | 29940 |
| HPV56 | L1 | 8 | 318 | EPPPSSVY | 29941 |
| HPV56 | L1 | 9 | 318 | EPPPSSVYV | 29942 |
| HPV56 | L1 | 10 | 318 | EPPPSSVYVA | 29943 |
| HPV56 | L1 | 8 | 287 | EQLFARHY | 29944 |
| HPV56 | L1 | 9 | 287 | EQLFARHYF | 29945 |
| HPV56 | L1 | 8 | 383 | EQLSKYDA | 29946 |
| HPV56 | L1 | 11 | 383 | EQLSKYDARKI | 29947 |
| HPV56 | L1 | 11 | 464 | EQPPTEKQDPL | 29948 |
| HPV56 | L1 | 8 | 140 | EVGRGQPL | 29949 |
| HPV56 | L1 | 10 | 140 | EVGRGQPLGA | 29950 |
| HPV56 | L1 | 9 | 419 | EVMAYLHNM | 29951 |
| HPV56 | L1 | 11 | 419 | EVMAYLHNMNA | 29952 |
| HPV56 | L1 | 9 | 21 | FLDVGAVNV | 29953 |
| HPV56 | L1 | 10 | 21 | FLDVGAVNVF | 29954 |
| HPV56 | L1 | 8 | 30 | FPIFLQMA | 29955 |
| HPV56 | L1 | 10 | 30 | FPIFLQMATW | 29956 |
| HPV56 | L1 | 8 | 495 | FPLGRKFL | 29957 |
| HPV56 | L1 | 9 | 495 | FPLGRKFLM | 29958 |
| HPV56 | L1 | 11 | 495 | FPLGRKFLMQL | 29959 |
| HPV56 | L1 | 8 | 409 | FQLCKITL | 29960 |
| HPV56 | L1 | 10 | 409 | FQLCKITLSA | 29961 |
| HPV56 | L1 | 8 | 407 | FVFQLCKI | 29962 |
| HPV56 | L1 | 10 | 407 | FVFQLCKITL | 29963 |
| HPV56 | L1 | 8 | 356 | GICWGNQL | 29964 |
| HPV56 | L1 | 9 | 356 | GICWGNQLF | 29965 |
| HPV56 | L1 | 10 | 356 | GICWGNQLFV | 29966 |
| HPV56 | L1 | 8 | 17 | GLCIFLDV | 29967 |
| HPV56 | L1 | 10 | 17 | GLCIFLDVGA | 29968 |
| HPV56 | L1 | 11 | 17 | GLCIFLDVGAV | 29969 |
| HPV56 | L1 | 10 | 138 | GLEVGRGQPL | 29970 |
| HPV56 | L1 | 8 | 118 | GLPDTNIY | 29971 |
| HPV56 | L1 | 8 | 150 | GLSGHPLF | 29972 |
| HPV56 | L1 | 11 | 150 | GLSGHPLFNRL | 29973 |
| HPV56 | L1 | 10 | 438 | GLSPPVATSL | 29974 |
| HPV56 | L1 | 8 | 144 | GQPLGAGL | 29975 |
| HPV56 | L1 | 9 | 399 | HVEEYELQF | 29976 |
| HPV56 | L1 | 10 | 399 | HVEEYELQFV | 29977 |
| HPV56 | L1 | 11 | 399 | HVEEYELQFVF | 29978 |
| HPV56 | L1 | 9 | 96 | IPKVSAYQY | 29979 |
| HPV56 | L1 | 11 | 96 | IPKVSAYQYRV | 29980 |
| HPV56 | L1 | 8 | 192 | IVGCTPAM | 29981 |
| HPV56 | L1 | 8 | 258 | IVQSTCKY | 29982 |
| HPV56 | L1 | 11 | 258 | IVQSTCKYPDY | 29983 |
| HPV56 | L1 | 9 | 392 | KINQYLRHV | 29984 |
| HPV56 | L1 | 8 | 413 | KITLSAEV | 29985 |
| HPV56 | L1 | 9 | 413 | KITLSAEVM | 29986 |
| HPV56 | L1 | 10 | 413 | KITLSAEVMA | 29987 |
| HPV56 | L1 | 11 | 413 | KITLSAEVMAY | 29988 |
| HPV56 | L1 | 11 | 270 | KMSADAYGDSM | 29989 |
| HPV56 | L1 | 8 | 343 | KPYWLQRA | 29990 |
| HPV56 | L1 | 8 | 470 | KQDPLAKY | 29991 |
| HPV56 | L1 | 10 | 470 | RQDPLAKYKF | 29992 |
| HPV56 | L1 | 11 | 470 | KQDPLAKYKFW | 29993 |
| HPV56 | L1 | 8 | 186 | KQTQLCIV | 29994 |
| HPV56 | L1 | 8 | 300 | KVGETIPA | 29995 |
| HPV56 | L1 | 10 | 300 | KVGETIPAEL | 29996 |
| HPV56 | L1 | 11 | 300 | KVGETIPAELY | 29997 |
| HPV56 | L1 | 8 | 245 | KVLQESKA | 29998 |
| HPV56 | L1 | 10 | 245 | KVLQESKAEV | 29999 |
| HPV56 | L1 | 9 | 98 | KVSAYQYRV | 30000 |
| HPV56 | L1 | 10 | 98 | KVSAYQYRVF | 30001 |
| HPV56 | L1 | 8 | 55 | KVVATDSY | 30002 |
| HPV56 | L1 | 9 | 55 | KVVATDSYV | 30003 |
| HPV56 | L1 | 9 | 45 | KVYLPPTPV | 30004 |
| HPV56 | L1 | 11 | 224 | LINTPIEDGDM | 30005 |
| HPV56 | L1 | 8 | 77 | LLAVGHPY | 30006 |
| HPV56 | L1 | 9 | 77 | LLAVGHPYY | 30007 |
| HPV56 | L1 | 11 | 77 | LLAVGHPYYSV | 30008 |
| HPV56 | L1 | 9 | 431 | LLEDWNIGL | 30009 |

TABLE XIV-continued

B62 Supermotif Peptides

| Type | Protein | No. of Amino Acid | Position | Sequence | Seq. Id. No. |
|---|---|---|---|---|---|
| HPV56 | L1 | 11 | 502 | LMQLGTRSKPA | 30010 |
| HPV56 | L1 | 9 | 111 | LPDPNKFGL | 30011 |
| HPV56 | L1 | 9 | 48 | LPPTPVSKV | 30012 |
| HPV56 | L1 | 10 | 48 | LPPTPVSKVV | 30013 |
| HPV56 | L1 | 11 | 48 | LPPTPVSKVVA | 30014 |
| HPV56 | L1 | 9 | 484 | LQDSFSTDL | 30015 |
| HPV56 | L1 | 8 | 247 | LQESKAEV | 30016 |
| HPV56 | L1 | 10 | 247 | LQESKAEVPL | 30017 |
| HPV56 | L1 | 10 | 405 | LQFVFQLCKI | 30018 |
| HPV56 | L1 | 11 | 347 | LQRAQGHNNGI | 30019 |
| HPV56 | L1 | 8 | 132 | LVWACVGL | 30020 |
| HPV56 | L1 | 10 | 132 | LVWACVGLEV | 30021 |
| HPV56 | L1 | 8 | 234 | MIDTGFGA | 30022 |
| HPV56 | L1 | 9 | 234 | MIDTGFGAM | 30023 |
| HPV56 | L1 | 11 | 234 | MIDTGFGAMDF | 30024 |
| HPV56 | L1 | 8 | 333 | MITSEAQL | 30025 |
| HPV56 | L1 | 9 | 333 | MITSEAQLF | 30026 |
| HPV56 | L1 | 8 | 2 | MLPMMYIY | 30027 |
| HPV56 | L1 | 8 | 1 | MMLPMMYI | 30028 |
| HPV56 | L1 | 9 | 1 | MMLPMMYIY | 30029 |
| HPV56 | L1 | 10 | 5 | MMYIYRDPPL | 30030 |
| HPV56 | L1 | 10 | 503 | MQLGTRSKPA | 30031 |
| HPV56 | L1 | 11 | 503 | MQLGTRSKPAV | 30032 |
| HPV56 | L1 | 8 | 436 | NIGLSPPV | 30033 |
| HPV56 | L1 | 9 | 436 | NIGLSPPVA | 30034 |
| HPV56 | L1 | 8 | 95 | NIPKVSAY | 30035 |
| HPV56 | L1 | 10 | 95 | NIPKVSAYQY | 30036 |
| HPV56 | L1 | 11 | 180 | NISVDGKQTQL | 30037 |
| HPV56 | L1 | 10 | 123 | NIYNPDQERL | 30038 |
| HPV56 | L1 | 11 | 123 | NIYNPDQERLV | 30039 |
| HPV56 | L1 | 8 | 167 | NLANNNVI | 30040 |
| HPV56 | L1 | 8 | 430 | NLLEDWNI | 30041 |
| HPV56 | L1 | 10 | 430 | NLLEDWNIGL | 30042 |
| HPV56 | L1 | 10 | 483 | NLQDSFSTDL | 30043 |
| HPV56 | L1 | 10 | 426 | NMNANLLEDW | 30044 |
| HPV56 | L1 | 11 | 375 | NMTISTATEQL | 30045 |
| HPV56 | L1 | 8 | 126 | NPDQERLV | 30046 |
| HPV56 | L1 | 9 | 126 | NPDQERLVW | 30047 |
| HPV56 | L1 | 10 | 126 | NPDQERLVWA | 30048 |
| HPV56 | L1 | 8 | 361 | NQLFVTVV | 30049 |
| HPV56 | L1 | 10 | 394 | NQYLRHVEEY | 30050 |
| HPV56 | L1 | 9 | 28 | NVFPIFLQM | 30051 |
| HPV56 | L1 | 10 | 28 | NVFPIFLQMA | 30052 |
| HPV56 | L1 | 10 | 172 | NVIEDSRDNI | 30053 |
| HPV56 | L1 | 8 | 228 | PIEDGDMI | 30054 |
| HPV56 | L1 | 9 | 31 | PIFLQMATW | 30055 |
| HPV56 | L1 | 8 | 473 | PLAKYKFW | 30056 |
| HPV56 | L1 | 10 | 473 | PLAKYKFWDV | 30057 |
| HPV56 | L1 | 9 | 221 | PLALINTPI | 30058 |
| HPV56 | L1 | 11 | 255 | PLDIVQSTCKY | 30059 |
| HPV56 | L1 | 11 | 146 | PLGAGLSGHPL | 30060 |
| HPV56 | L1 | 8 | 496 | PLGRKFLM | 30061 |
| HPV56 | L1 | 10 | 496 | PLGRKFLMQL | 30062 |
| HPV56 | L1 | 8 | 13 | PLHYGLCI | 30063 |
| HPV56 | L1 | 9 | 13 | PLHYGLCIF | 30064 |
| HPV56 | L1 | 10 | 13 | PLHYGLCIFL | 30065 |
| HPV56 | L1 | 11 | 4 | PMMYIYRDPPL | 30066 |
| HPV56 | L1 | 10 | 220 | PPLALINTPI | 30067 |
| HPV56 | L1 | 9 | 12 | PPLHYGLCI | 30068 |
| HPV56 | L1 | 10 | 12 | PPLHYGLCIF | 30069 |
| HPV56 | L1 | 11 | 12 | PPLHYGLCIFL | 30070 |
| HPV56 | L1 | 8 | 319 | PPPSSVYV | 30071 |
| HPV56 | L1 | 9 | 319 | PPPSSVYVA | 30072 |
| HPV56 | L1 | 8 | 320 | PPSSVYVA | 30073 |
| HPV56 | L1 | 9 | 466 | PPTEKQDPL | 30074 |
| HPV56 | L1 | 10 | 466 | PPTEKQDPLA | 30075 |
| HPV56 | L1 | 8 | 49 | PPTPVSKV | 30076 |
| HPV56 | L1 | 9 | 49 | PPTPVSKVV | 30077 |
| HPV56 | L1 | 10 | 49 | PPTPVSKVVA | 30078 |
| HPV56 | L1 | 11 | 441 | PPVATSLEDKY | 30079 |
| HPV56 | L1 | 10 | 442 | PVATSLEDKY | 30080 |
| HPV56 | L1 | 11 | 52 | PVSKVVATDSY | 30081 |
| HPV56 | L1 | 10 | 189 | QLCIVGCTPA | 30082 |
| HPV56 | L1 | 11 | 189 | QLCIVGCTPAM | 30083 |
| HPV56 | L1 | 9 | 410 | QLCKITLSA | 30084 |

TABLE XIV-continued

B62 Supermotif Peptides

| Type | Protein | No. of Amino Acid | Position | Sequence | Seq. Id. No. |
|---|---|---|---|---|---|
| HPV56 | L1 | 11 | 410 | QLCKITLSAEV | 30085 |
| HPV56 | L1 | 8 | 288 | QLFARHYF | 30086 |
| HPV56 | L1 | 11 | 288 | QLFARHYFNRA | 30087 |
| HPV56 | L1 | 8 | 339 | QLFNKPYW | 30088 |
| HPV56 | L1 | 9 | 339 | QLFNKPYWL | 30089 |
| HPV56 | L1 | 9 | 504 | QLGTRSKPA | 30090 |
| HPV56 | L1 | 10 | 504 | QLGTRSKPAV | 30091 |
| HPV56 | L1 | 11 | 504 | QLGTRSKPAVA | 30092 |
| HPV56 | L1 | 10 | 384 | QLSKYDARKI | 30093 |
| HPV56 | L1 | 10 | 465 | QPPTEKQDPL | 30094 |
| HPV56 | L1 | 11 | 465 | QPPTEKQDPLA | 30095 |
| HPV56 | L1 | 10 | 213 | QVTTGDCPPL | 30096 |
| HPV56 | L1 | 11 | 213 | QVTTGDCPPLA | 30097 |
| HPV56 | L1 | 10 | 159 | RLDDTESSNL | 30098 |
| HPV56 | L1 | 11 | 159 | RLDDTESSNLA | 30099 |
| HPV56 | L1 | 9 | 76 | RLLAVGHPY | 30100 |
| HPV56 | L1 | 10 | 76 | RLLAVGHPYY | 30101 |
| HPV56 | L1 | 8 | 110 | RLPDPNKF | 30102 |
| HPV56 | L1 | 10 | 110 | RLPDPNKFGL | 30103 |
| HPV56 | L1 | 9 | 131 | RLVWACVGL | 30104 |
| HPV56 | L1 | 11 | 131 | RLVWACVGLEV | 30105 |
| HPV56 | L1 | 8 | 40 | RPSENKVY | 30106 |
| HPV56 | L1 | 9 | 40 | RPSENKVYL | 30107 |
| HPV56 | L1 | 10 | 108 | RVRLPDPNKF | 30108 |
| HPV56 | L1 | 11 | 67 | SIFYHAGSSRL | 30109 |
| HPV56 | L1 | 8 | 446 | SLEDKYRY | 30110 |
| HPV56 | L1 | 9 | 446 | SLEDKYRYV | 30111 |
| HPV56 | L1 | 9 | 332 | SMITSEAQL | 30112 |
| HPV56 | L1 | 10 | 332 | SMITSEAQLF | 30113 |
| HPV56 | L1 | 11 | 279 | SMWFYLRREQL | 30114 |
| HPV56 | L1 | 8 | 440 | SPPVATSL | 30115 |
| HPV56 | L1 | 9 | 182 | SVDGKQTQL | 30116 |
| HPV56 | L1 | 11 | 182 | SVDGKQTQLCI | 30117 |
| HPV56 | L1 | 11 | 86 | SVTKDNTKTNI | 30118 |
| HPV56 | L1 | 11 | 323 | SVYVATPSGSM | 30119 |
| HPV56 | L1 | 8 | 304 | TIPAELYL | 30120 |
| HPV56 | L1 | 9 | 377 | TISTATEQL | 30121 |
| HPV56 | L1 | 8 | 415 | TLSAEVMA | 30122 |
| HPV56 | L1 | 9 | 415 | TLSAEVMAY | 30123 |
| HPV56 | L1 | 10 | 415 | TLSAEVMAYL | 30124 |
| HPV56 | L1 | 8 | 196 | TPAMGEHW | 30125 |
| HPV56 | L1 | 8 | 227 | TPIEDGDM | 30126 |
| HPV56 | L1 | 9 | 227 | TPIEDGDMI | 30127 |
| HPV56 | L1 | 11 | 328 | TPSGSMITSEA | 30128 |
| HPV56 | L1 | 8 | 51 | TPVSKVVA | 30129 |
| HPV56 | L1 | 11 | 188 | TQLCIVGCTPA | 30130 |
| HPV56 | L1 | 11 | 212 | TQVTTGDCPPL | 30131 |
| HPV56 | L1 | 11 | 366 | TVVDTTRSTNM | 30132 |
| HPV56 | L1 | 9 | 173 | VIEDSRDNI | 30133 |
| HPV56 | L1 | 11 | 173 | VIEDSRDNISV | 30134 |
| HPV56 | L1 | 9 | 246 | VLQESKAEV | 30135 |
| HPV56 | L1 | 11 | 246 | VLQESKAEVPL | 30136 |
| HPV56 | L1 | 8 | 420 | VMAYLHNM | 30137 |
| HPV56 | L1 | 10 | 420 | VMAYLHNMNA | 30138 |
| HPV56 | L1 | 10 | 259 | VQSTCKYPDY | 30139 |
| HPV56 | L1 | 11 | 259 | VQSTCKYPDYL | 30140 |
| HPV56 | L1 | 8 | 56 | VVATDSYV | 30141 |
| HPV56 | L1 | 10 | 367 | VVDTTRSTNM | 30142 |
| HPV56 | L1 | 8 | 7 | YIYRDPPL | 30143 |
| HPV56 | L1 | 10 | 7 | YIYRDPPLHY | 30144 |
| HPV56 | L1 | 9 | 423 | YLHNMNANL | 30145 |
| HPV56 | L1 | 10 | 423 | YLHNMNANLL | 30146 |
| HPV56 | L1 | 8 | 268 | YLKMSADA | 30147 |
| HPV56 | L1 | 9 | 268 | YLKMSADAY | 30148 |
| HPV56 | L1 | 10 | 47 | YLPPTPVSKV | 30149 |
| HPV56 | L1 | 11 | 47 | YLPPTPVSKVV | 30150 |
| HPV56 | L1 | 8 | 396 | YLRHVEEY | 30151 |
| HPV56 | L1 | 10 | 396 | YLRHVEEYEL | 30152 |
| HPV56 | L1 | 8 | 283 | YLRREQLF | 30153 |
| HPV56 | L1 | 9 | 283 | YLRREQLFA | 30154 |
| HPV56 | L1 | 9 | 265 | YPDYLKMSA | 30155 |
| HPV56 | L1 | 11 | 265 | YPDYLKMSADA | 30156 |
| HPV56 | L1 | 8 | 102 | YQYRVFRV | 30157 |
| HPV56 | L1 | 10 | 102 | YQYRVFRVRL | 30158 |
| HPV56 | L1 | 9 | 325 | YVATPSGSM | 30159 |

TABLE XIV-continued

B62 Supermotif Peptides

| Type | Protein | No. of Amino Acid | Position | Sequence | Seq. Id. No. |
|---|---|---|---|---|---|
| HPV56 | L1 | 10 | 325 | YVATPSGSMI | 30160 |
| HPV56 | L1 | 8 | 62 | YVKRTSIF | 30161 |
| HPV56 | L1 | 9 | 62 | YVKRTSIFY | 30162 |
| HPV56 | L1 | 11 | 62 | YVKRTSIFYHA | 30163 |
| HPV56 | L2 | 8 | 438 | ALWPVYFF | 30164 |
| HPV56 | L2 | 9 | 271 | APDPDFMNI | 30165 |
| HPV56 | L2 | 10 | 271 | APDPDFMNIV | 30166 |
| HPV56 | L2 | 11 | 271 | APDPDFMNIVA | 30167 |
| HPV56 | L2 | 9 | 358 | APGLSSQSV | 30168 |
| HPV56 | L2 | 10 | 358 | APGLSSQSVA | 30169 |
| HPV56 | L2 | 11 | 391 | APLGNVWETPF | 30170 |
| HPV56 | L2 | 11 | 170 | APQTGEVSGNI | 30171 |
| HPV56 | L2 | 8 | 223 | APRLYRKA | 30172 |
| HPV56 | L2 | 9 | 223 | APRLYRKAF | 30173 |
| HPV56 | L2 | 8 | 327 | AQAEEIEM | 30174 |
| HPV56 | L2 | 11 | 327 | AQAEEIEMQPL | 30175 |
| HPV56 | L2 | 10 | 201 | AVHGSGTEPI | 30176 |
| HPV56 | L2 | 9 | 27 | CPEDVVNKI | 30177 |
| HPV56 | L2 | 8 | 322 | DISPIAQA | 30178 |
| HPV56 | L2 | 11 | 322 | DISPIAQAEEI | 30179 |
| HPV56 | L2 | 9 | 142 | DITPTSSTV | 30180 |
| HPV56 | L2 | 11 | 142 | DITPTSSTVHV | 30181 |
| HPV56 | L2 | 11 | 406 | DIVLPTGPSTW | 30182 |
| HPV56 | L2 | 10 | 349 | DIYANIDDEA | 30183 |
| HPV56 | L2 | 9 | 238 | DPAFLDRPA | 30184 |
| HPV56 | L2 | 11 | 238 | DPAFLDRPATL | 30185 |
| HPV56 | L2 | 8 | 273 | DPDFMNIV | 30186 |
| HPV56 | L2 | 9 | 273 | DPDFMNIVA | 30187 |
| HPV56 | L2 | 10 | 273 | DPDFMNIVAL | 30188 |
| HPV56 | L2 | 8 | 100 | DPSIVTLV | 30189 |
| HPV56 | L2 | 8 | 425 | DVTHDVYI | 30190 |
| HPV56 | L2 | 9 | 83 | DVTPARPPI | 30191 |
| HPV56 | L2 | 10 | 83 | DVTPARPPIV | 30192 |
| HPV56 | L2 | 11 | 83 | DVTPARPPIVV | 30193 |
| HPV56 | L2 | 11 | 30 | DVVNKIEQKTW | 30194 |
| HPV56 | L2 | 9 | 429 | DVYIQGSSF | 30195 |
| HPV56 | L2 | 10 | 429 | DVYIQGSSFA | 30196 |
| HPV56 | L2 | 11 | 429 | DVYIQGSSFAL | 30197 |
| HPV56 | L2 | 8 | 331 | EIEMQPLL | 30198 |
| HPV56 | L2 | 10 | 331 | EIEMQPLLSA | 30199 |
| HPV56 | L2 | 8 | 194 | EIPMQTFA | 30200 |
| HPV56 | L2 | 9 | 194 | EIPMQTFAV | 30201 |
| HPV56 | L2 | 11 | 129 | EITSSSTTTPA | 30202 |
| HPV56 | L2 | 8 | 333 | EMQPLLSA | 30203 |
| HPV56 | L2 | 8 | 208 | EPISSTPI | 30204 |
| HPV56 | L2 | 11 | 208 | EPISSTPIPGF | 30205 |
| HPV56 | L2 | 9 | 36 | EQKTWADKI | 30206 |
| HPV56 | L2 | 10 | 36 | EQKTWADKIL | 30207 |
| HPV56 | L2 | 8 | 175 | EVSGNILI | 30208 |
| HPV56 | L2 | 9 | 162 | FIDPPVIEA | 30209 |
| HPV56 | L2 | 8 | 241 | FLDRPATL | 30210 |
| HPV56 | L2 | 9 | 241 | FLDRPATLV | 30211 |
| HPV56 | L2 | 11 | 241 | FLDRPATLVSA | 30212 |
| HPV56 | L2 | 11 | 276 | FMNIVALHRPA | 30213 |
| HPV56 | L2 | 10 | 231 | FQQVKVTDPA | 30214 |
| HPV56 | L2 | 11 | 231 | FQQVKVTDPAF | 30215 |
| HPV56 | L2 | 9 | 418 | FVPQSPYDV | 30216 |
| HPV56 | L2 | 8 | 188 | GIHSYEEI | 30217 |
| HPV56 | L2 | 10 | 188 | GIHSYEEIPM | 30218 |
| HPV56 | L2 | 11 | 118 | GIPNFTGSGGF | 30219 |
| HPV56 | L2 | 8 | 360 | GLSSQSVA | 30220 |
| HPV56 | L2 | 9 | 346 | GLYDIYANI | 30221 |
| HPV56 | L2 | 8 | 412 | GPSTWPFV | 30222 |
| HPV56 | L2 | 8 | 97 | GPTDPSIV | 30223 |
| HPV56 | L2 | 10 | 97 | GPTDPSIVTL | 30224 |
| HPV56 | L2 | 11 | 97 | GPTDPSIVTLV | 30225 |
| HPV56 | L2 | 8 | 269 | GVAPDPDF | 30226 |
| HPV56 | L2 | 9 | 269 | GVAPDPDFM | 30227 |
| HPV56 | L2 | 11 | 269 | GVAPDPDFMNI | 30228 |
| HPV56 | L2 | 11 | 293 | GVRFSRLGRKA | 30229 |
| HPV56 | L2 | 8 | 156 | HITNPLFI | 30230 |
| HPV56 | L2 | 9 | 372 | HLPIKPSTL | 30231 |
| HPV56 | L2 | 11 | 372 | HLPIKPSTLSF | 30232 |
| HPV56 | L2 | 11 | 151 | HVSSTHITNPL | 30233 |
| HPV56 | L2 | 10 | 180 | ILISTPTSGI | 30234 |

TABLE XIV-continued

B62 Supermotif Peptides

| Type | Protein | No. of Amino Acid | Position | Sequence | Seq. Id. No. |
|---|---|---|---|---|---|
| HPV56 | L2 | 8 | 44 | ILQWGSLF | 30235 |
| HPV56 | L2 | 10 | 44 | ILQWGSLFTY | 30236 |
| HPV56 | L2 | 11 | 44 | ILQWGSLFTYF | 30237 |
| HPV56 | L2 | 8 | 215 | IPGFRRIA | 30238 |
| HPV56 | L2 | 9 | 215 | IPGFRRIAA | 30239 |
| HPV56 | L2 | 8 | 195 | IPMQTFAV | 30240 |
| HPV56 | L2 | 10 | 119 | IPNFTGSGGF | 30241 |
| HPV56 | L2 | 10 | 453 | IPYFFADGDV | 30242 |
| HPV56 | L2 | 11 | 453 | IPYFFADGDVA | 30243 |
| HPV56 | L2 | 8 | 432 | IQGSSFAL | 30244 |
| HPV56 | L2 | 9 | 432 | IQGSSFALW | 30245 |
| HPV56 | L2 | 11 | 432 | IQGSSFALWPV | 30246 |
| HPV56 | L2 | 9 | 305 | IQTRRGTQI | 30247 |
| HPV56 | L2 | 11 | 305 | IQTRRGTQIGA | 30248 |
| HPV56 | L2 | 8 | 279 | IVALHRPA | 30249 |
| HPV56 | L2 | 9 | 279 | IVALHRPAF | 30250 |
| HPV56 | L2 | 11 | 81 | IVDVTPARPPI | 30251 |
| HPV56 | L2 | 10 | 407 | IVLPTGPSTW | 30252 |
| HPV56 | L2 | 10 | 103 | IVTLVEESSV | 30253 |
| HPV56 | L2 | 11 | 103 | IVTLVEESSVI | 30254 |
| HPV56 | L2 | 8 | 34 | KIEQKTWA | 30255 |
| HPV56 | L2 | 11 | 34 | KIEQKTWADKI | 30256 |
| HPV56 | L2 | 8 | 43 | KILQWGSL | 30257 |
| HPV56 | L2 | 9 | 43 | KILQWGSLF | 30258 |
| HPV56 | L2 | 11 | 43 | KILQWGSLFTY | 30259 |
| HPV56 | L2 | 10 | 22 | KLSGTCPEDV | 30260 |
| HPV56 | L2 | 11 | 22 | KLSGTCPEDVV | 30261 |
| HPV56 | L2 | 8 | 376 | KPSTLSFA | 30262 |
| HPV56 | L2 | 8 | 235 | KVTDPAFL | 30263 |
| HPV56 | L2 | 9 | 181 | LISTPTSGI | 30264 |
| HPV56 | L2 | 8 | 337 | LLSANNSF | 30265 |
| HPV56 | L2 | 11 | 337 | LLSANNSFDGL | 30266 |
| HPV56 | L2 | 8 | 373 | LPIKPSTL | 30267 |
| HPV56 | L2 | 10 | 373 | LPIKPSTLSF | 30268 |
| HPV56 | L2 | 11 | 373 | LPIKPSTLSFA | 30269 |
| HPV56 | L2 | 8 | 409 | LPTGPSTW | 30270 |
| HPV56 | L2 | 10 | 409 | LPTGPSTWPF | 30271 |
| HPV56 | L2 | 11 | 409 | LPTGPSTWPFV | 30272 |
| HPV56 | L2 | 9 | 45 | LQWGSLFTY | 30273 |
| HPV56 | L2 | 10 | 45 | LQWGSLFTYF | 30274 |
| HPV56 | L2 | 8 | 106 | LVEESSVI | 30275 |
| HPV56 | L2 | 8 | 248 | LVSADNPL | 30276 |
| HPV56 | L2 | 9 | 248 | LVSADNPLF | 30277 |
| HPV56 | L2 | 11 | 334 | MQPLLSANNSF | 30278 |
| HPV56 | L2 | 9 | 353 | NIDDEAPGL | 30279 |
| HPV56 | L2 | 11 | 179 | NILISTPTSGI | 30280 |
| HPV56 | L2 | 9 | 278 | NIVALHRPA | 30281 |
| HPV56 | L2 | 10 | 278 | NIVALHRPAF | 30282 |
| HPV56 | L2 | 11 | 253 | NPLFEGTDTSL | 30283 |
| HPV56 | L2 | 9 | 159 | NPLFIDPPV | 30284 |
| HPV56 | L2 | 10 | 159 | NPLFIDPPVI | 30285 |
| HPV56 | L2 | 9 | 388 | NVTAPLGNV | 30286 |
| HPV56 | L2 | 10 | 388 | NVTAPLGNVW | 30287 |
| HPV56 | L2 | 8 | 395 | NVWETPFY | 30288 |
| HPV56 | L2 | 8 | 325 | PIAQQEEI | 30289 |
| HPV56 | L2 | 10 | 325 | PIAQAEEIEM | 30290 |
| HPV56 | L2 | 9 | 374 | PIKPSTLSF | 30291 |
| HPV56 | L2 | 10 | 374 | PIKPSTLSFA | 30292 |
| HPV56 | L2 | 8 | 214 | PIPGFRRI | 30293 |
| HPV56 | L2 | 9 | 214 | PIPGFRRIA | 30294 |
| HPV56 | L2 | 10 | 214 | PIPGFRRIAA | 30295 |
| HPV56 | L2 | 10 | 209 | PISSTPIPGF | 30296 |
| HPV56 | L2 | 10 | 254 | PLFEGTDTSL | 30297 |
| HPV56 | L2 | 11 | 254 | PLFEGTDTSLA | 30298 |
| HPV56 | L2 | 8 | 160 | PLFIDPPV | 30299 |
| HPV56 | L2 | 9 | 160 | PLFIDPPVI | 30300 |
| HPV56 | L2 | 11 | 160 | PLFIDPPVIEA | 30301 |
| HPV56 | L2 | 10 | 392 | PLGNVWETPF | 30302 |
| HPV56 | L2 | 11 | 392 | PLGNVWETPFY | 30303 |
| HPV56 | L2 | 9 | 73 | PLGSRPSTI | 30304 |
| HPV56 | L2 | 10 | 73 | PLGSRPSTIV | 30305 |
| HPV56 | L2 | 9 | 336 | PLLSANNSF | 30306 |
| HPV56 | L2 | 8 | 89 | PPIVVESV | 30307 |
| HPV56 | L2 | 11 | 420 | PQSPYDVTHDV | 30308 |
| HPV56 | L2 | 10 | 171 | PQTGEVSGNI | 30309 |

TABLE XIV-continued

B62 Supermotif Peptides

| Type | Protein | No. of Amino Acid | Position | Sequence | Seq. Id. No. |
|---|---|---|---|---|---|
| HPV56 | L2 | 11 | 171 | PQTGEVSGNIL | 30310 |
| HPV56 | L2 | 11 | 166 | PVIEAPQTGEV | 30311 |
| HPV56 | L2 | 8 | 312 | QIGARVHY | 30312 |
| HPV56 | L2 | 9 | 312 | QIGARVHYY | 30313 |
| HPV56 | L2 | 10 | 312 | QIGARVHYYY | 30314 |
| HPV56 | L2 | 8 | 16 | QLYKTCKL | 30315 |
| HPV56 | L2 | 10 | 335 | QPLLSANNSF | 30316 |
| HPV56 | L2 | 9 | 232 | QQVKVTDPA | 30317 |
| HPV56 | L2 | 10 | 232 | QQVKVTDPAF | 30318 |
| HPV56 | L2 | 11 | 232 | QQVKVTDPAFL | 30319 |
| HPV56 | L2 | 8 | 233 | QVKVTDPA | 30320 |
| HPV56 | L2 | 9 | 233 | QVKVTDPAF | 30321 |
| HPV56 | L2 | 10 | 233 | QVKVTDPAFL | 30322 |
| HPV56 | L2 | 8 | 220 | RIAAPRLY | 30323 |
| HPV56 | L2 | 11 | 220 | RIAAPRLYRKA | 30324 |
| HPV56 | L2 | 11 | 452 | RIPYFFADGDV | 30325 |
| HPV56 | L2 | 8 | 298 | RLGRKATI | 30326 |
| HPV56 | L2 | 10 | 225 | RLYRKAFQQV | 30327 |
| HPV56 | L2 | 11 | 284 | RPAFTTRRGGV | 30328 |
| HPV56 | L2 | 8 | 244 | RPATLVSA | 30329 |
| HPV56 | L2 | 9 | 88 | RPPIVVESV | 30330 |
| HPV56 | L2 | 8 | 77 | RPSTIVDV | 30331 |
| HPV56 | L2 | 11 | 77 | RPSTIVDVTPA | 30332 |
| HPV56 | L2 | 8 | 316 | RVHYYYDI | 30333 |
| HPV56 | L2 | 11 | 316 | RVHYYYDISPI | 30334 |
| HPV56 | L2 | 11 | 102 | SIVTLVEESSV | 30335 |
| HPV56 | L2 | 9 | 262 | SLAFSPSGV | 30336 |
| HPV56 | L2 | 10 | 262 | SLAFSPSGVA | 30337 |
| HPV56 | L2 | 9 | 49 | SLFTYFGGL | 30338 |
| HPV56 | L2 | 11 | 49 | SLFTYFGGLGI | 30339 |
| HPV56 | L2 | 9 | 324 | SPIAQAEEI | 30340 |
| HPV56 | L2 | 11 | 324 | SPIAQAEEIEM | 30341 |
| HPV56 | L2 | 11 | 266 | SPSGVAPDPDF | 30342 |
| HPV56 | L2 | 9 | 422 | SPYDVTHDV | 30343 |
| HPV56 | L2 | 10 | 422 | SPYDVTHDVY | 30344 |
| HPV56 | L2 | 11 | 422 | SPYDVTHDVYI | 30345 |
| HPV56 | L2 | 9 | 363 | SQSVATPSA | 30346 |
| HPV56 | L2 | 11 | 363 | SQSVATPSAHL | 30347 |
| HPV56 | L2 | 9 | 365 | SVATPSAHL | 30348 |
| HPV56 | L2 | 11 | 365 | SVATPSAHLPI | 30349 |
| HPV56 | L2 | 9 | 95 | SVGPTDPSI | 30350 |
| HPV56 | L2 | 10 | 95 | SVGPTDPSIV | 30351 |
| HPV56 | L2 | 9 | 111 | SVIESGAGI | 30352 |
| HPV56 | L2 | 10 | 304 | TIQTRRGTQI | 30353 |
| HPV56 | L2 | 8 | 80 | TIVDVTPA | 30354 |
| HPV56 | L2 | 11 | 379 | TLSFASNTTNV | 30355 |
| HPV56 | L2 | 8 | 105 | TLVEESSV | 30356 |
| HPV56 | L2 | 9 | 105 | TLVEESSVI | 30357 |
| HPV56 | L2 | 9 | 247 | TLVSADNPL | 30358 |
| HPV56 | L2 | 10 | 247 | TLVSADNPLF | 30359 |
| HPV56 | L2 | 8 | 85 | TPARPPIV | 30360 |
| HPV56 | L2 | 9 | 85 | TPARPPIVV | 30361 |
| HPV56 | L2 | 9 | 399 | TPFYSGPDI | 30362 |
| HPV56 | L2 | 10 | 399 | TPFYSGPDIV | 30363 |
| HPV56 | L2 | 11 | 399 | TPFYSGPDIVL | 30364 |
| HPV56 | L2 | 9 | 213 | TPIPGFRRI | 30365 |
| HPV56 | L2 | 10 | 213 | TPIPGFRRIA | 30366 |
| HPV56 | L2 | 11 | 213 | TPIPGFRRIAA | 30367 |
| HPV56 | L2 | 8 | 368 | TPSAHLPI | 30368 |
| HPV56 | L2 | 9 | 184 | TPTSGIHSY | 30369 |
| HPV56 | L2 | 9 | 144 | TPTSSTVHV | 30370 |
| HPV56 | L2 | 9 | 311 | TQIGARVHY | 30371 |
| HPV56 | L2 | 10 | 311 | TQIGARVHYY | 30372 |
| HPV56 | L2 | 11 | 311 | TQIGARVHYYY | 30373 |
| HPV56 | L2 | 9 | 15 | TQLYKTCKL | 30374 |
| HPV56 | L2 | 9 | 149 | TVHVSSTHI | 30375 |
| HPV56 | L2 | 10 | 167 | VIEAPQTGEV | 30376 |
| HPV56 | L2 | 8 | 112 | VIESGAGI | 30377 |
| HPV56 | L2 | 11 | 112 | VIESGAGIPNF | 30378 |
| HPV56 | L2 | 11 | 140 | VLDITPTSSTV | 30379 |
| HPV56 | L2 | 9 | 408 | VLPTGPSTW | 30380 |
| HPV56 | L2 | 11 | 408 | VLPTGPSTWPF | 30381 |
| HPV56 | L2 | 10 | 72 | VPLGSRPSTI | 30382 |
| HPV56 | L2 | 11 | 72 | VPLGSRPSTIV | 30383 |
| HPV56 | L2 | 8 | 419 | VPQSPYDV | 30384 |

TABLE XIV-continued

B62 Supermotif Peptides

| Type | Protein | No. of Amino Acid | Position | Sequence | Seq. Id. No. |
|---|---|---|---|---|---|
| HPV56 | L2 | 10 | 31 | VVNKIEQKTW | 30385 |
| HPV56 | L2 | 11 | 31 | VVNKIEQKTWA | 30386 |
| HPV56 | L2 | 9 | 416 | WPFVPQSPY | 30387 |
| HPV56 | L2 | 11 | 416 | WPFVPQSPYDV | 30388 |
| HPV56 | L2 | 8 | 431 | YIQGSSFA | 30389 |
| HPV56 | L2 | 9 | 431 | YIQGSSFAL | 30390 |
| HPV56 | L2 | 10 | 431 | YIQGSSFALW | 30391 |
| HPV56 | L2 | 11 | 71 | YVPLGSRPSTI | 30392 |

TABLE XV

A01 Motif Peptides

| Type | Protein | No. of Amino Acids | Position | Sequence | A*0101 | Seq. Id. No. |
|---|---|---|---|---|---|---|
| HPV16 | E1 | 11 | 248 | ADSIKTLLQQY | | 30393 |
| HPV16 | E1 | 10 | 206 | AMLAKFKELY | | 30394 |
| HPV16 | E1 | 8 | 524 | ATVPCWNY | | 30395 |
| HPV16 | E1 | 9 | 404 | DCATMCRHY | 0.0011 | 30396 |
| HPV16 | E1 | 10 | 522 | DDATVPCWNY | | 30397 |
| HPV16 | E1 | 9 | 371 | DDSEIAYKY | | 30398 |
| HPV16 | E1 | 8 | 372 | DSEIAYKY | | 30399 |
| HPV16 | E1 | 10 | 249 | DSIKTLLQQY | | 30400 |
| HPV16 | E1 | 10 | 356 | ELSQMVQWAY | | 30401 |
| HPV16 | E1 | 9 | 152 | ETETPCSQY | | 30402 |
| HPV16 | E1 | 9 | 594 | FDENGNPVY | | 30403 |
| HPV16 | E1 | 8 | 127 | FESEDSGY | | 30404 |
| HPV16 | E1 | 10 | 162 | GGSGGGCSQY | | 30405 |
| HPV16 | E1 | 9 | 325 | GISNISEVY | | 30406 |
| HPV16 | E1 | 10 | 272 | GMVVLLLVRY | | 30407 |
| HPV16 | E1 | 9 | 163 | GSGGGCSQY | | 30408 |
| HPV16 | E1 | 8 | 571 | GTDSRWPY | | 30409 |
| HPV16 | E1 | 9 | 12 | GTGCNGWFY | 3.9 | 30410 |
| HPV16 | E1 | 11 | 568 | INAGTDSRWPY | | 30411 |
| HPV16 | E1 | 8 | 326 | ISNISEVY | | 30412 |
| HPV16 | E1 | 9 | 369 | IVDDSEIAY | | 30413 |
| HPV16 | E1 | 11 | 369 | IVDDSEIAYKY | | 30414 |
| HPV16 | E1 | 11 | 323 | KTGISNISEVY | | 30415 |
| HPV16 | E1 | 10 | 252 | KTLLQQYCLY | | 30416 |
| HPV16 | E1 | 11 | 521 | LDDATVPCWNY | | 30417 |
| HPV16 | E1 | 9 | 126 | LFESEDSGY | | 30418 |
| HPV16 | E1 | 9 | 312 | LRSTAAALY | | 30419 |
| HPV16 | E1 | 11 | 312 | LRSTAAALYWY | | 30420 |
| HPV16 | E1 | 9 | 357 | LSQMVQWAY | | 30421 |
| HPV16 | E1 | 11 | 48 | LVDFIVNDNDY | | 30422 |
| HPV16 | E1 | 9 | 207 | MLAKFKELY | | 30423 |
| HPV16 | E1 | 9 | 420 | MSMSQWIKY | | 30424 |
| HPV16 | E1 | 10 | 593 | PFDENGNPVY | | 30425 |
| HPV16 | E1 | 10 | 419 | QMSMSQWIKY | | 30426 |
| HPV16 | E1 | 11 | 80 | RDAVQVLKRKY | | 30427 |
| HPV16 | E1 | 11 | 150 | RHETETPCSQY | | 30428 |
| HPV16 | E1 | 8 | 313 | RSTAAALY | | 30429 |
| HPV16 | E1 | 10 | 313 | RSTAAALYWY | | 30430 |
| HPV16 | E1 | 8 | 421 | SMSQWIKY | | 30431 |
| HPV16 | E1 | 9 | 314 | STAAALYWY | | 30432 |
| HPV16 | E1 | 8 | 315 | TAAALYWY | | 30433 |
| HPV16 | E1 | 8 | 370 | VDDSEIAY | | 30434 |
| HPV16 | E1 | 10 | 370 | VDDSEIAYKY | | 30435 |
| HPV16 | E1 | 11 | 402 | VKDCATMCRHY | | 30436 |
| HPV16 | E2 | 9 | 11 | CQDKILTHY | | 30437 |
| HPV16 | E2 | 10 | 122 | DGDICNTMHY | | 30438 |
| HPV16 | E2 | 11 | 22 | DSTDLRDHIDY | | 30439 |
| HPV16 | E2 | 8 | 80 | ETIYNSQY | | 30440 |
| HPV16 | E2 | 8 | 171 | FKDDAEKY | | 30441 |
| HPV16 | E2 | 11 | 293 | GDANTLKCLRY | | 30442 |
| HPV16 | E2 | 10 | 328 | HKSAIVTLTY | | 30443 |
| HPV16 | E2 | 9 | 35 | HMRLECAIY | | 30444 |
| HPV16 | E2 | 10 | 35 | HMRLECAIYY | | 30445 |
| HPV16 | E2 | 9 | 329 | KSAIVTLTY | | 30446 |
| HPV16 | E2 | 9 | 94 | LQDVSLEVY | | 30447 |
| HPV16 | E2 | 11 | 77 | LTLETIYNSQY | | 30448 |
| HPV16 | E2 | 8 | 296 | NTLKCLRY | | 30449 |

TABLE XV-continued

A01 Motif Peptides

| Type | Protein | No. of Amino Acids | Position | Sequence | A*0101 | Seq. Id. No. |
|---|---|---|---|---|---|---|
| HPV16 | E2 | 10 | 106 | PTGCIKKHGY | | 30450 |
| HPV16 | E2 | 8 | 151 | QVDYYGLY | | 30451 |
| HPV16 | E2 | 9 | 151 | QVDYYGLYY | | 30452 |
| HPV16 | E2 | 8 | 37 | RLECAIYY | | 30453 |
| HPV16 | E2 | 10 | 23 | STDLRDHIDY | | 30454 |
| HPV16 | E2 | 10 | 78 | TLETIYNSQY | | 30455 |
| HPV16 | E2 | 11 | 128 | TMHYTNWTHIY | | 30456 |
| HPV16 | E2 | 8 | 160 | VHEGIRTY | | 30457 |
| HPV16 | E2 | 10 | 145 | VTVVEGQVDY | | 30458 |
| HPV16 | E2 | 11 | 145 | VTVVEGQVDYY | | 30459 |
| HPV16 | E2 | 8 | 147 | VVEGQVDY | | 30460 |
| HPV16 | E2 | 9 | 147 | VVEGQVDYY | | 30461 |
| HPV16 | E2 | 11 | 92 | WTLQDVSLEVY | | 30462 |
| HPV16 | E2 | 8 | 131 | YTNWTHIY | | 30463 |
| HPV16 | E5 | 11 | 53 | AASAFRCFIVY | | 30464 |
| HPV16 | E5 | 10 | 54 | ASAFRCFIVY | | 30465 |
| HPV16 | E6 | 11 | 51 | DFAFRDLCIVY | | 30466 |
| HPV16 | E6 | 8 | 54 | FRDLCIVY | | 30467 |
| HPV16 | E6 | 8 | 76 | FYSKISEY | | 30468 |
| HPV16 | E6 | 11 | 76 | FYSKISEYRHY | | 30469 |
| HPV16 | E6 | 8 | 92 | GTTLEQQY | 0.0006 | 30470 |
| HPV16 | E6 | 10 | 30 | IHDIILECVY | 0.028 | 30471 |
| HPV16 | E6 | 9 | 80 | ISEYRHYCY | 0.31 | 30472 |
| HPV16 | E6 | 8 | 79 | KISEYRHY | | 30473 |
| HPV16 | E6 | 10 | 79 | KISEYRHYCY | 0.009 | 30474 |
| HPV16 | E6 | 9 | 69 | VCDKCLKFY | 0.0017 | 30475 |
| HPV16 | E6 | 10 | 77 | YSKISEYRHY | 0.015 | 30476 |
| HPV16 | E7 | 8 | 4 | DTPTLHEY | 0.0002 | 30477 |
| HPV16 | E7 | 8 | 18 | ETTDLYCY | 0.078 | 30478 |
| HPV16 | E7 | 10 | 43 | GQAEPDRAHY | | 30479 |
| HPV16 | E7 | 10 | 2 | HGDTPTLHEY | 0.003 | 30480 |
| HPV16 | E7 | 9 | 44 | QAEPDRAHY | 0.021 | 30481 |
| HPV16 | E7 | 8 | 16 | QPETTDLY | 0.001 | 30482 |
| HPV16 | E7 | 10 | 16 | QPETTDLYCY | 0.033 | 30483 |
| HPV16 | L1 | 9 | 373 | AISTSETTY | | 30484 |
| HPV16 | L1 | 11 | 371 | CAAISTSETTY | | 30485 |
| HPV16 | L1 | 10 | 251 | CTSICKYPDY | | 30486 |
| HPV16 | L1 | 9 | 13 | CYENDVNVY | | 30487 |
| HPV16 | L1 | 8 | 154 | DTENASAY | | 30488 |
| HPV16 | L1 | 11 | 386 | FKEYLRRGEEY | | 30489 |
| HPV16 | L1 | 11 | 307 | GSTANLASSNY | | 30490 |
| HPV16 | L1 | 8 | 374 | ISTSETTY | | 30491 |
| HPV16 | L1 | 11 | 11 | ITCYENDVNVY | | 30492 |
| HPV16 | L1 | 10 | 407 | ITLTADVMTY | | 30493 |
| HPV16 | L1 | 8 | 463 | KEDPLKKY | | 30494 |
| HPV16 | L1 | 11 | 151 | KLDDTENASAY | | 30495 |
| HPV16 | L1 | 10 | 152 | LDDTENASAY | | 30496 |
| HPV16 | L1 | 8 | 68 | LLAVGHPY | | 30497 |
| HPV16 | L1 | 8 | 31 | LPSEATVY | | 30498 |
| HPV16 | L1 | 8 | 409 | LTADVMTY | | 30499 |
| HPV16 | L1 | 9 | 169 | NRECISMDY | | 30500 |
| HPV16 | L1 | 9 | 462 | PKEDPLKKY | | 30501 |
| HPV16 | L1 | 11 | 247 | PLDICTSICKY | | 30502 |
| HPV16 | L1 | 11 | 43 | PVSKVVSTDEY | | 30503 |
| HPV16 | L1 | 10 | 328 | SDAQIFNKPY | | 30504 |
| HPV16 | L1 | 10 | 308 | STANLASSNY | | 30505 |
| HPV16 | L1 | 11 | 50 | TDEYVARTNIY | | 30506 |
| HPV16 | L1 | 11 | 327 | TSDAQIFNKPY | | 30507 |
| HPV16 | L1 | 9 | 252 | TSICKYPDY | | 30508 |
| HPV16 | L1 | 11 | 65 | TSRLLAVGHPY | | 30509 |
| HPV16 | L1 | 11 | 379 | TTYKNTNFKEY | | 30510 |
| HPV16 | L1 | 10 | 293 | VGENVPDDLY | | 30511 |
| HPV16 | L1 | 10 | 44 | VSKVVSTDEY | | 30512 |
| HPV16 | L1 | 8 | 268 | YGDSLFFY | | 30513 |
| HPV16 | L1 | 8 | 53 | YVARTNY | | 30514 |
| HPV16 | L1 | 9 | 53 | YVARTNIYY | | 30515 |
| HPV16 | L2 | 10 | 443 | AGDFYLHPSY | | 30516 |
| HPV16 | L2 | 11 | 443 | AGDFYLHPSYY | | 30517 |
| HPV16 | L2 | 9 | 259 | GIDVDNTLY | | 30518 |
| HPV16 | L2 | 10 | 317 | GKSIGAKVHY | | 30519 |
| HPV16 | L2 | 11 | 317 | GKSIGAKVHYY | | 30520 |
| HPV16 | L2 | 10 | 63 | GSGTGGRTGY | | 30521 |
| HPV16 | L2 | 11 | 218 | GSRPVARLGLY | | 30522 |
| HPV16 | L2 | 8 | 65 | GTGGRTGY | | 30523 |
| HPV16 | L2 | 8 | 440 | IADAGDFY | | 30524 |

TABLE XV-continued

A01 Motif Peptides

| Type | Protein | No. of Amino Acids | Position | Sequence | A*0101 | Seq. Id. No. |
|---|---|---|---|---|---|---|
| HPV16 | L2 | 8 | 41 | IADQILQY | | 30525 |
| HPV16 | L2 | 8 | 320 | IGAKVHYY | | 30526 |
| HPV16 | L2 | 9 | 320 | IGAKVHYYY | | 30527 |
| HPV16 | L2 | 9 | 439 | IIADAGDFY | | 30528 |
| HPV16 | L2 | 10 | 243 | ITTPTKLITY | | 30529 |
| HPV16 | L2 | 8 | 250 | ITYDNPAY | | 30530 |
| HPV16 | L2 | 9 | 11 | KRASATQLY | | 30531 |
| HPV16 | L2 | 9 | 318 | KSIGAKVHY | | 30532 |
| HPV16 | L2 | 10 | 318 | KSIGAKVHYY | | 30533 |
| HPV16 | L2 | 11 | 318 | KSIGAKVHYYY | | 30534 |
| HPV16 | L2 | 10 | 39 | KTIADQILQY | | 30535 |
| HPV16 | L2 | 11 | 183 | LSSSTISTHNY | | 30536 |
| HPV16 | L2 | 10 | 294 | LTSRRTGIRY | | 30537 |
| HPV16 | L2 | 10 | 397 | NTTIPFGGAY | | 30538 |
| HPV16 | L2 | 8 | 386 | PSTSLSGY | | 30539 |
| HPV16 | L2 | 11 | 383 | PSVPSTSLSGY | | 30540 |
| HPV16 | L2 | 9 | 358 | PTSINNGLY | | 36541 |
| HPV16 | L2 | 8 | 221 | PVARLGLY | | 30542 |
| HPV16 | L2 | 8 | 342 | QTITPSTY | | 30543 |
| HPV16 | L2 | 8 | 12 | RASATQLY | | 30544 |
| HPV16 | L2 | 11 | 9 | RTKRASATQLY | | 30545 |
| HPV16 | L2 | 10 | 184 | SSSTISTHNY | | 30546 |
| HPV16 | L2 | 9 | 185 | SSTISTHNY | | 30547 |
| HPV16 | L2 | 8 | 186 | STISTHNY | | 30548 |
| HPV16 | L2 | 11 | 62 | TGSGTGGRTGY | | 30549 |
| HPV16 | L2 | 9 | 40 | TIADQILQY | | 30550 |
| HPV16 | L2 | 8 | 359 | TSINNGLY | | 30551 |
| HPV16 | L2 | 11 | 359 | TSINNGLYDIY | | 30552 |
| HPV16 | L2 | 9 | 295 | TSRRTGIRY | | 30553 |
| HPV16 | L2 | 9 | 398 | TTIPFGGAY | | 30554 |
| HPV16 | L2 | 9 | 244 | TTPTKLITY | | 30555 |
| HPV16 | L2 | 9 | 385 | VPSTSLSGY | | 30556 |
| HPV16 | L2 | 11 | 437 | YTIIADAGDFY | | 30557 |
| HPV18 | E1 | 8 | 578 | AKDNRWPY | | 30558 |
| HPV18 | E1 | 10 | 213 | AMLAVFKDTY | | 30559 |
| HPV18 | E1 | 8 | 531 | ATTTCWTY | | 30560 |
| HPV18 | E1 | 9 | 411 | DCATMCKHY | | 30561 |
| HPV18 | E1 | 10 | 529 | DDATTTCWTY | | 30562 |
| HPV18 | E1 | 9 | 378 | DESDMAFEY | | 30563 |
| HPV18 | E1 | 8 | 379 | ESDMAFEY | | 30564 |
| HPV18 | E1 | 8 | 130 | FTISDSGY | | 30565 |
| HPV18 | E1 | 9 | 484 | GPANTGKSY | | 30566 |
| HPV18 | E1 | 9 | 11 | GTGCNGWFY | 3.9 | 30567 |
| HPV18 | E1 | 10 | 576 | HPAKDNRWPY | | 30568 |
| HPV18 | E1 | 8 | 401 | KSNCQAKY | | 30569 |
| HPV18 | E1 | 10 | 259 | KTLIQPFILY | | 30570 |
| HPV18 | E1 | 11 | 528 | LDDATTTCWTY | | 30571 |
| HPV18 | E1 | 11 | 409 | LKDCATMCKHY | | 30572 |
| HPV18 | E1 | 9 | 400 | LKSNCQAKY | | 30573 |
| HPV18 | E1 | 9 | 319 | LRSSVAALY | | 30574 |
| HPV18 | E1 | 11 | 319 | LRSSVAALYWY | | 30575 |
| HPV18 | E1 | 11 | 376 | LTDESDMAFEY | | 30576 |
| HPV18 | E1 | 9 | 214 | MLAVFKDTY | | 30577 |
| HPV18 | E1 | 10 | 600 | PFDKNGNPVY | | 30578 |
| HPV18 | E1 | 8 | 320 | RSSVAALY | | 30579 |
| HPV18 | E1 | 10 | 320 | RSSVAALYWY | | 30580 |
| HPV18 | E1 | 9 | 321 | SSVAALYWY | | 30581 |
| HPV18 | E1 | 8 | 322 | SVAALYWY | | 30582 |
| HPV18 | E1 | 10 | 377 | TDESDMAFEY | | 30583 |
| HPV18 | E1 | 10 | 533 | TTCWTYFDTY | | 30584 |
| HPV18 | E1 | 11 | 532 | TTTCWTYFDTY | | 30585 |
| HPV18 | E2 | 10 | 154 | ATCVSHRGLY | | 30586 |
| HPV18 | E2 | 11 | 154 | ATCVSHRGLYY | | 30587 |
| HPV18 | E2 | 11 | 132 | CMTYVAWDSVY | | 30588 |
| HPV18 | E2 | 8 | 156 | CVSHRGLY | | 30589 |
| HPV18 | E2 | 9 | 156 | CVSHRGLYY | | 30590 |
| HPV18 | E2 | 8 | 29 | DIDSQIQY | | 30591 |
| HPV18 | E2 | 11 | 26 | DSKDIDSQIQY | | 30592 |
| HPV18 | E2 | 9 | 354 | DSVQILVGY | | 30593 |
| HPV18 | E2 | 8 | 176 | FKSECEKY | | 30594 |
| HPV18 | E2 | 11 | 352 | IPDSVQILVGY | | 30595 |
| HPV18 | E2 | 9 | 329 | KTGILTVTY | | 30596 |
| HPV18 | E2 | 10 | 133 | MTYVAWDSVY | | 30597 |
| HPV18 | E2 | 11 | 133 | MTYVAWDSVYY | | 30598 |
| HPV18 | E2 | 8 | 128 | NKDNCMTY | | 30599 |

TABLE XV-continued

A01 Motif Peptides

| Type | Protein | No. of Amino Acids | Position | Sequence | A*0101 | Seq. Id. No. |
|---|---|---|---|---|---|---|
| HPV18 | E2 | 8 | 297 | NSLKCLRY | | 30600 |
| HPV18 | E2 | 10 | 353 | PDSVQILVGY | | 30601 |
| HPV18 | E2 | 11 | 56 | QTLNHQVVPAY | | 30602 |
| HPV18 | E2 | 9 | 296 | RNSLKCLRY | | 30603 |
| HPV18 | E2 | 10 | 27 | SKDIDSQIQY | | 30604 |
| HPV18 | E2 | 11 | 230 | STVSVGTAKTY | | 30605 |
| HPV18 | E2 | 10 | 231 | TVSVGTAKTY | | 30606 |
| HPV18 | E2 | 9 | 165 | VKEGYNTFY | | 30607 |
| HPV18 | E2 | 9 | 15 | VQDKIIDHY | | 30608 |
| HPV18 | E2 | 8 | 157 | VSHRGLYY | | 30609 |
| HPV18 | E2 | 9 | 232 | VSVGTAKTY | | 30610 |
| HPV18 | E2 | 11 | 173 | YIEFKSECEKY | | 30611 |
| HPV18 | E2 | 8 | 135 | YVAWDSVY | | 30612 |
| HPV18 | E2 | 9 | 135 | YVAWDSVYY | | 30613 |
| HPV18 | E5 | 10 | 30 | AYAWVLVFVY | | 30614 |
| HPV18 | E5 | 11 | 43 | ITSPATAFTVY | | 30615 |
| HPV18 | E5 | 9 | 23 | LPSVCMCAY | | 30616 |
| HPV18 | E5 | 8 | 24 | PSVCMCAY | | 30617 |
| HPV18 | E5 | 9 | 45 | SPATAFTVY | | 30618 |
| HPV18 | E5 | 10 | 44 | TSPATAFTVY | | 30619 |
| HPV18 | E6 | 8 | 27 | DIEITCVY | 0.0025 | 30620 |
| HPV18 | E6 | 11 | 46 | EPAFKDLFVVY | | 30621 |
| HPV18 | E6 | 9 | 4 | FEDPTRRPY | 0.0017 | 30622 |
| HPV18 | E6 | 8 | 49 | FKDLFVVY | | 30623 |
| HPV18 | E6 | 11 | 71 | FYSRIRELRHY | | 30624 |
| HPV18 | E6 | 11 | 62 | HAACHKCIDFY | | 30625 |
| HPV18 | E6 | 10 | 25 | LQDIEITCVY | 0.0023 | 30626 |
| HPV18 | E6 | 10 | 3 | RFEDPTRRPY | 0.0015 | 30627 |
| HPV18 | E6 | 11 | 89 | TLEKLTNTGLY | 5.9 | 30628 |
| HPV18 | E6 | 10 | 72 | YSRIRELRHY | 0.0008 | 30629 |
| HPV18 | L1 | 9 | 495 | APAENKDPY | | 30630 |
| HPV18 | L1 | 8 | 345 | ASPGSCVY | | 30631 |
| HPV18 | L1 | 11 | 407 | ASTQSPVPGQY | | 30632 |
| HPV18 | L1 | 10 | 286 | CQSICKYPDY | | 30633 |
| HPV18 | L1 | 11 | 493 | DAAPAENKDPY | | 30634 |
| HPV18 | L1 | 9 | 258 | DGDMVDTGY | | 30635 |
| HPV18 | L1 | 9 | 364 | DSQLFNKPY | | 30636 |
| HPV18 | L1 | 8 | 330 | DTVPQSLY | | 30637 |
| HPV18 | L1 | 8 | 517 | FSLDLDQY | | 30638 |
| HPV18 | L1 | 8 | 177 | GLSGHPFY | | 30639 |
| HPV18 | L1 | 11 | 342 | GMPASPGSCVY | | 30640 |
| HPV18 | L1 | 10 | 443 | ITLTADVMSY | | 30641 |
| HPV18 | L1 | 9 | 516 | KFSLDLDQY | | 30642 |
| HPV18 | L1 | 10 | 120 | KQDIPKVSAY | | 30643 |
| HPV18 | L1 | 11 | 256 | LEDGDMVDTGY | | 30644 |
| HPV18 | L1 | 8 | 445 | LTADVMSY | | 30645 |
| HPV18 | L1 | 10 | 328 | MGDTVPQSLY | | 30646 |
| HPV18 | L1 | 10 | 343 | MPASPGSCVY | | 30647 |
| HPV18 | L1 | 8 | 496 | PAENKDPY | | 30648 |
| HPV18 | L1 | 9 | 344 | PASPGSCVY | | 30649 |
| HPV18 | L1 | 11 | 282 | PLDICQSICKY | | 30650 |
| HPV18 | L1 | 9 | 472 | PTTSLVDTY | | 30651 |
| HPV18 | L1 | 9 | 287 | QSICKYPDY | | 30652 |
| HPV18 | L1 | 8 | 410 | QSPVPGQY | | 30653 |
| HPV18 | L1 | 10 | 416 | QYDATKFKQY | | 30654 |
| HPV18 | L1 | 9 | 424 | QYSRHVEEY | | 30655 |
| HPV18 | L1 | 8 | 66 | RPSDNTVY | | 30656 |
| HPV18 | L1 | 10 | 363 | SDSQLFNKPY | | 30657 |
| HPV18 | L1 | 11 | 100 | SSRLLTVGNPY | | 30658 |
| HPV18 | L1 | 10 | 408 | STQSPVPGQY | | 30659 |
| HPV18 | L1 | 11 | 78 | SVARVVNTDDY | | 30660 |
| HPV18 | L1 | 11 | 327 | TMGDTVPQSLY | | 30661 |
| HPV18 | L1 | 9 | 409 | TQSPVPGQY | | 30662 |
| HPV18 | L1 | 11 | 362 | TSDSQLFNKPY | | 30663 |
| HPV18 | L1 | 8 | 473 | TTSLVDTY | | 30664 |
| HPV18 | L1 | 9 | 204 | VRDNVSVDY | | 30665 |
| HPV18 | L1 | 8 | 89 | VTPTSIFY | | 30666 |
| HPV18 | L1 | 9 | 417 | YDATKFKQY | | 30667 |
| HPV18 | L1 | 11 | 35 | YMVHIIICGHY | | 30668 |
| HPV18 | L1 | 8 | 425 | YSRHVEEY | | 30669 |
| HPV18 | L1 | 9 | 4 | YTRVLILHY | | 30670 |
| HPV18 | L2 | 11 | 341 | ATEDNDLFDIY | | 30671 |
| HPV18 | L2 | 11 | 322 | DISPIAPSPEY | | 30672 |
| HPV18 | L2 | 8 | 344 | DNDLFDIY | | 30673 |
| HPV18 | L2 | 10 | 62 | GSGTGGRTGY | | 30674 |

TABLE XV-continued

A01 Motif Peptides

| Type | Protein | No. of Amino Acids | Position | Sequence | A*0101 | Seq. Id. No. |
|---|---|---|---|---|---|---|
| HPV18 | L2 | 8 | 64 | GTGGRTGY | | 30675 |
| HPV18 | L2 | 10 | 432 | GTHYYLWPLY | | 30676 |
| HPV18 | L2 | 11 | 432 | GTHYYLWPLYY | | 30677 |
| HPV18 | L2 | 10 | 183 | GTPTSGTHGY | | 30678 |
| HPV18 | L2 | 11 | 310 | GTQIGARVHFY | | 30679 |
| HPV18 | L2 | 8 | 313 | IGARVHFY | | 30680 |
| HPV18 | L2 | 10 | 323 | ISPIAPSPEY | | 30681 |
| HPV18 | L2 | 9 | 10 | KRASVTDLY | | 30682 |
| HPV18 | L2 | 10 | 242 | LTRPSSLITY | | 30683 |
| HPV18 | L2 | 10 | 391 | LTSSWDVPVY | | 30684 |
| HPV18 | L2 | 8 | 325 | PIAPSPEY | | 30685 |
| HPV18 | L2 | 9 | 419 | PTAPASTQY | | 30686 |
| HPV18 | L2 | 9 | 376 | PTISSASSY | | 30687 |
| HPV18 | L2 | 8 | 185 | PTSGTHGY | | 30688 |
| HPV18 | L2 | 8 | 11 | RASVTDLY | | 30689 |
| HPV18 | L2 | 8 | 244 | RPSSLITY | | 30690 |
| HPV18 | L2 | 11 | 364 | RSTTSFAFFKY | | 30691 |
| HPV18 | L2 | 8 | 220 | RVAGPRLY | | 30692 |
| HPV18 | L2 | 8 | 393 | SSWDVPVY | | 30693 |
| HPV18 | L2 | 10 | 365 | STTSFAFFKY | | 30694 |
| HPV18 | L2 | 10 | 342 | TEDNDLFDIY | | 30695 |
| HPV18 | L2 | 11 | 61 | TGSGTGGRTGY | | 30696 |
| HPV18 | L2 | 8 | 377 | TISSASSY | | 30697 |
| HPV18 | L2 | 8 | 367 | TSFAFFKY | | 30698 |
| HPV18 | L2 | 9 | 392 | TSSWDVPVY | | 30699 |
| HPV18 | L2 | 9 | 366 | TFSFAFFKY | | 30700 |
| HPV18 | L2 | 11 | 417 | VSPTAPASTQY | | 30701 |
| HPV18 | L2 | 11 | 374 | YSPTISSASSY | | 30702 |
| HPV31 | E1 | 11 | 79 | AEAVQVLKRKY | | 30703 |
| HPV31 | E1 | 10 | 186 | AMLGKFKELY | | 30704 |
| HPV31 | E1 | 8 | 504 | ATTPCWHY | | 30705 |
| HPV31 | E1 | 10 | 502 | DDATTPCWHY | | 30706 |
| HPV31 | E1 | 9 | 351 | DDSEIAYKY | | 30707 |
| HPV31 | E1 | 8 | 96 | DISSCVDY | | 30708 |
| HPV31 | E1 | 10 | 336 | DLSQMVQWAY | | 30709 |
| HPV31 | E1 | 8 | 352 | DSEIAYKY | | 30710 |
| HPV31 | E1 | 8 | 50 | FIDNCNVY | | 30711 |
| HPV31 | E1 | 8 | 551 | GKDDRWPY | | 30712 |
| HPV31 | E1 | 9 | 305 | GMSNISDVY | | 30713 |
| HPV31 | E1 | 9 | 11 | GTGCNGWFY | 3.9 | 30714 |
| HPV31 | E1 | 10 | 456 | HGAPNTGKSY | | 30715 |
| HPV31 | E1 | 11 | 548 | INAGKDDRWPY | | 30716 |
| HPV31 | E1 | 11 | 471 | ISFLQGCIISY | | 30717 |
| HPV31 | E1 | 10 | 232 | KTLLQPYCLY | | 30718 |
| HPV31 | E1 | 11 | 501 | LDDATTPCWHY | | 30719 |
| HPV31 | E1 | 9 | 125 | LFELPDSGY | | 30720 |
| HPV31 | E1 | 9 | 292 | LRSTAAALY | | 30721 |
| HPV31 | E1 | 11 | 292 | LRSTAAALYWY | | 30722 |
| HPV31 | E1 | 10 | 94 | LSDISSCVDY | | 30723 |
| HPV31 | E1 | 9 | 337 | LSQMVQWAY | | 30724 |
| HPV31 | E1 | 8 | 350 | MDDSEIAY | | 30725 |
| HPV31 | E1 | 10 | 350 | MDDSEIAYKY | | 30726 |
| HPV31 | E1 | 8 | 306 | MSNISDVY | | 30727 |
| HPV31 | E1 | 11 | 47 | MVDFIDNCNVY | | 30728 |
| HPV31 | E1 | 10 | 573 | PFDKNGNPVY | | 30729 |
| HPV31 | E1 | 11 | 93 | PLSDISSCVDY | | 30730 |
| HPV31 | E1 | 8 | 293 | RSTAAALY | | 30731 |
| HPV31 | E1 | 10 | 293 | RSTAAALYWY | | 30732 |
| HPV31 | E1 | 11 | 303 | RTGMSNISDVY | | 30733 |
| HPV31 | E1 | 9 | 294 | STAAALYWY | | 30734 |
| HPV31 | E1 | 8 | 295 | TAAALYWY | | 30735 |
| HPV31 | E1 | 11 | 505 | TTPCWHYIDNY | | 30736 |
| HPV31 | E1 | 11 | 382 | VKDCGTMCRHY | | 30737 |
| HPV31 | E1 | 9 | 349 | VMDDSEIAY | | 30738 |
| HPV31 | E1 | 11 | 349 | VMDDSEIAYKY | | 30739 |
| HPV31 | E1 | 10 | 419 | WRDIVKFLRY | | 30740 |
| HPV31 | E2 | 9 | 11 | CQDKILEHY | | 30741 |
| HPV31 | E2 | 10 | 122 | DGDVHNTMHY | | 30742 |
| HPV31 | E2 | 11 | 22 | DSKRLCDHIDY | | 30743 |
| HPV31 | E2 | 8 | 80 | ETLNNTEY | | 30744 |
| HPV31 | E2 | 8 | 171 | FTEEAKKY | | 30745 |
| HPV31 | E2 | 11 | 300 | GDANILKCLRY | | 30746 |
| HPV31 | E2 | 9 | 336 | KNAIVTLTY | | 30747 |
| HPV31 | E2 | 8 | 312 | LSKYKQLY | | 30748 |
| HPV31 | E2 | 10 | 78 | MLETLNNTEY | | 30749 |

TABLE XV-continued

A01 Motif Peptides

| Type | Protein | No. of Amino Acids | Position | Sequence | A*0101 | Seq. Id. No. |
|---|---|---|---|---|---|---|
| HPV31 | E2 | 11 | 77 | MMLETLNNTEY | | 30750 |
| HPV31 | E2 | 9 | 361 | NTVSVSTGY | | 30751 |
| HPV31 | E2 | 10 | 106 | PTGCLKKHGY | | 30752 |
| HPV31 | E2 | 8 | 37 | RLECVLMY | | 30753 |
| HPV31 | E2 | 9 | 311 | RLSKYKQLY | | 30754 |
| HPV31 | E2 | 11 | 128 | TMHYTNWKFIY | | 30755 |
| HPV31 | E2 | 10 | 93 | TMQQTSLELY | | 30756 |
| HPV31 | E2 | 8 | 362 | TVSVSTGY | | 30757 |
| HPV31 | E2 | 8 | 160 | VHEGHITY | | 30758 |
| HPV31 | E2 | 11 | 92 | WTMQQTSLELY | | 30759 |
| HPV31 | E2 | 8 | 131 | YTNWKFIY | | 30760 |
| HPV31 | E5 | 11 | 53 | ATSPLRCFCIY | | 30761 |
| HPV31 | E5 | 10 | 54 | TSPLRCFCIY | | 30762 |
| HPV31 | E6 | 8 | 63 | CTKCLRFY | | 30763 |
| HPV31 | E6 | 11 | 44 | DFAFTDLTIVY | | 30764 |
| HPV31 | E6 | 10 | 14 | ELSSALEIPY | | 30765 |
| HPV31 | E6 | 8 | 47 | FTDLTIVY | | 30766 |
| HPV31 | E6 | 11 | 69 | FYSKVSEFRWY | | 30767 |
| HPV31 | E6 | 8 | 72 | KVSEFRWY | | 30768 |
| HPV31 | E6 | 10 | 72 | KVSEFRWYRY | | 30769 |
| HPV31 | E6 | 9 | 15 | LSSALEIPY | | 30770 |
| HPV31 | E6 | 11 | 22 | PYDELRLNCVY | | 30771 |
| HPV31 | E6 | 8 | 16 | SSALEIPY | | 30772 |
| HPV31 | E6 | 9 | 73 | VSEFRWYRY | | 30773 |
| HPV31 | E6 | 10 | 23 | YDELRLNCVY | | 30774 |
| HPV31 | E6 | 10 | 70 | YSKVSEFRWY | | 30775 |
| HPV31 | E7 | 8 | 4 | ETPTLQDY | | 30776 |
| HPV31 | E7 | 10 | 43 | GQAEPDTSNY | | 30777 |
| HPV31 | E7 | 9 | 17 | PEATDLHCY | | 30778 |
| HPV31 | E7 | 9 | 44 | QAEPDTSNY | | 30779 |
| HPV31 | E7 | 10 | 16 | QPEATDLHCY | | 30780 |
| HPV31 | E7 | 10 | 2 | RGETPTLQDY | | 30781 |
| HPV31 | L1 | 8 | 285 | ATLANSTY | | 30782 |
| HPV31 | L1 | 10 | 226 | CNSICKYPDY | | 30783 |
| HPV31 | L1 | 8 | 129 | DTENSNRY | | 30784 |
| HPV31 | L1 | 8 | 270 | ESVPTDLY | | 30785 |
| HPV31 | L1 | 10 | 127 | FDDTENSNRY | | 30786 |
| HPV31 | L1 | 9 | 356 | FKSSNFKEY | | 30787 |
| HPV31 | L1 | 9 | 269 | GESVPTDLY | | 30788 |
| HPV31 | L1 | 11 | 282 | GSTATLANSTY | | 30789 |
| HPV31 | L1 | 10 | 382 | ITLSADIMTY | | 30790 |
| HPV31 | L1 | 8 | 438 | KEDPFKDY | | 30791 |
| HPV31 | L1 | 11 | 126 | KFDDTENSNRY | | 30792 |
| HPV31 | L1 | 8 | 357 | KSSNFKEY | | 30793 |
| HPV31 | L1 | 8 | 384 | LSADIMTY | | 30794 |
| HPV31 | L1 | 8 | 43 | LTVGHPYY | | 30795 |
| HPV31 | L1 | 9 | 144 | NRECISMDY | | 30796 |
| HPV31 | L1 | 9 | 227 | NSICKYPDY | | 30797 |
| HPV31 | L1 | 9 | 437 | PKEDPFKDY | | 30798 |
| HPV31 | L1 | 11 | 222 | PLDICNSICKY | | 30799 |
| HPV31 | L1 | 10 | 410 | PPSGSLEDTY | | 30800 |
| HPV31 | L1 | 9 | 411 | PSGSLEDTY | | 30801 |
| HPV31 | L1 | 11 | 17 | PVSKVVSTDEY | | 30802 |
| HPV31 | L1 | 8 | 5 | RPSEATVY | | 30803 |
| HPV31 | L1 | 10 | 303 | SDAQIFNKPY | | 30804 |
| HPV31 | L1 | 8 | 412 | SGSLEDTY | | 30805 |
| HPV31 | L1 | 10 | 283 | STATLANSTY | | 30806 |
| HPV31 | L1 | 11 | 24 | TDEYVTRTNIY | | 30807 |
| HPV31 | L1 | 9 | 383 | TLSADIMTY | | 30808 |
| HPV31 | L1 | 11 | 302 | TSDAQIFNKPY | | 30809 |
| HPV31 | L1 | 11 | 354 | TTFKSSNFKEY | | 30810 |
| HPV31 | L1 | 10 | 268 | VGESVPTDLY | | 30811 |
| HPV31 | L1 | 10 | 18 | VSKVVSTDEY | | 30812 |
| HPV31 | L1 | 8 | 28 | VTRTNIYY | | 30813 |
| HPV31 | L1 | 8 | 243 | YGDTLFFY | | 30814 |
| HPV31 | L2 | 9 | 311 | ATIGARVHY | | 30815 |
| HPV31 | L2 | 10 | 311 | ATIGARVHYY | | 30816 |
| HPV31 | L2 | 11 | 311 | ATIGARVHYYY | | 30817 |
| HPV31 | L2 | 10 | 253 | ETVNAEESLY | | 30818 |
| HPV31 | L2 | 11 | 237 | FLSAPKQLITY | | 30819 |
| HPV31 | L2 | 8 | 433 | FVDGGDFY | | 30820 |
| HPV31 | L2 | 10 | 436 | GGDFYLHPSY | | 30821 |
| HPV31 | L2 | 11 | 436 | GGDFYLHPSYY | | 30822 |
| HPV31 | L2 | 10 | 63 | GSGTGGRTGY | | 30823 |
| HPV31 | L2 | 8 | 65 | GTGGRTGY | | 30824 |

TABLE XV-continued

A01 Motif Peptides

| Type | Protein | No. of Amino Acids | Position | Sequence | A*0101 | Seq. Id. No. |
|---|---|---|---|---|---|---|
| HPV31 | L2 | 11 | 38 | HTTIADQILRY | | 30825 |
| HPV31 | L2 | 8 | 41 | IADQILRY | | 30826 |
| HPV3I | L2 | 8 | 313 | IGARVHYY | | 30827 |
| HPV31 | L2 | 9 | 313 | IGARVHYYY | | 30828 |
| HPV31 | L2 | 8 | 245 | ITYENPAY | | 30829 |
| HPV31 | L2 | 9 | 11 | KRASATQLY | | 30830 |
| HPV31 | L2 | 9 | 348 | LNDGLYDIY | | 30831 |
| HPV31 | L2 | 10 | 238 | LSAPKQLITY | | 30832 |
| HPV31 | L2 | 11 | 178 | LSSSSISTHNY | | 30833 |
| HPV31 | L2 | 10 | 287 | LTSRRNTVRY | | 30834 |
| HPV31 | L2 | 9 | 378 | QSTSAVSAY | | 30835 |
| HPV31 | L2 | 8 | 12 | RASATQLY | | 30836 |
| HPV31 | L2 | 8 | 216 | RPARLGLY | | 30837 |
| HPV31 | L2 | 11 | 9 | RTKRASATQLY | | 30838 |
| HPV31 | L2 | 11 | 309 | SGATIGARVHY | | 30839 |
| HPV31 | L2 | 11 | 62 | SGSGTGGRTGY | | 30840 |
| HPV31 | L2 | 8 | 181 | SSISTHNY | | 30841 |
| HPV31 | L2 | 9 | 180 | SSSISTHNY | | 30842 |
| HPV31 | L2 | 10 | 179 | SSSSISTHNY | | 30843 |
| HPV31 | L2 | 8 | 346 | STLNDGLY | | 30844 |
| HPV31 | L2 | 11 | 346 | STLNDGLYDIY | | 30845 |
| HPV31 | L2 | 8 | 379 | STSAVSAY | | 30846 |
| HPV31 | L2 | 9 | 40 | TIADQILRY | | 30847 |
| HPV31 | L2 | 9 | 288 | TSRRNTVRY | | 30848 |
| HPV31 | L2 | 9 | 345 | TSTLNDGLY | | 30849 |
| HPV31 | L2 | 10 | 39 | TTIADQILRY | | 30850 |
| HPV31 | L2 | 10 | 344 | TTSTLNDGLY | | 30851 |
| HPV31 | L2 | 11 | 343 | TTTSTLNDGLY | | 30852 |
| HPV31 | L2 | 8 | 255 | VNAEESLY | | 30853 |
| HPV31 | L2 | 10 | 377 | VQSTSAVSAY | | 30854 |
| HPV31 | L2 | 11 | 430 | VSIFVDGGDFY | | 30855 |
| HPV33 | E1 | 9 | 226 | CTDWCITGY | | 30856 |
| HPV33 | E1 | 8 | 364 | DDSDIAYY | | 30857 |
| HPV33 | E1 | 9 | 364 | DDSDIAYYY | | 30858 |
| HPV33 | E1 | 10 | 349 | DLSEMVQWAY | | 30859 |
| HPV33 | E1 | 8 | 365 | DSDIAYYY | | 30860 |
| HPV33 | E1 | 9 | 587 | FDENGNPVY | | 30861 |
| HPV33 | E1 | 9 | 470 | GPANTGKSY | | 30862 |
| HPV33 | E1 | 8 | 564 | GTDSRWPY | | 30863 |
| HPV33 | E1 | 11 | 192 | HSSNTKANILY | | 30864 |
| HPV33 | E1 | 11 | 514 | IDDVTPISWTY | | 30865 |
| HPV33 | E1 | 9 | 125 | IDELEDSGY | | 30866 |
| HPV33 | E1 | 9 | 520 | ISWTYIDDY | | 30867 |
| HPV33 | E1 | 10 | 124 | KIDELEDSGY | | 30868 |
| HPV33 | E1 | 9 | 305 | LRSQTCALY | | 30869 |
| HPV33 | E1 | 9 | 350 | LSEMVQWAY | | 30870 |
| HPV33 | E1 | 9 | 362 | LTDDSDIAY | | 30871 |
| HPV33 | E1 | 10 | 362 | LTDDSDIAYY | | 30872 |
| HPV33 | E1 | 11 | 362 | LTDDSDIAYYY | | 30873 |
| HPV33 | E1 | 8 | 195 | NTKANILY | | 30874 |
| HPV33 | E1 | 10 | 586 | PFDENGNPVY | | 30875 |
| HPV33 | E1 | 10 | 519 | PISWTYIDDY | | 30876 |
| HPV33 | E1 | 8 | 306 | RSQTCALY | | 30877 |
| HPV33 | E1 | 10 | 193 | SSNTKANILY | | 30878 |
| HPV33 | E1 | 8 | 363 | TDDSDIAY | | 30879 |
| HPV33 | E1 | 9 | 363 | TDDSDIAYY | | 30880 |
| HPV33 | E1 | 10 | 363 | TDDSDIAYYY | | 30881 |
| HPV33 | E1 | 11 | 561 | TNAGTDSRWPY | | 30882 |
| HPV33 | E1 | 11 | 224 | TSCTDWCITGY | | 30883 |
| HPV33 | E1 | 11 | 110 | TSINKNKECTY | | 30884 |
| HPV33 | E1 | 11 | 395 | VKDCGIMCRHY | | 30885 |
| HPV33 | E1 | 8 | 517 | VTPISWTY | | 30886 |
| HPV33 | E2 | 10 | 78 | ALETLSKSQY | | 30887 |
| HPV33 | E2 | 10 | 145 | CTMVTGKVDY | | 30888 |
| HPV33 | E2 | 10 | 122 | DNDKKNTMDY | | 30889 |
| HPV33 | E2 | 10 | 282 | ESNSLKCLRY | | 30890 |
| HPV33 | E2 | 8 | 80 | ETLSKSQY | | 30891 |
| HPV33 | E2 | 8 | 171 | FKEDAAKY | | 30892 |
| HPV33 | E2 | 11 | 281 | GESNSLKCLRY | | 30893 |
| HPV33 | E2 | 8 | 151 | KVDYIGMY | | 30894 |
| HPV33 | E2 | 9 | 151 | KVDYIGMYY | | 30895 |
| HPV33 | E2 | 9 | 162 | NCEKVYFKY | | 30896 |
| HPV33 | E2 | 8 | 284 | NSLKCLRY | | 30897 |
| HPV33 | E2 | 9 | 113 | QGETVTVQY | | 30898 |
| HPV33 | E2 | 8 | 37 | RMECALLY | | 30899 |

TABLE XV-continued

A01 Motif Peptides

| Type | Protein | No. of Amino Acids | Position | Sequence | A*0101 | Seq. Id. No. |
|---|---|---|---|---|---|---|
| HPV33 | E2 | 9 | 283 | SNSLKCLRY | | 30900 |
| HPV33 | E2 | 11 | 128 | TMDYTNWGEIY | | 30901 |
| HPV33 | E2 | 9 | 146 | TMVTGKVDY | | 30902 |
| HPV33 | E2 | 9 | 11 | VQEKILDLY | | 30903 |
| HPV33 | E2 | 11 | 148 | VTGKVDYIGMY | | 30904 |
| HPV33 | E2 | 8 | 131 | YTNWGEIY | | 30905 |
| HPV33 | E5 | 10 | 44 | GSPLKIFFCY | | 30906 |
| HPV33 | E5 | 11 | 43 | VGSPLKIFFCY | | 30907 |
| HPV33 | E6 | 9 | 46 | AFADLTVVY | | 30908 |
| HPV33 | E6 | 11 | 44 | DFAFADLTVVY | | 30909 |
| HPV33 | E6 | 8 | 47 | FADLTVVY | | 30910 |
| HPV33 | E6 | 8 | 69 | FLSKISEY | | 30911 |
| HPV33 | E6 | 11 | 69 | FLSKISEYRHY | | 30912 |
| HPV33 | E6 | 9 | 73 | ISEYRHYNY | | 30913 |
| HPV33 | E6 | 8 | 72 | KISEYRHY | | 30914 |
| HPV33 | E6 | 10 | 72 | KISEYRHYNY | | 30915 |
| HPV33 | E6 | 10 | 70 | LSKISEYRHY | | 30916 |
| HPV33 | E7 | 10 | 43 | GQAQPATADY | | 30917 |
| HPV33 | E7 | 11 | 43 | GQAQPATADYY | | 30918 |
| HPV33 | E7 | 9 | 8 | LKEYVLDLY | | 30919 |
| HPV33 | E7 | 11 | 6 | PTLKEYVLDLY | | 30920 |
| HPV33 | E7 | 8 | 46 | QPATADYY | | 30921 |
| HPV33 | E7 | 8 | 16 | YPEPTDLY | | 30922 |
| HPV33 | E7 | 10 | 16 | YPEPTDLYCY | | 30923 |
| HPV33 | L1 | 10 | 225 | CGSTCKYPDY | | 30924 |
| HPV33 | L1 | 10 | 345 | CTQVTSDSTY | | 30925 |
| HPV33 | L1 | 8 | 129 | DTETGNKY | | 30926 |
| HPV33 | L1 | 9 | 435 | EKEDPLGKY | | 30927 |
| HPV33 | L1 | 9 | 303 | ESQLFNKPY | | 30928 |
| HPV33 | L1 | 10 | 127 | FDDTETGNKY | | 30929 |
| HPV33 | L1 | 11 | 359 | FKEYIRHVEEY | | 30930 |
| HPV33 | L1 | 9 | 268 | GEAVPDDLY | | 30931 |
| HPV33 | L1 | 9 | 226 | GSTCKYPDY | | 30932 |
| HPV33 | L1 | 8 | 436 | KEDPLGKY | | 30933 |
| HPV33 | L1 | 11 | 126 | KFDDTETGNKY | | 30934 |
| HPV33 | L1 | 8 | 355 | KNENFKEY | | 30935 |
| HPV33 | L1 | 10 | 267 | LGEAVPDDLY | | 30936 |
| HPV33 | L1 | 8 | 42 | LLAVGHPY | | 30937 |
| HPV33 | L1 | 8 | 382 | LTAEVMTY | | 30938 |
| HPV33 | L1 | 9 | 144 | NRECLSMDY | | 30939 |
| HPV33 | L1 | 11 | 221 | PIDICGSTCKY | | 30940 |
| HPV33 | L1 | 11 | 433 | PKEKEDPLGKY | | 30941 |
| HPV33 | L1 | 10 | 408 | PPSASLQDTY | | 30942 |
| HPV33 | L1 | 9 | 409 | PSASLQDTY | | 30943 |
| HPV33 | L1 | 11 | 17 | PVSKVVSTDEY | | 30944 |
| HPV33 | L1 | 8 | 5 | RPSEATVY | | 30945 |
| HPV33 | L1 | 8 | 410 | SASLQDTY | | 30946 |
| HPV33 | L1 | 10 | 302 | SESQLFNKPY | | 30947 |
| HPV33 | L1 | 11 | 39 | SSRLLAVGHPY | | 30948 |
| HPV33 | L1 | 8 | 227 | STCKYPDY | | 30949 |
| HPV33 | L1 | 11 | 352 | STYKNENFKEY | | 30950 |
| HPV33 | L1 | 11 | 24 | TDEYVSRTSIY | | 30951 |
| HPV33 | L1 | 11 | 301 | TSESQLFNKPY | | 30952 |
| HPV33 | L1 | 10 | 18 | VSKVVSTDEY | | 30953 |
| HPV33 | L1 | 8 | 28 | VSRTSIYY | | 30954 |
| HPV33 | L1 | 9 | 28 | VSRTSIYYY | | 30955 |
| HPV33 | L1 | 10 | 380 | VTLTAEVMTY | | 30956 |
| HPV33 | L1 | 8 | 27 | YVSRTSIY | | 30957 |
| HPV33 | L1 | 9 | 27 | YVSRTSIYY | | 30958 |
| HPV33 | L1 | 10 | 27 | YVSRTSIYYY | | 30959 |
| HPV33 | L2 | 11 | 436 | DGADFVLHPSY | | 30960 |
| HPV33 | L2 | 11 | 183 | FSSPTVSTQSY | | 30961 |
| HPV33 | L2 | 10 | 437 | GADFVLHPSY | | 30962 |
| HPV33 | L2 | 8 | 64 | GSGGRTGY | | 30963 |
| HPV33 | L2 | 10 | 62 | GSGSGGRTGY | | 30964 |
| HPV33 | L2 | 11 | 218 | GSRPVARLGLY | | 30965 |
| HPV33 | L2 | 11 | 37 | GSTIADQILKY | | 30966 |
| HPV33 | L2 | 8 | 374 | HTPMQHSY | | 30967 |
| HPV33 | L2 | 8 | 336 | HTVPNEQY | | 30968 |
| HPV33 | L2 | 8 | 40 | IADQILKY | | 30969 |
| HPV33 | L2 | 8 | 318 | IGARIHYY | | 30970 |
| HPV33 | L2 | 9 | 358 | INDGLYDVY | | 30971 |
| HPV33 | L2 | 9 | 10 | KRASATQLY | | 30972 |
| HPV33 | L2 | 9 | 348 | LHDTSTSSY | | 30973 |
| HPV33 | L2 | 10 | 243 | LTSPHKLITY | | 30974 |

TABLE XV-continued

A01 Motif Peptides

| Type | Protein | No. of Amino Acids | Position | Sequence | A*0101 | Seq. Id. No. |
|---|---|---|---|---|---|---|
| HPV33 | L2 | 11 | 333 | PLDHTVPNEQY | | 30975 |
| HPV33 | L2 | 8 | 186 | PTVSTQSY | | 30976 |
| HPV33 | L2 | 8 | 221 | PVARLGLY | | 30977 |
| HPV33 | L2 | 8 | 11 | RASATQLY | | 30978 |
| HPV33 | L2 | 9 | 63 | SGSGGRTGY | | 30979 |
| HPV33 | L2 | 10 | 184 | SSPTVSTQSY | | 30980 |
| HPV33 | L2 | 10 | 354 | SSYSINDGLY | | 30981 |
| HPV33 | L2 | 10 | 38 | STIADQILKY | | 30982 |
| HPV33 | L2 | 9 | 355 | SYSINDGLY | | 30983 |
| HPV33 | L2 | 11 | 61 | TGSGSGGRTGY | | 30984 |
| HPV33 | L2 | 9 | 39 | TIADQILKY | | 30985 |
| HPV33 | L2 | 9 | 244 | TSPHKLITY | | 30986 |
| HPV33 | L2 | 11 | 353 | TSSYSINDGLY | | 30987 |
| HPV33 | L2 | 8 | 356 | YSINDGLY | | 30988 |
| HPV33 | L2 | 11 | 356 | YSINDGLYDVY | | 30989 |
| HPV45 | E1 | 8 | 564 | AKDNKWPY | | 30990 |
| HPV45 | E1 | 10 | 199 | AMLAVFKDIY | | 30991 |
| HPV45 | E1 | 8 | 517 | ATHTCWTY | | 30992 |
| HPV45 | E1 | 9 | 397 | DCAVMCRHY | | 30993 |
| HPV45 | E1 | 10 | 515 | DDATHTCWTY | | 30994 |
| HPV45 | E1 | 9 | 364 | DESDMAFQY | | 30995 |
| HPV45 | E1 | 10 | 562 | DPAKDNKWPY | | 30996 |
| HPV45 | E1 | 8 | 365 | ESDMAFQY | | 30997 |
| HPV45 | E1 | 8 | 130 | FTISDSGY | | 30998 |
| HPV45 | E1 | 9 | 470 | GPANTGKSY | | 30999 |
| HPV45 | E1 | 11 | 459 | GTPKKNCILLY | | 31000 |
| HPV45 | E1 | 10 | 519 | HTCWTYFDNY | | 31001 |
| HPV45 | E1 | 8 | 378 | KSNCQAKY | | 31002 |
| HPV45 | E1 | 10 | 245 | KTLIKPATLY | | 31003 |
| HPV45 | E1 | 11 | 514 | LDDATHTCWTY | | 31004 |
| HPV45 | E1 | 11 | 395 | LKDCAVMCRHY | | 31005 |
| HPV45 | E1 | 9 | 386 | LKSNCQAKY | | 31006 |
| HPV45 | E1 | 9 | 305 | LRSSVAALY | | 31007 |
| HPV45 | E1 | 11 | 305 | LRSSVAALYWY | | 31008 |
| HPV45 | E1 | 11 | 362 | LTDESDMAFQY | | 31009 |
| HPV45 | E1 | 9 | 200 | MLAVFKDIY | | 31010 |
| HPV45 | E1 | 8 | 414 | NMSQWIKY | | 31011 |
| HPV45 | E1 | 10 | 586 | PFDKNGNPVY | | 31012 |
| HPV45 | E1 | 10 | 412 | QMNMSQWIKY | | 31013 |
| HPV45 | E1 | 8 | 306 | RSSVAALY | | 31014 |
| HPV45 | E1 | 10 | 306 | RSSVAALYWY | | 31015 |
| HPV45 | E1 | 9 | 307 | SSVAALYWY | | 31016 |
| HPV45 | E1 | 8 | 308 | SVAALYWY | | 31017 |
| HPV45 | E1 | 10 | 363 | TDESDMAFQY | | 31018 |
| HPV45 | E2 | 11 | 134 | CMNYVVWDSIY | | 31019 |
| HPV45 | E2 | 8 | 158 | CVSYWGVY | | 31020 |
| HPV45 | E2 | 9 | 158 | CVSYWGVYY | | 31021 |
| HPV45 | E2 | 11 | 28 | DSKDINSQISY | | 31022 |
| HPV45 | E2 | 8 | 178 | FKSECEKY | | 31023 |
| HPV45 | E2 | 10 | 186 | GNSNTWEVQY | | 31024 |
| HPV45 | E2 | 8 | 167 | IKDGDTTY | | 31025 |
| HPV45 | E2 | 9 | 167 | IKDGDTTYY | | 31026 |
| HPV45 | E2 | 11 | 151 | IWDKTAACVSY | | 31027 |
| HPV45 | E2 | 9 | 300 | KNSLKCLRY | | 31028 |
| HPV45 | E2 | 8 | 154 | KTAACVSY | | 31029 |
| HPV45 | E2 | 9 | 17 | LQDKILDHY | | 31030 |
| HPV45 | E2 | 8 | 130 | NKDNCMNY | | 31031 |
| HPV45 | E2 | 8 | 301 | NSLKCLRY | | 31032 |
| HPV45 | E2 | 9 | 187 | NSNTWEVQY | | 31033 |
| HPV45 | E2 | 9 | 357 | NSVQISVGY | | 31034 |
| HPV45 | E2 | 9 | 332 | NTGILTVTY | | 31035 |
| HPV45 | E2 | 10 | 356 | PNSVQISVGY | | 31036 |
| HPV45 | E2 | 10 | 29 | SKDINSQISY | | 31037 |
| HPV45 | E2 | 11 | 155 | TAACVSYWGVY | | 31038 |
| HPV45 | E2 | 8 | 159 | VSYWGVYY | | 31039 |
| HPV45 | E6 | 9 | 37 | ATLERTEVY | | 31040 |
| HPV45 | E6 | 11 | 35 | CKATLERTEVY | | 31041 |
| HPV45 | E6 | 8 | 27 | DVSIACVY | | 31042 |
| HPV45 | E6 | 9 | 4 | FDDPTQRPY | | 31043 |
| HPV45 | E6 | 8 | 127 | FHSIAGQY | | 31044 |
| HPV45 | E6 | 8 | 49 | FKDLFIVY | | 31045 |
| HPV45 | E6 | 10 | 71 | FYSRIRELRY | | 31046 |
| HPV45 | E6 | 11 | 71 | FYSRIRELRYY | | 31047 |
| HPV45 | E6 | 10 | 25 | LQDVSIACVY | | 31048 |
| HPV45 | E6 | 11 | 46 | QFAFKDLFIVY | | 31049 |

TABLE XV-continued

A01 Motif Peptides

| Type | Protein | No. of Amino Acids | Position | Sequence | A*0101 | Seq. Id. No. |
|---|---|---|---|---|---|---|
| HPV45 | E6 | 10 | 3 | RFDDPTQRPY | | 31050 |
| HPV45 | E6 | 11 | 89 | TLEKITNTELY | | 31051 |
| HPV45 | E6 | 8 | 38 | TLERTEVY | | 31052 |
| HPV45 | E6 | 11 | 62 | YAACHKCIDFY | | 31053 |
| HPV45 | E6 | 9 | 72 | YSRIRELRY | | 31054 |
| HPV45 | E6 | 10 | 72 | YSRIRELRYY | | 31055 |
| HPV45 | E7 | 10 | 20 | ELDPVDLLCY | | 31056 |
| HPV45 | L1 | 11 | 375 | ASTQNPVPNTY | | 31057 |
| HPV45 | L1 | 10 | 252 | CQSICKYPDY | | 31058 |
| HPV45 | L1 | 9 | 224 | DGDMVDTGY | | 31059 |
| HPV45 | L1 | 9 | 332 | DSQLFNKPY | | 31060 |
| HPV45 | L1 | 11 | 461 | DTTPPEKQDPY | | 31061 |
| HPV45 | L1 | 8 | 296 | DTVPTDLY | | 31062 |
| HPV45 | L1 | 8 | 313 | ETPGSCVY | | 31063 |
| HPV45 | L1 | 8 | 485 | FSSDLDQY | | 31064 |
| HPV45 | L1 | 8 | 143 | GLSGHPFY | | 31065 |
| HPV45 | L1 | 9 | 392 | HYSRHVEEY | | 31066 |
| HPV45 | L1 | 11 | 222 | IEDGDMVDTGY | | 31067 |
| HPV45 | L1 | 10 | 411 | ITLTAEVMSY | | 31068 |
| HPV45 | L1 | 9 | 484 | KFSSDLDQY | | 31069 |
| HPV45 | L1 | 10 | 86 | KQAVPKVSAY | | 31070 |
| HPV45 | L1 | 8 | 413 | LTAEVMSY | | 31071 |
| HPV45 | L1 | 10 | 294 | MGDTVPTDLY | | 31072 |
| HPV45 | L1 | 10 | 311 | MRETPGSCVY | | 31073 |
| HPV45 | L1 | 11 | 310 | NMRETPGSCVY | | 31074 |
| HPV45 | L1 | 11 | 383 | NTYDPTKFKHY | | 31075 |
| HPV45 | L1 | 11 | 248 | PLDICQSICKY | | 31076 |
| HPV45 | L1 | 8 | 464 | PPEKQDPY | | 31077 |
| HPV45 | L1 | 9 | 440 | PTTSLVDTY | | 31078 |
| HPV45 | L1 | 9 | 253 | QSICKYPDY | | 31079 |
| HPV45 | L1 | 8 | 31 | RPSDSTVY | | 31080 |
| HPV45 | L1 | 10 | 331 | SDSQLFNKPY | | 31081 |
| HPV45 | L1 | 11 | 65 | SSRLLTVGNPY | | 31082 |
| HPV45 | L1 | 10 | 376 | STQNPVPNTY | | 31083 |
| HPV45 | L1 | 11 | 43 | SVARVVNTDDY | | 31084 |
| HPV45 | L1 | 11 | 330 | TSDSQLFNKPY | | 31085 |
| HPV45 | L1 | 10 | 462 | TTPPEKQDPY | | 31086 |
| HPV45 | L1 | 8 | 441 | TTSLVDTY | | 31087 |
| HPV45 | L1 | 10 | 384 | TYDPTKFKHY | | 31088 |
| HPV45 | L1 | 11 | 293 | VMGDTVPTDLY | | 31089 |
| HPV45 | L1 | 9 | 170 | VRDNVSVDY | | 31090 |
| HPV45 | L1 | 8 | 54 | VSRTSIFY | | 31091 |
| HPV45 | L1 | 8 | 393 | YSRHVEEY | | 31092 |
| HPV45 | L1 | 9 | 53 | TVSRTSIFY | | 31093 |
| HPV45 | L2 | 11 | 340 | ATNDSDLFDVY | | 31094 |
| HPV45 | L2 | 8 | 343 | DSDLFDVY | | 31095 |
| HPV45 | L2 | 8 | 64 | GSGGRTGY | | 31096 |
| HPV45 | L2 | 10 | 62 | GSGSGGRTGY | | 31097 |
| HPV45 | L2 | 10 | 183 | GTPTSGSHGY | | 31098 |
| HPV45 | L2 | 10 | 433 | GTQYYLWPWY | | 31099 |
| HPV45 | L2 | 11 | 433 | GTQYYLWPWYY | | 31100 |
| HPV45 | L2 | 9 | 365 | HKSFTYPKY | | 31101 |
| HPV45 | L2 | 9 | 10 | KRASATDLY | | 31102 |
| HPV45 | L2 | 8 | 366 | KSFTYPKY | | 31103 |
| HPV45 | L2 | 11 | 375 | LTMPSTAASSY | | 31104 |
| HPV45 | L2 | 10 | 392 | LTSAWDVPIY | | 31105 |
| HPV45 | L2 | 9 | 377 | MPSTAASSY | | 31106 |
| HPV45 | L2 | 9 | 342 | NDSDLFDVY | | 31107 |
| HPV45 | L2 | 8 | 378 | PSTAASSY | | 31108 |
| HPV45 | L2 | 10 | 361 | PSTIHKSFTY | | 31109 |
| HPV45 | L2 | 9 | 420 | PTNASTTTY | | 31110 |
| HPV45 | L2 | 8 | 185 | PTSGSHGY | | 31111 |
| HPV45 | L2 | 8 | 11 | RASATDLY | | 31112 |
| HPV45 | L2 | 9 | 63 | SGSGGRTGY | | 31113 |
| HPV45 | L2 | 11 | 246 | SSLVTFDNPAY | | 31114 |
| HPV45 | L2 | 9 | 362 | STIHKSFTY | | 31115 |
| HPV45 | L2 | 11 | 61 | TGSGSGGRTGY | | 31116 |
| HPV45 | L2 | 10 | 376 | TMPSTAASSY | | 31117 |
| HPV45 | L2 | 8 | 421 | TNASTTTY | | 31118 |
| HPV45 | L2 | 10 | 341 | TNDSDLFDVY | | 31119 |
| HPV45 | L2 | 11 | 360 | TPSTIHKSFTY | | 31120 |
| HPV45 | L2 | 9 | 393 | TSAWDVPIY | | 31121 |
| HPV45 | L2 | 11 | 418 | TSPTNASTTTY | | 31122 |
| HPV45 | L2 | 11 | 426 | TTYIGIHGTQY | | 31123 |
| HPV45 | L2 | 8 | 249 | VTFDNPAY | | 31124 |

TABLE XV-continued

A01 Motif Peptides

| Type | Protein | No. of Amino Acids | Position | Sequence | A*0101 | Seq. Id. No. |
|---|---|---|---|---|---|---|
| HPV56 | E2 | 10 | 21 | ALESLSTTIY | | 31125 |
| HPV56 | E2 | 9 | 71 | CMQYVAWKY | | 31126 |
| HPV56 | E2 | 11 | 71 | CMQYVAWKYIY | | 31127 |
| HPV56 | E2 | 11 | 138 | CPDSVSSTCRY | | 31128 |
| HPV56 | E2 | 10 | 92 | CSGVDYRGIY | | 31129 |
| HPV56 | E2 | 11 | 92 | CSGVDYRGIYY | | 31130 |
| HPV56 | E2 | 10 | 65 | DGSKNNCMQY | | 31131 |
| HPV56 | E2 | 9 | 140 | DSVSSTCRY | | 31132 |
| HPV56 | E2 | 8 | 23 | ESLSTTIY | | 31133 |
| HPV56 | E2 | 11 | 294 | FLSHVKIPVVY | | 31134 |
| HPV56 | E2 | 8 | 261 | FVDVTSTY | | 31135 |
| HPV56 | E2 | 9 | 66 | GSKNNCMQY | | 31136 |
| HPV56 | E2 | 8 | 94 | GVDYRGIY | | 31137 |
| HPV56 | E2 | 9 | 94 | GVDYRGIYY | | 31138 |
| HPV56 | E2 | 8 | 130 | HMENESIY | | 31139 |
| HPV56 | E2 | 11 | 258 | KTLFVDVTSTY | | 31140 |
| HPV56 | E2 | 9 | 22 | LESLSTTIY | | 31141 |
| HPV56 | E2 | 10 | 295 | LSHVKIPVVY | | 31142 |
| HPV56 | E2 | 11 | 149 | NVSPVETVNEY | | 31143 |
| HPV56 | E2 | 9 | 277 | NYSIITIIY | | 31144 |
| HPV56 | E2 | 10 | 139 | PDSVSSTCRY | | 31145 |
| HPV56 | E2 | 8 | 152 | PVETVNEY | | 31146 |
| HPV56 | E2 | 8 | 141 | SVSSTCRY | | 31147 |
| HPV56 | E2 | 8 | 271 | TSTDNKNY | | 31148 |
| HPV56 | E2 | 11 | 91 | VCSGVDYRGIY | | 31149 |
| HPV56 | E2 | 8 | 103 | VHDGHKTY | | 31150 |
| HPV56 | E2 | 9 | 103 | VHDGHKTYY | | 31151 |
| HPV56 | E2 | 10 | 150 | VSPVETVNEY | | 31152 |
| HPV56 | E2 | 9 | 270 | WTSTDNKNY | | 31153 |
| HPV56 | E2 | 8 | 278 | YSIITIIY | | 31154 |
| HPV56 | E2 | 8 | 74 | YVAWKYIY | | 31155 |
| HPV56 | E2 | 9 | 74 | YVAWKYIYY | | 31156 |
| HPV56 | E6 | 8 | 50 | CTELKLVY | | 31157 |
| HPV56 | E6 | 8 | 72 | FYSKVRKY | | 31158 |
| HPV56 | E6 | 10 | 72 | FYSKVRKYRY | | 31159 |
| HPV56 | E6 | 11 | 72 | FYSKVRKYRYY | | 31160 |
| HPV56 | E6 | 10 | 37 | KKELTRAEVY | | 31161 |
| HPV56 | E6 | 9 | 99 | LCDLLIRCY | | 31162 |
| HPV56 | E6 | 10 | 26 | LIDLRLSCVY | | 31163 |
| HPV56 | E6 | 11 | 47 | NFACTELKLVY | | 31164 |
| HPV56 | E6 | 9 | 73 | YSKVRKYRY | | 31165 |
| HPV56 | E6 | 10 | 73 | YSKVRKYRYY | | 31166 |
| HPV56 | E7 | 9 | 51 | RQAKQHTCY | | 31167 |
| HPV56 | L1 | 11 | 273 | ADAYGDSMWFY | | 31168 |
| HPV56 | L1 | 8 | 381 | ATEQLSKY | | 31169 |
| HPV56 | L1 | 8 | 444 | ATSLEDKY | | 31170 |
| HPV56 | L1 | 10 | 444 | ATSLEDKYRY | | 31171 |
| HPV56 | L1 | 11 | 37 | ATWRPSENKVY | | 31172 |
| HPV56 | L1 | 11 | 60 | DSYVKRTSIFY | | 31173 |
| HPV56 | L1 | 8 | 303 | ETIPAELY | | 31174 |
| HPV56 | L1 | 10 | 316 | GREPPPSSVY | | 31175 |
| HPV56 | L1 | 11 | 378 | ISTATEQLSKY | | 31176 |
| HPV56 | L1 | 10 | 414 | ITLSAEVMAY | | 31177 |
| HPV56 | L1 | 8 | 470 | KQDPLAKY | | 31178 |
| HPV56 | L1 | 10 | 93 | KTNIPKVSAY | | 31179 |
| HPV56 | L1 | 10 | 387 | KYDARKINQY | | 31180 |
| HPV56 | L1 | 8 | 77 | LLAVGHPY | | 31181 |
| HPV56 | L1 | 9 | 77 | LLAVGHPYY | | 31182 |
| HPV56 | L1 | 8 | 416 | LSAEVMAY | | 31183 |
| HPV56 | L1 | 9 | 1 | MMLPMMYIY | | 31184 |
| HPV56 | L1 | 11 | 255 | PLDIVQSTCKY | | 31185 |
| HPV56 | L1 | 11 | 467 | PTEKQDPLAKY | | 31186 |
| HPV56 | L1 | 10 | 442 | PVATSLEDKY | | 31187 |
| HPV56 | L1 | 11 | 52 | PVSKVVATDSY | | 31188 |
| HPV56 | L1 | 9 | 260 | QSTCKYPDY | | 31189 |
| HPV56 | L1 | 8 | 40 | RPSENKVY | | 31190 |
| HPV56 | L1 | 10 | 285 | RREQLFARHY | | 31191 |
| HPV56 | L1 | 10 | 336 | SEAQLFNKPY | | 31192 |
| HPV56 | L1 | 8 | 446 | SLEDKYRY | | 31193 |
| HPV56 | L1 | 11 | 74 | SSRLLAVGHPY | | 31194 |
| HPV56 | L1 | 10 | 379 | STATEQLSKY | | 31195 |
| HPV56 | L1 | 8 | 261 | STCKYPDY | | 31196 |
| HPV56 | L1 | 9 | 415 | TLSAEVMAY | | 31197 |
| HPV56 | L1 | 11 | 335 | TSEAQLFNKPY | | 31198 |
| HPV56 | L1 | 9 | 445 | TSLEDKYRY | | 31199 |

TABLE XV-continued

A01 Motif Peptides

| Type | Protein | No. of Amino Acids | Position | Sequence | A*0101 | Seq. Id. No. |
|---|---|---|---|---|---|---|
| HPV56 | L1 | 10 | 301 | VGETIPAELY | | 31200 |
| HPV56 | L1 | 10 | 259 | VQSTCKYPDY | | 31201 |
| HPV56 | L1 | 10 | 53 | VSKVVATDSY | | 31202 |
| HPV56 | L1 | 9 | 388 | YDARKINQY | | 31203 |
| HPV56 | L1 | 8 | 276 | YGDSMWFY | | 31204 |
| HPV56 | L1 | 8 | 9 | YRDPPLHY | | 31205 |
| HPV56 | L2 | 8 | 64 | GSGGRAGY | | 31206 |
| HPV56 | L2 | 10 | 434 | GSSFALWPVY | | 31207 |
| HPV56 | L2 | 10 | 62 | GTGSGGRAGY | | 31208 |
| HPV56 | L2 | 10 | 310 | GTQIGARVHY | | 31209 |
| HPV56 | L2 | 11 | 310 | GTQIGARVHYY | | 31210 |
| HPV56 | L2 | 8 | 313 | IGARVHYY | | 31211 |
| HPV56 | L2 | 9 | 313 | IGARVHYYY | | 31212 |
| HPV56 | L2 | 11 | 182 | ISTPTSGIHSY | | 31213 |
| HPV56 | L2 | 9 | 10 | KRASATQLY | | 31214 |
| HPV56 | L2 | 11 | 338 | LSANNSFDGLY | | 31215 |
| HPV56 | L2 | 8 | 341 | NNSFDGLY | | 31216 |
| HPV56 | L2 | 11 | 341 | NNSFDGLYDIY | | 31217 |
| HPV56 | L2 | 10 | 342 | NSFDGLYDIY | | 31218 |
| HPV56 | L2 | 8 | 185 | PTSGIHSY | | 31219 |
| HPV56 | L2 | 9 | 423 | PYDVTHDVY | | 31220 |
| HPV56 | L2 | 11 | 433 | QGSSFALWPVY | | 31221 |
| HPV56 | L2 | 11 | 421 | QSPYDVTHDVY | | 31222 |
| HPV56 | L2 | 8 | 11 | RASATQLY | | 31223 |
| HPV56 | L2 | 8 | 220 | RIAAPRLY | | 31224 |
| HPV56 | L2 | 8 | 436 | SFALWPVY | | 31225 |
| HPV56 | L2 | 9 | 343 | SFDGLYDIY | | 31226 |
| HPV56 | L2 | 9 | 435 | SSFALWPVY | | 31227 |
| HPV56 | L2 | 10 | 183 | STPTSGIHSY | | 31228 |
| HPV56 | L2 | 11 | 414 | STWPFVPQSPY | | 31229 |
| HPV56 | L2 | 9 | 63 | TGSGGRAGY | | 31230 |

TABLE XVI

A03 Motif Peptides with Binding Data

| Type | Protein | Sequence | Position | No. of Amino Acids | A*0301 | Seq. Id. No. |
|---|---|---|---|---|---|---|
| HPV16 | E1 | AAALYWYK | 316 | 8 | | 31231 |
| HPV16 | E1 | AAFGLTPSIA | 239 | 10 | | 31232 |
| HPV16 | E1 | AAMLAKFK | 205 | 8 | | 31233 |
| HPV16 | E1 | AAMLAKFKELY | 205 | 11 | | 31234 |
| HPV16 | E1 | AANTGKSLF | 478 | 9 | | 31235 |
| HPV16 | E1 | ADAKIGMLDDA | 514 | 11 | | 31236 |
| HPV16 | E1 | ADSIKTLLQQY | 248 | 11 | | 31237 |
| HPV16 | E1 | ADTNSNASA | 383 | 9 | | 31238 |
| HPV16 | E1 | ADTNSNASAF | 383 | 10 | | 31239 |
| HPV16 | E1 | AFGLTPSIA | 240 | 9 | | 31240 |
| HPV16 | E1 | AFLKSNSQA | 391 | 9 | | 31241 |
| HPV16 | E1 | AFLKSNSQAK | 391 | 10 | | 31242 |
| HPV16 | E1 | AGTDSRWPY | 570 | 9 | | 31243 |
| HPV16 | E1 | AGTDSRWPYLH | 570 | 11 | | 31244 |
| HPV16 | E1 | AICIEKQSR | 112 | 9 | 0.0010 | 31245 |
| HPV16 | E1 | AICIEKQSRA | 112 | 10 | | 31246 |
| HPV16 | E1 | AICIEKQSRAA | 112 | 11 | | 31247 |
| HPV16 | E1 | ALFTAQEA | 69 | 8 | | 31248 |
| HPV16 | E1 | ALFTAQEAK | 69 | 9 | 0.2400 | 31249 |
| HPV16 | E1 | ALFTAQEAKQH | 69 | 11 | | 31250 |
| HPV16 | E1 | ALKRFLQGIPK | 459 | 11 | | 31251 |
| HPV16 | E1 | AMLAKFKELY | 206 | 10 | | 31252 |
| HPV16 | E1 | ASAFLKSNSQA | 389 | 11 | | 31253 |
| HPV16 | E1 | ATMCRHYK | 406 | 8 | | 31254 |
| HPV16 | E1 | ATMCRHYKR | 406 | 9 | 0.0660 | 31255 |
| HPV16 | E1 | ATMCRHYKRA | 406 | 10 | | 31256 |
| HPV16 | E1 | ATVPCWNY | 524 | 8 | | 31257 |
| HPV16 | E1 | AVQVLKRK | 82 | 8 | | 31258 |
| HPV16 | E1 | AVQVLKRKY | 82 | 9 | | 31259 |
| HPV16 | E1 | AVVEKKTGDA | 23 | 10 | | 31260 |
| HPV16 | E1 | CATMCRHY | 405 | 8 | | 31261 |
| HPV16 | E1 | CATMCRHYK | 405 | 9 | 0.0012 | 31262 |
| HPV16 | E1 | CATMCRHYKR | 405 | 10 | | 31263 |
| HPV16 | E1 | CATMCRHYKRA | 405 | 11 | | 31264 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E1 | CCDWCIAA | 233 | 8 | | 31265 |
| HPV16 | E1 | CCDWCIAAF | 233 | 9 | | 31266 |
| HPV16 | E1 | CDRVDDGGDWK | 430 | 11 | | 31267 |
| HPV16 | E1 | CDWCIAAF | 234 | 8 | | 31268 |
| HPV16 | E1 | CFVNSKSH | 500 | 8 | | 31269 |
| HPV16 | E1 | CFVNSKSHF | 500 | 9 | | 31270 |
| HPV16 | E1 | CGKNRETIEK | 283 | 10 | | 31271 |
| HPV16 | E1 | CIEKQSRA | 114 | 8 | | 31272 |
| HPV16 | E1 | CIEKQSRAA | 114 | 9 | | 31273 |
| HPV16 | E1 | CIEKQSRAAK | 114 | 10 | | 31274 |
| HPV16 | E1 | CIEKQSRAAKR | 114 | 11 | | 31275 |
| HPV16 | E1 | CILLYGAA | 472 | 8 | | 31276 |
| HPV16 | E1 | CLYLHIQSLA | 259 | 10 | | 31277 |
| HPV16 | E1 | CMMIEPPK | 304 | 8 | | 31278 |
| HPV16 | E1 | CMMIEPPKLR | 304 | 10 | | 31279 |
| HPV16 | E1 | CVDNNISPR | 101 | 9 | | 31280 |
| HPV16 | E1 | CVDNNISPRLK | 101 | 11 | | 31281 |
| HPV16 | E1 | DAKIGMLDDA | 515 | 10 | | 31282 |
| HPV16 | E1 | DATVPCWNY | 523 | 9 | | 31283 |
| HPV16 | E1 | DAVQVLKR | 81 | 8 | | 31284 |
| HPV16 | E1 | DAVQVLKRK | 81 | 9 | | 31285 |
| HPV16 | E1 | DAVQVLKRKY | 81 | 10 | | 31286 |
| HPV16 | E1 | DCATMCRH | 404 | 8 | | 31287 |
| HPV16 | E1 | DCATMCRHY | 404 | 9 | 0.0001 | 31288 |
| HPV16 | E1 | DCATMCRHYK | 404 | 10 | 0.0044 | 31289 |
| HPV16 | E1 | DCATMCRHYKR | 404 | 11 | | 31290 |
| HPV16 | E1 | DDATVPCWNY | 522 | 10 | | 31291 |
| HPV16 | E1 | DDSEIAYK | 371 | 8 | | 31292 |
| HPV16 | E1 | DDSEIAYKY | 371 | 9 | | 31293 |
| HPV16 | E1 | DDSEIAYKYA | 371 | 10 | | 31294 |
| HPV16 | E1 | DFIVNDNDY | 50 | 9 | | 31295 |
| HPV16 | E1 | DGDSLPTF | 631 | 8 | | 31296 |
| HPV16 | E1 | DGDSLPTFK | 631 | 9 | | 31297 |
| HPV16 | E1 | DGGDWKQIVMF | 435 | 11 | | 31298 |
| HPV16 | E1 | DGNLVSMDVK | 541 | 10 | | 31299 |
| HPV16 | E1 | DGNLVSMDVKH | 541 | 11 | | 31300 |
| HPV16 | E1 | DIVDDSEIA | 368 | 9 | | 31301 |
| HPV16 | E1 | DIVDDSEIAY | 368 | 10 | | 31302 |
| HPV16 | E1 | DIVDDSEIAYK | 368 | 11 | | 31303 |
| HPV16 | E1 | DSDTGEDLVDF | 41 | 11 | | 31304 |
| HPV16 | E1 | DSEIAYKY | 372 | 8 | | 31305 |
| HPV16 | E1 | DSEIAYKYA | 372 | 9 | | 31306 |
| HPV16 | E1 | DSIKTLLQQY | 249 | 10 | | 31307 |
| HPV16 | E1 | DSRWPYLH | 573 | 8 | | 31308 |
| HPV16 | E1 | DSRWPYLHNR | 573 | 10 | | 31309 |
| HPV16 | E1 | DTGEDLVDF | 43 | 9 | | 31310 |
| HPV16 | E1 | DTNSNASA | 384 | 8 | | 31311 |
| HPV16 | E1 | DTNSNASAF | 384 | 9 | | 31312 |
| HPV16 | E1 | DTNSNASAFLK | 384 | 11 | | 31313 |
| HPV16 | E1 | DTPEWIQR | 335 | 8 | | 31314 |
| HPV16 | E1 | DVKHRPLVQLK | 548 | 11 | | 31315 |
| HPV16 | E1 | EAKQHRDA | 75 | 8 | | 31316 |
| HPV16 | E1 | EAVVEKKTGDA | 22 | 11 | | 31317 |
| HPV16 | E1 | EFMSFLTA | 452 | 8 | | 31318 |
| HPV16 | E1 | EFMSFLTALK | 452 | 10 | | 31319 |
| HPV16 | E1 | EFMSFLTALKR | 452 | 11 | | 31320 |
| HPV16 | E1 | EGTGCNGWF | 11 | 9 | 0.0008 | 31321 |
| HPV16 | E1 | EGTGCNGWFY | 11 | 10 | 0.0005 | 31322 |
| HPV16 | E1 | EIAYKYAQLA | 374 | 10 | | 31323 |
| HPV16 | E1 | ELNDKNWK | 603 | 8 | | 31324 |
| HPV16 | E1 | ELNDKNWKSF | 603 | 10 | | 31325 |
| HPV16 | E1 | ELNDKNWKSFF | 603 | 11 | | 31326 |
| HPV16 | E1 | ELSQMVQWA | 356 | 9 | | 31327 |
| HPV16 | E1 | ELSQMVQWAY | 356 | 10 | | 31328 |
| HPV16 | E1 | ELVRPFKSNK | 221 | 10 | | 31329 |
| HPV16 | E1 | ETAHALFTA | 65 | 9 | | 31330 |
| HPV16 | E1 | ETETAHALF | 63 | 9 | | 31331 |
| HPV16 | E1 | ETETAHALFTA | 63 | 11 | | 31332 |
| HPV16 | E1 | ETETPCSQY | 152 | 9 | | 31333 |
| HPV16 | E1 | ETIEKLLSK | 288 | 9 | | 31334 |
| HPV16 | E1 | ETQQMLQVEGR | 140 | 11 | | 31335 |
| HPV16 | E1 | FDENGNPVY | 594 | 9 | | 31336 |
| HPV16 | E1 | FFSRTWSR | 612 | 8 | | 31337 |
| HPV16 | E1 | FGLTPSIA | 241 | 8 | | 31338 |
| HPV16 | E1 | FGMSLMKF | 486 | 8 | | 31339 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E1 | FIVNDNDY | 51 | 8 | | 31340 |
| HPV16 | E1 | FLKSNSQA | 392 | 8 | | 31341 |
| HPV16 | E1 | FLKSNSQAK | 392 | 9 | 0.0013 | 31342 |
| HPV16 | E1 | FLQGIPKK | 463 | 8 | | 31343 |
| HPV16 | E1 | FLQGSVICF | 493 | 9 | | 31344 |
| HPV16 | E1 | FLRYQGVEF | 445 | 9 | | 31345 |
| HPV16 | E1 | FLTALKRF | 456 | 8 | | 31346 |
| HPV16 | E1 | FMSFLTALK | 453 | 9 | 0.1300 | 31347 |
| HPV16 | E1 | FMSFLTALKR | 453 | 10 | | 31348 |
| HPV16 | E1 | FMSFLTALKRF | 453 | 11 | | 31349 |
| HPV16 | E1 | FSELVRPF | 219 | 8 | | 31350 |
| HPV16 | E1 | FSELVRPFK | 219 | 9 | | 31351 |
| HPV16 | E1 | FSRTWSRLSLH | 613 | 11 | | 31352 |
| HPV16 | E1 | FTAQEAKQH | 71 | 9 | | 31353 |
| HPV16 | E1 | FTAQEAKQHR | 71 | 10 | | 31354 |
| HPV16 | E1 | FTFPNEFPF | 586 | 9 | | 31355 |
| HPV16 | E1 | FVNSKSHF | 501 | 8 | | 31356 |
| HPV16 | E1 | GAANTGKSLF | 477 | 10 | | 31357 |
| HPV16 | E1 | GCNGWFYVEA | 14 | 10 | | 31358 |
| HPV16 | E1 | GCVDNNISPR | 100 | 10 | | 31359 |
| HPV16 | E1 | GDSLPTFK | 632 | 8 | | 31360 |
| HPV16 | E1 | GDTPEWIQR | 334 | 9 | 0.0008 | 31361 |
| HPV16 | E1 | GDWKQIVMF | 437 | 9 | | 31362 |
| HPV16 | E1 | GDWKQIVMFLR | 437 | 11 | | 31363 |
| HPV16 | E1 | GGDWKQIVMF | 436 | 10 | | 31364 |
| HPV16 | E1 | GGEGVSER | 176 | 8 | | 31365 |
| HPV16 | E1 | GGEGVSERH | 176 | 9 | | 31366 |
| HPV16 | E1 | GGSGGGCSQY | 162 | 10 | | 31367 |
| HPV16 | E1 | GIPKKNCILLY | 466 | 11 | | 31368 |
| HPV16 | E1 | GISNISEVY | 325 | 9 | | 31369 |
| HPV16 | E1 | GLTPSIADSIK | 242 | 11 | | 31370 |
| HPV16 | E1 | GMVVLLLVR | 272 | 9 | 0.0036 | 31371 |
| HPV16 | E1 | GMVVLLLVRY | 272 | 10 | | 31372 |
| HPV16 | E1 | GMVVLLLVRYK | 272 | 11 | | 31373 |
| HPV16 | E1 | GSGGEGVSER | 174 | 10 | | 31374 |
| HPV16 | E1 | GSGGEGVSERH | 174 | 11 | | 31375 |
| HPV16 | E1 | GSGGGCSQY | 163 | 9 | | 31376 |
| HPV16 | E1 | GSVICFVNSK | 496 | 10 | | 31377 |
| HPV16 | E1 | GTDSRWPY | 571 | 8 | | 31378 |
| HPV16 | E1 | GTDSRWPYLH | 571 | 10 | | 31379 |
| HPV16 | E1 | GTGCNGWF | 12 | 8 | | 31380 |
| HPV16 | E1 | GTGCNGWFY | 12 | 9 | 0.0004 | 31381 |
| HPV16 | E1 | GVEFMSFLTA | 450 | 10 | | 31382 |
| HPV16 | E1 | GVSFSELVR | 216 | 9 | 0.0011 | 31383 |
| HPV16 | E1 | GVSFSELVRPF | 216 | 11 | | 31384 |
| HPV16 | E1 | HALFTAQEA | 68 | 9 | | 31385 |
| HPV16 | E1 | HALFTAQEAK | 68 | 10 | | 31386 |
| HPV16 | E1 | HFWLQPLA | 507 | 8 | | 31387 |
| HPV16 | E1 | HFWLQPLADA | 507 | 10 | | 31388 |
| HPV16 | E1 | HFWLQPLADAK | 507 | 11 | | 31389 |
| HPV16 | E1 | HSFNDCTF | 348 | 8 | | 31390 |
| HPV16 | E1 | IAAFGLTPSIA | 238 | 11 | | 31391 |
| HPV16 | E1 | IAYKYAQLA | 375 | 9 | | 31392 |
| HPV16 | E1 | ICFVNSKSH | 499 | 9 | | 31393 |
| HPV16 | E1 | ICFVNSKSHF | 499 | 10 | | 31394 |
| HPV16 | E1 | ICIEKQSR | 113 | 8 | | 31395 |
| HPV16 | E1 | ICIEKQSRA | 113 | 9 | | 31396 |
| HPV16 | E1 | ICIEKQSRAA | 113 | 10 | | 31397 |
| HPV16 | E1 | ICIEKQSRAAK | 113 | 11 | | 31398 |
| HPV16 | E1 | IDDNLRNA | 532 | 8 | | 31399 |
| HPV16 | E1 | ILLYGAANTGK | 473 | 11 | | 31400 |
| HPV16 | E1 | ILNVLKTSNA | 194 | 10 | | 31401 |
| HPV16 | E1 | ILNVLKTSNAK | 194 | 11 | | 31402 |
| HPV16 | E1 | ISNISEVY | 326 | 8 | | 31403 |
| HPV16 | E1 | IVDDSEIA | 369 | 8 | | 31404 |
| HPV16 | E1 | IVDDSEIAY | 369 | 9 | | 31405 |
| HPV16 | E1 | IVDDSEIAYK | 369 | 10 | | 31406 |
| HPV16 | E1 | IVDDSEIAYKY | 369 | 11 | | 31407 |
| HPV16 | E1 | IVKDCATMCR | 401 | 10 | | 31408 |
| HPV16 | E1 | IVKDCATMCRH | 401 | 11 | | 31409 |
| HPV16 | E1 | IVNDNDYLTQA | 52 | 11 | | 31410 |
| HPV16 | E1 | KAAMLAKF | 204 | 8 | | 31411 |
| HPV16 | E1 | KAAMLAKFK | 204 | 9 | 0.1100 | 31412 |
| HPV16 | E1 | KAICIEKQSR | 111 | 10 | | 31413 |
| HPV16 | E1 | KAICIEKQSRA | 111 | 11 | | 31414 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E1 | KCGKNRETIEK | 282 | 11 | | 31415 |
| HPV16 | E1 | KDCATMCR | 403 | 8 | | 31416 |
| HPV16 | E1 | KDCATMCRH | 403 | 9 | 0.0011 | 31417 |
| HPV16 | E1 | KDCATMCRHY | 403 | 10 | 0.0005 | 31418 |
| HPV16 | E1 | KDCATMCRHYK | 403 | 11 | | 31419 |
| HPV16 | E1 | KFKELYGVSF | 210 | 10 | | 31420 |
| HPV16 | E1 | KFLQGSVICF | 492 | 10 | | 31421 |
| HPV16 | E1 | KIGMLDDA | 517 | 8 | | 31422 |
| HPV16 | E1 | KIVKDCATMCR | 400 | 11 | | 31423 |
| HPV16 | E1 | KLRSTAAA | 311 | 8 | | 31424 |
| HPV16 | E1 | KLRSTAAALY | 311 | 10 | | 31425 |
| HPV16 | E1 | KSFFSRTWSR | 610 | 10 | | 31426 |
| HPV16 | E1 | KSHFWLQPLA | 505 | 10 | | 31427 |
| HPV16 | E1 | KSLFGMSLMK | 483 | 10 | | 31428 |
| HPV16 | E1 | KSLFGMSLMKF | 483 | 11 | | 31429 |
| HPV16 | E1 | KSNSQAKIVK | 394 | 10 | | 31430 |
| HPV16 | E1 | KSTCCDWCIA | 230 | 10 | | 31431 |
| HPV16 | E1 | KSTCCDWCIAA | 230 | 11 | | 31432 |
| HPV16 | E1 | KTGISNISEVY | 323 | 11 | | 31433 |
| HPV16 | E1 | KTLLQQYCLY | 252 | 10 | | 31434 |
| HPV16 | E1 | KTSNAKAA | 199 | 8 | | 31435 |
| HPV16 | E1 | KTSNAKAAMLA | 199 | 11 | | 31436 |
| HPV16 | E1 | LADTNSNA | 382 | 8 | | 31437 |
| HPV16 | E1 | LADTNSNASA | 382 | 10 | | 31438 |
| HPV16 | E1 | LADTNSNASAF | 382 | 11 | | 31439 |
| HPV16 | E1 | LAKFKELY | 208 | 8 | | 31440 |
| HPV16 | E1 | LDDATVPCWNY | 521 | 11 | | 31441 |
| HPV16 | E1 | LDGNLVSMDVK | 540 | 11 | | 31442 |
| HPV16 | E1 | LFESEDSGY | 126 | 9 | | 31443 |
| HPV16 | E1 | LFGMSLMK | 485 | 8 | | 31444 |
| HPV16 | E1 | LFGMSLMKF | 485 | 9 | | 31445 |
| HPV16 | E1 | LFTAQEAK | 70 | 8 | | 31446 |
| HPV16 | E1 | LFTAQEAKQH | 70 | 10 | | 31447 |
| HPV16 | E1 | LFTAQEAKQHR | 70 | 11 | | 31448 |
| HPV16 | E1 | LITSNINA | 563 | 8 | | 31449 |
| HPV16 | E1 | LLITSNINA | 562 | 9 | | 31450 |
| HPV16 | E1 | LLLVRYKCGK | 276 | 10 | | 31451 |
| HPV16 | E1 | LLQQYCLY | 254 | 8 | | 31452 |
| HPV16 | E1 | LLQQYCLYLH | 254 | 10 | | 31453 |
| HPV16 | E1 | LLVRYKCGK | 277 | 9 | 0.0043 | 31454 |
| HPV16 | E1 | LLVRYKCGKNR | 277 | 11 | | 31455 |
| HPV16 | E1 | LLYGAANTGK | 474 | 10 | | 31456 |
| HPV16 | E1 | LSLHEDEDK | 620 | 9 | 0.0005 | 31457 |
| HPV16 | E1 | LSQMVQWA | 357 | 8 | | 31458 |
| HPV16 | E1 | LSQMVQWAY | 357 | 9 | | 31459 |
| HPV16 | E1 | LTNILNVLK | 191 | 9 | 0.0086 | 31460 |
| HPV16 | E1 | LTPSIADSIK | 243 | 10 | | 31461 |
| HPV16 | E1 | LTQAETETA | 59 | 9 | | 31462 |
| HPV16 | E1 | LTQAETETAH | 59 | 10 | | 31463 |
| HPV16 | E1 | LTQAETETAHA | 59 | 11 | | 31464 |
| HPV16 | E1 | LVDFIVNDNDY | 48 | 11 | | 31465 |
| HPV16 | E1 | LVRPFKSNK | 222 | 9 | 0.0700 | 31466 |
| HPV16 | E1 | LVRYKCGK | 278 | 8 | | 31467 |
| HPV16 | E1 | LVRYKCGKNR | 278 | 10 | | 31468 |
| HPV16 | E1 | LVSMDVKH | 544 | 8 | | 31469 |
| HPV16 | E1 | LVSMDVKHR | 544 | 9 | 0.0005 | 31470 |
| HPV16 | E1 | LVVFTFPNEF | 583 | 10 | | 31471 |
| HPV16 | E1 | MCMMIEPPK | 303 | 9 | | 31472 |
| HPV16 | E1 | MCMMIEPPKLR | 303 | 11 | | 31473 |
| HPV16 | E1 | MCRHYKRA | 408 | 8 | | 31474 |
| HPV16 | E1 | MCRHYKRAEK | 408 | 10 | | 31475 |
| HPV16 | E1 | MCRHYKRAEKK | 408 | 11 | | 31476 |
| HPV16 | E1 | MFLRYQGVEF | 444 | 10 | | 31477 |
| HPV16 | E1 | MIEPPKLR | 306 | 8 | | 31478 |
| HPV16 | E1 | MIEPPKLRSTA | 306 | 11 | | 31479 |
| HPV16 | E1 | MLAKFKELY | 207 | 9 | | 31480 |
| HPV16 | E1 | MLQVEGRH | 144 | 8 | | 31481 |
| HPV16 | E1 | MMIEPPKLR | 305 | 9 | 0.0010 | 31482 |
| HPV16 | E1 | MSFLTALK | 454 | 8 | | 31483 |
| HPV16 | E1 | MSFLTALKR | 454 | 9 | 0.0870 | 31484 |
| HPV16 | E1 | MSFLTALKRF | 454 | 10 | | 31485 |
| HPV16 | E1 | MSMSQWIK | 420 | 8 | | 31486 |
| HPV16 | E1 | MSMSQWIKY | 420 | 9 | | 31487 |
| HPV16 | E1 | MSMSQWIKYR | 420 | 10 | | 31488 |
| HPV16 | E1 | MSQWIKYR | 422 | 8 | | 31489 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E1 | MSQWIKYRCDR | 422 | 11 | | 31490 |
| HPV16 | E1 | MVVLLLVR | 273 | 8 | | 31491 |
| HPV16 | E1 | MVVLLLVRY | 273 | 9 | | 31492 |
| HPV16 | E1 | MVVLLLVRYK | 273 | 10 | | 31493 |
| HPV16 | E1 | NAGTDSRWPY | 569 | 10 | | 31494 |
| HPV16 | E1 | NAKAAMLA | 202 | 8 | | 31495 |
| HPV16 | E1 | NAKAAMLAK | 202 | 9 | 0.0005 | 31496 |
| HPV16 | E1 | NAKAAMLAKF | 202 | 10 | | 31497 |
| HPV16 | E1 | NAKAAMLAKFK | 202 | 11 | | 31498 |
| HPV16 | E1 | NCILLYGA | 471 | 8 | | 31499 |
| HPV16 | E1 | NCILLYGAA | 471 | 9 | | 31500 |
| HPV16 | E1 | NDGDSLPTF | 630 | 9 | | 31501 |
| HPV16 | E1 | NDGDSLPTFK | 630 | 10 | | 31502 |
| HPV16 | E1 | NDIVDDSEIA | 367 | 10 | | 31503 |
| HPV16 | E1 | NDIVDDSEIAY | 367 | 11 | | 31504 |
| HPV16 | E1 | NDKNWKSF | 605 | 8 | | 31505 |
| HPV16 | E1 | NDKNWKSFF | 605 | 9 | | 31506 |
| HPV16 | E1 | NDKNWKSFFSR | 605 | 11 | | 31507 |
| HPV16 | E1 | NDNDYLTQA | 54 | 9 | | 31508 |
| HPV16 | E1 | NGNPVYELNDK | 597 | 11 | | 31509 |
| HPV16 | E1 | NGWFYVEA | 16 | 8 | | 31510 |
| HPV16 | E1 | NILNVLKTSNA | 193 | 11 | | 31511 |
| HPV16 | E1 | NINAGTDSR | 567 | 9 | 0.0005 | 31512 |
| HPV16 | E1 | NISPRLKA | 105 | 8 | | 31513 |
| HPV16 | E1 | NLVSMDVK | 543 | 8 | | 31514 |
| HPV16 | E1 | NLVSMDVKH | 543 | 9 | | 31515 |
| HPV16 | E1 | NLVSMDVKHR | 543 | 10 | | 31516 |
| HPV16 | E1 | NSNASAFLK | 386 | 9 | 0.0005 | 31517 |
| HPV16 | E1 | NSQAKIVK | 396 | 8 | | 31518 |
| HPV16 | E1 | NSQAKIVKDCA | 396 | 11 | | 31519 |
| HPV16 | E1 | NVLKTSNA | 196 | 8 | | 31520 |
| HPV16 | E1 | NVLKTSNAK | 196 | 9 | 0.0005 | 31521 |
| HPV16 | E1 | NVLKTSNAKA | 196 | 10 | | 31522 |
| HPV16 | E1 | NVLKTSNAKAA | 196 | 11 | | 31523 |
| HPV16 | E1 | PCWNYIDDNLR | 527 | 11 | | 31524 |
| HPV16 | E1 | PFDENGNPVY | 593 | 10 | | 31525 |
| HPV16 | E1 | PLLITSNINA | 561 | 10 | | 31526 |
| HPV16 | E1 | PLTNILNVLK | 190 | 10 | | 31527 |
| HPV16 | E1 | PMCMMIEPPK | 302 | 10 | | 31528 |
| HPV16 | E1 | PSIADSIK | 245 | 8 | | 31529 |
| HPV16 | E1 | PVYELNDK | 600 | 8 | | 31530 |
| HPV16 | E1 | PVYELNDKNWK | 600 | 11 | | 31531 |
| HPV16 | E1 | QAETETAH | 61 | 8 | | 31532 |
| HPV16 | E1 | QAETETAHA | 61 | 9 | | 31533 |
| HPV16 | E1 | QAETETAHALF | 61 | 11 | | 31534 |
| HPV16 | E1 | QAKIVKDCA | 398 | 9 | | 31535 |
| HPV16 | E1 | QGSVICFVNSK | 495 | 11 | | 31536 |
| HPV16 | E1 | QGVEFMSF | 449 | 8 | | 31537 |
| HPV16 | E1 | QGVEFMSFLTA | 449 | 11 | | 31538 |
| HPV16 | E1 | QIVMFLRY | 441 | 8 | | 31539 |
| HPV16 | E1 | QLADTNSNA | 381 | 9 | | 31540 |
| HPV16 | E1 | QLADTNSNASA | 381 | 11 | | 31541 |
| HPV16 | E1 | QMLQVEGR | 143 | 8 | | 31542 |
| HPV16 | E1 | QMLQVEGRH | 143 | 9 | | 31543 |
| HPV16 | E1 | QMSMSQWIK | 419 | 9 | 0.0023 | 31544 |
| HPV16 | E1 | QMSMSQWIKY | 419 | 10 | | 31545 |
| HPV16 | E1 | QMSMSQWIKYR | 419 | 11 | | 31546 |
| HPV16 | E1 | QSRAAKRR | 118 | 8 | | 31547 |
| HPV16 | E1 | QSRAAKRRLF | 118 | 10 | | 31548 |
| HPV16 | E1 | QTVLQHSF | 343 | 8 | | 31549 |
| HPV16 | E1 | RAAKRRLF | 120 | 8 | | 31550 |
| HPV16 | E1 | RDAVQVLK | 80 | 8 | | 31551 |
| HPV16 | E1 | RDAVQVLKR | 80 | 9 | | 31552 |
| HPV16 | E1 | RDAVQVLKRK | 80 | 10 | | 31553 |
| HPV16 | E1 | RDAVQVLKRKY | 80 | 11 | | 31554 |
| HPV16 | E1 | RFLQGIPK | 462 | 8 | | 31555 |
| HPV16 | E1 | RFLQGIPKK | 462 | 9 | | 31556 |
| HPV16 | E1 | RLFESEDSGY | 125 | 10 | | 31557 |
| HPV16 | E1 | RLKAICIEK | 109 | 9 | 0.0840 | 31558 |
| HPV16 | E1 | RLSLHEDEDK | 619 | 10 | | 31559 |
| HPV16 | E1 | RLVVFTFPNEF | 582 | 11 | | 31560 |
| HPV16 | E1 | RSTAAALY | 313 | 8 | | 31561 |
| HPV16 | E1 | RSTAAALYWY | 313 | 10 | | 31562 |
| HPV16 | E1 | RSTAAALYWYK | 313 | 11 | | 31563 |
| HPV16 | E1 | RTWSRLSLH | 615 | 9 | | 31564 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E1 | RVDDGGDWK | 432 | 9 | | 31565 |
| HPV16 | E1 | SAFLKSNSQA | 390 | 10 | | 31566 |
| HPV16 | E1 | SAFLKSNSQAK | 390 | 11 | | 31567 |
| HPV16 | E1 | SDTGEDLVDF | 42 | 10 | | 31568 |
| HPV16 | E1 | SFFSRTWSR | 611 | 9 | | 31569 |
| HPV16 | E1 | SFLTALKR | 455 | 8 | | 31570 |
| HPV16 | E1 | SFLTALKRF | 455 | 9 | | 31571 |
| HPV16 | E1 | SFSELVRPF | 218 | 9 | | 31572 |
| HPV16 | E1 | SFSELVRPFK | 218 | 10 | | 31573 |
| HPV16 | E1 | SGCVDNNISPR | 99 | 11 | | 31574 |
| HPV16 | E1 | SGGEGVSER | 175 | 9 | | 31575 |
| HPV16 | E1 | SGGEGVSERH | 175 | 10 | | 31576 |
| HPV16 | E1 | SGGGCSQY | 164 | 8 | | 31577 |
| HPV16 | E1 | SGGSGGGCSQY | 161 | 11 | | 31578 |
| HPV16 | E1 | SGSGGEGVSER | 173 | 11 | | 31579 |
| HPV16 | E1 | SIKTLLQQY | 250 | 9 | | 31580 |
| HPV16 | E1 | SLFGMSLMK | 484 | 9 | 0.7200 | 31581 |
| HPV16 | E1 | SLFGMSLMKF | 484 | 10 | | 31582 |
| HPV16 | E1 | SLHEDEDK | 621 | 8 | | 31583 |
| HPV16 | E1 | SMSQWIKY | 421 | 8 | | 31584 |
| HPV16 | E1 | SMSQWIKYR | 421 | 9 | 0.6900 | 31585 |
| HPV16 | E1 | STAAALYWY | 314 | 9 | | 31586 |
| HPV16 | E1 | STAAALYWYK | 314 | 10 | | 31587 |
| HPV16 | E1 | STCCDWCIA | 231 | 9 | | 31588 |
| HPV16 | E1 | STCCDWCIAA | 231 | 10 | | 31589 |
| HPV16 | E1 | STCCDWCIAAF | 231 | 11 | | 31590 |
| HPV16 | E1 | SVICFVNSK | 497 | 9 | 0.0005 | 31591 |
| HPV16 | E1 | SVICFVNSKSH | 497 | 11 | | 31592 |
| HPV16 | E1 | TAAALYWY | 315 | 8 | | 31593 |
| HPV16 | E1 | TAAALYWYK | 315 | 9 | 0.7800 | 31594 |
| HPV16 | E1 | TAHALFTA | 66 | 8 | | 31595 |
| HPV16 | E1 | TAHALFTAQEA | 66 | 11 | | 31596 |
| HPV16 | E1 | TAQEAKQH | 72 | 8 | | 31597 |
| HPV16 | E1 | TAQEAKQHR | 72 | 9 | 0.0005 | 31598 |
| HPV16 | E1 | TAQEAKQHRDA | 72 | 11 | | 31599 |
| HPV16 | E1 | TCCDWCIA | 232 | 8 | | 31600 |
| HPV16 | E1 | TCCDWCIAA | 232 | 9 | | 31601 |
| HPV16 | E1 | TCCDWCIAAF | 232 | 10 | | 31602 |
| HPV16 | E1 | TDSRWPYLH | 572 | 9 | | 31603 |
| HPV16 | E1 | TDSRWPYLHNR | 572 | 11 | | 31604 |
| HPV16 | E1 | TFELSQMVQWA | 354 | 11 | | 31605 |
| HPV16 | E1 | TFPNEFPF | 587 | 8 | | 31606 |
| HPV16 | E1 | TGCNGWFY | 13 | 8 | | 31607 |
| HPV16 | E1 | TGCNGWFYVEA | 13 | 11 | | 31608 |
| HPV16 | E1 | TGEDLVDF | 44 | 8 | | 31609 |
| HPV16 | E1 | TGISNISEVY | 324 | 10 | | 31610 |
| HPV16 | E1 | TIEKLLSK | 289 | 8 | | 31611 |
| HPV16 | E1 | TLLQQYCLY | 253 | 9 | | 31612 |
| HPV16 | E1 | TLLQQYCLYH | 253 | 11 | | 31613 |
| HPV16 | E1 | TMCRHYKR | 407 | 8 | | 31614 |
| HPV16 | E1 | TMCRHYKRA | 407 | 9 | | 31615 |
| HPV16 | E1 | TMCRHYKRAEK | 407 | 11 | | 31616 |
| HPV16 | E1 | TSNAKAAMLA | 200 | 10 | | 31617 |
| HPV16 | E1 | TSNAKAAMLAK | 200 | 11 | | 31618 |
| HPV16 | E1 | TSNINAGTDSR | 565 | 11 | | 31619 |
| HPV16 | E1 | VDDGGDWK | 433 | 8 | | 31620 |
| HPV16 | E1 | VDDSEIAY | 370 | 8 | | 31621 |
| HPV16 | E1 | VDDSEIAYK | 370 | 9 | | 31622 |
| HPV16 | E1 | VDDSEIAYKY | 370 | 10 | | 31623 |
| HPV16 | E1 | VDDSEIAYKYA | 370 | 11 | | 31624 |
| HPV16 | E1 | VDFIVNDNDY | 49 | 10 | | 31625 |
| HPV16 | E1 | VDNNISPR | 102 | 8 | | 31626 |
| HPV16 | E1 | VDNNISPRLK | 102 | 10 | | 31627 |
| HPV16 | E1 | VDNNISPRLKA | 102 | 11 | | 31628 |
| HPV16 | E1 | VFTFPNEF | 585 | 8 | | 31629 |
| HPV16 | E1 | VFTFPNEFPF | 585 | 10 | | 31630 |
| HPV16 | E1 | VICFVNSK | 498 | 8 | | 31631 |
| HPV16 | E1 | VICFVNSKSH | 498 | 10 | | 31632 |
| HPV16 | E1 | VICFVNSKSHF | 498 | 11 | | 31633 |
| HPV16 | E1 | VLKTSNAK | 197 | 8 | | 31634 |
| HPV16 | E1 | VLKTSNAKA | 197 | 9 | | 31635 |
| HPV16 | E1 | VLKTSNAKAA | 197 | 10 | | 31636 |
| HPV16 | E1 | VLLLVRYK | 275 | 8 | | 31637 |
| HPV16 | E1 | VLLLVRYKCGK | 275 | 11 | | 31638 |
| HPV16 | E1 | VLQHSFNDCTF | 345 | 11 | | 31639 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E1 | VMFLRYQGVEF | 443 | 11 | | 31640 |
| HPV16 | E1 | VSFSELVR | 217 | 8 | | 31641 |
| HPV16 | E1 | VSFSELVRPF | 217 | 10 | | 31642 |
| HPV16 | E1 | VSFSELVRPFK | 217 | 11 | | 31643 |
| HPV16 | E1 | VSMDVKHR | 545 | 8 | | 31644 |
| HPV16 | E1 | VVEKKTGDA | 24 | 9 | | 31645 |
| HPV16 | E1 | VVFTFPNEF | 584 | 9 | | 31646 |
| HPV16 | E1 | VVFTFPNEFPF | 584 | 11 | | 31647 |
| HPV16 | E1 | VVLLLVRY | 274 | 8 | | 31648 |
| HPV16 | E1 | VVLLLVRYK | 274 | 9 | 1.0000 | 31649 |
| HPV16 | E1 | WFYVEAVVEK | 18 | 10 | | 31650 |
| HPV16 | E1 | WFYVEAVVEKK | 18 | 11 | | 31651 |
| HPV16 | E1 | WGMVVLLLVR | 271 | 10 | | 31652 |
| HPV16 | E1 | WGMVVLLLVRY | 271 | 11 | | 31653 |
| HPV16 | E1 | WIKYRCDR | 425 | 8 | | 31654 |
| HPV16 | E1 | WIQRQTVLQH | 339 | 10 | | 31655 |
| HPV16 | E1 | WLQPLADA | 509 | 8 | | 31656 |
| HPV16 | E1 | WLQPLADAK | 509 | 9 | 0.0005 | 31657 |
| HPV16 | E1 | YAQLADTNSNA | 379 | 11 | | 31658 |
| HPV16 | E1 | YCLYLHIQSLA | 258 | 11 | | 31659 |
| HPV16 | E1 | YGAANTGK | 476 | 8 | | 31660 |
| HPV16 | E1 | YGAANTGKSLF | 476 | 11 | | 31661 |
| HPV16 | E1 | YGDTPEWIQR | 333 | 10 | | 31662 |
| HPV16 | E1 | YGVSFSELVR | 215 | 10 | | 31663 |
| HPV16 | E1 | YIDDNLRNA | 531 | 9 | | 31664 |
| HPV16 | E1 | YLHIQSLA | 261 | 8 | | 31665 |
| HPV16 | E1 | YLHNRLVVF | 578 | 9 | | 31666 |
| HPV16 | E1 | YLHNRLVVFTF | 578 | 11 | | 31667 |
| HPV16 | E1 | YLTQAETETA | 58 | 10 | | 31668 |
| HPV16 | E1 | YLTQAETETAH | 58 | 11 | | 31669 |
| HPV16 | E1 | YVEAVVEK | 20 | 8 | | 31670 |
| HPV16 | E1 | YVEAVVEKK | 20 | 9 | | 31671 |
| HPV16 | E2 | AATHTKAVA | 220 | 9 | | 31672 |
| HPV16 | E2 | AFNSSHKGR | 270 | 9 | | 31673 |
| HPV16 | E2 | AIYYKAREMGF | 41 | 11 | | 31674 |
| HPV16 | E2 | ATHTKAVA | 221 | 8 | | 31675 |
| HPV16 | E2 | AVSKNKALQA | 63 | 10 | | 31676 |
| HPV16 | E2 | AVSSTWHWTGH | 314 | 11 | | 31677 |
| HPV16 | E2 | CAIYYKAR | 40 | 8 | | 31678 |
| HPV16 | E2 | CLRYRFKK | 300 | 8 | | 31679 |
| HPV16 | E2 | CLRYRFKKH | 300 | 9 | | 31680 |
| HPV16 | E2 | DAEKYSKNK | 174 | 9 | | 31681 |
| HPV16 | E2 | DANTLKCLR | 294 | 9 | | 31682 |
| HPV16 | E2 | DANTLKCLRY | 294 | 10 | | 31683 |
| HPV16 | E2 | DANTLKCLRYR | 294 | 11 | | 31684 |
| HPV16 | E2 | DDAEKYSK | 173 | 8 | | 31685 |
| HPV16 | E2 | DDAEKYSKNK | 173 | 10 | | 31686 |
| HPV16 | E2 | DGDICNTMH | 122 | 9 | | 31687 |
| HPV16 | E2 | DGDICNTMHY | 122 | 10 | | 31688 |
| HPV16 | E2 | DICNTMHY | 124 | 8 | | 31689 |
| HPV16 | E2 | DLRDHIDY | 25 | 8 | | 31690 |
| HPV16 | E2 | DLRDHIDYWK | 25 | 10 | | 31691 |
| HPV16 | E2 | DLRDHIDYWKH | 25 | 11 | | 31692 |
| HPV16 | E2 | DSAPILTA | 263 | 8 | | 31693 |
| HPV16 | E2 | DSAPILTAF | 263 | 9 | | 31694 |
| HPV16 | E2 | DSEWQRDQF | 338 | 9 | | 31695 |
| HPV16 | E2 | DSTDLRDH | 22 | 8 | | 31696 |
| HPV16 | E2 | DSTDLRDHIDY | 22 | 11 | | 31697 |
| HPV16 | E2 | DSVDSAPILTA | 260 | 11 | | 31698 |
| HPV16 | E2 | DTGNPCHTTK | 246 | 10 | | 31699 |
| HPV16 | E2 | DVSLEVYLTA | 96 | 10 | | 31700 |
| HPV16 | E2 | ECAIYYKA | 39 | 8 | | 31701 |
| HPV16 | E2 | ECAIYYKAR | 39 | 9 | | 31702 |
| HPV16 | E2 | EGIRTYFVQF | 162 | 10 | | 31703 |
| HPV16 | E2 | EGIRTYFVQFK | 162 | 11 | | 31704 |
| HPV16 | E2 | EGQVDYYGLY | 149 | 10 | | 31705 |
| HPV16 | E2 | EGQVDYYGLYY | 149 | 11 | | 31706 |
| HPV16 | E2 | EIIRQHLA | 209 | 8 | | 31707 |
| HPV16 | E2 | EIIRQHLANH | 209 | 10 | | 31708 |
| HPV16 | E2 | ELQLTLETIY | 74 | 10 | | 31709 |
| HPV16 | E2 | EMGFKHINH | 48 | 9 | | 31710 |
| HPV16 | E2 | ETIYNSQY | 80 | 8 | | 31711 |
| HPV16 | E2 | ETQTTIQR | 233 | 8 | | 31712 |
| HPV16 | E2 | ETQTTIQRPR | 233 | 10 | | 31713 |
| HPV16 | E2 | EVSSPEIIR | 204 | 9 | | 31714 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E2 | EVSSPEIIRQH | 204 | 11 | | 31715 |
| HPV16 | E2 | FDGDICNTMH | 121 | 10 | | 31716 |
| HPV16 | E2 | FDGDICNTMHY | 121 | 11 | | 31717 |
| HPV16 | E2 | FLSQVKIPK | 346 | 9 | | 31718 |
| HPV16 | E2 | FVQFKDDA | 168 | 8 | | 31719 |
| HPV16 | E2 | FVQFKDDAEK | 168 | 10 | | 31720 |
| HPV16 | E2 | FVQFKDDAEKY | 168 | 11 | | 31721 |
| HPV16 | E2 | GCIKKHGY | 108 | 8 | | 31722 |
| HPV16 | E2 | GDANTLKCLR | 293 | 10 | | 31723 |
| HPV16 | E2 | GDANTLKCLRY | 293 | 11 | | 31724 |
| HPV16 | E2 | GDICNTMH | 123 | 8 | | 31725 |
| HPV16 | E2 | GDICNTMHY | 123 | 9 | | 31726 |
| HPV16 | E2 | GIRTYFVQF | 163 | 9 | | 31727 |
| HPV16 | E2 | GIRTYFVQFK | 163 | 10 | | 31728 |
| HPV16 | E2 | GLYYVHEGIR | 156 | 10 | | 31729 |
| HPV16 | E2 | GTEETQTTIQR | 230 | 11 | | 31730 |
| HPV16 | E2 | HGYTVEVQF | 113 | 9 | | 31731 |
| HPV16 | E2 | HIDYWKHMR | 29 | 9 | | 31732 |
| HPV16 | E2 | HINHQVVPTLA | 53 | 11 | | 31733 |
| HPV16 | E2 | HIYICEEA | 136 | 8 | | 31734 |
| HPV16 | E2 | HLANHPAA | 214 | 8 | | 31735 |
| HPV16 | E2 | HLANHPAATH | 214 | 10 | | 31736 |
| HPV16 | E2 | HLKGDANTLK | 290 | 10 | | 31737 |
| HPV16 | E2 | HMRLECAIY | 35 | 9 | | 31738 |
| HPV16 | E2 | HMRLECAIYY | 35 | 10 | | 31739 |
| HPV16 | E2 | HMRLECAIYYK | 35 | 11 | | 31740 |
| HPV16 | E2 | HTTKLLHR | 252 | 8 | | 31741 |
| HPV16 | E2 | IDYWKHMR | 30 | 8 | | 31742 |
| HPV16 | E2 | IIRQHLANH | 210 | 9 | | 31743 |
| HPV16 | E2 | IIRQHLANRPA | 210 | 11 | | 31744 |
| HPV16 | E2 | ILCPTSVF | 193 | 8 | | 31745 |
| HPV16 | E2 | ILTAFNSSH | 267 | 9 | | 31746 |
| HPV16 | E2 | ILTAFNSSHK | 267 | 10 | | 31747 |
| HPV16 | E2 | IVHLKGDA | 288 | 8 | | 31748 |
| HPV16 | E2 | KAREMGFK | 45 | 8 | | 31749 |
| HPV16 | E2 | KAREMGFKH | 45 | 9 | | 31750 |
| HPV16 | E2 | KCLRYFK | 299 | 8 | | 31751 |
| HPV16 | E2 | KCLRYFKK | 299 | 9 | | 31752 |
| HPV16 | E2 | KCLRYFKKH | 299 | 10 | | 31753 |
| HPV16 | E2 | KDDAEKYSK | 172 | 9 | | 31754 |
| HPV16 | E2 | KDDAEKYSKNK | 172 | 11 | | 31755 |
| HPV16 | E2 | KGDANTLK | 292 | 8 | | 31756 |
| HPV16 | E2 | KGDANTLKCLR | 292 | 11 | | 31757 |
| HPV16 | E2 | KLLHRDSVDSA | 255 | 11 | | 31758 |
| HPV16 | E2 | KSAIVTLTY | 329 | 9 | | 31759 |
| HPV16 | E2 | KTITVSTGF | 354 | 9 | | 31760 |
| HPV16 | E2 | LANHPAATH | 215 | 9 | | 31761 |
| HPV16 | E2 | LANHPAATHTK | 215 | 11 | | 31762 |
| HPV16 | E2 | LAVSKNKA | 62 | 8 | | 31763 |
| HPV16 | E2 | LAVSKNKALQA | 62 | 11 | | 31764 |
| HPV16 | E2 | LCQRLNVCQDK | 4 | 11 | | 31765 |
| HPV16 | E2 | LLHRDSVDSA | 256 | 10 | | 31766 |
| HPV16 | E2 | LSQVKIPK | 347 | 8 | | 31767 |
| HPV16 | E2 | LTAFNSSH | 268 | 8 | | 31768 |
| HPV16 | E2 | LTAFNSSHK | 268 | 9 | | 31769 |
| HPV16 | E2 | LTAFNSSHKGR | 268 | 11 | | 31770 |
| HPV16 | E2 | LTAPTGCIK | 103 | 9 | | 31771 |
| HPV16 | E2 | LTAPTGCIKK | 103 | 10 | | 31772 |
| HPV16 | E2 | LTAPTGCIKKH | 103 | 11 | | 31773 |
| HPV16 | E2 | LTLETIYNSQY | 77 | 11 | | 31774 |
| HPV16 | E2 | LTYDSEWQR | 335 | 9 | | 31775 |
| HPV16 | E2 | MGFKHINH | 49 | 8 | | 31776 |
| HPV16 | E2 | NCNSNTTPIVH | 280 | 11 | | 31777 |
| HPV16 | E2 | NDSTDLRDH | 21 | 9 | | 31778 |
| HPV16 | E2 | NSNTTPIVH | 282 | 9 | | 31779 |
| HPV16 | E2 | NSNTTPIVHLK | 282 | 11 | | 31780 |
| HPV16 | E2 | NSQYSNEK | 84 | 8 | | 31781 |
| HPV16 | E2 | NTLKCLRY | 296 | 8 | | 31782 |
| HPV16 | E2 | NTLKCLRYR | 296 | 9 | | 31783 |
| HPV16 | E2 | NTLKCLRYRF | 296 | 10 | | 31784 |
| HPV16 | E2 | NTLKCLRYRFK | 296 | 11 | | 31785 |
| HPV16 | E2 | NTMHYTNWTH | 127 | 10 | | 31786 |
| HPV16 | E2 | NTTPIVHLK | 284 | 9 | | 31787 |
| HPV16 | E2 | NVCQDKILTH | 9 | 10 | | 31788 |
| HPV16 | E2 | NVCQDKILTHY | 9 | 11 | | 31789 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E2 | PAATHTKA | 219 | 8 | | 31790 |
| HPV16 | E2 | PAATHTKAVA | 219 | 10 | | 31791 |
| HPV16 | E2 | PCHTTKLLH | 250 | 9 | | 31792 |
| HPV16 | E2 | PCHTTKLLHR | 250 | 10 | | 31793 |
| HPV16 | E2 | PDTGNPCH | 245 | 8 | | 31794 |
| HPV16 | E2 | PDTGNPCHTTK | 245 | 11 | | 31795 |
| HPV16 | E2 | PILTAFNSSH | 266 | 10 | | 31796 |
| HPV16 | E2 | PILTAFNSSHK | 266 | 11 | | 31797 |
| HPV16 | E2 | PIVHLKGDA | 287 | 9 | | 31798 |
| HPV16 | E2 | PTGCIKKH | 106 | 8 | | 31799 |
| HPV16 | E2 | PTGCIKKHGY | 106 | 10 | | 31800 |
| HPV16 | E2 | PTLAVSKNK | 60 | 9 | | 31801 |
| HPV16 | E2 | PTLAVSKNKA | 60 | 10 | | 31802 |
| HPV16 | E2 | QDKILTHY | 12 | 8 | | 31803 |
| HPV16 | E2 | QDVSLEVY | 95 | 8 | | 31804 |
| HPV16 | E2 | QDVSLEVYLTA | 95 | 11 | | 31805 |
| HPV16 | E2 | QFDGDICNTMH | 120 | 11 | | 31806 |
| HPV16 | E2 | QFKDDAEK | 170 | 8 | | 31807 |
| HPV16 | E2 | QFKDDAEKY | 170 | 9 | | 31808 |
| HPV16 | E2 | QFKDDAEKYSK | 170 | 11 | | 31809 |
| HPV16 | E2 | QFLSQVKIPK | 345 | 10 | | 31810 |
| HPV16 | E2 | QLTLETIY | 76 | 8 | | 31811 |
| HPV16 | E2 | QTTIQRPR | 235 | 8 | | 31812 |
| HPV16 | E2 | QVDYYGLY | 151 | 8 | | 31813 |
| HPV16 | E2 | QVDYYGLYY | 151 | 9 | | 31814 |
| HPV16 | E2 | QVDYYGLYYVH | 151 | 11 | | 31815 |
| HPV16 | E2 | QVILCPTSVF | 191 | 10 | | 31816 |
| HPV16 | E2 | QVVPTLAVSK | 57 | 10 | | 31817 |
| HPV16 | E2 | RDHIDYWK | 27 | 8 | | 31818 |
| HPV16 | E2 | RDHIDYWKH | 27 | 9 | | 31819 |
| HPV16 | E2 | RDHIDYWKHMR | 27 | 11 | | 31820 |
| HPV16 | E2 | RDQFLSQVK | 343 | 9 | | 31821 |
| HPV16 | E2 | RFKKHCTLY | 304 | 9 | | 31822 |
| HPV16 | E2 | RFKKHCTLYTA | 304 | 11 | | 31823 |
| HPV16 | E2 | RLECAIYY | 37 | 8 | | 31824 |
| HPV16 | E2 | RLECAIYYK | 37 | 9 | | 31825 |
| HPV16 | E2 | RLECAIYYKA | 37 | 10 | | 31826 |
| HPV16 | E2 | RLECAIYYKAR | 37 | 11 | | 31827 |
| HPV16 | E2 | RLNVCQDK | 7 | 8 | | 31828 |
| HPV16 | E2 | RSEPDTGNPCH | 242 | 11 | | 31829 |
| HPV16 | E2 | RTYFVQFK | 165 | 8 | | 31830 |
| HPV16 | E2 | RTYFVQFKDDA | 165 | 11 | | 31831 |
| HPV16 | E2 | SAIVTLTY | 330 | 8 | | 31832 |
| HPV16 | E2 | SAPILTAF | 264 | 8 | | 31833 |
| HPV16 | E2 | SLEVYLTA | 98 | 8 | | 31834 |
| HPV16 | E2 | SSPEIIRQH | 206 | 9 | | 31835 |
| HPV16 | E2 | SSPEIIRQHLA | 206 | 11 | | 31836 |
| HPV16 | E2 | SSTWHWTGH | 316 | 9 | | 31837 |
| HPV16 | E2 | STDLRDHIDY | 23 | 10 | | 31838 |
| HPV16 | E2 | STWHWTGH | 317 | 8 | | 31839 |
| HPV16 | E2 | STWHWTGHNVK | 317 | 11 | | 31840 |
| HPV16 | E2 | SVDSAPILTA | 261 | 10 | | 31841 |
| HPV16 | E2 | SVDSAPILTAF | 261 | 11 | | 31842 |
| HPV16 | E2 | SVTVVEGQVDY | 144 | 11 | | 31843 |
| HPV16 | E2 | TAFNSSHK | 269 | 8 | | 31844 |
| HPV16 | E2 | TAFNSSHKGR | 269 | 10 | | 31845 |
| HPV16 | E2 | TAPTGCIK | 104 | 8 | | 31846 |
| HPV16 | E2 | TAPTGCIKK | 104 | 9 | | 31847 |
| HPV16 | E2 | TAPTGCIKKH | 104 | 10 | | 31848 |
| HPV16 | E2 | TAVSSTWH | 313 | 8 | | 31849 |
| HPV16 | E2 | TDLRDHIDY | 24 | 9 | | 31850 |
| HPV16 | E2 | TDLRDHIDYWK | 24 | 11 | | 31851 |
| HPV16 | E2 | TGCIKKHGY | 107 | 9 | | 31852 |
| HPV16 | E2 | TGHNVKHK | 322 | 8 | | 31853 |
| HPV16 | E2 | TGHNVKHKSA | 322 | 10 | | 31854 |
| HPV16 | E2 | TGNPCHTTK | 247 | 9 | | 31855 |
| HPV16 | E2 | TITVSTGF | 355 | 8 | | 31856 |
| HPV16 | E2 | TIYNSQYSNEK | 81 | 11 | | 31857 |
| HPV16 | E2 | TLAVSKNK | 61 | 8 | | 31858 |
| HPV16 | E2 | TLAVSKNKA | 61 | 9 | | 31859 |
| HPV16 | E2 | TLETIYNSQY | 78 | 10 | | 31860 |
| HPV16 | E2 | TLKCLRYR | 297 | 8 | | 31861 |
| HPV16 | E2 | TLKCLRYRF | 297 | 9 | | 31862 |
| HPV16 | E2 | TLKCLRYRFK | 297 | 10 | | 31863 |
| HPV16 | E2 | TLKCLRYRFKK | 297 | 11 | | 31864 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E2 | TLQDVSLEVY | 93 | 10 | | 31865 |
| HPV16 | E2 | TLTYDSEWQR | 334 | 10 | | 31866 |
| HPV16 | E2 | TLYTAVSSTWH | 310 | 11 | | 31867 |
| HPV16 | E2 | TMHYTNWTH | 128 | 9 | | 31868 |
| HPV16 | E2 | TMHYTNWTHIY | 128 | 11 | | 31869 |
| HPV16 | E2 | TTPIVHLK | 285 | 8 | | 31870 |
| HPV16 | E2 | TTPIVHLKGDA | 285 | 11 | | 31871 |
| HPV16 | E2 | TVVEGQVDY | 146 | 9 | | 31872 |
| HPV16 | E2 | TVVEGQVDYY | 146 | 10 | | 31873 |
| HPV16 | E2 | VCQDKILTH | 10 | 9 | | 31874 |
| HPV16 | E2 | VCQDKILTHY | 10 | 10 | | 31875 |
| HPV16 | E2 | VDSAPILTA | 262 | 9 | | 31876 |
| HPV16 | E2 | VDSAPILTAF | 262 | 10 | | 31877 |
| HPV16 | E2 | VDYYGLYY | 152 | 8 | | 31878 |
| HPV16 | E2 | VDYYGLYYVH | 152 | 10 | | 31879 |
| HPV16 | E2 | VILCPTSVF | 192 | 9 | | 31880 |
| HPV16 | E2 | VSKNKALQA | 64 | 9 | | 31881 |
| HPV16 | E2 | VSLEVYLTA | 97 | 9 | | 31882 |
| HPV16 | E2 | VSSPEIIR | 205 | 8 | | 31883 |
| HPV16 | E2 | VSSPEIIRQH | 205 | 10 | | 31884 |
| HPV16 | E2 | VSSTWHWTGH | 315 | 10 | | 31885 |
| HPV16 | E2 | VTLTYDSEWQR | 333 | 11 | | 31886 |
| HPV16 | E2 | VTVVEGQVDY | 145 | 10 | | 31887 |
| HPV16 | E2 | VTVVEGQVDYY | 145 | 11 | | 31888 |
| HPV16 | E2 | VVEGQVDY | 147 | 8 | | 31889 |
| HPV16 | E2 | VVEGQVDYY | 147 | 9 | | 31890 |
| HPV16 | E2 | VVPTLAVSK | 58 | 9 | | 31891 |
| HPV16 | E2 | VVPTLAVSKNK | 58 | 11 | | 31892 |
| HPV16 | E2 | WTGHNVKH | 321 | 8 | | 31893 |
| HPV16 | E2 | WTGHNVKHK | 321 | 9 | | 31894 |
| HPV16 | E2 | WTGHNVKHKSA | 321 | 11 | | 31895 |
| HPV16 | E2 | WTHIYICEEA | 134 | 10 | | 31896 |
| HPV16 | E2 | WTLQDVSLEVY | 92 | 11 | | 31897 |
| HPV16 | E2 | YDSEWQRDQF | 337 | 10 | | 31898 |
| HPV16 | E2 | YFVQFKDDA | 167 | 9 | | 31899 |
| HPV16 | E2 | YFVQFKDDAEK | 167 | 11 | | 31900 |
| HPV16 | E2 | YGLYYVHEGIR | 155 | 11 | | 31901 |
| HPV16 | E2 | YLTAPTGCIK | 102 | 10 | | 31902 |
| HPV16 | E2 | YLTAPTGCIKK | 102 | 11 | | 31903 |
| HPV16 | E2 | YSKNKVWEVH | 178 | 10 | | 31904 |
| HPV16 | E2 | YSKNKVWEVHA | 178 | 11 | | 31905 |
| HPV16 | E2 | YTAVSSTWH | 312 | 9 | | 31906 |
| HPV16 | E2 | YTNWTHIY | 131 | 8 | | 31907 |
| HPV16 | E2 | YVHEGIRTY | 159 | 9 | | 31908 |
| HPV16 | E2 | YVHEGIRTYF | 159 | 10 | | 31909 |
| HPV16 | E5 | AASAFRCF | 53 | 8 | | 31910 |
| HPV16 | E5 | AASAFRCFIVY | 53 | 11 | | 31911 |
| HPV16 | E5 | AFRCFIVY | 56 | 8 | | 31912 |
| HPV16 | E5 | AFRCFIVYIIF | 56 | 11 | | 31913 |
| HPV16 | E5 | ASAFRCFIVY | 54 | 10 | | 31914 |
| HPV16 | E5 | ASTTLLACF | 7 | 9 | | 31915 |
| HPV16 | E5 | CFIVYIIF | 59 | 8 | | 31916 |
| HPV16 | E5 | CFIVYIIFVY | 59 | 10 | | 31917 |
| HPV16 | E5 | CVLLCVCLLIR | 20 | 11 | | 31918 |
| HPV16 | E5 | DTASTTLLA | 5 | 9 | | 31919 |
| HPV16 | E5 | DTASTTLLACF | 5 | 11 | | 31920 |
| HPV16 | E5 | FIVYIIFVY | 60 | 9 | | 31921 |
| HPV16 | E5 | FLIHTHAR | 72 | 8 | | 31922 |
| HPV16 | E5 | FLIHTHARF | 72 | 9 | | 31923 |
| HPV16 | E5 | FVYIPLFLIH | 66 | 10 | | 31924 |
| HPV16 | E5 | IFVYIPLF | 65 | 8 | | 31925 |
| HPV16 | E5 | IFVYIPLFLIH | 65 | 11 | | 31926 |
| HPV16 | E5 | IIFVYIPLF | 64 | 9 | | 31927 |
| HPV16 | E5 | IILVLLLWITA | 43 | 11 | | 31928 |
| HPV16 | E5 | ILVLLLWITA | 44 | 10 | | 31929 |
| HPV16 | E5 | ILVLLLWITAA | 44 | 11 | | 31930 |
| HPV16 | E5 | ITAASAFR | 51 | 8 | | 31931 |
| HPV16 | E5 | ITAASAFRCF | 51 | 10 | | 31932 |
| HPV16 | E5 | IVYIIFVY | 61 | 8 | | 31933 |
| HPV16 | E5 | LACFLLCF | 12 | 8 | | 31934 |
| HPV16 | E5 | LCVCLLIR | 23 | 8 | | 31935 |
| HPV16 | E5 | LDTASTTLLA | 4 | 10 | | 31936 |
| HPV16 | E5 | LFLIHTHA | 71 | 8 | | 31937 |
| HPV16 | E5 | LFLIHTHAR | 71 | 9 | | 31938 |
| HPV16 | E5 | LFLIHTHARF | 71 | 10 | | 31939 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E5 | LIHTHARF | 73 | 8 | | 31940 |
| HPV16 | E5 | LLACFLLCF | 11 | 9 | | 31941 |
| HPV16 | E5 | LLCVCLLIR | 22 | 9 | | 31942 |
| HPV16 | E5 | LLLSVSTY | 32 | 8 | | 31943 |
| HPV16 | E5 | LLLWITAA | 47 | 8 | | 31944 |
| HPV16 | E5 | LLLWITAASA | 47 | 10 | | 31945 |
| HPV16 | E5 | LLLWITAASAF | 47 | 11 | | 31946 |
| HPV16 | E5 | LLWITAASA | 48 | 9 | | 31947 |
| HPV16 | E5 | LLWITAASAF | 48 | 10 | | 31948 |
| HPV16 | E5 | LLWITAASAFR | 48 | 11 | | 31949 |
| HPV16 | E5 | LVLLLWITA | 45 | 9 | | 31950 |
| HPV16 | E5 | LVLLLWITAA | 45 | 10 | | 31951 |
| HPV16 | E5 | NLDTASTTLLA | 3 | 11 | | 31952 |
| HPV16 | E5 | PLFLIHTH | 70 | 8 | | 31953 |
| HPV16 | E5 | PLFLIHTHA | 70 | 9 | | 31954 |
| HPV16 | E5 | PLFLIHTHAR | 70 | 10 | | 31955 |
| HPV16 | E5 | PLFLIHTHARF | 70 | 11 | | 31956 |
| HPV16 | E5 | PLLLSVSTY | 31 | 9 | | 31957 |
| HPV16 | E5 | RCFIVYIIF | 58 | 9 | | 31958 |
| HPV16 | E5 | RCFIVYIIFVY | 58 | 11 | | 31959 |
| HPV16 | E5 | SAFRCFIVY | 55 | 9 | | 31960 |
| HPV16 | E5 | STTLLACF | 8 | 8 | | 31961 |
| HPV16 | E5 | TAASAFRCF | 52 | 9 | | 31962 |
| HPV16 | E5 | TASTTLLA | 6 | 8 | | 31963 |
| HPV16 | E5 | TASTTLLACF | 6 | 10 | | 31964 |
| HPV16 | E5 | TLLACFLLCF | 10 | 10 | | 31965 |
| HPV16 | E5 | TTLLACFLLCF | 9 | 11 | | 31966 |
| HPV16 | E5 | VLLCVCLLIR | 21 | 10 | | 31967 |
| HPV16 | E5 | VLLLWITA | 46 | 8 | | 31968 |
| HPV16 | E5 | VLLLWITAA | 46 | 9 | | 31969 |
| HPV16 | E5 | VLLLWITAASA | 46 | 11 | | 31970 |
| HPV16 | E5 | WITAASAF | 50 | 8 | | 31971 |
| HPV16 | E5 | WITAASAFR | 50 | 9 | | 31972 |
| HPV16 | E5 | WITAASAFRCF | 50 | 11 | | 31973 |
| HPV16 | E5 | YIIFVYIPLF | 63 | 10 | | 31974 |
| HPV16 | E5 | YIPLFLIH | 68 | 8 | | 31975 |
| HPV16 | E5 | YIPLFLIHTH | 68 | 10 | | 31976 |
| HPV16 | E5 | YIPLFLIHTHA | 68 | 11 | | 31977 |
| HPV16 | E6 | AFRDLCIVY | 53 | 9 | 0.0052 | 31978 |
| HPV16 | E6 | AFRDLCIVYR | 53 | 10 | | 31979 |
| HPV16 | E6 | AMFQDPQER | 7 | 9 | 0.0170 | 31980 |
| HPV16 | E6 | AMFQDPQERPR | 7 | 11 | | 31981 |
| HPV16 | E6 | AVCDKCLK | 68 | 8 | 0.0053 | 31982 |
| HPV16 | E6 | AVCDKCLKF | 68 | 9 | 0.0002 | 31983 |
| HPV16 | E6 | AVCDKCLKFY | 68 | 10 | 0.0052 | 31984 |
| HPV16 | E6 | CCRSSRTR | 146 | 8 | | 31985 |
| HPV16 | E6 | CCRSSRTRR | 146 | 9 | 0.0003 | 31986 |
| HPV16 | E6 | CDKCLKFY | 70 | 8 | | 31987 |
| HPV16 | E6 | CDKCLKFYSK | 70 | 10 | | 31988 |
| HPV16 | E6 | CIVYRDGNPY | 58 | 10 | 0.0026 | 31989 |
| HPV16 | E6 | CIVYRDGNPYA | 58 | 11 | | 31990 |
| HPV16 | E6 | CLKFYSKISEY | 73 | 11 | | 31991 |
| HPV16 | E6 | CMSCCRSSR | 143 | 9 | 0.0033 | 31992 |
| HPV16 | E6 | CMSCCRSSRTR | 143 | 11 | | 31993 |
| HPV16 | E6 | CTELQTTIH | 23 | 9 | 0.0002 | 31994 |
| HPV16 | E6 | CVYCKQQLLR | 37 | 10 | 0.0001 | 31995 |
| HPV16 | E6 | CVYCKQQLLRR | 37 | 11 | | 31996 |
| HPV16 | E6 | DFAFRDLCIVY | 51 | 11 | | 31997 |
| HPV16 | E6 | DGNPYAVCDK | 63 | 10 | | 31998 |
| HPV16 | E6 | DIILECVY | 32 | 8 | | 31999 |
| HPV16 | E6 | DIILECVYCK | 32 | 10 | 0.0065 | 32000 |
| HPV16 | E6 | DLLIRCINCQK | 105 | 11 | | 32001 |
| HPV16 | E6 | ECVYCKQQLLR | 36 | 11 | | 32002 |
| HPV16 | E6 | EVYDFAFR | 48 | 8 | 0.0004 | 32003 |
| HPV16 | E6 | FAFRDLCIVY | 52 | 10 | | 32004 |
| HPV16 | E6 | FAFRDLCIVYR | 52 | 11 | | 32005 |
| HPV16 | E6 | GTTLEQQY | 92 | 8 | | 32006 |
| HPV16 | E6 | GTTLEQQYNK | 92 | 10 | 0.0002 | 32007 |
| HPV16 | E6 | HDIILECVY | 31 | 9 | 0.0002 | 32008 |
| HPV16 | E6 | HDIILECVYCK | 31 | 11 | | 32009 |
| HPV16 | E6 | HLDKKQRF | 125 | 8 | | 32010 |
| HPV16 | E6 | HLDKKQRFH | 125 | 9 | 0.0009 | 32011 |
| HPV16 | E6 | IILECVYCK | 33 | 9 | 0.0016 | 32012 |
| HPV16 | E6 | ILECVYCK | 34 | 8 | | 32013 |
| HPV16 | E6 | ISEYRHYCY | 80 | 9 | 0.0001 | 32014 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E6 | IVYRDGNPY | 59 | 9 | 0.1500 | 32015 |
| HPV16 | E6 | IVYRDGNPYA | 59 | 10 | | 32016 |
| HPV16 | E6 | KCLKFYSK | 72 | 8 | | 32017 |
| HPV16 | E6 | KFYSKISEY | 75 | 9 | 0.0015 | 32018 |
| HPV16 | E6 | KFYSKISEYR | 75 | 10 | 0.0067 | 32019 |
| HPV16 | E6 | KFYSKISEYRH | 75 | 11 | | 32020 |
| HPV16 | E6 | KISEYRHY | 79 | 8 | | 32021 |
| HPV16 | E6 | KISEYRHYCY | 79 | 10 | 0.0043 | 32022 |
| HPV16 | E6 | LCIVYRDGNPY | 57 | 11 | | 32023 |
| HPV16 | E6 | LCPEEKQR | 117 | 8 | | 32024 |
| HPV16 | E6 | LCPEEKQRH | 117 | 9 | 0.0003 | 32025 |
| HPV16 | E6 | LCTELQTTIH | 22 | 10 | | 32026 |
| HPV16 | E6 | LDKKQRFH | 126 | 8 | | 32027 |
| HPV16 | E6 | LDKKQRFHNIR | 126 | 11 | | 32028 |
| HPV16 | E6 | LIRCINCQK | 107 | 9 | 0.0025 | 32029 |
| HPV16 | E6 | LLIRCINCQK | 106 | 10 | 0.0210 | 32030 |
| HPV16 | E6 | LLRREVYDF | 44 | 9 | | 32031 |
| HPV16 | E6 | LLRREVYDFA | 44 | 10 | | 32032 |
| HPV16 | E6 | LLRREVYDFAF | 44 | 11 | | 32033 |
| HPV16 | E6 | MFQDPQER | 8 | 8 | | 32034 |
| HPV16 | E6 | MFQDPQERPR | 8 | 10 | | 32035 |
| HPV16 | E6 | MFQDPQERPRK | 8 | 11 | | 32036 |
| HPV16 | E6 | MSCCRSSR | 144 | 8 | | 32037 |
| HPV16 | E6 | MSCCRSSRTR | 144 | 10 | | 32038 |
| HPV16 | E6 | MSCCRSSRTRR | 144 | 11 | | 32039 |
| HPV16 | E6 | NCQKPLCPEEK | 112 | 11 | | 32040 |
| HPV16 | E6 | NIRGRWTGR | 134 | 9 | 0.0014 | 32041 |
| HPV16 | E6 | PLCDLLIR | 102 | 8 | | 32042 |
| HPV16 | E6 | PLCPEEKQR | 116 | 9 | 0.0002 | 32043 |
| HPV16 | E6 | PLCPEEKQRH | 116 | 10 | | 32044 |
| HPV16 | E6 | QDPQERPR | 10 | 8 | | 32045 |
| HPV16 | E6 | QDPQERPRK | 10 | 9 | | 32046 |
| HPV16 | E6 | QLCTELQTTIH | 21 | 11 | | 32047 |
| HPV16 | E6 | QLLRREVY | 43 | 8 | | 32048 |
| HPV16 | E6 | QLLRREVYDF | 43 | 10 | | 32049 |
| HPV16 | E6 | QLLRREVYDFA | 43 | 11 | | 32050 |
| HPV16 | E6 | RCMSCCRSSR | 142 | 10 | | 32051 |
| HPV16 | E6 | RDGNPYAVCDK | 62 | 11 | | 32052 |
| HPV16 | E6 | RDLCIVYR | 55 | 8 | | 32053 |
| HPV16 | E6 | RFHNIRGR | 131 | 8 | | 32054 |
| HPV16 | E6 | RTAMFQDPQER | 5 | 11 | | 32055 |
| HPV16 | E6 | SCCRSSRTR | 145 | 9 | 0.0003 | 32056 |
| HPV16 | E6 | SCCRSSRTRR | 145 | 10 | | 32057 |
| HPV16 | E6 | SLYGTTLEQQY | 89 | 11 | | 32058 |
| HPV16 | E6 | TAMFQDPQER | 6 | 10 | | 32059 |
| HPV16 | E6 | TGRCMSCCR | 140 | 9 | 0.0003 | 32060 |
| HPV16 | E6 | TIHDIILECVY | 29 | 11 | | 32061 |
| HPV16 | E6 | TLEQQYNK | 94 | 8 | | 32062 |
| HPV16 | E6 | TTLEQQYNK | 93 | 9 | 0.0100 | 32063 |
| HPV16 | E6 | VCDKCLKF | 69 | 8 | | 32064 |
| HPV16 | E6 | VCDKCLKFY | 69 | 9 | 0.0002 | 32065 |
| HPV16 | E6 | VCDKCLKFYSK | 69 | 11 | | 32066 |
| HPV16 | E6 | WTGRCMSCCR | 139 | 10 | 0.0003 | 32067 |
| HPV16 | E6 | YAVCDKCLK | 67 | 9 | 0.0003 | 32068 |
| HPV16 | E6 | YAVCDKCLKF | 67 | 10 | | 32069 |
| HPV16 | E6 | YAVCDKCLKFY | 67 | 11 | | 32070 |
| HPV16 | E6 | YCKQQLLR | 39 | 8 | | 32071 |
| HPV16 | E6 | YCKQQLLRR | 39 | 9 | 0.0003 | 32072 |
| HPV16 | E6 | YGTTLEQQY | 91 | 9 | | 32073 |
| HPV16 | E6 | YGTTLEQQYNK | 91 | 11 | | 32074 |
| HPV16 | E6 | YSKISEYR | 77 | 8 | | 32075 |
| HPV16 | E6 | YSKISEYRH | 77 | 9 | | 32076 |
| HPV16 | E6 | YSKISEYRHY | 77 | 10 | 0.0001 | 32077 |
| HPV16 | E7 | AGQAEPDR | 42 | 8 | | 32078 |
| HPV16 | E7 | AGQAEPDRA | 42 | 9 | | 32079 |
| HPV16 | E7 | AGQAEPDRAH | 42 | 10 | | 32080 |
| HPV16 | E7 | AGQAEPDRAHY | 42 | 11 | | 32081 |
| HPV16 | E7 | CCKCDSTLR | 58 | 9 | 0.0003 | 32082 |
| HPV16 | E7 | CVQSTHVDIR | 68 | 10 | 0.0049 | 32083 |
| HPV16 | E7 | DGPAGQAEPDR | 39 | 11 | | 32084 |
| HPV16 | E7 | DLQPETTDLY | 14 | 10 | 0.0002 | 32085 |
| HPV16 | E7 | DTPTLHEY | 4 | 8 | | 32086 |
| HPV16 | E7 | EDEIDGPA | 35 | 8 | | 32087 |
| HPV16 | E7 | EDEIDGPAGQA | 35 | 11 | | 32088 |
| HPV16 | E7 | EIDGPAGQA | 37 | 9 | | 32089 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | E7 | ETTDLYCY | 18 | 8 | 0.0002 | 32090 |
| HPV16 | E7 | FCCKCDSTLR | 57 | 10 | | 32091 |
| HPV16 | E7 | GDTPTLHEY | 3 | 9 | | 32092 |
| HPV16 | E7 | GIVCPICSQK | 88 | 10 | 0.0003 | 32093 |
| HPV16 | E7 | HGDTPTLH | 2 | 8 | | 32094 |
| HPV16 | E7 | HGDTPTLHEY | 2 | 10 | 0.0001 | 32095 |
| HPV16 | E7 | IDGPAGQA | 38 | 8 | | 32096 |
| HPV16 | E7 | IVCPICSQK | 89 | 9 | 0.0077 | 32097 |
| HPV16 | E7 | LCVQSTHVDIR | 67 | 11 | | 32098 |
| HPV16 | E7 | LDLQPETTDLY | 13 | 11 | | 32099 |
| HPV16 | E7 | LGIVCPICSQK | 87 | 11 | | 32100 |
| HPV16 | E7 | NIVTFCCK | 53 | 8 | | 32101 |
| HPV16 | E7 | PAGQAEPDR | 41 | 9 | | 32102 |
| HPV16 | E7 | PAGQAEPDRA | 41 | 10 | | 32103 |
| HPV16 | E7 | PAGQAEPDRAH | 41 | 11 | | 32104 |
| HPV16 | E7 | PDRAHYNIVTF | 47 | 11 | | 32105 |
| HPV16 | E7 | QAEPDRAH | 44 | 8 | | 32106 |
| HPV16 | E7 | QAEPDRAHY | 44 | 9 | 0.0002 | 32107 |
| HPV16 | E7 | QSTHVDIR | 70 | 8 | | 32108 |
| HPV16 | E7 | RAHYNIVTF | 49 | 9 | | 32109 |
| HPV16 | E7 | RLCVQSTH | 66 | 8 | | 32110 |
| HPV16 | E7 | STLRLCVQSTH | 63 | 11 | | 32111 |
| HPV16 | E7 | TFCCKCDSTLR | 56 | 11 | | 32112 |
| HPV16 | E7 | TLRLCVQSTH | 64 | 10 | | 32113 |
| HPV16 | E7 | VCPICSQK | 90 | 8 | | 32114 |
| HPV16 | L1 | AAISTSETTY | 372 | 10 | | 32115 |
| HPV16 | L1 | AAISTSETTYK | 372 | 11 | | 32116 |
| HPV16 | L1 | AANAGVDNR | 162 | 9 | | 32117 |
| HPV16 | L1 | ACQKHTPPA | 453 | 9 | | 32118 |
| HPV16 | L1 | ACQKHTPPAPK | 453 | 11 | | 32119 |
| HPV16 | L1 | ACVGVEVGR | 127 | 9 | | 32120 |
| HPV16 | L1 | ADLDQFPLGR | 483 | 10 | | 32121 |
| HPV16 | L1 | ADLDQFPLGRK | 483 | 11 | | 32122 |
| HPV16 | L1 | ADVMTYIH | 411 | 8 | | 32123 |
| HPV16 | L1 | AGLKAKPK | 498 | 8 | | 32124 |
| HPV16 | L1 | AGLKAKPKF | 498 | 9 | | 32125 |
| HPV16 | L1 | AGTSRLLA | 63 | 8 | | 32126 |
| HPV16 | L1 | AGTSRLLAVGH | 63 | 11 | | 32127 |
| HPV16 | L1 | AIACQKHTPPA | 451 | 11 | | 32128 |
| HPV16 | L1 | AISTSETTY | 373 | 9 | | 32129 |
| HPV16 | L1 | AISTSETTYK | 373 | 10 | | 32130 |
| HPV16 | L1 | AMDFTTLQA | 233 | 9 | | 32131 |
| HPV16 | L1 | AMDFTTLQANK | 233 | 11 | | 32132 |
| HPV16 | L1 | ASAYAANA | 158 | 8 | | 32133 |
| HPV16 | L1 | AVGENVPDDLY | 292 | 11 | | 32134 |
| HPV16 | L1 | AVGHPYFPIK | 70 | 10 | | 32135 |
| HPV16 | L1 | AVGHPYFPIKK | 70 | 11 | | 32136 |
| HPV16 | L1 | CAAISTSETTY | 371 | 11 | | 32137 |
| HPV16 | L1 | CTSICKYPDY | 251 | 10 | | 32138 |
| HPV16 | L1 | CVGVEVGR | 128 | 8 | | 32139 |
| HPV16 | L1 | DAQIFNKPY | 329 | 9 | | 32140 |
| HPV16 | L1 | DDTENASA | 153 | 8 | | 32141 |
| HPV16 | L1 | DDTENASAY | 153 | 9 | | 32142 |
| HPV16 | L1 | DDTENASAYA | 153 | 10 | | 32143 |
| HPV16 | L1 | DDTENASAYAA | 153 | 11 | | 32144 |
| HPV16 | L1 | DFTTLQANK | 235 | 9 | | 32145 |
| HPV16 | L1 | DGDMVDTGF | 223 | 9 | | 32146 |
| HPV16 | L1 | DGDMVDTGFGA | 223 | 11 | | 32147 |
| HPV16 | L1 | DICTSICK | 249 | 8 | | 32148 |
| HPV16 | L1 | DICTSICKY | 249 | 9 | | 32149 |
| HPV16 | L1 | DLDQFPLGR | 484 | 9 | | 32150 |
| HPV16 | L1 | DLDQFPLGRK | 484 | 10 | | 32151 |
| HPV16 | L1 | DLDQFPLGRKF | 484 | 11 | | 32152 |
| HPV16 | L1 | DLQFIFQLCK | 397 | 10 | | 32153 |
| HPV16 | L1 | DLYIKGSGSTA | 300 | 11 | | 32154 |
| HPV16 | L1 | DMVDTGFGA | 225 | 9 | | 32155 |
| HPV16 | L1 | DSLFFYLR | 270 | 8 | | 32156 |
| HPV16 | L1 | DSLFFYLRR | 270 | 9 | | 32157 |
| HPV16 | L1 | DTENASAY | 154 | 8 | | 32158 |
| HPV16 | L1 | DTENASAYA | 154 | 9 | | 32159 |
| HPV16 | L1 | DTENASAYAA | 154 | 10 | | 32160 |
| HPV16 | L1 | DTGFGAMDF | 228 | 9 | | 32161 |
| HPV16 | L1 | DTQRLVWA | 120 | 8 | | 32162 |
| HPV16 | L1 | DTSFYNPDTQR | 113 | 11 | | 32163 |
| HPV16 | L1 | DTYRFVTSQA | 442 | 10 | | 32164 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | L1 | DVNVYHIF | 17 | 8 | | 32165 |
| HPV16 | L1 | DVNVYHIFF | 17 | 9 | | 32166 |
| HPV16 | L1 | ECISMDYK | 171 | 8 | | 32167 |
| HPV16 | L1 | EDPLKKYTF | 464 | 9 | | 32168 |
| HPV16 | L1 | EDTYRFVTSQA | 441 | 11 | | 32169 |
| HPV16 | L1 | ETTYKNTNF | 378 | 9 | | 32170 |
| HPV16 | L1 | ETTYKNTNFK | 378 | 10 | | 32171 |
| HPV16 | L1 | EVNLKEKF | 474 | 8 | | 32172 |
| HPV16 | L1 | EVNLKEKFSA | 474 | 10 | | 32173 |
| HPV16 | L1 | FFYLRREQMF | 273 | 10 | | 32174 |
| HPV16 | L1 | FGAMDFTTLQA | 231 | 11 | | 32175 |
| HPV16 | L1 | FGFPDTSF | 109 | 8 | | 32176 |
| HPV16 | L1 | FGFPDTSFY | 109 | 9 | | 32177 |
| HPV16 | L1 | FIYILVITCY | 5 | 10 | | 32178 |
| HPV16 | L1 | FLLQAGLK | 494 | 8 | | 32179 |
| HPV16 | L1 | FLLQAGLKA | 494 | 9 | | 32180 |
| HPV16 | L1 | FLLQAGLKAK | 494 | 10 | | 32181 |
| HPV16 | L1 | FSADLDQF | 481 | 8 | | 32182 |
| HPV16 | L1 | FTLGKRKA | 506 | 8 | | 32183 |
| HPV16 | L1 | FTTLQANK | 236 | 8 | | 32184 |
| HPV16 | L1 | FVRHLFNR | 282 | 8 | | 32185 |
| HPV16 | L1 | FVRHLFNRA | 282 | 9 | | 32186 |
| HPV16 | L1 | FVRHLFNRAGA | 282 | 11 | | 32187 |
| HPV16 | L1 | FVTSQAIA | 446 | 8 | | 32188 |
| HPV16 | L1 | FVTSQAIACQK | 446 | 11 | | 32189 |
| HPV16 | L1 | FVTVVDTTR | 356 | 9 | | 32190 |
| HPV16 | L1 | GAMDFTTLQA | 232 | 10 | | 32191 |
| HPV16 | L1 | GCKPPIGEH | 186 | 9 | | 32192 |
| HPV16 | L1 | GDMVDTGF | 224 | 8 | | 32193 |
| HPV16 | L1 | GDMVDTGFGA | 224 | 10 | | 32194 |
| HPV16 | L1 | GDSLFFYLR | 269 | 9 | | 32195 |
| HPV16 | L1 | GDSLFFYLRR | 269 | 10 | | 32196 |
| HPV16 | L1 | GFPDTSFY | 110 | 8 | | 32197 |
| HPV16 | L1 | GGTLEDTY | 437 | 8 | | 32198 |
| HPV16 | L1 | GGTLEDTYR | 437 | 9 | | 32199 |
| HPV16 | L1 | GGTLEDTYRF | 437 | 10 | | 32200 |
| HPV16 | L1 | GICWGNQLF | 348 | 9 | | 32201 |
| HPV16 | L1 | GISGHPLLNK | 142 | 10 | | 32202 |
| HPV16 | L1 | GLKAKPKF | 499 | 8 | | 32203 |
| HPV16 | L1 | GLQYRVFR | 93 | 8 | | 32204 |
| HPV16 | L1 | GLQYRVFRIH | 93 | 10 | | 32205 |
| HPV16 | L1 | GSGSTANLA | 305 | 9 | | 32206 |
| HPV16 | L1 | GSMVTSDA | 323 | 8 | | 32207 |
| HPV16 | L1 | GSMVTSDAQIF | 323 | 11 | | 32208 |
| HPV16 | L1 | GSPCTNVA | 198 | 8 | | 32209 |
| HPV16 | L1 | GSTANLASSNY | 307 | 11 | | 32210 |
| HPV16 | L1 | GTLEDTYR | 438 | 8 | | 32211 |
| HPV16 | L1 | GTLEDTYRF | 438 | 9 | | 32212 |
| HPV16 | L1 | GTSRLLAVGH | 64 | 10 | | 32213 |
| HPV16 | L1 | HAGTSRLLA | 62 | 9 | | 32214 |
| HPV16 | L1 | HGEEYDLQF | 392 | 9 | | 32215 |
| HPV16 | L1 | HGEEYDLQFIF | 392 | 11 | | 32216 |
| HPV16 | L1 | HLFNRAGA | 285 | 8 | | 32217 |
| HPV16 | L1 | HLPDPNKF | 102 | 8 | | 32218 |
| HPV16 | L1 | HLPDPNKFGF | 102 | 10 | | 32219 |
| HPV16 | L1 | IACQKHTPPA | 452 | 10 | | 32220 |
| HPV16 | L1 | ICKYPDYIK | 254 | 9 | | 32221 |
| HPV16 | L1 | ICTSICKY | 250 | 8 | | 32222 |
| HPV16 | L1 | ICTSICKYPDY | 250 | 11 | | 32223 |
| HPV16 | L1 | ICWGNQLF | 349 | 8 | | 32224 |
| HPV16 | L1 | IFNKPYWLQR | 332 | 10 | | 32225 |
| HPV16 | L1 | IFNKPYWLQRA | 332 | 11 | | 32226 |
| HPV16 | L1 | IFQLCKITLTA | 401 | 11 | | 32227 |
| HPV16 | L1 | IGCKPPIGEH | 185 | 10 | | 32228 |
| HPV16 | L1 | ILVPKVSGLQY | 86 | 11 | | 32229 |
| HPV16 | L1 | ISGHPLLNK | 143 | 9 | | 32230 |
| HPV16 | L1 | ISTSETTY | 374 | 8 | | 32231 |
| HPV16 | L1 | ISTSETTYK | 374 | 9 | | 32232 |
| HPV16 | L1 | ITCYENDVNVY | 11 | 11 | | 32233 |
| HPV16 | L1 | ITLTADVMTY | 407 | 10 | | 32234 |
| HPV16 | L1 | KAKPKFTLGK | 501 | 10 | | 32235 |
| HPV16 | L1 | KAKPKFTLGKR | 501 | 11 | | 32236 |
| HPV16 | L1 | KFGFPDTSF | 108 | 9 | | 32237 |
| HPV16 | L1 | KFGFPDTSFY | 108 | 10 | | 32238 |
| HPV16 | L1 | KFLLQAGLK | 493 | 9 | | 32239 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | L1 | KFLLQAGLKA | 493 | 10 | | 32240 |
| HPV16 | L1 | KFLLQAGLKAK | 493 | 11 | | 32241 |
| HPV16 | L1 | KFSADLDQF | 480 | 9 | | 32242 |
| HPV16 | L1 | KFTLGKRK | 505 | 8 | | 32243 |
| HPV16 | L1 | KFTLGKRKA | 505 | 9 | | 32244 |
| HPV16 | L1 | KGSGSTANLA | 304 | 10 | | 32245 |
| HPV16 | L1 | KGSPCTNVA | 197 | 9 | | 32246 |
| HPV16 | L1 | KITLTADVMTY | 406 | 11 | | 32247 |
| HPV16 | L1 | KLDDTENA | 151 | 8 | | 32248 |
| HPV16 | L1 | KLDDTENASA | 151 | 10 | | 32249 |
| HPV16 | L1 | KLDDTENASAY | 151 | 11 | | 32250 |
| HPV16 | L1 | KVSGLQYR | 90 | 8 | | 32251 |
| HPV16 | L1 | KVSGLQYRVF | 90 | 10 | | 32252 |
| HPV16 | L1 | KVSGLQYRVFR | 90 | 11 | | 32253 |
| HPV16 | L1 | KVVSTDEY | 46 | 8 | | 32254 |
| HPV16 | L1 | KVVSTDEYVA | 46 | 10 | | 32255 |
| HPV16 | L1 | KVVSTDEYVAR | 46 | 11 | | 32256 |
| HPV16 | L1 | LAVGHPYF | 69 | 8 | | 32257 |
| HPV16 | L1 | LAVGHPYFPIK | 69 | 11 | | 32258 |
| HPV16 | L1 | LCKITLTA | 404 | 8 | | 32259 |
| HPV16 | L1 | LDDTENASA | 152 | 9 | | 32260 |
| HPV16 | L1 | LDDTENASAY | 152 | 10 | | 32261 |
| HPV16 | L1 | LDDTENASAYA | 152 | 11 | | 32262 |
| HPV16 | L1 | LDICTSICK | 248 | 9 | | 32263 |
| HPV16 | L1 | LDICTSICKY | 248 | 10 | | 32264 |
| HPV16 | L1 | LDQFPLGR | 485 | 8 | | 32265 |
| HPV16 | L1 | LDQFPLGRK | 485 | 9 | | 32266 |
| HPV16 | L1 | LDQFPLGRKF | 485 | 10 | | 32267 |
| HPV16 | L1 | LFFYLRREQMF | 272 | 11 | | 32268 |
| HPV16 | L1 | LFVTVVDTTR | 355 | 10 | | 32269 |
| HPV16 | L1 | LGRKFLLQA | 490 | 9 | | 32270 |
| HPV16 | L1 | LGVGISGH | 139 | 8 | | 32271 |
| HPV16 | L1 | LIGCKPPIGEH | 184 | 11 | | 32272 |
| HPV16 | L1 | LLAVGHPY | 68 | 8 | | 32273 |
| HPV16 | L1 | LLAVGHPYF | 68 | 9 | | 32274 |
| HPV16 | L1 | LLNKLDDTENA | 148 | 11 | | 32275 |
| HPV16 | L1 | LLQAGLKA | 495 | 8 | | 32276 |
| HPV16 | L1 | LLQAGLKAK | 495 | 9 | | 32277 |
| HPV16 | L1 | LLQAGLKAKPK | 495 | 11 | | 32278 |
| HPV16 | L1 | LTADVMTY | 409 | 8 | | 32279 |
| HPV16 | L1 | LTADVMTYIH | 409 | 10 | | 32280 |
| HPV16 | L1 | LVPKVSGLQY | 87 | 10 | | 32281 |
| HPV16 | L1 | LVPKVSGLQYR | 87 | 11 | | 32282 |
| HPV16 | L1 | MDFTTLQA | 234 | 8 | | 32283 |
| HPV16 | L1 | MDFTTLQANK | 234 | 10 | | 32284 |
| HPV16 | L1 | MFVRHLFNR | 281 | 9 | | 32285 |
| HPV16 | L1 | MFVRHLFNRA | 281 | 10 | | 32286 |
| HPV16 | L1 | MSLWLPSEA | 27 | 9 | | 32287 |
| HPV16 | L1 | MVDTGFGA | 226 | 8 | | 32288 |
| HPV16 | L1 | MVDTGFGAMDF | 226 | 11 | | 32289 |
| HPV16 | L1 | MVSEPYGDSLF | 263 | 11 | | 32290 |
| HPV16 | L1 | MVTSDAQIF | 325 | 9 | | 32291 |
| HPV16 | L1 | MVTSDAQIFNK | 325 | 11 | | 32292 |
| HPV16 | L1 | NASAYAANA | 157 | 9 | | 32293 |
| HPV16 | L1 | NDVNVYHIF | 16 | 9 | | 32294 |
| HPV16 | L1 | NDVNVYHIFF | 16 | 10 | | 32295 |
| HPV16 | L1 | NFKEYLRH | 385 | 8 | | 32296 |
| HPV16 | L1 | NGICWGNQLF | 347 | 10 | | 32297 |
| HPV16 | L1 | NIYYHAGTSR | 58 | 10 | | 32298 |
| HPV16 | L1 | NLASSNYF | 311 | 8 | | 32299 |
| HPV16 | L1 | NLKEKFSA | 476 | 8 | | 32300 |
| HPV16 | L1 | NSTILEDWNF | 421 | 10 | | 32301 |
| HPV16 | L1 | NTNFKEYLR | 383 | 9 | | 32302 |
| HPV16 | L1 | NTNFKEYLRH | 383 | 10 | | 32303 |
| HPV16 | L1 | NVPDDLYIK | 296 | 9 | | 32304 |
| HPV16 | L1 | PAPKEDPLK | 460 | 9 | | 32305 |
| HPV16 | L1 | PAPKEDPLKK | 460 | 10 | | 32306 |
| HPV16 | L1 | PAPKEDPLKKY | 460 | 11 | | 32307 |
| HPV16 | L1 | PDPNKFGF | 104 | 8 | | 32308 |
| HPV16 | L1 | PDTQRLVWA | 119 | 9 | | 32309 |
| HPV16 | L1 | PDYIKMVSEPY | 258 | 11 | | 32310 |
| HPV16 | L1 | PGGTLEDTY | 436 | 9 | | 32311 |
| HPV16 | L1 | PGGTLEDTYR | 436 | 10 | | 32312 |
| HPV16 | L1 | PGGTLEDTYRF | 436 | 11 | | 32313 |
| HPV16 | L1 | PIGEHWGK | 190 | 8 | | 32314 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | L1 | PIKKPNNNK | 77 | 9 | | 32315 |
| HPV16 | L1 | PLDICTSICK | 247 | 10 | | 32316 |
| HPV16 | L1 | PLDICTSICKY | 247 | 11 | | 32317 |
| HPV16 | L1 | PLGRKFLLQA | 489 | 10 | | 32318 |
| HPV16 | L1 | PLGVGISGH | 138 | 9 | | 32319 |
| HPV16 | L1 | PSGSMVTSDA | 321 | 10 | | 32320 |
| HPV16 | L1 | PTTSSTSTTA | 515 | 10 | | 32321 |
| HPV16 | L1 | PTTSSTSTTAK | 515 | 11 | | 32322 |
| HPV16 | L1 | PVSKVVSTDEY | 43 | 11 | | 32323 |
| HPV16 | L1 | QAGLKAKPK | 497 | 9 | | 32324 |
| HPV16 | L1 | QAGLKAKPKF | 497 | 10 | | 32325 |
| HPV16 | L1 | QAIACQKH | 450 | 8 | | 32326 |
| HPV16 | L1 | QDGDMVDTGF | 222 | 10 | | 32327 |
| HPV16 | L1 | QFIFQLCK | 399 | 8 | | 32328 |
| HPV16 | L1 | QFPLGRKF | 487 | 8 | | 32329 |
| HPV16 | L1 | QIFNKPYWLQR | 331 | 11 | | 32330 |
| HPV16 | L1 | QLCKITLTA | 403 | 9 | | 32331 |
| HPV16 | L1 | QLCLIGCK | 181 | 8 | | 32332 |
| HPV16 | L1 | QLFVTVVDTTR | 354 | 11 | | 32333 |
| HPV16 | L1 | QMFVRHLF | 280 | 8 | | 32334 |
| HPV16 | L1 | QMFVRHLFNR | 280 | 10 | | 32335 |
| HPV16 | L1 | QMFVRHLFNRA | 280 | 11 | | 32336 |
| HPV16 | L1 | QMSLWLPSEA | 26 | 10 | | 32337 |
| HPV16 | L1 | QTQLCLIGCK | 179 | 10 | | 32338 |
| HPV16 | L1 | RFVTSQAIA | 445 | 9 | | 32339 |
| HPV16 | L1 | RIHLPDPNK | 100 | 9 | | 32340 |
| HPV16 | L1 | RIHLPDPNKF | 100 | 10 | | 32341 |
| HPV16 | L1 | RLLAVGHPY | 67 | 9 | | 32342 |
| HPV16 | L1 | RLLAVGHPYF | 67 | 10 | | 32343 |
| HPV16 | L1 | RSTNMSLCA | 364 | 9 | | 32344 |
| HPV16 | L1 | RSTNMSLCAA | 364 | 10 | | 32345 |
| HPV16 | L1 | RTNIYYHA | 56 | 8 | | 32346 |
| HPV16 | L1 | SADLDQFPLGR | 482 | 11 | | 32347 |
| HPV16 | L1 | SDAQIFNK | 328 | 8 | | 32348 |
| HPV16 | L1 | SDAQIFNKPY | 328 | 10 | | 32349 |
| HPV16 | L1 | SFYNPDTQR | 115 | 9 | | 32350 |
| HPV16 | L1 | SGHPLLNK | 144 | 8 | | 32351 |
| HPV16 | L1 | SGLQYRVF | 92 | 8 | | 32352 |
| HPV16 | L1 | SGLQYRVFR | 92 | 9 | | 32353 |
| HPV16 | L1 | SGLQYRVFRIH | 92 | 11 | | 32354 |
| HPV16 | L1 | SGSMVTSDA | 322 | 9 | | 32355 |
| HPV16 | L1 | SGSTANLA | 306 | 8 | | 32356 |
| HPV16 | L1 | SICKYPDY | 253 | 8 | | 32357 |
| HPV16 | L1 | SICKYPDYIK | 253 | 10 | | 32358 |
| HPV16 | L1 | SLFFYLRR | 271 | 8 | | 32359 |
| HPV16 | L1 | SLWLPSEA | 28 | 8 | | 32360 |
| HPV16 | L1 | SLWLPSEATVY | 28 | 11 | | 32361 |
| HPV16 | L1 | SMVTSDAQIF | 324 | 10 | | 32362 |
| HPV16 | L1 | SSTSTTAK | 518 | 8 | | 32363 |
| HPV16 | L1 | SSTSTTAKR | 518 | 9 | | 32364 |
| HPV16 | L1 | SSTSTTAKRK | 518 | 10 | | 32365 |
| HPV16 | L1 | SSTSTTAKRKK | 518 | 11 | | 32366 |
| HPV16 | L1 | STANLASSNY | 308 | 10 | | 32367 |
| HPV16 | L1 | STANLASSNYF | 308 | 11 | | 32368 |
| HPV16 | L1 | STDEYVAR | 49 | 8 | | 32369 |
| HPV16 | L1 | STILEDWNF | 422 | 9 | | 32370 |
| HPV16 | L1 | STNMSLCA | 365 | 8 | | 32371 |
| HPV16 | L1 | STNMSLCAA | 365 | 9 | | 32372 |
| HPV16 | L1 | STSETTYK | 375 | 8 | | 32373 |
| HPV16 | L1 | STSTTAKR | 519 | 8 | | 32374 |
| HPV16 | L1 | STSTTAKRK | 519 | 9 | | 32375 |
| HPV16 | L1 | STSTTAKRKK | 519 | 10 | | 32376 |
| HPV16 | L1 | STSTTAKRKKR | 519 | 11 | | 32377 |
| HPV16 | L1 | STTAKRKK | 521 | 8 | | 32378 |
| HPV16 | L1 | STTAKRKKR | 521 | 9 | | 32379 |
| HPV16 | L1 | STTAKRKKRK | 521 | 10 | | 32380 |
| HPV16 | L1 | TADVMTYIH | 410 | 9 | | 32381 |
| HPV16 | L1 | TAKRKKRK | 523 | 8 | | 32382 |
| HPV16 | L1 | TANLASSNY | 309 | 9 | | 32383 |
| HPV16 | L1 | TANLASSNYF | 309 | 10 | | 32384 |
| HPV16 | L1 | TCYENDVNVY | 12 | 10 | | 32385 |
| HPV16 | L1 | TCYENDVNVYH | 12 | 11 | | 32386 |
| HPV16 | L1 | TDEYVARTNIY | 50 | 11 | | 32387 |
| HPV16 | L1 | TFIYILVITCY | 4 | 11 | | 32388 |
| HPV16 | L1 | TFWEVNLK | 471 | 8 | | 32389 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | L1 | TFWEVNLKEK | 471 | 10 | | 32390 |
| HPV16 | L1 | TFWEVNLKEKF | 471 | 11 | | 32391 |
| HPV16 | L1 | TGFGAMDF | 229 | 8 | | 32392 |
| HPV16 | L1 | TILEDWNF | 423 | 8 | | 32393 |
| HPV16 | L1 | TLEDTYRF | 439 | 8 | | 32394 |
| HPV16 | L1 | TLTADVMTY | 408 | 9 | | 32395 |
| HPV16 | L1 | TLTADVMTYIH | 408 | 11 | | 32396 |
| HPV16 | L1 | TSDAQIFNK | 327 | 9 | | 32397 |
| HPV16 | L1 | TSDAQIFNKPY | 327 | 11 | | 32398 |
| HPV16 | L1 | TSETTYKNTNF | 376 | 11 | | 32399 |
| HPV16 | L1 | TSFYNPDTQR | 114 | 10 | | 32400 |
| HPV16 | L1 | TSICKYPDY | 252 | 9 | | 32401 |
| HPV16 | L1 | TSICKYPDYIK | 252 | 11 | | 32402 |
| HPV16 | L1 | TSQAIACQK | 448 | 9 | | 32403 |
| HPV16 | L1 | TSQAIACQKH | 448 | 10 | | 32404 |
| HPV16 | L1 | TSRLLAVGH | 65 | 9 | | 32405 |
| HPV16 | L1 | TSRLLAVGHPY | 65 | 11 | | 32406 |
| HPV16 | L1 | TSSTSTTA | 517 | 8 | | 32407 |
| HPV16 | L1 | TSSTSTTAK | 517 | 9 | | 32408 |
| HPV16 | L1 | TSSTSTTAKR | 517 | 10 | | 32409 |
| HPV16 | L1 | TSSTSTTAKRK | 517 | 11 | | 32410 |
| HPV16 | L1 | TSTTAKRK | 520 | 8 | | 32411 |
| HPV16 | L1 | TSTTAKRKK | 520 | 9 | | 32412 |
| HPV16 | L1 | TSTTAKRKKR | 520 | 10 | | 32413 |
| HPV16 | L1 | TSTTAKRKKRK | 520 | 11 | | 32414 |
| HPV16 | L1 | TTAKRKKR | 522 | 8 | | 32415 |
| HPV16 | L1 | TTAKRKKRK | 522 | 9 | | 32416 |
| HPV16 | L1 | TTRSTNMSLCA | 362 | 11 | | 32417 |
| HPV16 | L1 | TTSSTSTTA | 516 | 9 | | 32418 |
| HPV16 | L1 | TTSSTSTTAK | 516 | 10 | | 32419 |
| HPV16 | L1 | TTSSTSTTAKR | 516 | 11 | | 32420 |
| HPV16 | L1 | TTYKNTNF | 379 | 8 | | 32421 |
| HPV16 | L1 | TTYKNTNFK | 379 | 9 | | 32422 |
| HPV16 | L1 | TTYKNTNFKEY | 379 | 11 | | 32423 |
| HPV16 | L1 | TVYLPPVPVSK | 36 | 11 | | 32424 |
| HPV16 | L1 | VARTNIYY | 54 | 8 | | 32425 |
| HPV16 | L1 | VARTNIYYH | 54 | 9 | | 32426 |
| HPV16 | L1 | VARTNIYYHA | 54 | 10 | | 32427 |
| HPV16 | L1 | VDNRECISMDY | 167 | 11 | | 32428 |
| HPV16 | L1 | VDTGFGAMDF | 227 | 10 | | 32429 |
| HPV16 | L1 | VFRIHLPDPNK | 98 | 11 | | 32430 |
| HPV16 | L1 | VGENVPDDLY | 293 | 10 | | 32431 |
| HPV16 | L1 | VGHPYFPIK | 71 | 9 | | 32432 |
| HPV16 | L1 | VGHPYFPIKK | 71 | 10 | | 32433 |
| HPV16 | L1 | VGISGHPLLNK | 141 | 11 | | 32434 |
| HPV16 | L1 | VSEPYGDSLF | 264 | 10 | | 32435 |
| HPV16 | L1 | VSEPYGDSLFF | 264 | 11 | | 32436 |
| HPV16 | L1 | VSGLQYRVF | 91 | 9 | | 32437 |
| HPV16 | L1 | VSGLQYRVFR | 91 | 10 | | 32438 |
| HPV16 | L1 | VSKVVSTDEY | 44 | 10 | | 32439 |
| HPV16 | L1 | VSTDEYVA | 48 | 8 | | 32440 |
| HPV16 | L1 | VSTDEYVAR | 48 | 9 | | 32441 |
| HPV16 | L1 | VTSDAQIF | 326 | 8 | | 32442 |
| HPV16 | L1 | VTSDAQIFNK | 326 | 10 | | 32443 |
| HPV16 | L1 | VTSQAIACQK | 447 | 10 | | 32444 |
| HPV16 | L1 | VTSQAIACQKH | 447 | 11 | | 32445 |
| HPV16 | L1 | VTVVDTTR | 357 | 8 | | 32446 |
| HPV16 | L1 | VVSTDEYVA | 47 | 9 | | 32447 |
| HPV16 | L1 | VVSTDEYVAR | 47 | 10 | | 32448 |
| HPV16 | L1 | WACVGVEVGR | 126 | 10 | | 32449 |
| HPV16 | L1 | WGKGSPCTNVA | 195 | 11 | | 32450 |
| HPV16 | L1 | WLPSEATVY | 30 | 9 | | 32451 |
| HPV16 | L1 | WLQRAQGH | 338 | 8 | | 32452 |
| HPV16 | L1 | YAANAGVDNR | 161 | 10 | | 32453 |
| HPV16 | L1 | YDLQFIFQLCK | 396 | 11 | | 32454 |
| HPV16 | L1 | YFPIKKPNNNK | 75 | 11 | | 32455 |
| HPV16 | L1 | YGDSLFFY | 268 | 8 | | 32456 |
| HPV16 | L1 | YGDSLFFYLR | 268 | 10 | | 32457 |
| HPV16 | L1 | YGDSLFFYLRR | 268 | 11 | | 32458 |
| HPV16 | L1 | YIKGSGSTA | 302 | 9 | | 32459 |
| HPV16 | L1 | YIKMVSEPY | 260 | 9 | | 32460 |
| HPV16 | L1 | YILVITCY | 7 | 8 | | 32461 |
| HPV16 | L1 | YLPPVPVSK | 38 | 9 | | 32462 |
| HPV16 | L1 | YLRHGEEY | 389 | 8 | | 32463 |
| HPV16 | L1 | YLRREQMF | 275 | 8 | | 32464 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | L1 | YLRREQMFVR | 275 | 10 | | 32465 |
| HPV16 | L1 | YLRREQMFVRH | 275 | 11 | | 32466 |
| HPV16 | L1 | YTFWEVNLK | 470 | 9 | | 32467 |
| HPV16 | L1 | YTFWEVNLKEK | 470 | 11 | | 32468 |
| HPV16 | L1 | YVARTNIY | 53 | 8 | | 32469 |
| HPV16 | L1 | YVARTNIYY | 53 | 9 | | 32470 |
| HPV16 | L1 | YVARTNIYYH | 53 | 10 | | 32471 |
| HPV16 | L1 | YVARTNIYYHA | 53 | 11 | | 32472 |
| HPV16 | L2 | ADAGDFYLH | 441 | 9 | | 32473 |
| HPV16 | L2 | AFITTPTK | 241 | 8 | | 32474 |
| HPV16 | L2 | AGDFYLHPSY | 443 | 10 | | 32475 |
| HPV16 | L2 | AGDFYLHPSYY | 443 | 11 | | 32476 |
| HPV16 | L2 | AGTCPPDIIPK | 25 | 11 | | 32477 |
| HPV16 | L2 | ALHRPALTSR | 288 | 10 | | 32478 |
| HPV16 | L2 | ALHRPALTSRR | 288 | 11 | | 32479 |
| HPV16 | L2 | ALPTSINNGLY | 356 | 11 | | 32480 |
| HPV16 | L2 | ALTSRRTGIR | 293 | 10 | | 32481 |
| HPV16 | L2 | ALTSRRTGIRY | 293 | 11 | | 32482 |
| HPV16 | L2 | ASATQLYK | 13 | 8 | | 32483 |
| HPV16 | L2 | ASATQLYKTCK | 13 | 11 | | 32484 |
| HPV16 | L2 | ATDTLAPVR | 82 | 9 | | 32485 |
| HPV16 | L2 | ATQLYKTCK | 15 | 9 | | 32486 |
| HPV16 | L2 | ATQLYKTCKQA | 15 | 11 | | 32487 |
| HPV16 | L2 | DAGDFYLH | 442 | 8 | | 32488 |
| HPV16 | L2 | DAGDFYLHPSY | 442 | 11 | | 32489 |
| HPV16 | L2 | DFLDIVALH | 282 | 9 | | 32490 |
| HPV16 | L2 | DFLDIVALHR | 282 | 10 | | 32491 |
| HPV16 | L2 | DFSTIDSA | 329 | 8 | | 32492 |
| HPV16 | L2 | DFYLHPSY | 445 | 8 | | 32493 |
| HPV16 | L2 | DFYLHPSYY | 445 | 9 | | 32494 |
| HPV16 | L2 | DIIPKVEGK | 31 | 9 | | 32495 |
| HPV16 | L2 | DIPINITDQA | 415 | 10 | | 32496 |
| HPV16 | L2 | DIVALHRPA | 285 | 9 | | 32497 |
| HPV16 | L2 | DVDNTLYF | 261 | 8 | | 32498 |
| HPV16 | L2 | EGIDVDNTLY | 258 | 10 | | 32499 |
| HPV16 | L2 | EGIDVDNTLYF | 258 | 11 | | 32500 |
| HPV16 | L2 | ELQTITPSTY | 340 | 10 | | 32501 |
| HPV16 | L2 | ETSFIDAGA | 111 | 9 | | 32502 |
| HPV16 | L2 | FFSDVSLA | 465 | 8 | | 32503 |
| HPV16 | L2 | FFSDVSLAA | 465 | 9 | | 32504 |
| HPV16 | L2 | FITTPTKLITY | 242 | 11 | | 32505 |
| HPV16 | L2 | FLDIVALH | 283 | 8 | | 32506 |
| HPV16 | L2 | FLDIVALHR | 283 | 9 | | 32507 |
| HPV16 | L2 | FLDIVALHRPA | 283 | 11 | | 32508 |
| HPV16 | L2 | FSDVSLAA | 466 | 8 | | 32509 |
| HPV16 | L2 | FSSNDNSINIA | 268 | 11 | | 32510 |
| HPV16 | L2 | FTLSSSTISTH | 181 | 11 | | 32511 |
| HPV16 | L2 | GAKVHYYY | 321 | 8 | | 32512 |
| HPV16 | L2 | GAKVHYYYDF | 321 | 10 | | 32513 |
| HPV16 | L2 | GDFYLHPSY | 444 | 9 | | 32514 |
| HPV16 | L2 | GDFYLHPSYY | 444 | 10 | | 32515 |
| HPV16 | L2 | GIDVDNTLY | 259 | 9 | | 32516 |
| HPV16 | L2 | GIDVDNTLYF | 259 | 10 | | 32517 |
| HPV16 | L2 | GIGTGSGTGGR | 59 | 11 | | 32518 |
| HPV16 | L2 | GIRYSRIGNK | 300 | 10 | | 32519 |
| HPV16 | L2 | GLYDIYADDF | 364 | 10 | | 32520 |
| HPV16 | L2 | GLYSRTTQQVK | 226 | 11 | | 32521 |
| HPV16 | L2 | GSGTGGRTGY | 63 | 10 | | 32522 |
| HPV16 | L2 | GSPQYTIIA | 433 | 9 | | 32523 |
| HPV16 | L2 | GSPQYTIIADA | 433 | 11 | | 32524 |
| HPV16 | L2 | GSRPVARLGLY | 218 | 11 | | 32525 |
| HPV16 | L2 | GTCPPDIIPK | 26 | 10 | | 32526 |
| HPV16 | L2 | GTGGRTGY | 65 | 8 | | 32527 |
| HPV16 | L2 | GTGSGTGGR | 61 | 9 | | 32528 |
| HPV16 | L2 | IADAGDFY | 440 | 8 | | 32529 |
| HPV16 | L2 | IADAGDFYLH | 440 | 10 | | 32530 |
| HPV16 | L2 | IADQILQY | 41 | 8 | | 32531 |
| HPV16 | L2 | IDVDNTLY | 260 | 8 | | 32532 |
| HPV16 | L2 | IDVDNTLYF | 260 | 9 | | 32533 |
| HPV16 | L2 | IGAKVHYY | 320 | 8 | | 32534 |
| HPV16 | L2 | IGAKVHYYY | 320 | 9 | | 32535 |
| HPV16 | L2 | IGAKVHYYYDF | 320 | 11 | | 32536 |
| HPV16 | L2 | IGNKQTLR | 306 | 8 | | 32537 |
| HPV16 | L2 | IGNKQTLRTR | 306 | 10 | | 32538 |
| HPV16 | L2 | IGTGSGTGGR | 60 | 10 | | 32539 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | L2 | IIADAGDF | 439 | 8 | | 32540 |
| HPV16 | L2 | IIADAGDFY | 439 | 9 | | 32541 |
| HPV16 | L2 | IIADAGDFYLH | 439 | 11 | | 32542 |
| HPV16 | L2 | IIPKVEGK | 32 | 8 | | 32543 |
| HPV16 | L2 | IIPKVEGKTIA | 32 | 11 | | 32544 |
| HPV16 | L2 | ILQYGSMGVF | 45 | 10 | | 32545 |
| HPV16 | L2 | ILQYGSMGVFF | 45 | 11 | | 32546 |
| HPV16 | L2 | ITPSTYTTTSH | 344 | 11 | | 32547 |
| HPV16 | L2 | ITTPTKLITY | 243 | 10 | | 32548 |
| HPV16 | L2 | ITTSTDTTPA | 135 | 10 | | 32549 |
| HPV16 | L2 | ITYDNPAY | 250 | 8 | | 32550 |
| HPV16 | L2 | IVALHRPA | 286 | 8 | | 32551 |
| HPV16 | L2 | IVPGSPQY | 430 | 8 | | 32552 |
| HPV16 | L2 | IVSLVEETSF | 105 | 10 | | 32553 |
| HPV16 | L2 | KLITYDNPA | 248 | 9 | | 32554 |
| HPV16 | L2 | KLITYDNPAY | 248 | 10 | | 32555 |
| HPV16 | L2 | KSIGAKVH | 318 | 8 | | 32556 |
| HPV16 | L2 | KSIGAKVHY | 318 | 9 | | 32557 |
| HPV16 | L2 | KSIGAKVHYY | 318 | 10 | | 32558 |
| HPV16 | L2 | KSIGAKVHYYY | 318 | 11 | | 32559 |
| HPV16 | L2 | KTIADQILQY | 39 | 10 | | 32560 |
| HPV16 | L2 | KVEGKTIA | 35 | 8 | | 32561 |
| HPV16 | L2 | KVHYYYDF | 323 | 8 | | 32562 |
| HPV16 | L2 | LDIVALHR | 284 | 8 | | 32563 |
| HPV16 | L2 | LDIVALHRPA | 284 | 10 | | 32564 |
| HPV16 | L2 | LGTRPPTA | 75 | 8 | | 32565 |
| HPV16 | L2 | LIPVPGSPQY | 427 | 11 | | 32566 |
| HPV16 | L2 | LITYDNPA | 249 | 8 | | 32567 |
| HPV16 | L2 | LITYDNPAY | 249 | 9 | | 32568 |
| HPV16 | L2 | LSSSTISTH | 183 | 9 | | 32569 |
| HPV16 | L2 | LSSSTISTHNY | 183 | 11 | | 32570 |
| HPV16 | L2 | LTSRRTGIR | 294 | 9 | | 32571 |
| HPV16 | L2 | LTSRRTGIRY | 294 | 10 | | 32572 |
| HPV16 | L2 | LVEETSFIDA | 108 | 10 | | 32573 |
| HPV16 | L2 | MLRKRRKR | 454 | 8 | | 32574 |
| HPV16 | L2 | MLRKRRKRLPY | 454 | 11 | | 32575 |
| HPV16 | L2 | NDNSINIA | 271 | 8 | | 32576 |
| HPV16 | L2 | NGLYDIYA | 363 | 8 | | 32577 |
| HPV16 | L2 | NGLYDIYADDF | 363 | 11 | | 32578 |
| HPV16 | L2 | NIAPDPDF | 276 | 8 | | 32579 |
| HPV16 | L2 | NSINIAPDPDF | 273 | 11 | | 32580 |
| HPV16 | L2 | NTTIPFGGA | 397 | 9 | | 32581 |
| HPV16 | L2 | NTTIPFGGAY | 397 | 10 | | 32582 |
| HPV16 | L2 | NTVTTVTTH | 150 | 9 | | 32583 |
| HPV16 | L2 | PAETGGHF | 174 | 8 | | 32584 |
| HPV16 | L2 | PAFITTPTK | 240 | 9 | | 32585 |
| HPV16 | L2 | PALTSRRTGIR | 292 | 11 | | 32586 |
| HPV16 | L2 | PANTTIPF | 395 | 8 | | 32587 |
| HPV16 | L2 | PANTTIPFGGA | 395 | 11 | | 32588 |
| HPV16 | L2 | PDFLDIVA | 281 | 8 | | 32589 |
| HPV16 | L2 | PDFLDIVALH | 281 | 10 | | 32590 |
| HPV16 | L2 | PDFLDIVALHR | 281 | 11 | | 32591 |
| HPV16 | L2 | PDIIPKVEGK | 30 | 10 | | 32592 |
| HPV16 | L2 | PDIPINITDQA | 414 | 11 | | 32593 |
| HPV16 | L2 | PDPDFLDIVA | 279 | 10 | | 32594 |
| HPV16 | L2 | PGSPQYTIIA | 432 | 10 | | 32595 |
| HPV16 | L2 | PGSRPVAR | 217 | 8 | | 32596 |
| HPV16 | L2 | PINITDQA | 417 | 8 | | 32597 |
| HPV16 | L2 | PIPGSRPVA | 215 | 9 | | 32598 |
| HPV16 | L2 | PIPGSRPVAR | 215 | 10 | | 32599 |
| HPV16 | L2 | PIVPGSPQY | 429 | 9 | | 32600 |
| HPV16 | L2 | PLGTRPPTA | 74 | 9 | | 32601 |
| HPV16 | L2 | PSIPPDVSGF | 124 | 10 | | 32602 |
| HPV16 | L2 | PSTSLSGY | 386 | 8 | | 32603 |
| HPV16 | L2 | PSTSLSGYIPA | 386 | 11 | | 32604 |
| HPV16 | L2 | PSTYTTTSH | 346 | 9 | | 32605 |
| HPV16 | L2 | PSTYTTTSHA | 346 | 10 | | 32606 |
| HPV16 | L2 | PSTYTTTSHAA | 346 | 11 | | 32607 |
| HPV16 | L2 | PSVLQPPTPA | 166 | 10 | | 32608 |
| HPV16 | L2 | PSVPSTSLSGY | 383 | 11 | | 32609 |
| HPV16 | L2 | PSYYMLRK | 450 | 8 | | 32610 |
| HPV16 | L2 | PSYYMLRKR | 450 | 9 | | 32611 |
| HPV16 | L2 | PSYYMLRKRR | 450 | 10 | | 32612 |
| HPV16 | L2 | PSYYMLRKRRK | 450 | 11 | | 32613 |
| HPV16 | L2 | PTATDTLA | 80 | 8 | | 32614 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | L2 | PTATDTLAPVR | 80 | 11 | | 32615 |
| HPV16 | L2 | PTKLITYDNPA | 246 | 11 | | 32616 |
| HPV16 | L2 | PTPAETGGH | 172 | 9 | | 32617 |
| HPV16 | L2 | PTPAETGGHF | 172 | 10 | | 32618 |
| HPV16 | L2 | PTSINNGLY | 358 | 9 | | 32619 |
| HPV16 | L2 | PVARLGLY | 221 | 8 | | 32620 |
| HPV16 | L2 | PVARLGLYSR | 221 | 10 | | 32621 |
| HPV16 | L2 | QILQYGSMGVF | 44 | 11 | | 32622 |
| HPV16 | L2 | QLYKTCKQA | 17 | 9 | | 32623 |
| HPV16 | L2 | QTITPSTY | 342 | 8 | | 32624 |
| HPV16 | L2 | QTLRTRSGK | 310 | 9 | | 32625 |
| HPV16 | L2 | QVKVVDPA | 234 | 8 | | 32626 |
| HPV16 | L2 | QVKVVDPAF | 234 | 9 | | 32627 |
| HPV16 | L2 | RASATQLY | 12 | 8 | | 32628 |
| HPV16 | L2 | RASATQLYK | 12 | 9 | | 32629 |
| HPV16 | L2 | RIGNKQTLR | 305 | 9 | | 32630 |
| HPV16 | L2 | RIGNKQTLRTR | 305 | 11 | | 32631 |
| HPV16 | L2 | RSAKRTKR | 5 | 8 | | 32632 |
| HPV16 | L2 | RSAKRTKRA | 5 | 9 | | 32633 |
| HPV16 | L2 | RSAKRTKRASA | 5 | 11 | | 32634 |
| HPV16 | L2 | RSGKSIGA | 315 | 8 | | 32635 |
| HPV16 | L2 | RSGKSIGAK | 315 | 9 | | 32636 |
| HPV16 | L2 | RSGKSIGAKVH | 315 | 11 | | 32637 |
| HPV16 | L2 | RTGIRYSR | 298 | 8 | | 32638 |
| HPV16 | L2 | RTGYIPLGTR | 69 | 10 | | 32639 |
| HPV16 | L2 | RTKRASATQLY | 9 | 11 | | 32640 |
| HPV16 | L2 | RTRSGKSIGA | 313 | 10 | | 32641 |
| HPV16 | L2 | RTRSGKSIGAK | 313 | 11 | | 32642 |
| HPV16 | L2 | SAKRTKRA | 6 | 8 | | 32643 |
| HPV16 | L2 | SAKRTKRASA | 6 | 10 | | 32644 |
| HPV16 | L2 | SATQLYKTCK | 14 | 10 | | 32645 |
| HPV16 | L2 | SGKSIGAK | 316 | 8 | | 32646 |
| HPV16 | L2 | SGKSGAKVH | 316 | 10 | | 32647 |
| HPV16 | L2 | SGKSIGAKVHY | 316 | 11 | | 32648 |
| HPV16 | L2 | SGTGGRTGY | 64 | 9 | | 32649 |
| HPV16 | L2 | SIGAKVHY | 319 | 8 | | 32650 |
| HPV16 | L2 | SIGAKVHYY | 319 | 9 | | 32651 |
| HPV16 | L2 | SIGAKVHYYY | 319 | 10 | | 32652 |
| HPV16 | L2 | SINIAPDPDF | 274 | 10 | | 32653 |
| HPV16 | L2 | SINNGLYDIY | 360 | 10 | | 32654 |
| HPV16 | L2 | SINNGLYDIYA | 360 | 11 | | 32655 |
| HPV16 | L2 | SIPPDVSGF | 125 | 9 | | 32656 |
| HPV16 | L2 | SITTSTDTTPA | 134 | 11 | | 32657 |
| HPV16 | L2 | SIVSLVEETSF | 104 | 11 | | 32658 |
| HPV16 | L2 | SLSGYIPA | 389 | 8 | | 32659 |
| HPV16 | L2 | SLVEETSF | 107 | 8 | | 32660 |
| HPV16 | L2 | SLVEETSFIDA | 107 | 11 | | 32661 |
| HPV16 | L2 | SSNDNSINIA | 269 | 10 | | 32662 |
| HPV16 | L2 | SSSTISTH | 184 | 8 | | 32663 |
| HPV16 | L2 | SSSTISTHNY | 184 | 10 | | 32664 |
| HPV16 | L2 | SSTISTHNY | 185 | 9 | | 32665 |
| HPV16 | L2 | SSTPIPGSR | 212 | 9 | | 32666 |
| HPV16 | L2 | STISTHNY | 186 | 8 | | 32667 |
| HPV16 | L2 | STPIPGSR | 213 | 8 | | 32668 |
| HPV16 | L2 | STPIPGSRPVA | 213 | 11 | | 32669 |
| HPV16 | L2 | STSLSGYIPA | 387 | 10 | | 32670 |
| HPV16 | L2 | STYTTTSH | 347 | 8 | | 32671 |
| HPV16 | L2 | STYTTTSHA | 347 | 9 | | 32672 |
| HPV16 | L2 | STYTTTSHAA | 347 | 10 | | 32673 |
| HPV16 | L2 | SVLQPPTPA | 167 | 9 | | 32674 |
| HPV16 | L2 | SVPSTSLSGY | 384 | 10 | | 32675 |
| HPV16 | L2 | TATDTLAPVR | 81 | 10 | | 32676 |
| HPV16 | L2 | TCPPDIIPK | 27 | 9 | | 32677 |
| HPV16 | L2 | TDTLAPVR | 83 | 8 | | 32678 |
| HPV16 | L2 | TGIRYSRIGNK | 299 | 11 | | 32679 |
| HPV16 | L2 | TGSGTGGR | 62 | 8 | | 32680 |
| HPV16 | L2 | TGSGTGGRTGY | 62 | 11 | | 32681 |
| HPV16 | L2 | TGYIPLGTR | 70 | 9 | | 32682 |
| HPV16 | L2 | TIADQILQY | 40 | 9 | | 32683 |
| HPV16 | L2 | TIIADAGDF | 438 | 9 | | 32684 |
| HPV16 | L2 | TIIADAGDFY | 438 | 10 | | 32685 |
| HPV16 | L2 | TIPFGGAY | 399 | 8 | | 32686 |
| HPV16 | L2 | TLRTRSGK | 311 | 8 | | 32687 |
| HPV16 | L2 | TLSSSTISTH | 182 | 10 | | 32688 |
| HPV16 | L2 | TSFIDAGA | 112 | 8 | | 32689 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV16 | L2 | TSINNGLY | 359 | 8 | | 32690 |
| HPV16 | L2 | TSINNGLYDIY | 359 | 11 | | 32691 |
| HPV16 | L2 | TSLSGYIPA | 388 | 9 | | 32692 |
| HPV16 | L2 | TSRRTGIR | 295 | 8 | | 32693 |
| HPV16 | L2 | TSRRTGIRY | 295 | 9 | | 32694 |
| HPV16 | L2 | TSRRTGIRYSR | 295 | 11 | | 32695 |
| HPV16 | L2 | TSSTPIPGSR | 211 | 10 | | 32696 |
| HPV16 | L2 | TSTDTTPA | 137 | 8 | | 32697 |
| HPV16 | L2 | TTHNNPTF | 156 | 8 | | 32698 |
| HPV16 | L2 | TTIPFGGA | 398 | 8 | | 32699 |
| HPV16 | L2 | TTIPFGGAY | 398 | 9 | | 32700 |
| HPV16 | L2 | TTPTKLITY | 244 | 9 | | 32701 |
| HPV16 | L2 | TTQQVKVVDPA | 231 | 11 | | 32702 |
| HPV16 | L2 | TTSTDTTPA | 136 | 9 | | 32703 |
| HPV16 | L2 | TTVTTHNNPTF | 153 | 11 | | 32704 |
| HPV16 | L2 | TVTTHNNPTF | 154 | 10 | | 32705 |
| HPV16 | L2 | TVTTVTTH | 151 | 8 | | 32706 |
| HPV16 | L2 | VALHRPALTSR | 287 | 11 | | 32707 |
| HPV16 | L2 | VARLGLYSR | 222 | 9 | | 32708 |
| HPV16 | L2 | VDPAFITTPTK | 238 | 11 | | 32709 |
| HPV16 | L2 | VLQPPTPA | 168 | 8 | | 32710 |
| HPV16 | L2 | VSLVEETSF | 106 | 9 | | 32711 |
| HPV16 | L2 | VTSSTPIPGSR | 210 | 11 | | 32712 |
| HPV16 | L2 | VTTHNNPTF | 155 | 9 | | 32713 |
| HPV16 | L2 | YDFSTIDSA | 328 | 9 | | 32714 |
| HPV16 | L2 | YDIYADDF | 366 | 8 | | 32715 |
| HPV16 | L2 | YFFSDVSLA | 464 | 9 | | 32716 |
| HPV16 | L2 | YFFSDVSLAA | 464 | 10 | | 32717 |
| HPV16 | L2 | YGSMGVFF | 48 | 8 | | 32718 |
| HPV16 | L2 | YIPANTTIPF | 393 | 10 | | 32719 |
| HPV16 | L2 | YIPLGTRPPTA | 72 | 11 | | 32720 |
| HPV16 | L2 | YLHPSYYMLR | 447 | 10 | | 32721 |
| HPV16 | L2 | YLHPSYYMLRK | 447 | 11 | | 32722 |
| HPV16 | L2 | YMLRKRRK | 453 | 8 | | 32723 |
| HPV16 | L2 | YMLRKRRKR | 453 | 9 | | 32724 |
| HPV16 | L2 | YSRIGNKQTLR | 303 | 11 | | 32725 |
| HPV16 | L2 | YSRTTQQVK | 228 | 9 | | 32726 |
| HPV16 | L2 | YTIIADAGDF | 437 | 10 | | 32727 |
| HPV16 | L2 | YTIIADAGDFY | 437 | 11 | | 32728 |
| HPV16 | L2 | YTTTSHAA | 349 | 8 | | 32729 |
| HPV18 | E1 | AAAFLKSNCQA | 396 | 11 | | 32730 |
| HPV18 | E1 | AAFLKSNCQA | 397 | 10 | | 32731 |
| HPV18 | E1 | AAFLKSNCQAK | 397 | 11 | | 32732 |
| HPV18 | E1 | ADSNSNAA | 390 | 8 | | 32733 |
| HPV18 | E1 | ADSNSNAAA | 390 | 9 | | 32734 |
| HPV18 | E1 | ADSNSNAAAF | 390 | 10 | | 32735 |
| HPV18 | E1 | ADTEGNPF | 636 | 8 | | 32736 |
| HPV18 | E1 | ADTEGNPFGTF | 636 | 11 | | 32737 |
| HPV18 | E1 | AFEYALLA | 383 | 8 | | 32738 |
| HPV18 | E1 | AFLKSNCQA | 398 | 9 | | 32739 |
| HPV18 | E1 | AFLKSNCQAK | 398 | 10 | | 32740 |
| HPV18 | E1 | AFLKSNCQAKY | 398 | 11 | | 32741 |
| HPV18 | E1 | AIFGVNPTIA | 246 | 10 | | 32742 |
| HPV18 | E1 | ALDGNPISIDR | 546 | 11 | | 32743 |
| HPV18 | E1 | ALFHAQEVH | 68 | 9 | | 32744 |
| HPV18 | E1 | ALKSFLKGTPK | 466 | 11 | | 32745 |
| HPV18 | E1 | ALLADSNSNA | 387 | 10 | | 32746 |
| HPV18 | E1 | ALLADSNSNAA | 387 | 11 | | 32747 |
| HPV18 | E1 | ALLRYKCGK | 284 | 9 | 0.0900 | 32748 |
| HPV18 | E1 | ALLRYKCGKSR | 284 | 11 | | 32749 |
| HPV18 | E1 | AMLAVFKDTY | 213 | 10 | | 32750 |
| HPV18 | E1 | ATDTGSDMVDF | 40 | 11 | | 32751 |
| HPV18 | E1 | ATMCKHYR | 413 | 8 | | 32752 |
| HPV18 | E1 | ATMCKHYRR | 413 | 9 | 0.0300 | 32753 |
| HPV18 | E1 | ATMCKHYRRA | 413 | 10 | | 32754 |
| HPV18 | E1 | ATTTCWTY | 531 | 8 | | 32755 |
| HPV18 | E1 | ATTTCWTYF | 531 | 9 | | 32756 |
| HPV18 | E1 | AVFKDTYGLSF | 216 | 11 | | 32757 |
| HPV18 | E1 | AVISFVNSTSH | 504 | 11 | | 32758 |
| HPV18 | E1 | CATMCKHY | 412 | 8 | | 32759 |
| HPV18 | E1 | CATMCKHYR | 412 | 9 | 0.0012 | 32760 |
| HPV18 | E1 | CATMCKHYRR | 412 | 10 | | 32761 |
| HPV18 | E1 | CATMCKHYRRA | 412 | 11 | | 32762 |
| HPV18 | E1 | CFFERTWSR | 618 | 9 | | 32763 |
| HPV18 | E1 | CGKSRLTVA | 290 | 9 | | 32764 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E1 | CGKSRLTVAK | 290 | 10 | | 32765 |
| HPV18 | E1 | CGPANTGK | 483 | 8 | | 32766 |
| HPV18 | E1 | CGPANTGKSY | 483 | 10 | | 32767 |
| HPV18 | E1 | CGPANTGKSYF | 483 | 11 | | 32768 |
| HPV18 | E1 | CLVFCGPA | 479 | 8 | | 32769 |
| HPV18 | E1 | CMLIQPPK | 311 | 8 | | 32770 |
| HPV18 | E1 | CMLIQPPKLR | 311 | 10 | | 32771 |
| HPV18 | E1 | CSGGSTEA | 160 | 8 | | 32772 |
| HPV18 | E1 | CSKIDEGGDWR | 437 | 11 | | 32773 |
| HPV18 | E1 | CTDWVTAIF | 240 | 9 | | 32774 |
| HPV18 | E1 | CTIAQLKDLLK | 196 | 11 | | 32775 |
| HPV18 | E1 | DADTEGNPF | 635 | 9 | | 32776 |
| HPV18 | E1 | DAQVLHVLK | 78 | 9 | | 32777 |
| HPV18 | E1 | DAQVLHVLKR | 78 | 10 | | 32778 |
| HPV18 | E1 | DAQVLHVLKRK | 78 | 11 | | 32779 |
| HPV18 | E1 | DATTTCWTY | 530 | 9 | | 32780 |
| HPV18 | E1 | DATTTCWTYF | 530 | 10 | | 32781 |
| HPV18 | E1 | DCATMCKH | 411 | 8 | | 32782 |
| HPV18 | E1 | DCATMCKHY | 411 | 9 | | 32783 |
| HPV18 | E1 | DCATMCKHYR | 411 | 10 | | 32784 |
| HPV18 | E1 | DCATMCKHYRR | 411 | 11 | | 32785 |
| HPV18 | E1 | DCKWGVLILA | 275 | 10 | | 32786 |
| HPV18 | E1 | DDATTTCWTY | 529 | 10 | | 32787 |
| HPV18 | E1 | DDATTTCWTYF | 529 | 11 | | 32788 |
| HPV18 | E1 | DFIDTQGTF | 49 | 9 | | 32789 |
| HPV18 | E1 | DGEGTGCNGWF | 8 | 11 | | 32790 |
| HPV18 | E1 | DGNPISIDR | 548 | 9 | | 32791 |
| HPV18 | E1 | DGNPISIDRK | 548 | 10 | | 32792 |
| HPV18 | E1 | DGNPISIDRKH | 548 | 11 | | 32793 |
| HPV18 | E1 | DLHEEEEDA | 628 | 9 | | 32794 |
| HPV18 | E1 | DLLKVNNK | 203 | 8 | | 32795 |
| HPV18 | E1 | DLLKVNNKQGA | 203 | 11 | | 32796 |
| HPV18 | E1 | DLSEMVQWA | 363 | 9 | | 32797 |
| HPV18 | E1 | DLSEMVQWAF | 363 | 10 | | 32798 |
| HPV18 | E1 | DLVRNFKSDK | 228 | 10 | | 32799 |
| HPV18 | E1 | DMAFEYALLA | 381 | 10 | | 32800 |
| HPV18 | E1 | DSGYGCSEVEA | 134 | 11 | | 32801 |
| HPV18 | E1 | DSNSNAAA | 391 | 8 | | 32802 |
| HPV18 | E1 | DSNSNAAAF | 391 | 9 | | 32803 |
| HPV18 | E1 | DSNSNAAAFLK | 391 | 11 | | 32804 |
| HPV18 | E1 | DTEGNPFGTF | 637 | 10 | | 32805 |
| HPV18 | E1 | DTEGNPFGTFK | 637 | 11 | | 32806 |
| HPV18 | E1 | DTGSDMVDF | 42 | 9 | | 32807 |
| HPV18 | E1 | DTKVAMLDDA | 522 | 10 | | 32808 |
| HPV18 | E1 | DTPEWIQR | 342 | 8 | | 32809 |
| HPV18 | E1 | DTQGTFCEQA | 52 | 10 | | 32810 |
| HPV18 | E1 | DVISDDEDENA | 30 | 11 | | 32811 |
| HPV18 | E1 | EDADTEGNPF | 634 | 10 | | 32812 |
| HPV18 | E1 | EFITFLGA | 459 | 8 | | 32813 |
| HPV18 | E1 | EFITFLGALK | 459 | 10 | | 32814 |
| HPV18 | E1 | EFPNAFPF | 594 | 8 | | 32815 |
| HPV18 | E1 | EFPNAFPFDK | 594 | 10 | | 32816 |
| HPV18 | E1 | EGFKTLIQPF | 256 | 10 | | 32817 |
| HPV18 | E1 | EGGDWRPIVQF | 442 | 11 | | 32818 |
| HPV18 | E1 | EGNPFGTF | 639 | 8 | | 32819 |
| HPV18 | E1 | EGNPFGTFK | 639 | 9 | | 32820 |
| HPV18 | E1 | EGNPFGTFKLR | 639 | 11 | | 32821 |
| HPV18 | E1 | EGTGCNGWF | 10 | 9 | 0.0008 | 32822 |
| HPV18 | E1 | EGTGCNGWFY | 10 | 10 | 0.0005 | 32823 |
| HPV18 | E1 | EINDKNWK | 610 | 8 | | 32824 |
| HPV18 | E1 | EINDKNWKCF | 610 | 10 | | 32825 |
| HPV18 | E1 | EINDKNWKCFF | 610 | 11 | | 32826 |
| HPV18 | E1 | EISLNSGQK | 115 | 9 | | 32827 |
| HPV18 | E1 | EISLNSGQKK | 115 | 10 | | 32828 |
| HPV18 | E1 | EISLNSGQKKA | 115 | 11 | | 32829 |
| HPV18 | E1 | ELETAQALF | 62 | 9 | | 32830 |
| HPV18 | E1 | ELETAQALFH | 62 | 10 | | 32831 |
| HPV18 | E1 | ELETAQALFHA | 62 | 11 | | 32832 |
| HPV18 | E1 | ELTDESDMA | 375 | 9 | | 32833 |
| HPV18 | E1 | ELTDESDMAF | 375 | 10 | | 32834 |
| HPV18 | E1 | ESDMAFEY | 379 | 8 | | 32835 |
| HPV18 | E1 | ESDMAFEYA | 379 | 9 | | 32836 |
| HPV18 | E1 | ESRITVFEF | 587 | 9 | | 32837 |
| HPV18 | E1 | ETAQALFH | 64 | 8 | | 32838 |
| HPV18 | E1 | ETAQALFHA | 64 | 9 | | 32839 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E1 | ETCMLIQPPK | 309 | 10 | | 32840 |
| HPV18 | E1 | EVDTELSPR | 104 | 9 | | 32841 |
| HPV18 | E1 | EVHNDAQVLH | 74 | 10 | | 32842 |
| HPV18 | E1 | FCEQAELETA | 57 | 10 | | 32843 |
| HPV18 | E1 | FCGPANTGK | 482 | 9 | | 32844 |
| HPV18 | E1 | FCGPANTGKSY | 482 | 11 | | 32845 |
| HPV18 | E1 | FDKNGNPVY | 601 | 9 | | 32846 |
| HPV18 | E1 | FDLSEMVQWA | 362 | 10 | | 32847 |
| HPV18 | E1 | FDLSEMVQWAF | 362 | 11 | | 32848 |
| HPV18 | E1 | FDTYMRNA | 539 | 8 | | 32849 |
| HPV18 | E1 | FFERTWSR | 619 | 8 | | 32850 |
| HPV18 | E1 | FGMSFIHF | 493 | 8 | | 32851 |
| HPV18 | E1 | FGTFKLRA | 643 | 8 | | 32852 |
| HPV18 | E1 | FGVNPTIA | 248 | 8 | | 32853 |
| HPV18 | E1 | FGVNPTIAEGF | 248 | 11 | | 32854 |
| HPV18 | E1 | FIDTQGTF | 50 | 8 | | 32855 |
| HPV18 | E1 | FIHFIQGA | 497 | 8 | | 32856 |
| HPV18 | E1 | FIQGAVISF | 500 | 9 | | 32857 |
| HPV18 | E1 | FITFLGALK | 460 | 9 | 0.0320 | 32858 |
| HPV18 | E1 | FITFLGALKSF | 460 | 11 | | 32859 |
| HPV18 | E1 | FLGALKSF | 463 | 8 | | 32860 |
| HPV18 | E1 | FLGALKSFLK | 463 | 10 | | 32861 |
| HPV18 | E1 | FLKGTPKK | 470 | 8 | | 32862 |
| HPV18 | E1 | FLKSNCQA | 399 | 8 | | 32863 |
| HPV18 | E1 | FLKSNCQAK | 399 | 9 | 0.0035 | 32864 |
| HPV18 | E1 | FLKSNCQAKY | 399 | 10 | | 32865 |
| HPV18 | E1 | FLRYQQIEF | 452 | 9 | | 32866 |
| HPV18 | E1 | FTDLVRNF | 226 | 8 | | 32867 |
| HPV18 | E1 | FTDLVRNFK | 226 | 9 | | 32868 |
| HPV18 | E1 | FTISDSGY | 130 | 8 | | 32869 |
| HPV18 | E1 | FVNSTSHF | 508 | 8 | | 32870 |
| HPV18 | E1 | GALKSFLK | 465 | 8 | | 32871 |
| HPV18 | E1 | GAMLAVFK | 212 | 8 | | 32872 |
| HPV18 | E1 | GAMLAVFKDTY | 212 | 11 | | 32873 |
| HPV18 | E1 | GCNGWFYVQA | 13 | 10 | | 32874 |
| HPV18 | E1 | GDTPEWIQR | 341 | 9 | 0.0008 | 32875 |
| HPV18 | E1 | GDWRPIVQF | 444 | 9 | | 32876 |
| HPV18 | E1 | GDWRPIVQFLR | 444 | 11 | | 32877 |
| HPV18 | E1 | GFKTLIQPF | 257 | 9 | | 32878 |
| HPV18 | E1 | GGDWRPIVQF | 443 | 10 | | 32879 |
| HPV18 | E1 | GLSFTDLVR | 223 | 9 | 0.0009 | 32880 |
| HPV18 | E1 | GLSFTDLVRNF | 223 | 11 | | 32881 |
| HPV18 | E1 | GMSFIHFIQGA | 494 | 11 | | 32882 |
| HPV18 | E1 | GSTENSPLGER | 92 | 11 | | 32883 |
| HPV18 | E1 | GTFKLRAGQNH | 644 | 11 | | 32884 |
| HPV18 | E1 | GTGCNGWF | 11 | 8 | | 32885 |
| HPV18 | E1 | GTGCNGWFY | 11 | 9 | 0.0004 | 32886 |
| HPV18 | E1 | GTPKKNCLVF | 473 | 10 | | 32887 |
| HPV18 | E1 | GVLILALLR | 279 | 9 | 0.0058 | 32888 |
| HPV18 | E1 | GVLILALLRY | 279 | 10 | | 32889 |
| HPV18 | E1 | GVLILALLRYK | 279 | 11 | | 32890 |
| HPV18 | E1 | GVNPTIAEGF | 249 | 10 | | 32891 |
| HPV18 | E1 | GVNPTIAEGFK | 249 | 11 | | 32892 |
| HPV18 | E1 | HAQEVHNDA | 71 | 9 | | 32893 |
| HPV18 | E1 | HFIQGAVISF | 499 | 10 | | 32894 |
| HPV18 | E1 | HFWLEPLTDTK | 514 | 11 | | 32895 |
| HPV18 | E1 | HGIDDSNF | 355 | 8 | | 32896 |
| HPV18 | E1 | HIQCLDCK | 270 | 8 | | 32897 |
| HPV18 | E1 | HVLKRKFA | 83 | 8 | | 32898 |
| HPV18 | E1 | IAQLKDLLK | 198 | 9 | 0.0003 | 32899 |
| HPV18 | E1 | IDEGGDWR | 440 | 8 | | 32900 |
| HPV18 | E1 | IDTQGTFCEQA | 51 | 11 | | 32901 |
| HPV18 | E1 | IFGVNPTIA | 247 | 9 | | 32902 |
| HPV18 | E1 | IIQHGIDDSNF | 352 | 11 | | 32903 |
| HPV18 | E1 | ILALLRYK | 282 | 8 | | 32904 |
| HPV18 | E1 | ILALLRYKCGK | 282 | 11 | | 32905 |
| HPV18 | E1 | ILLTTNIH | 569 | 8 | | 32906 |
| HPV18 | E1 | ILLTTNIHPA | 569 | 10 | | 32907 |
| HPV18 | E1 | ILLTTNIHPAK | 569 | 11 | | 32908 |
| HPV18 | E1 | ISDDEDENA | 32 | 9 | | 32909 |
| HPV18 | E1 | ISFVNSTSH | 506 | 9 | | 32910 |
| HPV18 | E1 | ISFVNSTSHF | 506 | 10 | | 32911 |
| HPV18 | E1 | ISIDRKHK | 552 | 8 | | 32912 |
| HPV18 | E1 | ISLNSGQK | 116 | 8 | | 32913 |
| HPV18 | E1 | ISLNSGQKK | 116 | 9 | 0.0003 | 32914 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E1 | ISLNSGQKKA | 116 | 10 | | 32915 |
| HPV18 | E1 | ISLNSGQKKAK | 116 | 11 | | 32916 |
| HPV18 | E1 | ITFLGALK | 461 | 8 | | 32917 |
| HPV18 | E1 | ITFLGALKSF | 461 | 10 | | 32918 |
| HPV18 | E1 | ITVFEFPNA | 590 | 9 | | 32919 |
| HPV18 | E1 | ITVFEFPNAF | 590 | 10 | | 32920 |
| HPV18 | E1 | KCFFERTWSR | 617 | 10 | | 32921 |
| HPV18 | E1 | KCGKSRLTVA | 289 | 10 | | 32922 |
| HPV18 | E1 | KCGKSRLTVAK | 289 | 11 | | 32923 |
| HPV18 | E1 | KDCATMCK | 410 | 8 | | 32924 |
| HPV18 | E1 | KDCATMCKH | 410 | 9 | | 32925 |
| HPV18 | E1 | KDCATMCKHY | 410 | 10 | | 32926 |
| HPV18 | E1 | KDCATMCKHYR | 410 | 11 | | 32927 |
| HPV18 | E1 | KDLLKVNNK | 202 | 9 | | 32928 |
| HPV18 | E1 | KDNRWPYLESR | 579 | 11 | | 32929 |
| HPV18 | E1 | KDTYGLSF | 219 | 8 | | 32930 |
| HPV18 | E1 | KGLSTLLH | 299 | 8 | | 32931 |
| HPV18 | E1 | KGTPKKNCLVF | 472 | 11 | | 32932 |
| HPV18 | E1 | KIDEGGDWR | 439 | 9 | | 32933 |
| HPV18 | E1 | KLRAGQNH | 647 | 8 | | 32934 |
| HPV18 | E1 | KLRAGQNHR | 647 | 9 | 0.3000 | 32935 |
| HPV18 | E1 | KLRSSVAA | 318 | 8 | | 32936 |
| HPV18 | E1 | KLRSSVAALY | 318 | 10 | | 32937 |
| HPV18 | E1 | KSFLKGTPK | 468 | 9 | 0.0003 | 32938 |
| HPV18 | E1 | KSFLKGTPKK | 468 | 10 | | 32939 |
| HPV18 | E1 | KSNCQAKY | 401 | 8 | | 32940 |
| HPV18 | E1 | KSNCQAKYLK | 401 | 10 | | 32941 |
| HPV18 | E1 | KSRLTVAK | 292 | 8 | | 32942 |
| HPV18 | E1 | KSYFGMSF | 490 | 8 | | 32943 |
| HPV18 | E1 | KSYFGMSFIH | 490 | 10 | | 32944 |
| HPV18 | E1 | KSYFGMSFIHF | 490 | 11 | | 32945 |
| HPV18 | E1 | KTLIQPFILY | 259 | 10 | | 32946 |
| HPV18 | E1 | KTLIQPFILYA | 259 | 11 | | 32947 |
| HPV18 | E1 | KTTCTDWVTA | 237 | 10 | | 32948 |
| HPV18 | E1 | KVAMLDDA | 524 | 8 | | 32949 |
| HPV18 | E1 | KVNNKQGA | 206 | 8 | | 32950 |
| HPV18 | E1 | KVNNKQGAMLA | 206 | 11 | | 32951 |
| HPV18 | E1 | LADSNSNA | 389 | 8 | | 32952 |
| HPV18 | E1 | LADSNSNAA | 389 | 9 | | 32953 |
| HPV18 | E1 | LADSNSNAAA | 389 | 10 | | 32954 |
| HPV18 | E1 | LADSNSNAAAF | 389 | 11 | | 32955 |
| HPV18 | E1 | LALLRYKCGK | 283 | 10 | | 32956 |
| HPV18 | E1 | LAVFKDTY | 215 | 8 | | 32957 |
| HPV18 | E1 | LDCKWGVLILA | 274 | 11 | | 32958 |
| HPV18 | E1 | LDDATTTCWTY | 528 | 11 | | 32959 |
| HPV18 | E1 | LDGNPISIDR | 547 | 10 | | 32960 |
| HPV18 | E1 | LDGNPISIDRK | 547 | 11 | | 32961 |
| HPV18 | E1 | LDLHEEEEDA | 627 | 10 | | 32962 |
| HPV18 | E1 | LFHAQEVH | 69 | 8 | | 32963 |
| HPV18 | E1 | LFHAQEVHNDA | 69 | 11 | | 32964 |
| HPV18 | E1 | LFTISDSGY | 129 | 9 | | 32965 |
| HPV18 | E1 | LGALKSFLK | 464 | 9 | | 32966 |
| HPV18 | E1 | LILALLRY | 281 | 8 | | 32967 |
| HPV18 | E1 | LILALLRYK | 281 | 9 | 0.2700 | 32968 |
| HPV18 | E1 | LIQPFILY | 261 | 8 | | 32969 |
| HPV18 | E1 | LIQPFILYA | 261 | 9 | | 32970 |
| HPV18 | E1 | LIQPFILYAH | 261 | 10 | | 32971 |
| HPV18 | E1 | LIQPPKLR | 313 | 8 | | 32972 |
| HPV18 | E1 | LLADSNSNA | 388 | 9 | | 32973 |
| HPV18 | E1 | LLADSNSNAA | 388 | 10 | | 32974 |
| HPV18 | E1 | LLADSNSNAAA | 388 | 11 | | 32975 |
| HPV18 | E1 | LLKVNNKQGA | 204 | 10 | | 32976 |
| HPV18 | E1 | LLRYKCGK | 285 | 8 | | 32977 |
| HPV18 | E1 | LLRYKCGKSR | 285 | 10 | | 32978 |
| HPV18 | E1 | LLTTNIHPA | 570 | 9 | | 32979 |
| HPV18 | E1 | LLTTNIHPAK | 570 | 10 | | 32980 |
| HPV18 | E1 | LSEMVQWA | 364 | 8 | | 32981 |
| HPV18 | E1 | LSEMVQWAF | 364 | 9 | | 32982 |
| HPV18 | E1 | LSFTDLVR | 224 | 8 | | 32983 |
| HPV18 | E1 | LSFTDLVRNF | 224 | 10 | | 32984 |
| HPV18 | E1 | LSFTDLVRNFK | 224 | 11 | | 32985 |
| HPV18 | E1 | LTDESDMA | 376 | 8 | | 32986 |
| HPV18 | E1 | LTDESDMAF | 376 | 9 | | 32987 |
| HPV18 | E1 | LTDESDMAFEY | 376 | 11 | | 32988 |
| HPV18 | E1 | LTTNIHPA | 571 | 8 | | 32989 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E1 | LTTNIHPAK | 571 | 9 | 0.0910 | 32990 |
| HPV18 | E1 | LVFCGPANTGK | 480 | 11 | | 32991 |
| HPV18 | E1 | LVRNFKSDK | 229 | 9 | 0.0005 | 32992 |
| HPV18 | E1 | MAFEYALLA | 382 | 9 | | 32993 |
| HPV18 | E1 | MCKHYRRA | 415 | 8 | | 32994 |
| HPV18 | E1 | MCKHYRRAQK | 415 | 10 | | 32995 |
| HPV18 | E1 | MCKHYRRAQKR | 415 | 11 | | 32996 |
| HPV18 | E1 | MGDTPEWIQR | 340 | 10 | | 32997 |
| HPV18 | E1 | MLAVFKDTY | 214 | 9 | | 32998 |
| HPV18 | E1 | MLIQPPKLR | 312 | 9 | 0.0005 | 32999 |
| HPV18 | E1 | MSFIHFIQGA | 495 | 10 | | 33000 |
| HPV18 | E1 | MSQWIRFR | 429 | 8 | | 33001 |
| HPV18 | E1 | MSQWIRFRCSK | 429 | 11 | | 33002 |
| HPV18 | E1 | MVDFIDTQGTF | 47 | 11 | | 33003 |
| HPV18 | E1 | NCLVFCGPA | 478 | 9 | | 33004 |
| HPV18 | E1 | NCQAKYLK | 403 | 8 | | 33005 |
| HPV18 | E1 | NCQAKYLKDCA | 403 | 11 | | 33006 |
| HPV18 | E1 | NDAQVLHVLK | 77 | 10 | | 33007 |
| HPV18 | E1 | NDAQVLHVLKR | 77 | 11 | | 33008 |
| HPV18 | E1 | NDKNWKCF | 612 | 8 | | 33009 |
| HPV18 | E1 | NDKNWKCFF | 612 | 9 | | 33010 |
| HPV18 | E1 | NDKNWKCFFER | 612 | 11 | | 33011 |
| HPV18 | E1 | NFDLSEMVQWA | 361 | 11 | | 33012 |
| HPV18 | E1 | NGNPVYEINDK | 604 | 11 | | 33013 |
| HPV18 | E1 | NGWFYVQA | 15 | 8 | | 33014 |
| HPV18 | E1 | NIHPAKDNR | 574 | 9 | 0.0005 | 33015 |
| HPV18 | E1 | NMSQWIRF | 428 | 8 | | 33016 |
| HPV18 | E1 | NMSQWIRFR | 428 | 9 | 0.0540 | 33017 |
| HPV18 | E1 | NSGQKKAK | 119 | 8 | | 33018 |
| HPV18 | E1 | NSGQKKAKR | 119 | 9 | 0.0005 | 33019 |
| HPV18 | E1 | NSGQKKAKRR | 119 | 10 | | 33020 |
| HPV18 | E1 | NSNAAAFLK | 393 | 9 | 0.0057 | 33021 |
| HPV18 | E1 | NTGKSYFGMSF | 487 | 11 | | 33022 |
| HPV18 | E1 | NVCSGGSTEA | 158 | 10 | | 33023 |
| HPV18 | E1 | NVNPQCTIA | 191 | 9 | | 33024 |
| HPV18 | E1 | PAKDNRWPY | 577 | 9 | | 33025 |
| HPV18 | E1 | PANTGKSY | 485 | 8 | | 33026 |
| HPV18 | E1 | PANTGKSYF | 485 | 9 | | 33027 |
| HPV18 | E1 | PFDKNGNPVY | 600 | 10 | | 33028 |
| HPV18 | E1 | PFGTFKLR | 642 | 8 | | 33029 |
| HPV18 | E1 | PFGTFKLRA | 652 | 9 | | 33030 |
| HPV18 | E1 | PILLTTNIH | 568 | 9 | | 33031 |
| HPV18 | E1 | PILLTTNIHPA | 568 | 11 | | 33032 |
| HPV18 | E1 | PISIDRKH | 551 | 8 | | 33033 |
| HPV18 | E1 | PISIDRKHK | 551 | 9 | | 33034 |
| HPV18 | E1 | PIVQFLRY | 448 | 8 | | 33035 |
| HPV18 | E1 | PLTDTKVA | 519 | 8 | | 33036 |
| HPV18 | E1 | PTIAEGFK | 252 | 8 | | 33037 |
| HPV18 | E1 | PVYEINDK | 607 | 8 | | 33038 |
| HPV18 | E1 | PVYEINDKNWK | 607 | 11 | | 33039 |
| HPV18 | E1 | QAELETAQA | 60 | 9 | | 33040 |
| HPV18 | E1 | QAELETAQALF | 60 | 11 | | 33041 |
| HPV18 | E1 | QAKYLKDCA | 405 | 9 | | 33042 |
| HPV18 | E1 | QALFHAQEVH | 67 | 10 | | 33043 |
| HPV18 | E1 | QCTIAQLK | 195 | 8 | | 33044 |
| HPV18 | E1 | QFLRYQQIEF | 451 | 10 | | 33045 |
| HPV18 | E1 | QGAMLAVF | 211 | 8 | | 33046 |
| HPV18 | E1 | QGAMLAVFK | 211 | 9 | | 33047 |
| HPV18 | E1 | QGTFCEQA | 54 | 8 | | 33048 |
| HPV18 | E1 | QIEFITFLGA | 457 | 10 | | 33049 |
| HPV18 | E1 | QIQVTTNGEH | 146 | 10 | | 33050 |
| HPV18 | E1 | QLKDLLKVNNK | 200 | 11 | | 33051 |
| HPV18 | E1 | QMNMSQWIR | 426 | 9 | 0.0011 | 33052 |
| HPV18 | E1 | QMNMSQWIRF | 426 | 10 | | 33053 |
| HPV18 | E1 | QMNMSQWIRFR | 426 | 11 | | 33054 |
| HPV18 | E1 | QVLHVLKR | 80 | 8 | | 33055 |
| HPV18 | E1 | QVLHVLKRK | 80 | 9 | 0.0028 | 33056 |
| HPV18 | E1 | QVLHVLKRKF | 80 | 10 | | 33057 |
| HPV18 | E1 | QVLHVLKRKFA | 80 | 11 | | 33058 |
| HPV18 | E1 | QVTTNGEH | 148 | 8 | | 33059 |
| HPV18 | E1 | RITVFEFPNA | 589 | 10 | | 33060 |
| HPV18 | E1 | RITVFEFPNAF | 589 | 11 | | 33061 |
| HPV18 | E1 | RLDLHEEEDA | 626 | 11 | | 33062 |
| HPV18 | E1 | RLEVDTELSPR | 102 | 11 | | 33063 |
| HPV18 | E1 | RLFTISDSGY | 128 | 10 | | 33064 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E1 | RSSVAALY | 320 | 8 | | 33065 |
| HPV18 | E1 | RSSVAALYWY | 320 | 10 | | 33066 |
| HPV18 | E1 | RSSVAALYWYR | 320 | 11 | | 33067 |
| HPV18 | E1 | RTWSRLDLH | 622 | 9 | | 33068 |
| HPV18 | E1 | SDDEDENA | 33 | 8 | | 33069 |
| HPV18 | E1 | SDMAFEYA | 380 | 8 | | 33070 |
| HPV18 | E1 | SDMAFEYALLA | 380 | 11 | | 33071 |
| HPV18 | E1 | SFIHFIQGA | 496 | 9 | | 33072 |
| HPV18 | E1 | SFLKGTPK | 469 | 8 | | 33073 |
| HPV18 | E1 | SFLKGTPKK | 469 | 9 | | 33074 |
| HPV18 | E1 | SFTDLVRNF | 225 | 9 | | 33075 |
| HPV18 | E1 | SFTDLVRNFK | 225 | 10 | | 33076 |
| HPV18 | E1 | SFVNSTSH | 507 | 8 | | 33077 |
| HPV18 | E1 | SFVNSTSHF | 507 | 9 | | 33078 |
| HPV18 | E1 | SGQKKAKR | 120 | 8 | | 33079 |
| HPV18 | E1 | SGQKKAKRR | 120 | 9 | | 33080 |
| HPV18 | E1 | SGQKKAKRRLF | 120 | 11 | | 33081 |
| HPV18 | E1 | SGYGCSEVEA | 135 | 10 | | 33082 |
| HPV18 | E1 | SLNSGQKK | 117 | 8 | | 33083 |
| HPV18 | E1 | SLNSGQKKA | 117 | 9 | | 33084 |
| HPV18 | E1 | SLNSGQKKAK | 117 | 10 | | 33085 |
| HPV18 | E1 | SLNSGQKKAKR | 117 | 11 | | 33086 |
| HPV18 | E1 | SSVAALYWY | 321 | 9 | | 33087 |
| HPV18 | E1 | SSVAALYWYR | 321 | 10 | | 33088 |
| HPV18 | E1 | STENSPLGER | 93 | 10 | | 33089 |
| HPV18 | E1 | SVAALYWY | 322 | 8 | | 33090 |
| HPV18 | E1 | SVAALYWYR | 322 | 9 | 2.9000 | 33091 |
| HPV18 | E1 | TAIFGVNPTIA | 245 | 11 | | 33092 |
| HPV18 | E1 | TAQALFHA | 65 | 8 | | 33093 |
| HPV18 | E1 | TCMLIQPPK | 310 | 9 | | 33094 |
| HPV18 | E1 | TCMLIQPPKLR | 310 | 11 | | 33095 |
| HPV18 | E1 | TCTDWVTA | 239 | 8 | | 33096 |
| HPV18 | E1 | TCTDWVTAIF | 239 | 10 | | 33097 |
| HPV18 | E1 | TCWTYFDTY | 534 | 9 | | 33098 |
| HPV18 | E1 | TCWTYFDTYMR | 534 | 11 | | 33099 |
| HPV18 | E1 | TDESDMAF | 377 | 8 | | 33100 |
| HPV18 | E1 | TDESDMAFEY | 377 | 10 | | 33101 |
| HPV18 | E1 | TDESDMAFEYA | 377 | 11 | | 33102 |
| HPV18 | E1 | TDLVRNFK | 227 | 8 | | 33103 |
| HPV18 | E1 | TDLVRNFKSDK | 227 | 11 | | 33104 |
| HPV18 | E1 | TDTGSDMVDF | 41 | 10 | | 33105 |
| HPV18 | E1 | TDTKVAMLDDA | 521 | 11 | | 33106 |
| HPV18 | E1 | TDWVTAIF | 241 | 8 | | 33107 |
| HPV18 | E1 | TFCEQAELETA | 56 | 11 | | 33108 |
| HPV18 | E1 | TFKLRAGQNH | 645 | 10 | | 33109 |
| HPV18 | E1 | TFKLRAGQNHR | 645 | 11 | | 33110 |
| HPV18 | E1 | TFLGALKSF | 462 | 9 | | 33111 |
| HPV18 | E1 | TFLGALKSFLK | 462 | 11 | | 33112 |
| HPV18 | E1 | TGCNGWFY | 12 | 8 | | 33113 |
| HPV18 | E1 | TGCNGWFYVQA | 12 | 11 | | 33114 |
| HPV18 | E1 | TGKSYFGMSF | 488 | 10 | | 33115 |
| HPV18 | E1 | TGSDMVDF | 43 | 8 | | 33116 |
| HPV18 | E1 | TIAQLKDLLK | 197 | 10 | | 33117 |
| HPV18 | E1 | TLIQPFILY | 260 | 9 | | 33118 |
| HPV18 | E1 | TLIQPFILYA | 260 | 10 | | 33119 |
| HPV18 | E1 | TLIQPFILYAH | 260 | 11 | | 33120 |
| HPV18 | E1 | TMCKHYRR | 414 | 8 | | 33121 |
| HPV18 | E1 | TMCKHYRRA | 414 | 9 | | 33122 |
| HPV18 | E1 | TMCKHYRRAQK | 414 | 11 | | 33123 |
| HPV18 | E1 | TTCTDWVTA | 238 | 9 | | 33124 |
| HPV18 | E1 | TTCTDWVTAIF | 238 | 11 | | 33125 |
| HPV18 | E1 | TTCWTYFDTY | 533 | 10 | | 33126 |
| HPV18 | E1 | TTNIHPAK | 572 | 8 | | 33127 |
| HPV18 | E1 | TTNIHPAKDNR | 572 | 11 | | 33128 |
| HPV18 | E1 | TTTCWTYF | 532 | 8 | | 33129 |
| HPV18 | E1 | TTTCWTYFDTY | 532 | 11 | | 33130 |
| HPV18 | E1 | TVAKGLSTLLH | 296 | 11 | | 33131 |
| HPV18 | E1 | TVFEFPNA | 591 | 8 | | 33132 |
| HPV18 | E1 | TVFEFPNAF | 591 | 9 | | 33133 |
| HPV18 | E1 | TVFEFPNAFPF | 591 | 11 | | 33134 |
| HPV18 | E1 | VAALYWYR | 323 | 8 | | 33135 |
| HPV18 | E1 | VAKGLSTLLH | 297 | 10 | | 33136 |
| HPV18 | E1 | VCSGGSTEA | 159 | 9 | | 33137 |
| HPV18 | E1 | VDFIDTQGTF | 48 | 10 | | 33138 |
| HPV18 | E1 | VDTELSPR | 105 | 8 | | 33139 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E1 | VFCGPANTGK | 481 | 10 | | 33140 |
| HPV18 | E1 | VFEFPNAF | 592 | 8 | | 33141 |
| HPV18 | E1 | VFEFPNAFPF | 592 | 10 | | 33142 |
| HPV18 | E1 | VFKDTYGLSF | 217 | 10 | | 33143 |
| HPV18 | E1 | VISDDEDENA | 31 | 10 | | 33144 |
| HPV18 | E1 | VISFVNSTSH | 505 | 10 | | 33145 |
| HPV18 | E1 | VISFVNSTSHF | 505 | 11 | | 33146 |
| HPV18 | E1 | VLHVLKRK | 81 | 8 | | 33147 |
| HPV18 | E1 | VLHVLKRKF | 81 | 9 | | 33148 |
| HPV18 | E1 | VLHVLKRKFA | 81 | 10 | | 33149 |
| HPV18 | E1 | VLILALLR | 280 | 8 | | 33150 |
| HPV18 | E1 | VLILALLRY | 280 | 9 | | 33151 |
| HPV18 | E1 | VLILALLRYK | 280 | 10 | | 33152 |
| HPV18 | E1 | VMGDTPEWIQR | 339 | 11 | | 33153 |
| HPV18 | E1 | WFYVQAIVDK | 17 | 10 | | 33154 |
| HPV18 | E1 | WFYVQAIVDKK | 17 | 11 | | 33155 |
| HPV18 | E1 | WGVLILALLR | 278 | 10 | | 33156 |
| HPV18 | E1 | WGVLILALLRY | 278 | 11 | | 33157 |
| HPV18 | E1 | WIQRLTIIQH | 346 | 10 | | 33158 |
| HPV18 | E1 | WIRFRCSK | 432 | 8 | | 33159 |
| HPV18 | E1 | WLEPLTDTK | 516 | 9 | | 33160 |
| HPV18 | E1 | WLEPLTDTKVA | 516 | 11 | | 33161 |
| HPV18 | E1 | WTYFDTYMR | 536 | 9 | 0.0005 | 33162 |
| HPV18 | E1 | WTYFDTYMRNA | 536 | 11 | | 33163 |
| HPV18 | E1 | YAHIQCLDCK | 268 | 10 | | 33164 |
| HPV18 | E1 | YALLADSNSNA | 386 | 11 | | 33165 |
| HPV18 | E1 | YFDTYMRNA | 538 | 9 | | 33166 |
| HPV18 | E1 | YFGMSFIH | 492 | 8 | | 33167 |
| HPV18 | E1 | YFGMSFIHF | 492 | 9 | | 33168 |
| HPV18 | E1 | YGCSEVEA | 137 | 8 | | 33169 |
| HPV18 | E1 | YGLSFTDLVR | 222 | 10 | | 33170 |
| HPV18 | E1 | YLESRITVF | 585 | 9 | | 33171 |
| HPV18 | E1 | YLESRITVFEF | 585 | 11 | | 33172 |
| HPV18 | E1 | YLKDCATMCK | 408 | 10 | | 33173 |
| HPV18 | E1 | YLKDCATMCKH | 408 | 11 | | 33174 |
| HPV18 | E1 | YVQAIVDK | 19 | 8 | | 33175 |
| HPV18 | E1 | YVQAIVDKK | 19 | 9 | 0.0005 | 33176 |
| HPV18 | E2 | AATPTGNNK | 269 | 9 | | 33177 |
| HPV18 | E2 | AATPTGNNKR | 269 | 10 | | 33178 |
| HPV18 | E2 | AATPTGNNKRR | 269 | 11 | | 33179 |
| HPV18 | E2 | AATRPGHCGLA | 245 | 11 | | 33180 |
| HPV18 | E2 | AGTWDKTA | 147 | 8 | | 33181 |
| HPV18 | E2 | AIFFAAREH | 45 | 9 | | 33182 |
| HPV18 | E2 | ALQGLAQSR | 82 | 9 | | 33183 |
| HPV18 | E2 | ALQGLAQSRY | 82 | 10 | | 33184 |
| HPV18 | E2 | ALQGLAQSRYK | 82 | 11 | | 33185 |
| HPV18 | E2 | ATCVSHRGLY | 154 | 10 | | 33186 |
| HPV18 | E2 | ATCVSHRGLYY | 154 | 11 | | 33187 |
| HPV18 | E2 | ATPTGNNK | 270 | 8 | | 33188 |
| HPV18 | E2 | ATPTGNNKR | 270 | 9 | | 33189 |
| HPV18 | E2 | ATPTGNNKRR | 270 | 10 | | 33190 |
| HPV18 | E2 | ATPTGNNKRRK | 270 | 11 | | 33191 |
| HPV18 | E2 | ATQLVKQLQH | 214 | 10 | | 33192 |
| HPV18 | E2 | ATRPGHCGLA | 246 | 10 | | 33193 |
| HPV18 | E2 | CGLAEKQH | 252 | 8 | | 33194 |
| HPV18 | E2 | CGPVNPLLGA | 260 | 10 | | 33195 |
| HPV18 | E2 | CGPVNPLLGAA | 260 | 11 | | 33196 |
| HPV18 | E2 | CLRYRLRK | 301 | 8 | | 33197 |
| HPV18 | E2 | CLRYRLRKH | 301 | 9 | | 33198 |
| HPV18 | E2 | CMTYVAWDSVY | 132 | 11 | | 33199 |
| HPV18 | E2 | CSGNTTPIIH | 282 | 10 | | 33200 |
| HPV18 | E2 | CSTSDDTVSA | 205 | 10 | | 33201 |
| HPV18 | E2 | CVQDKIIDH | 14 | 9 | | 33202 |
| HPV18 | E2 | CVQDKIIDHY | 14 | 10 | | 33203 |
| HPV18 | E2 | CVSHRGLY | 156 | 8 | | 33204 |
| HPV18 | E2 | CVSHRGLYY | 156 | 9 | | 33205 |
| HPV18 | E2 | CVSHRGLYYVK | 156 | 11 | | 33206 |
| HPV18 | E2 | DAGTWDKTA | 146 | 9 | | 33207 |
| HPV18 | E2 | DDTVSATQLVK | 209 | 11 | | 33208 |
| HPV18 | E2 | DGNKDNCMTY | 126 | 10 | | 33209 |
| HPV18 | E2 | DIDSQIQY | 29 | 8 | | 33210 |
| HPV18 | E2 | DISSTWHWTGA | 315 | 11 | | 33211 |
| HPV18 | E2 | DSKDIDSQIQY | 26 | 11 | | 33212 |
| HPV18 | E2 | DSQIQYWQLIR | 31 | 11 | | 33213 |
| HPV18 | E2 | DSVQILVGY | 354 | 9 | | 33214 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E2 | DSVYYMTDA | 139 | 9 | | 33215 |
| HPV18 | E2 | DTVSATQLVK | 210 | 10 | | 33216 |
| HPV18 | E2 | EFKSECEK | 175 | 8 | | 33217 |
| HPV18 | E2 | EFKSECEKY | 175 | 9 | | 33218 |
| HPV18 | E2 | EGYNTFYIEF | 167 | 10 | | 33219 |
| HPV18 | E2 | EGYNTFYIEFK | 167 | 11 | | 33220 |
| HPV18 | E2 | ELQMALQGLA | 78 | 10 | | 33221 |
| HPV18 | E2 | ELWNTEPTH | 104 | 9 | | 33222 |
| HPV18 | E2 | ELWNTEPTHCF | 104 | 11 | | 33223 |
| HPV18 | E2 | FDGNKDNCMTY | 125 | 11 | | 33224 |
| HPV18 | E2 | GAATPTGNNK | 268 | 10 | | 33225 |
| HPV18 | E2 | GAATPTGNNKR | 268 | 11 | | 33226 |
| HPV18 | E2 | GDRNSLKCLR | 294 | 10 | | 33227 |
| HPV18 | E2 | GDRNSLKCLRY | 294 | 11 | | 33228 |
| HPV18 | E2 | GGQTVQVY | 117 | 8 | | 33229 |
| HPV18 | E2 | GGQTVQVYF | 117 | 9 | | 33230 |
| HPV18 | E2 | GILTVTYH | 331 | 8 | | 33231 |
| HPV18 | E2 | GLAQSRYK | 85 | 8 | | 33232 |
| HPV18 | E2 | GLYYVKEGY | 161 | 9 | | 33233 |
| HPV18 | E2 | GTAKTYGQTSA | 235 | 11 | | 33234 |
| HPV18 | E2 | HCGLAEKQH | 251 | 9 | | 33235 |
| HPV18 | E2 | HCGPVNPLLGA | 259 | 11 | | 33236 |
| HPV18 | E2 | HGIQTLNH | 53 | 8 | | 33237 |
| HPV18 | E2 | HLKGDRNSLK | 291 | 10 | | 33238 |
| HPV18 | E2 | HSETQRTK | 338 | 8 | | 33239 |
| HPV18 | E2 | HSETQRTKF | 338 | 9 | | 33240 |
| HPV18 | E2 | IDHYENDSK | 20 | 9 | | 33241 |
| HPV18 | E2 | IFFAAREH | 46 | 8 | | 33242 |
| HPV18 | E2 | IIDHYENDSK | 19 | 10 | | 33243 |
| HPV18 | E2 | IIHLKGDR | 289 | 8 | | 33244 |
| HPV18 | E2 | ISKSKAHK | 68 | 8 | | 33245 |
| HPV18 | E2 | ISKSKAHKA | 68 | 9 | | 33246 |
| HPV18 | E2 | ISSTWHWTGA | 316 | 10 | | 33247 |
| HPV18 | E2 | KAHKAIELQMA | 72 | 11 | | 33248 |
| HPV18 | E2 | KAIELQMA | 75 | 8 | | 33249 |
| HPV18 | E2 | KCLRYRLR | 300 | 8 | | 33250 |
| HPV18 | E2 | KCLRYRLRK | 300 | 9 | | 33251 |
| HPV18 | E2 | KCLRYRLRKH | 300 | 10 | | 33252 |
| HPV18 | E2 | KDIDSQIQY | 28 | 9 | | 33253 |
| HPV18 | E2 | KDNCMTYVA | 129 | 9 | | 33254 |
| HPV18 | E2 | KGDRNSLK | 293 | 8 | | 33255 |
| HPV18 | E2 | KGDRNSLKCLR | 293 | 11 | | 33256 |
| HPV18 | E2 | KGGQTVQVY | 116 | 9 | | 33257 |
| HPV18 | E2 | KGGQTVQVYF | 116 | 10 | | 33258 |
| HPV18 | E2 | KIIDHYENDSK | 18 | 11 | | 33259 |
| HPV18 | E2 | KTATCVSH | 152 | 8 | | 33260 |
| HPV18 | E2 | KTATCVSHR | 152 | 9 | | 33261 |
| HPV18 | E2 | KTGILTVTY | 329 | 9 | | 33262 |
| HPV18 | E2 | KTGILTVTYH | 329 | 10 | | 33263 |
| HPV18 | E2 | KTYGQTSA | 238 | 8 | | 33264 |
| HPV18 | E2 | KTYGQTSAA | 238 | 9 | | 33265 |
| HPV18 | E2 | KTYGQTSAATR | 238 | 11 | | 33266 |
| HPV18 | E2 | LCSGNTTPIIH | 281 | 11 | | 33267 |
| HPV18 | E2 | LGAATPTGNNK | 267 | 11 | | 33268 |
| HPV18 | E2 | LIRWENAIF | 39 | 9 | | 33269 |
| HPV18 | E2 | LIRWENAIFF | 39 | 10 | | 33270 |
| HPV18 | E2 | LIRWENAIFFA | 39 | 11 | | 33271 |
| HPV18 | E2 | LSCVQDKIIDH | 12 | 11 | | 33272 |
| HPV18 | E2 | LSERLSCVQDK | 8 | 11 | | 33273 |
| HPV18 | E2 | LTVTYHSETQR | 333 | 11 | | 33274 |
| HPV18 | E2 | MALQGLAQSR | 81 | 10 | | 33275 |
| HPV18 | E2 | MALQGLAQSRY | 81 | 11 | | 33276 |
| HPV18 | E2 | MCSTSDDTVSA | 204 | 11 | | 33277 |
| HPV18 | E2 | MTDAGTWDK | 144 | 9 | | 33278 |
| HPV18 | E2 | MTDAGTWDKTA | 144 | 11 | | 33279 |
| HPV18 | E2 | MTYVAWDSVY | 133 | 10 | | 33280 |
| HPV18 | E2 | MTYVAWDSVYY | 133 | 11 | | 33281 |
| HPV18 | E2 | NAIFFAAR | 44 | 8 | | 33282 |
| HPV18 | E2 | NAIFFAAREH | 44 | 10 | | 33283 |
| HPV18 | E2 | NISKSKAH | 67 | 8 | | 33284 |
| HPV18 | E2 | NISKSKAHK | 67 | 9 | | 33285 |
| HPV18 | E2 | NISKSKAHKA | 67 | 10 | | 33286 |
| HPV18 | E2 | NSLKCLRY | 297 | 8 | | 33287 |
| HPV18 | E2 | NSLKCLRYR | 297 | 9 | | 33288 |
| HPV18 | E2 | NSLKCLRYRLR | 297 | 11 | | 33289 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E2 | NTEPTHCF | 107 | 8 | | 33290 |
| HPV18 | E2 | NTEPTHCFK | 107 | 9 | | 33291 |
| HPV18 | E2 | NTEPTHCFKK | 107 | 10 | | 33292 |
| HPV18 | E2 | NTFYIEFK | 170 | 8 | | 33293 |
| HPV18 | E2 | NTGTWEVH | 185 | 8 | | 33294 |
| HPV18 | E2 | NTGTWEVHF | 185 | 9 | | 33295 |
| HPV18 | E2 | NTTPIIHLK | 285 | 9 | | 33296 |
| HPV18 | E2 | PAYNISKSK | 64 | 9 | | 33297 |
| HPV18 | E2 | PAYNISKSKA | 64 | 10 | | 33298 |
| HPV18 | E2 | PAYNISKSKAH | 64 | 11 | | 33299 |
| HPV18 | E2 | PDSVQILVGY | 353 | 10 | | 33300 |
| HPV18 | E2 | PGHCGLAEK | 249 | 9 | | 33301 |
| HPV18 | E2 | PGHCGLAEKQH | 249 | 11 | | 33302 |
| HPV18 | E2 | PIIHLKGDR | 288 | 9 | | 33303 |
| HPV18 | E2 | PTGNNKRR | 272 | 8 | | 33304 |
| HPV18 | E2 | PTGNNKRRK | 272 | 9 | | 33305 |
| HPV18 | E2 | PVNPLLGA | 262 | 8 | | 33306 |
| HPV18 | E2 | PVNPLLGAA | 262 | 9 | | 33307 |
| HPV18 | E2 | QDKIIDHY | 16 | 8 | | 33308 |
| HPV18 | E2 | QGLAQSRY | 84 | 8 | | 33309 |
| HPV18 | E2 | QGLAQSRYK | 84 | 9 | | 33310 |
| HPV18 | E2 | QIQYWQLIR | 33 | 9 | | 33311 |
| HPV18 | E2 | QLIRWENA | 38 | 8 | | 33312 |
| HPV18 | E2 | QLIRWENAIF | 38 | 10 | | 33313 |
| HPV18 | E2 | QLIRWENAIFF | 38 | 11 | | 33314 |
| HPV18 | E2 | QLQHTPSPY | 220 | 9 | | 33315 |
| HPV18 | E2 | QLVKQLQH | 216 | 8 | | 33316 |
| HPV18 | E2 | QMALQGLA | 80 | 8 | | 33317 |
| HPV18 | E2 | QMALQGLAQSR | 80 | 11 | | 33318 |
| HPV18 | E2 | QTLNHQVVPA | 56 | 10 | | 33319 |
| HPV18 | E2 | QTLNHQVVPAY | 56 | 11 | | 33320 |
| HPV18 | E2 | QTPKETLSER | 2 | 10 | | 33321 |
| HPV18 | E2 | QTSAATRPGH | 242 | 10 | | 33322 |
| HPV18 | E2 | QTVQVYFDGNK | 119 | 11 | | 33323 |
| HPV18 | E2 | QVVPAYNISK | 61 | 10 | | 33324 |
| HPV18 | E2 | QVYFDGNK | 122 | 8 | | 33325 |
| HPV18 | E2 | RDISSTWH | 314 | 8 | | 33326 |
| HPV18 | E2 | RGLYYVKEGY | 160 | 10 | | 33327 |
| HPV18 | E2 | RLRKHSDH | 305 | 8 | | 33328 |
| HPV18 | E2 | RLRKHSDHY | 305 | 9 | | 33329 |
| HPV18 | E2 | RLRKHSDHYR | 305 | 10 | | 33330 |
| HPV18 | E2 | RLSCVQDK | 11 | 8 | | 33331 |
| HPV18 | E2 | RTKFLNTVA | 343 | 9 | | 33332 |
| HPV18 | E2 | SAATRPGH | 244 | 8 | | 33333 |
| HPV18 | E2 | SATQLVKQLQH | 213 | 11 | | 33334 |
| HPV18 | E2 | SCVQDKIIDH | 13 | 10 | | 33335 |
| HPV18 | E2 | SCVQDKIIDHY | 13 | 11 | | 33336 |
| HPV18 | E2 | SGNTTPIIH | 283 | 9 | | 33337 |
| HPV18 | E2 | SGNTTPIIHLK | 283 | 11 | | 33338 |
| HPV18 | E2 | SLKCLRYR | 298 | 8 | | 33339 |
| HPV18 | E2 | SLKCLRYRLR | 298 | 10 | | 33340 |
| HPV18 | E2 | SLKCLRYRLRK | 298 | 11 | | 33341 |
| HPV18 | E2 | SSTVSVGTA | 229 | 9 | | 33342 |
| HPV18 | E2 | SSTVSVGTAK | 229 | 10 | | 33343 |
| HPV18 | E2 | SSTWHWTGA | 317 | 9 | | 33344 |
| HPV18 | E2 | STSDDTVSA | 206 | 9 | | 33345 |
| HPV18 | E2 | STVSVGTA | 230 | 8 | | 33346 |
| HPV18 | E2 | STVSVGTAK | 230 | 9 | | 33347 |
| HPV18 | E2 | STVSVGTAKTY | 230 | 11 | | 33348 |
| HPV18 | E2 | STWHWTGA | 318 | 8 | | 33349 |
| HPV18 | E2 | SVGTAKTY | 233 | 8 | | 33350 |
| HPV18 | E2 | SVQILVGY | 355 | 8 | | 33351 |
| HPV18 | E2 | SVYYMTDA | 140 | 8 | | 33352 |
| HPV18 | E2 | TAKTYGQTSA | 236 | 10 | | 33353 |
| HPV18 | E2 | TAKTYGQTSAA | 236 | 11 | | 33354 |
| HPV18 | E2 | TATCVSHR | 153 | 8 | | 33355 |
| HPV18 | E2 | TATCVSHRGLY | 153 | 11 | | 33356 |
| HPV18 | E2 | TCVSHRGLY | 155 | 9 | | 33357 |
| HPV18 | E2 | TCVSHRGLYY | 155 | 10 | | 33358 |
| HPV18 | E2 | TDAGTWDK | 145 | 8 | | 33359 |
| HPV18 | E2 | TDAGTWDKTA | 145 | 10 | | 33360 |
| HPV18 | E2 | TGILTVTY | 330 | 8 | | 33361 |
| HPV18 | E2 | TGILTVTYH | 330 | 9 | | 33362 |
| HPV18 | E2 | TGNNKRRK | 273 | 8 | | 33363 |
| HPV18 | E2 | TGTWEVHF | 186 | 8 | | 33364 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E2 | TLNHQVVPA | 57 | 9 | | 33365 |
| HPV18 | E2 | TLNHQVVPAY | 57 | 10 | | 33366 |
| HPV18 | E2 | TSAATRPGH | 243 | 9 | | 33367 |
| HPV18 | E2 | TSDDTVSA | 207 | 8 | | 33368 |
| HPV18 | E2 | TTPIIHLK | 286 | 8 | | 33369 |
| HPV18 | E2 | TTPIIHLKGDR | 286 | 11 | | 33370 |
| HPV18 | E2 | TVQVYFDGNK | 120 | 10 | | 33371 |
| HPV18 | E2 | TVSATQLVK | 211 | 9 | | 33372 |
| HPV18 | E2 | TVSVGTAK | 231 | 8 | | 33373 |
| HPV18 | E2 | TVSVGTAKTY | 231 | 10 | | 33374 |
| HPV18 | E2 | TVTYHSETQR | 334 | 10 | | 33375 |
| HPV18 | E2 | VAWDSVYY | 136 | 8 | | 33376 |
| HPV18 | E2 | VSATQLVK | 212 | 8 | | 33377 |
| HPV18 | E2 | VSHRGLYY | 157 | 8 | | 33378 |
| HPV18 | E2 | VSHRGLYYVK | 157 | 10 | | 33379 |
| HPV18 | E2 | VSVGTAKTY | 232 | 9 | | 33380 |
| HPV18 | E2 | VTYHSETQR | 335 | 9 | | 33381 |
| HPV18 | E2 | VTYHSETQRTK | 335 | 11 | | 33382 |
| HPV18 | E2 | VVPAYNISK | 62 | 9 | | 33383 |
| HPV18 | E2 | VVPAYNISKSK | 62 | 11 | | 33384 |
| HPV18 | E2 | WDKTATCVSH | 150 | 10 | | 33385 |
| HPV18 | E2 | WDKTATCVSHR | 150 | 11 | | 33386 |
| HPV18 | E2 | WDSVYYMTDA | 138 | 10 | | 33387 |
| HPV18 | E2 | WTGAGNEK | 322 | 8 | | 33388 |
| HPV18 | E2 | YGNTGTWEVH | 183 | 10 | | 33389 |
| HPV18 | E2 | YGNTGTWEVHF | 183 | 11 | | 33390 |
| HPV18 | E2 | YGQTSAATR | 240 | 9 | | 33391 |
| HPV18 | E2 | YIEFKSECEK | 173 | 10 | | 33392 |
| HPV18 | E2 | YIEFKSECEKY | 173 | 11 | | 33393 |
| HPV18 | E2 | YMTDAGTWDK | 143 | 10 | | 33394 |
| HPV18 | E2 | YSSTVSVGTA | 228 | 10 | | 33395 |
| HPV18 | E2 | YSSTVSVGTAK | 228 | 11 | | 33396 |
| HPV18 | E2 | YVAWDSVY | 135 | 8 | | 33397 |
| HPV18 | E2 | YVAWDSVYY | 135 | 9 | | 33398 |
| HPV18 | E2 | YVKEGYNTF | 164 | 9 | | 33399 |
| HPV18 | E2 | YVKEGYNTFY | 164 | 10 | | 33400 |
| HPV18 | E5 | AFTVYVFCF | 49 | 9 | | 33401 |
| HPV18 | E5 | ATAFTVYVF | 47 | 9 | | 33402 |
| HPV18 | E5 | ATAFTVYVFCF | 47 | 11 | | 33403 |
| HPV18 | E5 | CAYAWVLVF | 29 | 9 | | 33404 |
| HPV18 | E5 | CAYAWVLVFVY | 29 | 11 | | 33405 |
| HPV18 | E5 | CFCVCMYVCCH | 9 | 11 | | 33406 |
| HPV18 | E5 | CFLLPMLLLH | 56 | 10 | | 33407 |
| HPV18 | E5 | CMCAYAWVLVF | 27 | 11 | | 33408 |
| HPV18 | E5 | CVCMYVCCH | 11 | 9 | | 33409 |
| HPV18 | E5 | FCFCVCMY | 8 | 8 | | 33410 |
| HPV18 | E5 | FCFLLPMLLLH | 55 | 11 | | 33411 |
| HPV18 | E5 | FCVCMYVCCH | 10 | 10 | | 33412 |
| HPV18 | E5 | FLFCFCVCMY | 6 | 10 | | 33413 |
| HPV18 | E5 | FLLPMLLLH | 57 | 9 | | 33414 |
| HPV18 | E5 | FLLPMLLLHIH | 57 | 11 | | 33415 |
| HPV18 | E5 | FTVYVFCF | 50 | 8 | | 33416 |
| HPV18 | E5 | FVYIVVITSPA | 37 | 11 | | 33417 |
| HPV18 | E5 | IFLFCFCVCMY | 5 | 11 | | 33418 |
| HPV18 | E5 | ITSPATAF | 43 | 8 | | 33419 |
| HPV18 | E5 | ITSPATAFTVY | 43 | 11 | | 33420 |
| HPV18 | E5 | IVVITSPA | 40 | 8 | | 33421 |
| HPV18 | E5 | IVVITSPATA | 40 | 10 | | 33422 |
| HPV18 | E5 | IVVITSPATAF | 40 | 11 | | 33423 |
| HPV18 | E5 | LFCFCVCMY | 7 | 9 | | 33424 |
| HPV18 | E5 | LLPMLLLH | 58 | 8 | | 33425 |
| HPV18 | E5 | LLPMLLLHIH | 58 | 10 | | 33426 |
| HPV18 | E5 | LLPMLLLHIHA | 58 | 11 | | 33427 |
| HPV18 | E5 | LLPSVCMCA | 22 | 9 | | 33428 |
| HPV18 | E5 | LLPSVCMCAY | 22 | 10 | | 33429 |
| HPV18 | E5 | LLPSVCMCAYA | 22 | 11 | | 33430 |
| HPV18 | E5 | LSLIFLFCF | 2 | 9 | | 33431 |
| HPV18 | E5 | MCAYAWVLVF | 28 | 10 | | 33432 |
| HPV18 | E5 | MLLLHIHA | 61 | 8 | | 33433 |
| HPV18 | E5 | MLSLIFLF | 1 | 8 | | 33434 |
| HPV18 | E5 | MLSLIFLFCF | 1 | 10 | | 33435 |
| HPV18 | E5 | PATAFTVY | 46 | 8 | | 33436 |
| HPV18 | E5 | PATAFTVYVF | 46 | 10 | | 33437 |
| HPV18 | E5 | PLLPSVCMCA | 21 | 10 | | 33438 |
| HPV18 | E5 | PLLPSVCMCAY | 21 | 11 | | 33439 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E5 | PMLLLHIH | 60 | 8 | | 33440 |
| HPV18 | E5 | PMLLLHIHA | 60 | 9 | | 33441 |
| HPV18 | E5 | PSVCMCAY | 24 | 8 | | 33442 |
| HPV18 | E5 | PSVCMCAYA | 24 | 9 | | 33443 |
| HPV18 | E5 | SLIFLFCF | 3 | 8 | | 33444 |
| HPV18 | E5 | SVCMCAYA | 25 | 8 | | 33445 |
| HPV18 | E5 | TAFTVYVF | 48 | 8 | | 33446 |
| HPV18 | E5 | TAFTVYVFCF | 48 | 10 | | 33447 |
| HPV18 | E5 | TSPATAFTVY | 44 | 10 | | 33448 |
| HPV18 | E5 | VCMYVCCH | 12 | 8 | | 33449 |
| HPV18 | E5 | VITSPATA | 42 | 8 | | 33450 |
| HPV18 | E5 | VITSPATAF | 42 | 9 | | 33451 |
| HPV18 | E5 | VVITSPATA | 41 | 9 | | 33452 |
| HPV18 | E5 | VVITSPATAF | 41 | 10 | | 33453 |
| HPV18 | E5 | YAWVLVFVY | 31 | 9 | | 33454 |
| HPV18 | E5 | YIVVITSPA | 39 | 9 | | 33455 |
| HPV18 | E5 | YIVVITSPATA | 39 | 11 | | 33456 |
| HPV18 | E6 | AACHKCIDF | 63 | 9 | | 33457 |
| HPV18 | E6 | AACHKCIDFY | 63 | 10 | | 33458 |
| HPV18 | E6 | ACHKCIDF | 64 | 8 | | 33459 |
| HPV18 | E6 | ACHKCIDFY | 64 | 9 | | 33460 |
| HPV18 | E6 | ACHKCIDFYSR | 64 | 11 | | 33461 |
| HPV18 | E6 | AFKDLFVVY | 48 | 9 | | 33462 |
| HPV18 | E6 | AFKDLFVVYR | 48 | 10 | | 33463 |
| HPV18 | E6 | AGHYRGQCH | 131 | 9 | 0.0005 | 33464 |
| HPV18 | E6 | CCNRARQER | 141 | 9 | | 33465 |
| HPV18 | E6 | CIDFYSRIR | 68 | 9 | 0.0001 | 33466 |
| HPV18 | E6 | CLRCQKPLNPA | 105 | 11 | | 33467 |
| HPV18 | E6 | DFYSRIRELR | 70 | 10 | 0.0002 | 33468 |
| HPV18 | E6 | DFYSRIRELRH | 70 | 11 | | 33469 |
| HPV18 | E6 | DIEITCVY | 27 | 8 | | 33470 |
| HPV18 | E6 | DIEITCVYCK | 27 | 10 | 0.0089 | 33471 |
| HPV18 | E6 | DSIPHAACH | 58 | 9 | 0.0005 | 33472 |
| HPV18 | E6 | DSIPHAACHK | 58 | 10 | | 33473 |
| HPV18 | E6 | DSVYGDTLEK | 83 | 10 | 0.0005 | 33474 |
| HPV18 | E6 | EDPTRRPY | 5 | 8 | | 33475 |
| HPV18 | E6 | EDPTRRPYK | 5 | 9 | | 33476 |
| HPV18 | E6 | EFAFKDLF | 46 | 8 | | 33477 |
| HPV18 | E6 | EFAFKDLFVVY | 46 | 11 | | 33478 |
| HPV18 | E6 | EITCVYCK | 29 | 8 | | 33479 |
| HPV18 | E6 | ELRHYSDSVY | 77 | 10 | 0.0002 | 33480 |
| HPV18 | E6 | ELTEVFEF | 40 | 8 | | 33481 |
| HPV18 | E6 | ELTEVFEFA | 40 | 9 | | 33482 |
| HPV18 | E6 | ELTEVFEFAF | 40 | 10 | | 33483 |
| HPV18 | E6 | ELTEVFEFAFK | 40 | 11 | | 33484 |
| HPV18 | E6 | EVFEFAFK | 43 | 8 | 0.0025 | 33485 |
| HPV18 | E6 | EVFEFAFKDLF | 43 | 11 | | 33486 |
| HPV18 | E6 | FAFKDLFVVY | 47 | 10 | | 33487 |
| HPV18 | E6 | FAFKDLFVVYR | 47 | 11 | | 33488 |
| HPV18 | E6 | FVVYRDSIPH | 53 | 10 | | 33489 |
| HPV18 | E6 | FVVYRDSIPHA | 53 | 11 | | 33490 |
| HPV18 | E6 | GLYNLLIR | 97 | 8 | | 33491 |
| HPV18 | E6 | GLYNLLIRCLR | 97 | 11 | | 33492 |
| HPV18 | E6 | HAACHKCIDF | 62 | 10 | | 33493 |
| HPV18 | E6 | HAACHKCIDFY | 62 | 11 | | 33494 |
| HPV18 | E6 | HLNEKRRF | 120 | 8 | | 33495 |
| HPV18 | E6 | HLNEKRRFH | 120 | 9 | | 33496 |
| HPV18 | E6 | HSCCNRAR | 139 | 8 | | 33497 |
| HPV18 | E6 | HSCCNRARQER | 139 | 11 | | 33498 |
| HPV18 | E6 | IAGHYRGQCH | 130 | 10 | | 33499 |
| HPV18 | E6 | IDFYSRIR | 69 | 8 | | 33500 |
| HPV18 | E6 | IDFYSRIRELR | 69 | 11 | | 33501 |
| HPV18 | E6 | KCIDFYSR | 67 | 8 | | 33502 |
| HPV18 | E6 | KCIDFYSRIR | 67 | 10 | | 33503 |
| HPV18 | E6 | KDLFVVYR | 50 | 8 | | 33504 |
| HPV18 | E6 | KLRHLNEK | 117 | 8 | | 33505 |
| HPV18 | E6 | KLRHLNEKR | 117 | 9 | 0.0250 | 33506 |
| HPV18 | E6 | KLRHLNEKRR | 117 | 10 | 0.0130 | 33507 |
| HPV18 | E6 | KLRHLNEKRRF | 117 | 11 | | 33508 |
| HPV18 | E6 | KLTNTGLY | 92 | 8 | | 33509 |
| HPV18 | E6 | KTVLELTEVF | 36 | 10 | | 33510 |
| HPV18 | E6 | LFVVYRDSIPH | 52 | 11 | | 33511 |
| HPV18 | E6 | LIRCLRCQK | 102 | 9 | 0.0190 | 33512 |
| HPV18 | E6 | LLIRCLRCQK | 101 | 10 | 0.0470 | 33513 |
| HPV18 | E6 | LTEVFEFA | 41 | 8 | | 33514 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E6 | LTEVFEFAF | 41 | 9 | | 33515 |
| HPV18 | E6 | LTEVFEFAFK | 41 | 10 | 0.0001 | 33516 |
| HPV18 | E6 | MARFEDPTR | 1 | 9 | | 33517 |
| HPV18 | E6 | MARFEDPTRR | 1 | 10 | | 33518 |
| HPV18 | E6 | NIAGHYRGQCH | 129 | 11 | | 33519 |
| HPV18 | E6 | NLLIRCLR | 100 | 8 | | 33520 |
| HPV18 | E6 | NLLIRCLRCQK | 100 | 11 | | 33521 |
| HPV18 | E6 | NTGLYNLLIR | 95 | 10 | 0.0002 | 33522 |
| HPV18 | E6 | PAEKLRHLNEK | 114 | 11 | | 33523 |
| HPV18 | E6 | PLNPAEKLR | 111 | 9 | 0.0002 | 33524 |
| HPV18 | E6 | PLNPAEKLRH | 111 | 10 | | 33525 |
| HPV18 | E6 | QCHSCCNR | 137 | 8 | | 33526 |
| HPV18 | E6 | QCHSCCNRA | 137 | 9 | | 33527 |
| HPV18 | E6 | QCHSCCNRAR | 137 | 10 | | 33528 |
| HPV18 | E6 | QDIEITCVY | 26 | 9 | | 33529 |
| HPV18 | E6 | QDIEITCVYCK | 26 | 11 | | 33530 |
| HPV18 | E6 | RARQERLQR | 144 | 9 | 0.0007 | 33531 |
| HPV18 | E6 | RARQERLQRR | 144 | 10 | | 33532 |
| HPV18 | E6 | RARQERLQRRR | 144 | 11 | | 33533 |
| HPV18 | E6 | RCQKPLNPA | 107 | 9 | | 33534 |
| HPV18 | E6 | RCQKPLNPAEK | 107 | 11 | | 33535 |
| HPV18 | E6 | RDSIPHAA | 57 | 8 | | 33536 |
| HPV18 | E6 | RDSIPHAACH | 57 | 10 | | 33537 |
| HPV18 | E6 | RDSIPHAACHK | 57 | 11 | | 33538 |
| HPV18 | E6 | RFEDPTRR | 3 | 8 | | 33539 |
| HPV18 | E6 | RFEDPTRRPY | 3 | 10 | 0.0002 | 33540 |
| HPV18 | E6 | RFEDPTRRPYK | 3 | 11 | | 33541 |
| HPV18 | E6 | RFHNIAGH | 126 | 8 | | 33542 |
| HPV18 | E6 | RFHNIAGHY | 126 | 9 | 0.0005 | 33543 |
| HPV18 | E6 | RFHNIAGHYR | 126 | 10 | 0.0023 | 33544 |
| HPV18 | E6 | RGQCHSCCNR | 135 | 10 | | 33545 |
| HPV18 | E6 | RGQCHSCCNRA | 135 | 11 | | 33546 |
| HPV18 | E6 | RIRELRHY | 74 | 8 | | 33547 |
| HPV18 | E6 | SCCNRARQER | 140 | 10 | | 33548 |
| HPV18 | E6 | SDSVYGDTLEK | 82 | 11 | | 33549 |
| HPV18 | E6 | SIPHAACH | 59 | 8 | | 33550 |
| HPV18 | E6 | SIPHAACHK | 59 | 9 | 0.0170 | 33551 |
| HPV18 | E6 | SLQDIEITCVY | 24 | 11 | | 33552 |
| HPV18 | E6 | SVYGDTLEK | 84 | 9 | 0.0800 | 33553 |
| HPV18 | E6 | TGLYNLLIR | 96 | 9 | 0.0005 | 33554 |
| HPV18 | E6 | TLEKLTNTGLY | 89 | 11 | 0.0003 | 33555 |
| HPV18 | E6 | TVLELTEVF | 37 | 9 | | 33556 |
| HPV18 | E6 | TVLELTEVFEF | 37 | 11 | | 33557 |
| HPV18 | E6 | VFEFAFKDLF | 44 | 10 | 0.0001 | 33558 |
| HPV18 | E6 | VLELTEVF | 38 | 8 | | 33559 |
| HPV18 | E6 | VLELTEVFEF | 38 | 10 | | 33560 |
| HPV18 | E6 | VLELTEVFEFA | 38 | 11 | | 33561 |
| HPV18 | E6 | VVYRDSIPH | 54 | 9 | 0.1200 | 33562 |
| HPV18 | E6 | VVYRDSIPHA | 54 | 10 | | 33563 |
| HPV18 | E6 | VVYRDSIPHAA | 54 | 11 | | 33564 |
| HPV18 | E6 | YSRIRELR | 72 | 8 | | 33565 |
| HPV18 | E6 | YSRIRELRH | 72 | 9 | | 33566 |
| HPV18 | E6 | YSRIRELRHY | 72 | 10 | 0.0001 | 33567 |
| HPV18 | E7 | ADDLRAFQQLF | 80 | 11 | | 33568 |
| HPV18 | E7 | ATLQDIVLH | 6 | 9 | | 33569 |
| HPV18 | E7 | CCKCEARIK | 65 | 9 | | 33570 |
| HPV18 | E7 | CMCCKCEA | 63 | 8 | | 33571 |
| HPV18 | E7 | CMCCKCEAR | 63 | 9 | | 33572 |
| HPV18 | E7 | CMCCKCEARIK | 63 | 11 | 0.0014 | 33573 |
| HPV18 | E7 | DDLRAFQQLF | 81 | 10 | | 33574 |
| HPV18 | E7 | DGVNHQHLPA | 42 | 10 | | 33575 |
| HPV18 | E7 | DGVNHQHLPAR | 42 | 11 | | 33576 |
| HPV18 | E7 | DLRAFQQLF | 82 | 9 | | 33577 |
| HPV18 | E7 | EIDGVNHQH | 40 | 9 | | 33578 |
| HPV18 | E7 | EIPVDLLCH | 20 | 9 | | 33579 |
| HPV18 | E7 | ESSADDLR | 77 | 8 | | 33580 |
| HPV18 | E7 | ESSADDLRA | 77 | 9 | | 33581 |
| HPV18 | E7 | ESSADDLRAF | 77 | 10 | | 33582 |
| HPV18 | E7 | GVNHQHLPA | 43 | 9 | | 33583 |
| HPV18 | E7 | GVNHQHLPAR | 43 | 10 | | 33584 |
| HPV18 | E7 | GVNHQHLPARR | 43 | 11 | | 33585 |
| HPV18 | E7 | HLPARRAEPQR | 48 | 11 | | 33586 |
| HPV18 | E7 | HTMLCMCCK | 59 | 9 | 0.0640 | 33587 |
| HPV18 | E7 | IDGVNHQH | 41 | 8 | | 33588 |
| HPV18 | E7 | IDGVNHQHLPA | 41 | 11 | | 33589 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | E7 | KATLQDIVLH | 5 | 10 | | 33590 |
| HPV18 | E7 | KLVVESSA | 73 | 8 | | 33591 |
| HPV18 | E7 | LCMCCKCEA | 62 | 9 | | 33592 |
| HPV18 | E7 | LCMCCKCEAR | 62 | 10 | | 33593 |
| HPV18 | E7 | LFLNTLSF | 89 | 8 | | 33594 |
| HPV18 | E7 | LSFVCPWCA | 94 | 9 | 0.0005 | 33595 |
| HPV18 | E7 | LVVESSADDLR | 74 | 11 | | 33596 |
| HPV18 | E7 | MCCKCEAR | 64 | 8 | | 33597 |
| HPV18 | E7 | MCCKCEARIK | 64 | 10 | | 33598 |
| HPV18 | E7 | MLCMCCKCEA | 61 | 10 | | 33599 |
| HPV18 | E7 | MLCMCCKCEAR | 61 | 11 | | 33600 |
| HPV18 | E7 | NDEIDGVNH | 38 | 9 | | 33601 |
| HPV18 | E7 | NDEIDGVNHQH | 38 | 11 | | 33602 |
| HPV18 | E7 | NTLSFVCPWCA | 92 | 11 | | 33603 |
| HPV18 | E7 | PARRAEPQR | 50 | 9 | | 33604 |
| HPV18 | E7 | PARRAEPQRH | 50 | 10 | | 33605 |
| HPV18 | E7 | QLFLNTLSF | 88 | 9 | 0.0005 | 33606 |
| HPV18 | E7 | RIKLVVESSA | 71 | 10 | 0.0005 | 33607 |
| HPV18 | E7 | SADDLRAF | 79 | 8 | | 33608 |
| HPV18 | E7 | SFVCPWCA | 95 | 8 | | 33609 |
| HPV18 | E7 | SSADDLRA | 78 | 8 | | 33610 |
| HPV18 | E7 | SSADDLRAF | 78 | 9 | | 33611 |
| HPV18 | E7 | TLQDIVLH | 7 | 8 | | 33612 |
| HPV18 | E7 | TLSFVCPWCA | 93 | 10 | | 33613 |
| HPV18 | E7 | TMLCMCCK | 60 | 8 | 0.0240 | 33614 |
| HPV18 | E7 | TMLCMCCKCEA | 60 | 11 | | 33615 |
| HPV18 | E7 | VVESSADDLR | 75 | 10 | | 33616 |
| HPV18 | E7 | VVESSADDLRA | 75 | 11 | | 33617 |
| HPV18 | L1 | AAPAENKDPY | 494 | 10 | | 33618 |
| HPV18 | L1 | AATSNVSEDVR | 195 | 11 | | 33619 |
| HPV18 | L1 | ACAGVEIGR | 162 | 9 | | 33620 |
| HPV18 | L1 | ADPYGDSMF | 300 | 9 | | 33621 |
| HPV18 | L1 | ADPYGDSMFF | 300 | 10 | | 33622 |
| HPV18 | L1 | ADVMSYIH | 447 | 8 | | 33623 |
| HPV18 | L1 | AGGGNKQDIPK | 115 | 11 | | 33624 |
| HPV18 | L1 | AIGEHWAK | 225 | 8 | | 33625 |
| HPV18 | L1 | AIGEHWAKGTA | 225 | 11 | | 33626 |
| HPV18 | L1 | AITCQKDA | 487 | 8 | | 33627 |
| HPV18 | L1 | AITCQKDAA | 487 | 9 | | 33628 |
| HPV18 | L1 | AITCQKDAAPA | 487 | 11 | | 33629 |
| HPV18 | L1 | ALWRPSDNTVY | 63 | 11 | | 33630 |
| HPV18 | L1 | AMDFSTLQDTK | 268 | 11 | | 33631 |
| HPV18 | L1 | ASPGSCVY | 345 | 8 | | 33632 |
| HPV18 | L1 | ASTQSPVPGQY | 407 | 11 | | 33633 |
| HPV18 | L1 | ATKFKQYSR | 419 | 9 | | 33634 |
| HPV18 | L1 | ATKFKQYSRH | 419 | 10 | | 33635 |
| HPV18 | L1 | ATSNVSEDVR | 196 | 10 | | 33636 |
| HPV18 | L1 | ATTSSKPA | 552 | 8 | | 33637 |
| HPV18 | L1 | ATTSSKPAK | 552 | 9 | | 33638 |
| HPV18 | L1 | ATTSSKPAKR | 552 | 10 | | 33639 |
| HPV18 | L1 | CAGVEIGR | 163 | 8 | | 33640 |
| HPV18 | L1 | CAPAIGEH | 222 | 8 | | 33641 |
| HPV18 | L1 | CAPAIGEHWA | 222 | 10 | | 33642 |
| HPV18 | L1 | CAPAIGEHWAK | 222 | 11 | | 33643 |
| HPV18 | L1 | CGHYIILF | 42 | 8 | | 33644 |
| HPV18 | L1 | CGHYIILFLR | 42 | 10 | | 33645 |
| HPV18 | L1 | CILGCAPA | 218 | 8 | | 33646 |
| HPV18 | L1 | CLRREQLF | 310 | 8 | | 33647 |
| HPV18 | L1 | CLRREQLFA | 310 | 9 | | 33648 |
| HPV18 | L1 | CLRREQLFAR | 310 | 10 | | 33649 |
| HPV18 | L1 | CLRREQLFARH | 310 | 11 | | 33650 |
| HPV18 | L1 | CLYTRVLILH | 2 | 10 | | 33651 |
| HPV18 | L1 | CLYTRVLILHY | 2 | 11 | | 33652 |
| HPV18 | L1 | DAAPAENK | 493 | 8 | | 33653 |
| HPV18 | L1 | DAAPAENKDPY | 493 | 11 | | 33654 |
| HPV18 | L1 | DATKFKQY | 418 | 8 | | 33655 |
| HPV18 | L1 | DATKFKQYSR | 418 | 10 | | 33656 |
| HPV18 | L1 | DATKFKQYSRH | 418 | 11 | | 33657 |
| HPV18 | L1 | DCPPLELK | 245 | 8 | | 33658 |
| HPV18 | L1 | DDTESSHA | 188 | 8 | | 33659 |
| HPV18 | L1 | DDTESSHAA | 188 | 9 | | 33660 |
| HPV18 | L1 | DDYVTPTSIF | 86 | 10 | | 33661 |
| HPV18 | L1 | DDYVTPTSIFY | 86 | 11 | | 33662 |
| HPV18 | L1 | DFSTLQDTK | 270 | 9 | | 33663 |
| HPV18 | L1 | DGDMVDTGY | 258 | 9 | | 33664 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | L1 | DGDMVDTGYGA | 258 | 11 | | 33665 |
| HPV18 | L1 | DICQSICK | 284 | 8 | | 33666 |
| HPV18 | L1 | DICQSICKY | 284 | 9 | | 33667 |
| HPV18 | L1 | DIPKVSAY | 122 | 8 | | 33668 |
| HPV18 | L1 | DIPKVSAYQY | 122 | 10 | | 33669 |
| HPV18 | L1 | DIPKVSAYQYR | 122 | 11 | | 33670 |
| HPV18 | L1 | DLDQYPLGR | 520 | 9 | | 33671 |
| HPV18 | L1 | DLDQYPLGRK | 520 | 10 | | 33672 |
| HPV18 | L1 | DLDQYPLGRKF | 520 | 11 | | 33673 |
| HPV18 | L1 | DMVDTGYGA | 260 | 9 | | 33674 |
| HPV18 | L1 | DSMFFCLR | 305 | 8 | | 33675 |
| HPV18 | L1 | DSMFFCLRR | 305 | 9 | | 33676 |
| HPV18 | L1 | DSQLFNKPY | 364 | 9 | | 33677 |
| HPV18 | L1 | DTESSHAA | 189 | 8 | | 33678 |
| HPV18 | L1 | DTGYGAMDF | 263 | 9 | | 33679 |
| HPV18 | L1 | DTSIYNPETQR | 148 | 11 | | 33680 |
| HPV18 | L1 | DTVPQSLY | 330 | 8 | | 33681 |
| HPV18 | L1 | DTVPQSLYIK | 330 | 10 | | 33682 |
| HPV18 | L1 | DTYRFVQSVA | 478 | 10 | | 33683 |
| HPV18 | L1 | DVRDNVSVDY | 203 | 10 | | 33684 |
| HPV18 | L1 | DVRDNVSVDYK | 203 | 11 | | 33685 |
| HPV18 | L1 | EDGDMVDTGY | 257 | 10 | | 33686 |
| HPV18 | L1 | EDVRDNVSVDY | 202 | 11 | | 33687 |
| HPV18 | L1 | ETQRLVWA | 155 | 8 | | 33688 |
| HPV18 | L1 | ETQRLVWACA | 155 | 10 | | 33689 |
| HPV18 | L1 | FARHFWNR | 317 | 8 | | 33690 |
| HPV18 | L1 | FARHFWNRA | 317 | 9 | | 33691 |
| HPV18 | L1 | FCLRREQLF | 309 | 9 | | 33692 |
| HPV18 | L1 | FCLRREQLFA | 309 | 10 | | 33693 |
| HPV18 | L1 | FCLRREQLFAR | 309 | 11 | | 33694 |
| HPV18 | L1 | FFCLRREQLF | 308 | 10 | | 33695 |
| HPV18 | L1 | FFCLRREQLFA | 308 | 11 | | 33696 |
| HPV18 | L1 | FGLPDTSIY | 144 | 9 | | 33697 |
| HPV18 | L1 | FLQMALWR | 59 | 8 | | 33698 |
| HPV18 | L1 | FLRNVNVF | 49 | 8 | | 33699 |
| HPV18 | L1 | FLRNVNVFPIF | 49 | 11 | | 33700 |
| HPV18 | L1 | FLVQAGLR | 530 | 8 | | 33701 |
| HPV18 | L1 | FLVQAGLRR | 530 | 9 | | 33702 |
| HPV18 | L1 | FLVQAGLRRK | 530 | 10 | | 33703 |
| HPV18 | L1 | FSLDLDQY | 517 | 8 | | 33704 |
| HPV18 | L1 | FSTLQDTK | 271 | 8 | | 33705 |
| HPV18 | L1 | FVQSVAITCQK | 482 | 11 | | 33706 |
| HPV18 | L1 | GCAPAIGEH | 221 | 9 | | 33707 |
| HPV18 | L1 | GCAPAIGEHWA | 221 | 11 | | 33708 |
| HPV18 | L1 | GDCPPLELK | 244 | 9 | | 33709 |
| HPV18 | L1 | GDMVDTGY | 259 | 8 | | 33710 |
| HPV18 | L1 | QDMVDTGYGA | 259 | 10 | | 33711 |
| HPV18 | L1 | GDSMFFCLR | 304 | 9 | | 33712 |
| HPV18 | L1 | GDSMFFCLRR | 304 | 10 | | 33713 |
| HPV18 | L1 | GDTVPQSLY | 329 | 9 | | 33714 |
| HPV18 | L1 | GDTVPQSLYIK | 329 | 11 | | 33715 |
| HPV18 | L1 | GGGNKQDIPK | 116 | 10 | | 33716 |
| HPV18 | L1 | GGNKQDIPK | 117 | 9 | | 33717 |
| HPV18 | L1 | GLPDTSIY | 145 | 8 | | 33718 |
| HPV18 | L1 | GLRRKPTIGPR | 535 | 11 | | 33719 |
| HPV18 | L1 | GLSGHPFY | 177 | 8 | | 33720 |
| HPV18 | L1 | GLSGHPFYNK | 177 | 10 | | 33721 |
| HPV18 | L1 | GMPASPGSCVY | 342 | 11 | | 33722 |
| HPV18 | L1 | GSIVTSDSQLF | 358 | 11 | | 33723 |
| HPV18 | L1 | GVCWHNQLF | 383 | 9 | | 33724 |
| HPV18 | L1 | GVGLSGHPF | 175 | 9 | | 33725 |
| HPV18 | L1 | GVGLSGHPFY | 175 | 10 | | 33726 |
| HPV18 | L1 | HIIICGHY | 38 | 8 | | 33727 |
| HPV18 | L1 | HLLPLYGPLY | 13 | 10 | | 33728 |
| HPV18 | L1 | HLLPLYGPLYH | 13 | 11 | | 33729 |
| HPV18 | L1 | HSILVYMVH | 30 | 9 | | 33730 |
| HPV18 | L1 | HVEEYDLQF | 428 | 9 | | 33731 |
| HPV18 | L1 | HVEEYDLQFIF | 428 | 11 | | 33732 |
| HPV18 | L1 | ICGHYIILF | 41 | 9 | | 33733 |
| HPV18 | L1 | ICGHYIILFLR | 41 | 11 | | 33734 |
| HPV18 | L1 | ICQSICKY | 285 | 8 | | 33735 |
| HPV18 | L1 | ICQSICKYPDY | 285 | 11 | | 33736 |
| HPV18 | L1 | IFLQMALWR | 58 | 9 | | 33737 |
| HPV18 | L1 | IFQLCTITLTA | 437 | 11 | | 33738 |
| HPV18 | L1 | IFYHAGSSR | 94 | 9 | | 33739 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | L1 | IGEHWAKGTA | 226 | 10 | | 33740 |
| HPV18 | L1 | IGPRKRSA | 542 | 9 | | 33741 |
| HPV18 | L1 | IGPRKRSAPSA | 542 | 11 | | 33742 |
| HPV18 | L1 | IICGHYIILF | 40 | 10 | | 33743 |
| HPV18 | L1 | IIICGHYIILF | 39 | 11 | | 33744 |
| HPV18 | L1 | IILFLRNVNVF | 46 | 11 | | 33745 |
| HPV18 | L1 | ILFLRNVNVF | 47 | 10 | | 33746 |
| HPV18 | L1 | ILGCAPAIGEH | 219 | 11 | | 33747 |
| HPV18 | L1 | ILHYHLLPLY | 9 | 10 | | 33748 |
| HPV18 | L1 | ITCQKDAA | 488 | 8 | | 33749 |
| HPV18 | L1 | ITCQKDAAPA | 488 | 10 | | 33750 |
| HPV18 | L1 | ITLTADVMSY | 443 | 10 | | 33751 |
| HPV18 | L1 | IVTSDSQLF | 360 | 9 | | 33752 |
| HPV18 | L1 | IVTSDSQLFNK | 360 | 11 | | 33753 |
| HPV18 | L1 | KDAAPAENK | 492 | 9 | | 33754 |
| HPV18 | L1 | KDPYDKLK | 500 | 8 | | 33755 |
| HPV18 | L1 | KDPYDKLKF | 500 | 9 | | 33756 |
| HPV18 | L1 | KFGLPDTSIY | 143 | 10 | | 33757 |
| HPV18 | L1 | KFKQYSRH | 421 | 8 | | 33758 |
| HPV18 | L1 | KFLVQAGLR | 529 | 9 | | 33759 |
| HPV18 | L1 | KFLVQAGLRR | 529 | 10 | | 33760 |
| HPV18 | L1 | KFLVQAGLRRK | 529 | 11 | | 33761 |
| HPV18 | L1 | KFSLDLDQY | 516 | 9 | | 33762 |
| HPV18 | L1 | KFWNVDLK | 507 | 8 | | 33763 |
| HPV18 | L1 | KFWNVDLKEK | 507 | 10 | | 33764 |
| HPV18 | L1 | KFWNVDLKEKF | 507 | 11 | | 33765 |
| HPV18 | L1 | KGTACKSR | 232 | 8 | | 33766 |
| HPV18 | L1 | KLDDTESSH | 186 | 9 | | 33767 |
| HPV18 | L1 | KLDDTESSHA | 186 | 10 | | 33768 |
| HPV18 | L1 | KLDDTESSHAA | 186 | 11 | | 33769 |
| HPV18 | L1 | KLKFWNVDLK | 505 | 10 | | 33770 |
| HPV18 | L1 | KVSAYQYR | 125 | 8 | | 33771 |
| HPV18 | L1 | KVSAYQYRVF | 125 | 10 | | 33772 |
| HPV18 | L1 | KVSAYQYRVFR | 125 | 11 | | 33773 |
| HPV18 | L1 | LCILGCAPA | 217 | 9 | | 33774 |
| HPV18 | L1 | LCTITLTA | 440 | 8 | | 33775 |
| HPV18 | L1 | LDDTESSH | 187 | 8 | | 33776 |
| HPV18 | L1 | LDDTESSHA | 187 | 9 | | 33777 |
| HPV18 | L1 | LDDTESSHAA | 187 | 10 | | 33778 |
| HPV18 | L1 | LDICQSICK | 283 | 9 | | 33779 |
| HPV18 | L1 | LDICQSICKY | 283 | 10 | | 33780 |
| HPV18 | L1 | LDLDQYPLGR | 519 | 10 | | 33781 |
| HPV18 | L1 | LDLDQYPLGRK | 519 | 11 | | 33782 |
| HPV18 | L1 | LDQYPLGR | 521 | 8 | | 33783 |
| HPV18 | L1 | LDQYPLGRK | 521 | 9 | | 33784 |
| HPV18 | L1 | LDQYPLGRKF | 521 | 10 | | 33785 |
| HPV18 | L1 | LFARHFWNR | 316 | 9 | | 33786 |
| HPV18 | L1 | LFARHFWNRA | 316 | 10 | | 33787 |
| HPV18 | L1 | LFLRNVNVF | 48 | 9 | | 33788 |
| HPV18 | L1 | LFNKPYWLH | 367 | 9 | | 33789 |
| HPV18 | L1 | LFNKPYWLHK | 367 | 10 | | 33790 |
| HPV18 | L1 | LFNKPYWLHKA | 367 | 11 | | 33791 |
| HPV18 | L1 | LGCAPAIGEH | 220 | 10 | | 33792 |
| HPV18 | L1 | LGRKFLVQA | 526 | 9 | | 33793 |
| HPV18 | L1 | LGVGLSGH | 174 | 8 | | 33794 |
| HPV18 | L1 | LGVGLSGHPF | 174 | 10 | | 33795 |
| HPV18 | L1 | LGVGLSGHPFY | 174 | 11 | | 33796 |
| HPV18 | L1 | LILHYHLLPLY | 8 | 11 | | 33797 |
| HPV18 | L1 | LLPLYGPLY | 14 | 9 | | 33798 |
| HPV18 | L1 | LLPLYGPLYH | 14 | 10 | | 33799 |
| HPV18 | L1 | LLTVGNPY | 103 | 8 | | 33800 |
| HPV18 | L1 | LLTVGNPYF | 103 | 9 | | 33801 |
| HPV18 | L1 | LLTVGNPYFR | 103 | 10 | | 33802 |
| HPV18 | L1 | LSGHPFYNK | 178 | 9 | | 33803 |
| HPV18 | L1 | LTADVMSY | 445 | 8 | | 33804 |
| HPV18 | L1 | LTADVMSYIH | 445 | 10 | | 33805 |
| HPV18 | L1 | LTVGNPYF | 104 | 8 | | 33806 |
| HPV18 | L1 | LTVGNPYFR | 104 | 9 | | 33807 |
| HPV18 | L1 | LVQAGLRR | 531 | 8 | | 33808 |
| HPV18 | L1 | LVQAGLRRK | 531 | 9 | | 33809 |
| HPV18 | L1 | MCLYTRVLILH | 1 | 11 | | 33810 |
| HPV18 | L1 | MDFSTLQDTK | 269 | 10 | | 33811 |
| HPV18 | L1 | MFFCLRREQLF | 307 | 11 | | 33812 |
| HPV18 | L1 | MGDTVPQSLY | 328 | 10 | | 33813 |
| HPV18 | L1 | MSADPYGDSMF | 298 | 11 | | 33814 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | L1 | MVDTGYGA | 261 | 8 | | 33815 |
| HPV18 | L1 | MVDTGYGAMDF | 261 | 11 | | 33816 |
| HPV18 | L1 | MVHIIICGH | 36 | 9 | | 33817 |
| HPV18 | L1 | MVHIIICGHY | 36 | 10 | | 33818 |
| HPV18 | L1 | NGVCWHNQLF | 382 | 10 | | 33819 |
| HPV18 | L1 | NSSILEDWNF | 457 | 10 | | 33820 |
| HPV18 | L1 | NTVYLPPPSVA | 70 | 11 | | 33821 |
| HPV18 | L1 | NVDLKEKF | 510 | 8 | | 33822 |
| HPV18 | L1 | NVFPIFLQMA | 54 | 10 | | 33823 |
| HPV18 | L1 | NVNVFPIF | 52 | 8 | | 33824 |
| HPV18 | L1 | PAENKDPY | 496 | 8 | | 33825 |
| HPV18 | L1 | PAENKDPYDK | 496 | 10 | | 33826 |
| HPV18 | L1 | PAIGEHWA | 224 | 8 | | 33827 |
| HPV18 | L1 | PAIGEHWAK | 224 | 9 | | 33828 |
| HPV18 | L1 | PAKRVRVR | 558 | 8 | | 33829 |
| HPV18 | L1 | PAKRVRVRA | 558 | 9 | | 33830 |
| HPV18 | L1 | PAKRVRVRAR | 558 | 10 | | 33831 |
| HPV18 | L1 | PAKRVRVRARK | 558 | 11 | | 33832 |
| HPV18 | L1 | PASPGSCVY | 344 | 9 | | 33833 |
| HPV18 | L1 | PDYLQMSA | 293 | 8 | | 33834 |
| HPV18 | L1 | PDYLQMSADPY | 293 | 11 | | 33835 |
| HPV18 | L1 | PGQYDATK | 414 | 8 | | 33836 |
| HPV18 | L1 | PGQYDATKF | 414 | 9 | | 33837 |
| HPV18 | L1 | PGQYDATKFK | 414 | 10 | | 33838 |
| HPV18 | L1 | PIFLQMALWR | 57 | 10 | | 33839 |
| HPV18 | L1 | PLDICQSICK | 282 | 10 | | 33840 |
| HPV18 | L1 | PLDICQSICKY | 282 | 11 | | 33841 |
| HPV18 | L1 | PLGRKFLVQA | 525 | 10 | | 33842 |
| HPV18 | L1 | PLGVGLSGH | 173 | 9 | | 33843 |
| HPV18 | L1 | PLGVGLSGHPF | 173 | 11 | | 33844 |
| HPV18 | L1 | PLHSILVY | 28 | 8 | | 33845 |
| HPV18 | L1 | PLHSILVYMVH | 28 | 11 | | 33846 |
| HPV18 | L1 | PLPLHSILVY | 26 | 10 | | 33847 |
| HPV18 | L1 | PLYGPLYH | 16 | 8 | | 33848 |
| HPV18 | L1 | PLYGPLYHPR | 16 | 10 | | 33849 |
| HPV18 | L1 | PLYHPRPLPLH | 20 | 11 | | 33850 |
| HPV18 | L1 | PSATTSSK | 550 | 8 | | 33851 |
| HPV18 | L1 | PSATTSSKPA | 550 | 10 | | 33852 |
| HPV18 | L1 | PSATTSSKPAK | 550 | 11 | | 33853 |
| HPV18 | L1 | PSTNLTICA | 399 | 9 | | 33854 |
| HPV18 | L1 | PTIGPRKR | 540 | 8 | | 33855 |
| HPV18 | L1 | PTIGPRKRSA | 540 | 10 | | 33856 |
| HPV18 | L1 | PTSIFYHA | 91 | 8 | | 33857 |
| HPV18 | L1 | PTTSLVDTY | 472 | 9 | | 33858 |
| HPV18 | L1 | PTTSLVDTYR | 472 | 10 | | 33859 |
| HPV18 | L1 | PTTSLVDTYRF | 472 | 11 | | 33860 |
| HPV18 | L1 | PVPGQYDA | 412 | 8 | | 33861 |
| HPV18 | L1 | PVPGQYDATK | 412 | 10 | | 33862 |
| HPV18 | L1 | PVPGQYDATKF | 412 | 11 | | 33863 |
| HPV18 | L1 | QDIPKVSA | 121 | 8 | | 33864 |
| HPV18 | L1 | QDIPKVSAY | 121 | 9 | | 33865 |
| HPV18 | L1 | QDIPKVSAYQY | 121 | 11 | | 33866 |
| HPV18 | L1 | QGDCPPLELK | 243 | 10 | | 33867 |
| HPV18 | L1 | QGHNNGVCWH | 378 | 10 | | 33868 |
| HPV18 | L1 | QLCILGCA | 216 | 8 | | 33869 |
| HPV18 | L1 | QLCILGCAPA | 216 | 10 | | 33870 |
| HPV18 | L1 | QLCTITLTA | 439 | 9 | | 33871 |
| HPV18 | L1 | QLFARHFWNR | 315 | 10 | | 33872 |
| HPV18 | L1 | QLFARHFWNRA | 315 | 11 | | 33873 |
| HPV18 | L1 | QLFNKPYWLH | 366 | 10 | | 33874 |
| HPV18 | L1 | QLFNKPYWLHK | 366 | 11 | | 33875 |
| HPV18 | L1 | QLPDPNKF | 137 | 8 | | 33876 |
| HPV18 | L1 | QSICKYPDY | 287 | 9 | | 33877 |
| HPV18 | L1 | QSPVPGQY | 410 | 8 | | 33878 |
| HPV18 | L1 | QSPVPGQYDA | 410 | 10 | | 33879 |
| HPV18 | L1 | QSVAITCQK | 484 | 9 | | 33880 |
| HPV18 | L1 | QSVAITCQKDA | 484 | 11 | | 33881 |
| HPV18 | L1 | QTQLCILGCA | 214 | 10 | | 33882 |
| HPV18 | L1 | RDNVSVDY | 205 | 8 | | 33883 |
| HPV18 | L1 | RDNVSVDYK | 205 | 9 | | 33884 |
| HPV18 | L1 | RLLTVGNPY | 102 | 9 | | 33885 |
| HPV18 | L1 | RLLTVGNPYF | 102 | 10 | | 33886 |
| HPV18 | L1 | RLLTVGNPYFR | 102 | 11 | | 33887 |
| HPV18 | L1 | RSAPSATTSSK | 547 | 11 | | 33888 |
| HPV18 | L1 | RVLILHYH | 6 | 8 | | 33889 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | L1 | RVPAGGGNK | 112 | 9 | | 33890 |
| HPV18 | L1 | RVQLPDPNK | 135 | 9 | | 33891 |
| HPV18 | L1 | RVQLPDPNKF | 135 | 10 | | 33892 |
| HPV18 | L1 | RVRVRARK | 561 | 8 | | 33893 |
| HPV18 | L1 | RVVNTDDY | 81 | 8 | | 33894 |
| HPV18 | L1 | SADPYGDSMF | 299 | 10 | | 33895 |
| HPV18 | L1 | SADPYGDSMFF | 299 | 11 | | 33896 |
| HPV18 | L1 | SAPSATTSSK | 548 | 10 | | 33897 |
| HPV18 | L1 | SATTSSKPA | 551 | 9 | | 33898 |
| HPV18 | L1 | SATTSSKPAK | 551 | 10 | | 33899 |
| HPV18 | L1 | SATTSSKPAKR | 551 | 11 | | 33900 |
| HPV18 | L1 | SAYQYRVF | 127 | 8 | | 33901 |
| HPV18 | L1 | SAYQYRVFR | 127 | 9 | | 33902 |
| HPV18 | L1 | SDSQLFNK | 363 | 8 | | 33903 |
| HPV18 | L1 | SDSQLFNKPY | 363 | 10 | | 33904 |
| HPV18 | L1 | SGHPFYNK | 179 | 8 | | 33905 |
| HPV18 | L1 | SICKYPDY | 288 | 8 | | 33906 |
| HPV18 | L1 | SIFYHAGSSR | 93 | 10 | | 33907 |
| HPV18 | L1 | SILEDWNF | 459 | 8 | | 33908 |
| HPV18 | L1 | SILVYMVH | 31 | 8 | | 33909 |
| HPV18 | L1 | SIVTSDSQLF | 359 | 10 | | 33910 |
| HPV18 | L1 | SIYNPETQR | 150 | 9 | | 33911 |
| HPV18 | L1 | SLDLDQYPLGR | 518 | 11 | | 33912 |
| HPV18 | L1 | SLVDTYRF | 475 | 8 | | 33913 |
| HPV18 | L1 | SLYIKGTGMPA | 335 | 11 | | 33914 |
| HPV18 | L1 | SMFFCLRR | 306 | 8 | | 33915 |
| HPV18 | L1 | SSILEDWNF | 458 | 9 | | 33916 |
| HPV18 | L1 | SSKPAKRVR | 555 | 9 | | 33917 |
| HPV18 | L1 | SSKPAKRVRVR | 555 | 11 | | 33918 |
| HPV18 | L1 | SSRLLTVGNPY | 100 | 11 | | 33919 |
| HPV18 | L1 | STNLTICA | 400 | 8 | | 33920 |
| HPV18 | L1 | STQSPVPGQY | 408 | 10 | | 33921 |
| HPV18 | L1 | SVAITCQK | 485 | 8 | | 33922 |
| HPV18 | L1 | SVAITCQKDA | 485 | 10 | | 33923 |
| HPV18 | L1 | SVAITCQKDAA | 485 | 11 | | 33924 |
| HPV18 | L1 | SVARVVNTDDY | 78 | 11 | | 33925 |
| HPV18 | L1 | TADVMSYIH | 446 | 9 | | 33926 |
| HPV18 | L1 | TCQKDAAPA | 489 | 9 | | 33927 |
| HPV18 | L1 | TDDYVTPTSIF | 85 | 11 | | 33928 |
| HPV18 | L1 | TGYGAMDF | 264 | 8 | | 33929 |
| HPV18 | L1 | TIGPRKRSA | 541 | 9 | | 33930 |
| HPV18 | L1 | TITLTADVMSY | 442 | 11 | | 33931 |
| HPV18 | L1 | TLTADVMSY | 444 | 9 | | 33932 |
| HPV18 | L1 | TLTADVMSYIH | 444 | 11 | | 33933 |
| HPV18 | L1 | TMGDTVPQSLY | 327 | 11 | | 33934 |
| HPV18 | L1 | TSDSQLFNK | 362 | 9 | | 33935 |
| HPV18 | L1 | TSDSQLFNKPY | 362 | 11 | | 33936 |
| HPV18 | L1 | TSIFYHAGSSR | 92 | 11 | | 33937 |
| HPV18 | L1 | TSIYNPETQR | 149 | 10 | | 33938 |
| HPV18 | L1 | TSLVDTYR | 474 | 8 | | 33939 |
| HPV18 | L1 | TSLVDTYRF | 474 | 9 | | 33940 |
| HPV18 | L1 | TSNVSEDVR | 197 | 9 | | 33941 |
| HPV18 | L1 | TSSKPAKR | 554 | 8 | | 33942 |
| HPV18 | L1 | TSSKPAKRVR | 554 | 10 | | 33943 |
| HPV18 | L1 | TTPSTNLTICA | 397 | 11 | | 33944 |
| HPV18 | L1 | TTSLVDTY | 473 | 8 | | 33945 |
| HPV18 | L1 | TTSLVDTYR | 473 | 9 | | 33946 |
| HPV18 | L1 | TTSLVDTYRF | 473 | 10 | | 33947 |
| HPV18 | L1 | TTSSKPAK | 553 | 8 | | 33948 |
| HPV18 | L1 | TTSSKPAKR | 553 | 9 | | 33949 |
| HPV18 | L1 | TTSSKPAKRVR | 553 | 11 | | 33950 |
| HPV18 | L1 | TVGNPYFR | 105 | 8 | | 33951 |
| HPV18 | L1 | TVGNPYFRVPA | 105 | 11 | | 33952 |
| HPV18 | L1 | TVPQSLYIK | 331 | 9 | | 33953 |
| HPV18 | L1 | TVYLPPPSVA | 71 | 10 | | 33954 |
| HPV18 | L1 | TVYLPPPSVAR | 71 | 11 | | 33955 |
| HPV18 | L1 | VAITCQKDA | 486 | 9 | | 33956 |
| HPV18 | L1 | VAITCQKDAA | 486 | 10 | | 33957 |
| HPV18 | L1 | VARVVNTDDY | 79 | 10 | | 33958 |
| HPV18 | L1 | VCWHNQLF | 384 | 8 | | 33959 |
| HPV18 | L1 | VDTGYGAMDF | 262 | 10 | | 33960 |
| HPV18 | L1 | VDTYRFVQSVA | 477 | 11 | | 33961 |
| HPV18 | L1 | VFPIFLQMA | 55 | 9 | | 33962 |
| HPV18 | L1 | VFRVQLPDPNK | 133 | 11 | | 33963 |
| HPV18 | L1 | VGLSGHPF | 176 | 8 | | 33964 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | L1 | VGLSGHPFY | 176 | 9 | | 33965 |
| HPV18 | L1 | VGLSGHPFYNK | 176 | 11 | | 33966 |
| HPV18 | L1 | VGNPYFRVPA | 106 | 10 | | 33967 |
| HPV18 | L1 | VSAYQYRVF | 126 | 9 | | 33968 |
| HPV18 | L1 | VSAYQYRVFR | 126 | 10 | | 33969 |
| HPV18 | L1 | VTPTSIFY | 89 | 8 | | 33970 |
| HPV18 | L1 | VTPTSIFYH | 89 | 9 | | 33971 |
| HPV18 | L1 | VTPTSIFYHA | 89 | 10 | | 33972 |
| HPV18 | L1 | VTSDSQLF | 361 | 8 | | 33973 |
| HPV18 | L1 | VTSDSQLFNK | 361 | 10 | | 33974 |
| HPV18 | L1 | WACAGVEIGR | 161 | 10 | | 33975 |
| HPV18 | L1 | WAKGTACK | 230 | 8 | | 33976 |
| HPV18 | L1 | WAKGTACKSR | 230 | 10 | | 33977 |
| HPV18 | L1 | WLHKAQGH | 373 | 8 | | 33978 |
| HPV18 | L1 | YDATKFKQY | 417 | 9 | | 33979 |
| HPV18 | L1 | YDATKFKQYSR | 417 | 11 | | 33980 |
| HPV18 | L1 | YFRVPAGGGNK | 110 | 11 | | 33981 |
| HPV18 | L1 | YGDSMFFCLR | 303 | 10 | | 33982 |
| HPV18 | L1 | YGDSMFFCLRR | 303 | 11 | | 33983 |
| HPV18 | L1 | YGPLYHPR | 18 | 8 | | 33984 |
| HPV18 | L1 | YIKGTGMPA | 337 | 9 | | 33985 |
| HPV18 | L1 | YLPPPSVA | 73 | 8 | | 33986 |
| HPV18 | L1 | YLPPPSVAR | 73 | 9 | | 33987 |
| HPV18 | L1 | YLQMSADPY | 295 | 9 | | 33988 |
| HPV18 | L1 | YMVHIIICGH | 35 | 10 | | 33989 |
| HPV18 | L1 | YMVHIIICGHY | 35 | 11 | | 33990 |
| HPV18 | L1 | YSRHVEEY | 425 | 8 | | 33991 |
| HPV18 | L1 | YTRVLILH | 4 | 8 | | 33992 |
| HPV18 | L1 | YTRVLILHY | 4 | 9 | | 33993 |
| HPV18 | L1 | YTRVLILHYH | 4 | 10 | | 33994 |
| HPV18 | L1 | YVTPTSIF | 88 | 8 | | 33995 |
| HPV18 | L1 | YVTPTSIFY | 88 | 9 | | 33996 |
| HPV18 | L1 | YVTPTSIFYH | 88 | 10 | | 33997 |
| HPV18 | L1 | YVTPTSIFYHA | 88 | 11 | | 33998 |
| HPV18 | L2 | AFEPVDTTLTF | 255 | 11 | | 33999 |
| HPV18 | L2 | AGPRLYSR | 222 | 8 | | 34000 |
| HPV18 | L2 | AGPRLYSRA | 222 | 9 | | 34001 |
| HPV18 | L2 | AGPRLYSRAY | 222 | 10 | | 34002 |
| HPV18 | L2 | ALTSRRGTVR | 286 | 10 | | 34003 |
| HPV18 | L2 | ALTSRRGTVRF | 286 | 11 | | 34004 |
| HPV18 | L2 | ASTQYIGIH | 423 | 9 | | 34005 |
| HPV18 | L2 | ASVTDLYK | 12 | 8 | | 34006 |
| HPV18 | L2 | ASVTDLYKTCK | 12 | 11 | | 34007 |
| HPV18 | L2 | ATEDNDLF | 341 | 8 | | 34008 |
| HPV18 | L2 | ATEDNDLFDIY | 341 | 11 | | 34009 |
| HPV18 | L2 | DFMDIIRLH | 275 | 9 | | 34010 |
| HPV18 | L2 | DFMDIIRLHR | 275 | 10 | | 34011 |
| HPV18 | L2 | DIIRLHRPA | 278 | 9 | | 34012 |
| HPV18 | L2 | DISPIAPSPEY | 322 | 11 | | 34013 |
| HPV18 | L2 | DITSAGTTTPA | 129 | 11 | | 34014 |
| HPV18 | L2 | DIYADDMDPA | 349 | 10 | | 34015 |
| HPV18 | L2 | DMDPAVPVPSR | 354 | 11 | | 34016 |
| HPV18 | L2 | DSDFMDIIR | 273 | 9 | | 34017 |
| HPV18 | L2 | DSDFMDIIRLH | 273 | 11 | | 34018 |
| HPV18 | L2 | DSSVVTSGA | 109 | 9 | | 34019 |
| HPV18 | L2 | DSSVVTSGAPR | 109 | 11 | | 34020 |
| HPV18 | L2 | DTTLTFDPR | 260 | 9 | | 34021 |
| HPV18 | L2 | EDNDLFDIY | 343 | 9 | | 34022 |
| HPV18 | L2 | EDNDLFDIYA | 343 | 10 | | 34023 |
| HPV18 | L2 | EDSSVVTSGA | 108 | 10 | | 34024 |
| HPV18 | L2 | EGTTLADK | 36 | 8 | | 34025 |
| HPV18 | L2 | EIPLQTFA | 194 | 8 | | 34026 |
| HPV18 | L2 | ELQPLVSA | 334 | 8 | | 34027 |
| HPV18 | L2 | EVPQTGEVA | 169 | 9 | | 34028 |
| HPV18 | L2 | FADGFVAA | 455 | 8 | | 34029 |
| HPV18 | L2 | FDIYADDMDPA | 348 | 11 | | 34030 |
| HPV18 | L2 | FFADGFVA | 454 | 8 | | 34031 |
| HPV18 | L2 | FFADGFVAA | 454 | 9 | | 34032 |
| HPV18 | L2 | FFKYSPTISSA | 371 | 11 | | 34033 |
| HPV18 | L2 | FIPKKRKR | 443 | 8 | | 34034 |
| HPV18 | L2 | FIPKKRKRVPY | 443 | 11 | | 34035 |
| HPV18 | L2 | FLTRPSSLITY | 241 | 11 | | 34036 |
| HPV18 | L2 | FMDIIRLH | 276 | 8 | | 34037 |
| HPV18 | L2 | FMDIIRLHR | 276 | 9 | | 34038 |
| HPV18 | L2 | FMDIIRLHRPA | 276 | 11 | | 34039 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | L2 | FSRLGQRA | 296 | 8 | | 34040 |
| HPV18 | L2 | FSRLGQRATMF | 296 | 11 | | 34041 |
| HPV18 | L2 | FTRSGTQIGA | 306 | 10 | | 34042 |
| HPV18 | L2 | FTRSGTQIGAR | 306 | 11 | | 34043 |
| HPV18 | L2 | FVGTPTSGTH | 181 | 10 | | 34044 |
| HPV18 | L2 | GARVHFYH | 314 | 8 | | 34045 |
| HPV18 | L2 | GIGTGSGTGGR | 58 | 11 | | 34046 |
| HPV18 | L2 | GIHGTHYY | 429 | 8 | | 34047 |
| HPV18 | L2 | GSGTGGRTGY | 62 | 10 | | 34048 |
| HPV18 | L2 | GTCPPDVVPK | 25 | 10 | | 34049 |
| HPV18 | L2 | GTGGRTGY | 64 | 8 | | 34050 |
| HPV18 | L2 | GTGSGTGGR | 60 | 9 | | 34051 |
| HPV18 | L2 | GTHYYLWPLY | 432 | 10 | | 34052 |
| HPV18 | L2 | GTHYYLWPLYY | 432 | 11 | | 34053 |
| HPV18 | L2 | GTPTSGTH | 183 | 8 | | 34054 |
| HPV18 | L2 | GTPTSGTHGY | 183 | 10 | | 34055 |
| HPV18 | L2 | GTQIGARVH | 310 | 9 | | 34056 |
| HPV18 | L2 | GTQIGARVHF | 310 | 10 | | 34057 |
| HPV18 | L2 | GTQIGARVHFY | 310 | 11 | | 34058 |
| HPV18 | L2 | GTSGFDITSA | 124 | 10 | | 34059 |
| HPV18 | L2 | GTVRFSRLGQR | 292 | 11 | | 34060 |
| HPV18 | L2 | HFYHDISPIA | 318 | 10 | | 34061 |
| HPV18 | L2 | HGTHYYLWPLY | 431 | 11 | | 34062 |
| HPV18 | L2 | HGYEEIPLQTF | 190 | 11 | | 34063 |
| HPV18 | L2 | IGARVHFY | 313 | 8 | | 34064 |
| HPV18 | L2 | IGARVHFYH | 313 | 9 | | 34065 |
| HPV18 | L2 | IGIHGTHY | 428 | 8 | | 34066 |
| HPV18 | L2 | IGIHGTHYY | 428 | 9 | | 34067 |
| HPV18 | L2 | IGTGSGTGGR | 59 | 10 | | 34068 |
| HPV18 | L2 | IIEVPQTGEVA | 167 | 11 | | 34069 |
| HPV18 | L2 | IIRLHRPA | 279 | 8 | | 34070 |
| HPV18 | L2 | ILQWSSLGIF | 44 | 10 | | 34071 |
| HPV18 | L2 | ISPIAPSPEY | 323 | 10 | | 34072 |
| HPV18 | L2 | ISSTPLPTVR | 210 | 10 | | 34073 |
| HPV18 | L2 | ISSTPLPTVRR | 210 | 11 | | 34074 |
| HPV18 | L2 | ISTTNFTNPA | 152 | 10 | | 34075 |
| HPV18 | L2 | ISTTNFTNPAF | 152 | 11 | | 34076 |
| HPV18 | L2 | ITSAGTTTPA | 130 | 10 | | 34077 |
| HPV18 | L2 | ITYDNPAF | 249 | 8 | | 34078 |
| HPV18 | L2 | IVSPTAPA | 416 | 8 | | 34079 |
| HPV18 | L2 | KILQWSSLGIF | 43 | 11 | | 34080 |
| HPV18 | L2 | KVEGTTLA | 34 | 8 | | 34081 |
| HPV18 | L2 | KVEGTTLADK | 34 | 10 | | 34082 |
| HPV18 | L2 | LGQRATMF | 299 | 8 | | 34083 |
| HPV18 | L2 | LGQRATMFTR | 299 | 10 | | 34084 |
| HPV18 | L2 | LITYDNPA | 248 | 8 | | 34085 |
| HPV18 | L2 | LITYDNPAF | 248 | 9 | | 34086 |
| HPV18 | L2 | LTRPSSLITY | 242 | 10 | | 34087 |
| HPV18 | L2 | LTSRRGTVR | 287 | 9 | | 34088 |
| HPV18 | L2 | LTSRRGTVRF | 287 | 10 | | 34089 |
| HPV18 | L2 | LTSSWDVPVY | 391 | 10 | | 34090 |
| HPV18 | L2 | LVSATEDNDLF | 338 | 11 | | 34091 |
| HPV18 | L2 | MDIIRLHR | 277 | 8 | | 34092 |
| HPV18 | L2 | MDIIRLHRPA | 277 | 10 | | 34093 |
| HPV18 | L2 | MDPAVPVPSR | 355 | 10 | | 34094 |
| HPV18 | L2 | MFTRSGTQIGA | 305 | 11 | | 34095 |
| HPV18 | L2 | MVSHRAAR | 1 | 8 | | 34096 |
| HPV18 | L2 | MVSHRAARR | 1 | 9 | | 34097 |
| HPV18 | L2 | MVSHRAARRK | 1 | 10 | | 34098 |
| HPV18 | L2 | MVSHRAARRKR | 1 | 11 | | 34099 |
| HPV18 | L2 | NDLFDIYA | 345 | 8 | | 34100 |
| HPV18 | L2 | NTVVDVGPTR | 79 | 10 | | 34101 |
| HPV18 | L2 | PALTSRRGTVR | 285 | 11 | | 34102 |
| HPV18 | L2 | PASTQYIGIH | 422 | 10 | | 34103 |
| HPV18 | L2 | PAVPVPSR | 357 | 8 | | 34104 |
| HPV18 | L2 | PDSDFMDIIR | 272 | 10 | | 34105 |
| HPV18 | L2 | PIAPSPEY | 325 | 8 | | 34106 |
| HPV18 | L2 | PISSTPLPTVR | 209 | 11 | | 34107 |
| HPV18 | L2 | PIVSPTAPA | 415 | 9 | | 34108 |
| HPV18 | L2 | PLPTVRRVA | 214 | 9 | | 34109 |
| HPV18 | L2 | PLTSSWDVPVY | 390 | 11 | | 34110 |
| HPV18 | L2 | PLYYFIPK | 439 | 8 | | 34111 |
| HPV18 | L2 | PLYYFIPKK | 439 | 9 | | 34112 |
| HPV18 | L2 | PLYYFIPKKR | 439 | 10 | | 34113 |
| HPV18 | L2 | PLYYFIPKKRK | 439 | 11 | | 34114 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | L2 | PSRSTTSF | 362 | 8 | | 34115 |
| HPV18 | L2 | PSRSTTSFA | 362 | 9 | | 34116 |
| HPV18 | L2 | PSRSTTSFAF | 362 | 10 | | 34117 |
| HPV18 | L2 | PSRSTTSFAFF | 362 | 11 | | 34118 |
| HPV18 | L2 | PSSLITYDNPA | 245 | 11 | | 34119 |
| HPV18 | L2 | PTAPASTQY | 419 | 9 | | 34120 |
| HPV18 | L2 | PTFTGTSGF | 120 | 9 | | 34121 |
| HPV18 | L2 | PTISSASSY | 376 | 9 | | 34122 |
| HPV18 | L2 | PTSGTHGY | 185 | 8 | | 34123 |
| HPV18 | L2 | PTVRRVAGPR | 216 | 10 | | 34124 |
| HPV18 | L2 | PVDTTLTF | 258 | 8 | | 34125 |
| HPV18 | L2 | PVDTTLTFDPR | 258 | 11 | | 34126 |
| HPV18 | L2 | PVPSRSTTSF | 360 | 10 | | 34127 |
| HPV18 | L2 | PVPSRSTTSFA | 360 | 11 | | 34128 |
| HPV18 | L2 | QIGARVHF | 312 | 8 | | 34129 |
| HPV18 | L2 | QIGARVHFY | 312 | 9 | | 34130 |
| HPV18 | L2 | QIGARVHFYH | 312 | 10 | | 34131 |
| HPV18 | L2 | QTGEVAGNVF | 172 | 10 | | 34132 |
| HPV18 | L2 | QVSVANPEF | 233 | 9 | | 34133 |
| HPV18 | L2 | RAARRKRA | 5 | 8 | | 34134 |
| HPV18 | L2 | RASVTDLY | 11 | 8 | | 34135 |
| HPV18 | L2 | RASVTDLYK | 11 | 9 | | 34136 |
| HPV18 | L2 | RAYQQVSVA | 229 | 9 | | 34137 |
| HPV18 | L2 | RFSRLGQR | 295 | 8 | | 34138 |
| HPV18 | L2 | RFSRLGQRA | 295 | 9 | | 34139 |
| HPV18 | L2 | RGTVRFSR | 291 | 8 | | 34140 |
| HPV18 | L2 | RLGQRATMF | 298 | 9 | | 34141 |
| HPV18 | L2 | RLGQRATMFTR | 298 | 11 | | 34142 |
| HPV18 | L2 | RLHRPALTSR | 281 | 10 | | 34143 |
| HPV18 | L2 | RLHRPALTSRR | 281 | 11 | | 34144 |
| HPV18 | L2 | RSDVPDSDF | 268 | 9 | | 34145 |
| HPV18 | L2 | RSGTQIGA | 308 | 8 | | 34146 |
| HPV18 | L2 | RSGTQIGAR | 308 | 9 | | 34147 |
| HPV18 | L2 | RSGTQIGARVH | 308 | 11 | | 34148 |
| HPV18 | L2 | RSTTSFAF | 364 | 8 | | 34149 |
| HPV18 | L2 | RSTTSFAFF | 364 | 9 | | 34150 |
| HPV18 | L2 | RSTTSFAFFK | 364 | 10 | | 34151 |
| HPV18 | L2 | RSTTSFAFFKY | 364 | 11 | | 34152 |
| HPV18 | L2 | RTGYIPLGGR | 68 | 10 | | 34153 |
| HPV18 | L2 | RVAGPRLY | 220 | 8 | | 34154 |
| HPV18 | L2 | RVAGPRLYSR | 220 | 10 | | 34155 |
| HPV18 | L2 | RVAGPRLYSRA | 220 | 11 | | 34156 |
| HPV18 | L2 | RVPYFFADGF | 450 | 10 | | 34157 |
| HPV18 | L2 | SAGTTTPA | 132 | 8 | | 34158 |
| HPV18 | L2 | SATEDNDLF | 340 | 9 | | 34159 |
| HPV18 | L2 | SDFMDIIR | 274 | 8 | | 34160 |
| HPV18 | L2 | SDFMDIIRLH | 274 | 10 | | 34161 |
| HPV18 | L2 | SDFMDIIRLHR | 274 | 11 | | 34162 |
| HPV18 | L2 | SDVPDSDF | 269 | 8 | | 34163 |
| HPV18 | L2 | SGAPRPTF | 115 | 8 | | 34164 |
| HPV18 | L2 | SGFDITSA | 126 | 8 | | 34165 |
| HPV18 | L2 | SGTCPPDVVPK | 24 | 11 | | 34166 |
| HPV18 | L2 | SGTGGRTGY | 63 | 9 | | 34167 |
| HPV18 | L2 | SGTQIGAR | 309 | 8 | | 34168 |
| HPV18 | L2 | SGTQIGARVH | 309 | 10 | | 34169 |
| HPV18 | L2 | SGTQIGARVHF | 309 | 11 | | 34170 |
| HPV18 | L2 | SISTTNFTNPA | 151 | 11 | | 34171 |
| HPV18 | L2 | SLITYDNPA | 247 | 9 | | 34172 |
| HPV18 | L2 | SLITYDNPAF | 247 | 10 | | 34173 |
| HPV18 | L2 | SSLITYDNPA | 246 | 10 | | 34174 |
| HPV18 | L2 | SSLITYDNPAF | 246 | 11 | | 34175 |
| HPV18 | L2 | SSTPLPTVR | 211 | 9 | | 34176 |
| HPV18 | L2 | SSTPLPTVRR | 211 | 10 | | 34177 |
| HPV18 | L2 | SSVVTSGA | 110 | 8 | | 34178 |
| HPV18 | L2 | SSVVTSGAPR | 110 | 10 | | 34179 |
| HPV18 | L2 | SSWDVPVY | 393 | 8 | | 34180 |
| HPV18 | L2 | STPLPTVR | 212 | 8 | | 34181 |
| HPV18 | L2 | STPLPTVRR | 212 | 9 | | 34182 |
| HPV18 | L2 | STPLPTVRRVA | 212 | 11 | | 34183 |
| HPV18 | L2 | STQYIGIH | 424 | 8 | | 34184 |
| HPV18 | L2 | STQYIGIHGTH | 424 | 11 | | 34185 |
| HPV18 | L2 | STSVSISTTNF | 147 | 11 | | 34186 |
| HPV18 | L2 | STTNFTNPA | 153 | 9 | | 34187 |
| HPV18 | L2 | STTNFTNPAF | 153 | 10 | | 34188 |
| HPV18 | L2 | STTSFAFF | 365 | 8 | | 34189 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV18 | L2 | STTSFAFFK | 365 | 9 | | 34190 |
| HPV18 | L2 | STTSFAFFKY | 365 | 10 | | 34191 |
| HPV18 | L2 | SVANPEFLTR | 235 | 10 | | 34192 |
| HPV18 | L2 | SVSISTTNF | 149 | 9 | | 34193 |
| HPV18 | L2 | SVTDLYKTCK | 13 | 10 | | 34194 |
| HPV18 | L2 | SVVTSGAPR | 111 | 9 | | 34195 |
| HPV18 | L2 | SVWPIVSPTA | 412 | 10 | | 34196 |
| HPV18 | L2 | TAPASTQY | 420 | 8 | | 34197 |
| HPV18 | L2 | TCPPDVVPK | 26 | 9 | | 34198 |
| HPV18 | L2 | TDLYKTCK | 15 | 8 | | 34199 |
| HPV18 | L2 | TFTGTSGF | 121 | 8 | | 34200 |
| HPV18 | L2 | TGEVAGNVF | 173 | 9 | | 34201 |
| HPV18 | L2 | TGSGTGGR | 61 | 8 | | 34202 |
| HPV18 | L2 | TGSGTGGRTGY | 61 | 11 | | 34203 |
| HPV18 | L2 | TGTSGFDITSA | 123 | 11 | | 34204 |
| HPV18 | L2 | TGYIPLGGR | 69 | 9 | | 34205 |
| HPV18 | L2 | TISSASSY | 377 | 8 | | 34206 |
| HPV18 | L2 | TSAGTTTPA | 131 | 9 | | 34207 |
| HPV18 | L2 | TSFAFFKY | 367 | 8 | | 34208 |
| HPV18 | L2 | TSGAPRPTF | 114 | 9 | | 34209 |
| HPV18 | L2 | TSGFDITSA | 125 | 9 | | 34210 |
| HPV18 | L2 | TSRRGTVR | 288 | 8 | | 34211 |
| HPV18 | L2 | TSRRGTVRF | 288 | 9 | | 34212 |
| HPV18 | L2 | TSRRGTVRFSR | 288 | 11 | | 34213 |
| HPV18 | L2 | TSSWDVPVY | 392 | 9 | | 34214 |
| HPV18 | L2 | TSVSISTTNF | 148 | 10 | | 34215 |
| HPV18 | L2 | TSVWPIVSPTA | 411 | 11 | | 34216 |
| HPV18 | L2 | TTLTFDPR | 261 | 8 | | 34217 |
| HPV18 | L2 | TTNFTNPA | 154 | 8 | | 34218 |
| HPV18 | L2 | TTNFTNPAF | 154 | 9 | | 34219 |
| HPV18 | L2 | TTSFAFFK | 366 | 8 | | 34220 |
| HPV18 | L2 | TTSFAFFKY | 366 | 9 | | 34221 |
| HPV18 | L2 | TVRFSRLGQR | 293 | 10 | | 34222 |
| HPV18 | L2 | TVRFSRLGQRA | 293 | 11 | | 34223 |
| HPV18 | L2 | TVRRVAGPR | 217 | 9 | | 34224 |
| HPV18 | L2 | TVRRVAGPRLY | 217 | 11 | | 34225 |
| HPV18 | L2 | TVVDVGPTR | 80 | 9 | | 34226 |
| HPV18 | L2 | VAGPRLYSR | 221 | 9 | | 34227 |
| HPV18 | L2 | VAGPRLYSRA | 221 | 10 | | 34228 |
| HPV18 | L2 | VAGPRLYSRAY | 221 | 11 | | 34229 |
| HPV18 | L2 | VANPEFLTR | 236 | 9 | | 34230 |
| HPV18 | L2 | VDTTLTFDPR | 259 | 10 | | 34231 |
| HPV18 | L2 | VFVGTPTSGTH | 180 | 11 | | 34232 |
| HPV18 | L2 | VGTPTSGTH | 182 | 9 | | 34233 |
| HPV18 | L2 | VGTPTSGTHGY | 182 | 11 | | 34234 |
| HPV18 | L2 | VSATEDNDLF | 339 | 10 | | 34235 |
| HPV18 | L2 | VSHRAARR | 2 | 8 | | 34236 |
| HPV18 | L2 | VSHRAARRK | 2 | 9 | | 34237 |
| HPV18 | L2 | VSHRAARRKR | 2 | 10 | | 34238 |
| HPV18 | L2 | VSHRAARRKRA | 2 | 11 | | 34239 |
| HPV18 | L2 | VSISTTNF | 150 | 8 | | 34240 |
| HPV18 | L2 | VSPTAPASTQY | 417 | 11 | | 34241 |
| HPV18 | L2 | VSVANPEF | 234 | 8 | | 34242 |
| HPV18 | L2 | VSVANPEFLTR | 234 | 11 | | 34243 |
| HPV18 | L2 | VTDLYKTCK | 14 | 9 | | 34244 |
| HPV18 | L2 | VTSGAPRPTF | 113 | 10 | | 34245 |
| HPV18 | L2 | VVDVGPTR | 81 | 8 | | 34246 |
| HPV18 | L2 | VVPKVEGTTLA | 31 | 11 | | 34247 |
| HPV18 | L2 | VVTSGAPR | 112 | 8 | | 34248 |
| HPV18 | L2 | VVTSGAPRPTF | 112 | 11 | | 34249 |
| HPV18 | L2 | YADDMDPA | 351 | 8 | | 34250 |
| HPV18 | L2 | YFFADGFVA | 453 | 9 | | 34251 |
| HPV18 | L2 | YFFADGFVAA | 453 | 10 | | 34252 |
| HPV18 | L2 | YFIPKKRK | 442 | 8 | | 34253 |
| HPV18 | L2 | YFIPKKRKR | 442 | 9 | | 34254 |
| HPV18 | L2 | YIELQPLVSA | 332 | 10 | | 34255 |
| HPV18 | L2 | YIGIHGTH | 427 | 8 | | 34256 |
| HPV18 | L2 | YIGIHGTHY | 427 | 9 | | 34257 |
| HPV18 | L2 | YIGIHGTHYY | 427 | 10 | | 34258 |
| HPV18 | L2 | YLWPLYYF | 436 | 8 | | 34259 |
| HPV18 | L2 | YLWPLYYFIPK | 436 | 11 | | 34260 |
| HPV18 | L2 | YSPTISSA | 374 | 8 | | 34261 |
| HPV18 | L2 | YSPTISSASSY | 374 | 11 | | 34262 |
| HPV18 | L2 | YSRAYQQVSVA | 227 | 11 | | 34263 |
| HPV31 | E1 | AAALYWYR | 296 | 8 | | 34264 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E1 | AAFGVTGTVA | 219 | 10 | | 34265 |
| HPV31 | E1 | AAMLGKFK | 185 | 8 | | 34266 |
| HPV31 | E1 | AAMLGKFKELY | 185 | 11 | | 34267 |
| HPV31 | E1 | ACAFLKSNSQA | 369 | 11 | | 34268 |
| HPV31 | E1 | ADAKIGMLDDA | 494 | 11 | | 34269 |
| HPV31 | E1 | ADSDSNACA | 363 | 9 | | 34270 |
| HPV31 | E1 | ADSDSNACAF | 363 | 10 | | 34271 |
| HPV31 | E1 | AFGVTGTVA | 220 | 9 | | 34272 |
| HPV31 | E1 | AFLKSNSQA | 371 | 9 | | 34273 |
| HPV31 | E1 | AFLKSNSQAK | 371 | 10 | | 34274 |
| HPV31 | E1 | AGKDDRWPY | 550 | 9 | | 34275 |
| HPV31 | E1 | AGKDDRWPYLH | 550 | 11 | | 34276 |
| HPV31 | E1 | AICIENNSK | 111 | 9 | | 34277 |
| HPV31 | E1 | AICIENNSKTA | 111 | 11 | | 34278 |
| HPV31 | E1 | ALFHAQEA | 68 | 8 | | 34279 |
| HPV31 | E1 | ALFHAQEAEEH | 68 | 11 | | 34280 |
| HPV31 | E1 | ALKLFLKGVPK | 439 | 11 | | 34281 |
| HPV31 | E1 | AMLGKFKELY | 186 | 10 | | 34282 |
| HPV31 | E1 | ATTPCWHY | 504 | 8 | | 34283 |
| HPV31 | E1 | AVQVLKRK | 81 | 8 | | 34284 |
| HPV31 | E1 | AVQVLKRKY | 81 | 9 | | 34285 |
| HPV31 | E1 | CAFLKSNSQA | 370 | 10 | | 34286 |
| HPV31 | E1 | CAFLKSNSQAK | 370 | 11 | | 34287 |
| HPV31 | E1 | CAKNRITIEK | 263 | 10 | | 34288 |
| HPV31 | E1 | CDKVSDEGDWR | 410 | 11 | | 34289 |
| HPV31 | E1 | CGTMCRHY | 385 | 8 | | 34290 |
| HPV31 | E1 | CGTMCRHYK | 385 | 9 | | 34291 |
| HPV31 | E1 | CGTMCRHYKR | 385 | 10 | | 34292 |
| HPV31 | E1 | CGTMCRHYKRA | 385 | 11 | | 34293 |
| HPV31 | E1 | CIENNSKTA | 113 | 9 | | 34294 |
| HPV31 | E1 | CIENNSKTAK | 113 | 10 | | 34295 |
| HPV31 | E1 | CIENNSKTAKR | 113 | 11 | | 34296 |
| HPV31 | E1 | CIISYANSK | 477 | 9 | | 34297 |
| HPV31 | E1 | CIISYANSKSH | 477 | 11 | | 34298 |
| HPV31 | E1 | CLYCHLQSLA | 239 | 10 | | 34299 |
| HPV31 | E1 | CMLIQPPK | 284 | 8 | | 34300 |
| HPV31 | E1 | CMLIQPPKLR | 284 | 10 | | 34301 |
| HPV31 | E1 | CTDWCVAA | 213 | 8 | | 34302 |
| HPV31 | E1 | CTDWCVAAF | 213 | 9 | | 34303 |
| HPV31 | E1 | CVDYNISPR | 100 | 9 | | 34304 |
| HPV31 | E1 | CVDYNISPRLK | 100 | 11 | | 34305 |
| HPV31 | E1 | CVSGQNIR | 620 | 8 | | 34306 |
| HPV31 | E1 | DAKIGMLDDA | 495 | 10 | | 34307 |
| HPV31 | E1 | DATTPCWH | 503 | 8 | | 34308 |
| HPV31 | E1 | DATTPCWHY | 503 | 9 | | 34309 |
| HPV31 | E1 | DCGTMCRH | 384 | 8 | | 34310 |
| HPV31 | E1 | DCGTMCRHY | 384 | 9 | | 34311 |
| HPV31 | E1 | DCGTMCRHYK | 384 | 10 | | 34312 |
| HPV31 | E1 | DCGTMCRHYKR | 384 | 11 | | 34313 |
| HPV31 | E1 | DDATTPCWH | 502 | 9 | | 34314 |
| HPV31 | E1 | DDATTPCWHY | 502 | 10 | | 34315 |
| HPV31 | E1 | DDRWPYLH | 553 | 8 | | 34316 |
| HPV31 | E1 | DDRWPYLHSR | 553 | 10 | | 34317 |
| HPV31 | E1 | DDSEIAYK | 351 | 8 | | 34318 |
| HPV31 | E1 | DDSEIAYKY | 351 | 9 | | 34319 |
| HPV31 | E1 | DDSEIAYKYA | 351 | 10 | | 34320 |
| HPV31 | E1 | DFIDNCNVY | 49 | 9 | | 34321 |
| HPV31 | E1 | DGDSFSTF | 611 | 8 | | 34322 |
| HPV31 | E1 | DGDSFSTFK | 611 | 9 | | 34323 |
| HPV31 | E1 | DGEGTGCNGWF | 8 | 11 | | 34324 |
| HPV31 | E1 | DGNPVSIDVK | 521 | 10 | | 34325 |
| HPV31 | E1 | DGNPVSIDVKH | 521 | 11 | | 34326 |
| HPV31 | E1 | DISSCVDY | 96 | 8 | | 34327 |
| HPV31 | E1 | DIVKFLRY | 421 | 8 | | 34328 |
| HPV31 | E1 | DLSQMVQWA | 336 | 9 | | 34329 |
| HPV31 | E1 | DLSQMVQWAY | 336 | 10 | | 34330 |
| HPV31 | E1 | DSDSNACA | 364 | 8 | | 34331 |
| HPV31 | E1 | DSDSNACAF | 364 | 9 | | 34332 |
| HPV31 | E1 | DSDSNACAFLK | 364 | 11 | | 34333 |
| HPV31 | E1 | DSEIAYKY | 352 | 8 | | 34334 |
| HPV31 | E1 | DSEIAYKYA | 352 | 9 | | 34335 |
| HPV31 | E1 | DSNACAFLK | 366 | 9 | | 34336 |
| HPV31 | E1 | DTGEDMVDF | 42 | 9 | | 34337 |
| HPV31 | E1 | DVKHKALMQLK | 528 | 11 | | 34338 |
| HPV31 | E1 | DVMDDSEIA | 348 | 9 | | 34339 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E1 | DVMDDSEIAY | 348 | 10 | | 34340 |
| HPV31 | E1 | DVMDDSEIAYK | 348 | 11 | | 34341 |
| HPV31 | E1 | EAEEHAEA | 74 | 8 | | 34342 |
| HPV31 | E1 | EAETAQALF | 62 | 9 | | 34343 |
| HPV31 | E1 | EAETAQALFH | 62 | 10 | | 34344 |
| HPV31 | E1 | EAETAQALFHA | 62 | 11 | | 34345 |
| HPV31 | E1 | EAVQVLKR | 80 | 8 | | 34346 |
| HPV31 | E1 | EAVQVLKRK | 80 | 9 | | 34347 |
| HPV31 | E1 | EAVQVLKRKY | 80 | 10 | | 34348 |
| HPV31 | E1 | EDKENDGDSF | 606 | 10 | | 34349 |
| HPV31 | E1 | EFVSFLSA | 432 | 8 | | 34350 |
| HPV31 | E1 | EFVSFLSALK | 432 | 10 | | 34351 |
| HPV31 | E1 | EGDWRDIVK | 416 | 9 | | 34352 |
| HPV31 | E1 | EGDWRDIVKF | 416 | 10 | | 34353 |
| HPV31 | E1 | EGFKTLLQPY | 229 | 10 | | 34354 |
| HPV31 | E1 | EGTGCNGWF | 10 | 9 | 0.0008 | 34355 |
| HPV31 | E1 | EGTGCNGWFY | 10 | 10 | 0.0005 | 34356 |
| HPV31 | E1 | EIAYKYAQLA | 354 | 10 | | 34357 |
| HPV31 | E1 | ELIRPFQSNK | 201 | 10 | | 34358 |
| HPV31 | E1 | ELSDKNWK | 583 | 8 | | 34359 |
| HPV31 | E1 | ELSDKNWKSF | 583 | 10 | | 34360 |
| HPV31 | E1 | ELSDKNWKSFF | 583 | 11 | | 34361 |
| HPV31 | E1 | ETAQALFH | 64 | 8 | | 34362 |
| HPV31 | E1 | ETAQALFHA | 64 | 9 | | 34363 |
| HPV31 | E1 | ETPEWIER | 315 | 8 | | 34364 |
| HPV31 | E1 | FDKNGNPVY | 574 | 9 | | 34365 |
| HPV31 | E1 | FDLSQMVQWA | 335 | 10 | | 34366 |
| HPV31 | E1 | FDLSQMVQWAY | 335 | 11 | | 34367 |
| HPV31 | E1 | FFSRTWCR | 592 | 8 | | 34368 |
| HPV31 | E1 | FGMSLISF | 466 | 8 | | 34369 |
| HPV31 | E1 | FGVTGTVA | 221 | 8 | | 34370 |
| HPV31 | E1 | FGVTGTVAEGF | 221 | 11 | | 34371 |
| HPV31 | E1 | FIDNCNVY | 50 | 8 | | 34372 |
| HPV31 | E1 | FLKGVPKK | 443 | 8 | | 34373 |
| HPV31 | E1 | FLKSNSQA | 372 | 8 | | 34374 |
| HPV31 | E1 | FLKSNSQAK | 372 | 9 | 0.0013 | 34375 |
| HPV31 | E1 | FLQGCIISY | 473 | 9 | | 34376 |
| HPV31 | E1 | FLQGCIISYA | 473 | 10 | | 34377 |
| HPV31 | E1 | FLRYQQIEF | 425 | 9 | | 34378 |
| HPV31 | E1 | FLSALKLF | 436 | 8 | | 34379 |
| HPV31 | E1 | FLSALKLFLK | 436 | 10 | | 34380 |
| HPV31 | E1 | FMELIRPF | 199 | 8 | | 34381 |
| HPV31 | E1 | FSRTWCRLNLH | 593 | 11 | | 34382 |
| HPV31 | E1 | FTFPNPFPF | 566 | 9 | 0.0008 | 34383 |
| HPV31 | E1 | FTFPNPFPFDK | 566 | 11 | | 34384 |
| HPV31 | E1 | FVSFLSALK | 433 | 9 | | 34385 |
| HPV31 | E1 | FVSFLSALKLF | 433 | 11 | | 34386 |
| HPV31 | E1 | GAPNTGKSY | 457 | 9 | | 34387 |
| HPV31 | E1 | GAPNTGKSYF | 457 | 10 | | 34388 |
| HPV31 | E1 | CCIISYANSK | 476 | 10 | | 34389 |
| HPV31 | E1 | GCNGWFYVEA | 13 | 10 | | 34390 |
| HPV31 | E1 | GDSFSTFK | 612 | 8 | | 34391 |
| HPV31 | E1 | GDWRDIVK | 417 | 8 | | 34392 |
| HPV31 | E1 | GDWRDIVKF | 417 | 9 | | 34393 |
| HPV31 | E1 | GDWRDIVKFLR | 417 | 11 | | 34394 |
| HPV31 | E1 | GFKTLLQPY | 230 | 9 | | 34395 |
| HPV31 | E1 | GMSNISDVY | 305 | 9 | | 34396 |
| HPV31 | E1 | GMVMLMLVR | 252 | 9 | | 34397 |
| HPV31 | E1 | GMVMLMLVRF | 252 | 10 | | 34398 |
| HPV31 | E1 | GMVMLMLVRFK | 252 | 11 | | 34399 |
| HPV31 | E1 | GSDGTHSER | 157 | 9 | | 34400 |
| HPV31 | E1 | GTGCNGWF | 11 | 8 | | 34401 |
| HPV31 | E1 | GTGCNGWFY | 11 | 9 | 0.0004 | 34402 |
| HPV31 | E1 | GTMCRHYK | 386 | 8 | | 34403 |
| HPV31 | E1 | GTMCRHYKR | 386 | 9 | | 34404 |
| HPV31 | E1 | GTMCRHYKRA | 386 | 10 | | 34405 |
| HPV31 | E1 | GTVAEGFK | 225 | 8 | | 34406 |
| HPV31 | E1 | GVPKKNCILIH | 446 | 11 | | 34407 |
| HPV31 | E1 | GVSFMELIR | 196 | 9 | | 34408 |
| HPV31 | E1 | GVSFMELIRPF | 196 | 11 | | 34409 |
| HPV31 | E1 | GVTGTVAEGF | 222 | 10 | | 34410 |
| HPV31 | E1 | GVTGTVAEGFK | 222 | 11 | | 34411 |
| HPV31 | E1 | HAEAVQVLK | 78 | 9 | | 34412 |
| HPV31 | E1 | HAEAVQVLKR | 78 | 10 | | 34413 |
| HPV31 | E1 | HAEAVQVLKRK | 78 | 11 | | 34414 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E1 | HAQEAEEH | 71 | 8 | | 34415 |
| HPV31 | E1 | HAQEAEEHA | 71 | 9 | | 34416 |
| HPV31 | E1 | HAQEAEEHAEA | 71 | 11 | | 34417 |
| HPV31 | E1 | HFWLQPLA | 487 | 8 | | 34418 |
| HPV31 | E1 | HFWLQPLADA | 487 | 10 | | 34419 |
| HPV31 | E1 | HFWLQPLADAK | 487 | 11 | | 34420 |
| HPV31 | E1 | HGAPNTGK | 456 | 8 | | 34421 |
| HPV31 | E1 | HGAPNTGKSY | 456 | 10 | | 34422 |
| HPV31 | E1 | HGAPNTGKSYF | 456 | 11 | | 34423 |
| HPV31 | E1 | HSERENETPTR | 162 | 11 | | 34424 |
| HPV31 | E1 | HSFNDTTF | 328 | 8 | | 34425 |
| HPV31 | E1 | HSRLVVFTF | 560 | 9 | | 34426 |
| HPV31 | E1 | IAYKYAQLA | 355 | 9 | | 34427 |
| HPV31 | E1 | ICIENNSK | 112 | 8 | | 34428 |
| HPV31 | E1 | ICIENNSKTA | 112 | 10 | | 34429 |
| HPV31 | E1 | ICIENNSKTAK | 112 | 11 | | 34430 |
| HPV31 | E1 | IDNCNVYNNQA | 51 | 11 | | 34431 |
| HPV31 | E1 | IDNYLRNA | 512 | 8 | | 34432 |
| HPV31 | E1 | IISYANSK | 478 | 8 | | 34433 |
| HPV31 | E1 | IISYANSKSH | 478 | 10 | | 34434 |
| HPV31 | E1 | IISYANSKSHF | 478 | 11 | | 34435 |
| HPV31 | E1 | ILIHGAPNTGK | 453 | 11 | | 34436 |
| HPV31 | E1 | ILQVLKTSNGK | 174 | 11 | | 34437 |
| HPV31 | E1 | ISFLQGCIISY | 471 | 11 | | 34438 |
| HPV31 | E1 | ISYANSKSH | 479 | 9 | | 34439 |
| HPV31 | E1 | ISYANSKSHF | 479 | 10 | | 34440 |
| HPV31 | E1 | ITIEKLLEK | 268 | 9 | | 34441 |
| HPV31 | E1 | ITSNINAGK | 544 | 9 | | 34442 |
| HPV31 | E1 | IVKDCGTMCR | 381 | 10 | | 34443 |
| HPV31 | E1 | IVKDCGTMCRH | 381 | 11 | | 34444 |
| HPV31 | E1 | KAAMLGKF | 184 | 8 | | 34445 |
| HPV31 | E1 | KAAMLGKFK | 184 | 9 | | 34446 |
| HPV31 | E1 | KAICIENNSK | 110 | 10 | | 34447 |
| HPV31 | E1 | KCAKNRITIEK | 262 | 11 | | 34448 |
| HPV31 | E1 | KCVSGQNIR | 619 | 9 | | 34449 |
| HPV31 | E1 | KDCGTMCR | 383 | 8 | | 34450 |
| HPV31 | E1 | KDCGTMCRH | 383 | 9 | | 34451 |
| HPV31 | E1 | KDCGTMCRHY | 383 | 10 | | 34452 |
| HPV31 | E1 | KDCGTMCRHYK | 383 | 11 | | 34453 |
| HPV31 | E1 | KDDRWPYLH | 552 | 9 | | 34454 |
| HPV31 | E1 | KDDRWPYLHSR | 552 | 11 | | 34455 |
| HPV31 | E1 | KFKELYGVSF | 190 | 10 | | 34456 |
| HPV31 | E1 | KFLRYQQIEF | 424 | 10 | | 34457 |
| HPV31 | E1 | KIGMLDDA | 497 | 8 | | 34458 |
| HPV31 | E1 | KIVKDCGTMCR | 380 | 11 | | 34459 |
| HPV31 | E1 | KLFLKGVPK | 441 | 9 | | 34460 |
| HPV31 | E1 | KLFLKGVPKK | 441 | 10 | | 34461 |
| HPV31 | E1 | KLRSTAAA | 291 | 8 | | 34462 |
| HPV31 | E1 | KLRSTAAALY | 291 | 10 | | 34463 |
| HPV31 | E1 | KSFFSRTWCR | 590 | 10 | | 34464 |
| HPV31 | E1 | KSHFWLQPLA | 485 | 10 | | 34465 |
| HPV31 | E1 | KSNSQAKIVK | 374 | 10 | | 34466 |
| HPV31 | E1 | KSTCTDWCVA | 210 | 10 | | 34467 |
| HPV31 | E1 | KSTCTDWCVAA | 210 | 11 | | 34468 |
| HPV31 | E1 | KSYFGMSLISF | 463 | 11 | | 34469 |
| HPV31 | E1 | KTAKRRLF | 119 | 8 | | 34470 |
| HPV31 | E1 | KTLLQPYCLY | 232 | 10 | | 34471 |
| HPV31 | E1 | KTSNGKAA | 179 | 8 | | 34472 |
| HPV31 | E1 | KVSDEGDWR | 412 | 9 | | 34473 |
| HPV31 | E1 | LADSDSNA | 362 | 8 | | 34474 |
| HPV31 | E1 | LADSDSNACA | 362 | 10 | | 34475 |
| HPV31 | E1 | LADSDSNACAF | 362 | 11 | | 34476 |
| HPV31 | E1 | LDDATTPCWH | 501 | 10 | | 34477 |
| HPV31 | E1 | LDDATTPCWHY | 501 | 11 | | 34478 |
| HPV31 | E1 | LDGNPVSIDVK | 520 | 11 | | 34479 |
| HPV31 | E1 | LFELPDSGY | 125 | 9 | | 34480 |
| HPV31 | E1 | LFHAQEAEEH | 69 | 10 | | 34481 |
| HPV31 | E1 | LFHAQEAEEHA | 69 | 11 | | 34482 |
| HPV31 | E1 | LFLKGVPK | 442 | 8 | | 34483 |
| HPV31 | E1 | LFLKGVPKK | 442 | 9 | | 34484 |
| HPV31 | E1 | LGKFKELY | 188 | 8 | | 34485 |
| HPV31 | E1 | LIHGAPNTGK | 454 | 10 | | 34486 |
| HPV31 | E1 | LIQPPKLR | 286 | 8 | | 34487 |
| HPV31 | E1 | LIQPPKLRSTA | 286 | 11 | | 34488 |
| HPV31 | E1 | LIRPFQSNK | 202 | 9 | | 34489 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E1 | LITSNINA | 543 | 8 | | 34490 |
| HPV31 | E1 | LITSNINAGK | 543 | 10 | | 34491 |
| HPV31 | E1 | LLITSNINA | 542 | 9 | | 34492 |
| HPV31 | E1 | LLITSNINAGK | 542 | 11 | | 34493 |
| HPV31 | E1 | LLQPYCLY | 234 | 8 | | 34494 |
| HPV31 | E1 | LLQPYCLYCH | 234 | 10 | | 34495 |
| HPV31 | E1 | LMLVRFKCA | 256 | 9 | | 34496 |
| HPV31 | E1 | LMLVRFKCAK | 256 | 10 | | 34497 |
| HPV31 | E1 | LSALKLFLK | 437 | 9 | | 34498 |
| HPV31 | E1 | LSCNGSDGTH | 153 | 10 | | 34499 |
| HPV31 | E1 | LSDISSCVDY | 94 | 10 | | 34500 |
| HPV31 | E1 | LSDKNWKSF | 584 | 9 | | 34501 |
| HPV31 | E1 | LSDKNWKSFF | 584 | 10 | | 34502 |
| HPV31 | E1 | LSQMVQWA | 337 | 8 | | 34503 |
| HPV31 | E1 | LSQMVQWAY | 337 | 9 | | 34504 |
| HPV31 | E1 | LVRFKCAK | 258 | 8 | | 34505 |
| HPV31 | E1 | LVRFKCAKNR | 258 | 10 | | 34506 |
| HPV31 | E1 | LVVFTFPNPF | 563 | 10 | | 34507 |
| HPV31 | E1 | MCRHYKRA | 388 | 8 | | 34508 |
| HPV31 | E1 | MCRHYKRAEK | 388 | 10 | | 34509 |
| HPV31 | E1 | MCRHYKRAEKR | 388 | 11 | | 34510 |
| HPV31 | E1 | MDDSEIAY | 350 | 8 | | 34511 |
| HPV31 | E1 | MDDSEIAYK | 350 | 9 | | 34512 |
| HPV31 | E1 | MDDSEIAYKY | 350 | 10 | | 34513 |
| HPV31 | E1 | MDDSEIAYKYA | 350 | 11 | | 34514 |
| HPV31 | E1 | MGQWIKSR | 402 | 8 | | 34515 |
| HPV31 | E1 | MGQWIKSRCDK | 402 | 11 | | 34516 |
| HPV31 | E1 | MLDDATTPCWH | 500 | 11 | | 34517 |
| HPV31 | E1 | MLGKFKELY | 187 | 9 | | 34518 |
| HPV31 | E1 | MLIQPPKLR | 285 | 9 | 0.0005 | 34519 |
| HPV31 | E1 | MLMLVRFK | 255 | 8 | | 34520 |
| HPV31 | E1 | MLMLVRFKCA | 255 | 10 | | 34521 |
| HPV31 | E1 | MLMLVRFKCAK | 255 | 11 | | 34522 |
| HPV31 | E1 | MLVRFKCA | 257 | 8 | | 34523 |
| HPV31 | E1 | MLVRFKCAK | 257 | 9 | | 34524 |
| HPV31 | E1 | MLVRFKCAKNR | 257 | 11 | | 34525 |
| HPV31 | E1 | MSMGQWIK | 400 | 8 | | 34526 |
| HPV31 | E1 | MSMGQWIKSR | 400 | 10 | | 34527 |
| HPV31 | E1 | MSNISDVY | 306 | 8 | | 34528 |
| HPV31 | E1 | MVDFIDNCNVY | 47 | 11 | | 34529 |
| HPV31 | E1 | MVMLMLVR | 253 | 8 | | 34530 |
| HPV31 | E1 | MVMLMLVRF | 253 | 9 | | 34531 |
| HPV31 | E1 | MVMLMLVRFK | 253 | 10 | | 34532 |
| HPV31 | E1 | NAGKDDRWPY | 549 | 10 | | 34533 |
| HPV31 | E1 | NCILIHGA | 451 | 8 | | 34534 |
| HPV31 | E1 | NCMLIQPPK | 283 | 9 | | 34535 |
| HPV31 | E1 | NCMLIQPPKLR | 283 | 11 | | 34536 |
| HPV31 | E1 | NCNVYNNQA | 53 | 9 | | 34537 |
| HPV31 | E1 | NCNVYNNQAEA | 53 | 11 | | 34538 |
| HPV31 | E1 | NDGDSFSTF | 610 | 9 | | 34539 |
| HPV31 | E1 | NDGDSFSTFK | 610 | 10 | | 34540 |
| HPV31 | E1 | NDVMDDSEIA | 347 | 10 | | 34541 |
| HPV31 | E1 | NDVMDDSEIAY | 347 | 11 | | 34542 |
| HPV31 | E1 | NGKAAMLGK | 182 | 9 | | 34543 |
| HPV31 | E1 | NGKAAMLGKF | 182 | 10 | | 34544 |
| HPV31 | E1 | NGKAAMLGKFK | 182 | 11 | | 34545 |
| HPV31 | E1 | NGNPVYELSDK | 577 | 11 | | 34546 |
| HPV31 | E1 | NGSDGTHSER | 156 | 10 | | 34547 |
| HPV31 | E1 | NGWFYVEA | 15 | 8 | | 34548 |
| HPV31 | E1 | NINAGKDDR | 547 | 9 | | 34549 |
| HPV31 | E1 | NISPRLKA | 104 | 8 | | 34550 |
| HPV31 | E1 | NLHEEEDK | 601 | 8 | | 34551 |
| HPV31 | E1 | NSKTAKRR | 117 | 8 | | 34552 |
| HPV31 | E1 | NSKTAKRRLF | 117 | 10 | | 34553 |
| HPV31 | E1 | NSQAKIVK | 376 | 8 | | 34554 |
| HPV31 | E1 | NVYNNQAEA | 55 | 9 | | 34555 |
| HPV31 | E1 | PCWHYIDNY | 507 | 9 | | 34556 |
| HPV31 | E1 | PCWHYIDNYLR | 507 | 11 | | 34557 |
| HPV31 | E1 | PFDKNGNPVY | 573 | 10 | | 34558 |
| HPV31 | E1 | PLLITSNINA | 541 | 10 | | 34559 |
| HPV31 | E1 | PLSDISSCVDY | 93 | 11 | | 34560 |
| HPV31 | E1 | PTRNILQVLK | 170 | 10 | | 34561 |
| HPV31 | E1 | PVSIDVKH | 524 | 8 | | 34562 |
| HPV31 | E1 | PVSIDVKHK | 524 | 9 | | 34563 |
| HPV31 | E1 | PVSIDVKHKA | 524 | 10 | | 34564 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E1 | PVYELSDK | 580 | 8 | | 34565 |
| HPV31 | E1 | PVYELSDKNWK | 580 | 11 | | 34566 |
| HPV31 | E1 | QAEAETAQA | 60 | 9 | | 34567 |
| HPV31 | E1 | QAEAETAQALF | 60 | 11 | | 34568 |
| HPV31 | E1 | QALFHAQEA | 67 | 9 | | 34569 |
| HPV31 | E1 | QGCIISYA | 475 | 8 | | 34570 |
| HPV31 | E1 | QGCIISYANSK | 475 | 11 | | 34571 |
| HPV31 | E1 | QIEFVSFLSA | 430 | 10 | | 34572 |
| HPV31 | E1 | QLADSDSNA | 361 | 9 | | 34573 |
| HPV31 | E1 | QLADSDSNACA | 361 | 11 | | 34574 |
| HPV31 | E1 | QMSMGQWIK | 399 | 9 | | 34575 |
| HPV31 | E1 | QMSMGQWIKSR | 399 | 11 | | 34576 |
| HPV31 | E1 | QTVLQHSF | 323 | 8 | | 34577 |
| HPV31 | E1 | QVLKTSNGK | 176 | 9 | | 34578 |
| HPV31 | E1 | QVLKTSNGKA | 176 | 10 | | 34579 |
| HPV31 | E1 | QVLKTSNGKAA | 176 | 11 | | 34580 |
| HPV31 | E1 | RDIVKFLR | 420 | 8 | | 34581 |
| HPV31 | E1 | RDIVKFLRY | 420 | 9 | | 34582 |
| HPV31 | E1 | RFKCAKNR | 260 | 8 | | 34583 |
| HPV31 | E1 | RITIEKLLEK | 267 | 10 | | 34584 |
| HPV31 | E1 | RLFELPDSGY | 124 | 10 | | 34585 |
| HPV31 | E1 | RLNLHEEEDK | 599 | 10 | | 34586 |
| HPV31 | E1 | RLVVFTFPNPF | 562 | 11 | | 34587 |
| HPV31 | E1 | RSTAAALY | 293 | 8 | | 34588 |
| HPV31 | E1 | RSTAAALYWY | 293 | 10 | | 34589 |
| HPV31 | E1 | RSTAAALYWYR | 293 | 11 | | 34590 |
| HPV31 | E1 | RTGMSNISDVY | 303 | 11 | | 34591 |
| HPV31 | E1 | RTWCRLNLH | 595 | 9 | | 34592 |
| HPV31 | E1 | SALKLFLK | 438 | 8 | | 34593 |
| HPV31 | E1 | SCNGSDGTH | 154 | 9 | | 34594 |
| HPV31 | E1 | SCVDYNISPR | 99 | 10 | | 34595 |
| HPV31 | E1 | SDEGDWRDIVK | 414 | 11 | | 34596 |
| HPV31 | E1 | SDGTHSER | 158 | 8 | | 34597 |
| HPV31 | E1 | SDISSCVDY | 95 | 9 | | 34598 |
| HPV31 | E1 | SDKNWKSF | 585 | 8 | | 34599 |
| HPV31 | E1 | SDKNWKSFF | 585 | 9 | | 34600 |
| HPV31 | E1 | SDKNWKSFFSR | 585 | 11 | | 34601 |
| HPV31 | E1 | SDSNACAF | 365 | 8 | | 34602 |
| HPV31 | E1 | SDSNACAFLK | 365 | 10 | | 34603 |
| HPV31 | E1 | SDTGEDMVDF | 41 | 10 | | 34604 |
| HPV31 | E1 | SFFSRTWCR | 591 | 9 | | 34605 |
| HPV31 | E1 | SFLQGCIISY | 472 | 10 | | 34606 |
| HPV31 | E1 | SFLQGCIISYA | 472 | 11 | | 34607 |
| HPV31 | E1 | SFLSALKLF | 435 | 9 | | 34608 |
| HPV31 | E1 | SFLSALKLFLK | 435 | 11 | | 34609 |
| HPV31 | E1 | SFMELIRPF | 198 | 9 | | 34610 |
| HPV31 | E1 | SIDVKHKA | 526 | 8 | | 34611 |
| HPV31 | E1 | SMGQWIKSR | 401 | 9 | | 34612 |
| HPV31 | E1 | SSCVDYNISPR | 98 | 11 | | 34613 |
| HPV31 | E1 | SSDTGEDMVDF | 40 | 11 | | 34614 |
| HPV31 | E1 | STAAALYWY | 294 | 9 | | 34615 |
| HPV31 | E1 | STAAALYWYR | 294 | 10 | | 34616 |
| HPV31 | E1 | STCTDWCVA | 211 | 9 | | 34617 |
| HPV31 | E1 | STCTDWCVAA | 211 | 10 | | 34618 |
| HPV31 | E1 | STCTDWCVAAF | 211 | 11 | | 34619 |
| HPV31 | E1 | STNCMLIQPPK | 281 | 11 | | 34620 |
| HPV31 | E1 | TAAALYWY | 295 | 8 | | 34621 |
| HPV31 | E1 | TAAALYWYR | 295 | 9 | | 34622 |
| HPV31 | E1 | TAQALFHA | 65 | 8 | | 34623 |
| HPV31 | E1 | TAQALFHAQEA | 65 | 11 | | 34624 |
| HPV31 | E1 | TCTDWCVA | 212 | 8 | | 34625 |
| HPV31 | E1 | TCTDWCVAA | 212 | 9 | | 34626 |
| HPV31 | E1 | TCTDWCVAAF | 212 | 10 | | 34627 |
| HPV31 | E1 | TDWCVAAF | 214 | 8 | | 34628 |
| HPV31 | E1 | TFDLSQMVQWA | 334 | 11 | | 34629 |
| HPV31 | E1 | TFKCVSGQNIR | 617 | 11 | | 34630 |
| HPV31 | E1 | TFPNPFPF | 567 | 8 | | 34631 |
| HPV31 | E1 | TFPNPFPFDK | 567 | 10 | | 34632 |
| HPV31 | E1 | TGCNGWFY | 12 | 8 | | 34633 |
| HPV31 | E1 | TGCNGWFYVEA | 12 | 11 | | 34634 |
| HPV31 | E1 | TGEDMVDF | 43 | 8 | | 34635 |
| HPV31 | E1 | TGMSNISDVY | 304 | 10 | | 34636 |
| HPV31 | E1 | TGTVAEGF | 224 | 8 | | 34637 |
| HPV31 | E1 | TGTVAEGFK | 224 | 9 | | 34638 |
| HPV31 | E1 | TIEKLLEK | 269 | 8 | | 34639 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E1 | TLLQPYCLY | 233 | 9 | | 34640 |
| HPV31 | E1 | TLLQPYCLYCH | 233 | 11 | | 34641 |
| HPV31 | E1 | TLSCNGSDGTH | 152 | 11 | | 34642 |
| HPV31 | E1 | TMCRHYKR | 387 | 8 | | 34643 |
| HPV31 | E1 | TMCRHYKRA | 387 | 9 | | 34644 |
| HPV31 | E1 | TMCRHYKRAEK | 387 | 11 | | 34645 |
| HPV31 | E1 | TSNGKAAMLGK | 180 | 11 | | 34646 |
| HPV31 | E1 | TSNINAGK | 545 | 8 | | 34647 |
| HPV31 | E1 | TSNINAGKDDR | 545 | 11 | | 34648 |
| HPV31 | E1 | TTPCWHYIDNY | 505 | 11 | | 34649 |
| HPV31 | E1 | VAAFGVTGTVA | 218 | 11 | | 34650 |
| HPV31 | E1 | VDFIDNCNVY | 48 | 10 | | 34651 |
| HPV31 | E1 | VDYNISPR | 101 | 8 | | 34652 |
| HPV31 | E1 | VDYNISPRLK | 101 | 10 | | 34653 |
| HPV31 | E1 | VDYNISPRLKA | 101 | 11 | | 34654 |
| HPV31 | E1 | VFTFPNPF | 565 | 8 | | 34655 |
| HPV31 | E1 | VFTFPNPFPF | 565 | 10 | | 34656 |
| HPV31 | E1 | VLKTSNGK | 177 | 8 | | 34657 |
| HPV31 | E1 | VLKTSNGKA | 177 | 9 | | 34658 |
| HPV31 | E1 | VLKTSNGKAA | 177 | 10 | | 34659 |
| HPV31 | E1 | VLQHSFNDTTF | 325 | 11 | | 34660 |
| HPV31 | E1 | VMDDSEIA | 349 | 8 | | 34661 |
| HPV31 | E1 | VMDDSEIAY | 349 | 9 | | 34662 |
| HPV31 | E1 | VMDDSEIAYK | 349 | 10 | | 34663 |
| HPV31 | E1 | VMDDSEIAYKY | 349 | 11 | | 34664 |
| HPV31 | E1 | VMLMLVRF | 254 | 8 | | 34665 |
| HPV31 | E1 | VMLMLVRFK | 254 | 9 | | 34666 |
| HPV31 | E1 | VMLMLVRFKCA | 254 | 11 | | 34667 |
| HPV31 | E1 | VSDEGDWR | 413 | 8 | | 34668 |
| HPV31 | E1 | VSFLSALK | 434 | 8 | | 34669 |
| HPV31 | E1 | VSFLSALKLF | 434 | 10 | | 34670 |
| HPV31 | E1 | VSFMELIR | 197 | 8 | | 34671 |
| HPV31 | E1 | VSFMELIRPF | 197 | 10 | | 34672 |
| HPV31 | E1 | VSIDVKHK | 525 | 8 | | 34673 |
| HPV31 | E1 | VSIDVKHKA | 525 | 9 | | 34674 |
| HPV31 | E1 | VTGTVAEGF | 223 | 9 | | 34675 |
| HPV31 | E1 | VTGTVAEGFK | 223 | 10 | | 34676 |
| HPV31 | E1 | VVFTFPNPF | 564 | 9 | | 34677 |
| HPV31 | E1 | VVFTFPNPFPF | 564 | 11 | | 34678 |
| HPV31 | E1 | WFYVEAVIDR | 17 | 10 | | 34679 |
| HPV31 | E1 | WGMVMLMLVR | 251 | 10 | | 34680 |
| HPV31 | E1 | WGMVMLMLVRF | 251 | 11 | | 34681 |
| HPV31 | E1 | WIERQTVLQH | 319 | 10 | | 34682 |
| HPV31 | E1 | WIKSRCDK | 405 | 8 | | 34683 |
| HPV31 | E1 | WLQPLADA | 489 | 8 | | 34684 |
| HPV31 | E1 | WLQPLADAK | 489 | 9 | 0.0005 | 34685 |
| HPV31 | E1 | YANSKSHF | 481 | 8 | | 34686 |
| HPV31 | E1 | YAQLADSDSNA | 359 | 11 | | 34687 |
| HPV31 | E1 | YCHLQSLA | 241 | 8 | | 34688 |
| HPV31 | E1 | YCLYCHLQSLA | 238 | 11 | | 34689 |
| HPV31 | E1 | YFGMSLISF | 465 | 9 | | 34690 |
| HPV31 | E1 | YGETPEWIER | 313 | 10 | | 34691 |
| HPV31 | E1 | YGVSFMELIR | 195 | 10 | | 34692 |
| HPV31 | E1 | YIDNYLRNA | 511 | 9 | | 34693 |
| HPV31 | E1 | YLHSRLVVF | 558 | 9 | | 34694 |
| HPV31 | E1 | YLHSRLVVFTF | 558 | 11 | | 34695 |
| HPV31 | E1 | YVEAVIDR | 19 | 8 | | 34696 |
| HPV31 | E2 | AAACTNQTR | 277 | 9 | | 34697 |
| HPV31 | E2 | AAACTNQTRA | 277 | 10 | | 34698 |
| HPV31 | E2 | AACTNQTR | 278 | 8 | | 34699 |
| HPV31 | E2 | AACTNQTRA | 278 | 9 | | 34700 |
| HPV31 | E2 | ACTNQTRA | 279 | 8 | | 34701 |
| HPV31 | E2 | AGGQVIVF | 188 | 8 | | 34702 |
| HPV31 | E2 | AGIVTKLPTA | 208 | 10 | | 34703 |
| HPV31 | E2 | ALGTSEGVR | 229 | 9 | | 34704 |
| HPV31 | E2 | ALGTSEGVRR | 229 | 10 | | 34705 |
| HPV31 | E2 | ALGTSEGVRRA | 229 | 11 | | 34706 |
| HPV31 | E2 | ALSVSKAK | 61 | 8 | | 34707 |
| HPV31 | E2 | ALSVSKAKA | 61 | 9 | | 34708 |
| HPV31 | E2 | ATTPIIHLK | 291 | 9 | | 34709 |
| HPV31 | E2 | ATTSTKRPR | 239 | 9 | | 34710 |
| HPV31 | E2 | CALGTSEGVR | 228 | 10 | | 34711 |
| HPV31 | E2 | CALGTSEGVRR | 228 | 11 | | 34712 |
| HPV31 | E2 | CDHIDYWK | 27 | 8 | | 34713 |
| HPV31 | E2 | CDHIDYWKH | 27 | 9 | | 34714 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E2 | CDHIDYWKHIR | 27 | 11 | | 34715 |
| HPV31 | E2 | CGVISAAA | 272 | 8 | | 34716 |
| HPV31 | E2 | CLRYRLSK | 307 | 8 | | 34717 |
| HPV31 | E2 | CLRYRLSKY | 307 | 9 | | 34718 |
| HPV31 | E2 | CLRYRLSKYK | 307 | 10 | | 34719 |
| HPV31 | E2 | CTDGKHKNA | 330 | 9 | | 34720 |
| HPV31 | E2 | CTVVEGQVNCK | 145 | 11 | | 34721 |
| HPV31 | E2 | CVLMYKAR | 40 | 8 | | 34722 |
| HPV31 | E2 | DANILKCLR | 301 | 9 | | 34723 |
| HPV31 | E2 | DANILKCLRY | 301 | 10 | | 34724 |
| HPV31 | E2 | DANILKCLRYR | 301 | 11 | | 34725 |
| HPV31 | E2 | DDFLNTVK | 351 | 8 | | 34726 |
| HPV31 | E2 | DGDVHNTMH | 122 | 9 | | 34727 |
| HPV31 | E2 | DGDVHNTMHY | 122 | 10 | | 34728 |
| HPV31 | E2 | DSKRLCDH | 22 | 8 | | 34729 |
| HPV31 | E2 | DSKRLCDHIDY | 22 | 11 | | 34730 |
| HPV31 | E2 | DSVNCGVISA | 268 | 10 | | 34731 |
| HPV31 | E2 | DSVNCGVISAA | 268 | 11 | | 34732 |
| HPV31 | E2 | DVHNTMHY | 124 | 8 | | 34733 |
| HPV31 | E2 | EAKKYGTGK | 174 | 9 | | 34734 |
| HPV31 | E2 | EAKKYGTGKK | 174 | 10 | | 34735 |
| HPV31 | E2 | ECVLMYKA | 39 | 8 | | 34736 |
| HPV31 | E2 | ECVLMYKAR | 39 | 9 | | 34737 |
| HPV31 | E2 | EGHITYFVNF | 162 | 10 | | 34738 |
| HPV31 | E2 | EGQVNCKGIY | 149 | 10 | | 34739 |
| HPV31 | E2 | EGQVNCKGIYY | 149 | 11 | | 34740 |
| HPV31 | E2 | EGVRRATTSTK | 234 | 11 | | 34741 |
| HPV31 | E2 | EISFAGIVTK | 204 | 10 | | 34742 |
| HPV31 | E2 | EMGIHSINH | 48 | 9 | | 34743 |
| HPV31 | E2 | ESVFSSDEISF | 197 | 11 | | 34744 |
| HPV31 | E2 | ETLNNTEY | 80 | 8 | | 34745 |
| HPV31 | E2 | ETLNNTEYK | 80 | 9 | | 34746 |
| HPV31 | E2 | EVHAGGQVIVF | 185 | 11 | | 34747 |
| HPV31 | E2 | EVQFDGDVH | 118 | 9 | | 34748 |
| HPV31 | E2 | FAGIVTKLPTA | 207 | 11 | | 34749 |
| HPV31 | E2 | FDGDVHNTMH | 121 | 10 | | 34750 |
| HPV31 | E2 | FDGDVHNTMHY | 121 | 11 | | 34751 |
| HPV31 | E2 | FSSDEISF | 200 | 8 | | 34752 |
| HPV31 | E2 | FSSDEISFA | 200 | 9 | | 34753 |
| HPV31 | E2 | FTEEAKKY | 171 | 8 | | 34754 |
| HPV31 | E2 | FVNFTEEA | 168 | 8 | | 34755 |
| HPV31 | E2 | FVNFTEEAK | 168 | 9 | | 34756 |
| HPV31 | E2 | FVNFTEEAKK | 168 | 10 | | 34757 |
| HPV31 | E2 | FVNFTEEAKKY | 168 | 11 | | 34758 |
| HPV31 | E2 | GCLKKHGY | 108 | 8 | | 34759 |
| HPV31 | E2 | GDANILKCLR | 300 | 10 | | 34760 |
| HPV31 | E2 | GDANILKCLRY | 300 | 11 | | 34761 |
| HPV31 | E2 | GDVHNTMH | 123 | 8 | | 34762 |
| HPV31 | E2 | GDVHNTMHY | 123 | 9 | | 34763 |
| HPV31 | E2 | GIVTKLPTA | 209 | 9 | | 34764 |
| HPV31 | E2 | GIYYVHEGH | 156 | 9 | | 34765 |
| HPV31 | E2 | GTGKKWEVH | 179 | 9 | | 34766 |
| HPV31 | E2 | GTGKKWEVHA | 179 | 10 | | 34767 |
| HPV31 | E2 | GTSEGVRR | 231 | 8 | | 34768 |
| HPV31 | E2 | GTSEGVRRA | 231 | 9 | | 34769 |
| HPV31 | E2 | GVRRATTSTK | 235 | 10 | | 34770 |
| HPV31 | E2 | GVRRATTSTKR | 235 | 11 | | 34771 |
| HPV31 | E2 | HAGGQVIVF | 187 | 9 | | 34772 |
| HPV31 | E2 | HGYTVEVQF | 113 | 9 | | 34773 |
| HPV31 | E2 | HIDYWKHIR | 29 | 9 | | 34774 |
| HPV31 | E2 | HIRLECVLMY | 35 | 10 | | 34775 |
| HPV31 | E2 | HIRLECVLMYK | 35 | 11 | | 34776 |
| HPV31 | E2 | HITYFVNF | 164 | 8 | | 34777 |
| HPV31 | E2 | HLKGDANILK | 297 | 10 | | 34778 |
| HPV31 | E2 | HSINHQVVPA | 52 | 10 | | 34779 |
| HPV31 | E2 | IDYWKHIR | 30 | 8 | | 34780 |
| HPV31 | E2 | IIHLKGDA | 295 | 8 | | 34781 |
| HPV31 | E2 | ILEHYENDSK | 15 | 10 | | 34782 |
| HPV31 | E2 | ILEHYENDSKR | 15 | 11 | | 34783 |
| HPV31 | E2 | ILKCLRYR | 304 | 8 | | 34784 |
| HPV31 | E2 | ILKCLRYRLSK | 304 | 11 | | 34785 |
| HPV31 | E2 | ISAAACTNQTR | 275 | 11 | | 34786 |
| HPV31 | E2 | ISFAGIVTK | 205 | 9 | | 34787 |
| HPV31 | E2 | ISTSQRDDF | 345 | 9 | | 34788 |
| HPV31 | E2 | ITYFVNFTEEA | 165 | 11 | | 34789 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E2 | IVFPESVF | 193 | 8 | | 34790 |
| HPV31 | E2 | IVTKLPTA | 210 | 8 | | 34791 |
| HPV31 | E2 | KAREMGIH | 45 | 8 | | 34792 |
| HPV31 | E2 | KCLRYRLSK | 306 | 9 | | 34793 |
| HPV31 | E2 | KCLRYRLSKY | 306 | 10 | | 34794 |
| HPV31 | E2 | KCLRYRLSKYK | 306 | 11 | | 34795 |
| HPV31 | E2 | KGDANILK | 299 | 8 | | 34796 |
| HPV31 | E2 | KGDANILKCLR | 299 | 11 | | 34797 |
| HPV31 | E2 | KGIYYVHEGH | 155 | 10 | | 34798 |
| HPV31 | E2 | KILEHYENDSK | 14 | 11 | | 34799 |
| HPV31 | E2 | LCDHIDYWK | 26 | 9 | | 34800 |
| HPV31 | E2 | LCDHIDYWKH | 26 | 10 | | 34801 |
| HPV31 | E2 | LGTSEGVR | 230 | 8 | | 34802 |
| HPV31 | E2 | LGTSEGVRR | 230 | 9 | | 34803 |
| HPV31 | E2 | LGTSEGVRRA | 230 | 10 | | 34804 |
| HPV31 | E2 | LMYKAREMGIH | 42 | 11 | | 34805 |
| HPV31 | E2 | LSKYKQLY | 312 | 8 | | 34806 |
| HPV31 | E2 | LSQRLNVCQDK | 4 | 11 | | 34807 |
| HPV31 | E2 | LSVSKAKA | 62 | 8 | | 34808 |
| HPV31 | E2 | LSVSKAKALQA | 62 | 11 | | 34809 |
| HPV31 | E2 | LTAPTGCLK | 103 | 9 | | 34810 |
| HPV31 | E2 | LTAPTGCLKK | 103 | 10 | | 34811 |
| HPV31 | E2 | LTAPTGCLKKH | 103 | 11 | | 34812 |
| HPV31 | E2 | LTYISTSQR | 342 | 9 | | 34813 |
| HPV31 | E2 | MGIHSINH | 49 | 8 | | 34814 |
| HPV31 | E2 | MLETLNNTEY | 78 | 10 | | 34815 |
| HPV31 | E2 | MLETLNNTEYK | 78 | 11 | | 34816 |
| HPV31 | E2 | MMLETLNNTEY | 77 | 11 | | 34817 |
| HPV31 | E2 | NAIVTLTY | 337 | 8 | | 34818 |
| HPV31 | E2 | NCGVISAA | 271 | 8 | | 34819 |
| HPV31 | E2 | NCGVISAAA | 271 | 9 | | 34820 |
| HPV31 | E2 | NCKGIYYVH | 153 | 9 | | 34821 |
| HPV31 | E2 | NDSKRLCDH | 21 | 9 | | 34822 |
| HPV31 | E2 | NFTEEAKK | 170 | 8 | | 34823 |
| HPV31 | E2 | NFTEEAKKY | 170 | 9 | | 34824 |
| HPV31 | E2 | NILKCLRY | 303 | 8 | | 34825 |
| HPV31 | E2 | NILKCLRYR | 303 | 9 | | 34826 |
| HPV31 | E2 | NTHHPNKLLR | 254 | 10 | | 34827 |
| HPV31 | E2 | NTMHYTNWK | 127 | 9 | | 34828 |
| HPV31 | E2 | NTMHYTNWKF | 127 | 10 | | 34829 |
| HPV31 | E2 | NTTTSNSK | 219 | 8 | | 34830 |
| HPV31 | E2 | NTTTSNSKTCA | 219 | 11 | | 34831 |
| HPV31 | E2 | NTVSVSTGY | 361 | 9 | | 34832 |
| HPV31 | E2 | NVCQDKILEH | 9 | 10 | | 34833 |
| HPV31 | E2 | NVCQDKILEHY | 9 | 11 | | 34834 |
| HPV31 | E2 | PALSVSKA | 60 | 8 | | 34835 |
| HPV31 | E2 | PALSVSKAK | 60 | 9 | | 34836 |
| HPV31 | E2 | PALSVSKAKA | 60 | 10 | | 34837 |
| HPV31 | E2 | PATTPIIH | 290 | 8 | | 34838 |
| HPV31 | E2 | PATTPIIHLK | 290 | 10 | | 34839 |
| HPV31 | E2 | PIIHLKGDA | 294 | 9 | | 34840 |
| HPV31 | E2 | PTGCLKKH | 106 | 8 | | 34841 |
| HPV31 | E2 | PTGCLKKHGY | 106 | 10 | | 34842 |
| HPV31 | E2 | QDKILEHY | 12 | 8 | | 34843 |
| HPV31 | E2 | QFDGDVHNTMH | 120 | 11 | | 34844 |
| HPV31 | E2 | QLYEQVSSTWH | 317 | 11 | | 34845 |
| HPV31 | E2 | QTRAVSCPA | 283 | 9 | | 34846 |
| HPV31 | E2 | QTSLELYLTA | 96 | 10 | | 34847 |
| HPV31 | E2 | QVIVFPESVF | 191 | 10 | | 34848 |
| HPV31 | E2 | QVNCKGIY | 151 | 8 | | 34849 |
| HPV31 | E2 | QVNCKGIYY | 151 | 9 | | 34850 |
| HPV31 | E2 | QVNCKGIYYVH | 151 | 11 | | 34851 |
| HPV31 | E2 | QVVPALSVSK | 57 | 10 | | 34852 |
| HPV31 | E2 | QVVPALSVSKA | 57 | 11 | | 34853 |
| HPV31 | E2 | RATTSTKR | 238 | 8 | | 34854 |
| HPV31 | E2 | RATTSTKRPR | 238 | 10 | | 34855 |
| HPV31 | E2 | RDDFLNTVK | 350 | 9 | | 34856 |
| HPV31 | E2 | RLCDHIDY | 25 | 8 | | 34857 |
| HPV31 | E2 | RLCDHIDYWK | 25 | 10 | | 34858 |
| HPV31 | E2 | RLCDHIDYWKH | 25 | 11 | | 34859 |
| HPV31 | E2 | RLECVLMY | 37 | 8 | | 34860 |
| HPV31 | E2 | RLECVLMYK | 37 | 9 | | 34861 |
| HPV31 | E2 | RLECVLMYKA | 37 | 10 | | 34862 |
| HPV31 | E2 | RLECVLMYKAR | 37 | 11 | | 34863 |
| HPV31 | E2 | RLNVCQDK | 7 | 8 | | 34864 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E2 | RLSKYKQLY | 311 | 9 | | 34865 |
| HPV31 | E2 | RTEPEHRNTH | 247 | 10 | | 34866 |
| HPV31 | E2 | RTEPEHRNTHH | 247 | 11 | | 34867 |
| HPV31 | E2 | SAAACTNQTR | 276 | 10 | | 34868 |
| HPV31 | E2 | SAAACTNQTRA | 276 | 11 | | 34869 |
| HPV31 | E2 | SCPATTPIIH | 288 | 10 | | 34870 |
| HPV31 | E2 | SFAGIVTK | 206 | 8 | | 34871 |
| HPV31 | E2 | SINHQVVPA | 53 | 9 | | 34872 |
| HPV31 | E2 | SLELYLTA | 98 | 8 | | 34873 |
| HPV31 | E2 | SSDEISFA | 201 | 8 | | 34874 |
| HPV31 | E2 | STKRPRTEPEH | 242 | 11 | | 34875 |
| HPV31 | E2 | STSQRDDF | 346 | 8 | | 34876 |
| HPV31 | E2 | STWHWTCTDGK | 324 | 11 | | 34877 |
| HPV31 | E2 | SVFSSDEISF | 198 | 10 | | 34878 |
| HPV31 | E2 | SVFSSDEISFA | 198 | 11 | | 34879 |
| HPV31 | E2 | SVNCGVISA | 269 | 9 | | 34880 |
| HPV31 | E2 | SVNCGVISAA | 269 | 10 | | 34881 |
| HPV31 | E2 | SVNCGVISAAA | 269 | 11 | | 34882 |
| HPV31 | E2 | SVSKAKALQA | 63 | 10 | | 34883 |
| HPV31 | E2 | TANNTTTSNSK | 216 | 11 | | 34884 |
| HPV31 | E2 | TAPTGCLK | 104 | 8 | | 34885 |
| HPV31 | E2 | TAPTGCLKK | 104 | 9 | | 34886 |
| HPV31 | E2 | TAPTGCLKKH | 104 | 10 | | 34887 |
| HPV31 | E2 | TCALGTSEGVR | 227 | 11 | | 34888 |
| HPV31 | E2 | TCTDGKHK | 329 | 8 | | 34889 |
| HPV31 | E2 | TCTDGKHKNA | 329 | 10 | | 34890 |
| HPV31 | E2 | TDGKHKNA | 331 | 8 | | 34891 |
| HPV31 | E2 | TGCLKKHGY | 107 | 9 | | 34892 |
| HPV31 | E2 | TGKKWEVH | 180 | 8 | | 34893 |
| HPV31 | E2 | TGKKWEVHA | 180 | 9 | | 34894 |
| HPV31 | E2 | TLNNTEYK | 81 | 8 | | 34895 |
| HPV31 | E2 | TLTYISTSQR | 341 | 10 | | 34896 |
| HPV31 | E2 | TMHYTNWK | 128 | 8 | | 34897 |
| HPV31 | E2 | TMHYTNWKF | 128 | 9 | | 34898 |
| HPV31 | E2 | TMHYTNWKFIY | 128 | 11 | | 34899 |
| HPV31 | E2 | TMQQTSLELY | 93 | 10 | | 34900 |
| HPV31 | E2 | TSEGVRRA | 232 | 8 | | 34901 |
| HPV31 | E2 | TSLELYLTA | 97 | 9 | | 34902 |
| HPV31 | E2 | TSNSKTCA | 222 | 8 | | 34903 |
| HPV31 | E2 | TTPIIHLK | 292 | 8 | | 34904 |
| HPV31 | E2 | TTPIIHLKGDA | 292 | 11 | | 34905 |
| HPV31 | E2 | TTSNSKTCA | 221 | 9 | | 34906 |
| HPV31 | E2 | TTSTKRPR | 240 | 8 | | 34907 |
| HPV31 | E2 | TTTSNSKTCA | 220 | 10 | | 34908 |
| HPV31 | E2 | TVEVQFDGDVH | 116 | 11 | | 34909 |
| HPV31 | E2 | TVSVSTGY | 362 | 8 | | 34910 |
| HPV31 | E2 | TVVEGQVNCK | 146 | 10 | | 34911 |
| HPV31 | E2 | VCQDKILEH | 10 | 9 | | 34912 |
| HPV31 | E2 | VCQDKILEHY | 10 | 10 | | 34913 |
| HPV31 | E2 | VDSVNCGVISA | 267 | 11 | | 34914 |
| HPV31 | E2 | VFSSDEISF | 199 | 9 | | 34915 |
| HPV31 | E2 | VFSSDEISFA | 199 | 10 | | 34916 |
| HPV31 | E2 | VIVFPESVF | 192 | 9 | | 34917 |
| HPV31 | E2 | VSCPATTPIIH | 287 | 11 | | 34918 |
| HPV31 | E2 | VSKAKALQA | 64 | 9 | | 34919 |
| HPV31 | E2 | VTLTYISTSQR | 340 | 11 | | 34920 |
| HPV31 | E2 | VVEGQVNCK | 147 | 9 | | 34921 |
| HPV31 | E2 | VVPALSVSK | 58 | 9 | | 34922 |
| HPV31 | E2 | VVPALSVSKA | 58 | 10 | | 34923 |
| HPV31 | E2 | VVPALSVSKAK | 58 | 11 | | 34924 |
| HPV31 | E2 | WTCTDGKH | 328 | 8 | | 34925 |
| HPV31 | E2 | WTCTDGKHK | 328 | 9 | | 34926 |
| HPV31 | E2 | WTCTDGKHKNA | 328 | 11 | | 34927 |
| HPV31 | E2 | WTMQQTSLELY | 92 | 11 | | 34928 |
| HPV31 | E2 | YFVNFTEEA | 167 | 9 | | 34929 |
| HPV31 | E2 | YFVNFTEEAK | 167 | 10 | | 34930 |
| HPV31 | E2 | YFVNFTEEAKK | 167 | 11 | | 34931 |
| HPV31 | E2 | YGTGKKWEVH | 178 | 10 | | 34932 |
| HPV31 | E2 | YGTGKKWEVHA | 178 | 11 | | 34933 |
| HPV31 | E2 | YISTSQRDDF | 344 | 10 | | 34934 |
| HPV31 | E2 | YLTAPTGCLK | 102 | 10 | | 34935 |
| HPV31 | E2 | YLTAPTGCLKK | 102 | 11 | | 34936 |
| HPV31 | E2 | YTNWKFIY | 131 | 8 | | 34937 |
| HPV31 | E2 | YVHEGHITY | 159 | 9 | | 34938 |
| HPV31 | E2 | YVHEGHITYF | 159 | 10 | | 34939 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E5 | ATSPLRCF | 53 | 8 | | 34940 |
| HPV31 | E5 | ATSPLRCFCIY | 53 | 11 | | 34941 |
| HPV31 | E5 | CFCIYVVF | 59 | 8 | | 34942 |
| HPV31 | E5 | CFCIYVVFIY | 59 | 10 | | 34943 |
| HPV31 | E5 | CFLLCFCVLLF | 14 | 11 | | 34944 |
| HPV31 | E5 | CIYVVFIY | 61 | 8 | | 34945 |
| HPV31 | E5 | CVLLFVCLVIR | 20 | 11 | | 34946 |
| HPV31 | E5 | FCIYVVFIY | 60 | 9 | | 34947 |
| HPV31 | E5 | FIYIPLFVIH | 66 | 10 | | 34948 |
| HPV31 | E5 | FLLCFCVLLF | 15 | 10 | | 34949 |
| HPV31 | E5 | FVIHTHASF | 72 | 9 | | 34950 |
| HPV31 | E5 | IATSPLRCF | 52 | 9 | | 34951 |
| HPV31 | E5 | ILWVIATSPLR | 48 | 11 | | 34952 |
| HPV31 | E5 | ISTVSIVLCF | 6 | 10 | | 34953 |
| HPV31 | E5 | IVILWVIA | 46 | 8 | | 34954 |
| HPV31 | E5 | IVLCFLLCF | 11 | 9 | | 34955 |
| HPV31 | E5 | LCFCVLLF | 17 | 8 | | 34956 |
| HPV31 | E5 | LFVCLVIR | 23 | 8 | | 34957 |
| HPV31 | E5 | LFVIHTHA | 71 | 8 | | 34958 |
| HPV31 | E5 | LFVIHTHASF | 71 | 10 | | 34959 |
| HPV31 | E5 | LIVILWVIA | 45 | 9 | | 34960 |
| HPV31 | E5 | LLCFCVLLF | 16 | 9 | | 34961 |
| HPV31 | E5 | LLFVCLVIR | 22 | 9 | | 34962 |
| HPV31 | E5 | LLIVILWVIA | 44 | 10 | | 34963 |
| HPV31 | E5 | LLLIVILWVIA | 43 | 11 | | 34964 |
| HPV31 | E5 | LVLSVSVY | 32 | 8 | | 34965 |
| HPV31 | E5 | LVLSVSVYA | 32 | 9 | | 34966 |
| HPV31 | E5 | NISTVSIVLCF | 5 | 11 | | 34967 |
| HPV31 | E5 | PLFVIHTH | 70 | 8 | | 34968 |
| HPV31 | E5 | PLFVIHTHA | 70 | 9 | | 34969 |
| HPV31 | E5 | PLFVIHTHASF | 70 | 11 | | 34970 |
| HPV31 | E5 | PLRCFCIY | 56 | 8 | | 34971 |
| HPV31 | E5 | PLRCFCIYVVF | 56 | 11 | | 34972 |
| HPV31 | E5 | PLVLSVSVY | 31 | 9 | | 34973 |
| HPV31 | E5 | PLVLSVSVYA | 31 | 10 | | 34974 |
| HPV31 | E5 | RCFCIYVVF | 58 | 9 | | 34975 |
| HPV31 | E5 | RCFCIYVVFIY | 58 | 11 | | 34976 |
| HPV31 | E5 | SIVLCFLLCF | 10 | 10 | | 34977 |
| HPV31 | E5 | STVSIVLCF | 7 | 9 | | 34978 |
| HPV31 | E5 | TSPLRCFCIY | 54 | 10 | | 34979 |
| HPV31 | E5 | TVSIVLCF | 8 | 8 | | 34980 |
| HPV31 | E5 | VFIYIPLF | 65 | 8 | | 34981 |
| HPV31 | E5 | VFIYIPLFVIH | 65 | 11 | | 34982 |
| HPV31 | E5 | VIATSPLR | 51 | 8 | | 34983 |
| HPV31 | E5 | VIATSPLRCF | 51 | 10 | | 34984 |
| HPV31 | E5 | VIHTHASF | 73 | 8 | | 34985 |
| HPV31 | E5 | VLCFLLCF | 12 | 8 | | 34986 |
| HPV31 | E5 | VLLFVCLVIR | 21 | 10 | | 34987 |
| HPV31 | E5 | VLSVSVYA | 33 | 8 | | 34988 |
| HPV31 | E5 | VSIVLCFLLCF | 9 | 11 | | 34989 |
| HPV31 | E5 | VVFIYIPLF | 64 | 9 | | 34990 |
| HPV31 | E5 | WVIATSPLR | 50 | 9 | | 34991 |
| HPV31 | E5 | WVIATSPLRCF | 50 | 11 | | 34992 |
| HPV31 | E5 | YIPLFVIH | 68 | 8 | | 34993 |
| HPV31 | E5 | YIPLFVIHTH | 68 | 10 | | 34994 |
| HPV31 | E5 | YIPLFVIHTHA | 68 | 11 | | 34995 |
| HPV31 | E5 | YVVFIYIPLF | 63 | 10 | | 34996 |
| HPV31 | E6 | AFTDLTIVY | 46 | 9 | | 34997 |
| HPV31 | E6 | AFTDLTIVYR | 46 | 10 | | 34998 |
| HPV31 | E6 | ALEIPYDELR | 18 | 10 | | 34999 |
| HPV31 | E6 | CIACWRRPR | 136 | 9 | | 35000 |
| HPV31 | E6 | CLRFYSKVSEF | 66 | 11 | | 35001 |
| HPV31 | E6 | CTKCLRFY | 63 | 8 | | 35002 |
| HPV31 | E6 | CTKCLRFYSK | 63 | 10 | | 35003 |
| HPV31 | E6 | DDTPHGVCTK | 56 | 10 | | 35004 |
| HPV31 | E6 | DFAFTDLTIVY | 44 | 11 | | 35005 |
| HPV31 | E6 | DLLIRCITCQR | 98 | 11 | | 35006 |
| HPV31 | E6 | DTPHGVCTK | 57 | 9 | | 35007 |
| HPV31 | E6 | EFRWYRYSVY | 75 | 10 | | 35008 |
| HPV31 | E6 | EIPYDELR | 20 | 8 | | 35009 |
| HPV31 | E6 | ELRLNCVY | 25 | 8 | | 35010 |
| HPV31 | E6 | ELRLNCVYCK | 25 | 10 | | 35011 |
| HPV31 | E6 | ELSSALEIPY | 14 | 10 | | 35012 |
| HPV31 | E6 | ETEVLDFA | 39 | 8 | | 35013 |
| HPV31 | E6 | ETEVLDFAF | 39 | 9 | | 35014 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E6 | FAFTDLTIVY | 45 | 10 | | 35015 |
| HPV31 | E6 | FAFTDLTIVYR | 45 | 11 | | 35016 |
| HPV31 | E6 | FTDLTIVY | 47 | 8 | | 35017 |
| HPV31 | E6 | FTDLTIVYR | 47 | 9 | | 35018 |
| HPV31 | E6 | GGRWTGRCIA | 129 | 10 | | 35019 |
| HPV31 | E6 | GICDLLIR | 95 | 8 | | 35020 |
| HPV31 | E6 | GTTLEKLTNK | 85 | 10 | | 35021 |
| HPV31 | E6 | GVCTKCLR | 61 | 8 | | 35022 |
| HPV31 | E6 | GVCTKCLRF | 61 | 9 | | 35023 |
| HPV31 | E6 | GVCTKCLRFY | 61 | 10 | | 35024 |
| HPV31 | E6 | HGVCTKCLR | 60 | 9 | | 35025 |
| HPV31 | E6 | HGVCTKCLRF | 60 | 10 | | 35026 |
| HPV31 | E6 | HGVCTKCLRFY | 60 | 11 | | 35027 |
| HPV31 | E6 | HLDKKKRF | 118 | 8 | | 35028 |
| HPV31 | E6 | HLDKKKRFH | 118 | 9 | | 35029 |
| HPV31 | E6 | IACWRRPR | 137 | 8 | | 35030 |
| HPV31 | E6 | IGGRWTGR | 128 | 8 | | 35031 |
| HPV31 | E6 | IGGRWTGRCIA | 128 | 11 | | 35032 |
| HPV31 | E6 | IVYRDDTPH | 52 | 9 | | 35033 |
| HPV31 | E6 | KCLRFYSK | 65 | 8 | | 35034 |
| HPV31 | E6 | KGICDLLIR | 94 | 9 | | 35035 |
| HPV31 | E6 | KLHELSSA | 11 | 8 | | 35036 |
| HPV31 | E6 | KVSEFRWY | 72 | 8 | | 35037 |
| HPV31 | E6 | KVSEFRWYR | 72 | 9 | | 35038 |
| HPV31 | E6 | KVSEFRWYRY | 72 | 10 | | 35039 |
| HPV31 | E6 | LCPEEKQR | 110 | 8 | | 35040 |
| HPV31 | E6 | LCPEEKQRH | 110 | 9 | 0.0003 | 35041 |
| HPV31 | E6 | LDKKKRFH | 119 | 8 | | 35042 |
| HPV31 | E6 | LIRCITCQR | 100 | 9 | | 35043 |
| HPV31 | E6 | LLIRCITCQR | 99 | 10 | | 35044 |
| HPV31 | E6 | LSSALEIPY | 15 | 9 | | 35045 |
| HPV31 | E6 | LTETEVLDF | 37 | 9 | | 35046 |
| HPV31 | E6 | LTETEVLDFA | 37 | 10 | | 35047 |
| HPV31 | E6 | LTETEVLDFAF | 37 | 11 | | 35048 |
| HPV31 | E6 | LTIVYRDDTPH | 50 | 11 | | 35049 |
| HPV31 | E6 | MFKNPAER | 1 | 8 | | 35050 |
| HPV31 | E6 | MFKNPAERPR | 1 | 10 | | 35051 |
| HPV31 | E6 | MFKNPAERPRK | 1 | 11 | | 35052 |
| HPV31 | E6 | NIGGRWTGR | 127 | 9 | | 35053 |
| HPV31 | E6 | PAERPRKLH | 5 | 9 | | 35054 |
| HPV31 | E6 | PLCPEEKQR | 109 | 9 | 0.0002 | 35055 |
| HPV31 | E6 | PLCPEEKQRH | 109 | 10 | | 35056 |
| HPV31 | E6 | QLTETEVLDF | 36 | 10 | | 35057 |
| HPV31 | E6 | QLTETEVLDFA | 36 | 11 | | 35058 |
| HPV31 | E6 | RCIACWRR | 135 | 8 | | 35059 |
| HPV31 | E6 | RCIACWRRPR | 135 | 10 | | 35060 |
| HPV31 | E6 | RDDTPHGVCTK | 55 | 11 | | 35061 |
| HPV31 | E6 | RFHNIGGR | 124 | 8 | | 35062 |
| HPV31 | E6 | RFYSKVSEF | 68 | 9 | | 35063 |
| HPV31 | E6 | RFYSKVSEFR | 68 | 10 | | 35064 |
| HPV31 | E6 | RLNCVYCK | 27 | 8 | | 35065 |
| HPV31 | E6 | SALEIPYDELR | 17 | 11 | | 35066 |
| HPV31 | E6 | SSALEIPY | 16 | 8 | | 35067 |
| HPV31 | E6 | SVYGTTLEK | 82 | 9 | | 35068 |
| HPV31 | E6 | TCQRPLCPEEK | 105 | 11 | | 35069 |
| HPV31 | E6 | TDLTIVYR | 48 | 8 | | 35070 |
| HPV31 | E6 | TGRCIACWR | 133 | 9 | | 35071 |
| HPV31 | E6 | TGRCIACWRR | 133 | 10 | | 35072 |
| HPV31 | E6 | TIVYRDDTPH | 51 | 10 | | 35073 |
| HPV31 | E6 | TLEKLTNK | 87 | 8 | | 35074 |
| HPV31 | E6 | TTLEKLTNK | 86 | 9 | | 35075 |
| HPV31 | E6 | VCTKCLRF | 62 | 8 | | 35076 |
| HPV31 | E6 | VCTKCLRFY | 62 | 9 | | 35077 |
| HPV31 | E6 | VCTKCLRFYSK | 62 | 11 | | 35078 |
| HPV31 | E6 | VSEFRWYR | 73 | 8 | | 35079 |
| HPV31 | E6 | VSEFRWYRY | 73 | 9 | | 35080 |
| HPV31 | E6 | WTGRCIACWR | 132 | 10 | | 35081 |
| HPV31 | E6 | WTGRCIACWRR | 132 | 11 | | 35082 |
| HPV31 | E6 | YDELRLNCVY | 23 | 10 | | 35083 |
| HPV31 | E6 | YGTTLEKLTNK | 84 | 11 | | 35084 |
| HPV31 | E6 | YSKVSEFR | 70 | 8 | | 35085 |
| HPV31 | E6 | YSKVSEFRWY | 70 | 10 | | 35086 |
| HPV31 | E6 | YSKVSEFRWYR | 70 | 11 | | 35087 |
| HPV31 | E6 | YSVYGTTLEK | 81 | 10 | | 35088 |
| HPV31 | E7 | AGQAEPDTSNY | 42 | 11 | | 35089 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | E7 | CCQCKSTLR | 58 | 9 | | 35090 |
| HPV31 | E7 | CVQSTQVDIR | 68 | 10 | | 35091 |
| HPV31 | E7 | DLQPEATDLH | 14 | 10 | | 35092 |
| HPV31 | E7 | DTSNYNIVTF | 48 | 10 | | 35093 |
| HPV31 | E7 | DVIDSPAGQA | 36 | 10 | | 35094 |
| HPV31 | E7 | EATDLHCY | 18 | 8 | | 35095 |
| HPV31 | E7 | EDVIDSPA | 35 | 8 | | 35096 |
| HPV31 | E7 | EDVIDSPAGQA | 35 | 11 | | 35097 |
| HPV31 | E7 | ETPTLQDY | 4 | 8 | | 35098 |
| HPV31 | E7 | FCCQCKSTLR | 57 | 10 | | 35099 |
| HPV31 | E7 | FGIVCPNSCSR | 87 | 11 | | 35100 |
| HPV31 | E7 | GIVCPNCSTR | 88 | 10 | | 35101 |
| HPV31 | E7 | IDSPAGQA | 38 | 8 | | 35102 |
| HPV31 | E7 | ILQELLMGSF | 78 | 10 | | 35103 |
| HPV31 | E7 | IVCPNCSTR | 89 | 9 | | 35104 |
| HPV31 | E7 | IVTFCCQCK | 54 | 9 | | 35105 |
| HPV31 | E7 | LCVQSTQVDIR | 67 | 11 | | 35106 |
| HPV31 | E7 | LDLQPEATDLH | 13 | 11 | | 35107 |
| HPV31 | E7 | NIVTFCCQCK | 53 | 10 | | 35108 |
| HPV31 | E7 | PDTSNYNIVTF | 47 | 11 | | 35109 |
| HPV31 | E7 | QAEPDTSNY | 44 | 9 | | 35110 |
| HPV31 | E7 | QDYVLDLQPEA | 9 | 11 | | 35111 |
| HPV31 | E7 | QSTQVDIR | 70 | 8 | | 35112 |
| HPV31 | E7 | RGETPTLQDY | 2 | 10 | | 35113 |
| HPV31 | E7 | RILQELLMGSF | 77 | 11 | | 35114 |
| HPV31 | E7 | SDEEDVIDSPA | 32 | 11 | | 35115 |
| HPV31 | E7 | TFCCQCKSTLR | 56 | 11 | | 35116 |
| HPV31 | E7 | TSNYNIVTF | 49 | 9 | | 35117 |
| HPV31 | E7 | VCPNCSTR | 90 | 8 | | 35118 |
| HPV31 | E7 | VIDSPAGQA | 37 | 9 | | 35119 |
| HPV31 | E7 | VLDLQPEA | 12 | 8 | | 35120 |
| HPV31 | E7 | VTFCCQCK | 55 | 8 | | 35121 |
| HPV31 | E7 | YVLDLQPEA | 11 | 9 | | 35122 |
| HPV31 | L1 | AAIANSDTTF | 347 | 10 | | 35123 |
| HPV31 | L1 | AAIANSDTTFK | 347 | 11 | | 35124 |
| HPV31 | L1 | ACVGLEVGR | 102 | 9 | | 35125 |
| HPV31 | L1 | ADIMTYIH | 386 | 8 | | 35126 |
| HPV31 | L1 | ADLDQFPLGR | 458 | 10 | | 35127 |
| HPV31 | L1 | ADLDQFPLGRK | 458 | 11 | | 35128 |
| HPV31 | L1 | AGGPGTDNR | 137 | 9 | | 35129 |
| HPV31 | L1 | AGKRSAPSA | 483 | 9 | | 35130 |
| HPV31 | L1 | AGSARLLTVGH | 37 | 11 | | 35131 |
| HPV31 | L1 | AGYRARPK | 473 | 8 | | 35132 |
| HPV31 | L1 | AGYRARPKF | 473 | 9 | | 35133 |
| HPV31 | L1 | AGYRARPKFK | 473 | 10 | | 35134 |
| HPV31 | L1 | AGYRARPKFKA | 473 | 11 | | 35135 |
| HPV31 | L1 | AIANSDTTF | 348 | 9 | | 35136 |
| HPV31 | L1 | AIANSDTTFK | 348 | 10 | | 35137 |
| HPV31 | L1 | AILEDWNF | 398 | 8 | | 35138 |
| HPV31 | L1 | AITCQKTA | 426 | 8 | | 35139 |
| HPV31 | L1 | AITCQKTAPQK | 426 | 11 | | 35140 |
| HPV31 | L1 | AMDFTALQDTK | 208 | 11 | | 35141 |
| HPV31 | L1 | ASTTTPAK | 491 | 8 | | 35142 |
| HPV31 | L1 | ASTTTPAKR | 491 | 9 | | 35143 |
| HPV31 | L1 | ASTTTPAKRK | 491 | 10 | | 35144 |
| HPV31 | L1 | ASTTTPAKRKK | 491 | 11 | | 35145 |
| HPV31 | L1 | ATLANSTY | 285 | 8 | | 35146 |
| HPV31 | L1 | ATLANSTYF | 285 | 9 | | 35147 |
| HPV31 | L1 | CAAIANSDTTF | 346 | 11 | | 35148 |
| HPV31 | L1 | CVGLEVGR | 103 | 8 | | 35149 |
| HPV31 | L1 | DAQIFNKPY | 304 | 9 | | 35150 |
| HPV31 | L1 | DCPPLELK | 185 | 8 | | 35151 |
| HPV31 | L1 | DDTENSNR | 128 | 8 | | 35152 |
| HPV31 | L1 | DDTENSNRY | 128 | 9 | | 35153 |
| HPV31 | L1 | DDTENSNRYA | 128 | 10 | | 35154 |
| HPV31 | L1 | DFTALQDTK | 210 | 9 | | 35155 |
| HPV31 | L1 | DGDMVDTGF | 198 | 9 | | 35156 |
| HPV31 | L1 | DGDMVDTGFGA | 198 | 11 | | 35157 |
| HPV31 | L1 | DICNSICK | 224 | 8 | | 35158 |
| HPV31 | L1 | DICNSICKY | 224 | 9 | | 35159 |
| HPV31 | L1 | DLDQFPLGR | 459 | 9 | | 35160 |
| HPV31 | L1 | DLDQFPLGRK | 459 | 10 | | 35161 |
| HPV31 | L1 | DLDQFPLGRKF | 459 | 11 | | 35162 |
| HPV31 | L1 | DLQFIFQLCK | 372 | 10 | | 35163 |
| HPV31 | L1 | DLYIKGSGSTA | 275 | 11 | | 35164 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | L1 | DMVDTGFGA | 200 | 9 | | 35165 |
| HPV31 | L1 | DTENSNRY | 129 | 8 | | 35166 |
| HPV31 | L1 | DTENSNRYA | 129 | 9 | | 35167 |
| HPV31 | L1 | DTGFGAMDG | 203 | 9 | | 35168 |
| HPV31 | L1 | DTGFGAMDFTA | 203 | 11 | | 35169 |
| HPV31 | L1 | DTLFFYLR | 245 | 8 | | 35170 |
| HPV31 | L1 | DTLFFYLRR | 245 | 9 | | 35171 |
| HPV31 | L1 | DTSFYNPETQR | 88 | 11 | | 35172 |
| HPV31 | L1 | DTTFKSSNF | 353 | 9 | | 35173 |
| HPV31 | L1 | DTTFKSSNFK | 353 | 10 | | 35174 |
| HPV31 | L1 | DTYRFVTSQA | 417 | 10 | | 35175 |
| HPV31 | L1 | ECISMDYK | 146 | 8 | | 35176 |
| HPV31 | L1 | EDPFKDYVF | 439 | 9 | | 35177 |
| HPV31 | L1 | EDTYRFVTSQA | 416 | 11 | | 35178 |
| HPV31 | L1 | EFDLQFIF | 370 | 8 | | 35179 |
| HPV31 | L1 | ESVPTDLY | 270 | 8 | | 35180 |
| HPV31 | L1 | ESVPTDLYIK | 270 | 10 | | 35181 |
| HPV31 | L1 | ETQRLVWA | 95 | 8 | | 35182 |
| HPV31 | L1 | EVNLKEKF | 449 | 8 | | 35183 |
| HPV31 | L1 | EVNLKEKFSA | 449 | 10 | | 35184 |
| HPV31 | L1 | FDDTENSNR | 127 | 9 | | 35185 |
| HPV31 | L1 | FDDTENSNRY | 127 | 10 | | 35186 |
| HPV31 | L1 | FDDTENSNRYA | 127 | 11 | | 35187 |
| HPV31 | L1 | FDLQFIFQLCK | 371 | 11 | | 35188 |
| HPV31 | L1 | FFYLRREQMF | 248 | 10 | | 35189 |
| HPV31 | L1 | FGAMDFTA | 206 | 8 | | 35190 |
| HPV31 | L1 | FGFPDTSF | 84 | 8 | | 35191 |
| HPV31 | L1 | FGFPDTSFY | 84 | 9 | | 35192 |
| HPV31 | L1 | FLLQAGYR | 469 | 8 | | 35193 |
| HPV31 | L1 | FLLQAGYRA | 469 | 9 | | 35194 |
| HPV31 | L1 | FLLQAGYRAR | 469 | 10 | | 35195 |
| HPV31 | L1 | FSADLDQF | 456 | 8 | | 35196 |
| HPV31 | L1 | FTALQDTK | 211 | 8 | | 35197 |
| HPV31 | L1 | FVRHFFNR | 257 | 8 | | 35198 |
| HPV31 | L1 | FVTSQAITCQK | 421 | 11 | | 35199 |
| HPV31 | L1 | FVTVVDTTR | 331 | 9 | | 35200 |
| HPV31 | L1 | GCKPPIGEH | 161 | 9 | | 35201 |
| HPV31 | L1 | GDCPPLELK | 184 | 9 | | 35202 |
| HPV31 | L1 | GDMVDTGF | 199 | 8 | | 35203 |
| HPV31 | L1 | GDMVDTGFGA | 199 | 10 | | 35204 |
| HPV31 | L1 | GDTLFFYLR | 244 | 9 | | 35205 |
| HPV31 | L1 | GDTLFFYLRR | 244 | 10 | | 35206 |
| HPV31 | L1 | GFGAMDFTA | 205 | 9 | | 35207 |
| HPV31 | L1 | GFPDTSFY | 85 | 8 | | 35208 |
| HPV31 | L1 | GGPGTDNR | 138 | 8 | | 35209 |
| HPV31 | L1 | GICWGNQLF | 323 | 9 | | 35210 |
| HPV31 | L1 | GISGHPLLNK | 117 | 10 | | 35211 |
| HPV31 | L1 | GISGHPLLNKF | 117 | 11 | | 35212 |
| HPV31 | L1 | GLQYRVFR | 68 | 8 | | 35213 |
| HPV31 | L1 | GLQYRVFRVR | 68 | 10 | | 35214 |
| HPV31 | L1 | GSARLLTVGH | 38 | 10 | | 35215 |
| HPV31 | L1 | GSGSTATLA | 280 | 9 | | 35216 |
| HPV31 | L1 | GSLEDTYR | 413 | 8 | | 35217 |
| HPV31 | L1 | GSLEDTYRF | 413 | 9 | | 35218 |
| HPV31 | L1 | GSMVTSDA | 298 | 8 | | 35219 |
| HPV31 | L1 | GSMVTSDAQIF | 298 | 11 | | 35220 |
| HPV31 | L1 | GSPCSNNA | 173 | 8 | | 35221 |
| HPV31 | L1 | GSTATLANSTY | 282 | 11 | | 35222 |
| HPV31 | L1 | HGEEFDLQF | 367 | 9 | | 35223 |
| HPV31 | L1 | HGEEFDLQFIF | 367 | 11 | | 35224 |
| HPV31 | L1 | IANSDTTF | 349 | 8 | | 35225 |
| HPV31 | L1 | IANSDTTFK | 349 | 9 | | 35226 |
| HPV31 | L1 | ICKYPDYLK | 229 | 9 | | 35227 |
| HPV31 | L1 | ICNSICKY | 225 | 8 | | 35228 |
| HPV31 | L1 | ICMSICKYPDY | 225 | 11 | | 35229 |
| HPV31 | L1 | ICWGNQLF | 324 | 8 | | 35230 |
| HPV31 | L1 | IFNKPYWMQR | 307 | 10 | | 35231 |
| HPV31 | L1 | IFNKPYWMQRA | 307 | 11 | | 35232 |
| HPV31 | L1 | IFQLCKITLSA | 376 | 11 | | 35233 |
| HPV31 | L1 | IMTYIHSMNPA | 388 | 11 | | 35234 |
| HPV31 | L1 | ISGHPLLNK | 118 | 9 | | 35235 |
| HPV31 | L1 | ISGHPLLNKF | 118 | 10 | | 35236 |
| HPV31 | L1 | ITCQKTAPQK | 427 | 10 | | 35237 |
| HPV31 | L1 | ITLSADIMTY | 382 | 10 | | 35238 |
| HPV31 | L1 | IVVPKVSGLQY | 61 | 11 | | 35239 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | L1 | KAGKRSAPSA | 482 | 10 | | 35240 |
| HPV31 | L1 | KDYVFWEVNLK | 443 | 11 | | 35241 |
| HPV31 | L1 | KFDDTENSNR | 126 | 10 | | 35242 |
| HPV31 | L1 | KFDDTENSNRY | 126 | 11 | | 35243 |
| HPV31 | L1 | KFGFPDTSF | 83 | 9 | | 35244 |
| HPV31 | L1 | KFGFPDTSFY | 83 | 10 | | 35245 |
| HPV31 | L1 | KFKAGKRSA | 480 | 9 | | 35246 |
| HPV31 | L1 | KFLLQAGY | 468 | 8 | | 35247 |
| HPV31 | L1 | KFLLQAGYR | 468 | 9 | | 35248 |
| HPV31 | L1 | KFLLQAGYRA | 468 | 10 | | 35249 |
| HPV31 | L1 | KFLLQAGYRAR | 468 | 11 | | 35250 |
| HPV31 | L1 | KFSADLDQF | 455 | 9 | | 35251 |
| HPV31 | L1 | KGSGSTATLA | 279 | 10 | | 35252 |
| HPV31 | L1 | KGSPCSNNA | 172 | 9 | | 35253 |
| HPV31 | L1 | KITLSADIMTY | 381 | 11 | | 35254 |
| HPV31 | L1 | KSSNFKEY | 357 | 8 | | 35255 |
| HPV31 | L1 | KSSNFKEYLR | 357 | 10 | | 35256 |
| HPV31 | L1 | KSSNFKEYLRH | 357 | 11 | | 35257 |
| HPV31 | L1 | KTAPQKPK | 431 | 8 | | 35258 |
| HPV31 | L1 | KVSGLQYR | 65 | 8 | | 35259 |
| HPV31 | L1 | KVSGLQYRVF | 65 | 10 | | 35260 |
| HPV31 | L1 | KVSGLQYRVFR | 65 | 11 | | 35261 |
| HPV31 | L1 | KVVSTDEY | 20 | 8 | | 35262 |
| HPV31 | L1 | KVVSTDEYVTR | 20 | 11 | | 35263 |
| HPV31 | L1 | LCKITLSA | 379 | 8 | | 35264 |
| HPV31 | L1 | LDICNSICK | 223 | 9 | | 35265 |
| HPV31 | L1 | LDICNSICKY | 223 | 10 | | 35266 |
| HPV31 | L1 | LDQFPLGR | 460 | 8 | | 35267 |
| HPV31 | L1 | LDQFPLGRK | 460 | 9 | | 35268 |
| HPV31 | L1 | LDQFPLGRKF | 460 | 10 | | 35269 |
| HPV31 | L1 | LFFYLRREQMF | 247 | 11 | | 35270 |
| HPV31 | L1 | LFVTVVDTTR | 330 | 10 | | 35271 |
| HPV31 | L1 | LGCKPPIGEH | 160 | 10 | | 35272 |
| HPV31 | L1 | LGRKFLLQA | 465 | 9 | | 35273 |
| HPV31 | L1 | LGRKFLLQAGY | 465 | 11 | | 35274 |
| HPV31 | L1 | LGVGISGH | 114 | 8 | | 35275 |
| HPV31 | L1 | LLGCKPPIGEH | 159 | 11 | | 35276 |
| HPV31 | L1 | LLQAGYRA | 470 | 8 | | 35277 |
| HPV31 | L1 | LLQAGYRAR | 470 | 9 | | 35278 |
| HPV31 | L1 | LLQAGYRARPK | 470 | 11 | | 35279 |
| HPV31 | L1 | LLTVGHPY | 42 | 8 | | 35280 |
| HPV31 | L1 | LLTVGHPYY | 42 | 9 | | 35281 |
| HPV31 | L1 | LSADIMTY | 384 | 8 | | 35282 |
| HPV31 | L1 | LSADIMTYIH | 384 | 10 | | 35283 |
| HPV31 | L1 | LTVGHPYY | 43 | 8 | | 35284 |
| HPV31 | L1 | MDFTALQDTK | 209 | 10 | | 35285 |
| HPV31 | L1 | MFVRHFFNR | 256 | 9 | | 35286 |
| HPV31 | L1 | MSLWRPSEA | 1 | 9 | | 35287 |
| HPV31 | L1 | MSVCAAIA | 343 | 8 | | 35288 |
| HPV31 | L1 | MTYIHSMNPA | 389 | 10 | | 35289 |
| HPV31 | L1 | MVAEPYGDTLF | 238 | 11 | | 35290 |
| HPV31 | L1 | MVDTGFGA | 201 | 8 | | 35291 |
| HPV31 | L1 | MVDTGFGAMDF | 201 | 11 | | 35292 |
| HPV31 | L1 | MVTSDAQIF | 300 | 9 | | 35293 |
| HPV31 | L1 | MVTSDAQIFNK | 300 | 11 | | 35294 |
| HPV31 | L1 | NFKEYLRH | 360 | 8 | | 35295 |
| HPV31 | L1 | NGICWGNQLF | 322 | 10 | | 35296 |
| HPV31 | L1 | NIYYHAGSA | 32 | 9 | | 35297 |
| HPV31 | L1 | NIYYHAGSAR | 32 | 10 | | 35298 |
| HPV31 | L1 | NLKEKFSA | 451 | 8 | | 35299 |
| HPV31 | L1 | NMSVCAAIA | 342 | 9 | | 35300 |
| HPV31 | L1 | NSDTTFKSSNF | 351 | 11 | | 35301 |
| HPV31 | L1 | NSICKYPDY | 227 | 9 | | 35302 |
| HPV31 | L1 | NSICKYPDYLK | 227 | 11 | | 35303 |
| HPV31 | L1 | PAILEDWNF | 397 | 9 | | 35304 |
| HPV31 | L1 | PAKRKKTK | 496 | 8 | | 35305 |
| HPV31 | L1 | PAKRKKTKK | 496 | 9 | | 35306 |
| HPV31 | L1 | PDPNKFGF | 79 | 8 | | 35307 |
| HPV31 | L1 | PDYLKMVA | 233 | 8 | | 35308 |
| HPV31 | L1 | PDYLKMVAEPY | 233 | 11 | | 35309 |
| HPV31 | L1 | PGDCPPLELK | 183 | 10 | | 35310 |
| HPV31 | L1 | PIGEHWGK | 165 | 8 | | 35311 |
| HPV31 | L1 | PLDICNSICK | 222 | 10 | | 35312 |
| HPV31 | L1 | PLDICNSICKY | 222 | 11 | | 35313 |
| HPV31 | L1 | PLGRKFLLQA | 464 | 10 | | 35314 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | L1 | PLGVGISGH | 113 | 9 | | 35315 |
| HPV31 | L1 | PSASTTTPA | 489 | 9 | | 35316 |
| HPV31 | L1 | PSASTTTPAK | 489 | 10 | | 35317 |
| HPV31 | L1 | PSASTTTPAKR | 489 | 11 | | 35318 |
| HPV31 | L1 | PSGSLEDTY | 411 | 9 | | 35319 |
| HPV31 | L1 | PSGSLEDTYR | 411 | 10 | | 35320 |
| HPV31 | L1 | PSGSLEDTYRF | 411 | 11 | | 35321 |
| HPV31 | L1 | PSGSMVTSDA | 296 | 10 | | 35322 |
| HPV31 | L1 | PVSKVVSTDEY | 17 | 11 | | 35323 |
| HPV31 | L1 | QAGYRARPK | 472 | 9 | | 35324 |
| HPV31 | L1 | QAGYRARPKF | 472 | 10 | | 35325 |
| HPV31 | L1 | QAGYRARPKFK | 472 | 11 | | 35326 |
| HPV31 | L1 | QAITCQKTA | 425 | 9 | | 35327 |
| HPV31 | L1 | QDGDMVDTGF | 197 | 10 | | 35328 |
| HPV31 | L1 | QFIFQLCK | 374 | 8 | | 35329 |
| HPV31 | L1 | QFPLGRKF | 462 | 8 | | 35330 |
| HPV31 | L1 | QIFNKPYWMQR | 306 | 11 | | 35331 |
| HPV31 | L1 | QLCKITLSA | 378 | 9 | | 35332 |
| HPV31 | L1 | QLCLLGCK | 156 | 8 | | 35333 |
| HPV31 | L1 | QLFVTVVDTTR | 329 | 11 | | 35334 |
| HPV31 | L1 | QMFVRHFF | 255 | 8 | | 35335 |
| HPV31 | L1 | QMFVRHFFNR | 255 | 10 | | 35336 |
| HPV31 | L1 | QTQLCLLGCK | 154 | 10 | | 35337 |
| HPV31 | L1 | RARPKFKA | 476 | 8 | | 35338 |
| HPV31 | L1 | RARPKFKAGK | 476 | 10 | | 35339 |
| HPV31 | L1 | RARPKFKAGKR | 476 | 11 | | 35340 |
| HPV31 | L1 | RLLTVGHPY | 41 | 9 | | 35341 |
| HPV31 | L1 | RLLTVGHPYY | 41 | 10 | | 35342 |
| HPV31 | L1 | RLPDPNKF | 77 | 8 | | 35343 |
| HPV31 | L1 | RLPDPNKFGF | 77 | 10 | | 35344 |
| HPV31 | L1 | RSTNMSVCA | 339 | 9 | | 35345 |
| HPV31 | L1 | RSTNMSVCAA | 339 | 10 | | 35346 |
| HPV31 | L1 | RTNIYYHA | 30 | 8 | | 35347 |
| HPV31 | L1 | RTNIYYHAGSA | 30 | 11 | | 35348 |
| HPV31 | L1 | RVRLPDPNK | 75 | 9 | | 35349 |
| HPV31 | L1 | RVRLPDPNKF | 75 | 10 | | 35350 |
| HPV31 | L1 | SADIMTYIH | 385 | 9 | | 35351 |
| HPV31 | L1 | SADLDQFPLGR | 457 | 11 | | 35352 |
| HPV31 | L1 | SAPSASTTTPA | 487 | 11 | | 35353 |
| HPV31 | L1 | SARLLTVGH | 39 | 9 | | 35354 |
| HPV31 | L1 | SARLLTVGHPY | 39 | 11 | | 35355 |
| HPV31 | L1 | SASTTTPA | 490 | 8 | | 35356 |
| HPV31 | L1 | SASTTTPAK | 490 | 9 | | 35357 |
| HPV31 | L1 | SASTTTPAKR | 490 | 10 | | 35358 |
| HPV31 | L1 | SASTTTPAKRK | 490 | 11 | | 35359 |
| HPV31 | L1 | SDAQIFNK | 303 | 8 | | 35360 |
| HPV31 | L1 | SDAQIFNKPY | 303 | 10 | | 35361 |
| HPV31 | L1 | SDNPKKIVVPK | 55 | 11 | | 35362 |
| HPV31 | L1 | SDTTFKSSNF | 352 | 10 | | 35363 |
| HPV31 | L1 | SDTTFKSSNFK | 352 | 11 | | 35364 |
| HPV31 | L1 | SFYNPETQR | 90 | 9 | | 35365 |
| HPV31 | L1 | SGHPLLNK | 119 | 8 | | 35366 |
| HPV31 | L1 | SGHPLLNKF | 119 | 9 | | 35367 |
| HPV31 | L1 | SGLQYRVF | 67 | 8 | | 35368 |
| HPV31 | L1 | SGLQYRVFR | 67 | 9 | | 35369 |
| HPV31 | L1 | SGLQYRVFRVR | 67 | 11 | | 35370 |
| HPV31 | L1 | SGSLEDTY | 412 | 8 | | 35371 |
| HPV31 | L1 | SGSLEDTYR | 412 | 9 | | 35372 |
| HPV31 | L1 | SGSLEDTYRF | 412 | 10 | | 35373 |
| HPV31 | L1 | SGSMVTSDA | 297 | 9 | | 35374 |
| HPV31 | L1 | SGSTATLA | 281 | 8 | | 35375 |
| HPV31 | L1 | SICKYPDY | 228 | 8 | | 35376 |
| HPV31 | L1 | SICKYPDYLK | 228 | 10 | | 35377 |
| HPV31 | L1 | SIPKSDNPK | 51 | 9 | | 35378 |
| HPV31 | L1 | SIPKSDNPKK | 51 | 10 | | 35379 |
| HPV31 | L1 | SLEDTYRF | 414 | 8 | | 35380 |
| HPV31 | L1 | SLWRPSEA | 2 | 8 | | 35381 |
| HPV31 | L1 | SLWRPSEATVY | 2 | 11 | | 35382 |
| HPV31 | L1 | SMVTSDAQIF | 299 | 10 | | 35383 |
| HPV31 | L1 | SSNFKEYLR | 358 | 9 | | 35384 |
| HPV31 | L1 | SSNFKEYLRH | 358 | 10 | | 35385 |
| HPV31 | L1 | STATLANSTY | 283 | 10 | | 35386 |
| HPV31 | L1 | STATLANSTYF | 283 | 11 | | 35387 |
| HPV31 | L1 | STDEYVTR | 23 | 8 | | 35388 |
| HPV31 | L1 | STNMSVCA | 340 | 8 | | 35389 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | L1 | STNMSVCAA | 340 | 9 | | 35390 |
| HPV31 | L1 | STNMSVCAAIA | 340 | 11 | | 35391 |
| HPV31 | L1 | STTTPAKR | 492 | 8 | | 35392 |
| HPV31 | L1 | STTTPAKRK | 492 | 9 | | 35393 |
| HPV31 | L1 | STTTPAKRKK | 492 | 10 | | 35394 |
| HPV31 | L1 | SVPTDLYIK | 271 | 9 | | 35395 |
| HPV31 | L1 | TAPQKPKEDPF | 432 | 11 | | 35396 |
| HPV31 | L1 | TATLANSTY | 284 | 9 | | 35397 |
| HPV31 | L1 | TATLANSTYF | 284 | 10 | | 35398 |
| HPV31 | L1 | TCQKTAPQK | 428 | 9 | | 35399 |
| HPV31 | L1 | TCQKTAPQKPK | 428 | 11 | | 35400 |
| HPV31 | L1 | TDEYVTRTNIY | 24 | 11 | | 35401 |
| HPV31 | L1 | TDNRECISMDY | 142 | 11 | | 35402 |
| HPV31 | L1 | TFKSSNFK | 355 | 8 | | 35403 |
| HPV31 | L1 | TFKSSNFKEY | 355 | 10 | | 35404 |
| HPV31 | L1 | TGFGAMDF | 204 | 8 | | 35405 |
| HPV31 | L1 | TGFGAMDFTA | 204 | 10 | | 35406 |
| HPV31 | L1 | TLANSTYF | 286 | 8 | | 35407 |
| HPV31 | L1 | TLFFYLRR | 246 | 8 | | 35408 |
| HPV31 | L1 | TLSADIMTY | 383 | 9 | | 35409 |
| HPV31 | L1 | TLSADIMTYIH | 383 | 11 | | 35410 |
| HPV31 | L1 | TSDAQIFNK | 302 | 9 | | 35411 |
| HPV31 | L1 | TSDAQIFNKPY | 302 | 11 | | 35412 |
| HPV31 | L1 | TSFYNPETQR | 89 | 10 | | 35413 |
| HPV31 | L1 | TSQAITCQK | 423 | 9 | | 35414 |
| HPV31 | L1 | TSQAITCQKTA | 423 | 11 | | 35415 |
| HPV31 | L1 | TTFKSSNF | 354 | 8 | | 35416 |
| HPV31 | L1 | TTFKSSNFK | 354 | 9 | | 35417 |
| HPV31 | L1 | TTFKSSNFKEY | 354 | 11 | | 35418 |
| HPV31 | L1 | TTPAKRKK | 494 | 8 | | 35419 |
| HPV31 | L1 | TTPAKRKKTK | 494 | 10 | | 35420 |
| HPV31 | L1 | TTPAKRKKTKK | 494 | 11 | | 35421 |
| HPV31 | L1 | TTRSTNMSVCA | 337 | 11 | | 35422 |
| HPV31 | L1 | TTTPAKRK | 493 | 8 | | 35423 |
| HPV31 | L1 | TTTPAKRKK | 493 | 9 | | 35424 |
| HPV31 | L1 | TTPAKRKKTK | 493 | 11 | | 35425 |
| HPV31 | L1 | TVGESVPTDLY | 267 | 11 | | 35426 |
| HPV31 | L1 | TVGHPYYSIPK | 44 | 11 | | 35427 |
| HPV31 | L1 | TVYLPPVPVSK | 10 | 11 | | 35428 |
| HPV31 | L1 | VAEPYGDTLF | 239 | 10 | | 35429 |
| HPV31 | L1 | VAEPYGDTLFF | 239 | 11 | | 35430 |
| HPV31 | L1 | VDTGFGAMDF | 202 | 10 | | 35431 |
| HPV31 | L1 | VFRVRLPDPNK | 73 | 11 | | 35432 |
| HPV31 | L1 | VFWEVNLK | 446 | 8 | | 35433 |
| HPV31 | L1 | VFWEVNLKEK | 446 | 10 | | 35434 |
| HPV31 | L1 | VFWEVNLKEKF | 446 | 11 | | 35435 |
| HPV31 | L1 | VGESVPTDLY | 268 | 10 | | 35436 |
| HPV31 | L1 | VGHPYYSIPK | 45 | 10 | | 35437 |
| HPV31 | L1 | VGISGHPLLNK | 116 | 11 | | 35438 |
| HPV31 | L1 | VSGLQYRVF | 66 | 9 | | 35439 |
| HPV31 | L1 | VSGLQYRVFR | 66 | 10 | | 35440 |
| HPV31 | L1 | VSKVVSTDEY | 18 | 10 | | 35441 |
| HPV31 | L1 | VSTDEYVTR | 22 | 9 | | 35442 |
| HPV31 | L1 | VTRTNIYY | 28 | 8 | | 35443 |
| HPV31 | L1 | VTRTNIYYH | 28 | 9 | | 35444 |
| HPV31 | L1 | VTRTNIYYHA | 28 | 10 | | 35445 |
| HPV31 | L1 | VTSDAQIF | 301 | 8 | | 35446 |
| HPV31 | L1 | VTSDAQIFNK | 301 | 10 | | 35447 |
| HPV31 | L1 | VTSQAITCQK | 422 | 10 | | 35448 |
| HPV31 | L1 | VTVVDTTR | 332 | 8 | | 35449 |
| HPV31 | L1 | VVPKVSGLQY | 62 | 10 | | 35450 |
| HPV31 | L1 | VVPKVSGLQYR | 62 | 11 | | 35451 |
| HPV31 | L1 | VVSTDEYVTR | 21 | 10 | | 35452 |
| HPV31 | L1 | WACVGLEVGR | 101 | 10 | | 35453 |
| HPV31 | L1 | WGKGSPCSNNA | 170 | 11 | | 35454 |
| HPV31 | L1 | WMQRAQGH | 313 | 8 | | 35455 |
| HPV31 | L1 | YAGGPGTDNR | 136 | 10 | | 35456 |
| HPV31 | L1 | YGDTLFFY | 243 | 8 | | 35457 |
| HPV31 | L1 | TGDTLFFYLR | 243 | 10 | | 35458 |
| HPV31 | L1 | YGDTLFFYLRR | 243 | 11 | | 35459 |
| HPV31 | L1 | YIHSMNPA | 391 | 8 | | 35460 |
| HPV31 | L1 | YIKGSGSTA | 277 | 9 | | 35461 |
| HPV31 | L1 | YLKMVAEPY | 235 | 9 | | 35462 |
| HPV31 | L1 | YLPPVPVSK | 12 | 9 | | 35463 |
| HPV31 | L1 | YLRHGEEF | 364 | 8 | | 35464 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | L1 | YLRREQMF | 250 | 8 | | 35465 |
| HPV31 | L1 | YLRREQMFVR | 250 | 10 | | 35466 |
| HPV31 | L1 | YLRREQMFVRH | 250 | 11 | | 35467 |
| HPV31 | L1 | YSIPKSDNPK | 50 | 10 | | 35468 |
| HPV31 | L1 | YSIPKSDNPKK | 50 | 11 | | 35469 |
| HPV31 | L1 | YVFWEVNLK | 445 | 9 | | 35470 |
| HPV31 | L1 | YVFWEVNLKEK | 445 | 11 | | 35471 |
| HPV31 | L1 | YVTRTNIY | 27 | 8 | | 35472 |
| HPV31 | L1 | YVTRTNIYY | 27 | 9 | | 35473 |
| HPV31 | L1 | YVTRTNIYYH | 27 | 10 | | 35474 |
| HPV31 | L1 | YVTRTNIYYHA | 27 | 11 | | 35475 |
| HPV31 | L2 | ADTDFTVDTPA | 357 | 11 | | 35476 |
| HPV31 | L2 | AGTCPSDVIPK | 25 | 11 | | 35477 |
| HPV31 | L2 | AILDVTSVSTH | 143 | 11 | | 35478 |
| HPV31 | L2 | ALHRPALTSR | 281 | 10 | | 35479 |
| HPV31 | L2 | ALHRPALTSRR | 281 | 11 | | 35480 |
| HPV31 | L2 | ALTSRRNTVR | 286 | 10 | | 35481 |
| HPV31 | L2 | ALTSRRNTVRY | 286 | 11 | | 35482 |
| HPV31 | L2 | ASATQLYQTCK | 13 | 11 | | 35483 |
| HPV31 | L2 | ATHNVSPSTA | 367 | 10 | | 35484 |
| HPV31 | L2 | ATIGARVH | 311 | 8 | | 35485 |
| HPV31 | L2 | ATIGARVHY | 311 | 9 | | 35486 |
| HPV31 | L2 | ATIGARVHYY | 311 | 10 | | 35487 |
| HPV31 | L2 | ATIGARVHYYY | 311 | 11 | | 35488 |
| HPV31 | L2 | ATQLYQTCK | 15 | 9 | | 35489 |
| HPV31 | L2 | ATQLYQTCKA | 15 | 10 | | 35490 |
| HPV31 | L2 | ATQLYQTCKAA | 15 | 11 | | 35491 |
| HPV31 | L2 | ATTADTTPA | 135 | 9 | | 35492 |
| HPV31 | L2 | AVQSTSAVSA | 376 | 10 | | 35493 |
| HPV31 | L2 | AVQSTSAVSAY | 376 | 11 | | 35494 |
| HPV31 | L2 | DFLDIIALH | 275 | 9 | | 35495 |
| HPV31 | L2 | DFLDIIALHR | 275 | 10 | | 35496 |
| HPV31 | L2 | DFTVDTPA | 360 | 8 | | 35497 |
| HPV31 | L2 | DFTVDTPATH | 360 | 10 | | 35498 |
| HPV31 | L2 | DFYLHPSY | 438 | 8 | | 35499 |
| HPV31 | L2 | DFYLHPSYY | 438 | 9 | | 35500 |
| HPV31 | L2 | DGGDFYLH | 435 | 8 | | 35501 |
| HPV31 | L2 | DGGDFYLHPSY | 435 | 11 | | 35502 |
| HPV31 | L2 | DGLYDIYA | 350 | 8 | | 35503 |
| HPV31 | L2 | DIATTADTTPA | 133 | 11 | | 35504 |
| HPV31 | L2 | DIIALHRPA | 278 | 9 | | 35505 |
| HPV31 | L2 | DISSINPA | 322 | 8 | | 35506 |
| HPV31 | L2 | DIYADTDF | 354 | 8 | | 35507 |
| HPV31 | L2 | DTDFTVDTPA | 358 | 10 | | 35508 |
| HPV31 | L2 | DVGAPAPIPH | 116 | 10 | | 35509 |
| HPV31 | L2 | DVIPKIEH | 31 | 8 | | 35510 |
| HPV31 | L2 | DVTSVSTH | 146 | 8 | | 35511 |
| HPV31 | L2 | EMQPLGASA | 334 | 9 | | 35512 |
| HPV31 | L2 | ESGIVDVGA | 111 | 9 | | 35513 |
| HPV31 | L2 | ESGIVDVGAPA | 111 | 11 | | 35514 |
| HPV31 | L2 | ESIEMQPLGA | 331 | 10 | | 35515 |
| HPV31 | L2 | ESLYFSNTSH | 259 | 10 | | 35516 |
| HPV31 | L2 | ETVNAEESLY | 253 | 10 | | 35517 |
| HPV31 | L2 | ETVNAEESLYF | 253 | 11 | | 35518 |
| HPV31 | L2 | FFTDVSVA | 458 | 8 | | 35519 |
| HPV31 | L2 | FFTDVSVAA | 458 | 9 | | 35520 |
| HPV31 | L2 | FLDIIALH | 276 | 8 | | 35521 |
| HPV31 | L2 | FLDIIALHR | 276 | 9 | | 35522 |
| HPV31 | L2 | FLDIIALHRPA | 276 | 11 | | 35523 |
| HPV31 | L2 | FLSAPKQLITY | 237 | 11 | | 35524 |
| HPV31 | L2 | FSGPDVPIEH | 404 | 10 | | 35525 |
| HPV31 | L2 | FSGPDVPIEHA | 404 | 11 | | 35526 |
| HPV31 | L2 | FSNTSHNIA | 263 | 9 | | 35527 |
| HPV31 | L2 | FTDVSVAA | 459 | 8 | | 35528 |
| HPV31 | L2 | FTVDTPATH | 361 | 9 | | 35529 |
| HPV31 | L2 | FVDGGDFY | 433 | 8 | | 35530 |
| HPV31 | L2 | FVDGGDFYLH | 433 | 10 | | 35531 |
| HPV31 | L2 | GAPAPIPH | 118 | 8 | | 35532 |
| HPV31 | L2 | GARVHYYY | 314 | 8 | | 35533 |
| HPV31 | L2 | GATIGARVH | 310 | 9 | | 35534 |
| HPV31 | L2 | GATIGARVHY | 310 | 10 | | 35535 |
| HPV31 | L2 | GATIGARVHYY | 310 | 11 | | 35536 |
| HPV31 | L2 | GDFYLHPSY | 437 | 9 | | 35537 |
| HPV31 | L2 | GDFYLHPSYY | 437 | 10 | | 35538 |
| HPV31 | L2 | GFDIATTA | 131 | 8 | | 35539 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | L2 | GGDFYLHPSY | 436 | 10 | | 35540 |
| HPV31 | L2 | GGDFYLHPSYY | 436 | 11 | | 35541 |
| HPV31 | L2 | GIGSGSGTGGR | 59 | 11 | | 35542 |
| HPV31 | L2 | GIVDVGAPA | 113 | 9 | | 35543 |
| HPV31 | L2 | GLYDIYADTDF | 351 | 11 | | 35544 |
| HPV31 | L2 | GLYSKATQQVK | 221 | 11 | | 35545 |
| HPV31 | L2 | GSGSGTGGR | 61 | 9 | | 35546 |
| HPV31 | L2 | GSGTGGRTGY | 63 | 10 | | 35547 |
| HPV31 | L2 | GTCPSDVIPK | 26 | 10 | | 35548 |
| HPV31 | L2 | GTGGRTGY | 65 | 8 | | 35549 |
| HPV31 | L2 | GVRRPARLGLY | 213 | 11 | | 35550 |
| HPV31 | L2 | HAPTQVFPF | 413 | 9 | | 35551 |
| HPV31 | L2 | HTTIADQILR | 38 | 10 | | 35552 |
| HPV31 | L2 | HTTIADQILRY | 38 | 11 | | 35553 |
| HPV31 | L2 | IADQILRY | 41 | 8 | | 35554 |
| HPV31 | L2 | IALHRPALTSR | 280 | 11 | | 35555 |
| HPV31 | L2 | IATTADTTPA | 134 | 10 | | 35556 |
| HPV31 | L2 | IDPTFLSA | 233 | 8 | | 35557 |
| HPV31 | L2 | IDPTFLSAPK | 233 | 10 | | 35558 |
| HPV31 | L2 | IFSGPDVPIEH | 403 | 11 | | 35559 |
| HPV31 | L2 | IFVDGGDF | 432 | 8 | | 35560 |
| HPV31 | L2 | IFVDGGDFY | 432 | 9 | | 35561 |
| HPV31 | L2 | IFVDGGDFYLH | 432 | 11 | | 35562 |
| HPV31 | L2 | IGARVHYY | 313 | 8 | | 35563 |
| HPV31 | L2 | IGARVHYYY | 313 | 9 | | 35564 |
| HPV31 | L2 | IGSGSGTGGR | 60 | 10 | | 35565 |
| HPV31 | L2 | IIALHRPA | 279 | 8 | | 35566 |
| HPV31 | L2 | ILDVTSVSTH | 144 | 10 | | 35567 |
| HPV31 | L2 | ILRYGSMGVF | 45 | 10 | | 35568 |
| HPV31 | L2 | ILRYGSMGVFF | 45 | 11 | | 35569 |
| HPV31 | L2 | ITSSTPIPGVR | 205 | 11 | | 35570 |
| HPV31 | L2 | ITYENPAY | 245 | 8 | | 35571 |
| HPV31 | L2 | IVDVGAPA | 114 | 8 | | 35572 |
| HPV31 | L2 | KIEHTTIA | 35 | 8 | | 35573 |
| HPV31 | L2 | KVIDPTFLSA | 231 | 10 | | 35574 |
| HPV31 | L2 | LAPTTPQVSIF | 423 | 11 | | 35575 |
| HPV31 | L2 | LDIIALHR | 277 | 8 | | 35576 |
| HPV31 | L2 | LDIIALHRPA | 277 | 10 | | 35577 |
| HPV31 | L2 | LDVTSVSTH | 145 | 9 | | 35578 |
| HPV31 | L2 | LGNKQTLR | 299 | 8 | | 35579 |
| HPV31 | L2 | LGNKQTLRTR | 299 | 10 | | 35580 |
| HPV31 | L2 | LITYENPA | 244 | 8 | | 35581 |
| HPV31 | L2 | LITYENPAY | 244 | 9 | | 35582 |
| HPV31 | L2 | LLLSSSSISTH | 176 | 11 | | 35583 |
| HPV31 | L2 | LLSSSSISTH | 177 | 10 | | 35584 |
| HPV31 | L2 | LSAPKQLITY | 238 | 10 | | 35585 |
| HPV31 | L2 | LSSSSISTH | 178 | 9 | | 35586 |
| HPV31 | L2 | LSSSSISTHNY | 178 | 11 | | 35587 |
| HPV31 | L2 | LSTGFDIPIF | 395 | 10 | | 35588 |
| HPV31 | L2 | LSTRPSTVSEA | 75 | 11 | | 35589 |
| HPV31 | L2 | LTSRRNTVR | 287 | 9 | | 35590 |
| HPV31 | L2 | LTSRRNTVRY | 287 | 10 | | 35591 |
| HPV31 | L2 | MLKRRRKR | 447 | 8 | | 35592 |
| HPV31 | L2 | MLKRRRKRVSY | 447 | 11 | | 35593 |
| HPV31 | L2 | NAEESLYF | 256 | 8 | | 35594 |
| HPV31 | L2 | NDGLYDIY | 349 | 8 | | 35595 |
| HPV31 | L2 | NDGLYDIYA | 349 | 9 | | 35596 |
| HPV31 | L2 | NIAPDPDF | 269 | 8 | | 35597 |
| HPV31 | L2 | NTTVPLSTGF | 390 | 10 | | 35598 |
| HPV31 | L2 | NTVRYSRLGNK | 292 | 11 | | 35599 |
| HPV31 | L2 | PALTSRRNTVR | 285 | 11 | | 35600 |
| HPV31 | L2 | PARLGLYSK | 217 | 9 | | 35601 |
| HPV31 | L2 | PARLGLYSKA | 217 | 10 | | 35602 |
| HPV31 | L2 | PATHNVSPSTA | 366 | 11 | | 35603 |
| HPV31 | L2 | PAYETVNA | 250 | 8 | | 35604 |
| HPV31 | L2 | PDFLDIIA | 274 | 8 | | 35605 |
| HPV31 | L2 | PDFLDIIALH | 274 | 10 | | 35606 |
| HPV31 | L2 | PDFLDIIALHR | 274 | 11 | | 35607 |
| HPV31 | L2 | PDPDFLDIIA | 272 | 10 | | 35608 |
| HPV31 | L2 | PDVPIEHA | 407 | 8 | | 35609 |
| HPV31 | L2 | PGVRRPAR | 212 | 8 | | 35610 |
| HPV31 | L2 | PIEHAPTQVF | 410 | 10 | | 35611 |
| HPV31 | L2 | PIPGVRRPA | 210 | 9 | | 35612 |
| HPV31 | L2 | PIPGVRRPAR | 210 | 10 | | 35613 |
| HPV31 | L2 | PIPHPPTTSGF | 122 | 11 | | 35614 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | L2 | PLSTGFDIPIF | 394 | 11 | | 35615 |
| HPV31 | L2 | PSDVIPKIEH | 29 | 10 | | 35616 |
| HPV31 | L2 | PSTAVQSTSA | 373 | 10 | | 35617 |
| HPV31 | L2 | PSVLQPPTPA | 161 | 10 | | 35618 |
| HPV31 | L2 | PSYYMLKR | 443 | 8 | | 35619 |
| HPV31 | L2 | PSYYMLKRR | 443 | 9 | | 35620 |
| HPV31 | L2 | PSYYMLKRRR | 443 | 10 | | 35621 |
| HPV31 | L2 | PSYYMLKRRRK | 443 | 11 | | 35622 |
| HPV31 | L2 | PTFLSAPK | 235 | 8 | | 35623 |
| HPV31 | L2 | PTPAETSGH | 167 | 9 | | 35624 |
| HPV31 | L2 | PTQVFPFPLA | 415 | 10 | | 35625 |
| HPV31 | L2 | PTTPQVSIF | 425 | 9 | | 35626 |
| HPV31 | L2 | PTTSGFDIA | 127 | 9 | | 35627 |
| HPV31 | L2 | QILRYGSMGVF | 44 | 11 | | 35628 |
| HPV31 | L2 | QLITYENPA | 243 | 9 | | 35629 |
| HPV31 | L2 | QLITYENPAY | 243 | 10 | | 35630 |
| HPV31 | L2 | QLYQTCKA | 17 | 8 | | 35631 |
| HPV31 | L2 | QLYQTCKAA | 17 | 9 | | 35632 |
| HPV31 | L2 | QSTSAVSA | 378 | 8 | | 35633 |
| HPV31 | L2 | QSTSAVSAY | 378 | 9 | | 35634 |
| HPV31 | L2 | QTLRTRSGA | 303 | 9 | | 35635 |
| HPV31 | L2 | QVFPFPLA | 417 | 8 | | 35636 |
| HPV31 | L2 | QVKVIDPTF | 229 | 9 | | 35637 |
| HPV31 | L2 | QVSIFVDGGDF | 429 | 11 | | 35638 |
| HPV31 | L2 | RASATQLY | 12 | 8 | | 35639 |
| HPV31 | L2 | RLGLYSKA | 219 | 8 | | 35640 |
| HPV31 | L2 | RLGNKQTLR | 298 | 9 | | 35641 |
| HPV31 | L2 | RLGNKQTLRTR | 298 | 11 | | 35642 |
| HPV31 | L2 | RSGATIGA | 308 | 8 | | 35643 |
| HPV31 | L2 | RSGATIGAR | 308 | 9 | | 35644 |
| HPV31 | L2 | RSGATIGARVH | 308 | 11 | | 35645 |
| HPV31 | L2 | RSKRSTKR | 2 | 8 | | 35646 |
| HPV31 | L2 | RSKRSTKRTK | 2 | 10 | | 35647 |
| HPV31 | L2 | RSKRSTKRTKR | 2 | 11 | | 35648 |
| HPV31 | L2 | RSTKRTKR | 5 | 8 | | 35649 |
| HPV31 | L2 | RSTKRTKRA | 5 | 9 | | 35650 |
| HPV31 | L2 | RSTKRTKRASA | 5 | 11 | | 35651 |
| HPV31 | L2 | RTGYVPLSTR | 69 | 10 | | 35652 |
| HPV31 | L2 | RTKRASATQLY | 9 | 11 | | 35653 |
| HPV31 | L2 | RTRSGATIGA | 306 | 10 | | 35654 |
| HPV31 | L2 | RTRSGATIGAR | 306 | 11 | | 35655 |
| HPV31 | L2 | SAPKQLITY | 239 | 9 | | 35656 |
| HPV31 | L2 | SATQLYQTCK | 14 | 10 | | 35657 |
| HPV31 | L2 | SATQLYQTCKA | 14 | 11 | | 35658 |
| HPV31 | L2 | SDVIPKIEH | 30 | 9 | | 35659 |
| HPV31 | L2 | SGATIGAR | 309 | 8 | | 35660 |
| HPV31 | L2 | SGATIGARVH | 309 | 10 | | 35661 |
| HPV31 | L2 | SGATIGARVHY | 309 | 11 | | 35662 |
| HPV31 | L2 | SGFDIATTA | 130 | 9 | | 35663 |
| HPV31 | L2 | SGIVDVGA | 112 | 8 | | 35664 |
| HPV31 | L2 | SGIVDVGAPA | 112 | 10 | | 35665 |
| HPV31 | L2 | SGPDVPIEH | 405 | 9 | | 35666 |
| HPV31 | L2 | SGPDVPIEHA | 405 | 10 | | 35667 |
| HPV31 | L2 | SGSGTGGR | 62 | 8 | | 35668 |
| HPV31 | L2 | SGSGTGGRTGY | 62 | 11 | | 35669 |
| HPV31 | L2 | SGTGGRTGY | 64 | 9 | | 35670 |
| HPV31 | L2 | SIEMQPLGA | 332 | 9 | | 35671 |
| HPV31 | L2 | SIEMQPLGASA | 332 | 11 | | 35672 |
| HPV31 | L2 | SIFVDGGDF | 431 | 9 | | 35673 |
| HPV31 | L2 | SIFVDGGDFY | 431 | 10 | | 35674 |
| HPV31 | L2 | SLYFSNTSH | 260 | 9 | | 35675 |
| HPV31 | L2 | SSISTHNY | 181 | 8 | | 35676 |
| HPV31 | L2 | SSSISTHNY | 180 | 9 | | 35677 |
| HPV31 | L2 | SSSSISTH | 179 | 8 | | 35678 |
| HPV31 | L2 | SSSSISTHNY | 179 | 10 | | 35679 |
| HPV31 | L2 | SSTPIPGVR | 207 | 9 | | 35680 |
| HPV31 | L2 | SSTPIPGVRR | 207 | 10 | | 35681 |
| HPV31 | L2 | STAVQSTSA | 374 | 9 | | 35682 |
| HPV31 | L2 | STGFDIPIF | 396 | 9 | | 35683 |
| HPV31 | L2 | STHENPTF | 151 | 8 | | 35684 |
| HPV31 | L2 | STKRTKRA | 6 | 8 | | 35685 |
| HPV31 | L2 | STKRTKRASA | 6 | 10 | | 35686 |
| HPV31 | L2 | STLNDGLY | 346 | 8 | | 35687 |
| HPV31 | L2 | STLNDGLYDIY | 346 | 11 | | 35688 |
| HPV31 | L2 | STPIPGVR | 208 | 8 | | 35689 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV31 | L2 | STPIPGVRR | 208 | 9 | | 35690 |
| HPV31 | L2 | STPIPGVRRPA | 208 | 11 | | 35691 |
| HPV31 | L2 | STRPSTVSEA | 76 | 10 | | 35692 |
| HPV31 | L2 | STSAVSAY | 379 | 8 | | 35693 |
| HPV31 | L2 | STVSEASIPIR | 80 | 11 | | 35694 |
| HPV31 | L2 | SVLQPPTPA | 162 | 9 | | 35695 |
| HPV31 | L2 | SVSTHENPTF | 149 | 10 | | 35696 |
| HPV31 | L2 | TAVQSTSA | 375 | 8 | | 35697 |
| HPV31 | L2 | TAVQSTSAVSA | 375 | 11 | | 35698 |
| HPV31 | L2 | TCPSDVIPK | 27 | 9 | | 35699 |
| HPV31 | L2 | TDFTVDTPA | 359 | 9 | | 35700 |
| HPV31 | L2 | TDFTVDTPATH | 359 | 11 | | 35701 |
| HPV31 | L2 | TGFDIPIF | 397 | 8 | | 35702 |
| HPV31 | L2 | TGYVPLSTR | 70 | 9 | | 35703 |
| HPV31 | L2 | TIADQILR | 40 | 8 | | 35704 |
| HPV31 | L2 | TIADQILRY | 40 | 9 | | 35705 |
| HPV31 | L2 | TIGARVHY | 312 | 8 | | 35706 |
| HPV31 | L2 | TIGARVHYY | 312 | 9 | | 35707 |
| HPV31 | L2 | TIGARVHYYY | 312 | 10 | | 35708 |
| HPV31 | L2 | TLNDGLYDIY | 347 | 10 | | 35709 |
| HPV31 | L2 | TLNDGLYDIYA | 347 | 11 | | 35710 |
| HPV31 | L2 | TLRTRSGA | 304 | 8 | | 35711 |
| HPV31 | L2 | TSGFDIATTA | 129 | 10 | | 35712 |
| HPV31 | L2 | TSHNIAPDPDF | 266 | 11 | | 35713 |
| HPV31 | L2 | TSRRNTVR | 288 | 8 | | 35714 |
| HPV31 | L2 | TSRRNTVRY | 288 | 9 | | 35715 |
| HPV31 | L2 | TSRRNTVRYSR | 288 | 11 | | 35716 |
| HPV31 | L2 | TSSTPIPGVR | 206 | 10 | | 35717 |
| HPV31 | L2 | TSSTPIPGVRR | 206 | 11 | | 35718 |
| HPV31 | L2 | TSTLNDGLY | 345 | 9 | | 35719 |
| HPV31 | L2 | TSVSTHENPTF | 148 | 11 | | 35720 |
| HPV31 | L2 | TTADTTPA | 136 | 8 | | 35721 |
| HPV31 | L2 | TTIADQILR | 39 | 9 | | 35722 |
| HPV31 | L2 | TTIADQILRY | 39 | 10 | | 35723 |
| HPV31 | L2 | TTPQVSIF | 426 | 8 | | 35724 |
| HPV31 | L2 | TTSGFDIA | 128 | 8 | | 35725 |
| HPV31 | L2 | TTSGFDIATTA | 128 | 11 | | 35726 |
| HPV31 | L2 | TTSTLNDGLY | 344 | 10 | | 35727 |
| HPV31 | L2 | TTTSTLNDGLY | 343 | 11 | | 35728 |
| HPV31 | L2 | TTVPLSTGF | 391 | 9 | | 35729 |
| HPV31 | L2 | TVDTPATH | 362 | 8 | | 35730 |
| HPV31 | L2 | TVNAEESLY | 254 | 9 | | 35731 |
| HPV31 | L2 | TVNAEESLYF | 254 | 10 | | 35732 |
| HPV31 | L2 | TVPLSTGF | 392 | 8 | | 35733 |
| HPV31 | L2 | TVRYSRLGNK | 293 | 10 | | 35734 |
| HPV31 | L2 | TVSEASIPIR | 81 | 10 | | 35735 |
| HPV31 | L2 | VDGGDFYLH | 434 | 9 | | 35736 |
| HPV31 | L2 | VDVGAPAPIPH | 115 | 11 | | 35737 |
| HPV31 | L2 | VGAPAPIPH | 117 | 9 | | 35738 |
| HPV31 | L2 | VIDPTFLSA | 232 | 9 | | 35739 |
| HPV31 | L2 | VIDPTFLSAPK | 232 | 11 | | 35740 |
| HPV31 | L2 | VIPKIEHTTIA | 32 | 11 | | 35741 |
| HPV31 | L2 | VLQPPTPA | 163 | 8 | | 35742 |
| HPV31 | L2 | VSEASIPIR | 82 | 9 | | 35743 |
| HPV31 | L2 | VSIFVDGGDF | 430 | 10 | | 35744 |
| HPV31 | L2 | VSIFVDGGDFY | 430 | 11 | | 35745 |
| HPV31 | L2 | VSTHENPTF | 150 | 9 | | 35746 |
| HPV31 | L2 | VSYFFTDVSVA | 455 | 11 | | 35747 |
| HPV31 | L2 | YDISSINPA | 321 | 9 | | 35748 |
| HPV31 | L2 | YDIYADTDF | 353 | 9 | | 35749 |
| HPV31 | L2 | YFFTDVSVA | 457 | 9 | | 35750 |
| HPV31 | L2 | YFFTDVSVAA | 457 | 10 | | 35751 |
| HPV31 | L2 | YFSNTSHNIA | 262 | 10 | | 35752 |
| HPV31 | L2 | YGSMGVFF | 48 | 8 | | 35753 |
| HPV31 | L2 | YLHPSYYMLK | 440 | 10 | | 35754 |
| HPV31 | L2 | YLHPSYYMLKR | 440 | 11 | | 35755 |
| HPV31 | L2 | YMLKRRRK | 446 | 8 | | 35756 |
| HPV31 | L2 | YMLKRRRKR | 446 | 9 | | 35757 |
| HPV31 | L2 | YSKATQQVK | 223 | 9 | | 35758 |
| HPV31 | L2 | YSRLGNKQTLR | 296 | 11 | | 35759 |
| HPV33 | E1 | AAAFLKSNSQA | 382 | 11 | | 35760 |
| HPV33 | E1 | AACSQSAA | 90 | 8 | | 35761 |
| HPV33 | E1 | AAEDVVDR | 96 | 8 | | 35762 |
| HPV33 | E1 | AAEDVVDRA | 96 | 9 | | 35763 |
| HPV33 | E1 | AAEDVVDRAA | 96 | 10 | | 35764 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E1 | AAFLKSNSQA | 383 | 10 | | 35765 |
| HPV33 | E1 | AAFLKSNSQAK | 383 | 11 | | 35766 |
| HPV33 | E1 | AANPCRTSINK | 104 | 11 | | 35767 |
| HPV33 | E1 | ADDSGTDLLEF | 40 | 11 | | 35768 |
| HPV33 | E1 | ADPEGTNGA | 2 | 9 | | 35769 |
| HPV33 | E1 | ADSNSNAA | 376 | 8 | | 35770 |
| HPV33 | E1 | ADSNSNAAA | 376 | 9 | | 35771 |
| HPV33 | E1 | ADSNSNAAAF | 376 | 10 | | 35772 |
| HPV33 | E1 | ADTEAARA | 61 | 8 | | 35773 |
| HPV33 | E1 | ADTEAARALF | 61 | 10 | | 35774 |
| HPV33 | E1 | AFKKFLKGIPK | 452 | 11 | | 35775 |
| HPV33 | E1 | AFLGAFKK | 448 | 8 | | 35776 |
| HPV33 | E1 | AFLGAFKKF | 448 | 9 | | 35777 |
| HPV33 | E1 | AFLGAFKKFLK | 448 | 11 | | 35778 |
| HPV33 | E1 | AFLKSNSQA | 384 | 9 | | 35779 |
| HPV33 | E1 | AFLKSNSQAK | 384 | 10 | | 35780 |
| HPV33 | E1 | AGENTRSLR | 635 | 9 | | 35781 |
| HPV33 | E1 | AGMGCTGWF | 10 | 9 | | 35782 |
| HPV33 | E1 | AGTDSRWPY | 563 | 9 | | 35783 |
| HPV33 | E1 | AGTDSRWPYLH | 563 | 11 | | 35784 |
| HPV33 | E1 | AINDENWK | 596 | 8 | | 35785 |
| HPV33 | E1 | AINDENWKSF | 596 | 10 | | 35786 |
| HPV33 | E1 | AINDENWKSFF | 596 | 11 | | 35787 |
| HPV33 | E1 | ALKRKFAA | 84 | 8 | | 35788 |
| HPV33 | E1 | ALYWFRTA | 311 | 8 | | 35789 |
| HPV33 | E1 | AVCALKRK | 81 | 8 | | 35790 |
| HPV33 | E1 | AVCALKRKF | 81 | 9 | | 35791 |
| HPV33 | E1 | AVCALKRKFA | 81 | 10 | | 35792 |
| HPV33 | E1 | AVCALKRKFAA | 81 | 11 | | 35793 |
| HPV33 | E1 | CALKRKFA | 83 | 8 | | 35794 |
| HPV33 | E1 | CALKRKFAA | 83 | 9 | | 35795 |
| HPV33 | E1 | CALYWFRTA | 310 | 9 | | 35796 |
| HPV33 | E1 | CGIMCRHY | 398 | 8 | | 35797 |
| HPV33 | E1 | CGIMCRHYK | 398 | 9 | | 35798 |
| HPV33 | E1 | CGIMCRHYKK | 398 | 10 | | 35799 |
| HPV33 | E1 | CGIMCRHYKKA | 398 | 11 | | 35800 |
| HPV33 | E1 | CGPANTGK | 469 | 8 | | 35801 |
| HPV33 | E1 | CGPANTGKSY | 469 | 10 | | 35802 |
| HPV33 | E1 | CGPANTGKSYF | 469 | 11 | | 35803 |
| HPV33 | E1 | CMLICGPA | 465 | 8 | | 35804 |
| HPV33 | E1 | CMVIEPPK | 297 | 8 | | 35805 |
| HPV33 | E1 | CMVIEPPKLR | 297 | 10 | | 35806 |
| HPV33 | E1 | CSAGENTR | 633 | 8 | | 35807 |
| HPV33 | E1 | CSAGENTRSLR | 633 | 11 | | 35808 |
| HPV33 | E1 | CSKNRLTVA | 276 | 9 | | 35809 |
| HPV33 | E1 | CSKNRLTVAK | 276 | 10 | | 35810 |
| HPV33 | E1 | CTDWCITGY | 226 | 9 | | 35811 |
| HPV33 | E1 | CTGWFEVEA | 14 | 9 | | 35812 |
| HPV33 | E1 | CVISCVNSK | 490 | 9 | | 35813 |
| HPV33 | E1 | CVISCVNSKSH | 490 | 11 | | 35814 |
| HPV33 | E1 | CVNSKSHF | 494 | 8 | | 35815 |
| HPV33 | E1 | DCGIMCRH | 397 | 8 | | 35816 |
| HPV33 | E1 | DCGIMCRHY | 397 | 9 | | 35817 |
| HPV33 | E1 | DCGIMCRHYK | 397 | 10 | | 35818 |
| HPV33 | E1 | DCGIMCRHYKK | 397 | 11 | | 35819 |
| HPV33 | E1 | DDLNAVCA | 77 | 8 | | 35820 |
| HPV33 | E1 | DDLNAVCALK | 77 | 10 | | 35821 |
| HPV33 | E1 | DDLNAVCALKR | 77 | 11 | | 35822 |
| HPV33 | E1 | DDSDIAYY | 364 | 8 | | 35823 |
| HPV33 | E1 | DDSDIAYYY | 364 | 9 | | 35824 |
| HPV33 | E1 | DDSDIAYYYA | 364 | 10 | | 35825 |
| HPV33 | E1 | DDSGTDLLEF | 41 | 10 | | 35826 |
| HPV33 | E1 | DDSMENSIQA | 52 | 10 | | 35827 |
| HPV33 | E1 | DDVTPISWTY | 515 | 10 | | 35828 |
| HPV33 | E1 | DGNEISIDVK | 534 | 10 | | 35829 |
| HPV33 | E1 | DGNEISIDVKH | 534 | 11 | | 35830 |
| HPV33 | E1 | DIAYYYAQLA | 367 | 10 | | 35831 |
| HPV33 | E1 | DLIEEEDK | 614 | 8 | | 35832 |
| HPV33 | E1 | DLIEEEDKENH | 614 | 11 | | 35833 |
| HPV33 | E1 | DLNAVCALK | 78 | 9 | | 35834 |
| HPV33 | E1 | DLNAVCALKR | 78 | 10 | | 35835 |
| HPV33 | E1 | DLNAVCALKRK | 78 | 11 | | 35836 |
| HPV33 | E1 | DLSEMVQWA | 349 | 9 | | 35837 |
| HPV33 | E1 | DLSEMVQWAY | 349 | 10 | | 35838 |
| HPV33 | E1 | DSDIAYYY | 365 | 8 | | 35839 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E1 | DSDIAYYYA | 365 | 9 | | 35840 |
| HPV33 | E1 | DSGTDLLEF | 42 | 9 | | 35841 |
| HPV33 | E1 | DSMENSIQA | 53 | 9 | | 35842 |
| HPV33 | E1 | DSNSNAAA | 377 | 8 | | 35843 |
| HPV33 | E1 | DSNSNAAAF | 377 | 9 | | 35844 |
| HPV33 | E1 | DSNSNAAAFLK | 377 | 11 | | 35845 |
| HPV33 | E1 | DSRWPYLH | 566 | 8 | | 35846 |
| HPV33 | E1 | DSRWPYLHSR | 566 | 10 | | 35847 |
| HPV33 | E1 | DTEAARALF | 62 | 9 | | 35848 |
| HPV33 | E1 | DVKHRALVQLK | 541 | 11 | | 35849 |
| HPV33 | E1 | DVTPISWTY | 516 | 9 | | 35850 |
| HPV33 | E1 | DVVDRAANPCR | 99 | 11 | | 35851 |
| HPV33 | E1 | ECTYRKRK | 117 | 8 | | 35852 |
| HPV33 | E1 | EDDLNAVCA | 76 | 9 | | 35853 |
| HPV33 | E1 | EDDLNAVCALK | 76 | 11 | | 35854 |
| HPV33 | E1 | EDVVDRAA | 98 | 8 | | 35855 |
| HPV33 | E1 | EFKNPFPF | 580 | 8 | | 35856 |
| HPV33 | E1 | EFTAFLGA | 445 | 8 | | 35857 |
| HPV33 | E1 | EFTAFLGAF | 445 | 9 | | 35858 |
| HPV33 | E1 | EFTAFLGAFK | 445 | 10 | | 35859 |
| HPV33 | E1 | EFTAFLGAFKK | 445 | 11 | | 35860 |
| HPV33 | E1 | EGEDDLNA | 74 | 8 | | 35861 |
| HPV33 | E1 | EGEDDLNAVCA | 74 | 11 | | 35862 |
| HPV33 | E1 | EISIDVKH | 537 | 8 | | 35863 |
| HPV33 | E1 | EISIDVKHR | 537 | 9 | | 35864 |
| HPV33 | E1 | EISIDVKHRA | 537 | 10 | | 35865 |
| HPV33 | E1 | ELTDDSDIA | 361 | 9 | | 35866 |
| HPV33 | E1 | ELTDDSDIAY | 361 | 10 | | 35867 |
| HPV33 | E1 | ELTDDSDIAYY | 361 | 11 | | 35868 |
| HPV33 | E1 | ELVRPFKSDK | 214 | 10 | | 35869 |
| HPV33 | E1 | ESLKVLIK | 242 | 8 | | 35870 |
| HPV33 | E1 | ESLKVLIKQH | 242 | 10 | | 35871 |
| HPV33 | E1 | ETCMVIEPPK | 295 | 10 | | 35872 |
| HPV33 | E1 | EVEAVIER | 19 | 8 | | 35873 |
| HPV33 | E1 | EVEAVIERR | 19 | 9 | | 35874 |
| HPV33 | E1 | FAACSQSA | 89 | 8 | | 35875 |
| HPV33 | E1 | FAACSQSAA | 89 | 9 | | 35876 |
| HPV33 | E1 | FDENGNPVY | 587 | 9 | | 35877 |
| HPV33 | E1 | FDENGNPVYA | 587 | 10 | | 35878 |
| HPV33 | E1 | FDLSEMVQWA | 348 | 10 | | 35879 |
| HPV33 | E1 | FDLSEMVQWAY | 348 | 11 | | 35880 |
| HPV33 | E1 | FFSRTWCK | 605 | 8 | | 35881 |
| HPV33 | E1 | FGMSLIQF | 479 | 8 | | 35882 |
| HPV33 | E1 | FGMSLIQFLK | 479 | 10 | | 35883 |
| HPV33 | E1 | FLGAFKKF | 449 | 8 | | 35884 |
| HPV33 | E1 | FLGAFKKFLK | 449 | 10 | | 35885 |
| HPV33 | E1 | FLKGIPKK | 456 | 8 | | 35886 |
| HPV33 | E1 | FLKSNSQA | 385 | 8 | | 35887 |
| HPV33 | E1 | FLKSNSQAK | 385 | 9 | 0.0013 | 35888 |
| HPV33 | E1 | FMELVRPF | 212 | 8 | | 35889 |
| HPV33 | E1 | FMELVRPFK | 212 | 9 | | 35890 |
| HPV33 | E1 | FTAFLGAF | 446 | 8 | | 35891 |
| HPV33 | E1 | FTAFLGAFK | 446 | 9 | | 35892 |
| HPV33 | E1 | FTAFLGAFKK | 446 | 10 | | 35893 |
| HPV33 | E1 | FTAFLGAFKKF | 446 | 11 | | 35894 |
| HPV33 | E1 | GAFKKFLK | 451 | 8 | | 35895 |
| HPV33 | E1 | GAGMGCTGWF | 9 | 10 | | 35896 |
| HPV33 | E1 | GCTGWFEVEA | 13 | 10 | | 35897 |
| HPV33 | E1 | GCVISCVNSK | 489 | 10 | | 35898 |
| HPV33 | E1 | GGNISTFK | 625 | 8 | | 35899 |
| HPV33 | E1 | GGNISTFKCSA | 625 | 11 | | 35900 |
| HPV33 | E1 | GIIILLIR | 265 | 9 | | 35901 |
| HPV33 | E1 | GIIILLIRF | 265 | 10 | | 35902 |
| HPV33 | E1 | GIIILLIRFR | 265 | 11 | | 35903 |
| HPV33 | E1 | GIMCRHYK | 399 | 8 | | 35904 |
| HPV33 | E1 | GIMCRHYKK | 399 | 9 | | 35905 |
| HPV33 | E1 | GIMCRHYKKA | 399 | 10 | | 35906 |
| HPV33 | E1 | GISFMELVR | 209 | 9 | | 35907 |
| HPV33 | E1 | GISFMELVRPF | 209 | 11 | | 35908 |
| HPV33 | E1 | GISPSVAESLK | 235 | 11 | | 35909 |
| HPV33 | E1 | GMGCTGWF | 11 | 8 | | 35910 |
| HPV33 | E1 | GMSLIQFLK | 480 | 9 | | 35911 |
| HPV33 | E1 | GTDSRWPY | 564 | 8 | | 35912 |
| HPV33 | E1 | GTDSRWPYLH | 564 | 10 | | 35913 |
| HPV33 | E1 | GTTPEWIDR | 327 | 9 | | 35914 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E1 | HFWLQPLSDA | 500 | 10 | | 35915 |
| HPV33 | E1 | HFWLQPLSDAK | 500 | 11 | | 35916 |
| HPV33 | E1 | HGGNISTF | 624 | 8 | | 35917 |
| HPV33 | E1 | HGGNISTFK | 624 | 9 | | 35918 |
| HPV33 | E1 | HLQCLTCDR | 256 | 9 | | 35919 |
| HPV33 | E1 | HSFNDNIF | 341 | 8 | | 35920 |
| HPV33 | E1 | HSRLTVFEF | 573 | 9 | | 35921 |
| HPV33 | E1 | HSRLTVFEFK | 573 | 10 | | 35922 |
| HPV33 | E1 | HSSNTKANILY | 192 | 11 | | 35923 |
| HPV33 | E1 | IAYYYAQLA | 368 | 9 | | 35924 |
| HPV33 | E1 | ICGPANTGK | 468 | 9 | | 35925 |
| HPV33 | E1 | ICGPANTGKSY | 468 | 11 | | 35926 |
| HPV33 | E1 | IDDSMENSIQA | 51 | 11 | | 35927 |
| HPV33 | E1 | IDDVTPISWTY | 514 | 11 | | 35928 |
| HPV33 | E1 | IDDYMRNA | 525 | 8 | | 35929 |
| HPV33 | E1 | IDELEDSGY | 125 | 9 | | 35930 |
| HPV33 | E1 | IDRLTVLQH | 333 | 9 | | 35931 |
| HPV33 | E1 | IDRLTVLQHSF | 333 | 11 | | 35932 |
| HPV33 | E1 | IFDLSEMVQWA | 347 | 11 | | 35933 |
| HPV33 | E1 | IGQWIQSR | 415 | 8 | | 35934 |
| HPV33 | E1 | IGQWIQSRCEK | 415 | 11 | | 35935 |
| HPV33 | E1 | IIILLLIR | 266 | 8 | | 35936 |
| HPV33 | E1 | IIILLLIRF | 266 | 9 | | 35937 |
| HPV33 | E1 | IIILLLIRFR | 266 | 10 | | 35938 |
| HPV33 | E1 | IILLLIRF | 267 | 8 | | 35939 |
| HPV33 | E1 | IILLLIRFR | 267 | 9 | | 35940 |
| HPV33 | E1 | ILLLIRFR | 268 | 8 | | 35941 |
| HPV33 | E1 | ILLLIRFRCSK | 268 | 11 | | 35942 |
| HPV33 | E1 | ILYKFKEA | 200 | 8 | | 35943 |
| HPV33 | E1 | ILYKFKEAY | 200 | 9 | | 35944 |
| HPV33 | E1 | IMCRHYKK | 400 | 8 | | 35945 |
| HPV33 | E1 | IMCRHYKKA | 400 | 9 | | 35946 |
| HPV33 | E1 | IMCRHYKKAEK | 400 | 11 | | 35947 |
| HPV33 | E1 | ISCVNSKSH | 492 | 9 | | 35948 |
| HPV33 | E1 | ISCVNSKSHF | 492 | 10 | | 35949 |
| HPV33 | E1 | ISEDEDETA | 32 | 9 | | 35950 |
| HPV33 | E1 | ISFMELVR | 210 | 8 | | 35951 |
| HPV33 | E1 | ISFMELVRPF | 210 | 10 | | 35952 |
| HPV33 | E1 | ISFMELVRPFK | 210 | 11 | | 35953 |
| HPV33 | E1 | ISIDVKHR | 538 | 8 | | 35954 |
| HPV33 | E1 | ISIDVKHRA | 538 | 9 | | 35955 |
| HPV33 | E1 | ISNVLHSSNTK | 187 | 11 | | 35956 |
| HPV33 | E1 | ISPSVAESLK | 236 | 10 | | 35957 |
| HPV33 | E1 | ISTFKCSA | 628 | 8 | | 35958 |
| HPV33 | E1 | ISWTYIDDY | 520 | 9 | | 35959 |
| HPV33 | E1 | ISWTYIDDYMR | 520 | 11 | | 35960 |
| HPV33 | E1 | ITGYGISPSVA | 231 | 11 | | 35961 |
| HPV33 | E1 | IVKDCGIMCR | 394 | 10 | | 35962 |
| HPV33 | E1 | IVKDCGIMCRH | 394 | 11 | | 35963 |
| HPV33 | E1 | KANILYKF | 197 | 8 | | 35964 |
| HPV33 | E1 | KANILYKFK | 197 | 9 | | 35965 |
| HPV33 | E1 | KANILYKFKEA | 197 | 11 | | 35966 |
| HPV33 | E1 | KCSAGENTR | 632 | 9 | | 35967 |
| HPV33 | E1 | KDCGIMCR | 396 | 8 | | 35968 |
| HPV33 | E1 | KDCGIMCRH | 396 | 9 | | 35969 |
| HPV33 | E1 | KDCGIMCRHY | 396 | 10 | | 35970 |
| HPV33 | E1 | KDCGIMCRHYK | 396 | 11 | | 35971 |
| HPV33 | E1 | KFAACSQSA | 88 | 9 | | 35972 |
| HPV33 | E1 | KFAACSQSAA | 88 | 10 | | 35973 |
| HPV33 | E1 | KFKEAYGISF | 203 | 10 | | 35974 |
| HPV33 | E1 | KFLKGIPK | 455 | 8 | | 35975 |
| HPV33 | E1 | KFLKGIPKK | 455 | 9 | | 35976 |
| HPV33 | E1 | KGCVISCVNSK | 488 | 11 | | 35977 |
| HPV33 | E1 | KIDELEDSGY | 124 | 10 | | 35978 |
| HPV33 | E1 | KIVKDCGIMCR | 393 | 11 | | 35979 |
| HPV33 | E1 | KLDLIEEEDK | 612 | 10 | | 35980 |
| HPV33 | E1 | KLRSQTCA | 304 | 8 | | 35981 |
| HPV33 | E1 | KLRSQTCALY | 304 | 10 | | 35982 |
| HPV33 | E1 | KMSIGQWIQSR | 412 | 11 | | 35983 |
| HPV33 | E1 | KSCMLICGPA | 463 | 10 | | 35984 |
| HPV33 | E1 | KDFFSRTWCK | 603 | 10 | | 35985 |
| HPV33 | E1 | KSNSQAKIVK | 387 | 10 | | 35986 |
| HPV33 | E1 | KSYFGMSLIQF | 476 | 11 | | 35987 |
| HPV33 | E1 | KTNDGGNWR | 425 | 9 | | 35988 |
| HPV33 | E1 | KVLIKQHSLY | 245 | 10 | | 35989 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E1 | LADSNSNA | 375 | 8 | | 35990 |
| HPV33 | E1 | LADSNSNAA | 375 | 9 | | 35991 |
| HPV33 | E1 | LADSNSNAAA | 375 | 10 | | 35992 |
| HPV33 | E1 | LADSNSNAAAF | 375 | 11 | | 35993 |
| HPV33 | E1 | LDGNEISIDVK | 533 | 11 | | 35994 |
| HPV33 | E1 | LDLIEEEDK | 613 | 9 | | 35995 |
| HPV33 | E1 | LGAFKKFLK | 450 | 9 | | 35996 |
| HPV33 | E1 | LICGPANTGK | 467 | 10 | | 35997 |
| HPV33 | E1 | LIEEEDKENH | 615 | 10 | | 35998 |
| HPV33 | E1 | LIKQHSLY | 247 | 8 | | 35999 |
| HPV33 | E1 | LIKQHSLYTH | 247 | 10 | | 36000 |
| HPV33 | E1 | LIRFRCSK | 271 | 8 | | 36001 |
| HPV33 | E1 | LIRFRCSKNR | 271 | 10 | | 36002 |
| HPV33 | E1 | LLIRFRCSK | 270 | 9 | | 36003 |
| HPV33 | E1 | LLIRFRCSKNR | 270 | 11 | | 36004 |
| HPV33 | E1 | LLLIRFRCSK | 269 | 10 | | 36005 |
| HPV33 | E1 | LLLTSNTNA | 555 | 9 | | 36006 |
| HPV33 | E1 | LLRYQNIEF | 438 | 9 | | 36007 |
| HPV33 | E1 | LLRYQNIEFTA | 438 | 11 | | 36008 |
| HPV33 | E1 | LLTSNTNA | 556 | 8 | | 36009 |
| HPV33 | E1 | LSEMVQWA | 350 | 8 | | 36010 |
| HPV33 | E1 | LSEMVQWAY | 350 | 9 | | 36011 |
| HPV33 | E1 | LTDDSDIA | 362 | 8 | | 36012 |
| HPV33 | E1 | LTDDSDIAY | 362 | 9 | | 36013 |
| HPV33 | E1 | LTDDSDIAYY | 362 | 10 | | 36014 |
| HPV33 | E1 | LTDDSDIAYYY | 362 | 11 | | 36015 |
| HPV33 | E1 | LTVFEFKNPF | 576 | 10 | | 36016 |
| HPV33 | E1 | LTVLQHSF | 336 | 8 | | 36017 |
| HPV33 | E1 | LVRPFKSDK | 215 | 9 | | 36018 |
| HPV33 | E1 | MADPEGTNGA | 1 | 10 | | 36019 |
| HPV33 | E1 | MCRHYKKA | 401 | 8 | | 36020 |
| HPV33 | E1 | MCRHYKKAEK | 401 | 10 | | 36021 |
| HPV33 | E1 | MCRHYKKAEKR | 401 | 11 | | 36022 |
| HPV33 | E1 | MGCTGWFEVEA | 12 | 11 | | 36023 |
| HPV33 | E1 | MLICGPANTGK | 466 | 11 | | 36024 |
| HPV33 | E1 | MSIGQWIQSR | 413 | 10 | | 36025 |
| HPV33 | E1 | MSLIQFLK | 481 | 8 | | 36026 |
| HPV33 | E1 | MVIEPPKLR | 298 | 9 | | 36027 |
| HPV33 | E1 | NAGTDSRWPY | 562 | 10 | | 36028 |
| HPV33 | E1 | NAVCALKR | 80 | 8 | | 36029 |
| HPV33 | E1 | NAVCALKRK | 80 | 9 | | 36030 |
| HPV33 | E1 | NAVCALKRKF | 80 | 10 | | 36031 |
| HPV33 | E1 | NAVCALKRKFA | 80 | 11 | | 36032 |
| HPV33 | E1 | NDENWKSF | 598 | 8 | | 36033 |
| HPV33 | E1 | NDENWKSFF | 598 | 9 | | 36034 |
| HPV33 | E1 | NDENWKSFFSR | 598 | 11 | | 36035 |
| HPV33 | E1 | NGAGMGCTGWF | 8 | 11 | | 36036 |
| HPV33 | E1 | NIEFTAFLGA | 443 | 10 | | 36037 |
| HPV33 | E1 | NIEFTAFLGAF | 443 | 11 | | 36038 |
| HPV33 | E1 | NILYKFKEA | 199 | 9 | | 36039 |
| HPV33 | E1 | NILYKFKEAY | 199 | 10 | | 36040 |
| HPV33 | E1 | NIQEGEDDLNA | 71 | 11 | | 36041 |
| HPV33 | E1 | NISEDEDETA | 31 | 10 | | 36042 |
| HPV33 | E1 | NISTFKCSA | 627 | 9 | | 36043 |
| HPV33 | E1 | NSIQADTEA | 57 | 9 | | 36044 |
| HPV33 | E1 | NSIQADTEAA | 57 | 10 | | 36045 |
| HPV33 | E1 | NSIQADTEAAR | 57 | 11 | | 36046 |
| HPV33 | E1 | NSNAAAFLK | 379 | 9 | 0.0057 | 36047 |
| HPV33 | E1 | NSQAKIVK | 389 | 8 | | 36048 |
| HPV33 | E1 | NTKANILY | 195 | 8 | | 36049 |
| HPV33 | E1 | NTKANILYK | 195 | 9 | | 36050 |
| HPV33 | E1 | NTKANILYKF | 195 | 10 | | 36051 |
| HPV33 | E1 | NTKANILYKFK | 195 | 11 | | 36052 |
| HPV33 | E1 | NTNAGTDSR | 560 | 9 | | 36053 |
| HPV33 | E1 | NVLHSSNTK | 189 | 9 | | 36054 |
| HPV33 | E1 | NVLHSSNTKA | 189 | 10 | | 36055 |
| HPV33 | E1 | PANTGKSY | 471 | 8 | | 36056 |
| HPV33 | E1 | PANTGKSYF | 471 | 9 | | 36057 |
| HPV33 | E1 | PCRTSINK | 107 | 8 | | 36058 |
| HPV33 | E1 | PCRTSINKNK | 107 | 10 | | 36059 |
| HPV33 | E1 | PFDENGNPVY | 586 | 10 | | 36060 |
| HPV33 | E1 | PFDENGNPVYA | 586 | 11 | | 36061 |
| HPV33 | E1 | PISWTYIDDY | 519 | 10 | | 36062 |
| HPV33 | E1 | PIVQLLRY | 434 | 8 | | 36063 |
| HPV33 | E1 | PLLLTSNTNA | 554 | 10 | | 36064 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E1 | PSVAESLK | 238 | 8 | | 36065 |
| HPV33 | E1 | PVYAINDENWK | 593 | 11 | | 36066 |
| HPV33 | E1 | QADTEAAR | 60 | 8 | | 36067 |
| HPV33 | E1 | QADTEAARA | 60 | 9 | | 36068 |
| HPV33 | E1 | QADTEAARALF | 60 | 11 | | 36069 |
| HPV33 | E1 | QGTTPEWIDR | 326 | 10 | | 36070 |
| HPV33 | E1 | QLADSNSNA | 374 | 9 | | 36071 |
| HPV33 | E1 | QLADSNSNAA | 374 | 10 | | 36072 |
| HPV33 | E1 | QLADSNSNAAA | 374 | 11 | | 36073 |
| HPV33 | E1 | QLLRYQNIEF | 437 | 10 | | 36074 |
| HPV33 | E1 | QSAAEDVVDR | 94 | 10 | | 36075 |
| HPV33 | E1 | QSAAEDVVDRA | 94 | 11 | | 36076 |
| HPV33 | E1 | QTCALYWF | 308 | 8 | | 36077 |
| HPV33 | E1 | QTCALYWFR | 308 | 9 | | 36078 |
| HPV33 | E1 | QTCALYWFRTA | 308 | 11 | | 36079 |
| HPV33 | E1 | RCSKNRLTVA | 275 | 10 | | 36080 |
| HPV33 | E1 | RCSKNRLTVAK | 275 | 11 | | 36081 |
| HPV33 | E1 | RFRCSKNR | 273 | 8 | | 36082 |
| HPV33 | E1 | RGIIILLLIR | 264 | 10 | | 36083 |
| HPV33 | E1 | RGIIILLLIRF | 264 | 11 | | 36084 |
| HPV33 | E1 | RLTVFEFK | 575 | 8 | | 36085 |
| HPV33 | E1 | RLTVFEFKNPF | 575 | 11 | | 36086 |
| HPV33 | E1 | RLTVLQHSF | 335 | 9 | | 36087 |
| HPV33 | E1 | RSQTCALY | 306 | 8 | | 36088 |
| HPV33 | E1 | RSQTCALYWF | 306 | 10 | | 36089 |
| HPV33 | E1 | RSQTCALYWFR | 306 | 11 | | 36090 |
| HPV33 | E1 | RTSINKNK | 109 | 8 | | 36091 |
| HPV33 | E1 | SAAEDVVDR | 95 | 9 | | 36092 |
| HPV33 | E1 | SAAEDVVDRA | 95 | 10 | | 36093 |
| HPV33 | E1 | SAAEDVVDRAA | 95 | 11 | | 36094 |
| HPV33 | E1 | SAGENTRSLR | 634 | 10 | | 36095 |
| HPV33 | E1 | SCMLICGPA | 464 | 9 | | 36096 |
| HPV33 | E1 | SCTDWCITGY | 225 | 10 | | 36097 |
| HPV33 | E1 | SCVNSKSH | 493 | 8 | | 36098 |
| HPV33 | E1 | SCVNSKSHF | 493 | 9 | | 36099 |
| HPV33 | E1 | SDIAYYYA | 366 | 8 | | 36100 |
| HPV33 | E1 | SDIAYYYAQLA | 366 | 11 | | 36101 |
| HPV33 | E1 | SFFSRTWCK | 604 | 9 | | 36102 |
| HPV33 | E1 | SFMELVRPF | 211 | 9 | | 36103 |
| HPV33 | E1 | SFMELVRPFK | 211 | 10 | | 36104 |
| HPV33 | E1 | SGTDLLEF | 43 | 8 | | 36105 |
| HPV33 | E1 | SIDVKHRA | 539 | 8 | | 36106 |
| HPV33 | E1 | SIGQWIQSR | 414 | 9 | | 36107 |
| HPV33 | E1 | SINKNKECTY | 111 | 10 | | 36108 |
| HPV33 | E1 | SINKNKECTYR | 111 | 11 | | 36109 |
| HPV33 | E1 | SIQADTEA | 58 | 8 | | 36110 |
| HPV33 | E1 | SIQADTEAA | 58 | 9 | | 36111 |
| HPV33 | E1 | SIQADTEAAR | 58 | 10 | | 36112 |
| HPV33 | E1 | SIQADTEAARA | 58 | 11 | | 36113 |
| HPV33 | E1 | SLKVLIKQH | 243 | 9 | | 36114 |
| HPV33 | E1 | SMENSIQA | 54 | 8 | | 36115 |
| HPV33 | E1 | SSNTKANILY | 193 | 10 | | 36116 |
| HPV33 | E1 | SSNTKANILYK | 193 | 11 | | 36117 |
| HPV33 | E1 | SVAESLKVLIK | 239 | 11 | | 36118 |
| HPV33 | E1 | TAFLGAFK | 447 | 8 | | 36119 |
| HPV33 | E1 | TAFLGAFKK | 447 | 9 | | 36120 |
| HPV33 | E1 | TAFLGAFKKF | 447 | 10 | | 36121 |
| HPV33 | E1 | TCALYWFR | 309 | 8 | | 36122 |
| HPV33 | E1 | TCALYWFRTA | 309 | 10 | | 36123 |
| HPV33 | E1 | TCMVIEPPK | 296 | 9 | | 36124 |
| HPV33 | E1 | TCMVIEPPKLR | 296 | 11 | | 36125 |
| HPV33 | E1 | TDDSDIAY | 363 | 8 | | 36126 |
| HPV33 | E1 | TDDSDIAYY | 363 | 9 | | 36127 |
| HPV33 | E1 | TDDSDIAYYY | 363 | 10 | | 36128 |
| HPV33 | E1 | TDDSDIAYYYA | 363 | 11 | | 36129 |
| HPV33 | E1 | TDSRWPYLH | 565 | 9 | | 36130 |
| HPV33 | E1 | TDSRWPYLHSR | 565 | 11 | | 36131 |
| HPV33 | E1 | TDWCITGY | 227 | 8 | | 36132 |
| HPV33 | E1 | TFKCSAGENTR | 630 | 11 | | 36133 |
| HPV33 | E1 | TGWFEVEA | 15 | 8 | | 36134 |
| HPV33 | E1 | TGYGISPSVA | 232 | 10 | | 36135 |
| HPV33 | E1 | TLQEISNVLH | 183 | 10 | | 36136 |
| HPV33 | E1 | TSCTDWCITGY | 224 | 11 | | 36137 |
| HPV33 | E1 | TSINKNKECTY | 110 | 11 | | 36138 |
| HPV33 | E1 | TSNTNAGTDSR | 558 | 11 | | 36139 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E1 | TTPEWIDR | 328 | 8 | | 36140 |
| HPV33 | E1 | TVFEFKNPF | 577 | 9 | | 36141 |
| HPV33 | E1 | TVFEFKNPFPF | 577 | 11 | | 36142 |
| HPV33 | E1 | VAESLKVLIK | 240 | 10 | | 36143 |
| HPV33 | E1 | VCALKRKF | 82 | 8 | | 36144 |
| HPV33 | E1 | VCALKRKFA | 82 | 9 | | 36145 |
| HPV33 | E1 | VCALKRKFAA | 82 | 10 | | 36146 |
| HPV33 | E1 | VDRAANPCR | 101 | 9 | | 36147 |
| HPV33 | E1 | VFEFKNPF | 578 | 8 | | 36148 |
| HPV33 | E1 | VFEFKNPFPF | 578 | 10 | | 36149 |
| HPV33 | E1 | VIEPPKLR | 299 | 8 | | 36150 |
| HPV33 | E1 | VISCVNSK | 491 | 8 | | 36151 |
| HPV33 | E1 | VISCVNSKSH | 491 | 10 | | 36152 |
| HPV33 | E1 | VISCVNSKSHF | 491 | 11 | | 36153 |
| HPV33 | E1 | VLHSSNTK | 190 | 8 | | 36154 |
| HPV33 | E1 | VLHSSNTKA | 190 | 9 | | 36155 |
| HPV33 | E1 | VLIKQHSLY | 246 | 9 | | 36156 |
| HPV33 | E1 | VLIKQHSLYTH | 246 | 11 | | 36157 |
| HPV33 | E1 | VLQHSFNDNIF | 338 | 11 | | 36158 |
| HPV33 | E1 | VTLQEISNVLH | 182 | 11 | | 36159 |
| HPV33 | E1 | VTPISWTY | 517 | 8 | | 36160 |
| HPV33 | E1 | VVDRAANPCR | 100 | 10 | | 36161 |
| HPV33 | E1 | WFEVEAVIER | 17 | 10 | | 36162 |
| HPV33 | E1 | WFEVEAVIERR | 17 | 11 | | 36163 |
| HPV33 | E1 | WIDRLTVLQH | 332 | 10 | | 36164 |
| HPV33 | E1 | WIQSRCEK | 418 | 8 | | 36165 |
| HPV33 | E1 | WLQPLSDA | 502 | 8 | | 36166 |
| HPV33 | E1 | WLQPLSDAK | 502 | 9 | | 36167 |
| HPV33 | E1 | WTYIDDYMR | 522 | 9 | | 36168 |
| HPV33 | E1 | WTYIDDYMRNA | 522 | 11 | | 36169 |
| HPV33 | E1 | YAINDENWK | 595 | 9 | | 36170 |
| HPV33 | E1 | YAINDENWKSF | 595 | 11 | | 36171 |
| HPV33 | E1 | YAQLADSNSNA | 372 | 11 | | 36172 |
| HPV33 | E1 | YFGMSLIQF | 478 | 9 | | 36173 |
| HPV33 | E1 | YFGMSLIQFLK | 478 | 11 | | 36174 |
| HPV33 | E1 | YGISFMELVR | 208 | 10 | | 36175 |
| HPV33 | E1 | YGISPSVA | 234 | 8 | | 36176 |
| HPV33 | E1 | YIDDYMRNA | 524 | 9 | | 36177 |
| HPV33 | E1 | YLHSRLTVF | 571 | 9 | | 36178 |
| HPV33 | E1 | YLHSRLTVFEF | 571 | 11 | | 36179 |
| HPV33 | E1 | YTHLQCLTCDR | 254 | 11 | | 36180 |
| HPV33 | E2 | AAAKRRRPA | 223 | 9 | | 36181 |
| HPV33 | E2 | AAKRRRPA | 224 | 8 | | 36182 |
| HPV33 | E2 | ADIQTDNDNR | 210 | 10 | | 36183 |
| HPV33 | E2 | ADPALDNR | 246 | 8 | | 36184 |
| HPV33 | E2 | ADPALDNRTA | 246 | 10 | | 36185 |
| HPV33 | E2 | ADPALDNRTAR | 246 | 11 | | 36186 |
| HPV33 | E2 | AFQVIELQMA | 69 | 10 | | 36187 |
| HPV33 | E2 | ALDNRTAR | 249 | 8 | | 36188 |
| HPV33 | E2 | ALDNRTARTA | 249 | 10 | | 36189 |
| HPV33 | E2 | ALETLSKSQY | 78 | 10 | | 36190 |
| HPV33 | E2 | ALLYTAKQMGF | 41 | 11 | | 36191 |
| HPV33 | E2 | ATNCTNKQR | 258 | 9 | | 36192 |
| HPV33 | E2 | AVQEKILDLY | 10 | 10 | | 36193 |
| HPV33 | E2 | CADPALDNR | 245 | 9 | | 36194 |
| HPV33 | E2 | CADPALDNRTA | 245 | 11 | | 36195 |
| HPV33 | E2 | CALLYTAK | 40 | 8 | | 36196 |
| HPV33 | E2 | CLRYRLKPY | 288 | 9 | | 36197 |
| HPV33 | E2 | CLRYRLKPYK | 288 | 10 | | 36198 |
| HPV33 | E2 | CSSNVAPIVH | 269 | 10 | | 36199 |
| HPV33 | E2 | CTMVTGKVDY | 145 | 10 | | 36200 |
| HPV33 | E2 | DIQTDNDNR | 211 | 9 | | 36201 |
| HPV33 | E2 | DLPSQIEH | 25 | 8 | | 36202 |
| HPV33 | E2 | DLPSQIEHWK | 25 | 10 | | 36203 |
| HPV33 | E2 | DTAQPLTK | 235 | 8 | | 36204 |
| HPV33 | E2 | DTAQPLTKLF | 235 | 10 | | 36205 |
| HPV33 | E2 | DTCTMVTGK | 143 | 9 | | 36206 |
| HPV33 | E2 | DTTDTAQPLTK | 232 | 11 | | 36207 |
| HPV33 | E2 | ECALLYTA | 39 | 8 | | 36208 |
| HPV33 | E2 | ECALLYTAK | 39 | 9 | | 36209 |
| HPV33 | E2 | EDAAKYSK | 173 | 8 | | 36210 |
| HPV33 | E2 | EDTCTMVTGK | 142 | 10 | | 36211 |
| HPV33 | E2 | EISARLNA | 3 | 8 | | 36212 |
| HPV33 | E2 | ELQMALETLSK | 74 | 11 | | 36213 |
| HPV33 | E2 | ELYSSMSSTWH | 298 | 11 | | 36214 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E2 | ESNSLKCLR | 282 | 9 | | 36215 |
| HPV33 | E2 | ESNSLKCLRY | 282 | 10 | | 36216 |
| HPV33 | E2 | ESNSLKCLRYR | 282 | 11 | | 36217 |
| HPV33 | E2 | ETLSKSQY | 80 | 8 | | 36218 |
| HPV33 | E2 | ETVTVQYDNDK | 115 | 11 | | 36219 |
| HPV33 | E2 | EVWLCEPPK | 100 | 9 | | 36220 |
| HPV33 | E2 | EVWLCEPPKCF | 100 | 11 | | 36221 |
| HPV33 | E2 | FCADPALDNR | 244 | 10 | | 36222 |
| HPV33 | E2 | FVTEQQQQMF | 325 | 10 | | 36223 |
| HPV33 | E2 | GMYYIHNCEK | 156 | 10 | | 36224 |
| HPV33 | E2 | HLKGESNSLK | 278 | 10 | | 36225 |
| HPV33 | E2 | IGMYYIHNCEK | 155 | 11 | | 36226 |
| HPV33 | E2 | ILDLYEADK | 15 | 9 | | 36227 |
| HPV33 | E2 | ISARLNAVQEK | 4 | 11 | | 36228 |
| HPV33 | E2 | KAFQVIELQMA | 68 | 11 | | 36229 |
| HPV33 | E2 | KCLRYRLK | 287 | 8 | | 36230 |
| HPV33 | E2 | KCLRYRLKPY | 287 | 10 | | 36231 |
| HPV33 | E2 | KCLRYRLKPYK | 287 | 11 | | 36232 |
| HPV33 | E2 | KGESNSLK | 280 | 8 | | 36233 |
| HPV33 | E2 | KGESNSLKCLR | 280 | 11 | | 36234 |
| HPV33 | E2 | KILDLYEA | 14 | 8 | | 36235 |
| HPV33 | E2 | KILDLYEADK | 14 | 10 | | 36236 |
| HPV33 | E2 | KLFCADPA | 242 | 8 | | 36237 |
| HPV33 | E2 | KLIRMECA | 34 | 8 | | 36238 |
| HPV33 | E2 | KLIRMECALLY | 34 | 11 | | 36239 |
| HPV33 | E2 | KTDLPSQIEH | 23 | 10 | | 36240 |
| HPV33 | E2 | KTQMWEVH | 180 | 8 | | 36241 |
| HPV33 | E2 | KVDYIGMY | 151 | 8 | | 36242 |
| HPV33 | E2 | KVDYIGMYY | 151 | 9 | | 36243 |
| HPV33 | E2 | KVDYIGMYYIH | 151 | 11 | | 36244 |
| HPV33 | E2 | KVYFKYFK | 165 | 8 | | 36245 |
| HPV33 | E2 | KVYFKYFKEDA | 165 | 11 | | 36246 |
| HPV33 | E2 | LASKTKAF | 63 | 8 | | 36247 |
| HPV33 | E2 | LCEPPKCF | 103 | 8 | | 36248 |
| HPV33 | E2 | LCEPPKCFK | 103 | 9 | | 36249 |
| HPV33 | E2 | LCEPPKCFKK | 103 | 10 | | 36250 |
| HPV33 | E2 | LCHQVVPSLLA | 54 | 11 | | 36251 |
| HPV33 | E2 | LDLYEADK | 16 | 8 | | 36252 |
| HPV33 | E2 | LDNRTARTA | 250 | 9 | | 36253 |
| HPV33 | E2 | LFCADPALDNR | 243 | 11 | | 36254 |
| HPV33 | E2 | LIRMECALLY | 35 | 10 | | 36255 |
| HPV33 | E2 | LLASKTKA | 62 | 8 | | 36256 |
| HPV33 | E2 | LLASKTKAF | 62 | 9 | | 36257 |
| HPV33 | E2 | LLYTAKQMGF | 42 | 10 | | 36258 |
| HPV33 | E2 | LTKLFCADPA | 240 | 10 | | 36259 |
| HPV33 | E2 | MALETLSK | 77 | 8 | | 36260 |
| HPV33 | E2 | MALETLSKSQY | 77 | 11 | | 36261 |
| HPV33 | E2 | MDYTNWGEIY | 129 | 10 | | 36262 |
| HPV33 | E2 | MGFSHLCH | 49 | 8 | | 36263 |
| HPV33 | E2 | MVTGKVDY | 147 | 8 | | 36264 |
| HPV33 | E2 | NAVQEKILDLY | 9 | 11 | | 36265 |
| HPV33 | E2 | NCEKVYFK | 162 | 8 | | 36266 |
| HPV33 | E2 | NCEKVYFKY | 162 | 9 | | 36267 |
| HPV33 | E2 | NCEKVYFKYF | 162 | 10 | | 36268 |
| HPV33 | E2 | NCEKVYFKYFK | 162 | 11 | | 36269 |
| HPV33 | E2 | NDKKNTMDY | 123 | 9 | | 36270 |
| HPV33 | E2 | NDNRPPQA | 216 | 8 | | 36271 |
| HPV33 | E2 | NDNRPPQAA | 216 | 9 | | 36272 |
| HPV33 | E2 | NDNRPPQAAA | 216 | 10 | | 36273 |
| HPV33 | E2 | NDNRPPQAAAK | 216 | 11 | | 36274 |
| HPV33 | E2 | NGIVTVTF | 318 | 8 | | 36275 |
| HPV33 | E2 | NSKNGIVTVTF | 315 | 11 | | 36276 |
| HPV33 | E2 | NSLKCLRY | 284 | 8 | | 36277 |
| HPV33 | E2 | NSLKCLRYR | 284 | 9 | | 36278 |
| HPV33 | E2 | NSLKCLRYRLK | 284 | 11 | | 36279 |
| HPV33 | E2 | NVAPIVHLK | 272 | 9 | | 36280 |
| HPV33 | E2 | PADTTDTA | 230 | 8 | | 36281 |
| HPV33 | E2 | PALDNRTA | 248 | 8 | | 36282 |
| HPV33 | E2 | PALDNRTAR | 248 | 9 | | 36283 |
| HPV33 | E2 | PALDNRTARTA | 248 | 11 | | 36284 |
| HPV33 | E2 | PLTKLFCA | 239 | 8 | | 36285 |
| HPV33 | E2 | PLTKLFCADPA | 239 | 11 | | 36286 |
| HPV33 | E2 | PSLLASKTK | 60 | 9 | | 36287 |
| HPV33 | E2 | PSLLASKTKA | 60 | 10 | | 36288 |
| HPV33 | E2 | PSLLASKTKAF | 60 | 11 | | 36289 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E2 | PSQIEHWK | 27 | 8 | | 36290 |
| HPV33 | E2 | PSQIEHWKLIR | 27 | 11 | | 36291 |
| HPV33 | E2 | PTVQISTGF | 342 | 9 | | 36292 |
| HPV33 | E2 | QAAAKRRR | 222 | 8 | | 36293 |
| HPV33 | E2 | QAAAKRRRPA | 222 | 10 | | 36294 |
| HPV33 | E2 | QGETVTVQY | 113 | 9 | | 36295 |
| HPV33 | E2 | QIEHWKLIR | 29 | 9 | | 36296 |
| HPV33 | E2 | QISTTETA | 203 | 8 | | 36297 |
| HPV33 | E2 | QMALETLSK | 76 | 9 | | 36298 |
| HPV33 | E2 | QMFLGTVK | 332 | 8 | | 36299 |
| HPV33 | E2 | QMGFSHLCH | 48 | 9 | | 36300 |
| HPV33 | E2 | QTDNDNRPPQA | 213 | 11 | | 36301 |
| HPV33 | E2 | QVIELQMA | 71 | 8 | | 36302 |
| HPV33 | E2 | QVVPSLLA | 57 | 8 | | 36303 |
| HPV33 | E2 | QVVPSLLASK | 57 | 10 | | 36304 |
| HPV33 | E2 | RLKPYKELY | 292 | 9 | | 36305 |
| HPV33 | E2 | RLNAVQEK | 7 | 8 | | 36306 |
| HPV33 | E2 | RMECALLY | 37 | 8 | | 36307 |
| HPV33 | E2 | RMECALLYTA | 37 | 10 | | 36308 |
| HPV33 | E2 | RMECALLYTAK | 37 | 11 | | 36309 |
| HPV33 | E2 | RTATNCTNK | 256 | 9 | | 36310 |
| HPV33 | E2 | RTATNCTNKQR | 256 | 11 | | 36311 |
| HPV33 | E2 | RTVCSSNVA | 266 | 9 | | 36312 |
| HPV33 | E2 | SARLNAVQEK | 5 | 10 | | 36313 |
| HPV33 | E2 | SLEVWLCEPPK | 98 | 11 | | 36314 |
| HPV33 | E2 | SLKCLRYR | 285 | 8 | | 36315 |
| HPV33 | E2 | SLKCLRYRLK | 285 | 10 | | 36316 |
| HPV33 | E2 | SLLASKTK | 61 | 8 | | 36317 |
| HPV33 | E2 | SLLASKTKA | 61 | 9 | | 36318 |
| HPV33 | E2 | SLLASKTKAF | 61 | 10 | | 36319 |
| HPV33 | E2 | SSMSSTWH | 301 | 8 | | 36320 |
| HPV33 | E2 | SSNQISTTETA | 200 | 11 | | 36321 |
| HPV33 | E2 | SSNVAPIVH | 270 | 9 | | 36322 |
| HPV33 | E2 | SSNVAPIVHLK | 270 | 11 | | 36323 |
| HPV33 | E2 | SSTWHWTSDNK | 304 | 11 | | 36324 |
| HPV33 | E2 | STWHWTSDNK | 305 | 10 | | 36325 |
| HPV33 | E2 | TADIQTDNDNR | 209 | 11 | | 36326 |
| HPV33 | E2 | TAKQMGFSH | 45 | 9 | | 36327 |
| HPV33 | E2 | TAQPLTKLF | 236 | 9 | | 36328 |
| HPV33 | E2 | TAQPLTKLFCA | 236 | 11 | | 36329 |
| HPV33 | E2 | TARTATNCTNK | 254 | 11 | | 36330 |
| HPV33 | E2 | TATNCTNK | 257 | 8 | | 36331 |
| HPV33 | E2 | TATNCTNKQR | 257 | 10 | | 36332 |
| HPV33 | E2 | TCTMVTGK | 144 | 8 | | 36333 |
| HPV33 | E2 | TCTMVTGKVDY | 144 | 11 | | 36334 |
| HPV33 | E2 | TDLPSQIEH | 24 | 9 | | 36335 |
| HPV33 | E2 | TDLPSQIEHWK | 24 | 11 | | 36336 |
| HPV33 | E2 | TDNDNRPPQA | 214 | 10 | | 36337 |
| HPV33 | E2 | TDNDNRPPQAA | 214 | 11 | | 36338 |
| HPV33 | E2 | TDTAQPLTK | 234 | 9 | | 36339 |
| HPV33 | E2 | TDTAQPLTKLF | 234 | 11 | | 36340 |
| HPV33 | E2 | TFVTEQQQQMF | 324 | 11 | | 36341 |
| HPV33 | E2 | TGKVDYIGMY | 149 | 10 | | 36342 |
| HPV33 | E2 | TGKVDYIGMYY | 149 | 11 | | 36343 |
| HPV33 | E2 | TMDYTNWGEIY | 128 | 11 | | 36344 |
| HPV33 | E2 | TMVTGKVDY | 146 | 9 | | 36345 |
| HPV33 | E2 | TSDNKNSK | 310 | 8 | | 36346 |
| HPV33 | E2 | TTDTAQPLTK | 233 | 10 | | 36347 |
| HPV33 | E2 | TVCSSNVA | 267 | 8 | | 36348 |
| HPV33 | E2 | TVQISTGF | 343 | 8 | | 36349 |
| HPV33 | E2 | TVQYDNDK | 118 | 8 | | 36350 |
| HPV33 | E2 | TVQYDNDKK | 118 | 9 | | 36351 |
| HPV33 | E2 | TVTVQYDNDK | 116 | 10 | | 36352 |
| HPV33 | E2 | TVTVQYDNDKK | 116 | 11 | | 36353 |
| HPV33 | E2 | VAPIVHLK | 273 | 8 | | 36354 |
| HPV33 | E2 | VCSSNVAPIVH | 268 | 11 | | 36355 |
| HPV33 | E2 | VDYIGMYY | 152 | 8 | | 36356 |
| HPV33 | E2 | VDYIGMYYIH | 152 | 10 | | 36357 |
| HPV33 | E2 | VTEQQQQMF | 326 | 9 | | 36358 |
| HPV33 | E2 | VTGKVDYIGMY | 148 | 11 | | 36359 |
| HPV33 | E2 | VTVQYDNDK | 117 | 9 | | 36360 |
| HPV33 | E2 | VTVQYDNDKK | 117 | 10 | | 36361 |
| HPV33 | E2 | VVPSLLASK | 58 | 9 | | 36362 |
| HPV33 | E2 | VVPSLLASKTK | 58 | 11 | | 36363 |
| HPV33 | E2 | WLCEPPKCF | 102 | 9 | | 36364 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E2 | WLCEPPKCFK | 102 | 10 | | 36365 |
| HPV33 | E2 | WLCEPPKCFKK | 102 | 11 | | 36366 |
| HPV33 | E2 | WTSDNKNSK | 309 | 9 | | 36367 |
| HPV33 | E2 | YDNDKKNTMDY | 121 | 11 | | 36368 |
| HPV33 | E2 | YFKEDAAK | 170 | 8 | | 36369 |
| HPV33 | E2 | YFKEDAAKY | 170 | 9 | | 36370 |
| HPV33 | E2 | YFKEDAAKYSK | 170 | 11 | | 36371 |
| HPV33 | E2 | YFKYFKEDA | 167 | 9 | | 36372 |
| HPV33 | E2 | YFKYFKEDAA | 167 | 10 | | 36373 |
| HPV33 | E2 | YFKYFKEDAAK | 167 | 11 | | 36374 |
| HPV33 | E2 | YIGMYYIH | 154 | 8 | | 36375 |
| HPV33 | E2 | YIHNCEKVY | 159 | 9 | | 36376 |
| HPV33 | E2 | YIHNCEKVYF | 159 | 10 | | 36377 |
| HPV33 | E2 | YIHNCEKVYFK | 159 | 11 | | 36378 |
| HPV33 | E2 | YSKTQMWEVH | 178 | 10 | | 36379 |
| HPV33 | E2 | YSSMSSTWH | 300 | 9 | | 36380 |
| HPV33 | E2 | YTAKQMGF | 44 | 8 | | 36381 |
| HPV33 | E2 | YTAKQMGFSH | 44 | 10 | | 36382 |
| HPV33 | E2 | YTNWGEIY | 131 | 8 | | 36383 |
| HPV33 | E5 | CINFHAQH | 63 | 8 | | 36384 |
| HPV33 | E5 | FCYLLFLY | 51 | 8 | | 36385 |
| HPV33 | E5 | FFCYLLFLY | 50 | 9 | | 36386 |
| HPV33 | E5 | FLCLSLLLR | 12 | 9 | | 36387 |
| HPV33 | E5 | FLYLPMMCINF | 56 | 11 | | 36388 |
| HPV33 | E5 | FVFVLCFILF | 3 | 10 | | 36389 |
| HPV33 | E5 | FVGSPLKIF | 42 | 9 | | 36390 |
| HPV33 | E5 | FVGSPLKIFF | 42 | 10 | | 36391 |
| HPV33 | E5 | FVLCFILF | 5 | 8 | | 36392 |
| HPV33 | E5 | GSPLKIFF | 44 | 8 | | 36393 |
| HPV33 | E5 | GSPLKIFFCY | 44 | 10 | | 36394 |
| HPV33 | E5 | IFFCYLLF | 49 | 8 | | 36395 |
| HPV33 | E5 | IFFCYLLFLY | 49 | 10 | | 36396 |
| HPV33 | E5 | IFVFVLCF | 2 | 8 | | 36397 |
| HPV33 | E5 | IFVFVLCFILF | 2 | 11 | | 36398 |
| HPV33 | E5 | ILFLCLSLLLR | 10 | 11 | | 36399 |
| HPV33 | E5 | ILSISTYA | 23 | 8 | | 36400 |
| HPV33 | E5 | KIFFCYLLF | 48 | 9 | | 36401 |
| HPV33 | E5 | KIFFCYLLFLY | 48 | 11 | | 36402 |
| HPV33 | E5 | LCLSLLLR | 13 | 8 | | 36403 |
| HPV33 | E5 | LFLCLSLLLR | 11 | 10 | | 36404 |
| HPV33 | E5 | LILSISTY | 22 | 8 | | 36405 |
| HPV33 | E5 | LILSISTYA | 22 | 9 | | 36406 |
| HPV33 | E5 | LLVLVLLLWVF | 32 | 11 | | 36407 |
| HPV33 | E5 | LLWVFVGSPLK | 38 | 11 | | 36408 |
| HPV33 | E5 | LVLLLWVF | 35 | 8 | | 36409 |
| HPV33 | E5 | LVLVLLLWVF | 33 | 10 | | 36410 |
| HPV33 | E5 | MCINFHAQH | 62 | 9 | | 36411 |
| HPV33 | E5 | MIFVFVLCF | 1 | 9 | | 36412 |
| HPV33 | E5 | MMCINFHA | 61 | 8 | | 36413 |
| HPV33 | E5 | MMCINFHAQH | 61 | 10 | | 36414 |
| HPV33 | E5 | PLILSISTY | 21 | 9 | | 36415 |
| HPV33 | E5 | PLILSISTYA | 21 | 10 | | 36416 |
| HPV33 | E5 | PLKIFFCY | 46 | 8 | | 36417 |
| HPV33 | E5 | PLKIFFCYLLF | 46 | 11 | | 36418 |
| HPV33 | E5 | PMMCINFH | 60 | 8 | | 36419 |
| HPV33 | E5 | PMMCINFHA | 60 | 9 | | 36420 |
| HPV33 | E5 | PMMCINFHAQH | 60 | 11 | | 36421 |
| HPV33 | E5 | VFVGSPLK | 41 | 8 | | 36422 |
| HPV33 | E5 | VFVGSPLKIF | 41 | 10 | | 36423 |
| HPV33 | E5 | VFVGSPLKIFF | 41 | 11 | | 36424 |
| HPV33 | E5 | VFVLCFILF | 4 | 9 | | 36425 |
| HPV33 | E5 | VGSPLKIF | 43 | 8 | | 36426 |
| HPV33 | E5 | VGSPLKIFF | 43 | 9 | | 36427 |
| HPV33 | E5 | VGSPLKIFFCY | 43 | 11 | | 36428 |
| HPV33 | E5 | VLVLLLWVF | 34 | 9 | | 36429 |
| HPV33 | E5 | WVFVGSPLK | 40 | 9 | | 36430 |
| HPV33 | E5 | WVFVGSPLKIF | 40 | 11 | | 36431 |
| HPV33 | E5 | YLPMMCINF | 58 | 9 | | 36432 |
| HPV33 | E5 | YLPMMCINFH | 58 | 10 | | 36433 |
| HPV33 | E5 | YLPMMCINFHA | 58 | 11 | | 36434 |
| HPV33 | E6 | AACWRSRR | 137 | 8 | | 36435 |
| HPV33 | E6 | AACWRSRRR | 137 | 9 | | 36436 |
| HPV33 | E6 | ACWRSRRR | 138 | 8 | | 36437 |
| HPV33 | E6 | ACWRSRRRETA | 138 | 11 | | 36438 |
| HPV33 | E6 | ADLTVVYR | 48 | 8 | | 36439 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E6 | AFADLTVVY | 46 | 9 | | 36440 |
| HPV33 | E6 | AFADLTVVYR | 46 | 10 | | 36441 |
| HPV33 | E6 | AGRCAACWR | 133 | 9 | | 36442 |
| HPV33 | E6 | AGRCAACWRSR | 133 | 11 | | 36443 |
| HPV33 | E6 | CAACWRSR | 136 | 8 | | 36444 |
| HPV33 | E6 | CAACWRSRR | 136 | 9 | | 36445 |
| HPV33 | E6 | CAACWRSRRR | 136 | 10 | | 36446 |
| HPV33 | E6 | CLRFLSKISEY | 66 | 11 | | 36447 |
| HPV33 | E6 | CVECKKPLQR | 30 | 10 | | 36448 |
| HPV33 | E6 | DFAFADLTVVY | 44 | 11 | | 36449 |
| HPV33 | E6 | DLCQALETTIH | 14 | 11 | | 36450 |
| HPV33 | E6 | DTEEKPRTLH | 4 | 10 | | 36451 |
| HPV33 | E6 | ECKKPLQR | 32 | 8 | | 36452 |
| HPV33 | E6 | EGNPFGICK | 56 | 9 | | 36453 |
| HPV33 | E6 | EILIRCIICQR | 98 | 11 | | 36454 |
| HPV33 | E6 | ELQCVECK | 27 | 8 | | 36455 |
| HPV33 | E6 | ELQCVECKK | 27 | 9 | | 36456 |
| HPV33 | E6 | EVYDFAFA | 41 | 8 | | 36457 |
| HPV33 | E6 | FADLTVVY | 47 | 8 | | 36458 |
| HPV33 | E6 | FADLTVVYR | 47 | 9 | | 36459 |
| HPV33 | E6 | FAFADLTVVY | 45 | 10 | | 36460 |
| HPV33 | E6 | FAFADLTVVYR | 45 | 11 | | 36461 |
| HPV33 | E6 | FGICKLCLR | 60 | 9 | | 36462 |
| HPV33 | E6 | FGICKLCLRF | 60 | 10 | | 36463 |
| HPV33 | E6 | FLSKISEY | 69 | 8 | | 36464 |
| HPV33 | E6 | FLSKISEYR | 69 | 9 | | 36465 |
| HPV33 | E6 | FLSKISEYRH | 69 | 10 | | 36466 |
| HPV33 | E6 | FLSKISEYRHY | 69 | 11 | | 36467 |
| HPV33 | E6 | GICKLCLR | 61 | 8 | | 36468 |
| HPV33 | E6 | GICKLCLRF | 61 | 9 | | 36469 |
| HPV33 | E6 | HVDLNKRF | 118 | 8 | | 36470 |
| HPV33 | E6 | HVDLNKRFH | 118 | 9 | | 36471 |
| HPV33 | E6 | ICKLCLRF | 62 | 8 | | 36472 |
| HPV33 | E6 | ICKLCLRFLSK | 62 | 11 | | 36473 |
| HPV33 | E6 | ICQRPLCPQEK | 105 | 11 | | 36474 |
| HPV33 | E6 | ILIRCIICQR | 99 | 10 | | 36475 |
| HPV33 | E6 | ISEYRHYNY | 73 | 9 | | 36476 |
| HPV33 | E6 | ISGRWAGR | 128 | 8 | | 36477 |
| HPV33 | E6 | ISGRWAGRCA | 128 | 10 | | 36478 |
| HPV33 | E6 | ISGRWAGRCAA | 128 | 11 | | 36479 |
| HPV33 | E6 | KISEYRHY | 72 | 8 | | 36480 |
| HPV33 | E6 | KISEYRHYNY | 72 | 10 | | 36481 |
| HPV33 | E6 | KLCLRFLSK | 64 | 9 | | 36482 |
| HPV33 | E6 | LCLRFLSK | 65 | 8 | | 36483 |
| HPV33 | E6 | LCPQEKKR | 110 | 8 | | 36484 |
| HPV33 | E6 | LCPQEKKRH | 110 | 9 | | 36485 |
| HPV33 | E6 | LCQALETTIH | 15 | 10 | | 36486 |
| HPV33 | E6 | LIRCIICQR | 100 | 9 | | 36487 |
| HPV33 | E6 | LSKISEYR | 70 | 8 | | 36488 |
| HPV33 | E6 | LSKISEYRH | 70 | 9 | | 36489 |
| HPV33 | E6 | LSKISEYRHY | 70 | 10 | | 36490 |
| HPV33 | E6 | LTVVYREGNPF | 50 | 11 | | 36491 |
| HPV33 | E6 | MFQDTEEK | 1 | 8 | | 36492 |
| HPV33 | E6 | MFQDTEEKPR | 1 | 10 | | 36493 |
| HPV33 | E6 | NIELQCVECK | 25 | 10 | | 36494 |
| HPV33 | E6 | NIELQCVECKK | 25 | 11 | | 36495 |
| HPV33 | E6 | NISGRWAGR | 127 | 9 | | 36496 |
| HPV33 | E6 | NISGRWAGRCA | 127 | 11 | | 36497 |
| HPV33 | E6 | NTLEQTVK | 86 | 8 | | 36498 |
| HPV33 | E6 | NTLEQTVKK | 86 | 9 | | 36499 |
| HPV33 | E6 | PFGICKLCLR | 59 | 10 | | 36500 |
| HPV33 | E6 | PFGICKLCLRF | 59 | 11 | | 36501 |
| HPV33 | E6 | PLCPQEKK | 109 | 8 | | 36502 |
| HPV33 | E6 | PLCPQEKKR | 109 | 9 | | 36503 |
| HPV33 | E6 | PLCPQEKKRH | 109 | 10 | | 36504 |
| HPV33 | E6 | PLNEILIR | 95 | 8 | | 36505 |
| HPV33 | E6 | PLQRSEVY | 36 | 8 | | 36506 |
| HPV33 | E6 | PLQRSEVYDF | 36 | 10 | | 36507 |
| HPV33 | E6 | PLQRSEVYDFA | 36 | 11 | | 36508 |
| HPV33 | E6 | QALETTIH | 17 | 8 | | 36509 |
| HPV33 | E6 | QCVECKKPLQR | 29 | 11 | | 36510 |
| HPV33 | E6 | QDTEEKPR | 3 | 8 | | 36511 |
| HPV33 | E6 | QDTEEKPRTLH | 3 | 11 | | 36512 |
| HPV33 | E6 | RCAACWRSR | 135 | 9 | | 36513 |
| HPV33 | E6 | RCAACWRSRR | 135 | 10 | | 36514 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | E6 | RCAACWRSRRR | 135 | 11 | | 36515 |
| HPV33 | E6 | RFHNISGR | 124 | 8 | | 36516 |
| HPV33 | E6 | RFHNISGRWA | 124 | 10 | | 36517 |
| HPV33 | E6 | RFLSKISEY | 68 | 9 | | 36518 |
| HPV33 | E6 | RFLSKISEYR | 68 | 10 | | 36519 |
| HPV33 | E6 | RFLSKISEYRH | 68 | 11 | | 36520 |
| HPV33 | E6 | RSEVYDFA | 39 | 8 | | 36521 |
| HPV33 | E6 | RSEVYDFAF | 39 | 9 | | 36522 |
| HPV33 | E6 | RSEVYDFAFA | 39 | 10 | | 36523 |
| HPV33 | E6 | RSRRRETA | 141 | 8 | | 36524 |
| HPV33 | E6 | RTLHDLCQA | 10 | 9 | | 36525 |
| HPV33 | E6 | SGRWAGRCA | 129 | 9 | | 36526 |
| HPV33 | E6 | SGRWAGRCAA | 129 | 10 | | 36527 |
| HPV33 | E6 | TLEQTVKK | 87 | 8 | | 36528 |
| HPV33 | E6 | TLHDLCQA | 11 | 8 | | 36529 |
| HPV33 | E6 | TVVYREGNPF | 51 | 10 | | 36530 |
| HPV33 | E6 | VDLNKRFH | 119 | 8 | | 36531 |
| HPV33 | E6 | VVYREGNPF | 52 | 9 | | 36532 |
| HPV33 | E6 | WAGRCAACWR | 132 | 10 | | 36533 |
| HPV33 | E6 | YGNTLEQTVK | 84 | 10 | | 36534 |
| HPV33 | E6 | YGNTLEQTVKK | 84 | 11 | | 36535 |
| HPV33 | E7 | ADYYIVTCCH | 50 | 10 | | 36536 |
| HPV33 | E7 | CCHTCNTTVR | 57 | 10 | | 36537 |
| HPV33 | E7 | CVNSTASDLR | 68 | 10 | | 36538 |
| HPV33 | E7 | DGQAQPATA | 42 | 9 | | 36539 |
| HPV33 | E7 | DGQAQPATADY | 42 | 11 | | 36540 |
| HPV33 | E7 | DLYPEPTDLY | 14 | 10 | | 36541 |
| HPV33 | E7 | DSSDEDEGLDR | 30 | 11 | | 36542 |
| HPV33 | E7 | EGLDRPDGQA | 36 | 10 | | 36543 |
| HPV33 | E7 | GLDRPDGQA | 37 | 9 | | 36544 |
| HPV33 | E7 | GTVNIVCPTCA | 85 | 11 | | 36545 |
| HPV33 | E7 | HTCNTTVR | 59 | 8 | | 36546 |
| HPV33 | E7 | LCVNSTASDLR | 67 | 11 | | 36547 |
| HPV33 | E7 | LDLYPEPTDLY | 13 | 11 | | 36548 |
| HPV33 | E7 | LDRPDGQA | 38 | 8 | | 36549 |
| HPV33 | E7 | LDRPDGQAQPA | 38 | 11 | | 36550 |
| HPV33 | E7 | NIVCPTCA | 88 | 8 | | 36551 |
| HPV33 | E7 | NSTASDLR | 70 | 8 | | 36552 |
| HPV33 | E7 | PDGQAQPA | 41 | 8 | | 36553 |
| HPV33 | E7 | PDGQAQPATA | 41 | 10 | | 36554 |
| HPV33 | E7 | PTLKEYVLDLY | 6 | 11 | | 36555 |
| HPV33 | E7 | QAQPATADY | 44 | 9 | | 36556 |
| HPV33 | E7 | QAQPATADYY | 44 | 10 | | 36557 |
| HPV33 | E7 | RGHKPTLK | 2 | 8 | | 36558 |
| HPV33 | E7 | RGHKPTLKEY | 2 | 10 | | 36559 |
| HPV33 | E7 | RLCVNSTA | 66 | 8 | | 36560 |
| HPV33 | E7 | SDEDEGLDR | 32 | 9 | | 36561 |
| HPV33 | E7 | SSDEDEGLDR | 31 | 10 | | 36562 |
| HPV33 | E7 | TADYYIVTCCH | 49 | 11 | | 36563 |
| HPV33 | E7 | TCCHTCNTTVR | 56 | 11 | | 36564 |
| HPV33 | E7 | TLKEYVLDLY | 7 | 10 | | 36565 |
| HPV33 | E7 | TTVRLCVNSTA | 63 | 11 | | 36566 |
| HPV33 | E7 | TVNIVCPTCA | 86 | 10 | | 36567 |
| HPV33 | E7 | TVRLCVNSTA | 64 | 10 | | 36568 |
| HPV33 | L1 | AAPTSTRTSSA | 482 | 11 | | 36569 |
| HPV33 | L1 | ACTNAAPA | 175 | 8 | | 36570 |
| HPV33 | L1 | ACVGLEIGR | 102 | 9 | | 36571 |
| HPV33 | L1 | ADLDQFPLGR | 456 | 10 | | 36572 |
| HPV33 | L1 | ADLDQFPLGRK | 456 | 11 | | 36573 |
| HPV33 | L1 | ADNRECLSMDY | 142 | 11 | | 36574 |
| HPV33 | L1 | AGLKAKPK | 471 | 8 | | 36575 |
| HPV33 | L1 | AGLKAKPKLK | 471 | 10 | | 36576 |
| HPV33 | L1 | AGLKAKPKLKR | 471 | 11 | | 36577 |
| HPV33 | L1 | AGSSRLLA | 37 | 8 | | 36578 |
| HPV33 | L1 | AGSSRLLAVGH | 37 | 11 | | 36579 |
| HPV33 | L1 | AITCQKTVPPK | 424 | 11 | | 36580 |
| HPV33 | L1 | ASIQSSAF | 284 | 8 | | 36581 |
| HPV33 | L1 | ASIQSSAFF | 284 | 9 | | 36582 |
| HPV33 | L1 | ASLQDTYR | 411 | 8 | | 36583 |
| HPV33 | L1 | ASLQDTYRF | 411 | 9 | | 36584 |
| HPV33 | L1 | AVGHPYFSIK | 44 | 10 | | 36585 |
| HPV33 | L1 | AVPDDLYIK | 270 | 9 | | 36586 |
| HPV33 | L1 | CGSTCKYPDY | 225 | 10 | | 36587 |
| HPV33 | L1 | CMDFKTLQA | 207 | 9 | | 36588 |
| HPV33 | L1 | CMDFKTLQANK | 207 | 11 | | 36589 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | L1 | CTQVTSDSTY | 345 | 10 | | 36590 |
| HPV33 | L1 | CTQVTSDSTYK | 345 | 11 | | 36591 |
| HPV33 | L1 | CVGLEIGR | 103 | 8 | | 36592 |
| HPV33 | L1 | DDTETGNK | 128 | 8 | | 36593 |
| HPV33 | L1 | DDTETGNKY | 128 | 9 | | 36594 |
| HPV33 | L1 | DFKTLQANK | 209 | 9 | | 36595 |
| HPV33 | L1 | DGDMVDTGF | 197 | 9 | | 36596 |
| HPV33 | L1 | DICGSTCK | 223 | 8 | | 36597 |
| HPV33 | L1 | DICGSTCKY | 223 | 9 | | 36598 |
| HPV33 | L1 | DILEDWQF | 396 | 8 | | 36599 |
| HPV33 | L1 | DLDQFPLGR | 457 | 9 | | 36600 |
| HPV33 | L1 | DLDQFPLGRK | 457 | 10 | | 36601 |
| HPV33 | L1 | DLDQFPLGRKF | 457 | 11 | | 36602 |
| HPV33 | L1 | DLKEKFSA | 449 | 8 | | 36603 |
| HPV33 | L1 | DLQFVFQLCK | 370 | 10 | | 36604 |
| HPV33 | L1 | DLYIKGSGTTA | 274 | 11 | | 36605 |
| HPV33 | L1 | DSLFFFLR | 244 | 8 | | 36606 |
| HPV33 | L1 | DSLFFFLRR | 244 | 9 | | 36607 |
| HPV33 | L1 | DSTYKNENF | 351 | 9 | | 36608 |
| HPV33 | L1 | DSTYKNENFK | 351 | 10 | | 36609 |
| HPV33 | L1 | DTETGNKY | 129 | 8 | | 36610 |
| HPV33 | L1 | DTGFGCMDF | 202 | 9 | | 36611 |
| HPV33 | L1 | DTGFGCMDFK | 202 | 10 | | 36612 |
| HPV33 | L1 | DTQRLVWA | 95 | 8 | | 36613 |
| HPV33 | L1 | DTSFYNPDTQR | 88 | 11 | | 36614 |
| HPV33 | L1 | DTYRFVTSQA | 415 | 10 | | 36615 |
| HPV33 | L1 | EAVPDDLY | 269 | 8 | | 36616 |
| HPV33 | L1 | EAVPDDLYIK | 269 | 10 | | 36617 |
| HPV33 | L1 | ECLSMDYK | 146 | 8 | | 36618 |
| HPV33 | L1 | EDGDMVDTGF | 196 | 10 | | 36619 |
| HPV33 | L1 | EDPLGKYTF | 437 | 9 | | 36620 |
| HPV33 | L1 | ESQLFNKPY | 303 | 9 | | 36621 |
| HPV33 | L1 | EVDLKEKF | 447 | 8 | | 36622 |
| HPV33 | L1 | EVDLKEKFSA | 447 | 10 | | 36623 |
| HPV33 | L1 | EVMTYIHA | 385 | 8 | | 36624 |
| HPV33 | L1 | FDDTETGNK | 127 | 9 | | 36625 |
| HPV33 | L1 | FDDTETGNKY | 127 | 10 | | 36626 |
| HPV33 | L1 | FFFLRREQMF | 247 | 10 | | 36627 |
| HPV33 | L1 | FFLRREQMF | 248 | 9 | | 36628 |
| HPV33 | L1 | FFLRREQMFVR | 248 | 11 | | 36629 |
| HPV33 | L1 | FFNRAGTLGEA | 260 | 11 | | 36630 |
| HPV33 | L1 | FGCMDFKTLQA | 205 | 11 | | 36631 |
| HPV33 | L1 | FGFPDTSF | 84 | 8 | | 36632 |
| HPV33 | L1 | FGFPDTSFY | 84 | 9 | | 36633 |
| HPV33 | L1 | FGLTPPPSA | 403 | 9 | | 36634 |
| HPV33 | L1 | FLLQAGLK | 467 | 8 | | 36635 |
| HPV33 | L1 | FLLQAGLKA | 467 | 9 | | 36636 |
| HPV33 | L1 | FLLQAGLKAK | 467 | 10 | | 36637 |
| HPV33 | L1 | FLRREQMF | 249 | 8 | | 36638 |
| HPV33 | L1 | FLRREQMFVR | 249 | 10 | | 36639 |
| HPV33 | L1 | FLRREQMFVRH | 249 | 11 | | 36640 |
| HPV33 | L1 | FSADLDQF | 454 | 8 | | 36641 |
| HPV33 | L1 | FSIKNPTNA | 50 | 9 | | 36642 |
| HPV33 | L1 | FSIKNPTNAK | 50 | 10 | | 36643 |
| HPV33 | L1 | FSIKNPTNAKK | 50 | 11 | | 36644 |
| HPV33 | L1 | FVRHFFNR | 256 | 8 | | 36645 |
| HPV33 | L1 | FVRHFFNRA | 256 | 9 | | 36646 |
| HPV33 | L1 | FVTSQAITCQK | 419 | 11 | | 36647 |
| HPV33 | L1 | FVTVVDTTR | 330 | 9 | | 36648 |
| HPV33 | L1 | GCKPPTGEH | 161 | 9 | | 36649 |
| HPV33 | L1 | GCMDFKTLQA | 206 | 10 | | 36650 |
| HPV33 | L1 | GDMVDTGF | 198 | 8 | | 36651 |
| HPV33 | L1 | GDSLFFFLR | 243 | 9 | | 36652 |
| HPV33 | L1 | GDSLFFFLRR | 243 | 10 | | 36653 |
| HPV33 | L1 | GFGCMDFK | 204 | 8 | | 36654 |
| HPV33 | L1 | GFPDTSFY | 85 | 8 | | 36655 |
| HPV33 | L1 | GICWGNQVF | 322 | 9 | | 36656 |
| HPV33 | L1 | GISGHPLLNK | 117 | 10 | | 36657 |
| HPV33 | L1 | GISGHPLLNKF | 117 | 11 | | 36658 |
| HPV33 | L1 | GLKAKPKLK | 472 | 9 | | 36659 |
| HPV33 | L1 | GLKAKPKLKR | 472 | 10 | | 36660 |
| HPV33 | L1 | GLKAKPKLKRA | 472 | 11 | | 36661 |
| HPV33 | L1 | GLQYRVFR | 68 | 8 | | 36662 |
| HPV33 | L1 | GLQYRVFRVR | 68 | 10 | | 36663 |
| HPV33 | L1 | GLTPPPSA | 404 | 8 | | 36664 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | L1 | GSMVTSESQLF | 297 | 11 | | 36665 |
| HPV33 | L1 | GSSRLLAVGH | 38 | 10 | | 36666 |
| HPV33 | L1 | GSTCKYPDY | 226 | 9 | | 36667 |
| HPV33 | L1 | GSTCKYPDYLK | 226 | 11 | | 36668 |
| HPV33 | L1 | GTTASIQSSA | 281 | 10 | | 36669 |
| HPV33 | L1 | GTTASIQSSAF | 281 | 11 | | 36670 |
| HPV33 | L1 | GVACTNAA | 173 | 8 | | 36671 |
| HPV33 | L1 | GVACTNAAPA | 173 | 10 | | 36672 |
| HPV33 | L1 | HVEEYDLQF | 365 | 9 | | 36673 |
| HPV33 | L1 | HVEEYDLQFVF | 365 | 11 | | 36674 |
| HPV33 | L1 | ICGSTCKY | 224 | 8 | | 36675 |
| HPV33 | L1 | ICGSTCKYPDY | 224 | 11 | | 36676 |
| HPV33 | L1 | ICWGNQVF | 323 | 8 | | 36677 |
| HPV33 | L1 | IDICGSTCK | 222 | 9 | | 36678 |
| HPV33 | L1 | IDICGSTCKY | 222 | 10 | | 36679 |
| HPV33 | L1 | ISGHPLLNK | 118 | 9 | | 36680 |
| HPV33 | L1 | ISGHPLLNKF | 118 | 10 | | 36681 |
| HPV33 | L1 | ITCQKTVPPK | 425 | 10 | | 36682 |
| HPV33 | L1 | KAKPKLKR | 474 | 8 | | 36683 |
| HPV33 | L1 | KAKPKLKRA | 474 | 9 | | 36684 |
| HPV33 | L1 | KAKPKLKRAA | 474 | 10 | | 36685 |
| HPV33 | L1 | KFDDTETGNK | 126 | 10 | | 36686 |
| HPV33 | L1 | KFDDTETGNKY | 126 | 11 | | 36687 |
| HPV33 | L1 | KFGFPDTSF | 83 | 9 | | 36688 |
| HPV33 | L1 | KFGFPDTSFY | 83 | 10 | | 36689 |
| HPV33 | L1 | KFLLQAGLK | 466 | 9 | | 36690 |
| HPV33 | L1 | KFLLQAGLKA | 466 | 10 | | 36691 |
| HPV33 | L1 | KFLLQAGLKAK | 466 | 11 | | 36692 |
| HPV33 | L1 | KFSADLDQF | 453 | 9 | | 36693 |
| HPV33 | L1 | KGVACTNA | 172 | 8 | | 36694 |
| HPV33 | L1 | KGVACTNAA | 172 | 9 | | 36695 |
| HPV33 | L1 | KGVACTNAAPA | 172 | 11 | | 36696 |
| HPV33 | L1 | KLKRAAPTSTR | 478 | 11 | | 36697 |
| HPV33 | L1 | KTVPPKEK | 429 | 8 | | 36698 |
| HPV33 | L1 | KVSGLQYR | 65 | 8 | | 36699 |
| HPV33 | L1 | KVSGLQYRVF | 65 | 10 | | 36700 |
| HPV33 | L1 | KVSGLQYRVFR | 65 | 11 | | 36701 |
| HPV33 | L1 | KVTLTAEVMTY | 379 | 11 | | 36702 |
| HPV33 | L1 | KVVSTDEY | 20 | 8 | | 36703 |
| HPV33 | L1 | KVVSTDEYVSR | 20 | 11 | | 36704 |
| HPV33 | L1 | LAVGHPYF | 43 | 8 | | 36705 |
| HPV33 | L1 | LAVGHPYFSIK | 43 | 11 | | 36706 |
| HPV33 | L1 | LCKVTLTA | 377 | 8 | | 36707 |
| HPV33 | L1 | LCTQVTSDSTY | 344 | 11 | | 36708 |
| HPV33 | L1 | LDQFPLGR | 458 | 8 | | 36709 |
| HPV33 | L1 | LDQFPLGRK | 458 | 9 | | 36710 |
| HPV33 | L1 | LDQFPLGRKF | 458 | 10 | | 36711 |
| HPV33 | L1 | LFFFLRREQMF | 246 | 11 | | 36712 |
| HPV33 | L1 | LFNKPYWLQR | 306 | 10 | | 36713 |
| HPV33 | L1 | LFNKPYWLQRA | 306 | 11 | | 36714 |
| HPV33 | L1 | LGCKPPTGEH | 160 | 10 | | 36715 |
| HPV33 | L1 | LGEAVPDDLY | 267 | 10 | | 36716 |
| HPV33 | L1 | LGRKFLLQA | 463 | 9 | | 36717 |
| HPV33 | L1 | LGVGISGH | 114 | 8 | | 36718 |
| HPV33 | L1 | LLAVGHPY | 42 | 8 | | 36719 |
| HPV33 | L1 | LLAVGHPYF | 42 | 9 | | 36720 |
| HPV33 | L1 | LLGCKPPTGEH | 159 | 11 | | 36721 |
| HPV33 | L1 | LLQAGLKA | 468 | 8 | | 36722 |
| HPV33 | L1 | LLQAGLKAK | 468 | 9 | | 36723 |
| HPV33 | L1 | LLQAGLKAKPK | 468 | 11 | | 36724 |
| HPV33 | L1 | LLVPKVSGLQY | 61 | 11 | | 36725 |
| HPV33 | L1 | LTAEVMTY | 382 | 8 | | 36726 |
| HPV33 | L1 | LTAEVMTYIH | 382 | 10 | | 36727 |
| HPV33 | L1 | LTAEVMTYIHA | 382 | 11 | | 36728 |
| HPV33 | L1 | LVPKVSGLQY | 62 | 10 | | 36729 |
| HPV33 | L1 | LVPKVSGLQYR | 62 | 11 | | 36730 |
| HPV33 | L1 | MDFKTLQA | 208 | 8 | | 36731 |
| HPV33 | L1 | MDFKTLQANK | 208 | 10 | | 36732 |
| HPV33 | L1 | MFVRHFFNR | 255 | 9 | | 36733 |
| HPV33 | L1 | MFVRHFFNRA | 255 | 10 | | 36734 |
| HPV33 | L1 | MSVWRPSEA | 1 | 9 | | 36735 |
| HPV33 | L1 | MTSEPYGDSLF | 237 | 11 | | 36736 |
| HPV33 | L1 | MVDTGFGCMDF | 200 | 11 | | 36737 |
| HPV33 | L1 | MVTSESQLF | 299 | 9 | | 36738 |
| HPV33 | L1 | MVTSESQLFNK | 299 | 11 | | 36739 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | L1 | NAKKLLVPK | 57 | 9 | | 36740 |
| HPV33 | L1 | NFKEYIRH | 358 | 8 | | 36741 |
| HPV33 | L1 | NGICWGNQVF | 321 | 10 | | 36742 |
| HPV33 | L1 | PDILEDWQF | 395 | 9 | | 36743 |
| HPV33 | L1 | PDPNKFGF | 79 | 8 | | 36744 |
| HPV33 | L1 | PDTQRLVWA | 94 | 9 | | 36745 |
| HPV33 | L1 | PDYLKMTSEPY | 232 | 11 | | 36746 |
| HPV33 | L1 | PGQPGADNR | 137 | 9 | | 36747 |
| HPV33 | L1 | PIDICGSTCK | 221 | 10 | | 36748 |
| HPV33 | L1 | PIDICGSTCKY | 221 | 11 | | 36749 |
| HPV33 | L1 | PLGRKFLLQA | 462 | 10 | | 36750 |
| HPV33 | L1 | PLGVGISGH | 113 | 9 | | 36751 |
| HPV33 | L1 | PSASLQDTY | 409 | 9 | | 36752 |
| HPV33 | L1 | PSASLQDTYR | 409 | 10 | | 36753 |
| HPV33 | L1 | PSASLQDTYRF | 409 | 11 | | 36754 |
| HPV33 | L1 | PTGEHWGK | 165 | 8 | | 36755 |
| HPV33 | L1 | PTGEHWGKGVA | 165 | 11 | | 36756 |
| HPV33 | L1 | PTNAKKLLVPK | 55 | 11 | | 36757 |
| HPV33 | L1 | PTSTRTSSA | 484 | 9 | | 36758 |
| HPV33 | L1 | PTSTRTSSAK | 484 | 10 | | 36759 |
| HPV33 | L1 | PTSTRTSSAKR | 484 | 11 | | 36760 |
| HPV33 | L1 | PVSKVVSTDEY | 17 | 11 | | 36761 |
| HPV33 | L1 | QAGLKAKPK | 470 | 9 | | 36762 |
| HPV33 | L1 | QAGLKAKPKLK | 470 | 11 | | 36763 |
| HPV33 | L1 | QDTYRFVTSQA | 414 | 11 | | 36764 |
| HPV33 | L1 | QFGLTPPPSA | 402 | 10 | | 36765 |
| HPV33 | L1 | QFPLGRKF | 460 | 8 | | 36766 |
| HPV33 | L1 | QFVFQLCK | 372 | 8 | | 36767 |
| HPV33 | L1 | QLCKVTLTA | 376 | 9 | | 36768 |
| HPV33 | L1 | QLCLLGCK | 156 | 8 | | 36769 |
| HPV33 | L1 | QLFNKPYWLQR | 305 | 11 | | 36770 |
| HPV33 | L1 | QMFVRHFF | 254 | 8 | | 36771 |
| HPV33 | L1 | QMFVRHFFNR | 254 | 10 | | 36772 |
| HPV33 | L1 | QMFVRHFFNRA | 254 | 11 | | 36773 |
| HPV33 | L1 | QTQLCLLGCK | 154 | 10 | | 36774 |
| HPV33 | L1 | QVFVTVVDTTR | 328 | 11 | | 36775 |
| HPV33 | L1 | QVTSDSTY | 347 | 8 | | 36776 |
| HPV33 | L1 | QVTSDSTYK | 347 | 9 | | 36777 |
| HPV33 | L1 | RAAPTSTR | 481 | 8 | | 36778 |
| HPV33 | L1 | RAGTLGEA | 263 | 8 | | 36779 |
| HPV33 | L1 | RLLAVGHPY | 41 | 9 | | 36780 |
| HPV33 | L1 | RLLAVGHPYF | 41 | 10 | | 36781 |
| HPV33 | L1 | RLPDPNKF | 77 | 8 | | 36782 |
| HPV33 | L1 | RLPDPNKFGF | 77 | 10 | | 36783 |
| HPV33 | L1 | RTSIYYYA | 30 | 8 | | 36784 |
| HPV33 | L1 | RTSSAKRK | 488 | 8 | | 36785 |
| HPV33 | L1 | RTSSAKRKK | 488 | 9 | | 36786 |
| HPV33 | L1 | RTSSAKRKKVK | 488 | 11 | | 36787 |
| HPV33 | L1 | RVRLPDPNK | 75 | 9 | | 36788 |
| HPV33 | L1 | RVRLPDPNKF | 75 | 10 | | 36789 |
| HPV33 | L1 | SADLDQFPLGR | 455 | 11 | | 36790 |
| HPV33 | L1 | SAKRKKVK | 491 | 8 | | 36791 |
| HPV33 | L1 | SAKRKKVKK | 491 | 9 | | 36792 |
| HPV33 | L1 | SASLQDTY | 410 | 8 | | 36793 |
| HPV33 | L1 | SASLQDTYR | 410 | 9 | | 36794 |
| HPV33 | L1 | SASLQDTYRF | 410 | 10 | | 36795 |
| HPV33 | L1 | SDSTYKNENF | 350 | 10 | | 36796 |
| HPV33 | L1 | SDSTYKNENFK | 350 | 11 | | 36797 |
| HPV33 | L1 | SFYNPDTQR | 90 | 9 | | 36798 |
| HPV33 | L1 | SGHPLLNK | 119 | 8 | | 36799 |
| HPV33 | L1 | SGHPLLNKF | 119 | 9 | | 36800 |
| HPV33 | L1 | SGLQYRVF | 67 | 8 | | 36801 |
| HPV33 | L1 | SGLQYRVFR | 67 | 9 | | 36802 |
| HPV33 | L1 | SGLQYRVFRVR | 67 | 11 | | 36803 |
| HPV33 | L1 | SGTTASIQSSA | 280 | 11 | | 36804 |
| HPV33 | L1 | SIKNPTNA | 51 | 8 | | 36805 |
| HPV33 | L1 | SIKNPTNAK | 51 | 9 | | 36806 |
| HPV33 | L1 | SIKNPTNAKK | 51 | 10 | | 36807 |
| HPV33 | L1 | SIQSSAFF | 285 | 8 | | 36808 |
| HPV33 | L1 | SIYYYAGSSR | 32 | 10 | | 36809 |
| HPV33 | L1 | SLFFFLRR | 245 | 8 | | 36810 |
| HPV33 | L1 | SLQDTYRF | 412 | 8 | | 36811 |
| HPV33 | L1 | SMVTSESQLF | 298 | 10 | | 36812 |
| HPV33 | L1 | SSAKRKKVK | 490 | 9 | | 36813 |
| HPV33 | L1 | SSAKRKKVKK | 490 | 10 | | 36814 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | L1 | SSRLLAVGH | 39 | 9 | | 36815 |
| HPV33 | L1 | SSRLLAVGHPY | 39 | 11 | | 36816 |
| HPV33 | L1 | STCKYPDY | 227 | 8 | | 36817 |
| HPV33 | L1 | STCKYPDYLK | 227 | 10 | | 36818 |
| HPV33 | L1 | STDEYVSR | 23 | 8 | | 36819 |
| HPV33 | L1 | STRTSSAK | 486 | 8 | | 36820 |
| HPV33 | L1 | STRTSSAKR | 486 | 9 | | 36821 |
| HPV33 | L1 | STRTSSAKRK | 486 | 10 | | 36822 |
| HPV33 | L1 | STRTSSAKRKK | 486 | 11 | | 36823 |
| HPV33 | L1 | STYKNENF | 352 | 8 | | 36824 |
| HPV33 | L1 | STYKNENFK | 352 | 9 | | 36825 |
| HPV33 | L1 | STYKNENFKEY | 352 | 11 | | 36826 |
| HPV33 | L1 | SVWRPSEA | 2 | 8 | | 36827 |
| HPV33 | L1 | SVWRPSEATVY | 2 | 11 | | 36828 |
| HPV33 | L1 | TAEVMTYIH | 383 | 9 | | 36829 |
| HPV33 | L1 | TAEVMTYIHA | 383 | 10 | | 36830 |
| HPV33 | L1 | TASIQSSA | 283 | 8 | | 36831 |
| HPV33 | L1 | TASIQSSAF | 283 | 9 | | 36832 |
| HPV33 | L1 | TASIQSSAFF | 283 | 10 | | 36833 |
| HPV33 | L1 | TCKYPDYLK | 228 | 9 | | 36834 |
| HPV33 | L1 | TCQKTVPPK | 426 | 9 | | 36835 |
| HPV33 | L1 | TCQKTVPPKEK | 426 | 11 | | 36836 |
| HPV33 | L1 | TDEYVSRTSIY | 24 | 11 | | 36837 |
| HPV33 | L1 | TFWEVDLK | 444 | 8 | | 36838 |
| HPV33 | L1 | TFWEVDLKEK | 444 | 10 | | 36839 |
| HPV33 | L1 | TFWEVDLKEKF | 444 | 11 | | 36840 |
| HPV33 | L1 | TGEHWGKGVA | 166 | 10 | | 36841 |
| HPV33 | L1 | TGFGCMDF | 203 | 8 | | 36842 |
| HPV33 | L1 | TGFGCMDFK | 203 | 9 | | 36843 |
| HPV33 | L1 | TGNKYPGQPGA | 132 | 11 | | 36844 |
| HPV33 | L1 | TLGEAVPDDLY | 266 | 11 | | 36845 |
| HPV33 | L1 | TLTAEVMTY | 381 | 9 | | 36846 |
| HPV33 | L1 | TLTAEVMTYIH | 381 | 11 | | 36847 |
| HPV33 | L1 | TSDSTYKNENF | 349 | 11 | | 36848 |
| HPV33 | L1 | TSEPYGDSLF | 238 | 10 | | 36849 |
| HPV33 | L1 | TSEPYGDSLFF | 238 | 11 | | 36850 |
| HPV33 | L1 | TSESQLFNK | 301 | 9 | | 36851 |
| HPV33 | L1 | TSESQLFNKPY | 301 | 11 | | 36852 |
| HPV33 | L1 | TSFYNPDTQR | 89 | 10 | | 36853 |
| HPV33 | L1 | TSIYYYAGSSR | 31 | 11 | | 36854 |
| HPV33 | L1 | TSQAITCQK | 421 | 9 | | 36855 |
| HPV33 | L1 | TSSAKRKK | 489 | 8 | | 36856 |
| HPV33 | L1 | TSSAKRKKVK | 489 | 10 | | 36857 |
| HPV33 | L1 | TSSAKRKKVKK | 489 | 11 | | 36858 |
| HPV33 | L1 | TSTRTSSA | 485 | 8 | | 36859 |
| HPV33 | L1 | TSTRTSSAK | 485 | 9 | | 36860 |
| HPV33 | L1 | TSTRTSSAKR | 485 | 10 | | 36861 |
| HPV33 | L1 | TSTRTSSAKRK | 485 | 11 | | 36862 |
| HPV33 | L1 | TTASIQSSA | 282 | 9 | | 36863 |
| HPV33 | L1 | TTASIQSSAF | 282 | 10 | | 36864 |
| HPV33 | L1 | TTASIQSSAFF | 282 | 11 | | 36865 |
| HPV33 | L1 | TVYLPPVPVSK | 10 | 11 | | 36866 |
| HPV33 | L1 | VACTNAAPA | 174 | 9 | | 36867 |
| HPV33 | L1 | VDLKEKFSA | 448 | 9 | | 36868 |
| HPV33 | L1 | VDTGFGCMDF | 201 | 10 | | 36869 |
| HPV33 | L1 | VDTGFGCMDFK | 201 | 11 | | 36870 |
| HPV33 | L1 | VFQLCKVTLTA | 374 | 11 | | 36871 |
| HPV33 | L1 | VFRVRLPDPNK | 73 | 11 | | 36872 |
| HPV33 | L1 | VFVTVVDTTR | 329 | 10 | | 36873 |
| HPV33 | L1 | VGHPYFSIK | 45 | 9 | | 36874 |
| HPV33 | L1 | VGISGHPLLNK | 116 | 11 | | 36875 |
| HPV33 | L1 | VSGLQYRVF | 66 | 9 | | 36876 |
| HPV33 | L1 | VSGLQYRVFR | 66 | 10 | | 36877 |
| HPV33 | L1 | VSKVVSTDEY | 18 | 10 | | 36878 |
| HPV33 | L1 | VSRTSIYY | 28 | 8 | | 36879 |
| HPV33 | L1 | VSRTSIYYY | 28 | 9 | | 36880 |
| HPV33 | L1 | VSRTSIYYYA | 28 | 10 | | 36881 |
| HPV33 | L1 | VSTDEYVSR | 22 | 9 | | 36882 |
| HPV33 | L1 | VTLTAEVMTY | 380 | 10 | | 36883 |
| HPV33 | L1 | VTSDSTYK | 348 | 8 | | 36884 |
| HPV33 | L1 | VTSESQLF | 300 | 8 | | 36885 |
| HPV33 | L1 | VTSESQLFNK | 300 | 10 | | 36886 |
| HPV33 | L1 | VTSQAITCQK | 420 | 10 | | 36887 |
| HPV33 | L1 | VTVVDTTR | 331 | 8 | | 36888 |
| HPV33 | L1 | VVSTDEYVSR | 21 | 10 | | 36889 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | L1 | WACVGLEIGR | 101 | 10 | | 36890 |
| HPV33 | L1 | WGKGVACTNA | 170 | 10 | | 36891 |
| HPV33 | L1 | WGKGVACTNAA | 170 | 11 | | 36892 |
| HPV33 | L1 | WLQRAQGH | 312 | 8 | | 36893 |
| HPV33 | L1 | YAGSSRLLA | 36 | 9 | | 36894 |
| HPV33 | L1 | YDLQFVFQLCK | 369 | 11 | | 36895 |
| HPV33 | L1 | YFSIKNPTNA | 49 | 10 | | 36896 |
| HPV33 | L1 | YFSIKNPTNAK | 49 | 11 | | 36897 |
| HPV33 | L1 | YGDSLFFF | 242 | 8 | | 36898 |
| HPV33 | L1 | YGDSLFFFLR | 242 | 10 | | 36899 |
| HPV33 | L1 | YGDSLFFFLRR | 242 | 11 | | 36900 |
| HPV33 | L1 | YIKGSGTTA | 276 | 9 | | 36901 |
| HPV33 | L1 | YIRHVEEY | 362 | 8 | | 36902 |
| HPV33 | L1 | YLKMTSEPY | 234 | 9 | | 36903 |
| HPV33 | L1 | YLPPVPVSK | 12 | 9 | | 36904 |
| HPV33 | L1 | YTFWEVDLK | 443 | 9 | | 36905 |
| HPV33 | L1 | YTFWEVDLKEK | 443 | 11 | | 36906 |
| HPV33 | L1 | YVSRTSIY | 27 | 8 | | 36907 |
| HPV33 | L1 | YVSRTSIYY | 27 | 9 | | 36908 |
| HPV33 | L1 | YVSRTSIYYY | 27 | 10 | | 36909 |
| HPV33 | L1 | YVSRTSIYYYA | 27 | 11 | | 36910 |
| HPV33 | L2 | AAIPLQPIR | 81 | 9 | | 36911 |
| HPV33 | L2 | ADDVDNVH | 367 | 8 | | 36912 |
| HPV33 | L2 | ADFVLHPSY | 438 | 9 | | 36913 |
| HPV33 | L2 | ADFVLHPSYF | 438 | 10 | | 36914 |
| HPV33 | L2 | AFLTSPHK | 241 | 8 | | 36915 |
| HPV33 | L2 | AIPLQPIR | 82 | 8 | | 36916 |
| HPV33 | L2 | AITSRRHTVR | 291 | 10 | | 36917 |
| HPV33 | L2 | AITSRRHTVRF | 291 | 11 | | 36918 |
| HPV33 | L2 | ALHRPAITSR | 286 | 10 | | 36919 |
| HPV33 | L2 | ALHRPAITSRR | 286 | 11 | | 36920 |
| HPV33 | L2 | ASATQLYQTCK | 12 | 11 | | 36921 |
| HPV33 | L2 | ATLKTRSGK | 308 | 9 | | 36922 |
| HPV33 | L2 | ATQLYQTCK | 14 | 9 | | 36923 |
| HPV33 | L2 | ATQLYQTCKA | 14 | 10 | | 36924 |
| HPV33 | L2 | DFLDIIALH | 280 | 9 | | 36925 |
| HPV33 | L2 | DFLDIIALHR | 280 | 10 | | 36926 |
| HPV33 | L2 | DFVLHPSY | 439 | 8 | | 36927 |
| HPV33 | L2 | DFVLHPSYF | 439 | 9 | | 36928 |
| HPV33 | L2 | DGADFVLH | 436 | 8 | | 36929 |
| HPV33 | L2 | DGADFVLHPSY | 436 | 11 | | 36930 |
| HPV33 | L2 | DGLYDVYA | 360 | 8 | | 36931 |
| HPV33 | L2 | DIIALHRPA | 283 | 9 | | 36932 |
| HPV33 | L2 | DISPAPDPDF | 272 | 10 | | 36933 |
| HPV33 | L2 | DLSPIVPLDH | 327 | 10 | | 36934 |
| HPV33 | L2 | DTIVVDGA | 431 | 8 | | 36935 |
| HPV33 | L2 | DTIVVDGADF | 431 | 10 | | 36936 |
| HPV33 | L2 | DVDNVHTPMQH | 369 | 11 | | 36937 |
| HPV33 | L2 | DVTTSADTTPA | 130 | 11 | | 36938 |
| HPV33 | L2 | DVYADDVDNVH | 364 | 11 | | 36939 |
| HPV33 | L2 | EASGHFIF | 176 | 8 | | 36940 |
| HPV33 | L2 | EDTLQFQH | 263 | 8 | | 36941 |
| HPV33 | L2 | EGSTIADQILK | 36 | 11 | | 36942 |
| HPV33 | L2 | ESFDPEDTLQF | 258 | 11 | | 36943 |
| HPV33 | L2 | ESSIQTISTH | 149 | 10 | | 36944 |
| HPV33 | L2 | ETSFIEAGA | 110 | 9 | | 36945 |
| HPV33 | L2 | ETSFIEAGAPA | 110 | 11 | | 36946 |
| HPV33 | L2 | FDPEDTLQF | 260 | 9 | | 36947 |
| HPV33 | L2 | FDPEDTLQFQH | 260 | 11 | | 36948 |
| HPV33 | L2 | FDTIVVDGA | 430 | 9 | | 36949 |
| HPV33 | L2 | FDTIVVDGADF | 430 | 11 | | 36950 |
| HPV33 | L2 | FFTDVRVA | 459 | 8 | | 36951 |
| HPV33 | L2 | FFTDVRVAA | 459 | 9 | | 36952 |
| HPV33 | L2 | FIEAGAPA | 113 | 8 | | 36953 |
| HPV33 | L2 | FILRRRRK | 447 | 8 | | 36954 |
| HPV33 | L2 | FILRRRRKR | 447 | 9 | | 36955 |
| HPV33 | L2 | FILRRRRKRF | 447 | 10 | | 36956 |
| HPV33 | L2 | FLDIIALH | 281 | 8 | | 36957 |
| HPV33 | L2 | FLDIIALHR | 281 | 9 | | 36958 |
| HPV33 | L2 | FLDIIALHRPA | 281 | 11 | | 36959 |
| HPV33 | L2 | FLTSPHKLITY | 242 | 11 | | 36960 |
| HPV33 | L2 | FSRVGQKA | 301 | 8 | | 36961 |
| HPV33 | L2 | FSRVGQKATLK | 301 | 11 | | 36962 |
| HPV33 | L2 | FSSPTVSTQSY | 183 | 11 | | 36963 |
| HPV33 | L2 | FTDVRVAA | 460 | 8 | | 36964 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | L2 | FTEPSVLH | 163 | 8 | | 36965 |
| HPV33 | L2 | FTEPSVLHPPA | 163 | 11 | | 36966 |
| HPV33 | L2 | FVLHPSYF | 440 | 8 | | 36967 |
| HPV33 | L2 | FVLHPSYFILR | 440 | 11 | | 36968 |
| HPV33 | L2 | FVPISPFF | 421 | 8 | | 36969 |
| HPV33 | L2 | FVPISPFFPF | 421 | 10 | | 36970 |
| HPV33 | L2 | GADFVLHPSY | 437 | 10 | | 36971 |
| HPV33 | L2 | GADFVLHPSYF | 437 | 11 | | 36972 |
| HPV33 | L2 | GFDVTTSA | 128 | 8 | | 36973 |
| HPV33 | L2 | GIGTGSGSGGR | 58 | 11 | | 36974 |
| HPV33 | L2 | GLYSRNTQQVK | 226 | 11 | | 36975 |
| HPV33 | L2 | GSGGRTGY | 64 | 8 | | 36976 |
| HPV33 | L2 | GSGSGGRTGY | 62 | 10 | | 36977 |
| HPV33 | L2 | GSRPVARLGLY | 218 | 11 | | 36978 |
| HPV33 | L2 | GSTIADQILK | 37 | 10 | | 36979 |
| HPV33 | L2 | GSTIADQILKY | 37 | 11 | | 36980 |
| HPV33 | L2 | GTCPPDVIPK | 25 | 10 | | 36981 |
| HPV33 | L2 | GTDPPTAA | 75 | 8 | | 36982 |
| HPV33 | L2 | GTGSGSGGR | 60 | 9 | | 36983 |
| HPV33 | L2 | HDTSTSSY | 349 | 8 | | 36984 |
| HPV33 | L2 | HSYSTFATTR | 379 | 10 | | 36985 |
| HPV33 | L2 | HTPMQHSY | 374 | 8 | | 36986 |
| HPV33 | L2 | HTPMQHSYSTF | 374 | 11 | | 36987 |
| HPV33 | L2 | HTVPNEQY | 336 | 8 | | 36988 |
| HPV33 | L2 | HTVRFSRVGQK | 297 | 11 | | 36989 |
| HPV33 | L2 | IADQILKY | 40 | 8 | | 36990 |
| HPV33 | L2 | IALHRPAITSR | 285 | 11 | | 36991 |
| HPV33 | L2 | IGARIHYY | 318 | 8 | | 36992 |
| HPV33 | L2 | IGTDPPTA | 74 | 8 | | 36993 |
| HPV33 | L2 | IGTDPPTAA | 74 | 9 | | 36994 |
| HPV33 | L2 | IGTGSGSGGR | 59 | 10 | | 36995 |
| HPV33 | L2 | IIALHRPA | 284 | 8 | | 36996 |
| HPV33 | L2 | ILKYGSLGVF | 44 | 10 | | 36997 |
| HPV33 | L2 | ILKYGSLGVFF | 44 | 11 | | 36998 |
| HPV33 | L2 | ILRRRRKR | 448 | 8 | | 36999 |
| HPV33 | L2 | ILRRRRKRF | 448 | 9 | | 37000 |
| HPV33 | L2 | ILRRRRKRFPY | 448 | 11 | | 37001 |
| HPV33 | L2 | ISPAPDPDF | 273 | 9 | | 37002 |
| HPV33 | L2 | ISTHLNPTF | 155 | 9 | | 37003 |
| HPV33 | L2 | ITSRRHTVR | 292 | 9 | | 37004 |
| HPV33 | L2 | ITSRRHTVRF | 292 | 10 | | 37005 |
| HPV33 | L2 | ITYDNPAF | 250 | 8 | | 37006 |
| HPV33 | L2 | ITYDNPAFESF | 250 | 11 | | 37007 |
| HPV33 | L2 | IVSLIEETSF | 104 | 10 | | 37008 |
| HPV33 | L2 | IVVDGADF | 433 | 8 | | 37009 |
| HPV33 | L2 | IVVDGADFVLH | 433 | 11 | | 37010 |
| HPV33 | L2 | KATLKTRSGK | 307 | 10 | | 37011 |
| HPV33 | L2 | KLITYDNPA | 248 | 9 | | 37012 |
| HPV33 | L2 | KLITYDNPAF | 248 | 10 | | 37013 |
| HPV33 | L2 | KTRSGKQIGA | 311 | 10 | | 37014 |
| HPV33 | L2 | KTRSGKQIGAR | 311 | 11 | | 37015 |
| HPV33 | L2 | KVEGSTIA | 34 | 8 | | 37016 |
| HPV33 | L2 | LDHTVPNEQY | 334 | 10 | | 37017 |
| HPV33 | L2 | LDIIALHR | 282 | 8 | | 37018 |
| HPV33 | L2 | LDIIALHRPA | 282 | 10 | | 37019 |
| HPV33 | L2 | LFPTSSPF | 414 | 8 | | 37020 |
| HPV33 | L2 | LIEETSFIEA | 107 | 10 | | 37021 |
| HPV33 | L2 | LITYDNPA | 249 | 8 | | 37022 |
| HPV33 | L2 | LITYDNPAF | 249 | 9 | | 37023 |
| HPV33 | L2 | LSPIVPLDH | 328 | 9 | | 37024 |
| HPV33 | L2 | LTSPHKLITY | 243 | 10 | | 37025 |
| HPV33 | L2 | MSGPDIPSPLF | 405 | 11 | | 37026 |
| HPV33 | L2 | NDGLYDVY | 359 | 8 | | 37027 |
| HPV33 | L2 | NDGLYDVYA | 359 | 9 | | 37028 |
| HPV33 | L2 | NTQQVKVVDPA | 231 | 11 | | 37029 |
| HPV33 | L2 | NVHTPMQH | 372 | 8 | | 37030 |
| HPV33 | L2 | NVHTPMQHSY | 372 | 10 | | 37031 |
| HPV33 | L2 | NVSIPLNTGF | 391 | 10 | | 37032 |
| HPV33 | L2 | PAEASGHF | 174 | 8 | | 37033 |
| HPV33 | L2 | PAEASGHFIF | 174 | 10 | | 37034 |
| HPV33 | L2 | PAFLTSPH | 240 | 8 | | 37035 |
| HPV33 | L2 | PAFLTSPHK | 240 | 9 | | 37036 |
| HPV33 | L2 | PAITSRRH | 290 | 8 | | 37037 |
| HPV33 | L2 | PAITSRRHTVR | 290 | 11 | | 37038 |
| HPV33 | L2 | PAPAEASGH | 172 | 9 | | 37039 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | L2 | PAPAEASGHF | 172 | 10 | | 37040 |
| HPV33 | L2 | PAPSIPTPSGF | 119 | 11 | | 37041 |
| HPV33 | L2 | PDFLDIIA | 279 | 8 | | 37042 |
| HPV33 | L2 | PDFLDIIALH | 279 | 10 | | 37043 |
| HPV33 | L2 | PDFLDIIALHR | 279 | 11 | | 37044 |
| HPV33 | L2 | PDIPSPLF | 408 | 8 | | 37045 |
| HPV33 | L2 | PDPDFLDIIA | 277 | 10 | | 37046 |
| HPV33 | L2 | PFDTIVVDGA | 429 | 10 | | 37047 |
| HPV33 | L2 | PFVPISPF | 420 | 8 | | 37048 |
| HPV33 | L2 | PFVPISPFF | 420 | 9 | | 37049 |
| HPV33 | L2 | PFVPISPFFPF | 420 | 11 | | 37050 |
| HPV33 | L2 | PGSRPVAR | 217 | 8 | | 37051 |
| HPV33 | L2 | PIGTDPPTA | 73 | 9 | | 37052 |
| HPV33 | L2 | PIGTDPPTAA | 73 | 10 | | 37053 |
| HPV33 | L2 | PIPGSRPVA | 215 | 9 | | 37054 |
| HPV33 | L2 | PIPGSRPVAR | 215 | 10 | | 37055 |
| HPV33 | L2 | PISPFFPF | 423 | 8 | | 37056 |
| HPV33 | L2 | PLDHTVPNEQY | 333 | 11 | | 37057 |
| HPV33 | L2 | PLFPTSSPF | 413 | 9 | | 37058 |
| HPV33 | L2 | PLHDTSTSSY | 347 | 10 | | 37059 |
| HPV33 | L2 | PMQHSYSTF | 376 | 9 | | 37060 |
| HPV33 | L2 | PMQHSYSTFA | 376 | 10 | | 37061 |
| HPV33 | L2 | PSGFDVTTSA | 126 | 10 | | 37062 |
| HPV33 | L2 | PSIPTPSGF | 121 | 9 | | 37063 |
| HPV33 | L2 | PSPLFPTSSPF | 411 | 11 | | 37064 |
| HPV33 | L2 | PSVLHPPA | 166 | 8 | | 37065 |
| HPV33 | L2 | PSVLHPPAPA | 166 | 10 | | 37066 |
| HPV33 | L2 | PSYFILRR | 444 | 8 | | 37067 |
| HPV33 | L2 | PSYFILRRR | 444 | 9 | | 37068 |
| HPV33 | L2 | PSYFILRRRR | 444 | 10 | | 37069 |
| HPV33 | L2 | PSYFILRRRRK | 444 | 11 | | 37070 |
| HPV33 | L2 | PTAAIPLQPIR | 79 | 11 | | 37071 |
| HPV33 | L2 | PTFTEPSVLH | 161 | 10 | | 37072 |
| HPV33 | L2 | PTVSTQSY | 186 | 8 | | 37073 |
| HPV33 | L2 | PVARLGLY | 221 | 8 | | 37074 |
| HPV33 | L2 | PVARLGLYSR | 221 | 10 | | 37075 |
| HPV33 | L2 | QDLSPIVPLDH | 326 | 11 | | 37076 |
| HPV33 | L2 | QFQHSDISPA | 267 | 10 | | 37077 |
| HPV33 | L2 | QIGARIHY | 317 | 8 | | 37078 |
| HPV33 | L2 | QIGARIHYY | 317 | 9 | | 37079 |
| HPV33 | L2 | QILKYGSLGVF | 43 | 11 | | 37080 |
| HPV33 | L2 | QLYQTCKA | 16 | 8 | | 37081 |
| HPV33 | L2 | QSYENIPMDTF | 191 | 11 | | 37082 |
| HPV33 | L2 | QTISTHLNPTF | 153 | 11 | | 37083 |
| HPV33 | L2 | QVKVVDPA | 234 | 8 | | 37084 |
| HPV33 | L2 | QVKVVDPAF | 234 | 9 | | 37085 |
| HPV33 | L2 | RASATQLY | 11 | 8 | | 37086 |
| HPV33 | L2 | RFPYFFTDVR | 455 | 10 | | 37087 |
| HPV33 | L2 | RFSRVGQK | 300 | 8 | | 37088 |
| HPV33 | L2 | RFSRVGQKA | 300 | 9 | | 37089 |
| HPV33 | L2 | RSGKQIGA | 313 | 8 | | 37090 |
| HPV33 | L2 | RSGKQIGAR | 313 | 9 | | 37091 |
| HPV33 | L2 | RSGKQIGARIH | 313 | 11 | | 37092 |
| HPV33 | L2 | RSTRRKRA | 5 | 8 | | 37093 |
| HPV33 | L2 | RSTRRKRASA | 5 | 10 | | 37094 |
| HPV33 | L2 | RVGQKATLK | 303 | 9 | | 37095 |
| HPV33 | L2 | RVGQKATLKTR | 303 | 11 | | 37096 |
| HPV33 | L2 | SATQLYQTCK | 13 | 10 | | 37097 |
| HPV33 | L2 | SATQLYQTCKA | 13 | 11 | | 37098 |
| HPV33 | L2 | SDISPAPDPDF | 271 | 11 | | 37099 |
| HPV33 | L2 | SFDPEDTLQF | 259 | 10 | | 37100 |
| HPV33 | L2 | SFIEAGAPA | 112 | 9 | | 37101 |
| HPV33 | L2 | SGFDVTTSA | 127 | 9 | | 37102 |
| HPV33 | L2 | SGKQIGAR | 314 | 8 | | 37103 |
| HPV33 | L2 | SGKQIGARIH | 314 | 10 | | 37104 |
| HPV33 | L2 | SGKQIGARIHY | 314 | 11 | | 37105 |
| HPV33 | L2 | SGPDIPSPLF | 406 | 10 | | 37106 |
| HPV33 | L2 | SGSGGRTGY | 63 | 9 | | 37107 |
| HPV33 | L2 | SINDGLYDVY | 357 | 10 | | 37108 |
| HPV33 | L2 | SINDGLYDVYA | 357 | 11 | | 37109 |
| HPV33 | L2 | SIPLNTGF | 393 | 8 | | 37110 |
| HPV33 | L2 | SIPTPSGF | 122 | 8 | | 37111 |
| HPV33 | L2 | SIQTISTH | 151 | 8 | | 37112 |
| HPV33 | L2 | SIVSLIEETSF | 103 | 11 | | 37113 |
| HPV33 | L2 | SLIEETSF | 106 | 8 | | 37114 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV33 | L2 | SLIEETSFIEA | 106 | 11 | | 37115 |
| HPV33 | L2 | SSIQTISTH | 150 | 9 | | 37116 |
| HPV33 | L2 | SSPFVPISPF | 418 | 10 | | 37117 |
| HPV33 | L2 | SSPFVPISPFF | 418 | 11 | | 37118 |
| HPV33 | L2 | SSPTVSTQSY | 184 | 10 | | 37119 |
| HPV33 | L2 | SSTPIPGSR | 212 | 9 | | 37120 |
| HPV33 | L2 | SSYSINDGLY | 354 | 10 | | 37121 |
| HPV33 | L2 | STHLNPTF | 156 | 8 | | 37122 |
| HPV33 | L2 | STIADQILK | 38 | 9 | | 37123 |
| HPV33 | L2 | STIADQILKY | 38 | 10 | | 37124 |
| HPV33 | L2 | STPIPGSR | 213 | 8 | | 37125 |
| HPV33 | L2 | STPIPGSRPVA | 213 | 11 | | 37126 |
| HPV33 | L2 | STRRKRASA | 6 | 9 | | 37127 |
| HPV33 | L2 | SVLHPPAPA | 167 | 9 | | 37128 |
| HPV33 | L2 | SVLHPPAPAEA | 167 | 11 | | 37129 |
| HPV33 | L2 | TAAIPLQPIR | 80 | 10 | | 37130 |
| HPV33 | L2 | TCPPDVIPK | 26 | 9 | | 37131 |
| HPV33 | L2 | TFTEPSVLH | 162 | 9 | | 37132 |
| HPV33 | L2 | TGSGSGGR | 61 | 8 | | 37133 |
| HPV33 | L2 | TGSGSGGRTGY | 61 | 11 | | 37134 |
| HPV33 | L2 | TGTCPPDVIPK | 24 | 11 | | 37135 |
| HPV33 | L2 | TIADQILK | 39 | 8 | | 37136 |
| HPV33 | L2 | TIADQILKY | 39 | 9 | | 37137 |
| HPV33 | L2 | TISTHLNPTF | 154 | 10 | | 37138 |
| HPV33 | L2 | TIVVDGADF | 432 | 9 | | 37139 |
| HPV33 | L2 | TLKTRSGK | 309 | 8 | | 37140 |
| HPV33 | L2 | TSADTTPA | 133 | 8 | | 37141 |
| HPV33 | L2 | TSFIEAGA | 111 | 8 | | 37142 |
| HPV33 | L2 | TSFIEAGAPA | 111 | 10 | | 37143 |
| HPV33 | L2 | TSPHKLITY | 244 | 9 | | 37144 |
| HPV33 | L2 | TSRRHTVR | 293 | 8 | | 37145 |
| HPV33 | L2 | TSRRHTVRF | 293 | 9 | | 37146 |
| HPV33 | L2 | TSRRHTVRFSR | 293 | 11 | | 37147 |
| HPV33 | L2 | TSSPFVPISPF | 417 | 11 | | 37148 |
| HPV33 | L2 | TSSTPIPGSR | 211 | 10 | | 37149 |
| HPV33 | L2 | TSSYSINDGLY | 353 | 11 | | 37150 |
| HPV33 | L2 | TTSADTTPA | 132 | 9 | | 37151 |
| HPV33 | L2 | TVRFSRVGQK | 298 | 10 | | 37152 |
| HPV33 | L2 | TVRFSRVGQKA | 298 | 11 | | 37153 |
| HPV33 | L2 | VARLGLYSR | 222 | 9 | | 37154 |
| HPV33 | L2 | VDGADFVLH | 435 | 9 | | 37155 |
| HPV33 | L2 | VDNVHTPMQH | 370 | 10 | | 37156 |
| HPV33 | L2 | VDPAFLTSPH | 238 | 10 | | 37157 |
| HPV33 | L2 | VDPAFLTSPHK | 238 | 11 | | 37158 |
| HPV33 | L2 | VGQKATLK | 304 | 8 | | 37159 |
| HPV33 | L2 | VGQKATLKTR | 304 | 10 | | 37160 |
| HPV33 | L2 | VIPKVEGSTIA | 31 | 11 | | 37161 |
| HPV33 | L2 | VLHPPAPA | 168 | 8 | | 37162 |
| HPV33 | L2 | VLHPPAPAEA | 168 | 10 | | 37163 |
| HPV33 | L2 | VLHPSYFILR | 441 | 10 | | 37164 |
| HPV33 | L2 | VLHPSYFILRR | 441 | 11 | | 37165 |
| HPV33 | L2 | VSIPLNTGF | 392 | 9 | | 37166 |
| HPV33 | L2 | VSLIEETSF | 105 | 9 | | 37167 |
| HPV33 | L2 | VTSSTPIPGSR | 210 | 11 | | 37168 |
| HPV33 | L2 | VTTSADTTPA | 131 | 10 | | 37169 |
| HPV33 | L2 | VVDGADFVLH | 434 | 10 | | 37170 |
| HPV33 | L2 | VVDPAFLTSPH | 237 | 11 | | 37171 |
| HPV33 | L2 | YADDVDNVH | 366 | 9 | | 37172 |
| HPV33 | L2 | YDNPAFESF | 252 | 9 | | 37173 |
| HPV33 | L2 | YFFTDVRVA | 458 | 9 | | 37174 |
| HPV33 | L2 | YFFTDVRVAA | 458 | 10 | | 37175 |
| HPV33 | L2 | YFILRRRR | 446 | 8 | | 37176 |
| HPV33 | L2 | YFILRRRRK | 446 | 9 | | 37177 |
| HPV33 | L2 | YFILRRRRKR | 446 | 10 | | 37178 |
| HPV33 | L2 | YFILRRRRKRF | 446 | 11 | | 37179 |
| HPV33 | L2 | YGSLGVFF | 47 | 8 | | 37180 |
| HPV33 | L2 | YSINDGLY | 356 | 8 | | 37181 |
| HPV33 | L2 | YSINDGLYDVY | 356 | 11 | | 37182 |
| HPV33 | L2 | YSRNTQQVK | 228 | 9 | | 37183 |
| HPV33 | L2 | YSTFATTR | 381 | 8 | | 37184 |
| HPV33 | L2 | YVPIGTDPPTA | 71 | 11 | | 37185 |
| HPV45 | E1 | AAAFLKSNCQA | 382 | 11 | | 37186 |
| HPV45 | E1 | AAFLKSNCQA | 383 | 10 | | 37187 |
| HPV45 | E1 | AAFLKSNCQAK | 383 | 11 | | 37188 |
| HPV45 | E1 | AAMLAVFK | 198 | 8 | | 37189 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E1 | AAMLAVFKDIY | 198 | 11 | | 37190 |
| HPV45 | E1 | ADCNSNAA | 376 | 8 | | 37191 |
| HPV45 | E1 | ADCNSNAAA | 376 | 9 | | 37192 |
| HPV45 | E1 | ADCNSNAAAF | 376 | 10 | | 37193 |
| HPV45 | E1 | ADTEGIPF | 622 | 8 | | 37194 |
| HPV45 | E1 | ADTEGIPFGTF | 622 | 11 | | 37195 |
| HPV45 | E1 | ADTKVAMLDDA | 507 | 11 | | 37196 |
| HPV45 | E1 | AFLKSNCQA | 384 | 9 | | 37197 |
| HPV45 | E1 | AFLKSNCQAK | 384 | 10 | | 37198 |
| HPV45 | E1 | AFLKSNCQAKY | 384 | 11 | | 37199 |
| HPV45 | E1 | AFQYAQLA | 369 | 8 | | 37200 |
| HPV45 | E1 | AIFGVNPTVA | 232 | 10 | | 37201 |
| HPV45 | E1 | AIISFVNSNSH | 490 | 11 | | 37202 |
| HPV45 | E1 | ALDGNPISIDR | 532 | 11 | | 37203 |
| HPV45 | E1 | ALKEFLKGTPK | 452 | 11 | | 37204 |
| HPV45 | E1 | ALLRYKCGK | 270 | 9 | 0.0900 | 37205 |
| HPV45 | E1 | ALLRYKCGKNR | 270 | 11 | | 37206 |
| HPV45 | E1 | AMLAVFKDIY | 199 | 10 | | 37207 |
| HPV45 | E1 | AMLDDATH | 512 | 8 | | 37208 |
| HPV45 | E1 | ASNKKAAMLA | 193 | 10 | | 37209 |
| HPV45 | E1 | ATDTGSDMVDF | 40 | 11 | | 37210 |
| HPV45 | E1 | ATHTCWTY | 517 | 8 | | 37211 |
| HPV45 | E1 | ATHTCWTYF | 517 | 9 | | 37212 |
| HPV45 | E1 | AVFKDIYGLSF | 202 | 11 | | 37213 |
| HPV45 | E1 | AVMCRHYK | 399 | 8 | | 37214 |
| HPV45 | E1 | AVMCRHYKR | 399 | 9 | | 37215 |
| HPV45 | E1 | AVMCRHYKRA | 399 | 10 | | 37216 |
| HPV45 | E1 | CAVMCRHY | 398 | 8 | | 37217 |
| HPV45 | E1 | CAVMCRHYK | 398 | 9 | | 37218 |
| HPV45 | E1 | CAVMCRHYKR | 398 | 10 | | 37219 |
| HPV45 | E1 | CAVMCRHYKRA | 398 | 11 | | 37220 |
| HPV45 | E1 | CFFERTWSR | 604 | 9 | | 37221 |
| HPV45 | E1 | CGKNRLTVA | 276 | 9 | | 37222 |
| HPV45 | E1 | CGKNRLTVAK | 276 | 10 | | 37223 |
| HPV45 | E1 | CILLYGPA | 465 | 8 | | 37224 |
| HPV45 | E1 | CMLIEPPK | 297 | 8 | | 37225 |
| HPV45 | E1 | CMLIEPPKLR | 297 | 10 | | 37226 |
| HPV45 | E1 | CSKIDEGGDWR | 423 | 11 | | 37227 |
| HPV45 | E1 | CTDWVMAIF | 226 | 9 | | 37228 |
| HPV45 | E1 | CVTGQNTR | 634 | 8 | | 37229 |
| HPV45 | E1 | DADTEGIPF | 621 | 9 | | 37230 |
| HPV45 | E1 | DAQVLHLLK | 78 | 9 | | 37231 |
| HPV45 | E1 | DAQVLHLLKR | 78 | 10 | | 37232 |
| HPV45 | E1 | DAQVLHLLKRK | 78 | 11 | | 37233 |
| HPV45 | E1 | DATHTCWTY | 516 | 9 | | 37234 |
| HPV45 | E1 | DATHTCWTYF | 516 | 10 | | 37235 |
| HPV45 | E1 | DCAVMCRH | 397 | 8 | | 37236 |
| HPV45 | E1 | DCAVMCRHY | 397 | 9 | | 37237 |
| HPV45 | E1 | DCAVMCRHYK | 397 | 10 | | 37238 |
| HPV45 | E1 | DCAVMCRHYKR | 397 | 11 | | 37239 |
| HPV45 | E1 | DCKWGVLILA | 261 | 10 | | 37240 |
| HPV45 | E1 | DCNSNAAA | 377 | 8 | | 37241 |
| HPV45 | E1 | DCNSNAAAF | 377 | 9 | | 37242 |
| HPV45 | E1 | DCNSNAAAFLK | 377 | 11 | | 37243 |
| HPV45 | E1 | DDATHTCWTY | 515 | 10 | | 37244 |
| HPV45 | E1 | DDATHTCWTYF | 515 | 11 | | 37245 |
| HPV45 | E1 | DGEGTGCNGWF | 8 | 11 | | 37246 |
| HPV45 | E1 | DGNPISIDR | 534 | 9 | | 37247 |
| HPV45 | E1 | DGNPISIDRK | 534 | 10 | | 37248 |
| HPV45 | E1 | DGNPISIDRKH | 534 | 11 | | 37249 |
| HPV45 | E1 | DLHEDDEDA | 614 | 9 | | 37250 |
| HPV45 | E1 | DLSDMVQWA | 349 | 9 | | 37251 |
| HPV45 | E1 | DLSDMVQWAF | 349 | 10 | | 37252 |
| HPV45 | E1 | DLTDESDMA | 361 | 9 | | 37253 |
| HPV45 | E1 | DLTDESDMAF | 361 | 10 | | 37254 |
| HPV45 | E1 | DLVRNFKSDK | 214 | 10 | | 37255 |
| HPV45 | E1 | DMAFQYAQLA | 367 | 10 | | 37256 |
| HPV45 | E1 | DSGYGCSEVEA | 134 | 11 | | 37257 |
| HPV45 | E1 | DTEGIPFGTF | 623 | 10 | | 37258 |
| HPV45 | E1 | DTEGIPFGTFK | 623 | 11 | | 37259 |
| HPV45 | E1 | DTGSDMVDF | 42 | 9 | | 37260 |
| HPV45 | E1 | DTKVAMLDDA | 508 | 10 | | 37261 |
| HPV45 | E1 | DTPEWIQR | 328 | 8 | | 37262 |
| HPV45 | E1 | DTQLSICEQA | 52 | 10 | | 37263 |
| HPV45 | E1 | DVISDDEDETA | 30 | 11 | | 37264 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E1 | EDADTEGIPF | 620 | 10 | | 37265 |
| HPV45 | E1 | EFISFLRA | 445 | 8 | | 37266 |
| HPV45 | E1 | EFISFLRALK | 445 | 10 | | 37267 |
| HPV45 | E1 | EFLKGTPK | 455 | 8 | | 37268 |
| HPV45 | E1 | EFLKGTPKK | 455 | 9 | | 37269 |
| HPV45 | E1 | EGFKTLIK | 242 | 8 | | 37270 |
| HPV45 | E1 | EGFKTLIKPA | 242 | 10 | | 37271 |
| HPV45 | E1 | EGGDWRPIVQF | 428 | 11 | | 37272 |
| HPV45 | E1 | EGIPFGTF | 625 | 8 | | 37273 |
| HPV45 | E1 | EGIPFGTFK | 625 | 9 | | 37274 |
| HPV45 | E1 | EGTGCNGWF | 10 | 9 | 0.0008 | 37275 |
| HPV45 | E1 | EGTGCNGWFF | 10 | 10 | | 37276 |
| HPV45 | E1 | EINDKNWK | 596 | 8 | | 37277 |
| HPV45 | E1 | EINDKNWKCF | 596 | 10 | | 37278 |
| HPV45 | E1 | EINDKNWKCFF | 596 | 11 | | 37279 |
| HPV45 | E1 | EISLNSGH | 115 | 8 | | 37280 |
| HPV45 | E1 | EISLNSGHK | 115 | 9 | | 37281 |
| HPV45 | E1 | EISLNSGHKK | 115 | 10 | | 37282 |
| HPV45 | E1 | EISLNSGHKKA | 115 | 11 | | 37283 |
| HPV45 | E1 | ELKELLQA | 186 | 8 | | 37284 |
| HPV45 | E1 | ELKELLQASNK | 186 | 11 | | 37285 |
| HPV45 | E1 | ELLQASNK | 189 | 8 | | 37286 |
| HPV45 | E1 | ELLQASNKK | 189 | 9 | | 37287 |
| HPV45 | E1 | ELLQASNKKA | 189 | 10 | | 37288 |
| HPV45 | E1 | ELLQASNKKAA | 189 | 11 | | 37289 |
| HPV45 | E1 | ESDMAFQY | 365 | 8 | | 37290 |
| HPV45 | E1 | ESDMAFQYA | 365 | 9 | | 37291 |
| HPV45 | E1 | ESRVTVFTF | 573 | 9 | | 37292 |
| HPV45 | E1 | ESRVTVFTFPH | 573 | 11 | | 37293 |
| HPV45 | E1 | ETAQALFH | 64 | 8 | | 37294 |
| HPV45 | E1 | ETAQALFHA | 64 | 9 | | 37295 |
| HPV45 | E1 | ETCMLIEPPK | 295 | 10 | | 37296 |
| HPV45 | E1 | ETQVTVNTNA | 146 | 10 | | 37297 |
| HPV45 | E1 | EVQNDAQVLH | 74 | 10 | | 37298 |
| HPV45 | E1 | FDKNGNPVY | 587 | 9 | | 37299 |
| HPV45 | E1 | FDLSDMVQWA | 348 | 10 | | 37300 |
| HPV45 | E1 | FDLSDMVQWAF | 348 | 11 | | 37301 |
| HPV45 | E1 | FDNYMRNA | 525 | 8 | | 37302 |
| HPV45 | E1 | FFERTWSR | 605 | 8 | | 37303 |
| HPV45 | E1 | FFVETIVEK | 18 | 9 | | 37304 |
| HPV45 | E1 | FFVETIVEKK | 18 | 10 | | 37305 |
| HPV45 | E1 | FGMSFIHF | 479 | 8 | | 37306 |
| HPV45 | E1 | FGVNPTVA | 234 | 8 | | 37307 |
| HPV45 | E1 | FGVNPTVAEGF | 234 | 11 | | 37308 |
| HPV45 | E1 | FIHFLQGA | 483 | 8 | | 37309 |
| HPV45 | E1 | FISFLRALK | 446 | 9 | | 37310 |
| HPV45 | E1 | FISFLRALKEF | 446 | 11 | | 37311 |
| HPV45 | E1 | FLKGTPKK | 456 | 8 | | 37312 |
| HPV45 | E1 | FLKSNCQA | 385 | 8 | | 37313 |
| HPV45 | E1 | FLKSNCQAK | 385 | 9 | 0.0035 | 37314 |
| HPV45 | E1 | FLKSNCQAKY | 385 | 10 | | 37315 |
| HPV45 | E1 | FLQGAIISF | 486 | 9 | | 37316 |
| HPV45 | E1 | FLRALKEF | 449 | 8 | | 37317 |
| HPV45 | E1 | FLRALKEFLK | 449 | 10 | | 37318 |
| HPV45 | E1 | FLRYQGVEF | 438 | 9 | | 37319 |
| HPV45 | E1 | FTDLVRNF | 212 | 8 | | 37320 |
| HPV45 | E1 | FTDLVRNFK | 212 | 9 | | 37321 |
| HPV45 | E1 | FTFPHAFPF | 579 | 9 | | 37322 |
| HPV45 | E1 | FTFPHAFPFDK | 579 | 11 | | 37323 |
| HPV45 | E1 | FTISDSGY | 130 | 8 | | 37324 |
| HPV45 | E1 | FVETIVEK | 19 | 8 | | 37325 |
| HPV45 | E1 | FVETIVEKK | 19 | 9 | | 37326 |
| HPV45 | E1 | FVNSNSHF | 494 | 8 | | 37327 |
| HPV45 | E1 | GCSEVEAA | 138 | 8 | | 37328 |
| HPV45 | E1 | GDTPEWIQR | 327 | 9 | 0.0008 | 37329 |
| HPV45 | E1 | GDWRPIVQF | 430 | 9 | | 37330 |
| HPV45 | E1 | GDWRPIVQFLR | 430 | 11 | | 37331 |
| HPV45 | E1 | GFKTLIKPA | 243 | 9 | | 37332 |
| HPV45 | E1 | GGDSSDNA | 168 | 8 | | 37333 |
| HPV45 | E1 | GGDWRPIVQF | 429 | 10 | | 37334 |
| HPV45 | E1 | GIPFGTFK | 626 | 8 | | 37335 |
| HPV45 | E1 | GLSFTDLVR | 209 | 9 | 0.0009 | 37336 |
| HPV45 | E1 | GLSFTDLVRNF | 209 | 11 | | 37337 |
| HPV45 | E1 | GMSFIHFLQGA | 480 | 11 | | 37338 |
| HPV45 | E1 | GTGCNGWF | 11 | 8 | | 37339 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E1 | GTGCNGWFF | 11 | 9 | | 37340 |
| HPV45 | E1 | GTPKKNCILLY | 459 | 11 | | 37341 |
| HPV45 | E1 | GVEFISFLR | 443 | 9 | | 37342 |
| HPV45 | E1 | GVEFISFLRA | 443 | 10 | | 37343 |
| HPV45 | E1 | GVLILALLR | 265 | 9 | 0.0058 | 37344 |
| HPV45 | E1 | GVLILALLRY | 265 | 10 | | 37345 |
| HPV45 | E1 | GVLILALLRYK | 265 | 11 | | 37346 |
| HPV45 | E1 | GVNPTVAEGF | 235 | 10 | | 37347 |
| HPV45 | E1 | GVNPTVAEGFK | 235 | 11 | | 37348 |
| HPV45 | E1 | HAQEVQNDA | 71 | 9 | | 37349 |
| HPV45 | E1 | HCSITELK | 181 | 8 | | 37350 |
| HPV45 | E1 | HFLQGAIISF | 485 | 10 | | 37351 |
| HPV45 | E1 | HFWLEPLA | 500 | 8 | | 37352 |
| HPV45 | E1 | HFWLEPLADTK | 500 | 11 | | 37353 |
| HPV45 | E1 | HGIDDSNF | 341 | 8 | | 37354 |
| HPV45 | E1 | HIQCLDCK | 256 | 8 | | 37355 |
| HPV45 | E1 | HLLKRKFA | 83 | 8 | | 37356 |
| HPV45 | E1 | HTCWTYFDNY | 519 | 10 | | 37357 |
| HPV45 | E1 | ICEQAEQETA | 57 | 10 | | 37358 |
| HPV45 | E1 | IDEGGDWR | 426 | 8 | | 37359 |
| HPV45 | E1 | IDPAKDNK | 561 | 8 | | 37360 |
| HPV45 | E1 | IDPAKDNKWPY | 561 | 11 | | 37361 |
| HPV45 | E1 | IDTQLSICEQA | 51 | 11 | | 37362 |
| HPV45 | E1 | IFGVNPTVA | 233 | 9 | | 37363 |
| HPV45 | E1 | IIQHGIDDSNF | 338 | 11 | | 37364 |
| HPV45 | E1 | IISFVNSNSH | 491 | 10 | | 37365 |
| HPV45 | E1 | IISFVNSNSHF | 491 | 11 | | 37366 |
| HPV45 | E1 | ILALLRYK | 268 | 8 | | 37367 |
| HPV45 | E1 | ILALLRYKCGK | 268 | 11 | | 37368 |
| HPV45 | E1 | ILLTSNIDPA | 555 | 10 | | 37369 |
| HPV45 | E1 | ILLTSNIDPAK | 555 | 11 | | 37370 |
| HPV45 | E1 | ILLYGPANTGK | 466 | 11 | | 37371 |
| HPV45 | E1 | ISDDEDETA | 32 | 9 | | 37372 |
| HPV45 | E1 | ISFLRALK | 447 | 8 | | 37373 |
| HPV45 | E1 | ISFLRALKEF | 447 | 10 | | 37374 |
| HPV45 | E1 | ISFVNSNSH | 492 | 9 | | 37375 |
| HPV45 | E1 | ISFVNSNSHF | 492 | 10 | | 37376 |
| HPV45 | E1 | ISIDRKHK | 538 | 8 | | 37377 |
| HPV45 | E1 | ISLNSGHK | 116 | 8 | | 37378 |
| HPV45 | E1 | ISLNSGHKK | 116 | 9 | | 37379 |
| HPV45 | E1 | ISLNSGHKKA | 116 | 10 | | 37380 |
| HPV45 | E1 | ISLNSGHKKAK | 116 | 11 | | 37381 |
| HPV45 | E1 | ITELKELLQA | 184 | 10 | | 37382 |
| HPV45 | E1 | KAAMLAVF | 197 | 8 | | 37383 |
| HPV45 | E1 | KAAMLAVFK | 197 | 9 | | 37384 |
| HPV45 | E1 | KCFFERTWSR | 603 | 10 | | 37385 |
| HPV45 | E1 | KCGKNRLTVA | 275 | 10 | | 37386 |
| HPV45 | E1 | KCGKNRLTVAK | 275 | 11 | | 37387 |
| HPV45 | E1 | KCVTGQNTR | 633 | 9 | | 37388 |
| HPV45 | E1 | KDCAVMCR | 396 | 8 | | 37389 |
| HPV45 | E1 | KDCAVMCRH | 396 | 9 | | 37390 |
| HPV45 | E1 | KDCAVMCRHY | 396 | 10 | | 37391 |
| HPV45 | E1 | KDCAVMCRHYK | 396 | 11 | | 37392 |
| HPV45 | E1 | KDIYGLSF | 205 | 8 | | 37393 |
| HPV45 | E1 | KDNKWPYLESR | 565 | 11 | | 37394 |
| HPV45 | E1 | KGLSTLLH | 285 | 8 | | 37395 |
| HPV45 | E1 | KIDEGGDWR | 425 | 9 | | 37396 |
| HPV45 | E1 | KLRSSVAA | 304 | 8 | | 37397 |
| HPV45 | E1 | KLRSSVAALY | 304 | 10 | | 37398 |
| HPV45 | E1 | KSNCQAKY | 387 | 8 | | 37399 |
| HPV45 | E1 | KSNCQAKYLK | 387 | 10 | | 37400 |
| HPV45 | E1 | KSYFGMSF | 476 | 8 | | 37401 |
| HPV45 | E1 | KSYFGMSFIH | 476 | 10 | | 37402 |
| HPV45 | E1 | KSYFGMSFIHF | 476 | 11 | | 37403 |
| HPV45 | E1 | KTLIKPATLY | 245 | 10 | | 37404 |
| HPV45 | E1 | KTLIKPATLYA | 245 | 11 | | 37405 |
| HPV45 | E1 | KTTCTDWVMA | 223 | 10 | | 37406 |
| HPV45 | E1 | KVAMLDDA | 510 | 8 | | 37407 |
| HPV45 | E1 | KVAMLDDATH | 510 | 10 | | 37408 |
| HPV45 | E1 | LADCNSNA | 375 | 8 | | 37409 |
| HPV45 | E1 | LADCNSNAA | 375 | 9 | | 37410 |
| HPV45 | E1 | LADCNSNAAA | 375 | 10 | | 37411 |
| HPV45 | E1 | LADCNSNAAAF | 375 | 11 | | 37412 |
| HPV45 | E1 | LALLRYKCGK | 269 | 10 | | 37413 |
| HPV45 | E1 | LAVFKDIY | 201 | 8 | | 37414 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E1 | LDCKWGVLILA | 260 | 11 | | 37415 |
| HPV45 | E1 | LDDATHTCWTY | 514 | 11 | | 37416 |
| HPV45 | E1 | LDGNPISIDR | 533 | 10 | | 37417 |
| HPV45 | E1 | LDGNPISIDRK | 533 | 11 | | 37418 |
| HPV45 | E1 | LDLHEDDEDA | 613 | 10 | | 37419 |
| HPV45 | E1 | LFHAQEVQNDA | 69 | 11 | | 37420 |
| HPV45 | E1 | LFTISDSGY | 129 | 9 | | 37421 |
| HPV45 | E1 | LIEPPKLR | 299 | 8 | | 37422 |
| HPV45 | E1 | LIKPATLY | 247 | 8 | | 37423 |
| HPV45 | E1 | LIKPATLYA | 247 | 9 | | 37424 |
| HPV45 | E1 | LIKPATLYAH | 247 | 10 | | 37425 |
| HPV45 | E1 | LILALLRY | 267 | 8 | | 37426 |
| HPV45 | E1 | LILALLRYK | 267 | 9 | 0.2700 | 37427 |
| HPV45 | E1 | LLKRKFAGGSK | 84 | 11 | | 37428 |
| HPV45 | E1 | LLQASNKK | 190 | 8 | | 37429 |
| HPV45 | E1 | LLQASNKKA | 190 | 9 | | 37430 |
| HPV45 | E1 | LLQASNKKAA | 190 | 10 | | 37431 |
| HPV45 | E1 | LLRYKCGK | 271 | 8 | | 37432 |
| HPV45 | E1 | LLRYKCGKNR | 271 | 10 | | 37433 |
| HPV45 | E1 | LLTSNIDPA | 556 | 9 | | 37434 |
| HPV45 | E1 | LLTSNIDPAK | 556 | 10 | | 37435 |
| HPV45 | E1 | LLYGPANTGK | 467 | 10 | | 37436 |
| HPV45 | E1 | LSDMVQWA | 350 | 8 | | 37437 |
| HPV45 | E1 | LSDMVQWAF | 350 | 9 | | 37438 |
| HPV45 | E1 | LSFTDLVR | 210 | 8 | | 37439 |
| HPV45 | E1 | LSFTDLVRNF | 210 | 10 | | 37440 |
| HPV45 | E1 | LSFTDLVRNFK | 210 | 11 | | 37441 |
| HPV45 | E1 | LSVDTDLSPR | 103 | 10 | | 37442 |
| HPV45 | E1 | LTDESDMA | 362 | 8 | | 37443 |
| HPV45 | E1 | LTDESDMAF | 362 | 9 | | 37444 |
| HPV45 | E1 | LTDESDMAFQY | 362 | 11 | | 37445 |
| HPV45 | E1 | LTSNIDPA | 557 | 8 | | 37446 |
| HPV45 | E1 | LTSNIDPAK | 557 | 9 | | 37447 |
| HPV45 | E1 | LVRNFKSDK | 215 | 9 | 0.0005 | 37448 |
| HPV45 | E1 | MAFQYAQLA | 368 | 9 | | 37449 |
| HPV45 | E1 | MAIFGVNPTVA | 231 | 11 | | 37450 |
| HPV45 | E1 | MCRHYKRA | 401 | 8 | | 37451 |
| HPV45 | E1 | MCRHYKRAQK | 401 | 10 | | 37452 |
| HPV45 | E1 | MCRHYKRAQKR | 401 | 11 | | 37453 |
| HPV45 | E1 | MLAVFKDIY | 200 | 9 | | 37454 |
| HPV45 | E1 | MLIEPPKLR | 298 | 9 | | 37455 |
| HPV45 | E1 | MSFIHFLQGA | 481 | 10 | | 37456 |
| HPV45 | E1 | MSQWIKYR | 415 | 8 | | 37457 |
| HPV45 | E1 | MSQWIKYRCSK | 415 | 11 | | 37458 |
| HPV45 | E1 | NAENGGSVH | 154 | 9 | | 37459 |
| HPV45 | E1 | NAENVDPH | 174 | 8 | | 37460 |
| HPV45 | E1 | NCILLYGPA | 464 | 9 | | 37461 |
| HPV45 | E1 | NCQAKYLK | 389 | 8 | | 37462 |
| HPV45 | E1 | NCQAKYLKDCA | 389 | 11 | | 37463 |
| HPV45 | E1 | NDAQVLHLLK | 77 | 10 | | 37464 |
| HPV45 | E1 | NDAQVLHLLKR | 77 | 11 | | 37465 |
| HPV45 | E1 | NDKNWKCF | 598 | 8 | | 37466 |
| HPV45 | E1 | NDKNWKCFF | 598 | 9 | | 37467 |
| HPV45 | E1 | NDKNWKCFFER | 598 | 11 | | 37468 |
| HPV45 | E1 | NDLTDESDMA | 360 | 10 | | 37469 |
| HPV45 | E1 | NDLTDESDMAF | 360 | 11 | | 37470 |
| HPV45 | E1 | NFDLSDMVQWA | 347 | 11 | | 37471 |
| HPV45 | E1 | NGNPVYEINDK | 590 | 11 | | 37472 |
| HPV45 | E1 | NIDPAKDNK | 560 | 9 | | 37473 |
| HPV45 | E1 | NMSQWIKY | 414 | 8 | | 37474 |
| HPV45 | E1 | NMSQWIKYR | 414 | 9 | | 37475 |
| HPV45 | E1 | NSGHKKAK | 119 | 8 | | 37476 |
| HPV45 | E1 | NSGHKKAKR | 119 | 9 | | 37477 |
| HPV45 | E1 | NSGHKKAKRR | 119 | 10 | | 37478 |
| HPV45 | E1 | NSHFWLEPLA | 498 | 10 | | 37479 |
| HPV45 | E1 | NSNAAAFLK | 379 | 9 | 0.0057 | 37480 |
| HPV45 | E1 | NTGKSYFGMSF | 473 | 11 | | 37481 |
| HPV45 | E1 | NTNAENGGSVH | 152 | 11 | | 37482 |
| HPV45 | E1 | PAKDNKWPY | 563 | 9 | | 37483 |
| HPV45 | E1 | PANTGKSY | 471 | 8 | | 37484 |
| HPV45 | E1 | PANTGKSYF | 471 | 9 | | 37485 |
| HPV45 | E1 | PFDKNGNPVY | 586 | 10 | | 37486 |
| HPV45 | E1 | PILLTSNIDPA | 554 | 11 | | 37487 |
| HPV45 | E1 | PISIDRKH | 537 | 8 | | 37488 |
| HPV45 | E1 | PISIDRKHK | 537 | 9 | | 37489 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E1 | PIVQFLRY | 434 | 8 | | 37490 |
| HPV45 | E1 | PLADTKVA | 505 | 8 | | 37491 |
| HPV45 | E1 | PTVAEGFK | 238 | 8 | | 37492 |
| HPV45 | E1 | PVYEINDK | 593 | 8 | | 37493 |
| HPV45 | E1 | PVYEINDKNWK | 593 | 11 | | 37494 |
| HPV45 | E1 | QAEQETAQA | 60 | 9 | | 37495 |
| HPV45 | E1 | QAEQETAQALF | 60 | 11 | | 37496 |
| HPV45 | E1 | QAKYLKDCA | 391 | 9 | | 37497 |
| HPV45 | E1 | QASNKKAA | 192 | 8 | | 37498 |
| HPV45 | E1 | QASNKKAAMLA | 192 | 11 | | 37499 |
| HPV45 | E1 | QFLRYQGVEF | 437 | 10 | | 37500 |
| HPV45 | E1 | QGVEFISF | 442 | 8 | | 37501 |
| HPV45 | E1 | QGVEFISFLR | 442 | 10 | | 37502 |
| HPV45 | E1 | QGVEFISFLRA | 442 | 11 | | 37503 |
| HPV45 | E1 | QLADCNSNA | 374 | 9 | | 37504 |
| HPV45 | E1 | QLADCNSNAA | 374 | 10 | | 37505 |
| HPV45 | E1 | QLADCNSNAAA | 374 | 11 | | 37506 |
| HPV45 | E1 | QLSICEQA | 54 | 8 | | 37507 |
| HPV45 | E1 | QLSVDTDLSPR | 102 | 11 | | 37508 |
| HPV45 | E1 | QMNMSQWIK | 412 | 9 | | 37509 |
| HPV45 | E1 | QMNMSQWIKY | 412 | 10 | | 37510 |
| HPV45 | E1 | QMNMSQWIKYR | 412 | 11 | | 37511 |
| HPV45 | E1 | QSSGGDSSDNA | 165 | 11 | | 37512 |
| HPV45 | E1 | QVLHLLKR | 80 | 8 | | 37513 |
| HPV45 | E1 | QVLHLLKRK | 80 | 9 | | 37514 |
| HPV45 | E1 | QVLHLLKRKF | 80 | 10 | | 37515 |
| HPV45 | E1 | QVLHLLKRKFA | 80 | 11 | | 37516 |
| HPV45 | E1 | QVTVNTNA | 148 | 8 | | 37517 |
| HPV45 | E1 | RALKEFLK | 451 | 8 | | 37518 |
| HPV45 | E1 | RLDLHEDDEDA | 612 | 11 | | 37519 |
| HPV45 | E1 | RLFTISDSGY | 128 | 10 | | 37520 |
| HPV45 | E1 | RLQEISLNSGH | 112 | 11 | | 37521 |
| HPV45 | E1 | RSSVAALY | 306 | 8 | | 37522 |
| HPV45 | E1 | RSSVAALYWY | 306 | 10 | | 37523 |
| HPV45 | E1 | RSSVAALYWYR | 306 | 11 | | 37524 |
| HPV45 | E1 | RTWSRLDLH | 608 | 9 | | 37525 |
| HPV45 | E1 | RVTVFTFPH | 575 | 9 | | 37526 |
| HPV45 | E1 | RVTVFTFPHA | 575 | 10 | | 37527 |
| HPV45 | E1 | RVTVFTFPHAF | 575 | 11 | | 37528 |
| HPV45 | E1 | SDDEDETA | 33 | 8 | | 37529 |
| HPV45 | E1 | SDMAFQYA | 366 | 8 | | 37530 |
| HPV45 | E1 | SDMAFQYAQLA | 366 | 11 | | 37531 |
| HPV45 | E1 | SDMVQWAF | 351 | 8 | | 37532 |
| HPV45 | E1 | SDNAENVDPH | 172 | 10 | | 37533 |
| HPV45 | E1 | SFIHFLQGA | 482 | 9 | | 37534 |
| HPV45 | E1 | SFLRALKEF | 448 | 9 | | 37535 |
| HPV45 | E1 | SFLRALKEFLK | 448 | 11 | | 37536 |
| HPV45 | E1 | SFTDLVRNF | 211 | 9 | | 37537 |
| HPV45 | E1 | SFTDLVRNFK | 211 | 10 | | 37538 |
| HPV45 | E1 | SFVNSNSH | 493 | 8 | | 37539 |
| HPV45 | E1 | SFVNSNSHF | 493 | 9 | | 37540 |
| HPV45 | E1 | SGDTPEWIQR | 326 | 10 | | 37541 |
| HPV45 | E1 | SGGDSSDNA | 167 | 9 | | 37542 |
| HPV45 | E1 | SGHKKAKR | 120 | 8 | | 37543 |
| HPV45 | E1 | SGHKKAKRR | 120 | 9 | | 37544 |
| HPV45 | E1 | SGHKKAKRRLF | 120 | 11 | | 37545 |
| HPV45 | E1 | SGYGCSEVEA | 135 | 10 | | 37546 |
| HPV45 | E1 | SGYGCSEVEAA | 135 | 11 | | 37547 |
| HPV45 | E1 | SICEQAEQETA | 56 | 11 | | 37548 |
| HPV45 | E1 | SITELKELLQA | 183 | 11 | | 37549 |
| HPV45 | E1 | SLNSGHKK | 117 | 8 | | 37550 |
| HPV45 | E1 | SLNSGHKKA | 117 | 9 | | 37551 |
| HPV45 | E1 | SLNSGHKKAK | 117 | 10 | | 37552 |
| HPV45 | E1 | SLNSGHKKAKR | 117 | 11 | | 37553 |
| HPV45 | E1 | SSDNAENVDPH | 171 | 11 | | 37554 |
| HPV45 | E1 | SSGGDSSDNA | 166 | 10 | | 37555 |
| HPV45 | E1 | SSVAALYWY | 307 | 9 | | 37556 |
| HPV45 | E1 | SSVAALYWYR | 307 | 10 | | 37557 |
| HPV45 | E1 | SVAALYWY | 308 | 8 | | 37558 |
| HPV45 | E1 | SVAALYWYR | 308 | 9 | 2.9000 | 37559 |
| HPV45 | E1 | SVDTDLSPR | 104 | 9 | | 37560 |
| HPV45 | E1 | TAQALFHA | 65 | 8 | | 37561 |
| HPV45 | E1 | TCMLIEPPK | 296 | 9 | | 37562 |
| HPV45 | E1 | TCMLIEPPKLR | 296 | 11 | | 37563 |
| HPV45 | E1 | TCTDWVMA | 225 | 8 | | 37564 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E1 | TCTDWVMAIF | 225 | 10 | | 37565 |
| HPV45 | E1 | TCWTYFDNY | 520 | 9 | | 37566 |
| HPV45 | E1 | TCWTYFDNYMR | 520 | 11 | | 37567 |
| HPV45 | E1 | TDESDMAF | 363 | 8 | | 37568 |
| HPV45 | E1 | TDESDMAFQY | 363 | 10 | | 37569 |
| HPV45 | E1 | TDESDMAFQYA | 363 | 11 | | 37570 |
| HPV45 | E1 | TDLVRNFK | 213 | 8 | | 37571 |
| HPV45 | E1 | TDLVRNFKSDK | 213 | 11 | | 37572 |
| HPV45 | E1 | TDTGSDMVDF | 41 | 10 | | 37573 |
| HPV45 | E1 | TDWVMAIF | 227 | 8 | | 37574 |
| HPV45 | E1 | TFKCVTGQNTR | 631 | 11 | | 37575 |
| HPV45 | E1 | TFPHAFPF | 580 | 8 | | 37576 |
| HPV45 | E1 | TFPHAFPFDK | 580 | 10 | | 37577 |
| HPV45 | E1 | TGCNGWFF | 12 | 8 | | 37578 |
| HPV45 | E1 | TGKSYFGMSF | 474 | 10 | | 37579 |
| HPV45 | E1 | TGSDMVDF | 43 | 8 | | 37580 |
| HPV45 | E1 | TLIKPATLY | 246 | 9 | | 37581 |
| HPV45 | E1 | TLIKPATLYA | 246 | 10 | | 37582 |
| HPV45 | E1 | TLIKPATLYAH | 246 | 11 | | 37583 |
| HPV45 | E1 | TSNIDPAK | 558 | 8 | | 37584 |
| HPV45 | E1 | TSNIDPAKDNK | 558 | 11 | | 37585 |
| HPV45 | E1 | TTCTDWVMA | 224 | 9 | | 37586 |
| HPV45 | E1 | TTCTDWVMAIF | 224 | 11 | | 37587 |
| HPV45 | E1 | TVAEGFKTLIK | 239 | 11 | | 37588 |
| HPV45 | E1 | TVAKGLSTLLH | 282 | 11 | | 37589 |
| HPV45 | E1 | TVFTFPHA | 577 | 8 | | 37590 |
| HPV45 | E1 | TVFTFPHAF | 577 | 9 | | 37591 |
| HPV45 | E1 | TVFTFPHAFPF | 577 | 11 | | 37592 |
| HPV45 | E1 | VAALYWYR | 309 | 8 | | 37593 |
| HPV45 | E1 | VAEGFKTLIK | 240 | 10 | | 37594 |
| HPV45 | E1 | VAKGLSTLLH | 283 | 10 | | 37595 |
| HPV45 | E1 | VAMLDDATH | 511 | 9 | | 37596 |
| HPV45 | E1 | VDPHCSITELK | 178 | 11 | | 37597 |
| HPV45 | E1 | VDTDLSPR | 105 | 8 | | 37598 |
| HPV45 | E1 | VFKDIYGLSF | 203 | 10 | | 37599 |
| HPV45 | E1 | VFTFPHAF | 578 | 8 | | 37600 |
| HPV45 | E1 | VFTFPHAFPF | 578 | 10 | | 37601 |
| HPV45 | E1 | VISDDEDETA | 31 | 10 | | 37602 |
| HPV45 | E1 | VLHLLKRK | 81 | 8 | | 37603 |
| HPV45 | E1 | VLHLLKRKF | 81 | 9 | | 37604 |
| HPV45 | E1 | VLHLLKRKFA | 81 | 10 | | 37605 |
| HPV45 | E1 | VLILALLR | 266 | 8 | | 37606 |
| HPV45 | E1 | VLILALLRY | 266 | 9 | | 37607 |
| HPV45 | E1 | VLILALLRYK | 266 | 10 | | 37608 |
| HPV45 | E1 | VMCRHYKR | 400 | 8 | | 37609 |
| HPV45 | E1 | VMCRHYKRA | 400 | 9 | | 37610 |
| HPV45 | E1 | VMCRHYKRAQK | 400 | 11 | | 37611 |
| HPV45 | E1 | VSGDTPEWIQR | 325 | 11 | | 37612 |
| HPV45 | E1 | VTVFTFPH | 576 | 8 | | 37613 |
| HPV45 | E1 | VTVFTFPHA | 576 | 9 | | 37614 |
| HPV45 | E1 | VTVFTFPHAF | 576 | 10 | | 37615 |
| HPV45 | E1 | WFFVETIVEK | 17 | 10 | | 37616 |
| HPV45 | E1 | WFFVETIVEKK | 17 | 11 | | 37617 |
| HPV45 | E1 | WGVLILALLR | 264 | 10 | | 37618 |
| HPV45 | E1 | WGVLILALLRY | 264 | 11 | | 37619 |
| HPV45 | E1 | WIKYRCSK | 418 | 8 | | 37620 |
| HPV45 | E1 | WIQRLTIIQH | 332 | 10 | | 37621 |
| HPV45 | E1 | WLEPLADTK | 502 | 9 | | 37622 |
| HPV45 | E1 | WLEPLADTKVA | 502 | 11 | | 37623 |
| HPV45 | E1 | WTYFDNYMR | 522 | 9 | | 37624 |
| HPV45 | E1 | WTYFDNYMRNA | 522 | 11 | | 37625 |
| HPV45 | E1 | YAHIQCLDCK | 254 | 10 | | 37626 |
| HPV45 | E1 | YAQLADCNSNA | 372 | 11 | | 37627 |
| HPV45 | E1 | YFDNYMRNA | 524 | 9 | | 37628 |
| HPV45 | E1 | YFGMSFIH | 478 | 8 | | 37629 |
| HPV45 | E1 | YFGMSFIHF | 478 | 9 | | 37630 |
| HPV45 | E1 | YGCSEVEA | 137 | 8 | | 37631 |
| HPV45 | E1 | YGCSEVEAA | 137 | 9 | | 37632 |
| HPV45 | E1 | YGLSFTDLVR | 208 | 10 | | 37633 |
| HPV45 | E1 | YGPANTGK | 469 | 8 | | 37634 |
| HPV45 | E1 | YGPANTGKSY | 469 | 10 | | 37635 |
| HPV45 | E1 | YGPANTGKSYF | 469 | 11 | | 37636 |
| HPV45 | E1 | YLESRVTVF | 571 | 9 | | 37637 |
| HPV45 | E1 | YLESRVTVFTF | 571 | 11 | | 37638 |
| HPV45 | E1 | YLKDCAVMCR | 394 | 10 | | 37639 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E1 | YLKDCAVMCRH | 394 | 11 | | 37640 |
| HPV45 | E2 | AACVSYWGVY | 156 | 10 | | 37641 |
| HPV45 | E2 | AACVSYWGVYY | 156 | 11 | | 37642 |
| HPV45 | E2 | ACVSYWGVY | 157 | 9 | | 37643 |
| HPV45 | E2 | ACVSYWGVYY | 157 | 10 | | 37644 |
| HPV45 | E2 | AIELQMALK | 78 | 9 | | 37645 |
| HPV45 | E2 | AILFTAREH | 47 | 9 | | 37646 |
| HPV45 | E2 | ALKGLAQSK | 84 | 9 | | 37647 |
| HPV45 | E2 | ALKGLAQSKY | 84 | 10 | | 37648 |
| HPV45 | E2 | ALQDKILDH | 16 | 9 | | 37649 |
| HPV45 | E2 | ALQDKILDHY | 16 | 10 | | 37650 |
| HPV45 | E2 | ASTSTPKTA | 226 | 9 | | 37651 |
| HPV45 | E2 | ASVGTPKPH | 234 | 9 | | 37652 |
| HPV45 | E2 | ATQIVRQLQH | 216 | 10 | | 37653 |
| HPV45 | E2 | ATQIVRQLQHA | 216 | 11 | | 37654 |
| HPV45 | E2 | CFKKGGKTVH | 115 | 10 | | 37655 |
| HPV45 | E2 | CGLTEQHH | 254 | 8 | | 37656 |
| HPV45 | E2 | CGLTEQHHGR | 254 | 10 | | 37657 |
| HPV45 | E2 | CLRYRLRK | 305 | 8 | | 37658 |
| HPV45 | E2 | CLRYRLRKY | 305 | 9 | | 37659 |
| HPV45 | E2 | CLRYRLRKYA | 305 | 10 | | 37660 |
| HPV45 | E2 | CMNYVVWDSIY | 134 | 11 | | 37661 |
| HPV45 | E2 | CSGNTTPIIH | 286 | 10 | | 37662 |
| HPV45 | E2 | CSSTSNNK | 274 | 8 | | 37663 |
| HPV45 | E2 | CSSTSNNKR | 274 | 9 | | 37664 |
| HPV45 | E2 | CSSTSNNKRR | 274 | 10 | | 37665 |
| HPV45 | E2 | CSSTSNNKRRK | 274 | 11 | | 37666 |
| HPV45 | E2 | CSTSDDTVSA | 207 | 10 | | 37667 |
| HPV45 | E2 | CVSYWGVY | 158 | 8 | | 37668 |
| HPV45 | E2 | CVSYWGVYY | 158 | 9 | | 37669 |
| HPV45 | E2 | CVSYWGVYYIK | 158 | 11 | | 37670 |
| HPV45 | E2 | DDTVSATQIVR | 211 | 11 | | 37671 |
| HPV45 | E2 | DGDTTYYVQF | 169 | 10 | | 37672 |
| HPV45 | E2 | DGDTTYYVQFK | 169 | 11 | | 37673 |
| HPV45 | E2 | DGNKDNCMNY | 128 | 10 | | 37674 |
| HPV45 | E2 | DINSQISY | 31 | 8 | | 37675 |
| HPV45 | E2 | DSKDINSQISY | 28 | 11 | | 37676 |
| HPV45 | E2 | DTTYYVQF | 171 | 8 | | 37677 |
| HPV45 | E2 | DTTYYVQFK | 171 | 9 | | 37678 |
| HPV45 | E2 | DTVSATQIVR | 212 | 10 | | 37679 |
| HPV45 | E2 | ELQMALKGLA | 80 | 10 | | 37680 |
| HPV45 | E2 | ELWNTEPSQCF | 106 | 11 | | 37681 |
| HPV45 | E2 | ESLSERLSA | 8 | 9 | | 37682 |
| HPV45 | E2 | ETGIWDKTA | 148 | 9 | | 37683 |
| HPV45 | E2 | ETGIWDKTAA | 148 | 10 | | 37684 |
| HPV45 | E2 | FDGNKDNCMNY | 127 | 11 | | 37685 |
| HPV45 | E2 | FTAREHGITK | 50 | 10 | | 37686 |
| HPV45 | E2 | GDKNSLKCLR | 298 | 10 | | 37687 |
| HPV45 | E2 | GDKNSLKCLRY | 298 | 11 | | 37688 |
| HPV45 | E2 | GDTTYYVQF | 170 | 9 | | 37689 |
| HPV45 | E2 | GDTTYYVQFK | 170 | 10 | | 37690 |
| HPV45 | E2 | GGKTVHVY | 119 | 8 | | 37691 |
| HPV45 | E2 | GGKTVHVYF | 119 | 9 | | 37692 |
| HPV45 | E2 | GIWDKTAA | 150 | 8 | | 37693 |
| HPV45 | E2 | GLTEQHHGR | 255 | 9 | | 37694 |
| HPV45 | E2 | GTPKPHIQTPA | 237 | 11 | | 37695 |
| HPV45 | E2 | HASTSTPK | 225 | 8 | | 37696 |
| HPV45 | E2 | HASTSTPKTA | 225 | 10 | | 37697 |
| HPV45 | E2 | HGITKLNH | 55 | 8 | | 37698 |
| HPV45 | E2 | HGRVNTHVH | 261 | 9 | | 37699 |
| HPV45 | E2 | HIQTPATK | 242 | 8 | | 37700 |
| HPV45 | E2 | HIQTPATKR | 242 | 9 | | 37701 |
| HPV45 | E2 | HIQTPATKRPR | 242 | 11 | | 37702 |
| HPV45 | E2 | HLKGDKNSLK | 295 | 10 | | 37703 |
| HPV45 | E2 | HVYFDGNK | 124 | 8 | | 37704 |
| HPV45 | E2 | IIHLKGDK | 293 | 8 | | 37705 |
| HPV45 | E2 | ILDHYENDSK | 21 | 10 | | 37706 |
| HPV45 | E2 | ILFTAREH | 48 | 8 | | 37707 |
| HPV45 | E2 | ISKSKAHK | 70 | 8 | | 37708 |
| HPV45 | E2 | ISKSKAHKA | 70 | 9 | | 37709 |
| HPV45 | E2 | ISYWQLIR | 36 | 8 | | 37710 |
| HPV45 | E2 | ITETGIWDK | 146 | 9 | | 37711 |
| HPV45 | E2 | ITETGIWDKTA | 146 | 11 | | 37712 |
| HPV45 | E2 | IVRQLQHA | 219 | 8 | | 37713 |
| HPV45 | E2 | KAHKAIELQMA | 74 | 11 | | 37714 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E2 | KAIELQMA | 77 | 8 | | 37715 |
| HPV45 | E2 | KAIELQMALK | 77 | 10 | | 37716 |
| HPV45 | E2 | KCLRYRLR | 304 | 8 | | 37717 |
| HPV45 | E2 | KCLRYRLRK | 304 | 9 | | 37718 |
| HPV45 | E2 | KCLRYRLRKY | 304 | 10 | | 37719 |
| HPV45 | E2 | KCLRYRLRKYA | 304 | 11 | | 37720 |
| HPV45 | E2 | KDGDTTYY | 168 | 8 | | 37721 |
| HPV45 | E2 | KDGDTTYYVQF | 168 | 11 | | 37722 |
| HPV45 | E2 | KDINSQISY | 30 | 9 | | 37723 |
| HPV45 | E2 | KGDKNSLK | 297 | 8 | | 37724 |
| HPV45 | E2 | KGDKNSLKCLR | 297 | 11 | | 37725 |
| HPV45 | E2 | KGGKTVHVY | 118 | 9 | | 37726 |
| HPV45 | E2 | KGGKTVHVYF | 118 | 10 | | 37727 |
| HPV45 | E2 | KGLAQSKY | 86 | 8 | | 37728 |
| HPV45 | E2 | KILDHYENDSK | 20 | 11 | | 37729 |
| HPV45 | E2 | KTAACVSY | 154 | 8 | | 37730 |
| HPV45 | E2 | KTASVGTPK | 232 | 9 | | 37731 |
| HPV45 | E2 | KTASVGTPKPH | 232 | 11 | | 37732 |
| HPV45 | E2 | KTVHVYFDGNK | 121 | 11 | | 37733 |
| HPV45 | E2 | LCSSTSNNK | 273 | 9 | | 37734 |
| HPV45 | E2 | LCSSTSNNKR | 273 | 10 | | 37735 |
| HPV45 | E2 | LCSSTSNNKRR | 273 | 11 | | 37736 |
| HPV45 | E2 | LDHYENDSK | 22 | 9 | | 37737 |
| HPV45 | E2 | LFTAREHGITK | 49 | 11 | | 37738 |
| HPV45 | E2 | LIRLENAILF | 41 | 10 | | 37739 |
| HPV45 | E2 | LLCSSTSNNK | 272 | 10 | | 37740 |
| HPV45 | E2 | LLCSSTSNNKR | 272 | 11 | | 37741 |
| HPV45 | E2 | LSALQDKILDH | 14 | 11 | | 37742 |
| HPV45 | E2 | LSERLSALQDK | 10 | 11 | | 37743 |
| HPV45 | E2 | LTEQHHGR | 256 | 8 | | 37744 |
| HPV45 | E2 | LTVTYNSEVQR | 336 | 11 | | 37745 |
| HPV45 | E2 | MALKGLAQSK | 83 | 10 | | 37746 |
| HPV45 | E2 | MALKGLAQSKY | 83 | 11 | | 37747 |
| HPV45 | E2 | MCSTSDDTVSA | 206 | 11 | | 37748 |
| HPV45 | E2 | NAILFTAR | 46 | 8 | | 37749 |
| HPV45 | E2 | NAILFTAREH | 46 | 10 | | 37750 |
| HPV45 | E2 | NISKSKAH | 69 | 8 | | 37751 |
| HPV45 | E2 | NISKSKAHK | 69 | 9 | | 37752 |
| HPV45 | E2 | NISKSKAHKA | 69 | 10 | | 37753 |
| HPV45 | E2 | NSEVQRNTF | 341 | 9 | | 37754 |
| HPV45 | E2 | NSLKCLRY | 301 | 8 | | 37755 |
| HPV45 | E2 | NSLKCLRYR | 301 | 9 | | 37756 |
| HPV45 | E2 | NSLKCLRYRLR | 301 | 11 | | 37757 |
| HPV45 | E2 | NSNTWEVQY | 187 | 9 | | 37758 |
| HPV45 | E2 | NSQISYWQLIR | 33 | 11 | | 37759 |
| HPV45 | E2 | NSVQISVGY | 357 | 9 | | 37760 |
| HPV45 | E2 | NTEPSQCF | 109 | 8 | | 37761 |
| HPV45 | E2 | NTEPSQCFK | 109 | 9 | | 37762 |
| HPV45 | E2 | NTEPSQCFKK | 109 | 10 | | 37763 |
| HPV45 | E2 | NTGILTVTY | 332 | 9 | | 37764 |
| HPV45 | E2 | NTTPIIHLK | 289 | 9 | | 37765 |
| HPV45 | E2 | PIIHLKGDK | 292 | 9 | | 37766 |
| HPV45 | E2 | PINISKSK | 67 | 8 | | 37767 |
| HPV45 | E2 | PINISKSKA | 67 | 9 | | 37768 |
| HPV45 | E2 | PINISKSKAH | 67 | 10 | | 37769 |
| HPV45 | E2 | PINISKSKAHK | 67 | 11 | | 37770 |
| HPV45 | E2 | PLLCSSTSNNK | 271 | 11 | | 37771 |
| HPV45 | E2 | PSQCFKKGGK | 112 | 10 | | 37772 |
| HPV45 | E2 | QCFKKGGK | 114 | 8 | | 37773 |
| HPV45 | E2 | QCFKKGGKTVH | 114 | 11 | | 37774 |
| HPV45 | E2 | QCGLTEQH | 253 | 8 | | 37775 |
| HPV45 | E2 | QCGLTEQHH | 253 | 9 | | 37776 |
| HPV45 | E2 | QCGLTEQHHGR | 253 | 11 | | 37777 |
| HPV45 | E2 | QDKILDHY | 18 | 8 | | 37778 |
| HPV45 | E2 | QFKSECEK | 177 | 8 | | 37779 |
| HPV45 | E2 | QFKSECEKY | 177 | 9 | | 37780 |
| HPV45 | E2 | QISYWQLIR | 35 | 9 | | 37781 |
| HPV45 | E2 | QIVRQLQH | 218 | 8 | | 37782 |
| HPV45 | E2 | QIVRQLQHA | 218 | 9 | | 37783 |
| HPV45 | E2 | QLIRLENA | 40 | 8 | | 37784 |
| HPV45 | E2 | QLIRLENAILF | 40 | 11 | | 37785 |
| HPV45 | E2 | QLQHASTSTPK | 222 | 11 | | 37786 |
| HPV45 | E2 | QMALKGLA | 82 | 8 | | 37787 |
| HPV45 | E2 | QMALKGLAQSK | 82 | 11 | | 37788 |
| HPV45 | E2 | QTPATKRPR | 244 | 9 | | 37789 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E2 | QTPKESLSER | 4 | 10 | | 37790 |
| HPV45 | E2 | QVVPPINISK | 63 | 10 | | 37791 |
| HPV45 | E2 | RLENAILF | 43 | 8 | | 37792 |
| HPV45 | E2 | RLENAILFTA | 43 | 10 | | 37793 |
| HPV45 | E2 | RLENAILFTAR | 43 | 11 | | 37794 |
| HPV45 | E2 | RLRKYADH | 309 | 8 | | 37795 |
| HPV45 | E2 | RLRKYADHY | 309 | 9 | | 37796 |
| HPV45 | E2 | RLSALQDK | 13 | 8 | | 37797 |
| HPV45 | E2 | SALQDKILDH | 15 | 10 | | 37798 |
| HPV45 | E2 | SALQDKILDHY | 15 | 11 | | 37799 |
| HPV45 | E2 | SATQIVRQLQH | 215 | 11 | | 37800 |
| HPV45 | E2 | SGNTTPIIH | 287 | 9 | | 37801 |
| HPV45 | E2 | SGNTTPIIHLK | 287 | 11 | | 37802 |
| HPV45 | E2 | SLKCLRYR | 302 | 8 | | 37803 |
| HPV45 | E2 | SLKCLRYRLR | 302 | 10 | | 37804 |
| HPV45 | E2 | SLKCLRYRLRK | 302 | 11 | | 37805 |
| HPV45 | E2 | SLSERLSA | 9 | 8 | | 37806 |
| HPV45 | E2 | SSTSNNKR | 275 | 8 | | 37807 |
| HPV45 | E2 | SSTSNNKRR | 275 | 9 | | 37808 |
| HPV45 | E2 | SSTSNNKRRK | 275 | 10 | | 37809 |
| HPV45 | E2 | SSTWHWTGCNK | 321 | 11 | | 37810 |
| HPV45 | E2 | STSDDTVSA | 208 | 9 | | 37811 |
| HPV45 | E2 | STSNNKRR | 276 | 8 | | 37812 |
| HPV45 | E2 | STSNNKRRK | 276 | 9 | | 37813 |
| HPV45 | E2 | STSTPKTA | 227 | 8 | | 37814 |
| HPV45 | E2 | STWHWTGCNK | 322 | 10 | | 37815 |
| HPV45 | E2 | SVGTPKPH | 235 | 8 | | 37816 |
| HPV45 | E2 | SVQISVGY | 358 | 8 | | 37817 |
| HPV45 | E2 | TAACVSYWGVY | 155 | 11 | | 37818 |
| HPV45 | E2 | TAREHGITK | 51 | 9 | | 37819 |
| HPV45 | E2 | TASVGTPK | 233 | 8 | | 37820 |
| HPV45 | E2 | TASVGTPKPH | 233 | 10 | | 37821 |
| HPV45 | E2 | TGILTVTY | 333 | 8 | | 37822 |
| HPV45 | E2 | TGIWDKTA | 149 | 8 | | 37823 |
| HPV45 | E2 | TGIWDKTAA | 149 | 9 | | 37824 |
| HPV45 | E2 | TSDDTVSA | 209 | 8 | | 37825 |
| HPV45 | E2 | TSNNKRRK | 277 | 8 | | 37826 |
| HPV45 | E2 | TTPIIHLK | 290 | 8 | | 37827 |
| HPV45 | E2 | TTPIIHLKGDK | 290 | 11 | | 37828 |
| HPV45 | E2 | TTYYVQFK | 172 | 8 | | 37829 |
| HPV45 | E2 | TVHVYFDGNK | 122 | 10 | | 37830 |
| HPV45 | E2 | TVSATQIVR | 213 | 9 | | 37831 |
| HPV45 | E2 | TVTYNSEVQR | 337 | 10 | | 37832 |
| HPV45 | E2 | VCSGNTTPIIH | 285 | 11 | | 37833 |
| HPV45 | E2 | VSATQIVR | 214 | 8 | | 37834 |
| HPV45 | E2 | VSYWGVYY | 159 | 8 | | 37835 |
| HPV45 | E2 | VSYWGVYYIK | 159 | 10 | | 37836 |
| HPV45 | E2 | VTYNSEVQR | 338 | 9 | | 37837 |
| HPV45 | E2 | VVPPINISK | 64 | 9 | | 37838 |
| HPV45 | E2 | VVPPINISKS | 64 | 11 | | 37839 |
| HPV45 | E2 | VVWDSIYY | 138 | 8 | | 37840 |
| HPV45 | E2 | WDKTAACVSY | 152 | 10 | | 37841 |
| HPV45 | E2 | YGNSNTWEVQY | 185 | 11 | | 37842 |
| HPV45 | E2 | YIKDGDTTY | 166 | 9 | | 37843 |
| HPV45 | E2 | YIKDGDTTYY | 166 | 10 | | 37844 |
| HPV45 | E2 | YITETGIWDK | 145 | 10 | | 37845 |
| HPV45 | E2 | YSEISSTWH | 317 | 9 | | 37846 |
| HPV45 | E2 | YVQFKSECEK | 175 | 10 | | 37847 |
| HPV45 | E2 | YVQFKSECEKY | 175 | 11 | | 37848 |
| HPV45 | E2 | YVVWDSIY | 137 | 8 | | 37849 |
| HPV45 | E2 | YVVWDSIYY | 137 | 9 | | 37850 |
| HPV45 | E6 | AACHKCIDF | 63 | 9 | | 37851 |
| HPV45 | E6 | AACHKCIDFY | 63 | 10 | | 37852 |
| HPV45 | E6 | ACHKCIDF | 64 | 8 | | 37853 |
| HPV45 | E6 | ACHKCIDFY | 64 | 9 | | 37854 |
| HPV45 | E6 | ACHKCIDFYSR | 64 | 11 | | 37855 |
| HPV45 | E6 | ACVYCKATLER | 31 | 11 | | 37856 |
| HPV45 | E6 | AFKDLFIVY | 48 | 9 | | 37857 |
| HPV45 | E6 | AFKDLFIVYR | 48 | 10 | | 37858 |
| HPV45 | E6 | ATLERTEVY | 37 | 9 | | 37859 |
| HPV45 | E6 | ATLERTEVYQF | 37 | 11 | | 37860 |
| HPV45 | E6 | CCDQARQER | 141 | 9 | | 37861 |
| HPV45 | E6 | CCDQARQERLR | 141 | 11 | | 37862 |
| HPV45 | E6 | CDQARQER | 142 | 8 | | 37863 |
| HPV45 | E6 | CDQARQERLR | 142 | 10 | | 37864 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E6 | CDQARQERLRR | 142 | 11 | | 37865 |
| HPV45 | E6 | CIAYAACH | 59 | 8 | | 37866 |
| HPV45 | E6 | CIAYAACHK | 59 | 9 | | 37867 |
| HPV45 | E6 | CIDFYSRIR | 68 | 9 | 0.001 | 37868 |
| HPV45 | E6 | CLRCQKPLNPA | 105 | 11 | | 37869 |
| HPV45 | E6 | CVYCKATLER | 32 | 10 | | 37870 |
| HPV45 | E6 | DCIAYAACH | 58 | 9 | | 37871 |
| HPV45 | E6 | DCIAYAACHK | 58 | 10 | | 37872 |
| HPV45 | E6 | DDPTQRPY | 5 | 8 | | 37873 |
| HPV45 | E6 | DDPTQRPYK | 5 | 9 | | 37874 |
| HPV45 | E6 | DFYSRIRELR | 70 | 10 | 0.0002 | 37875 |
| HPV45 | E6 | DFYSRIRELRY | 70 | 11 | | 37876 |
| HPV45 | E6 | DLFIVYRDCIA | 51 | 11 | | 37877 |
| HPV45 | E6 | DVSIACVY | 27 | 8 | | 37878 |
| HPV45 | E6 | DVSIACVYCK | 27 | 10 | | 37879 |
| HPV45 | E6 | DVSIACVYCKA | 27 | 11 | | 37880 |
| HPV45 | E6 | ELRYYSNSVY | 77 | 10 | | 37881 |
| HPV45 | E6 | ELYNLLIR | 97 | 8 | | 37882 |
| HPV45 | E6 | ELYNLLIRCLR | 97 | 11 | | 37883 |
| HPV45 | E6 | EVYQFAFK | 43 | 8 | | 37884 |
| HPV45 | E6 | EVYQFAFKDLF | 43 | 11 | | 37885 |
| HPV45 | E6 | FAFKDLFIVY | 47 | 10 | | 37886 |
| HPV45 | E6 | FAFKDLFIVYR | 47 | 11 | | 37887 |
| HPV45 | E6 | FDDPTQRPY | 4 | 9 | | 37888 |
| HPV45 | E6 | FDDPTQRPYK | 4 | 10 | | 37889 |
| HPV45 | E6 | FIVYRDCIA | 53 | 9 | | 37890 |
| HPV45 | E6 | FIVYRDCIAY | 53 | 10 | | 37891 |
| HPV45 | E6 | FIVYRDCIAYA | 53 | 11 | | 37892 |
| HPV45 | E6 | HLKDKRRF | 120 | 8 | | 37893 |
| HPV45 | E6 | HLKDKRRFH | 120 | 9 | | 37894 |
| HPV45 | E6 | HSIAGQYR | 128 | 8 | | 37895 |
| HPV45 | E6 | IACVYCKA | 30 | 8 | | 37896 |
| HPV45 | E6 | IAYAACHK | 60 | 8 | | 37897 |
| HPV45 | E6 | IDFYSRIR | 69 | 8 | | 37898 |
| HPV45 | E6 | IDFYSRIRELR | 69 | 11 | | 37899 |
| HPV45 | E6 | IVYRDCIA | 54 | 8 | | 37900 |
| HPV45 | E6 | IVYRDCIAY | 54 | 9 | | 37901 |
| HPV45 | E6 | IVYRDCIAYA | 54 | 10 | | 37902 |
| HPV45 | E6 | IVYRDCIAYAA | 54 | 11 | | 37903 |
| HPV45 | E6 | KATLERTEVY | 36 | 10 | | 37904 |
| HPV45 | E6 | KCIDFYSR | 67 | 8 | | 37905 |
| HPV45 | E6 | KCIDFYSRIR | 67 | 10 | | 37906 |
| HPV45 | E6 | KDKRRFHSIA | 122 | 10 | | 37907 |
| HPV45 | E6 | KDLFIVYR | 50 | 8 | | 37908 |
| HPV45 | E6 | KITNTELY | 92 | 8 | | 37909 |
| HPV45 | E6 | LFIVYRDCIA | 52 | 10 | | 37910 |
| HPV45 | E6 | LFIVYRDCIAY | 52 | 11 | | 37911 |
| HPV45 | E6 | LIRCLRCQK | 102 | 9 | 0.0190 | 37912 |
| HPV45 | E6 | LLIRCLRCQK | 101 | 10 | 0.0470 | 37913 |
| HPV45 | E6 | MARFDDPTQR | 1 | 10 | | 37914 |
| HPV45 | E6 | NLLIRCLR | 100 | 8 | | 37915 |
| HPV45 | E6 | NLLIRCLRCQK | 100 | 11 | | 37916 |
| HPV45 | E6 | NSVYGETLEK | 83 | 10 | | 37917 |
| HPV45 | E6 | NTCCDQAR | 139 | 8 | | 37918 |
| HPV45 | E6 | NTCCDQARQER | 139 | 11 | | 37919 |
| HPV45 | E6 | NTELYNLLIR | 95 | 10 | | 37920 |
| HPV45 | E6 | NTSLQDVSIA | 22 | 10 | | 37921 |
| HPV45 | E6 | PAEKRRHLK | 114 | 9 | | 37922 |
| HPV45 | E6 | PEAKRRHLKDK | 114 | 11 | | 37923 |
| HPV45 | E6 | PLNPAEKR | 111 | 8 | | 37924 |
| HPV45 | E6 | PLNPAEKRR | 111 | 9 | | 37925 |
| HPV45 | E6 | PLNPAEKRRH | 111 | 10 | | 37926 |
| HPV45 | E6 | QARQERLR | 144 | 8 | | 37927 |
| HPV45 | E6 | QARQERLRR | 144 | 9 | | 37928 |
| HPV45 | E6 | QARQERLRRR | 144 | 10 | | 37929 |
| HPV45 | E6 | QARQERLRRRR | 144 | 11 | | 37930 |
| HPV45 | E6 | QCNTCCDQA | 137 | 9 | | 37931 |
| HPV45 | E6 | QCNTCCDQAR | 137 | 10 | | 37932 |
| HPV45 | E6 | QDVSIACVY | 26 | 9 | | 37933 |
| HPV45 | E6 | QDVSIACVYCK | 26 | 11 | | 37934 |
| HPV45 | E6 | QFAFKDLF | 46 | 8 | | 37935 |
| HPV45 | E6 | QFAFKDLFIVY | 46 | 11 | | 37936 |
| HPV45 | E6 | RCQKPLNPA | 107 | 9 | | 37937 |
| HPV45 | E6 | RCQKPLNPAEK | 107 | 11 | | 37938 |
| HPV45 | E6 | RDCIAYAA | 57 | 8 | | 37939 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E6 | RDCIAYAACH | 57 | 10 | | 37940 |
| HPV45 | E6 | RDCIAYAACHK | 57 | 11 | | 37941 |
| HPV45 | E6 | RFDDPTQR | 3 | 8 | | 37942 |
| HPV45 | E6 | RFDDPTQRPY | 3 | 10 | | 37943 |
| HPV45 | E6 | RFDDPTQRPYK | 3 | 11 | | 37944 |
| HPV45 | E6 | RFHSIAGQY | 126 | 9 | | 37945 |
| HPV45 | E6 | RFHSIAGQYR | 126 | 10 | | 37946 |
| HPV45 | E6 | RGQCNTCCDQA | 135 | 11 | | 37947 |
| HPV45 | E6 | RIRELRYY | 74 | 8 | | 37948 |
| HPV45 | E6 | RTEVYQFA | 41 | 8 | | 37949 |
| HPV45 | E6 | RTEVYQFAF | 41 | 9 | | 37950 |
| HPV45 | E6 | RTEVYQFAFK | 41 | 10 | | 37951 |
| HPV45 | E6 | SIACVYCK | 29 | 8 | | 37952 |
| HPV45 | E6 | SIACVYCKA | 29 | 9 | | 37953 |
| HPV45 | E6 | SLQDVSIA | 24 | 8 | | 37954 |
| HPV45 | E6 | SLQDVSIACVY | 24 | 11 | | 37955 |
| HPV45 | E6 | SVYGETLEK | 84 | 9 | | 37956 |
| HPV45 | E6 | TCCDQARQER | 140 | 10 | | 37957 |
| HPV45 | E6 | TLEKITNTELY | 89 | 11 | | 37958 |
| HPV45 | E6 | TLERTEVY | 38 | 8 | | 37959 |
| HPV45 | E6 | TLERTEVYQF | 38 | 10 | | 37960 |
| HPV45 | E6 | TLERTEVYQFA | 38 | 11 | | 37961 |
| HPV45 | E6 | TSLQDVSIA | 23 | 9 | | 37962 |
| HPV45 | E6 | VSIACVYCK | 28 | 9 | | 37963 |
| HPV45 | E6 | VSIACVYCKA | 28 | 10 | | 37964 |
| HPV45 | E6 | YAACHKCIDF | 62 | 10 | | 37965 |
| HPV45 | E6 | YAACHKCIDFY | 62 | 11 | | 37966 |
| HPV45 | E6 | YCKATLER | 34 | 8 | | 37967 |
| HPV45 | E6 | YSRIRELR | 72 | 8 | | 37968 |
| HPV45 | E6 | YSRIRELRY | 72 | 9 | | 37969 |
| HPV45 | E6 | YSRIRELRYY | 72 | 10 | | 37970 |
| HPV45 | E7 | ADDLRTLQQLF | 81 | 11 | | 37971 |
| HPV45 | E7 | ADGVSHAQLPA | 42 | 11 | | 37972 |
| HPV45 | E7 | ATLQEIVLH | 6 | 9 | | 37973 |
| HPV45 | E7 | CVCCKCDGR | 64 | 9 | | 37974 |
| HPV45 | E7 | DDLRTLQQLF | 82 | 10 | | 37975 |
| HPV45 | E7 | DGVSHAQLPA | 43 | 10 | | 37976 |
| HPV45 | E7 | DGVSHAQLPAR | 43 | 11 | | 37977 |
| HPV45 | E7 | DLRTLQQLF | 83 | 9 | | 37978 |
| HPV45 | E7 | EADGVSHA | 41 | 8 | | 37979 |
| HPV45 | E7 | ELDPVDLLCY | 20 | 10 | | 37980 |
| HPV45 | E7 | ELTVESSA | 74 | 8 | | 37981 |
| HPV45 | E7 | ESEEENDEA | 34 | 9 | | 37982 |
| HPV45 | E7 | ESSADDLR | 78 | 8 | | 37983 |
| HPV45 | E7 | GVSHAQLPA | 44 | 9 | | 37984 |
| HPV45 | E7 | GVSHAQLPAR | 44 | 10 | | 37985 |
| HPV45 | E7 | GVSHAQLPARR | 44 | 11 | | 37986 |
| HPV45 | E7 | HAQLPARR | 47 | 8 | | 37987 |
| HPV45 | E7 | HAQLPARRA | 47 | 9 | | 37988 |
| HPV45 | E7 | ILCVCCKCDGR | 62 | 11 | | 37989 |
| HPV45 | E7 | KILCVCCK | 61 | 8 | | 37990 |
| HPV45 | E7 | LCVCCKCDGR | 63 | 10 | | 37991 |
| HPV45 | E7 | LDPVDLLCY | 21 | 9 | | 37992 |
| HPV45 | E7 | LFLSTLSF | 90 | 8 | | 37993 |
| HPV45 | E7 | LSESEEENDEA | 32 | 11 | | 37994 |
| HPV45 | E7 | LSFVCPWCA | 95 | 9 | 0.0005 | 37995 |
| HPV45 | E7 | LTVESSADDLR | 75 | 11 | | 37996 |
| HPV45 | E7 | NDEADGVSH | 39 | 9 | | 37997 |
| HPV45 | E7 | NDEADGVSHA | 39 | 10 | | 37998 |
| HPV45 | E7 | PARRAEPQR | 51 | 9 | | 37999 |
| HPV45 | E7 | PARRAEPQRH | 51 | 10 | | 38000 |
| HPV45 | E7 | PARRAEPQRHK | 51 | 11 | | 38001 |
| HPV45 | E7 | QLFLSTLSF | 89 | 9 | | 38002 |
| HPV45 | E7 | QLPARRAEPQR | 49 | 11 | | 38003 |
| HPV45 | E7 | RAEPQRHK | 54 | 8 | | 38004 |
| HPV45 | E7 | RATLQEIVLH | 5 | 10 | | 38005 |
| HPV45 | E7 | RIELTVESSA | 72 | 10 | | 38006 |
| HPV45 | E7 | SFVCPWCA | 96 | 8 | | 38007 |
| HPV45 | E7 | STLSFVCPWCA | 93 | 11 | | 38008 |
| HPV45 | E7 | TLQEIVLH | 7 | 8 | | 38009 |
| HPV45 | E7 | TLSFVCPWCA | 94 | 10 | | 38010 |
| HPV45 | E7 | TVESSADDLR | 76 | 10 | | 38011 |
| HPV45 | E7 | VCCKCDGR | 65 | 8 | | 38012 |
| HPV45 | E7 | VSHAQLPA | 45 | 8 | | 38013 |
| HPV45 | E7 | VSHAQLPAR | 45 | 9 | | 38014 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | E7 | VSHAQLPARR | 45 | 10 | | 38015 |
| HPV45 | E7 | VSHAQLPARRA | 45 | 11 | | 38016 |
| HPV45 | L1 | AASTSTASR | 517 | 9 | | 38017 |
| HPV45 | L1 | AASTSTASRPA | 517 | 11 | | 38018 |
| HPV45 | L1 | AATAVITQDVR | 161 | 11 | | 38019 |
| HPV45 | L1 | ACVGMEIGR | 128 | 9 | | 38020 |
| HPV45 | L1 | ADPYGDSMF | 266 | 9 | | 38021 |
| HPV45 | L1 | ADPYGDSMFF | 266 | 10 | | 38022 |
| HPV45 | L1 | AGNKQAVPK | 83 | 9 | | 38023 |
| HPV45 | L1 | AIGEHWAK | 191 | 8 | | 38024 |
| HPV45 | L1 | ALPDPNKF | 103 | 8 | | 38025 |
| HPV45 | L1 | ALWRPSDSTVY | 28 | 11 | | 38026 |
| HPV45 | L1 | AMDFSTLQDTK | 234 | 11 | | 38027 |
| HPV45 | L1 | ASRPAKRVR | 523 | 9 | | 38028 |
| HPV45 | L1 | ASRPAKRVRIR | 523 | 11 | | 38029 |
| HPV45 | L1 | ASTQNPVPNTY | 375 | 11 | | 38030 |
| HPV45 | L1 | ASTSTASR | 518 | 8 | | 38031 |
| HPV45 | L1 | ASTSTASRPA | 518 | 10 | | 38032 |
| HPV45 | L1 | ASTSTASRPAK | 518 | 11 | | 38033 |
| HPV45 | L1 | ATAVITQDVR | 162 | 10 | | 38034 |
| HPV45 | L1 | AVITQDVR | 164 | 8 | | 38035 |
| HPV45 | L1 | AVPKVSAY | 88 | 8 | | 38036 |
| HPV45 | L1 | AVPKVSAYQY | 88 | 10 | | 38037 |
| HPV45 | L1 | AVPKVSAYQYR | 88 | 11 | | 38038 |
| HPV45 | L1 | CILGCVPA | 184 | 8 | | 38039 |
| HPV45 | L1 | CLRREQLF | 276 | 8 | | 38040 |
| HPV45 | L1 | CLRREQLFA | 276 | 9 | | 38041 |
| HPV45 | L1 | CLRREQLFAR | 276 | 10 | | 38042 |
| HPV45 | L1 | CLRREQLFARH | 276 | 11 | | 38043 |
| HPV45 | L1 | CVGMEIGR | 129 | 8 | | 38044 |
| HPV45 | L1 | CVPAIGEH | 188 | 8 | | 38045 |
| HPV45 | L1 | CVPAIGEHWA | 188 | 10 | | 38046 |
| HPV45 | L1 | CVPAIGEHWAK | 188 | 11 | | 38047 |
| HPV45 | L1 | DCPPLELK | 211 | 8 | | 38048 |
| HPV45 | L1 | DDTESAHA | 154 | 8 | | 38049 |
| HPV45 | L1 | DDTESAHAA | 154 | 9 | | 38050 |
| HPV45 | L1 | DDTESAHAATA | 154 | 11 | | 38051 |
| HPV45 | L1 | DDYVSRTSIF | 51 | 10 | | 38052 |
| HPV45 | L1 | DDYVSRTSIFY | 51 | 11 | | 38053 |
| HPV45 | L1 | DFSTLQDTK | 236 | 9 | | 38054 |
| HPV45 | L1 | DGDMVDTGY | 224 | 9 | | 38055 |
| HPV45 | L1 | DGDMVDTGYGA | 224 | 11 | | 38056 |
| HPV45 | L1 | DICQSICK | 250 | 8 | | 38057 |
| HPV45 | L1 | DICQSICKY | 250 | 9 | | 38058 |
| HPV45 | L1 | DLDQYPLGR | 488 | 9 | | 38059 |
| HPV45 | L1 | DLDQYPLGRK | 488 | 10 | | 38060 |
| HPV45 | L1 | DLDQYPLGRKF | 488 | 11 | | 38061 |
| HPV45 | L1 | DLYIKGTSA | 301 | 9 | | 38062 |
| HPV45 | L1 | DMVDTGYGA | 226 | 9 | | 38063 |
| HPV45 | L1 | DSMFFCLR | 271 | 8 | | 38064 |
| HPV45 | L1 | DSMFFCLRR | 271 | 9 | | 38065 |
| HPV45 | L1 | DSQLFNKPY | 332 | 9 | | 38066 |
| HPV45 | L1 | DSTIYNPETQR | 114 | 11 | | 38067 |
| HPV45 | L1 | DTESAHAA | 155 | 8 | | 38068 |
| HPV45 | L1 | DTESAHAATA | 155 | 10 | | 38069 |
| HPV45 | L1 | DTGYGAMDF | 229 | 9 | | 38070 |
| HPV45 | L1 | DTTPPEKQDPY | 461 | 11 | | 38071 |
| HPV45 | L1 | DTVPTDLY | 296 | 8 | | 38072 |
| HPV45 | L1 | DTVPTDLYIK | 296 | 10 | | 38073 |
| HPV45 | L1 | DTYRFVQSVA | 446 | 10 | | 38074 |
| HPV45 | L1 | DVRDNVSVDY | 169 | 10 | | 38075 |
| HPV45 | L1 | DVRDNVSVDYK | 169 | 11 | | 38076 |
| HPV45 | L1 | EDGDMVDTGY | 223 | 10 | | 38077 |
| HPV45 | L1 | ESAHAATA | 157 | 8 | | 38078 |
| HPV45 | L1 | ETPGSCVY | 313 | 8 | | 38079 |
| HPV45 | L1 | ETQRLVWA | 121 | 8 | | 38080 |
| HPV45 | L1 | FARHFWNR | 283 | 8 | | 38081 |
| HPV45 | L1 | FARHFWNRA | 283 | 9 | | 38082 |
| HPV45 | L1 | FCLRREQLF | 275 | 9 | | 38083 |
| HPV45 | L1 | FCLRREQLFA | 275 | 10 | | 38084 |
| HPV45 | L1 | FCLRREQLFAR | 275 | 11 | | 38085 |
| HPV45 | L1 | FFCLRREQLF | 274 | 10 | | 38086 |
| HPV45 | L1 | FFCLRREQLFA | 274 | 11 | | 38087 |
| HPV45 | L1 | FGLPDSTIY | 110 | 9 | | 38088 |
| HPV45 | L1 | FLKNVNVF | 14 | 8 | | 38089 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | L1 | FLKNVNVFPIF | 14 | 11 | | 38090 |
| HPV45 | L1 | FLQMALWR | 24 | 8 | | 38091 |
| HPV45 | L1 | FLVQAGLR | 498 | 8 | | 38092 |
| HPV45 | L1 | FLVQAGLRR | 498 | 9 | | 38093 |
| HPV45 | L1 | FLVQAGLRRR | 498 | 10 | | 38094 |
| HPV45 | L1 | FSSDLDQY | 485 | 8 | | 38095 |
| HPV45 | L1 | FSTLQDTK | 237 | 8 | | 38096 |
| HPV45 | L1 | FVQSVAVTCQK | 450 | 11 | | 38097 |
| HPV45 | L1 | FVTVVDTTR | 359 | 9 | | 38098 |
| HPV45 | L1 | GAGNKQAVPK | 82 | 10 | | 38099 |
| HPV45 | L1 | GCVPAIGEH | 187 | 9 | | 38100 |
| HPV45 | L1 | GCVPAIGEHWA | 187 | 11 | | 38101 |
| HPV45 | L1 | GDCPPLELK | 210 | 9 | | 38102 |
| HPV45 | L1 | GDMVDTGY | 225 | 8 | | 38103 |
| HPV45 | L1 | GDMVDTGYGA | 225 | 10 | | 38104 |
| HPV45 | L1 | GDSMFFCLR | 270 | 9 | | 38105 |
| HPV45 | L1 | GDSMFFCLRR | 270 | 10 | | 38106 |
| HPV45 | L1 | GDTVPTDLY | 295 | 9 | | 38107 |
| HPV45 | L1 | GDTVPTDLYIK | 295 | 11 | | 38108 |
| HPV45 | L1 | GICWHNQLF | 351 | 9 | | 38109 |
| HPV45 | L1 | GIGLSGHPF | 141 | 9 | | 38110 |
| HPV45 | L1 | GIGLSGHPFY | 141 | 10 | | 38111 |
| HPV45 | L1 | GLPDSTIY | 111 | 8 | | 38112 |
| HPV45 | L1 | GLRRRPTIGPR | 503 | 11 | | 38113 |
| HPV45 | L1 | GLSGHPFY | 143 | 8 | | 38114 |
| HPV45 | L1 | GLSGHPFYNK | 143 | 10 | | 38115 |
| HPV45 | L1 | GSITTSDSQLF | 326 | 11 | | 38116 |
| HPV45 | L1 | HGIIIFLK | 9 | 8 | | 38117 |
| HPV45 | L1 | HVEEYDLQF | 396 | 9 | | 38118 |
| HPV45 | L1 | HVEEYDLQFIF | 396 | 11 | | 38119 |
| HPV45 | L1 | ICQSICKY | 251 | 8 | | 38120 |
| HPV45 | L1 | ICQSICKYPDY | 251 | 11 | | 38121 |
| HPV45 | L1 | ICWHNQLF | 352 | 8 | | 38122 |
| HPV45 | L1 | IFLKNVNVF | 13 | 9 | | 38123 |
| HPV45 | L1 | IFLQMALWR | 23 | 9 | | 38124 |
| HPV45 | L1 | IFQLCTITLTA | 405 | 11 | | 38125 |
| HPV45 | L1 | IFYHAGSSR | 59 | 9 | | 38126 |
| HPV45 | L1 | IGLSGHPF | 142 | 8 | | 38127 |
| HPV45 | L1 | IGLSGHPFY | 142 | 9 | | 38128 |
| HPV45 | L1 | IGLSGHPFYNK | 142 | 11 | | 38129 |
| HPV45 | L1 | IGPRKRPA | 510 | 8 | | 38130 |
| HPV45 | L1 | IGPRKRPAA | 510 | 9 | | 38131 |
| HPV45 | L1 | IIFLFNVNVF | 12 | 10 | | 38132 |
| HPV45 | L1 | IIIFLKNVNVF | 11 | 11 | | 38133 |
| HPV45 | L1 | IIYGHGIIIF | 5 | 10 | | 38134 |
| HPV45 | L1 | ILGCVPAIGEH | 185 | 11 | | 38135 |
| HPV45 | L1 | ITLTAEVMSY | 411 | 10 | | 38136 |
| HPV45 | L1 | ITTSDSQLF | 328 | 9 | | 38137 |
| HPV45 | L1 | ITTSDSQLFNK | 328 | 11 | | 38138 |
| HPV45 | L1 | KDTTPPEK | 460 | 8 | | 38139 |
| HPV45 | L1 | KFGLPDSTIY | 109 | 10 | | 38140 |
| HPV45 | L1 | KFKHYSRH | 389 | 8 | | 38141 |
| HPV45 | L1 | KFLVQAGLR | 497 | 9 | | 38142 |
| HPV45 | L1 | KFLVQAGLRR | 497 | 10 | | 38143 |
| HPV45 | L1 | KFLVQAGLRRR | 497 | 11 | | 38144 |
| HPV45 | L1 | KFSSDLDQY | 484 | 9 | | 38145 |
| HPV45 | L1 | KFWTVDLK | 475 | 8 | | 38146 |
| HPV45 | L1 | KFWTVDLKEK | 475 | 10 | | 38147 |
| HPV45 | L1 | KFWTVDLKEKF | 475 | 11 | | 38148 |
| HPV45 | L1 | KGTLCKPA | 198 | 8 | | 38149 |
| HPV45 | L1 | KGTSANMR | 305 | 8 | | 38150 |
| HPV45 | L1 | KLDDTESA | 152 | 8 | | 38151 |
| HPV45 | L1 | KLDDTESAH | 152 | 9 | | 38152 |
| HPV45 | L1 | KLDDTESAHA | 152 | 10 | | 38153 |
| HPV45 | L1 | KLDDTESAHAA | 152 | 11 | | 38154 |
| HPV45 | L1 | KLKFWTVDLK | 473 | 10 | | 38155 |
| HPV45 | L1 | KVSAYQYR | 91 | 8 | | 38156 |
| HPV45 | L1 | KVSAYQYRVF | 91 | 10 | | 38157 |
| HPV45 | L1 | KVSAYQYRVFR | 91 | 11 | | 38158 |
| HPV45 | L1 | LCILGCVPA | 183 | 9 | | 38159 |
| HPV45 | L1 | LCTITLTA | 408 | 8 | | 38160 |
| HPV45 | L1 | LDDTESAH | 153 | 8 | | 38161 |
| HPV45 | L1 | LDDTESAHA | 153 | 9 | | 38162 |
| HPV45 | L1 | LDDTESAHAA | 153 | 10 | | 38163 |
| HPV45 | L1 | LDICQSICK | 249 | 9 | | 38164 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | L1 | LDICQSICKY | 249 | 10 | | 38165 |
| HPV45 | L1 | LDQYPLGR | 489 | 8 | | 38166 |
| HPV45 | L1 | LDQYPLGRK | 489 | 9 | | 38167 |
| HPV45 | L1 | LDQYPLGRKF | 489 | 10 | | 38168 |
| HPV45 | L1 | LFARHFWNR | 282 | 9 | | 38169 |
| HPV45 | L1 | LFARHFWNRA | 282 | 10 | | 38170 |
| HPV45 | L1 | LFNKPYWLH | 335 | 9 | | 38171 |
| HPV45 | L1 | LFNKPYWLHK | 335 | 10 | | 38172 |
| HPV45 | L1 | LFNKPYWLHKA | 335 | 11 | | 38173 |
| HPV45 | L1 | LFVTVVDTTR | 358 | 10 | | 38174 |
| HPV45 | L1 | LGCVPAIGEH | 186 | 10 | | 38175 |
| HPV45 | L1 | LGIGLSGH | 140 | 8 | | 38176 |
| HPV45 | L1 | LGIGLSGHPF | 140 | 10 | | 38177 |
| HPV45 | L1 | LGIGLSGHPFY | 140 | 11 | | 38178 |
| HPV45 | L1 | LGRKFLVQA | 494 | 9 | | 38179 |
| HPV45 | L1 | LLTVGNPY | 68 | 8 | | 38180 |
| HPV45 | L1 | LLTVGNPYF | 68 | 9 | | 38181 |
| HPV45 | L1 | LLTVGNPYFR | 68 | 10 | | 38182 |
| HPV45 | L1 | LSGHPFYNK | 144 | 9 | | 38183 |
| HPV45 | L1 | LTAEVMSY | 413 | 8 | | 38184 |
| HPV45 | L1 | LTAEVMSYIH | 413 | 10 | | 38185 |
| HPV45 | L1 | LTVGNPYF | 69 | 8 | | 38186 |
| HPV45 | L1 | LTVGNPYFR | 69 | 9 | | 38187 |
| HPV45 | L1 | LVQAGLRR | 499 | 8 | | 38188 |
| HPV45 | L1 | LVQAGLRRR | 499 | 9 | | 38189 |
| HPV45 | L1 | MAHNIIYGH | 1 | 9 | | 38190 |
| HPV45 | L1 | MDFSTLQDTK | 235 | 10 | | 38191 |
| HPV45 | L1 | MFFCLRREQLF | 273 | 11 | | 38192 |
| HPV45 | L1 | MGDTVPTDLY | 294 | 10 | | 38193 |
| HPV45 | L1 | MSADPYGDSMF | 264 | 11 | | 38194 |
| HPV45 | L1 | MVDTGYGA | 227 | 8 | | 38195 |
| HPV45 | L1 | MVDTGYGAMDF | 227 | 11 | | 38196 |
| HPV45 | L1 | NGICWHNQLF | 350 | 10 | | 38197 |
| HPV45 | L1 | NIIYGHGIIF | 4 | 11 | | 38198 |
| HPV45 | L1 | NMRETPGSCVY | 310 | 11 | | 38199 |
| HPV45 | L1 | NSSILENWNF | 425 | 10 | | 38200 |
| HPV45 | L1 | NTDDYVSR | 49 | 8 | | 38201 |
| HPV45 | L1 | NTYDPTKF | 383 | 8 | | 38202 |
| HPV45 | L1 | NTYDPTKFK | 383 | 9 | | 38203 |
| HPV45 | L1 | NTYDPTKFKH | 383 | 10 | | 38204 |
| HPV45 | L1 | NTYDPTKFKHY | 383 | 11 | | 38205 |
| HPV45 | L1 | NVFPIFLQMA | 19 | 10 | | 38206 |
| HPV45 | L1 | NVNVFPIF | 17 | 8 | | 38207 |
| HPV45 | L1 | PAASTSTA | 516 | 8 | | 38208 |
| HPV45 | L1 | PAASTSTASR | 516 | 10 | | 38209 |
| HPV45 | L1 | PAIGEHWA | 190 | 8 | | 38210 |
| HPV45 | L1 | PAIGEHWAK | 190 | 9 | | 38211 |
| HPV45 | L1 | PAKRVRIR | 526 | 8 | | 38212 |
| HPV45 | L1 | PAKRVRIRSK | 526 | 10 | | 38213 |
| HPV45 | L1 | PAKRVRIRSKK | 526 | 11 | | 38214 |
| HPV45 | L1 | PDYLQMSA | 259 | 8 | | 38215 |
| HPV45 | L1 | PDYLQMSADPY | 259 | 11 | | 38216 |
| HPV45 | L1 | PGDCPPLELK | 209 | 10 | | 38217 |
| HPV45 | L1 | PIFLQMALWR | 22 | 10 | | 38218 |
| HPV45 | L1 | PLDICQSICK | 248 | 10 | | 38219 |
| HPV45 | L1 | PLDICQSICKY | 248 | 11 | | 38220 |
| HPV45 | L1 | PLGIGLSGH | 139 | 9 | | 38221 |
| HPV45 | L1 | PLGIGLSGHPF | 139 | 11 | | 38222 |
| HPV45 | L1 | PLGRKFLVQA | 493 | 10 | | 38223 |
| HPV45 | L1 | PSGAGNKQA | 80 | 9 | | 38224 |
| HPV45 | L1 | PTDLYIKGTSA | 299 | 11 | | 38225 |
| HPV45 | L1 | PTIGPRKR | 508 | 8 | | 38226 |
| HPV45 | L1 | PTIGPRKRPA | 508 | 10 | | 38227 |
| HPV45 | L1 | PTIGPRKRPAA | 508 | 11 | | 38228 |
| HPV45 | L1 | PTKFKHYSR | 387 | 9 | | 38229 |
| HPV45 | L1 | PTKFKHYSRH | 387 | 10 | | 38230 |
| HPV45 | L1 | PTTSLVDTY | 440 | 9 | | 38231 |
| HPV45 | L1 | PTTSLVDTYR | 440 | 10 | | 38232 |
| HPV45 | L1 | PTTSLVDTYRF | 440 | 11 | | 38233 |
| HPV45 | L1 | PVPNTYDPTK | 380 | 10 | | 38234 |
| HPV45 | L1 | PVPNTYDPTKF | 380 | 11 | | 38235 |
| HPV45 | L1 | QAVPKVSA | 87 | 8 | | 38236 |
| HPV45 | L1 | QAVPKVSAY | 87 | 9 | | 38237 |
| HPV45 | L1 | QAVPKVSAYQY | 87 | 11 | | 38238 |
| HPV45 | L1 | QDPYDKLK | 468 | 8 | | 38239 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | L1 | QDPYDKLKF | 468 | 9 | | 38240 |
| HPV45 | L1 | QDVRDNVSVDY | 168 | 11 | | 38241 |
| HPV45 | L1 | QGHNNGICWH | 346 | 10 | | 38242 |
| HPV45 | L1 | QLCILGCVPA | 182 | 10 | | 38243 |
| HPV45 | L1 | QLCTITLTA | 407 | 9 | | 38244 |
| HPV45 | L1 | QLFARHFWNR | 281 | 10 | | 38245 |
| HPV45 | L1 | QLFARHFWNRA | 281 | 11 | | 38246 |
| HPV45 | L1 | QLFNKPYWLH | 334 | 10 | | 38247 |
| HPV45 | L1 | QLFNKPYWLHK | 334 | 11 | | 38248 |
| HPV45 | L1 | QLFVTVVDTTR | 357 | 11 | | 38249 |
| HPV45 | L1 | QSICKYPDY | 253 | 9 | | 38250 |
| HPV45 | L1 | QSVAVTCQK | 452 | 9 | | 38251 |
| HPV45 | L1 | RDNVSVDY | 171 | 8 | | 38252 |
| HPV45 | L1 | RDNVSVDYK | 171 | 9 | | 38253 |
| HPV45 | L1 | RLLTVGNPY | 67 | 9 | | 38254 |
| HPV45 | L1 | RLLTVGNPYF | 67 | 10 | | 38255 |
| HPV45 | L1 | RLLTVGNPYFR | 67 | 11 | | 38256 |
| HPV45 | L1 | RSTNLTLCA | 367 | 9 | | 38257 |
| HPV45 | L1 | RTSIFYHA | 56 | 8 | | 38258 |
| HPV45 | L1 | RVALPDPNK | 101 | 9 | | 38259 |
| HPV45 | L1 | RVALPDPNKF | 101 | 10 | | 38260 |
| HPV45 | L1 | RVRIRSKK | 529 | 8 | | 38261 |
| HPV45 | L1 | RVVNTDDY | 46 | 8 | | 38262 |
| HPV45 | L1 | RVVNTDDYVSR | 46 | 11 | | 38263 |
| HPV45 | L1 | RVVPSGAGNK | 77 | 10 | | 38264 |
| HPV45 | L1 | SADPYGDSMF | 265 | 10 | | 38265 |
| HPV45 | L1 | SADPYGDSMFF | 265 | 11 | | 38266 |
| HPV45 | L1 | SAYQYRVF | 93 | 8 | | 38267 |
| HPV45 | L1 | SAYQYRVFR | 93 | 9 | | 38268 |
| HPV45 | L1 | SAYQYRVFRVA | 93 | 11 | | 38269 |
| HPV45 | L1 | SDLDQYPLGR | 487 | 10 | | 38270 |
| HPV45 | L1 | SDLDQYPLGRK | 487 | 11 | | 38271 |
| HPV45 | L1 | SDSQLFNK | 331 | 8 | | 38272 |
| HPV45 | L1 | SDSQLFNKPY | 331 | 10 | | 38273 |
| HPV45 | L1 | SGAGNKQA | 81 | 8 | | 38274 |
| HPV45 | L1 | SGAGNKQAVPK | 81 | 11 | | 38275 |
| HPV45 | L1 | SGHPFYNK | 145 | 8 | | 38276 |
| HPV45 | L1 | SICKYPDY | 254 | 8 | | 38277 |
| HPV45 | L1 | SIFYHAGSSR | 58 | 10 | | 38278 |
| HPV45 | L1 | SILENWNF | 427 | 8 | | 38279 |
| HPV45 | L1 | SITTSDSQLF | 327 | 10 | | 38280 |
| HPV45 | L1 | SLVDTYRF | 443 | 8 | | 38281 |
| HPV45 | L1 | SMFFCLRR | 272 | 8 | | 38282 |
| HPV45 | L1 | SSDLDQYPLGR | 486 | 11 | | 38283 |
| HPV45 | L1 | SSILENWNF | 426 | 9 | | 38284 |
| HPV45 | L1 | SSRLLTVGNPY | 65 | 11 | | 38285 |
| HPV45 | L1 | STASRPAK | 521 | 8 | | 38286 |
| HPV45 | L1 | STASRPAKR | 521 | 9 | | 38287 |
| HPV45 | L1 | STASRPAKRVR | 521 | 11 | | 38288 |
| HPV45 | L1 | STIYNPETQR | 115 | 10 | | 38289 |
| HPV45 | L1 | STNLTLCA | 368 | 8 | | 38290 |
| HPV45 | L1 | STQNPVPNTY | 376 | 10 | | 38291 |
| HPV45 | L1 | STSTASRPA | 519 | 9 | | 38292 |
| HPV45 | L1 | STSTASRPAK | 519 | 10 | | 38293 |
| HPV45 | L1 | STSTASRPAKR | 519 | 11 | | 38294 |
| HPV45 | L1 | STVYLPPPSVA | 35 | 11 | | 38295 |
| HPV45 | L1 | SVARVVNTDDY | 43 | 11 | | 38296 |
| HPV45 | L1 | SVAVTCQK | 453 | 8 | | 38297 |
| HPV45 | L1 | TAEVMSYIH | 414 | 9 | | 38298 |
| HPV45 | L1 | TASRPAKR | 522 | 8 | | 38299 |
| HPV45 | L1 | TASRPAKRVR | 522 | 10 | | 38300 |
| HPV45 | L1 | TAVITQDVR | 163 | 9 | | 38301 |
| HPV45 | L1 | TCQKDTTPPEK | 457 | 11 | | 38302 |
| HPV45 | L1 | TDDYVSRTSIF | 50 | 11 | | 38303 |
| HPV45 | L1 | TDLYIKGTSA | 300 | 10 | | 38304 |
| HPV45 | L1 | TGYGAMDF | 230 | 8 | | 38305 |
| HPV45 | L1 | TIGPRKRPA | 509 | 9 | | 38306 |
| HPV45 | L1 | TIGPRKRPAA | 509 | 10 | | 38307 |
| HPV45 | L1 | TITLTAEVMSY | 410 | 11 | | 38308 |
| HPV45 | L1 | TIYNPETQR | 116 | 9 | | 38309 |
| HPV45 | L1 | TLTAEVMSY | 412 | 9 | | 38310 |
| HPV45 | L1 | TLTAEVMSYIH | 412 | 11 | | 38311 |
| HPV45 | L1 | TSDSQLFNK | 330 | 9 | | 38312 |
| HPV45 | L1 | TSDSQLFNKPY | 330 | 11 | | 38313 |
| HPV45 | L1 | TSIFYHAGSSR | 57 | 11 | | 38314 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | L1 | TSLVDTYR | 442 | 8 | | 38315 |
| HPV45 | L1 | TSLVDTYRF | 442 | 9 | | 38316 |
| HPV45 | L1 | TSTASRPA | 520 | 8 | | 38317 |
| HPV45 | L1 | TSTASRPAK | 520 | 9 | | 38318 |
| HPV45 | L1 | TSTASRPAKR | 520 | 10 | | 38319 |
| HPV45 | L1 | TTPPEKQDPY | 462 | 10 | | 38320 |
| HPV45 | L1 | TTRSTNLTLCA | 365 | 11 | | 38321 |
| HPV45 | L1 | TTSDSQLF | 329 | 8 | | 38322 |
| HPV45 | L1 | TTSDSQLFNK | 329 | 10 | | 38323 |
| HPV45 | L1 | TTSLVDTY | 441 | 8 | | 38324 |
| HPV45 | L1 | TTSLVDTYR | 441 | 9 | | 38325 |
| HPV45 | L1 | TTSLVDTYRF | 441 | 10 | | 38326 |
| HPV45 | L1 | TVDLKEKF | 478 | 8 | | 38327 |
| HPV45 | L1 | TVGNPYFR | 70 | 8 | | 38328 |
| HPV45 | L1 | TVPTDLYIK | 297 | 9 | | 38329 |
| HPV45 | L1 | TVYLPPPSVA | 36 | 10 | | 38330 |
| HPV45 | L1 | TVYLPPPSVAR | 36 | 11 | | 38331 |
| HPV45 | L1 | VALPDPNK | 102 | 8 | | 38332 |
| HPV45 | L1 | VALPDPNKF | 102 | 9 | | 38333 |
| HPV45 | L1 | VARVVNTDDY | 44 | 10 | | 38334 |
| HPV45 | L1 | VDTGYGAMDF | 228 | 10 | | 38335 |
| HPV45 | L1 | VDTYRFVQSVA | 445 | 11 | | 38336 |
| HPV45 | L1 | VFPIFLQMA | 20 | 9 | | 38337 |
| HPV45 | L1 | VFRVALPDPNK | 99 | 11 | | 38338 |
| HPV45 | L1 | VMGDTVPTDLY | 293 | 11 | | 38339 |
| HPV45 | L1 | VSAYQYRVF | 92 | 9 | | 38340 |
| HPV45 | L1 | VSAYQYRVFR | 92 | 10 | | 38341 |
| HPV45 | L1 | VSRTSIFY | 54 | 8 | | 38342 |
| HPV45 | L1 | VSRTSIFYH | 54 | 9 | | 38343 |
| HPV45 | L1 | VSRTSIFYHA | 54 | 10 | | 38344 |
| HPV45 | L1 | VTVVDTTR | 360 | 8 | | 38345 |
| HPV45 | L1 | VVNTDDYVSR | 47 | 10 | | 38346 |
| HPV45 | L1 | VVPSGAGNK | 78 | 9 | | 38347 |
| HPV45 | L1 | VVPSGAGNKQA | 78 | 11 | | 38348 |
| HPV45 | L1 | WACVGMEIGR | 127 | 10 | | 38349 |
| HPV45 | L1 | WAKGTLCK | 196 | 8 | | 38350 |
| HPV45 | L1 | WAKGTLCKPA | 196 | 10 | | 38351 |
| HPV45 | L1 | WLHKAQGH | 341 | 8 | | 38352 |
| HPV45 | L1 | WTVDLKEK | 477 | 8 | | 38353 |
| HPV45 | L1 | WTVDLKEKF | 477 | 9 | | 38354 |
| HPV45 | L1 | YDPTKFKH | 385 | 8 | | 38355 |
| HPV45 | L1 | YDPTKFKHY | 385 | 9 | | 38356 |
| HPV45 | L1 | YDPTKFKHYSR | 385 | 11 | | 38357 |
| HPV45 | L1 | YFRVVPSGA | 75 | 9 | | 38358 |
| HPV45 | L1 | YGDSMFFCLR | 269 | 10 | | 38359 |
| HPV45 | L1 | YGDSMFFCLRR | 269 | 11 | | 38360 |
| HPV45 | L1 | YGHGIIIF | 7 | 8 | | 38361 |
| HPV45 | L1 | YGHGIIIFLK | 7 | 10 | | 38362 |
| HPV45 | L1 | YIKGTSANMR | 303 | 10 | | 38363 |
| HPV45 | L1 | YLPPPSVA | 38 | 8 | | 38364 |
| HPV45 | L1 | YLPPPSVAR | 38 | 9 | | 38365 |
| HPV45 | L1 | YLQMSADPY | 261 | 9 | | 38366 |
| HPV45 | L1 | YSRHVEEY | 393 | 8 | | 38367 |
| HPV45 | L1 | YVSRTSIF | 53 | 8 | | 38368 |
| HPV45 | L1 | YVSRTSIFY | 53 | 9 | | 38369 |
| HPV45 | L1 | YVSRTSIFYH | 53 | 10 | | 38370 |
| HPV45 | L1 | YVSRTSIFYHA | 53 | 11 | | 38371 |
| HPV45 | L2 | AARRKRASA | 6 | 9 | | 38372 |
| HPV45 | L2 | ALSSRRGTVR | 286 | 10 | | 38373 |
| HPV45 | L2 | ALSSRRGTVRF | 286 | 11 | | 38374 |
| HPV45 | L2 | ASATDLYR | 12 | 8 | | 38375 |
| HPV45 | L2 | ASATDLYRTCK | 12 | 11 | | 38376 |
| HPV45 | L2 | ASGAPVPTF | 114 | 9 | | 38377 |
| HPV45 | L2 | ASTTPSTIH | 357 | 9 | | 38378 |
| HPV45 | L2 | ASTTPSTIHK | 357 | 10 | | 38379 |
| HPV45 | L2 | ASTTTYIGIH | 423 | 10 | | 38380 |
| HPV45 | L2 | ATDLYRTCK | 14 | 9 | | 38381 |
| HPV45 | L2 | ATMFTRSGK | 303 | 9 | | 38382 |
| HPV45 | L2 | ATNDSDLF | 340 | 8 | | 38383 |
| HPV45 | L2 | ATNDSDLFDVY | 340 | 11 | | 38384 |
| HPV45 | L2 | DFMDIIRLH | 275 | 9 | | 38385 |
| HPV45 | L2 | DFMDIIRLHR | 275 | 10 | | 38386 |
| HPV45 | L2 | DIIRLHRPA | 278 | 9 | | 38387 |
| HPV45 | L2 | DLFDVYADF | 345 | 9 | | 38388 |
| HPV45 | L2 | DSDFMDIIR | 273 | 9 | | 38389 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | L2 | DSDFMDIIRLH | 273 | 11 | | 38390 |
| HPV45 | L2 | DSDLFDVY | 343 | 8 | | 38391 |
| HPV45 | L2 | DSDLFDVYA | 343 | 9 | | 38392 |
| HPV45 | L2 | DSDLFDVYADF | 343 | 11 | | 38393 |
| HPV45 | L2 | DSSVVASGA | 109 | 9 | | 38394 |
| HPV45 | L2 | DSVSISSTSF | 148 | 10 | | 38395 |
| HPV45 | L2 | DVYADFPPPA | 348 | 10 | | 38396 |
| HPV45 | L2 | EDSSVVASGA | 108 | 10 | | 38397 |
| HPV45 | L2 | EGTTLADK | 36 | 8 | | 38398 |
| HPV45 | L2 | EIELQPLISA | 331 | 10 | | 38399 |
| HPV45 | L2 | EIPLQTFA | 194 | 8 | | 38400 |
| HPV45 | L2 | EITSSGTTTPA | 129 | 11 | | 38401 |
| HPV45 | L2 | ELQPLISA | 333 | 8 | | 38402 |
| HPV45 | L2 | FADGFVAA | 456 | 8 | | 38403 |
| HPV45 | L2 | FDVYADFPPPA | 347 | 11 | | 38404 |
| HPV45 | L2 | FFADGFVA | 455 | 8 | | 38405 |
| HPV45 | L2 | FFADGFVAA | 455 | 9 | | 38406 |
| HPV45 | L2 | FLTHPSSLVTF | 241 | 11 | | 38407 |
| HPV45 | L2 | FMDIIRLH | 276 | 8 | | 38408 |
| HPV45 | L2 | FMDIIRLHR | 276 | 9 | | 38409 |
| HPV45 | L2 | FMDIIRLHRPA | 276 | 11 | | 38410 |
| HPV45 | L2 | FSRLGQRA | 296 | 8 | | 38411 |
| HPV45 | L2 | FSRLGQRATMF | 296 | 11 | | 38412 |
| HPV45 | L2 | FTRSGKQIGGR | 306 | 11 | | 38413 |
| HPV45 | L2 | FVGTPTSGSH | 181 | 10 | | 38414 |
| HPV45 | L2 | GGRVHFYH | 314 | 8 | | 38415 |
| HPV45 | L2 | GIGTGSGSGGR | 58 | 11 | | 38416 |
| HPV45 | L2 | GIHGTQYY | 430 | 8 | | 38417 |
| HPV45 | L2 | GSGGRTGY | 64 | 8 | | 38418 |
| HPV45 | L2 | GSGSGGRTGY | 62 | 10 | | 38419 |
| HPV45 | L2 | GTCPPDVINK | 25 | 10 | | 38420 |
| HPV45 | L2 | GTGSGSGGR | 60 | 9 | | 38421 |
| HPV45 | L2 | GTPTSGSH | 183 | 8 | | 38422 |
| HPV45 | L2 | GTPTSGSHGY | 183 | 10 | | 38423 |
| HPV45 | L2 | GTQYYLWPWY | 433 | 10 | | 38424 |
| HPV45 | L2 | GTQYYLWPWYY | 433 | 11 | | 38425 |
| HPV45 | L2 | GTVRFSRLGQR | 292 | 11 | | 38426 |
| HPV45 | L2 | HDISPIAA | 321 | 8 | | 38427 |
| HPV45 | L2 | HFYHDISPIA | 318 | 10 | | 38428 |
| HPV45 | L2 | HFYHDISPIAA | 318 | 11 | | 38429 |
| HPV45 | L2 | HGTQYYLWPWY | 432 | 11 | | 38430 |
| HPV45 | L2 | HGYEEIPLQTF | 190 | 11 | | 38431 |
| HPV45 | L2 | IFVGTPTSGSH | 180 | 11 | | 38432 |
| HPV45 | L2 | IGGRVHFY | 313 | 8 | | 38433 |
| HPV45 | L2 | IGGRVHFYH | 313 | 9 | | 38434 |
| HPV45 | L2 | IGIHGTQY | 429 | 8 | | 38435 |
| HPV45 | L2 | IGIHGTQYY | 429 | 9 | | 38436 |
| HPV45 | L2 | IGTGSGSGGR | 59 | 10 | | 38437 |
| HPV45 | L2 | IIRLHRPA | 279 | 8 | | 38438 |
| HPV45 | L2 | ILQWSSLGIF | 44 | 10 | | 38439 |
| HPV45 | L2 | ISATNDSDLF | 338 | 10 | | 38440 |
| HPV45 | L2 | ISSTPLPTVR | 210 | 10 | | 38441 |
| HPV45 | L2 | ISSTPLPTVRR | 210 | 11 | | 38442 |
| HPV45 | L2 | ISSTSFTNPA | 152 | 10 | | 38443 |
| HPV45 | L2 | ISSTSFTNPAF | 152 | 11 | | 38444 |
| HPV45 | L2 | ITSSGTTTPA | 130 | 10 | | 38445 |
| HPV45 | L2 | KILQWSSLGIF | 43 | 11 | | 38446 |
| HPV45 | L2 | KSFTYPKY | 366 | 8 | | 38447 |
| HPV45 | L2 | KVEGTTLA | 34 | 8 | | 38448 |
| HPV45 | L2 | KVEGTTLADK | 34 | 10 | | 38449 |
| HPV45 | L2 | LFDVYADF | 346 | 8 | | 38450 |
| HPV45 | L2 | LGQRATMF | 299 | 8 | | 38451 |
| HPV45 | L2 | LGQRATMFTR | 299 | 10 | | 38452 |
| HPV45 | L2 | LISATNDSDLF | 337 | 11 | | 38453 |
| HPV45 | L2 | LSSRRGTVR | 287 | 9 | | 38454 |
| HPV45 | L2 | LSSRRGTVRF | 287 | 10 | | 38455 |
| HPV45 | L2 | LTHPSSLVTF | 242 | 10 | | 38456 |
| HPV45 | L2 | LTMPSTAA | 375 | 8 | | 38457 |
| HPV45 | L2 | LTMPSTAASSY | 375 | 11 | | 38458 |
| HPV45 | L2 | LTSAWDVPIY | 392 | 10 | | 38459 |
| HPV45 | L2 | LVEDSSVVA | 106 | 9 | | 38460 |
| HPV45 | L2 | LVTFDNPA | 248 | 8 | | 38461 |
| HPV45 | L2 | LVTFDNPAY | 248 | 9 | | 38462 |
| HPV45 | L2 | MDIIRLHR | 277 | 8 | | 38463 |
| HPV45 | L2 | MDIIRLHRPA | 277 | 10 | | 38464 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | L2 | MVSHRAAR | 1 | 8 | | 38465 |
| HPV45 | L2 | MVSHRAARR | 1 | 9 | | 38466 |
| HPV45 | L2 | MVSHRAARRK | 1 | 10 | | 38467 |
| HPV45 | L2 | MVSHRAARRKR | 1 | 11 | | 38468 |
| HPV45 | L2 | NASTTTYIGIH | 422 | 11 | | 38469 |
| HPV45 | L2 | NDSDLFDVY | 342 | 9 | | 38470 |
| HPV45 | L2 | NDSDLFDVYA | 342 | 10 | | 38471 |
| HPV45 | L2 | NTVVDVGPTR | 79 | 10 | | 38472 |
| HPV45 | L2 | NVTVPLTSA | 387 | 9 | | 38473 |
| HPV45 | L2 | PALSSRRGTVR | 285 | 11 | | 38474 |
| HPV45 | L2 | PASTTPSTIH | 356 | 10 | | 38475 |
| HPV45 | L2 | PASTTPSTIHK | 356 | 11 | | 38476 |
| HPV45 | L2 | PDIILPSH | 404 | 8 | | 38477 |
| HPV45 | L2 | PDSDFMDIIR | 272 | 10 | | 38478 |
| HPV45 | L2 | PISSTPLPTVR | 209 | 11 | | 38479 |
| HPV45 | L2 | PLDTTLSF | 258 | 8 | | 38480 |
| HPV45 | L2 | PLPTVRRVR | 214 | 9 | | 38481 |
| HPV45 | L2 | PLTSAWDVPIY | 391 | 11 | | 38482 |
| HPV45 | L2 | PMWPSTSPTNA | 413 | 11 | | 38483 |
| HPV45 | L2 | PSSLVTFDNPA | 245 | 11 | | 38484 |
| HPV45 | L2 | PSTAASSY | 378 | 8 | | 38485 |
| HPV45 | L2 | PSTIHKSF | 361 | 8 | | 38486 |
| HPV45 | L2 | PSTIHKSFTY | 361 | 10 | | 38487 |
| HPV45 | L2 | PSTSPTNA | 416 | 8 | | 38488 |
| HPV45 | L2 | PTFTGTSGF | 120 | 9 | | 38489 |
| HPV45 | L2 | PTNASTTTY | 420 | 9 | | 38490 |
| HPV45 | L2 | PTSGSHGY | 185 | 8 | | 38491 |
| HPV45 | L2 | PTSNVPDSDF | 267 | 10 | | 38492 |
| HPV45 | L2 | PTVRRVRGPR | 216 | 10 | | 38493 |
| HPV45 | L2 | PVPTFTGTSGF | 118 | 11 | | 38494 |
| HPV45 | L2 | QIGGRVHF | 312 | 8 | | 38495 |
| HPV45 | L2 | QIGGRVHFY | 312 | 9 | | 38496 |
| HPV45 | L2 | QIGGRVHFYH | 312 | 10 | | 38497 |
| HPV45 | L2 | QTGEVSGNIF | 172 | 10 | | 38498 |
| HPV45 | L2 | QVRVSTSQF | 233 | 9 | | 38499 |
| HPV45 | L2 | RAARRKRA | 5 | 8 | | 38500 |
| HPV45 | L2 | RAARRKRASA | 5 | 10 | | 38501 |
| HPV45 | L2 | RASATDLY | 11 | 8 | | 38502 |
| HPV45 | L2 | RASATDLYR | 11 | 9 | | 38503 |
| HPV45 | L2 | RATMFTRSGK | 302 | 10 | | 38504 |
| HPV45 | L2 | RFSRLGQR | 295 | 8 | | 38505 |
| HPV45 | L2 | RFSRLGQRA | 295 | 9 | | 38506 |
| HPV45 | L2 | RGPRLYSR | 222 | 8 | | 38507 |
| HPV45 | L2 | RGPRLYSRA | 222 | 9 | | 38508 |
| HPV45 | L2 | RGTVRFSR | 291 | 8 | | 38509 |
| HPV45 | L2 | RIPYFFADGF | 451 | 10 | | 38510 |
| HPV45 | L2 | RLGQRATMF | 298 | 9 | | 38511 |
| HPV45 | L2 | RLGQRATMFTR | 298 | 11 | | 38512 |
| HPV45 | L2 | RLHRPALSSR | 281 | 10 | | 38513 |
| HPV45 | L2 | RLHRPALSSRR | 281 | 11 | | 38514 |
| HPV45 | L2 | RLYSRANQQVR | 225 | 11 | | 38515 |
| HPV45 | L2 | RSGKQIGGR | 308 | 9 | | 38516 |
| HPV45 | L2 | RSGKQIGGRVH | 308 | 11 | | 38517 |
| HPV45 | L2 | RTGYVPLGGR | 68 | 10 | | 38518 |
| HPV45 | L2 | RVRGPRLY | 220 | 8 | | 38519 |
| HPV45 | L2 | RVRGPRLYSR | 220 | 10 | | 38520 |
| HPV45 | L2 | RVRGPRLYSRA | 220 | 11 | | 38521 |
| HPV45 | L2 | RVSTSQFLTH | 235 | 10 | | 38522 |
| HPV45 | L2 | SATDLYRTCK | 13 | 10 | | 38523 |
| HPV45 | L2 | SATNDSDLF | 339 | 9 | | 38524 |
| HPV45 | L2 | SAWDVPIY | 394 | 8 | | 38525 |
| HPV45 | L2 | SDFMDIIR | 274 | 8 | | 38526 |
| HPV45 | L2 | SDFMDIIRLH | 274 | 10 | | 38527 |
| HPV45 | L2 | SDFMDIIRLHR | 274 | 11 | | 38528 |
| HPV45 | L2 | SDLFDVYA | 344 | 8 | | 38529 |
| HPV45 | L2 | SDLFDVYADF | 344 | 10 | | 38530 |
| HPV45 | L2 | SGAPVPTF | 115 | 8 | | 38531 |
| HPV45 | L2 | SGKQIGGR | 309 | 8 | | 38532 |
| HPV45 | L2 | SGKQIGGRVH | 309 | 10 | | 38533 |
| HPV45 | L2 | SGKQIGGRVHF | 309 | 11 | | 38534 |
| HPV45 | L2 | SGSGGRTGY | 63 | 9 | | 38535 |
| HPV45 | L2 | SGTCPPDVINK | 24 | 11 | | 38536 |
| HPV45 | L2 | SISSTSFTNPA | 151 | 11 | | 38537 |
| HPV45 | L2 | SLTMPSTA | 374 | 8 | | 38538 |
| HPV45 | L2 | SLTMPSTAA | 374 | 9 | | 38539 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | L2 | SLVTFDNPA | 247 | 9 | | 38540 |
| HPV45 | L2 | SLVTFDNPAY | 247 | 10 | | 38541 |
| HPV45 | L2 | SSGTTTPA | 132 | 8 | | 38542 |
| HPV45 | L2 | SSLVTFDNPA | 246 | 10 | | 38543 |
| HPV45 | L2 | SSLVTFDNPAY | 246 | 11 | | 38544 |
| HPV45 | L2 | SSRRGTVR | 288 | 8 | | 38545 |
| HPV45 | L2 | SSRRGTVRF | 288 | 9 | | 38546 |
| HPV45 | L2 | SSRRGTVRFSR | 288 | 11 | | 38547 |
| HPV45 | L2 | SSTPLPTVR | 211 | 9 | | 38548 |
| HPV45 | L2 | SSTPLPTVRR | 211 | 10 | | 38549 |
| HPV45 | L2 | SSTSFTNPA | 153 | 9 | | 38550 |
| HPV45 | L2 | SSTSFTNPAF | 153 | 10 | | 38551 |
| HPV45 | L2 | SSVVASGA | 110 | 8 | | 38552 |
| HPV45 | L2 | STIHKSFTY | 362 | 9 | | 38553 |
| HPV45 | L2 | STIHKSFTYPK | 362 | 11 | | 38554 |
| HPV45 | L2 | STPLPTVR | 212 | 8 | | 38555 |
| HPV45 | L2 | STPLPTVRR | 212 | 9 | | 38556 |
| HPV45 | L2 | STPLPTVRRVR | 212 | 11 | | 38557 |
| HPV45 | L2 | STSFTNPA | 154 | 8 | | 38558 |
| HPV45 | L2 | STSFTNPAF | 154 | 9 | | 38559 |
| HPV45 | L2 | STSQFLTH | 237 | 8 | | 38560 |
| HPV45 | L2 | STTPSTIH | 358 | 8 | | 38561 |
| HPV45 | L2 | STTPSTIHK | 358 | 9 | | 38562 |
| HPV45 | L2 | STTPSTIHKSF | 358 | 11 | | 38563 |
| HPV45 | L2 | STTTYIGIH | 424 | 9 | | 38564 |
| HPV45 | L2 | SVSISSTSF | 149 | 9 | | 38565 |
| HPV45 | L2 | TCPPDVINK | 26 | 9 | | 38566 |
| HPV45 | L2 | TDLYRTCK | 15 | 8 | | 38567 |
| HPV45 | L2 | TFTGTSGF | 121 | 8 | | 38568 |
| HPV45 | L2 | TGEVSGNIF | 173 | 9 | | 38569 |
| HPV45 | L2 | TGPDIILPSH | 402 | 10 | | 38570 |
| HPV45 | L2 | TGSGSGGR | 61 | 8 | | 38571 |
| HPV45 | L2 | TGSGSGGRTGY | 61 | 11 | | 38572 |
| HPV45 | L2 | TGYVPLGGR | 69 | 9 | | 38573 |
| HPV45 | L2 | TIHKSFTY | 363 | 8 | | 38574 |
| HPV45 | L2 | TIHKSFTYPK | 363 | 10 | | 38575 |
| HPV45 | L2 | TIHKSFTYPKY | 363 | 11 | | 38576 |
| HPV45 | L2 | TLVEDSSVVA | 105 | 10 | | 38577 |
| HPV45 | L2 | TMFTRSGK | 304 | 8 | | 38578 |
| HPV45 | L2 | TMPSTAASSY | 376 | 10 | | 38579 |
| HPV45 | L2 | TSAWDVPIY | 393 | 9 | | 38580 |
| HPV45 | L2 | TSFTNPAF | 155 | 8 | | 38581 |
| HPV45 | L2 | TSNVPDSDF | 268 | 9 | | 38582 |
| HPV45 | L2 | TSPTNASTTTY | 418 | 11 | | 38583 |
| HPV45 | L2 | TSSGTTTPA | 131 | 9 | | 38584 |
| HPV45 | L2 | TTPSTIHK | 359 | 8 | | 38585 |
| HPV45 | L2 | TTPSTIHKSF | 359 | 10 | | 38586 |
| HPV45 | L2 | TTTYIGIH | 425 | 8 | | 38587 |
| HPV45 | L2 | TTYIGIHGTQY | 426 | 11 | | 38588 |
| HPV45 | L2 | TVRFSRLGQR | 293 | 10 | | 38589 |
| HPV45 | L2 | TVRFSRLGQRA | 293 | 11 | | 38590 |
| HPV45 | L2 | TVRRVRGPR | 217 | 9 | | 38591 |
| HPV45 | L2 | TVRRVRGPRLY | 217 | 11 | | 38592 |
| HPV45 | L2 | TVVDVGPTR | 80 | 9 | | 38593 |
| HPV45 | L2 | VASGAPVPTF | 113 | 10 | | 38594 |
| HPV45 | L2 | VDSVSISSTSF | 147 | 11 | | 38595 |
| HPV45 | L2 | VGTPTSGSH | 182 | 9 | | 38596 |
| HPV45 | L2 | VGTPTSGSHGY | 182 | 11 | | 38597 |
| HPV45 | L2 | VINKVEGTTLA | 31 | 11 | | 38598 |
| HPV45 | L2 | VSHRAARR | 2 | 8 | | 38599 |
| HPV45 | L2 | VSHRAARRK | 2 | 9 | | 38600 |
| HPV45 | L2 | VSHRAARRKR | 2 | 10 | | 38601 |
| HPV45 | L2 | VSHRAARRKRA | 2 | 11 | | 38602 |
| HPV45 | L2 | VSISSTSF | 150 | 8 | | 38603 |
| HPV45 | L2 | VSTSQFLTH | 236 | 9 | | 38604 |
| HPV45 | L2 | VTFDNPAY | 249 | 8 | | 38605 |
| HPV45 | L2 | VTLVEDSSVVA | 104 | 11 | | 38606 |
| HPV45 | L2 | VTVPLTSA | 388 | 8 | | 38607 |
| HPV45 | L2 | VVASGAPVPTF | 112 | 11 | | 38608 |
| HPV45 | L2 | VVDVGPTR | 81 | 8 | | 38609 |
| HPV45 | L2 | YADFPPPA | 350 | 8 | | 38610 |
| HPV45 | L2 | YFFADGFVA | 454 | 9 | | 38611 |
| HPV45 | L2 | YFFADGFVAA | 454 | 10 | | 38612 |
| HPV45 | L2 | YFPKKRKR | 444 | 8 | | 38613 |
| HPV45 | L2 | YFPKKRKRIPY | 444 | 11 | | 38614 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV45 | L2 | YIGIHGTQY | 428 | 9 | | 38615 |
| HPV45 | L2 | YIGIHGTQYY | 428 | 10 | | 38616 |
| HPV45 | L2 | YLWPWYYY | 437 | 8 | | 38617 |
| HPV45 | L2 | YLWPWYYYF | 437 | 9 | | 38618 |
| HPV45 | L2 | YLWPWYYYFPK | 437 | 11 | | 38619 |
| HPV45 | L2 | YSLTMPSTA | 373 | 9 | | 38620 |
| HPV45 | L2 | YSLTMPSTAA | 373 | 10 | | 38621 |
| HPV45 | L2 | YSNVTVPLTSA | 385 | 11 | | 38622 |
| HPV45 | L2 | YSRANQQVR | 227 | 9 | | 38623 |
| HPV45 | L2 | YTGPDIILPSH | 401 | 11 | | 38624 |
| HPV56 | E2 | AAVSHRPGK | 177 | 9 | | 38625 |
| HPV56 | E2 | AAVSHRPGKR | 177 | 10 | | 38626 |
| HPV56 | E2 | ACSAIEVQIA | 12 | 10 | | 38627 |
| HPV56 | E2 | ALESLSTTIY | 21 | 10 | | 38628 |
| HPV56 | E2 | AVSHRPGK | 178 | 8 | | 38629 |
| HPV56 | E2 | AVSHRPGKR | 178 | 9 | | 38630 |
| HPV56 | E2 | AVSHRPGKRPR | 178 | 11 | | 38631 |
| HPV56 | E2 | CCRYRFQK | 249 | 8 | | 38632 |
| HPV56 | E2 | CCRYRFQKY | 249 | 9 | | 38633 |
| HPV56 | E2 | CCRYRFQKYK | 249 | 10 | | 38634 |
| HPV56 | E2 | CFKKEGQH | 52 | 8 | | 38635 |
| HPV56 | E2 | CLQVCKAK | 4 | 8 | | 38636 |
| HPV56 | E2 | CLQVCKAKA | 4 | 9 | | 38637 |
| HPV56 | E2 | CMQYVAWK | 71 | 8 | | 38638 |
| HPV56 | E2 | CMQYVAWKY | 71 | 9 | | 38639 |
| HPV56 | E2 | CMQYVAWKYIY | 71 | 11 | | 38640 |
| HPV56 | E2 | CSAIEVQIA | 13 | 9 | | 38641 |
| HPV56 | E2 | CSGVDYRGIY | 92 | 10 | | 38642 |
| HPV56 | E2 | CSGVDYRGIYY | 92 | 11 | | 38643 |
| HPV56 | E2 | DAAVSHRPGK | 176 | 10 | | 38644 |
| HPV56 | E2 | DAAVSHRPGKR | 176 | 11 | | 38645 |
| HPV56 | E2 | DFEQEAKK | 113 | 8 | | 38646 |
| HPV56 | E2 | DFEQEAKKF | 113 | 9 | | 38647 |
| HPV56 | E2 | DGHKTYYTDF | 105 | 10 | | 38648 |
| HPV56 | E2 | DGSKNNCMQY | 65 | 10 | | 38649 |
| HPV56 | E2 | DSSRESHA | 195 | 8 | | 38650 |
| HPV56 | E2 | DSSRESHAK | 195 | 9 | | 38651 |
| HPV56 | E2 | DSVSSTCR | 140 | 8 | | 38652 |
| HPV56 | E2 | DSVSSTCRY | 140 | 9 | | 38653 |
| HPV56 | E2 | DTDNTDSR | 213 | 8 | | 38654 |
| HPV56 | E2 | DTDNTDSRSR | 213 | 10 | | 38655 |
| HPV56 | E2 | EAKKFGCK | 117 | 8 | | 38656 |
| HPV56 | E2 | EFDSSRESH | 193 | 9 | | 38657 |
| HPV56 | E2 | EFDSSRESHA | 193 | 10 | | 38658 |
| HPV56 | E2 | EFDSSRESHAK | 193 | 11 | | 38659 |
| HPV56 | E2 | EGQHIEVWF | 56 | 9 | | 38660 |
| HPV56 | E2 | ELWLTEPK | 43 | 8 | | 38661 |
| HPV56 | E2 | ELWLTEPKK | 43 | 9 | | 38662 |
| HPV56 | E2 | ELWLTEPKKCF | 43 | 11 | | 38663 |
| HPV56 | E2 | ESEFDSSR | 191 | 8 | | 38664 |
| HPV56 | E2 | ESEFDSSRESH | 191 | 11 | | 38665 |
| HPV56 | E2 | ESHAKCVTTH | 199 | 10 | | 38666 |
| HPV56 | E2 | ESLSTTIY | 23 | 8 | | 38667 |
| HPV56 | E2 | ETQRNSFLSH | 288 | 10 | | 38668 |
| HPV56 | E2 | ETVNEYNTH | 154 | 9 | | 38669 |
| HPV56 | E2 | ETVNEYNTHK | 154 | 10 | | 38670 |
| HPV56 | E2 | EVHMENESIY | 128 | 10 | | 38671 |
| HPV56 | E2 | EVWFDGSK | 61 | 8 | | 38672 |
| HPV56 | E2 | FDGSKNNCMQY | 64 | 11 | | 38673 |
| HPV56 | E2 | FDSSRESH | 194 | 8 | | 38674 |
| HPV56 | E2 | FDSSRESHA | 194 | 9 | | 38675 |
| HPV56 | E2 | FDSSRESHAK | 194 | 10 | | 38676 |
| HPV56 | E2 | FGCKNIWEVH | 121 | 10 | | 38677 |
| HPV56 | E2 | FLSHVKIPVVY | 294 | 11 | | 38678 |
| HPV56 | E2 | FVDVTSTY | 261 | 8 | | 38679 |
| HPV56 | E2 | FVDVTSTYH | 261 | 9 | | 38680 |
| HPV56 | E2 | GCKNIWEVH | 122 | 9 | | 38681 |
| HPV56 | E2 | GDKTTPVVH | 231 | 9 | | 38682 |
| HPV56 | E2 | GDKTTPVVHLK | 231 | 11 | | 38683 |
| HPV56 | E2 | GIYYVHDGH | 99 | 9 | | 38684 |
| HPV56 | E2 | GIYYVHDGHK | 99 | 10 | | 38685 |
| HPV56 | E2 | GSKNNCMQY | 66 | 9 | | 38686 |
| HPV56 | E2 | GSKNNCMQYVA | 66 | 11 | | 38687 |
| HPV56 | 12 | GVDYRGIY | 94 | 8 | | 38688 |
| HPV56 | E2 | GVDYRGIYY | 94 | 9 | | 38689 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | E2 | GVDYRGIYYVH | 94 | 11 | | 38690 |
| HPV56 | E2 | HAKCVTTH | 201 | 8 | | 38691 |
| HPV56 | E2 | HAKCVTTHTH | 201 | 10 | | 38692 |
| HPV56 | E2 | HDGHKTYY | 104 | 8 | | 38693 |
| HPV56 | E2 | HDGHKTYYTDF | 104 | 11 | | 38694 |
| HPV56 | E2 | HIEVWFDGSK | 59 | 10 | | 38695 |
| HPV56 | E2 | HISDTDNTDSR | 210 | 11 | | 38696 |
| HPV56 | E2 | HLKGEPNR | 239 | 8 | | 38697 |
| HPV56 | E2 | HLKGEPNRLK | 239 | 10 | | 38698 |
| HPV56 | E2 | HMENESIY | 130 | 8 | | 38699 |
| HPV56 | E2 | HVKIPVVY | 297 | 8 | | 38700 |
| HPV56 | E2 | HVKIPVVYR | 297 | 9 | | 38701 |
| HPV56 | E2 | IALESLSTTIY | 20 | 11 | | 38702 |
| HPV56 | E2 | IIYKDETQR | 283 | 9 | | 38703 |
| HPV56 | E2 | ISDTDNTDSR | 211 | 10 | | 38704 |
| HPV56 | E2 | ITIIYKDETQR | 281 | 11 | | 38705 |
| HPV56 | E2 | KACSAIEVQIA | 11 | 11 | | 38706 |
| HPV56 | E2 | KCCRYRFQK | 248 | 9 | | 38707 |
| HPV56 | E2 | KCCRYRFQKY | 248 | 10 | | 38708 |
| HPV56 | E2 | KCCRYRFQKYK | 248 | 11 | | 38709 |
| HPV56 | E2 | KCFKKEGQH | 51 | 9 | | 38710 |
| HPV56 | E2 | KCVTTHTH | 203 | 8 | | 38711 |
| HPV56 | E2 | KDETQRNSF | 286 | 9 | | 38712 |
| HPV56 | E2 | KFGCKNIWEVH | 120 | 11 | | 38713 |
| HPV56 | E2 | KGEPNRLK | 241 | 8 | | 38714 |
| HPV56 | E2 | KGEPNRLKCCR | 241 | 11 | | 38715 |
| HPV56 | E2 | KTLFVDVTSTY | 258 | 11 | | 38716 |
| HPV56 | E2 | KTTPVVHLK | 233 | 9 | | 38717 |
| HPV56 | E2 | KTYYTDFEQEA | 108 | 11 | | 38718 |
| HPV56 | E2 | KVCSGVDY | 90 | 8 | | 38719 |
| HPV56 | E2 | KVCSGVDYR | 90 | 9 | | 38720 |
| HPV56 | E2 | LFVDVTSTY | 260 | 9 | | 38721 |
| HPV56 | E2 | LFVDVTSTYH | 260 | 10 | | 38722 |
| HPV56 | E2 | LSHVKIPVVY | 295 | 10 | | 38723 |
| HPV56 | E2 | LSHVKIPVVYR | 295 | 11 | | 38724 |
| HPV56 | E2 | LTEPKKCF | 46 | 8 | | 38725 |
| HPV56 | E2 | LTEPKKCFK | 46 | 9 | | 38726 |
| HPV56 | E2 | LTEPKKCFKK | 46 | 10 | | 38727 |
| HPV56 | E2 | MVPCLQVCK | 1 | 9 | | 38728 |
| HPV56 | E2 | MVPCLQVCKA | 1 | 10 | | 38729 |
| HPV56 | E2 | MVPCLQVCKAK | 1 | 11 | | 38730 |
| HPV56 | E2 | NCMQYVAWK | 70 | 9 | | 38731 |
| HPV56 | E2 | NCMQYVAWKY | 70 | 10 | | 38732 |
| HPV56 | E2 | NGDCGWQK | 83 | 8 | | 38733 |
| HPV56 | E2 | NSFLSHVK | 292 | 8 | | 38734 |
| HPV56 | E2 | NVSPVETVNEY | 149 | 11 | | 38735 |
| HPV56 | E2 | PCLQVCKA | 3 | 8 | | 38736 |
| HPV56 | E2 | PCLQVCKAK | 3 | 9 | | 38737 |
| HPV56 | E2 | PCLQVCKAKA | 3 | 10 | | 38738 |
| HPV56 | E2 | PDSVSSTCR | 139 | 9 | | 38739 |
| HPV56 | E2 | PDSVSSTCRY | 139 | 10 | | 38740 |
| HPV56 | E2 | PGDKTTPVVH | 230 | 10 | | 38741 |
| HPV56 | E2 | PGKRPRLR | 183 | 8 | | 38742 |
| HPV56 | E2 | PVETVNEY | 152 | 8 | | 38743 |
| HPV56 | E2 | PVETVNEYNTH | 152 | 11 | | 38744 |
| HPV56 | E2 | PVVHLKGEPNR | 236 | 11 | | 38745 |
| HPV56 | E2 | PVVYRLVWDK | 301 | 10 | | 38746 |
| HPV56 | E2 | QDAAVSHR | 175 | 8 | | 38747 |
| HPV56 | E2 | QDAAVSHRPGK | 175 | 11 | | 38748 |
| HPV56 | E2 | QVCKAKACSA | 6 | 10 | | 38749 |
| HPV56 | E2 | RFQKYKTLF | 253 | 9 | | 38750 |
| HPV56 | E2 | RGIYYVHDGH | 98 | 10 | | 38751 |
| HPV56 | E2 | RGIYYVHDGHK | 98 | 11 | | 38752 |
| HPV56 | E2 | RLKCCRYR | 246 | 8 | | 38753 |
| HPV56 | E2 | RLKCCRYRF | 246 | 9 | | 38754 |
| HPV56 | E2 | RLKCCRYRFQK | 246 | 11 | | 38755 |
| HPV56 | E2 | RLRESEFDSSR | 188 | 11 | | 38756 |
| HPV56 | E2 | RSINNNNH | 222 | 8 | | 38757 |
| HPV56 | E2 | RSRSINNNNH | 220 | 10 | | 38758 |
| HPV56 | E2 | SAIEVQIA | 14 | 8 | | 38759 |
| HPV56 | E2 | SDTDNTDSR | 212 | 9 | | 38760 |
| HPV56 | E2 | SDTDNTDSRSR | 212 | 11 | | 38761 |
| HPV56 | E2 | SGVDYRGIY | 93 | 9 | | 38762 |
| HPV56 | E2 | SGVDYRGIYY | 93 | 10 | | 38763 |
| HPV56 | E2 | SIITIIYK | 279 | 8 | | 38764 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | E2 | SINNNNHPGDK | 223 | 11 | | 38765 |
| HPV56 | E2 | SSRESHAK | 196 | 8 | | 38766 |
| HPV56 | E2 | STSVGNQDA | 169 | 9 | | 38767 |
| HPV56 | E2 | STSVGNQDAA | 169 | 10 | | 38768 |
| HPV56 | E2 | STYHWTSTDNK | 266 | 11 | | 38769 |
| HPV56 | E2 | SVGNQDAA | 171 | 8 | | 38770 |
| HPV56 | E2 | SVGNQDAAVSH | 171 | 11 | | 38771 |
| HPV56 | E2 | SVSSTCRY | 141 | 8 | | 38772 |
| HPV56 | E2 | TCEELWLTEPK | 40 | 11 | | 38773 |
| HPV56 | E2 | TDFEQEAK | 112 | 8 | | 38774 |
| HPV56 | E2 | TDFEQEAKK | 112 | 9 | | 38775 |
| HPV56 | E2 | TDFEQEAKKF | 112 | 10 | | 38776 |
| HPV56 | E2 | TDNTDSRSR | 214 | 9 | | 38777 |
| HPV56 | E2 | TIIYKDETQR | 282 | 10 | | 38778 |
| HPV56 | E2 | TIYNNEEWTLR | 28 | 11 | | 38779 |
| HPV56 | E2 | TLFVDVTSTY | 259 | 10 | | 38780 |
| HPV56 | E2 | TLFVDVTSTYH | 259 | 11 | | 38781 |
| HPV56 | E2 | TSTDNKNY | 271 | 8 | | 38782 |
| HPV56 | E2 | TSTSVGNQDA | 168 | 10 | | 38783 |
| HPV56 | E2 | TSTSVGNQDAA | 168 | 11 | | 38784 |
| HPV56 | E2 | TSVGNQDA | 170 | 8 | | 38785 |
| HPV56 | E2 | TSVGNQDAA | 170 | 9 | | 38786 |
| HPV56 | E2 | TTPVVHLK | 234 | 8 | | 38787 |
| HPV56 | E2 | TTSTSVGNQDA | 167 | 11 | | 38788 |
| HPV56 | E2 | TVNEYNTH | 155 | 8 | | 38789 |
| HPV56 | E2 | TVNEYNTHK | 155 | 9 | | 38790 |
| HPV56 | E2 | VAWKYIYY | 75 | 8 | | 38791 |
| HPV56 | E2 | VCKAKACSA | 7 | 9 | | 38792 |
| HPV56 | E2 | VCSGVDYR | 91 | 8 | | 38793 |
| HPV56 | E2 | VCSGVDYRGIY | 91 | 11 | | 38794 |
| HPV56 | E2 | VDVTSTYH | 262 | 8 | | 38795 |
| HPV56 | E2 | VDYRGIYY | 95 | 8 | | 38796 |
| HPV56 | E2 | VDYRGIYYVH | 95 | 10 | | 38797 |
| HPV56 | E2 | VGNQDAAVSH | 172 | 10 | | 38798 |
| HPV56 | E2 | VGNQDAAVSHR | 172 | 11 | | 38799 |
| HPV56 | E2 | VSHRPGKR | 179 | 8 | | 38800 |
| HPV56 | E2 | VSHRPGKRPR | 179 | 10 | | 38801 |
| HPV56 | E2 | VSPVETVNEY | 150 | 10 | | 38802 |
| HPV56 | E2 | VVHLKGEPNR | 237 | 10 | | 38803 |
| HPV56 | E2 | VVYRLVWDK | 302 | 9 | | 38804 |
| HPV56 | E2 | WLTEPKKCF | 45 | 9 | | 38805 |
| HPV56 | E2 | WLTEPKKCFK | 45 | 10 | | 38806 |
| HPV56 | E2 | WLTEPKKCFKK | 45 | 11 | | 38807 |
| HPV56 | E2 | WTSTDNKNY | 270 | 9 | | 38808 |
| HPV56 | E2 | YCPDSVSSTCR | 137 | 11 | | 38809 |
| HPV56 | E2 | YSIITIIY | 278 | 8 | | 38810 |
| HPV56 | E2 | YSIITIIYK | 278 | 9 | | 38811 |
| HPV56 | E2 | YTDFEQEA | 111 | 8 | | 38812 |
| HPV56 | E2 | YTDFEQEAK | 111 | 9 | | 38813 |
| HPV56 | E2 | YTDFEQEAKK | 111 | 10 | | 38814 |
| HPV56 | E2 | YTDFEQEAKKF | 111 | 11 | | 38815 |
| HPV56 | E2 | YVAWKYIY | 74 | 8 | | 38816 |
| HPV56 | E2 | YVAWKYIYY | 74 | 9 | | 38817 |
| HPV56 | E2 | YVHDGHKTY | 102 | 9 | | 38818 |
| HPV56 | E2 | YVHDGHKTYY | 102 | 10 | | 38819 |
| HPV56 | E6 | ACTELKLVY | 49 | 9 | | 38820 |
| HPV56 | E6 | ACTELKLVYR | 49 | 10 | | 38821 |
| HPV56 | E6 | ATLESITK | 89 | 8 | | 38822 |
| HPV56 | E6 | ATLESITKK | 89 | 9 | | 38823 |
| HPV56 | E6 | AVCRVCLLF | 64 | 9 | | 38824 |
| HPV56 | E6 | AVCRVCLLFY | 64 | 10 | | 38825 |
| HPV56 | E6 | CDLLIRCY | 100 | 8 | | 38826 |
| HPV56 | E6 | CDLLIRCYR | 100 | 9 | | 38827 |
| HPV56 | E6 | CDRKRRFH | 122 | 8 | | 38828 |
| HPV56 | E6 | CDRKRRFHLIA | 122 | 11 | | 38829 |
| HPV56 | E6 | CLGCWRQTSR | 139 | 10 | | 38830 |
| HPV56 | E6 | CLLFYSKVR | 69 | 9 | | 38831 |
| HPV56 | E6 | CLLFYSKVRK | 69 | 10 | | 38832 |
| HPV56 | E6 | CLLFYSKVRKY | 69 | 11 | | 38833 |
| HPV56 | E6 | CTELKLVY | 50 | 8 | | 38834 |
| HPV56 | E6 | CTELKLVYR | 50 | 9 | | 38835 |
| HPV56 | E6 | CVYCKKELTR | 33 | 10 | | 38836 |
| HPV56 | E6 | CVYCKKELTRA | 33 | 11 | | 38837 |
| HPV56 | E6 | DDFPYAVCR | 59 | 9 | | 38838 |
| HPV56 | E6 | DFPYAVCR | 60 | 8 | | 38839 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | E6 | DLLIRCYR | 101 | 8 | | 38840 |
| HPV56 | E6 | DLRLSCVY | 28 | 8 | | 38841 |
| HPV56 | E6 | DLRLSCVYCK | 28 | 10 | | 38842 |
| HPV56 | E6 | DLRLSCVYCKK | 28 | 11 | | 38843 |
| HPV56 | E6 | EIPLIDLR | 23 | 8 | | 38844 |
| HPV56 | E6 | ELKLVYRDDF | 52 | 10 | | 38845 |
| HPV56 | E6 | ELTRAEVY | 39 | 8 | | 38846 |
| HPV56 | E6 | ELTRAEVYNF | 39 | 10 | | 38847 |
| HPV56 | E6 | ELTRAEVYNFA | 39 | 11 | | 38848 |
| HPV56 | E6 | EVLEIPLIDLR | 20 | 11 | | 38849 |
| HPV56 | E6 | EVYNFACTELK | 44 | 11 | | 38850 |
| HPV56 | E6 | FACTELKLVY | 48 | 10 | | 38851 |
| HPV56 | E6 | FACTELKLVYR | 48 | 11 | | 38852 |
| HPV56 | E6 | GATLESITK | 88 | 9 | | 38853 |
| HPV56 | E6 | GATLESITKK | 88 | 10 | | 38854 |
| HPV56 | E6 | GCWRQTSR | 141 | 8 | | 38855 |
| HPV56 | E6 | GCWRQTSREPR | 141 | 11 | | 38856 |
| HPV56 | E6 | GSCLGCWR | 137 | 8 | | 38857 |
| HPV56 | E6 | HCDRKRRF | 121 | 8 | | 38858 |
| HPV56 | E6 | HCDRKRRFH | 121 | 9 | | 38859 |
| HPV56 | E6 | IDLRLSCVY | 27 | 9 | | 38860 |
| HPV56 | E6 | IDLRLSCVYCK | 27 | 11 | | 38861 |
| HPV56 | E6 | KLVYRDDF | 54 | 8 | | 38862 |
| HPV56 | E6 | KLVYRDDFPY | 54 | 10 | | 38863 |
| HPV56 | E6 | KLVYRDDFPYA | 54 | 11 | | 38864 |
| HPV56 | E6 | KVRKYRYY | 75 | 8 | | 38865 |
| HPV56 | E6 | KVRKYRYYDY | 75 | 10 | | 38866 |
| HPV56 | E6 | LCDLLIRCY | 99 | 9 | | 38867 |
| HPV56 | E6 | LCDLLIRCYR | 99 | 10 | | 38868 |
| HPV56 | E6 | LFYSKVRK | 71 | 8 | | 38869 |
| HPV56 | E6 | LFYSKVRKY | 71 | 9 | | 38870 |
| HPV56 | E6 | LFYSKVRKYR | 71 | 10 | | 38871 |
| HPV56 | E6 | LFYSKVRKYRY | 71 | 11 | | 38872 |
| HPV56 | E6 | LGCWRQTSR | 140 | 9 | | 38873 |
| HPV56 | E6 | LIDLRLSCVY | 26 | 10 | | 38874 |
| HPV56 | E6 | LLFYSKVR | 70 | 8 | | 38875 |
| HPV56 | E6 | LLFYSKVRK | 70 | 9 | | 38876 |
| HPV56 | E6 | LLFYSKVRKY | 70 | 10 | | 38877 |
| HPV56 | E6 | LLFYSKVRKYR | 70 | 11 | | 38878 |
| HPV56 | E6 | LSCVYCKK | 31 | 8 | | 38879 |
| HPV56 | E6 | LTPEEKQLH | 113 | 9 | | 38880 |
| HPV56 | E6 | LTRAEVYNF | 40 | 9 | | 38881 |
| HPV56 | E6 | LTRAEVYNFA | 40 | 10 | | 38882 |
| HPV56 | E6 | LVYRDDFPY | 55 | 9 | | 38883 |
| HPV56 | E6 | LVYRDDFPYA | 55 | 10 | | 38884 |
| HPV56 | E6 | NFACTELK | 47 | 8 | | 38885 |
| HPV56 | E6 | NFACTELKLVY | 47 | 11 | | 38886 |
| HPV56 | E6 | PLIDLRLSCVY | 25 | 11 | | 38887 |
| HPV56 | E6 | PLTPEEKQLH | 112 | 10 | | 38888 |
| HPV56 | E6 | QFNNPQER | 4 | 8 | | 38889 |
| HPV56 | E6 | QFNNPQERPR | 4 | 10 | | 38890 |
| HPV56 | E6 | QLCDLLIR | 98 | 8 | | 38891 |
| HPV56 | E6 | QLCDLLIRCY | 98 | 10 | | 38892 |
| HPV56 | E6 | QLCDLLIRCYR | 98 | 11 | | 38893 |
| HPV56 | E6 | QLHCDRKR | 119 | 8 | | 38894 |
| HPV56 | E6 | QLHCDRKRR | 119 | 9 | | 38895 |
| HPV56 | E6 | QLHCDRKRRF | 119 | 10 | | 38896 |
| HPV56 | E6 | QLHCDRKRRFH | 119 | 11 | | 38897 |
| HPV56 | E6 | QSPLTPEEK | 110 | 9 | | 38898 |
| HPV56 | E6 | RAEVYNFA | 42 | 8 | | 38899 |
| HPV56 | E6 | RCQSPLTPEEK | 108 | 11 | | 38900 |
| HPV56 | E6 | RDDFPYAVCR | 58 | 10 | | 38901 |
| HPV56 | E6 | RLSCVYCK | 30 | 8 | | 38902 |
| HPV56 | E6 | RLSCVYCKK | 30 | 9 | | 38903 |
| HPV56 | E6 | RVCLLFYSK | 67 | 9 | | 38904 |
| HPV56 | E6 | RVCLLFYSKVR | 67 | 11 | | 38905 |
| HPV56 | E6 | SCLGCWRQTSR | 138 | 11 | | 38906 |
| HPV56 | E6 | SCVYCKKELTR | 32 | 11 | | 38907 |
| HPV56 | E6 | TGSCLGCWR | 136 | 9 | | 38908 |
| HPV56 | E6 | TLESITKK | 90 | 8 | | 38909 |
| HPV56 | E6 | VCLLFYSK | 68 | 8 | | 38910 |
| HPV56 | E6 | VCLLFYSKVR | 68 | 10 | | 38911 |
| HPV56 | E6 | VCLLFYSKVRK | 68 | 11 | | 38912 |
| HPV56 | E6 | VCRVCLLF | 65 | 8 | | 38913 |
| HPV56 | E6 | VCRVCLLFY | 65 | 9 | | 38914 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | E6 | VCRVCLLFYSK | 65 | 11 | | 38915 |
| HPV56 | E6 | VLEIPLIDLR | 21 | 10 | | 38916 |
| HPV56 | E6 | WTGSCLGCWR | 135 | 10 | | 38917 |
| HPV56 | E6 | YAVCRVCLLF | 63 | 10 | | 38918 |
| HPV56 | E6 | YAVCRVCLLFY | 63 | 11 | | 38919 |
| HPV56 | E6 | YCKKELTR | 35 | 8 | | 38920 |
| HPV56 | E6 | YCKKELTRA | 35 | 9 | | 38921 |
| HPV56 | E6 | YDYSVYGA | 82 | 8 | | 38922 |
| HPV56 | E6 | YGATLESITK | 87 | 10 | | 38923 |
| HPV56 | E6 | YGATLESITKK | 87 | 11 | | 38924 |
| HPV56 | E6 | YSKVRKYR | 73 | 8 | | 38925 |
| HPV56 | E6 | YSKVRKYRY | 73 | 9 | | 38926 |
| HPV56 | E6 | YSKVRKYRYY | 73 | 10 | | 38927 |
| HPV56 | E7 | ALTVTCPLCA | 93 | 10 | | 38928 |
| HPV56 | E7 | DIQSTKEDLR | 75 | 10 | | 38929 |
| HPV56 | E7 | EDEDEDEVDH | 33 | 10 | | 38930 |
| HPV56 | E7 | EDEDEVDH | 35 | 8 | | 38931 |
| HPV56 | E7 | EDEVDHLQER | 37 | 10 | | 38932 |
| HPV56 | E7 | EVDHLQER | 39 | 8 | | 38933 |
| HPV56 | E7 | FVVQLDIQSTK | 70 | 11 | | 38934 |
| HPV56 | E7 | GALTVTCPLCA | 92 | 11 | | 38935 |
| HPV56 | E7 | HLQERPQQA | 42 | 9 | | 38936 |
| HPV56 | E7 | HLQERPQQAR | 42 | 10 | | 38937 |
| HPV56 | E7 | HVPCCECK | 62 | 8 | | 38938 |
| HPV56 | E7 | HVPCCECKF | 62 | 9 | | 38939 |
| HPV56 | E7 | LDIQSTKEDLR | 74 | 11 | | 38940 |
| HPV56 | E7 | LIHVPCCECK | 60 | 10 | | 38941 |
| HPV56 | E7 | LIHVPCCECKF | 60 | 11 | | 38942 |
| HPV56 | E7 | LTVTCPLCA | 94 | 9 | | 38943 |
| HPV56 | E7 | QAKQHTCY | 52 | 8 | | 38944 |
| HPV56 | E7 | QAKQHTCYLIH | 52 | 11 | | 38945 |
| HPV56 | E7 | QARQAKQH | 49 | 8 | | 38946 |
| HPV56 | E7 | QARQAKQHTCY | 49 | 11 | | 38947 |
| HPV56 | E7 | QLDIQSTK | 73 | 8 | | 38948 |
| HPV56 | E7 | QSTKEDLR | 77 | 8 | | 38949 |
| HPV56 | E7 | RVVQQLLMGA | 84 | 10 | | 38950 |
| HPV56 | E7 | TVTCPLCA | 95 | 8 | | 38951 |
| HPV56 | E7 | VDHLQERPQQA | 40 | 11 | | 38952 |
| HPV56 | E7 | VVQLDIQSTK | 71 | 10 | | 38953 |
| HPV56 | E7 | VVQQLLMGA | 85 | 9 | | 38954 |
| HPV56 | E7 | YLIHVPCCECK | 59 | 11 | | 38955 |
| HPV56 | L1 | ACVGLEVGR | 135 | 9 | | 38956 |
| HPV56 | L1 | ADAYGDSMWF | 273 | 10 | | 38957 |
| HPV56 | L1 | ADAYGDSMWFY | 273 | 11 | | 38958 |
| HPV56 | L1 | AGKVGETIPA | 298 | 10 | | 38959 |
| HPV56 | L1 | AGLSGHPLF | 149 | 9 | | 38960 |
| HPV56 | L1 | AGLSGHPLFNR | 149 | 11 | | 38961 |
| HPV56 | L1 | AGSSRLLA | 72 | 8 | | 38962 |
| HPV56 | L1 | AGSSRLLAVGH | 72 | 11 | | 38963 |
| HPV56 | L1 | AMDFKVLQESK | 241 | 11 | | 38964 |
| HPV56 | L1 | AMGEHWTK | 198 | 8 | | 38965 |
| HPV56 | L1 | AMGEHWTKGA | 198 | 10 | | 38966 |
| HPV56 | L1 | ATDSYVKR | 58 | 8 | | 38967 |
| HPV56 | L1 | ATEQLSKY | 381 | 8 | | 38968 |
| HPV56 | L1 | ATEQLSKYDA | 381 | 10 | | 38969 |
| HPV56 | L1 | ATEQLSKYDAR | 381 | 11 | | 38970 |
| HPV56 | L1 | ATSKKRSA | 514 | 8 | | 38971 |
| HPV56 | L1 | ATSLEDKY | 444 | 8 | | 38972 |
| HPV56 | L1 | ATSLEDKYR | 444 | 9 | | 38973 |
| HPV56 | L1 | ATSLEDKYRY | 444 | 10 | | 38974 |
| HPV56 | L1 | ATWRPSENK | 37 | 9 | | 38975 |
| HPV56 | L1 | ATWRPSENKVY | 37 | 11 | | 38976 |
| HPV56 | L1 | AVATSKKR | 512 | 8 | | 38977 |
| HPV56 | L1 | AVATSKKRSA | 512 | 10 | | 38978 |
| HPV56 | L1 | AVGHPYYSVTK | 79 | 11 | | 38979 |
| HPV56 | L1 | AVNVFPIF | 26 | 8 | | 38980 |
| HPV56 | L1 | CIFLDVGA | 19 | 8 | | 38981 |
| HPV56 | L1 | CIVGCTPA | 191 | 8 | | 38982 |
| HPV56 | L1 | CTPAMGEH | 195 | 8 | | 38983 |
| HPV56 | L1 | CTPAMGEHWTK | 195 | 11 | | 38984 |
| HPV56 | L1 | CVGLEVGR | 136 | 8 | | 38985 |
| HPV56 | L1 | DARKINQY | 389 | 8 | | 38986 |
| HPV56 | L1 | DARKINQYLR | 389 | 10 | | 38987 |
| HPV56 | L1 | DARKINQYLRH | 389 | 11 | | 38988 |
| HPV56 | L1 | DAYGDSMWF | 274 | 9 | | 38989 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L1 | DAYGDSMWFY | 274 | 10 | | 38990 |
| HPV56 | L1 | DDTESSNLA | 161 | 9 | | 38991 |
| HPV56 | L1 | DFKVLQESK | 243 | 9 | | 38992 |
| HPV56 | L1 | DFKVLQESKA | 243 | 10 | | 38993 |
| HPV56 | L1 | DGDMIDTGF | 231 | 9 | | 38994 |
| HPV56 | L1 | DGDMIDTGFGA | 231 | 11 | | 38995 |
| HPV56 | L1 | DIVQSTCK | 257 | 8 | | 38996 |
| HPV56 | L1 | DIVQSTCKY | 257 | 9 | | 38997 |
| HPV56 | L1 | DLDQFPLGR | 491 | 9 | | 38998 |
| HPV56 | L1 | DLDQFPLGRK | 491 | 10 | | 38999 |
| HPV56 | L1 | DLDQFPLGRKF | 491 | 11 | | 39000 |
| HPV56 | L1 | DMIDTGFGA | 233 | 9 | | 39001 |
| HPV56 | L1 | DSFSTDLDQF | 486 | 10 | | 39002 |
| HPV56 | L1 | DSMWFYLR | 278 | 8 | | 39003 |
| HPV56 | L1 | DSMWFYLRR | 278 | 9 | | 39004 |
| HPV56 | L1 | DSRDNISVDGK | 176 | 11 | | 39005 |
| HPV56 | L1 | DSYVKRTSIF | 60 | 10 | | 39006 |
| HPV56 | L1 | DSYVKRTSIFY | 60 | 11 | | 39007 |
| HPV56 | L1 | DTESSNLA | 162 | 8 | | 39008 |
| HPV56 | L1 | DTGFGAMDF | 236 | 9 | | 39009 |
| HPV56 | L1 | DTGFGAMDFK | 236 | 10 | | 39010 |
| HPV56 | L1 | DTNIYNPDQER | 121 | 11 | | 39011 |
| HPV56 | L1 | DVGAVNVF | 23 | 8 | | 39012 |
| HPV56 | L1 | DVGAVNVFPIF | 23 | 11 | | 39013 |
| HPV56 | L1 | DVNLQDSF | 481 | 8 | | 39014 |
| HPV56 | L1 | EAQLFNKPY | 337 | 9 | | 39015 |
| HPV56 | L1 | EDGDMIDTGF | 230 | 10 | | 39016 |
| HPV56 | L1 | EDKYRYVR | 448 | 8 | | 39017 |
| HPV56 | L1 | EDKYRYVRSTA | 448 | 11 | | 39018 |
| HPV56 | L1 | ELQFVFQLCK | 404 | 10 | | 39019 |
| HPV56 | L1 | ELYLKGSNGR | 308 | 10 | | 39020 |
| HPV56 | L1 | ETIPAELY | 303 | 8 | | 39021 |
| HPV56 | L1 | ETIPAELYLK | 303 | 10 | | 39022 |
| HPV56 | L1 | EVGRGQPLGA | 140 | 10 | | 39023 |
| HPV56 | L1 | EVMAYLHNMNA | 419 | 11 | | 39024 |
| HPV56 | L1 | FARHYFNR | 290 | 8 | | 39025 |
| HPV56 | L1 | FARHYFNRA | 290 | 9 | | 39026 |
| HPV56 | L1 | FARHYFNRAGK | 290 | 11 | | 39027 |
| HPV56 | L1 | FGLPDTNIY | 117 | 9 | | 39028 |
| HPV56 | L1 | FLDVGAVNVF | 21 | 10 | | 39029 |
| HPV56 | L1 | FLMQLGTR | 501 | 8 | | 39030 |
| HPV56 | L1 | FLMQLGTRSK | 501 | 10 | | 39031 |
| HPV56 | L1 | FLQMATWR | 33 | 8 | | 39032 |
| HPV56 | L1 | FSTDLDQF | 488 | 8 | | 39033 |
| HPV56 | L1 | FVTVVDTTR | 364 | 9 | | 39034 |
| HPV56 | L1 | GAGLSGHPLF | 148 | 10 | | 39035 |
| HPV56 | L1 | GAVNVFPIF | 25 | 9 | | 39036 |
| HPV56 | L1 | GCTPAMGEH | 194 | 9 | | 39037 |
| HPV56 | L1 | GDMIDTGF | 232 | 8 | | 39038 |
| HPV56 | L1 | GDMIDTGFGA | 232 | 10 | | 39039 |
| HPV56 | L1 | GDSMWFYLR | 277 | 9 | | 39040 |
| HPV56 | L1 | GDSMWFYLRR | 277 | 10 | | 39041 |
| HPV56 | L1 | GFGAMDFK | 238 | 8 | | 39042 |
| HPV56 | L1 | GICWGNQLF | 356 | 9 | | 39043 |
| HPV56 | L1 | GLCIFLDVGA | 17 | 10 | | 39044 |
| HPV56 | L1 | GLPDTNIY | 118 | 8 | | 39045 |
| HPV56 | L1 | GLSGHPLF | 150 | 8 | | 39046 |
| HPV56 | L1 | GLSGHPLFNR | 150 | 10 | | 39047 |
| HPV56 | L1 | GSMITSEA | 331 | 8 | | 39048 |
| HPV56 | L1 | GSMITSEAQLF | 331 | 11 | | 39049 |
| HPV56 | L1 | GSSRLLAVGH | 73 | 10 | | 39050 |
| HPV56 | L1 | GTRSKPAVA | 506 | 9 | | 39051 |
| HPV56 | L1 | HAGSSRLLA | 71 | 9 | | 39052 |
| HPV56 | L1 | HVEEYELQF | 399 | 9 | | 39053 |
| HPV56 | L1 | HVEEYELQFVF | 399 | 11 | | 39054 |
| HPV56 | L1 | ICWGNQLF | 357 | 8 | | 39055 |
| HPV56 | L1 | IDTGFGAMDF | 235 | 10 | | 39056 |
| HPV56 | L1 | IDTGFGAMDFK | 235 | 11 | | 39057 |
| HPV56 | L1 | IFLDVGAVNVF | 20 | 11 | | 39058 |
| HPV56 | L1 | IFLQMATWR | 32 | 9 | | 39059 |
| HPV56 | L1 | IFYHAGSSR | 68 | 9 | | 39060 |
| HPV56 | L1 | IGLSPPVA | 437 | 8 | | 39061 |
| HPV56 | L1 | ISTATEQLSK | 378 | 10 | | 39062 |
| HPV56 | L1 | ISTATEQLSKY | 378 | 11 | | 39063 |
| HPV56 | L1 | ITLSAEVMA | 414 | 9 | | 39064 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L1 | ITLSAEVMAY | 414 | 10 | | 39065 |
| HPV56 | L1 | ITSEAQLF | 334 | 8 | | 39066 |
| HPV56 | L1 | ITSEAQLFNK | 334 | 10 | | 39067 |
| HPV56 | L1 | IVGCTPAMGEH | 192 | 11 | | 39068 |
| HPV56 | L1 | IVQSTCKY | 258 | 8 | | 39069 |
| HPV56 | L1 | IVQSTCKYPDY | 258 | 11 | | 39070 |
| HPV56 | L1 | KDNTKTNIPK | 89 | 10 | | 39071 |
| HPV56 | L1 | KFGLPDTNIY | 116 | 10 | | 39072 |
| HPV56 | L1 | KFLMQLGTR | 500 | 9 | | 39073 |
| HPV56 | L1 | KFLMQLGTRSK | 500 | 11 | | 39074 |
| HPV56 | L1 | KFWDVNLQDSF | 478 | 11 | | 39075 |
| HPV56 | L1 | KINQYLRH | 392 | 8 | | 39076 |
| HPV56 | L1 | KITLSAEVMA | 413 | 10 | | 39077 |
| HPV56 | L1 | KITLSAEVMAY | 413 | 11 | | 39078 |
| HPV56 | L1 | KTNIPKVSA | 93 | 9 | | 39079 |
| HPV56 | L1 | KTNIPKVSAY | 93 | 10 | | 39080 |
| HPV56 | L1 | KVGETIPA | 300 | 8 | | 39081 |
| HPV56 | L1 | KVGETIPAELY | 300 | 11 | | 39082 |
| HPV56 | L1 | KVLQESKA | 245 | 8 | | 39083 |
| HPV56 | L1 | KVSAYQYR | 98 | 8 | | 39084 |
| HPV56 | L1 | KVSAYQYRVF | 98 | 10 | | 39085 |
| HPV56 | L1 | KVSAYQYRVFR | 98 | 11 | | 39086 |
| HPV56 | L1 | KVVATDSY | 55 | 8 | | 39087 |
| HPV56 | L1 | KVVATDSYVK | 55 | 10 | | 39088 |
| HPV56 | L1 | KVVATDSYVKR | 55 | 11 | | 39089 |
| HPV56 | L1 | KVYLPPTPVSK | 45 | 11 | | 39090 |
| HPV56 | L1 | LANNNVIEDSR | 168 | 11 | | 39091 |
| HPV56 | L1 | LAVGHPYY | 78 | 8 | | 39092 |
| HPV56 | L1 | LCIFLDVGA | 18 | 9 | | 39093 |
| HPV56 | L1 | LCIVGCTPA | 190 | 9 | | 39094 |
| HPV56 | L1 | LCKITLSA | 411 | 8 | | 39095 |
| HPV56 | L1 | LDDTESSNLA | 160 | 10 | | 39096 |
| HPV56 | L1 | LDIVQSTCK | 256 | 9 | | 39097 |
| HPV56 | L1 | LDIVQSTCKY | 256 | 10 | | 39098 |
| HPV56 | L1 | LDQFPLGR | 492 | 8 | | 39099 |
| HPV56 | L1 | LDQFPLGRK | 492 | 9 | | 39100 |
| HPV56 | L1 | LDQFPLGRKF | 492 | 10 | | 39101 |
| HPV56 | L1 | LDVGAVNVF | 22 | 9 | | 39102 |
| HPV56 | L1 | LFARHYFNR | 289 | 9 | | 39103 |
| HPV56 | L1 | LFARHYFNRA | 289 | 10 | | 39104 |
| HPV56 | L1 | LFNKPYWLQR | 340 | 10 | | 39105 |
| HPV56 | L1 | LFNKPYWLQRA | 340 | 11 | | 39106 |
| HPV56 | L1 | LFVTVVDTTR | 363 | 10 | | 39107 |
| HPV56 | L1 | LGAGLSGH | 147 | 8 | | 39108 |
| HPV56 | L1 | LGAGLSGHPLF | 147 | 11 | | 39109 |
| HPV56 | L1 | LGTRSKPA | 505 | 8 | | 39110 |
| HPV56 | L1 | LGTRSKPAVA | 505 | 10 | | 39111 |
| HPV56 | L1 | LLAVGHPY | 77 | 8 | | 39112 |
| HPV56 | L1 | LLAVGHPYY | 77 | 9 | | 39113 |
| HPV56 | L1 | LMQLGTRSK | 502 | 9 | | 39114 |
| HPV56 | L1 | LMQLGTRSKPA | 502 | 11 | | 39115 |
| HPV56 | L1 | LSAEVMAY | 416 | 8 | | 39116 |
| HPV56 | L1 | LSAEVMAYLH | 416 | 10 | | 39117 |
| HPV56 | L1 | LSGHPLFNR | 151 | 9 | | 39118 |
| HPV56 | L1 | LSKYDARK | 385 | 8 | | 39119 |
| HPV56 | L1 | MATWRPSENK | 36 | 10 | | 39120 |
| HPV56 | L1 | MAYLHNMNA | 421 | 9 | | 39121 |
| HPV56 | L1 | MDFKVLQESK | 242 | 10 | | 39122 |
| HPV56 | L1 | MDFKVLQESKA | 242 | 11 | | 39123 |
| HPV56 | L1 | MGEHWTKGA | 199 | 9 | | 39124 |
| HPV56 | L1 | MIDTGFGA | 234 | 8 | | 39125 |
| HPV56 | L1 | MIDTGFGAMDF | 234 | 11 | | 39126 |
| HPV56 | L1 | MITSEAQLF | 333 | 9 | | 39127 |
| HPV56 | L1 | MITSEAQLFNK | 333 | 11 | | 39128 |
| HPV56 | L1 | MLPMMYIY | 2 | 8 | | 39129 |
| HPV56 | L1 | MLPMMYIYR | 2 | 9 | | 39130 |
| HPV56 | L1 | MMLPMMYIY | 1 | 9 | | 39131 |
| HPV56 | L1 | MMLPMMYIYR | 1 | 10 | | 39132 |
| HPV56 | L1 | MMYIYRDPPLH | 5 | 11 | | 39133 |
| HPV56 | L1 | NGICWGNQLF | 355 | 10 | | 39134 |
| HPV56 | L1 | NGREPPSSVY | 315 | 11 | | 39135 |
| HPV56 | L1 | NIGLSPPVA | 436 | 9 | | 39136 |
| HPV56 | L1 | NIPKVSAY | 95 | 8 | | 39137 |
| HPV56 | L1 | NIPKVSAYQY | 95 | 10 | | 39138 |
| HPV56 | L1 | NIPKVSAYQYR | 95 | 11 | | 39139 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L1 | NIYNPDQER | 123 | 9 | | 39140 |
| HPV56 | L1 | NTKTNIPK | 91 | 8 | | 39141 |
| HPV56 | L1 | NTKTNIPKVSA | 91 | 11 | | 39142 |
| HPV56 | L1 | NVFPIFLQMA | 28 | 10 | | 39143 |
| HPV56 | L1 | PAMGEHWTK | 197 | 9 | | 39144 |
| HPV56 | L1 | PAMGEHWTKGA | 197 | 11 | | 39145 |
| HPV56 | L1 | PAVATSKK | 511 | 8 | | 39146 |
| HPV56 | L1 | PAVATSKKR | 511 | 9 | | 39147 |
| HPV56 | L1 | PAVATSKKRSA | 511 | 11 | | 39148 |
| HPV56 | L1 | PDQERLVWA | 127 | 9 | | 39149 |
| HPV56 | L1 | PDYLKMSA | 266 | 8 | | 39150 |
| HPV56 | L1 | PDYLKMSADA | 266 | 10 | | 39151 |
| HPV56 | L1 | PDYLKMSADAY | 266 | 11 | | 39152 |
| HPV56 | L1 | PIFLQMATWR | 31 | 10 | | 39153 |
| HPV56 | L1 | PLDIVQSTCK | 255 | 10 | | 39154 |
| HPV56 | L1 | PLDIVQSTCKY | 255 | 11 | | 39155 |
| HPV56 | L1 | PLGAGLSGH | 146 | 9 | | 39156 |
| HPV56 | L1 | PLHYGLCIF | 13 | 9 | | 39157 |
| HPV56 | L1 | PSGSMITSEA | 329 | 10 | | 39158 |
| HPV56 | L1 | PTEKQDPLA | 467 | 9 | | 39159 |
| HPV56 | L1 | PTEKQDPLAK | 467 | 10 | | 39160 |
| HPV56 | L1 | PTEKQDPLAKY | 467 | 11 | | 39161 |
| HPV56 | L1 | PTPVSKVVA | 50 | 9 | | 39162 |
| HPV56 | L1 | PTSTSTPA | 522 | 8 | | 39163 |
| HPV56 | L1 | PTSTSTPAK | 522 | 9 | | 39164 |
| HPV56 | L1 | PTSTSTPAKR | 522 | 10 | | 39165 |
| HPV56 | L1 | PTSTSTPAKRK | 522 | 11 | | 39166 |
| HPV56 | L1 | PVATSLEDK | 442 | 9 | | 39167 |
| HPV56 | L1 | PVATSLEDKY | 442 | 10 | | 39168 |
| HPV56 | L1 | PVATSLEDKYR | 442 | 11 | | 39169 |
| HPV56 | L1 | PVSKVVATDSY | 52 | 11 | | 39170 |
| HPV56 | L1 | QDPLAKYK | 471 | 8 | | 39171 |
| HPV56 | L1 | QDPLAKYKF | 471 | 9 | | 39172 |
| HPV56 | L1 | QDSFSTDLDQF | 485 | 11 | | 39173 |
| HPV56 | L1 | QFPLGRKF | 494 | 8 | | 39174 |
| HPV56 | L1 | QFVFQLCK | 406 | 8 | | 39175 |
| HPV56 | L1 | QLCIVGCTPA | 189 | 10 | | 39176 |
| HPV56 | L1 | QLCKITLSA | 410 | 9 | | 39177 |
| HPV56 | L1 | QLFARHYF | 288 | 8 | | 39178 |
| HPV56 | L1 | QLFARHYFNR | 288 | 10 | | 39179 |
| HPV56 | L1 | QLFARHYFNRA | 288 | 11 | | 39180 |
| HPV56 | L1 | QLFNKPYWLQR | 339 | 11 | | 39181 |
| HPV56 | L1 | QLFVTVVDTTR | 362 | 11 | | 39182 |
| HPV56 | L1 | QLGTRSKPA | 504 | 9 | | 39183 |
| HPV56 | L1 | QLGTRSKPAVA | 504 | 11 | | 39184 |
| HPV56 | L1 | QLSKYDAR | 384 | 8 | | 39185 |
| HPV56 | L1 | QLSKYDARK | 384 | 9 | | 39186 |
| HPV56 | L1 | QMATWRPSENK | 35 | 11 | | 39187 |
| HPV56 | L1 | QSTCKYPDY | 260 | 9 | | 39188 |
| HPV56 | L1 | QSTCKYPDYLK | 260 | 11 | | 39189 |
| HPV56 | L1 | QVTTGDCPPLA | 213 | 11 | | 39190 |
| HPV56 | L1 | RAGKVGETIPA | 297 | 11 | | 39191 |
| HPV56 | L1 | RDNISVDGK | 178 | 9 | | 39192 |
| HPV56 | L1 | RLDDTESSNLA | 159 | 11 | | 39193 |
| HPV56 | L1 | RLLAVGHPY | 76 | 9 | | 39194 |
| HPV56 | L1 | RLLAVGHPYY | 76 | 10 | | 39195 |
| HPV56 | L1 | RLPDPNKF | 110 | 8 | | 39196 |
| HPV56 | L1 | RSAPTSTSTPA | 519 | 11 | | 39197 |
| HPV56 | L1 | RSKPAVATSK | 508 | 10 | | 39198 |
| HPV56 | L1 | RSKPAVATSKK | 508 | 11 | | 39199 |
| HPV56 | L1 | RSTAITCQR | 455 | 9 | | 39200 |
| HPV56 | L1 | RSTNMTISTA | 372 | 10 | | 39201 |
| HPV56 | L1 | RTSIFYHA | 65 | 8 | | 39202 |
| HPV56 | L1 | RVRLPDPNK | 108 | 9 | | 39203 |
| HPV56 | L1 | RVRLPDPNKF | 108 | 10 | | 39204 |
| HPV56 | L1 | SADAYGDSMWF | 272 | 11 | | 39205 |
| HPV56 | L1 | SAEVMAYLH | 417 | 9 | | 39206 |
| HPV56 | L1 | SAPTSTSTPA | 520 | 10 | | 39207 |
| HPV56 | L1 | SAPTSTSTPAK | 520 | 11 | | 39208 |
| HPV56 | L1 | SAYQYRVF | 100 | 8 | | 39209 |
| HPV56 | L1 | SAYQYRVFR | 100 | 9 | | 39210 |
| HPV56 | L1 | SAYQYRVFRVR | 100 | 11 | | 39211 |
| HPV56 | L1 | SFSTDLDQF | 487 | 9 | | 39212 |
| HPV56 | L1 | SGHPLFNR | 152 | 8 | | 39213 |
| HPV56 | L1 | SGSMITSEA | 330 | 9 | | 39214 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L1 | SIFYHAGSSR | 67 | 10 | | 39215 |
| HPV56 | L1 | SLEDKYRY | 446 | 8 | | 39216 |
| HPV56 | L1 | SLEDKYRYVR | 446 | 10 | | 39217 |
| HPV56 | L1 | SMITSEAQLF | 332 | 10 | | 39218 |
| HPV56 | L1 | SMWFYLRR | 279 | 8 | | 39219 |
| HPV56 | L1 | SSRLLAVGH | 74 | 9 | | 39220 |
| HPV56 | L1 | SSRLLAVGHPY | 74 | 11 | | 39221 |
| HPV56 | L1 | STAITCQR | 456 | 8 | | 39222 |
| HPV56 | L1 | STATEQLSK | 379 | 9 | | 39223 |
| HPV56 | L1 | STATEQLSKY | 379 | 10 | | 39224 |
| HPV56 | L1 | STCKYPDY | 261 | 8 | | 39225 |
| HPV56 | L1 | STCKYPDYLK | 261 | 10 | | 39226 |
| HPV56 | L1 | STDLDQFPLGR | 489 | 11 | | 39227 |
| HPV56 | L1 | STNMTISTA | 373 | 9 | | 39228 |
| HPV56 | L1 | STPAKRKR | 526 | 8 | | 39229 |
| HPV56 | L1 | STPAKRKRR | 526 | 9 | | 39230 |
| HPV56 | L1 | STSTPAKR | 524 | 8 | | 39231 |
| HPV56 | L1 | STSTPAKRK | 524 | 9 | | 39232 |
| HPV56 | L1 | STSTPAKRKR | 524 | 10 | | 39233 |
| HPV56 | L1 | STSTPAKRKRR | 524 | 11 | | 39234 |
| HPV56 | L1 | SVTKDNTK | 86 | 8 | | 39235 |
| HPV56 | L1 | TATEQLSK | 380 | 8 | | 39236 |
| HPV56 | L1 | TATEQLSKY | 380 | 9 | | 39237 |
| HPV56 | L1 | TATEQLSKYDA | 380 | 11 | | 39238 |
| HPV56 | L1 | TCKYPDYLK | 262 | 9 | | 39239 |
| HPV56 | L1 | TCQREQPPTEK | 460 | 11 | | 39240 |
| HPV56 | L1 | TDLDQFPLGR | 490 | 10 | | 39241 |
| HPV56 | L1 | TDLDQFPLGRK | 490 | 11 | | 39242 |
| HPV56 | L1 | TDSYVKRTSIF | 59 | 11 | | 39243 |
| HPV56 | L1 | TGDCPPLA | 216 | 8 | | 39244 |
| HPV56 | L1 | TGFGAMDF | 237 | 8 | | 39245 |
| HPV56 | L1 | TGFGAMDFK | 237 | 9 | | 39246 |
| HPV56 | L1 | TIPAELYLK | 304 | 9 | | 39247 |
| HPV56 | L1 | TISTATEQLSK | 377 | 11 | | 39248 |
| HPV56 | L1 | TLSAEVMA | 415 | 8 | | 39249 |
| HPV56 | L1 | TLSAEVMAY | 415 | 9 | | 39250 |
| HPV56 | L1 | TLSAEVMAYLH | 415 | 11 | | 39251 |
| HPV56 | L1 | TSEAQLFNK | 335 | 9 | | 39252 |
| HPV56 | L1 | TSEAQLFNKPY | 335 | 11 | | 39253 |
| HPV56 | L1 | TSIFYHAGSSR | 66 | 11 | | 39254 |
| HPV56 | L1 | TSLEDKYR | 445 | 8 | | 39255 |
| HPV56 | L1 | TSLEDKYRY | 445 | 9 | | 39256 |
| HPV56 | L1 | TSLEDKYRYVR | 445 | 11 | | 39257 |
| HPV56 | L1 | TSTPAKRK | 525 | 8 | | 39258 |
| HPV56 | L1 | TSTPAKRKR | 525 | 9 | | 39259 |
| HPV56 | L1 | TSTPAKRKRR | 525 | 10 | | 39260 |
| HPV56 | L1 | TSTSTPAK | 523 | 8 | | 39261 |
| HPV56 | L1 | TSTSTPAKR | 523 | 9 | | 39262 |
| HPV56 | L1 | TSTSTPAKRK | 523 | 10 | | 39263 |
| HPV56 | L1 | TSTSTPAKRKR | 523 | 11 | | 39264 |
| HPV56 | L1 | TTGDCPPLA | 215 | 9 | | 39265 |
| HPV56 | L1 | VATDSYVK | 57 | 8 | | 39266 |
| HPV56 | L1 | VATDSYVKR | 57 | 9 | | 39267 |
| HPV56 | L1 | VATSKKRSA | 513 | 9 | | 39268 |
| HPV56 | L1 | VATSLEDK | 443 | 8 | | 39269 |
| HPV56 | L1 | VATSLEDKY | 443 | 9 | | 39270 |
| HPV56 | L1 | VATSLEDKYR | 443 | 10 | | 39271 |
| HPV56 | L1 | VATSLEDKYRY | 443 | 11 | | 39272 |
| HPV56 | L1 | VFPIFLQMA | 29 | 9 | | 39273 |
| HPV56 | L1 | VFQLCKITLSA | 408 | 11 | | 39274 |
| HPV56 | L1 | VFRVRLPDPNK | 106 | 11 | | 39275 |
| HPV56 | L1 | VGAVNVFPIF | 24 | 10 | | 39276 |
| HPV56 | L1 | VGCTPAMGEH | 193 | 10 | | 39277 |
| HPV56 | L1 | VGETIPAELY | 301 | 10 | | 39278 |
| HPV56 | L1 | VGHPYYSVTK | 80 | 10 | | 39279 |
| HPV56 | L1 | VGRGQPLGA | 141 | 9 | | 39280 |
| HPV56 | L1 | VMAYLHNMNA | 420 | 10 | | 39281 |
| HPV56 | L1 | VSAYQYRVF | 99 | 9 | | 39282 |
| HPV56 | L1 | VSAYQYRVFR | 99 | 10 | | 39283 |
| HPV56 | L1 | VSKVVATDSY | 53 | 10 | | 39284 |
| HPV56 | L1 | VTTGDCPPLA | 214 | 10 | | 39285 |
| HPV56 | L1 | VTVVDTTR | 365 | 8 | | 39286 |
| HPV56 | L1 | VVATDSYVK | 56 | 9 | | 39287 |
| HPV56 | L1 | VVATDSYVKR | 56 | 10 | | 39288 |
| HPV56 | L1 | WACVGLEVGR | 134 | 10 | | 39289 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L1 | WDVNLQDSF | 480 | 9 | | 39290 |
| HPV56 | L1 | WFYLRREQLF | 281 | 10 | | 39291 |
| HPV56 | L1 | WFYLRREQLFA | 281 | 11 | | 39292 |
| HPV56 | L1 | WLQRAQGH | 346 | 8 | | 39293 |
| HPV56 | L1 | WTKGAVCK | 203 | 8 | | 39294 |
| HPV56 | L1 | YDARKINQY | 388 | 9 | | 39295 |
| HPV56 | L1 | YDARKINQYLR | 388 | 11 | | 39296 |
| HPV56 | L1 | YGDSMWFY | 276 | 8 | | 39297 |
| HPV56 | L1 | YGDSMWFYLR | 276 | 10 | | 39298 |
| HPV56 | L1 | YGDSMWFYLRR | 276 | 11 | | 39299 |
| HPV56 | L1 | YGLCIFLDVGA | 16 | 11 | | 39300 |
| HPV56 | L1 | YIYRDPPLH | 7 | 9 | | 39301 |
| HPV56 | L1 | YIYRDPPLHY | 7 | 10 | | 39302 |
| HPV56 | L1 | YLKGSNGR | 310 | 8 | | 39303 |
| HPV56 | L1 | YLKMSADA | 268 | 8 | | 39304 |
| HPV56 | L1 | YLKMSADAY | 268 | 9 | | 39305 |
| HPV56 | L1 | YLPPTPVSK | 47 | 9 | | 39306 |
| HPV56 | L1 | YLRHVEEY | 396 | 8 | | 39307 |
| HPV56 | L1 | YLRREQLF | 283 | 8 | | 39308 |
| HPV56 | L1 | YLRREQLFA | 283 | 9 | | 39309 |
| HPV56 | L1 | YLRREQLFAR | 283 | 10 | | 39310 |
| HPV56 | L1 | YLRREQLFARH | 283 | 11 | | 39311 |
| HPV56 | L1 | YSVTKDNTK | 85 | 9 | | 39312 |
| HPV56 | L1 | YVKRTSIF | 62 | 8 | | 39313 |
| HPV56 | L1 | YVKRTSIFY | 62 | 9 | | 39314 |
| HPV56 | L1 | YVKRTSIFYH | 62 | 10 | | 39315 |
| HPV56 | L1 | YVKRTSIFYHA | 62 | 11 | | 39316 |
| HPV56 | L1 | YVRSTAITCQR | 453 | 11 | | 39317 |
| HPV56 | L2 | AAPRLYRK | 222 | 8 | | 39318 |
| HPV56 | L2 | AAPRLYRKA | 222 | 9 | | 39319 |
| HPV56 | L2 | AAPRLYRKAF | 222 | 10 | | 39320 |
| HPV56 | L2 | ADKILQWGSLF | 41 | 11 | | 39321 |
| HPV56 | L2 | AFQQVKVTDPA | 230 | 11 | | 39322 |
| HPV56 | L2 | AFSPSGVA | 264 | 8 | | 39323 |
| HPV56 | L2 | AFTTRRGGVR | 286 | 10 | | 39324 |
| HPV56 | L2 | AFTTRRGGVRF | 286 | 11 | | 39325 |
| HPV56 | L2 | AGYVPLGSR | 69 | 9 | | 39326 |
| HPV56 | L2 | ALHRPAFTTR | 281 | 10 | | 39327 |
| HPV56 | L2 | ALHRPAFTTRR | 281 | 11 | | 39328 |
| HPV56 | L2 | ALWPVYFF | 438 | 8 | | 39329 |
| HPV56 | L2 | ALWPVYFFR | 438 | 9 | | 39330 |
| HPV56 | L2 | ALWPVYFFRR | 438 | 10 | | 39331 |
| HPV56 | L2 | ALWPVYFFRRR | 438 | 11 | | 39332 |
| HPV56 | L2 | ASATQLYK | 12 | 8 | | 39333 |
| HPV56 | L2 | ASATQLYKTCK | 12 | 11 | | 39334 |
| HPV56 | L2 | ASNTTNVTA | 383 | 9 | | 39335 |
| HPV56 | L2 | ATLVSADNPLF | 246 | 11 | | 39336 |
| HPV56 | L2 | ATPSAHLPIK | 367 | 10 | | 39337 |
| HPV56 | L2 | ATQLYKTCK | 14 | 9 | | 39338 |
| HPV56 | L2 | ATRRKRASA | 6 | 9 | | 39339 |
| HPV56 | L2 | DFMNIVALH | 275 | 9 | | 39340 |
| HPV56 | L2 | DFMNIVALHR | 275 | 10 | | 39341 |
| HPV56 | L2 | DGLYDIYA | 345 | 8 | | 39342 |
| HPV56 | L2 | DISPIAQA | 322 | 8 | | 39343 |
| HPV56 | L2 | DITPTSSTVH | 142 | 10 | | 39344 |
| HPV56 | L2 | DIYANIDDEA | 349 | 10 | | 39345 |
| HPV56 | L2 | DVVNKIEQK | 30 | 9 | | 39346 |
| HPV56 | L2 | DVYIQGSSF | 429 | 9 | | 39347 |
| HPV56 | L2 | DVYIQGSSFA | 429 | 10 | | 39348 |
| HPV56 | L2 | EAPGLSSQSVA | 357 | 11 | | 39349 |
| HPV56 | L2 | EDVVNKIEQK | 29 | 10 | | 39350 |
| HPV56 | L2 | EGTDTSLA | 257 | 8 | | 39351 |
| HPV56 | L2 | EGTDTSLAF | 257 | 9 | | 39352 |
| HPV56 | L2 | EIEMQPLLSA | 331 | 10 | | 39353 |
| HPV56 | L2 | EIPMQTFA | 194 | 8 | | 39354 |
| HPV56 | L2 | EIPMQTFAVH | 194 | 10 | | 39355 |
| HPV56 | L2 | EITSSSTTTPA | 129 | 11 | | 39356 |
| HPV56 | L2 | EMQPLLSA | 333 | 8 | | 39357 |
| HPV56 | L2 | ESGAGIPNF | 114 | 9 | | 39358 |
| HPV56 | L2 | ESSVIESGA | 109 | 9 | | 39359 |
| HPV56 | L2 | FADGDVAA | 457 | 8 | | 39360 |
| HPV56 | L2 | FALWPVYF | 437 | 8 | | 39361 |
| HPV56 | L2 | FALWPVYFF | 437 | 9 | | 39362 |
| HPV56 | L2 | FALWPVYFFR | 437 | 10 | | 39363 |
| HPV56 | L2 | FALWPVYFFRR | 437 | 11 | | 39364 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L2 | FASNTTNVTA | 382 | 10 | | 39365 |
| HPV56 | L2 | FDGLYDIY | 344 | 8 | | 39366 |
| HPV56 | L2 | FDGLYDIYA | 344 | 9 | | 39367 |
| HPV56 | L2 | FFADGDVA | 456 | 8 | | 39368 |
| HPV56 | L2 | FFADGDVAA | 456 | 9 | | 39369 |
| HPV56 | L2 | FFRRRRRK | 444 | 8 | | 39370 |
| HPV56 | L2 | FFRRRRRKR | 444 | 9 | | 39371 |
| HPV56 | L2 | FIDPPVIEA | 162 | 9 | | 39372 |
| HPV56 | L2 | FLDRPATLVSA | 241 | 11 | | 39373 |
| HPV56 | L2 | FMNIVALH | 276 | 8 | | 39374 |
| HPV56 | L2 | FMNIVALHR | 276 | 9 | | 39375 |
| HPV56 | L2 | FMNIVALHRPA | 276 | 11 | | 39376 |
| HPV56 | L2 | FSRLGRKA | 296 | 8 | | 39377 |
| HPV56 | L2 | FTTRRGGVR | 287 | 9 | | 39378 |
| HPV56 | L2 | FTTRRGGVRF | 287 | 10 | | 39379 |
| HPV56 | L2 | FVPQSPYDVTH | 418 | 11 | | 39380 |
| HPV56 | L2 | GARVHYYY | 314 | 8 | | 39381 |
| HPV56 | L2 | GFRRIAAPR | 217 | 9 | | 39382 |
| HPV56 | L2 | GFRRIAAPRLY | 217 | 11 | | 39383 |
| HPV56 | L2 | GGVRFSRLGR | 292 | 10 | | 39384 |
| HPV56 | L2 | GGVRFSRLGRK | 292 | 11 | | 39385 |
| HPV56 | L2 | GIGTGTGSGGR | 58 | 11 | | 39386 |
| HPV56 | L2 | GIPNFTGSGGF | 118 | 11 | | 39387 |
| HPV56 | L2 | GLSSQSVA | 360 | 8 | | 39388 |
| HPV56 | L2 | GSGGRAGY | 64 | 8 | | 39389 |
| HPV56 | L2 | GSSFALWPVY | 434 | 10 | | 39390 |
| HPV56 | L2 | GSSFALWPVYF | 434 | 11 | | 39391 |
| HPV56 | L2 | GTCPEDVVNK | 25 | 10 | | 39392 |
| HPV56 | L2 | GTDTSLAF | 258 | 8 | | 39393 |
| HPV56 | L2 | GTGSGGRA | 62 | 8 | | 39394 |
| HPV56 | L2 | GTGSGGRAGY | 62 | 10 | | 39395 |
| HPV56 | L2 | GTGTGSGGR | 60 | 9 | | 39396 |
| HPV56 | L2 | GTGTGSGGRA | 60 | 10 | | 39397 |
| HPV56 | L2 | GTQIGARVH | 310 | 9 | | 39398 |
| HPV56 | L2 | GTQIGARVHY | 310 | 10 | | 39399 |
| HPV56 | L2 | GTQIGARVHYY | 310 | 11 | | 39400 |
| HPV56 | L2 | GVAPDPDF | 269 | 8 | | 39401 |
| HPV56 | L2 | GVRFSRLGR | 293 | 9 | | 39402 |
| HPV56 | L2 | GVRFSRLGRK | 293 | 10 | | 39403 |
| HPV56 | L2 | GVRFSRLGRKA | 293 | 11 | | 39404 |
| HPV56 | L2 | HDVYIQGSSF | 428 | 10 | | 39405 |
| HPV56 | L2 | HDVYIQGSSFA | 428 | 11 | | 39406 |
| HPV56 | L2 | HLPIKPSTLSF | 372 | 11 | | 39407 |
| HPV56 | L2 | HSYEEIPMQTF | 190 | 11 | | 39408 |
| HPV56 | L2 | IAAPRLYR | 221 | 8 | | 39409 |
| HPV56 | L2 | IAAPRLYRK | 221 | 9 | | 39410 |
| HPV56 | L2 | IAAPRLYRKA | 221 | 10 | | 39411 |
| HPV56 | L2 | IAAPRLYRKAF | 221 | 11 | | 39412 |
| HPV56 | L2 | IDPPVIEA | 163 | 8 | | 39413 |
| HPV56 | L2 | IGARVHYY | 313 | 8 | | 39414 |
| HPV56 | L2 | IGARVHYYY | 313 | 9 | | 39415 |
| HPV56 | L2 | IGTGTGSGGR | 59 | 10 | | 39416 |
| HPV56 | L2 | IGTGTGSGGRA | 59 | 11 | | 39417 |
| HPV56 | L2 | ILISTPTSGIH | 180 | 11 | | 39418 |
| HPV56 | L2 | ILQWGSLF | 44 | 8 | | 39419 |
| HPV56 | L2 | ILQWGSLFTY | 44 | 10 | | 39420 |
| HPV56 | L2 | ILQWGSLFTYF | 44 | 11 | | 39421 |
| HPV56 | L2 | ISSTPIPGF | 210 | 9 | | 39422 |
| HPV56 | L2 | ISSTPIPGFR | 210 | 10 | | 39423 |
| HPV56 | L2 | ISSTPIPGFRR | 210 | 11 | | 39424 |
| HPV56 | L2 | ISTPTSGIH | 182 | 9 | | 39425 |
| HPV56 | L2 | ISTPTSGIHSY | 182 | 11 | | 39426 |
| HPV56 | L2 | ITPTSSTVH | 143 | 9 | | 39427 |
| HPV56 | L2 | ITSSSTTTPA | 130 | 10 | | 39428 |
| HPV56 | L2 | IVALHRPA | 279 | 8 | | 39429 |
| HPV56 | L2 | IVALHRPAF | 279 | 9 | | 39430 |
| HPV56 | L2 | IVDVTPAR | 81 | 8 | | 39431 |
| HPV56 | L2 | KATIQTRR | 302 | 8 | | 39432 |
| HPV56 | L2 | KIEQKTWA | 34 | 8 | | 39433 |
| HPV56 | L2 | KIEQKTWADK | 34 | 10 | | 39434 |
| HPV56 | L2 | KILQWGSLF | 43 | 9 | | 39435 |
| HPV56 | L2 | KILQWGSLFTY | 43 | 11 | | 39436 |
| HPV56 | L2 | KVTDPAFLDR | 235 | 10 | | 39437 |
| HPV56 | L2 | LAFSPSGVA | 263 | 9 | | 39438 |
| HPV56 | L2 | LDITPTSSTVH | 141 | 11 | | 39439 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L2 | LDRPATLVSA | 242 | 10 | | 39440 |
| HPV56 | L2 | LFEGTDTSLA | 255 | 10 | | 39441 |
| HPV56 | L2 | LFEGTDTSLAF | 255 | 11 | | 39442 |
| HPV56 | L2 | LFIDPPVIEA | 161 | 10 | | 39443 |
| HPV56 | L2 | LGNVWETPF | 393 | 9 | | 39444 |
| HPV56 | L2 | LGNVWETPFY | 393 | 10 | | 39445 |
| HPV56 | L2 | LGRKATIQTR | 299 | 10 | | 39446 |
| HPV56 | L2 | LGRKATIQTRR | 299 | 11 | | 39447 |
| HPV56 | L2 | LISTPTSGIH | 181 | 10 | | 39448 |
| HPV56 | L2 | LLSANNSF | 337 | 8 | | 39449 |
| HPV56 | L2 | LSANNSFDGLY | 338 | 11 | | 39450 |
| HPV56 | L2 | LSSQSVATPSA | 361 | 11 | | 39451 |
| HPV56 | L2 | LVSADNPLF | 248 | 9 | | 39452 |
| HPV56 | L2 | MVAHRATR | 1 | 8 | | 39453 |
| HPV56 | L2 | MVAHRATRR | 1 | 9 | | 39454 |
| HPV56 | L2 | MVAHRATRRK | 1 | 10 | | 39455 |
| HPV56 | L2 | MVAHRATRRKR | 1 | 11 | | 39456 |
| HPV56 | L2 | NFTGSGGF | 121 | 8 | | 39457 |
| HPV56 | L2 | NIVALHRPA | 278 | 9 | | 39458 |
| HPV56 | L2 | NIVALHRPAF | 278 | 10 | | 39459 |
| HPV56 | L2 | NSFDGLYDIY | 342 | 10 | | 39460 |
| HPV56 | L2 | NSFDGLYDIYA | 342 | 11 | | 39461 |
| HPV56 | L2 | NVWETPFY | 395 | 8 | | 39462 |
| HPV56 | L2 | PAFLDRPA | 239 | 8 | | 39463 |
| HPV56 | L2 | PAFTTRRGGVR | 285 | 11 | | 39464 |
| HPV56 | L2 | PDFMNIVA | 274 | 8 | | 39465 |
| HPV56 | L2 | PDFMNIVALH | 274 | 10 | | 39466 |
| HPV56 | L2 | PDFMNIVALHR | 274 | 11 | | 39467 |
| HPV56 | L2 | PDPDFMNIVA | 272 | 10 | | 39468 |
| HPV56 | L2 | PFVPQSPY | 417 | 8 | | 39469 |
| HPV56 | L2 | PGFRRIAA | 216 | 8 | | 39470 |
| HPV56 | L2 | PGFRRIAAPR | 216 | 10 | | 39471 |
| HPV56 | L2 | PGLSSQSVA | 359 | 9 | | 39472 |
| HPV56 | L2 | PIKPSTLSF | 374 | 9 | | 39473 |
| HPV56 | L2 | PIKPSTLSFA | 374 | 10 | | 39474 |
| HPV56 | L2 | PIPGFRRIA | 214 | 9 | | 39475 |
| HPV56 | L2 | PIPGFRRIAA | 214 | 10 | | 39476 |
| HPV56 | L2 | PISSTPIPGF | 209 | 10 | | 39477 |
| HPV56 | L2 | PISSTPIPGFR | 209 | 11 | | 39478 |
| HPV56 | L2 | PLFEGTDTSLA | 254 | 11 | | 39479 |
| HPV56 | L2 | PLFIDPPVIEA | 160 | 11 | | 39480 |
| HPV56 | L2 | PLGNVWETPF | 392 | 10 | | 39481 |
| HPV56 | L2 | PLGNVWETPFY | 392 | 11 | | 39482 |
| HPV56 | L2 | PLLSANNSF | 336 | 9 | | 39483 |
| HPV56 | L2 | PMQTFAVH | 196 | 8 | | 39484 |
| HPV56 | L2 | PSAHLPIK | 369 | 8 | | 39485 |
| HPV56 | L2 | PSGVAPDPDF | 267 | 10 | | 39486 |
| HPV56 | L2 | PSTIVDVTPA | 78 | 10 | | 39487 |
| HPV56 | L2 | PSTIVDVTPAR | 78 | 11 | | 39488 |
| HPV56 | L2 | PTGPSTWPF | 410 | 9 | | 39489 |
| HPV56 | L2 | PTSGIHSY | 185 | 8 | | 39490 |
| HPV56 | L2 | PVYFFRRR | 441 | 8 | | 39491 |
| HPV56 | L2 | PVYFFRRRR | 441 | 9 | | 39492 |
| HPV56 | L2 | PVYFFRRRRR | 441 | 10 | | 39493 |
| HPV56 | L2 | PVYFFRRRRRK | 441 | 11 | | 39494 |
| HPV56 | L2 | QGSSFALWPVY | 433 | 11 | | 39495 |
| HPV56 | L2 | QIGARVHY | 312 | 8 | | 39496 |
| HPV56 | L2 | QIGARVHYY | 312 | 9 | | 39497 |
| HPV56 | L2 | QIGARVHYYY | 312 | 10 | | 39498 |
| HPV56 | L2 | QSPYDVTH | 421 | 8 | | 39499 |
| HPV56 | L2 | QSPYDVTHDVY | 421 | 11 | | 39500 |
| HPV56 | L2 | QSVATPSA | 364 | 8 | | 39501 |
| HPV56 | L2 | QSVATPSAH | 364 | 9 | | 39502 |
| HPV56 | L2 | QTRRGTQIGA | 306 | 10 | | 39503 |
| HPV56 | L2 | QTRRGTQIGAR | 306 | 11 | | 39504 |
| HPV56 | L2 | QVKVTDPA | 233 | 8 | | 39505 |
| HPV56 | L2 | QVKVTDPAF | 233 | 9 | | 39506 |
| HPV56 | L2 | RAGYVPLGSR | 68 | 10 | | 39507 |
| HPV56 | L2 | RASATQLY | 11 | 8 | | 39508 |
| HPV56 | L2 | RASATQLYK | 11 | 9 | | 39509 |
| HPV56 | L2 | RATRRKRA | 5 | 8 | | 39510 |
| HPV56 | L2 | RATRRKRASA | 5 | 10 | | 39511 |
| HPV56 | L2 | RFSRLGRK | 295 | 8 | | 39512 |
| HPV56 | L2 | RFSRLGRKA | 295 | 9 | | 39513 |
| HPV56 | L2 | RGGVRFSR | 291 | 8 | | 39514 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L2 | RGGVRFSRLGR | 291 | 11 | | 39515 |
| HPV56 | L2 | RGTQIGAR | 309 | 8 | | 39516 |
| HPV56 | L2 | RGTQIGARVH | 309 | 10 | | 39517 |
| HPV56 | L2 | RGTQIGARVHY | 309 | 11 | | 39518 |
| HPV56 | L2 | RIAAPRLY | 220 | 8 | | 39519 |
| HPV56 | L2 | RIAAPRLYR | 220 | 9 | | 39520 |
| HPV56 | L2 | RIAAPRLYRK | 220 | 10 | | 39521 |
| HPV56 | L2 | RIAAPRLYRKA | 220 | 11 | | 39522 |
| HPV56 | L2 | RLGRKATIQTR | 298 | 11 | | 39523 |
| HPV56 | L2 | RLYRKAFQQVK | 225 | 11 | | 39524 |
| HPV56 | L2 | SANNSFDGLY | 339 | 10 | | 39525 |
| HPV56 | L2 | SATQLYKTCK | 13 | 10 | | 39526 |
| HPV56 | L2 | SFALWPVY | 436 | 8 | | 39527 |
| HPV56 | L2 | SFALWPVYF | 436 | 9 | | 39528 |
| HPV56 | L2 | SFALWPVYFF | 436 | 10 | | 39529 |
| HPV56 | L2 | SFALWPVYFFR | 436 | 11 | | 39530 |
| HPV56 | L2 | SFASNTTNVTA | 381 | 11 | | 39531 |
| HPV56 | L2 | SFDGLYDIY | 343 | 9 | | 39532 |
| HPV56 | L2 | SFDGLYDIYA | 343 | 10 | | 39533 |
| HPV56 | L2 | SGAGIPNF | 115 | 8 | | 39534 |
| HPV56 | L2 | SGTCPEDVVNK | 24 | 11 | | 39535 |
| HPV56 | L2 | SGVAPDPDF | 268 | 9 | | 39536 |
| HPV56 | L2 | SLAFSPSGVA | 262 | 10 | | 39537 |
| HPV56 | L2 | SSFALWPVY | 435 | 9 | | 39538 |
| HPV56 | L2 | SSFALWPVYF | 435 | 10 | | 39539 |
| HPV56 | L2 | SSFALWPVYFF | 435 | 11 | | 39540 |
| HPV56 | L2 | SSQSVATPSA | 362 | 10 | | 39541 |
| HPV56 | L2 | SSQSVATPSAH | 362 | 11 | | 39542 |
| HPV56 | L2 | SSSTTTPA | 132 | 8 | | 39543 |
| HPV56 | L2 | SSTHITNPLF | 153 | 10 | | 39544 |
| HPV56 | L2 | SSTPIPGF | 211 | 8 | | 39545 |
| HPV56 | L2 | SSTPIPGFR | 211 | 9 | | 39546 |
| HPV56 | L2 | SSTPIPGFRR | 211 | 10 | | 39547 |
| HPV56 | L2 | SSTVHVSSTH | 147 | 10 | | 39548 |
| HPV56 | L2 | SSVIESGA | 110 | 8 | | 39549 |
| HPV56 | L2 | STHITNPLF | 154 | 9 | | 39550 |
| HPV56 | L2 | STIVDVTPA | 79 | 9 | | 39551 |
| HPV56 | L2 | STIVDVTPAR | 79 | 10 | | 39552 |
| HPV56 | L2 | STPIPGFR | 212 | 8 | | 39553 |
| HPV56 | L2 | STPIPGFRR | 212 | 9 | | 39554 |
| HPV56 | L2 | STPIPGFRRIA | 212 | 11 | | 39555 |
| HPV56 | L2 | STPTSGIH | 183 | 8 | | 39556 |
| HPV56 | L2 | STPTSGIHSY | 183 | 10 | | 39557 |
| HPV56 | L2 | STVHVSSTH | 148 | 9 | | 39558 |
| HPV56 | L2 | STWPFVPQSPY | 414 | 11 | | 39559 |
| HPV56 | L2 | SVATPSAH | 365 | 8 | | 39560 |
| HPV56 | L2 | TCPEDVVNK | 26 | 9 | | 39561 |
| HPV56 | L2 | TDPAFLDR | 237 | 8 | | 39562 |
| HPV56 | L2 | TDPAFLDRPA | 237 | 10 | | 39563 |
| HPV56 | L2 | TGPSTWPF | 411 | 8 | | 39564 |
| HPV56 | L2 | TGSGGRAGY | 63 | 9 | | 38565 |
| HPV56 | L2 | TGTGSGGR | 61 | 8 | | 39566 |
| HPV56 | L2 | TGTGSGGRA | 61 | 9 | | 39567 |
| HPV56 | L2 | TGTGSGGRAGY | 61 | 11 | | 39568 |
| HPV56 | L2 | TIVDVTPA | 80 | 8 | | 39569 |
| HPV56 | L2 | TIVDVTPAR | 80 | 9 | | 39570 |
| HPV56 | L2 | TLVSADNPLF | 247 | 10 | | 39571 |
| HPV56 | L2 | TSLAFSPSGVA | 261 | 11 | | 39572 |
| HPV56 | L2 | TSSSTTTPA | 131 | 9 | | 39573 |
| HPV56 | L2 | TTSTVHVSSTH | 146 | 11 | | 39574 |
| HPV56 | L2 | TTRRGGVR | 288 | 8 | | 39575 |
| HPV56 | L2 | TTRRGGVRF | 288 | 9 | | 39576 |
| HPV56 | L2 | TTRRGGVRFSR | 288 | 11 | | 39577 |
| HPV56 | L2 | TVHVSSTH | 149 | 8 | | 39578 |
| HPV56 | L2 | VAHRATRR | 2 | 8 | | 39579 |
| HPV56 | L2 | VAHRATRRK | 2 | 9 | | 39580 |
| HPV56 | L2 | VAHRATRRKR | 2 | 10 | | 39581 |
| HPV56 | L2 | VAHRATRRKRA | 2 | 11 | | 39582 |
| HPV56 | L2 | VALHRPAF | 280 | 8 | | 39583 |
| HPV56 | L2 | VALHRPAFTTR | 280 | 11 | | 39584 |
| HPV56 | L2 | VATPSAHLPIK | 366 | 11 | | 39585 |
| HPV56 | L2 | VIESGAGIPNF | 112 | 11 | | 39586 |
| HPV56 | L2 | VLPTGPSTWPF | 408 | 11 | | 39587 |
| HPV56 | L2 | VSADNPLF | 249 | 8 | | 39588 |
| HPV56 | L2 | VSSTHITNPLF | 152 | 11 | | 39589 |

TABLE XVI-continued

A03 Motif Peptides with Binding Data

| Type | Protein | Sequence | Position | No. of Amino Acids | A*0301 | Seq. Id. No. |
|---|---|---|---|---|---|---|
| HPV56 | L2 | VTDPAFLDR | 236 | 9 | | 39590 |
| HPV56 | L2 | VTDPAFLDRPA | 236 | 11 | | 39591 |
| HPV56 | L2 | VVNKIEQK | 31 | 8 | | 39592 |
| HPV56 | L2 | VVNKIEQKTWA | 31 | 11 | | 39593 |
| HPV56 | L2 | WGSLFTYF | 47 | 8 | | 39594 |
| HPV56 | L2 | YANIDDEA | 351 | 8 | | 39595 |
| HPV56 | L2 | YDISPIAQA | 321 | 9 | | 39596 |
| HPV56 | L2 | YDIYANIDDEA | 348 | 11 | | 39597 |
| HPV56 | L2 | YDVTHDVY | 424 | 8 | | 39598 |
| HPV56 | L2 | YFFADGDVA | 455 | 9 | | 39599 |
| HPV56 | L2 | YFFADGDVAA | 455 | 10 | | 39600 |
| HPV56 | L2 | YFFRRRRR | 443 | 8 | | 39601 |
| HPV56 | L2 | YFFRRRRRK | 443 | 9 | | 39602 |
| HPV56 | L2 | YFFRRRRRKR | 443 | 10 | | 39603 |
| HPV56 | L2 | YIQGSSFA | 431 | 8 | | 39604 |

TABLE XVII

A11 Motif Peptides

| Type | Protein | Position | No. of Amino Acids | Sequeuce | A*1101 | Seq. Id. No. |
|---|---|---|---|---|---|---|
| HPV16 | E1 | 316 | 8 | AAALYWYK | | 39605 |
| HPV16 | E1 | 205 | 8 | AAMLAKFK | | 39606 |
| HPV16 | E1 | 205 | 11 | AAMLAKFKELY | | 39607 |
| HPV16 | E1 | 248 | 11 | ADSIKTLLQQY | | 39608 |
| HPV16 | E1 | 391 | 10 | AFLKSNSQAK | | 39609 |
| HPV16 | E1 | 570 | 9 | AGTDSRWPY | | 39610 |
| HPV16 | E1 | 570 | 11 | AGTDSRWPYLH | | 39611 |
| HPV16 | E1 | 112 | 9 | AICIEKQSR | 0.0057 | 39612 |
| HPV16 | E1 | 69 | 9 | ALFTAQEAK | 0.4000 | 39613 |
| HPV16 | E1 | 69 | 11 | ALFTAQEAKQH | | 39614 |
| HPV16 | E1 | 459 | 11 | ALKRFLQGIPK | | 39615 |
| HPV16 | E1 | 206 | 10 | AMLAKFKELY | | 39616 |
| HPV16 | E1 | 406 | 8 | ATMCRHYK | | 39617 |
| HPV16 | E1 | 406 | 9 | ATMCRHYKR | 1.5000 | 39618 |
| HPV16 | E1 | 524 | 8 | ATVPCWNY | | 39619 |
| HPV16 | E1 | 82 | 8 | AVQVLKRK | | 39620 |
| HPV16 | E1 | 82 | 9 | AVQVLKRKY | | 39621 |
| HPV16 | E1 | 405 | 8 | CATMCRHY | | 39622 |
| HPV16 | E1 | 405 | 9 | CATMCRHYK | 0.0098 | 39623 |
| HPV16 | E1 | 405 | 10 | CATMCRHYKR | | 39624 |
| HPV16 | E1 | 430 | 11 | CDRVDDGGDWK | | 39625 |
| HPV16 | E1 | 500 | 8 | CFVNSKSH | | 39626 |
| HPV16 | E1 | 283 | 10 | CGKNRETIEK | | 39627 |
| HPV16 | E1 | 114 | 10 | CIEKQSRAAK | | 39628 |
| HPV16 | E1 | 114 | 11 | CIEKQSRAAKR | | 39629 |
| HPV16 | E1 | 304 | 8 | CMMIEPPK | | 39630 |
| HPV16 | E1 | 304 | 10 | CMMIEPPKLR | | 39631 |
| HPV16 | E1 | 101 | 9 | CVDNNISPR | | 39632 |
| HPV16 | E1 | 101 | 11 | CVDNNISPRLK | | 39633 |
| HPV16 | E1 | 523 | 9 | DATVPCWNY | | 39634 |
| HPV16 | E1 | 81 | 8 | DAVQVLKR | | 39635 |
| HPV16 | E1 | 81 | 9 | DAVQVLKRK | | 39636 |
| HPV16 | E1 | 81 | 10 | DAVQVLKRKY | | 39637 |
| HPV16 | E1 | 404 | 8 | DCATMCRH | | 39638 |
| HPV16 | E1 | 404 | 9 | DCATMCRHY | 0.0001 | 39639 |
| HPV16 | E1 | 404 | 10 | DCATMCRHYK | 0.0130 | 39640 |
| HPV16 | E1 | 404 | 11 | DCATMCRHYKR | | 39641 |
| HPV16 | E1 | 522 | 10 | DDATVPCWNY | | 39642 |
| HPV16 | E1 | 371 | 8 | DDSEIAYK | | 39643 |
| HPV16 | E1 | 371 | 9 | DDSEIAYKY | | 39644 |
| HPV16 | E1 | 50 | 9 | DFIVNDNDY | | 39645 |
| HPV16 | E1 | 631 | 9 | DGDSLPTFK | | 39646 |
| HPV16 | E1 | 541 | 10 | DGNLVSMDVK | | 39647 |
| HPV16 | E1 | 541 | 11 | DGNLVSMDVKH | | 39648 |
| HPV16 | E1 | 368 | 10 | DIVDDSEIAY | | 39649 |
| HPV16 | E1 | 368 | 11 | DIVDDSEIAYK | | 39650 |
| HPV16 | E1 | 103 | 9 | DNNISPRLK | | 39651 |
| HPV16 | E1 | 372 | 8 | DSEIAYKY | | 39652 |
| HPV16 | E1 | 249 | 10 | DSIKTLLQQY | | 39653 |
| HPV16 | E1 | 573 | 8 | DSRWPYLH | | 39654 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV16 | E1 | 573 | 10 | DSRWPYLHNR | | 39655 |
| HPV16 | E1 | 384 | 11 | DTNSNASAFLK | | 39656 |
| HPV16 | E1 | 335 | 8 | DTPEWIQR | | 39657 |
| HPV16 | E1 | 548 | 11 | DVKHRPLVQLK | | 39658 |
| HPV16 | E1 | 452 | 10 | EFMSFLTALK | | 39659 |
| HPV16 | E1 | 452 | 11 | EFMSFLTALKR | | 39660 |
| HPV16 | E1 | 11 | 10 | EGTGCNGWFY | 0.0002 | 39661 |
| HPV16 | E1 | 603 | 8 | ELNDKNWK | | 39662 |
| HPV16 | E1 | 356 | 10 | ELSQMVQWAY | | 39663 |
| HPV16 | E1 | 221 | 10 | ELVRPFKSNK | | 39664 |
| HPV16 | E1 | 629 | 11 | ENDGDSLPTFK | | 39665 |
| HPV16 | E1 | 152 | 9 | ETETPCSQY | | 39666 |
| HPV16 | E1 | 288 | 9 | ETIEKLLSK | | 39667 |
| HPV16 | E1 | 140 | 11 | ETQQMLQVEGR | | 39668 |
| HPV16 | E1 | 594 | 9 | FDENGNPVY | | 39669 |
| HPV16 | E1 | 612 | 8 | FFSRTWSR | | 39670 |
| HPV16 | E1 | 51 | 8 | FIVNDNDY | | 39671 |
| HPV16 | E1 | 392 | 9 | FLKSNSQAK | 0.0002 | 39672 |
| HPV16 | E1 | 463 | 8 | FLQGIPKK | | 39673 |
| HPV16 | E1 | 453 | 9 | FMSFLTALK | 0.2100 | 39674 |
| HPV16 | E1 | 453 | 10 | FMSFLTALKR | | 39675 |
| HPV16 | E1 | 219 | 9 | FSELVRPFK | | 39676 |
| HPV16 | E1 | 613 | 11 | FSRTWSRLSLH | | 39677 |
| HPV16 | E1 | 71 | 9 | FTAQEAKQH | | 39678 |
| HPV16 | E1 | 71 | 10 | FTAQEAKQHR | | 39679 |
| HPV16 | E1 | 100 | 10 | GCVDNNISPR | | 39680 |
| HPV16 | E1 | 632 | 8 | GDSLPTFK | | 39681 |
| HPV16 | E1 | 334 | 9 | GDTPEWIQR | 0.0002 | 39682 |
| HPV16 | E1 | 437 | 11 | GDWKQIVMFLR | | 39683 |
| HPV16 | E1 | 176 | 8 | GGEGVSER | | 39684 |
| HPV16 | E1 | 176 | 9 | GGEGVSERH | | 39685 |
| HPV16 | E1 | 162 | 10 | GGSGGGCSQY | | 39686 |
| HPV16 | E1 | 466 | 11 | GIPKKNCILLY | | 39687 |
| HPV16 | E1 | 325 | 9 | GISNISEVY | | 39688 |
| HPV16 | E1 | 242 | 11 | GLTPSIADSIK | | 39689 |
| HPV16 | E1 | 272 | 9 | GMVVLLLVR | 0.0082 | 39690 |
| HPV16 | E1 | 272 | 10 | GMVVLLLVRY | | 39691 |
| HPV16 | E1 | 272 | 11 | GMVVLLLVRYK | | 39692 |
| HPV16 | E1 | 542 | 9 | GNLVSMDVK | | 39693 |
| HPV16 | E1 | 542 | 10 | GNLVSMDVKH | | 39694 |
| HPV16 | E1 | 542 | 11 | GNLVSMDVKHR | | 39695 |
| HPV16 | E1 | 598 | 10 | GNPVYELNDK | | 39696 |
| HPV16 | E1 | 174 | 10 | GSGGEGVSER | | 39697 |
| HPV16 | E1 | 174 | 11 | GSGGEGVSERH | | 39698 |
| HPV16 | E1 | 163 | 9 | GSGGGCSQY | | 39699 |
| HPV16 | E1 | 496 | 10 | GSVICFVNSK | | 39700 |
| HPV16 | E1 | 571 | 8 | GTDSRWPY | | 39701 |
| HPV16 | E1 | 571 | 10 | GTDSRWPYLH | | 39702 |
| HPV16 | E1 | 12 | 9 | GTGCNGWFY | 0.0720 | 39703 |
| HPV16 | E1 | 216 | 9 | GVSFSELVR | 0.0180 | 39704 |
| HPV16 | E1 | 68 | 10 | HALFTAQEAK | | 39705 |
| HPV16 | E1 | 507 | 11 | HFWLQPLADAK | | 39706 |
| HPV16 | E1 | 499 | 9 | ICFVNSKSH | | 39707 |
| HPV16 | E1 | 113 | 8 | ICIEKQSR | | 39708 |
| HPV16 | E1 | 113 | 11 | ICIEKQSRAAK | | 39709 |
| HPV16 | E1 | 473 | 11 | ILLYGAANTGK | | 39710 |
| HPV16 | E1 | 194 | 11 | ILNVLKTSNAK | | 39711 |
| HPV16 | E1 | 568 | 8 | INAGTDSR | | 39712 |
| HPV16 | E1 | 568 | 11 | INAGTDSRWPY | | 39713 |
| HPV16 | E1 | 326 | 8 | ISNISEVY | | 39714 |
| HPV16 | E1 | 369 | 9 | IVDDSEIAY | | 39715 |
| HPV16 | E1 | 369 | 10 | IVDDSEIAYK | | 39716 |
| HPV16 | E1 | 369 | 11 | IVDDSEIAYKY | | 39717 |
| HPV16 | E1 | 401 | 10 | IVKDCATMCR | | 39718 |
| HPV16 | E1 | 401 | 11 | IVKDCATMCRH | | 39719 |
| HPV16 | E1 | 204 | 9 | KAAMLAKFK | 0.1800 | 39720 |
| HPV16 | E1 | 111 | 10 | KAICIEKQSR | | 39721 |
| HPV16 | E1 | 282 | 11 | KCGKNRETIEK | | 39722 |
| HPV16 | E1 | 403 | 8 | KDCATMCR | | 39723 |
| HPV16 | E1 | 403 | 9 | KDCATMCRH | 0.0002 | 39724 |
| HPV16 | E1 | 403 | 10 | KDCATMCRHY | 0.0002 | 39725 |
| HPV16 | E1 | 403 | 11 | KDCATMCRHYK | | 39726 |
| HPV16 | E1 | 400 | 11 | KIVKDCATMCR | | 39727 |
| HPV16 | E1 | 311 | 10 | KLRSTAAALY | | 39728 |
| HPV16 | E1 | 285 | 8 | KNRETIEK | | 39729 |

TABLE XVII-continued

A11 Motif Peptides

| Type | Protein | Position | No. of Amino Acids | Sequence | A*1101 | Seq. Id. No. |
|---|---|---|---|---|---|---|
| HPV16 | E1 | 607 | 9 | KNWKSFFSR | | 39730 |
| HPV16 | E1 | 610 | 10 | KSFFSRTWSR | | 39731 |
| HPV16 | E1 | 483 | 10 | KSLFGMSLMK | | 39732 |
| HPV16 | E1 | 394 | 10 | KSNSQAKIVK | | 39733 |
| HPV16 | E1 | 323 | 11 | KTGISNISEVY | | 39734 |
| HPV16 | E1 | 252 | 10 | KTLLQQYCLY | | 39735 |
| HPV16 | E1 | 208 | 8 | LAKFKELY | | 39736 |
| HPV16 | E1 | 521 | 11 | LDDATVPCWNY | | 39737 |
| HPVi6 | E1 | 540 | 11 | LDGNLVSMDVK | | 39738 |
| HPV16 | E1 | 126 | 9 | LFESEDSGY | | 39739 |
| HPV16 | E1 | 485 | 8 | LFGMSLMK | | 39740 |
| HPV16 | E1 | 70 | 8 | LFTAQEAK | | 39741 |
| HPV16 | E1 | 70 | 10 | LFTAQEAKQH | | 39742 |
| HPV16 | E1 | 70 | 11 | LFTAQEAKQHR | | 39743 |
| HPV16 | E1 | 276 | 10 | LLLVRYKCGK | | 39744 |
| HPV16 | E1 | 254 | 8 | LLQQYCLY | | 39745 |
| HPV16 | E1 | 254 | 10 | LLQQYCLYLH | | 39746 |
| HPV16 | E1 | 277 | 9 | LLVRYKCGK | 0.0033 | 39747 |
| HPV16 | E1 | 277 | 11 | LLVRYKCGKNR | | 39748 |
| HPV16 | E1 | 474 | 10 | LLYGAANTGK | | 39749 |
| HPV16 | E1 | 195 | 10 | LNVLKTSNAK | | 39750 |
| HPV16 | E1 | 620 | 9 | LSLHEDEDK | 0.0002 | 39751 |
| HPV16 | E1 | 357 | 9 | LSQMVQWAY | | 39752 |
| HPV16 | E1 | 191 | 9 | LTNILNVLK | 0.4200 | 39753 |
| HPV16 | E1 | 243 | 10 | LTPSIADSIK | | 39754 |
| HPV16 | E1 | 59 | 10 | LTQAETETAH | | 39755 |
| HPV16 | E1 | 48 | 11 | LVDFIVNDNDY | | 39756 |
| HPV16 | E1 | 222 | 9 | LVRPFKSNK | 1.8000 | 39757 |
| HPV16 | E1 | 278 | 8 | LVRYKCGK | | 39758 |
| HPV16 | E1 | 278 | 10 | LVRYKCGKNR | | 39759 |
| HPV16 | E1 | 544 | 8 | LVSMDVKH | | 39760 |
| HPV16 | E1 | 544 | 9 | LVSMDVKHR | 0.0089 | 39761 |
| HPV16 | E1 | 303 | 9 | MCMMIEPPK | | 39762 |
| HPV16 | E1 | 303 | 11 | MCMMIEPPKLR | | 39763 |
| HPV16 | E1 | 408 | 10 | MCRHYKRAEK | | 39764 |
| HPV16 | E1 | 408 | 11 | MCRHYKRAEKK | | 39765 |
| HPV16 | E1 | 306 | 8 | MIEPPKLR | | 39766 |
| HPV16 | E1 | 207 | 9 | MLAKFKELY | | 39767 |
| HPV16 | E1 | 144 | 8 | MLQVEGRH | | 39768 |
| HPV16 | E1 | 305 | 9 | MMIEPPKLR | 0.0086 | 39769 |
| HPV16 | E1 | 454 | 8 | MSFLTALK | | 39770 |
| HPV16 | E1 | 454 | 9 | MSFLTALKR | 0.0980 | 39771 |
| HPV16 | E1 | 420 | 8 | MSMSQWIK | | 39772 |
| HPV16 | E1 | 420 | 9 | MSMSQWIKY | | 39773 |
| HPV16 | E1 | 420 | 10 | MSMSQWIKYR | | 39774 |
| HPV16 | E1 | 422 | 8 | MSQWIKYR | | 39775 |
| HPV16 | E1 | 422 | 11 | MSQWIKYRCDR | | 39776 |
| HPV16 | E1 | 273 | 8 | MVVLLLVR | | 39777 |
| HPV16 | E1 | 273 | 9 | MVVLLLVRY | | 39778 |
| HPV16 | E1 | 273 | 10 | MVVLLLVRYK | | 39779 |
| HPV16 | E1 | 569 | 10 | NAGTDSRWPY | | 39780 |
| HPV16 | E1 | 202 | 9 | NAKAAMLAK | 0.0031 | 39781 |
| HPV16 | E1 | 202 | 11 | NAKAAMLAKFK | | 39782 |
| HPV16 | E1 | 630 | 10 | NDGDSLPTFK | | 39783 |
| HPV16 | E1 | 367 | 11 | NDIVDDSEIAY | | 39784 |
| HPV16 | E1 | 605 | 11 | NDKNWKSFFSR | | 39785 |
| HPV16 | E1 | 597 | 11 | NGNPVYELNDK | | 39786 |
| HPV16 | E1 | 567 | 9 | NINAGTDSR | 0.0002 | 39787 |
| HPV16 | E1 | 543 | 8 | NLVSMDVK | | 39788 |
| HPV16 | E1 | 543 | 9 | NLVSMDVKH | | 39789 |
| HPV16 | E1 | 543 | 10 | NLVSMDVKHR | | 39790 |
| HPV16 | E1 | 104 | 8 | NNISPRLK | | 39791 |
| HPV16 | E1 | 386 | 9 | NSNASAFLK | 0.0110 | 39792 |
| HPV16 | E1 | 396 | 8 | NSQAKIVK | | 39793 |
| HPV16 | E1 | 196 | 9 | NVLKTSNAK | 0.0015 | 39794 |
| HPV16 | E1 | 527 | 11 | PCWNYIDDNLR | | 39795 |
| HPV16 | E1 | 593 | 10 | PFDENGNPVY | | 39796 |
| HPV16 | E1 | 190 | 10 | PLTNILNVLK | | 39797 |
| HPV16 | E1 | 302 | 10 | PMCMMIEPPK | | 39798 |
| HPV16 | E1 | 245 | 8 | PSIADSIK | | 39799 |
| HPV16 | E1 | 600 | 8 | PVYELNDK | | 39800 |
| HPV16 | E1 | 600 | 11 | PVYELNDKNWK | | 39801 |
| HPV16 | E1 | 61 | 8 | QAETETAH | | 39802 |
| HPV16 | E1 | 495 | 11 | QGSVICFVNSK | | 39803 |
| HPV16 | E1 | 441 | 8 | QIVMFLRY | | 39804 |

TABLE XVII-continued

A11 Motif Peptides

| Type | Protein | Position | No. of Amino Acids | Sequence | A*1101 | Seq. Id. No. |
|---|---|---|---|---|---|---|
| HPV16 | E1 | 143 | 8 | QMLQVEGR | | 39805 |
| HPV16 | E1 | 143 | 9 | QMLQVEGRH | | 39806 |
| HPV16 | E1 | 419 | 9 | QMSMSQWIK | 0.0260 | 39807 |
| HPV16 | E1 | 419 | 10 | QMSMSQWIKY | | 39808 |
| HPV16 | E1 | 419 | 11 | QMSMSQWIKYR | | 39809 |
| HPV16 | E1 | 118 | 8 | QSRAAKRR | | 39810 |
| HPV16 | E1 | 80 | 8 | RDAVQVLK | | 39811 |
| HPV16 | E1 | 80 | 9 | RDAVQVLKR | | 39812 |
| HPV16 | E1 | 80 | 10 | RDAVQVLKRK | | 39813 |
| HPV16 | E1 | 80 | 11 | RDAVQVLKRKY | | 39814 |
| HPV16 | E1 | 462 | 8 | RFLQGIPK | | 39815 |
| HPV16 | E1 | 462 | 9 | RFLQGIPKK | | 39816 |
| HPV16 | E1 | 125 | 10 | RLFESEDSGY | | 39817 |
| HPV16 | E1 | 109 | 9 | RLKAICIEK | 0.0510 | 39818 |
| HPV16 | E1 | 619 | 10 | RLSLHEDEDK | | 39819 |
| HPV16 | E1 | 313 | 8 | RSTAAALY | | 39820 |
| HPV16 | E1 | 313 | 10 | RSTAAALYWY | | 39821 |
| HPV16 | E1 | 313 | 11 | RSTAAALYWYK | | 39822 |
| HPV16 | E1 | 615 | 9 | RTWSRLSLH | | 39823 |
| HPV16 | E1 | 432 | 9 | RVDDGGDWK | | 39824 |
| HPV16 | E1 | 390 | 11 | SAFLKSNSQAK | | 39825 |
| HPV16 | E1 | 611 | 9 | SFFSRTWSR | | 39826 |
| HPV16 | E1 | 455 | 8 | SFLTALKR | | 39827 |
| HPV16 | E1 | 218 | 10 | SFSELVRPFK | | 39828 |
| HPV16 | E1 | 99 | 11 | SGCVDNNISPR | | 39829 |
| HPV16 | E1 | 175 | 9 | SGGEGVSER | | 39830 |
| HPV16 | E1 | 175 | 10 | SGGEGVSERH | | 39831 |
| HPV16 | E1 | 164 | 8 | SGGGCSQY | | 39832 |
| HPV16 | E1 | 161 | 11 | SGGSGGGCSQY | | 39833 |
| HPV16 | E1 | 173 | 11 | SGSGGEGVSER | | 39834 |
| HPV16 | E1 | 250 | 9 | SIKTLLQQY | | 39835 |
| HPV16 | E1 | 484 | 9 | SLFGMSLMK | 7.1000 | 39836 |
| HPV16 | E1 | 621 | 8 | SLHEDEDK | | 39837 |
| HPV16 | E1 | 421 | 8 | SMSQWIKY | | 39838 |
| HPV16 | E1 | 421 | 9 | SMSQWIKYR | 0.0280 | 39839 |
| HPV16 | E1 | 201 | 10 | SNAKAAMLAK | | 39840 |
| HPV16 | E1 | 387 | 8 | SNASAFLK | | 39841 |
| HPV16 | E1 | 566 | 10 | SNINAGTDSR | | 39842 |
| HPV16 | E1 | 395 | 9 | SNSQAKIVK | | 39843 |
| HPV16 | E1 | 314 | 9 | STAAALYWY | | 39844 |
| HPV16 | E1 | 314 | 10 | STAAALYWYK | | 39845 |
| HPV16 | E1 | 497 | 9 | SVICFVNSK | 0.0002 | 39846 |
| HPV16 | E1 | 497 | 11 | SVICFVNSKSH | | 39847 |
| HPV16 | E1 | 315 | 8 | TAAALYWY | | 39848 |
| HPV16 | E1 | 315 | 9 | TAAALYWYK | 20.0000 | 39849 |
| HPV16 | E1 | 72 | 8 | TAQEAKQH | | 39850 |
| HPV16 | E1 | 72 | 9 | TAQEAKQHR | 0.0025 | 39851 |
| HPV16 | E1 | 572 | 9 | TDSRWPYLH | | 39852 |
| HPV16 | E1 | 572 | 11 | TDSRWPYLHNR | | 39853 |
| HPV16 | E1 | 13 | 8 | TGCNGWFY | | 39854 |
| HPV16 | E1 | 324 | 10 | TGISNISEVY | | 39855 |
| HPV16 | E1 | 289 | 8 | TIEKLLSK | | 39856 |
| HPV16 | E1 | 253 | 9 | TLLQQYCLY | | 39857 |
| HPV16 | E1 | 253 | 11 | TLLQQYCLYLH | | 39858 |
| HPV16 | E1 | 407 | 8 | TMCRHYKR | | 39859 |
| HPV16 | E1 | 407 | 11 | TMCRHYKRAEK | | 39860 |
| HPV16 | E1 | 192 | 8 | TNILNVLK | | 39861 |
| HPV16 | E1 | 385 | 10 | TNSNASAFLK | | 39862 |
| HPV16 | E1 | 200 | 11 | TSNAKAAMLAK | | 39863 |
| HPV16 | E1 | 565 | 11 | TSNINAGTDSR | | 39864 |
| HPV16 | E1 | 433 | 8 | VDDGGDWK | | 39865 |
| HPV16 | E1 | 370 | 8 | VDDSEIAY | | 39866 |
| HPV16 | E1 | 370 | 9 | VDDSEIAYK | | 39867 |
| HPV16 | E1 | 370 | 10 | VDDSEIAYKY | | 39868 |
| HPV16 | E1 | 49 | 10 | VDFIVNDNDY | | 39869 |
| HPV16 | E1 | 102 | 8 | VDNNISPR | | 39870 |
| HPV16 | E1 | 102 | 10 | VDNNISPRLK | | 39871 |
| HPV16 | E1 | 498 | 8 | VICFVNSK | | 39872 |
| HPV16 | E1 | 498 | 10 | VICFVNSKSH | | 39873 |
| HPV16 | E1 | 197 | 8 | VLKTSNAK | | 39874 |
| HPV16 | E1 | 275 | 8 | VLLLVRYK | | 39875 |
| HPV16 | E1 | 275 | 11 | VLLLVRYKCGK | | 39876 |
| HPV16 | E1 | 217 | 8 | VSFSELVR | | 39877 |
| HPV16 | E1 | 217 | 11 | VSFSELVRPFK | | 39878 |
| HPV16 | E1 | 545 | 8 | VSMDVKHR | | 39879 |

TABLE XVII-continued

A11 Motif Peptides

| Type | Protein | Position | No. of Amino Acids | Sequence | A*1101 | Seq. Id. No. |
|---|---|---|---|---|---|---|
| HPV16 | E1 | 274 | 8 | VVLLLVRY | | 39880 |
| HPV16 | E1 | 274 | 9 | VVLLLVRYK | 0.3600 | 39881 |
| HPV16 | E1 | 18 | 10 | WFYVEAVVEK | | 39882 |
| HPV16 | E1 | 18 | 11 | WFYVEAVVEKK | | 39883 |
| HPV16 | E1 | 271 | 10 | WGMVVLLLVR | | 39884 |
| HPV16 | E1 | 271 | 11 | WGMVVLLLVRY | | 39885 |
| HPV16 | E1 | 425 | 8 | WIKYRCDR | | 39886 |
| HPV16 | E1 | 339 | 10 | WIQRQTVLQH | | 39887 |
| HPV16 | E1 | 509 | 9 | WLQPLADAK | 0.0002 | 39888 |
| HPV16 | E1 | 529 | 9 | WNYIDDNLR | | 39889 |
| HPV16 | E1 | 476 | 8 | YGAANTGK | | 39890 |
| HPV16 | E1 | 333 | 10 | YGDTPEWIQR | | 39891 |
| HPV16 | E1 | 215 | 10 | YGVSFSELVR | | 39892 |
| HPV16 | E1 | 58 | 11 | YLTQAETETAH | | 39893 |
| HPV16 | E1 | 20 | 8 | YVEAVVEK | | 39894 |
| HPV16 | E1 | 20 | 9 | YVEAVVEKK | | 39895 |
| HPV16 | E2 | 270 | 9 | AFNSSHKGR | | 39896 |
| HPV16 | E2 | 216 | 8 | ANHPAATH | | 39897 |
| HPV16 | E2 | 216 | 10 | ANRPAATHTK | | 39898 |
| HPV16 | E2 | 295 | 8 | ANTLKCLR | | 39899 |
| HPV16 | E2 | 295 | 9 | ANTLKCLRY | | 39900 |
| HPV16 | E2 | 295 | 10 | ANTLKCLRYR | | 39901 |
| HPV16 | E2 | 314 | 11 | AVSSTWHWTGH | | 39902 |
| HPV16 | E2 | 40 | 8 | CAIYYKAR | | 39903 |
| HPV16 | E2 | 300 | 8 | CLRYRFKK | | 39904 |
| HPV16 | E2 | 300 | 9 | CLRYRFKKH | | 39905 |
| HPV16 | E2 | 281 | 10 | CNSNTTPIVH | | 39906 |
| HPV16 | E2 | 126 | 11 | CNTMHYTNWTH | | 39907 |
| HPV16 | E2 | 174 | 9 | DAEKYSKNK | | 39908 |
| HPV16 | E2 | 294 | 9 | DANTLKCLR | | 39909 |
| HPV16 | E2 | 294 | 10 | DANTLKCLRY | | 39910 |
| HPV16 | E2 | 294 | 11 | DANTLKCLRYR | | 39911 |
| HPV16 | E2 | 173 | 8 | DDAEKYSK | | 39912 |
| HPV16 | E2 | 173 | 10 | DDAEKYSKNK | | 39913 |
| HPV16 | E2 | 122 | 9 | DGDICNTMH | | 39914 |
| HPV16 | E2 | 122 | 10 | DGDICNTMHY | | 39915 |
| HPV16 | E2 | 124 | 8 | DICNTMHY | | 39916 |
| HPV16 | E2 | 25 | 8 | DLRDHIDY | | 39917 |
| HPV16 | E2 | 25 | 10 | DLRDHIDYWK | | 39918 |
| HPV16 | E2 | 25 | 11 | DLRDHIDYWKH | | 39919 |
| HPV16 | E2 | 22 | 8 | DSTDLRDH | | 39920 |
| HPV16 | E2 | 22 | 11 | DSTDLRDHIDY | | 39921 |
| HPV16 | E2 | 246 | 10 | DTGNPCHTTK | | 39922 |
| HPV16 | E2 | 39 | 9 | ECAIYYKAR | | 39923 |
| HPV16 | E2 | 162 | 11 | EGIRTYFVQFK | | 39924 |
| HPV16 | E2 | 149 | 10 | EGQVDYYGLY | | 39925 |
| HPV16 | E2 | 149 | 11 | EGQVDYYGLYY | | 39926 |
| HPV16 | E2 | 209 | 10 | EIIRQHLANH | | 39927 |
| HPV16 | E2 | 74 | 10 | ELQLTLETIY | | 39928 |
| HPV16 | E2 | 48 | 9 | EMGFKHINH | | 39929 |
| HPV16 | E2 | 20 | 8 | ENDSTDLR | | 39930 |
| HPV16 | E2 | 20 | 10 | ENDSTDLRDH | | 39931 |
| HPV16 | E2 | 80 | 8 | ETIYNSQY | | 39932 |
| HPV16 | E2 | 233 | 8 | ETQTTIQR | | 39933 |
| HPV16 | E2 | 233 | 10 | ETQTTIQRPR | | 39934 |
| HPV16 | E2 | 204 | 9 | EVSSPEIIR | | 39935 |
| HPV16 | E2 | 204 | 11 | EVSSPEIIRQH | | 39936 |
| HPV16 | E2 | 121 | 10 | FDGDICNTMH | | 39937 |
| HPV16 | E2 | 121 | 11 | FDGDICNTMHY | | 39938 |
| HPV16 | E2 | 346 | 9 | FLSQVKIPK | | 39939 |
| HPV16 | E2 | 271 | 8 | FNSSHKGR | | 39940 |
| HPV16 | E2 | 168 | 10 | FVQFKDDAEK | | 39941 |
| HPV16 | E2 | 168 | 11 | FVQFKDDAEKY | | 39942 |
| HPV16 | E2 | 108 | 8 | GCIKKHGY | | 39943 |
| HPV16 | E2 | 293 | 10 | GDANTLKCLR | | 39944 |
| HPV16 | E2 | 293 | 11 | GDANTLKCLRY | | 39945 |
| HPV16 | E2 | 123 | 8 | GDICNTMH | | 39946 |
| HPV16 | E2 | 123 | 9 | GDICNTMHY | | 39947 |
| HPV16 | E2 | 163 | 10 | GIRTYFVQFK | | 39948 |
| HPV16 | E2 | 156 | 10 | GLYYVHEGIR | | 39949 |
| HPV16 | E2 | 248 | 8 | GNPCHTTK | | 39950 |
| HPV16 | E2 | 248 | 11 | GNPCHTTKLLH | | 39951 |
| HPV16 | E2 | 230 | 11 | GTEETQTTIQR | | 39952 |
| HPV16 | E2 | 29 | 9 | HIDYWKHMR | | 39953 |
| HPV16 | E2 | 214 | 10 | HLANHPAATH | | 39954 |

TABLE XVII-continued

A11 Motif Peptides

| Type | Protein | Position | No. of Amino Acids | Sequence | A*1101 | Seq. Id. No. |
|---|---|---|---|---|---|---|
| HPV16 | E2 | 290 | 10 | HLKGDANTLK | | 39955 |
| HPV16 | E2 | 35 | 9 | HMRLECAIY | | 39956 |
| HPV16 | E2 | 35 | 10 | HMRLECAIYY | | 39957 |
| HPV16 | E2 | 35 | 11 | HMRLECAIYYK | | 39958 |
| HPV16 | E2 | 252 | 8 | HTTKLLHR | | 39959 |
| HPV16 | E2 | 30 | 8 | IDYWKHMR | | 39960 |
| HPV16 | E2 | 210 | 9 | IIRQHLANH | | 39961 |
| HPV16 | E2 | 267 | 9 | ILTAFNSSH | | 39962 |
| HPV16 | E2 | 267 | 10 | ILTAFNSSHK | | 39963 |
| HPV16 | E2 | 45 | 8 | KAREMGFK | | 39964 |
| HPV16 | E2 | 45 | 9 | KAREMGFKH | | 39965 |
| HPV16 | E2 | 299 | 8 | KCLRYRFK | | 39966 |
| HPV16 | E2 | 299 | 9 | KCLRYRFKK | | 39967 |
| HPV16 | E2 | 299 | 10 | KCLRYRFKKH | | 39968 |
| HPV16 | E2 | 172 | 9 | KDDAEKYSK | | 39969 |
| HPV16 | E2 | 172 | 11 | KDDAEKYSKNK | | 39970 |
| HPV16 | E2 | 292 | 8 | KGDANTLK | | 39971 |
| HPV16 | E2 | 292 | 11 | KGDANTLKCLR | | 39972 |
| HPV16 | E2 | 180 | 8 | KNKVWEVH | | 39973 |
| HPV16 | E2 | 329 | 9 | KSAIVTLTY | | 39974 |
| HPV16 | E2 | 215 | 9 | LANHPAATH | | 39975 |
| HPV16 | E2 | 215 | 11 | LANHPAATHTK | | 39976 |
| HPV16 | E2 | 4 | 11 | LCQRLNVCQDK | | 39977 |
| HPV16 | E2 | 8 | 11 | LNVCQDKILTH | | 39978 |
| HPV16 | E2 | 347 | 8 | LSQVKIPK | | 39979 |
| HPV16 | E2 | 268 | 8 | LTAFNSSH | | 39980 |
| HPV16 | E2 | 268 | 9 | LTAFNSSHK | | 39981 |
| HPV16 | E2 | 268 | 11 | LTAFNSSHKGR | | 39982 |
| HPV16 | E2 | 103 | 9 | LTAPTGCIK | | 39983 |
| HPV16 | E2 | 103 | 10 | LTAPTGCIKK | | 39984 |
| HPV16 | E2 | 103 | 11 | LTAPTGCIKKH | | 39985 |
| HPV16 | E2 | 77 | 11 | LTLETIYNSQY | | 39986 |
| HPV16 | E2 | 335 | 9 | LTYDSEWQR | | 39987 |
| HPV16 | E2 | 49 | 8 | MGFKHINH | | 39988 |
| HPV16 | E2 | 280 | 11 | NCNSNTTPIVH | | 39989 |
| HPV16 | E2 | 21 | 9 | NDSTDLRDH | | 39990 |
| HPV16 | E2 | 282 | 9 | NSNTTPIVH | | 39991 |
| HPV16 | E2 | 282 | 11 | NSNTTPIVHLK | | 39992 |
| HPV16 | E2 | 84 | 8 | NSQYSNEK | | 39993 |
| HPV16 | E2 | 296 | 8 | NTLKCLRY | | 39994 |
| HPV16 | E2 | 296 | 9 | NTLKCLRYR | | 39995 |
| HPV16 | E2 | 296 | 11 | NTLKCLRYRFK | | 39996 |
| HPV16 | E2 | 127 | 10 | NTMHYTNWTH | | 39997 |
| HPV16 | E2 | 284 | 9 | NTTPIVHLK | | 39998 |
| HPV16 | E2 | 9 | 10 | NVCQDKILTH | | 39999 |
| HPV16 | E2 | 9 | 11 | NVCQDKILTHY | | 40000 |
| HPV16 | E2 | 250 | 9 | PCHTTKLLH | | 40001 |
| HPV16 | E2 | 250 | 10 | PCHTTKLLHR | | 40002 |
| HPV16 | E2 | 245 | 8 | PDTGNPCH | | 40003 |
| HPV16 | E2 | 245 | 11 | PDTGNPCHTTK | | 40004 |
| HPV16 | E2 | 266 | 10 | PILTAFNSSH | | 40005 |
| HPV16 | E2 | 266 | 11 | PILTAFNSSHK | | 40006 |
| HPV16 | E2 | 106 | 8 | PTGCIKKH | | 40007 |
| HPV16 | E2 | 106 | 10 | PTGCIKKHGY | | 40008 |
| HPV16 | E2 | 60 | 9 | PTLAVSKNK | | 40009 |
| HPV16 | E2 | 12 | 8 | QDKILTHY | | 40010 |
| HPV16 | E2 | 95 | 8 | QDVSLEVY | | 40011 |
| HPV16 | E2 | 120 | 11 | QFDGDICNTMH | | 40012 |
| HPV16 | E2 | 170 | 8 | QFKDDAEK | | 40013 |
| HPV16 | E2 | 170 | 9 | QFKDDAEKY | | 40014 |
| HPV16 | E2 | 170 | 11 | QFKDDAEKYSK | | 40015 |
| HPV16 | E2 | 345 | 10 | QFLSQVKIPK | | 40016 |
| HPV16 | E2 | 76 | 8 | QLTLETIY | | 40017 |
| HPV16 | E2 | 235 | 8 | QTTIQRPR | | 40018 |
| HPV16 | E2 | 151 | 8 | QVDYYGLY | | 40019 |
| HPV16 | E2 | 151 | 9 | QVDYYGLYY | | 40020 |
| HPV16 | E2 | 151 | 11 | QVDYYGLYYVH | | 40021 |
| HPV16 | E2 | 57 | 10 | QVVPTLAVSK | | 40022 |
| HPV16 | E2 | 27 | 8 | RDHIDYWK | | 40023 |
| HPV16 | E2 | 27 | 9 | RDHIDYWKH | | 40024 |
| HPV16 | E2 | 27 | 11 | RDHIDYWKHMR | | 40025 |
| HPV16 | E2 | 343 | 9 | RDQFLSQVK | | 40026 |
| HPV16 | E2 | 304 | 9 | RFKKHCTLY | | 40027 |
| HPV16 | E2 | 37 | 8 | RLECAIYY | | 40028 |
| HPV16 | E2 | 37 | 9 | RLECAIYYK | | 40029 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV16 | E2 | 37 | 11 | RLECAIYYKAR | | 40030 |
| HPY16 | E2 | 7 | 8 | RLNVCQDK | | 40031 |
| HPV16 | E2 | 242 | 11 | RSEPDTGNPCH | | 40032 |
| HPV16 | E2 | 165 | 8 | RTYFVQFK | | 40033 |
| HPV16 | E2 | 330 | 8 | SAIVTLTY | | 40034 |
| HPV16 | E2 | 202 | 11 | SNEVSSPEIIR | | 40035 |
| HPV16 | E2 | 283 | 8 | SNTTPIVH | | 40036 |
| HPV16 | E2 | 283 | 10 | SNTTPIVHLK | | 40037 |
| HPV16 | E2 | 206 | 9 | SSPEIIRQH | | 40038 |
| HPV16 | E2 | 316 | 9 | SSTWHWTGH | | 40039 |
| HPV16 | E2 | 23 | 10 | STDLRDHIDY | | 40040 |
| HPV16 | E2 | 317 | 8 | STWHWTGH | | 40041 |
| HPV16 | E2 | 317 | 11 | STWHWTGHNVK | | 40042 |
| HPV16 | E2 | 144 | 11 | SVTVVEGQVDY | | 40043 |
| HPV16 | E2 | 269 | 8 | TAFNSSHK | | 40044 |
| HPV16 | E2 | 269 | 10 | TAFNSSHKGR | | 40045 |
| HPV16 | E2 | 104 | 8 | TAPTGCIK | | 40046 |
| HPV16 | E2 | 104 | 9 | TAPTGCIKK | | 40047 |
| HPV16 | E2 | 104 | 10 | TAPTGCIKKH | | 40048 |
| HPV16 | E2 | 313 | 8 | TAVSSTWH | | 40049 |
| HPV16 | E2 | 24 | 9 | TDLRDHIDY | | 40050 |
| HPV16 | E2 | 24 | 11 | TDLRDHIDYWK | | 40051 |
| HPV16 | E2 | 107 | 9 | TGCIKKHGY | | 40052 |
| HPV16 | E2 | 322 | 8 | TGHNVKHK | | 40053 |
| HPV16 | E2 | 247 | 9 | TGNPCHTTK | | 40054 |
| HPV16 | E2 | 81 | 11 | TIYNSQYSNEK | | 40055 |
| HPV16 | E2 | 61 | 8 | TLAVSKNK | | 40056 |
| HPV16 | E2 | 78 | 10 | TLETIYNSQY | | 40057 |
| HPV16 | E2 | 297 | 8 | TLKCLRYR | | 40058 |
| HPV16 | E2 | 297 | 10 | TLKCLRYRFK | | 40059 |
| HPV16 | E2 | 297 | 11 | TLKCLRYRFKK | | 40060 |
| HPV16 | E2 | 93 | 10 | TLQDVSLEVY | | 40061 |
| HPV16 | E2 | 334 | 10 | TLTYDSEWQR | | 40062 |
| HPV16 | E2 | 310 | 11 | TLYTAVSSTWH | | 40063 |
| HPV16 | E2 | 128 | 9 | TMHYTNWTH | | 40064 |
| HPV16 | E2 | 128 | 11 | TMHYTNWTHIY | | 40065 |
| HPV16 | E2 | 285 | 8 | TTPIVHLK | | 40066 |
| HPV16 | E2 | 146 | 9 | TVVEGQVDY | | 40067 |
| HPV16 | E2 | 146 | 10 | TVVEGQVDYY | | 40068 |
| HPV16 | E2 | 10 | 9 | VCQDKILTH | | 40069 |
| HPV16 | E2 | 10 | 10 | VCQDKILTHY | | 40070 |
| HPV16 | E2 | 152 | 8 | VDYYGLYY | | 40071 |
| HPV16 | E2 | 152 | 10 | VDYYGLYYVH | | 40072 |
| HPV16 | E2 | 205 | 8 | VSSPEIR | | 40073 |
| HPV16 | E2 | 205 | 10 | VSSPEIIRQH | | 40074 |
| HPV16 | E2 | 315 | 10 | VSSTWIIWTGH | | 40075 |
| HPV16 | E2 | 333 | 11 | VTLTYDSEWQR | | 40076 |
| HPV16 | E2 | 145 | 10 | VTVVEGQVDY | | 40077 |
| HPV16 | E2 | 145 | 11 | VTVVEGQVDYY | | 40078 |
| HPV16 | E2 | 147 | 8 | VVEGQVDY | | 40079 |
| HPV16 | E2 | 147 | 9 | VVEGQVDYY | | 40080 |
| HPV16 | E2 | 58 | 9 | VVPTLAVSK | | 40081 |
| HPV16 | E2 | 58 | 11 | VVPTLAVSKNK | | 40082 |
| HPV16 | E2 | 321 | 8 | WTGHNVKH | | 40083 |
| HPV16 | E2 | 321 | 9 | WTGHNVKHK | | 40084 |
| HPV16 | E2 | 92 | 11 | WTLQDVSLEVY | | 40085 |
| HPV16 | E2 | 167 | 11 | YFVQFKDDAEK | | 40086 |
| HPV16 | E2 | 155 | 11 | YGLYYVHEGIR | | 40087 |
| HPV16 | E2 | 102 | 10 | YLTAPTGCIK | | 40088 |
| HPV16 | E2 | 102 | 11 | YLTAPTGCIKK | | 40089 |
| HPV16 | E2 | 83 | 9 | YNSQYSNEK | | 40090 |
| HPV16 | E2 | 178 | 10 | YSKNKVWEVH | | 40091 |
| HPV16 | E2 | 312 | 9 | YTAVSSTWH | | 40092 |
| HPV16 | E2 | 131 | 8 | YTNWTHIY | | 40093 |
| HPV16 | E2 | 159 | 9 | YVHEGIRTY | | 40094 |
| HPV16 | E5 | 53 | 11 | AASAFRCFIVY | | 40095 |
| HPV16 | E5 | 56 | 8 | AFRCFIVY | | 40096 |
| HPV16 | E5 | 54 | 10 | ASAFRCFIVY | | 40097 |
| HPV16 | E5 | 59 | 10 | CFIVYIIFVY | | 40098 |
| HPV16 | E5 | 20 | 11 | CVLLCVCLLIR | | 40099 |
| HPV16 | E5 | 60 | 9 | FIVYIIFVY | | 40100 |
| HPV16 | E5 | 72 | 8 | FLIHTHAR | | 40101 |
| HPV16 | E5 | 66 | 10 | FVYIPLFLIH | | 40102 |
| HPV16 | E5 | 65 | 11 | IFVYIPLFLIH | | 40103 |
| HPV16 | E5 | 51 | 8 | ITAASAFR | | 40104 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV16 | E5 | 61 | 8 | IVYIIFVY | | 40105 |
| HPV16 | E5 | 23 | 8 | LCVCLLIR | | 40106 |
| HPV16 | E5 | 71 | 9 | LFLIHTHAR | | 40107 |
| HPV16 | E5 | 22 | 9 | LLCVCLLIR | | 40108 |
| HPV16 | E5 | 32 | 8 | LLLSVSTY | | 40109 |
| HPV16 | E5 | 48 | 11 | LLWITAASAFR | | 40110 |
| HPV16 | E5 | 70 | 8 | PLFLIHTH | | 40111 |
| HPV16 | E5 | 70 | 10 | PLFLIHTHAR | | 40112 |
| HPV16 | E5 | 31 | 9 | PLLLSVSTY | | 40113 |
| HPV16 | E5 | 58 | 11 | RCFIVYIIFVY | | 40114 |
| HPV16 | E5 | 55 | 9 | SAFRCFIVY | | 40115 |
| HPV16 | E5 | 21 | 10 | VLLCVCLLIR | | 40116 |
| HPV16 | E5 | 50 | 9 | WITAASAFR | | 40117 |
| HPV16 | E5 | 68 | 8 | YIPLFLIH | | 40118 |
| HPV16 | E5 | 68 | 10 | YIPLFLIHTH | | 40119 |
| HPV16 | E6 | 53 | 9 | AFRDLCIVY | 0.0001 | 40120 |
| HPV16 | E6 | 53 | 10 | AFRDLCIVYR | | 40121 |
| HPV16 | E6 | 7 | 9 | AMFQDPQER | 0.0320 | 40122 |
| HPV16 | E6 | 7 | 11 | AMFQDPQERPR | | 40123 |
| HPV16 | E6 | 68 | 8 | AVCDKCLK | 0.0110 | 40124 |
| HPV16 | E6 | 68 | 10 | AVCDKCLKFY | 0.0190 | 40125 |
| HPV16 | E6 | 146 | 8 | CCRSSRTR | | 40126 |
| HPV16 | E6 | 146 | 9 | CCRSSRTRR | 0.0001 | 40127 |
| HPV16 | E6 | 70 | 8 | CDKCLKFY | | 40128 |
| HPV16 | E6 | 70 | 10 | CDKCLKFYSK | | 40129 |
| HPV16 | E6 | 58 | 10 | CIVYRDGNPY | 0.0004 | 40130 |
| HPV16 | E6 | 73 | 11 | CLKFYSKISEY | | 40131 |
| HPV16 | E6 | 143 | 9 | CMSCCRSSR | 0.0001 | 40132 |
| HPV16 | E6 | 143 | 11 | CMSCCRSSRTR | | 40133 |
| HPV16 | E6 | 23 | 9 | CTELQTTIH | 0.0001 | 40134 |
| HPV16 | E6 | 37 | 10 | CVYCKQQLLR | 0.0005 | 40135 |
| HPV16 | E6 | 37 | 11 | CVYCKQQLLRR | | 40136 |
| HPV16 | E6 | 51 | 11 | DFAFRDLCIVY | | 40137 |
| HPV16 | E6 | 63 | 10 | DGNPYAVCDK | | 40138 |
| HPV16 | E6 | 32 | 8 | DIILECVY | | 40139 |
| HPV16 | E6 | 32 | 10 | DIILECVYCK | 0.0210 | 40140 |
| HPV16 | E6 | 105 | 11 | DLLIRCINCQK | | 40141 |
| HPV16 | E6 | 36 | 11 | ECVYCKQQLLR | | 40142 |
| HPV16 | E6 | 48 | 8 | EVYDFAFR | 0.0025 | 40143 |
| HPV16 | E6 | 52 | 10 | FAFRDLCIVY | | 40144 |
| HPV16 | E6 | 52 | 11 | FAFRDLCIVYR | | 40145 |
| HPV16 | E6 | 64 | 9 | GNPYAVCDK | 0.0001 | 40146 |
| HPV16 | E6 | 92 | 8 | GTTLEQQY | | 40147 |
| HPV16 | E6 | 92 | 10 | GTTLEQQYNK | 0.0700 | 40148 |
| HPV16 | E6 | 31 | 9 | HDIILECVY | 0.0001 | 40149 |
| HPV16 | E6 | 31 | 11 | HDIILECVYCK | | 40150 |
| HPV16 | E6 | 125 | 9 | HLDKKQRFH | 0.0001 | 40151 |
| HPV16 | E6 | 133 | 10 | HNIRGRWTGR | | 40152 |
| HPV16 | E6 | 33 | 9 | IILECVYCK | 0.0190 | 40153 |
| HPV16 | E6 | 34 | 8 | ILECVYCK | | 40154 |
| HPV16 | E6 | 80 | 9 | ISEYRHYCY | 0.0150 | 40155 |
| HPV16 | E6 | 59 | 9 | IVYRDGNPY | 0.1500 | 40156 |
| HPV16 | E6 | 72 | 8 | KCLKFYSK | | 40157 |
| HPV16 | E6 | 75 | 9 | KFYSKISEY | 0.0002 | 40158 |
| HPV16 | E6 | 75 | 10 | KFYSKISEYR | 0.0002 | 40159 |
| HPV16 | E6 | 75 | 11 | KFYSKISEYRH | | 40160 |
| HPV16 | E6 | 79 | 8 | KISEYRHY | | 40161 |
| HPV16 | E6 | 79 | 10 | KISEYRHYCY | 0.0038 | 40162 |
| HPV16 | E6 | 57 | 11 | LCIVYRDGNPY | | 40163 |
| HPV16 | E6 | 117 | 8 | LCPEEKQR | | 40164 |
| HPV16 | E6 | 117 | 9 | LCPEEKQRH | 0.0001 | 40165 |
| HPV16 | E6 | 22 | 10 | LCTELQTTIH | | 40166 |
| HPV16 | E6 | 126 | 8 | LDKKQRFH | | 40167 |
| HPV16 | E6 | 126 | 11 | LDKKQRFHNIR | | 40168 |
| HPV16 | E6 | 107 | 9 | LIRCINCQK | 0.0009 | 40169 |
| HPV16 | E6 | 106 | 10 | LLIRCINCQK | 0.1800 | 40170 |
| HPV16 | E6 | 8 | 8 | MFQDPQER | | 40171 |
| HPV16 | E6 | 8 | 10 | MFQDPQERPR | | 40172 |
| HPV16 | E6 | 8 | 11 | MFQDPQERPRK | | 40173 |
| HPV16 | E6 | 144 | 8 | MSCCRSSR | | 40174 |
| HPV16 | E6 | 144 | 10 | MSCCRSSRTR | | 40175 |
| HPV16 | E6 | 144 | 11 | MSCCRSSRTRR | | 40176 |
| HPV16 | E6 | 112 | 11 | NCQKPLCPEEK | | 40177 |
| HPV16 | E6 | 134 | 9 | NIRGRWTGR | 0.0005 | 40178 |
| HPV16 | E6 | 102 | 8 | PLCDLLIR | | 40179 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV16 | E6 | 116 | 9 | PLCPEEKQR | 0.0005 | 40180 |
| HPV16 | E6 | 116 | 10 | PLCPEEKQRH | | 40181 |
| HPV16 | E6 | 10 | 8 | QDPQERPR | | 40182 |
| HPV16 | E6 | 10 | 9 | QDPQERPRK | | 40183 |
| HPV16 | E6 | 21 | 11 | QLCTELQTTIH | | 40184 |
| HPV16 | E6 | 43 | 8 | QLLRREVY | | 40185 |
| HPV16 | E6 | 142 | 10 | RCMSCCRSSR | | 40186 |
| HPV16 | E6 | 62 | 11 | RDGNPYAVCDK | | 40187 |
| HPV16 | E6 | 55 | 8 | RDLCIVYR | | 40188 |
| HPV16 | E6 | 131 | 8 | RFHNIRGR | | 41089 |
| HPV16 | E6 | 5 | 11 | RTAMFQDPQER | | 40190 |
| HPV16 | E6 | 145 | 9 | SCCRSSRTR | 0.0001 | 40191 |
| HPV16 | E6 | 145 | 10 | SCCRSSRTRR | | 40192 |
| HPV16 | E6 | 89 | 11 | SLYGTTLEQQY | | 40193 |
| HPV16 | E6 | 6 | 10 | TAMFQDPQER | | 40194 |
| HPV16 | E6 | 140 | 9 | TGRCMSCCR | 0.0001 | 40195 |
| HPV16 | E6 | 29 | 11 | TIHDIILECVY | | 40196 |
| HPV16 | E6 | 94 | 8 | TLEQQYNK | | 40197 |
| HPV16 | E6 | 93 | 9 | TTLEQQYNK | 0.2900 | 40198 |
| HPV16 | E6 | 69 | 9 | VCDKCLKFY | 0.0002 | 40199 |
| HPV16 | E6 | 69 | 11 | VCDKCLKFYSK | | 40200 |
| HPV16 | E6 | 139 | 10 | WTGRCMSCCR | 0.0008 | 40201 |
| HPV16 | E6 | 67 | 9 | YAVCDKCLK | 0.0010 | 40202 |
| HPV16 | E6 | 67 | 11 | YAVCDKCLKFY | | 40203 |
| HPV16 | E6 | 39 | 8 | YCKQQLLR | | 40204 |
| HPV16 | E6 | 39 | 9 | YCKQQLLRR | 0.0001 | 40205 |
| HPV16 | E6 | 91 | 9 | YGTTLEQQY | | 40206 |
| HPV16 | E6 | 91 | 11 | YGTTLEQQYNK | | 40207 |
| HPV16 | E6 | 99 | 11 | YNKPLCDLLIR | | 40208 |
| HPV16 | E6 | 77 | 8 | YSKISEYR | | 40209 |
| HPV16 | E6 | 77 | 9 | YSKISEYRH | | 40210 |
| HPV16 | E6 | 77 | 10 | YSKIESYRHY | 0.0001 | 40211 |
| HPV16 | E7 | 42 | 8 | AGQAEPDR | | 40212 |
| HPV16 | E7 | 42 | 10 | AGQAEPDRAH | | 40213 |
| HPV16 | E7 | 42 | 11 | AGQAEPDRAHY | | 40214 |
| HPV16 | E7 | 58 | 9 | CCKCDSTLR | 0.0001 | 40215 |
| HPV16 | E7 | 68 | 10 | CVQSTHVDIR | 0.0001 | 40216 |
| HPV16 | E7 | 39 | 11 | DGPAGQAEPDR | | 40217 |
| HPV16 | E7 | 14 | 10 | DLQPETTDLY | 0.0002 | 40218 |
| HPV16 | E7 | 4 | 8 | DTPTLHEY | | 40219 |
| HPV16 | E7 | 18 | 8 | ETTDLYCY | 0.0001 | 40220 |
| HPV16 | E7 | 57 | 10 | FCCKCDSTLR | | 40221 |
| HPV16 | E7 | 3 | 9 | GDTPTLHEY | | 40222 |
| HPV16 | E7 | 88 | 10 | GIVCPICSQK | 0.0670 | 40223 |
| HPV16 | E7 | 2 | 8 | HGDTPTLH | | 40224 |
| HPV16 | E7 | 2 | 10 | HGDTPTLHEY | 0.0001 | 40225 |
| HPV16 | E7 | 89 | 9 | IVCPICSQK | 0.0065 | 40226 |
| HPV16 | E7 | 67 | 11 | LCVQSTHVDIR | | 40227 |
| HPV16 | E7 | 13 | 11 | LDLQPETTDLY | | 40228 |
| HPV16 | E7 | 87 | 11 | LGIVCPICSQK | | 40229 |
| HPV16 | E7 | 53 | 8 | NIVTFCCK | | 40230 |
| HPV16 | E7 | 41 | 9 | PAGQAEPDR | | 40231 |
| HPV16 | E7 | 41 | 11 | PAGQAEPDRAH | | 40232 |
| HPV16 | E7 | 44 | 8 | QAEPDRAH | | 40233 |
| HPV16 | E7 | 44 | 9 | QAEPDRAHY | 0.0002 | 40234 |
| HPV16 | E7 | 70 | 8 | QSTHVDIR | | 40235 |
| HPV16 | E7 | 66 | 8 | RLCVQSTH | | 40236 |
| HPV16 | E7 | 63 | 11 | STLRLCVQSTH | | 40237 |
| HPV16 | E7 | 56 | 11 | TFCCKCDSTLR | | 40238 |
| HPV16 | E7 | 64 | 10 | TLRLCVQSTH | | 40239 |
| HPV16 | E7 | 90 | 8 | VCPICSQK | | 40240 |
| HPV16 | E7 | 52 | 9 | YNIVTFCCK | 0.0022 | 40241 |
| HPV16 | L1 | 372 | 10 | AAISTSETTY | | 40242 |
| HPV16 | L1 | 372 | 11 | AAISTSETTYK | | 40243 |
| HPV16 | L1 | 162 | 9 | AANAGVDNR | | 40244 |
| HPV16 | L1 | 453 | 11 | ACQKHTPPAPK | | 40245 |
| HPV16 | L1 | 127 | 9 | ACVGVEVGR | | 40246 |
| HPV16 | L1 | 483 | 10 | ADLDQFPLGR | | 40247 |
| HPV16 | L1 | 483 | 11 | ADLDQFPLGRK | | 40248 |
| HPV16 | L1 | 411 | 8 | ADVMTYIH | | 40249 |
| HPV16 | L1 | 498 | 8 | AGLKAKPK | | 40250 |
| HPV16 | L1 | 63 | 11 | AGTSRLLAVGH | | 40251 |
| HPV16 | L1 | 373 | 9 | AISTSETTY | | 40252 |
| HPV16 | L1 | 373 | 10 | AISTSETTYK | | 40253 |
| HPV16 | L1 | 233 | 11 | AMDFTTLQANK | | 40254 |

TABLE XVII-continued

A11 Motif Peptides

| Type | Protein | Position | No. of Amino Acids | Sequence | A*1101 | Seq. Id. No. |
|---|---|---|---|---|---|---|
| HPV16 | L1 | 163 | 8 | ANAGVDNR | | 40255 |
| HPV16 | L1 | 310 | 8 | ANLASSNY | | 40256 |
| HPV16 | L1 | 292 | 11 | AVGENVPDDLY | | 40257 |
| HPV16 | L1 | 70 | 10 | AVGHPYFPIK | | 40258 |
| HPV16 | L1 | 70 | 11 | AVGHPYFPIKK | | 40259 |
| HPV16 | L1 | 371 | 11 | CAAISTSETTY | | 40260 |
| HPV16 | L1 | 251 | 10 | CTSICKYPDY | | 40261 |
| HPV16 | L1 | 128 | 8 | CVGVEVGR | | 40262 |
| HPV16 | L1 | 329 | 9 | DAQIFNKPY | | 40263 |
| HPV16 | L1 | 153 | 9 | DDTENASAY | | 40264 |
| HPV16 | L1 | 235 | 9 | DFTTLQANK | | 40265 |
| HPV16 | L1 | 249 | 8 | DICTSICK | | 40266 |
| HPV16 | L1 | 249 | 9 | DICTSICKY | | 40267 |
| HPV16 | L1 | 484 | 9 | DLDQFPLGR | | 40268 |
| HPV16 | L1 | 484 | 10 | DLDQFPLGRK | | 40269 |
| HPV16 | L1 | 397 | 10 | DLQFIFQLCK | | 40270 |
| HPV16 | L1 | 168 | 10 | DNRECISMDY | | 40271 |
| HPV16 | L1 | 168 | 11 | DNRECISMDYK | | 40272 |
| HPV16 | L1 | 270 | 8 | DSLFFYLR | | 40273 |
| HPV16 | L1 | 270 | 9 | DSLFFYLRR | | 40274 |
| HPV16 | L1 | 154 | 8 | DTENASAY | | 40275 |
| HPV16 | L1 | 113 | 11 | DTSFYNPDTQR | | 40276 |
| HPV16 | L1 | 171 | 8 | ECISMDYK | | 40277 |
| HPV16 | L1 | 15 | 8 | ENDVNVYH | | 40278 |
| HPV16 | L1 | 295 | 8 | ENVPDDLY | | 40279 |
| HPV16 | L1 | 295 | 10 | ENVPDDLYIK | | 40280 |
| HPV16 | L1 | 378 | 10 | ETTYKNTNFK | | 40281 |
| HPV16 | L1 | 109 | 9 | FGFPDTSFY | | 40282 |
| HPV16 | L1 | 5 | 10 | FIYILVITCY | | 40283 |
| HPV16 | L1 | 494 | 8 | FLLQAGLK | | 40284 |
| HPV16 | L1 | 494 | 10 | FLLQAGLKAK | | 40285 |
| HPV16 | L1 | 333 | 9 | FNKPYWLQR | | 40286 |
| HPV16 | L1 | 236 | 8 | FTTLQANK | | 40287 |
| HPV16 | L1 | 282 | 8 | FVRHLFNR | | 40288 |
| HPV16 | L1 | 446 | 11 | FVTSQAIACQK | | 40289 |
| HPV16 | L1 | 356 | 9 | FVTVVDTTR | | 40290 |
| HPV16 | L1 | 186 | 9 | GCKPPIGEH | | 40291 |
| HPV16 | L1 | 269 | 9 | GDSLFFYLR | | 40292 |
| HPV16 | L1 | 269 | 10 | GDSLFFYLRR | | 40293 |
| HPV16 | L1 | 110 | 8 | GFPDTSFY | | 40294 |
| HPV16 | L1 | 437 | 8 | GGTLEDTY | | 40295 |
| HPV16 | L1 | 437 | 9 | GGTLEDTYR | | 40296 |
| HPV16 | L1 | 142 | 10 | GISGHPLLNK | | 40297 |
| HPV16 | L1 | 93 | 8 | GLQYRVFR | | 40298 |
| HPV16 | L1 | 93 | 10 | GLQYRVFRIH | | 40299 |
| HPV16 | L1 | 307 | 11 | GSTANLASSNY | | 40300 |
| HPV16 | L1 | 438 | 8 | GTLEDTYR | | 40301 |
| HPV16 | L1 | 64 | 10 | GTSRLLAVGH | | 40302 |
| HPV16 | L1 | 254 | 9 | ICKYPDYIK | | 40303 |
| HPV16 | L1 | 250 | 8 | ICTSICKY | | 40304 |
| HPV16 | L1 | 250 | 11 | ICTSICKYPDY | | 40305 |
| HPV16 | L1 | 332 | 10 | IFNKPYWLQR | | 40306 |
| HPV16 | L1 | 185 | 10 | IGCKPPIGEH | | 40307 |
| HPV16 | L1 | 86 | 11 | ILVPKVSGLQY | | 40308 |
| HPV16 | L1 | 143 | 9 | ISGHPLLNK | | 40309 |
| HPV16 | L1 | 374 | 8 | ISTSETTY | | 40310 |
| HPV16 | L1 | 374 | 9 | ISTSETTYK | | 40311 |
| HPV16 | L1 | 11 | 11 | ITCYENDVNVY | | 40312 |
| HPV16 | L1 | 407 | 10 | ITLTADVMTY | | 40313 |
| HPV16 | L1 | 501 | 10 | KAKPKFTLGK | | 40314 |
| HPV16 | L1 | 501 | 11 | KAKPKFTLGKR | | 40315 |
| HPV16 | L1 | 108 | 10 | KFGFPDTSFY | | 40316 |
| HPV16 | L1 | 493 | 9 | KFLLQAGLK | | 40317 |
| HPV16 | L1 | 493 | 11 | KFLLQAGLKAK | | 40318 |
| HPV16 | L1 | 505 | 8 | KFTLGKRK | | 40319 |
| HPV16 | L1 | 406 | 11 | KITLTADVMTY | | 40320 |
| HPV16 | L1 | 151 | 11 | KLDDTENASAY | | 40321 |
| HPV16 | L1 | 382 | 8 | KNTNFKEY | | 40322 |
| HPV16 | L1 | 382 | 10 | KNTNFKEYLR | | 40323 |
| HPV16 | L1 | 382 | 11 | KNTNFKEYLRH | | 40324 |
| HPV16 | L1 | 90 | 8 | KVSGLQYR | | 40325 |
| HPV16 | L1 | 90 | 11 | KVSGLQYRVFR | | 40326 |
| HPV16 | L1 | 46 | 8 | KVVSTDEY | | 40327 |
| HPV16 | L1 | 46 | 11 | KVVSTDEYVAR | | 40328 |
| HPV16 | L1 | 69 | 11 | LAVGHPYFPIK | | 40329 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV16 | L1 | 152 | 10 | LDDTENASAY | | 40330 |
| HPV16 | L1 | 248 | 9 | LDICTSICK | | 40331 |
| HPV16 | L1 | 248 | 10 | LDICTSICKY | | 40332 |
| HPV16 | L1 | 485 | 8 | LDQFPLGR | | 40333 |
| HPV16 | L1 | 485 | 9 | LDQFPLGRK | | 40334 |
| HPV16 | L1 | 355 | 10 | LFVTVVDTTR | | 40335 |
| HPV16 | L1 | 139 | 8 | LGVGISGH | | 40336 |
| HPV16 | L1 | 184 | 11 | LIGCKPPIGEH | | 40337 |
| HPV16 | L1 | 68 | 8 | LLAVGHPY | | 40338 |
| HPV16 | L1 | 495 | 9 | LLQAGLKAK | | 40339 |
| HPV16 | L1 | 495 | 11 | LLQAGLKAKPK | | 40340 |
| HPV16 | L1 | 409 | 8 | LTADVMTY | | 40341 |
| HPV16 | L1 | 409 | 10 | LTADVMTYIH | | 40342 |
| HPV16 | L1 | 87 | 10 | LVPKVSGLQY | | 40343 |
| HPV16 | L1 | 87 | 11 | LVPKVSGLQYR | | 40344 |
| HPV16 | L1 | 234 | 10 | MDFTTLQANK | | 40345 |
| HPV16 | L1 | 281 | 9 | MFVRHLFNR | | 40346 |
| HPV16 | L1 | 325 | 11 | MVTSDAQIFNK | | 40347 |
| HPV16 | L1 | 385 | 8 | NFKEYLRH | | 40348 |
| HPV16 | L1 | 58 | 10 | NIYYHAGTSR | | 40349 |
| HPV16 | L1 | 83 | 8 | NNKILVPK | | 40350 |
| HPV16 | L1 | 82 | 9 | NNNKILVPK | | 40351 |
| HPV16 | L1 | 383 | 9 | NTNFKEYLR | | 40352 |
| HPV16 | L1 | 383 | 10 | NTNFKEYLRH | | 40353 |
| HPV16 | L1 | 296 | 9 | NVPDDLYIK | | 40354 |
| HPV16 | L1 | 460 | 9 | PAPKEDPLK | | 40355 |
| HPV16 | L1 | 460 | 10 | PAPKEDPLKK | | 40356 |
| HPV16 | L1 | 460 | 11 | PAPKEDPLKKY | | 40357 |
| HPV16 | L1 | 258 | 11 | PDYIKMVSEPY | | 40358 |
| HPV16 | L1 | 436 | 9 | PGGTLEDTY | | 40359 |
| HPV16 | L1 | 436 | 10 | PGGTLEDTYR | | 40360 |
| HPV16 | L1 | 190 | 8 | PIGEHWGK | | 40361 |
| HPV16 | L1 | 77 | 9 | PIKKPNNNK | | 40362 |
| HPV16 | L1 | 247 | 10 | PLDICTSICK | | 40363 |
| HPV16 | L1 | 247 | 11 | PLDICTSICKY | | 40364 |
| HPV16 | L1 | 138 | 9 | PLGVGISGH | | 40365 |
| HPV16 | L1 | 81 | 10 | PNNNKILVPK | | 40366 |
| HPV16 | L1 | 515 | 11 | PTTSSTSTTAK | | 40367 |
| HPV16 | L1 | 43 | 11 | PVSKVVSTDEY | | 40368 |
| HPV16 | L1 | 497 | 9 | QAGLKAKPK | | 40369 |
| HPV16 | L1 | 450 | 8 | QAIACQKH | | 40370 |
| HPV16 | L1 | 399 | 8 | QFIFQLCK | | 40371 |
| HPV16 | L1 | 331 | 11 | QIFNKPYWLQR | | 40372 |
| HPV16 | L1 | 181 | 8 | QLCLIGCK | | 40373 |
| HPV16 | L1 | 354 | 11 | QLFVTVVDTTR | | 40374 |
| HPV16 | L1 | 280 | 10 | QMFVRHLFNR | | 40375 |
| HPV16 | L1 | 179 | 10 | QTQLCLIGCK | | 40376 |
| HPV16 | L1 | 100 | 9 | RIHLPDPNK | | 40377 |
| HPV16 | L1 | 67 | 9 | RLLAVGHPY | | 40378 |
| HPV16 | L1 | 482 | 11 | SADLDQFPLGR | | 40379 |
| HPV16 | L1 | 328 | 8 | SDAQIFNK | | 40380 |
| HPV16 | L1 | 328 | 10 | SDAQIFNKPY | | 40381 |
| HPV16 | L1 | 115 | 9 | SFYNPDTQR | | 40382 |
| HPV16 | L1 | 144 | 8 | SGHPLLNK | | 40383 |
| HPV16 | L1 | 92 | 9 | SGLQYRVFR | | 40384 |
| HPV16 | L1 | 92 | 11 | SGLQYRVFRIH | | 40385 |
| HPV16 | L1 | 253 | 8 | SICKYPDY | | 40386 |
| HPV16 | L1 | 253 | 10 | SICKYPDYIK | | 40387 |
| HPV16 | L1 | 271 | 8 | SLFFYLRR | | 40388 |
| HPV16 | L1 | 28 | 11 | SLWLPSEATVY | | 40389 |
| HPV16 | L1 | 518 | 8 | SSTSTTAK | | 40390 |
| HPV16 | L1 | 518 | 9 | SSTSTTAKR | | 40391 |
| HPV16 | L1 | 518 | 10 | SSTSTTAKRK | | 40392 |
| HPV16 | L1 | 518 | 11 | SSTSTTAKRKK | | 40393 |
| HPV16 | L1 | 308 | 10 | STANLASSNY | | 40394 |
| HPV16 | L1 | 49 | 8 | STDEYVAR | | 40395 |
| HPV16 | L1 | 375 | 8 | STSETTYK | | 40396 |
| HPV16 | L1 | 519 | 8 | STSTTAKR | | 40397 |
| HPV16 | L1 | 519 | 9 | STSTTAKRK | | 40398 |
| HPV16 | L1 | 519 | 10 | STSTTAKRKK | | 40399 |
| HPV16 | L1 | 519 | 11 | STSTTAKRKKR | | 40400 |
| HPV16 | L1 | 521 | 8 | STTAKRKK | | 40401 |
| HPV16 | L1 | 521 | 9 | STTAKRKKR | | 40402 |
| HPV16 | L1 | 521 | 10 | STTAKRKKRK | | 40403 |
| HPV16 | L1 | 410 | 9 | TADVMTYIH | | 40404 |

TABLE XVII-continued

A11 Motif Peptides

| Type | Protein | Position | No. of Amino Acids | Sequence | A*1101 | Seq. Id. No. |
|---|---|---|---|---|---|---|
| HPV16 | L1 | 523 | 8 | TAKRKKRK | | 40405 |
| HPV16 | L1 | 309 | 9 | TANLASSNY | | 40406 |
| HPV16 | L1 | 12 | 10 | TCYENDVNVY | | 40407 |
| HPV16 | L1 | 12 | 11 | TCYENDVNVYH | | 40408 |
| HPV16 | L1 | 50 | 11 | TDEYVARTNIY | | 40409 |
| HPV16 | L1 | 4 | 11 | TFIYILVITCY | | 40410 |
| HPV16 | L1 | 471 | 8 | TFWEVNLK | | 40411 |
| HPV16 | L1 | 471 | 10 | TFWEVNLKEK | | 40412 |
| HPV16 | L1 | 408 | 9 | TLTADVMTY | | 40413 |
| HPV16 | L1 | 408 | 11 | TLTADVMTYIH | | 40414 |
| HPV16 | L1 | 384 | 8 | TNFKEYLR | | 40415 |
| HPV16 | L1 | 384 | 9 | TNFKEYLRH | | 40416 |
| HPV16 | L1 | 57 | 11 | TNIYYHAGTSR | | 40417 |
| HPV16 | L1 | 327 | 9 | TSDAQIFNK | | 40418 |
| HPV16 | L1 | 327 | 11 | TSDAQIFNKPY | | 40419 |
| HPV16 | L1 | 114 | 10 | TSFYNPDTQR | | 40420 |
| HPV16 | L1 | 252 | 9 | TSICKYPDY | | 40421 |
| HPV16 | L1 | 252 | 11 | TSICKYPDYIK | | 40422 |
| HPV16 | L1 | 448 | 9 | TSQAIACQK | | 40423 |
| HPV16 | L1 | 448 | 10 | TSQAIACQKH | | 40424 |
| HPV16 | L1 | 65 | 9 | TSRLLAVGH | | 40425 |
| HPV16 | L1 | 65 | 11 | TSRLLAVGHPY | | 40426 |
| HPV16 | L1 | 517 | 9 | TSSTSTTAK | | 40427 |
| HPV16 | L1 | 517 | 10 | TSSTSTTAKR | | 40428 |
| HPV16 | L1 | 517 | 11 | TSSTSTTAKRK | | 40429 |
| HPV16 | L1 | 520 | 8 | TSTTAKRK | | 40430 |
| HPV16 | L1 | 520 | 9 | TSTTAKRKK | | 40431 |
| HPV16 | L1 | 520 | 10 | TSTTAKRKKR | | 40432 |
| HPV16 | L1 | 520 | 11 | TSTTAKRKKRK | | 40433 |
| HPV16 | L1 | 522 | 8 | TTAKRKKR | | 40434 |
| HPV16 | L1 | 522 | 9 | TTAKRKKRK | | 40435 |
| HPV16 | L1 | 516 | 10 | TTSSTSTTAK | | 40436 |
| HPV16 | L1 | 516 | 11 | TTSSTSTTAKR | | 40437 |
| HPV16 | L1 | 379 | 9 | TTYKNTNFK | | 40438 |
| HPV16 | L1 | 379 | 11 | TTYKNTNFKEY | | 40439 |
| HPV16 | L1 | 36 | 11 | TVYLPPVPVSK | | 40440 |
| HPV16 | L1 | 54 | 8 | VARTNIYY | | 40441 |
| HPV16 | L1 | 54 | 9 | VARTNIYYH | | 40442 |
| HPV16 | L1 | 167 | 11 | VDNRECISMDY | | 40443 |
| HPV16 | L1 | 98 | 11 | VFRIHLPDPNK | | 40444 |
| HPV16 | L1 | 293 | 10 | VGENVPDDLY | | 40445 |
| HPV16 | L1 | 71 | 9 | VGHPYFPIK | | 40446 |
| HPV16 | L1 | 71 | 10 | VGHPYFPIKK | | 40447 |
| HPV16 | L1 | 141 | 11 | VGISGHPLLNK | | 40448 |
| HPV16 | L1 | 91 | 10 | VSGLQYRVFR | | 40449 |
| HPV16 | L1 | 44 | 10 | VSKVVSTDEY | | 40450 |
| HPV16 | L1 | 48 | 9 | VSTDEYVAR | | 40451 |
| HPV16 | L1 | 326 | 10 | VTSDAQIFNK | | 40452 |
| HPV16 | L1 | 447 | 10 | VTSQAIACQK | | 40453 |
| HPV16 | L1 | 447 | 11 | VTSQAIACQKH | | 40454 |
| HPV16 | L1 | 357 | 8 | VTVVDTTR | | 40455 |
| HPV16 | L1 | 47 | 10 | VVSTDEYVAR | | 40456 |
| HPV16 | L1 | 126 | 10 | WACVGVEVGR | | 40457 |
| HPV16 | L1 | 30 | 9 | WLPSEATVY | | 40458 |
| HPV16 | L1 | 338 | 8 | WLQRAQGH | | 40459 |
| HPV16 | L1 | 161 | 10 | YAANAGVDNR | | 40460 |
| HPV16 | L1 | 396 | 11 | YDLQFIFQLCK | | 40461 |
| HPV16 | L1 | 75 | 11 | YFPIKKPNNNK | | 40462 |
| HPV16 | L1 | 268 | 8 | YGDSLFFY | | 40463 |
| HPV16 | L1 | 268 | 10 | YGDSLFFYLR | | 40464 |
| HPV16 | L1 | 268 | 11 | YGDSLFFYLRR | | 40465 |
| HPV16 | L1 | 260 | 9 | YIKMVSEPY | | 40466 |
| HPV16 | L1 | 7 | 8 | YILVITCY | | 40467 |
| HPV16 | L1 | 38 | 9 | YLPPVPVSK | | 40468 |
| HPV16 | L1 | 389 | 8 | YLRHGEEY | | 40469 |
| HPV16 | L1 | 275 | 10 | YLRREQMFVR | | 40470 |
| HPV16 | L1 | 275 | 11 | YLRREQMFVRH | | 40471 |
| HPV16 | L1 | 470 | 9 | YTFWEVNLK | | 40472 |
| HPV16 | L1 | 470 | 11 | YTFWEVNLKEK | | 40473 |
| HPV16 | L1 | 53 | 8 | YVARTNIY | | 40474 |
| HPV16 | L1 | 53 | 9 | YVARTNIYY | | 40475 |
| HPV16 | L1 | 53 | 10 | YVARTNIYYH | | 40476 |
| HPV16 | L2 | 441 | 9 | ADAGDFYLH | | 40477 |
| HPV16 | L2 | 241 | 8 | AFITTPTK | | 40478 |
| HPV16 | L2 | 443 | 10 | AGDFYLHPSY | | 40479 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV16 | L2 | 443 | 11 | AGDFYLHPSYY | | 40480 |
| HPV16 | L2 | 25 | 11 | AGTCPPDIIPK | | 40481 |
| HPV16 | L2 | 288 | 10 | ALHRPALTSR | | 40482 |
| HPV16 | L2 | 288 | 11 | ALHRPALTSRR | | 40483 |
| HPV16 | L2 | 356 | 11 | ALPTSINNGLY | | 40484 |
| HPV16 | L2 | 293 | 10 | ALTSRRTGIR | | 40485 |
| HPV16 | L2 | 293 | 11 | ALTSRRTGIRY | | 40486 |
| HPV16 | L2 | 396 | 11 | ANTTIPFGGAY | | 40487 |
| HPV16 | L2 | 13 | 8 | ASATQLYK | | 40488 |
| HPV16 | L2 | 13 | 11 | ASATQLYKTCK | | 40489 |
| HPV16 | L2 | 82 | 9 | ATDTLAPVR | | 40490 |
| HPV16 | L2 | 15 | 9 | ATQLYKTCK | | 40491 |
| HPV16 | L2 | 442 | 8 | DAGDFYLH | | 40492 |
| HPV16 | L2 | 442 | 11 | DAGDFYLHPSY | | 40493 |
| HPV16 | L2 | 282 | 9 | DFLDIVALH | | 40494 |
| HPV16 | L2 | 282 | 10 | DFLDIVALHR | | 40495 |
| HPV16 | L2 | 445 | 8 | DFYLHPSY | | 40496 |
| HPV16 | L2 | 445 | 9 | DFYLHPSYY | | 40497 |
| HPV16 | L2 | 31 | 9 | DIIPKVEGK | | 40498 |
| HPV16 | L2 | 258 | 10 | EGIDVDNTLY | | 40499 |
| HPV16 | L2 | 340 | 10 | ELQTITPSTY | | 40500 |
| HPV16 | L2 | 242 | 11 | FITTPTKLITY | | 40501 |
| HPV16 | L2 | 283 | 8 | FLDIVALH | | 40502 |
| HPV16 | L2 | 283 | 9 | FLDIVALHR | | 40503 |
| HPV16 | L2 | 181 | 11 | FTLSSSTISTH | | 40504 |
| HPV16 | L2 | 321 | 8 | GAKVHYYY | | 40505 |
| HPV16 | L2 | 444 | 9 | GDFYLHPSY | | 40506 |
| HPV16 | L2 | 444 | 10 | GDFYLHPSYY | | 40507 |
| HPV16 | L2 | 259 | 9 | GIDVDNTLY | | 40508 |
| HPV16 | L2 | 59 | 11 | GIGTGSGTGGR | | 40509 |
| HPV16 | L2 | 300 | 10 | GIRYSRIGNK | | 40510 |
| HPV16 | L2 | 226 | 11 | GLYSRTTQQVK | | 40511 |
| HPV16 | L2 | 307 | 9 | GNKQTLRTR | | 40512 |
| HPV16 | L2 | 63 | 10 | GSGTGGRTGY | | 40513 |
| HPV16 | L2 | 218 | 11 | GSRPVARLGLY | | 40514 |
| HPV16 | L2 | 26 | 10 | GTCPPDIIPK | | 40515 |
| HPV16 | L2 | 65 | 8 | GTGGRTGY | | 40516 |
| HPV16 | L2 | 61 | 9 | GTGSGTGGR | | 40517 |
| HPV16 | L2 | 440 | 8 | IADAGDFY | | 40518 |
| HPV16 | L2 | 440 | 10 | IADAGDFYLH | | 40519 |
| HPV16 | L2 | 41 | 8 | IADQILQY | | 40520 |
| HPV16 | L2 | 260 | 8 | IDVDNTLY | | 40521 |
| HPV16 | L2 | 320 | 8 | IGAKVHYY | | 40522 |
| HPV16 | L2 | 320 | 9 | IGAKVHYYY | | 40523 |
| HPV16 | L2 | 306 | 8 | IGNKQTLR | | 40524 |
| HPV16 | L2 | 306 | 10 | IGNKQTLRTR | | 40525 |
| HPV16 | L2 | 60 | 10 | IGTGSGTGGR | | 40526 |
| HPV16 | L2 | 439 | 9 | IIADAGDFY | | 40527 |
| HPV16 | L2 | 439 | 11 | IIADAGDFYLH | | 40528 |
| HPV16 | L2 | 32 | 8 | IIPKVEGK | | 40529 |
| HPV16 | L2 | 361 | 9 | INNGLYDIY | | 40530 |
| HPV16 | L2 | 148 | 11 | INNTVTTVTTH | | 40531 |
| HPV16 | L2 | 344 | 11 | ITPSTYTTTSH | | 40532 |
| HPV16 | L2 | 243 | 10 | ITTPTKLITY | | 40533 |
| HPV16 | L2 | 250 | 8 | ITYDNPAY | | 40534 |
| HPV16 | L2 | 430 | 8 | IVPGSPQY | | 40535 |
| HPV16 | L2 | 248 | 10 | KLITYDNPAY | | 40536 |
| HPV16 | L2 | 318 | 8 | KSIGAKVH | | 40537 |
| HPV16 | L2 | 318 | 9 | KSIGAKVHY | | 40538 |
| HPV16 | L2 | 318 | 10 | KSIGAKVHYY | | 40539 |
| HPV16 | L2 | 318 | 11 | KSIGAKVHYYY | | 40540 |
| HPV16 | L2 | 39 | 10 | KTIADQILQY | | 40541 |
| HPV16 | L2 | 284 | 8 | LDIVALHR | | 40542 |
| HPV16 | L2 | 427 | 11 | LIPIVPGSPQY | | 40543 |
| HPV16 | L2 | 249 | 9 | LITYDNPAY | | 40544 |
| HPV16 | L2 | 183 | 9 | LSSSTISTH | | 40545 |
| HPV16 | L2 | 183 | 11 | LSSSTISTHNY | | 40546 |
| HPV16 | L2 | 294 | 9 | LTSRRTGIR | | 40547 |
| HPV16 | L2 | 294 | 10 | LTSRRTGIRY | | 40548 |
| HPV16 | L2 | 454 | 8 | MLRKRRKR | | 40549 |
| HPV16 | L2 | 454 | 11 | MLRKRRKRLPY | | 40550 |
| HPV16 | L2 | 362 | 8 | NNGLYDIY | | 40551 |
| HPV16 | L2 | 149 | 10 | NNTVTTVTTH | | 40552 |
| HPV16 | L2 | 397 | 10 | NTTIPFGGAY | | 40553 |
| HPV16 | L2 | 150 | 9 | NTVTTVTTH | | 40554 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV16 | L2 | 240 | 9 | PAFITTPTK | | 40555 |
| HPV16 | L2 | 292 | 11 | PALTSRRTGIR | | 40556 |
| HPV16 | L2 | 281 | 10 | PDFLDIVALH | | 40557 |
| HPV16 | L2 | 281 | 11 | PDFLDIVALHR | | 40558 |
| HPV16 | L2 | 30 | 10 | PDIIPKVEGK | | 40559 |
| HPV16 | L2 | 217 | 8 | PGSRPVAR | | 40560 |
| HPV16 | L2 | 215 | 10 | PIPGSRPVAR | | 40561 |
| HPV16 | L2 | 429 | 9 | PIVPGSPQY | | 40562 |
| HPV16 | L2 | 386 | 8 | PSTSLSGY | | 40563 |
| HPV16 | L2 | 346 | 9 | PSTYTITSH | | 40564 |
| HPV16 | L2 | 383 | 11 | PSVPSTSLSGY | | 40565 |
| HPV16 | L2 | 450 | 8 | PSYYMLRK | | 40566 |
| HPV16 | L2 | 450 | 9 | PSYYMLRKR | | 40567 |
| HPV16 | L2 | 450 | 10 | PSYYMLRKRR | | 40568 |
| HPV16 | L2 | 450 | 11 | PSYYMLRKRRK | | 40569 |
| HPV16 | L2 | 80 | 11 | PTATDTLAPVR | | 40570 |
| HPV16 | L2 | 172 | 9 | PTPAETGGH | | 40571 |
| HPV16 | L2 | 358 | 9 | PTSINNGLY | | 40572 |
| HPV16 | L2 | 221 | 8 | PVARLGLY | | 40573 |
| HPV16 | L2 | 221 | 10 | PVARLGLYSR | | 40574 |
| HPV16 | L2 | 342 | 8 | QTITPSTY | | 40575 |
| HPV16 | L2 | 310 | 9 | QTLRTRSGK | | 40576 |
| HPV16 | L2 | 12 | 8 | RASATQLY | | 40577 |
| HPV16 | L2 | 12 | 9 | RASATQLYK | | 40578 |
| HPV16 | L2 | 305 | 9 | RIGNKQTLR | | 40579 |
| HPV16 | L2 | 305 | 11 | RIGNKQTLRTR | | 40580 |
| HPV16 | L2 | 5 | 8 | RSAKRTKR | | 40581 |
| HPV16 | L2 | 315 | 9 | RSGKSIGAK | | 40582 |
| HPV16 | L2 | 315 | 11 | RSGKSIGAKVH | | 40583 |
| HPV16 | L2 | 298 | 8 | RTGIRYSR | | 40584 |
| HPV16 | L2 | 69 | 10 | RTGYIPLGTR | | 40585 |
| HPV16 | L2 | 9 | 11 | RTKRASATQLY | | 40586 |
| HPV16 | L2 | 313 | 11 | RTRSGKSIGAK | | 40587 |
| HPV16 | L2 | 14 | 10 | SATQLYKTCK | | 40588 |
| HPV16 | L2 | 316 | 8 | SGKSIGAK | | 40589 |
| HPV16 | L2 | 316 | 10 | SGKSIGAKVH | | 40590 |
| HPV16 | L2 | 316 | 11 | SGKSIGAKVHY | | 40591 |
| HPV16 | L2 | 64 | 9 | SGTGGRTGY | | 40592 |
| HPV16 | L2 | 319 | 8 | SIGAKVHY | | 40593 |
| HPV16 | L2 | 319 | 9 | SIGAKVHYY | | 40594 |
| HPV16 | L2 | 319 | 10 | SIGAKVHYYY | | 40595 |
| HPV16 | L2 | 360 | 10 | SINNGLYDIY | | 40596 |
| HPV16 | L2 | 184 | 8 | SSSTISTH | | 40597 |
| HPV16 | L2 | 184 | 10 | SSSTISTHNY | | 40598 |
| HPV16 | L2 | 185 | 9 | SSTISTHNY | | 40599 |
| HPV16 | L2 | 212 | 9 | SSTPIPGSR | | 40600 |
| HPV16 | L2 | 186 | 8 | STISTHNY | | 40601 |
| HPV16 | L2 | 213 | 8 | STPIPGSR | | 40602 |
| HPV16 | L2 | 347 | 8 | STYTTTSH | | 40603 |
| HPV16 | L2 | 384 | 10 | SVPSTSLSGY | | 40604 |
| HPV16 | L2 | 81 | 10 | TATDTLAPVR | | 40605 |
| HPV16 | L2 | 27 | 9 | TCPPDIIPK | | 40606 |
| HPV16 | L2 | 83 | 8 | TDTLAPVR | | 40607 |
| HPV16 | L2 | 299 | 11 | TGIRYSRIGNK | | 40608 |
| HPV16 | L2 | 62 | 8 | TGSGTGGR | | 40609 |
| HPV16 | L2 | 62 | 11 | TGSGTGGRTGY | | 40610 |
| HPV16 | L2 | 70 | 9 | TGYIPLGTR | | 40611 |
| HPV16 | L2 | 40 | 9 | TIADQILQY | | 40612 |
| HPV16 | L2 | 438 | 10 | TIIADAGDFY | | 40613 |
| HPV16 | L2 | 399 | 8 | TIPFGGAY | | 40614 |
| HPV16 | L2 | 311 | 8 | TLRTRSGK | | 40615 |
| HPV16 | L2 | 182 | 10 | TLSSSTISTH | | 40616 |
| HPV16 | L2 | 359 | 8 | TSINNGLY | | 40617 |
| HPV16 | L2 | 359 | 11 | TSINNGLYDIY | | 40618 |
| HPV16 | L2 | 295 | 8 | TSRRTGIR | | 40619 |
| HPV16 | L2 | 295 | 9 | TSRRTGIRY | | 40620 |
| HPV16 | L2 | 295 | 11 | TSRRTGIRYSR | | 40621 |
| HPV16 | L2 | 211 | 10 | TSSTPIPGSR | | 40622 |
| HPV16 | L2 | 398 | 9 | TTIPFGGAY | | 40623 |
| HPV16 | L2 | 244 | 9 | TTPTKLITY | | 40624 |
| HPV16 | L2 | 151 | 8 | TVTTVTTH | | 40625 |
| HPV16 | L2 | 287 | 11 | VALHRPALTSR | | 40626 |
| HPV16 | L2 | 222 | 9 | VARLGLYSR | | 40627 |
| HPV16 | L2 | 238 | 11 | VDPAFITTPTK | | 40628 |
| HPV16 | L2 | 210 | 11 | VTSSTPIPGSR | | 40629 |

TABLE XVII-continued

A11 Motif Peptides

| Type | Protein | Position | No. of Amino Acids | Sequence | A*1101 | Seq. Id. No. |
|---|---|---|---|---|---|---|
| HPV16 | L2 | 447 | 10 | YLHPSYYMLR | | 40630 |
| HPV16 | L2 | 447 | 11 | YLHPSYYMLRK | | 40631 |
| HPV16 | L2 | 453 | 8 | YMLRKRRK | | 40632 |
| HPV16 | L2 | 453 | 9 | YMLRKRRKR | | 40633 |
| HPV16 | L2 | 303 | 11 | YSRIGNKQTLR | | 40634 |
| HPV16 | L2 | 228 | 9 | YSRTTQQVK | | 40635 |
| HPV16 | L2 | 437 | 11 | YTIIADAGDFY | | 40636 |
| HPV18 | E1 | 397 | 11 | AAFLKSNCQAK | | 40637 |
| HPV18 | E1 | 398 | 10 | AFLKSNCQAK | | 40638 |
| HPV18 | E1 | 398 | 11 | AFLKSNCQAKY | | 40639 |
| HPV18 | E1 | 546 | 11 | ALDGNPISIDR | | 40640 |
| HPV18 | E1 | 68 | 9 | ALFHAQEVH | | 40641 |
| HPV18 | E1 | 466 | 11 | ALKSFLKGTPK | | 40642 |
| HPV18 | E1 | 284 | 9 | ALLRYKCGK | 0.1400 | 40643 |
| HPV18 | E1 | 284 | 11 | ALLRYKCGKSR | | 40644 |
| HPV18 | E1 | 213 | 10 | AMLAVFKDTY | | 40645 |
| HPV18 | E1 | 413 | 8 | ATMCKHYR | | 40646 |
| HPV18 | E1 | 413 | 9 | ATMCKHYRR | 0.2800 | 40647 |
| HPV18 | E1 | 531 | 8 | ATTTCWTY | | 40648 |
| HPV18 | E1 | 504 | 11 | AVISFVNSTSH | | 40649 |
| HPV18 | E1 | 412 | 8 | CATMCKHY | | 40650 |
| HPV18 | E1 | 412 | 9 | CATMCKHYR | 0.0110 | 40651 |
| HPV18 | E1 | 412 | 10 | CATMCKHYRR | | 40652 |
| HPV18 | E1 | 618 | 9 | CFFERTWSR | | 40653 |
| HPV18 | E1 | 290 | 10 | CGKSRLTVAK | | 40654 |
| HPV18 | E1 | 483 | 8 | CGPANTGK | | 40655 |
| HPV18 | E1 | 483 | 10 | CGPANTGKSY | | 40656 |
| HPV18 | E1 | 311 | 8 | CMLIQPPK | | 40657 |
| HPV18 | E1 | 311 | 10 | CMLIQPPKLR | | 40658 |
| HPV18 | E1 | 437 | 11 | CSKIDEGGDWR | | 40659 |
| HPV18 | E1 | 196 | 11 | CTIAQLKDLLK | | 40660 |
| HPV18 | E1 | 78 | 9 | DAQVLHVLK | | 40661 |
| HPV18 | E1 | 78 | 10 | DAQVLHVLKR | | 40662 |
| HPV18 | E1 | 78 | 11 | DAQVLHVLKRK | | 40663 |
| HPV18 | E1 | 530 | 9 | DATTTCWTY | | 40664 |
| HPV18 | E1 | 411 | 8 | DCATMCKH | | 40665 |
| HPV18 | E1 | 411 | 9 | DCATMCKHY | | 40666 |
| HPV18 | E1 | 411 | 10 | DCATMCKHYR | | 40667 |
| HPV18 | E1 | 411 | 11 | DCATMCKHYRR | | 40668 |
| HPV18 | E1 | 529 | 10 | DDATTTCWTY | | 40669 |
| HPV18 | E1 | 548 | 9 | DGNPISIDR | | 40670 |
| HPV18 | E1 | 548 | 10 | DGNPISIDRK | | 40671 |
| HPV18 | E1 | 548 | 11 | DGNPISIDRKH | | 40672 |
| HPV18 | E1 | 203 | 8 | DLLKVNNK | | 40673 |
| HPV18 | E1 | 228 | 10 | DLVRNFKSDK | | 40674 |
| HPV18 | E1 | 580 | 10 | DNRWPYLESR | | 40675 |
| HPV18 | E1 | 391 | 11 | DSNSNAAAFLK | | 40676 |
| HPV18 | E1 | 637 | 11 | DTEGNPFGTFK | | 40677 |
| HPV18 | E1 | 342 | 8 | DTPEWIQR | | 40678 |
| HPV18 | E1 | 459 | 10 | EFITFLGALK | | 40679 |
| HPV18 | E1 | 594 | 10 | EFPNAFPFDK | | 40680 |
| HPV18 | E1 | 639 | 9 | EGNPFGTFK | | 40681 |
| HPV18 | E1 | 639 | 11 | EGNPFGTFKLR | | 40682 |
| HPV18 | E1 | 10 | 10 | EGTGCNGWFY | 0.0002 | 40683 |
| HPV18 | E1 | 610 | 8 | EINDKNWK | | 40684 |
| HPV18 | E1 | 115 | 9 | EISLNSGQK | | 40685 |
| HPV18 | E1 | 115 | 10 | EISLNSGQKK | | 40686 |
| HPV18 | E1 | 62 | 10 | ELETAQALFH | | 40687 |
| HPV18 | E1 | 95 | 8 | ENSPLGER | | 40688 |
| HPV18 | E1 | 379 | 8 | ESDMAFEY | | 40689 |
| HPV18 | E1 | 64 | 8 | ETAQALFH | | 40690 |
| HPV18 | E1 | 309 | 10 | ETCMLIQPPK | | 40691 |
| HPV18 | E1 | 104 | 9 | EVDTELSPR | | 40692 |
| HPV18 | E1 | 74 | 10 | EVHNDAQVLH | | 40693 |
| HPV18 | E1 | 482 | 9 | FCGPANTGK | | 40694 |
| HPV18 | E1 | 482 | 11 | FCGPANTGKSY | | 40695 |
| HPV18 | E1 | 601 | 9 | FDKNGNPVY | | 40696 |
| HPV18 | E1 | 619 | 8 | FFERTWSR | | 40697 |
| HPV18 | E1 | 460 | 9 | FITFLGALK | 0.0370 | 40698 |
| HPV18 | E1 | 463 | 10 | FLGALKSFLK | | 40699 |
| HPV18 | E1 | 470 | 8 | FLKGTPKK | | 40700 |
| HPV18 | E1 | 399 | 9 | FLKSNCQAK | 0.0007 | 40701 |
| HPV18 | E1 | 399 | 10 | FLKSNCQAKY | | 40702 |
| HPV18 | E1 | 226 | 9 | FTDLVRNFK | | 40703 |
| HPV18 | E1 | 130 | 8 | FTISDSGY | | 40704 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | E1 | 465 | 8 | GALKSFLK | | 40705 |
| HPV18 | E1 | 212 | 8 | GAMLAVFK | | 40706 |
| HPV18 | E1 | 212 | 11 | GAMLAVFKDTY | | 40707 |
| HPV18 | E1 | 341 | 9 | GDTPEWIQR | 0.0002 | 40708 |
| HPV18 | E1 | 444 | 11 | GDWRPIVQFLR | | 40709 |
| HPV18 | E1 | 223 | 9 | GLSFTDLVR | 0.0025 | 40710 |
| HPV18 | E1 | 640 | 8 | GNPFGTFK | | 40711 |
| HPV18 | E1 | 640 | 10 | GNPFGTFKLR | | 40712 |
| HPV18 | E1 | 549 | 8 | GNPISIDR | | 40713 |
| HPV18 | E1 | 549 | 9 | GNPISIDRK | | 40714 |
| HPV18 | E1 | 549 | 10 | GNPISIDRKH | | 40715 |
| HPV18 | E1 | 549 | 11 | GNPISIDRKHK | | 40716 |
| HPV18 | E1 | 605 | 10 | GNPVYEINDK | | 40717 |
| HPV18 | E1 | 92 | 11 | GSTENSPLGER | | 40718 |
| HPV18 | E1 | 644 | 11 | GTFKLRAGQNH | | 40719 |
| HPV18 | E1 | 11 | 9 | GTGCNGWFY | 0.0720 | 40720 |
| HPV18 | E1 | 279 | 9 | GVLILALLR | 0.1400 | 40721 |
| HPV18 | E1 | 279 | 10 | GVLILALLRY | | 40722 |
| HPV18 | E1 | 279 | 11 | GVLILALLRYK | | 40723 |
| HPV18 | E1 | 249 | 11 | GVNPTIAEGFK | | 40724 |
| HPV18 | E1 | 514 | 11 | HFWLEPLTDTK | | 40725 |
| HPV18 | E1 | 270 | 8 | HIQCLDCK | | 40726 |
| HPV18 | E1 | 76 | 8 | HNDAQVLH | | 40727 |
| HPV18 | E1 | 76 | 11 | HNDAQVLHVLK | | 40728 |
| HPV18 | E1 | 198 | 9 | IAQLKDLLK | 0.0027 | 40729 |
| HPV18 | E1 | 440 | 8 | IDEGGDWR | | 40730 |
| HPV18 | E1 | 282 | 8 | ILALLRYK | | 40731 |
| HPV18 | E1 | 282 | 11 | ILALLRYKCGK | | 40732 |
| HPV18 | E1 | 569 | 8 | ILLTTNIH | | 40733 |
| HPV18 | E1 | 569 | 11 | ILLTTNIHPAK | | 40734 |
| HPV18 | E1 | 506 | 9 | ISFVNSTSH | | 40735 |
| HPV18 | E1 | 552 | 8 | ISIDRKHK | | 40736 |
| HPV18 | E1 | 116 | 8 | ISLNSGQK | | 40737 |
| HPV18 | E1 | 116 | 9 | ISLNSGQKK | 0.0026 | 40738 |
| HPV18 | E1 | 116 | 11 | ISLNSGQKKAK | | 40739 |
| HPV18 | E1 | 461 | 8 | ITFLGALK | | 40740 |
| HPV18 | E1 | 617 | 10 | KCFFERTWSR | | 40741 |
| HPV18 | E1 | 289 | 11 | KCGKSRLTVAK | | 40742 |
| HPV18 | E1 | 410 | 8 | KDCATMCK | | 40743 |
| HPV18 | E1 | 410 | 9 | KDCATMCKH | | 40744 |
| HPV18 | E1 | 410 | 10 | KDCATMCKHY | | 40745 |
| HPV18 | E1 | 410 | 11 | KDCATMCKHYR | | 40746 |
| HPV18 | E1 | 202 | 9 | KDLLKVNNK | | 40747 |
| HPV18 | E1 | 579 | 11 | KDNRWPYLESR | | 40748 |
| HPV18 | E1 | 299 | 8 | KGLSTLLH | | 40749 |
| HPV18 | E1 | 439 | 9 | KIDEGGDWR | | 40750 |
| HPV18 | E1 | 647 | 8 | KLRAGQNH | | 40751 |
| HPV18 | E1 | 647 | 9 | KLRAGQNHR | 0.0013 | 40752 |
| HPV18 | E1 | 318 | 10 | KLRSSVAALY | | 40753 |
| HPV18 | E1 | 614 | 9 | KNWKCFFER | | 40754 |
| HPV18 | E1 | 468 | 9 | KSFLKGTPK | 0.0015 | 40755 |
| HPV18 | E1 | 468 | 10 | KSFLKGTPKK | | 40756 |
| HPV18 | E1 | 401 | 8 | KSNCQAKY | | 40757 |
| HPV18 | E1 | 401 | 10 | KSNCQAKYLK | | 40758 |
| HPV18 | E1 | 292 | 8 | KSRLTVAK | | 40759 |
| HPV18 | E1 | 490 | 10 | KSYFGMSFIH | | 40760 |
| HPV18 | E1 | 259 | 10 | KTLIQPFILY | | 40761 |
| HPV18 | E1 | 283 | 10 | LALLRYKCGK | | 40762 |
| HPV18 | E1 | 215 | 8 | LAVFKDTY | | 40763 |
| HPV18 | E1 | 528 | 11 | LDDATTTCWTY | | 40764 |
| HPV18 | E1 | 547 | 10 | LDGNPISIDR | | 40765 |
| HPV18 | E1 | 547 | 11 | LDGNPISIDRK | | 40766 |
| HPV18 | E1 | 69 | 8 | LFHAQEVH | | 40767 |
| HPV18 | E1 | 129 | 9 | LFTISDSGY | | 40768 |
| HPV18 | E1 | 464 | 9 | LGALKSFLK | | 40769 |
| HPV18 | E1 | 281 | 8 | LILALLRY | | 40770 |
| HPV18 | E1 | 281 | 9 | LILALLRYK | 0.1800 | 40771 |
| HPV18 | E1 | 261 | 8 | LIQPFILY | | 40772 |
| HPV18 | E1 | 261 | 10 | LIQPFILYAH | | 40773 |
| HPV18 | E1 | 313 | 8 | LIQPPKLR | | 40774 |
| HPV18 | E1 | 285 | 8 | LLRYKCGK | | 40775 |
| HPV18 | E1 | 285 | 10 | LLRYKCGKSR | | 40776 |
| HPV18 | E1 | 570 | 10 | LLTTNIHPAK | | 40777 |
| HPV18 | E1 | 118 | 9 | LNSGQKKAK | | 40778 |
| HPV18 | E1 | 118 | 10 | LNSGQKKAKR | | 40779 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | E1 | 118 | 11 | LSNGQKKAKRR | | 40780 |
| HPV18 | E1 | 224 | 8 | LSFTDLVR | | 40781 |
| HPV18 | E1 | 224 | 11 | LSFTDLVRNFK | | 40782 |
| HPV18 | E1 | 376 | 11 | LTDESDMAFEY | | 40783 |
| HPV18 | E1 | 571 | 9 | LTTNIHPAK | 0.1200 | 40784 |
| HPV18 | E1 | 480 | 11 | LVFCGPANTGK | | 40785 |
| HPV18 | E1 | 229 | 9 | LVRNFKSDK | 0.0002 | 40786 |
| HPV18 | E1 | 415 | 10 | MCKHYRRAQK | | 40787 |
| HPV18 | E1 | 415 | 11 | MCKHYRRAQKR | | 40788 |
| HPV18 | E1 | 340 | 10 | MGDTPEWIQR | | 40789 |
| HPV18 | E1 | 214 | 9 | MLAVFKDTY | | 40790 |
| HPV18 | E1 | 312 | 9 | MLIQPPKLR | 0.0014 | 40791 |
| HPV18 | E1 | 427 | 8 | MNMSQWIR | | 40792 |
| HPV18 | E1 | 427 | 10 | MNMSQWIRFR | | 40793 |
| HPV18 | E1 | 429 | 8 | MSQWIRFR | | 40794 |
| HPV18 | E1 | 429 | 11 | MSQWIRFRCSK | | 40795 |
| HPV18 | E1 | 403 | 8 | NCQAKYLK | | 40796 |
| HPV18 | E1 | 77 | 10 | NDAQVLHVLK | | 40797 |
| HPV18 | E1 | 77 | 11 | NDAQVLHVLKR | | 40798 |
| HPV18 | E1 | 612 | 11 | NDKNWKCFFER | | 40799 |
| HPV18 | E1 | 604 | 11 | NGNPVYEINDK | | 40800 |
| HPV18 | E1 | 574 | 9 | NIHPAKDNR | 0.0002 | 40801 |
| HPV18 | E1 | 428 | 9 | NMSQWIRFR | 0.0012 | 40802 |
| HPV18 | E1 | 119 | 8 | NSGQKKAK | | 40803 |
| HPV18 | E1 | 119 | 9 | NSGQKKAKR | 0.0002 | 40804 |
| HPV18 | E1 | 119 | 10 | NSGQKKAKRR | | 40805 |
| HPV18 | E1 | 393 | 9 | NSNAAAFLK | 0.3700 | 40806 |
| HPV18 | E1 | 577 | 9 | PAKDNRWPY | | 40807 |
| HPV18 | E1 | 485 | 8 | PANTGKSY | | 40808 |
| HPV18 | E1 | 600 | 10 | PFDKNGNPVY | | 40809 |
| HPV18 | E1 | 642 | 8 | PFGTFKLR | | 40810 |
| HPV18 | E1 | 568 | 9 | PILLTTNIH | | 40811 |
| HPV18 | E1 | 551 | 8 | PISIDRKH | | 40812 |
| HPV18 | E1 | 551 | 9 | PISIDRKHK | | 40813 |
| HPV18 | E1 | 448 | 8 | PIVQFLRY | | 40814 |
| HPV18 | E1 | 596 | 8 | PNAFPFDK | | 40815 |
| HPV18 | E1 | 252 | 8 | PTIAEGFK | | 40816 |
| HPV18 | E1 | 607 | 8 | PVYEINDK | | 40817 |
| HPV18 | E1 | 607 | 11 | PVYEINDKNWK | | 40818 |
| HPV18 | E1 | 67 | 10 | QALFHAQEVH | | 40819 |
| HPV18 | E1 | 195 | 8 | QCTIAQLK | | 40820 |
| HPV18 | E1 | 211 | 9 | QGAMLAVFK | | 40821 |
| HPV18 | E1 | 146 | 10 | QIQVTTNGEH | | 40822 |
| HPV18 | E1 | 200 | 11 | QLKDLLKVNNK | | 40823 |
| HPV18 | E1 | 426 | 9 | QMNMSQWIR | 0.0023 | 40824 |
| HPV18 | E1 | 426 | 11 | QMNMSQWIRFR | | 40825 |
| HPV18 | E1 | 80 | 8 | QVLHVLKR | | 40826 |
| HPV18 | E1 | 80 | 9 | QVLHVLKRK | 0.0020 | 40827 |
| HPV18 | E1 | 148 | 8 | QVTTNGEH | | 40828 |
| HPV18 | E1 | 102 | 11 | RLEVDTELSPR | | 40829 |
| HPV18 | E1 | 128 | 10 | RLFTISDSGY | | 40830 |
| HPV18 | E1 | 320 | 8 | RSSVAALY | | 40831 |
| HPV18 | E1 | 320 | 10 | RSSVAALYWY | | 40832 |
| HPV18 | E1 | 320 | 11 | RSSVAALYWYR | | 40833 |
| HPV18 | E1 | 622 | 9 | RTWSRLDLH | | 40834 |
| HPV18 | E1 | 469 | 8 | SFLKGTPK | | 40835 |
| HPV18 | E1 | 469 | 9 | SFLKGTPKK | | 40836 |
| HPV18 | E1 | 225 | 10 | SFTDLVRNFK | | 40837 |
| HPV18 | E1 | 507 | 8 | SFVNSTSH | | 40838 |
| HPV18 | E1 | 120 | 8 | SGQKKAKR | | 40839 |
| HPV18 | E1 | 120 | 9 | SGQKKAKRR | | 40840 |
| HPV18 | E1 | 117 | 8 | SLNSGQKK | | 40841 |
| HPV18 | E1 | 117 | 10 | SLNSGQKKAK | | 40842 |
| HPV18 | E1 | 117 | 11 | SLNSGQKKAKR | | 40843 |
| HPV18 | E1 | 394 | 8 | SNAAAFLK | | 40844 |
| HPV18 | E1 | 402 | 9 | SNCQAKYLK | | 40845 |
| HPV18 | E1 | 392 | 10 | SNSNAAAFLK | | 40846 |
| HPV18 | E1 | 321 | 9 | SSVAALYWY | | 40847 |
| HPV18 | E1 | 321 | 10 | SSVAALYWYR | | 40848 |
| HPV18 | E1 | 93 | 10 | STENSPLGER | | 40849 |
| HPV18 | E1 | 322 | 8 | SVAALYWY | | 40850 |
| HPV18 | E1 | 322 | 9 | SVAALYWYR | 8.8000 | 40851 |
| HPV18 | E1 | 310 | 9 | TCMLIQPPK | | 40852 |
| HPV18 | E1 | 310 | 11 | TCMLIQPPKLR | | 40853 |
| HPV18 | E1 | 534 | 9 | TCWTYFDTY | | 40854 |

TABLE XVII-continued

A11 Motif Peptides

| Type | Protein | Position | No. of Amino Acids | Sequence | A*1101 | Seq. Id. No. |
|---|---|---|---|---|---|---|
| HPV18 | E1 | 534 | 11 | TCWTYFDTYMR | | 40855 |
| HPV18 | E1 | 377 | 10 | TDESDMAFEY | | 40856 |
| HPV18 | E1 | 227 | 8 | TDLVRNFK | | 40857 |
| HPV18 | E1 | 227 | 11 | TDLVRNFKSDK | | 40858 |
| HPV18 | E1 | 645 | 10 | TFKLRAGQNH | | 40859 |
| HPV18 | E1 | 645 | 11 | TFKLRAGQNHR | | 40860 |
| HPV18 | E1 | 462 | 11 | TFLGALKSFLK | | 40861 |
| HPV18 | E1 | 12 | 8 | TGCNGWFY | | 40862 |
| HPV18 | E1 | 197 | 10 | TIAQLKDLLK | | 40863 |
| HPV18 | E1 | 260 | 9 | TLIQPFILY | | 40864 |
| HPV18 | E1 | 260 | 11 | TLIQPFILYAH | | 40865 |
| HPV18 | E1 | 414 | 8 | TMCKHYRR | | 40866 |
| HPV18 | E1 | 414 | 11 | TMCKHYRRAQK | | 40867 |
| HPV18 | E1 | 573 | 10 | TNIHPAKDNR | | 40868 |
| HPV18 | E1 | 533 | 10 | TTCWTYFDTY | | 40869 |
| HPV18 | E1 | 572 | 8 | TTNIHPAK | | 40870 |
| HPV18 | E1 | 572 | 11 | TTNIHPAKDNR | | 40871 |
| HPV18 | E1 | 532 | 11 | TTTCWTYFDTY | | 40872 |
| HPV18 | E1 | 296 | 11 | TVAKGLSTLLH | | 40873 |
| HPV18 | E1 | 323 | 8 | VAALYWYR | | 40874 |
| HPV18 | E1 | 297 | 10 | VAKGLSTLLH | | 40875 |
| HPV18 | E1 | 105 | 8 | VDTELSPR | | 40876 |
| HPV18 | E1 | 481 | 10 | VFCGPANTGK | | 40877 |
| HPV18 | E1 | 505 | 10 | VISFVNSTSH | | 40878 |
| HPV18 | E1 | 81 | 8 | VLHVLKRK | | 40879 |
| HPV18 | E1 | 280 | 8 | VLILALLR | | 40880 |
| HPV18 | E1 | 280 | 9 | VLILALLRY | | 40881 |
| HPV18 | E1 | 280 | 10 | VLILALLRYK | | 40882 |
| HPV18 | E1 | 339 | 11 | VMGDTPEWIQR | | 40883 |
| HPV18 | E1 | 192 | 11 | VNPQCTIAQLK | | 40884 |
| HPV18 | E1 | 250 | 10 | VNPTIAEGFK | | 40885 |
| HPV18 | E1 | 17 | 10 | WFYVQAIVDK | | 40886 |
| HPV18 | E1 | 17 | 11 | WFYVQAIVDKK | | 40887 |
| HPV18 | E1 | 278 | 10 | WGVLILALLR | | 40888 |
| HPV18 | E1 | 278 | 11 | WGVLILALLRY | | 40889 |
| HPV18 | E1 | 346 | 10 | WIQRLTIIQH | | 40890 |
| HPV18 | E1 | 432 | 8 | WIRFRCSK | | 40891 |
| HPV18 | E1 | 516 | 9 | WLEPLTDTK | | 40892 |
| HPV18 | E1 | 536 | 9 | WTYFDTYMR | 0.0120 | 40893 |
| HPV18 | E1 | 268 | 10 | YAHIQCLDCK | | 40894 |
| HPV18 | E1 | 492 | 8 | YFGMSFIH | | 40895 |
| HPV18 | E1 | 222 | 10 | YGLSFTDLVR | | 40896 |
| HPV18 | E1 | 408 | 10 | YLKDCATMCK | | 40897 |
| HPV18 | E1 | 408 | 11 | YLKDCATMCKH | | 40898 |
| HPV18 | E1 | 19 | 8 | YVQAIVDK | | 40899 |
| HPV18 | E1 | 19 | 9 | YVQAIVDKK | 0.0290 | 40900 |
| HPV18 | E2 | 269 | 9 | AATPTGNNK | | 40901 |
| HPV18 | E2 | 269 | 10 | AATPTGNNKR | | 40902 |
| HPV18 | E2 | 269 | 11 | AATPTGNNKRR | | 40903 |
| HPV18 | E2 | 45 | 9 | AIFFAAREH | | 40904 |
| HPV18 | E2 | 82 | 9 | ALQGLAQSR | | 40905 |
| HPV18 | E2 | 82 | 10 | ALQGLAQSRY | | 40906 |
| HPV18 | E2 | 82 | 11 | ALQGLAQSRYK | | 40907 |
| HPV18 | E2 | 154 | 10 | ATCVSHRGLY | | 40908 |
| HPV18 | E2 | 154 | 11 | ATCVSHRGLYY | | 40909 |
| HPV18 | E2 | 270 | 8 | ATPTGNNK | | 40910 |
| HPV18 | E2 | 270 | 9 | ATPTGNNKR | | 40911 |
| HPV18 | E2 | 270 | 10 | ATPTGNNKRR | | 40912 |
| HPV18 | E2 | 270 | 11 | ATPTGNNKRRK | | 40913 |
| HPV18 | E2 | 214 | 10 | ATQLVKQLQH | | 40914 |
| HPV18 | E2 | 252 | 8 | CGLAEKQH | | 40915 |
| HPV18 | E2 | 301 | 8 | CLRYRLRK | | 40916 |
| HPV18 | E2 | 301 | 9 | CLRYRLRKH | | 40917 |
| HPV18 | E2 | 132 | 11 | CMTYVAWDSVY | | 40918 |
| HPV18 | E2 | 282 | 10 | CSGNTTPIIH | | 40919 |
| HPV18 | E2 | 14 | 9 | CVQDKIIDH | | 40920 |
| HPV18 | E2 | 14 | 10 | CVQDKIIDHY | | 40921 |
| HPV18 | E2 | 156 | 8 | CVSHRGLY | | 40922 |
| HPV18 | E2 | 156 | 9 | CVSHRGLYY | | 40923 |
| HPV18 | E2 | 156 | 11 | CVSHRGLYYVK | | 40924 |
| HPV18 | E2 | 209 | 11 | DDTVSATQLVK | | 40925 |
| HPV18 | E2 | 126 | 10 | DGNKDNCMTY | | 40926 |
| HPV18 | E2 | 29 | 8 | DIDSQIQY | | 40927 |
| HPV18 | E2 | 26 | 11 | DSKDIDSQIQY | | 40928 |
| HPV18 | E2 | 31 | 11 | DSQIQYWQLIR | | 40929 |

TABLE XVII-continued

A11 Motif Peptides

| Type | Protein | Position | No. of Amino Acids | Sequence | A*1101 | Seq. Id. No. |
|---|---|---|---|---|---|---|
| HPV18 | E2 | 354 | 9 | DSVQILVGY | | 40930 |
| HPV18 | E2 | 210 | 10 | DTVSATQLVK | | 40931 |
| HPV18 | E2 | 175 | 8 | EFKSECEK | | 40932 |
| HPV18 | E2 | 175 | 9 | EFKSECEKY | | 40933 |
| HPV18 | E2 | 167 | 11 | EGYNTFYIEFK | | 40934 |
| HPV18 | E2 | 104 | 9 | ELWNTEPTH | | 40935 |
| HPV18 | E2 | 43 | 9 | ENAIFFAAR | | 40936 |
| HPV18 | E2 | 43 | 11 | ENAIFFAAREH | | 40937 |
| HPV18 | E2 | 125 | 11 | FDGNKDNCMTY | | 40938 |
| HPV18 | E2 | 268 | 10 | GAATPTGNNK | | 40939 |
| HPV18 | E2 | 268 | 11 | GAATPTGNNKR | | 40940 |
| HPV18 | E2 | 294 | 10 | GDRNSLKCLR | | 40941 |
| HPV18 | E2 | 294 | 11 | GDRNSLKCLRY | | 40942 |
| HPV18 | E2 | 117 | 8 | GGQTVQVY | | 40943 |
| HPV18 | E2 | 331 | 8 | GILTVTYH | | 40944 |
| HPV18 | E2 | 85 | 8 | GLAQSRYK | | 40945 |
| HPV18 | E2 | 161 | 9 | GLYYVKEGY | | 40946 |
| HPV18 | E2 | 127 | 9 | GNKDNCMTY | | 40947 |
| HPV18 | E2 | 184 | 9 | GNTGTWEVH | | 40948 |
| HPV18 | E2 | 284 | 8 | GNTTPIIH | | 40949 |
| HPV18 | E2 | 284 | 10 | GNTTPIIHLK | | 40950 |
| HPV18 | E2 | 251 | 9 | HCGLAEKQH | | 40951 |
| HPV18 | E2 | 53 | 8 | HGIQTLNH | | 40952 |
| HPV18 | E2 | 291 | 10 | HLKGDRNSLK | | 40953 |
| HPV18 | E2 | 338 | 8 | HSETQRTK | | 40954 |
| HPV18 | E2 | 20 | 9 | IDHYENDSK | | 40955 |
| HPV18 | E2 | 46 | 8 | IFFAAREH | | 40956 |
| HPV18 | E2 | 19 | 10 | IIDHYENDSK | | 40957 |
| HPV18 | E2 | 289 | 8 | IIHLKGDR | | 40958 |
| HPV18 | E2 | 68 | 8 | ISKSKAHK | | 40959 |
| HPV18 | E2 | 300 | 8 | KCLRYRLR | | 40960 |
| HPV18 | E2 | 300 | 9 | KCLRYRLRK | | 40961 |
| HPV18 | E2 | 300 | 10 | KCLRYRLRKH | | 40962 |
| HPV18 | E2 | 28 | 9 | KDIDSQIQY | | 40963 |
| HPV18 | E2 | 293 | 8 | KGDRNSLK | | 40964 |
| HPV18 | E2 | 293 | 11 | KGDRNSLKCLR | | 40965 |
| HPV18 | E2 | 116 | 9 | KGGQTVQVY | | 40966 |
| HPV18 | E2 | 18 | 11 | KIIDHYENDSK | | 40967 |
| HPV18 | E2 | 152 | 8 | KTATCVSH | | 40968 |
| HPV18 | E2 | 152 | 9 | KTATCVSHR | | 40969 |
| HPV18 | E2 | 329 | 9 | KTGILTVTY | | 40970 |
| HPV18 | E2 | 329 | 10 | KTGILTVTYH | | 40971 |
| HPV18 | E2 | 238 | 11 | KTYGQTSAATR | | 40972 |
| HPV18 | E2 | 281 | 11 | LCSGNTTPIIH | | 40973 |
| HPV18 | E2 | 267 | 11 | LGAATPTGNNK | | 40974 |
| HPV18 | E2 | 58 | 9 | LNHQVVPAY | | 40975 |
| HPV18 | E2 | 12 | 11 | LSCVQDKIIDH | | 40976 |
| HPV18 | E2 | 8 | 11 | LSERLSCVQDK | | 40977 |
| HPV18 | E2 | 333 | 11 | LTVTYHSETQR | | 40978 |
| HPV18 | E2 | 81 | 10 | MALQGLAQSR | | 40979 |
| HPV18 | E2 | 81 | 11 | MALQGLAQSRY | | 40980 |
| HPV18 | E2 | 144 | 9 | MTDAGTWDK | | 40981 |
| HPV18 | E2 | 133 | 10 | MTYVAWDSVY | | 40982 |
| HPV18 | E2 | 133 | 11 | MTYVAWDSVYY | | 40983 |
| HPV18 | E2 | 44 | 8 | NAIFFAAR | | 40984 |
| HPV18 | E2 | 44 | 10 | NAIFFAAREH | | 40985 |
| HPV18 | E2 | 67 | 8 | NISKSKAH | | 40986 |
| HPV18 | E2 | 67 | 9 | NISKSKAHK | | 40987 |
| HPV18 | E2 | 297 | 8 | NSLKCLRY | | 40988 |
| HPV18 | E2 | 297 | 9 | NSLKCLRYR | | 40989 |
| HPV18 | E2 | 297 | 11 | NSLKCLRYRLR | | 40990 |
| HPV18 | E2 | 107 | 9 | NTEPTHCFK | | 40991 |
| HPV18 | E2 | 107 | 10 | NTEPTHCFKK | | 40992 |
| HPV18 | E2 | 170 | 8 | NTFYIEFK | | 40993 |
| HPV18 | E2 | 185 | 8 | NTGTWEVH | | 40994 |
| HPV18 | E2 | 285 | 9 | NTTPIIHLK | | 40995 |
| HPV18 | E2 | 64 | 9 | PAYNISKSK | | 40996 |
| HPV18 | E2 | 64 | 11 | PAYNISKSKAH | | 40997 |
| HPV18 | E2 | 353 | 10 | PDSVQILVGY | | 40998 |
| HPV18 | E2 | 249 | 9 | PGHCGLAEK | | 40999 |
| HPV18 | E2 | 249 | 11 | PGHCGLAEKQH | | 41000 |
| HPV18 | E2 | 288 | 9 | PIIHLKGDR | | 41001 |
| HPV18 | E2 | 272 | 8 | PTGNNKRR | | 41002 |
| HPV18 | E2 | 272 | 9 | PTGNNKRRK | | 41003 |
| HPV18 | E2 | 16 | 8 | QDKIIDHY | | 41004 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | E2 | 84 | 8 | QGLAQSRY | | 41005 |
| HPV18 | E2 | 84 | 9 | QGLAQSRYK | | 41006 |
| HPV18 | E2 | 33 | 9 | QIQYWQLIR | | 41007 |
| HPV18 | E2 | 220 | 9 | QLQHTPSPY | | 41008 |
| HPV18 | E2 | 216 | 8 | QLVKQLQH | | 41009 |
| HPV18 | E2 | 80 | 11 | QMALQGLAQSR | | 41010 |
| HPV18 | E2 | 56 | 11 | QTLNHQVVPAY | | 41011 |
| HPV18 | E2 | 2 | 10 | QTPKETLSER | | 41012 |
| HPV18 | E2 | 242 | 10 | QTSAATRPGH | | 41013 |
| HPV18 | E2 | 119 | 11 | QTVQVYFDGNK | | 41014 |
| HPV18 | E2 | 61 | 10 | QVVPAYNISK | | 41015 |
| HPV18 | E2 | 122 | 8 | QVYFDGNK | | 41016 |
| HPV18 | E2 | 314 | 8 | RDISSTWH | | 41017 |
| HPV18 | E2 | 160 | 10 | RGLYYVKEGY | | 41018 |
| HPV18 | E2 | 305 | 8 | RLRKHSDH | | 41019 |
| HPV18 | E2 | 305 | 9 | RLRKHSDHY | | 41020 |
| HPV18 | E2 | 305 | 10 | RLRKHSDHYR | | 41021 |
| HPV18 | E2 | 11 | 8 | RLSCVQDK | | 41022 |
| HPV18 | E2 | 296 | 8 | RNSLKCLR | | 41023 |
| HPV18 | E2 | 296 | 9 | RNSLKCLRY | | 41024 |
| HPV18 | E2 | 296 | 10 | RNSLKCLRYR | | 41025 |
| HPV18 | E2 | 244 | 8 | SAATRPGH | | 41026 |
| HPV18 | E2 | 213 | 11 | SATQLVKQLQH | | 41027 |
| HPV18 | E2 | 13 | 10 | SCVQDKIIDH | | 41028 |
| HPV18 | E2 | 13 | 11 | SCVQDKIIDHY | | 41029 |
| HPV18 | E2 | 283 | 9 | SGNTTPIIH | | 41030 |
| HPV18 | E2 | 283 | 11 | SGNTTPIIHLK | | 41031 |
| HPV18 | E2 | 298 | 8 | SLKCLRYR | | 41032 |
| HPV18 | E2 | 298 | 10 | SLKCLRYRLR | | 41033 |
| HPV18 | E2 | 298 | 11 | SLKCLRYRLRK | | 41034 |
| HPV18 | E2 | 229 | 10 | SSTVSVGTAK | | 41035 |
| HPV18 | E2 | 230 | 9 | STVSVGTAK | | 41036 |
| HPV18 | E2 | 230 | 11 | STVSVGTAKTY | | 41037 |
| HPV18 | E2 | 233 | 8 | SVGTAKTY | | 41038 |
| HPV18 | E2 | 355 | 8 | SVQILVGY | | 41039 |
| HPV18 | E2 | 153 | 8 | TATCVSHR | | 41040 |
| HPV18 | E2 | 153 | 11 | TATCVSHRGLY | | 41041 |
| HPV18 | E2 | 155 | 9 | TCVSHRGLY | | 41042 |
| HPV18 | E2 | 155 | 10 | TCVSHRGLYY | | 41043 |
| HPV18 | E2 | 145 | 8 | TDAGTWDK | | 41044 |
| HPV18 | E2 | 330 | 8 | TGILTVTY | | 41045 |
| HPV18 | E2 | 330 | 9 | TGILTVTYH | | 41046 |
| HPV18 | E2 | 273 | 8 | TGNNKRRK | | 41047 |
| HPV18 | E2 | 57 | 10 | TLNHQVVPAY | | 41048 |
| HPV18 | E2 | 243 | 9 | TSAATRPGH | | 41049 |
| HPV18 | E2 | 286 | 8 | TTPIIHLK | | 41050 |
| HPV18 | E2 | 286 | 11 | TTPIIHLKGDR | | 41051 |
| HPV18 | E2 | 120 | 10 | TVQVYFDGNK | | 41052 |
| HPV18 | E2 | 211 | 9 | TVSATQLVK | | 41053 |
| HPV18 | E2 | 231 | 8 | TVSVGTAK | | 41054 |
| HPV18 | E2 | 231 | 10 | TVSVGTAKTY | | 41055 |
| HPV18 | E2 | 334 | 10 | TVTYHSETQR | | 41056 |
| HPV18 | E2 | 136 | 8 | VAWDSVYY | | 41057 |
| HPV18 | E2 | 212 | 8 | VSATQLVK | | 41058 |
| HPV18 | E2 | 157 | 8 | VSHRGLYY | | 41059 |
| HPV18 | E2 | 157 | 10 | VSHRGLYYVK | | 41060 |
| HPV18 | E2 | 232 | 9 | VSVGTAKTY | | 41061 |
| HPV18 | E2 | 335 | 9 | VTYHSETQR | | 41062 |
| HPV18 | E2 | 335 | 11 | VTYHSETQRTK | | 41063 |
| HPV18 | E2 | 62 | 9 | VVPAYNISK | | 41064 |
| HPV18 | E2 | 62 | 11 | VVPAYNISKSK | | 41065 |
| HPV18 | E2 | 150 | 10 | WDKTATCVSH | | 41066 |
| HPV18 | E2 | 150 | 11 | WDKTATCVSHR | | 41067 |
| HPV18 | E2 | 106 | 10 | WNTEPTHCFK | | 41068 |
| HPV18 | E2 | 106 | 11 | WNTEPTHCFKK | | 41069 |
| HPV18 | E2 | 322 | 8 | WTGAGNEK | | 41070 |
| HPV18 | E2 | 183 | 10 | YGNTGTWEVH | | 41071 |
| HPV18 | E2 | 240 | 9 | YGQTSAATR | | 41072 |
| HPV18 | E2 | 173 | 10 | YIEFKSECEK | | 41073 |
| HPV18 | E2 | 173 | 11 | YIEFKSECEKY | | 41074 |
| HPV18 | E2 | 143 | 10 | YMTDAGTWDK | | 41075 |
| HPV18 | E2 | 66 | 9 | YNISKSKAH | | 41076 |
| HPV18 | E2 | 66 | 10 | YNISKSKAHK | | 41077 |
| HPV18 | E2 | 169 | 9 | YNTFYIEFK | | 41078 |
| HPV18 | E2 | 228 | 11 | YSSTVSVGTAK | | 41079 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | E2 | 135 | 8 | YVAWDSVY | | 41080 |
| HPV18 | E2 | 135 | 9 | YVAWDSVYY | | 41081 |
| HPV18 | E2 | 164 | 10 | YVKEGYNTFY | | 41082 |
| HPV18 | E5 | 29 | 11 | CAYAWVLVFVY | | 41083 |
| HPV18 | E5 | 9 | 11 | CFCVCMYVCCH | | 41084 |
| HPV18 | E5 | 56 | 10 | CFLLPMLLLH | | 41085 |
| HPV18 | E5 | 11 | 9 | CVCMYVCCH | | 41086 |
| HPV18 | E5 | 8 | 8 | FCFCVCMY | | 41087 |
| HPV18 | E5 | 55 | 11 | FCFLLPMLLLH | | 41088 |
| HPV18 | E5 | 10 | 10 | FCVCMYVCCH | | 41089 |
| HPV18 | E5 | 6 | 10 | FLFCFCVCMY | | 41090 |
| HPV18 | E5 | 57 | 9 | FLLPMLLLH | | 41091 |
| HPV18 | E5 | 57 | 11 | FLLPMLLLHIH | | 41092 |
| HPV18 | E5 | 5 | 11 | IFLFCFCVCMY | | 41093 |
| HPV18 | E5 | 43 | 11 | ITSPATAFTVY | | 41094 |
| HPV18 | E5 | 7 | 9 | LFCFCVCMY | | 41095 |
| HPV18 | E5 | 58 | 8 | LLPMLLH | | 41096 |
| HPV18 | E5 | 58 | 10 | LLPMLLLHIH | | 41097 |
| HPV18 | E5 | 22 | 10 | LLPSVCMCAY | | 41098 |
| HPV18 | E5 | 46 | 8 | PATAFTVY | | 41099 |
| HPV18 | E5 | 21 | 11 | PLLPSVCMCAY | | 41100 |
| HPV18 | E5 | 60 | 8 | PMLLLHIH | | 41101 |
| HPV18 | E5 | 24 | 8 | PSVCMCAY | | 41102 |
| HPV18 | E5 | 44 | 10 | TSPATAFTVY | | 41103 |
| HPV18 | E5 | 12 | 8 | VCMYVCCH | | 41104 |
| HPV18 | E5 | 31 | 9 | YAWVLVFVY | | 41105 |
| HPV18 | E6 | 63 | 10 | AACHKCIDFY | | 41106 |
| HPV18 | E6 | 64 | 9 | ACHKCIDFY | | 41107 |
| HPV18 | E6 | 64 | 11 | ACHKCIDFYSR | | 41108 |
| HPV18 | E6 | 48 | 9 | AFKDLFVVY | | 41109 |
| HPV18 | E6 | 48 | 10 | AFKDLFVVYR | | 41110 |
| HPV18 | E6 | 131 | 9 | AGHYRGQCH | 0.0002 | 41111 |
| HPV18 | E6 | 141 | 9 | CCNRARQER | | 41112 |
| HPV18 | E6 | 68 | 9 | CIDFYSRIR | 0.0001 | 41113 |
| HPV18 | E6 | 142 | 8 | CNRARQER | | 41114 |
| HPV18 | E6 | 142 | 11 | CNRARQERLQR | | 41115 |
| HPV18 | E6 | 70 | 10 | DFYSRIRELR | 0.0001 | 41116 |
| HPV18 | E6 | 70 | 11 | DFYSRIRELRH | | 41117 |
| HPV18 | E6 | 27 | 8 | DIEITCVY | | 41118 |
| HPV18 | E6 | 27 | 10 | DIEITCVYCK | 0.0021 | 41119 |
| HPV18 | E6 | 58 | 9 | DSIPHAACH | 0.0002 | 41120 |
| HPV18 | E6 | 58 | 10 | DSIPHAACHK | | 41121 |
| HPV18 | E6 | 83 | 10 | DSVYGDTLEK | 0.0051 | 41122 |
| HPV18 | E6 | 5 | 8 | EDPTRRPY | | 41123 |
| HPV18 | E6 | 5 | 9 | EDPTRRPYK | | 41124 |
| HPV18 | E6 | 46 | 11 | EFAFKDLFVVY | | 41125 |
| HPV18 | E6 | 29 | 8 | EITCVYCK | | 41126 |
| HPV18 | E6 | 77 | 10 | ELRHYSDSVY | 0.0002 | 41127 |
| HPV18 | E6 | 40 | 11 | ELTEVFEFAFK | | 41128 |
| HPV18 | E6 | 43 | 8 | EVFEFAFK | 0.0180 | 41129 |
| HPV18 | E6 | 47 | 10 | FAFKDLFVVY | | 41130 |
| HPV18 | E6 | 47 | 11 | FAFKDLFVVYR | | 41131 |
| HPV18 | E6 | 53 | 10 | FVVYRDSIPH | | 41132 |
| HPV18 | E6 | 97 | 8 | GLYNLLIR | | 41133 |
| HPV18 | E6 | 97 | 11 | GLYNLLIRCLR | | 41134 |
| HPV18 | E6 | 62 | 11 | HAACHKCIDFY | | 41135 |
| HPV18 | E6 | 120 | 9 | HLNEKRRFH | | 41136 |
| HPV18 | E6 | 128 | 8 | HNIAGHYR | | 41137 |
| HPV18 | E6 | 139 | 8 | HSCCNRAR | | 41138 |
| HPV18 | E6 | 139 | 11 | HSCCNRARQER | | 41139 |
| HPV18 | E6 | 130 | 10 | IAGHYRGQCH | | 41140 |
| HPV18 | E6 | 69 | 8 | IDFYSRIR | | 41141 |
| HPV18 | E6 | 69 | 11 | IDFYSRIRELR | | 41142 |
| HPV18 | E6 | 67 | 8 | KCIDFYSR | | 41143 |
| HPV18 | E6 | 67 | 10 | KCIDFYSRIR | | 41144 |
| HPV18 | E6 | 50 | 8 | KDLFVVYR | | 41145 |
| HPV18 | E6 | 117 | 8 | KLRHLNEK | | 41146 |
| HPV18 | E6 | 117 | 9 | KLRHLNEKR | 0.0005 | 41147 |
| HPV18 | E6 | 117 | 10 | KLRHLNEKRR | 0.0001 | 41148 |
| HPV18 | E6 | 92 | 8 | KLTNTGLY | | 41149 |
| HPV18 | E6 | 52 | 11 | LFVVYRDSIPH | | 41150 |
| HPV18 | E6 | 102 | 9 | LIRCLRCQK | 0.0012 | 41151 |
| HPV18 | E6 | 101 | 10 | LLIRCLRCQK | 0.1200 | 41152 |
| HPV18 | E6 | 121 | 8 | LNEKRRFH | | 41153 |
| HPV18 | E6 | 112 | 8 | LNPAEKLR | | 41154 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | E6 | 112 | 9 | LNPAEKLRH | | 41155 |
| HPV18 | E6 | 41 | 10 | LTEVFEFAFK | 0.0360 | 41156 |
| HPV18 | E6 | 1 | 9 | MARFEDPTR | | 41157 |
| HPV18 | E6 | 1 | 10 | MARFEDPTRR | | 41158 |
| HPV18 | E6 | 129 | 11 | NIAGHYRGQCH | | 41159 |
| HPV18 | E6 | 100 | 8 | NLLIRCLR | | 41160 |
| HPV18 | E6 | 100 | 11 | NLLIRCLRCQK | | 41161 |
| HPV18 | E6 | 95 | 10 | NTGLYNLLIR | 0.0013 | 41162 |
| HPV18 | E6 | 114 | 11 | PAEKLRHLNEK | | 41163 |
| HPV18 | E6 | 111 | 9 | PLNPAEKLR | 0.0005 | 41164 |
| HPV18 | E6 | 111 | 10 | PLNPAEKLRH | | 41165 |
| HPV18 | E6 | 137 | 8 | QCHSCCNR | | 41166 |
| HPV18 | E6 | 137 | 10 | QCHSCCNRAR | | 41167 |
| HPV18 | E6 | 26 | 9 | QDIEITCVY | | 41168 |
| HPV18 | E6 | 26 | 11 | QDIEITCVYCK | | 41169 |
| HPV18 | E6 | 144 | 9 | RARQERLQR | 0.0002 | 41170 |
| HPV18 | E6 | 144 | 10 | RARQERLQRR | | 41171 |
| HPV18 | E6 | 144 | 11 | RARQERLQRRR | | 41172 |
| HPV18 | E6 | 107 | 11 | RCQKPLNPAEK | | 41173 |
| HPV18 | E6 | 57 | 10 | RDSIPHAACH | | 41174 |
| HPV18 | E6 | 57 | 11 | RDSIPHAACHK | | 41175 |
| HPV18 | E6 | 3 | 8 | RFEDPTRR | | 41176 |
| HPV18 | E6 | 3 | 10 | RFEDPTRRPY | 0.0002 | 41177 |
| HPV18 | E6 | 3 | 11 | RFEDPTRRPYK | | 41178 |
| HPV18 | E6 | 126 | 8 | RFHNIAGH | | 41179 |
| HPV18 | E6 | 126 | 9 | RFHNIAGHY | 0.0002 | 41180 |
| HPV18 | E6 | 126 | 10 | RFHNIAGHYR | 0.0057 | 41181 |
| HPV18 | E6 | 135 | 10 | RGQCHSCCNR | | 41182 |
| HPV18 | E6 | 74 | 8 | RIRELRHY | | 41183 |
| HPV18 | E6 | 140 | 10 | SCCNRARQER | | 41184 |
| HPV18 | E6 | 82 | 11 | SDSVYGDTLEK | | 41185 |
| HPV18 | E6 | 59 | 8 | SIPHAACH | | 41186 |
| HPV18 | E6 | 59 | 9 | SIPHAACHK | 0.1200 | 41187 |
| HPV18 | E6 | 24 | 11 | SLQDIEITCVY | | 41188 |
| HPV18 | E6 | 84 | 9 | SVYGDTLEK | 0.2300 | 41189 |
| HPV18 | E6 | 96 | 9 | TGLYNLLIR | 0.0002 | 41190 |
| HPV18 | E6 | 89 | 11 | TLEKLTNTGLY | 0.0002 | 41191 |
| HPV18 | E6 | 94 | 11 | TNTGLYNLLIR | | 41192 |
| HPV18 | E6 | 54 | 9 | VVYRDSIPH | 0.3800 | 41193 |
| HPV18 | E6 | 99 | 9 | YNLLIRCLR | | 41194 |
| HPV18 | E6 | 72 | 8 | YSRIRELR | | 41195 |
| HPV18 | E6 | 72 | 9 | YSRIRELRH | | 41196 |
| HPV18 | E6 | 72 | 10 | YSRIRELRHY | 0.0001 | 41197 |
| HPV18 | E7 | 6 | 9 | ATLQDIVLH | | 41198 |
| HPV18 | E7 | 65 | 9 | CCKCEARIK | | 41199 |
| HPV18 | E7 | 63 | 9 | CMCCKCEAR | | 41200 |
| HPV18 | E7 | 63 | 11 | CMCCKCEARIK | 0.0002 | 41201 |
| HPV18 | E7 | 42 | 11 | DGVNHQHLPAR | | 41202 |
| HPV18 | E7 | 40 | 9 | EIDGVNHQH | | 41203 |
| HPV18 | E7 | 20 | 9 | EIPVDLLCH | | 41204 |
| HPV18 | E7 | 37 | 10 | ENDEIDGVNH | | 41205 |
| HPV18 | E7 | 77 | 8 | ESSADDLR | | 41206 |
| HPV18 | E7 | 43 | 10 | GVNHQHLPAR | | 41207 |
| HPV18 | E7 | 43 | 11 | GVNHQHLPARR | | 41208 |
| HPV18 | E7 | 48 | 11 | HLPARRAEPQR | | 41209 |
| HPV18 | E7 | 59 | 9 | HTMLCMCCK | 0.0940 | 41210 |
| HPV18 | E7 | 41 | 8 | IDGVNHQH | | 41211 |
| HPV18 | E7 | 5 | 10 | KATLQDIVLH | | 41212 |
| HPV18 | E7 | 62 | 10 | LCMCCKCEAR | | 41213 |
| HPV18 | E7 | 74 | 11 | LVVESSADDLR | | 41214 |
| HPV18 | E7 | 64 | 8 | MCCKCEAR | | 41215 |
| HPV18 | E7 | 64 | 10 | MCCKCEARIK | | 41216 |
| HPV18 | E7 | 61 | 11 | MLCMCCKCEAR | | 41217 |
| HPV18 | E7 | 38 | 9 | NDEIDGVNH | | 41218 |
| HPV18 | E7 | 38 | 11 | NDEIDGVNHQH | | 41219 |
| HPV18 | E7 | 50 | 9 | PARRAEPQR | | 41220 |
| HPV18 | E7 | 50 | 10 | PARRAEPQRH | | 41221 |
| HPV18 | E7 | 18 | 11 | QNEIPVDLLCH | | 41222 |
| HPV18 | E7 | 7 | 8 | TLQDIVLH | | 41223 |
| HPV18 | E7 | 60 | 8 | TMLCMCCK | 0.0240 | 41224 |
| HPV18 | E7 | 44 | 9 | VNHQHLPAR | 0.0007 | 41225 |
| HPV18 | E7 | 44 | 10 | VNHQHLPARR | | 41226 |
| HPV18 | E7 | 75 | 10 | VVESSADDLR | | 41227 |
| HPV18 | L1 | 494 | 10 | AAPAENKDPY | | 41228 |
| HPV18 | L1 | 195 | 11 | AATSNVSEDVR | | 41229 |

TABLE XVII-continued

A11 Motif Peptides

| Type | Protein | Position | No. of Amino Acids | Sequence | A*1101 | Seq. Id. No. |
|---|---|---|---|---|---|---|
| HPV18 | L1 | 162 | 9 | ACAGVEIGR | | 41230 |
| HPV18 | L1 | 447 | 8 | ADVMSYIH | | 41231 |
| HPV18 | L1 | 115 | 11 | AGGGNKQDIPK | | 41232 |
| HPV18 | L1 | 225 | 8 | AIGEHWAK | | 41233 |
| HPV18 | L1 | 63 | 11 | ALWRPSDNTVY | | 41234 |
| HPV18 | L1 | 268 | 11 | AMDFSTLQDTK | | 41235 |
| HPV18 | L1 | 345 | 8 | ASPGSCVY | | 41236 |
| HPV18 | L1 | 407 | 11 | ASTQSPVPGQY | | 41237 |
| HPV18 | L1 | 419 | 9 | ATKFKQYSR | | 41238 |
| HPV18 | L1 | 419 | 10 | ATKFKQYSRH | | 41239 |
| HPV18 | L1 | 196 | 10 | ATSNVSEDVR | | 41240 |
| HPV18 | L1 | 552 | 9 | ATTSSKPAK | | 41241 |
| HPV18 | L1 | 552 | 10 | ATTSSKPAKR | | 41242 |
| HPV18 | L1 | 163 | 8 | CAGVEIGR | | 41243 |
| HPV18 | L1 | 222 | 8 | CAPAIGEH | | 41244 |
| HPV18 | L1 | 222 | 11 | CAPAIGEHWAK | | 41245 |
| HPV18 | L1 | 42 | 10 | CGHYIILFLR | | 41246 |
| HPV18 | L1 | 310 | 10 | CLRREQLFAR | | 41247 |
| HPV18 | L1 | 310 | 11 | CLRREQLFARH | | 41248 |
| HPV18 | L1 | 2 | 10 | CLYTRVLILH | | 41249 |
| HPV18 | L1 | 2 | 11 | CLYTRVLILHY | | 41250 |
| HPV18 | L1 | 493 | 8 | DAAPAENK | | 41251 |
| HPV18 | L1 | 493 | 11 | DAAPAENKDPY | | 41252 |
| HPV18 | L1 | 418 | 8 | DATKFKQY | | 41253 |
| HPV18 | L1 | 418 | 10 | DATKFKQYSR | | 41254 |
| HPV18 | L1 | 418 | 11 | DATKFKQYSRH | | 41255 |
| HPV18 | L1 | 245 | 8 | DCPPLELK | | 41256 |
| HPV18 | L1 | 86 | 11 | DDYVTPTSIFY | | 41257 |
| HPV18 | L1 | 270 | 9 | DFSTLQDTK | | 41258 |
| HPV18 | L1 | 258 | 9 | DGDMVDTGY | | 41259 |
| HPV18 | L1 | 284 | 8 | DICQSICK | | 41260 |
| HPV18 | L1 | 284 | 9 | DICQSICKY | | 41261 |
| HPV18 | L1 | 122 | 8 | DIPKVSAY | | 41262 |
| HPV18 | L1 | 122 | 10 | DIPKVSAYQY | | 41263 |
| HPV18 | L1 | 122 | 11 | DIPKVSAYQYR | | 41264 |
| HPV18 | L1 | 520 | 9 | DLDQYPLGR | | 41265 |
| HPV18 | L1 | 520 | 10 | DLDQYPLGRK | | 41266 |
| HPV18 | L1 | 206 | 8 | DNVSVDYK | | 41267 |
| HPV18 | L1 | 305 | 8 | DSMFFCLR | | 41268 |
| HPV18 | L1 | 305 | 9 | DSMFFCLRR | | 41269 |
| HPV18 | L1 | 364 | 9 | DSQLFNKPY | | 41270 |
| HPV18 | L1 | 148 | 11 | DTSIYNPETQR | | 41271 |
| HPV18 | L1 | 330 | 8 | DTVPQSLY | | 41272 |
| HPV18 | L1 | 330 | 10 | DTVPQSLYIK | | 41273 |
| HPV18 | L1 | 203 | 10 | DVRDNVSVDY | | 41274 |
| HPV18 | L1 | 203 | 11 | DVRDNVSVDYK | | 41275 |
| HPV18 | L1 | 257 | 10 | EDGDMVDTGY | | 41276 |
| HPV18 | L1 | 202 | 11 | EDVRDNVSVDY | | 41277 |
| HPV18 | L1 | 498 | 8 | ENKDPYDK | | 41278 |
| HPV18 | L1 | 498 | 10 | ENKDPYDKLK | | 41279 |
| HPV18 | L1 | 317 | 8 | FARHFWNR | | 41280 |
| HPV18 | L1 | 309 | 11 | FCLRREQLFAR | | 41281 |
| HPV18 | L1 | 144 | 9 | FGLPDTSIY | | 41282 |
| HPV18 | L1 | 59 | 8 | FLQMALWR | | 41283 |
| HPV18 | L1 | 530 | 8 | FLVQAGLR | | 41284 |
| HPV18 | L1 | 530 | 9 | FLVQAGLRR | | 41285 |
| HPV18 | L1 | 530 | 10 | FLVQAGLRRK | | 41286 |
| HPV18 | L1 | 368 | 8 | FNKPYWLH | | 41287 |
| HPV18 | L1 | 368 | 9 | FNKPYWLHK | | 41288 |
| HPV18 | L1 | 517 | 8 | FSLDLDQY | | 41289 |
| HPV18 | L1 | 271 | 8 | FSTLQDTK | | 41290 |
| HPV18 | L1 | 482 | 11 | FVQSVAITCQK | | 41291 |
| HPV18 | L1 | 221 | 9 | GCAPAIGEH | | 41292 |
| HPV18 | L1 | 244 | 9 | GDCPPLELK | | 41293 |
| HPV18 | L1 | 259 | 8 | GDMVDTGY | | 41294 |
| HPV18 | L1 | 304 | 9 | GDSMFFCLR | | 41295 |
| HPV18 | L1 | 304 | 10 | GDSMFFCLRR | | 41296 |
| HPV18 | L1 | 329 | 9 | GDTVPQSLY | | 41297 |
| HPV18 | L1 | 329 | 11 | GDTVPQSLYIK | | 41298 |
| HPV18 | L1 | 116 | 10 | GGGNKQDIPK | | 41299 |
| HPV18 | L1 | 117 | 9 | GGNKQDIPK | | 41300 |
| HPV18 | L1 | 145 | 8 | GLPDTSIY | | 41301 |
| HPV18 | L1 | 535 | 11 | GLRRKPTIGPR | | 41302 |
| HPV18 | L1 | 177 | 8 | GLSGHPFY | | 41303 |
| HPV18 | L1 | 177 | 10 | GLSGHPFYNK | | 41304 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | L1 | 342 | 11 | GMPASPGSCVY | | 41305 |
| HPV18 | L1 | 118 | 8 | GNKQDIPK | | 41306 |
| HPV18 | L1 | 175 | 10 | GVGLSGHPFY | | 41307 |
| HPV18 | L1 | 38 | 8 | HIIICGHY | | 41308 |
| HPV18 | L1 | 13 | 10 | HLLPLYGPLY | | 41309 |
| HPV18 | L1 | 13 | 11 | HLLPLYGPLYH | | 41310 |
| HPV18 | L1 | 380 | 8 | HNNGVCWH | | 41311 |
| HPV18 | L1 | 30 | 9 | HSILVYMVH | | 41312 |
| HPV18 | L1 | 41 | 11 | ICGHYIILFLR | | 41313 |
| HPV18 | L1 | 285 | 8 | ICQSICKY | | 41314 |
| HPV18 | L1 | 285 | 11 | ICQSICKYPDY | | 41315 |
| HPV18 | L1 | 58 | 9 | IFLQMALWR | | 41316 |
| HPV18 | L1 | 94 | 9 | IFYHAGSSR | | 41317 |
| HPV18 | L1 | 219 | 11 | ILGCAPAIGEH | | 41318 |
| HPV18 | L1 | 9 | 10 | ILHYHLLPLY | | 41319 |
| HPV18 | L1 | 443 | 10 | ITLTADVMSY | | 41320 |
| HPV18 | L1 | 360 | 11 | IVTSDSQLFNK | | 41321 |
| HPV18 | L1 | 492 | 9 | KDAAPAENK | | 41322 |
| HPV18 | L1 | 500 | 8 | KDPYDKLK | | 41323 |
| HPV18 | L1 | 143 | 10 | KFGLPDTSIY | | 41324 |
| HPV18 | L1 | 421 | 8 | KFKQYSRH | | 41325 |
| HPV18 | L1 | 529 | 9 | KFLVQAGLR | | 41326 |
| HPV18 | L1 | 529 | 10 | KFLVQAGLRR | | 41327 |
| HPV18 | L1 | 529 | 11 | KFLVQAGLRRK | | 41328 |
| HPV18 | L1 | 516 | 9 | KFSLDLDQY | | 41329 |
| HPV18 | L1 | 507 | 8 | KFWNVDLK | | 41330 |
| HPV18 | L1 | 507 | 10 | KFWNVDLKEK | | 41331 |
| HPV18 | L1 | 232 | 8 | KGTACKSR | | 41332 |
| HPV18 | L1 | 186 | 9 | KLDDTESSH | | 41333 |
| HPV18 | L1 | 505 | 10 | KLKFWNVDLK | | 41334 |
| HPV18 | L1 | 125 | 8 | KVSAYQYR | | 41335 |
| HPV18 | L1 | 125 | 11 | KVSAYQYRVFR | | 41336 |
| HPV18 | L1 | 187 | 8 | LDDTESSH | | 41337 |
| HPV18 | L1 | 283 | 9 | LDICQSICK | | 41338 |
| HPV18 | L1 | 283 | 10 | LDICQSICKY | | 41339 |
| HPV18 | L1 | 519 | 10 | LDLDQYPLGR | | 41340 |
| HPV18 | L1 | 519 | 11 | LDLDQYPLGRK | | 41341 |
| HPV18 | L1 | 521 | 8 | LDQYPLGR | | 41342 |
| HPV18 | L1 | 521 | 9 | LDQYPLGRK | | 41343 |
| HPV18 | L1 | 316 | 9 | LFARHFWNR | | 41344 |
| HPV18 | L1 | 367 | 9 | LFNKPYWLH | | 41345 |
| HPV18 | L1 | 367 | 10 | LFNKPYWLHK | | 41346 |
| HPV18 | L1 | 220 | 10 | LGCAPAIGEH | | 41347 |
| HPV18 | L1 | 174 | 8 | LGVGLSGH | | 41348 |
| HPV18 | L1 | 174 | 11 | LGVGLSGHPFY | | 41349 |
| HPV18 | L1 | 8 | 11 | LILHYHLLPLY | | 41350 |
| HPV18 | L1 | 14 | 9 | LLPLYGPLY | | 41351 |
| HPV18 | L1 | 14 | 10 | LLPLYGPLYH | | 41352 |
| HPV18 | L1 | 103 | 8 | LLTVGNPY | | 41353 |
| HPV18 | L1 | 103 | 10 | LLTVGNPYFR | | 41354 |
| HPV18 | L1 | 178 | 9 | LSGHPFYNK | | 41355 |
| HPV18 | L1 | 445 | 8 | LTADVMSY | | 41356 |
| HPV18 | L1 | 445 | 10 | LTADVMSYIH | | 41357 |
| HPV18 | L1 | 104 | 9 | LTVGNPYFR | | 41358 |
| HPV18 | L1 | 531 | 8 | LVQAGLRR | | 41359 |
| HPV18 | L1 | 531 | 9 | LVQAGLRRK | | 41360 |
| HPV18 | L1 | 1 | 11 | MCLYTRVLILH | | 41361 |
| HPV18 | L1 | 269 | 10 | MDFSTLQDTK | | 41362 |
| HPV18 | L1 | 328 | 10 | MGDTVPQSLY | | 41363 |
| HPV18 | L1 | 36 | 9 | MVHIIICGH | | 41364 |
| HPV18 | L1 | 36 | 10 | MVHIIICGHY | | 41365 |
| HPV18 | L1 | 496 | 8 | PAENKDPY | | 41366 |
| HPV18 | L1 | 496 | 10 | PAENKDPYDK | | 41367 |
| HPV18 | L1 | 224 | 9 | PAIGEHWAK | | 41368 |
| HPV18 | L1 | 558 | 8 | PAKRVRVR | | 41369 |
| HPV18 | L1 | 558 | 10 | PAKRVRVRAR | | 41370 |
| HPV18 | L1 | 558 | 11 | PAKRVRVRARK | | 41371 |
| HPV18 | L1 | 344 | 9 | PASPGSCVY | | 41372 |
| HPV18 | L1 | 293 | 11 | PDYLQMSADPY | | 41373 |
| HPV18 | L1 | 414 | 8 | PGQYDATK | | 41374 |
| HPV18 | L1 | 414 | 10 | PGQYDATKFK | | 41375 |
| HPV18 | L1 | 57 | 10 | PIFLQMALWR | | 41376 |
| HPV18 | L1 | 282 | 10 | PLDICQSICK | | 41377 |
| HPV18 | L1 | 282 | 11 | PLDICQSICKY | | 41378 |
| HPV18 | L1 | 173 | 9 | PLGVGLSGH | | 41379 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | L1 | 28 | 8 | PLHSILVY | | 41380 |
| HPV18 | L1 | 28 | 11 | PLHSILVYMVH | | 41381 |
| HPV18 | L1 | 26 | 10 | PLPLHSILVY | | 41382 |
| HPV18 | L1 | 16 | 8 | PLYGPLYH | | 41383 |
| HPV18 | L1 | 16 | 10 | PLYGPLYHPR | | 41384 |
| HPV18 | L1 | 20 | 11 | PLYHPRPLPLH | | 41385 |
| HPV18 | L1 | 550 | 8 | PSATTSSK | | 41386 |
| HPV18 | L1 | 550 | 11 | PSATTSSKPAK | | 41387 |
| HPV18 | L1 | 540 | 8 | PTIGPRKR | | 41388 |
| HPV18 | L1 | 472 | 9 | PTTSLVDTY | | 41389 |
| HPV18 | L1 | 472 | 10 | PTTSLVDTYR | | 41390 |
| HPV18 | L1 | 412 | 10 | PVPGQYDATK | | 41391 |
| HPV18 | L1 | 121 | 9 | QDIPKVSAY | | 41392 |
| HPV18 | L1 | 121 | 11 | QDIPKVSAYQY | | 41393 |
| HPV18 | L1 | 243 | 10 | QGDCPPLELK | | 41394 |
| HPV18 | L1 | 378 | 10 | QGHNNGVCWH | | 41395 |
| HPV18 | L1 | 315 | 10 | QLFARHFWNR | | 41396 |
| HPV18 | L1 | 366 | 10 | QLFNKPYWLH | | 41397 |
| HPV18 | L1 | 366 | 11 | QLFNKPYWLHK | | 41398 |
| HPV18 | L1 | 287 | 9 | QSICKYPDY | | 41399 |
| HPV18 | L1 | 410 | 8 | QSPVPGQY | | 41400 |
| HPV18 | L1 | 484 | 9 | QSVAITCQK | | 41401 |
| HPV18 | L1 | 205 | 8 | RDNVSVDY | | 41402 |
| HPV18 | L1 | 205 | 9 | RDNVSVDYK | | 41403 |
| HPV18 | L1 | 102 | 9 | RLLTVGNPY | | 41404 |
| HPV18 | L1 | 102 | 11 | RLLTVGNPYFR | | 41405 |
| HPV18 | L1 | 547 | 11 | RSAPSATTSSK | | 41406 |
| HPV18 | L1 | 6 | 8 | RVLILHYH | | 41407 |
| HPV18 | L1 | 112 | 9 | RVPAGGGNK | | 41408 |
| HPV18 | L1 | 135 | 9 | RVQLPDPNK | | 41409 |
| HPV18 | L1 | 561 | 8 | RVRVRARK | | 41410 |
| HPV18 | L1 | 81 | 8 | RVVNTDDY | | 41411 |
| HPV18 | L1 | 548 | 10 | SAPSATTSSK | | 41412 |
| HPV18 | L1 | 551 | 10 | SATTSSKPAK | | 41413 |
| HPV18 | L1 | 551 | 11 | SATTSSKPAKR | | 41414 |
| HPV18 | L1 | 127 | 9 | SAYQYRVFR | | 41415 |
| HPV18 | L1 | 363 | 8 | SDSQLFNK | | 41416 |
| HPV18 | L1 | 363 | 10 | SDSQLFNKPY | | 41417 |
| HPV18 | L1 | 179 | 8 | SGHPFYNK | | 41418 |
| HPV18 | L1 | 288 | 8 | SICKYPDY | | 41419 |
| HPV18 | L1 | 93 | 10 | SIFYHAGSSR | | 41420 |
| HPV18 | L1 | 31 | 8 | SILVYMVH | | 41421 |
| HPV18 | L1 | 150 | 9 | SIYNPETQR | | 41422 |
| HPV18 | L1 | 518 | 11 | SLDLDQYPLGR | | 41423 |
| HPV18 | L1 | 306 | 8 | SMFFCLRR | | 41424 |
| HPV18 | L1 | 198 | 8 | SNVSEDVR | | 41425 |
| HPV18 | L1 | 555 | 9 | SSKPAKRVR | | 41426 |
| HPV18 | L1 | 555 | 11 | SSKPAKRVRVR | | 41427 |
| HPV18 | L1 | 100 | 11 | SSRLLTVGNPY | | 41428 |
| HPV18 | L1 | 408 | 10 | STQSPVPGQY | | 41429 |
| HPV18 | L1 | 485 | 8 | SVAITCQK | | 41430 |
| HPV18 | L1 | 78 | 11 | SVARVVNTDDY | | 41431 |
| HPV18 | L1 | 446 | 9 | TADVMSYIH | | 41432 |
| HPV18 | L1 | 442 | 11 | TITLTADVMSY | | 41433 |
| HPV18 | L1 | 444 | 9 | TLTADVMSY | | 41434 |
| HPV18 | L1 | 444 | 11 | TLTADVMSYIH | | 41435 |
| HPV18 | L1 | 327 | 11 | TMGDTVPQSLY | | 41436 |
| HPV18 | L1 | 362 | 9 | TSDSQLFNK | | 41437 |
| HPV18 | L1 | 362 | 11 | TSDSQLFNKPY | | 41438 |
| HPV18 | L1 | 92 | 11 | TSIFYHAGSSR | | 41439 |
| HPV18 | L1 | 149 | 10 | TSIYNPETQR | | 41440 |
| HPV18 | L1 | 474 | 8 | TSLVDTYR | | 41441 |
| HPV18 | L1 | 197 | 9 | TSNVSEDVR | | 41442 |
| HPV18 | L1 | 554 | 8 | TSSKPAKR | | 41443 |
| HPV18 | L1 | 554 | 10 | TSSKPAKRVR | | 41444 |
| HPV18 | L1 | 473 | 8 | TTSLVDTY | | 41445 |
| HPV18 | L1 | 473 | 9 | TTSLVDTYR | | 41446 |
| HPV18 | L1 | 553 | 8 | TTSSKPAK | | 41447 |
| HPV18 | L1 | 553 | 9 | TTSSKPAKR | | 41448 |
| HPV18 | L1 | 553 | 11 | TTSSKPAKRVR | | 41449 |
| HPV18 | L1 | 105 | 8 | TVGNPYFR | | 41450 |
| HPV18 | L1 | 331 | 9 | TVPQSLYIK | | 41451 |
| HPV18 | L1 | 71 | 11 | TVYLPPPSVAR | | 41452 |
| HPV18 | L1 | 79 | 10 | VARVVNTDDY | | 41453 |
| HPV18 | L1 | 133 | 11 | VFRVQLPDPNK | | 41454 |

TABLE XVII-continued

A11 Motif Peptides

| Type | Protein | Position | No. of Amino Acids | Sequence | A*1101 | Seq. Id. No. |
|---|---|---|---|---|---|---|
| HPV18 | L1 | 176 | 9 | VGLSGHPFY | | 41455 |
| HPV18 | L1 | 176 | 11 | VGLSGHPFYNK | | 41456 |
| HPV18 | L1 | 126 | 10 | VSAYQYRVFR | | 41457 |
| HPV18 | L1 | 89 | 8 | VTPTSIFY | | 41458 |
| HPV18 | L1 | 89 | 9 | VTPTSIFYH | | 41459 |
| HPV18 | L1 | 361 | 10 | VTSDSQLFNK | | 41460 |
| HPV18 | L1 | 161 | 10 | WACAGVEIGR | | 41461 |
| HPV18 | L1 | 230 | 8 | WAKGTACK | | 41462 |
| HPV18 | L1 | 230 | 10 | WAKGTACKSR | | 41463 |
| HPV18 | L1 | 373 | 8 | WLHKAQGH | | 41464 |
| HPV18 | L1 | 509 | 8 | WNVDLKEK | | 41465 |
| HPV18 | L1 | 417 | 9 | YDATKFKQY | | 41466 |
| HPV18 | L1 | 417 | 11 | YDATKFKQYSR | | 41467 |
| HPV18 | L1 | 110 | 11 | YFRVPAGGGNK | | 41468 |
| HPV18 | L1 | 303 | 10 | YGDSMFFCLR | | 41469 |
| HPV18 | L1 | 303 | 11 | YGDSMFFCLRR | | 41470 |
| HPV18 | L1 | 18 | 8 | YGPLYHPR | | 41471 |
| HPV18 | L1 | 73 | 9 | YLPPPSVAR | | 41472 |
| HPV18 | L1 | 295 | 9 | YLQMSADPY | | 41473 |
| HPV18 | L1 | 35 | 10 | YMVHIIICGH | | 41474 |
| HPV18 | L1 | 35 | 11 | YMVHIIICGHY | | 41475 |
| HPV18 | L1 | 184 | 11 | YNKLDDTESSH | | 41476 |
| HPV18 | L1 | 425 | 8 | YSRHVEEY | | 41477 |
| HPV18 | L1 | 4 | 8 | YTRVLILH | | 41478 |
| HPV18 | L1 | 4 | 9 | YTRVLILHY | | 41479 |
| HPV18 | L1 | 4 | 10 | YTRVLILHYH | | 41480 |
| HPV18 | L1 | 88 | 9 | YVTPTSIFY | | 41481 |
| HPV18 | L1 | 88 | 10 | YVTPTSIFYH | | 41482 |
| HPV18 | L2 | 222 | 8 | AGPRLYSR | | 41483 |
| HPV18 | L2 | 222 | 10 | AGPRLYSRAY | | 41484 |
| HPV18 | L2 | 286 | 10 | ALTSRRGTVR | | 41485 |
| HPV18 | L2 | 237 | 8 | ANPEFLTR | | 41486 |
| HPV18 | L2 | 423 | 9 | ASTQYIGIH | | 41487 |
| HPV18 | L2 | 12 | 8 | ASVTDLYK | | 41488 |
| HPV18 | L2 | 12 | 11 | ASVTDLYKTCK | | 41489 |
| HPV18 | L2 | 341 | 11 | ATEDNDLFDIY | | 41490 |
| HPV18 | L2 | 275 | 9 | DFMDIIRLH | | 41491 |
| HPV18 | L2 | 275 | 10 | DFMDIIRLHR | | 41492 |
| HPV18 | L2 | 322 | 11 | DISPIAPSPEY | | 41493 |
| HPV18 | L2 | 354 | 11 | DMDPAVPVPSR | | 41494 |
| HPV18 | L2 | 344 | 8 | DNDLFDIY | | 41495 |
| HPV18 | L2 | 273 | 9 | DSDFMDIIR | | 41496 |
| HPV18 | L2 | 273 | 11 | DSDFMDIIRLH | | 41497 |
| HPV18 | L2 | 109 | 11 | DSSVVTSGAPR | | 41498 |
| HPV18 | L2 | 260 | 9 | DTTLTFDPR | | 41499 |
| HPV18 | L2 | 343 | 9 | EDNDLFDIY | | 41500 |
| HPV18 | L2 | 36 | 8 | EGTTLADK | | 41501 |
| HPV18 | L2 | 443 | 8 | FIPKKRKR | | 41502 |
| HPV18 | L2 | 443 | 11 | FIPKKRKRVPY | | 41503 |
| HPV18 | L2 | 241 | 11 | FLTRPSSLITY | | 41504 |
| HPV18 | L2 | 276 | 8 | FMDIIRLH | | 41505 |
| HPV18 | L2 | 276 | 9 | FMDIIRLHR | | 41506 |
| HPV18 | L2 | 306 | 11 | FTRSGTQIGAR | | 41507 |
| HPV18 | L2 | 181 | 10 | FVGTPTSGTH | | 41508 |
| HPV18 | L2 | 314 | 8 | GARVHFYH | | 41509 |
| HPV18 | L2 | 58 | 11 | GIGTGSGTGGR | | 41510 |
| HPV18 | L2 | 429 | 8 | GIHGTHYY | | 41511 |
| HPV18 | L2 | 62 | 10 | GSGTGGRTGY | | 41512 |
| HPV18 | L2 | 25 | 10 | GTCPPDVVPK | | 41513 |
| HPV18 | L2 | 64 | 8 | GTGGRTGY | | 41514 |
| HPV18 | L2 | 60 | 9 | GTGSGTGGR | | 41515 |
| HPV18 | L2 | 432 | 10 | GTHYYLWPLY | | 41516 |
| HPV18 | L2 | 432 | 11 | GTHYYLWPLYY | | 41517 |
| HPV18 | L2 | 183 | 8 | GTPTSGTH | | 41518 |
| HPV18 | L2 | 183 | 10 | GTPTSGTHGY | | 41519 |
| HPV18 | L2 | 310 | 9 | GTQIGARVH | | 41520 |
| HPV18 | L2 | 310 | 11 | GTQIGARVHFY | | 41521 |
| HPV18 | L2 | 292 | 11 | GTVRFSRLGQR | | 41522 |
| HPV18 | L2 | 431 | 11 | HGTHYYLWPLY | | 41523 |
| HPV18 | L2 | 313 | 8 | IGARVHFY | | 41524 |
| HPV18 | L2 | 313 | 9 | IGARVHFYH | | 41525 |
| HPV18 | L2 | 428 | 8 | IGIHGTHY | | 41526 |
| HPV18 | L2 | 428 | 9 | IGIHGTHYY | | 41527 |
| HPV18 | L2 | 59 | 10 | IGTGSGTGGR | | 41528 |
| HPV18 | L2 | 323 | 10 | ISPIAPSPEY | | 41529 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | L2 | 210 | 10 | ISSTPLPTVR | | 41530 |
| HPV18 | L2 | 210 | 11 | ISSTPLPTVRR | | 41531 |
| HPV18 | L2 | 34 | 10 | KVEGTTLADK | | 41532 |
| HPV18 | L2 | 299 | 10 | LGQRATMFTR | | 41533 |
| HPV18 | L2 | 242 | 10 | LTRPSSLITY | | 41534 |
| HPV18 | L2 | 287 | 9 | LTSRRGTVR | | 41535 |
| HPV18 | L2 | 391 | 10 | LTSSWDVPVY | | 41536 |
| HPV18 | L2 | 277 | 8 | MDIIRLHR | | 41537 |
| HPV18 | L2 | 355 | 10 | MDPAVPVPSR | | 41538 |
| HPV18 | L2 | 1 | 8 | MVSHRAAR | | 41539 |
| HPV18 | L2 | 1 | 9 | MVSHRAARR | | 41540 |
| HPV18 | L2 | 1 | 10 | MVSHRAARRK | | 41541 |
| HPV18 | L2 | 1 | 11 | MVSHRAARRKR | | 41542 |
| HPV18 | L2 | 79 | 10 | NTVVDVGPTR | | 41543 |
| HPV18 | L2 | 285 | 11 | PALTSRRGTVR | | 41544 |
| HPV18 | L2 | 422 | 10 | PASTQYIGIH | | 41545 |
| HPV18 | L2 | 357 | 8 | PAVPVPSR | | 41546 |
| HPV18 | L2 | 272 | 10 | PDSDFMDIIR | | 41547 |
| HPV18 | L2 | 325 | 8 | PIAPSPEY | | 41548 |
| HPV18 | L2 | 209 | 11 | PISSTPLPTVR | | 41549 |
| HPV18 | L2 | 390 | 11 | PLTSSWDVPVY | | 41550 |
| HPV18 | L2 | 439 | 8 | PLYYFIPK | | 41551 |
| HPV18 | L2 | 439 | 9 | PLYYFIPKK | | 41552 |
| HPV18 | L2 | 439 | 10 | PLYYFIPKKR | | 41553 |
| HPV18 | L2 | 439 | 11 | PLYYFIPKKRK | | 41554 |
| HPV18 | L2 | 419 | 9 | PTAPASTQY | | 41555 |
| HPV18 | L2 | 376 | 9 | PTISSASSY | | 41556 |
| HPV18 | L2 | 185 | 8 | PTSGTHGY | | 41557 |
| HPV18 | L2 | 216 | 10 | PTVRRVAGPR | | 41558 |
| HPV18 | L2 | 258 | 11 | PVDTTLTFDPR | | 41559 |
| HPV18 | L2 | 312 | 9 | QIGARVHFY | | 41560 |
| HPV18 | L2 | 312 | 10 | QIGARVHFYH | | 41561 |
| HPV18 | L2 | 11 | 8 | RASVTDLY | | 41562 |
| HPV18 | L2 | 11 | 9 | RASVTDLYK | | 41563 |
| HPV18 | L2 | 295 | 8 | RFSRLGQR | | 41564 |
| HPV18 | L2 | 291 | 8 | RGTVRFSR | | 41565 |
| HPV18 | L2 | 298 | 11 | RLGQRATMFTR | | 41566 |
| HPV18 | L2 | 281 | 10 | RLHRPALTSR | | 41567 |
| HPV18 | L2 | 281 | 11 | RLHRPALTSRR | | 41568 |
| HPV18 | L2 | 308 | 9 | RSGTQIGAR | | 41569 |
| HPV18 | L2 | 308 | 11 | RSGTQIGARVH | | 41570 |
| HPV18 | L2 | 364 | 10 | RSTTSFAFFK | | 41571 |
| HPV18 | L2 | 364 | 11 | RSTTSFAFFKY | | 41572 |
| HPV18 | L2 | 68 | 10 | RTGYIPLGGR | | 41573 |
| HPV18 | L2 | 220 | 8 | RVAGPRLY | | 41574 |
| HPV18 | L2 | 220 | 10 | RVAGPRLYSR | | 41575 |
| HPV18 | L2 | 274 | 8 | SDFMDIIR | | 41576 |
| HPV18 | L2 | 274 | 10 | SDFMDIIRLH | | 41577 |
| HPV18 | L2 | 274 | 11 | SDFMDIIRLHR | | 41578 |
| HPV18 | L2 | 24 | 11 | SGTCPPDVVPK | | 41579 |
| HPV18 | L2 | 63 | 9 | SGTGGRTGY | | 41580 |
| HPV18 | L2 | 309 | 8 | SGTQIGAR | | 41581 |
| HPV18 | L2 | 309 | 10 | SGTQIGARVH | | 41582 |
| HPV18 | L2 | 78 | 11 | SNTVVDVGPTR | | 41583 |
| HPV18 | L2 | 211 | 9 | SSTPLPTVR | | 41584 |
| HPV18 | L2 | 211 | 10 | SSTPLPTVRR | | 41585 |
| HPV18 | L2 | 110 | 10 | SSVVTSGAPR | | 41586 |
| HPV18 | L2 | 393 | 8 | SSWDVPVY | | 41587 |
| HPV18 | L2 | 212 | 8 | STPLPTVR | | 41588 |
| HPV18 | L2 | 212 | 9 | STPLPTVRR | | 41589 |
| HPV18 | L2 | 424 | 8 | STQYIGIH | | 41590 |
| HPV18 | L2 | 424 | 11 | STQYIGIHGTH | | 41591 |
| HPV18 | L2 | 365 | 9 | STTSFAFFK | | 41592 |
| HPV18 | L2 | 365 | 10 | STTSFAFFKY | | 41593 |
| HPV18 | L2 | 235 | 10 | SVANPEFLTR | | 41594 |
| HPV18 | L2 | 13 | 10 | SVTDLYKTCK | | 41595 |
| HPV18 | L2 | 111 | 9 | SVVTSGAPR | | 41596 |
| HPV18 | L2 | 420 | 8 | TAPASTQY | | 41597 |
| HPV18 | L2 | 26 | 9 | TCPPDVVPK | | 41598 |
| HPV18 | L2 | 15 | 8 | TDLYKTCK | | 41599 |
| HPV18 | L2 | 61 | 8 | TGSGTGGR | | 41600 |
| HPV18 | L2 | 61 | 11 | TGSGTGGRTGY | | 41601 |
| HPV18 | L2 | 69 | 9 | TGYIPLGGR | | 41602 |
| HPV18 | L2 | 377 | 8 | TISSASSY | | 41603 |
| HPV18 | L2 | 367 | 8 | TSFAFFKY | | 41604 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV18 | L2 | 288 | 8 | TSRRGTVR | | 41605 |
| HPV18 | L2 | 288 | 11 | TSRRGTVRFSR | | 41606 |
| HPV18 | L2 | 392 | 9 | TSSWDVPVY | | 41607 |
| HPV18 | L2 | 261 | 8 | TTLTFDPR | | 41608 |
| HPV18 | L2 | 366 | 8 | TTSFAFFK | | 41609 |
| HPV18 | L2 | 366 | 9 | TTSFAFFKY | | 41610 |
| HPV18 | L2 | 293 | 10 | TVRFSRLGQR | | 41611 |
| HPV18 | L2 | 217 | 9 | TVRRVAGPR | | 41612 |
| HPV18 | L2 | 217 | 11 | TVRRVAGPRLY | | 41613 |
| HPV18 | L2 | 80 | 9 | TVVDVGPTR | | 41614 |
| HPV18 | L2 | 221 | 9 | VAGPRLYSR | | 41615 |
| HPV18 | L2 | 221 | 11 | VAGPRLYSRAY | | 41616 |
| HPV18 | L2 | 236 | 9 | VANPEFLTR | | 41617 |
| HPV18 | L2 | 259 | 10 | VDTTLTFDPR | | 41618 |
| HPV18 | L2 | 180 | 11 | VFVGTPTSGTH | | 41619 |
| HPV18 | L2 | 182 | 9 | VGTPTSGTH | | 41620 |
| HPV18 | L2 | 182 | 11 | VGTPTSGTHGY | | 41621 |
| HPV18 | L2 | 2 | 8 | VSHRAARR | | 41622 |
| HPV18 | L2 | 2 | 9 | VSHRAARRK | | 41623 |
| HPV18 | L2 | 2 | 10 | VSHRAARRKR | | 41624 |
| HPV18 | L2 | 417 | 11 | VSPTAPASTQY | | 41625 |
| HPV18 | L2 | 234 | 11 | VSVANPEFLTR | | 41626 |
| HPV18 | L2 | 14 | 9 | VTDLYKTCK | | 41627 |
| HPV18 | L2 | 81 | 8 | VVDVGPTR | | 41628 |
| HPV18 | L2 | 112 | 8 | VVTSGAPR | | 41629 |
| HPV18 | L2 | 442 | 8 | YFIPKKRK | | 41630 |
| HPV18 | L2 | 442 | 9 | YFIPKKRKR | | 41631 |
| HPV18 | L2 | 427 | 8 | YIGIHGTH | | 41632 |
| HPV18 | L2 | 427 | 9 | YIGIHGTHY | | 41633 |
| HPV18 | L2 | 427 | 10 | YIGIHGTHYY | | 41634 |
| HPV18 | L2 | 436 | 11 | YLWPLYYFIPK | | 41635 |
| HPV18 | L2 | 374 | 11 | YSPTISSASSY | | 41636 |
| HPV31 | E1 | 296 | 8 | AAALYWYR | | 41637 |
| HPV31 | E1 | 185 | 8 | AAMLGKFK | | 41638 |
| HPV31 | E1 | 185 | 11 | AAMLGKFKELY | | 41639 |
| HPV31 | E1 | 371 | 10 | AFLKSNSQAK | | 41640 |
| HPV31 | E1 | 550 | 9 | AGKDDRWPY | | 41641 |
| HPV31 | E1 | 550 | 11 | AGKDDRWPYLH | | 41642 |
| HPV31 | E1 | 111 | 9 | AICIENNSK | | 41643 |
| HPV31 | E1 | 68 | 11 | ALFHAQEAEEH | | 41644 |
| HPV31 | E1 | 439 | 11 | ALKLFLKGVPK | | 41645 |
| HPV31 | E1 | 186 | 10 | AMLGKFKELY | | 41646 |
| HPV31 | E1 | 504 | 8 | ATTPCWHY | | 41647 |
| HPV31 | E1 | 81 | 8 | AVQVLKRK | | 41648 |
| HPV31 | E1 | 81 | 9 | AVQVLKRKY | | 41649 |
| HPV31 | E1 | 370 | 11 | CAFLKSNSQAK | | 41650 |
| HPV31 | E1 | 263 | 10 | CAKNRITIEK | | 41651 |
| HPV31 | E1 | 410 | 11 | CDKVSDEGDWR | | 41652 |
| HPV31 | E1 | 385 | 8 | CGTMCRHY | | 41653 |
| HPV31 | E1 | 385 | 9 | CGTMCRHYK | | 41654 |
| HPV31 | E1 | 385 | 10 | CGTMCRHYKR | | 41655 |
| HPV31 | E1 | 113 | 10 | CIENNSKTAK | | 41656 |
| HPV31 | E1 | 113 | 11 | CIENNSKTAKR | | 41657 |
| HPV31 | E1 | 477 | 9 | CIISYANSK | | 41658 |
| HPV31 | E1 | 477 | 11 | CIISYANSKSH | | 41659 |
| HPV31 | E1 | 284 | 8 | CMLIQPPK | | 41660 |
| HPV31 | E1 | 284 | 10 | CMLIQPPKLR | | 41661 |
| HPV31 | E1 | 155 | 8 | CNGSDGTH | | 41662 |
| HPV31 | E1 | 155 | 11 | CNGSDGTHSER | | 41663 |
| HPV31 | E1 | 100 | 9 | CVDYNISPR | | 41664 |
| HPV31 | E1 | 100 | 11 | CVDYNISPRLK | | 41665 |
| HPV31 | E1 | 620 | 8 | CVSGQNIR | | 41666 |
| HPV31 | E1 | 503 | 8 | DATTPCWH | | 41667 |
| HPV31 | E1 | 503 | 9 | DATTPCWHY | | 41668 |
| HPV31 | E1 | 384 | 8 | DCGTMCRH | | 41669 |
| HPV31 | E1 | 384 | 9 | DCGTMCRHY | | 41670 |
| HPV31 | E1 | 384 | 10 | DCGTMCRHYK | | 41671 |
| HPV31 | E1 | 384 | 11 | DCGTMCRHYKR | | 41672 |
| HPV31 | E1 | 502 | 9 | DDATTPCWH | | 41673 |
| HPV31 | E1 | 502 | 10 | DDATTPCWHY | | 41674 |
| HPV31 | E1 | 553 | 8 | DDRWPYLH | | 41675 |
| HPV31 | E1 | 553 | 10 | DDRWPYLHSR | | 41676 |
| HPV31 | E1 | 351 | 8 | DDSEIAYK | | 41677 |
| HPV31 | E1 | 351 | 9 | DDSEIAYKY | | 41678 |
| HPV31 | E1 | 49 | 9 | DFIDNCNVY | | 41679 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV31 | E1 | 611 | 9 | DGDSFSTFK | | 41680 |
| HPV31 | E1 | 521 | 10 | DGNPVSIDVK | | 41681 |
| HPV31 | E1 | 521 | 11 | DGNPVSIDVKH | | 41682 |
| HPV31 | E1 | 96 | 8 | DISSCVDY | | 41683 |
| HPV31 | E1 | 421 | 8 | DIVKFLRY | | 41684 |
| HPV31 | E1 | 336 | 10 | DLSQMVQWAY | | 41685 |
| HPV31 | E1 | 364 | 11 | DSDSNACAFLK | | 41686 |
| HPV31 | E1 | 352 | 8 | DSEIAYKY | | 41687 |
| HPV31 | E1 | 366 | 9 | DSNACAFLK | | 41688 |
| HPV31 | E1 | 528 | 11 | DVKHKALMQLK | | 41689 |
| HPV31 | E1 | 348 | 10 | DVMDDSEIAY | | 41690 |
| HPV31 | E1 | 348 | 11 | DVMDDSEIAYK | | 41691 |
| HPV31 | E1 | 62 | 10 | EAETAQALFH | | 41692 |
| HPV31 | E1 | 80 | 8 | EAVQVLKR | | 41693 |
| HPV31 | E1 | 80 | 9 | EAVQVLKRK | | 41694 |
| HPV31 | E1 | 80 | 10 | EAVQVLKRKY | | 41695 |
| HPV31 | E1 | 432 | 10 | EFVSFLSALK | | 41696 |
| HPV31 | E1 | 416 | 9 | EGDWRDIVK | | 41697 |
| HPV31 | E1 | 229 | 10 | EGFKTLLQPY | | 41698 |
| HPV31 | E1 | 10 | 10 | EGTGCNGWFY | 0.0002 | 41699 |
| HPV31 | E1 | 201 | 10 | ELIRPFQSNK | | 41700 |
| HPV31 | E1 | 583 | 8 | ELSDKNWK | | 41701 |
| HPV31 | E1 | 609 | 11 | ENDGDSFSTFK | | 41702 |
| HPV31 | E1 | 115 | 8 | ENNSKTAK | | 41703 |
| HPV31 | E1 | 115 | 9 | ENNSKTAKR | | 41704 |
| HPV31 | E1 | 115 | 10 | ENNSKTAKRR | | 41705 |
| HPV31 | E1 | 64 | 8 | ETAQALFH | | 41706 |
| HPV31 | E1 | 315 | 8 | ETPEWIER | | 41707 |
| HPV31 | E1 | 574 | 9 | FDKNGNPVY | | 41708 |
| HPV31 | E1 | 335 | 11 | FDLSQMVQWAY | | 41709 |
| HPV31 | E1 | 592 | 8 | FFSRTWCR | | 41710 |
| HPV31 | E1 | 50 | 8 | FIDNCNVY | | 41711 |
| HPV31 | E1 | 443 | 8 | FLKGVPKK | | 41712 |
| HPV31 | E1 | 372 | 9 | FLKSNSQAK | 0.0002 | 41713 |
| HPV31 | E1 | 473 | 9 | FLQGCIISY | | 41714 |
| HPV31 | E1 | 436 | 10 | FLSALKLFLK | | 41715 |
| HPV31 | E1 | 593 | 11 | FSRTWCRLNLH | | 41716 |
| HPV31 | E1 | 566 | 11 | FTFPNPFPFDK | | 41717 |
| HPV31 | E1 | 433 | 9 | FVSFLSALK | | 41718 |
| HPV31 | E1 | 457 | 9 | GAPNTGKSY | | 41719 |
| HPV31 | E1 | 476 | 10 | GCIISYANSK | | 41720 |
| HPV31 | E1 | 612 | 8 | GDSFSTFK | | 41721 |
| HPV31 | E1 | 417 | 8 | GDWRDIVK | | 41722 |
| HPV31 | E1 | 417 | 11 | GDWRDIVKFLR | | 41723 |
| HPV31 | E1 | 230 | 9 | GFKTLLQPY | | 41724 |
| HPV31 | E1 | 305 | 9 | GMSNISDVY | | 41725 |
| HPV31 | E1 | 252 | 9 | GMVMLMLVR | | 41726 |
| HPV31 | E1 | 252 | 11 | GMVMLMLVRFK | | 41727 |
| HPV31 | E1 | 522 | 9 | GNPVSIDVK | | 41728 |
| HPV31 | E1 | 522 | 10 | GNPVSIDVKH | | 41729 |
| HPV31 | E1 | 522 | 11 | GNPVSIDVKHK | | 41730 |
| HPV31 | E1 | 578 | 10 | GNPVYELSDK | | 41731 |
| HPV31 | E1 | 157 | 9 | GSDGTHSER | | 41732 |
| HPV31 | E1 | 11 | 9 | GTGCNGWFY | 0.0720 | 41733 |
| HPV31 | E1 | 386 | 8 | GTMCRHYK | | 41734 |
| HPV31 | E1 | 386 | 9 | GTMCRHYKR | | 41735 |
| HPV31 | E1 | 225 | 8 | GTVAEGFK | | 41736 |
| HPV31 | E1 | 446 | 11 | GVPKKNCILIH | | 41737 |
| HPV31 | E1 | 196 | 9 | GVSFMELIR | | 41738 |
| HPV31 | E1 | 222 | 11 | GVTGTVAEGFK | | 41739 |
| HPV31 | E1 | 78 | 9 | HAEAVQVLK | | 41740 |
| HPV31 | E1 | 78 | 10 | HAEAVQVLKR | | 41741 |
| HPV31 | E1 | 78 | 11 | HAEAVQVLKRK | | 41742 |
| HPV31 | E1 | 71 | 8 | HAQEAEEH | | 41743 |
| HPV31 | E1 | 487 | 11 | HFWLQPLADAK | | 41744 |
| HPV31 | E1 | 456 | 8 | HGAPNTGK | | 41745 |
| HPV31 | E1 | 456 | 10 | HGAPNTGKSY | | 41746 |
| HPV31 | E1 | 162 | 11 | HSERENETPTR | | 41747 |
| HPV31 | E1 | 112 | 8 | ICIENNSK | | 41748 |
| HPV31 | E1 | 112 | 11 | ICIENNSKTAK | | 41749 |
| HPV31 | E1 | 478 | 8 | IISYANSK | | 41750 |
| HPV31 | E1 | 478 | 10 | IISYANSKSH | | 41751 |
| HPV31 | E1 | 453 | 11 | ILIHGAPNTGK | | 41752 |
| HPV31 | E1 | 174 | 11 | ILQVLKTSNGK | | 41753 |
| HPV31 | E1 | 548 | 8 | INAGKDDR | | 41754 |

TABLE XVII-continued

A11 Motif Peptides

| Type | Protein | Position | No. of Amino Acids | Sequence | A*1101 | Seq. Id. No. |
|---|---|---|---|---|---|---|
| HPV31 | E1 | 548 | 11 | INAGKDDRWPY | | 41755 |
| HPV31 | E1 | 471 | 11 | ISFLQGCIISY | | 41756 |
| HPV31 | E1 | 479 | 9 | ISYANSKSH | | 41757 |
| HPV31 | E1 | 268 | 9 | ITIEKLLEK | | 41758 |
| HPV31 | E1 | 544 | 9 | ITSNINAGK | | 41759 |
| HPV31 | E1 | 381 | 10 | IVKDCGTMCR | | 41760 |
| HPV31 | E1 | 381 | 11 | IVKDCGTMCRH | | 41761 |
| HPV31 | E1 | 184 | 9 | KAAMLGKFK | | 41762 |
| HPV31 | E1 | 110 | 10 | KAICIENNSK | | 41763 |
| HPV31 | E1 | 262 | 11 | KCAKNRITIEK | | 41764 |
| HPV31 | E1 | 619 | 9 | KCVSGQNIR | | 41765 |
| HPV31 | E1 | 383 | 8 | KDCGTMCR | | 41766 |
| HPV31 | E1 | 383 | 9 | KDCGTMCRH | | 41767 |
| HPV31 | E1 | 383 | 10 | KDCGTMCRHY | | 41768 |
| HPV31 | E1 | 383 | 11 | KDCGTMCRHYK | | 41769 |
| HPV31 | E1 | 552 | 9 | KDDRWPYLH | | 41770 |
| HPV31 | E1 | 552 | 11 | KDDRWPYLHSR | | 41771 |
| HPV31 | E1 | 380 | 11 | KIVKDCGTMCR | | 41772 |
| HPV31 | E1 | 441 | 9 | KLFLKGVPK | | 41773 |
| HPV31 | E1 | 441 | 10 | KLFLKGVPKK | | 41774 |
| HPV31 | E1 | 291 | 10 | KLRSTAAALY | | 41775 |
| HPV31 | E1 | 265 | 8 | KNRITIEK | | 41776 |
| HPV31 | E1 | 587 | 9 | KNWKSFFSR | | 41777 |
| HPV31 | E1 | 590 | 10 | KSFFSRTWCR | | 41778 |
| HPV31 | E1 | 374 | 10 | KSNSQAKIVK | | 41779 |
| HPV31 | E1 | 232 | 10 | KTLLQPYCLY | | 41780 |
| HPV31 | E1 | 412 | 9 | KVSDEGDWR | | 41781 |
| HPV31 | E1 | 501 | 10 | LDDATTPCWH | | 41782 |
| HPV31 | E1 | 501 | 11 | LDDATTPCWHY | | 41783 |
| HPV31 | E1 | 520 | 11 | LDGNPVSIDVK | | 41784 |
| HPV31 | E1 | 125 | 9 | LFELPDSGY | | 41785 |
| HPV31 | E1 | 69 | 10 | LFHAQEAEEH | | 41786 |
| HPV31 | E1 | 442 | 8 | LFLKGVPK | | 41787 |
| HPV31 | E1 | 442 | 9 | LFLKGVPKK | | 41788 |
| HPV31 | E1 | 188 | 8 | LGKFKELY | | 41789 |
| HPV31 | E1 | 454 | 10 | LIHGAPNTGK | | 41790 |
| HPV31 | E1 | 286 | 8 | LIQPPKLR | | 41791 |
| HPV31 | E1 | 202 | 9 | LIRPFQSNK | | 41792 |
| HPV31 | E1 | 543 | 10 | LITSNINAGK | | 41793 |
| HPV31 | E1 | 542 | 11 | LLITSNINAGK | | 41794 |
| HPV31 | E1 | 234 | 8 | LLQPYCLY | | 41795 |
| HPV31 | E1 | 234 | 10 | LLQPYCLYCH | | 41796 |
| HPV31 | E1 | 256 | 10 | LMLVRFKCAK | | 41797 |
| HPV31 | E1 | 600 | 9 | LNLHEEEDK | | 41798 |
| HPV31 | E1 | 437 | 9 | LSALKLFLK | | 41799 |
| HPV31 | E1 | 153 | 10 | LSCNGSDGTH | | 41800 |
| HPV31 | E1 | 94 | 10 | LSDISSCVDY | | 41801 |
| HPV31 | E1 | 337 | 9 | LSQMVQWAY | | 41802 |
| HPV31 | E1 | 258 | 8 | LVRFKCAK | | 41803 |
| HPV31 | E1 | 258 | 10 | LVRFKCAKNR | | 41804 |
| HPV31 | E1 | 388 | 10 | MCRHYKRAEK | | 41805 |
| HPV31 | E1 | 388 | 11 | MCRHYKRAEKR | | 41806 |
| HPV31 | E1 | 350 | 8 | MDDSEIAY | | 41807 |
| HPV31 | E1 | 350 | 9 | MDDSEIAYK | | 41808 |
| HPV31 | E1 | 350 | 10 | MDDSEIAYKY | | 41809 |
| HPV31 | E1 | 402 | 8 | MGQWIKSR | | 41810 |
| HPV31 | E1 | 402 | 11 | MGQWIKSRCDK | | 41811 |
| HPV31 | E1 | 500 | 11 | MLDDATTPCWH | | 41812 |
| HPV31 | E1 | 187 | 9 | MLGKFKELY | | 41813 |
| HPV31 | E1 | 285 | 9 | MLIQPPKLR | 0.0014 | 41814 |
| HPV31 | E1 | 255 | 8 | MLMLVRFK | | 41815 |
| HPV31 | E1 | 255 | 11 | MLMLVRFKCAK | | 41816 |
| HPV31 | E1 | 257 | 9 | MLVRFKCAK | | 41817 |
| HPV31 | E1 | 257 | 11 | MLVRFKCAKNR | | 41818 |
| HPV31 | E1 | 400 | 8 | MSMGQWIK | | 41819 |
| HPV31 | E1 | 400 | 10 | MSMGQWIKSR | | 41820 |
| HPV31 | E1 | 306 | 8 | MSNISDVY | | 41821 |
| HPV31 | E1 | 47 | 11 | MVDFIDNCNVY | | 41822 |
| HPV31 | E1 | 253 | 8 | MVMLMLVR | | 41823 |
| HPV31 | E1 | 253 | 10 | MVMLMLVRFK | | 41824 |
| HPV31 | E1 | 549 | 10 | NAGKDDRWPY | | 41825 |
| HPV31 | E1 | 283 | 9 | NCMLIQPPK | | 41826 |
| HPV31 | E1 | 283 | 11 | NCMLIQPPKLR | | 41827 |
| HPV31 | E1 | 610 | 10 | NDGDSFSTFK | | 41828 |
| HPV31 | E1 | 347 | 11 | NDVMDDSEIAY | | 41829 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV31 | E1 | 182 | 9 | NGKAAMLGK | | 41830 |
| HPV31 | E1 | 182 | 11 | NGKAAMLGKFK | | 41831 |
| HPV31 | E1 | 577 | 11 | NGNPVYELSDK | | 41832 |
| HPV31 | E1 | 156 | 10 | NGSDGTHSER | | 41833 |
| HPV31 | E1 | 547 | 9 | NINAGKDDR | | 41834 |
| HPV31 | E1 | 601 | 8 | NLHEEEDK | | 41835 |
| HPV31 | E1 | 116 | 8 | NNSKTAKR | | 41836 |
| HPV31 | E1 | 116 | 9 | NNSKTAKRR | | 41837 |
| HPV31 | E1 | 117 | 8 | NSKTAKRR | | 41838 |
| HPV31 | E1 | 376 | 8 | NSQAKIVK | | 41839 |
| HPV31 | E1 | 507 | 9 | PCWHYIDNY | | 41840 |
| HPV31 | E1 | 507 | 11 | PCWHYIDNYLR | | 41841 |
| HPV31 | E1 | 573 | 10 | PFDKNGNPVY | | 41842 |
| HPV31 | E1 | 93 | 11 | PLSDISSCVDY | | 41843 |
| HPV31 | E1 | 569 | 8 | PNPFPFDK | | 41844 |
| HPV31 | E1 | 170 | 10 | PTRNILQVLK | | 41845 |
| HPV31 | E1 | 524 | 8 | PVSIDVKH | | 41846 |
| HPV31 | E1 | 524 | 9 | PVSIDVKHK | | 41847 |
| HPV31 | E1 | 580 | 8 | PVYELSDK | | 41848 |
| HPV31 | E1 | 580 | 11 | PVYELSDKNWK | | 41849 |
| HPV31 | E1 | 475 | 11 | QGCIISYANSK | | 41850 |
| HPV31 | E1 | 399 | 9 | QMSMGQWIK | | 41851 |
| HPV31 | E1 | 399 | 11 | QMSMGQWIKSR | | 41852 |
| HPV31 | E1 | 176 | 9 | QVLKTSNGK | | 41853 |
| HPV31 | E1 | 420 | 8 | RDIVKFLR | | 41854 |
| HPV31 | E1 | 420 | 9 | RDIVKFLRY | | 41855 |
| HPV31 | E1 | 260 | 8 | RFKCAKNR | | 41856 |
| HPV31 | E1 | 267 | 10 | RITIEKLLEK | | 41857 |
| HPV31 | E1 | 124 | 10 | RLFELPDSGY | | 41858 |
| HPV31 | E1 | 599 | 10 | RLNHEEEDK | | 41859 |
| HPV31 | E1 | 172 | 8 | RNILQVLK | | 41860 |
| HPV31 | E1 | 293 | 8 | RSTAAALY | | 41861 |
| HPV31 | E1 | 293 | 10 | RSTAAALYWY | | 41862 |
| HPV31 | E1 | 293 | 11 | RSTAAALYWYR | | 41863 |
| HPV31 | E1 | 303 | 11 | RTGMSNISDVY | | 41864 |
| HPV31 | E1 | 595 | 9 | RTWCRLNLH | | 41865 |
| HPV31 | E1 | 438 | 8 | SALKLFLK | | 41866 |
| HPV31 | E1 | 154 | 9 | SCNGSDGTH | | 41867 |
| HPV31 | E1 | 99 | 10 | SCVDYNISPR | | 41868 |
| HPV31 | E1 | 414 | 11 | SDEGDWRDIVK | | 41869 |
| HPV31 | E1 | 158 | 8 | SDGTHSER | | 41870 |
| HPV31 | E1 | 95 | 9 | SDISSCVDY | | 41871 |
| HPV31 | E1 | 585 | 11 | SDKNWKSFFSR | | 41872 |
| HPV31 | E1 | 365 | 10 | SDSNACAFLK | | 41873 |
| HPV31 | E1 | 591 | 9 | SFFSRTWCR | | 41874 |
| HPV31 | E1 | 472 | 10 | SFLQGCIISY | | 41875 |
| HPV31 | E1 | 435 | 11 | SFLSALKLFLK | | 41876 |
| HPV31 | E1 | 401 | 9 | SMGQWIKSR | | 41877 |
| HPV31 | E1 | 367 | 8 | SNACAFLK | | 41878 |
| HPV31 | E1 | 181 | 10 | SNGKAAMLGK | | 41879 |
| HPV31 | E1 | 546 | 10 | SNINAGKDDR | | 41880 |
| HPV31 | E1 | 375 | 9 | SNSQAKIVK | | 41881 |
| HPV31 | E1 | 98 | 11 | SSCVDYNISPR | | 41882 |
| HPV31 | E1 | 294 | 9 | STAAALYWY | | 41883 |
| HPV31 | E1 | 294 | 10 | STAAALYWYR | | 41884 |
| HPV31 | E1 | 281 | 11 | STNCMLIQPPK | | 41885 |
| HPV31 | E1 | 295 | 8 | TAAALYWY | | 41886 |
| HPV31 | E1 | 295 | 9 | TAAALYWYR | | 41887 |
| HPV31 | E1 | 617 | 11 | TFKCVSGQNIR | | 41888 |
| HPV31 | E1 | 567 | 10 | TFPNPFPFDK | | 41889 |
| HPV31 | E1 | 12 | 8 | TGCNGWFY | | 41890 |
| HPV31 | E1 | 304 | 10 | TGMSNISDVY | | 41891 |
| HPV31 | E1 | 224 | 9 | TGTVAEGFK | | 41892 |
| HPV31 | E1 | 269 | 8 | TIEKLLEK | | 41893 |
| HPV31 | E1 | 233 | 9 | TLLQPYCLY | | 41894 |
| HPV31 | E1 | 233 | 11 | TLLQPYCLYCH | | 41895 |
| HPV31 | E1 | 152 | 11 | TLSCNGSDGTH | | 41896 |
| HPV31 | E1 | 387 | 8 | TMCRHYKR | | 41897 |
| HPV31 | E1 | 387 | 11 | TMCRHYKRAEK | | 41898 |
| HPV31 | E1 | 282 | 10 | TNCMLIQPPK | | 41899 |
| HPV31 | E1 | 180 | 11 | TSNGKAAMLGK | | 41900 |
| HPV31 | E1 | 545 | 8 | TSNINAGK | | 41901 |
| HPV31 | E1 | 545 | 11 | TSNINAGKDDR | | 41902 |
| HPV31 | E1 | 505 | 11 | TTPCWHYIDNY | | 41903 |
| HPV31 | E1 | 48 | 10 | VDFIDNCNVY | | 41904 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV31 | E1 | 101 | 8 | VDYNISPR | | 41905 |
| HPV31 | E1 | 101 | 10 | VDYNISPRLK | | 41906 |
| HPV31 | E1 | 177 | 8 | VLKTSNGK | | 41907 |
| HPV31 | E1 | 349 | 9 | VMDDSEIAY | | 41908 |
| HPV31 | E1 | 349 | 10 | VMDDSEIAYK | | 41909 |
| HPV31 | E1 | 349 | 11 | VMDDSEIAYKY | | 41910 |
| HPV31 | E1 | 254 | 9 | VMLMLVRFK | | 41911 |
| HPV31 | E1 | 413 | 8 | VSDEGDWR | | 41912 |
| HPV31 | E1 | 434 | 8 | VSFLSALK | | 41913 |
| HPV31 | E1 | 197 | 8 | VSFMELIR | | 41914 |
| HPV31 | E1 | 525 | 8 | VSIDVKHK | | 41915 |
| HPV31 | E1 | 223 | 10 | VTGTVAEGFK | | 41916 |
| HPV31 | E1 | 17 | 10 | WFYVEAVIDR | | 41917 |
| HPV31 | E1 | 251 | 10 | WGMVMLMLVR | | 41918 |
| HPV31 | E1 | 319 | 10 | WIERQTVLQH | | 41919 |
| HPV31 | E1 | 405 | 8 | WIKSRCDK | | 41920 |
| HPV31 | E1 | 489 | 9 | WLQPLADAK | 0.0002 | 41921 |
| HPV31 | E1 | 313 | 10 | YGETPEWIER | | 41922 |
| HPV31 | E1 | 195 | 10 | YGVSFMELIR | | 41923 |
| HPV31 | E1 | 103 | 8 | YNISPRLK | | 41924 |
| HPV31 | E1 | 19 | 8 | YVEAVIDR | | 41925 |
| HPV31 | E2 | 277 | 9 | AAAQACTNQTR | | 41926 |
| HPV31 | E2 | 278 | 8 | AACTNQTR | | 41927 |
| HPV31 | E2 | 229 | 9 | ALGTSEGVR | | 41928 |
| HPV31 | E2 | 229 | 10 | ALGTSEGVRR | | 41929 |
| HPV31 | E2 | 61 | 8 | ALSVSKAK | | 41930 |
| HPV31 | E2 | 302 | 8 | ANILKCLR | | 41931 |
| HPV31 | E2 | 302 | 9 | ANILKCLRY | | 41932 |
| HPV31 | E2 | 302 | 10 | ANILKCLRYR | | 41933 |
| HPV31 | E2 | 217 | 10 | ANNTTTSNSK | | 41934 |
| HPV31 | E2 | 291 | 9 | ATTPIIHLK | | 41935 |
| HPV31 | E2 | 239 | 9 | ATTSTKRPR | | 41936 |
| HPV31 | E2 | 228 | 10 | CALGTSEGVR | | 41937 |
| HPV31 | E2 | 228 | 11 | CALGTSEGVRR | | 41938 |
| HPV31 | E2 | 27 | 8 | CDHIDYWK | | 41939 |
| HPV31 | E2 | 27 | 9 | CDHIDYWKH | | 41940 |
| HPV31 | E2 | 27 | 11 | CDHIDYWKHIR | | 41941 |
| HPV31 | E2 | 307 | 8 | CLRYRLSK | | 41942 |
| HPV31 | E2 | 307 | 9 | CLRYRLSKY | | 41943 |
| HPV31 | E2 | 307 | 10 | CLRYRLSKYK | | 41944 |
| HPV31 | E2 | 145 | 11 | CTVVEGQVNCK | | 41945 |
| HPV31 | E2 | 40 | 8 | CVLMYKAR | | 41946 |
| HPV31 | E2 | 301 | 9 | DANILKCLR | | 41947 |
| HPV31 | E2 | 301 | 10 | DANILKCLRY | | 41948 |
| HPV31 | E2 | 301 | 11 | DANILKCLRYR | | 41949 |
| HPV31 | E2 | 351 | 8 | DDFLNTVK | | 41950 |
| HPV31 | E2 | 122 | 9 | DGDVHNTMH | | 41951 |
| HPV31 | E2 | 122 | 10 | DGDVHNTMHY | | 41952 |
| HPV31 | E2 | 22 | 8 | DSKRLCDH | | 41953 |
| HPV31 | E2 | 22 | 11 | DSKRLCDHIDY | | 41954 |
| HPV31 | E2 | 124 | 8 | DVHNTMHY | | 41955 |
| HPV31 | E2 | 174 | 9 | EAKKYGTGK | | 41956 |
| HPV31 | E2 | 174 | 10 | EAKKYGTGKK | | 41957 |
| HPV31 | E2 | 39 | 9 | ECVLMYKAR | | 41958 |
| HPV31 | E2 | 149 | 10 | EGQVNCKGIY | | 41959 |
| HPV31 | E2 | 149 | 11 | EGQVNCKGIYY | | 41960 |
| HPV31 | E2 | 234 | 11 | EGVRRATTSTK | | 41961 |
| HPV31 | E2 | 204 | 10 | EISFAGIVTK | | 41962 |
| HPV31 | E2 | 48 | 9 | EMGIHSINH | | 41963 |
| HPV31 | E2 | 20 | 10 | ENDSKRLCDH | | 41964 |
| HPV31 | E2 | 80 | 8 | ETLNNTEY | | 41965 |
| HPV31 | E2 | 80 | 9 | ETLNNTEYK | | 41966 |
| HPV31 | E2 | 118 | 9 | EVQFDGDVH | | 41967 |
| HPV31 | E2 | 121 | 10 | FDGDVHNTMH | | 41968 |
| HPV31 | E2 | 121 | 11 | FDGDVHNTMHY | | 41969 |
| HPV31 | E2 | 171 | 8 | FTEEAKKY | | 41970 |
| HPV31 | E2 | 168 | 9 | FVNFTEEAK | | 41971 |
| HPV31 | E2 | 168 | 10 | FVNFTEEAKK | | 41972 |
| HPV31 | E2 | 168 | 11 | FVNFTEEAKKY | | 41973 |
| HPV31 | E2 | 108 | 8 | GCLKKHGY | | 41974 |
| HPV31 | E2 | 300 | 10 | GDANILKCLR | | 41975 |
| HPV31 | E2 | 300 | 11 | GDANILKCLRY | | 41976 |
| HPV31 | E2 | 123 | 8 | GDVHNTMH | | 41977 |
| HPV31 | E2 | 123 | 9 | GDVHNTMHY | | 41978 |
| HPV31 | E2 | 156 | 9 | GIYYVHEGH | | 41979 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV31 | E2 | 179 | 9 | GTGKKWEVH | | 41980 |
| HPV31 | E2 | 231 | 8 | GTSEGVRR | | 41981 |
| HPV31 | E2 | 235 | 10 | GVRRATTSTK | | 41982 |
| HPV31 | E2 | 235 | 11 | GVRRATTSTKR | | 41983 |
| HPV31 | E2 | 29 | 9 | HIDYWKHIR | | 41984 |
| HPV31 | E2 | 35 | 10 | HIRLECVLMY | | 41985 |
| HPV31 | E2 | 35 | 11 | HIRLECVLMYK | | 41986 |
| HPV31 | E2 | 297 | 10 | HLKGDANILK | | 41987 |
| HPV31 | E2 | 126 | 10 | HNTMHYTNWK | | 41988 |
| HPV31 | E2 | 30 | 8 | IDYWKHIR | | 41989 |
| HPV31 | E2 | 15 | 10 | ILEHYENDSK | | 41990 |
| HPV31 | E2 | 15 | 11 | ILEHYENDSKR | | 41991 |
| HPV31 | E2 | 304 | 8 | ILKCLRYR | | 41992 |
| HPV31 | E2 | 304 | 11 | ILKCLRYRLSK | | 41993 |
| HPV31 | E2 | 275 | 11 | ISAAACTNQTR | | 41994 |
| HPV31 | E2 | 205 | 9 | ISFAGIVTK | | 41995 |
| HPV31 | E2 | 45 | 8 | KAREMGIH | | 41996 |
| HPV31 | E2 | 306 | 9 | KCLRYRLSK | | 41997 |
| HPV31 | E2 | 306 | 10 | KCLRYRLSKY | | 41998 |
| HPV31 | E2 | 306 | 11 | KCLRYRLSKYK | | 41999 |
| HPV31 | E2 | 299 | 8 | KGDANILK | | 42000 |
| HPV31 | E2 | 299 | 11 | KGDANILKCLR | | 42001 |
| HPV31 | E2 | 155 | 10 | KGIYYVHEGH | | 42002 |
| HPV31 | E2 | 14 | 11 | KILEHYENDSK | | 42003 |
| HPV31 | E2 | 336 | 9 | KNAIVTLTY | | 42004 |
| HPV31 | E2 | 26 | 9 | LCDHIDYWK | | 42005 |
| HPV31 | E2 | 26 | 10 | LCDHIDYWKH | | 42006 |
| HPV31 | E2 | 230 | 8 | LGTSEGVR | | 42007 |
| HPV31 | E2 | 230 | 9 | LGTSEGVRR | | 42008 |
| HPV31 | E2 | 42 | 11 | LMYKAREMGIH | | 42009 |
| HPV31 | E2 | 8 | 11 | LNVCQDKILEH | | 42010 |
| HPV31 | E2 | 312 | 8 | LSKYKQLY | | 42011 |
| HPV31 | E2 | 4 | 11 | LSQRLNVCQDK | | 42012 |
| HPV31 | E2 | 103 | 9 | LTAPTGCLK | | 42013 |
| HPV31 | E2 | 103 | 10 | LTAPTGCLKK | | 42014 |
| HPV31 | E2 | 103 | 11 | LTAPTGCLKKH | | 42015 |
| HPV31 | E2 | 342 | 9 | LTYISTSQR | | 42016 |
| HPV31 | E2 | 49 | 8 | MGIHSINH | | 42017 |
| HPV31 | E2 | 78 | 10 | MLETLNNTEY | | 42018 |
| HPV31 | E2 | 78 | 11 | MLETLNNTEYK | | 42019 |
| HPV31 | E2 | 77 | 11 | MMLETLNNTEY | | 42020 |
| HPV31 | E2 | 337 | 8 | NAIVTLTY | | 42021 |
| HPV31 | E2 | 153 | 9 | NCKGIYYVH | | 42022 |
| HPV31 | E2 | 21 | 9 | NDSKRLCDH | | 42023 |
| HPV31 | E2 | 170 | 8 | NFTEEAKK | | 42024 |
| HPV31 | E2 | 170 | 9 | NFTEEAKKY | | 42025 |
| HPV31 | E2 | 303 | 8 | NILKCLRY | | 42026 |
| HPV31 | E2 | 303 | 9 | NILKCLRYR | | 42027 |
| HPV31 | E2 | 218 | 9 | NNTTTSNSK | | 42028 |
| HPV31 | E2 | 254 | 10 | NTHHPNKLLR | | 42029 |
| HPV31 | E2 | 127 | 9 | NTMHYTNWK | | 42030 |
| HPV31 | E2 | 219 | 8 | NTTTSNSK | | 42031 |
| HPV31 | E2 | 361 | 9 | NTVSVSTGY | | 42032 |
| HPV31 | E2 | 9 | 10 | NVCQDKILEH | | 42033 |
| HPV31 | E2 | 9 | 11 | NVCQDKILEHY | | 42034 |
| HPV31 | E2 | 60 | 9 | PALSVSKAK | | 42035 |
| HPV31 | E2 | 290 | 8 | PATTPIIH | | 42036 |
| HPV31 | E2 | 290 | 10 | PATTPIIHLK | | 42037 |
| HPV31 | E2 | 360 | 10 | PNTVSVSTGY | | 42038 |
| HPV31 | E2 | 106 | 8 | PTGCLKKH | | 42039 |
| HPV31 | E2 | 106 | 10 | PTGCLKKHGY | | 42040 |
| HPV31 | E2 | 12 | 8 | QDKILEHY | | 42041 |
| HPV31 | E2 | 120 | 11 | QFDGDVHNTMH | | 42042 |
| HPV31 | E2 | 317 | 11 | QLYEQVSSTWH | | 42043 |
| HPV31 | E2 | 151 | 8 | QVNCKGIY | | 42044 |
| HPV31 | E2 | 151 | 9 | QVNCKGIYY | | 42045 |
| HPV31 | E2 | 151 | 11 | QVNCKGIYYVH | | 42046 |
| HPV31 | E2 | 57 | 10 | QVVPALSVSK | | 42047 |
| HPV31 | E2 | 238 | 8 | RATTSTKR | | 42048 |
| HPV31 | E2 | 238 | 10 | RATTSTKRPR | | 42049 |
| HPV31 | E2 | 350 | 9 | RDDFLNTVK | | 42050 |
| HPV31 | E2 | 25 | 8 | RLCDHIDY | | 42051 |
| HPV31 | E2 | 25 | 10 | RLCDHIDYWK | | 42052 |
| HPV31 | E2 | 25 | 11 | RLCDHIDYWKH | | 42053 |
| HPV31 | E2 | 37 | 8 | RLECVLMY | | 42054 |

TABLE XVII-continued

A11 Motif Peptides

| Type | Protein | Position | No. of Amino Acids | Sequence | A*1101 | Seq. Id. No. |
|---|---|---|---|---|---|---|
| HPV31 | E2 | 37 | 9 | RLECVLMYK | | 42055 |
| HPV31 | E2 | 37 | 11 | RLECVLMYKAR | | 42056 |
| HPV31 | E2 | 7 | 8 | RLNVCQDK | | 42057 |
| HPV31 | E2 | 311 | 9 | RLSKYKQLY | | 42058 |
| HPV31 | E2 | 253 | 8 | RNTHHPNK | | 42059 |
| HPV31 | E2 | 253 | 11 | RNTHHPNKLLR | | 42060 |
| HPV31 | E2 | 247 | 10 | RTEPEHRNTH | | 42061 |
| HPV31 | E2 | 247 | 11 | RTEPEHRNTHH | | 42062 |
| HPV31 | E2 | 276 | 10 | SAAACTNQTR | | 42063 |
| HPV31 | E2 | 288 | 10 | SCPATTPIIH | | 42064 |
| HPV31 | E2 | 206 | 8 | SFAGIVTK | | 42065 |
| HPV31 | E2 | 242 | 11 | STKRPRTEPEH | | 42066 |
| HPV31 | E2 | 324 | 11 | STWHWTCTDGK | | 42067 |
| HPV31 | E2 | 216 | 11 | TANNTTTSNSK | | 42068 |
| HPV31 | E2 | 104 | 8 | TAPTGCLK | | 42069 |
| HPV31 | E2 | 104 | 9 | TAPTGCLKK | | 42070 |
| HPV31 | E2 | 104 | 10 | TAPTGCLKKH | | 42071 |
| HPV31 | E2 | 227 | 11 | TCALGTSEGVR | | 42072 |
| HPV31 | E2 | 329 | 8 | TCTDGKHK | | 42073 |
| HPV31 | E2 | 107 | 9 | TGCLKKHGY | | 42074 |
| HPV31 | E2 | 180 | 8 | TGKKWEVH | | 42075 |
| HPV31 | E2 | 81 | 8 | TLNNTEYK | | 42076 |
| HPV31 | E2 | 341 | 10 | TLTYISTSQR | | 42077 |
| HPV31 | E2 | 128 | 8 | TMHYTNWK | | 42078 |
| HPV31 | E2 | 128 | 11 | TMHYTNWKFIY | | 42079 |
| HPV31 | E2 | 93 | 10 | TMQQTSLELY | | 42080 |
| HPV31 | E2 | 292 | 8 | TTPIIHLK | | 42081 |
| HPV31 | E2 | 240 | 8 | TTSTKRPR | | 42082 |
| HPV31 | E2 | 116 | 11 | TVEVQFDGDVH | | 42083 |
| HPV31 | E2 | 362 | 8 | TVSVSTGY | | 42084 |
| HPV31 | E2 | 146 | 10 | TVVEGQVNCK | | 42085 |
| HPV31 | E2 | 10 | 9 | VCQDKILEH | | 42086 |
| HPV31 | E2 | 10 | 10 | VCQDKILEHY | | 42087 |
| HPV31 | E2 | 152 | 8 | VNCKGIYY | | 42088 |
| HPV31 | E2 | 152 | 10 | VNCKGIYYVH | | 42089 |
| HPV31 | E2 | 169 | 8 | VNFTEEAK | | 42090 |
| HPV31 | E2 | 169 | 9 | VNFTEEAKK | | 42091 |
| HPV31 | E2 | 169 | 10 | VNFTEEAKKY | | 42092 |
| HPV31 | E2 | 287 | 11 | VSCPATTPIIH | | 42093 |
| HPV31 | E2 | 340 | 11 | VTLTYISTSQR | | 42094 |
| HPV31 | E2 | 147 | 9 | VVEGQVNCK | | 42095 |
| HPV31 | E2 | 58 | 9 | VVPALSVSK | | 42096 |
| HPV31 | E2 | 58 | 11 | VVPALSVSKAK | | 42097 |
| HPV31 | E2 | 328 | 8 | WTCTDGKH | | 42098 |
| HPV31 | E2 | 328 | 9 | WTCTDGKHK | | 42099 |
| HPV31 | E2 | 92 | 11 | WTMQQTSLELY | | 42100 |
| HPV31 | E2 | 167 | 10 | YFVNFTEEAK | | 42101 |
| HPV31 | E2 | 167 | 11 | YFVNFTEEAKK | | 42102 |
| HPV31 | E2 | 178 | 10 | YGTGKKWEVH | | 42103 |
| HPV31 | E2 | 102 | 10 | YLTAPTGCLK | | 42104 |
| HPV31 | E2 | 102 | 11 | YLTAPTGCLKK | | 42105 |
| HPV31 | E2 | 131 | 8 | YTNWKFIY | | 42106 |
| HPV31 | E2 | 159 | 9 | YVHEGHITY | | 42107 |
| HPV31 | E5 | 53 | 11 | ATSPLRCFCIY | | 42108 |
| HPV31 | E5 | 59 | 10 | CFCIYVVFIY | | 42109 |
| HPV31 | E5 | 61 | 8 | CIYVVFIY | | 42110 |
| HPV31 | E5 | 20 | 11 | CVLLFVCLVIR | | 42111 |
| HPV31 | E5 | 60 | 9 | FCIYVVFIY | | 42112 |
| HPV31 | E5 | 66 | 10 | FIYIPLFVIH | | 42113 |
| HPV31 | E5 | 48 | 11 | ILWVIATSPLR | | 42114 |
| HPV31 | E5 | 23 | 8 | LFVCLVIR | | 42115 |
| HPV31 | E5 | 22 | 9 | LLFVCLVIR | | 42116 |
| HPV31 | E5 | 32 | 8 | LVLSVSVY | | 42117 |
| HPV31 | E5 | 70 | 8 | PLFVIHTH | | 42118 |
| HPV31 | E5 | 56 | 8 | PLRCFCIY | | 42119 |
| HPV31 | E5 | 31 | 9 | PLVLSVSVY | | 42120 |
| HPV31 | E5 | 58 | 11 | RCFCIYVVFIY | | 42121 |
| HPV31 | E5 | 54 | 10 | TSPLRCFCIY | | 42122 |
| HPV31 | E5 | 65 | 11 | VFIYIPLFVIH | | 42123 |
| HPV31 | E5 | 51 | 8 | VIATSPLR | | 42124 |
| HPV31 | E5 | 21 | 10 | VLLFVCLVIR | | 42125 |
| HPV31 | E5 | 50 | 9 | WVIATSPLR | | 42126 |
| HPV31 | E5 | 68 | 8 | YIPLFVIH | | 42127 |
| HPV31 | E5 | 68 | 10 | YIPLFVIHTH | | 42128 |
| HPV31 | E6 | 46 | 9 | AFTDLTIVY | | 42129 |

TABLE XVII-continued

A11 Motif Peptides

| Type | Protein | Position | No. of Amino Acids | Sequence | A*1101 | Seq. Id. No. |
|---|---|---|---|---|---|---|
| HPV31 | E6 | 46 | 10 | AFTDLTIVYR | | 42130 |
| HPV31 | E6 | 18 | 10 | ALEIPYDELR | | 42131 |
| HPV31 | E6 | 136 | 9 | CIACWRRPR | | 42132 |
| HPV31 | E6 | 63 | 8 | CTKCLRFY | | 42133 |
| HPV31 | E6 | 63 | 10 | CTKCLRFYSK | | 42134 |
| HPV31 | E6 | 56 | 10 | DDTPHGVCTK | | 42135 |
| HPV31 | E6 | 44 | 11 | DFAFTDLTIVY | | 42136 |
| HPV31 | E6 | 98 | 11 | DLLIRCITCQR | | 42137 |
| HPV31 | E6 | 57 | 9 | DTPHGVCTK | | 42138 |
| HPV31 | E6 | 75 | 10 | EFRWYRYSVY | | 42139 |
| HPV31 | E6 | 20 | 8 | EIPYDELR | | 42140 |
| HPV31 | E6 | 25 | 8 | ELRLNCVY | | 42141 |
| HPV31 | E6 | 25 | 10 | ELRLNCVYCK | | 42142 |
| HPV31 | E6 | 14 | 10 | ELSSALEIPY | | 42143 |
| HPV31 | E6 | 45 | 10 | FAFTDLTIVY | | 42144 |
| HPV31 | E6 | 45 | 11 | FAFTDLTIVYR | | 42145 |
| HPV31 | E6 | 47 | 8 | FTDLTIVY | | 42146 |
| HPV31 | E6 | 47 | 9 | FTDLTIVYR | | 42147 |
| HPV31 | E6 | 95 | 8 | GICDLLIR | | 42148 |
| HPV31 | E6 | 85 | 10 | GTTLEKLTNK | | 42149 |
| HPV31 | E6 | 61 | 8 | GVCTKCLR | | 42150 |
| HPV31 | E6 | 61 | 10 | GVCTKCLRFY | | 42151 |
| HPV31 | E6 | 60 | 9 | HGVCTKCLR | | 42152 |
| HPV31 | E6 | 60 | 11 | HGVCTKCLRFY | | 42153 |
| HPV31 | E6 | 118 | 9 | HLDKKKRFH | | 42154 |
| HPV31 | E6 | 126 | 10 | HNIGGRWTGR | | 42155 |
| HPV31 | E6 | 137 | 8 | IACWRRPR | | 42156 |
| HPV31 | E6 | 128 | 8 | IGGRWTGR | | 42157 |
| HPV31 | E6 | 52 | 9 | IVYRDDTPH | | 42158 |
| HPV31 | E6 | 65 | 8 | KCLRFYSK | | 42159 |
| HPV31 | E6 | 94 | 9 | KGICDLLIR | | 42160 |
| HPV31 | E6 | 3 | 8 | KNPAERPR | | 42161 |
| HPV31 | E6 | 3 | 9 | KNPAERPRK | | 42162 |
| HPV31 | E6 | 3 | 11 | KNPAERPRKLH | | 42163 |
| HPV31 | E6 | 72 | 8 | KVSEFRWY | | 42164 |
| HPV31 | E6 | 72 | 9 | KVSEFRWYR | | 42165 |
| HPV31 | E6 | 72 | 10 | KVSEFRWYRY | | 42166 |
| HPV31 | E6 | 110 | 8 | LCPEEKQR | | 42167 |
| HPV31 | E6 | 110 | 9 | LCPEEKQRH | 0.0001 | 42168 |
| HPV31 | E6 | 119 | 8 | LDKKKRFH | | 42169 |
| HPV31 | E6 | 100 | 9 | LIRCITCQR | | 42170 |
| HPV31 | E6 | 99 | 10 | LLIRCITCQR | | 42171 |
| HPV31 | E6 | 15 | 9 | LSSALEIPY | | 42172 |
| HPV31 | E6 | 50 | 11 | LTIVYRDDTPH | | 42173 |
| HPV31 | E6 | 1 | 8 | MFKNPAER | | 42174 |
| HPV31 | E6 | 1 | 10 | MFKNPAERPR | | 42175 |
| HPV31 | E6 | 1 | 11 | MFKNPAERPRK | | 42176 |
| HPV31 | E6 | 127 | 9 | NIGGRWTGR | | 42177 |
| HPV31 | E6 | 5 | 9 | PAERPRKLH | | 42178 |
| HPV31 | E6 | 109 | 9 | PLCPEEKQR | 0.0005 | 42179 |
| HPV31 | E6 | 109 | 10 | PLCPEEKQRH | | 42180 |
| HPV31 | E6 | 135 | 8 | RCIACWRR | | 42181 |
| HPV31 | E6 | 135 | 10 | RCIACWRRPR | | 42182 |
| HPV31 | E6 | 55 | 11 | RDDTPHGVCTK | | 42183 |
| HPV31 | E6 | 124 | 8 | RFHNIGGR | | 42184 |
| HPV31 | E6 | 68 | 10 | RFYSKVSEFR | | 42185 |
| HPV31 | E6 | 27 | 8 | RLNCVYCK | | 42186 |
| HPV31 | E6 | 17 | 11 | SALEIPYDELR | | 42187 |
| HPV31 | E6 | 16 | 8 | SSALEIPY | | 42188 |
| HPV31 | E6 | 82 | 9 | SVYGTTLEK | | 42189 |
| HPV31 | E6 | 105 | 11 | TCQRPLCPEEK | | 42190 |
| HPV31 | E6 | 48 | 8 | TDLTIVYR | | 42191 |
| HPV31 | E6 | 133 | 9 | TGRCIACWR | | 42192 |
| HPV31 | E6 | 133 | 10 | TGRCIACWRR | | 42193 |
| HPV31 | E6 | 51 | 10 | TIVYRDDTPH | | 42194 |
| HPV31 | E6 | 87 | 8 | TLEKLTNK | | 42195 |
| HPV31 | E6 | 92 | 11 | TNKGICDLLIR | | 42196 |
| HPV31 | E6 | 86 | 9 | TTLEKLTNK | | 42197 |
| HPV31 | E6 | 62 | 9 | VCTKCLRFY | | 42198 |
| HPV31 | E6 | 62 | 11 | VCTKCLRFYSK | | 42199 |
| HPV31 | E6 | 73 | 8 | VSEFRWYR | | 42200 |
| HPV31 | E6 | 73 | 9 | VSEFRWYRY | | 42201 |
| HPV31 | E6 | 132 | 10 | WTGRCIACWR | | 42202 |
| HPV31 | E6 | 132 | 11 | WTGRCIACWRR | | 42203 |
| HPV31 | E6 | 23 | 10 | YDELRLNCVY | | 42204 |

TABLE XVII-continued

A11 Motif Peptides

| Type | Protein | Position | No. of Amino Acids | Sequence | A*1101 | Seq. Id. No. |
|---|---|---|---|---|---|---|
| HPV31 | E6 | 84 | 11 | YGTTLEKLTNK | | 42205 |
| HPV31 | E6 | 70 | 8 | YSKVSEFR | | 42206 |
| HPV31 | E6 | 70 | 10 | YSKVSEFRWY | | 42207 |
| HPV31 | E6 | 70 | 11 | YSKVSEFRWYR | | 42208 |
| HPV31 | E6 | 81 | 10 | YSVYGTTLEK | | 42209 |
| HPV31 | E7 | 42 | 11 | AGQAEPDTSNY | | 42210 |
| HPV31 | E7 | 58 | 9 | CCQCKSTLR | | 42211 |
| HPV31 | E7 | 68 | 10 | CVQSTQVDIR | | 42212 |
| HPV31 | E7 | 14 | 10 | DLQPEATDLH | | 42213 |
| HPV31 | E7 | 18 | 8 | EATDLHCY | | 42214 |
| HPV31 | E7 | 4 | 8 | ETPTLQDY | | 42215 |
| HPV31 | E7 | 57 | 10 | FCCQCKSTLR | | 42216 |
| HPV31 | E7 | 87 | 11 | FGIVCPNCSTR | | 42217 |
| HPV31 | E7 | 88 | 10 | GIVCPNCSTR | | 42218 |
| HPV31 | E7 | 89 | 9 | IVCPNCSTR | | 42219 |
| HPV31 | E7 | 54 | 9 | IVTFCCQCK | | 42220 |
| HPV31 | E7 | 67 | 11 | LCVQSTQVDIR | | 42221 |
| HPV31 | E7 | 13 | 11 | LDLQPEATDLH | | 42222 |
| HPV31 | E7 | 53 | 10 | NIVTFCCQCK | | 42223 |
| HPV31 | E7 | 44 | 9 | QAEPDTSNY | | 42224 |
| HPV31 | E7 | 70 | 8 | QSTQVDIR | | 42225 |
| HPV31 | E7 | 2 | 10 | RGETPTLQDY | | 42226 |
| HPV31 | E7 | 56 | 11 | TFCCQCKSTLR | | 42227 |
| HPV31 | E7 | 90 | 8 | VCPNCSTR | | 42228 |
| HPV31 | E7 | 55 | 8 | VTFCCQCK | | 42229 |
| HPV31 | E7 | 52 | 11 | YNIVTFCCQCK | | 42230 |
| HPV31 | L1 | 347 | 11 | AAIANSDTTFK | | 42231 |
| HPV31 | L1 | 102 | 9 | ACVGLEVGR | | 42232 |
| HPV31 | L1 | 386 | 8 | ADIMTYIH | | 42233 |
| HPV31 | L1 | 458 | 10 | ADLDQFPLGR | | 42234 |
| HPV31 | L1 | 458 | 11 | ADLDQFPLGRK | | 42235 |
| HPV31 | L1 | 137 | 9 | AGGPGTDNR | | 42236 |
| HPV31 | L1 | 37 | 11 | AGSARLLTVGH | | 42237 |
| HPV31 | L1 | 473 | 8 | AGYRARPK | | 42238 |
| HPV31 | L1 | 473 | 10 | AGYRARPKFK | | 42239 |
| HPV31 | L1 | 348 | 10 | AIANSDTTFK | | 42240 |
| HPV31 | L1 | 426 | 11 | AITCQKTAPQK | | 42241 |
| HPV31 | L1 | 208 | 11 | AMDFTALQDTK | | 42242 |
| HPV31 | L1 | 350 | 8 | ANSDTTFK | | 42243 |
| HPV31 | L1 | 491 | 8 | ASTTTPAK | | 42244 |
| HPV31 | L1 | 491 | 9 | ASTTTPAKR | | 42245 |
| HPV31 | L1 | 491 | 10 | ASTTTPAKRK | | 42246 |
| HPV31 | L1 | 491 | 11 | ASTTTPAKRKK | | 42247 |
| HPV31 | L1 | 285 | 8 | ATLANSTY | | 42248 |
| HPV31 | L1 | 226 | 10 | CNSICKYPDY | | 42249 |
| HPV31 | L1 | 103 | 8 | CVGLEVGR | | 42250 |
| HPV31 | L1 | 304 | 9 | DAQIFNKPY | | 42251 |
| HPV31 | L1 | 185 | 8 | DCPPLELK | | 42252 |
| HPV31 | L1 | 128 | 8 | DDTENSNR | | 42253 |
| HPV31 | L1 | 128 | 9 | DDTENSNRY | | 42254 |
| HPV31 | L1 | 210 | 9 | DFTALQDTK | | 42255 |
| HPV31 | L1 | 224 | 8 | DICNSICK | | 42256 |
| HPV31 | L1 | 224 | 9 | DICNSICKY | | 42257 |
| HPV31 | L1 | 459 | 9 | DLDQFPLGR | | 42258 |
| HPV31 | L1 | 459 | 10 | DLDQFPLGRK | | 42259 |
| HPV31 | L1 | 372 | 10 | DLQFIFQLCK | | 42260 |
| HPV31 | L1 | 56 | 10 | DNPKKIVVPK | | 42261 |
| HPV31 | L1 | 143 | 10 | DNRECISMDY | | 42262 |
| HPV31 | L1 | 143 | 11 | DNRECISMDYK | | 42263 |
| HPV31 | L1 | 129 | 8 | DTENSNRY | | 42264 |
| HPV31 | L1 | 245 | 8 | DTLFFYLR | | 42265 |
| HPV31 | L1 | 245 | 9 | DTLFFYLRR | | 42266 |
| HPV31 | L1 | 88 | 11 | DTSFYNPETQR | | 42267 |
| HPV31 | L1 | 353 | 10 | DTTFKSSNFK | | 42268 |
| HPV31 | L1 | 146 | 8 | ECISMDYK | | 42269 |
| HPV31 | L1 | 270 | 8 | ESVPTDLY | | 42270 |
| HPV31 | L1 | 270 | 10 | ESVPTDLYIK | | 42271 |
| HPV31 | L1 | 127 | 9 | FDDTENSNR | | 42272 |
| HPV31 | L1 | 127 | 10 | FDDTENSNRY | | 42273 |
| HPV31 | L1 | 371 | 11 | FDLQFIFQLCK | | 42274 |
| HPV31 | L1 | 84 | 9 | FGFPDTSFY | | 42275 |
| HPV31 | L1 | 469 | 8 | FLLQAGYR | | 42276 |
| HPV31 | L1 | 469 | 10 | FLLQAGYRAR | | 42277 |
| HPV31 | L1 | 308 | 9 | FNKPYWMQR | | 42278 |
| HPV31 | L1 | 211 | 8 | FTALQDTK | | 42279 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV31 | L1 | 257 | 8 | FVRHFFNR | | 42280 |
| HPV31 | L1 | 421 | 11 | FVTSQAITCQK | | 42281 |
| HPV31 | L1 | 331 | 9 | FVTVVDTTR | | 42282 |
| HPV31 | L1 | 161 | 9 | GCKPPIGEH | | 42283 |
| HPV31 | L1 | 184 | 9 | GDCPPLELK | | 42284 |
| HPV31 | L1 | 244 | 9 | GDTLFFYLR | | 42285 |
| HPV31 | L1 | 244 | 10 | GDTLFFYLRR | | 42286 |
| HPV31 | L1 | 85 | 8 | GFPDTSFY | | 42287 |
| HPV31 | L1 | 138 | 8 | GGPGTDNR | | 42288 |
| HPV31 | L1 | 117 | 10 | GISGHPLLNK | | 42289 |
| HPV31 | L1 | 68 | 8 | GLQYRVFR | | 42290 |
| HPV31 | L1 | 68 | 10 | GLQYRVFRVR | | 42291 |
| HPV31 | L1 | 38 | 10 | GSARLLTVGH | | 42292 |
| HPV31 | L1 | 413 | 8 | GSLEDTYR | | 42293 |
| HPV31 | L1 | 282 | 11 | GSTATLANSTY | | 42294 |
| HPV31 | L1 | 349 | 9 | IANSDTTFK | | 42295 |
| HPV31 | L1 | 229 | 9 | ICKYPDYLK | | 42296 |
| HPV31 | L1 | 225 | 8 | ICNSICKY | | 42297 |
| HPV31 | L1 | 225 | 11 | ICNSICKYPDY | | 42298 |
| HPV31 | L1 | 307 | 10 | IFNKPYWMQR | | 42299 |
| HPV31 | L1 | 118 | 9 | ISGHPLLNK | | 42300 |
| HPV31 | L1 | 427 | 10 | ITCQKTAPQK | | 42301 |
| HPV31 | L1 | 382 | 10 | ITLSADIMTY | | 42302 |
| HPV31 | L1 | 61 | 11 | IVVPKVSGLQY | | 42303 |
| HPV31 | L1 | 443 | 11 | KDYVFWEVNLK | | 42304 |
| HPV31 | L1 | 126 | 10 | KFDDTENSNR | | 42305 |
| HPV31 | L1 | 126 | 11 | KFDDTENSNRY | | 42306 |
| HPV31 | L1 | 83 | 10 | KFGFPDTSFY | | 42307 |
| HPV31 | L1 | 468 | 8 | KFLLQAGY | | 42308 |
| HPV31 | L1 | 468 | 9 | KFLLQAGYR | | 42309 |
| HPV31 | L1 | 468 | 11 | KFLLQAGYRAR | | 42310 |
| HPV31 | L1 | 381 | 11 | KITLSADIMTY | | 42311 |
| HPV31 | L1 | 357 | 8 | KSSNFKEY | | 42312 |
| HPV31 | L1 | 357 | 10 | KSSNFKEYLR | | 42313 |
| HPV31 | L1 | 357 | 11 | KSSNFKEYLRH | | 42314 |
| HPV31 | L1 | 431 | 8 | KTAPQKPK | | 42315 |
| HPV31 | L1 | 65 | 8 | KVSGLQYR | | 42316 |
| HPV31 | L1 | 65 | 11 | KVSGLQYRVFR | | 42317 |
| HPV31 | L1 | 20 | 8 | KVVSTDEY | | 42318 |
| HPV31 | L1 | 20 | 11 | KVVSTDEYVTR | | 42319 |
| HPV31 | L1 | 223 | 9 | LDICNSICK | | 42320 |
| HPV31 | L1 | 223 | 10 | LDICNSICKY | | 42321 |
| HPV31 | L1 | 460 | 8 | LDQFPLGR | | 42322 |
| HPV31 | L1 | 460 | 9 | LDQFPLGRK | | 42323 |
| HPV31 | L1 | 330 | 10 | LFVTVVDTTR | | 42324 |
| HPV31 | L1 | 160 | 10 | LGCKPPIGEH | | 42325 |
| HPV31 | L1 | 465 | 11 | LGRKFLLQAGY | | 42326 |
| HPV31 | L1 | 114 | 8 | LGVGISGH | | 42327 |
| HPV31 | L1 | 159 | 11 | LLGCKPPIGEH | | 42328 |
| HPV31 | L1 | 470 | 9 | LLQAGYRAR | | 42329 |
| HPV31 | L1 | 470 | 11 | LLQAGYRARPK | | 42330 |
| HPV31 | L1 | 42 | 8 | LLTVGHPY | | 42331 |
| HPV31 | L1 | 42 | 9 | LLTVGHPYY | | 42332 |
| HPV31 | L1 | 384 | 8 | LSADIMTY | | 42333 |
| HPV31 | L1 | 384 | 10 | LSADIMTYIH | | 42334 |
| HPV31 | L1 | 43 | 8 | LTVGHPYY | | 42335 |
| HPV31 | L1 | 209 | 10 | MDFTALQDTK | | 42336 |
| HPV31 | L1 | 256 | 9 | MFVRHFFNR | | 42337 |
| HPV31 | L1 | 300 | 11 | MVTSDAQIFNK | | 42338 |
| HPV31 | L1 | 360 | 8 | NFKEYLRH | | 42339 |
| HPV31 | L1 | 32 | 10 | NIYYHAGSAR | | 42340 |
| HPV31 | L1 | 227 | 9 | NSICKYPDY | | 42341 |
| HPV31 | L1 | 227 | 11 | NSICKYPDYLK | | 42342 |
| HPV31 | L1 | 496 | 8 | PAKRKKTK | | 42343 |
| HPV31 | L1 | 496 | 9 | PAKRKKTKK | | 42344 |
| HPV31 | L1 | 233 | 11 | PDYLKMVAEPY | | 42345 |
| HPV31 | L1 | 183 | 10 | PGDCPPLELK | | 42346 |
| HPV31 | L1 | 165 | 8 | PIGEHWGK | | 42347 |
| HPV31 | L1 | 222 | 10 | PLDICNSICK | | 42348 |
| HPV31 | L1 | 222 | 11 | PLDICNSICKY | | 42349 |
| HPV31 | L1 | 113 | 9 | PLGVGISGH | | 42350 |
| HPV31 | L1 | 489 | 10 | PSASTTTPAK | | 42351 |
| HPV31 | L1 | 489 | 11 | PSASTTTPAKR | | 42352 |
| HPV31 | L1 | 411 | 9 | PSGSLEDTY | | 42353 |
| HPV31 | L1 | 411 | 10 | PSGSLEDTYR | | 42354 |

TABLE XVII-continued

A11 Motif Peptides

| Type | Protein | Position | No. of Amino Acids | Sequence | A*1101 | Seq. Id. No. |
|---|---|---|---|---|---|---|
| HPV31 | L1 | 17 | 11 | PVSKVVSTDEY | | 42355 |
| HPV31 | L1 | 472 | 9 | QAGYRARPK | | 42356 |
| HPV31 | L1 | 472 | 11 | QAGYRARPKFK | | 42357 |
| HPV31 | L1 | 374 | 8 | QFIFQLCK | | 42358 |
| HPV31 | L1 | 306 | 11 | QIFNKPYWMQR | | 42359 |
| HPV31 | L1 | 156 | 8 | QLCLLGCK | | 42360 |
| HPV31 | L1 | 329 | 11 | QLFVTVVDTTR | | 42361 |
| HPV31 | L1 | 255 | 10 | QMFVRHFFNR | | 42362 |
| HPV31 | L1 | 154 | 10 | QTQLCLLGCK | | 42363 |
| HPV31 | L1 | 476 | 10 | RARPKFKAGK | | 42364 |
| HPV31 | L1 | 476 | 11 | RARPKFKAGKR | | 42365 |
| HPV31 | L1 | 41 | 9 | RLLTVGHPY | | 42366 |
| HPV31 | L1 | 41 | 10 | RLLTVGHPYY | | 42367 |
| HPV31 | L1 | 75 | 9 | RVRLPDPNK | | 42368 |
| HPV31 | L1 | 385 | 9 | SADIMTYIH | | 42369 |
| HPV31 | L1 | 457 | 11 | SADLDQFPLGR | | 42370 |
| HPV31 | L1 | 39 | 9 | SARLLTVGH | | 42371 |
| HPV31 | L1 | 39 | 11 | SARLLTVGHPY | | 42372 |
| HPV31 | L1 | 490 | 9 | SASTTTPAK | | 42373 |
| HPV31 | L1 | 490 | 10 | SASTTTPAKR | | 42374 |
| HPV31 | L1 | 490 | 11 | SASTTTPAKRK | | 42375 |
| HPV31 | L1 | 303 | 8 | SDAQIFNK | | 42376 |
| HPV31 | L1 | 303 | 10 | SDAQIFNKPY | | 42377 |
| HPV31 | L1 | 55 | 11 | SDNPKKIVVPK | | 42378 |
| HPV31 | L1 | 352 | 11 | SDTTFKSSNFK | | 42379 |
| HPV31 | L1 | 90 | 9 | SFYNPETQR | | 42380 |
| HPV31 | L1 | 119 | 8 | SGHPLLNK | | 42381 |
| HPV31 | L1 | 67 | 9 | SGLQYRVFR | | 42382 |
| HPV31 | L1 | 67 | 11 | SGLQYRVFRVR | | 42383 |
| HPV31 | L1 | 412 | 8 | SGSLEDTY | | 42384 |
| HPV31 | L1 | 412 | 9 | SGSLEDTYR | | 42385 |
| HPV31 | L1 | 228 | 8 | SICKYPDY | | 42386 |
| HPV31 | L1 | 228 | 10 | SICKYPDYLK | | 42387 |
| HPV31 | L1 | 51 | 9 | SIPKSDNPK | | 42388 |
| HPV31 | L1 | 51 | 10 | SIPKSDNPKK | | 42389 |
| HPV31 | L1 | 2 | 11 | SLWRPSEATVY | | 42390 |
| HPV31 | L1 | 359 | 8 | SNFKEYLR | | 42391 |
| HPV31 | L1 | 359 | 9 | SNFKEYLRH | | 42392 |
| HPV31 | L1 | 358 | 9 | SSNFKEYLR | | 42393 |
| HPV31 | L1 | 358 | 10 | SSNFKEYLRH | | 42394 |
| HPV31 | L1 | 283 | 10 | STATLANSTY | | 42395 |
| HPV31 | L1 | 23 | 8 | STDEYVTR | | 42396 |
| HPV31 | L1 | 492 | 8 | STTTPAKR | | 42397 |
| HPV31 | L1 | 492 | 9 | STTTPAKRK | | 42398 |
| HPV31 | L1 | 492 | 10 | STTTPAKRKK | | 42399 |
| HPV31 | L1 | 271 | 9 | SVPTDLYIK | | 42400 |
| HPV31 | L1 | 284 | 9 | TATLANSTY | | 42401 |
| HPV31 | L1 | 428 | 9 | TCQKTAPQK | | 42402 |
| HPV31 | L1 | 428 | 11 | TCQKTAPQKPK | | 42403 |
| HPV31 | L1 | 24 | 11 | TDEYVTRTNIY | | 42404 |
| HPV31 | L1 | 142 | 11 | TDNRECISMDY | | 42405 |
| HPV31 | L1 | 355 | 8 | TFKSSNFK | | 42406 |
| HPV31 | L1 | 355 | 10 | TFKSSNFKEY | | 42407 |
| HPV31 | L1 | 246 | 8 | TLFFYLRR | | 42408 |
| HPV31 | L1 | 383 | 9 | TLSADIMTY | | 42409 |
| HPV31 | L1 | 383 | 11 | TLSADIMTYIH | | 42410 |
| HPV31 | L1 | 31 | 11 | TNIYYHAGSAR | | 42411 |
| HPV31 | L1 | 302 | 9 | TSDAQIFNK | | 42412 |
| HPV31 | L1 | 302 | 11 | TSDAQIFNKPY | | 42413 |
| HPV31 | L1 | 89 | 10 | TSFYNPETQR | | 42414 |
| HPV31 | L1 | 423 | 9 | TSQAITCQK | | 42415 |
| HPV31 | L1 | 354 | 9 | TTFKSSNFK | | 42416 |
| HPV31 | L1 | 354 | 11 | TTFKSSNFKEY | | 42417 |
| HPV31 | L1 | 494 | 8 | TTAPKRKK | | 42418 |
| HPV31 | L1 | 494 | 10 | TTAPKRKKTK | | 42419 |
| HPV31 | L1 | 494 | 11 | TTAPKRKKTKK | | 42420 |
| HPV31 | L1 | 493 | 8 | TTTPAKRK | | 42421 |
| HPV31 | L1 | 493 | 9 | TTTPAKRKK | | 42422 |
| HPV31 | L1 | 493 | 11 | TTTPAKRKKTK | | 42423 |
| HPV31 | L1 | 267 | 11 | TVGESVPTDLY | | 42424 |
| HPV31 | L1 | 44 | 11 | TVGHPYYSIPK | | 42425 |
| HPV31 | L1 | 10 | 11 | TVYLPPVPVSK | | 42426 |
| HPV31 | L1 | 73 | 11 | VFRVRLPDPNK | | 42427 |
| HPV31 | L1 | 446 | 8 | VFWEVNLK | | 42428 |
| HPV31 | L1 | 446 | 10 | VFWEVNLKEK | | 42429 |

TABLE XVII-continued

A11 Motif Peptides

| Type | Protein | Position | No. of Amino Acids | Sequence | A*1101 | Seq. Id. No. |
|---|---|---|---|---|---|---|
| HPV31 | L1 | 268 | 10 | VGESVPTDLY | | 42430 |
| HPV31 | L1 | 45 | 10 | VGHPYYSIPK | | 42431 |
| HPV31 | L1 | 116 | 11 | VGISGHPLLNK | | 42432 |
| HPV31 | L1 | 66 | 10 | VSGLQYRVFR | | 42433 |
| HPV31 | L1 | 18 | 10 | VSKVVSTDEY | | 42434 |
| HPV31 | L1 | 22 | 9 | VSTDEYVTR | | 42435 |
| HPV31 | L1 | 28 | 8 | VTRTNIYY | | 42436 |
| HPV31 | L1 | 28 | 9 | VTRTNIYYH | | 42437 |
| HPV31 | L1 | 301 | 10 | VTSDAQIFNK | | 42438 |
| HPV31 | L1 | 422 | 10 | VTSQAITCQK | | 42439 |
| HPV31 | L1 | 332 | 8 | VTVVDTTR | | 42440 |
| HPV31 | L1 | 62 | 10 | VVPKVSGLQY | | 42441 |
| HPV31 | L1 | 62 | 11 | VVPKVSGLQYR | | 42442 |
| HPV31 | L1 | 21 | 10 | VVSTDEYVTR | | 42443 |
| HPV31 | L1 | 101 | 10 | WACVGLEVGR | | 42444 |
| HPV31 | L1 | 313 | 8 | WMQRAQGH | | 42445 |
| HPV31 | L1 | 136 | 10 | YAGGPGTDNR | | 42446 |
| HPV31 | L1 | 243 | 8 | YGDTLFFY | | 42447 |
| HPV31 | L1 | 243 | 10 | YGDTLFFYLR | | 42448 |
| HPV31 | L1 | 243 | 11 | YGDTLFFYLRR | | 42449 |
| HPV31 | L1 | 235 | 9 | YLKMVAEPY | | 42450 |
| HPV31 | L1 | 12 | 9 | YLPPVPVSK | | 42451 |
| HPV31 | L1 | 250 | 10 | YLRREQMFVR | | 42452 |
| HPV31 | L1 | 250 | 11 | YLRREQMFVRH | | 42453 |
| HPV31 | L1 | 50 | 10 | YSIPKSDNPK | | 42454 |
| HPV31 | L1 | 50 | 11 | YSIPKSDNPKK | | 42455 |
| HPV31 | L1 | 445 | 9 | YVFWEVNLK | | 42456 |
| HPV31 | L1 | 445 | 11 | YVFWEVNLKEK | | 42457 |
| HPV31 | L1 | 27 | 8 | YVTRTNIY | | 42458 |
| HPV31 | L1 | 27 | 9 | YVTRTNIYY | | 42459 |
| HPV31 | L1 | 27 | 10 | YVTRTNIYYH | | 42460 |
| HPV31 | L2 | 25 | 11 | AGTCPSDVIPK | | 42461 |
| HPV31 | L2 | 143 | 11 | AILDVTSVSTH | | 42462 |
| HPV31 | L2 | 281 | 10 | ALHRPALTSR | | 42463 |
| HPV31 | L2 | 281 | 11 | ALHRPALTSRR | | 42464 |
| HPV31 | L2 | 286 | 10 | ALTSRRNTVR | | 42465 |
| HPV31 | L2 | 286 | 11 | ALTSRRNTVRY | | 42466 |
| HPV31 | L2 | 13 | 11 | ASATQLYQTCK | | 42467 |
| HPV31 | L2 | 311 | 8 | ATIGARVH | | 42468 |
| HPV31 | L2 | 311 | 9 | ATIGARVHY | | 42469 |
| HPV31 | L2 | 311 | 10 | ATIGARVHYY | | 42470 |
| HPV31 | L2 | 311 | 11 | ATIGARVHYYY | | 42471 |
| HPV31 | L2 | 15 | 9 | ATQLYQTCK | | 42472 |
| HPV31 | L2 | 376 | 11 | AVQSTSAVSAY | | 42473 |
| HPV31 | L2 | 275 | 9 | DFLDIIALH | | 42474 |
| HPV31 | L2 | 275 | 10 | DFLDIIALHR | | 42475 |
| HPV31 | L2 | 360 | 10 | DFTVDTPATH | | 42476 |
| HPV31 | L2 | 438 | 8 | DFYLHPSY | | 42477 |
| HPV31 | L2 | 438 | 9 | DFYLHPSYY | | 42478 |
| HPV31 | L2 | 435 | 8 | DGGDFYLH | | 42479 |
| HPV31 | L2 | 435 | 11 | DGGDFYLHPSY | | 42480 |
| HPV31 | L2 | 116 | 10 | DVGAPAPIPH | | 42481 |
| HPV31 | L2 | 31 | 8 | DVIPKIEH | | 42482 |
| HPV31 | L2 | 146 | 8 | DVTSVSTH | | 42483 |
| HPV31 | L2 | 259 | 10 | ESLYFSNTSH | | 42484 |
| HPV31 | L2 | 253 | 10 | ETVNAEESLY | | 42485 |
| HPV31 | L2 | 276 | 8 | FLDIIALH | | 42486 |
| HPV31 | L2 | 276 | 9 | FLDIIALHR | | 42487 |
| HPV31 | L2 | 237 | 11 | FLSAPKQLITY | | 42488 |
| HPV31 | L2 | 404 | 10 | FSGPDVPIEH | | 42489 |
| HPV31 | L2 | 361 | 9 | FTVDTPATH | | 42490 |
| HPV31 | L2 | 433 | 8 | FVDGGDFY | | 42491 |
| HPV31 | L2 | 433 | 10 | FVDGGDFYLH | | 42492 |
| HPV31 | L2 | 118 | 8 | GAPAPIPH | | 42493 |
| HPV31 | L2 | 314 | 8 | GARVHYYY | | 42494 |
| HPV31 | L2 | 310 | 9 | GATIGARVH | | 42495 |
| HPV31 | L2 | 310 | 10 | GATIGARVHY | | 42496 |
| HPV31 | L2 | 310 | 11 | GATIGARVHYY | | 42497 |
| HPV31 | L2 | 437 | 9 | GDFYLHPSY | | 42498 |
| HPV31 | L2 | 437 | 10 | GDFYLHPSYY | | 42499 |
| HPV31 | L2 | 436 | 10 | GGDFYLHPSY | | 42500 |
| HPV31 | L2 | 436 | 11 | GGDFYLHPSYY | | 42501 |
| HPV31 | L2 | 59 | 11 | GIGSGSGTGGR | | 42502 |
| HPV31 | L2 | 221 | 11 | GLYSKATQQVK | | 42503 |
| HPV31 | L2 | 300 | 9 | GNKQTLRTR | | 42504 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV31 | L2 | 61 | 9 | GSGSGTGGR | | 42505 |
| HPV31 | L2 | 63 | 10 | GSGTGGRTGY | | 42506 |
| HPV31 | L2 | 26 | 10 | GTCPSDVIPK | | 42507 |
| HPV31 | L2 | 65 | 8 | GTGGRTGY | | 42508 |
| HPV31 | L2 | 213 | 11 | GVRRPARLGLY | | 42509 |
| HPV31 | L2 | 38 | 10 | HTTIADQILR | | 42510 |
| HPV31 | L2 | 38 | 11 | HTTIADQILRY | | 42511 |
| HPV31 | L2 | 41 | 8 | IADQILRY | | 42512 |
| HPV31 | L2 | 280 | 11 | IALHRPALTSR | | 42513 |
| HPV31 | L2 | 233 | 10 | IDPTFLSAPK | | 42514 |
| HPV31 | L2 | 403 | 11 | IFSGPDVPIEH | | 42515 |
| HPV31 | L2 | 432 | 9 | IFVDGGDFY | | 42516 |
| HPV31 | L2 | 432 | 11 | IFVDGGDFYLH | | 42517 |
| HPV31 | L2 | 313 | 8 | IGARVHYY | | 42518 |
| HPV31 | L2 | 313 | 9 | IGARVHYYY | | 42519 |
| HPV31 | L2 | 60 | 10 | IGSGSGTGGR | | 42520 |
| HPV31 | L2 | 144 | 10 | ILDVTSVSTH | | 42521 |
| HPV31 | L2 | 205 | 11 | ITSSTPIPGVR | | 42522 |
| HPV31 | L2 | 245 | 8 | ITYENPAY | | 42523 |
| HPV31 | L2 | 277 | 8 | LDIIALHR | | 42524 |
| HPV31 | L2 | 145 | 9 | LDVTSVSTH | | 42525 |
| HPV31 | L2 | 299 | 8 | LGNKQTLR | | 42526 |
| HPV31 | L2 | 299 | 10 | LGNKQTLRTR | | 42527 |
| HPV31 | L2 | 244 | 9 | LITYENPAY | | 42528 |
| HPV31 | L2 | 176 | 11 | LLLSSSSISTH | | 42529 |
| HPV31 | L2 | 177 | 10 | LLSSSSISTH | | 42530 |
| HPV31 | L2 | 348 | 9 | LNDGLYDIY | | 42531 |
| HPV31 | L2 | 238 | 10 | LSAPKQLITY | | 42532 |
| HPV31 | L2 | 178 | 9 | LSSSSISTH | | 42533 |
| HPV31 | L2 | 178 | 11 | LSSSSISTHNY | | 42534 |
| HPV31 | L2 | 287 | 9 | LTSRRNTVR | | 42535 |
| HPV31 | L2 | 287 | 10 | LTSRRNTVRY | | 42536 |
| HPV31 | L2 | 447 | 8 | MLKRRRKR | | 42537 |
| HPV31 | L2 | 447 | 11 | MLKRRRKRVSY | | 42538 |
| HPV31 | L2 | 349 | 8 | NDGLYDIY | | 42539 |
| HPV31 | L2 | 292 | 11 | NTVRYSRLGNK | | 42540 |
| HPV31 | L2 | 285 | 11 | PALTSRRNTVR | | 42541 |
| HPV31 | L2 | 217 | 9 | PARLGLYSK | | 42542 |
| HPV31 | L2 | 274 | 10 | PDFLDIIALH | | 42543 |
| HPV31 | L2 | 274 | 11 | PDFLDIIALHR | | 42544 |
| HPV31 | L2 | 212 | 8 | PGVRRPAR | | 42545 |
| HPV31 | L2 | 210 | 10 | PIPGVRRPAR | | 42546 |
| HPV31 | L2 | 29 | 10 | PSDVIPKIEH | | 42547 |
| HPV31 | L2 | 443 | 8 | PSYYMLKR | | 42548 |
| HPV31 | L2 | 443 | 9 | PSYYMLKRR | | 42549 |
| HPV31 | L2 | 443 | 10 | PSYYMLKRRR | | 42550 |
| HPV31 | L2 | 443 | 11 | PSYYMLKRRRK | | 42551 |
| HPV31 | L2 | 235 | 8 | PTFLSAPK | | 42552 |
| HPV31 | L2 | 167 | 9 | PTPAETSGH | | 42553 |
| HPV31 | L2 | 243 | 10 | QLITYENPAY | | 42554 |
| HPV31 | L2 | 378 | 9 | QSTSAVSAY | | 42555 |
| HPV31 | L2 | 12 | 8 | RASATQLY | | 42556 |
| HPV31 | L2 | 298 | 9 | RLGNKQTLR | | 42557 |
| HPV31 | L2 | 298 | 11 | RLGNKQTLRTR | | 42558 |
| HPV31 | L2 | 291 | 8 | RNTVRYSR | | 42559 |
| HPV31 | L2 | 308 | 9 | RSGATIGAR | | 42560 |
| HPV31 | L2 | 308 | 11 | RSGATIGARVH | | 42561 |
| HPV31 | L2 | 2 | 8 | RSKRSTKR | | 42562 |
| HPV31 | L2 | 2 | 10 | RSKRSTKRTK | | 42563 |
| HPV31 | L2 | 2 | 11 | RSKRSTKRTKR | | 42564 |
| HPV31 | L2 | 5 | 8 | RSTKRTKR | | 42565 |
| HPV31 | L2 | 69 | 10 | RTGYVPLSTR | | 42566 |
| HPV31 | L2 | 9 | 11 | RTKRASATQLY | | 42567 |
| HPV31 | L2 | 306 | 11 | RTRSGATIGAR | | 42568 |
| HPV31 | L2 | 239 | 9 | SAPKQLITY | | 42569 |
| HPV31 | L2 | 14 | 10 | SATQLYQTCK | | 42570 |
| HPV31 | L2 | 30 | 9 | SDVIPKIEH | | 42571 |
| HPV31 | L2 | 309 | 8 | SGATIGAR | | 42572 |
| HPV31 | L2 | 309 | 10 | SGATIGARVH | | 42573 |
| HPV31 | L2 | 309 | 11 | SGATIGARVHY | | 42574 |
| HPV31 | L2 | 405 | 9 | SGPDVPIEH | | 42575 |
| HPV31 | L2 | 62 | 8 | SGSGTGGR | | 42576 |
| HPV31 | L2 | 62 | 11 | SGSGTGGRTGY | | 42577 |
| HPV31 | L2 | 64 | 9 | SGTGGRTGY | | 42578 |
| HPV31 | L2 | 431 | 10 | SIFVDGGDFY | | 42579 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV31 | L2 | 260 | 9 | SLYFSNTSH | | 42580 |
| HPV31 | L2 | 181 | 8 | SSISTHNY | | 42581 |
| HPV31 | L2 | 180 | 9 | SSSISTHNY | | 42582 |
| HPV31 | L2 | 179 | 8 | SSSSISTH | | 42583 |
| HPV31 | L2 | 179 | 10 | SSSSISTHNY | | 42584 |
| HPV31 | L2 | 207 | 9 | SSTPIPGVR | | 42585 |
| HPV31 | L2 | 207 | 10 | SSTPIPGVRR | | 42586 |
| HPV31 | L2 | 346 | 8 | STLNDGLY | | 42587 |
| HPV31 | L2 | 346 | 11 | STLNDGLYDIY | | 42588 |
| HPV31 | L2 | 208 | 8 | STPIPGVR | | 42589 |
| HPV31 | L2 | 208 | 9 | STPIPGVRR | | 42590 |
| HPV31 | L2 | 379 | 8 | STSAVSAY | | 42591 |
| HPV31 | L2 | 80 | 11 | STVSEASIPIR | | 42592 |
| HPV31 | L2 | 27 | 9 | TCPSDVIPK | | 42593 |
| HPV31 | L2 | 359 | 11 | TDFTVDTPATH | | 42594 |
| HPV31 | L2 | 70 | 9 | TGYVPLSTR | | 42595 |
| HPV31 | L2 | 40 | 8 | TIADQILR | | 42596 |
| HPV31 | L2 | 40 | 9 | TIADQILRY | | 42597 |
| HPV31 | L2 | 312 | 8 | TIGARVHY | | 42598 |
| HPV31 | L2 | 312 | 9 | TIGARVHYY | | 42599 |
| HPV31 | L2 | 312 | 10 | TIGARVHYYY | | 42600 |
| HPV31 | L2 | 347 | 10 | TLNDGLYDIY | | 42601 |
| HPV31 | L2 | 288 | 8 | TSRRNTVR | | 42602 |
| HPV31 | L2 | 288 | 9 | TSRRNTVRY | | 42603 |
| HPV31 | L2 | 288 | 11 | TSRRNTVRYSR | | 42604 |
| HPV31 | L2 | 206 | 10 | TSSTPIPGVR | | 42605 |
| HPV31 | L2 | 206 | 11 | TSSTPIPGVRR | | 42606 |
| HPV31 | L2 | 345 | 9 | TSTLNDGLY | | 42607 |
| HPV31 | L2 | 39 | 9 | TTIADQILR | | 42608 |
| HPV31 | L2 | 39 | 10 | TTIADQILRY | | 42609 |
| HPV31 | L2 | 344 | 10 | TTSTLNDGLY | | 42610 |
| HPV31 | L2 | 343 | 11 | TTTSTLNDGLY | | 42611 |
| HPV31 | L2 | 362 | 8 | TVDTPATH | | 42612 |
| HPV31 | L2 | 254 | 9 | TVNAEESLY | | 42613 |
| HPV31 | L2 | 293 | 10 | TVRYSRLGNK | | 42614 |
| HPV31 | L2 | 81 | 10 | TVSEASIPIR | | 42615 |
| HPV31 | L2 | 434 | 9 | VDGGDFYLH | | 42616 |
| HPV31 | L2 | 115 | 11 | VDVGAPAPIPH | | 42617 |
| HPV31 | L2 | 117 | 9 | VGAPAPIPH | | 42618 |
| HPV31 | L2 | 232 | 11 | VIDPTFLSAPK | | 42619 |
| HPV31 | L2 | 255 | 8 | VNAEESLY | | 42620 |
| HPV31 | L2 | 82 | 9 | VSEASIPIR | | 42621 |
| HPV31 | L2 | 430 | 11 | VSIFVDGGDFY | | 42622 |
| HPV31 | L2 | 440 | 10 | YLHPSYYMLK | | 42623 |
| HPV31 | L2 | 440 | 11 | YLHPSYYMLKR | | 42624 |
| HPV31 | L2 | 446 | 8 | YMLKRRRK | | 42625 |
| HPV31 | L2 | 446 | 9 | YMLKRRRKR | | 42626 |
| HPV31 | L2 | 223 | 9 | YSKATQQVK | | 42627 |
| HPV31 | L2 | 296 | 11 | YSRLGNKQTLR | | 42628 |
| HPV33 | E1 | 96 | 8 | AAEDVVDR | | 42629 |
| HPV33 | E1 | 383 | 11 | AAFLKSNSQAK | | 42630 |
| HPV33 | E1 | 104 | 11 | AANPCRTSINK | | 42631 |
| HPV33 | E1 | 452 | 11 | AFKKFLKGIPK | | 42632 |
| HPV33 | E1 | 448 | 8 | AFLGAFKK | | 42633 |
| HPV33 | E1 | 448 | 11 | AFLGAFKKFLK | | 42634 |
| HPV33 | E1 | 384 | 10 | AFLKSNSQAK | | 42635 |
| HPV33 | E1 | 635 | 9 | AGENTRSLR | | 42636 |
| HPV33 | E1 | 563 | 9 | AGTDSRWPY | | 42637 |
| HPV33 | E1 | 563 | 11 | AGTDSRWPYLH | | 42638 |
| HPV33 | E1 | 596 | 8 | AINDENWK | | 42639 |
| HPV33 | E1 | 198 | 8 | ANILYKFK | | 42640 |
| HPV33 | E1 | 198 | 11 | ANILYKFKEAY | | 42641 |
| HPV33 | E1 | 105 | 10 | ANPCRTSINK | | 42642 |
| HPV33 | E1 | 81 | 8 | AVCALKRK | | 42643 |
| HPV33 | E1 | 398 | 8 | CGIMCRHY | | 42644 |
| HPV33 | E1 | 398 | 9 | CGIMCRHYK | | 42645 |
| HPV33 | E1 | 398 | 10 | CGIMCRHYKK | | 42646 |
| HPV33 | E1 | 469 | 8 | CGPANTGK | | 42647 |
| HPV33 | E1 | 469 | 10 | CGPANTGKSY | | 42648 |
| HPV33 | E1 | 297 | 8 | CMVIEPPK | | 42649 |
| HPV33 | E1 | 297 | 10 | CMVIEPPKLR | | 42650 |
| HPV33 | E1 | 633 | 8 | CSAGENTR | | 42651 |
| HPV33 | E1 | 633 | 11 | CSAGENTRSLR | | 42652 |
| HPV33 | E1 | 276 | 10 | CSKNRLTVAK | | 42653 |
| HPV33 | E1 | 226 | 9 | CTDWCITGY | | 42654 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | E1 | 490 | 9 | CVISCVNSK | | 42655 |
| HPV33 | E1 | 490 | 11 | CVISCVNSKSH | | 42656 |
| HPV33 | E1 | 397 | 8 | DCGIMCRH | | 42657 |
| HPV33 | E1 | 397 | 9 | DCGIMCRHY | | 42658 |
| HPV33 | E1 | 397 | 10 | DCGIMCRHYK | | 42659 |
| HPV33 | E1 | 397 | 11 | DCGIMCRHYKK | | 42660 |
| HPV33 | E1 | 77 | 10 | DDLNAVCALK | | 42661 |
| HPV33 | E1 | 77 | 11 | DDLNAVCALKR | | 42662 |
| HPV33 | E1 | 364 | 8 | DDSDIAYY | | 42663 |
| HPV33 | E1 | 364 | 9 | DDSDIAYYY | | 42664 |
| HPV33 | E1 | 515 | 10 | DDVTPISWTY | | 42665 |
| HPV33 | E1 | 534 | 10 | DGNEISIDVK | | 42666 |
| HPV33 | E1 | 534 | 11 | DGNEISIDVKH | | 42667 |
| HPV33 | E1 | 614 | 8 | DLIEEEDK | | 42668 |
| HPV33 | E1 | 614 | 11 | DLIEEEDKENH | | 42669 |
| HPV33 | E1 | 78 | 9 | DLNAVCALK | | 42670 |
| HPV33 | E1 | 78 | 10 | DLNAVCALKR | | 42671 |
| HPV33 | E1 | 78 | 11 | DLNAVCALKRK | | 42672 |
| HPV33 | E1 | 349 | 10 | DLSEMVQWAY | | 42673 |
| HPV33 | E1 | 365 | 8 | DSDIAYYY | | 42674 |
| HPV33 | E1 | 377 | 11 | DSNSNAAAFLK | | 42675 |
| HPV33 | E1 | 566 | 8 | DSRWPYLH | | 42676 |
| HPV33 | E1 | 566 | 10 | DSRWPYLHSR | | 42677 |
| HPV33 | E1 | 541 | 11 | DVKHRALVQLK | | 42678 |
| HPV33 | E1 | 516 | 9 | DVTPISWTY | | 42679 |
| HPV33 | E1 | 99 | 11 | DVVDRAANPCR | | 42680 |
| HPV33 | E1 | 117 | 8 | ECTYRKRK | | 42681 |
| HPV33 | E1 | 76 | 11 | EDDLNAVCALK | | 42682 |
| HPV33 | E1 | 445 | 10 | EFTAFLGAFK | | 42683 |
| HPV33 | E1 | 445 | 11 | EFTAFLGAFKK | | 42684 |
| HPV33 | E1 | 537 | 8 | EISIDVKH | | 42685 |
| HPV33 | E1 | 537 | 9 | EISIDVKHR | | 42686 |
| HPV33 | E1 | 361 | 10 | ELTDDSDIAY | | 42687 |
| HPV33 | E1 | 361 | 11 | ELTDDSDIAYY | | 42688 |
| HPV33 | E1 | 214 | 10 | ELVRPFKSDK | | 42689 |
| HPV33 | E1 | 622 | 11 | ENHGGNISTFK | | 42690 |
| HPV33 | E1 | 600 | 9 | ENWKSFFSR | | 42691 |
| HPV33 | E1 | 242 | 8 | ESLKVLIK | | 42692 |
| HPV33 | E1 | 242 | 10 | ESLKVLIKQH | | 42693 |
| HPV33 | E1 | 295 | 10 | ETCMVIEPPK | | 42694 |
| HPV33 | E1 | 19 | 8 | EVEAVIER | | 42695 |
| HPV33 | E1 | 19 | 9 | EVEAVIERR | | 42696 |
| HPV33 | E1 | 587 | 9 | FDENGNPVY | | 42697 |
| HPV33 | E1 | 348 | 11 | FDLSEMVQWAY | | 42698 |
| HPV33 | E1 | 605 | 8 | FFSRTWCK | | 42699 |
| HPV33 | E1 | 479 | 10 | FGMSLIQFLK | | 42700 |
| HPV33 | E1 | 449 | 10 | FLGAFKKFLK | | 42701 |
| HPV33 | E1 | 456 | 8 | FLKGIPKK | | 42702 |
| HPV33 | E1 | 385 | 9 | FLKSNSQAK | 0.0002 | 42703 |
| HPV33 | E1 | 212 | 9 | FMELVRPFK | | 42704 |
| HPV33 | E1 | 446 | 9 | FTAFLGAFK | | 42705 |
| HPV33 | E1 | 446 | 10 | FTAFLGAFKK | | 42706 |
| HPV33 | E1 | 451 | 8 | GAFKKFLK | | 42707 |
| HPV33 | E1 | 489 | 10 | GCVISCVNSK | | 42708 |
| HPV33 | E1 | 625 | 8 | GGNISTFK | | 42709 |
| HPV33 | E1 | 265 | 9 | GIIILLIR | | 42710 |
| HPV33 | E1 | 265 | 11 | GIIILLIRFR | | 42711 |
| HPV33 | E1 | 399 | 8 | GIMCRHYK | | 42712 |
| HPV33 | E1 | 399 | 9 | GIMCRHYKK | | 42713 |
| HPV33 | E1 | 209 | 9 | GISFMELVR | | 42714 |
| HPV33 | E1 | 235 | 11 | GISPSVAESLK | | 42715 |
| HPV33 | E1 | 480 | 9 | GMSLIQFLK | | 42716 |
| HPV33 | E1 | 535 | 9 | GNEISIDVK | | 42717 |
| HPV33 | E1 | 535 | 10 | GNEISIDVKH | | 42718 |
| HPV33 | E1 | 535 | 11 | GNEISIDVKHR | | 42719 |
| HPV33 | E1 | 430 | 11 | GNWRPIVQLLR | | 42720 |
| HPV33 | E1 | 564 | 8 | GTDSRWPY | | 42721 |
| HPV33 | E1 | 564 | 10 | GTDSRWPYLH | | 42722 |
| HPV33 | E1 | 327 | 9 | GTTPEWIDR | | 42723 |
| HPV33 | E1 | 500 | 11 | HFWLQPLSDAK | | 42724 |
| HPV33 | E1 | 624 | 9 | HGGNISTFK | | 42725 |
| HPV33 | E1 | 256 | 9 | HLQCLTCDR | | 42726 |
| HPV33 | E1 | 573 | 10 | HSRLTVFEFK | | 42727 |
| HPV33 | E1 | 192 | 11 | HSSNTKANILY | | 42728 |
| HPV33 | E1 | 468 | 9 | ICGPANTGK | | 42729 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV33 | E1 | 468 | 11 | ICGPANTGKSY | | 42730 |
| HPV33 | E1 | 514 | 11 | IDDVTPISWTY | | 42731 |
| HPV33 | E1 | 125 | 9 | IDELEDSGY | | 42732 |
| HPV33 | E1 | 333 | 9 | IDRLTVLQH | | 42733 |
| HPV33 | E1 | 415 | 8 | IGQWIQSR | | 42734 |
| HPV33 | E1 | 415 | 11 | IGQWIQSRCEK | | 42735 |
| HPV33 | E1 | 266 | 8 | IIILLLIR | | 42736 |
| HPV33 | E1 | 266 | 10 | IIILLLIRFR | | 42737 |
| HPV33 | E1 | 267 | 9 | IILLLIRFR | | 42738 |
| HPV33 | E1 | 268 | 8 | ILLLIRFR | | 42739 |
| HPV33 | E1 | 268 | 11 | ILLLIRFRCSK | | 42740 |
| HPV33 | E1 | 200 | 9 | ILYKFKEAY | | 42741 |
| HPV33 | E1 | 400 | 8 | IMCRHYKK | | 42742 |
| HPV33 | E1 | 400 | 11 | IMCRHYKKAEK | | 42743 |
| HPV33 | E1 | 112 | 9 | INKNKECTY | | 42744 |
| HPV33 | E1 | 112 | 10 | INKNKECTYR | | 42745 |
| HPV33 | E1 | 112 | 11 | INKNKECTYRK | | 42746 |
| HPV33 | E1 | 492 | 9 | ISCVNSKSH | | 42747 |
| HPV33 | E1 | 210 | 8 | ISFMELVR | | 42748 |
| HPV33 | E1 | 210 | 11 | ISFMELVRPFK | | 42749 |
| HPV33 | E1 | 538 | 8 | ISIDVKHR | | 42750 |
| HPV33 | E1 | 187 | 11 | ISNVLHSSNTK | | 42751 |
| HPV33 | E1 | 236 | 10 | ISPSVAESLK | | 42752 |
| HPV33 | E1 | 520 | 9 | ISWTYIDDY | | 42753 |
| HPV33 | E1 | 520 | 11 | ISWTYIDDYMR | | 42754 |
| HPV33 | E1 | 394 | 10 | IVKDCGIMCR | | 42755 |
| HPV33 | E1 | 394 | 11 | IVKDCGIMCRH | | 42756 |
| HPV33 | E1 | 197 | 9 | KANILYKFK | | 42757 |
| HPV33 | E1 | 632 | 9 | KCSAGENTR | | 42758 |
| HPV33 | E1 | 396 | 8 | KDCGIMCR | | 42759 |
| HPV33 | E1 | 396 | 9 | KDCGIMCRH | | 42760 |
| HPV33 | E1 | 396 | 10 | KDCGIMCRHY | | 42761 |
| HPV33 | E1 | 396 | 11 | KDCGIMCRHYK | | 42762 |
| HPV33 | E1 | 455 | 8 | KFLKGIPK | | 42763 |
| HPV33 | E1 | 455 | 9 | KFLKGIPKK | | 42764 |
| HPV33 | E1 | 488 | 11 | KGCVISCVNSK | | 42765 |
| HPV33 | E1 | 124 | 10 | KIDELEDSGY | | 42766 |
| HPV33 | E1 | 393 | 11 | KIVKDCGIMCR | | 42767 |
| HPV33 | E1 | 612 | 10 | KLDLIEEEDK | | 42768 |
| HPV33 | E1 | 304 | 10 | KLRSQTCALY | | 42769 |
| HPV33 | E1 | 412 | 11 | KMSIGQWIQSR | | 42770 |
| HPV33 | E1 | 114 | 8 | KNKECTYR | | 42771 |
| HPV33 | E1 | 114 | 9 | KNKECTYRK | | 42772 |
| HPV33 | E1 | 114 | 10 | KNKECTYRKR | | 42773 |
| HPV33 | E1 | 114 | 11 | KNKECTYRKRK | | 42774 |
| HPV33 | E1 | 278 | 8 | KNRLTVAK | | 42775 |
| HPV33 | E1 | 603 | 10 | KSFFSRTWCK | | 42776 |
| HPV33 | E1 | 387 | 10 | KSNSQAKIVK | | 42777 |
| HPV33 | E1 | 425 | 9 | KTNDGGNWR | | 42778 |
| HPV33 | E1 | 245 | 10 | KVLIKQHSLY | | 42779 |
| HPV33 | E1 | 533 | 11 | LDGNEISIDVK | | 42780 |
| HPV33 | E1 | 613 | 9 | LDLIEEEDK | | 42781 |
| HPV33 | E1 | 450 | 9 | LGAFKKFLK | | 42782 |
| HPV33 | E1 | 467 | 10 | LICGPANTGK | | 42783 |
| HPV33 | E1 | 615 | 10 | LIEEEDKENH | | 42784 |
| HPV33 | E1 | 247 | 8 | LIKQHSLY | | 42785 |
| HPV33 | E1 | 247 | 10 | LIKQHSLYTH | | 42786 |
| HPV33 | E1 | 271 | 8 | LIRFRCSK | | 42787 |
| HPV33 | E1 | 271 | 10 | LIRFRCSKNR | | 42788 |
| HPV33 | E1 | 270 | 9 | LLIRFRCSK | | 42789 |
| HPV33 | E1 | 270 | 11 | LLIRFRCSKNR | | 42790 |
| HPV33 | E1 | 269 | 10 | LLLIRFRCSK | | 42791 |
| HPV33 | E1 | 79 | 8 | LNAVCALK | | 42792 |
| HPV33 | E1 | 79 | 9 | LNAVCALKR | | 42793 |
| HPV33 | E1 | 79 | 10 | LNAVCALKRK | | 42794 |
| HPV33 | E1 | 350 | 9 | LSEMVQWAY | | 42795 |
| HPV33 | E1 | 362 | 9 | LTDDSDIAY | | 42796 |
| HPV33 | E1 | 362 | 10 | LTDDSDIAYY | | 42797 |
| HPV33 | E1 | 362 | 11 | LTDDSDIAYYY | | 42798 |
| HPV33 | E1 | 215 | 9 | LVRPFKSDK | | 42799 |
| HPV33 | E1 | 401 | 10 | MCRHYKKAEK | | 42800 |
| HPV33 | E1 | 401 | 11 | MCRHYKKAEKR | | 42801 |
| HPV33 | E1 | 466 | 11 | MLICGPANTGK | | 42802 |
| HPV33 | E1 | 413 | 10 | MSIGQWIQSR | | 42803 |
| HPV33 | E1 | 481 | 8 | MSLIQFLK | | 42804 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | E1 | 298 | 9 | MVIEPPKLR | | 42805 |
| HPV33 | E1 | 562 | 10 | NAGTDSRWPY | | 42806 |
| HPV33 | E1 | 80 | 8 | NAVCALKR | | 42807 |
| HPV33 | E1 | 80 | 9 | NAVCALKRK | | 42808 |
| HPV33 | E1 | 598 | 11 | NDENWKSFFSR | | 42809 |
| HPV33 | E1 | 199 | 10 | NILYKFKEAY | | 42810 |
| HPV33 | E1 | 57 | 11 | NSIQADTEAAR | | 42811 |
| HPV33 | E1 | 379 | 9 | NSNAAAFLK | 0.3700 | 42812 |
| HPV33 | E1 | 389 | 8 | NSQAKIVK | | 42813 |
| HPV33 | E1 | 195 | 8 | NTKANILY | | 42814 |
| HPV33 | E1 | 195 | 9 | NTKANILYK | | 42815 |
| HPV33 | E1 | 195 | 11 | NTKANILYKFK | | 42816 |
| HPV33 | E1 | 560 | 9 | NTNAGTDSR | | 42817 |
| HPV33 | E1 | 189 | 9 | NVLHSSNTK | | 42818 |
| HPV33 | E1 | 471 | 8 | PANTGKSY | | 42819 |
| HPV33 | E1 | 107 | 8 | PCRTSINK | | 42820 |
| HPV33 | E1 | 107 | 10 | PCRTSINKNK | | 42821 |
| HPV33 | E1 | 586 | 10 | PFDENGNPVY | | 42822 |
| HPV33 | E1 | 519 | 10 | PISWTYIDDY | | 42823 |
| HPV33 | E1 | 434 | 8 | PIVQLLRY | | 42824 |
| HPV33 | E1 | 238 | 8 | PSVAESLK | | 42825 |
| HPV33 | E1 | 593 | 11 | PVYAINDENWK | | 42826 |
| HPV33 | E1 | 60 | 8 | QADTEAAR | | 42827 |
| HPV33 | E1 | 326 | 10 | QGTTPEWIDR | | 42828 |
| HPV33 | E1 | 94 | 10 | QSAAEDVVDR | | 42829 |
| HPV33 | E1 | 308 | 9 | QTCALYWFR | | 42830 |
| HPV33 | E1 | 275 | 11 | RCSKNRLTVAK | | 42831 |
| HPV33 | E1 | 273 | 8 | RFRCSKNR | | 42832 |
| HPV33 | E1 | 264 | 10 | RGIIILLLIR | | 42833 |
| HPV33 | E1 | 575 | 8 | RLTVFEFK | | 42834 |
| HPV33 | E1 | 306 | 8 | RSQTCALY | | 42835 |
| HPV33 | E1 | 306 | 11 | RSQTCALYWFR | | 42836 |
| HPV33 | E1 | 109 | 8 | RTSINKNK | | 42837 |
| HPV33 | E1 | 95 | 9 | SAAEDVVDR | | 42838 |
| HPV33 | E1 | 634 | 10 | SAGENTRSLR | | 42839 |
| HPV33 | E1 | 225 | 10 | SCTDWCITGY | | 42840 |
| HPV33 | E1 | 493 | 8 | SCVNSKSH | | 42841 |
| HPV33 | E1 | 604 | 9 | SFFSRTWCK | | 42842 |
| HPV33 | E1 | 211 | 10 | SFMELVRPFK | | 42843 |
| HPV33 | E1 | 414 | 9 | SIGQWIQSR | | 42844 |
| HPV33 | E1 | 111 | 10 | SINKNKECTY | | 42845 |
| HPV33 | E1 | 111 | 11 | SINKNKECTYR | | 42846 |
| HPV33 | E1 | 58 | 10 | SIQADTEAAR | | 42847 |
| HPV33 | E1 | 243 | 9 | SLKVLIKQH | | 42848 |
| HPV33 | E1 | 380 | 8 | SNAAAFLK | | 42849 |
| HPV33 | E1 | 378 | 10 | SNSNAAAFLK | | 42850 |
| HPV33 | E1 | 388 | 9 | SNSQAKIVK | | 42851 |
| HPV33 | E1 | 194 | 9 | SNTKANILY | | 42852 |
| HPV33 | E1 | 194 | 10 | SNTKANILYK | | 42853 |
| HPV33 | E1 | 559 | 10 | SNTNAGTDSR | | 42854 |
| HPV33 | E1 | 188 | 10 | SNVLHSSNTK | | 42855 |
| HPV33 | E1 | 193 | 10 | SSNTKANILY | | 42856 |
| HPV33 | E1 | 193 | 11 | SSNTKANILYK | | 42857 |
| HPV33 | E1 | 239 | 11 | SVAESLKVLIK | | 42858 |
| HPV33 | E1 | 447 | 8 | TAFLGAFK | | 42859 |
| HPV33 | E1 | 447 | 9 | TAFLGAFKK | | 42860 |
| HPV33 | E1 | 309 | 8 | TCALYWFR | | 42861 |
| HPV33 | E1 | 296 | 9 | TCMVIEPPK | | 42862 |
| HPV33 | E1 | 296 | 11 | TCMVIEPPKLR | | 42863 |
| HPV33 | E1 | 363 | 8 | TDDSDIAY | | 42864 |
| HPV33 | E1 | 363 | 9 | TDDSDIAYY | | 42865 |
| HPV33 | E1 | 363 | 10 | TDDSDIAYYY | | 42866 |
| HPV33 | E1 | 565 | 9 | TDSRWPYLH | | 42867 |
| HPV33 | E1 | 565 | 11 | TDSRWPYLHSR | | 42868 |
| HPV33 | E1 | 227 | 8 | TDWCITGY | | 42869 |
| HPV33 | E1 | 630 | 11 | TFKCSAGENTR | | 42870 |
| HPV33 | E1 | 183 | 10 | TLQEISNVLH | | 42871 |
| HPV33 | E1 | 561 | 8 | TNAGTDSR | | 42872 |
| HPV33 | E1 | 561 | 11 | TNAGTDSRWPY | | 42873 |
| HPV33 | E1 | 426 | 8 | TNDGGNWR | | 42874 |
| HPV33 | E1 | 224 | 11 | TSCTDWCITGY | | 42875 |
| HPV33 | E1 | 110 | 11 | TSINKNKECTY | | 42876 |
| HPV33 | E1 | 558 | 11 | TSNTNAGTDSR | | 42877 |
| HPV33 | E1 | 328 | 8 | TTPEWIDR | | 42878 |
| HPV33 | E1 | 240 | 10 | VAESLKVLIK | | 42879 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | E1 | 101 | 9 | VDRAANPCR | | 42880 |
| HPV33 | E1 | 299 | 8 | VIEPPKLR | | 42881 |
| HPV33 | E1 | 491 | 8 | VISCVNSK | | 42882 |
| HPV33 | E1 | 491 | 10 | VISCVNSKSH | | 42883 |
| HPV33 | E1 | 190 | 8 | VLHSSNTK | | 42884 |
| HPV33 | E1 | 246 | 9 | VLIKQHSLY | | 42885 |
| HPV33 | E1 | 246 | 11 | VLIKQHSLYTH | | 42886 |
| HPV33 | E1 | 182 | 11 | VTLQEISNVLH | | 42887 |
| HPV33 | E1 | 517 | 8 | VTPISWTY | | 42888 |
| HPV33 | E1 | 100 | 10 | VVDRAANPCR | | 42889 |
| HPV33 | E1 | 17 | 10 | WFEVEAVIER | | 42890 |
| HPV33 | E1 | 17 | 11 | WFEVEAVIERR | | 42891 |
| HPV33 | E1 | 332 | 10 | WIDRLTVLQH | | 42892 |
| HPV33 | E1 | 418 | 8 | WIQSRCEK | | 42893 |
| HPV33 | E1 | 502 | 9 | WLQPLSDAK | | 42894 |
| HPV33 | E1 | 522 | 9 | WTYIDDYMR | | 42895 |
| HPV33 | E1 | 595 | 9 | YAINDENWK | | 42896 |
| HPV33 | E1 | 478 | 11 | YFGMSLIQFLK | | 42897 |
| HPV33 | E1 | 208 | 10 | YGISFMELVR | | 42898 |
| HPV33 | E1 | 254 | 11 | YTHLQCLTCDR | | 42899 |
| HPV33 | E2 | 210 | 10 | ADIQTDNDNR | | 42900 |
| HPV33 | E2 | 246 | 8 | ADPALDNR | | 42901 |
| HPV33 | E2 | 246 | 11 | ADPALDNRTAR | | 42902 |
| HPV33 | E2 | 249 | 8 | ALDNRTAR | | 42903 |
| HPV33 | E2 | 78 | 10 | ALETLSKSQY | | 42904 |
| HPV33 | E2 | 258 | 9 | ATNCTNKQR | | 42905 |
| HPV33 | E2 | 10 | 10 | AVQEKILDLY | | 42906 |
| HPV33 | E2 | 245 | 9 | CADPALDNR | | 42907 |
| HPV33 | E2 | 40 | 8 | CALLYTAK | | 42908 |
| HPV33 | E2 | 288 | 9 | CLRYRLKPY | | 42909 |
| HPV33 | E2 | 288 | 10 | CLRYRLKPYK | | 42910 |
| HPV33 | E2 | 269 | 10 | CSSNVAPIVH | | 42911 |
| HPV33 | E2 | 145 | 10 | CTMVTGKVDY | | 42912 |
| HPV33 | E2 | 211 | 9 | DIQTDNDNR | | 42913 |
| HPV33 | E2 | 25 | 8 | DLPSQIEH | | 42914 |
| HPV33 | E2 | 25 | 10 | DLPSQIEHWK | | 42915 |
| HPV33 | E2 | 122 | 10 | DNDKKNTMDY | | 42916 |
| HPV33 | E2 | 217 | 10 | DNRPPQAAAK | | 42917 |
| HPV33 | E2 | 217 | 11 | DNRPPQAAAKR | | 42918 |
| HPV33 | E2 | 235 | 8 | DTAQPLTK | | 42919 |
| HPV33 | E2 | 143 | 9 | DTCTMVTGK | | 42920 |
| HPV33 | E2 | 232 | 11 | DTTDTAQPLTK | | 42921 |
| HPV33 | E2 | 39 | 9 | ECALLYTAK | | 42922 |
| HPV33 | E2 | 173 | 8 | EDAAKYSK | | 42923 |
| HPV33 | E2 | 142 | 10 | EDTCTMVTGK | | 42924 |
| HPV33 | E2 | 74 | 11 | ELQMALETLSK | | 42925 |
| HPV33 | E2 | 298 | 11 | ELYSSMSSTWH | | 42926 |
| HPV33 | E2 | 282 | 9 | ESNSLKCLR | | 42927 |
| HPV33 | E2 | 282 | 10 | ESNSLKCLRY | | 42928 |
| HPV33 | E2 | 282 | 11 | ESNSLKCLRYR | | 42929 |
| HPV33 | E2 | 80 | 8 | ETLSKSQY | | 42930 |
| HPV33 | E2 | 115 | 11 | ETVTVQYDNDK | | 42931 |
| HPV33 | E2 | 100 | 9 | EVWLCEPPK | | 42932 |
| HPV33 | E2 | 244 | 10 | FCADPALDNR | | 42933 |
| HPV33 | E2 | 156 | 10 | GMYYIHNCEK | | 42934 |
| HPV33 | E2 | 278 | 10 | HLKGESNSLK | | 42935 |
| HPV33 | E2 | 161 | 9 | HNCEKVYFK | | 42936 |
| HPV33 | E2 | 161 | 10 | HNCEKVYFKY | | 42937 |
| HPV33 | E2 | 155 | 11 | IGMYYIHNCEK | | 42938 |
| HPV33 | E2 | 15 | 9 | ILDLYEADK | | 42939 |
| HPV33 | E2 | 4 | 11 | ISARLNAVQEK | | 42940 |
| HPV33 | E2 | 287 | 8 | KCLRYRLK | | 42941 |
| HPV33 | E2 | 287 | 10 | KCLRYRLKPY | | 42942 |
| HPV33 | E2 | 287 | 11 | KCLRYRLKPYK | | 42943 |
| HPV33 | E2 | 280 | 8 | KGESNSLK | | 42944 |
| HPV33 | E2 | 280 | 11 | KGESNSLKCLR | | 42945 |
| HPV33 | E2 | 14 | 10 | KILDLYEADK | | 42946 |
| HPV33 | E2 | 34 | 11 | KLIRMECALLY | | 42947 |
| HPV33 | E2 | 23 | 10 | KTDLPSQIEH | | 42948 |
| HPV33 | E2 | 180 | 8 | KTQMWEVH | | 42949 |
| HPV33 | E2 | 151 | 8 | KVDYIGMY | | 42950 |
| HPV33 | E2 | 151 | 9 | KVDYIGMYY | | 42951 |
| HPV33 | E2 | 151 | 11 | KVDYIGMYYIH | | 42952 |
| HPV33 | E2 | 165 | 8 | KVYFKYFK | | 42953 |
| HPV33 | E2 | 103 | 9 | LCEPPKCFK | | 42954 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | E2 | 103 | 10 | LCEPPKCFKK | | 42955 |
| HPV33 | E2 | 16 | 8 | LDLYEADK | | 42956 |
| HPV33 | E2 | 243 | 11 | LFCADPALDNR | | 42957 |
| HPV33 | E2 | 35 | 10 | LIRMECALLY | | 42958 |
| HPV33 | E2 | 77 | 8 | MALETLSK | | 42959 |
| HPV33 | E2 | 77 | 11 | MALETLSKSQY | | 42960 |
| HPV33 | E2 | 129 | 10 | MDYTNWGEIY | | 42961 |
| HPV33 | E2 | 49 | 8 | MGFSHLCH | | 42962 |
| HPV33 | E2 | 147 | 8 | MVTGKVDY | | 42963 |
| HPV33 | E2 | 9 | 11 | NAVQEKILDLY | | 42964 |
| HPV33 | E2 | 162 | 8 | NCEKVYFK | | 42965 |
| HPV33 | E2 | 162 | 9 | NCEKVYFKY | | 42966 |
| HPV33 | E2 | 162 | 11 | NCEKVYFKYFK | | 42967 |
| HPV33 | E2 | 123 | 9 | NDKKNTMDY | | 42968 |
| HPV33 | E2 | 216 | 11 | NDNRPPQAAAK | | 42969 |
| HPV33 | E2 | 284 | 8 | NSLKCLRY | | 42970 |
| HPV33 | E2 | 284 | 9 | NSLKCLRYR | | 42971 |
| HPV33 | E2 | 284 | 11 | NSLKCLRYRLK | | 42972 |
| HPV33 | E2 | 272 | 9 | NVAPIVHLK | | 42973 |
| HPV33 | E2 | 248 | 9 | PALDNRTAR | | 42974 |
| HPV33 | E2 | 60 | 9 | PSLLASKTK | | 42975 |
| HPV33 | E2 | 27 | 8 | PSQIEHWK | | 42976 |
| HPV33 | E2 | 27 | 11 | PSQIEHWKLIR | | 42977 |
| HPV33 | E2 | 222 | 8 | QAAAKRRR | | 42978 |
| HPV33 | E2 | 113 | 9 | QGETVTVQY | | 42979 |
| HPV33 | E2 | 29 | 9 | QIEHWKLIR | | 42980 |
| HPV33 | E2 | 76 | 9 | QMALETLSK | | 42981 |
| HPV33 | E2 | 332 | 8 | QMFLGTVK | | 42982 |
| HPV33 | E2 | 48 | 9 | QMGFSHLCH | | 42983 |
| HPV33 | E2 | 57 | 10 | QVVPSLLASK | | 42984 |
| HPV33 | E2 | 292 | 9 | RLKPYKELY | | 42985 |
| HPV33 | E2 | 7 | 8 | RLNAVQEK | | 42986 |
| HPV33 | E2 | 37 | 8 | RMECALLY | | 42987 |
| HPV33 | E2 | 37 | 11 | RMECALLYTAK | | 42988 |
| HPV33 | E2 | 256 | 9 | RTATNCTNK | | 42989 |
| HPV33 | E2 | 256 | 11 | RTATNCTNKQR | | 42990 |
| HPV33 | E2 | 5 | 10 | SARLNAVQEK | | 42991 |
| HPV33 | E2 | 98 | 11 | SLEVWLCEPPK | | 42992 |
| HPV33 | E2 | 285 | 8 | SLKCLRYR | | 42993 |
| HPV33 | E2 | 285 | 10 | SLKCLRYRLK | | 42994 |
| HPV33 | E2 | 61 | 8 | SLLASKTK | | 42995 |
| HPV33 | E2 | 283 | 8 | SNSLKCLR | | 42996 |
| HPV33 | E2 | 283 | 9 | SNSLKCLRY | | 42997 |
| HPV33 | E2 | 283 | 10 | SNSLKCLRYR | | 42998 |
| HPV33 | E2 | 271 | 8 | SNVAPIVH | | 42999 |
| HPV33 | E2 | 271 | 10 | SNVAPIVHLK | | 43000 |
| HPV33 | E2 | 301 | 8 | SSMSSTWH | | 43001 |
| HPV33 | E2 | 270 | 9 | SSNVAPIVH | | 43002 |
| HPV33 | E2 | 270 | 11 | SSNVAPIVHLK | | 43003 |
| HPV33 | E2 | 304 | 11 | SSTWHWTSDNK | | 43004 |
| HPV33 | E2 | 305 | 10 | STWHWTSDNK | | 43005 |
| HPV33 | E2 | 209 | 11 | TADIQTDNDNR | | 43006 |
| HPV33 | E2 | 45 | 9 | TAKQMGFSH | | 43007 |
| HPV33 | E2 | 254 | 11 | TARTATNCTNK | | 43008 |
| HPV33 | E2 | 257 | 8 | TATNCTNK | | 43009 |
| HPV33 | E2 | 257 | 10 | TATNCTNKQR | | 43010 |
| HPV33 | E2 | 144 | 8 | TCTMVTGK | | 43011 |
| HPV33 | E2 | 144 | 11 | TCTMVTGKVDY | | 43012 |
| HPV33 | E2 | 24 | 9 | TDLPSQIEH | | 43013 |
| HPV33 | E2 | 24 | 11 | TDLPSQIEHWK | | 43014 |
| HPV33 | E2 | 234 | 9 | TDTAQPLTK | | 43015 |
| HPV33 | E2 | 149 | 10 | TGKVDYIGMY | | 43016 |
| HPV33 | E2 | 149 | 11 | TGKVDYIGMYY | | 43017 |
| HPV33 | E2 | 128 | 11 | TMDYTNWGEIY | | 43018 |
| HPV33 | E2 | 146 | 9 | TMVTGKVDY | | 43019 |
| HPV33 | E2 | 259 | 8 | TNCTNKQR | | 43020 |
| HPV33 | E2 | 310 | 8 | TSDNKNSK | | 43021 |
| HPV33 | E2 | 233 | 10 | TTDTAQPLTK | | 43022 |
| HPV33 | E2 | 118 | 8 | TVQYDNDK | | 43023 |
| HPV33 | E2 | 118 | 9 | TVQYDNDKK | | 43024 |
| HPV33 | E2 | 116 | 10 | TVTVQYDNDK | | 43025 |
| HPV33 | E2 | 116 | 11 | TVTVQYDNDKK | | 43026 |
| HPV33 | E2 | 273 | 8 | VAPIVHLK | | 43027 |
| HPV33 | E2 | 268 | 11 | VCSSNVAPIVH | | 43028 |
| HPV33 | E2 | 152 | 8 | VDYIGMYY | | 43029 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | E2 | 152 | 10 | VDYIGMYYIH | | 43030 |
| HPV33 | E2 | 148 | 11 | VTGKVDYIGMY | | 43031 |
| HPV33 | E2 | 117 | 9 | VTVQYDNDK | | 43032 |
| HPV33 | E2 | 117 | 10 | VTVQYDNDKK | | 43033 |
| HPV33 | E2 | 58 | 9 | VVPSLLASK | | 43034 |
| HPV33 | E2 | 58 | 11 | VVPSLLASKTK | | 43035 |
| HPV33 | E2 | 102 | 10 | WLCEPPKCFK | | 43036 |
| HPV33 | E2 | 102 | 11 | WLCEPPKCFKK | | 43037 |
| HPV33 | E2 | 309 | 9 | WTSDNKNSK | | 43038 |
| HPV33 | E2 | 121 | 11 | YDNDKKNTMDY | | 43039 |
| HPV33 | E2 | 170 | 8 | YFKEDAAK | | 43040 |
| HPV33 | E2 | 170 | 9 | YFKEDAAKY | | 43041 |
| HPV33 | E2 | 170 | 11 | YFKEDAAKYSK | | 43042 |
| HPV33 | E2 | 167 | 11 | YFKYFKEDAAK | | 43043 |
| HPV33 | E2 | 154 | 8 | YIGMYYIH | | 43044 |
| HPV33 | E2 | 159 | 9 | YIHNCEKVY | | 43045 |
| HPV33 | E2 | 159 | 11 | YIHNCEKVYFK | | 43046 |
| HPV33 | E2 | 178 | 10 | YSKTQMWEVH | | 43047 |
| HPV33 | E2 | 300 | 9 | YSSMSSTWH | | 43048 |
| HPV33 | E2 | 44 | 10 | YTAKQMGFSH | | 43049 |
| HPV33 | E2 | 131 | 8 | YTNWGEIY | | 43050 |
| HPV33 | E5 | 63 | 8 | CINFHAQH | | 43051 |
| HPV33 | E5 | 51 | 8 | FCYLLFLY | | 43052 |
| HPV33 | E5 | 50 | 9 | FFCYLLFLY | | 43053 |
| HPV33 | E5 | 12 | 9 | FLCLSLLLR | | 43054 |
| HPV33 | E5 | 44 | 10 | GSPLKIFFCY | | 43055 |
| HPV33 | E5 | 49 | 10 | IFFCYLLFLY | | 43056 |
| HPV33 | E5 | 10 | 11 | ILFLCLSLLLR | | 43057 |
| HPV33 | E5 | 48 | 11 | KIFFCYLLFLY | | 43058 |
| HPV33 | E5 | 13 | 8 | LCLSLLLR | | 43059 |
| HPV33 | E5 | 11 | 10 | LFLCLSLLLR | | 43060 |
| HPV33 | E5 | 22 | 8 | LILSISTY | | 43061 |
| HPV33 | E5 | 38 | 11 | LLWVFVGSPLK | | 43062 |
| HPV33 | E5 | 62 | 9 | MCINFHAQH | | 43063 |
| HPV33 | E5 | 61 | 10 | MMCINFHAQH | | 43064 |
| HPV33 | E5 | 21 | 9 | PLILSISTY | | 43065 |
| HPV33 | E5 | 46 | 8 | PLKIFFCY | | 43066 |
| HPV33 | E5 | 60 | 8 | PMMCINFH | | 43067 |
| HPV33 | E5 | 60 | 11 | PMMCINFHAQH | | 43068 |
| HPV33 | E5 | 41 | 8 | VFVGSPLK | | 43069 |
| HPV33 | E5 | 43 | 11 | VGSPLKIFFCY | | 43070 |
| HPV33 | E5 | 40 | 9 | WVFVGSPLK | | 43071 |
| HPV33 | E5 | 58 | 10 | YLPMMCINFH | | 43072 |
| HPV33 | E6 | 137 | 8 | AACWRSRR | | 43073 |
| HPV33 | E6 | 137 | 9 | AACWRSRRR | | 43074 |
| HPV33 | E6 | 138 | 8 | ACWRSRRR | | 43075 |
| HPV33 | E6 | 48 | 8 | ADLTVVYR | | 43076 |
| HPV33 | E6 | 46 | 9 | AFADLTVVY | | 43077 |
| HPV33 | E6 | 46 | 10 | AFADLTVVYR | | 43078 |
| HPV33 | E6 | 133 | 9 | AGRCAACWR | | 43079 |
| HPV33 | E6 | 133 | 11 | AGRCAACWRSR | | 43080 |
| HPV33 | E6 | 136 | 8 | CAACWRSR | | 43081 |
| HPV33 | E6 | 136 | 9 | CAACWRSRR | | 43082 |
| HPV33 | E6 | 136 | 10 | CAACWRSRRR | | 43083 |
| HPV33 | E6 | 66 | 11 | CLRFLSKISEY | | 43084 |
| HPV33 | E6 | 30 | 10 | CVECKKPLQR | | 43085 |
| HPV33 | E6 | 44 | 11 | DFAFADLTVVY | | 43086 |
| HPV33 | E6 | 14 | 11 | DLCQALETTIH | | 43087 |
| HPV33 | E6 | 4 | 10 | DTEEKPRTLH | | 43088 |
| HPV33 | E6 | 32 | 8 | ECKKPLQR | | 43089 |
| HPV33 | E6 | 56 | 9 | EGNPFGICK | | 43090 |
| HPV33 | E6 | 98 | 11 | EILIRCIICQR | | 43091 |
| HPV33 | E6 | 27 | 8 | ELQCVECK | | 43092 |
| HPV33 | E6 | 27 | 9 | ELQCVECKK | | 43093 |
| HPV33 | E6 | 47 | 8 | FADLTVVY | | 43094 |
| HPV33 | E6 | 47 | 9 | FADLTVVYR | | 43095 |
| HPV33 | E6 | 45 | 10 | FAFADLTVVY | | 43096 |
| HPV33 | E6 | 45 | 11 | FAFADLTVVYR | | 43097 |
| HPV33 | E6 | 60 | 9 | FGICKLCLR | | 43098 |
| HPV33 | E6 | 69 | 8 | FLSKISEY | | 43099 |
| HPV33 | E6 | 69 | 9 | FLSKISEYR | | 43100 |
| HPV33 | E6 | 69 | 10 | FLSKISEYRH | | 43101 |
| HPV33 | E6 | 69 | 11 | FLSKISEYRHY | | 43102 |
| HPV33 | E6 | 61 | 8 | GICKLCLR | | 43103 |
| HPV33 | E6 | 57 | 8 | GNPFGICK | | 43104 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV33 | E6 | 85 | 9 | GNTLEQTVK | | 43105 |
| HPV33 | E6 | 85 | 10 | GNTLEQTVKK | | 43106 |
| HPV33 | E6 | 24 | 11 | HNIELQCVECK | | 43107 |
| HPV33 | E6 | 126 | 10 | HNISGRWAGR | | 43108 |
| HPV33 | E6 | 118 | 9 | HVDLNKRFH | | 43109 |
| HPV33 | E6 | 62 | 11 | ICKLCLRFLSK | | 43110 |
| HPV33 | E6 | 105 | 11 | ICQRPLCPQEK | | 43111 |
| HPV33 | E6 | 99 | 10 | ILIRCIICQR | | 43112 |
| HPV33 | E6 | 73 | 9 | ISEYRHYNY | | 43113 |
| HPV33 | E6 | 128 | 8 | ISGRWAGR | | 43114 |
| HPV33 | E6 | 72 | 8 | KISEYRHY | | 43115 |
| HPV33 | E6 | 72 | 10 | KISEYRHYNY | | 43116 |
| HPV33 | E6 | 64 | 9 | KLCLRFLSK | | 43117 |
| HPV33 | E6 | 65 | 8 | LCLRFLSK | | 43118 |
| HPV33 | E6 | 110 | 8 | LCPQEKKR | | 43119 |
| HPV33 | E6 | 110 | 9 | LCPQEKKRH | | 43120 |
| HPV33 | E6 | 15 | 10 | LCQALETTIH | | 43121 |
| HPV33 | E6 | 100 | 9 | LIRCIICQR | | 43122 |
| HPV33 | E6 | 121 | 11 | LNKRFHNISGR | | 43123 |
| HPV33 | E6 | 70 | 8 | LSKISEYR | | 43124 |
| HPV33 | E6 | 70 | 9 | LSKISEYRH | | 43125 |
| HPV33 | E6 | 70 | 10 | LSKISEYRHY | | 43126 |
| HPV33 | E6 | 1 | 8 | MFQDTEEK | | 43127 |
| HPV33 | E6 | 1 | 10 | MFQDTEEKPR | | 43128 |
| HPV33 | E6 | 25 | 10 | NIELQCVECK | | 43129 |
| HPV33 | E6 | 25 | 11 | NIELQCVECKK | | 43130 |
| HPV33 | E6 | 127 | 9 | NISGRWAGR | | 43131 |
| HPV33 | E6 | 86 | 8 | NTLEQTVK | | 43132 |
| HPV33 | E6 | 86 | 9 | NTLEQTVKK | | 43133 |
| HPV33 | E6 | 59 | 10 | PFGICKLCLR | | 43134 |
| HPV33 | E6 | 109 | 8 | PLCPQEKK | | 43135 |
| HPV33 | E6 | 109 | 9 | PLCPQEKKR | | 43136 |
| HPV33 | E6 | 109 | 10 | PLCPQEKKRH | | 43137 |
| HPV33 | E6 | 95 | 8 | PLNEILIR | | 43138 |
| HPV33 | E6 | 36 | 8 | PLQRSEVY | | 43139 |
| HPV33 | E6 | 17 | 8 | QALETTIH | | 43140 |
| HPV33 | E6 | 29 | 11 | QCVECKKPLQR | | 43141 |
| HPV33 | E6 | 3 | 8 | QDTEEKPR | | 43142 |
| HPV33 | E6 | 3 | 11 | QDTEEKPRTLH | | 43143 |
| HPV33 | E6 | 135 | 9 | RCAACWRSR | | 43144 |
| HPV33 | E6 | 135 | 10 | RCAACWRSRR | | 43145 |
| HPV33 | E6 | 135 | 11 | RCAACWRSRRR | | 43146 |
| HPV33 | E6 | 124 | 8 | RFHNISGR | | 43147 |
| HPV33 | E6 | 68 | 9 | RFLSKISEY | | 43148 |
| HPV33 | E6 | 68 | 10 | RFLSKISEYR | | 43149 |
| HPV33 | E6 | 68 | 11 | RFLSKISEYRH | | 43150 |
| HPV33 | E6 | 87 | 8 | TLEQTVKK | | 43151 |
| HPV33 | E6 | 119 | 8 | VDLNKRFH | | 43152 |
| HPV33 | E6 | 132 | 10 | WAGRCAACWR | | 43153 |
| HPV33 | E6 | 84 | 10 | YGNTLEQTVK | | 43154 |
| HPV33 | E6 | 84 | 11 | YGNTLEQTVKK | | 43155 |
| HPV33 | E7 | 50 | 10 | ADYYIVTCCH | | 43156 |
| HPV33 | E7 | 57 | 10 | CCHTCNTTVR | | 43157 |
| HPV33 | E7 | 68 | 10 | CVNSTASDLR | | 43158 |
| HPV33 | E7 | 42 | 11 | DGQAQPATADY | | 43159 |
| HPV33 | E7 | 14 | 10 | DLYPEPTDLY | | 43160 |
| HPV33 | E7 | 30 | 11 | DSSDEDEGLDR | | 43161 |
| HPV33 | E7 | 59 | 8 | HTCNTTVR | | 43162 |
| HPV33 | E7 | 67 | 11 | LCVNSTASDLR | | 43163 |
| HPV33 | E7 | 13 | 11 | LDLYPEPTDLY | | 43164 |
| HPV33 | E7 | 70 | 8 | NSTASDLR | | 43165 |
| HPV33 | E7 | 6 | 11 | PTLKEYVLDLY | | 43166 |
| HPV33 | E7 | 44 | 9 | QAQPATADY | | 43167 |
| HPV33 | E7 | 44 | 10 | QAQPATADYY | | 43168 |
| HPV33 | E7 | 2 | 8 | RGHKPTLK | | 43169 |
| HPV33 | E7 | 2 | 10 | RGHKPTLKEY | | 43170 |
| HPV33 | E7 | 32 | 9 | SDEDEGLDR | | 43171 |
| HPV33 | E7 | 31 | 10 | SSDEDEGLDR | | 43172 |
| HPV33 | E7 | 49 | 11 | TADYYIVTCCH | | 43173 |
| HPV33 | E7 | 56 | 11 | TCCHTCNTTVR | | 43174 |
| HPV33 | E7 | 7 | 10 | TLKEYVLDLY | | 43175 |
| HPV33 | E7 | 69 | 9 | VNSTASDLR | | 43176 |
| HPV33 | L1 | 102 | 9 | ACVGLEIGR | | 43177 |
| HPV33 | L1 | 456 | 10 | ADLDQFPLGR | | 43178 |
| HPV33 | L1 | 456 | 11 | ADLDQFPLGRK | | 43179 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV33 | L1 | 142 | 11 | ADNRECLSMDY | | 43180 |
| HPV33 | L1 | 471 | 8 | AGLKAKPK | | 43181 |
| HPV33 | L1 | 471 | 10 | AGLKAKPKLK | | 43182 |
| HPV33 | L1 | 471 | 11 | AGLKAKPKLKR | | 43183 |
| HPV33 | L1 | 37 | 11 | AGSSRLLAVGH | | 43184 |
| HPV33 | L1 | 424 | 11 | AITCQKTVPPK | | 43185 |
| HPV33 | L1 | 411 | 8 | ASLQDTYR | | 43186 |
| HPV33 | L1 | 44 | 10 | AVGHPYFSIK | | 43187 |
| HPV33 | L1 | 270 | 9 | AVPDDLYIK | | 43188 |
| HPV33 | L1 | 225 | 10 | CGSTCKYPDY | | 43189 |
| HPV33 | L1 | 207 | 11 | CMDFKTLQANK | | 43190 |
| HPV33 | L1 | 345 | 10 | CTQVTSDSTY | | 43191 |
| HPV33 | L1 | 345 | 11 | CTQVTSDSTYK | | 43192 |
| HPV33 | L1 | 103 | 8 | CVGLEIGR | | 43193 |
| HPV33 | L1 | 128 | 8 | DDTETGNK | | 43194 |
| HPV33 | L1 | 128 | 9 | DDTETGNKY | | 43195 |
| HPV33 | L1 | 209 | 9 | DFKTLQANK | | 43196 |
| HPV33 | L1 | 223 | 8 | DICGSTCK | | 43197 |
| HPV33 | L1 | 223 | 9 | DICGSTCKY | | 43198 |
| HPV33 | L1 | 457 | 9 | DLDQFPLGR | | 43199 |
| HPV33 | L1 | 457 | 10 | DLDQFPLGRK | | 43200 |
| HPV33 | L1 | 370 | 10 | DLQFVFQLCK | | 43201 |
| HPV33 | L1 | 143 | 10 | DNRECLSMDY | | 43202 |
| HPV33 | L1 | 143 | 11 | DNRECLSMDYK | | 43203 |
| HPV33 | L1 | 244 | 8 | DSLFFFLR | | 43204 |
| HPV33 | L1 | 244 | 9 | DSLFFFLRR | | 43205 |
| HPV33 | L1 | 351 | 10 | DSTYKNENFK | | 43206 |
| HPV33 | L1 | 129 | 8 | DTETGNKY | | 43207 |
| HPV33 | L1 | 202 | 10 | DTGFGCMDFK | | 43208 |
| HPV33 | L1 | 88 | 11 | DTSFYNPDTQR | | 43209 |
| HPV33 | L1 | 269 | 8 | EAVPDDLY | | 43210 |
| HPV33 | L1 | 269 | 10 | EAVPDDLYIK | | 43211 |
| HPV33 | L1 | 146 | 8 | ECLSMDYK | | 43212 |
| HPV33 | L1 | 357 | 8 | ENFKEYIR | | 43213 |
| HPV33 | L1 | 357 | 9 | ENFKEYIRH | | 43214 |
| HPV33 | L1 | 303 | 9 | ESQLFNKPY | | 43215 |
| HPV33 | L1 | 127 | 9 | FDDTETGNK | | 43216 |
| HPV33 | L1 | 127 | 10 | FDDTETGNKY | | 43217 |
| HPV33 | L1 | 248 | 11 | FFLRREQMFVR | | 43218 |
| HPV33 | L1 | 84 | 9 | FGFPDTSFY | | 43219 |
| HPV33 | L1 | 467 | 8 | FLLQAGLK | | 43220 |
| HPV33 | L1 | 467 | 10 | FLLQAGLKAK | | 43221 |
| HPV33 | L1 | 249 | 10 | FLRREQMFVR | | 43222 |
| HPV33 | L1 | 249 | 11 | FLRREQMFVRH | | 43223 |
| HPV33 | L1 | 307 | 9 | FNKPYWLQR | | 43224 |
| HPV33 | L1 | 50 | 10 | FSIKNPTNAK | | 43225 |
| HPV33 | L1 | 50 | 11 | FSIKNPTNAKK | | 43226 |
| HPV33 | L1 | 256 | 8 | FVRHFFNR | | 43227 |
| HPV33 | L1 | 419 | 11 | FVTSQAITCQK | | 43228 |
| HPV33 | L1 | 330 | 9 | FVTVVDTTR | | 43229 |
| HPV33 | L1 | 161 | 9 | GCKPPTGEH | | 43230 |
| HPV33 | L1 | 243 | 9 | GDSLFFFLR | | 43231 |
| HPV33 | L1 | 243 | 10 | GDSLFFFLRR | | 43232 |
| HPV33 | L1 | 204 | 8 | GFGCMDFK | | 43233 |
| HPV33 | L1 | 85 | 8 | GFPDTSFY | | 43234 |
| HPV33 | L1 | 117 | 10 | GISGHPLLNK | | 43235 |
| HPV33 | L1 | 472 | 9 | GLKAKPKLK | | 43236 |
| HPV33 | L1 | 472 | 10 | GLKAKPKLKR | | 43237 |
| HPV33 | L1 | 68 | 8 | GLQYRVFR | | 43238 |
| HPV33 | L1 | 68 | 10 | GLQYRVFRVR | | 43239 |
| HPV33 | L1 | 38 | 10 | GSSRLLAVGH | | 43240 |
| HPV33 | L1 | 226 | 9 | GSTCKYPDY | | 43241 |
| HPV33 | L1 | 226 | 11 | GSTCKYPDYLK | | 43242 |
| HPV33 | L1 | 224 | 8 | ICGSTCKY | | 43243 |
| HPV33 | L1 | 224 | 11 | ICGSTCKYPDY | | 43244 |
| HPV33 | L1 | 222 | 9 | IDICGSTCK | | 43245 |
| HPV33 | L1 | 222 | 10 | IDICGSTCKY | | 43246 |
| HPV33 | L1 | 118 | 9 | ISGHPLLNK | | 43247 |
| HPV33 | L1 | 425 | 10 | ITCQKTVPPK | | 43248 |
| HPV33 | L1 | 474 | 8 | KAKPKLKR | | 43249 |
| HPV33 | L1 | 126 | 10 | KFDDTETGNK | | 43250 |
| HPV33 | L1 | 126 | 11 | KFDDTETGNKY | | 43251 |
| HPV33 | L1 | 83 | 10 | KFGFPDTSFY | | 43252 |
| HPV33 | L1 | 466 | 9 | KFLLQAGLK | | 43253 |
| HPV33 | L1 | 466 | 11 | KFLLQAGLKAK | | 43254 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | L1 | 478 | 11 | KLKRAAPTSTR | | 43255 |
| HPV33 | L1 | 355 | 8 | KNENFKEY | | 43256 |
| HPV33 | L1 | 355 | 10 | KNENFKEYIR | | 43257 |
| HPV33 | L1 | 355 | 11 | KNENFKEYIRH | | 43258 |
| HPV33 | L1 | 53 | 8 | KNPTNAKK | | 43259 |
| HPV33 | L1 | 429 | 8 | KTVPPKEK | | 43260 |
| HPV33 | L1 | 65 | 8 | KVSGLQYR | | 43261 |
| HPV33 | L1 | 65 | 11 | KVSGLQYRVFR | | 43262 |
| HPV33 | L1 | 379 | 11 | KVTLTAEVMTY | | 43263 |
| HPV33 | L1 | 20 | 8 | KVVSTDEY | | 43264 |
| HPV33 | L1 | 20 | 11 | KVVSTDEYVSR | | 43265 |
| HPV33 | L1 | 43 | 11 | LAVGHPYFSIK | | 43266 |
| HPV33 | L1 | 344 | 11 | LCTQVTSDSTY | | 43267 |
| HPV33 | L1 | 458 | 8 | LDQFPLGR | | 43268 |
| HPV33 | L1 | 458 | 9 | LDQFPLGRK | | 43269 |
| HPV33 | L1 | 306 | 10 | LFNKPYWLQR | | 43270 |
| HPV33 | L1 | 160 | 10 | LGCKPPTGEH | | 43271 |
| HPV33 | L1 | 267 | 10 | LGEAVPDDLY | | 43272 |
| HPV33 | L1 | 114 | 8 | LGVGISGH | | 43273 |
| HPV33 | L1 | 42 | 8 | LLAVGHPY | | 43274 |
| HPV33 | L1 | 159 | 11 | LLGCKPPTGEH | | 43275 |
| HPV33 | L1 | 468 | 9 | LLQAGLKAK | | 43276 |
| HPV33 | L1 | 468 | 11 | LLQAGLKAKPK | | 43277 |
| HPV33 | L1 | 61 | 11 | LLVPKVSGLQY | | 43278 |
| HPV33 | L1 | 382 | 8 | LTAEVMTY | | 43279 |
| HPV33 | L1 | 382 | 10 | LTAEVMTYIH | | 43280 |
| HPV33 | L1 | 62 | 10 | LVPKVSGLQY | | 43281 |
| HPV33 | L1 | 62 | 11 | LVPKVSGLQYR | | 43282 |
| HPV33 | L1 | 208 | 10 | MDFKTLQANK | | 43283 |
| HPV33 | L1 | 255 | 9 | MFVRHFFNR | | 43284 |
| HPV33 | L1 | 299 | 11 | MVTSESQLFNK | | 43285 |
| HPV33 | L1 | 57 | 9 | NAKKLLVPK | | 43286 |
| HPV33 | L1 | 358 | 8 | NFKEYIRH | | 43287 |
| HPV33 | L1 | 232 | 11 | PDYLKMTSEPY | | 43288 |
| HPV33 | L1 | 137 | 9 | PGQPGADNR | | 43289 |
| HPV33 | L1 | 221 | 10 | PIDICGSTCK | | 43290 |
| HPV33 | L1 | 221 | 11 | PIDICGSTCKY | | 43291 |
| HPV33 | L1 | 113 | 9 | PLGVGISGH | | 43292 |
| HPV33 | L1 | 409 | 9 | PSASLQDTY | | 43293 |
| HPV33 | L1 | 409 | 10 | PSASLQDTYR | | 43294 |
| HPV33 | L1 | 165 | 8 | PTGEHWGK | | 43295 |
| HPV33 | L1 | 55 | 11 | PTNAKKLLVPK | | 43296 |
| HPV33 | L1 | 484 | 10 | PTSTRTSSAK | | 43297 |
| HPV33 | L1 | 484 | 11 | PTSTRTSSAKR | | 43298 |
| HPV33 | L1 | 17 | 11 | PVSKVVSTDEY | | 43299 |
| HPV33 | L1 | 470 | 9 | QAGLKAKPK | | 43300 |
| HPV33 | L1 | 470 | 11 | QAGLKAKPKLK | | 43301 |
| HPV33 | L1 | 372 | 8 | QFVFQLCK | | 43302 |
| HPV33 | L1 | 156 | 8 | QLCLLGCK | | 43303 |
| HPV33 | L1 | 305 | 11 | QLFNKPYWLQR | | 43304 |
| HPV33 | L1 | 254 | 10 | QMFVRHFFNR | | 43305 |
| HPV33 | L1 | 154 | 10 | QTQLCLLGCK | | 43306 |
| HPV33 | L1 | 328 | 11 | QVFVTVVDTTR | | 43307 |
| HPV33 | L1 | 347 | 8 | QVTSDSTY | | 43308 |
| HPV33 | L1 | 347 | 9 | QVTSDSTYK | | 43309 |
| HPV33 | L1 | 481 | 8 | RAAPTSTR | | 43310 |
| HPV33 | L1 | 41 | 9 | RLLAVGHPY | | 43311 |
| HPV33 | L1 | 488 | 8 | RTSSAKRK | | 43312 |
| HPV33 | L1 | 488 | 9 | RTSSAKRKK | | 43313 |
| HPV33 | L1 | 488 | 11 | RTSSAKRKKVK | | 43314 |
| HPV33 | L1 | 75 | 9 | RVRLPDPNK | | 43315 |
| HPV33 | L1 | 455 | 11 | SADLDQFFLGR | | 43316 |
| HPV33 | L1 | 491 | 8 | SAKRKKVK | | 43317 |
| HPV33 | L1 | 491 | 9 | SAKRKKVKK | | 43318 |
| HPV33 | L1 | 410 | 8 | SASLQDTY | | 43319 |
| HPV33 | L1 | 410 | 9 | SASLQDTYR | | 43320 |
| HPV33 | L1 | 350 | 11 | SDSTYKNENFK | | 43321 |
| HPV33 | L1 | 90 | 9 | SFYNPDTQR | | 43322 |
| HPV33 | L1 | 119 | 8 | SGHPLLNK | | 43323 |
| HPV33 | L1 | 67 | 9 | SGLQYRVFR | | 43324 |
| HPV33 | L1 | 67 | 11 | SGLQYRVFRVR | | 43325 |
| HPV33 | L1 | 51 | 9 | SIKNPTNAK | | 43326 |
| HPV33 | L1 | 51 | 10 | SIKNPTNAKK | | 43327 |
| HPV33 | L1 | 32 | 10 | SIYYYAGSSR | | 43328 |
| HPV33 | L1 | 245 | 8 | SLFFFLRR | | 43329 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | L1 | 490 | 9 | SSAKRKKVK | | 43330 |
| HPV33 | L1 | 490 | 10 | SSAKRKKVKK | | 43331 |
| HPV33 | L1 | 39 | 9 | SSRLLAVGH | | 43332 |
| HPV33 | L1 | 39 | 11 | SSRLLAVGHPY | | 43333 |
| HPV33 | L1 | 227 | 8 | STCKYPDY | | 43334 |
| HPV33 | L1 | 227 | 10 | STCKYPDYLK | | 43335 |
| HPV33 | L1 | 23 | 8 | STDEYVSR | | 43336 |
| HPV33 | L1 | 486 | 8 | STRTSSAK | | 43337 |
| HPV33 | L1 | 486 | 9 | STRTSSAKR | | 43338 |
| HPV33 | L1 | 486 | 10 | STRTSSAKRK | | 43339 |
| HPV33 | L1 | 486 | 11 | STRTSSAKRKK | | 43340 |
| HPV33 | L1 | 352 | 9 | STYKNENFK | | 43341 |
| HPV33 | L1 | 352 | 11 | STYKNENFKEY | | 43342 |
| HPV33 | L1 | 2 | 11 | SVWRPSEATVY | | 43343 |
| HPV33 | L1 | 383 | 9 | TAEVMTYIH | | 43344 |
| HPV33 | L1 | 228 | 9 | TCKYPDYLK | | 43345 |
| HPV33 | L1 | 426 | 9 | TCQKTVPPK | | 43346 |
| HPV33 | L1 | 426 | 11 | TCQKTVPPKEK | | 43347 |
| HPV33 | L1 | 24 | 11 | TDEYVSRTSIY | | 43348 |
| HPV33 | L1 | 444 | 8 | TFWEVDLK | | 43349 |
| HPV33 | L1 | 444 | 10 | TFWEVDLKEK | | 43350 |
| HPV33 | L1 | 203 | 9 | TGFGCMDFK | | 43351 |
| HPV33 | L1 | 266 | 11 | TLGEAVPDDLY | | 43352 |
| HPV33 | L1 | 381 | 9 | TLTAEVMTY | | 43353 |
| HPV33 | L1 | 381 | 11 | TLTAEVMTYIH | | 43354 |
| HPV33 | L1 | 56 | 10 | TNAKKLLVPK | | 43355 |
| HPV33 | L1 | 301 | 9 | TSESQLFNK | | 43356 |
| HPV33 | L1 | 301 | 11 | TSESQLFNKPY | | 43357 |
| HPV33 | L1 | 89 | 10 | TSFYNPDTQR | | 43358 |
| HPV33 | L1 | 31 | 11 | TSIYYYAGSSR | | 43359 |
| HPV33 | L1 | 421 | 9 | TSQAITCQK | | 43360 |
| HPV33 | L1 | 489 | 8 | TSSAKRKK | | 43361 |
| HPV33 | L1 | 489 | 10 | TSSAKRKKVK | | 43362 |
| HPV33 | L1 | 489 | 11 | TSSAKRKKVKK | | 43363 |
| HPV33 | L1 | 485 | 9 | TSTRTSSAK | | 43364 |
| HPV33 | L1 | 485 | 10 | TSTRTSSAKR | | 43365 |
| HPV33 | L1 | 485 | 11 | TSTRTSSAKRK | | 43366 |
| HPV33 | L1 | 10 | 11 | TVYLPPVPVSK | | 43367 |
| HPV33 | L1 | 201 | 11 | VDTGFGCMDFK | | 43368 |
| HPV33 | L1 | 73 | 11 | VFRVRLPDPNK | | 43369 |
| HPV33 | L1 | 329 | 10 | VFVTVVDTTR | | 43370 |
| HPV33 | L1 | 45 | 9 | VGHPYFSIK | | 43371 |
| HPV33 | L1 | 116 | 11 | VGISGHPLLNK | | 43372 |
| HPV33 | L1 | 66 | 10 | VSGLQYRVFR | | 43373 |
| HPV33 | L1 | 18 | 10 | VSKVVSTDEY | | 43374 |
| HPV33 | L1 | 28 | 8 | VSRTSIYY | | 43375 |
| HPV33 | L1 | 28 | 9 | VSRTSIYYY | | 43376 |
| HPV33 | L1 | 22 | 9 | VSTDEYVSR | | 43377 |
| HPV33 | L1 | 380 | 10 | VTLTAEVMTY | | 43378 |
| HPV33 | L1 | 348 | 8 | VTSDSTYK | | 43379 |
| HPV33 | L1 | 300 | 10 | VTSESQLFNK | | 43380 |
| HPV33 | L1 | 420 | 10 | VTSQAITCQK | | 43381 |
| HPV33 | L1 | 331 | 8 | VTVVDTTR | | 43382 |
| HPV33 | L1 | 21 | 10 | VVSTDEYVSR | | 43383 |
| HPV33 | L1 | 101 | 10 | WACVGLEIGR | | 43384 |
| HPV33 | L1 | 312 | 8 | WLQRAQGH | | 43385 |
| HPV33 | L1 | 369 | 11 | YDLQFVFQLCK | | 43386 |
| HPV33 | L1 | 49 | 11 | YFSIKNPTNAK | | 43387 |
| HPV33 | L1 | 242 | 10 | YGDSLFFFLR | | 43388 |
| HPV33 | L1 | 242 | 11 | YGDSLFFFLRR | | 43389 |
| HPV33 | L1 | 362 | 8 | YIRHVEEY | | 43390 |
| HPV33 | L1 | 234 | 9 | YLKMTSEPY | | 43391 |
| HPV33 | L1 | 12 | 9 | YLPPVPVSK | | 43392 |
| HPV33 | L1 | 443 | 9 | YTFWEVDLK | | 43393 |
| HPV33 | L1 | 443 | 11 | YTFWEVDLKEK | | 43394 |
| HPV33 | L1 | 27 | 8 | YVSRTSIY | | 43395 |
| HPV33 | L1 | 27 | 9 | YVSRTSIYY | | 43396 |
| HPV33 | L1 | 27 | 10 | YVSRTSIYYY | | 43397 |
| HPV33 | L2 | 81 | 9 | AAIPLQPIR | | 43398 |
| HPV33 | L2 | 367 | 8 | ADDVDNVH | | 43399 |
| HPV33 | L2 | 438 | 9 | ADFVLHPSY | | 43400 |
| HPV33 | L2 | 241 | 8 | AFLTSPHK | | 43401 |
| HPV33 | L2 | 82 | 8 | AIPLQPIR | | 43402 |
| HPV33 | L2 | 291 | 10 | AITSRRHTVR | | 43403 |
| HPV33 | L2 | 286 | 10 | ALHRPAITSR | | 43404 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | L2 | 286 | 11 | ALHRPAITSRR | | 43405 |
| HPV33 | L2 | 12 | 11 | ASATQLYQTCK | | 43406 |
| HPV33 | L2 | 308 | 9 | ATLKTRSGK | | 43407 |
| HPV33 | L2 | 14 | 9 | ATQLYQTCK | | 43408 |
| HPV33 | L2 | 280 | 9 | DFLDIIALH | | 43409 |
| HPV33 | L2 | 280 | 10 | DFLDIIALHR | | 43410 |
| HPV33 | L2 | 439 | 8 | DFVLHPSY | | 43411 |
| HPV33 | L2 | 436 | 8 | DGADFVLH | | 43412 |
| HPV33 | L2 | 436 | 11 | DGADFVLHPSY | | 43413 |
| HPV33 | L2 | 327 | 10 | DLSPIVPLDH | | 43414 |
| HPV33 | L2 | 371 | 9 | DNVHTPMQH | | 43415 |
| HPV33 | L2 | 371 | 11 | DNVHTPMQHSY | | 43416 |
| HPV33 | L2 | 369 | 11 | DVDNVHTPMQH | | 43417 |
| HPV33 | L2 | 364 | 11 | DVYADDVDNVH | | 43418 |
| HPV33 | L2 | 263 | 8 | EDTLQFQH | | 43419 |
| HPV33 | L2 | 36 | 11 | EGSTIADQILK | | 43420 |
| HPV33 | L2 | 149 | 10 | ESSIQTISTH | | 43421 |
| HPV33 | L2 | 260 | 11 | FDPEDTLQFQH | | 43422 |
| HPV33 | L2 | 447 | 8 | FILRRRRK | | 43423 |
| HPV33 | L2 | 447 | 9 | FILRRRRKR | | 43424 |
| HPV33 | L2 | 281 | 8 | FLDIIALH | | 43425 |
| HPV33 | L2 | 281 | 9 | FLDIIALHR | | 43426 |
| HPV33 | L2 | 242 | 11 | FLTSPHKLITY | | 43427 |
| HPV33 | L2 | 301 | 11 | FSRVGQKATLK | | 43428 |
| HPV33 | L2 | 183 | 11 | FSSPTVSTQSY | | 43429 |
| HPV33 | L2 | 163 | 8 | FTEPSVLH | | 43430 |
| HPV33 | L2 | 440 | 11 | FVLHPSYFILR | | 43431 |
| HPV33 | L2 | 437 | 10 | GADFVLHPSY | | 43432 |
| HPV33 | L2 | 58 | 11 | GIGTGSGSGGR | | 43433 |
| HPV33 | L2 | 226 | 11 | GLYSRNTQQVK | | 43434 |
| HPV33 | L2 | 64 | 8 | GSGGRTGY | | 43435 |
| HPV33 | L2 | 62 | 10 | GSGSGGRTGY | | 43436 |
| HPV33 | L2 | 218 | 11 | GSRPVARLGLY | | 43437 |
| HPV33 | L2 | 37 | 10 | GSTIADQILK | | 43438 |
| HPV33 | L2 | 37 | 11 | GSTIADQILKY | | 43439 |
| HPV33 | L2 | 25 | 10 | GTCPPDVIPK | | 43440 |
| HPV33 | L2 | 60 | 9 | GTGSGSGGR | | 43441 |
| HPV33 | L2 | 349 | 8 | HDTSTSSY | | 43442 |
| HPV33 | L2 | 379 | 10 | HSYSTFATTR | | 43443 |
| HPV33 | L2 | 374 | 8 | HTPMQHSY | | 43444 |
| HPV33 | L2 | 336 | 8 | HTVPNEQY | | 43445 |
| HPV33 | L2 | 297 | 11 | HTVRFSRVGQK | | 43446 |
| HPV33 | L2 | 40 | 8 | IADQILKY | | 43447 |
| HPV33 | L2 | 285 | 11 | IALHRPAITSR | | 43448 |
| HPV33 | L2 | 318 | 8 | IGARIHYY | | 43449 |
| HPV33 | L2 | 59 | 10 | IGTGSGSGGR | | 43450 |
| HPV33 | L2 | 448 | 8 | ILRRRRKR | | 43451 |
| HPV33 | L2 | 448 | 11 | ILRRRRKRFPY | | 43452 |
| HPV33 | L2 | 358 | 9 | INDGLYDVY | | 43453 |
| HPV33 | L2 | 292 | 9 | ITSRRHTVR | | 43454 |
| HPV33 | L2 | 433 | 11 | IVVDGADFVLH | | 43455 |
| HPV33 | L2 | 307 | 10 | KATLKTRSGK | | 43456 |
| HPV33 | L2 | 311 | 11 | KTRSGKQIGAR | | 43457 |
| HPV33 | L2 | 334 | 10 | LDHTVPNEQY | | 43458 |
| HPV33 | L2 | 282 | 8 | LDIIALHR | | 43459 |
| HPV33 | L2 | 328 | 9 | LSPIVPLDH | | 43460 |
| HPV33 | L2 | 243 | 10 | LTSPHKLITY | | 43461 |
| HPV33 | L2 | 359 | 8 | NDGLYDVY | | 43462 |
| HPV33 | L2 | 372 | 8 | NVHTPMQH | | 43463 |
| HPV33 | L2 | 372 | 10 | NVHTPMQHSY | | 43464 |
| HPV33 | L2 | 240 | 8 | PAFLTSPH | | 43465 |
| HPV33 | L2 | 240 | 9 | PAFLTSPHK | | 43466 |
| HPV33 | L2 | 290 | 8 | PAITSRRH | | 43467 |
| HPV33 | L2 | 290 | 11 | PAITSRRHTVR | | 43468 |
| HPV33 | L2 | 172 | 9 | PAPAEASGH | | 43469 |
| HPV33 | L2 | 279 | 10 | PDFLDIIALH | | 43470 |
| HPV33 | L2 | 279 | 11 | PDFLDIIALHR | | 43471 |
| HPV33 | L2 | 217 | 8 | PGSRPVAR | | 43472 |
| HPV33 | L2 | 215 | 10 | PIPGSRPVAR | | 43473 |
| HPV33 | L2 | 333 | 11 | PLDHTVPNEQY | | 43474 |
| HPV33 | L2 | 347 | 10 | PLHDTSTSSY | | 43475 |
| HPV33 | L2 | 339 | 11 | PNEQYELQPLH | | 43476 |
| HPV33 | L2 | 444 | 8 | PSYFILRR | | 43477 |
| HPV33 | L2 | 444 | 9 | PSYFILRRR | | 43478 |
| HPV33 | L2 | 444 | 10 | PSYFILRRRR | | 43479 |

TABLE XVII-continued

A11 Motif Peptides

| Type | Protein | Position | No. of Amino Acids | Sequence | A*1101 | Seq. Id. No. |
|---|---|---|---|---|---|---|
| HPV33 | L2 | 444 | 11 | PSYFILRRRRK | | 43480 |
| HPV33 | L2 | 79 | 11 | PTAAIPLQPIR | | 43481 |
| HPV33 | L2 | 161 | 10 | PTFTEPSVLH | | 43482 |
| HPV33 | L2 | 186 | 8 | PTVSTQSY | | 43483 |
| HPV33 | L2 | 221 | 8 | PVARLGLY | | 43484 |
| HPV33 | L2 | 221 | 10 | PVARLGLYSR | | 43485 |
| HPV33 | L2 | 326 | 11 | QDLSPIVPLDH | | 43486 |
| HPV33 | L2 | 317 | 8 | QIGARIHY | | 43487 |
| HPV33 | L2 | 317 | 9 | QIGARIHYY | | 43488 |
| HPV33 | L2 | 11 | 8 | RASATQLY | | 43489 |
| HPV33 | L2 | 455 | 10 | RFPYFFTDVR | | 43490 |
| HPV33 | L2 | 300 | 8 | RFSRVGQK | | 43491 |
| HPV33 | L2 | 313 | 9 | RSGKQIGAR | | 43492 |
| HPV33 | L2 | 313 | 11 | RSGKQIGARIH | | 43493 |
| HPV33 | L2 | 303 | 9 | RVGQKATLK | | 43494 |
| HPV33 | L2 | 303 | 11 | RVGQKATLKTR | | 43495 |
| HPV33 | L2 | 13 | 10 | SATQLYQTCK | | 43496 |
| HPV33 | L2 | 314 | 8 | SGKQIGAR | | 43497 |
| HPV33 | L2 | 314 | 10 | SGKQIGARIH | | 43498 |
| HPV33 | L2 | 314 | 11 | SGKQIGARIHY | | 43499 |
| HPV33 | L2 | 63 | 9 | SGSGGRTGY | | 43500 |
| HPV33 | L2 | 357 | 10 | SINDGLYDVY | | 43501 |
| HPV33 | L2 | 151 | 8 | SIQTISTH | | 43502 |
| HPV33 | L2 | 150 | 9 | SSIQTISTH | | 43503 |
| HPV33 | L2 | 184 | 10 | SSPTVSTQSY | | 43504 |
| HPV33 | L2 | 212 | 9 | SSTPIPGSR | | 43505 |
| HPV33 | L2 | 354 | 10 | SSYSINDGLY | | 43506 |
| HPV33 | L2 | 38 | 9 | STIADQILK | | 43507 |
| HPV33 | L2 | 38 | 10 | STIADQILKY | | 43508 |
| HPV33 | L2 | 213 | 8 | STPIPGSR | | 43509 |
| HPV33 | L2 | 80 | 10 | TAAIPLQPIR | | 43510 |
| HPV33 | L2 | 26 | 9 | TCPPDVIPK | | 43511 |
| HPV33 | L2 | 162 | 9 | TFTEPSVLH | | 43512 |
| HPV33 | L2 | 61 | 8 | TGSGSGGR | | 43513 |
| HPV33 | L2 | 61 | 11 | TGSGSGGRTGY | | 43514 |
| HPV33 | L2 | 24 | 11 | TGTCPPDVIPK | | 43515 |
| HPV33 | L2 | 39 | 8 | TIADQILK | | 43516 |
| HPV33 | L2 | 39 | 9 | TIADQILKY | | 43517 |
| HPV33 | L2 | 309 | 8 | TLKTRSGK | | 43518 |
| HPV33 | L2 | 244 | 9 | TSPHKLITY | | 43519 |
| HPV33 | L2 | 293 | 8 | TSRRHTVR | | 43520 |
| HPV33 | L2 | 293 | 11 | TSRRHTVRFSR | | 43521 |
| HPV33 | L2 | 211 | 10 | TSSTPIPGSR | | 43522 |
| HPV33 | L2 | 353 | 11 | TSSYSINDGLY | | 43523 |
| HPV33 | L2 | 298 | 10 | TVRFSRVGQK | | 43524 |
| HPV33 | L2 | 222 | 9 | VARLGLYSR | | 43525 |
| HPV33 | L2 | 435 | 9 | VDGADFVLH | | 43526 |
| HPV33 | L2 | 370 | 10 | VDNVHTPMQH | | 43527 |
| HPV33 | L2 | 238 | 10 | VDPAFLTSPH | | 43528 |
| HPV33 | L2 | 238 | 11 | VDPAFLTSPHK | | 43529 |
| HPV33 | L2 | 304 | 8 | VGQKATLK | | 43530 |
| HPV33 | L2 | 304 | 10 | VGQKATLKTR | | 43531 |
| HPV33 | L2 | 441 | 10 | VLHPSYFILR | | 43532 |
| HPV33 | L2 | 441 | 11 | VLHPSYFILRR | | 43533 |
| HPV33 | L2 | 210 | 11 | VTSSTPIPGSR | | 43534 |
| HPV33 | L2 | 434 | 10 | VVDGADFVLH | | 43535 |
| HPV33 | L2 | 237 | 11 | VVDPAFLTSPH | | 43536 |
| HPV33 | L2 | 366 | 9 | YADDVDNVH | | 43537 |
| HPV33 | L2 | 446 | 8 | YFILRRRR | | 43538 |
| HPV33 | L2 | 446 | 9 | YFILRRRRK | | 43539 |
| HPV33 | L2 | 446 | 10 | YFILRRRRKR | | 43540 |
| HPV33 | L2 | 356 | 8 | YSINDGLY | | 43541 |
| HPV33 | L2 | 356 | 11 | YSINDGLYDVY | | 43542 |
| HPV33 | L2 | 228 | 9 | YSRNTQQVK | | 43543 |
| HPV33 | L2 | 381 | 8 | YSTFATTR | | 43544 |
| HPV45 | E1 | 383 | 11 | AAFLKSNCQAK | | 43545 |
| HPV45 | E1 | 198 | 8 | AAMLAVFK | | 43546 |
| HPV45 | E1 | 198 | 11 | AAMLAVFKDIY | | 43547 |
| HPV45 | E1 | 384 | 10 | AFLKSNCQAK | | 43548 |
| HPV45 | E1 | 384 | 11 | AFLKSNCQAKY | | 43549 |
| HPV45 | E1 | 490 | 11 | AIISFVNSNSH | | 43550 |
| HPV45 | E1 | 532 | 11 | ALDGNPISIDR | | 43551 |
| HPV45 | E1 | 452 | 11 | ALKEFLKGTPK | | 43552 |
| HPV45 | E1 | 270 | 9 | ALLRYKCGK | 0.1400 | 43553 |
| HPV45 | E1 | 270 | 11 | ALLRYKCGKNR | | 43554 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV45 | E1 | 199 | 10 | AMLAVFKDIY | | 43555 |
| HPV45 | E1 | 512 | 8 | AMLDDATH | | 43556 |
| HPV45 | E1 | 517 | 8 | ATHTCWTY | | 43557 |
| HPV45 | E1 | 399 | 8 | AVMCRHYK | | 43558 |
| HPV45 | E1 | 399 | 9 | AVMCRHYKR | | 43559 |
| HPV45 | E1 | 398 | 8 | CAVMCRHY | | 43560 |
| HPV45 | E1 | 398 | 9 | CAVMCRHYK | | 43561 |
| HPV45 | E1 | 398 | 10 | CAVMCRHYKR | | 43562 |
| HPV45 | E1 | 604 | 9 | CFFERTWSR | | 43563 |
| HPV45 | E1 | 276 | 10 | CGKNRLTVAK | | 43564 |
| HPV45 | E1 | 297 | 8 | CMLIEPPK | | 43565 |
| HPV45 | E1 | 297 | 10 | CMLIEPPKLR | | 43566 |
| HPV45 | E1 | 378 | 10 | CNSNAAAFLK | | 43567 |
| HPV45 | E1 | 423 | 11 | CSKIDEGGDWR | | 43568 |
| HPV45 | E1 | 634 | 8 | CVTGQNTR | | 43569 |
| HPV45 | E1 | 78 | 9 | DAQVLHLLK | | 43570 |
| HPV45 | E1 | 78 | 10 | DAQVLHLLKR | | 43571 |
| HPV45 | E1 | 78 | 11 | DAQVLHLLKRK | | 43572 |
| HPV45 | E1 | 516 | 9 | DATHTCWTY | | 43573 |
| HPV45 | E1 | 397 | 8 | DCAVMCRH | | 43574 |
| HPV45 | E1 | 397 | 9 | DCAVMCRHY | | 43575 |
| HPV45 | E1 | 397 | 10 | DCAVMCRHYK | | 43576 |
| HPV45 | E1 | 397 | 11 | DCAVMCRHYKR | | 43577 |
| HPV45 | E1 | 377 | 11 | DCNSNAAAFLK | | 43578 |
| HPV45 | E1 | 515 | 10 | DDATHTCWTY | | 43579 |
| HPV45 | E1 | 534 | 9 | DGNPISIDR | | 43580 |
| HPV45 | E1 | 534 | 10 | DGNPISIDRK | | 43581 |
| HPV45 | E1 | 534 | 11 | DGNPISIDRKH | | 43582 |
| HPV45 | E1 | 214 | 10 | DLVRNFKSDK | | 43583 |
| HPV45 | E1 | 173 | 9 | DNAENVDPH | | 43584 |
| HPV45 | E1 | 566 | 10 | DNKQPYLESR | | 43585 |
| HPV45 | E1 | 623 | 11 | DTEGIPFGTFK | | 43586 |
| HPV45 | E1 | 328 | 8 | DTPEWIQR | | 43587 |
| HPV45 | E1 | 445 | 10 | EFISFLRALK | | 43588 |
| HPV45 | E1 | 455 | 8 | EFLKGTPK | | 43589 |
| HPV45 | E1 | 455 | 9 | EFLKGTPKK | | 43590 |
| HPV45 | E1 | 242 | 8 | EGFKTLIK | | 43591 |
| HPV45 | E1 | 625 | 9 | EGIPFGTFK | | 43592 |
| HPV45 | E1 | 596 | 8 | EINDKNWK | | 43593 |
| HPV45 | E1 | 115 | 8 | EISLNSGH | | 43594 |
| HPV45 | E1 | 115 | 9 | EISLNSGHK | | 43595 |
| HPV45 | E1 | 115 | 10 | EISLNSGHKK | | 43596 |
| HPV45 | E1 | 186 | 11 | ELKELLQASNK | | 43597 |
| HPV45 | E1 | 189 | 8 | ELLQASNK | | 43598 |
| HPV45 | E1 | 189 | 9 | ELLQASNKK | | 43599 |
| HPV45 | E1 | 365 | 8 | ESDMAFQY | | 43600 |
| HPV45 | E1 | 573 | 11 | ESRVTVFTFPH | | 43601 |
| HPV45 | E1 | 64 | 8 | ETAQALFH | | 43602 |
| HPV45 | E1 | 295 | 10 | ETCMLIEPPK | | 43603 |
| HPV45 | E1 | 74 | 10 | EVQNDAQVLH | | 43604 |
| HPV45 | E1 | 587 | 9 | FDKNGNPVY | | 43605 |
| HPV45 | E1 | 605 | 8 | FFERTWSR | | 43606 |
| HPV45 | E1 | 18 | 9 | FFVETIVEK | | 43607 |
| HPV45 | E1 | 18 | 10 | FFVETIVEKK | | 43608 |
| HPV45 | E1 | 446 | 9 | FISFLRALK | | 43609 |
| HPV45 | E1 | 456 | 8 | FLKGTPKK | | 43610 |
| HPV45 | E1 | 385 | 9 | FLKSNCQAK | 0.0007 | 43611 |
| HPV45 | E1 | 385 | 10 | FLKSNCQAKY | | 43612 |
| HPV45 | E1 | 449 | 10 | FLRALKEFLK | | 43613 |
| HPV45 | E1 | 212 | 9 | FTDLVRNFK | | 43614 |
| HPV45 | E1 | 579 | 11 | FTFPHAFPFDK | | 43615 |
| HPV45 | E1 | 130 | 8 | FTISDSGY | | 43616 |
| HPV45 | E1 | 19 | 8 | FVETIVEK | | 43617 |
| HPV45 | E1 | 19 | 9 | FVETIVEKK | | 43618 |
| HPV45 | E1 | 327 | 9 | GDTPEWIQR | 0.0002 | 43619 |
| HPV45 | E1 | 430 | 11 | GDWRPIVQFLR | | 43620 |
| HPV45 | E1 | 626 | 8 | GIPFGTFK | | 43621 |
| HPV45 | E1 | 209 | 9 | GLSFTDLVR | 0.0025 | 43622 |
| HPV45 | E1 | 535 | 8 | GNPISIDR | | 43623 |
| HPV45 | E1 | 535 | 9 | GNPISIDRK | | 43624 |
| HPV45 | E1 | 535 | 10 | GNPISIDRKH | | 43625 |
| HPV45 | E1 | 535 | 11 | GNPISIDRKHK | | 43626 |
| HPV45 | E1 | 591 | 10 | GNPVYEINDK | | 43627 |
| HPV45 | E1 | 459 | 11 | GTPKKNCILLY | | 43628 |
| HPV45 | E1 | 443 | 9 | GVEFISFLR | | 43629 |

TABLE XVII-continued

All Motif Peptides

| Type | Protein | Position | No. of Amino Acids | Sequeuce | A*1101 | Seq. Id. No. |
|---|---|---|---|---|---|---|
| HPV45 | E1 | 265 | 9 | GVLILALLR | 0.1400 | 43630 |
| HPV45 | E1 | 265 | 10 | GVLILALLRY | | 43631 |
| HPV45 | E1 | 265 | 11 | GVLILALLRYK | | 43632 |
| HPV45 | E1 | 235 | 11 | GVNPTVAEGFK | | 43633 |
| HPV45 | E1 | 181 | 8 | HCSITELK | | 43634 |
| HPV45 | E1 | 500 | 11 | HFWLEPLADTK | | 43635 |
| HPV45 | E1 | 256 | 8 | HIQCLDCK | | 43636 |
| HPV45 | E1 | 519 | 10 | HTCWTYFDNY | | 43637 |
| HPV45 | E1 | 426 | 8 | IDEGGDWR | | 43638 |
| HPV45 | E1 | 561 | 8 | IDPAKDNK | | 43639 |
| HPV45 | E1 | 561 | 11 | IDPAKDNKWPY | | 43640 |
| HPV45 | E1 | 491 | 10 | IISFVNSNSH | | 43641 |
| HPV45 | E1 | 268 | 8 | ILALLRYK | | 43642 |
| HPV45 | E1 | 268 | 11 | ILALLRYKCGK | | 43643 |
| HPV45 | E1 | 555 | 11 | ILLTSNIDPAK | | 43644 |
| HPV45 | E1 | 466 | 11 | ILLYGPANTGK | | 43645 |
| HPV45 | E1 | 447 | 8 | ISFLRALK | | 43646 |
| HPV45 | E1 | 492 | 9 | ISFVNSNSH | | 43647 |
| HPV45 | E1 | 538 | 8 | ISIDRKHK | | 43648 |
| HPV45 | E1 | 116 | 8 | ISLNSGHK | | 43649 |
| HPV45 | E1 | 116 | 9 | ISLNSGHKK | | 43650 |
| HPV45 | E1 | 116 | 11 | ISLNSGHKKAK | | 43651 |
| HPV45 | E1 | 197 | 9 | KAAMLAVFK | | 43652 |
| HPV45 | E1 | 603 | 10 | KCFFERTWSR | | 43653 |
| HPV45 | E1 | 275 | 11 | KCGKNRUTVAK | | 43654 |
| HPV45 | E1 | 633 | 9 | KCVTGQNTR | | 43655 |
| HPV45 | E1 | 396 | 8 | KDCAVMCR | | 43656 |
| HPV45 | E1 | 396 | 9 | KDCAVMCRH | | 43657 |
| HPV45 | E1 | 396 | 10 | KDCAVMCRHY | | 43658 |
| HPV45 | E1 | 396 | 11 | KDCAVMCRHYK | | 43659 |
| HPV45 | E1 | 565 | 11 | KDNKWPYLESR | | 43660 |
| HPV45 | E1 | 285 | 8 | KGLSTLLH | | 43661 |
| HPV45 | E1 | 425 | 9 | KIDEGGDWR | | 43662 |
| HPV45 | E1 | 304 | 10 | KLRSSVAALY | | 43663 |
| HPV45 | E1 | 278 | 8 | KNRLTVAK | | 43664 |
| HPV45 | E1 | 600 | 9 | KNWKCFFER | | 43665 |
| HPV45 | E1 | 387 | 8 | KSNCQAKY | | 43666 |
| HPV45 | E1 | 387 | 10 | KSNCQAKYLK | | 43667 |
| HPV45 | E1 | 476 | 10 | KSYFGMSFIH | | 43668 |
| HPV45 | E1 | 245 | 10 | KTLIKPATLY | | 43669 |
| HPV45 | E1 | 510 | 10 | KVAMLDDATH | | 43670 |
| HPV45 | E1 | 269 | 10 | LALLRYKCGK | | 43671 |
| HPV45 | E1 | 201 | 8 | LAVFKDIY | | 43672 |
| HPV45 | E1 | 514 | 11 | LDDATHTCWTY | | 43673 |
| HPV45 | E1 | 533 | 10 | LDGNPISIDR | | 43674 |
| HPV45 | E1 | 533 | 11 | LDGNPISIDRK | | 43675 |
| HPV45 | E1 | 129 | 9 | LFTISDSGY | | 43676 |
| HPV45 | E1 | 299 | 8 | LIEPPKLR | | 43677 |
| HPV45 | E1 | 247 | 8 | LIKPATLY | | 43678 |
| HPV45 | E1 | 247 | 10 | LIKPATLYAH | | 43679 |
| HPV45 | E1 | 267 | 8 | LILALLRY | | 43680 |
| HPV45 | E1 | 267 | 9 | LILALLRYK | 0.1800 | 43681 |
| HPV45 | E1 | 84 | 11 | LLKRKFAGGSK | | 43682 |
| HPV45 | E1 | 190 | 8 | LLQASNKK | | 43683 |
| HPV45 | E1 | 271 | 8 | LLRYKCGK | | 43684 |
| HPV45 | E1 | 271 | 10 | LLRYKCGKNR | | 43685 |
| HPV45 | E1 | 556 | 10 | LLTSNIDPAK | | 43686 |
| HPV45 | E1 | 467 | 10 | LLYGPANTGK | | 43687 |
| HPV45 | E1 | 118 | 9 | LNSGHKKAK | | 43688 |
| HPV45 | E1 | 118 | 10 | LNSGHKKAKR | | 43689 |
| HPV45 | E1 | 118 | 11 | LNSGHKKAKRR | | 43690 |
| HPV45 | E1 | 210 | 8 | LSFTDLVR | | 43691 |
| HPV45 | E1 | 210 | 11 | LSFTDLVRNFK | | 43692 |
| HPV45 | E1 | 103 | 10 | LSVDTDLSPR | | 43693 |
| HPV45 | E1 | 362 | 11 | LTDESDMAFQY | | 43694 |
| HPV45 | E1 | 557 | 9 | LTSNIDPAK | | 43695 |
| HPV45 | E1 | 215 | 9 | LVRNFKSDK | 0.0002 | 43696 |
| HPV45 | E1 | 401 | 10 | MCRHYKRAQK | | 43697 |
| HPV45 | E1 | 401 | 11 | MCRHYKRAQKR | | 43698 |
| HPV45 | E1 | 200 | 9 | MLAVFKDIY | | 43699 |
| HPV45 | E1 | 298 | 9 | MLIEPPKLR | | 43700 |
| HPV45 | E1 | 413 | 8 | MNMSQWIK | | 43701 |
| HPV45 | E1 | 413 | 9 | MNMSQWIKY | | 43702 |
| HPV45 | E1 | 413 | 10 | MNMSQWIKYR | | 43703 |
| HPV45 | E1 | 415 | 8 | MSQWIKYR | | 43704 |

TABLE XVII-continued

A11 Motif Peptides

| Type | Protein | Position | No. of Amino Acids | Sequence | A*1101 | Seq. Id. No. |
|---|---|---|---|---|---|---|
| HPV45 | E1 | 415 | 11 | MSQWIKYRCSK | | 43705 |
| HPV45 | E1 | 154 | 9 | NAENGGSVH | | 43706 |
| HPV45 | E1 | 174 | 8 | NAENVDPH | | 43707 |
| HPV45 | E1 | 389 | 8 | NCQAKYLK | | 43708 |
| HPV45 | E1 | 77 | 10 | NDAQVLHLLK | | 43709 |
| HPV45 | E1 | 77 | 11 | NDAQVLHLLKR | | 43710 |
| HPV45 | E1 | 598 | 11 | NDKNWKCFFER | | 43711 |
| HPV45 | E1 | 590 | 11 | NGNPVYEINDK | | 43712 |
| HPV45 | E1 | 560 | 9 | NIDPAKDNK | | 43713 |
| HPV45 | E1 | 414 | 8 | NMSQWIKY | | 43714 |
| HPV45 | E1 | 414 | 9 | NMSQWIKYR | | 43715 |
| HPV45 | E1 | 119 | 8 | NSGHKKAK | | 43716 |
| HPV45 | E1 | 119 | 9 | NSGHKKAKR | | 43717 |
| HPV45 | E1 | 119 | 10 | NSGHKKAKRR | | 43718 |
| HPV45 | E1 | 379 | 9 | NSNAAAFLK | 0.3700 | 43719 |
| HPV45 | E1 | 152 | 11 | NTNAENGGSVH | | 43720 |
| HPV45 | E1 | 563 | 9 | PAKDNKWPY | | 43721 |
| HPV45 | E1 | 471 | 8 | PANTGKSY | | 43722 |
| HPV45 | E1 | 586 | 10 | PFDKNGNPVY | | 43723 |
| HPV45 | E1 | 537 | 8 | PISIDRKH | | 43724 |
| HPV45 | E1 | 537 | 9 | PISIDRKHK | | 43725 |
| HPV45 | E1 | 434 | 8 | PIVQFLRY | | 43726 |
| HPV45 | E1 | 238 | 8 | PTVAEGFK | | 43727 |
| HPV45 | E1 | 593 | 8 | PVYEINDK | | 43728 |
| HPV45 | E1 | 593 | 11 | PVYEINDKNWK | | 43729 |
| HPV45 | E1 | 442 | 10 | QGVEFISFLR | | 43730 |
| HPV45 | E1 | 102 | 11 | QLSVDTDLSPR | | 43731 |
| HPV45 | E1 | 412 | 9 | QMNMSQWIK | | 43732 |
| HPV45 | E1 | 412 | 10 | QMNMSQWIKY | | 43733 |
| HPV45 | E1 | 412 | 11 | QMNMSQWIKYR | | 43734 |
| HPV45 | E1 | 76 | 8 | QNDAQVLH | | 43735 |
| HPV45 | E1 | 76 | 11 | QNDAQVLHLLK | | 43736 |
| HPV45 | E1 | 80 | 8 | QVLHLLKR | | 43737 |
| HPV45 | E1 | 80 | 9 | QVLHLLKRK | | 43738 |
| HPV45 | E1 | 451 | 8 | RALKEFLK | | 43739 |
| HPV45 | E1 | 128 | 10 | RLFTISDSGY | | 43740 |
| HPV45 | E1 | 112 | 11 | RLQEISLNSGH | | 43741 |
| HPV45 | E1 | 306 | 8 | RSSVAALY | | 43742 |
| HPV45 | E1 | 306 | 10 | RSSVAALYWY | | 43743 |
| HPV45 | E1 | 306 | 11 | RSSVAALYWYR | | 43744 |
| HPV45 | E1 | 608 | 9 | RTWSRLDLH | | 43745 |
| HPV45 | E1 | 575 | 9 | RVTVFTFPH | | 43746 |
| HPV45 | E1 | 172 | 10 | SDNAENVDPH | | 43747 |
| HPV45 | E1 | 448 | 11 | SFLRALKEFLK | | 43748 |
| HPV45 | E1 | 211 | 10 | SFTDLVRNFK | | 43749 |
| HPV45 | E1 | 493 | 8 | SFVNSNSH | | 43750 |
| HPV45 | E1 | 326 | 10 | SGDTPEWIQR | | 43751 |
| HPV45 | E1 | 120 | 8 | SGHKKAKR | | 43752 |
| HPV45 | E1 | 120 | 9 | SGHKKAKRR | | 43753 |
| HPV45 | E1 | 117 | 8 | SLNSGHKK | | 43754 |
| HPV45 | E1 | 117 | 10 | SLNSGHKKAK | | 43755 |
| HPV45 | E1 | 117 | 11 | SLNSGHKKAKR | | 43756 |
| HPV45 | E1 | 380 | 8 | SNAAAFLK | | 43757 |
| HPV45 | E1 | 388 | 9 | SNCQAKYLK | | 43758 |
| HPV45 | E1 | 559 | 10 | SNIDPAKDNK | | 43759 |
| HPV45 | E1 | 171 | 11 | SSDNAENVDPH | | 43760 |
| HPV45 | E1 | 307 | 9 | SSVAALYWY | | 43761 |
| HPV45 | E1 | 307 | 10 | SSVAALYWYR | | 43762 |
| HPV45 | E1 | 308 | 8 | SVAALYWY | | 43763 |
| HPV45 | E1 | 308 | 9 | SVAALYWYR | 8.8000 | 43764 |
| HPV45 | E1 | 104 | 9 | SVDTDLSPR | | 43765 |
| HPV45 | E1 | 296 | 9 | TCMLIEPPK | | 43766 |
| HPV45 | E1 | 296 | 11 | TCMLIEPPKLR | | 43767 |
| HPV45 | E1 | 520 | 9 | TCWTYFDNY | | 43768 |
| HPV45 | E1 | 520 | 11 | TCWTYFDNYMR | | 43769 |
| HPV45 | E1 | 363 | 10 | TDESDMAFQY | | 43770 |
| HPV45 | E1 | 213 | 8 | TDLVRNFK | | 43771 |
| HPV45 | E1 | 213 | 11 | TDLVRNFKSDK | | 43772 |
| HPV45 | E1 | 631 | 11 | TFKCVTGQNTR | | 43773 |
| HPV45 | E1 | 580 | 10 | TFPHAFPFDK | | 43774 |
| HPV45 | E1 | 246 | 9 | TLIKPATLY | | 43775 |
| HPV45 | E1 | 246 | 11 | TLIKPATLYAH | | 43776 |
| HPV45 | E1 | 153 | 10 | TNAENGGSVH | | 43777 |
| HPV45 | E1 | 558 | 8 | TSNIDPAK | | 43778 |
| HPV45 | E1 | 558 | 11 | TSNIDPAKDNK | | 43779 |

TABLE XVII-continued

A11 Motif Peptides

| Type | Protein | Position | No. of Amino Acids | Sequence | A*1101 | Seq. Id. No. |
|---|---|---|---|---|---|---|
| HPV45 | E1 | 239 | 11 | TVAEGFKTLIK | | 43780 |
| HPV45 | E1 | 282 | 11 | TVAKGLSTLLH | | 43781 |
| HPV45 | E1 | 309 | 8 | VAALYWYR | | 43782 |
| HPV45 | E1 | 240 | 10 | VAEGFKTLIK | | 43783 |
| HPV45 | E1 | 283 | 10 | VAKGLSTLLH | | 43784 |
| HPV45 | E1 | 511 | 9 | VAMLDDATH | | 43785 |
| HPV45 | E1 | 178 | 11 | VDPHCSITELK | | 43786 |
| HPV45 | E1 | 105 | 8 | VDTDLSPR | | 43787 |
| HPV45 | E1 | 81 | 8 | VLHLLKRK | | 43788 |
| HPV45 | E1 | 266 | 8 | VLILALLR | | 43789 |
| HPV45 | E1 | 266 | 9 | VLILALLRY | | 43790 |
| HPV45 | E1 | 266 | 10 | VLILALLRYK | | 43791 |
| HPV45 | E1 | 400 | 8 | VMCRHYKR | | 43792 |
| HPV45 | E1 | 400 | 11 | VMCRHYKRAQK | | 43793 |
| HPV45 | E1 | 236 | 10 | VNPTVAEGFK | | 43794 |
| HPV45 | E1 | 325 | 11 | VSGDTPEWIQR | | 43795 |
| HPV45 | E1 | 576 | 8 | VTVFTFPH | | 43796 |
| HPV45 | E1 | 17 | 10 | WFFVETIVEK | | 43797 |
| HPV45 | E1 | 17 | 11 | WFFVETIVEKK | | 43798 |
| HPV45 | E1 | 264 | 10 | WGVLILALLR | | 43799 |
| HPV45 | E1 | 264 | 11 | WGVLILALLRY | | 43800 |
| HPV45 | E1 | 418 | 8 | WIKYRCSK | | 43801 |
| HPV45 | E1 | 332 | 10 | WIQRLTIIQH | | 43802 |
| HPV45 | E1 | 502 | 9 | WLEPLADTK | | 43803 |
| HPV45 | E1 | 522 | 9 | WTYFDNYMR | | 43804 |
| HPV45 | E1 | 254 | 10 | YAHIQCLDCK | | 43805 |
| HPV45 | E1 | 478 | 8 | YFGMSFIH | | 43806 |
| HPV45 | E1 | 208 | 10 | YGLSFTDLVR | | 43807 |
| HPV45 | E1 | 469 | 8 | YGPANTGK | | 43808 |
| HPV45 | E1 | 469 | 10 | YGPANTGKY | | 43809 |
| HPV45 | E1 | 394 | 10 | YLKDCAVMCR | | 43810 |
| HPV45 | E1 | 394 | 11 | YLKDCAVMCRH | | 43811 |
| HPV45 | E2 | 156 | 10 | AACVSYWGVY | | 43812 |
| HPV45 | E2 | 156 | 11 | AACVSYWGVYY | | 43813 |
| HPV45 | E2 | 157 | 9 | ACVSYWGVY | | 43814 |
| HPV45 | E2 | 157 | 10 | ACVSYWGVYY | | 43815 |
| HPV45 | E2 | 78 | 9 | AIELQMALK | | 43816 |
| HPV45 | E2 | 47 | 9 | AILFTAREH | | 43817 |
| HPV45 | E2 | 84 | 9 | ALKGLAQSK | | 43818 |
| HPV45 | E2 | 84 | 10 | ALKGLAQSKY | | 43819 |
| HPV45 | E2 | 16 | 9 | ALQDKILDH | | 43820 |
| HPV45 | E2 | 16 | 10 | ALQDKILDHY | | 43821 |
| HPV45 | E2 | 234 | 9 | ASVGTPKPH | | 43822 |
| HPV45 | E2 | 216 | 10 | ATQIVRQLQH | | 43823 |
| HPV45 | E2 | 115 | 10 | CFKKGGKTVH | | 43824 |
| HPV45 | E2 | 254 | 8 | CGLTEQHH | | 43825 |
| HPV45 | E2 | 254 | 10 | CGLTEQHHGR | | 43826 |
| HPV45 | E2 | 305 | 8 | CLRYRLRK | | 43827 |
| HPV45 | E2 | 305 | 9 | CLRYRLRKY | | 43828 |
| HPV45 | E2 | 134 | 11 | CMNYVVWDSIY | | 43829 |
| HPV45 | E2 | 286 | 10 | CSGNTTPIIH | | 43830 |
| HPV45 | E2 | 274 | 8 | CSSTSNNK | | 43831 |
| HPV45 | E2 | 274 | 9 | CSSTSNNKR | | 43832 |
| HPV45 | E2 | 274 | 10 | CSSTSNNKRR | | 43833 |
| HPV45 | E2 | 274 | 11 | CSSTSNNKRRK | | 43834 |
| HPV45 | E2 | 158 | 8 | CVSYWGVY | | 43835 |
| HPV45 | E2 | 158 | 9 | CVSYWGVYY | | 43836 |
| HPV45 | E2 | 158 | 11 | CVSYWGVYYIK | | 43837 |
| HPV45 | E2 | 211 | 11 | DDTVSATQIVR | | 43838 |
| HPV45 | E2 | 169 | 11 | DGDTTYYVQFK | | 43839 |
| HPV45 | E2 | 128 | 10 | DGNKDNCMNY | | 43840 |
| HPV45 | E2 | 31 | 8 | DINSQISY | | 43841 |
| HPV45 | E2 | 28 | 11 | DSKDINSQISY | | 43842 |
| HPV45 | E2 | 171 | 9 | DTTYYVQFK | | 43843 |
| HPV45 | E2 | 212 | 10 | DTVSATQIVR | | 43844 |
| HPV45 | E2 | 45 | 9 | ENAILFTAR | | 43845 |
| HPV45 | E2 | 45 | 11 | ENAILFTAREH | | 43846 |
| HPV45 | E2 | 127 | 11 | FDGNKDNCMNY | | 43847 |
| HPV45 | E2 | 50 | 10 | FTAREHGITK | | 43848 |
| HPV45 | E2 | 298 | 10 | GDKNSLKCLR | | 43849 |
| HPV45 | E2 | 298 | 11 | GDKNSLKCLRY | | 43850 |
| HPV45 | E2 | 170 | 10 | GDTTYYVQFK | | 43851 |
| HPV45 | E2 | 119 | 8 | GGKTVHVY | | 43852 |
| HPV45 | E2 | 255 | 9 | GLTEQHHGR | | 43853 |
| HPV45 | E2 | 129 | 9 | GNKDNCMNY | | 43854 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV45 | E2 | 186 | 10 | GNSNTWEVQY | | 43855 |
| HPV45 | E2 | 288 | 8 | GNTTPIIH | | 43856 |
| HPV45 | E2 | 288 | 10 | GNTTPIIHLK | | 43857 |
| HPV45 | E2 | 225 | 8 | HASTSTPK | | 43858 |
| HPV45 | E2 | 55 | 8 | HGITKLNH | | 43859 |
| HPV45 | E2 | 261 | 9 | HGTVNTHVH | | 43860 |
| HPV45 | E2 | 242 | 8 | HIQTPATK | | 43861 |
| HPV45 | E2 | 242 | 9 | HIQTPATKR | | 43862 |
| HPV45 | E2 | 242 | 11 | HIQTPATKRPR | | 43863 |
| HPV45 | E2 | 295 | 10 | HLKGDKNSLK | | 43864 |
| HPV45 | E2 | 124 | 8 | HVYFDGNK | | 43865 |
| HPV45 | E2 | 293 | 8 | IIHLKGDK | | 43866 |
| HPV45 | E2 | 21 | 10 | ILDHYENDSK | | 43867 |
| HPV45 | E2 | 48 | 8 | ILFTAREH | | 43868 |
| HPV45 | E2 | 68 | 9 | INISKSKAH | | 43869 |
| HPV45 | E2 | 68 | 10 | INISKSKAHK | | 43870 |
| HPV45 | E2 | 70 | 8 | ISKSKAHK | | 43871 |
| HPV45 | E2 | 36 | 8 | ISYWQLIR | | 43872 |
| HPV45 | E2 | 146 | 9 | ITETGIWDK | | 43873 |
| HPV45 | E2 | 77 | 10 | KAIELQMALK | | 43874 |
| HPV45 | E2 | 304 | 8 | KCLRYRLR | | 43875 |
| HPV45 | E2 | 304 | 9 | KCLRYRLRK | | 43876 |
| HPV45 | E2 | 304 | 10 | KCLRYRLRKY | | 43877 |
| HPV45 | E2 | 168 | 8 | KDGDTTYY | | 43878 |
| HPV45 | E2 | 30 | 9 | KDINSQISY | | 43879 |
| HPV45 | E2 | 297 | 8 | KGDKNSLK | | 43880 |
| HPV45 | E2 | 297 | 11 | KGDKNSLKCLR | | 43881 |
| HPV45 | E2 | 118 | 9 | KGGKTVHVY | | 43882 |
| HPV45 | E2 | 86 | 8 | KGLAQSKY | | 43883 |
| HPV45 | E2 | 20 | 11 | KILDHYENDSK | | 43884 |
| HPV45 | E2 | 300 | 8 | KNSLKCLR | | 43885 |
| HPV45 | E2 | 300 | 9 | KNSLKCLRY | | 43886 |
| HPV45 | E2 | 300 | 10 | KNSLKCLRYR | | 43887 |
| HPV45 | E2 | 331 | 10 | KNTGILTVTY | | 43888 |
| HPV45 | E2 | 154 | 8 | KTAACVSY | | 43889 |
| HPV45 | E2 | 232 | 9 | KTASVGTPK | | 43890 |
| HPV45 | E2 | 232 | 11 | KTASVGTPKPH | | 43891 |
| HPV45 | E2 | 121 | 11 | KTVHVYFDGNK | | 43892 |
| HPV45 | E2 | 273 | 9 | LCSSTSNNK | | 43893 |
| HPV45 | E2 | 273 | 10 | LCSSTSNNKR | | 43894 |
| HPV45 | E2 | 273 | 11 | LCSSTSNNKRR | | 43895 |
| HPV45 | E2 | 22 | 9 | LDHYENDSK | | 43896 |
| HPV45 | E2 | 49 | 11 | LFTAREHGITK | | 43897 |
| HPV45 | E2 | 272 | 10 | LLCSSTSNNK | | 43898 |
| HPV45 | E2 | 272 | 11 | LLCSSTSNNKR | | 43899 |
| HPV45 | E2 | 14 | 11 | LSALQDKILDH | | 43900 |
| HPV45 | E2 | 10 | 11 | LSERLSALQDK | | 43901 |
| HPV45 | E2 | 256 | 8 | LTEQHHGR | | 43902 |
| HPV45 | E2 | 336 | 11 | LTVTYNSEVQR | | 43903 |
| HPV45 | E2 | 83 | 10 | MALKGLAQSK | | 43904 |
| HPV45 | E2 | 83 | 11 | MALKGLAQSKY | | 43905 |
| HPV45 | E2 | 135 | 10 | MNYVVWDSIY | | 43906 |
| HPV45 | E2 | 135 | 11 | MNYVVWDSIYY | | 43907 |
| HPV45 | E2 | 46 | 8 | NAILFTAR | | 43908 |
| HPV45 | E2 | 46 | 10 | NAILFTAREH | | 43909 |
| HPV45 | E2 | 69 | 8 | NISKSKAH | | 43910 |
| HPV45 | E2 | 69 | 9 | NISKSKAHK | | 43911 |
| HPV45 | E2 | 301 | 8 | NSLKCLRY | | 43912 |
| HPV45 | E2 | 301 | 9 | NSLKCLRYR | | 43913 |
| HPV45 | E2 | 301 | 11 | NSLKCLRYRLR | | 43914 |
| HPV45 | E2 | 187 | 9 | NSNTWEVQY | | 43915 |
| HPV45 | E2 | 33 | 11 | NSQISYWQLIR | | 43916 |
| HPV45 | E2 | 357 | 9 | NSVQISVGY | | 43917 |
| HPV45 | E2 | 109 | 9 | NTEPSQCFK | | 43918 |
| HPV45 | E2 | 109 | 10 | NTEPSQCFKK | | 43919 |
| HPV45 | E2 | 332 | 9 | NTGILTVTY | | 43920 |
| HPV45 | E2 | 289 | 9 | NTTPIIHLK | | 43921 |
| HPV45 | E2 | 292 | 9 | PIIHLKGDK | | 43922 |
| HPV45 | E2 | 67 | 8 | PINISKSK | | 43923 |
| HPV45 | E2 | 67 | 10 | PINISKSKAH | | 43924 |
| HPV45 | E2 | 67 | 11 | PINISKSKAHK | | 43925 |
| HPV45 | E2 | 271 | 11 | PLLCSSTSNNK | | 43926 |
| HPV45 | E2 | 356 | 10 | PNSVQISVGY | | 43927 |
| HPV45 | E2 | 112 | 10 | PSQCFKKGGK | | 43928 |
| HPV45 | E2 | 114 | 8 | QCFKKGGK | | 43929 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV45 | E2 | 114 | 11 | QCFKKGGKTVH | | 43930 |
| HPV45 | E2 | 253 | 8 | QCGLTEQH | | 43931 |
| HPV45 | E2 | 253 | 9 | QCGLTEQHH | | 43932 |
| HPV45 | E2 | 253 | 11 | QCGLTEQHHGR | | 43933 |
| HPV45 | E2 | 18 | 8 | QDKILDHY | | 43934 |
| HPV45 | E2 | 177 | 8 | QFKSECEK | | 43935 |
| HPV45 | E2 | 177 | 9 | QFKSECEKY | | 43936 |
| HPV45 | E2 | 35 | 9 | QISYWQLIR | | 43937 |
| HPV45 | E2 | 218 | 8 | QIVRQLQH | | 43938 |
| HPV45 | E2 | 222 | 11 | QLQHASTSTPK | | 43939 |
| HPV45 | E2 | 82 | 11 | QMALKGLAQSK | | 43940 |
| HPV45 | E2 | 244 | 9 | QTPATKRPR | | 43941 |
| HPV45 | E2 | 4 | 10 | QTPKESLSER | | 43942 |
| HPV45 | E2 | 63 | 10 | QVVPPINISK | | 43943 |
| HPV45 | E2 | 43 | 11 | RLENAILFTAR | | 43944 |
| HPV45 | E2 | 309 | 8 | RLRKYADH | | 43945 |
| HPV45 | E2 | 309 | 9 | RLRKYADHY | | 43946 |
| HPV45 | E2 | 13 | 8 | RLSALQDK | | 43947 |
| HPV45 | E2 | 15 | 10 | SALQDKILDH | | 43948 |
| HPV45 | E2 | 15 | 11 | SALQDKILDHY | | 43949 |
| HPV45 | E2 | 215 | 11 | SATQIVRQLQH | | 43950 |
| HPV45 | E2 | 287 | 9 | SGNTTPIIH | | 43951 |
| HPV45 | E2 | 287 | 11 | SGNTTPIIHLK | | 43952 |
| HPV45 | E2 | 302 | 8 | SLKCLRYR | | 43953 |
| HPV45 | E2 | 302 | 10 | SLKCLRYRLR | | 43954 |
| HPV45 | E2 | 302 | 11 | SLKCLRYRLRK | | 43955 |
| HPV45 | E2 | 188 | 8 | SNTWEVQY | | 43956 |
| HPV45 | E2 | 275 | 8 | SSTSNNKR | | 43957 |
| HPV45 | E2 | 275 | 9 | SSTSNNKRR | | 43958 |
| HPV45 | E2 | 275 | 10 | SSTSNNKRRK | | 43959 |
| HPV45 | E2 | 321 | 11 | SSTWHWTGCNK | | 43960 |
| HPV45 | E2 | 276 | 8 | STSNNKRR | | 43961 |
| HPV45 | E2 | 276 | 9 | STSNNKRRK | | 43962 |
| HPV45 | E2 | 322 | 10 | STWHWTGCNK | | 43963 |
| HPV45 | E2 | 235 | 8 | SVGTPKPH | | 43964 |
| HPV45 | E2 | 358 | 8 | SVQISVGY | | 43965 |
| HPV45 | E2 | 155 | 11 | TAACVSYWGVY | | 43966 |
| HPV45 | E2 | 51 | 9 | TAREHGITK | | 43967 |
| HPV45 | E2 | 233 | 8 | TASVGTPK | | 43968 |
| HPV45 | E2 | 233 | 10 | TASVGTPKPH | | 43969 |
| HPV45 | E2 | 333 | 8 | TGILTVTY | | 43970 |
| HPV45 | E2 | 277 | 8 | TSNNKRRK | | 43971 |
| HPV45 | E2 | 290 | 8 | TTPIIHLK | | 43972 |
| HPV45 | E2 | 290 | 11 | TTPIIHLKGDK | | 43973 |
| HPV45 | E2 | 172 | 8 | TTYYVQFK | | 43974 |
| HPV45 | E2 | 122 | 10 | TVHVYFDGNK | | 43975 |
| HPV45 | E2 | 213 | 9 | TVSATQIVR | | 43976 |
| HPV45 | E2 | 337 | 10 | TVTYNSEVQR | | 43977 |
| HPV45 | E2 | 285 | 11 | VCSGNTTPIIH | | 43978 |
| HPV45 | E2 | 214 | 8 | VSATQIVR | | 43979 |
| HPV45 | E2 | 159 | 8 | VSYWGVYY | | 43980 |
| HPV45 | E2 | 159 | 10 | VSYWGVYYIK | | 43981 |
| HPV45 | E2 | 338 | 9 | VTYNSEVQR | | 43982 |
| HPV45 | E2 | 64 | 9 | VVPPINISK | | 43983 |
| HPV45 | E2 | 64 | 11 | VVPPINISKSK | | 43984 |
| HPV45 | E2 | 138 | 8 | VVWDSIYY | | 43985 |
| HPV45 | E2 | 152 | 10 | WDKTAACVSY | | 43986 |
| HPV45 | E2 | 108 | 10 | WNTEPSQCFK | | 43987 |
| HPV45 | E2 | 108 | 11 | WNTEPSQCFKK | | 43988 |
| HPV45 | E2 | 185 | 11 | YGNSNTWEVQY | | 43989 |
| HPV45 | E2 | 166 | 9 | YIKDGDTTY | | 43990 |
| HPV45 | E2 | 166 | 10 | YIKDGDTTYY | | 43991 |
| HPV45 | E2 | 145 | 10 | YITETGIWDK | | 43992 |
| HPV45 | E2 | 317 | 9 | YSEISSTWH | | 43993 |
| HPV45 | E2 | 175 | 10 | YVQFKSECEK | | 43994 |
| HPV45 | E2 | 175 | 11 | YVQFKSECEKY | | 43995 |
| HPV45 | E2 | 137 | 8 | YVVWDSIY | | 43996 |
| HPV45 | E2 | 137 | 9 | YVVWDSIYY | | 43997 |
| HPV45 | E6 | 63 | 10 | AACHKCIDFY | | 43998 |
| HPV45 | E6 | 64 | 9 | ACHKCIDFY | | 43999 |
| HPV45 | E6 | 64 | 11 | ACHKCIDFYSR | | 44000 |
| HPV45 | E6 | 31 | 11 | ACVYCKATLER | | 44001 |
| HPV45 | E6 | 48 | 9 | AFKDLFIVY | | 44002 |
| HPV45 | E6 | 48 | 10 | AFKDLFIVYR | | 44003 |
| HPV45 | E6 | 37 | 9 | ATLERTEVY | | 44004 |

TABLE XVII-continued

All Motif Peptides

| Type | Protein | Position | No. of Amino Acids | Sequence | A*1101 | Seq. Id. No. |
|---|---|---|---|---|---|---|
| HPV45 | E6 | 141 | 9 | CCDQARQER | | 44005 |
| HPV45 | E6 | 141 | 11 | CCDQARQERLR | | 44006 |
| HPV45 | E6 | 142 | 8 | CDQARQER | | 44007 |
| HPV45 | E6 | 142 | 10 | CDQARQERLR | | 44008 |
| HPV45 | E6 | 142 | 11 | CDQARQERLRR | | 44009 |
| HPV45 | E6 | 59 | 8 | CIAYAACH | | 44010 |
| HPV45 | E6 | 59 | 9 | CIAYAACHK | | 44011 |
| HPV45 | E6 | 68 | 9 | CIDFYSRIR | 0.0001 | 44012 |
| HPV45 | E6 | 138 | 9 | CNTCCDQAR | | 44013 |
| HPV45 | E6 | 32 | 10 | CVYCKATLER | | 44014 |
| HPV45 | E6 | 58 | 9 | DCIAYAACH | | 44015 |
| HPV45 | E6 | 58 | 10 | DCIAYAACHK | | 44016 |
| HPV45 | E6 | 5 | 8 | DDPTQRPY | | 44017 |
| HPV45 | E6 | 5 | 9 | DDPTQRPYK | | 44018 |
| HPV45 | E6 | 70 | 10 | DFYSRIRELR | 0.0001 | 44019 |
| HPV45 | E6 | 70 | 11 | DFYSRIRELRY | | 44020 |
| HPV45 | E6 | 27 | 8 | DVSIACVY | | 44021 |
| HPV45 | E6 | 27 | 10 | DVSIACVYCK | | 44022 |
| HPV45 | E6 | 77 | 10 | ELRYYSNSVY | | 44023 |
| HPV45 | E6 | 97 | 8 | ELYNLLIR | | 44024 |
| HPV45 | E6 | 97 | 11 | ELYNLLIRCLR | | 44025 |
| HPV45 | E6 | 43 | 8 | EVYQFAFK | | 44026 |
| HPV45 | E6 | 47 | 10 | FAFKDLFIVY | | 44027 |
| HPV45 | E6 | 47 | 11 | FAFKDLFIVYR | | 44028 |
| HPV45 | E6 | 4 | 9 | FDDPTQRPY | | 44029 |
| HPV45 | E6 | 4 | 10 | FDDPTQRPYK | | 44030 |
| HPV45 | E6 | 53 | 10 | FIVYRDCIAY | | 44031 |
| HPV45 | E6 | 120 | 9 | HLKDKRRFH | | 44032 |
| HPV45 | E6 | 128 | 8 | HSIAGQYR | | 44033 |
| HPV45 | E6 | 60 | 8 | IAYAACHK | | 44034 |
| HPV45 | E6 | 69 | 8 | IDFYSRIR | | 44035 |
| HPV45 | E6 | 69 | 11 | IDFYSRIRELR | | 44036 |
| HPV45 | E6 | 54 | 9 | IVYRDCIAY | | 44037 |
| HPV45 | E6 | 36 | 10 | KATLERTEVY | | 44038 |
| HPV45 | E6 | 67 | 8 | KCIDFYSR | | 44039 |
| HPV45 | E6 | 67 | 10 | KCIDFYSRIR | | 44040 |
| HPV45 | E6 | 50 | 8 | KDLFIVYR | | 44041 |
| HPV45 | E6 | 92 | 8 | KITNETELY | | 44042 |
| HPV45 | E6 | 52 | 11 | LFIVYRDCIAY | | 44043 |
| HPV45 | E6 | 102 | 9 | LIRCLRCQK | 0.0012 | 44044 |
| HPV45 | E6 | 101 | 10 | LLIRCLRCQK | 0.1200 | 44045 |
| HPV45 | E6 | 112 | 8 | LNPAEKRR | | 44046 |
| HPV45 | E6 | 112 | 9 | LNPAEKRRH | | 44047 |
| HPV45 | E6 | 112 | 11 | LNPAEKRRHLK | | 44048 |
| HPV45 | E6 | 1 | 10 | MARFDDPTQR | | 44049 |
| HPV45 | E6 | 100 | 8 | NLLIRCLR | | 44050 |
| HPV45 | E6 | 100 | 11 | NLLIRCLRCQK | | 44051 |
| HPV45 | E6 | 83 | 10 | NSVYGETLEK | | 44052 |
| HPV45 | E6 | 139 | 8 | NTCCDQAR | | 44053 |
| HPV45 | E6 | 139 | 11 | NTCCDQARQER | | 44054 |
| HPV45 | E6 | 95 | 10 | NTELYNLLIR | | 44055 |
| HPV45 | E6 | 114 | 9 | PAEKRRHLK | | 44056 |
| HPV45 | E6 | 114 | 11 | PAEKRRHLKDK | | 44057 |
| HPV45 | E6 | 111 | 8 | PLNPAEKR | | 44058 |
| HPV45 | E6 | 111 | 9 | PLNPAEKRR | | 44059 |
| HPV45 | E6 | 111 | 10 | PLNPAEKRRH | | 44060 |
| HPV45 | E6 | 144 | 8 | QARQERLR | | 44061 |
| HPV45 | E6 | 144 | 9 | QARQERLRR | | 44062 |
| HPV45 | E6 | 144 | 10 | QARQERLRRR | | 44063 |
| HPV45 | E6 | 144 | 11 | QARQERLRRRR | | 44064 |
| HPV45 | E6 | 137 | 10 | QCNTCCDQAR | | 44065 |
| HPV45 | E6 | 26 | 9 | QDVSIACVY | | 44066 |
| HPV45 | E6 | 26 | 11 | QDVSIACVYCK | | 44067 |
| HPV45 | E6 | 46 | 11 | QFAFKDLFIVY | | 44068 |
| HPV45 | E6 | 107 | 11 | RCQKPLNPAEK | | 44069 |
| HPV45 | E6 | 57 | 10 | RDCIAYAACH | | 44070 |
| HPV45 | E6 | 57 | 11 | RDCIAYAACHK | | 44071 |
| HPV45 | E6 | 3 | 8 | RFDDPTQR | | 44072 |
| HPV45 | E6 | 3 | 10 | RFDDPTQRPY | | 44073 |
| HPV45 | E6 | 3 | 11 | RFDDPTQRPYK | | 44074 |
| HPV45 | E6 | 126 | 9 | RFHSIAGQY | | 44075 |
| HPV45 | E6 | 126 | 10 | RFHSIAGQYR | | 44076 |
| HPV45 | E6 | 74 | 8 | RIRELRYY | | 44077 |
| HPV45 | E6 | 41 | 10 | RTEVYQFAFK | | 44078 |
| HPV45 | E6 | 29 | 8 | SIACVYCK | | 44079 |

TABLE XVII-continued

A11 Motif Peptides

| Type | Protein | Position | No. of Amino Acids | Sequence | A*1101 | Seq. Id. No. |
|---|---|---|---|---|---|---|
| HPV45 | E6 | 24 | 11 | SLQDVSIACVY | | 44080 |
| HPV45 | E6 | 82 | 11 | SNSVYGETLEK | | 44081 |
| HPV45 | E6 | 84 | 9 | SVYGETLEK | | 44082 |
| HPV45 | E6 | 140 | 10 | TCCDQARQER | | 44083 |
| HPV45 | E6 | 89 | 11 | TLEKITNTELY | | 44084 |
| HPV45 | E6 | 38 | 8 | TLERTEVY | | 44085 |
| HPV45 | E6 | 94 | 11 | TNTELYNLLIR | | 44086 |
| HPV45 | E6 | 28 | 9 | VSIACVYCK | | 44087 |
| HPV45 | E6 | 62 | 11 | YAACHKCIDFY | | 44088 |
| HPV45 | E6 | 34 | 8 | YCKATLER | | 44089 |
| HPV45 | E6 | 99 | 9 | YNLLIRCLR | | 44090 |
| HPV45 | E6 | 72 | 8 | YSRIRELR | | 44091 |
| HPV45 | E6 | 72 | 9 | YSRIRELRY | | 44092 |
| HPV45 | E6 | 72 | 10 | YSRIRELRYY | | 44093 |
| HPV45 | E7 | 6 | 9 | ATLQEIVLH | | 44094 |
| HPV45 | E7 | 64 | 9 | CVCCKCDGR | | 44095 |
| HPV45 | E7 | 43 | 11 | DGVSHAQLPAR | | 44096 |
| HPV45 | E7 | 20 | 10 | ELDPVDLLCY | | 44097 |
| HPV45 | E7 | 38 | 10 | ENDEADGVSH | | 44098 |
| HPV45 | E7 | 78 | 8 | ESSADDLR | | 44099 |
| HPV45 | E7 | 44 | 10 | GVSHAQLPAR | | 44100 |
| HPV45 | E7 | 44 | 11 | GVSHAQLPARR | | 44101 |
| HPV45 | E7 | 47 | 8 | HAQLPARR | | 44102 |
| HPV45 | E7 | 62 | 11 | ILCVCCKCDGR | | 44103 |
| HPV45 | E7 | 61 | 8 | KILCVCCK | | 44104 |
| HPV45 | E7 | 63 | 10 | LCVCCKCDGR | | 44105 |
| HPV45 | E7 | 21 | 9 | LDPVDLLCY | | 44106 |
| HPV45 | E7 | 75 | 11 | LTVESSADDLR | | 44107 |
| HPV45 | E7 | 39 | 9 | NDEADGVSH | | 44108 |
| HPV45 | E7 | 51 | 9 | PARRAEPQR | | 44109 |
| HPV45 | E7 | 51 | 10 | PARRAEPQRH | | 44110 |
| HPV45 | E7 | 51 | 11 | PARRAEPQRHK | | 44111 |
| HPV45 | E7 | 49 | 11 | QLPARRAEPQR | | 44112 |
| HPV45 | E7 | 54 | 8 | RAEPQRHK | | 44113 |
| HPV45 | E7 | 5 | 10 | RATLQEIVLH | | 44114 |
| HPV45 | E7 | 7 | 8 | TLQEIVLH | | 44115 |
| HPV45 | E7 | 76 | 10 | TVESSADDLR | | 44116 |
| HPV45 | E7 | 65 | 8 | VCCKCDGR | | 44117 |
| HPV45 | E7 | 45 | 9 | VSHAQLPAR | | 44118 |
| HPV45 | E7 | 45 | 10 | VSHAQLPARR | | 44119 |
| HPV45 | L1 | 517 | 9 | AASTSTASR | | 44120 |
| HPV45 | L1 | 161 | 11 | AATAVITQDVR | | 44121 |
| HPV45 | L1 | 128 | 9 | ACVGMEIGR | | 44122 |
| HPV45 | L1 | 83 | 9 | AGNKQAVPK | | 44123 |
| HPV45 | L1 | 191 | 8 | AIGEHWAK | | 44124 |
| HPV45 | L1 | 28 | 11 | ALWRPSDSTVY | | 44125 |
| HPV45 | L1 | 234 | 11 | AMDFSTLQDTK | | 44126 |
| HPV45 | L1 | 523 | 9 | ASRPAKRVR | | 44127 |
| HPV45 | L1 | 523 | 11 | ASRPAKRVRIR | | 44128 |
| HPV45 | L1 | 375 | 11 | ASTQNPVPNTY | | 44129 |
| HPV45 | L1 | 518 | 8 | ASTSTASR | | 44130 |
| HPV45 | L1 | 518 | 11 | ASTSTASRPAK | | 44131 |
| HPV45 | L1 | 162 | 10 | ATAVITQDVR | | 44132 |
| HPV45 | L1 | 164 | 8 | AVITQDVR | | 44133 |
| HPV45 | L1 | 88 | 8 | AVPKVSAY | | 44134 |
| HPV45 | L1 | 88 | 10 | AVPKVSAYQY | | 44135 |
| HPV45 | L1 | 88 | 11 | AVPKVSAYQYR | | 44136 |
| HPV45 | L1 | 276 | 10 | CLRREQLFAR | | 44137 |
| HPV45 | L1 | 276 | 11 | CLRREQLFARH | | 44138 |
| HPV45 | L1 | 129 | 8 | CVGMEIGR | | 44139 |
| HPV45 | L1 | 188 | 8 | CVPAIGEH | | 44140 |
| HPV45 | L1 | 188 | 11 | CVPAIGEHWAK | | 44141 |
| HPV45 | L1 | 211 | 8 | DCPPLELK | | 44142 |
| HPV45 | L1 | 51 | 11 | DDYVSRTSIFY | | 44143 |
| HPV45 | L1 | 236 | 9 | DFSTLQDTK | | 44144 |
| HPV45 | L1 | 224 | 9 | DGDMVDTGY | | 44145 |
| HPV45 | L1 | 250 | 8 | DICQSICK | | 44146 |
| HPV45 | L1 | 250 | 9 | DICQSICKY | | 44147 |
| HPV45 | L1 | 488 | 9 | DLDQYPLGR | | 44148 |
| HPV45 | L1 | 488 | 10 | DLDQYPLGRK | | 44149 |
| HPV45 | L1 | 172 | 8 | DNVSVDYK | | 44150 |
| HPV45 | L1 | 271 | 8 | DSMFFCLR | | 44151 |
| HPV45 | L1 | 271 | 9 | DSMFFCLRR | | 44152 |
| HPV45 | L1 | 332 | 9 | DSQLFNKPY | | 44153 |
| HPV45 | L1 | 114 | 11 | DSTIYNPETQR | | 44154 |

TABLE XVII-continued

A11 Motif Peptides

| Type | Protein | Position | No. of Amino Acids | Sequence | A*1101 | Seq. Id. No. |
|---|---|---|---|---|---|---|
| HPV45 | L1 | 461 | 11 | DTTPPEKQDPY | | 44155 |
| HPV45 | L1 | 296 | 8 | DTVPTDLY | | 44156 |
| HPV45 | L1 | 296 | 10 | DTVPTDLYIK | | 44157 |
| HPV45 | L1 | 169 | 10 | DVRDNVSVDY | | 44158 |
| HPV45 | L1 | 169 | 11 | DVRDNVSVDYK | | 44159 |
| HPV45 | L1 | 223 | 10 | EDGDMVDTGY | | 44160 |
| HPV45 | L1 | 313 | 8 | ETPGSCVY | | 44161 |
| HPV45 | L1 | 283 | 8 | FARHFWNR | | 44162 |
| HPV45 | L1 | 275 | 11 | FCLRREQLFAR | | 44163 |
| HPV45 | L1 | 110 | 9 | FGLPDSTIY | | 44164 |
| HPV45 | L1 | 24 | 8 | FLQMALWR | | 44165 |
| HPV45 | L1 | 498 | 8 | FLVQAGLR | | 44166 |
| HPV45 | L1 | 498 | 9 | FLVQAGLRR | | 44167 |
| HPV45 | L1 | 498 | 10 | FLVQAGLRRR | | 44168 |
| HPV45 | L1 | 336 | 8 | FNKPYWLH | | 44169 |
| HPV45 | L1 | 336 | 9 | FNKPYWLHK | | 44170 |
| HPV45 | L1 | 485 | 8 | FSSDLDQY | | 44171 |
| HPV45 | L1 | 237 | 8 | FSTLQDTK | | 44172 |
| HPV45 | L1 | 450 | 11 | FVQSVAVTCQK | | 44173 |
| HPV45 | L1 | 359 | 9 | FVTVVDTTR | | 44174 |
| HPV45 | L1 | 82 | 10 | GAGNKQAVPK | | 44175 |
| HPV45 | L1 | 187 | 9 | GCVPAIGEH | | 44176 |
| HPV45 | L1 | 210 | 9 | GDCPPLELK | | 44177 |
| HPV45 | L1 | 225 | 8 | GDMVDTGY | | 44178 |
| HPV45 | L1 | 270 | 9 | GDSMFFCLR | | 44179 |
| HPV45 | L1 | 270 | 10 | GDSMFFCLRR | | 44180 |
| HPV45 | L1 | 295 | 9 | GDTVPTDLY | | 44181 |
| HPV45 | L1 | 295 | 11 | GDTVPTDLYIK | | 44182 |
| HPV45 | L1 | 141 | 10 | GIGLSGHPFY | | 44183 |
| HPV45 | L1 | 111 | 8 | GLPDSTIY | | 44184 |
| HPV45 | L1 | 503 | 11 | GLRRRPTIGPR | | 44185 |
| HPV45 | L1 | 143 | 8 | GLSGHPFY | | 44186 |
| HPV45 | L1 | 143 | 10 | GLSGHPFYNK | | 44187 |
| HPV45 | L1 | 84 | 8 | GNKQAVPK | | 44188 |
| HPV45 | L1 | 9 | 8 | HGIIIFLK | | 44189 |
| HPV45 | L1 | 348 | 8 | HNNGICWH | | 44190 |
| HPV45 | L1 | 251 | 8 | ICQSICKY | | 44191 |
| HPV45 | L1 | 251 | 11 | ICQSICKYPDY | | 44192 |
| HPV45 | L1 | 23 | 9 | IFLQMALWR | | 44193 |
| HPV45 | L1 | 59 | 9 | IFYHAGSSR | | 44194 |
| HPV45 | L1 | 142 | 9 | IGLSGHPFY | | 44195 |
| HPV45 | L1 | 142 | 11 | IGLSGHPFYNK | | 44196 |
| HPV45 | L1 | 185 | 11 | ILGCVPAIGEH | | 44197 |
| HPV45 | L1 | 411 | 10 | ITLTAEVMSY | | 44198 |
| HPV45 | L1 | 328 | 11 | ITTSDSQLFNK | | 44199 |
| HPV45 | L1 | 460 | 8 | KDTTPPEK | | 44200 |
| HPV45 | L1 | 109 | 10 | KFGLPDSTIY | | 44201 |
| HPV45 | L1 | 389 | 8 | KFKHYSRH | | 44202 |
| HPV45 | L1 | 497 | 9 | KFLVQAGLR | | 44203 |
| HPV45 | L1 | 497 | 10 | KFLVQAGLRR | | 44204 |
| HPV45 | L1 | 497 | 11 | KFLVQAGLRRR | | 44205 |
| HPV45 | L1 | 484 | 9 | KFSSDLDQY | | 44206 |
| HPV45 | L1 | 475 | 8 | KFWTVDLK | | 44207 |
| HPV45 | L1 | 475 | 10 | KFWTVDLKEK | | 44208 |
| HPV45 | L1 | 305 | 8 | KGTSANMR | | 44209 |
| HPV45 | L1 | 152 | 9 | KLDDTESAH | | 44210 |
| HPV45 | L1 | 473 | 10 | KLKFWTVDLK | | 44211 |
| HPV45 | L1 | 91 | 8 | KVSAYQYR | | 44212 |
| HPV45 | L1 | 91 | 11 | KVSAYQYRVFR | | 44213 |
| HPV45 | L1 | 153 | 8 | LDDTESAH | | 44214 |
| HPV45 | L1 | 249 | 9 | LDICQSICK | | 44215 |
| HPV45 | L1 | 249 | 10 | LDICQSICKY | | 44216 |
| HPV45 | L1 | 489 | 8 | LDQYPLGR | | 44217 |
| HPV45 | L1 | 489 | 9 | LDQYPLGRK | | 44218 |
| HPV45 | L1 | 282 | 9 | LFARHFWNR | | 44219 |
| HPV45 | L1 | 335 | 9 | LFNKPYWLH | | 44220 |
| HPV45 | L1 | 335 | 10 | LFNKPYWLHK | | 44221 |
| HPV45 | L1 | 358 | 10 | LFVTVVDTTR | | 44222 |
| HPV45 | L1 | 186 | 10 | LGCVPAIGEH | | 44223 |
| HPV45 | L1 | 140 | 8 | LGIGLSGH | | 44224 |
| HPV45 | L1 | 140 | 11 | LGIGLSGHPFY | | 44225 |
| HPV45 | L1 | 68 | 8 | LLTVGNPY | | 44226 |
| HPV45 | L1 | 68 | 10 | LLTVGNPYFR | | 44227 |
| HPV45 | L1 | 144 | 9 | LSGHPFYNK | | 44228 |
| HPV45 | L1 | 413 | 8 | LTAEVMSY | | 44229 |

TABLE XVII-continued

A11 Motif Peptides

| Type | Protein | Position | No. of Amino Acids | Sequence | A*1101 | Seq. Id. No. |
|---|---|---|---|---|---|---|
| HPV45 | L1 | 413 | 10 | LTAEVMSYIH | | 44230 |
| HPV45 | L1 | 69 | 9 | LTVGNPYFR | | 44231 |
| HPV45 | L1 | 499 | 8 | LVQAGLRR | | 44232 |
| HPV45 | L1 | 499 | 9 | LVQAGLRRR | | 44233 |
| HPV45 | L1 | 1 | 9 | MAHNIIYGH | | 44234 |
| HPV45 | L1 | 235 | 10 | MDFSTLQDTK | | 44235 |
| HPV45 | L1 | 294 | 10 | MGDTVPTDLY | | 44236 |
| HPV45 | L1 | 310 | 11 | NMRETPGSCVY | | 44237 |
| HPV45 | L1 | 49 | 8 | NTDDYVSR | | 44238 |
| HPV45 | L1 | 383 | 9 | NTYDPTKFK | | 44239 |
| HPV45 | L1 | 383 | 10 | NTYDPTKFKH | | 44240 |
| HPV45 | L1 | 383 | 11 | NTYDPTKFKHY | | 44241 |
| HPV45 | L1 | 516 | 10 | PAASTSTASR | | 44242 |
| HPV45 | L1 | 190 | 9 | PAIGEHWAK | | 44243 |
| HPV45 | L1 | 526 | 8 | PAKRVRIR | | 44244 |
| HPV45 | L1 | 526 | 10 | PAKRVRIRSK | | 44245 |
| HPV45 | L1 | 526 | 11 | PAKRVRIRSKK | | 44246 |
| HPV45 | L1 | 259 | 11 | PDYLQMSADPY | | 44247 |
| HPV45 | L1 | 209 | 10 | PGDCPPLELK | | 44248 |
| HPV45 | L1 | 22 | 10 | PIFLQMALWR | | 44249 |
| HPV45 | L1 | 248 | 10 | PLDICQSICK | | 44250 |
| HPV45 | L1 | 248 | 11 | PLDICQSICKY | | 44251 |
| HPV45 | L1 | 139 | 9 | PLGIGLSGH | | 44252 |
| HPV45 | L1 | 382 | 8 | PNTYDPTK | | 44253 |
| HPV45 | L1 | 382 | 10 | PNTYDPTKFK | | 44254 |
| HPV45 | L1 | 382 | 11 | PNTYDPTKFKH | | 44255 |
| HPV45 | L1 | 508 | 8 | PTIGPRKR | | 44256 |
| HPV45 | L1 | 387 | 9 | PTKFKHYSR | | 44257 |
| HPV45 | L1 | 387 | 10 | PTKFKHYSRH | | 44258 |
| HPV45 | L1 | 440 | 9 | PTTSLVDTY | | 44259 |
| HPV45 | L1 | 440 | 10 | PTTSLVDTYR | | 44260 |
| HPV45 | L1 | 380 | 10 | PVPNTYDPTK | | 44261 |
| HPV45 | L1 | 87 | 9 | QAVPKVSAY | | 44262 |
| HPV45 | L1 | 87 | 11 | QAVPKVSAYQY | | 44263 |
| HPV45 | L1 | 468 | 8 | QDPYDKLK | | 44264 |
| HPV45 | L1 | 168 | 11 | QDVRDNVSVDY | | 44265 |
| HPV45 | L1 | 346 | 10 | QGHNNGICWH | | 44266 |
| HPV45 | L1 | 281 | 10 | QLFARHFWNR | | 44267 |
| HPV45 | L1 | 334 | 10 | QLFNKPYWLH | | 44268 |
| HPV45 | L1 | 334 | 11 | QLFNKPYWLHK | | 44269 |
| HPV45 | L1 | 357 | 11 | QLFVTVVDTTR | | 44270 |
| HPV45 | L1 | 378 | 8 | QNPVPNTY | | 44271 |
| HPV45 | L1 | 253 | 9 | QSICKYPDY | | 44272 |
| HPV45 | L1 | 452 | 9 | QSVAVTCQK | | 44273 |
| HPV45 | L1 | 171 | 8 | RDNVSVDY | | 44274 |
| HPV45 | L1 | 171 | 9 | RDNVSVDYK | | 44275 |
| HPV45 | L1 | 67 | 9 | RLLTVGNPY | | 44276 |
| HPV45 | L1 | 67 | 11 | RLLTVGNPYFR | | 44277 |
| HPV45 | L1 | 101 | 9 | RVALPDPNK | | 44278 |
| HPV45 | L1 | 529 | 8 | RVRIRSKK | | 44279 |
| HPV45 | L1 | 46 | 8 | RVVNTDDY | | 44280 |
| HPV45 | L1 | 46 | 11 | RVVNTDDYVSR | | 44281 |
| HPV45 | L1 | 77 | 10 | RVVPSGAGNK | | 44282 |
| HPV45 | L1 | 93 | 9 | SAYQYRVFR | | 44283 |
| HPV45 | L1 | 487 | 10 | SDLDQYPLGR | | 44284 |
| HPV45 | L1 | 487 | 11 | SDLDQYPLGRK | | 44285 |
| HPV45 | L1 | 331 | 8 | SDSQLFNK | | 44286 |
| HPV45 | L1 | 331 | 10 | SDSQLFNKPY | | 44287 |
| HPV45 | L1 | 81 | 11 | SGAGNKQAVPK | | 44288 |
| HPV45 | L1 | 145 | 8 | SGHPFYNK | | 44289 |
| HPV45 | L1 | 254 | 8 | SICKYPDY | | 44290 |
| HPV45 | L1 | 58 | 10 | SIFYHAGSSR | | 44291 |
| HPV45 | L1 | 272 | 8 | SMFFCLRR | | 44292 |
| HPV45 | L1 | 486 | 11 | SSDLDQYPLGR | | 44293 |
| HPV45 | L1 | 65 | 11 | SSRLLTVGNPY | | 44294 |
| HPV45 | L1 | 521 | 8 | STASRPAK | | 44295 |
| HPV45 | L1 | 521 | 9 | STASRPAKR | | 44296 |
| HPV45 | L1 | 521 | 11 | STASRPAKRVR | | 44297 |
| HPV45 | L1 | 115 | 10 | STIYNPETQR | | 44298 |
| HPV45 | L1 | 376 | 10 | STQNPVPNTY | | 44299 |
| HPV45 | L1 | 519 | 10 | STSTASRPAK | | 44300 |
| HPV45 | L1 | 519 | 11 | STSTASRPAKR | | 44301 |
| HPV45 | L1 | 43 | 11 | SVARVVNTDDY | | 44302 |
| HPV45 | L1 | 453 | 8 | SVAVTCQK | | 44303 |
| HPV45 | L1 | 414 | 9 | TAEVMSYIH | | 44304 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV45 | L1 | 522 | 8 | TASRPAKR | | 44305 |
| HPV45 | L1 | 522 | 10 | TASRPAKRVR | | 44306 |
| HPV45 | L1 | 163 | 9 | TAVITQDVR | | 44307 |
| HPV45 | L1 | 457 | 11 | TCQKDTTPPEK | | 44308 |
| HPV45 | L1 | 410 | 11 | TITLTAEVMSY | | 44309 |
| HPV45 | L1 | 116 | 9 | TIYNPETQR | | 44310 |
| HPV45 | L1 | 412 | 9 | TLTAEVMSY | | 44311 |
| HPV45 | L1 | 412 | 11 | TLTAEVMSYIH | | 44312 |
| HPV45 | L1 | 330 | 9 | TSDSQLFNK | | 44313 |
| HPV45 | L1 | 330 | 11 | TSDSQLFNKPY | | 44314 |
| HPV45 | L1 | 57 | 11 | TSIFYHAGSSR | | 44315 |
| HPV45 | L1 | 442 | 8 | TSLVDTYR | | 44316 |
| HPV45 | L1 | 520 | 9 | TSTASRPAK | | 44317 |
| HPV45 | L1 | 520 | 10 | TSTASRPAKR | | 44318 |
| HPV45 | L1 | 462 | 10 | TTPPEKQDPY | | 44319 |
| HPV45 | L1 | 329 | 10 | TTSDSQLFNK | | 44320 |
| HPV45 | L1 | 441 | 8 | TTSLVDTY | | 44321 |
| HPV45 | L1 | 441 | 9 | TTSLVDTYR | | 44322 |
| HPV45 | L1 | 70 | 8 | TVGNPYFR | | 44323 |
| HPV45 | L1 | 297 | 9 | TVPTDLYIK | | 44324 |
| HPV45 | L1 | 36 | 11 | TVYLPPPSVAR | | 44325 |
| HPV45 | L1 | 102 | 8 | VALPDPNK | | 44326 |
| HPV45 | L1 | 44 | 10 | VARVVNTDDY | | 44327 |
| HPV45 | L1 | 99 | 11 | VFRVALPDPNK | | 44328 |
| HPV45 | L1 | 293 | 11 | VMGDTVPTDLY | | 44329 |
| HPV45 | L1 | 48 | 9 | VNTDDYVSR | | 44330 |
| HPV45 | L1 | 92 | 10 | VSAYQYRVFR | | 44331 |
| HPV45 | L1 | 54 | 8 | VSRTSIFY | | 44332 |
| HPV45 | L1 | 54 | 9 | VSRTSIFYH | | 44333 |
| HPV45 | L1 | 360 | 8 | VTVVDTTR | | 44334 |
| HPV45 | L1 | 47 | 10 | VVNTDDYVSR | | 44335 |
| HPV45 | L1 | 78 | 9 | VVPSGAGNK | | 44336 |
| HPV45 | L1 | 127 | 10 | WACVGMEIGR | | 44337 |
| HPV45 | L1 | 196 | 8 | WAKGTLCK | | 44338 |
| HPV45 | L1 | 341 | 8 | WLHKAQGH | | 44339 |
| HPV45 | L1 | 477 | 8 | WTVDLKEK | | 44340 |
| HPV45 | L1 | 385 | 8 | YDPTKFKH | | 44341 |
| HPV45 | L1 | 385 | 9 | YDPTKFKHY | | 44342 |
| HPV45 | L1 | 385 | 11 | YDPTKFKHYSR | | 44343 |
| HPV45 | L1 | 269 | 10 | YGDSMFFCLR | | 44344 |
| HPV45 | L1 | 269 | 11 | YGDSMFFCLRR | | 44345 |
| HPV45 | L1 | 7 | 10 | YGHGIIIFLK | | 44346 |
| HPV45 | L1 | 303 | 10 | YIKGTSANMR | | 44347 |
| HPV45 | L1 | 38 | 9 | YLPPPSVAR | | 44348 |
| HPV45 | L1 | 261 | 9 | YLQMSADPY | | 44349 |
| HPV45 | L1 | 150 | 11 | YNKLDDTESAH | | 44350 |
| HPV45 | L1 | 393 | 8 | YSRHVEEY | | 44351 |
| HPV45 | L1 | 53 | 9 | YVSRTSIFY | | 44352 |
| HPV45 | L1 | 53 | 10 | YVSRTSIFYH | | 44353 |
| HPV45 | L2 | 286 | 10 | ALSSRRGTVR | | 44354 |
| HPV45 | L2 | 12 | 8 | ASATDLYR | | 44355 |
| HPV45 | L2 | 12 | 11 | ASATDLYRTCK | | 44356 |
| HPV45 | L2 | 357 | 9 | ASTTPSTIH | | 44357 |
| HPV45 | L2 | 357 | 10 | ASTTPSTIHK | | 44358 |
| HPV45 | L2 | 423 | 10 | ASTTTYIGIH | | 44359 |
| HPV45 | L2 | 14 | 9 | ATDLYRTCK | | 44360 |
| HPV45 | L2 | 303 | 9 | ATMFTRSGK | | 44361 |
| HPV45 | L2 | 340 | 11 | ATNDSDLFDVY | | 44362 |
| HPV45 | L2 | 275 | 9 | DFMDIIRLH | | 44363 |
| HPV45 | L2 | 275 | 10 | DFMDIIRLHR | | 44364 |
| HPV45 | L2 | 273 | 9 | DSDFMDIIR | | 44365 |
| HPV45 | L2 | 273 | 11 | DSDFMDIIRLH | | 44366 |
| HPV45 | L2 | 343 | 8 | DSDLFDVY | | 44367 |
| HPV45 | L2 | 36 | 8 | EGTTLADK | | 44368 |
| HPV45 | L2 | 276 | 8 | FMDIIRLH | | 44369 |
| HPV45 | L2 | 276 | 9 | FMDIIRLHR | | 44370 |
| HPV45 | L2 | 306 | 11 | FTRSGKQIGGR | | 44371 |
| HPV45 | L2 | 181 | 10 | FVGTPTSGSH | | 44372 |
| HPV45 | L2 | 314 | 8 | GGRVHFYH | | 44373 |
| HPV45 | L2 | 58 | 11 | GIGTGSGSGGR | | 44374 |
| HPV45 | L2 | 430 | 8 | GIHGTQYY | | 44375 |
| HPV45 | L2 | 64 | 8 | GSGGRTGY | | 44376 |
| HPV45 | L2 | 62 | 10 | GSGSGGRTGY | | 44377 |
| HPV45 | L2 | 25 | 10 | GTCPPDVINK | | 44378 |
| HPV45 | L2 | 60 | 9 | GTGSGSGGR | | 44379 |

TABLE XVII-continued

A11 Motif Peptides

| Type | Protein | Position | No. of Amino Acids | Sequence | A*1101 | Seq. Id. No. |
|---|---|---|---|---|---|---|
| HPV45 | L2 | 183 | 8 | GTPTSGSH | | 44380 |
| HPV45 | L2 | 183 | 10 | GTPTSGSHGY | | 44381 |
| HPV45 | L2 | 433 | 10 | GTQYYLWPWY | | 44382 |
| HPV45 | L2 | 433 | 11 | GTQYYLWPWYY | | 44383 |
| HPV45 | L2 | 292 | 11 | GTVRFSRLGQR | | 44384 |
| HPV45 | L2 | 432 | 11 | HGTQYYLWPWY | | 44385 |
| HPV45 | L2 | 180 | 11 | IFVGTPTSGSH | | 44386 |
| HPV45 | L2 | 313 | 8 | IGGRVHFY | | 44387 |
| HPV45 | L2 | 313 | 9 | IGGRVHFYH | | 44388 |
| HPV45 | L2 | 429 | 8 | IGIHGTQY | | 44389 |
| HPV45 | L2 | 429 | 9 | IGIHGTQYY | | 44390 |
| HPV45 | L2 | 59 | 10 | IGTGSGSGGR | | 44391 |
| HPV45 | L2 | 210 | 10 | ISSTPLPTVR | | 44392 |
| HPV45 | L2 | 210 | 11 | ISSTPLPTVRR | | 44393 |
| HPV45 | L2 | 366 | 8 | KSFTYPKY | | 44394 |
| HPV45 | L2 | 34 | 10 | KVEGTTLADK | | 44395 |
| HPV45 | L2 | 299 | 10 | LGQRATMFTR | | 44396 |
| HPV45 | L2 | 287 | 9 | LSSRRGTVR | | 44397 |
| HPV45 | L2 | 375 | 11 | LTMPSTAASSY | | 44398 |
| HPV45 | L2 | 392 | 10 | LTSAWDVPIY | | 44399 |
| HPV45 | L2 | 248 | 9 | LVTFDNPAY | | 44400 |
| HPV45 | L2 | 277 | 8 | MDIIRLHR | | 44401 |
| HPV45 | L2 | 1 | 8 | MVSHRAAR | | 44402 |
| HPV45 | L2 | 1 | 9 | MVSHRAARR | | 44403 |
| HPV45 | L2 | 1 | 10 | MVSHRAARRK | | 44404 |
| HPV45 | L2 | 1 | 11 | MVSHRAARRKR | | 44405 |
| HPV45 | L2 | 422 | 11 | NASTTTYIGIH | | 44406 |
| HPV45 | L2 | 342 | 9 | NDSDLFDVY | | 44407 |
| HPV45 | L2 | 79 | 10 | NTVVDVGPTR | | 44408 |
| HPV45 | L2 | 285 | 11 | PALSSRRGTVR | | 44409 |
| HPV45 | L2 | 356 | 10 | PASTTPSTIH | | 44410 |
| HPV45 | L2 | 356 | 11 | PASTTPSTIHK | | 44411 |
| HPV45 | L2 | 404 | 8 | PDIILPSH | | 44412 |
| HPV45 | L2 | 272 | 10 | PDSDFMDIIR | | 44413 |
| HPV45 | L2 | 209 | 11 | PISSTPLPTVR | | 44414 |
| HPV45 | L2 | 214 | 9 | PLPTVRRVR | | 44415 |
| HPV45 | L2 | 391 | 11 | PLTSAWDVPIY | | 44416 |
| HPV45 | L2 | 378 | 8 | PSTAASSY | | 44417 |
| HPV45 | L2 | 361 | 10 | PSTIHKSFTY | | 44418 |
| HPV45 | L2 | 420 | 9 | PTNASTTTY | | 44419 |
| HPV45 | L2 | 185 | 8 | PTSGSHGY | | 44420 |
| HPV45 | L2 | 216 | 10 | PTVRRVRGPR | | 44421 |
| HPV45 | L2 | 312 | 9 | QIGGRVHFY | | 44422 |
| HPV45 | L2 | 312 | 10 | QIGGRVHFYH | | 44423 |
| HPV45 | L2 | 11 | 8 | RASATDLY | | 44424 |
| HPV45 | L2 | 11 | 9 | RASATDLYR | | 44425 |
| HPV45 | L2 | 302 | 10 | RATMFTRSGK | | 44426 |
| HPV45 | L2 | 295 | 8 | RFSRLGQR | | 44427 |
| HPV45 | L2 | 222 | 8 | RGPRLYSR | | 44428 |
| HPV45 | L2 | 291 | 8 | RGTVRFSR | | 44429 |
| HPV45 | L2 | 298 | 11 | RLGQRATMFTR | | 44430 |
| HPV45 | L2 | 281 | 10 | RLHRPALSSR | | 44431 |
| HPV45 | L2 | 281 | 11 | RLHRPALSSRR | | 44432 |
| HPV45 | L2 | 225 | 11 | RLYSRANQQVR | | 44433 |
| HPV45 | L2 | 308 | 9 | RSGKQIGGR | | 44434 |
| HPV45 | L2 | 308 | 11 | RSGKQIGGRVH | | 44435 |
| HPV45 | L2 | 68 | 10 | RTGYVPLGGR | | 44436 |
| HPV45 | L2 | 220 | 8 | RVRGPRLY | | 44437 |
| HPV45 | L2 | 220 | 10 | RVRGPRLYSR | | 44438 |
| HPV45 | L2 | 235 | 10 | RVSTSQFLTH | | 44439 |
| HPV45 | L2 | 13 | 10 | SATDLYRTCK | | 44440 |
| HPV45 | L2 | 394 | 8 | SAWDVPIY | | 44441 |
| HPV45 | L2 | 274 | 8 | SDFMDIIR | | 44442 |
| HPV45 | L2 | 274 | 10 | SDFMDIIRLH | | 44443 |
| HPV45 | L2 | 274 | 11 | SDFMDIIRLHR | | 44444 |
| HPV45 | L2 | 309 | 8 | SGKQIGGR | | 44445 |
| HPV45 | L2 | 309 | 10 | SGKQIGGRVH | | 44446 |
| HPV45 | L2 | 63 | 9 | SGSGGRTGY | | 44447 |
| HPV45 | L2 | 24 | 11 | SGTCPPDVINK | | 44448 |
| HPV45 | L2 | 247 | 10 | SLVTFDNPAY | | 44449 |
| HPV45 | L2 | 78 | 11 | SNTVVDVGPTR | | 44450 |
| HPV45 | L2 | 246 | 11 | SSLVTFDNPAY | | 44451 |
| HPV45 | L2 | 288 | 8 | SSRRGTVR | | 44452 |
| HPV45 | L2 | 288 | 11 | SSRRGTVRFSR | | 44453 |
| HPV45 | L2 | 211 | 9 | SSTPLPTVR | | 44454 |

TABLE XVII-continued

A11 Motif Peptides

| Type | Protein | Position | No. of Amino Acids | Sequence | A*1101 | Seq. Id. No. |
|---|---|---|---|---|---|---|
| HPV45 | L2 | 211 | 10 | SSTPLPTVRR | | 44455 |
| HPV45 | L2 | 362 | 9 | STIHKSFTY | | 44456 |
| HPV45 | L2 | 362 | 11 | STIHKSFTYPK | | 44457 |
| HPV45 | L2 | 212 | 8 | STPLPTVR | | 44458 |
| HPV45 | L2 | 212 | 9 | STPLPTVRR | | 44459 |
| HPV45 | L2 | 212 | 11 | STPLPTVRRVR | | 44460 |
| HPV45 | L2 | 237 | 8 | STSQFLTH | | 44461 |
| HPV45 | L2 | 358 | 8 | STTPSTIH | | 44462 |
| HPV45 | L2 | 358 | 9 | STTPSTIHK | | 44463 |
| HPV45 | L2 | 424 | 9 | STTTYIGIH | | 44464 |
| HPV45 | L2 | 26 | 9 | TCPPDVINK | | 44465 |
| HPV45 | L2 | 15 | 8 | TDLYRTCK | | 44466 |
| HPV45 | L2 | 402 | 10 | TGPDIILPSH | | 44467 |
| HPV45 | L2 | 61 | 8 | TGSGSGGR | | 44468 |
| HPV45 | L2 | 61 | 11 | TGSGSGGRTGY | | 44469 |
| HPV45 | L2 | 69 | 9 | TGYVPLGGR | | 44470 |
| HPV45 | L2 | 363 | 8 | TIHKSFTY | | 44471 |
| HPV45 | L2 | 363 | 10 | TIHKSFTYPK | | 44472 |
| HPV45 | L2 | 363 | 11 | TIHKSFTYPKY | | 44473 |
| HPV45 | L2 | 304 | 8 | TMFTRSGK | | 44474 |
| HPV45 | L2 | 376 | 10 | TMPSTAASSY | | 44475 |
| HPV45 | L2 | 421 | 8 | TNASTTTY | | 44476 |
| HPV45 | L2 | 341 | 10 | TNDSDLFDVY | | 44477 |
| HPV45 | L2 | 393 | 9 | TSAWDVPIY | | 44478 |
| HPV45 | L2 | 418 | 11 | TSPTNASTTTY | | 44479 |
| HPV45 | L2 | 359 | 8 | TTPSTIHK | | 44480 |
| HPV45 | L2 | 425 | 8 | TTTYIGIH | | 44481 |
| HPV45 | L2 | 426 | 11 | TTYIGIHGTQY | | 44482 |
| HPV45 | L2 | 293 | 10 | TVRFSRLGQR | | 44483 |
| HPV45 | L2 | 217 | 9 | TVRRVRGPR | | 44484 |
| HPV45 | L2 | 217 | 11 | TVRRVRGPRLY | | 44485 |
| HPV45 | L2 | 80 | 9 | TVVDVGPTR | | 44486 |
| HPV45 | L2 | 182 | 9 | VGTPTSGSH | | 44487 |
| HPV45 | L2 | 182 | 11 | VGTPTSGSHGY | | 44488 |
| HPV45 | L2 | 2 | 8 | VSHRAARR | | 44489 |
| HPV45 | L2 | 2 | 9 | VSHRAARRK | | 44490 |
| HPV45 | L2 | 2 | 10 | VSHRAARRKR | | 44491 |
| HPV45 | L2 | 236 | 9 | VSTSQFLTH | | 44492 |
| HPV45 | L2 | 249 | 8 | VTFDNPAY | | 44493 |
| HPV45 | L2 | 81 | 8 | VVDVGPTR | | 44494 |
| HPV45 | L2 | 444 | 8 | YFPKKRKR | | 44495 |
| HPV45 | L2 | 444 | 11 | YFPKKRKRIPY | | 44496 |
| HPV45 | L2 | 428 | 9 | YIGIHGTQY | | 44497 |
| HPV45 | L2 | 428 | 10 | YIGIHGTQYY | | 44498 |
| HPV45 | L2 | 437 | 8 | YLWPWYYY | | 44499 |
| HPV45 | L2 | 437 | 11 | YLWPWYYYFPK | | 44500 |
| HPV45 | L2 | 227 | 9 | YSRANQQVR | | 44501 |
| HPV45 | L2 | 401 | 11 | YTGPDIILPSH | | 44502 |
| HPV56 | E2 | 177 | 9 | AAVSHRPGK | | 44503 |
| HPV56 | E2 | 177 | 10 | AAVSHRPGKR | | 44504 |
| HPV56 | E2 | 21 | 10 | ALESLSTTIY | | 44505 |
| HPV56 | E2 | 178 | 8 | AVSHRPGK | | 44506 |
| HPV56 | E2 | 178 | 9 | AVSHRPGKR | | 44507 |
| HPV56 | E2 | 178 | 11 | AVSHRPGKRPR | | 44508 |
| HPV56 | E2 | 249 | 8 | CCRYRFQK | | 44509 |
| HPV56 | E2 | 249 | 9 | CCRYRFQKY | | 44510 |
| HPV56 | E2 | 249 | 10 | CCRYRFQKYK | | 44511 |
| HPV56 | E2 | 52 | 8 | CFKKEGQH | | 44512 |
| HPV56 | E2 | 4 | 8 | CLQVCKAK | | 44513 |
| HPV56 | E2 | 71 | 8 | CMQYVAWK | | 44514 |
| HPV56 | E2 | 71 | 9 | CMQYVAWKY | | 44515 |
| HPV56 | E2 | 71 | 11 | CMQYVAWKYIY | | 44516 |
| HPV56 | E2 | 92 | 10 | CSGVDYRGIY | | 44517 |
| HPV56 | E2 | 92 | 11 | CSGVDYRGIYY | | 44518 |
| HPV56 | E2 | 176 | 10 | DAAVSHRPGK | | 44519 |
| HPV56 | E2 | 176 | 11 | DAAVSHRPGKR | | 44520 |
| RPV56 | E2 | 113 | 8 | DFEQEAKK | | 44521 |
| HPV56 | E2 | 65 | 10 | DGSKNNCMQY | | 44522 |
| HPV56 | E2 | 215 | 8 | DNTDSRSR | | 44523 |
| HPV56 | E2 | 195 | 9 | DSSRESHAK | | 44524 |
| HPV56 | E2 | 140 | 8 | DSVSSTCR | | 44525 |
| HPV56 | E2 | 140 | 9 | DSVSSTCRY | | 44526 |
| HPV56 | E2 | 213 | 8 | DTDNTDSR | | 44527 |
| HPV56 | E2 | 213 | 10 | DTDNTDSRSR | | 44528 |
| HPV56 | E2 | 117 | 8 | EAKKFGCK | | 44529 |

TABLE XVII-continued

A11 Motif Peptides

| Type | Protein | Position | No. of Amino Acids | Sequence | A*1101 | Seq. Id. No. |
|---|---|---|---|---|---|---|
| HPV56 | E2 | 193 | 9 | EFDSSRESH | | 44530 |
| HPV56 | E2 | 193 | 11 | EFDSSRESHAK | | 44531 |
| HPV56 | E2 | 43 | 8 | ELWLTEPK | | 44532 |
| HPV56 | E2 | 43 | 9 | ELWLTEPKK | | 44533 |
| HPV56 | E2 | 191 | 8 | ESEFDSSR | | 44534 |
| HPV56 | E2 | 191 | 11 | ESEFDSSRESH | | 44535 |
| HPV56 | E2 | 199 | 10 | ESHAKCVTTH | | 44536 |
| HPV56 | E2 | 23 | 8 | ESLSTTIY | | 44537 |
| HPV56 | E2 | 288 | 10 | ETQRNSFLSH | | 44538 |
| HPV56 | E2 | 154 | 9 | ETVNEYNTH | | 44539 |
| HPV56 | E2 | 154 | 10 | ETVNEYNTHK | | 44540 |
| HPV56 | E2 | 128 | 10 | EVHMENESIY | | 44541 |
| HPV56 | E2 | 61 | 8 | EVWFDGSK | | 44542 |
| HPV56 | E2 | 64 | 11 | FDGSKNNCMQY | | 44543 |
| HPV56 | E2 | 194 | 8 | FDSSRESH | | 44544 |
| HPV56 | E2 | 194 | 10 | FDSSRESHAK | | 44545 |
| HPV56 | E2 | 121 | 10 | FGCKNIWEVH | | 44546 |
| HPV56 | E2 | 294 | 11 | FLSHVKIPVVY | | 44547 |
| HPV56 | E2 | 261 | 8 | FVDVTSTY | | 44548 |
| HPV56 | E2 | 261 | 9 | FVDVTSTYH | | 44549 |
| HPV56 | E2 | 122 | 9 | GCKNIWEVH | | 44550 |
| HPV56 | E2 | 231 | 9 | GDKTTPVVH | | 44551 |
| HPV56 | E2 | 231 | 11 | GDKTTPVVHLK | | 44552 |
| HPV56 | E2 | 99 | 9 | GIYYVHDGH | | 44553 |
| HPV56 | E2 | 99 | 10 | GIYYVHDGHK | | 44554 |
| HPV56 | E2 | 173 | 9 | GNQDAAVSH | | 44555 |
| HPV56 | E2 | 173 | 10 | GNQDAAVSHR | | 44556 |
| HPV56 | E2 | 66 | 9 | GSKNNCMQY | | 44557 |
| HPV56 | E2 | 94 | 8 | GVDYRGIY | | 44558 |
| HPV56 | E2 | 94 | 9 | GVDYRGIYY | | 44559 |
| HPV56 | E2 | 94 | 11 | GVDYRGIYYVH | | 44560 |
| HPV56 | E2 | 201 | 8 | HAKCVTTH | | 44561 |
| HPV56 | E2 | 201 | 10 | HAKCVTTHTH | | 44562 |
| HPV56 | E2 | 104 | 8 | HDGHKTYY | | 44563 |
| RPV56 | E2 | 59 | 10 | HIEVWFDGSK | | 44564 |
| HPV56 | E2 | 210 | 11 | HISDTDNTDSR | | 44565 |
| HPV56 | E2 | 239 | 8 | HLKGEPNR | | 44566 |
| HPV56 | E2 | 239 | 10 | HLKGEPNRLK | | 44567 |
| HPV56 | E2 | 130 | 8 | HMENESIY | | 44568 |
| HPV56 | E2 | 297 | 8 | HVKIPVVY | | 44569 |
| HPV56 | E2 | 297 | 9 | HVKIPVVYR | | 44570 |
| HPV56 | E2 | 20 | 11 | IALESLSTTIY | | 44571 |
| HPV56 | E2 | 283 | 9 | IIYKDETQR | | 44572 |
| HPV56 | E2 | 224 | 10 | INNNNHPGDK | | 44573 |
| HPV56 | E2 | 211 | 10 | ISDTDNTDSR | | 44574 |
| HPV56 | E2 | 281 | 11 | ITIIYKDETQR | | 44575 |
| HPV56 | E2 | 248 | 9 | KCCRYRFQK | | 44576 |
| HPV56 | E2 | 248 | 10 | KCCRYRFQKY | | 44577 |
| HPV56 | E2 | 248 | 11 | KCCRYRFQKYK | | 44578 |
| HPV56 | E2 | 51 | 9 | KCFKKEGQH | | 44579 |
| HPV56 | E2 | 203 | 8 | KCVTTHTH | | 44580 |
| HPV56 | E2 | 120 | 11 | KFGCKNIWEVH | | 44581 |
| HPV56 | E2 | 241 | 8 | KGEPNRLK | | 44582 |
| HPV56 | E2 | 241 | 11 | KGEPNRLKCCR | | 44583 |
| HPV56 | E2 | 68 | 11 | KNNCMQYVAWK | | 44584 |
| HPV56 | E2 | 276 | 10 | KNYSIITIIY | | 44585 |
| HPV56 | E2 | 276 | 11 | KNYSIITIIYK | | 44586 |
| HPV56 | E2 | 258 | 11 | KTLFVDVTSTY | | 44587 |
| HPV56 | E2 | 233 | 9 | KTTPVVHLK | | 44588 |
| HPV56 | E2 | 90 | 8 | KVCSGVDY | | 44589 |
| HPV56 | E2 | 90 | 9 | KVCSGVDYR | | 44590 |
| HPV56 | E2 | 260 | 9 | LFVDVTSTY | | 44591 |
| HPV56 | E2 | 260 | 10 | LFVDVTSTYH | | 44592 |
| HPV56 | E2 | 295 | 10 | LSHVKIPVVY | | 44593 |
| HPV56 | E2 | 295 | 11 | LSHVKIPVVYR | | 44594 |
| HPV56 | E2 | 46 | 9 | LTEPKKCFK | | 44595 |
| HPV56 | E2 | 46 | 10 | LTEPKKCFKK | | 44596 |
| HPV56 | E2 | 1 | 9 | MVPCLQVCK | | 44597 |
| HPV56 | E2 | 1 | 11 | MVPCLQVCKAK | | 44598 |
| HPV56 | E2 | 70 | 9 | NCMQYVAWK | | 44599 |
| HPV56 | E2 | 70 | 10 | NCMQYVAWKY | | 44600 |
| HPV56 | E2 | 83 | 8 | NGDCGWQK | | 44601 |
| HPV56 | E2 | 69 | 10 | NNCMQYVAWK | | 44602 |
| HPV56 | E2 | 69 | 11 | NNCMQYVAWKY | | 44603 |
| HPV56 | E2 | 31 | 8 | NNEEWTLR | | 44604 |

TABLE XVII-continued

A11 Motif Peptides

| Type | Protein | Position | No. of Amino Acids | Sequence | A*1101 | Seq. Id. No. |
|---|---|---|---|---|---|---|
| HPV56 | E2 | 226 | 8 | NNNHPGDK | | 44605 |
| HPV56 | E2 | 225 | 9 | NNNNHPGDK | | 44606 |
| HPV56 | E2 | 292 | 8 | NSFLSHVK | | 44607 |
| HPV56 | E2 | 149 | 11 | NVSPVETVNEY | | 44608 |
| HPV56 | E2 | 3 | 9 | PCLQVCKAK | | 44609 |
| HPV56 | E2 | 139 | 9 | PDSVSSTCR | | 44610 |
| HPV56 | E2 | 139 | 10 | PDSVSSTCRY | | 44611 |
| HPV56 | E2 | 230 | 10 | PGDKTTPVVH | | 44612 |
| HPV56 | E2 | 183 | 8 | PGKRPRLR | | 44613 |
| HPV56 | E2 | 244 | 8 | PNRLKCCR | | 44614 |
| HPV56 | E2 | 244 | 9 | PNRLKCCRY | | 44615 |
| HPV56 | E2 | 244 | 10 | PNRLKCCRYR | | 44616 |
| HPV56 | E2 | 152 | 8 | PVETVNEY | | 44617 |
| HPV56 | E2 | 152 | 11 | PVETVNEYNTH | | 44618 |
| HPV56 | E2 | 236 | 11 | PVVHLKGEPNR | | 44619 |
| HPV56 | E2 | 301 | 10 | PVVYRLVWDK | | 44620 |
| HPV56 | E2 | 175 | 8 | QDAAVSHR | | 44621 |
| HPV56 | E2 | 175 | 11 | QDAAVSHRPGK | | 44622 |
| HPV56 | E2 | 98 | 10 | RGIYYVHDGH | | 44623 |
| HPV56 | E2 | 98 | 11 | RGIYYVHDGHK | | 44624 |
| HPV56 | E2 | 246 | 8 | RLKCCRYR | | 44625 |
| HPV56 | E2 | 246 | 11 | RLKCCRYRFQK | | 44626 |
| HPV56 | E2 | 188 | 11 | RLRESEFDSSR | | 44627 |
| HPV56 | E2 | 291 | 9 | RNSFLSHVK | | 44628 |
| HPV56 | E2 | 222 | 8 | RSINNNNH | | 44629 |
| HPV56 | E2 | 220 | 10 | RSRSINNNNH | | 44630 |
| HPV56 | E2 | 212 | 9 | SDTDNTDSR | | 44631 |
| HPV56 | E2 | 212 | 11 | SDTDNTDSRSR | | 44632 |
| HPV56 | E2 | 93 | 9 | SGVDYRGIY | | 44633 |
| HPV56 | E2 | 93 | 10 | SGVDYRGIYY | | 44634 |
| HPV56 | E2 | 279 | 8 | SIITIIYK | | 44635 |
| HPV56 | E2 | 223 | 11 | SINNNNHPGDK | | 44636 |
| HPV56 | E2 | 196 | 8 | SSRESHAK | | 44637 |
| HPV56 | E2 | 266 | 11 | STYHWTSTDNK | | 44638 |
| HPV56 | E2 | 171 | 11 | SVGNQDAAVSH | | 44639 |
| HPV56 | E2 | 141 | 8 | SVSSTCRY | | 44640 |
| HPV56 | E2 | 40 | 11 | TCEELWLTEPK | | 44641 |
| HPV56 | E2 | 112 | 8 | TDFEQEAK | | 44642 |
| HPV56 | E2 | 112 | 9 | TDFEQEAKK | | 44643 |
| HPV56 | E2 | 214 | 9 | TDNTDSRSR | | 44644 |
| HPV56 | E2 | 282 | 10 | TIIYKDETQR | | 44645 |
| HPV56 | E2 | 28 | 11 | TIYNNEEWTLR | | 44646 |
| HPV56 | E2 | 259 | 10 | TLFVDVTSTY | | 44647 |
| HPV56 | E2 | 259 | 11 | TLFVDVTSTYH | | 44648 |
| HPV56 | E2 | 271 | 8 | TSTDNKNY | | 44649 |
| HPV56 | E2 | 234 | 8 | TTPVVHLK | | 44650 |
| HPV56 | E2 | 155 | 8 | TVNEYNTH | | 44651 |
| HPV56 | E2 | 155 | 9 | TVNEYNTHK | | 44652 |
| HPV56 | E2 | 75 | 8 | VAWKYIYY | | 44653 |
| HPV56 | E2 | 91 | 8 | VCSGVDYR | | 44654 |
| HPV56 | E2 | 91 | 11 | VCSGVDYRGIY | | 44655 |
| HPV56 | E2 | 262 | 8 | VDVTSTYH | | 44656 |
| HPV56 | E2 | 95 | 8 | VDYRGIYY | | 44657 |
| HPV56 | E2 | 95 | 10 | VDYRGIYYVH | | 44658 |
| HPV56 | E2 | 172 | 10 | VGNQDAAVSH | | 44659 |
| HPV56 | E2 | 172 | 11 | VGNQDAAVSHR | | 44660 |
| HPV56 | E2 | 156 | 8 | VNEYNTHK | | 44661 |
| HPV56 | E2 | 179 | 8 | VSHRPGKR | | 44662 |
| HPV56 | E2 | 179 | 10 | VSHRPGKRPR | | 44663 |
| HPV56 | E2 | 150 | 10 | VSPVETVNEY | | 44664 |
| HPV56 | E2 | 237 | 10 | VVHLKGEPNR | | 44665 |
| HPV56 | E2 | 302 | 9 | VVYRLVWDK | | 44666 |
| HPV56 | E2 | 45 | 10 | WLTEPKKCFK | | 44667 |
| HPV56 | E2 | 45 | 11 | WLTEPKKCFKK | | 44668 |
| HPV56 | E2 | 270 | 9 | WTSTDNKNY | | 44669 |
| HPV56 | E2 | 137 | 11 | YCPDSVSSTCR | | 44670 |
| HPV56 | E2 | 82 | 9 | YNGDCGWQK | | 44671 |
| HPV56 | E2 | 30 | 9 | YNNEEWTLR | | 44672 |
| HPV56 | E2 | 278 | 8 | YSIITIIY | | 44673 |
| HPV56 | E2 | 278 | 9 | YSIITIIYK | | 44674 |
| HPV56 | E2 | 111 | 9 | YTDFEQEAK | | 44675 |
| HPV56 | E2 | 111 | 10 | YTDFEQEAKK | | 44676 |
| HPV56 | E2 | 74 | 8 | YVAWKYIY | | 44677 |
| HPV56 | E2 | 74 | 9 | YVAWKYIYY | | 44678 |
| HPV56 | E2 | 102 | 9 | YVHDGHKTY | | 44679 |

TABLE XVII-continued

A11 Motif Peptides

| Type | Protein | Position | No. of Amino Acids | Sequence | A*1101 | Seq. Id. No. |
|---|---|---|---|---|---|---|
| HPV56 | E2 | 102 | 10 | YVHDGHKTYY | | 44680 |
| HPV56 | E6 | 49 | 9 | ACTELKLVY | | 44681 |
| HPV56 | E6 | 49 | 10 | ACTELKLVYR | | 44682 |
| HPV56 | E6 | 89 | 8 | ATLESITK | | 44683 |
| HPV56 | E6 | 89 | 9 | ATLESITKK | | 44684 |
| HPV56 | E6 | 64 | 10 | AVCRVCLLFY | | 44685 |
| HPV56 | E6 | 100 | 8 | CDLLIRCY | | 44686 |
| HPV56 | E6 | 100 | 9 | CDLLIRCYR | | 44687 |
| HPV56 | E6 | 122 | 8 | CDRKRRFH | | 44688 |
| HPV56 | E6 | 139 | 10 | CLGCWRQTSR | | 44689 |
| HPV56 | E6 | 69 | 9 | CLLFYSKVR | | 44690 |
| HPV56 | E6 | 69 | 10 | CLLFYSKVRK | | 44691 |
| HPV56 | E6 | 69 | 11 | CLLFYSKVRKY | | 44692 |
| HPV56 | E6 | 50 | 8 | CTELKLVY | | 44693 |
| HPV56 | E6 | 50 | 9 | CTELKLVYR | | 44694 |
| HPV56 | E6 | 33 | 10 | CVYCKKELTR | | 44695 |
| HPV56 | E6 | 59 | 9 | DDFPYAVCR | | 44696 |
| HPV56 | E6 | 60 | 8 | DFPYAVCR | | 44697 |
| HPV56 | E6 | 101 | 8 | DLLIRCYR | | 44698 |
| HPV56 | E6 | 28 | 8 | DLRLSCVY | | 44699 |
| HPV56 | E6 | 28 | 10 | DLRLSCVYCK | | 44700 |
| HPV56 | E6 | 28 | 11 | DLRLSCVYCKK | | 44701 |
| HPV56 | E6 | 23 | 8 | EIPLIDLR | | 44702 |
| HPV56 | E6 | 39 | 8 | ELTRAEVY | | 44703 |
| HPV56 | E6 | 20 | 11 | EVLEIPLIDLR | | 44704 |
| HPV56 | E6 | 44 | 11 | EVYNFACTELK | | 44705 |
| HPV56 | E6 | 48 | 10 | FACTELKLVY | | 44706 |
| HPV56 | E6 | 48 | 11 | FACTELKLVYR | | 44707 |
| HPV56 | E6 | 5 | 9 | FNNPQERPR | | 44708 |
| HPV56 | E6 | 88 | 9 | GATLESITK | | 44709 |
| HPV56 | E6 | 88 | 10 | GATLESITKK | | 44710 |
| HPV56 | E6 | 141 | 8 | GCWRQTSR | | 44711 |
| HPV56 | E6 | 141 | 11 | GCWRQTSREPR | | 44712 |
| HPV56 | E6 | 137 | 8 | GSCLGCWR | | 44713 |
| HPV56 | E6 | 121 | 9 | HCDRKRRFH | | 44714 |
| HPV56 | E6 | 27 | 9 | IDLRLSCVY | | 44715 |
| HPV56 | E6 | 27 | 11 | IDLRLSCVYCK | | 44716 |
| HPV56 | E6 | 54 | 10 | KLVYRDDFPY | | 44717 |
| HPV56 | E6 | 75 | 8 | KVRKYRYY | | 44718 |
| HPV56 | E6 | 75 | 10 | KVRKYRYYDY | | 44719 |
| HPV56 | E6 | 99 | 9 | LCDLLIRCY | | 44720 |
| HPV56 | E6 | 99 | 10 | LCDLLIRCYR | | 44721 |
| HPV56 | E6 | 71 | 8 | LFYSKVRK | | 44722 |
| HPV56 | E6 | 71 | 9 | LFYSKVRKY | | 44723 |
| HPV56 | E6 | 71 | 10 | LFYSKVRKYR | | 44724 |
| HPV56 | E6 | 71 | 11 | LFYSKVRKYRY | | 44725 |
| HPV56 | E6 | 140 | 9 | LGCWRQTSR | | 44726 |
| HPV56 | E6 | 26 | 10 | LIDLRLSCVY | | 44727 |
| HPV56 | E6 | 70 | 8 | LLFYSKVR | | 44728 |
| HPV56 | E6 | 70 | 9 | LLFYSKVRK | | 44729 |
| HPV56 | E6 | 70 | 10 | LLFYSKVRKY | | 44730 |
| HPV56 | E6 | 70 | 11 | LLFYSKVRKYR | | 44731 |
| HPV56 | E6 | 31 | 8 | LSCVYCKK | | 44732 |
| HPV56 | E6 | 113 | 9 | LTPEEKQLH | | 44733 |
| HPV56 | E6 | 55 | 9 | LVYRDDFPY | | 44734 |
| HPV56 | E6 | 47 | 8 | NFACTELK | | 44735 |
| HPV56 | E6 | 47 | 11 | NFACTELKLVY | | 44736 |
| HPV56 | E6 | 6 | 8 | NNPQERPR | | 44737 |
| HPV56 | E6 | 6 | 11 | NNPQERPRSLH | | 44738 |
| HPV56 | E6 | 25 | 11 | PLIDLRLSCVY | | 44739 |
| HPV56 | E6 | 112 | 10 | PLTPEEKQLH | | 44740 |
| HPV56 | E6 | 4 | 8 | QFNNPQER | | 44741 |
| HPV56 | E6 | 4 | 10 | QFNNPQERPR | | 44742 |
| HPV56 | E6 | 98 | 8 | QLCDLLIR | | 44743 |
| HPV56 | E6 | 98 | 10 | QLCDLLIRCY | | 44744 |
| HPV56 | E6 | 98 | 11 | QLCDLLIRCYR | | 44745 |
| HPV56 | E6 | 119 | 8 | QLHCDRKR | | 44746 |
| HPV56 | E6 | 119 | 9 | QLHCDRKRR | | 44747 |
| HPV56 | E6 | 119 | 11 | QLHCDRKRRFH | | 44748 |
| HPV56 | E6 | 110 | 9 | QSPLTPEEK | | 44749 |
| HPV56 | E6 | 108 | 11 | RCQSPLTPEEK | | 44750 |
| HPV56 | E6 | 58 | 10 | RDDFPYAVCR | | 44751 |
| HPV56 | E6 | 30 | 8 | RLSCVYCK | | 44752 |
| HPV56 | E6 | 30 | 9 | RLSCVYCKK | | 44753 |
| HPV56 | E6 | 67 | 9 | RVCLLFYSK | | 44754 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV56 | E6 | 67 | 11 | RVCLLFYSKVR | | 44755 |
| HPV56 | E6 | 138 | 11 | SCLGCWRQTSR | | 44756 |
| HPV56 | E6 | 32 | 11 | SCVYCKKELTR | | 44757 |
| HPV56 | E6 | 136 | 9 | TGSCLGCWR | | 44758 |
| HPV56 | E6 | 90 | 8 | TLESITKK | | 44759 |
| HPV56 | E6 | 68 | 8 | VCLLFYSK | | 44760 |
| HPV56 | E6 | 68 | 10 | VCLLFYSKVR | | 44761 |
| HPV56 | E6 | 68 | 11 | VCLLFYSKVRK | | 44762 |
| HPV56 | E6 | 65 | 9 | VCRVCLLFY | | 44763 |
| HPV56 | E6 | 65 | 11 | VCRVCLLFYSK | | 44764 |
| HPV56 | E6 | 21 | 10 | VLEIPLIDLR | | 44765 |
| HPV56 | E6 | 135 | 10 | WTGSCLGCWR | | 44766 |
| HPV56 | E6 | 63 | 11 | YAVCRVCLLFY | | 44767 |
| HPV56 | E6 | 35 | 8 | YCKKELTR | | 44768 |
| HPV56 | E6 | 87 | 10 | YGATLESITK | | 44769 |
| HPV56 | E6 | 87 | 11 | YGATLESITKK | | 44770 |
| HPV56 | E6 | 46 | 9 | YNFACTELK | | 44771 |
| HPV56 | E6 | 73 | 8 | YSKVRKYR | | 44772 |
| HPV56 | E6 | 73 | 9 | YSKVRKYRY | | 44773 |
| HPV56 | E6 | 73 | 10 | YSKVRKYRYY | | 44774 |
| HPV56 | E7 | 75 | 10 | DIQSTKEDLR | | 44775 |
| HPV56 | E7 | 33 | 10 | EDEDEDEVDH | | 44776 |
| HPV56 | E7 | 35 | 8 | EDEDEVDH | | 44777 |
| HPV56 | E7 | 37 | 10 | EDEVDHLQER | | 44778 |
| HPV56 | E7 | 39 | 8 | EVDHLQER | | 44779 |
| HPV56 | E7 | 70 | 11 | FVVQLDIQSTK | | 44780 |
| HPV56 | E7 | 42 | 10 | HLQERPQQAR | | 44781 |
| HPV56 | E7 | 62 | 8 | HVPCCECK | | 44782 |
| HPV56 | E7 | 74 | 11 | LDIQSTKEDLR | | 44783 |
| HPV56 | E7 | 60 | 10 | LIHVPCCECK | | 44784 |
| HPV56 | E7 | 52 | 8 | QAKQHTCY | | 44785 |
| HPV56 | E7 | 52 | 11 | QAKQHTCYLIH | | 44786 |
| HPV56 | E7 | 49 | 8 | QARQAKQH | | 44787 |
| HPV56 | E7 | 49 | 11 | QARQAKQHTCY | | 44788 |
| HPV56 | E7 | 73 | 8 | QLDIQSTK | | 44789 |
| HPV56 | E7 | 77 | 8 | QSTKEDLR | | 44790 |
| HPV56 | E7 | 71 | 10 | VVQLDIQSTK | | 44791 |
| HPV56 | E7 | 59 | 11 | YLIHVPCCECK | | 44792 |
| HPV56 | L1 | 135 | 9 | ACVGLEVGR | | 44793 |
| HPV56 | L1 | 273 | 11 | ADAYGDSMWFY | | 44794 |
| HPV56 | L1 | 149 | 11 | AGLSGHPLFNR | | 44795 |
| HPV56 | L1 | 72 | 11 | AGSSRLLAVGH | | 44796 |
| HPV56 | L1 | 241 | 11 | AMDFKVLQESK | | 44797 |
| HPV56 | L1 | 198 | 8 | AMGEHWTK | | 44798 |
| HPV56 | L1 | 169 | 10 | ANNNVIEDSR | | 44799 |
| HPV56 | L1 | 58 | 8 | ATDSYVKR | | 44800 |
| HPV56 | L1 | 381 | 8 | ATEQLSKY | | 44801 |
| HPV56 | L1 | 381 | 11 | ATEQLSKYDAR | | 44802 |
| HPV56 | L1 | 444 | 8 | ATSLEDKY | | 44803 |
| HPV56 | L1 | 444 | 9 | ATSLEDKYR | | 44804 |
| HPV56 | L1 | 444 | 10 | ATSLEDKYRY | | 44805 |
| HPV56 | L1 | 37 | 9 | ATWRPSENK | | 44806 |
| HPV56 | L1 | 37 | 11 | ATWRPSENKVY | | 44807 |
| HPV56 | L1 | 512 | 8 | AVATSKKR | | 44808 |
| HPV56 | L1 | 79 | 11 | AVGHPYYSVTK | | 44809 |
| HPV56 | L1 | 195 | 8 | CTPAMGEH | | 44810 |
| HPV56 | L1 | 195 | 11 | CTPAMGEHWTK | | 44811 |
| HPV56 | L1 | 136 | 8 | CVGLEVGR | | 44812 |
| HPV56 | L1 | 389 | 8 | DARKINQY | | 44813 |
| HPV56 | L1 | 389 | 10 | DARKINQYLR | | 44814 |
| HPV56 | L1 | 389 | 11 | DARKINQYLRH | | 44815 |
| HPV56 | L1 | 274 | 10 | DAYGDSMWFY | | 44816 |
| HPV56 | L1 | 243 | 9 | DFKVLQESK | | 44817 |
| HPV56 | L1 | 257 | 8 | DIVQSTCK | | 44818 |
| HPV56 | L1 | 257 | 9 | DIVQSTCKY | | 44819 |
| HPV56 | L1 | 491 | 9 | DLDQFPLGR | | 44820 |
| HPV56 | L1 | 491 | 10 | DLDQFPLGRK | | 44821 |
| HPV56 | L1 | 179 | 8 | DNISVDGK | | 44822 |
| HPV56 | L1 | 90 | 9 | DNTKTNIPK | | 44823 |
| HPV56 | L1 | 278 | 8 | DSMWFYLR | | 44824 |
| HPV56 | L1 | 278 | 9 | DSMWFYLRR | | 44825 |
| HPV56 | L1 | 176 | 11 | DSRDNISVDGK | | 44826 |
| HPV56 | L1 | 60 | 11 | DSYVKRTSIFY | | 44827 |
| HPV56 | L1 | 236 | 10 | DTGFGAMDFK | | 44828 |
| HPV56 | L1 | 121 | 11 | DTNIYNPDQER | | 44829 |

TABLE XVII-continued

A11 Motif Peptides

| Type | Protein | Position | No. of Amino Acids | Sequence | A*1101 | Seq. Id. No. |
|---|---|---|---|---|---|---|
| HPV56 | L1 | 337 | 9 | EAQLFNKPY | | 44830 |
| HPV56 | L1 | 448 | 8 | EDKYRYVR | | 44831 |
| HPV56 | L1 | 404 | 10 | ELQFVFQLCK | | 44832 |
| HPV56 | L1 | 308 | 10 | ELYLKGSNGR | | 44833 |
| HPV56 | L1 | 303 | 8 | ETIPAELY | | 44834 |
| HPV56 | L1 | 303 | 10 | ETIPAELYLK | | 44835 |
| HPV56 | L1 | 290 | 8 | FARHYFNR | | 44836 |
| HPV56 | L1 | 290 | 11 | FARHYFNRAGK | | 44837 |
| HPV56 | L1 | 117 | 9 | FGLPDTNIY | | 44838 |
| HPV56 | L1 | 501 | 8 | FLMQLGTR | | 44839 |
| HPV56 | L1 | 501 | 10 | FLMQLGTRSK | | 44840 |
| HPV56 | L1 | 33 | 8 | FLQMATWR | | 44841 |
| HPV56 | L1 | 341 | 9 | FNKPYWLQR | | 44842 |
| HPV56 | L1 | 364 | 9 | FVTVVDTTR | | 44843 |
| HPV56 | L1 | 194 | 9 | GCTPAMGEH | | 44844 |
| HPV56 | L1 | 277 | 9 | GDSMWFYLR | | 44845 |
| HPV56 | L1 | 277 | 10 | GDSMWFYLRR | | 44846 |
| HPV56 | L1 | 238 | 8 | GFGAMDFK | | 44847 |
| HPV56 | L1 | 118 | 8 | GLPDTNIY | | 44848 |
| HPV56 | L1 | 150 | 10 | GLSGHPLFNR | | 44849 |
| HPV56 | L1 | 73 | 10 | GSSRLLAVGH | | 44850 |
| HPV56 | L1 | 235 | 11 | IDTGFGAMDFK | | 44851 |
| HPV56 | L1 | 32 | 9 | IFLQMATWR | | 44852 |
| HPV56 | L1 | 68 | 9 | IFYHAGSSR | | 44853 |
| HPV56 | L1 | 393 | 11 | INQYLRHVEEY | | 44854 |
| HPV56 | L1 | 378 | 10 | ISTATEQLSK | | 44855 |
| HPV56 | L1 | 378 | 11 | ISTATEQLSKY | | 44856 |
| HPV56 | L1 | 414 | 10 | ITLSAEVMAY | | 44857 |
| HPV56 | L1 | 334 | 10 | ITSEAQLFNK | | 44858 |
| HPV56 | L1 | 192 | 11 | IVGCTPAMGEH | | 44859 |
| HPV56 | L1 | 258 | 8 | IVQSTCKY | | 44860 |
| HPV56 | L1 | 258 | 11 | IVQSTCKYPDY | | 44861 |
| HPV56 | L1 | 89 | 10 | KDNTKTNIPK | | 44862 |
| HPV56 | L1 | 116 | 10 | KFGLPDTNIY | | 44863 |
| HPV56 | L1 | 500 | 9 | KFLMQLGTR | | 44864 |
| HPV56 | L1 | 500 | 11 | KFLMQLGTRSK | | 44865 |
| HPV56 | L1 | 392 | 8 | KINQYLRH | | 44866 |
| HPV56 | L1 | 413 | 11 | KITLSAEVMAY | | 44867 |
| HPV56 | L1 | 93 | 10 | KTNIPKVSAY | | 44868 |
| HPV56 | L1 | 300 | 11 | KVGETIPAELY | | 44869 |
| HPV56 | L1 | 98 | 8 | KVSAYQYR | | 44870 |
| HPV56 | L1 | 98 | 11 | KVSAYQYRVFR | | 44871 |
| HPV56 | L1 | 55 | 8 | KVVATDSY | | 44872 |
| HPV56 | L1 | 55 | 10 | KVVATDSYVK | | 44873 |
| HPV56 | L1 | 55 | 11 | KVVATDSYVKR | | 44874 |
| HPV56 | L1 | 45 | 11 | KVYLPPTPVSK | | 44875 |
| HPV56 | L1 | 168 | 11 | LANNNVIEDSR | | 44876 |
| HPV56 | L1 | 78 | 8 | LAVGHPYY | | 44877 |
| HPV56 | L1 | 256 | 9 | LDIVQSTCK | | 44878 |
| HPV56 | L1 | 256 | 10 | LDIVQSTCKY | | 44879 |
| HPV56 | L1 | 492 | 8 | LDQFPLGR | | 44880 |
| HPV56 | L1 | 492 | 9 | LDQFPLGRK | | 44881 |
| HPV56 | L1 | 289 | 9 | LFARHYFNR | | 44882 |
| HPV56 | L1 | 340 | 10 | LFNKPYWLQR | | 44883 |
| HPV56 | L1 | 363 | 10 | LFVTVVDTTR | | 44884 |
| HPV56 | L1 | 147 | 8 | LGAGLSGH | | 44885 |
| HPV56 | L1 | 77 | 8 | LLAVGHPY | | 44886 |
| HPV56 | L1 | 77 | 9 | LLAVGHPYY | | 44887 |
| HPV56 | L1 | 502 | 9 | LMQLGTRSK | | 44888 |
| HPV56 | L1 | 416 | 8 | LSAEVMAY | | 44889 |
| HPV56 | L1 | 416 | 10 | LSAEVMAYLH | | 44890 |
| HPV56 | L1 | 151 | 9 | LSGHPLFNR | | 44891 |
| HPV56 | L1 | 385 | 8 | LSKYDARK | | 44892 |
| HPV56 | L1 | 36 | 10 | MATWRPSENK | | 44893 |
| HPV56 | L1 | 242 | 10 | MDFKVLQESK | | 44894 |
| HPV56 | L1 | 333 | 11 | MITSEAQLFNK | | 44895 |
| HPV56 | L1 | 2 | 8 | MLPMMYIY | | 44896 |
| HPV56 | L1 | 2 | 9 | MLPMMYIYR | | 44897 |
| HPV56 | L1 | 1 | 9 | MMLPMMYIY | | 44898 |
| HPV56 | L1 | 1 | 10 | MMLPMMYIYR | | 44899 |
| HPV56 | L1 | 5 | 11 | MMYIYRDPPLH | | 44900 |
| HPV56 | L1 | 315 | 11 | NGREPPPSSVY | | 44901 |
| HPV56 | L1 | 95 | 8 | NIPKVSAY | | 44902 |
| HPV56 | L1 | 95 | 10 | NIPKVSAYQY | | 44903 |
| HPV56 | L1 | 95 | 11 | NIPKVSAYQYR | | 44904 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV56 | L1 | 123 | 9 | NIYNPDQER | | 44905 |
| HPV56 | L1 | 170 | 9 | NNNVIEDSR | | 44906 |
| HPV56 | L1 | 171 | 8 | NNVIEDSR | | 44907 |
| HPV56 | L1 | 91 | 8 | NTKTNIPK | | 44908 |
| HPV56 | L1 | 197 | 9 | PAMGEHWTK | | 44909 |
| HPV56 | L1 | 511 | 8 | PAVATSKK | | 44910 |
| HPV56 | L1 | 511 | 9 | PAVATSKKR | | 44911 |
| HPV56 | L1 | 266 | 11 | PDYLKMSADAY | | 44912 |
| HPV56 | L1 | 31 | 10 | PIFLQMATWR | | 44913 |
| HPV56 | L1 | 255 | 10 | PLDIVQSTCK | | 44914 |
| HPV56 | L1 | 255 | 11 | PLDIVQSTCKY | | 44915 |
| HPV56 | L1 | 146 | 9 | PLGAGLSGH | | 44916 |
| HPV56 | L1 | 467 | 10 | PTEKQDPLAK | | 44917 |
| HPV56 | L1 | 467 | 11 | PTEKQDPLAKY | | 44918 |
| HPV56 | L1 | 522 | 9 | PTSTSTPAK | | 44919 |
| HPV56 | L1 | 522 | 10 | PTSTSTPAKR | | 44920 |
| HPV56 | L1 | 522 | 11 | PTSTSTPAKRK | | 44921 |
| HPV56 | L1 | 442 | 9 | PVATSLEDK | | 44922 |
| HPV56 | L1 | 442 | 10 | PVATSLEDKY | | 44923 |
| HPV56 | L1 | 442 | 11 | PVATSLEDKYR | | 44924 |
| HPV56 | L1 | 52 | 11 | PVSKVVATDSY | | 44925 |
| HPV56 | L1 | 471 | 8 | QDPLAKYK | | 44926 |
| HPV56 | L1 | 406 | 8 | QFVFQLCK | | 44927 |
| HPV56 | L1 | 288 | 10 | QLFARHYFNR | | 44928 |
| HPV56 | L1 | 339 | 11 | QLFNKPYWLQR | | 44929 |
| HPV56 | L1 | 362 | 11 | QLFVTVVDTTR | | 44930 |
| HPV56 | L1 | 384 | 8 | QLSKYDAR | | 44931 |
| HPV56 | L1 | 384 | 9 | QLSKYDARK | | 44932 |
| HPV56 | L1 | 35 | 11 | QMATWRPSENK | | 44933 |
| HPV56 | L1 | 260 | 9 | QSTCKYPDY | | 44934 |
| HPV56 | L1 | 260 | 11 | QSTCKYPDYLK | | 44935 |
| HPV56 | L1 | 178 | 9 | RDNISVDGK | | 44936 |
| HPV56 | L1 | 76 | 9 | RLLAVGHPY | | 44937 |
| HPV56 | L1 | 76 | 10 | RLLAVGHPYY | | 44938 |
| HPV56 | L1 | 508 | 10 | RSKPAVATSK | | 44939 |
| HPV56 | L1 | 508 | 11 | RSKPAVATSKK | | 44940 |
| HPV56 | L1 | 455 | 9 | RSTAITCQR | | 44941 |
| HPV56 | L1 | 108 | 9 | RVRLPDPNK | | 44942 |
| HPV56 | L1 | 417 | 9 | SAEVMAYLH | | 44943 |
| HPV56 | L1 | 520 | 11 | SAPTSTSTPAK | | 44944 |
| HPV56 | L1 | 100 | 9 | SAYQYRVFR | | 44945 |
| HPV56 | L1 | 100 | 11 | SAYQYRVFRVR | | 44946 |
| HPV56 | L1 | 152 | 8 | SGHPLFNR | | 44947 |
| HPV56 | L1 | 67 | 10 | SIFYHAGSSR | | 44948 |
| HPV56 | L1 | 446 | 8 | SLEDKYRY | | 44949 |
| HPV56 | L1 | 446 | 10 | SLEDKYRYVR | | 44950 |
| HPV56 | L1 | 279 | 8 | SMWFYLRR | | 44951 |
| HPV56 | L1 | 74 | 9 | SSRLLAVGH | | 44952 |
| HPV56 | L1 | 74 | 11 | SSRLLAVGHPY | | 44953 |
| HPV56 | L1 | 456 | 8 | STAITCQR | | 44954 |
| HPV56 | L1 | 379 | 9 | STATEQLSK | | 44955 |
| HPV56 | L1 | 379 | 10 | STATEQLSKY | | 44956 |
| HPV56 | L1 | 261 | 8 | STCKYPDY | | 44957 |
| HPV56 | L1 | 261 | 10 | STCKYPDYLK | | 44958 |
| HPV56 | L1 | 489 | 11 | STDLDQFPLGR | | 44959 |
| HPV56 | L1 | 526 | 8 | STPAKRKR | | 44960 |
| HPV56 | L1 | 526 | 9 | STPAKRKRR | | 44961 |
| HPV56 | L1 | 524 | 8 | STSTPAKR | | 44962 |
| HPV56 | L1 | 524 | 9 | STSTPAKRK | | 44963 |
| HPV56 | L1 | 524 | 10 | STSTPAKRKR | | 44964 |
| HPV56 | L1 | 524 | 11 | STSTPAKRKRR | | 44965 |
| HPV56 | L1 | 86 | 8 | SVTKDNTK | | 44966 |
| HPV56 | L1 | 380 | 8 | TATEQLSK | | 44967 |
| HPV56 | L1 | 380 | 9 | TATEQLSKY | | 44968 |
| HPV56 | L1 | 262 | 9 | TCKYPDYLK | | 44969 |
| HPV56 | L1 | 460 | 11 | TCQREQPPTEK | | 44970 |
| HPV56 | L1 | 490 | 10 | TDLDQFPLGR | | 44971 |
| HPV56 | L1 | 490 | 11 | TDLDQFPLGRK | | 44972 |
| HPV56 | L1 | 237 | 9 | TGFGAMDFK | | 44973 |
| HPV56 | L1 | 304 | 9 | TIPAELYLK | | 44974 |
| HPV56 | L1 | 377 | 11 | TISTATEQLSK | | 44975 |
| HPV56 | L1 | 415 | 9 | TLSAEVMAY | | 44976 |
| HPV56 | L1 | 415 | 11 | TLSAEVMAYLH | | 44977 |
| HPV56 | L1 | 94 | 9 | TNIPKVSAY | | 44978 |
| HPV56 | L1 | 94 | 11 | TNIPKVSAYQY | | 44979 |

TABLE XVII-continued

A11 Motif Peptides

| Type | Protein | Position | No. of Amino Acids | Sequence | A*1101 | Seq. Id. No. |
|---|---|---|---|---|---|---|
| HPV56 | L1 | 122 | 10 | TNIYNPDQER | | 44980 |
| HPV56 | L1 | 335 | 9 | TSEAQLFNK | | 44981 |
| HPV56 | L1 | 335 | 11 | TSEAQLFNKPY | | 44982 |
| HPV56 | L1 | 66 | 11 | TSIFYHAGSSR | | 44983 |
| HPV56 | L1 | 445 | 8 | TSLEDKYR | | 44984 |
| HPV56 | L1 | 445 | 9 | TSLEDKYRY | | 44985 |
| HPV56 | L1 | 445 | 11 | TSLEDKYRYVR | | 44986 |
| HPV56 | L1 | 525 | 8 | TSTPAKRK | | 44987 |
| HPV56 | L1 | 525 | 9 | TSTPAKRKR | | 44988 |
| HPV56 | L1 | 525 | 10 | TSTPAKRKRR | | 44989 |
| HPV56 | L1 | 523 | 8 | TSTSTPAK | | 44990 |
| HPV56 | L1 | 523 | 9 | TSTSTPAKR | | 44991 |
| HPV56 | L1 | 523 | 10 | TSTSTPAKRK | | 44992 |
| HPV56 | L1 | 523 | 11 | TSTSTPAKRKR | | 44993 |
| HPV56 | L1 | 57 | 8 | VATDSYVK | | 44994 |
| HPV56 | L1 | 57 | 9 | VATDSYVKR | | 44995 |
| HPV56 | L1 | 443 | 8 | VATSLEDK | | 44996 |
| HPV56 | L1 | 443 | 9 | VATSLEDKY | | 44997 |
| HPV56 | L1 | 443 | 10 | VATSLEDKYR | | 44998 |
| HPV56 | L1 | 443 | 11 | VATSLEDKYRY | | 44999 |
| HPV56 | L1 | 106 | 11 | VFRVRLPDPNK | | 45000 |
| HPV56 | L1 | 193 | 10 | VGCTPAMGEH | | 45001 |
| HPV56 | L1 | 301 | 10 | VGETIPAELY | | 45002 |
| HPV56 | L1 | 80 | 10 | VGHPYYSVTK | | 45003 |
| HPV56 | L1 | 99 | 10 | VSAYQYRVFR | | 45004 |
| HPV56 | L1 | 53 | 10 | VSKVVATDSY | | 45005 |
| HPV56 | L1 | 365 | 8 | VTVVDTTR | | 45006 |
| HPV56 | L1 | 56 | 9 | VVATDSYVK | | 45007 |
| HPV56 | L1 | 56 | 10 | VVATDSYVKR | | 45008 |
| HPV56 | L1 | 134 | 10 | WACVGLEVGR | | 45009 |
| HPV56 | L1 | 346 | 8 | WLQRAQGH | | 45010 |
| HPV56 | L1 | 203 | 8 | WTKGAVCK | | 45011 |
| HPV56 | L1 | 388 | 9 | YDARKINQY | | 45012 |
| HPV56 | L1 | 388 | 11 | YDARKINQYLR | | 45013 |
| HPV56 | L1 | 276 | 8 | YGDSMWFY | | 45014 |
| HPV56 | L1 | 276 | 10 | YGDSMWFYLR | | 45015 |
| HPV56 | L1 | 276 | 11 | YGDSMWFYLRR | | 45016 |
| HPV56 | L1 | 7 | 9 | YIYRDPPLH | | 45017 |
| HPV56 | L1 | 7 | 10 | YIYRDPPLHY | | 45018 |
| HPV56 | L1 | 310 | 8 | YLKGSNGR | | 45019 |
| HPV56 | L1 | 268 | 9 | YLKMSADAY | | 45020 |
| HPV56 | L1 | 47 | 9 | YLPPTPVSK | | 45021 |
| HPV56 | L1 | 396 | 8 | YLRHVEEY | | 45022 |
| HPV56 | L1 | 283 | 10 | YLRREQLFAR | | 45023 |
| HPV56 | L1 | 283 | 11 | YLRREQLFARH | | 45024 |
| HPV56 | L1 | 85 | 9 | YSVTKDNTK | | 45025 |
| HPV56 | L1 | 62 | 9 | YVKRTSIFY | | 45026 |
| HPV56 | L1 | 62 | 10 | YVKRTSIFYH | | 45027 |
| HPV56 | L1 | 453 | 11 | YVRSTAITCQR | | 45028 |
| HPV56 | L2 | 222 | 8 | AAPRLYRK | | 45029 |
| HPV56 | L2 | 286 | 10 | AFTTRRGGVR | | 45030 |
| HPV56 | L2 | 69 | 9 | AGYVPLGSR | | 45031 |
| HPV56 | L2 | 281 | 10 | ALHRPAFTTR | | 45032 |
| HPV56 | L2 | 281 | 11 | ALHRPAFTTRR | | 45033 |
| HPV56 | L2 | 438 | 9 | ALWPVYFFR | | 45034 |
| HPV56 | L2 | 438 | 10 | ALWPVYFFRR | | 45035 |
| HPV56 | L2 | 438 | 11 | ALWPVYFFRRR | | 45036 |
| HPV56 | L2 | 340 | 9 | ANNSFDGLY | | 45037 |
| HPV56 | L2 | 12 | 8 | ASATQLYK | | 45038 |
| HPV56 | L2 | 12 | 11 | ASATQLYKTCK | | 45039 |
| HPV56 | L2 | 367 | 10 | ATPSAHLPIK | | 45040 |
| HPV56 | L2 | 14 | 9 | ATQLYKTCK | | 45041 |
| HPV56 | L2 | 275 | 9 | DFMNIVALH | | 45042 |
| HPV56 | L2 | 275 | 10 | DFMNIVALHR | | 45043 |
| HPV56 | L2 | 142 | 10 | DITPTSSTVH | | 45044 |
| HPV56 | L2 | 30 | 9 | DVVNKIEQK | | 45045 |
| HPV56 | L2 | 29 | 10 | EDVVNKIEQK | | 45046 |
| HPV56 | L2 | 194 | 10 | EIPMQTFAVH | | 45047 |
| HPV56 | L2 | 437 | 10 | FALWPVYFFR | | 45048 |
| HPV56 | L2 | 437 | 11 | FALWPVYFFRR | | 45049 |
| HPV56 | L2 | 344 | 8 | FDGLYDIY | | 45050 |
| HPV56 | L2 | 444 | 8 | FFRRRRRK | | 45051 |
| HPV56 | L2 | 444 | 9 | FFRRRRRKR | | 45052 |
| HPV56 | L2 | 276 | 8 | FMNIVALH | | 45053 |
| HPV56 | L2 | 276 | 9 | FMNIVALHR | | 45054 |

TABLE XVII-continued

A11 Motif Peptides

| Type | Protein | Position | No. of Amino Acids | Sequeuce | A*1101 | Seq. Id. No. |
|---|---|---|---|---|---|---|
| HPV56 | L2 | 287 | 9 | FTTRRGGVR | | 45055 |
| HPV56 | L2 | 418 | 11 | FVPQSPYDVTH | | 45056 |
| HPV56 | L2 | 314 | 8 | GARVHYYY | | 45057 |
| HPV56 | L2 | 217 | 9 | GFRRIAAPR | | 45058 |
| HPV56 | L2 | 217 | 11 | GFRRIAAPRLY | | 45059 |
| HPV56 | L2 | 292 | 10 | GGVRFSRLGR | | 45060 |
| HPV56 | L2 | 292 | 11 | GGVRFSRLGRK | | 45061 |
| HPV56 | L2 | 58 | 11 | GIGTGTGSGGR | | 45062 |
| HPV56 | L2 | 394 | 9 | GNVWETPFY | | 45063 |
| HPV56 | L2 | 64 | 8 | GSGGRAGY | | 45064 |
| HPV56 | L2 | 434 | 10 | GSSFALWPVY | | 45065 |
| HPV56 | L2 | 25 | 10 | GTCPEDVVNK | | 45066 |
| HPV56 | L2 | 62 | 10 | GTGSGGRAGY | | 45067 |
| HPV56 | L2 | 60 | 9 | GTGTGSGGR | | 45068 |
| HPV56 | L2 | 310 | 9 | GTQIGARVH | | 45069 |
| HPV56 | L2 | 310 | 10 | GTQIGARVHY | | 45070 |
| HPV56 | L2 | 310 | 11 | GTQIGARVHYY | | 45071 |
| HPV56 | L2 | 293 | 9 | GVRFSRLGR | | 45072 |
| HPV56 | L2 | 293 | 10 | GVRFSRLGRK | | 45073 |
| HPV56 | L2 | 221 | 8 | IAAPRLYR | | 45074 |
| HPV56 | L2 | 221 | 9 | IAAPRLYRK | | 45075 |
| HPV56 | L2 | 313 | 8 | IGARVHYY | | 45076 |
| HPV56 | L2 | 313 | 9 | IGARVHYYY | | 45077 |
| HPV56 | L2 | 59 | 10 | IGTGTGSGGR | | 45078 |
| HPV56 | L2 | 180 | 11 | ILISTPTSGIH | | 45079 |
| HPV56 | L2 | 44 | 10 | ILQWGSLFTY | | 45080 |
| HPV56 | L2 | 210 | 10 | ISSTPIPGFR | | 45081 |
| HPV56 | L2 | 210 | 11 | ISSTPIPGFRR | | 45082 |
| HPV56 | L2 | 182 | 9 | ISTPTSGIH | | 45083 |
| HPV56 | L2 | 182 | 11 | ISTPTSGIHSY | | 45084 |
| HPV56 | L2 | 143 | 9 | ITPTSSTVH | | 45085 |
| HPV56 | L2 | 81 | 8 | IVDVTPAR | | 45086 |
| HPV56 | L2 | 302 | 8 | KATIQTRR | | 45087 |
| HPV56 | L2 | 34 | 10 | KIEQKTWADK | | 45088 |
| HPV56 | L2 | 43 | 11 | KILQWGSLFTY | | 45089 |
| HPV56 | L2 | 235 | 10 | KVTDPAFLDR | | 45090 |
| HPV56 | L2 | 141 | 11 | LDITPTSSTVH | | 45091 |
| HPV56 | L2 | 393 | 10 | LGNVWETPFY | | 45092 |
| HPV56 | L2 | 299 | 10 | LGRKATIQTR | | 45093 |
| HPV56 | L2 | 299 | 11 | LGRKATIQTRR | | 45094 |
| HPV56 | L2 | 181 | 10 | LISTPTSGIH | | 45095 |
| HPV56 | L2 | 338 | 11 | LSANNSFDGLY | | 45096 |
| HPV56 | L2 | 277 | 8 | MNIVALHR | | 45097 |
| HPV56 | L2 | 1 | 8 | MVAHRATR | | 45098 |
| HPV56 | L2 | 1 | 9 | MVAHRATRR | | 45099 |
| HPV56 | L2 | 1 | 10 | MVAHRATRRK | | 45100 |
| HPV56 | L2 | 1 | 11 | MVAHRATRRKR | | 45101 |
| HPV56 | L2 | 341 | 8 | NNSFDGLY | | 45102 |
| HPV56 | L2 | 341 | 11 | NNSFDGLYDIY | | 45103 |
| HPV56 | L2 | 342 | 10 | NSFDGLYDIY | | 45104 |
| HPV56 | L2 | 395 | 8 | NVWETPFY | | 45105 |
| HPV56 | L2 | 285 | 11 | PAFTTRRGGVR | | 45106 |
| HPV56 | L2 | 274 | 10 | PDFMNIVALH | | 45107 |
| HPV56 | L2 | 274 | 11 | PDFMNIVALHR | | 45108 |
| HPV56 | L2 | 417 | 8 | PFVPQSPY | | 45109 |
| HPV56 | L2 | 216 | 10 | PGFRRIAAPR | | 45110 |
| HPV56 | L2 | 209 | 11 | PISSTPIPGFR | | 45111 |
| HPV56 | L2 | 392 | 11 | PLGNVWETPFY | | 45112 |
| HPV56 | L2 | 196 | 8 | PMQTFAVH | | 45113 |
| HPV56 | L2 | 369 | 8 | PSAHLPIK | | 45114 |
| HPV56 | L2 | 78 | 11 | PSTIVDVTPAR | | 45115 |
| HPV56 | L2 | 185 | 8 | PTSGIHSY | | 45116 |
| HPV56 | L2 | 441 | 8 | PVYFFRRR | | 45117 |
| HPV56 | L2 | 441 | 9 | PVYFFRRRR | | 45118 |
| HPV56 | L2 | 441 | 10 | PVYFFRRRRR | | 45119 |
| HPV56 | L2 | 441 | 11 | PVYFFRRRRRK | | 45120 |
| HPV56 | L2 | 433 | 11 | QGSSFALWPVY | | 45121 |
| HPV56 | L2 | 312 | 8 | QIGARVHY | | 45122 |
| HPV56 | L2 | 312 | 9 | QIGARVHYY | | 45123 |
| HPV56 | L2 | 312 | 10 | QIGARVHYYY | | 45124 |
| HPV56 | L2 | 421 | 8 | QSPYDVTH | | 45125 |
| HPV56 | L2 | 421 | 11 | QSPYDVTHDVY | | 45126 |
| HPV56 | L2 | 364 | 9 | QSVATPSAH | | 45127 |
| HPV56 | L2 | 306 | 11 | QTRRGTQIGAR | | 45128 |
| HPV56 | L2 | 68 | 10 | RAGYVPLGSR | | 45129 |

TABLE XVII-continued

A11 Motif Peptides

| Type | Protein | Position | No. of Amino Acids | Sequence | A*1101 | Seq. Id. No. |
|---|---|---|---|---|---|---|
| HPV56 | L2 | 11 | 8 | RASATQLY | | 45130 |
| HPV56 | L2 | 11 | 9 | RASATQLYK | | 45131 |
| HPV56 | L2 | 295 | 8 | RFSRLGRK | | 45132 |
| HPV56 | L2 | 291 | 8 | RGGVRFSR | | 45133 |
| HPV56 | L2 | 291 | 11 | RGGVRFSRLGR | | 45134 |
| HPV56 | L2 | 309 | 8 | RGTQIGAR | | 45135 |
| HPV56 | L2 | 309 | 10 | RGTQIGARVH | | 45136 |
| HPV56 | L2 | 309 | 11 | RGTQIGARVHY | | 45137 |
| HPV56 | L2 | 220 | 8 | RIAAPRLY | | 45138 |
| HPV56 | L2 | 220 | 9 | RIAAPRLYR | | 45139 |
| HPV56 | L2 | 220 | 10 | RIAAPRLYRK | | 45140 |
| HPV56 | L2 | 298 | 11 | RLGRKATIQTR | | 45141 |
| HPV56 | L2 | 225 | 11 | RLYRKAFQQVK | | 45142 |
| HPV56 | L2 | 339 | 10 | SANNSFDGLY | | 45143 |
| HPV56 | L2 | 13 | 10 | SATQLYKTCK | | 45144 |
| HPV56 | L2 | 436 | 8 | SFALWPVY | | 45145 |
| HPV56 | L2 | 436 | 11 | SFALWPVYFFR | | 45146 |
| HPV56 | L2 | 343 | 9 | SFDGLYDIY | | 45147 |
| HPV56 | L2 | 24 | 11 | SGTCPEDVVNK | | 45148 |
| HPV56 | L2 | 435 | 9 | SSFALWPVY | | 45149 |
| HPV56 | L2 | 362 | 11 | SSQSVATPSAH | | 45150 |
| HPV56 | L2 | 211 | 9 | SSTPIPGFR | | 45151 |
| HPV56 | L2 | 211 | 10 | SSTPIPGFRR | | 45152 |
| HPV56 | L2 | 147 | 10 | SSTVHVSSTH | | 45153 |
| HPV56 | L2 | 79 | 10 | STIVDVTPAR | | 45154 |
| HPV56 | L2 | 212 | 8 | STPIPGFR | | 45155 |
| HPV56 | L2 | 212 | 9 | STPIPGFRR | | 45156 |
| HPV56 | L2 | 183 | 8 | STPTSGIH | | 45157 |
| HPV56 | L2 | 183 | 10 | STPTSGIHSY | | 45158 |
| HPV56 | L2 | 148 | 9 | STVHVSSTH | | 45159 |
| HPV56 | L2 | 414 | 11 | STWPFVPQSPY | | 45160 |
| HPV56 | L2 | 365 | 8 | SVATPSAH | | 45161 |
| HPV56 | L2 | 26 | 9 | TCPEDVVNK | | 45162 |
| HPV56 | L2 | 237 | 8 | TDPAFLDR | | 45163 |
| HPV56 | L2 | 63 | 9 | TGSGGRAGY | | 45164 |
| HPV56 | L2 | 61 | 8 | TGTGSGGR | | 45165 |
| HPV56 | L2 | 61 | 11 | TGTGSGGRAGY | | 45166 |
| HPV56 | L2 | 80 | 9 | TIVDVTPAR | | 45167 |
| HPV56 | L2 | 146 | 11 | TSSTVHVSSTH | | 45168 |
| HPV56 | L2 | 288 | 8 | TTRRGGVR | | 45169 |
| HPV56 | L2 | 288 | 11 | TTRRGGVRFSR | | 45170 |
| HPV56 | L2 | 149 | 8 | TVHVSSTH | | 45171 |
| HPV56 | L2 | 2 | 8 | VAHRATRR | | 45172 |
| HPV56 | L2 | 2 | 9 | VAHRATRRK | | 45173 |
| HPV56 | L2 | 2 | 10 | VAHRATRRKR | | 45174 |
| HPV56 | L2 | 280 | 11 | VALHRPAFTTR | | 45175 |
| HPV56 | L2 | 366 | 11 | VATPSAHLPIK | | 45176 |
| HPV56 | L2 | 236 | 9 | VTDPAFLDR | | 45177 |
| HPV56 | L2 | 31 | 7 | VVNKIEQK | | 45178 |
| HPV56 | L2 | 424 | 8 | YDVTHDVY | | 45179 |
| HPV56 | L2 | 443 | 8 | YFFRRRRR | | 45180 |
| HPV56 | L2 | 443 | 9 | YFFRRRRRK | | 45181 |
| HPV56 | L2 | 443 | 10 | YFFRRRRRKR | | 45182 |

TABLE XVIII

A24 Motif Peptides

| Type | Protein | Position | No. of Amino Acids | Sequence | A*2402 | Seq. Id. No. |
|---|---|---|---|---|---|---|
| HPV16 | E1 | 240 | 8 | AFGLTPSI | | 45183 |
| HPV16 | E1 | 391 | 11 | AFLKSNSQAKI | | 45184 |
| HPV16 | E1 | 206 | 9 | AMLAKFKEL | | 45185 |
| HPV16 | E1 | 500 | 9 | CFVNSKSHF | | 45186 |
| HPV16 | E1 | 500 | 10 | CFVNSKSHFW | | 45187 |
| HPV16 | E1 | 500 | 11 | CFVNSKSHFWL | | 45188 |
| HPV16 | E1 | 304 | 9 | CMMIEPPKL | | 45189 |
| HPV16 | E1 | 528 | 9 | CWNYIDDNL | | 45190 |
| HPV16 | E1 | 50 | 10 | DFIVNDNDYL | | 45191 |
| HPV16 | E1 | 235 | 9 | DWCIAAFGL | | 45192 |
| HPV16 | E1 | 438 | 8 | DWKQIVMF | | 45193 |

TABLE XVIII-continued

A24 Motif Peptides

| Type | Protein | Position | No. of Amino Acids | Sequence | A*2402 | Seq. Id. No. |
|---|---|---|---|---|---|---|
| HPV16 | E1 | 438 | 9 | DWKQIVMFL | | 45194 |
| HPV16 | E1 | 452 | 9 | EFMSFLTAL | | 45195 |
| HPV16 | E1 | 338 | 9 | EWIQRQTVL | | 45196 |
| HPV16 | E1 | 612 | 9 | FFSRTWSRL | | 45197 |
| HPV16 | E1 | 612 | 11 | FFSRTWSRLSL | | 45198 |
| HPV16 | E1 | 453 | 8 | FMSFLTAL | | 45199 |
| HPV16 | E1 | 453 | 11 | FMSFLTALKRF | | 45200 |
| HPV16 | E1 | 508 | 11 | FWLQPLADAKI | | 45201 |
| HPV16 | E1 | 519 | 11 | GMLDDATVPCW | | 45202 |
| HPV16 | E1 | 487 | 8 | GMSLMKFL | | 45203 |
| HPV16 | E1 | 210 | 10 | KFKELYGVSF | | 45204 |
| HPV16 | E1 | 492 | 8 | KFLQGSVI | | 45205 |
| HPV16 | E1 | 492 | 10 | KFLQGSVICF | | 45206 |
| HPV16 | E1 | 89 | 10 | KYLVSPLSDI | | 45207 |
| HPV16 | E1 | 485 | 9 | LFGMSLMKF | | 45208 |
| HPV16 | E1 | 485 | 10 | LFGMSLMKFL | | 45209 |
| HPV16 | E1 | 490 | 10 | LMKFLQGSVI | | 45210 |
| HPV16 | E1 | 475 | 11 | LYGAANTGKSL | | 45211 |
| HPV16 | E1 | 214 | 9 | LYGVSFSEL | | 45212 |
| HPV16 | E1 | 260 | 8 | LYLHIQSL | | 45213 |
| HPV16 | E1 | 319 | 8 | LYWYKTGI | | 45214 |
| HPV16 | E1 | 319 | 11 | LYWYKTGISNI | | 45215 |
| HPV16 | E1 | 444 | 10 | MFLRYQGVEF | | 45216 |
| HPV16 | E1 | 305 | 8 | MMIEPPKL | | 45217 |
| HPV16 | E1 | 608 | 10 | NWKSFFSRTW | | 45218 |
| HPV16 | E1 | 530 | 11 | NYIDDNLRNAL | | 45219 |
| HPV16 | E1 | 302 | 11 | PMCMMIEPPKL | | 45220 |
| HPV16 | E1 | 577 | 10 | PYLHNRLVVF | | 45221 |
| HPV16 | E1 | 419 | 8 | QMSMSQWI | | 45222 |
| HPV16 | E1 | 359 | 11 | QMVQWAYDNDI | | 45223 |
| HPV16 | E1 | 362 | 8 | QWAYDNDI | | 45224 |
| HPV16 | E1 | 257 | 8 | QYCLYLHI | | 45225 |
| HPV16 | E1 | 257 | 11 | QYCLYLHIQSL | | 45226 |
| HPV16 | E1 | 575 | 9 | RWPYLHNRL | | 45227 |
| HPV16 | E1 | 280 | 11 | RYKCGKNRETI | | 45228 |
| HPV16 | E1 | 447 | 10 | RYQGVEFMSF | | 45229 |
| HPV16 | E1 | 447 | 11 | RYQGVEFMSFL | | 45230 |
| HPV16 | E1 | 611 | 10 | SFFSRTWSRL | | 45231 |
| HPV16 | E1 | 455 | 9 | SFLTALKRF | | 45232 |
| HPV16 | E1 | 455 | 10 | SFLTALKRFL | | 45233 |
| HPV16 | E1 | 349 | 9 | SFNDCTFEL | | 45234 |
| HPV16 | E1 | 218 | 9 | SFSELVRPF | | 45235 |
| HPV16 | E1 | 546 | 9 | SMDVKHRPL | | 45236 |
| HPV16 | E1 | 270 | 8 | SWGMVVLL | | 45237 |
| HPV16 | E1 | 270 | 9 | SWGMVVLLL | | 45238 |
| HPV16 | E1 | 354 | 10 | TFELSQMVQW | | 45239 |
| HPV16 | E1 | 587 | 8 | TFPNEFPF | | 45240 |
| HPV16 | E1 | 585 | 8 | VFTFPNEF | | 45241 |
| HPV16 | E1 | 585 | 10 | VFTFPNEFPF | | 45242 |
| HPV16 | E1 | 443 | 11 | VMFLRYQGVEF | | 45243 |
| HPV16 | E1 | 601 | 9 | VYELNDKNW | | 45244 |
| HPV16 | E1 | 332 | 8 | VYGDTPEW | | 45245 |
| HPV16 | E1 | 332 | 9 | VYGDTPEWI | | 45246 |
| HPV16 | E1 | 321 | 9 | WYKTGISNI | | 45247 |
| HPV16 | E1 | 320 | 10 | YWYKTGISNI | | 45248 |
| HPV16 | E2 | 270 | 10 | AFNSSHKGRI | | 45249 |
| HPV16 | E2 | 31 | 8 | DYWKHMRL | | 45250 |
| HPV16 | E2 | 340 | 8 | EWQRDQFL | | 45251 |
| HPV16 | E2 | 114 | 8 | GYTVEVQF | | 45252 |
| HPV16 | E2 | 35 | 8 | HMRLECAI | | 45253 |
| HPV16 | E2 | 18 | 9 | HYENDSTDL | | 45254 |
| HPV16 | E2 | 130 | 8 | HYTNWTHI | | 45255 |
| HPV16 | E2 | 130 | 10 | HYTNWTHIYI | | 45256 |
| HPV16 | E2 | 82 | 11 | IYNSQYSNEKW | | 45257 |
| HPV16 | E2 | 42 | 10 | IYYKAREMGF | | 45258 |
| HPV16 | E2 | 91 | 9 | KWTLQDVSL | | 45259 |
| HPV16 | E2 | 177 | 8 | KYSKNKVW | | 45260 |
| HPV16 | E2 | 311 | 9 | LYTAVSSTW | | 45261 |
| HPV16 | E2 | 311 | 11 | LYTAVSSTWHW | | 45262 |
| HPV16 | E2 | 157 | 8 | LYYVHEGI | | 45263 |
| HPV16 | E2 | 345 | 8 | QFLSQVKI | | 45264 |
| HPV16 | E2 | 86 | 9 | QYSNEKWTL | | 45265 |
| HPV16 | E2 | 304 | 8 | RFKKHCTL | | 45266 |
| HPV16 | E2 | 302 | 10 | RYRFKKHCTL | | 45267 |

TABLE XVIII-continued

A24 Motif Peptides

| Type | Protein | Position | No. of Amino Acids | Sequence | A*2402 | Seq. Id. No. |
|---|---|---|---|---|---|---|
| HPV16 | E2 | 128 | 10 | TMHYTNWTHI | | 45268 |
| HPV16 | E2 | 336 | 11 | TYDSEWQRDQF | | 45269 |
| HPV16 | E2 | 183 | 11 | VWEVHAGGQVI | | 45270 |
| HPV16 | E2 | 101 | 10 | VYLTAPTGCI | | 45271 |
| HPV16 | E2 | 32 | 11 | YWKHMRLECAI | | 45272 |
| HPV16 | E2 | 154 | 11 | YYGLYYVHEGI | | 45273 |
| HPV16 | E2 | 43 | 9 | YYKAREMGF | | 45274 |
| HPV16 | E2 | 158 | 11 | YYVHEGIRTYF | | 45275 |
| HPV16 | E5 | 56 | 9 | AFRCFIVYI | | 45276 |
| HPV16 | E5 | 56 | 10 | AFRCFIVYII | | 45277 |
| HPV16 | E5 | 56 | 11 | AFRCFIVYIIF | | 45278 |
| HPV16 | E5 | 18 | 10 | CFCVLLCVCL | | 45279 |
| HPV16 | E5 | 18 | 11 | CFCVLLCVCLL | | 45280 |
| HPV16 | E5 | 59 | 8 | CFIVYIIF | | 45281 |
| HPV16 | E5 | 59 | 11 | CFIVYIIFVYI | | 45282 |
| HPV16 | E5 | 14 | 9 | CFLLCFCVL | | 45283 |
| HPV16 | E5 | 14 | 10 | CFLLCFCVLL | | 45284 |
| HPV16 | E5 | 65 | 8 | IFVYIPLF | | 45285 |
| HPV16 | E5 | 65 | 9 | IFVYIPLFL | | 45286 |
| HPV16 | E5 | 65 | 10 | IFVYIPLFLI | | 45287 |
| HPV16 | E5 | 71 | 10 | LFLIHTHARF | | 45288 |
| HPV16 | E5 | 71 | 11 | LFLIHTHARFL | | 45289 |
| HPV16 | E5 | 49 | 9 | LWITAASAF | | 45290 |
| HPV16 | E5 | 38 | 8 | TYTSLIIL | | 45291 |
| HPV16 | E5 | 38 | 10 | TYTSLIILVL | | 45292 |
| HPV16 | E5 | 38 | 11 | TYTSLIILVLL | | 45293 |
| HPV16 | E5 | 62 | 8 | VYIIFVYI | | 45294 |
| HPV16 | E5 | 62 | 10 | VYIIFVYIPL | | 45295 |
| HPV16 | E5 | 62 | 11 | VYIIFVYIPLF | | 45296 |
| HPV16 | E5 | 67 | 8 | VYIPLFLI | | 45297 |
| HPV16 | E6 | 87 | 9 | CYSLYGTTL | 0.0460 | 45298 |
| HPV16 | E6 | 51 | 9 | DFAFRDLCI | 0.0003 | 45299 |
| HPV16 | E6 | 82 | 9 | EYRHYCYSL | 0.0051 | 45300 |
| HPV16 | E6 | 85 | 11 | HYCYSLYGTTL | 0.0650 | 45301 |
| HPV16 | E6 | 66 | 9 | PYAVCDKCL | 0.0078 | 45302 |
| HPV16 | E6 | 66 | 11 | PYAVCDKCLKF | 0.1100 | 45303 |
| HPV16 | E6 | 98 | 9 | QYNKPLCDL | 0.0001 | 45304 |
| HPV16 | E6 | 98 | 10 | QYNKPLCDLL | 0.0015 | 45305 |
| HPV16 | E6 | 98 | 11 | QYNKPLCDLLI | | 45306 |
| HPV16 | E6 | 131 | 9 | RFHNIRGRW | 0.0220 | 45307 |
| HPV16 | E6 | 38 | 8 | VYCKQQLL | 0.0069 | 45308 |
| HPV16 | E6 | 49 | 9 | VYDFAFRDL | 0.0150 | 45309 |
| HPV16 | E6 | 49 | 11 | VYDFAFRDLCI | | 45310 |
| HPV16 | E7 | 83 | 11 | LMGTLGIVCPI | | 45311 |
| HPV16 | E7 | 56 | 10 | TFCCKCDSTL | | 45312 |
| HPV16 | L1 | 13 | 11 | CYENDVNVYHI | | 45313 |
| HPV16 | L1 | 176 | 9 | DYKQTQLCL | | 45314 |
| HPV16 | L1 | 176 | 10 | DYKQTQLCLI | | 45315 |
| HPV16 | L1 | 395 | 8 | EYDLQFIF | | 45316 |
| HPV16 | L1 | 395 | 10 | EYDLQFIFQL | | 45317 |
| HPV16 | L1 | 388 | 11 | EYLRHGEEYDL | | 45318 |
| HPV16 | L1 | 52 | 8 | EYVARTNI | | 45319 |
| HPV16 | L1 | 24 | 8 | FFQMSLWL | | 45320 |
| HPV16 | L1 | 273 | 10 | FFYLRREQMF | | 45321 |
| HPV16 | L1 | 472 | 10 | FWEVNLKEKF | | 45322 |
| HPV16 | L1 | 274 | 9 | FYLRREQMF | | 45323 |
| HPV16 | L1 | 116 | 9 | FYNPDTQRL | | 45324 |
| HPV16 | L1 | 116 | 11 | FYNPDTQRLVW | | 45325 |
| HPV16 | L1 | 230 | 10 | GFGAMDFTTL | | 45326 |
| HPV16 | L1 | 23 | 8 | IFFQMSLW | | 45327 |
| HPV16 | L1 | 23 | 9 | IFFQMSLWL | | 45328 |
| HPV16 | L1 | 332 | 8 | IFNKPYWL | | 45329 |
| HPV16 | L1 | 401 | 9 | IFQLCKITL | | 45330 |
| HPV16 | L1 | 59 | 10 | IYYHAGTSRL | | 45331 |
| HPV16 | L1 | 59 | 11 | IYYHAGTSRLL | | 45332 |
| HPV16 | L1 | 108 | 9 | KFGFPDTSF | | 45333 |
| HPV16 | L1 | 493 | 8 | KFLLQAGL | | 45334 |
| HPV16 | L1 | 480 | 9 | KFSADLDQF | | 45335 |
| HPV16 | L1 | 480 | 11 | KFSADLDQFPL | | 45336 |
| HPV16 | L1 | 262 | 11 | KMVSEPYGDSL | | 45337 |
| HPV16 | L1 | 469 | 9 | KYTFWEVNL | | 45338 |
| HPV16 | L1 | 272 | 11 | LFFYLRREQMF | | 45339 |
| HPV16 | L1 | 29 | 11 | LWLPSEATVYL | | 45340 |
| HPV16 | L1 | 367 | 8 | NMSLCAAI | | 45341 |

TABLE XVIII-continued

A24 Motif Peptides

| Type | Protein | Position | No. of Amino Acids | Sequence | A*2402 | Seq. Id. No. |
|---|---|---|---|---|---|---|
| HPV16 | L1 | 267 | 8 | PYGDSLFF | | 45342 |
| HPV16 | L1 | 267 | 10 | PYGDSLFFYL | | 45343 |
| HPV16 | L1 | 399 | 9 | QFIFQLCKI | | 45344 |
| HPV16 | L1 | 399 | 11 | QFIFQLCKITL | | 45345 |
| HPV16 | L1 | 487 | 8 | QFPLGRKF | | 45346 |
| HPV16 | L1 | 487 | 9 | QFPLGRKFL | | 45347 |
| HPV16 | L1 | 487 | 10 | QFPLGRKFLL | | 45348 |
| HPV16 | L1 | 280 | 8 | QMFVRHLF | | 45349 |
| HPV16 | L1 | 95 | 9 | QYRVFRIHL | | 45350 |
| HPV16 | L1 | 445 | 8 | RFVTSQAI | | 45351 |
| HPV16 | L1 | 115 | 10 | SFYNPDTQRL | | 45352 |
| HPV16 | L1 | 174 | 9 | SMDYKQTQL | | 45353 |
| HPV16 | L1 | 174 | 11 | SMDYKQTQLCL | | 45354 |
| HPV16 | L1 | 419 | 10 | SMNSTILEDW | | 45355 |
| HPV16 | L1 | 324 | 9 | SMVTSDAQI | | 45356 |
| HPV16 | L1 | 324 | 10 | SMVTSDAQIF | | 45357 |
| HPV16 | L1 | 4 | 8 | TFIYILVI | | 45358 |
| HPV16 | L1 | 471 | 11 | TFWEVNLKEKF | | 45359 |
| HPV16 | L1 | 415 | 10 | TYIHSMNSTI | | 45360 |
| HPV16 | L1 | 415 | 11 | TYIHSMNSTIL | | 45361 |
| HPV16 | L1 | 380 | 11 | TYKNTNFKEYL | | 45362 |
| HPV16 | L1 | 443 | 10 | TYRFVTSQAI | | 45363 |
| HPV16 | L1 | 20 | 10 | VYHIFFQMSL | | 45364 |
| HPV16 | L1 | 20 | 11 | VYHIFFQMSLW | | 45365 |
| HPV16 | L1 | 60 | 9 | YYHAGTSRL | | 45366 |
| HPV16 | L1 | 60 | 10 | YYHAGTSRLL | | 45367 |
| HPV16 | L2 | 241 | 9 | AFITTPTKL | | 45368 |
| HPV16 | L2 | 241 | 10 | AFITTPTKLI | | 45369 |
| HPV16 | L2 | 256 | 11 | AYEGIDVDNTL | | 45370 |
| HPV16 | L2 | 282 | 8 | DFLDIVAL | | 45371 |
| HPV16 | L2 | 329 | 11 | DFSTIDSAEEI | | 45372 |
| HPV16 | L2 | 445 | 11 | DFYLHPSYYML | | 45373 |
| HPV16 | L2 | 446 | 10 | FYLHPSYYML | | 45374 |
| HPV16 | L2 | 392 | 9 | GYIPANTTI | | 45375 |
| HPV16 | L2 | 392 | 11 | GYIPANTTIPF | | 45376 |
| HPV16 | L2 | 180 | 9 | HFTLSSSTI | | 45377 |
| HPV16 | L2 | 325 | 9 | HYYYDFSTI | | 45378 |
| HPV16 | L2 | 365 | 9 | LYDIYADDF | | 45379 |
| HPV16 | L2 | 365 | 10 | LYDIYADDFI | | 45380 |
| HPV16 | L2 | 266 | 10 | LYFSSNDNSI | | 45381 |
| HPV16 | L2 | 192 | 10 | NYEEIPMDTF | | 45382 |
| HPV16 | L2 | 192 | 11 | NYEEIPMDTFI | | 45383 |
| HPV16 | L2 | 401 | 8 | PFGGAYNI | | 45384 |
| HPV16 | L2 | 401 | 10 | PFGGAYNIPL | | 45385 |
| HPV16 | L2 | 463 | 9 | PYFFSDVSL | | 45386 |
| HPV16 | L2 | 47 | 8 | QYGSMGVF | | 45387 |
| HPV16 | L2 | 47 | 9 | QYGSMGVFF | | 45388 |
| HPV16 | L2 | 436 | 11 | QYTIIADAGDF | | 45389 |
| HPV16 | L2 | 302 | 11 | RYSRIGNKQTL | | 45390 |
| HPV16 | L2 | 50 | 9 | SMGVFFGGL | | 45391 |
| HPV16 | L2 | 50 | 11 | SMGVFFGGLGI | | 45392 |
| HPV16 | L2 | 162 | 8 | TFTDPSVL | | 45393 |
| HPV16 | L2 | 251 | 10 | TYDNPAYEGI | | 45394 |
| HPV16 | L2 | 348 | 10 | TYTTSHAAL | | 45395 |
| HPV16 | L2 | 53 | 8 | VFFGGLGI | | 45396 |
| HPV16 | L2 | 464 | 8 | YFFSDVSL | | 45397 |
| HPV16 | L2 | 267 | 9 | YFSSNDNSI | | 45398 |
| HPV16 | L2 | 267 | 11 | YFSSNDNSINI | | 45399 |
| HPV16 | L2 | 453 | 10 | YMLRKRRKRL | | 45400 |
| HPV16 | L2 | 452 | 11 | YYMLRKRRKRL | | 45401 |
| HPV16 | L2 | 326 | 8 | YYYDFSTI | | 45402 |
| HPV18 | E1 | 526 | 11 | AMLDDATTTCW | | 45403 |
| HPV18 | E1 | 618 | 10 | CFFERTWSRL | | 45404 |
| HPV18 | E1 | 311 | 9 | CMLIQPPKL | | 45405 |
| HPV18 | E1 | 49 | 9 | DFIDTQGTF | | 45406 |
| HPV18 | E1 | 381 | 8 | DMAFEYAL | | 45407 |
| HPV18 | E1 | 381 | 9 | DMAFEYALL | | 45408 |
| HPV18 | E1 | 445 | 8 | DWRPIVQF | | 45409 |
| HPV18 | E1 | 445 | 9 | DWRPIVQFL | | 45410 |
| HPV18 | E1 | 459 | 9 | EFITFLGAL | | 45411 |
| HPV18 | E1 | 594 | 8 | EFPNAFPF | | 45412 |
| HPV18 | E1 | 366 | 11 | EMVQWAFDNEL | | 45413 |
| HPV18 | E1 | 345 | 8 | EWIQRLTI | | 45414 |
| HPV18 | E1 | 345 | 9 | EWIQRLTII | | 45415 |

TABLE XVIII-continued

A24 Motif Peptides

| Type | Protein | Position | No. of Amino Acids | Sequence | A*2402 | Seq. Id. No. |
|---|---|---|---|---|---|---|
| HPV18 | E1 | 619 | 9 | FFERTWSRL | | 45416 |
| HPV18 | E1 | 619 | 11 | FFERTWSRLDL | | 45417 |
| HPV18 | E1 | 257 | 9 | GFKTLIQPF | | 45418 |
| HPV18 | E1 | 257 | 10 | GFKTLIQPFI | | 45419 |
| HPV18 | E1 | 257 | 11 | GFKTLIQPFIL | | 45420 |
| HPV18 | E1 | 494 | 8 | GMSFIHFI | | 45421 |
| HPV18 | E1 | 16 | 8 | GWFYVQAI | | 45422 |
| HPV18 | E1 | 499 | 8 | HFIQGAVI | | 45423 |
| HPV18 | E1 | 499 | 10 | HFIQGAVISF | | 45424 |
| HPV18 | E1 | 247 | 8 | IFGVNPTI | | 45425 |
| HPV18 | E1 | 277 | 9 | KWGVLILAL | | 45426 |
| HPV18 | E1 | 277 | 10 | KWGVLILALL | | 45427 |
| HPV18 | E1 | 267 | 8 | LYAHIQCL | | 45428 |
| HPV18 | E1 | 326 | 8 | LYWYRTGI | | 45429 |
| HPV18 | E1 | 326 | 11 | LYWYRTGISNI | | 45430 |
| HPV18 | E1 | 361 | 10 | NFDLSEMVQW | | 45431 |
| HPV18 | E1 | 428 | 8 | NMSQWIRF | | 45432 |
| HPV18 | E1 | 615 | 10 | NWKCFFERTW | | 45433 |
| HPV18 | E1 | 264 | 8 | PFILYAHI | | 45434 |
| HPV18 | E1 | 264 | 11 | PFILYAHIQCL | | 45435 |
| HPV18 | E1 | 584 | 10 | PYLESRITVF | | 45436 |
| HPV18 | E1 | 451 | 8 | QFLRYQQI | | 45437 |
| HPV18 | E1 | 451 | 10 | QFLRYQQIEF | | 45438 |
| HPV18 | E1 | 451 | 11 | QFLRYQQIEFI | | 45439 |
| HPV18 | E1 | 426 | 8 | QMNSQWI | | 45440 |
| HPV18 | E1 | 426 | 10 | QMNSQWIRF | | 45441 |
| HPV18 | E1 | 369 | 8 | QWAFDNEL | | 45442 |
| HPV18 | E1 | 431 | 10 | QWIRFCSKI | | 45443 |
| HPV18 | E1 | 582 | 9 | RWPYLESRI | | 45444 |
| HPV18 | E1 | 287 | 9 | RYKCGKSRL | | 45445 |
| HPV18 | E1 | 454 | 8 | RYQQIEFI | | 45446 |
| HPV18 | E1 | 454 | 10 | RYQQIEFITF | | 45447 |
| HPV18 | E1 | 454 | 11 | RYQQIEFITFL | | 45448 |
| HPV18 | E1 | 496 | 11 | SFIHFIQGAVI | | 45449 |
| HPV18 | E1 | 225 | 9 | SFTDLVRNF | | 45450 |
| HPV18 | E1 | 507 | 9 | SFVNSTSHF | | 45451 |
| HPV18 | E1 | 507 | 10 | SFVNSTSHFW | | 45452 |
| HPV18 | E1 | 507 | 11 | SFVNSTSHFWL | | 45453 |
| HPV18 | E1 | 491 | 8 | SYFGMSFI | | 45454 |
| HPV18 | E1 | 491 | 10 | SYFGMSFIHF | | 45455 |
| HPV18 | E1 | 491 | 11 | SYFGMSFIHFI | | 45456 |
| HPV18 | E1 | 56 | 8 | TFCEQAEL | | 45457 |
| HPV18 | E1 | 462 | 9 | TFLGALKSF | | 45458 |
| HPV18 | E1 | 462 | 10 | TFLGALKSFL | | 45459 |
| HPV18 | E1 | 537 | 11 | TYFDTYMRNAL | | 45460 |
| HPV18 | E1 | 221 | 9 | TYGLSFTDL | | 45461 |
| HPV18 | E1 | 592 | 8 | VFEFPNAF | | 45462 |
| HPV18 | E1 | 592 | 10 | VFEFPNAFPF | | 45463 |
| HPV18 | E1 | 217 | 8 | VFKDTYGL | | 45464 |
| HPV18 | E1 | 217 | 10 | VFKDTYGLSF | | 45465 |
| HPV18 | E1 | 339 | 8 | VMGDTPEW | | 45466 |
| HPV18 | E1 | 339 | 9 | VMGDTPEWI | | 45467 |
| HPV18 | E1 | 608 | 9 | VYEINDKNW | | 45468 |
| HPV18 | E1 | 328 | 9 | WYRTGISNI | | 45469 |
| HPV18 | E1 | 538 | 10 | YFDTYMRNAL | | 45470 |
| HPV18 | E1 | 492 | 9 | YFGMSFIHF | | 45471 |
| HPV18 | E1 | 492 | 10 | YFGMSFIHFI | | 45472 |
| HPV18 | E1 | 542 | 11 | YMRNALDGNPI | | 45473 |
| HPV18 | E1 | 327 | 10 | YWYRTGISNI | | 45474 |
| HPV18 | E2 | 95 | 11 | DWTLQDTCEEL | | 45475 |
| HPV18 | E2 | 47 | 9 | FFAAREHGI | | 45476 |
| HPV18 | E2 | 168 | 9 | GYNTFYIEF | | 45477 |
| HPV18 | E2 | 22 | 9 | HYENDSKDI | | 45478 |
| HPV18 | E2 | 312 | 9 | HYRDISSTW | | 45479 |
| HPV18 | E2 | 312 | 11 | HYRDISSTWHW | | 45480 |
| HPV18 | E2 | 46 | 10 | IFFAAREHGI | | 45481 |
| HPV18 | E2 | 345 | 8 | KFLNTVAI | | 45482 |
| HPV18 | E2 | 182 | 8 | KYGNTGTW | | 45483 |
| HPV18 | E2 | 105 | 10 | LWNTEPTHCF | | 45484 |
| HPV18 | E2 | 162 | 11 | LYYVKEGYNTF | | 45485 |
| HPV18 | E2 | 35 | 8 | QYWQLIRW | | 45486 |
| HPV18 | E2 | 41 | 8 | RWENAIFF | | 45487 |
| HPV18 | E2 | 90 | 9 | RYKTEDWTL | | 45488 |
| HPV18 | E2 | 188 | 11 | TWEVHFGNNVI | | 45489 |

TABLE XVIII-continued

A24 Motif Peptides

| Type | Protein | Position | No. of Amino Acids | Sequence | A*2402 | Seq. Id. No. |
|---|---|---|---|---|---|---|
| HPV18 | E2 | 336 | 11 | TYHSETQRTKF | | 45490 |
| HPV18 | E2 | 141 | 10 | VYYMTDAGTW | | 45491 |
| HPV18 | E2 | 143 | 8 | YMTDAGTW | | 45492 |
| HPV18 | E2 | 36 | 11 | YWQLIRWENAI | | 45493 |
| HPV18 | E2 | 142 | 9 | YYMTDAGTW | | 45494 |
| HPV18 | E2 | 163 | 10 | YYVKEGYNTF | | 45495 |
| HPV18 | E5 | 49 | 9 | AFTVYVFCF | | 45496 |
| HPV18 | E5 | 49 | 10 | AFTVYVFCFL | | 45497 |
| HPV18 | E5 | 49 | 11 | AFTVYVFCFLL | | 45498 |
| HPV18 | E5 | 32 | 9 | AWVLVFVYI | | 45499 |
| HPV18 | E5 | 30 | 8 | AYAWVLVF | | 45500 |
| HPV18 | E5 | 30 | 11 | AYAWVLVFVYI | | 45501 |
| HPV18 | E5 | 56 | 8 | CFLLPMLL | | 45502 |
| HPV18 | E5 | 56 | 9 | CFLLPMLLL | | 45503 |
| HPV18 | E5 | 56 | 11 | CFLLPMLLLHI | | 45504 |
| HPV18 | E5 | 27 | 9 | CMCAYAWVL | | 45505 |
| HPV18 | E5 | 27 | 11 | CMCAYAWVLVF | | 45506 |
| HPV18 | E5 | 13 | 10 | CMYVCCHVPL | | 45507 |
| HPV18 | E5 | 13 | 11 | CMYVCCHVPLL | | 45508 |
| HPV18 | E5 | 14 | 9 | MYVCCHVPL | | 45509 |
| HPV18 | E5 | 14 | 10 | MYVCCHVPLL | | 45510 |
| HPV18 | E5 | 60 | 10 | PMLLLHIHAI | | 45511 |
| HPV18 | E5 | 60 | 11 | PMLLLHIHAIL | | 45512 |
| HPV18 | E5 | 54 | 9 | VFCFLLPML | | 45513 |
| HPV18 | E5 | 54 | 10 | VFCFLLPMLL | | 45514 |
| HPV18 | E5 | 54 | 11 | VFCFLLPMLLL | | 45515 |
| HPV18 | E5 | 36 | 8 | VFVYIVVI | | 45516 |
| HPV18 | E5 | 52 | 8 | VYVFCLL | | 45517 |
| HPV18 | E5 | 52 | 11 | VYVFCFLLPML | | 45518 |
| HPV18 | E6 | 70 | 9 | DFYSRIREL | | 45519 |
| HPV18 | E6 | 46 | 8 | EFAFKDLF | | 45520 |
| HPV18 | E6 | 71 | 8 | FYSRIREL | 0.0260 | 45521 |
| HPV18 | E6 | 80 | 11 | HYSDSVYGDTL | 0.0069 | 45522 |
| HPV18 | E6 | 52 | 9 | LFVVYRDSI | | 45523 |
| HPV18 | E6 | 98 | 9 | LYNLLIRCL | 0.0001 | 45524 |
| HPV18 | E6 | 11 | 11 | PYKLPDLCTEL | 0.0064 | 45525 |
| HPV18 | E6 | 44 | 9 | VFEFAFKDL | | 45526 |
| HPV18 | E6 | 44 | 10 | VFEFAFKDLF | 0.0360 | 45527 |
| HPV18 | E6 | 33 | 9 | VYCKTVLEL | 0.0220 | 45528 |
| HPV18 | E6 | 85 | 9 | VYGDTLEKL | 0.0150 | 45529 |
| HPV18 | E7 | 85 | 10 | AFQQLFLNTL | | 45530 |
| HPV18 | E7 | 63 | 10 | CMCCKCEARI | 0.0001 | 45531 |
| HPV18 | E7 | 89 | 8 | LFLNTLSF | | 45532 |
| HPV18 | L1 | 128 | 11 | AYQYRVFRVQL | | 45533 |
| HPV18 | L1 | 211 | 9 | DYKQTQLCI | | 45534 |
| HPV18 | L1 | 211 | 10 | DYKQTQLCIL | | 45535 |
| HPV18 | L1 | 87 | 8 | DYVTPTSI | | 45536 |
| HPV18 | L1 | 87 | 9 | DYVTPTSIF | | 45537 |
| HPV18 | L1 | 431 | 8 | EYDLQFIF | | 45538 |
| HPV18 | L1 | 431 | 10 | EYDLQFIFQL | | 45539 |
| HPV18 | L1 | 308 | 9 | FFCLRREQL | | 45540 |
| HPV18 | L1 | 308 | 10 | FFCLRREQLF | | 45541 |
| HPV18 | L1 | 508 | 10 | FWNVDLKEKF | | 45542 |
| HPV18 | L1 | 95 | 9 | FYHAGSSRL | | 45543 |
| HPV18 | L1 | 95 | 10 | FYHAGSSRLL | | 45544 |
| HPV18 | L1 | 265 | 10 | GYGAMDFSTL | | 45545 |
| HPV18 | L1 | 11 | 11 | HYHLLPLYGPL | | 45546 |
| HPV18 | L1 | 58 | 8 | IFLQMALW | | 45547 |
| HPV18 | L1 | 437 | 9 | IFQLCTITL | | 45548 |
| HPV18 | L1 | 94 | 10 | IFYHAGSSRL | | 45549 |
| HPV18 | L1 | 94 | 11 | IFYHAGSSRLL | | 45550 |
| HPV18 | L1 | 151 | 9 | IYNPETQRL | | 45551 |
| HPV18 | L1 | 151 | 11 | IYNPETQRLVW | | 45552 |
| HPV18 | L1 | 143 | 9 | KFGLPDTSI | | 45553 |
| HPV18 | L1 | 529 | 8 | KFLVQAGL | | 45554 |
| HPV18 | L1 | 516 | 11 | KFSLDLDQYPL | | 45555 |
| HPV18 | L1 | 507 | 11 | KFWNVDLKEKF | | 45556 |
| HPV18 | L1 | 48 | 9 | LFLRNVNVF | | 45557 |
| HPV18 | L1 | 48 | 11 | LFLRNVNVFPI | | 45558 |
| HPV18 | L1 | 367 | 8 | LFNKPYWL | | 45559 |
| HPV18 | L1 | 64 | 11 | LWRPSDNTVYL | | 45560 |
| HPV18 | L1 | 17 | 11 | LYGPLYHPRPL | | 45561 |
| HPV18 | L1 | 21 | 9 | LYHPRPLPL | | 45562 |
| HPV18 | L1 | 3 | 8 | LYTRVLIL | | 45563 |

TABLE XVIII-continued

A24 Motif Peptides

| Type | Protein | Position | No. of Amino Acids | Sequence | A*2402 | Seq. Id. No. |
|---|---|---|---|---|---|---|
| HPV18 | L1 | 307 | 10 | MFFCLRREQL | | 45564 |
| HPV18 | L1 | 307 | 11 | MFFCLRREQLF | | 45565 |
| HPV18 | L1 | 502 | 8 | PYDKLKFW | | 45566 |
| HPV18 | L1 | 302 | 8 | PYGDSMFF | | 45567 |
| HPV18 | L1 | 302 | 10 | PYGDSMFFCL | | 45568 |
| HPV18 | L1 | 435 | 9 | QFIFQLCTI | | 45569 |
| HPV18 | L1 | 435 | 11 | QFIFQLCTITL | | 45570 |
| HPV18 | L1 | 523 | 8 | QYPLGRKF | | 45571 |
| HPV18 | L1 | 523 | 9 | QYPLGRKFL | | 45572 |
| HPV18 | L1 | 130 | 9 | QYRVFRVQL | | 45573 |
| HPV18 | L1 | 424 | 11 | QYSRHVEEYDL | | 45574 |
| HPV18 | L1 | 481 | 8 | RFVQSVAI | | 45575 |
| HPV18 | L1 | 306 | 11 | SMFFCLRREQL | | 45576 |
| HPV18 | L1 | 455 | 10 | SMNSSILEDW | | 45577 |
| HPVIS | L1 | 451 | 10 | SYIHSMNSSI | | 45578 |
| HPV18 | L1 | 451 | 11 | SYIHSMNSSIL | | 45579 |
| HPV18 | L1 | 327 | 10 | TMGDTVPQSL | | 45580 |
| HPV18 | L1 | 479 | 10 | TYRFVQSVAI | | 45581 |
| HPV18 | L1 | 55 | 10 | VFPIFLQMAL | | 45582 |
| HPV18 | L1 | 55 | 11 | VFPIFLQMALW | | 45583 |
| HPV18 | L1 | 160 | 9 | VWACAGVEI | | 45584 |
| HPV18 | L1 | 34 | 8 | VYMVHIII | | 45585 |
| HPV18 | L1 | 351 | 10 | VYSPSPSGSI | | 45586 |
| HPV18 | L2 | 255 | 9 | AFEPVDTTL | | 45587 |
| HPV18 | L2 | 255 | 11 | AFEPVDTTLTF | | 45588 |
| HPV18 | L2 | 370 | 9 | AFFKYSPTI | | 45589 |
| HPV18 | L2 | 161 | 8 | AFSDPSII | | 45590 |
| HPV18 | L2 | 275 | 8 | DFMDIIRL | | 45591 |
| HPV18 | L2 | 240 | 9 | EFLTRPSSL | | 45592 |
| HPV18 | L2 | 240 | 10 | EFLTRPSSLI | | 45593 |
| HPV18 | L2 | 331 | 8 | EYIELQPL | | 45594 |
| HPV18 | L2 | 371 | 8 | FFKYSPTI | | 45595 |
| HPV18 | L2 | 319 | 8 | FYHDISPI | | 45596 |
| HPV18 | L2 | 191 | 10 | GYEEIPLQTF | | 45597 |
| HPV18 | L2 | 318 | 9 | HFYHDISPI | | 45598 |
| HPV18 | L2 | 434 | 10 | HYYLWPLYYF | | 45599 |
| HPV18 | L2 | 434 | 11 | HYYLWPLYYFI | | 45600 |
| HPV18 | L2 | 52 | 8 | IFLGGLGI | | 45601 |
| HPV18 | L2 | 437 | 8 | LWPLYYFI | | 45602 |
| HPV18 | L2 | 305 | 9 | MFTRSGTQI | | 45603 |
| HPV18 | L2 | 452 | 8 | PYFFADGF | | 45604 |
| HPV18 | L2 | 46 | 8 | QWSSLGIF | | 45605 |
| HPV18 | L2 | 46 | 9 | QWSSLGIFL | | 45606 |
| HPV18 | L2 | 368 | 11 | SFAFFKYSPTI | | 45607 |
| HPV18 | L2 | 383 | 9 | SYSNVTVPL | | 45608 |
| HPV18 | L2 | 121 | 8 | TFTGTSGF | | 45609 |
| HPV18 | L2 | 121 | 10 | TFTGTSGFDI | | 45610 |
| HPV18 | L2 | 304 | 10 | TMFTRSGTQI | | 45611 |
| HPV18 | L2 | 399 | 9 | VYTGPDITL | | 45612 |
| HPV18 | L2 | 435 | 9 | YYLWPLYYF | | 45613 |
| HPV18 | L2 | 435 | 10 | YYLWPLYYFI | | 45614 |
| HPV31 | E1 | 371 | 11 | AFLKSNSQAKI | | 45615 |
| HPV31 | E1 | 186 | 9 | AMLGKFKEL | | 45616 |
| HPV31 | E1 | 284 | 9 | CMLIQPPKL | | 45617 |
| HPV31 | E1 | 508 | 9 | CWHYIDNYL | | 45618 |
| HPV31 | E1 | 418 | 8 | DWRDIVKF | | 45619 |
| HPV31 | E1 | 418 | 9 | DWRDIVKFL | | 45620 |
| HPV31 | E1 | 102 | 8 | DYNISPRL | | 45621 |
| HPV31 | E1 | 102 | 11 | DYNISPRLKAI | | 45622 |
| HPV31 | E1 | 432 | 9 | EFVSFLSAL | | 45623 |
| HPV31 | E1 | 432 | 11 | EFVSFLSALKL | | 45624 |
| HPV31 | E1 | 318 | 9 | EWIERQTVL | | 45625 |
| HPV31 | E1 | 592 | 9 | FFSRTWCRL | | 45626 |
| HPV31 | E1 | 592 | 11 | FFSRTWCRLNL | | 45627 |
| HPV31 | E1 | 199 | 8 | FMELIRPF | | 45628 |
| HPV31 | E1 | 488 | 11 | FWLQPLADAKI | | 45629 |
| HPV31 | E1 | 230 | 11 | GFKTLLQPYCL | | 45630 |
| HPV31 | E1 | 499 | 11 | GMLDDATTPCW | | 45631 |
| HPV31 | E1 | 467 | 8 | GMSLISFL | | 45632 |
| HPV31 | E1 | 252 | 10 | GMVMLMLVRF | | 45633 |
| HPV31 | E1 | 16 | 9 | GWFYVEAVI | | 45634 |
| HPV31 | E1 | 510 | 11 | HYIDNYLRNAL | | 45635 |
| HPV31 | E1 | 190 | 10 | KFKELYGVSF | | 45636 |
| HPV31 | E1 | 424 | 8 | KFLRYQQI | | 45637 |

TABLE XVIII-continued

A24 Motif Peptides

| Type | Protein | Position | No. of Amino Acids | Sequence | A*2402 | Seq. Id. No. |
|---|---|---|---|---|---|---|
| HPV31 | E1 | 424 | 10 | KFLRYQQIEF | | 45638 |
| HPV31 | E1 | 88 | 10 | KYVGSPLSDI | | 45639 |
| HPV31 | E1 | 534 | 9 | LMQLKCPPL | | 45640 |
| HPV31 | E1 | 534 | 10 | LMQLKCPPLL | | 45641 |
| HPV31 | E1 | 534 | 11 | LMQLKCPPLLI | | 45642 |
| HPV31 | E1 | 240 | 8 | LYCHLQSL | | 45643 |
| HPV31 | E1 | 194 | 9 | LYGVSFMEL | | 45644 |
| HPV31 | E1 | 194 | 10 | LYGVSFMELI | | 45645 |
| HPV31 | E1 | 299 | 11 | LYWYRTGMSNI | | 45646 |
| HPV31 | E1 | 588 | 10 | NWKSFFSRTW | | 45647 |
| HPV31 | E1 | 237 | 8 | PYCLYCHL | | 45648 |
| HPV31 | E1 | 237 | 11 | PYCLYCHLQSL | | 45649 |
| HPV31 | E1 | 557 | 10 | PYLHSRLVVF | | 45650 |
| HPV31 | E1 | 399 | 8 | QMSMGQWI | | 45651 |
| HPV31 | E1 | 260 | 9 | RFKCAKNRI | | 45652 |
| HPV31 | E1 | 260 | 11 | RFKCAKNRITI | | 45653 |
| HPV31 | E1 | 555 | 9 | RWPYLHSRL | | 45654 |
| HPV31 | E1 | 427 | 10 | RYQQIEFVSF | | 45655 |
| HPV31 | E1 | 427 | 11 | RYQQIEFVSFL | | 45656 |
| HPV31 | E1 | 591 | 10 | SFFSRTWCRL | | 45657 |
| HPV31 | E1 | 472 | 8 | SFLQGCII | | 45658 |
| HPV31 | E1 | 435 | 8 | SPLSALKL | | 45659 |
| HPV31 | E1 | 435 | 9 | SFLSALKLF | | 45660 |
| HPV31 | E1 | 435 | 10 | SFLSALKLFL | | 45661 |
| HPV31 | E1 | 198 | 9 | SFMELIRPF | | 45662 |
| HPV31 | E1 | 329 | 9 | SFNDTTFDL | | 45663 |
| HPV31 | E1 | 250 | 9 | SWGMVMLML | | 45664 |
| HPV31 | E1 | 480 | 9 | SYANSKSHF | | 45665 |
| HPV31 | E1 | 480 | 10 | SYANSKSHFW | | 45666 |
| HPV31 | E1 | 480 | 11 | SYANSKSHFWL | | 45667 |
| HPV31 | E1 | 464 | 8 | SYFGMSLI | | 45668 |
| HPV31 | E1 | 464 | 10 | SYFGMSLISF | | 45669 |
| HPV31 | E1 | 464 | 11 | SYFGMSLISFL | | 45670 |
| HPV31 | E1 | 334 | 10 | TFDLSQMVQW | | 45671 |
| HPV31 | E1 | 617 | 10 | TFKCVSGQNI | | 45672 |
| HPV31 | E1 | 567 | 8 | TFPNPFPF | | 45673 |
| HPV31 | E1 | 565 | 8 | VFTFPNPF | | 45674 |
| HPV31 | E1 | 565 | 10 | VFTFPNPFPF | | 45675 |
| HPV31 | E1 | 254 | 8 | VMLMLVRF | | 45676 |
| HPV31 | E1 | 581 | 9 | VYELSDKNW | | 45677 |
| HPV31 | E1 | 312 | 8 | VYGETPEW | | 45678 |
| HPV31 | E1 | 312 | 9 | VYGETPEWI | | 45679 |
| HPV31 | E1 | 17 | 8 | WFYVEAVI | | 45680 |
| HPV31 | E1 | 301 | 9 | WYRTGMSNI | | 45681 |
| HPV31 | E1 | 465 | 9 | YFGMSLISF | | 45682 |
| HPV31 | E1 | 465 | 10 | YFGMSLISFL | | 45683 |
| HPV31 | E1 | 300 | 10 | YWYRTGMSNI | | 45684 |
| HPV31 | E2 | 352 | 8 | DFLNTVKI | | 45685 |
| HPV31 | E2 | 91 | 9 | DWTMQQTSL | | 45686 |
| HPV31 | E2 | 91 | 11 | DWTMQQTSLEL | | 45687 |
| HPV31 | E2 | 31 | 8 | DYWKHIRL | | 45688 |
| HPV31 | E2 | 114 | 8 | GYTVEVQF | | 45689 |
| HPV31 | E2 | 18 | 9 | HYENDSKRL | | 45690 |
| HPV31 | E2 | 130 | 8 | HYTNWKFI | | 45691 |
| HPV31 | E2 | 130 | 10 | HYTNWKFIYL | | 45692 |
| HPV31 | E2 | 157 | 9 | IYYVHEGHI | | 45693 |
| HPV31 | E2 | 183 | 11 | KWEVHAGGQVI | | 45694 |
| HPV31 | E2 | 177 | 8 | KYGTGKKW | | 45695 |
| HPV31 | E2 | 42 | 10 | LMYKAREMGI | | 45696 |
| HPV31 | E2 | 318 | 9 | LYEQVSSTW | | 45697 |
| HPV31 | E2 | 318 | 11 | LYEQVSSTWHW | | 45698 |
| HPV31 | E2 | 101 | 10 | LYLTAPTGCL | | 45699 |
| HPV31 | E2 | 43 | 9 | MYKAREMGI | | 45700 |
| HPV31 | E2 | 133 | 9 | NWKFIYLCI | | 45701 |
| HPV31 | E2 | 309 | 10 | RYRLSKYKQL | | 45702 |
| HPV31 | E2 | 206 | 9 | SFAGIVTKL | | 45703 |
| HPV31 | E2 | 128 | 9 | TMHYTNWKF | | 45704 |
| HPV31 | E2 | 128 | 10 | TMHYTNWKFI | | 45705 |
| HPV31 | E2 | 93 | 9 | TMQQTSLEL | | 45706 |
| HPV31 | E2 | 93 | 11 | TMQQTSLELYL | | 45707 |
| HPV31 | E2 | 343 | 11 | TYISTSQRDDF | | 45708 |
| HPV31 | E2 | 199 | 9 | VFSSDEISF | | 45709 |
| HPV31 | E2 | 32 | 11 | YWKHIRLECVL | | 45710 |
| HPV31 | E2 | 158 | 8 | YYVHEGHI | | 45711 |

TABLE XVIII-continued

A24 Motif Peptides

| Type | Protein | Position | No. of Amino Acids | Sequence | A*2402 | Seq. Id. No. |
|---|---|---|---|---|---|---|
| HPV31 | E2 | 158 | 11 | YYVHEGHITYF | | 45712 |
| HPV31 | E5 | 59 | 8 | CFCIYVVF | | 45713 |
| HPV31 | E5 | 59 | 9 | CFCIYVVFI | | 45714 |
| HPV31 | E5 | 59 | 11 | CFCIYVVFIYI | | 45715 |
| HPV31 | E5 | 18 | 10 | CFCVLLFVCL | | 45716 |
| HPV31 | E5 | 14 | 9 | CFLLCFCVL | | 45717 |
| HPV31 | E5 | 14 | 10 | CFLLCFCVLL | | 45718 |
| HPV31 | E5 | 14 | 11 | CFLLCFCVLLF | | 45719 |
| HPV31 | E5 | 67 | 8 | IYIPLFVI | | 45720 |
| HPV31 | E5 | 62 | 8 | IYVVFIYI | | 45721 |
| HPV31 | E5 | 62 | 10 | IYVVFIYIPL | | 45722 |
| HPV31 | E5 | 62 | 11 | IYVVFIYIPLF | | 45723 |
| HPV31 | E5 | 23 | 10 | LFVCLVIRPL | | 45724 |
| HPV31 | E5 | 71 | 10 | LFVIHTHASF | | 45725 |
| HPV31 | E5 | 71 | 11 | LFVIHTHASFL | | 45726 |
| HPV31 | E5 | 49 | 9 | LWVIATSPL | | 45727 |
| HPV31 | E5 | 65 | 8 | VFIYIPLF | | 45728 |
| HPV31 | E5 | 65 | 10 | VFIYIPLFVI | | 45729 |
| HPV31 | E5 | 38 | 8 | VYATLLLL | | 45730 |
| HPV31 | E5 | 38 | 9 | VYATLLLLI | | 45731 |
| HPV31 | E5 | 38 | 11 | VYATLLLLIVI | | 45732 |
| HPV31 | E6 | 44 | 9 | DFAFTDLTI | | 45733 |
| HPV31 | E6 | 69 | 8 | FYSKVSEF | | 45734 |
| HPV31 | E6 | 69 | 10 | FYSKVSEFRW | | 45735 |
| HPV31 | E6 | 124 | 9 | RFHNIGGRW | | 45736 |
| HPV31 | E6 | 68 | 9 | RFYSKVSEF | | 45737 |
| HPV31 | E6 | 68 | 11 | RFYSKVSEFRW | | 45738 |
| HPV31 | E6 | 131 | 10 | RWTGRCIACW | | 45739 |
| HPV31 | E6 | 80 | 9 | RYSVYGTTL | | 45740 |
| HPV31 | E6 | 83 | 9 | VYGTTLEKL | | 45741 |
| HPV31 | E6 | 78 | 11 | WYRYSVYGTTL | | 45742 |
| HPV31 | E7 | 56 | 10 | TFCCQCKSTL | | 45743 |
| HPV31 | L1 | 151 | 9 | DYKQTQLCL | | 45744 |
| HPV31 | L1 | 151 | 10 | DYKQTQLCLL | | 45745 |
| HPV31 | L1 | 444 | 9 | DYVFWEVNL | | 45746 |
| HPV31 | L1 | 370 | 8 | EFDLQFIF | | 45747 |
| HPV31 | L1 | 370 | 10 | EFDLQFIFQL | | 45748 |
| HPV31 | L1 | 363 | 9 | EYLRHGEEF | | 45749 |
| HPV31 | L1 | 363 | 11 | EYLRHGEEFDL | | 45750 |
| HPV31 | L1 | 26 | 8 | EYVTRTNI | | 45751 |
| HPV31 | L1 | 248 | 10 | FFYLRREQMF | | 45752 |
| HPV31 | L1 | 447 | 10 | FWEVNLKEKF | | 45753 |
| HPV31 | L1 | 249 | 9 | FYLRREQMF | | 45754 |
| HPV31 | L1 | 91 | 9 | FYNPETQRL | | 45755 |
| HPV31 | L1 | 91 | 11 | FYNPETQRLVW | | 45756 |
| HPV31 | L1 | 205 | 10 | GFGAMDFTAL | | 45757 |
| HPV31 | L1 | 474 | 8 | GYRARPKF | | 45758 |
| HPV31 | L1 | 376 | 9 | IFQLCKITL | | 45759 |
| HPV31 | L1 | 33 | 10 | IYYHAGSARL | | 45760 |
| HPV31 | L1 | 33 | 11 | IYYHAGSARLL | | 45761 |
| HPV31 | L1 | 83 | 9 | KFGFPDTSF | | 45762 |
| HPV31 | L1 | 455 | 9 | KFSADLDQF | | 45763 |
| HPV31 | L1 | 455 | 11 | KFSADLDQFPL | | 45764 |
| HPV31 | L1 | 237 | 11 | KMVAEPYGDTL | | 45765 |
| HPV31 | L1 | 247 | 11 | LFFYLRREQMF | | 45766 |
| HPV31 | L1 | 3 | 11 | LWRPSEATVYL | | 45767 |
| HPV31 | L1 | 342 | 8 | NMSVCAAI | | 45768 |
| HPV31 | L1 | 441 | 8 | PFKDYVFW | | 45769 |
| HPV31 | L1 | 242 | 8 | PYGDTLFF | | 45770 |
| HPV31 | L1 | 242 | 10 | PYGDTLFFYL | | 45771 |
| HPV31 | L1 | 374 | 9 | QFIFQLCKI | | 45772 |
| HPV31 | L1 | 374 | 11 | QFIFQLCKITL | | 45773 |
| HPV31 | L1 | 462 | 8 | QFPLGRKF | | 45774 |
| HPV31 | L1 | 462 | 9 | QFPLGRKFL | | 45775 |
| HPV31 | L1 | 462 | 10 | QFPLGRKFLL | | 45776 |
| HPV31 | L1 | 255 | 8 | QMFVRHFF | | 45777 |
| HPV31 | L1 | 70 | 9 | QYRVFRVRL | | 45778 |
| HPV31 | L1 | 420 | 8 | RFVTSQAI | | 45779 |
| HPV31 | L1 | 90 | 10 | SFYNPETQRL | | 45780 |
| HPV31 | L1 | 149 | 9 | SMDYKQTQL | | 45781 |
| HPV31 | L1 | 149 | 11 | SMDYKQTQLCL | | 45782 |
| HPV31 | L1 | 394 | 10 | SMNPAILEDW | | 45783 |
| HPV31 | L1 | 299 | 9 | SMVTSDAQI | | 45784 |
| HPV31 | L1 | 299 | 10 | SMVTSDAQIF | | 45785 |

TABLE XVIII-continued

A24 Motif Peptides

| Type | Protein | Position | No. of Amino Acids | Sequence | A*2402 | Seq. Id. No. |
|---|---|---|---|---|---|---|
| HPV31 | L1 | 355 | 11 | TFKSSNFKEYL | | 45786 |
| HPV31 | L1 | 390 | 10 | TYIHSMNPAI | | 45787 |
| HPV31 | L1 | 390 | 11 | TYIHSMNPAIL | | 45788 |
| HPV31 | L1 | 418 | 10 | TYRFVTSQAI | | 45789 |
| HPV31 | L1 | 446 | 11 | VFWEVNLKEKF | | 45790 |
| HPV31 | L1 | 34 | 9 | YYHAGSARL | | 45791 |
| HPV31 | L1 | 34 | 10 | YYHAGSARLL | | 45792 |
| HPV31 | L2 | 251 | 11 | AYETVNAEESL | | 45793 |
| HPV31 | L2 | 385 | 11 | AYVPTNTTVPL | | 45794 |
| HPV31 | L2 | 275 | 8 | DFLDIIAL | | 45795 |
| HPV31 | L2 | 438 | 11 | DFYLHPSYYML | | 45796 |
| HPV31 | L2 | 439 | 10 | FYLHPSYYML | | 45797 |
| HPV31 | L2 | 318 | 9 | HYYYDISSI | | 45798 |
| HPV31 | L2 | 403 | 9 | IFSGPDVPI | | 45799 |
| HPV31 | L2 | 432 | 8 | IFVDGGDF | | 45800 |
| HPV31 | L2 | 432 | 10 | IFVDGGDFYL | | 45801 |
| HPV31 | L2 | 352 | 10 | LYDIYADTDF | | 45802 |
| HPV31 | L2 | 261 | 10 | LYFSNTSHNI | | 45803 |
| HPV31 | L2 | 187 | 10 | NYEEIPMDTF | | 45804 |
| HPV31 | L2 | 187 | 11 | NYEEIPMDTFI | | 45805 |
| HPV31 | L2 | 47 | 8 | RYGSMGVF | | 45806 |
| HPV31 | L2 | 47 | 9 | RYGSMGVFF | | 45807 |
| HPV31 | L2 | 295 | 11 | RYSRLGNKQTL | | 45808 |
| HPV31 | L2 | 50 | 9 | SMGVFFGGL | | 45809 |
| HPV31 | L2 | 50 | 11 | SMGVFFGGLGI | | 45810 |
| HPV31 | L2 | 195 | 11 | TFIVSTNNENI | | 45811 |
| HPV31 | L2 | 236 | 9 | TFLSAPKQL | | 45812 |
| HPV31 | L2 | 236 | 10 | TFLSAPKQLI | | 45813 |
| HPV31 | L2 | 157 | 8 | TFTDPSVL | | 45814 |
| HPV31 | L2 | 53 | 8 | VFFGGLGI | | 45815 |
| HPV31 | L2 | 262 | 9 | YFSNTSHNI | | 45816 |
| HPV31 | L2 | 319 | 8 | YYYDISSI | | 45817 |
| HPV33 | E1 | 452 | 9 | AFKKFLKGI | | 45818 |
| HPV33 | E1 | 448 | 9 | AFLGAFKKF | | 45819 |
| HPV33 | E1 | 448 | 10 | AFLGAFKKFL | | 45820 |
| HPV33 | E1 | 384 | 11 | AFLKSNSQAKI | | 45821 |
| HPV33 | E1 | 207 | 9 | AYGISFMEL | | 45822 |
| HPV33 | E1 | 297 | 9 | CMVIEPPKL | | 45823 |
| HPV33 | E1 | 228 | 9 | DWCITGYGI | | 45824 |
| HPV33 | E1 | 49 | 11 | EFIDDSMENSI | | 45825 |
| HPV33 | E1 | 580 | 8 | EFKNPFPF | | 45826 |
| HPV33 | E1 | 445 | 9 | EFTAFLGAF | | 45827 |
| HPV33 | E1 | 352 | 11 | EMVQWAYDNEL | | 45828 |
| HPV33 | E1 | 331 | 9 | EWIDRLTVL | | 45829 |
| HPV33 | E1 | 605 | 9 | FFSRTWCKL | | 45830 |
| HPV33 | E1 | 605 | 11 | FFSRTWCKLDL | | 45831 |
| HPV33 | E1 | 212 | 8 | FMELVRPF | | 45832 |
| HPV33 | E1 | 501 | 11 | FWLQPLSDAKI | | 45833 |
| HPV33 | E1 | 11 | 8 | GMGCTGWF | | 45834 |
| HPV33 | E1 | 512 | 9 | GMIDDVTPI | | 45835 |
| HPV33 | E1 | 512 | 11 | GMIDDVTPISW | | 45836 |
| HPV33 | E1 | 480 | 8 | GMSLIQFL | | 45837 |
| HPV33 | E1 | 16 | 9 | GWFEVEAVI | | 45838 |
| HPV33 | E1 | 347 | 10 | IFDLSEMVQW | | 45839 |
| HPV33 | E1 | 203 | 8 | KFKEAYGI | | 45840 |
| HPV33 | E1 | 203 | 10 | KFKEAYGISF | | 45841 |
| HPV33 | E1 | 412 | 8 | KMSIGQWI | | 45842 |
| HPV33 | E1 | 69 | 11 | LFNIQEGEDDL | | 45843 |
| HPV33 | E1 | 286 | 8 | LMSNLLSI | | 45844 |
| HPV33 | E1 | 201 | 10 | LYKFKEAYGI | | 45845 |
| HPV33 | E1 | 253 | 8 | LYTHLQCL | | 45846 |
| HPV33 | E1 | 312 | 11 | LYWFRTAMSNI | | 45847 |
| HPV33 | E1 | 601 | 10 | NWKSFFSRTW | | 45848 |
| HPV33 | E1 | 431 | 8 | NWRPIVQL | | 45849 |
| HPV33 | E1 | 431 | 9 | NWRPIVQLL | | 45850 |
| HPV33 | E1 | 570 | 10 | PYLHSRLTVF | | 45851 |
| HPV33 | E1 | 485 | 8 | QFLKGCVI | | 45852 |
| HPV33 | E1 | 355 | 8 | QWAYDNEL | | 45853 |
| HPV33 | E1 | 273 | 9 | RFRCSKNRL | | 45854 |
| HPV33 | E1 | 568 | 9 | RWPYLHSRL | | 45855 |
| HPV33 | E1 | 440 | 10 | RYQNIEFTAF | | 45856 |
| HPV33 | E1 | 440 | 11 | RYQNIEFTAFL | | 45857 |
| HPV33 | E1 | 604 | 10 | SFFSRTWCKL | | 45858 |
| HPV33 | E1 | 211 | 9 | SFMELVRPF | | 45859 |

TABLE XVIII-continued

A24 Motif Peptides

| Type | Protein | Position | No. of Amino Acids | Sequence | A*2402 | Seq. Id. No. |
|---|---|---|---|---|---|---|
| HPV33 | E1 | 342 | 9 | SFNDNIFDL | | 45860 |
| HPV33 | E1 | 477 | 8 | SYFGMSLI | | 45861 |
| HPV33 | E1 | 477 | 10 | SYFGMSLIQF | | 45862 |
| HPV33 | E1 | 477 | 11 | SYFGMSLIQFL | | 45863 |
| HPV33 | E1 | 609 | 8 | TWCKLDLI | | 45864 |
| HPV33 | E1 | 523 | 11 | TYIDDYMRNAL | | 45865 |
| HPV33 | E1 | 119 | 10 | TYRKRKIDEL | | 45866 |
| HPV33 | E1 | 578 | 8 | VFEFKNPF | | 45867 |
| HPV33 | E1 | 578 | 10 | VFEFKNPFPF | | 45868 |
| HPV33 | E1 | 594 | 9 | VYAINDENW | | 45869 |
| HPV33 | E1 | 17 | 8 | WFEVEAVI | | 45870 |
| HPV33 | E1 | 314 | 9 | WFRTAMSNI | | 45871 |
| HPV33 | E1 | 478 | 9 | YFGMSLIQF | | 45872 |
| HPV33 | E1 | 478 | 10 | YFGMSLIQFL | | 45873 |
| HPV33 | E1 | 528 | 11 | YMRNALDGNEI | | 45874 |
| HPV33 | E1 | 313 | 10 | YWFRTAMSNI | | 45875 |
| HPV33 | E2 | 69 | 11 | AFQVIELQMAL | | 45876 |
| HPV33 | E2 | 153 | 8 | DYIGMYYI | | 45877 |
| HPV33 | E2 | 130 | 8 | DYTNWGEI | | 45878 |
| HPV33 | E2 | 130 | 10 | DYTNWGEIYI | | 45879 |
| HPV33 | E2 | 130 | 11 | DYTNWGEIYII | | 45880 |
| HPV33 | E2 | 32 | 11 | HWKLIRMECAL | | 45881 |
| HPV33 | E2 | 177 | 8 | KYSKTQMW | | 45882 |
| HPV33 | E2 | 243 | 8 | LFCADPAL | | 45883 |
| HPV33 | E2 | 18 | 9 | LYEADKTDL | | 45884 |
| HPV33 | E2 | 299 | 9 | LYSSMSSTW | | 45885 |
| HPV33 | E2 | 299 | 11 | LYSSMSSTWHW | | 45886 |
| HPV33 | E2 | 43 | 9 | LYTAKQMGF | | 45887 |
| HPV33 | E2 | 333 | 8 | MFLGTVKI | | 45888 |
| HPV33 | E2 | 183 | 11 | MWEVHVGGQVI | | 45889 |
| HPV33 | E2 | 133 | 8 | NWGEIYII | | 45890 |
| HPV33 | E2 | 332 | 9 | QMFLGTVKI | | 45891 |
| HPV33 | E2 | 91 | 9 | QWTLQQTSL | | 45892 |
| HPV33 | E2 | 86 | 9 | QYSTSQWTL | | 45893 |
| HPV33 | E2 | 290 | 10 | RYRLKPYKEL | | 45894 |
| HPV33 | E2 | 302 | 8 | SMSSTWHW | | 45895 |
| HPV33 | E2 | 324 | 11 | TFVTEQQQQMF | | 45896 |
| HPV33 | E2 | 128 | 10 | TMDYTNWGEI | | 45897 |
| HPV33 | E2 | 146 | 10 | TMVTGKVDYI | | 45898 |
| HPV33 | E2 | 101 | 10 | VWLCEPPKCF | | 45899 |
| HPV33 | E2 | 158 | 11 | YYIHNCEKVYF | | 45900 |
| HPV33 | E5 | 30 | 8 | AWLLVLVL | | 45901 |
| HPV33 | E5 | 30 | 9 | AWLLVLVLL | | 45902 |
| HPV33 | E5 | 30 | 10 | AWLLVLVLLL | | 45903 |
| HPV33 | E5 | 30 | 11 | AWLLVLVLLLW | | 45904 |
| HPV33 | E5 | 8 | 8 | CFILFLCL | | 45905 |
| HPV33 | E5 | 8 | 10 | CFILFLCLSL | | 45906 |
| HPV33 | E5 | 8 | 11 | CFILFLCLSLL | | 45907 |
| HPV33 | E5 | 52 | 8 | CYLLFLYL | | 45908 |
| HPV33 | E5 | 50 | 8 | FFCYLLFL | | 45909 |
| HPV33 | E5 | 50 | 10 | FFCYLLFLYL | | 45910 |
| HPV33 | E5 | 49 | 8 | IFFCYLLF | | 45911 |
| HPV33 | E5 | 49 | 9 | IFFCYLLFL | | 45912 |
| HPV33 | E5 | 49 | 11 | IFFCYLLFLYL | | 45913 |
| HPV33 | E5 | 2 | 8 | IFVFVLCF | | 45914 |
| HPV33 | E5 | 2 | 9 | IFVFVLCFI | | 45915 |
| HPV33 | E5 | 2 | 10 | IFVFVLCFIL | | 45916 |
| HPV33 | E5 | 2 | 11 | IFVFVLCFILF | | 45917 |
| HPV33 | E5 | 11 | 8 | LFLCLSLL | | 45918 |
| HPV33 | E5 | 11 | 9 | LFLCLSLLL | | 45919 |
| HPV33 | E5 | 55 | 10 | LFLYLPMMCI | | 45920 |
| HPV33 | E5 | 39 | 9 | LWVFVGSPL | | 45921 |
| HPV33 | E5 | 39 | 11 | LWVFVGSPLKI | | 45922 |
| HPV33 | E5 | 57 | 8 | LYLPMMCI | | 45923 |
| HPV33 | E5 | 57 | 10 | LYLPMMCINF | | 45924 |
| HPV33 | E5 | 28 | 8 | TYAWLLVL | | 45925 |
| HPV33 | E5 | 28 | 10 | TYAWLLVLVL | | 45926 |
| HPV33 | E5 | 28 | 11 | TYAWLLVLVLL | | 45927 |
| HPV33 | E5 | 41 | 9 | VFVGSPLKI | | 45928 |
| HPV33 | E5 | 41 | 10 | VFVGSPLKIF | | 45929 |
| HPV33 | E5 | 41 | 11 | VFVGSPLKIFF | | 45930 |
| HPV33 | E5 | 4 | 8 | VFVLCFIL | | 45931 |
| HPV33 | E5 | 4 | 9 | VFVLCFILF | | 45932 |
| HPV33 | E5 | 4 | 10 | VFVLCFILFL | | 45933 |

TABLE XVIII-continued

A24 Motif Peptides

| Type | Protein | Position | No. of Amino Acids | Sequence | A*2402 | Seq. Id. No. |
|---|---|---|---|---|---|---|
| HPV33 | E6 | 139 | 11 | CWRSRRRETAL | | 45934 |
| HPV33 | E6 | 78 | 11 | HYNYSVYGNTL | | 45935 |
| HPV33 | E6 | 80 | 9 | NYSVYGNTL | | 45936 |
| HPV33 | E6 | 59 | 9 | PFGICKLCL | | 45937 |
| HPV33 | E6 | 59 | 11 | PFGICKLCLRF | | 45938 |
| HPV33 | E6 | 124 | 9 | RFHNISGRW | | 45939 |
| HPV33 | E6 | 131 | 10 | RWAGRCAACW | | 45940 |
| HPV33 | E6 | 42 | 9 | VYDFAFADL | | 45941 |
| HPV33 | E6 | 53 | 8 | VYREGNPF | | 45942 |
| HPV33 | E6 | 53 | 10 | VYREGNPFGI | | 45943 |
| HPV33 | E7 | 15 | 8 | LYPEPTDL | | 45944 |
| HPV33 | L1 | 392 | 10 | AMNPDILEDW | | 45945 |
| HPV33 | L1 | 151 | 9 | DYKQTQLCL | | 45946 |
| HPV33 | L1 | 151 | 10 | DYKQTQLCLL | | 45947 |
| HPV33 | L1 | 368 | 8 | EYDLQFVF | | 45948 |
| HPV33 | L1 | 368 | 10 | EYDLQFVFQL | | 45949 |
| HPV33 | L1 | 361 | 11 | EYIRHVEEYDL | | 45950 |
| HPV33 | L1 | 26 | 8 | EYVSRTSI | | 45951 |
| HPV33 | L1 | 247 | 10 | FFFLRREQMF | | 45952 |
| HPV33 | L1 | 248 | 9 | FFLRREQMF | | 45953 |
| HPV33 | L1 | 260 | 8 | FFNRAGTL | | 45954 |
| HPV33 | L1 | 445 | 10 | FWEVDLKEKF | | 45955 |
| HPV33 | L1 | 91 | 9 | FYNPDTQRL | | 45956 |
| HPV33 | L1 | 91 | 11 | FYNPDTQRLVW | | 45957 |
| HPV33 | L1 | 204 | 10 | GFGCMDFKTL | | 45958 |
| HPV33 | L1 | 259 | 9 | HFFNRAGTL | | 45959 |
| HPV33 | L1 | 33 | 10 | IYYYAGSSRL | | 45960 |
| HPV33 | L1 | 33 | 11 | IYYYAGSSRLL | | 45961 |
| HPV33 | L1 | 83 | 9 | KFGFPDTSF | | 45962 |
| HPV33 | L1 | 466 | 8 | KFLLQAGL | | 45963 |
| HPV33 | L1 | 453 | 9 | KFSADLDQF | | 45964 |
| HPV33 | L1 | 453 | 11 | KFSADLDQFPL | | 45965 |
| HPV33 | L1 | 236 | 11 | KMTSEPYGDSL | | 45966 |
| HPV33 | L1 | 442 | 9 | KYTFWEVDL | | 45967 |
| HPV33 | L1 | 246 | 11 | LFFFLRREQMF | | 45968 |
| HPV33 | L1 | 306 | 8 | LFNKPYWL | | 45969 |
| HPV33 | L1 | 241 | 8 | PYGDSLFF | | 45970 |
| HPV33 | L1 | 241 | 9 | PYGDSLFFF | | 45971 |
| HPV33 | L1 | 241 | 10 | PYGDSLFFFL | | 45972 |
| HPV33 | L1 | 460 | 8 | QFPLGRKF | | 45973 |
| HPV33 | L1 | 460 | 9 | QFPLGRKFL | | 45974 |
| HPV33 | L1 | 460 | 10 | QFPLGRKFLL | | 45975 |
| HPV33 | L1 | 372 | 11 | QFVFQLCKVTL | | 45976 |
| HPV33 | L1 | 254 | 8 | QMFVRHFF | | 45977 |
| HPV33 | L1 | 70 | 9 | QYRVFRVRL | | 45978 |
| HPV33 | L1 | 418 | 8 | RFVTSQAI | | 45979 |
| HPV33 | L1 | 90 | 10 | SFYNPDTQRL | | 45980 |
| HPV33 | L1 | 149 | 9 | SMDYKQTQL | | 45981 |
| HPV33 | L1 | 149 | 11 | SMDYKQTQLCL | | 45982 |
| HPV33 | L1 | 298 | 9 | SMVTSESQL | | 45983 |
| HPV33 | L1 | 298 | 10 | SMVTSESQLF | | 45984 |
| HPV33 | L1 | 444 | 11 | TFWEVDLKEKF | | 45985 |
| HPV33 | L1 | 388 | 10 | TYIHAMNPDI | | 45986 |
| HPV33 | L1 | 388 | 11 | TYIHAMNPDIL | | 45987 |
| HPV33 | L1 | 353 | 11 | TYKNENFKEYI | | 45988 |
| HPV33 | L1 | 416 | 10 | TYRFVTSQAI | | 45989 |
| HPV33 | L1 | 374 | 9 | VFQLCKVTL | | 45990 |
| HPV33 | L1 | 100 | 9 | VWACVGLEI | | 45991 |
| HPV33 | L1 | 3 | 11 | VWRPSEATVYL | | 45992 |
| HPV33 | L1 | 35 | 8 | YYAGSSRL | | 45993 |
| HPV33 | L1 | 35 | 9 | YYAGSSRLL | | 45994 |
| HPV33 | L1 | 34 | 9 | YYYAGSSRL | | 45995 |
| HPV33 | L1 | 34 | 10 | YYYAGSSRLL | | 45996 |
| HPV33 | L2 | 256 | 11 | AFESFDPEDTL | | 45997 |
| HPV33 | L2 | 241 | 9 | AFLTSPHKL | | 45998 |
| HPV33 | L2 | 241 | 10 | AFLTSPHKLI | | 45999 |
| HPV33 | L2 | 280 | 8 | DFLDIIAL | | 46000 |
| HPV33 | L2 | 439 | 9 | DFVLHPSYF | | 46001 |
| HPV33 | L2 | 439 | 10 | DFVLHPSYFI | | 46002 |
| HPV33 | L2 | 439 | 11 | DFVLHPSYFIL | | 46003 |
| HPV33 | L2 | 323 | 9 | HYYQDLSPI | | 46004 |
| HPV33 | L2 | 46 | 8 | KYGSLGVF | | 46005 |
| HPV33 | L2 | 46 | 9 | KYGSLGVFF | | 46006 |
| HPV33 | L2 | 414 | 8 | LFPTSSPF | | 46007 |

TABLE XVIII-continued

A24 Motif Peptides

| Type | Protein | Position | No. of Amino Acids | Sequence | A*2402 | Seq. Id. No. |
|---|---|---|---|---|---|---|
| HPV33 | L2 | 414 | 11 | LFPTSSPFVPI | | 46008 |
| HPV33 | L2 | 426 | 8 | PFFPFDTI | | 46009 |
| HPV33 | L2 | 420 | 8 | PFVPISPF | | 46010 |
| HPV33 | L2 | 420 | 9 | PFVPISPFF | | 46011 |
| HPV33 | L2 | 420 | 11 | PFVPISPFFPF | | 46012 |
| HPV33 | L2 | 376 | 9 | PMQHSYSTF | | 46013 |
| HPV33 | L2 | 300 | 11 | RFSRVGQKATL | | 46014 |
| HPV33 | L2 | 259 | 8 | SFDPEDTL | | 46015 |
| HPV33 | L2 | 259 | 10 | SFDPEDTLQF | | 46016 |
| HPV33 | L2 | 192 | 10 | SYENIPMDTF | | 46017 |
| HPV33 | L2 | 355 | 8 | SYSINDGL | | 46018 |
| HPV33 | L2 | 162 | 8 | TFTEPSVL | | 46019 |
| HPV33 | L2 | 251 | 10 | TYDNPAFESF | | 46020 |
| HPV33 | L2 | 52 | 8 | VFFGGLGI | | 46021 |
| HPV33 | L2 | 404 | 11 | VMSGPDIPSPL | | 46022 |
| HPV33 | L2 | 446 | 11 | YFILRRRKRF | | 46023 |
| HPV33 | L2 | 324 | 8 | YYQDLSPI | | 46024 |
| HPV33 | L2 | 324 | 11 | YYQDLSPIVPL | | 46025 |
| HPV45 | E1 | 199 | 9 | AMLAVFKDI | | 46026 |
| HPV45 | E1 | 512 | 11 | AMLDDATHTCW | | 46027 |
| HPV45 | E1 | 604 | 10 | CFFERTWSRL | | 46028 |
| HPV45 | E1 | 297 | 9 | CMLIEPPKL | | 46029 |
| HPV45 | E1 | 49 | 9 | DFIDTQLSI | | 46030 |
| HPV45 | E1 | 367 | 9 | DMAFQYAQL | | 46031 |
| HPV45 | E1 | 46 | 10 | DMVDFIDTQL | | 46032 |
| HPV45 | E1 | 352 | 11 | DMVQWAFDNDL | | 46033 |
| HPV45 | E1 | 431 | 8 | DWRPIVQF | | 46034 |
| HPV45 | E1 | 431 | 9 | DWRPIVQFL | | 46035 |
| HPV45 | E1 | 445 | 9 | EFISFLRAL | | 46036 |
| HPV45 | E1 | 331 | 8 | EWIQRLTI | | 46037 |
| HPV45 | E1 | 331 | 9 | EWIQRLTII | | 46038 |
| HPV45 | E1 | 605 | 9 | FFERTWSRL | | 46039 |
| HPV45 | E1 | 605 | 11 | FFERTWSRLDL | | 46040 |
| HPV45 | E1 | 243 | 11 | GFKTLIKPATL | | 46041 |
| HPV45 | E1 | 480 | 8 | GMSFIHFL | | 46042 |
| HPV45 | E1 | 16 | 8 | GWFFVETI | | 46043 |
| HPV45 | E1 | 485 | 8 | HFLQGAII | | 46044 |
| HPV45 | E1 | 485 | 10 | HFLQGAIISF | | 46045 |
| HPV45 | E1 | 207 | 9 | IYGLSFTDL | | 46046 |
| HPV45 | E1 | 263 | 9 | KWGVLILAL | | 46047 |
| HPV45 | E1 | 263 | 10 | KWGVLILALL | | 46048 |
| HPV45 | E1 | 253 | 8 | LYAHIQCL | | 46049 |
| HPV45 | E1 | 312 | 8 | LYWYRTGI | | 46050 |
| HPV45 | E1 | 312 | 11 | LYWYRTGISNI | | 46051 |
| HPV45 | E1 | 347 | 10 | NFDLSDMVQW | | 46052 |
| HPV45 | E1 | 601 | 10 | NWKCFFERTW | | 46053 |
| HPV45 | E1 | 570 | 10 | PYLESRVTVF | | 46054 |
| HPV45 | E1 | 437 | 10 | QFLRYQGVEF | | 46055 |
| HPV45 | E1 | 437 | 11 | QFLRYQGVEFI | | 46056 |
| HPV45 | E1 | 412 | 8 | QMNMSQWI | | 46057 |
| HPV45 | E1 | 355 | 8 | QWAFDNDL | | 46058 |
| HPV45 | E1 | 417 | 10 | QWIKYRCSKI | | 46059 |
| HPV45 | E1 | 273 | 9 | RYKCGKNRL | | 46060 |
| HPV45 | E1 | 440 | 8 | RYQGVEFI | | 46061 |
| HPV45 | E1 | 440 | 10 | RYQGVEFISF | | 46062 |
| HPV45 | E1 | 440 | 11 | RYQGVEFISFL | | 46063 |
| HPV45 | E1 | 482 | 10 | SFIHFLQGAI | | 46064 |
| HPV45 | E1 | 482 | 11 | SFIHFLQGAII | | 46065 |
| HPV45 | E1 | 448 | 9 | SFLRALKEF | | 46066 |
| HPV45 | E1 | 448 | 10 | SFLRALKEFL | | 46067 |
| HPV45 | E1 | 211 | 9 | SFTDLVRNF | | 46068 |
| HPV45 | E1 | 493 | 9 | SFVNSNSHF | | 46069 |
| HPV45 | E1 | 493 | 10 | SFVNSNSHFW | | 46070 |
| HPV45 | E1 | 493 | 11 | SFVNSNSHFWL | | 46071 |
| HPV45 | E1 | 477 | 8 | SYFGMSFI | | 46072 |
| HPV45 | E1 | 477 | 10 | SYFGMSFIHF | | 46073 |
| HPV45 | E1 | 477 | 11 | SYFGMSFIHFL | | 46074 |
| HPV45 | E1 | 580 | 8 | TFPHAFPF | | 46075 |
| HPV45 | E1 | 523 | 11 | TYFDNYMRNAL | | 46076 |
| HPV45 | E1 | 203 | 8 | VFKDIYGL | | 46077 |
| HPV45 | E1 | 203 | 10 | VFKDIYGLSF | | 46078 |
| HPV45 | E1 | 578 | 8 | VFTFPHAF | | 46079 |
| HPV45 | E1 | 578 | 10 | VFTFPHAFPF | | 46080 |
| HPV45 | E1 | 594 | 9 | VYEINDKNW | | 46081 |

TABLE XVIII-continued

A24 Motif Peptides

| Type | Protein | Position | No. of Amino Acids | Sequence | A*2402 | Seq. Id. No. |
|---|---|---|---|---|---|---|
| HPV45 | E1 | 314 | 9 | WYRTGISNI | | 46082 |
| HPV45 | E1 | 524 | 10 | YFDNYMRNAL | | 46083 |
| HPV45 | E1 | 478 | 9 | YFGMSFIHF | | 46084 |
| HPV45 | E1 | 478 | 10 | YFGMSFIHFL | | 46085 |
| HPV45 | E1 | 528 | 11 | YMRNALDGNPI | | 46086 |
| HPV45 | E1 | 313 | 10 | YWYRTGISNI | | 46087 |
| HPV45 | E2 | 134 | 10 | CMNYVVWDSI | | 46088 |
| HPV45 | E2 | 97 | 11 | EWTLQDTCEEL | | 46089 |
| HPV45 | E2 | 325 | 11 | HWTGCNKNTGI | | 46090 |
| HPV45 | E2 | 24 | 9 | HYENDSKDI | | 46091 |
| HPV45 | E2 | 316 | 9 | HYSEISSTW | | 46092 |
| HPV45 | E2 | 316 | 11 | HYSEISSTWHW | | 46093 |
| HPV45 | E2 | 143 | 9 | IYYITETGI | | 46094 |
| HPV45 | E2 | 143 | 10 | IYYITETGIW | | 46095 |
| HPV45 | E2 | 2 | 9 | KMQTPKESL | | 46096 |
| HPV45 | E2 | 312 | 9 | KYADHYSEI | | 46097 |
| HPV45 | E2 | 184 | 8 | KYGNSNTW | | 46098 |
| HPV45 | E2 | 92 | 9 | KYNNEEWTL | | 46099 |
| HPV45 | E2 | 49 | 9 | LFTAREHGI | | 46100 |
| HPV45 | E2 | 107 | 10 | LWNTEPSQCF | | 46101 |
| HPV45 | E2 | 136 | 8 | NYVVWDSI | | 46102 |
| HPV45 | E2 | 136 | 11 | NYVVWDSIYYI | | 46103 |
| HPV45 | E2 | 160 | 8 | SYWGVYYI | | 46104 |
| HPV45 | E2 | 37 | 8 | SYWQLIRL | | 46105 |
| HPV45 | E2 | 348 | 8 | TFLDVVTI | | 46106 |
| HPV45 | E2 | 190 | 11 | TWEVQYGGNVI | | 46107 |
| HPV45 | E2 | 339 | 11 | TYNSEVQRNTF | | 46108 |
| HPV45 | E2 | 139 | 8 | VWDSIYYI | | 46109 |
| HPV45 | E2 | 38 | 11 | YWQLIRLENAI | | 46110 |
| HPV45 | E2 | 144 | 8 | YYITETGI | | 46111 |
| HPV45 | E2 | 144 | 9 | YYITETGIW | | 46112 |
| HPV45 | E6 | 61 | 9 | AYAACHKCI | | 46113 |
| HPV45 | E6 | 61 | 11 | AYAACHKCIDF | | 46114 |
| HPV45 | E6 | 70 | 9 | DFYSRIREL | | 46115 |
| HPV45 | E6 | 71 | 8 | FYSRIREL | 0.0260 | 46116 |
| HPV45 | E6 | 52 | 9 | LFIVYRDCI | | 46117 |
| HPV45 | E6 | 98 | 9 | LYNLLIRCL | 0.0001 | 46118 |
| HPV45 | E6 | 11 | 11 | PYKLPDLCTEL | 0.0064 | 46119 |
| HPV45 | E6 | 46 | 8 | QFAFKDLF | | 46120 |
| HPV45 | E6 | 46 | 9 | QFAFKDLFI | | 46121 |
| HPV45 | E6 | 85 | 9 | VYGETLEKI | | 46122 |
| HPV45 | E6 | 44 | 9 | VYQFAFKDL | | 46123 |
| HPV45 | E6 | 44 | 10 | VYQFAFKDLF | | 46124 |
| HPV45 | E6 | 44 | 11 | VYQFAFKDLFI | | 46125 |
| HPV45 | E6 | 80 | 11 | YYSNSVYGETL | | 46126 |
| HPV45 | E7 | 90 | 8 | LFLSTLSF | | 46127 |
| HPV45 | L1 | 94 | 11 | AYQYRVFRVAL | | 46128 |
| HPV45 | L1 | 177 | 9 | DYKQTQLCI | | 46129 |
| HPV45 | L1 | 177 | 10 | DYKQTQLCIL | | 46130 |
| HPV45 | L1 | 52 | 8 | DYVSRTSI | | 46131 |
| HPV45 | L1 | 52 | 9 | DYVSRTSIF | | 46132 |
| HPV45 | L1 | 399 | 8 | EYDLQFIF | | 46133 |
| HPV45 | L1 | 399 | 10 | EYDLQFIFQL | | 46134 |
| HPV45 | L1 | 274 | 9 | FFCLRREQL | | 46135 |
| HPV45 | L1 | 274 | 10 | FFCLRREQLF | | 46136 |
| HPV45 | L1 | 476 | 10 | FWTVDLKEKF | | 46137 |
| HPV45 | L1 | 60 | 9 | FYHAGSSRL | | 46138 |
| HPV45 | L1 | 60 | 10 | FYHAGSSRLL | | 46139 |
| HPV45 | L1 | 131 | 10 | GMEIGRGQPL | | 46140 |
| HPV45 | L1 | 231 | 10 | GYGAMDFSTL | | 46141 |
| HPV45 | L1 | 392 | 11 | HYSRHVEEYDL | | 46142 |
| HPV45 | L1 | 13 | 9 | IFLKNVNVF | | 46143 |
| HPV45 | L1 | 13 | 11 | IFLKNVNVFPI | | 46144 |
| HPV45 | L1 | 23 | 8 | IFLQMALW | | 46145 |
| HPV45 | L1 | 405 | 9 | IFQLCTITL | | 46146 |
| HPV45 | L1 | 59 | 10 | IFYHAGSSRL | | 46147 |
| HPV45 | L1 | 59 | 11 | IFYHAGSSRLL | | 46148 |
| HPV45 | L1 | 6 | 8 | IYGHGIII | | 46149 |
| HPV45 | L1 | 6 | 9 | IYGHGIIIF | | 46150 |
| HPV45 | L1 | 6 | 10 | IYGHGIIIFL | | 46151 |
| HPV45 | L1 | 117 | 9 | IYNPETQRL | | 46152 |
| HPV45 | L1 | 117 | 11 | IYNPETQRLVW | | 46153 |
| HPV45 | L1 | 109 | 9 | KFGLPDSTI | | 46154 |
| HPV45 | L1 | 497 | 8 | KFLVQAGL | | 46155 |

TABLE XVIII-continued

A24 Motif Peptides

| Type | Protein | Position | No. of Amino Acids | Sequence | A*2402 | Seq. Id. No. |
|---|---|---|---|---|---|---|
| HPV45 | L1 | 484 | 11 | KFSSDLDQYPL | | 46156 |
| HPV45 | L1 | 475 | 11 | KFWTVDLKEKF | | 46157 |
| HPV45 | L1 | 335 | 8 | LFNKPYWL | | 46158 |
| HPV45 | L1 | 29 | 11 | LWRPSDSTVYL | | 46159 |
| HPV45 | L1 | 273 | 10 | MFFCLRREQL | | 46160 |
| HPV45 | L1 | 273 | 11 | MFFCLRREQLF | | 46161 |
| HPV45 | L1 | 470 | 8 | PYDKLKFW | | 46162 |
| HPV45 | L1 | 268 | 8 | PYGDSMFF | | 46163 |
| HPV45 | L1 | 268 | 10 | PYGDSMFFCL | | 46164 |
| HPV45 | L1 | 403 | 9 | QFIFQLCTI | | 46165 |
| HPV45 | L1 | 403 | 11 | QFIFQLCTITL | | 46166 |
| HPV45 | L1 | 491 | 8 | QYPLGRKF | | 46167 |
| HPV45 | L1 | 491 | 9 | QYPLGRKFL | | 46168 |
| HPV45 | L1 | 96 | 9 | QYRVFRVAL | | 46169 |
| HPV45 | L1 | 272 | 11 | SMFFCLRREQL | | 46170 |
| HPV45 | L1 | 423 | 10 | SMNSSILENW | | 46171 |
| HPV45 | L1 | 419 | 10 | SYIHSMNSSI | | 46172 |
| HPV45 | L1 | 419 | 11 | SYIHSMNSSIL | | 46173 |
| HPV45 | L1 | 20 | 10 | VFPIFLQMAL | | 46174 |
| HPV45 | L1 | 20 | 11 | VFPIFLQMALW | | 46175 |
| HPV45 | L1 | 293 | 10 | VMGDTVPTDL | | 46176 |
| HPV45 | L1 | 126 | 9 | VWACVGMEI | | 46177 |
| HPV45 | L1 | 319 | 10 | VYSPSPSGSI | | 46178 |
| HPV45 | L2 | 161 | 8 | AFSDPSII | | 46179 |
| HPV45 | L2 | 255 | 9 | AYEPLDTTL | | 46180 |
| HPV45 | L2 | 255 | 11 | AYEPLDTTLSF | | 46181 |
| HPV45 | L2 | 275 | 8 | DFMDIIRL | | 46182 |
| HPV45 | L2 | 319 | 8 | FYHDISPI | | 46183 |
| HPV45 | L2 | 191 | 10 | GYEEIPLQTF | | 46184 |
| HPV45 | L2 | 318 | 9 | HFYHDISPI | | 46185 |
| HPV45 | L2 | 52 | 8 | IFLGGLGI | | 46186 |
| HPV45 | L2 | 400 | 8 | IYTGPDII | | 46187 |
| HPV45 | L2 | 400 | 9 | IYTGPDIIL | | 46188 |
| HPV45 | L2 | 346 | 8 | LFDVYADF | | 46189 |
| HPV45 | L2 | 438 | 8 | LWPWYYYF | | 46190 |
| HPV45 | L2 | 305 | 9 | MFTRSGKQI | | 46191 |
| HPV45 | L2 | 453 | 8 | PYFFADGF | | 46192 |
| HPV45 | L2 | 240 | 9 | QFLTHPSSL | | 46193 |
| HPV45 | L2 | 46 | 8 | QWSSLGIF | | 46194 |
| HPV45 | L2 | 46 | 9 | QWSSLGIFL | | 46195 |
| HPV45 | L2 | 435 | 11 | QYYLWPWYYYF | | 46196 |
| HPV45 | L2 | 367 | 9 | SFTYPKYSL | | 46197 |
| HPV45 | L2 | 384 | 9 | SYSNVTVPL | | 46198 |
| HPV45 | L2 | 250 | 10 | TFDNPAYEPL | | 46199 |
| HPV45 | L2 | 121 | 8 | TFTGTSGF | | 46200 |
| HPV45 | L2 | 121 | 10 | TFTGTSGFEI | | 46201 |
| HPV45 | L2 | 304 | 10 | TMFTRSGKQI | | 46202 |
| HPV45 | L2 | 444 | 9 | YFPKKRKRI | | 46203 |
| HPV45 | L2 | 443 | 10 | YYFPKKRKRI | | 46204 |
| HPV45 | L2 | 436 | 10 | YYLWPWYYYF | | 46205 |
| HPV45 | L2 | 442 | 11 | YYYFPKKRKRI | | 46206 |
| HPV56 | E2 | 52 | 9 | CFKKEGQHI | | 46207 |
| HPV56 | E2 | 71 | 10 | CMQYVAWKYI | | 46208 |
| HPV56 | E2 | 113 | 9 | DFEQEAKKF | | 46209 |
| HPV56 | E2 | 34 | 11 | EWTLRDTCEEL | | 46210 |
| HPV56 | E2 | 126 | 11 | IWEVHMENESI | | 46211 |
| HPV56 | E2 | 284 | 11 | IYKDETQRNSF | | 46212 |
| HPV56 | E2 | 29 | 9 | IYNNEEWTL | | 46213 |
| HPV56 | E2 | 80 | 9 | IYYNGDCGW | | 46214 |
| HPV56 | E2 | 120 | 8 | KFGCKNIW | | 46215 |
| HPV56 | E2 | 78 | 11 | KYIYYNGDCGW | | 46216 |
| HPV56 | E2 | 260 | 11 | LFVDVTSTYHW | | 46217 |
| HPV56 | E2 | 44 | 10 | LWLTEPKKCF | | 46218 |
| HPV56 | E2 | 277 | 8 | NYSIITII | | 46219 |
| HPV56 | E2 | 73 | 8 | QYVAWKYI | | 46220 |
| HPV56 | E2 | 253 | 8 | RFQKYKTL | | 46221 |
| HPV56 | E2 | 253 | 9 | RFQKYKTLF | | 46222 |
| HPV56 | E2 | 251 | 10 | RYRFQKYKTL | | 46223 |
| HPV56 | E2 | 251 | 11 | RYRFQKYKTLF | | 46224 |
| HPV56 | E2 | 293 | 8 | SFLSHVKI | | 46225 |
| HPV56 | E2 | 81 | 8 | YYNGDCGW | | 46226 |
| HPV56 | E6 | 106 | 8 | CYRCQSPL | | 46227 |
| HPV56 | E6 | 60 | 11 | DFPYAVCRVCL | | 46228 |
| HPV56 | E6 | 83 | 9 | DYSVYGATL | | 46229 |

TABLE XVIII-continued

A24 Motif Peptides

| Type | Protein | Position | No. of Amino Acids | Sequence | A*2402 | Seq. Id. No. |
|---|---|---|---|---|---|---|
| HPV56 | E6 | 134 | 10 | GWTGSCLGCW | | 46230 |
| HPV56 | E6 | 47 | 9 | NFACTELKL | | 46231 |
| HPV56 | E6 | 62 | 9 | PYAVCRVCL | | 46232 |
| HPV56 | E6 | 62 | 10 | PYAVCRVCLL | | 46233 |
| HPV56 | E6 | 62 | 11 | PYAVCRVCLLF | | 46234 |
| HPV56 | E6 | 127 | 9 | RFHLIAHGW | | 46235 |
| HPV56 | E6 | 86 | 9 | VYGATLESI | | 46236 |
| HPV56 | E6 | 45 | 9 | VYNFACTEL | | 46237 |
| HPV56 | E6 | 45 | 11 | VYNFACTELKL | | 46238 |
| HPV56 | E6 | 81 | 11 | YYDYSVYGATL | | 46239 |
| HPV56 | E7 | 69 | 8 | KFVVQLDI | | 46240 |
| HPV56 | E7 | 90 | 11 | LMGALTVTCPL | | 46241 |
| HPV56 | L1 | 275 | 8 | AYGDSMWF | | 46242 |
| HPV56 | L1 | 275 | 10 | AYGDSMWFYL | | 46243 |
| HPV56 | L1 | 422 | 10 | AYLHNMNANL | | 46244 |
| HPV56 | L1 | 422 | 11 | AYLHNMNANLL | | 46245 |
| HPV56 | L1 | 101 | 11 | AYQYRVFRVRL | | 46246 |
| HPV56 | L1 | 402 | 8 | EYELQFVF | | 46247 |
| HPV56 | L1 | 402 | 10 | EYELQFVFQL | | 46248 |
| HPV56 | L1 | 479 | 10 | FWDVNLQDSF | | 46249 |
| HPV56 | L1 | 69 | 9 | FYHAGSSRL | | 46250 |
| HPV56 | L1 | 69 | 10 | FYHAGSSRLL | | 46251 |
| HPV56 | L1 | 282 | 8 | FYLRREQL | | 46252 |
| HPV56 | L1 | 282 | 9 | FYLRREQLF | | 46253 |
| HPV56 | L1 | 238 | 10 | GFGAMDFKVL | | 46254 |
| HPV56 | L1 | 15 | 8 | HYGLCIFL | | 46255 |
| HPV56 | L1 | 20 | 11 | IFLDVGAVNVF | | 46256 |
| HPV56 | L1 | 32 | 8 | IFLQMATW | | 46257 |
| HPV56 | L1 | 68 | 10 | IFYHAGSSRL | | 46258 |
| HPV56 | L1 | 68 | 11 | IFYHAGSSRLL | | 46259 |
| HPV56 | L1 | 124 | 9 | IYNPDQERL | | 46260 |
| HPV56 | L1 | 124 | 11 | IYNPDQERLVW | | 46261 |
| HPV56 | L1 | 8 | 11 | IYRDPPLHYGL | | 46262 |
| HPV56 | L1 | 116 | 9 | KFGLPDTNI | | 46263 |
| HPV56 | L1 | 478 | 11 | KFWDVNLQDSF | | 46264 |
| HPV56 | L1 | 387 | 11 | KYDARKINQYL | | 46265 |
| HPV56 | L1 | 476 | 9 | KYKFWDVNL | | 46266 |
| HPV56 | L1 | 450 | 10 | KYRYVRSTAI | | 46267 |
| HPV56 | L1 | 340 | 8 | LFNKPYWL | | 46268 |
| HPV56 | L1 | 1 | 8 | MMLPMMYI | | 46269 |
| HPV56 | L1 | 5 | 10 | MMYIYRDPPL | | 46270 |
| HPV56 | L1 | 280 | 10 | MWFYLRREQL | | 46271 |
| HPV56 | L1 | 280 | 11 | MWFYLRREQLF | | 46272 |
| HPV56 | L1 | 6 | 9 | MYIYRDPPL | | 46273 |
| HPV56 | L1 | 426 | 10 | NMNANLLEDW | | 46274 |
| HPV56 | L1 | 375 | 11 | NMTISTATEQL | | 46275 |
| HPV56 | L1 | 4 | 11 | PMMYIYRDPPL | | 46276 |
| HPV56 | L1 | 494 | 8 | QFPLGRKF | | 46277 |
| HPV56 | L1 | 494 | 9 | QFPLGRKFL | | 46278 |
| HPV56 | L1 | 406 | 9 | QFVFQLCKI | | 46279 |
| HPV56 | L1 | 406 | 11 | QFVFQLCKITL | | 46280 |
| HPV56 | L1 | 395 | 11 | QYLRHVEEYEL | | 46281 |
| HPV56 | L1 | 103 | 9 | QYRVFRVRL | | 46282 |
| HPV56 | L1 | 452 | 8 | RYVRSTAI | | 46283 |
| HPV56 | L1 | 487 | 9 | SFSTDLDQF | | 46284 |
| HPV56 | L1 | 487 | 11 | SFSTDLDQFPL | | 46285 |
| HPV56 | L1 | 332 | 9 | SMITSEAQL | | 46286 |
| HPV56 | L1 | 332 | 10 | SMITSEAQLF | | 46287 |
| HPV56 | L1 | 279 | 11 | SMWFYLRREQL | | 46288 |
| HPV56 | L1 | 61 | 8 | SYVKRTSI | | 46289 |
| HPV56 | L1 | 61 | 9 | SYVKRTSIF | | 46290 |
| HPV56 | L1 | 38 | 11 | TWRPSENKVYL | | 46291 |
| HPV56 | L1 | 29 | 11 | VFPIFLQMATW | | 46292 |
| HPV56 | L1 | 408 | 9 | VFQLCKITL | | 46293 |
| HPV56 | L1 | 324 | 11 | VYVATPSGSMI | | 46294 |
| HPV56 | L1 | 281 | 9 | WFYLRREQL | | 46295 |
| HPV56 | L1 | 281 | 10 | WFYLRREQLF | | 46296 |
| HPV56 | L2 | 240 | 9 | AFLDRPATL | | 46297 |
| HPV56 | L2 | 286 | 11 | AFTTRRGGVRF | | 46298 |
| HPV56 | L2 | 275 | 8 | DFMNIVAL | | 46299 |
| HPV56 | L2 | 444 | 10 | FFRRRRRKRI | | 46300 |
| HPV56 | L2 | 401 | 9 | FYSGPDIVL | | 46301 |
| HPV56 | L2 | 217 | 10 | GFRRIAAPRL | | 46302 |
| HPV56 | L2 | 318 | 9 | HYYYDISPI | | 46303 |

TABLE XVIII-continued

A24 Motif Peptides

| Type | Protein | Position | No. of Amino Acids | Sequence | A*2402 | Seq. Id. No. |
|---|---|---|---|---|---|---|
| HPV56 | L2 | 255 | 9 | LFEGTDTSL | | 46304 |
| HPV56 | L2 | 255 | 11 | LFEGTDTSLAF | | 46305 |
| HPV56 | L2 | 161 | 8 | LFIDPPVI | | 46306 |
| HPV56 | L2 | 50 | 8 | LFTYFGGL | | 46307 |
| HPV56 | L2 | 50 | 10 | LFTYFGGLGI | | 46308 |
| HPV56 | L2 | 347 | 8 | LYDIYANI | | 46309 |
| HPV56 | L2 | 121 | 8 | NFTGSGGF | | 46310 |
| HPV56 | L2 | 121 | 10 | NFTGSGGFEI | | 46311 |
| HPV56 | L2 | 400 | 8 | PFYSGPDI | | 46312 |
| HPV56 | L2 | 400 | 10 | PFYSGPDIVL | | 46313 |
| HPV56 | L2 | 423 | 10 | PYDVTHDVYI | | 46314 |
| HPV56 | L2 | 46 | 9 | QWGSLFTYF | | 46315 |
| HPV56 | L2 | 295 | 11 | RFSRLGRKATI | | 46316 |
| HPV56 | L2 | 436 | 9 | SFALWPVYF | | 46317 |
| HPV56 | L2 | 436 | 10 | SFALWPVYFF | | 46318 |
| HPV56 | L2 | 343 | 8 | SFDGLYDI | | 46319 |
| HPV56 | L2 | 191 | 10 | SYEEIPMQTF | | 46320 |
| HPV56 | L2 | 39 | 9 | TWADKILQW | | 46321 |
| HPV56 | L2 | 52 | 8 | TYFGGLGI | | 46322 |
| HPV56 | L2 | 430 | 8 | VYIQGSSF | | 46323 |
| HPV56 | L2 | 430 | 10 | VYIQGSSFAL | | 46324 |
| HPV56 | L2 | 430 | 11 | VYIQGSSFALW | | 46325 |
| HPV56 | L2 | 443 | 11 | YFFRRRRRKRI | | 46326 |
| HPV56 | L2 | 319 | 8 | YYYDISPI | | 46327 |

TABLE XIX

DR Supermotif Peptides

| Type | Protein | Position | Sequence | Sequence Id. No. | Core Sequence | Core Seq. Id. No. |
|---|---|---|---|---|---|---|
| HPV16 | E1 | 319 | AAALYWYKTGISNIS | 46328 | LYWYKTGIS | 48425 |
| HPV16 | E1 | 271 | ACSWGMVVLLLVRYK | 46329 | WGMVVLLLV | 48426 |
| HPV16 | E1 | 243 | AFGLTPSIADSIKTL | 46330 | LTPSIADSI | 48427 |
| HPV16 | E1 | 402 | AKIVKDCATMCRHYK | 46331 | VKDCATMCR | 48428 |
| HPV16 | E1 | 321 | ALYWYKTGISNISEV | 46332 | WYKTGISNI | 48429 |
| HPV16 | E1 | 392 | ASAFLKSNSQAKIVK | 46333 | FLKSNSQAK | 48430 |
| HPV16 | E1 | 262 | CLYLHIQSLACSWGM | 46334 | LHIQSLACS | 48431 |
| HPV16 | E1 | 307 | CMMIEPPKLRSTAAA | 46335 | IEPPKLRST | 48432 |
| HPV16 | E1 | 18 | CNGWFYVEAVVEKKT | 46336 | WFYVEAVVE | 48433 |
| HPV16 | E1 | 531 | CWNYIDDNLRNALDG | 46337 | YIDDNLRNA | 48434 |
| HPV16 | E1 | 355 | DCTFELSQMVQWAYD | 46338 | FELSQMVQW | 48435 |
| HPV16 | E1 | 544 | DGNLVSMDVKHRPLV | 46339 | LVSMDVKHR | 48436 |
| HPV16 | E1 | 609 | DKNWKSFFSRTWSRL | 46340 | WKSFFSRTW | 48437 |
| HPV16 | E1 | 375 | DSEIAYKYAQLADTN | 46341 | IAYKYAQLA | 48438 |
| HPV16 | E1 | 134 | DSGYGNTEVETQQML | 46342 | YGNTEVETQ | 48439 |
| HPV16 | E1 | 238 | DWCIAAFGLTPSIAD | 46343 | IAAFGLTPS | 48440 |
| HPV16 | E1 | 377 | EIAYKYAQLADTNSN | 46344 | YKYAQLADT | 48441 |
| HPV16 | E1 | 294 | EKLLSKLLCVSPMCM | 46345 | LSKLLCVSP | 48442 |
| HPV16 | E1 | 641 | FKCVSGQNTNTL--- | 46346 | VSGQNTNTL | 48443 |
| HPV16 | E1 | 635 | GDSLPTFKCVSGQNT | 46347 | LPTFKCVSG | 48444 |
| HPV16 | E1 | 48 | GEDLVDFIVNDNDYL | 46348 | LVDFIVNDN | 48445 |
| HPV16 | E1 | 180 | GEGVSERHTICQTPL | 46349 | VSERHTICQ | 48446 |
| HPV16 | E1 | 439 | GGDWKQIVMFLRYQG | 46350 | WKQIVMFLR | 48447 |
| HPV16 | E1 | 485 | GKSLFGMSLMKFLQG | 46351 | LFGMSLMKF | 48448 |
| HPV16 | E1 | 499 | GSVICFVNSKSHFWL | 46352 | ICFVNSKSH | 48449 |
| HPV16 | E1 | 453 | GVEFMSFLTALKRFL | 46353 | FMSFLTALK | 48450 |
| HPV16 | E1 | 20 | GWFYVEAVVEKKTGD | 46354 | YVEAVVEKK | 48451 |
| HPV16 | E1 | 71 | HALFTAQEAKQHRDA | 46355 | FTAQEAKQH | 48452 |
| HPV16 | E1 | 554 | HRPLVQLKCPPLLIT | 46356 | LVQLKCPPL | 48453 |
| HPV16 | E1 | 241 | IAAFGLTPSIADSIK | 46357 | FGLTPSIAD | 48454 |
| HPV16 | E1 | 293 | IEKLLSKLLCVSPMC | 46358 | LLSKLLCVS | 48455 |
| HPV16 | E1 | 521 | IGMLDDATVPCWNYI | 46359 | LDDATVPCW | 48456 |
| HPV16 | E1 | 254 | IKTLLQQYCLYLHIQ | 46360 | LLQQYCLYL | 48457 |
| HPV16 | E1 | 476 | ILLYGAANTGKSLFG | 46361 | YGAANTGKS | 48458 |
| HPV16 | E1 | 332 | ISEVYGDTPEWIQRQ | 46362 | VYGDTPEWI | 48459 |
| HPV16 | E1 | 215 | KELYGVSFSELVRPF | 46363 | YGVSFSELV | 48460 |
| HPV16 | E1 | 520 | KIGMLDDATVPCWNY | 46364 | MLDDATVPC | 48461 |
| HPV16 | E1 | 473 | KNCILLYGAANTGKS | 46365 | ILLYGAANT | 48462 |
| HPV16 | E1 | 90 | KRKYLVSPLSDISGC | 46366 | YLVSPLSDI | 48463 |
| HPV16 | E1 | 613 | KSFFSRTWSRLSLHE | 46367 | FSRTWSRLS | 48464 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV16 | E1 | 508 | KSHFWLQPLADAKIG | 46368 | FWLQPLADA | 48465 |
| HPV16 | E1 | 486 | KSLFGMSLMKFLQGS | 46369 | FGMSLMKFL | 48466 |
| HPV16 | E1 | 255 | KTLLQQYCLYLHIQS | 46370 | LQQYCLYLH | 48467 |
| HPV16 | E1 | 463 | LKRFLQGIPKKNCIL | 46371 | FLQGIPKKN | 48468 |
| HPV16 | E1 | 300 | LLCVSPMCMMIEPPK | 46372 | VSPMCMMIE | 48469 |
| HPV16 | E1 | 493 | LMKFLQGSVICFVNS | 46373 | FLQGSVICF | 48470 |
| HPV16 | E1 | 198 | LNVLKTSNAKAAMLA | 46374 | LKTSNAKAA | 48471 |
| HPV16 | E1 | 467 | LQGIPKKNCILLYGA | 46375 | IPKKNCILL | 48472 |
| HPV16 | E1 | 513 | LQPLADAKIGMLDDA | 46376 | LADAKIGML | 48473 |
| HPV16 | E1 | 297 | LSKLLCVSPMCMMIE | 46377 | LLCVSPMCM | 48474 |
| HPV16 | E1 | 557 | LVQLKCPPLLITSNI | 46378 | LKCPPLLIT | 48475 |
| HPV16 | E1 | 217 | LYGVSFSELVRPFKS | 46379 | VSFSELVRP | 48476 |
| HPV16 | E1 | 322 | LYWYKTGISNISEVY | 46380 | YKTGISNIS | 48477 |
| HPV16 | E1 | 494 | MKFLQGSVICFVNSK | 46381 | LQGSVICFV | 48478 |
| HPV16 | E1 | 425 | MSQWIKYRCDRVDDG | 46382 | WIKYRCDRV | 48479 |
| HPV16 | E1 | 474 | NCILLYGAANTGKSL | 46383 | LLYGAANTG | 48480 |
| HPV16 | E1 | 370 | NDIVDDSEIAYKYAQ | 46384 | VDDSEIAYK | 48481 |
| HPV16 | E1 | 59 | NDYLTQAETETAHAL | 46385 | LTQAETETA | 48482 |
| HPV16 | E1 | 19 | NGWFYVEAVVEKKTG | 46386 | FYVEAVVEK | 48483 |
| HPV16 | E1 | 584 | NRLVVFTFPNEFPFD | 46387 | VVFTFPNEF | 48484 |
| HPV16 | E1 | 139 | NTEVETQQMLQVEGR | 46388 | VETQQMLQV | 48485 |
| HPV16 | E1 | 340 | PEWIQRQTVLQHSFN | 46389 | IQRQTVLQH | 48486 |
| HPV16 | E1 | 305 | PMCMMIEPPKLRSTA | 46390 | MMIEPPKLR | 48487 |
| HPV16 | E1 | 312 | PPKLRSTAAALYWYK | 46391 | LRSTAAALY | 48488 |
| HPV16 | E1 | 563 | PPLLITSNINAGTDS | 46392 | LITSNINAG | 48489 |
| HPV16 | E1 | 401 | QAKIVKDCATMCRHY | 46393 | IVKDCATMC | 48490 |
| HPV16 | E1 | 365 | QWAYDNDIVDDSEIA | 46394 | YDNDIVDDS | 48491 |
| HPV16 | E1 | 290 | RETIEKLLSKLLCVS | 46395 | IEKLLSKLL | 48492 |
| HPV16 | E1 | 186 | RHTICQTPLTNILNV | 46396 | ICQTPLTNI | 48493 |
| HPV16 | E1 | 91 | RKYLVSPLSDISGCV | 46397 | LVSPLSDIS | 48494 |
| HPV16 | E1 | 540 | RNALDGNLVSMDVKH | 46398 | LDGNLVSMD | 48495 |
| HPV16 | E1 | 555 | RPLVQLKCPPLLITS | 46399 | VQLKCPPLL | 48496 |
| HPV16 | E1 | 127 | RRLFESEDSGYGNTE | 46400 | FESEDSGYG | 48497 |
| HPV16 | E1 | 578 | RWPYLHNRLVVFTFP | 46401 | YLHNRLVVF | 48498 |
| HPV16 | E1 | 223 | SELVRPFKSNKSTCC | 46402 | VRPFKSNKS | 48499 |
| HPV16 | E1 | 102 | SGCVDNNISPRLKAI | 46403 | VDNNISPRL | 48500 |
| HPV16 | E1 | 509 | SHFWLQPLADAKIGM | 46404 | WLQPLADAK | 48501 |
| HPV16 | E1 | 298 | SKLLCVSPMCMMIEP | 46405 | LCVSPMCMM | 48502 |
| HPV16 | E1 | 549 | SMDVKHRPLVQLKCP | 46406 | VKHRPLVQL | 48503 |
| HPV16 | E1 | 110 | SPRLKAICIEKQSRA | 46407 | LKAICIEKQ | 48504 |
| HPV16 | E1 | 617 | SRTWSRLSLHEDEDK | 46408 | WSRLSLHED | 48505 |
| HPV16 | E1 | 273 | SWGMVVLLLVRYKCG | 46409 | MVVLLLVRY | 48506 |
| HPV16 | E1 | 195 | TNILNVLKTSNAKAA | 46410 | LNVLKTSNA | 48507 |
| HPV16 | E1 | 339 | TPEWIQRQTVLQHSF | 46411 | WIQRQTVLQ | 48508 |
| HPV16 | E1 | 24 | VEAVVEKKTGDAISD | 46412 | VVEKKTGDA | 48509 |
| HPV16 | E1 | 454 | VEFMSFLTALKRFLQ | 46413 | MSFLTALKR | 48510 |
| HPV16 | E1 | 588 | VFTFPNEFPFDENGN | 46414 | FPNEFPFDE | 48511 |
| HPV16 | E1 | 501 | VICFVNSKSHFWLQP | 46415 | FVNSKSHFW | 48512 |
| HPV16 | E1 | 278 | VLLLVRYKCGKNRET | 46416 | LVRYKCGKN | 48513 |
| HPV16 | E1 | 446 | VMFLRYQGVEFMSFL | 46417 | LRYQGVEFM | 48514 |
| HPV16 | E1 | 86 | VQVLKRKYLVSPLSD | 46418 | LKRKYLVSP | 48515 |
| HPV16 | E1 | 226 | VRPFKSNKSTCCDWC | 46419 | FKSNKSTCC | 48516 |
| HPV16 | E1 | 274 | WGMVVLLLVRYKCGK | 46420 | VVLLLVRYK | 48517 |
| HPV16 | E1 | 428 | WIKYRCDRVDDGGDW | 46421 | YRCDRVDDG | 48518 |
| HPV16 | E1 | 579 | WPYLHNRLVVFTFPN | 46422 | LHNRLVVFT | 48519 |
| HPV16 | E1 | 382 | YAQLADTNSNASAFL | 46423 | LADTNSNAS | 48520 |
| HPV16 | E1 | 261 | YCLYLHIQSLACSWG | 46424 | YLHIQSLAC | 48521 |
| HPV16 | E1 | 264 | YLHIQSLACSWGMVV | 46425 | IQSLACSWG | 48522 |
| HPV16 | E2 | 178 | AEKYSKNKVWEVHAG | 46426 | YSKNKVWEV | 48523 |
| HPV16 | E2 | 44 | AIYYKAREMGFKHIN | 46427 | YKAREMGFK | 48524 |
| HPV16 | E2 | 268 | APILTAFNSSHKGRI | 46428 | LTAFNSSHK | 48525 |
| HPV16 | E2 | 49 | AREMGFKHINHQVVP | 46429 | MGFKHINHQ | 48526 |
| HPV16 | E2 | 229 | AVALGTEETQTTIQR | 46430 | LGTEETQTT | 48527 |
| HPV16 | E2 | 312 | CTLYTAVSSTWHWTG | 46431 | YTAVSSTWH | 48528 |
| HPV16 | E2 | 347 | DQFLSQVKIPKTITV | 46432 | LSQVKIPKT | 48529 |
| HPV16 | E2 | 99 | DVSLEVYLTAPTGCI | 46433 | LEVYLTAPT | 48530 |
| HPV16 | E2 | 152 | EGQVDYYGLYYVHEG | 46434 | VDYYGLYYV | 48531 |
| HPV16 | E2 | 77 | ELQLTLETIYNSQYS | 46435 | LTLETIYNS | 48532 |
| HPV16 | E2 | 83 | ETIYNSQYSNEKWTL | 46436 | YNSQYSNEK | 48533 |
| HPV16 | E2 | 121 | EVQFDGDICNTMHYT | 46437 | FDGDICNTM | 48534 |
| HPV16 | E2 | 54 | FKHINHQVVPTLAVS | 46438 | INHQVVPTL | 48535 |
| HPV16 | E2 | 192 | GGQVILCPTSVFSSN | 46439 | VILCPTSVF | 48536 |
| HPV16 | E2 | 326 | GHNVKHKSAIVTLTY | 46440 | VKHKSAIVT | 48537 |
| HPV16 | E2 | 159 | GLYYVHEGIRTYFVQ | 46441 | YVHEGIRTY | 48538 |
| HPV16 | E2 | 193 | GQVILCPTSVFSSNE | 46442 | ILCPTSVFS | 48539 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV16 | E2 | 311 | HCTLYTAVSSTWHWT | 46443 | LYTAVSSTW | 48540 |
| HPV16 | E2 | 164 | HEGIRTYFVQFKDDA | 46444 | IRTYFVQFK | 48541 |
| HPV16 | E2 | 139 | HIYICEEASVTVVEG | 46445 | ICEEASVTV | 48542 |
| HPV16 | E2 | 59 | HQVVPTLAVSKNKAL | 46446 | VPTLAVSKN | 48543 |
| HPV16 | E2 | 33 | IDYWKHMRLECAIYY | 46447 | WKHMRLECA | 48544 |
| HPV16 | E2 | 183 | KNKVWEVHAGGQVIL | 46448 | VWEVHAGGQ | 48545 |
| HPV16 | E2 | 94 | KWTLQDVSLEVYLTA | 46449 | LQDVSLEVY | 48546 |
| HPV16 | E2 | 102 | LEVYLTAPTGCIKKH | 46450 | YLTAPTGCI | 48547 |
| HPV16 | E2 | 73 | LQAIELQLTLETIYN | 46451 | IELQLTLET | 48548 |
| HPV16 | E2 | 350 | LSQVKIPKTITVSTG | 46452 | VKIPKTITV | 48549 |
| HPV16 | E2 | 19 | LTHYENDSTDLRDHI | 46453 | YENDSTDLR | 48550 |
| HPV16 | E2 | 92 | NEKWTLQDVSLEVYL | 46454 | WTLQDVSLE | 48551 |
| HPV16 | E2 | 58 | NHQVVPTLAVSKNKA | 46455 | VVPTLAVSK | 48552 |
| HPV16 | E2 | 70 | NKALQAIELQLTLET | 46456 | LQAIELQLT | 48553 |
| HPV16 | E2 | 211 | PEIIRQHLANHPAAT | 46457 | IRQHLANHP | 48554 |
| HPV16 | E2 | 238 | QTTIQRPRSEPDTGN | 46458 | IQRPRSEPD | 48555 |
| HPV16 | E2 | 194 | QVILCPTSVFSSNEV | 46459 | LCPTSVFSS | 48556 |
| HPV16 | E2 | 352 | QVKIPKTITVSTGFM | 46460 | IPKTITVST | 48557 |
| HPV16 | E2 | 262 | RDSVDSAPILTAFNS | 46461 | VDSAPILTA | 48558 |
| HPV16 | E2 | 10 | RLNVCQDKILTHYEN | 46462 | VCQDKILTH | 48559 |
| HPV16 | E2 | 215 | RQHLANHPAATHTKA | 46463 | LANHPAATH | 48560 |
| HPV16 | E2 | 305 | RYRFKKHCTLYTAVS | 46464 | FKKHCTLYT | 48561 |
| HPV16 | E2 | 101 | SLEVYLTAPTGCIKK | 46465 | VYLTAPTGC | 48562 |
| HPV16 | E2 | 205 | SNEVSSPEIIRQHLA | 46466 | VSSPEIIRQ | 48563 |
| HPV16 | E2 | 210 | SPEIIRQHLANHPAA | 46467 | IIRQHLANH | 48564 |
| HPV16 | E2 | 147 | SVTVVEGQVDYYGLY | 46468 | VVEGQVDYY | 48565 |
| HPV16 | E2 | 138 | THIYICEEASVTVVE | 46469 | YICEEASVT | 48566 |
| HPV16 | E2 | 257 | TKLLHRDSVDSAPIL | 46470 | LHRDSVDSA | 48567 |
| HPV16 | E2 | 64 | TLAVSKNKALQAIEL | 46471 | VSKNKALQA | 48568 |
| HPV16 | E2 | 200 | TSVFSSNEVSSPEII | 46472 | FSSNEVSSP | 48569 |
| HPV16 | E2 | 256 | TTKLLHRDSVDSAPI | 46473 | LLHRDSVDS | 48570 |
| HPV16 | E2 | 321 | TWHWTGHNVKHKSAI | 46474 | WTGHNVKHK | 48571 |
| HPV16 | E2 | 155 | VDYYGLYYVHEGIRT | 46475 | YGLYYVHEG | 48572 |
| HPV16 | E2 | 36 | WKHMRLECAIYYKAR | 46476 | MRLECAIYY | 48573 |
| HPV16 | E2 | 134 | YTNWTHIYICEEASV | 46477 | WTHIYICEE | 48574 |
| HPV16 | E5 | 1 | ---MTNLDTASTTLL | 46478 | MTNLDTAST | 48575 |
| HPV16 | E5 | 16 | ACFLLCFCVLLCVCL | 46479 | LLCFCVLLC | 48576 |
| HPV16 | E5 | 57 | ASAFRCFIVYIIFVY | 46480 | FRCFIVYII | 48577 |
| HPV16 | E5 | 21 | CFCVLLCVCLLIRPL | 46481 | VLLCVCLLI | 48578 |
| HPV16 | E5 | 62 | CFIVYIIFVYIPLFL | 46482 | VYIIFVYIP | 48579 |
| HPV16 | E5 | 17 | CFLLCFCVLLCVCLL | 46483 | LCFCVLLCV | 48580 |
| HPV16 | E5 | 29 | CLLIRPLLLSVSTYT | 46484 | IRPLLLSVS | 48581 |
| HPV16 | E5 | 27 | CVCLLIRPLLLSVST | 46485 | LLIRPLLLS | 48582 |
| HPV16 | E5 | 23 | CVLLCVCLLIRPLLL | 46486 | LCVCLLIRP | 48583 |
| HPV16 | E5 | 22 | FCVLLCVCLLIRPLL | 46487 | LLCVCLLIR | 48584 |
| HPV16 | E5 | 60 | FRCFIVYIIFVYIPL | 46488 | FIVYIIFVY | 48585 |
| HPV16 | E5 | 69 | FVYIPLFLIHTHARF | 46489 | IPLFLIHTH | 48586 |
| HPV16 | E5 | 68 | IFVYIPLFLIHTHAR | 46490 | YIPLFLIHT | 48587 |
| HPV16 | E5 | 46 | IILVLLLWITAASAF | 46491 | VLLLWITAA | 48588 |
| HPV16 | E5 | 47 | ILVLLLWITAASAFR | 46492 | LLLWITAAS | 48589 |
| HPV16 | E5 | 32 | IRPLLLSVSTYTSLI | 46493 | LLLSVSTYT | 48590 |
| HPV16 | E5 | 64 | IVYIIFVYIPLFLIH | 46494 | IIFVYIPLF | 48591 |
| HPV16 | E5 | 15 | LACFLLCFCVLLCVC | 46495 | FLLCFCVLL | 48592 |
| HPV16 | E5 | 19 | LLCFCVLLCVCLLIR | 46496 | FCVLLCVCL | 48593 |
| HPV16 | E5 | 50 | LLLWITAASAFRCFI | 46497 | WITAASAFR | 48594 |
| HPV16 | E5 | 36 | LLSVSTYTSLIILVL | 46498 | VSTYTSLII | 48595 |
| HPV16 | E5 | 51 | LLWITAASAFRCFIV | 46499 | ITAASAFRC | 48596 |
| HPV16 | E5 | 48 | LVLLLWITAASAFRC | 46500 | LLWITAASA | 48597 |
| HPV16 | E5 | 4 | MTNLDTASTTLLACF | 46501 | LDTASTTLL | 48598 |
| HPV16 | E5 | 73 | PLFLIHTHARFLIT- | 46502 | LIHTHARFL | 48599 |
| HPV16 | E5 | 33 | RPLLLSVSTYTSLII | 46503 | LLSVSTYTS | 48600 |
| HPV16 | E5 | 44 | SLIILVLLLWITAAS | 46504 | ILVLLLWIT | 48601 |
| HPV16 | E5 | 11 | STTLLACFLLCFCVL | 46505 | LLACFLLCF | 48602 |
| HPV16 | E5 | 43 | TSLIILVLLLWITAA | 46506 | IILVLLLWI | 48603 |
| HPV16 | E5 | 12 | TTLLACFLLCFCVLL | 46507 | LACFLLCFC | 48604 |
| HPV16 | E5 | 28 | VCLLIRPLLLSVSTY | 46508 | LIRPLLLSV | 48605 |
| HPV16 | E5 | 49 | VLLLWITAASAFRCF | 46509 | LWITAASAF | 48606 |
| HPV16 | E5 | 39 | VSTYTSLIILVLLLW | 46510 | YTSLIILVL | 48607 |
| HPV16 | E5 | 65 | VYIIFVYIPLFLIHT | 46511 | IFVYIPLFL | 48608 |
| HPV16 | E5 | 66 | YIIFVYIPLFLIHTH | 46512 | FVYIPLFLI | 48609 |
| HPV16 | E5 | 71 | YIPLFLIHTHARFLI | 46513 | LFLIHTHAR | 48610 |
| HPV16 | E5 | 42 | YTSLIILVLLLWITA | 46514 | LIILVLLLW | 48611 |
| HPV16 | E6 | 1 | ---MHQKRTAMFQDP | 46515 | MHQKRTAMF | 48612 |
| HPV16 | E6 | 61 | CIVYRDGNPYAVCDK | 46516 | YRDGNPYAV | 48613 |
| HPV16 | E6 | 76 | CLKFYSKISEYRHYC | 46517 | FYSKISEYR | 48614 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV16 | E6 | 90 | CYSLYGTTLEQQYNK | 46518 | LYGTTLEQQ | 48615 |
| HPV16 | E6 | 54 | DFAFRDLCIVYRDGN | 46519 | FRDLCIVYR | 48616 |
| HPV16 | E6 | 35 | DIILECVYCKQQLLR | 46520 | LECVYCKQQ | 48617 |
| HPV16 | E6 | 108 | DLLIRCINCQKPLCP | 46521 | IRCINCQKP | 48618 |
| HPV16 | E6 | 39 | ECVYCKQQLLRREVY | 46522 | YCKQQLLRR | 48619 |
| HPV16 | E6 | 99 | EQQYNKPLCDLLIRC | 46523 | YNKPLCDLL | 48620 |
| HPV16 | E6 | 135 | FHNIRGRWTGRCMSC | 46524 | IRGRWTGRC | 48621 |
| HPV16 | E6 | 144 | GRCMSCCRSSRTRRE | 46525 | MSCCRSSRT | 48622 |
| HPV16 | E6 | 88 | HYCSLYGTTLEQQY | 46526 | YSLYGTTLE | 48623 |
| HPV16 | E6 | 33 | IHDIILECVYCKQQL | 46527 | IILECVYCK | 48624 |
| HPV16 | E6 | 111 | IRCINCQKPLCPEEK | 46528 | INCQKPLCP | 48625 |
| HPV16 | E6 | 44 | KQQLLRREVYDFAFR | 46529 | LLRREVYDF | 48626 |
| HPV16 | E6 | 106 | LCDLLIRCINCQKPL | 46530 | LLIRCINCQ | 48627 |
| HPV16 | E6 | 103 | NKPLCDLLIRCINCQ | 46531 | LCDLLIRCI | 48628 |
| HPV16 | E6 | 19 | PRKLPQLCTELQTTI | 46532 | LPQLCTELQ | 48629 |
| HPV16 | E6 | 69 | PYAVCDKCLKFYSKI | 46533 | VCDKCLKFY | 48630 |
| HPV16 | E6 | 30 | QTTIHDIILECVYCK | 46534 | IHDIILECV | 48631 |
| HPV16 | E6 | 139 | RGRWTGRCMSCCRSS | 46535 | WTGRCMSCC | 48632 |
| HPV16 | E6 | 52 | VYDFAFRDLCIVYRD | 46536 | FAFRDLCIV | 48633 |
| HPV16 | E7 | 1 | ---MHGDTPTLHEYM | 46537 | MHGDTPTLH | 48634 |
| HPV16 | E7 | 84 | DLLMGTLGIVCPICS | 46538 | MGTLGIVCP | 48635 |
| HPV16 | E7 | 12 | HEYMLDLQPETTDLY | 46539 | MLDLQPETT | 48636 |
| HPV16 | E7 | 54 | HYNIVTFCCKCDSTL | 46540 | IVTFCCKCD | 48637 |
| HPV16 | E7 | 79 | IRTLEDLLMGTLGIV | 46541 | LEDLLMGTL | 48638 |
| HPV16 | E7 | 82 | LEDLLMGTLGIVCPI | 46542 | LLMGTLGIV | 48639 |
| HPV16 | E7 | 90 | LGIVCPICSQKP--- | 46543 | VCPICSQKP | 48640 |
| HPV16 | E7 | 87 | MGTLGIVCPICSQKP | 46544 | LGIVCPICS | 48641 |
| HPV16 | E7 | 15 | MLDLQPETTDLYCYE | 46545 | LQPETTDLY | 48642 |
| HPV16 | E7 | 69 | RLCVQSTHVDIRTLE | 46546 | VQSTHVDIR | 48643 |
| HPV16 | E7 | 74 | STHVDIRTLEDLLMG | 46547 | VDIRTLEDL | 48644 |
| HPV16 | E7 | 23 | TDLYCYEQLNDSSEE | 46548 | YCYEQLNDS | 48645 |
| HPV16 | E7 | 89 | TLGIVCPICSQKP-- | 46549 | IVCPICSQK | 48646 |
| HPV16 | E7 | 67 | TLRLCVQSTHVDIRT | 46550 | LCVQSTHVD | 48647 |
| HPV16 | E7 | 8 | TPTLHEYMLDLQPET | 46551 | LHEYMLDLQ | 48648 |
| HPV16 | L1 | 1 | ---MQVTFIYILVIT | 46552 | MQVTFIYIL | 48649 |
| HPV16 | L1 | 3 | -MQVTFIYILVITCY | 46553 | VTFIYILVI | 48650 |
| HPV16 | L1 | 414 | ADVMTYIHSMNSTIL | 46554 | MTYIHSMNS | 48651 |
| HPV16 | L1 | 293 | AGAVGENVPDDLYIK | 46555 | VGENVPDDL | 48652 |
| HPV16 | L1 | 236 | AMDFTTLQANKSEVP | 46556 | FTTLQANKS | 48653 |
| HPV16 | L1 | 38 | ATVYLPPVPVSKVVS | 46557 | YLPPVPVSK | 48654 |
| HPV16 | L1 | 374 | CAAISTSETTYKNTN | 46558 | ISTSETTYK | 48655 |
| HPV16 | L1 | 175 | CISMDYKQTQLCLIG | 46559 | MDYKQTQLC | 48656 |
| HPV16 | L1 | 214 | CPPLELINTVIQDGD | 46560 | LELINTVIQ | 48657 |
| HPV16 | L1 | 54 | DEYVARTNIYYHAGT | 46561 | VARTNIYYH | 48658 |
| HPV16 | L1 | 400 | DLQFIFQLCKITLTA | 46562 | FIFQLCKIT | 48659 |
| HPV16 | L1 | 303 | DLYIKGSGSTANLAS | 46563 | IKGSGSTAN | 48660 |
| HPV16 | L1 | 116 | DTSFYNPDTQRLVWA | 46564 | FYNPDTQRL | 48661 |
| HPV16 | L1 | 430 | DWNFGLQPPPGGTLE | 46565 | FGLQPPPGG | 48662 |
| HPV16 | L1 | 37 | EATVYLPPVPVSKVV | 46566 | VYLPPVPVS | 48663 |
| HPV16 | L1 | 444 | EDTYRFVTSQAIACQ | 46567 | YRFVTSQAI | 48664 |
| HPV16 | L1 | 18 | ENDVNVYHIFFQMSL | 46568 | VNVYHIFFQ | 48665 |
| HPV16 | L1 | 477 | EVNLKEKFSADLDQF | 46569 | LKEKFSADL | 48666 |
| HPV16 | L1 | 248 | EVPLDICTSICKYPD | 46570 | LDICTSICK | 48667 |
| HPV16 | L1 | 27 | FFQMSLWLPSEATVY | 46571 | MSLWLPSEA | 48668 |
| HPV16 | L1 | 276 | FFYLRREQMFVRHLF | 46572 | LRREQMFVR | 48669 |
| HPV16 | L1 | 234 | FGAMDFTTLQANKSE | 46573 | MDFTTLQAN | 48670 |
| HPV16 | L1 | 8 | FIYILVITCYENDVN | 46574 | ILVITCYEN | 48671 |
| HPV16 | L1 | 239 | FTTLQANKSEVPLDI | 46575 | LQANKSEVP | 48672 |
| HPV16 | L1 | 396 | GEEYDLQFIFQLCKI | 46576 | YDLQFIFQL | 48673 |
| HPV16 | L1 | 195 | GEHWGKGSPCTNVAV | 46577 | WGKGSPCTN | 48674 |
| HPV16 | L1 | 96 | GLQYRVFRIHLPDPN | 46578 | YRVFRIHLP | 48675 |
| HPV16 | L1 | 355 | GNQLFVTVVDTTRST | 46579 | LFVTVVDTT | 48676 |
| HPV16 | L1 | 139 | GQPLGVGISGHPLLN | 46580 | LGVGISGHP | 48677 |
| HPV16 | L1 | 133 | GVEVGRGQPLGVGIS | 46581 | VGRGQPLGV | 48678 |
| HPV16 | L1 | 143 | GVGISGHPLLNKLDD | 46582 | ISGHPLLNK | 48679 |
| HPV16 | L1 | 76 | HPYFPIKKPNNNKIL | 46583 | FPIKKPNNN | 48680 |
| HPV16 | L1 | 404 | IFQLCKITLTADVMT | 46584 | LCKITLTAD | 48681 |
| HPV16 | L1 | 420 | IHSMNSTILEDWNFG | 46585 | MNSTILEDW | 48682 |
| HPV16 | L1 | 508 | KFTLGKRKATPTTSS | 46586 | LGKRKATPT | 48683 |
| HPV16 | L1 | 409 | KITLTADVMTYIHSM | 46587 | LTADVMTYI | 48684 |
| HPV16 | L1 | 246 | KSEVPLDICTSICKY | 46588 | VPLDICTSI | 48685 |
| HPV16 | L1 | 472 | KYTFWEVNLKEKFSA | 46589 | FWEVNLKEK | 48686 |
| HPV16 | L1 | 185 | LCLIGCKPPIGEHWG | 46590 | IGCKPPIGE | 48687 |
| HPV16 | L1 | 470 | LKKYTFWEVNLKEKF | 46591 | YTFWEVNLK | 48688 |
| HPV16 | L1 | 42 | LPPVPVSKVVSTDEY | 46592 | VPVSKVVST | 48689 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV16 | L1 | 30 | MSLWLPSEATVYLPP | 46593 | WLPSEATVY | 48690 |
| HPV16 | L1 | 417 | MTYIHSMNSTILEDW | 46594 | IHSMNSTIL | 48691 |
| HPV16 | L1 | 167 | NAGVDNRECISMDYK | 46595 | VDNRECISM | 48692 |
| HPV16 | L1 | 61 | NIYYHAGTSRLLAVG | 46596 | YHAGTSRLL | 48693 |
| HPV16 | L1 | 87 | NKILVPKVSGLQYRV | 46597 | LVPKVSGLQ | 48694 |
| HPV16 | L1 | 337 | NKPYWLQRAQGHNNG | 46598 | YWLQRAQGH | 48695 |
| HPV16 | L1 | 370 | NMSLCAAISTSETTY | 46599 | LCAAISTSE | 48696 |
| HPV16 | L1 | 86 | NNKILVPKVSGLQYR | 46600 | ILVPKVSGL | 48697 |
| HPV16 | L1 | 221 | NTVIQDGDMVDTGFG | 46601 | IQDGDMVDT | 48698 |
| HPV16 | L1 | 206 | NVAVNPGDCPPLELI | 46602 | VNPGDCPPL | 48699 |
| HPV16 | L1 | 301 | PDDLYIKGSGSTANL | 46603 | LYIKGSGST | 48700 |
| HPV16 | L1 | 250 | PLDICTSICKYPDYI | 46604 | ICTSICKYP | 48701 |
| HPV16 | L1 | 216 | PLELINTVIQDGDMV | 46605 | LINTVIQDG | 48702 |
| HPV16 | L1 | 109 | PNKFGFPDTSFYNPD | 46606 | FGFPDTSFY | 48703 |
| HPV16 | L1 | 44 | PVPVSKVVSTDEYVA | 46607 | VSKVVSTDE | 48704 |
| HPV16 | L1 | 402 | QFIFQLCKITLTADV | 46608 | FQLCKITLT | 48705 |
| HPV16 | L1 | 490 | QFPLGRKFLLQAGLK | 46609 | LGRKFLLQA | 48706 |
| HPV16 | L1 | 184 | QLCLIGCKPPIGEHW | 46610 | LIGCKPPIG | 48707 |
| HPV16 | L1 | 357 | QLFVTVVDTTRSTNM | 46611 | VTVVDTTRS | 48708 |
| HPV16 | L1 | 182 | QTQLCLIGCKPPIGE | 46612 | LCLIGCKPP | 48709 |
| HPV16 | L1 | 5 | QVTFIYILVITCYEN | 46613 | FIYILVITC | 48710 |
| HPV16 | L1 | 98 | QYRVFRIHLPDPNKF | 46614 | VFRIHLPDP | 48711 |
| HPV16 | L1 | 281 | REQMFVRHLFNRAGA | 46615 | MFVRHLFNR | 48712 |
| HPV16 | L1 | 287 | RHLFNRAGAVGENVP | 46616 | FNRAGAVGE | 48713 |
| HPV16 | L1 | 495 | RKFLLQAGLKAKPKF | 46617 | LLQAGLKAK | 48714 |
| HPV16 | L1 | 126 | RLVWACVGVEVGRGQ | 46618 | WACVGVEVG | 48715 |
| HPV16 | L1 | 485 | SADLDQFPLGRKFLL | 46619 | LDQFPLGRK | 48716 |
| HPV16 | L1 | 325 | SGSMVTSDAQIFNKP | 46620 | MVTSDAQIF | 48717 |
| HPV16 | L1 | 31 | SLWLPSEATVYLPPV | 46621 | LPSEATVYL | 48718 |
| HPV16 | L1 | 177 | SMDYKQTQLCLIGCK | 46622 | YKQTQLCLI | 48719 |
| HPV16 | L1 | 69 | SRLLAVGHPYFPIKK | 46623 | LAVGHPYFP | 48720 |
| HPV16 | L1 | 317 | SSNYFPTPSGSMVTS | 46624 | YFPTPSGSM | 48721 |
| HPV16 | L1 | 368 | STNMSLCAAISTSET | 46625 | MSLCAAIST | 48722 |
| HPV16 | L1 | 7 | TFIYILVITCYENDV | 46626 | YILVITCYE | 48723 |
| HPV16 | L1 | 60 | TNIYYHAGTSRLLAV | 46627 | YYHAGTSRL | 48724 |
| HPV16 | L1 | 124 | TQRLVWACVGVEVGR | 46628 | LVWACVGVE | 48725 |
| HPV16 | L1 | 39 | TVYLPPVPVSKVVST | 46629 | LPPVPVSKV | 48726 |
| HPV16 | L1 | 446 | TYRFVTSQAIACQKH | 46630 | FVTSQAIAC | 48727 |
| HPV16 | L1 | 101 | VFRIHLPDPNKFGFP | 46631 | IHLPDPNKF | 48728 |
| HPV16 | L1 | 6 | VTFIYILVITCYEND | 46632 | IYILVITCY | 48729 |
| HPV16 | L1 | 360 | VTVVDTTRSTNMSLC | 46633 | VDTTRSTNM | 48730 |
| HPV16 | L1 | 23 | VYHIFFQMSLWLPSE | 46634 | IFFQMSLWL | 48731 |
| HPV16 | L1 | 24 | YHIFFQMSLWLPSEA | 46635 | FFQMSLWLP | 48732 |
| HPV16 | L1 | 260 | YPDYIKMVSEPYGDS | 46636 | YIKMVSEPY | 48733 |
| HPV16 | L1 | 447 | YRFVTSQAIACQKHT | 46637 | VTSQAIACQ | 48734 |
| HPV16 | L1 | 99 | YRVFRIHLPDPNKFG | 46638 | FRIHLPDPN | 48735 |
| HPV16 | L2 | 1 | ---MRHKRSAKRTKR | 46639 | MRHKRSAKR | 48736 |
| HPV16 | L2 | 373 | ADDFITDTSTTPVPS | 46640 | FITDTSTTP | 48737 |
| HPV16 | L2 | 45 | ADQILQYGSMGVFFG | 46641 | ILQYGSMGV | 48738 |
| HPV16 | L2 | 339 | AEEIELQTITPSTYT | 46642 | IELQTITPS | 48739 |
| HPV16 | L2 | 446 | AGDFYLHPSYYMLRK | 46643 | FYLHPSYYM | 48740 |
| HPV16 | L2 | 427 | APSLIPIVPGSPQYT | 46644 | LIPIVPGSP | 48741 |
| HPV16 | L2 | 374 | DDFITDTSTTPVPSV | 46645 | ITDTSTTPV | 48742 |
| HPV16 | L2 | 242 | DPAFITTPTKLITYD | 46646 | FITTPTKLI | 48743 |
| HPV16 | L2 | 283 | DPDFLDIVALHRPAL | 46647 | FLDIVALHR | 48744 |
| HPV16 | L2 | 168 | DPSVLQPPTPAETGG | 46648 | VLQPPTPAE | 48745 |
| HPV16 | L2 | 46 | DQILQYGSMGVFFGG | 46649 | LQYGSMGVF | 48746 |
| HPV16 | L2 | 202 | DTFIVSTNPNTVTSS | 46650 | IVSTNPNTV | 48747 |
| HPV16 | L2 | 341 | EIELQTITPSTYTTT | 46651 | LQTITPSTY | 48748 |
| HPV16 | L2 | 198 | EIPMDTFIVSTNPNT | 46652 | MDTFIVSTN | 48749 |
| HPV16 | L2 | 114 | ETSFIDAGAPTSVPS | 46653 | FIDAGAPTS | 48750 |
| HPV16 | L2 | 406 | GGAYNIPLVSGPDIP | 46654 | YNIPLVSGP | 48751 |
| HPV16 | L2 | 181 | GGHFTLSSSTISTHN | 46655 | FTLSSSTIS | 48752 |
| HPV16 | L2 | 41 | GKTIADQILQYGSMG | 46656 | IADQILQYG | 48753 |
| HPV16 | L2 | 416 | GPDIPINITDQAPSL | 46657 | IPINITDQA | 48754 |
| HPV16 | L2 | 55 | GVFFGGLGIGTGSGT | 46658 | FGGLGIGTG | 48755 |
| HPV16 | L2 | 183 | HFTLSSSTISTHNYE | 46659 | LSSSTISTH | 48756 |
| HPV16 | L2 | 328 | HYYYDFSTIDSAEEI | 46660 | YDFSTIDSA | 48757 |
| HPV16 | L2 | 148 | ILDINNTVTTVTTHN | 46661 | INNTVTTVT | 48758 |
| HPV16 | L2 | 48 | ILQYGSMGVFFGGLG | 46662 | YGSMGVFFG | 48759 |
| HPV16 | L2 | 36 | IPKVEGKTIADQILQ | 46663 | VEGKTIADQ | 48760 |
| HPV16 | L2 | 411 | IPLVSGPDIPINITD | 46664 | VSGPDIPIN | 48761 |
| HPV16 | L2 | 289 | IVALHRPALTSRRTG | 46665 | LHRPALTSR | 48762 |
| HPV16 | L2 | 108 | IVSLVEETSFIDAGA | 46666 | LVEETSFID | 48763 |
| HPV16 | L2 | 326 | KVHYYYDFSTIDSAE | 46667 | YYYDFSTID | 48764 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV16 | L2 | 89 | LAPVRPPLTVDPVGP | 46668 | VRPPLTVDP | 48765 |
| HPV16 | L2 | 287 | LDIVALHRPALTSRR | 46669 | VALHRPALT | 48766 |
| HPV16 | L2 | 430 | LIPIVPGSPQYTIIA | 46670 | IVPGSPQYT | 48767 |
| HPV16 | L2 | 465 | LPYFFSDVSLAA--- | 46671 | FFSDVSLAA | 48768 |
| HPV16 | L2 | 393 | LSGYIPANTTIPFGG | 46672 | YIPANTTIP | 48769 |
| HPV16 | L2 | 365 | NNGLYDIYADDFITD | 46673 | LYDIYADDF | 48770 |
| HPV16 | L2 | 152 | NNTVTTVTTHNNPTF | 46674 | VTTVTTHNN | 48771 |
| HPV16 | L2 | 257 | NPAYEGIDVDNTLYF | 46675 | YEGIDVDNT | 48772 |
| HPV16 | L2 | 163 | NPTFTDPSVLQPPTP | 46676 | FTDPSVLQP | 48773 |
| HPV16 | L2 | 400 | NTTIPFGGAYNIPLV | 46677 | IPFGGAYNI | 48774 |
| HPV16 | L2 | 146 | PAILDINNTVTTVTT | 46678 | LDINNTVTT | 48775 |
| HPV16 | L2 | 284 | PDFLDIVALHRPALT | 46679 | LDIVALHRP | 48776 |
| HPV16 | L2 | 420 | PINITDQAPSLIPIV | 46680 | ITDQAPSLI | 48777 |
| HPV16 | L2 | 95 | PLTVDPVGPSDPSIV | 46681 | VDPVGPSDP | 48778 |
| HPV16 | L2 | 210 | PNTVTSSTPIPGSRP | 46682 | VTSSTPIPG | 48779 |
| HPV16 | L2 | 130 | PPDVSGFSITTSTDT | 46683 | VSGFSITTS | 48780 |
| HPV16 | L2 | 169 | PSVLQPPTPAETGGH | 46684 | LQPPTPAET | 48781 |
| HPV16 | L2 | 123 | PTSVPSIPPDVSGFS | 46685 | VPSIPPDVS | 48782 |
| HPV16 | L2 | 462 | RKRLPYFFSDVSLAA | 46686 | LPYFFSDVS | 48783 |
| HPV16 | L2 | 227 | RLGLYSRTTQQVKVV | 46687 | LYSRTTQQV | 48784 |
| HPV16 | L2 | 464 | RLPYFFSDVSLAA-- | 46688 | YFFSDVSLA | 48785 |
| HPV16 | L2 | 294 | RPALTSRRTGIRYSR | 46689 | LTSRRTGIR | 48786 |
| HPV16 | L2 | 93 | RPPLTVDPVGPSDPS | 46690 | LTVDPVGPS | 48787 |
| HPV16 | L2 | 301 | RTGIRYSRIGNKQTL | 46691 | IRYSRIGNK | 48788 |
| HPV16 | L2 | 72 | RTGYIPLGTRPPTAT | 46692 | YIPLGTRPP | 48789 |
| HPV16 | L2 | 394 | SGYIPANTTIPFGGA | 46693 | IPANTTIPF | 48790 |
| HPV16 | L2 | 53 | SMGVFFGGLGIGTGS | 46694 | VFFGGLGIG | 48791 |
| HPV16 | L2 | 222 | SRPVARLGLYSRTTQ | 46695 | VARLGLYSR | 48792 |
| HPV16 | L2 | 216 | STPIPGSRPVARLGL | 46696 | IPGSRPVAR | 48793 |
| HPV16 | L2 | 390 | STSLSGYIPANTTIP | 46697 | LSGYIPANT | 48794 |
| HPV16 | L2 | 86 | TDTLAPVRPPLTVDP | 46698 | LAPVRPPLT | 48795 |
| HPV16 | L2 | 193 | THNYEEIPMDTFIVS | 46699 | YEEIPMDTF | 48796 |
| HPV16 | L2 | 250 | TKLITYDNPAYEGID | 46700 | ITYDNPAYE | 48797 |
| HPV16 | L2 | 235 | TQQVKVVDPAFITTP | 46701 | VKVVDPAFI | 48798 |
| HPV16 | L2 | 115 | TSFIDAGAPTSVPSI | 46702 | IDAGAPTSV | 48799 |
| HPV16 | L2 | 382 | TTPVPSVPSTSLSGY | 46703 | VPSVPSTSL | 48800 |
| HPV16 | L2 | 98 | VDPVGPSDPSIVSLV | 46704 | VGPSDPSIV | 48801 |
| HPV16 | L2 | 327 | VHYYYDFSTIDSAEE | 46705 | YYDFSTIDS | 48802 |
| HPV16 | L2 | 238 | VKVVDPAFITTPTKL | 46706 | VDPAFITTP | 48803 |
| HPV16 | L2 | 126 | VPSIPPDVSGFSITT | 46707 | IPPDVSGFS | 48804 |
| HPV16 | L2 | 385 | VPSVPSTSLSGYIPA | 46708 | VPSTSLSGY | 48805 |
| HPV16 | L2 | 133 | VSGFSITTSTDTTPA | 46709 | FSITTSTDT | 48806 |
| HPV16 | L2 | 369 | YDIYADDFITDTSTT | 46710 | YADDFITDT | 48807 |
| HPV16 | L2 | 260 | YEGIDVDNTLYFSSN | 46711 | IDVDNTLYF | 48808 |
| HPV16 | L2 | 75 | YIPLGTRPPTATDTL | 46712 | LGTRPPTAT | 48809 |
| HPV16 | L2 | 306 | YSRIGNKQTLRTRSG | 46713 | IGNKQTLRT | 48810 |
| HPV16 | L2 | 330 | YYDFSTIDSAEEIEL | 46714 | FSTIDSAEE | 48811 |
| HPV18 | E1 | 399 | AAAFLKSNCQAKYLK | 46715 | FLKSNCQAK | 48812 |
| HPV18 | E1 | 409 | AKYLKDCATMCKHYR | 46716 | LKDCATMCK | 48813 |
| HPV18 | E1 | 328 | ALYWYRTGISNISEV | 46717 | WYRTGISNI | 48814 |
| HPV18 | E1 | 314 | CMLIQPPKLRSSVAA | 46718 | IQPPKLRSS | 48815 |
| HPV18 | E1 | 17 | CNGWFYVQAIVDKKT | 46719 | WFYVQAIVD | 48816 |
| HPV18 | E1 | 142 | CSEVEATQIQVTTNG | 46720 | VEATQIQVT | 48817 |
| HPV18 | E1 | 538 | CWTYFDTYMRNALDG | 46721 | YFDTYMRNA | 48818 |
| HPV18 | E1 | 278 | DCKWGVLILALLRYK | 46722 | WGVLILALL | 48819 |
| HPV18 | E1 | 384 | DMAFEYALLADSNSN | 46723 | FEYALLADS | 48820 |
| HPV18 | E1 | 583 | DNRWPYLESRITVFE | 46724 | WPYLESRIT | 48821 |
| HPV18 | E1 | 137 | DSGYGCSEVEATQIQ | 46725 | YGCSEVEAT | 48822 |
| HPV18 | E1 | 362 | DSNFDLSEMVQWAFD | 46726 | FDLSEMVQW | 48823 |
| HPV18 | E1 | 624 | ERTWSRLDLHEEEED | 46727 | WSRLDLHEE | 48824 |
| HPV18 | E1 | 382 | ESDMAFEYALLADSN | 46728 | MAFEYALLA | 48825 |
| HPV18 | E1 | 312 | ETCMLIQPPKLRSSV | 46729 | MLIQPPKLR | 48826 |
| HPV18 | E1 | 542 | FDTYMRNALDGNPIS | 46730 | YMRNALDGN | 48827 |
| HPV18 | E1 | 500 | FIHFIQGAVISFVNS | 46731 | FIQGAVISF | 48828 |
| HPV18 | E1 | 268 | FILYAHIQCLDCKWG | 46732 | YAHIQCLDC | 48829 |
| HPV18 | E1 | 261 | FKTLIQPFILYAHIQ | 46733 | LIQPFILYA | 48830 |
| HPV18 | E1 | 506 | GAVISFVNSTSHFWL | 46734 | ISFVNSTSH | 48831 |
| HPV18 | E1 | 159 | GGNVCSGGSTEAIDN | 46735 | VCSGGSTEA | 48832 |
| HPV18 | E1 | 643 | GNPFGTFKLRAGQNH | 46736 | FGTFKLRAG | 48833 |
| HPV18 | E1 | 19 | GWFYVQAIVDKKTGD | 46737 | YVQAIVDKK | 48834 |
| HPV18 | E1 | 561 | HKPLIQLKCPPILLT | 46738 | LIQLKCPPI | 48835 |
| HPV18 | E1 | 461 | IEFITFLGALKSFLK | 46739 | ITFLGALKS | 48836 |
| HPV18 | E1 | 192 | IENVNPQCTIAQLKD | 46740 | VNPQCTIAQ | 48837 |
| HPV18 | E1 | 250 | IFGVNPTIAEGFKTL | 46741 | VNPTIAEGF | 48838 |
| HPV18 | E1 | 501 | IHFIQGAVISFVNST | 46742 | IQGAVISFV | 48839 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV18 | E1 | 285 | ILALLRYKCGKSRLT | 46743 | LLRYKCGKS | 48840 |
| HPV18 | E1 | 339 | ISEVMGDTPEWIQRL | 46744 | VMGDTPEWI | 48841 |
| HPV18 | E1 | 464 | ITFLGALKSFLKGTP | 46745 | LGALKSFLK | 48842 |
| HPV18 | E1 | 593 | ITVFEFPNAFPFDKN | 46746 | FEFPNAFPF | 48843 |
| HPV18 | E1 | 620 | KCFFERTWSRLDLHE | 46747 | FERTWSRLD | 48844 |
| HPV18 | E1 | 222 | KDTYGLSFTDLVRNF | 46748 | YGLSFTDLV | 48845 |
| HPV18 | E1 | 480 | KNCLVFCGPANTGKS | 46749 | LVFCGPANT | 48846 |
| HPV18 | E1 | 562 | KPLIQLKCPPILLTT | 46750 | IQLKCPPIL | 48847 |
| HPV18 | E1 | 89 | KRKFAGGSTENSPLG | 46751 | FAGGSTENS | 48848 |
| HPV18 | E1 | 493 | KSYFGMSFIHFIQGA | 46752 | FGMSFIHFI | 48849 |
| HPV18 | E1 | 262 | KTLIQPFILYAHIQC | 46753 | IQPFILYAH | 48850 |
| HPV18 | E1 | 527 | KVAMLDDATTTCWTY | 46754 | MLDDATTTC | 48851 |
| HPV18 | E1 | 280 | KWGVLILALLRYKCG | 46755 | VLILALLRY | 48852 |
| HPV18 | E1 | 520 | LEPLTDTKVAMLDDA | 46756 | LTDTKVAML | 48853 |
| HPV18 | E1 | 85 | LHVLKRKFAGGSTEN | 46757 | LKRKFAGGS | 48854 |
| HPV18 | E1 | 564 | LIQLKCPPILLTTNI | 46758 | LKCPPILLT | 48855 |
| HPV18 | E1 | 470 | LKSFLKGTPKKNCLV | 46759 | FLKGTPKKN | 48856 |
| HPV18 | E1 | 307 | LLHVPETCMLIQPPK | 46760 | VPETCMLIQ | 48857 |
| HPV18 | E1 | 288 | LLRYKCGKSRLTVAK | 46761 | YKCGKSRLT | 48858 |
| HPV18 | E1 | 329 | LYWYRTGISNISEVM | 46762 | YRTGISNIS | 48859 |
| HPV18 | E1 | 432 | MSQWIRFRCSKIDEG | 46763 | WIRFRCSKI | 48860 |
| HPV18 | E1 | 481 | NCLVFCGPANTGKSY | 46764 | VFCGPANTG | 48861 |
| HPV18 | E1 | 18 | NGWFYVQAIVDKKTG | 46765 | FYVQAIVDK | 48862 |
| HPV18 | E1 | 189 | NSNIENVNPQCTIAQ | 46766 | IENVNPQCT | 48863 |
| HPV18 | E1 | 347 | PEWIQRLTIIQHGID | 46767 | IQRLTIIQH | 48864 |
| HPV18 | E1 | 570 | PPILLTTNIHPAKDN | 46768 | LLTTNIHPA | 48865 |
| HPV18 | E1 | 319 | PPKLRSSVAALYWYR | 46769 | LRSSVAALY | 48866 |
| HPV18 | E1 | 63 | QAELETAQALFHAQE | 46770 | LETAQALFH | 48867 |
| HPV18 | E1 | 408 | QAKYLKDCATMCKHY | 46771 | YLKDCATMC | 48868 |
| HPV18 | E1 | 70 | QALFHAQEVHNDAQV | 46772 | FHAQEVHND | 48869 |
| HPV18 | E1 | 266 | QPFILYAHIQCLDCK | 46773 | ILYAHIQCL | 48870 |
| HPV18 | E1 | 372 | QWAFDNELTDESDMA | 46774 | FDNELTDES | 48871 |
| HPV18 | E1 | 105 | RLEVDTELSPRLQEI | 46775 | VDTELSPRL | 48872 |
| HPV18 | E1 | 352 | RLTIIQHGIDDSNFD | 46776 | IIQHGIDDS | 48873 |
| HPV18 | E1 | 297 | RLTVAKGLSTLLHVP | 46777 | VAKGLSTLL | 48874 |
| HPV18 | E1 | 547 | RNALDGNPISIDRKH | 46778 | LDGNPISID | 48875 |
| HPV18 | E1 | 130 | RRLFTISDSGYGCSE | 46779 | FTISDSGYG | 48876 |
| HPV18 | E1 | 585 | RWPYLESRITVFEFP | 46780 | YLESRITVF | 48877 |
| HPV18 | E1 | 48 | SDMVDFIDTQGTFCE | 46781 | VDFIDTQGT | 48878 |
| HPV18 | E1 | 516 | SHFWLEPLTDTKVAM | 46782 | WLEPLTDTK | 48879 |
| HPV18 | E1 | 113 | SPRLQEISLNSGQKK | 46783 | LQEISLNSG | 48880 |
| HPV18 | E1 | 433 | SQWIRFRCSKIDEGG | 46784 | IRFRCSKID | 48881 |
| HPV18 | E1 | 305 | STLLHVPETCMLIQP | 46785 | LHVPETCML | 48882 |
| HPV18 | E1 | 248 | TAIFGVNPTIAEGFK | 46786 | FGVNPTIAE | 48883 |
| HPV18 | E1 | 230 | TDLVRNFKSDKTTCT | 46787 | VRNFKSDKT | 48884 |
| HPV18 | E1 | 168 | TEAIDNGGTEGNNSS | 46788 | IDNGGTEGN | 48885 |
| HPV18 | E1 | 346 | TPEWIQRLTIIQHGI | 46789 | WIQRLTIIQ | 48886 |
| HPV18 | E1 | 515 | TSHFWLEPLTDTKVA | 46790 | FWLEPLTDT | 48887 |
| HPV18 | E1 | 536 | TTCWTYFDTYMRNAL | 46791 | WTYFDTYMR | 48888 |
| HPV18 | E1 | 224 | TYGLSFTDLVRNFKS | 46792 | LSFTDLVRN | 48889 |
| HPV18 | E1 | 326 | VAALYWYRTGISNIS | 46793 | LYWYRTGIS | 48890 |
| HPV18 | E1 | 528 | VAMLDDATTTCWTYF | 46794 | LDDATTTCW | 48891 |
| HPV18 | E1 | 51 | VDFIDTQGTFCEQAE | 46795 | IDTQGTFCE | 48892 |
| HPV18 | E1 | 595 | VFEFPNAFPFDKNGN | 46796 | FPNAFPFDK | 48893 |
| HPV18 | E1 | 508 | VISFVNSTSHFWLEP | 46797 | FVNSTSHFW | 48894 |
| HPV18 | E1 | 23 | VQAIVDKKTGDVISD | 46798 | IVDKKTGDV | 48895 |
| HPV18 | E1 | 453 | VQFLRYQQIEFITFL | 46799 | LRYQQIEFI | 48896 |
| HPV18 | E1 | 233 | VRNFKSDKTTCTDWV | 46800 | FKSDKTTCT | 48897 |
| HPV18 | E1 | 247 | VTAIFGVNPTIAEGF | 46801 | IFGVNPTIA | 48898 |
| HPV18 | E1 | 281 | WGVLILALLRYKCGK | 46802 | LILALLRYK | 48899 |
| HPV18 | E1 | 435 | WIRFRCSKIDEGGDW | 46803 | FRCSKIDEG | 48900 |
| HPV18 | E1 | 586 | WPYLESRITVFEFPN | 46804 | LESRITVFE | 48901 |
| HPV18 | E1 | 271 | YAHIQCLDCKWGVLI | 46805 | IQCLDCKWG | 48902 |
| HPV18 | E1 | 389 | YALLADSNSNAAAFL | 46806 | LADSNSNAA | 48903 |
| HPV18 | E2 | 150 | AGTWDKTATCVSHRG | 46807 | WDKTATCVS | 48904 |
| HPV18 | E2 | 240 | AKTYGQTSAATRPGH | 46808 | YGQTSAATR | 48905 |
| HPV18 | E2 | 157 | ATCVSHRGLYYVKEG | 46809 | VSHRGLYYV | 48906 |
| HPV18 | E2 | 68 | AYNISKSKAHKAIEL | 46810 | ISKSKAHKA | 48907 |
| HPV18 | E2 | 105 | CEELWNTEPTHCFKK | 46811 | LWNTEPTHC | 48908 |
| HPV18 | E2 | 183 | CEKYGNTGTWEVHFG | 46812 | YGNTGTWEV | 48909 |
| HPV18 | E2 | 135 | CMTYVAWDSVYYMTD | 46813 | YVAWDSVYY | 48910 |
| HPV18 | E2 | 212 | DDTVSATQLVKQLQH | 46814 | VSATQLVKQ | 48911 |
| HPV18 | E2 | 34 | DSQIQYWQLIRWENA | 46815 | IQYWQLIRW | 48912 |
| HPV18 | E2 | 142 | DSVYYMTDAGTWDKT | 46816 | YYMTDAGTW | 48913 |
| HPV18 | E2 | 106 | EELWNTEPTHCFKKG | 46817 | WNTEPTHCF | 48914 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV18 | E2 | 81 | ELQMALQGLAQSRYK | 46818 | MALQGLAQS | 48915 |
| HPV18 | E2 | 193 | EVHFGNNVIDCNDSM | 46819 | FGNNVIDCN | 48916 |
| HPV18 | E2 | 77 | HKAIELQMALQGLAQ | 46820 | IELQMALQG | 48917 |
| HPV18 | E2 | 63 | HQVVPAYNISKSKAH | 46821 | VPAYNISKS | 48918 |
| HPV18 | E2 | 58 | IQTLNHQVVPAYNIS | 46822 | LNHQVVPAY | 48919 |
| HPV18 | E2 | 169 | KEGYNTFYIEFKSEC | 46823 | YNTFYIEFK | 48920 |
| HPV18 | E2 | 8 | KETLSERLSCVQDKI | 46824 | LSERLSCVQ | 48921 |
| HPV18 | E2 | 350 | LNTVAIPDSVQILVG | 46825 | VAIPDSVQI | 48922 |
| HPV18 | E2 | 15 | LSCVQDKIIDHYEND | 46826 | VQDKIIDHY | 48923 |
| HPV18 | E2 | 136 | MTYVAWDSVYYMTDA | 46827 | VAWDSVYYM | 48924 |
| HPV18 | E2 | 198 | NNVIDCNDSMCSTSD | 46828 | IDCNDSMCS | 48925 |
| HPV18 | E2 | 267 | NPLLGAATPTGNNKR | 46829 | LGAATPTGN | 48926 |
| HPV18 | E2 | 173 | NTFYIEFKSECEKYG | 46830 | YIEFKSECE | 48927 |
| HPV18 | E2 | 228 | PSPYSSTVSVGTAKT | 46831 | YSSTVSVGT | 48928 |
| HPV18 | E2 | 281 | RRKLCSGNTTPIIHL | 46832 | LCSGNTTPI | 48929 |
| HPV18 | E2 | 346 | RTKFLNTVAIPDSVQ | 46833 | FLNTVAIPD | 48930 |
| HPV18 | E2 | 313 | SDHYRDISSTWHWTG | 46834 | YRDISSTWH | 48931 |
| HPV18 | E2 | 232 | SSTVSVGTAKTYGQT | 46835 | VSVGTAKTY | 48932 |
| HPV18 | E2 | 320 | SSTWHWTGAGNEKTG | 46836 | WHWTGAGNE | 48933 |
| HPV18 | E2 | 96 | TEDWTLQDTCEELWN | 46837 | WTLQDTCEE | 48934 |
| HPV18 | E2 | 347 | TKFLNTVAIPDSVQI | 46838 | LNTVAIPDS | 48935 |
| HPV18 | E2 | 234 | TVSVGTAKTYGQTSA | 46839 | VGTAKTYGQ | 48936 |
| HPV18 | E2 | 221 | VKQLQHTPSPYSSTV | 46840 | LQHTPSPYS | 48937 |
| HPV18 | E2 | 266 | VNPLLGAATPTGNNK | 46841 | LLGAATPTG | 48938 |
| HPV18 | E2 | 66 | VPAYNISKSKAHKAI | 46842 | YNISKSKAH | 48939 |
| HPV18 | E2 | 144 | VYYMTDAGTWDKTAT | 46843 | MTDAGTWDK | 48940 |
| HPV18 | E2 | 40 | WQLIRWENAIFFAAR | 46844 | IRWENAIFF | 48941 |
| HPV18 | E5 | 2 | --MLSLIFLFCFCVC | 46845 | LSLIFLFCF | 48942 |
| HPV18 | E5 | 35 | AWVLVFVYIVVITSP | 46846 | LVFVYIVVI | 48943 |
| HPV18 | E5 | 33 | AYAWVLVFVYIVVIT | 46847 | WVLVFVYIV | 48944 |
| HPV18 | E5 | 20 | CCHVPLLPSVCMCAY | 46848 | VPLLPSVCM | 48945 |
| HPV18 | E5 | 12 | CFCVCMYVCCHVPLL | 46849 | VCMYVCCHV | 48946 |
| HPV18 | E5 | 59 | CFLLPMLLLHIHAIL | 46850 | LPMLLLHIH | 48947 |
| HPV18 | E5 | 16 | CMYVCCHVPLLPSVC | 46851 | VCCHVPLLP | 48948 |
| HPV18 | E5 | 58 | FCFLLPMLLLHIHAI | 46852 | LLPMLLLHI | 48949 |
| HPV18 | E5 | 53 | FTVYVFCFLLPMLLL | 46853 | YVFCFLLPM | 48950 |
| HPV18 | E5 | 40 | FVYIVVITSPATAFT | 46854 | IVVITSPAT | 48951 |
| HPV18 | E5 | 22 | HVPLLPSVCMCAYAW | 46855 | LLPSVCMCA | 48952 |
| HPV18 | E5 | 8 | IFLFCFCVCMYVCCH | 46856 | FCFCVCMYV | 48953 |
| HPV18 | E5 | 43 | IVVITSPATAFTVYV | 46857 | ITSPATAFT | 48954 |
| HPV18 | E5 | 7 | LIFLFCFCVCMYVCC | 46858 | LFCFCVCMY | 48955 |
| HPV18 | E5 | 61 | LLPMLLLHIHAILSL | 46859 | MLLLHIHAI | 48956 |
| HPV18 | E5 | 38 | LVFVYIVVITSPATA | 46860 | VYIVVITSP | 48957 |
| HPV18 | E5 | 31 | MCAYAWVLVFVYIVV | 46861 | YAWVLVFVY | 48958 |
| HPV18 | E5 | 64 | MLLLHIHAILSLQ-- | 46862 | LHIHAILSL | 48959 |
| HPV18 | E5 | 4 | MLSLIFLFCFCVCMY | 46863 | LIFLFCFCV | 48960 |
| HPV18 | E5 | 63 | PMLLLHIHAILSLQ- | 46864 | LLHIHAILS | 48961 |
| HPV18 | E5 | 6 | SLIFLFCFCVCMYVC | 46865 | FLFCFCVCM | 48962 |
| HPV18 | E5 | 54 | TVYVFCFLLPMLLLH | 46866 | VFCFLLPML | 48963 |
| HPV18 | E5 | 15 | VCMYVCCHVPLLPSV | 46867 | YVCCHVPLL | 48964 |
| HPV18 | E5 | 57 | VFCFLLPMLLLHIHA | 46868 | FLLPMLLLH | 48965 |
| HPV18 | E5 | 39 | VFVYIVVITSPATAF | 46869 | YIVVITSPA | 48966 |
| HPV18 | E5 | 37 | VLVFVYIVVITSPAT | 46870 | FVYIVVITS | 48967 |
| HPV18 | E5 | 23 | VPLLPSVCMCAYAWV | 46871 | LPSVCMCAY | 48968 |
| HPV18 | E5 | 41 | VYIVVITSPATAFTV | 46872 | VVITSPATA | 48969 |
| HPV18 | E5 | 55 | VYVFCFLLPMLLLHI | 46873 | FCFLLPMLL | 48970 |
| HPV18 | E5 | 36 | WVLVFVYIVVITSPA | 46874 | VFVYIVVIT | 48971 |
| HPV18 | E5 | 42 | YIVVITSPATAFTVY | 46875 | VITSPATAF | 48972 |
| HPV18 | E6 | 30 | DIEITCVYCKTVLEL | 46876 | ITCVYCKTV | 48973 |
| HPV18 | E6 | 54 | DLFVVYRDSIPHAAC | 46877 | VVYRDSIPH | 48974 |
| HPV18 | E6 | 49 | EFAFKDLFVVYRDSI | 46878 | FKDLFVVYR | 48975 |
| HPV18 | E6 | 56 | FVVYRDSIPHAACHK | 46879 | YRDSIPHAA | 48976 |
| HPV18 | E6 | 106 | IRCLRCQKPLNPAEK | 46880 | LRCQKPLNP | 48977 |
| HPV18 | E6 | 33 | ITCVYCKTVLELTEV | 46881 | VYCKTVLEL | 48978 |
| HPV18 | E6 | 39 | KTVLELTEVFEFAFK | 46882 | LELTEVFEF | 48979 |
| HPV18 | E6 | 93 | LEKLTNTGLYNLLIR | 46883 | LTNTGLYNL | 48980 |
| HPV18 | E6 | 55 | LFVVYRDSIPHAACH | 46884 | VYRDSIPHA | 48981 |
| HPV18 | E6 | 28 | LQDIEITCVYCKTVL | 46885 | IEITCVYCK | 48982 |
| HPV18 | E6 | 101 | LYNLLIRCLRCQKPL | 46886 | LLIRCLRCQ | 48983 |
| HPV18 | E6 | 103 | NLLIRCLRCQKPLNP | 46887 | IRCLRCQKP | 48984 |
| HPV18 | E6 | 98 | NTGLYNLLIRCLRCQ | 46888 | LYNLLIRCL | 48985 |
| HPV18 | E6 | 25 | NTSLQDIEITCVYCK | 46889 | LQDIEITCV | 48986 |
| HPV18 | E6 | 14 | PYKLPDLCTELNTSL | 46890 | LPDLCTELN | 48987 |
| HPV18 | E6 | 60 | RDSIPHAACHKCIDF | 46891 | IPHAACHKC | 48988 |
| HPV18 | E6 | 12 | RRPYKLPDLCTELNT | 46892 | YKLPDLCTE | 48989 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV18 | E6 | 85 | SDSVYGDTLEKLTNT | 46893 | VYGDTLEKL | 48990 |
| HPV18 | E6 | 34 | TCVYCKTVLELTEVF | 46894 | YCKTVLELT | 48991 |
| HPV18 | E6 | 47 | VFEFAFKDLFVVYRD | 46895 | FAFKDLFVV | 48992 |
| HPV18 | E7 | 1 | ---MHGPKATLQDIV | 46896 | MHGPKATLQ | 48993 |
| HPV18 | E7 | 89 | FQQLFLNTLSFVCPW | 46897 | LFLNTLSFV | 48994 |
| HPV18 | E7 | 49 | HQHLPARRAEPQRHT | 46898 | LPARRAEPQ | 48995 |
| HPV18 | E7 | 44 | IDGVNHQHLPARRAE | 46899 | VNHQHLPAR | 48996 |
| HPV18 | E7 | 75 | IKLVVESSADDLRAF | 46900 | VVESSADDL | 48997 |
| HPV18 | E7 | 8 | KATLQDIVLHLEPQN | 46901 | LQDIVLHLE | 48998 |
| HPV18 | E7 | 94 | LNTLSFVCPWCASQQ | 46902 | LSFVCPWCA | 48999 |
| HPV18 | E7 | 86 | LRAFQQLFLNTLSFV | 46903 | FQQLFLNTL | 49000 |
| HPV18 | E7 | 97 | LSFVCPWCASQQ--- | 46904 | VCPWCASQQ | 49001 |
| HPV18 | E7 | 12 | QDIVLHLEPQNEIPV | 46905 | VLHLEPQNE | 49002 |
| HPV18 | E7 | 21 | QNEIPVDLLCHEQLS | 46906 | IPVDLLCHE | 49003 |
| HPV18 | E7 | 90 | QQLFLNTLSFVCPWC | 46907 | FLNTLSFVC | 49004 |
| HPV18 | E7 | 61 | RHTMLCMCCKCEARI | 46908 | MLCMCCKCE | 49005 |
| HPV18 | E7 | 74 | RIKLVVESSADDLRA | 46909 | LVVESSADD | 49006 |
| HPV18 | E7 | 96 | TLSFVCPWCASQQ-- | 46910 | FVCPWCASQ | 49007 |
| HPV18 | E7 | 26 | VDLLCHEQLSDSEEE | 46911 | LCHEQLSDS | 49008 |
| HPV18 | L1 | 3 | -MCLYTRVLILHYHL | 46912 | LYTRVLILH | 49009 |
| HPV18 | L1 | 450 | ADVMSYIHSMNSSIL | 46913 | MSYIHSMNS | 49010 |
| HPV18 | L1 | 328 | AGTMGDTVPQSLYIK | 46914 | MGDTVPQSL | 49011 |
| HPV18 | L1 | 226 | APAIGEHWAKGTACK | 46915 | IGEHWAKGT | 49012 |
| HPV18 | L1 | 131 | AYQYRVFRVQLPDPN | 46916 | YRVFRVQLP | 49013 |
| HPV18 | L1 | 45 | CGHYIILFLRNVNVF | 46917 | YIILFLRNV | 49014 |
| HPV18 | L1 | 249 | CPPLELKNTVLEDGD | 46918 | LELKNTVLE | 49015 |
| HPV18 | L1 | 89 | DDYVTPTSIFYHAGS | 46919 | VTPTSIFYH | 49016 |
| HPV18 | L1 | 436 | DLQFIFQLCTITLTA | 46920 | FIFQLCTIT | 49017 |
| HPV18 | L1 | 72 | DNTVYLPPPSVARVV | 46921 | VYLPPPSVA | 49018 |
| HPV18 | L1 | 151 | DTSIYNPETQRLVWA | 46922 | IYNPETQRL | 49019 |
| HPV18 | L1 | 466 | DWNFGVPPPPTTSLV | 46923 | FGVPPPPTT | 49020 |
| HPV18 | L1 | 283 | EVPLDICQSICKYPD | 46924 | LDICQSICK | 49021 |
| HPV18 | L1 | 311 | FFCLRREQLFARHFW | 46925 | LRREQLFAR | 49022 |
| HPV18 | L1 | 62 | FLQMALWRPSDNTVY | 46926 | MALWRPSDN | 49023 |
| HPV18 | L1 | 59 | FPIFLQMALWRPSDN | 46927 | FLQMALWRP | 49024 |
| HPV18 | L1 | 274 | FSTLQDTKCEVPLDI | 46928 | LQDTKCEVP | 49025 |
| HPV18 | L1 | 394 | FVTVVDTTPSTNLTI | 46929 | VVDTTPSTN | 49026 |
| HPV18 | L1 | 230 | GEHWAKGTACKSRPL | 46930 | WAKGTACKS | 49027 |
| HPV18 | L1 | 110 | GNPYFRVPAGGGNKQ | 46931 | YFRVPAGGG | 49028 |
| HPV18 | L1 | 22 | GPLYHPRPLPLHSIL | 46932 | YHPRPLPLH | 49029 |
| HPV18 | L1 | 174 | GQPLGVGLSGHPFYN | 46933 | LGVGLSGHP | 49030 |
| HPV18 | L1 | 351 | GSCVYSPSPSGSIVT | 46934 | VYSPSPSGS | 49031 |
| HPV18 | L1 | 168 | GVEIGRGQPLGVGLS | 46935 | IGRGQPLGV | 49032 |
| HPV18 | L1 | 41 | HIIICGHYIILFLRN | 46936 | ICGHYIILF | 49033 |
| HPV18 | L1 | 390 | HNQLFVTVVDTTPST | 46937 | LFVTVVDTT | 49034 |
| HPV18 | L1 | 440 | IFQLCTITLTADVMS | 46938 | LCTITLTAD | 49035 |
| HPV18 | L1 | 456 | IHSMNSSILEDWNFG | 46939 | MNSSILEDW | 49036 |
| HPV18 | L1 | 50 | ILFLRNVNVFPIFLQ | 46940 | LRNVNVFPI | 49037 |
| HPV18 | L1 | 12 | ILHYHLLPLYGPLYH | 46941 | YHLLPLYGP | 49038 |
| HPV18 | L1 | 35 | ILVYMVHIIICGHYI | 46942 | YMVHIIICG | 49039 |
| HPV18 | L1 | 281 | KCEVPLDICQSICKY | 46943 | VPLDICQSI | 49040 |
| HPV18 | L1 | 146 | KFGLPDTSIYNPETQ | 46944 | LPDTSIYNP | 49041 |
| HPV18 | L1 | 508 | KLKFWNVDLKEKFSL | 46945 | FWNVDLKEK | 49042 |
| HPV18 | L1 | 123 | KQDIPKVSAYQYRVF | 46946 | IPKVSAYQY | 49043 |
| HPV18 | L1 | 220 | LCILGCAPAIGEHWA | 46947 | LGCAPAIGE | 49044 |
| HPV18 | L1 | 464 | LEDWNFGVPPPPTTS | 46948 | WNFGVPPPP | 49045 |
| HPV18 | L1 | 32 | LHSILVYMVHIIICG | 46949 | ILVYMVHII | 49046 |
| HPV18 | L1 | 437 | LQFIFQLCTITLTAD | 46950 | IFQLCTITL | 49047 |
| HPV18 | L1 | 53 | LRNVNVFPIFLQMAL | 46951 | VNVFPIFLQ | 49048 |
| HPV18 | L1 | 36 | LVYMVHIIICGHYII | 46952 | MVHIIICGH | 49049 |
| HPV18 | L1 | 4 | MCLYTRVLILHYHLL | 46953 | YTRVLILHY | 49050 |
| HPV18 | L1 | 453 | MSYIHSMNSSILEDW | 46954 | IHSMNSSIL | 49051 |
| HPV18 | L1 | 468 | NFGVPPPPTTSLVDT | 46955 | VPPPPTTSL | 49052 |
| HPV18 | L1 | 372 | NKPYWLHKAQGHNNG | 46956 | YWLHKAQGH | 49053 |
| HPV18 | L1 | 256 | NTVLEDGDMVDTGYG | 46957 | LEDGDMVDT | 49054 |
| HPV18 | L1 | 73 | NTVYLPPPSVARVVN | 46958 | YLPPPSVAR | 49055 |
| HPV18 | L1 | 513 | NVDLKEKFSLDLDQY | 46959 | LKEKFSLDL | 49056 |
| HPV18 | L1 | 55 | NVNVFPIFLQMALWR | 46960 | VFPIFLQMA | 49057 |
| HPV18 | L1 | 210 | NVSVDYKQTQLCILG | 46961 | VDYKQTQLC | 49058 |
| HPV18 | L1 | 285 | PLDICQSICKYPDYL | 46962 | ICQSICKYP | 49059 |
| HPV18 | L1 | 251 | PLELKNTVLEDGDMV | 46963 | LKNTVLEDG | 49060 |
| HPV18 | L1 | 29 | PLPLHSILVYMVHII | 46964 | LHSILVYMV | 49061 |
| HPV18 | L1 | 144 | PNKFGLPDTSIYNPE | 46965 | FGLPDTSIY | 49062 |
| HPV18 | L1 | 336 | PQSLYIKGTGMPASP | 46966 | LYIKGTGMP | 49063 |
| HPV18 | L1 | 27 | PRPLPLHSILVYMVH | 46967 | LPLHSILVY | 49064 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV18 | L1 | 536 | QAGLRRKPTIGPRKR | 46968 | LRRKPTIGP | 49065 |
| HPV18 | L1 | 438 | QFIFQLCTITLTADV | 46969 | FQLCTITLT | 49066 |
| HPV18 | L1 | 219 | QLCILGCAPAIGEHW | 46970 | ILGCAPAIG | 49067 |
| HPV18 | L1 | 392 | QLFVTVVDTTPSTNL | 46971 | VTVVDTTPS | 49068 |
| HPV18 | L1 | 217 | QTQLCILGCAPAIGE | 46972 | LCILGCAPA | 49069 |
| HPV18 | L1 | 526 | QYPLGRKFLVQAGLR | 46973 | LGRKFLVQA | 49070 |
| HPV18 | L1 | 133 | QYRVFRVQLPDPNKF | 46974 | VFRVQLPDP | 49071 |
| HPV18 | L1 | 322 | RHFWNRAGTMGDTVP | 46975 | WNRAGTMGD | 49072 |
| HPV18 | L1 | 531 | RKFLVQAGLRRKPTI | 46976 | LVQAGLRRK | 49073 |
| HPV18 | L1 | 161 | RLVWACAGVEIGRGQ | 46977 | WACAGVEIG | 49074 |
| HPV18 | L1 | 9 | RVLILHYHLLPLYGP | 46978 | ILHYHLLPL | 49075 |
| HPV18 | L1 | 352 | SCVYSPSPSGSIVTS | 46979 | YSPSPSGSI | 49076 |
| HPV18 | L1 | 204 | SEDVRDNVSVDYKQT | 46980 | VRDNVSVDY | 49077 |
| HPV18 | L1 | 360 | SGSIVTSDSQLFNKP | 46981 | IVTSDSQLF | 49078 |
| HPV18 | L1 | 96 | SIFYHAGSSRLLTVG | 46982 | YHAGSSRLL | 49079 |
| HPV18 | L1 | 34 | SILVYMVHIIICGHY | 46983 | VYMVHIIIC | 49080 |
| HPV18 | L1 | 521 | SLDLDQYPLGRKFLV | 46984 | LDQYPLGRK | 49081 |
| HPV18 | L1 | 338 | SLYIKGTGMPASPGS | 46985 | IKGTGMPAS | 49082 |
| HPV18 | L1 | 429 | SRHVEEYDLQFIFQL | 46986 | VEEYDLQFI | 49083 |
| HPV18 | L1 | 104 | SRLLTVGNPYFRVPA | 46987 | LTVGNPYFR | 49084 |
| HPV18 | L1 | 241 | SRPLSQGDCPPLELK | 46988 | LSQGDCPPL | 49085 |
| HPV18 | L1 | 403 | STNLTICASTQSPVP | 46989 | LTICASTQS | 49086 |
| HPV18 | L1 | 212 | SVDYKQTQLCILGCA | 46990 | YKQTQLCIL | 49087 |
| HPV18 | L1 | 88 | TDDYVTPTSIFYHAG | 46991 | YVTPTSIFY | 49088 |
| HPV18 | L1 | 445 | TITLTADVMSYIHSM | 46992 | LTADVMSYI | 49089 |
| HPV18 | L1 | 159 | TQRLVWACAGVEIGR | 46993 | LVWACAGVE | 49090 |
| HPV18 | L1 | 95 | TSIFYHAGSSRLLTV | 46994 | FYHAGSSRL | 49091 |
| HPV18 | L1 | 74 | TVYLPPPSVARVVNT | 46995 | LPPPSVARV | 49092 |
| HPV18 | L1 | 482 | TYRFVQSVAITCQKD | 46996 | FVQSVAITC | 49093 |
| HPV18 | L1 | 480 | VDTYRFVQSVAITCQ | 46997 | YRFVQSVAI | 49094 |
| HPV18 | L1 | 432 | VEEYDLQFIFQLCTI | 46998 | YDLQFIFQL | 49095 |
| HPV18 | L1 | 58 | VFPIFLQMALWRPSD | 46999 | IFLQMALWR | 49096 |
| HPV18 | L1 | 136 | VFRVQLPDPNKFGLP | 47000 | VQLPDPNKF | 49097 |
| HPV18 | L1 | 10 | VLILHYHLLPLYGPL | 47001 | LHYHLLPLY | 49098 |
| HPV18 | L1 | 395 | VTVVDTTPSTNLTIC | 47002 | VDTTPSTNL | 49099 |
| HPV18 | L1 | 37 | VYMVHIIICGHYIIL | 47003 | VHIIICGHY | 49100 |
| HPV18 | L1 | 506 | YDKLKFWNVDLKEKF | 47004 | LKFWNVDLK | 49101 |
| HPV18 | L1 | 269 | YGAMDFSTLQDTKCE | 47005 | MDFSTLQDT | 49102 |
| HPV18 | L1 | 21 | YGPLYHPRPLPLHSI | 47006 | LYHPRPLPL | 49103 |
| HPV18 | L1 | 15 | YHLLPLYGPLYHPRP | 47007 | LPLYGPLYH | 49104 |
| HPV18 | L1 | 48 | YIILFLRNVNVFPIF | 47008 | LFLRNVNVF | 49105 |
| HPV18 | L1 | 187 | YNKLDDTESSHAATS | 47009 | LDDTESSHA | 49106 |
| HPV18 | L1 | 295 | YPDYLQMSADPYGDS | 47010 | YLQMSADPY | 49107 |
| HPV18 | L1 | 483 | YRFVQSVAITCQKDA | 47011 | VQSVAITCQ | 49108 |
| HPV18 | L1 | 134 | YRVFRVQLPDPNKFG | 47012 | FRVQLPDPN | 49109 |
| HPV18 | L2 | 1 | ---MVSHRAARRKRA | 47013 | MVSHRAARR | 49110 |
| HPV18 | L2 | 2 | --MVSHRAARRKRAS | 47014 | VSHRAARRK | 49111 |
| HPV18 | L2 | 355 | ADDMDPAVPVPSRST | 47015 | MDPAVPVPS | 49112 |
| HPV18 | L2 | 44 | ADKILQWSSLGIFLG | 47016 | ILQWSSLGI | 49113 |
| HPV18 | L2 | 180 | AGNVFVGTPTSGTHG | 47017 | VFVGTPTSG | 49114 |
| HPV18 | L2 | 384 | ASSYSNVTVPLTSSW | 47018 | YSNVTVPLT | 49115 |
| HPV18 | L2 | 306 | ATMFTRSGTQIGARV | 47019 | FTRSGTQIG | 49116 |
| HPV18 | L2 | 361 | AVPVPSRSTTSFAFF | 47020 | VPSRSTTSF | 49117 |
| HPV18 | L2 | 407 | DITLPSTTSVWPIVS | 47021 | LPSTTSVWP | 49118 |
| HPV18 | L2 | 45 | DKILQWSSLGIFLGG | 47022 | LQWSSLGIF | 49119 |
| HPV18 | L2 | 347 | DNDLFDIYADDMDPA | 47023 | LFDIYADDM | 49120 |
| HPV18 | L2 | 112 | DSSVVTSGAPRPTFT | 47024 | VVTSGAPRP | 49121 |
| HPV18 | L2 | 210 | EEPISSTPLPTVRRV | 47025 | ISSTPLPTV | 49122 |
| HPV18 | L2 | 197 | EIPLQTFASSGTEEE | 47026 | LQTFASSGT | 49123 |
| HPV18 | L2 | 372 | FAFFKYSPTISSASS | 47027 | FKYSPTISS | 49124 |
| HPV18 | L2 | 259 | FEPVDTTLTFDPRSD | 47028 | VDTTLTFDP | 49125 |
| HPV18 | L2 | 374 | FFKYSPTISSASSYS | 47029 | YSPTISSAS | 49126 |
| HPV18 | L2 | 299 | FSRLGQRATMFTRSG | 47030 | LGQRATMFT | 49127 |
| HPV18 | L2 | 130 | GFDITSAGTTTPAVL | 47031 | ITSAGTTTP | 49128 |
| HPV18 | L2 | 54 | GIFLGGLGIGTGSGT | 47032 | LGGLGIGTG | 49129 |
| HPV18 | L2 | 181 | GNVFVGTPTSGTHGY | 47033 | FVGTPTSGT | 49130 |
| HPV18 | L2 | 405 | GPDITLPSTTSVWPI | 47034 | ITLPSTTSV | 49131 |
| HPV18 | L2 | 435 | GTHYYLWPLYYFIPK | 47035 | YYLWPLYYF | 49132 |
| HPV18 | L2 | 40 | GTTLADKILQWSSLG | 47036 | LADKILQWS | 49133 |
| HPV18 | L2 | 96 | IEPVGPTDPSIVTLI | 47037 | VGPTDPSIV | 49134 |
| HPV18 | L2 | 282 | IIRLHRPALTSRRGT | 47038 | LHRPALTSR | 49135 |
| HPV18 | L2 | 47 | ILQWSSLGIFLGGLG | 47039 | WSSLGIFLG | 49136 |
| HPV18 | L2 | 106 | IVTLIEDSSVVTSGA | 47040 | LIEDSSVVT | 49137 |
| HPV18 | L2 | 350 | LFDIYADDMDPAVPV | 47041 | IYADDMDPA | 49138 |
| HPV18 | L2 | 200 | LQTFASSGTEEPIS | 47042 | FASSGTEE | 49139 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV18 | L2 | 440 | LWPLYYFIPKKRKRV | 47043 | LYYFIPKKR | 49140 |
| HPV18 | L2 | 280 | MDIIRLHRPALTSRR | 47044 | IRLHRPALT | 49141 |
| HPV18 | L2 | 256 | NPAFEPVDTTLTFDP | 47045 | FEPVDTTLT | 49142 |
| HPV18 | L2 | 162 | NPAFSDPSIIEVPQT | 47046 | FSDPSIIEV | 49143 |
| HPV18 | L2 | 241 | NPEFLTRPSSLITYD | 47047 | FLTRPSSLI | 49144 |
| HPV18 | L2 | 82 | NTVVDVGPTRPPVVI | 47048 | VDVGPTRPP | 49145 |
| HPV18 | L2 | 182 | NVFVGTPTSGTHGYE | 47049 | VGTPTSGTH | 49146 |
| HPV18 | L2 | 389 | NVTVPLTSSWDVPVY | 47050 | VPLTSSWDV | 49147 |
| HPV18 | L2 | 141 | PAVLDITPSSTSVSI | 47051 | LDITPSSTS | 49148 |
| HPV18 | L2 | 242 | PEFLTRPSSLITYDN | 47052 | LTRPSSLIT | 49149 |
| HPV18 | L2 | 333 | PEYIELQPLVSATED | 47053 | IELQPLVSA | 49150 |
| HPV18 | L2 | 168 | PSIIEVPQTGEVAGN | 47054 | IEVPQTGEV | 49151 |
| HPV18 | L2 | 93 | PVVIEPVGPTDPSIV | 47055 | IEPVGPTDP | 49152 |
| HPV18 | L2 | 294 | RGTVRFSRLGQRATM | 47056 | VRFSRLGQR | 49153 |
| HPV18 | L2 | 451 | RKRVPYFFADGFVAA | 47057 | VPYFFADGF | 49154 |
| HPV18 | L2 | 91 | RPPVVIEPVGPTDPS | 47058 | VVIEPVGPT | 49155 |
| HPV18 | L2 | 319 | RVHFYHDISPIAPSP | 47059 | FYHDISPIA | 49156 |
| HPV18 | L2 | 277 | SDFMDIIRLHRPALT | 47060 | MDIIRLHRP | 49157 |
| HPV18 | L2 | 371 | SFAFFKYSPTISSAS | 47061 | FFKYSPTIS | 49158 |
| HPV18 | L2 | 52 | SLGIFLGGLGIGTGS | 47062 | IFLGGLGIG | 49159 |
| HPV18 | L2 | 81 | SNTVVDVGPTRPPVV | 47063 | VVDVGPTRP | 49160 |
| HPV18 | L2 | 332 | SPEYIELQPLVSATE | 47064 | YIELQPLVS | 49161 |
| HPV18 | L2 | 378 | SPTISSASSYSNVTV | 47065 | ISSASSYSN | 49162 |
| HPV18 | L2 | 231 | SRAYQQVSVANPEFL | 47066 | YQQVSVANP | 49163 |
| HPV18 | L2 | 249 | SSLITYDNPAFEPVD | 47067 | ITYDNPAFE | 49164 |
| HPV18 | L2 | 113 | SSVVTSGAPRPTFTG | 47068 | VTSGAPRPT | 49165 |
| HPV18 | L2 | 150 | STSVSISTTNFTNPA | 47069 | VSISTTNFT | 49166 |
| HPV18 | L2 | 192 | THGYEEIPLQTFASS | 47070 | YEEIPLQTF | 49167 |
| HPV18 | L2 | 140 | TPAVLDITPSSTSVS | 47071 | VLDITPSST | 49168 |
| HPV18 | L2 | 428 | TQYIGIHGTHYYLWP | 47072 | IGIHGTHYY | 49169 |
| HPV18 | L2 | 128 | TSGFDITSAGTTTPA | 47073 | FDITSAGTT | 49170 |
| HPV18 | L2 | 414 | TSVWPIVSPTAPAST | 47074 | WPIVSPTAP | 49171 |
| HPV18 | L2 | 413 | TTSVWPIVSPTAPAS | 47075 | VWPIVSPTA | 49172 |
| HPV18 | L2 | 320 | VHFYHDISPIAPSPE | 47076 | YHDISPIAP | 49173 |
| HPV18 | L2 | 143 | VLDITPSSTSVSIST | 47077 | ITPSSTSVS | 49174 |
| HPV18 | L2 | 35 | VPKVEGTTLADKILQ | 47078 | VEGTTLADK | 49175 |
| HPV18 | L2 | 400 | VPVYTGPDITLPSTT | 47079 | YTGPDITLP | 49176 |
| HPV18 | L2 | 221 | VRRVAGPRLYSRAYQ | 47080 | VAGPRLYSR | 49177 |
| HPV18 | L2 | 107 | VTLIEDSSVVTSGAP | 47081 | IEDSSVVTS | 49178 |
| HPV18 | L2 | 84 | VVDVGPTRPPVVIEP | 47082 | VGPTRPPVV | 49179 |
| HPV18 | L2 | 416 | VWPIVSPTAPASTQY | 47083 | IVSPTAPAS | 49180 |
| HPV18 | L2 | 417 | WPIVSPTAPASTQYI | 47084 | VSPTAPAST | 49181 |
| HPV18 | L2 | 323 | YHDISPIAPSPEYIE | 47085 | ISPIAPSPE | 49182 |
| HPV18 | L2 | 335 | YIELQPLVSATEDND | 47086 | LQPLVSATE | 49183 |
| HPV18 | L2 | 234 | YQQVSVANPEFLTRP | 47087 | VSVANPEFL | 49184 |
| HPV18 | L2 | 387 | YSNVTVPLTSSWDVP | 47088 | VTVPLTSSW | 49185 |
| HPV31 | E1 | 299 | AAALYWYRTGMSNIS | 47089 | LYWYRTGMS | 49186 |
| HPV31 | E1 | 372 | ACAFLKSNSQAKIVK | 47090 | FLKSNSQAK | 49187 |
| HPV31 | E1 | 251 | ACSWGMVMLMLVRFK | 47091 | WGMVMLMLV | 49188 |
| HPV31 | E1 | 223 | AFGVTGTVAEGFKTL | 47092 | VTGTVAEGF | 49189 |
| HPV31 | E1 | 382 | AKIVKDCGTMCRHYK | 47093 | VKDCGTMCR | 49190 |
| HPV31 | E1 | 442 | ALKLFLKGVPKKNCI | 47094 | LFLKGVPKK | 49191 |
| HPV31 | E1 | 301 | ALYWYRTGMSNISDV | 47095 | WYRTGMSNI | 49192 |
| HPV31 | E1 | 287 | CMLIQPPKLRSTAAA | 47096 | IQPPKLRST | 49193 |
| HPV31 | E1 | 17 | CNGWFYVEAVIDRQT | 47097 | WFYVEAVID | 49194 |
| HPV31 | E1 | 511 | CWHYIDNYLRNALDG | 47098 | YIDNYLRNA | 49195 |
| HPV31 | E1 | 556 | DDRWPYLHSRLVVFT | 47099 | WPYLHSRLV | 49196 |
| HPV31 | E1 | 589 | DKNWKSFFSRTWCRL | 47100 | WKSFFSRTW | 49197 |
| HPV31 | E1 | 355 | DSEIAYKYAQLADSD | 47101 | IAYKYAQLA | 49198 |
| HPV31 | E1 | 133 | DSGYGNTEVETQQMV | 47102 | YGNTEVETQ | 49199 |
| HPV31 | E1 | 335 | DTTFDLSQMVQWAYD | 47103 | FDLSQMVQW | 49200 |
| HPV31 | E1 | 218 | DWCVAAFGVTGTVAE | 47104 | VAAFGVTGT | 49201 |
| HPV31 | E1 | 357 | EIAYKYAQLADSDSN | 47105 | YKYAQLADS | 49202 |
| HPV31 | E1 | 274 | EKLLEKLLCISTNCM | 47106 | LEKLLCIST | 49203 |
| HPV31 | E1 | 621 | FKCVSGQNIRTL--- | 47107 | VSGQNIRTL | 49204 |
| HPV31 | E1 | 234 | FKTLLQPYCLYCHLQ | 47108 | LLQPYCLYC | 49205 |
| HPV31 | E1 | 479 | GCIISYANSKSHFWL | 47109 | ISYANSKSH | 49206 |
| HPV31 | E1 | 615 | GDSFSTFKCVSGQNI | 47110 | FSTFKCVSG | 49207 |
| HPV31 | E1 | 465 | GKSYFGMSLISFLQG | 47111 | YFGMSLISF | 49208 |
| HPV31 | E1 | 94 | GSPLSDISSCVDYNI | 47112 | LSDISSCVD | 49209 |
| HPV31 | E1 | 19 | GWFYVEAVIDRQTGD | 47113 | YVEAVIDRQ | 49210 |
| HPV31 | E1 | 534 | HKALMQLKCPPLLIT | 47114 | LMQLKCPPL | 49211 |
| HPV31 | E1 | 515 | IDNYLRNALDGNPVS | 47115 | YLRNALDGN | 49212 |
| HPV31 | E1 | 434 | IEFVSFLSALKLFLK | 47116 | VSFLSALKL | 49213 |
| HPV31 | E1 | 273 | IEKLLEKLLCISTNC | 47117 | LLEKLLCIS | 49214 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV31 | E1 | 501 | IGMLDDATTPCWHYI | 47118 | LDDATTPCW | 49215 |
| HPV31 | E1 | 481 | IISYANSKSHFWLQP | 47119 | YANSKSHFW | 49216 |
| HPV31 | E1 | 206 | IRPFQSNKSTCTDWC | 47120 | FQSNKSTCT | 49217 |
| HPV31 | E1 | 312 | ISDVYGETPEWIERQ | 47121 | VYGETPEWI | 49218 |
| HPV31 | E1 | 474 | ISFLQGCIISYANSK | 47122 | LQGCIISYA | 49219 |
| HPV31 | E1 | 535 | KALMQLKCPPLLITS | 47123 | MQLKCPPLL | 49220 |
| HPV31 | E1 | 195 | KELYGVSFMELIRPF | 47124 | YGVSFMELI | 49221 |
| HPV31 | E1 | 500 | KIGMLDDATTPCWHY | 47125 | MLDDATTPC | 49222 |
| HPV31 | E1 | 453 | KNCILIHGAPNTGKS | 47126 | ILIHGAPNT | 49223 |
| HPV31 | E1 | 268 | KNRITIEKLLEKLLC | 47127 | ITIEKLLEK | 49224 |
| HPV31 | E1 | 89 | KRKYVGSPLSDISSC | 47128 | YVGSPLSDI | 49225 |
| HPV31 | E1 | 593 | KSFFSRTWCRLNLHE | 47129 | FSRTWCRLN | 49226 |
| HPV31 | E1 | 488 | KSHFWLQPLADAKIG | 47130 | FWLQPLADA | 49227 |
| HPV31 | E1 | 466 | KSYFGMSLISFLQGC | 47131 | FGMSLISFL | 49228 |
| HPV31 | E1 | 235 | KTLLQPYCLYCHLQS | 47132 | LQPYCLYCH | 49229 |
| HPV31 | E1 | 277 | LEKLLCISTNCMLIQ | 47133 | LLCISTNCM | 49230 |
| HPV31 | E1 | 473 | LISFLQGCIISYANS | 47134 | FLQGCIISY | 49231 |
| HPV31 | E1 | 447 | LKGVPKKNCILIHGA | 47135 | VPKKNCILI | 49232 |
| HPV31 | E1 | 443 | LKLFLKGVPKKNCIL | 47136 | FLKGVPKKN | 49233 |
| HPV31 | E1 | 280 | LLCISTNCMLIQPPK | 47137 | ISTNCMLIQ | 49234 |
| HPV31 | E1 | 259 | LMLVRFKCAKNRITI | 47138 | VRFKCAKNR | 49235 |
| HPV31 | E1 | 537 | LMQLKCPPLLITSNI | 47139 | LKCPPLLIT | 49236 |
| HPV31 | E1 | 493 | LQPLADAKIGMLDDA | 47140 | LADAKIGML | 49237 |
| HPV31 | E1 | 566 | LVVFTFPNPFPFDKN | 47141 | FTFPNPFPF | 49238 |
| HPV31 | E1 | 197 | LYGVSFMELIRPFQS | 47142 | VSFMELIRP | 49239 |
| HPV31 | E1 | 302 | LYWYRTGMSNISDVY | 47143 | YRTGMSNIS | 49240 |
| HPV31 | E1 | 203 | MELIRPFQSNKSTCT | 47144 | IRPFQSNKS | 49241 |
| HPV31 | E1 | 405 | MGQWIKSRCDKVSDE | 47145 | WIKSRCDKV | 49242 |
| HPV31 | E1 | 258 | MLMLVRFKCAKNRIT | 47146 | LVRFKCAKN | 49243 |
| HPV31 | E1 | 146 | MVQVEEQQTTLSCNG | 47147 | VEEQQTTLS | 49244 |
| HPV31 | E1 | 454 | NCILIHGAPNTGKSY | 47148 | LIHGAPNTG | 49245 |
| HPV31 | E1 | 56 | NCNVYNNQAEAETAQ | 47149 | VYNNQAEAE | 49246 |
| HPV31 | E1 | 350 | NDVMDDSEIAYKYAQ | 47150 | MDDSEIAYK | 49247 |
| HPV31 | E1 | 18 | NGWFYVEAVIDRQTG | 47151 | FYVEAVIDR | 49248 |
| HPV31 | E1 | 138 | NTEVETQQMVQVEEQ | 47152 | VETQQMVQV | 49249 |
| HPV31 | E1 | 320 | PEWIERQTVLQHSFN | 47153 | IERQTVLQH | 49250 |
| HPV31 | E1 | 292 | PPKLRSTAAALYWYR | 47154 | LRSTAAALY | 49251 |
| HPV31 | E1 | 543 | PPLLITSNINAGKDD | 47155 | LITSNINAG | 49252 |
| HPV31 | E1 | 70 | QALFHAQEAEEHAEA | 47156 | FHAQEAEEH | 49253 |
| HPV31 | E1 | 433 | QIEFVSFLSALKLFL | 47157 | FVSFLSALK | 49254 |
| HPV31 | E1 | 153 | QTTLSCNGSDGTHSE | 47158 | LSCNGSDGT | 49255 |
| HPV31 | E1 | 345 | QWAYDNDVMDDSEIA | 47159 | YDNDVMDDS | 49256 |
| HPV31 | E1 | 90 | RKYVGSPLSDISSCV | 47160 | VGSPLSDIS | 49257 |
| HPV31 | E1 | 520 | RNALDGNPVSIDVKH | 47161 | LDGNPVSID | 49258 |
| HPV31 | E1 | 175 | RNILQVLKTSNGKAA | 47162 | LQVLKTSNG | 49259 |
| HPV31 | E1 | 126 | RRLFELPDSGYGNTE | 47163 | FELPDSGYG | 49260 |
| HPV31 | E1 | 558 | RWPYLHSRLVVFTFP | 47164 | YLHSRLVVF | 49261 |
| HPV31 | E1 | 489 | SHFWLQPLADAKIGM | 47165 | WLQPLADAK | 49262 |
| HPV31 | E1 | 529 | SIDVKHKALMQLKCP | 47166 | VKHKALMQL | 49263 |
| HPV31 | E1 | 109 | SPRLKAICIENNSKT | 47167 | LKAICIENN | 49264 |
| HPV31 | E1 | 564 | SRLVVFTFPNPFPFD | 47168 | VVFTFPNPF | 49265 |
| HPV31 | E1 | 597 | SRTWCRLNLHEEEDK | 47169 | WCRLNLHEE | 49266 |
| HPV31 | E1 | 101 | SSCVDYNISPRLKAI | 47170 | VDYNISPRL | 49267 |
| HPV31 | E1 | 253 | SWGMVMLMLVRFKCA | 47171 | MVMLMLVRF | 49268 |
| HPV31 | E1 | 285 | TNCMLIQPPKLRSTA | 47172 | MLIQPPKLR | 49269 |
| HPV31 | E1 | 319 | TPEWIERQTVLQHSF | 47173 | WIERQTVLQ | 49270 |
| HPV31 | E1 | 221 | VAAFGVTGTVAEGFK | 47174 | FGVTGTVAE | 49271 |
| HPV31 | E1 | 51 | VDFIDNCNVYNNQAE | 47175 | IDNCNVYNN | 49272 |
| HPV31 | E1 | 23 | VEAVIDRQTGDNISE | 47176 | VIDRQTGDN | 49273 |
| HPV31 | E1 | 568 | VFTFPNPFPFDKNGN | 47177 | FPNPFPFDK | 49274 |
| HPV31 | E1 | 426 | VKFLRYQQIEFVSFL | 47178 | LRYQQIEFV | 49275 |
| HPV31 | E1 | 85 | VQVLKRKYVGSPLSD | 47179 | LKRKYVGSP | 49276 |
| HPV31 | E1 | 437 | VSFLSALKLFLKGVP | 47180 | LSALKLFLK | 49277 |
| HPV31 | E1 | 200 | VSFMELIRPFQSNKS | 47181 | MELIRPFQS | 49278 |
| HPV31 | E1 | 254 | WGMVMLMLVRFKCAK | 47182 | VMLMLVRFK | 49279 |
| HPV31 | E1 | 559 | WPYLHSRLVVFTFPN | 47183 | LHSRLVVFT | 49280 |
| HPV31 | E1 | 362 | YAQLADSDSNACAFL | 47184 | LADSDSNAC | 49281 |
| HPV31 | E1 | 244 | YCHLQSLACSWGMVM | 47185 | LQSLACSWG | 49282 |
| HPV31 | E1 | 241 | YCLYCHLQSLACSWG | 47186 | YCHLQSLAC | 49283 |
| HPV31 | E2 | 211 | AGIVTKLPTANNTTT | 47187 | VTKLPTANN | 49284 |
| HPV31 | E2 | 70 | AKALQAIELQMMLET | 47188 | LQAIELQMM | 49285 |
| HPV31 | E2 | 64 | ALSVSKAKALQAIEL | 47189 | VSKAKALQA | 49286 |
| HPV31 | E2 | 49 | AREMGIHSINHQVVP | 47190 | MGIHSINHQ | 49287 |
| HPV31 | E2 | 275 | CGVISAAACTNQTRA | 47191 | ISAAACTNQ | 49288 |
| HPV31 | E2 | 354 | DDFLNTVKIPNTVSV | 47192 | LNTVKIPNT | 49289 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV31 | E2 | 94 | DWTMQQTSLELYLTA | 47193 | MQQTSLELY | 49290 |
| HPV31 | E2 | 152 | EGQVNCKGIYYVHEG | 47194 | VNCKGIYYV | 49291 |
| HPV31 | E2 | 207 | EISFAGIVTKLPTAN | 47195 | FAGIVTKLP | 49292 |
| HPV31 | E2 | 77 | ELQMMLETLNNTEYK | 47196 | MMLETLNNT | 49293 |
| HPV31 | E2 | 200 | ESVFSSDEISFAGIV | 47197 | FSSDEISFA | 49294 |
| HPV31 | E2 | 210 | FAGIVTKLPTANNTT | 47198 | IVTKLPTAN | 49295 |
| HPV31 | E2 | 267 | GDSVDSVNCGVISAA | 47199 | VDSVNCGVI | 49296 |
| HPV31 | E2 | 193 | GQVIVFPESVFSSDE | 47200 | IVFPESVFS | 49297 |
| HPV31 | E2 | 38 | HIRLECVLMYKAREM | 47201 | LECVLMYKA | 49298 |
| HPV31 | E2 | 167 | HITYFVNFTEEAKKY | 47202 | YFVNFTEEA | 49299 |
| HPV31 | E2 | 59 | HQVVPALSVSKAKAL | 47203 | VPALSVSKA | 49300 |
| HPV31 | E2 | 33 | IDYWKHIRLECVLMY | 47204 | WKHIRLECV | 49301 |
| HPV31 | E2 | 54 | IHSINHQVVPALSVS | 47205 | INHQVVPAL | 49302 |
| HPV31 | E2 | 342 | IVTLTYISTSQRDDF | 47206 | LTYISTSQR | 49303 |
| HPV31 | E2 | 160 | IYYVHEGHITYFVNF | 47207 | VHEGHITYF | 49304 |
| HPV31 | E2 | 319 | KQLYEQVSSTWHWTC | 47208 | YEQVSSTWH | 49305 |
| HPV31 | E2 | 41 | LECVLMYKAREMGIH | 47209 | VLMYKAREM | 49306 |
| HPV31 | E2 | 102 | LELYLTAPTGCLKKH | 47210 | YLTAPTGCL | 49307 |
| HPV31 | E2 | 308 | LKCLRYRLSKYKQLY | 47211 | LRYRLSKYK | 49308 |
| HPV31 | E2 | 357 | LNTVKIPNTVSVSTG | 47212 | VKIPNTVSV | 49309 |
| HPV31 | E2 | 73 | LQAIELQMMLETLNN | 47213 | IELQMMLET | 49310 |
| HPV31 | E2 | 340 | NAIVTLTYISTSQRD | 47214 | VTLTYISTS | 49311 |
| HPV31 | E2 | 274 | NCGVISAAACTNQTR | 47215 | VISAAACTN | 49312 |
| HPV31 | E2 | 92 | NEDWTMQQTSLELYL | 47216 | WTMQQTSLE | 49313 |
| HPV31 | E2 | 58 | NHQVVPALSVSKAKA | 47217 | VVPALSVSK | 49314 |
| HPV31 | E2 | 262 | NKLLRGDSVDSVNCG | 47218 | LRGDSVDSV | 49315 |
| HPV31 | E2 | 136 | NWKFIYLCIDGQCTV | 47219 | FIYLCIDGQ | 49316 |
| HPV31 | E2 | 261 | PNKLLRGDSVDSVNC | 47220 | LLRGDSVDS | 49317 |
| HPV31 | E2 | 147 | QCTVVEGQVNCKGIY | 47221 | VVEGQVNCK | 49318 |
| HPV31 | E2 | 99 | QTSLELYLTAPTGCL | 47222 | LELYLTAPT | 49319 |
| HPV31 | E2 | 194 | QVIVFPESVFSSDEI | 47223 | VFPESVFSS | 49320 |
| HPV31 | E2 | 10 | RLNVCQDKILEHYEN | 47224 | VCQDKILEH | 49321 |
| HPV31 | E2 | 205 | SDEISFAGIVTKLPT | 47225 | ISFAGIVTK | 49322 |
| HPV31 | E2 | 236 | SEGVRRATTSTKRPR | 47226 | VRRATTSTK | 49323 |
| HPV31 | E2 | 101 | SLELYLTAPTGCLKK | 47227 | LYLTAPTGC | 49324 |
| HPV31 | E2 | 326 | SSTWHWTCTDGKHKN | 47228 | WHWTCTDGK | 49325 |
| HPV31 | E2 | 287 | TRAVSCPATTPIIHL | 47229 | VSCPATTPI | 49326 |
| HPV31 | E2 | 359 | TVKIPNTVSVSTGYM | 47230 | IPNTVSVST | 49327 |
| HPV31 | E2 | 270 | VDSVNCGVISAAACT | 47231 | VNCGVISAA | 49328 |
| HPV31 | E2 | 44 | VLMYKAREMGIHSIN | 47232 | YKAREMGIH | 49329 |
| HPV31 | E2 | 62 | VPALSVSKAKALQAI | 47233 | LSVSKAKAL | 49330 |
| HPV31 | E2 | 36 | WKHIRLECVLMYKAR | 47234 | IRLECVLMY | 49331 |
| HPV31 | E2 | 318 | YKQLYEQVSSTWHWT | 47235 | LYEQVSSTW | 49332 |
| HPV31 | E2 | 141 | YLCIDGQCTVVEGQV | 47236 | IDGQCTVVE | 49333 |
| HPV31 | E2 | 134 | YTNWKFIYLCIDGQC | 47237 | WKFIYLCID | 49334 |
| HPV31 | E5 | 1 | ---MIELNISTVSIV | 47238 | MIELNISTV | 49335 |
| HPV31 | E5 | 2 | --MIELNISTVSIVL | 47239 | IELNISTVS | 49336 |
| HPV31 | E5 | 43 | ATLLLLIVILWVIAT | 47240 | LLLIVILWV | 49337 |
| HPV31 | E5 | 62 | CFCIYVVFIYIPLFV | 47241 | IYVVFIYIP | 49338 |
| HPV31 | E5 | 21 | CFCVLLFVCLVIRPL | 47242 | VLLFVCLVI | 49339 |
| HPV31 | E5 | 17 | CFLLCFCVLLFVCLV | 47243 | LCFCVLLFV | 49340 |
| HPV31 | E5 | 64 | CIYVVFIYIPLFVIH | 47244 | VVFIYIPLF | 49341 |
| HPV31 | E5 | 29 | CLVIRPLVLSVSVYA | 47245 | IRPLVLSVS | 49342 |
| HPV31 | E5 | 23 | CVLLFVCLVIRPLVL | 47246 | LFVCLVIRP | 49343 |
| HPV31 | E5 | 6 | ELNISTVSIVLCFLL | 47247 | ISTVSIVLC | 49344 |
| HPV31 | E5 | 22 | FCVLLFVCLVIRPLV | 47248 | LLFVCLVIR | 49345 |
| HPV31 | E5 | 69 | FIYIPLFVIHTHASF | 47249 | IPLFVIHTH | 49346 |
| HPV31 | E5 | 27 | FVCLVIRPLVLSVSV | 47250 | LVIRPLVLS | 49347 |
| HPV31 | E5 | 51 | ILWVIATSPLRCFCI | 47251 | VIATSPLRC | 49348 |
| HPV31 | E5 | 32 | IRPLVLSVSVYATLL | 47252 | LVLSVSVYA | 49349 |
| HPV31 | E5 | 9 | ISTVSIVLCFLLCFC | 47253 | VSIVLCFLL | 49350 |
| HPV31 | E5 | 49 | IVILWVIATSPLRCF | 47254 | LWVIATSPL | 49351 |
| HPV31 | E5 | 65 | IYVVFIYIPLFVIHT | 47255 | VFIYIPLFV | 49352 |
| HPV31 | E5 | 16 | LCFLLCFCVLLFVCL | 47256 | LLCFCVLLF | 49353 |
| HPV31 | E5 | 74 | LFVIHTHASFLSQQ- | 47257 | IHTHASFLS | 49354 |
| HPV31 | E5 | 48 | LIVILWVIATSPLRC | 47258 | ILWVIATSP | 49355 |
| HPV31 | E5 | 47 | LLIVILWVIATSPLR | 47259 | VILWVIATS | 49356 |
| HPV31 | E5 | 46 | LLLIVILWVIATSPL | 47260 | IVILWVIAT | 49357 |
| HPV31 | E5 | 60 | LRCFCIYVVFIYIPL | 47261 | FCIYVVFIY | 49358 |
| HPV31 | E5 | 52 | LWVIATSPLRCFCIY | 47262 | IATSPLRCF | 49359 |
| HPV31 | E5 | 4 | MIELNISTVSIVLCF | 47263 | LNISTVSIV | 49360 |
| HPV31 | E5 | 73 | PLFVIHTHASFLSQQ | 47264 | VIHTHASFL | 49361 |
| HPV31 | E5 | 33 | RPLVLSVSVYATLLL | 47265 | VLSVSVYAT | 49362 |
| HPV31 | E5 | 13 | SIVLCFLLCFCVLLF | 47266 | LCFLLCFCV | 49363 |
| HPV31 | E5 | 38 | SVSVYATLLLLIVIL | 47267 | VYATLLLLI | 49364 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV31 | E5 | 44 | TLLLLIVILWVIATS | 47268 | LLIVILWVI | 49365 |
| HPV31 | E5 | 57 | TSPLRCFCIYVVFIY | 47269 | LRCFCIYVV | 49366 |
| HPV31 | E5 | 11 | TVSIVLCFLLCFCVL | 47270 | IVLCFLLCF | 49367 |
| HPV31 | E5 | 28 | VCLVIRPLVLSVSVY | 47271 | VIRPLVLSV | 49368 |
| HPV31 | E5 | 68 | VFIYIPLFVIHTHAS | 47272 | YIPLFVIHT | 49369 |
| HPV31 | E5 | 50 | VILWVIATSPLRCFC | 47273 | WVIATSPLR | 49370 |
| HPV31 | E5 | 15 | VLCFLLCFCVLLFVC | 47274 | FLLCFCVLL | 49371 |
| HPV31 | E5 | 24 | VLLFVCLVIRPLVLS | 47275 | FVCLVIRPL | 49372 |
| HPV31 | E5 | 36 | VLSVSVYATLLLLIV | 47276 | VSVYATLLL | 49373 |
| HPV31 | E5 | 12 | VSIVLCFLLCFCVLL | 47277 | VLCFLLCFC | 49374 |
| HPV31 | E5 | 39 | VSVYATLLLLIVILW | 47278 | YATLLLLIV | 49375 |
| HPV31 | E5 | 42 | YATLLLLIVILWVIA | 47279 | LLLLIVILW | 49376 |
| HPV31 | E5 | 71 | YIPLFVIHTHASFLS | 47280 | LFVIHTHAS | 49377 |
| HPV31 | E5 | 66 | YVVFIYIPLFVIHTH | 47281 | FIYIPLFVI | 49378 |
| HPV31 | E6 | 1 | ---MFKNPAERPRKL | 47282 | MFKNPAERP | 49379 |
| HPV31 | E6 | 21 | ALEIPYDELRLNCVY | 47283 | IPYDELRLN | 49380 |
| HPV31 | E6 | 100 | CDLLIRCITCQRPLC | 47284 | LIRCITCQR | 49381 |
| HPV31 | E6 | 69 | CLRFYSKVSEFRWYR | 47285 | FYSKVSEFR | 49382 |
| HPV31 | E6 | 47 | DFAFTDLTIVYRDDT | 47286 | FTDLTIVYR | 49383 |
| HPV31 | E6 | 101 | DLLIRCITCQRPLCP | 47287 | IRCITCQRP | 49384 |
| HPV31 | E6 | 78 | EFRWYRYSVYGTTLE | 47288 | WYRYSVYGT | 49385 |
| HPV31 | E6 | 23 | EIPYDELRLNCVYCK | 47289 | YDELRLNCV | 49386 |
| HPV31 | E6 | 28 | ELRLNCVYCKGQLTE | 47290 | LNCVYCKGQ | 49387 |
| HPV31 | E6 | 128 | FHNIGGRWTGRCIAC | 47291 | IGGRWTGRC | 49388 |
| HPV31 | E6 | 132 | GGRWTGRCIACWRRP | 47292 | WTGRCIACW | 49389 |
| HPV31 | E6 | 140 | IACWRRPRTETQV-- | 47293 | WRRPRTETQ | 49390 |
| HPV31 | E6 | 99 | ICDLLIRCITCQRPL | 47294 | LLIRCITCQ | 49391 |
| HPV31 | E6 | 104 | IRCITCQRPLCPEEK | 47295 | ITCQRPLCP | 49392 |
| HPV31 | E6 | 37 | KGQLTETEVLDFAFT | 47296 | LTETEVLDF | 49393 |
| HPV31 | E6 | 91 | LEKLTNKGICDLLIR | 47297 | LTNKGICDL | 49394 |
| HPV31 | E6 | 53 | LTIVYRDDTPHGVCT | 47298 | VYRDDTPHG | 49395 |
| HPV31 | E6 | 32 | NCVYCKGQLTETEVL | 47299 | YCKGQLTET | 49396 |
| HPV31 | E6 | 96 | NKGICDLLIRCITCQ | 47300 | ICDLLIRCI | 49397 |
| HPV31 | E6 | 62 | PHGVCTKCLRFYSKV | 47301 | VCTKCLRFY | 49398 |
| HPV31 | E6 | 12 | PRKLHELSSALEIPY | 47302 | LHELSSALE | 49399 |
| HPV31 | E6 | 83 | RYSVYGTTLEKLTNK | 47303 | VYGTTLEKL | 49400 |
| HPV31 | E6 | 43 | TEVLDFAFTDLTIVY | 47304 | LDFAFTDLT | 49401 |
| HPV31 | E6 | 54 | TIVYRDDTPHGVCTK | 47305 | YRDDTPHGV | 49402 |
| HPV31 | E6 | 45 | VLDFAFTDLTIVYRD | 47306 | FAFTDLTIV | 49403 |
| HPV31 | E6 | 81 | WYRYSVYGTTLEKLT | 47307 | YSVYGTTLE | 49404 |
| HPV31 | E6 | 26 | YDELRLNCVYCKGQL | 47308 | LRLNCVYCK | 49405 |
| HPV31 | E7 | 1 | ---MRGETPTLQDYV | 47309 | MRGETPTLQ | 49406 |
| HPV31 | E7 | 78 | DIRILQELLMGSFGI | 47310 | ILQELLMGS | 49407 |
| HPV31 | E7 | 37 | EEDVIDSPAGQAEPD | 47311 | VIDSPAGQA | 49408 |
| HPV31 | E7 | 84 | ELLMGSFGIVCPNCS | 47312 | MGSFGIVCP | 49409 |
| HPV31 | E7 | 90 | FGIVCPNCSTRL--- | 47313 | VCPNCSTRL | 49410 |
| HPV31 | E7 | 79 | IRILQELLMGSFGIV | 47314 | LQELLMGSF | 49411 |
| HPV31 | E7 | 87 | MGSFGIVCPNCSTRL | 47315 | FGIVCPNCS | 49412 |
| HPV31 | E7 | 54 | NYNIVTFCCQCKSTL | 47316 | IVTFCCQCK | 49413 |
| HPV31 | E7 | 12 | QDYVLDLQPEATDLH | 47317 | VLDLQPEAT | 49414 |
| HPV31 | E7 | 69 | RLCVQSTQVDIRILQ | 47318 | VQSTQVDIR | 49415 |
| HPV31 | E7 | 89 | SFGIVCPNCSTRL-- | 47319 | IVCPNCSTR | 49416 |
| HPV31 | E7 | 74 | STQVDIRILQELLMG | 47320 | VDIRILQEL | 49417 |
| HPV31 | E7 | 67 | TLRLCVQSTQVDIRI | 47321 | LCVQSTQVD | 49418 |
| HPV31 | E7 | 8 | TPTLQDYVLDLQPEA | 47322 | LQDYVLDLQ | 49419 |
| HPV31 | E7 | 15 | VLDLQPEATDLHCYE | 47323 | LQPEATDLH | 49420 |
| HPV31 | L1 | 1 | ---MSLWRPSEATVY | 47324 | MSLWRPSEA | 49421 |
| HPV31 | L1 | 389 | ADIMTYIHSMNPAIL | 47325 | MTYIHSMNP | 49422 |
| HPV31 | L1 | 43 | ARLLTVGHPYYSIPK | 47326 | LTVGHPYYS | 49423 |
| HPV31 | L1 | 12 | ATVYLPPVPVSKVVS | 47327 | YLPPVPVSK | 49424 |
| HPV31 | L1 | 349 | CAAIANSDTTFKSSN | 47328 | IANSDTTFK | 49425 |
| HPV31 | L1 | 150 | CISMDYKQTQLCLLG | 47329 | MDYKQTQLC | 49426 |
| HPV31 | L1 | 189 | CPPLELKNSVIQDGD | 47330 | LELKNSVIQ | 49427 |
| HPV31 | L1 | 28 | DEYVTRTNIYYHAGS | 47331 | VTRTNIYYH | 49428 |
| HPV31 | L1 | 375 | DLQFIFQLCKITLSA | 47332 | FIFQLCKIT | 49429 |
| HPV31 | L1 | 278 | DLYIKGSGSTATLAN | 47333 | IKGSGSTAT | 49430 |
| HPV31 | L1 | 91 | DTSFYNPETQRLVWA | 47334 | FYNPETQRL | 49431 |
| HPV31 | L1 | 405 | DWNFGLTTPPSGSLE | 47335 | FGLTTPPSG | 49432 |
| HPV31 | L1 | 447 | DYVFWEVNLKEKFSA | 47336 | FWEVNLKEK | 49433 |
| HPV31 | L1 | 11 | EATVYLPPVPVSKVV | 47337 | VYLPPVPVS | 49434 |
| HPV31 | L1 | 419 | EDTYRFVTSQAITCQ | 47338 | YRFVTSQAI | 49435 |
| HPV31 | L1 | 452 | EVNLKEKFSADLDQF | 47339 | LKEKFSADL | 49436 |
| HPV31 | L1 | 251 | FFYLRREQMFVRHFF | 47340 | LRREQMFVR | 49437 |
| HPV31 | L1 | 209 | FGAMDFTALQDTKSN | 47341 | MDFTALQDT | 49438 |
| HPV31 | L1 | 445 | FKDYVFWEVNLKEKF | 47342 | YVFWEVNLK | 49439 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV31 | L1 | 214 | FTALQDTKSNVPLDI | 47343 | LQDTKSNVP | 49440 |
| HPV31 | L1 | 371 | GEEFDLQFIFQLCKI | 47344 | FDLQFIFQL | 49441 |
| HPV31 | L1 | 170 | GEHWGKGSPCSNNAI | 47345 | WGKGSPCSN | 49442 |
| HPV31 | L1 | 108 | GLEVGRGQPLGVGIS | 47346 | VGRGQPLGV | 49443 |
| HPV31 | L1 | 71 | GLQYRVFRVRLPDPN | 47347 | YRVFRVRLP | 49444 |
| HPV31 | L1 | 330 | GNQLFVTVVDTTRST | 47348 | LFVTVVDTT | 49445 |
| HPV31 | L1 | 114 | GQPLGVGISGHPLLN | 47349 | LGVGISGHP | 49446 |
| HPV31 | L1 | 118 | GVGISGHPLLNKFDD | 47350 | ISGHPLLNK | 49447 |
| HPV31 | L1 | 50 | HPYYSIPKSDNPKKI | 47351 | YSIPKSDNP | 49448 |
| HPV31 | L1 | 379 | IFQLCKITLSADIMT | 47352 | LCKITLSAD | 49449 |
| HPV31 | L1 | 395 | IHSMNPAILEDWNFG | 47353 | MNPAILEDW | 49450 |
| HPV31 | L1 | 384 | KITLSADIMTYIHSM | 47354 | LSADIMTYI | 49451 |
| HPV31 | L1 | 62 | KKIVVPKVSGLQYRV | 47355 | VVPKVSGLQ | 49452 |
| HPV31 | L1 | 221 | KSNVPLDICNSICKY | 47356 | VPLDICNSI | 49453 |
| HPV31 | L1 | 160 | LCLLGCKPPIGEHWG | 47357 | LGCKPPIGE | 49454 |
| HPV31 | L1 | 403 | LEDWNFGLTTPPSGS | 47358 | WNFGLTTPP | 49455 |
| HPV31 | L1 | 16 | LPPVPVSKVVSTDEY | 47359 | VPVSKVVST | 49456 |
| HPV31 | L1 | 4 | MSLWRPSEATVYLPP | 47360 | WRPSEATVY | 49457 |
| HPV31 | L1 | 392 | MTYIHSMNPAILEDW | 47361 | IHSMNPAIL | 49458 |
| HPV31 | L1 | 407 | NFGLTTPPSGSLEDT | 47362 | LTTPPSGSL | 49459 |
| HPV31 | L1 | 35 | NIYYHAGSARLLTVG | 47363 | YHAGSARLL | 49460 |
| HPV31 | L1 | 312 | NKPYWMQRAQGHNNG | 47364 | YWMQRAQGH | 49461 |
| HPV31 | L1 | 345 | NMSVCAAIANSDTTF | 47365 | VCAAIANSD | 49462 |
| HPV31 | L1 | 181 | NNAITPGDCPPLELK | 47366 | ITPGDCPPL | 49463 |
| HPV31 | L1 | 292 | NSTYFPTPSGSMVTS | 47367 | YFPTPSGSM | 49464 |
| HPV31 | L1 | 196 | NSVIQDGDMVDTGFG | 47368 | IQDGDMVDT | 49465 |
| HPV31 | L1 | 223 | NVPLDICNSICKYPD | 47369 | LDICNSICK | 49466 |
| HPV31 | L1 | 61 | PKKIVVPKVSGLQYR | 47370 | IVVPKVSGL | 49467 |
| HPV31 | L1 | 225 | PLDICNSICKYPDYL | 47371 | ICNSICKYP | 49468 |
| HPV31 | L1 | 191 | PLELKNSVIQDGDMV | 47372 | LKNSVIQDG | 49469 |
| HPV31 | L1 | 84 | PNKFGFPDTSFYNPE | 47373 | FGFPDTSFY | 49470 |
| HPV31 | L1 | 276 | PTDLYIKGSGSTATL | 47374 | LYIKGSGST | 49471 |
| HPV31 | L1 | 18 | PVPVSKVVSTDEYVT | 47375 | VSKVVSTDE | 49472 |
| HPV31 | L1 | 377 | QFIFQLCKITLSADI | 47376 | FQLCKITLS | 49473 |
| HPV31 | L1 | 465 | QFPLGRKFLLQAGYR | 47377 | LGRKFLLQA | 49474 |
| HPV31 | L1 | 159 | QLCLLGCKPPIGEHW | 47378 | LLGCKPPIG | 49475 |
| HPV31 | L1 | 332 | QLFVTVVDTTRSTNM | 47379 | VTVVDTTRS | 49476 |
| HPV31 | L1 | 157 | QTQLCLLGCKPPIGE | 47380 | LCLLGCKPP | 49477 |
| HPV31 | L1 | 73 | QYRVFRVRLPDPNKF | 47381 | VFRVRLPDP | 49478 |
| HPV31 | L1 | 262 | RHFFNRSGTVGESVP | 47382 | FNRSGTVGE | 49479 |
| HPV31 | L1 | 101 | RLVWACVGLEVGRGQ | 47383 | WACVGLEVG | 49480 |
| HPV31 | L1 | 460 | SADLDQFPLGRKFLL | 47384 | LDQFPLGRK | 49481 |
| HPV31 | L1 | 300 | SGSMVTSDAQIFNKP | 47385 | MVTSDAQIF | 49482 |
| HPV31 | L1 | 268 | SGTVGESVPTDLYIK | 47386 | VGESVPTDL | 49483 |
| HPV31 | L1 | 152 | SMDYKQTQLCLLGCK | 47387 | YKQTQLCLL | 49484 |
| HPV31 | L1 | 427 | SQAITCQKTAPQKPK | 47388 | ITCQKTAPQ | 49485 |
| HPV31 | L1 | 343 | STNMSVCAAIANSDT | 47389 | MSVCAAIAN | 49486 |
| HPV31 | L1 | 34 | TNIYYHAGSARLLTV | 47390 | YYHAGSARL | 49487 |
| HPV31 | L1 | 99 | TQRLVWACVGLEVGR | 47391 | LVWACVGLE | 49488 |
| HPV31 | L1 | 13 | TVYLPPVPVSKVVST | 47392 | LPPVPVSKV | 49489 |
| HPV31 | L1 | 421 | TYRFVTSQAITCQKT | 47393 | FVTSQAITC | 49490 |
| HPV31 | L1 | 76 | VFRVRLPDPNKFGFP | 47394 | VRLPDPNKF | 49491 |
| HPV31 | L1 | 335 | VTVVDTTRSTNMSVC | 47395 | VDTTRSTNM | 49492 |
| HPV31 | L1 | 235 | YPDYLKMVAEPYGDT | 47396 | YLKMVAEPY | 49493 |
| HPV31 | L1 | 422 | YRFVTSQAITCQKTA | 47397 | VTSQAITCQ | 49494 |
| HPV31 | L1 | 74 | YRVFRVRLPDPNKFG | 47398 | FRVRLPDPN | 49495 |
| HPV31 | L2 | 1 | ---MRSKRSTKRTKR | 47399 | MRSKRSTKR | 49496 |
| HPV31 | L2 | 45 | ADQILRYGSMGVFFG | 47400 | ILRYGSMGV | 49497 |
| HPV31 | L2 | 363 | DFTVDTPATHNVSPS | 47401 | VDTPATHNV | 49498 |
| HPV31 | L2 | 276 | DPDFLDIIALHRPAL | 47402 | FLDIIALHR | 49499 |
| HPV31 | L2 | 163 | DPSVLQPPTPAETSG | 47403 | VLQPPTPAE | 49500 |
| HPV31 | L2 | 46 | DQILRYGSMGVFFGG | 47404 | LRYGSMGVF | 49501 |
| HPV31 | L2 | 361 | DTDFTVDTPATHNVS | 47405 | FTVDTPATH | 49502 |
| HPV31 | L2 | 411 | DVPIEHAPTQVFPFP | 47406 | IEHAPTQVF | 49503 |
| HPV31 | L2 | 87 | EASIPIRPPVSIDPV | 47407 | IPIRPPVSI | 49504 |
| HPV31 | L2 | 261 | EESLYFSNTSHNIAP | 47408 | LYFSNTSHN | 49505 |
| HPV31 | L2 | 193 | EIPMDTFIVSTNNEN | 47409 | MDTFIVSTN | 49506 |
| HPV31 | L2 | 114 | ESGIVDVGAPAPIPH | 47410 | IVDVGAPAP | 49507 |
| HPV31 | L2 | 262 | ESLYFSNTSHNIAPD | 47411 | YFSNTSHNI | 49508 |
| HPV31 | L2 | 333 | GESIEMQPLGASATT | 47412 | IEMQPLGAS | 49509 |
| HPV31 | L2 | 439 | GGDFYLHPSYYMLKR | 47413 | FYLHPSYYM | 49510 |
| HPV31 | L2 | 177 | GHLLLSSSSISTHNY | 47414 | LLSSSSIST | 49511 |
| HPV31 | L2 | 409 | GPDVPIEHAPTQVFP | 47415 | VPIEHAPTQ | 49512 |
| HPV31 | L2 | 55 | GVFFGGLGIGSGSGT | 47416 | FGGLGIGSG | 49513 |
| HPV31 | L2 | 178 | HLLLSSSSISTHNYE | 47417 | LSSSSISTH | 49514 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV31 | L2 | 41 | HTTIADQILRYGSMG | 47418 | IADQILRYG | 49515 |
| HPV31 | L2 | 321 | HYYYDISSINPAGES | 47419 | YDISSINPA | 49516 |
| HPV31 | L2 | 98 | IDPVGPLDPSIVSLV | 47420 | VGPLDPSIV | 49517 |
| HPV31 | L2 | 282 | IIALHRPALTSRRNT | 47421 | LHRPALTSR | 49518 |
| HPV31 | L2 | 147 | ILDVTSVSTHENPTF | 47422 | VTSVSTHEN | 49519 |
| HPV31 | L2 | 48 | ILRYGSMGVFFGGLG | 47423 | YGSMGVFFG | 49520 |
| HPV31 | L2 | 404 | IPIFSGPDVPIEHAP | 47424 | FSGPDVPIE | 49521 |
| HPV31 | L2 | 36 | IPKIEHTTIADQILR | 47425 | IEHTTIADQ | 49522 |
| HPV31 | L2 | 117 | IVDVGAPAPIPHPPT | 47426 | VGAPAPIPH | 49523 |
| HPV31 | L2 | 245 | KQLITYENPAYETVN | 47427 | ITYENPAYE | 49524 |
| HPV31 | L2 | 280 | LDIIALHRPALTSRR | 47428 | IALHRPALT | 49525 |
| HPV31 | L2 | 338 | MQPLGASATTTSTLN | 47429 | LGASATTTS | 49526 |
| HPV31 | L2 | 352 | NDGLYDIYADTDFTV | 47430 | LYDIYADTD | 49527 |
| HPV31 | L2 | 205 | NENITSSTPIPGVRR | 47431 | ITSSTPIPG | 49528 |
| HPV31 | L2 | 252 | NPAYETVNAEESLYF | 47432 | YETVNAEES | 49529 |
| HPV31 | L2 | 158 | NPTFTDPSVLQPPTP | 47433 | FTDPSVLQP | 49530 |
| HPV31 | L2 | 145 | PAILDVTSVSTHENP | 47434 | LDVTSVSTH | 49531 |
| HPV31 | L2 | 123 | PAPIPHPPTTSGFDI | 47435 | IPHPPTTSG | 49532 |
| HPV31 | L2 | 277 | PDFLDIIALHRPALT | 47436 | LDIIALHRP | 49533 |
| HPV31 | L2 | 423 | PFPLAPTTPQVSIFV | 47437 | LAPTTPQVS | 49534 |
| HPV31 | L2 | 82 | PSTVSEASIPIRPPV | 47438 | VSEASIPIR | 49535 |
| HPV31 | L2 | 164 | PSVLQPPTPAETSGH | 47439 | LQPPTPAET | 49536 |
| HPV31 | L2 | 418 | PTQVFPFPLAPTTPQ | 47440 | VFPFPLAPT | 49537 |
| HPV31 | L2 | 95 | PVSIDPVGPLDPSIV | 47441 | IDPVGPLDP | 49538 |
| HPV31 | L2 | 455 | RKRVSYFFTDVSVAA | 47442 | VSYFFTDVS | 49539 |
| HPV31 | L2 | 222 | RLGLYSKATQQVKVI | 47443 | LYSKATQQV | 49540 |
| HPV31 | L2 | 294 | RNTVRYSRLGNKQTL | 47444 | VRYSRLGNK | 49541 |
| HPV31 | L2 | 93 | RPPVSIDPVGPLDPS | 47445 | VSIDPVGPL | 49542 |
| HPV31 | L2 | 72 | RTGYVPLSTRPSTVS | 47446 | YVPLSTRPS | 49543 |
| HPV31 | L2 | 319 | RVHYYYDISSINPAG | 47447 | YYYDISSIN | 49544 |
| HPV31 | L2 | 457 | RVSYFFTDVSVAA-- | 47448 | YFFTDVSVA | 49545 |
| HPV31 | L2 | 387 | SAYVPTNTTVPLSTG | 47449 | VPTNTTVPL | 49546 |
| HPV31 | L2 | 176 | SGHLLLSSSSISTHN | 47450 | LLLSSSSIS | 49547 |
| HPV31 | L2 | 115 | SGIVDVGAPAPIPHP | 47451 | VDVGAPAPI | 49548 |
| HPV31 | L2 | 335 | SIEMQPLGASATTTS | 47452 | MQPLGASAT | 49549 |
| HPV31 | L2 | 89 | SIPIRPPVSIDPVGP | 47453 | IRPPVSIDP | 49550 |
| HPV31 | L2 | 53 | SMGVFFGGLGIGSGS | 47454 | VFFGGLGIG | 49551 |
| HPV31 | L2 | 377 | STAVQSTSAVSAYVP | 47455 | VQSTSAVSA | 49552 |
| HPV31 | L2 | 371 | THNVSPSTAVQSTSA | 47456 | VSPSTAVQS | 49553 |
| HPV31 | L2 | 188 | THNYEEIPMDTFIVS | 47457 | YEEIPMDTF | 49554 |
| HPV31 | L2 | 144 | TPAILDVTSVSTHEN | 47458 | ILDVTSVST | 49555 |
| HPV31 | L2 | 19 | TQLYQTCKAAGTCPS | 47459 | YQTCKAAGT | 49556 |
| HPV31 | L2 | 230 | TQQVKVIDPTFLSAP | 47460 | VKVIDPTFL | 49557 |
| HPV31 | L2 | 419 | TQVFPFPLAPTTPQV | 47461 | FPFPLAPTT | 49558 |
| HPV31 | L2 | 383 | TSAVSAYVPTNTTVP | 47462 | VSAYVPTNT | 49559 |
| HPV31 | L2 | 132 | TSGFDIATTADTTPA | 47463 | FDIATTADT | 49560 |
| HPV31 | L2 | 421 | VFPFPLAPTTPQVSI | 47464 | FPLAPTTPQ | 49561 |
| HPV31 | L2 | 101 | VGPLDPSIVSLVEES | 47465 | LDPSIVSLV | 49562 |
| HPV31 | L2 | 320 | VHYYYDISSINPAGE | 47466 | YYDISSINP | 49563 |
| HPV31 | L2 | 233 | VKVIDPTFLSAPKQL | 47467 | IDPTFLSAP | 49564 |
| HPV31 | L2 | 386 | VSAYVPTNTTVPLST | 47468 | YVPTNTTVP | 49565 |
| HPV31 | L2 | 109 | VSLVEESGIVDVGAP | 47469 | VEESGIVDV | 49566 |
| HPV31 | L2 | 458 | VSYFFTDVSVAA--- | 47470 | FFTDVSVAA | 49567 |
| HPV31 | L2 | 255 | YETVNAEESLYFSNT | 47471 | VNAEESLYF | 49568 |
| HPV31 | L2 | 299 | YSRLGNKQTLRTRSG | 47472 | LGNKQTLRT | 49569 |
| HPV31 | L2 | 75 | YVPLSTRPSTVSEAS | 47473 | LSTRPSTVS | 49570 |
| HPV31 | L2 | 323 | YYDISSINPAGESIE | 47474 | ISSINPAGE | 49571 |
| HPV33 | E1 | 385 | AAAFLKSNSQAKIVK | 47475 | FLKSNSQAK | 49572 |
| HPV33 | E1 | 100 | AEDVVDRAANPCRTS | 47476 | VVDRAANPC | 49573 |
| HPV33 | E1 | 395 | AKIVKDCGIMCRHYK | 47477 | VKDCGIMCR | 49574 |
| HPV33 | E1 | 287 | AKLMSNLLSIPETCM | 47478 | MSNLLSIPE | 49575 |
| HPV33 | E1 | 314 | ALYWFRTAMSNISDV | 47479 | WFRTAMSNI | 49576 |
| HPV33 | E1 | 210 | AYGISFMELVRPFKS | 47480 | ISFMELVRP | 49577 |
| HPV33 | E1 | 313 | CALYWFRTAMSNISD | 47481 | YWFRTAMSN | 49578 |
| HPV33 | E1 | 182 | CENVTLQEISNVLHS | 47482 | VTLQEISNV | 49579 |
| HPV33 | E1 | 300 | CMVIEPPKLRSQTCA | 47483 | IEPPKLRSQ | 49580 |
| HPV33 | E1 | 17 | CTGWFEVEAVIERRT | 47484 | WFEVEAVIE | 49581 |
| HPV33 | E1 | 602 | DENWKSFFSRTWCKL | 47485 | WKSFFSRTW | 49582 |
| HPV33 | E1 | 370 | DIAYYYAQLADSNSN | 47486 | YYYAQLADS | 49583 |
| HPV33 | E1 | 348 | DNIFDLSEMVQWAYD | 47487 | FDLSEMVQW | 49584 |
| HPV33 | E1 | 266 | DRGIIILLLIRFRCS | 47488 | IIILLLIRF | 49585 |
| HPV33 | E1 | 368 | DSDIAYYYAQLADSN | 47489 | IAYYYAQLA | 49586 |
| HPV33 | E1 | 133 | DSGYGNTEVETQQMV | 47490 | YGNTEVETQ | 49587 |
| HPV33 | E1 | 569 | DSRWPYLHSRLTVFE | 47491 | WPYLHSRLT | 49588 |
| HPV33 | E1 | 156 | DTNLNDLESSGVGDD | 47492 | LNDLESSGV | 49589 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV33 | E1 | 231 | DWCITGYGISPSVAE | 47493 | ITGYGISPS | 49590 |
| HPV33 | E1 | 120 | ECTYRKRKIDELEDS | 47494 | YRKRKIDEL | 49591 |
| HPV33 | E1 | 79 | EDDLNAVCALKRKFA | 47495 | LNAVCALKR | 49592 |
| HPV33 | E1 | 298 | ETCMVIEPPKLRSQT | 47496 | MVIEPPKLR | 49593 |
| HPV33 | E1 | 456 | FKKFLKGIPKKSCML | 47497 | FLKGIPKKS | 49594 |
| HPV33 | E1 | 492 | GCVISCVNSKSHFWL | 47498 | ISCVNSKSH | 49595 |
| HPV33 | E1 | 628 | GGNISTFKCSAGENT | 47499 | ISTFKCSAG | 49596 |
| HPV33 | E1 | 478 | GKSYFGMSLIQFLKG | 47500 | YFGMSLIQF | 49597 |
| HPV33 | E1 | 236 | GYGISPSVAESLKVL | 47501 | ISPSVAESL | 49598 |
| HPV33 | E1 | 547 | HRALVQLKCPPLLLT | 47502 | LVQLKCPPL | 49599 |
| HPV33 | E1 | 254 | HSLYTHLQCLTCDRG | 47503 | YTHLQCLTC | 49600 |
| HPV33 | E1 | 371 | IAYYYAQLADSNSNA | 47504 | YYAQLADSN | 49601 |
| HPV33 | E1 | 528 | IDDYMRNALDGNEIS | 47505 | YMRNALDGN | 49602 |
| HPV33 | E1 | 514 | IGMIDDVTPISWTYI | 47506 | IDDVTPISW | 49603 |
| HPV33 | E1 | 418 | IGQWIQSRCEKTNDG | 47507 | WIQSRCEKT | 49604 |
| HPV33 | E1 | 271 | ILLLIRFRCSKNRLT | 47508 | LIRFRCSKN | 49605 |
| HPV33 | E1 | 487 | IQFLKGCVISCVNSK | 47509 | LKGCVISCV | 49606 |
| HPV33 | E1 | 325 | ISDVQGTTPEWIDRL | 47510 | VQGTTPEWI | 49607 |
| HPV33 | E1 | 213 | ISFMELVRPFKSDKT | 47511 | MELVRPFKS | 49608 |
| HPV33 | E1 | 234 | ITGYGISPSVAESLK | 47512 | YGISPSVAE | 49609 |
| HPV33 | E1 | 208 | KEAYGISFMELVRPF | 47513 | YGISFMELV | 49610 |
| HPV33 | E1 | 513 | KIGMIDDVTPISWTY | 47514 | MIDDVTPIS | 49611 |
| HPV33 | E1 | 281 | KNRLTVAKLMSNLLS | 47515 | LTVAKLMSN | 49612 |
| HPV33 | E1 | 466 | KSCMLICGPANTGKS | 47516 | MLICGPANT | 49613 |
| HPV33 | E1 | 606 | KSFFSRTWCKLDLIE | 47517 | FSRTWCKLD | 49614 |
| HPV33 | E1 | 501 | KSHFWLQPLSDAKIG | 47518 | FWLQPLSDA | 49615 |
| HPV33 | E1 | 479 | KSYFGMSLIQFLKGC | 47519 | FGMSLIQFL | 49616 |
| HPV33 | E1 | 248 | KVLIKQHSLYTHLQC | 47520 | IKQHSLYTH | 49617 |
| HPV33 | E1 | 486 | LIQFLKGCVISCVNS | 47521 | FLKGCVISC | 49618 |
| HPV33 | E1 | 460 | LKGIPKKSCMLICGP | 47522 | IPKKSCMLI | 49619 |
| HPV33 | E1 | 247 | LKVLIKQHSLYTHLQ | 47523 | LIKQHSLYT | 49620 |
| HPV33 | E1 | 50 | LLEFIDDSMENSIQA | 47524 | FIDDSMENS | 49621 |
| HPV33 | E1 | 272 | LLLIRFRCSKNRLTV | 47525 | IRFRCSKNR | 49622 |
| HPV33 | E1 | 293 | LLSIPETCMVIEPPK | 47526 | IPETCMVIE | 49623 |
| HPV33 | E1 | 159 | LNDLESSGVGDDSEV | 47527 | LESSGVGDD | 49624 |
| HPV33 | E1 | 506 | LQPLSDAKIGMIDDV | 47528 | LSDAKIGMI | 49625 |
| HPV33 | E1 | 579 | LTVFEFKNPFPFDEN | 47529 | FEFKNPFPF | 49626 |
| HPV33 | E1 | 550 | LVQLKCPPLLLTSNT | 47530 | LKCPPLLLT | 49627 |
| HPV33 | E1 | 315 | LYWFRTAMSNISDVQ | 47531 | FRTAMSNIS | 49628 |
| HPV33 | E1 | 216 | MELVRPFKSDKTSCT | 47532 | VRPFKSDKT | 49629 |
| HPV33 | E1 | 202 | NILYKFKEAYGISFM | 47533 | YKFKEAYGI | 49630 |
| HPV33 | E1 | 138 | NTEVETQQMVQQVES | 47534 | VETQQMVQQ | 49631 |
| HPV33 | E1 | 333 | PEWIDRLTVLQHSFN | 47535 | IDRLTVLQH | 49632 |
| HPV33 | E1 | 305 | PPKLRSQTCALYWFR | 47536 | LRSQTCALY | 49633 |
| HPV33 | E1 | 556 | PPLLLTSNTNAGTDS | 47537 | LLTSNTNAG | 49634 |
| HPV33 | E1 | 144 | QQMVQQVESQNGDTN | 47538 | VQQVESQNG | 49635 |
| HPV33 | E1 | 358 | QWAYDNELTDDSDIA | 47539 | YDNELTDDS | 49636 |
| HPV33 | E1 | 548 | RALVQLKCPPLLLTS | 47540 | VQLKCPPLL | 49637 |
| HPV33 | E1 | 267 | RGIIILLLIRFRCSK | 47541 | IILLLIRFR | 49638 |
| HPV33 | E1 | 283 | RLTVAKLMSNLLSIP | 47542 | VAKLMSNLL | 49639 |
| HPV33 | E1 | 533 | RNALDGNEISIDVKH | 47543 | LDGNEISID | 49640 |
| HPV33 | E1 | 571 | RWPYLHSRLTVFEFK | 47544 | YLHSRLTVF | 49641 |
| HPV33 | E1 | 467 | SCMLICGPANTGKSY | 47545 | LICGPANTG | 49642 |
| HPV33 | E1 | 502 | SHFWLQPLSDAKIGM | 47546 | WLQPLSDAK | 49643 |
| HPV33 | E1 | 542 | SIDVKHRALVQLKCP | 47547 | VKHRALVQL | 49644 |
| HPV33 | E1 | 291 | SNLLSIPETCMVIEP | 47548 | LSIPETCMV | 49645 |
| HPV33 | E1 | 191 | SNVLHSSNTKANILY | 47549 | LHSSNTKAN | 49646 |
| HPV33 | E1 | 610 | SRTWCKLDLIEEEDK | 47550 | WCKLDLIEE | 49647 |
| HPV33 | E1 | 524 | SWTYIDDYMRNALDG | 47551 | YIDDYMRNA | 49648 |
| HPV33 | E1 | 312 | TCALYWFRTAMSNIS | 47552 | LYWFRTAMS | 49649 |
| HPV33 | E1 | 18 | TGWFEVEAVIERRTG | 47553 | FEVEAVIER | 49650 |
| HPV33 | E1 | 332 | TPEWIDRLTVLQHSF | 47554 | WIDRLTVLQ | 49651 |
| HPV33 | E1 | 286 | VAKLMSNLLSIPETC | 47555 | LMSNLLSIP | 49652 |
| HPV33 | E1 | 85 | VCALKRKFAACSQSA | 47556 | LKRKFAACS | 49653 |
| HPV33 | E1 | 23 | VEAVIERRTGDNISE | 47557 | VIERRTGDN | 49654 |
| HPV33 | E1 | 581 | VFEFKNPFPFDENGN | 47558 | FKNPFPFDE | 49655 |
| HPV33 | E1 | 439 | VQLLRYQNIEFTAFL | 47559 | LRYQNIEFT | 49656 |
| HPV33 | E1 | 219 | VRPFKSDKTSCTDWC | 47560 | FKSDKTSCT | 49657 |
| HPV33 | E1 | 520 | VTPISWTYIDDYMRN | 47561 | ISWTYIDDY | 49658 |
| HPV33 | E1 | 572 | WPYLHSRLTVFEFKN | 47562 | LHSRLTVFE | 49659 |
| HPV33 | E1 | 375 | YAQLADSNSNAAAFL | 47563 | LADSNSNAA | 49660 |
| HPV33 | E1 | 257 | YTHLQCLTCDRGIII | 47564 | LQCLTCDRG | 49661 |
| HPV33 | E2 | 1 | ---MEEISARLNAVQ | 47565 | MEEISARLN | 49662 |
| HPV33 | E2 | 178 | AAKYSKTQMWEVHVG | 47566 | YSKTQMWEV | 49663 |
| HPV33 | E2 | 72 | AFQVIELQMALETLS | 47567 | VIELQMALE | 49664 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV33 | E2 | 49 | AKQMGFSHLCHQVVP | 47568 | MGFSHLCHQ | 49665 |
| HPV33 | E2 | 44 | ALLYTAKQMGFSHLC | 47569 | YTAKQMGFS | 49666 |
| HPV33 | E2 | 240 | AQPLTKLFCADPALD | 47570 | LTKLFCADP | 49667 |
| HPV33 | E2 | 58 | CHQVVPSLLASKTKA | 47571 | VVPSLLASK | 49668 |
| HPV33 | E2 | 250 | DPALDNRTARTATNC | 47572 | LDNRTARTA | 49669 |
| HPV33 | E2 | 139 | EIYIIEEDTCTMVTG | 47573 | IIEEDTCTM | 49670 |
| HPV33 | E2 | 16 | EKILDLYEADKTDLP | 47574 | LDLYEADKT | 49671 |
| HPV33 | E2 | 77 | ELQMALETLSKSQYS | 47575 | MALETLSKS | 49672 |
| HPV33 | E2 | 188 | EVHVGGQVIVCPTSI | 47576 | VGGQVIVCP | 49673 |
| HPV33 | E2 | 171 | FKYFKEDAAKYSKTQ | 47577 | FKEDAAKYS | 49674 |
| HPV33 | E2 | 73 | FQVIELQMALETLSK | 47578 | IELQMALET | 49675 |
| HPV33 | E2 | 54 | FSHLCHQVVPSLLAS | 47579 | LCHQVVPSL | 49676 |
| HPV33 | E2 | 192 | GGQVIVCPTSISSNQ | 47580 | VIVCPTSIS | 49677 |
| HPV33 | E2 | 193 | GQVIVCPTSISSNQI | 47581 | IVCPTSISS | 49678 |
| HPV33 | E2 | 59 | HQVVPSLLASKTKAF | 47582 | VPSLLASKT | 49679 |
| HPV33 | E2 | 35 | HWKLIRMECALLYTA | 47583 | LIRMECALL | 49680 |
| HPV33 | E2 | 33 | IEHWKLIRMECALLY | 47584 | WKLIRMECA | 49681 |
| HPV33 | E2 | 158 | IGMYYIHNCEKVYFK | 47585 | YYIHNCEKV | 49682 |
| HPV33 | E2 | 140 | IYIIEEDTCTMVTGK | 47586 | IEEDTCTMV | 49683 |
| HPV33 | E2 | 300 | KELYSSMSSTWHWTS | 47587 | YSSMSSTWH | 49684 |
| HPV33 | E2 | 183 | KTQMWEVHVGGQVIV | 47588 | MWEVHVGGQ | 49685 |
| HPV33 | E2 | 19 | LDLYEADKTDLPSQI | 47589 | YEADKTDLP | 49686 |
| HPV33 | E2 | 102 | LEVWLCEPPKCFKKQ | 47590 | WLCEPPKCF | 49687 |
| HPV33 | E2 | 338 | LGTVKIPPTVQISTG | 47591 | VKIPPTVQI | 49688 |
| HPV33 | E2 | 38 | LIRMECALLYTAKQM | 47592 | MECALLYTA | 49689 |
| HPV33 | E2 | 296 | LKPYKELYSSMSSTW | 47593 | YKELYSSMS | 49690 |
| HPV33 | E2 | 11 | LNAVQEKILDLYEAD | 47594 | VQEKILDLY | 49691 |
| HPV33 | E2 | 243 | LTKLFCADPALDNRT | 47595 | LFCADPALD | 49692 |
| HPV33 | E2 | 321 | NGIVTVTFVTEQQQQ | 47596 | VTVTFVTEQ | 49693 |
| HPV33 | E2 | 30 | PSQIEHWKLIRMECA | 47597 | IEHWKLIRM | 49694 |
| HPV33 | E2 | 199 | PTSISSNQISTTETA | 47598 | ISSNQISTT | 49695 |
| HPV33 | E2 | 335 | QMFLGTVKIPPTVQI | 47599 | LGTVKIPPT | 49696 |
| HPV33 | E2 | 333 | QQQMFLGTVKIPPTV | 47600 | MFLGTVKIP | 49697 |
| HPV33 | E2 | 268 | QRTVCSSNVAPIVHL | 47601 | VCSSNVAPI | 49698 |
| HPV33 | E2 | 99 | QTSLEVWLCEPPKCF | 47602 | LEVWLCEPP | 49699 |
| HPV33 | E2 | 194 | QVIVCPTSISSNQIS | 47603 | VCPTSISSN | 49700 |
| HPV33 | E2 | 94 | QWTLQQTSLEVWLCE | 47604 | LQQTSLEVW | 49701 |
| HPV33 | E2 | 101 | SLEVWLCEPPKCFKK | 47605 | VWLCEPPKC | 49702 |
| HPV33 | E2 | 204 | SNQISTTETADIQTD | 47606 | ISTTETADI | 49703 |
| HPV33 | E2 | 147 | TCTMVTGKVDYIGMY | 47607 | MVTGKVDYI | 49704 |
| HPV33 | E2 | 152 | TGKVDYIGMYYIHNC | 47608 | VDYIGMYYI | 49705 |
| HPV33 | E2 | 70 | TKAFQVIELQMALET | 47609 | FQVIELQMA | 49706 |
| HPV33 | E2 | 244 | TKLFCADPALDNRTA | 47610 | FCADPALDN | 49707 |
| HPV33 | E2 | 92 | TSQWTLQQTSLEVWL | 47611 | WTLQQTSLE | 49708 |
| HPV33 | E2 | 155 | VDYIGMYYIHNCEKV | 47612 | IGMYYIHNC | 49709 |
| HPV33 | E2 | 62 | VPSLLASKTKAFQVI | 47613 | LLASKTKAF | 49710 |
| HPV33 | E2 | 36 | WKLIRMECALLYTAK | 47614 | IRMECALLY | 49711 |
| HPV33 | E2 | 170 | YFKYFKEDAAKYSKT | 47615 | YFKEDAAKY | 49712 |
| HPV33 | E2 | 299 | YKELYSSMSSTWHWT | 47616 | LYSSMSSTW | 49713 |
| HPV33 | E2 | 134 | YTNWGEIYIIEEDTC | 47617 | WGEIYIIEE | 49714 |
| HPV33 | E5 | 1 | ---MIFVFVLCILF | 47618 | MIFVFVLCF | 49715 |
| HPV33 | E5 | 2 | --MIFVFVLCFILFL | 47619 | IFVFVLCFI | 49716 |
| HPV33 | E5 | 3 | -MIFVFVLCFILFLC | 47620 | FVFVLCFIL | 49717 |
| HPV33 | E5 | 33 | AWLLVLVLLLWVFVG | 47621 | LVLVLLLWV | 49718 |
| HPV33 | E5 | 11 | CFILFLCLSLLLRPL | 47622 | LFLCLSLLL | 49719 |
| HPV33 | E5 | 66 | CINFHAQHMTQQE-- | 47623 | FHAQHMTQQ | 49720 |
| HPV33 | E5 | 17 | CLSLLLRPLILSIST | 47624 | LLLRPLILS | 49721 |
| HPV33 | E5 | 55 | CYLLFLYLPMMCINF | 47625 | LFLYLPMMC | 49722 |
| HPV33 | E5 | 54 | FCYLLFLYLPMMCIN | 47626 | LLFLYLPMM | 49723 |
| HPV33 | E5 | 12 | FILFLCLSLLLRPLI | 47627 | FLCLSLLLR | 49724 |
| HPV33 | E5 | 59 | FLYLPMMCINFHAQH | 47628 | LPMMCINFH | 49725 |
| HPV33 | E5 | 6 | FVFVLCFILFLCLSL | 47629 | VLCFILFLC | 49726 |
| HPV33 | E5 | 47 | GSPLKIFFCYLLFLY | 47630 | LKIFFCYLL | 49727 |
| HPV33 | E5 | 5 | IFVFVLCFILFLCLS | 47631 | FVLCFILFL | 49728 |
| HPV33 | E5 | 13 | ILFLCLSLLLRPLIL | 47632 | LCLSLLLRP | 49729 |
| HPV33 | E5 | 29 | ISTYAWLLVLVLLLW | 47633 | YAWLLVLVL | 49730 |
| HPV33 | E5 | 10 | LCFILFLCLSLLLRP | 47634 | ILFLCLSLL | 49731 |
| HPV33 | E5 | 58 | LFLYLPMMCINFHAQ | 47635 | YLPMMCINF | 49732 |
| HPV33 | E5 | 50 | LKIFFCYLLFLYLPM | 47636 | FFCYLLFLY | 49733 |
| HPV33 | E5 | 57 | LLFLYLPMMCINFHA | 47637 | LYLPMMCIN | 49734 |
| HPV33 | E5 | 40 | LLLWVFVGSPLKIFF | 47638 | WVFVGSPLK | 49735 |
| HPV33 | E5 | 41 | LLWVFVGSPLKIFFC | 47639 | VFVGSPLKI | 49736 |
| HPV33 | E5 | 22 | LRPLILSISTYAWLL | 47640 | LILSISTYA | 49737 |
| HPV33 | E5 | 18 | LSLLLRPLILSISTY | 47641 | LLRPLILSI | 49738 |
| HPV33 | E5 | 38 | LVLLLWVFVGSPLKI | 47642 | LLWVFVGSP | 49739 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV33 | E5 | 36 | LVLVLLLWVFVGSPL | 47643 | VLLLWVFVG | 49740 |
| HPV33 | E5 | 42 | LWVFVGSPLKIFFCY | 47644 | FVGSPLKIF | 49741 |
| HPV33 | E5 | 49 | PLKIFFCYLLFLYLP | 47645 | IFFCYLLFL | 49742 |
| HPV33 | E5 | 23 | RPLILSISTYAWLLV | 47646 | ILSISTYAW | 49743 |
| HPV33 | E5 | 19 | SLLLRPLILSISTYA | 47647 | LRPLILSIS | 49744 |
| HPV33 | E5 | 31 | TYAWLLVLVLLLWVF | 47648 | WLLVLVLLL | 49745 |
| HPV33 | E5 | 9 | VLCFILFLCLSLLLR | 47649 | FILFLCLSL | 49746 |
| HPV33 | E5 | 34 | WLLVLVLLLWVFVGS | 47650 | VLVLLLWVF | 49747 |
| HPV33 | E5 | 32 | YAWLLVLVLLLWVFV | 47651 | LLVLVLLLW | 49748 |
| HPV33 | E5 | 56 | YLLFLYLPMMCINFH | 47652 | FLYLPMMCI | 49749 |
| HPV33 | E6 | 69 | CLRFLSKISEYRHYN | 47653 | FLSKISEYR | 49750 |
| HPV33 | E6 | 47 | DFAFADLTVVYREGN | 47654 | FADLTVVYR | 49751 |
| HPV33 | E6 | 101 | EILIRCIICQRPLCP | 47655 | IRCIICQRP | 49752 |
| HPV33 | E6 | 23 | ETTIHNIELQCVECK | 47656 | IHNIELQCV | 49753 |
| HPV33 | E6 | 128 | FHNISGRWAGRCAAC | 47657 | ISGRWAGRC | 49754 |
| HPV33 | E6 | 60 | GNPFGICKLCLRFLS | 47658 | FGICKLCLR | 49755 |
| HPV33 | E6 | 65 | ICKLCLRFLSKISEY | 47659 | LCLRFLSKI | 49756 |
| HPV33 | E6 | 26 | IHNIELQCVECKKPL | 47660 | IELQCVECK | 49757 |
| HPV33 | E6 | 104 | IRCIICQRPLCPQEK | 47661 | IICQRPLCP | 49758 |
| HPV33 | E6 | 96 | KKPLNEILIRCIICQ | 47662 | LNEILIRCI | 49759 |
| HPV33 | E6 | 37 | KKPLQRSEVYDFAFA | 47663 | LQRSEVYDF | 49760 |
| HPV33 | E6 | 99 | LNEILIRCIICQRPL | 47664 | ILIRCIICQ | 49761 |
| HPV33 | E6 | 31 | LQCVECKKPLQRSEV | 47665 | VECKKPLQR | 49762 |
| HPV33 | E6 | 100 | NEILIRCIICQRPLC | 47666 | LIRCIICQR | 49763 |
| HPV33 | E6 | 28 | NIELQCVECKKPLQR | 47667 | LQCVECKKP | 49764 |
| HPV33 | E6 | 83 | NYSVYGNTLEQTVKK | 47668 | VYGNTLEQT | 49765 |
| HPV33 | E6 | 62 | PFGICKLCLRFLSKI | 47669 | ICKLCLRFL | 49766 |
| HPV33 | E6 | 105 | RCIICQRPLCPQEKK | 47670 | ICQRPLCPQ | 49767 |
| HPV33 | E6 | 43 | SEVYDFAFADLTVVY | 47671 | YDFAFADLT | 49768 |
| HPV33 | E6 | 132 | SGRWAGRCAACWRSR | 47672 | WAGRCAACW | 49769 |
| HPV33 | E6 | 54 | TVVYREGNPFGICKL | 47673 | YREGNPFGI | 49770 |
| HPV33 | E6 | 45 | VYDFAFADLTVVYRE | 47674 | FAFADLTVV | 49771 |
| HPV33 | E7 | 1 | ---MRGHKPTLKEYV | 47675 | MRGHKPTLK | 49772 |
| HPV33 | E7 | 53 | ADYYIVTCCHTCNTT | 47676 | YIVTCCHTC | 49773 |
| HPV33 | E7 | 82 | IQQLLMGTVNIVCPT | 47677 | LLMGTVNIV | 49774 |
| HPV33 | E7 | 12 | KEYVLDLYPEPTDLY | 47678 | VLDLYPEPT | 49775 |
| HPV33 | E7 | 8 | KPTLKEYVLDLYPEP | 47679 | LKEYVLDLY | 49776 |
| HPV33 | E7 | 79 | LRTIQQLLMGTVNIV | 47680 | IQQLLMGTV | 49777 |
| HPV33 | E7 | 87 | MGTVNIVCPTCAQQ- | 47681 | VNIVCPTCA | 49778 |
| HPV33 | E7 | 84 | QLLMGTVNIVCPTCA | 47682 | MGTVNIVCP | 49779 |
| HPV33 | E7 | 69 | RLCVNSTASDLRTIQ | 47683 | VNSTASDLR | 49780 |
| HPV33 | E7 | 52 | TADYYIVTCCHTCNT | 47684 | YYIVTCCHT | 49781 |
| HPV33 | E7 | 23 | TDLYCYEQLSDSSDE | 47685 | YCYEQLSDS | 49782 |
| HPV33 | E7 | 89 | TVNIVCPTCAQQ--- | 47686 | IVCPTCAQQ | 49783 |
| HPV33 | E7 | 67 | TVRLCVNSTASDLRT | 47687 | LCVNSTASD | 49784 |
| HPV33 | E7 | 15 | VLDLYPEPTDLYCYE | 47688 | LYPEPTDLY | 49785 |
| HPV33 | E7 | 55 | YYIVTCCHTCNTTVR | 47689 | VTCCHTCNT | 49786 |
| HPV33 | L1 | 1 | ---MSVWRPSEATVY | 47690 | MSVWRPSEA | 49787 |
| HPV33 | L1 | 387 | AEVMTYIHAMNPDIL | 47691 | MTYIHAMNP | 49788 |
| HPV33 | L1 | 267 | AGTLGEAVPDDLYIK | 47692 | LGEAVPDDL | 49789 |
| HPV33 | L1 | 61 | AKKLLVPKVSGLQYR | 47693 | LLVPKVSGL | 49790 |
| HPV33 | L1 | 12 | ATVYLPPVPVSKVVS | 47694 | YLPPVPVSK | 49791 |
| HPV33 | L1 | 150 | CLSMDYKQTQLCLLG | 47695 | MDYKQTQLC | 49792 |
| HPV33 | L1 | 210 | CMDFKTLQANKSDVP | 47696 | FKTLQANKS | 49793 |
| HPV33 | L1 | 188 | CPPLELINTIIEDGD | 47697 | LELINTIIE | 49794 |
| HPV33 | L1 | 348 | CTQVTSDSTYKNENF | 47698 | VTSDSTYKN | 49795 |
| HPV33 | L1 | 28 | DEYVSRTSIYYYAGS | 47699 | VSRTSIYYY | 49796 |
| HPV33 | L1 | 373 | DLQFVFQLCKVTLTA | 47700 | FVFQLCKVT | 49797 |
| HPV33 | L1 | 277 | DLYIKGSGTTASIQS | 47701 | IKGSGTTAS | 49798 |
| HPV33 | L1 | 91 | DTSFYNPDTQRLVWA | 47702 | FYNPDTQRL | 49799 |
| HPV33 | L1 | 222 | DVPIDICGSTCKYPD | 47703 | IDICGSTCK | 49800 |
| HPV33 | L1 | 403 | DWQFGLTPPPSASLQ | 47704 | FGLTPPPSA | 49801 |
| HPV33 | L1 | 11 | EATVYLPPVPVSKVV | 47705 | VYLPPVPVS | 49802 |
| HPV33 | L1 | 450 | EVDLKEKFSADLDQF | 47706 | LKEKFSADL | 49803 |
| HPV33 | L1 | 250 | FFFLRREQMFVRHFF | 47707 | LRREQMFVR | 49804 |
| HPV33 | L1 | 208 | FGCMDFKTLQANKSD | 47708 | MDFKTLQAN | 49805 |
| HPV33 | L1 | 213 | FKTLQANKSDVPIDI | 47709 | LQANKSDVP | 49806 |
| HPV33 | L1 | 170 | GEHWGKGVACTNAAP | 47710 | WGKGVACTN | 49807 |
| HPV33 | L1 | 174 | GKGVACTNAAPANDC | 47711 | VACTNAAPA | 49808 |
| HPV33 | L1 | 108 | GLEIGRGQPLGVGIS | 47712 | IGRGQPLGV | 49809 |
| HPV33 | L1 | 71 | GLQYRVFRVRLPDPN | 47713 | YRVFRVRLP | 49810 |
| HPV33 | L1 | 329 | GNQVFVTVVDTTRST | 47714 | VFVTVVDTT | 49811 |
| HPV33 | L1 | 114 | GQPLGVGISGHPLLN | 47715 | LGVGISGHP | 49812 |
| HPV33 | L1 | 118 | GVGISGHPLLNKFDD | 47716 | ISGHPLLNK | 49813 |
| HPV33 | L1 | 50 | HPYFSIKNPTNAKKL | 47717 | FSIKNPTNA | 49814 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV33 | L1 | 393 | IHAMNPDILEDWQFG | 47718 | MNPDILEDW | 49815 |
| HPV33 | L1 | 366 | IRHVEEYDLQFVFQL | 47719 | VEEYDLQFV | 49816 |
| HPV33 | L1 | 62 | KKLLVPKVSGLQYRV | 47720 | LVPKVSGLQ | 49817 |
| HPV33 | L1 | 479 | KPKLKRAAPTSTRTS | 47721 | LKRAAPTST | 49818 |
| HPV33 | L1 | 220 | KSDVPIDICGSTCKY | 47722 | VPIDICGST | 49819 |
| HPV33 | L1 | 382 | KVTLTAEVMTYIHAM | 47723 | LTAEVMTYI | 49820 |
| HPV33 | L1 | 445 | KYTFWEVDLKEKFSA | 47724 | FWEVDLKEK | 49821 |
| HPV33 | L1 | 160 | LCLLGCKPPTGEHWG | 47725 | LGCKPPTGE | 49822 |
| HPV33 | L1 | 401 | LEDWQFGLTPPPSAS | 47726 | WQFGLTPPP | 49823 |
| HPV33 | L1 | 443 | LGKYTFWEVDLKEKF | 47727 | YTFWEVDLK | 49824 |
| HPV33 | L1 | 127 | LNKFDDTETGNKYPG | 47728 | FDDTETGNK | 49825 |
| HPV33 | L1 | 16 | LPPVPVSKVVSTDEY | 47729 | VPVSKVVST | 49826 |
| HPV33 | L1 | 4 | MSVWRPSEATVYLPP | 47730 | WRPSEATVY | 49827 |
| HPV33 | L1 | 390 | MTYIHAMNPDILEDW | 47731 | IHAMNPDIL | 49828 |
| HPV33 | L1 | 311 | NKPYWLQRAQGHNNG | 47732 | YWLQRAQGH | 49829 |
| HPV33 | L1 | 344 | NMTLCTQVTSDSTYK | 47733 | LCTQVTSDS | 49830 |
| HPV33 | L1 | 195 | NTIIEDGDMVDTGFG | 47734 | IEDGDMVDT | 49831 |
| HPV33 | L1 | 275 | PDDLYIKGSGTTASI | 47735 | LYIKGSGTT | 49832 |
| HPV33 | L1 | 224 | PIDICGSTCKYPDYL | 47736 | ICGSTCKYP | 49833 |
| HPV33 | L1 | 190 | PLELINTIIEDGDMV | 47737 | LINTIIEDG | 49834 |
| HPV33 | L1 | 84 | PNKFGFPDTSFYNPD | 47738 | FGFPDTSFY | 49835 |
| HPV33 | L1 | 18 | PVPVSKVVSTDEYVS | 47739 | VSKVVSTDE | 49836 |
| HPV33 | L1 | 417 | QDTYRFVTSQAITCQ | 47740 | YRFVTSQAI | 49837 |
| HPV33 | L1 | 405 | QFGLTPPPSASLQDT | 47741 | LTPPPSASL | 49838 |
| HPV33 | L1 | 463 | QFPLGRKFLLQAGLK | 47742 | LGRKFLLQA | 49839 |
| HPV33 | L1 | 375 | QFVFQLCKVTLTAEV | 47743 | FQLCKVTLT | 49840 |
| HPV33 | L1 | 159 | QLCLLGCKPPTGEHW | 47744 | LLGCKPPTG | 49841 |
| HPV33 | L1 | 157 | QTQLCLLGCKPPTGE | 47745 | LCLLGCKPP | 49842 |
| HPV33 | L1 | 331 | QVFVTVVDTTRSTNM | 47746 | VTVVDTTRS | 49843 |
| HPV33 | L1 | 73 | QYRVFRVRLPDPNKF | 47747 | VFRVRLPDP | 49844 |
| HPV33 | L1 | 261 | RHFFNRAGTLGEAVP | 47748 | FNRAGTLGE | 49845 |
| HPV33 | L1 | 468 | RKFLLQAGLKAKPKL | 47749 | LLQAGLKAK | 49846 |
| HPV33 | L1 | 101 | RLVWACVGLEIGRGQ | 47750 | WACVGLEIG | 49847 |
| HPV33 | L1 | 458 | SADLDQFPLGRKFLL | 47751 | LDQFPLGRK | 49848 |
| HPV33 | L1 | 299 | SGSMVTSESQLFNKP | 47752 | MVTSESQLF | 49849 |
| HPV33 | L1 | 35 | SIYYYAGSSRLLAVG | 47753 | YYAGSSRLL | 49850 |
| HPV33 | L1 | 152 | SMDYKQTQLCLLGCK | 47754 | YKQTQLCLL | 49851 |
| HPV33 | L1 | 425 | SQAITCQKTVPPKEK | 47755 | ITCQKTVPP | 49852 |
| HPV33 | L1 | 43 | SRLLAVGHPYFSIKN | 47756 | LAVGHPYFS | 49853 |
| HPV33 | L1 | 291 | SSAFFPTPSGSMVTS | 47757 | FFPTPSGSM | 49854 |
| HPV33 | L1 | 27 | TDEYVSRTSIYYYAG | 47758 | YVSRTSIYY | 49855 |
| HPV33 | L1 | 99 | TQRLVWACVGLEIGR | 47759 | LVWACVGLE | 49856 |
| HPV33 | L1 | 34 | TSIYYYAGSSRLLAV | 47760 | YYYAGSSRL | 49857 |
| HPV33 | L1 | 13 | TVYLPPVPVSKVVST | 47761 | LPPVPVSKV | 49858 |
| HPV33 | L1 | 419 | TYRFVTSQAITCQKT | 47762 | FVTSQAITC | 49859 |
| HPV33 | L1 | 369 | VEEYDLQFVFQLCKV | 47763 | YDLQFVFQL | 49860 |
| HPV33 | L1 | 377 | VFQLCKVTLTAEVMT | 47764 | LCKVTLTAE | 49861 |
| HPV33 | L1 | 76 | VFRVRLPDPNKFGFP | 47765 | VRLPDPNKF | 49862 |
| HPV33 | L1 | 334 | VTVVDTTRSTNMTLC | 47766 | VDTTRSTNM | 49863 |
| HPV33 | L1 | 234 | YPDYLKMTSEPYGDS | 47767 | YLKMTSEPY | 49864 |
| HPV33 | L1 | 420 | YRFVTSQAITCQKTV | 47768 | VTSQAITCQ | 49865 |
| HPV33 | L1 | 74 | YRVFRVRLPDPNKFG | 47769 | FRVRLPDPN | 49866 |
| HPV33 | L2 | 1 | ---MRHKRSTRRKRA | 47770 | MRHKRSTRR | 49867 |
| HPV33 | L2 | 370 | ADDVDNVHTPMQHSY | 47771 | VDNVHTPMQ | 49868 |
| HPV33 | L2 | 44 | ADQILKYGSLGVFFG | 47772 | ILKYGSLGV | 49869 |
| HPV33 | L2 | 85 | AIPLQPIRPPVTVDT | 47773 | LQPIRPPVT | 49870 |
| HPV33 | L2 | 281 | DPDFLDIIALHRPAI | 47774 | FLDIIALHR | 49871 |
| HPV33 | L2 | 45 | DQILKYGSLGVFFGG | 47775 | LKYGSLGVF | 49872 |
| HPV33 | L2 | 202 | DTFVVSTDSSNVTSS | 47776 | VVSTDSSNV | 49873 |
| HPV33 | L2 | 266 | EDTLQFQHSDISPAP | 47777 | LQFQHSDIS | 49874 |
| HPV33 | L2 | 168 | EPSVLHPPAPAEASG | 47778 | VLHPPAPAE | 49875 |
| HPV33 | L2 | 152 | ESSIQTISTHLNPTF | 47779 | IQTISTHLN | 49876 |
| HPV33 | L2 | 113 | ETSFIEAGAPAPSIP | 47780 | FIEAGAPAP | 49877 |
| HPV33 | L2 | 433 | FDTIVVDGADFVLHP | 47781 | IVVDGADFV | 49878 |
| HPV33 | L2 | 260 | FESFDPEDTLQFQHS | 47782 | FDPEDTLQF | 49879 |
| HPV33 | L2 | 430 | FFPFDTIVVDGADFV | 47783 | FDTIVVDGA | 49880 |
| HPV33 | L2 | 304 | FSRVGKATLKTRSG | 47784 | VGQKATLKT | 49881 |
| HPV33 | L2 | 424 | FVPISPFFPFDTIVV | 47785 | ISPFFPFDT | 49882 |
| HPV33 | L2 | 440 | GADFVLHPSYFILRR | 47786 | FVLHPSYFI | 49883 |
| HPV33 | L2 | 182 | GHFIFSSPTVSTQSY | 47787 | IFSSPTVST | 49884 |
| HPV33 | L2 | 40 | GSTIADQILKYGSLG | 47788 | IADQILKYG | 49885 |
| HPV33 | L2 | 54 | GVFFGGLGIGTGSGS | 47789 | FGGLGIGTG | 49886 |
| HPV33 | L2 | 183 | HFIFSSPTVSTQSYE | 47790 | FSSPTVSTQ | 49887 |
| HPV33 | L2 | 250 | HKLITYDNPAFESFD | 47791 | ITYDNPAFE | 49888 |
| HPV33 | L2 | 377 | HTPMQHSYSTFATTR | 47792 | MQHSYSTFA | 49889 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV33 | L2 | 325 | IHYYQDLSPIVPLDH | 47793 | YQDLSPIVP | 49890 |
| HPV33 | L2 | 287 | IIALHRPAITSRRHT | 47794 | LHRPAITSR | 49891 |
| HPV33 | L2 | 47 | ILKYGSLGVFFGGLG | 47795 | YGSLGVFFG | 49892 |
| HPV33 | L2 | 35 | IPKVEGSTIADQILK | 47796 | VEGSTIADQ | 49893 |
| HPV33 | L2 | 427 | ISPFFPFDTIVVDGA | 47797 | FFPFDTIVV | 49894 |
| HPV33 | L2 | 334 | IVPLDHTVPNEQYEL | 47798 | LDHTVPNEQ | 49895 |
| HPV33 | L2 | 107 | IVSLIEETSFIEAGA | 47799 | LIEETSFIE | 49896 |
| HPV33 | L2 | 285 | LDIIALHRPAITSRR | 47800 | IALHRPAIT | 49897 |
| HPV33 | L2 | 88 | LQPIRPPVTVDTVGP | 47801 | IRPPVTVDT | 49898 |
| HPV33 | L2 | 348 | LQPLHDTSTSSYSIN | 47802 | LHDTSTSSY | 49899 |
| HPV33 | L2 | 365 | LYDVYADDVDNVHTP | 47803 | VYADDVDNV | 49900 |
| HPV33 | L2 | 362 | NDGLYDVYADDVDNV | 47804 | LYDVYADDV | 49901 |
| HPV33 | L2 | 343 | NEQYELQPLHDTSTS | 47805 | YELQPLHDT | 49902 |
| HPV33 | L2 | 198 | NIPMDTFVVSTDSSN | 47806 | MDTFVVSTD | 49903 |
| HPV33 | L2 | 257 | NPAFESFDPEDTLQF | 47807 | FESFDPEDT | 49904 |
| HPV33 | L2 | 163 | NPTFTEPSVLHPPAP | 47808 | FTEPSVLHP | 49905 |
| HPV33 | L2 | 400 | NTGFDTPVMSGPDIP | 47809 | FDTPVMSGP | 49906 |
| HPV33 | L2 | 142 | PAIINVSSVGESSIQ | 47810 | INVSSVGES | 49907 |
| HPV33 | L2 | 282 | PDFLDIIALHRPAIT | 47811 | LDIIALHRP | 49908 |
| HPV33 | L2 | 129 | PSGFDVTTSADTTPA | 47812 | FDVTTSADT | 49909 |
| HPV33 | L2 | 414 | PSPLFPTSSPFVPIS | 47813 | LFPTSSPFV | 49910 |
| HPV33 | L2 | 169 | PSVLHPPAPAEASGH | 47814 | LHPPAPAEA | 49911 |
| HPV33 | L2 | 94 | PVTVDTVGPLDSSIV | 47815 | VDTVGPLDS | 49912 |
| HPV33 | L2 | 381 | QHSYSTFATTRTSNV | 47816 | YSTFATTRT | 49913 |
| HPV33 | L2 | 458 | RFPYFFTDVRVAA-- | 47817 | YFFTDVRVA | 49914 |
| HPV33 | L2 | 299 | RHTVRFSRVGQKATL | 47818 | VRFSRVGQK | 49915 |
| HPV33 | L2 | 324 | RIHYYQDLSPIVPLD | 47819 | YYQDLSPIV | 49916 |
| HPV33 | L2 | 456 | RKRFPYFFTDVRVAA | 47820 | FPYFFTDVR | 49917 |
| HPV33 | L2 | 227 | RLGLYSRNTQQVKVV | 47821 | LYSRNTQQV | 49918 |
| HPV33 | L2 | 92 | RPPVTVDTVGPLDSS | 47822 | VTVDTVGPL | 49919 |
| HPV33 | L2 | 71 | RTGYVPIGTDPPTAA | 47823 | YVPIGTDPP | 49920 |
| HPV33 | L2 | 181 | SGHFIFSSPTVSTQS | 47824 | FIFSSPTVS | 49921 |
| HPV33 | L2 | 52 | SLGVFFGGLGIGTGS | 47825 | VFFGGLGIG | 49922 |
| HPV33 | L2 | 428 | SPFFPFDTIVVDGAD | 47826 | FPFDTIVVD | 49923 |
| HPV33 | L2 | 332 | SPIVPLDHTVPNEQY | 47827 | VPLDHTVPN | 49924 |
| HPV33 | L2 | 415 | SPLFPTSSPFVPISP | 47828 | FPTSSPFVP | 49925 |
| HPV33 | L2 | 222 | SRPVARLGLYSRNTQ | 47829 | VARLGLYSR | 49926 |
| HPV33 | L2 | 210 | SSNVTSSTPIPGSRP | 47830 | VTSSTPIPG | 49927 |
| HPV33 | L2 | 421 | SSPFVPISPFFPFDT | 47831 | FVPISPFFP | 49928 |
| HPV33 | L2 | 159 | STHLNPTFTEPSVLH | 47832 | LNPTFTEPS | 49929 |
| HPV33 | L2 | 216 | STPIPGSRPVARLGL | 47833 | IPGSRPVAR | 49930 |
| HPV33 | L2 | 83 | TAAIPLQPIRPPVTV | 47834 | IPLQPIRPP | 49931 |
| HPV33 | L2 | 203 | TFVVSTDSSNVTSST | 47835 | VSTDSSNVT | 49932 |
| HPV33 | L2 | 268 | TLQFQHSDISPAPDP | 47836 | FQHSDISPA | 49933 |
| HPV33 | L2 | 141 | TPAIINVSSVGESSI | 47837 | IINVSSVGE | 49934 |
| HPV33 | L2 | 405 | TPVMSGPDIPSPLFP | 47838 | MSGPDIPSP | 49935 |
| HPV33 | L2 | 18 | TQLYQTCKATGTCPP | 47839 | YQTCKATGT | 49936 |
| HPV33 | L2 | 235 | TQQVKVVDPAFLTSP | 47840 | VKVVDPAFL | 49937 |
| HPV33 | L2 | 193 | TQSYENIPMDTFVVS | 47841 | YENIPMDTF | 49938 |
| HPV33 | L2 | 114 | TSFIEAGAPAPSIPT | 47842 | IEAGAPAPS | 49939 |
| HPV33 | L2 | 97 | VDTVGPLDSSIVSLI | 47843 | VGPLDSSIV | 49940 |
| HPV33 | L2 | 100 | VGPLDSSIVSLIEET | 47844 | LDSSIVSLI | 49941 |
| HPV33 | L2 | 238 | VKVVDPAFLTSPHKL | 47845 | VDPAFLTSP | 49942 |
| HPV33 | L2 | 147 | VSSVGESSIQTISTH | 47846 | VGESSIQTI | 49943 |
| HPV33 | L2 | 328 | YQDLSPIVPLDHTVP | 47847 | LSPIVPLDH | 49944 |
| HPV33 | L2 | 384 | YSTFATTRTSNVSIP | 47848 | FATTRTSNV | 49945 |
| HPV33 | L2 | 74 | YVPIGTDPPTAAIPL | 47849 | IGTDPPTAA | 49946 |
| HPV45 | E1 | 385 | AAAFLKSNCQAKYLK | 47850 | FLKSNCQAK | 49947 |
| HPV45 | E1 | 178 | AENVDPHCSITELKE | 47851 | VDPHCSITE | 49948 |
| HPV45 | E1 | 395 | AKYLKDCAVMCRHYK | 47852 | LKDCAVMCR | 49949 |
| HPV45 | E1 | 314 | ALYWYRTGISNISEV | 47853 | WYRTGISNI | 49950 |
| HPV45 | E1 | 254 | ATLYAHIQCLDCKWG | 47854 | YAHIQCLDC | 49951 |
| HPV45 | E1 | 300 | CMLIEPPKLRSSVAA | 47855 | IEPPKLRSS | 49952 |
| HPV45 | E1 | 17 | CNGWFFVETIVEKKT | 47856 | WFFVETIVE | 49953 |
| HPV45 | E1 | 142 | CSEVEAAETQVTVNT | 47857 | VEAAETQVT | 49954 |
| HPV45 | E1 | 524 | CWTYFDNYMRNALDG | 47858 | YFDNYMRNA | 49955 |
| HPV45 | E1 | 264 | DCKWGVLILALLRYK | 47859 | WGVLILALL | 49956 |
| HPV45 | E1 | 370 | DMAFQYAQLADCNSN | 47860 | FQYAQLADC | 49957 |
| HPV45 | E1 | 569 | DNKWPYLESRVTVFT | 47861 | WPYLESRVT | 49958 |
| HPV45 | E1 | 137 | DSGYGCSEVEAAETQ | 47862 | YGCSEVEAA | 49959 |
| HPV45 | E1 | 348 | DSNFDLSDMVQWAFD | 47863 | FDLSDMVQW | 49960 |
| HPV45 | E1 | 231 | DWVMAIFGVNPTVAE | 47864 | MAIFGVNPT | 49961 |
| HPV45 | E1 | 610 | ERTWSRLDLHEDDED | 47865 | WSRLDLHED | 49962 |
| HPV45 | E1 | 368 | ESDMAFQYAQLADCN | 47866 | MAFQYAQLA | 49963 |
| HPV45 | E1 | 298 | ETCMLIEPPKLRSSV | 47867 | MLIEPPKLR | 49964 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV45 | E1 | 528 | FDNYMRNALDGNPIS | 47868 | YMRNALDGN | 49965 |
| HPV45 | E1 | 486 | FIHFLQGAIISFVNS | 47869 | FLQGAIISF | 49966 |
| HPV45 | E1 | 635 | FKCVTGQNTRPL--- | 47870 | VTGQNTRPL | 49967 |
| HPV45 | E1 | 247 | FKTLIKPATLYAHIQ | 47871 | LIKPATLYA | 49968 |
| HPV45 | E1 | 492 | GAIISFVNSNSHFWL | 47872 | ISFVNSNSH | 49969 |
| HPV45 | E1 | 161 | GGSVHSTQSSGGDSS | 47873 | VHSTQSSGG | 49970 |
| HPV45 | E1 | 629 | GIPFGTFKCVTGQNT | 47874 | FGTFKCVTG | 49971 |
| HPV45 | E1 | 19 | GWFFVETIVEKKTGD | 47875 | FVETIVEKK | 49972 |
| HPV45 | E1 | 547 | HKPLLQLKCPPILLT | 47876 | LLQLKCPPI | 49973 |
| HPV45 | E1 | 236 | IFGVNPTVAEGFKTL | 47877 | VNPTVAEGF | 49974 |
| HPV45 | E1 | 487 | IHFLQGAIISFVNSN | 47878 | LQGAIISFV | 49975 |
| HPV45 | E1 | 494 | IISFVNSNSHFWLEP | 47879 | FVNSNSHFW | 49976 |
| HPV45 | E1 | 271 | ILALLRYKCGKNRLT | 47880 | LLRYKCGKN | 49977 |
| HPV45 | E1 | 469 | ILLYGPANTGKSYFG | 47881 | YGPANTGKS | 49978 |
| HPV45 | E1 | 325 | ISEVSGDTPEWIQRL | 47882 | VSGDTPEWI | 49979 |
| HPV45 | E1 | 210 | IYGLSFTDLVRNFKS | 47883 | LSFTDLVRN | 49980 |
| HPV45 | E1 | 606 | KCFFERTWSRLDLHE | 47884 | FERTWSRLD | 49981 |
| HPV45 | E1 | 208 | KDIYGLSFTDLVRNF | 47885 | YGLSFTDLV | 49982 |
| HPV45 | E1 | 466 | KNCILLYGPANTGKS | 47886 | ILLYGPANT | 49983 |
| HPV45 | E1 | 548 | KPLLQLKCPPILLTS | 47887 | LQLKCPPIL | 49984 |
| HPV45 | E1 | 479 | KSYFGMSFIHFLQGA | 47888 | FGMSFIHFL | 49985 |
| HPV45 | E1 | 248 | KTLIKPATLYAHIQC | 47889 | IKPATLYAH | 49986 |
| HPV45 | E1 | 513 | KVAMLDDATHTCWTY | 47890 | MLDDATHTC | 49987 |
| HPV45 | E1 | 266 | KWGVLILALLRYKCG | 47891 | VLILALLRY | 49988 |
| HPV45 | E1 | 571 | KWPYLESRVTVFTFP | 47892 | YLESRVTVF | 49989 |
| HPV45 | E1 | 506 | LEPLADTKVAMLDDA | 47893 | LADTKVAML | 49990 |
| HPV45 | E1 | 85 | LHLLKRKFAGGSKEN | 47894 | LKRKFAGGS | 49991 |
| HPV45 | E1 | 456 | LKEFLKGTPKKNCIL | 47895 | FLKGTPKKN | 49992 |
| HPV45 | E1 | 293 | LLHVPETCMLIEPPK | 47896 | VPETCMLIE | 49993 |
| HPV45 | E1 | 550 | LLQLKCPPILLTSNI | 47897 | LKCPPILLT | 49994 |
| HPV45 | E1 | 315 | LYWYRTGISNISEVS | 47898 | YRTGISNIS | 49995 |
| HPV45 | E1 | 234 | MAIFGVNPTVAEGFK | 47899 | FGVNPTVAE | 49996 |
| HPV45 | E1 | 418 | MSQWIKYRCSKIDEG | 47900 | WIKYRCSKI | 49997 |
| HPV45 | E1 | 50 | MVDFIDTQLSICEQA | 47901 | FIDTQLSIC | 49998 |
| HPV45 | E1 | 467 | NCILLYGPANTGKSY | 47902 | LLYGPANTG | 49999 |
| HPV45 | E1 | 18 | NGWFFVETIVEKKTG | 47903 | FFVETIVEK | 50000 |
| HPV45 | E1 | 501 | NSHFWLEPLADTKVA | 47904 | FWLEPLADT | 50001 |
| HPV45 | E1 | 99 | NSPLGEQLSVDTDLS | 47905 | LGEQLSVDT | 50002 |
| HPV45 | E1 | 333 | PEWIQRLTIIQHGID | 47906 | IQRLTIIQH | 50003 |
| HPV45 | E1 | 556 | PPILLTSNIDPAKDN | 47907 | LLTSNIDPA | 50004 |
| HPV45 | E1 | 305 | PPKLRSSVAALYWYR | 47908 | LRSSVAALY | 50005 |
| HPV45 | E1 | 394 | QAKYLKDCAVMCRHY | 47909 | YLKDCAVMC | 50006 |
| HPV45 | E1 | 70 | QALFHAQEVQNDAQV | 47910 | FHAQEVQND | 50007 |
| HPV45 | E1 | 105 | QLSVDTDLSPRLQEI | 47911 | VDTDLSPRL | 50008 |
| HPV45 | E1 | 358 | QWAFDNDLTDESDMA | 47912 | FDNDLTDES | 50009 |
| HPV45 | E1 | 338 | RLTIIQHGIDDSNFD | 47913 | IIQHGIDDS | 50010 |
| HPV45 | E1 | 283 | RLTVAKGLSTLLHVP | 47914 | VAKGLSTLL | 50011 |
| HPV45 | E1 | 533 | RNALDGNPISIDRKH | 47915 | LDGNPISID | 50012 |
| HPV45 | E1 | 130 | RRLFTISDSGYGCSE | 47916 | FTISDSGYG | 50013 |
| HPV45 | E1 | 48 | SDMVDFIDTQLSICE | 47917 | VDFIDTQLS | 50014 |
| HPV45 | E1 | 502 | SHFWLEPLADTKVAM | 47918 | WLEPLADTK | 50015 |
| HPV45 | E1 | 113 | SPRLQEISLNSGHKK | 47919 | LQEISLNSG | 50016 |
| HPV45 | E1 | 419 | SQWIKYRCSKIDEGG | 47920 | IKYRCSKID | 50017 |
| HPV45 | E1 | 291 | STLLHVPETCMLIEP | 47921 | LHVPETCML | 50018 |
| HPV45 | E1 | 216 | TDLVRNFKSDKTTCT | 47922 | VRNFKSDKT | 50019 |
| HPV45 | E1 | 332 | TPEWIQRLTIIQHGI | 47923 | WIQRLTIIQ | 50020 |
| HPV45 | E1 | 312 | VAALYWYRTGISNIS | 47924 | LYWYRTGIS | 50021 |
| HPV45 | E1 | 51 | VDFIDTQLSICEQAE | 47925 | IDTQLSICE | 50022 |
| HPV45 | E1 | 447 | VEFISFLRALKEFLK | 47926 | ISFLRALKE | 50023 |
| HPV45 | E1 | 23 | VETIVEKKTGDVISD | 47927 | IVEKKTGDV | 50024 |
| HPV45 | E1 | 581 | VFTFPHAFPFDKNGN | 47928 | FPHAFPFDK | 50025 |
| HPV45 | E1 | 233 | VMAIFGVNPTVAEGF | 47929 | IFGVNPTVA | 50026 |
| HPV45 | E1 | 439 | VQFLRYQGVEFISFL | 47930 | LRYQGVEFI | 50027 |
| HPV45 | E1 | 219 | VRNFKSDKTTCTDWV | 47931 | FKSDKTTCT | 50028 |
| HPV45 | E1 | 579 | VTVFTFPHAFPFDKN | 47932 | FTFPHAFPF | 50029 |
| HPV45 | E1 | 267 | WGVLILALLRYKCGK | 47933 | LILALLRYK | 50030 |
| HPV45 | E1 | 421 | WIKYRCSKIDEGGDW | 47934 | YRCSKIDEG | 50031 |
| HPV45 | E1 | 572 | WPYLESRVTVFTFPH | 47935 | LESRVTVFT | 50032 |
| HPV45 | E1 | 257 | YAHIQCLDCKWGVLI | 47936 | IQCLDCKWG | 50033 |
| HPV45 | E1 | 375 | YAQLADCNSAAAFL | 47937 | LADCNSAA | 50034 |
| HPV45 | E2 | 1 | ---MKMQTPKESLSE | 47938 | MKMQTPKES | 50035 |
| HPV45 | E2 | 159 | AACVSYWGVYYIKDG | 47939 | VSYWGVYYI | 50036 |
| HPV45 | E2 | 317 | ADHYSEISSTWHWTG | 47940 | YSEISSTWH | 50037 |
| HPV45 | E2 | 107 | CEELWNTEPSQCFKK | 47941 | LWNTEPSQC | 50038 |
| HPV45 | E2 | 185 | CEKYGNSNTWEVQYG | 47942 | YGNSNTWEV | 50039 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV45 | E2 | 137 | CMNYVVWDSIYYITE | 47943 | YVVWDSIYY | 50040 |
| HPV45 | E2 | 214 | DDTVSATQIVRQLQH | 47944 | VSATQIVRQ | 50041 |
| HPV45 | E2 | 144 | DSIYYITETGIWDKT | 47945 | YYITETGIW | 50042 |
| HPV45 | E2 | 108 | EELWNTEPSQCFKKG | 47946 | WNTEPSQCF | 50043 |
| HPV45 | E2 | 83 | ELQMALKGLAQSKYN | 47947 | MALKGLAQS | 50044 |
| HPV45 | E2 | 151 | ETGIWDKTAACVSYW | 47948 | IWDKTAACV | 50045 |
| HPV45 | E2 | 195 | EVQYGGNVIDCNDSM | 47949 | YGGNVIDCN | 50046 |
| HPV45 | E2 | 200 | GNVIDCNDSMCSTSD | 47950 | IDCNDSMCS | 50047 |
| HPV45 | E2 | 79 | HKAIELQMALKGLAQ | 47951 | IELQMALKG | 50048 |
| HPV45 | E2 | 272 | HNPLLCSSTSNNKRR | 47952 | LLCSSTSNN | 50049 |
| HPV45 | E2 | 65 | HQVVPPINISKSKAH | 47953 | VPPINISKS | 50050 |
| HPV45 | E2 | 39 | ISYWQLIRLENAILF | 47954 | WQLIRLENA | 50051 |
| HPV45 | E2 | 60 | ITKLNHQVVPPINIS | 47955 | LNHQVVPPI | 50052 |
| HPV45 | E2 | 146 | IYYITETGIWDKTAA | 47956 | ITETGIWDK | 50053 |
| HPV45 | E2 | 10 | KESLSERLSALQDKI | 47957 | LSERLSALQ | 50054 |
| HPV45 | E2 | 243 | KPHIQTPATKRPRQC | 47958 | IQTPATKRP | 50055 |
| HPV45 | E2 | 353 | LDVVTIPNSVQISVG | 47959 | VTIPNSVQI | 50056 |
| HPV45 | E2 | 44 | LIRLENAILFTAREH | 47960 | LENAILFTA | 50057 |
| HPV45 | E2 | 313 | LRKYADHYSEISSTW | 47961 | YADHYSEIS | 50058 |
| HPV45 | E2 | 17 | LSALQDKILDHYEND | 47962 | LQDKILDHY | 50059 |
| HPV45 | E2 | 138 | MNYVVWDSIYYITET | 47963 | VVWDSIYYI | 50060 |
| HPV45 | E2 | 98 | NEEWTLQDTCEELWN | 47964 | WTLQDTCEE | 50061 |
| HPV45 | E2 | 273 | NPLLCSSTSNNKRRK | 47965 | LCSSTSNNK | 50062 |
| HPV45 | E2 | 36 | NSQISYWQLIRLENA | 47966 | ISYWQLIRL | 50063 |
| HPV45 | E2 | 350 | NTFLDVVTIPNSVQI | 47967 | LDVVTIPNS | 50064 |
| HPV45 | E2 | 268 | NTHVHNPLLCSSTSN | 47968 | VHNPLLCSS | 50065 |
| HPV45 | E2 | 70 | PINISKSKAHKAIEL | 47969 | ISKSKAHKA | 50066 |
| HPV45 | E2 | 349 | RNTFLDVVTIPNSVQ | 47970 | FLDVVTIPN | 50067 |
| HPV45 | E2 | 285 | RRKVCSGNTTPIIHL | 47971 | VCSGNTTPI | 50068 |
| HPV45 | E2 | 32 | SKDINSQISYWQLIR | 47972 | INSQISYWQ | 50069 |
| HPV45 | E2 | 324 | SSTWHWTGCNKNTGI | 47973 | WHWTGCNKN | 50070 |
| HPV45 | E2 | 236 | TASVGTPKPHIQTPA | 47974 | VGTPKPHIQ | 50071 |
| HPV45 | E2 | 152 | TGIWDKTAACVSYWG | 47975 | WDKTAACVS | 50072 |
| HPV45 | E2 | 175 | TTYYVQFKSECEKYG | 47976 | YVQFKSECE | 50073 |
| HPV45 | E2 | 68 | VPPINISKSKAHKAI | 47977 | INISKSKAH | 50074 |
| HPV45 | E2 | 223 | VRQLQHASTSTPKTA | 47978 | LQHASTSTP | 50075 |
| HPV45 | E2 | 162 | VSYWGVYYIKDGDTT | 47979 | WGVYYIKDG | 50076 |
| HPV45 | E2 | 167 | VYYIKDGDTTYYVQF | 47980 | IKDGDTTYY | 50077 |
| HPV45 | E2 | 42 | WQLIRLENAILFTAR | 47981 | IRLENAILF | 50078 |
| HPV45 | E6 | 34 | ACVYCKATLERTEVY | 47982 | YCKATLERT | 50079 |
| HPV45 | E6 | 54 | DLFIVYRDCIAYAAC | 47983 | IVYRDCIAY | 50080 |
| HPV45 | E6 | 30 | DVSIACVYCKATLER | 47984 | IACVYCKAT | 50081 |
| HPV45 | E6 | 80 | ELRYYSNSVYGETLE | 47985 | YYSNSVYGE | 50082 |
| HPV45 | E6 | 56 | FIVYRDCIAYAACHK | 47986 | YRDCIAYAA | 50083 |
| HPV45 | E6 | 33 | IACVYCKATLERTEV | 47987 | VYCKATLER | 50084 |
| HPV45 | E6 | 106 | IRCLRCQKPLNPAEK | 47988 | LRCQKPLNP | 50085 |
| HPV45 | E6 | 39 | KATLERTEVYQFAFK | 47989 | LERTEVYQF | 50086 |
| HPV45 | E6 | 93 | LEKITNTELYNLLIR | 47990 | ITNTELYNL | 50087 |
| HPV45 | E6 | 55 | LFIVYRDCIAYAACH | 47991 | VYRDCIAYA | 50088 |
| HPV45 | E6 | 28 | LQDVSIACVYCKATL | 47992 | VSIACVYCK | 50089 |
| HPV45 | E6 | 101 | LYNLLIRCLRCQKPL | 47993 | LLIRCLRCQ | 50090 |
| HPV45 | E6 | 103 | NLLIRCLRCQKPLNP | 47994 | IRCLRCQKP | 50091 |
| HPV45 | E6 | 98 | NTELYNLLIRCLRCQ | 47995 | LYNLLIRCL | 50092 |
| HPV45 | E6 | 25 | NTSLQDVSIACVYCK | 47996 | LQDVSIACV | 50093 |
| HPV45 | E6 | 14 | PYKLPDLCTELNTSL | 47997 | LPDLCTELN | 50094 |
| HPV45 | E6 | 49 | QFAFKDLFIVYRDCI | 47998 | FKDLFIVYR | 50095 |
| HPV45 | E6 | 12 | QRPYKLPDLCTELNT | 47999 | YKLPDLCTE | 50096 |
| HPV45 | E6 | 60 | RDCIAYAACHKCIDF | 48000 | IAYAACHKC | 50097 |
| HPV45 | E6 | 85 | SNSVYGETLEKITNT | 48001 | VYGETLEKI | 50098 |
| HPV45 | E6 | 47 | VYQFAFKDLFIVYRD | 48002 | FAFKDLFIV | 50099 |
| HPV45 | E7 | 1 | ---MHGPRATLQEIV | 48003 | MHGPRATLQ | 50100 |
| HPV45 | E7 | 45 | ADGVSHAQLPARRAE | 48004 | VSHAQLPAR | 50101 |
| HPV45 | E7 | 50 | HAQLPARRAEPQRHK | 48005 | LPARRAEPQ | 50102 |
| HPV45 | E7 | 90 | LQQLFLSTLSFVCPW | 48006 | LFLSTLSFV | 50103 |
| HPV45 | E7 | 87 | LRTLQQLFLSTLSFV | 48007 | LQQLFLSTL | 50104 |
| HPV45 | E7 | 98 | LSFVCPWCATNQ--- | 48008 | VCPWCATNQ | 50105 |
| HPV45 | E7 | 95 | LSTLSFVCPWCATNQ | 48009 | LSFVCPWCA | 50106 |
| HPV45 | E7 | 12 | QEIVLHLEPQNELDP | 48010 | VLHLEPQNE | 50107 |
| HPV45 | E7 | 21 | QNELDPVDLLCYEQL | 48011 | LDPVDLLCY | 50108 |
| HPV45 | E7 | 91 | QQLFLSTLSFVCPWC | 48012 | FLSTLSFVC | 50109 |
| HPV45 | E7 | 8 | RATLQEIVLHLEPQN | 48013 | LQEIVLHLE | 50110 |
| HPV45 | E7 | 62 | RHKILCVCCKCDGRI | 48014 | ILCVCCKCD | 50111 |
| HPV45 | E7 | 75 | RIELTVESSADDLRT | 48015 | LTVESSADD | 50112 |
| HPV45 | E7 | 97 | TLSFVCPWCATNQ-- | 48016 | FVCPWCATN | 50113 |
| HPV45 | E7 | 27 | VDLLCYEQLSESEEE | 48017 | LCYEQLSES | 50114 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV45 | L1 | 1 | ---MAHNIIYGHGII | 48018 | MAHNIIYGH | 50115 |
| HPV45 | L1 | 418 | AEVMSYIHSMNSSIL | 48019 | MSYIHSMNS | 50116 |
| HPV45 | L1 | 294 | AGVMGDTVPTDLYIK | 48020 | MGDTVPTDL | 50117 |
| HPV45 | L1 | 165 | ATAVITQDVRDNVSV | 48021 | VITQDVRDN | 50118 |
| HPV45 | L1 | 97 | AYQYRVFRVALPDPN | 48022 | YRVFRVALP | 50119 |
| HPV45 | L1 | 215 | CPPLELKNTIIEDGD | 48023 | LELKNTIIE | 50120 |
| HPV45 | L1 | 54 | DDYVSRTSIFYHAGS | 48024 | VSRTSIFYH | 50121 |
| HPV45 | L1 | 404 | DLQFIFQLCTITLTA | 48025 | FIFQLCTIT | 50122 |
| HPV45 | L1 | 304 | DLYIKGTSANMRETP | 48026 | IKGTSANMR | 50123 |
| HPV45 | L1 | 117 | DSTIYNPETQRLVWA | 48027 | IYNPETQRL | 50124 |
| HPV45 | L1 | 37 | DSTVYLPPPSVARVV | 48028 | VYLPPPSVA | 50125 |
| HPV45 | L1 | 249 | EVPLDICQSICKYPD | 48029 | LDICQSICK | 50126 |
| HPV45 | L1 | 277 | FFCLRREQLFARHFW | 48030 | LRREQLFAR | 50127 |
| HPV45 | L1 | 27 | FLQMALWRPSDSTVY | 48031 | MALWRPSDS | 50128 |
| HPV45 | L1 | 24 | FPIFLQMALWRPSDS | 48032 | FLQMALWRP | 50129 |
| HPV45 | L1 | 240 | FSTLQDTKCEVPLDI | 48033 | LQDTKCEVP | 50130 |
| HPV45 | L1 | 196 | GEHWAKGTLCKPAQL | 48034 | WAKGTLCKP | 50131 |
| HPV45 | L1 | 13 | GIIIFLKNVNVFPIF | 48035 | IFLKNVNVF | 50132 |
| HPV45 | L1 | 134 | GMEIGRGQPLGIGLS | 48036 | IGRGQPLGI | 50133 |
| HPV45 | L1 | 75 | GNPYFRVVPSGAGNK | 48037 | YFRVVPSGA | 50134 |
| HPV45 | L1 | 140 | GQPLGIGLSGHPFYN | 48038 | LGIGLSGHP | 50135 |
| HPV45 | L1 | 319 | GSCVYSPSPSGSITT | 48039 | VYSPSPSGS | 50136 |
| HPV45 | L1 | 6 | HNIIYGHGIIIFLKN | 48040 | IYGHGIIIF | 50137 |
| HPV45 | L1 | 358 | HNQLFVTVVDTTRST | 48041 | LFVTVVDTT | 50138 |
| HPV45 | L1 | 408 | IFQLCTITLTAEVMS | 48042 | LCTITLTAE | 50139 |
| HPV45 | L1 | 424 | IHSMNSSILENWNFG | 48043 | MNSSILENW | 50140 |
| HPV45 | L1 | 15 | IIFLKNVNVFPIFLQ | 48044 | LKNVNVFPI | 50141 |
| HPV45 | L1 | 247 | KCEVPLDICQSICKY | 48045 | VPLDICQSI | 50142 |
| HPV45 | L1 | 112 | KFGLPDSTIYNPETQ | 48046 | LPDSTIYNP | 50143 |
| HPV45 | L1 | 476 | KLKFWTVDLKEKFSS | 48047 | FWTVDLKEK | 40144 |
| HPV45 | L1 | 89 | KQAVPKVSAYQYRVF | 48048 | VPKVSAYQY | 50145 |
| HPV45 | L1 | 186 | LCILGCVPAIGEHWA | 48049 | LGCVPAIGE | 50146 |
| HPV45 | L1 | 432 | LENWNFGVPPPPTTS | 48050 | WNFGVPPPP | 50147 |
| HPV45 | L1 | 18 | LKNVNVFPIFLQMAL | 48051 | VNVFPIFLQ | 50148 |
| HPV45 | L1 | 405 | LQFIFQLCTITLTAE | 48052 | IFQLCTITL | 50149 |
| HPV45 | L1 | 30 | MALWRPSDSTVYLPP | 48053 | WRPSDSTVY | 50150 |
| HPV45 | L1 | 421 | MSYIHSMNSSILENW | 48054 | IHSMNSSIL | 50151 |
| HPV45 | L1 | 436 | NFGVPPPPTTSLVDT | 48055 | VPPPPTTSL | 50152 |
| HPV45 | L1 | 7 | NIIYGHGIIIFLKNV | 48056 | YGHGIIIFL | 50153 |
| HPV45 | L1 | 340 | NKPYWLHKAQGHNNG | 48057 | YWLHKAQGH | 50154 |
| HPV45 | L1 | 76 | NPYFRVVPSGAGNKQ | 48058 | FRVVPSGAG | 50155 |
| HPV45 | L1 | 222 | NTIIEDGDMVDTGYG | 48059 | IEDGDMVDT | 50156 |
| HPV45 | L1 | 20 | NVNVFPIFLQMALWR | 48060 | VFPIFLQMA | 50157 |
| HPV45 | L1 | 176 | NVSVDYKQTQLCILG | 48061 | VDYKQTQLC | 50158 |
| HPV45 | L1 | 434 | NWNFGVPPPPTTSLV | 48062 | FGVPPPPTT | 50159 |
| HPV45 | L1 | 207 | PAQLQPGDCPPLELK | 48063 | LQPGDCPPL | 50160 |
| HPV45 | L1 | 251 | PLDICQSICKYPDYL | 48064 | ICQSICKYP | 50161 |
| HPV45 | L1 | 217 | PLELKNTIIEDGDMV | 48065 | LKNTIIEDG | 50162 |
| HPV45 | L1 | 110 | PNKFGLPDSTIYNPE | 48066 | FGLPDSTIY | 50163 |
| HPV45 | L1 | 302 | PTDLYIKGTSANMRE | 48067 | LYIKGTSAN | 50164 |
| HPV45 | L1 | 504 | QAGLRRRPTIGPRKR | 48068 | LRRRPTIGP | 50165 |
| HPV45 | L1 | 406 | QFIFQLCTITLTAEV | 48069 | FQLCTITLT | 50166 |
| HPV45 | L1 | 185 | QLCILGCVPAIGEHW | 48070 | ILGCVPAIG | 50167 |
| HPV45 | L1 | 360 | QLFVTVVDTTRSTNL | 48071 | VTVVDTTRS | 50168 |
| HPV45 | L1 | 183 | QTQLCILGCVPAIGE | 48072 | LCILGCVPA | 50169 |
| HPV45 | L1 | 494 | QYPLGRKFLVQAGLR | 48073 | LGRKFLVQA | 50170 |
| HPV45 | L1 | 99 | QYRVFRVALPDPNKF | 48074 | VFRVALPDP | 50171 |
| HPV45 | L1 | 293 | RAGVMGDTVPTDLYI | 48075 | VMGDTVPTD | 50172 |
| HPV45 | L1 | 288 | RHFWNRAGVMGDTVP | 48076 | WNRAGVMGD | 50173 |
| HPV45 | L1 | 499 | RKFLVQAGLRRRPTI | 48077 | LVQAGLRRR | 50174 |
| HPV45 | L1 | 127 | RLVWACVGMEIGRGQ | 48078 | WACVGMEIG | 50175 |
| HPV45 | L1 | 320 | SCVYSPSPSGSITTS | 48079 | YSPSPSGSI | 50176 |
| HPV45 | L1 | 328 | SGSITTSDSQLFNKP | 48080 | ITTSDSQLF | 50177 |
| HPV45 | L1 | 61 | SIFYHAGSSRLLTVG | 48081 | YHAGSSRLL | 50178 |
| HPV45 | L1 | 397 | SRHVEEYDLQFIFQL | 48082 | VEEYDLQFI | 50179 |
| HPV45 | L1 | 69 | SRLLTVGNPYFRVVP | 48083 | LTVGNPYFR | 50180 |
| HPV45 | L1 | 489 | SSDLDQYPLGRKFLV | 48084 | LDQYPLGRK | 50181 |
| HPV45 | L1 | 371 | STNLTLCASTQNPVP | 48085 | LTLCASTQN | 50182 |
| HPV45 | L1 | 38 | STVYLPPPSVARVVN | 48086 | YLPPPSVAR | 50183 |
| HPV45 | L1 | 178 | SVDYKQTQLCILGCV | 48087 | YKQTQLCIL | 50184 |
| HPV45 | L1 | 53 | TDDYVSRTSIFYHAG | 48088 | YVSRTSIFY | 50185 |
| HPV45 | L1 | 303 | TDLYIKGTSANMRET | 48089 | YIKGTSANM | 50186 |
| HPV45 | L1 | 413 | TITLTAEVMSYIHSM | 48090 | LTAEVMSYI | 50187 |
| HPV45 | L1 | 170 | TQDVRDNVSVDYKQT | 48091 | VRDNVSVDY | 50188 |
| HPV45 | L1 | 125 | TQRLVWACVGMEIGR | 48092 | LVWACVGME | 50189 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV45 | L1 | 60 | TSIFYHAGSSRLLTV | 48093 | FYHAGSSRL | 50190 |
| HPV45 | L1 | 481 | TVDLKEKFSSDLDQY | 48094 | LKEKFSSDL | 50191 |
| HPV45 | L1 | 39 | TVYLPPPSVARVVNT | 48095 | LPPPSVARV | 50192 |
| HPV45 | L1 | 450 | TYRFVQSVAVTCQKD | 48096 | FVQSVAVTC | 50193 |
| HPV45 | L1 | 448 | VDTYRFVQSVAVTCQ | 48097 | YRFVQSVAV | 50194 |
| HPV45 | L1 | 400 | VEEYDLQFIFQLCTI | 48098 | YDLQFIFQL | 50195 |
| HPV45 | L1 | 23 | VFPIFLQMALWRPSD | 48099 | IFLQMALWR | 50196 |
| HPV45 | L1 | 102 | VFRVALPDPNKFGLP | 48100 | VALPDPNKF | 50197 |
| HPV45 | L1 | 192 | VPAIGEHWAKGTLCK | 48101 | IGEHWAKGT | 50198 |
| HPV45 | L1 | 363 | VTVVDTTRSTNLTLC | 48102 | VDTTRSTNL | 50199 |
| HPV45 | L1 | 474 | YDKLKFWTVDLKEKF | 48103 | LKFWTVDLK | 50200 |
| HPV45 | L1 | 78 | YFRVVPSGAGNKQAV | 48104 | VVPSGAGNK | 50201 |
| HPV45 | L1 | 235 | YGAMDFSTLQDTKCE | 48105 | MDFSTLQDT | 50202 |
| HPV45 | L1 | 153 | YNKLDDTESAHAATA | 48106 | LDDTESAHA | 50203 |
| HPV45 | L1 | 261 | YPDYLQMSADPYGDS | 48107 | YLQMSADPY | 50204 |
| HPV45 | L1 | 451 | YRFVQSVAVTCQKDT | 48108 | VQSVAVTCQ | 50205 |
| HPV45 | L1 | 100 | YRVFRVALPDPNKFG | 48109 | FRVALPDPN | 50206 |
| HPV45 | L2 | 1 | ---MVSHRAARRKRA | 48110 | MVSHRAARR | 50207 |
| HPV45 | L2 | 2 | --MVSHRAARRKRAS | 48111 | VSHRAARRK | 50208 |
| HPV45 | L2 | 44 | ADKILQWSSLGIFLG | 48112 | ILQWSSLGI | 50209 |
| HPV45 | L2 | 385 | ASSYSNVTVPLTSAW | 48113 | YSNVTVPLT | 50210 |
| HPV45 | L2 | 408 | DIILPSHTPMWPSTS | 48114 | LPSHTPMWP | 50211 |
| HPV45 | L2 | 45 | DKILQWSSLGIFLGG | 48115 | LQWSSLGIF | 50212 |
| HPV45 | L2 | 346 | DSDLFDVYADFPPPA | 48116 | LFDVYADFP | 50213 |
| HPV45 | L2 | 112 | DSSVVASGAPVPTFT | 48117 | VVASGAPVP | 50214 |
| HPV45 | L2 | 263 | DTTLSFEPTSNVPDS | 48118 | LSFEPTSNV | 50215 |
| HPV45 | L2 | 334 | EIELQPLISATNDSD | 48119 | LQPLISATN | 50216 |
| HPV45 | L2 | 197 | EIPLQTFASSGSGTE | 48120 | LQTFASSGS | 50217 |
| HPV45 | L2 | 350 | FDVYADFPPPASTTP | 48121 | YADFPPPAS | 50218 |
| HPV45 | L2 | 299 | FSRLGQRATMFTRSG | 48122 | LGQRATMFT | 50219 |
| HPV45 | L2 | 130 | GFEITSSGTTTPAVL | 48123 | ITSSGTTTP | 50220 |
| HPV45 | L2 | 54 | GIFLGGLGIGTGSGS | 48124 | LGGLGIGTG | 50221 |
| HPV45 | L2 | 181 | GNIFVGTPTSGSHGY | 48125 | FVGTPTSGS | 50222 |
| HPV45 | L2 | 40 | GTTLADKILQWSSLG | 48126 | LADKILQWS | 50223 |
| HPV45 | L2 | 414 | HTPMWPSTSPTNAST | 48127 | MWPSTSPTN | 50224 |
| HPV45 | L2 | 96 | IEPVGPTDPSIVTLV | 48128 | VGPTDPSIV | 50225 |
| HPV45 | L2 | 282 | IIRLHRPALSSRRGT | 48129 | LHRPALSSR | 50226 |
| HPV45 | L2 | 47 | ILQWSSLGIFLGGLG | 48130 | WSSLGIFLG | 50227 |
| HPV45 | L2 | 35 | INKVEGTTLADKILQ | 48131 | VEGTTLADK | 50228 |
| HPV45 | L2 | 106 | IVTLVEDSSVVASGA | 48132 | LVEDSSVVA | 50229 |
| HPV45 | L2 | 375 | KYSLTMPSTAASSYS | 48133 | LTMPSTAAS | 50230 |
| HPV45 | L2 | 349 | LFDVYADFPPPASTT | 48134 | VYADFPPPA | 50231 |
| HPV45 | L2 | 200 | LQTFASSGSGTEPIS | 48135 | FASSGSGTE | 50232 |
| HPV45 | L2 | 441 | LWPWYYYFPKKRKRI | 48136 | WYYYFPKKR | 50233 |
| HPV45 | L2 | 280 | MDIIRLHRPALSSRR | 48137 | IRLHRPALS | 50234 |
| HPV45 | L2 | 182 | NIFVGTPTSGSHGYE | 48138 | VGTPTSGSH | 50235 |
| HPV45 | L2 | 162 | NPAFSDPSIIEVPQT | 48139 | FSDPSIIEV | 50236 |
| HPV45 | L2 | 256 | NPAYEPLDTTLSFEP | 48140 | YEPLDTTLS | 50237 |
| HPV45 | L2 | 234 | NQQVRVSTSQFLTHP | 48141 | VRVSTSQFL | 50238 |
| HPV45 | L2 | 82 | NTVVDVGPTRPPVVI | 48142 | VDVGPTRPP | 50239 |
| HPV45 | L2 | 390 | NVTVPLTSAWDVPIY | 48143 | VPLTSAWDV | 50240 |
| HPV45 | L2 | 141 | PAVLDITPTVDSVSI | 48144 | LDITPTVDS | 50241 |
| HPV45 | L2 | 407 | PDIILPSHTPMWPST | 48145 | ILPSHTPMW | 50242 |
| HPV45 | L2 | 168 | PSIIEVPQTGEVSGN | 48146 | IEVPQTGEV | 50243 |
| HPV45 | L2 | 364 | PSTIHKSFTYPKYSL | 48147 | IHKSFTYPK | 50244 |
| HPV45 | L2 | 93 | PVVIEPVGPTDPSIV | 48148 | IEPVGPTDP | 50245 |
| HPV45 | L2 | 294 | RGTVRFSRLGQRATM | 48149 | VRFSRLGQR | 50246 |
| HPV45 | L2 | 452 | RKRIPYFFADGFVAA | 48150 | IPYFFADGF | 50247 |
| HPV45 | L2 | 91 | RPPVVIEPVGPTDPS | 48151 | VVIEPVGPT | 50248 |
| HPV45 | L2 | 319 | RVHFYHDISPIAATE | 48152 | FYHDISPIA | 50249 |
| HPV45 | L2 | 277 | SDFMDIIRLHRPALS | 48153 | MDIIRLHRP | 50250 |
| HPV45 | L2 | 370 | SFTYPKYSLTMPSTA | 48154 | YPKYSLTMP | 50251 |
| HPV45 | L2 | 180 | SGNIFVGTPTSGSHG | 48155 | IFVGTPTSG | 50252 |
| HPV45 | L2 | 192 | SHGYEEIPLQTFASS | 48156 | YEEIPLQTF | 50253 |
| HPV45 | L2 | 52 | SLGIFLGGLGIGTGS | 48157 | IFLGGLGIG | 50254 |
| HPV45 | L2 | 377 | SLTMPSTAASSYSNV | 48158 | MPSTAASSY | 50255 |
| HPV45 | L2 | 81 | SNTVVDVGPTRPPVV | 48159 | VVDVGPTRP | 50256 |
| HPV45 | L2 | 242 | SQFLTHPSSLVTFDN | 48160 | LTHPSSLVT | 50257 |
| HPV45 | L2 | 249 | SSLVTFDNPAYEPLD | 48161 | VTFDNPAYE | 50258 |
| HPV45 | L2 | 113 | SSVVASGAPVPTFTG | 48162 | VASGAPVPT | 50259 |
| HPV45 | L2 | 332 | TEEIELQPLISATND | 48163 | IELQPLISA | 50260 |
| HPV45 | L2 | 210 | TEPISSTPLPTVRRV | 48164 | ISSTPLPTV | 50261 |
| HPV45 | L2 | 140 | TPAVLDITPTVDSVS | 48165 | VLDITPTVD | 50262 |
| HPV45 | L2 | 415 | TPMWPSTSPTNASTT | 48166 | WPSTSPTNA | 50263 |
| HPV45 | L2 | 147 | TPTVDSVSISSTSFT | 48167 | VDSVSISST | 50264 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV45 | L2 | 128 | TSGFEITSSGTTTPA | 48168 | FEITSSGTT | 50265 |
| HPV45 | L2 | 241 | TSQFLTHPSSLVTFD | 48169 | FLTHPSSLV | 50266 |
| HPV45 | L2 | 429 | TTYIGIHGTQYYLWP | 48170 | IGIHGTQYY | 50267 |
| HPV45 | L2 | 150 | VDSVSISSTSFTNPA | 48171 | VSISSTSFT | 50268 |
| HPV45 | L2 | 320 | VHFYHDISPIAATEE | 48172 | YHDISPIAA | 50269 |
| HPV45 | L2 | 401 | VPIYTGPDIILPSHT | 48173 | YTGPDIILP | 50270 |
| HPV45 | L2 | 221 | VRRVRGPRLYSRANQ | 48174 | VRGPRLYSR | 50271 |
| HPV45 | L2 | 107 | VTLVEDSSVVASGAP | 48175 | VEDSSVVAS | 50272 |
| HPV45 | L2 | 84 | VVDVGPTRPPVVIEP | 48176 | VGPTRPPVV | 50273 |
| HPV45 | L2 | 353 | YADFPPPASTTPSTI | 48177 | FPPPASTTP | 50274 |
| HPV45 | L2 | 259 | YEPLDTTLSFEPTSN | 48178 | LDTTLSFEP | 50275 |
| HPV45 | L2 | 323 | YHDISPIAATEEIEL | 48179 | ISPIAATEE | 50276 |
| HPV45 | L2 | 373 | YPKYSLTMPSTAASS | 48180 | YSLTMPSTA | 50277 |
| HPV45 | L2 | 388 | YSNVTVPLTSAWDVP | 48181 | VTVPLTSAW | 50278 |
| HPV56 | E2 | 2 | --MVPCLQVCKAKAC | 48182 | VPCLQVCKA | 50279 |
| HPV56 | E2 | 121 | AKKFGCKNIWEVHME | 48183 | FGCKNIWEV | 50280 |
| HPV56 | E2 | 44 | CEELWLTEPKKCFKK | 48184 | LWLTEPKKC | 50281 |
| HPV56 | E2 | 126 | CKNIWEVHMENESIY | 48185 | IWEVHMENE | 50282 |
| HPV56 | E2 | 7 | CLQVCKAKACSAIEV | 48186 | VCKAKACSA | 50283 |
| HPV56 | E2 | 16 | CSAIEVQIALESLST | 48187 | IEVQIALES | 50284 |
| HPV56 | E2 | 95 | CSGVDYRGIYYVHDG | 48188 | VDYRGIYYV | 50285 |
| HPV56 | E2 | 88 | DCGWQKVCSGVDYRG | 48189 | WQKVCSGVD | 50286 |
| HPV56 | E2 | 137 | ESIYCPDSVSSTCRY | 48190 | YCPDSVSST | 50287 |
| HPV56 | E2 | 131 | EVHMENESIYCPDSV | 48191 | MENESIYCP | 50288 |
| HPV56 | E2 | 20 | EVQIALESLSTTIYN | 48192 | IALESLSTT | 50289 |
| HPV56 | E2 | 257 | FQKYKTLFVDVTSTY | 48193 | YKTLFVDVT | 50290 |
| HPV56 | E2 | 62 | HIEVWFDGSKNNCMQ | 48194 | VWFDGSKNN | 50291 |
| HPV56 | E2 | 284 | ITIIYKDETQRNSFL | 48195 | IYKDETQRN | 50292 |
| HPV56 | E2 | 302 | KIPVVYRLVWDK--- | 48196 | VVYRLVWDK | 50293 |
| HPV56 | E2 | 261 | KTLFVDVTSTYHWTS | 48197 | FVDVTSTYH | 50294 |
| HPV56 | E2 | 81 | KYIYYNGDCGWQKVC | 48198 | YYNGDCGWQ | 50295 |
| HPV56 | E2 | 298 | LSHVKIPVVYRLVWD | 48199 | VKIPVVYRL | 50296 |
| HPV56 | E2 | 75 | MQYVAWKYIYYNGDC | 48200 | VAWKYIYYN | 50297 |
| HPV56 | E2 | 35 | NEEWTLRDTCEELWL | 48201 | WTLRDTCEE | 50298 |
| HPV56 | E2 | 136 | NESIYCPDSVSSTCR | 48202 | IYCPDSVSS | 50299 |
| HPV56 | E2 | 278 | NKNYSIITIIYKDET | 48203 | YSIITIIYK | 50300 |
| HPV56 | E2 | 295 | NSFLSHVKIPVVYRL | 48204 | LSHVKIPVV | 50301 |
| HPV56 | E2 | 22 | QIALESLSTTIYNNE | 48205 | LESLSTTIY | 50302 |
| HPV56 | E2 | 150 | RYNVSPVETVNEYNT | 48206 | VSPVETVNE | 50303 |
| HPV56 | E2 | 254 | RYRFQKYKTLFVDVT | 48207 | FQKYKTLFV | 50304 |
| HPV56 | E2 | 172 | STSVGNQDAAVSHRP | 48208 | VGNQDAAVS | 50305 |
| HPV56 | E2 | 148 | TCRYNVSPVETVNEY | 48209 | YNVSPVETV | 50306 |
| HPV56 | E2 | 262 | TLFVDVTSTYHWTST | 48210 | VDVTSTYHW | 50307 |
| HPV56 | E2 | 268 | TSTYHWTSTDNKNYS | 48211 | YHWTSTDNK | 50308 |
| HPV56 | E2 | 156 | VETVNEYNTHKTTTT | 48212 | VNEYNTHKT | 50309 |
| HPV56 | E2 | 159 | VNEYNTHKTTTTTST | 48213 | YNTHKTTTT | 50310 |
| HPV56 | E2 | 5 | VPCLQVCKAKACSAI | 48214 | LQVCKAKAC | 50311 |
| HPV56 | E2 | 260 | YKTLFVDVTSTYHWT | 48215 | LFVDVTSTY | 50312 |
| HPV56 | E6 | 46 | AEVYNFACTELKLVY | 48216 | YNFACTELK | 50313 |
| HPV56 | E6 | 135 | AHGWTGSCLGCWRQT | 48217 | WTGSCLGCW | 50314 |
| HPV56 | E6 | 63 | DFPYAVCRVCLLFYS | 48218 | YAVCRVCLL | 50315 |
| HPV56 | E6 | 104 | DLLIRCYRCQSPLTP | 48219 | IRCYRCQSP | 50316 |
| HPV56 | E6 | 31 | DLRLSCVYCKKELTR | 48220 | LSCVYCKKE | 50317 |
| HPV56 | E6 | 86 | DYSVYGATLESITKK | 48221 | VYGATLESI | 50318 |
| HPV56 | E6 | 26 | EIPLIDLRLSCVYCK | 48222 | LIDLRLSCV | 50319 |
| HPV56 | E6 | 131 | FHLIAHGWTGSCLGC | 48223 | IAHGWTGSC | 50320 |
| HPV56 | E6 | 27 | IPLIDLRLSCVYCKK | 48224 | IDLRLSCVY | 50321 |
| HPV56 | E6 | 107 | IRCYRCQSPLTPEEK | 48225 | YRCQSPLTP | 50322 |
| HPV56 | E6 | 40 | KKELTRAEVYNFACT | 48226 | LTRAEVYNF | 50323 |
| HPV56 | E6 | 99 | KKQLCDLLIRCYRCQ | 48227 | LCDLLIRCY | 50324 |
| HPV56 | E6 | 57 | KLVYRDDFPYAVCRV | 48228 | YRDDFPYAV | 50325 |
| HPV56 | E6 | 81 | KYRYYDYSVYGATLE | 48229 | YYDYSVYGA | 50326 |
| HPV56 | E6 | 94 | LESITKKQLCDLLIR | 48230 | ITKKQLCDL | 50327 |
| HPV56 | E6 | 29 | LIDLRLSCVYCKKEL | 48231 | LRLSCVYCK | 50328 |
| HPV56 | E6 | 21 | LSEVLEIPLIDLRLS | 48232 | VLEIPLIDL | 50329 |
| HPV56 | E6 | 65 | PYAVCRVCLLFYSKV | 48233 | VCRVCLLFY | 50330 |
| HPV56 | E6 | 45 | RAEVYNFACTELKLV | 48234 | VYNFACTEL | 50331 |
| HPV56 | E6 | 61 | RDDFPYAVCRVCLLF | 48235 | FPYAVCRVC | 50332 |
| HPV56 | E6 | 35 | SCVYCKKELTRAEVY | 48236 | YCKKELTRA | 50333 |
| HPV56 | E6 | 22 | SEVLEIPLIDLRLSC | 48237 | LEIPLIDLR | 50334 |
| HPV56 | E6 | 71 | VCLLFYSKVRKYRYY | 48238 | LFYSKVRKY | 50335 |
| HPV56 | E6 | 24 | VLEIPLIDLRLSCVY | 48239 | IPLIDLRLS | 50336 |
| HPV56 | E6 | 48 | VYNFACTELKLVYRD | 48240 | FACTELKLV | 50337 |
| HPV56 | E6 | 84 | YYDYSVYGATLESIT | 48241 | YSVYGATLE | 50338 |
| HPV56 | E7 | 1 | ---MHGKVPTLQDVV | 48242 | MHGKVPTLQ | 50339 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV56 | E7 | 96 | ALTVTCPLCASSN-- | 48243 | VTCPLCASS | 50340 |
| HPV56 | E7 | 71 | CKFVVQLDIQSTKED | 48244 | VVQLDIQST | 50341 |
| HPV56 | E7 | 61 | CYLIHVPCCECKFVV | 48245 | IHVPCCECK | 50342 |
| HPV56 | E7 | 85 | DLRVVQQLLMGALTV | 48246 | VVQQLLMGA | 50343 |
| HPV56 | E7 | 59 | HTCYLIHVPCCECKF | 48247 | YLIHVPCCE | 50344 |
| HPV56 | E7 | 63 | LIHVPCCECKFVVQL | 48248 | VPCCECKFV | 50345 |
| HPV56 | E7 | 11 | LQDVVLELTPQTEID | 48249 | VVLELTPQT | 50346 |
| HPV56 | E7 | 86 | LRVVQQLLMGALTVT | 48250 | VQQLLMGAL | 50347 |
| HPV56 | E7 | 94 | MGALTVTCPLCASSN | 48251 | LTVTCPLCA | 50348 |
| HPV56 | E7 | 12 | QDVVLELTPQTEIDL | 48252 | VLELTPQTE | 50349 |
| HPV56 | E7 | 91 | QLLMGALTVTCPLCA | 48253 | MGALTVTCP | 50350 |
| HPV56 | E7 | 90 | QQLLMGALTVTCPLC | 48254 | LMGALTVTC | 50351 |
| HPV56 | E7 | 60 | TCYLIHVPCCECKFV | 48255 | LIHVPCCEC | 50352 |
| HPV56 | E7 | 8 | VPTLQDVVLELTPQT | 48256 | LQDVVLELT | 50353 |
| HPV56 | E7 | 89 | VQQLLMGALTVTCPL | 48257 | LLMGALTVT | 50354 |
| HPV56 | E7 | 74 | VVQLDIQSTKEDLRV | 48258 | LDIQSTKED | 50355 |
| HPV56 | L1 | 1 | ---MMLPMMYIRDP | 48259 | MMLPMMYIY | 50356 |
| HPV56 | L1 | 3 | -MMLPMMYIRDPPL | 48260 | LPMMYIRD | 50357 |
| HPV56 | L1 | 301 | AGKVGETIPAELYLK | 48261 | VGETIPAEL | 50358 |
| HPV56 | L1 | 432 | ANLLEDWNIGLSPPV | 48262 | LEDWNIGLS | 50359 |
| HPV56 | L1 | 29 | AVNVFPIFLQMATWR | 48263 | VFPIFLQMA | 50360 |
| HPV56 | L1 | 104 | AYQYRVFRVRLPDPN | 48264 | YRVFRVRLP | 50361 |
| HPV56 | L1 | 22 | CIFLDVGAVNVFPIF | 48265 | LDVGAVNVF | 50362 |
| HPV56 | L1 | 222 | CPPLALINTPIEDGD | 48266 | LALINTPIE | 50363 |
| HPV56 | L1 | 14 | DPPLHYGLCIFLDVG | 48267 | LHYGLCIFL | 50364 |
| HPV56 | L1 | 63 | DSYVKRTSIFYHAGS | 48268 | VKRTSIFYH | 50365 |
| HPV56 | L1 | 484 | DVNLQDSFSTDLDQF | 48269 | LQDSFSTDL | 50366 |
| HPV56 | L1 | 437 | DWNIGLSPPVATSLE | 48270 | IGLSPPVAT | 50367 |
| HPV56 | L1 | 451 | EDKYRYVRSTAITCQ | 48271 | YRYVRSTAI | 50368 |
| HPV56 | L1 | 407 | ELQFVFQLCKITLSA | 48272 | FVFQLCKIT | 50369 |
| HPV56 | L1 | 46 | ENKVYLPPTPVSKVV | 48273 | VYLPPTPVS | 50370 |
| HPV56 | L1 | 256 | EVPLDIVQSTCKYPD | 48274 | LDIVQSTCK | 50371 |
| HPV56 | L1 | 242 | FGAMDFKVLQESKAE | 48275 | MDFKVLQES | 50372 |
| HPV56 | L1 | 247 | FKVLQESKAEVPLDI | 48276 | LQESKAEVP | 50373 |
| HPV56 | L1 | 24 | FLDVGAVNVFPIFLQ | 48277 | VGAVNVFPI | 50374 |
| HPV56 | L1 | 36 | FLQMATWRPSENKVY | 48278 | MATWRPSEN | 50375 |
| HPV56 | L1 | 160 | FNRLDDTESSNLANN | 48279 | LDDTESSNL | 50376 |
| HPV56 | L1 | 33 | FPIFLQMATWRPSEN | 48280 | FLQMATWRP | 50377 |
| HPV56 | L1 | 482 | FWDVNLQDSFSTDLD | 48281 | VNLQDSFST | 50378 |
| HPV56 | L1 | 151 | GAGLSGHPLFNRLDD | 48282 | LSGHPLFNR | 50379 |
| HPV56 | L1 | 203 | GEHWTKGAVCKSTQV | 48283 | WTKGAVCKS | 50380 |
| HPV56 | L1 | 141 | GLEVGRGQPLGAGLS | 48284 | VGRGQPLGA | 50381 |
| HPV56 | L1 | 363 | GNQLFVTVVDTTRST | 48285 | LFVTVVDTT | 50382 |
| HPV56 | L1 | 147 | GQPLGAGLSGHPLFN | 48286 | LGAGLSGHP | 50383 |
| HPV56 | L1 | 254 | KAEVPLDIVQSTCKY | 48287 | VPLDIVQST | 50384 |
| HPV56 | L1 | 119 | KFGLPDTNIYNPDQE | 48288 | LPDTNIYNP | 50385 |
| HPV56 | L1 | 416 | KITLSAEVMAYLHNM | 48289 | LSAEVMAYL | 50386 |
| HPV56 | L1 | 96 | KTNIPKVSAYQYRVF | 48290 | IPKVSAYQY | 50387 |
| HPV56 | L1 | 48 | KVYLPPTPVSKVVAT | 48291 | LPPTPVSKV | 50388 |
| HPV56 | L1 | 479 | KYKFWDVNLQDSFST | 48292 | FWDVNLQDS | 50389 |
| HPV56 | L1 | 453 | KYRYVRSTAITCQRE | 48293 | YVRSTAITC | 50390 |
| HPV56 | L1 | 477 | LAKYKFWDVNLQDSF | 48294 | YKFWDVNLQ | 50391 |
| HPV56 | L1 | 21 | LCIFLDVGAVNVFPI | 48295 | FLDVGAVNV | 50392 |
| HPV56 | L1 | 193 | LCIVGCTPAMGEHWT | 48296 | VGCTPAMGE | 50393 |
| HPV56 | L1 | 435 | LEDWNIGLSPPVATS | 48297 | WNIGLSPPV | 50394 |
| HPV56 | L1 | 427 | LHNMNANLLEDWNIG | 48298 | MNANLLEDW | 50395 |
| HPV56 | L1 | 400 | LRHVEEYELQFVFQL | 48299 | VEEYELQFV | 50396 |
| HPV56 | L1 | 388 | LSKYDARKINQYLRH | 48300 | YDARKINQY | 50397 |
| HPV56 | L1 | 424 | MAYLHNMNANLLEDW | 48301 | LHNMNANLL | 50398 |
| HPV56 | L1 | 8 | MMYIRDPPLHYGLC | 48302 | IYRDPPLHY | 50399 |
| HPV56 | L1 | 9 | MYIRDPPLHYGLCI | 48303 | YRDPPLHYG | 50400 |
| HPV56 | L1 | 439 | NIGLSPPVATSLEDK | 48304 | LSPPVATSL | 50401 |
| HPV56 | L1 | 183 | NISVDGKQTQLCIVG | 48305 | VDGKQTQLC | 50402 |
| HPV56 | L1 | 345 | NKPYWLQRAQGHNNG | 48306 | YWLQRAQGH | 50403 |
| HPV56 | L1 | 47 | NKVYLPPTPVSKVVA | 48307 | YLPPTPVSK | 50404 |
| HPV56 | L1 | 229 | NTPIEDGDMIDTGFG | 48308 | IEDGDMIDT | 50405 |
| HPV56 | L1 | 309 | PAELYLKGSNGREPP | 48309 | LYLKGSNGR | 50406 |
| HPV56 | L1 | 224 | PLALINTPIEDGDMI | 48310 | LINTPIEDG | 50407 |
| HPV56 | L1 | 258 | PLDIVQSTCKYPDYL | 48311 | IVQSTCKYP | 50408 |
| HPV56 | L1 | 7 | PMMYIRDPPLHYGL | 48312 | YIYRDPPLH | 50409 |
| HPV56 | L1 | 117 | PNKFGLPDTNIYNPD | 48313 | FGLPDTNIY | 50410 |
| HPV56 | L1 | 324 | PSSVYVATPSGSMIT | 48314 | VYVATPSGS | 50411 |
| HPV56 | L1 | 53 | PTPVSKVVATDSYVK | 48315 | VSKVVATDS | 50412 |
| HPV56 | L1 | 132 | QERLVWACVGLEVGR | 48316 | LVWACVGLE | 50413 |
| HPV56 | L1 | 497 | QFPLGRKFLMQLGTR | 48317 | LGRKFLMQL | 50414 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV56 | L1 | 409 | QFVFQLCKITLSAEV | 48318 | FQLCKITLS | 50415 |
| HPV56 | L1 | 192 | QLCIVGCTPAMGEHW | 48319 | IVGCTPAMG | 50416 |
| HPV56 | L1 | 365 | QLFVTVVDTTRSTNM | 48320 | VTVVDTTRS | 50417 |
| HPV56 | L1 | 190 | QTQLCIVGCTPAMGE | 48321 | LCIVGCTPA | 50418 |
| HPV56 | L1 | 106 | QYRVFRVRLPDPNKF | 48322 | VFRVRLPDP | 50419 |
| HPV56 | L1 | 502 | RKFLMQLGTRSKPAV | 48323 | LMQLGTRSK | 50420 |
| HPV56 | L1 | 134 | RLVWACVGLEVGRGQ | 48324 | WACVGLEVG | 50421 |
| HPV56 | L1 | 333 | SGSMITSEAQLFNKP | 48325 | MITSEAQLF | 50422 |
| HPV56 | L1 | 70 | SIFYHAGSSRLLAVG | 48326 | YHAGSSRLL | 50423 |
| HPV56 | L1 | 78 | SRLLAVGHPYYSVTK | 48327 | LAVGHPYYS | 50424 |
| HPV56 | L1 | 168 | SSNLANNNVIEDSRD | 48328 | LANNNVIED | 50425 |
| HPV56 | L1 | 325 | SSVYVATPSGSMITS | 48329 | YVATPSGSM | 50426 |
| HPV56 | L1 | 492 | STDLDQFPLGRKFLM | 48330 | LDQFPLGRK | 50427 |
| HPV56 | L1 | 376 | STNMTISTATEQLSK | 48331 | MTISTATEQ | 50428 |
| HPV56 | L1 | 214 | STQVTTGDCPPLALI | 48332 | VTTGDCPPL | 50429 |
| HPV56 | L1 | 62 | TDSYVKRTSIFYHAG | 48333 | YVKRTSIFY | 50430 |
| HPV56 | L1 | 385 | TEQLSKYDARKINQY | 48334 | LSKYDARKI | 50431 |
| HPV56 | L1 | 199 | TPAMGEHWTKGAVCK | 48335 | MGEHWTKGA | 50432 |
| HPV56 | L1 | 69 | TSIFYHAGSSRLLAV | 48336 | FYHAGSSRL | 50433 |
| HPV56 | L1 | 403 | VEEYELQFVFQLCKI | 48337 | YELQFVFQL | 50434 |
| HPV56 | L1 | 32 | VFPIFLQMATWRPSE | 48338 | IFLQMATWR | 50435 |
| HPV56 | L1 | 411 | VFQLCKITLSAEVMA | 48339 | LCKITLSAE | 50436 |
| HPV56 | L1 | 109 | VFRVRLPDPNKFGLP | 48340 | VRLPDPNKF | 50437 |
| HPV56 | L1 | 27 | VGAVNVFPIFLQMAT | 48341 | VNVFPIFLQ | 50438 |
| HPV56 | L1 | 56 | VSKVVATDSYVKRTS | 48342 | VVATDSYVK | 50439 |
| HPV56 | L1 | 368 | VTVVDTTRSTNMTIS | 48343 | VDTTRSTNM | 50440 |
| HPV56 | L1 | 284 | WFYLRREQLFARHYF | 48344 | LRREQLFAR | 50441 |
| HPV56 | L1 | 268 | YPDYLKMSADAYGDS | 48345 | YLKMSADAY | 50442 |
| HPV56 | L1 | 107 | YRVFRVRLPDPNKFG | 48346 | FRVRLPDPN | 50443 |
| HPV56 | L1 | 454 | YRYVRSTAITCQREQ | 48347 | VRSTAITCQ | 50444 |
| HPV56 | L1 | 87 | YYSVTKDNTKTNIPK | 48348 | VTKDNTKTN | 50445 |
| HPV56 | L2 | 1 | ---MVAHRATRRKRA | 48349 | MVAHRATRR | 50446 |
| HPV56 | L2 | 2 | --MVAHRATRRKRAS | 48350 | VAHRATRRK | 50447 |
| HPV56 | L2 | 44 | ADKILQWGSLFTYFG | 48351 | ILQWGSLFT | 50448 |
| HPV56 | L2 | 332 | AEEIEMQPLLSANNS | 48352 | IEMQPLLSA | 50449 |
| HPV56 | L2 | 361 | APGLSSQSVATPSAH | 48353 | LSSQSVATP | 50450 |
| HPV56 | L2 | 249 | ATLVSADNPLFEGTD | 48354 | VSADNPLFE | 50451 |
| HPV56 | L2 | 409 | DIVLPTGPSTWPFVP | 48355 | LPTGPSTWP | 50452 |
| HPV56 | L2 | 45 | DKILQWGSLFTYFGG | 48356 | LQWGSLFTY | 50453 |
| HPV56 | L2 | 241 | DPAFLDRPATLVSAD | 48357 | FLDRPATLV | 50454 |
| HPV56 | L2 | 276 | DPDFMNIVALHRPAF | 48358 | FMNIVALHR | 50455 |
| HPV56 | L2 | 263 | DTSLAFSPSGVAPDP | 48359 | LAFSPSGVA | 50456 |
| HPV56 | L2 | 334 | EIEMQPLLSANNSFD | 48360 | MQPLLSANN | 50457 |
| HPV56 | L2 | 197 | EIPMQTFAVHGSGTE | 48361 | MQTFAVHGS | 50458 |
| HPV56 | L2 | 112 | ESSVIESGAGIPNFT | 48362 | VIESGAGIP | 50459 |
| HPV56 | L2 | 347 | FDGLYDIYANIDDEA | 48363 | LYDIYANID | 50460 |
| HPV56 | L2 | 234 | FQQVKVTDPAFLDRP | 48364 | VKVTDPAFL | 50461 |
| HPV56 | L2 | 221 | FRRIAAPRLYRKAFQ | 48365 | IAAPRLYRK | 50462 |
| HPV56 | L2 | 299 | FSRLGRKATIQTRRG | 48366 | LGRKATIQT | 50463 |
| HPV56 | L2 | 54 | FTYFGGLGIGTGTGS | 48367 | FGGLGIGTG | 50464 |
| HPV56 | L2 | 130 | GFEITSSSTTTPAVL | 48368 | ITSSSTTTP | 50465 |
| HPV56 | L2 | 181 | GNILISTPTSGIHSY | 48369 | LISTPTSGI | 50466 |
| HPV56 | L2 | 437 | GSSFALWPVYFFRRR | 48370 | FALWPVYFF | 50467 |
| HPV56 | L2 | 431 | HDVYIQGSSFALWPV | 48371 | YIQGSSFAL | 50468 |
| HPV56 | L2 | 375 | HLPIKPSTLSFASNT | 48372 | IKPSTLSFA | 50469 |
| HPV56 | L2 | 321 | HYYYDISPIAQAEEI | 48373 | YDISPIAQA | 50470 |
| HPV56 | L2 | 192 | IHSYEEIPMQTFAVH | 48374 | YEEIPMQTF | 50471 |
| HPV56 | L2 | 47 | ILQWGSLFTYFGGLG | 48375 | WGSLFTYFG | 50472 |
| HPV56 | L2 | 218 | IPGFRRIAAPRLYRK | 48376 | FRRIAAPRL | 50473 |
| HPV56 | L2 | 84 | IVDVTPARPPIVVES | 48377 | VTPARPPIV | 50474 |
| HPV56 | L2 | 106 | IVTLVEESSVIESGA | 48378 | LVEESSVIE | 50475 |
| HPV56 | L2 | 280 | MNIVALHRPAFTTRR | 48379 | VALHRPAFT | 50476 |
| HPV56 | L2 | 200 | MQTFAVHGSGTEPIS | 48380 | FAVHGSGTE | 50477 |
| HPV56 | L2 | 182 | NILISTPTSGIHSYE | 48381 | ISTPTSGIH | 50478 |
| HPV56 | L2 | 256 | NPLFEGTDTSLAFSP | 48382 | FEGTDTSLA | 50479 |
| HPV56 | L2 | 162 | NPLFIDPPVIEAPQT | 48383 | FIDPPVIEA | 50480 |
| HPV56 | L2 | 242 | PAFLDRPATLVSADN | 48384 | LDRPATLVS | 50481 |
| HPV56 | L2 | 141 | PAVLDITPTSSTVHV | 48385 | LDITPTSST | 50482 |
| HPV56 | L2 | 277 | PDFMNIVALHRPAFT | 48386 | MNIVALHRP | 50483 |
| HPV56 | L2 | 408 | PDIVLPTGPSTWPFV | 48387 | VLPTGPSTW | 50484 |
| HPV56 | L2 | 93 | PIVVESVGPTDPSIV | 48388 | VESVGPTDP | 50485 |
| HPV56 | L2 | 163 | PLFIDPPVIEAPQTG | 48389 | IDPPVIEAP | 50486 |
| HPV56 | L2 | 168 | PPVIEAPQTGEVSGN | 48390 | IEAPQTGEV | 50487 |
| HPV56 | L2 | 81 | PSTIVDVTPARPPIV | 48391 | IVDVTPARP | 50488 |
| HPV56 | L2 | 40 | QKTWADKILQWGSLF | 48392 | WADKILQWG | 50489 |

TABLE XIX-continued

DR Supermotif Peptides

| Type | Protein | Position | Sequence | Sequence Id. No. | Core Sequence | Core Seq. Id. No. |
|---|---|---|---|---|---|---|
| HPV56 | L2 | 338 | QPLLSANNSFDGLYD | 48393 | LSANNSFDG | 50490 |
| HPV56 | L2 | 71 | RAGYVPLGSRPSTIV | 48394 | YVPLGSRPS | 50491 |
| HPV56 | L2 | 294 | RGGVRFSRLGRKATI | 48395 | VRFSRLGRK | 50492 |
| HPV56 | L2 | 231 | RKAFQQVKVTDPAFL | 48396 | FQQVKVTDP | 50493 |
| HPV56 | L2 | 453 | RKRIPYFFADGDVAA | 48397 | IPYFFADGD | 50494 |
| HPV56 | L2 | 91 | RPPIVVESVGPTDPS | 48398 | IVVESVGPT | 50495 |
| HPV56 | L2 | 319 | RVHYYYDISPIAQAE | 48399 | YYYDISPIA | 50496 |
| HPV56 | L2 | 373 | SAHLPIKPSTLSFAS | 48400 | LPIKPSTLS | 50497 |
| HPV56 | L2 | 128 | SGGFEITSSSTTTPA | 48401 | FEITSSSTT | 50498 |
| HPV56 | L2 | 180 | SGNILISTPTSGIHS | 48402 | ILISTPTSG | 50499 |
| HPV56 | L2 | 265 | SLAFSPSGVAPDPDF | 48403 | FSPSGVAPD | 50500 |
| HPV56 | L2 | 366 | SQSVATPSAHLPIKP | 48404 | VATPSAHLP | 50501 |
| HPV56 | L2 | 150 | SSTVHVSSTHITNPL | 48405 | VHVSSTHIT | 50502 |
| HPV56 | L2 | 82 | STIVDVTPARPPIVV | 48406 | VDVTPARPP | 50503 |
| HPV56 | L2 | 23 | TCKLSGTCPEDVVNK | 48407 | LSGTCPEDV | 50504 |
| HPV56 | L2 | 210 | TEPISSTPIPGFRRI | 48408 | ISSTPIPGF | 50505 |
| HPV56 | L2 | 202 | TFAVHGSGTEPISST | 48409 | VHGSGTEPI | 50506 |
| HPV56 | L2 | 176 | TGEVSGNILISTPTS | 48410 | VSGNILIST | 50507 |
| HPV56 | L2 | 430 | THDVYIQGSSFALWP | 48411 | VYIQGSSFA | 50508 |
| HPV56 | L2 | 382 | TLSFASNTTNVTAPL | 48412 | FASNTTNVT | 50509 |
| HPV56 | L2 | 161 | TNPLFIDPPVIEAPQ | 48413 | LFIDPPVIE | 50510 |
| HPV56 | L2 | 140 | TPAVLDITPTSSTVH | 48414 | VLDITPTSS | 50511 |
| HPV56 | L2 | 402 | TPFYSGPDIVLPTGP | 48415 | YSGPDIVLP | 50512 |
| HPV56 | L2 | 18 | TQLYKTCKLSGTCPE | 48416 | YKTCKLSGT | 50513 |
| HPV56 | L2 | 152 | TVHVSSTHITNPLFI | 48417 | VSSTHITNP | 50514 |
| HPV56 | L2 | 418 | TWPFVPQSPYDVTHD | 48418 | FVPQSPYDV | 50515 |
| HPV56 | L2 | 96 | VESVGPTDPSIVTLV | 48419 | VGPTDPSIV | 50516 |
| HPV56 | L2 | 320 | VHYYYDISPIAQAEE | 48420 | YYDISPIAQ | 50517 |
| HPV56 | L2 | 143 | VLDITPTSSTVHVSS | 48421 | ITPTSSTVH | 50518 |
| HPV56 | L2 | 107 | VTLVEESSVIESGAG | 48422 | VEESSVIES | 50519 |
| HPV56 | L2 | 354 | YANIDDEAPGLSSQS | 48423 | IDDEAPGLS | 50520 |
| HPV56 | L2 | 74 | YVPLGSRPSTIVDVT | 48424 | LGSRPSTIV | 50521 |

TABLE XXa

DR 3a Submotif Peptides

| Type | Protein | Position | Sequence | Sequence Id. No. | Core Sequence | Core Seq. Id. No. |
|---|---|---|---|---|---|---|
| HPV16 | E1 | 531 | CWNYIDDNLRNALDG | 50522 | YIDDNLRNA | 50853 |
| HPV16 | E1 | 369 | DNDIVDDSEIAYKYA | 50523 | IVDDSEIAY | 50854 |
| HPV16 | E1 | 33 | GDAISDDENENDSDT | 50524 | ISDDENEND | 50855 |
| HPV16 | E1 | 332 | ISEVYGDTPEWIQRQ | 50525 | VYGDTPEWI | 50856 |
| HPV16 | E1 | 520 | KIGMLDDATVPCWNY | 50526 | MLDDATVPC | 50857 |
| HPV16 | E1 | 113 | LKAICIEKQSRAAKR | 50527 | ICIEKQSRA | 50858 |
| HPV16 | E1 | 19 | NGWFYVEAVVEKKTG | 50528 | FYVEAVVEK | 50859 |
| HPV16 | E1 | 305 | PMCMMIEPPKLRSTA | 50529 | MMIEPPKLR | 50860 |
| HPV16 | E1 | 592 | PNEFPFDENGNPVYE | 50530 | FPFDENGNP | 50861 |
| HPV16 | E1 | 401 | QAKIVKDCATMCRHY | 50531 | IVKDCATMC | 50862 |
| HPV16 | E1 | 365 | QWAYDNDIVDDSEIA | 50532 | YDNDIVDDS | 50863 |
| HPV16 | E1 | 622 | RLSLHEDEDKENDGD | 50533 | LHEDEDKEN | 50864 |
| HPV16 | E1 | 127 | RRLFESEDSGYGNTE | 50534 | FESEDSGYG | 50865 |
| HPV16 | E1 | 52 | VDFIVNDNDYLTQAE | 50535 | IVNDNDYLT | 50866 |
| HPV16 | E1 | 588 | VFTFPNEFPFDENGN | 50536 | FPNEFPFDE | 50867 |
| HPV16 | E1 | 428 | WIKYRCDRVDDGGDW | 50537 | YRCDRVDDG | 50868 |
| HPV16 | E2 | 229 | AVALGTEETQTTIQR | 50538 | LGTEETQTT | 50869 |
| HPV16 | E2 | 77 | ELQLTLETIYNSQYS | 50539 | LTLETIYNS | 50870 |
| HPV16 | E2 | 121 | EVQFDGDICNTMHYT | 50540 | FDGDICNTM | 50871 |
| HPV16 | E2 | 171 | FVQFKDDAEKYSKNK | 50541 | FKDDAEKYS | 50872 |
| HPV16 | E2 | 159 | GLYYVHEGIRTYFVQ | 50542 | YVHEGIRTY | 50873 |
| HPV16 | E2 | 139 | HIYICEEASVTVVEG | 50543 | ICEEASVTV | 50874 |
| HPV16 | E2 | 291 | IVHLKGDANTLKCLR | 50544 | LKGDANTLK | 50875 |
| HPV16 | E2 | 335 | IVTLTYDSEWQRDQF | 50545 | LTYDSEWQR | 50876 |
| HPV16 | E2 | 115 | KHGYTVEVQFDGDIC | 50546 | YTVEVQFDG | 50877 |
| HPV16 | E2 | 97 | LQDVSLEVYLTAPTG | 50547 | VSLEVYLTA | 50878 |
| HPV16 | E2 | 19 | LTHYENDSTDLRDHI | 50548 | YENDSTDLR | 50879 |
| HPV16 | E2 | 87 | NSQYSNEKWTLQDVS | 50549 | YSNEKWTLQ | 50880 |
| HPV16 | E2 | 10 | RLNVCQDKILTHYEN | 50550 | VCQDKILTH | 50881 |
| HPV16 | E2 | 138 | THIYICEEASVTVVE | 50551 | YICEEASVT | 50882 |
| HPV16 | E2 | 257 | TKLLHRDSVDSAPIL | 50552 | LHRDSVDSA | 50883 |
| HPV16 | E2 | 337 | TLTYDSEWQRDQFLS | 50553 | YDSEWQRDQ | 50884 |
| HPV16 | E2 | 119 | TVEVQFDGDICNTMH | 50554 | VQFDGDICN | 50885 |

TABLE XXa-continued

DR 3a Submotif Peptides

| Type | Protein | Position | Sequence | Sequence Id. No. | Core Sequence | Core Seq. Id. No. |
|---|---|---|---|---|---|---|
| HPV16 | E2 | 36 | WKHMRLECAIYYKAR | 50555 | MRLECAIYY | 50886 |
| HPV16 | E6 | 33 | IHDIILECVYCKQQL | 50556 | IILECVYCK | 50887 |
| HPV16 | E6 | 60 | LCIVYRDGNPYAVCD | 50557 | VYRDGNPYA | 50888 |
| HPV16 | E6 | 22 | LPQLCTELQTTIHDI | 50558 | LCTELQTTI | 50889 |
| HPV16 | E6 | 45 | QQLLRREVYDFAFRD | 50559 | LRREVYDFA | 50890 |
| HPV16 | E6 | 8 | RTAMFQDPQERPRKL | 50560 | MFQDPQERP | 50891 |
| HPV16 | E7 | 1 | MHGDTPTLHEYM | 50561 | MHGDTPTLH | 50892 |
| HPV16 | E7 | 11 | LHEYMLDLQPETTDL | 50562 | YMLDLQPET | 50893 |
| HPV16 | E7 | 15 | MLDLQPETTDLYCYE | 50563 | LQPETTDLY | 50894 |
| HPV16 | E7 | 23 | TDLYCYEQLNDSSEE | 50564 | YCYEQLNDS | 50895 |
| HPV16 | L1 | 276 | FFYLRREQMFVRHLF | 50565 | LRREQMFVR | 50896 |
| HPV16 | L1 | 297 | GENVPDDLYIKGSGS | 50566 | VPDDLYIKG | 50897 |
| HPV16 | L1 | 326 | GSMVTSDAQIFNKPY | 50567 | VTSDAQIFN | 50898 |
| HPV16 | L1 | 220 | INTVIQDGDMVDTGF | 50568 | VIQDGDMVD | 50899 |
| HPV16 | L1 | 14 | ITCYENDVNVYHIFF | 50569 | YENDVNVYH | 50900 |
| HPV16 | L1 | 481 | KEKFSADLDQFPLGR | 50570 | FSADLDQFP | 50901 |
| HPV16 | L1 | 409 | KITLTADVMTYIHSM | 50571 | LTADVMTYI | 50902 |
| HPV16 | L1 | 246 | KSEVPLDICTSICKY | 50572 | VPLDICTSI | 50903 |
| HPV16 | L1 | 424 | NSTILEDWNFGLQPP | 50573 | ILEDWNFGL | 50904 |
| HPV16 | L1 | 48 | SKVVSTDEYVARTNI | 50574 | VSTDEYVAR | 50905 |
| HPV16 | L1 | 31 | SLWLPSEATVYLPPV | 50575 | LPSEATVYL | 50906 |
| HPV16 | L1 | 117 | TSFYNPDTQRLVWAC | 50576 | YNPDTQRLV | 50907 |
| HPV16 | L1 | 129 | WACVGVEVGRGQPLG | 50577 | VGVEVGRGQ | 50908 |
| HPV16 | L1 | 263 | YIKMVSEPYGDSLFF | 50578 | MVSEPYGDS | 50909 |
| HPV16 | L2 | 373 | ADDFITDTSTTPVPS | 50579 | FITDTSTTP | 50910 |
| HPV16 | L2 | 108 | IVSLVEETSFIDAGA | 50580 | LVEETSFID | 50911 |
| HPV16 | L2 | 326 | KVHYYYDFSTIDSAE | 50581 | YYYDFSTID | 50912 |
| HPV16 | L2 | 465 | LPYFFSDVSLAA | 50582 | FFSDVSLAA | 50913 |
| HPV16 | L2 | 368 | LYDIYADDFITDTST | 50583 | IYADDFITD | 50914 |
| HPV16 | L2 | 439 | QYTIIADAGDFYLHP | 50584 | IIADAGDFY | 50915 |
| HPV16 | L2 | 93 | RPPLTVDPVGPSDPS | 50585 | LTVDPVGPS | 50916 |
| HPV16 | L2 | 277 | SINIAPDPDFLDIVA | 50586 | IAPDPDFLD | 50917 |
| HPV16 | L2 | 250 | TKLITYDNPAYEGID | 50587 | ITYDNPAYE | 50918 |
| HPV16 | L2 | 126 | VPSIPPDVSGFSITT | 50588 | IPPDVSGFS | 50919 |
| HPV16 | L2 | 369 | YDIYADDFITDTSTT | 50589 | YADDFITDT | 50920 |
| HPV16 | L2 | 196 | YEEIPMDTFIVSTNP | 50590 | IPMDTFIVS | 50921 |
| HPV16 | L2 | 260 | YEGIDVDNTLYFSSN | 50591 | IDVDNTLYF | 50922 |
| HPV18 | E1 | 75 | AQEVHNDAQVLHVLK | 50592 | VHNDAQVLH | 50923 |
| HPV18 | E1 | 376 | DNELTDESDMAFEYA | 50593 | LTDESDMAF | 50924 |
| HPV18 | E1 | 382 | ESDMAFEYALLADSN | 50594 | MAFEYALLA | 50925 |
| HPV18 | E1 | 388 | EYALLADSNSNAAAF | 50595 | LLADSNSNA | 50926 |
| HPV18 | E1 | 32 | GDVISDDEDENATDT | 50596 | ISDDEDENA | 50927 |
| HPV18 | E1 | 103 | GERLEVDTELSPRLQ | 50597 | LEVDTELSP | 50928 |
| HPV18 | E1 | 339 | ISEVMGDTPEWIQRL | 50598 | VMGDTPEWI | 50929 |
| HPV18 | E1 | 527 | KVAMLDDATTTCWTY | 50599 | MLDDATTTC | 50930 |
| HPV18 | E1 | 217 | MLAVFKDTYGLSFTD | 50600 | VFKDTYGLS | 50931 |
| HPV18 | E1 | 599 | PNAFPFDKNGNPVYE | 50601 | FPFDKNGNP | 50932 |
| HPV18 | E1 | 408 | QAKYLKDCATMCKHY | 50602 | YLKDCATMC | 50933 |
| HPV18 | E1 | 372 | QWAFDNELTDESDMA | 50603 | FDNELTDES | 50934 |
| HPV18 | E1 | 629 | RLDLHEEEEDADTEG | 50604 | LHEEEEDAD | 50935 |
| HPV18 | E1 | 105 | RLEVDTELSPRLQEI | 50605 | VDTELSPRL | 50936 |
| HPV18 | E1 | 31 | TGDVISDDEDENATD | 50606 | VISDDEDEN | 50937 |
| HPV18 | E1 | 515 | TSHFWLEPLTDTKVA | 50607 | FWLEPLTDT | 50938 |
| HPV18 | E1 | 233 | VRNFKSDKTTCTDWV | 50608 | FKSDKTTCT | 50939 |
| HPV18 | E2 | 164 | GLYYVKEGYNTFYIE | 50609 | YVKEGYNTF | 50940 |
| HPV18 | E2 | 292 | IIHLKGDRNSLKCLR | 50610 | LKGDRNSLK | 50941 |
| HPV18 | E2 | 136 | MTYVAWDSVYYMTDA | 50611 | VAWDSVYYM | 50942 |
| HPV18 | E2 | 91 | QSRYKTEDWTLQDTC | 50612 | YKTEDWTLQ | 50943 |
| HPV18 | E2 | 143 | SVYYMTDAGTWDKTA | 50613 | YMTDAGTWD | 50944 |
| HPV18 | E2 | 123 | TVQVYFDGNKDNCMT | 50614 | VYFDGNKDN | 50945 |
| HPV18 | E2 | 337 | TVTYHSETQRTKFLN | 50615 | YHSETQRTK | 50946 |
| HPV18 | E2 | 40 | WQLIRWENAIFFAAR | 50616 | IRWENAIFF | 50947 |
| HPV18 | E2 | 176 | YIEFKSECEKYGNTG | 50617 | FKSECEKYG | 50948 |
| HPV18 | E6 | 55 | LFVVYRDSIPHAACH | 50618 | VYRDSIPHA | 50949 |
| HPV18 | E6 | 17 | LPDLCTELNTSLQDI | 50619 | LCTELNTSL | 50950 |
| HPV18 | E6 | 85 | SDSVYGDTLEKLTNT | 50620 | VYGDTLEKL | 50951 |
| HPV18 | E7 | 13 | DIVLHLEPQNEIPVD | 50621 | LHLEPQNEI | 50952 |
| HPV18 | E7 | 21 | QNEIPVDLLCHEQLS | 50622 | IPVDLLCHE | 50953 |
| HPV18 | E7 | 74 | RIKLVVESSADDLRA | 50623 | LVVESSADD | 50954 |
| HPV18 | E7 | 26 | VDLLCHEQLSDSEEE | 50624 | LCHEQLSDS | 50955 |
| HPV18 | L1 | 83 | ARVVNTDDYVTPTSI | 50625 | VNTDDYVTP | 50956 |
| HPV18 | L1 | 311 | FFCLRREQLFARHFW | 50626 | LRREQLFAR | 50957 |
| HPV18 | L1 | 361 | GSIVTSDSQLFNKPY | 50627 | VTSDSQLFN | 50958 |
| HPV18 | L1 | 281 | KCEVPLDICQSICKY | 50628 | VPLDICQSI | 50959 |
| HPV18 | L1 | 517 | KEKFSLDLDQYPLGR | 50629 | FSLDLDQYP | 50960 |

TABLE XXa-continued

DR 3a Submotif Peptides

| Type | Protein | Position | Sequence | Sequence Id. No. | Core Sequence | Core Seq. Id. No. |
|---|---|---|---|---|---|---|
| HPV18 | L1 | 519 | KFSLDLDQYPLGRKF | 50630 | LDLDQYPLG | 50961 |
| HPV18 | L1 | 255 | KNTVLEDGDMVDTGY | 50631 | VLEDGDMVD | 50962 |
| HPV18 | L1 | 460 | NSSILEDWNFGVPPP | 50632 | ILEDWNFGV | 50963 |
| HPV18 | L1 | 445 | TITLTADVMSYIHSM | 50633 | LTADVMSYI | 50964 |
| HPV18 | L1 | 152 | TSIYNPETQRLVWAC | 50634 | YNPETQRLV | 50965 |
| HPV18 | L1 | 298 | YLQMSADPYGDSMFF | 50635 | MSADPYGDS | 50966 |
| HPV18 | L2 | 351 | FDIYADDMDPAVPVP | 50636 | YADDMDPAV | 50967 |
| HPV18 | L2 | 106 | IVTLIEDSSVVTSGA | 50637 | LIEDSSVVT | 50968 |
| HPV18 | L2 | 350 | LFDIYADDMDPAVPV | 50638 | IYADDMDPA | 50969 |
| HPV18 | L2 | 91 | RPPVVIEPVGPTDPS | 50639 | VVIEPVGPT | 50970 |
| HPV18 | L2 | 319 | RVHFYHDISPIAPSP | 50640 | FYHDISPIA | 50971 |
| HPV18 | L2 | 249 | SSLITYDNPAFEPVD | 50641 | ITYDNPAFE | 50972 |
| HPV18 | L2 | 454 | VPYFFADGFVAA | 50642 | FFADGFVAA | 50973 |
| HPV31 | E1 | 413 | CDKVSDEGDWRDIVK | 50643 | VSDEGDWRD | 50974 |
| HPV31 | E1 | 349 | DNDVMDDSEIAYKYA | 50644 | VMDDSEIAY | 50975 |
| HPV31 | E1 | 32 | GDNISEDENEDSSDT | 50645 | ISEDENEDS | 50976 |
| HPV31 | E1 | 312 | ISDVYGETPEWIERQ | 50646 | VYGETPEWI | 50977 |
| HPV31 | E1 | 500 | KIGMLDDATTPCWHY | 50647 | MLDDATTPC | 50978 |
| HPV31 | E1 | 268 | KNRITIEKLLEKLLC | 50648 | ITIEKLLEK | 50979 |
| HPV31 | E1 | 112 | LKAICIENNSKTAKR | 50649 | ICIENNSKT | 50980 |
| HPV31 | E1 | 18 | NGWFYVEAVIDRQTG | 50650 | FYVEAVIDR | 50981 |
| HPV31 | E1 | 572 | PNPFPFDKNGNPVYE | 50651 | FPFDKNGNP | 50982 |
| HPV31 | E1 | 381 | QAKIVKDCGTMCRHY | 50652 | IVKDCGTMC | 50983 |
| HPV31 | E1 | 144 | QQMVQVEEQQTTLSC | 50653 | VQVEEQQTT | 50984 |
| HPV31 | E1 | 345 | QWAYDNDVMDDSEIA | 50654 | YDNDVMDDS | 50985 |
| HPV31 | E1 | 602 | RLNLHEEEDKENDGD | 50655 | LHEEEDKEN | 50986 |
| HPV31 | E2 | 77 | ELQMMLETLNNTEYK | 50656 | MMLETLNNT | 50987 |
| HPV31 | E2 | 200 | ESVFSSDEISFAGIV | 50657 | FSSDEISFA | 50988 |
| HPV31 | E2 | 139 | FIYLCIDGQCTVVEG | 50658 | LCIDGQCTV | 50989 |
| HPV31 | E2 | 298 | IIHLKGDANILKCLR | 50659 | LKGDANILK | 50990 |
| HPV31 | E2 | 115 | KHGYTVEVQFDGDVH | 50660 | YTVEVQFDG | 50991 |
| HPV31 | E2 | 262 | NKLLRGDSVDSVNCG | 50661 | LRGDSVDSV | 50992 |
| HPV31 | E2 | 87 | NTEYKNEDWTMQQTS | 50662 | YKNEDWTMQ | 50993 |
| HPV31 | E2 | 194 | QVIVFPESVFSSDEI | 50663 | VFPESVFSS | 50994 |
| HPV31 | E2 | 10 | RLNVCQDKILEHYEN | 50664 | VCQDKILEH | 50995 |
| HPV31 | E2 | 119 | TVEVQFDGDVHNTMH | 50665 | VQFDGDVHN | 50996 |
| HPV31 | E2 | 36 | WKHIRLECVLMYKAR | 50666 | IRLECVLMY | 50997 |
| HPV31 | E6 | 21 | ALEIPYDELRLNCVY | 50667 | IPYDELRLN | 50998 |
| HPV31 | E6 | 53 | LTIVYRDDTPHGVCT | 50668 | VYRDDTPHG | 50999 |
| HPV31 | E6 | 54 | TIVYRDDTPHGVCTK | 50669 | YRDDTPHGV | 51000 |
| HPV31 | E7 | 1 | MRGETPTLQDYV | 50670 | MRGETPTLQ | 51001 |
| HPV31 | E7 | 78 | DIRILQELLMGSFGI | 50671 | ILQELLMGS | 51002 |
| HPV31 | E7 | 11 | LQDYVLDLQPEATDL | 50672 | YVLDLQPEA | 51003 |
| HPV31 | E7 | 15 | VLDLQPEATDLHCYE | 50673 | LQPEATDLH | 51004 |
| HPV31 | L1 | 251 | FFYLRREQMFVRHFF | 50674 | LRREQMFVR | 51005 |
| HPV31 | L1 | 272 | GESVPTDLYIKGSGS | 50675 | VPTDLYIKG | 51006 |
| HPV31 | L1 | 301 | GSMVTSDAQIFNKPY | 50676 | VTSDAQIFN | 51007 |
| HPV31 | L1 | 446 | KDYVFWEVNLKEKFS | 50677 | VFWEVNLKE | 51008 |
| HPV31 | L1 | 456 | KEKFSADLDQFPLGR | 50678 | FSADLDQFP | 51009 |
| HPV31 | L1 | 384 | KITLSADIMTYIHSM | 50679 | LSADIMTYI | 51010 |
| HPV31 | L1 | 195 | KNSVIQDGDMVDTGF | 50680 | VIQDGDMVD | 51011 |
| HPV31 | L1 | 221 | KSNVPLDICNSICKY | 50681 | VPLDICNSI | 51012 |
| HPV31 | L1 | 399 | NPAILEDWNFGLTTP | 50682 | ILEDWNFGL | 51013 |
| HPV31 | L1 | 22 | SKVVSTDEYVTRTNI | 50683 | VSTDEYVTR | 51014 |
| HPV31 | L1 | 92 | TSFYNPETQRLVWAC | 50684 | YNPETQRLV | 51015 |
| HPV31 | L1 | 104 | WACVGLEVGRGQPLG | 50685 | VGLEVGRGQ | 51016 |
| HPV31 | L1 | 238 | YLKMVAEPYGDTLFF | 50686 | MVAEPYGDT | 51017 |
| HPV31 | L2 | 361 | DTDFTVDTPATHNVS | 50687 | FTVDTPATH | 51018 |
| HPV31 | L2 | 409 | GPDVPIEHAPTQVFP | 50688 | VPIEHAPTQ | 51019 |
| HPV31 | L2 | 108 | IVSLVEESGIVDVGA | 50689 | LVEESGIVD | 51020 |
| HPV31 | L2 | 245 | KQLITYENPAYETVN | 50690 | ITYENPAYE | 51021 |
| HPV31 | L2 | 355 | LYDIYADTDFTVDTP | 50691 | IYADTDFTV | 51022 |
| HPV31 | L2 | 432 | QVSIFVDGGDFYLHP | 50692 | IFVDGGDFY | 51023 |
| HPV31 | L2 | 93 | RPPVSIDPVGPLDPS | 50693 | VSIDPVGPL | 51024 |
| HPV31 | L2 | 319 | RVHYYYDISSINPAG | 50694 | YYYDISSIN | 51025 |
| HPV31 | L2 | 270 | SHNIAPDPDFLDIIA | 50695 | IAPDPDFLD | 51026 |
| HPV31 | L2 | 458 | VSYFFTDVSVAA | 50696 | FFTDVSVAA | 51027 |
| HPV31 | L2 | 191 | YEEIPMDTFIVSTNN | 50697 | IPMDTFIVS | 51028 |
| HPV31 | L2 | 255 | YETVNAEESLYFSNT | 50698 | VNAEESLYF | 51029 |
| HPV33 | E1 | 362 | DNELTDDSDIAYYYA | 50699 | LTDDSDIAY | 51030 |
| HPV33 | E1 | 170 | DSEVSCETNVDSCEN | 50700 | VSCETNVDS | 51031 |
| HPV33 | E1 | 59 | ENSIQADTEAARALF | 50701 | IQADTEAAR | 51032 |
| HPV33 | E1 | 298 | ETCMVIEPPKLRSQT | 50702 | MVIEPPKLR | 51033 |
| HPV33 | E1 | 32 | GDNISEDEDETADDS | 50703 | ISEDEDETA | 51034 |
| HPV33 | E1 | 513 | KIGMIDDVTPISWTY | 50704 | MIDDVTPIS | 51035 |

TABLE XXa-continued

DR 3a Submotif Peptides

| Type | Protein | Position | Sequence | Sequence Id. No. | Core Sequence | Core Seq. Id. No. |
|---|---|---|---|---|---|---|
| HPV33 | E1 | 615 | KLDLIEEEDKENHGG | 50705 | LIEEEDKEN | 51036 |
| HPV33 | E1 | 585 | KNPFPFDENGNPVYA | 50706 | FPFDENGNP | 51037 |
| HPV33 | E1 | 50 | LLEFIDDSMENSIQA | 50707 | FIDDSMENS | 51038 |
| HPV33 | E1 | 260 | LQCLTCDRGIIILLL | 50708 | LTCDRGIII | 51039 |
| HPV33 | E1 | 394 | QAKIVKDCGIMCRHY | 50709 | IVKDCGIMC | 51040 |
| HPV33 | E1 | 358 | QWAYDNELTDDSDIA | 50710 | YDNELTDDS | 51041 |
| HPV33 | E1 | 164 | SSGVGDDSEVSCETN | 50711 | VGDDSEVSC | 51042 |
| HPV33 | E1 | 524 | SWTYIDDYMRNALDG | 50712 | YIDDYMRNA | 51043 |
| HPV33 | E1 | 18 | TGWFEVEAVIERRTG | 50713 | FEVEAVIER | 51044 |
| HPV33 | E1 | 219 | VRPFKSDKTSCTDWC | 50714 | FKSDKTSCT | 51045 |
| HPV33 | E1 | 597 | VYAINDENWKSFFSR | 50715 | INDENWKSF | 51046 |
| HPV33 | E2 | 139 | EIYIIEEDTCTMVTG | 50716 | IIEEDTCTM | 51047 |
| HPV33 | E2 | 77 | ELQMALETLSKSQYS | 50717 | MALETLSKS | 51048 |
| HPV33 | E2 | 171 | FKYFKEDAAKYSKTQ | 50718 | FKEDAAKYS | 51049 |
| HPV33 | E2 | 138 | GEIYIIEEDTCTMVT | 50719 | YIIEEDTCT | 51050 |
| HPV33 | E2 | 279 | IVHLKGESNSLKCLR | 50720 | LKGESNSLK | 51051 |
| HPV33 | E2 | 140 | IYIIEEDTCTMVTGK | 50721 | IEEDTCTMV | 51052 |
| HPV33 | E2 | 19 | LDLYEADKTDLPSQI | 50722 | YEADKTDLP | 51053 |
| HPV33 | E2 | 212 | TADIQTDNDNRPPQA | 50723 | IQTDNDNRP | 51054 |
| HPV33 | E2 | 244 | TKLFCADPALDNRTA | 50724 | FCADPALDN | 51055 |
| HPV33 | E2 | 325 | TVTFVTEQQQQMFLG | 50725 | FVTEQQQQM | 51056 |
| HPV33 | E2 | 119 | TVTVQYDNDKKNTMD | 50726 | VQYDNDKKN | 51057 |
| HPV33 | E2 | 36 | WKLIRMECALLYTAK | 50727 | IRMECALLY | 51058 |
| HPV33 | E2 | 170 | YFKYFKEDAAKYSKT | 50728 | YFKEDAAKY | 51059 |
| HPV33 | E6 | 1 | MFQDTEEKPRTL | 50729 | MFQDTEEKP | 51060 |
| HPV33 | E6 | 53 | LTVVYREGNPFGICK | 50730 | VYREGNPFG | 51061 |
| HPV33 | E7 | 11 | LKEYVLDLYPEPTDL | 50731 | YVLDLYPEP | 51062 |
| HPV33 | E7 | 23 | TDLYCYEQLSDSSDE | 50732 | YCYEQLSDS | 51063 |
| HPV33 | E7 | 15 | VLDLYPEPTDLYCYE | 50733 | LYPEPTDLY | 51064 |
| HPV33 | L1 | 348 | CTQVTSDSTYKNENF | 50734 | VTSDSTYKN | 51065 |
| HPV33 | L1 | 354 | DSTYKNENFKEYIRH | 50735 | YKNENFKEY | 51066 |
| HPV33 | L1 | 250 | FFFLRREQMFVRHFF | 50736 | LRREQMFVR | 51067 |
| HPV33 | L1 | 271 | GEAVPDDLYIKGSGT | 50737 | VPDDLYIKG | 51068 |
| HPV33 | L1 | 300 | GSMVTSESQLFNKPY | 50738 | VTSESQLFN | 51069 |
| HPV33 | L1 | 393 | IHAMNPDILEDWQFG | 50739 | MNPDILEDW | 51070 |
| HPV33 | L1 | 194 | INTIIEDGDMVDTGF | 50740 | IIEDGDMVD | 51071 |
| HPV33 | L1 | 454 | KEKFSADLDQFPLGR | 50741 | FSADLDQFP | 51072 |
| HPV33 | L1 | 220 | KSDVPIDICGSTCKY | 50742 | VPIDICGST | 51073 |
| HPV33 | L1 | 382 | KVTLTAEVMTYIHAM | 50743 | LTAEVMTYI | 51074 |
| HPV33 | L1 | 397 | NPDILEDWQFGLTPP | 50744 | ILEDWQFGL | 51075 |
| HPV33 | L1 | 22 | SKVVSTDEYVSRTSI | 50745 | VSTDEYVSR | 51076 |
| HPV33 | L1 | 92 | TSFYNPDTQRLVWAC | 50746 | YNPDTQRLV | 51077 |
| HPV33 | L1 | 104 | WACVGLEIGRGQPLG | 50747 | VGLEIGRGQ | 51078 |
| HPV33 | L1 | 237 | YLKMTSEPYGDSLFF | 50748 | MTSEPYGDS | 51079 |
| HPV33 | L2 | 338 | DHTVPNEQYELQPLH | 50749 | VPNEQYELQ | 51080 |
| HPV33 | L2 | 433 | FDTIVVDGADFVLHP | 50750 | IVVDGADFV | 51081 |
| HPV33 | L2 | 260 | FESFDPEDTLQFQHS | 50751 | FDPEDTLQF | 51082 |
| HPV33 | L2 | 250 | HKLITYDNPAFESFD | 50752 | ITYDNPAFE | 51083 |
| HPV33 | L2 | 107 | IVSLIEETSFIEAGA | 50753 | LIEETSFIE | 51084 |
| HPV33 | L2 | 365 | LYDVYADDVDNVHTP | 50754 | VYADDVDNV | 51085 |
| HPV33 | L2 | 324 | RIHYYQDLSPIVPLD | 50755 | YYQDLSPIV | 51086 |
| HPV33 | L2 | 92 | RPPVTVDTVGPLDSS | 50756 | VTVDTVGPL | 51087 |
| HPV33 | L2 | 428 | SPFFPFDTIVVDGAD | 50757 | FPFDTIVVD | 51088 |
| HPV33 | L2 | 332 | SPIVPLDHTVPNEQY | 50758 | VPLDHTVPN | 51089 |
| HPV33 | L2 | 203 | TFVVSTDSSNVTSST | 50759 | VSTDSSNVT | 51090 |
| HPV33 | L2 | 366 | YDVYADDVDNVHTPM | 50760 | YADDVDNVH | 51091 |
| HPV33 | L2 | 196 | YENIPMDTFVVSTDS | 50761 | IPMDTFVVS | 51092 |
| HPV33 | L2 | 74 | YVPIGTDPPTAAIPL | 50762 | IGTDPPTAA | 51093 |
| HPV45 | E1 | 75 | AQEVQNDAQVLHLLK | 50763 | VQNDAQVLH | 51094 |
| HPV45 | E1 | 362 | DNDLTDESDMAFQYA | 50764 | LTDESDMAF | 51095 |
| HPV45 | E1 | 298 | ETCMLIEPPKLRSSV | 50765 | MLIEPPKLR | 51096 |
| HPV45 | E1 | 32 | GDVISDDEDETATDT | 50766 | ISDDEDETA | 51097 |
| HPV45 | E1 | 103 | GEQLSVDTDLSPRLQ | 50767 | LSVDTDLSP | 51098 |
| HPV45 | E1 | 325 | ISEVSGDTPEWIQRL | 50768 | VSGDTPEWI | 51099 |
| HPV45 | E1 | 513 | KVAMLDDATHTCWTY | 50769 | MLDDATHTC | 51100 |
| HPV45 | E1 | 203 | MLAVFKDIYGLSFTD | 50770 | VFKDIYGLS | 51101 |
| HPV45 | E1 | 18 | NGWFFVETIVEKKTG | 50771 | FFVETIVEK | 51102 |
| HPV45 | E1 | 501 | NSHFWLEPLADTKVA | 50772 | FWLEPLADT | 51103 |
| HPV45 | E1 | 585 | PHAFPFDKNGNPVYE | 50773 | FPFDKNGNP | 51104 |
| HPV45 | E1 | 394 | QAKYLKDCAVMCRHY | 50774 | YLKDCAVMC | 51105 |
| HPV45 | E1 | 105 | QLSVDTDLSPRLQEI | 50775 | VDTDLSPRL | 51106 |
| HPV45 | E1 | 358 | QWAFDNDLTDESDMA | 50776 | FDNDLTDES | 51107 |
| HPV45 | E1 | 615 | RLDLHEDDEDADTEG | 50777 | LHEDDEDAD | 51108 |
| HPV45 | E1 | 31 | TGDVISDDEDETATD | 50778 | VISDDEDET | 51109 |
| HPV45 | E1 | 219 | VRNFKSDKTTCTDWV | 50779 | FKSDKTTCT | 51110 |

TABLE XXa-continued

DR 3a Submotif Peptides

| Type | Protein | Position | Sequence | Sequence Id. No. | Core Sequence | Core Seq. Id. No. |
|---|---|---|---|---|---|---|
| HPV45 | E2 | 166 | GVYYIKDGDTTYYVQ | 50780 | YIKDGDTTY | 51111 |
| HPV45 | E2 | 296 | IIHLKGDKNSLKCLR | 50781 | LKGDKNSLK | 51112 |
| HPV45 | E2 | 138 | MNYVVWDSIYYITET | 50782 | VVWDSIYYI | 51113 |
| HPV45 | E2 | 93 | QSKYNNEEWTLQDTC | 50783 | YNNEEWTLQ | 51114 |
| HPV45 | E2 | 145 | SIYYITETGIWDKTA | 50784 | YITETGIWD | 51115 |
| HPV45 | E2 | 125 | TVHVYFDGNKDNCMN | 50785 | VYFDGNKDN | 51116 |
| HPV45 | E2 | 340 | TVTYNSEVQRNTFLD | 50786 | YNSEVQRNT | 51117 |
| HPV45 | E2 | 42 | WQLIRLENAILFTAR | 50787 | IRLENAILF | 51118 |
| HPV45 | E2 | 178 | YVQFKSECEKYGNSN | 50788 | FKSECEKYG | 51119 |
| HPV45 | E6 | 55 | LFIVYRDCIAYAACH | 50789 | VYRDCIAYA | 51120 |
| HPV45 | E6 | 17 | LPDLCTELNTSLQDV | 50790 | LCTELNTSL | 51121 |
| HPV45 | E6 | 85 | SNSVYGETLEKITNT | 50791 | VYGETLEKI | 51122 |
| HPV45 | E7 | 13 | EIVLHLEPQNELDPV | 50792 | LHLEPQNEL | 51123 |
| HPV45 | E7 | 75 | RIELTVESSADDLRT | 50793 | LTVESSADD | 51124 |
| HPV45 | E7 | 27 | VDLLCYEQLSESEEE | 50794 | LCYEQLSES | 51125 |
| HPV45 | L1 | 48 | ARVVNTDDYVSRTSI | 50795 | VNTDDYVSR | 51126 |
| HPV45 | L1 | 277 | FFCLRREQLFARHFW | 50796 | LRREQLFAR | 51127 |
| HPV45 | L1 | 298 | GDTVPTDLYIKGTSA | 50797 | VPTDLYIKG | 51128 |
| HPV45 | L1 | 247 | KCEVPLDICQSICKY | 50798 | VPLDICQSI | 51129 |
| HPV45 | L1 | 485 | KEKFSSDLDQYPLGR | 50799 | FSSDLDQYP | 51130 |
| HPV45 | L1 | 221 | KNTIIEDGDMVDTGY | 50800 | IIEDGDMVD | 51131 |
| HPV45 | L1 | 293 | RAGVMGDTVPTDLYI | 50801 | VMGDTVPTD | 51132 |
| HPV45 | L1 | 118 | STIYNPETQRLVWAC | 50802 | YNPETQRLV | 51133 |
| HPV45 | L1 | 413 | TITLTAEVMSYIHSM | 50803 | LTAEVMSYI | 51134 |
| HPV45 | L1 | 130 | WACVGMEIGRGQPLG | 50804 | VGMEIGRGQ | 51135 |
| HPV45 | L1 | 264 | YLQMSADPYGDSMFF | 50805 | MSADPYGDS | 51136 |
| HPV45 | L2 | 263 | DTTLSFEPTSNVPDS | 50806 | LSFEPTSNV | 51137 |
| HPV45 | L2 | 455 | IPYFFADGFVAA | 50807 | FFADGFVAA | 51138 |
| HPV45 | L2 | 106 | IVTLVEDSSVVASGA | 50808 | LVEDSSVVA | 51139 |
| HPV45 | L2 | 349 | LFDVYADFPPPASTT | 50809 | VYADFPPPA | 51140 |
| HPV45 | L2 | 91 | RPPVVIEPVGPTDPS | 50810 | VVIEPVGPT | 51141 |
| HPV45 | L2 | 319 | RVHFYHDISPIAATE | 50811 | FYHDISPIA | 51142 |
| HPV45 | L2 | 249 | SSLVTFDNPAYEPLD | 50812 | VTFDNPAYE | 51143 |
| HPV56 | E2 | 137 | ESIYCPDSVSSTCRY | 50813 | YCPDSVSST | 51144 |
| HPV56 | E2 | 131 | EVHMENESIYCPDSV | 50814 | MENESIYCP | 51145 |
| HPV56 | E2 | 20 | EVQIALESLSTTIYN | 50815 | IALESLSTT | 51146 |
| HPV56 | E2 | 62 | HIEVWFDGSKNNCMQ | 50816 | VWFDGSKNN | 51147 |
| HPV56 | E2 | 110 | HKTYYTDFEQEAKKF | 50817 | YYTDFEQEA | 51148 |
| HPV56 | E2 | 284 | ITIYKDETQRNSFL | 50818 | IYKDETQRN | 51149 |
| HPV56 | E2 | 129 | IWEVHMENESIYCPD | 50819 | VHMENESIY | 51150 |
| HPV56 | E2 | 53 | KKCFKKEGQHIEVWF | 50820 | FKKEGQHIE | 51151 |
| HPV56 | E2 | 285 | TIIYKDETQRNSFLS | 50821 | YKDETQRNS | 51152 |
| HPV56 | E2 | 30 | TTIYNNEEWTLRDTC | 50822 | YNNEEWTLR | 51153 |
| HPV56 | E2 | 240 | VVHLKGEPNRLKCCR | 50823 | LKGEPNRLK | 51154 |
| HPV56 | E2 | 82 | YIYYNGDCGWQKVCS | 50824 | YNGDCGWQK | 51155 |
| HPV56 | E2 | 260 | YKTLFVDVTSTYHWT | 50825 | LFVDVTSTY | 51156 |
| HPV56 | E6 | 57 | KLVYRDDFPYAVCRV | 50826 | YRDDFPYAV | 51157 |
| HPV56 | E6 | 56 | LKLVYRDDFPYAVCR | 50827 | VYRDDFPYA | 51158 |
| HPV56 | E7 | 72 | KFVVQLDIQSTKEDL | 50828 | VQLDIQSTK | 51159 |
| HPV56 | E7 | 11 | LQDVVLELTPQTEID | 50829 | VVLELTPQT | 51160 |
| HPV56 | L1 | 305 | GETIPAELYLKGSNG | 50830 | IPAELYLKG | 51161 |
| HPV56 | L1 | 20 | GLCIFLDVGAVNVFP | 50831 | IFLDVGAVN | 51162 |
| HPV56 | L1 | 334 | GSMITSEAQLFNKPY | 50832 | ITSEAQLFN | 51163 |
| HPV56 | L1 | 254 | KAEVPLDIVQSTCKY | 50833 | VPLDIVQST | 51164 |
| HPV56 | L1 | 416 | KITLSAEVMAYLHNM | 50834 | LSAEVMAYL | 51165 |
| HPV56 | L1 | 8 | MMYIYRDPPLHYGLC | 50835 | IYRDPPLHY | 51166 |
| HPV56 | L1 | 431 | NANLLEDWNIGLSPP | 50836 | LLEDWNIGL | 51167 |
| HPV56 | L1 | 488 | QDSFSTDLDQFPLGR | 50837 | FSTDLDQFP | 51168 |
| HPV56 | L1 | 57 | SKVVATDSYVKRTSI | 50838 | VATDSYVKR | 51169 |
| HPV56 | L1 | 125 | TNIYNPDQERLVWAC | 50839 | YNPDQERLV | 51170 |
| HPV56 | L1 | 137 | WACVGLEVGRGQPLG | 50840 | VGLEVGRGQ | 51171 |
| HPV56 | L1 | 284 | WFYLRREQLFARHYF | 50841 | LRREQLFAR | 51172 |
| HPV56 | L1 | 271 | YLKMSADAYGDSMWF | 50842 | MSADAYGDS | 51173 |
| HPV56 | L1 | 87 | YYSVTKDNTKTNIPK | 50843 | VTKDNTKTN | 51174 |
| HPV56 | L2 | 249 | ATLVSADNPLFEGTD | 50844 | VSADNPLFE | 51175 |
| HPV56 | L2 | 456 | IPYFFADGDVAA | 50845 | FFADGDVAA | 51176 |
| HPV56 | L2 | 106 | IVTLVEESSVIESGA | 50846 | LVEESSVIE | 51177 |
| HPV56 | L2 | 270 | PSGVAPDPDFMNIVA | 50847 | VAPDPDFMN | 51178 |
| HPV56 | L2 | 426 | PYDVTHDVYIQGSSF | 50848 | VTHDVYIQG | 51179 |
| HPV56 | L2 | 91 | RPPIVVESVGPTDPS | 50849 | IVVESVGPT | 51180 |
| HPV56 | L2 | 319 | RVHYYYDISPIAQAE | 50850 | YYYDISPIA | 51181 |
| HPV56 | L2 | 161 | TNPLFIDPPVIEAPQ | 50851 | LFIDPPVIE | 51182 |
| HPV56 | L2 | 354 | YANIDDEAPGLSSQS | 50852 | IDDEAPGLS | 51183 |

TABLE XXb

DR3b Supermotif Peptides

| Type | Protein | Position | Sequence | Sequence Id. No. | Core Sequence | Core Seq. Id. No. |
|---|---|---|---|---|---|---|
| HPV16 | E1 | 115 | AICIEKQSRAAKRRL | 51184 | IEKQSRAAK | 51334 |
| HPV16 | E1 | 545 | GNLVSMDVKHRPLVQ | 51185 | VSMDVKHRP | 51335 |
| HPV16 | E1 | 478 | LYGAANTGKSLFGMS | 51186 | AANTGKSLF | 51336 |
| HPV16 | E1 | 570 | NINAGTDSRWPYLHN | 51187 | AGTDSRWPY | 51337 |
| HPV16 | E1 | 602 | NPVYELNDKNWKSFF | 51188 | YELNDKNWK | 51338 |
| HPV16 | E1 | 145 | QQMLQVEGRHETETP | 51189 | LQVEGRHET | 51339 |
| HPV16 | E1 | 247 | TPSIADSIKTLLQQY | 51190 | IADSIKTLL | 51340 |
| HPV16 | E1 | 532 | WNYIDDNLRNALDGN | 51191 | IDDNLRNAL | 51341 |
| HPV16 | E1 | 23 | YVEAVVEKKTGDAIS | 51192 | AVVEKKTGD | 51342 |
| HPV16 | E2 | 125 | DGDICNTMHYTNWTH | 51193 | ICNTMHYTN | 51343 |
| HPV16 | E2 | 270 | ILTAFNSSHKGRINC | 51194 | AFNSSHKGR | 51344 |
| HPV16 | E2 | 167 | IRTYFVQFKDDAEKY | 51195 | YFVQFKDDA | 51345 |
| HPV16 | E2 | 271 | LTAFNSSHKGRINCN | 51196 | FNSSHKGRI | 51346 |
| HPV16 | E2 | 346 | RDQFLSQVKIPKTIT | 51197 | FLSQVKIPK | 51347 |
| HPV16 | E2 | 315 | YTAVSSTWHWTGHNV | 51198 | VSSTWHWTG | 51348 |
| HPV16 | E6 | 26 | CTELQTTIHDIILEC | 51199 | LQTTIHDII | 51349 |
| HPV16 | E6 | 117 | QKPLCPEEKQRHLDK | 51200 | LCPEEKQRH | 51350 |
| HPV16 | L1 | 165 | AANAGVDNRECISMD | 51201 | AGVDNRECI | 51351 |
| HPV16 | L1 | 359 | FVTVVDTTRSTNMSL | 51202 | VVDTTRSTN | 51352 |
| HPV16 | L1 | 440 | GGTLEDTYRFVTSQA | 51203 | LEDTYRFVT | 51353 |
| HPV16 | L1 | 141 | PLGVGISGHPLLNKL | 51204 | VGISGHPLL | 51354 |
| HPV16 | L1 | 173 | RECISMDYKQTQLCL | 51205 | ISMDYKQTQ | 51355 |
| HPV16 | L1 | 452 | SQAIACQKHTPPAPK | 51206 | IACQKHTPP | 51356 |
| HPV16 | L2 | 18 | ATQLYKTCKQAGTCP | 51207 | LYKTCKQAG | 51357 |
| HPV16 | L2 | 293 | HRPALTSRRTGIRYS | 51208 | ALTSRRTGI | 51358 |
| HPV16 | L2 | 7 | KRSAKRTKRASATQL | 51209 | AKRTKRASA | 51359 |
| HPV16 | L2 | 349 | PSTYTTTSHAALPTS | 51210 | YTTTSHAAL | 51360 |
| HPV18 | E1 | 229 | FTDLVRNFKSDKTTC | 51211 | LVRNFKSDK | 51361 |
| HPV18 | E1 | 552 | GNPISIDRKHKPLIQ | 51212 | ISIDRKHKP | 51362 |
| HPV18 | E1 | 509 | ISFVNSTHFWLEPL | 51213 | VNSTSHFWL | 51363 |
| HPV18 | E1 | 205 | KDLLKVNNKQGAMLA | 51214 | LKVNNKQGA | 51364 |
| HPV18 | E1 | 471 | KSFLKGTPKKNCLVF | 51215 | LKGTPKKNC | 51365 |
| HPV18 | E1 | 609 | NPVYEINDKNWKCFF | 51216 | YEINDKNWK | 51366 |
| HPV18 | E1 | 571 | PILLTTNIHPAKDNR | 51217 | LTTNIHPAK | 51367 |
| HPV18 | E1 | 22 | YVQAIVDKKTGDVIS | 51218 | AIVDKKTGD | 51368 |
| HPV18 | E2 | 23 | IDHYENDSKDIDSQI | 51219 | YENDSKDID | 51369 |
| HPV18 | E2 | 333 | TGILTVTYHSETQRT | 51220 | LTVTYHSET | 51370 |
| HPV18 | E2 | 172 | YNTFYIEFKSECEKY | 51221 | FYIEFKSEC | 51371 |
| HPV18 | E2 | 316 | YRDISSTWHWTGAGN | 51222 | ISSTWHWTG | 51372 |
| HPV18 | E6 | 134 | AGHYRGQCHSCCNRA | 51223 | YRGQCHSCC | 51373 |
| HPV18 | E7 | 54 | ARRAEPQRHTMLCMC | 51224 | AEPQRHTML | 51374 |
| HPV18 | L1 | 552 | APSATTSSKPAKRVR | 51225 | ATTSSKPAK | 51375 |
| HPV18 | L1 | 495 | KDAAPAENKDPYDKL | 51226 | APAENKDPY | 51376 |
| HPV18 | L1 | 176 | PLGVGLSGHPFYNKL | 51227 | VGLSGHPFY | 51377 |
| HPV18 | L1 | 208 | RDNVSVDYKQTQLCI | 51228 | VSVDYKQTQ | 51378 |
| HPV18 | L1 | 200 | TSNVSEDVRDNVSVD | 51229 | VSEDVRDNV | 51379 |
| HPV18 | L1 | 476 | TTSLVDTYRFVQSVA | 51230 | LVDTYRFVQ | 51380 |
| HPV18 | L2 | 263 | DTTLTFDPRSDVPDS | 51231 | LTFDPRSDV | 51381 |
| HPV18 | L2 | 286 | HRPALTSRRGTVRFS | 51232 | ALTSRRGTV | 51382 |
| HPV18 | L2 | 17 | VTDLYKTCKQSGTCP | 51233 | LYKTCKQSG | 51383 |
| HPV31 | E1 | 114 | AICIENNSKTAKRRL | 51234 | IENNSKTAK | 51384 |
| HPV31 | E1 | 103 | CVDYNISPRLKAICI | 51235 | YNISPRLKA | 51385 |
| HPV31 | E1 | 525 | GNPVSIDVKHKALMQ | 51236 | VSIDVKHKA | 51386 |
| HPV31 | E1 | 458 | IHGAPNTGKSYFGMS | 51237 | APNTGKSYF | 51387 |
| HPV31 | E1 | 533 | KHKALMQLKCPPLLI | 51238 | ALMQLKCPP | 51388 |
| HPV31 | E1 | 550 | NINAGKDDRWPYLHS | 51239 | AGKDDRWPY | 51389 |
| HPV31 | E1 | 582 | NPVYELSDKNWKSFF | 51240 | YELSDKNWK | 51390 |
| HPV31 | E2 | 125 | DGDVHNTMHYTNWKF | 51241 | VHNTMHYTN | 51391 |
| HPV31 | E2 | 121 | EVQFDGDVHNTMHYT | 51242 | FDGDVHNTM | 51392 |
| HPV31 | E2 | 171 | FVNFTEEAKKYGTGK | 51243 | FTEEAKKYG | 51393 |
| HPV31 | E2 | 159 | GIYYVHEGHITYFVN | 51244 | YVHEGHITY | 51394 |
| HPV31 | E2 | 19 | LEHYENDSKRLCDHI | 51245 | YENDSKRLC | 51395 |
| HPV31 | E2 | 345 | LTYISTSQRDDFLNT | 51246 | ISTSQRDDF | 51396 |
| HPV31 | E2 | 353 | RDDFLNTVKIPNTVS | 51247 | FLNTVKIPN | 51397 |
| HPV31 | E2 | 239 | VRRATTSTKRPRTEP | 51248 | ATTSTKRPR | 51398 |
| HPV31 | E2 | 322 | YEQVSSTWHWTCTDG | 51249 | VSSTWHWTC | 51399 |
| HPV31 | E6 | 110 | QRPLCPEEKQRHLDK | 51250 | LCPEEKQRH | 51400 |
| HPV31 | E7 | 57 | IVTFCCQCKSTLRLC | 51251 | FCCQCKSTL | 51401 |
| HPV31 | L1 | 213 | DFTALQDTKSNVPLD | 51252 | ALQDTKSNV | 51402 |
| HPV31 | L1 | 334 | FVTVVDTTRSTNMSV | 51253 | VVDTTRSTN | 51403 |

TABLE XXb-continued

DR3b Supermotif Peptides

| Type | Protein | Position | Sequence | Sequence Id. No. | Core Sequence | Core Seq. Id. No. |
|---|---|---|---|---|---|---|
| HPV31 | L1 | 116 | PLGVGISGHPLLNKF | 51254 | VGISGHPLL | 51404 |
| HPV31 | L1 | 148 | RECISMDYKQTQLCL | 51255 | ISMDYKQTQ | 51405 |
| HPV31 | L1 | 415 | SGSLEDTYRFVTSQA | 51256 | LEDTYRFVT | 51406 |
| HPV31 | L2 | 18 | ATQLYQTCKAAGTCP | 51257 | LYQTCKAAG | 51407 |
| HPV31 | L2 | 286 | HRPALTSRRNTVRYS | 51258 | ALTSRRNTV | 51408 |
| HPV31 | L2 | 170 | PTPAETSGHLLLSSS | 51259 | AETSGHLLL | 51409 |
| HPV31 | L2 | 263 | SLYFSNTSHNIAPDP | 51260 | FSNTSHNIA | 51410 |
| HPV31 | L2 | 73 | TGYVPLSTRPSTVSE | 51261 | VPLSTRPST | 51411 |
| HPV31 | L2 | 226 | YSKATQQVKVIDPTF | 51262 | ATQQVKVID | 51412 |
| HPV33 | E1 | 22 | EVEAVIERRTGDNIS | 51263 | AVIERRTGD | 51413 |
| HPV33 | E1 | 538 | GNEISIDVKHRALVQ | 51264 | ISIDVKHRA | 51414 |
| HPV33 | E1 | 635 | KCSAGENTRSLRS | 51265 | AGENTRSLR | 51415 |
| HPV33 | E1 | 546 | KHRALVQLKCPPLLL | 51266 | ALVQLKCPP | 51416 |
| HPV33 | E1 | 616 | LDLIEEEDKENHGGN | 51267 | IEEEDKENH | 51417 |
| HPV33 | E1 | 563 | NTNAGTDSRWPYLHS | 51268 | AGTDSRWPY | 51418 |
| HPV33 | E1 | 240 | SPSVAESLKVLIKQH | 51269 | VAESLKVLI | 51419 |
| HPV33 | E2 | 42 | ECALLYTAKQMGFSH | 51270 | LLYTAKQMG | 51420 |
| HPV33 | E2 | 334 | QQMFLGTVKIPPTVQ | 51271 | FLGTVKIPP | 51421 |
| HPV33 | E2 | 121 | TVQYDNDKKNTMDYT | 51272 | YDNDKKNTM | 51422 |
| HPV33 | E2 | 303 | YSSMSSTWHWTSDNK | 51273 | MSSTWHWTS | 51423 |
| HPV33 | E5 | 62 | LPMMCINFHAQHMTQ | 51274 | MCINFHAQH | 51424 |
| HPV33 | E6 | 19 | CQALETTIHNIELQC | 51275 | LETTIHNIE | 51425 |
| HPV33 | E6 | 88 | GNTLEQTVKKPLNEI | 51276 | LEQTVKKPL | 51426 |
| HPV33 | E6 | 119 | KRHVDLNKRFHNISG | 51277 | VDLNKRFHN | 51427 |
| HPV33 | E6 | 110 | QRPLCPQEKKRHVDL | 51278 | LCPQEKKRH | 51428 |
| HPV33 | L1 | 333 | FVTVVDTTRSTNMTL | 51279 | VVDTTRSTN | 51429 |
| HPV33 | L1 | 36 | IYYYAGSSRLLAVGH | 51280 | YAGSSRLLA | 51430 |
| HPV33 | L1 | 483 | KRAAPTSTRTSSAKR | 51281 | APTSTRTSS | 51431 |
| HPV33 | L1 | 116 | PLGVGISGHPLLNKF | 51282 | VGISGHPLL | 51432 |
| HPV33 | L1 | 148 | RECLSMDYKQTQLCL | 51283 | LSMDYKQTQ | 51433 |
| HPV33 | L1 | 413 | SASLQDTYRFVTSQA | 51284 | LQDTYRFVT | 51434 |
| HPV33 | L2 | 17 | ATQLYQTCKATGTCP | 51285 | LYQTCKATG | 51435 |
| HPV33 | L2 | 242 | DPAFLTSPHKLITYD | 51286 | FLTSPHKLI | 51436 |
| HPV33 | L2 | 459 | FPYFFTDVRVAA | 51287 | FFTDVRVAA | 51437 |
| HPV33 | L2 | 291 | HRPAITSRRHTVRFS | 51288 | AITSRRHTV | 51438 |
| HPV33 | L2 | 175 | PAPAEASGHFIFSSP | 51289 | AEASGHFIF | 51439 |
| HPV45 | E1 | 215 | FTDLVRNFKSDKTTC | 51290 | LVRNFKSDK | 51440 |
| HPV45 | E1 | 538 | GNPISIDRKHKPLLQ | 51291 | ISIDRKHKP | 51441 |
| HPV45 | E1 | 495 | ISFVNSNSHFWLEPL | 51292 | VNSNSHFWL | 51442 |
| HPV45 | E1 | 457 | KEFLKGTPKKNCILL | 51293 | LKGTPKKNC | 51443 |
| HPV45 | E1 | 191 | KELLQASNKKAAMLA | 51294 | LQASNKKAA | 51444 |
| HPV45 | E1 | 595 | NPVYEINDKNWKCFF | 51295 | YEINDKNWK | 51445 |
| HPV45 | E2 | 174 | DTTYYVQFKSECEKY | 51296 | YYVQFKSEC | 51446 |
| HPV45 | E2 | 48 | ENAILFTAREHGITK | 51297 | ILFTAREHG | 51447 |
| HPV45 | E2 | 25 | LDHYENDSKDINSQI | 51298 | YENDSKDIN | 51448 |
| HPV45 | E2 | 256 | QCGLTEQHHGRVNTH | 51299 | LTEQHHGRV | 51449 |
| HPV45 | E2 | 320 | YSEISSTWHWTGCNK | 51300 | ISSTWHWTG | 51450 |
| HPV45 | E6 | 130 | FHSIAGQYRGQCNTC | 51301 | IAGQYRGQC | 51451 |
| HPV45 | E7 | 55 | ARRAEPQRHKILCVC | 51302 | AEPQRHKIL | 51452 |
| HPV45 | L1 | 362 | FVTVVDTTRSTNLTL | 51303 | VVDTTRSTN | 51453 |
| HPV45 | L1 | 142 | PLGIGLSGHPFYNKL | 51304 | IGLSGHPFY | 51454 |
| HPV45 | L1 | 174 | RDNVSVDYKQTQLCI | 51305 | VSVDYKQTQ | 51455 |
| HPV45 | L1 | 166 | TAVITQDVRDNVSVD | 51306 | ITQDVRDNV | 51456 |
| HPV45 | L1 | 444 | TTSLVDTYRFVQSVA | 51307 | LVDTYRFVQ | 51457 |
| HPV45 | L2 | 17 | ATDLYRTCKQSGTCP | 51308 | LYRTCKQSG | 51458 |
| HPV45 | L2 | 306 | ATMFTRSGKQIGGRV | 51309 | FTRSGKQIG | 51459 |
| HPV45 | L2 | 286 | HRPALSSRRGTVRFS | 51310 | ALSSRRGTV | 51460 |
| HPV45 | L2 | 230 | YSRANQQVRVSTSQF | 51311 | ANQQVRVST | 51461 |
| HPV56 | E2 | 264 | FVDVTSTYHWTSTDN | 51312 | VTSTYHWTS | 51462 |
| HPV56 | E2 | 102 | GIYYVHDGHKTYYTD | 51313 | YVHDGHKTY | 51463 |
| HPV56 | E2 | 177 | NQDAAVSHRPGKRPR | 51314 | AAVSHRPGK | 51464 |
| HPV56 | E2 | 142 | PDSVSSTCRYNVSPV | 51315 | VSSTCRYNV | 51465 |
| HPV56 | E2 | 224 | SRSINNNNHPGDKTT | 51316 | INNNNHPGD | 51466 |
| HPV56 | E2 | 114 | YTDFEQEAKKFGCKN | 51317 | FEQEAKKFG | 51467 |
| HPV56 | E6 | 120 | EKQLHCDRKRRFHLI | 51318 | LHCDRKRRF | 51468 |
| HPV56 | E6 | 113 | QSPLTPEEKQLHCDR | 51319 | LTPEEKQLH | 51469 |
| HPV56 | E6 | 49 | YNFACTELKLVYRDD | 51320 | ACTELKLVY | 51470 |
| HPV56 | L1 | 246 | DFKVLQESKAEVPLD | 51321 | VLQESKAEV | 51471 |
| HPV56 | L1 | 367 | FVTVVDTTRSTNMTI | 51322 | VVDTTRSTN | 51472 |

TABLE XXb-continued

DR3b Supermotif Peptides

| Type | Protein | Position | Sequence | Sequence Id. No. | Core Sequence | Core Seq. Id. No. |
|---|---|---|---|---|---|---|
| HPV56 | L1 | 513 | KPAVATSKKRSAPTS | 51323 | VATSKKRSA | 51473 |
| HPV56 | L1 | 259 | LDIVQSTCKYPDYLK | 51324 | VQSTCKYPD | 51474 |
| HPV56 | L1 | 173 | NNNVIEDSRDNISVD | 51325 | VIEDSRDNI | 51475 |
| HPV56 | L1 | 149 | PLGAGLSGHPLFNRL | 51326 | AGLSGHPLF | 51476 |
| HPV56 | L1 | 181 | RDNISVDGKQTQLCI | 51327 | ISVDGKQTQ | 51477 |
| HPV56 | L1 | 512 | SKPAVATSKKRSAPT | 51328 | AVATSKKRS | 51478 |
| HPV56 | L2 | 17 | ATQLYKTCKLSGTCP | 51329 | LYKTCKLSG | 51479 |
| HPV56 | L2 | 303 | GRKATIQTRRGTQIG | 51330 | ATIQTRRGT | 51480 |
| HPV56 | L2 | 286 | HRPAFTTRRGGVRFS | 51331 | AFTTRRGGV | 51481 |
| HPV56 | L2 | 367 | QSVATPSAHLPIKPS | 51332 | ATPSAHLPI | 51482 |
| HPV56 | L2 | 230 | YRKAFQQVKVTDPAF | 51333 | AFQQVKVTD | 51483 |

TABLE XXI

Population coverage with combined HLA Supertypes

| | PHENOTYPIC FREQUENCY | | | | | |
|---|---|---|---|---|---|---|
| HLA-SUPERTYPES | Caucasian | North American Black | Japanese | Chinese | Hispanic | Average |
| a. Individual Supertypes | | | | | | |
| A2 | 45.8 | 39.0 | 42.4 | 45.9 | 43.0 | 43.2 |
| A3 | 37.5 | 42.1 | 45.8 | 52.7 | 43.1 | 44.2 |
| B7 | 43.2 | 55.1 | 57.1 | 43.0 | 49.3 | 49.5 |
| A1 | 47.1 | 16.1 | 21.8 | 14.7 | 26.3 | 25.2 |
| A24 | 23.9 | 38.9 | 58.6 | 40.1 | 38.3 | 40.0 |
| B44 | 43.0 | 21.2 | 42.9 | 39.1 | 39.0 | 37.0 |
| B27 | 28.4 | 26.1 | 13.3 | 13.9 | 35.3 | 23.4 |
| B62 | 12.6 | 4.8 | 36.5 | 25.4 | 11.1 | 18.1 |
| B58 | 10.0 | 25.1 | 1.6 | 9.0 | 5.9 | 10.3 |
| b. Combined Supertypes | | | | | | |
| A2, A3, B7 | 84.3 | 86.8 | 89.5 | 89.8 | 86.8 | 87.4 |
| A2, A3, B7, A24, B44, A1 | 99.5 | 98.1 | 100.0 | 99.5 | 99.4 | 99.3 |
| A2, A3, B7, A24, B44, A1, B27, B62, B58 | 99.9 | 99.6 | 100.0 | 99.8 | 99.9 | 99.8 |

TABLE XXII

ACCESSION NUMBERS

| | | |
|---|---|---|
| HPV16 | E1 | W1SLHS |
| HPV16 | E2 | W2WLHS |
| HPV16 | E5 | W5WLHS |
| HPV16 | E6 | W6WLHS |
| HPV16 | E7 | W7WLHS |
| HPV16 | L1 | AAD33259 |
| HPV16 | L2 | AAD33258 |
| HPV18 | E1 | W1WL18 |
| HPV18 | E2 | W2WL18 |
| HPV18 | E5 | W5WL18 |
| HPV18 | E6 | W6WL18 |
| HPV18 | E7 | PO6788 |
| HPV18 | L1 | CAA28671 |
| HPV18 | L2 | P2WL18 |
| HPV31 | E1 | W1WL31 |
| HPV31 | E2 | W2WL3 |
| HPV31 | E5 | W5WL31 |
| HPV31 | E6 | W6WL31 |
| HPV31 | E7 | W7WL31 |
| HPV31 | L1 | P1WL31 |
| HPV31 | L2 | P2WL31 |
| HPV45 | E1 | S36563 |
| HPV45 | E2 | S36564 |
| HPV45 | E6 | CAB44706 |
| HPV45 | E7 | CAB44707 |
| HPV45 | L1 | CAB44705 |
| HPV45 | L2 | S36565 |
| HPV33 | E1 | W1WL33 |
| HPV33 | E2 | W2WL33 |
| HPV33 | E5 | W5WL33 |
| HPV33 | E6 | W6WL33 |
| HPV33 | E7 | W7WL33 |
| HPV33 | L1 | P1WL33 |
| HPV33 | L2 | P2WL33 |
| HPV56 | E2 | S36581 |
| HPV56 | E6 | W6WL56 |
| HPV56 | E7 | S36580 |
| HPV56 | L1 | S38563 |
| HPV56 | L2 | S36582 |

SEQUENCE LISTING (51505 sequences)

SEQ ID NO: 1 - protein, 10 aa, Artificial Sequence
  Peptide Derived from Human Papillomavirus
AMLAKFKELY

SEQ ID NO: 2 - protein, 8 aa, Artificial Sequence
  Peptide Derived from Human Papillomavirus
ATVPCWNY

SEQ ID NO: 3 - protein, 9 aa, Artificial Sequence
  Peptide Derived from Human Papillomavirus
AVQVLKRKY

SEQ ID NO: 4 - protein, 11 aa, Artificial Sequence
  Peptide Derived from Human Papillomavirus
CTFELSQMVQW

SEQ ID NO: 5 - protein, 10 aa, Artificial Sequence
  Peptide Derived from Human Papillomavirus
DIVDDSEIAY

SEQ ID NO: 6 - protein, 11 aa, Artificial Sequence
  Peptide Derived from Human Papillomavirus
DSDTGEDLVDF

SEQ ID NO: 7 - protein, 8 aa, Artificial Sequence
  Peptide Derived from Human Papillomavirus
DSEIAYKY

SEQ ID NO: 8 - protein, 10 aa, Artificial Sequence
  Peptide Derived from Human Papillomavirus
DSIKTLLQQY

SEQ ID NO: 9 - protein, 9 aa, Artificial Sequence
  Peptide Derived from Human Papillomavirus
DTGEDLVDF

SEQ ID NO: 10 - protein, 9 aa, Artificial Sequence
  Peptide Derived from Human Papillomavirus
DTNSNASAF

SEQ ID NO: 11 - protein, 10 aa, Artificial Sequence
  Peptide Derived from Human Papillomavirus
ELNDKNWKSF

SEQ ID NO: 12 - protein, 11 aa, Artificial Sequence
  Peptide Derived from Human Papillomavirus
ELNDKNWKSFF

SEQ ID NO: 13 - protein, 8 aa, Artificial Sequence
  Peptide Derived from Human Papillomavirus
ELSQMVQW

SEQ ID NO: 14 - protein, 10 aa, Artificial Sequence
  Peptide Derived from Human Papillomavirus
ELSQMVQWAY

SEQ ID NO: 15 - protein, 9 aa, Artificial Sequence
  Peptide Derived from Human Papillomavirus
ETETAHALF

SEQ ID NO: 16 - protein, 9 aa, Artificial Sequence
  Peptide Derived from Human Papillomavirus
ETETPCSQY

SEQ ID NO: 17 - protein, 9 aa, Artificial Sequence
  Peptide Derived from Human Papillomavirus
EVYGDTPEW

SEQ ID NO: 18 - protein, 8 aa, Artificial Sequence
  Peptide Derived from Human Papillomavirus
FIVNDNDY

SEQ ID NO: 19 - protein, 9 aa, Artificial Sequence
  Peptide Derived from Human Papillomavirus
FLQGSVICF

SEQ ID NO: 20 - protein, 9 aa, Artificial Sequence
  Peptide Derived from Human Papillomavirus
FLRYQGVEF

SEQ ID NO: 21 - protein, 8 aa, Artificial Sequence
  Peptide Derived from Human Papillomavirus
FLTALKRF

SEQ ID NO: 22 - protein, 11 aa, Artificial Sequence
  Peptide Derived from Human Papillomavirus
FMSFLTALKRF

SEQ ID NO: 23 - protein, 8 aa, Artificial Sequence
  Peptide Derived from Human Papillomavirus
FSELVRPF

SEQ ID NO: 24 - protein, 9 aa, Artificial Sequence
  Peptide Derived from Human Papillomavirus
FTFPNEFPF

SEQ ID NO: 25 - protein, 8 aa, Artificial Sequence
  Peptide Derived from Human Papillomavirus
FVNSKSHF

SEQ ID NO: 26 - protein, 9 aa, Artificial Sequence
  Peptide Derived from Human Papillomavirus
FVNSKSHFW

SEQ ID NO: 27 - protein, 11 aa, Artificial Sequence
  Peptide Derived from Human Papillomavirus
GIPKKNCILLY

SEQ ID NO: 28 - protein, 9 aa, Artificial Sequence
  Peptide Derived from Human Papillomavirus
GISNISEVY

SEQ ID NO: 29 - protein, 11 aa, Artificial Sequence
  Peptide Derived from Human Papillomavirus
GMLDDATVPCW

SEQ ID NO: 30 - protein, 10 aa, Artificial Sequence
  Peptide Derived from Human Papillomavirus
GMVVLLLVRY

SEQ ID NO: 31 - protein, 9 aa, Artificial Sequence
  Peptide Derived from Human Papillomavirus
GSGGGCSQY

SEQ ID NO: 32 - protein, 8 aa, Artificial Sequence
  Peptide Derived from Human Papillomavirus
GTDSRWPY

SEQ ID NO: 33 - protein, 8 aa, Artificial Sequence
  Peptide Derived from Human Papillomavirus
GTGCNGWF

SEQ ID NO: 34 - protein, 9 aa, Artificial Sequence
  Peptide Derived from Human Papillomavirus
GTGCNGWFY

SEQ ID NO: 35 - protein, 11 aa, Artificial Sequence
  Peptide Derived from Human Papillomavirus
GVSFSELVRPF

SEQ ID NO: 36 - protein, 9 aa, Artificial Sequence
  Peptide Derived from Human Papillomavirus
HIQSLACSW

SEQ ID NO: 37 - protein, 8 aa, Artificial Sequence
  Peptide Derived from Human Papillomavirus
HSFNDCTF

SEQ ID NO: 38 - protein, 11 aa, Artificial Sequence
  Peptide Derived from Human Papillomavirus
ISEVYGDTPEW

SEQ ID NO: 39 - protein, 8 aa, Artificial Sequence
  Peptide Derived from Human Papillomavirus
ISNISEVY

SEQ ID NO: 40 - protein, 9 aa, Artificial Sequence
  Peptide Derived from Human Papillomavirus
IVDDSEIAY

SEQ ID NO: 41 - protein, 11 aa, Artificial Sequence
  Peptide Derived from Human Papillomavirus
IVDDSEIAYKY

SEQ ID NO: 42 - protein, 10 aa, Artificial Sequence
  Peptide Derived from Human Papillomavirus
KLRSTAAALY

SEQ ID NO: 43 - protein, 11 aa, Artificial Sequence
  Peptide Derived from Human Papillomavirus
KLRSTAAALYW

SEQ ID NO: 44 - protein, 8 aa, Artificial Sequence
  Peptide Derived from Human Papillomavirus
KSFFSRTW

SEQ ID NO: 45 - protein, 11 aa, Artificial Sequence
  Peptide Derived from Human Papillomavirus
KSLFGMSLMKF

SEQ ID NO: 46 - protein, 10 aa, Artificial Sequence
  Peptide Derived from Human Papillomavirus
KSNKSTCCDW

SEQ ID NO: 47 - protein, 11 aa, Artificial Sequence
  Peptide Derived from Human Papillomavirus
KTGISNISEVY

SEQ ID NO: 48 - protein, 10 aa, Artificial Sequence
  Peptide Derived from Human Papillomavirus
KTLLQQYCLY

SEQ ID NO: 49 - protein, 8 aa, Artificial Sequence
  Peptide Derived from Human Papillomavirus
LLQQYCLY

SEQ ID NO: 50 - protein, 9 aa, Artificial Sequence
  Peptide Derived from Human Papillomavirus
LSQMVQWAY

SEQ ID NO: 51 - protein, 11 aa, Artificial Sequence
  Peptide Derived from Human Papillomavirus
LVDFIVNDNDY

SEQ ID NO: 52 - protein, 10 aa, Artificial Sequence
  Peptide Derived from Human Papillomavirus
LVVFTFPNEF

SEQ ID NO: 53 - protein, 9 aa, Artificial Sequence
  Peptide Derived from Human Papillomavirus
MLAKFKELY

SEQ ID NO: 54 - protein, 10 aa, Artificial Sequence
  Peptide Derived from Human Papillomavirus
MLDDATVPCW

SEQ ID NO: 55 - protein, 10 aa, Artificial Sequence
  Peptide Derived from Human Papillomavirus
MSFLTALKRF

SEQ ID NO: 56 - protein, 9 aa, Artificial Sequence
  Peptide Derived from Human Papillomavirus
MSMSQWIKY

SEQ ID NO: 57 - protein, 9 aa, Artificial Sequence
  Peptide Derived from Human Papillomavirus
MVVLLLVRY

SEQ ID NO: 58 - protein, 10 aa, Artificial Sequence
  Peptide Derived from Human Papillomavirus
NINAGTDSRW

SEQ ID NO: 59 - protein, 10 aa, Artificial Sequence
  Peptide Derived from Human Papillomavirus
PVYELNDKNW

SEQ ID NO: 60 - protein, 8 aa, Artificial Sequence
  Peptide Derived from Human Papillomavirus
QIVMFLRY

SEQ ID NO: 61 - protein, 10 aa, Artificial Sequence
  Peptide Derived from Human Papillomavirus
QMSMSQWIKY

SEQ ID NO: 62 - protein, 10 aa, Artificial Sequence
  Peptide Derived from Human Papillomavirus
QSRAAKRRLF

SEQ ID NO: 63 - protein, 8 aa, Artificial Sequence
  Peptide Derived from Human Papillomavirus
QTVLQHSF

SEQ ID NO: 64 - protein, 10 aa, Artificial Sequence
  Peptide Derived from Human Papillomavirus
RLFESEDSGY

SEQ ID NO: 65 - protein, 11 aa, Artificial Sequence
  Peptide Derived from Human Papillomavirus
RLVVFTFPNEF

SEQ ID NO: 66 - protein, 8 aa, Artificial Sequence
  Peptide Derived from Human Papillomavirus
RSTAAALY

SEQ ID NO: 67 - protein, 9 aa, Artificial Sequence
  Peptide Derived from Human Papillomavirus
RSTAAALYW

SEQ ID NO: 68 - protein, 10 aa, Artificial Sequence
  Peptide Derived from Human Papillomavirus
RSTAAALYWY

SEQ ID NO: 69 - protein, 8 aa, Artificial Sequence
  Peptide Derived from Human Papillomavirus
RVDDGGDW

SEQ ID NO: 70 - protein, 9 aa, Artificial Sequence
  Peptide Derived from Human Papillomavirus
SIKTLLQQY

SEQ ID NO: 71 - protein, 10 aa, Artificial Sequence
  Peptide Derived from Human Papillomavirus
SLFGMSLMKF

SEQ ID NO: 72 - protein, 8 aa, Artificial Sequence
  Peptide Derived from Human Papillomavirus
SMSQWIKY

SEQ ID NO: 73 - protein, 8 aa, Artificial Sequence
  Peptide Derived from Human Papillomavirus
STAAALYW

SEQ ID NO: 74 - protein, 9 aa, Artificial Sequence
  Peptide Derived from Human Papillomavirus
STAAALYWY

SEQ ID NO: 75 - protein, 11 aa, Artificial Sequence
  Peptide Derived from Human Papillomavirus
STCCDWCIAAF

SEQ ID NO: 76 - protein, 9 aa, Artificial Sequence
  Peptide Derived from Human Papillomavirus
TLLQQYCLY

SEQ ID NO: 77 - protein, 11 aa, Artificial Sequence
  Peptide Derived from Human Papillomavirus
VICFVNSKSHF

SEQ ID NO: 78 - protein, 11 aa, Artificial Sequence
  Peptide Derived from Human Papillomavirus
VLQHSFNDCTF

SEQ ID NO: 79 - protein, 11 aa, Artificial Sequence
  Peptide Derived from Human Papillomavirus
VMFLRYQGVEF

SEQ ID NO: 80 - protein, 10 aa, Artificial Sequence
  Peptide Derived from Human Papillomavirus
VSFSELVRPF

SEQ ID NO: 81 - protein, 9 aa, Artificial Sequence
  Peptide Derived from Human Papillomavirus
VVFTFPNEF

SEQ ID NO: 82 - protein, 11 aa, Artificial Sequence
  Peptide Derived from Human Papillomavirus
VVFTFPNEFPF

SEQ ID NO: 83 - protein, 8 aa, Artificial Sequence
  Peptide Derived from Human Papillomavirus
VVLLLVRY

SEQ ID NO: 84 - protein, 11 aa, Artificial Sequence
  Peptide Derived from Human Papillomavirus
YLHIQSLACSW

SEQ ID NO: 85 - protein, 9 aa, Artificial Sequence
  Peptide Derived from Human Papillomavirus
YLHNRLVVF

SEQ ID NO: 86 - protein, 11 aa, Artificial Sequence
  Peptide Derived from Human Papillomavirus
YLHNRLVVFTF

SEQ ID NO: 87 - protein, 11 aa, Artificial Sequence
  Peptide Derived from Human Papillomavirus
AIVTLTYDSEW

SEQ ID NO: 88 - protein, 11 aa, Artificial Sequence
  Peptide Derived from Human Papillomavirus
AIYYKAREMGF

SEQ ID NO: 89 - protein, 8 aa, Artificial Sequence
  Peptide Derived from Human Papillomavirus
AVSSTWHW

SEQ ID NO: 90 - protein, 11 aa, Artificial Sequence
  Peptide Derived from Human Papillomavirus
CTLYTAVSSTW

SEQ ID NO: 91 - protein, 8 aa, Artificial Sequence
  Peptide Derived from Human Papillomavirus
DICNTMHY

SEQ ID NO: 92 - protein, 11 aa, Artificial Sequence
  Peptide Derived from Human Papillomavirus
DICNTMHYTNW

SEQ ID NO: 93 - protein, 8 aa, Artificial Sequence
  Peptide Derived from Human Papillomavirus
DLRDHIDY

SEQ ID NO: 94 - protein, 9 aa, Artificial Sequence
  Peptide Derived from Human Papillomavirus
DLRDHIDYW

SEQ ID NO: 95 - protein, 9 aa, Artificial Sequence
  Peptide Derived from Human Papillomavirus
DSAPILTAF

SEQ ID NO: 96 - protein, 9 aa, Artificial Sequence
  Peptide Derived from Human Papillomavirus
DSEWQRDQF

SEQ ID NO: 97 - protein, 11 aa, Artificial Sequence
  Peptide Derived from Human Papillomavirus
DSTDLRDHIDY

SEQ ID NO: 98 - protein, 10 aa, Artificial Sequence
  Peptide Derived from Human Papillomavirus
ELQLTLETIY

SEQ ID NO: 99 - protein, 8 aa, Artificial Sequence
  Peptide Derived from Human Papillomavirus
ETIYNSQY

SEQ ID NO: 100 - protein, 11 aa, Artificial Sequence
  Peptide Derived from Human Papillomavirus
FVQFKDDAEKY

SEQ ID NO: 101 - protein, 9 aa, Artificial Sequence
  Peptide Derived from Human Papillomavirus
GIRTYFVQF

SEQ ID NO: 102 - protein, 9 aa, Artificial Sequence
  Peptide Derived from Human Papillomavirus
HMRLECAIY

SEQ ID NO: 103 - protein, 10 aa, Artificial Sequence
  Peptide Derived from Human Papillomavirus
HMRLECAIYY

SEQ ID NO: 104 - protein, 8 aa, Artificial Sequence
  Peptide Derived from Human Papillomavirus
ILCPTSVF

SEQ ID NO: 105 - protein, 10 aa, Artificial Sequence
  Peptide Derived from Human Papillomavirus
IVTLTYDSEW

SEQ ID NO: 106 - protein, 9 aa, Artificial Sequence
  Peptide Derived from Human Papillomavirus
KSAIVTLTY

SEQ ID NO: 107 - protein, 9 aa, Artificial Sequence
  Peptide Derived from Human Papillomavirus
KTITVSTGF

SEQ ID NO: 108 - protein, 11 aa, Artificial Sequence
  Peptide Derived from Human Papillomavirus
LTLETIYNSQY

SEQ ID NO: 109 - protein, 9 aa, Artificial Sequence
  Peptide Derived from Human Papillomavirus
NSQYSNEKW

SEQ ID NO: 110 - protein, 8 aa, Artificial Sequence
  Peptide Derived from Human Papillomavirus
NTLKCLRY

SEQ ID NO: 111 - protein, 10 aa, Artificial Sequence
  Peptide Derived from Human Papillomavirus
NTLKCLRYRF

SEQ ID NO: 112 - protein, 8 aa, Artificial Sequence
  Peptide Derived from Human Papillomavirus
NTMHYTNW

SEQ ID NO: 113 - protein, 11 aa, Artificial Sequence
  Peptide Derived from Human Papillomavirus
NVCQDKILTHY

SEQ ID NO: 114 - protein, 10 aa, Artificial Sequence
  Peptide Derived from Human Papillomavirus
PTGCIKKHGY

SEQ ID NO: 115 - protein, 8 aa, Artificial Sequence
  Peptide Derived from Human Papillomavirus
QLTLETIY

SEQ ID NO: 116 - protein, 8 aa, Artificial Sequence
  Peptide Derived from Human Papillomavirus
QVDYYGLY

SEQ ID NO: 117 - protein, 9 aa, Artificial Sequence
  Peptide Derived from Human Papillomavirus
QVDYYGLYY

SEQ ID NO: 118 - protein, 10 aa, Artificial Sequence
  Peptide Derived from Human Papillomavirus
QVILCPTSVF

SEQ ID NO: 119 - protein, 8 aa, Artificial Sequence
  Peptide Derived from Human Papillomavirus
RLECAIYY

SEQ ID NO: 120 - protein, 10 aa, Artificial Sequence
  Peptide Derived from Human Papillomavirus
STDLRDHIDY

SEQ ID NO: 121 - protein, 11 aa, Artificial Sequence
  Peptide Derived from Human Papillomavirus
STDLRDHIDYW

SEQ ID NO: 122 - protein, 11 aa, Artificial Sequence
  Peptide Derived from Human Papillomavirus
SVDSAPILTAF

SEQ ID NO: 123 - protein, 11 aa, Artificial Sequence
  Peptide Derived from Human Papillomavirus
SVTVVEGQVDY

SEQ ID NO: 124 - protein, 8 aa, Artificial Sequence
  Peptide Derived from Human Papillomavirus
TITVSTGF

SEQ ID NO: 125 - protein, 10 aa, Artificial Sequence
  Peptide Derived from Human Papillomavirus
TLETIYNSQY

SEQ ID NO: 126 - protein, 9 aa, Artificial Sequence
  Peptide Derived from Human Papillomavirus
TLKCLRYRF

SEQ ID NO: 127 - protein, 10 aa, Artificial Sequence
  Peptide Derived from Human Papillomavirus
TLQDVSLEVY

SEQ ID NO: 128 - protein, 8 aa, Artificial Sequence
  Peptide Derived from Human Papillomavirus
TLTYDSEW

SEQ ID NO: 129 - protein, 10 aa, Artificial Sequence
  Peptide Derived from Human Papillomavirus
TLYTAVSSTW

SEQ ID NO: 130 - protein, 11 aa, Artificial Sequence
  Peptide Derived from Human Papillomavirus
TMHYTNWTHIY

SEQ ID NO: 131 - protein, 9 aa, Artificial Sequence
  Peptide Derived from Human Papillomavirus
TVVEGQVDY

SEQ ID NO: 132 - protein, 10 aa, Artificial Sequence
  Peptide Derived from Human Papillomavirus
TVVEGQVDYY

SEQ ID NO: 133 - protein, 9 aa, Artificial Sequence
  Peptide Derived from Human Papillomavirus
VILCPTSVF

SEQ ID NO: 134 - protein, 9 aa, Artificial Sequence
  Peptide Derived from Human Papillomavirus
VTLTYDSEW

SEQ ID NO: 135 - protein, 10 aa, Artificial Sequence
  Peptide Derived from Human Papillomavirus
VTVVEGQVDY

SEQ ID NO: 136 - protein, 11 aa, Artificial Sequence
  Peptide Derived from Human Papillomavirus
VTVVEGQVDYY

SEQ ID NO: 137 - protein, 8 aa, Artificial Sequence
  Peptide Derived from Human Papillomavirus
VVEGQVDY

SEQ ID NO: 138 - protein, 9 aa, Artificial Sequence
  Peptide Derived from Human Papillomavirus
VVEGQVDYY

SEQ ID NO: 139 - protein, 11 aa, Artificial Sequence
  Peptide Derived from Human Papillomavirus
WTLQDVSLEVY

SEQ ID NO: 140 - protein, 8 aa, Artificial Sequence
  Peptide Derived from Human Papillomavirus
YTAVSSTW

SEQ ID NO: 141 - protein, 10 aa, Artificial Sequence
  Peptide Derived from Human Papillomavirus
YTAVSSTWHW

SEQ ID NO: 142 - protein, 8 aa, Artificial Sequence
  Peptide Derived from Human Papillomavirus
YTNWTHIY

SEQ ID NO: 143 - protein, 9 aa, Artificial Sequence
  Peptide Derived from Human Papillomavirus
YVHEGIRTY

SEQ ID NO: 144 - protein, 10 aa, Artificial Sequence
  Peptide Derived from Human Papillomavirus
YVHEGIRTYF

SEQ ID NO: 145 - protein, 10 aa, Artificial Sequence
  Peptide Derived from Human Papillomavirus
ASAFRCFIVY

SEQ ID NO: 146 - protein, 9 aa, Artificial Sequence
  Peptide Derived from Human Papillomavirus
ASTTLLACF

SEQ ID NO: 147 - protein, 11 aa, Artificial Sequence
  Peptide Derived from Human Papillomavirus
DTASTTLLACF

SEQ ID NO: 148 - protein, 9 aa, Artificial Sequence
  Peptide Derived from Human Papillomavirus
FIVYIIFVY

SEQ ID NO: 149 - protein, 9 aa, Artificial Sequence
  Peptide Derived from Human Papillomavirus
FLIHTHARF

SEQ ID NO: 150 - protein, 9 aa, Artificial Sequence
  Peptide Derived from Human Papillomavirus
IIFVYIPLF

SEQ ID NO: 151 - protein, 8 aa, Artificial Sequence
  Peptide Derived from Human Papillomavirus
IILVLLLW

SEQ ID NO: 152 - protein, 10 aa, Artificial Sequence
  Peptide Derived from Human Papillomavirus
ITAASAFRCF

SEQ ID NO: 153 - protein, 8 aa, Artificial Sequence
  Peptide Derived from Human Papillomavirus
IVYIIFVY

SEQ ID NO: 154 - protein, 8 aa, Artificial Sequence
  Peptide Derived from Human Papillomavirus
LIHTHARF

SEQ ID NO: 155 - protein, 9 aa, Artificial Sequence
  Peptide Derived from Human Papillomavirus
LIILVLLLW

SEQ ID NO: 156 - protein, 9 aa, Artificial Sequence
  Peptide Derived from Human Papillomavirus
LLACFLLCF

SEQ ID NO: 157 - protein, 8 aa, Artificial Sequence
  Peptide Derived from Human Papillomavirus
LLLSVSTY

SEQ ID NO: 158 - protein, 11 aa, Artificial Sequence
  Peptide Derived from Human Papillomavirus
LLLWITAASAF

SEQ ID NO: 159 - protein, 10 aa, Artificial Sequence
  Peptide Derived from Human Papillomavirus
LLWITAASAF

SEQ ID NO: 160 - protein, 11 aa, Artificial Sequence
  Peptide Derived from Human Papillomavirus
PLFLIHTHARF

SEQ ID NO: 161 - protein, 9 aa, Artificial Sequence
  Peptide Derived from Human Papillomavirus
PLLLSVSTY

SEQ ID NO: 162 - protein, 10 aa, Artificial Sequence
  Peptide Derived from Human Papillomavirus
SLIILVLLLW

SEQ ID NO: 163 - protein, 8 aa, Artificial Sequence
  Peptide Derived from Human Papillomavirus
STTLLACF

SEQ ID NO: 164 - protein, 10 aa, Artificial Sequence
  Peptide Derived from Human Papillomavirus
TLLACFLLCF

SEQ ID NO: 165 - protein, 11 aa, Artificial Sequence
  Peptide Derived from Human Papillomavirus
TSLIILVLLLW

SEQ ID NO: 166 - protein, 11 aa, Artificial Sequence
  Peptide Derived from Human Papillomavirus
TTLLACFLLCF

SEQ ID NO: 167 - protein, 8 aa, Artificial Sequence
  Peptide Derived from Human Papillomavirus
WITAASAF

SEQ ID NO: 168 - protein, 11 aa, Artificial Sequence
  Peptide Derived from Human Papillomavirus
WITAASAFRCF

SEQ ID NO: 169 - protein, 10 aa, Artificial Sequence
  Peptide Derived from Human Papillomavirus
YIIFVYIPLF

SEQ ID NO: 170 - protein, 9 aa, Artificial Sequence
  Peptide Derived from Human Papillomavirus
AVCDKCLKF

SEQ ID NO: 171 - protein, 10 aa, Artificial Sequence
  Peptide Derived from Human Papillomavirus
AVCDKCLKFY

SEQ ID NO: 172 - protein, 10 aa, Artificial Sequence
  Peptide Derived from Human Papillomavirus
CIVYRDGNPY

SEQ ID NO: 173 - protein, 11 aa, Artificial Sequence
  Peptide Derived from Human Papillomavirus
CLKFYSKISEY

SEQ ID NO: 174 - protein, 8 aa, Artificial Sequence
  Peptide Derived from Human Papillomavirus
DIILECVY

SEQ ID NO: 175 - protein, 8 aa, Artificial Sequence
  Peptide Derived from Human Papillomavirus
GTTLEQQY

SEQ ID NO: 176 - protein, 8 aa, Artificial Sequence
  Peptide Derived from Human Papillomavirus
HLDKKQRF

SEQ ID NO: 177 - protein, 9 aa, Artificial Sequence
  Peptide Derived from Human Papillomavirus
ISEYRHYCY

SEQ ID NO: 178 - protein, 9 aa, Artificial Sequence
  Peptide Derived from Human Papillomavirus
IVYRDGNPY

SEQ ID NO: 179 - protein, 8 aa, Artificial Sequence
  Peptide Derived from Human Papillomavirus
KISEYRHY

SEQ ID NO: 180 - protein, 10 aa, Artificial Sequence
  Peptide Derived from Human Papillomavirus
KISEYRHYCY

SEQ ID NO: 181 - protein, 9 aa, Artificial Sequence
  Peptide Derived from Human Papillomavirus
LLRREVYDF

SEQ ID NO: 182 - protein, 11 aa, Artificial Sequence
  Peptide Derived from Human Papillomavirus
LLRREVYDFAF

SEQ ID NO: 183 - protein, 8 aa, Artificial Sequence
  Peptide Derived from Human Papillomavirus
QLLRREVY

SEQ ID NO: 184 - protein, 10 aa, Artificial Sequence
  Peptide Derived from Human Papillomavirus
QLLRREVYDF

SEQ ID NO: 185 - protein, 11 aa, Artificial Sequence
  Peptide Derived from Human Papillomavirus
SLYGTTLEQQY

SEQ ID NO: 186 - protein, 11 aa, Artificial Sequence
  Peptide Derived from Human Papillomavirus
TIHDIILECVY

SEQ ID NO: 187 - protein, 10 aa, Artificial Sequence
  Peptide Derived from Human Papillomavirus
YSKISEYRHY

SEQ ID NO: 188 - protein, 10 aa, Artificial Sequence
  Peptide Derived from Human Papillomavirus
DLQPETTDLY

SEQ ID NO: 189 - protein, 8 aa, Artificial Sequence
  Peptide Derived from Human Papillomavirus
DTPTLHEY

SEQ ID NO: 190 - protein, 8 aa, Artificial Sequence
  Peptide Derived from Human Papillomavirus
ETTDLYCY

SEQ ID NO: 191 - protein, 9 aa, Artificial Sequence
  Peptide Derived from Human Papillomavirus
AISTSETTY

SEQ ID NO: 192 - protein, 11 aa, Artificial Sequence
  Peptide Derived from Human Papillomavirus
AVGENVPDDLY

SEQ ID NO: 193 - protein, 10 aa, Artificial Sequence
  Peptide Derived from Human Papillomavirus
CTSICKYPDY

SEQ ID NO: 194 - protein, 9 aa, Artificial Sequence
  Peptide Derived from Human Papillomavirus
DICTSICKY

SEQ ID NO: 195 - protein, 11 aa, Artificial Sequence
  Peptide Derived from Human Papillomavirus
DLDQFPLGRKF

SEQ ID NO: 196 - protein, 8 aa, Artificial Sequence
  Peptide Derived from Human Papillomavirus
DTENASAY

SEQ ID NO: 197 - protein, 9 aa, Artificial Sequence
  Peptide Derived from Human Papillomavirus
DTGFGAMDF

SEQ ID NO: 198 - protein, 8 aa, Artificial Sequence
  Peptide Derived from Human Papillomavirus
DVNVYHIF

SEQ ID NO: 199 - protein, 9 aa, Artificial Sequence
  Peptide Derived from Human Papillomavirus
DVNVYHIFF

SEQ ID NO: 200 - protein, 9 aa, Artificial Sequence
  Peptide Derived from Human Papillomavirus
ETTYKNTNF

SEQ ID NO: 201 - protein, 8 aa, Artificial Sequence
  Peptide Derived from Human Papillomavirus
EVNLKEKF

SEQ ID NO: 202 - protein, 10 aa, Artificial Sequence
  Peptide Derived from Human Papillomavirus
FIYILVITCY

SEQ ID NO: 203 - protein, 8 aa, Artificial Sequence
  Peptide Derived from Human Papillomavirus
FSADLDQF

SEQ ID NO: 204 - protein, 9 aa, Artificial Sequence
  Peptide Derived from Human Papillomavirus
GICWGNQLF

SEQ ID NO: 205 - protein, 8 aa, Artificial Sequence
  Peptide Derived from Human Papillomavirus
GLKAKPKF

SEQ ID NO: 206 - protein, 11 aa, Artificial Sequence
  Peptide Derived from Human Papillomavirus
GSMVTSDAQIF

SEQ ID NO: 207 - protein, 11 aa, Artificial Sequence
  Peptide Derived from Human Papillomavirus
GSTANLASSNY

SEQ ID NO: 208 - protein, 9 aa, Artificial Sequence
  Peptide Derived from Human Papillomavirus
GTLEDTYRF

SEQ ID NO: 209 - protein, 9 aa, Artificial Sequence
  Peptide Derived from Human Papillomavirus
HIFFQMSLW

SEQ ID NO: 210 - protein, 8 aa, Artificial Sequence
  Peptide Derived from Human Papillomavirus
HLPDPNKF

SEQ ID NO: 211 - protein, 10 aa, Artificial Sequence
  Peptide Derived from Human Papillomavirus
HLPDPNKFGF

SEQ ID NO: 212 - protein, 11 aa, Artificial Sequence
  Peptide Derived from Human Papillomavirus
HSMNSTILEDW

SEQ ID NO: 213 - protein, 11 aa, Artificial Sequence
  Peptide Derived from Human Papillomavirus
ILVPKVSGLQY

SEQ ID NO: 214 - protein, 8 aa, Artificial Sequence
  Peptide Derived from Human Papillomavirus
ISTSETTY

SEQ ID NO: 215 - protein, 11 aa, Artificial Sequence
  Peptide Derived from Human Papillomavirus
ITCYENDVNVY

SEQ ID NO: 216 - protein, 10 aa, Artificial Sequence
  Peptide Derived from Human Papillomavirus
ITLTADVMTY

SEQ ID NO: 217 - protein, 11 aa, Artificial Sequence
  Peptide Derived from Human Papillomavirus
KITLTADVMTY

SEQ ID NO: 218 - protein, 11 aa, Artificial Sequence
  Peptide Derived from Human Papillomavirus
KLDDTENASAY

SEQ ID NO: 219 - protein, 10 aa, Artificial Sequence
  Peptide Derived from Human Papillomavirus
KVSGLQYRVF

SEQ ID NO: 220 - protein, 8 aa, Artificial Sequence
  Peptide Derived from Human Papillomavirus
KVVSTDEY

SEQ ID NO: 221 - protein, 8 aa, Artificial Sequence
  Peptide Derived from Human Papillomavirus
LLAVGHPY

SEQ ID NO: 222 - protein, 9 aa, Artificial Sequence
  Peptide Derived from Human Papillomavirus
LLAVGHPYF

SEQ ID NO: 223 - protein, 8 aa, Artificial Sequence
  Peptide Derived from Human Papillomavirus
LTADVMTY

SEQ ID NO: 224 - protein, 10 aa, Artificial Sequence
  Peptide Derived from Human Papillomavirus
LVPKVSGLQY

SEQ ID NO: 225 - protein, 11 aa, Artificial Sequence
  Peptide Derived from Human Papillomavirus
MVDTGFGAMDF

SEQ ID NO: 226 - protein, 11 aa, Artificial Sequence
  Peptide Derived from Human Papillomavirus
MVSEPYGDSLF

SEQ ID NO: 227 - protein, 9 aa, Artificial Sequence
  Peptide Derived from Human Papillomavirus
MVTSDAQIF

SEQ ID NO: 228 - protein, 8 aa, Artificial Sequence
  Peptide Derived from Human Papillomavirus
NLASSNYF

SEQ ID NO: 229 - protein, 8 aa, Artificial Sequence
  Peptide Derived from Human Papillomavirus
NSTILEDW

SEQ ID NO: 230 - protein, 10 aa, Artificial Sequence
  Peptide Derived from Human Papillomavirus
NSTILEDWNF

SEQ ID NO: 231 - protein, 11 aa, Artificial Sequence
  Peptide Derived from Human Papillomavirus
PLDICTSICKY

SEQ ID NO: 232 - protein, 8 aa, Artificial Sequence
  Peptide Derived from Human Papillomavirus
PLKKYTFW

SEQ ID NO: 233 - protein, 11 aa, Artificial Sequence
  Peptide Derived from Human Papillomavirus
PVSKVVSTDEY

SEQ ID NO: 234 - protein, 8 aa, Artificial Sequence
  Peptide Derived from Human Papillomavirus
QIFNKPYW

SEQ ID NO: 235 - protein, 8 aa, Artificial Sequence
  Peptide Derived from Human Papillomavirus
QMFVRHLF

SEQ ID NO: 236 - protein, 10 aa, Artificial Sequence
  Peptide Derived from Human Papillomavirus
RIHLPDPNKF

SEQ ID NO: 237 - protein, 9 aa, Artificial Sequence
  Peptide Derived from Human Papillomavirus
RLLAVGHPY

SEQ ID NO: 238 - protein, 10 aa, Artificial Sequence
  Peptide Derived from Human Papillomavirus
RLLAVGHPYF

SEQ ID NO: 239 - protein, 8 aa, Artificial Sequence
  Peptide Derived from Human Papillomavirus
SICKYPDY

SEQ ID NO: 240 - protein, 11 aa, Artificial Sequence
  Peptide Derived from Human Papillomavirus
SLWLPSEATVY

SEQ ID NO: 241 - protein, 10 aa, Artificial Sequence
  Peptide Derived from Human Papillomavirus
SMNSTILEDW

SEQ ID NO: 242 - protein, 10 aa, Artificial Sequence
  Peptide Derived from Human Papillomavirus
SMVTSDAQIF

SEQ ID NO: 243 - protein, 10 aa, Artificial Sequence
  Peptide Derived from Human Papillomavirus
STANLASSNY

SEQ ID NO: 244 - protein, 11 aa, Artificial Sequence
  Peptide Derived from Human Papillomavirus
STANLASSNYF

SEQ ID NO: 245 - protein, 9 aa, Artificial Sequence
  Peptide Derived from Human Papillomavirus
STILEDWNF

SEQ ID NO: 246 - protein, 8 aa, Artificial Sequence
  Peptide Derived from Human Papillomavirus
TILEDWNF

SEQ ID NO: 247 - protein, 8 aa, Artificial Sequence
  Peptide Derived from Human Papillomavirus
TLEDTYRF

SEQ ID NO: 248 - protein, 9 aa, Artificial Sequence
  Peptide Derived from Human Papillomavirus
TLTADVMTY

SEQ ID NO: 249 - protein, 11 aa, Artificial Sequence
  Peptide Derived from Human Papillomavirus
TSDAQIFNKPY

SEQ ID NO: 250 - protein, 11 aa, Artificial Sequence
  Peptide Derived from Human Papillomavirus
TSETTYKNTNF

SEQ ID NO: 251 - protein, 9 aa, Artificial Sequence
  Peptide Derived from Human Papillomavirus
TSICKYPDY

SEQ ID NO: 252 - protein, 11 aa, Artificial Sequence
  Peptide Derived from Human Papillomavirus
TSRLLAVGHPY

SEQ ID NO: 253 - protein, 8 aa, Artificial Sequence
  Peptide Derived from Human Papillomavirus
TTYKNTNF

SEQ ID NO: 254 - protein, 11 aa, Artificial Sequence
  Peptide Derived from Human Papillomavirus
TTYKNTNFKEY

SEQ ID NO: 255 - protein, 10 aa, Artificial Sequence
  Peptide Derived from Human Papillomavirus
VSEPYGDSLF

SEQ ID NO: 256 - protein, 11 aa, Artificial Sequence
  Peptide Derived from Human Papillomavirus
VSEPYGDSLFF

SEQ ID NO: 257 - protein, 9 aa, Artificial Sequence
  Peptide Derived from Human Papillomavirus
VSGLQYRVF

SEQ ID NO: 258 - protein, 10 aa, Artificial Sequence
  Peptide Derived from Human Papillomavirus
VSKVVSTDEY

SEQ ID NO: 259 - protein, 8 aa, Artificial Sequence
  Peptide Derived from Human Papillomavirus
VTSDAQIF

SEQ ID NO: 260 - protein, 9 aa, Artificial Sequence
  Peptide Derived from Human Papillomavirus
WLPSEATVY

SEQ ID NO: 261 - protein, 9 aa, Artificial Sequence
  Peptide Derived from Human Papillomavirus
YIKMVSEPY

SEQ ID NO: 262 - protein, 8 aa, Artificial Sequence
  Peptide Derived from Human Papillomavirus
YILVITCY

SEQ ID NO: 263 - protein, 8 aa, Artificial Sequence
  Peptide Derived from Human Papillomavirus
YLRHGEEY

SEQ ID NO: 264 - protein, 8 aa, Artificial Sequence
  Peptide Derived from Human Papillomavirus
YLRREQMF

SEQ ID NO: 265 - protein, 8 aa, Artificial Sequence
  Peptide Derived from Human Papillomavirus
YVARTNIY

SEQ ID NO: 266 - protein, 9 aa, Artificial Sequence
  Peptide Derived from Human Papillomavirus
YVARTNIYY

SEQ ID NO: 267 - protein, 11 aa, Artificial Sequence
  Peptide Derived from Human Papillomavirus
ALPTSINNGLY

SEQ ID NO: 268 - protein, 11 aa, Artificial Sequence
  Peptide Derived from Human Papillomavirus
ALTSRRTGIRY

SEQ ID NO: 269 - protein, 8 aa, Artificial Sequence
  Peptide Derived from Human Papillomavirus
DVDNTLYF

SEQ ID NO: 270 - protein, 10 aa, Artificial Sequence
  Peptide Derived from Human Papillomavirus
ELQTITPSTY

SEQ ID NO: 271 - protein, 11 aa, Artificial Sequence
  Peptide Derived from Human Papillomavirus
FITTPTKLITY

SEQ ID NO: 272 - protein, 9 aa, Artificial Sequence
  Peptide Derived from Human Papillomavirus
GIDVDNTLY

SEQ ID NO: 273 - protein, 10 aa, Artificial Sequence
  Peptide Derived from Human Papillomavirus
GIDVDNTLYF

SEQ ID NO: 274 - protein, 10 aa, Artificial Sequence
  Peptide Derived from Human Papillomavirus
GLYDIYADDF

SEQ ID NO: 275 - protein, 10 aa, Artificial Sequence
  Peptide Derived from Human Papillomavirus
GSGTGGRTGY

SEQ ID NO: 276 - protein, 11 aa, Artificial Sequence
  Peptide Derived from Human Papillomavirus
GSRPVARLGLY

SEQ ID NO: 277 - protein, 8 aa, Artificial Sequence
  Peptide Derived from Human Papillomavirus
GTGGRTGY

SEQ ID NO: 278 - protein, 8 aa, Artificial Sequence
  Peptide Derived from Human Papillomavirus
IIADAGDF

SEQ ID NO: 279 - protein, 9 aa, Artificial Sequence
  Peptide Derived from Human Papillomavirus
IIADAGDFY

SEQ ID NO: 280 - protein, 10 aa, Artificial Sequence
  Peptide Derived from Human Papillomavirus
ILQYGSMGVF

SEQ ID NO: 281 - protein, 11 aa, Artificial Sequence
  Peptide Derived from Human Papillomavirus
ILQYGSMGVFF

SEQ ID NO: 282 - protein, 10 aa, Artificial Sequence
  Peptide Derived from Human Papillomavirus
ITTPTKLITY

SEQ ID NO: 283 - protein, 8 aa, Artificial Sequence
  Peptide Derived from Human Papillomavirus
ITYDNPAY

SEQ ID NO: 284 - protein, 8 aa, Artificial Sequence
  Peptide Derived from Human Papillomavirus
IVPGSPQY

SEQ ID NO: 285 - protein, 10 aa, Artificial Sequence
  Peptide Derived from Human Papillomavirus
IVSLVEETSF

SEQ ID NO: 286 - protein, 10 aa, Artificial Sequence
  Peptide Derived from Human Papillomavirus
KLITYDNPAY

SEQ ID NO: 287 - protein, 9 aa, Artificial Sequence
  Peptide Derived from Human Papillomavirus
KSIGAKVHY

SEQ ID NO: 288 - protein, 10 aa, Artificial Sequence
  Peptide Derived from Human Papillomavirus
KSIGAKVHYY

SEQ ID NO: 289 - protein, 11 aa, Artificial Sequence
  Peptide Derived from Human Papillomavirus
KSIGAKVHYYY

SEQ ID NO: 290 - protein, 10 aa, Artificial Sequence
  Peptide Derived from Human Papillomavirus
KTIADQILQY

SEQ ID NO: 291 - protein, 8 aa, Artificial Sequence
  Peptide Derived from Human Papillomavirus
KVHYYYDF

SEQ ID NO: 292 - protein, 11 aa, Artificial Sequence
  Peptide Derived from Human Papillomavirus
LIPIVPGSPQY

SEQ ID NO: 293 - protein, 9 aa, Artificial Sequence
  Peptide Derived from Human Papillomavirus
LITYDNPAY

SEQ ID NO: 294 - protein, 11 aa, Artificial Sequence
  Peptide Derived from Human Papillomavirus
LSSSTISTHNY

SEQ ID NO: 295 - protein, 10 aa, Artificial Sequence
  Peptide Derived from Human Papillomavirus
LTSRRTGIRY

SEQ ID NO: 296 - protein, 11 aa, Artificial Sequence
  Peptide Derived from Human Papillomavirus
MLRKRRKRLPY

SEQ ID NO: 297 - protein, 8 aa, Artificial Sequence
  Peptide Derived from Human Papillomavirus
NIAPDPDF

SEQ ID NO: 298 - protein, 11 aa, Artificial Sequence
  Peptide Derived from Human Papillomavirus
NSINIAPDPDF

SEQ ID NO: 299 - protein, 10 aa, Artificial Sequence
  Peptide Derived from Human Papillomavirus
NTTIPFGGAY

SEQ ID NO: 300 - protein, 9 aa, Artificial Sequence
  Peptide Derived from Human Papillomavirus
PIVPGSPQY

SEQ ID NO: 301 - protein, 10 aa, Artificial Sequence
  Peptide Derived from Human Papillomavirus
PSIPPDVSGF

SEQ ID NO: 302 - protein, 8 aa, Artificial Sequence
  Peptide Derived from Human Papillomavirus
PSTSLSGY

SEQ ID NO: 303 - protein, 11 aa, Artificial Sequence
  Peptide Derived from Human Papillomavirus
PSVPSTSLSGY

SEQ ID NO: 304 - protein, 10 aa, Artificial Sequence
  Peptide Derived from Human Papillomavirus
PTPAETGGHF

SEQ ID NO: 305 - protein, 9 aa, Artificial Sequence
  Peptide Derived from Human Papillomavirus
PTSINNGLY

SEQ ID NO: 306 - protein, 8 aa, Artificial Sequence
  Peptide Derived from Human Papillomavirus
PVARLGLY

SEQ ID NO: 307 - protein, 11 aa, Artificial Sequence
  Peptide Derived from Human Papillomavirus
QILQYGSMGVF

SEQ ID NO: 308 - protein, 8 aa, Artificial Sequence
  Peptide Derived from Human Papillomavirus
QTITPSTY

SEQ ID NO: 309 - protein, 9 aa, Artificial Sequence
  Peptide Derived from Human Papillomavirus
QVKVVDPAF

SEQ ID NO: 310 - protein, 11 aa, Artificial Sequence
  Peptide Derived from Human Papillomavirus
RTKRASATQLY

SEQ ID NO: 311 - protein, 8 aa, Artificial Sequence
  Peptide Derived from Human Papillomavirus
SIGAKVHY

SEQ ID NO: 312 - protein, 9 aa, Artificial Sequence
  Peptide Derived from Human Papillomavirus
SIGAKVHYY

SEQ ID NO: 313 - protein, 10 aa, Artificial Sequence
  Peptide Derived from Human Papillomavirus
SIGAKVHYYY

SEQ ID NO: 314 - protein, 10 aa, Artificial Sequence
  Peptide Derived from Human Papillomavirus
SINIAPDPDF

SEQ ID NO: 315 - protein, 10 aa, Artificial Sequence
  Peptide Derived from Human Papillomavirus
SINNGLYDIY

SEQ ID NO: 316 - protein, 9 aa, Artificial Sequence
  Peptide Derived from Human Papillomavirus
SIPPDVSGF

SEQ ID NO: 317 - protein, 11 aa, Artificial Sequence
  Peptide Derived from Human Papillomavirus
SIVSLVEETSF

SEQ ID NO: 318 - protein, 8 aa, Artificial Sequence
  Peptide Derived from Human Papillomavirus
SLVEETSF

SEQ ID NO: 319 - protein, 10 aa, Artificial Sequence
  Peptide Derived from Human Papillomavirus
SSSTISTHNY

SEQ ID NO: 320 - protein, 9 aa, Artificial Sequence
  Peptide Derived from Human Papillomavirus
SSTISTHNY

SEQ ID NO: 321 - protein, 8 aa, Artificial Sequence
  Peptide Derived from Human Papillomavirus
STISTHNY

SEQ ID NO: 322 - protein, 10 aa, Artificial Sequence
  Peptide Derived from Human Papillomavirus
SVPSTSLSGY

SEQ ID NO: 323 - protein, 9 aa, Artificial Sequence
  Peptide Derived from Human Papillomavirus
TIADQILQY

SEQ ID NO: 324 - protein, 9 aa, Artificial Sequence
  Peptide Derived from Human Papillomavirus
TIIADAGDF

SEQ ID NO: 325 - protein, 10 aa, Artificial Sequence
  Peptide Derived from Human Papillomavirus
TIIADAGDFY

SEQ ID NO: 326 - protein, 8 aa, Artificial Sequence
  Peptide Derived from Human Papillomavirus
TIPFGGAY

SEQ ID NO: 327 - protein, 8 aa, Artificial Sequence
  Peptide Derived from Human Papillomavirus
TSINNGLY

SEQ ID NO: 328 - protein, 11 aa, Artificial Sequence
  Peptide Derived from Human Papillomavirus
TSINNGLYDIY

SEQ ID NO: 329 - protein, 9 aa, Artificial Sequence
  Peptide Derived from Human Papillomavirus
TSRRTGIRY

SEQ ID NO: 330 - protein, 8 aa, Artificial Sequence
  Peptide Derived from Human Papillomavirus
TTHNNPTF

SEQ ID NO: 331 - protein, 9 aa, Artificial Sequence
  Peptide Derived from Human Papillomavirus
TTIPFGGAY

SEQ ID NO: 332 - protein, 9 aa, Artificial Sequence
  Peptide Derived from Human Papillomavirus
TTPTKLITY

SEQ ID NO: 333 - protein, 11 aa, Artificial Sequence
  Peptide Derived from Human Papillomavirus
TTVTTHNNPTF

SEQ ID NO: 334 - protein, 10 aa, Artificial Sequence
  Peptide Derived from Human Papillomavirus
TVTTHNNPTF

SEQ ID NO: 335 - protein, 9 aa, Artificial Sequence
  Peptide Derived from Human Papillomavirus
VSLVEETSF

SEQ ID NO: 336 - protein, 9 aa, Artificial Sequence
  Peptide Derived from Human Papillomavirus
VTTHNNPTF

SEQ ID NO: 337 - protein, 10 aa, Artificial Sequence
  Peptide Derived from Human Papillomavirus
YIPANTTIPF

SEQ ID NO: 338 - protein, 10 aa, Artificial Sequence
  Peptide Derived from Human Papillomavirus
YTIIADAGDF

SEQ ID NO: 339 - protein, 11 aa, Artificial Sequence
  Peptide Derived from Human Papillomavirus
YTIIADAGDFY

SEQ ID NO: 340 - protein, 10 aa, Artificial Sequence
  Peptide Derived from Human Papillomavirus
AMLAVFKDTY

SEQ ID NO: 341 - protein, 11 aa, Artificial Sequence
  Peptide Derived from Human Papillomavirus
AMLDDATTTCW

SEQ ID NO: 342 - protein, 11 aa, Artificial Sequence
  Peptide Derived from Human Papillomavirus
ATDTGSDMVDF

SEQ ID NO: 343 - protein, 8 aa, Artificial Sequence
  Peptide Derived from Human Papillomavirus
ATTTCWTY

SEQ ID NO: 344 - protein, 9 aa, Artificial Sequence
  Peptide Derived from Human Papillomavirus
ATTTCWTYF

SEQ ID NO: 345 - protein, 11 aa, Artificial Sequence
  Peptide Derived from Human Papillomavirus
AVFKDTYGLSF

SEQ ID NO: 346 - protein, 10 aa, Artificial Sequence
  Peptide Derived from Human Papillomavirus
CSKIDEGGDW

SEQ ID NO: 347 - protein, 9 aa, Artificial Sequence
  Peptide Derived from Human Papillomavirus
CTDWVTAIF

SEQ ID NO: 348 - protein, 8 aa, Artificial Sequence
  Peptide Derived from Human Papillomavirus
DLSEMVQW

SEQ ID NO: 349 - protein, 10 aa, Artificial Sequence
  Peptide Derived from Human Papillomavirus
DLSEMVQWAF

SEQ ID NO: 350 - protein, 9 aa, Artificial Sequence
  Peptide Derived from Human Papillomavirus
DSNSNAAAF

SEQ ID NO: 351 - protein, 10 aa, Artificial Sequence
  Peptide Derived from Human Papillomavirus
DTEGNPFGTF

SEQ ID NO: 352 - protein, 9 aa, Artificial Sequence
  Peptide Derived from Human Papillomavirus
DTGSDMVDF

SEQ ID NO: 353 - protein, 10 aa, Artificial Sequence
  Peptide Derived from Human Papillomavirus
EINDKNWKCF

SEQ ID NO: 354 - protein, 11 aa, Artificial Sequence
  Peptide Derived from Human Papillomavirus
EINDKNWKCFF

SEQ ID NO: 355 - protein, 9 aa, Artificial Sequence
  Peptide Derived from Human Papillomavirus
ELETAQALF

SEQ ID NO: 356 - protein, 10 aa, Artificial Sequence
  Peptide Derived from Human Papillomavirus
ELTDESDMAF

SEQ ID NO: 357 - protein, 8 aa, Artificial Sequence
  Peptide Derived from Human Papillomavirus
ESDMAFEY

SEQ ID NO: 358 - protein, 9 aa, Artificial Sequence
  Peptide Derived from Human Papillomavirus
ESRITVFEF

SEQ ID NO: 359 - protein, 9 aa, Artificial Sequence
  Peptide Derived from Human Papillomavirus
EVMGDTPEW

SEQ ID NO: 360 - protein, 8 aa, Artificial Sequence
  Peptide Derived from Human Papillomavirus
FIDTQGTF

SEQ ID NO: 361 - protein, 9 aa, Artificial Sequence
  Peptide Derived from Human Papillomavirus
FIQGAVISF

SEQ ID NO: 362 - protein, 11 aa, Artificial Sequence
  Peptide Derived from Human Papillomavirus
FITFLGALKSF

SEQ ID NO: 363 - protein, 8 aa, Artificial Sequence
  Peptide Derived from Human Papillomavirus
FLGALKSF

SEQ ID NO: 364 - protein, 10 aa, Artificial Sequence
  Peptide Derived from Human Papillomavirus
FLKSNCQAKY

SEQ ID NO: 365 - protein, 9 aa, Artificial Sequence
  Peptide Derived from Human Papillomavirus
FLRYQQIEF

SEQ ID NO: 366 - protein, 8 aa, Artificial Sequence
  Peptide Derived from Human Papillomavirus
FTDLVRNF

SEQ ID NO: 367 - protein, 8 aa, Artificial Sequence
  Peptide Derived from Human Papillomavirus
FTISDSGY

SEQ ID NO: 368 - protein, 8 aa, Artificial Sequence
  Peptide Derived from Human Papillomavirus
FVNSTSHF

SEQ ID NO: 369 - protein, 9 aa, Artificial Sequence
  Peptide Derived from Human Papillomavirus
FVNSTSHFW

SEQ ID NO: 370 - protein, 11 aa, Artificial Sequence
  Peptide Derived from Human Papillomavirus
GLSFTDLVRNF

SEQ ID NO: 371 - protein, 8 aa, Artificial Sequence
  Peptide Derived from Human Papillomavirus
GTGCNGWF

SEQ ID NO: 372 - protein, 9 aa, Artificial Sequence
  Peptide Derived from Human Papillomavirus
GTGCNGWFY

SEQ ID NO: 373 - protein, 10 aa, Artificial Sequence
  Peptide Derived from Human Papillomavirus
GTPKKNCLVF

SEQ ID NO: 374 - protein, 10 aa, Artificial Sequence
  Peptide Derived from Human Papillomavirus
GVLILALLRY

SEQ ID NO: 375 - protein, 10 aa, Artificial Sequence
  Peptide Derived from Human Papillomavirus
GVNPTIAEGF

SEQ ID NO: 376 - protein, 9 aa, Artificial Sequence
  Peptide Derived from Human Papillomavirus
HIQCLDCKW

SEQ ID NO: 377 - protein, 11 aa, Artificial Sequence
  Peptide Derived from Human Papillomavirus
IIQHGIDDSNF

SEQ ID NO: 378 - protein, 11 aa, Artificial Sequence
  Peptide Derived from Human Papillomavirus
ISEVMGDTPEW

SEQ ID NO: 379 - protein, 10 aa, Artificial Sequence
  Peptide Derived from Human Papillomavirus
ISFVNSTSHF

SEQ ID NO: 380 - protein, 11 aa, Artificial Sequence
  Peptide Derived from Human Papillomavirus
ISFVNSTSHFW

SEQ ID NO: 381 - protein, 10 aa, Artificial Sequence
  Peptide Derived from Human Papillomavirus
ITFLGALKSF

SEQ ID NO: 382 - protein, 10 aa, Artificial Sequence
  Peptide Derived from Human Papillomavirus
ITVFEFPNAF

SEQ ID NO: 383 - protein, 8 aa, Artificial Sequence
  Peptide Derived from Human Papillomavirus
KIDEGGDW

SEQ ID NO: 384 - protein, 10 aa, Artificial Sequence
  Peptide Derived from Human Papillomavirus
KLRSSVAALY

SEQ ID NO: 385 - protein, 11 aa, Artificial Sequence
  Peptide Derived from Human Papillomavirus
KLRSSVAALYW

SEQ ID NO: 386 - protein, 10 aa, Artificial Sequence
  Peptide Derived from Human Papillomavirus
KSDKTTCTDW

SEQ ID NO: 387 - protein, 8 aa, Artificial Sequence
  Peptide Derived from Human Papillomavirus
KSNCQAKY

SEQ ID NO: 388 - protein, 8 aa, Artificial Sequence
  Peptide Derived from Human Papillomavirus
KSYFGMSF

SEQ ID NO: 389 - protein, 11 aa, Artificial Sequence
  Peptide Derived from Human Papillomavirus
KSYFGMSFIHF

SEQ ID NO: 390 - protein, 10 aa, Artificial Sequence
  Peptide Derived from Human Papillomavirus
KTLIQPFILY

SEQ ID NO: 391 - protein, 8 aa, Artificial Sequence
  Peptide Derived from Human Papillomavirus
LILALLRY

SEQ ID NO: 392 - protein, 8 aa, Artificial Sequence
  Peptide Derived from Human Papillomavirus
LIQPFILY

SEQ ID NO: 393 - protein, 9 aa, Artificial Sequence
  Peptide Derived from Human Papillomavirus
LSEMVQWAF

SEQ ID NO: 394 - protein, 10 aa, Artificial Sequence
  Peptide Derived from Human Papillomavirus
LSFTDLVRNF

SEQ ID NO: 395 - protein, 9 aa, Artificial Sequence
  Peptide Derived from Human Papillomavirus
LTDESDMAF

SEQ ID NO: 396 - protein, 11 aa, Artificial Sequence
  Peptide Derived from Human Papillomavirus
LTDESDMAFEY

SEQ ID NO: 397 - protein, 9 aa, Artificial Sequence
  Peptide Derived from Human Papillomavirus
MLAVFKDTY

SEQ ID NO: 398 - protein, 10 aa, Artificial Sequence
  Peptide Derived from Human Papillomavirus
MLDDATTTCW

SEQ ID NO: 399 - protein, 11 aa, Artificial Sequence
  Peptide Derived from Human Papillomavirus
MVDFIDTQGTF

SEQ ID NO: 400 - protein, 10 aa, Artificial Sequence
  Peptide Derived from Human Papillomavirus
NIHPAKDNRW

SEQ ID NO: 401 - protein, 8 aa, Artificial Sequence
  Peptide Derived from Human Papillomavirus
NMSQWIRF

SEQ ID NO: 402 - protein, 11 aa, Artificial Sequence
  Peptide Derived from Human Papillomavirus
NTGKSYFGMSF

SEQ ID NO: 403 - protein, 8 aa, Artificial Sequence
  Peptide Derived from Human Papillomavirus
PIVQFLRY

SEQ ID NO: 404 - protein, 10 aa, Artificial Sequence
  Peptide Derived from Human Papillomavirus
PVYEINDKNW

SEQ ID NO: 405 - protein, 10 aa, Artificial Sequence
  Peptide Derived from Human Papillomavirus
QMNMSQWIRF

SEQ ID NO: 406 - protein, 10 aa, Artificial Sequence
  Peptide Derived from Human Papillomavirus
QVLHVLKRKF

SEQ ID NO: 407 - protein, 11 aa, Artificial Sequence
  Peptide Derived from Human Papillomavirus
RITVFEFPNAF

SEQ ID NO: 408 - protein, 10 aa, Artificial Sequence
  Peptide Derived from Human Papillomavirus
RLFTISDSGY

SEQ ID NO: 409 - protein, 8 aa, Artificial Sequence
  Peptide Derived from Human Papillomavirus
RSSVAALY

SEQ ID NO: 410 - protein, 9 aa, Artificial Sequence
  Peptide Derived from Human Papillomavirus
RSSVAALYW

SEQ ID NO: 411 - protein, 10 aa, Artificial Sequence
  Peptide Derived from Human Papillomavirus
RSSVAALYWY

SEQ ID NO: 412 - protein, 8 aa, Artificial Sequence
  Peptide Derived from Human Papillomavirus
SSVAALYW

SEQ ID NO: 413 - protein, 9 aa, Artificial Sequence
  Peptide Derived from Human Papillomavirus
SSVAALYWY

SEQ ID NO: 414 - protein, 8 aa, Artificial Sequence
  Peptide Derived from Human Papillomavirus
SVAALYWY

SEQ ID NO: 415 - protein, 9 aa, Artificial Sequence
  Peptide Derived from Human Papillomavirus
TLIQPFILY

SEQ ID NO: 416 - protein, 11 aa, Artificial Sequence
  Peptide Derived from Human Papillomavirus
TTCTDWVTAIF

SEQ ID NO: 417 - protein, 10 aa, Artificial Sequence
  Peptide Derived from Human Papillomavirus
TTCWTYFDTY

SEQ ID NO: 418 - protein, 8 aa, Artificial Sequence
  Peptide Derived from Human Papillomavirus
TTTCWTYF

SEQ ID NO: 419 - protein, 11 aa, Artificial Sequence
  Peptide Derived from Human Papillomavirus
TTTCWTYFDTY

SEQ ID NO: 420 - protein, 9 aa, Artificial Sequence
  Peptide Derived from Human Papillomavirus
TVFEFPNAF

SEQ ID NO: 421 - protein, 11 aa, Artificial Sequence
  Peptide Derived from Human Papillomavirus
TVFEFPNAFPF

SEQ ID NO: 422 - protein, 11 aa, Artificial Sequence
  Peptide Derived from Human Papillomavirus
VISFVNSTSHF

SEQ ID NO: 423 - protein, 9 aa, Artificial Sequence
  Peptide Derived from Human Papillomavirus
VLHVLKRKF

SEQ ID NO: 424 - protein, 9 aa, Artificial Sequence
  Peptide Derived from Human Papillomavirus
VLILALLRY

SEQ ID NO: 425 - protein, 8 aa, Artificial Sequence
  Peptide Derived from Human Papillomavirus
VMGDTPEW

SEQ ID NO: 426 - protein, 9 aa, Artificial Sequence
  Peptide Derived from Human Papillomavirus
YLESRITVF

SEQ ID NO: 427 - protein, 11 aa, Artificial Sequence
  Peptide Derived from Human Papillomavirus
YLESRITVFEF

SEQ ID NO: 428 - protein, 10 aa, Artificial Sequence
  Peptide Derived from Human Papillomavirus
ALQGLAQSRY

SEQ ID NO: 429 - protein, 10 aa, Artificial Sequence
  Peptide Derived from Human Papillomavirus
ATCVSHRGLY

SEQ ID NO: 430 - protein, 11 aa, Artificial Sequence
  Peptide Derived from Human Papillomavirus
ATCVSHRGLYY

SEQ ID NO: 431 - protein, 11 aa, Artificial Sequence
  Peptide Derived from Human Papillomavirus
CMTYVAWDSVY

SEQ ID NO: 432 - protein, 10 aa, Artificial Sequence
  Peptide Derived from Human Papillomavirus
CVQDKIIDHY

SEQ ID NO: 433 - protein, 8 aa, Artificial Sequence
  Peptide Derived from Human Papillomavirus
CVSHRGLY

SEQ ID NO: 434 - protein, 9 aa, Artificial Sequence
  Peptide Derived from Human Papillomavirus
CVSHRGLYY

SEQ ID NO: 435 - protein, 8 aa, Artificial Sequence
  Peptide Derived from Human Papillomavirus
DIDSQIQY

SEQ ID NO: 436 - protein, 9 aa, Artificial Sequence
  Peptide Derived from Human Papillomavirus
DIDSQIQYW

SEQ ID NO: 437 - protein, 8 aa, Artificial Sequence
  Peptide Derived from Human Papillomavirus
DISSTWHW

SEQ ID NO: 438 - protein, 11 aa, Artificial Sequence
  Peptide Derived from Human Papillomavirus
DSKDIDSQIQY

SEQ ID NO: 439 - protein, 9 aa, Artificial Sequence
  Peptide Derived from Human Papillomavirus
DSVQILVGY

SEQ ID NO: 440 - protein, 11 aa, Artificial Sequence
  Peptide Derived from Human Papillomavirus
ELWNTEPTHCF

SEQ ID NO: 441 - protein, 9 aa, Artificial Sequence
  Peptide Derived from Human Papillomavirus
GLYYVKEGY

SEQ ID NO: 442 - protein, 9 aa, Artificial Sequence
  Peptide Derived from Human Papillomavirus
HSETQRTKF

SEQ ID NO: 443 - protein, 9 aa, Artificial Sequence
  Peptide Derived from Human Papillomavirus
KTGILTVTY

SEQ ID NO: 444 - protein, 9 aa, Artificial Sequence
  Peptide Derived from Human Papillomavirus
LIRWENAIF

SEQ ID NO: 445 - protein, 10 aa, Artificial Sequence
  Peptide Derived from Human Papillomavirus
LIRWENAIFF

SEQ ID NO: 446 - protein, 10 aa, Artificial Sequence
  Peptide Derived from Human Papillomavirus
MTYVAWDSVY

SEQ ID NO: 447 - protein, 11 aa, Artificial Sequence
  Peptide Derived from Human Papillomavirus
MTYVAWDSVYY

SEQ ID NO: 448 - protein, 8 aa, Artificial Sequence
  Peptide Derived from Human Papillomavirus
NSLKCLRY

SEQ ID NO: 449 - protein, 8 aa, Artificial Sequence
  Peptide Derived from Human Papillomavirus
NTEPTHCF

SEQ ID NO: 450 - protein, 9 aa, Artificial Sequence
  Peptide Derived from Human Papillomavirus
NTGTWEVHF

SEQ ID NO: 451 - protein, 10 aa, Artificial Sequence
  Peptide Derived from Human Papillomavirus
QIQYWQLIRW

SEQ ID NO: 452 - protein, 10 aa, Artificial Sequence
  Peptide Derived from Human Papillomavirus
QLIRWENAIF

SEQ ID NO: 453 - protein, 11 aa, Artificial Sequence
  Peptide Derived from Human Papillomavirus
QLIRWENAIFF

SEQ ID NO: 454 - protein, 9 aa, Artificial Sequence
  Peptide Derived from Human Papillomavirus
QLQHTPSPY

SEQ ID NO: 455 - protein, 9 aa, Artificial Sequence
  Peptide Derived from Human Papillomavirus
QSRYKTEDW

SEQ ID NO: 456 - protein, 11 aa, Artificial Sequence
  Peptide Derived from Human Papillomavirus
QTLNHQVVPAY

SEQ ID NO: 457 - protein, 9 aa, Artificial Sequence
  Peptide Derived from Human Papillomavirus
RLRKHSDHY

SEQ ID NO: 458 - protein, 11 aa, Artificial Sequence
  Peptide Derived from Human Papillomavirus
STVSVGTAKTY

SEQ ID NO: 459 - protein, 8 aa, Artificial Sequence
  Peptide Derived from Human Papillomavirus
SVGTAKTY

SEQ ID NO: 460 - protein, 8 aa, Artificial Sequence
  Peptide Derived from Human Papillomavirus
SVQILVGY

SEQ ID NO: 461 - protein, 11 aa, Artificial Sequence
  Peptide Derived from Human Papillomavirus
SVYYMTDAGTW

SEQ ID NO: 462 - protein, 10 aa, Artificial Sequence
  Peptide Derived from Human Papillomavirus
TLNHQVVPAY

SEQ ID NO: 463 - protein, 10 aa, Artificial Sequence
  Peptide Derived from Human Papillomavirus
TLQDTCEELW

SEQ ID NO: 464 - protein, 10 aa, Artificial Sequence
  Peptide Derived from Human Papillomavirus
TVSVGTAKTY

SEQ ID NO: 465 - protein, 8 aa, Artificial Sequence
  Peptide Derived from Human Papillomavirus
VSHRGLYY

SEQ ID NO: 466 - protein, 9 aa, Artificial Sequence
  Peptide Derived from Human Papillomavirus
VSVGTAKTY

SEQ ID NO: 467 - protein, 11 aa, Artificial Sequence
  Peptide Derived from Human Papillomavirus
WTLQDTCEELW

SEQ ID NO: 468 - protein, 11 aa, Artificial Sequence
  Peptide Derived from Human Papillomavirus
YIEFKSECEKY

SEQ ID NO: 469 - protein, 8 aa, Artificial Sequence
  Peptide Derived from Human Papillomavirus
YMTDAGTW

SEQ ID NO: 470 - protein, 8 aa, Artificial Sequence
  Peptide Derived from Human Papillomavirus
YVAWDSVY

SEQ ID NO: 471 - protein, 9 aa, Artificial Sequence
  Peptide Derived from Human Papillomavirus
YVAWDSVYY

SEQ ID NO: 472 - protein, 9 aa, Artificial Sequence
  Peptide Derived from Human Papillomavirus
YVKEGYNTF

SEQ ID NO: 473 - protein, 10 aa, Artificial Sequence
  Peptide Derived from Human Papillomavirus
YVKEGYNTFY

SEQ ID NO: 474 - protein, 9 aa, Artificial Sequence
  Peptide Derived from Human Papillomavirus
ATAFTVYVF

SEQ ID NO: 475 - protein, 11 aa, Artificial Sequence
  Peptide Derived from Human Papillomavirus
ATAFTVYVFCF

SEQ ID NO: 476 - protein, 11 aa, Artificial Sequence
  Peptide Derived from Human Papillomavirus
CMCAYAWVLVF

SEQ ID NO: 477 - protein, 10 aa, Artificial Sequence
  Peptide Derived from Human Papillomavirus
FLFCFCVCMY

SEQ ID NO: 478 - protein, 8 aa, Artificial Sequence
  Peptide Derived from Human Papillomavirus
FTVYVFCF

SEQ ID NO: 479 - protein, 8 aa, Artificial Sequence
  Peptide Derived from Human Papillomavirus
ITSPATAF

SEQ ID NO: 480 - protein, 11 aa, Artificial Sequence
  Peptide Derived from Human Papillomavirus
ITSPATAFTVY

SEQ ID NO: 481 - protein, 11 aa, Artificial Sequence
  Peptide Derived from Human Papillomavirus
IVVITSPATAF

SEQ ID NO: 482 - protein, 10 aa, Artificial Sequence
  Peptide Derived from Human Papillomavirus
LLPSVCMCAY

SEQ ID NO: 483 - protein, 9 aa, Artificial Sequence
  Peptide Derived from Human Papillomavirus
LSLIFLFCF

SEQ ID NO: 484 - protein, 8 aa, Artificial Sequence
  Peptide Derived from Human Papillomavirus
MLSLIFLF

SEQ ID NO: 485 - protein, 10 aa, Artificial Sequence
  Peptide Derived from Human Papillomavirus
MLSLIFLFCF

SEQ ID NO: 486 - protein, 11 aa, Artificial Sequence
  Peptide Derived from Human Papillomavirus
PLLPSVCMCAY

SEQ ID NO: 487 - protein, 8 aa, Artificial Sequence
  Peptide Derived from Human Papillomavirus
PSVCMCAY

SEQ ID NO: 488 - protein, 10 aa, Artificial Sequence
  Peptide Derived from Human Papillomavirus
PSVCMCAYAW

SEQ ID NO: 489 - protein, 8 aa, Artificial Sequence
  Peptide Derived from Human Papillomavirus
SLIFLFCF

SEQ ID NO: 490 - protein, 9 aa, Artificial Sequence
  Peptide Derived from Human Papillomavirus
SVCMCAYAW

SEQ ID NO: 491 - protein, 10 aa, Artificial Sequence
  Peptide Derived from Human Papillomavirus
TSPATAFTVY

SEQ ID NO: 492 - protein, 9 aa, Artificial Sequence
  Peptide Derived from Human Papillomavirus
VITSPATAF

SEQ ID NO: 493 - protein, 10 aa, Artificial Sequence
  Peptide Derived from Human Papillomavirus
VVITSPATAF

SEQ ID NO: 494 - protein, 8 aa, Artificial Sequence
  Peptide Derived from Human Papillomavirus
DIEITCVY

SEQ ID NO: 495 - protein, 10 aa, Artificial Sequence
  Peptide Derived from Human Papillomavirus
ELRHYSDSVY

SEQ ID NO: 496 - protein, 8 aa, Artificial Sequence
  Peptide Derived from Human Papillomavirus
ELTEVFEF

SEQ ID NO: 497 - protein, 10 aa, Artificial Sequence
  Peptide Derived from Human Papillomavirus
ELTEVFEFAF

SEQ ID NO: 498 - protein, 11 aa, Artificial Sequence
  Peptide Derived from Human Papillomavirus
EVFEFAFKDLF

SEQ ID NO: 499 - protein, 8 aa, Artificial Sequence
  Peptide Derived from Human Papillomavirus
HLNEKRRF

SEQ ID NO: 500 - protein, 11 aa, Artificial Sequence
  Peptide Derived from Human Papillomavirus
KLRHLNEKRRF

SEQ ID NO: 501 - protein, 8 aa, Artificial Sequence
  Peptide Derived from Human Papillomavirus
KLTNTGLY

SEQ ID NO: 502 - protein, 10 aa, Artificial Sequence
  Peptide Derived from Human Papillomavirus
KTVLELTEVF

SEQ ID NO: 503 - protein, 9 aa, Artificial Sequence
  Peptide Derived from Human Papillomavirus
LTEVFEFAF

SEQ ID NO: 504 - protein, 8 aa, Artificial Sequence
  Peptide Derived from Human Papillomavirus
RIRELRHY

SEQ ID NO: 505 - protein, 11 aa, Artificial Sequence
  Peptide Derived from Human Papillomavirus
SLQDIEITCVY

SEQ ID NO: 506 - protein, 11 aa, Artificial Sequence
  Peptide Derived from Human Papillomavirus
TLEKLTNTGLY

SEQ ID NO: 507 - protein, 9 aa, Artificial Sequence
  Peptide Derived from Human Papillomavirus
TVLELTEVF

SEQ ID NO: 508 - protein, 11 aa, Artificial Sequence
  Peptide Derived from Human Papillomavirus
TVLELTEVFEF

SEQ ID NO: 509 - protein, 8 aa, Artificial Sequence
  Peptide Derived from Human Papillomavirus
VLELTEVF

SEQ ID NO: 510 - protein, 10 aa, Artificial Sequence
  Peptide Derived from Human Papillomavirus
VLELTEVFEF

SEQ ID NO: 511 - protein, 10 aa, Artificial Sequence
  Peptide Derived from Human Papillomavirus
YSRIRELRHY

SEQ ID NO: 512 - protein, 9 aa, Artificial Sequence
  Peptide Derived from Human Papillomavirus
DLRAFQQLF

SEQ ID NO: 513 - protein, 10 aa, Artificial Sequence
  Peptide Derived from Human Papillomavirus
ESSADDLRAF

SEQ ID NO: 514 - protein, 11 aa, Artificial Sequence
  Peptide Derived from Human Papillomavirus
FLNTLSFVCPW

SEQ ID NO: 515 - protein, 9 aa, Artificial Sequence
  Peptide Derived from Human Papillomavirus
NTLSFVCPW

SEQ ID NO: 516 - protein, 9 aa, Artificial Sequence
  Peptide Derived from Human Papillomavirus
QLFLNTLSF

SEQ ID NO: 517 - protein, 9 aa, Artificial Sequence
  Peptide Derived from Human Papillomavirus
SSADDLRAF

SEQ ID NO: 518 - protein, 8 aa, Artificial Sequence
  Peptide Derived from Human Papillomavirus
TLSFVCPW

SEQ ID NO: 519 - protein, 11 aa, Artificial Sequence
  Peptide Derived from Human Papillomavirus
ALWRPSDNTVY

SEQ ID NO: 520 - protein, 8 aa, Artificial Sequence
  Peptide Derived from Human Papillomavirus
ASPGSCVY

SEQ ID NO: 521 - protein, 11 aa, Artificial Sequence
  Peptide Derived from Human Papillomavirus
ASTQSPVPGQY

SEQ ID NO: 522 - protein, 8 aa, Artificial Sequence
  Peptide Derived from Human Papillomavirus
CLRREQLF

SEQ ID NO: 523 - protein, 11 aa, Artificial Sequence
  Peptide Derived from Human Papillomavirus
CLYTRVLILHY

SEQ ID NO: 524 - protein, 9 aa, Artificial Sequence
  Peptide Derived from Human Papillomavirus
DICQSICKY

SEQ ID NO: 525 - protein, 8 aa, Artificial Sequence
  Peptide Derived from Human Papillomavirus
DIPKVSAY

SEQ ID NO: 526 - protein, 10 aa, Artificial Sequence
  Peptide Derived from Human Papillomavirus
DIPKVSAYQY

SEQ ID NO: 527 - protein, 11 aa, Artificial Sequence
  Peptide Derived from Human Papillomavirus
DLDQYPLGRKF

SEQ ID NO: 528 - protein, 9 aa, Artificial Sequence
  Peptide Derived from Human Papillomavirus
DSQLFNKPY

SEQ ID NO: 529 - protein, 10 aa, Artificial Sequence
  Peptide Derived from Human Papillomavirus
DSQLFNKPYW

SEQ ID NO: 530 - protein, 9 aa, Artificial Sequence
  Peptide Derived from Human Papillomavirus
DTGYGAMDF

SEQ ID NO: 531 - protein, 8 aa, Artificial Sequence
  Peptide Derived from Human Papillomavirus
DTVPQSLY

SEQ ID NO: 532 - protein, 10 aa, Artificial Sequence
  Peptide Derived from Human Papillomavirus
DVRDNVSVDY

SEQ ID NO: 533 - protein, 8 aa, Artificial Sequence
  Peptide Derived from Human Papillomavirus
FLRNVNVF

SEQ ID NO: 534 - protein, 11 aa, Artificial Sequence
  Peptide Derived from Human Papillomavirus
FLRNVNVFPIF

SEQ ID NO: 535 - protein, 8 aa, Artificial Sequence
  Peptide Derived from Human Papillomavirus
FSLDLDQY

SEQ ID NO: 536 - protein, 8 aa, Artificial Sequence
  Peptide Derived from Human Papillomavirus
GLPDTSIY

SEQ ID NO: 537 - protein, 8 aa, Artificial Sequence
  Peptide Derived from Human Papillomavirus
GLSGHPFY

SEQ ID NO: 538 - protein, 11 aa, Artificial Sequence
  Peptide Derived from Human Papillomavirus
GMPASPGSCVY

SEQ ID NO: 539 - protein, 11 aa, Artificial Sequence
  Peptide Derived from Human Papillomavirus
GSIVTSDSQLF

SEQ ID NO: 540 - protein, 9 aa, Artificial Sequence
  Peptide Derived from Human Papillomavirus
GVCWHNQLF

SEQ ID NO: 541 - protein, 9 aa, Artificial Sequence
  Peptide Derived from Human Papillomavirus
GVGLSGHPF

SEQ ID NO: 542 - protein, 10 aa, Artificial Sequence
  Peptide Derived from Human Papillomavirus
GVGLSGHPFY

SEQ ID NO: 543 - protein, 8 aa, Artificial Sequence
  Peptide Derived from Human Papillomavirus
HIIICGHY

SEQ ID NO: 544 - protein, 10 aa, Artificial Sequence
  Peptide Derived from Human Papillomavirus
HLLPLYGPLY

SEQ ID NO: 545 - protein, 11 aa, Artificial Sequence
  Peptide Derived from Human Papillomavirus
HSMNSSILEDW

SEQ ID NO: 546 - protein, 9 aa, Artificial Sequence
  Peptide Derived from Human Papillomavirus
HVEEYDLQF

SEQ ID NO: 547 - protein, 11 aa, Artificial Sequence
  Peptide Derived from Human Papillomavirus
HVEEYDLQFIF

SEQ ID NO: 548 - protein, 10 aa, Artificial Sequence
  Peptide Derived from Human Papillomavirus
IICGHYIILF

SEQ ID NO: 549 - protein, 11 aa, Artificial Sequence
  Peptide Derived from Human Papillomavirus
IIICGHYIILF

SEQ ID NO: 550 - protein, 11 aa, Artificial Sequence
  Peptide Derived from Human Papillomavirus
IILFLRNVNVF

SEQ ID NO: 551 - protein, 10 aa, Artificial Sequence
  Peptide Derived from Human Papillomavirus
ILFLRNVNVF

SEQ ID NO: 552 - protein, 10 aa, Artificial Sequence
  Peptide Derived from Human Papillomavirus
ILHYHLLPLY

SEQ ID NO: 553 - protein, 10 aa, Artificial Sequence
  Peptide Derived from Human Papillomavirus
ITLTADVMSY

SEQ ID NO: 554 - protein, 9 aa, Artificial Sequence
  Peptide Derived from Human Papillomavirus
IVTSDSQLF

SEQ ID NO: 555 - protein, 10 aa, Artificial Sequence
  Peptide Derived from Human Papillomavirus
KVSAYQYRVF

SEQ ID NO: 556 - protein, 11 aa, Artificial Sequence
  Peptide Derived from Human Papillomavirus
LILHYHLLPLY

SEQ ID NO: 557 - protein, 9 aa, Artificial Sequence
  Peptide Derived from Human Papillomavirus
LLPLYGPLY

SEQ ID NO: 558 - protein, 8 aa, Artificial Sequence
  Peptide Derived from Human Papillomavirus
LLTVGNPY

SEQ ID NO: 559 - protein, 9 aa, Artificial Sequence
  Peptide Derived from Human Papillomavirus
LLTVGNPYF

SEQ ID NO: 560 - protein, 8 aa, Artificial Sequence
  Peptide Derived from Human Papillomavirus
LTADVMSY

SEQ ID NO: 561 - protein, 8 aa, Artificial Sequence
  Peptide Derived from Human Papillomavirus
LTVGNPYF

SEQ ID NO: 562 - protein, 11 aa, Artificial Sequence
  Peptide Derived from Human Papillomavirus
MSADPYGDSMF

SEQ ID NO: 563 - protein, 11 aa, Artificial Sequence
  Peptide Derived from Human Papillomavirus
MVDTGYGAMDF

SEQ ID NO: 564 - protein, 10 aa, Artificial Sequence
  Peptide Derived from Human Papillomavirus
MVHIIICGHY

SEQ ID NO: 565 - protein, 8 aa, Artificial Sequence
  Peptide Derived from Human Papillomavirus
NSSILEDW

SEQ ID NO: 566 - protein, 10 aa, Artificial Sequence
  Peptide Derived from Human Papillomavirus
NSSILEDWNF

SEQ ID NO: 567 - protein, 8 aa, Artificial Sequence
  Peptide Derived from Human Papillomavirus
NVDLKEKF

SEQ ID NO: 568 - protein, 8 aa, Artificial Sequence
  Peptide Derived from Human Papillomavirus
NVNVFPIF

SEQ ID NO: 569 - protein, 9 aa, Artificial Sequence
  Peptide Derived from Human Papillomavirus
PIFLQMALW

SEQ ID NO: 570 - protein, 11 aa, Artificial Sequence
  Peptide Derived from Human Papillomavirus
PLDICQSICKY

SEQ ID NO: 571 - protein, 11 aa, Artificial Sequence
  Peptide Derived from Human Papillomavirus
PLGVGLSGHPF

SEQ ID NO: 572 - protein, 8 aa, Artificial Sequence
  Peptide Derived from Human Papillomavirus
PLHSILVY

SEQ ID NO: 573 - protein, 10 aa, Artificial Sequence
  Peptide Derived from Human Papillomavirus
PLPLHSILVY

SEQ ID NO: 574 - protein, 9 aa, Artificial Sequence
  Peptide Derived from Human Papillomavirus
PTTSLVDTY

SEQ ID NO: 575 - protein, 11 aa, Artificial Sequence
  Peptide Derived from Human Papillomavirus
PTTSLVDTYRF

SEQ ID NO: 576 - protein, 11 aa, Artificial Sequence
  Peptide Derived from Human Papillomavirus
PVPGQYDATKF

SEQ ID NO: 577 - protein, 8 aa, Artificial Sequence
  Peptide Derived from Human Papillomavirus
QLFARHFW

SEQ ID NO: 578 - protein, 8 aa, Artificial Sequence
  Peptide Derived from Human Papillomavirus
QLFNKPYW

SEQ ID NO: 579 - protein, 8 aa, Artificial Sequence
  Peptide Derived from Human Papillomavirus
QLPDPNKF

SEQ ID NO: 580 - protein, 9 aa, Artificial Sequence
  Peptide Derived from Human Papillomavirus
QSICKYPDY

SEQ ID NO: 581 - protein, 8 aa, Artificial Sequence
  Peptide Derived from Human Papillomavirus
QSPVPGQY

SEQ ID NO: 582 - protein, 9 aa, Artificial Sequence
  Peptide Derived from Human Papillomavirus
RLLTVGNPY

SEQ ID NO: 583 - protein, 10 aa, Artificial Sequence
  Peptide Derived from Human Papillomavirus
RLLTVGNPYF

SEQ ID NO: 584 - protein, 10 aa, Artificial Sequence
  Peptide Derived from Human Papillomavirus
RVQLPDPNKF

SEQ ID NO: 585 - protein, 8 aa, Artificial Sequence
  Peptide Derived from Human Papillomavirus
RVVNTDDY

SEQ ID NO: 586 - protein, 8 aa, Artificial Sequence
  Peptide Derived from Human Papillomavirus
SICKYPDY

SEQ ID NO: 587 - protein, 8 aa, Artificial Sequence
  Peptide Derived from Human Papillomavirus
SILEDWNF

SEQ ID NO: 588 - protein, 10 aa, Artificial Sequence
  Peptide Derived from Human Papillomavirus
SIVTSDSQLF

SEQ ID NO: 589 - protein, 8 aa, Artificial Sequence
  Peptide Derived from Human Papillomavirus
SLVDTYRF

SEQ ID NO: 590 - protein, 10 aa, Artificial Sequence
  Peptide Derived from Human Papillomavirus
SMNSSILEDW

SEQ ID NO: 591 - protein, 9 aa, Artificial Sequence
  Peptide Derived from Human Papillomavirus
SSILEDWNF

SEQ ID NO: 592 - protein, 11 aa, Artificial Sequence
  Peptide Derived from Human Papillomavirus
SSRLLTVGNPY

SEQ ID NO: 593 - protein, 10 aa, Artificial Sequence
  Peptide Derived from Human Papillomavirus
STQSPVPGQY

SEQ ID NO: 594 - protein, 11 aa, Artificial Sequence
  Peptide Derived from Human Papillomavirus
SVARVVNTDDY

SEQ ID NO: 595 - protein, 11 aa, Artificial Sequence
  Peptide Derived from Human Papillomavirus
TITLTADVMSY

SEQ ID NO: 596 - protein, 9 aa, Artificial Sequence
  Peptide Derived from Human Papillomavirus
TLTADVMSY

SEQ ID NO: 597 - protein, 11 aa, Artificial Sequence
  Peptide Derived from Human Papillomavirus
TMGDTVPQSLY

SEQ ID NO: 598 - protein, 11 aa, Artificial Sequence
  Peptide Derived from Human Papillomavirus
TSDSQLFNKPY

SEQ ID NO: 599 - protein, 9 aa, Artificial Sequence
  Peptide Derived from Human Papillomavirus
TSLVDTYRF

SEQ ID NO: 600 - protein, 8 aa, Artificial Sequence
  Peptide Derived from Human Papillomavirus
TTSLVDTY

SEQ ID NO: 601 - protein, 10 aa, Artificial Sequence
  Peptide Derived from Human Papillomavirus
TTSLVDTYRF

SEQ ID NO: 602 - protein, 9 aa, Artificial Sequence
  Peptide Derived from Human Papillomavirus
VSAYQYRVF

SEQ ID NO: 603 - protein, 8 aa, Artificial Sequence
  Peptide Derived from Human Papillomavirus
VTPTSIFY

SEQ ID NO: 604 - protein, 8 aa, Artificial Sequence
  Peptide Derived from Human Papillomavirus
VTSDSQLF

SEQ ID NO: 605 - protein, 9 aa, Artificial Sequence
  Peptide Derived from Human Papillomavirus
YLQMSADPY

SEQ ID NO: 606 - protein, 11 aa, Artificial Sequence
  Peptide Derived from Human Papillomavirus
YMVHIIICGHY

SEQ ID NO: 607 - protein, 8 aa, Artificial Sequence
  Peptide Derived from Human Papillomavirus
YSRHVEEY

SEQ ID NO: 608 - protein, 9 aa, Artificial Sequence
  Peptide Derived from Human Papillomavirus
YTRVLILHY

SEQ ID NO: 609 - protein, 8 aa, Artificial Sequence
  Peptide Derived from Human Papillomavirus
YVTPTSIF

SEQ ID NO: 610 - protein, 9 aa, Artificial Sequence
  Peptide Derived from Human Papillomavirus
YVTPTSIFY

SEQ ID NO: 611 - protein, 11 aa, Artificial Sequence
  Peptide Derived from Human Papillomavirus
ALTSRRGTVRF

SEQ ID NO: 612 - protein, 8 aa, Artificial Sequence
  Peptide Derived from Human Papillomavirus
ATEDNDLF

SEQ ID NO: 613 - protein, 11 aa, Artificial Sequence
  Peptide Derived from Human Papillomavirus
ATEDNDLFDIY

SEQ ID NO: 614 - protein, 11 aa, Artificial Sequence
  Peptide Derived from Human Papillomavirus
DISPIAPSPEY

SEQ ID NO: 615 - protein, 11 aa, Artificial Sequence
  Peptide Derived from Human Papillomavirus
DITLPSTTSVW

SEQ ID NO: 616 - protein, 11 aa, Artificial Sequence
  Peptide Derived from Human Papillomavirus
FIPKKRKRVPY

SEQ ID NO: 617 - protein, 11 aa, Artificial Sequence
  Peptide Derived from Human Papillomavirus
FLTRPSSLITY

SEQ ID NO: 618 - protein, 11 aa, Artificial Sequence
  Peptide Derived from Human Papillomavirus
FSRLGQRATMF

SEQ ID NO: 619 - protein, 8 aa, Artificial Sequence
  Peptide Derived from Human Papillomavirus
GIHGTHYY

SEQ ID NO: 620 - protein, 10 aa, Artificial Sequence
  Peptide Derived from Human Papillomavirus
GIHGTHYYLW

SEQ ID NO: 621 - protein, 10 aa, Artificial Sequence
  Peptide Derived from Human Papillomavirus
GSGTGGRTGY

SEQ ID NO: 622 - protein, 8 aa, Artificial Sequence
  Peptide Derived from Human Papillomavirus
GTGGRTGY

SEQ ID NO: 623 - protein, 10 aa, Artificial Sequence
  Peptide Derived from Human Papillomavirus
GTHYYLWPLY

SEQ ID NO: 624 - protein, 11 aa, Artificial Sequence
  Peptide Derived from Human Papillomavirus
GTHYYLWPLYY

SEQ ID NO: 625 - protein, 10 aa, Artificial Sequence
  Peptide Derived from Human Papillomavirus
GTPTSGTHGY

SEQ ID NO: 626 - protein, 10 aa, Artificial Sequence
  Peptide Derived from Human Papillomavirus
GTQIGARVHF

SEQ ID NO: 627 - protein, 11 aa, Artificial Sequence
  Peptide Derived from Human Papillomavirus
GTQIGARVHFY

SEQ ID NO: 628 - protein, 11 aa, Artificial Sequence
  Peptide Derived from Human Papillomavirus
GTTLADKILQW

SEQ ID NO: 629 - protein, 10 aa, Artificial Sequence
  Peptide Derived from Human Papillomavirus
ILQWSSLGIF

SEQ ID NO: 630 - protein, 10 aa, Artificial Sequence
  Peptide Derived from Human Papillomavirus
ISPIAPSPEY

SEQ ID NO: 631 - protein, 11 aa, Artificial Sequence
  Peptide Derived from Human Papillomavirus
ISTTNFTNPAF

SEQ ID NO: 632 - protein, 10 aa, Artificial Sequence
  Peptide Derived from Human Papillomavirus
ITLPSTTSVW

SEQ ID NO: 633 - protein, 8 aa, Artificial Sequence
  Peptide Derived from Human Papillomavirus
ITYDNPAF

SEQ ID NO: 634 - protein, 11 aa, Artificial Sequence
  Peptide Derived from Human Papillomavirus
KILQWSSLGIF

SEQ ID NO: 635 - protein, 9 aa, Artificial Sequence
  Peptide Derived from Human Papillomavirus
LITYDNPAF

SEQ ID NO: 636 - protein, 10 aa, Artificial Sequence
  Peptide Derived from Human Papillomavirus
LTRPSSLITY

SEQ ID NO: 637 - protein, 10 aa, Artificial Sequence
  Peptide Derived from Human Papillomavirus
LTSRRGTVRF

SEQ ID NO: 638 - protein, 10 aa, Artificial Sequence
  Peptide Derived from Human Papillomavirus
LTSSWDVPVY

SEQ ID NO: 639 - protein, 11 aa, Artificial Sequence
  Peptide Derived from Human Papillomavirus
LVSATEDNDLF

SEQ ID NO: 640 - protein, 10 aa, Artificial Sequence
  Peptide Derived from Human Papillomavirus
NVTVPLTSSW

SEQ ID NO: 641 - protein, 8 aa, Artificial Sequence
  Peptide Derived from Human Papillomavirus
PIAPSPEY

SEQ ID NO: 642 - protein, 11 aa, Artificial Sequence
  Peptide Derived from Human Papillomavirus
PLTSSWDVPVY

SEQ ID NO: 643 - protein, 8 aa, Artificial Sequence
  Peptide Derived from Human Papillomavirus
PSRSTTSF

SEQ ID NO: 644 - protein, 10 aa, Artificial Sequence
  Peptide Derived from Human Papillomavirus
PSRSTTSFAF

SEQ ID NO: 645 - protein, 11 aa, Artificial Sequence
  Peptide Derived from Human Papillomavirus
PSRSTTSFAFF

SEQ ID NO: 646 - protein, 9 aa, Artificial Sequence
  Peptide Derived from Human Papillomavirus
PTAPASTQY

SEQ ID NO: 647 - protein, 9 aa, Artificial Sequence
  Peptide Derived from Human Papillomavirus
PTFTGTSGF

SEQ ID NO: 648 - protein, 9 aa, Artificial Sequence
  Peptide Derived from Human Papillomavirus
PTISSASSY

SEQ ID NO: 649 - protein, 8 aa, Artificial Sequence
  Peptide Derived from Human Papillomavirus
PTSGTHGY

SEQ ID NO: 650 - protein, 8 aa, Artificial Sequence
  Peptide Derived from Human Papillomavirus
PVDTTLTF

SEQ ID NO: 651 - protein, 10 aa, Artificial Sequence
  Peptide Derived from Human Papillomavirus
PVPSRSTTSF

SEQ ID NO: 652 - protein, 8 aa, Artificial Sequence
  Peptide Derived from Human Papillomavirus
QIGARVHF

SEQ ID NO: 653 - protein, 9 aa, Artificial Sequence
  Peptide Derived from Human Papillomavirus
QIGARVHFY

SEQ ID NO: 654 - protein, 10 aa, Artificial Sequence
  Peptide Derived from Human Papillomavirus
QTGEVAGNVF

SEQ ID NO: 655 - protein, 9 aa, Artificial Sequence
  Peptide Derived from Human Papillomavirus
QVSVANPEF

SEQ ID NO: 656 - protein, 9 aa, Artificial Sequence
  Peptide Derived from Human Papillomavirus
RLGQRATMF

SEQ ID NO: 657 - protein, 9 aa, Artificial Sequence
  Peptide Derived from Human Papillomavirus
RSDVPDSDF

SEQ ID NO: 658 - protein, 8 aa, Artificial Sequence
  Peptide Derived from Human Papillomavirus
RSTTSFAF

SEQ ID NO: 659 - protein, 9 aa, Artificial Sequence
  Peptide Derived from Human Papillomavirus
RSTTSFAFF

SEQ ID NO: 660 - protein, 11 aa, Artificial Sequence
  Peptide Derived from Human Papillomavirus
RSTTSFAFFKY

SEQ ID NO: 661 - protein, 8 aa, Artificial Sequence
  Peptide Derived from Human Papillomavirus
RVAGPRLY

SEQ ID NO: 662 - protein, 10 aa, Artificial Sequence
  Peptide Derived from Human Papillomavirus
RVPYFFADGF

SEQ ID NO: 663 - protein, 10 aa, Artificial Sequence
  Peptide Derived from Human Papillomavirus
SLITYDNPAF

SEQ ID NO: 664 - protein, 11 aa, Artificial Sequence
  Peptide Derived from Human Papillomavirus
SSLITYDNPAF

SEQ ID NO: 665 - protein, 8 aa, Artificial Sequence
  Peptide Derived from Human Papillomavirus
SSWDVPVY

SEQ ID NO: 666 - protein, 11 aa, Artificial Sequence
  Peptide Derived from Human Papillomavirus
STSVSISTTNF

SEQ ID NO: 667 - protein, 10 aa, Artificial Sequence
  Peptide Derived from Human Papillomavirus
STTNFTNPAF

SEQ ID NO: 668 - protein, 8 aa, Artificial Sequence
  Peptide Derived from Human Papillomavirus
STTSFAFF

SEQ ID NO: 669 - protein, 10 aa, Artificial Sequence
  Peptide Derived from Human Papillomavirus
STTSFAFFKY

SEQ ID NO: 670 - protein, 9 aa, Artificial Sequence
  Peptide Derived from Human Papillomavirus
SVSISTTNF

SEQ ID NO: 671 - protein, 8 aa, Artificial Sequence
  Peptide Derived from Human Papillomavirus
TISSASSY

SEQ ID NO: 672 - protein, 9 aa, Artificial Sequence
  Peptide Derived from Human Papillomavirus
TLADKILQW

SEQ ID NO: 673 - protein, 9 aa, Artificial Sequence
  Peptide Derived from Human Papillomavirus
TLPSTTSVW

SEQ ID NO: 674 - protein, 8 aa, Artificial Sequence
  Peptide Derived from Human Papillomavirus
TSFAFFKY

SEQ ID NO: 675 - protein, 9 aa, Artificial Sequence
  Peptide Derived from Human Papillomavirus
TSGAPRPTF

SEQ ID NO: 676 - protein, 9 aa, Artificial Sequence
  Peptide Derived from Human Papillomavirus
TSRRGTVRF

SEQ ID NO: 677 - protein, 9 aa, Artificial Sequence
  Peptide Derived from Human Papillomavirus
TSSWDVPVY

SEQ ID NO: 678 - protein, 10 aa, Artificial Sequence
  Peptide Derived from Human Papillomavirus
TSVSISTTNF

SEQ ID NO: 679 - protein, 10 aa, Artificial Sequence
  Peptide Derived from Human Papillomavirus
TTLADKILQW

SEQ ID NO: 680 - protein, 9 aa, Artificial Sequence
  Peptide Derived from Human Papillomavirus
TTNFTNPAF

SEQ ID NO: 681 - protein, 9 aa, Artificial Sequence
  Peptide Derived from Human Papillomavirus
TTSFAFFKY

SEQ ID NO: 682 - protein, 8 aa, Artificial Sequence
  Peptide Derived from Human Papillomavirus
TVPLTSSW

SEQ ID NO: 683 - protein, 11 aa, Artificial Sequence
  Peptide Derived from Human Papillomavirus
TVRRVAGPRLY

SEQ ID NO: 684 - protein, 10 aa, Artificial Sequence
  Peptide Derived from Human Papillomavirus
VSATEDNDLF

SEQ ID NO: 685 - protein, 8 aa, Artificial Sequence
  Peptide Derived from Human Papillomavirus
VSISTTNF

SEQ ID NO: 686 - protein, 11 aa, Artificial Sequence
  Peptide Derived from Human Papillomavirus
VSPTAPASTQY

SEQ ID NO: 687 - protein, 8 aa, Artificial Sequence
  Peptide Derived from Human Papillomavirus
VSVANPEF

SEQ ID NO: 688 - protein, 10 aa, Artificial Sequence
  Peptide Derived from Human Papillomavirus
VTSGAPRPTF

SEQ ID NO: 689 - protein, 9 aa, Artificial Sequence
  Peptide Derived from Human Papillomavirus
VTVPLTSSW

SEQ ID NO: 690 - protein, 11 aa, Artificial Sequence
  Peptide Derived from Human Papillomavirus
VVTSGAPRPTF

SEQ ID NO: 691 - protein, 9 aa, Artificial Sequence
  Peptide Derived from Human Papillomavirus
YIGIHGTHY

SEQ ID NO: 692 - protein, 10 aa, Artificial Sequence
  Peptide Derived from Human Papillomavirus
YIGIHGTHYY

SEQ ID NO: 693 - protein, 8 aa, Artificial Sequence
  Peptide Derived from Human Papillomavirus
YLWPLYYF

SEQ ID NO: 694 - protein, 11 aa, Artificial Sequence
  Peptide Derived from Human Papillomavirus
YSPTISSASSY

SEQ ID NO: 695 - protein, 10 aa, Artificial Sequence
  Peptide Derived from Human Papillomavirus
AMLGKFKELY

SEQ ID NO: 696 - protein, 8 aa, Artificial Sequence
  Peptide Derived from Human Papillomavirus
ATTPCWHY

SEQ ID NO: 697 - protein, 9 aa, Artificial Sequence
  Peptide Derived from Human Papillomavirus
AVQVLKRKY

SEQ ID NO: 698 - protein, 9 aa, Artificial Sequence
  Peptide Derived from Human Papillomavirus
CTDWCVAAF

SEQ ID NO: 699 - protein, 8 aa, Artificial Sequence
  Peptide Derived from Human Papillomavirus
DISSCVDY

SEQ ID NO: 700 - protein, 8 aa, Artificial Sequence
  Peptide Derived from Human Papillomavirus
DIVKFLRY

SEQ ID NO: 701 - protein, 8 aa, Artificial Sequence
  Peptide Derived from Human Papillomavirus
DLSQMVQW

SEQ ID NO: 702 - protein, 10 aa, Artificial Sequence
  Peptide Derived from Human Papillomavirus
DLSQMVQWAY

SEQ ID NO: 703 - protein, 9 aa, Artificial Sequence
  Peptide Derived from Human Papillomavirus
DSDSNACAF

SEQ ID NO: 704 - protein, 8 aa, Artificial Sequence
  Peptide Derived from Human Papillomavirus
DSEIAYKY

SEQ ID NO: 705 - protein, 9 aa, Artificial Sequence
  Peptide Derived from Human Papillomavirus
DTGEDMVDF

SEQ ID NO: 706 - protein, 10 aa, Artificial Sequence
  Peptide Derived from Human Papillomavirus
DVMDDSEIAY

SEQ ID NO: 707 - protein, 9 aa, Artificial Sequence
  Peptide Derived from Human Papillomavirus
DVYGETPEW

SEQ ID NO: 708 - protein, 10 aa, Artificial Sequence
  Peptide Derived from Human Papillomavirus
ELSDKNWKSF

SEQ ID NO: 709 - protein, 11 aa, Artificial Sequence
  Peptide Derived from Human Papillomavirus
ELSDKNWKSFF

SEQ ID NO: 710 - protein, 8 aa, Artificial Sequence
  Peptide Derived from Human Papillomavirus
FIDNCNVY

SEQ ID NO: 711 - protein, 9 aa, Artificial Sequence
  Peptide Derived from Human Papillomavirus
FLQGCIISY

SEQ ID NO: 712 - protein, 9 aa, Artificial Sequence
  Peptide Derived from Human Papillomavirus
FLRYQQIEF

SEQ ID NO: 713 - protein, 8 aa, Artificial Sequence
  Peptide Derived from Human Papillomavirus
FLSALKLF

SEQ ID NO: 714 - protein, 8 aa, Artificial Sequence
  Peptide Derived from Human Papillomavirus
FMELIRPF

SEQ ID NO: 715 - protein, 9 aa, Artificial Sequence
  Peptide Derived from Human Papillomavirus
FTFPNPFPF

SEQ ID NO: 716 - protein, 11 aa, Artificial Sequence
  Peptide Derived from Human Papillomavirus
FVSFLSALKLF

SEQ ID NO: 717 - protein, 11 aa, Artificial Sequence
  Peptide Derived from Human Papillomavirus
GMLDDATTPCW

SEQ ID NO: 718 - protein, 9 aa, Artificial Sequence
  Peptide Derived from Human Papillomavirus
GMSNISDVY

SEQ ID NO: 719 - protein, 10 aa, Artificial Sequence
  Peptide Derived from Human Papillomavirus
GMVMLMLVRF

SEQ ID NO: 720 - protein, 8 aa, Artificial Sequence
  Peptide Derived from Human Papillomavirus
GTGCNGWF

SEQ ID NO: 721 - protein, 9 aa, Artificial Sequence
  Peptide Derived from Human Papillomavirus
GTGCNGWFY

SEQ ID NO: 722 - protein, 11 aa, Artificial Sequence
  Peptide Derived from Human Papillomavirus
GVSFMELIRPF

SEQ ID NO: 723 - protein, 10 aa, Artificial Sequence
  Peptide Derived from Human Papillomavirus
GVTGTVAEGF

SEQ ID NO: 724 - protein, 9 aa, Artificial Sequence
  Peptide Derived from Human Papillomavirus
HLQSLACSW

SEQ ID NO: 725 - protein, 8 aa, Artificial Sequence
  Peptide Derived from Human Papillomavirus
HSFNDTTF

SEQ ID NO: 726 - protein, 9 aa, Artificial Sequence
  Peptide Derived from Human Papillomavirus
HSRLVVFTF

SEQ ID NO: 727 - protein, 11 aa, Artificial Sequence
  Peptide Derived from Human Papillomavirus
IISYANSKSHF

SEQ ID NO: 728 - protein, 11 aa, Artificial Sequence
  Peptide Derived from Human Papillomavirus
ISDVYGETPEW

SEQ ID NO: 729 - protein, 11 aa, Artificial Sequence
  Peptide Derived from Human Papillomavirus
ISFLQGCIISY

SEQ ID NO: 730 - protein, 10 aa, Artificial Sequence
  Peptide Derived from Human Papillomavirus
ISYANSKSHF

SEQ ID NO: 731 - protein, 11 aa, Artificial Sequence
  Peptide Derived from Human Papillomavirus
ISYANSKSHFW

SEQ ID NO: 732 - protein, 10 aa, Artificial Sequence
  Peptide Derived from Human Papillomavirus
KLRSTAAALY

SEQ ID NO: 733 - protein, 11 aa, Artificial Sequence
  Peptide Derived from Human Papillomavirus
KLRSTAAALYW

SEQ ID NO: 734 - protein, 8 aa, Artificial Sequence
  Peptide Derived from Human Papillomavirus
KSFFSRTW

SEQ ID NO: 735 - protein, 11 aa, Artificial Sequence
  Peptide Derived from Human Papillomavirus
KSYFGMSLISF

SEQ ID NO: 736 - protein, 8 aa, Artificial Sequence
  Peptide Derived from Human Papillomavirus
KTAKRRLF

SEQ ID NO: 737 - protein, 10 aa, Artificial Sequence
  Peptide Derived from Human Papillomavirus
KTLLQPYCLY

SEQ ID NO: 738 - protein, 8 aa, Artificial Sequence
  Peptide Derived from Human Papillomavirus
KVSDEGDW

SEQ ID NO: 739 - protein, 8 aa, Artificial Sequence
  Peptide Derived from Human Papillomavirus
LLQPYCLY

SEQ ID NO: 740 - protein, 10 aa, Artificial Sequence
  Peptide Derived from Human Papillomavirus
LSDISSCVDY

SEQ ID NO: 741 - protein, 9 aa, Artificial Sequence
  Peptide Derived from Human Papillomavirus
LSDKNWKSF

SEQ ID NO: 742 - protein, 10 aa, Artificial Sequence
  Peptide Derived from Human Papillomavirus
LSDKNWKSFF

SEQ ID NO: 743 - protein, 9 aa, Artificial Sequence
  Peptide Derived from Human Papillomavirus
LSQMVQWAY

SEQ ID NO: 744 - protein, 10 aa, Artificial Sequence
  Peptide Derived from Human Papillomavirus
LVVFTFPNPF

SEQ ID NO: 745 - protein, 10 aa, Artificial Sequence
  Peptide Derived from Human Papillomavirus
MLDDATTPCW

SEQ ID NO: 746 - protein, 9 aa, Artificial Sequence
  Peptide Derived from Human Papillomavirus
MLGKFKELY

SEQ ID NO: 747 - protein, 8 aa, Artificial Sequence
  Peptide Derived from Human Papillomavirus
MSNISDVY

SEQ ID NO: 748 - protein, 11 aa, Artificial Sequence
  Peptide Derived from Human Papillomavirus
MVDFIDNCNVY

SEQ ID NO: 749 - protein, 9 aa, Artificial Sequence
  Peptide Derived from Human Papillomavirus
MVMLMLVRF

SEQ ID NO: 750 - protein, 10 aa, Artificial Sequence
  Peptide Derived from Human Papillomavirus
NINAGKDDRW

SEQ ID NO: 751 - protein, 10 aa, Artificial Sequence
  Peptide Derived from Human Papillomavirus
NSKTAKRRLF

SEQ ID NO: 752 - protein, 11 aa, Artificial Sequence
  Peptide Derived from Human Papillomavirus
PLSDISSCVDY

SEQ ID NO: 753 - protein, 10 aa, Artificial Sequence
  Peptide Derived from Human Papillomavirus
PVYELSDKNW

SEQ ID NO: 754 - protein, 10 aa, Artificial Sequence
  Peptide Derived from Human Papillomavirus
QSNKSTCTDW

SEQ ID NO: 755 - protein, 8 aa, Artificial Sequence
  Peptide Derived from Human Papillomavirus
QTVLQHSF

SEQ ID NO: 756 - protein, 10 aa, Artificial Sequence
  Peptide Derived from Human Papillomavirus
RLFELPDSGY

SEQ ID NO: 757 - protein, 11 aa, Artificial Sequence
  Peptide Derived from Human Papillomavirus
RLVVFTFPNPF

SEQ ID NO: 758 - protein, 8 aa, Artificial Sequence
  Peptide Derived from Human Papillomavirus
RSTAAALY

SEQ ID NO: 759 - protein, 9 aa, Artificial Sequence
  Peptide Derived from Human Papillomavirus
RSTAAALYW

SEQ ID NO: 760 - protein, 10 aa, Artificial Sequence
  Peptide Derived from Human Papillomavirus
RSTAAALYWY

SEQ ID NO: 761 - protein, 11 aa, Artificial Sequence
  Peptide Derived from Human Papillomavirus
RTGMSNISDVY

SEQ ID NO: 762 - protein, 11 aa, Artificial Sequence
  Peptide Derived from Human Papillomavirus
SSDTGEDMVDF

SEQ ID NO: 763 - protein, 8 aa, Artificial Sequence
  Peptide Derived from Human Papillomavirus
STAAALYW

SEQ ID NO: 764 - protein, 9 aa, Artificial Sequence
  Peptide Derived from Human Papillomavirus
STAAALYWY

SEQ ID NO: 765 - protein, 11 aa, Artificial Sequence
  Peptide Derived from Human Papillomavirus
STCTDWCVAAF

SEQ ID NO: 766 - protein, 9 aa, Artificial Sequence
  Peptide Derived from Human Papillomavirus
TLLQPYCLY

SEQ ID NO: 767 - protein, 11 aa, Artificial Sequence
  Peptide Derived from Human Papillomavirus
TTFDLSQMVQW

SEQ ID NO: 768 - protein, 11 aa, Artificial Sequence
  Peptide Derived from Human Papillomavirus
TTPCWHYIDNY

SEQ ID NO: 769 - protein, 11 aa, Artificial Sequence
  Peptide Derived from Human Papillomavirus
VLQHSFNDTTF

SEQ ID NO: 770 - protein, 9 aa, Artificial Sequence
  Peptide Derived from Human Papillomavirus
VMDDSEIAY

SEQ ID NO: 771 - protein, 11 aa, Artificial Sequence
  Peptide Derived from Human Papillomavirus
VMDDSEIAYKY

SEQ ID NO: 772 - protein, 8 aa, Artificial Sequence
  Peptide Derived from Human Papillomavirus
VMLMLVRF

SEQ ID NO: 773 - protein, 10 aa, Artificial Sequence
  Peptide Derived from Human Papillomavirus
VSFLSALKLF

SEQ ID NO: 774 - protein, 10 aa, Artificial Sequence
  Peptide Derived from Human Papillomavirus
VSFMELIRPF

SEQ ID NO: 775 - protein, 9 aa, Artificial Sequence
  Peptide Derived from Human Papillomavirus
VTGTVAEGF

SEQ ID NO: 776 - protein, 9 aa, Artificial Sequence
  Peptide Derived from Human Papillomavirus
VVFTFPNPF

SEQ ID NO: 777 - protein, 11 aa, Artificial Sequence
  Peptide Derived from Human Papillomavirus
VVFTFPNPFPF

SEQ ID NO: 778 - protein, 9 aa, Artificial Sequence
  Peptide Derived from Human Papillomavirus
YLHSRLVVF

SEQ ID NO: 779 - protein, 11 aa, Artificial Sequence
  Peptide Derived from Human Papillomavirus
YLHSRLVVFTF

SEQ ID NO: 780 - protein, 9 aa, Artificial Sequence
  Peptide Derived from Human Papillomavirus
CLRYRLSKY

SEQ ID NO: 781 - protein, 11 aa, Artificial Sequence
  Peptide Derived from Human Papillomavirus
DSKRLCDHIDY

SEQ ID NO: 782 - protein, 8 aa, Artificial Sequence
  Peptide Derived from Human Papillomavirus
DVHNTMHY

SEQ ID NO: 783 - protein, 11 aa, Artificial Sequence
  Peptide Derived from Human Papillomavirus
DVHNTMHYTNW

SEQ ID NO: 784 - protein, 11 aa, Artificial Sequence
  Peptide Derived from Human Papillomavirus
ESVFSSDEISF

SEQ ID NO: 785 - protein, 8 aa, Artificial Sequence
  Peptide Derived from Human Papillomavirus
ETLNNTEY

SEQ ID NO: 786 - protein, 11 aa, Artificial Sequence
  Peptide Derived from Human Papillomavirus
EVHAGGQVIVF

SEQ ID NO: 787 - protein, 8 aa, Artificial Sequence
  Peptide Derived from Human Papillomavirus
FSSDEISF

SEQ ID NO: 788 - protein, 8 aa, Artificial Sequence
  Peptide Derived from Human Papillomavirus
FTEEAKKY

SEQ ID NO: 789 - protein, 11 aa, Artificial Sequence
  Peptide Derived from Human Papillomavirus
FVNFTEEAKKY

SEQ ID NO: 790 - protein, 10 aa, Artificial Sequence
  Peptide Derived from Human Papillomavirus
HIRLECVLMY

SEQ ID NO: 791 - protein, 8 aa, Artificial Sequence
  Peptide Derived from Human Papillomavirus
HITYFVNF

SEQ ID NO: 792 - protein, 9 aa, Artificial Sequence
  Peptide Derived from Human Papillomavirus
ISTSQRDDF

SEQ ID NO: 793 - protein, 8 aa, Artificial Sequence
  Peptide Derived from Human Papillomavirus
IVFPESVF

SEQ ID NO: 794 - protein, 8 aa, Artificial Sequence
  Peptide Derived from Human Papillomavirus
LSKYKQLY

SEQ ID NO: 795 - protein, 10 aa, Artificial Sequence
  Peptide Derived from Human Papillomavirus
MLETLNNTEY

SEQ ID NO: 796 - protein, 11 aa, Artificial Sequence
  Peptide Derived from Human Papillomavirus
MMLETLNNTEY

SEQ ID NO: 797 - protein, 8 aa, Artificial Sequence
  Peptide Derived from Human Papillomavirus
NILKCLRY

SEQ ID NO: 798 - protein, 9 aa, Artificial Sequence
  Peptide Derived from Human Papillomavirus
NTEYKNEDW

SEQ ID NO: 799 - protein, 8 aa, Artificial Sequence
  Peptide Derived from Human Papillomavirus
NTMHYTNW

SEQ ID NO: 800 - protein, 10 aa, Artificial Sequence
  Peptide Derived from Human Papillomavirus
NTMHYTNWKF

SEQ ID NO: 801 - protein, 9 aa, Artificial Sequence
  Peptide Derived from Human Papillomavirus
NTVSVSTGY

SEQ ID NO: 802 - protein, 11 aa, Artificial Sequence
  Peptide Derived from Human Papillomavirus
NVCQDKILEHY

SEQ ID NO: 803 - protein, 10 aa, Artificial Sequence
  Peptide Derived from Human Papillomavirus
PTGCLKKHGY

SEQ ID NO: 804 - protein, 10 aa, Artificial Sequence
  Peptide Derived from Human Papillomavirus
QLYEQVSSTW

SEQ ID NO: 805 - protein, 10 aa, Artificial Sequence
  Peptide Derived from Human Papillomavirus
QVIVFPESVF

SEQ ID NO: 806 - protein, 8 aa, Artificial Sequence
  Peptide Derived from Human Papillomavirus
QVNCKGIY

SEQ ID NO: 807 - protein, 9 aa, Artificial Sequence
  Peptide Derived from Human Papillomavirus
QVNCKGIYY

SEQ ID NO: 808 - protein, 8 aa, Artificial Sequence
  Peptide Derived from Human Papillomavirus
QVSSTWHW

SEQ ID NO: 809 - protein, 8 aa, Artificial Sequence
  Peptide Derived from Human Papillomavirus
RLCDHIDY

SEQ ID NO: 810 - protein, 9 aa, Artificial Sequence
  Peptide Derived from Human Papillomavirus
RLCDHIDYW

SEQ ID NO: 811 - protein, 8 aa, Artificial Sequence
  Peptide Derived from Human Papillomavirus
RLECVLMY

SEQ ID NO: 812 - protein, 9 aa, Artificial Sequence
  Peptide Derived from Human Papillomavirus
RLSKYKQLY

SEQ ID NO: 813 - protein, 8 aa, Artificial Sequence
  Peptide Derived from Human Papillomavirus
STSQRDDF

SEQ ID NO: 814 - protein, 10 aa, Artificial Sequence
  Peptide Derived from Human Papillomavirus
SVFSSDEISF

SEQ ID NO: 815 - protein, 9 aa, Artificial Sequence
  Peptide Derived from Human Papillomavirus
TMHYTNWKF

SEQ ID NO: 816 - protein, 11 aa, Artificial Sequence
  Peptide Derived from Human Papillomavirus
TMHYTNWKFIY

SEQ ID NO: 817 - protein, 10 aa, Artificial Sequence
  Peptide Derived from Human Papillomavirus
TMQQTSLELY

SEQ ID NO: 818 - protein, 8 aa, Artificial Sequence
  Peptide Derived from Human Papillomavirus
TVSVSTGY

SEQ ID NO: 819 - protein, 9 aa, Artificial Sequence
  Peptide Derived from Human Papillomavirus
VIVFPESVF

SEQ ID NO: 820 - protein, 11 aa, Artificial Sequence
  Peptide Derived from Human Papillomavirus
WTMQQTSLELY

SEQ ID NO: 821 - protein, 10 aa, Artificial Sequence
  Peptide Derived from Human Papillomavirus
YISTSQRDDF

SEQ ID NO: 822 - protein, 8 aa, Artificial Sequence
  Peptide Derived from Human Papillomavirus
YTNWKFIY

SEQ ID NO: 823 - protein, 9 aa, Artificial Sequence
  Peptide Derived from Human Papillomavirus
YVHEGHITY

SEQ ID NO: 824 - protein, 10 aa, Artificial Sequence
  Peptide Derived from Human Papillomavirus
YVHEGHITYF

SEQ ID NO: 825 - protein, 11 aa, Artificial Sequence
  Peptide Derived from Human Papillomavirus
ATLLLLIVILW

SEQ ID NO: 826 - protein, 8 aa, Artificial Sequence
  Peptide Derived from Human Papillomavirus
ATSPLRCF

SEQ ID NO: 827 - protein, 11 aa, Artificial Sequence
  Peptide Derived from Human Papillomavirus
ATSPLRCFCIY

SEQ ID NO: 828 - protein, 8 aa, Artificial Sequence
  Peptide Derived from Human Papillomavirus
CIYVVFIY

SEQ ID NO: 829 - protein, 10 aa, Artificial Sequence
  Peptide Derived from Human Papillomavirus
FLLCFCVLLF

SEQ ID NO: 830 - protein, 9 aa, Artificial Sequence
  Peptide Derived from Human Papillomavirus
FVIHTHASF

SEQ ID NO: 831 - protein, 10 aa, Artificial Sequence
  Peptide Derived from Human Papillomavirus
ISTVSIVLCF

SEQ ID NO: 832 - protein, 9 aa, Artificial Sequence
  Peptide Derived from Human Papillomavirus
IVLCFLLCF

SEQ ID NO: 833 - protein, 9 aa, Artificial Sequence
  Peptide Derived from Human Papillomavirus
LLCFCVLLF

SEQ ID NO: 834 - protein, 8 aa, Artificial Sequence
  Peptide Derived from Human Papillomavirus
LLLIVILW

SEQ ID NO: 835 - protein, 9 aa, Artificial Sequence
  Peptide Derived from Human Papillomavirus
LLLLIVILW

SEQ ID NO: 836 - protein, 8 aa, Artificial Sequence
  Peptide Derived from Human Papillomavirus
LVLSVSVY

SEQ ID NO: 837 - protein, 11 aa, Artificial Sequence
  Peptide Derived from Human Papillomavirus
NISTVSIVLCF

SEQ ID NO: 838 - protein, 11 aa, Artificial Sequence
  Peptide Derived from Human Papillomavirus
PLFVIHTHASF

SEQ ID NO: 839 - protein, 8 aa, Artificial Sequence
  Peptide Derived from Human Papillomavirus
PLRCFCIY

SEQ ID NO: 840 - protein, 11 aa, Artificial Sequence
  Peptide Derived from Human Papillomavirus
PLRCFCIYVVF

SEQ ID NO: 841 - protein, 9 aa, Artificial Sequence
  Peptide Derived from Human Papillomavirus
PLVLSVSVY

SEQ ID NO: 842 - protein, 10 aa, Artificial Sequence
  Peptide Derived from Human Papillomavirus
SIVLCFLLCF

SEQ ID NO: 843 - protein, 9 aa, Artificial Sequence
  Peptide Derived from Human Papillomavirus
STVSIVLCF

SEQ ID NO: 844 - protein, 10 aa, Artificial Sequence
  Peptide Derived from Human Papillomavirus
TLLLLIVILW

SEQ ID NO: 845 - protein, 10 aa, Artificial Sequence
  Peptide Derived from Human Papillomavirus
TSPLRCFCIY

SEQ ID NO: 846 - protein, 8 aa, Artificial Sequence
  Peptide Derived from Human Papillomavirus
TVSIVLCF

SEQ ID NO: 847 - protein, 10 aa, Artificial Sequence
  Peptide Derived from Human Papillomavirus
VIATSPLRCF

SEQ ID NO: 848 - protein, 8 aa, Artificial Sequence
  Peptide Derived from Human Papillomavirus
VIHTHASF

SEQ ID NO: 849 - protein, 8 aa, Artificial Sequence
  Peptide Derived from Human Papillomavirus
VLCFLLCF

SEQ ID NO: 850 - protein, 11 aa, Artificial Sequence
  Peptide Derived from Human Papillomavirus
VSIVLCFLLCF

SEQ ID NO: 851 - protein, 9 aa, Artificial Sequence
  Peptide Derived from Human Papillomavirus
VVFIYIPLF

SEQ ID NO: 852 - protein, 11 aa, Artificial Sequence
  Peptide Derived from Human Papillomavirus
WVIATSPLRCF

SEQ ID NO: 853 - protein, 10 aa, Artificial Sequence
  Peptide Derived from Human Papillomavirus
YVVFIYIPLF

SEQ ID NO: 854 - protein, 11 aa, Artificial Sequence
  Peptide Derived from Human Papillomavirus
CLRFYSKVSEF

SEQ ID NO: 855 - protein, 8 aa, Artificial Sequence
  Peptide Derived from Human Papillomavirus
CTKCLRFY

SEQ ID NO: 856 - protein, 8 aa, Artificial Sequence
  Peptide Derived from Human Papillomavirus
ELRLNCVY

SEQ ID NO: 857 - protein, 10 aa, Artificial Sequence
  Peptide Derived from Human Papillomavirus
ELSSALEIPY

SEQ ID NO: 858 - protein, 9 aa, Artificial Sequence
  Peptide Derived from Human Papillomavirus
ETEVLDFAF

SEQ ID NO: 859 - protein, 8 aa, Artificial Sequence
  Peptide Derived from Human Papillomavirus
FTDLTIVY

SEQ ID NO: 860 - protein, 9 aa, Artificial Sequence
  Peptide Derived from Human Papillomavirus
GVCTKCLRF

SEQ ID NO: 861 - protein, 10 aa, Artificial Sequence
  Peptide Derived from Human Papillomavirus
GVCTKCLRFY

SEQ ID NO: 862 - protein, 8 aa, Artificial Sequence
  Peptide Derived from Human Papillomavirus
HLDKKKRF

SEQ ID NO: 863 - protein, 8 aa, Artificial Sequence
  Peptide Derived from Human Papillomavirus
KVSEFRWY

SEQ ID NO: 864 - protein, 10 aa, Artificial Sequence
  Peptide Derived from Human Papillomavirus
KVSEFRWYRY

SEQ ID NO: 865 - protein, 9 aa, Artificial Sequence
  Peptide Derived from Human Papillomavirus
LSSALEIPY

SEQ ID NO: 866 - protein, 9 aa, Artificial Sequence
  Peptide Derived from Human Papillomavirus
LTETEVLDF

SEQ ID NO: 867 - protein, 11 aa, Artificial Sequence
  Peptide Derived from Human Papillomavirus
LTETEVLDFAF

SEQ ID NO: 868 - protein, 10 aa, Artificial Sequence
  Peptide Derived from Human Papillomavirus
QLTETEVLDF

SEQ ID NO: 869 - protein, 8 aa, Artificial Sequence
  Peptide Derived from Human Papillomavirus
SSALEIPY

SEQ ID NO: 870 - protein, 9 aa, Artificial Sequence
  Peptide Derived from Human Papillomavirus
VSEFRWYRY

SEQ ID NO: 871 - protein, 9 aa, Artificial Sequence
  Peptide Derived from Human Papillomavirus
WTGRCIACW

SEQ ID NO: 872 - protein, 9 aa, Artificial Sequence
  Peptide Derived from Human Papillomavirus
YSKVSEFRW

SEQ ID NO: 873 - protein, 10 aa, Artificial Sequence
  Peptide Derived from Human Papillomavirus
YSKVSEFRWY

SEQ ID NO: 874 - protein, 10 aa, Artificial Sequence
  Peptide Derived from Human Papillomavirus
DTSNYNIVTF

SEQ ID NO: 875 - protein, 8 aa, Artificial Sequence
  Peptide Derived from Human Papillomavirus
ETPTLQDY

SEQ ID NO: 876 - protein, 10 aa, Artificial Sequence
  Peptide Derived from Human Papillomavirus
ILQELLMGSF

SEQ ID NO: 877 - protein, 11 aa, Artificial Sequence
  Peptide Derived from Human Papillomavirus
RILQELLMGSF

SEQ ID NO: 878 - protein, 9 aa, Artificial Sequence
  Peptide Derived from Human Papillomavirus
TSNYNIVTF

SEQ ID NO: 879 - protein, 9 aa, Artificial Sequence
  Peptide Derived from Human Papillomavirus
AIANSDTTF

SEQ ID NO: 880 - protein, 8 aa, Artificial Sequence
  Peptide Derived from Human Papillomavirus
AILEDWNF

SEQ ID NO: 881 - protein, 8 aa, Artificial Sequence
  Peptide Derived from Human Papillomavirus
ATLANSTY

SEQ ID NO: 882 - protein, 9 aa, Artificial Sequence
  Peptide Derived from Human Papillomavirus
ATLANSTYF

SEQ ID NO: 883 - protein, 9 aa, Artificial Sequence
  Peptide Derived from Human Papillomavirus
DICNSICKY

SEQ ID NO: 884 - protein, 11 aa, Artificial Sequence
  Peptide Derived from Human Papillomavirus
DLDQFPLGRKF

SEQ ID NO: 885 - protein, 8 aa, Artificial Sequence
  Peptide Derived from Human Papillomavirus
DTENSNRY

SEQ ID NO: 886 - protein, 9 aa, Artificial Sequence
  Peptide Derived from Human Papillomavirus
DTGFGAMDF

SEQ ID NO: 887 - protein, 9 aa, Artificial Sequence
  Peptide Derived from Human Papillomavirus
DTTFKSSNF

SEQ ID NO: 888 - protein, 8 aa, Artificial Sequence
  Peptide Derived from Human Papillomavirus
ESVPTDLY

SEQ ID NO: 889 - protein, 8 aa, Artificial Sequence
  Peptide Derived from Human Papillomavirus
EVNLKEKF

SEQ ID NO: 890 - protein, 8 aa, Artificial Sequence
  Peptide Derived from Human Papillomavirus
FSADLDQF

SEQ ID NO: 891 - protein, 9 aa, Artificial Sequence
  Peptide Derived from Human Papillomavirus
GICWGNQLF

SEQ ID NO: 892 - protein, 11 aa, Artificial Sequence
  Peptide Derived from Human Papillomavirus
GISGHPLLNKF

SEQ ID NO: 893 - protein, 9 aa, Artificial Sequence
  Peptide Derived from Human Papillomavirus
GSLEDTYRF

SEQ ID NO: 894 - protein, 11 aa, Artificial Sequence
  Peptide Derived from Human Papillomavirus
GSMVTSDAQIF

SEQ ID NO: 895 - protein, 11 aa, Artificial Sequence
  Peptide Derived from Human Papillomavirus
GSTATLANSTY

SEQ ID NO: 896 - protein, 11 aa, Artificial Sequence
  Peptide Derived from Human Papillomavirus
HSMNPAILEDW

SEQ ID NO: 897 - protein, 10 aa, Artificial Sequence
  Peptide Derived from Human Papillomavirus
ISGHPLLNKF

SEQ ID NO: 898 - protein, 10 aa, Artificial Sequence
  Peptide Derived from Human Papillomavirus
ITLSADIMTY

SEQ ID NO: 899 - protein, 11 aa, Artificial Sequence
  Peptide Derived from Human Papillomavirus
IVVPKVSGLQY

SEQ ID NO: 900 - protein, 11 aa, Artificial Sequence
  Peptide Derived from Human Papillomavirus
KITLSADIMTY

SEQ ID NO: 901 - protein, 8 aa, Artificial Sequence
  Peptide Derived from Human Papillomavirus
KSSNFKEY

SEQ ID NO: 902 - protein, 10 aa, Artificial Sequence
  Peptide Derived from Human Papillomavirus
KVSGLQYRVF

SEQ ID NO: 903 - protein, 8 aa, Artificial Sequence
  Peptide Derived from Human Papillomavirus
KVVSTDEY

SEQ ID NO: 904 - protein, 8 aa, Artificial Sequence
  Peptide Derived from Human Papillomavirus
LLTVGHPY

SEQ ID NO: 905 - protein, 9 aa, Artificial Sequence
  Peptide Derived from Human Papillomavirus
LLTVGHPYY

SEQ ID NO: 906 - protein, 8 aa, Artificial Sequence
  Peptide Derived from Human Papillomavirus
LSADIMTY

SEQ ID NO: 907 - protein, 8 aa, Artificial Sequence
  Peptide Derived from Human Papillomavirus
LTVGHPYY

SEQ ID NO: 908 - protein, 11 aa, Artificial Sequence
  Peptide Derived from Human Papillomavirus
MVAEPYGDTLF

SEQ ID NO: 909 - protein, 11 aa, Artificial Sequence
  Peptide Derived from Human Papillomavirus
MVDTGFGAMDF

SEQ ID NO: 910 - protein, 9 aa, Artificial Sequence
  Peptide Derived from Human Papillomavirus
MVTSDAQIF

SEQ ID NO: 911 - protein, 11 aa, Artificial Sequence
  Peptide Derived from Human Papillomavirus
NSDTTFKSSNF

SEQ ID NO: 912 - protein, 9 aa, Artificial Sequence
  Peptide Derived from Human Papillomavirus
NSICKYPDY

SEQ ID NO: 913 - protein, 11 aa, Artificial Sequence
  Peptide Derived from Human Papillomavirus
PLDICNSICKY

SEQ ID NO: 914 - protein, 9 aa, Artificial Sequence
  Peptide Derived from Human Papillomavirus
PSGSLEDTY

SEQ ID NO: 915 - protein, 11 aa, Artificial Sequence
  Peptide Derived from Human Papillomavirus
PSGSLEDTYRF

SEQ ID NO: 916 - protein, 11 aa, Artificial Sequence
  Peptide Derived from Human Papillomavirus
PVSKVVSTDEY

SEQ ID NO: 917 - protein, 8 aa, Artificial Sequence
  Peptide Derived from Human Papillomavirus
QIFNKPYW

SEQ ID NO: 918 - protein, 8 aa, Artificial Sequence
  Peptide Derived from Human Papillomavirus
QMFVRHFF

SEQ ID NO: 919 - protein, 9 aa, Artificial Sequence
  Peptide Derived from Human Papillomavirus
RLLTVGHPY

SEQ ID NO: 920 - protein, 10 aa, Artificial Sequence
  Peptide Derived from Human Papillomavirus
RLLTVGHPYY

SEQ ID NO: 921 - protein, 8 aa, Artificial Sequence
  Peptide Derived from Human Papillomavirus
RLPDPNKF

SEQ ID NO: 922 - protein, 10 aa, Artificial Sequence
  Peptide Derived from Human Papillomavirus
RLPDPNKFGF

SEQ ID NO: 923 - protein, 10 aa, Artificial Sequence
  Peptide Derived from Human Papillomavirus
RVRLPDPNKF

SEQ ID NO: 924 - protein, 8 aa, Artificial Sequence
  Peptide Derived from Human Papillomavirus
SICKYPDY

SEQ ID NO: 925 - protein, 8 aa, Artificial Sequence
  Peptide Derived from Human Papillomavirus
SLEDTYRF

SEQ ID NO: 926 - protein, 11 aa, Artificial Sequence
  Peptide Derived from Human Papillomavirus
SLWRPSEATVY

SEQ ID NO: 927 - protein, 10 aa, Artificial Sequence
  Peptide Derived from Human Papillomavirus
SMNPAILEDW

SEQ ID NO: 928 - protein, 10 aa, Artificial Sequence
  Peptide Derived from Human Papillomavirus
SMVTSDAQIF

SEQ ID NO: 929 - protein, 10 aa, Artificial Sequence
  Peptide Derived from Human Papillomavirus
STATLANSTY

SEQ ID NO: 930 - protein, 11 aa, Artificial Sequence
  Peptide Derived from Human Papillomavirus
STATLANSTYF

SEQ ID NO: 931 - protein, 8 aa, Artificial Sequence
  Peptide Derived from Human Papillomavirus
TLANSTYF

SEQ ID NO: 932 - protein, 9 aa, Artificial Sequence
  Peptide Derived from Human Papillomavirus
TLSADIMTY

SEQ ID NO: 933 - protein, 11 aa, Artificial Sequence
  Peptide Derived from Human Papillomavirus
TSDAQIFNKPY

SEQ ID NO: 934 - protein, 8 aa, Artificial Sequence
  Peptide Derived from Human Papillomavirus
TTFKSSNF

SEQ ID NO: 935 - protein, 11 aa, Artificial Sequence
  Peptide Derived from Human Papillomavirus
TTFKSSNFKEY

SEQ ID NO: 936 - protein, 11 aa, Artificial Sequence
  Peptide Derived from Human Papillomavirus
TVGESVPTDLY

SEQ ID NO: 937 - protein, 9 aa, Artificial Sequence
  Peptide Derived from Human Papillomavirus
VSGLQYRVF

SEQ ID NO: 938 - protein, 10 aa, Artificial Sequence
  Peptide Derived from Human Papillomavirus
VSKVVSTDEY

SEQ ID NO: 939 - protein, 8 aa, Artificial Sequence
  Peptide Derived from Human Papillomavirus
VTRTNIYY

SEQ ID NO: 940 - protein, 8 aa, Artificial Sequence
  Peptide Derived from Human Papillomavirus
VTSDAQIF

SEQ ID NO: 941 - protein, 10 aa, Artificial Sequence
  Peptide Derived from Human Papillomavirus
VVPKVSGLQY

SEQ ID NO: 942 - protein, 9 aa, Artificial Sequence
  Peptide Derived from Human Papillomavirus
YLKMVAEPY

SEQ ID NO: 943 - protein, 8 aa, Artificial Sequence
  Peptide Derived from Human Papillomavirus
YLRHGEEF

SEQ ID NO: 944 - protein, 8 aa, Artificial Sequence
  Peptide Derived from Human Papillomavirus
YLRREQMF

SEQ ID NO: 945 - protein, 8 aa, Artificial Sequence
  Peptide Derived from Human Papillomavirus
YVTRTNIY

SEQ ID NO: 946 - protein, 9 aa, Artificial Sequence
  Peptide Derived from Human Papillomavirus
YVTRTNIYY

SEQ ID NO: 947 - protein, 11 aa, Artificial Sequence
  Peptide Derived from Human Papillomavirus
ALTSRRNTVRY

SEQ ID NO: 948 - protein, 9 aa, Artificial Sequence
  Peptide Derived from Human Papillomavirus
ATIGARVHY

SEQ ID NO: 949 - protein, 10 aa, Artificial Sequence
  Peptide Derived from Human Papillomavirus
ATIGARVHYY

SEQ ID NO: 950 - protein, 11 aa, Artificial Sequence
  Peptide Derived from Human Papillomavirus
ATIGARVHYYY

SEQ ID NO: 951 - protein, 11 aa, Artificial Sequence
  Peptide Derived from Human Papillomavirus
AVQSTSAVSAY

SEQ ID NO: 952 - protein, 8 aa, Artificial Sequence
  Peptide Derived from Human Papillomavirus
DIYADTDF

SEQ ID NO: 953 - protein, 10 aa, Artificial Sequence
  Peptide Derived from Human Papillomavirus
ETVNAEESLY

SEQ ID NO: 954 - protein, 11 aa, Artificial Sequence
  Peptide Derived from Human Papillomavirus
ETVNAEESLYF

SEQ ID NO: 955 - protein, 11 aa, Artificial Sequence
  Peptide Derived from Human Papillomavirus
FLSAPKQLITY

SEQ ID NO: 956 - protein, 8 aa, Artificial Sequence
  Peptide Derived from Human Papillomavirus
FVDGGDFY

SEQ ID NO: 957 - protein, 11 aa, Artificial Sequence
  Peptide Derived from Human Papillomavirus
GLYDIYADTDF

SEQ ID NO: 958 - protein, 10 aa, Artificial Sequence
  Peptide Derived from Human Papillomavirus
GSGTGGRTGY

SEQ ID NO: 959 - protein, 8 aa, Artificial Sequence
  Peptide Derived from Human Papillomavirus
GTGGRTGY

SEQ ID NO: 960 - protein, 11 aa, Artificial Sequence
  Peptide Derived from Human Papillomavirus
GVRRPARLGLY

SEQ ID NO: 961 - protein, 11 aa, Artificial Sequence
  Peptide Derived from Human Papillomavirus
HTTIADQILRY

SEQ ID NO: 962 - protein, 10 aa, Artificial Sequence
  Peptide Derived from Human Papillomavirus
ILRYGSMGVF

SEQ ID NO: 963 - protein, 11 aa, Artificial Sequence
  Peptide Derived from Human Papillomavirus
ILRYGSMGVFF

SEQ ID NO: 964 - protein, 8 aa, Artificial Sequence
  Peptide Derived from Human Papillomavirus
ITYENPAY

SEQ ID NO: 965 - protein, 9 aa, Artificial Sequence
  Peptide Derived from Human Papillomavirus
LITYENPAY

SEQ ID NO: 966 - protein, 10 aa, Artificial Sequence
  Peptide Derived from Human Papillomavirus
LSAPKQLITY

SEQ ID NO: 967 - protein, 11 aa, Artificial Sequence
  Peptide Derived from Human Papillomavirus
LSSSSISTHNY

SEQ ID NO: 968 - protein, 10 aa, Artificial Sequence
  Peptide Derived from Human Papillomavirus
LSTGFDIPIF

SEQ ID NO: 969 - protein, 10 aa, Artificial Sequence
  Peptide Derived from Human Papillomavirus
LTSRRNTVRY

SEQ ID NO: 970 - protein, 11 aa, Artificial Sequence
  Peptide Derived from Human Papillomavirus
MLKRRRKRVSY

SEQ ID NO: 971 - protein, 8 aa, Artificial Sequence
  Peptide Derived from Human Papillomavirus
NIAPDPDF

SEQ ID NO: 972 - protein, 10 aa, Artificial Sequence
  Peptide Derived from Human Papillomavirus
NTTVPLSTGF

SEQ ID NO: 973 - protein, 10 aa, Artificial Sequence
  Peptide Derived from Human Papillomavirus
PIEHAPTQVF

SEQ ID NO: 974 - protein, 11 aa, Artificial Sequence
  Peptide Derived from Human Papillomavirus
PIPHPPTTSGF

SEQ ID NO: 975 - protein, 11 aa, Artificial Sequence
  Peptide Derived from Human Papillomavirus
PLSTGFDIPIF

SEQ ID NO: 976 - protein, 9 aa, Artificial Sequence
  Peptide Derived from Human Papillomavirus
PTTPQVSIF

SEQ ID NO: 977 - protein, 11 aa, Artificial Sequence
  Peptide Derived from Human Papillomavirus
QILRYGSMGVF

SEQ ID NO: 978 - protein, 10 aa, Artificial Sequence
  Peptide Derived from Human Papillomavirus
QLITYENPAY

SEQ ID NO: 979 - protein, 9 aa, Artificial Sequence
  Peptide Derived from Human Papillomavirus
QSTSAVSAY

SEQ ID NO: 980 - protein, 9 aa, Artificial Sequence
  Peptide Derived from Human Papillomavirus
QVKVIDPTF

SEQ ID NO: 981 - protein, 11 aa, Artificial Sequence
  Peptide Derived from Human Papillomavirus
QVSIFVDGGDF

SEQ ID NO: 982 - protein, 11 aa, Artificial Sequence
  Peptide Derived from Human Papillomavirus
RTKRASATQLY

SEQ ID NO: 983 - protein, 9 aa, Artificial Sequence
  Peptide Derived from Human Papillomavirus
SIFVDGGDF

SEQ ID NO: 984 - protein, 10 aa, Artificial Sequence
  Peptide Derived from Human Papillomavirus
SIFVDGGDFY

SEQ ID NO: 985 - protein, 8 aa, Artificial Sequence
  Peptide Derived from Human Papillomavirus
SSISTHNY

SEQ ID NO: 986 - protein, 9 aa, Artificial Sequence
  Peptide Derived from Human Papillomavirus
SSSISTHNY

SEQ ID NO: 987 - protein, 10 aa, Artificial Sequence
  Peptide Derived from Human Papillomavirus
SSSSISTHNY

SEQ ID NO: 988 - protein, 9 aa, Artificial Sequence
  Peptide Derived from Human Papillomavirus
STGFDIPIF

SEQ ID NO: 989 - protein, 8 aa, Artificial Sequence
  Peptide Derived from Human Papillomavirus
STHENPTF

SEQ ID NO: 990 - protein, 8 aa, Artificial Sequence
  Peptide Derived from Human Papillomavirus
STLNDGLY

SEQ ID NO: 991 - protein, 11 aa, Artificial Sequence
  Peptide Derived from Human Papillomavirus
STLNDGLYDIY

SEQ ID NO: 992 - protein, 8 aa, Artificial Sequence
  Peptide Derived from Human Papillomavirus
STSAVSAY

SEQ ID NO: 993 - protein, 10 aa, Artificial Sequence
  Peptide Derived from Human Papillomavirus
SVSTHENPTF

SEQ ID NO: 994 - protein, 9 aa, Artificial Sequence
  Peptide Derived from Human Papillomavirus
TIADQILRY

SEQ ID NO: 995 - protein, 8 aa, Artificial Sequence
  Peptide Derived from Human Papillomavirus
TIGARVHY

SEQ ID NO: 996 - protein, 9 aa, Artificial Sequence
  Peptide Derived from Human Papillomavirus
TIGARVHYY

SEQ ID NO: 997 - protein, 10 aa, Artificial Sequence
  Peptide Derived from Human Papillomavirus
TIGARVHYYY

SEQ ID NO: 998 - protein, 10 aa, Artificial Sequence
  Peptide Derived from Human Papillomavirus
TLNDGLYDIY

SEQ ID NO: 999 - protein, 11 aa, Artificial Sequence
  Peptide Derived from Human Papillomavirus
TSHNIAPDPDF

SEQ ID NO: 1000 - protein, 9 aa, Artificial Sequence
  Peptide Derived from Human Papillomavirus
TSRRNTVRY

SEQ ID NO: 1001 - protein, 9 aa, Artificial Sequence
  Peptide Derived from Human Papillomavirus
TSTLNDGLY

SEQ ID NO: 1002 - protein, 11 aa, Artificial Sequence
  Peptide Derived from Human Papillomavirus
TSVSTHENPTF

SEQ ID NO: 1003 - protein, 10 aa, Artificial Sequence
  Peptide Derived from Human Papillomavirus
TTIADQILRY

SEQ ID NO: 1004 - protein, 8 aa, Artificial Sequence
  Peptide Derived from Human Papillomavirus
TTPQVSIF

SEQ ID NO: 1005 - protein, 10 aa, Artificial Sequence
  Peptide Derived from Human Papillomavirus
TTSTLNDGLY

SEQ ID NO: 1006 - protein, 11 aa, Artificial Sequence
  Peptide Derived from Human Papillomavirus
TTTSTLNDGLY

SEQ ID NO: 1007 - protein, 9 aa, Artificial Sequence
  Peptide Derived from Human Papillomavirus
TTVPLSTGF

SEQ ID NO: 1008 - protein, 9 aa, Artificial Sequence
  Peptide Derived from Human Papillomavirus
TVNAEESLY

SEQ ID NO: 1009 - protein, 10 aa, Artificial Sequence
  Peptide Derived from Human Papillomavirus
TVNAEESLYF

SEQ ID NO: 1010 - protein, 8 aa, Artificial Sequence
  Peptide Derived from Human Papillomavirus
TVPLSTGF

SEQ ID NO: 1011 - protein, 10 aa, Artificial Sequence
  Peptide Derived from Human Papillomavirus
VSIFVDGGDF

SEQ ID NO: 1012 - protein, 11 aa, Artificial Sequence
  Peptide Derived from Human Papillomavirus
VSIFVDGGDFY

SEQ ID NO: 1013 - protein, 9 aa, Artificial Sequence
  Peptide Derived from Human Papillomavirus
VSTHENPTF

SEQ ID NO: 1014 - protein, 10 aa, Artificial Sequence
  Peptide Derived from Human Papillomavirus
AINDENWKSF

SEQ ID NO: 1015 - protein, 11 aa, Artificial Sequence
  Peptide Derived from Human Papillomavirus
AINDENWKSFF

SEQ ID NO: 1016 - protein, 9 aa, Artificial Sequence
  Peptide Derived from Human Papillomavirus
AVCALKRKF

SEQ ID NO: 1017 - protein, 9 aa, Artificial Sequence
  Peptide Derived from Human Papillomavirus
CTDWCITGY

SEQ ID NO: 1018 - protein, 8 aa, Artificial Sequence
  Peptide Derived from Human Papillomavirus
CVNSKSHF

SEQ ID NO: 1019 - protein, 9 aa, Artificial Sequence
  Peptide Derived from Human Papillomavirus
CVNSKSHFW

SEQ ID NO: 1020 - protein, 8 aa, Artificial Sequence
  Peptide Derived from Human Papillomavirus
DLSEMVQW

SEQ ID NO: 1021 - protein, 10 aa, Artificial Sequence
  Peptide Derived from Human Papillomavirus
DLSEMVQWAY

SEQ ID NO: 1022 - protein, 8 aa, Artificial Sequence
  Peptide Derived from Human Papillomavirus
DSDIAYYY

SEQ ID NO: 1023 - protein, 9 aa, Artificial Sequence
  Peptide Derived from Human Papillomavirus
DSGTDLLEF

SEQ ID NO: 1024 - protein, 9 aa, Artificial Sequence
  Peptide Derived from Human Papillomavirus
DSNSNAAAF

SEQ ID NO: 1025 - protein, 9 aa, Artificial Sequence
  Peptide Derived from Human Papillomavirus
DTEAARALF

SEQ ID NO: 1026 - protein, 9 aa, Artificial Sequence
  Peptide Derived from Human Papillomavirus
DVQGTTPEW

SEQ ID NO: 1027 - protein, 9 aa, Artificial Sequence
  Peptide Derived from Human Papillomavirus
DVTPISWTY

SEQ ID NO: 1028 - protein, 10 aa, Artificial Sequence
  Peptide Derived from Human Papillomavirus
ELTDDSDIAY

SEQ ID NO: 1029 - protein, 11 aa, Artificial Sequence
  Peptide Derived from Human Papillomavirus
ELTDDSDIAYY

SEQ ID NO: 1030 - protein, 8 aa, Artificial Sequence
  Peptide Derived from Human Papillomavirus
FLGAFKKF

SEQ ID NO: 1031 - protein, 8 aa, Artificial Sequence
  Peptide Derived from Human Papillomavirus
FMELVRPF

SEQ ID NO: 1032 - protein, 8 aa, Artificial Sequence
  Peptide Derived from Human Papillomavirus
FTAFLGAF

SEQ ID NO: 1033 - protein, 11 aa, Artificial Sequence
  Peptide Derived from Human Papillomavirus
FTAFLGAFKKF

SEQ ID NO: 1034 - protein, 10 aa, Artificial Sequence
  Peptide Derived from Human Papillomavirus
GIIILLLIRF

SEQ ID NO: 1035 - protein, 11 aa, Artificial Sequence
  Peptide Derived from Human Papillomavirus
GISFMELVRPF

SEQ ID NO: 1036 - protein, 8 aa, Artificial Sequence
  Peptide Derived from Human Papillomavirus
GMGCTGWF

SEQ ID NO: 1037 - protein, 11 aa, Artificial Sequence
  Peptide Derived from Human Papillomavirus
GMIDDVTPISW

SEQ ID NO: 1038 - protein, 8 aa, Artificial Sequence
  Peptide Derived from Human Papillomavirus
GTDSRWPY

SEQ ID NO: 1039 - protein, 8 aa, Artificial Sequence
  Peptide Derived from Human Papillomavirus
HSFNDNIF

SEQ ID NO: 1040 - protein, 9 aa, Artificial Sequence
  Peptide Derived from Human Papillomavirus
HSRLTVFEF

SEQ ID NO: 1041 - protein, 11 aa, Artificial Sequence
  Peptide Derived from Human Papillomavirus
HSSNTKANILY

SEQ ID NO: 1042 - protein, 9 aa, Artificial Sequence
  Peptide Derived from Human Papillomavirus
IIILLLIRF

SEQ ID NO: 1043 - protein, 8 aa, Artificial Sequence
  Peptide Derived from Human Papillomavirus
IILLLIRF

SEQ ID NO: 1044 - protein, 9 aa, Artificial Sequence
  Peptide Derived from Human Papillomavirus
ILYKFKEAY

SEQ ID NO: 1045 - protein, 10 aa, Artificial Sequence
  Peptide Derived from Human Papillomavirus
ISCVNSKSHF

SEQ ID NO: 1046 - protein, 11 aa, Artificial Sequence
  Peptide Derived from Human Papillomavirus
ISCVNSKSHFW

SEQ ID NO: 1047 - protein, 11 aa, Artificial Sequence
  Peptide Derived from Human Papillomavirus
ISDVQGTTPEW

SEQ ID NO: 1048 - protein, 10 aa, Artificial Sequence
  Peptide Derived from Human Papillomavirus
ISFMELVRPF

SEQ ID NO: 1049 - protein, 9 aa, Artificial Sequence
  Peptide Derived from Human Papillomavirus
ISWTYIDDY

SEQ ID NO: 1050 - protein, 10 aa, Artificial Sequence
  Peptide Derived from Human Papillomavirus
KIDELEDSGY

SEQ ID NO: 1051 - protein, 10 aa, Artificial Sequence
  Peptide Derived from Human Papillomavirus
KLRSQTCALY

SEQ ID NO: 1052 - protein, 11 aa, Artificial Sequence
  Peptide Derived from Human Papillomavirus
KLRSQTCALYW

SEQ ID NO: 1053 - protein, 10 aa, Artificial Sequence
  Peptide Derived from Human Papillomavirus
KSDKTSCTDW

SEQ ID NO: 1054 - protein, 8 aa, Artificial Sequence
  Peptide Derived from Human Papillomavirus
KSFFSRTW

SEQ ID NO: 1055 - protein, 11 aa, Artificial Sequence
  Peptide Derived from Human Papillomavirus
KSYFGMSLIQF

SEQ ID NO: 1056 - protein, 8 aa, Artificial Sequence
  Peptide Derived from Human Papillomavirus
KTNDGGNW

SEQ ID NO: 1057 - protein, 10 aa, Artificial Sequence
  Peptide Derived from Human Papillomavirus
KVLIKQHSLY

SEQ ID NO: 1058 - protein, 8 aa, Artificial Sequence
  Peptide Derived from Human Papillomavirus
LIKQHSLY

SEQ ID NO: 1059 - protein, 9 aa, Artificial Sequence
  Peptide Derived from Human Papillomavirus
LLRYQNIEF

SEQ ID NO: 1060 - protein, 9 aa, Artificial Sequence
  Peptide Derived from Human Papillomavirus
LSEMVQWAY

SEQ ID NO: 1061 - protein, 9 aa, Artificial Sequence
  Peptide Derived from Human Papillomavirus
LTDDSDIAY

SEQ ID NO: 1062 - protein, 10 aa, Artificial Sequence
  Peptide Derived from Human Papillomavirus
LTDDSDIAYY

SEQ ID NO: 1063 - protein, 11 aa, Artificial Sequence
  Peptide Derived from Human Papillomavirus
LTDDSDIAYYY

SEQ ID NO: 1064 - protein, 10 aa, Artificial Sequence
  Peptide Derived from Human Papillomavirus
LTVFEFKNPF

SEQ ID NO: 1065 - protein, 8 aa, Artificial Sequence
  Peptide Derived from Human Papillomavirus
LTVLQHSF

SEQ ID NO: 1066 - protein, 10 aa, Artificial Sequence
  Peptide Derived from Human Papillomavirus
MIDDVTPISW

SEQ ID NO: 1067 - protein, 11 aa, Artificial Sequence
  Peptide Derived from Human Papillomavirus
NIEFTAFLGAF

SEQ ID NO: 1068 - protein, 11 aa, Artificial Sequence
  Peptide Derived from Human Papillomavirus
NIFDLSEMVQW

SEQ ID NO: 1069 - protein, 10 aa, Artificial Sequence
  Peptide Derived from Human Papillomavirus
NILYKFKEAY

SEQ ID NO: 1070 - protein, 8 aa, Artificial Sequence
  Peptide Derived from Human Papillomavirus
NTKANILY

SEQ ID NO: 1071 - protein, 10 aa, Artificial Sequence
  Peptide Derived from Human Papillomavirus
NTKANILYKF

SEQ ID NO: 1072 - protein, 10 aa, Artificial Sequence
  Peptide Derived from Human Papillomavirus
NTNAGTDSRW

SEQ ID NO: 1073 - protein, 10 aa, Artificial Sequence
  Peptide Derived from Human Papillomavirus
PISWTYIDDY

SEQ ID NO: 1074 - protein, 8 aa, Artificial Sequence
  Peptide Derived from Human Papillomavirus
PIVQLLRY

SEQ ID NO: 1075 - protein, 10 aa, Artificial Sequence
  Peptide Derived from Human Papillomavirus
PVYAINDENW

SEQ ID NO: 1076 - protein, 10 aa, Artificial Sequence
  Peptide Derived from Human Papillomavirus
QLLRYQNIEF

SEQ ID NO: 1077 - protein, 8 aa, Artificial Sequence
  Peptide Derived from Human Papillomavirus
QTCALYWF

SEQ ID NO: 1078 - protein, 11 aa, Artificial Sequence
  Peptide Derived from Human Papillomavirus
RLTVFEFKNPF

SEQ ID NO: 1079 - protein, 9 aa, Artificial Sequence
  Peptide Derived from Human Papillomavirus
RLTVLQHSF

SEQ ID NO: 1080 - protein, 8 aa, Artificial Sequence
  Peptide Derived from Human Papillomavirus
RSQTCALY

SEQ ID NO: 1081 - protein, 9 aa, Artificial Sequence
  Peptide Derived from Human Papillomavirus
RSQTCALYW

SEQ ID NO: 1082 - protein, 10 aa, Artificial Sequence
  Peptide Derived from Human Papillomavirus
RSQTCALYWF

SEQ ID NO: 1083 - protein, 10 aa, Artificial Sequence
  Peptide Derived from Human Papillomavirus
SINKNKECTY

SEQ ID NO: 1084 - protein, 10 aa, Artificial Sequence
  Peptide Derived from Human Papillomavirus
SSNTKANILY

SEQ ID NO: 1085 - protein, 11 aa, Artificial Sequence
  Peptide Derived from Human Papillomavirus
TSCTDWCITGY

SEQ ID NO: 1086 - protein, 11 aa, Artificial Sequence
  Peptide Derived from Human Papillomavirus
TSINKNKECTY

SEQ ID NO: 1087 - protein, 9 aa, Artificial Sequence
  Peptide Derived from Human Papillomavirus
TVFEFKNPF

SEQ ID NO: 1088 - protein, 11 aa, Artificial Sequence
  Peptide Derived from Human Papillomavirus
TVFEFKNPFPF

SEQ ID NO: 1089 - protein, 11 aa, Artificial Sequence
  Peptide Derived from Human Papillomavirus
VISCVNSKSHF

SEQ ID NO: 1090 - protein, 9 aa, Artificial Sequence
  Peptide Derived from Human Papillomavirus
VLIKQHSLY

SEQ ID NO: 1091 - protein, 11 aa, Artificial Sequence
  Peptide Derived from Human Papillomavirus
VLQHSFNDNIF

SEQ ID NO: 1092 - protein, 8 aa, Artificial Sequence
  Peptide Derived from Human Papillomavirus
VTPISWTY

SEQ ID NO: 1093 - protein, 9 aa, Artificial Sequence
  Peptide Derived from Human Papillomavirus
YLHSRLTVF

SEQ ID NO: 1094 - protein, 11 aa, Artificial Sequence
  Peptide Derived from Human Papillomavirus
YLHSRLTVFEF

SEQ ID NO: 1095 - protein, 10 aa, Artificial Sequence
  Peptide Derived from Human Papillomavirus
ALETLSKSQY

SEQ ID NO: 1096 - protein, 11 aa, Artificial Sequence
  Peptide Derived from Human Papillomavirus
ALLYTAKQMGF

SEQ ID NO: 1097 - protein, 10 aa, Artificial Sequence
  Peptide Derived from Human Papillomavirus
AVQEKILDLY

SEQ ID NO: 1098 - protein, 9 aa, Artificial Sequence
  Peptide Derived from Human Papillomavirus
CLRYRLKPY

SEQ ID NO: 1099 - protein, 10 aa, Artificial Sequence
  Peptide Derived from Human Papillomavirus
CTMVTGKVDY

SEQ ID NO: 1100 - protein, 9 aa, Artificial Sequence
  Peptide Derived from Human Papillomavirus
DLPSQIEHW

SEQ ID NO: 1101 - protein, 10 aa, Artificial Sequence
  Peptide Derived from Human Papillomavirus
DTAQPLTKLF

SEQ ID NO: 1102 - protein, 10 aa, Artificial Sequence
  Peptide Derived from Human Papillomavirus
ELYSSMSSTW

SEQ ID NO: 1103 - protein, 10 aa, Artificial Sequence
  Peptide Derived from Human Papillomavirus
ESNSLKCLRY

SEQ ID NO: 1104 - protein, 8 aa, Artificial Sequence
  Peptide Derived from Human Papillomavirus
ETLSKSQY

SEQ ID NO: 1105 - protein, 11 aa, Artificial Sequence
  Peptide Derived from Human Papillomavirus
EVWLCEPPKCF

SEQ ID NO: 1106 - protein, 10 aa, Artificial Sequence
  Peptide Derived from Human Papillomavirus
FVTEQQQQMF

SEQ ID NO: 1107 - protein, 11 aa, Artificial Sequence
  Peptide Derived from Human Papillomavirus
KLIRMECALLY

SEQ ID NO: 1108 - protein, 9 aa, Artificial Sequence
  Peptide Derived from Human Papillomavirus
KSQYSTSQW

SEQ ID NO: 1109 - protein, 11 aa, Artificial Sequence
  Peptide Derived from Human Papillomavirus
KTDLPSQIEHW

SEQ ID NO: 1110 - protein, 8 aa, Artificial Sequence
  Peptide Derived from Human Papillomavirus
KVDYIGMY

SEQ ID NO: 1111 - protein, 9 aa, Artificial Sequence
  Peptide Derived from Human Papillomavirus
KVDYIGMYY

SEQ ID NO: 1112 - protein, 10 aa, Artificial Sequence
  Peptide Derived from Human Papillomavirus
LIRMECALLY

SEQ ID NO: 1113 - protein, 9 aa, Artificial Sequence
  Peptide Derived from Human Papillomavirus
LLASKTKAF

SEQ ID NO: 1114 - protein, 10 aa, Artificial Sequence
  Peptide Derived from Human Papillomavirus
LLYTAKQMGF

SEQ ID NO: 1115 - protein, 11 aa, Artificial Sequence
  Peptide Derived from Human Papillomavirus
LSKSQYSTSQW

SEQ ID NO: 1116 - protein, 8 aa, Artificial Sequence
  Peptide Derived from Human Papillomavirus
MVTGKVDY

SEQ ID NO: 1117 - protein, 11 aa, Artificial Sequence
  Peptide Derived from Human Papillomavirus
NSKNGIVTVTF

SEQ ID NO: 1118 - protein, 8 aa, Artificial Sequence
  Peptide Derived from Human Papillomavirus
NSLKCLRY

SEQ ID NO: 1119 - protein, 8 aa, Artificial Sequence
  Peptide Derived from Human Papillomavirus
NTMDYTNW

SEQ ID NO: 1120 - protein, 11 aa, Artificial Sequence
  Peptide Derived from Human Papillomavirus
PSLLASKTKAF

SEQ ID NO: 1121 - protein, 9 aa, Artificial Sequence
  Peptide Derived from Human Papillomavirus
PTVQISTGF

SEQ ID NO: 1122 - protein, 9 aa, Artificial Sequence
  Peptide Derived from Human Papillomavirus
RLKPYKELY

SEQ ID NO: 1123 - protein, 8 aa, Artificial Sequence
  Peptide Derived from Human Papillomavirus
RMECALLY

SEQ ID NO: 1124 - protein, 10 aa, Artificial Sequence
  Peptide Derived from Human Papillomavirus
SLLASKTKAF

SEQ ID NO: 1125 - protein, 8 aa, Artificial Sequence
  Peptide Derived from Human Papillomavirus
SMSSTWHW

SEQ ID NO: 1126 - protein, 9 aa, Artificial Sequence
  Peptide Derived from Human Papillomavirus
SSMSSTWHW

SEQ ID NO: 1127 - protein, 10 aa, Artificial Sequence
  Peptide Derived from Human Papillomavirus
TLQQTSLEVW

SEQ ID NO: 1128 - protein, 11 aa, Artificial Sequence
  Peptide Derived from Human Papillomavirus
TMDYTNWGEIY

SEQ ID NO: 1129 - protein, 9 aa, Artificial Sequence
  Peptide Derived from Human Papillomavirus
TMVTGKVDY

SEQ ID NO: 1130 - protein, 8 aa, Artificial Sequence
  Peptide Derived from Human Papillomavirus
TVQISTGF

SEQ ID NO: 1131 - protein, 9 aa, Artificial Sequence
  Peptide Derived from Human Papillomavirus
VTEQQQQMF

SEQ ID NO: 1132 - protein, 11 aa, Artificial Sequence
  Peptide Derived from Human Papillomavirus
VTGKVDYIGMY

SEQ ID NO: 1133 - protein, 9 aa, Artificial Sequence
  Peptide Derived from Human Papillomavirus
WLCEPPKCF

SEQ ID NO: 1134 - protein, 11 aa, Artificial Sequence
  Peptide Derived from Human Papillomavirus
WTLQQTSLEVW

SEQ ID NO: 1135 - protein, 9 aa, Artificial Sequence
  Peptide Derived from Human Papillomavirus
YIHNCEKVY

SEQ ID NO: 1136 - protein, 10 aa, Artificial Sequence
  Peptide Derived from Human Papillomavirus
YIHNCEKVYF

SEQ ID NO: 1137 - protein, 8 aa, Artificial Sequence
  Peptide Derived from Human Papillomavirus
YSSMSSTW

SEQ ID NO: 1138 - protein, 10 aa, Artificial Sequence
  Peptide Derived from Human Papillomavirus
YSSMSSTWHW

SEQ ID NO: 1139 - protein, 8 aa, Artificial Sequence
  Peptide Derived from Human Papillomavirus
YTAKQMGF

SEQ ID NO: 1140 - protein, 8 aa, Artificial Sequence
  Peptide Derived from Human Papillomavirus
YTNWGEIY

SEQ ID NO: 1141 - protein, 11 aa, Artificial Sequence
  Peptide Derived from Human Papillomavirus
FLYLPMMCINF

SEQ ID NO: 1142 - protein, 10 aa, Artificial Sequence
  Peptide Derived from Human Papillomavirus
FVFVLCFILF

SEQ ID NO: 1143 - protein, 9 aa, Artificial Sequence
  Peptide Derived from Human Papillomavirus
FVGSPLKIF

SEQ ID NO: 1144 - protein, 10 aa, Artificial Sequence
  Peptide Derived from Human Papillomavirus
FVGSPLKIFF

SEQ ID NO: 1145 - protein, 8 aa, Artificial Sequence
  Peptide Derived from Human Papillomavirus
FVLCFILF

SEQ ID NO: 1146 - protein, 8 aa, Artificial Sequence
  Peptide Derived from Human Papillomavirus
GSPLKIFF

SEQ ID NO: 1147 - protein, 10 aa, Artificial Sequence
  Peptide Derived from Human Papillomavirus
GSPLKIFFCY

SEQ ID NO: 1148 - protein, 9 aa, Artificial Sequence
  Peptide Derived from Human Papillomavirus
ILSISTYAW

SEQ ID NO: 1149 - protein, 9 aa, Artificial Sequence
  Peptide Derived from Human Papillomavirus
KIFFCYLLF

SEQ ID NO: 1150 - protein, 11 aa, Artificial Sequence
  Peptide Derived from Human Papillomavirus
KIFFCYLLFLY

SEQ ID NO: 1151 - protein, 8 aa, Artificial Sequence
  Peptide Derived from Human Papillomavirus
LILSISTY

SEQ ID NO: 1152 - protein, 10 aa, Artificial Sequence
  Peptide Derived from Human Papillomavirus
LILSISTYAW

SEQ ID NO: 1153 - protein, 9 aa, Artificial Sequence
  Peptide Derived from Human Papillomavirus
LLVLVLLLW

SEQ ID NO: 1154 - protein, 11 aa, Artificial Sequence
  Peptide Derived from Human Papillomavirus
LLVLVLLLWVF

SEQ ID NO: 1155 - protein, 8 aa, Artificial Sequence
  Peptide Derived from Human Papillomavirus
LSISTYAW

SEQ ID NO: 1156 - protein, 8 aa, Artificial Sequence
  Peptide Derived from Human Papillomavirus
LVLLLWVF

SEQ ID NO: 1157 - protein, 8 aa, Artificial Sequence
  Peptide Derived from Human Papillomavirus
LVLVLLLW

SEQ ID NO: 1158 - protein, 10 aa, Artificial Sequence
  Peptide Derived from Human Papillomavirus
LVLVLLLWVF

SEQ ID NO: 1159 - protein, 9 aa, Artificial Sequence
  Peptide Derived from Human Papillomavirus
MIFVFVLCF

SEQ ID NO: 1160 - protein, 9 aa, Artificial Sequence
  Peptide Derived from Human Papillomavirus
PLILSISTY

SEQ ID NO: 1161 - protein, 11 aa, Artificial Sequence
  Peptide Derived from Human Papillomavirus
PLILSISTYAW

SEQ ID NO: 1162 - protein, 8 aa, Artificial Sequence
  Peptide Derived from Human Papillomavirus
PLKIFFCY

SEQ ID NO: 1163 - protein, 11 aa, Artificial Sequence
  Peptide Derived from Human Papillomavirus
PLKIFFCYLLF

SEQ ID NO: 1164 - protein, 9 aa, Artificial Sequence
  Peptide Derived from Human Papillomavirus
VLVLLLWVF

SEQ ID NO: 1165 - protein, 10 aa, Artificial Sequence
  Peptide Derived from Human Papillomavirus
WLLVLVLLLW

SEQ ID NO: 1166 - protein, 11 aa, Artificial Sequence
  Peptide Derived from Human Papillomavirus
WVFVGSPLKIF

SEQ ID NO: 1167 - protein, 9 aa, Artificial Sequence
  Peptide Derived from Human Papillomavirus
YLPMMCINF

SEQ ID NO: 1168 - protein, 11 aa, Artificial Sequence
  Peptide Derived from Human Papillomavirus
CLRFLSKISEY

SEQ ID NO: 1169 - protein, 8 aa, Artificial Sequence
  Peptide Derived from Human Papillomavirus
FLSKISEY

SEQ ID NO: 1170 - protein, 11 aa, Artificial Sequence
  Peptide Derived from Human Papillomavirus
FLSKISEYRHY

SEQ ID NO: 1171 - protein, 9 aa, Artificial Sequence
  Peptide Derived from Human Papillomavirus
GICKLCLRF

SEQ ID NO: 1172 - protein, 8 aa, Artificial Sequence
  Peptide Derived from Human Papillomavirus
HVDLNKRF

SEQ ID NO: 1173 - protein, 9 aa, Artificial Sequence
  Peptide Derived from Human Papillomavirus
ISEYRHYNY

SEQ ID NO: 1174 - protein, 8 aa, Artificial Sequence
  Peptide Derived from Human Papillomavirus
KISEYRHY

SEQ ID NO: 1175 - protein, 10 aa, Artificial Sequence
  Peptide Derived from Human Papillomavirus
KISEYRHYNY

SEQ ID NO: 1176 - protein, 10 aa, Artificial Sequence
  Peptide Derived from Human Papillomavirus
LSKISEYRHY

SEQ ID NO: 1177 - protein, 11 aa, Artificial Sequence
  Peptide Derived from Human Papillomavirus
LTVVYREGNPF

SEQ ID NO: 1178 - protein, 8 aa, Artificial Sequence
  Peptide Derived from Human Papillomavirus
PLQRSEVY

SEQ ID NO: 1179 - protein, 10 aa, Artificial Sequence
  Peptide Derived from Human Papillomavirus
PLQRSEVYDF

SEQ ID NO: 1180 - protein, 9 aa, Artificial Sequence
  Peptide Derived from Human Papillomavirus
RSEVYDFAF

SEQ ID NO: 1181 - protein, 10 aa, Artificial Sequence
  Peptide Derived from Human Papillomavirus
TVVYREGNPF

SEQ ID NO: 1182 - protein, 9 aa, Artificial Sequence
  Peptide Derived from Human Papillomavirus
VVYREGNPF

SEQ ID NO: 1183 - protein, 10 aa, Artificial Sequence
  Peptide Derived from Human Papillomavirus
DLYPEPTDLY

SEQ ID NO: 1184 - protein, 11 aa, Artificial Sequence
  Peptide Derived from Human Papillomavirus
PTLKEYVLDLY

SEQ ID NO: 1185 - protein, 10 aa, Artificial Sequence
  Peptide Derived from Human Papillomavirus
TLKEYVLDLY

SEQ ID NO: 1186 - protein, 10 aa, Artificial Sequence
  Peptide Derived from Human Papillomavirus
AMNPDILEDW

SEQ ID NO: 1187 - protein, 8 aa, Artificial Sequence
  Peptide Derived from Human Papillomavirus
ASIQSSAF

SEQ ID NO: 1188 - protein, 9 aa, Artificial Sequence
  Peptide Derived from Human Papillomavirus
ASIQSSAFF

SEQ ID NO: 1189 - protein, 9 aa, Artificial Sequence
  Peptide Derived from Human Papillomavirus
ASLQDTYRF

SEQ ID NO: 1190 - protein, 10 aa, Artificial Sequence
  Peptide Derived from Human Papillomavirus
CTQVTSDSTY

SEQ ID NO: 1191 - protein, 9 aa, Artificial Sequence
  Peptide Derived from Human Papillomavirus
DICGSTCKY

SEQ ID NO: 1192 - protein, 8 aa, Artificial Sequence
  Peptide Derived from Human Papillomavirus
DILEDWQF

SEQ ID NO: 1193 - protein, 11 aa, Artificial Sequence
  Peptide Derived from Human Papillomavirus
DLDQFPLGRKF

SEQ ID NO: 1194 - protein, 9 aa, Artificial Sequence
  Peptide Derived from Human Papillomavirus
DSTYKNENF

SEQ ID NO: 1195 - protein, 8 aa, Artificial Sequence
  Peptide Derived from Human Papillomavirus
DTETGNKY

SEQ ID NO: 1196 - protein, 9 aa, Artificial Sequence
  Peptide Derived from Human Papillomavirus
DTGFGCMDF

SEQ ID NO: 1197 - protein, 9 aa, Artificial Sequence
  Peptide Derived from Human Papillomavirus
ESQLFNKPY

SEQ ID NO: 1198 - protein, 10 aa, Artificial Sequence
  Peptide Derived from Human Papillomavirus
ESQLFNKPYW

SEQ ID NO: 1199 - protein, 8 aa, Artificial Sequence
  Peptide Derived from Human Papillomavirus
EVDLKEKF

SEQ ID NO: 1200 - protein, 8 aa, Artificial Sequence
  Peptide Derived from Human Papillomavirus
FLRREQMF

SEQ ID NO: 1201 - protein, 8 aa, Artificial Sequence
  Peptide Derived from Human Papillomavirus
FSADLDQF

SEQ ID NO: 1202 - protein, 9 aa, Artificial Sequence
  Peptide Derived from Human Papillomavirus
GICWGNQVF

SEQ ID NO: 1203 - protein, 11 aa, Artificial Sequence
  Peptide Derived from Human Papillomavirus
GISGHPLLNKF

SEQ ID NO: 1204 - protein, 11 aa, Artificial Sequence
  Peptide Derived from Human Papillomavirus
GSMVTSESQLF

SEQ ID NO: 1205 - protein, 9 aa, Artificial Sequence
  Peptide Derived from Human Papillomavirus
GSTCKYPDY

SEQ ID NO: 1206 - protein, 11 aa, Artificial Sequence
  Peptide Derived from Human Papillomavirus
GTTASIQSSAF

SEQ ID NO: 1207 - protein, 9 aa, Artificial Sequence
  Peptide Derived from Human Papillomavirus
HVEEYDLQF

SEQ ID NO: 1208 - protein, 11 aa, Artificial Sequence
  Peptide Derived from Human Papillomavirus
HVEEYDLQFVF

SEQ ID NO: 1209 - protein, 10 aa, Artificial Sequence
  Peptide Derived from Human Papillomavirus
ISGHPLLNKF

SEQ ID NO: 1210 - protein, 10 aa, Artificial Sequence
  Peptide Derived from Human Papillomavirus
KVSGLQYRVF

SEQ ID NO: 1211 - protein, 11 aa, Artificial Sequence
  Peptide Derived from Human Papillomavirus
KVTLTAEVMTY

SEQ ID NO: 1212 - protein, 8 aa, Artificial Sequence
  Peptide Derived from Human Papillomavirus
KVVSTDEY

SEQ ID NO: 1213 - protein, 8 aa, Artificial Sequence
  Peptide Derived from Human Papillomavirus
LLAVGHPY

SEQ ID NO: 1214 - protein, 9 aa, Artificial Sequence
  Peptide Derived from Human Papillomavirus
LLAVGHPYF

SEQ ID NO: 1215 - protein, 11 aa, Artificial Sequence
  Peptide Derived from Human Papillomavirus
LLVPKVSGLQY

SEQ ID NO: 1216 - protein, 8 aa, Artificial Sequence
  Peptide Derived from Human Papillomavirus
LTAEVMTY

SEQ ID NO: 1217 - protein, 10 aa, Artificial Sequence
  Peptide Derived from Human Papillomavirus
LVPKVSGLQY

SEQ ID NO: 1218 - protein, 11 aa, Artificial Sequence
  Peptide Derived from Human Papillomavirus
MTSEPYGDSLF

SEQ ID NO: 1219 - protein, 11 aa, Artificial Sequence
  Peptide Derived from Human Papillomavirus
MVDTGFGCMDF

SEQ ID NO: 1220 - protein, 9 aa, Artificial Sequence
  Peptide Derived from Human Papillomavirus
MVTSESQLF

SEQ ID NO: 1221 - protein, 11 aa, Artificial Sequence
  Peptide Derived from Human Papillomavirus
PIDICGSTCKY

SEQ ID NO: 1222 - protein, 8 aa, Artificial Sequence
  Peptide Derived from Human Papillomavirus
PLGKYTFW

SEQ ID NO: 1223 - protein, 9 aa, Artificial Sequence
  Peptide Derived from Human Papillomavirus
PSASLQDTY

SEQ ID NO: 1224 - protein, 11 aa, Artificial Sequence
  Peptide Derived from Human Papillomavirus
PSASLQDTYRF

SEQ ID NO: 1225 - protein, 11 aa, Artificial Sequence
  Peptide Derived from Human Papillomavirus
PVSKVVSTDEY

SEQ ID NO: 1226 - protein, 8 aa, Artificial Sequence
  Peptide Derived from Human Papillomavirus
QLFNKPYW

SEQ ID NO: 1227 - protein, 8 aa, Artificial Sequence
  Peptide Derived from Human Papillomavirus
QMFVRHFF

SEQ ID NO: 1228 - protein, 8 aa, Artificial Sequence
  Peptide Derived from Human Papillomavirus
QVTSDSTY

SEQ ID NO: 1229 - protein, 9 aa, Artificial Sequence
  Peptide Derived from Human Papillomavirus
RLLAVGHPY

SEQ ID NO: 1230 - protein, 10 aa, Artificial Sequence
  Peptide Derived from Human Papillomavirus
RLLAVGHPYF

SEQ ID NO: 1231 - protein, 8 aa, Artificial Sequence
  Peptide Derived from Human Papillomavirus
RLPDPNKF

SEQ ID NO: 1232 - protein, 10 aa, Artificial Sequence
  Peptide Derived from Human Papillomavirus
RLPDPNKFGF

SEQ ID NO: 1233 - protein, 10 aa, Artificial Sequence
  Peptide Derived from Human Papillomavirus
RVRLPDPNKF

SEQ ID NO: 1234 - protein, 8 aa, Artificial Sequence
  Peptide Derived from Human Papillomavirus
SIQSSAFF

SEQ ID NO: 1235 - protein, 8 aa, Artificial Sequence
  Peptide Derived from Human Papillomavirus
SLQDTYRF

SEQ ID NO: 1236 - protein, 10 aa, Artificial Sequence
  Peptide Derived from Human Papillomavirus
SMVTSESQLF

SEQ ID NO: 1237 - protein, 11 aa, Artificial Sequence
  Peptide Derived from Human Papillomavirus
SSRLLAVGHPY

SEQ ID NO: 1238 - protein, 8 aa, Artificial Sequence
  Peptide Derived from Human Papillomavirus
STCKYPDY

SEQ ID NO: 1239 - protein, 8 aa, Artificial Sequence
  Peptide Derived from Human Papillomavirus
STYKNENF

SEQ ID NO: 1240 - protein, 11 aa, Artificial Sequence
  Peptide Derived from Human Papillomavirus
STYKNENFKEY

SEQ ID NO: 1241 - protein, 11 aa, Artificial Sequence
  Peptide Derived from Human Papillomavirus
SVWRPSEATVY

SEQ ID NO: 1242 - protein, 11 aa, Artificial Sequence
  Peptide Derived from Human Papillomavirus
TLGEAVPDDLY

SEQ ID NO: 1243 - protein, 9 aa, Artificial Sequence
  Peptide Derived from Human Papillomavirus
TLTAEVMTY

SEQ ID NO: 1244 - protein, 11 aa, Artificial Sequence
  Peptide Derived from Human Papillomavirus
TSDSTYKNENF

SEQ ID NO: 1245 - protein, 10 aa, Artificial Sequence
  Peptide Derived from Human Papillomavirus
TSEPYGDSLF

SEQ ID NO: 1246 - protein, 11 aa, Artificial Sequence
  Peptide Derived from Human Papillomavirus
TSEPYGDSLFF

SEQ ID NO: 1247 - protein, 11 aa, Artificial Sequence
  Peptide Derived from Human Papillomavirus
TSESQLFNKPY

SEQ ID NO: 1248 - protein, 10 aa, Artificial Sequence
  Peptide Derived from Human Papillomavirus
TTASIQSSAF

SEQ ID NO: 1249 - protein, 11 aa, Artificial Sequence
  Peptide Derived from Human Papillomavirus
TTASIQSSAFF

SEQ ID NO: 1250 - protein, 9 aa, Artificial Sequence
  Peptide Derived from Human Papillomavirus
VSGLQYRVF

SEQ ID NO: 1251 - protein, 10 aa, Artificial Sequence
  Peptide Derived from Human Papillomavirus
VSKVVSTDEY

SEQ ID NO: 1252 - protein, 8 aa, Artificial Sequence
  Peptide Derived from Human Papillomavirus
VSRTSIYY

SEQ ID NO: 1253 - protein, 9 aa, Artificial Sequence
  Peptide Derived from Human Papillomavirus
VSRTSIYYY

SEQ ID NO: 1254 - protein, 10 aa, Artificial Sequence
  Peptide Derived from Human Papillomavirus
VTLTAEVMTY

SEQ ID NO: 1255 - protein, 8 aa, Artificial Sequence
  Peptide Derived from Human Papillomavirus
VTSESQLF

SEQ ID NO: 1256 - protein, 8 aa, Artificial Sequence
  Peptide Derived from Human Papillomavirus
YIRHVEEY

SEQ ID NO: 1257 - protein, 9 aa, Artificial Sequence
  Peptide Derived from Human Papillomavirus
YLKMTSEPY

SEQ ID NO: 1258 - protein, 8 aa, Artificial Sequence
  Peptide Derived from Human Papillomavirus
YVSRTSIY

SEQ ID NO: 1259 - protein, 9 aa, Artificial Sequence
  Peptide Derived from Human Papillomavirus
YVSRTSIYY

SEQ ID NO: 1260 - protein, 10 aa, Artificial Sequence
  Peptide Derived from Human Papillomavirus
YVSRTSIYYY

SEQ ID NO: 1261 - protein, 11 aa, Artificial Sequence
  Peptide Derived from Human Papillomavirus
AITSRRHTVRF

SEQ ID NO: 1262 - protein, 10 aa, Artificial Sequence
  Peptide Derived from Human Papillomavirus
DISPAPDPDF

SEQ ID NO: 1263 - protein, 10 aa, Artificial Sequence
  Peptide Derived from Human Papillomavirus
DTIVVDGADF

SEQ ID NO: 1264 - protein, 11 aa, Artificial Sequence
  Peptide Derived from Human Papillomavirus
ESFDPEDTLQF

SEQ ID NO: 1265 - protein, 10 aa, Artificial Sequence
  Peptide Derived from Human Papillomavirus
FILRRRRKRF

SEQ ID NO: 1266 - protein, 11 aa, Artificial Sequence
  Peptide Derived from Human Papillomavirus
FLTSPHKLITY

SEQ ID NO: 1267 - protein, 11 aa, Artificial Sequence
  Peptide Derived from Human Papillomavirus
FSSPTVSTQSY

SEQ ID NO: 1268 - protein, 8 aa, Artificial Sequence
  Peptide Derived from Human Papillomavirus
FVLHPSYF

SEQ ID NO: 1269 - protein, 8 aa, Artificial Sequence
  Peptide Derived from Human Papillomavirus
FVPISPFF

SEQ ID NO: 1270 - protein, 10 aa, Artificial Sequence
  Peptide Derived from Human Papillomavirus
FVPISPFFPF

SEQ ID NO: 1271 - protein, 8 aa, Artificial Sequence
  Peptide Derived from Human Papillomavirus
GSGGRTGY

SEQ ID NO: 1272 - protein, 10 aa, Artificial Sequence
  Peptide Derived from Human Papillomavirus
GSGSGGRTGY

SEQ ID NO: 1273 - protein, 11 aa, Artificial Sequence
  Peptide Derived from Human Papillomavirus
GSRPVARLGLY

SEQ ID NO: 1274 - protein, 11 aa, Artificial Sequence
  Peptide Derived from Human Papillomavirus
GSTIADQILKY

SEQ ID NO: 1275 - protein, 8 aa, Artificial Sequence
  Peptide Derived from Human Papillomavirus
HTPMQHSY

SEQ ID NO: 1276 - protein, 11 aa, Artificial Sequence
  Peptide Derived from Human Papillomavirus
HTPMQHSYSTF

SEQ ID NO: 1277 - protein, 8 aa, Artificial Sequence
  Peptide Derived from Human Papillomavirus
HTVPNEQY

SEQ ID NO: 1278 - protein, 10 aa, Artificial Sequence
  Peptide Derived from Human Papillomavirus
ILKYGSLGVF

SEQ ID NO: 1279 - protein, 11 aa, Artificial Sequence
  Peptide Derived from Human Papillomavirus
ILKYGSLGVFF

SEQ ID NO: 1280 - protein, 9 aa, Artificial Sequence
  Peptide Derived from Human Papillomavirus
ILRRRRKRF

SEQ ID NO: 1281 - protein, 11 aa, Artificial Sequence
  Peptide Derived from Human Papillomavirus
ILRRRRKRFPY

SEQ ID NO: 1282 - protein, 9 aa, Artificial Sequence
  Peptide Derived from Human Papillomavirus
ISPAPDPDF

SEQ ID NO: 1283 - protein, 9 aa, Artificial Sequence
  Peptide Derived from Human Papillomavirus
ISTHLNPTF

SEQ ID NO: 1284 - protein, 10 aa, Artificial Sequence
  Peptide Derived from Human Papillomavirus
ITSRRHTVRF

SEQ ID NO: 1285 - protein, 8 aa, Artificial Sequence
  Peptide Derived from Human Papillomavirus
ITYDNPAF

SEQ ID NO: 1286 - protein, 11 aa, Artificial Sequence
  Peptide Derived from Human Papillomavirus
ITYDNPAFESF

SEQ ID NO: 1287 - protein, 10 aa, Artificial Sequence
  Peptide Derived from Human Papillomavirus
IVSLIEETSF

SEQ ID NO: 1288 - protein, 8 aa, Artificial Sequence
  Peptide Derived from Human Papillomavirus
IVVDGADF

SEQ ID NO: 1289 - protein, 10 aa, Artificial Sequence
  Peptide Derived from Human Papillomavirus
KLITYDNPAF

SEQ ID NO: 1290 - protein, 9 aa, Artificial Sequence
  Peptide Derived from Human Papillomavirus
LITYDNPAF

SEQ ID NO: 1291 - protein, 10 aa, Artificial Sequence
  Peptide Derived from Human Papillomavirus
LTSPHKLITY

SEQ ID NO: 1292 - protein, 11 aa, Artificial Sequence
  Peptide Derived from Human Papillomavirus
MSGPDIPSPLF

SEQ ID NO: 1293 - protein, 10 aa, Artificial Sequence
  Peptide Derived from Human Papillomavirus
NVHTPMQHSY

SEQ ID NO: 1294 - protein, 10 aa, Artificial Sequence
  Peptide Derived from Human Papillomavirus
NVSIPLNTGF

SEQ ID NO: 1295 - protein, 8 aa, Artificial Sequence
  Peptide Derived from Human Papillomavirus
PISPFFPF

SEQ ID NO: 1296 - protein, 11 aa, Artificial Sequence
  Peptide Derived from Human Papillomavirus
PLDHTVPNEQY

SEQ ID NO: 1297 - protein, 9 aa, Artificial Sequence
  Peptide Derived from Human Papillomavirus
PLFPTSSPF

SEQ ID NO: 1298 - protein, 10 aa, Artificial Sequence
  Peptide Derived from Human Papillomavirus
PLHDTSTSSY

SEQ ID NO: 1299 - protein, 9 aa, Artificial Sequence
  Peptide Derived from Human Papillomavirus
PMQHSYSTF

SEQ ID NO: 1300 - protein, 9 aa, Artificial Sequence
  Peptide Derived from Human Papillomavirus
PSIPTPSGF

SEQ ID NO: 1301 - protein, 11 aa, Artificial Sequence
  Peptide Derived from Human Papillomavirus
PSPLFPTSSPF

SEQ ID NO: 1302 - protein, 8 aa, Artificial Sequence
  Peptide Derived from Human Papillomavirus
PTVSTQSY

SEQ ID NO: 1303 - protein, 8 aa, Artificial Sequence
  Peptide Derived from Human Papillomavirus
PVARLGLY

SEQ ID NO: 1304 - protein, 8 aa, Artificial Sequence
  Peptide Derived from Human Papillomavirus
QIGARIHY

SEQ ID NO: 1305 - protein, 9 aa, Artificial Sequence
  Peptide Derived from Human Papillomavirus
QIGARIHYY

SEQ ID NO: 1306 - protein, 11 aa, Artificial Sequence
  Peptide Derived from Human Papillomavirus
QILKYGSLGVF

SEQ ID NO: 1307 - protein, 11 aa, Artificial Sequence
  Peptide Derived from Human Papillomavirus
QSYENIPMDTF

SEQ ID NO: 1308 - protein, 11 aa, Artificial Sequence
  Peptide Derived from Human Papillomavirus
QTISTHLNPTF

SEQ ID NO: 1309 - protein, 9 aa, Artificial Sequence
  Peptide Derived from Human Papillomavirus
QVKVVDPAF

SEQ ID NO: 1310 - protein, 10 aa, Artificial Sequence
  Peptide Derived from Human Papillomavirus
SINDGLYDVY

SEQ ID NO: 1311 - protein, 8 aa, Artificial Sequence
  Peptide Derived from Human Papillomavirus
SIPLNTGF

SEQ ID NO: 1312 - protein, 8 aa, Artificial Sequence
  Peptide Derived from Human Papillomavirus
SIPTPSGF

SEQ ID NO: 1313 - protein, 11 aa, Artificial Sequence
  Peptide Derived from Human Papillomavirus
SIVSLIEETSF

SEQ ID NO: 1314 - protein, 8 aa, Artificial Sequence
  Peptide Derived from Human Papillomavirus
SLIEETSF

SEQ ID NO: 1315 - protein, 10 aa, Artificial Sequence
  Peptide Derived from Human Papillomavirus
SSPFVPISPF

SEQ ID NO: 1316 - protein, 11 aa, Artificial Sequence
  Peptide Derived from Human Papillomavirus
SSPFVPISPFF

SEQ ID NO: 1317 - protein, 10 aa, Artificial Sequence
  Peptide Derived from Human Papillomavirus
SSPTVSTQSY

SEQ ID NO: 1318 - protein, 10 aa, Artificial Sequence
  Peptide Derived from Human Papillomavirus
SSYSINDGLY

SEQ ID NO: 1319 - protein, 8 aa, Artificial Sequence
  Peptide Derived from Human Papillomavirus
STHLNPTF

SEQ ID NO: 1320 - protein, 10 aa, Artificial Sequence
  Peptide Derived from Human Papillomavirus
STIADQILKY

SEQ ID NO: 1321 - protein, 9 aa, Artificial Sequence
  Peptide Derived from Human Papillomavirus
TIADQILKY

SEQ ID NO: 1322 - protein, 10 aa, Artificial Sequence
  Peptide Derived from Human Papillomavirus
TISTHLNPTF

SEQ ID NO: 1323 - protein, 9 aa, Artificial Sequence
  Peptide Derived from Human Papillomavirus
TIVVDGADF

SEQ ID NO: 1324 - protein, 9 aa, Artificial Sequence
  Peptide Derived from Human Papillomavirus
TSPHKLITY

SEQ ID NO: 1325 - protein, 9 aa, Artificial Sequence
  Peptide Derived from Human Papillomavirus
TSRRHTVRF

SEQ ID NO: 1326 - protein, 11 aa, Artificial Sequence
  Peptide Derived from Human Papillomavirus
TSSPFVPISPF

SEQ ID NO: 1327 - protein, 11 aa, Artificial Sequence
  Peptide Derived from Human Papillomavirus
TSSYSINDGLY

SEQ ID NO: 1328 - protein, 9 aa, Artificial Sequence
  Peptide Derived from Human Papillomavirus
VSIPLNTGF

SEQ ID NO: 1329 - protein, 9 aa, Artificial Sequence
  Peptide Derived from Human Papillomavirus
VSLIEETSF

SEQ ID NO: 1330 - protein, 8 aa, Artificial Sequence
  Peptide Derived from Human Papillomavirus
YSINDGLY

SEQ ID NO: 1331 - protein, 11 aa, Artificial Sequence
  Peptide Derived from Human Papillomavirus
YSINDGLYDVY

SEQ ID NO: 1332 - protein, 10 aa, Artificial Sequence
  Peptide Derived from Human Papillomavirus
AMLAVFKDIY

SEQ ID NO: 1333 - protein, 11 aa, Artificial Sequence
  Peptide Derived from Human Papillomavirus
AMLDDATHTCW

SEQ ID NO: 1334 - protein, 11 aa, Artificial Sequence
  Peptide Derived from Human Papillomavirus
ATDTGSDMVDF

SEQ ID NO: 1335 - protein, 8 aa, Artificial Sequence
  Peptide Derived from Human Papillomavirus
ATHTCWTY

SEQ ID NO: 1336 - protein, 9 aa, Artificial Sequence
  Peptide Derived from Human Papillomavirus
ATHTCWTYF

SEQ ID NO: 1337 - protein, 11 aa, Artificial Sequence
  Peptide Derived from Human Papillomavirus
AVFKDIYGLSF

SEQ ID NO: 1338 - protein, 10 aa, Artificial Sequence
  Peptide Derived from Human Papillomavirus
CSKIDEGGDW

SEQ ID NO: 1339 - protein, 9 aa, Artificial Sequence
  Peptide Derived from Human Papillomavirus
CTDWVMAIF

SEQ ID NO: 1340 - protein, 8 aa, Artificial Sequence
  Peptide Derived from Human Papillomavirus
DLSDMVQW

SEQ ID NO: 1341 - protein, 10 aa, Artificial Sequence
  Peptide Derived from Human Papillomavirus
DLSDMVQWAF

SEQ ID NO: 1342 - protein, 10 aa, Artificial Sequence
  Peptide Derived from Human Papillomavirus
DLTDESDMAF

SEQ ID NO: 1343 - protein, 10 aa, Artificial Sequence
  Peptide Derived from Human Papillomavirus
DTEGIPFGTF

SEQ ID NO: 1344 - protein, 9 aa, Artificial Sequence
  Peptide Derived from Human Papillomavirus
DTGSDMVDF

SEQ ID NO: 1345 - protein, 10 aa, Artificial Sequence
  Peptide Derived from Human Papillomavirus
EINDKNWKCF

SEQ ID NO: 1346 - protein, 11 aa, Artificial Sequence
  Peptide Derived from Human Papillomavirus
EINDKNWKCFF

SEQ ID NO: 1347 - protein, 8 aa, Artificial Sequence
  Peptide Derived from Human Papillomavirus
ESDMAFQY

SEQ ID NO: 1348 - protein, 9 aa, Artificial Sequence
  Peptide Derived from Human Papillomavirus
ESRVTVFTF

SEQ ID NO: 1349 - protein, 9 aa, Artificial Sequence
  Peptide Derived from Human Papillomavirus
EVSGDTPEW

SEQ ID NO: 1350 - protein, 11 aa, Artificial Sequence
  Peptide Derived from Human Papillomavirus
FISFLRALKEF

SEQ ID NO: 1351 - protein, 10 aa, Artificial Sequence
  Peptide Derived from Human Papillomavirus
FLKSNCQAKY

SEQ ID NO: 1352 - protein, 9 aa, Artificial Sequence
  Peptide Derived from Human Papillomavirus
FLQGAIISF

SEQ ID NO: 1353 - protein, 8 aa, Artificial Sequence
  Peptide Derived from Human Papillomavirus
FLRALKEF

SEQ ID NO: 1354 - protein, 9 aa, Artificial Sequence
  Peptide Derived from Human Papillomavirus
FLRYQGVEF

SEQ ID NO: 1355 - protein, 8 aa, Artificial Sequence
  Peptide Derived from Human Papillomavirus
FTDLVRNF

SEQ ID NO: 1356 - protein, 9 aa, Artificial Sequence
  Peptide Derived from Human Papillomavirus
FTFPHAFPF

SEQ ID NO: 1357 - protein, 8 aa, Artificial Sequence
  Peptide Derived from Human Papillomavirus
FTISDSGY

SEQ ID NO: 1358 - protein, 8 aa, Artificial Sequence
  Peptide Derived from Human Papillomavirus
FVNSNSHF

SEQ ID NO: 1359 - protein, 9 aa, Artificial Sequence
  Peptide Derived from Human Papillomavirus
FVNSNSHFW

SEQ ID NO: 1360 - protein, 11 aa, Artificial Sequence
  Peptide Derived from Human Papillomavirus
GLSFTDLVRNF

SEQ ID NO: 1361 - protein, 8 aa, Artificial Sequence
  Peptide Derived from Human Papillomavirus
GTGCNGWF

SEQ ID NO: 1362 - protein, 9 aa, Artificial Sequence
  Peptide Derived from Human Papillomavirus
GTGCNGWFF

SEQ ID NO: 1363 - protein, 11 aa, Artificial Sequence
  Peptide Derived from Human Papillomavirus
GTPKKNCILLY

SEQ ID NO: 1364 - protein, 10 aa, Artificial Sequence
  Peptide Derived from Human Papillomavirus
GVLILALLRY

SEQ ID NO: 1365 - protein, 10 aa, Artificial Sequence
  Peptide Derived from Human Papillomavirus
GVNPTVAEGF

SEQ ID NO: 1366 - protein, 9 aa, Artificial Sequence
  Peptide Derived from Human Papillomavirus
HIQCLDCKW

SEQ ID NO: 1367 - protein, 10 aa, Artificial Sequence
  Peptide Derived from Human Papillomavirus
HTCWTYFDNY

SEQ ID NO: 1368 - protein, 11 aa, Artificial Sequence
  Peptide Derived from Human Papillomavirus
IIQHGIDDSNF

SEQ ID NO: 1369 - protein, 11 aa, Artificial Sequence
  Peptide Derived from Human Papillomavirus
IISFVNSNSHF

SEQ ID NO: 1370 - protein, 11 aa, Artificial Sequence
  Peptide Derived from Human Papillomavirus
ISEVSGDTPEW

SEQ ID NO: 1371 - protein, 10 aa, Artificial Sequence
  Peptide Derived from Human Papillomavirus
ISFLRALKEF

SEQ ID NO: 1372 - protein, 10 aa, Artificial Sequence
  Peptide Derived from Human Papillomavirus
ISFVNSNSHF

SEQ ID NO: 1373 - protein, 11 aa, Artificial Sequence
  Peptide Derived from Human Papillomavirus
ISFVNSNSHFW

SEQ ID NO: 1374 - protein, 8 aa, Artificial Sequence
  Peptide Derived from Human Papillomavirus
KIDEGGDW

SEQ ID NO: 1375 - protein, 10 aa, Artificial Sequence
  Peptide Derived from Human Papillomavirus
KLRSSVAALY

SEQ ID NO: 1376 - protein, 11 aa, Artificial Sequence
  Peptide Derived from Human Papillomavirus
KLRSSVAALYW

SEQ ID NO: 1377 - protein, 10 aa, Artificial Sequence
  Peptide Derived from Human Papillomavirus
KSDKTTCTDW

SEQ ID NO: 1378 - protein, 8 aa, Artificial Sequence
  Peptide Derived from Human Papillomavirus
KSNCQAKY

SEQ ID NO: 1379 - protein, 8 aa, Artificial Sequence
  Peptide Derived from Human Papillomavirus
KSYFGMSF

SEQ ID NO: 1380 - protein, 11 aa, Artificial Sequence
  Peptide Derived from Human Papillomavirus
KSYFGMSFIHF

SEQ ID NO: 1381 - protein, 10 aa, Artificial Sequence
  Peptide Derived from Human Papillomavirus
KTLIKPATLY

SEQ ID NO: 1382 - protein, 8 aa, Artificial Sequence
  Peptide Derived from Human Papillomavirus
LIKPATLY

SEQ ID NO: 1383 - protein, 8 aa, Artificial Sequence
  Peptide Derived from Human Papillomavirus
LILALLRY

SEQ ID NO: 1384 - protein, 9 aa, Artificial Sequence
  Peptide Derived from Human Papillomavirus
LSDMVQWAF

SEQ ID NO: 1385 - protein, 10 aa, Artificial Sequence
  Peptide Derived from Human Papillomavirus
LSFTDLVRNF

SEQ ID NO: 1386 - protein, 9 aa, Artificial Sequence
  Peptide Derived from Human Papillomavirus
LTDESDMAF

SEQ ID NO: 1387 - protein, 11 aa, Artificial Sequence
  Peptide Derived from Human Papillomavirus
LTDESDMAFQY

SEQ ID NO: 1388 - protein, 9 aa, Artificial Sequence
  Peptide Derived from Human Papillomavirus
MLAVFKDIY

SEQ ID NO: 1389 - protein, 10 aa, Artificial Sequence
  Peptide Derived from Human Papillomavirus
MLDDATHTCW

SEQ ID NO: 1390 - protein, 10 aa, Artificial Sequence
  Peptide Derived from Human Papillomavirus
NIDPAKDNKW

SEQ ID NO: 1391 - protein, 8 aa, Artificial Sequence
  Peptide Derived from Human Papillomavirus
NMSQWIKY

SEQ ID NO: 1392 - protein, 11 aa, Artificial Sequence
  Peptide Derived from Human Papillomavirus
NTGKSYFGMSF

SEQ ID NO: 1393 - protein, 8 aa, Artificial Sequence
  Peptide Derived from Human Papillomavirus
PIVQFLRY

SEQ ID NO: 1394 - protein, 10 aa, Artificial Sequence
  Peptide Derived from Human Papillomavirus
PVYEINDKNW

SEQ ID NO: 1395 - protein, 10 aa, Artificial Sequence
  Peptide Derived from Human Papillomavirus
QMNMSQWIKY

SEQ ID NO: 1396 - protein, 10 aa, Artificial Sequence
  Peptide Derived from Human Papillomavirus
QVLHLLKRKF

SEQ ID NO: 1397 - protein, 10 aa, Artificial Sequence
  Peptide Derived from Human Papillomavirus
RLFTISDSGY

SEQ ID NO: 1398 - protein, 8 aa, Artificial Sequence
  Peptide Derived from Human Papillomavirus
RSSVAALY

SEQ ID NO: 1399 - protein, 9 aa, Artificial Sequence
  Peptide Derived from Human Papillomavirus
RSSVAALYW

SEQ ID NO: 1400 - protein, 10 aa, Artificial Sequence
  Peptide Derived from Human Papillomavirus
RSSVAALYWY

SEQ ID NO: 1401 - protein, 11 aa, Artificial Sequence
  Peptide Derived from Human Papillomavirus
RVTVFTFPHAF

SEQ ID NO: 1402 - protein, 8 aa, Artificial Sequence
  Peptide Derived from Human Papillomavirus
SSVAALYW

SEQ ID NO: 1403 - protein, 9 aa, Artificial Sequence
  Peptide Derived from Human Papillomavirus
SSVAALYWY

SEQ ID NO: 1404 - protein, 8 aa, Artificial Sequence
  Peptide Derived from Human Papillomavirus
SVAALYWY

SEQ ID NO: 1405 - protein, 9 aa, Artificial Sequence
  Peptide Derived from Human Papillomavirus
TLIKPATLY

SEQ ID NO: 1406 - protein, 11 aa, Artificial Sequence
  Peptide Derived from Human Papillomavirus
TTCTDWVMAIF

SEQ ID NO: 1407 - protein, 9 aa, Artificial Sequence
  Peptide Derived from Human Papillomavirus
TVFTFPHAF

SEQ ID NO: 1408 - protein, 11 aa, Artificial Sequence
  Peptide Derived from Human Papillomavirus
TVFTFPHAFPF

SEQ ID NO: 1409 - protein, 9 aa, Artificial Sequence
  Peptide Derived from Human Papillomavirus
VLHLLKRKF

SEQ ID NO: 1410 - protein, 9 aa, Artificial Sequence
  Peptide Derived from Human Papillomavirus
VLILALLRY

SEQ ID NO: 1411 - protein, 8 aa, Artificial Sequence
  Peptide Derived from Human Papillomavirus
VSGDTPEW

SEQ ID NO: 1412 - protein, 10 aa, Artificial Sequence
  Peptide Derived from Human Papillomavirus
VTVFTFPHAF

SEQ ID NO: 1413 - protein, 9 aa, Artificial Sequence
  Peptide Derived from Human Papillomavirus
YLESRVTVF

SEQ ID NO: 1414 - protein, 11 aa, Artificial Sequence
  Peptide Derived from Human Papillomavirus
YLESRVTVFTF

SEQ ID NO: 1415 - protein, 10 aa, Artificial Sequence
  Peptide Derived from Human Papillomavirus
ALKGLAQSKY

SEQ ID NO: 1416 - protein, 10 aa, Artificial Sequence
  Peptide Derived from Human Papillomavirus
ALQDKILDHY

SEQ ID NO: 1417 - protein, 9 aa, Artificial Sequence
  Peptide Derived from Human Papillomavirus
CLRYRLRKY

SEQ ID NO: 1418 - protein, 11 aa, Artificial Sequence
  Peptide Derived from Human Papillomavirus
CMNYVVWDSIY

SEQ ID NO: 1419 - protein, 8 aa, Artificial Sequence
  Peptide Derived from Human Papillomavirus
CVSYWGVY

SEQ ID NO: 1420 - protein, 9 aa, Artificial Sequence
  Peptide Derived from Human Papillomavirus
CVSYWGVYY

SEQ ID NO: 1421 - protein, 8 aa, Artificial Sequence
  Peptide Derived from Human Papillomavirus
DINSQISY

SEQ ID NO: 1422 - protein, 9 aa, Artificial Sequence
  Peptide Derived from Human Papillomavirus
DINSQISYW

SEQ ID NO: 1423 - protein, 11 aa, Artificial Sequence
  Peptide Derived from Human Papillomavirus
DSKDINSQISY

SEQ ID NO: 1424 - protein, 8 aa, Artificial Sequence
  Peptide Derived from Human Papillomavirus
DTTYYVQF

SEQ ID NO: 1425 - protein, 8 aa, Artificial Sequence
  Peptide Derived from Human Papillomavirus
EISSTWHW

SEQ ID NO: 1426 - protein, 11 aa, Artificial Sequence
  Peptide Derived from Human Papillomavirus
ELWNTEPSQCF

SEQ ID NO: 1427 - protein, 8 aa, Artificial Sequence
  Peptide Derived from Human Papillomavirus
KTAACVSY

SEQ ID NO: 1428 - protein, 9 aa, Artificial Sequence
  Peptide Derived from Human Papillomavirus
KTAACVSYW

SEQ ID NO: 1429 - protein, 10 aa, Artificial Sequence
  Peptide Derived from Human Papillomavirus
LIRLENAILF

SEQ ID NO: 1430 - protein, 9 aa, Artificial Sequence
  Peptide Derived from Human Papillomavirus
NSEVQRNTF

SEQ ID NO: 1431 - protein, 8 aa, Artificial Sequence
  Peptide Derived from Human Papillomavirus
NSLKCLRY

SEQ ID NO: 1432 - protein, 9 aa, Artificial Sequence
  Peptide Derived from Human Papillomavirus
NSNTWEVQY

SEQ ID NO: 1433 - protein, 9 aa, Artificial Sequence
  Peptide Derived from Human Papillomavirus
NSVQISVGY

SEQ ID NO: 1434 - protein, 8 aa, Artificial Sequence
  Peptide Derived from Human Papillomavirus
NTEPSQCF

SEQ ID NO: 1435 - protein, 9 aa, Artificial Sequence
  Peptide Derived from Human Papillomavirus
NTGILTVTY

SEQ ID NO: 1436 - protein, 11 aa, Artificial Sequence
  Peptide Derived from Human Papillomavirus
QLIRLENAILF

SEQ ID NO: 1437 - protein, 9 aa, Artificial Sequence
  Peptide Derived from Human Papillomavirus
QSKYNNEEW

SEQ ID NO: 1438 - protein, 8 aa, Artificial Sequence
  Peptide Derived from Human Papillomavirus
RLENAILF

SEQ ID NO: 1439 - protein, 9 aa, Artificial Sequence
  Peptide Derived from Human Papillomavirus
RLRKYADHY

SEQ ID NO: 1440 - protein, 11 aa, Artificial Sequence
  Peptide Derived from Human Papillomavirus
SIYYITETGIW

SEQ ID NO: 1441 - protein, 8 aa, Artificial Sequence
  Peptide Derived from Human Papillomavirus
SVQISVGY

SEQ ID NO: 1442 - protein, 10 aa, Artificial Sequence
  Peptide Derived from Human Papillomavirus
TLQDTCEELW

SEQ ID NO: 1443 - protein, 8 aa, Artificial Sequence
  Peptide Derived from Human Papillomavirus
VSYWGVYY

SEQ ID NO: 1444 - protein, 8 aa, Artificial Sequence
  Peptide Derived from Human Papillomavirus
VVWDSIYY

SEQ ID NO: 1445 - protein, 11 aa, Artificial Sequence
  Peptide Derived from Human Papillomavirus
WTLQDTCEELW

SEQ ID NO: 1446 - protein, 9 aa, Artificial Sequence
  Peptide Derived from Human Papillomavirus
YIKDGDTTY

SEQ ID NO: 1447 - protein, 10 aa, Artificial Sequence
  Peptide Derived from Human Papillomavirus
YIKDGDTTYY

SEQ ID NO: 1448 - protein, 8 aa, Artificial Sequence
  Peptide Derived from Human Papillomavirus
YITETGIW

SEQ ID NO: 1449 - protein, 8 aa, Artificial Sequence
  Peptide Derived from Human Papillomavirus
YSEISSTW

SEQ ID NO: 1450 - protein, 10 aa, Artificial Sequence
  Peptide Derived from Human Papillomavirus
YSEISSTWHW

SEQ ID NO: 1451 - protein, 11 aa, Artificial Sequence
  Peptide Derived from Human Papillomavirus
YVQFKSECEKY

SEQ ID NO: 1452 - protein, 8 aa, Artificial Sequence
  Peptide Derived from Human Papillomavirus
YVVWDSIY

SEQ ID NO: 1453 - protein, 9 aa, Artificial Sequence
  Peptide Derived from Human Papillomavirus
YVVWDSIYY

SEQ ID NO: 1454 - protein, 9 aa, Artificial Sequence
  Peptide Derived from Human Papillomavirus
ATLERTEVY

SEQ ID NO: 1455 - protein, 11 aa, Artificial Sequence
  Peptide Derived from Human Papillomavirus
ATLERTEVYQF

SEQ ID NO: 1456 - protein, 8 aa, Artificial Sequence
  Peptide Derived from Human Papillomavirus
DVSIACVY

SEQ ID NO: 1457 - protein, 10 aa, Artificial Sequence
  Peptide Derived from Human Papillomavirus
ELRYYSNSVY

SEQ ID NO: 1458 - protein, 11 aa, Artificial Sequence
  Peptide Derived from Human Papillomavirus
EVYQFAFKDLF

SEQ ID NO: 1459 - protein, 10 aa, Artificial Sequence
  Peptide Derived from Human Papillomavirus
FIVYRDCIAY

SEQ ID NO: 1460 - protein, 8 aa, Artificial Sequence
  Peptide Derived from Human Papillomavirus
HLKDKRRF

SEQ ID NO: 1461 - protein, 9 aa, Artificial Sequence
  Peptide Derived from Human Papillomavirus
IVYRDCIAY

SEQ ID NO: 1462 - protein, 8 aa, Artificial Sequence
  Peptide Derived from Human Papillomavirus
KITNTELY

SEQ ID NO: 1463 - protein, 8 aa, Artificial Sequence
  Peptide Derived from Human Papillomavirus
RIRELRYY

SEQ ID NO: 1464 - protein, 9 aa, Artificial Sequence
  Peptide Derived from Human Papillomavirus
RTEVYQFAF

SEQ ID NO: 1465 - protein, 11 aa, Artificial Sequence
  Peptide Derived from Human Papillomavirus
SLQDVSIACVY

SEQ ID NO: 1466 - protein, 11 aa, Artificial Sequence
  Peptide Derived from Human Papillomavirus
TLEKITNTELY

SEQ ID NO: 1467 - protein, 8 aa, Artificial Sequence
  Peptide Derived from Human Papillomavirus
TLERTEVY

SEQ ID NO: 1468 - protein, 10 aa, Artificial Sequence
  Peptide Derived from Human Papillomavirus
TLERTEVYQF

SEQ ID NO: 1469 - protein, 9 aa, Artificial Sequence
  Peptide Derived from Human Papillomavirus
YSRIRELRY

SEQ ID NO: 1470 - protein, 10 aa, Artificial Sequence
  Peptide Derived from Human Papillomavirus
YSRIRELRYY

SEQ ID NO: 1471 - protein, 9 aa, Artificial Sequence
  Peptide Derived from Human Papillomavirus
DLRTLQQLF

SEQ ID NO: 1472 - protein, 10 aa, Artificial Sequence
  Peptide Derived from Human Papillomavirus
ELDPVDLLCY

SEQ ID NO: 1473 - protein, 11 aa, Artificial Sequence
  Peptide Derived from Human Papillomavirus
FLSTLSFVCPW

SEQ ID NO: 1474 - protein, 10 aa, Artificial Sequence
  Peptide Derived from Human Papillomavirus
LSTLSFVCPW

SEQ ID NO: 1475 - protein, 9 aa, Artificial Sequence
  Peptide Derived from Human Papillomavirus
QLFLSTLSF

SEQ ID NO: 1476 - protein, 9 aa, Artificial Sequence
  Peptide Derived from Human Papillomavirus
STLSFVCPW

SEQ ID NO: 1477 - protein, 8 aa, Artificial Sequence
  Peptide Derived from Human Papillomavirus
TLSFVCPW

SEQ ID NO: 1478 - protein, 8 aa, Artificial Sequence
  Peptide Derived from Human Papillomavirus
ALPDPNKF

SEQ ID NO: 1479 - protein, 11 aa, Artificial Sequence
  Peptide Derived from Human Papillomavirus
ALWRPSDSTVY

SEQ ID NO: 1480 - protein, 11 aa, Artificial Sequence
  Peptide Derived from Human Papillomavirus
ASTQNPVPNTY

SEQ ID NO: 1481 - protein, 8 aa, Artificial Sequence
  Peptide Derived from Human Papillomavirus
AVPKVSAY

SEQ ID NO: 1482 - protein, 10 aa, Artificial Sequence
  Peptide Derived from Human Papillomavirus
AVPKVSAYQY

SEQ ID NO: 1483 - protein, 8 aa, Artificial Sequence
  Peptide Derived from Human Papillomavirus
CLRREQLF

SEQ ID NO: 1484 - protein, 9 aa, Artificial Sequence
  Peptide Derived from Human Papillomavirus
CVPAIGEHW

SEQ ID NO: 1485 - protein, 9 aa, Artificial Sequence
  Peptide Derived from Human Papillomavirus
DICQSICKY

SEQ ID NO: 1486 - protein, 11 aa, Artificial Sequence
  Peptide Derived from Human Papillomavirus
DLDQYPLGRKF

SEQ ID NO: 1487 - protein, 9 aa, Artificial Sequence
  Peptide Derived from Human Papillomavirus
DSQLFNKPY

SEQ ID NO: 1488 - protein, 10 aa, Artificial Sequence
  Peptide Derived from Human Papillomavirus
DSQLFNKPYW

SEQ ID NO: 1489 - protein, 9 aa, Artificial Sequence
  Peptide Derived from Human Papillomavirus
DTGYGAMDF

SEQ ID NO: 1490 - protein, 11 aa, Artificial Sequence
  Peptide Derived from Human Papillomavirus
DTTPPEKQDPY

SEQ ID NO: 1491 - protein, 8 aa, Artificial Sequence
  Peptide Derived from Human Papillomavirus
DTVPTDLY

SEQ ID NO: 1492 - protein, 10 aa, Artificial Sequence
  Peptide Derived from Human Papillomavirus
DVRDNVSVDY

SEQ ID NO: 1493 - protein, 8 aa, Artificial Sequence
  Peptide Derived from Human Papillomavirus
ETPGSCVY

SEQ ID NO: 1494 - protein, 8 aa, Artificial Sequence
  Peptide Derived from Human Papillomavirus
FLKNVNVF

SEQ ID NO: 1495 - protein, 11 aa, Artificial Sequence
  Peptide Derived from Human Papillomavirus
FLKNVNVFPIF

SEQ ID NO: 1496 - protein, 8 aa, Artificial Sequence
  Peptide Derived from Human Papillomavirus
FSSDLDQY

SEQ ID NO: 1497 - protein, 9 aa, Artificial Sequence
  Peptide Derived from Human Papillomavirus
GICWHNQLF

SEQ ID NO: 1498 - protein, 9 aa, Artificial Sequence
  Peptide Derived from Human Papillomavirus
GIGLSGHPF

SEQ ID NO: 1499 - protein, 10 aa, Artificial Sequence
  Peptide Derived from Human Papillomavirus
GIGLSGHPFY

SEQ ID NO: 1500 - protein, 8 aa, Artificial Sequence
  Peptide Derived from Human Papillomavirus
GLPDSTIY

SEQ ID NO: 1501 - protein, 8 aa, Artificial Sequence
  Peptide Derived from Human Papillomavirus
GLSGHPFY

SEQ ID NO: 1502 - protein, 11 aa, Artificial Sequence
  Peptide Derived from Human Papillomavirus
GSITTSDSQLF

SEQ ID NO: 1503 - protein, 11 aa, Artificial Sequence
  Peptide Derived from Human Papillomavirus
HSMNSSILENW

SEQ ID NO: 1504 - protein, 9 aa, Artificial Sequence
  Peptide Derived from Human Papillomavirus
HVEEYDLQF

SEQ ID NO: 1505 - protein, 11 aa, Artificial Sequence
  Peptide Derived from Human Papillomavirus
HVEEYDLQFIF

SEQ ID NO: 1506 - protein, 10 aa, Artificial Sequence
  Peptide Derived from Human Papillomavirus
IIFLKNVNVF

SEQ ID NO: 1507 - protein, 11 aa, Artificial Sequence
  Peptide Derived from Human Papillomavirus
IIIFLKNVNVF

SEQ ID NO: 1508 - protein, 10 aa, Artificial Sequence
  Peptide Derived from Human Papillomavirus
IIYGHGIIIF

SEQ ID NO: 1509 - protein, 10 aa, Artificial Sequence
  Peptide Derived from Human Papillomavirus
ITLTAEVMSY

SEQ ID NO: 1510 - protein, 9 aa, Artificial Sequence
  Peptide Derived from Human Papillomavirus
ITTSDSQLF

SEQ ID NO: 1511 - protein, 10 aa, Artificial Sequence
  Peptide Derived from Human Papillomavirus
KVSAYQYRVF

SEQ ID NO: 1512 - protein, 8 aa, Artificial Sequence
  Peptide Derived from Human Papillomavirus
LLTVGNPY

SEQ ID NO: 1513 - protein, 9 aa, Artificial Sequence
  Peptide Derived from Human Papillomavirus
LLTVGNPYF

SEQ ID NO: 1514 - protein, 8 aa, Artificial Sequence
  Peptide Derived from Human Papillomavirus
LTAEVMSY

SEQ ID NO: 1515 - protein, 8 aa, Artificial Sequence
  Peptide Derived from Human Papillomavirus
LTVGNPYF

SEQ ID NO: 1516 - protein, 11 aa, Artificial Sequence
  Peptide Derived from Human Papillomavirus
MSADPYGDSMF

SEQ ID NO: 1517 - protein, 11 aa, Artificial Sequence
  Peptide Derived from Human Papillomavirus
MVDTGYGAMDF

SEQ ID NO: 1518 - protein, 11 aa, Artificial Sequence
  Peptide Derived from Human Papillomavirus
NIIYGHGIIIF

SEQ ID NO: 1519 - protein, 11 aa, Artificial Sequence
  Peptide Derived from Human Papillomavirus
NMRETPGSCVY

SEQ ID NO: 1520 - protein, 8 aa, Artificial Sequence
  Peptide Derived from Human Papillomavirus
NSSILENW

SEQ ID NO: 1521 - protein, 10 aa, Artificial Sequence
  Peptide Derived from Human Papillomavirus
NSSILENWNF

SEQ ID NO: 1522 - protein, 8 aa, Artificial Sequence
  Peptide Derived from Human Papillomavirus
NTYDPTKF

SEQ ID NO: 1523 - protein, 11 aa, Artificial Sequence
  Peptide Derived from Human Papillomavirus
NTYDPTKFKHY

SEQ ID NO: 1524 - protein, 8 aa, Artificial Sequence
  Peptide Derived from Human Papillomavirus
NVNVFPIF

SEQ ID NO: 1525 - protein, 9 aa, Artificial Sequence
  Peptide Derived from Human Papillomavirus
PIFLQMALW

SEQ ID NO: 1526 - protein, 11 aa, Artificial Sequence
  Peptide Derived from Human Papillomavirus
PLDICQSICKY

SEQ ID NO: 1527 - protein, 11 aa, Artificial Sequence
  Peptide Derived from Human Papillomavirus
PLGIGLSGHPF

SEQ ID NO: 1528 - protein, 9 aa, Artificial Sequence
  Peptide Derived from Human Papillomavirus
PTTSLVDTY

SEQ ID NO: 1529 - protein, 11 aa, Artificial Sequence
  Peptide Derived from Human Papillomavirus
PTTSLVDTYRF

SEQ ID NO: 1530 - protein, 11 aa, Artificial Sequence
  Peptide Derived from Human Papillomavirus
PVPNTYDPTKF

SEQ ID NO: 1531 - protein, 8 aa, Artificial Sequence
  Peptide Derived from Human Papillomavirus
QLFARHFW

SEQ ID NO: 1532 - protein, 8 aa, Artificial Sequence
  Peptide Derived from Human Papillomavirus
QLFNKPYW

SEQ ID NO: 1533 - protein, 9 aa, Artificial Sequence
  Peptide Derived from Human Papillomavirus
QSICKYPDY

SEQ ID NO: 1534 - protein, 9 aa, Artificial Sequence
  Peptide Derived from Human Papillomavirus
RLLTVGNPY

SEQ ID NO: 1535 - protein, 10 aa, Artificial Sequence
  Peptide Derived from Human Papillomavirus
RLLTVGNPYF

SEQ ID NO: 1536 - protein, 10 aa, Artificial Sequence
  Peptide Derived from Human Papillomavirus
RVALPDPNKF

SEQ ID NO: 1537 - protein, 8 aa, Artificial Sequence
  Peptide Derived from Human Papillomavirus
RVVNTDDY

SEQ ID NO: 1538 - protein, 8 aa, Artificial Sequence
  Peptide Derived from Human Papillomavirus
SICKYPDY

SEQ ID NO: 1539 - protein, 8 aa, Artificial Sequence
  Peptide Derived from Human Papillomavirus
SILENWNF

SEQ ID NO: 1540 - protein, 10 aa, Artificial Sequence
  Peptide Derived from Human Papillomavirus
SITTSDSQLF

SEQ ID NO: 1541 - protein, 8 aa, Artificial Sequence
  Peptide Derived from Human Papillomavirus
SLVDTYRF

SEQ ID NO: 1542 - protein, 10 aa, Artificial Sequence
  Peptide Derived from Human Papillomavirus
SMNSSILENW

SEQ ID NO: 1543 - protein, 9 aa, Artificial Sequence
  Peptide Derived from Human Papillomavirus
SSILENWNF

SEQ ID NO: 1544 - protein, 11 aa, Artificial Sequence
  Peptide Derived from Human Papillomavirus
SSRLLTVGNPY

SEQ ID NO: 1545 - protein, 10 aa, Artificial Sequence
  Peptide Derived from Human Papillomavirus
STQNPVPNTY

SEQ ID NO: 1546 - protein, 11 aa, Artificial Sequence
  Peptide Derived from Human Papillomavirus
SVARVVNTDDY

SEQ ID NO: 1547 - protein, 11 aa, Artificial Sequence
  Peptide Derived from Human Papillomavirus
TITLTAEVMSY

SEQ ID NO: 1548 - protein, 9 aa, Artificial Sequence
  Peptide Derived from Human Papillomavirus
TLTAEVMSY

SEQ ID NO: 1549 - protein, 11 aa, Artificial Sequence
  Peptide Derived from Human Papillomavirus
TSDSQLFNKPY

SEQ ID NO: 1550 - protein, 9 aa, Artificial Sequence
  Peptide Derived from Human Papillomavirus
TSLVDTYRF

SEQ ID NO: 1551 - protein, 10 aa, Artificial Sequence
  Peptide Derived from Human Papillomavirus
TTPPEKQDPY

SEQ ID NO: 1552 - protein, 8 aa, Artificial Sequence
  Peptide Derived from Human Papillomavirus
TTSDSQLF

SEQ ID NO: 1553 - protein, 8 aa, Artificial Sequence
  Peptide Derived from Human Papillomavirus
TTSLVDTY

SEQ ID NO: 1554 - protein, 10 aa, Artificial Sequence
  Peptide Derived from Human Papillomavirus
TTSLVDTYRF

SEQ ID NO: 1555 - protein, 8 aa, Artificial Sequence
  Peptide Derived from Human Papillomavirus
TVDLKEKF

SEQ ID NO: 1556 - protein, 11 aa, Artificial Sequence
  Peptide Derived from Human Papillomavirus
VMGDTVPTDLY

SEQ ID NO: 1557 - protein, 9 aa, Artificial Sequence
  Peptide Derived from Human Papillomavirus
VSAYQYRVF

SEQ ID NO: 1558 - protein, 8 aa, Artificial Sequence
  Peptide Derived from Human Papillomavirus
VSRTSIFY

SEQ ID NO: 1559 - protein, 9 aa, Artificial Sequence
  Peptide Derived from Human Papillomavirus
WTVDLKEKF

SEQ ID NO: 1560 - protein, 9 aa, Artificial Sequence
  Peptide Derived from Human Papillomavirus
YLQMSADPY

SEQ ID NO: 1561 - protein, 8 aa, Artificial Sequence
  Peptide Derived from Human Papillomavirus
YSRHVEEY

SEQ ID NO: 1562 - protein, 8 aa, Artificial Sequence
  Peptide Derived from Human Papillomavirus
YVSRTSIF

SEQ ID NO: 1563 - protein, 9 aa, Artificial Sequence
  Peptide Derived from Human Papillomavirus
YVSRTSIFY

SEQ ID NO: 1564 - protein, 11 aa, Artificial Sequence
  Peptide Derived from Human Papillomavirus
ALSSRRGTVRF

SEQ ID NO: 1565 - protein, 9 aa, Artificial Sequence
  Peptide Derived from Human Papillomavirus
ASGAPVPTF

SEQ ID NO: 1566 - protein, 8 aa, Artificial Sequence
  Peptide Derived from Human Papillomavirus
ATNDSDLF

SEQ ID NO: 1567 - protein, 11 aa, Artificial Sequence
  Peptide Derived from Human Papillomavirus
ATNDSDLFDVY

SEQ ID NO: 1568 - protein, 11 aa, Artificial Sequence
  Peptide Derived from Human Papillomavirus
DIILPSHTPMW

SEQ ID NO: 1569 - protein, 9 aa, Artificial Sequence
  Peptide Derived from Human Papillomavirus
DLFDVYADF

SEQ ID NO: 1570 - protein, 8 aa, Artificial Sequence
  Peptide Derived from Human Papillomavirus
DSDLFDVY

SEQ ID NO: 1571 - protein, 11 aa, Artificial Sequence
  Peptide Derived from Human Papillomavirus
DSDLFDVYADF

SEQ ID NO: 1572 - protein, 10 aa, Artificial Sequence
  Peptide Derived from Human Papillomavirus
DSVSISSTSF

SEQ ID NO: 1573 - protein, 11 aa, Artificial Sequence
  Peptide Derived from Human Papillomavirus
FLTHPSSLVTF

SEQ ID NO: 1574 - protein, 11 aa, Artificial Sequence
  Peptide Derived from Human Papillomavirus
FSRLGQRATMF

SEQ ID NO: 1575 - protein, 8 aa, Artificial Sequence
  Peptide Derived from Human Papillomavirus
GIHGTQYY

SEQ ID NO: 1576 - protein, 10 aa, Artificial Sequence
  Peptide Derived from Human Papillomavirus
GIHGTQYYLW

SEQ ID NO: 1577 - protein, 8 aa, Artificial Sequence
  Peptide Derived from Human Papillomavirus
GSGGRTGY

SEQ ID NO: 1578 - protein, 10 aa, Artificial Sequence
  Peptide Derived from Human Papillomavirus
GSGSGGRTGY

SEQ ID NO: 1579 - protein, 10 aa, Artificial Sequence
  Peptide Derived from Human Papillomavirus
GTPTSGSHGY

SEQ ID NO: 1580 - protein, 9 aa, Artificial Sequence
  Peptide Derived from Human Papillomavirus
GTQYYLWPW

SEQ ID NO: 1581 - protein, 10 aa, Artificial Sequence
  Peptide Derived from Human Papillomavirus
GTQYYLWPWY

SEQ ID NO: 1582 - protein, 11 aa, Artificial Sequence
  Peptide Derived from Human Papillomavirus
GTQYYLWPWYY

SEQ ID NO: 1583 - protein, 11 aa, Artificial Sequence
  Peptide Derived from Human Papillomavirus
GTTLADKILQW

SEQ ID NO: 1584 - protein, 10 aa, Artificial Sequence
  Peptide Derived from Human Papillomavirus
IILPSHTPMW

SEQ ID NO: 1585 - protein, 9 aa, Artificial Sequence
  Peptide Derived from Human Papillomavirus
ILPSHTPMW

SEQ ID NO: 1586 - protein, 10 aa, Artificial Sequence
  Peptide Derived from Human Papillomavirus
ILQWSSLGIF

SEQ ID NO: 1587 - protein, 10 aa, Artificial Sequence
  Peptide Derived from Human Papillomavirus
ISATNDSDLF

SEQ ID NO: 1588 - protein, 11 aa, Artificial Sequence
  Peptide Derived from Human Papillomavirus
ISSTSFTNPAF

SEQ ID NO: 1589 - protein, 11 aa, Artificial Sequence
  Peptide Derived from Human Papillomavirus
KILQWSSLGIF

SEQ ID NO: 1590 - protein, 8 aa, Artificial Sequence
  Peptide Derived from Human Papillomavirus
KSFTYPKY

SEQ ID NO: 1591 - protein, 11 aa, Artificial Sequence
  Peptide Derived from Human Papillomavirus
LISATNDSDLF

SEQ ID NO: 1592 - protein, 10 aa, Artificial Sequence
  Peptide Derived from Human Papillomavirus
LSSRRGTVRF

SEQ ID NO: 1593 - protein, 10 aa, Artificial Sequence
  Peptide Derived from Human Papillomavirus
LTHPSSLVTF

SEQ ID NO: 1594 - protein, 11 aa, Artificial Sequence
  Peptide Derived from Human Papillomavirus
LTMPSTAASSY

SEQ ID NO: 1595 - protein, 10 aa, Artificial Sequence
  Peptide Derived from Human Papillomavirus
LTSAWDVPIY

SEQ ID NO: 1596 - protein, 9 aa, Artificial Sequence
  Peptide Derived from Human Papillomavirus
LVTFDNPAY

SEQ ID NO: 1597 - protein, 10 aa, Artificial Sequence
  Peptide Derived from Human Papillomavirus
NVTVPLTSAW

SEQ ID NO: 1598 - protein, 8 aa, Artificial Sequence
  Peptide Derived from Human Papillomavirus
PLDTTLSF

SEQ ID NO: 1599 - protein, 11 aa, Artificial Sequence
  Peptide Derived from Human Papillomavirus
PLTSAWDVPIY

SEQ ID NO: 1600 - protein, 8 aa, Artificial Sequence
  Peptide Derived from Human Papillomavirus
PSTAASSY

SEQ ID NO: 1601 - protein, 8 aa, Artificial Sequence
  Peptide Derived from Human Papillomavirus
PSTIHKSF

SEQ ID NO: 1602 - protein, 10 aa, Artificial Sequence
  Peptide Derived from Human Papillomavirus
PSTIHKSFTY

SEQ ID NO: 1603 - protein, 9 aa, Artificial Sequence
  Peptide Derived from Human Papillomavirus
PTFTGTSGF

SEQ ID NO: 1604 - protein, 9 aa, Artificial Sequence
  Peptide Derived from Human Papillomavirus
PTNASTTTY

SEQ ID NO: 1605 - protein, 8 aa, Artificial Sequence
  Peptide Derived from Human Papillomavirus
PTSGSHGY

SEQ ID NO: 1606 - protein, 10 aa, Artificial Sequence
  Peptide Derived from Human Papillomavirus
PTSNVPDSDF

SEQ ID NO: 1607 - protein, 11 aa, Artificial Sequence
  Peptide Derived from Human Papillomavirus
PVPTFTGTSGF

SEQ ID NO: 1608 - protein, 8 aa, Artificial Sequence
  Peptide Derived from Human Papillomavirus
QIGGRVHF

SEQ ID NO: 1609 - protein, 9 aa, Artificial Sequence
  Peptide Derived from Human Papillomavirus
QIGGRVHFY

SEQ ID NO: 1610 - protein, 10 aa, Artificial Sequence
  Peptide Derived from Human Papillomavirus
QTGEVSGNIF

SEQ ID NO: 1611 - protein, 9 aa, Artificial Sequence
  Peptide Derived from Human Papillomavirus
QVRVSTSQF

SEQ ID NO: 1612 - protein, 10 aa, Artificial Sequence
  Peptide Derived from Human Papillomavirus
RIPYFFADGF

SEQ ID NO: 1613 - protein, 9 aa, Artificial Sequence
  Peptide Derived from Human Papillomavirus
RLGQRATMF

SEQ ID NO: 1614 - protein, 8 aa, Artificial Sequence
  Peptide Derived from Human Papillomavirus
RVRGPRLY

SEQ ID NO: 1615 - protein, 10 aa, Artificial Sequence
  Peptide Derived from Human Papillomavirus
SLVTFDNPAY

SEQ ID NO: 1616 - protein, 11 aa, Artificial Sequence
  Peptide Derived from Human Papillomavirus
SSLVTFDNPAY

SEQ ID NO: 1617 - protein, 9 aa, Artificial Sequence
  Peptide Derived from Human Papillomavirus
SSRRGTVRF

SEQ ID NO: 1618 - protein, 10 aa, Artificial Sequence
  Peptide Derived from Human Papillomavirus
SSTSFTNPAF

SEQ ID NO: 1619 - protein, 9 aa, Artificial Sequence
  Peptide Derived from Human Papillomavirus
STIHKSFTY

SEQ ID NO: 1620 - protein, 9 aa, Artificial Sequence
  Peptide Derived from Human Papillomavirus
STSFTNPAF

SEQ ID NO: 1621 - protein, 11 aa, Artificial Sequence
  Peptide Derived from Human Papillomavirus
STTPSTIHKSF

SEQ ID NO: 1622 - protein, 9 aa, Artificial Sequence
  Peptide Derived from Human Papillomavirus
SVSISSTSF

SEQ ID NO: 1623 - protein, 8 aa, Artificial Sequence
  Peptide Derived from Human Papillomavirus
TIHKSFTY

SEQ ID NO: 1624 - protein, 11 aa, Artificial Sequence
  Peptide Derived from Human Papillomavirus
TIHKSFTYPKY

SEQ ID NO: 1625 - protein, 9 aa, Artificial Sequence
  Peptide Derived from Human Papillomavirus
TLADKILQW

SEQ ID NO: 1626 - protein, 10 aa, Artificial Sequence
  Peptide Derived from Human Papillomavirus
TMPSTAASSY

SEQ ID NO: 1627 - protein, 9 aa, Artificial Sequence
  Peptide Derived from Human Papillomavirus
TSAWDVPIY

SEQ ID NO: 1628 - protein, 8 aa, Artificial Sequence
  Peptide Derived from Human Papillomavirus
TSFTNPAF

SEQ ID NO: 1629 - protein, 9 aa, Artificial Sequence
  Peptide Derived from Human Papillomavirus
TSNVPDSDF

SEQ ID NO: 1630 - protein, 11 aa, Artificial Sequence
  Peptide Derived from Human Papillomavirus
TSPTNASTTTY

SEQ ID NO: 1631 - protein, 10 aa, Artificial Sequence
  Peptide Derived from Human Papillomavirus
TTLADKILQW

SEQ ID NO: 1632 - protein, 10 aa, Artificial Sequence
  Peptide Derived from Human Papillomavirus
TTPSTIHKSF

SEQ ID NO: 1633 - protein, 11 aa, Artificial Sequence
  Peptide Derived from Human Papillomavirus
TTYIGIHGTQY

SEQ ID NO: 1634 - protein, 8 aa, Artificial Sequence
  Peptide Derived from Human Papillomavirus
TVPLTSAW

SEQ ID NO: 1635 - protein, 11 aa, Artificial Sequence
  Peptide Derived from Human Papillomavirus
TVRRVRGPRLY

SEQ ID NO: 1636 - protein, 8 aa, Artificial Sequence
  Peptide Derived from Human Papillomavirus
VSISSTSF

SEQ ID NO: 1637 - protein, 8 aa, Artificial Sequence
  Peptide Derived from Human Papillomavirus
VTFDNPAY

SEQ ID NO: 1638 - protein, 9 aa, Artificial Sequence
  Peptide Derived from Human Papillomavirus
VTVPLTSAW

SEQ ID NO: 1639 - protein, 11 aa, Artificial Sequence
  Peptide Derived from Human Papillomavirus
VVASGAPVPTF

SEQ ID NO: 1640 - protein, 9 aa, Artificial Sequence
  Peptide Derived from Human Papillomavirus
YIGIHGTQY

SEQ ID NO: 1641 - protein, 10 aa, Artificial Sequence
  Peptide Derived from Human Papillomavirus
YIGIHGTQYY

SEQ ID NO: 1642 - protein, 8 aa, Artificial Sequence
  Peptide Derived from Human Papillomavirus
YLWPWYYY

SEQ ID NO: 1643 - protein, 9 aa, Artificial Sequence
  Peptide Derived from Human Papillomavirus
YLWPWYYYF

SEQ ID NO: 1644 - protein, 10 aa, Artificial Sequence
  Peptide Derived from Human Papillomavirus
ALESLSTTIY

SEQ ID NO: 1645 - protein, 9 aa, Artificial Sequence
  Peptide Derived from Human Papillomavirus
CMQYVAWKY

SEQ ID NO: 1646 - protein, 11 aa, Artificial Sequence
  Peptide Derived from Human Papillomavirus
CMQYVAWKYIY

SEQ ID NO: 1647 - protein, 10 aa, Artificial Sequence
  Peptide Derived from Human Papillomavirus
CSGVDYRGIY

SEQ ID NO: 1648 - protein, 11 aa, Artificial Sequence
  Peptide Derived from Human Papillomavirus
CSGVDYRGIYY

SEQ ID NO: 1649 - protein, 9 aa, Artificial Sequence
  Peptide Derived from Human Papillomavirus
DSVSSTCRY

SEQ ID NO: 1650 - protein, 8 aa, Artificial Sequence
  Peptide Derived from Human Papillomavirus
DVTSTYHW

SEQ ID NO: 1651 - protein, 11 aa, Artificial Sequence
  Peptide Derived from Human Papillomavirus
ELWLTEPKKCF

SEQ ID NO: 1652 - protein, 8 aa, Artificial Sequence
  Peptide Derived from Human Papillomavirus
ESLSTTIY

SEQ ID NO: 1653 - protein, 10 aa, Artificial Sequence
  Peptide Derived from Human Papillomavirus
EVHMENESIY

SEQ ID NO: 1654 - protein, 11 aa, Artificial Sequence
  Peptide Derived from Human Papillomavirus
FLSHVKIPVVY

SEQ ID NO: 1655 - protein, 8 aa, Artificial Sequence
  Peptide Derived from Human Papillomavirus
FVDVTSTY

SEQ ID NO: 1656 - protein, 10 aa, Artificial Sequence
  Peptide Derived from Human Papillomavirus
FVDVTSTYHW

SEQ ID NO: 1657 - protein, 9 aa, Artificial Sequence
  Peptide Derived from Human Papillomavirus
GSKNNCMQY

SEQ ID NO: 1658 - protein, 8 aa, Artificial Sequence
  Peptide Derived from Human Papillomavirus
GVDYRGIY

SEQ ID NO: 1659 - protein, 9 aa, Artificial Sequence
  Peptide Derived from Human Papillomavirus
GVDYRGIYY

SEQ ID NO: 1660 - protein, 8 aa, Artificial Sequence
  Peptide Derived from Human Papillomavirus
HMENESIY

SEQ ID NO: 1661 - protein, 8 aa, Artificial Sequence
  Peptide Derived from Human Papillomavirus
HVKIPVVY

SEQ ID NO: 1662 - protein, 10 aa, Artificial Sequence
  Peptide Derived from Human Papillomavirus
KIPVVYRLVW

SEQ ID NO: 1663 - protein, 11 aa, Artificial Sequence
  Peptide Derived from Human Papillomavirus
KTLFVDVTSTY

SEQ ID NO: 1664 - protein, 8 aa, Artificial Sequence
  Peptide Derived from Human Papillomavirus
KVCSGVDY

SEQ ID NO: 1665 - protein, 10 aa, Artificial Sequence
  Peptide Derived from Human Papillomavirus
LSHVKIPVVY

SEQ ID NO: 1666 - protein, 11 aa, Artificial Sequence
  Peptide Derived from Human Papillomavirus
LSTTIYNNEEW

SEQ ID NO: 1667 - protein, 8 aa, Artificial Sequence
  Peptide Derived from Human Papillomavirus
LTEPKKCF

SEQ ID NO: 1668 - protein, 11 aa, Artificial Sequence
  Peptide Derived from Human Papillomavirus
NVSPVETVNEY

SEQ ID NO: 1669 - protein, 8 aa, Artificial Sequence
  Peptide Derived from Human Papillomavirus
PVETVNEY

SEQ ID NO: 1670 - protein, 8 aa, Artificial Sequence
  Peptide Derived from Human Papillomavirus
PVVYRLVW

SEQ ID NO: 1671 - protein, 9 aa, Artificial Sequence
  Peptide Derived from Human Papillomavirus
RLKCCRYRF

SEQ ID NO: 1672 - protein, 10 aa, Artificial Sequence
  Peptide Derived from Human Papillomavirus
STTIYNNEEW

SEQ ID NO: 1673 - protein, 8 aa, Artificial Sequence
  Peptide Derived from Human Papillomavirus
SVSSTCRY

SEQ ID NO: 1674 - protein, 8 aa, Artificial Sequence
  Peptide Derived from Human Papillomavirus
TIYNNEEW

SEQ ID NO: 1675 - protein, 10 aa, Artificial Sequence
  Peptide Derived from Human Papillomavirus
TLFVDVTSTY

SEQ ID NO: 1676 - protein, 10 aa, Artificial Sequence
  Peptide Derived from Human Papillomavirus
TLRDTCEELW

SEQ ID NO: 1677 - protein, 8 aa, Artificial Sequence
  Peptide Derived from Human Papillomavirus
TSTDNKNY

SEQ ID NO: 1678 - protein, 9 aa, Artificial Sequence
  Peptide Derived from Human Papillomavirus
TTIYNNEEW

SEQ ID NO: 1679 - protein, 10 aa, Artificial Sequence
  Peptide Derived from Human Papillomavirus
VSPVETVNEY

SEQ ID NO: 1680 - protein, 9 aa, Artificial Sequence
  Peptide Derived from Human Papillomavirus
WLTEPKKCF

SEQ ID NO: 1681 - protein, 11 aa, Artificial Sequence
  Peptide Derived from Human Papillomavirus
WTLRDTCEELW

SEQ ID NO: 1682 - protein, 9 aa, Artificial Sequence
  Peptide Derived from Human Papillomavirus
WTSTDNKNY

SEQ ID NO: 1683 - protein, 10 aa, Artificial Sequence
  Peptide Derived from Human Papillomavirus
YIYYNGDCGW

SEQ ID NO: 1684 - protein, 8 aa, Artificial Sequence
  Peptide Derived from Human Papillomavirus
YSIITIIY

SEQ ID NO: 1685 - protein, 11 aa, Artificial Sequence
  Peptide Derived from Human Papillomavirus
YTDFEQEAKKF

SEQ ID NO: 1686 - protein, 8 aa, Artificial Sequence
  Peptide Derived from Human Papillomavirus
YVAWKYIY

SEQ ID NO: 1687 - protein, 9 aa, Artificial Sequence
  Peptide Derived from Human Papillomavirus
YVAWKYIYY

SEQ ID NO: 1688 - protein, 9 aa, Artificial Sequence
  Peptide Derived from Human Papillomavirus
YVHDGHKTY

SEQ ID NO: 1689 - protein, 10 aa, Artificial Sequence
  Peptide Derived from Human Papillomavirus
YVHDGHKTYY

SEQ ID NO: 1690 - protein, 9 aa, Artificial Sequence
  Peptide Derived from Human Papillomavirus
AVCRVCLLF

SEQ ID NO: 1691 - protein, 10 aa, Artificial Sequence
  Peptide Derived from Human Papillomavirus
AVCRVCLLFY

SEQ ID NO: 1692 - protein, 11 aa, Artificial Sequence
  Peptide Derived from Human Papillomavirus
CLLFYSKVRKY

SEQ ID NO: 1693 - protein, 8 aa, Artificial Sequence
  Peptide Derived from Human Papillomavirus
CTELKLVY

SEQ ID NO: 1694 - protein, 8 aa, Artificial Sequence
  Peptide Derived from Human Papillomavirus
DLRLSCVY

SEQ ID NO: 1695 - protein, 10 aa, Artificial Sequence
  Peptide Derived from Human Papillomavirus
ELKLVYRDDF

SEQ ID NO: 1696 - protein, 8 aa, Artificial Sequence
  Peptide Derived from Human Papillomavirus
ELTRAEVY

SEQ ID NO: 1697 - protein, 10 aa, Artificial Sequence
  Peptide Derived from Human Papillomavirus
ELTRAEVYNF

SEQ ID NO: 1698 - protein, 8 aa, Artificial Sequence
  Peptide Derived from Human Papillomavirus
KLVYRDDF

SEQ ID NO: 1699 - protein, 10 aa, Artificial Sequence
  Peptide Derived from Human Papillomavirus
KLVYRDDFPY

SEQ ID NO: 1700 - protein, 8 aa, Artificial Sequence
  Peptide Derived from Human Papillomavirus
KVRKYRYY

SEQ ID NO: 1701 - protein, 10 aa, Artificial Sequence
  Peptide Derived from Human Papillomavirus
KVRKYRYYDY

SEQ ID NO: 1702 - protein, 10 aa, Artificial Sequence
  Peptide Derived from Human Papillomavirus
LIDLRLSCVY

SEQ ID NO: 1703 - protein, 10 aa, Artificial Sequence
  Peptide Derived from Human Papillomavirus
LLFYSKVRKY

SEQ ID NO: 1704 - protein, 9 aa, Artificial Sequence
  Peptide Derived from Human Papillomavirus
LTRAEVYNF

SEQ ID NO: 1705 - protein, 9 aa, Artificial Sequence
  Peptide Derived from Human Papillomavirus
LVYRDDFPY

SEQ ID NO: 1706 - protein, 11 aa, Artificial Sequence
  Peptide Derived from Human Papillomavirus
PLIDLRLSCVY

SEQ ID NO: 1707 - protein, 10 aa, Artificial Sequence
  Peptide Derived from Human Papillomavirus
QLCDLLIRCY

SEQ ID NO: 1708 - protein, 10 aa, Artificial Sequence
  Peptide Derived from Human Papillomavirus
QLHCDRKRRF

SEQ ID NO: 1709 - protein, 9 aa, Artificial Sequence
  Peptide Derived from Human Papillomavirus
WTGSCLGCW

SEQ ID NO: 1710 - protein, 9 aa, Artificial Sequence
  Peptide Derived from Human Papillomavirus
YSKVRKYRY

SEQ ID NO: 1711 - protein, 10 aa, Artificial Sequence
  Peptide Derived from Human Papillomavirus
YSKVRKYRYY

SEQ ID NO: 1712 - protein, 9 aa, Artificial Sequence
  Peptide Derived from Human Papillomavirus
HVPCCECKF

SEQ ID NO: 1713 - protein, 11 aa, Artificial Sequence
  Peptide Derived from Human Papillomavirus
LIHVPCCECKF

SEQ ID NO: 1714 - protein, 8 aa, Artificial Sequence
  Peptide Derived from Human Papillomavirus
ATEQLSKY

SEQ ID NO: 1715 - protein, 8 aa, Artificial Sequence
  Peptide Derived from Human Papillomavirus
ATSLEDKY

SEQ ID NO: 1716 - protein, 10 aa, Artificial Sequence
  Peptide Derived from Human Papillomavirus
ATSLEDKYRY

SEQ ID NO: 1717 - protein, 11 aa, Artificial Sequence
  Peptide Derived from Human Papillomavirus
ATWRPSENKVY

SEQ ID NO: 1718 - protein, 8 aa, Artificial Sequence
  Peptide Derived from Human Papillomavirus
AVNVFPIF

SEQ ID NO: 1719 - protein, 9 aa, Artificial Sequence
  Peptide Derived from Human Papillomavirus
CTPAMGEHW

SEQ ID NO: 1720 - protein, 9 aa, Artificial Sequence
  Peptide Derived from Human Papillomavirus
DIVQSTCKY

SEQ ID NO: 1721 - protein, 11 aa, Artificial Sequence
  Peptide Derived from Human Papillomavirus
DLDQFPLGRKF

SEQ ID NO: 1722 - protein, 10 aa, Artificial Sequence
  Peptide Derived from Human Papillomavirus
DSFSTDLDQF

SEQ ID NO: 1723 - protein, 10 aa, Artificial Sequence
  Peptide Derived from Human Papillomavirus
DSYVKRTSIF

SEQ ID NO: 1724 - protein, 11 aa, Artificial Sequence
  Peptide Derived from Human Papillomavirus
DSYVKRTSIFY

SEQ ID NO: 1725 - protein, 9 aa, Artificial Sequence
  Peptide Derived from Human Papillomavirus
DTGFGAMDF

SEQ ID NO: 1726 - protein, 8 aa, Artificial Sequence
  Peptide Derived from Human Papillomavirus
DVGAVNVF

SEQ ID NO: 1727 - protein, 11 aa, Artificial Sequence
  Peptide Derived from Human Papillomavirus
DVGAVNVFPIF

SEQ ID NO: 1728 - protein, 8 aa, Artificial Sequence
  Peptide Derived from Human Papillomavirus
DVNLQDSF

SEQ ID NO: 1729 - protein, 8 aa, Artificial Sequence
  Peptide Derived from Human Papillomavirus
ETIPAELY

SEQ ID NO: 1730 - protein, 10 aa, Artificial Sequence
  Peptide Derived from Human Papillomavirus
FLDVGAVNVF

SEQ ID NO: 1731 - protein, 8 aa, Artificial Sequence
  Peptide Derived from Human Papillomavirus
FSTDLDQF

SEQ ID NO: 1732 - protein, 9 aa, Artificial Sequence
  Peptide Derived from Human Papillomavirus
GICWGNQLF

SEQ ID NO: 1733 - protein, 8 aa, Artificial Sequence
  Peptide Derived from Human Papillomavirus
GLPDTNIY

SEQ ID NO: 1734 - protein, 8 aa, Artificial Sequence
  Peptide Derived from Human Papillomavirus
GLSGHPLF

SEQ ID NO: 1735 - protein, 11 aa, Artificial Sequence
  Peptide Derived from Human Papillomavirus
GSMITSEAQLF

SEQ ID NO: 1736 - protein, 9 aa, Artificial Sequence
  Peptide Derived from Human Papillomavirus
HVEEYELQF

SEQ ID NO: 1737 - protein, 11 aa, Artificial Sequence
  Peptide Derived from Human Papillomavirus
HVEEYELQFVF

SEQ ID NO: 1738 - protein, 11 aa, Artificial Sequence
  Peptide Derived from Human Papillomavirus
ISTATEQLSKY

SEQ ID NO: 1739 - protein, 10 aa, Artificial Sequence
  Peptide Derived from Human Papillomavirus
ITLSAEVMAY

SEQ ID NO: 1740 - protein, 8 aa, Artificial Sequence
  Peptide Derived from Human Papillomavirus
ITSEAQLF

SEQ ID NO: 1741 - protein, 8 aa, Artificial Sequence
  Peptide Derived from Human Papillomavirus
IVQSTCKY

SEQ ID NO: 1742 - protein, 11 aa, Artificial Sequence
  Peptide Derived from Human Papillomavirus
IVQSTCKYPDY

SEQ ID NO: 1743 - protein, 11 aa, Artificial Sequence
  Peptide Derived from Human Papillomavirus
KITLSAEVMAY

SEQ ID NO: 1744 - protein, 10 aa, Artificial Sequence
  Peptide Derived from Human Papillomavirus
KTNIPKVSAY

SEQ ID NO: 1745 - protein, 11 aa, Artificial Sequence
  Peptide Derived from Human Papillomavirus
KVGETIPAELY

SEQ ID NO: 1746 - protein, 10 aa, Artificial Sequence
  Peptide Derived from Human Papillomavirus
KVSAYQYRVF

SEQ ID NO: 1747 - protein, 8 aa, Artificial Sequence
  Peptide Derived from Human Papillomavirus
KVVATDSY

SEQ ID NO: 1748 - protein, 8 aa, Artificial Sequence
  Peptide Derived from Human Papillomavirus
LLAVGHPY

SEQ ID NO: 1749 - protein, 9 aa, Artificial Sequence
  Peptide Derived from Human Papillomavirus
LLAVGHPYY

SEQ ID NO: 1750 - protein, 8 aa, Artificial Sequence
  Peptide Derived from Human Papillomavirus
LSAEVMAY

SEQ ID NO: 1751 - protein, 11 aa, Artificial Sequence
  Peptide Derived from Human Papillomavirus
MIDTGFGAMDF

SEQ ID NO: 1752 - protein, 9 aa, Artificial Sequence
  Peptide Derived from Human Papillomavirus
MITSEAQLF

SEQ ID NO: 1753 - protein, 8 aa, Artificial Sequence
  Peptide Derived from Human Papillomavirus
MLPMMYIY

SEQ ID NO: 1754 - protein, 9 aa, Artificial Sequence
  Peptide Derived from Human Papillomavirus
MMLPMMYIY

SEQ ID NO: 1755 - protein, 11 aa, Artificial Sequence
  Peptide Derived from Human Papillomavirus
MSADAYGDSMW

SEQ ID NO: 1756 - protein, 8 aa, Artificial Sequence
  Peptide Derived from Human Papillomavirus
NIPKVSAY

SEQ ID NO: 1757 - protein, 10 aa, Artificial Sequence
  Peptide Derived from Human Papillomavirus
NIPKVSAYQY

SEQ ID NO: 1758 - protein, 10 aa, Artificial Sequence
  Peptide Derived from Human Papillomavirus
NMNANLLEDW

SEQ ID NO: 1759 - protein, 9 aa, Artificial Sequence
  Peptide Derived from Human Papillomavirus
PIFLQMATW

SEQ ID NO: 1760 - protein, 8 aa, Artificial Sequence
  Peptide Derived from Human Papillomavirus
PLAKYKFW

SEQ ID NO: 1761 - protein, 11 aa, Artificial Sequence
  Peptide Derived from Human Papillomavirus
PLDIVQSTCKY

SEQ ID NO: 1762 - protein, 9 aa, Artificial Sequence
  Peptide Derived from Human Papillomavirus
PLHYGLCIF

SEQ ID NO: 1763 - protein, 11 aa, Artificial Sequence
  Peptide Derived from Human Papillomavirus
PTEKQDPLAKY

SEQ ID NO: 1764 - protein, 10 aa, Artificial Sequence
  Peptide Derived from Human Papillomavirus
PVATSLEDKY

SEQ ID NO: 1765 - protein, 11 aa, Artificial Sequence
  Peptide Derived from Human Papillomavirus
PVSKVVATDSY

SEQ ID NO: 1766 - protein, 8 aa, Artificial Sequence
  Peptide Derived from Human Papillomavirus
QLFARHYF

SEQ ID NO: 1767 - protein, 8 aa, Artificial Sequence
  Peptide Derived from Human Papillomavirus
QLFNKPYW

SEQ ID NO: 1768 - protein, 9 aa, Artificial Sequence
  Peptide Derived from Human Papillomavirus
QSTCKYPDY

SEQ ID NO: 1769 - protein, 9 aa, Artificial Sequence
  Peptide Derived from Human Papillomavirus
RLLAVGHPY

SEQ ID NO: 1770 - protein, 10 aa, Artificial Sequence
  Peptide Derived from Human Papillomavirus
RLLAVGHPYY

SEQ ID NO: 1771 - protein, 8 aa, Artificial Sequence
  Peptide Derived from Human Papillomavirus
RLPDPNKF

SEQ ID NO: 1772 - protein, 10 aa, Artificial Sequence
  Peptide Derived from Human Papillomavirus
RVRLPDPNKF

SEQ ID NO: 1773 - protein, 8 aa, Artificial Sequence
  Peptide Derived from Human Papillomavirus
SLEDKYRY

SEQ ID NO: 1774 - protein, 10 aa, Artificial Sequence
  Peptide Derived from Human Papillomavirus
SMITSEAQLF

SEQ ID NO: 1775 - protein, 11 aa, Artificial Sequence
  Peptide Derived from Human Papillomavirus
SSRLLAVGHPY

SEQ ID NO: 1776 - protein, 10 aa, Artificial Sequence
  Peptide Derived from Human Papillomavirus
STATEQLSKY

SEQ ID NO: 1777 - protein, 8 aa, Artificial Sequence
  Peptide Derived from Human Papillomavirus
STCKYPDY

SEQ ID NO: 1778 - protein, 9 aa, Artificial Sequence
  Peptide Derived from Human Papillomavirus
TLSAEVMAY

SEQ ID NO: 1779 - protein, 11 aa, Artificial Sequence
  Peptide Derived from Human Papillomavirus
TSEAQLFNKPY

SEQ ID NO: 1780 - protein, 9 aa, Artificial Sequence
  Peptide Derived from Human Papillomavirus
TSLEDKYRY

SEQ ID NO: 1781 - protein, 9 aa, Artificial Sequence
  Peptide Derived from Human Papillomavirus
VSAYQYRVF

SEQ ID NO: 1782 - protein, 10 aa, Artificial Sequence
  Peptide Derived from Human Papillomavirus
VSKVVATDSY

SEQ ID NO: 1783 - protein, 10 aa, Artificial Sequence
  Peptide Derived from Human Papillomavirus
YIYRDPPLHY

SEQ ID NO: 1784 - protein, 9 aa, Artificial Sequence
  Peptide Derived from Human Papillomavirus
YLKMSADAY

SEQ ID NO: 1785 - protein, 8 aa, Artificial Sequence
  Peptide Derived from Human Papillomavirus
YLRHVEEY

SEQ ID NO: 1786 - protein, 8 aa, Artificial Sequence
  Peptide Derived from Human Papillomavirus
YLRREQLF

SEQ ID NO: 1787 - protein, 8 aa, Artificial Sequence
  Peptide Derived from Human Papillomavirus
YVKRTSIF

SEQ ID NO: 1788 - protein, 9 aa, Artificial Sequence
  Peptide Derived from Human Papillomavirus
YVKRTSIFY

SEQ ID NO: 1789 - protein, 8 aa, Artificial Sequence
  Peptide Derived from Human Papillomavirus
ALWPVYFF

SEQ ID NO: 1790 - protein, 11 aa, Artificial Sequence
  Peptide Derived from Human Papillomavirus
ATLVSADNPLF

SEQ ID NO: 1791 - protein, 11 aa, Artificial Sequence
  Peptide Derived from Human Papillomavirus
DIVLPTGPSTW

SEQ ID NO: 1792 - protein, 11 aa, Artificial Sequence
  Peptide Derived from Human Papillomavirus
DVVNKIEQKTW

SEQ ID NO: 1793 - protein, 9 aa, Artificial Sequence
  Peptide Derived from Human Papillomavirus
DVYIQGSSF

SEQ ID NO: 1794 - protein, 9 aa, Artificial Sequence
  Peptide Derived from Human Papillomavirus
ESGAGIPNF

SEQ ID NO: 1795 - protein, 10 aa, Artificial Sequence
  Peptide Derived from Human Papillomavirus
FTTRRGGVRF

SEQ ID NO: 1796 - protein, 11 aa, Artificial Sequence
  Peptide Derived from Human Papillomavirus
GIPNFTGSGGF

SEQ ID NO: 1797 - protein, 8 aa, Artificial Sequence
  Peptide Derived from Human Papillomavirus
GSGGRAGY

SEQ ID NO: 1798 - protein, 10 aa, Artificial Sequence
  Peptide Derived from Human Papillomavirus
GSSFALWPVY

SEQ ID NO: 1799 - protein, 11 aa, Artificial Sequence
  Peptide Derived from Human Papillomavirus
GSSFALWPVYF

SEQ ID NO: 1800 - protein, 8 aa, Artificial Sequence
  Peptide Derived from Human Papillomavirus
GTDTSLAF

SEQ ID NO: 1801 - protein, 10 aa, Artificial Sequence
  Peptide Derived from Human Papillomavirus
GTGSGGRAGY

SEQ ID NO: 1802 - protein, 10 aa, Artificial Sequence
  Peptide Derived from Human Papillomavirus
GTQIGARVHY

SEQ ID NO: 1803 - protein, 11 aa, Artificial Sequence
  Peptide Derived from Human Papillomavirus
GTQIGARVHYY

SEQ ID NO: 1804 - protein, 8 aa, Artificial Sequence
  Peptide Derived from Human Papillomavirus
GVAPDPDF

SEQ ID NO: 1805 - protein, 11 aa, Artificial Sequence
  Peptide Derived from Human Papillomavirus
HLPIKPSTLSF

SEQ ID NO: 1806 - protein, 11 aa, Artificial Sequence
  Peptide Derived from Human Papillomavirus
HSYEEIPMQTF

SEQ ID NO: 1807 - protein, 8 aa, Artificial Sequence
  Peptide Derived from Human Papillomavirus
ILQWGSLF

SEQ ID NO: 1808 - protein, 10 aa, Artificial Sequence
  Peptide Derived from Human Papillomavirus
ILQWGSLFTY

SEQ ID NO: 1809 - protein, 11 aa, Artificial Sequence
  Peptide Derived from Human Papillomavirus
ILQWGSLFTYF

SEQ ID NO: 1810 - protein, 9 aa, Artificial Sequence
  Peptide Derived from Human Papillomavirus
ISSTPIPGF

SEQ ID NO: 1811 - protein, 11 aa, Artificial Sequence
  Peptide Derived from Human Papillomavirus
ISTPTSGIHSY

SEQ ID NO: 1812 - protein, 9 aa, Artificial Sequence
  Peptide Derived from Human Papillomavirus
IVALHRPAF

SEQ ID NO: 1813 - protein, 10 aa, Artificial Sequence
  Peptide Derived from Human Papillomavirus
IVLPTGPSTW

SEQ ID NO: 1814 - protein, 9 aa, Artificial Sequence
  Peptide Derived from Human Papillomavirus
KILQWGSLF

SEQ ID NO: 1815 - protein, 11 aa, Artificial Sequence
  Peptide Derived from Human Papillomavirus
KILQWGSLFTY

SEQ ID NO: 1816 - protein, 10 aa, Artificial Sequence
  Peptide Derived from Human Papillomavirus
KTWADKILQW

SEQ ID NO: 1817 - protein, 8 aa, Artificial Sequence
  Peptide Derived from Human Papillomavirus
LLSANNSF

SEQ ID NO: 1818 - protein, 11 aa, Artificial Sequence
  Peptide Derived from Human Papillomavirus
LSANNSFDGLY

SEQ ID NO: 1819 - protein, 9 aa, Artificial Sequence
  Peptide Derived from Human Papillomavirus
LVSADNPLF

SEQ ID NO: 1820 - protein, 10 aa, Artificial Sequence
  Peptide Derived from Human Papillomavirus
NIVALHRPAF

SEQ ID NO: 1821 - protein, 10 aa, Artificial Sequence
  Peptide Derived from Human Papillomavirus
NSFDGLYDIY

SEQ ID NO: 1822 - protein, 10 aa, Artificial Sequence
  Peptide Derived from Human Papillomavirus
NVTAPLGNVW

SEQ ID NO: 1823 - protein, 8 aa, Artificial Sequence
  Peptide Derived from Human Papillomavirus
NVWETPFY

SEQ ID NO: 1824 - protein, 9 aa, Artificial Sequence
  Peptide Derived from Human Papillomavirus
PIKPSTLSF

SEQ ID NO: 1825 - protein, 10 aa, Artificial Sequence
  Peptide Derived from Human Papillomavirus
PISSTPIPGF

SEQ ID NO: 1826 - protein, 10 aa, Artificial Sequence
  Peptide Derived from Human Papillomavirus
PLGNVWETPF

SEQ ID NO: 1827 - protein, 11 aa, Artificial Sequence
  Peptide Derived from Human Papillomavirus
PLGNVWETPFY

SEQ ID NO: 1828 - protein, 9 aa, Artificial Sequence
  Peptide Derived from Human Papillomavirus
PLLSANNSF

SEQ ID NO: 1829 - protein, 10 aa, Artificial Sequence
  Peptide Derived from Human Papillomavirus
PSGVAPDPDF

SEQ ID NO: 1830 - protein, 9 aa, Artificial Sequence
  Peptide Derived from Human Papillomavirus
PTGPSTWPF

SEQ ID NO: 1831 - protein, 8 aa, Artificial Sequence
  Peptide Derived from Human Papillomavirus
PTSGIHSY

SEQ ID NO: 1832 - protein, 8 aa, Artificial Sequence
  Peptide Derived from Human Papillomavirus
QIGARVHY

SEQ ID NO: 1833 - protein, 9 aa, Artificial Sequence
  Peptide Derived from Human Papillomavirus
QIGARVHYY

SEQ ID NO: 1834 - protein, 10 aa, Artificial Sequence
  Peptide Derived from Human Papillomavirus
QIGARVHYYY

SEQ ID NO: 1835 - protein, 11 aa, Artificial Sequence
  Peptide Derived from Human Papillomavirus
QSPYDVTHDVY

SEQ ID NO: 1836 - protein, 9 aa, Artificial Sequence
  Peptide Derived from Human Papillomavirus
QVKVTDPAF

SEQ ID NO: 1837 - protein, 8 aa, Artificial Sequence
  Peptide Derived from Human Papillomavirus
RIAAPRLY

SEQ ID NO: 1838 - protein, 9 aa, Artificial Sequence
  Peptide Derived from Human Papillomavirus
SSFALWPVY

SEQ ID NO: 1839 - protein, 10 aa, Artificial Sequence
  Peptide Derived from Human Papillomavirus
SSFALWPVYF

SEQ ID NO: 1840 - protein, 11 aa, Artificial Sequence
  Peptide Derived from Human Papillomavirus
SSFALWPVYFF

SEQ ID NO: 1841 - protein, 10 aa, Artificial Sequence
  Peptide Derived from Human Papillomavirus
SSTHITNPLF

SEQ ID NO: 1842 - protein, 8 aa, Artificial Sequence
  Peptide Derived from Human Papillomavirus
SSTPIPGF

SEQ ID NO: 1843 - protein, 9 aa, Artificial Sequence
  Peptide Derived from Human Papillomavirus
STHITNPLF

SEQ ID NO: 1844 - protein, 10 aa, Artificial Sequence
  Peptide Derived from Human Papillomavirus
STPTSGIHSY

SEQ ID NO: 1845 - protein, 11 aa, Artificial Sequence
  Peptide Derived from Human Papillomavirus
STWPFVPQSPY

SEQ ID NO: 1846 - protein, 10 aa, Artificial Sequence
  Peptide Derived from Human Papillomavirus
TLVSADNPLF

SEQ ID NO: 1847 - protein, 9 aa, Artificial Sequence
  Peptide Derived from Human Papillomavirus
TTRRGGVRF

SEQ ID NO: 1848 - protein, 11 aa, Artificial Sequence
  Peptide Derived from Human Papillomavirus
VIESGAGIPNF

SEQ ID NO: 1849 - protein, 9 aa, Artificial Sequence
  Peptide Derived from Human Papillomavirus
VLPTGPSTW

SEQ ID NO: 1850 - protein, 11 aa, Artificial Sequence
  Peptide Derived from Human Papillomavirus
VLPTGPSTWPF

SEQ ID NO: 1851 - protein, 8 aa, Artificial Sequence
  Peptide Derived from Human Papillomavirus
VSADNPLF

SEQ ID NO: 1852 - protein, 11 aa, Artificial Sequence
  Peptide Derived from Human Papillomavirus
VSSTHITNPLF

SEQ ID NO: 1853 - protein, 9 aa, Artificial Sequence
  Peptide Derived from Human Papillomavirus
VTAPLGNVW

SEQ ID NO: 1854 - protein, 10 aa, Artificial Sequence
  Peptide Derived from Human Papillomavirus
VVNKIEQKTW

SEQ ID NO: 1855 - protein, 10 aa, Artificial Sequence
  Peptide Derived from Human Papillomavirus
YIQGSSFALW

SEQ ID NO: 1856 - protein, 9 aa, Artificial Sequence
  Peptide Derived from Human Papillomavirus
AAALYWYKT

SEQ ID NO: 1857 - protein, 11 aa, Artificial Sequence
  Peptide Derived from Human Papillomavirus
AAALYWYKTGI

SEQ ID NO: 1858 - protein, 9 aa, Artificial Sequence
  Peptide Derived from Human Papillomavirus
AAFGLTPSI

SEQ ID NO: 1859 - protein, 10 aa, Artificial Sequence
  Peptide Derived from Human Papillomavirus
AAFGLTPSIA

SEQ ID NO: 1860 - protein, 8 aa, Artificial Sequence
  Peptide Derived from Human Papillomavirus
AALYWYKT

SEQ ID NO: 1861 - protein, 10 aa, Artificial Sequence
  Peptide Derived from Human Papillomavirus
AALYWYKTGI

SEQ ID NO: 1862 - protein, 10 aa, Artificial Sequence
  Peptide Derived from Human Papillomavirus
AAMLAKFKEL

SEQ ID NO: 1863 - protein, 8 aa, Artificial Sequence
  Peptide Derived from Human Papillomavirus
AANTGKSL

SEQ ID NO: 1864 - protein, 11 aa, Artificial Sequence
  Peptide Derived from Human Papillomavirus
AANTGKSLFGM

SEQ ID NO: 1865 - protein, 10 aa, Artificial Sequence
  Peptide Derived from Human Papillomavirus
AICIEKQSRA

SEQ ID NO: 1866 - protein, 11 aa, Artificial Sequence
  Peptide Derived from Human Papillomavirus
AICIEKQSRAA

SEQ ID NO: 1867 - protein, 9 aa, Artificial Sequence
  Peptide Derived from Human Papillomavirus
ALDGNLVSM

SEQ ID NO: 1868 - protein, 11 aa, Artificial Sequence
  Peptide Derived from Human Papillomavirus
ALDGNLVSMDV

SEQ ID NO: 1869 - protein, 8 aa, Artificial Sequence
  Peptide Derived from Human Papillomavirus
ALFTAQEA

SEQ ID NO: 1870 - protein, 9 aa, Artificial Sequence
  Peptide Derived from Human Papillomavirus
ALKRFLQGI

SEQ ID NO: 1871 - protein, 9 aa, Artificial Sequence
  Peptide Derived from Human Papillomavirus
ALYWYKTGI

SEQ ID NO: 1872 - protein, 9 aa, Artificial Sequence
  Peptide Derived from Human Papillomavirus
AMLAKFKEL

SEQ ID NO: 1873 - protein, 10 aa, Artificial Sequence
  Peptide Derived from Human Papillomavirus
AQEAKQHRDA

SEQ ID NO: 1874 - protein, 11 aa, Artificial Sequence
  Peptide Derived from Human Papillomavirus
AQEAKQHRDAV

SEQ ID NO: 1875 - protein, 10 aa, Artificial Sequence
  Peptide Derived from Human Papillomavirus
AQLADTNSNA

SEQ ID NO: 1876 - protein, 10 aa, Artificial Sequence
  Peptide Derived from Human Papillomavirus
ATMCRHYKRA

SEQ ID NO: 1877 - protein, 9 aa, Artificial Sequence
  Peptide Derived from Human Papillomavirus
ATVPCWNYI

SEQ ID NO: 1878 - protein, 10 aa, Artificial Sequence
  Peptide Derived from Human Papillomavirus
AVQVLKRKYL

SEQ ID NO: 1879 - protein, 11 aa, Artificial Sequence
  Peptide Derived from Human Papillomavirus
AVQVLKRKYLV

SEQ ID NO: 1880 - protein, 10 aa, Artificial Sequence
  Peptide Derived from Human Papillomavirus
AVVEKKTGDA

SEQ ID NO: 1881 - protein, 11 aa, Artificial Sequence
  Peptide Derived from Human Papillomavirus
AVVEKKTGDAI

SEQ ID NO: 1882 - protein, 11 aa, Artificial Sequence
  Peptide Derived from Human Papillomavirus
CATMCRHYKRA

SEQ ID NO: 1883 - protein, 8 aa, Artificial Sequence
  Peptide Derived from Human Papillomavirus
CIAAFGLT

SEQ ID NO: 1884 - protein, 11 aa, Artificial Sequence
  Peptide Derived from Human Papillomavirus
CIAAFGLTPSI

SEQ ID NO: 1885 - protein, 8 aa, Artificial Sequence
  Peptide Derived from Human Papillomavirus
CIEKQSRA

SEQ ID NO: 1886 - protein, 9 aa, Artificial Sequence
  Peptide Derived from Human Papillomavirus
CIEKQSRAA

SEQ ID NO: 1887 - protein, 8 aa, Artificial Sequence
  Peptide Derived from Human Papillomavirus
CILLYGAA

SEQ ID NO: 1888 - protein, 10 aa, Artificial Sequence
  Peptide Derived from Human Papillomavirus
CILLYGAANT

SEQ ID NO: 1889 - protein, 9 aa, Artificial Sequence
  Peptide Derived from Human Papillomavirus
CLYLHIQSL

SEQ ID NO: 1890 - protein, 10 aa, Artificial Sequence
  Peptide Derived from Human Papillomavirus
CLYLHIQSLA

SEQ ID NO: 1891 - protein, 9 aa, Artificial Sequence
  Peptide Derived from Human Papillomavirus
CMMIEPPKL

SEQ ID NO: 1892 - protein, 8 aa, Artificial Sequence
  Peptide Derived from Human Papillomavirus
CQTPLTNI

SEQ ID NO: 1893 - protein, 9 aa, Artificial Sequence
  Peptide Derived from Human Papillomavirus
CQTPLTNIL

SEQ ID NO: 1894 - protein, 11 aa, Artificial Sequence
  Peptide Derived from Human Papillomavirus
CQTPLTNILNV

SEQ ID NO: 1895 - protein, 8 aa, Artificial Sequence
  Peptide Derived from Human Papillomavirus
CTFELSQM

SEQ ID NO: 1896 - protein, 9 aa, Artificial Sequence
  Peptide Derived from Human Papillomavirus
CTFELSQMV

SEQ ID NO: 1897 - protein, 10 aa, Artificial Sequence
  Peptide Derived from Human Papillomavirus
CVDNNISPRL

SEQ ID NO: 1898 - protein, 9 aa, Artificial Sequence
  Peptide Derived from Human Papillomavirus
CVSGQNTNT

SEQ ID NO: 1899 - protein, 10 aa, Artificial Sequence
  Peptide Derived from Human Papillomavirus
CVSGQNTNTL

SEQ ID NO: 1900 - protein, 8 aa, Artificial Sequence
  Peptide Derived from Human Papillomavirus
CVSPMCMM

SEQ ID NO: 1901 - protein, 9 aa, Artificial Sequence
  Peptide Derived from Human Papillomavirus
CVSPMCMMI

SEQ ID NO: 1902 - protein, 10 aa, Artificial Sequence
  Peptide Derived from Human Papillomavirus
DAKIGMLDDA

SEQ ID NO: 1903 - protein, 11 aa, Artificial Sequence
  Peptide Derived from Human Papillomavirus
DAKIGMLDDAT

SEQ ID NO: 1904 - protein, 10 aa, Artificial Sequence
  Peptide Derived from Human Papillomavirus
DATVPCWNYI

SEQ ID NO: 1905 - protein, 11 aa, Artificial Sequence
  Peptide Derived from Human Papillomavirus
DAVQVLKRKYL

SEQ ID NO: 1906 - protein, 10 aa, Artificial Sequence
  Peptide Derived from Human Papillomavirus
DISGCVDNNI

SEQ ID NO: 1907 - protein, 8 aa, Artificial Sequence
  Peptide Derived from Human Papillomavirus
DIVDDSEI

SEQ ID NO: 1908 - protein, 9 aa, Artificial Sequence
  Peptide Derived from Human Papillomavirus
DIVDDSEIA

SEQ ID NO: 1909 - protein, 10 aa, Artificial Sequence
  Peptide Derived from Human Papillomavirus
DTGEDLVDFI

SEQ ID NO: 1910 - protein, 11 aa, Artificial Sequence
  Peptide Derived from Human Papillomavirus
DTGEDLVDFIV

SEQ ID NO: 1911 - protein, 8 aa, Artificial Sequence
  Peptide Derived from Human Papillomavirus
DTNSNASA

SEQ ID NO: 1912 - protein, 10 aa, Artificial Sequence
  Peptide Derived from Human Papillomavirus
DTNSNASAFL

SEQ ID NO: 1913 - protein, 10 aa, Artificial Sequence
  Peptide Derived from Human Papillomavirus
DTPEWIQRQT

SEQ ID NO: 1914 - protein, 11 aa, Artificial Sequence
  Peptide Derived from Human Papillomavirus
DTPEWIQRQTV

SEQ ID NO: 1915 - protein, 8 aa, Artificial Sequence
  Peptide Derived from Human Papillomavirus
DVKHRPLV

SEQ ID NO: 1916 - protein, 10 aa, Artificial Sequence
  Peptide Derived from Human Papillomavirus
DVKHRPLVQL

SEQ ID NO: 1917 - protein, 8 aa, Artificial Sequence
  Peptide Derived from Human Papillomavirus
EAKQHRDA

SEQ ID NO: 1918 - protein, 9 aa, Artificial Sequence
  Peptide Derived from Human Papillomavirus
EAKQHRDAV

SEQ ID NO: 1919 - protein, 11 aa, Artificial Sequence
  Peptide Derived from Human Papillomavirus
EAKQHRDAVQV

SEQ ID NO: 1920 - protein, 8 aa, Artificial Sequence
  Peptide Derived from Human Papillomavirus
EAVVEKKT

SEQ ID NO: 1921 - protein, 11 aa, Artificial Sequence
  Peptide Derived from Human Papillomavirus
EAVVEKKTGDA

SEQ ID NO: 1922 - protein, 9 aa, Artificial Sequence
  Peptide Derived from Human Papillomavirus
EIAYKYAQL

SEQ ID NO: 1923 - protein, 10 aa, Artificial Sequence
  Peptide Derived from Human Papillomavirus
EIAYKYAQLA

SEQ ID NO: 1924 - protein, 9 aa, Artificial Sequence
  Peptide Derived from Human Papillomavirus
ELSQMVQWA

SEQ ID NO: 1925 - protein, 10 aa, Artificial Sequence
  Peptide Derived from Human Papillomavirus
ELYGVSFSEL

SEQ ID NO: 1926 - protein, 11 aa, Artificial Sequence
  Peptide Derived from Human Papillomavirus
ELYGVSFSELV

SEQ ID NO: 1927 - protein, 8 aa, Artificial Sequence
  Peptide Derived from Human Papillomavirus
ETAHALFT

SEQ ID NO: 1928 - protein, 9 aa, Artificial Sequence
  Peptide Derived from Human Papillomavirus
ETAHALFTA

SEQ ID NO: 1929 - protein, 8 aa, Artificial Sequence
  Peptide Derived from Human Papillomavirus
ETETAHAL

SEQ ID NO: 1930 - protein, 10 aa, Artificial Sequence
  Peptide Derived from Human Papillomavirus
ETETAHALFT

SEQ ID NO: 1931 - protein, 11 aa, Artificial Sequence
  Peptide Derived from Human Papillomavirus
ETETAHALFTA

SEQ ID NO: 1932 - protein, 10 aa, Artificial Sequence
  Peptide Derived from Human Papillomavirus
ETIEKLLSKL

SEQ ID NO: 1933 - protein, 11 aa, Artificial Sequence
  Peptide Derived from Human Papillomavirus
ETIEKLLSKLL

SEQ ID NO: 1934 - protein, 8 aa, Artificial Sequence
  Peptide Derived from Human Papillomavirus
ETQQMLQV

SEQ ID NO: 1935 - protein, 8 aa, Artificial Sequence
  Peptide Derived from Human Papillomavirus
EVETQQML

SEQ ID NO: 1936 - protein, 10 aa, Artificial Sequence
  Peptide Derived from Human Papillomavirus
EVETQQMLQV

SEQ ID NO: 1937 - protein, 10 aa, Artificial Sequence
  Peptide Derived from Human Papillomavirus
EVYGDTPEWI

SEQ ID NO: 1938 - protein, 9 aa, Artificial Sequence
  Peptide Derived from Human Papillomavirus
FIVNDNDYL

SEQ ID NO: 1939 - protein, 10 aa, Artificial Sequence
  Peptide Derived from Human Papillomavirus
FIVNDNDYLT

SEQ ID NO: 1940 - protein, 8 aa, Artificial Sequence
  Peptide Derived from Human Papillomavirus
FLKSNSQA

SEQ ID NO: 1941 - protein, 10 aa, Artificial Sequence
  Peptide Derived from Human Papillomavirus
FLKSNSQAKI

SEQ ID NO: 1942 - protein, 11 aa, Artificial Sequence
  Peptide Derived from Human Papillomavirus
FLKSNSQAKIV

SEQ ID NO: 1943 - protein, 11 aa, Artificial Sequence
  Peptide Derived from Human Papillomavirus
FLQGIPKKNCI

SEQ ID NO: 1944 - protein, 10 aa, Artificial Sequence
  Peptide Derived from Human Papillomavirus
FLQGSVICFV

SEQ ID NO: 1945 - protein, 10 aa, Artificial Sequence
  Peptide Derived from Human Papillomavirus
FLRYQGVEFM

SEQ ID NO: 1946 - protein, 9 aa, Artificial Sequence
  Peptide Derived from Human Papillomavirus
FLTALKRFL

SEQ ID NO: 1947 - protein, 8 aa, Artificial Sequence
  Peptide Derived from Human Papillomavirus
FMSFLTAL

SEQ ID NO: 1948 - protein, 10 aa, Artificial Sequence
  Peptide Derived from Human Papillomavirus
FVNSKSHFWL

SEQ ID NO: 1949 - protein, 9 aa, Artificial Sequence
  Peptide Derived from Human Papillomavirus
GAANTGKSL

SEQ ID NO: 1950 - protein, 8 aa, Artificial Sequence
  Peptide Derived from Human Papillomavirus
GIPKKNCI

SEQ ID NO: 1951 - protein, 9 aa, Artificial Sequence
  Peptide Derived from Human Papillomavirus
GIPKKNCIL

SEQ ID NO: 1952 - protein, 10 aa, Artificial Sequence
  Peptide Derived from Human Papillomavirus
GIPKKNCILL

SEQ ID NO: 1953 - protein, 8 aa, Artificial Sequence
  Peptide Derived from Human Papillomavirus
GISNISEV

SEQ ID NO: 1954 - protein, 10 aa, Artificial Sequence
  Peptide Derived from Human Papillomavirus
GLTPSIADSI

SEQ ID NO: 1955 - protein, 8 aa, Artificial Sequence
  Peptide Derived from Human Papillomavirus
GMLDDATV

SEQ ID NO: 1956 - protein, 8 aa, Artificial Sequence
  Peptide Derived from Human Papillomavirus
GMSLMKFL

SEQ ID NO: 1957 - protein, 8 aa, Artificial Sequence
  Peptide Derived from Human Papillomavirus
GMVVLLLV

SEQ ID NO: 1958 - protein, 9 aa, Artificial Sequence
  Peptide Derived from Human Papillomavirus
GTDSRWPYL

SEQ ID NO: 1959 - protein, 10 aa, Artificial Sequence
  Peptide Derived from Human Papillomavirus
GTGCNGWFYV

SEQ ID NO: 1960 - protein, 8 aa, Artificial Sequence
  Peptide Derived from Human Papillomavirus
GTNGEEGT

SEQ ID NO: 1961 - protein, 8 aa, Artificial Sequence
  Peptide Derived from Human Papillomavirus
GVEFMSFL

SEQ ID NO: 1962 - protein, 9 aa, Artificial Sequence
  Peptide Derived from Human Papillomavirus
GVEFMSFLT

SEQ ID NO: 1963 - protein, 10 aa, Artificial Sequence
  Peptide Derived from Human Papillomavirus
GVEFMSFLTA

SEQ ID NO: 1964 - protein, 11 aa, Artificial Sequence
  Peptide Derived from Human Papillomavirus
GVEFMSFLTAL

SEQ ID NO: 1965 - protein, 8 aa, Artificial Sequence
  Peptide Derived from Human Papillomavirus
GVSERHTI

SEQ ID NO: 1966 - protein, 11 aa, Artificial Sequence
  Peptide Derived from Human Papillomavirus
GVSERHTICQT

SEQ ID NO: 1967 - protein, 8 aa, Artificial Sequence
  Peptide Derived from Human Papillomavirus
GVSFSELV

SEQ ID NO: 1968 - protein, 9 aa, Artificial Sequence
  Peptide Derived from Human Papillomavirus
HALFTAQEA

SEQ ID NO: 1969 - protein, 11 aa, Artificial Sequence
  Peptide Derived from Human Papillomavirus
HIQSLACSWGM

SEQ ID NO: 1970 - protein, 8 aa, Artificial Sequence
  Peptide Derived from Human Papillomavirus
HTICQTPL

SEQ ID NO: 1971 - protein, 9 aa, Artificial Sequence
  Peptide Derived from Human Papillomavirus
HTICQTPLT

SEQ ID NO: 1972 - protein, 11 aa, Artificial Sequence
  Peptide Derived from Human Papillomavirus
HTICQTPLTNI

SEQ ID NO: 1973 - protein, 10 aa, Artificial Sequence
  Peptide Derived from Human Papillomavirus
IAAFGLTPSI

SEQ ID NO: 1974 - protein, 11 aa, Artificial Sequence
  Peptide Derived from Human Papillomavirus
IAAFGLTPSIA

SEQ ID NO: 1975 - protein, 8 aa, Artificial Sequence
  Peptide Derived from Human Papillomavirus
IADSIKTL

SEQ ID NO: 1976 - protein, 9 aa, Artificial Sequence
  Peptide Derived from Human Papillomavirus
IADSIKTLL

SEQ ID NO: 1977 - protein, 8 aa, Artificial Sequence
  Peptide Derived from Human Papillomavirus
IAYKYAQL

SEQ ID NO: 1978 - protein, 9 aa, Artificial Sequence
  Peptide Derived from Human Papillomavirus
IAYKYAQLA

SEQ ID NO: 1979 - protein, 11 aa, Artificial Sequence
  Peptide Derived from Human Papillomavirus
IAYKYAQLADT

SEQ ID NO: 1980 - protein, 9 aa, Artificial Sequence
  Peptide Derived from Human Papillomavirus
ILLYGAANT

SEQ ID NO: 1981 - protein, 10 aa, Artificial Sequence
  Peptide Derived from Human Papillomavirus
ILNVLKTSNA

SEQ ID NO: 1982 - protein, 10 aa, Artificial Sequence
  Peptide Derived from Human Papillomavirus
IQSLACSWGM

SEQ ID NO: 1983 - protein, 11 aa, Artificial Sequence
  Peptide Derived from Human Papillomavirus
IQSLACSWGMV

SEQ ID NO: 1984 - protein, 9 aa, Artificial Sequence
  Peptide Derived from Human Papillomavirus
ITSNINAGT

SEQ ID NO: 1985 - protein, 8 aa, Artificial Sequence
  Peptide Derived from Human Papillomavirus
IVDDSEIA

SEQ ID NO: 1986 - protein, 8 aa, Artificial Sequence
  Peptide Derived from Human Papillomavirus
IVKDCATM

SEQ ID NO: 1987 - protein, 10 aa, Artificial Sequence
  Peptide Derived from Human Papillomavirus
IVMFLRYQGV

SEQ ID NO: 1988 - protein, 8 aa, Artificial Sequence
  Peptide Derived from Human Papillomavirus
IVNDNDYL

SEQ ID NO: 1989 - protein, 9 aa, Artificial Sequence
  Peptide Derived from Human Papillomavirus
IVNDNDYLT

SEQ ID NO: 1990 - protein, 11 aa, Artificial Sequence
  Peptide Derived from Human Papillomavirus
IVNDNDYLTQA

SEQ ID NO: 1991 - protein, 11 aa, Artificial Sequence
  Peptide Derived from Human Papillomavirus
KAAMLAKFKEL

SEQ ID NO: 1992 - protein, 11 aa, Artificial Sequence
  Peptide Derived from Human Papillomavirus
KAICIEKQSRA

SEQ ID NO: 1993 - protein, 8 aa, Artificial Sequence
  Peptide Derived from Human Papillomavirus
KIGMLDDA

SEQ ID NO: 1994 - protein, 9 aa, Artificial Sequence
  Peptide Derived from Human Papillomavirus
KIGMLDDAT

SEQ ID NO: 1995 - protein, 10 aa, Artificial Sequence
  Peptide Derived from Human Papillomavirus
KIGMLDDATV

SEQ ID NO: 1996 - protein, 8 aa, Artificial Sequence
  Peptide Derived from Human Papillomavirus
KIVKDCAT

SEQ ID NO: 1997 - protein, 9 aa, Artificial Sequence
  Peptide Derived from Human Papillomavirus
KIVKDCATM

SEQ ID NO: 1998 - protein, 8 aa, Artificial Sequence
  Peptide Derived from Human Papillomavirus
KLLCVSPM

SEQ ID NO: 1999 - protein, 10 aa, Artificial Sequence
  Peptide Derived from Human Papillomavirus
KLLCVSPMCM

SEQ ID NO: 2000 - protein, 11 aa, Artificial Sequence
  Peptide Derived from Human Papillomavirus
KLLCVSPMCMM

SEQ ID NO: 2001 - protein, 9 aa, Artificial Sequence
  Peptide Derived from Human Papillomavirus
KLLSKLLCV

SEQ ID NO: 2002 - protein, 8 aa, Artificial Sequence
  Peptide Derived from Human Papillomavirus
KLRSTAAA

SEQ ID NO: 2003 - protein, 9 aa, Artificial Sequence
  Peptide Derived from Human Papillomavirus
KLRSTAAAL

SEQ ID NO: 2004 - protein, 9 aa, Artificial Sequence
  Peptide Derived from Human Papillomavirus
KQHRDAVQV

SEQ ID NO: 2005 - protein, 10 aa, Artificial Sequence
  Peptide Derived from Human Papillomavirus
KQHRDAVQVL

SEQ ID NO: 2006 - protein, 9 aa, Artificial Sequence
  Peptide Derived from Human Papillomavirus
KQMSMSQWI

SEQ ID NO: 2007 - protein, 10 aa, Artificial Sequence
  Peptide Derived from Human Papillomavirus
KQSRAAKRRL

SEQ ID NO: 2008 - protein, 10 aa, Artificial Sequence
  Peptide Derived from Human Papillomavirus
KTGISNISEV

SEQ ID NO: 2009 - protein, 9 aa, Artificial Sequence
  Peptide Derived from Human Papillomavirus
KTLLQQYCL

SEQ ID NO: 2010 - protein, 11 aa, Artificial Sequence
  Peptide Derived from Human Papillomavirus
KTLLQQYCLYL

SEQ ID NO: 2011 - protein, 8 aa, Artificial Sequence
  Peptide Derived from Human Papillomavirus
KTSNAKAA

SEQ ID NO: 2012 - protein, 9 aa, Artificial Sequence
  Peptide Derived from Human Papillomavirus
KTSNAKAAM

SEQ ID NO: 2013 - protein, 10 aa, Artificial Sequence
  Peptide Derived from Human Papillomavirus
KTSNAKAAML

SEQ ID NO: 2014 - protein, 11 aa, Artificial Sequence
  Peptide Derived from Human Papillomavirus
KTSNAKAAMLA

SEQ ID NO: 2015 - protein, 8 aa, Artificial Sequence
  Peptide Derived from Human Papillomavirus
LACSWGMV

SEQ ID NO: 2016 - protein, 9 aa, Artificial Sequence
  Peptide Derived from Human Papillomavirus
LACSWGMVV

SEQ ID NO: 2017 - protein, 10 aa, Artificial Sequence
  Peptide Derived from Human Papillomavirus
LACSWGMVVL

SEQ ID NO: 2018 - protein, 11 aa, Artificial Sequence
  Peptide Derived from Human Papillomavirus
LACSWGMVVLL

SEQ ID NO: 2019 - protein, 8 aa, Artificial Sequence
  Peptide Derived from Human Papillomavirus
LADAKIGM

SEQ ID NO: 2020 - protein, 9 aa, Artificial Sequence
  Peptide Derived from Human Papillomavirus
LADAKIGML

SEQ ID NO: 2021 - protein, 8 aa, Artificial Sequence
  Peptide Derived from Human Papillomavirus
LADTNSNA

SEQ ID NO: 2022 - protein, 10 aa, Artificial Sequence
  Peptide Derived from Human Papillomavirus
LADTNSNASA

SEQ ID NO: 2023 - protein, 10 aa, Artificial Sequence
  Peptide Derived from Human Papillomavirus
LAKFKELYGV

SEQ ID NO: 2024 - protein, 8 aa, Artificial Sequence
  Peptide Derived from Human Papillomavirus
LITSNINA

SEQ ID NO: 2025 - protein, 10 aa, Artificial Sequence
  Peptide Derived from Human Papillomavirus
LITSNINAGT

SEQ ID NO: 2026 - protein, 9 aa, Artificial Sequence
  Peptide Derived from Human Papillomavirus
LLCVSPMCM

SEQ ID NO: 2027 - protein, 10 aa, Artificial Sequence
  Peptide Derived from Human Papillomavirus
LLCVSPMCMM

SEQ ID NO: 2028 - protein, 11 aa, Artificial Sequence
  Peptide Derived from Human Papillomavirus
LLCVSPMCMMI

SEQ ID NO: 2029 - protein, 9 aa, Artificial Sequence
  Peptide Derived from Human Papillomavirus
LLITSNINA

SEQ ID NO: 2030 - protein, 11 aa, Artificial Sequence
  Peptide Derived from Human Papillomavirus
LLITSNINAGT

SEQ ID NO: 2031 - protein, 9 aa, Artificial Sequence
  Peptide Derived from Human Papillomavirus
LLQQYCLYL

SEQ ID NO: 2032 - protein, 11 aa, Artificial Sequence
  Peptide Derived from Human Papillomavirus
LLQQYCLYLHI

SEQ ID NO: 2033 - protein, 8 aa, Artificial Sequence
  Peptide Derived from Human Papillomavirus
LLSKLLCV

SEQ ID NO: 2034 - protein, 11 aa, Artificial Sequence
  Peptide Derived from Human Papillomavirus
LLSKLLCVSPM

SEQ ID NO: 2035 - protein, 8 aa, Artificial Sequence
  Peptide Derived from Human Papillomavirus
LLYGAANT

SEQ ID NO: 2036 - protein, 9 aa, Artificial Sequence
  Peptide Derived from Human Papillomavirus
LMKFLQGSV

SEQ ID NO: 2037 - protein, 10 aa, Artificial Sequence
  Peptide Derived from Human Papillomavirus
LMKFLQGSVI

SEQ ID NO: 2038 - protein, 10 aa, Artificial Sequence
  Peptide Derived from Human Papillomavirus
LQGIPKKNCI

SEQ ID NO: 2039 - protein, 11 aa, Artificial Sequence
  Peptide Derived from Human Papillomavirus
LQGIPKKNCIL

SEQ ID NO: 2040 - protein, 9 aa, Artificial Sequence
  Peptide Derived from Human Papillomavirus
LQGSVICFV

SEQ ID NO: 2041 - protein, 9 aa, Artificial Sequence
  Peptide Derived from Human Papillomavirus
LQHSFNDCT

SEQ ID NO: 2042 - protein, 9 aa, Artificial Sequence
  Peptide Derived from Human Papillomavirus
LQPLADAKI

SEQ ID NO: 2043 - protein, 11 aa, Artificial Sequence
  Peptide Derived from Human Papillomavirus
LQPLADAKIGM

SEQ ID NO: 2044 - protein, 8 aa, Artificial Sequence
  Peptide Derived from Human Papillomavirus
LQQYCLYL

SEQ ID NO: 2045 - protein, 10 aa, Artificial Sequence
  Peptide Derived from Human Papillomavirus
LQQYCLYLHI

SEQ ID NO: 2046 - protein, 9 aa, Artificial Sequence
  Peptide Derived from Human Papillomavirus
LQVEGRHET

SEQ ID NO: 2047 - protein, 11 aa, Artificial Sequence
  Peptide Derived from Human Papillomavirus
LQVEGRHETET

SEQ ID NO: 2048 - protein, 8 aa, Artificial Sequence
  Peptide Derived from Human Papillomavirus
LTALKRFL

SEQ ID NO: 2049 - protein, 11 aa, Artificial Sequence
  Peptide Derived from Human Papillomavirus
LTALKRFLQGI

SEQ ID NO: 2050 - protein, 8 aa, Artificial Sequence
  Peptide Derived from Human Papillomavirus
LTNILNVL

SEQ ID NO: 2051 - protein, 10 aa, Artificial Sequence
  Peptide Derived from Human Papillomavirus
LTNILNVLKT

SEQ ID NO: 2052 - protein, 9 aa, Artificial Sequence
  Peptide Derived from Human Papillomavirus
LTPSIADSI

SEQ ID NO: 2053 - protein, 11 aa, Artificial Sequence
  Peptide Derived from Human Papillomavirus
LTPSIADSIKT

SEQ ID NO: 2054 - protein, 8 aa, Artificial Sequence
  Peptide Derived from Human Papillomavirus
LTQAETET

SEQ ID NO: 2055 - protein, 9 aa, Artificial Sequence
  Peptide Derived from Human Papillomavirus
LTQAETETA

SEQ ID NO: 2056 - protein, 11 aa, Artificial Sequence
  Peptide Derived from Human Papillomavirus
LTQAETETAHA

SEQ ID NO: 2057 - protein, 9 aa, Artificial Sequence
  Peptide Derived from Human Papillomavirus
LVQLKCPPL

SEQ ID NO: 2058 - protein, 10 aa, Artificial Sequence
  Peptide Derived from Human Papillomavirus
LVQLKCPPLL

SEQ ID NO: 2059 - protein, 11 aa, Artificial Sequence
  Peptide Derived from Human Papillomavirus
LVQLKCPPLLI

SEQ ID NO: 2060 - protein, 11 aa, Artificial Sequence
  Peptide Derived from Human Papillomavirus
LVRPFKSNKST

SEQ ID NO: 2061 - protein, 11 aa, Artificial Sequence
  Peptide Derived from Human Papillomavirus
LVSMDVKHRPL

SEQ ID NO: 2062 - protein, 8 aa, Artificial Sequence
  Peptide Derived from Human Papillomavirus
LVSPLSDI

SEQ ID NO: 2063 - protein, 10 aa, Artificial Sequence
  Peptide Derived from Human Papillomavirus
MIEPPKLRST

SEQ ID NO: 2064 - protein, 11 aa, Artificial Sequence
  Peptide Derived from Human Papillomavirus
MIEPPKLRSTA

SEQ ID NO: 2065 - protein, 8 aa, Artificial Sequence
  Peptide Derived from Human Papillomavirus
MLAKFKEL

SEQ ID NO: 2066 - protein, 11 aa, Artificial Sequence
  Peptide Derived from Human Papillomavirus
MLAKFKELYGV

SEQ ID NO: 2067 - protein, 10 aa, Artificial Sequence
  Peptide Derived from Human Papillomavirus
MLQVEGRHET

SEQ ID NO: 2068 - protein, 8 aa, Artificial Sequence
  Peptide Derived from Human Papillomavirus
MMIEPPKL

SEQ ID NO: 2069 - protein, 11 aa, Artificial Sequence
  Peptide Derived from Human Papillomavirus
MMIEPPKLRST

SEQ ID NO: 2070 - protein, 10 aa, Artificial Sequence
  Peptide Derived from Human Papillomavirus
MVQWAYDNDI

SEQ ID NO: 2071 - protein, 11 aa, Artificial Sequence
  Peptide Derived from Human Papillomavirus
MVQWAYDNDIV

SEQ ID NO: 2072 - protein, 11 aa, Artificial Sequence
  Peptide Derived from Human Papillomavirus
NAGTDSRWPYL

SEQ ID NO: 2073 - protein, 8 aa, Artificial Sequence
  Peptide Derived from Human Papillomavirus
NAKAAMLA

SEQ ID NO: 2074 - protein, 8 aa, Artificial Sequence
  Peptide Derived from Human Papillomavirus
NALDGNLV

SEQ ID NO: 2075 - protein, 10 aa, Artificial Sequence
  Peptide Derived from Human Papillomavirus
NALDGNLVSM

SEQ ID NO: 2076 - protein, 8 aa, Artificial Sequence
  Peptide Derived from Human Papillomavirus
NILNVLKT

SEQ ID NO: 2077 - protein, 11 aa, Artificial Sequence
  Peptide Derived from Human Papillomavirus
NILNVLKTSNA

SEQ ID NO: 2078 - protein, 9 aa, Artificial Sequence
  Peptide Derived from Human Papillomavirus
NISEVYGDT

SEQ ID NO: 2079 - protein, 8 aa, Artificial Sequence
  Peptide Derived from Human Papillomavirus
NISPRLKA

SEQ ID NO: 2080 - protein, 9 aa, Artificial Sequence
  Peptide Derived from Human Papillomavirus
NISPRLKAI

SEQ ID NO: 2081 - protein, 11 aa, Artificial Sequence
  Peptide Derived from Human Papillomavirus
NISPRLKAICI

SEQ ID NO: 2082 - protein, 10 aa, Artificial Sequence
  Peptide Derived from Human Papillomavirus
NLRNALDGNL

SEQ ID NO: 2083 - protein, 11 aa, Artificial Sequence
  Peptide Derived from Human Papillomavirus
NLRNALDGNLV

SEQ ID NO: 2084 - protein, 9 aa, Artificial Sequence
  Peptide Derived from Human Papillomavirus
NTEVETQQM

SEQ ID NO: 2085 - protein, 10 aa, Artificial Sequence
  Peptide Derived from Human Papillomavirus
NTEVETQQML

SEQ ID NO: 2086 - protein, 9 aa, Artificial Sequence
  Peptide Derived from Human Papillomavirus
NTGKSLFGM

SEQ ID NO: 2087 - protein, 11 aa, Artificial Sequence
  Peptide Derived from Human Papillomavirus
NTGKSLFGMSL

SEQ ID NO: 2088 - protein, 8 aa, Artificial Sequence
  Peptide Derived from Human Papillomavirus
NVLKTSNA

SEQ ID NO: 2089 - protein, 10 aa, Artificial Sequence
  Peptide Derived from Human Papillomavirus
NVLKTSNAKA

SEQ ID NO: 2090 - protein, 11 aa, Artificial Sequence
  Peptide Derived from Human Papillomavirus
NVLKTSNAKAA

SEQ ID NO: 2091 - protein, 10 aa, Artificial Sequence
  Peptide Derived from Human Papillomavirus
PAGTNGEEGT

SEQ ID NO: 2092 - protein, 9 aa, Artificial Sequence
  Peptide Derived from Human Papillomavirus
PLADAKIGM

SEQ ID NO: 2093 - protein, 10 aa, Artificial Sequence
  Peptide Derived from Human Papillomavirus
PLADAKIGML

SEQ ID NO: 2094 - protein, 8 aa, Artificial Sequence
  Peptide Derived from Human Papillomavirus
PLLITSNI

SEQ ID NO: 2095 - protein, 10 aa, Artificial Sequence
  Peptide Derived from Human Papillomavirus
PLLITSNINA

SEQ ID NO: 2096 - protein, 9 aa, Artificial Sequence
  Peptide Derived from Human Papillomavirus
PLSDISGCV

SEQ ID NO: 2097 - protein, 8 aa, Artificial Sequence
  Peptide Derived from Human Papillomavirus
PLTNILNV

SEQ ID NO: 2098 - protein, 9 aa, Artificial Sequence
  Peptide Derived from Human Papillomavirus
PLTNILNVL

SEQ ID NO: 2099 - protein, 11 aa, Artificial Sequence
  Peptide Derived from Human Papillomavirus
PLTNILNVLKT

SEQ ID NO: 2100 - protein, 10 aa, Artificial Sequence
  Peptide Derived from Human Papillomavirus
PLVQLKCPPL

SEQ ID NO: 2101 - protein, 11 aa, Artificial Sequence
  Peptide Derived from Human Papillomavirus
PLVQLKCPPLL

SEQ ID NO: 2102 - protein, 11 aa, Artificial Sequence
  Peptide Derived from Human Papillomavirus
PMCMMIEPPKL

SEQ ID NO: 2103 - protein, 11 aa, Artificial Sequence
  Peptide Derived from Human Papillomavirus
PTFKCVSGQNT

SEQ ID NO: 2104 - protein, 9 aa, Artificial Sequence
  Peptide Derived from Human Papillomavirus
QAETETAHA

SEQ ID NO: 2105 - protein, 10 aa, Artificial Sequence
  Peptide Derived from Human Papillomavirus
QAETETAHAL

SEQ ID NO: 2106 - protein, 9 aa, Artificial Sequence
  Peptide Derived from Human Papillomavirus
QAKIVKDCA

SEQ ID NO: 2107 - protein, 10 aa, Artificial Sequence
  Peptide Derived from Human Papillomavirus
QAKIVKDCAT

SEQ ID NO: 2108 - protein, 11 aa, Artificial Sequence
  Peptide Derived from Human Papillomavirus
QAKIVKDCATM

SEQ ID NO: 2109 - protein, 11 aa, Artificial Sequence
  Peptide Derived from Human Papillomavirus
QIVMFLRYQGV

SEQ ID NO: 2110 - protein, 9 aa, Artificial Sequence
  Peptide Derived from Human Papillomavirus
QLADTNSNA

SEQ ID NO: 2111 - protein, 11 aa, Artificial Sequence
  Peptide Derived from Human Papillomavirus
QLADTNSNASA

SEQ ID NO: 2112 - protein, 8 aa, Artificial Sequence
  Peptide Derived from Human Papillomavirus
QLKCPPLL

SEQ ID NO: 2113 - protein, 9 aa, Artificial Sequence
  Peptide Derived from Human Papillomavirus
QLKCPPLLI

SEQ ID NO: 2114 - protein, 10 aa, Artificial Sequence
  Peptide Derived from Human Papillomavirus
QLKCPPLLIT

SEQ ID NO: 2115 - protein, 11 aa, Artificial Sequence
  Peptide Derived from Human Papillomavirus
QMLQVEGRHET

SEQ ID NO: 2116 - protein, 8 aa, Artificial Sequence
  Peptide Derived from Human Papillomavirus
QMSMSQWI

SEQ ID NO: 2117 - protein, 11 aa, Artificial Sequence
  Peptide Derived from Human Papillomavirus
QMVQWAYDNDI

SEQ ID NO: 2118 - protein, 9 aa, Artificial Sequence
  Peptide Derived from Human Papillomavirus
QQYCLYLHI

SEQ ID NO: 2119 - protein, 8 aa, Artificial Sequence
  Peptide Derived from Human Papillomavirus
QTPLTNIL

SEQ ID NO: 2120 - protein, 10 aa, Artificial Sequence
  Peptide Derived from Human Papillomavirus
QTPLTNILNV

SEQ ID NO: 2121 - protein, 11 aa, Artificial Sequence
  Peptide Derived from Human Papillomavirus
QTPLTNILNVL

SEQ ID NO: 2122 - protein, 8 aa, Artificial Sequence
  Peptide Derived from Human Papillomavirus
QVEGRHET

SEQ ID NO: 2123 - protein, 10 aa, Artificial Sequence
  Peptide Derived from Human Papillomavirus
QVEGRHETET

SEQ ID NO: 2124 - protein, 8 aa, Artificial Sequence
  Peptide Derived from Human Papillomavirus
QVLKRKYL

SEQ ID NO: 2125 - protein, 9 aa, Artificial Sequence
  Peptide Derived from Human Papillomavirus
QVLKRKYLV

SEQ ID NO: 2126 - protein, 9 aa, Artificial Sequence
  Peptide Derived from Human Papillomavirus
RAEKKQMSM

SEQ ID NO: 2127 - protein, 8 aa, Artificial Sequence
  Peptide Derived from Human Papillomavirus
RTWSRLSL

SEQ ID NO: 2128 - protein, 11 aa, Artificial Sequence
  Peptide Derived from Human Papillomavirus
RVDDGGDWKQI

SEQ ID NO: 2129 - protein, 10 aa, Artificial Sequence
  Peptide Derived from Human Papillomavirus
SAFLKSNSQA

SEQ ID NO: 2130 - protein, 8 aa, Artificial Sequence
  Peptide Derived from Human Papillomavirus
SIADSIKT

SEQ ID NO: 2131 - protein, 9 aa, Artificial Sequence
  Peptide Derived from Human Papillomavirus
SIADSIKTL

SEQ ID NO: 2132 - protein, 10 aa, Artificial Sequence
  Peptide Derived from Human Papillomavirus
SIADSIKTLL

SEQ ID NO: 2133 - protein, 11 aa, Artificial Sequence
  Peptide Derived from Human Papillomavirus
SIKTLLQQYCL

SEQ ID NO: 2134 - protein, 8 aa, Artificial Sequence
  Peptide Derived from Human Papillomavirus
SLACSWGM

SEQ ID NO: 2135 - protein, 9 aa, Artificial Sequence
  Peptide Derived from Human Papillomavirus
SLACSWGMV

SEQ ID NO: 2136 - protein, 10 aa, Artificial Sequence
  Peptide Derived from Human Papillomavirus
SLACSWGMVV

SEQ ID NO: 2137 - protein, 11 aa, Artificial Sequence
  Peptide Derived from Human Papillomavirus
SLACSWGMVVL

SEQ ID NO: 2138 - protein, 8 aa, Artificial Sequence
  Peptide Derived from Human Papillomavirus
SLFGMSLM

SEQ ID NO: 2139 - protein, 11 aa, Artificial Sequence
  Peptide Derived from Human Papillomavirus
SLFGMSLMKFL

SEQ ID NO: 2140 - protein, 10 aa, Artificial Sequence
  Peptide Derived from Human Papillomavirus
SLMKFLQGSV

SEQ ID NO: 2141 - protein, 11 aa, Artificial Sequence
  Peptide Derived from Human Papillomavirus
SLMKFLQGSVI

SEQ ID NO: 2142 - protein, 8 aa, Artificial Sequence
  Peptide Derived from Human Papillomavirus
SLPTFKCV

SEQ ID NO: 2143 - protein, 9 aa, Artificial Sequence
  Peptide Derived from Human Papillomavirus
SMDVKHRPL

SEQ ID NO: 2144 - protein, 10 aa, Artificial Sequence
  Peptide Derived from Human Papillomavirus
SMDVKHRPLV

SEQ ID NO: 2145 - protein, 10 aa, Artificial Sequence
  Peptide Derived from Human Papillomavirus
SQAKIVKDCA

SEQ ID NO: 2146 - protein, 11 aa, Artificial Sequence
  Peptide Derived from Human Papillomavirus
SQAKIVKDCAT

SEQ ID NO: 2147 - protein, 11 aa, Artificial Sequence
  Peptide Derived from Human Papillomavirus
SQWIKYRCDRV

SEQ ID NO: 2148 - protein, 11 aa, Artificial Sequence
  Peptide Derived from Human Papillomavirus
STAAALYWYKT

SEQ ID NO: 2149 - protein, 8 aa, Artificial Sequence
  Peptide Derived from Human Papillomavirus
STCCDWCI

SEQ ID NO: 2150 - protein, 9 aa, Artificial Sequence
  Peptide Derived from Human Papillomavirus
STCCDWCIA

SEQ ID NO: 2151 - protein, 10 aa, Artificial Sequence
  Peptide Derived from Human Papillomavirus
STCCDWCIAA

SEQ ID NO: 2152 - protein, 10 aa, Artificial Sequence
  Peptide Derived from Human Papillomavirus
TAAALYWYKT

SEQ ID NO: 2153 - protein, 8 aa, Artificial Sequence
  Peptide Derived from Human Papillomavirus
TAHALFTA

SEQ ID NO: 2154 - protein, 11 aa, Artificial Sequence
  Peptide Derived from Human Papillomavirus
TAHALFTAQEA

SEQ ID NO: 2155 - protein, 10 aa, Artificial Sequence
  Peptide Derived from Human Papillomavirus
TALKRFLQGI

SEQ ID NO: 2156 - protein, 11 aa, Artificial Sequence
  Peptide Derived from Human Papillomavirus
TAQEAKQHRDA

SEQ ID NO: 2157 - protein, 8 aa, Artificial Sequence
  Peptide Derived from Human Papillomavirus
TICQTPLT

SEQ ID NO: 2158 - protein, 10 aa, Artificial Sequence
  Peptide Derived from Human Papillomavirus
TICQTPLTNI

SEQ ID NO: 2159 - protein, 11 aa, Artificial Sequence
  Peptide Derived from Human Papillomavirus
TICQTPLTNIL

SEQ ID NO: 2160 - protein, 9 aa, Artificial Sequence
  Peptide Derived from Human Papillomavirus
TIEKLLSKL

SEQ ID NO: 2161 - protein, 10 aa, Artificial Sequence
  Peptide Derived from Human Papillomavirus
TIEKLLSKLL

SEQ ID NO: 2162 - protein, 8 aa, Artificial Sequence
  Peptide Derived from Human Papillomavirus
TLLQQYCL

SEQ ID NO: 2163 - protein, 10 aa, Artificial Sequence
  Peptide Derived from Human Papillomavirus
TLLQQYCLYL

SEQ ID NO: 2164 - protein, 9 aa, Artificial Sequence
  Peptide Derived from Human Papillomavirus
TMCRHYKRA

SEQ ID NO: 2165 - protein, 8 aa, Artificial Sequence
  Peptide Derived from Human Papillomavirus
TQAETETA

SEQ ID NO: 2166 - protein, 10 aa, Artificial Sequence
  Peptide Derived from Human Papillomavirus
TQAETETAHA

SEQ ID NO: 2167 - protein, 11 aa, Artificial Sequence
  Peptide Derived from Human Papillomavirus
TQAETETAHAL

SEQ ID NO: 2168 - protein, 11 aa, Artificial Sequence
  Peptide Derived from Human Papillomavirus
TVLQHSFNDCT

SEQ ID NO: 2169 - protein, 8 aa, Artificial Sequence
  Peptide Derived from Human Papillomavirus
TVPCWNYI

SEQ ID NO: 2170 - protein, 8 aa, Artificial Sequence
  Peptide Derived from Human Papillomavirus
VLKRKYLV

SEQ ID NO: 2171 - protein, 11 aa, Artificial Sequence
  Peptide Derived from Human Papillomavirus
VLKRKYLVSPL

SEQ ID NO: 2172 - protein, 9 aa, Artificial Sequence
  Peptide Derived from Human Papillomavirus
VLKTSNAKA

SEQ ID NO: 2173 - protein, 10 aa, Artificial Sequence
  Peptide Derived from Human Papillomavirus
VLKTSNAKAA

SEQ ID NO: 2174 - protein, 11 aa, Artificial Sequence
  Peptide Derived from Human Papillomavirus
VLKTSNAKAAM

SEQ ID NO: 2175 - protein, 10 aa, Artificial Sequence
  Peptide Derived from Human Papillomavirus
VLQHSFNDCT

SEQ ID NO: 2176 - protein, 9 aa, Artificial Sequence
  Peptide Derived from Human Papillomavirus
VMFLRYQGV

SEQ ID NO: 2177 - protein, 8 aa, Artificial Sequence
  Peptide Derived from Human Papillomavirus
VQLKCPPL

SEQ ID NO: 2178 - protein, 9 aa, Artificial Sequence
  Peptide Derived from Human Papillomavirus
VQLKCPPLL

SEQ ID NO: 2179 - protein, 10 aa, Artificial Sequence
  Peptide Derived from Human Papillomavirus
VQLKCPPLLI

SEQ ID NO: 2180 - protein, 11 aa, Artificial Sequence
  Peptide Derived from Human Papillomavirus
VQLKCPPLLIT

SEQ ID NO: 2181 - protein, 9 aa, Artificial Sequence
  Peptide Derived from Human Papillomavirus
VQVLKRKYL

SEQ ID NO: 2182 - protein, 10 aa, Artificial Sequence
  Peptide Derived from Human Papillomavirus
VQVLKRKYLV

SEQ ID NO: 2183 - protein, 9 aa, Artificial Sequence
  Peptide Derived from Human Papillomavirus
VQWAYDNDI

SEQ ID NO: 2184 - protein, 10 aa, Artificial Sequence
  Peptide Derived from Human Papillomavirus
VQWAYDNDIV

SEQ ID NO: 2185 - protein, 9 aa, Artificial Sequence
  Peptide Derived from Human Papillomavirus
VVEKKTGDA

SEQ ID NO: 2186 - protein, 10 aa, Artificial Sequence
  Peptide Derived from Human Papillomavirus
VVEKKTGDAI

SEQ ID NO: 2187 - protein, 8 aa, Artificial Sequence
  Peptide Derived from Human Papillomavirus
WAYDNDIV

SEQ ID NO: 2188 - protein, 9 aa, Artificial Sequence
  Peptide Derived from Human Papillomavirus
WIKYRCDRV

SEQ ID NO: 2189 - protein, 8 aa, Artificial Sequence
  Peptide Derived from Human Papillomavirus
WIQRQTVL

SEQ ID NO: 2190 - protein, 8 aa, Artificial Sequence
  Peptide Derived from Human Papillomavirus
WLQPLADA

SEQ ID NO: 2191 - protein, 10 aa, Artificial Sequence
  Peptide Derived from Human Papillomavirus
WLQPLADAKI

SEQ ID NO: 2192 - protein, 11 aa, Artificial Sequence
  Peptide Derived from Human Papillomavirus
YAQLADTNSNA

SEQ ID NO: 2193 - protein, 9 aa, Artificial Sequence
  Peptide Derived from Human Papillomavirus
YIDDNLRNA

SEQ ID NO: 2194 - protein, 10 aa, Artificial Sequence
  Peptide Derived from Human Papillomavirus
YIDDNLRNAL

SEQ ID NO: 2195 - protein, 8 aa, Artificial Sequence
  Peptide Derived from Human Papillomavirus
YLHIQSLA

SEQ ID NO: 2196 - protein, 8 aa, Artificial Sequence
  Peptide Derived from Human Papillomavirus
YLHNRLVV

SEQ ID NO: 2197 - protein, 10 aa, Artificial Sequence
  Peptide Derived from Human Papillomavirus
YLHNRLVVFT

SEQ ID NO: 2198 - protein, 9 aa, Artificial Sequence
  Peptide Derived from Human Papillomavirus
YLTQAETET

SEQ ID NO: 2199 - protein, 10 aa, Artificial Sequence
  Peptide Derived from Human Papillomavirus
YLTQAETETA

SEQ ID NO: 2200 - protein, 9 aa, Artificial Sequence
  Peptide Derived from Human Papillomavirus
YLVSPLSDI

SEQ ID NO: 2201 - protein, 10 aa, Artificial Sequence
  Peptide Derived from Human Papillomavirus
YQGVEFMSFL

SEQ ID NO: 2202 - protein, 11 aa, Artificial Sequence
  Peptide Derived from Human Papillomavirus
YQGVEFMSFLT

SEQ ID NO: 2203 - protein, 10 aa, Artificial Sequence
  Peptide Derived from Human Papillomavirus
YVEAVVEKKT

SEQ ID NO: 2204 - protein, 8 aa, Artificial Sequence
  Peptide Derived from Human Papillomavirus
AATHTKAV

SEQ ID NO: 2205 - protein, 9 aa, Artificial Sequence
  Peptide Derived from Human Papillomavirus
AATHTKAVA

SEQ ID NO: 2206 - protein, 10 aa, Artificial Sequence
  Peptide Derived from Human Papillomavirus
AATHTKAVAL

SEQ ID NO: 2207 - protein, 8 aa, Artificial Sequence
  Peptide Derived from Human Papillomavirus
AIELQLTL

SEQ ID NO: 2208 - protein, 10 aa, Artificial Sequence
  Peptide Derived from Human Papillomavirus
AIELQLTLET

SEQ ID NO: 2209 - protein, 11 aa, Artificial Sequence
  Peptide Derived from Human Papillomavirus
AIELQLTLETI

SEQ ID NO: 2210 - protein, 9 aa, Artificial Sequence
  Peptide Derived from Human Papillomavirus
AIYYKAREM

SEQ ID NO: 2211 - protein, 9 aa, Artificial Sequence
  Peptide Derived from Human Papillomavirus
ALGTEETQT

SEQ ID NO: 2212 - protein, 10 aa, Artificial Sequence
  Peptide Derived from Human Papillomavirus
ALGTEETQTT

SEQ ID NO: 2213 - protein, 11 aa, Artificial Sequence
  Peptide Derived from Human Papillomavirus
ALGTEETQTTI

SEQ ID NO: 2214 - protein, 9 aa, Artificial Sequence
  Peptide Derived from Human Papillomavirus
ALQAIELQL

SEQ ID NO: 2215 - protein, 10 aa, Artificial Sequence
  Peptide Derived from Human Papillomavirus
ALQAIELQLT

SEQ ID NO: 2216 - protein, 11 aa, Artificial Sequence
  Peptide Derived from Human Papillomavirus
ALQAIELQLTL

SEQ ID NO: 2217 - protein, 8 aa, Artificial Sequence
  Peptide Derived from Human Papillomavirus
ATHTKAVA

SEQ ID NO: 2218 - protein, 9 aa, Artificial Sequence
  Peptide Derived from Human Papillomavirus
ATHTKAVAL

SEQ ID NO: 2219 - protein, 11 aa, Artificial Sequence
  Peptide Derived from Human Papillomavirus
ATHTKAVALGT

SEQ ID NO: 2220 - protein, 9 aa, Artificial Sequence
  Peptide Derived from Human Papillomavirus
AVALGTEET

SEQ ID NO: 2221 - protein, 11 aa, Artificial Sequence
  Peptide Derived from Human Papillomavirus
AVALGTEETQT

SEQ ID NO: 2222 - protein, 8 aa, Artificial Sequence
  Peptide Derived from Human Papillomavirus
AVSKNKAL

SEQ ID NO: 2223 - protein, 10 aa, Artificial Sequence
  Peptide Derived from Human Papillomavirus
AVSKNKALQA

SEQ ID NO: 2224 - protein, 11 aa, Artificial Sequence
  Peptide Derived from Human Papillomavirus
AVSKNKALQAI

SEQ ID NO: 2225 - protein, 9 aa, Artificial Sequence
  Peptide Derived from Human Papillomavirus
AVSSTWHWT

SEQ ID NO: 2226 - protein, 10 aa, Artificial Sequence
  Peptide Derived from Human Papillomavirus
CAIYYKAREM

SEQ ID NO: 2227 - protein, 8 aa, Artificial Sequence
  Peptide Derived from Human Papillomavirus
CIKKHGYT

SEQ ID NO: 2228 - protein, 9 aa, Artificial Sequence
  Peptide Derived from Human Papillomavirus
CIKKHGYTV

SEQ ID NO: 2229 - protein, 11 aa, Artificial Sequence
  Peptide Derived from Human Papillomavirus
CIKKHGYTVEV

SEQ ID NO: 2230 - protein, 11 aa, Artificial Sequence
  Peptide Derived from Human Papillomavirus
CLRYRFKKHCT

SEQ ID NO: 2231 - protein, 11 aa, Artificial Sequence
  Peptide Derived from Human Papillomavirus
CQRLNVCQDKI

SEQ ID NO: 2232 - protein, 10 aa, Artificial Sequence
  Peptide Derived from Human Papillomavirus
CTLYTAVSST

SEQ ID NO: 2233 - protein, 10 aa, Artificial Sequence
  Peptide Derived from Human Papillomavirus
DAEKYSKNKV

SEQ ID NO: 2234 - protein, 8 aa, Artificial Sequence
  Peptide Derived from Human Papillomavirus
DANTLKCL

SEQ ID NO: 2235 - protein, 9 aa, Artificial Sequence
  Peptide Derived from Human Papillomavirus
DICNTMHYT

SEQ ID NO: 2236 - protein, 9 aa, Artificial Sequence
  Peptide Derived from Human Papillomavirus
DQFLSQVKI

SEQ ID NO: 2237 - protein, 8 aa, Artificial Sequence
  Peptide Derived from Human Papillomavirus
DTGNPCHT

SEQ ID NO: 2238 - protein, 9 aa, Artificial Sequence
  Peptide Derived from Human Papillomavirus
DTGNPCHTT

SEQ ID NO: 2239 - protein, 11 aa, Artificial Sequence
  Peptide Derived from Human Papillomavirus
DTGNPCHTTKL

SEQ ID NO: 2240 - protein, 8 aa, Artificial Sequence
  Peptide Derived from Human Papillomavirus
DVSLEVYL

SEQ ID NO: 2241 - protein, 9 aa, Artificial Sequence
  Peptide Derived from Human Papillomavirus
DVSLEVYLT

SEQ ID NO: 2242 - protein, 10 aa, Artificial Sequence
  Peptide Derived from Human Papillomavirus
DVSLEVYLTA

SEQ ID NO: 2243 - protein, 11 aa, Artificial Sequence
  Peptide Derived from Human Papillomavirus
EASVTVVEGQV

SEQ ID NO: 2244 - protein, 8 aa, Artificial Sequence
  Peptide Derived from Human Papillomavirus
EIIRQHLA

SEQ ID NO: 2245 - protein, 8 aa, Artificial Sequence
  Peptide Derived from Human Papillomavirus
ELQLTLET

SEQ ID NO: 2246 - protein, 9 aa, Artificial Sequence
  Peptide Derived from Human Papillomavirus
ELQLTLETI

SEQ ID NO: 2247 - protein, 11 aa, Artificial Sequence
  Peptide Derived from Human Papillomavirus
EMGFKHINHQV

SEQ ID NO: 2248 - protein, 9 aa, Artificial Sequence
  Peptide Derived from Human Papillomavirus
ETLCQRLNV

SEQ ID NO: 2249 - protein, 8 aa, Artificial Sequence
  Peptide Derived from Human Papillomavirus
EVHAGGQV

SEQ ID NO: 2250 - protein, 9 aa, Artificial Sequence
  Peptide Derived from Human Papillomavirus
EVHAGGQVI

SEQ ID NO: 2251 - protein, 10 aa, Artificial Sequence
  Peptide Derived from Human Papillomavirus
EVHAGGQVIL

SEQ ID NO: 2252 - protein, 8 aa, Artificial Sequence
  Peptide Derived from Human Papillomavirus
EVQFDGDI

SEQ ID NO: 2253 - protein, 11 aa, Artificial Sequence
  Peptide Derived from Human Papillomavirus
EVQFDGDICNT

SEQ ID NO: 2254 - protein, 8 aa, Artificial Sequence
  Peptide Derived from Human Papillomavirus
EVSSPEII

SEQ ID NO: 2255 - protein, 8 aa, Artificial Sequence
  Peptide Derived from Human Papillomavirus
EVYLTAPT

SEQ ID NO: 2256 - protein, 11 aa, Artificial Sequence
  Peptide Derived from Human Papillomavirus
EVYLTAPTGCI

SEQ ID NO: 2257 - protein, 10 aa, Artificial Sequence
  Peptide Derived from Human Papillomavirus
FLSQVKIPKT

SEQ ID NO: 2258 - protein, 11 aa, Artificial Sequence
  Peptide Derived from Human Papillomavirus
FLSQVKIPKTI

SEQ ID NO: 2259 - protein, 8 aa, Artificial Sequence
  Peptide Derived from Human Papillomavirus
FVQFKDDA

SEQ ID NO: 2260 - protein, 9 aa, Artificial Sequence
  Peptide Derived from Human Papillomavirus
GLYYVHEGI

SEQ ID NO: 2261 - protein, 11 aa, Artificial Sequence
  Peptide Derived from Human Papillomavirus
GLYYVHEGIRT

SEQ ID NO: 2262 - protein, 8 aa, Artificial Sequence
  Peptide Derived from Human Papillomavirus
GQVDYYGL

SEQ ID NO: 2263 - protein, 11 aa, Artificial Sequence
  Peptide Derived from Human Papillomavirus
GQVDYYGLYYV

SEQ ID NO: 2264 - protein, 8 aa, Artificial Sequence
  Peptide Derived from Human Papillomavirus
GQVILCPT

SEQ ID NO: 2265 - protein, 10 aa, Artificial Sequence
  Peptide Derived from Human Papillomavirus
GQVILCPTSV

SEQ ID NO: 2266 - protein, 8 aa, Artificial Sequence
  Peptide Derived from Human Papillomavirus
GTEETQTT

SEQ ID NO: 2267 - protein, 9 aa, Artificial Sequence
  Peptide Derived from Human Papillomavirus
GTEETQTTI

SEQ ID NO: 2268 - protein, 8 aa, Artificial Sequence
  Peptide Derived from Human Papillomavirus
HAGGQVIL

SEQ ID NO: 2269 - protein, 11 aa, Artificial Sequence
  Peptide Derived from Human Papillomavirus
HAGGQVILCPT

SEQ ID NO: 2270 - protein, 8 aa, Artificial Sequence
  Peptide Derived from Human Papillomavirus
HIDYWKHM

SEQ ID NO: 2271 - protein, 10 aa, Artificial Sequence
  Peptide Derived from Human Papillomavirus
HIDYWKHMRL

SEQ ID NO: 2272 - protein, 9 aa, Artificial Sequence
  Peptide Derived from Human Papillomavirus
HINHQVVPT

SEQ ID NO: 2273 - protein, 10 aa, Artificial Sequence
  Peptide Derived from Human Papillomavirus
HINHQVVPTL

SEQ ID NO: 2274 - protein, 11 aa, Artificial Sequence
  Peptide Derived from Human Papillomavirus
HINHQVVPTLA

SEQ ID NO: 2275 - protein, 8 aa, Artificial Sequence
  Peptide Derived from Human Papillomavirus
HIYICEEA

SEQ ID NO: 2276 - protein, 10 aa, Artificial Sequence
  Peptide Derived from Human Papillomavirus
HIYICEEASV

SEQ ID NO: 2277 - protein, 11 aa, Artificial Sequence
  Peptide Derived from Human Papillomavirus
HIYICEEASVT

SEQ ID NO: 2278 - protein, 8 aa, Artificial Sequence
  Peptide Derived from Human Papillomavirus
HLANHPAA

SEQ ID NO: 2279 - protein, 9 aa, Artificial Sequence
  Peptide Derived from Human Papillomavirus
HLANHPAAT

SEQ ID NO: 2280 - protein, 11 aa, Artificial Sequence
  Peptide Derived from Human Papillomavirus
HLANHPAATHT

SEQ ID NO: 2281 - protein, 8 aa, Artificial Sequence
  Peptide Derived from Human Papillomavirus
HLKGDANT

SEQ ID NO: 2282 - protein, 9 aa, Artificial Sequence
  Peptide Derived from Human Papillomavirus
HLKGDANTL

SEQ ID NO: 2283 - protein, 8 aa, Artificial Sequence
  Peptide Derived from Human Papillomavirus
HMRLECAI

SEQ ID NO: 2284 - protein, 8 aa, Artificial Sequence
  Peptide Derived from Human Papillomavirus
HQVVPTLA

SEQ ID NO: 2285 - protein, 9 aa, Artificial Sequence
  Peptide Derived from Human Papillomavirus
HQVVPTLAV

SEQ ID NO: 2286 - protein, 9 aa, Artificial Sequence
  Peptide Derived from Human Papillomavirus
HTKAVALGT

SEQ ID NO: 2287 - protein, 11 aa, Artificial Sequence
  Peptide Derived from Human Papillomavirus
HTTKLLHRDSV

SEQ ID NO: 2288 - protein, 11 aa, Artificial Sequence
  Peptide Derived from Human Papillomavirus
IIRQHLANHPA

SEQ ID NO: 2289 - protein, 10 aa, Artificial Sequence
  Peptide Derived from Human Papillomavirus
ILTHYENDST

SEQ ID NO: 2290 - protein, 10 aa, Artificial Sequence
  Peptide Derived from Human Papillomavirus
IQRPRSEPDT

SEQ ID NO: 2291 - protein, 8 aa, Artificial Sequence
  Peptide Derived from Human Papillomavirus
ITVSTGFM

SEQ ID NO: 2292 - protein, 10 aa, Artificial Sequence
  Peptide Derived from Human Papillomavirus
ITVSTGFMSI

SEQ ID NO: 2293 - protein, 8 aa, Artificial Sequence
  Peptide Derived from Human Papillomavirus
IVHLKGDA

SEQ ID NO: 2294 - protein, 10 aa, Artificial Sequence
  Peptide Derived from Human Papillomavirus
IVHLKGDANT

SEQ ID NO: 2295 - protein, 11 aa, Artificial Sequence
  Peptide Derived from Human Papillomavirus
IVHLKGDANTL

SEQ ID NO: 2296 - protein, 8 aa, Artificial Sequence
  Peptide Derived from Human Papillomavirus
KALQAIEL

SEQ ID NO: 2297 - protein, 10 aa, Artificial Sequence
  Peptide Derived from Human Papillomavirus
KALQAIELQL

SEQ ID NO: 2298 - protein, 11 aa, Artificial Sequence
  Peptide Derived from Human Papillomavirus
KALQAIELQLT

SEQ ID NO: 2299 - protein, 10 aa, Artificial Sequence
  Peptide Derived from Human Papillomavirus
KAREMGFKHI

SEQ ID NO: 2300 - protein, 10 aa, Artificial Sequence
  Peptide Derived from Human Papillomavirus
KAVALGTEET

SEQ ID NO: 2301 - protein, 11 aa, Artificial Sequence
  Peptide Derived from Human Papillomavirus
KILTHYENDST

SEQ ID NO: 2302 - protein, 8 aa, Artificial Sequence
  Peptide Derived from Human Papillomavirus
KIPKTITV

SEQ ID NO: 2303 - protein, 10 aa, Artificial Sequence
  Peptide Derived from Human Papillomavirus
KIPKTITVST

SEQ ID NO: 2304 - protein, 8 aa, Artificial Sequence
  Peptide Derived from Human Papillomavirus
KLLHRDSV

SEQ ID NO: 2305 - protein, 11 aa, Artificial Sequence
  Peptide Derived from Human Papillomavirus
KLLHRDSVDSA

SEQ ID NO: 2306 - protein, 10 aa, Artificial Sequence
  Peptide Derived from Human Papillomavirus
KTITVSTGFM

SEQ ID NO: 2307 - protein, 11 aa, Artificial Sequence
  Peptide Derived from Human Papillomavirus
KVWEVHAGGQV

SEQ ID NO: 2308 - protein, 8 aa, Artificial Sequence
  Peptide Derived from Human Papillomavirus
LANHPAAT

SEQ ID NO: 2309 - protein, 10 aa, Artificial Sequence
  Peptide Derived from Human Papillomavirus
LANHPAATHT

SEQ ID NO: 2310 - protein, 8 aa, Artificial Sequence
  Peptide Derived from Human Papillomavirus
LAVSKNKA

SEQ ID NO: 2311 - protein, 9 aa, Artificial Sequence
  Peptide Derived from Human Papillomavirus
LAVSKNKAL

SEQ ID NO: 2312 - protein, 11 aa, Artificial Sequence
  Peptide Derived from Human Papillomavirus
LAVSKNKALQA

SEQ ID NO: 2313 - protein, 10 aa, Artificial Sequence
  Peptide Derived from Human Papillomavirus
LLHRDSVDSA

SEQ ID NO: 2314 - protein, 8 aa, Artificial Sequence
  Peptide Derived from Human Papillomavirus
LQAIELQL

SEQ ID NO: 2315 - protein, 9 aa, Artificial Sequence
  Peptide Derived from Human Papillomavirus
LQAIELQLT

SEQ ID NO: 2316 - protein, 10 aa, Artificial Sequence
  Peptide Derived from Human Papillomavirus
LQAIELQLTL

SEQ ID NO: 2317 - protein, 8 aa, Artificial Sequence
  Peptide Derived from Human Papillomavirus
LQDVSLEV

SEQ ID NO: 2318 - protein, 10 aa, Artificial Sequence
  Peptide Derived from Human Papillomavirus
LQDVSLEVYL

SEQ ID NO: 2319 - protein, 11 aa, Artificial Sequence
  Peptide Derived from Human Papillomavirus
LQDVSLEVYLT

SEQ ID NO: 2320 - protein, 8 aa, Artificial Sequence
  Peptide Derived from Human Papillomavirus
LQLTLETI

SEQ ID NO: 2321 - protein, 8 aa, Artificial Sequence
  Peptide Derived from Human Papillomavirus
LTAPTGCI

SEQ ID NO: 2322 - protein, 9 aa, Artificial Sequence
  Peptide Derived from Human Papillomavirus
LTHYENDST

SEQ ID NO: 2323 - protein, 11 aa, Artificial Sequence
  Peptide Derived from Human Papillomavirus
LTHYENDSTDL

SEQ ID NO: 2324 - protein, 9 aa, Artificial Sequence
  Peptide Derived from Human Papillomavirus
NTMHYTNWT

SEQ ID NO: 2325 - protein, 11 aa, Artificial Sequence
  Peptide Derived from Human Papillomavirus
NTMHYTNWTHI

SEQ ID NO: 2326 - protein, 8 aa, Artificial Sequence
  Peptide Derived from Human Papillomavirus
NTTPIVHL

SEQ ID NO: 2327 - protein, 8 aa, Artificial Sequence
  Peptide Derived from Human Papillomavirus
NVCQDKIL

SEQ ID NO: 2328 - protein, 9 aa, Artificial Sequence
  Peptide Derived from Human Papillomavirus
NVCQDKILT

SEQ ID NO: 2329 - protein, 8 aa, Artificial Sequence
  Peptide Derived from Human Papillomavirus
NVKHKSAI

SEQ ID NO: 2330 - protein, 9 aa, Artificial Sequence
  Peptide Derived from Human Papillomavirus
NVKHKSAIV

SEQ ID NO: 2331 - protein, 10 aa, Artificial Sequence
  Peptide Derived from Human Papillomavirus
NVKHKSAIVT

SEQ ID NO: 2332 - protein, 11 aa, Artificial Sequence
  Peptide Derived from Human Papillomavirus
NVKHKSAIVTL

SEQ ID NO: 2333 - protein, 8 aa, Artificial Sequence
  Peptide Derived from Human Papillomavirus
PAATHTKA

SEQ ID NO: 2334 - protein, 9 aa, Artificial Sequence
  Peptide Derived from Human Papillomavirus
PAATHTKAV

SEQ ID NO: 2335 - protein, 10 aa, Artificial Sequence
  Peptide Derived from Human Papillomavirus
PAATHTKAVA

SEQ ID NO: 2336 - protein, 11 aa, Artificial Sequence
  Peptide Derived from Human Papillomavirus
PAATHTKAVAL

SEQ ID NO: 2337 - protein, 9 aa, Artificial Sequence
  Peptide Derived from Human Papillomavirus
PIVHLKGDA

SEQ ID NO: 2338 - protein, 11 aa, Artificial Sequence
  Peptide Derived from Human Papillomavirus
PIVHLKGDANT

SEQ ID NO: 2339 - protein, 11 aa, Artificial Sequence
  Peptide Derived from Human Papillomavirus
PTGCIKKHGYT

SEQ ID NO: 2340 - protein, 10 aa, Artificial Sequence
  Peptide Derived from Human Papillomavirus
PTLAVSKNKA

SEQ ID NO: 2341 - protein, 11 aa, Artificial Sequence
  Peptide Derived from Human Papillomavirus
PTLAVSKNKAL

SEQ ID NO: 2342 - protein, 10 aa, Artificial Sequence
  Peptide Derived from Human Papillomavirus
PTSVFSSNEV

SEQ ID NO: 2343 - protein, 8 aa, Artificial Sequence
  Peptide Derived from Human Papillomavirus
QAIELQLT

SEQ ID NO: 2344 - protein, 9 aa, Artificial Sequence
  Peptide Derived from Human Papillomavirus
QAIELQLTL

SEQ ID NO: 2345 - protein, 11 aa, Artificial Sequence
  Peptide Derived from Human Papillomavirus
QAIELQLTLET

SEQ ID NO: 2346 - protein, 10 aa, Artificial Sequence
  Peptide Derived from Human Papillomavirus
QVDYYGLYYV

SEQ ID NO: 2347 - protein, 9 aa, Artificial Sequence
  Peptide Derived from Human Papillomavirus
QVILCPTSV

SEQ ID NO: 2348 - protein, 8 aa, Artificial Sequence
  Peptide Derived from Human Papillomavirus
QVKIPKTI

SEQ ID NO: 2349 - protein, 9 aa, Artificial Sequence
  Peptide Derived from Human Papillomavirus
QVKIPKTIT

SEQ ID NO: 2350 - protein, 10 aa, Artificial Sequence
  Peptide Derived from Human Papillomavirus
QVKIPKTITV

SEQ ID NO: 2351 - protein, 8 aa, Artificial Sequence
  Peptide Derived from Human Papillomavirus
QVVPTLAV

SEQ ID NO: 2352 - protein, 8 aa, Artificial Sequence
  Peptide Derived from Human Papillomavirus
RINCNSNT

SEQ ID NO: 2353 - protein, 9 aa, Artificial Sequence
  Peptide Derived from Human Papillomavirus
RINCNSNTT

SEQ ID NO: 2354 - protein, 11 aa, Artificial Sequence
  Peptide Derived from Human Papillomavirus
RINCNSNTTPI

SEQ ID NO: 2355 - protein, 10 aa, Artificial Sequence
  Peptide Derived from Human Papillomavirus
RLECAIYYKA

SEQ ID NO: 2356 - protein, 9 aa, Artificial Sequence
  Peptide Derived from Human Papillomavirus
RLNVCQDKI

SEQ ID NO: 2357 - protein, 10 aa, Artificial Sequence
  Peptide Derived from Human Papillomavirus
RLNVCQDKIL

SEQ ID NO: 2358 - protein, 11 aa, Artificial Sequence
  Peptide Derived from Human Papillomavirus
RLNVCQDKILT

SEQ ID NO: 2359 - protein, 9 aa, Artificial Sequence
  Peptide Derived from Human Papillomavirus
RQHLANHPA

SEQ ID NO: 2360 - protein, 10 aa, Artificial Sequence
  Peptide Derived from Human Papillomavirus
RQHLANHPAA

SEQ ID NO: 2361 - protein, 11 aa, Artificial Sequence
  Peptide Derived from Human Papillomavirus
RQHLANHPAAT

SEQ ID NO: 2362 - protein, 11 aa, Artificial Sequence
  Peptide Derived from Human Papillomavirus
RTYFVQFKDDA

SEQ ID NO: 2363 - protein, 8 aa, Artificial Sequence
  Peptide Derived from Human Papillomavirus
SLEVYLTA

SEQ ID NO: 2364 - protein, 10 aa, Artificial Sequence
  Peptide Derived from Human Papillomavirus
SLEVYLTAPT

SEQ ID NO: 2365 - protein, 8 aa, Artificial Sequence
  Peptide Derived from Human Papillomavirus
SQVKIPKT

SEQ ID NO: 2366 - protein, 9 aa, Artificial Sequence
  Peptide Derived from Human Papillomavirus
SQVKIPKTI

SEQ ID NO: 2367 - protein, 10 aa, Artificial Sequence
  Peptide Derived from Human Papillomavirus
SQVKIPKTIT

SEQ ID NO: 2368 - protein, 11 aa, Artificial Sequence
  Peptide Derived from Human Papillomavirus
SQVKIPKTITV

SEQ ID NO: 2369 - protein, 9 aa, Artificial Sequence
  Peptide Derived from Human Papillomavirus
SQYSNEKWT

SEQ ID NO: 2370 - protein, 10 aa, Artificial Sequence
  Peptide Derived from Human Papillomavirus
SQYSNEKWTL

SEQ ID NO: 2371 - protein, 8 aa, Artificial Sequence
  Peptide Derived from Human Papillomavirus
STDLRDHI

SEQ ID NO: 2372 - protein, 10 aa, Artificial Sequence
  Peptide Derived from Human Papillomavirus
STWHWTGHNV

SEQ ID NO: 2373 - protein, 8 aa, Artificial Sequence
  Peptide Derived from Human Papillomavirus
SVDSAPIL

SEQ ID NO: 2374 - protein, 9 aa, Artificial Sequence
  Peptide Derived from Human Papillomavirus
SVDSAPILT

SEQ ID NO: 2375 - protein, 10 aa, Artificial Sequence
  Peptide Derived from Human Papillomavirus
SVDSAPILTA

SEQ ID NO: 2376 - protein, 8 aa, Artificial Sequence
  Peptide Derived from Human Papillomavirus
SVFSSNEV

SEQ ID NO: 2377 - protein, 9 aa, Artificial Sequence
  Peptide Derived from Human Papillomavirus
SVTVVEGQV

SEQ ID NO: 2378 - protein, 11 aa, Artificial Sequence
  Peptide Derived from Human Papillomavirus
TAFNSSHKGRI

SEQ ID NO: 2379 - protein, 10 aa, Artificial Sequence
  Peptide Derived from Human Papillomavirus
TAVSSTWHWT

SEQ ID NO: 2380 - protein, 11 aa, Artificial Sequence
  Peptide Derived from Human Papillomavirus
TIQRPRSEPDT

SEQ ID NO: 2381 - protein, 9 aa, Artificial Sequence
  Peptide Derived from Human Papillomavirus
TITVSTGFM

SEQ ID NO: 2382 - protein, 11 aa, Artificial Sequence
  Peptide Derived from Human Papillomavirus
TITVSTGFMSI

SEQ ID NO: 2383 - protein, 9 aa, Artificial Sequence
  Peptide Derived from Human Papillomavirus
TLAVSKNKA

SEQ ID NO: 2384 - protein, 10 aa, Artificial Sequence
  Peptide Derived from Human Papillomavirus
TLAVSKNKAL

SEQ ID NO: 2385 - protein, 8 aa, Artificial Sequence
  Peptide Derived from Human Papillomavirus
TLCQRLNV

SEQ ID NO: 2386 - protein, 9 aa, Artificial Sequence
  Peptide Derived from Human Papillomavirus
TLQDVSLEV

SEQ ID NO: 2387 - protein, 11 aa, Artificial Sequence
  Peptide Derived from Human Papillomavirus
TLQDVSLEVYL

SEQ ID NO: 2388 - protein, 9 aa, Artificial Sequence
  Peptide Derived from Human Papillomavirus
TLYTAVSST

SEQ ID NO: 2389 - protein, 8 aa, Artificial Sequence
  Peptide Derived from Human Papillomavirus
TMHYTNWT

SEQ ID NO: 2390 - protein, 10 aa, Artificial Sequence
  Peptide Derived from Human Papillomavirus
TMHYTNWTHI

SEQ ID NO: 2391 - protein, 10 aa, Artificial Sequence
  Peptide Derived from Human Papillomavirus
TTKLLHRDSV

SEQ ID NO: 2392 - protein, 11 aa, Artificial Sequence
  Peptide Derived from Human Papillomavirus
TTPIVHLKGDA

SEQ ID NO: 2393 - protein, 10 aa, Artificial Sequence
  Peptide Derived from Human Papillomavirus
TVEVQFDGDI

SEQ ID NO: 2394 - protein, 9 aa, Artificial Sequence
  Peptide Derived from Human Papillomavirus
TVSTGFMSI

SEQ ID NO: 2395 - protein, 8 aa, Artificial Sequence
  Peptide Derived from Human Papillomavirus
VALGTEET

SEQ ID NO: 2396 - protein, 10 aa, Artificial Sequence
  Peptide Derived from Human Papillomavirus
VALGTEETQT

SEQ ID NO: 2397 - protein, 11 aa, Artificial Sequence
  Peptide Derived from Human Papillomavirus
VALGTEETQTT

SEQ ID NO: 2398 - protein, 8 aa, Artificial Sequence
  Peptide Derived from Human Papillomavirus
VILCPTSV

SEQ ID NO: 2399 - protein, 10 aa, Artificial Sequence
  Peptide Derived from Human Papillomavirus
VQFDGDICNT

SEQ ID NO: 2400 - protein, 11 aa, Artificial Sequence
  Peptide Derived from Human Papillomavirus
VQFDGDICNTM

SEQ ID NO: 2401 - protein, 8 aa, Artificial Sequence
  Peptide Derived from Human Papillomavirus
VTVVEGQV

SEQ ID NO: 2402 - protein, 11 aa, Artificial Sequence
  Peptide Derived from Human Papillomavirus
VVEGQVDYYGL

SEQ ID NO: 2403 - protein, 10 aa, Artificial Sequence
  Peptide Derived from Human Papillomavirus
WQRDQFLSQV

SEQ ID NO: 2404 - protein, 11 aa, Artificial Sequence
  Peptide Derived from Human Papillomavirus
WTGHNVKHKSA

SEQ ID NO: 2405 - protein, 10 aa, Artificial Sequence
  Peptide Derived from Human Papillomavirus
WTHIYICEEA

SEQ ID NO: 2406 - protein, 8 aa, Artificial Sequence
  Peptide Derived from Human Papillomavirus
WTLQDVSL

SEQ ID NO: 2407 - protein, 10 aa, Artificial Sequence
  Peptide Derived from Human Papillomavirus
WTLQDVSLEV

SEQ ID NO: 2408 - protein, 8 aa, Artificial Sequence
  Peptide Derived from Human Papillomavirus
YICEEASV

SEQ ID NO: 2409 - protein, 9 aa, Artificial Sequence
  Peptide Derived from Human Papillomavirus
YICEEASVT

SEQ ID NO: 2410 - protein, 10 aa, Artificial Sequence
  Peptide Derived from Human Papillomavirus
YICEEASVTV

SEQ ID NO: 2411 - protein, 11 aa, Artificial Sequence
  Peptide Derived from Human Papillomavirus
YICEEASVTVV

SEQ ID NO: 2412 - protein, 9 aa, Artificial Sequence
  Peptide Derived from Human Papillomavirus
YLTAPTGCI

SEQ ID NO: 2413 - protein, 11 aa, Artificial Sequence
  Peptide Derived from Human Papillomavirus
YTAVSSTWHWT

SEQ ID NO: 2414 - protein, 9 aa, Artificial Sequence
  Peptide Derived from Human Papillomavirus
YTNWTHIYI

SEQ ID NO: 2415 - protein, 11 aa, Artificial Sequence
  Peptide Derived from Human Papillomavirus
YTVEVQFDGDI

SEQ ID NO: 2416 - protein, 8 aa, Artificial Sequence
  Peptide Derived from Human Papillomavirus
YVHEGIRT

SEQ ID NO: 2417 - protein, 11 aa, Artificial Sequence
  Peptide Derived from Human Papillomavirus
YVHEGIRTYFV

SEQ ID NO: 2418 - protein, 9 aa, Artificial Sequence
  Peptide Derived from Human Papillomavirus
AASAFRCFI

SEQ ID NO: 2419 - protein, 10 aa, Artificial Sequence
  Peptide Derived from Human Papillomavirus
AASAFRCFIV

SEQ ID NO: 2420 - protein, 8 aa, Artificial Sequence
  Peptide Derived from Human Papillomavirus
CLLIRPLL

SEQ ID NO: 2421 - protein, 9 aa, Artificial Sequence
  Peptide Derived from Human Papillomavirus
CLLIRPLLL

SEQ ID NO: 2422 - protein, 11 aa, Artificial Sequence
  Peptide Derived from Human Papillomavirus
CLLIRPLLLSV

SEQ ID NO: 2423 - protein, 9 aa, Artificial Sequence
  Peptide Derived from Human Papillomavirus
CVCLLIRPL

SEQ ID NO: 2424 - protein, 10 aa, Artificial Sequence
  Peptide Derived from Human Papillomavirus
CVCLLIRPLL

SEQ ID NO: 2425 - protein, 11 aa, Artificial Sequence
  Peptide Derived from Human Papillomavirus
CVCLLIRPLLL

SEQ ID NO: 2426 - protein, 8 aa, Artificial Sequence
  Peptide Derived from Human Papillomavirus
CVLLCVCL

SEQ ID NO: 2427 - protein, 9 aa, Artificial Sequence
  Peptide Derived from Human Papillomavirus
CVLLCVCLL

SEQ ID NO: 2428 - protein, 10 aa, Artificial Sequence
  Peptide Derived from Human Papillomavirus
CVLLCVCLLI

SEQ ID NO: 2429 - protein, 8 aa, Artificial Sequence
  Peptide Derived from Human Papillomavirus
DTASTTLL

SEQ ID NO: 2430 - protein, 9 aa, Artificial Sequence
  Peptide Derived from Human Papillomavirus
DTASTTLLA

SEQ ID NO: 2431 - protein, 8 aa, Artificial Sequence
  Peptide Derived from Human Papillomavirus
FIVYIIFV

SEQ ID NO: 2432 - protein, 10 aa, Artificial Sequence
  Peptide Derived from Human Papillomavirus
FIVYIIFVYI

SEQ ID NO: 2433 - protein, 10 aa, Artificial Sequence
  Peptide Derived from Human Papillomavirus
FLIHTHARFL

SEQ ID NO: 2434 - protein, 11 aa, Artificial Sequence
  Peptide Derived from Human Papillomavirus
FLIHTHARFLI

SEQ ID NO: 2435 - protein, 8 aa, Artificial Sequence
  Peptide Derived from Human Papillomavirus
FLLCFCVL

SEQ ID NO: 2436 - protein, 9 aa, Artificial Sequence
  Peptide Derived from Human Papillomavirus
FLLCFCVLL

SEQ ID NO: 2437 - protein, 11 aa, Artificial Sequence
  Peptide Derived from Human Papillomavirus
FLLCFCVLLCV

SEQ ID NO: 2438 - protein, 8 aa, Artificial Sequence
  Peptide Derived from Human Papillomavirus
FVYIPLFL

SEQ ID NO: 2439 - protein, 9 aa, Artificial Sequence
  Peptide Derived from Human Papillomavirus
FVYIPLFLI

SEQ ID NO: 2440 - protein, 11 aa, Artificial Sequence
  Peptide Derived from Human Papillomavirus
FVYIPLFLIHT

SEQ ID NO: 2441 - protein, 8 aa, Artificial Sequence
  Peptide Derived from Human Papillomavirus
HTHARFLI

SEQ ID NO: 2442 - protein, 9 aa, Artificial Sequence
  Peptide Derived from Human Papillomavirus
HTHARFLIT

SEQ ID NO: 2443 - protein, 8 aa, Artificial Sequence
  Peptide Derived from Human Papillomavirus
IIFVYIPL

SEQ ID NO: 2444 - protein, 10 aa, Artificial Sequence
  Peptide Derived from Human Papillomavirus
IIFVYIPLFL

SEQ ID NO: 2445 - protein, 11 aa, Artificial Sequence
  Peptide Derived from Human Papillomavirus
IIFVYIPLFLI

SEQ ID NO: 2446 - protein, 9 aa, Artificial Sequence
  Peptide Derived from Human Papillomavirus
IILVLLLWI

SEQ ID NO: 2447 - protein, 10 aa, Artificial Sequence
  Peptide Derived from Human Papillomavirus
IILVLLLWIT

SEQ ID NO: 2448 - protein, 11 aa, Artificial Sequence
  Peptide Derived from Human Papillomavirus
IILVLLLWITA

SEQ ID NO: 2449 - protein, 8 aa, Artificial Sequence
  Peptide Derived from Human Papillomavirus
ILVLLLWI

SEQ ID NO: 2450 - protein, 9 aa, Artificial Sequence
  Peptide Derived from Human Papillomavirus
ILVLLLWIT

SEQ ID NO: 2451 - protein, 10 aa, Artificial Sequence
  Peptide Derived from Human Papillomavirus
ILVLLLWITA

SEQ ID NO: 2452 - protein, 11 aa, Artificial Sequence
  Peptide Derived from Human Papillomavirus
ILVLLLWITAA

SEQ ID NO: 2453 - protein, 11 aa, Artificial Sequence
  Peptide Derived from Human Papillomavirus
ITAASAFRCFI

SEQ ID NO: 2454 - protein, 9 aa, Artificial Sequence
  Peptide Derived from Human Papillomavirus
IVYIIFVYI

SEQ ID NO: 2455 - protein, 11 aa, Artificial Sequence
  Peptide Derived from Human Papillomavirus
IVYIIFVYIPL

SEQ ID NO: 2456 - protein, 10 aa, Artificial Sequence
  Peptide Derived from Human Papillomavirus
LACFLLCFCV

SEQ ID NO: 2457 - protein, 11 aa, Artificial Sequence
  Peptide Derived from Human Papillomavirus
LACFLLCFCVL

SEQ ID NO: 2458 - protein, 9 aa, Artificial Sequence
  Peptide Derived from Human Papillomavirus
LIHTHARFL

SEQ ID NO: 2459 - protein, 10 aa, Artificial Sequence
  Peptide Derived from Human Papillomavirus
LIHTHARFLI

SEQ ID NO: 2460 - protein, 11 aa, Artificial Sequence
  Peptide Derived from Human Papillomavirus
LIHTHARFLIT

SEQ ID NO: 2461 - protein, 8 aa, Artificial Sequence
  Peptide Derived from Human Papillomavirus
LIILVLLL

SEQ ID NO: 2462 - protein, 10 aa, Artificial Sequence
  Peptide Derived from Human Papillomavirus
LIILVLLLWI

SEQ ID NO: 2463 - protein, 11 aa, Artificial Sequence
  Peptide Derived from Human Papillomavirus
LIILVLLLWIT

SEQ ID NO: 2464 - protein, 9 aa, Artificial Sequence
  Peptide Derived from Human Papillomavirus
LIRPLLLSV

SEQ ID NO: 2465 - protein, 11 aa, Artificial Sequence
  Peptide Derived from Human Papillomavirus
LIRPLLLSVST

SEQ ID NO: 2466 - protein, 11 aa, Artificial Sequence
  Peptide Derived from Human Papillomavirus
LLACFLLCFCV

SEQ ID NO: 2467 - protein, 8 aa, Artificial Sequence
  Peptide Derived from Human Papillomavirus
LLCFCVLL

SEQ ID NO: 2468 - protein, 10 aa, Artificial Sequence
  Peptide Derived from Human Papillomavirus
LLCFCVLLCV

SEQ ID NO: 2469 - protein, 8 aa, Artificial Sequence
  Peptide Derived from Human Papillomavirus
LLCVCLLI

SEQ ID NO: 2470 - protein, 11 aa, Artificial Sequence
  Peptide Derived from Human Papillomavirus
LLCVCLLIRPL

SEQ ID NO: 2471 - protein, 8 aa, Artificial Sequence
  Peptide Derived from Human Papillomavirus
LLIRPLLL

SEQ ID NO: 2472 - protein, 10 aa, Artificial Sequence
  Peptide Derived from Human Papillomavirus
LLIRPLLLSV

SEQ ID NO: 2473 - protein, 9 aa, Artificial Sequence
  Peptide Derived from Human Papillomavirus
LLLSVSTYT

SEQ ID NO: 2474 - protein, 11 aa, Artificial Sequence
  Peptide Derived from Human Papillomavirus
LLLSVSTYTSL

SEQ ID NO: 2475 - protein, 8 aa, Artificial Sequence
  Peptide Derived from Human Papillomavirus
LLLWITAA

SEQ ID NO: 2476 - protein, 10 aa, Artificial Sequence
  Peptide Derived from Human Papillomavirus
LLLWITAASA

SEQ ID NO: 2477 - protein, 8 aa, Artificial Sequence
  Peptide Derived from Human Papillomavirus
LLSVSTYT

SEQ ID NO: 2478 - protein, 10 aa, Artificial Sequence
  Peptide Derived from Human Papillomavirus
LLSVSTYTSL

SEQ ID NO: 2479 - protein, 11 aa, Artificial Sequence
  Peptide Derived from Human Papillomavirus
LLSVSTYTSLI

SEQ ID NO: 2480 - protein, 9 aa, Artificial Sequence
  Peptide Derived from Human Papillomavirus
LLWITAASA

SEQ ID NO: 2481 - protein, 8 aa, Artificial Sequence
  Peptide Derived from Human Papillomavirus
LVLLLWIT

SEQ ID NO: 2482 - protein, 9 aa, Artificial Sequence
  Peptide Derived from Human Papillomavirus
LVLLLWITA

SEQ ID NO: 2483 - protein, 10 aa, Artificial Sequence
  Peptide Derived from Human Papillomavirus
LVLLLWITAA

SEQ ID NO: 2484 - protein, 9 aa, Artificial Sequence
  Peptide Derived from Human Papillomavirus
MTNLDTAST

SEQ ID NO: 2485 - protein, 10 aa, Artificial Sequence
  Peptide Derived from Human Papillomavirus
MTNLDTASTT

SEQ ID NO: 2486 - protein, 11 aa, Artificial Sequence
  Peptide Derived from Human Papillomavirus
MTNLDTASTTL

SEQ ID NO: 2487 - protein, 8 aa, Artificial Sequence
  Peptide Derived from Human Papillomavirus
NLDTASTT

SEQ ID NO: 2488 - protein, 9 aa, Artificial Sequence
  Peptide Derived from Human Papillomavirus
NLDTASTTL

SEQ ID NO: 2489 - protein, 10 aa, Artificial Sequence
  Peptide Derived from Human Papillomavirus
NLDTASTTLL

SEQ ID NO: 2490 - protein, 11 aa, Artificial Sequence
  Peptide Derived from Human Papillomavirus
NLDTASTTLLA

SEQ ID NO: 2491 - protein, 9 aa, Artificial Sequence
  Peptide Derived from Human Papillomavirus
PLFLIHTHA

SEQ ID NO: 2492 - protein, 8 aa, Artificial Sequence
  Peptide Derived from Human Papillomavirus
PLLLSVST

SEQ ID NO: 2493 - protein, 10 aa, Artificial Sequence
  Peptide Derived from Human Papillomavirus
PLLLSVSTYT

SEQ ID NO: 2494 - protein, 8 aa, Artificial Sequence
  Peptide Derived from Human Papillomavirus
SAFRCFIV

SEQ ID NO: 2495 - protein, 10 aa, Artificial Sequence
  Peptide Derived from Human Papillomavirus
SAFRCFIVYI

SEQ ID NO: 2496 - protein, 11 aa, Artificial Sequence
  Peptide Derived from Human Papillomavirus
SAFRCFIVYII

SEQ ID NO: 2497 - protein, 8 aa, Artificial Sequence
  Peptide Derived from Human Papillomavirus
SLIILVLL

SEQ ID NO: 2498 - protein, 9 aa, Artificial Sequence
  Peptide Derived from Human Papillomavirus
SLIILVLLL

SEQ ID NO: 2499 - protein, 11 aa, Artificial Sequence
  Peptide Derived from Human Papillomavirus
SLIILVLLLWI

SEQ ID NO: 2500 - protein, 9 aa, Artificial Sequence
  Peptide Derived from Human Papillomavirus
STTLLACFL

SEQ ID NO: 2501 - protein, 10 aa, Artificial Sequence
  Peptide Derived from Human Papillomavirus
STTLLACFLL

SEQ ID NO: 2502 - protein, 8 aa, Artificial Sequence
  Peptide Derived from Human Papillomavirus
STYTSLII

SEQ ID NO: 2503 - protein, 9 aa, Artificial Sequence
  Peptide Derived from Human Papillomavirus
STYTSLIIL

SEQ ID NO: 2504 - protein, 10 aa, Artificial Sequence
  Peptide Derived from Human Papillomavirus
STYTSLIILV

SEQ ID NO: 2505 - protein, 11 aa, Artificial Sequence
  Peptide Derived from Human Papillomavirus
STYTSLIILVL

SEQ ID NO: 2506 - protein, 8 aa, Artificial Sequence
  Peptide Derived from Human Papillomavirus
SVSTYTSL

SEQ ID NO: 2507 - protein, 9 aa, Artificial Sequence
  Peptide Derived from Human Papillomavirus
SVSTYTSLI

SEQ ID NO: 2508 - protein, 10 aa, Artificial Sequence
  Peptide Derived from Human Papillomavirus
SVSTYTSLII

SEQ ID NO: 2509 - protein, 11 aa, Artificial Sequence
  Peptide Derived from Human Papillomavirus
SVSTYTSLIIL

SEQ ID NO: 2510 - protein, 10 aa, Artificial Sequence
  Peptide Derived from Human Papillomavirus
TAASAFRCFI

SEQ ID NO: 2511 - protein, 11 aa, Artificial Sequence
  Peptide Derived from Human Papillomavirus
TAASAFRCFIV

SEQ ID NO: 2512 - protein, 8 aa, Artificial Sequence
  Peptide Derived from Human Papillomavirus
TASTTLLA

SEQ ID NO: 2513 - protein, 11 aa, Artificial Sequence
  Peptide Derived from Human Papillomavirus
TASTTLLACFL

SEQ ID NO: 2514 - protein, 8 aa, Artificial Sequence
  Peptide Derived from Human Papillomavirus
TLLACFLL

SEQ ID NO: 2515 - protein, 8 aa, Artificial Sequence
  Peptide Derived from Human Papillomavirus
TTLLACFL

SEQ ID NO: 2516 - protein, 9 aa, Artificial Sequence
  Peptide Derived from Human Papillomavirus
TTLLACFLL

SEQ ID NO: 2517 - protein, 8 aa, Artificial Sequence
  Peptide Derived from Human Papillomavirus
VLLCVCLL

SEQ ID NO: 2518 - protein, 9 aa, Artificial Sequence
  Peptide Derived from Human Papillomavirus
VLLCVCLLI

SEQ ID NO: 2519 - protein, 8 aa, Artificial Sequence
  Peptide Derived from Human Papillomavirus
VLLLWITA

SEQ ID NO: 2520 - protein, 9 aa, Artificial Sequence
  Peptide Derived from Human Papillomavirus
VLLLWITAA

SEQ ID NO: 2521 - protein, 11 aa, Artificial Sequence
  Peptide Derived from Human Papillomavirus
VLLLWITAASA

SEQ ID NO: 2522 - protein, 9 aa, Artificial Sequence
  Peptide Derived from Human Papillomavirus
YIIFVYIPL

SEQ ID NO: 2523 - protein, 11 aa, Artificial Sequence
  Peptide Derived from Human Papillomavirus
YIIFVYIPLFL

SEQ ID NO: 2524 - protein, 9 aa, Artificial Sequence
  Peptide Derived from Human Papillomavirus
YIPLFLIHT

SEQ ID NO: 2525 - protein, 11 aa, Artificial Sequence
  Peptide Derived from Human Papillomavirus
YIPLFLIHTHA

SEQ ID NO: 2526 - protein, 8 aa, Artificial Sequence
  Peptide Derived from Human Papillomavirus
YTSLIILV

SEQ ID NO: 2527 - protein, 9 aa, Artificial Sequence
  Peptide Derived from Human Papillomavirus
YTSLIILVL

SEQ ID NO: 2528 - protein, 10 aa, Artificial Sequence
  Peptide Derived from Human Papillomavirus
YTSLIILVLL

SEQ ID NO: 2529 - protein, 11 aa, Artificial Sequence
  Peptide Derived from Human Papillomavirus
YTSLIILVLLL

SEQ ID NO: 2530 - protein, 8 aa, Artificial Sequence
  Peptide Derived from Human Papillomavirus
CINCQKPL

SEQ ID NO: 2531 - protein, 11 aa, Artificial Sequence
  Peptide Derived from Human Papillomavirus
CIVYRDGNPYA

SEQ ID NO: 2532 - protein, 8 aa, Artificial Sequence
  Peptide Derived from Human Papillomavirus
CLKFYSKI

SEQ ID NO: 2533 - protein, 10 aa, Artificial Sequence
  Peptide Derived from Human Papillomavirus
CMSCCRSSRT

SEQ ID NO: 2534 - protein, 8 aa, Artificial Sequence
  Peptide Derived from Human Papillomavirus
CTELQTTI

SEQ ID NO: 2535 - protein, 11 aa, Artificial Sequence
  Peptide Derived from Human Papillomavirus
CTELQTTIHDI

SEQ ID NO: 2536 - protein, 8 aa, Artificial Sequence
  Peptide Derived from Human Papillomavirus
CVYCKQQL

SEQ ID NO: 2537 - protein, 9 aa, Artificial Sequence
  Peptide Derived from Human Papillomavirus
CVYCKQQLL

SEQ ID NO: 2538 - protein, 9 aa, Artificial Sequence
  Peptide Derived from Human Papillomavirus
ELQTTIHDI

SEQ ID NO: 2539 - protein, 10 aa, Artificial Sequence
  Peptide Derived from Human Papillomavirus
ELQTTIHDII

SEQ ID NO: 2540 - protein, 11 aa, Artificial Sequence
  Peptide Derived from Human Papillomavirus
ELQTTIHDIIL

SEQ ID NO: 2541 - protein, 8 aa, Artificial Sequence
  Peptide Derived from Human Papillomavirus
EQQYNKPL

SEQ ID NO: 2542 - protein, 11 aa, Artificial Sequence
  Peptide Derived from Human Papillomavirus
EQQYNKPLCDL

SEQ ID NO: 2543 - protein, 10 aa, Artificial Sequence
  Peptide Derived from Human Papillomavirus
EVYDFAFRDL

SEQ ID NO: 2544 - protein, 8 aa, Artificial Sequence
  Peptide Derived from Human Papillomavirus
FAFRDLCI

SEQ ID NO: 2545 - protein, 9 aa, Artificial Sequence
  Peptide Derived from Human Papillomavirus
FAFRDLCIV

SEQ ID NO: 2546 - protein, 11 aa, Artificial Sequence
  Peptide Derived from Human Papillomavirus
FQDPQERPRKL

SEQ ID NO: 2547 - protein, 11 aa, Artificial Sequence
  Peptide Derived from Human Papillomavirus
HLDKKQRFHNI

SEQ ID NO: 2548 - protein, 11 aa, Artificial Sequence
  Peptide Derived from Human Papillomavirus
ILECVYCKQQL

SEQ ID NO: 2549 - protein, 10 aa, Artificial Sequence
  Peptide Derived from Human Papillomavirus
IVYRDGNPYA

SEQ ID NO: 2550 - protein, 11 aa, Artificial Sequence
  Peptide Derived from Human Papillomavirus
IVYRDGNPYAV

SEQ ID NO: 2551 - protein, 9 aa, Artificial Sequence
  Peptide Derived from Human Papillomavirus
KLPQLCTEL

SEQ ID NO: 2552 - protein, 11 aa, Artificial Sequence
  Peptide Derived from Human Papillomavirus
KLPQLCTELQT

SEQ ID NO: 2553 - protein, 9 aa, Artificial Sequence
  Peptide Derived from Human Papillomavirus
KQQLLRREV

SEQ ID NO: 2554 - protein, 11 aa, Artificial Sequence
  Peptide Derived from Human Papillomavirus
LIRCINCQKPL

SEQ ID NO: 2555 - protein, 10 aa, Artificial Sequence
  Peptide Derived from Human Papillomavirus
LLRREVYDFA

SEQ ID NO: 2556 - protein, 8 aa, Artificial Sequence
  Peptide Derived from Human Papillomavirus
LQTTIHDI

SEQ ID NO: 2557 - protein, 9 aa, Artificial Sequence
  Peptide Derived from Human Papillomavirus
LQTTIHDII

SEQ ID NO: 2558 - protein, 10 aa, Artificial Sequence
  Peptide Derived from Human Papillomavirus
LQTTIHDIIL

SEQ ID NO: 2559 - protein, 11 aa, Artificial Sequence
  Peptide Derived from Human Papillomavirus
NIRGRWTGRCM

SEQ ID NO: 2560 - protein, 10 aa, Artificial Sequence
  Peptide Derived from Human Papillomavirus
PLCDLLIRCI

SEQ ID NO: 2561 - protein, 11 aa, Artificial Sequence
  Peptide Derived from Human Papillomavirus
PLCPEEKQRHL

SEQ ID NO: 2562 - protein, 8 aa, Artificial Sequence
  Peptide Derived from Human Papillomavirus
PQERPRKL

SEQ ID NO: 2563 - protein, 11 aa, Artificial Sequence
  Peptide Derived from Human Papillomavirus
PQERPRKLPQL

SEQ ID NO: 2564 - protein, 9 aa, Artificial Sequence
  Peptide Derived from Human Papillomavirus
PQLCTELQT

SEQ ID NO: 2565 - protein, 10 aa, Artificial Sequence
  Peptide Derived from Human Papillomavirus
PQLCTELQTT

SEQ ID NO: 2566 - protein, 11 aa, Artificial Sequence
  Peptide Derived from Human Papillomavirus
PQLCTELQTTI

SEQ ID NO: 2567 - protein, 8 aa, Artificial Sequence
  Peptide Derived from Human Papillomavirus
QLCTELQT

SEQ ID NO: 2568 - protein, 9 aa, Artificial Sequence
  Peptide Derived from Human Papillomavirus
QLCTELQTT

SEQ ID NO: 2569 - protein, 10 aa, Artificial Sequence
  Peptide Derived from Human Papillomavirus
QLCTELQTTI

SEQ ID NO: 2570 - protein, 11 aa, Artificial Sequence
  Peptide Derived from Human Papillomavirus
QLLRREVYDFA

SEQ ID NO: 2571 - protein, 8 aa, Artificial Sequence
  Peptide Derived from Human Papillomavirus
QQLLRREV

SEQ ID NO: 2572 - protein, 10 aa, Artificial Sequence
  Peptide Derived from Human Papillomavirus
QQYNKPLCDL

SEQ ID NO: 2573 - protein, 11 aa, Artificial Sequence
  Peptide Derived from Human Papillomavirus
QQYNKPLCDLL

SEQ ID NO: 2574 - protein, 8 aa, Artificial Sequence
  Peptide Derived from Human Papillomavirus
QTTIHDII

SEQ ID NO: 2575 - protein, 9 aa, Artificial Sequence
  Peptide Derived from Human Papillomavirus
QTTIHDIIL

SEQ ID NO: 2576 - protein, 8 aa, Artificial Sequence
  Peptide Derived from Human Papillomavirus
RTRRETQL

SEQ ID NO: 2577 - protein, 10 aa, Artificial Sequence
  Peptide Derived from Human Papillomavirus
TIHDIILECV

SEQ ID NO: 2578 - protein, 10 aa, Artificial Sequence
  Peptide Derived from Human Papillomavirus
TLEQQYNKPL

SEQ ID NO: 2579 - protein, 8 aa, Artificial Sequence
  Peptide Derived from Human Papillomavirus
TTIHDIIL

SEQ ID NO: 2580 - protein, 11 aa, Artificial Sequence
  Peptide Derived from Human Papillomavirus
TTIHDIILECV

SEQ ID NO: 2581 - protein, 11 aa, Artificial Sequence
  Peptide Derived from Human Papillomavirus
TTLEQQYNKPL

SEQ ID NO: 2582 - protein, 8 aa, Artificial Sequence
  Peptide Derived from Human Papillomavirus
YAVCDKCL

SEQ ID NO: 2583 - protein, 9 aa, Artificial Sequence
  Peptide Derived from Human Papillomavirus
CVQSTHVDI

SEQ ID NO: 2584 - protein, 11 aa, Artificial Sequence
  Peptide Derived from Human Papillomavirus
CVQSTHVDIRT

SEQ ID NO: 2585 - protein, 8 aa, Artificial Sequence
  Peptide Derived from Human Papillomavirus
DIRTLEDL

SEQ ID NO: 2586 - protein, 9 aa, Artificial Sequence
  Peptide Derived from Human Papillomavirus
DIRTLEDLL

SEQ ID NO: 2587 - protein, 10 aa, Artificial Sequence
  Peptide Derived from Human Papillomavirus
DIRTLEDLLM

SEQ ID NO: 2588 - protein, 9 aa, Artificial Sequence
  Peptide Derived from Human Papillomavirus
DLLMGTLGI

SEQ ID NO: 2589 - protein, 10 aa, Artificial Sequence
  Peptide Derived from Human Papillomavirus
DLLMGTLGIV

SEQ ID NO: 2590 - protein, 9 aa, Artificial Sequence
  Peptide Derived from Human Papillomavirus
DLQPETTDL

SEQ ID NO: 2591 - protein, 8 aa, Artificial Sequence
  Peptide Derived from Human Papillomavirus
DLYCYEQL

SEQ ID NO: 2592 - protein, 9 aa, Artificial Sequence
  Peptide Derived from Human Papillomavirus
DTPTLHEYM

SEQ ID NO: 2593 - protein, 10 aa, Artificial Sequence
  Peptide Derived from Human Papillomavirus
DTPTLHEYML

SEQ ID NO: 2594 - protein, 9 aa, Artificial Sequence
  Peptide Derived from Human Papillomavirus
EIDGPAGQA

SEQ ID NO: 2595 - protein, 11 aa, Artificial Sequence
  Peptide Derived from Human Papillomavirus
ETTDLYCYEQL

SEQ ID NO: 2596 - protein, 8 aa, Artificial Sequence
  Peptide Derived from Human Papillomavirus
GQAEPDRA

SEQ ID NO: 2597 - protein, 9 aa, Artificial Sequence
  Peptide Derived from Human Papillomavirus
GTLGIVCPI

SEQ ID NO: 2598 - protein, 10 aa, Artificial Sequence
  Peptide Derived from Human Papillomavirus
HVDIRTLEDL

SEQ ID NO: 2599 - protein, 11 aa, Artificial Sequence
  Peptide Derived from Human Papillomavirus
HVDIRTLEDLL

SEQ ID NO: 2600 - protein, 11 aa, Artificial Sequence
  Peptide Derived from Human Papillomavirus
IVTFCCKCDST

SEQ ID NO: 2601 - protein, 8 aa, Artificial Sequence
  Peptide Derived from Human Papillomavirus
LLMGTLGI

SEQ ID NO: 2602 - protein, 9 aa, Artificial Sequence
  Peptide Derived from Human Papillomavirus
LLMGTLGIV

SEQ ID NO: 2603 - protein, 8 aa, Artificial Sequence
  Peptide Derived from Human Papillomavirus
LMGTLGIV

SEQ ID NO: 2604 - protein, 11 aa, Artificial Sequence
  Peptide Derived from Human Papillomavirus
LMGTLGIVCPI

SEQ ID NO: 2605 - protein, 8 aa, Artificial Sequence
  Peptide Derived from Human Papillomavirus
LQPETTDL

SEQ ID NO: 2606 - protein, 8 aa, Artificial Sequence
  Peptide Derived from Human Papillomavirus
MLDLQPET

SEQ ID NO: 2607 - protein, 9 aa, Artificial Sequence
  Peptide Derived from Human Papillomavirus
MLDLQPETT

SEQ ID NO: 2608 - protein, 11 aa, Artificial Sequence
  Peptide Derived from Human Papillomavirus
MLDLQPETTDL

SEQ ID NO: 2609 - protein, 10 aa, Artificial Sequence
  Peptide Derived from Human Papillomavirus
PAGQAEPDRA

SEQ ID NO: 2610 - protein, 8 aa, Artificial Sequence
  Peptide Derived from Human Papillomavirus
PTLHEYML

SEQ ID NO: 2611 - protein, 10 aa, Artificial Sequence
  Peptide Derived from Human Papillomavirus
PTLHEYMLDL

SEQ ID NO: 2612 - protein, 11 aa, Artificial Sequence
  Peptide Derived from Human Papillomavirus
QAEPDRAHYNI

SEQ ID NO: 2613 - protein, 8 aa, Artificial Sequence
  Peptide Derived from Human Papillomavirus
RAHYNIVT

SEQ ID NO: 2614 - protein, 9 aa, Artificial Sequence
  Peptide Derived from Human Papillomavirus
RLCVQSTHV

SEQ ID NO: 2615 - protein, 11 aa, Artificial Sequence
  Peptide Derived from Human Papillomavirus
RLCVQSTHVDI

SEQ ID NO: 2616 - protein, 8 aa, Artificial Sequence
  Peptide Derived from Human Papillomavirus
RTLEDLLM

SEQ ID NO: 2617 - protein, 10 aa, Artificial Sequence
  Peptide Derived from Human Papillomavirus
RTLEDLLMGT

SEQ ID NO: 2618 - protein, 11 aa, Artificial Sequence
  Peptide Derived from Human Papillomavirus
RTLEDLLMGTL

SEQ ID NO: 2619 - protein, 8 aa, Artificial Sequence
  Peptide Derived from Human Papillomavirus
STHVDIRT

SEQ ID NO: 2620 - protein, 9 aa, Artificial Sequence
  Peptide Derived from Human Papillomavirus
STHVDIRTL

SEQ ID NO: 2621 - protein, 10 aa, Artificial Sequence
  Peptide Derived from Human Papillomavirus
STLRLCVQST

SEQ ID NO: 2622 - protein, 9 aa, Artificial Sequence
  Peptide Derived from Human Papillomavirus
TLEDLLMGT

SEQ ID NO: 2623 - protein, 10 aa, Artificial Sequence
  Peptide Derived from Human Papillomavirus
TLEDLLMGTL

SEQ ID NO: 2624 - protein, 8 aa, Artificial Sequence
  Peptide Derived from Human Papillomavirus
TLGIVCPI

SEQ ID NO: 2625 - protein, 9 aa, Artificial Sequence
  Peptide Derived from Human Papillomavirus
TLHEYMLDL

SEQ ID NO: 2626 - protein, 9 aa, Artificial Sequence
  Peptide Derived from Human Papillomavirus
TLRLCVQST

SEQ ID NO: 2627 - protein, 11 aa, Artificial Sequence
  Peptide Derived from Human Papillomavirus
TLRLCVQSTHV

SEQ ID NO: 2628 - protein, 10 aa, Artificial Sequence
  Peptide Derived from Human Papillomavirus
TTDLYCYEQL

SEQ ID NO: 2629 - protein, 8 aa, Artificial Sequence
  Peptide Derived from Human Papillomavirus
VQSTHVDI

SEQ ID NO: 2630 - protein, 10 aa, Artificial Sequence
  Peptide Derived from Human Papillomavirus
VQSTHVDIRT

SEQ ID NO: 2631 - protein, 11 aa, Artificial Sequence
  Peptide Derived from Human Papillomavirus
VQSTHVDIRTL

SEQ ID NO: 2632 - protein, 10 aa, Artificial Sequence
  Peptide Derived from Human Papillomavirus
VTFCCKCDST

SEQ ID NO: 2633 - protein, 11 aa, Artificial Sequence
  Peptide Derived from Human Papillomavirus
VTFCCKCDSTL

SEQ ID NO: 2634 - protein, 9 aa, Artificial Sequence
  Peptide Derived from Human Papillomavirus
YMLDLQPET

SEQ ID NO: 2635 - protein, 10 aa, Artificial Sequence
  Peptide Derived from Human Papillomavirus
YMLDLQPETT

SEQ ID NO: 2636 - protein, 8 aa, Artificial Sequence
  Peptide Derived from Human Papillomavirus
AAISTSET

SEQ ID NO: 2637 - protein, 9 aa, Artificial Sequence
  Peptide Derived from Human Papillomavirus
AAISTSETT

SEQ ID NO: 2638 - protein, 8 aa, Artificial Sequence
  Peptide Derived from Human Papillomavirus
AIACQKHT

SEQ ID NO: 2639 - protein, 11 aa, Artificial Sequence
  Peptide Derived from Human Papillomavirus
AIACQKHTPPA

SEQ ID NO: 2640 - protein, 8 aa, Artificial Sequence
  Peptide Derived from Human Papillomavirus
AISTSETT

SEQ ID NO: 2641 - protein, 9 aa, Artificial Sequence
  Peptide Derived from Human Papillomavirus
AMDFTTLQA

SEQ ID NO: 2642 - protein, 8 aa, Artificial Sequence
  Peptide Derived from Human Papillomavirus
AQGHNNGI

SEQ ID NO: 2643 - protein, 10 aa, Artificial Sequence
  Peptide Derived from Human Papillomavirus
AQIFNKPYWL

SEQ ID NO: 2644 - protein, 8 aa, Artificial Sequence
  Peptide Derived from Human Papillomavirus
ATPTTSST

SEQ ID NO: 2645 - protein, 10 aa, Artificial Sequence
  Peptide Derived from Human Papillomavirus
ATPTTSSTST

SEQ ID NO: 2646 - protein, 11 aa, Artificial Sequence
  Peptide Derived from Human Papillomavirus
ATPTTSSTSTT

SEQ ID NO: 2647 - protein, 8 aa, Artificial Sequence
  Peptide Derived from Human Papillomavirus
ATVYLPPV

SEQ ID NO: 2648 - protein, 10 aa, Artificial Sequence
  Peptide Derived from Human Papillomavirus
ATVYLPPVPV

SEQ ID NO: 2649 - protein, 10 aa, Artificial Sequence
  Peptide Derived from Human Papillomavirus
AVGENVPDDL

SEQ ID NO: 2650 - protein, 9 aa, Artificial Sequence
  Peptide Derived from Human Papillomavirus
AVGHPYFPI

SEQ ID NO: 2651 - protein, 10 aa, Artificial Sequence
  Peptide Derived from Human Papillomavirus
AVNPGDCPPL

SEQ ID NO: 2652 - protein, 9 aa, Artificial Sequence
  Peptide Derived from Human Papillomavirus
CAAISTSET

SEQ ID NO: 2653 - protein, 10 aa, Artificial Sequence
  Peptide Derived from Human Papillomavirus
CAAISTSETT

SEQ ID NO: 2654 - protein, 9 aa, Artificial Sequence
  Peptide Derived from Human Papillomavirus
CISMDYKQT

SEQ ID NO: 2655 - protein, 11 aa, Artificial Sequence
  Peptide Derived from Human Papillomavirus
CISMDYKQTQL

SEQ ID NO: 2656 - protein, 9 aa, Artificial Sequence
  Peptide Derived from Human Papillomavirus
CLIGCKPPI

SEQ ID NO: 2657 - protein, 8 aa, Artificial Sequence
  Peptide Derived from Human Papillomavirus
CQKHTPPA

SEQ ID NO: 2658 - protein, 11 aa, Artificial Sequence
  Peptide Derived from Human Papillomavirus
CTSICKYPDYI

SEQ ID NO: 2659 - protein, 11 aa, Artificial Sequence
  Peptide Derived from Human Papillomavirus
DAQIFNKPYWL

SEQ ID NO: 2660 - protein, 8 aa, Artificial Sequence
  Peptide Derived from Human Papillomavirus
DLQFIFQL

SEQ ID NO: 2661 - protein, 11 aa, Artificial Sequence
  Peptide Derived from Human Papillomavirus
DLQFIFQLCKI

SEQ ID NO: 2662 - protein, 10 aa, Artificial Sequence
  Peptide Derived from Human Papillomavirus
DLYIKGSGST

SEQ ID NO: 2663 - protein, 11 aa, Artificial Sequence
  Peptide Derived from Human Papillomavirus
DLYIKGSGSTA

SEQ ID NO: 2664 - protein, 9 aa, Artificial Sequence
  Peptide Derived from Human Papillomavirus
DMVDTGFGA

SEQ ID NO: 2665 - protein, 10 aa, Artificial Sequence
  Peptide Derived from Human Papillomavirus
DMVDTGFGAM

SEQ ID NO: 2666 - protein, 10 aa, Artificial Sequence
  Peptide Derived from Human Papillomavirus
DQFPLGRKFL

SEQ ID NO: 2667 - protein, 11 aa, Artificial Sequence
  Peptide Derived from Human Papillomavirus
DQFPLGRKFLL

SEQ ID NO: 2668 - protein, 9 aa, Artificial Sequence
  Peptide Derived from Human Papillomavirus
DTENASAYA

SEQ ID NO: 2669 - protein, 10 aa, Artificial Sequence
  Peptide Derived from Human Papillomavirus
DTENASAYAA

SEQ ID NO: 2670 - protein, 10 aa, Artificial Sequence
  Peptide Derived from Human Papillomavirus
DTGFGAMDFT

SEQ ID NO: 2671 - protein, 11 aa, Artificial Sequence
  Peptide Derived from Human Papillomavirus
DTGFGAMDFTT

SEQ ID NO: 2672 - protein, 8 aa, Artificial Sequence
  Peptide Derived from Human Papillomavirus
DTQRLVWA

SEQ ID NO: 2673 - protein, 10 aa, Artificial Sequence
  Peptide Derived from Human Papillomavirus
DTQRLVWACV

SEQ ID NO: 2674 - protein, 9 aa, Artificial Sequence
  Peptide Derived from Human Papillomavirus
DTSFYNPDT

SEQ ID NO: 2675 - protein, 8 aa, Artificial Sequence
  Peptide Derived from Human Papillomavirus
DTTRSTNM

SEQ ID NO: 2676 - protein, 10 aa, Artificial Sequence
  Peptide Derived from Human Papillomavirus
DTTRSTNMSL

SEQ ID NO: 2677 - protein, 10 aa, Artificial Sequence
  Peptide Derived from Human Papillomavirus
DTYRFVTSQA

SEQ ID NO: 2678 - protein, 11 aa, Artificial Sequence
  Peptide Derived from Human Papillomavirus
DTYRFVTSQAI

SEQ ID NO: 2679 - protein, 9 aa, Artificial Sequence
  Peptide Derived from Human Papillomavirus
DVMTYIHSM

SEQ ID NO: 2680 - protein, 11 aa, Artificial Sequence
  Peptide Derived from Human Papillomavirus
DVNVYHIFFQM

SEQ ID NO: 2681 - protein, 9 aa, Artificial Sequence
  Peptide Derived from Human Papillomavirus
EATVYLPPV

SEQ ID NO: 2682 - protein, 11 aa, Artificial Sequence
  Peptide Derived from Human Papillomavirus
EATVYLPPVPV

SEQ ID NO: 2683 - protein, 8 aa, Artificial Sequence
  Peptide Derived from Human Papillomavirus
EQMFVRHL

SEQ ID NO: 2684 - protein, 8 aa, Artificial Sequence
  Peptide Derived from Human Papillomavirus
EVGRGQPL

SEQ ID NO: 2685 - protein, 10 aa, Artificial Sequence
  Peptide Derived from Human Papillomavirus
EVGRGQPLGV

SEQ ID NO: 2686 - protein, 10 aa, Artificial Sequence
  Peptide Derived from Human Papillomavirus
EVNLKEKFSA

SEQ ID NO: 2687 - protein, 8 aa, Artificial Sequence
  Peptide Derived from Human Papillomavirus
EVPLDICT

SEQ ID NO: 2688 - protein, 10 aa, Artificial Sequence
  Peptide Derived from Human Papillomavirus
EVPLDICTSI

SEQ ID NO: 2689 - protein, 8 aa, Artificial Sequence
  Peptide Derived from Human Papillomavirus
FIFQLCKI

SEQ ID NO: 2690 - protein, 9 aa, Artificial Sequence
  Peptide Derived from Human Papillomavirus
FIFQLCKIT

SEQ ID NO: 2691 - protein, 10 aa, Artificial Sequence
  Peptide Derived from Human Papillomavirus
FIFQLCKITL

SEQ ID NO: 2692 - protein, 11 aa, Artificial Sequence
  Peptide Derived from Human Papillomavirus
FIFQLCKITLT

SEQ ID NO: 2693 - protein, 8 aa, Artificial Sequence
  Peptide Derived from Human Papillomavirus
FIYILVIT

SEQ ID NO: 2694 - protein, 9 aa, Artificial Sequence
  Peptide Derived from Human Papillomavirus
FLLQAGLKA

SEQ ID NO: 2695 - protein, 8 aa, Artificial Sequence
  Peptide Derived from Human Papillomavirus
FQLCKITL

SEQ ID NO: 2696 - protein, 9 aa, Artificial Sequence
  Peptide Derived from Human Papillomavirus
FQLCKITLT

SEQ ID NO: 2697 - protein, 10 aa, Artificial Sequence
  Peptide Derived from Human Papillomavirus
FQLCKITLTA

SEQ ID NO: 2698 - protein, 11 aa, Artificial Sequence
  Peptide Derived from Human Papillomavirus
FQMSLWLPSEA

SEQ ID NO: 2699 - protein, 8 aa, Artificial Sequence
  Peptide Derived from Human Papillomavirus
FTLGKRKA

SEQ ID NO: 2700 - protein, 9 aa, Artificial Sequence
  Peptide Derived from Human Papillomavirus
FTLGKRKAT

SEQ ID NO: 2701 - protein, 11 aa, Artificial Sequence
  Peptide Derived from Human Papillomavirus
FTLGKRKATPT

SEQ ID NO: 2702 - protein, 11 aa, Artificial Sequence
  Peptide Derived from Human Papillomavirus
FTTLQANKSEV

SEQ ID NO: 2703 - protein, 9 aa, Artificial Sequence
  Peptide Derived from Human Papillomavirus
FVRHLFNRA

SEQ ID NO: 2704 - protein, 11 aa, Artificial Sequence
  Peptide Derived from Human Papillomavirus
FVRHLFNRAGA

SEQ ID NO: 2705 - protein, 8 aa, Artificial Sequence
  Peptide Derived from Human Papillomavirus
FVTSQAIA

SEQ ID NO: 2706 - protein, 8 aa, Artificial Sequence
  Peptide Derived from Human Papillomavirus
FVTVVDTT

SEQ ID NO: 2707 - protein, 11 aa, Artificial Sequence
  Peptide Derived from Human Papillomavirus
FVTVVDTTRST

SEQ ID NO: 2708 - protein, 8 aa, Artificial Sequence
  Peptide Derived from Human Papillomavirus
GAMDFTTL

SEQ ID NO: 2709 - protein, 10 aa, Artificial Sequence
  Peptide Derived from Human Papillomavirus
GAMDFTTLQA

SEQ ID NO: 2710 - protein, 11 aa, Artificial Sequence
  Peptide Derived from Human Papillomavirus
GAVGENVPDDL

SEQ ID NO: 2711 - protein, 8 aa, Artificial Sequence
  Peptide Derived from Human Papillomavirus
GICWGNQL

SEQ ID NO: 2712 - protein, 10 aa, Artificial Sequence
  Peptide Derived from Human Papillomavirus
GICWGNQLFV

SEQ ID NO: 2713 - protein, 11 aa, Artificial Sequence
  Peptide Derived from Human Papillomavirus
GICWGNQLFVT

SEQ ID NO: 2714 - protein, 8 aa, Artificial Sequence
  Peptide Derived from Human Papillomavirus
GISGHPLL

SEQ ID NO: 2715 - protein, 11 aa, Artificial Sequence
  Peptide Derived from Human Papillomavirus
GISGHPLLNKL

SEQ ID NO: 2716 - protein, 9 aa, Artificial Sequence
  Peptide Derived from Human Papillomavirus
GLKAKPKFT

SEQ ID NO: 2717 - protein, 10 aa, Artificial Sequence
  Peptide Derived from Human Papillomavirus
GLKAKPKFTL

SEQ ID NO: 2718 - protein, 9 aa, Artificial Sequence
  Peptide Derived from Human Papillomavirus
GLQPPPGGT

SEQ ID NO: 2719 - protein, 10 aa, Artificial Sequence
  Peptide Derived from Human Papillomavirus
GLQPPPGGTL

SEQ ID NO: 2720 - protein, 9 aa, Artificial Sequence
  Peptide Derived from Human Papillomavirus
GLQYRVFRI

SEQ ID NO: 2721 - protein, 11 aa, Artificial Sequence
  Peptide Derived from Human Papillomavirus
GLQYRVFRIHL

SEQ ID NO: 2722 - protein, 8 aa, Artificial Sequence
  Peptide Derived from Human Papillomavirus
GQPLGVGI

SEQ ID NO: 2723 - protein, 10 aa, Artificial Sequence
  Peptide Derived from Human Papillomavirus
GTLEDTYRFV

SEQ ID NO: 2724 - protein, 11 aa, Artificial Sequence
  Peptide Derived from Human Papillomavirus
GTLEDTYRFVT

SEQ ID NO: 2725 - protein, 8 aa, Artificial Sequence
  Peptide Derived from Human Papillomavirus
GTSRLLAV

SEQ ID NO: 2726 - protein, 8 aa, Artificial Sequence
  Peptide Derived from Human Papillomavirus
GVDNRECI

SEQ ID NO: 2727 - protein, 10 aa, Artificial Sequence
  Peptide Derived from Human Papillomavirus
GVDNRECISM

SEQ ID NO: 2728 - protein, 10 aa, Artificial Sequence
  Peptide Derived from Human Papillomavirus
GVEVGRGQPL

SEQ ID NO: 2729 - protein, 9 aa, Artificial Sequence
  Peptide Derived from Human Papillomavirus
GVGISGHPL

SEQ ID NO: 2730 - protein, 10 aa, Artificial Sequence
  Peptide Derived from Human Papillomavirus
GVGISGHPLL

SEQ ID NO: 2731 - protein, 8 aa, Artificial Sequence
  Peptide Derived from Human Papillomavirus
HAGTSRLL

SEQ ID NO: 2732 - protein, 9 aa, Artificial Sequence
  Peptide Derived from Human Papillomavirus
HAGTSRLLA

SEQ ID NO: 2733 - protein, 10 aa, Artificial Sequence
  Peptide Derived from Human Papillomavirus
HAGTSRLLAV

SEQ ID NO: 2734 - protein, 8 aa, Artificial Sequence
  Peptide Derived from Human Papillomavirus
HIFFQMSL

SEQ ID NO: 2735 - protein, 10 aa, Artificial Sequence
  Peptide Derived from Human Papillomavirus
HIFFQMSLWL

SEQ ID NO: 2736 - protein, 8 aa, Artificial Sequence
  Peptide Derived from Human Papillomavirus
HLFNRAGA

SEQ ID NO: 2737 - protein, 9 aa, Artificial Sequence
  Peptide Derived from Human Papillomavirus
HLFNRAGAV

SEQ ID NO: 2738 - protein, 11 aa, Artificial Sequence
  Peptide Derived from Human Papillomavirus
HTPPAPKEDPL

SEQ ID NO: 2739 - protein, 10 aa, Artificial Sequence
  Peptide Derived from Human Papillomavirus
IACQKHTPPA

SEQ ID NO: 2740 - protein, 9 aa, Artificial Sequence
  Peptide Derived from Human Papillomavirus
ILEDWNFGL

SEQ ID NO: 2741 - protein, 11 aa, Artificial Sequence
  Peptide Derived from Human Papillomavirus
ILVITCYENDV

SEQ ID NO: 2742 - protein, 9 aa, Artificial Sequence
  Peptide Derived from Human Papillomavirus
ILVPKVSGL

SEQ ID NO: 2743 - protein, 9 aa, Artificial Sequence
  Peptide Derived from Human Papillomavirus
IQDGDMVDT

SEQ ID NO: 2744 - protein, 8 aa, Artificial Sequence
  Peptide Derived from Human Papillomavirus
ITCYENDV

SEQ ID NO: 2745 - protein, 10 aa, Artificial Sequence
  Peptide Derived from Human Papillomavirus
ITCYENDVNV

SEQ ID NO: 2746 - protein, 8 aa, Artificial Sequence
  Peptide Derived from Human Papillomavirus
ITLTADVM

SEQ ID NO: 2747 - protein, 9 aa, Artificial Sequence
  Peptide Derived from Human Papillomavirus
ITLTADVMT

SEQ ID NO: 2748 - protein, 11 aa, Artificial Sequence
  Peptide Derived from Human Papillomavirus
ITLTADVMTYI

SEQ ID NO: 2749 - protein, 8 aa, Artificial Sequence
  Peptide Derived from Human Papillomavirus
KAKPKFTL

SEQ ID NO: 2750 - protein, 9 aa, Artificial Sequence
  Peptide Derived from Human Papillomavirus
KATPTTSST

SEQ ID NO: 2751 - protein, 11 aa, Artificial Sequence
  Peptide Derived from Human Papillomavirus
KATPTTSSTST

SEQ ID NO: 2752 - protein, 10 aa, Artificial Sequence
  Peptide Derived from Human Papillomavirus
KILVPKVSGL

SEQ ID NO: 2753 - protein, 8 aa, Artificial Sequence
  Peptide Derived from Human Papillomavirus
KITLTADV

SEQ ID NO: 2754 - protein, 9 aa, Artificial Sequence
  Peptide Derived from Human Papillomavirus
KITLTADVM

SEQ ID NO: 2755 - protein, 10 aa, Artificial Sequence
  Peptide Derived from Human Papillomavirus
KITLTADVMT

SEQ ID NO: 2756 - protein, 8 aa, Artificial Sequence
  Peptide Derived from Human Papillomavirus
KLDDTENA

SEQ ID NO: 2757 - protein, 10 aa, Artificial Sequence
  Peptide Derived from Human Papillomavirus
KLDDTENASA

SEQ ID NO: 2758 - protein, 11 aa, Artificial Sequence
  Peptide Derived from Human Papillomavirus
KMVSEPYGDSL

SEQ ID NO: 2759 - protein, 8 aa, Artificial Sequence
  Peptide Derived from Human Papillomavirus
KQTQLCLI

SEQ ID NO: 2760 - protein, 9 aa, Artificial Sequence
  Peptide Derived from Human Papillomavirus
KVSGLQYRV

SEQ ID NO: 2761 - protein, 9 aa, Artificial Sequence
  Peptide Derived from Human Papillomavirus
KVVSTDEYV

SEQ ID NO: 2762 - protein, 10 aa, Artificial Sequence
  Peptide Derived from Human Papillomavirus
KVVSTDEYVA

SEQ ID NO: 2763 - protein, 9 aa, Artificial Sequence
  Peptide Derived from Human Papillomavirus
LASSNYFPT

SEQ ID NO: 2764 - protein, 10 aa, Artificial Sequence
  Peptide Derived from Human Papillomavirus
LAVGHPYFPI

SEQ ID NO: 2765 - protein, 8 aa, Artificial Sequence
  Peptide Derived from Human Papillomavirus
LIGCKPPI

SEQ ID NO: 2766 - protein, 11 aa, Artificial Sequence
  Peptide Derived from Human Papillomavirus
LINTVIQDGDM

SEQ ID NO: 2767 - protein, 11 aa, Artificial Sequence
  Peptide Derived from Human Papillomavirus
LLAVGHPYFPI

SEQ ID NO: 2768 - protein, 8 aa, Artificial Sequence
  Peptide Derived from Human Papillomavirus
LLNKLDDT

SEQ ID NO: 2769 - protein, 11 aa, Artificial Sequence
  Peptide Derived from Human Papillomavirus
LLNKLDDTENA

SEQ ID NO: 2770 - protein, 8 aa, Artificial Sequence
  Peptide Derived from Human Papillomavirus
LLQAGLKA

SEQ ID NO: 2771 - protein, 8 aa, Artificial Sequence
  Peptide Derived from Human Papillomavirus
LQANKSEV

SEQ ID NO: 2772 - protein, 10 aa, Artificial Sequence
  Peptide Derived from Human Papillomavirus
LQANKSEVPL

SEQ ID NO: 2773 - protein, 10 aa, Artificial Sequence
  Peptide Derived from Human Papillomavirus
LQFIFQLCKI

SEQ ID NO: 2774 - protein, 11 aa, Artificial Sequence
  Peptide Derived from Human Papillomavirus
LQFIFQLCKIT

SEQ ID NO: 2775 - protein, 8 aa, Artificial Sequence
  Peptide Derived from Human Papillomavirus
LQPPPGGT

SEQ ID NO: 2776 - protein, 9 aa, Artificial Sequence
  Peptide Derived from Human Papillomavirus
LQPPPGGTL

SEQ ID NO: 2777 - protein, 11 aa, Artificial Sequence
  Peptide Derived from Human Papillomavirus
LQRAQGHNNGI

SEQ ID NO: 2778 - protein, 8 aa, Artificial Sequence
  Peptide Derived from Human Papillomavirus
LQYRVFRI

SEQ ID NO: 2779 - protein, 10 aa, Artificial Sequence
  Peptide Derived from Human Papillomavirus
LQYRVFRIHL

SEQ ID NO: 2780 - protein, 9 aa, Artificial Sequence
  Peptide Derived from Human Papillomavirus
LTADVMTYI

SEQ ID NO: 2781 - protein, 10 aa, Artificial Sequence
  Peptide Derived from Human Papillomavirus
LVITCYENDV

SEQ ID NO: 2782 - protein, 8 aa, Artificial Sequence
  Peptide Derived from Human Papillomavirus
LVPKVSGL

SEQ ID NO: 2783 - protein, 8 aa, Artificial Sequence
  Peptide Derived from Human Papillomavirus
LVWACVGV

SEQ ID NO: 2784 - protein, 10 aa, Artificial Sequence
  Peptide Derived from Human Papillomavirus
LVWACVGVEV

SEQ ID NO: 2785 - protein, 8 aa, Artificial Sequence
  Peptide Derived from Human Papillomavirus
MQVTFIYI

SEQ ID NO: 2786 - protein, 9 aa, Artificial Sequence
  Peptide Derived from Human Papillomavirus
MQVTFIYIL

SEQ ID NO: 2787 - protein, 10 aa, Artificial Sequence
  Peptide Derived from Human Papillomavirus
MQVTFIYILV

SEQ ID NO: 2788 - protein, 11 aa, Artificial Sequence
  Peptide Derived from Human Papillomavirus
MQVTFIYILVI

SEQ ID NO: 2789 - protein, 10 aa, Artificial Sequence
  Peptide Derived from Human Papillomavirus
MTYIHSMNST

SEQ ID NO: 2790 - protein, 11 aa, Artificial Sequence
  Peptide Derived from Human Papillomavirus
MTYIHSMNSTI

SEQ ID NO: 2791 - protein, 8 aa, Artificial Sequence
  Peptide Derived from Human Papillomavirus
MVDTGFGA

SEQ ID NO: 2792 - protein, 9 aa, Artificial Sequence
  Peptide Derived from Human Papillomavirus
MVDTGFGAM

SEQ ID NO: 2793 - protein, 10 aa, Artificial Sequence
  Peptide Derived from Human Papillomavirus
MVSEPYGDSL

SEQ ID NO: 2794 - protein, 8 aa, Artificial Sequence
  Peptide Derived from Human Papillomavirus
MVTSDAQI

SEQ ID NO: 2795 - protein, 10 aa, Artificial Sequence
  Peptide Derived from Human Papillomavirus
NAGVDNRECI

SEQ ID NO: 2796 - protein, 9 aa, Artificial Sequence
  Peptide Derived from Human Papillomavirus
NASAYAANA

SEQ ID NO: 2797 - protein, 11 aa, Artificial Sequence
  Peptide Derived from Human Papillomavirus
NASAYAANAGV

SEQ ID NO: 2798 - protein, 8 aa, Artificial Sequence
  Peptide Derived from Human Papillomavirus
NIYYHAGT

SEQ ID NO: 2799 - protein, 11 aa, Artificial Sequence
  Peptide Derived from Human Papillomavirus
NIYYHAGTSRL

SEQ ID NO: 2800 - protein, 10 aa, Artificial Sequence
  Peptide Derived from Human Papillomavirus
NLASSNYFPT

SEQ ID NO: 2801 - protein, 8 aa, Artificial Sequence
  Peptide Derived from Human Papillomavirus
NLKEKFSA

SEQ ID NO: 2802 - protein, 10 aa, Artificial Sequence
  Peptide Derived from Human Papillomavirus
NLKEKFSADL

SEQ ID NO: 2803 - protein, 8 aa, Artificial Sequence
  Peptide Derived from Human Papillomavirus
NMSLCAAI

SEQ ID NO: 2804 - protein, 10 aa, Artificial Sequence
  Peptide Derived from Human Papillomavirus
NMSLCAAIST

SEQ ID NO: 2805 - protein, 8 aa, Artificial Sequence
  Peptide Derived from Human Papillomavirus
NQLFVTVV

SEQ ID NO: 2806 - protein, 10 aa, Artificial Sequence
  Peptide Derived from Human Papillomavirus
NQLFVTVVDT

SEQ ID NO: 2807 - protein, 11 aa, Artificial Sequence
  Peptide Derived from Human Papillomavirus
NQLFVTVVDTT

SEQ ID NO: 2808 - protein, 8 aa, Artificial Sequence
  Peptide Derived from Human Papillomavirus
NTNFKEYL

SEQ ID NO: 2809 - protein, 9 aa, Artificial Sequence
  Peptide Derived from Human Papillomavirus
NTVIQDGDM

SEQ ID NO: 2810 - protein, 10 aa, Artificial Sequence
  Peptide Derived from Human Papillomavirus
NTVIQDGDMV

SEQ ID NO: 2811 - protein, 8 aa, Artificial Sequence
  Peptide Derived from Human Papillomavirus
NVPDDLYI

SEQ ID NO: 2812 - protein, 9 aa, Artificial Sequence
  Peptide Derived from Human Papillomavirus
NVYHIFFQM

SEQ ID NO: 2813 - protein, 11 aa, Artificial Sequence
  Peptide Derived from Human Papillomavirus
NVYHIFFQMSL

SEQ ID NO: 2814 - protein, 8 aa, Artificial Sequence
  Peptide Derived from Human Papillomavirus
PAPKEDPL

SEQ ID NO: 2815 - protein, 10 aa, Artificial Sequence
  Peptide Derived from Human Papillomavirus
PIKKPNNNKI

SEQ ID NO: 2816 - protein, 11 aa, Artificial Sequence
  Peptide Derived from Human Papillomavirus
PIKKPNNNKIL

SEQ ID NO: 2817 - protein, 8 aa, Artificial Sequence
  Peptide Derived from Human Papillomavirus
PLDICTSI

SEQ ID NO: 2818 - protein, 8 aa, Artificial Sequence
  Peptide Derived from Human Papillomavirus
PLELINTV

SEQ ID NO: 2819 - protein, 9 aa, Artificial Sequence
  Peptide Derived from Human Papillomavirus
PLELINTVI

SEQ ID NO: 2820 - protein, 8 aa, Artificial Sequence
  Peptide Derived from Human Papillomavirus
PLGRKFLL

SEQ ID NO: 2821 - protein, 10 aa, Artificial Sequence
  Peptide Derived from Human Papillomavirus
PLGRKFLLQA

SEQ ID NO: 2822 - protein, 11 aa, Artificial Sequence
  Peptide Derived from Human Papillomavirus
PLGVGISGHPL

SEQ ID NO: 2823 - protein, 10 aa, Artificial Sequence
  Peptide Derived from Human Papillomavirus
PLKKYTFWEV

SEQ ID NO: 2824 - protein, 9 aa, Artificial Sequence
  Peptide Derived from Human Papillomavirus
PLLNKLDDT

SEQ ID NO: 2825 - protein, 8 aa, Artificial Sequence
  Peptide Derived from Human Papillomavirus
PTPSGSMV

SEQ ID NO: 2826 - protein, 9 aa, Artificial Sequence
  Peptide Derived from Human Papillomavirus
PTPSGSMVT

SEQ ID NO: 2827 - protein, 8 aa, Artificial Sequence
  Peptide Derived from Human Papillomavirus
PTTSSTST

SEQ ID NO: 2828 - protein, 9 aa, Artificial Sequence
  Peptide Derived from Human Papillomavirus
PTTSSTSTT

SEQ ID NO: 2829 - protein, 10 aa, Artificial Sequence
  Peptide Derived from Human Papillomavirus
PTTSSTSTTA

SEQ ID NO: 2830 - protein, 8 aa, Artificial Sequence
  Peptide Derived from Human Papillomavirus
PVPVSKVV

SEQ ID NO: 2831 - protein, 10 aa, Artificial Sequence
  Peptide Derived from Human Papillomavirus
PVPVSKVVST

SEQ ID NO: 2832 - protein, 8 aa, Artificial Sequence
  Peptide Derived from Human Papillomavirus
PVSKVVST

SEQ ID NO: 2833 - protein, 11 aa, Artificial Sequence
  Peptide Derived from Human Papillomavirus
QAGLKAKPKFT

SEQ ID NO: 2834 - protein, 9 aa, Artificial Sequence
  Peptide Derived from Human Papillomavirus
QAIACQKHT

SEQ ID NO: 2835 - protein, 9 aa, Artificial Sequence
  Peptide Derived from Human Papillomavirus
QANKSEVPL

SEQ ID NO: 2836 - protein, 11 aa, Artificial Sequence
  Peptide Derived from Human Papillomavirus
QANKSEVPLDI

SEQ ID NO: 2837 - protein, 9 aa, Artificial Sequence
  Peptide Derived from Human Papillomavirus
QIFNKPYWL

SEQ ID NO: 2838 - protein, 8 aa, Artificial Sequence
  Peptide Derived from Human Papillomavirus
QLCKITLT

SEQ ID NO: 2839 - protein, 9 aa, Artificial Sequence
  Peptide Derived from Human Papillomavirus
QLCKITLTA

SEQ ID NO: 2840 - protein, 11 aa, Artificial Sequence
  Peptide Derived from Human Papillomavirus
QLCKITLTADV

SEQ ID NO: 2841 - protein, 11 aa, Artificial Sequence
  Peptide Derived from Human Papillomavirus
QLCLIGCKPPI

SEQ ID NO: 2842 - protein, 9 aa, Artificial Sequence
  Peptide Derived from Human Papillomavirus
QLFVTVVDT

SEQ ID NO: 2843 - protein, 10 aa, Artificial Sequence
  Peptide Derived from Human Papillomavirus
QLFVTVVDTT

SEQ ID NO: 2844 - protein, 11 aa, Artificial Sequence
  Peptide Derived from Human Papillomavirus
QMFVRHLFNRA

SEQ ID NO: 2845 - protein, 10 aa, Artificial Sequence
  Peptide Derived from Human Papillomavirus
QMSLWLPSEA

SEQ ID NO: 2846 - protein, 11 aa, Artificial Sequence
  Peptide Derived from Human Papillomavirus
QMSLWLPSEAT

SEQ ID NO: 2847 - protein, 8 aa, Artificial Sequence
  Peptide Derived from Human Papillomavirus
QVTFIYIL

SEQ ID NO: 2848 - protein, 9 aa, Artificial Sequence
  Peptide Derived from Human Papillomavirus
QVTFIYILV

SEQ ID NO: 2849 - protein, 10 aa, Artificial Sequence
  Peptide Derived from Human Papillomavirus
QVTFIYILVI

SEQ ID NO: 2850 - protein, 11 aa, Artificial Sequence
  Peptide Derived from Human Papillomavirus
QVTFIYILVIT

SEQ ID NO: 2851 - protein, 9 aa, Artificial Sequence
  Peptide Derived from Human Papillomavirus
RAGAVGENV

SEQ ID NO: 2852 - protein, 9 aa, Artificial Sequence
  Peptide Derived from Human Papillomavirus
RAQGHNNGI

SEQ ID NO: 2853 - protein, 9 aa, Artificial Sequence
  Peptide Derived from Human Papillomavirus
RLVWACVGV

SEQ ID NO: 2854 - protein, 11 aa, Artificial Sequence
  Peptide Derived from Human Papillomavirus
RLVWACVGVEV

SEQ ID NO: 2855 - protein, 8 aa, Artificial Sequence
  Peptide Derived from Human Papillomavirus
RTNIYYHA

SEQ ID NO: 2856 - protein, 10 aa, Artificial Sequence
  Peptide Derived from Human Papillomavirus
RTNIYYHAGT

SEQ ID NO: 2857 - protein, 9 aa, Artificial Sequence
  Peptide Derived from Human Papillomavirus
SADLDQFPL

SEQ ID NO: 2858 - protein, 9 aa, Artificial Sequence
  Peptide Derived from Human Papillomavirus
SAYAANAGV

SEQ ID NO: 2859 - protein, 9 aa, Artificial Sequence
  Peptide Derived from Human Papillomavirus
SICKYPDYI

SEQ ID NO: 2860 - protein, 11 aa, Artificial Sequence
  Peptide Derived from Human Papillomavirus
SICKYPDYIKM

SEQ ID NO: 2861 - protein, 8 aa, Artificial Sequence
  Peptide Derived from Human Papillomavirus
SLCAAIST

SEQ ID NO: 2862 - protein, 11 aa, Artificial Sequence
  Peptide Derived from Human Papillomavirus
SLCAAISTSET

SEQ ID NO: 2863 - protein, 11 aa, Artificial Sequence
  Peptide Derived from Human Papillomavirus
SLFFYLRREQM

SEQ ID NO: 2864 - protein, 8 aa, Artificial Sequence
  Peptide Derived from Human Papillomavirus
SLWLPSEA

SEQ ID NO: 2865 - protein, 9 aa, Artificial Sequence
  Peptide Derived from Human Papillomavirus
SLWLPSEAT

SEQ ID NO: 2866 - protein, 10 aa, Artificial Sequence
  Peptide Derived from Human Papillomavirus
SLWLPSEATV

SEQ ID NO: 2867 - protein, 9 aa, Artificial Sequence
  Peptide Derived from Human Papillomavirus
SMDYKQTQL

SEQ ID NO: 2868 - protein, 11 aa, Artificial Sequence
  Peptide Derived from Human Papillomavirus
SMDYKQTQLCL

SEQ ID NO: 2869 - protein, 9 aa, Artificial Sequence
  Peptide Derived from Human Papillomavirus
SMVTSDAQI

SEQ ID NO: 2870 - protein, 10 aa, Artificial Sequence
  Peptide Derived from Human Papillomavirus
SQAIACQKHT

SEQ ID NO: 2871 - protein, 9 aa, Artificial Sequence
  Peptide Derived from Human Papillomavirus
STDEYVART

SEQ ID NO: 2872 - protein, 11 aa, Artificial Sequence
  Peptide Derived from Human Papillomavirus
STDEYVARTNI

SEQ ID NO: 2873 - protein, 11 aa, Artificial Sequence
  Peptide Derived from Human Papillomavirus
STILEDWNFGL

SEQ ID NO: 2874 - protein, 8 aa, Artificial Sequence
  Peptide Derived from Human Papillomavirus
STNMSLCA

SEQ ID NO: 2875 - protein, 9 aa, Artificial Sequence
  Peptide Derived from Human Papillomavirus
STNMSLCAA

SEQ ID NO: 2876 - protein, 10 aa, Artificial Sequence
  Peptide Derived from Human Papillomavirus
STNMSLCAAI

SEQ ID NO: 2877 - protein, 10 aa, Artificial Sequence
  Peptide Derived from Human Papillomavirus
STSETTYKNT

SEQ ID NO: 2878 - protein, 11 aa, Artificial Sequence
  Peptide Derived from Human Papillomavirus
STTAKRKKRKL

SEQ ID NO: 2879 - protein, 8 aa, Artificial Sequence
  Peptide Derived from Human Papillomavirus
TADVMTYI

SEQ ID NO: 2880 - protein, 11 aa, Artificial Sequence
  Peptide Derived from Human Papillomavirus
TADVMTYIHSM

SEQ ID NO: 2881 - protein, 9 aa, Artificial Sequence
  Peptide Derived from Human Papillomavirus
TAKRKKRKL

SEQ ID NO: 2882 - protein, 10 aa, Artificial Sequence
  Peptide Derived from Human Papillomavirus
TILEDWNFGL

SEQ ID NO: 2883 - protein, 9 aa, Artificial Sequence
  Peptide Derived from Human Papillomavirus
TLEDTYRFV

SEQ ID NO: 2884 - protein, 10 aa, Artificial Sequence
  Peptide Derived from Human Papillomavirus
TLEDTYRFVT

SEQ ID NO: 2885 - protein, 8 aa, Artificial Sequence
  Peptide Derived from Human Papillomavirus
TLGKRKAT

SEQ ID NO: 2886 - protein, 10 aa, Artificial Sequence
  Peptide Derived from Human Papillomavirus
TLGKRKATPT

SEQ ID NO: 2887 - protein, 11 aa, Artificial Sequence
  Peptide Derived from Human Papillomavirus
TLGKRKATPTT

SEQ ID NO: 2888 - protein, 9 aa, Artificial Sequence
  Peptide Derived from Human Papillomavirus
TLQANKSEV

SEQ ID NO: 2889 - protein, 11 aa, Artificial Sequence
  Peptide Derived from Human Papillomavirus
TLQANKSEVPL

SEQ ID NO: 2890 - protein, 8 aa, Artificial Sequence
  Peptide Derived from Human Papillomavirus
TLTADVMT

SEQ ID NO: 2891 - protein, 10 aa, Artificial Sequence
  Peptide Derived from Human Papillomavirus
TLTADVMTYI

SEQ ID NO: 2892 - protein, 9 aa, Artificial Sequence
  Peptide Derived from Human Papillomavirus
TQRLVWACV

SEQ ID NO: 2893 - protein, 11 aa, Artificial Sequence
  Peptide Derived from Human Papillomavirus
TQRLVWACVGV

SEQ ID NO: 2894 - protein, 10 aa, Artificial Sequence
  Peptide Derived from Human Papillomavirus
TTAKRKKRKL

SEQ ID NO: 2895 - protein, 10 aa, Artificial Sequence
  Peptide Derived from Human Papillomavirus
TTLQANKSEV

SEQ ID NO: 2896 - protein, 9 aa, Artificial Sequence
  Peptide Derived from Human Papillomavirus
TTRSTNMSL

SEQ ID NO: 2897 - protein, 11 aa, Artificial Sequence
  Peptide Derived from Human Papillomavirus
TTRSTNMSLCA

SEQ ID NO: 2898 - protein, 8 aa, Artificial Sequence
  Peptide Derived from Human Papillomavirus
TTSSTSTT

SEQ ID NO: 2899 - protein, 9 aa, Artificial Sequence
  Peptide Derived from Human Papillomavirus
TTSSTSTTA

SEQ ID NO: 2900 - protein, 8 aa, Artificial Sequence
  Peptide Derived from Human Papillomavirus
TVIQDGDM

SEQ ID NO: 2901 - protein, 9 aa, Artificial Sequence
  Peptide Derived from Human Papillomavirus
TVIQDGDMV

SEQ ID NO: 2902 - protein, 11 aa, Artificial Sequence
  Peptide Derived from Human Papillomavirus
TVIQDGDMVDT

SEQ ID NO: 2903 - protein, 9 aa, Artificial Sequence
  Peptide Derived from Human Papillomavirus
TVVDTTRST

SEQ ID NO: 2904 - protein, 11 aa, Artificial Sequence
  Peptide Derived from Human Papillomavirus
TVVDTTRSTNM

SEQ ID NO: 2905 - protein, 9 aa, Artificial Sequence
  Peptide Derived from Human Papillomavirus
TVYLPPVPV

SEQ ID NO: 2906 - protein, 10 aa, Artificial Sequence
  Peptide Derived from Human Papillomavirus
VARTNIYYHA

SEQ ID NO: 2907 - protein, 11 aa, Artificial Sequence
  Peptide Derived from Human Papillomavirus
VAVNPGDCPPL

SEQ ID NO: 2908 - protein, 8 aa, Artificial Sequence
  Peptide Derived from Human Papillomavirus
VIQDGDMV

SEQ ID NO: 2909 - protein, 10 aa, Artificial Sequence
  Peptide Derived from Human Papillomavirus
VIQDGDMVDT

SEQ ID NO: 2910 - protein, 9 aa, Artificial Sequence
  Peptide Derived from Human Papillomavirus
VITCYENDV

SEQ ID NO: 2911 - protein, 11 aa, Artificial Sequence
  Peptide Derived from Human Papillomavirus
VITCYENDVNV

SEQ ID NO: 2912 - protein, 8 aa, Artificial Sequence
  Peptide Derived from Human Papillomavirus
VMTYIHSM

SEQ ID NO: 2913 - protein, 11 aa, Artificial Sequence
  Peptide Derived from Human Papillomavirus
VMTYIHSMNST

SEQ ID NO: 2914 - protein, 8 aa, Artificial Sequence
  Peptide Derived from Human Papillomavirus
VTFIYILV

SEQ ID NO: 2915 - protein, 9 aa, Artificial Sequence
  Peptide Derived from Human Papillomavirus
VTFIYILVI

SEQ ID NO: 2916 - protein, 10 aa, Artificial Sequence
  Peptide Derived from Human Papillomavirus
VTFIYILVIT

SEQ ID NO: 2917 - protein, 10 aa, Artificial Sequence
  Peptide Derived from Human Papillomavirus
VTVVDTTRST

SEQ ID NO: 2918 - protein, 8 aa, Artificial Sequence
  Peptide Derived from Human Papillomavirus
VVDTTRST

SEQ ID NO: 2919 - protein, 10 aa, Artificial Sequence
  Peptide Derived from Human Papillomavirus
VVDTTRSTNM

SEQ ID NO: 2920 - protein, 8 aa, Artificial Sequence
  Peptide Derived from Human Papillomavirus
VVSTDEYV

SEQ ID NO: 2921 - protein, 9 aa, Artificial Sequence
  Peptide Derived from Human Papillomavirus
VVSTDEYVA

SEQ ID NO: 2922 - protein, 11 aa, Artificial Sequence
  Peptide Derived from Human Papillomavirus
VVSTDEYVART

SEQ ID NO: 2923 - protein, 8 aa, Artificial Sequence
  Peptide Derived from Human Papillomavirus
WACVGVEV

SEQ ID NO: 2924 - protein, 8 aa, Artificial Sequence
  Peptide Derived from Human Papillomavirus
WLPSEATV

SEQ ID NO: 2925 - protein, 10 aa, Artificial Sequence
  Peptide Derived from Human Papillomavirus
WLPSEATVYL

SEQ ID NO: 2926 - protein, 8 aa, Artificial Sequence
  Peptide Derived from Human Papillomavirus
YIHSMNST

SEQ ID NO: 2927 - protein, 9 aa, Artificial Sequence
  Peptide Derived from Human Papillomavirus
YIHSMNSTI

SEQ ID NO: 2928 - protein, 10 aa, Artificial Sequence
  Peptide Derived from Human Papillomavirus
YIHSMNSTIL

SEQ ID NO: 2929 - protein, 8 aa, Artificial Sequence
  Peptide Derived from Human Papillomavirus
YIKGSGST

SEQ ID NO: 2930 - protein, 9 aa, Artificial Sequence
  Peptide Derived from Human Papillomavirus
YIKGSGSTA

SEQ ID NO: 2931 - protein, 11 aa, Artificial Sequence
  Peptide Derived from Human Papillomavirus
YIKGSGSTANL

SEQ ID NO: 2932 - protein, 10 aa, Artificial Sequence
  Peptide Derived from Human Papillomavirus
YLPPVPVSKV

SEQ ID NO: 2933 - protein, 11 aa, Artificial Sequence
  Peptide Derived from Human Papillomavirus
YLPPVPVSKVV

SEQ ID NO: 2934 - protein, 10 aa, Artificial Sequence
  Peptide Derived from Human Papillomavirus
YLRHGEEYDL

SEQ ID NO: 2935 - protein, 9 aa, Artificial Sequence
  Peptide Derived from Human Papillomavirus
YLRREQMFV

SEQ ID NO: 2936 - protein, 8 aa, Artificial Sequence
  Peptide Derived from Human Papillomavirus
YTFWEVNL

SEQ ID NO: 2937 - protein, 11 aa, Artificial Sequence
  Peptide Derived from Human Papillomavirus
YVARTNIYYHA

SEQ ID NO: 2938 - protein, 11 aa, Artificial Sequence
  Peptide Derived from Human Papillomavirus
AALPTSINNGL

SEQ ID NO: 2939 - protein, 8 aa, Artificial Sequence
  Peptide Derived from Human Papillomavirus
AILDINNT

SEQ ID NO: 2940 - protein, 9 aa, Artificial Sequence
  Peptide Derived from Human Papillomavirus
AILDINNTV

SEQ ID NO: 2941 - protein, 10 aa, Artificial Sequence
  Peptide Derived from Human Papillomavirus
AILDINNTVT

SEQ ID NO: 2942 - protein, 11 aa, Artificial Sequence
  Peptide Derived from Human Papillomavirus
AILDINNTVTT

SEQ ID NO: 2943 - protein, 8 aa, Artificial Sequence
  Peptide Derived from Human Papillomavirus
ALHRPALT

SEQ ID NO: 2944 - protein, 10 aa, Artificial Sequence
  Peptide Derived from Human Papillomavirus
ALPTSINNGL

SEQ ID NO: 2945 - protein, 9 aa, Artificial Sequence
  Peptide Derived from Human Papillomavirus
ALTSRRTGI

SEQ ID NO: 2946 - protein, 8 aa, Artificial Sequence
  Peptide Derived from Human Papillomavirus
ATDTLAPV

SEQ ID NO: 2947 - protein, 11 aa, Artificial Sequence
  Peptide Derived from Human Papillomavirus
ATQLYKTCKQA

SEQ ID NO: 2948 - protein, 8 aa, Artificial Sequence
  Peptide Derived from Human Papillomavirus
DAGAPTSV

SEQ ID NO: 2949 - protein, 11 aa, Artificial Sequence
  Peptide Derived from Human Papillomavirus
DAGAPTSVPSI

SEQ ID NO: 2950 - protein, 10 aa, Artificial Sequence
  Peptide Derived from Human Papillomavirus
DIIPKVEGKT

SEQ ID NO: 2951 - protein, 11 aa, Artificial Sequence
  Peptide Derived from Human Papillomavirus
DIIPKVEGKTI

SEQ ID NO: 2952 - protein, 8 aa, Artificial Sequence
  Peptide Derived from Human Papillomavirus
DINNTVTT

SEQ ID NO: 2953 - protein, 9 aa, Artificial Sequence
  Peptide Derived from Human Papillomavirus
DINNTVTTV

SEQ ID NO: 2954 - protein, 10 aa, Artificial Sequence
  Peptide Derived from Human Papillomavirus
DINNTVTTVT

SEQ ID NO: 2955 - protein, 11 aa, Artificial Sequence
  Peptide Derived from Human Papillomavirus
DINNTVTTVTT

SEQ ID NO: 2956 - protein, 10 aa, Artificial Sequence
  Peptide Derived from Human Papillomavirus
DIPINITDQA

SEQ ID NO: 2957 - protein, 9 aa, Artificial Sequence
  Peptide Derived from Human Papillomavirus
DIVALHRPA

SEQ ID NO: 2958 - protein, 10 aa, Artificial Sequence
  Peptide Derived from Human Papillomavirus
DIVALHRPAL

SEQ ID NO: 2959 - protein, 11 aa, Artificial Sequence
  Peptide Derived from Human Papillomavirus
DIVALHRPALT

SEQ ID NO: 2960 - protein, 8 aa, Artificial Sequence
  Peptide Derived from Human Papillomavirus
DIYADDFI

SEQ ID NO: 2961 - protein, 9 aa, Artificial Sequence
  Peptide Derived from Human Papillomavirus
DIYADDFIT

SEQ ID NO: 2962 - protein, 11 aa, Artificial Sequence
  Peptide Derived from Human Papillomavirus
DIYADDFITDT

SEQ ID NO: 2963 - protein, 9 aa, Artificial Sequence
  Peptide Derived from Human Papillomavirus
DQAPSLIPI

SEQ ID NO: 2964 - protein, 10 aa, Artificial Sequence
  Peptide Derived from Human Papillomavirus
DQAPSLIPIV

SEQ ID NO: 2965 - protein, 9 aa, Artificial Sequence
  Peptide Derived from Human Papillomavirus
DQILQYGSM

SEQ ID NO: 2966 - protein, 11 aa, Artificial Sequence
  Peptide Derived from Human Papillomavirus
DQILQYGSMGV

SEQ ID NO: 2967 - protein, 11 aa, Artificial Sequence
  Peptide Derived from Human Papillomavirus
DTFIVSTNPNT

SEQ ID NO: 2968 - protein, 10 aa, Artificial Sequence
  Peptide Derived from Human Papillomavirus
DTLAPVRPPL

SEQ ID NO: 2969 - protein, 11 aa, Artificial Sequence
  Peptide Derived from Human Papillomavirus
DTLAPVRPPLT

SEQ ID NO: 2970 - protein, 10 aa, Artificial Sequence
  Peptide Derived from Human Papillomavirus
DTSTTPVPSV

SEQ ID NO: 2971 - protein, 9 aa, Artificial Sequence
  Peptide Derived from Human Papillomavirus
DTTPAILDI

SEQ ID NO: 2972 - protein, 8 aa, Artificial Sequence
  Peptide Derived from Human Papillomavirus
DVSGFSIT

SEQ ID NO: 2973 - protein, 9 aa, Artificial Sequence
  Peptide Derived from Human Papillomavirus
DVSGFSITT

SEQ ID NO: 2974 - protein, 11 aa, Artificial Sequence
  Peptide Derived from Human Papillomavirus
DVSGFSITTST

SEQ ID NO: 2975 - protein, 8 aa, Artificial Sequence
  Peptide Derived from Human Papillomavirus
EIELQTIT

SEQ ID NO: 2976 - protein, 11 aa, Artificial Sequence
  Peptide Derived from Human Papillomavirus
EIELQTITPST

SEQ ID NO: 2977 - protein, 8 aa, Artificial Sequence
  Peptide Derived from Human Papillomavirus
EIPMDTFI

SEQ ID NO: 2978 - protein, 9 aa, Artificial Sequence
  Peptide Derived from Human Papillomavirus
EIPMDTFIV

SEQ ID NO: 2979 - protein, 11 aa, Artificial Sequence
  Peptide Derived from Human Papillomavirus
EIPMDTFIVST

SEQ ID NO: 2980 - protein, 9 aa, Artificial Sequence
  Peptide Derived from Human Papillomavirus
ELQTITPST

SEQ ID NO: 2981 - protein, 11 aa, Artificial Sequence
  Peptide Derived from Human Papillomavirus
ELQTITPSTYT

SEQ ID NO: 2982 - protein, 8 aa, Artificial Sequence
  Peptide Derived from Human Papillomavirus
ETGGHFTL

SEQ ID NO: 2983 - protein, 9 aa, Artificial Sequence
  Peptide Derived from Human Papillomavirus
ETSFIDAGA

SEQ ID NO: 2984 - protein, 11 aa, Artificial Sequence
  Peptide Derived from Human Papillomavirus
ETSFIDAGAPT

SEQ ID NO: 2985 - protein, 8 aa, Artificial Sequence
  Peptide Derived from Human Papillomavirus
FIDAGAPT

SEQ ID NO: 2986 - protein, 10 aa, Artificial Sequence
  Peptide Derived from Human Papillomavirus
FIDAGAPTSV

SEQ ID NO: 2987 - protein, 8 aa, Artificial Sequence
  Peptide Derived from Human Papillomavirus
FITDTSTT

SEQ ID NO: 2988 - protein, 10 aa, Artificial Sequence
  Peptide Derived from Human Papillomavirus
FITDTSTTPV

SEQ ID NO: 2989 - protein, 8 aa, Artificial Sequence
  Peptide Derived from Human Papillomavirus
FITTPTKL

SEQ ID NO: 2990 - protein, 9 aa, Artificial Sequence
  Peptide Derived from Human Papillomavirus
FITTPTKLI

SEQ ID NO: 2991 - protein, 10 aa, Artificial Sequence
  Peptide Derived from Human Papillomavirus
FITTPTKLIT

SEQ ID NO: 2992 - protein, 9 aa, Artificial Sequence
  Peptide Derived from Human Papillomavirus
FIVSTNPNT

SEQ ID NO: 2993 - protein, 10 aa, Artificial Sequence
  Peptide Derived from Human Papillomavirus
FIVSTNPNTV

SEQ ID NO: 2994 - protein, 11 aa, Artificial Sequence
  Peptide Derived from Human Papillomavirus
FIVSTNPNTVT

SEQ ID NO: 2995 - protein, 11 aa, Artificial Sequence
  Peptide Derived from Human Papillomavirus
FLDIVALHRPA

SEQ ID NO: 2996 - protein, 11 aa, Artificial Sequence
  Peptide Derived from Human Papillomavirus
FTDPSVLQPPT

SEQ ID NO: 2997 - protein, 8 aa, Artificial Sequence
  Peptide Derived from Human Papillomavirus
FTLSSSTI

SEQ ID NO: 2998 - protein, 10 aa, Artificial Sequence
  Peptide Derived from Human Papillomavirus
FTLSSSTIST

SEQ ID NO: 2999 - protein, 9 aa, Artificial Sequence
  Peptide Derived from Human Papillomavirus
GAPTSVPSI

SEQ ID NO: 3000 - protein, 8 aa, Artificial Sequence
  Peptide Derived from Human Papillomavirus
GAYNIPLV

SEQ ID NO: 3001 - protein, 8 aa, Artificial Sequence
  Peptide Derived from Human Papillomavirus
GIDVDNTL

SEQ ID NO: 3002 - protein, 8 aa, Artificial Sequence
  Peptide Derived from Human Papillomavirus
GIGTGSGT

SEQ ID NO: 3003 - protein, 10 aa, Artificial Sequence
  Peptide Derived from Human Papillomavirus
GLGIGTGSGT

SEQ ID NO: 3004 - protein, 11 aa, Artificial Sequence
  Peptide Derived from Human Papillomavirus
GLYDIYADDFI

SEQ ID NO: 3005 - protein, 10 aa, Artificial Sequence
  Peptide Derived from Human Papillomavirus
GLYSRTTQQV

SEQ ID NO: 3006 - protein, 8 aa, Artificial Sequence
  Peptide Derived from Human Papillomavirus
GTCPPDII

SEQ ID NO: 3007 - protein, 11 aa, Artificial Sequence
  Peptide Derived from Human Papillomavirus
GTCPPDIIPKV

SEQ ID NO: 3008 - protein, 9 aa, Artificial Sequence
  Peptide Derived from Human Papillomavirus
GTGGRTGYI

SEQ ID NO: 3009 - protein, 11 aa, Artificial Sequence
  Peptide Derived from Human Papillomavirus
GTGGRTGYIPL

SEQ ID NO: 3010 - protein, 10 aa, Artificial Sequence
  Peptide Derived from Human Papillomavirus
GTGSGTGGRT

SEQ ID NO: 3011 - protein, 8 aa, Artificial Sequence
  Peptide Derived from Human Papillomavirus
GTRPPTAT

SEQ ID NO: 3012 - protein, 10 aa, Artificial Sequence
  Peptide Derived from Human Papillomavirus
GTRPPTATDT

SEQ ID NO: 3013 - protein, 11 aa, Artificial Sequence
  Peptide Derived from Human Papillomavirus
GTRPPTATDTL

SEQ ID NO: 3014 - protein, 9 aa, Artificial Sequence
  Peptide Derived from Human Papillomavirus
GVFFGGLGI

SEQ ID NO: 3015 - protein, 11 aa, Artificial Sequence
  Peptide Derived from Human Papillomavirus
GVFFGGLGIGT

SEQ ID NO: 3016 - protein, 8 aa, Artificial Sequence
  Peptide Derived from Human Papillomavirus
HAALPTSI

SEQ ID NO: 3017 - protein, 9 aa, Artificial Sequence
  Peptide Derived from Human Papillomavirus
IADAGDFYL

SEQ ID NO: 3018 - protein, 11 aa, Artificial Sequence
  Peptide Derived from Human Papillomavirus
IADQILQYGSM

SEQ ID NO: 3019 - protein, 8 aa, Artificial Sequence
  Peptide Derived from Human Papillomavirus
IAPDPDFL

SEQ ID NO: 3020 - protein, 10 aa, Artificial Sequence
  Peptide Derived from Human Papillomavirus
IAPDPDFLDI

SEQ ID NO: 3021 - protein, 11 aa, Artificial Sequence
  Peptide Derived from Human Papillomavirus
IAPDPDFLDIV

SEQ ID NO: 3022 - protein, 10 aa, Artificial Sequence
  Peptide Derived from Human Papillomavirus
IIADAGDFYL

SEQ ID NO: 3023 - protein, 9 aa, Artificial Sequence
  Peptide Derived from Human Papillomavirus
IIPKVEGKT

SEQ ID NO: 3024 - protein, 10 aa, Artificial Sequence
  Peptide Derived from Human Papillomavirus
IIPKVEGKTI

SEQ ID NO: 3025 - protein, 11 aa, Artificial Sequence
  Peptide Derived from Human Papillomavirus
IIPKVEGKTIA

SEQ ID NO: 3026 - protein, 8 aa, Artificial Sequence
  Peptide Derived from Human Papillomavirus
ILDINNTV

SEQ ID NO: 3027 - protein, 9 aa, Artificial Sequence
  Peptide Derived from Human Papillomavirus
ILDINNTVT

SEQ ID NO: 3028 - protein, 10 aa, Artificial Sequence
  Peptide Derived from Human Papillomavirus
ILDINNTVTT

SEQ ID NO: 3029 - protein, 11 aa, Artificial Sequence
  Peptide Derived from Human Papillomavirus
ILDINNTVTTV

SEQ ID NO: 3030 - protein, 9 aa, Artificial Sequence
  Peptide Derived from Human Papillomavirus
ILQYGSMGV

SEQ ID NO: 3031 - protein, 8 aa, Artificial Sequence
  Peptide Derived from Human Papillomavirus
ITDQAPSL

SEQ ID NO: 3032 - protein, 9 aa, Artificial Sequence
  Peptide Derived from Human Papillomavirus
ITDQAPSLI

SEQ ID NO: 3033 - protein, 11 aa, Artificial Sequence
  Peptide Derived from Human Papillomavirus
ITDQAPSLIPI

SEQ ID NO: 3034 - protein, 9 aa, Artificial Sequence
  Peptide Derived from Human Papillomavirus
ITDTSTTPV

SEQ ID NO: 3035 - protein, 8 aa, Artificial Sequence
  Peptide Derived from Human Papillomavirus
ITPSTYTT

SEQ ID NO: 3036 - protein, 9 aa, Artificial Sequence
  Peptide Derived from Human Papillomavirus
ITPSTYTTT

SEQ ID NO: 3037 - protein, 8 aa, Artificial Sequence
  Peptide Derived from Human Papillomavirus
ITTPTKLI

SEQ ID NO: 3038 - protein, 9 aa, Artificial Sequence
  Peptide Derived from Human Papillomavirus
ITTPTKLIT

SEQ ID NO: 3039 - protein, 8 aa, Artificial Sequence
  Peptide Derived from Human Papillomavirus
ITTSTDTT

SEQ ID NO: 3040 - protein, 10 aa, Artificial Sequence
  Peptide Derived from Human Papillomavirus
ITTSTDTTPA

SEQ ID NO: 3041 - protein, 11 aa, Artificial Sequence
  Peptide Derived from Human Papillomavirus
ITTSTDTTPAI

SEQ ID NO: 3042 - protein, 11 aa, Artificial Sequence
  Peptide Derived from Human Papillomavirus
ITYDNPAYEGI

SEQ ID NO: 3043 - protein, 8 aa, Artificial Sequence
  Peptide Derived from Human Papillomavirus
IVALHRPA

SEQ ID NO: 3044 - protein, 9 aa, Artificial Sequence
  Peptide Derived from Human Papillomavirus
IVALHRPAL

SEQ ID NO: 3045 - protein, 10 aa, Artificial Sequence
  Peptide Derived from Human Papillomavirus
IVALHRPALT

SEQ ID NO: 3046 - protein, 9 aa, Artificial Sequence
  Peptide Derived from Human Papillomavirus
IVPGSPQYT

SEQ ID NO: 3047 - protein, 10 aa, Artificial Sequence
  Peptide Derived from Human Papillomavirus
IVPGSPQYTI

SEQ ID NO: 3048 - protein, 11 aa, Artificial Sequence
  Peptide Derived from Human Papillomavirus
IVPGSPQYTII

SEQ ID NO: 3049 - protein, 8 aa, Artificial Sequence
  Peptide Derived from Human Papillomavirus
IVSLVEET

SEQ ID NO: 3050 - protein, 11 aa, Artificial Sequence
  Peptide Derived from Human Papillomavirus
IVSLVEETSFI

SEQ ID NO: 3051 - protein, 8 aa, Artificial Sequence
  Peptide Derived from Human Papillomavirus
IVSTNPNT

SEQ ID NO: 3052 - protein, 9 aa, Artificial Sequence
  Peptide Derived from Human Papillomavirus
IVSTNPNTV

SEQ ID NO: 3053 - protein, 10 aa, Artificial Sequence
  Peptide Derived from Human Papillomavirus
IVSTNPNTVT

SEQ ID NO: 3054 - protein, 9 aa, Artificial Sequence
  Peptide Derived from Human Papillomavirus
KLITYDNPA

SEQ ID NO: 3055 - protein, 10 aa, Artificial Sequence
  Peptide Derived from Human Papillomavirus
KQAGTCPPDI

SEQ ID NO: 3056 - protein, 11 aa, Artificial Sequence
  Peptide Derived from Human Papillomavirus
KQAGTCPPDII

SEQ ID NO: 3057 - protein, 8 aa, Artificial Sequence
  Peptide Derived from Human Papillomavirus
KTCKQAGT

SEQ ID NO: 3058 - protein, 8 aa, Artificial Sequence
  Peptide Derived from Human Papillomavirus
KTIADQIL

SEQ ID NO: 3059 - protein, 8 aa, Artificial Sequence
  Peptide Derived from Human Papillomavirus
KVEGKTIA

SEQ ID NO: 3060 - protein, 11 aa, Artificial Sequence
  Peptide Derived from Human Papillomavirus
KVEGKTIADQI

SEQ ID NO: 3061 - protein, 10 aa, Artificial Sequence
  Peptide Derived from Human Papillomavirus
KVHYYYDFST

SEQ ID NO: 3062 - protein, 11 aa, Artificial Sequence
  Peptide Derived from Human Papillomavirus
KVHYYYDFSTI

SEQ ID NO: 3063 - protein, 8 aa, Artificial Sequence
  Peptide Derived from Human Papillomavirus
KVVDPAFI

SEQ ID NO: 3064 - protein, 9 aa, Artificial Sequence
  Peptide Derived from Human Papillomavirus
KVVDPAFIT

SEQ ID NO: 3065 - protein, 10 aa, Artificial Sequence
  Peptide Derived from Human Papillomavirus
KVVDPAFITT

SEQ ID NO: 3066 - protein, 8 aa, Artificial Sequence
  Peptide Derived from Human Papillomavirus
LAPVRPPL

SEQ ID NO: 3067 - protein, 9 aa, Artificial Sequence
  Peptide Derived from Human Papillomavirus
LAPVRPPLT

SEQ ID NO: 3068 - protein, 10 aa, Artificial Sequence
  Peptide Derived from Human Papillomavirus
LAPVRPPLTV

SEQ ID NO: 3069 - protein, 8 aa, Artificial Sequence
  Peptide Derived from Human Papillomavirus
LITYDNPA

SEQ ID NO: 3070 - protein, 9 aa, Artificial Sequence
  Peptide Derived from Human Papillomavirus
LQPPTPAET

SEQ ID NO: 3071 - protein, 8 aa, Artificial Sequence
  Peptide Derived from Human Papillomavirus
LQTITPST

SEQ ID NO: 3072 - protein, 10 aa, Artificial Sequence
  Peptide Derived from Human Papillomavirus
LQTITPSTYT

SEQ ID NO: 3073 - protein, 11 aa, Artificial Sequence
  Peptide Derived from Human Papillomavirus
LQTITPSTYTT

SEQ ID NO: 3074 - protein, 8 aa, Artificial Sequence
  Peptide Derived from Human Papillomavirus
LQYGSMGV

SEQ ID NO: 3075 - protein, 8 aa, Artificial Sequence
  Peptide Derived from Human Papillomavirus
LTSRRTGI

SEQ ID NO: 3076 - protein, 8 aa, Artificial Sequence
  Peptide Derived from Human Papillomavirus
LVEETSFI

SEQ ID NO: 3077 - protein, 10 aa, Artificial Sequence
  Peptide Derived from Human Papillomavirus
LVEETSFIDA

SEQ ID NO: 3078 - protein, 9 aa, Artificial Sequence
  Peptide Derived from Human Papillomavirus
LVSGPDIPI

SEQ ID NO: 3079 - protein, 11 aa, Artificial Sequence
  Peptide Derived from Human Papillomavirus
LVSGPDIPINI

SEQ ID NO: 3080 - protein, 9 aa, Artificial Sequence
  Peptide Derived from Human Papillomavirus
MLRKRRKRL

SEQ ID NO: 3081 - protein, 9 aa, Artificial Sequence
  Peptide Derived from Human Papillomavirus
NIAPDPDFL

SEQ ID NO: 3082 - protein, 11 aa, Artificial Sequence
  Peptide Derived from Human Papillomavirus
NIAPDPDFLDI

SEQ ID NO: 3083 - protein, 10 aa, Artificial Sequence
  Peptide Derived from Human Papillomavirus
NIPLVSGPDI

SEQ ID NO: 3084 - protein, 9 aa, Artificial Sequence
  Peptide Derived from Human Papillomavirus
NITDQAPSL

SEQ ID NO: 3085 - protein, 10 aa, Artificial Sequence
  Peptide Derived from Human Papillomavirus
NITDQAPSLI

SEQ ID NO: 3086 - protein, 9 aa, Artificial Sequence
  Peptide Derived from Human Papillomavirus
NTTIPFGGA

SEQ ID NO: 3087 - protein, 9 aa, Artificial Sequence
  Peptide Derived from Human Papillomavirus
NTVTSSTPI

SEQ ID NO: 3088 - protein, 8 aa, Artificial Sequence
  Peptide Derived from Human Papillomavirus
NTVTTVTT

SEQ ID NO: 3089 - protein, 9 aa, Artificial Sequence
  Peptide Derived from Human Papillomavirus
PAETGGHFT

SEQ ID NO: 3090 - protein, 10 aa, Artificial Sequence
  Peptide Derived from Human Papillomavirus
PAETGGHFTL

SEQ ID NO: 3091 - protein, 8 aa, Artificial Sequence
  Peptide Derived from Human Papillomavirus
PAFITTPT

SEQ ID NO: 3092 - protein, 10 aa, Artificial Sequence
  Peptide Derived from Human Papillomavirus
PAFITTPTKL

SEQ ID NO: 3093 - protein, 11 aa, Artificial Sequence
  Peptide Derived from Human Papillomavirus
PAFITTPTKLI

SEQ ID NO: 3094 - protein, 9 aa, Artificial Sequence
  Peptide Derived from Human Papillomavirus
PAILDINNT

SEQ ID NO: 3095 - protein, 10 aa, Artificial Sequence
  Peptide Derived from Human Papillomavirus
PAILDINNTV

SEQ ID NO: 3096 - protein, 11 aa, Artificial Sequence
  Peptide Derived from Human Papillomavirus
PAILDINNTVT

SEQ ID NO: 3097 - protein, 8 aa, Artificial Sequence
  Peptide Derived from Human Papillomavirus
PALTSRRT

SEQ ID NO: 3098 - protein, 10 aa, Artificial Sequence
  Peptide Derived from Human Papillomavirus
PALTSRRTGI

SEQ ID NO: 3099 - protein, 11 aa, Artificial Sequence
  Peptide Derived from Human Papillomavirus
PANTTIPFGGA

SEQ ID NO: 3100 - protein, 8 aa, Artificial Sequence
  Peptide Derived from Human Papillomavirus
PAYEGIDV

SEQ ID NO: 3101 - protein, 11 aa, Artificial Sequence
  Peptide Derived from Human Papillomavirus
PAYEGIDVDNT

SEQ ID NO: 3102 - protein, 8 aa, Artificial Sequence
  Peptide Derived from Human Papillomavirus
PINITDQA

SEQ ID NO: 3103 - protein, 11 aa, Artificial Sequence
  Peptide Derived from Human Papillomavirus
PINITDQAPSL

SEQ ID NO: 3104 - protein, 8 aa, Artificial Sequence
  Peptide Derived from Human Papillomavirus
PIPGSRPV

SEQ ID NO: 3105 - protein, 9 aa, Artificial Sequence
  Peptide Derived from Human Papillomavirus
PIPGSRPVA

SEQ ID NO: 3106 - protein, 11 aa, Artificial Sequence
  Peptide Derived from Human Papillomavirus
PIPGSRPVARL

SEQ ID NO: 3107 - protein, 10 aa, Artificial Sequence
  Peptide Derived from Human Papillomavirus
PIVPGSPQYT

SEQ ID NO: 3108 - protein, 11 aa, Artificial Sequence
  Peptide Derived from Human Papillomavirus
PIVPGSPQYTI

SEQ ID NO: 3109 - protein, 8 aa, Artificial Sequence
  Peptide Derived from Human Papillomavirus
PLGTRPPT

SEQ ID NO: 3110 - protein, 9 aa, Artificial Sequence
  Peptide Derived from Human Papillomavirus
PLGTRPPTA

SEQ ID NO: 3111 - protein, 10 aa, Artificial Sequence
  Peptide Derived from Human Papillomavirus
PLGTRPPTAT

SEQ ID NO: 3112 - protein, 8 aa, Artificial Sequence
  Peptide Derived from Human Papillomavirus
PLVSGPDI

SEQ ID NO: 3113 - protein, 10 aa, Artificial Sequence
  Peptide Derived from Human Papillomavirus
PLVSGPDIPI

SEQ ID NO: 3114 - protein, 9 aa, Artificial Sequence
  Peptide Derived from Human Papillomavirus
PMDTFIVST

SEQ ID NO: 3115 - protein, 9 aa, Artificial Sequence
  Peptide Derived from Human Papillomavirus
PQYTIIADA

SEQ ID NO: 3116 - protein, 8 aa, Artificial Sequence
  Peptide Derived from Human Papillomavirus
PTATDTLA

SEQ ID NO: 3117 - protein, 10 aa, Artificial Sequence
  Peptide Derived from Human Papillomavirus
PTATDTLAPV

SEQ ID NO: 3118 - protein, 8 aa, Artificial Sequence
  Peptide Derived from Human Papillomavirus
PTFTDPSV

SEQ ID NO: 3119 - protein, 9 aa, Artificial Sequence
  Peptide Derived from Human Papillomavirus
PTFTDPSVL

SEQ ID NO: 3120 - protein, 11 aa, Artificial Sequence
  Peptide Derived from Human Papillomavirus
PTKLITYDNPA

SEQ ID NO: 3121 - protein, 11 aa, Artificial Sequence
  Peptide Derived from Human Papillomavirus
PTPAETGGHFT

SEQ ID NO: 3122 - protein, 8 aa, Artificial Sequence
  Peptide Derived from Human Papillomavirus
PTSINNGL

SEQ ID NO: 3123 - protein, 11 aa, Artificial Sequence
  Peptide Derived from Human Papillomavirus
PTSINNGLYDI

SEQ ID NO: 3124 - protein, 11 aa, Artificial Sequence
  Peptide Derived from Human Papillomavirus
PTSVPSIPPDV

SEQ ID NO: 3125 - protein, 11 aa, Artificial Sequence
  Peptide Derived from Human Papillomavirus
PVARLGLYSRT

SEQ ID NO: 3126 - protein, 9 aa, Artificial Sequence
  Peptide Derived from Human Papillomavirus
PVGPSDPSI

SEQ ID NO: 3127 - protein, 10 aa, Artificial Sequence
  Peptide Derived from Human Papillomavirus
PVGPSDPSIV

SEQ ID NO: 3128 - protein, 8 aa, Artificial Sequence
  Peptide Derived from Human Papillomavirus
PVPSVPST

SEQ ID NO: 3129 - protein, 10 aa, Artificial Sequence
  Peptide Derived from Human Papillomavirus
PVPSVPSTSL

SEQ ID NO: 3130 - protein, 8 aa, Artificial Sequence
  Peptide Derived from Human Papillomavirus
PVRPPLTV

SEQ ID NO: 3131 - protein, 11 aa, Artificial Sequence
  Peptide Derived from Human Papillomavirus
PVRPPLTVDPV

SEQ ID NO: 3132 - protein, 9 aa, Artificial Sequence
  Peptide Derived from Human Papillomavirus
QAGTCPPDI

SEQ ID NO: 3133 - protein, 10 aa, Artificial Sequence
  Peptide Derived from Human Papillomavirus
QAGTCPPDII

SEQ ID NO: 3134 - protein, 8 aa, Artificial Sequence
  Peptide Derived from Human Papillomavirus
QAPSLIPI

SEQ ID NO: 3135 - protein, 9 aa, Artificial Sequence
  Peptide Derived from Human Papillomavirus
QAPSLIPIV

SEQ ID NO: 3136 - protein, 8 aa, Artificial Sequence
  Peptide Derived from Human Papillomavirus
QILQYGSM

SEQ ID NO: 3137 - protein, 10 aa, Artificial Sequence
  Peptide Derived from Human Papillomavirus
QILQYGSMGV

SEQ ID NO: 3138 - protein, 9 aa, Artificial Sequence
  Peptide Derived from Human Papillomavirus
QLYKTCKQA

SEQ ID NO: 3139 - protein, 11 aa, Artificial Sequence
  Peptide Derived from Human Papillomavirus
QLYKTCKQAGT

SEQ ID NO: 3140 - protein, 9 aa, Artificial Sequence
  Peptide Derived from Human Papillomavirus
QQVKVVDPA

SEQ ID NO: 3141 - protein, 11 aa, Artificial Sequence
  Peptide Derived from Human Papillomavirus
QQVKVVDPAFI

SEQ ID NO: 3142 - protein, 9 aa, Artificial Sequence
  Peptide Derived from Human Papillomavirus
QTITPSTYT

SEQ ID NO: 3143 - protein, 10 aa, Artificial Sequence
  Peptide Derived from Human Papillomavirus
QTITPSTYTT

SEQ ID NO: 3144 - protein, 11 aa, Artificial Sequence
  Peptide Derived from Human Papillomavirus
QTITPSTYTTT

SEQ ID NO: 3145 - protein, 11 aa, Artificial Sequence
  Peptide Derived from Human Papillomavirus
QTLRTRSGKSI

SEQ ID NO: 3146 - protein, 8 aa, Artificial Sequence
  Peptide Derived from Human Papillomavirus
QVKVVDPA

SEQ ID NO: 3147 - protein, 10 aa, Artificial Sequence
  Peptide Derived from Human Papillomavirus
QVKVVDPAFI

SEQ ID NO: 3148 - protein, 11 aa, Artificial Sequence
  Peptide Derived from Human Papillomavirus
QVKVVDPAFIT

SEQ ID NO: 3149 - protein, 10 aa, Artificial Sequence
  Peptide Derived from Human Papillomavirus
RASATQLYKT

SEQ ID NO: 3150 - protein, 8 aa, Artificial Sequence
  Peptide Derived from Human Papillomavirus
RIGNKQTL

SEQ ID NO: 3151 - protein, 10 aa, Artificial Sequence
  Peptide Derived from Human Papillomavirus
RIGNKQTLRT

SEQ ID NO: 3152 - protein, 8 aa, Artificial Sequence
  Peptide Derived from Human Papillomavirus
RLGLYSRT

SEQ ID NO: 3153 - protein, 9 aa, Artificial Sequence
  Peptide Derived from Human Papillomavirus
RLGLYSRTT

SEQ ID NO: 3154 - protein, 9 aa, Artificial Sequence
  Peptide Derived from Human Papillomavirus
RLPYFFSDV

SEQ ID NO: 3155 - protein, 11 aa, Artificial Sequence
  Peptide Derived from Human Papillomavirus
RLPYFFSDVSL

SEQ ID NO: 3156 - protein, 9 aa, Artificial Sequence
  Peptide Derived from Human Papillomavirus
RTGIRYSRI

SEQ ID NO: 3157 - protein, 9 aa, Artificial Sequence
  Peptide Derived from Human Papillomavirus
RTGYIPLGT

SEQ ID NO: 3158 - protein, 8 aa, Artificial Sequence
  Peptide Derived from Human Papillomavirus
RTKRASAT

SEQ ID NO: 3159 - protein, 10 aa, Artificial Sequence
  Peptide Derived from Human Papillomavirus
RTKRASATQL

SEQ ID NO: 3160 - protein, 8 aa, Artificial Sequence
  Peptide Derived from Human Papillomavirus
RTRSGKSI

SEQ ID NO: 3161 - protein, 10 aa, Artificial Sequence
  Peptide Derived from Human Papillomavirus
RTRSGKSIGA

SEQ ID NO: 3162 - protein, 8 aa, Artificial Sequence
  Peptide Derived from Human Papillomavirus
RTTQQVKV

SEQ ID NO: 3163 - protein, 9 aa, Artificial Sequence
  Peptide Derived from Human Papillomavirus
RTTQQVKVV

SEQ ID NO: 3164 - protein, 9 aa, Artificial Sequence
  Peptide Derived from Human Papillomavirus
SAEEIELQT

SEQ ID NO: 3165 - protein, 10 aa, Artificial Sequence
  Peptide Derived from Human Papillomavirus
SAEEIELQTI

SEQ ID NO: 3166 - protein, 11 aa, Artificial Sequence
  Peptide Derived from Human Papillomavirus
SAEEIELQTIT

SEQ ID NO: 3167 - protein, 8 aa, Artificial Sequence
  Peptide Derived from Human Papillomavirus
SAKRTKRA

SEQ ID NO: 3168 - protein, 10 aa, Artificial Sequence
  Peptide Derived from Human Papillomavirus
SAKRTKRASA

SEQ ID NO: 3169 - protein, 11 aa, Artificial Sequence
  Peptide Derived from Human Papillomavirus
SAKRTKRASAT

SEQ ID NO: 3170 - protein, 8 aa, Artificial Sequence
  Peptide Derived from Human Papillomavirus
SATQLYKT

SEQ ID NO: 3171 - protein, 11 aa, Artificial Sequence
  Peptide Derived from Human Papillomavirus
SINIAPDPDFL

SEQ ID NO: 3172 - protein, 9 aa, Artificial Sequence
  Peptide Derived from Human Papillomavirus
SINNGLYDI

SEQ ID NO: 3173 - protein, 11 aa, Artificial Sequence
  Peptide Derived from Human Papillomavirus
SINNGLYDIYA

SEQ ID NO: 3174 - protein, 11 aa, Artificial Sequence
  Peptide Derived from Human Papillomavirus
SIPPDVSGFSI

SEQ ID NO: 3175 - protein, 8 aa, Artificial Sequence
  Peptide Derived from Human Papillomavirus
SITTSTDT

SEQ ID NO: 3176 - protein, 9 aa, Artificial Sequence
  Peptide Derived from Human Papillomavirus
SITTSTDTT

SEQ ID NO: 3177 - protein, 11 aa, Artificial Sequence
  Peptide Derived from Human Papillomavirus
SITTSTDTTPA

SEQ ID NO: 3178 - protein, 9 aa, Artificial Sequence
  Peptide Derived from Human Papillomavirus
SIVSLVEET

SEQ ID NO: 3179 - protein, 8 aa, Artificial Sequence
  Peptide Derived from Human Papillomavirus
SLSGYIPA

SEQ ID NO: 3180 - protein, 10 aa, Artificial Sequence
  Peptide Derived from Human Papillomavirus
SLSGYIPANT

SEQ ID NO: 3181 - protein, 11 aa, Artificial Sequence
  Peptide Derived from Human Papillomavirus
SLSGYIPANTT

SEQ ID NO: 3182 - protein, 9 aa, Artificial Sequence
  Peptide Derived from Human Papillomavirus
SLVEETSFI

SEQ ID NO: 3183 - protein, 11 aa, Artificial Sequence
  Peptide Derived from Human Papillomavirus
SLVEETSFIDA

SEQ ID NO: 3184 - protein, 9 aa, Artificial Sequence
  Peptide Derived from Human Papillomavirus
SMGVFFGGL

SEQ ID NO: 3185 - protein, 11 aa, Artificial Sequence
  Peptide Derived from Human Papillomavirus
SMGVFFGGLGI

SEQ ID NO: 3186 - protein, 8 aa, Artificial Sequence
  Peptide Derived from Human Papillomavirus
STDTTPAI

SEQ ID NO: 3187 - protein, 9 aa, Artificial Sequence
  Peptide Derived from Human Papillomavirus
STDTTPAIL

SEQ ID NO: 3188 - protein, 11 aa, Artificial Sequence
  Peptide Derived from Human Papillomavirus
STDTTPAILDI

SEQ ID NO: 3189 - protein, 8 aa, Artificial Sequence
  Peptide Derived from Human Papillomavirus
STHNYEEI

SEQ ID NO: 3190 - protein, 10 aa, Artificial Sequence
  Peptide Derived from Human Papillomavirus
STHNYEEIPM

SEQ ID NO: 3191 - protein, 9 aa, Artificial Sequence
  Peptide Derived from Human Papillomavirus
STIDSAEEI

SEQ ID NO: 3192 - protein, 11 aa, Artificial Sequence
  Peptide Derived from Human Papillomavirus
STIDSAEEIEL

SEQ ID NO: 3193 - protein, 11 aa, Artificial Sequence
  Peptide Derived from Human Papillomavirus
STISTHNYEEI

SEQ ID NO: 3194 - protein, 8 aa, Artificial Sequence
  Peptide Derived from Human Papillomavirus
STNPNTVT

SEQ ID NO: 3195 - protein, 11 aa, Artificial Sequence
  Peptide Derived from Human Papillomavirus
STNPNTVTSST

SEQ ID NO: 3196 - protein, 10 aa, Artificial Sequence
  Peptide Derived from Human Papillomavirus
STPIPGSRPV

SEQ ID NO: 3197 - protein, 11 aa, Artificial Sequence
  Peptide Derived from Human Papillomavirus
STPIPGSRPVA

SEQ ID NO: 3198 - protein, 8 aa, Artificial Sequence
  Peptide Derived from Human Papillomavirus
STSLSGYI

SEQ ID NO: 3199 - protein, 10 aa, Artificial Sequence
  Peptide Derived from Human Papillomavirus
STSLSGYIPA

SEQ ID NO: 3200 - protein, 8 aa, Artificial Sequence
  Peptide Derived from Human Papillomavirus
STTPVPSV

SEQ ID NO: 3201 - protein, 11 aa, Artificial Sequence
  Peptide Derived from Human Papillomavirus
STTPVPSVPST

SEQ ID NO: 3202 - protein, 9 aa, Artificial Sequence
  Peptide Derived from Human Papillomavirus
STYTTTSHA

SEQ ID NO: 3203 - protein, 10 aa, Artificial Sequence
  Peptide Derived from Human Papillomavirus
STYTTTSHAA

SEQ ID NO: 3204 - protein, 11 aa, Artificial Sequence
  Peptide Derived from Human Papillomavirus
STYTTTSHAAL

SEQ ID NO: 3205 - protein, 9 aa, Artificial Sequence
  Peptide Derived from Human Papillomavirus
SVLQPPTPA

SEQ ID NO: 3206 - protein, 11 aa, Artificial Sequence
  Peptide Derived from Human Papillomavirus
SVLQPPTPAET

SEQ ID NO: 3207 - protein, 9 aa, Artificial Sequence
  Peptide Derived from Human Papillomavirus
SVPSIPPDV

SEQ ID NO: 3208 - protein, 11 aa, Artificial Sequence
  Peptide Derived from Human Papillomavirus
SVPSTSLSGYI

SEQ ID NO: 3209 - protein, 9 aa, Artificial Sequence
  Peptide Derived from Human Papillomavirus
TATDTLAPV

SEQ ID NO: 3210 - protein, 8 aa, Artificial Sequence
  Peptide Derived from Human Papillomavirus
TIDSAEEI

SEQ ID NO: 3211 - protein, 10 aa, Artificial Sequence
  Peptide Derived from Human Papillomavirus
TIDSAEEIEL

SEQ ID NO: 3212 - protein, 11 aa, Artificial Sequence
  Peptide Derived from Human Papillomavirus
TIIADAGDFYL

SEQ ID NO: 3213 - protein, 10 aa, Artificial Sequence
  Peptide Derived from Human Papillomavirus
TIPFGGAYNI

SEQ ID NO: 3214 - protein, 10 aa, Artificial Sequence
  Peptide Derived from Human Papillomavirus
TISTHNYEEI

SEQ ID NO: 3215 - protein, 8 aa, Artificial Sequence
  Peptide Derived from Human Papillomavirus
TITPSTYT

SEQ ID NO: 3216 - protein, 9 aa, Artificial Sequence
  Peptide Derived from Human Papillomavirus
TITPSTYTT

SEQ ID NO: 3217 - protein, 10 aa, Artificial Sequence
  Peptide Derived from Human Papillomavirus
TITPSTYTTT

SEQ ID NO: 3218 - protein, 9 aa, Artificial Sequence
  Peptide Derived from Human Papillomavirus
TLAPVRPPL

SEQ ID NO: 3219 - protein, 10 aa, Artificial Sequence
  Peptide Derived from Human Papillomavirus
TLAPVRPPLT

SEQ ID NO: 3220 - protein, 11 aa, Artificial Sequence
  Peptide Derived from Human Papillomavirus
TLAPVRPPLTV

SEQ ID NO: 3221 - protein, 10 aa, Artificial Sequence
  Peptide Derived from Human Papillomavirus
TLRTRSGKSI

SEQ ID NO: 3222 - protein, 9 aa, Artificial Sequence
  Peptide Derived from Human Papillomavirus
TLSSSTIST

SEQ ID NO: 3223 - protein, 11 aa, Artificial Sequence
  Peptide Derived from Human Papillomavirus
TLYFSSNDNSI

SEQ ID NO: 3224 - protein, 10 aa, Artificial Sequence
  Peptide Derived from Human Papillomavirus
TQLYKTCKQA

SEQ ID NO: 3225 - protein, 10 aa, Artificial Sequence
  Peptide Derived from Human Papillomavirus
TQQVKVVDPA

SEQ ID NO: 3226 - protein, 9 aa, Artificial Sequence
  Peptide Derived from Human Papillomavirus
TTHNNPTFT

SEQ ID NO: 3227 - protein, 8 aa, Artificial Sequence
  Peptide Derived from Human Papillomavirus
TTIPFGGA

SEQ ID NO: 3228 - protein, 11 aa, Artificial Sequence
  Peptide Derived from Human Papillomavirus
TTIPFGGAYNI

SEQ ID NO: 3229 - protein, 8 aa, Artificial Sequence
  Peptide Derived from Human Papillomavirus
TTPAILDI

SEQ ID NO: 3230 - protein, 11 aa, Artificial Sequence
  Peptide Derived from Human Papillomavirus
TTPAILDINNT

SEQ ID NO: 3231 - protein, 8 aa, Artificial Sequence
  Peptide Derived from Human Papillomavirus
TTPTKLIT

SEQ ID NO: 3232 - protein, 10 aa, Artificial Sequence
  Peptide Derived from Human Papillomavirus
TTPVPSVPST

SEQ ID NO: 3233 - protein, 8 aa, Artificial Sequence
  Peptide Derived from Human Papillomavirus
TTQQVKVV

SEQ ID NO: 3234 - protein, 11 aa, Artificial Sequence
  Peptide Derived from Human Papillomavirus
TTQQVKVVDPA

SEQ ID NO: 3235 - protein, 9 aa, Artificial Sequence
  Peptide Derived from Human Papillomavirus
TTSHAALPT

SEQ ID NO: 3236 - protein, 11 aa, Artificial Sequence
  Peptide Derived from Human Papillomavirus
TTSHAALPTSI

SEQ ID NO: 3237 - protein, 9 aa, Artificial Sequence
  Peptide Derived from Human Papillomavirus
TTSTDTTPA

SEQ ID NO: 3238 - protein, 10 aa, Artificial Sequence
  Peptide Derived from Human Papillomavirus
TTSTDTTPAI

SEQ ID NO: 3239 - protein, 11 aa, Artificial Sequence
  Peptide Derived from Human Papillomavirus
TTSTDTTPAIL

SEQ ID NO: 3240 - protein, 8 aa, Artificial Sequence
  Peptide Derived from Human Papillomavirus
TTTSHAAL

SEQ ID NO: 3241 - protein, 10 aa, Artificial Sequence
  Peptide Derived from Human Papillomavirus
TTTSHAALPT

SEQ ID NO: 3242 - protein, 10 aa, Artificial Sequence
  Peptide Derived from Human Papillomavirus
TTVTTHNNPT

SEQ ID NO: 3243 - protein, 8 aa, Artificial Sequence
  Peptide Derived from Human Papillomavirus
TVTSSTPI

SEQ ID NO: 3244 - protein, 9 aa, Artificial Sequence
  Peptide Derived from Human Papillomavirus
TVTTHNNPT

SEQ ID NO: 3245 - protein, 11 aa, Artificial Sequence
  Peptide Derived from Human Papillomavirus
TVTTHNNPTFT

SEQ ID NO: 3246 - protein, 8 aa, Artificial Sequence
  Peptide Derived from Human Papillomavirus
VALHRPAL

SEQ ID NO: 3247 - protein, 9 aa, Artificial Sequence
  Peptide Derived from Human Papillomavirus
VALHRPALT

SEQ ID NO: 3248 - protein, 10 aa, Artificial Sequence
  Peptide Derived from Human Papillomavirus
VARLGLYSRT

SEQ ID NO: 3249 - protein, 11 aa, Artificial Sequence
  Peptide Derived from Human Papillomavirus
VARLGLYSRTT

SEQ ID NO: 3250 - protein, 8 aa, Artificial Sequence
  Peptide Derived from Human Papillomavirus
VLQPPTPA

SEQ ID NO: 3251 - protein, 10 aa, Artificial Sequence
  Peptide Derived from Human Papillomavirus
VLQPPTPAET

SEQ ID NO: 3252 - protein, 8 aa, Artificial Sequence
  Peptide Derived from Human Papillomavirus
VTTHNNPT

SEQ ID NO: 3253 - protein, 10 aa, Artificial Sequence
  Peptide Derived from Human Papillomavirus
VTTHNNPTFT

SEQ ID NO: 3254 - protein, 11 aa, Artificial Sequence
  Peptide Derived from Human Papillomavirus
VTTVTTHNNPT

SEQ ID NO: 3255 - protein, 8 aa, Artificial Sequence
  Peptide Derived from Human Papillomavirus
VVDPAFIT

SEQ ID NO: 3256 - protein, 9 aa, Artificial Sequence
  Peptide Derived from Human Papillomavirus
VVDPAFITT

SEQ ID NO: 3257 - protein, 11 aa, Artificial Sequence
  Peptide Derived from Human Papillomavirus
VVDPAFITTPT

SEQ ID NO: 3258 - protein, 9 aa, Artificial Sequence
  Peptide Derived from Human Papillomavirus
YADDFITDT

SEQ ID NO: 3259 - protein, 11 aa, Artificial Sequence
  Peptide Derived from Human Papillomavirus
YADDFITDTST

SEQ ID NO: 3260 - protein, 8 aa, Artificial Sequence
  Peptide Derived from Human Papillomavirus
YIPANTTI

SEQ ID NO: 3261 - protein, 10 aa, Artificial Sequence
  Peptide Derived from Human Papillomavirus
YIPLGTRPPT

SEQ ID NO: 3262 - protein, 11 aa, Artificial Sequence
  Peptide Derived from Human Papillomavirus
YIPLGTRPPTA

SEQ ID NO: 3263 - protein, 8 aa, Artificial Sequence
  Peptide Derived from Human Papillomavirus
YLHPSYYM

SEQ ID NO: 3264 - protein, 9 aa, Artificial Sequence
  Peptide Derived from Human Papillomavirus
YLHPSYYML

SEQ ID NO: 3265 - protein, 10 aa, Artificial Sequence
  Peptide Derived from Human Papillomavirus
YMLRKRRKRL

SEQ ID NO: 3266 - protein, 8 aa, Artificial Sequence
  Peptide Derived from Human Papillomavirus
YTTTSHAA

SEQ ID NO: 3267 - protein, 9 aa, Artificial Sequence
  Peptide Derived from Human Papillomavirus
YTTTSHAAL

SEQ ID NO: 3268 - protein, 11 aa, Artificial Sequence
  Peptide Derived from Human Papillomavirus
YTTTSHAALPT

SEQ ID NO: 3269 - protein, 11 aa, Artificial Sequence
  Peptide Derived from Human Papillomavirus
AAAFLKSNCQA

SEQ ID NO: 3270 - protein, 10 aa, Artificial Sequence
  Peptide Derived from Human Papillomavirus
AAFLKSNCQA

SEQ ID NO: 3271 - protein, 8 aa, Artificial Sequence
  Peptide Derived from Human Papillomavirus
AALYWYRT

SEQ ID NO: 3272 - protein, 10 aa, Artificial Sequence
  Peptide Derived from Human Papillomavirus
AALYWYRTGI

SEQ ID NO: 3273 - protein, 8 aa, Artificial Sequence
  Peptide Derived from Human Papillomavirus
AIFGVNPT

SEQ ID NO: 3274 - protein, 9 aa, Artificial Sequence
  Peptide Derived from Human Papillomavirus
AIFGVNPTI

SEQ ID NO: 3275 - protein, 10 aa, Artificial Sequence
  Peptide Derived from Human Papillomavirus
AIFGVNPTIA

SEQ ID NO: 3276 - protein, 10 aa, Artificial Sequence
  Peptide Derived from Human Papillomavirus
AIVDKKTGDV

SEQ ID NO: 3277 - protein, 11 aa, Artificial Sequence
  Peptide Derived from Human Papillomavirus
AIVDKKTGDVI

SEQ ID NO: 3278 - protein, 9 aa, Artificial Sequence
  Peptide Derived from Human Papillomavirus
ALDGNPISI

SEQ ID NO: 3279 - protein, 8 aa, Artificial Sequence
  Peptide Derived from Human Papillomavirus
ALFHAQEV

SEQ ID NO: 3280 - protein, 9 aa, Artificial Sequence
  Peptide Derived from Human Papillomavirus
ALKSFLKGT

SEQ ID NO: 3281 - protein, 10 aa, Artificial Sequence
  Peptide Derived from Human Papillomavirus
ALLADSNSNA

SEQ ID NO: 3282 - protein, 11 aa, Artificial Sequence
  Peptide Derived from Human Papillomavirus
ALLADSNSNAA

SEQ ID NO: 3283 - protein, 9 aa, Artificial Sequence
  Peptide Derived from Human Papillomavirus
ALYWYRTGI

SEQ ID NO: 3284 - protein, 9 aa, Artificial Sequence
  Peptide Derived from Human Papillomavirus
AMLAVFKDT

SEQ ID NO: 3285 - protein, 8 aa, Artificial Sequence
  Peptide Derived from Human Papillomavirus
AMLDDATT

SEQ ID NO: 3286 - protein, 9 aa, Artificial Sequence
  Peptide Derived from Human Papillomavirus
AMLDDATTT

SEQ ID NO: 3287 - protein, 10 aa, Artificial Sequence
  Peptide Derived from Human Papillomavirus
AQALFHAQEV

SEQ ID NO: 3288 - protein, 8 aa, Artificial Sequence
  Peptide Derived from Human Papillomavirus
AQEVHNDA

SEQ ID NO: 3289 - protein, 10 aa, Artificial Sequence
  Peptide Derived from Human Papillomavirus
AQEVHNDAQV

SEQ ID NO: 3290 - protein, 11 aa, Artificial Sequence
  Peptide Derived from Human Papillomavirus
AQEVHNDAQVL

SEQ ID NO: 3291 - protein, 8 aa, Artificial Sequence
  Peptide Derived from Human Papillomavirus
AQKRQMNM

SEQ ID NO: 3292 - protein, 9 aa, Artificial Sequence
  Peptide Derived from Human Papillomavirus
AQLKDLLKV

SEQ ID NO: 3293 - protein, 8 aa, Artificial Sequence
  Peptide Derived from Human Papillomavirus
ATDTGSDM

SEQ ID NO: 3294 - protein, 9 aa, Artificial Sequence
  Peptide Derived from Human Papillomavirus
ATDTGSDMV

SEQ ID NO: 3295 - protein, 10 aa, Artificial Sequence
  Peptide Derived from Human Papillomavirus
ATMCKHYRRA

SEQ ID NO: 3296 - protein, 8 aa, Artificial Sequence
  Peptide Derived from Human Papillomavirus
ATQIQVTT

SEQ ID NO: 3297 - protein, 11 aa, Artificial Sequence
  Peptide Derived from Human Papillomavirus
ATTTCWTYFDT

SEQ ID NO: 3298 - protein, 9 aa, Artificial Sequence
  Peptide Derived from Human Papillomavirus
AVFKDTYGL

SEQ ID NO: 3299 - protein, 9 aa, Artificial Sequence
  Peptide Derived from Human Papillomavirus
AVISFVNST

SEQ ID NO: 3300 - protein, 11 aa, Artificial Sequence
  Peptide Derived from Human Papillomavirus
CATMCKHYRRA

SEQ ID NO: 3301 - protein, 8 aa, Artificial Sequence
  Peptide Derived from Human Papillomavirus
CLDCKWGV

SEQ ID NO: 3302 - protein, 9 aa, Artificial Sequence
  Peptide Derived from Human Papillomavirus
CLDCKWGVL

SEQ ID NO: 3303 - protein, 10 aa, Artificial Sequence
  Peptide Derived from Human Papillomavirus
CLDCKWGVLI

SEQ ID NO: 3304 - protein, 11 aa, Artificial Sequence
  Peptide Derived from Human Papillomavirus
CLDCKWGVLIL

SEQ ID NO: 3305 - protein, 8 aa, Artificial Sequence
  Peptide Derived from Human Papillomavirus
CLVFCGPA

SEQ ID NO: 3306 - protein, 10 aa, Artificial Sequence
  Peptide Derived from Human Papillomavirus
CLVFCGPANT

SEQ ID NO: 3307 - protein, 9 aa, Artificial Sequence
  Peptide Derived from Human Papillomavirus
CMLIQPPKL

SEQ ID NO: 3308 - protein, 10 aa, Artificial Sequence
  Peptide Derived from Human Papillomavirus
CQAKYLKDCA

SEQ ID NO: 3309 - protein, 11 aa, Artificial Sequence
  Peptide Derived from Human Papillomavirus
CQAKYLKDCAT

SEQ ID NO: 3310 - protein, 8 aa, Artificial Sequence
  Peptide Derived from Human Papillomavirus
CTDWVTAI

SEQ ID NO: 3311 - protein, 11 aa, Artificial Sequence
  Peptide Derived from Human Papillomavirus
CTDWVTAIFGV

SEQ ID NO: 3312 - protein, 9 aa, Artificial Sequence
  Peptide Derived from Human Papillomavirus
CTIAQLKDL

SEQ ID NO: 3313 - protein, 10 aa, Artificial Sequence
  Peptide Derived from Human Papillomavirus
CTIAQLKDLL

SEQ ID NO: 3314 - protein, 11 aa, Artificial Sequence
  Peptide Derived from Human Papillomavirus
DADTEGNPFGT

SEQ ID NO: 3315 - protein, 8 aa, Artificial Sequence
  Peptide Derived from Human Papillomavirus
DAQVLHVL

SEQ ID NO: 3316 - protein, 8 aa, Artificial Sequence
  Peptide Derived from Human Papillomavirus
DATTTCWT

SEQ ID NO: 3317 - protein, 9 aa, Artificial Sequence
  Peptide Derived from Human Papillomavirus
DLHEEEEDA

SEQ ID NO: 3318 - protein, 11 aa, Artificial Sequence
  Peptide Derived from Human Papillomavirus
DLHEEEEDADT

SEQ ID NO: 3319 - protein, 11 aa, Artificial Sequence
  Peptide Derived from Human Papillomavirus
DLLKVNNKQGA

SEQ ID NO: 3320 - protein, 9 aa, Artificial Sequence
  Peptide Derived from Human Papillomavirus
DLSEMVQWA

SEQ ID NO: 3321 - protein, 11 aa, Artificial Sequence
  Peptide Derived from Human Papillomavirus
DLVRNFKSDKT

SEQ ID NO: 3322 - protein, 8 aa, Artificial Sequence
  Peptide Derived from Human Papillomavirus
DMAFEYAL

SEQ ID NO: 3323 - protein, 9 aa, Artificial Sequence
  Peptide Derived from Human Papillomavirus
DMAFEYALL

SEQ ID NO: 3324 - protein, 10 aa, Artificial Sequence
  Peptide Derived from Human Papillomavirus
DMAFEYALLA

SEQ ID NO: 3325 - protein, 8 aa, Artificial Sequence
  Peptide Derived from Human Papillomavirus
DMVDFIDT

SEQ ID NO: 3326 - protein, 11 aa, Artificial Sequence
  Peptide Derived from Human Papillomavirus
DMVDFIDTQGT

SEQ ID NO: 3327 - protein, 9 aa, Artificial Sequence
  Peptide Derived from Human Papillomavirus
DTEGNPFGT

SEQ ID NO: 3328 - protein, 8 aa, Artificial Sequence
  Peptide Derived from Human Papillomavirus
DTELSPRL

SEQ ID NO: 3329 - protein, 11 aa, Artificial Sequence
  Peptide Derived from Human Papillomavirus
DTELSPRLQEI

SEQ ID NO: 3330 - protein, 10 aa, Artificial Sequence
  Peptide Derived from Human Papillomavirus
DTGSDMVDFI

SEQ ID NO: 3331 - protein, 10 aa, Artificial Sequence
  Peptide Derived from Human Papillomavirus
DTKVAMLDDA

SEQ ID NO: 3332 - protein, 11 aa, Artificial Sequence
  Peptide Derived from Human Papillomavirus
DTKVAMLDDAT

SEQ ID NO: 3333 - protein, 9 aa, Artificial Sequence
  Peptide Derived from Human Papillomavirus
DTPEWIQRL

SEQ ID NO: 3334 - protein, 10 aa, Artificial Sequence
  Peptide Derived from Human Papillomavirus
DTPEWIQRLT

SEQ ID NO: 3335 - protein, 11 aa, Artificial Sequence
  Peptide Derived from Human Papillomavirus
DTPEWIQRLTI

SEQ ID NO: 3336 - protein, 10 aa, Artificial Sequence
  Peptide Derived from Human Papillomavirus
DTQGTFCEQA

SEQ ID NO: 3337 - protein, 8 aa, Artificial Sequence
  Peptide Derived from Human Papillomavirus
DTYGLSFT

SEQ ID NO: 3338 - protein, 10 aa, Artificial Sequence
  Peptide Derived from Human Papillomavirus
DTYGLSFTDL

SEQ ID NO: 3339 - protein, 11 aa, Artificial Sequence
  Peptide Derived from Human Papillomavirus
DTYGLSFTDLV

SEQ ID NO: 3340 - protein, 8 aa, Artificial Sequence
  Peptide Derived from Human Papillomavirus
DTYMRNAL

SEQ ID NO: 3341 - protein, 11 aa, Artificial Sequence
  Peptide Derived from Human Papillomavirus
DVISDDEDENA

SEQ ID NO: 3342 - protein, 8 aa, Artificial Sequence
  Peptide Derived from Human Papillomavirus
EAIDNGGT

SEQ ID NO: 3343 - protein, 8 aa, Artificial Sequence
  Peptide Derived from Human Papillomavirus
EATQIQVT

SEQ ID NO: 3344 - protein, 9 aa, Artificial Sequence
  Peptide Derived from Human Papillomavirus
EATQIQVTT

SEQ ID NO: 3345 - protein, 11 aa, Artificial Sequence
  Peptide Derived from Human Papillomavirus
EISLNSGQKKA

SEQ ID NO: 3346 - protein, 8 aa, Artificial Sequence
  Peptide Derived from Human Papillomavirus
ELETAQAL

SEQ ID NO: 3347 - protein, 11 aa, Artificial Sequence
  Peptide Derived from Human Papillomavirus
ELETAQALFHA

SEQ ID NO: 3348 - protein, 9 aa, Artificial Sequence
  Peptide Derived from Human Papillomavirus
ELSPRLQEI

SEQ ID NO: 3349 - protein, 11 aa, Artificial Sequence
  Peptide Derived from Human Papillomavirus
ELSPRLQEISL

SEQ ID NO: 3350 - protein, 8 aa, Artificial Sequence
  Peptide Derived from Human Papillomavirus
ELTDESDM

SEQ ID NO: 3351 - protein, 9 aa, Artificial Sequence
  Peptide Derived from Human Papillomavirus
ELTDESDMA

SEQ ID NO: 3352 - protein, 11 aa, Artificial Sequence
  Peptide Derived from Human Papillomavirus
EMVQWAFDNEL

SEQ ID NO: 3353 - protein, 8 aa, Artificial Sequence
  Peptide Derived from Human Papillomavirus
EQAELETA

SEQ ID NO: 3354 - protein, 10 aa, Artificial Sequence
  Peptide Derived from Human Papillomavirus
EQAELETAQA

SEQ ID NO: 3355 - protein, 11 aa, Artificial Sequence
  Peptide Derived from Human Papillomavirus
EQAELETAQAL

SEQ ID NO: 3356 - protein, 9 aa, Artificial Sequence
  Peptide Derived from Human Papillomavirus
ETAQALFHA

SEQ ID NO: 3357 - protein, 11 aa, Artificial Sequence
  Peptide Derived from Human Papillomavirus
ETCMLIQPPKL

SEQ ID NO: 3358 - protein, 10 aa, Artificial Sequence
  Peptide Derived from Human Papillomavirus
EVDTELSPRL

SEQ ID NO: 3359 - protein, 9 aa, Artificial Sequence
  Peptide Derived from Human Papillomavirus
EVEATQIQV

SEQ ID NO: 3360 - protein, 10 aa, Artificial Sequence
  Peptide Derived from Human Papillomavirus
EVEATQIQVT

SEQ ID NO: 3361 - protein, 11 aa, Artificial Sequence
  Peptide Derived from Human Papillomavirus
EVEATQIQVTT

SEQ ID NO: 3362 - protein, 8 aa, Artificial Sequence
  Peptide Derived from Human Papillomavirus
EVHNDAQV

SEQ ID NO: 3363 - protein, 9 aa, Artificial Sequence
  Peptide Derived from Human Papillomavirus
EVHNDAQVL

SEQ ID NO: 3364 - protein, 11 aa, Artificial Sequence
  Peptide Derived from Human Papillomavirus
EVHNDAQVLHV

SEQ ID NO: 3365 - protein, 10 aa, Artificial Sequence
  Peptide Derived from Human Papillomavirus
EVMGDTPEWI

SEQ ID NO: 3366 - protein, 11 aa, Artificial Sequence
  Peptide Derived from Human Papillomavirus
FAGGSTENSPL

SEQ ID NO: 3367 - protein, 8 aa, Artificial Sequence
  Peptide Derived from Human Papillomavirus
FIHFIQGA

SEQ ID NO: 3368 - protein, 9 aa, Artificial Sequence
  Peptide Derived from Human Papillomavirus
FIHFIQGAV

SEQ ID NO: 3369 - protein, 10 aa, Artificial Sequence
  Peptide Derived from Human Papillomavirus
FIHFIQGAVI

SEQ ID NO: 3370 - protein, 10 aa, Artificial Sequence
  Peptide Derived from Human Papillomavirus
FILYAHIQCL

SEQ ID NO: 3371 - protein, 10 aa, Artificial Sequence
  Peptide Derived from Human Papillomavirus
FIQGAVISFV

SEQ ID NO: 3372 - protein, 8 aa, Artificial Sequence
  Peptide Derived from Human Papillomavirus
FITFLGAL

SEQ ID NO: 3373 - protein, 9 aa, Artificial Sequence
  Peptide Derived from Human Papillomavirus
FLGALKSFL

SEQ ID NO: 3374 - protein, 11 aa, Artificial Sequence
  Peptide Derived from Human Papillomavirus
FLKGTPKKNCL

SEQ ID NO: 3375 - protein, 8 aa, Artificial Sequence
  Peptide Derived from Human Papillomavirus
FLKSNCQA

SEQ ID NO: 3376 - protein, 11 aa, Artificial Sequence
  Peptide Derived from Human Papillomavirus
FLKSNCQAKYL

SEQ ID NO: 3377 - protein, 10 aa, Artificial Sequence
  Peptide Derived from Human Papillomavirus
FLRYQQIEFI

SEQ ID NO: 3378 - protein, 11 aa, Artificial Sequence
  Peptide Derived from Human Papillomavirus
FLRYQQIEFIT

SEQ ID NO: 3379 - protein, 10 aa, Artificial Sequence
  Peptide Derived from Human Papillomavirus
FVNSTSHFWL

SEQ ID NO: 3380 - protein, 10 aa, Artificial Sequence
  Peptide Derived from Human Papillomavirus
GALKSFLKGT

SEQ ID NO: 3381 - protein, 10 aa, Artificial Sequence
  Peptide Derived from Human Papillomavirus
GAMLAVFKDT

SEQ ID NO: 3382 - protein, 10 aa, Artificial Sequence
  Peptide Derived from Human Papillomavirus
GAVISFVNST

SEQ ID NO: 3383 - protein, 9 aa, Artificial Sequence
  Peptide Derived from Human Papillomavirus
GIDDSNFDL

SEQ ID NO: 3384 - protein, 8 aa, Artificial Sequence
  Peptide Derived from Human Papillomavirus
GISNISEV

SEQ ID NO: 3385 - protein, 9 aa, Artificial Sequence
  Peptide Derived from Human Papillomavirus
GISNISEVM

SEQ ID NO: 3386 - protein, 8 aa, Artificial Sequence
  Peptide Derived from Human Papillomavirus
GLSFTDLV

SEQ ID NO: 3387 - protein, 8 aa, Artificial Sequence
  Peptide Derived from Human Papillomavirus
GLSTLLHV

SEQ ID NO: 3388 - protein, 11 aa, Artificial Sequence
  Peptide Derived from Human Papillomavirus
GLSTLLHVPET

SEQ ID NO: 3389 - protein, 8 aa, Artificial Sequence
  Peptide Derived from Human Papillomavirus
GMSFIHFI

SEQ ID NO: 3390 - protein, 11 aa, Artificial Sequence
  Peptide Derived from Human Papillomavirus
GMSFIHFIQGA

SEQ ID NO: 3391 - protein, 9 aa, Artificial Sequence
  Peptide Derived from Human Papillomavirus
GQKKAKRRL

SEQ ID NO: 3392 - protein, 11 aa, Artificial Sequence
  Peptide Derived from Human Papillomavirus
GQKKAKRRLFT

SEQ ID NO: 3393 - protein, 9 aa, Artificial Sequence
  Peptide Derived from Human Papillomavirus
GTEGNNSSV

SEQ ID NO: 3394 - protein, 9 aa, Artificial Sequence
  Peptide Derived from Human Papillomavirus
GTFCEQAEL

SEQ ID NO: 3395 - protein, 11 aa, Artificial Sequence
  Peptide Derived from Human Papillomavirus
GTFCEQAELET

SEQ ID NO: 3396 - protein, 10 aa, Artificial Sequence
  Peptide Derived from Human Papillomavirus
GTGCNGWFYV

SEQ ID NO: 3397 - protein, 8 aa, Artificial Sequence
  Peptide Derived from Human Papillomavirus
GTPKKNCL

SEQ ID NO: 3398 - protein, 9 aa, Artificial Sequence
  Peptide Derived from Human Papillomavirus
GTPKKNCLV

SEQ ID NO: 3399 - protein, 8 aa, Artificial Sequence
  Peptide Derived from Human Papillomavirus
GTSDNSNI

SEQ ID NO: 3400 - protein, 11 aa, Artificial Sequence
  Peptide Derived from Human Papillomavirus
GTSDNSNIENV

SEQ ID NO: 3401 - protein, 8 aa, Artificial Sequence
  Peptide Derived from Human Papillomavirus
GVLILALL

SEQ ID NO: 3402 - protein, 9 aa, Artificial Sequence
  Peptide Derived from Human Papillomavirus
HAQEVHNDA

SEQ ID NO: 3403 - protein, 11 aa, Artificial Sequence
  Peptide Derived from Human Papillomavirus
HAQEVHNDAQV

SEQ ID NO: 3404 - protein, 11 aa, Artificial Sequence
  Peptide Derived from Human Papillomavirus
HIQCLDCKWGV

SEQ ID NO: 3405 - protein, 8 aa, Artificial Sequence
  Peptide Derived from Human Papillomavirus
HVLKRKFA

SEQ ID NO: 3406 - protein, 8 aa, Artificial Sequence
  Peptide Derived from Human Papillomavirus
HVPETCML

SEQ ID NO: 3407 - protein, 9 aa, Artificial Sequence
  Peptide Derived from Human Papillomavirus
HVPETCMLI

SEQ ID NO: 3408 - protein, 8 aa, Artificial Sequence
  Peptide Derived from Human Papillomavirus
IAEGFKTL

SEQ ID NO: 3409 - protein, 9 aa, Artificial Sequence
  Peptide Derived from Human Papillomavirus
IAEGFKTLI

SEQ ID NO: 3410 - protein, 8 aa, Artificial Sequence
  Peptide Derived from Human Papillomavirus
IAQLKDLL

SEQ ID NO: 3411 - protein, 10 aa, Artificial Sequence
  Peptide Derived from Human Papillomavirus
IAQLKDLLKV

SEQ ID NO: 3412 - protein, 10 aa, Artificial Sequence
  Peptide Derived from Human Papillomavirus
ILLTTNIHPA

SEQ ID NO: 3413 - protein, 9 aa, Artificial Sequence
  Peptide Derived from Human Papillomavirus
ILYAHIQCL

SEQ ID NO: 3414 - protein, 10 aa, Artificial Sequence
  Peptide Derived from Human Papillomavirus
IQCLDCKWGV

SEQ ID NO: 3415 - protein, 11 aa, Artificial Sequence
  Peptide Derived from Human Papillomavirus
IQCLDCKWGVL

SEQ ID NO: 3416 - protein, 9 aa, Artificial Sequence
  Peptide Derived from Human Papillomavirus
IQGAVISFV

SEQ ID NO: 3417 - protein, 8 aa, Artificial Sequence
  Peptide Derived from Human Papillomavirus
IQLKCPPI

SEQ ID NO: 3418 - protein, 9 aa, Artificial Sequence
  Peptide Derived from Human Papillomavirus
IQLKCPPIL

SEQ ID NO: 3419 - protein, 10 aa, Artificial Sequence
  Peptide Derived from Human Papillomavirus
IQLKCPPILL

SEQ ID NO: 3420 - protein, 11 aa, Artificial Sequence
  Peptide Derived from Human Papillomavirus
IQLKCPPILLT

SEQ ID NO: 3421 - protein, 8 aa, Artificial Sequence
  Peptide Derived from Human Papillomavirus
IQPFILYA

SEQ ID NO: 3422 - protein, 10 aa, Artificial Sequence
  Peptide Derived from Human Papillomavirus
IQPFILYAHI

SEQ ID NO: 3423 - protein, 10 aa, Artificial Sequence
  Peptide Derived from Human Papillomavirus
IQPPKLRSSV

SEQ ID NO: 3424 - protein, 11 aa, Artificial Sequence
  Peptide Derived from Human Papillomavirus
IQPPKLRSSVA

SEQ ID NO: 3425 - protein, 11 aa, Artificial Sequence
  Peptide Derived from Human Papillomavirus
IQRLTIIQHGI

SEQ ID NO: 3426 - protein, 11 aa, Artificial Sequence
  Peptide Derived from Human Papillomavirus
ITFLGALKSFL

SEQ ID NO: 3427 - protein, 9 aa, Artificial Sequence
  Peptide Derived from Human Papillomavirus
ITVFEFPNA

SEQ ID NO: 3428 - protein, 9 aa, Artificial Sequence
  Peptide Derived from Human Papillomavirus
IVDKKTGDV

SEQ ID NO: 3429 - protein, 10 aa, Artificial Sequence
  Peptide Derived from Human Papillomavirus
IVDKKTGDVI

SEQ ID NO: 3430 - protein, 10 aa, Artificial Sequence
  Peptide Derived from Human Papillomavirus
IVQFLRYQQI

SEQ ID NO: 3431 - protein, 8 aa, Artificial Sequence
  Peptide Derived from Human Papillomavirus
KAKRRLFT

SEQ ID NO: 3432 - protein, 9 aa, Artificial Sequence
  Peptide Derived from Human Papillomavirus
KAKRRLFTI

SEQ ID NO: 3433 - protein, 11 aa, Artificial Sequence
  Peptide Derived from Human Papillomavirus
KIDEGGDWRPI

SEQ ID NO: 3434 - protein, 11 aa, Artificial Sequence
  Peptide Derived from Human Papillomavirus
KLRAGQNHRPL

SEQ ID NO: 3435 - protein, 8 aa, Artificial Sequence
  Peptide Derived from Human Papillomavirus
KLRSSVAA

SEQ ID NO: 3436 - protein, 9 aa, Artificial Sequence
  Peptide Derived from Human Papillomavirus
KLRSSVAAL

SEQ ID NO: 3437 - protein, 8 aa, Artificial Sequence
  Peptide Derived from Human Papillomavirus
KQGAMLAV

SEQ ID NO: 3438 - protein, 8 aa, Artificial Sequence
  Peptide Derived from Human Papillomavirus
KTLIQPFI

SEQ ID NO: 3439 - protein, 9 aa, Artificial Sequence
  Peptide Derived from Human Papillomavirus
KTLIQPFIL

SEQ ID NO: 3440 - protein, 11 aa, Artificial Sequence
  Peptide Derived from Human Papillomavirus
KTLIQPFILYA

SEQ ID NO: 3441 - protein, 8 aa, Artificial Sequence
  Peptide Derived from Human Papillomavirus
KTTCTDWV

SEQ ID NO: 3442 - protein, 9 aa, Artificial Sequence
  Peptide Derived from Human Papillomavirus
KTTCTDWVT

SEQ ID NO: 3443 - protein, 10 aa, Artificial Sequence
  Peptide Derived from Human Papillomavirus
KTTCTDWVTA

SEQ ID NO: 3444 - protein, 11 aa, Artificial Sequence
  Peptide Derived from Human Papillomavirus
KTTCTDWVTAI

SEQ ID NO: 3445 - protein, 8 aa, Artificial Sequence
  Peptide Derived from Human Papillomavirus
KVAMLDDA

SEQ ID NO: 3446 - protein, 9 aa, Artificial Sequence
  Peptide Derived from Human Papillomavirus
KVAMLDDAT

SEQ ID NO: 3447 - protein, 10 aa, Artificial Sequence
  Peptide Derived from Human Papillomavirus
KVAMLDDATT

SEQ ID NO: 3448 - protein, 11 aa, Artificial Sequence
  Peptide Derived from Human Papillomavirus
KVAMLDDATTT

SEQ ID NO: 3449 - protein, 8 aa, Artificial Sequence
  Peptide Derived from Human Papillomavirus
KVNNKQGA

SEQ ID NO: 3450 - protein, 9 aa, Artificial Sequence
  Peptide Derived from Human Papillomavirus
KVNNKQGAM

SEQ ID NO: 3451 - protein, 10 aa, Artificial Sequence
  Peptide Derived from Human Papillomavirus
KVNNKQGAML

SEQ ID NO: 3452 - protein, 11 aa, Artificial Sequence
  Peptide Derived from Human Papillomavirus
KVNNKQGAMLA

SEQ ID NO: 3453 - protein, 8 aa, Artificial Sequence
  Peptide Derived from Human Papillomavirus
LADSNSNA

SEQ ID NO: 3454 - protein, 9 aa, Artificial Sequence
  Peptide Derived from Human Papillomavirus
LADSNSNAA

SEQ ID NO: 3455 - protein, 10 aa, Artificial Sequence
  Peptide Derived from Human Papillomavirus
LADSNSNAAA

SEQ ID NO: 3456 - protein, 10 aa, Artificial Sequence
  Peptide Derived from Human Papillomavirus
LAVFKDTYGL

SEQ ID NO: 3457 - protein, 9 aa, Artificial Sequence
  Peptide Derived from Human Papillomavirus
LIQLKCPPI

SEQ ID NO: 3458 - protein, 10 aa, Artificial Sequence
  Peptide Derived from Human Papillomavirus
LIQLKCPPIL

SEQ ID NO: 3459 - protein, 11 aa, Artificial Sequence
  Peptide Derived from Human Papillomavirus
LIQLKCPPILL

SEQ ID NO: 3460 - protein, 9 aa, Artificial Sequence
  Peptide Derived from Human Papillomavirus
LIQPFILYA

SEQ ID NO: 3461 - protein, 11 aa, Artificial Sequence
  Peptide Derived from Human Papillomavirus
LIQPFILYAHI

SEQ ID NO: 3462 - protein, 11 aa, Artificial Sequence
  Peptide Derived from Human Papillomavirus
LIQPPKLRSSV

SEQ ID NO: 3463 - protein, 9 aa, Artificial Sequence
  Peptide Derived from Human Papillomavirus
LLADSNSNA

SEQ ID NO: 3464 - protein, 10 aa, Artificial Sequence
  Peptide Derived from Human Papillomavirus
LLADSNSNAA

SEQ ID NO: 3465 - protein, 11 aa, Artificial Sequence
  Peptide Derived from Human Papillomavirus
LLADSNSNAAA

SEQ ID NO: 3466 - protein, 9 aa, Artificial Sequence
  Peptide Derived from Human Papillomavirus
LLHVPETCM

SEQ ID NO: 3467 - protein, 10 aa, Artificial Sequence
  Peptide Derived from Human Papillomavirus
LLHVPETCML

SEQ ID NO: 3468 - protein, 11 aa, Artificial Sequence
  Peptide Derived from Human Papillomavirus
LLHVPETCMLI

SEQ ID NO: 3469 - protein, 10 aa, Artificial Sequence
  Peptide Derived from Human Papillomavirus
LLKVNNKQGA

SEQ ID NO: 3470 - protein, 11 aa, Artificial Sequence
  Peptide Derived from Human Papillomavirus
LLKVNNKQGAM

SEQ ID NO: 3471 - protein, 11 aa, Artificial Sequence
  Peptide Derived from Human Papillomavirus
LLRYKCGKSRL

SEQ ID NO: 3472 - protein, 9 aa, Artificial Sequence
  Peptide Derived from Human Papillomavirus
LLTTNIHPA

SEQ ID NO: 3473 - protein, 8 aa, Artificial Sequence
  Peptide Derived from Human Papillomavirus
LTDESDMA

SEQ ID NO: 3474 - protein, 8 aa, Artificial Sequence
  Peptide Derived from Human Papillomavirus
LTDTKVAM

SEQ ID NO: 3475 - protein, 9 aa, Artificial Sequence
  Peptide Derived from Human Papillomavirus
LTDTKVAML

SEQ ID NO: 3476 - protein, 8 aa, Artificial Sequence
  Peptide Derived from Human Papillomavirus
LTIIQHGI

SEQ ID NO: 3477 - protein, 8 aa, Artificial Sequence
  Peptide Derived from Human Papillomavirus
LTTNIHPA

SEQ ID NO: 3478 - protein, 9 aa, Artificial Sequence
  Peptide Derived from Human Papillomavirus
LTVAKGLST

SEQ ID NO: 3479 - protein, 10 aa, Artificial Sequence
  Peptide Derived from Human Papillomavirus
LTVAKGLSTL

SEQ ID NO: 3480 - protein, 11 aa, Artificial Sequence
  Peptide Derived from Human Papillomavirus
LTVAKGLSTLL

SEQ ID NO: 3481 - protein, 9 aa, Artificial Sequence
  Peptide Derived from Human Papillomavirus
LVFCGPANT

SEQ ID NO: 3482 - protein, 10 aa, Artificial Sequence
  Peptide Derived from Human Papillomavirus
LVRNFKSDKT

SEQ ID NO: 3483 - protein, 11 aa, Artificial Sequence
  Peptide Derived from Human Papillomavirus
LVRNFKSDKTT

SEQ ID NO: 3484 - protein, 8 aa, Artificial Sequence
  Peptide Derived from Human Papillomavirus
MAFEYALL

SEQ ID NO: 3485 - protein, 9 aa, Artificial Sequence
  Peptide Derived from Human Papillomavirus
MAFEYALLA

SEQ ID NO: 3486 - protein, 8 aa, Artificial Sequence
  Peptide Derived from Human Papillomavirus
MLAVFKDT

SEQ ID NO: 3487 - protein, 11 aa, Artificial Sequence
  Peptide Derived from Human Papillomavirus
MLAVFKDTYGL

SEQ ID NO: 3488 - protein, 8 aa, Artificial Sequence
  Peptide Derived from Human Papillomavirus
MLDDATTT

SEQ ID NO: 3489 - protein, 11 aa, Artificial Sequence
  Peptide Derived from Human Papillomavirus
MLDDATTTCWT

SEQ ID NO: 3490 - protein, 8 aa, Artificial Sequence
  Peptide Derived from Human Papillomavirus
MLIQPPKL

SEQ ID NO: 3491 - protein, 10 aa, Artificial Sequence
  Peptide Derived from Human Papillomavirus
MVDFIDTQGT

SEQ ID NO: 3492 - protein, 10 aa, Artificial Sequence
  Peptide Derived from Human Papillomavirus
MVQWAFDNEL

SEQ ID NO: 3493 - protein, 11 aa, Artificial Sequence
  Peptide Derived from Human Papillomavirus
MVQWAFDNELT

SEQ ID NO: 3494 - protein, 8 aa, Artificial Sequence
  Peptide Derived from Human Papillomavirus
NALDGNPI

SEQ ID NO: 3495 - protein, 10 aa, Artificial Sequence
  Peptide Derived from Human Papillomavirus
NALDGNPISI

SEQ ID NO: 3496 - protein, 9 aa, Artificial Sequence
  Peptide Derived from Human Papillomavirus
NATDTGSDM

SEQ ID NO: 3497 - protein, 10 aa, Artificial Sequence
  Peptide Derived from Human Papillomavirus
NATDTGSDMV

SEQ ID NO: 3498 - protein, 10 aa, Artificial Sequence
  Peptide Derived from Human Papillomavirus
NIENVNPQCT

SEQ ID NO: 3499 - protein, 11 aa, Artificial Sequence
  Peptide Derived from Human Papillomavirus
NIENVNPQCTI

SEQ ID NO: 3500 - protein, 9 aa, Artificial Sequence
  Peptide Derived from Human Papillomavirus
NISEVMGDT

SEQ ID NO: 3501 - protein, 9 aa, Artificial Sequence
  Peptide Derived from Human Papillomavirus
NTGKSYFGM

SEQ ID NO: 3502 - protein, 8 aa, Artificial Sequence
  Peptide Derived from Human Papillomavirus
NVCSGGST

SEQ ID NO: 3503 - protein, 10 aa, Artificial Sequence
  Peptide Derived from Human Papillomavirus
NVCSGGSTEA

SEQ ID NO: 3504 - protein, 11 aa, Artificial Sequence
  Peptide Derived from Human Papillomavirus
NVCSGGSTEAI

SEQ ID NO: 3505 - protein, 8 aa, Artificial Sequence
  Peptide Derived from Human Papillomavirus
NVNPQCTI

SEQ ID NO: 3506 - protein, 9 aa, Artificial Sequence
  Peptide Derived from Human Papillomavirus
NVNPQCTIA

SEQ ID NO: 3507 - protein, 11 aa, Artificial Sequence
  Peptide Derived from Human Papillomavirus
NVNPQCTIAQL

SEQ ID NO: 3508 - protein, 10 aa, Artificial Sequence
  Peptide Derived from Human Papillomavirus
PAKDNRWPYL

SEQ ID NO: 3509 - protein, 11 aa, Artificial Sequence
  Peptide Derived from Human Papillomavirus
PANTGKSYFGM

SEQ ID NO: 3510 - protein, 8 aa, Artificial Sequence
  Peptide Derived from Human Papillomavirus
PILLTTNI

SEQ ID NO: 3511 - protein, 11 aa, Artificial Sequence
  Peptide Derived from Human Papillomavirus
PILLTTNIHPA

SEQ ID NO: 3512 - protein, 11 aa, Artificial Sequence
  Peptide Derived from Human Papillomavirus
PISIDRKHKPL

SEQ ID NO: 3513 - protein, 11 aa, Artificial Sequence
  Peptide Derived from Human Papillomavirus
PIVQFLRYQQI

SEQ ID NO: 3514 - protein, 8 aa, Artificial Sequence
  Peptide Derived from Human Papillomavirus
PLGERLEV

SEQ ID NO: 3515 - protein, 10 aa, Artificial Sequence
  Peptide Derived from Human Papillomavirus
PLGERLEVDT

SEQ ID NO: 3516 - protein, 10 aa, Artificial Sequence
  Peptide Derived from Human Papillomavirus
PLIQLKCPPI

SEQ ID NO: 3517 - protein, 11 aa, Artificial Sequence
  Peptide Derived from Human Papillomavirus
PLIQLKCPPIL

SEQ ID NO: 3518 - protein, 8 aa, Artificial Sequence
  Peptide Derived from Human Papillomavirus
PLTDTKVA

SEQ ID NO: 3519 - protein, 9 aa, Artificial Sequence
  Peptide Derived from Human Papillomavirus
PLTDTKVAM

SEQ ID NO: 3520 - protein, 10 aa, Artificial Sequence
  Peptide Derived from Human Papillomavirus
PLTDTKVAML

SEQ ID NO: 3521 - protein, 8 aa, Artificial Sequence
  Peptide Derived from Human Papillomavirus
PQCTIAQL

SEQ ID NO: 3522 - protein, 11 aa, Artificial Sequence
  Peptide Derived from Human Papillomavirus
PQCTIAQLKDL

SEQ ID NO: 3523 - protein, 9 aa, Artificial Sequence
  Peptide Derived from Human Papillomavirus
PTIAEGFKT

SEQ ID NO: 3524 - protein, 10 aa, Artificial Sequence
  Peptide Derived from Human Papillomavirus
PTIAEGFKTL

SEQ ID NO: 3525 - protein, 11 aa, Artificial Sequence
  Peptide Derived from Human Papillomavirus
PTIAEGFKTLI

SEQ ID NO: 3526 - protein, 9 aa, Artificial Sequence
  Peptide Derived from Human Papillomavirus
QAELETAQA

SEQ ID NO: 3527 - protein, 10 aa, Artificial Sequence
  Peptide Derived from Human Papillomavirus
QAELETAQAL

SEQ ID NO: 3528 - protein, 8 aa, Artificial Sequence
  Peptide Derived from Human Papillomavirus
QAIVDKKT

SEQ ID NO: 3529 - protein, 11 aa, Artificial Sequence
  Peptide Derived from Human Papillomavirus
QAIVDKKTGDV

SEQ ID NO: 3530 - protein, 9 aa, Artificial Sequence
  Peptide Derived from Human Papillomavirus
QAKYLKDCA

SEQ ID NO: 3531 - protein, 10 aa, Artificial Sequence
  Peptide Derived from Human Papillomavirus
QAKYLKDCAT

SEQ ID NO: 3532 - protein, 11 aa, Artificial Sequence
  Peptide Derived from Human Papillomavirus
QAKYLKDCATM

SEQ ID NO: 3533 - protein, 9 aa, Artificial Sequence
  Peptide Derived from Human Papillomavirus
QALFHAQEV

SEQ ID NO: 3534 - protein, 8 aa, Artificial Sequence
  Peptide Derived from Human Papillomavirus
QIEFITFL

SEQ ID NO: 3535 - protein, 10 aa, Artificial Sequence
  Peptide Derived from Human Papillomavirus
QIEFITFLGA

SEQ ID NO: 3536 - protein, 11 aa, Artificial Sequence
  Peptide Derived from Human Papillomavirus
QIEFITFLGAL

SEQ ID NO: 3537 - protein, 8 aa, Artificial Sequence
  Peptide Derived from Human Papillomavirus
QLKCPPIL

SEQ ID NO: 3538 - protein, 9 aa, Artificial Sequence
  Peptide Derived from Human Papillomavirus
QLKCPPILL

SEQ ID NO: 3539 - protein, 10 aa, Artificial Sequence
  Peptide Derived from Human Papillomavirus
QLKCPPILLT

SEQ ID NO: 3540 - protein, 11 aa, Artificial Sequence
  Peptide Derived from Human Papillomavirus
QLKCPPILLTT

SEQ ID NO: 3541 - protein, 8 aa, Artificial Sequence
  Peptide Derived from Human Papillomavirus
QLKDLLKV

SEQ ID NO: 3542 - protein, 8 aa, Artificial Sequence
  Peptide Derived from Human Papillomavirus
QMNMSQWI

SEQ ID NO: 3543 - protein, 9 aa, Artificial Sequence
  Peptide Derived from Human Papillomavirus
QQIEFITFL

SEQ ID NO: 3544 - protein, 11 aa, Artificial Sequence
  Peptide Derived from Human Papillomavirus
QQIEFITFLGA

SEQ ID NO: 3545 - protein, 11 aa, Artificial Sequence
  Peptide Derived from Human Papillomavirus
QVLHVLKRKFA

SEQ ID NO: 3546 - protein, 9 aa, Artificial Sequence
  Peptide Derived from Human Papillomavirus
RAGQNHRPL

SEQ ID NO: 3547 - protein, 9 aa, Artificial Sequence
  Peptide Derived from Human Papillomavirus
RAQKRQMNM

SEQ ID NO: 3548 - protein, 10 aa, Artificial Sequence
  Peptide Derived from Human Papillomavirus
RITVFEFPNA

SEQ ID NO: 3549 - protein, 11 aa, Artificial Sequence
  Peptide Derived from Human Papillomavirus
RLDLHEEEEDA

SEQ ID NO: 3550 - protein, 8 aa, Artificial Sequence
  Peptide Derived from Human Papillomavirus
RLEVDTEL

SEQ ID NO: 3551 - protein, 9 aa, Artificial Sequence
  Peptide Derived from Human Papillomavirus
RLTIIQHGI

SEQ ID NO: 3552 - protein, 8 aa, Artificial Sequence
  Peptide Derived from Human Papillomavirus
RLTVAKGL

SEQ ID NO: 3553 - protein, 10 aa, Artificial Sequence
  Peptide Derived from Human Papillomavirus
RLTVAKGLST

SEQ ID NO: 3554 - protein, 11 aa, Artificial Sequence
  Peptide Derived from Human Papillomavirus
RLTVAKGLSTL

SEQ ID NO: 3555 - protein, 9 aa, Artificial Sequence
  Peptide Derived from Human Papillomavirus
RQMNMSQWI

SEQ ID NO: 3556 - protein, 10 aa, Artificial Sequence
  Peptide Derived from Human Papillomavirus
RTGISNISEV

SEQ ID NO: 3557 - protein, 11 aa, Artificial Sequence
  Peptide Derived from Human Papillomavirus
RTGISNISEVM

SEQ ID NO: 3558 - protein, 8 aa, Artificial Sequence
  Peptide Derived from Human Papillomavirus
RTWSRLDL

SEQ ID NO: 3559 - protein, 9 aa, Artificial Sequence
  Peptide Derived from Human Papillomavirus
SIDRKHKPL

SEQ ID NO: 3560 - protein, 10 aa, Artificial Sequence
  Peptide Derived from Human Papillomavirus
SIDRKHKPLI

SEQ ID NO: 3561 - protein, 9 aa, Artificial Sequence
  Peptide Derived from Human Papillomavirus
SLNSGQKKA

SEQ ID NO: 3562 - protein, 11 aa, Artificial Sequence
  Peptide Derived from Human Papillomavirus
SQWIRFRCSKI

SEQ ID NO: 3563 - protein, 10 aa, Artificial Sequence
  Peptide Derived from Human Papillomavirus
STEAIDNGGT

SEQ ID NO: 3564 - protein, 11 aa, Artificial Sequence
  Peptide Derived from Human Papillomavirus
STENSPLGERL

SEQ ID NO: 3565 - protein, 9 aa, Artificial Sequence
  Peptide Derived from Human Papillomavirus
STLLHVPET

SEQ ID NO: 3566 - protein, 11 aa, Artificial Sequence
  Peptide Derived from Human Papillomavirus
STLLHVPETCM

SEQ ID NO: 3567 - protein, 10 aa, Artificial Sequence
  Peptide Derived from Human Papillomavirus
STSHFWLEPL

SEQ ID NO: 3568 - protein, 11 aa, Artificial Sequence
  Peptide Derived from Human Papillomavirus
STSHFWLEPLT

SEQ ID NO: 3569 - protein, 10 aa, Artificial Sequence
  Peptide Derived from Human Papillomavirus
SVAALYWYRT

SEQ ID NO: 3570 - protein, 11 aa, Artificial Sequence
  Peptide Derived from Human Papillomavirus
SVDGTSDNSNI

SEQ ID NO: 3571 - protein, 9 aa, Artificial Sequence
  Peptide Derived from Human Papillomavirus
TAIFGVNPT

SEQ ID NO: 3572 - protein, 10 aa, Artificial Sequence
  Peptide Derived from Human Papillomavirus
TAIFGVNPTI

SEQ ID NO: 3573 - protein, 11 aa, Artificial Sequence
  Peptide Derived from Human Papillomavirus
TAIFGVNPTIA

SEQ ID NO: 3574 - protein, 8 aa, Artificial Sequence
  Peptide Derived from Human Papillomavirus
TAQALFHA

SEQ ID NO: 3575 - protein, 11 aa, Artificial Sequence
  Peptide Derived from Human Papillomavirus
TAQALFHAQEV

SEQ ID NO: 3576 - protein, 8 aa, Artificial Sequence
  Peptide Derived from Human Papillomavirus
TIAEGFKT

SEQ ID NO: 3577 - protein, 9 aa, Artificial Sequence
  Peptide Derived from Human Papillomavirus
TIAEGFKTL

SEQ ID NO: 3578 - protein, 10 aa, Artificial Sequence
  Peptide Derived from Human Papillomavirus
TIAEGFKTLI

SEQ ID NO: 3579 - protein, 8 aa, Artificial Sequence
  Peptide Derived from Human Papillomavirus
TIAQLKDL

SEQ ID NO: 3580 - protein, 9 aa, Artificial Sequence
  Peptide Derived from Human Papillomavirus
TIAQLKDLL

SEQ ID NO: 3581 - protein, 11 aa, Artificial Sequence
  Peptide Derived from Human Papillomavirus
TIAQLKDLLKV

SEQ ID NO: 3582 - protein, 8 aa, Artificial Sequence
  Peptide Derived from Human Papillomavirus
TLIQPFIL

SEQ ID NO: 3583 - protein, 10 aa, Artificial Sequence
  Peptide Derived from Human Papillomavirus
TLIQPFILYA

SEQ ID NO: 3584 - protein, 8 aa, Artificial Sequence
  Peptide Derived from Human Papillomavirus
TLLHVPET

SEQ ID NO: 3585 - protein, 10 aa, Artificial Sequence
  Peptide Derived from Human Papillomavirus
TLLHVPETCM

SEQ ID NO: 3586 - protein, 11 aa, Artificial Sequence
  Peptide Derived from Human Papillomavirus
TLLHVPETCML

SEQ ID NO: 3587 - protein, 9 aa, Artificial Sequence
  Peptide Derived from Human Papillomavirus
TMCKHYRRA

SEQ ID NO: 3588 - protein, 9 aa, Artificial Sequence
  Peptide Derived from Human Papillomavirus
TQGTFCEQA

SEQ ID NO: 3589 - protein, 11 aa, Artificial Sequence
  Peptide Derived from Human Papillomavirus
TQGTFCEQAEL

SEQ ID NO: 3590 - protein, 8 aa, Artificial Sequence
  Peptide Derived from Human Papillomavirus
TTCTDWVT

SEQ ID NO: 3591 - protein, 9 aa, Artificial Sequence
  Peptide Derived from Human Papillomavirus
TTCTDWVTA

SEQ ID NO: 3592 - protein, 10 aa, Artificial Sequence
  Peptide Derived from Human Papillomavirus
TTCTDWVTAI

SEQ ID NO: 3593 - protein, 9 aa, Artificial Sequence
  Peptide Derived from Human Papillomavirus
TTCWTYFDT

SEQ ID NO: 3594 - protein, 11 aa, Artificial Sequence
  Peptide Derived from Human Papillomavirus
TTCWTYFDTYM

SEQ ID NO: 3595 - protein, 10 aa, Artificial Sequence
  Peptide Derived from Human Papillomavirus
TTNGEHGGNV

SEQ ID NO: 3596 - protein, 10 aa, Artificial Sequence
  Peptide Derived from Human Papillomavirus
TTTCWTYFDT

SEQ ID NO: 3597 - protein, 8 aa, Artificial Sequence
  Peptide Derived from Human Papillomavirus
TVAKGLST

SEQ ID NO: 3598 - protein, 9 aa, Artificial Sequence
  Peptide Derived from Human Papillomavirus
TVAKGLSTL

SEQ ID NO: 3599 - protein, 10 aa, Artificial Sequence
  Peptide Derived from Human Papillomavirus
TVAKGLSTLL

SEQ ID NO: 3600 - protein, 8 aa, Artificial Sequence
  Peptide Derived from Human Papillomavirus
TVFEFPNA

SEQ ID NO: 3601 - protein, 9 aa, Artificial Sequence
  Peptide Derived from Human Papillomavirus
VAALYWYRT

SEQ ID NO: 3602 - protein, 11 aa, Artificial Sequence
  Peptide Derived from Human Papillomavirus
VAALYWYRTGI

SEQ ID NO: 3603 - protein, 8 aa, Artificial Sequence
  Peptide Derived from Human Papillomavirus
VAKGLSTL

SEQ ID NO: 3604 - protein, 9 aa, Artificial Sequence
  Peptide Derived from Human Papillomavirus
VAKGLSTLL

SEQ ID NO: 3605 - protein, 11 aa, Artificial Sequence
  Peptide Derived from Human Papillomavirus
VAKGLSTLLHV

SEQ ID NO: 3606 - protein, 8 aa, Artificial Sequence
  Peptide Derived from Human Papillomavirus
VAMLDDAT

SEQ ID NO: 3607 - protein, 9 aa, Artificial Sequence
  Peptide Derived from Human Papillomavirus
VAMLDDATT

SEQ ID NO: 3608 - protein, 10 aa, Artificial Sequence
  Peptide Derived from Human Papillomavirus
VAMLDDATTT

SEQ ID NO: 3609 - protein, 10 aa, Artificial Sequence
  Peptide Derived from Human Papillomavirus
VISDDEDENA

SEQ ID NO: 3610 - protein, 11 aa, Artificial Sequence
  Peptide Derived from Human Papillomavirus
VISDDEDENAT

SEQ ID NO: 3611 - protein, 8 aa, Artificial Sequence
  Peptide Derived from Human Papillomavirus
VISFVNST

SEQ ID NO: 3612 - protein, 10 aa, Artificial Sequence
  Peptide Derived from Human Papillomavirus
VLHVLKRKFA

SEQ ID NO: 3613 - protein, 11 aa, Artificial Sequence
  Peptide Derived from Human Papillomavirus
VLKRKFAGGST

SEQ ID NO: 3614 - protein, 9 aa, Artificial Sequence
  Peptide Derived from Human Papillomavirus
VMGDTPEWI

SEQ ID NO: 3615 - protein, 9 aa, Artificial Sequence
  Peptide Derived from Human Papillomavirus
VQAIVDKKT

SEQ ID NO: 3616 - protein, 9 aa, Artificial Sequence
  Peptide Derived from Human Papillomavirus
VQFLRYQQI

SEQ ID NO: 3617 - protein, 9 aa, Artificial Sequence
  Peptide Derived from Human Papillomavirus
VQWAFDNEL

SEQ ID NO: 3618 - protein, 10 aa, Artificial Sequence
  Peptide Derived from Human Papillomavirus
VQWAFDNELT

SEQ ID NO: 3619 - protein, 10 aa, Artificial Sequence
  Peptide Derived from Human Papillomavirus
VTAIFGVNPT

SEQ ID NO: 3620 - protein, 11 aa, Artificial Sequence
  Peptide Derived from Human Papillomavirus
VTAIFGVNPTI

SEQ ID NO: 3621 - protein, 11 aa, Artificial Sequence
  Peptide Derived from Human Papillomavirus
VTTNGEHGGNV

SEQ ID NO: 3622 - protein, 8 aa, Artificial Sequence
  Peptide Derived from Human Papillomavirus
WAFDNELT

SEQ ID NO: 3623 - protein, 8 aa, Artificial Sequence
  Peptide Derived from Human Papillomavirus
WIQRLTII

SEQ ID NO: 3624 - protein, 9 aa, Artificial Sequence
  Peptide Derived from Human Papillomavirus
WIRFRCSKI

SEQ ID NO: 3625 - protein, 8 aa, Artificial Sequence
  Peptide Derived from Human Papillomavirus
WLEPLTDT

SEQ ID NO: 3626 - protein, 10 aa, Artificial Sequence
  Peptide Derived from Human Papillomavirus
WLEPLTDTKV

SEQ ID NO: 3627 - protein, 11 aa, Artificial Sequence
  Peptide Derived from Human Papillomavirus
WLEPLTDTKVA

SEQ ID NO: 3628 - protein, 8 aa, Artificial Sequence
  Peptide Derived from Human Papillomavirus
WTYFDTYM

SEQ ID NO: 3629 - protein, 11 aa, Artificial Sequence
  Peptide Derived from Human Papillomavirus
WTYFDTYMRNA

SEQ ID NO: 3630 - protein, 8 aa, Artificial Sequence
  Peptide Derived from Human Papillomavirus
WVTAIFGV

SEQ ID NO: 3631 - protein, 11 aa, Artificial Sequence
  Peptide Derived from Human Papillomavirus
WVTAIFGVNPT

SEQ ID NO: 3632 - protein, 11 aa, Artificial Sequence
  Peptide Derived from Human Papillomavirus
YALLADSNSNA

SEQ ID NO: 3633 - protein, 8 aa, Artificial Sequence
  Peptide Derived from Human Papillomavirus
YLESRITV

SEQ ID NO: 3634 - protein, 8 aa, Artificial Sequence
  Peptide Derived from Human Papillomavirus
YLKDCATM

SEQ ID NO: 3635 - protein, 11 aa, Artificial Sequence
  Peptide Derived from Human Papillomavirus
YMRNALDGNPI

SEQ ID NO: 3636 - protein, 8 aa, Artificial Sequence
  Peptide Derived from Human Papillomavirus
YQQIEFIT

SEQ ID NO: 3637 - protein, 10 aa, Artificial Sequence
  Peptide Derived from Human Papillomavirus
YQQIEFITFL

SEQ ID NO: 3638 - protein, 10 aa, Artificial Sequence
  Peptide Derived from Human Papillomavirus
YVQAIVDKKT

SEQ ID NO: 3639 - protein, 9 aa, Artificial Sequence
  Peptide Derived from Human Papillomavirus
AAREHGIQT

SEQ ID NO: 3640 - protein, 10 aa, Artificial Sequence
  Peptide Derived from Human Papillomavirus
AAREHGIQTL

SEQ ID NO: 3641 - protein, 10 aa, Artificial Sequence
  Peptide Derived from Human Papillomavirus
AATRPGHCGL

SEQ ID NO: 3642 - protein, 11 aa, Artificial Sequence
  Peptide Derived from Human Papillomavirus
AATRPGHCGLA

SEQ ID NO: 3643 - protein, 8 aa, Artificial Sequence
  Peptide Derived from Human Papillomavirus
AIELQMAL

SEQ ID NO: 3644 - protein, 11 aa, Artificial Sequence
  Peptide Derived from Human Papillomavirus
AIELQMALQGL

SEQ ID NO: 3645 - protein, 11 aa, Artificial Sequence
  Peptide Derived from Human Papillomavirus
AIFFAAREHGI

SEQ ID NO: 3646 - protein, 8 aa, Artificial Sequence
  Peptide Derived from Human Papillomavirus
AIPDSVQI

SEQ ID NO: 3647 - protein, 9 aa, Artificial Sequence
  Peptide Derived from Human Papillomavirus
AIPDSVQIL

SEQ ID NO: 3648 - protein, 10 aa, Artificial Sequence
  Peptide Derived from Human Papillomavirus
AIPDSVQILV

SEQ ID NO: 3649 - protein, 11 aa, Artificial Sequence
  Peptide Derived from Human Papillomavirus
AQSRYKTEDWT

SEQ ID NO: 3650 - protein, 9 aa, Artificial Sequence
  Peptide Derived from Human Papillomavirus
ATCVSHRGL

SEQ ID NO: 3651 - protein, 8 aa, Artificial Sequence
  Peptide Derived from Human Papillomavirus
ATQLVKQL

SEQ ID NO: 3652 - protein, 11 aa, Artificial Sequence
  Peptide Derived from Human Papillomavirus
ATQLVKQLQHT

SEQ ID NO: 3653 - protein, 9 aa, Artificial Sequence
  Peptide Derived from Human Papillomavirus
ATRPGHCGL

SEQ ID NO: 3654 - protein, 10 aa, Artificial Sequence
  Peptide Derived from Human Papillomavirus
ATRPGHCGLA

SEQ ID NO: 3655 - protein, 10 aa, Artificial Sequence
  Peptide Derived from Human Papillomavirus
CMTYVAWDSV

SEQ ID NO: 3656 - protein, 10 aa, Artificial Sequence
  Peptide Derived from Human Papillomavirus
CVSHRGLYYV

SEQ ID NO: 3657 - protein, 8 aa, Artificial Sequence
  Peptide Derived from Human Papillomavirus
DAGTWDKT

SEQ ID NO: 3658 - protein, 9 aa, Artificial Sequence
  Peptide Derived from Human Papillomavirus
DAGTWDKTA

SEQ ID NO: 3659 - protein, 10 aa, Artificial Sequence
  Peptide Derived from Human Papillomavirus
DAGTWDKTAT

SEQ ID NO: 3660 - protein, 11 aa, Artificial Sequence
  Peptide Derived from Human Papillomavirus
DIDSQIQYWQL

SEQ ID NO: 3661 - protein, 9 aa, Artificial Sequence
  Peptide Derived from Human Papillomavirus
DISSTWHWT

SEQ ID NO: 3662 - protein, 11 aa, Artificial Sequence
  Peptide Derived from Human Papillomavirus
DISSTWHWTGA

SEQ ID NO: 3663 - protein, 9 aa, Artificial Sequence
  Peptide Derived from Human Papillomavirus
DTCEELWNT

SEQ ID NO: 3664 - protein, 8 aa, Artificial Sequence
  Peptide Derived from Human Papillomavirus
DTVSATQL

SEQ ID NO: 3665 - protein, 9 aa, Artificial Sequence
  Peptide Derived from Human Papillomavirus
DTVSATQLV

SEQ ID NO: 3666 - protein, 9 aa, Artificial Sequence
  Peptide Derived from Human Papillomavirus
ELQMALQGL

SEQ ID NO: 3667 - protein, 10 aa, Artificial Sequence
  Peptide Derived from Human Papillomavirus
ELQMALQGLA

SEQ ID NO: 3668 - protein, 8 aa, Artificial Sequence
  Peptide Derived from Human Papillomavirus
ELWNTEPT

SEQ ID NO: 3669 - protein, 10 aa, Artificial Sequence
  Peptide Derived from Human Papillomavirus
ETLSERLSCV

SEQ ID NO: 3670 - protein, 8 aa, Artificial Sequence
  Peptide Derived from Human Papillomavirus
ETQRTKFL

SEQ ID NO: 3671 - protein, 10 aa, Artificial Sequence
  Peptide Derived from Human Papillomavirus
ETQRTKFLNT

SEQ ID NO: 3672 - protein, 11 aa, Artificial Sequence
  Peptide Derived from Human Papillomavirus
ETQRTKFLNTV

SEQ ID NO: 3673 - protein, 8 aa, Artificial Sequence
  Peptide Derived from Human Papillomavirus
EVHFGNNV

SEQ ID NO: 3674 - protein, 9 aa, Artificial Sequence
  Peptide Derived from Human Papillomavirus
EVHFGNNVI

SEQ ID NO: 3675 - protein, 8 aa, Artificial Sequence
  Peptide Derived from Human Papillomavirus
FAAREHGI

SEQ ID NO: 3676 - protein, 10 aa, Artificial Sequence
  Peptide Derived from Human Papillomavirus
FAAREHGIQT

SEQ ID NO: 3677 - protein, 11 aa, Artificial Sequence
  Peptide Derived from Human Papillomavirus
FAAREHGIQTL

SEQ ID NO: 3678 - protein, 11 aa, Artificial Sequence
  Peptide Derived from Human Papillomavirus
FLNTVAIPDSV

SEQ ID NO: 3679 - protein, 9 aa, Artificial Sequence
  Peptide Derived from Human Papillomavirus
GAGNEKTGI

SEQ ID NO: 3680 - protein, 10 aa, Artificial Sequence
  Peptide Derived from Human Papillomavirus
GAGNEKTGIL

SEQ ID NO: 3681 - protein, 11 aa, Artificial Sequence
  Peptide Derived from Human Papillomavirus
GAGNEKTGILT

SEQ ID NO: 3682 - protein, 11 aa, Artificial Sequence
  Peptide Derived from Human Papillomavirus
GILTVTYHSET

SEQ ID NO: 3683 - protein, 9 aa, Artificial Sequence
  Peptide Derived from Human Papillomavirus
GIQTLNHQV

SEQ ID NO: 3684 - protein, 10 aa, Artificial Sequence
  Peptide Derived from Human Papillomavirus
GIQTLNHQVV

SEQ ID NO: 3685 - protein, 11 aa, Artificial Sequence
  Peptide Derived from Human Papillomavirus
GLAEKQHCGPV

SEQ ID NO: 3686 - protein, 9 aa, Artificial Sequence
  Peptide Derived from Human Papillomavirus
GLAQSRYKT

SEQ ID NO: 3687 - protein, 11 aa, Artificial Sequence
  Peptide Derived from Human Papillomavirus
GLYYVKEGYNT

SEQ ID NO: 3688 - protein, 9 aa, Artificial Sequence
  Peptide Derived from Human Papillomavirus
GTAKTYGQT

SEQ ID NO: 3689 - protein, 11 aa, Artificial Sequence
  Peptide Derived from Human Papillomavirus
GTAKTYGQTSA

SEQ ID NO: 3690 - protein, 8 aa, Artificial Sequence
  Peptide Derived from Human Papillomavirus
GTWDKTAT

SEQ ID NO: 3691 - protein, 10 aa, Artificial Sequence
  Peptide Derived from Human Papillomavirus
GTWDKTATCV

SEQ ID NO: 3692 - protein, 11 aa, Artificial Sequence
  Peptide Derived from Human Papillomavirus
GTWEVHFGNNV

SEQ ID NO: 3693 - protein, 9 aa, Artificial Sequence
  Peptide Derived from Human Papillomavirus
HLKGDRNSL

SEQ ID NO: 3694 - protein, 9 aa, Artificial Sequence
  Peptide Derived from Human Papillomavirus
HQVVPAYNI

SEQ ID NO: 3695 - protein, 9 aa, Artificial Sequence
  Peptide Derived from Human Papillomavirus
HTPSPYSST

SEQ ID NO: 3696 - protein, 10 aa, Artificial Sequence
  Peptide Derived from Human Papillomavirus
HTPSPYSSTV

SEQ ID NO: 3697 - protein, 11 aa, Artificial Sequence
  Peptide Derived from Human Papillomavirus
IIHLKGDRNSL

SEQ ID NO: 3698 - protein, 10 aa, Artificial Sequence
  Peptide Derived from Human Papillomavirus
ILTVTYHSET

SEQ ID NO: 3699 - protein, 8 aa, Artificial Sequence
  Peptide Derived from Human Papillomavirus
ILVGYMTM

SEQ ID NO: 3700 - protein, 8 aa, Artificial Sequence
  Peptide Derived from Human Papillomavirus
IQTLNHQV

SEQ ID NO: 3701 - protein, 9 aa, Artificial Sequence
  Peptide Derived from Human Papillomavirus
IQTLNHQVV

SEQ ID NO: 3702 - protein, 11 aa, Artificial Sequence
  Peptide Derived from Human Papillomavirus
IQTLNHQVVPA

SEQ ID NO: 3703 - protein, 8 aa, Artificial Sequence
  Peptide Derived from Human Papillomavirus
KAHKAIEL

SEQ ID NO: 3704 - protein, 10 aa, Artificial Sequence
  Peptide Derived from Human Papillomavirus
KAHKAIELQM

SEQ ID NO: 3705 - protein, 11 aa, Artificial Sequence
  Peptide Derived from Human Papillomavirus
KAHKAIELQMA

SEQ ID NO: 3706 - protein, 8 aa, Artificial Sequence
  Peptide Derived from Human Papillomavirus
KAIELQMA

SEQ ID NO: 3707 - protein, 9 aa, Artificial Sequence
  Peptide Derived from Human Papillomavirus
KAIELQMAL

SEQ ID NO: 3708 - protein, 8 aa, Artificial Sequence
  Peptide Derived from Human Papillomavirus
KLCSGNTT

SEQ ID NO: 3709 - protein, 10 aa, Artificial Sequence
  Peptide Derived from Human Papillomavirus
KLCSGNTTPI

SEQ ID NO: 3710 - protein, 11 aa, Artificial Sequence
  Peptide Derived from Human Papillomavirus
KLCSGNTTPII

SEQ ID NO: 3711 - protein, 10 aa, Artificial Sequence
  Peptide Derived from Human Papillomavirus
KQHCGPVNPL

SEQ ID NO: 3712 - protein, 11 aa, Artificial Sequence
  Peptide Derived from Human Papillomavirus
KQHCGPVNPLL

SEQ ID NO: 3713 - protein, 11 aa, Artificial Sequence
  Peptide Derived from Human Papillomavirus
KTATCVSHRGL

SEQ ID NO: 3714 - protein, 10 aa, Artificial Sequence
  Peptide Derived from Human Papillomavirus
KTEDWTLQDT

SEQ ID NO: 3715 - protein, 8 aa, Artificial Sequence
  Peptide Derived from Human Papillomavirus
KTGILTVT

SEQ ID NO: 3716 - protein, 8 aa, Artificial Sequence
  Peptide Derived from Human Papillomavirus
KTYGQTSA

SEQ ID NO: 3717 - protein, 9 aa, Artificial Sequence
  Peptide Derived from Human Papillomavirus
KTYGQTSAA

SEQ ID NO: 3718 - protein, 10 aa, Artificial Sequence
  Peptide Derived from Human Papillomavirus
KTYGQTSAAT

SEQ ID NO: 3719 - protein, 10 aa, Artificial Sequence
  Peptide Derived from Human Papillomavirus
LAEKQHCGPV

SEQ ID NO: 3720 - protein, 8 aa, Artificial Sequence
  Peptide Derived from Human Papillomavirus
LAQSRYKT

SEQ ID NO: 3721 - protein, 8 aa, Artificial Sequence
  Peptide Derived from Human Papillomavirus
LIRWENAI

SEQ ID NO: 3722 - protein, 11 aa, Artificial Sequence
  Peptide Derived from Human Papillomavirus
LIRWENAIFFA

SEQ ID NO: 3723 - protein, 8 aa, Artificial Sequence
  Peptide Derived from Human Papillomavirus
LLGAATPT

SEQ ID NO: 3724 - protein, 8 aa, Artificial Sequence
  Peptide Derived from Human Papillomavirus
LQDTCEEL

SEQ ID NO: 3725 - protein, 11 aa, Artificial Sequence
  Peptide Derived from Human Papillomavirus
LQDTCEELWNT

SEQ ID NO: 3726 - protein, 11 aa, Artificial Sequence
  Peptide Derived from Human Papillomavirus
LQGLAQSRYKT

SEQ ID NO: 3727 - protein, 11 aa, Artificial Sequence
  Peptide Derived from Human Papillomavirus
LQHTPSPYSST

SEQ ID NO: 3728 - protein, 8 aa, Artificial Sequence
  Peptide Derived from Human Papillomavirus
LQMALQGL

SEQ ID NO: 3729 - protein, 9 aa, Artificial Sequence
  Peptide Derived from Human Papillomavirus
LQMALQGLA

SEQ ID NO: 3730 - protein, 9 aa, Artificial Sequence
  Peptide Derived from Human Papillomavirus
LTVTYHSET

SEQ ID NO: 3731 - protein, 8 aa, Artificial Sequence
  Peptide Derived from Human Papillomavirus
LVKQLQHT

SEQ ID NO: 3732 - protein, 8 aa, Artificial Sequence
  Peptide Derived from Human Papillomavirus
MQTPKETL

SEQ ID NO: 3733 - protein, 10 aa, Artificial Sequence
  Peptide Derived from Human Papillomavirus
MTDAGTWDKT

SEQ ID NO: 3734 - protein, 11 aa, Artificial Sequence
  Peptide Derived from Human Papillomavirus
MTDAGTWDKTA

SEQ ID NO: 3735 - protein, 9 aa, Artificial Sequence
  Peptide Derived from Human Papillomavirus
MTYVAWDSV

SEQ ID NO: 3736 - protein, 10 aa, Artificial Sequence
  Peptide Derived from Human Papillomavirus
NISKSKAHKA

SEQ ID NO: 3737 - protein, 11 aa, Artificial Sequence
  Peptide Derived from Human Papillomavirus
NISKSKAHKAI

SEQ ID NO: 3738 - protein, 8 aa, Artificial Sequence
  Peptide Derived from Human Papillomavirus
NTTPIIHL

SEQ ID NO: 3739 - protein, 9 aa, Artificial Sequence
  Peptide Derived from Human Papillomavirus
NTVAIPDSV

SEQ ID NO: 3740 - protein, 11 aa, Artificial Sequence
  Peptide Derived from Human Papillomavirus
NTVAIPDSVQI

SEQ ID NO: 3741 - protein, 9 aa, Artificial Sequence
  Peptide Derived from Human Papillomavirus
NVIDCNDSM

SEQ ID NO: 3742 - protein, 10 aa, Artificial Sequence
  Peptide Derived from Human Papillomavirus
PAYNISKSKA

SEQ ID NO: 3743 - protein, 9 aa, Artificial Sequence
  Peptide Derived from Human Papillomavirus
PLLGAATPT

SEQ ID NO: 3744 - protein, 10 aa, Artificial Sequence
  Peptide Derived from Human Papillomavirus
PTGNNKRRKL

SEQ ID NO: 3745 - protein, 11 aa, Artificial Sequence
  Peptide Derived from Human Papillomavirus
PTHCFKKGGQT

SEQ ID NO: 3746 - protein, 8 aa, Artificial Sequence
  Peptide Derived from Human Papillomavirus
PVNPLLGA

SEQ ID NO: 3747 - protein, 9 aa, Artificial Sequence
  Peptide Derived from Human Papillomavirus
PVNPLLGAA

SEQ ID NO: 3748 - protein, 10 aa, Artificial Sequence
  Peptide Derived from Human Papillomavirus
PVNPLLGAAT

SEQ ID NO: 3749 - protein, 8 aa, Artificial Sequence
  Peptide Derived from Human Papillomavirus
QILVGYMT

SEQ ID NO: 3750 - protein, 9 aa, Artificial Sequence
  Peptide Derived from Human Papillomavirus
QILVGYMTM

SEQ ID NO: 3751 - protein, 8 aa, Artificial Sequence
  Peptide Derived from Human Papillomavirus
QIQYWQLI

SEQ ID NO: 3752 - protein, 8 aa, Artificial Sequence
  Peptide Derived from Human Papillomavirus
QLIRWENA

SEQ ID NO: 3753 - protein, 9 aa, Artificial Sequence
  Peptide Derived from Human Papillomavirus
QLIRWENAI

SEQ ID NO: 3754 - protein, 9 aa, Artificial Sequence
  Peptide Derived from Human Papillomavirus
QLVKQLQHT

SEQ ID NO: 3755 - protein, 8 aa, Artificial Sequence
  Peptide Derived from Human Papillomavirus
QMALQGLA

SEQ ID NO: 3756 - protein, 8 aa, Artificial Sequence
  Peptide Derived from Human Papillomavirus
QTLNHQVV

SEQ ID NO: 3757 - protein, 10 aa, Artificial Sequence
  Peptide Derived from Human Papillomavirus
QTLNHQVVPA

SEQ ID NO: 3758 - protein, 11 aa, Artificial Sequence
  Peptide Derived from Human Papillomavirus
QTPKETLSERL

SEQ ID NO: 3759 - protein, 8 aa, Artificial Sequence
  Peptide Derived from Human Papillomavirus
QVVPAYNI

SEQ ID NO: 3760 - protein, 9 aa, Artificial Sequence
  Peptide Derived from Human Papillomavirus
RLSCVQDKI

SEQ ID NO: 3761 - protein, 10 aa, Artificial Sequence
  Peptide Derived from Human Papillomavirus
RLSCVQDKII

SEQ ID NO: 3762 - protein, 8 aa, Artificial Sequence
  Peptide Derived from Human Papillomavirus
RTKFLNTV

SEQ ID NO: 3763 - protein, 9 aa, Artificial Sequence
  Peptide Derived from Human Papillomavirus
RTKFLNTVA

SEQ ID NO: 3764 - protein, 10 aa, Artificial Sequence
  Peptide Derived from Human Papillomavirus
RTKFLNTVAI

SEQ ID NO: 3765 - protein, 11 aa, Artificial Sequence
  Peptide Derived from Human Papillomavirus
SAATRPGHCGL

SEQ ID NO: 3766 - protein, 9 aa, Artificial Sequence
  Peptide Derived from Human Papillomavirus
SATQLVKQL

SEQ ID NO: 3767 - protein, 9 aa, Artificial Sequence
  Peptide Derived from Human Papillomavirus
SLKCLRYRL

SEQ ID NO: 3768 - protein, 9 aa, Artificial Sequence
  Peptide Derived from Human Papillomavirus
SMCSTSDDT

SEQ ID NO: 3769 - protein, 10 aa, Artificial Sequence
  Peptide Derived from Human Papillomavirus
SMCSTSDDTV

SEQ ID NO: 3770 - protein, 8 aa, Artificial Sequence
  Peptide Derived from Human Papillomavirus
SQIQYWQL

SEQ ID NO: 3771 - protein, 9 aa, Artificial Sequence
  Peptide Derived from Human Papillomavirus
SQIQYWQLI

SEQ ID NO: 3772 - protein, 9 aa, Artificial Sequence
  Peptide Derived from Human Papillomavirus
STSDDTVSA

SEQ ID NO: 3773 - protein, 10 aa, Artificial Sequence
  Peptide Derived from Human Papillomavirus
STSDDTVSAT

SEQ ID NO: 3774 - protein, 8 aa, Artificial Sequence
  Peptide Derived from Human Papillomavirus
STVSVGTA

SEQ ID NO: 3775 - protein, 10 aa, Artificial Sequence
  Peptide Derived from Human Papillomavirus
STVSVGTAKT

SEQ ID NO: 3776 - protein, 8 aa, Artificial Sequence
  Peptide Derived from Human Papillomavirus
STWHWTGA

SEQ ID NO: 3777 - protein, 11 aa, Artificial Sequence
  Peptide Derived from Human Papillomavirus
SVGTAKTYGQT

SEQ ID NO: 3778 - protein, 9 aa, Artificial Sequence
  Peptide Derived from Human Papillomavirus
SVQILVGYM

SEQ ID NO: 3779 - protein, 10 aa, Artificial Sequence
  Peptide Derived from Human Papillomavirus
SVQILVGYMT

SEQ ID NO: 3780 - protein, 11 aa, Artificial Sequence
  Peptide Derived from Human Papillomavirus
SVQILVGYMTM

SEQ ID NO: 3781 - protein, 8 aa, Artificial Sequence
  Peptide Derived from Human Papillomavirus
SVYYMTDA

SEQ ID NO: 3782 - protein, 10 aa, Artificial Sequence
  Peptide Derived from Human Papillomavirus
SVYYMTDAGT

SEQ ID NO: 3783 - protein, 8 aa, Artificial Sequence
  Peptide Derived from Human Papillomavirus
TAKTYGQT

SEQ ID NO: 3784 - protein, 10 aa, Artificial Sequence
  Peptide Derived from Human Papillomavirus
TAKTYGQTSA

SEQ ID NO: 3785 - protein, 11 aa, Artificial Sequence
  Peptide Derived from Human Papillomavirus
TAKTYGQTSAA

SEQ ID NO: 3786 - protein, 10 aa, Artificial Sequence
  Peptide Derived from Human Papillomavirus
TATCVSHRGL

SEQ ID NO: 3787 - protein, 9 aa, Artificial Sequence
  Peptide Derived from Human Papillomavirus
TLNHQVVPA

SEQ ID NO: 3788 - protein, 9 aa, Artificial Sequence
  Peptide Derived from Human Papillomavirus
TLQDTCEEL

SEQ ID NO: 3789 - protein, 9 aa, Artificial Sequence
  Peptide Derived from Human Papillomavirus
TLSERLSCV

SEQ ID NO: 3790 - protein, 10 aa, Artificial Sequence
  Peptide Derived from Human Papillomavirus
TQLVKQLQHT

SEQ ID NO: 3791 - protein, 9 aa, Artificial Sequence
  Peptide Derived from Human Papillomavirus
TQRTKFLNT

SEQ ID NO: 3792 - protein, 10 aa, Artificial Sequence
  Peptide Derived from Human Papillomavirus
TQRTKFLNTV

SEQ ID NO: 3793 - protein, 11 aa, Artificial Sequence
  Peptide Derived from Human Papillomavirus
TQRTKFLNTVA

SEQ ID NO: 3794 - protein, 8 aa, Artificial Sequence
  Peptide Derived from Human Papillomavirus
TVAIPDSV

SEQ ID NO: 3795 - protein, 10 aa, Artificial Sequence
  Peptide Derived from Human Papillomavirus
TVAIPDSVQI

SEQ ID NO: 3796 - protein, 11 aa, Artificial Sequence
  Peptide Derived from Human Papillomavirus
TVAIPDSVQIL

SEQ ID NO: 3797 - protein, 8 aa, Artificial Sequence
  Peptide Derived from Human Papillomavirus
TVSATQLV

SEQ ID NO: 3798 - protein, 11 aa, Artificial Sequence
  Peptide Derived from Human Papillomavirus
TVSATQLVKQL

SEQ ID NO: 3799 - protein, 9 aa, Artificial Sequence
  Peptide Derived from Human Papillomavirus
TVSVGTAKT

SEQ ID NO: 3800 - protein, 8 aa, Artificial Sequence
  Peptide Derived from Human Papillomavirus
TVTYHSET

SEQ ID NO: 3801 - protein, 11 aa, Artificial Sequence
  Peptide Derived from Human Papillomavirus
TVTYHSETQRT

SEQ ID NO: 3802 - protein, 9 aa, Artificial Sequence
  Peptide Derived from Human Papillomavirus
VAIPDSVQI

SEQ ID NO: 3803 - protein, 10 aa, Artificial Sequence
  Peptide Derived from Human Papillomavirus
VAIPDSVQIL

SEQ ID NO: 3804 - protein, 11 aa, Artificial Sequence
  Peptide Derived from Human Papillomavirus
VAIPDSVQILV

SEQ ID NO: 3805 - protein, 9 aa, Artificial Sequence
  Peptide Derived from Human Papillomavirus
VAWDSVYYM

SEQ ID NO: 3806 - protein, 10 aa, Artificial Sequence
  Peptide Derived from Human Papillomavirus
VAWDSVYYMT

SEQ ID NO: 3807 - protein, 8 aa, Artificial Sequence
  Peptide Derived from Human Papillomavirus
VIDCNDSM

SEQ ID NO: 3808 - protein, 11 aa, Artificial Sequence
  Peptide Derived from Human Papillomavirus
VIDCNDSMCST

SEQ ID NO: 3809 - protein, 8 aa, Artificial Sequence
  Peptide Derived from Human Papillomavirus
VQILVGYM

SEQ ID NO: 3810 - protein, 9 aa, Artificial Sequence
  Peptide Derived from Human Papillomavirus
VQILVGYMT

SEQ ID NO: 3811 - protein, 10 aa, Artificial Sequence
  Peptide Derived from Human Papillomavirus
VQILVGYMTM

SEQ ID NO: 3812 - protein, 10 aa, Artificial Sequence
  Peptide Derived from Human Papillomavirus
VTYHSETQRT

SEQ ID NO: 3813 - protein, 9 aa, Artificial Sequence
  Peptide Derived from Human Papillomavirus
WQLIRWENA

SEQ ID NO: 3814 - protein, 10 aa, Artificial Sequence
  Peptide Derived from Human Papillomavirus
WQLIRWENAI

SEQ ID NO: 3815 - protein, 9 aa, Artificial Sequence
  Peptide Derived from Human Papillomavirus
WTGAGNEKT

SEQ ID NO: 3816 - protein, 11 aa, Artificial Sequence
  Peptide Derived from Human Papillomavirus
WTGAGNEKTGI

SEQ ID NO: 3817 - protein, 10 aa, Artificial Sequence
  Peptide Derived from Human Papillomavirus
WTLQDTCEEL

SEQ ID NO: 3818 - protein, 11 aa, Artificial Sequence
  Peptide Derived from Human Papillomavirus
YMTDAGTWDKT

SEQ ID NO: 3819 - protein, 10 aa, Artificial Sequence
  Peptide Derived from Human Papillomavirus
YVAWDSVYYM

SEQ ID NO: 3820 - protein, 11 aa, Artificial Sequence
  Peptide Derived from Human Papillomavirus
YVAWDSVYYMT

SEQ ID NO: 3821 - protein, 8 aa, Artificial Sequence
  Peptide Derived from Human Papillomavirus
YVKEGYNT

SEQ ID NO: 3822 - protein, 11 aa, Artificial Sequence
  Peptide Derived from Human Papillomavirus
YVKEGYNTFYI

SEQ ID NO: 3823 - protein, 8 aa, Artificial Sequence
  Peptide Derived from Human Papillomavirus
ATAFTVYV

SEQ ID NO: 3824 - protein, 8 aa, Artificial Sequence
  Peptide Derived from Human Papillomavirus
CAYAWVLV

SEQ ID NO: 3825 - protein, 10 aa, Artificial Sequence
  Peptide Derived from Human Papillomavirus
CAYAWVLVFV

SEQ ID NO: 3826 - protein, 8 aa, Artificial Sequence
  Peptide Derived from Human Papillomavirus
CMCAYAWV

SEQ ID NO: 3827 - protein, 9 aa, Artificial Sequence
  Peptide Derived from Human Papillomavirus
CMCAYAWVL

SEQ ID NO: 3828 - protein, 10 aa, Artificial Sequence
  Peptide Derived from Human Papillomavirus
CMCAYAWVLV

SEQ ID NO: 3829 - protein, 8 aa, Artificial Sequence
  Peptide Derived from Human Papillomavirus
CMYVCCHV

SEQ ID NO: 3830 - protein, 10 aa, Artificial Sequence
  Peptide Derived from Human Papillomavirus
CMYVCCHVPL

SEQ ID NO: 3831 - protein, 11 aa, Artificial Sequence
  Peptide Derived from Human Papillomavirus
CMYVCCHVPLL

SEQ ID NO: 3832 - protein, 10 aa, Artificial Sequence
  Peptide Derived from Human Papillomavirus
CVCMYVCCHV

SEQ ID NO: 3833 - protein, 9 aa, Artificial Sequence
  Peptide Derived from Human Papillomavirus
FLFCFCVCM

SEQ ID NO: 3834 - protein, 11 aa, Artificial Sequence
  Peptide Derived from Human Papillomavirus
FLFCFCVCMYV

SEQ ID NO: 3835 - protein, 8 aa, Artificial Sequence
  Peptide Derived from Human Papillomavirus
FLLPMLLL

SEQ ID NO: 3836 - protein, 10 aa, Artificial Sequence
  Peptide Derived from Human Papillomavirus
FLLPMLLLHI

SEQ ID NO: 3837 - protein, 9 aa, Artificial Sequence
  Peptide Derived from Human Papillomavirus
FTVYVFCFL

SEQ ID NO: 3838 - protein, 10 aa, Artificial Sequence
  Peptide Derived from Human Papillomavirus
FTVYVFCFLL

SEQ ID NO: 3839 - protein, 8 aa, Artificial Sequence
  Peptide Derived from Human Papillomavirus
FVYIVVIT

SEQ ID NO: 3840 - protein, 11 aa, Artificial Sequence
  Peptide Derived from Human Papillomavirus
FVYIVVITSPA

SEQ ID NO: 3841 - protein, 8 aa, Artificial Sequence
  Peptide Derived from Human Papillomavirus
HIHAILSL

SEQ ID NO: 3842 - protein, 8 aa, Artificial Sequence
  Peptide Derived from Human Papillomavirus
HVPLLPSV

SEQ ID NO: 3843 - protein, 10 aa, Artificial Sequence
  Peptide Derived from Human Papillomavirus
HVPLLPSVCM

SEQ ID NO: 3844 - protein, 9 aa, Artificial Sequence
  Peptide Derived from Human Papillomavirus
ITSPATAFT

SEQ ID NO: 3845 - protein, 10 aa, Artificial Sequence
  Peptide Derived from Human Papillomavirus
ITSPATAFTV

SEQ ID NO: 3846 - protein, 8 aa, Artificial Sequence
  Peptide Derived from Human Papillomavirus
IVVITSPA

SEQ ID NO: 3847 - protein, 9 aa, Artificial Sequence
  Peptide Derived from Human Papillomavirus
IVVITSPAT

SEQ ID NO: 3848 - protein, 10 aa, Artificial Sequence
  Peptide Derived from Human Papillomavirus
IVVITSPATA

SEQ ID NO: 3849 - protein, 9 aa, Artificial Sequence
  Peptide Derived from Human Papillomavirus
LIFLFCFCV

SEQ ID NO: 3850 - protein, 11 aa, Artificial Sequence
  Peptide Derived from Human Papillomavirus
LIFLFCFCVCM

SEQ ID NO: 3851 - protein, 8 aa, Artificial Sequence
  Peptide Derived from Human Papillomavirus
LLHIHAIL

SEQ ID NO: 3852 - protein, 10 aa, Artificial Sequence
  Peptide Derived from Human Papillomavirus
LLHIHAILSL

SEQ ID NO: 3853 - protein, 8 aa, Artificial Sequence
  Peptide Derived from Human Papillomavirus
LLLHIHAI

SEQ ID NO: 3854 - protein, 9 aa, Artificial Sequence
  Peptide Derived from Human Papillomavirus
LLLHIHAIL

SEQ ID NO: 3855 - protein, 11 aa, Artificial Sequence
  Peptide Derived from Human Papillomavirus
LLLHIHAILSL

SEQ ID NO: 3856 - protein, 9 aa, Artificial Sequence
  Peptide Derived from Human Papillomavirus
LLPMLLLHI

SEQ ID NO: 3857 - protein, 11 aa, Artificial Sequence
  Peptide Derived from Human Papillomavirus
LLPMLLLHIHA

SEQ ID NO: 3858 - protein, 9 aa, Artificial Sequence
  Peptide Derived from Human Papillomavirus
LLPSVCMCA

SEQ ID NO: 3859 - protein, 11 aa, Artificial Sequence
  Peptide Derived from Human Papillomavirus
LLPSVCMCAYA

SEQ ID NO: 3860 - protein, 8 aa, Artificial Sequence
  Peptide Derived from Human Papillomavirus
LVFVYIVV

SEQ ID NO: 3861 - protein, 9 aa, Artificial Sequence
  Peptide Derived from Human Papillomavirus
LVFVYIVVI

SEQ ID NO: 3862 - protein, 10 aa, Artificial Sequence
  Peptide Derived from Human Papillomavirus
LVFVYIVVIT

SEQ ID NO: 3863 - protein, 8 aa, Artificial Sequence
  Peptide Derived from Human Papillomavirus
MLLLHIHA

SEQ ID NO: 3864 - protein, 9 aa, Artificial Sequence
  Peptide Derived from Human Papillomavirus
MLLLHIHAI

SEQ ID NO: 3865 - protein, 10 aa, Artificial Sequence
  Peptide Derived from Human Papillomavirus
MLLLHIHAIL

SEQ ID NO: 3866 - protein, 9 aa, Artificial Sequence
  Peptide Derived from Human Papillomavirus
PATAFTVYV

SEQ ID NO: 3867 - protein, 8 aa, Artificial Sequence
  Peptide Derived from Human Papillomavirus
PLLPSVCM

SEQ ID NO: 3868 - protein, 10 aa, Artificial Sequence
  Peptide Derived from Human Papillomavirus
PLLPSVCMCA

SEQ ID NO: 3869 - protein, 9 aa, Artificial Sequence
  Peptide Derived from Human Papillomavirus
PMLLLHIHA

SEQ ID NO: 3870 - protein, 10 aa, Artificial Sequence
  Peptide Derived from Human Papillomavirus
PMLLLHIHAI

SEQ ID NO: 3871 - protein, 11 aa, Artificial Sequence
  Peptide Derived from Human Papillomavirus
PMLLLHIHAIL

SEQ ID NO: 3872 - protein, 10 aa, Artificial Sequence
  Peptide Derived from Human Papillomavirus
SLIFLFCFCV

SEQ ID NO: 3873 - protein, 8 aa, Artificial Sequence
  Peptide Derived from Human Papillomavirus
SVCMCAYA

SEQ ID NO: 3874 - protein, 10 aa, Artificial Sequence
  Peptide Derived from Human Papillomavirus
SVCMCAYAWV

SEQ ID NO: 3875 - protein, 11 aa, Artificial Sequence
  Peptide Derived from Human Papillomavirus
SVCMCAYAWVL

SEQ ID NO: 3876 - protein, 11 aa, Artificial Sequence
  Peptide Derived from Human Papillomavirus
TAFTVYVFCFL

SEQ ID NO: 3877 - protein, 8 aa, Artificial Sequence
  Peptide Derived from Human Papillomavirus
TVYVFCFL

SEQ ID NO: 3878 - protein, 9 aa, Artificial Sequence
  Peptide Derived from Human Papillomavirus
TVYVFCFLL

SEQ ID NO: 3879 - protein, 11 aa, Artificial Sequence
  Peptide Derived from Human Papillomavirus
TVYVFCFLLPM

SEQ ID NO: 3880 - protein, 8 aa, Artificial Sequence
  Peptide Derived from Human Papillomavirus
VITSPATA

SEQ ID NO: 3881 - protein, 10 aa, Artificial Sequence
  Peptide Derived from Human Papillomavirus
VITSPATAFT

SEQ ID NO: 3882 - protein, 11 aa, Artificial Sequence
  Peptide Derived from Human Papillomavirus
VITSPATAFTV

SEQ ID NO: 3883 - protein, 8 aa, Artificial Sequence
  Peptide Derived from Human Papillomavirus
VLVFVYIV

SEQ ID NO: 3884 - protein, 9 aa, Artificial Sequence
  Peptide Derived from Human Papillomavirus
VLVFVYIVV

SEQ ID NO: 3885 - protein, 10 aa, Artificial Sequence
  Peptide Derived from Human Papillomavirus
VLVFVYIVVI

SEQ ID NO: 3886 - protein, 11 aa, Artificial Sequence
  Peptide Derived from Human Papillomavirus
VLVFVYIVVIT

SEQ ID NO: 3887 - protein, 8 aa, Artificial Sequence
  Peptide Derived from Human Papillomavirus
VVITSPAT

SEQ ID NO: 3888 - protein, 9 aa, Artificial Sequence
  Peptide Derived from Human Papillomavirus
VVITSPATA

SEQ ID NO: 3889 - protein, 11 aa, Artificial Sequence
  Peptide Derived from Human Papillomavirus
VVITSPATAFT

SEQ ID NO: 3890 - protein, 8 aa, Artificial Sequence
  Peptide Derived from Human Papillomavirus
WVLVFVYI

SEQ ID NO: 3891 - protein, 9 aa, Artificial Sequence
  Peptide Derived from Human Papillomavirus
WVLVFVYIV

SEQ ID NO: 3892 - protein, 10 aa, Artificial Sequence
  Peptide Derived from Human Papillomavirus
WVLVFVYIVV

SEQ ID NO: 3893 - protein, 11 aa, Artificial Sequence
  Peptide Derived from Human Papillomavirus
WVLVFVYIVVI

SEQ ID NO: 3894 - protein, 8 aa, Artificial Sequence
  Peptide Derived from Human Papillomavirus
YAWVLVFV

SEQ ID NO: 3895 - protein, 10 aa, Artificial Sequence
  Peptide Derived from Human Papillomavirus
YAWVLVFVYI

SEQ ID NO: 3896 - protein, 11 aa, Artificial Sequence
  Peptide Derived from Human Papillomavirus
YAWVLVFVYIV

SEQ ID NO: 3897 - protein, 9 aa, Artificial Sequence
  Peptide Derived from Human Papillomavirus
YIVVITSPA

SEQ ID NO: 3898 - protein, 10 aa, Artificial Sequence
  Peptide Derived from Human Papillomavirus
YIVVITSPAT

SEQ ID NO: 3899 - protein, 11 aa, Artificial Sequence
  Peptide Derived from Human Papillomavirus
YIVVITSPATA

SEQ ID NO: 3900 - protein, 8 aa, Artificial Sequence
  Peptide Derived from Human Papillomavirus
YVCCHVPL

SEQ ID NO: 3901 - protein, 9 aa, Artificial Sequence
  Peptide Derived from Human Papillomavirus
YVCCHVPLL

SEQ ID NO: 3902 - protein, 9 aa, Artificial Sequence
  Peptide Derived from Human Papillomavirus
YVFCFLLPM

SEQ ID NO: 3903 - protein, 10 aa, Artificial Sequence
  Peptide Derived from Human Papillomavirus
YVFCFLLPML

SEQ ID NO: 3904 - protein, 11 aa, Artificial Sequence
  Peptide Derived from Human Papillomavirus
YVFCFLLPMLL

SEQ ID NO: 3905 - protein, 8 aa, Artificial Sequence
  Peptide Derived from Human Papillomavirus
CIDFYSRI

SEQ ID NO: 3906 - protein, 11 aa, Artificial Sequence
  Peptide Derived from Human Papillomavirus
CIDFYSRIREL

SEQ ID NO: 3907 - protein, 8 aa, Artificial Sequence
  Peptide Derived from Human Papillomavirus
CLRCQKPL

SEQ ID NO: 3908 - protein, 11 aa, Artificial Sequence
  Peptide Derived from Human Papillomavirus
CLRCQKPLNPA

SEQ ID NO: 3909 - protein, 8 aa, Artificial Sequence
  Peptide Derived from Human Papillomavirus
CQKPLNPA

SEQ ID NO: 3910 - protein, 11 aa, Artificial Sequence
  Peptide Derived from Human Papillomavirus
CQKPLNPAEKL

SEQ ID NO: 3911 - protein, 8 aa, Artificial Sequence
  Peptide Derived from Human Papillomavirus
CTELNTSL

SEQ ID NO: 3912 - protein, 11 aa, Artificial Sequence
  Peptide Derived from Human Papillomavirus
CTELNTSLQDI

SEQ ID NO: 3913 - protein, 8 aa, Artificial Sequence
  Peptide Derived from Human Papillomavirus
CVYCKTVL

SEQ ID NO: 3914 - protein, 10 aa, Artificial Sequence
  Peptide Derived from Human Papillomavirus
CVYCKTVLEL

SEQ ID NO: 3915 - protein, 11 aa, Artificial Sequence
  Peptide Derived from Human Papillomavirus
CVYCKTVLELT

SEQ ID NO: 3916 - protein, 11 aa, Artificial Sequence
  Peptide Derived from Human Papillomavirus
DIEITCVYCKT

SEQ ID NO: 3917 - protein, 8 aa, Artificial Sequence
  Peptide Derived from Human Papillomavirus
DLCTELNT

SEQ ID NO: 3918 - protein, 10 aa, Artificial Sequence
  Peptide Derived from Human Papillomavirus
DLCTELNTSL

SEQ ID NO: 3919 - protein, 10 aa, Artificial Sequence
  Peptide Derived from Human Papillomavirus
DLFVVYRDSI

SEQ ID NO: 3920 - protein, 9 aa, Artificial Sequence
  Peptide Derived from Human Papillomavirus
DTLEKLTNT

SEQ ID NO: 3921 - protein, 11 aa, Artificial Sequence
  Peptide Derived from Human Papillomavirus
DTLEKLTNTGL

SEQ ID NO: 3922 - protein, 9 aa, Artificial Sequence
  Peptide Derived from Human Papillomavirus
EITCVYCKT

SEQ ID NO: 3923 - protein, 10 aa, Artificial Sequence
  Peptide Derived from Human Papillomavirus
EITCVYCKTV

SEQ ID NO: 3924 - protein, 11 aa, Artificial Sequence
  Peptide Derived from Human Papillomavirus
EITCVYCKTVL

SEQ ID NO: 3925 - protein, 9 aa, Artificial Sequence
  Peptide Derived from Human Papillomavirus
ELNTSLQDI

SEQ ID NO: 3926 - protein, 11 aa, Artificial Sequence
  Peptide Derived from Human Papillomavirus
ELNTSLQDIEI

SEQ ID NO: 3927 - protein, 9 aa, Artificial Sequence
  Peptide Derived from Human Papillomavirus
ELRHYSDSV

SEQ ID NO: 3928 - protein, 9 aa, Artificial Sequence
  Peptide Derived from Human Papillomavirus
ELTEVFEFA

SEQ ID NO: 3929 - protein, 10 aa, Artificial Sequence
  Peptide Derived from Human Papillomavirus
EVFEFAFKDL

SEQ ID NO: 3930 - protein, 8 aa, Artificial Sequence
  Peptide Derived from Human Papillomavirus
FAFKDLFV

SEQ ID NO: 3931 - protein, 9 aa, Artificial Sequence
  Peptide Derived from Human Papillomavirus
FAFKDLFVV

SEQ ID NO: 3932 - protein, 8 aa, Artificial Sequence
  Peptide Derived from Human Papillomavirus
FVVYRDSI

SEQ ID NO: 3933 - protein, 11 aa, Artificial Sequence
  Peptide Derived from Human Papillomavirus
FVVYRDSIPHA

SEQ ID NO: 3934 - protein, 10 aa, Artificial Sequence
  Peptide Derived from Human Papillomavirus
GLYNLLIRCL

SEQ ID NO: 3935 - protein, 10 aa, Artificial Sequence
  Peptide Derived from Human Papillomavirus
GQCHSCCNRA

SEQ ID NO: 3936 - protein, 8 aa, Artificial Sequence
  Peptide Derived from Human Papillomavirus
HAACHKCI

SEQ ID NO: 3937 - protein, 11 aa, Artificial Sequence
  Peptide Derived from Human Papillomavirus
HLNEKRRFHNI

SEQ ID NO: 3938 - protein, 8 aa, Artificial Sequence
  Peptide Derived from Human Papillomavirus
ITCVYCKT

SEQ ID NO: 3939 - protein, 9 aa, Artificial Sequence
  Peptide Derived from Human Papillomavirus
ITCVYCKTV

SEQ ID NO: 3940 - protein, 10 aa, Artificial Sequence
  Peptide Derived from Human Papillomavirus
ITCVYCKTVL

SEQ ID NO: 3941 - protein, 9 aa, Artificial Sequence
  Peptide Derived from Human Papillomavirus
KLPDLCTEL

SEQ ID NO: 3942 - protein, 11 aa, Artificial Sequence
  Peptide Derived from Human Papillomavirus
KLPDLCTELNT

SEQ ID NO: 3943 - protein, 10 aa, Artificial Sequence
  Peptide Derived from Human Papillomavirus
KLTNTGLYNL

SEQ ID NO: 3944 - protein, 11 aa, Artificial Sequence
  Peptide Derived from Human Papillomavirus
KLTNTGLYNLL

SEQ ID NO: 3945 - protein, 9 aa, Artificial Sequence
  Peptide Derived from Human Papillomavirus
KTVLELTEV

SEQ ID NO: 3946 - protein, 11 aa, Artificial Sequence
  Peptide Derived from Human Papillomavirus
LIRCLRCQKPL

SEQ ID NO: 3947 - protein, 9 aa, Artificial Sequence
  Peptide Derived from Human Papillomavirus
LQDIEITCV

SEQ ID NO: 3948 - protein, 9 aa, Artificial Sequence
  Peptide Derived from Human Papillomavirus
LQRRRETQV

SEQ ID NO: 3949 - protein, 8 aa, Artificial Sequence
  Peptide Derived from Human Papillomavirus
LTEVFEFA

SEQ ID NO: 3950 - protein, 9 aa, Artificial Sequence
  Peptide Derived from Human Papillomavirus
LTNTGLYNL

SEQ ID NO: 3951 - protein, 10 aa, Artificial Sequence
  Peptide Derived from Human Papillomavirus
LTNTGLYNLL

SEQ ID NO: 3952 - protein, 11 aa, Artificial Sequence
  Peptide Derived from Human Papillomavirus
LTNTGLYNLLI

SEQ ID NO: 3953 - protein, 8 aa, Artificial Sequence
  Peptide Derived from Human Papillomavirus
MARFEDPT

SEQ ID NO: 3954 - protein, 8 aa, Artificial Sequence
  Peptide Derived from Human Papillomavirus
NTGLYNLL

SEQ ID NO: 3955 - protein, 9 aa, Artificial Sequence
  Peptide Derived from Human Papillomavirus
NTGLYNLLI

SEQ ID NO: 3956 - protein, 9 aa, Artificial Sequence
  Peptide Derived from Human Papillomavirus
NTSLQDIEI

SEQ ID NO: 3957 - protein, 10 aa, Artificial Sequence
  Peptide Derived from Human Papillomavirus
NTSLQDIEIT

SEQ ID NO: 3958 - protein, 8 aa, Artificial Sequence
  Peptide Derived from Human Papillomavirus
PAEKLRHL

SEQ ID NO: 3959 - protein, 8 aa, Artificial Sequence
  Peptide Derived from Human Papillomavirus
PLNPAEKL

SEQ ID NO: 3960 - protein, 11 aa, Artificial Sequence
  Peptide Derived from Human Papillomavirus
PLNPAEKLRHL

SEQ ID NO: 3961 - protein, 8 aa, Artificial Sequence
  Peptide Derived from Human Papillomavirus
PTRRPYKL

SEQ ID NO: 3962 - protein, 11 aa, Artificial Sequence
  Peptide Derived from Human Papillomavirus
PTRRPYKLPDL

SEQ ID NO: 3963 - protein, 8 aa, Artificial Sequence
  Peptide Derived from Human Papillomavirus
RLQRRRET

SEQ ID NO: 3964 - protein, 10 aa, Artificial Sequence
  Peptide Derived from Human Papillomavirus
RLQRRRETQV

SEQ ID NO: 3965 - protein, 11 aa, Artificial Sequence
  Peptide Derived from Human Papillomavirus
RQERLQRRRET

SEQ ID NO: 3966 - protein, 11 aa, Artificial Sequence
  Peptide Derived from Human Papillomavirus
SIPHAACHKCI

SEQ ID NO: 3967 - protein, 8 aa, Artificial Sequence
  Peptide Derived from Human Papillomavirus
SLQDIEIT

SEQ ID NO: 3968 - protein, 10 aa, Artificial Sequence
  Peptide Derived from Human Papillomavirus
SLQDIEITCV

SEQ ID NO: 3969 - protein, 10 aa, Artificial Sequence
  Peptide Derived from Human Papillomavirus
SVYGDTLEKL

SEQ ID NO: 3970 - protein, 11 aa, Artificial Sequence
  Peptide Derived from Human Papillomavirus
SVYGDTLEKLT

SEQ ID NO: 3971 - protein, 8 aa, Artificial Sequence
  Peptide Derived from Human Papillomavirus
TLEKLTNT

SEQ ID NO: 3972 - protein, 10 aa, Artificial Sequence
  Peptide Derived from Human Papillomavirus
TLEKLTNTGL

SEQ ID NO: 3973 - protein, 8 aa, Artificial Sequence
  Peptide Derived from Human Papillomavirus
TVLELTEV

SEQ ID NO: 3974 - protein, 11 aa, Artificial Sequence
  Peptide Derived from Human Papillomavirus
VLELTEVFEFA

SEQ ID NO: 3975 - protein, 10 aa, Artificial Sequence
  Peptide Derived from Human Papillomavirus
VVYRDSIPHA

SEQ ID NO: 3976 - protein, 11 aa, Artificial Sequence
  Peptide Derived from Human Papillomavirus
VVYRDSIPHAA

SEQ ID NO: 3977 - protein, 8 aa, Artificial Sequence
  Peptide Derived from Human Papillomavirus
ATLQDIVL

SEQ ID NO: 3978 - protein, 10 aa, Artificial Sequence
  Peptide Derived from Human Papillomavirus
ATLQDIVLHL

SEQ ID NO: 3979 - protein, 8 aa, Artificial Sequence
  Peptide Derived from Human Papillomavirus
CMCCKCEA

SEQ ID NO: 3980 - protein, 10 aa, Artificial Sequence
  Peptide Derived from Human Papillomavirus
CMCCKCEARI

SEQ ID NO: 3981 - protein, 8 aa, Artificial Sequence
  Peptide Derived from Human Papillomavirus
DLLCHEQL

SEQ ID NO: 3982 - protein, 8 aa, Artificial Sequence
  Peptide Derived from Human Papillomavirus
DLRAFQQL

SEQ ID NO: 3983 - protein, 10 aa, Artificial Sequence
  Peptide Derived from Human Papillomavirus
DLRAFQQLFL

SEQ ID NO: 3984 - protein, 8 aa, Artificial Sequence
  Peptide Derived from Human Papillomavirus
EARIKLVV

SEQ ID NO: 3985 - protein, 10 aa, Artificial Sequence
  Peptide Derived from Human Papillomavirus
EIDGVNHQHL

SEQ ID NO: 3986 - protein, 8 aa, Artificial Sequence
  Peptide Derived from Human Papillomavirus
FLNTLSFV

SEQ ID NO: 3987 - protein, 8 aa, Artificial Sequence
  Peptide Derived from Human Papillomavirus
FQQLFLNT

SEQ ID NO: 3988 - protein, 9 aa, Artificial Sequence
  Peptide Derived from Human Papillomavirus
FQQLFLNTL

SEQ ID NO: 3989 - protein, 9 aa, Artificial Sequence
  Peptide Derived from Human Papillomavirus
GVNHQHLPA

SEQ ID NO: 3990 - protein, 8 aa, Artificial Sequence
  Peptide Derived from Human Papillomavirus
HLEPQNEI

SEQ ID NO: 3991 - protein, 10 aa, Artificial Sequence
  Peptide Derived from Human Papillomavirus
HLEPQNEIPV

SEQ ID NO: 3992 - protein, 9 aa, Artificial Sequence
  Peptide Derived from Human Papillomavirus
HQHLPARRA

SEQ ID NO: 3993 - protein, 11 aa, Artificial Sequence
  Peptide Derived from Human Papillomavirus
IVLHLEPQNEI

SEQ ID NO: 3994 - protein, 8 aa, Artificial Sequence
  Peptide Derived from Human Papillomavirus
KATLQDIV

SEQ ID NO: 3995 - protein, 9 aa, Artificial Sequence
  Peptide Derived from Human Papillomavirus
KATLQDIVL

SEQ ID NO: 3996 - protein, 11 aa, Artificial Sequence
  Peptide Derived from Human Papillomavirus
KATLQDIVLHL

SEQ ID NO: 3997 - protein, 8 aa, Artificial Sequence
  Peptide Derived from Human Papillomavirus
KLVVESSA

SEQ ID NO: 3998 - protein, 11 aa, Artificial Sequence
  Peptide Derived from Human Papillomavirus
KLVVESSADDL

SEQ ID NO: 3999 - protein, 8 aa, Artificial Sequence
  Peptide Derived from Human Papillomavirus
LQDIVLHL

SEQ ID NO: 4000 - protein, 10 aa, Artificial Sequence
  Peptide Derived from Human Papillomavirus
LVVESSADDL

SEQ ID NO: 4001 - protein, 10 aa, Artificial Sequence
  Peptide Derived from Human Papillomavirus
MLCMCCKCEA

SEQ ID NO: 4002 - protein, 11 aa, Artificial Sequence
  Peptide Derived from Human Papillomavirus
NTLSFVCPWCA

SEQ ID NO: 4003 - protein, 11 aa, Artificial Sequence
  Peptide Derived from Human Papillomavirus
PARRAEPQRHT

SEQ ID NO: 4004 - protein, 9 aa, Artificial Sequence
  Peptide Derived from Human Papillomavirus
PQNEIPVDL

SEQ ID NO: 4005 - protein, 10 aa, Artificial Sequence
  Peptide Derived from Human Papillomavirus
PQNEIPVDLL

SEQ ID NO: 4006 - protein, 9 aa, Artificial Sequence
  Peptide Derived from Human Papillomavirus
PQRHTMLCM

SEQ ID NO: 4007 - protein, 10 aa, Artificial Sequence
  Peptide Derived from Human Papillomavirus
PVDLLCHEQL

SEQ ID NO: 4008 - protein, 10 aa, Artificial Sequence
  Peptide Derived from Human Papillomavirus
QLFLNTLSFV

SEQ ID NO: 4009 - protein, 8 aa, Artificial Sequence
  Peptide Derived from Human Papillomavirus
QQLFLNTL

SEQ ID NO: 4010 - protein, 11 aa, Artificial Sequence
  Peptide Derived from Human Papillomavirus
QQLFLNTLSFV

SEQ ID NO: 4011 - protein, 8 aa, Artificial Sequence
  Peptide Derived from Human Papillomavirus
RAEPQRHT

SEQ ID NO: 4012 - protein, 9 aa, Artificial Sequence
  Peptide Derived from Human Papillomavirus
RAEPQRHTM

SEQ ID NO: 4013 - protein, 10 aa, Artificial Sequence
  Peptide Derived from Human Papillomavirus
RAEPQRHTML

SEQ ID NO: 4014 - protein, 8 aa, Artificial Sequence
  Peptide Derived from Human Papillomavirus
RAFQQLFL

SEQ ID NO: 4015 - protein, 10 aa, Artificial Sequence
  Peptide Derived from Human Papillomavirus
RAFQQLFLNT

SEQ ID NO: 4016 - protein, 11 aa, Artificial Sequence
  Peptide Derived from Human Papillomavirus
RAFQQLFLNTL

SEQ ID NO: 4017 - protein, 10 aa, Artificial Sequence
  Peptide Derived from Human Papillomavirus
RIKLVVESSA

SEQ ID NO: 4018 - protein, 11 aa, Artificial Sequence
  Peptide Derived from Human Papillomavirus
SADDLRAFQQL

SEQ ID NO: 4019 - protein, 9 aa, Artificial Sequence
  Peptide Derived from Human Papillomavirus
TLQDIVLHL

SEQ ID NO: 4020 - protein, 10 aa, Artificial Sequence
  Peptide Derived from Human Papillomavirus
TLSFVCPWCA

SEQ ID NO: 4021 - protein, 11 aa, Artificial Sequence
  Peptide Derived from Human Papillomavirus
TMLCMCCKCEA

SEQ ID NO: 4022 - protein, 10 aa, Artificial Sequence
  Peptide Derived from Human Papillomavirus
VLHLEPQNEI

SEQ ID NO: 4023 - protein, 9 aa, Artificial Sequence
  Peptide Derived from Human Papillomavirus
VVESSADDL

SEQ ID NO: 4024 - protein, 11 aa, Artificial Sequence
  Peptide Derived from Human Papillomavirus
VVESSADDLRA

SEQ ID NO: 4025 - protein, 10 aa, Artificial Sequence
  Peptide Derived from Human Papillomavirus
AATSNVSEDV

SEQ ID NO: 4026 - protein, 10 aa, Artificial Sequence
  Peptide Derived from Human Papillomavirus
AIGEHWAKGT

SEQ ID NO: 4027 - protein, 11 aa, Artificial Sequence
  Peptide Derived from Human Papillomavirus
AIGEHWAKGTA

SEQ ID NO: 4028 - protein, 8 aa, Artificial Sequence
  Peptide Derived from Human Papillomavirus
AITCQKDA

SEQ ID NO: 4029 - protein, 9 aa, Artificial Sequence
  Peptide Derived from Human Papillomavirus
AITCQKDAA

SEQ ID NO: 4030 - protein, 11 aa, Artificial Sequence
  Peptide Derived from Human Papillomavirus
AITCQKDAAPA

SEQ ID NO: 4031 - protein, 9 aa, Artificial Sequence
  Peptide Derived from Human Papillomavirus
ALWRPSDNT

SEQ ID NO: 4032 - protein, 10 aa, Artificial Sequence
  Peptide Derived from Human Papillomavirus
ALWRPSDNTV

SEQ ID NO: 4033 - protein, 10 aa, Artificial Sequence
  Peptide Derived from Human Papillomavirus
AMDFSTLQDT

SEQ ID NO: 4034 - protein, 8 aa, Artificial Sequence
  Peptide Derived from Human Papillomavirus
AQGHNNGV

SEQ ID NO: 4035 - protein, 11 aa, Artificial Sequence
  Peptide Derived from Human Papillomavirus
ATKFKQYSRHV

SEQ ID NO: 4036 - protein, 9 aa, Artificial Sequence
  Peptide Derived from Human Papillomavirus
ATSNVSEDV

SEQ ID NO: 4037 - protein, 8 aa, Artificial Sequence
  Peptide Derived from Human Papillomavirus
ATTSSKPA

SEQ ID NO: 4038 - protein, 11 aa, Artificial Sequence
  Peptide Derived from Human Papillomavirus
ATTSSKPAKRV

SEQ ID NO: 4039 - protein, 10 aa, Artificial Sequence
  Peptide Derived from Human Papillomavirus
CAPAIGEHWA

SEQ ID NO: 4040 - protein, 8 aa, Artificial Sequence
  Peptide Derived from Human Papillomavirus
CASTQSPV

SEQ ID NO: 4041 - protein, 8 aa, Artificial Sequence
  Peptide Derived from Human Papillomavirus
CILGCAPA

SEQ ID NO: 4042 - protein, 9 aa, Artificial Sequence
  Peptide Derived from Human Papillomavirus
CILGCAPAI

SEQ ID NO: 4043 - protein, 9 aa, Artificial Sequence
  Peptide Derived from Human Papillomavirus
CLRREQLFA

SEQ ID NO: 4044 - protein, 8 aa, Artificial Sequence
  Peptide Derived from Human Papillomavirus
CLYTRVLI

SEQ ID NO: 4045 - protein, 9 aa, Artificial Sequence
  Peptide Derived from Human Papillomavirus
CLYTRVLIL

SEQ ID NO: 4046 - protein, 8 aa, Artificial Sequence
  Peptide Derived from Human Papillomavirus
CQKDAAPA

SEQ ID NO: 4047 - protein, 11 aa, Artificial Sequence
  Peptide Derived from Human Papillomavirus
CQSICKYPDYL

SEQ ID NO: 4048 - protein, 9 aa, Artificial Sequence
  Peptide Derived from Human Papillomavirus
CTITLTADV

SEQ ID NO: 4049 - protein, 10 aa, Artificial Sequence
  Peptide Derived from Human Papillomavirus
CTITLTADVM

SEQ ID NO: 4050 - protein, 11 aa, Artificial Sequence
  Peptide Derived from Human Papillomavirus
CVYSPSPSGSI

SEQ ID NO: 4051 - protein, 8 aa, Artificial Sequence
  Peptide Derived from Human Papillomavirus
DLKEKFSL

SEQ ID NO: 4052 - protein, 10 aa, Artificial Sequence
  Peptide Derived from Human Papillomavirus
DLKEKFSLDL

SEQ ID NO: 4053 - protein, 8 aa, Artificial Sequence
  Peptide Derived from Human Papillomavirus
DLQFIFQL

SEQ ID NO: 4054 - protein, 10 aa, Artificial Sequence
  Peptide Derived from Human Papillomavirus
DLQFIFQLCT

SEQ ID NO: 4055 - protein, 11 aa, Artificial Sequence
  Peptide Derived from Human Papillomavirus
DLQFIFQLCTI

SEQ ID NO: 4056 - protein, 9 aa, Artificial Sequence
  Peptide Derived from Human Papillomavirus
DMVDTGYGA

SEQ ID NO: 4057 - protein, 10 aa, Artificial Sequence
  Peptide Derived from Human Papillomavirus
DMVDTGYGAM

SEQ ID NO: 4058 - protein, 10 aa, Artificial Sequence
  Peptide Derived from Human Papillomavirus
DQYPLGRKFL

SEQ ID NO: 4059 - protein, 11 aa, Artificial Sequence
  Peptide Derived from Human Papillomavirus
DQYPLGRKFLV

SEQ ID NO: 4060 - protein, 8 aa, Artificial Sequence
  Peptide Derived from Human Papillomavirus
DTESSHAA

SEQ ID NO: 4061 - protein, 9 aa, Artificial Sequence
  Peptide Derived from Human Papillomavirus
DTESSHAAT

SEQ ID NO: 4062 - protein, 11 aa, Artificial Sequence
  Peptide Derived from Human Papillomavirus
DTGYGAMDFST

SEQ ID NO: 4063 - protein, 8 aa, Artificial Sequence
  Peptide Derived from Human Papillomavirus
DTKCEVPL

SEQ ID NO: 4064 - protein, 10 aa, Artificial Sequence
  Peptide Derived from Human Papillomavirus
DTKCEVPLDI

SEQ ID NO: 4065 - protein, 9 aa, Artificial Sequence
  Peptide Derived from Human Papillomavirus
DTSIYNPET

SEQ ID NO: 4066 - protein, 8 aa, Artificial Sequence
  Peptide Derived from Human Papillomavirus
DTTPSTNL

SEQ ID NO: 4067 - protein, 9 aa, Artificial Sequence
  Peptide Derived from Human Papillomavirus
DTTPSTNLT

SEQ ID NO: 4068 - protein, 10 aa, Artificial Sequence
  Peptide Derived from Human Papillomavirus
DTTPSTNLTI

SEQ ID NO: 4069 - protein, 9 aa, Artificial Sequence
  Peptide Derived from Human Papillomavirus
DTVPQSLYI

SEQ ID NO: 4070 - protein, 9 aa, Artificial Sequence
  Peptide Derived from Human Papillomavirus
DTYRFVQSV

SEQ ID NO: 4071 - protein, 10 aa, Artificial Sequence
  Peptide Derived from Human Papillomavirus
DTYRFVQSVA

SEQ ID NO: 4072 - protein, 11 aa, Artificial Sequence
  Peptide Derived from Human Papillomavirus
DTYRFVQSVAI

SEQ ID NO: 4073 - protein, 9 aa, Artificial Sequence
  Peptide Derived from Human Papillomavirus
DVMSYIHSM

SEQ ID NO: 4074 - protein, 8 aa, Artificial Sequence
  Peptide Derived from Human Papillomavirus
DVRDNVSV

SEQ ID NO: 4075 - protein, 8 aa, Artificial Sequence
  Peptide Derived from Human Papillomavirus
EIGRGQPL

SEQ ID NO: 4076 - protein, 10 aa, Artificial Sequence
  Peptide Derived from Human Papillomavirus
EIGRGQPLGV

SEQ ID NO: 4077 - protein, 8 aa, Artificial Sequence
  Peptide Derived from Human Papillomavirus
ETQRLVWA

SEQ ID NO: 4078 - protein, 10 aa, Artificial Sequence
  Peptide Derived from Human Papillomavirus
ETQRLVWACA

SEQ ID NO: 4079 - protein, 10 aa, Artificial Sequence
  Peptide Derived from Human Papillomavirus
EVPLDICQSI

SEQ ID NO: 4080 - protein, 9 aa, Artificial Sequence
  Peptide Derived from Human Papillomavirus
FARHFWNRA

SEQ ID NO: 4081 - protein, 11 aa, Artificial Sequence
  Peptide Derived from Human Papillomavirus
FARHFWNRAGT

SEQ ID NO: 4082 - protein, 8 aa, Artificial Sequence
  Peptide Derived from Human Papillomavirus
FIFQLCTI

SEQ ID NO: 4083 - protein, 9 aa, Artificial Sequence
  Peptide Derived from Human Papillomavirus
FIFQLCTIT

SEQ ID NO: 4084 - protein, 10 aa, Artificial Sequence
  Peptide Derived from Human Papillomavirus
FIFQLCTITL

SEQ ID NO: 4085 - protein, 11 aa, Artificial Sequence
  Peptide Derived from Human Papillomavirus
FIFQLCTITLT

SEQ ID NO: 4086 - protein, 10 aa, Artificial Sequence
  Peptide Derived from Human Papillomavirus
FLRNVNVFPI

SEQ ID NO: 4087 - protein, 8 aa, Artificial Sequence
  Peptide Derived from Human Papillomavirus
FQLCTITL

SEQ ID NO: 4088 - protein, 9 aa, Artificial Sequence
  Peptide Derived from Human Papillomavirus
FQLCTITLT

SEQ ID NO: 4089 - protein, 10 aa, Artificial Sequence
  Peptide Derived from Human Papillomavirus
FQLCTITLTA

SEQ ID NO: 4090 - protein, 8 aa, Artificial Sequence
  Peptide Derived from Human Papillomavirus
FVQSVAIT

SEQ ID NO: 4091 - protein, 8 aa, Artificial Sequence
  Peptide Derived from Human Papillomavirus
FVTVVDTT

SEQ ID NO: 4092 - protein, 11 aa, Artificial Sequence
  Peptide Derived from Human Papillomavirus
FVTVVDTTPST

SEQ ID NO: 4093 - protein, 8 aa, Artificial Sequence
  Peptide Derived from Human Papillomavirus
GAMDFSTL

SEQ ID NO: 4094 - protein, 11 aa, Artificial Sequence
  Peptide Derived from Human Papillomavirus
GAMDFSTLQDT

SEQ ID NO: 4095 - protein, 8 aa, Artificial Sequence
  Peptide Derived from Human Papillomavirus
GLRRKPTI

SEQ ID NO: 4096 - protein, 11 aa, Artificial Sequence
  Peptide Derived from Human Papillomavirus
GLSGHPFYNKL

SEQ ID NO: 4097 - protein, 10 aa, Artificial Sequence
  Peptide Derived from Human Papillomavirus
GMPASPGSCV

SEQ ID NO: 4098 - protein, 8 aa, Artificial Sequence
  Peptide Derived from Human Papillomavirus
GQPLGVGL

SEQ ID NO: 4099 - protein, 9 aa, Artificial Sequence
  Peptide Derived from Human Papillomavirus
GTACKSRPL

SEQ ID NO: 4100 - protein, 11 aa, Artificial Sequence
  Peptide Derived from Human Papillomavirus
GTMGDTVPQSL

SEQ ID NO: 4101 - protein, 8 aa, Artificial Sequence
  Peptide Derived from Human Papillomavirus
GVCWHNQL

SEQ ID NO: 4102 - protein, 10 aa, Artificial Sequence
  Peptide Derived from Human Papillomavirus
GVCWHNQLFV

SEQ ID NO: 4103 - protein, 11 aa, Artificial Sequence
  Peptide Derived from Human Papillomavirus
GVCWHNQLFVT

SEQ ID NO: 4104 - protein, 10 aa, Artificial Sequence
  Peptide Derived from Human Papillomavirus
GVEIGRGQPL

SEQ ID NO: 4105 - protein, 8 aa, Artificial Sequence
  Peptide Derived from Human Papillomavirus
GVPPPPTT

SEQ ID NO: 4106 - protein, 10 aa, Artificial Sequence
  Peptide Derived from Human Papillomavirus
GVPPPPTTSL

SEQ ID NO: 4107 - protein, 11 aa, Artificial Sequence
  Peptide Derived from Human Papillomavirus
GVPPPPTTSLV

SEQ ID NO: 4108 - protein, 11 aa, Artificial Sequence
  Peptide Derived from Human Papillomavirus
HAATSNVSEDV

SEQ ID NO: 4109 - protein, 8 aa, Artificial Sequence
  Peptide Derived from Human Papillomavirus
HAGSSRLL

SEQ ID NO: 4110 - protein, 9 aa, Artificial Sequence
  Peptide Derived from Human Papillomavirus
HAGSSRLLT

SEQ ID NO: 4111 - protein, 10 aa, Artificial Sequence
  Peptide Derived from Human Papillomavirus
HAGSSRLLTV

SEQ ID NO: 4112 - protein, 9 aa, Artificial Sequence
  Peptide Derived from Human Papillomavirus
HIIICGHYI

SEQ ID NO: 4113 - protein, 10 aa, Artificial Sequence
  Peptide Derived from Human Papillomavirus
HIIICGHYII

SEQ ID NO: 4114 - protein, 11 aa, Artificial Sequence
  Peptide Derived from Human Papillomavirus
HIIICGHYIIL

SEQ ID NO: 4115 - protein, 9 aa, Artificial Sequence
  Peptide Derived from Human Papillomavirus
HLLPLYGPL

SEQ ID NO: 4116 - protein, 10 aa, Artificial Sequence
  Peptide Derived from Human Papillomavirus
HVEEYDLQFI

SEQ ID NO: 4117 - protein, 8 aa, Artificial Sequence
  Peptide Derived from Human Papillomavirus
IICGHYII

SEQ ID NO: 4118 - protein, 9 aa, Artificial Sequence
  Peptide Derived from Human Papillomavirus
IICGHYIIL

SEQ ID NO: 4119 - protein, 11 aa, Artificial Sequence
  Peptide Derived from Human Papillomavirus
IICGHYIILFL

SEQ ID NO: 4120 - protein, 8 aa, Artificial Sequence
  Peptide Derived from Human Papillomavirus
IIICGHYI

SEQ ID NO: 4121 - protein, 9 aa, Artificial Sequence
  Peptide Derived from Human Papillomavirus
IIICGHYII

SEQ ID NO: 4122 - protein, 10 aa, Artificial Sequence
  Peptide Derived from Human Papillomavirus
IIICGHYIIL

SEQ ID NO: 4123 - protein, 8 aa, Artificial Sequence
  Peptide Derived from Human Papillomavirus
IILFLRNV

SEQ ID NO: 4124 - protein, 10 aa, Artificial Sequence
  Peptide Derived from Human Papillomavirus
IILFLRNVNV

SEQ ID NO: 4125 - protein, 9 aa, Artificial Sequence
  Peptide Derived from Human Papillomavirus
ILEDWNFGV

SEQ ID NO: 4126 - protein, 9 aa, Artificial Sequence
  Peptide Derived from Human Papillomavirus
ILFLRNVNV

SEQ ID NO: 4127 - protein, 8 aa, Artificial Sequence
  Peptide Derived from Human Papillomavirus
ILGCAPAI

SEQ ID NO: 4128 - protein, 9 aa, Artificial Sequence
  Peptide Derived from Human Papillomavirus
ILHYHLLPL

SEQ ID NO: 4129 - protein, 8 aa, Artificial Sequence
  Peptide Derived from Human Papillomavirus
ILVYMVHI

SEQ ID NO: 4130 - protein, 9 aa, Artificial Sequence
  Peptide Derived from Human Papillomavirus
ILVYMVHII

SEQ ID NO: 4131 - protein, 10 aa, Artificial Sequence
  Peptide Derived from Human Papillomavirus
ILVYMVHIII

SEQ ID NO: 4132 - protein, 8 aa, Artificial Sequence
  Peptide Derived from Human Papillomavirus
ITCQKDAA

SEQ ID NO: 4133 - protein, 10 aa, Artificial Sequence
  Peptide Derived from Human Papillomavirus
ITCQKDAAPA

SEQ ID NO: 4134 - protein, 8 aa, Artificial Sequence
  Peptide Derived from Human Papillomavirus
ITLTADVM

SEQ ID NO: 4135 - protein, 11 aa, Artificial Sequence
  Peptide Derived from Human Papillomavirus
ITLTADVMSYI

SEQ ID NO: 4136 - protein, 8 aa, Artificial Sequence
  Peptide Derived from Human Papillomavirus
IVTSDSQL

SEQ ID NO: 4137 - protein, 9 aa, Artificial Sequence
  Peptide Derived from Human Papillomavirus
KAQGHNNGV

SEQ ID NO: 4138 - protein, 10 aa, Artificial Sequence
  Peptide Derived from Human Papillomavirus
KLDDTESSHA

SEQ ID NO: 4139 - protein, 11 aa, Artificial Sequence
  Peptide Derived from Human Papillomavirus
KLDDTESSHAA

SEQ ID NO: 4140 - protein, 9 aa, Artificial Sequence
  Peptide Derived from Human Papillomavirus
KLKFWNVDL

SEQ ID NO: 4141 - protein, 9 aa, Artificial Sequence
  Peptide Derived from Human Papillomavirus
KQDIPKVSA

SEQ ID NO: 4142 - protein, 8 aa, Artificial Sequence
  Peptide Derived from Human Papillomavirus
KQTQLCIL

SEQ ID NO: 4143 - protein, 11 aa, Artificial Sequence
  Peptide Derived from Human Papillomavirus
KQTQLCILGCA

SEQ ID NO: 4144 - protein, 9 aa, Artificial Sequence
  Peptide Derived from Human Papillomavirus
KVSAYQYRV

SEQ ID NO: 4145 - protein, 8 aa, Artificial Sequence
  Peptide Derived from Human Papillomavirus
LILHYHLL

SEQ ID NO: 4146 - protein, 10 aa, Artificial Sequence
  Peptide Derived from Human Papillomavirus
LILHYHLLPL

SEQ ID NO: 4147 - protein, 8 aa, Artificial Sequence
  Peptide Derived from Human Papillomavirus
LLPLYGPL

SEQ ID NO: 4148 - protein, 11 aa, Artificial Sequence
  Peptide Derived from Human Papillomavirus
LLTVGNPYFRV

SEQ ID NO: 4149 - protein, 8 aa, Artificial Sequence
  Peptide Derived from Human Papillomavirus
LQDTKCEV

SEQ ID NO: 4150 - protein, 10 aa, Artificial Sequence
  Peptide Derived from Human Papillomavirus
LQDTKCEVPL

SEQ ID NO: 4151 - protein, 9 aa, Artificial Sequence
  Peptide Derived from Human Papillomavirus
LQFIFQLCT

SEQ ID NO: 4152 - protein, 10 aa, Artificial Sequence
  Peptide Derived from Human Papillomavirus
LQFIFQLCTI

SEQ ID NO: 4153 - protein, 11 aa, Artificial Sequence
  Peptide Derived from Human Papillomavirus
LQFIFQLCTIT

SEQ ID NO: 4154 - protein, 9 aa, Artificial Sequence
  Peptide Derived from Human Papillomavirus
LTADVMSYI

SEQ ID NO: 4155 - protein, 11 aa, Artificial Sequence
  Peptide Derived from Human Papillomavirus
LTICASTQSPV

SEQ ID NO: 4156 - protein, 10 aa, Artificial Sequence
  Peptide Derived from Human Papillomavirus
LTVGNPYFRV

SEQ ID NO: 4157 - protein, 8 aa, Artificial Sequence
  Peptide Derived from Human Papillomavirus
LVDTYRFV

SEQ ID NO: 4158 - protein, 11 aa, Artificial Sequence
  Peptide Derived from Human Papillomavirus
LVDTYRFVQSV

SEQ ID NO: 4159 - protein, 11 aa, Artificial Sequence
  Peptide Derived from Human Papillomavirus
LVQAGLRRKPT

SEQ ID NO: 4160 - protein, 8 aa, Artificial Sequence
  Peptide Derived from Human Papillomavirus
LVWACAGV

SEQ ID NO: 4161 - protein, 10 aa, Artificial Sequence
  Peptide Derived from Human Papillomavirus
LVWACAGVEI

SEQ ID NO: 4162 - protein, 8 aa, Artificial Sequence
  Peptide Derived from Human Papillomavirus
LVYMVHII

SEQ ID NO: 4163 - protein, 9 aa, Artificial Sequence
  Peptide Derived from Human Papillomavirus
LVYMVHIII

SEQ ID NO: 4164 - protein, 10 aa, Artificial Sequence
  Peptide Derived from Human Papillomavirus
MALWRPSDNT

SEQ ID NO: 4165 - protein, 11 aa, Artificial Sequence
  Peptide Derived from Human Papillomavirus
MALWRPSDNTV

SEQ ID NO: 4166 - protein, 8 aa, Artificial Sequence
  Peptide Derived from Human Papillomavirus
MVDTGYGA

SEQ ID NO: 4167 - protein, 9 aa, Artificial Sequence
  Peptide Derived from Human Papillomavirus
MVDTGYGAM

SEQ ID NO: 4168 - protein, 11 aa, Artificial Sequence
  Peptide Derived from Human Papillomavirus
MVHIIICGHYI

SEQ ID NO: 4169 - protein, 8 aa, Artificial Sequence
  Peptide Derived from Human Papillomavirus
NLTICAST

SEQ ID NO: 4170 - protein, 8 aa, Artificial Sequence
  Peptide Derived from Human Papillomavirus
NQLFVTVV

SEQ ID NO: 4171 - protein, 10 aa, Artificial Sequence
  Peptide Derived from Human Papillomavirus
NQLFVTVVDT

SEQ ID NO: 4172 - protein, 11 aa, Artificial Sequence
  Peptide Derived from Human Papillomavirus
NQLFVTVVDTT

SEQ ID NO: 4173 - protein, 9 aa, Artificial Sequence
  Peptide Derived from Human Papillomavirus
NTDDYVTPT

SEQ ID NO: 4174 - protein, 11 aa, Artificial Sequence
  Peptide Derived from Human Papillomavirus
NTDDYVTPTSI

SEQ ID NO: 4175 - protein, 9 aa, Artificial Sequence
  Peptide Derived from Human Papillomavirus
NTVLEDGDM

SEQ ID NO: 4176 - protein, 10 aa, Artificial Sequence
  Peptide Derived from Human Papillomavirus
NTVLEDGDMV

SEQ ID NO: 4177 - protein, 10 aa, Artificial Sequence
  Peptide Derived from Human Papillomavirus
NTVYLPPPSV

SEQ ID NO: 4178 - protein, 11 aa, Artificial Sequence
  Peptide Derived from Human Papillomavirus
NTVYLPPPSVA

SEQ ID NO: 4179 - protein, 10 aa, Artificial Sequence
  Peptide Derived from Human Papillomavirus
NVDLKEKFSL

SEQ ID NO: 4180 - protein, 9 aa, Artificial Sequence
  Peptide Derived from Human Papillomavirus
NVFPIFLQM

SEQ ID NO: 4181 - protein, 10 aa, Artificial Sequence
  Peptide Derived from Human Papillomavirus
NVFPIFLQMA

SEQ ID NO: 4182 - protein, 11 aa, Artificial Sequence
  Peptide Derived from Human Papillomavirus
NVFPIFLQMAL

SEQ ID NO: 4183 - protein, 9 aa, Artificial Sequence
  Peptide Derived from Human Papillomavirus
NVNVFPIFL

SEQ ID NO: 4184 - protein, 11 aa, Artificial Sequence
  Peptide Derived from Human Papillomavirus
NVNVFPIFLQM

SEQ ID NO: 4185 - protein, 10 aa, Artificial Sequence
  Peptide Derived from Human Papillomavirus
NVSEDVRDNV

SEQ ID NO: 4186 - protein, 9 aa, Artificial Sequence
  Peptide Derived from Human Papillomavirus
NVSVDYKQT

SEQ ID NO: 4187 - protein, 11 aa, Artificial Sequence
  Peptide Derived from Human Papillomavirus
NVSVDYKQTQL

SEQ ID NO: 4188 - protein, 11 aa, Artificial Sequence
  Peptide Derived from Human Papillomavirus
PAENKDPYDKL

SEQ ID NO: 4189 - protein, 10 aa, Artificial Sequence
  Peptide Derived from Human Papillomavirus
PAGGGNKQDI

SEQ ID NO: 4190 - protein, 8 aa, Artificial Sequence
  Peptide Derived from Human Papillomavirus
PAIGEHWA

SEQ ID NO: 4191 - protein, 11 aa, Artificial Sequence
  Peptide Derived from Human Papillomavirus
PAIGEHWAKGT

SEQ ID NO: 4192 - protein, 9 aa, Artificial Sequence
  Peptide Derived from Human Papillomavirus
PAKRVRVRA

SEQ ID NO: 4193 - protein, 8 aa, Artificial Sequence
  Peptide Derived from Human Papillomavirus
PASPGSCV

SEQ ID NO: 4194 - protein, 8 aa, Artificial Sequence
  Peptide Derived from Human Papillomavirus
PIFLQMAL

SEQ ID NO: 4195 - protein, 8 aa, Artificial Sequence
  Peptide Derived from Human Papillomavirus
PLDICQSI

SEQ ID NO: 4196 - protein, 8 aa, Artificial Sequence
  Peptide Derived from Human Papillomavirus
PLELKNTV

SEQ ID NO: 4197 - protein, 9 aa, Artificial Sequence
  Peptide Derived from Human Papillomavirus
PLELKNTVL

SEQ ID NO: 4198 - protein, 8 aa, Artificial Sequence
  Peptide Derived from Human Papillomavirus
PLGRKFLV

SEQ ID NO: 4199 - protein, 10 aa, Artificial Sequence
  Peptide Derived from Human Papillomavirus
PLGRKFLVQA

SEQ ID NO: 4200 - protein, 9 aa, Artificial Sequence
  Peptide Derived from Human Papillomavirus
PLHSILVYM

SEQ ID NO: 4201 - protein, 10 aa, Artificial Sequence
  Peptide Derived from Human Papillomavirus
PLHSILVYMV

SEQ ID NO: 4202 - protein, 8 aa, Artificial Sequence
  Peptide Derived from Human Papillomavirus
PLPLHSIL

SEQ ID NO: 4203 - protein, 9 aa, Artificial Sequence
  Peptide Derived from Human Papillomavirus
PLPLHSILV

SEQ ID NO: 4204 - protein, 11 aa, Artificial Sequence
  Peptide Derived from Human Papillomavirus
PLPLHSILVYM

SEQ ID NO: 4205 - protein, 10 aa, Artificial Sequence
  Peptide Derived from Human Papillomavirus
PLSQGDCPPL

SEQ ID NO: 4206 - protein, 8 aa, Artificial Sequence
  Peptide Derived from Human Papillomavirus
PLYHPRPL

SEQ ID NO: 4207 - protein, 10 aa, Artificial Sequence
  Peptide Derived from Human Papillomavirus
PLYHPRPLPL

SEQ ID NO: 4208 - protein, 9 aa, Artificial Sequence
  Peptide Derived from Human Papillomavirus
PQSLYIKGT

SEQ ID NO: 4209 - protein, 11 aa, Artificial Sequence
  Peptide Derived from Human Papillomavirus
PQSLYIKGTGM

SEQ ID NO: 4210 - protein, 10 aa, Artificial Sequence
  Peptide Derived from Human Papillomavirus
PTIGPRKRSA

SEQ ID NO: 4211 - protein, 8 aa, Artificial Sequence
  Peptide Derived from Human Papillomavirus
PTSIFYHA

SEQ ID NO: 4212 - protein, 8 aa, Artificial Sequence
  Peptide Derived from Human Papillomavirus
PTTSLVDT

SEQ ID NO: 4213 - protein, 8 aa, Artificial Sequence
  Peptide Derived from Human Papillomavirus
PVPGQYDA

SEQ ID NO: 4214 - protein, 9 aa, Artificial Sequence
  Peptide Derived from Human Papillomavirus
PVPGQYDAT

SEQ ID NO: 4215 - protein, 9 aa, Artificial Sequence
  Peptide Derived from Human Papillomavirus
QAGLRRKPT

SEQ ID NO: 4216 - protein, 10 aa, Artificial Sequence
  Peptide Derived from Human Papillomavirus
QAGLRRKPTI

SEQ ID NO: 4217 - protein, 8 aa, Artificial Sequence
  Peptide Derived from Human Papillomavirus
QLCILGCA

SEQ ID NO: 4218 - protein, 10 aa, Artificial Sequence
  Peptide Derived from Human Papillomavirus
QLCILGCAPA

SEQ ID NO: 4219 - protein, 11 aa, Artificial Sequence
  Peptide Derived from Human Papillomavirus
QLCILGCAPAI

SEQ ID NO: 4220 - protein, 8 aa, Artificial Sequence
  Peptide Derived from Human Papillomavirus
QLCTITLT

SEQ ID NO: 4221 - protein, 9 aa, Artificial Sequence
  Peptide Derived from Human Papillomavirus
QLCTITLTA

SEQ ID NO: 4222 - protein, 11 aa, Artificial Sequence
  Peptide Derived from Human Papillomavirus
QLCTITLTADV

SEQ ID NO: 4223 - protein, 11 aa, Artificial Sequence
  Peptide Derived from Human Papillomavirus
QLFARHFWNRA

SEQ ID NO: 4224 - protein, 9 aa, Artificial Sequence
  Peptide Derived from Human Papillomavirus
QLFNKPYWL

SEQ ID NO: 4225 - protein, 9 aa, Artificial Sequence
  Peptide Derived from Human Papillomavirus
QLFVTVVDT

SEQ ID NO: 4226 - protein, 10 aa, Artificial Sequence
  Peptide Derived from Human Papillomavirus
QLFVTVVDTT

SEQ ID NO: 4227 - protein, 10 aa, Artificial Sequence
  Peptide Derived from Human Papillomavirus
QLPDPNKFGL

SEQ ID NO: 4228 - protein, 11 aa, Artificial Sequence
  Peptide Derived from Human Papillomavirus
QMALWRPSDNT

SEQ ID NO: 4229 - protein, 11 aa, Artificial Sequence
  Peptide Derived from Human Papillomavirus
QMSADPYGDSM

SEQ ID NO: 4230 - protein, 10 aa, Artificial Sequence
  Peptide Derived from Human Papillomavirus
QTQLCILGCA

SEQ ID NO: 4231 - protein, 8 aa, Artificial Sequence
  Peptide Derived from Human Papillomavirus
RAGTMGDT

SEQ ID NO: 4232 - protein, 9 aa, Artificial Sequence
  Peptide Derived from Human Papillomavirus
RAGTMGDTV

SEQ ID NO: 4233 - protein, 9 aa, Artificial Sequence
  Peptide Derived from Human Papillomavirus
RLVWACAGV

SEQ ID NO: 4234 - protein, 11 aa, Artificial Sequence
  Peptide Derived from Human Papillomavirus
RLVWACAGVEI

SEQ ID NO: 4235 - protein, 9 aa, Artificial Sequence
  Peptide Derived from Human Papillomavirus
RVLILHYHL

SEQ ID NO: 4236 - protein, 10 aa, Artificial Sequence
  Peptide Derived from Human Papillomavirus
RVLILHYHLL

SEQ ID NO: 4237 - protein, 9 aa, Artificial Sequence
  Peptide Derived from Human Papillomavirus
RVVNTDDYV

SEQ ID NO: 4238 - protein, 10 aa, Artificial Sequence
  Peptide Derived from Human Papillomavirus
RVVNTDDYVT

SEQ ID NO: 4239 - protein, 9 aa, Artificial Sequence
  Peptide Derived from Human Papillomavirus
SADPYGDSM

SEQ ID NO: 4240 - protein, 9 aa, Artificial Sequence
  Peptide Derived from Human Papillomavirus
SATTSSKPA

SEQ ID NO: 4241 - protein, 10 aa, Artificial Sequence
  Peptide Derived from Human Papillomavirus
SAYQYRVFRV

SEQ ID NO: 4242 - protein, 9 aa, Artificial Sequence
  Peptide Derived from Human Papillomavirus
SICKYPDYL

SEQ ID NO: 4243 - protein, 11 aa, Artificial Sequence
  Peptide Derived from Human Papillomavirus
SICKYPDYLQM

SEQ ID NO: 4244 - protein, 11 aa, Artificial Sequence
  Peptide Derived from Human Papillomavirus
SIFYHAGSSRL

SEQ ID NO: 4245 - protein, 10 aa, Artificial Sequence
  Peptide Derived from Human Papillomavirus
SILEDWNFGV

SEQ ID NO: 4246 - protein, 9 aa, Artificial Sequence
  Peptide Derived from Human Papillomavirus
SILVYMVHI

SEQ ID NO: 4247 - protein, 10 aa, Artificial Sequence
  Peptide Derived from Human Papillomavirus
SILVYMVHII

SEQ ID NO: 4248 - protein, 11 aa, Artificial Sequence
  Peptide Derived from Human Papillomavirus
SILVYMVHIII

SEQ ID NO: 4249 - protein, 9 aa, Artificial Sequence
  Peptide Derived from Human Papillomavirus
SIVTSDSQL

SEQ ID NO: 4250 - protein, 10 aa, Artificial Sequence
  Peptide Derived from Human Papillomavirus
SIYNPETQRL

SEQ ID NO: 4251 - protein, 11 aa, Artificial Sequence
  Peptide Derived from Human Papillomavirus
SIYNPETQRLV

SEQ ID NO: 4252 - protein, 9 aa, Artificial Sequence
  Peptide Derived from Human Papillomavirus
SLDLDQYPL

SEQ ID NO: 4253 - protein, 9 aa, Artificial Sequence
  Peptide Derived from Human Papillomavirus
SLVDTYRFV

SEQ ID NO: 4254 - protein, 9 aa, Artificial Sequence
  Peptide Derived from Human Papillomavirus
SLYIKGTGM

SEQ ID NO: 4255 - protein, 11 aa, Artificial Sequence
  Peptide Derived from Human Papillomavirus
SLYIKGTGMPA

SEQ ID NO: 4256 - protein, 11 aa, Artificial Sequence
  Peptide Derived from Human Papillomavirus
SMFFCLRREQL

SEQ ID NO: 4257 - protein, 8 aa, Artificial Sequence
  Peptide Derived from Human Papillomavirus
SQGDCPPL

SEQ ID NO: 4258 - protein, 10 aa, Artificial Sequence
  Peptide Derived from Human Papillomavirus
SQGDCPPLEL

SEQ ID NO: 4259 - protein, 10 aa, Artificial Sequence
  Peptide Derived from Human Papillomavirus
SQLFNKPYWL

SEQ ID NO: 4260 - protein, 10 aa, Artificial Sequence
  Peptide Derived from Human Papillomavirus
STLQDTKCEV

SEQ ID NO: 4261 - protein, 8 aa, Artificial Sequence
  Peptide Derived from Human Papillomavirus
STNLTICA

SEQ ID NO: 4262 - protein, 10 aa, Artificial Sequence
  Peptide Derived from Human Papillomavirus
STNLTICAST

SEQ ID NO: 4263 - protein, 10 aa, Artificial Sequence
  Peptide Derived from Human Papillomavirus
SVAITCQKDA

SEQ ID NO: 4264 - protein, 11 aa, Artificial Sequence
  Peptide Derived from Human Papillomavirus
SVAITCQKDAA

SEQ ID NO: 4265 - protein, 8 aa, Artificial Sequence
  Peptide Derived from Human Papillomavirus
SVARVVNT

SEQ ID NO: 4266 - protein, 9 aa, Artificial Sequence
  Peptide Derived from Human Papillomavirus
SVDYKQTQL

SEQ ID NO: 4267 - protein, 11 aa, Artificial Sequence
  Peptide Derived from Human Papillomavirus
SVDYKQTQLCI

SEQ ID NO: 4268 - protein, 8 aa, Artificial Sequence
  Peptide Derived from Human Papillomavirus
TACKSRPL

SEQ ID NO: 4269 - protein, 8 aa, Artificial Sequence
  Peptide Derived from Human Papillomavirus
TADVMSYI

SEQ ID NO: 4270 - protein, 11 aa, Artificial Sequence
  Peptide Derived from Human Papillomavirus
TADVMSYIHSM

SEQ ID NO: 4271 - protein, 10 aa, Artificial Sequence
  Peptide Derived from Human Papillomavirus
TICASTQSPV

SEQ ID NO: 4272 - protein, 9 aa, Artificial Sequence
  Peptide Derived from Human Papillomavirus
TIGPRKRSA

SEQ ID NO: 4273 - protein, 8 aa, Artificial Sequence
  Peptide Derived from Human Papillomavirus
TITLTADV

SEQ ID NO: 4274 - protein, 9 aa, Artificial Sequence
  Peptide Derived from Human Papillomavirus
TITLTADVM

SEQ ID NO: 4275 - protein, 9 aa, Artificial Sequence
  Peptide Derived from Human Papillomavirus
TLQDTKCEV

SEQ ID NO: 4276 - protein, 11 aa, Artificial Sequence
  Peptide Derived from Human Papillomavirus
TLQDTKCEVPL

SEQ ID NO: 4277 - protein, 10 aa, Artificial Sequence
  Peptide Derived from Human Papillomavirus
TLTADVMSYI

SEQ ID NO: 4278 - protein, 10 aa, Artificial Sequence
  Peptide Derived from Human Papillomavirus
TMGDTVPQSL

SEQ ID NO: 4279 - protein, 9 aa, Artificial Sequence
  Peptide Derived from Human Papillomavirus
TQLCILGCA

SEQ ID NO: 4280 - protein, 11 aa, Artificial Sequence
  Peptide Derived from Human Papillomavirus
TQLCILGCAPA

SEQ ID NO: 4281 - protein, 9 aa, Artificial Sequence
  Peptide Derived from Human Papillomavirus
TQRLVWACA

SEQ ID NO: 4282 - protein, 11 aa, Artificial Sequence
  Peptide Derived from Human Papillomavirus
TQRLVWACAGV

SEQ ID NO: 4283 - protein, 11 aa, Artificial Sequence
  Peptide Derived from Human Papillomavirus
TQSPVPGQYDA

SEQ ID NO: 4284 - protein, 8 aa, Artificial Sequence
  Peptide Derived from Human Papillomavirus
TTPSTNLT

SEQ ID NO: 4285 - protein, 9 aa, Artificial Sequence
  Peptide Derived from Human Papillomavirus
TTPSTNLTI

SEQ ID NO: 4286 - protein, 11 aa, Artificial Sequence
  Peptide Derived from Human Papillomavirus
TTPSTNLTICA

SEQ ID NO: 4287 - protein, 11 aa, Artificial Sequence
  Peptide Derived from Human Papillomavirus
TTSLVDTYRFV

SEQ ID NO: 4288 - protein, 10 aa, Artificial Sequence
  Peptide Derived from Human Papillomavirus
TTSSKPAKRV

SEQ ID NO: 4289 - protein, 9 aa, Artificial Sequence
  Peptide Derived from Human Papillomavirus
TVGNPYFRV

SEQ ID NO: 4290 - protein, 11 aa, Artificial Sequence
  Peptide Derived from Human Papillomavirus
TVGNPYFRVPA

SEQ ID NO: 4291 - protein, 8 aa, Artificial Sequence
  Peptide Derived from Human Papillomavirus
TVLEDGDM

SEQ ID NO: 4292 - protein, 9 aa, Artificial Sequence
  Peptide Derived from Human Papillomavirus
TVLEDGDMV

SEQ ID NO: 4293 - protein, 11 aa, Artificial Sequence
  Peptide Derived from Human Papillomavirus
TVLEDGDMVDT

SEQ ID NO: 4294 - protein, 8 aa, Artificial Sequence
  Peptide Derived from Human Papillomavirus
TVPQSLYI

SEQ ID NO: 4295 - protein, 11 aa, Artificial Sequence
  Peptide Derived from Human Papillomavirus
TVPQSLYIKGT

SEQ ID NO: 4296 - protein, 9 aa, Artificial Sequence
  Peptide Derived from Human Papillomavirus
TVVDTTPST

SEQ ID NO: 4297 - protein, 11 aa, Artificial Sequence
  Peptide Derived from Human Papillomavirus
TVVDTTPSTNL

SEQ ID NO: 4298 - protein, 9 aa, Artificial Sequence
  Peptide Derived from Human Papillomavirus
TVYLPPPSV

SEQ ID NO: 4299 - protein, 10 aa, Artificial Sequence
  Peptide Derived from Human Papillomavirus
TVYLPPPSVA

SEQ ID NO: 4300 - protein, 9 aa, Artificial Sequence
  Peptide Derived from Human Papillomavirus
VAITCQKDA

SEQ ID NO: 4301 - protein, 10 aa, Artificial Sequence
  Peptide Derived from Human Papillomavirus
VAITCQKDAA

SEQ ID NO: 4302 - protein, 11 aa, Artificial Sequence
  Peptide Derived from Human Papillomavirus
VARVVNTDDYV

SEQ ID NO: 4303 - protein, 8 aa, Artificial Sequence
  Peptide Derived from Human Papillomavirus
VLEDGDMV

SEQ ID NO: 4304 - protein, 10 aa, Artificial Sequence
  Peptide Derived from Human Papillomavirus
VLEDGDMVDT

SEQ ID NO: 4305 - protein, 8 aa, Artificial Sequence
  Peptide Derived from Human Papillomavirus
VLILHYHL

SEQ ID NO: 4306 - protein, 9 aa, Artificial Sequence
  Peptide Derived from Human Papillomavirus
VLILHYHLL

SEQ ID NO: 4307 - protein, 11 aa, Artificial Sequence
  Peptide Derived from Human Papillomavirus
VLILHYHLLPL

SEQ ID NO: 4308 - protein, 8 aa, Artificial Sequence
  Peptide Derived from Human Papillomavirus
VMSYIHSM

SEQ ID NO: 4309 - protein, 10 aa, Artificial Sequence
  Peptide Derived from Human Papillomavirus
VQAGLRRKPT

SEQ ID NO: 4310 - protein, 11 aa, Artificial Sequence
  Peptide Derived from Human Papillomavirus
VQAGLRRKPTI

SEQ ID NO: 4311 - protein, 11 aa, Artificial Sequence
  Peptide Derived from Human Papillomavirus
VQLPDPNKFGL

SEQ ID NO: 4312 - protein, 10 aa, Artificial Sequence
  Peptide Derived from Human Papillomavirus
VTPTSIFYHA

(The sequence listing continues in the following parts.)

What is claimed is:

1. A composition comprising an isolated oligopeptide 13 residues or less in length, which comprises the sequence ATLERTEVY (SEQ ID NO:31040).

2. The composition of claim 1, wherein the oligopeptide is joined to an amino acid linker.

3. The composition of claim 1, further comprising a CTL epitope wherein the CTL epitope is admixed or joined to the oligopeptide.

4. The composition of claim 1, further comprising an HTL epitope, wherein the HTL epitope is admixed or joined to the oligopeptide.

5. The composition of claim 4, wherein the HTL epitope is a PD-DR binding molecule.

6. The composition of claim 1, further comprising a liposome, wherein the oligopeptide is on or within the liposome.

7. The composition of claim 1, wherein the oligopeptide is joined to a lipid.

8. The composition of claim 1, wherein the oligopeptide is a heteropolymer.

9. The composition of claim 1, wherein the oligopeptide is a homopolymer.

10. The composition of claim 1, wherein the oligopeptide is bound to an HLA heavy chain, $\beta$2-microglobulin, and strepavidin complex, whereby a tetramer is formed.

* * * * *

UNITED STATES PATENT AND TRADEMARK OFFICE
CERTIFICATE OF CORRECTION

| | | |
|---|---|---|
| PATENT NO. | : 7,026,443 B1 | Page 1 of 1 |
| APPLICATION NO. | : 09/641528 | |
| DATED | : April 11, 2006 | |
| INVENTOR(S) | : Sette et al. | |

It is certified that error appears in the above-identified patent and that said Letters Patent is hereby corrected as shown below:

Claim 5
In column 1375, line 27, the term "PD-DR" should be replaced with --Pan-DR--.

Signed and Sealed this

Twelfth Day of June, 2007

JON W. DUDAS
*Director of the United States Patent and Trademark Office*